United States Patent 7,687,616 (SMALL MOLECULES MODULATING ACTIVITY OF MICRO RNA OLIGONUCLEOTIDES AND MICRO RNA TARGETS AND USES THEREOF) - sequence listing, part 160

SEQ ID NO: 6776232 - DNA, 58 bp, Homo sapiens
tctggctggggaagtcatttgatgcccttgagggtaagcaatgtgggccccagtgagg

SEQ ID NO: 6776233 - DNA, 64 bp, Homo sapiens
gggctagacatgtgaagcttggggagcagggaggtagctctgcactcctgtttcacctgggtcc

SEQ ID NO: 6776234 - DNA, 65 bp, Homo sapiens
tggtccatgcccacggaatgtgtggtttccaagacaaccatgaccctctacattgggctgagtca

SEQ ID NO: 6776235 - DNA, 72 bp, Homo sapiens
gtggcttgctggaagggtagtattaactatttaacatgtaatggtgtacttcactcttacctagcacgctgt

SEQ ID NO: 6776236 - DNA, 76 bp, Homo sapiens
ctgtacaacttgtgttcaactcggagctactagtctggaaagatcagcagaacctgaattgaacattgtttctcag

SEQ ID NO: 6776237 - DNA, 65 bp, Homo sapiens
cattccagtatgtgtcttttggcaaacagatgtttgcatttcttttgagtatatgcctaggaatg

SEQ ID NO: 6776238 - DNA, 85 bp, Homo sapiens
caggtacttaagtccacaggctgacagcgggtacaaagatagagaggcctgttaaaaagaccaatggattaaaaagaatacactg

SEQ ID NO: 6776239 - DNA, 62 bp, Homo sapiens
ttctccagaccctcctgcagaccctgataggtcaggacctcctgcactgggggctctgggag

SEQ ID NO: 6776240 - DNA, 102 bp, Homo sapiens
cccaccaagccctgtgttcataggaggagatgggagtaaccaggacagcccctggccacctctgactcctggacttggggctcttgaatactgcctggtggg

SEQ ID NO: 6776241 - DNA, 77 bp, Homo sapiens
ggtggaatgagtttcccaatgtcttaaagagttgctaaacatcagatgtaggatatggtagaaatcattcccaaacc

SEQ ID NO: 6776242 - DNA, 100 bp, Homo sapiens
tgatatttagcaactgcctggggtcaggcactggccagtcagcacacaggctgctgtgagcagtggcatggccgtgctgctatgggctggctgcatgtca

SEQ ID NO: 6776243 - DNA, 67 bp, Homo sapiens
cctggattaattgggtcatgtgtcccttgactgtagccagggaatgacatgtcctagttggtctagg

SEQ ID NO: 6776244 - DNA, 61 bp, Homo sapiens
gattctctccatgttttctgtccagccatatgtgcttgtgacaatacagcatggagacgtc

SEQ ID NO: 6776245 - DNA, 119 bp, Homo sapiens
tttcttcagctacaacttgagtcctagagttacatgaggatttttattgtcttcaaaaggtgaccttgagacatcacaaaatcctcaatgaaactctctagattaatgctttggagaaa

SEQ ID NO: 6776246 - DNA, 72 bp, Homo sapiens
agtggcagatgtaggtctgtatgtgacattcttgttcagtttcataaatgtggctgccacctgcctgaaatt

SEQ ID NO: 6776247 - DNA, 130 bp, Homo sapiens
gattaggaggatgtagagaaactagaagttttgaattctaatagtgtatccagtcattcaaggagacatatcctgaaggaaactggaaatacagaatcagagactggttaaaaataaaggctaaaaatgt

SEQ ID NO: 6776248 - DNA, 79 bp, Homo sapiens
cagggcaagtgcttctgatggtggaatgcttcagcccaggaggccaagcagaaccattcaggcacatttctagtctctg

SEQ ID NO: 6776249 - DNA, 95 bp, Homo sapiens
gtataatacggtcagattctaagtgggcacatttatcattatgaaaaaagcatttctagaatgtgttatttcagaatccagtactgtaaacatgc

SEQ ID NO: 6776250 - DNA, 58 bp, Homo sapiens
aggctgccaggcatatggcctctttgtgcccacacaatggaggccctgtctgtgccct

SEQ ID NO: 6776251 - DNA, 68 bp, Homo sapiens
tgacaagaatttgggactgttagcaaatattctagatgacagaatcaggttctcccaagttcttgaca

SEQ ID NO: 6776252 - DNA, 72 bp, Homo sapiens
tccagtccatggcctcagtcttagggggtagctttcttctccgcagagactcttggggactctggaacagga

SEQ ID NO: 6776253 - DNA, 79 bp, Homo sapiens
ggctggcacaaaggcataggatgtggaatcggcaggctctgctactcgtccacaggctgtgtgaccttggatggtggtc

SEQ ID NO: 6776254 - DNA, 62 bp, Homo sapiens
ccctgcagtgtgacctcacctaaaagtccagccggggatggagagggtgcagctgacagagg

SEQ ID NO: 6776255 - DNA, 71 bp, Homo sapiens
gtccaaaatagaattccaagtccagccaggccaaagatccctggtgcctggctggacttggtgtctgggac

SEQ ID NO: 6776256 - DNA, 84 bp, Homo sapiens
ttcctctgtcagtggctttggctttgggctcacctggatgtggatagccatgtggttggtcaaggccacagtgagcagagtgaa

SEQ ID NO: 6776257 - DNA, 55 bp, Homo sapiens
atctgaaaagcctcttactccttttgttaagagggtatatagtgtttttgcagat

SEQ ID NO: 6776258 - DNA, 85 bp, Homo sapiens
gctggactgtaaatgaggctcatttgaggctggggatacgtgaatgtgcttgttgtgctgggcccagggagcctctgggcacagc

SEQ ID NO: 6776259 - DNA, 84 bp, Homo sapiens
tttgcaagtggggagctctgttgtggtgctaacttcagttgtactaacatgttggcttgtcacaatgaaccctactatgtcaga

SEQ ID NO: 6776260 - DNA, 60 bp, Homo sapiens
attagctgcctgcttatgagctccatgactaaaattccttggtgtcaacaggcagctaat

SEQ ID NO: 6776261 - DNA, 65 bp, Homo sapiens
ttttatggggacctctatgtatctctagactacactttgagaagcgttggcctcccctgatgaga

SEQ ID NO: 6776262 - DNA, 60 bp, Homo sapiens
gagcaagattaaaaggctgggttgtgatcacactcactctcattttttcagtcattgttc

SEQ ID NO: 6776263 - DNA, 69 bp, Homo sapiens
gtggttatacctgggtagtgcatggaacgcttaaaaataagtttctaccggtacattcagggcaactac

SEQ ID NO: 6776264 - DNA, 96 bp, Homo sapiens
tctgcatggctaaccagctcctaggtgatgccagtgaggctggtccatgaccaccaggaccagcttcatgggcatgcaccagtgcagttgtgcaga

SEQ ID NO: 6776265 - DNA, 60 bp, Homo sapiens
ggcaaaggcttctttgcaggctttaggcttctgtttaaagttgcaaagacagccattccc

SEQ ID NO: 6776266 - DNA, 57 bp, Homo sapiens
ctcctgggctatgtctgcttggactcaccattgcatccccagcagctggcacaggag

SEQ ID NO: 6776267 - DNA, 66 bp, Homo sapiens
tgggacgtggtgggtaaatgccccagctccctcactcctcaggtggggcaatcctaacgtgttcca

SEQ ID NO: 6776268 - DNA, 85 bp, Homo sapiens
atttgagggtggctcagctgcactgttctgacccagggtttctcatgagactgagtcaacatgttggccgggactaccctcagat

SEQ ID NO: 6776269 - DNA, 55 bp, Homo sapiens
gaggcagtggaacagctctgggctaaactggttgggtcagctctatccacgcctt

SEQ ID NO: 6776270 - DNA, 75 bp, Homo sapiens
gacattctcctactgtgttttcctgctgaggcatcgttttaacagatgctcagacttaagaagatcagagttgtc

SEQ ID NO: 6776271 - DNA, 81 bp, Homo sapiens
gggagattttctgtgtgctgtcttggctttctttgtttcctaggctataggtaagagttaagacgtacatgagtgtcttct

SEQ ID NO: 6776272 - DNA, 56 bp, Homo sapiens
ggcatggcttggtggggcccgcaagtattacgagggtttgcatgaacaagtcagcc

SEQ ID NO: 6776273 - DNA, 94 bp, Homo sapiens
gggactgcgggtgtccccgagtctggcctgccagctctggtggccagggcacctctgcgcgcgggccagggccccggggctctcccgcagtccc

SEQ ID NO: 6776274 - DNA, 107 bp, Homo sapiens
agcttgtacagctgctttgattcagtaaagctaaatttctaagatttccttgacctttgcttaaactgagtttgagacagactatttttcttatcgcctgatgagct

SEQ ID NO: 6776275 - DNA, 55 bp, Homo sapiens
tgcccactgtctccctggctgaggtcccagccccttccccaaggcctcaggggca

SEQ ID NO: 6776276 - DNA, 61 bp, Homo sapiens
ctcctagagcacaaaaggccattgtgaatcatcccagtgctgcacttatggctctgaggag

SEQ ID NO: 6776277 - DNA, 84 bp, Homo sapiens
cctttcttcttgtcgtcatgattcagagtagggatgtaatgtttaaagaagatggttttggctctggcatgtggaaaagaaagg

SEQ ID NO: 6776278 - DNA, 70 bp, Homo sapiens
gacgccctctcggtagaggagctcgattccgcgcaggttctccctcagctcctctgcctggctgggcttc

SEQ ID NO: 6776279 - DNA, 64 bp, Homo sapiens
ggcgtccctggtggtacggcactggcaggtgtaggagccctccaggttgatgcaccaggcagcc

SEQ ID NO: 6776280 - DNA, 70 bp, Homo sapiens
tcgtgtctgggaagtcacagctgttaatgatgaggagggggacggtatgtggaacgccataggagcacga

SEQ ID NO: 6776281 - DNA, 55 bp, Homo sapiens
tgtcacacctcgtttagcattctttgtgtatgttggatgcaggggaggggtgata

SEQ ID NO: 6776282 - DNA, 78 bp, Homo sapiens
gtaggaagtgcacttatagtaatatgtgtaaaagctttgtatactgcatgtattattatttatgcatattatttttac

SEQ ID NO: 6776283 - DNA, 69 bp, Homo sapiens
gaaaacagatctgccatgaacagcagctgaggtgaaaatcatcagtgtctctctggtacttctgtcttc

SEQ ID NO: 6776284 - DNA, 72 bp, Homo sapiens
ggtacatttcccagaggtatgaataagttggataactttcctcacattgtgacagttttggagaaatgaacc

SEQ ID NO: 6776285 - DNA, 61 bp, Homo sapiens
aattctactctgtcttgagtgacagtgtggctacattctagtgtcaagagggagtgtaatt

SEQ ID NO: 6776286 - DNA, 84 bp, Homo sapiens
tgcagatggagacaagagggctatcaaggaggcaactgccaagtgagccaaacttctccttggtctttgattcttcatcaagca

SEQ ID NO: 6776287 - DNA, 55 bp, Homo sapiens
tttaccaggtctgtgcaggtgtcaatcagcttttgcatgggtgcagcctgataga

SEQ ID NO: 6776288 - DNA, 65 bp, Homo sapiens
gtcgctcaggctggagtgcagtggcgcgatctcggctcactgcaagctcagcctcccgggttcac

SEQ ID NO: 6776289 - DNA, 119 bp, Homo sapiens
tggggaagtagagtgggaaggaagtattcctcctgtgcctggcctgctcctgtggccgcagcatccctgggcgggacactcttatctgcttcacttgaccaccccttctgcttttccca

SEQ ID NO: 6776290 - DNA, 108 bp, Homo sapiens
ggggcttttgcagagaaggaaggaagggccacttactcctgctgtccagggaattcccggcagggagagccaggggtggtggctgatctggccttaatgacatccctc

SEQ ID NO: 6776291 - DNA, 61 bp, Homo sapiens
agccacatattcctggggacatagatctgagttagatctttaccaccaaagaatgctggct

SEQ ID NO: 6776292 - DNA, 56 bp, Homo sapiens
cctttttctgagttgtagcttcacgagtatcatgggccactgactgaagaaagagg

SEQ ID NO: 6776293 - DNA, 57 bp, Homo sapiens
acatgctttctaggtccttctgagttttaggatcctgagggatttggttggtattgt

SEQ ID NO: 6776294 - DNA, 66 bp, Homo sapiens
gagaaaggtcttggctctggccgcacagcagcctgtgcccagttgaggccaggactcagacttctc

SEQ ID NO: 6776295 - DNA, 67 bp, Homo sapiens
gccaggagatttagctgcttaactcctgttgtttttaatgggagtcatgtggctaaatctctgtggt

SEQ ID NO: 6776296 - DNA, 68 bp, Homo sapiens
aggcccctgctgtgaccggggagcaggcccgggtggggtgtctctccctgttttacggttgagggcct

SEQ ID NO: 6776297 - DNA, 59 bp, Homo sapiens
tctgcctgagggagctgaggaaggcatcctgaaggatgatcaggcatttgtcaggcaga

SEQ ID NO: 6776298 - DNA, 65 bp, Homo sapiens
ggtggtgtgttttcttcattctgcagggatcctgctagatggagcagaatagctatgctgccacc

SEQ ID NO: 6776299 - DNA, 60 bp, Homo sapiens
cattacatttcaaaatgtttcctgtgattgcttctaaaggaagctctgtgtaatgtagtg

SEQ ID NO: 6776300 - DNA, 87 bp, Homo sapiens
catgtcattcttttcttcatgagcagaagggaggggttttgtgaattaaaaactcaaatgctaatgccatggaaaaattatgacttg

SEQ ID NO: 6776301 - DNA, 64 bp, Homo sapiens
taatgatggtttcatcacttgaactgtcttgcattgatgggtatgttcaagtaaactattatta

SEQ ID NO: 6776302 - DNA, 60 bp, Homo sapiens
ggccctgaagtgtataagctaaaatgcctatgctaattagcaccacacactttagaggct

SEQ ID NO: 6776303 - DNA, 69 bp, Homo sapiens
gactttctgtctccctatcaatgtactatctcctttgtcaaagtagacagatagggaaggcagagtttc

SEQ ID NO: 6776304 - DNA, 59 bp, Homo sapiens
gacatgtttacattaggtgatatcgctggataacaccagtgatacccagtgagcgtgtc

SEQ ID NO: 6776305 - DNA, 90 bp, Homo sapiens
gatagccctgggtagtgctagttaatgctaattaacaaatgctagttagtattgttaaactgaagcattactaaataccaagatattatc

SEQ ID NO: 6776306 - DNA, 120 bp, Homo sapiens
gcaatcagcatctatgaatctcacttaacagaacatattggtgattagccaatgctaaaacaagtgactgtcagcatggggcaatgcatgtgcttctgcagtgaaaatagatcttattgc

SEQ ID NO: 6776307 - DNA, 65 bp, Homo sapiens
aagagtggtgtttggctggcaaattctgattcatctttcaggaccctgctcaagcatctcctctt

SEQ ID NO: 6776308 - DNA, 63 bp, Homo sapiens
gaagctagtcaagaggcatgggacaggctcctcacagccctcagaaggtgccactgacgcttt

SEQ ID NO: 6776309 - DNA, 57 bp, Homo sapiens
taacactgtgtctgccatatcctaatctttccaatagatggcagataatttgtgtta

SEQ ID NO: 6776310 - DNA, 57 bp, Homo sapiens
tggcttgaggatataacttgacttacaaagaaattctgagaagtatgtcttcagcca

SEQ ID NO: 6776311 - DNA, 61 bp, Homo sapiens
tttagcttaataaccttaataactcaggcaagtactgagtcttggttttcttaggtctgaa

SEQ ID NO: 6776312 - DNA, 85 bp, Homo sapiens
gaaggtgcccaggacagctaaacaagtgtgtagccattttggacaatacagaatgccttttgttagggctgccagatccattttc

SEQ ID NO: 6776313 - DNA, 76 bp, Homo sapiens
aaactttatctactctgtgcttcttattggtgtttggtttcaagctttgggggtaggtatagagtagcccttgttt

SEQ ID NO: 6776314 - DNA, 76 bp, Homo sapiens
agcctagttctcgcttctctagagctggggatcaggaagtgtttctcagtccaaatgagaggttgagggcctggct

SEQ ID NO: 6776315 - DNA, 119 bp, Homo sapiens
gctggatgtgatggtggacgcctgtaatcccaactacttgggaggctgagacaggagaattgcttgaacccaggaggtggcggttgcagtgagccgagattgcaccattgcactccagc

SEQ ID NO: 6776316 - DNA, 61 bp, Homo sapiens
cccactgagtgagcagagcagggcccatttctgataagcggtctctctgtctcctcttggg

SEQ ID NO: 6776317 - DNA, 63 bp, Homo sapiens
tttgcaccagggaagagatgccccagcacctgcttcaggccacagctctttctttggcacaaa

SEQ ID NO: 6776318 - DNA, 79 bp, Homo sapiens
gctgggtcaaagagagtttaagtgacttgccgaaggacaaacagctagttaaatggcagcacttgaacttgagcccagc

SEQ ID NO: 6776319 - DNA, 82 bp, Homo sapiens
ggggtatgtgtggcaggaacagaattggggttcttggggaggtttttttccacttaaaactctttttgtcgcctacgtctcc

SEQ ID NO: 6776320 - DNA, 86 bp, Homo sapiens
atcatctgggagcttttcggaaatgcagaaacttcaccctagacctagtgaattagaatctgcatttgaataaatctccaggtgat

SEQ ID NO: 6776321 - DNA, 87 bp, Homo sapiens
gctttggaatagtttgaatttacagccttgaaaacagcagatgtacaaataggtgtaattgtcttttaatgctgctattcccaaagc

SEQ ID NO: 6776322 - DNA, 59 bp, Homo sapiens
tagggatgtaaacatagtaattactcaattgtagtagctcaagaattattacatccttg

SEQ ID NO: 6776323 - DNA, 58 bp, Homo sapiens
ctggcctcacagaggctaagccatgaaacatttatgtggagtggtttttggagggcag

SEQ ID NO: 6776324 - DNA, 73 bp, Homo sapiens
ctatcaagcctgcgctgagaagttctttagagtggtacttcctaaatacatttacagtcgtggcttggcatag

SEQ ID NO: 6776325 - DNA, 90 bp, Homo sapiens
gctcaggatctttttcattctaatcatctcataggaaacagaaatgtcatttagaggtaggtagagtccaaaacaaagaagaacctgagt

SEQ ID NO: 6776326 - DNA, 60 bp, Homo sapiens
tgaggggctgggtgggttccacctgaggaggcgccacgactctgcccaccccggctccca

SEQ ID NO: 6776327 - DNA, 92 bp, Homo sapiens
catacttatcactaacaccctaataatcacagactagtgcacagatcaagatgttaacagttaattgttgttgggtgttgggaatatgtgtg

SEQ ID NO: 6776328 - DNA, 63 bp, Homo sapiens
agaagagtctcttccacctgctcattccagaggacccgctcaggtggcaaggggcgcctctct

SEQ ID NO: 6776329 - DNA, 86 bp, Homo sapiens
attgcctccttaaacctgggctcagctcccaagggaagatgtaccaagcctgttttcccttccggaaggcctttgaggtaggcggt

SEQ ID NO: 6776330 - DNA, 69 bp, Homo sapiens
ttagaattctgtaattctgttagtttcaagtatggtgagcttgagtatacgcagaataacagtgactga

SEQ ID NO: 6776331 - DNA, 71 bp, Homo sapiens
agcaatggaactcatgttctggtggaaaacagatgcaaatcagataatttcaacagaatatgatcagagtt

SEQ ID NO: 6776332 - DNA, 81 bp, Homo sapiens
gagtagtgccactctgggtcctgccattcactgggagggagacctcaggagggaccaggtcagggctctgactggacactc

SEQ ID NO: 6776333 - DNA, 58 bp, Homo sapiens
gcagggcaaatggcattttttcctgtgggctgaccccaaggaaggctgttggccttgc

SEQ ID NO: 6776334 - DNA, 66 bp, Homo sapiens
ggggagctaggtcaggggtcaccaccaggtttttcctttctgtgtggcctctgcactgggctcccc

SEQ ID NO: 6776335 - DNA, 90 bp, Homo sapiens
ccagaggcatttgaaatatgtgtcttttgaatcaaagaaacatagaggatttgaagatggaggagaccgcattttattttatggccctgg

SEQ ID NO: 6776336 - DNA, 72 bp, Homo sapiens
gtagataggatttgcatttttacaagtagccagttggtgctgctggaactgctttgaaaatcactggtctac

SEQ ID NO: 6776337 - DNA, 56 bp, Homo sapiens
gggacagctgtagtgcttggcttgagttcccctccgcatggagcacagagctgccc

SEQ ID NO: 6776338 - DNA, 95 bp, Homo sapiens
ttttctaagctctctacagtgaccatatatcatttttgtactcaaagaaaacgtatacagtttgatttttatggttcaagtgagaatttggaaaa

SEQ ID NO: 6776339 - DNA, 85 bp, Homo sapiens
gaacctactatgtatcaggcctagaacacagcagatatgaggatgctgttgtgggtttagctttgagagaattggacttgggttc

SEQ ID NO: 6776340 - DNA, 68 bp, Homo sapiens
gcatgctgataggagttaatggtgatgcagaatatttgtttacatttagtacaacttttacagtgtgt

SEQ ID NO: 6776341 - DNA, 56 bp, Homo sapiens
tgatatgaagatgtgttggagattcttcccggcttctcagtgacactcttcataca

SEQ ID NO: 6776342 - DNA, 62 bp, Homo sapiens
gctgtttcagttcctcttctatgtgctctgtgggatctgaacaggggagaactagagacagc

SEQ ID NO: 6776343 - DNA, 60 bp, Homo sapiens
tcattgctactcttgctcacaaactgctatgcacacaggactgggcaggttcagtaatgg

SEQ ID NO: 6776344 - DNA, 58 bp, Homo sapiens
tcacctggcccagctccagtgcttcctcccccgggaagccctccctgagcgccggtga

SEQ ID NO: 6776345 - DNA, 76 bp, Homo sapiens
ttagtatttgcccattcgtttagtccacaaatgcatctgtgctaggtgctggggatagaattgtgagtaaagctaa

SEQ ID NO: 6776346 - DNA, 83 bp, Homo sapiens
gggcatgccgatgggcctggggctgtgaaccagggcaactcgctttggctctcacttgcactcaggggacccatttagtgccc

SEQ ID NO: 6776347 - DNA, 87 bp, Homo sapiens
gtcaatattaatggggaggattctgggtcctgtgtcttgctaggatttccagggacggcaattccagaagttttccgattagttggc

SEQ ID NO: 6776348 - DNA, 73 bp, Homo sapiens
gaagtgttggacaggtgggtacctttatggaggctctgagggagaatctgtgccatgcccgtctaccagcttc

SEQ ID NO: 6776349 - DNA, 86 bp, Homo sapiens
cattagagacagtacatcacagtagttaagccagacagcctatggccaaattctagttctaccacttactgatctcgtctttggtg

SEQ ID NO: 6776350 - DNA, 97 bp, Homo sapiens
ccatcctgaggggacggaaatggtttcacctgaaggaggccagctttttaactggcctttttccctggagggacagccagccagtccaggagggtgg

SEQ ID NO: 6776351 - DNA, 68 bp, Homo sapiens
atgcaccgcagataaaaggcatgcattgtttgttgacagtagttatctaacttatttttcaggtgcgt

SEQ ID NO: 6776352 - DNA, 71 bp, Homo sapiens
tcccttgccctctaatttctggttggatttggctagtgtgaaaccttggctagagattgaagggtgaggga

SEQ ID NO: 6776353 - DNA, 65 bp, Homo sapiens
cctcaggaaatgaataaatggctatttggagtcctggctccctttgtgcttttatattcctgagg

SEQ ID NO: 6776354 - DNA, 57 bp, Homo sapiens
atgggagtgtgcttgaggagttgggataacagcactatggctggagcacagttcggt

SEQ ID NO: 6776355 - DNA, 93 bp, Homo sapiens
gggcagccagcccctcgaccaaggcctcaggaaggtaaagaagccgggtccacccgtgctcaacacctgacttcagtccagggtaggcggccc

SEQ ID NO: 6776356 - DNA, 64 bp, Homo sapiens
ggatgtcacagtacaggacgagttttcctggggataaaattcaggtgtggctatgctgtgttcc

SEQ ID NO: 6776357 - DNA, 56 bp, Homo sapiens
tgctgccactggtagtctcatttcaaagagtaaaatgtgaaaatccaatggcagca

SEQ ID NO: 6776358 - DNA, 82 bp, Homo sapiens
attagtttatggattagttcctctggggttggatagcttctcttggctcaatcagccatgtcaggggaatgacattgctaat

SEQ ID NO: 6776359 - DNA, 55 bp, Homo sapiens
agacactttcagaagtgtttgcaagttcagattctaatgacacttttcagtgtct

SEQ ID NO: 6776360 - DNA, 61 bp, Homo sapiens
gatgttgccttggtttatgctagggcacccacccttgcctttgcaccatcagtgcaatgtt

SEQ ID NO: 6776361 - DNA, 85 bp, Homo sapiens
tccggggcagtaaatcacacacaggcttgttaaaatagatgtccacagtgtatgggcagatggagcctgtgtttctgcccaggga

SEQ ID NO: 6776362 - DNA, 76 bp, Homo sapiens
cacagcgcctccacagagggcccttatagggagatccatctgtatcttcttcagtgcccctctagtagaggctgtg

SEQ ID NO: 6776363 - DNA, 68 bp, Homo sapiens
ttgtctttcttggtataaagcagggatatccaatcttttgacttccctgcctatattaaaagaagcaa

SEQ ID NO: 6776364 - DNA, 78 bp, Homo sapiens
tcatcttcagtgttggctacatctgcctggcagcaacatggctgcaacaatttcaggcagggttaacatctggaaaga

SEQ ID NO: 6776365 - DNA, 79 bp, Homo sapiens
ataattaggtcttataacgtcttgcaatgacatttgcaagatgtaaatgtcattgcaagatgttataggacctaattat

SEQ ID NO: 6776366 - DNA, 75 bp, Homo sapiens
tctctttctggtagggagacatctttacaaatgaaaatttcctttgtaaatgtgaatttccttttcaaaagaaga

SEQ ID NO: 6776367 - DNA, 130 bp, Homo sapiens
ggtcagccactttggaggacaggtgggacactagcaaggtagagatgtcattggtcagcagggaaaccatacataaaataatttcttctttcaatgagcattctttcccccacttgccccgctgctggct

SEQ ID NO: 6776368 - DNA, 63 bp, Homo sapiens
tctctctatatgtcaacagggggaaaaagacttaaataatcaaaactgatgactctagaggga

SEQ ID NO: 6776369 - DNA, 82 bp, Homo sapiens
gggagaggctccaggctgaggagacagaagccaaataccctgctctgggtgtttctccatcgtggcctgctctgcccctccc

SEQ ID NO: 6776370 - DNA, 74 bp, Homo sapiens
gagaccatgtgagcacgcccgaggcggcccggagaggggcggggcttcggaatgggcgaggcctgatgtggctc

SEQ ID NO: 6776371 - DNA, 77 bp, Homo sapiens
tgtacagtatgtgatcttactgaatattgtaggcagttataacacaatggttacacagtatatgggatcacagtata

SEQ ID NO: 6776372 - DNA, 62 bp, Homo sapiens
ggtgtgcataatttggcaatagaattccaagattctcatttattgtaaattgtgcctttgcc

SEQ ID NO: 6776373 - DNA, 63 bp, Homo sapiens
actgcttttgatctcttctgtactagctaagatatgatgtcaagaactgattaaataagcagt

SEQ ID NO: 6776374 - DNA, 130 bp, Homo sapiens
gattttgcccaactgtaggccaatgtaaatgttgtaagtacatctaaggtatgtcaggctaagctatagacgtttggtaggttagatgtattaagtgcattttcaacttgtgaattatagtgggtttatc

SEQ ID NO: 6776375 - DNA, 88 bp, Homo sapiens
ggtgaaggagaggcatgtcagcagatgcctaaggctttagaacttgcttggtccaggtcctgtgacagcagttgctgattccatcact

SEQ ID NO: 6776376 - DNA, 70 bp, Homo sapiens
ggatgaggtggacttttatcatattggctttcatctgcccacctgccatacatgaaaagtccacacaacc

SEQ ID NO: 6776377 - DNA, 102 bp, Homo sapiens
accccgccgccctgacagagcttgggagagggtccccaggacttggcgtacccgtccgtcctggggctgctgctgtcctcagagcctggggaggtaccgggt

SEQ ID NO: 6776378 - DNA, 76 bp, Homo sapiens
gagaatcactgcactcatcattttattgaatttacactttaaaaggtggatctgacagaaatgaaatcagtgactc

SEQ ID NO: 6776379 - DNA, 61 bp, Homo sapiens
attgagtcttttcatttcacatatgaggaaatcaaggcccagagaagtgaagtgactcaat

SEQ ID NO: 6776380 - DNA, 66 bp, Homo sapiens
catgactacttagtttgagagcatggaaacgttcatattttagttctgtgctttttaagtgtgatg

SEQ ID NO: 6776381 - DNA, 70 bp, Homo sapiens
cttctcaggctagtaaaagatgggaaggaggttcctcgccccccatcctgtttcactagcacacgaggag

SEQ ID NO: 6776382 - DNA, 88 bp, Homo sapiens
gatctggtgtcagtccctaaggatatgggctgtccccctaagatgatacatggacactcagaatgtcactgagggaccactggagatc

SEQ ID NO: 6776383 - DNA, 55 bp, Homo sapiens
gagttcatctcttcctgccctgcttctgagggaagctgttaaaaggtatgaattc

SEQ ID NO: 6776384 - DNA, 71 bp, Homo sapiens
cttcagaatctatgtgccagctccaaatagtctgcttactgcacctggagctagcatttagacatctggag

SEQ ID NO: 6776385 - DNA, 59 bp, Homo sapiens
aggaaacaggagggctagagagatagcgctcaagttttctttcacagtccctgtttcct

SEQ ID NO: 6776386 - DNA, 58 bp, Homo sapiens
gctgggctgtagtttgctgaccctgtgtctacagtattaatcaaatttacaacccagt

SEQ ID NO: 6776387 - DNA, 82 bp, Homo sapiens
ggttgcaaatggaggcctggcagcctcgtccagtgccaagaactgctctgagcatcagtcaccagcagccttccattcaacc

SEQ ID NO: 6776388 - DNA, 107 bp, Homo sapiens
ggttcagcattagattgttgccctgttaagaatgtctaatgtgcatttaaaagtattggaaagcaggcatttttgacaaagagcaatgtcactataacatatgaact

SEQ ID NO: 6776389 - DNA, 77 bp, Homo sapiens
atgcagagtcctaggccctgctccagatctatggaatcagaatctgcacttaagcgaggcctgcaggggatctgtgt

SEQ ID NO: 6776390 - DNA, 82 bp, Homo sapiens
gtgccagccatggctgatttgagagagggtgtttatatcccagtggtgtagaaagctcttctgaaatccagaggccgggcac

SEQ ID NO: 6776391 - DNA, 85 bp, Homo sapiens
ggcattccacaatgtgctggaactgtgctaagagaaggaaccgtgaccttggagctctcctgcagattcagcattattgcctgcc

SEQ ID NO: 6776392 - DNA, 110 bp, Homo sapiens
gtccattcctagttgtagaagtaaaatgccattgtatcattgagagtagaaaaaattaattctgtctggctttagagacacactggcatttgagctcagccttggaggac

SEQ ID NO: 6776393 - DNA, 69 bp, Homo sapiens
gcacagacatgtccacaaagcattcaaatgtcttatttgggtgtcctgctgggatattgttcagagtgc

SEQ ID NO: 6776394 - DNA, 75 bp, Homo sapiens
aagcatccagcacatgagaaagatgtaggctgggaggctagaccagtctctcttttacattttttctgcctgttt

SEQ ID NO: 6776395 - DNA, 83 bp, Homo sapiens
gcagctggtgacattatcctggccgtgaatggaaggtccacggaaggcctcatcttccaggtgccgggggtcatgggcaatgc

SEQ ID NO: 6776396 - DNA, 77 bp, Homo sapiens
aagctacatgcaagtaacagaacgtggatgggcatcatctcgccagtttctacagctgctgcttctcatgtcagttt

SEQ ID NO: 6776397 - DNA, 111 bp, Homo sapiens
ggtctgggtgacgcggtgtccagaggctcttggcccagttgccaaggaaagggacggcctgtcagttgtgttttgggcctgtcgggtccttcagcacctggagccacagcc

SEQ ID NO: 6776398 - DNA, 78 bp, Homo sapiens
ccctttcggcttcttagaggcgctccctctttaatggttgcgtgttcgatttggggtgccctgagttgctgtgtaggg

SEQ ID NO: 6776399 - DNA, 65 bp, Homo sapiens
atcaaagttgaccacccagtataaacaccactttttaggcttgtgcaaagggggttaatcatgat

SEQ ID NO: 6776400 - DNA, 95 bp, Homo sapiens
atgtatatatatgtatgtatatacttacatgtgtggaaggatatgcacttacctacttttatgcatgtaagtatatgcttacaggcctaaaacat

SEQ ID NO: 6776401 - DNA, 57 bp, Homo sapiens
ccaaggctgtcattcagtagctgctgaatgcacgctctgctgagtcactggccttgg

SEQ ID NO: 6776402 - DNA, 71 bp, Homo sapiens
gtagagaccatccagtaagtcagtgaaggacaggggtccctgaagtcactttaaactactgtggtctctac

SEQ ID NO: 6776403 - DNA, 105 bp, Homo sapiens
gctaattttgctgattgctaaatatgtgaatgatatcactttgttttattcttacaacattctgcaaagctgacatcattacattttctatgagcaaaccaaggc

SEQ ID NO: 6776404 - DNA, 66 bp, Homo sapiens
gttctctatcatcccttgtggtttggctcgaagccctggtctccaatcaagggtcatgacaggaac

SEQ ID NO: 6776405 - DNA, 71 bp, Homo sapiens
gtcaattcatgcacagctcttagcaccatgcctggaactatagtgctatagaagtgcttgcggattttgac

SEQ ID NO: 6776406 - DNA, 58 bp, Homo sapiens
tactgctttgactgtatgggactgtgacacattgtctcatatcacgtggaagccagtg

SEQ ID NO: 6776407 - DNA, 61 bp, Homo sapiens
acaaagcccggactcacaggcaggctgtatgtggctgtgtctgagtgtgcctgggcattgt

SEQ ID NO: 6776408 - DNA, 84 bp, Homo sapiens
ctggcagcctctccctccctggggctgtagggaatgctcccctcactggccagccaggggtggggttcaaatgggggaagccag

SEQ ID NO: 6776409 - DNA, 74 bp, Homo sapiens
gttgttggtagaattcagttccttgagggtataggactgaggttctgtttccttactagctgtcagccaagggc

SEQ ID NO: 6776410 - DNA, 61 bp, Homo sapiens
tgctggcctgagggctcctagcaggctgcctctgcagcctggccactcagggcctgaggca

SEQ ID NO: 6776411 - DNA, 55 bp, Homo sapiens
actggcagaggatagcactaatggaggatgtctatgtggtataaagcctgtcagt

SEQ ID NO: 6776412 - DNA, 84 bp, Homo sapiens
gtcagtgtgcaagatgggtatttatgaagcagaatatttagagtaactggttcagcttacaaaatacacctattaaaatatgac

SEQ ID NO: 6776413 - DNA, 55 bp, Homo sapiens
tgtaggatgatatgccagaagtagaatcaatgactagatttggcagtcttttaca

SEQ ID NO: 6776414 - DNA, 61 bp, Homo sapiens
tagggctttgcgatggctattccctctctctggaatacttttctatcacagatctgccctg

SEQ ID NO: 6776415 - DNA, 55 bp, Homo sapiens
acatctcacttctttgaaggcttgagatctcaggtccaaaggagactgagtgtgt

SEQ ID NO: 6776416 - DNA, 129 bp, Homo sapiens
gtggattattctctggcattttaccttatttaccttagctgttgaatgtagatccataaaaatcagcatgacaataagccagcagaaaggtagagacaatcaggggaaaatgtacagagatttttcaac

SEQ ID NO: 6776417 - DNA, 57 bp, Homo sapiens
gctgggtggcacttctggggtccagcagatgtttcacttggacttcctgtctccagt

SEQ ID NO: 6776418 - DNA, 126 bp, Homo sapiens
ctgctgggtagcataagaagtggatattatgggtatatggctaaggggaaattgagttgggaaatttagttaggatttggtggtataaaattatgtggtatatagtcacctctatgtctcattaag

SEQ ID NO: 6776419 - DNA, 95 bp, Homo sapiens
cccctttactggggtctcagaatggtttagttaagactgagtgtaaactgaaacaaattagtttttaaactatggagtatttgaagaaaaggtgg

SEQ ID NO: 6776420 - DNA, 64 bp, Homo sapiens
ggcttgtagtcagagcaggtgatgaccaaatctgaacttttgggtcctgttcttggctgaggct

SEQ ID NO: 6776421 - DNA, 56 bp, Homo sapiens
ggagcaaagatgcctcttgctatattttagcaaagagactggtggcattttgcccc

SEQ ID NO: 6776422 - DNA, 128 bp, Homo sapiens
tacccgtgggctttttcagcattcctagtattgtatatcctcacataaaaagtgataatattatgttggaaattactttatgtgatggattagtgtgaacatatttggggtgtttgaataattcagtg

SEQ ID NO: 6776423 - DNA, 83 bp, Homo sapiens
gtcccctcagagaaggaagttgcactgttcagttcctactgaggaaaagaaatttgcagatgctgctcctctctagaatagat

SEQ ID NO: 6776424 - DNA, 72 bp, Homo sapiens
catgctgagtctgaaacagctcagtggccgttctctgtcacagatagattgagctgtgtgggctcactcatg

SEQ ID NO: 6776425 - DNA, 58 bp, Homo sapiens
cagttgcctactacttgaataaatgggttgtttctggattctgggaattgggtagctg

SEQ ID NO: 6776426 - DNA, 66 bp, Homo sapiens
gatgcatgccatactaaaggtatcactagtctgcctggatcagtgatttatgtatgtgcacgtgtc

SEQ ID NO: 6776427 - DNA, 81 bp, Homo sapiens
aatggcaaaattactgatctgaaggacatgggacccacactatgatttctgtaacacttcagatattgatatatgtccatt

SEQ ID NO: 6776428 - DNA, 56 bp, Homo sapiens
tggtgaccctgacttctggccagcgcaggacgccccaggccccagccagggtatca

SEQ ID NO: 6776429 - DNA, 130 bp, Homo sapiens
gtatgagtgtgtgtgtgtgtttgtgtgtctgtgtatttataggggaatgagagtgccctgggtgtgcactttagatattcctctgtacatcctgtgtgtgcttacatggacacattctgtgtacttatac

SEQ ID NO: 6776430 - DNA, 67 bp, Homo sapiens
tgttgtagcccatgatggtggaaggcagtcccatcccattgcctccatttgtgtgtggccactaata

SEQ ID NO: 6776431 - DNA, 81 bp, Homo sapiens
aagagtactctgggtaaagaaggcaacctggttatgttatcttaaatatggattcctactgccttctgttactcgtacctt

SEQ ID NO: 6776432 - DNA, 59 bp, Homo sapiens
gcacttgaaaagatcaggtgcaattcaattatgaagtcgtatctgactttttgaagtgt

SEQ ID NO: 6776433 - DNA, 69 bp, Homo sapiens
ggctaccagcttctttgtctgggacccctatgtgtgggagatgtttgggactaagggagtttgttagcc

SEQ ID NO: 6776434 - DNA, 69 bp, Homo sapiens
tcatggtaacttcataaagttacccaaattttacagccgatggcagtgagactttgtgaggtgaagtga

SEQ ID NO: 6776435 - DNA, 71 bp, Homo sapiens
gctgggggtcaggaatgagttctggtgctctgtagtccggtgcagggttcccagcttccttccccttcagc

SEQ ID NO: 6776436 - DNA, 57 bp, Homo sapiens
ccagcgtaaaccataaaagtagaatttgtataaggattcacagggtggtttatgggg

SEQ ID NO: 6776437 - DNA, 66 bp, Homo sapiens
ctgcaaatgaataagactctgctagaaattcagtagcttaatgaatttttatggtcttatttgcag

SEQ ID NO: 6776438 - DNA, 66 bp, Homo sapiens
gattccagagaaaggcctggctgctgttgagagacccaggagtagctaaggccttattctgggttc

SEQ ID NO: 6776439 - DNA, 84 bp, Homo sapiens
catgtaaatgaactaggagtttttcttgagaagaaacaatgtaattcttcaacaaggaagtcccagtatatcctcagatgcatg

SEQ ID NO: 6776440 - DNA, 62 bp, Homo sapiens
cagactctttccctgtgacagagtcttgatgaaattctgcgggcttctctagggaaggtctg

SEQ ID NO: 6776441 - DNA, 76 bp, Homo sapiens
gcagtcactggaatagctgaggataatacagaagttgattatactcctctctgcctccttcagtctagatgattgt

SEQ ID NO: 6776442 - DNA, 76 bp, Homo sapiens
ccagccccggaaatctgggagtcttggctctgctgatgactgcaaggcaagctcaggcctcaggtgtcggggctgg

SEQ ID NO: 6776443 - DNA, 75 bp, Homo sapiens
ctattttattgtctcacaaacaggatgcccagcgtggatgggtatcagcaaaatcctgttgtaggcagtaattag

SEQ ID NO: 6776444 - DNA, 59 bp, Homo sapiens
gagccttaacccagatgctcatggtgccctagtcttgagttcttcatttaggtgggctt

SEQ ID NO: 6776445 - DNA, 67 bp, Homo sapiens
tgctgtcctgttttggagtaattatgtctggaaaactgccagtcattatgttcttaaactgatggca

SEQ ID NO: 6776446 - DNA, 66 bp, Homo sapiens
gttgaggctgatcccaggcactgtcgcaacccagctgggtgtgtgcatgcttggggcagcactgac

SEQ ID NO: 6776447 - DNA, 81 bp, Homo sapiens
gtgtgttgcctgcattgctcttctgttccttacatctgccttctggggtaggctcagagatgagtaagcacggctacacac

SEQ ID NO: 6776448 - DNA, 59 bp, Homo sapiens
gatctgtctaatattgacagtggggtattagagtttcccactattactgtgtggcagtc

SEQ ID NO: 6776449 - DNA, 84 bp, Homo sapiens
gaccaggacattcaagtttctgctcatgggaggtgtataccacaagcccccgtggggccagcagaaagctttctgtgtatggtc

SEQ ID NO: 6776450 - DNA, 70 bp, Homo sapiens
gagtgtgtttgtgtggctagttccctgaagagcccatcaacttagtaagcactcacacattcccacactt

SEQ ID NO: 6776451 - DNA, 58 bp, Homo sapiens
gtgagatatttaccttattttttgacactaagtgttggaaatccagtgtgtattttac

SEQ ID NO: 6776452 - DNA, 77 bp, Homo sapiens
ctggggccttggcctcattagatgaaactctccctcttcctatcaggctggggaatttttgaggaccagaacctcag

SEQ ID NO: 6776453 - DNA, 57 bp, Homo sapiens
tttgatgtgcaaaaatgatctcctgagaacagttcaatcattgcagagcacattaaa

SEQ ID NO: 6776454 - DNA, 75 bp, Homo sapiens
gggaggggctccagccaccacacccctgccaagcagctgcgccgggatgaggggtcattggctgggaaccttccc

SEQ ID NO: 6776455 - DNA, 57 bp, Homo sapiens
ccagaatccacattccccagagctctttggagatttgggaagcttgggtttgtttgg

SEQ ID NO: 6776456 - DNA, 72 bp, Homo sapiens
ccagcccctgcctctgctgctgtggcatcacagaagccatcagtgagtcacttattgctgagcaggtattgg

SEQ ID NO: 6776457 - DNA, 123 bp, Homo sapiens
gattttatttatatggtttaaacaataacatggctcataaactcagttcagttctgaattgtagagactagaggtgtagtttgggaattgtgtgtttgtgactgttaagctgatgttaaaatc

SEQ ID NO: 6776458 - DNA, 85 bp, Homo sapiens
ttatcaaagtgatcctaaagctattattcaaaatagttaatttttttatcctggaatcagctttggagacaatacttttggataa

SEQ ID NO: 6776459 - DNA, 111 bp, Homo sapiens
gtttaactctaagaaactcactcatacttaagcagtgctagttgagagaagctatggagaaagtgacaaccagtatgtttaggaggtgagttagtttttggcagttctaac

SEQ ID NO: 6776460 - DNA, 61 bp, Homo sapiens
gggtttgggggcagctggtctggtccaggaacctggctggaggcatgcaagctcccttccc

SEQ ID NO: 6776461 - DNA, 72 bp, Homo sapiens
gtgtgacaggtgaaatgtccttattaaaaatagtaatagtaatgacaatttttatctgttaatatttagcac

SEQ ID NO: 6776462 - DNA, 61 bp, Homo sapiens
gaattagctgttttgccataagcgctaagctgtgctgtaagtgctaagttgacagcagttt

SEQ ID NO: 6776463 - DNA, 73 bp, Homo sapiens
atgactgcattattggaacggctgaactttgacttatgtatcatgtttcagcagttttaagaataaaaggaat

SEQ ID NO: 6776464 - DNA, 81 bp, Homo sapiens
attgttcaagaatgatactctatgccaaattggagtatgaaccatccatttgggaatagggtatcatcgtcttgtaatggt

SEQ ID NO: 6776465 - DNA, 88 bp, Homo sapiens
gtactattactttatcacagaagaatcatgctgtgttagtccattctcacaatgctgtaaagatgctatctgagactgagtaatttac

SEQ ID NO: 6776466 - DNA, 78 bp, Homo sapiens
ggaggcgcatagctcaagatcagggtgccagaatggctgagttgtgattagggctctctggcttgcacagttaccttc

SEQ ID NO: 6776467 - DNA, 94 bp, Homo sapiens
caagtctaaagagccaaagtcattgtaatatatgctaagggcaaagggaaatagtcaatagctttgttagaatgtcttcaggtctttgagtttg

SEQ ID NO: 6776468 - DNA, 105 bp, Homo sapiens
gttgagatggagtctcgctgtctcgctgaggctggagtgcagtggtgcaatctcggctcactgcaacctctgcctcccaggttcaagtgattctcctgcctcagc

SEQ ID NO: 6776469 - DNA, 58 bp, Homo sapiens
acctgggaggcggaggttgtagtgagccgagatcgcaccactgcactccagccccggt

SEQ ID NO: 6776470 - DNA, 61 bp, Homo sapiens
attgtcttagtcagctcggactgctataacaaaatatcatagactgggtggctgaaacaat

SEQ ID NO: 6776471 - DNA, 78 bp, Homo sapiens
atggggtgcagcaggcagctgggggagttgagaacttgctcactcactcctcttttgtctttacccgctgcccctcat

SEQ ID NO: 6776472 - DNA, 81 bp, Homo sapiens
cggttcaagctgaaaatgttacacaggaagacataccatgtaaaggtcagattcttctactataataattttcttgatctg

SEQ ID NO: 6776473 - DNA, 56 bp, Homo sapiens
ccatgaatcctggcacttaggaggaggattagcacctctggtccaggtcttcatgg

SEQ ID NO: 6776474 - DNA, 68 bp, Homo sapiens
acatttacagcccaagaagtttatacgtacggatgagtccctgtagctacatttttgactgtgtatgt

SEQ ID NO: 6776475 - DNA, 79 bp, Homo sapiens
ggcgaggcttctcggggcgcggccagcaggacgggggcgtgaagaatttctcctgcaggcttgagtcctcagtcttgtc

SEQ ID NO: 6776476 - DNA, 60 bp, Homo sapiens
cccctgattcatgtaataattcactctaggatggaggcagtgccttacaagagtgagggg

SEQ ID NO: 6776477 - DNA, 89 bp, Homo sapiens
ggcctaaagctgaccactattttctcttcagatggccaggtggacagaaccctggactgggaggagatggaggactcagtttgcaggct

SEQ ID NO: 6776478 - DNA, 68 bp, Homo sapiens
gacctggacgtgcaggaagacaggcacaaaggctggccttggggactgaggcctgctgcgttcaggtt

SEQ ID NO: 6776479 - DNA, 65 bp, Homo sapiens
tcaaatcttggcattttgctctgatatggagtaacaatgatgtattagaagaggtgccaacttgg

SEQ ID NO: 6776480 - DNA, 80 bp, Homo sapiens
gagtgaaaagatgaacgatttgtcctgatttcattgtgtcctagcttgtgaccttggacaaatctcattatttctgactc

SEQ ID NO: 6776481 - DNA, 63 bp, Homo sapiens
tgactctgataagacatatggcagctttaaaaaactggcgtaatatgtcttcttctggagtca

SEQ ID NO: 6776482 - DNA, 88 bp, Homo sapiens
gcattcacccggagcctgtcatccgcttccataaggcagccttcctgggccagtgtgggctggtggaggacaatttcctgatgaatgt

SEQ ID NO: 6776483 - DNA, 83 bp, Homo sapiens
gctaattctgccctccttccttcctcctccagttctggtaggatatgagatacaagaggaagaggtctggggcaatgaatggc

SEQ ID NO: 6776484 - DNA, 129 bp, Homo sapiens
ttcttttggaaaatatcagctgtgagtgaaggcaggttggggaaaagcactaaggcctggtctcatctaccaggaaggtttccccctctgccttttccttactgagtgaatttaccaagtcatggagag

SEQ ID NO: 6776485 - DNA, 60 bp, Homo sapiens
ggatgacatttatgtgtgtgctgttatgactttgagaagcacagactagaaaggtctttc

SEQ ID NO: 6776486 - DNA, 56 bp, Homo sapiens
ggctggcttggtgagctgtcacttctctcctgaagccttcccactcccagttagcc

SEQ ID NO: 6776487 - DNA, 78 bp, Homo sapiens
acggtggcatggtttgttccaaattccaaagcaatcctcctgctaaggccattggacacaaaatccgtgtgatgctgt

SEQ ID NO: 6776488 - DNA, 58 bp, Homo sapiens
gtgccatttcacaggagctgagggtggagacaacagtctgtttcttgtgaagtgacac

SEQ ID NO: 6776489 - DNA, 115 bp, Homo sapiens
gagtgagccactgtgggaattcagggaggtggcgcagtgaccacccctggagggatatgtgtgtggcaggggtcgagggtctcgcccttccctgcttcctgcgcgtggctttctc

SEQ ID NO: 6776490 - DNA, 56 bp, Homo sapiens
gcagtcctatgtctgcaccagagccgcctcacgggcctatgggcaggcaaggaagc

SEQ ID NO: 6776491 - DNA, 70 bp, Homo sapiens
tgatgacaatgttgctgcaataaatgcaataatatctctctgcactgttattgcagtaccatagtcatta

SEQ ID NO: 6776492 - DNA, 70 bp, Homo sapiens
gttggctgcagagcataaatctgaataggttctccaaagtaagctttttctgcatgcatttgctcccaat

SEQ ID NO: 6776493 - DNA, 57 bp, Homo sapiens
attccaccttctacctgggagagaggacatactatatcgcagcagtggaagtggaat

SEQ ID NO: 6776494 - DNA, 63 bp, Homo sapiens
actcttgaactgattaagaatggatcataaaataaatttacattcatgatacagttttagagt

SEQ ID NO: 6776495 - DNA, 84 bp, Homo sapiens
cctctggtgtgaccttcagcaatctttcttggtcttctagccagatacagaggacaaaatgagaagtgcttgggtccccagagg

SEQ ID NO: 6776496 - DNA, 70 bp, Homo sapiens
agtgcctggtgcccttaagatgagaacagcaataataatcacacctttcatgtaccgtgtaccaggcatt

SEQ ID NO: 6776497 - DNA, 61 bp, Homo sapiens
ttttaccactgggtgacatggaaatcacaataaggaattctaatgtcatttgtggctgaag

SEQ ID NO: 6776498 - DNA, 88 bp, Homo sapiens
ggagaatcgcttgaaccctggaggcagaggtggcagtgagccgagatcgtaccactgcacttcagcctgggcgacacagtgagactct

SEQ ID NO: 6776499 - DNA, 62 bp, Homo sapiens
aggaaaccaggactgcaccgtctccttcaaaaacagcagacccgtgccactcgtggcttcct

SEQ ID NO: 6776500 - DNA, 84 bp, Homo sapiens
gccctagctaatatcctttccagagtacagtatcaaagaaacgatattactgtaagaaaatatctgaagggtacagtccagggt

SEQ ID NO: 6776501 - DNA, 57 bp, Homo sapiens
cctgagaggccctctcactgtcgtctttctgacagtggcaggcagaagcttctcagg

SEQ ID NO: 6776502 - DNA, 65 bp, Homo sapiens
agcagaggcaggaacccactgttcagtgcaagctgactctgtccacatgtgggcctgctgctcct

SEQ ID NO: 6776503 - DNA, 56 bp, Homo sapiens
cttccacctcacgcttgttcagcacaaaaagtggggagcaatagttgaggtgtgag

SEQ ID NO: 6776504 - DNA, 57 bp, Homo sapiens
aaatcaggaggccggcaggatttgacctggaggtcagagtttgctgacccctgcttt

SEQ ID NO: 6776505 - DNA, 90 bp, Homo sapiens
tagaattctgcctcacagtctaggtgtgtgatttaatttcttccattttaagactttgctttattcctagcccttgtggtagctgttctg

SEQ ID NO: 6776506 - DNA, 114 bp, Homo sapiens
ggctgttttcctcccggggaaggttctggagcatttcttctccatggggtaagtcagaattttctaggcaaaccacaggggaggaatgatgcccgggacaggggaggaagtgcc

SEQ ID NO: 6776507 - DNA, 128 bp, Homo sapiens
aatttgaataagcaaggtgtagacttttaaaaaaatctaggacatgcatttattaccaggctttcaagaaatctcttctgaacagttatgatgatgattatgctttgaaatatgctgtgcttcaaatt

SEQ ID NO: 6776508 - DNA, 59 bp, Homo sapiens
acagaacagatgtgggctactgtgggatctctgtggatccccagattcatgtctgctgt

SEQ ID NO: 6776509 - DNA, 81 bp, Homo sapiens
gggtcaaagcctggtacttgggaatgttttacagatgtgaatttgcttatgaatgaaatcattgccaagtattgagtgccc

SEQ ID NO: 6776510 - DNA, 121 bp, Homo sapiens
tggagaaagttctagattctggcctggcagatgctgtcttatttctcatcccactcaggagctggaaactaagagagccttgggttggaagcaggaggcaccaggctctagaaccatccca

SEQ ID NO: 6776511 - DNA, 59 bp, Homo sapiens
cactgtaatgtagtggaatcatgatgtgcttctatagatgcattatgctcattacagtg

SEQ ID NO: 6776512 - DNA, 56 bp, Homo sapiens
tttatcccaggggttgtatcttcccccatcaattatgggtttctcttggtgataaa

SEQ ID NO: 6776513 - DNA, 59 bp, Homo sapiens
ccaattggggaccaggtggtctgatctaaacagatcagagccttatgcttctcatatgg

SEQ ID NO: 6776514 - DNA, 66 bp, Homo sapiens
tgagctctgttagggctggaaccaaacatgtttgtatgtgtatctttggggtttaacatgggctta

SEQ ID NO: 6776515 - DNA, 60 bp, Homo sapiens
cactgtgctatgacacttggtttcaacttatttgagagttggaaactttcaagcataatg

SEQ ID NO: 6776516 - DNA, 84 bp, Homo sapiens
tttttggggcctctcacacatatcaaatgataagattaaacaaatagcataataattcataaatatttgtgggggctttttaaa

SEQ ID NO: 6776517 - DNA, 94 bp, Homo sapiens
ccagattatccaggataatcatatctgaaaaatctcctttgtcatgaaaggtaacattcacaggtttcaggaatgaggacctggatatatttgg

SEQ ID NO: 6776518 - DNA, 62 bp, Homo sapiens
gtggtgcccctcgcctgcagagcacagcatcatgagggtgctggtggctgtggggggactgc

SEQ ID NO: 6776519 - DNA, 60 bp, Homo sapiens
taccagcctgaccctgtctgacctgggctaggaaggaacagacatgggtccaggttggtg

SEQ ID NO: 6776520 - DNA, 67 bp, Homo sapiens
gccgggagaggcggcgcaggggcccagtccaccgagcgccgggcggcccttgcctgcactcctcggc

SEQ ID NO: 6776521 - DNA, 118 bp, Homo sapiens
tgcagctcctctcatatgctatttgcaaagtccctgggatggaatggactaatttttaaaatgaaaacctttcctttatctttccagaggaatttttagatagaaatggtctgctgca

SEQ ID NO: 6776522 - DNA, 91 bp, Homo sapiens
acagtttttcaggagcacatttgtttctctagagtaggtcctctttggagtccactttgagaagctgatgaaagctatggattctcattgt

SEQ ID NO: 6776523 - DNA, 82 bp, Homo sapiens
tgaataatgctatcaggacaaccacagccgggtgcctcggccgctggcacgtccttggctgggcttgcctcggcagagttca

SEQ ID NO: 6776524 - DNA, 79 bp, Homo sapiens
tcctagagcccagtgggccagtagctactcgcaagcctgttttactaattcttgctgctactcaggcctcggctcagga

SEQ ID NO: 6776525 - DNA, 76 bp, Homo sapiens
cagaaaagataatgttaagtcataggctatatcactatttctgtgatagctcatttagttaacattgttaattttg

SEQ ID NO: 6776526 - DNA, 57 bp, Homo sapiens
agcactcctgtctttcccctttgaaacataaaaggtaaagactgcaaggagaatgct

SEQ ID NO: 6776527 - DNA, 78 bp, Homo sapiens
caccctgctatcaagggctgaacacaggtttcaggcccaactctgcctgtttccaaagcccatgctcttgtagtggtg

SEQ ID NO: 6776528 - DNA, 80 bp, Homo sapiens
ggagatgagactgggcttgattctaagtcctttactgtgctgtgcaaggcctcatgtaatcaggccctggctgactctcc

SEQ ID NO: 6776529 - DNA, 76 bp, Homo sapiens
ttgcttgaacccaggaggcagaagttgcagtgagccgagattatgccactgcactccagcctgggtgacaaagcaa

SEQ ID NO: 6776530 - DNA, 63 bp, Homo sapiens
gtttccatgcagcagcctcccagccactgtagcgcaaacaaagccagaggtgctgctgcagac

SEQ ID NO: 6776531 - DNA, 67 bp, Homo sapiens
gtctttgagatctatcttgtctctcaactatctgtagatagtttgagaattgaaatagaattaagat

SEQ ID NO: 6776532 - DNA, 59 bp, Homo sapiens
gggcatggcagggggagctgcagggccatctgaggggccccagcatctgagccgtgtcc

SEQ ID NO: 6776533 - DNA, 123 bp, Homo sapiens
tataattatcatatatttgaaattgttttcagaaaatattatcagaaaaattcttccacagagtaattttggtgtggaatgatctgatgtattttatgataacttttagacaatgaaattata

SEQ ID NO: 6776534 - DNA, 78 bp, Homo sapiens
catccttggttcctcctgcctcagtatccgcatctgtgatctgggctgctatgaggcagagaaaggaccccatgggtg

SEQ ID NO: 6776535 - DNA, 61 bp, Homo sapiens
tacacatgatcatttagtagcaaagtctgttcatcagaaaactctaattgctttatgtgtg

SEQ ID NO: 6776536 - DNA, 63 bp, Homo sapiens
taagaaaagtcatcactcctctgaacttgcaacagcaagctctgctcatgatgacgtttcttg

SEQ ID NO: 6776537 - DNA, 74 bp, Homo sapiens
agggtagatattgcatagaaatcatcaggactgtggtttatgtttaatttgaagtcttcatgatttctctccct

SEQ ID NO: 6776538 - DNA, 71 bp, Homo sapiens
cctccccacgggcagccggcgcagacctccaggattcgccagcagattgtgcccagggacagtggggaagg

SEQ ID NO: 6776539 - DNA, 81 bp, Homo sapiens
gtgtgtagagcatggcctctctcctggaatggcatcttatacatataacccattggagccaagagttttacctttacatgc

SEQ ID NO: 6776540 - DNA, 59 bp, Homo sapiens
gcttcaggtggccattgttagtgaagccaaaagacttcagttaactgtgttacctgtgc

SEQ ID NO: 6776541 - DNA, 55 bp, Homo sapiens
cctggaatttctattggttcacccttagtgtggggatttggaggcagattccagg

SEQ ID NO: 6776542 - DNA, 110 bp, Homo sapiens
atgtaaatctgaacttgtcagacctttcaggatccccaccgcgtttaggatataatcgcaaatcctcccaatagcctaagagcctggcaaggtcgacctcagctttatgt

SEQ ID NO: 6776543 - DNA, 105 bp, Homo sapiens
gttctgggattcacttgcctttgccgtatagtaaaattttcatttatggtttatgctgttaaatgttcctttactggaatgcaaggtggtgggacccaagagaac

SEQ ID NO: 6776544 - DNA, 56 bp, Homo sapiens
tctcattcaaacagccctttatgtgtggtgggtacagatgaaggcactgagtggga

SEQ ID NO: 6776545 - DNA, 116 bp, Homo sapiens
gacaacagaacattgaccagatctatgcagtcatttgacatgcacacatggccttaccctttcatgtttgtaggtaagtgacactgcagacctggtgagactgtttcatgtatgtc

SEQ ID NO: 6776546 - DNA, 59 bp, Homo sapiens
aggcactgactcaagggagccaagggccaagcatagaaggcttcctggaggcagtgtct

SEQ ID NO: 6776547 - DNA, 57 bp, Homo sapiens
ttctagctcatggtgacagatctgtttcaagggtctgtcacagtgcacagctaagaa

SEQ ID NO: 6776548 - DNA, 75 bp, Homo sapiens
gttaatgactagtccacatttgtaaaataaattgtctttaagaggacattgttacagttgtagaaagtggttgac

SEQ ID NO: 6776549 - DNA, 66 bp, Homo sapiens
gttctcctcccttggcccagcctctctgtaaggaagtcagactctgtgctcagagggagggagagc

SEQ ID NO: 6776550 - DNA, 91 bp, Homo sapiens
gatcattatcatcattaagcatttatgaagcactttagagttatttactagaactcatgatatgcctataagatagattggtataatggtc

SEQ ID NO: 6776551 - DNA, 89 bp, Homo sapiens
atagaatgatataagaagtagtatggattaaactaggggtcaagaacttttcctataaaggtccagatagcaaatatgtttggttttgt

SEQ ID NO: 6776552 - DNA, 106 bp, Homo sapiens
cacctatttcttcaaacataggaagaaacatcttatctgcatgatccctcctggggagctatcttacggtcttatgtgataaggtgacctctcctttgggtgagtg

SEQ ID NO: 6776553 - DNA, 87 bp, Homo sapiens
tcatattgatattagtaatatttaaggtattgacatttgcaacttttaaaaaattaaagaagcaaggtgatacttacattagtgtga

SEQ ID NO: 6776554 - DNA, 74 bp, Homo sapiens
tgggttccctcgaagagcttattctttcactaatcctgaatcttctggtgactgattgcctgatgggggaaaca

SEQ ID NO: 6776555 - DNA, 77 bp, Homo sapiens
tgagtcacatttggggtaagtttgtcaagctgctcctatctctttctgcagcacatttactcagccctcatgactca

SEQ ID NO: 6776556 - DNA, 86 bp, Homo sapiens
aggagaaggacaggagcaagtgggctgcatgtttactattcagaatctggacattggctaatgggcccctttgactgtcatctttt

SEQ ID NO: 6776557 - DNA, 73 bp, Homo sapiens
acagtggaaaacgaaactggggccaggacttgtgcagctaacgtgtgcactctggccccattctttcccatgt

SEQ ID NO: 6776558 - DNA, 63 bp, Homo sapiens
agagcatggtcaggggccttgggtgagagtcctgcagctctggctggctctctgacgtgcttt

SEQ ID NO: 6776559 - DNA, 128 bp, Homo sapiens
ataaacctgtcttgacacatcattattgcccagagtccatagtttaccttagggttcactcttgatattgtacattctgtggacttggacaaaagtataatgacatgtattcaccattacagtattgt

SEQ ID NO: 6776560 - DNA, 65 bp, Homo sapiens
acattaaagagtaaggttagtttaccaccccaaggtgagcttcaatgtgcctatacctttaatgt

SEQ ID NO: 6776561 - DNA, 72 bp, Homo sapiens
ttgttcttcagtgattttggtctgccttagagtttgatgagtccaaggcttcccagagatgctcaaaaacaa

SEQ ID NO: 6776562 - DNA, 83 bp, Homo sapiens
ggggaggggacagtgagcctgggcaggtgggtagtggccaggtagagccttggatgccaggctcaggatgtccctgggtcccc

SEQ ID NO: 6776563 - DNA, 80 bp, Homo sapiens
ggagtataatgatttagtgtgctttttcccctgtgtttgcatgtttgcaaagatttaaagcagtattcgcaatgtactct

SEQ ID NO: 6776564 - DNA, 80 bp, Homo sapiens
cctgataaaagctgaggcaaaagaggttcattcagcaaaccttatgtgaataattcctttttgtcaagtgctatgtcagg

SEQ ID NO: 6776565 - DNA, 70 bp, Homo sapiens
acagtcgcggttgctgattgagaacaggcctgtcccagcagttctcagaggagtcgggagctgcggctgt

SEQ ID NO: 6776566 - DNA, 56 bp, Homo sapiens
ccgtttctgcttttagctaaactataggaaactgtcccctatgaagcaaggaaggg

SEQ ID NO: 6776567 - DNA, 94 bp, Homo sapiens
tctgtcagatatgtggctcagaagttaatatataaattttcaaagaaagttataaccgatgacttctgtgatgtcatatttacattatggcaga

SEQ ID NO: 6776568 - DNA, 69 bp, Homo sapiens
tcaaagacattcacaaatgttcacttttgttggattgctgagtgagcatatttgtgtgatgttaaagga

SEQ ID NO: 6776569 - DNA, 67 bp, Homo sapiens
acagagacctggccttgctttgcattatcccgggcgggggaagcaacgaggactcagatttctctgt

SEQ ID NO: 6776570 - DNA, 57 bp, Homo sapiens
atgctttaaactataaatccacagtatttggtgactgtggaggtgcagagaaggcat

SEQ ID NO: 6776571 - DNA, 92 bp, Homo sapiens
ctgtttgcacgggccagggcagggaggctttctgggagtgaggtgagagcaaggctgttcccagaggctccagtctctatttgtgcagacag

SEQ ID NO: 6776572 - DNA, 57 bp, Homo sapiens
caaaataattgagttagttttcagggtgggtgctcattagacagctctattattttg

SEQ ID NO: 6776573 - DNA, 130 bp, Homo sapiens
gctatgatacaagataacaatatacatcagcagtacccagttattttgtctttgtagttttattagaaaataatttcttggctggtaaagttcctgctggtataccttgtttctctgtgattagatctgc

SEQ ID NO: 6776574 - DNA, 82 bp, Homo sapiens
caagacaactatattaacttgtgatcctggattggaaccttgtccaggaacagaatgttagtgcaacagttggtgacgcttg

SEQ ID NO: 6776575 - DNA, 56 bp, Homo sapiens
gcaaggctcccgcagcccagggcactcagagcccctgggctcagccccagccctgc

SEQ ID NO: 6776576 - DNA, 128 bp, Homo sapiens
taaagttttccagaccgaggaaaaggttatctatttgtctacagctctggagcttttggctagtgcttctgggttcaaaatctcttagctgtgtctccgcttaaggataactctcctgggattcttta

SEQ ID NO: 6776577 - DNA, 63 bp, Homo sapiens
tgaaattatcagaaattcaaagggtgacctgttaatggcactggttgaagttctgtatggtca

SEQ ID NO: 6776578 - DNA, 77 bp, Homo sapiens
tggctaatggttctgcaggctgtacaggaagcatagcagcatctgcttctggtgaggcctcaggaagcttccagtca

SEQ ID NO: 6776579 - DNA, 88 bp, Homo sapiens
tagcttgccattttttccagtgttattttagagtgtgataaatgtaaatatatatatataaggagatactttcttaacatggcagcta

SEQ ID NO: 6776580 - DNA, 64 bp, Homo sapiens
agttgaaaacatgtccatacagaaacttgtacactcaagtttgtagcagcatggtttaatagct

SEQ ID NO: 6776581 - DNA, 57 bp, Homo sapiens
taacattccctttgtgccaagggaccaagatttcccttgtgcagagcaggagtgtta

SEQ ID NO: 6776582 - DNA, 123 bp, Homo sapiens
ttgttattgacttgtctctacctcacactgtgctagtcactagagttgcaatcatggacaataagaaatatgcctgtcattatgaggattacaatacagtggggcaggggacataaataatag

SEQ ID NO: 6776583 - DNA, 56 bp, Homo sapiens
gactgtgctggagccctctggaggggccagacaaccccaacagttgcaacactgtc

SEQ ID NO: 6776584 - DNA, 61 bp, Homo sapiens
agccactcagtgctgtattgacagaaattaaattagccatcagtgcgggcaatcagtggct

SEQ ID NO: 6776585 - DNA, 112 bp, Homo sapiens
tgatgaaactgccacaccaagaggttagtaaatgagttcaaagtcaaggaaactgtgagtgacagagccagactttgaactcagcagcctcattccatcgtcagtgctatta

SEQ ID NO: 6776586 - DNA, 59 bp, Homo sapiens
atggcaggcattgcaacatgtacatactgagtgctgagtatgtgccctgtgcctgtggt

SEQ ID NO: 6776587 - DNA, 68 bp, Homo sapiens
ttaacctgcaacagatctgtcttgccacaacaaactgggtcaagaccaagaaatgttagtctggttag

SEQ ID NO: 6776588 - DNA, 74 bp, Homo sapiens
catgtattcttaaggattgagcaaactgcaggctgcttgctgccttttaggtttgctagtccctgatctacttg

SEQ ID NO: 6776589 - DNA, 86 bp, Homo sapiens
ttcgaggtgtgttacaggtagcaaaacctttcctgaatgcacaattttatataggaaaggattgctgtgctgttggtcactgagaa

SEQ ID NO: 6776590 - DNA, 69 bp, Homo sapiens
gcacagtggagtgtgtccagggaatgtggatgttattgattctgtgtataattagaccatttactgtgc

SEQ ID NO: 6776591 - DNA, 124 bp, Homo sapiens
ttatcagtagaacagtaagtaattgtattagtatgttctaggaatggttgatgaaggaaggaagaaaatttcacaaatacttgaattattaaaataagaaactttccaaaatttttgctgatag

SEQ ID NO: 6776592 - DNA, 62 bp, Homo sapiens
ttgataaagaatctggatgaaagtattggtagctgatgaatttatcaaagattcttaattga

SEQ ID NO: 6776593 - DNA, 75 bp, Homo sapiens
tcatagttttgaagaagaccttgaaacctttggaggttttacgatttggtctttgcccagaaaatactgctatga

SEQ ID NO: 6776594 - DNA, 67 bp, Homo sapiens
catttatgagtcttactgcagtgaagcttcctgtgtatggaagtgtaaattcacagacttcaaagtg

SEQ ID NO: 6776595 - DNA, 74 bp, Homo sapiens
gctgtcagcccaggtcctcctcctccaggaaggcttcctcgaggtcctgggaggcaggacccctttcctacagc

SEQ ID NO: 6776596 - DNA, 106 bp, Homo sapiens
ggcccacaaattggcagcatcagtatcacctgggagcatattaaatcagcagctgcatttaacaagatccccaggtgattgtatgaccattaacatttgagaggcc

SEQ ID NO: 6776597 - DNA, 127 bp, Homo sapiens
gcatgggggtctctgcaaagcctgtcttctgccccttccctgacacatttctcccagtctccatgctgcctgggatggagatggaaatgaagggaagccccgcagtagaagaggccaggctccctgt

SEQ ID NO: 6776598 - DNA, 79 bp, Homo sapiens
cagcagaggccctggggggtgccctggcgaggtgggcatgctccctctccccagctgagctgcccttggcctcttgctg

SEQ ID NO: 6776599 - DNA, 78 bp, Homo sapiens
gctaaataggatgacatgaataaaaatcgtgtggtattttcctaatagatggttttattttagtttcctagatttagt

SEQ ID NO: 6776600 - DNA, 91 bp, Homo sapiens
ttggcttttgtggatattaaattagtaaaacattgtatatgtcattgacatatatattatttagcatgatgaaatattcatgatgtactaa

SEQ ID NO: 6776601 - DNA, 59 bp, Homo sapiens
cagtgcagctgccccgctggtaatacacaagattctgccaaggctggaagctgttgctg

SEQ ID NO: 6776602 - DNA, 58 bp, Homo sapiens
gtcctgaggatgcagagataaatgagacccagcctccacctctgcaggacctcagggc

SEQ ID NO: 6776603 - DNA, 130 bp, Homo sapiens
gaaaaaaaatgctgctctagcagtttgcagccaaactggaagcacaggatcagtggaatctcttagaaaagtattcttttgaaattcttgtggtcaatgtatgctgaaactgagaaaggacagatacatc

SEQ ID NO: 6776604 - DNA, 117 bp, Homo sapiens
tccttgagtgagtactgctataaaatgcattattattgctagtgtcatttcacaagagcctataatttcagtgtgatagagctacaatataagtatagtattgcaaaaccatcagga

SEQ ID NO: 6776605 - DNA, 75 bp, Homo sapiens
gggctgacctcatgagcttccagagacatcagagtaagtgacccttattctagtttcgaagctctgttctagttc

SEQ ID NO: 6776606 - DNA, 55 bp, Homo sapiens
cccagctgttgtctctcacatattaattaggggtgacaggaacaacagcccaggg

SEQ ID NO: 6776607 - DNA, 82 bp, Homo sapiens
gtatttagtgattttttagccctgtactgtgatactaagaagtagggcttaaatagggcctaaaaagtattgctaaaattac

SEQ ID NO: 6776608 - DNA, 130 bp, Homo sapiens
gtctcatggttttgctgttactattgtctttaactagcttgtactgcagtagagaaggcaattagctgtgtttatctttgttggtacactctgatcaaaacagtcaaggaacagatgcttccaggtggac

SEQ ID NO: 6776609 - DNA, 74 bp, Homo sapiens
ttgattcagaagtttcacaatgggttttatggtcacatgcttgattttgtctttcccatgaaacttcttttcaa

SEQ ID NO: 6776610 - DNA, 64 bp, Homo sapiens
ccagctgggattaagggaaaattagaatgaaatgaaaaaagaattttcatttaaaattggctgg

SEQ ID NO: 6776611 - DNA, 117 bp, Homo sapiens
tgagacgcaaggggtggggcacagtaacctcctgagggggcccaacagggacccctggccaccaggggctgaaatgttggggttgcctcagaggtgacagtggctcccctgagtccg

SEQ ID NO: 6776612 - DNA, 61 bp, Homo sapiens
gggctccttggattccgtgaacttaaccatctcataggaaggctacaggaatccagcgccc

SEQ ID NO: 6776613 - DNA, 71 bp, Homo sapiens
aaagctcagcatgtctcctagaactagctaataacacaaatgcggtgaataggattttgtgcttgagagtt

SEQ ID NO: 6776614 - DNA, 65 bp, Homo sapiens
aagatgtgatgggttaagggccaattgtcagttttagttttcttggcccctgactcattcatttt

SEQ ID NO: 6776615 - DNA, 70 bp, Homo sapiens
tgaattaaaaagtggcaccaatttgacaagattaggtaaagtttggtcatttgcactgccaattaattca

SEQ ID NO: 6776616 - DNA, 57 bp, Homo sapiens
aagttggagaggcagacagaggcccatctctacccttcactgcctgctctccagctt

SEQ ID NO: 6776617 - DNA, 96 bp, Homo sapiens
atatgagataccccagatgtgactgtaattaccttagcaatgcttttccacagtattttatagtttttaaagtagttccacacttggtctacatat

SEQ ID NO: 6776618 - DNA, 57 bp, Homo sapiens
gtagaatcatcatgagtgtgactgtaacaaatgcagacggactccagggtgttgtat

SEQ ID NO: 6776619 - DNA, 55 bp, Homo sapiens
tctttgtgaaagttcatttgcaattcaattggaactgcagctggtttcacaggga

SEQ ID NO: 6776620 - DNA, 60 bp, Homo sapiens
ggaccctgaccagcagtacttggtatgagtttactcttactataacgctgtgtcagctcc

SEQ ID NO: 6776621 - DNA, 73 bp, Homo sapiens
gagtgggaaaatacaaatagccttgaaaatatagccagggattttacgagtgctaatgatattgtgcctactt

SEQ ID NO: 6776622 - DNA, 67 bp, Homo sapiens
ctgtgttattggcaggaattagataagcttgtgaatttagggatctgcttcgcgccaatttcatcag

SEQ ID NO: 6776623 - DNA, 75 bp, Homo sapiens
aggtggtgcaaaaataattgcggtttttgctgttactttcagtggcaaaaaccgcaattgtttttgcacaaacct

SEQ ID NO: 6776624 - DNA, 85 bp, Homo sapiens
tccaagcttctggaatgataaatggaagcagcatcactgtgctactagtttcatttttcagatctagttgtaaaaagctattgga

SEQ ID NO: 6776625 - DNA, 57 bp, Homo sapiens
ctgctggcctagcccatcctctctggagctcaggctgaggcagggctggctcagcag

SEQ ID NO: 6776626 - DNA, 58 bp, Homo sapiens
tgcacaatttaaataaatacttgaggccagtggttttcagagtgtggtgagatgtgca

SEQ ID NO: 6776627 - DNA, 105 bp, Homo sapiens
tggtaactcttgaatatttgtcaggtaattgctaagtgcaagggagtatgggaaaagattacattctactctgtggtgtatttgcattgacataaatagtagcca

SEQ ID NO: 6776628 - DNA, 114 bp, Homo sapiens
aagagaaaagatatgggataggtctgtgcacttaggatagggtagaaatggggagaaggatcacatccctgacttctaggtgacatatcagagtttatgtcctgtgtatctctt

SEQ ID NO: 6776629 - DNA, 62 bp, Homo sapiens
cgggagctgcaagataaaagtgatgtgttggctgggcgcggtagctcaagcttgtaatcccg

SEQ ID NO: 6776630 - DNA, 82 bp, Homo sapiens
cgtagggcgacgccgtgtcccggcactcttctatgtcaaagaaagaggcgccgggtacgtggcgctcgaggtactccttgcg

SEQ ID NO: 6776631 - DNA, 79 bp, Homo sapiens
gtctgactcgataagcacaggagacgcacagccaggccctggctatctggcctcgtgaccatggtttttcagattagat

SEQ ID NO: 6776632 - DNA, 81 bp, Homo sapiens
atagagtgacagtgaagtgtttaaaggcatggtttctaggatcagacttcttgagctggcacttctccatactgactctgt

SEQ ID NO: 6776633 - DNA, 125 bp, Homo sapiens
ggcttctccagtcgcgtctttctcactcactggggagcccggcggtggcggcacctttcgaggtagacccgctgagctgctagcccgccggccagcgagtgagaggtcggacagactgtggagcc

SEQ ID NO: 6776634 - DNA, 59 bp, Homo sapiens
agattatctcctgattttaaggccaactgtgccgtgtaacacaatcaggggaataatct

SEQ ID NO: 6776635 - DNA, 129 bp, Homo sapiens
aggctcacacctcatgtccttttactcaggtcttgggacgacagagcccagcttgcacatggagccaggaggcagaatgtccaagctgggccccccacgggaccatgaacaagggacccttgtgtgcct

SEQ ID NO: 6776636 - DNA, 80 bp, Homo sapiens
cctttttataatcttcctatttttgaggtgttggaacattagtcttcaaggccttcttgggagagattgaactggatggg

SEQ ID NO: 6776637 - DNA, 111 bp, Homo sapiens
accagaagttcttaatctgaggttcatggagtcttaggcaatctatggataggctccacaggcagccacatgagctcctgaacttttttttgcagcattgtgaactgtggt

SEQ ID NO: 6776638 - DNA, 60 bp, Homo sapiens
tggccaatggctccggcctcatggttcctcaaggaggccagggtaccatcaacatggccg

SEQ ID NO: 6776639 - DNA, 82 bp, Homo sapiens
tgggctggaaactgtcagcaggacagagatgcaaaaatagaataggacagtgccatcgagcctgctgaggttgacatgccca

SEQ ID NO: 6776640 - DNA, 84 bp, Homo sapiens
ccaagtctttgctattgtgaatagtgctgcaataaacttatgtgtgcatgtgtctttatagtagcatgatttataatcctttgg

SEQ ID NO: 6776641 - DNA, 64 bp, Homo sapiens
gctatcgtccagcccttgcagcttctttggtcaccagaaaaatgacagagggctgactaatagt

SEQ ID NO: 6776642 - DNA, 74 bp, Homo sapiens
gctccaggtagacctggacaaccactcagcctcagggaaaaccatccagaggctgccctgtctgtctcctgggc

SEQ ID NO: 6776643 - DNA, 70 bp, Homo sapiens
gtgtatgtgttcatgagagtgtgcttgtgtatgtatgcatgcacatgtaacatatatgtagcatatatat

SEQ ID NO: 6776644 - DNA, 64 bp, Homo sapiens
cactggtggaaagcatctgatagccgtcttatttctcttcggacccagtgctgttcattcagtg

SEQ ID NO: 6776645 - DNA, 70 bp, Homo sapiens
ctaggttataaattgacacactggcatcaatgcagtcctaggatgccagtgtgccaatttacagctgaag

SEQ ID NO: 6776646 - DNA, 75 bp, Homo sapiens
ctgccagtgcattctggcagaacaggtgcttagctgatggcacttgataactgggggaagcacatactctggcag

SEQ ID NO: 6776647 - DNA, 77 bp, Homo sapiens
ttcctggtgtccctcagatgcactctgcgtacctctccctgccgtagaggctgaaatctgagggcttcatcaaggga

SEQ ID NO: 6776648 - DNA, 68 bp, Homo sapiens
ctgttgcccaggctggaatgcagtggcgtgatgtcagttcactgcaacctccgcctcccgggttcaag

SEQ ID NO: 6776649 - DNA, 68 bp, Homo sapiens
ggctctgagtctgctcctggtagcagatcttggatgggtcaaagttgcacagggcggtctttttcgcc

SEQ ID NO: 6776650 - DNA, 57 bp, Homo sapiens
ggagccaaggcttgcaatctgcagaacacgctttctggctgaattagccttgggttc

SEQ ID NO: 6776651 - DNA, 98 bp, Homo sapiens
tcctaattaagcaatcataactaatattggttaatatgtgtattgagttaggtaagcagtcataactaatattggttaatatgtgtactgagttaggg

SEQ ID NO: 6776652 - DNA, 62 bp, Homo sapiens
tagcgagtccttctcagtcagcctggttgttatgggttgctctgggaaatggattcatgctg

SEQ ID NO: 6776653 - DNA, 76 bp, Homo sapiens
ggcaagatccaaggggctaggagctcacactgagaccaagttcacagtgcatcatcattggccagtggatgttgtc

SEQ ID NO: 6776654 - DNA, 129 bp, Homo sapiens
tccttgttcttttcttagttgaacttcattacttgtaccaatcctttaaaacaacaaaacttactgatttggtttagaagggctggtcagaaatggcagtctctgattaaagacctaagccaacttgga

SEQ ID NO: 6776655 - DNA, 82 bp, Homo sapiens
gcctggcttcaggtccctgtgagccttggactctctcctctctctttggagtgtccttggcttgaggcacctcatgctgggc

SEQ ID NO: 6776656 - DNA, 83 bp, Homo sapiens
tggagacagaccacttggataagaaacagtcaagagactttatcatctgtttctcccatgtccaagtgagtattctgtatcca

SEQ ID NO: 6776657 - DNA, 55 bp, Homo sapiens
gggactggaggacctgcctccaaggtggctcatattggcaggtggcctcagttcc

SEQ ID NO: 6776658 - DNA, 86 bp, Homo sapiens
gagcagtttggtttttttctagctcaaagattctagtgtaacaaatagtggataccttagttgtgaaagttccttccagatttctc

SEQ ID NO: 6776659 - DNA, 61 bp, Homo sapiens
tctgttcagaaatggaagtgccatgctaatgcttgtggcagtgccattgtctcatagcagg

SEQ ID NO: 6776660 - DNA, 59 bp, Homo sapiens
ttcactgtgaataaaggctcccaatgaattctcatgagtttttaatggtcatagctgag

SEQ ID NO: 6776661 - DNA, 98 bp, Homo sapiens
ttaagattaccatagtatatcttcagaaattataggtaactaaagaaactgcagtatgatcaatggagatgtaacttgtctatctgaagtaattttga

SEQ ID NO: 6776662 - DNA, 69 bp, Homo sapiens
tagcattgcggttttgctatgtttgtgttttgataaattaatgtaaaaacatgcagcacatgaatgcta

SEQ ID NO: 6776663 - DNA, 70 bp, Homo sapiens
tgaaatgctgtcttgacctttctctctccattggtattgcagatattcagagggaaggacagatgtttca

SEQ ID NO: 6776664 - DNA, 83 bp, Homo sapiens
gtccaagatacaagtgctagcagatattgtgtctactggggacccactcctggttcacagccttctcttcactgtgtcttcac

SEQ ID NO: 6776665 - DNA, 88 bp, Homo sapiens
agcaccattttgcaggacacgtctaataactttcagtcatttatcactattcccaaatgccaggattattagaggcaaatcaggtgtt

SEQ ID NO: 6776666 - DNA, 60 bp, Homo sapiens
ttttgggttgtttttatttgtttgaagtagtgggatattttggacaaatgcaatttaaag

SEQ ID NO: 6776667 - DNA, 72 bp, Homo sapiens
atgtacatatagcctggtgagacggttgacaggagcaacctgcccacgtcatgtttcatttgtgctgtacat

SEQ ID NO: 6776668 - DNA, 71 bp, Homo sapiens
ctgccactgtaagtttgaaaataacaatgttattttctattttgttatttttgtctttgcagtacctgcag

SEQ ID NO: 6776669 - DNA, 61 bp, Homo sapiens
tactgcctgggggagacagctggtttgccacctgcaatgtctgtgacctcttaggcaagtg

SEQ ID NO: 6776670 - DNA, 63 bp, Homo sapiens
ttgcttccagggactcatacagctgttgtatcagcagggaaatgtgtcagtctttggaagcaa

SEQ ID NO: 6776671 - DNA, 84 bp, Homo sapiens
ggcaggcgctgtcagcccgggagggctgtctgggatttctagagggtcccagaacgggttcttcccaggccgatcccgcctgct

SEQ ID NO: 6776672 - DNA, 74 bp, Homo sapiens
atgcaggcctggtggtgctattccttctctcttgttcacggctcaaggccaggggctggcgcctccttctgcat

SEQ ID NO: 6776673 - DNA, 93 bp, Homo sapiens
gtggcatctttgggactcgaataaaatcttgctgttttcaagcctgtactcttggctgcgaagccacaactttttcttagcagtctcagccac

SEQ ID NO: 6776674 - DNA, 62 bp, Homo sapiens
gggaatttatgagaataattagttttgtgttgcttatattagagctggttatcttaattctt

SEQ ID NO: 6776675 - DNA, 61 bp, Homo sapiens
agtaatgaggatgtttgcaaaagtctcaattaaggacaaagttgttggcacccttattact

SEQ ID NO: 6776676 - DNA, 62 bp, Homo sapiens
tgaagttgaggtgcaaaccagtttaatgcaagctgtaccatgcgacgcctctcactgcttca

SEQ ID NO: 6776677 - DNA, 101 bp, Homo sapiens
cacagactctctcgggtctgggaaagttaatgtatctcatgtaactaactgacattcaccaaacgtaagaacagataaagtttcccccgacagaccctgtg

SEQ ID NO: 6776678 - DNA, 124 bp, Homo sapiens
tttgtaagtattagaatcacctggtggtcttgataaagtacgtaggcccaggcctagcctacttcaaagagcctggtcctgtagcacttgattagttctccaggtgatgccaataccctccaaa

SEQ ID NO: 6776679 - DNA, 62 bp, Homo sapiens
ttttggcttttcctcagcaagcttgcccttagtgacaggattgcagaagagagaagctagaa

SEQ ID NO: 6776680 - DNA, 55 bp, Homo sapiens
gctacctggagaatgtgactttgtctttaggagaaaatcactttgtacaggaagc

SEQ ID NO: 6776681 - DNA, 59 bp, Homo sapiens
cttctgggtgcctgagagagagacagacagacagaacggtttcaaaggcacctatgaag

SEQ ID NO: 6776682 - DNA, 81 bp, Homo sapiens
ctcaattatgatagacctcaatgtagacctcaacatatatcatgtgttcctctctaatttgtggctttgtttgtagttggg

SEQ ID NO: 6776683 - DNA, 88 bp, Homo sapiens
acggttattgctttcagaacagggattgggcctgtaatctttagtaagagagaaagacagagtaggcccaatccctgttgtgagctgt

SEQ ID NO: 6776684 - DNA, 90 bp, Homo sapiens
cctgtgtgtaaagagtgttccaaacggatataacagcaaacgcacaggccatgacctgggagcgtgcttgtcttgtttgagaaacatagg

SEQ ID NO: 6776685 - DNA, 56 bp, Homo sapiens
ctgtcagcaaatcagtgtctggacagccagctgcagggcctgagcatggctggcag

SEQ ID NO: 6776686 - DNA, 84 bp, Homo sapiens
agtcacaagcaaaatggcttttgcacttaaatcggacacaaaatccattttggctcactgtaagggctaatgctttcagtgact

SEQ ID NO: 6776687 - DNA, 75 bp, Homo sapiens
tctatgcattatggtagggctgtacaaattaggttttttcaacatatatttattgagcacctcccatatgctaga

SEQ ID NO: 6776688 - DNA, 56 bp, Homo sapiens
gcttgagacccagggagaagaacttctggtgccaaagttctttctggaaggtctgc

SEQ ID NO: 6776689 - DNA, 62 bp, Homo sapiens
ggccctgctcaggctgcgatgaaaatgcgaagcacctactattttcagcctgagcagctgcc

SEQ ID NO: 6776690 - DNA, 72 bp, Homo sapiens
tttcctagagagccagcatttgggccctgctggcttcattgaaagtaggcaggctcaaaagctggtaggaag

SEQ ID NO: 6776691 - DNA, 76 bp, Homo sapiens
gttttcttttgtaaggaatattcttggtgaagtaaagacacttaatagtcaccaacggctccttctcaatgagagc

SEQ ID NO: 6776692 - DNA, 94 bp, Homo sapiens
gctgcttggaaaacattgctggaacactgggatccactgagggagattcttccagaagtgtcctgtgtcccagactgtgacttttctaaccagc

SEQ ID NO: 6776693 - DNA, 61 bp, Homo sapiens
agcccaaggccacacagttagttaaaaggaaggactaacttagtacccaggcgttcgggct

SEQ ID NO: 6776694 - DNA, 68 bp, Homo sapiens
cagcaatgcctttcttagccctgaaggagcttcgctttctgtaagagttaagaaaggcaagtcacctg

SEQ ID NO: 6776695 - DNA, 62 bp, Homo sapiens
gcttatttattttctcgttgctcacagctctggagctgtcatcatttgagagaagaaagagc

SEQ ID NO: 6776696 - DNA, 97 bp, Homo sapiens
ttttgtggtttccatatctgttgcatatcatgttcaaacaaagatctcacattggagcagaaatatgctgattagatgaatggcattaagtacaaaa

SEQ ID NO: 6776697 - DNA, 79 bp, Homo sapiens
gggacccctgccacccccagcagggaaaggaggagaaggtgacactggccctcctgttgtcctgctggggcagaggccc

SEQ ID NO: 6776698 - DNA, 79 bp, Homo sapiens
agaaccacagtggagctgagtgtcctaggcatgggcttagcccagcgactgtgacctcagctaaccaatccagttaact

SEQ ID NO: 6776699 - DNA, 83 bp, Homo sapiens
tgtgcaatttactgggtttcctgtctttctctcacactagaaagtaatctttctgagttgaggaaatgcatttgccttgcaca

SEQ ID NO: 6776700 - DNA, 70 bp, Homo sapiens
tttcaacttgctttccaaatgactcacttcagtttcagctgagagaggcagaaggaaggcaaagttggga

SEQ ID NO: 6776701 - DNA, 83 bp, Homo sapiens
tattaaggcagttaaacaggtttttgaatggccccttttaacttttgggtcaggctgtcacttcttatttctctgctctaata

SEQ ID NO: 6776702 - DNA, 80 bp, Homo sapiens
ttatatagttttagaatgtttaaaaatggttatgatggagttcccaagaataaagatttttaggcatttcttctatgtga

SEQ ID NO: 6776703 - DNA, 62 bp, Homo sapiens
tgtctttccaaggctctgtgcctctttgtagtaaagggaagctggggagctttggagaggca

SEQ ID NO: 6776704 - DNA, 57 bp, Homo sapiens
ccctgcagaaccacagacaaactgtctttagaccaaagttctcactgatctgcaggg

SEQ ID NO: 6776705 - DNA, 55 bp, Homo sapiens
gcggcattccactctgggccctttgaagcctttgggccacaagcggaggagccgc

SEQ ID NO: 6776706 - DNA, 62 bp, Homo sapiens
ttcacagtgtttctcacggttaggatgctgactaaaccccagactgcaagcgaggctgtgaa

SEQ ID NO: 6776707 - DNA, 62 bp, Homo sapiens
caccagagttgtccaaatgattctacagtgtgatgtaattagtttatttggggactttgctg

SEQ ID NO: 6776708 - DNA, 57 bp, Homo sapiens
tcttattgggaagaaattgtgacaagtgaaattgtgacaagtctcagccaatgcaga

SEQ ID NO: 6776709 - DNA, 66 bp, Homo sapiens
cagttgtctcaacaccacttgctgaagaggctgttctctctccattgagtggtcttggcactcttg

SEQ ID NO: 6776710 - DNA, 120 bp, Homo sapiens
cattctctgcccttctcagccccactctgagcccaagcaggctgaccctgatgggccacatcattctagtttctggttgggttcagccaataagaggcactgactggagaccagagattg

SEQ ID NO: 6776711 - DNA, 55 bp, Homo sapiens
gagcccagtctgctcctgcgcccaccgggcagggctgagggccgcagctgggctc

SEQ ID NO: 6776712 - DNA, 89 bp, Homo sapiens
gctttgggtgttgacggtgaagtgggaatacttcttccctgagttgtcctggggagggattctccatttctggtttacaagaccagagt

SEQ ID NO: 6776713 - DNA, 86 bp, Homo sapiens
cctggcagctcctgaggactgctgggatgatgacacagcatttttgcatcagcatcgtactcacagggactcggagctcagccagg

SEQ ID NO: 6776714 - DNA, 68 bp, Homo sapiens
tgaggagcagctctgagctctgtggcttttgtgaccatggggtcacagcagctaaaggtgtctcctca

SEQ ID NO: 6776715 - DNA, 59 bp, Homo sapiens
ttgaactgtaagcatgtctgccctttgctctggagggagatactatctttacaattcaa

SEQ ID NO: 6776716 - DNA, 72 bp, Homo sapiens
agtcatatactgccttgtagattattagcattcgatgtatatgtgtctagtctacatggttagtattaagct

SEQ ID NO: 6776717 - DNA, 64 bp, Homo sapiens
cagacatgggacatagatccttgaggtttctggtgaaatctgcacatctgtgtttttgtatctg

SEQ ID NO: 6776718 - DNA, 68 bp, Homo sapiens
gaaagagtgtacaaaagtctgttacttggtacactatcccaccaacagtatagcttttgactgctttc

SEQ ID NO: 6776719 - DNA, 55 bp, Homo sapiens
gggcctgcatgcagaagggcttccccggttttgggtggaaggccacggcaggctt

SEQ ID NO: 6776720 - DNA, 71 bp, Homo sapiens
cctgtttagtctctcaggaggttttcctgcccacggggggtatggctgcctcccaggagaatctggccagg

SEQ ID NO: 6776721 - DNA, 66 bp, Homo sapiens
gatcttactgctcttggttgagttggtgtccaatagacagtttcagaggttagagcagtgggagtc

SEQ ID NO: 6776722 - DNA, 60 bp, Homo sapiens
tgaatttttttcagcatttccttttaaagaggttataaagttaagctgtaaaaggattca

SEQ ID NO: 6776723 - DNA, 100 bp, Homo sapiens
gagcttactctatttttctttacatgagtactcacttaggaaaggccatatgagcctacattgagaaggtggtcatttgcaagccaggaagagagagctc

SEQ ID NO: 6776724 - DNA, 99 bp, Homo sapiens
ttgcccggtggttgtggggaagggcagcctgactcacggtctgagtcccaggaacggatctgacctggaggaggtcccttctctggaggtgctgggcaa

SEQ ID NO: 6776725 - DNA, 57 bp, Homo sapiens
gtaagtaatttttgagagggtgctcttaatctctatcctcatcaaactttcacttgc

SEQ ID NO: 6776726 - DNA, 91 bp, Homo sapiens
acctctacagtatttaaggcatacatattgttataggtagcttttgttttgcatctgacctcaaaatgtgtatttcaatataaataggggt

SEQ ID NO: 6776727 - DNA, 77 bp, Homo sapiens
ctaggccttggtttccttaacagcctaaagggacagggaggtggaccctttgtggcaggagcggagaccgggcctgg

SEQ ID NO: 6776728 - DNA, 120 bp, Homo sapiens
gcctttgccctcaattgcaaacagagtggagtgtctcttagctaagaagtttgtgctgctcaagggtttgcacaaatacaaagttgagaaatactccttgctgaaaggggtgtaaaaggc

SEQ ID NO: 6776729 - DNA, 85 bp, Homo sapiens
agtaataagcagaaaagtctgggccacagagtgagaaatgtcctaaaaagtggacagttttaatgtggttcaatctttttttact

SEQ ID NO: 6776730 - DNA, 63 bp, Homo sapiens
caggaccttccatttctaaaccagatgtgattaccttattggatgaagaaaggaaggaacctg

SEQ ID NO: 6776731 - DNA, 55 bp, Homo sapiens
gcaggatgggtgtagcccagcagggtggccgcctggtgttacctccttcctttgc

SEQ ID NO: 6776732 - DNA, 64 bp, Homo sapiens
gggaggttaattggagcagcaggcctggagccactgcagggctcctggctccaatcaacctccc

SEQ ID NO: 6776733 - DNA, 55 bp, Homo sapiens
ctgaatgtcgatcagcttgggtcagagtctttgccgtggctggactggcattcag

SEQ ID NO: 6776734 - DNA, 89 bp, Homo sapiens
ctcaaagcgaaggccaagatcaccaagaatcttcactttttacttctgtgagacaggcttccttcttgggattcttggctgtctttggg

SEQ ID NO: 6776735 - DNA, 122 bp, Homo sapiens
gcttctgattgcaaatgaggtgagcatggactttggtgaatcagttttgttgacgctattgttttatcaaataactaatttattaaaagaatgcatgaagcttcagactgtaatcagtccgt

SEQ ID NO: 6776736 - DNA, 60 bp, Homo sapiens
ggcagcactgtcttgtcttaggactcagaaagtccagtcctgagatgagacagtgctgcc

SEQ ID NO: 6776737 - DNA, 58 bp, Homo sapiens
gtgtagatgtcacttggtgtaggaaggcagtaattcctgcacactgatgagatcacac

SEQ ID NO: 6776738 - DNA, 102 bp, Homo sapiens
tcatttggggtccatcttatttcctggggcacagctgggtctcttttcccagttgccaaactgaaggagtctcagctgggcctgaggaagggcagtagatga

SEQ ID NO: 6776739 - DNA, 73 bp, Homo sapiens
ggctctcggcggaccctgggaataggaggtgcaaagcgcgctcacacgcagcccaggtccgcggccgagagct

SEQ ID NO: 6776740 - DNA, 61 bp, Homo sapiens
acagacttacctaaggtcacacagctaagaagtcgtgaagctgggatcgaatcaagtctgt

SEQ ID NO: 6776741 - DNA, 69 bp, Homo sapiens
ctagaacccgtgttccccggtgccacgggtgctcgtggtgggatccctggctcccggaacagggtctgg

SEQ ID NO: 6776742 - DNA, 95 bp, Homo sapiens
ctctgactattcagtggacaggaatgttcaagtctcattccactgtgatgcttctcctgaacatccctgtacttcccacagaactcttacaggag

SEQ ID NO: 6776743 - DNA, 130 bp, Homo sapiens
aatgaggaacgggtggggtactgtgagcgtgggcagcatagagataaaacagtttgagcatctgctgcctagagtgcatgttttatctttgtggtccctaaagcacatagcaaaacacagatttacagtt

SEQ ID NO: 6776744 - DNA, 76 bp, Homo sapiens
atggggcatagtactggaacaatgaaactctgtagtatggctttgcttgtgatttcaaaggttctgcatgccccat

SEQ ID NO: 6776745 - DNA, 70 bp, Homo sapiens
cggcatgcacggcccggccgggtacccggcgcacggccccggaggcctggtgtgcgccgcgcagctgccg

SEQ ID NO: 6776746 - DNA, 60 bp, Homo sapiens
gtctttcttcatgtcggcggctctcgggggccagcctccgcccgcacgtatggagtggac

SEQ ID NO: 6776747 - DNA, 129 bp, Homo sapiens
ggcattggtggtgatgcaagagctacccttgaaggagaagagcagaagtccttggatccaagttgacctatttttggccgagtctccttttatcctgtcgctggtggatctgtagcttgatttgtcacc

SEQ ID NO: 6776748 - DNA, 118 bp, Homo sapiens
gttggtccaagttcagtatgtgaatggcctgtggagaagctggcacctgcaccaagcaggtaaacccacacctgaggggctgcaggccagctcaggccccatgcctacaggagccggc

SEQ ID NO: 6776749 - DNA, 70 bp, Homo sapiens
gacactgcaggcagagaggagcatttaatcaatcaattaattaattcagtgaatctctgttgagcgtatc

SEQ ID NO: 6776750 - DNA, 94 bp, Homo sapiens
agaggtgcaaaattggtaggggagagtagagggtctgattgaaattctgtccctggaacaagaagccaatcagctctctgctcctctcttctct

SEQ ID NO: 6776751 - DNA, 114 bp, Homo sapiens
tagggaaggagaaagagaaagaagagcaagagagaaaccacattgcctacattttctaaaagcaaggcctgtaattttcctcttttgaaaatctttttaaaaaacacttgccta

SEQ ID NO: 6776752 - DNA, 64 bp, Homo sapiens
tatacacattacagtttcaggagcactgggctagtcccatggttttcagactttaatgtgtgtg

SEQ ID NO: 6776753 - DNA, 57 bp, Homo sapiens
gtagaactggggtggcaagttgagatgaccctaaggtctctgtggcctaccctctac

SEQ ID NO: 6776754 - DNA, 72 bp, Homo sapiens
gtcagtggtagggctagttcaggggctgcagtagtgctggtgcccacaggtggaaccttctcctgccctgat

SEQ ID NO: 6776755 - DNA, 69 bp, Homo sapiens
atatgcagatagtcccctactcaggaacatttatgttcccttagtgggttattaaaaactctgatatat

SEQ ID NO: 6776756 - DNA, 67 bp, Homo sapiens
gatccacttgctcagtggcagggctggtatttagagctgtgcaggcagatgtactgagggagggatc

SEQ ID NO: 6776757 - DNA, 85 bp, Homo sapiens
tactggaaatggagacttgggtgaggcttcttcttgcctccaggaggggtgaaatggcccaaacacccagtgtctttgtgcagta

SEQ ID NO: 6776758 - DNA, 75 bp, Homo sapiens
tgctaatgtttcatttttagatttacaaatgaggggaacctgtaaaaggaggattgaaaatggaaaacataagta

SEQ ID NO: 6776759 - DNA, 60 bp, Homo sapiens
gtgatcctgttagatcccattagatttaagatgtctacatgttccttctgacagggacac

SEQ ID NO: 6776760 - DNA, 88 bp, Homo sapiens
ctgtcctctaccaggaccttatgaattgccctgaaaggtgctggttatacctgcaaaaggagagtcttgagtcactggtggagagcag

SEQ ID NO: 6776761 - DNA, 68 bp, Homo sapiens
ctgtcacccaggctggagtgcagtgatgcaatctcggctcactgcaacctccacctcctgggttcaag

SEQ ID NO: 6776762 - DNA, 57 bp, Homo sapiens
gcccagtcaggtccaaggccaccgctgcttgggctgtgccatccgcttgacctgggc

SEQ ID NO: 6776763 - DNA, 72 bp, Homo sapiens
tgaggggtggcaaacgtaccagcataaactgaaggttggacgaccctagtttcaggctggcacccaccccca

SEQ ID NO: 6776764 - DNA, 78 bp, Homo sapiens
ccctatcactgacctcttgtcggagctccagatatatcctgttgtctgctggagatcttgacattgaagtctatgggg

SEQ ID NO: 6776765 - DNA, 81 bp, Homo sapiens
ggaagctatgaggagagagaacacttgggtccatttgtttctggcttttgttatcttctttctgaccacttcaaagctttc

SEQ ID NO: 6776766 - DNA, 67 bp, Homo sapiens
cctcctgcccttgcatagatcttggcaatggttgctgtttcagtgccaatttagtaaaggcagtggg

SEQ ID NO: 6776767 - DNA, 86 bp, Homo sapiens
cagtgggctggagccccacagtggccacccactgagacagggcattagtttcctgttcaccatggtcacgtgctcccagctcagtg

SEQ ID NO: 6776768 - DNA, 77 bp, Homo sapiens
acttaaaagttgcttccctaactcttatccctgggaaatgatctagcatccaagtatgaggaaacaaccttttgagt

SEQ ID NO: 6776769 - DNA, 68 bp, Homo sapiens
gcagtagtattagcaatgcctcatgtcccagcactttgcggtttagaagcattatttaattttactgc

SEQ ID NO: 6776770 - DNA, 61 bp, Homo sapiens
tgtcagcagaaatctggtctgctttctgaaatgggatgtaggtttccaaattctctagaca

SEQ ID NO: 6776771 - DNA, 97 bp, Homo sapiens
gtagtaaagtagtgttctaaagttggttctgtgacatgttgtgcctgtgggtagagctcaaatagtccattgatgccagctgaactatcttccttgc

SEQ ID NO: 6776772 - DNA, 56 bp, Homo sapiens
agaaaacactgcaaagctgattggtaaattgattttgccatttgctgtggttttct

SEQ ID NO: 6776773 - DNA, 91 bp, Homo sapiens
gacagggatgtcccagaacaaaggccacagtcagtgggtgctgagccccacagccctgcagccatggcctgtggtcttggtggttcctgtc

SEQ ID NO: 6776774 - DNA, 65 bp, Homo sapiens
gagcatggcattaacaagatggaaggctaacttaatggaagttccattgataaaatgccatcctc

SEQ ID NO: 6776775 - DNA, 60 bp, Homo sapiens
acacatgtgcatgtgcacacatgcgtgcacaaacatgcagtgacacacatgcacatgggt

SEQ ID NO: 6776776 - DNA, 55 bp, Homo sapiens
tttcatagtatcttgcaaaggaaagaatcttttcctttgcaagatgtctatgaaa

SEQ ID NO: 6776777 - DNA, 69 bp, Homo sapiens
ggctctgtgtggtatacagcaacacagtttgagatatttctgtgatgttctgtatatcatatagttgct

SEQ ID NO: 6776778 - DNA, 86 bp, Homo sapiens
tccagacaacagagcagggtctgttgttttcacaagtcacagcagctgggaggcaattgtgaagacaacagcttaatctaactgga

SEQ ID NO: 6776779 - DNA, 87 bp, Homo sapiens
gactttatttttccatcgtggggctcctgtaatttttaaaagtctgtttgaagatattaatttggcaggaatgaggaagatggattc

SEQ ID NO: 6776780 - DNA, 78 bp, Homo sapiens
ggaaggtattagaatctttagatgaggactctaaaattcgggaaagttaagtcacttatctaaagacacatatctacc

SEQ ID NO: 6776781 - DNA, 75 bp, Homo sapiens
ctgccttccagcatctctgcaccctcccccacgccctgaaggaagtgggggtggaggagagagcgctgcaggcag

SEQ ID NO: 6776782 - DNA, 108 bp, Homo sapiens
ggatcatctccttgccgcacacgatggccttgtagaagagcttgtgggccttgcccttcatgccacgctgctgcaaggacacatgtgtcaaggcacaggccctggccc

SEQ ID NO: 6776783 - DNA, 79 bp, Homo sapiens
ctgttatatagcaatagataactgagatagactgcatttaataaaggttagctatttttaagttatcatcgttatccag

SEQ ID NO: 6776784 - DNA, 69 bp, Homo sapiens
gacatactgtatccaaggggaaagacgtctgggttctggtcctgactctgttacccttggtgagtggtc

SEQ ID NO: 6776785 - DNA, 72 bp, Homo sapiens
ggaccctgagggagcaagaggagatgatggcccctagctccacagctcctaacaaaggctctctctgggacc

SEQ ID NO: 6776786 - DNA, 75 bp, Homo sapiens
gttaatgtttgtaagaaggtgaaactgattatcttgacttacatagtcagtttctaaatcttaccaattcttagc

SEQ ID NO: 6776787 - DNA, 101 bp, Homo sapiens
tgaggtaggagaatcgcttgaacttgggaggcagaggttgcagtgagctgagatcatgccactgcgctctagcctgggagacagagagagactccatctca

SEQ ID NO: 6776788 - DNA, 57 bp, Homo sapiens
gagaggaggtttattgggtggtaagaagtttatgatacagctcagaacctcactgtc

SEQ ID NO: 6776789 - DNA, 58 bp, Homo sapiens
gctgcctgcttcatgtgggagaagcacagactttctcaagtgtgaattgagcagcagc

SEQ ID NO: 6776790 - DNA, 57 bp, Homo sapiens
gggactgtgaggcctaactgggaccccaggcaatgggaatcccatgagcccactccc

SEQ ID NO: 6776791 - DNA, 73 bp, Homo sapiens
tctgcatcccgcttctggagtctttacagacaaaactcatttttgtctgtaaagactccaaaagccatgtaga

SEQ ID NO: 6776792 - DNA, 75 bp, Homo sapiens
tgatttcctgggcacagcgttgggctcttgcagtaggcccctgcacagagggccctggctggctccagctcctca

SEQ ID NO: 6776793 - DNA, 90 bp, Homo sapiens
gcttagtgctaaacatctgttgcttcctaacaagtgctgcattcattttaatggcactggtgcacagaggtaaacggagctttggcaggc

SEQ ID NO: 6776794 - DNA, 95 bp, Homo sapiens
tgtacagatgagagtacaaattagcttcttacatttcatcctcatgaaaacccaaggatgtggatggagtatttattattctcattttaagtatg

SEQ ID NO: 6776795 - DNA, 57 bp, Homo sapiens
caacacattccatagactgctgtgagttggtgccaactcaacagcagggaagtgttg

SEQ ID NO: 6776796 - DNA, 55 bp, Homo sapiens
atgttccttgctctcaggtaaggccactcgattgtcttccgagagaaagggacat

SEQ ID NO: 6776797 - DNA, 67 bp, Homo sapiens
gttacatcaacgaagatggaaaaggaaagagacaaagtctctttgcctaactgttttcaattgttat

SEQ ID NO: 6776798 - DNA, 64 bp, Homo sapiens
ggggcagcccagaaggagctgttgggtggcgccagcaaccaggtctccttgtgggtcttgcccc

SEQ ID NO: 6776799 - DNA, 66 bp, Homo sapiens
agtggcaccagcggcatgcaagcccagggctgcctgattctggactccatgctgcctggagcttct

SEQ ID NO: 6776800 - DNA, 84 bp, Homo sapiens
gattttacatagaaaaacaaactcaggtcaaaaagcattaacaatttattcagtttgcagctgcctagttctttatgtgaaatt

SEQ ID NO: 6776801 - DNA, 76 bp, Homo sapiens
gactgctacgctttaacgtgagaagaagggcctcttgattcccagccagccctttgcatttgaaacctggcagctc

SEQ ID NO: 6776802 - DNA, 79 bp, Homo sapiens
ggatagcaactatttttctgcaggttgtatgctcattcttttaggaaatctagcaacttctacagatatagcattatcc

SEQ ID NO: 6776803 - DNA, 77 bp, Homo sapiens
gcagcatgagtctgcccaccgtcccactcaatcagctgacaactcgagtgagtgtgaggtgggagcttggaatctgt

SEQ ID NO: 6776804 - DNA, 79 bp, Homo sapiens
agtatgttgaacaaagtacttttcagtgcttaaaagctaattgagtaggtatggatcagtagtttgtaattaacatatt

SEQ ID NO: 6776805 - DNA, 55 bp, Homo sapiens
ccttgcagacctcccatggctgcctgctctgtagggcctcaggagggctgcatgg

SEQ ID NO: 6776806 - DNA, 88 bp, Homo sapiens
gtgtacaaatctggaggcttgaggggagacagagtggactccggcattttccgagtcctacatttcttcctctggcctgggagtacgc

SEQ ID NO: 6776807 - DNA, 57 bp, Homo sapiens
cattggtcttctaacagagagatatttctttcttttgtctctctgagaatattaatg

SEQ ID NO: 6776808 - DNA, 56 bp, Homo sapiens
atttgcttctgagtgtttaggaagccccttgtttctgaggatgaaggatagcaagt

SEQ ID NO: 6776809 - DNA, 70 bp, Homo sapiens
gggagtttgtaagtagcaggttactattttaatattttatattcaggcataacctgttagccatactcct

SEQ ID NO: 6776810 - DNA, 66 bp, Homo sapiens
ggagacaaccatactgttacagtttccctaatgggggccagaaggagaaaacagtgttttgcctct

SEQ ID NO: 6776811 - DNA, 74 bp, Homo sapiens
cagctctgccctcgcacatctgccacctgctttctgtggctctgtctggcgcttgtggggaatggcagagactg

SEQ ID NO: 6776812 - DNA, 55 bp, Homo sapiens
agaggatgcctccaaatgagggcagagcagcagctttccaactcagaggccctct

SEQ ID NO: 6776813 - DNA, 65 bp, Homo sapiens
gtggtatgaaggaggccggcagccaggtttgcactttcacttgttgcctttgcatcttcatccat

SEQ ID NO: 6776814 - DNA, 118 bp, Homo sapiens
taagtcacacagcgatgcttacctgcaaaggaggatgggaaagaagcaagtgtccagcttttttccagtctcttttgtgcagattggacaaggaagatagacatggctgagttattta

SEQ ID NO: 6776815 - DNA, 128 bp, Homo sapiens
gtgtaatactgtgaattctgtagtatctatatacaaggtaggtttaggtaatatattgcttaatttttctaaattgtttttatcacctgaaaccaacttgtgtactggtatcacactcatgttaacac

SEQ ID NO: 6776816 - DNA, 103 bp, Homo sapiens
aagaaaaagaatccacaggaacacaattattttgaccttgtatccagacaagatttatatctgtgacagggatcagaatgcaattcctagttgagtcattctt

SEQ ID NO: 6776817 - DNA, 70 bp, Homo sapiens
ctagtgtcaaagttatgaatgataagatttgcttcaataggtaaattctcttctcctgtaatgtcactgg

SEQ ID NO: 6776818 - DNA, 58 bp, Homo sapiens
ggggagtggtgtcactgagaggaaggcccaagcactttccccttctgcacctcttccc

SEQ ID NO: 6776819 - DNA, 81 bp, Homo sapiens
gttacgggtttgtggaagctgtgaacaagctacgtgactttctaaactttacttatctctgtttgcagccttatctgtaac

SEQ ID NO: 6776820 - DNA, 86 bp, Homo sapiens
ccaccatgcccaataccctccaaatcataggggacgaggggctgtctggtctcagtgggagggtgatgggcagatcatcctggtgg

SEQ ID NO: 6776821 - DNA, 89 bp, Homo sapiens
gagacagatcagctggccagttgtcctggcttgggcagcttctcaggtgcagccaggtcgacagcatgaccagcccacgagctcgtctc

SEQ ID NO: 6776822 - DNA, 104 bp, Homo sapiens
gtgtggccattaatagtatactggaacagtaggtgtaaccaaacaagctgatacacatttacctatagcttgctaaccctacttcagtaatagatgtcctatgc

SEQ ID NO: 6776823 - DNA, 81 bp, Homo sapiens
aagagggcacaattgaatgtcacttatggggcagtggaagcacttcctctgttatattggtatatttacatggactcaatt

SEQ ID NO: 6776824 - DNA, 76 bp, Homo sapiens
ttcaaagcgaatacaagcctgccacctggaggaaggactgcaccccttcaggtactaagtgctgattcactatgaa

SEQ ID NO: 6776825 - DNA, 88 bp, Homo sapiens
gtaaggattcttacatagagaagttacagtggaagataattcacattgattcattgtctgctttggttcactatgatagggaccttat

SEQ ID NO: 6776826 - DNA, 70 bp, Homo sapiens
gtttccaaccctgggctcccgacttacgccctatgtgagtgtgaggagtaggctgagggtgtggttgaac

SEQ ID NO: 6776827 - DNA, 65 bp, Homo sapiens
ggattgtggcatcaagatttagattcattcctctgtttgttggagtcattgaagccagtatatcc

SEQ ID NO: 6776828 - DNA, 72 bp, Homo sapiens
tcttaaactttgctgtaattctctatgacatgccttttaagaaggatatgagaatagggcaaggtcctgaga

SEQ ID NO: 6776829 - DNA, 61 bp, Homo sapiens
ggaggtgacaggtcgtcgtatgagtgcctggggactcctagacataagctctgtcaccttc

SEQ ID NO: 6776830 - DNA, 55 bp, Homo sapiens
tgtgcccttctgatgctttcctcttggtattagctacaagtaacagaagagcaca

SEQ ID NO: 6776831 - DNA, 55 bp, Homo sapiens
agcataagttggtacagccactttagagaacttcttagtggtctctacttacgct

SEQ ID NO: 6776832 - DNA, 77 bp, Homo sapiens
gtcatggacagcctgtagaccatgcctaccccccggggccttcatcccccatgttggcagggctgcttgtctaggac

SEQ ID NO: 6776833 - DNA, 57 bp, Homo sapiens
tttctttttaattttatgttgcatcattggtttttgaagcagctgcttgaaaagaaa

SEQ ID NO: 6776834 - DNA, 67 bp, Homo sapiens
agccatgagaatgaagaagacttaatggatatcatcctcctttataatctatttggttcacattgct

SEQ ID NO: 6776835 - DNA, 72 bp, Homo sapiens
cttatgtttccagctgtggattgggtactttctaaacagagatgtctgaccactagactgatgaagcaaaag

SEQ ID NO: 6776836 - DNA, 80 bp, Homo sapiens
tctttgtctggccaggctgggctacaagttgagtggagggtaatcctacatgcacacagctgggcctggctgggagctga

SEQ ID NO: 6776837 - DNA, 78 bp, Homo sapiens
atttctcattgttagcagagcagctgacagaatatgatcacaaatgttgctgatgctgttctgttaggaggtagaaat

SEQ ID NO: 6776838 - DNA, 56 bp, Homo sapiens
gggttttgggcaatgacctaaacacctttatcagtgcctgggaatgctcaaggccc

SEQ ID NO: 6776839 - DNA, 92 bp, Homo sapiens
gaaataatttatatagatgagtttaagtatattgatttgtgtgataaaaaaatatcataagattgaaacttggaagtcttttaagttgtttc

SEQ ID NO: 6776840 - DNA, 75 bp, Homo sapiens
gaaaacaaactcaaatggaagagtgtccttgtatattaatgaacaaaatttacttctgaatgtgagtttgttttt

SEQ ID NO: 6776841 - DNA, 69 bp, Homo sapiens
aagtggtccagagatggacgagcagatgacttcagcctggaacatcaacgtctatctgttggactcctt

SEQ ID NO: 6776842 - DNA, 71 bp, Homo sapiens
gtgcccattcccaccaggtatgtgccatgtgcctgcatgcacaggggcacatgtatgtgggagtgtgccac

SEQ ID NO: 6776843 - DNA, 77 bp, Homo sapiens
ggggctccggatagccacaggtggtccaactggccactcatcgcctggccacccccaagtaggtggtctgggtcccc

SEQ ID NO: 6776844 - DNA, 86 bp, Homo sapiens
ttcagttcttggccatgacaggacaggaagtcagacatacctccctgtacctccctccctcttatggtttagacccaacaactgaa

SEQ ID NO: 6776845 - DNA, 61 bp, Homo sapiens
gaaatgagttgattcagagactctggtcatcatcccagcgtcactgcctcttaactttttc

SEQ ID NO: 6776846 - DNA, 64 bp, Homo sapiens
ggatctttaatacagaagcaagacactggtaggcaaacagtacatgggtcatgctctgtgttcc

SEQ ID NO: 6776847 - DNA, 87 bp, Homo sapiens
tctcaggctgtgtccctctacagggaagcgctttctgttgtctgaaagaaaggaaagtgcatccttttagagtgttactgtttgaga

SEQ ID NO: 6776848 - DNA, 55 bp, Homo sapiens
tgtctctcatggtttgtaatgtggatttctttatacctattgctctagagagaca

SEQ ID NO: 6776849 - DNA, 79 bp, Homo sapiens
cagatctggcctagaaaaacatcctcctgacccctcagagagagggagagacacaggaatgtgtttctaggctgttctg

SEQ ID NO: 6776850 - DNA, 59 bp, Homo sapiens
ggtgctggggacctaaaggctttggcccctgagcaggttggaggtgggtccccgcagcc

SEQ ID NO: 6776851 - DNA, 56 bp, Homo sapiens
cgtatccttgtttcagagtctgctttggaggaagccaatctacaacaaaggatatg

SEQ ID NO: 6776852 - DNA, 56 bp, Homo sapiens
tgtcagctcctcctgagtgcggcttccagaatggctgggcctagaggaagctgaca

SEQ ID NO: 6776853 - DNA, 95 bp, Homo sapiens
tagtagtaatgctgcgaggtagaaggcataaaaccaattttgttcttcagaacttaaaattcagtgtttctttcacttgtgtgtagcacctgctg

SEQ ID NO: 6776854 - DNA, 64 bp, Homo sapiens
gttatctttgactgccattcttgaccacgtaatgtgtcagtcatcactggtagcaaagatttac

SEQ ID NO: 6776855 - DNA, 64 bp, Homo sapiens
ctgggggctagagagatgaaatatcttatctagaaaatgagaggttttgaatctagcagcctag

SEQ ID NO: 6776856 - DNA, 87 bp, Homo sapiens
ggagtctcactctgtcgccaggctggagtgcagtggtgcaatcttggctcactgcaacctccgcctgctgggttcaagtgattctcc

SEQ ID NO: 6776857 - DNA, 55 bp, Homo sapiens
aaatggagacaagaacccaggacttgtgactctcgggtcagggctgtttctattt

SEQ ID NO: 6776858 - DNA, 87 bp, Homo sapiens
tccatggtagttacttgcacactttcaggtcctctttgctactctaaggtaatatgcaaatttgaagatgttgcttgactcaatgga

SEQ ID NO: 6776859 - DNA, 75 bp, Homo sapiens
tttggtattcccatttcctagcacgttgctctctagagcttcatatcaacagcaggtggtagagaaaaatccaga

SEQ ID NO: 6776860 - DNA, 130 bp, Homo sapiens
tgttggaatgtatattagattaaattgatagatggttgtgtgaaaagaactgcaatattcaaacttgactgtatgcataaaattatttacagaactataccacattaataccatcttatttcatttcaga

SEQ ID NO: 6776861 - DNA, 60 bp, Homo sapiens
gagttaatgtgtacacaaagggcttatgacatagtccttgccctgtgtagttacatgctc

SEQ ID NO: 6776862 - DNA, 80 bp, Homo sapiens
gggcttgccttcttccctcctaccacgtgaaaagtatgctgtgactagcttattggtcccaggaggagaatgggcagccc

SEQ ID NO: 6776863 - DNA, 73 bp, Homo sapiens
gatctgcactctgagaggcttgggtccaagtttgactcagctattctatcttagagaatctgctgtgcagatt

SEQ ID NO: 6776864 - DNA, 88 bp, Homo sapiens
agagctcaggcagataggaacaagtttccttgctgtggttcgtgtttttgacagtgggaacatttgttctagtccagccgttcactct

SEQ ID NO: 6776865 - DNA, 93 bp, Homo sapiens
tagggagaagagaaatatgacaaaaatgctaactgtgttgaatctagatgatgaacacatgggtgtttattgtactatatctgtttttctcta

SEQ ID NO: 6776866 - DNA, 73 bp, Homo sapiens
tggaggctggaagtccaagatcagggatcagtcgggttctagccagggccctcttctaggtttcagcctgcca

SEQ ID NO: 6776867 - DNA, 62 bp, Homo sapiens
tcaggcccatttgtagccactttgcatcctagtctattgcagttggcttcctgagggtctgg

SEQ ID NO: 6776868 - DNA, 80 bp, Homo sapiens
ggatgctttgctcttgtttgaggttgtttgcatacagaattgttcatgtgtttgatagcccagagaatgcacagagctct

SEQ ID NO: 6776869 - DNA, 115 bp, Homo sapiens
gaccctgggggctcaggatccagcaaggggcggcaggagtaaaggaggaaggaatgacaggtgcaaataccttcccaccaaagcccttgttgccctctggctcctccccagagtt

SEQ ID NO: 6776870 - DNA, 72 bp, Homo sapiens
tcagccatgtgctagggtttactccaggagcatattaactcccaggattttaggctctcagtagctgggtga

SEQ ID NO: 6776871 - DNA, 80 bp, Homo sapiens
atttcattatggaagggtttataaaatgttggataattctgtgtaattctcacaattgagatcctcccacccaatgaggt

SEQ ID NO: 6776872 - DNA, 79 bp, Homo sapiens
gccgagctcctcaaaaatgtaccaattacatttttgctaactaaacgtaaagatgttttaatatttcgaggagttgtgt

SEQ ID NO: 6776873 - DNA, 55 bp, Homo sapiens
cttcttcagttgcatgtattgggataattaatgcaaggaagtgcaacagaagaag

SEQ ID NO: 6776874 - DNA, 86 bp, Homo sapiens
tggaagactctggacaggcagagatgagaaggagcatgtaactgaaactacaagttgtctcctaatgtctgtttcctcttcttcca

SEQ ID NO: 6776875 - DNA, 77 bp, Homo sapiens
ttataacgtagttataggtactctgcagcatttccccaaagttagcagtatcatgtttcctgtgactatctttgtaa

SEQ ID NO: 6776876 - DNA, 91 bp, Homo sapiens
gcatgacttctggggctaggccataaaaggcatagaaacttatcttgtctcttggattgcttgctctgagaatgaaaagaaatggttatgc

SEQ ID NO: 6776877 - DNA, 70 bp, Homo sapiens
ggggtggggctggcctggggtgagggctggagggctccgctgcagctccctggtagccatgctctccccc

SEQ ID NO: 6776878 - DNA, 80 bp, Homo sapiens
ccttgctaacctgctgctttgatgtgtaaatcataaatcaatcaccattattcactcattaaagcaggaccttaacaagg

SEQ ID NO: 6776879 - DNA, 75 bp, Homo sapiens
gttcctgttggaaaggccaggctgtggcggggcatctagacagcttaccgtagcagctctttactaaccagtaac

SEQ ID NO: 6776880 - DNA, 66 bp, Homo sapiens
gaaactcagtctggaaatattgacttcagagaagaattttgcataagtcatgtccagtggggtttc

SEQ ID NO: 6776881 - DNA, 79 bp, Homo sapiens
tgttttatcatgtgtttgtacctttaaatatcatatggtttagttgtgcatgtttttgagatacaaacagatagaagca

SEQ ID NO: 6776882 - DNA, 91 bp, Homo sapiens
tttggctgctttttccccacttcgctcatgtattttccagcctgaaacagacttcttgggaaagaatgagaaggtgaggtatggctttaga

SEQ ID NO: 6776883 - DNA, 62 bp, Homo sapiens
cttcaatttactcaaccaaaaaatggcggtggggggaacatttatggttgcagaggttggag

SEQ ID NO: 6776884 - DNA, 68 bp, Homo sapiens
tccaaggacgctggacccctgctgtaacaagacacagatcacacgggaggggttctcagccttaagga

SEQ ID NO: 6776885 - DNA, 58 bp, Homo sapiens
agggtaggtgtaagatagccctgtagaaccaaaagtgggtttcttgcttctgatccct

SEQ ID NO: 6776886 - DNA, 111 bp, Homo sapiens
ttagaagttagtgcaagtattgaattggcagaccatcttattaacaagttataaatagtttgtatcaaataagtggtcagatgagaagttcataatttgcaaagcctctga

SEQ ID NO: 6776887 - DNA, 64 bp, Homo sapiens
cccttcatacctatgatttttaatatcccaccatcaaaaatgaacatctttgggtcctgaaggg

SEQ ID NO: 6776888 - DNA, 82 bp, Homo sapiens
ctggcttctcccagggagatgagagggtacctgttctatggcccagagggcagcatgaggaccctcatcccagggaagccag

SEQ ID NO: 6776889 - DNA, 77 bp, Homo sapiens
gaactggcccatccagagtgatggcacctgctgggtgcgccgggcgcccgcggtaccactcattccctgggccgttc

SEQ ID NO: 6776890 - DNA, 66 bp, Homo sapiens
atttttgggccacaagccatgggaccatctcagaatgatggtctgttggcatgtgctaattaagat

SEQ ID NO: 6776891 - DNA, 59 bp, Homo sapiens
cgggaaagtttctcacacatgcagagacttgaggttctgaatgttaggaaactttcttg

SEQ ID NO: 6776892 - DNA, 66 bp, Homo sapiens
ataagtgagaacaaaaattagaggctataaagatagactggaatctgaattactgttttcatttgt

SEQ ID NO: 6776893 - DNA, 81 bp, Homo sapiens
ctgagagctggaccttctctttcacccgttcgacgcagcaagttcttaccttgcctggggtggatgggtccaagttttcgg

SEQ ID NO: 6776894 - DNA, 85 bp, Homo sapiens
ttgtttcagaagggtgaatagaattacagtgtgtttggaatataattcaaagataatgtagcattttaaagaaccctactaataa

SEQ ID NO: 6776895 - DNA, 73 bp, Homo sapiens
ccactttgccatgttgcctgcagaaacttgaggtcaacaagagagcgttctgcacagcatggcctcagagtgg

SEQ ID NO: 6776896 - DNA, 60 bp, Homo sapiens
gagataccgttgaataaaataacagctgaatgtacttagctggtttcaatgtgttatttc

SEQ ID NO: 6776897 - DNA, 129 bp, Homo sapiens
aaacttaaaaatttagagaataggttatcagttagagaacacagaaatctttggattaaaatatttgtatgaataccaagtactttttataatgcaaagaaaatgtttttgcctgtctctttatgaatt

SEQ ID NO: 6776898 - DNA, 72 bp, Homo sapiens
cctcatagagtgatgtaaggtatgtgaagtgcctggccacagtttaccctcaacaaattcactctataaagg

SEQ ID NO: 6776899 - DNA, 66 bp, Homo sapiens
ttctgtttggagtcatcctaatgcctccagaagcctgggagggctcaattgactcctgaggcagaa

SEQ ID NO: 6776900 - DNA, 64 bp, Homo sapiens
agtggcctgagggtagcacacctgcagcaatccggctcttgtgatttttgcctttatggtcact

SEQ ID NO: 6776901 - DNA, 66 bp, Homo sapiens
ctagtaagcagccagtgagtatggagggctgtgtgccaagcacagcttgtctcctggtgctgctag

SEQ ID NO: 6776902 - DNA, 71 bp, Homo sapiens
ttgaacagtttggaactcttgcaacataaactcatggatgagagttaacacaagtaagattccaggctcaa

SEQ ID NO: 6776903 - DNA, 97 bp, Homo sapiens
gggagtcaaaggcagccaagaaagtggcacccctagggaatgagcagatggatccctgggcctgccaccatcttaggaaatcaggtctctgatcccc

SEQ ID NO: 6776904 - DNA, 76 bp, Homo sapiens
gttctatggtctttagttgaaacatgtggtagtgactgcgatactgctataagaggacagatgaagattacagagc

SEQ ID NO: 6776905 - DNA, 58 bp, Homo sapiens
ggaaagacttaatttccactttctgctgcagtcagcatggttgagattcagtccttcc

SEQ ID NO: 6776906 - DNA, 64 bp, Homo sapiens
catgtgcatgctgttctgccagaaagatggagccacaccaaactttctgcagaaggcatacatg

SEQ ID NO: 6776907 - DNA, 88 bp, Homo sapiens
gtgctcagagatgggaggctgctttcctcctatcctggatctctggaggatgtcagcaaggcaccccccatttcttacactggagcac

SEQ ID NO: 6776908 - DNA, 57 bp, Homo sapiens
tgggctggctgaggcattcactgaaactacatcacagctgaaagtctctctcaccca

SEQ ID NO: 6776909 - DNA, 72 bp, Homo sapiens
aagttaggctcttaagcataacttaaaggcccataagcataaattaacttttaagacatgtgagcataactt

SEQ ID NO: 6776910 - DNA, 80 bp, Homo sapiens
ttctgttggagatagtttctaatgttgaaattatcagtgaatgttcattaattcttcatgttgaagctgtcaccatggaa

SEQ ID NO: 6776911 - DNA, 82 bp, Homo sapiens
ggacagcaatagctttgacagttgcaggcagtcttgccacattacatccctctgtttgcatgctagtcagtgattcctgttc

SEQ ID NO: 6776912 - DNA, 72 bp, Homo sapiens
ctgggcaatatggtgaaaccccatctctacaaaaaattagccaagcatggtggcgcgtacctgtagtcccag

SEQ ID NO: 6776913 - DNA, 73 bp, Homo sapiens
ttggggattagtgacatgttatggactggctactttgagtagcactgttctagcatgtttttgtgtactccaa

SEQ ID NO: 6776914 - DNA, 61 bp, Homo sapiens
tttcactgggctaacatcaaggcatcagccgggctgcattctttctgtaagctccatggaa

SEQ ID NO: 6776915 - DNA, 58 bp, Homo sapiens
catgtccatttatgcacagaaaaggctagctctgagcttcatggcaagaatggaaatg

SEQ ID NO: 6776916 - DNA, 64 bp, Homo sapiens
gaagaggagtagagaagacctagatgttggctttgactctgctggtagctcattccatgacttc

SEQ ID NO: 6776917 - DNA, 125 bp, Homo sapiens
ctccttcccttccccaccctctggccccagaatctccttggtctcgttccaggccccccagccctgggcctcagggtctgaggagaccgtctggagccaggcctgagtcgggggtgggaagagag

SEQ ID NO: 6776918 - DNA, 82 bp, Homo sapiens
tctttaagcctcagttttctcctctgtaaaatggagatgaatctcatttactgtaggagtgaaccaagatgaggaatgagga

SEQ ID NO: 6776919 - DNA, 96 bp, Homo sapiens
cgaggtctggagaatgtgggagaaaaggcttgaagaggttttgaagccagtttctgaaggcctctggagagtttggactggcttctttggcctttg

SEQ ID NO: 6776920 - DNA, 81 bp, Homo sapiens
ctctaccatgtactgcctacgtctgctataattcagtggttcttcactgttagagcaaacgtatgttttgtgatggttgag

SEQ ID NO: 6776921 - DNA, 73 bp, Homo sapiens
gacgcttacatcactccagaaccactggcagggagagcctgggccaaaggacctgtgggtgacattgaagctc

SEQ ID NO: 6776922 - DNA, 80 bp, Homo sapiens
tgtctcactgtacatgcatcttgtctatgtcttccactagagaccatgagggcagagatcagacctatgtacgttgcaca

SEQ ID NO: 6776923 - DNA, 79 bp, Homo sapiens
actctctttgaagagataaagtggctttattttctctccaactcaaataaagtgtattctttgtcatctgttagtaggt

SEQ ID NO: 6776924 - DNA, 55 bp, Homo sapiens
cccaggctggagtgcaatggtgcgatctcggctcgctgcaacctccgcgtctggg

SEQ ID NO: 6776925 - DNA, 107 bp, Homo sapiens
ggaaaggaaaggacagtgtgatcctgaagtgcagcatgaagcacatgtgacatagcagcaataagtcatctttctgctgcacttagctttagtctgactctcattcc

SEQ ID NO: 6776926 - DNA, 61 bp, Homo sapiens
ttagaggctgaggttttaatgcccatgtagacatgggaaatatggcattgggcctgactga

SEQ ID NO: 6776927 - DNA, 62 bp, Homo sapiens
gcctcacagtgtgaaggtcagtcacatggtgtgtgaaaaacccttgtcacctgtaaaggggc

SEQ ID NO: 6776928 - DNA, 68 bp, Homo sapiens
atataaagtgtgttttgattacgtcatgagtcatattaatcaatgtactagtctcacacatgttgtat

SEQ ID NO: 6776929 - DNA, 66 bp, Homo sapiens
ttcaaggacacccaggaataaggactggggatacagaattccagttccctttttgggtggaaagaa

SEQ ID NO: 6776930 - DNA, 64 bp, Homo sapiens
cccaaccattctttcaggttctataggaagcctacagtagggcttcctatcccatctgagtggg

SEQ ID NO: 6776931 - DNA, 80 bp, Homo sapiens
ctccttcccgcctgcatccttcccatttaaaccagggcttcttggcttggatgtggagggtgatgggactgggaagtggg

SEQ ID NO: 6776932 - DNA, 60 bp, Homo sapiens
tgcagaatcaagtccaattagcacgtgactttgtccgatgaatgatggcttgtttctgca

SEQ ID NO: 6776933 - DNA, 64 bp, Homo sapiens
gttaggatatggtgaaatggagatgatgcttaataaaggatataattcagcattatattctagc

SEQ ID NO: 6776934 - DNA, 84 bp, Homo sapiens
caagctgtgtccttttagtttaagaatcaccagagactacataattttagtttttacagagagagaactggactggctagtttg

SEQ ID NO: 6776935 - DNA, 102 bp, Homo sapiens
atggatttgcctattctggacatttcatgtaaatggaatgatacaatatgttaccttttgtgtctgtattcttttagcatgatgttttcaaggtttatccat

SEQ ID NO: 6776936 - DNA, 80 bp, Homo sapiens
ttattagatgtgtttaagtagagaataaataaccaattattaaggttgttgttaaggagtctctttgaatcatctgataa

SEQ ID NO: 6776937 - DNA, 61 bp, Homo sapiens
tacaaaacagtgctctggtccttgttgatcataaagaagaggttaagagtgctattttgta

SEQ ID NO: 6776938 - DNA, 58 bp, Homo sapiens
gcctccagaactgggagagaataataatttctgttatttaagctacccggtctgtggt

SEQ ID NO: 6776939 - DNA, 61 bp, Homo sapiens
ttgttgcagagatgaatgacataggtgtaaatagggctgaactcattcaatctctgaacag

SEQ ID NO: 6776940 - DNA, 72 bp, Homo sapiens
ccgcccccaccgctgctcgtgccaggacgcgcagtttgcagttgcagctctggcactggcgcgggatggcgg

SEQ ID NO: 6776941 - DNA, 56 bp, Homo sapiens
agcccctgtccatctgagatggcagagtggtggtgatgccaagtatggcagaggct

SEQ ID NO: 6776942 - DNA, 68 bp, Homo sapiens
gagccaacgggcatccgatgtgcactggtgcagcacccactgaggcacaggcagtgcccccgcggctc

SEQ ID NO: 6776943 - DNA, 61 bp, Homo sapiens
aaacagtatatgaaatgttaggatattctaaattggatatctgtattttaagatgctgttt

SEQ ID NO: 6776944 - DNA, 67 bp, Homo sapiens
tccggttctcctgggccctccggatcaggtaggggattacctcctccaaggagccatagggaatgga

SEQ ID NO: 6776945 - DNA, 73 bp, Homo sapiens
gtgcaggctctggagtaggatcactggggatctaatcacagtcccacactgaccagctgtgagacctgagcac

SEQ ID NO: 6776946 - DNA, 56 bp, Homo sapiens
gctcccaccgccgctatgggtaggccatgcagcattcctgagggcggggtgggcgc

SEQ ID NO: 6776947 - DNA, 111 bp, Homo sapiens
cctagttttaattcgaggggaaaaggaaacgttaaaccatatgtaattatgaggtcaattgccctgagtttggacgtttttataatactaatgaaggttaaagaggctggg

SEQ ID NO: 6776948 - DNA, 96 bp, Homo sapiens
acaccctcaggcagcctccatcatttgatacagctgtctgttcaagtctgccaacaggacagttaaaaatagatggccagtctcctttaagggtgt

SEQ ID NO: 6776949 - DNA, 85 bp, Homo sapiens
tcctgaaaattggaccaatattgacagcttttgcttaatccagaacagctcattgagaaaggggtcaatatctctcccactagga

SEQ ID NO: 6776950 - DNA, 71 bp, Homo sapiens
attctgcagttatattccatagattcagaagtatgattccatatgtctaagtctgtgaatataaacagagt

SEQ ID NO: 6776951 - DNA, 70 bp, Homo sapiens
caaggcttcacgtccccagtgcccccacctttaccagatggggacctgagctggggatgtcacagtcttg

SEQ ID NO: 6776952 - DNA, 60 bp, Homo sapiens
ggtggttcggtggaatggactgcaacgcattagatactgctgttattcttccaggccacc

SEQ ID NO: 6776953 - DNA, 68 bp, Homo sapiens
gattggtccctcatggacacatgatagtggggagcctccgtcatgtttgggccatgagtggactgttc

SEQ ID NO: 6776954 - DNA, 66 bp, Homo sapiens
cttgttaaattaggtagtgtttttaaggatttccttgtatgaatgtatcctaatttttaaaacaag

SEQ ID NO: 6776955 - DNA, 57 bp, Homo sapiens
tccaagtataaattagatactgtgggtcatcttggcaaatctgaggttgtatttgga

SEQ ID NO: 6776956 - DNA, 58 bp, Homo sapiens
tatttgtcttctgagagaattatcccattgagagtgggataaggcaggaggataagta

SEQ ID NO: 6776957 - DNA, 69 bp, Homo sapiens
aaagtgctgggattacaagtgtgagccactgtgcccagctcacacctataatcccagtcccagcatttt

SEQ ID NO: 6776958 - DNA, 60 bp, Homo sapiens
gggggttaggctgcgggctgctgagacgccgagctgtttctcagaagtgcagctgcccct

SEQ ID NO: 6776959 - DNA, 91 bp, Homo sapiens
gcttagaaactccagaaaagtgtgaatgacttattctgattctactttagacagataaagaaacaatcacagatggaggacttttctgtgc

SEQ ID NO: 6776960 - DNA, 98 bp, Homo sapiens
ggacaatgacggggtggggaggcatcccatccagcctcagagggcccagagaatggctgagcaggacagtgggagaccagaccctaccccgcaactcc

SEQ ID NO: 6776961 - DNA, 63 bp, Homo sapiens
gaaaatgtagagggtactcacacaaagccaagcaggtctacctgtgacctccctctatctttc

SEQ ID NO: 6776962 - DNA, 66 bp, Homo sapiens
gtaagtgaatagaagcttttaaataacaggagagagaaaaagctgtcccaaagcctatacacttac

SEQ ID NO: 6776963 - DNA, 65 bp, Homo sapiens
tcatcactgtgatgtctgctgtaatgaatgacatacttccagttataagaagcatcacaggaaga

SEQ ID NO: 6776964 - DNA, 60 bp, Homo sapiens
tcagttgctggatgtgcagctctcagaaaggcagaccttgggagtacactctgcagctga

SEQ ID NO: 6776965 - DNA, 106 bp, Homo sapiens
aaatgattacaagaaatacagtgtgggtttgggaggagtagatattaaagtggtgtttcttctatttctttatatacttacatgctatttttttaaaactttgttt

SEQ ID NO: 6776966 - DNA, 58 bp, Homo sapiens
tggttaatggcagccatttatgtaagggcggcttcttaattatggcttccattgacca

SEQ ID NO: 6776967 - DNA, 93 bp, Homo sapiens
tgcaggaagaggggataaagaaaagtttgaaaaatataacaatatgtccataaatatttcgtatgctctctgtgtcctgttttctttcctgcg

SEQ ID NO: 6776968 - DNA, 56 bp, Homo sapiens
aggcttatgtgcagtttactctggcactattttatgttgtcacactcacaaagcct

SEQ ID NO: 6776969 - DNA, 57 bp, Homo sapiens
catgtgcagcttcttcagcgagatctcacactccatcacactggaggagctgccatg

SEQ ID NO: 6776970 - DNA, 58 bp, Homo sapiens
tatttgcaagcatgcacaaaagcagtcacacaaacctgctcatgaagctctgcaaata

SEQ ID NO: 6776971 - DNA, 62 bp, Homo sapiens
ccagcctgccttgcaccggctctctgggttgtgctcacatgttaggtcgggcaaggtgctgg

SEQ ID NO: 6776972 - DNA, 55 bp, Homo sapiens
gaaagggccttggaactcaaagacttagatttgagtcttggtccaggctcatttc

SEQ ID NO: 6776973 - DNA, 73 bp, Homo sapiens
gtatgactcagcatgagtattgaacttgcctgtcttcacagaacacatggctcagtctcatgacaggttatac

SEQ ID NO: 6776974 - DNA, 60 bp, Homo sapiens
tgctgcctgtgtggccactcactctggggtgtaatccccaagttggactggacagcagca

SEQ ID NO: 6776975 - DNA, 60 bp, Homo sapiens
gaaaaggaggtgatacattccccatggtctgacccacagactttatgacctacccttttt

SEQ ID NO: 6776976 - DNA, 69 bp, Homo sapiens
catgaggtgtgggaggagctacataagttggatctaactttccaaataagtaatgtcttccttttcatg

SEQ ID NO: 6776977 - DNA, 63 bp, Homo sapiens
agccatcggcctatggctggccttaggaatcagtctctagccagactcaagggccaccaggct

SEQ ID NO: 6776978 - DNA, 65 bp, Homo sapiens
ctgggctgaaagctttctaattggtgttccatttcttcctcactacaggtaagctgtcggcctag

SEQ ID NO: 6776979 - DNA, 59 bp, Homo sapiens
ctggccccactggacagtgggcctcatccacctaacagtccatccatcagtccagccag

SEQ ID NO: 6776980 - DNA, 61 bp, Homo sapiens
actttactctttaattggggagatactgggtggtagggtttctttggtgggagattgaggt

SEQ ID NO: 6776981 - DNA, 56 bp, Homo sapiens
cctatggctcctgccctggagttgttcataagaccttccaggcagacagctatggg

SEQ ID NO: 6776982 - DNA, 64 bp, Homo sapiens
agttttatgggatttttaatttggcaaagacttctttggcaaaggtcagagactccctcaagct

SEQ ID NO: 6776983 - DNA, 59 bp, Homo sapiens
tctggtaataggcaatagcttgccaagaacttctggccaggctgaattgtcctaccaga

SEQ ID NO: 6776984 - DNA, 78 bp, Homo sapiens
gaaatgcaagggctttgaagcttggtgttgtcttaagtggtattttccacgaggagcaccagagctgggccgcagttc

SEQ ID NO: 6776985 - DNA, 76 bp, Homo sapiens
gaaatctgatccacaatgtgttgggttaagtttgggctcattccaatatgacccatttaacatattctttgatttt

SEQ ID NO: 6776986 - DNA, 59 bp, Homo sapiens
tttcttctatgtgtgatattttggtattaaagagccggggtattaaaatgaaggagaaa

SEQ ID NO: 6776987 - DNA, 97 bp, Homo sapiens
ctgactactgattttcacttaaatctgttgagaaaaaggcaattttgcttttgtttcttagcaacagatagcttgatcctgaaagtctaatggtaag

SEQ ID NO: 6776988 - DNA, 62 bp, Homo sapiens
ccttctgtctccctcatattgatgcatgactggtgtgaatgggtagagagagagaaaggagg

SEQ ID NO: 6776989 - DNA, 75 bp, Homo sapiens
gcccgggtcactcagcctgcctggttcctctaacctggcatgacagagaccgttgcaggctgagtgtatgtgtgt

SEQ ID NO: 6776990 - DNA, 75 bp, Homo sapiens
cagctggacctgagatgtgcacttttcgcttgcttttcattgcagaggagcagggacatggcatctctccggctg

SEQ ID NO: 6776991 - DNA, 69 bp, Homo sapiens
tgaatgaaggtttctagatgagttttgaagatgacctccatctttttttctccttctggactttatcca

SEQ ID NO: 6776992 - DNA, 61 bp, Homo sapiens
ctcccgggctcggggccccttcactggaggctgcaccccctcccaggctgcgagtcccgag

SEQ ID NO: 6776993 - DNA, 56 bp, Homo sapiens
actactgagaaatgtaggggcaggggccagagcctctgcccacatcactcaggagt

SEQ ID NO: 6776994 - DNA, 86 bp, Homo sapiens
tgttgccataaattggggtaattgagcagtttttaaaacgagcatgaataactgcatttaacaaatactctatcttcatgacaata

SEQ ID NO: 6776995 - DNA, 55 bp, Homo sapiens
ctgagtgctttgtcttgtaattcttcagctgaaaactacaacgccaggcactgag

SEQ ID NO: 6776996 - DNA, 64 bp, Homo sapiens
gcctaggcttcccgctcacatgcccccgcgacgcggcgggcgggccgggttggggaggctgggc

SEQ ID NO: 6776997 - DNA, 61 bp, Homo sapiens
cttctacacgtggctgtgccaagaaaggggcctcctcctttggcataccttagtggtggag

SEQ ID NO: 6776998 - DNA, 112 bp, Homo sapiens
gttcaagcaatcctcccacctcagcctccaaagtagctgggactactggccctgctcatactattttttgtagagacaggcttccactatgttgcccaggctggtcttgaac

SEQ ID NO: 6776999 - DNA, 77 bp, Homo sapiens
agagaagtttgaaattaggagaaatctggaaaaatctgtgtcacaaaaatttgtcctgagtcaaacatgttttctct

SEQ ID NO: 6777000 - DNA, 76 bp, Homo sapiens
aaatcctcaccctccactttatctgtctttagcacgaatgcagagacctcctagggaagtgtgaagggatgggttt

SEQ ID NO: 6777001 - DNA, 80 bp, Homo sapiens
atcggcctggcgcagtggctcacgcctgcaatcccagcactttgggaggccaaggagggcggatcacagggtcaggagat

SEQ ID NO: 6777002 - DNA, 63 bp, Homo sapiens
ggcctgagtctcccataggctaagtatttgccctgagtcataaagccagtgggaggcagtgct

SEQ ID NO: 6777003 - DNA, 57 bp, Homo sapiens
cccttccccaagtagagaggggagcatcccccgtgccccactcactgtgggggaggg

SEQ ID NO: 6777004 - DNA, 77 bp, Homo sapiens
gagagatgactagaaatgtattggtagctgagctgggaacagttttcaacatgctttatttctaaacattccatctt

SEQ ID NO: 6777005 - DNA, 74 bp, Homo sapiens
tctcatccaccctcaacaaagatagaaggatgctcttcctgtgcattcaagatctcctgggggagggaatggga

SEQ ID NO: 6777006 - DNA, 56 bp, Homo sapiens
atgagggaagctcacgtgtccacctggcaattggtaggagcatctggtttccccat

SEQ ID NO: 6777007 - DNA, 92 bp, Homo sapiens
tttactgagacagggtacacagtagtaggacaatatgtggtggaaaaaacagccacatttttctgctcctgaacagtgcatgatctagtaaa

SEQ ID NO: 6777008 - DNA, 72 bp, Homo sapiens
tgctttttgtgctctgcctggggtcatggcagggaaggcccagcaggctcccttgcagagcagggcagagca

SEQ ID NO: 6777009 - DNA, 61 bp, Homo sapiens
ttacagtagattttgaatgtggctgtaataaaacggcctttaaattttagaatttgtgtga

SEQ ID NO: 6777010 - DNA, 113 bp, Homo sapiens
gaaaggggaagccaaagattgtatctggtgttctctgttatcttctttctgtgaaagccctagctttcattagtatgacagcacgcagatcatctttattggcttttactttc

SEQ ID NO: 6777011 - DNA, 64 bp, Homo sapiens
ggacttgagtttgggagttctgtatgtttgagggcatccagaagtcagagtccttgaccagtcc

SEQ ID NO: 6777012 - DNA, 74 bp, Homo sapiens
tcagtatttgatacatgaaatggtggcatctgtccatttttctctttgctcatcttcattttgtccagtactga

SEQ ID NO: 6777013 - DNA, 76 bp, Homo sapiens
ggagcttgttcaaatgcagattctcattccataaatctgtggcagggcctgagaatttgcatttctaacaagctcc

SEQ ID NO: 6777014 - DNA, 55 bp, Homo sapiens
tgattaccatgtgctatgtgcctgctgggcactgcagaacatacactggtgaaca

SEQ ID NO: 6777015 - DNA, 63 bp, Homo sapiens
atgacaagggttgacacatgtcacccggccctatcaggagtgttatttgtttgccacttgcat

SEQ ID NO: 6777016 - DNA, 70 bp, Homo sapiens
ccctgagctccagcctcttctggaggtacgtgctactctggtcacacccaggtgaggttggggcacaggg

SEQ ID NO: 6777017 - DNA, 94 bp, Homo sapiens
gttttttgccccgtgagacagatagttttatcattacttccaagggaaaactgaggtataaggtatgtaaactatttgtccatggtcagaaaac

SEQ ID NO: 6777018 - DNA, 110 bp, Homo sapiens
agacagatactcagtgggctggggtcagccagcattacccctgacttgaactgtggaacaattcagccaagtgatgtggctgcaccctggcatcaccctaacctttgtct

SEQ ID NO: 6777019 - DNA, 70 bp, Homo sapiens
cccatctcctgtgtcttccccactggtgtcacacagtgtgtgagcaccctggggaagcacaaaggctggg

SEQ ID NO: 6777020 - DNA, 64 bp, Homo sapiens
ggtgtagcagtgtaggaatgtgaatcctggagataaatttcagggcacgtttctgcaatgctcc

SEQ ID NO: 6777021 - DNA, 94 bp, Homo sapiens
tgtgtagaagtgatataggaaactaacttatctttatatgttgttatgtacagttgtttgatttggttggttttttaaatttctaatttacaca

SEQ ID NO: 6777022 - DNA, 76 bp, Homo sapiens
tttaacattggcaaactcacattattagagaatgcaacactagtttaactgaatgaatggtttgtcttatgttaga

SEQ ID NO: 6777023 - DNA, 72 bp, Homo sapiens
ctttgccaagcactttacatatgtatgctcatttggttaaatgaggtaatgcatataaagtgcttagcacag

SEQ ID NO: 6777024 - DNA, 60 bp, Homo sapiens
tggcaaacgcttaagaagtggctcttggggtaaggtggggctgctttgtagcttttgcca

SEQ ID NO: 6777025 - DNA, 55 bp, Homo sapiens
ggacatggtactgctgaggttggcctgatgttggagtaacctggagaccaagtcc

SEQ ID NO: 6777026 - DNA, 71 bp, Homo sapiens
gaaagcagtatttagttctgttttgatttgttaagtttaagagacagtaatgccctaaatacttgcgtttc

SEQ ID NO: 6777027 - DNA, 75 bp, Homo sapiens
gtttaaaatgcctgccatttagaagtcttgcaacaagaaactcttacaagctgctaatggtagagtcaccagaac

SEQ ID NO: 6777028 - DNA, 90 bp, Homo sapiens
cagagttgcaggcggccccttgggatggagaatgggggaagctttatcccaagcttcagcccagcctccgcctccactgccccatctctg

SEQ ID NO: 6777029 - DNA, 64 bp, Homo sapiens
caaacctgttagaggtcatcgtgaaggtacatttgtcaaggcaggaggatattctaacagtttg

SEQ ID NO: 6777030 - DNA, 87 bp, Homo sapiens
catgtgcgtgtgtacttgttaatgtggtagtgcatatctgcttgtttgtgtatgaatgtgtgcccacttggtgtgcagatgtatgtg

SEQ ID NO: 6777031 - DNA, 60 bp, Homo sapiens
gcctggtgaggagaaatgctcagagccagacaactggctccttcattctcctgccaaggt

SEQ ID NO: 6777032 - DNA, 72 bp, Homo sapiens
agacaatatgtatattaagaattgatgctctgtgaggtcagtaactttatttttgatgtagtcatattgtct

SEQ ID NO: 6777033 - DNA, 108 bp, Homo sapiens
ttctttcccaggagtcagtgcttatgtctgtatgtggagaggggttgatattcagatcaactgatctatgaacagtatccatactgcccaaaacttctgaggatagaa

SEQ ID NO: 6777034 - DNA, 95 bp, Homo sapiens
ggaaagggaagggtagagagcagcgtgctgcagatgggtggcttgtttcctggagccgcgccccatctgagtgggtggctctgcttttcccttcc

SEQ ID NO: 6777035 - DNA, 55 bp, Homo sapiens
tggtcacatgcggggctgtagcctgtgagtgcaggaagctgttcctgtgtggcca

SEQ ID NO: 6777036 - DNA, 60 bp, Homo sapiens
gacagatgagttagaataggcaggcagggtcttgcagactgctttgatagcttatttttc

SEQ ID NO: 6777037 - DNA, 71 bp, Homo sapiens
ggttgttttctgataaggtcaatgcagtgctctgtaattaaacactacagaagtcttattagagaaagatc

SEQ ID NO: 6777038 - DNA, 66 bp, Homo sapiens
cagacacaggatccagggttgaggggttagtcagtttgtccttcagctggggccccctctgtcctg

SEQ ID NO: 6777039 - DNA, 76 bp, Homo sapiens
gttgtcattttgctgcatatttagaccttgatactctacttgctcctcaggttcttttgtactcagtattgacaac

SEQ ID NO: 6777040 - DNA, 72 bp, Homo sapiens
tctggggccaggtgtaggacaccaagggacatactggtatcctctgctctgtctttatatctatacccctga

SEQ ID NO: 6777041 - DNA, 77 bp, Homo sapiens
tcacattctggctggagtgcaggtgagtgatcagcaatgagctgtgaccacacacgtgcactccagcctgggtgtga

SEQ ID NO: 6777042 - DNA, 63 bp, Homo sapiens
acagaggttaggatgggttgtaaacactttattattatacagagcctaatatctaatctttgt

SEQ ID NO: 6777043 - DNA, 62 bp, Homo sapiens
ctccatttgtattccaggaatgtgatatatgtataatgtgatatcctggaatccaaatggag

SEQ ID NO: 6777044 - DNA, 64 bp, Homo sapiens
tagatacacatatattatttgtggctcaatttttgtttgggaatttaacatatgtgtgtacctg

SEQ ID NO: 6777045 - DNA, 55 bp, Homo sapiens
tggtgtactctcaagcagatgtctctactttaggcaaacatgttgtgagatacca

SEQ ID NO: 6777046 - DNA, 78 bp, Homo sapiens
ggtatcatagtcatctgtttacttttctgcttctccaattaaacaaggagtcatgtaatcacaatgacctaaggtact

SEQ ID NO: 6777047 - DNA, 71 bp, Homo sapiens
aggttttgggggttgtttgttacagtagttagcctatgctgactaatacattacctaacctctctgaacct

SEQ ID NO: 6777048 - DNA, 60 bp, Homo sapiens
ctgcatgagcctgaggctccttgagaagattctgggcagggagctaaaaggctggagcag

SEQ ID NO: 6777049 - DNA, 68 bp, Homo sapiens
acctggaggggaggtgtccccaaatctcattacctcctttgctctctctctctttctcccctccaggt

SEQ ID NO: 6777050 - DNA, 59 bp, Homo sapiens
ccggggctgaggcaacgcggagattggtgcctggcgcccctcttcggcctccgccttgg

SEQ ID NO: 6777051 - DNA, 66 bp, Homo sapiens
gcccctccttctagagaggtgagctggagaaggtcattttctcagttcctactttggtgaaggggt

SEQ ID NO: 6777052 - DNA, 69 bp, Homo sapiens
gagggatgaagaagcaagaggaaatgtggaccttggggaaggtaaacaggctcttgctctttggccctc

SEQ ID NO: 6777053 - DNA, 86 bp, Homo sapiens
catgtcttttttgtggctcttagtttatctttgacaaagttaatatattatgctgaatttaacttgggaaagacaagaaggaaatg

SEQ ID NO: 6777054 - DNA, 59 bp, Homo sapiens
tgcagttctatcacccaccccgtaaatagttttctgttgatggtaggtggtggaatgta

SEQ ID NO: 6777055 - DNA, 61 bp, Homo sapiens
agagctgcttgggaaccatcaattactgaatcgaagcaattgagggagcccggcgcggcct

SEQ ID NO: 6777056 - DNA, 105 bp, Homo sapiens
aggcctctccatcttgctcttcccatcttggccttacttgatgatgtataaagtcctctaaatggtcttatgacttaagtgggcccaggggaggggagaggacct

SEQ ID NO: 6777057 - DNA, 77 bp, Homo sapiens
gaaacacaaattgcagagcttcactctggactttctgattttggaaatctgcggtgaggcctgagaatttgtatttc

SEQ ID NO: 6777058 - DNA, 79 bp, Homo sapiens
aggtggatttaattgacaaactctgttgagataatattttctttgaaagaattaagctcaggggttcacaatttcactt

SEQ ID NO: 6777059 - DNA, 57 bp, Homo sapiens
ggctgcctggacctcctctttcaggttaacgctgacagaatggaggctcaggctgtc

SEQ ID NO: 6777060 - DNA, 58 bp, Homo sapiens
gctgctctttgaaatccatcactgctttgtaccaagactatgcctttcgaggggctgc

SEQ ID NO: 6777061 - DNA, 77 bp, Homo sapiens
ccaagttgtcataagcctattatttctttacattactgaagtgaaagacagcattaatggctaaatgccatacttgg

SEQ ID NO: 6777062 - DNA, 70 bp, Homo sapiens
gaactggggcccgggactcctcgcaaatgtgggacactgacattctgtgatgctgtcccaatgccctttc

SEQ ID NO: 6777063 - DNA, 64 bp, Homo sapiens
ccagccctccagactttggccatcctcttgttacacatggggaaactgaggctgggtgggtagg

SEQ ID NO: 6777064 - DNA, 61 bp, Homo sapiens
ccttacaaatatttgccttttatgtctctgcagtagctgagatactgtggcgaatgcaagg

SEQ ID NO: 6777065 - DNA, 55 bp, Homo sapiens
tggcttctggccaggcacaggagctctatgggctgtccctggactccaggagcca

SEQ ID NO: 6777066 - DNA, 96 bp, Homo sapiens
ctgtagagtaaatcctgtccttttgaatagaatgtaatctaatacattaaaaaatgtcctgaggcttttattttaaaggcagtgatattgctacag

SEQ ID NO: 6777067 - DNA, 70 bp, Homo sapiens
agaactcttaggaatgacaggtttcttctggttttgaccagaaagtaagtgccttttattcttatgttct

SEQ ID NO: 6777068 - DNA, 58 bp, Homo sapiens
aatgtgggggtgagctgtatatgaggcttcctgacatgctcttttcacttcccacatt

SEQ ID NO: 6777069 - DNA, 71 bp, Homo sapiens
ggaatgggaagtggctggtctttgctaatagagggccaaattcctgctcaggatcagccacctctttttcc

SEQ ID NO: 6777070 - DNA, 89 bp, Homo sapiens
tttaacaagagcttcagtgaatctttcatctgcgaagcttacagagcttcccaaacttgtggatagaatcacctggggatcttgctaaa

SEQ ID NO: 6777071 - DNA, 55 bp, Homo sapiens
gctggcttccttctgcagctagttttctctagttagtggcagagatggccacagc

SEQ ID NO: 6777072 - DNA, 82 bp, Homo sapiens
ccacttactctcttgtactctcatcattttgattaaatttttcatccttcaactggattatgagaataagggggtattttgg

SEQ ID NO: 6777073 - DNA, 75 bp, Homo sapiens
gggaagtgctgttgtgctgtactctacatggttatataaattatgcagtttaaggcacaattagcatgcattctc

SEQ ID NO: 6777074 - DNA, 62 bp, Homo sapiens
tgcccactagaaccaatgacatttctggattattcagatggcattaatttctagtgatggca

SEQ ID NO: 6777075 - DNA, 130 bp, Homo sapiens
tggcagtgataactgaaaggggctcatgattccacaggagctggttttcttctccatgacttttccaggaccagaaaaagctgtatcctgattgggtgacagacgtccttggagctattgctgcagatcg

SEQ ID NO: 6777076 - DNA, 55 bp, Homo sapiens
ggtggctcacgcctgtaatcccagcatttttggaggccaaggcaggcggatcacc

SEQ ID NO: 6777077 - DNA, 70 bp, Homo sapiens
cccagggaagaccacttcctggagggggcttgccacacttatgttcattccacagttgtctttcactggg

SEQ ID NO: 6777078 - DNA, 60 bp, Homo sapiens
gaatcaggttctgccgctgctctctgcctgcttgccaacagtgcagtgcagagccctttc

SEQ ID NO: 6777079 - DNA, 74 bp, Homo sapiens
gccatttttgggggaatctgattgtagcatttgtcacacaatattgttacaactatagatcccaagaaatgtgc

SEQ ID NO: 6777080 - DNA, 84 bp, Homo sapiens
cctgtcggacgagggccagctgcagcgagacatagaggatgacctgggggtcactgggcgccagctgctgagccctgtgtgggg

SEQ ID NO: 6777081 - DNA, 66 bp, Homo sapiens
gtctagcttcttccttctccccactggaagatgtcctgtagctgcccagataggaggaggctgggt

SEQ ID NO: 6777082 - DNA, 68 bp, Homo sapiens
gctgagggtgtccacatgggttgtcatttaactttaatctaccagcatccatggagagcactctgagt

SEQ ID NO: 6777083 - DNA, 85 bp, Homo sapiens
caatgatgcaatatgcaaacaaatacttactgaacctgtgctctgttccaggcacggtgctaagtgtttcatgttgctatctctg

SEQ ID NO: 6777084 - DNA, 64 bp, Homo sapiens
gctgggtgggtgctcgaggagagcttatttactcccttgcaatgcttcctcagcctcacctagc

SEQ ID NO: 6777085 - DNA, 76 bp, Homo sapiens
ttccactcctcctggtggggtggagggaccacatcagcacgatgtctgagttgccgctctacaacaggggagggaa

SEQ ID NO: 6777086 - DNA, 79 bp, Homo sapiens
gccttacacctagtggaggggagggacagggcattagagaatggttgccagagaatcacctctccttccaggatggggc

SEQ ID NO: 6777087 - DNA, 81 bp, Homo sapiens
caggcagggcagcccctcccaatcccagcatgggatgctagaccacctatgcagggctgggagggaaatgtctgagaactg

SEQ ID NO: 6777088 - DNA, 109 bp, Homo sapiens
tgaagccactgtagcttttgtgagtccaggagttgggtgacattattaaaccctcgtggcagtgtcgctgaagttcatgagtttccaaaatgaaggttccaggtgctca

SEQ ID NO: 6777089 - DNA, 59 bp, Homo sapiens
cttctcagtcttggttagagagactagttcttctaggaggctctgctggggctgaaaag

SEQ ID NO: 6777090 - DNA, 77 bp, Homo sapiens
ttcttcactgatctgttataatctcttttatgtcattggagctgaataaatactggttgaatggattagggaatgaa

SEQ ID NO: 6777091 - DNA, 77 bp, Homo sapiens
agcgctttcctctagtctaggccaatttatttcacacgtttactattgaccattaacacatgctggagggaggggtt

SEQ ID NO: 6777092 - DNA, 60 bp, Homo sapiens
gctgattgataaatgactaaatcagagagcaaaagagactgattctgttttatcatcagc

SEQ ID NO: 6777093 - DNA, 63 bp, Homo sapiens
gtacattgagcacgtactatgtgccacacagtgactggcacatagtatacactcaataaatac

SEQ ID NO: 6777094 - DNA, 113 bp, Homo sapiens
cgttgtccaatggcatcccagactctcattgcctgcttctgggtctgtgggaactcaaagtcccccaacagtccccagggctggggtgggtgagggagacgtgattggcaatg

SEQ ID NO: 6777095 - DNA, 62 bp, Homo sapiens
acattccaggcaaagggactagcaggagcaaaggcccctagctgggggtttgcttggcatgt

SEQ ID NO: 6777096 - DNA, 80 bp, Homo sapiens
ggtccagaaagactcctcgtgtggactttgcttctttatttgccaggaagcagtttggcccgagcagttcttttttgact

SEQ ID NO: 6777097 - DNA, 63 bp, Homo sapiens
gctgatttattgacctagtggtattttaattttgttttatttaccctttgtttatgaatcagc

SEQ ID NO: 6777098 - DNA, 109 bp, Homo sapiens
actgttggtcttctgtttagccattattctcagttctgtgcaggagtgagctgaaacaaagttgtatagcccagagagtgagaagctgcatttcatgtctcccaacagt

SEQ ID NO: 6777099 - DNA, 127 bp, Homo sapiens
tctagaaacgatttctagaaacaggtttctagaaacgatttctagaaacaggtttctagaaacgatttctagaaacaggtttctagaaacgatttctagaaacaggtttctagaaacgatttctaga

SEQ ID NO: 6777100 - DNA, 56 bp, Homo sapiens
ataagagcaggcttctggccagagtgagtgcagctctgccttgaagcaactcttgt

SEQ ID NO: 6777101 - DNA, 80 bp, Homo sapiens
gtttcatgagttcataaatctggagctgtggccaacactgggacctctgttggaaacttccagctttataattcagtagc

SEQ ID NO: 6777102 - DNA, 87 bp, Homo sapiens
tgttggtcatatttattattttatctgcttactttcagggtttcgtgcacctgaagttgccagaggaaatgtcatttataaccaaca

SEQ ID NO: 6777103 - DNA, 109 bp, Homo sapiens
ctcggcctccgctgctggagccccctcctctcaggatctcagccccccagacgtaaaggaagaggctggctgggtccctgagaggcccgggcccgcagaggaggaggag

SEQ ID NO: 6777104 - DNA, 57 bp, Homo sapiens
tctctaaagtagaaaagaccccagaattaagcttgggtctttgctctgatttagaga

SEQ ID NO: 6777105 - DNA, 64 bp, Homo sapiens
ggttgcagtcatgtgaataagtgtggggttacgttgactcgacaaatatttattgaatgtttcc

SEQ ID NO: 6777106 - DNA, 73 bp, Homo sapiens
gagcactgtaggctttagtccctggaattaataacttctgttagtgagctccagggctggggctcacaggctc

SEQ ID NO: 6777107 - DNA, 75 bp, Homo sapiens
gtaaattccagtgaccatagagtatggattgttgaccattcttgacatgccattggtcatggtgatggacattgc

SEQ ID NO: 6777108 - DNA, 63 bp, Homo sapiens
cagtcttactgcccctttgttcaatggagtggcttgtccacactaagaggggaggtaagtctg

SEQ ID NO: 6777109 - DNA, 69 bp, Homo sapiens
gtctacttgctgtgatggagaattctggaaggttctcccatccgaggatgccttatcgcactgagggac

SEQ ID NO: 6777110 - DNA, 93 bp, Homo sapiens
ctgtggtctcattttgcaaactagatgaaacgagtaaagatcactattgtcttgtctccatcttcttcagcctggttagtaggaggaccacag

SEQ ID NO: 6777111 - DNA, 71 bp, Homo sapiens
tgggaggtatggtctttgagaggtgactgagtcatgaggactcttctttcaagaatggattaggtctctta

SEQ ID NO: 6777112 - DNA, 90 bp, Homo sapiens
gtgtgcatgtgtgcacatgtgtgtgtgtgtgtgtgtgtgtgtgtgtgtgtgcgggtgcatatgcatgcatgcttgtgagaggcagtacac

SEQ ID NO: 6777113 - DNA, 89 bp, Homo sapiens
tggtgttatttttgtcatgttttgtaatgtctaacttctccaagggcactggcaaaggagatgtacagaagacaaaaggcagctagcca

SEQ ID NO: 6777114 - DNA, 58 bp, Homo sapiens
ccacctaaatatatttctaagcatctgtcttatatgaatatgtcttatgtttgggtgg

SEQ ID NO: 6777115 - DNA, 97 bp, Homo sapiens
ggtcaaggctgtggggctgccaggtcaccaggccctggacactcaagccgggtccctccggtgggggcagggcaggggctgcgccctcagcctgact

SEQ ID NO: 6777116 - DNA, 63 bp, Homo sapiens
ccaagcaaggctaattcacttgcccaaagccacacagctagtaagtgatgaagacctgtttgg

SEQ ID NO: 6777117 - DNA, 78 bp, Homo sapiens
gaaactgaggcttggagaggtcagggacttgcctaagattataaacctgagtccaaacctgaatgcgggtctcacttc

SEQ ID NO: 6777118 - DNA, 82 bp, Homo sapiens
catgatttgttggtgcattgctgtgatgatgttctgagctcacccagcctcagttactcaatgacagcaagttcaagtcatg

SEQ ID NO: 6777119 - DNA, 60 bp, Homo sapiens
gggagatacaatgattggttctcacccaggtggatctgagtggagactcattgatttcct

SEQ ID NO: 6777120 - DNA, 56 bp, Homo sapiens
ggaatgctgagatcctcaggccagatacccccagtatctgttcaaatcttagttcc

SEQ ID NO: 6777121 - DNA, 81 bp, Homo sapiens
actcttcattagttgactgcttttctagtctaaaattttgcttcaggtttgatctgtgaaagacagctggctgaggagagt

SEQ ID NO: 6777122 - DNA, 90 bp, Homo sapiens
gagtttcttgaaggttatagaggatgaacatctattaactaggtgatgaataggtaatggatttcgaacctctagcctgtttagcaattc

SEQ ID NO: 6777123 - DNA, 85 bp, Homo sapiens
ggctaccggtgctgccttggttcccagccagcaaggacctgattggtagtggggcatgaatagagctaagaggggcccggagacc

SEQ ID NO: 6777124 - DNA, 79 bp, Homo sapiens
gggttgtgataatgatacaaatctgaaatgcgttccaaaacatcctatgtccattgagctgtttcattattacaacacc

SEQ ID NO: 6777125 - DNA, 60 bp, Homo sapiens
gacagaggtgtccttgagtccacagggcctctggtccagcagccacgggacgcctctgtc

SEQ ID NO: 6777126 - DNA, 74 bp, Homo sapiens
gtagaaacggggtttcaccatgttggccaggctggtctcaaactcctgacctcaggtgatccgcccgtctcagc

SEQ ID NO: 6777127 - DNA, 57 bp, Homo sapiens
aatttattgaatcacacagggtagtcatagaacccctgtgggatggcttaatatttt

SEQ ID NO: 6777128 - DNA, 57 bp, Homo sapiens
ttctagctgttcatgtggctttatgctgatagtgtcagtcaaatgaacaagcttgaa

SEQ ID NO: 6777129 - DNA, 66 bp, Homo sapiens
ctggccctcactgctggctggattttcagtctgagagccagacctcggagtagtgagggaggccag

SEQ ID NO: 6777130 - DNA, 61 bp, Homo sapiens
tgtgaatgtgtgtggatgcatatgtgtgctatgcacatgcatgcaagtgcacatatgcaca

SEQ ID NO: 6777131 - DNA, 63 bp, Homo sapiens
aggtgccacacggggcgatcacatggcacgggattcctggctttgcccctttagtgggtgcct

SEQ ID NO: 6777132 - DNA, 116 bp, Homo sapiens
ctgtggccagaatctctgagatctctttcagcccaatgacactctgcacagtgcttgttaaacgttcttgaacctggcacacatggtggttggtgaagagtccttgaggaccacag

SEQ ID NO: 6777133 - DNA, 64 bp, Homo sapiens
ttgtaggcagtggttggaagagaactccatcagatgtcctcacacccataccactgacccataa

SEQ ID NO: 6777134 - DNA, 76 bp, Homo sapiens
gattggttcagttaatcctttcaagccaagcccatgagttgtgctctgcttggaacaggggtttgcccatccaatc

SEQ ID NO: 6777135 - DNA, 55 bp, Homo sapiens
aaaggaggaatggagagatgctgggttaattccagggatcagaatttcctccttt

SEQ ID NO: 6777136 - DNA, 89 bp, Homo sapiens
cctcatctggcttgtattttggagaactggcaggaaaataagggaatagagctatttaaagatccaggagtgctggttagagtataagg

SEQ ID NO: 6777137 - DNA, 67 bp, Homo sapiens
agtcttgtggctgaaagtcaagctgtgtctatgaaatgaaatggcttcaaaggtagcatacaacact

SEQ ID NO: 6777138 - DNA, 79 bp, Homo sapiens
ctctattactttatattctatctgccacagttgggctggacaagatgggaaggctggaaggtagaagatgaggtgggag

SEQ ID NO: 6777139 - DNA, 69 bp, Homo sapiens
cagagcgtgcagtctggagcagtaggaggtagatgtaggttaataccttgatgctcacactgacctctg

SEQ ID NO: 6777140 - DNA, 67 bp, Homo sapiens
ttgccagctgctttttgtcacatgggttgccaaggaataactgtgatgcaaaggacagttaaggcaa

SEQ ID NO: 6777141 - DNA, 77 bp, Homo sapiens
agtttccccagggagagaatggagaggtgagggctttcaaaagccagcatcccttcagtctccattatgcggagact

SEQ ID NO: 6777142 - DNA, 83 bp, Homo sapiens
gggaaccaagcaggtagttagaagagtctattacctgcctagaaaagcaaaatagatttgaatttaagacttgcatgcttctt

SEQ ID NO: 6777143 - DNA, 71 bp, Homo sapiens
ttgcctactctgcgtggctgctgtgagcgtgaaatgggatcatgtgcggaacagccacgcatggtccgtga

SEQ ID NO: 6777144 - DNA, 84 bp, Homo sapiens
agttgctttctttcttaatttttaaggacactgaaacaataatcacattttagggttcctgttgtattaagagttgaaacgatt

SEQ ID NO: 6777145 - DNA, 56 bp, Homo sapiens
ataggctttttaactctccaaaaattgatccattgtggtgagttattttggcttat

SEQ ID NO: 6777146 - DNA, 64 bp, Homo sapiens
cctcccttcctcctgcagcaggggttctggaaaaagcccagggctgccagggaggtggtggagg

SEQ ID NO: 6777147 - DNA, 59 bp, Homo sapiens
gctctttagggatctctggggaaatggagtgccttcctcaacaacttccctacagaagc

SEQ ID NO: 6777148 - DNA, 110 bp, Homo sapiens
tgggtcagggtaagttgctggacagtgggcagaggagacaggtactggctgagtgaagctcagggcaagtttgactcttccactgtctcagcctccagacgaatgaccca

SEQ ID NO: 6777149 - DNA, 98 bp, Homo sapiens
gcaagtactatgggtaatagtagagtgccaaaaaaaggacttaatgaataatattgtatcacatttttggcattctagcttagctctagtcagcttgt

SEQ ID NO: 6777150 - DNA, 61 bp, Homo sapiens
ctgttggaatgaaaggcgttgatcacctcatgattagctggttgtcacagctttccatcag

SEQ ID NO: 6777151 - DNA, 71 bp, Homo sapiens
tgttactatatgaactttggtgagaggtaaggatgagaattttctatctctgccaacagttaatgttgata

SEQ ID NO: 6777152 - DNA, 64 bp, Homo sapiens
cagagactgtacaatgccgagactaactcctgctctaatgagcggaggggcatttgcagctctg

SEQ ID NO: 6777153 - DNA, 77 bp, Homo sapiens
taccaagatgcagctagattccgatttacaagaaattccaagttaattgggtgcaacagctgaatatcaggatggta

SEQ ID NO: 6777154 - DNA, 72 bp, Homo sapiens
gtacagaggtcaggtaggagctcaggaatgcaagcgacagtctcactccctccaaatctgcacagtctgtac

SEQ ID NO: 6777155 - DNA, 55 bp, Homo sapiens
ttccctttctgaggctgccatactgccactgtccaggtggagctaagaaaaggaa

SEQ ID NO: 6777156 - DNA, 57 bp, Homo sapiens
tgtgtgacagcggctgcaggtgcccagtgccctggcacagggcagtgattgtccaca

SEQ ID NO: 6777157 - DNA, 110 bp, Homo sapiens
caacaaggatgctgccacaggcttgggagcagagccactgaaaacaggcagcctagtgcccactggtggctccgcttccatgggctggaaaatgagcggcagactgattg

SEQ ID NO: 6777158 - DNA, 84 bp, Homo sapiens
tgtgataaggattaagtagcacactgcatatgaagattgcttagcaatctgtaaagtactgtgtaaatacaagggcttattaca

SEQ ID NO: 6777159 - DNA, 61 bp, Homo sapiens
caagtcagtcaaaatataaattgttagccttatttgccaggtacaaaatttgactgatttg

SEQ ID NO: 6777160 - DNA, 56 bp, Homo sapiens
tactgccctgtaactgccaggtactgggctagtgctttacatatacagcgggagta

SEQ ID NO: 6777161 - DNA, 67 bp, Homo sapiens
cctttggtgttttacaaaggtattttacatatgattttatatgaagaaatctttgaaaatccattgg

SEQ ID NO: 6777162 - DNA, 59 bp, Homo sapiens
aagtagcaaggaagattatgatggcaagtcccacagcttctctgacattcctgttgctt

SEQ ID NO: 6777163 - DNA, 73 bp, Homo sapiens
tcttgatctcctcaccttgtgatcctcttgccttggcctcccaaagtgctgggattacaggcctgagtcaaga

SEQ ID NO: 6777164 - DNA, 62 bp, Homo sapiens
ggccctcaggttggggctgaggaaagggtggagccccagtagcccagcccctacctgttgcc

SEQ ID NO: 6777165 - DNA, 59 bp, Homo sapiens
agaactggatttaggaacagagaaactgcaaccaatgcttctctggataggccagtcct

SEQ ID NO: 6777166 - DNA, 67 bp, Homo sapiens
gttttgcaattttctgtccttgtactatttcacaggaaaagctgctgggcttgaaagctgctaaaac

SEQ ID NO: 6777167 - DNA, 73 bp, Homo sapiens
cttacagtaacattttcagtctgcagccgcgacgtctgatgttagggactagaactgagatctctgctgtgag

SEQ ID NO: 6777168 - DNA, 61 bp, Homo sapiens
aggtaccgcaggggtggagcaatgaccctagactcctgtcaatgaagtcatccttgtgcct

SEQ ID NO: 6777169 - DNA, 65 bp, Homo sapiens
ccaccagcctgggcatcatggtgcgggcacgggacacggcctcacccatcggtgcctttatgtgg

SEQ ID NO: 6777170 - DNA, 89 bp, Homo sapiens
acattctccatgagtttgtgttcatgtctggccagcggggctgaccttctgcagccctgagctagtgtgggcaggggcttggagaaagt

SEQ ID NO: 6777171 - DNA, 56 bp, Homo sapiens
aggtctgggattgaagacatcaagggggcctcctcgctgtcccccaaccccagcct

SEQ ID NO: 6777172 - DNA, 73 bp, Homo sapiens
cctaaaatgtctctttagagcaacagtaagtgaacttattttctgtaaagggacaaatagtaaatattttagg

SEQ ID NO: 6777173 - DNA, 55 bp, Homo sapiens
ggttgccggggcaggactggaaatcagtttctttcctctcacacccaaggcagct

SEQ ID NO: 6777174 - DNA, 68 bp, Homo sapiens
tggctttcccgaaatgtattagacctgagcattgatgccacatattccattgttgggatccaaggcca

SEQ ID NO: 6777175 - DNA, 58 bp, Homo sapiens
gctggcctcgcaggcaggatgtccatacggagggtcgcctgctgcagcgggagccggc

SEQ ID NO: 6777176 - DNA, 130 bp, Homo sapiens
agttacagatcacccactcatttcctaggaatctttgcccagagactcagcctccagtcagaggaggcaccactcatctctggggcgggtgggattttaccaaggaagagtcaggtcgttctgttttcct

SEQ ID NO: 6777177 - DNA, 69 bp, Homo sapiens
aagagatttctgataacatttagttgatttagtcacataattaactataatggggttaggaaatgtctt

SEQ ID NO: 6777178 - DNA, 63 bp, Homo sapiens
gaggaatacaacatttgaaagattcccaaggagaagagggaagagagatgttcaatatttctc

SEQ ID NO: 6777179 - DNA, 63 bp, Homo sapiens
ggtaggtggcctgagagccatctgtgacctgtcacatctcacctggctccagcctcccctacc

SEQ ID NO: 6777180 - DNA, 68 bp, Homo sapiens
gtggcttggatccttgtggagtgtcagaggcagtactctgagcttactcagggatacattttagtcat

SEQ ID NO: 6777181 - DNA, 56 bp, Homo sapiens
ggcaggcaagtctgctctgtgattttctctacctctgtgagcacatgggcctcgtt

SEQ ID NO: 6777182 - DNA, 75 bp, Homo sapiens
gggaaggcggggtcagctgagggcagcctcctaggtctgactcaggtctagaggatgttcctttcctgccttcct

SEQ ID NO: 6777183 - DNA, 59 bp, Homo sapiens
ttggtgaggacatgtgcaacttctttggacaatgattgtcccatgtgatgtctcattaa

SEQ ID NO: 6777184 - DNA, 60 bp, Homo sapiens
tgattagaagcgtgaatcctttcaaatgtgtgtgtcactgaaatggaatgtatctaatca

SEQ ID NO: 6777185 - DNA, 58 bp, Homo sapiens
gacacgcaggaccctgggccagtgacctaacccctctgcacctcggagcctccgtgtc

SEQ ID NO: 6777186 - DNA, 56 bp, Homo sapiens
gggaccccgtaggccacctgtgttccttcagagcagtgctagcctcacagggtctc

SEQ ID NO: 6777187 - DNA, 70 bp, Homo sapiens
ccctgtctccaaaacaatctcagatgagattctcatgagaacacaatttgtttggagaaattagcatggg

SEQ ID NO: 6777188 - DNA, 65 bp, Homo sapiens
gtgagactgtgtgtgtgtgtgtgtgtttgtgtgtgtgtgcatgcatatacgtatatggtgctcac

SEQ ID NO: 6777189 - DNA, 55 bp, Homo sapiens
gctctgagaggatgctgagcagcaacatcaactgctttttttccctctccagagc

SEQ ID NO: 6777190 - DNA, 93 bp, Homo sapiens
gatgagctatcaggttgccagtgggccctgttcttaggatcagaagaatctggctgagcctttggggctttctggtaactctgagtctaaatc

SEQ ID NO: 6777191 - DNA, 100 bp, Homo sapiens
ggtactatgctaggtgttttctaattaaatctacgctaggtgttttctaattaaatctacgctaggtgttttctaattaaatctatgctaggtgttttct

SEQ ID NO: 6777192 - DNA, 98 bp, Homo sapiens
agctttttctatttatttcagattgcaggttgcatttgtttatttgtttacaacaaaagtgcatgaacaaatcataccaagcaggaataataatagct

SEQ ID NO: 6777193 - DNA, 64 bp, Homo sapiens
gaggagaagctattggaaggacattgctgtgaatattcctgtcagctttcatgtggttcttctt

SEQ ID NO: 6777194 - DNA, 85 bp, Homo sapiens
gctttaataaagagcctctgtgtttcagcctcatgaatatgtttaaatttcaaaggacctggatcacagagatctgcaccagagc

SEQ ID NO: 6777195 - DNA, 80 bp, Homo sapiens
ggagacggtgggaatgtgagtagggtgagttggtgtggcaacctttggaaccactttagcacattccacagtacttttcc

SEQ ID NO: 6777196 - DNA, 89 bp, Homo sapiens
gggaacttattcaatcatttaatctggctcatgagcatttcttggtgctctggtgctggtgattcagattcaaatccaacaagattcct

SEQ ID NO: 6777197 - DNA, 66 bp, Homo sapiens
ggctttgtggttgactggaggagctcttgtttaccaaaatttggagctgttggcagctatcttgcc

SEQ ID NO: 6777198 - DNA, 73 bp, Homo sapiens
agcattaatatcaacaggtatggatgagattgcattgaaagctgtgcattgcatttgtcattgttgaggtgct

SEQ ID NO: 6777199 - DNA, 92 bp, Homo sapiens
gccatgcttttgatcaaagctgatactcagcaagtatcctgggtgtgattgtactagttacttgttgctaatgtctcttctgatagcttggc

SEQ ID NO: 6777200 - DNA, 87 bp, Homo sapiens
gtgagtgtgtctggtggtgggtgtagggcactgggattctggttccttctggcttctttgccgcactcggccaccagctgtcttcat

SEQ ID NO: 6777201 - DNA, 75 bp, Homo sapiens
gtcattgtgcagcacaggtgtgattggttagaattttctctgtgatcatctcagaacatctgttttgccaaaagc

SEQ ID NO: 6777202 - DNA, 111 bp, Homo sapiens
caagtagctgggaccacaggcatgtggtgtctctcgctttcttaaaaggatagcatacccttttacacaaaagatagcacaccatatgcactgttctataccttgcttttg

SEQ ID NO: 6777203 - DNA, 130 bp, Homo sapiens
ggtctcctgtatacactctcataggctgtgcactgcataactccagagaatccatccattcagactgtgatgagtggtgcctactggaattgaggagtgcccaacctgtacaactgtcaataacagccct

SEQ ID NO: 6777204 - DNA, 57 bp, Homo sapiens
gggcctgagaatctgcatgtctagttagttcccaggagatgctgatgctgcaggtcc

SEQ ID NO: 6777205 - DNA, 66 bp, Homo sapiens
aataatgagactcaattgtgtgtgtgtatttgcttacttacgtatatataagtaggttttcttatt

SEQ ID NO: 6777206 - DNA, 130 bp, Homo sapiens
ttctcatctgcaaaagtgccagggatttggattaaaacagttattgaggtcccttccagttctaagaatatatggccttcaagctaggaaaggggctttccagttccgagaccaaggatttgccatagaa

SEQ ID NO: 6777207 - DNA, 60 bp, Homo sapiens
cccccagaatgtccagcttcgtggagccacctgacaccatgaagaaactgttctgggtgg

SEQ ID NO: 6777208 - DNA, 78 bp, Homo sapiens
caggactttgggactggggagttgaagcactttcccaagggaggacggccaggagctctcccacccccacttggcctg

SEQ ID NO: 6777209 - DNA, 64 bp, Homo sapiens
tcaccaggagccatagagtcaggctgggcaagaagcacaaccgggtcctgaccatcttctgtga

SEQ ID NO: 6777210 - DNA, 75 bp, Homo sapiens
gccattggagatatgtcatgtaaggtgagctgctgaaatcagctactcaaggactattgcatgactcccaagagt

SEQ ID NO: 6777211 - DNA, 67 bp, Homo sapiens
ttctgtcgttgtctatcctgagtagtgctgggtgtgttagcagtgattctcttggactcagatagag

SEQ ID NO: 6777212 - DNA, 66 bp, Homo sapiens
cttcactgtgctctggccaagcgcgtgcgacttcctgtcacaccttaggcctgagcgcttattaag

SEQ ID NO: 6777213 - DNA, 72 bp, Homo sapiens
gtgaggagactggccttgatagtcttgtattgaccatttcccagatgcgtggtcaaggcagttctcttcaac

SEQ ID NO: 6777214 - DNA, 56 bp, Homo sapiens
cacaattcctaaccctagaggtgatatcagtatagctctggaggcaagggagagtg

SEQ ID NO: 6777215 - DNA, 92 bp, Homo sapiens
agacaatgtacaggtaggtatggtgcagtcttccagtggtccctagtgggattaagtagcaagctgatcattcttgcctgttttatctgtct

SEQ ID NO: 6777216 - DNA, 73 bp, Homo sapiens
gcctccagctcagaggatgctcctttatgttgatttgacaggaattccacataatcaccctccgggctgcagc

SEQ ID NO: 6777217 - DNA, 57 bp, Homo sapiens
tggagtcgtgtttgggatcggagctgcctgtggttctgaaccattgagcactgccta

SEQ ID NO: 6777218 - DNA, 90 bp, Homo sapiens
gtcagacaactcgggaaggtgctaaaggtcatggagccctattgttggttcattgcagatttgtagcttttcagtctgtcagtgtctgac

SEQ ID NO: 6777219 - DNA, 79 bp, Homo sapiens
ttttcagtagtaaatggatttggaagtctgagatattttcaaatacattcttgggtttttaaaatttattaccagaaaa

SEQ ID NO: 6777220 - DNA, 84 bp, Homo sapiens
ccacccgtgcctgttgcatgtgagaaacagtgatgtcgtctgtcttgtgtgacatgtatgttgttggcatgtgggtttgggagg

SEQ ID NO: 6777221 - DNA, 66 bp, Homo sapiens
catgggcaatattgtctaccagtatgagtctgactagagacttacacagtatccaaggttcttatg

SEQ ID NO: 6777222 - DNA, 129 bp, Homo sapiens
aggtatatcactaacgatactttaaaatttcaatttatgattagcctattgttggaatcatgattgcaataatgagaatgagaataaaatagttaatgagtgagaaaaaaaggagagagaaaatgtact

SEQ ID NO: 6777223 - DNA, 76 bp, Homo sapiens
catccttgtttgtcataactctgctgcaagttattttggtctctgtgacttgtggcggcaccatgattagggtttg

SEQ ID NO: 6777224 - DNA, 68 bp, Homo sapiens
gcaaggctgacctctctagactgtattatcccagctcccttgcccttctggttgggtcaggcccctgt

SEQ ID NO: 6777225 - DNA, 66 bp, Homo sapiens
ttctgggacccacgaaaggctttggagctcgctcgggctcctcgaagttgggcgtgcgtcgcagaa

SEQ ID NO: 6777226 - DNA, 64 bp, Homo sapiens
caggttctcaggctctgagaccctatgggaaattgcctatagggccccacagcctgggaaactg

SEQ ID NO: 6777227 - DNA, 63 bp, Homo sapiens
ccactattgctacatactgtatgggatttagggatactgtcaggagagtgtgtgaaatggtgg

SEQ ID NO: 6777228 - DNA, 83 bp, Homo sapiens
ctgtaggatacacttaatcttactgaggatcaaattaagaaatgttatttgttctaacagcatggattaggtcggttcaacag

SEQ ID NO: 6777229 - DNA, 67 bp, Homo sapiens
ggtgacataatttataggcctctttctttgtccacaaaaggaccttaggctctgtgaatatgtttcc

SEQ ID NO: 6777230 - DNA, 60 bp, Homo sapiens
gagctgccctgctctccgggatcttaggcccaggttcaggagacagagggcaaggcattc

SEQ ID NO: 6777231 - DNA, 66 bp, Homo sapiens
gcaatacagttgaagagattgatggttcttatgaattgtttgccttttcttttcaatggctgtagc

SEQ ID NO: 6777232 - DNA, 114 bp, Homo sapiens
tgaaatagaatgaattccaggctcattctcccttctatccctgtgatgacatcccaaccaaaaatgcatcacttttaaaggtgatcgaagtggaagtgggttcatctacagtca

SEQ ID NO: 6777233 - DNA, 86 bp, Homo sapiens
ctgctgcccctcttcattgtatcgttacatcttactgctttacacaagaaacagggacaaggatagagaaaaggggaacaaagcag

SEQ ID NO: 6777234 - DNA, 62 bp, Homo sapiens
gttgatttgtaggagtttgtttagacacataagtgcttttggataaaatacttacattcaac

SEQ ID NO: 6777235 - DNA, 61 bp, Homo sapiens
ggctgagcaatatgaggggaaataaatttctcagaaatgtatcccctgcaggttgctatcc

SEQ ID NO: 6777236 - DNA, 90 bp, Homo sapiens
gggacagctctctttttggccctgacactttgcagctgagtttgtacacttaaattgaagttgctgtgagggctctagactagctaaacc

SEQ ID NO: 6777237 - DNA, 67 bp, Homo sapiens
tgggaatatctcccaactagactctgcacatgaatccttgtctcatagtctgcactgggggagccca

SEQ ID NO: 6777238 - DNA, 71 bp, Homo sapiens
tagcaaccatcagtttcttctttagataaaatatattttatgtttgatctgatgaacagagatagttgcta

SEQ ID NO: 6777239 - DNA, 65 bp, Homo sapiens
aggctgtttaatgcaatgaaatgaggcattagattgaagcccatttcaagtgctttgaataatct

SEQ ID NO: 6777240 - DNA, 56 bp, Homo sapiens
tgccagtctgcctagtgggacagcagcctatgggcttgagggctaggcagggggca

SEQ ID NO: 6777241 - DNA, 86 bp, Homo sapiens
ggaggttagtgcagtgagtggcagagcagggaatgagctcaggttgcaggtccctggcttggcactctccactgccctatggctcc

SEQ ID NO: 6777242 - DNA, 73 bp, Homo sapiens
ccttaacagtgtattcggaggctaggtacgaaaccaattttatctgcttcagtgatatgtgaactgtatgagg

SEQ ID NO: 6777243 - DNA, 91 bp, Homo sapiens
ggaaagtgtgaacagtgattggctgtttgatgttcttaagaaattattgttaatttttcaggtgcagtaatcatattgttatatatttttt

SEQ ID NO: 6777244 - DNA, 98 bp, Homo sapiens
tggtatctctggactattcatagacagatggtaagaagctgcccagctcatttcaagttcaggctcagatggtttgttctagaagttccaggttacca

SEQ ID NO: 6777245 - DNA, 86 bp, Homo sapiens
acatgtctttgtagtgtgtattcagcaagcgaaacagaaaattatgaatttctacttatgtgtgaaatatgctctgtaatgcatgt

SEQ ID NO: 6777246 - DNA, 64 bp, Homo sapiens
ggaggtcttcacaaagctgttgttaaactctgtcaagagtttcttactttgcctgtgaaccttc

SEQ ID NO: 6777247 - DNA, 71 bp, Homo sapiens
tctccaacctgtgagagaagtgtgtgctcccaacagccacatattgggaggcttctagtcttacaaggaga

SEQ ID NO: 6777248 - DNA, 82 bp, Homo sapiens
ggggaaagatttagtcactcaatatttaggtgccaggcacccactgaacactaaagtatggaagtgaataagcctggtcccc

SEQ ID NO: 6777249 - DNA, 78 bp, Homo sapiens
gaggctaggctcaattgtgtacctgtggtccatttcaattcaggtgggcagctctgctaattgagcctggactccctc

SEQ ID NO: 6777250 - DNA, 55 bp, Homo sapiens
tcagaaaaagatgatttgttaaaactacattttgatgacctgtatctttttctgg

SEQ ID NO: 6777251 - DNA, 61 bp, Homo sapiens
gtgagaatcactgtatttgagctcaacagggaagctgtggttggagtgcagtgagaaaaac

SEQ ID NO: 6777252 - DNA, 69 bp, Homo sapiens
ggtcagatctagaagtggcatgaattacttctgcccatgtttcattggccagtactcagtcacctgacc

SEQ ID NO: 6777253 - DNA, 55 bp, Homo sapiens
ctgtagagggaccttggtgcacactgatgaacttgcccaaggtcacagctagcag

SEQ ID NO: 6777254 - DNA, 71 bp, Homo sapiens
tgaaaagatgtgcttctgtaatgaatgttacttactattaatggcaggtagtcagaggcgacatttttgca

SEQ ID NO: 6777255 - DNA, 61 bp, Homo sapiens
gggtatgcatgtctttgcacacaaatctacgtaaatatgtggtagagtatgtatatatccc

SEQ ID NO: 6777256 - DNA, 80 bp, Homo sapiens
gtctataaaacatttaaacaccaggaagaatcggtaggaaagataaatacgtctgcctgttgctagaatgtcatgtggac

SEQ ID NO: 6777257 - DNA, 83 bp, Homo sapiens
tagtgatcatcctggtgtgaggcgggagtgtagttaagtgatttgactaaaagagaacgttcgcacgactcagatgatgactg

SEQ ID NO: 6777258 - DNA, 63 bp, Homo sapiens
ggaggcctagccagctccagtttcagagatttttagaaagtgcctctgtttggcttggtttcc

SEQ ID NO: 6777259 - DNA, 79 bp, Homo sapiens
ccagacttctgatacgttgcacaacttgaatggctggctttggcaagcccccggcaagtgtgtattgtgactgggttgg

SEQ ID NO: 6777260 - DNA, 84 bp, Homo sapiens
ctttcaagtattttaaggactagtggtaaagtgagtctcacatgtgagtaatcactgttcactgttgtaaaatactggccaaag

SEQ ID NO: 6777261 - DNA, 113 bp, Homo sapiens
tttggtaaataacataaaacctgaaggttttgtttgcaaatcatgtcagttgccttcataaatgtacaggtaatgatttgttaacagacttaatgaaggttttaattaccaga

SEQ ID NO: 6777262 - DNA, 89 bp, Homo sapiens
tggaaaactctgcgcgggtgagtcagagtgccagcgccaagtttcctggcatgcaagaggaggctcccccgctcaggcagattttttta

SEQ ID NO: 6777263 - DNA, 79 bp, Homo sapiens
agtgtcagccctgaaacaacctcctctcaatcacaaaaccaccacttgagatgctgttctggtcatgggctgcaatact

SEQ ID NO: 6777264 - DNA, 67 bp, Homo sapiens
ttcactgttcttctgggaatggccctgcagcctccttgcgggaggggctgcctagaagaggagagaa

SEQ ID NO: 6777265 - DNA, 70 bp, Homo sapiens
ctccaacagaaatgtttgttaatattgtgagctacaggcaaacaatgaagggagacacttgctgtttggg

SEQ ID NO: 6777266 - DNA, 82 bp, Homo sapiens
attaggttgagctacatgaaattgctgatattctaacttttttgacttaaagaaacatcagcttcatgtgggtcaacctaat

SEQ ID NO: 6777267 - DNA, 55 bp, Homo sapiens
gccagcatcctgcattagggtggcctggtcttgcagctgcttggagggtgttggc

SEQ ID NO: 6777268 - DNA, 58 bp, Homo sapiens
tggtgaatagtagcttcagactcacctgttgagagtctgctttatcaagcattcacca

SEQ ID NO: 6777269 - DNA, 58 bp, Homo sapiens
aactgctgatcgaatcagtcaccctcatggacagagggacagagcacatcagcatgtt

SEQ ID NO: 6777270 - DNA, 63 bp, Homo sapiens
ttcttttaatccatctggtaaacctcagcaacaactgcaggaattgggcacggagtgaaagga

SEQ ID NO: 6777271 - DNA, 79 bp, Homo sapiens
ggttttgtttcctagagttttaagtacttgaaaaatatacttctattgcattaaggccattgaaatttggaacgttgcc

SEQ ID NO: 6777272 - DNA, 90 bp, Homo sapiens
tgtaaactgtttgttcttcagaggggaaagaacctgtgtaatcacctgaagacaaacggtcttaactttccagaagatgacagctttaca

SEQ ID NO: 6777273 - DNA, 66 bp, Homo sapiens
ttaacaaatgacctcagagaccaagaaggaggataaagctctttccaggtctaaaggcagggttga

SEQ ID NO: 6777274 - DNA, 64 bp, Homo sapiens
gtgctcttgctttctaacctaaagtgtctaatgagaactttagaaaggaaggaagtgttagcat

SEQ ID NO: 6777275 - DNA, 56 bp, Homo sapiens
tctggattttcttcgtaaggataagggtggctccatgttgatataggcaatctaga

SEQ ID NO: 6777276 - DNA, 73 bp, Homo sapiens
agagggatggaatgtatattgcaagcttgacttttctaataatctttgctctgctctaacattcctgacttct

SEQ ID NO: 6777277 - DNA, 70 bp, Homo sapiens
caggttccccagagggcatttgaagcaggaagcaagatgtttattgctatgtaaagctctgggtttcctg

SEQ ID NO: 6777278 - DNA, 55 bp, Homo sapiens
cccggctctgagggccccatgtgctttgacttggtggaaggctgctctgccaggg

SEQ ID NO: 6777279 - DNA, 74 bp, Homo sapiens
ggcactcttgcattttgatcctcatatattgcaaactgatttttgtaggataaattctccaaagtgtgagtgtt

SEQ ID NO: 6777280 - DNA, 80 bp, Homo sapiens
ctgtaggtgaggggctgcgacacttctgtctgcagcggccatctgtctctgacagcgagagagttgcccccttcctgcag

SEQ ID NO: 6777281 - DNA, 60 bp, Homo sapiens
gcttgtggaactcatctgcctggtctattccttgagagcaacacgcagtagtatacgagc

SEQ ID NO: 6777282 - DNA, 59 bp, Homo sapiens
ctgtagtcccagctactcaagaggctgaggcaccagaatcacttgagcctgggagacag

SEQ ID NO: 6777283 - DNA, 82 bp, Homo sapiens
gtgacagcatctagtaaacagtgtaggtggccaggcaatgcagattccaggcactatatatactttttattcatcatgtcat

SEQ ID NO: 6777284 - DNA, 84 bp, Homo sapiens
gaatcgcttgaacctgagaggcggaggttgcagtgaagccaagattgcaccactgcactccagcctggtgaaggagtgagattc

SEQ ID NO: 6777285 - DNA, 70 bp, Homo sapiens
gcagatgctggagtgatactcagaatgtgggtcatgttctagaattccatattttaagcattccggaagc

SEQ ID NO: 6777286 - DNA, 80 bp, Homo sapiens
tatccaagttggatcacagctcccttatacacaggcccatgaaggggctatggaaagaggggcgtgaattctagaggata

SEQ ID NO: 6777287 - DNA, 66 bp, Homo sapiens
attttagatcccaacaaaggacatggccataataaggcatctaggccataatcttaggatcaaaat

SEQ ID NO: 6777288 - DNA, 74 bp, Homo sapiens
gaccgcattcccacttggcaggatgttgctggaggtgaatggctgccatccttctaagagggacgtatgctgtc

SEQ ID NO: 6777289 - DNA, 58 bp, Homo sapiens
gatttctgggctttatttcagagtttctaatgctgagtggggatgaagttgggaagtt

SEQ ID NO: 6777290 - DNA, 76 bp, Homo sapiens
aaatatgtacagatatgtgtgtacagttgttttatataacattttatacaaatgacatgtatatcttacgctattt

SEQ ID NO: 6777291 - DNA, 69 bp, Homo sapiens
tcactcaggtttcttcttaggaatatgtttctaccttaagaaattctataaagaagaggcttgttttga

SEQ ID NO: 6777292 - DNA, 68 bp, Homo sapiens
tggagacaggcggtccagcccgccagcctggaattgctcttaggccagggccagattagccacctcca

SEQ ID NO: 6777293 - DNA, 58 bp, Homo sapiens
ggcccagctgggcggggacacggcggcctcgggcttgtgctccagccccagccgggcc

SEQ ID NO: 6777294 - DNA, 68 bp, Homo sapiens
tggagaatgtaggaaatacttttctgttactgtaatgctgaaggccatcctgcatcctgacctctcca

SEQ ID NO: 6777295 - DNA, 90 bp, Homo sapiens
tgaaagaaaaatactgaactgtagttaatactacacatgcagtgtgtatgtgtgtataataatgtctgcagtttacttttcaatctttca

SEQ ID NO: 6777296 - DNA, 71 bp, Homo sapiens
aggttccactttgcttagagaacaaggctttcctttcaagcctttatccctgtacaaggtgtccaaggcct

SEQ ID NO: 6777297 - DNA, 74 bp, Homo sapiens
aagaggatgggatttataccagtggcaggatatttctctgttttccaaacactggttttaatttccatttcctt

SEQ ID NO: 6777298 - DNA, 100 bp, Homo sapiens
tacattcaactttcctttgattttaaacttgaaaactggcaaaggaatggaagaatatttcagtcatgagttgttttcagttttcagacgaatgaatgta

SEQ ID NO: 6777299 - DNA, 130 bp, Homo sapiens
cagaatagtatttatgaaaatcttcagcttccttcttagatttgtagaaaccagcaccagtaggcttggtagcttatttcagctaaaattcttaattaaagggaagcctcagatttgttgtactatattg

SEQ ID NO: 6777300 - DNA, 95 bp, Homo sapiens
atcagcgagctctctgcacgacttcacctctgggcattcaaaatggattatgaaactacagaaaaggtaagctctctgtaagagaggccgctgat

SEQ ID NO: 6777301 - DNA, 97 bp, Homo sapiens
gagagctttatggtaatgctgatgtcagccccatctccagaaattctaagtgtggtcgggagtggggtctgggcatcagtcgtttaaagaaactctt

SEQ ID NO: 6777302 - DNA, 63 bp, Homo sapiens
ggtttatgtagggcatttcctagagggcatcctctttaggaaatactgtcctatgaaaggacc

SEQ ID NO: 6777303 - DNA, 56 bp, Homo sapiens
gttattgcagtatagaggtctaagcaccaattcttagatcatatacttgccatgac

SEQ ID NO: 6777304 - DNA, 104 bp, Homo sapiens
gagaactcgaatgaagattcactttggaacacattagtcaattagatatatgcatgcctgacaaatgtacccctagagtctagaatactttcatttcttatctt

SEQ ID NO: 6777305 - DNA, 61 bp, Homo sapiens
gctttggtgactgattttttgggaggaaattcaatgtctcattagggatcatcactgcagc

SEQ ID NO: 6777306 - DNA, 60 bp, Homo sapiens
agctgtggcaggctaggctttttggctatagatcttggttacattgccccttccacagtt

SEQ ID NO: 6777307 - DNA, 72 bp, Homo sapiens
cttctttccacccagttgactacaaaggggccagctcttcagccccttgttggccaggcctgggggaggaag

SEQ ID NO: 6777308 - DNA, 57 bp, Homo sapiens
gtttgtgtgagtgtacatatgtgtgtgtgtgcgtgtgtgtgtgactcatactagaac

SEQ ID NO: 6777309 - DNA, 106 bp, Homo sapiens
gccacaaaaattagagactacggtttgacacggtgcgtcttcagaaacagggacattttctgccatcctgagatgctacttgtcacataaagcttcaatttgtagc

SEQ ID NO: 6777310 - DNA, 68 bp, Homo sapiens
tacatggaaagaacatggactgtggggttaagtaacttaggttcagtgtcttgttctgctgctgtgta

SEQ ID NO: 6777311 - DNA, 70 bp, Homo sapiens
gcatgtagttacacaggaaaacattagcaagatatctagacttctatttggctccgtgtgacttaattgc

SEQ ID NO: 6777312 - DNA, 80 bp, Homo sapiens
gacaaactctgctcagaacatttaaaaagtggttgacttaggtcctaaatatctttttgaaatgttaacagggtttgctc

SEQ ID NO: 6777313 - DNA, 60 bp, Homo sapiens
agaatcaggcagagggagaagccaagctgtgatgccagcctggcagcctcagccaattct

SEQ ID NO: 6777314 - DNA, 83 bp, Homo sapiens
tcatcaccaccatcatcgtcattattggctcagcccctttgattaaatgtaatgcctccagtaaatgatgatagtgcctttga

SEQ ID NO: 6777315 - DNA, 58 bp, Homo sapiens
gtagaggtgggtttttgccatgttgcccaggctgctcaagcaatccacccacctcagc

SEQ ID NO: 6777316 - DNA, 124 bp, Homo sapiens
gggggagccgggagcggacgcgtgggtgagtggggaggggagtgagtaggtatcttctcttctctcggtgcatccctcaccttttcgctttttgcctcctggagacaactgaaattccttccct

SEQ ID NO: 6777317 - DNA, 59 bp, Homo sapiens
ttttcatttttatggtgaaacagagctaaaagtcatctgtgtcatgcattagatgaaga

SEQ ID NO: 6777318 - DNA, 66 bp, Homo sapiens
gccctcgccagctgtccttcctggtgggcgccgagggaaggcggtccaggatggctggcaagcggc

SEQ ID NO: 6777319 - DNA, 66 bp, Homo sapiens
tgtcttggctccttcacagggagatcacatgacatgccaaagtcccctatatgaggaagccatgca

SEQ ID NO: 6777320 - DNA, 57 bp, Homo sapiens
tgtttatagggtctgtcacttgaaaaagcctatgtcaagtatcaccatctgtgaaca

SEQ ID NO: 6777321 - DNA, 64 bp, Homo sapiens
gtattattctcagctttgggatatggaacagcagtcacgttttcacccaaaggagggtgatcac

SEQ ID NO: 6777322 - DNA, 65 bp, Homo sapiens
acatgactcatcaggaagttcagctctagttacaatttatagcaagctacctagatagtctatgt

SEQ ID NO: 6777323 - DNA, 85 bp, Homo sapiens
gttcacgtggatatagtgctttattgttcctgaaacactgttgcataattttcactggggtagtagagcacttaagcatgagaac

SEQ ID NO: 6777324 - DNA, 66 bp, Homo sapiens
gagtgggtagagcggagcccctgtagggcagagggaatctgacccttggtcttgcttttcctcctc

SEQ ID NO: 6777325 - DNA, 60 bp, Homo sapiens
ttaggtaacctaagaacctcagctttatacccaaagaaaactaggccttgggtagcctga

SEQ ID NO: 6777326 - DNA, 62 bp, Homo sapiens
tcttatagagttcagtgattttctgtgttttgctcatgggatagtcttcttgactcttgaga

SEQ ID NO: 6777327 - DNA, 61 bp, Homo sapiens
gcagacagagtctgtgaaactttttatactggtctattaaattttcactaggctcccctgc

SEQ ID NO: 6777328 - DNA, 60 bp, Homo sapiens
ccctggctttcccatcaatgtggcagtggaggcacttggagagcattgctggggaatggg

SEQ ID NO: 6777329 - DNA, 88 bp, Homo sapiens
tcctctccccatcatcatttgtactaacatgtctcagggcctcttagggctgagatgtcgttagatatctcctgatggaggcaagtga

SEQ ID NO: 6777330 - DNA, 86 bp, Homo sapiens
cagagctaatgaatgagaaagctgaaatctaaacccagttctgcctggctccagaaaaatcagtgttctttttcatgtgagttctg

SEQ ID NO: 6777331 - DNA, 60 bp, Homo sapiens
cttgtagctactttaggaagtagttttacttctctttacttccacagtgagaactgcaag

SEQ ID NO: 6777332 - DNA, 60 bp, Homo sapiens
gacagtggccctatttgaggaccccacagggcagtggagttgatgactggggtcagggtt

SEQ ID NO: 6777333 - DNA, 74 bp, Homo sapiens
gggaacatccattacatgtccaaagacaccctagattcccacatatctgtgatgtcttgtacatatgatttccc

SEQ ID NO: 6777334 - DNA, 58 bp, Homo sapiens
gggacagtttctccatttacaccttttgccttcagaagcctctgggaaagcctgtccc

SEQ ID NO: 6777335 - DNA, 65 bp, Homo sapiens
tgcctgggtttgggagatggtaatggtgtacatgcatctctgttagatctgcttaaacacaggca

SEQ ID NO: 6777336 - DNA, 62 bp, Homo sapiens
ggagtgagcaaatagagatttggtccaaaagttcaagccaggatctctgtcttgtgtgcttt

SEQ ID NO: 6777337 - DNA, 92 bp, Homo sapiens
gctctacaacctttggggtccagataagaccatcagctatgtgggttgtgccatccagctgtactttgtcctggccctgggaggggtggagt

SEQ ID NO: 6777338 - DNA, 83 bp, Homo sapiens
acaagacacttacttgttgtcgtgaagtaatatttcatgaattgtcagtgtaatactcatgacaaaaaaatagtgttaattgt

SEQ ID NO: 6777339 - DNA, 62 bp, Homo sapiens
ggtgggaaccgggtctccccagggtgccgtgaagtctctgagggccgggacccagtttctcc

SEQ ID NO: 6777340 - DNA, 113 bp, Homo sapiens
ccggcagcctttcgcgggcgagatgggggaggttagccaggcctttgatcccggcggggcgcgcctccacctccccgtctgcccggccttcctccacctcctcccgctgccgg

SEQ ID NO: 6777341 - DNA, 75 bp, Homo sapiens
tcagttcatctagttctgaagggttactcagtgtcatcttgatcagcccaccatcttcataacaagatttactga

SEQ ID NO: 6777342 - DNA, 59 bp, Homo sapiens
gcatagaggtgccaggcaagtttcaatgcccgttggagccctgccctaggcagctctgc

SEQ ID NO: 6777343 - DNA, 127 bp, Homo sapiens
ctcccagttgtttctgcattggtgggaggttggtgggagattggctggagtgggagaagtttatagctcatatttcatctctcactctgctaccatgcctcagtgtcaggacaagaaataactggag

SEQ ID NO: 6777344 - DNA, 64 bp, Homo sapiens
gatctgtgtgggtgactttaataaactcaggctattcctgggctgtagaatagttacacagatt

SEQ ID NO: 6777345 - DNA, 58 bp, Homo sapiens
gagtgggcaaaagaaagtaggcatctggtacataatgctgccttttaaagcctcgctt

SEQ ID NO: 6777346 - DNA, 55 bp, Homo sapiens
ggaggcctcatcttgccccgtgcccaggtagagcatgaggtagcatgaggcatct

SEQ ID NO: 6777347 - DNA, 130 bp, Homo sapiens
gaccttgaaagaactagagtctttaagagaacagagacattctatgaagataattttaaggaccttgaaagaactagcatcttcaagagaacagagtcattctcttaaagacgctagtgctctctaagtc

SEQ ID NO: 6777348 - DNA, 130 bp, Homo sapiens
ctgaccttttctgaagaataatttaatttaatattgaacaacagagagctggaagctgctcttagattgcatctcaggtggctactagtttatatgtggtcattactaatctagagtcccttttcaccag

SEQ ID NO: 6777349 - DNA, 56 bp, Homo sapiens
cctcactgtttaatagctggatctaaaaagctaggccatgcgggagaatagtgagg

SEQ ID NO: 6777350 - DNA, 64 bp, Homo sapiens
ggtctcggcatagaaaatgtgccctctgtcttgaggcagagacatccattttatatgctcaatc

SEQ ID NO: 6777351 - DNA, 58 bp, Homo sapiens
gatttacctctgagggtgtggttgcactgagcgtgatcacacttcaaagggttagatc

SEQ ID NO: 6777352 - DNA, 86 bp, Homo sapiens
ggagaggaggtgcttcaaggccatgtcaagctcttcaaggccatgtgatgtaggagggctggatttggtcttaggtaacaggctcc

SEQ ID NO: 6777353 - DNA, 60 bp, Homo sapiens
ccattatccacgggcttcctgacacagagcttccagtcatcaggaactagaaggtgatgg

SEQ ID NO: 6777354 - DNA, 66 bp, Homo sapiens
tatgcgtgcttgttagcatggaaagatcaatagggattaatagctttctctggtcaagcacacata

SEQ ID NO: 6777355 - DNA, 77 bp, Homo sapiens
cagggacacatggctgggatggggtagagaaaggagtctcctttttctcatactaccctttagttattgtgtatttg

SEQ ID NO: 6777356 - DNA, 57 bp, Homo sapiens
tggcctgcccaagtcaatcggaaactctgaggctaaaaattgctgtggcaggatcca

SEQ ID NO: 6777357 - DNA, 64 bp, Homo sapiens
gaatcttagaaaggttaaggaacttggtcaaagtcatacacgttaattagcaaagctgagattc

SEQ ID NO: 6777358 - DNA, 85 bp, Homo sapiens
ggagcacgggaacaggacacatttcttgttcaggcctcagaacttgcagttcttccagacaggggctgttcctgctccctcctcc

SEQ ID NO: 6777359 - DNA, 81 bp, Homo sapiens
gtatcccattctctgatcttcacatacccctattctttcattgcttgattaaaggtacgcgaaggtcagagaataggatac

SEQ ID NO: 6777360 - DNA, 68 bp, Homo sapiens
aaccgtatttccaaataaggtcacactcagaggttctgggtggatataaatttttggaggatactgtt

SEQ ID NO: 6777361 - DNA, 97 bp, Homo sapiens
tgcttgggaaaatagctgaaccacctaaagcatattttaattagccacagtggagcaaacactaaattatgctttgggctcagcacaccttgaagca

SEQ ID NO: 6777362 - DNA, 81 bp, Homo sapiens
ctcttctaaacctctatgttacctctattagaatattatttctgatgtagtttgtggagaaacaaagcaggaatggaggag

SEQ ID NO: 6777363 - DNA, 64 bp, Homo sapiens
agcaaagggacatgttctggcaatggtacacacagcctacttctagccaggacatcctcctgct

SEQ ID NO: 6777364 - DNA, 65 bp, Homo sapiens
cctggccagctaattgcccatctagggcattctcatactgcctcttgggctgtgtctggtccagg

SEQ ID NO: 6777365 - DNA, 61 bp, Homo sapiens
gtatgatgtgtagatacacacacatatatattcagatatgtgtgtgtatgcacacacatgc

SEQ ID NO: 6777366 - DNA, 91 bp, Homo sapiens
ctagtgtctcctgagctttgtattgtacgcctgtcaacttcaaattgcagttgaggccaccaggctggcaatgcgtcaagcagagaaccag

SEQ ID NO: 6777367 - DNA, 130 bp, Homo sapiens
attagaatcatgtggggagcttaaaaatacagattcctgggctccactccaagagcacaggaatgatgattgctgggagaggacctagagctctgtacctttatcgagtcttccccttggtggttctgat

SEQ ID NO: 6777368 - DNA, 84 bp, Homo sapiens
cagatgccctccagttgtttgtattaactctttcccacaatcaccaggtataagatgatagaaacaaaatggaatatggctctg

SEQ ID NO: 6777369 - DNA, 55 bp, Homo sapiens
ggcacctgtgaccccgagagaggactttgggcttttctctctggttggaggagct

SEQ ID NO: 6777370 - DNA, 56 bp, Homo sapiens
gggatgttttgaactgaaggcctcagtaccttgctggctgttagttgggggctccc

SEQ ID NO: 6777371 - DNA, 58 bp, Homo sapiens
gttacaaaggaagcttcactgcatgcattcttttgcccagtggggatctctttgtagc

SEQ ID NO: 6777372 - DNA, 76 bp, Homo sapiens
ttggattttcctgaagaacgaagtcatgtagtctgagtcaaagcagaatacttgacatttctttagggttatttgg

SEQ ID NO: 6777373 - DNA, 129 bp, Homo sapiens
atactgatgtaggggatgtaccaggagtgaagctggaagcatgcagactcgaagatccctctccccttgacctatcttcaggtgagtctgtcaggctttccatttccaattctggctcttcgtcaaaat

SEQ ID NO: 6777374 - DNA, 129 bp, Homo sapiens
cagtgagacccattggcaggcagtgggggtgtcaggagagggagcagcagccacaggatgaatgtgggagcccacgggtgtctcttgctcctcccctctgggcgtcatgctgctggcgctggtcctctg

SEQ ID NO: 6777375 - DNA, 63 bp, Homo sapiens
gatgctgaggagtaacattgagcatcacagattcccagggtgctggagatactgctcagtatc

SEQ ID NO: 6777376 - DNA, 71 bp, Homo sapiens
ctgtaccaagacaaatcagaaactccccatattattttttggttgttgttttttgtgttgttttggtttgg

SEQ ID NO: 6777377 - DNA, 81 bp, Homo sapiens
ataataatcctccgcattctgagtcactctttagcacacagcagatgtgtgcttactcagagtttggatggtcttggttat

SEQ ID NO: 6777378 - DNA, 60 bp, Homo sapiens
tgtgacccagactcatcttcttactcttaactaagtaggaaacagacctttgggcttaca

SEQ ID NO: 6777379 - DNA, 81 bp, Homo sapiens
ttgttccaagtctttgctattgtgagtagtgccacaataaacatacgtgtgcatgtgtctttatagcagcatgatttataa

SEQ ID NO: 6777380 - DNA, 79 bp, Homo sapiens
gggcttatgatctggaggttttcctcatgactgcaggcaggatctctttttcatgcaggaccaccccagcatcaagctc

SEQ ID NO: 6777381 - DNA, 69 bp, Homo sapiens
cacattccaggtagggaataaatgtcatgtgagtgccacacgtgagtgaaaaatttgcctggagctgtg

SEQ ID NO: 6777382 - DNA, 60 bp, Homo sapiens
cagagtgagtgtaaggttggattatgtatataaatagtgagcctgttaatactggctctg

SEQ ID NO: 6777383 - DNA, 85 bp, Homo sapiens
caggaactagggatcagcatgtcctacccagtgaagccctcctgggggtcttctctgcccataggaaatgcctccttctatcctg

SEQ ID NO: 6777384 - DNA, 64 bp, Homo sapiens
taaagtgtatgccatctctcatcagtatctctcatccagttaataggagaggatggcagctttg

SEQ ID NO: 6777385 - DNA, 76 bp, Homo sapiens
acctttacaggggaccccgatggtgacgtgtccttcctaggggccattacctctctcagggatcctagtgtctggt

SEQ ID NO: 6777386 - DNA, 59 bp, Homo sapiens
caggcatttttattgtccttaaactatagaaatataatttgggctctagaagtgttctg

SEQ ID NO: 6777387 - DNA, 65 bp, Homo sapiens
gtgctgagtgagaacccagagagagtgcaggtcagcgtgagggtctctgtgggtttcaccagcgc

SEQ ID NO: 6777388 - DNA, 56 bp, Homo sapiens
tccactggaacaactctgaggctgttttgcacagtctcccagaggatcccagtgga

SEQ ID NO: 6777389 - DNA, 80 bp, Homo sapiens
ggtacctgagaagaggttgtctgtgatgagttcgcttttattaatgacgaatataacacagatggcctgttttcagtacc

SEQ ID NO: 6777390 - DNA, 70 bp, Homo sapiens
tcggtgcgtgaggcccctgagcgaatcataaaaggggcactaagtctgttcgtgcaggggcccagatgga

SEQ ID NO: 6777391 - DNA, 60 bp, Homo sapiens
ggggagagaaattatagcaatgagtcacccaattctgctgcatctgctgtatctcttttc

SEQ ID NO: 6777392 - DNA, 78 bp, Homo sapiens
cctcttctaggcatgcttactcctgggctcatatcattcaggctaagagactgaaagagccccaggggcctgcagagg

SEQ ID NO: 6777393 - DNA, 80 bp, Homo sapiens
tagccaacctctgtacctcctctgacagatcaaattattaaattctgcttggggaaggtatggggcactcctcttggttg

SEQ ID NO: 6777394 - DNA, 58 bp, Homo sapiens
gtgcagtggggggacctccagaatgccttggcttcttggaagtcgtccttccacacac

SEQ ID NO: 6777395 - DNA, 111 bp, Homo sapiens
catgcaggaagtccctcccccaataagtcccccacttgccacagggcacgtcttgccctgaccagcaggacgggggcactccagctggggagaaggcagctttccttcatg

SEQ ID NO: 6777396 - DNA, 107 bp, Homo sapiens
tgccttctccaatcagtggtgtggggaaggaactgccattggttctggaaaatccagtcacatgatggggctggacatgacctccttcccttagcatgaagagggta

SEQ ID NO: 6777397 - DNA, 80 bp, Homo sapiens
ccagccacagccagggaggagggagcccaggcagatggccctgcctgcctgtgagtcaacccctccttggcactggctgg

SEQ ID NO: 6777398 - DNA, 66 bp, Homo sapiens
acgtccacacagcactggctgctgcagtgccaccgcccagcagcctcttgtgcctgtggtggttgt

SEQ ID NO: 6777399 - DNA, 86 bp, Homo sapiens
tttcttcacagatttgtattagctgtaaattttctgtctgaaaccctgacacagacagagggagaagctaaaataactggagggaa

SEQ ID NO: 6777400 - DNA, 67 bp, Homo sapiens
tcttcatgtcattcttcagtcttctttggaagcctttagccagaactgtcacgagtgacaaagagga

SEQ ID NO: 6777401 - DNA, 67 bp, Homo sapiens
tgccaatccagcaggcagtcatatcctttgccccttcaggtatgaaatggcagctgctgtagaggca

SEQ ID NO: 6777402 - DNA, 129 bp, Homo sapiens
cagtgctcttgaaggaggctttaggttatgtcaagagctgttgaggctgatggttcaggctgctgaatgcacctcatttcacttcaaagcttatgccttgacttttgcttgatacaggtatatagctgg

SEQ ID NO: 6777403 - DNA, 118 bp, Homo sapiens
ggtactgcatcttttgagcaatttggtctctttcagtcatctatgggccacacggagttgttctattgcttctgttggaaataaatgcacttaaacagatgttgtgacatgcagtagc

SEQ ID NO: 6777404 - DNA, 56 bp, Homo sapiens
gcagggctgagtcatgtgtgcctcttgcaagctctgggcaacatctctgttactgc

SEQ ID NO: 6777405 - DNA, 58 bp, Homo sapiens
ccactgattctgccaggtctctgcaattgcactgcatggaactgggactggtcagagg

SEQ ID NO: 6777406 - DNA, 56 bp, Homo sapiens
ggcagccctggaccctggagaatctggactggaggagctctggctcctgggctgcc

SEQ ID NO: 6777407 - DNA, 69 bp, Homo sapiens
gccttctgtcccaggagctgtaagacactgcacctgtggctgtcttaccttccagcttctggggagggt

SEQ ID NO: 6777408 - DNA, 61 bp, Homo sapiens
gctgtgttgctggtgtgcaaatgcatcatgcccttccacatttccacatctttgcacatgc

SEQ ID NO: 6777409 - DNA, 81 bp, Homo sapiens
ggggggaagagtgtttatttcatgttttactaaggaaaaaactgttcaagaaccttatagaacttaaatatgttttccctc

SEQ ID NO: 6777410 - DNA, 58 bp, Homo sapiens
tggtcaaagctgcggtcagcaacaacttggccaagatatgcttgacccagttttgcca

SEQ ID NO: 6777411 - DNA, 62 bp, Homo sapiens
gggcccagctaataggaactttggacttgaggcagagtatccagagggccggcatgtggtct

SEQ ID NO: 6777412 - DNA, 57 bp, Homo sapiens
ttgttgagatgtgtctctcaatcctgtaattttggtgagagagtatacagacaacaa

SEQ ID NO: 6777413 - DNA, 78 bp, Homo sapiens
ccagttaaagttaagacactttctaaatagaagtcttgtatatggggcttttgagaaagtgttttcccgtgatgctgg

SEQ ID NO: 6777414 - DNA, 60 bp, Homo sapiens
gtgcatatatgcacatatgtgtgtgtgcatgcatttgcttttatgtgtgcatttgtgcat

SEQ ID NO: 6777415 - DNA, 126 bp, Homo sapiens
ctgcaatgtttgcatttgttgggtgcctctggggcctcaagaatgtctctggtgaggcgctggatcattttaatcaatgcgctaagtgacgattcctgtggcaccggcccacattgcaacaaccag

SEQ ID NO: 6777416 - DNA, 55 bp, Homo sapiens
ggctgtggctgctcaggtgcagaccctgtctgtgggtggtgctggcagcccagcc

SEQ ID NO: 6777417 - DNA, 56 bp, Homo sapiens
gagctgggcacacgccacttgactgtgtggaagagggtggatgtctgcaccagctc

SEQ ID NO: 6777418 - DNA, 60 bp, Homo sapiens
accatgtaaaaaattaggtcatcttgggggaactcaaatgatcactttgttctgcttggt

SEQ ID NO: 6777419 - DNA, 84 bp, Homo sapiens
tgtcacaaattactcagcagacagttagctatattggtgtctttgaaaccatgtttggctctgctgtgtgcttttgtttgtaca

SEQ ID NO: 6777420 - DNA, 59 bp, Homo sapiens
gttggctggatgactgtgttaactggcccttaccagttaagtggtcagttttagacaac

SEQ ID NO: 6777421 - DNA, 75 bp, Homo sapiens
agcctgtgaaatctctgccactatcaccaattttatagatgaggatgctgaggcagaggtgaagttcacaaggct

SEQ ID NO: 6777422 - DNA, 59 bp, Homo sapiens
agcattaagaaggcagctttcaagatgttgtcatttgataattcagctgccttcatgct

SEQ ID NO: 6777423 - DNA, 62 bp, Homo sapiens
gcatggatctgaggcaagacactgtcaggttacacctgcaggaagctggtcagatcctgtgt

SEQ ID NO: 6777424 - DNA, 65 bp, Homo sapiens
tgtgatgggctgattaatagcagcacaagtggctgctccttgagattaattaatcacctgtcata

SEQ ID NO: 6777425 - DNA, 57 bp, Homo sapiens
cagcacagtttcccccatgagctcttggggagctggaggagggagatagctgtgctg

SEQ ID NO: 6777426 - DNA, 94 bp, Homo sapiens
ctgaactaatgtgtgtgcctgcatcaggacagagttcaatagctggccttgaagtttctgagggccctctgttttgtaagcaacgttgtgccag

SEQ ID NO: 6777427 - DNA, 85 bp, Homo sapiens
ctacattcgtgcgtagtacgaatttgtgcctgctgggtccttgtacctttacgccaggcagaaatctccgtaatcgtcagtgtag

SEQ ID NO: 6777428 - DNA, 57 bp, Homo sapiens
agatgctggggcccctcggatggcctggcagctccccccagcggtgccctagcctct

SEQ ID NO: 6777429 - DNA, 87 bp, Homo sapiens
gaataaaaaggctctaaatatgtatgacttctatcaattatccatgcttgaagaaagtcatatataatgagagtataggaaatgttt

SEQ ID NO: 6777430 - DNA, 91 bp, Homo sapiens
tctcagactcctttggaattgaaagagaatgtagctctttagggacagctgaagataaactcttgatttctgatttccagagcagtttgga

SEQ ID NO: 6777431 - DNA, 55 bp, Homo sapiens
gctgcagcagctgcagggttgtgaagagggaaatgactctccggctgccagcagc

SEQ ID NO: 6777432 - DNA, 66 bp, Homo sapiens
gcttagtgtttctttaggctgtgttgccaagacttcttgtcaactgtgtttggagtggacacaagc

SEQ ID NO: 6777433 - DNA, 55 bp, Homo sapiens
ggagtccaccaagtatttcaggttctctcctgggccacttgaaagtggatgtacc

SEQ ID NO: 6777434 - DNA, 62 bp, Homo sapiens
aggaggatcctgtgtcctgcttttcctttatcaaaccaaaaagctggcaatgttgtcctctt

SEQ ID NO: 6777435 - DNA, 88 bp, Homo sapiens
gaacagattgctggcattatggcagccaggatattgtcaggaggaacttggcagtgctcgtaggtgttatgatgctggctctttgctc

SEQ ID NO: 6777436 - DNA, 58 bp, Homo sapiens
tccaggagcaggagctgcagctgctgtccatgcagtagcttgagccctggtcctgaga

SEQ ID NO: 6777437 - DNA, 62 bp, Homo sapiens
atgtggggtcatggtttgaggtgcttgaagaacccataaaagtatctggacttatcctatat

SEQ ID NO: 6777438 - DNA, 69 bp, Homo sapiens
gcgtccccgcggtggcggcctccagcgccagtcccacccggacggcgccagccgcgcgccgcagggcgc

SEQ ID NO: 6777439 - DNA, 65 bp, Homo sapiens
gcgaaggactgcggattgttgtggaagcctgtgcccaacaggcctgtgacaccgtgtctgtgtgt

SEQ ID NO: 6777440 - DNA, 55 bp, Homo sapiens
tattttgtttcttggctcaggccctaaggaaaagcctgtatcaggttacaaagta

SEQ ID NO: 6777441 - DNA, 59 bp, Homo sapiens
aggcgggttgtgctaattgcttgctgtttttcctacaagcagaacctgcagacctgtct

SEQ ID NO: 6777442 - DNA, 83 bp, Homo sapiens
tggaaggagaataatagtgtctgtccatcagtaactaggtctcatgctttacaaagttcactggatggaagattttcctttta

SEQ ID NO: 6777443 - DNA, 56 bp, Homo sapiens
tgcctggggctggtcaccggggcttacagcaaggaactggaagcctttccagagca

SEQ ID NO: 6777444 - DNA, 83 bp, Homo sapiens
ggcctggggtgggaaacactggctgtgcagagggcagtaggaacggctgtggctctccggcatggccagagctgttctaggct

SEQ ID NO: 6777445 - DNA, 57 bp, Homo sapiens
tggttggagctccatgtccccgggcctgtaaggaattagtgccctcagctttaacca

SEQ ID NO: 6777446 - DNA, 80 bp, Homo sapiens
ttctcacagggcagcaagtggtgggagactttgacctagacccctaaagcttatcttgcatatttgttaatcatgtggaa

SEQ ID NO: 6777447 - DNA, 89 bp, Homo sapiens
cgcccccaccgctgctcgtgccaggacgcgcagtttgcagttgcagctctggcactggcgcgggatggcggagcttcccttggatggcg

SEQ ID NO: 6777448 - DNA, 56 bp, Homo sapiens
tgaagtttaattttggacatgacagaaatgtgatgtgtcataaaattaaaacttca

SEQ ID NO: 6777449 - DNA, 59 bp, Homo sapiens
cagggctctgccttgagggatggccattccagtagggccatattcttggaggagctttg

SEQ ID NO: 6777450 - DNA, 73 bp, Homo sapiens
ttggcctgacttattcttccgcaaagcttgcaagtaatgtcaagtaacagcaggagggaatgaagttagacaa

SEQ ID NO: 6777451 - DNA, 71 bp, Homo sapiens
ttctctaagagatgcagaagttaagtaaataaaccagtacgatacagagctgtcatttctattatagagga

SEQ ID NO: 6777452 - DNA, 61 bp, Homo sapiens
gaatcagatactgatttcagtcatttttaatggcttattgacttaatattggtactgattt

SEQ ID NO: 6777453 - DNA, 80 bp, Homo sapiens
ggtggaggggctgacaccacccaggcgcagaggcagggctcagggcctgctctgcagggaggttttagcccagcccagcc

SEQ ID NO: 6777454 - DNA, 60 bp, Homo sapiens
tgagcaccttctctcatttccctggaacctggccagggctgagctaacagtaggtgctta

SEQ ID NO: 6777455 - DNA, 57 bp, Homo sapiens
ggacagggttccaatgggcatggggtgttgcaagttctcctgttcatgactctgtcc

SEQ ID NO: 6777456 - DNA, 77 bp, Homo sapiens
tggcattatgtagctaaaaattgtgtcctgtctctacctatttttgaagaccatcctttagtttgcgtttcctgcca

SEQ ID NO: 6777457 - DNA, 130 bp, Homo sapiens
atacacaatggaacttggcagtctagattgttttggctttatttccattcacttaaaacaagtatgtgtgggaaggagcttgtgggaaatgggagtggaagagatataatttattttgggtattgtgtat

SEQ ID NO: 6777458 - DNA, 64 bp, Homo sapiens
ctgtgagacacccaagagtcagatggggaaactgagtcccagggctcaagggcatgctacgtgg

SEQ ID NO: 6777459 - DNA, 56 bp, Homo sapiens
tggataggagatcaatatgcaatttttactagattgttcttttggtcttttgacta

SEQ ID NO: 6777460 - DNA, 123 bp, Homo sapiens
ctcggttgccgcttctctcttctactgtcccagctgtctctgttttttaggcaactttctgtggctttttcaagagtggagatttggctggagcaggattaggtaagaaaagagggaacggag

SEQ ID NO: 6777461 - DNA, 67 bp, Homo sapiens
tgtgcctcatcttcacagacaacgggccatcctgctgagagatgtcccttgtctgtgatgtctgcca

SEQ ID NO: 6777462 - DNA, 69 bp, Homo sapiens
tcctacaaatttggaacctcacacagaagcagctgctattgcagatgcttttgattctggggtgtagga

SEQ ID NO: 6777463 - DNA, 62 bp, Homo sapiens
acagaacaagacctgcttattggtggataagacaacctctagtaaggcagctcttttcatgt

SEQ ID NO: 6777464 - DNA, 72 bp, Homo sapiens
ccatgagaagttagactagccaggcagagagatgcaggagctgactgtgggaggttagactagcttacatgg

SEQ ID NO: 6777465 - DNA, 76 bp, Homo sapiens
ggtagtggggcataggtgatttgagaagaagaacccagagatgtgggttcaaatcctagccctgtggcctgctatc

SEQ ID NO: 6777466 - DNA, 87 bp, Homo sapiens
ggcccagggaagtctttagcagagagctgagacggagaaaagggttctgaaccacagctgtctgctgaaggaagctgtccaaaggcc

SEQ ID NO: 6777467 - DNA, 70 bp, Homo sapiens
tagcaagtggcaccacatttctaggcatataaagaaataataacacctagaatttgtaaacaatttgcta

SEQ ID NO: 6777468 - DNA, 61 bp, Homo sapiens
gccagcaggctgcgattgctcattgtgtttggttataattagcagcatattctgcgatggc

SEQ ID NO: 6777469 - DNA, 130 bp, Homo sapiens
gactttacctattttgggccaaaggtgcagtcccatacagaagggaaatgcctgggagaggctctcaaagtccaggcatctctctgcttctgagctattcgattgcttgtgttcctaaaattagtaaagc

SEQ ID NO: 6777470 - DNA, 72 bp, Homo sapiens
gtttcctagataacttggtcttggatttctaagtcataatgtaagaagtctgaagactcatgtctgaaaagc

SEQ ID NO: 6777471 - DNA, 113 bp, Homo sapiens
tttgggtgttatttttgtcttacaggtacatgtcaaaaaatgcataacactgaaataacagagatttaggcatagttttgataaatacactagtataattagaatatcccaaa

SEQ ID NO: 6777472 - DNA, 122 bp, Homo sapiens
tgacctggagggcttgttaaaaatgcaaactctcaaccctttcctctgaagattttcattcatagggctggggtgggagctggttttaggtatttgcattcttagacatcagtcatcagtca

SEQ ID NO: 6777473 - DNA, 74 bp, Homo sapiens
tttctctgtggatcctaattctaacaacagatgtcctcataaggacattcttataagagtgaggcagagggaga

SEQ ID NO: 6777474 - DNA, 99 bp, Homo sapiens
ctagtggtttcttgtgtctatgtgccctcttagagtctctggttcagaatcacatcttacagtgggctttcagagtgctcatcttacagagataactgg

SEQ ID NO: 6777475 - DNA, 70 bp, Homo sapiens
ggagttacagagccctgcgctatagaataaactggcttcctcttaggtccaggagctcagggcttattcc

SEQ ID NO: 6777476 - DNA, 103 bp, Homo sapiens
gggccttggggagagggacccaggcagccaagtgtgtgtgtgagcacagtcatgcaccatgcatcaccgagttgcccaccagggcctccccctcctacccccc

SEQ ID NO: 6777477 - DNA, 77 bp, Homo sapiens
catctttcatgtaataggatgtgttaattgaggatttttccttttgactgaagcctcattagtgagaataatagatg

SEQ ID NO: 6777478 - DNA, 74 bp, Homo sapiens
tcgtagcaaaatggagatttccctgtgctgaagcagacaggtgacttcagacttaaaagatcccagcgctaaga

SEQ ID NO: 6777479 - DNA, 92 bp, Homo sapiens
gagggagtggaacatataaactggaaagtcagttctgagcaccttggcctcattgctcttgaactttctagtttcatgttgttgcatctctt

SEQ ID NO: 6777480 - DNA, 130 bp, Homo sapiens
tgggtgctggggggttgaggggggcgaggaggcagctcctcctgcaggcctgggaggagagggagctttggtttcccaaagcctggggtgagtgctgctgaagttatgtgacccggccttggccaagcta

SEQ ID NO: 6777481 - DNA, 59 bp, Homo sapiens
cagtgctttgggaggctgaggagggagggagcccttgagcccagaagttcaaggcactg

SEQ ID NO: 6777482 - DNA, 61 bp, Homo sapiens
ttggtaggggactagagtccagtgtggatatatgcagggctaaacaagttcccactaccag

SEQ ID NO: 6777483 - DNA, 79 bp, Homo sapiens
aacccagttcatttgtttctgtttggggcttagaattctcactgattcccatggcttgacaagcttattgcactgggtt

SEQ ID NO: 6777484 - DNA, 56 bp, Homo sapiens
cacagtattcactgggcagattactccaaacctttaaaatgccagtgtgtattgtg

SEQ ID NO: 6777485 - DNA, 74 bp, Homo sapiens
tgtttattccaaaaacagtttttgagtgtatgttctacaaagttctgcactagatactgttcaggaaatagaca

SEQ ID NO: 6777486 - DNA, 96 bp, Homo sapiens
tcacaactggatgaggtagctgctatttgtagttcagttttataagatgagcaaagagaggctacgagaggtaagttacaaccagctaggtagtga

SEQ ID NO: 6777487 - DNA, 58 bp, Homo sapiens
agatatagctgaggggtattataatttagcagaaatttaatcttcctacagctgatct

SEQ ID NO: 6777488 - DNA, 63 bp, Homo sapiens
gggtcctcagcacccgtgtctcccctttccttgcaggccagaggaggcaggtgcagaggtccc

SEQ ID NO: 6777489 - DNA, 64 bp, Homo sapiens
gctggaggattcagagacaggtttctgcagccaatgtgcctaaactgcatctctgagcctcagc

SEQ ID NO: 6777490 - DNA, 69 bp, Homo sapiens
acatttagatggtgttatagtactttttgtcataatggtggatgaattgtagcaccattaggtaagtgt

SEQ ID NO: 6777491 - DNA, 77 bp, Homo sapiens
cttgtccagtgcctgctgatgtctctctgggttgtggggaaaggggtgcctggggtggcagaagtagcatggacggg

SEQ ID NO: 6777492 - DNA, 106 bp, Homo sapiens
agagacattttggttggagaaagatgtttagagtgagacagctgggtttgaataaaacttcagtacttagtatttttcagctttgaatctcagaacaagagtttct

SEQ ID NO: 6777493 - DNA, 88 bp, Homo sapiens
ggagtctcgctctgtagcccaggctggagtgcagtggcaccatcttggttcactgcaacctccgcctcccaggttcaagcgattctcc

SEQ ID NO: 6777494 - DNA, 67 bp, Homo sapiens
gctgacttttcatgtatgtgggttttacagggctgactgtgaaacttgagtatatatggattttggc

SEQ ID NO: 6777495 - DNA, 79 bp, Homo sapiens
accagaggcagtagaaatttgagagatatttaggatgtggaaatatcaagaattgctgatgaatctgattggctttggt

SEQ ID NO: 6777496 - DNA, 99 bp, Homo sapiens
gttgccctccaatcccttcccttgaagtagccagagggaggtgtccactcctgattcaagcccttccttagctcctcatggcctggggtggagtccagc

SEQ ID NO: 6777497 - DNA, 68 bp, Homo sapiens
cctgagtgacttggccttccagtctggtcccccttctcgccagtcctgggcaggtcaggccagctagg

SEQ ID NO: 6777498 - DNA, 80 bp, Homo sapiens
ggccgtcctgggcccaggggctgcctggtggcttcaaaatgcagccagtgtgggttgggccgggttgggtccaggatgtc

SEQ ID NO: 6777499 - DNA, 71 bp, Homo sapiens
gctgctggtcctcagagctcatctcgaatagcaagagtaaaagataagaaagactggagggaccaaacagc

SEQ ID NO: 6777500 - DNA, 73 bp, Homo sapiens
ggtttttataatagtttacaaaaatgatgcatttagtaaaatattgttttggtaagcttcatgtgttgaaacc

SEQ ID NO: 6777501 - DNA, 55 bp, Homo sapiens
gcccatgctggggcaatgtttcccaccaggatgtttttttgccttaagtatgtgc

SEQ ID NO: 6777502 - DNA, 56 bp, Homo sapiens
gggccaggcactgtgtgagatatggggatacaaccatgaggacagtgccttggcct

SEQ ID NO: 6777503 - DNA, 76 bp, Homo sapiens
tacaggtacatgccaccatgcctggctaattttttaaaaaaatttagaaggctgggcatggtggctcacacctgta

SEQ ID NO: 6777504 - DNA, 58 bp, Homo sapiens
acacacatatatacatatttgtgcatgtatatttgcatgtttgtgtatatgtgtatgt

SEQ ID NO: 6777505 - DNA, 79 bp, Homo sapiens
tctgacatagcctactgaaagaatacataatttcccctaagaaaagaggagggacttagccttttagctgtaatccaga

SEQ ID NO: 6777506 - DNA, 55 bp, Homo sapiens
cctgcctcccagaggtcctctatacccttggcactagtctcctgctgggagtagg

SEQ ID NO: 6777507 - DNA, 104 bp, Homo sapiens
gcatcagagggctatagggagcagtgcctggcacataattagtgatcctaattattaggaactattcttgttagctcttcttcctattctaggcactgagatgc

SEQ ID NO: 6777508 - DNA, 64 bp, Homo sapiens
gtttattgagcatttaaccatatgccaggcactgtgcttggcactgggacagatgctctcagac

SEQ ID NO: 6777509 - DNA, 58 bp, Homo sapiens
tgacatgcatattcactcttcttgttgggtatccaacaagaccagtgttatgctgtca

SEQ ID NO: 6777510 - DNA, 82 bp, Homo sapiens
ctgaggactcaagttaactgctttgtgagctttctggaggcagaacctccaagcccatccaaattagatgatgtatcctcag

SEQ ID NO: 6777511 - DNA, 71 bp, Homo sapiens
gtgtctcctggcatttggttgagtagaattctatctcccttattagctaagtgtctctgctgaggagtcat

SEQ ID NO: 6777512 - DNA, 119 bp, Homo sapiens
gagcaggatgcccaggtgcaattctgcaggtgaggggtgaggggtgccacacccagcctgtgtcccacatgctgcaggagctcttctcattcaccccaagttttgcatgggctttgctt

SEQ ID NO: 6777513 - DNA, 62 bp, Homo sapiens
atttgttcactgctttattttcagcatttatcacagtgcctggcacattgcagtggattaat

SEQ ID NO: 6777514 - DNA, 75 bp, Homo sapiens
tcccagctcccttccctttcatgcccacagcaaggtctattgctgcaaattggtggtgaggcaagttggctggga

SEQ ID NO: 6777515 - DNA, 61 bp, Homo sapiens
ggctgctcctttaccctggcagcaggataagaagatgtggtgcacagggcccaggagagcc

SEQ ID NO: 6777516 - DNA, 65 bp, Homo sapiens
gttctgggaaggtggacctgttgctttactgtcatctcctctgccatcatctttcttcccaggac

SEQ ID NO: 6777517 - DNA, 71 bp, Homo sapiens
gtggtaagtcatagagctgggttttgaatttcagtcttctgattccaagacctattctattttcagactat

SEQ ID NO: 6777518 - DNA, 55 bp, Homo sapiens
attacaagatgggaaagggaagtgtgaccgggacactctgagagccacttgtagt

SEQ ID NO: 6777519 - DNA, 62 bp, Homo sapiens
ccttgatgcaagggttgcctttccagccaggctgtcttgccccggtaggcaatcctgcaagg

SEQ ID NO: 6777520 - DNA, 66 bp, Homo sapiens
aagtaaagttaggaatttgttactgtgtatattcacaatgcacatataagttctttagcatagctt

SEQ ID NO: 6777521 - DNA, 129 bp, Homo sapiens
cccagctctgccatgctcttcctgtgacacctttggaaaatgttacatctctctagagctcagtttgagcattcattgctagaatgtaatataggttaggggcatagactttagagccagatagctggg

SEQ ID NO: 6777522 - DNA, 120 bp, Homo sapiens
gtttttaatatggtcaatagtattaaagcttggaagcctagattcttttcttttgaccccaagtggaaaagaaagtcttccttgtttgtttgctttttttttccttgtgactgtgaaagc

SEQ ID NO: 6777523 - DNA, 55 bp, Homo sapiens
gttgacaaactacagcctgcaggccacatcttccctgctgcctgtttttgtgaat

SEQ ID NO: 6777524 - DNA, 77 bp, Homo sapiens
atgtctgccacgtagcgcaaatggcaaggctgtctatttaaaccatcagccaaatcaaaccgtctgctggaagacat

SEQ ID NO: 6777525 - DNA, 72 bp, Homo sapiens
gattctacagcccttgacagtggcagaagcatctttcaagacattgctttgctctcactgtaaggtctaatc

SEQ ID NO: 6777526 - DNA, 67 bp, Homo sapiens
ggagtagggggagcggaatgggatgcgaggcaggtctgctcgtgtgtattccctctccttcagctct

SEQ ID NO: 6777527 - DNA, 67 bp, Homo sapiens
cataccgcttgtcaccagcattctcactggcttataagttataattgctctgtgataaaggcgtatg

SEQ ID NO: 6777528 - DNA, 103 bp, Homo sapiens
ctgggcagcaggcagcagggagcaaagcaggagagcctgggcgagcgcacgaagggtgaggctcccatcccggggtctcctccgcctctgtgcctggtcacgg

SEQ ID NO: 6777529 - DNA, 81 bp, Homo sapiens
tgtggcttttccatgccttgctgctttggagtcctctgtatccagccagtggataagggaagagggggtagggcagccaca

SEQ ID NO: 6777530 - DNA, 75 bp, Homo sapiens
tcagctctccctcactccacttccctgggggactcaggatttctaggcaagtaaggagttgcggtggagggctgg

SEQ ID NO: 6777531 - DNA, 87 bp, Homo sapiens
actttaaatgtattaggttgatgcgaaagtaattgcggtttttgcaattacgtggcaataattttttcaccaacctaataactgagt

SEQ ID NO: 6777532 - DNA, 78 bp, Homo sapiens
aagtctgtggctcattctttagaatatacttattactgacaaattcaagattgctgaagaaagtgagtgataaggctt

SEQ ID NO: 6777533 - DNA, 78 bp, Homo sapiens
tcccttcactcaaccagccttgagggttcgttaactcacagcagtgtgaccagcccatagagaggcgaggagaaggga

SEQ ID NO: 6777534 - DNA, 57 bp, Homo sapiens
tcctcagaaacccctgtgaggtggaaattattattacctccaattggtagatgggga

SEQ ID NO: 6777535 - DNA, 73 bp, Homo sapiens
tgccagttttcacttatagggatgttattgaagaattttagaataatgcagagatttcctaaaagtgatggca

SEQ ID NO: 6777536 - DNA, 129 bp, Homo sapiens
tgtctacttagccgcaggaagtgatggctgtggcctgctggtctctttggattgcgcagttgccttatcttcgtgtgacacagaggcagactcggccaccccaggtatgacttgttttgggaagtgata

SEQ ID NO: 6777537 - DNA, 91 bp, Homo sapiens
gggtgtgattgaggcttatataatttgtaaaagcacctagtatgtggcctagcatgccagaggtgctcaagtaatatccttaacctcaccc

SEQ ID NO: 6777538 - DNA, 59 bp, Homo sapiens
gtaccctgaggcctcaggttcattggctttttgtcagattgccataggtctcagtttgc

SEQ ID NO: 6777539 - DNA, 87 bp, Homo sapiens
gtgcgtgtcatctttgctctgatggggtggacatagcagaaaatctaactctgtctgtagccccatacagaatgccagggtgagcac

SEQ ID NO: 6777540 - DNA, 120 bp, Homo sapiens
cctcccagttctgttcttccttcttactttcaccaggctcctcatgatcttgtttctggtgaaatcaagccaaaaccaagggcagctttgaagatagaacaaggaatagagcttcatagg

SEQ ID NO: 6777541 - DNA, 78 bp, Homo sapiens
cctgctgcagcttggcactcggggaccctggatgctttcatgaaggacaggaaagccgagtgccataggaggcatggg

SEQ ID NO: 6777542 - DNA, 56 bp, Homo sapiens
ggattgaggtttaaagagtttttgagcaagtaattaaatttctgcaagcctcaact

SEQ ID NO: 6777543 - DNA, 101 bp, Homo sapiens
gtgtgtgtgtgtgtgtgtgaaagtgctatctatcataaagctatgtaaaagttactctgttttgacagaaagttattattttttaaatgcatatatactgc

SEQ ID NO: 6777544 - DNA, 65 bp, Homo sapiens
ttacggatcttttagaggctagatttgggaggaagaaggaggagcaatgctgggagactctgtaa

SEQ ID NO: 6777545 - DNA, 100 bp, Homo sapiens
ctgccttgcattttcaaagtattgcattttaggttctatgccagattcgcctttaaaattggcttaaccttgtgagtgttagcactgaagatgctagcag

SEQ ID NO: 6777546 - DNA, 59 bp, Homo sapiens
atcctgggaggcggaggttgcagtgagtggagattgcaccactgcactccagcctgggt

SEQ ID NO: 6777547 - DNA, 60 bp, Homo sapiens
tacgtagttgttattactgcatatggtccctgggccagtgcacaatggaacaactcagtg

SEQ ID NO: 6777548 - DNA, 113 bp, Homo sapiens
agagaactttttaaaacttccttttctaggtgcatgcttcactggatattgataatctttcttttctctgtgttctctagagctgtacaaagaaaggtgattctaaaatcttt

SEQ ID NO: 6777549 - DNA, 60 bp, Homo sapiens
agccagagggatctttctaagatgcgtacattgcatgttggataatgtttctttttggct

SEQ ID NO: 6777550 - DNA, 57 bp, Homo sapiens
caggcctggagtggggtccgtgcatggccagctggctctgccccacggccagtcctg

SEQ ID NO: 6777551 - DNA, 67 bp, Homo sapiens
agcctgacttgtaacattttgccaatgtctgtgtgataaatactggtaccatgacaaatgtcaggtt

SEQ ID NO: 6777552 - DNA, 57 bp, Homo sapiens
tctaggtagagtggaccttgctgttcacgtcatagatggccattccgtgtacctaga

SEQ ID NO: 6777553 - DNA, 59 bp, Homo sapiens
tgtaattgctttgtaatgaaatgttgaaagctatttagagtccattcagagtaattaca

SEQ ID NO: 6777554 - DNA, 65 bp, Homo sapiens
gcagtaggtgaaggcctggggccgatgtggggcaccttgtcatgtaggtctgccttatctgctgc

SEQ ID NO: 6777555 - DNA, 77 bp, Homo sapiens
ggagagaggagatatttgtattctgtctctctaaagcaacaaaaaagagaagaaagatcaaatagtttccagtctct

SEQ ID NO: 6777556 - DNA, 55 bp, Homo sapiens
gaaaatgtttcctgttatttgctggacaagtcccaaagaacaggcagatgttctt

SEQ ID NO: 6777557 - DNA, 125 bp, Homo sapiens
tgaccttgattatttgattgtgtggtatctgacagagtgtttttaagtatatttatgaatgcctaaagcagaatatagaaaaaggaatactcttcaaacagctaccctgaagatttcttggatta

SEQ ID NO: 6777558 - DNA, 59 bp, Homo sapiens
atgctttcttctttcctgtaagcaaagatcaattcttccctaggtgctgaagatagcat

SEQ ID NO: 6777559 - DNA, 79 bp, Homo sapiens
tgacgagactctcaacgtttgttaaatgagtatatatatatttttaatggtcaatcagacaaggtttagagtttgttca

SEQ ID NO: 6777560 - DNA, 84 bp, Homo sapiens
taacatcttgctttagtgtggtgtatttgttatagttgataaaccattactgttacaatattatcaactgaggtctttatgtta

SEQ ID NO: 6777561 - DNA, 59 bp, Homo sapiens
gcttacgtacccacctgggtcatctgtcatcaaaatgcccccaggtaggtgccatgagt

SEQ ID NO: 6777562 - DNA, 55 bp, Homo sapiens
cttgagggcaggattctgttttattcatgtttgtatccacagagcctaactcagg

SEQ ID NO: 6777563 - DNA, 69 bp, Homo sapiens
gagagatcacatattgcttctctgaaattgtgaggtgagcggctcaggctagaagtaattgtgtttttc

SEQ ID NO: 6777564 - DNA, 67 bp, Homo sapiens
ctgtggcttttccggggagccttttcttctccctgaagtcacccccgcatatcccggagagccacag

SEQ ID NO: 6777565 - DNA, 88 bp, Homo sapiens
agtttaattaaatgtttagttttattttagtaatactttggcctttgtagttgccgagtggtaaagtgtactgaatatgaataaagct

SEQ ID NO: 6777566 - DNA, 62 bp, Homo sapiens
tccagttggaaacctacctgtgaaacctttagtaaagagatttcactaggtttctaggtggg

SEQ ID NO: 6777567 - DNA, 77 bp, Homo sapiens
tttgtaaatttgtactgccagatattaaacatattgcaaggttacagtaaatgctttggtgctggtacagaaacaga

SEQ ID NO: 6777568 - DNA, 70 bp, Homo sapiens
gtagtaataagggaggttgtggtacagtcatcaatcaccctcttggaactgctccaaaacctccatctgc

SEQ ID NO: 6777569 - DNA, 72 bp, Homo sapiens
ccctgaaggcatttcagagatctctgaggctgctactcccatcacaggcccagagtgctagtgccttgaggg

SEQ ID NO: 6777570 - DNA, 80 bp, Homo sapiens
ccctccatacttacaaatgatggtgttgctttcttgctgcctatgaatactaagttgtagtcacacatcccaggtgaggg

SEQ ID NO: 6777571 - DNA, 62 bp, Homo sapiens
attggtctaggctttaaaaagaccagcagcctctacttctgctgggagaagccagatacaat

SEQ ID NO: 6777572 - DNA, 64 bp, Homo sapiens
cagtcttcatagaaatatcacgtcttttctgattcatgaaaaggaaattttctgtgtgagattg

SEQ ID NO: 6777573 - DNA, 105 bp, Homo sapiens
ctgccctgcgctgtgctcgagctactgaaatattgatttttacagagccggcgcacacacactgaaaaatcaatattccagtgcacacaacagaacaggcagcag

SEQ ID NO: 6777574 - DNA, 56 bp, Homo sapiens
ttacattctggaaaggcacagaccaaagggccaggctgggccagccagacatgtga

SEQ ID NO: 6777575 - DNA, 68 bp, Homo sapiens
aggcaaatccttggcacagtggaattcaacagtcagttgacatcctgtctgagttcaaggtgatgcct

SEQ ID NO: 6777576 - DNA, 125 bp, Homo sapiens
aaaaagtctaaactatgtgaaggaagtggttttacaaagagaaagatcaattgcctacacaattcaaattttctagtgaattttttaatttgtggtttactttattcattttggagttacttttt

SEQ ID NO: 6777577 - DNA, 56 bp, Homo sapiens
aagggaggctcggccggctgctgcttacgcgggtaacctgtcggaaagccttgttt

SEQ ID NO: 6777578 - DNA, 58 bp, Homo sapiens
tcttcagagtaggatactagcttagttaagattgttgggtgctaatctgctctgtgga

SEQ ID NO: 6777579 - DNA, 65 bp, Homo sapiens
ggtccgttgacaggaaggcgttcccagcgactggacgctgcatgacgctcttgcaatctcacacc

SEQ ID NO: 6777580 - DNA, 63 bp, Homo sapiens
tgagcctggagcccagatgttttctctgggaagaggagcaaatgttattggctgcaaggctca

SEQ ID NO: 6777581 - DNA, 55 bp, Homo sapiens
ctttggttctgtccttcccagaaacctgaaagttgaagccaagacaggatcaagg

SEQ ID NO: 6777582 - DNA, 87 bp, Homo sapiens
gggactataggcatgcacaaccatgcacagctaatttttgtatttttagcagagatggagttttaccatgttggctaggctggtctc

SEQ ID NO: 6777583 - DNA, 70 bp, Homo sapiens
gcagtctggaaccaatatttgagggtttggcaggctagagtaaaatccataaaccatgcttccaggttgc

SEQ ID NO: 6777584 - DNA, 66 bp, Homo sapiens
aattataggtaagagcactgtctcctgctgatggtttacatcagaggtacccgcccttacagaatt

SEQ ID NO: 6777585 - DNA, 65 bp, Homo sapiens
ctggactgtgaggtctgggtgaggaggaatggtgtttaattctcatgtatatcttcagtgttcag

SEQ ID NO: 6777586 - DNA, 59 bp, Homo sapiens
gtgggtccggtccagcattctgggacgttcatggcgtgtttccctgcgtttcggcccac

SEQ ID NO: 6777587 - DNA, 62 bp, Homo sapiens
tgtcatccctgctgtggcctgtctcctgtctcccaggagcttaggccagggacagggacaca

SEQ ID NO: 6777588 - DNA, 72 bp, Homo sapiens
agtagatcccacatggagaaatgtaccactgaacctgtgtagtttgctgagtactctcctgtgtagtttgct

SEQ ID NO: 6777589 - DNA, 64 bp, Homo sapiens
ttttagattgggaaatgtaaagtcaacttaaagcagttgaaatcataacatttcctaactgaag

SEQ ID NO: 6777590 - DNA, 97 bp, Homo sapiens
gaggtaggaaaatcacttgagcccagagttcaaggctgcagtgagtttgatcataccattgcacttcagcctgggtgacagagtgagatcctgtctc

SEQ ID NO: 6777591 - DNA, 86 bp, Homo sapiens
gtagccagttgactttgcaaatgtgagtttagactgcattccaaatgcagtttagtgttgcatttggagttacatagtttggttat

SEQ ID NO: 6777592 - DNA, 76 bp, Homo sapiens
gcctgccctaggttaggctgtatgctcaatgtggagttttccatcatgaataagacaggccagcctggggtaaggt

SEQ ID NO: 6777593 - DNA, 111 bp, Homo sapiens
gttggccatgctggggccttctagggtcacagtgcacagcaggcgtggggccttcatctctgtggcatgttgcacttgtacctggagagtcggcctgggcatgaggccaac

SEQ ID NO: 6777594 - DNA, 80 bp, Homo sapiens
cctgggatgatgactcttccgctgagaagtttggctttctgtggggctctaagtgaccttagggaagtgttattctcagg

SEQ ID NO: 6777595 - DNA, 80 bp, Homo sapiens
tgtttaagccacccagtctatgttatcttgttatggcagtccagccaactaatatagggcatgagaaaagggaggagaca

SEQ ID NO: 6777596 - DNA, 60 bp, Homo sapiens
ggggctgctggagttaggtgggcttgaatctctccttcagctctgctagctctgtgcccc

SEQ ID NO: 6777597 - DNA, 81 bp, Homo sapiens
gtgtgttgagtgaataagacctaaggatgaatcatcatctgtgatatcatcaaaagggtattattggagctgcagcaacac

SEQ ID NO: 6777598 - DNA, 63 bp, Homo sapiens
tctccatgtttgctgcattccacacaattactggtagtgtgtgccagatacaagcactgggga

SEQ ID NO: 6777599 - DNA, 74 bp, Homo sapiens
tccctcctttaagagatatggctctctaatactttgcctgttgtttaagatacagacctcttattaaggaggga

SEQ ID NO: 6777600 - DNA, 59 bp, Homo sapiens
gtgagataactctaggtcttcgagatgtcatcaaaggtggccttgatggagttgtccat

SEQ ID NO: 6777601 - DNA, 82 bp, Homo sapiens
ttcttgtctggtttgctcatcttttacttggagacaagagctgttcaccttgctctgattaggtggaaacaagacagtagaa

SEQ ID NO: 6777602 - DNA, 59 bp, Homo sapiens
agacacttggaaggctggcctgagctctccgagaggcggtggtcagcagtttagggtct

SEQ ID NO: 6777603 - DNA, 91 bp, Homo sapiens
atgatgccaggactgcagcttcagggacttgtggcagatgcacagggtgcctctggctccctggagctccacactgcagtcccagctctgt

SEQ ID NO: 6777604 - DNA, 58 bp, Homo sapiens
ctgggagacactgaattctgccaataacctcaataagcttagaagcaggttctcccag

SEQ ID NO: 6777605 - DNA, 55 bp, Homo sapiens
ctggagctaataatccatctgaatatgaagaatcagaaggatttcatcagtccag

SEQ ID NO: 6777606 - DNA, 95 bp, Homo sapiens
gaagaatgtttgaaaatgaaacaattagctgtaatatcaccacagaacaggaatggttttgttgtggctgttgtttgttttcagcatgtgttttc

SEQ ID NO: 6777607 - DNA, 85 bp, Homo sapiens
tttttcattcattaatttaatattcaaagaacacctgatttatgccagccaccgttccaagtgttgagattagagggatgaagaa

SEQ ID NO: 6777608 - DNA, 81 bp, Homo sapiens
gggaaacaagcagggagcatcaagggaggggcccctgctcagcatccctcctatttggagcttccttgtctgatgtctccc

SEQ ID NO: 6777609 - DNA, 63 bp, Homo sapiens
ttagtcactagatgccgtatatataggatagttagctatcgaatggcttctcaggtgcactga

SEQ ID NO: 6777610 - DNA, 68 bp, Homo sapiens
ttcatgggcagtggtctgacttcttctttatgcttttccctggagcagcagggtcattgctctttgaa

SEQ ID NO: 6777611 - DNA, 66 bp, Homo sapiens
ggacctgtctgtttttcttgccatacctgagatcatcagaaatggcattgcaagggcaggaggtcc

SEQ ID NO: 6777612 - DNA, 96 bp, Homo sapiens
gtgtaccttgttgctgaaaaatgagtgaattgtgatttgtggacatattctacatcataataatacttagaaagtttataagcaaagttggtacac

SEQ ID NO: 6777613 - DNA, 91 bp, Homo sapiens
tgtcaaatgtgtgttttataattgcttcataagatgagtttcagaacattcactgtttcttaaagcagcttgtaaaatgtaggtattgtca

SEQ ID NO: 6777614 - DNA, 55 bp, Homo sapiens
ggtggttcatgcctggaatcccagcactgtgggaggccaaggtgggcggatcacc

SEQ ID NO: 6777615 - DNA, 129 bp, Homo sapiens
aagaaagtgtgtgggtttagctgtttggtgaaacaggatgagaagggctcttacgttactcatcaactgagaaacatatttccatctatttatactaacacatcaatctggatgcatacactgtgactt

SEQ ID NO: 6777616 - DNA, 65 bp, Homo sapiens
gatacaggatgctgaacatctctgggttgtctttccaaggggatggtctccaggtccactgtatc

SEQ ID NO: 6777617 - DNA, 58 bp, Homo sapiens
tatctgctttcctacttatcttggtgaataaaataaagccaggaaagaaaggcaggtg

SEQ ID NO: 6777618 - DNA, 77 bp, Homo sapiens
agggaagatgatgaatgtgtccagaagacttgaggtgactaaggaacacttgtggaaacattcgctgacactttcct

SEQ ID NO: 6777619 - DNA, 58 bp, Homo sapiens
ggccctcagctcccctgcgctggactctgctctccagcctgcagggcccttgtgggtc

SEQ ID NO: 6777620 - DNA, 124 bp, Homo sapiens
ggaagagtgttagaggagaaaactgctgctgagagtattggcaggcttggcctcagtttggactctgtaattttctttggacccaagtctgtaacctctgcgtacttcttctctcttaccttct

SEQ ID NO: 6777621 - DNA, 57 bp, Homo sapiens
attttctagatagatgatgcataagtttttaatcttctgcttgcacatctagaaagt

SEQ ID NO: 6777622 - DNA, 96 bp, Homo sapiens
cccggggccggaggagcgagagcgaagcagggagctgccctgtaatctggggcagccgtttccagcccgcgacttgttcagacggcgattcctggg

SEQ ID NO: 6777623 - DNA, 74 bp, Homo sapiens
ttatgtcctttaacttcatcacaagcacaagaaagattagtacattttgcaggtgaggagtctgaagcacataa

SEQ ID NO: 6777624 - DNA, 57 bp, Homo sapiens
catgccattccctgatcctaaccttccttaaggaagttcaagtaggagagtggcatg

SEQ ID NO: 6777625 - DNA, 58 bp, Homo sapiens
tggggttttaacatgttgccaggctggtcttgaactcttggcctcaagtgatccccca

SEQ ID NO: 6777626 - DNA, 55 bp, Homo sapiens
aggtttgaagacgtcattgaggggatgctgccatagaccaatgattctcaaactt

SEQ ID NO: 6777627 - DNA, 56 bp, Homo sapiens
tttctgccagtcactgctctaggtgctagcacttcacagagcattctaggcagagg

SEQ ID NO: 6777628 - DNA, 73 bp, Homo sapiens
ggtgaaaggatctagggtgtaggtcactgatgcttcttggaatcagcctggccataccctgagctgtttggcc

SEQ ID NO: 6777629 - DNA, 93 bp, Homo sapiens
cccctccagcagtgccactgcctccccaggctccacactgccatgtggtgatgtgggtcctgtgtggggagcagcccatgtgttgggaggagg

SEQ ID NO: 6777630 - DNA, 69 bp, Homo sapiens
gggctggagtgtttagttatattttgacttttagaagttgtcttcatatctactttgcaattcagtacc

SEQ ID NO: 6777631 - DNA, 77 bp, Homo sapiens
gttcagtaatgctatgctcagtctcaaatgaaataaagttgttcataacatcagaaagagatggctaagtgctgaac

SEQ ID NO: 6777632 - DNA, 83 bp, Homo sapiens
ctcagtattcatcccatgtgtttcacagctcacatcagtcccgtatatgagctctgagacacaaagggtgcatattcactggg

SEQ ID NO: 6777633 - DNA, 77 bp, Homo sapiens
taattataattgtagacatttgtcaagaatgactcatttggccaatggagtgttggcaaatgtttacttaataatta

SEQ ID NO: 6777634 - DNA, 76 bp, Homo sapiens
ggctgggactgacttaggcgagcagctgctcttaccaggggccactgggcatgcttgccatgggccagtgctggct

SEQ ID NO: 6777635 - DNA, 65 bp, Homo sapiens
tgggactcaaggcagcagaagaagactactgtctaaggatctgttagcttttacccagggtccta

SEQ ID NO: 6777636 - DNA, 69 bp, Homo sapiens
aagtaatcaagagcggcgacagcctttttttactcactggaaggttgtcatgttgactctgagggactt

SEQ ID NO: 6777637 - DNA, 87 bp, Homo sapiens
gatgggtattctactctgaatgtgcatgtaaatcaatgcattacttttgtagaggataagtctgcatattcagtgtgacctctcatt

SEQ ID NO: 6777638 - DNA, 104 bp, Homo sapiens
gtgtgcatgagtgcctgcatgtgtgtacatttgtgcacatgtgcatgggtgtggatgtctatgcgtttgtgtataaatttatgtgtgtgggtatgtgtgcacat

SEQ ID NO: 6777639 - DNA, 113 bp, Homo sapiens
gatgagctacttacagtccaggttgtgctgtcacatgtccggtgtcttttggtactctgagtttgtataaggaagctgttagacatgcatagtgcagcctggcatggcttatc

SEQ ID NO: 6777640 - DNA, 64 bp, Homo sapiens
ctttgattcagagagaattagcacattatttttcgtgaagaacatagttctctttgatccaggg

SEQ ID NO: 6777641 - DNA, 60 bp, Homo sapiens
tttatccattcaccagttgaacatttgggctatttgcagtttttggtggtcatggataga

SEQ ID NO: 6777642 - DNA, 67 bp, Homo sapiens
ctcgaaagctgttaatggcttgcagctgcctatgataggaagtctgcacatcttagctgtttttgag

SEQ ID NO: 6777643 - DNA, 58 bp, Homo sapiens
tgctctgcacatccctcacaaactgaatgttatttctttggtttgttgtgcagatgca

SEQ ID NO: 6777644 - DNA, 69 bp, Homo sapiens
gtgaagtgtgtgcatttttgataactgtgtacttctggtgactgtacagttagaaatgctattttttat

SEQ ID NO: 6777645 - DNA, 67 bp, Homo sapiens
tggaagagggagctgggtggcccttactttcctttgcttaaaggtggccctgactttccttttcaca

SEQ ID NO: 6777646 - DNA, 63 bp, Homo sapiens
gagcccattactttgcctatatgatgatgtaattaagtacaaattggaaaaggtagttggctt

SEQ ID NO: 6777647 - DNA, 74 bp, Homo sapiens
gcattttgtaagtctctcttgttagactggtgaacaaagtggagaggtgaggcaagaagagagtttaaacatgc

SEQ ID NO: 6777648 - DNA, 83 bp, Homo sapiens
tcttgtgtagtatttctcaactgcggcaatgaaaataaaacttgcaaccgtgtggcgcaggctttagaatctgctacaataga

SEQ ID NO: 6777649 - DNA, 75 bp, Homo sapiens
ggtggaaagccaggccagactcacacccttgctcttctcttgcagttggggaatgggtttttctgtctgtctgtc

SEQ ID NO: 6777650 - DNA, 77 bp, Homo sapiens
gccagctcagtcctcctctcatagagagttcttcattccctttcccaagctgctctctggaagggggagctgatggc

SEQ ID NO: 6777651 - DNA, 63 bp, Homo sapiens
gaaggaggctgctgccatcattaggtgtctgccacgcctatgagtcagtggagcctgcacttc

SEQ ID NO: 6777652 - DNA, 68 bp, Homo sapiens
tgagctaggttttccagtcgcatggagcactttctcacatattccacgctactgatttatctcgctta

SEQ ID NO: 6777653 - DNA, 83 bp, Homo sapiens
ggggtgttgtctttcttggtataaagcagggatatccaatcttttgacttccctgcctatattaaaagaagcaaagttgtctt

SEQ ID NO: 6777654 - DNA, 73 bp, Homo sapiens
ccctgggcagtttctccctctctccagctgtccagtcaaatttcaggctggagaagccaaactagtcactggg

SEQ ID NO: 6777655 - DNA, 103 bp, Homo sapiens
atacttgtgaataggactgaaatttatattttgggcactctttacctcagattcagagttcttaggattatttaaaattcatttgctggatgttttcaagtat

SEQ ID NO: 6777656 - DNA, 64 bp, Homo sapiens
agaggatagcaaatctgtttcaggtatatttggaatttgttagatcttgttacagatttccttt

SEQ ID NO: 6777657 - DNA, 87 bp, Homo sapiens
ctgtctcacttagcctgggagattcaggtgaagtttgtgcacagacttgaaagaaatgcagaatttcctagggtaggcaggagatgg

SEQ ID NO: 6777658 - DNA, 62 bp, Homo sapiens
ctatctggaagtcagaggtttgcagtccatttctgaattgctaaagctatattcccagaaag

SEQ ID NO: 6777659 - DNA, 76 bp, Homo sapiens
gttctgccaggcaggtgcagattcctcttgacttttgttatgaaaaccatcgtcaccttgcctggcttaccagagc

SEQ ID NO: 6777660 - DNA, 64 bp, Homo sapiens
gtttccagctcttagcaaaggcagaacaataaaacatcaaggatgtctttctaaggctgcaaac

SEQ ID NO: 6777661 - DNA, 91 bp, Homo sapiens
gtttcttttcataaacattggcaagtgaatttaacagccctgtttgtattagctggaggtttcatttgcatagtgattgttcttaggaaac

SEQ ID NO: 6777662 - DNA, 106 bp, Homo sapiens
ttttgctggactaacaatgttttggccatttggaagtagaaaataatctaatcgattactttttgcatagtaagtgtctttaataccttgtatttttcaagtaaaa

SEQ ID NO: 6777663 - DNA, 59 bp, Homo sapiens
ttccctgggactggcctgcacctcttgtcgcttgctggtgctgtgccctctgctgggaa

SEQ ID NO: 6777664 - DNA, 57 bp, Homo sapiens
ttggcaccagcacttgggatggcttatgctcagagtcaaacctactgtgcggtccaa

SEQ ID NO: 6777665 - DNA, 62 bp, Homo sapiens
cagcctccctgggcgctcttgtgccccacacggccggtgcctgagagctggggatgaggctg

SEQ ID NO: 6777666 - DNA, 80 bp, Homo sapiens
atgtctatattgagcgtatatgtacacatatatttatgcatatgtggatgtgtgtttatacatatattctatgtatatat

SEQ ID NO: 6777667 - DNA, 69 bp, Homo sapiens
gaagaagtggagcttttcctatcagagctactctgtggtactggtggagaggtcttccatgatgcattc

SEQ ID NO: 6777668 - DNA, 79 bp, Homo sapiens
tgaaagagatgtcaaggaagtgtgatctgaataatctgaaggaagactgaagagctttttgacatctctctatttttca

SEQ ID NO: 6777669 - DNA, 96 bp, Homo sapiens
gtaggaattcagactcttcaagattttcatgttttttatcttttgagtgattgggaacattctagagtgttgtgaaaatgtgtctgcatgtcctgc

SEQ ID NO: 6777670 - DNA, 60 bp, Homo sapiens
cagtagctactagccacatgttaatgttactgagtacttgaaatgtggctagtgcaactg

SEQ ID NO: 6777671 - DNA, 62 bp, Homo sapiens
tgcttccaatggaatcatgtcttgataactactgttaagcaacaagaatcccattggcccca

SEQ ID NO: 6777672 - DNA, 73 bp, Homo sapiens
gaaaatgttattcaaaaattctatggccaagcagcaggtcattggtattggaagacaatttgaaaacattctc

SEQ ID NO: 6777673 - DNA, 76 bp, Homo sapiens
gggagcagactgaggaaagtattgcctggtgaatccgaaggggcagaagttggagctttccatcagctatgtttcc

SEQ ID NO: 6777674 - DNA, 85 bp, Homo sapiens
ccaaattgtcagcaacccatcactcccaggcaaaatccaaactgctgggctgtccccttggactgatttgtgtgctggcttttgg

SEQ ID NO: 6777675 - DNA, 74 bp, Homo sapiens
gctctgtgtgtatgaaattgttcatctagaattatttatctggaaaaaaagacactttcaaatatgcacagagc

SEQ ID NO: 6777676 - DNA, 57 bp, Homo sapiens
cctgacctgttacatatattatctaatttaatattcacagtaagtgtagcaggtagg

SEQ ID NO: 6777677 - DNA, 78 bp, Homo sapiens
gtggaaggttaagagctccaatatttgtggcaactatttgagatgccaaaaattagaaggggctcagagcacctctac

SEQ ID NO: 6777678 - DNA, 79 bp, Homo sapiens
taggggtggagctaggataagcagagactgggttataaccctttcagcccaaatattctatctctctaagtagcccctg

SEQ ID NO: 6777679 - DNA, 59 bp, Homo sapiens
gcttcaggcagacagagctgtgggtctagggcagagacccatgcatccctctcctgggc

SEQ ID NO: 6777680 - DNA, 79 bp, Homo sapiens
gagcctcttactcatcccgaagtcatcagtcatgtttccaagagtgtgagtaattcagggagggagggagagagggctc

SEQ ID NO: 6777681 - DNA, 127 bp, Homo sapiens
gcaagagagttgcctaggacacaaaatatgagacataatcacttttagggtcatgcagctgcagggtggcacttgcatgatcctgagagtatctccttaaattttgcgccccaggtatttcttttgc

SEQ ID NO: 6777682 - DNA, 76 bp, Homo sapiens
aagtgtcacctcagagatacaaaccatggctattccaactagagaagccagggttggtctctctgaggtcacgctt

SEQ ID NO: 6777683 - DNA, 70 bp, Homo sapiens
tgtcggtgcaagccagcttgatgacctgtcggacatcacagaagaagttgtccagctggtttgggccaca

SEQ ID NO: 6777684 - DNA, 77 bp, Homo sapiens
cccttcctgaggtgctgagcacagtgagtgcaccatccaaccagaagcaacagctgtggaaagagcctttggagggg

SEQ ID NO: 6777685 - DNA, 66 bp, Homo sapiens
aggtggattacttctttgtgcttcagtttacttatccataaattggtataaaaacagtacctacct

SEQ ID NO: 6777686 - DNA, 60 bp, Homo sapiens
ctctccagggtgagctaggccaggaagtccttgcatcctcctacccccagccctggagag

SEQ ID NO: 6777687 - DNA, 70 bp, Homo sapiens
tgatatggcttatgtaggacactgtgcatggagaaggggagaacctgctttgctgcctactaagccctca

SEQ ID NO: 6777688 - DNA, 64 bp, Homo sapiens
ggaaattttgactcattcccttaagtactagctgttaagtggtatttaatatatgagagtttcc

SEQ ID NO: 6777689 - DNA, 108 bp, Homo sapiens
gatattggtctgttttatacttgcatctaaggtggataacttccagccattctcccctaaggggagaagttatccaccttagatgcaagtataaaacaaaccagtatc

SEQ ID NO: 6777690 - DNA, 75 bp, Homo sapiens
ggggctactcttccaatttttgctgctattgttatatattaatattcactgggtactaaaaagatgggcagcccc

SEQ ID NO: 6777691 - DNA, 60 bp, Homo sapiens
gatcttggagggtcttccacagccatgtaataccatggtcacatgaccctttccaaaatt

SEQ ID NO: 6777692 - DNA, 57 bp, Homo sapiens
gaggagagacccagatatatcgaccaggggctcccctgaaatttggaatttctcttc

SEQ ID NO: 6777693 - DNA, 64 bp, Homo sapiens
tccttgctggccattctctttgagatgaaaggactgcagatcaagctgtatggtcagagaagga

SEQ ID NO: 6777694 - DNA, 96 bp, Homo sapiens
gccagaggcagggcttggaccccaggcagggcctaacagagctctcgtaccagctattgatgtgtcttcctggcttaccctagctcctgcccttgc

SEQ ID NO: 6777695 - DNA, 123 bp, Homo sapiens
ctgttcacacctaatgtcttgaagagtaggtagcagcagtgtgggctgaacctaggccagcttgcttagcgggtcaccctgctgtgaagtcctggcaggtgttggtaatgtgtggaaatgcag

SEQ ID NO: 6777696 - DNA, 57 bp, Homo sapiens
tgactctgctgtgaaagcatttatggactttagaggctgtaagcacagcagggatca

SEQ ID NO: 6777697 - DNA, 55 bp, Homo sapiens
cccccacagggcggagattatctgtgaaagaaaatatctgcagctcctggggagg

SEQ ID NO: 6777698 - DNA, 55 bp, Homo sapiens
tacttcttctcccttcaactggttactaaatctggccaaatgtggagaaaaagta

SEQ ID NO: 6777699 - DNA, 64 bp, Homo sapiens
agctacactgtcttagaaaggggcatgctcatgggcattttgttcaaatgaagattgtgtagtt

SEQ ID NO: 6777700 - DNA, 89 bp, Homo sapiens
gggctgcctgccaggtgccagggcgcggctctggcctcccgctgcacaacccactttgccgccaagccctgtacccggcccagcagctc

SEQ ID NO: 6777701 - DNA, 65 bp, Homo sapiens
tgtgaagatgctctccatccaggagtgtctgagtcctggctggagcaggcatcttgtttaacaca

SEQ ID NO: 6777702 - DNA, 80 bp, Homo sapiens
ccttattagggaaactgacttgtctccaaggcagttccgtttgctacattacaatgagacagtaagttactttgacaggg

SEQ ID NO: 6777703 - DNA, 61 bp, Homo sapiens
tcttgcctgtgctttaggcctcaaactgatctcctggcagtgctcagggcattaggctaga

SEQ ID NO: 6777704 - DNA, 69 bp, Homo sapiens
agtactgcaggtggtggcccaggttggtcttgtaggaagcccgccgtcctacgccatcatagcggtact

SEQ ID NO: 6777705 - DNA, 56 bp, Homo sapiens
gcacacagaatcagtgggcataataaaatagttgtgtatgcagctaggtttggtgc

SEQ ID NO: 6777706 - DNA, 96 bp, Homo sapiens
cggagatgtgtactgatgttgcctccagtctcattttgtttgtaagcctacagatagatttgagggaggctttgaacaacatctttatattctctg

SEQ ID NO: 6777707 - DNA, 96 bp, Homo sapiens
acttgagttatggtattttgtgtggagctccaagtagcccgaatctaaagtctagagcatccatgcatggatttgacatgtgtactgtatttgagt

SEQ ID NO: 6777708 - DNA, 67 bp, Homo sapiens
gtttgagcagtttaaatctgtattttctatctaattgatgtgttgcaagaggagactgtactcagac

SEQ ID NO: 6777709 - DNA, 59 bp, Homo sapiens
tcctctgctcctgtggctctggaaggagatgcactgttctcccacccagggggagagga

SEQ ID NO: 6777710 - DNA, 75 bp, Homo sapiens
agaagctgctgtgttctcttgacccacccttaccccctgactggcctgtagctgggaggaggactagcagcttct

SEQ ID NO: 6777711 - DNA, 119 bp, Homo sapiens
ttcacagtctgtttaaagataagtcaggttatctagatgtgttatcagacatttgcaagtcgttgggtaaaccattaagatattttggaatttcatctttctcatataaaacacttgaa

SEQ ID NO: 6777712 - DNA, 58 bp, Homo sapiens
acagaattgttagcttaatggttgttgtcttaagccattaaatgttggcatattttgt

SEQ ID NO: 6777713 - DNA, 57 bp, Homo sapiens
tgggctcatggcccagcactggggcccattagggttagctgctgtggccagaatcca

SEQ ID NO: 6777714 - DNA, 70 bp, Homo sapiens
ctccattgttcctcacgtggacagatgatgcgtcctggtaaagcatgtattttccaaaaggaagttggag

SEQ ID NO: 6777715 - DNA, 63 bp, Homo sapiens
agtctattttagctgcatatgttttctgtattaattgggtgatgttagctgctatagtagatt

SEQ ID NO: 6777716 - DNA, 60 bp, Homo sapiens
ggggatggggcagaggttaaaggtggggggttctccacctgtggattttggttcctcctc

SEQ ID NO: 6777717 - DNA, 70 bp, Homo sapiens
gtatctctagtatcccttttgtaggtccaaatttgacttcctcatggcccagtagaaaagggatcgatac

SEQ ID NO: 6777718 - DNA, 75 bp, Homo sapiens
gtgagcaggataggggctcccttccctatacagtctgggagggaacatgtgcctctgtctaaaacacctcctcac

SEQ ID NO: 6777719 - DNA, 114 bp, Homo sapiens
ttctcttcttggagacctttggcaacacttggacaaggcacagcctgggtaatgaggaagtccctgcaacacagctcagtgcctccaagatttccagatacacagagaagagga

SEQ ID NO: 6777720 - DNA, 76 bp, Homo sapiens
gccagctgggatcaagctacaccctttggaaagaatcactatctgctctaatcatgtagacttattgcagcctggc

SEQ ID NO: 6777721 - DNA, 86 bp, Homo sapiens
gtgtacattgataaagggttgacagttatttccaaagctgcaaagtgctataggaagtaattgttgcctggctattcagaaggcac

SEQ ID NO: 6777722 - DNA, 70 bp, Homo sapiens
ctttacatgctttatcggattgacactgcagagaagcctttgatgttctcggttggataaacaggtttag

SEQ ID NO: 6777723 - DNA, 64 bp, Homo sapiens
gtccttgatgagatatttactctgtgaccatttctttctctgagagtgtttttctgtcaaggac

SEQ ID NO: 6777724 - DNA, 73 bp, Homo sapiens
tacatttttaaacctatctaagaaatagccctgatattgaaatggcttctgtggaataggtttgacagatgta

SEQ ID NO: 6777725 - DNA, 57 bp, Homo sapiens
gtcatttgagtcagcaacaggataatctgaatctgaggccaaaatgactcaaatgac

SEQ ID NO: 6777726 - DNA, 68 bp, Homo sapiens
tctggttcctatatagccttaaggattaattttagtgatcctcaaggaattaaatagggaatttcaga

SEQ ID NO: 6777727 - DNA, 94 bp, Homo sapiens
cctaaaagggcttgcccagaaaaggagctgcaggatgatgacagagagctgtgcgtcttgcaagatgctcctcattcatcatgtcccccctagg

SEQ ID NO: 6777728 - DNA, 86 bp, Homo sapiens
agcaggactggtttcttctggaggctccagggaggttccatttcttgtatcttccagcttctagaggctgccaacagtccttagct

SEQ ID NO: 6777729 - DNA, 105 bp, Homo sapiens
gcgtccaggagctggcagagcggcgcccggtcggcacccagtggcttggcggcccggcgtgcccctaaggggcccagaccgggcgccgagagagtccagcggcgc

SEQ ID NO: 6777730 - DNA, 94 bp, Homo sapiens
atatattctgactggtatcaaacaattaattagatttttacaaagaatataaaatagattttaattagtgtattggtatgttggtcaaatatgt

SEQ ID NO: 6777731 - DNA, 80 bp, Homo sapiens
ctgtggcttcaactgcaggacgaccgcctcatcttgaggcctctgggaggtaggtgctgtggtctccccgcttgacgcag

SEQ ID NO: 6777732 - DNA, 129 bp, Homo sapiens
tcctcctgtgtgggcatatgaggagggttggtaatgatgagatgctttgtgtatagacaagatttttggttttggttttaatggcagaggttttattaatgcttttacttgatttaaagtgtaggagga

SEQ ID NO: 6777733 - DNA, 61 bp, Homo sapiens
cttgatcctgagtcatggtgatgtgctatagcaccttacatttccacagactgaggtcagg

SEQ ID NO: 6777734 - DNA, 91 bp, Homo sapiens
gaggaatgtgtacaggtgaggtgacaggcatggggtcatgcagctgggagtggcagagctggcactgaccccaggcctgtgtctgttcctc

SEQ ID NO: 6777735 - DNA, 56 bp, Homo sapiens
tgcttttccatggggatccaattacttctgtgtggaccctttatgcggaacaggta

SEQ ID NO: 6777736 - DNA, 57 bp, Homo sapiens
gcccattgccctgaccagctgggataatactctgcttgctgtcccaggccaaagggc

SEQ ID NO: 6777737 - DNA, 65 bp, Homo sapiens
ctacagctgtcactcctgctcttgggatgggccaataccaagagtaaattcatgatgccaagtag

SEQ ID NO: 6777738 - DNA, 62 bp, Homo sapiens
tcaccatctgtatctgacaaattcttgctgctttgcaacggaagcatttcgataagatggga

SEQ ID NO: 6777739 - DNA, 58 bp, Homo sapiens
gcttcccacagctggactggggctccgcgttactgcacccagaagttccatggggggc

SEQ ID NO: 6777740 - DNA, 56 bp, Homo sapiens
tattatctctaaatttaggagaggataaatgttccctcctgggctaagatatagtg

SEQ ID NO: 6777741 - DNA, 86 bp, Homo sapiens
ccacccatttggtctccatactggttagtaggtactccctcctgccagcctctccacagtaggagatgccccaaaacagagggtgg

SEQ ID NO: 6777742 - DNA, 80 bp, Homo sapiens
tgattggcccatggttctgcaggccaaccggaagcatggcagcatctgcttctagggaggccgcaggaagctcccaatca

SEQ ID NO: 6777743 - DNA, 82 bp, Homo sapiens
gcctttgctattgtgaatagtgccacaataaacatacgtgtgcatgtgtctttatagtagcatgatttatagtcctttgggt

SEQ ID NO: 6777744 - DNA, 69 bp, Homo sapiens
actcttatgtacaccctaattataattgcatacaatgtctgcatgtggatatgttagggtgatgggagt

SEQ ID NO: 6777745 - DNA, 77 bp, Homo sapiens
cgtgcagtcagtctggagaggtaagtcagccggaacatgggttttggttcattttctcatctagatgtgactgcctg

SEQ ID NO: 6777746 - DNA, 63 bp, Homo sapiens
tgtgatggcaactcaatttctacaagactgaaacagtcttcatgaaattgattgcttatcaca

SEQ ID NO: 6777747 - DNA, 67 bp, Homo sapiens
agtctgaaggtacaatagaaataattaagcacacaatgtggtttgattagttttgttgaagaaggct

SEQ ID NO: 6777748 - DNA, 80 bp, Homo sapiens
ggtctagtatgaagtgaagctggagaaaggcagtggaaaatctccaccgaagtgcaaatcgcagccaccaaaaccagacc

SEQ ID NO: 6777749 - DNA, 60 bp, Homo sapiens
taaaggttagtagcagggaaactgtttccacggtcttgaaatctctgcttctgaattttg

SEQ ID NO: 6777750 - DNA, 76 bp, Homo sapiens
tcctcacaattgcttctccaactcttttaagtaatagggagctccagttaagtaaattgggggagcaggtagatga

SEQ ID NO: 6777751 - DNA, 88 bp, Homo sapiens
ggagtctcgctttgtcgcccaggctggagtgcagtggcaccatctcggttcactgcaacctccgcctcccgcgttcaagccattctcc

SEQ ID NO: 6777752 - DNA, 109 bp, Homo sapiens
gaaatggggacaggttgcccctgcctccatgtgtcctgagtcgctaccacccccaccaggcccgcggcccacagcacggggacccactggcagccgtggcccctctttc

SEQ ID NO: 6777753 - DNA, 55 bp, Homo sapiens
tggtttctcagactctttgcagtttttcattgtacaatgtgggcatgagaaacca

SEQ ID NO: 6777754 - DNA, 63 bp, Homo sapiens
agagacagttggggattagtgattactgtgacttggatagtctcactctgattaggtgtctct

SEQ ID NO: 6777755 - DNA, 66 bp, Homo sapiens
ctttctctttatgcatctgtacatctgtatgtctacaaacacacaaacacatgcatagagagagag

SEQ ID NO: 6777756 - DNA, 76 bp, Homo sapiens
ccttgtagttgtttcccccattgtctgtcaaagtggagagtaatcccagatggtttgcatgggagggctacaaagg

SEQ ID NO: 6777757 - DNA, 66 bp, Homo sapiens
taaacagctactgtgtcaaaggccaagagtttctattttcaaatcatgggacatggtagctctttg

SEQ ID NO: 6777758 - DNA, 55 bp, Homo sapiens
gatccagatatttgggctggtatacataatgatgccatgttcttgaatctgggtc

SEQ ID NO: 6777759 - DNA, 115 bp, Homo sapiens
gtgaatttccaagtatttacttggctaaaagtagctcgagaacagatttttctgctgtcacttaggtgcacacaggggagttctcagaaactctggcgaggcatggaaatggcac

SEQ ID NO: 6777760 - DNA, 55 bp, Homo sapiens
tcctttgtcttcattcctccttcccgtgagggtggggtggtctgctgaagaggga

SEQ ID NO: 6777761 - DNA, 74 bp, Homo sapiens
cacataataaggaagttgcagaagtggaattgaatcccagccttcctcactttgtagccatcctttcacatgtg

SEQ ID NO: 6777762 - DNA, 77 bp, Homo sapiens
tcagtggtctcgctgcagtgcaagcccagatggattggtccttactgatttgcagtgcagcactaccagctttctga

SEQ ID NO: 6777763 - DNA, 75 bp, Homo sapiens
gctttgtgagtcacttgacgtctgttgcaactactcatcacagtgtgaatgcagccagcaagtgaatacataagc

SEQ ID NO: 6777764 - DNA, 130 bp, Homo sapiens
gaagcagtgctctctagtgaggatgggggtctgtctgcaaagattggaagccacactcattcagtgggctccaaaatcctgtagcctccctctatatcttaataattttttttttttgagacagagtttc

SEQ ID NO: 6777765 - DNA, 79 bp, Homo sapiens
cctttatggtaacagctccagcttgagtcctgagtgcatgctctgcggtctggggtcacctggggtgcttaccagtagg

SEQ ID NO: 6777766 - DNA, 87 bp, Homo sapiens
agactttagccaggtttgtctgacactggagttcatgctttcactctgggtattgttaaggcagattgcctggcctgattatagtct

SEQ ID NO: 6777767 - DNA, 67 bp, Homo sapiens
gagcccttccaattgtgagattttttaattattattattattttattctttggagagatggggtctc

SEQ ID NO: 6777768 - DNA, 66 bp, Homo sapiens
cctacctgaccaggtggcttcccaaggggcacacgatcttgttggggagaagagctggtcaggagg

SEQ ID NO: 6777769 - DNA, 67 bp, Homo sapiens
gtaaaggcccattcaaacagctaggtgttcagcacacatatcttctgcctagtttgggtctgtttgc

SEQ ID NO: 6777770 - DNA, 62 bp, Homo sapiens
gtgtcaggcagagttagtgatttaggcagtggttctgcctgaggcttaatctgtcccaacac

SEQ ID NO: 6777771 - DNA, 73 bp, Homo sapiens
tttggtaagtctatttatccttgatcaaattagctaaatgttaatacctgcatagataggtagttatactaaa

SEQ ID NO: 6777772 - DNA, 74 bp, Homo sapiens
tctcttggaggttcttcctgtttctctacttatctcttgttgttgttgtagttctgcagaaacctttaggatga

SEQ ID NO: 6777773 - DNA, 57 bp, Homo sapiens
gtgctgagctgcagatgcgctctgacaagcacgtagagtgcagatgtcctttcacac

SEQ ID NO: 6777774 - DNA, 66 bp, Homo sapiens
cctttaaattgttttacactctcacttcacttggagaaagttgacagggaggtggaataagtaagg

SEQ ID NO: 6777775 - DNA, 64 bp, Homo sapiens
gctgagagggaacaagctcctggccgggcctaatgggttccaggtgtgctctgtgccctgcagc

SEQ ID NO: 6777776 - DNA, 56 bp, Homo sapiens
gtcctcagatgctgctgaaatgtacacatctcatagtttatgccagcgtttaggac

SEQ ID NO: 6777777 - DNA, 98 bp, Homo sapiens
attagactcccacaggaggctccttggagcatggtccagctagtttatgtcttgaaggggcagccatgctccaggtgcagtcttgggagccatctgat

SEQ ID NO: 6777778 - DNA, 94 bp, Homo sapiens
aaacatcacatctgacatttgagttgagactctttgggtaaagttaattaattcatttaggtattcacttacttgtcaggtatagattaagttt

SEQ ID NO: 6777779 - DNA, 108 bp, Homo sapiens
gtaagaagtcagatgaaaaattgcattattcaaaccatttttatggagtgtcttgtacacagcaggcactgaagtggtaaatgtaaatacgttttcttattgtcttat

SEQ ID NO: 6777780 - DNA, 58 bp, Homo sapiens
tccgttgacactgcatggagattatttctgtgacagcagtcttcaccagtgttaagga

SEQ ID NO: 6777781 - DNA, 67 bp, Homo sapiens
gctgtcaaacattgagcacttgctatttgcaggcatactgctaagatcgcagctaatatttgacagc

SEQ ID NO: 6777782 - DNA, 59 bp, Homo sapiens
gctctgggctgaatcatttatctgattatgtggactaaaagaatgtagaggtccagggc

SEQ ID NO: 6777783 - DNA, 71 bp, Homo sapiens
gcactgtcctagttgaagaggctgtcatcacttgggttaagtgtgacagcacggttcaactgctgctgtgc

SEQ ID NO: 6777784 - DNA, 97 bp, Homo sapiens
tgaggacaagtattggcccattcaataccttagagaaaagaaaactatgggaaaatttttttctgagagtatatgcctgagccaaattcttcactca

SEQ ID NO: 6777785 - DNA, 72 bp, Homo sapiens
atatggacatctcaagctagtgtttatagtaaggatatatcctacttcattattctagttttgagcttatat

SEQ ID NO: 6777786 - DNA, 78 bp, Homo sapiens
ctattgtgcccatggtcacagagcttaattaattgtcaaggagacaagagtaagatacctgggacagttggacaatag

SEQ ID NO: 6777787 - DNA, 68 bp, Homo sapiens
gatagttacaaaccaacaggcagcgtctcgtttttgttgttgttgttgtttgtttgtttgttttaatc

SEQ ID NO: 6777788 - DNA, 67 bp, Homo sapiens
ggctgaggctagcctcctaagtgcaattgggaaaaaaaattttgtaaatagttagcttgcctctgct

SEQ ID NO: 6777789 - DNA, 101 bp, Homo sapiens
gtgcaacaaggctgacatgtgctgtgctgtcatgtatttaattagttgtgcatggagattgatacatgtggctgtcacagcataatggactggcatggcac

SEQ ID NO: 6777790 - DNA, 78 bp, Homo sapiens
tgggagggattgggatggagcctgagtatagtttaccttctcagagaacattcagacaccgtacctattgccctttta

SEQ ID NO: 6777791 - DNA, 80 bp, Homo sapiens
ctgcatggggcctttggaagcagaagagggtgtgagggtcatgtgctacctgccgcttccaagggctgtccccatgccag

SEQ ID NO: 6777792 - DNA, 76 bp, Homo sapiens
tgggactctggagttttatttggtgctaagtagagagtgcctatatgatcagcccaaataaaaactgtagtcacta

SEQ ID NO: 6777793 - DNA, 105 bp, Homo sapiens
ggcaagattgatctgaggactgaacaaaatcatccatgtgcaaactttggtatcagttaaccaatgtgcctcatatggatgggcccagacctttgatgtcatgcc

SEQ ID NO: 6777794 - DNA, 64 bp, Homo sapiens
tgaagggtgcaaagcactctagctgctgaccagtggcagttcagagaccattctgctcccttca

SEQ ID NO: 6777795 - DNA, 64 bp, Homo sapiens
cacagagctagacagcaagggcctgcctcatgcagacagcagccctaacctgtcatagtgtgtg

SEQ ID NO: 6777796 - DNA, 77 bp, Homo sapiens
gcggctttctttatgtgtaaaaggcatgttttattgagattgaagagacaatgtcttttggataggtaaggaactgt

SEQ ID NO: 6777797 - DNA, 110 bp, Homo sapiens
ggtgaatgtaacctaaaatgtactccctggtgtgttatgatactgataaacttctgtttagggtaacatgattttagtatcataatatggtattatgggtgacgttttcc

SEQ ID NO: 6777798 - DNA, 76 bp, Homo sapiens
gtgctctgtagcaagttattcaataaatgtgagttaagttggtgaaacatttaatggaaaacatggtgctaagtat

SEQ ID NO: 6777799 - DNA, 60 bp, Homo sapiens
acttctctattttgtgctctgttgaatgacttggggtgaacagatgggacgtggaggagt

SEQ ID NO: 6777800 - DNA, 101 bp, Homo sapiens
gagaactaaagttttaacatgtaaagtaacttgtcctggttcacctgccttaggagtggaatcaaatcaagttcttttgagtgtagatttaatagactttc

SEQ ID NO: 6777801 - DNA, 108 bp, Homo sapiens
tcccaggtgctgcaggtgaatgggcctgtgtcactcttcgtgggcactgatgtcaggcatgggcctggaagaggacagagaaagtgtgttctgcaagcagccttggga

SEQ ID NO: 6777802 - DNA, 75 bp, Homo sapiens
ggaggaggctctggggcctcagggcctactgtatactcctctgtgactctgaacctgaggcttgggagttccgcc

SEQ ID NO: 6777803 - DNA, 82 bp, Homo sapiens
ctctctcattactataacctaatccttaacacagtgtctgatccataataactgagggaaggaaggtatagagaggggagag

SEQ ID NO: 6777804 - DNA, 60 bp, Homo sapiens
ccataaggagccagacattccagaatttgaaggaaagggcagaaaatggcatccttatgg

SEQ ID NO: 6777805 - DNA, 60 bp, Homo sapiens
ctcttctcctgggtgccaggctgataatagaattaaagcccagcatatactaggcctgag

SEQ ID NO: 6777806 - DNA, 69 bp, Homo sapiens
aagaaatggagactcagggacttagggtacctaagcaacttgcctaagatccaacattgtccatttttt

SEQ ID NO: 6777807 - DNA, 70 bp, Homo sapiens
agttcttgacaactatactacttactgggaaaatatctgcgctgtgagctttatggttatctaaagaact

SEQ ID NO: 6777808 - DNA, 66 bp, Homo sapiens
gtggtaaagaagataacaagcttgagaaaagtgcacttttttctagtctcgatctcttaatgccac

SEQ ID NO: 6777809 - DNA, 102 bp, Homo sapiens
atgggttctggggcttggggtggtggaggagaggcgccttgcggaaagccctcttcaggcactcgaaggcctcttgctcctcgactccccagtagaactggt

SEQ ID NO: 6777810 - DNA, 59 bp, Homo sapiens
gcctttttcaggagttgtgggagaccatctgtacttttctctcattatatccaagaggc

SEQ ID NO: 6777811 - DNA, 71 bp, Homo sapiens
tgtcaaacatagggactttgtggtcactctgtatatcacagattgctcttataatagtccttatgttagca

SEQ ID NO: 6777812 - DNA, 114 bp, Homo sapiens
ctgtgtgttactctctgctgtggttctgcctttagcgctgtgactggtacgtaattaacaaccagctgctgattgctaaatgcatgaatggtcacctgtacctgtggcagacag

SEQ ID NO: 6777813 - DNA, 82 bp, Homo sapiens
agctgcctcgtgaaatggtgacagagaggggcttggtattgattttgctgcctgttcctgatcattctattaggaggtggtt

SEQ ID NO: 6777814 - DNA, 86 bp, Homo sapiens
gagaattgcttgaacctgagaggtggaggttgcagtgagccaagatcttgccactgcacttcagcctgggcgacagagcaagactc

SEQ ID NO: 6777815 - DNA, 91 bp, Homo sapiens
ggaacaagccttagttagataagactttgctcctctcctgggagctccaggacactaaaaagccaagcttgctaccaacgcttgcccttcc

SEQ ID NO: 6777816 - DNA, 77 bp, Homo sapiens
gagatggtggtgaagagcacagtgaggaacagccggcatttaggaagtaccatcgcgtagctgttgacccccatccc

SEQ ID NO: 6777817 - DNA, 102 bp, Homo sapiens
ggatagggagacatgtttagtcatacagctagtgaagtcaggactggaattcaagcctgttgttgctgacttcacgagttgtgctcttgatcatctcattcc

SEQ ID NO: 6777818 - DNA, 56 bp, Homo sapiens
ttcaatgctggtttgtaaaaatatgtcaaaaaattaacatgcctgccagcattgga

SEQ ID NO: 6777819 - DNA, 59 bp, Homo sapiens
ttagcatgtgcaagggcctggaggcaagaatgagcttggcactctccctgcactggtga

SEQ ID NO: 6777820 - DNA, 65 bp, Homo sapiens
tattgccttcttgtctaaggaacacatcattaaagctgaaagatggttccttagaggaggcggtg

SEQ ID NO: 6777821 - DNA, 59 bp, Homo sapiens
gttattcctactaacgtcctgtgtcactgaggtgagttccacttgggggaaggaatgac

SEQ ID NO: 6777822 - DNA, 93 bp, Homo sapiens
tttcaggcttccgaactatttgcttctagtcagttccatgtgcaggtaactccagccaaaggtcttgtcttgacagagtttgccagcctgaaa

SEQ ID NO: 6777823 - DNA, 94 bp, Homo sapiens
gggacttcagttaacggaaaggggtgtgtcccaacaaagactcatacagtcaactgtctccatgctggcatgccccactgttaattgatttccc

SEQ ID NO: 6777824 - DNA, 98 bp, Homo sapiens
cctgggatcttatctgcctccactctgctgcctcggtgtgggtaccatcctaagggtggatcccctgtggtagcaagatggatgcaggtggcaacagg

SEQ ID NO: 6777825 - DNA, 66 bp, Homo sapiens
gttgagtcagcagtagtaaatcatgaaatatgatatgaacaccatggaagtgctcttctgaccaac

SEQ ID NO: 6777826 - DNA, 57 bp, Homo sapiens
ttttctagttcttagagaattggtctgccatagatctttctactcagaagtagaaga

SEQ ID NO: 6777827 - DNA, 58 bp, Homo sapiens
tcaggaaagaagatgctcagtggactgctacccaccccacatccctattcatttctga

SEQ ID NO: 6777828 - DNA, 60 bp, Homo sapiens
ctcatgcctgtaatcccagctcttggggatgccaaggctggtggattatgaggtcaggag

SEQ ID NO: 6777829 - DNA, 56 bp, Homo sapiens
cctcacagccctcctctagcactgatctggctgaactctgcagagcagctgtgggg

SEQ ID NO: 6777830 - DNA, 55 bp, Homo sapiens
aatttcccagtttctgtgggagagtgggagcctctcccacagaaactgcgaaatt

SEQ ID NO: 6777831 - DNA, 96 bp, Homo sapiens
gttctggaactagaagctgctgcccctgatgcctagaacagagctctcattaagctgcagggcagctagggagcttttggtatctgtgttccagac

SEQ ID NO: 6777832 - DNA, 67 bp, Homo sapiens
ctccatcagccccatggtgtgctccagcaggctcaggaggcaggcactggagatggggttgtcggag

SEQ ID NO: 6777833 - DNA, 105 bp, Homo sapiens
ggaattttaagaagacattgcctctgtttcagatatatttgtacttagctctaaggcaacaaattgaggatagtgaatttaagtgggggtagtagtcttaattcc

SEQ ID NO: 6777834 - DNA, 58 bp, Homo sapiens
ttaagcaaatgtcagttgttagtcaaccaaaatcggaggcaacagatattttgcttag

SEQ ID NO: 6777835 - DNA, 56 bp, Homo sapiens
gtgctgcttgggggcagagcagtttctggtcacagaagaaagccctcaggcgacac

SEQ ID NO: 6777836 - DNA, 60 bp, Homo sapiens
ataaggctgtgtttgcctggatgagagattgcagattccgtcagcagatccagcacttgt

SEQ ID NO: 6777837 - DNA, 74 bp, Homo sapiens
tctgaagtgagaacagtttgttggagactgtgcccttaaccagtagagtctctgctaactctgttagtgtcaga

SEQ ID NO: 6777838 - DNA, 80 bp, Homo sapiens
gctgattcccactggaatggatagagcagagtctgccttccccatcctgacttctttctattccgatccagaaagactgc

SEQ ID NO: 6777839 - DNA, 88 bp, Homo sapiens
gtaagggcatcttctgtagccatctcataaaattggattgtataactgtttactcaaggtgaaggagaggctgagaagtgattcttac

SEQ ID NO: 6777840 - DNA, 130 bp, Homo sapiens
tctgcccaccttgtgaatcaccgggaagctcagggagacagtggatttcctagagcactcagatgagattccaggaagtgactatgtcatacctgctgccagggatcttagggtggtcaccaaagttcga

SEQ ID NO: 6777841 - DNA, 66 bp, Homo sapiens
tgaggatagtatgaattaaatcatgagagaaaaaatgtctattcatggtattttttattatgctta

SEQ ID NO: 6777842 - DNA, 83 bp, Homo sapiens
gtgatgagggcttggccatttagggaggcaaggtgatttgctcaaagtcacacagctagtaagggccgaggcggaactcatgc

SEQ ID NO: 6777843 - DNA, 81 bp, Homo sapiens
agagatatgtgtaatactcctctgcactgtacccagaaatatactaggcactgaaggcacagaagtaaaatacaagtctct

SEQ ID NO: 6777844 - DNA, 112 bp, Homo sapiens
tagcctcaggcatgtccttcaggagggattccagaggcattgttatagacgatgacagctctgtgtgtgttattgccactgaagaccttccatgggacgcgatgtggagctg

SEQ ID NO: 6777845 - DNA, 64 bp, Homo sapiens
ttctctggagaaaatagtttcttctctagaaggtgtataaggagaagaaaacgtcttcagggga

SEQ ID NO: 6777846 - DNA, 66 bp, Homo sapiens
gctcaggatcgcttgccctagggaagtgacccaaaccttcacacctgaagggtcagggtcctcagc

SEQ ID NO: 6777847 - DNA, 71 bp, Homo sapiens
atgttctgttagaattgagctttataaactccaaaacattggtaatcaagcgtaagtcagttctcagacat

SEQ ID NO: 6777848 - DNA, 58 bp, Homo sapiens
agaagtttggtccttttcaaggcctaattttactgtgagtttataggaccaaacttct

SEQ ID NO: 6777849 - DNA, 73 bp, Homo sapiens
ggaatcttcaggggcaatggagatatgacccagagagactttgtttaatgtcttcattccccatgaagtcttc

SEQ ID NO: 6777850 - DNA, 73 bp, Homo sapiens
aattgcaatgcttattattaatagaatgttcaaattacggtactgtcattttatgaagtaataagtagcggtt

SEQ ID NO: 6777851 - DNA, 58 bp, Homo sapiens
ggccttaatctttccaggacctcaagcctctgtgagagtctgaagaaagacagggact

SEQ ID NO: 6777852 - DNA, 86 bp, Homo sapiens
agagacttctggaggaggctgcaacagggaaccagctgaagtcctcagctgaatctcaggcatcctttccctcctagaagctctct

SEQ ID NO: 6777853 - DNA, 112 bp, Homo sapiens
ggaggagtaagaaggtgggaatggggacattacagaatgcatggttagaaacaggcagctctgacctctgagccaatttctgtgtccagtttccccgtccacttgctgttct

SEQ ID NO: 6777854 - DNA, 63 bp, Homo sapiens
gcaagttagaccatagaaagagcatccaacttggagcttggggcatatggtgctaccttctgc

SEQ ID NO: 6777855 - DNA, 60 bp, Homo sapiens
tgatggttattacattcctcttgccagtaattggtataggatgtgcatatgacctaatca

SEQ ID NO: 6777856 - DNA, 73 bp, Homo sapiens
gggaccctggggacactgcccctgtgctgagttactgagatgagccagccttgcagctgtgcccagccttccc

SEQ ID NO: 6777857 - DNA, 57 bp, Homo sapiens
ctaggacctttacaattgtcctgtcagccatctggacttaggaatgtagaatcctag

SEQ ID NO: 6777858 - DNA, 57 bp, Homo sapiens
gttgtggagcgggcaggtaggactattgttcccgttgcgtcttggctgctgtgcgat

SEQ ID NO: 6777859 - DNA, 61 bp, Homo sapiens
ctttcataaggggttttataatcctattttataagggattttatagtcccttttatgaagg

SEQ ID NO: 6777860 - DNA, 56 bp, Homo sapiens
cactccacagtgcctgactcctggcaaacgtccaggaagtgctcgctgtggggatg

SEQ ID NO: 6777861 - DNA, 67 bp, Homo sapiens
ggagaagcagcatagctcccttagttgtgtcttaggtgaagcaacacttggctttgtttgtttttct

SEQ ID NO: 6777862 - DNA, 62 bp, Homo sapiens
gagcaactaggcttgcagggtggacatgttatgtctaaataactatctattgagccttgctc

SEQ ID NO: 6777863 - DNA, 68 bp, Homo sapiens
gtacatttatgcttaaaatcactaggatcagcaacactgattaatggagagataagcatggaatgtat

SEQ ID NO: 6777864 - DNA, 91 bp, Homo sapiens
gtgagttaccactttacccccactaggatggttaaagtctaaaagacagtaataagtgttggtgaggatgtggagaaattggaacccttat

SEQ ID NO: 6777865 - DNA, 73 bp, Homo sapiens
agacacggtgaaatgtcatcctttagccatttatttcctaaaaggcctcaaaagatcatgtttccatgtgttt

SEQ ID NO: 6777866 - DNA, 76 bp, Homo sapiens
taaataaggctcagagaagttaaggccaaagttatgaatcaagtaagtggcagagcttgttctcaagcctagttta

SEQ ID NO: 6777867 - DNA, 62 bp, Homo sapiens
ggaattcagggaagtcaaaaagcacagggcttcacattgataagtgatttccatctgattcc

SEQ ID NO: 6777868 - DNA, 71 bp, Homo sapiens
aagttctaaaatgccttgattcatgattctgtgatttcatatacaggacaatttataatgggcaagagctt

SEQ ID NO: 6777869 - DNA, 84 bp, Homo sapiens
gggctgcagtgaggattcttaggtggtttgaacttccaccaggcacaaaggtggaagcatttgagctttcttactggcatgtcc

SEQ ID NO: 6777870 - DNA, 80 bp, Homo sapiens
ggtctgcacagtgatgtcagaattggaaatcttcacctgaaagtccaattttctgatttcacttgaaatattggcagact

SEQ ID NO: 6777871 - DNA, 83 bp, Homo sapiens
cagctgcagtttaagagaattctggttttcctatcttgtcaccaacacgtagtcttatcagaatttttaagttctgcagtctg

SEQ ID NO: 6777872 - DNA, 93 bp, Homo sapiens
aaaattataacatttcctgatatagaagtctagaacaagagacatgaactatgaaacttattcagtttctacccttggaagtgtcattatttt

SEQ ID NO: 6777873 - DNA, 57 bp, Homo sapiens
actttgccctacagcagctctgcctccccatgtatgctgctgaggtggaggcaaagt

SEQ ID NO: 6777874 - DNA, 66 bp, Homo sapiens
ggaccaggaaacctccatgtagtcttcttaaatggaaaactataggctgcaaggaagttttggtct

SEQ ID NO: 6777875 - DNA, 84 bp, Homo sapiens
ctttatcttcattcccagcagccatgtaccacactcagtgcctggacatggtagatggctgcctaatgaatgaatctgatgaag

SEQ ID NO: 6777876 - DNA, 62 bp, Homo sapiens
aaaatagcctcacataattgcttcttcaagtttagtggaagcagctaagctgtggctgtttt

SEQ ID NO: 6777877 - DNA, 60 bp, Homo sapiens
gctatctggtggcgtgactaagactttgatagtcagatcataggtgtgttaccagttagt

SEQ ID NO: 6777878 - DNA, 72 bp, Homo sapiens
ggagccccacccactctgaccagaagctccccatccatggctgtgctgtctagagttggaagttctggcttt

SEQ ID NO: 6777879 - DNA, 59 bp, Homo sapiens
cacaactttccttgactgtaagatgggtaaaataatacttgctttacggggaagttgtg

SEQ ID NO: 6777880 - DNA, 59 bp, Homo sapiens
gtctctgggaaatagaggaccctagagccatattggatcaggcctgatatcccagacac

SEQ ID NO: 6777881 - DNA, 124 bp, Homo sapiens
ggcagagctacaatctcttcagaggcaggtagttgctgtgctggggcctcctgctctgttgaagaagagtggaccccctcaaggcagagctggggcctcctgctgggttgaagaaggttctgcc

SEQ ID NO: 6777882 - DNA, 89 bp, Homo sapiens
ttttattaggctggtgcaaaaataattgtggtttttaccataaaagtaatggcaaaaactgcaattgcttttgcaccagcccaataaaa

SEQ ID NO: 6777883 - DNA, 85 bp, Homo sapiens
agttccaggggctttcacttaggccttcctgtcatattgaccttcagtctatgagtcagagagcctatgtggggattctggcact

SEQ ID NO: 6777884 - DNA, 57 bp, Homo sapiens
ccccggcctcgcccctcttgggggccttcaaggaactggacagggagggcgctgggg

SEQ ID NO: 6777885 - DNA, 55 bp, Homo sapiens
gggaagcagcattgtgctggctcagcattgaagcaggtgcacagtgctgctgctc

SEQ ID NO: 6777886 - DNA, 56 bp, Homo sapiens
ggggcatgcatgtgtttcatacagcaggcatttgttgagcaccagctgcatgcccc

SEQ ID NO: 6777887 - DNA, 58 bp, Homo sapiens
tctctagggtttagcacagataattttaacaactgaagtttggaacagaccctgggga

SEQ ID NO: 6777888 - DNA, 64 bp, Homo sapiens
ttcagagaacttcatggaagagatcattttgagctgagccttgaggaaatgaggattttctgag

SEQ ID NO: 6777889 - DNA, 57 bp, Homo sapiens
tcctgccctgaaaagtcagtctctttaattcaaggtacagggtttgaagaggcagga

SEQ ID NO: 6777890 - DNA, 59 bp, Homo sapiens
gcaagctggctgttagaggatgattacttctcttaaattacctcttaccctcatcttgc

SEQ ID NO: 6777891 - DNA, 102 bp, Homo sapiens
taatgaaagcttcataatcaatagtggttttggcagcacccgccatctattgtaatatacgatctggtgctgtcataactttgatcattgatttttttttta

SEQ ID NO: 6777892 - DNA, 93 bp, Homo sapiens
cttcatgaaaattatgtgccctgttatagtctgaggcctcagctccatgctatcaggcttcaaggacagcagccacaggatacctctatgagg

SEQ ID NO: 6777893 - DNA, 55 bp, Homo sapiens
agagttgaggctggagaggtatgcaaaaaatcagatcttaaaaggtcttaacttt

SEQ ID NO: 6777894 - DNA, 64 bp, Homo sapiens
tatagtgatgtcttttaaattacataatcagtaaaatgatcaatgtgaggtaggcatgactata

SEQ ID NO: 6777895 - DNA, 90 bp, Homo sapiens
atgagtagaaagaggtcttggttacacagactcttcaattcagagggcaggccccatcgaggggagctgtgtgcaaaccttgatgctcat

SEQ ID NO: 6777896 - DNA, 64 bp, Homo sapiens
gactgagaataggcatcccgaggtgtttgtcttaacaatggaacccagagtgtctgtctcagtc

SEQ ID NO: 6777897 - DNA, 74 bp, Homo sapiens
gacggcgctgggtcggcctggcgcgccctcccgcgcccacgggcgctaggctaggtctgtgcgcagccgctgtc

SEQ ID NO: 6777898 - DNA, 77 bp, Homo sapiens
ctgagtgcaccttcatcaccatcaagccagacagtgtgcagcatggcctggctggcaagatcgtgaagtgctttgag

SEQ ID NO: 6777899 - DNA, 64 bp, Homo sapiens
ggacatacagcgattctcagttgggggttccttctaggatccccagggagtgagctgtctgccc

SEQ ID NO: 6777900 - DNA, 57 bp, Homo sapiens
tagcccagagagccaggggcttgctataatcaaggaagccagtggccagctgggtta

SEQ ID NO: 6777901 - DNA, 80 bp, Homo sapiens
aagggaaattctggggttagtgcagatctggtatagtctatagtcctggatgctgtggtaagccccaccggagctccctt

SEQ ID NO: 6777902 - DNA, 76 bp, Homo sapiens
ggcgggcaatttaaagaggatttcctcacttcttccctaggggagatgagtgggggatctctcacacaggcctgcc

SEQ ID NO: 6777903 - DNA, 97 bp, Homo sapiens
atgtctaaaatttgagaagtatgaaaacgtgcaaagtagaattaaccactggccatgcccgttcattcatacttaacctctattaacatttaggcat

SEQ ID NO: 6777904 - DNA, 60 bp, Homo sapiens
cttagtcagagcagggcaggcagaggggattcatcaaaatgcctgcctcctttggctagg

SEQ ID NO: 6777905 - DNA, 58 bp, Homo sapiens
gccgaccctatgtcacacgctgtctgtgacaggtccaggatttgtggggtcttaaggc

SEQ ID NO: 6777906 - DNA, 60 bp, Homo sapiens
cagggccattggcgtggctgtctgccagctggcaggagcagcatgttaaatgccgtcctg

SEQ ID NO: 6777907 - DNA, 55 bp, Homo sapiens
agaaggaggaatgggtagaaaggcaaaaagttcaaactcagctcttcctccctct

SEQ ID NO: 6777908 - DNA, 58 bp, Homo sapiens
ctctgttctctgattgtctgataggcgtatagtttgcctctccagacagagaacaggg

SEQ ID NO: 6777909 - DNA, 72 bp, Homo sapiens
ggagcccacacctcttggtctgggtcggccacacagagctctaccaccggctcatccacggagaggggctcc

SEQ ID NO: 6777910 - DNA, 78 bp, Homo sapiens
agaatctggggatgtttgttacagcacttaaccttttttgacataagaagccaaatgccagtgacctctctacattct

SEQ ID NO: 6777911 - DNA, 62 bp, Homo sapiens
cagttggcagatttgtcagtaagctgcatatttgagttactgacttacattctgtcttcttg

SEQ ID NO: 6777912 - DNA, 70 bp, Homo sapiens
actgaggcagtgaggtcggtctcacccaaacgcatgtggcagggacttggatcctcgaatctgcctaggt

SEQ ID NO: 6777913 - DNA, 63 bp, Homo sapiens
ggcaagtttgatgagtttctggaggctttgaatttgaagttttcctaaatttttagatttgcc

SEQ ID NO: 6777914 - DNA, 72 bp, Homo sapiens
tccccaggaatcaggtggttgctttcagcgggttagcttcatgcattttatgctgatttgatttcctggaga

SEQ ID NO: 6777915 - DNA, 59 bp, Homo sapiens
cagctcccagagtgaccagcagagggcgctgggcccaacatggtcagttctgggagctg

SEQ ID NO: 6777916 - DNA, 90 bp, Homo sapiens
tcatctaggccctgggaatgtaagtgggcagaagacagacagagtgctggttgtcatggagcttatattccaggtggagaaaatagatga

SEQ ID NO: 6777917 - DNA, 86 bp, Homo sapiens
gcacatttctttattgcactaaccatgataatgatgtatcatttatttagtgatcaatgcttgtcattgttcagtaaaggacatgc

SEQ ID NO: 6777918 - DNA, 58 bp, Homo sapiens
ctaggccacattccacaaatgttctgtcattaatatctgctggaaaaagtggttctag

SEQ ID NO: 6777919 - DNA, 56 bp, Homo sapiens
gtttgcagtcccacgtggcatggcctccagcccaacccacagtggagactggagac

SEQ ID NO: 6777920 - DNA, 130 bp, Homo sapiens
tcttagcatcccctaggaacttgcacacccaggtctctcgacttctggacctgcttcttaccatgccgtcttaagcagtcaggagtcgctgcctgggttcgagtcctagttaaattacttagtgctgaga

SEQ ID NO: 6777921 - DNA, 62 bp, Homo sapiens
ttgaacctagttagttctgggtcatcctgactcaggaatcctggactattaacttggttcaa

SEQ ID NO: 6777922 - DNA, 96 bp, Homo sapiens
ccagtgatgttgatagaattttttaaaacttctgcactcacaaagagaacaaaaaggtgtggtatcagcaggcaagaggttttatcaaatgtctgg

SEQ ID NO: 6777923 - DNA, 76 bp, Homo sapiens
tcgctctgttgcccaggctggagtgcagtggcgggacttcagctcactgctacctctgcctcccgggttcaagcga

SEQ ID NO: 6777924 - DNA, 67 bp, Homo sapiens
actgtttgctgatagatatttaaaggttattttttattaatgatgggaatagttctgtggcagcagt

SEQ ID NO: 6777925 - DNA, 58 bp, Homo sapiens
gtgtttgatgccctgtggtttttctctcacagagaccacagtccagtcatcatggcac

SEQ ID NO: 6777926 - DNA, 70 bp, Homo sapiens
ggtattcaggtaaaatagatagtatttctgaagttatcattaggaactttactctattttatagtgagcc

SEQ ID NO: 6777927 - DNA, 69 bp, Homo sapiens
aggaggctggttcaggccatattccaaatcctcatctgtgtgtgagtggcattcttagcctagcctcct

SEQ ID NO: 6777928 - DNA, 81 bp, Homo sapiens
ttttaatataattgggtatttcaaagagttcaaaattagggtggaagagctaagtggaaaatgcagttaataatattagaa

SEQ ID NO: 6777929 - DNA, 78 bp, Homo sapiens
cctttctgacttcaagatgaatctttgggacgatgtttctggtgcttggtccacagtgattcacttttgaaggagagg

SEQ ID NO: 6777930 - DNA, 76 bp, Homo sapiens
gaggcaacatgtaaaaagaagaatctggagctagccctggttcagatcctcactttcttattagaaatgtagcctt

SEQ ID NO: 6777931 - DNA, 70 bp, Homo sapiens
gcatttaagggctacttgatatgaatagcatatatctataaagcaagacatttccagtagcctgagatgt

SEQ ID NO: 6777932 - DNA, 57 bp, Homo sapiens
tagggtacaactcgaaagttctgtgaccaaaactgaatccatctcagtagtaccctg

SEQ ID NO: 6777933 - DNA, 57 bp, Homo sapiens
gcgtcgccggcgcctcgaggtgcgccactcaagccctgcccaggaatccggcggcgt

SEQ ID NO: 6777934 - DNA, 77 bp, Homo sapiens
ttgtcaatgattctgcaactgtgtgccatgaattcttagtcctgcaacatggtcataaagacagaaacattccacaa

SEQ ID NO: 6777935 - DNA, 129 bp, Homo sapiens
taatatgtagagcatctcaagagttggcaagatcttgtcttggctttgagaagccacaaacctccctcatctgcattttctgggggccaggacagtggtaaaaacggctgctctctctacccggtattg

SEQ ID NO: 6777936 - DNA, 63 bp, Homo sapiens
ttagttcacattctagaatgttatcgtggattaaacatatggtgactcctaaatgtgaaataa

SEQ ID NO: 6777937 - DNA, 61 bp, Homo sapiens
gcattcctgtacctctctgctagtatctaatgatgcatattaatgagagtgtattggatgc

SEQ ID NO: 6777938 - DNA, 63 bp, Homo sapiens
ccctgctgagagccagggctggcattagtgacaagaccgtgcctcccggggctcttccttggg

SEQ ID NO: 6777939 - DNA, 57 bp, Homo sapiens
tcatcatgactaagtgctgacacattctggggattgtcagtgaacttgttatgttgg

SEQ ID NO: 6777940 - DNA, 71 bp, Homo sapiens
cctgtgtgaaagccccctcagcccagagtgcttggcagagctggctttgagctgggaggtgtctgcactgg

SEQ ID NO: 6777941 - DNA, 83 bp, Homo sapiens
aagctgcacggcattctttagactgagagatagctgctggagttttactatttcaatgtcaaagaatgtaactagtgctcctt

SEQ ID NO: 6777942 - DNA, 88 bp, Homo sapiens
ggggatacattgacttacctagtatcaccagcatttgagagatatgaatacaagctttctgggtgatgctcggtgccctcagtgctcc

SEQ ID NO: 6777943 - DNA, 79 bp, Homo sapiens
gtttcaggctactcttttgagtcttcagatcctcttaaaattgaagagtattttaagattgcaaggtgaggtgtgtaac

SEQ ID NO: 6777944 - DNA, 95 bp, Homo sapiens
atcaggtgttgtgcttccttctttgtggtagaaagtacaagaggcaataacttatttttaactttagggaagggatgccccaacatgtccttgat

SEQ ID NO: 6777945 - DNA, 56 bp, Homo sapiens
cagccccatgaaaagggaggagggcctggtctttggtccctcaggtcattgggctg

SEQ ID NO: 6777946 - DNA, 98 bp, Homo sapiens
gcagggtaacccagccacccggtttgccctggaccatcctggttttaacactcaaagtcccatgtcctgggcagaatgggatggctggcctccctagt

SEQ ID NO: 6777947 - DNA, 83 bp, Homo sapiens
gaaaatgattgcttcactgagtagtctagactcaaagccaccgttggtctagatagtaacttcagtgacgcacttcttttttc

SEQ ID NO: 6777948 - DNA, 124 bp, Homo sapiens
tgtgtagctggaaaactaaggcagaagctgtaatattatatcatctgtgggcttttataatgcttttataaaagcagcacatggatatcagtgttttagttttttccatatgtgtaggttcaca

SEQ ID NO: 6777949 - DNA, 68 bp, Homo sapiens
tggcttagaaagcagcatttatgatctcacagtttctgtgggttagcaatccgaatgcagtttagcta

SEQ ID NO: 6777950 - DNA, 59 bp, Homo sapiens
ggatttgcagagatggcagagccacgtcagggctgggctcgagcagctgtgtaggatcc

SEQ ID NO: 6777951 - DNA, 84 bp, Homo sapiens
gagagttctttattactcccaggggaactatcaagtagaaagagtttgctctgaagcttcttgggcaaatttgaagatgctttt

SEQ ID NO: 6777952 - DNA, 108 bp, Homo sapiens
ccaaattatcttcagataaaaactagaaagaagttttttgagaaactgctttgttatgtgtacgttcatctcatagagctaaacctttcttttgattcagcagtttgg

SEQ ID NO: 6777953 - DNA, 61 bp, Homo sapiens
acgcggcctttccggacaccgactgagctgggcttgcctagctgggtgcccgaagccacgt

SEQ ID NO: 6777954 - DNA, 78 bp, Homo sapiens
ccaaaagggcttgcaaggattcataggaaactgccccaaataatttaagtttctgttcagttgatgtagttttcttgg

SEQ ID NO: 6777955 - DNA, 55 bp, Homo sapiens
ctcattgacaggtggccctgctgaccccacaggccacaggagtactgtcggtggg

SEQ ID NO: 6777956 - DNA, 64 bp, Homo sapiens
gggagctggtgtttcccgcggctccaggctgatacatctttgagttgtttgaaattttgcttcc

SEQ ID NO: 6777957 - DNA, 79 bp, Homo sapiens
gggagggcaagagaggaagagatggcagctttttaagtgaaattttaatcttatctatcttttgttcattttgagtccc

SEQ ID NO: 6777958 - DNA, 71 bp, Homo sapiens
gtgaagttgccatagagccacttccctctgcttttacaaaggctgttgagtctctatggcaattcctttac

SEQ ID NO: 6777959 - DNA, 71 bp, Homo sapiens
gtgttacgtggctcttttctgcatcaggattaagctctagttaattgcagtggtgagccactaagtaacac

SEQ ID NO: 6777960 - DNA, 62 bp, Homo sapiens
cgtccagggacagccttggggtggcgtccaaagagacgcgtcggaggttgtcccttgggacg

SEQ ID NO: 6777961 - DNA, 59 bp, Homo sapiens
tttgaattcacacttccaaagagaactttctagttctctttgccaatgaggatgacaaa

SEQ ID NO: 6777962 - DNA, 68 bp, Homo sapiens
ccagttaagcaggctcgttggaagtccccttctgacattgaaggtcttgtaaagagtctgccttctgg

SEQ ID NO: 6777963 - DNA, 86 bp, Homo sapiens
tacctatgagagcacacagaaatattttagctggtatatgcatgatttaagtaaaagaatgttaaatgtgtttgctcttctatgtg

SEQ ID NO: 6777964 - DNA, 73 bp, Homo sapiens
gagctgttcaagttaaatctcagaaggcatttccaagattcctttcctggctcttctgagttttctgcagttc

SEQ ID NO: 6777965 - DNA, 77 bp, Homo sapiens
tcctgccttggtaaaactgtcttaaatttggaatgtaagtgtctgaattgggaaggttgtaccagagagcagcagga

SEQ ID NO: 6777966 - DNA, 86 bp, Homo sapiens
cctgggatctaaaagtgtcttgattactaattaatttggcttccagttagttataaatgaggaagctgcttttgtttgatccttgg

SEQ ID NO: 6777967 - DNA, 64 bp, Homo sapiens
tgatgtctgctattcatagggaaagagaacgtagcaatccatttctcaaagagtggcagcttca

SEQ ID NO: 6777968 - DNA, 80 bp, Homo sapiens
ccatgtcttcaggaagggaaatcatccatctatccaaaaaaaagtattgataggagcccttctattccatggagatgaag

SEQ ID NO: 6777969 - DNA, 74 bp, Homo sapiens
tccatcactcatcacctagaggtttcagtgcctttagattagggttctgcacccatagctgatgatccactgga

SEQ ID NO: 6777970 - DNA, 80 bp, Homo sapiens
ggagataaaagggttggtttacaagtgatgggcagagtagccaagaacatctttaatttgtgacaactattgttatcttc

SEQ ID NO: 6777971 - DNA, 57 bp, Homo sapiens
gtatacagtcattgtgctgggaaatcttctcattatcctcacagtgacttctgatac

SEQ ID NO: 6777972 - DNA, 65 bp, Homo sapiens
tcggcggcttcagccgggcacttaatgatccctttctggggattgttaccagctggaggtggcgg

SEQ ID NO: 6777973 - DNA, 55 bp, Homo sapiens
tacagttaagctactggagaatattgccttattgtttttcgaaaagcttgctgta

SEQ ID NO: 6777974 - DNA, 84 bp, Homo sapiens
tgaggaaggggctcaaattcattcttttctatgtggatattcagttgtcctagaaccattgttgaaaagaatagtctttcctca

SEQ ID NO: 6777975 - DNA, 130 bp, Homo sapiens
acattagaatcacctggagagcttttaaaaattctaatgccctggccccagcccagaccaattatattaaaatctctggggtgggacccaggcatgagtatttttaaagctctccaggtagttccaacgt

SEQ ID NO: 6777976 - DNA, 66 bp, Homo sapiens
gcacaacaccaagggaggtatcattcacatagactacaacaggatgagtgttctctggggttgtgc

SEQ ID NO: 6777977 - DNA, 123 bp, Homo sapiens
gttaatatgtaaagggagtggcattggcaggtttagaattcttttcgtttctctttcccttgtttgagtagctacaaaattactaagtcctgtacaatctccctctctctctgtctacttaat

SEQ ID NO: 6777978 - DNA, 64 bp, Homo sapiens
gtcctgatacatgggctgtgacaagaagtgagagatagtgacagtgtgacaattgtgtcagaac

SEQ ID NO: 6777979 - DNA, 62 bp, Homo sapiens
aggagcaacccagggttcctttgaattctttgacaaaggtcttatggccttgggctgctctt

SEQ ID NO: 6777980 - DNA, 57 bp, Homo sapiens
tcttactcagggatgtaggcttgaaccgtggtaaatatcaaggactccctgggaaga

SEQ ID NO: 6777981 - DNA, 72 bp, Homo sapiens
tgctgaatccctctcttcctggagtcagagtcatcagacattctggagccttggatgggaaagaatttagca

SEQ ID NO: 6777982 - DNA, 62 bp, Homo sapiens
gagggccaggtagatatcaggagggagagtataaactcattatcctggtcaatcttgccttt

SEQ ID NO: 6777983 - DNA, 66 bp, Homo sapiens
gcccactttccttaaagttggggtgctgcaggacctccttgtcccacaacatttgaggaggggggc

SEQ ID NO: 6777984 - DNA, 71 bp, Homo sapiens
accttgttagactatggaccttatgcagctttcagtgtctgtatgcgctgtgtgtgtattctacgcaaggt

SEQ ID NO: 6777985 - DNA, 69 bp, Homo sapiens
gcagatgcgtgtgctgtcgagtatattggccggagaggtgtatctataactggaaggacacgtgtgtgt

SEQ ID NO: 6777986 - DNA, 58 bp, Homo sapiens
gttgaagatgttaagccgacccattttctcataagatgtatgtttctgcatcttcaac

SEQ ID NO: 6777987 - DNA, 60 bp, Homo sapiens
gggggttgggcggagggctggggccagagccttccccagccctgctgagacccagctccc

SEQ ID NO: 6777988 - DNA, 92 bp, Homo sapiens
gagggagatggttgattcagtgggagtggggagtggcagagggtgccttaactttttctggcttgacccctacttccttatgtgtttccttc

SEQ ID NO: 6777989 - DNA, 79 bp, Homo sapiens
gaagaccattagggtaattgaacacttatcttggtactcacattttcaaaggataggtattaaaccccaatgaatcttc

SEQ ID NO: 6777990 - DNA, 130 bp, Homo sapiens
cacccccaccccagctccctgaccacgggctgcggaagagtgggacgttatggaaccttctcagcttattcagagaggcttcttcttcctatttagtctccctctggctttccctgctgggatctgggtg

SEQ ID NO: 6777991 - DNA, 69 bp, Homo sapiens
agccataaatgaaggaaaggtatatgttgggatacccaatttaagtcaccttattttatttattacgtt

SEQ ID NO: 6777992 - DNA, 64 bp, Homo sapiens
gtacccatgctggagtgcagaggcatgatcatagctcatacagcctcgaactcctgcattttgc

SEQ ID NO: 6777993 - DNA, 82 bp, Homo sapiens
ttgctttggttttatagttaggaagacctgggttcatacagctattccgtgggcctcagtttcttcaactgtagaaaagcag

SEQ ID NO: 6777994 - DNA, 74 bp, Homo sapiens
gcaaatattgattctgtcccaagttgatgttttccccttaacattattataatgagggataaaaatcaaattgc

SEQ ID NO: 6777995 - DNA, 58 bp, Homo sapiens
taaagataaacaaaatggccctatttgagcaagaggggctcatgctgtttggtctttg

SEQ ID NO: 6777996 - DNA, 111 bp, Homo sapiens
gtacagacatcacttaggagcttgtaaggaatgcagaatctcaggctacgccctgcaccactgaaatagaatctgctttttagcaagatttttaggtgatgtatactgtat

SEQ ID NO: 6777997 - DNA, 82 bp, Homo sapiens
tgtgctttacttatcttctatttccaatcgcaactagcacctttgtagtaggtgtttgctgaagtgaaggtatgtttgcata

SEQ ID NO: 6777998 - DNA, 59 bp, Homo sapiens
accctttccaggacagcctgtgaatgtgaaattacccattcacaggctgtgggaatggt

SEQ ID NO: 6777999 - DNA, 71 bp, Homo sapiens
aaagattaggcggcaactgggcttagagaccacctgctgtcactgattgtccccactgctggctaattttt

SEQ ID NO: 6778000 - DNA, 68 bp, Homo sapiens
tctgtgggatcagcttctccaagtgacatggatgtgattcatggaacactctgaagctgaccagtaga

SEQ ID NO: 6778001 - DNA, 82 bp, Homo sapiens
tgtcttttctggccatggcaagccgagtgttgggagagaagaatgcacgcctggtattcagtgctgtggcacagacaagtca

SEQ ID NO: 6778002 - DNA, 81 bp, Homo sapiens
taagaggatccggggttcattttcactgagaggacggaagacctttaagttgattataaccactggagtaaagctctcttg

SEQ ID NO: 6778003 - DNA, 99 bp, Homo sapiens
gcgttaaaatagcctatctgcatgtgtatatatgtgtgtatgtgtatgtatatgcactcacacgcataaatacacagtctatttagttacctttaatgt

SEQ ID NO: 6778004 - DNA, 104 bp, Homo sapiens
gatacgaagagttggaaagaacttgacttgatttccagtttcattgtttattagctacagagacttaggcaagtcacttagtttctttcagactccaatttgtc

SEQ ID NO: 6778005 - DNA, 65 bp, Homo sapiens
gtgctgagagtgtgtgtatgagacaaattgtggtaccacatgtgtaaagatgatgctctagacac

SEQ ID NO: 6778006 - DNA, 58 bp, Homo sapiens
ggcacctctctgacaggctctgccagccaatgagttgtgaagccgctcataggggtcc

SEQ ID NO: 6778007 - DNA, 66 bp, Homo sapiens
gatctctaaggtcttgctgctcaaaatgttgtccatggaccagcagcagcagcagcaccagggatt

SEQ ID NO: 6778008 - DNA, 59 bp, Homo sapiens
aactcctgaattctcacacagctctgtgaggtggatgttggcagatgagaccaggggtt

SEQ ID NO: 6778009 - DNA, 71 bp, Homo sapiens
gcctatgaggattctttagagaacctatattgaattgtgtgatataacactcagaaagaatcatgatgggt

SEQ ID NO: 6778010 - DNA, 61 bp, Homo sapiens
gggcacatgcttagggaggaaagcttggaaaggcacaggcagagtgtttaaggatgtgccc

SEQ ID NO: 6778011 - DNA, 66 bp, Homo sapiens
gggctcagagcatttgggttggagtgtgctgctccagccttcatttaaggtgtagtgattatgccc

SEQ ID NO: 6778012 - DNA, 79 bp, Homo sapiens
gcctatgggggaggactgtgctatctactgaattatatgttgtgtgtgaaggtgcctagcatagtgtttggcccagtgc

SEQ ID NO: 6778013 - DNA, 99 bp, Homo sapiens
gcatcaaagttattttagtaaaatgcttttgctgtcattgctttaaaactagctcttcgaagtgggaaaaccaaaagttttattgaagcaatttgttgt

SEQ ID NO: 6778014 - DNA, 75 bp, Homo sapiens
tctgtgattttgtattcttccttagcagtacagttggaacagtgtgcatgaggataggaataactaaaacattga

SEQ ID NO: 6778015 - DNA, 71 bp, Homo sapiens
ccatctggagcccaagccagtgcttctagagcatgcttcaggtaaacaggactatggaattttccagatgg

SEQ ID NO: 6778016 - DNA, 70 bp, Homo sapiens
ggaagaacagcaggaaggccaggtaagggtgggatctgcctctgcctgactctccttgtctgaatcttcc

SEQ ID NO: 6778017 - DNA, 78 bp, Homo sapiens
tatatcccagaaacagatgacaagccctgaaccctcttgactcaagtgaaaaagatttgtctctgtttcctgaatatg

SEQ ID NO: 6778018 - DNA, 78 bp, Homo sapiens
cttttgtataacttagccttagggattgaggttgctggagtctagccttcaagtccactgagaagagttctgcagtag

SEQ ID NO: 6778019 - DNA, 60 bp, Homo sapiens
ggttgttctgcacccatgtatggggttaatgctggctccactcaccgaggcagagcatct

SEQ ID NO: 6778020 - DNA, 65 bp, Homo sapiens
ggagaggactagaaacctctgcttctcaatacatctgtgacatcagaggcttcaagtcattctcc

SEQ ID NO: 6778021 - DNA, 69 bp, Homo sapiens
gcctctcccgagtgtccgtgcagccccagacctgagcgctcgtcttccgggacggacacgcggcacggc

SEQ ID NO: 6778022 - DNA, 57 bp, Homo sapiens
gttgctgagagacagagtggaatggtatttccatttttctaactctcagaatccagc

SEQ ID NO: 6778023 - DNA, 83 bp, Homo sapiens
cagtggataagaacatttgtcagaaaaaaacagccaggctcaaaatatgtttgacaagagcaaatgttcttgaaattccattg

SEQ ID NO: 6778024 - DNA, 60 bp, Homo sapiens
ttgagacattaattacctctgcaaaatattttcacaacagcagataggttagtgtttcag

SEQ ID NO: 6778025 - DNA, 67 bp, Homo sapiens
ggcttgactctaagctgcaggttgaatccaggtgtgctccacctgtgttcatttgcggctgcaagcc

SEQ ID NO: 6778026 - DNA, 115 bp, Homo sapiens
attcttcagcaccagttcaatgtgttacctacaacatagtcttctacagataatcactgagcatatactgatgagggttttgtgtgtgttcactattgcaactacagtgagggat

SEQ ID NO: 6778027 - DNA, 58 bp, Homo sapiens
tggccttcatgtggacaatgtgtctctgttccccaaagcacaggctatatgagagcca

SEQ ID NO: 6778028 - DNA, 85 bp, Homo sapiens
tgaggaaattttactttggatacagtactttgcagtgcagataaaaacatttaagcaggtaaattatcaaaggtagagaatatca

SEQ ID NO: 6778029 - DNA, 123 bp, Homo sapiens
accttcatctagtatctgctctttataatctaaaacagtatctacgggaactatttcaaggtttgaattcatagttcatggagatgccaagcattgttaaagaaattattttattttgagagt

SEQ ID NO: 6778030 - DNA, 55 bp, Homo sapiens
gtatagaagaaaaatggaaagacagaagaagcattctctgtcatttcttctgtac

SEQ ID NO: 6778031 - DNA, 73 bp, Homo sapiens
gaaaatgttggaagctgacagctgggttcagatgtagggacgctttcagattttatcagcttccagcatgttt

SEQ ID NO: 6778032 - DNA, 62 bp, Homo sapiens
ctcttaggcttttttaaagcacagacctggcaccatgtcctgtacttgggagagctgcagag

SEQ ID NO: 6778033 - DNA, 58 bp, Homo sapiens
ccattattaactttatggggaagtgagaatataatccagaataaagtgctaataatgg

SEQ ID NO: 6778034 - DNA, 67 bp, Homo sapiens
ggccactgaggcaggaggttgagaactgtggggagtgctgggcagtggccaacttcctgcctctgcc

SEQ ID NO: 6778035 - DNA, 125 bp, Homo sapiens
agacgtgacttgaaatgatttcatttgtcagcggctgtgtagtttgcattgtaatgaagaaagcaaactttaccacttcaaatacaagtagattatgtttcgtttgaccgtttttagtactgtct

SEQ ID NO: 6778036 - DNA, 55 bp, Homo sapiens
agaaatgtaattgcaactgtctgttcaaatactgggtaacagcaattgcattttt

SEQ ID NO: 6778037 - DNA, 72 bp, Homo sapiens
tcgtgtaagattgcctgaaaatagagaatttcaagcagtagattttattctgtatttcaggtatgtatttgg

SEQ ID NO: 6778038 - DNA, 60 bp, Homo sapiens
ggtactttatacatgcatctgctatagaacctagtcatgattagcatgtgtgacagtatc

SEQ ID NO: 6778039 - DNA, 58 bp, Homo sapiens
ttatccttgagtattggggaagaggactccaaatgtctctccaaattcctgaggataa

SEQ ID NO: 6778040 - DNA, 62 bp, Homo sapiens
gacaaatgagtctcatacccggaggcattccttgtctcagagttggtctgagatcgtttttc

SEQ ID NO: 6778041 - DNA, 77 bp, Homo sapiens
gtggacaaaacaggcatcactcagcaaagctgaatcaggaaagagctttccaggctgagtttgcttgcagtgtccat

SEQ ID NO: 6778042 - DNA, 78 bp, Homo sapiens
tccagtttctctatagtggttatatcagacaaagtatttcaatggttttcaggtacatcacatactggggagtgagga

SEQ ID NO: 6778043 - DNA, 60 bp, Homo sapiens
agaggacattgctgaaaggaaggtagttaattaagctgaattctgctgtagcaagtccct

SEQ ID NO: 6778044 - DNA, 72 bp, Homo sapiens
gaagtctcttgggtttatctgtagagcttcacctacctcatccaatggtatattgatagacccagggatttt

SEQ ID NO: 6778045 - DNA, 70 bp, Homo sapiens
gaaatttaaaattttcagcttgacttgatcaaacattgatcatagggtctcttgaaaatgattaagtttt

SEQ ID NO: 6778046 - DNA, 91 bp, Homo sapiens
ttctcagagctgccagaaacatcatctgagggtttgggcatcagctctgcctggctggtgttcaggccctcagtcactttggaagtgagaa

SEQ ID NO: 6778047 - DNA, 129 bp, Homo sapiens
cagcaaaagagtttattttatcaatggctagcagatagggggcacacttttggtagatatccaaagcaggcaggctctaagtggataaaagtctgcttatttgggctatgattagaacaattagatgtg

SEQ ID NO: 6778048 - DNA, 64 bp, Homo sapiens
ctgccagttgtttgccttgaaatgacaggcttattttgttcatgttcaagaaaatgtctagcag

SEQ ID NO: 6778049 - DNA, 69 bp, Homo sapiens
ggtcacatggttgagcttgatctccagctcccctcccttcccaggagatgaggctcatcttatgtggct

SEQ ID NO: 6778050 - DNA, 74 bp, Homo sapiens
gattgtatactgcacaaggcctggacacaccattcaaggaatggtgtcccctggggttgtgtaccatttcagtc

SEQ ID NO: 6778051 - DNA, 64 bp, Homo sapiens
ctgggcctatgactgtggaggtggcatctgggctggccctgatgctataagccacagtggacag

SEQ ID NO: 6778052 - DNA, 83 bp, Homo sapiens
gggttttcctgaacctccaagctggtcctctgtgtcgttgctgtccaggaacaaaggacaggagctgagggacaggaaacccc

SEQ ID NO: 6778053 - DNA, 113 bp, Homo sapiens
atggcaatcccaggagagctcaatggttatttttggatgctagttagttacagggtggagcatataactaactagtgttcaaaatacctactgagctctcttgggactgccat

SEQ ID NO: 6778054 - DNA, 62 bp, Homo sapiens
taccagatctatctgttgatggtgctttcagaagagccaccaatatttggtagatcactgta

SEQ ID NO: 6778055 - DNA, 89 bp, Homo sapiens
ttcagtgactacaacaatggctttgtgctaagaaataaatgaatcaaaatttaaaataagacaaagttaacagttggatagttaatgaa

SEQ ID NO: 6778056 - DNA, 98 bp, Homo sapiens
tgtttatagaaacgatagcattgcagttggtgtcactgattgcccacgttgttacttcaatgaagccagctgggatgcgattgcatggtctttaaata

SEQ ID NO: 6778057 - DNA, 57 bp, Homo sapiens
gctctctgctgtatccttaggctttggaacagtccccagcccatagtagcacgaggc

SEQ ID NO: 6778058 - DNA, 73 bp, Homo sapiens
acttattccagcagtctgccccgctataactggtcaaagtaaagctgtggcagcactttggagtttatgaagt

SEQ ID NO: 6778059 - DNA, 70 bp, Homo sapiens
gtcccctccctcagcctgctgctctggagacaaccactcttcttcagacatgcaggctgaggctctggac

SEQ ID NO: 6778060 - DNA, 72 bp, Homo sapiens
tgtcccattcaagagtatagagaccaggagttcacagcaactccagtcctatctgcccttggacttaagata

SEQ ID NO: 6778061 - DNA, 84 bp, Homo sapiens
acccttgaacttagagccactaagatgtctgctgatacatttcttctatcatatgcatatgaaatttttgtggtaagtttgggt

SEQ ID NO: 6778062 - DNA, 79 bp, Homo sapiens
tggtcaggcatggtgcatgttttgctgggaatgtttatgcaaagaagccattgtttcagcatcagtactaatctggcca

SEQ ID NO: 6778063 - DNA, 65 bp, Homo sapiens
tgttacatgagcccagaaatctccctttgatggcttgcactagtgggagttgggtctctgtcaca

SEQ ID NO: 6778064 - DNA, 86 bp, Homo sapiens
gataagctggtggacactgtgctagccttttttcctttatgtagcaggctctctagaaggctggccatggtgcccttggctgaatc

SEQ ID NO: 6778065 - DNA, 58 bp, Homo sapiens
tttaggttcctgcttctccacgccaatgacatggtgagagaatagaggggaagctgaa

SEQ ID NO: 6778066 - DNA, 87 bp, Homo sapiens
tctcctgctgtgaccctcaagatggaagcagtttctgttgtctgaaaggaaagaaagtgcttcctttttgagggttactgtttgaga

SEQ ID NO: 6778067 - DNA, 61 bp, Homo sapiens
gccagagcatggggacctattttaccaattaatcatgctgtaggttcagtctccatgctgc

SEQ ID NO: 6778068 - DNA, 84 bp, Homo sapiens
tttgccaattatttgtcgagtgtctgctatgggctgagccttattctaggtcctagggattcaacactgaacaaaataggcaaa

SEQ ID NO: 6778069 - DNA, 130 bp, Homo sapiens
cagcccccggcggcccttgccgatggccaggcggggccgaccgcggttcaggccgtccaggagggagcaggcctggcagagcgcgcggctggccagcgccccacagcgggggcaggcgccggggcgcggg

SEQ ID NO: 6778070 - DNA, 69 bp, Homo sapiens
ggttctgatccagagtgtaattctccatgctgaagcttggttggacgaaatagctctggattcaggatc

SEQ ID NO: 6778071 - DNA, 55 bp, Homo sapiens
tcagtttttaagagttatgcgacttgaatagtgatttgcaaattctaaaaactga

SEQ ID NO: 6778072 - DNA, 59 bp, Homo sapiens
ttaaatgtgcctaaacctgtaacttgtcatagttcgatacataggttggctatatttaa

SEQ ID NO: 6778073 - DNA, 63 bp, Homo sapiens
cgaggaggaacgggcgacatttgcccaagtaaattgtgcacatgttgctagttacttgctttg

SEQ ID NO: 6778074 - DNA, 77 bp, Homo sapiens
tgcttgtttattgctaattgttttcccaaccagagaattagaaagggaaaacatgaatagatattaaacaaatagca

SEQ ID NO: 6778075 - DNA, 60 bp, Homo sapiens
gcaccgccttggaccgcccgctgcgccagcagaccacggggaagcggttctggcggtagc

SEQ ID NO: 6778076 - DNA, 55 bp, Homo sapiens
aaacgtggctgaaccttggcactattcttgcctcattggttttcagcccaggttt

SEQ ID NO: 6778077 - DNA, 85 bp, Homo sapiens
ccgcttggtgaggtttcggggctgggcggcatcacccaggcctacgtggtacaccctgccgtccacctcgatggccactgagcgg

SEQ ID NO: 6778078 - DNA, 64 bp, Homo sapiens
gcagagatttcaggttggggcagaaggcggtggtaagccttctcctggaacactggagaggtgc

SEQ ID NO: 6778079 - DNA, 61 bp, Homo sapiens
cagcacagagtattttattgatgccgttcaaaatcataggcatccagtgagaaatgtgttg

SEQ ID NO: 6778080 - DNA, 62 bp, Homo sapiens
gagatatgactttgggagatattacataacctcagcaggtttctttccaatattcatgtctc

SEQ ID NO: 6778081 - DNA, 57 bp, Homo sapiens
atgaagacaggtctcatcaccagtaagaaatttaaaggtgattaatcatgtctccat

SEQ ID NO: 6778082 - DNA, 80 bp, Homo sapiens
ggcggggaggcgggagcaggagcccgcggccggccagccgaagatggtggcggctactcctcctggtgagtctgcccgcc

SEQ ID NO: 6778083 - DNA, 57 bp, Homo sapiens
aggggcaggctgggagtcatcagaggccagatggggctctatccccagcttccccct

SEQ ID NO: 6778084 - DNA, 59 bp, Homo sapiens
gtgtggccgattaagcttatctacaatccctgttctaagtcatagattaatggccacac

SEQ ID NO: 6778085 - DNA, 55 bp, Homo sapiens
gcttctgaagagcagaagtggagcaagaaaactcaagctgaaggcgctcagaagc

SEQ ID NO: 6778086 - DNA, 60 bp, Homo sapiens
actgccttgattgccagtttccctttcctgaaataggggaattgcataaatatgaggagt

SEQ ID NO: 6778087 - DNA, 80 bp, Homo sapiens
caggtgatgagagggtgtggaagtcatgggctgagagagctggtcaggttccccccagcctttcacatgagcatcacttg

SEQ ID NO: 6778088 - DNA, 84 bp, Homo sapiens
gtgtgtgtgtgtgtgtgtgtgtccctacaacagcttcacttacaaagtagttgaaaaagaggggctgcttcatcacaagcagac

SEQ ID NO: 6778089 - DNA, 72 bp, Homo sapiens
ggcctgcctacctgggcccaccagtgcctggcccagaggagaggaacagagctgggcttcaggcctgcagcc

SEQ ID NO: 6778090 - DNA, 101 bp, Homo sapiens
cgaaattctattaggctggtgcaaaagtaattgcagtttctgccactgaaagtaatggcaagaaccgcaattacttttgcacctgcctaagtagctcctcg

SEQ ID NO: 6778091 - DNA, 130 bp, Homo sapiens
ttccaaaatttctcacagtaaaagagaagcgtatgtgggttcagttgaaacagacaaatgaaattctcatccgagaacttggtattccttttaacaagccaccacccatcttgtcactgatgaagttgaa

SEQ ID NO: 6778092 - DNA, 79 bp, Homo sapiens
aggtaaatcaatttggaggatgtcggcatatttaatccttcccaagggtgaattgtggctttttccaatttgttgacct

SEQ ID NO: 6778093 - DNA, 74 bp, Homo sapiens
aaactctcttacaaaagcaaggaatctagaaataccaggccaggcttggctttctgacccttgtcagacagttt

SEQ ID NO: 6778094 - DNA, 65 bp, Homo sapiens
ggcatggctgggttctggtgagggccctcttcttggtttgcagacagccagcacccagctgtgtc

SEQ ID NO: 6778095 - DNA, 85 bp, Homo sapiens
aaagggtcatcatatatcgaatgggcatcattacaccttccctacctaacttgtgatgatcaggtgagatacatgaaggctcttt

SEQ ID NO: 6778096 - DNA, 58 bp, Homo sapiens
tccctaggaggcggcatcgtccctgcttttctagtctcggccaaattcctcctaggga

SEQ ID NO: 6778097 - DNA, 80 bp, Homo sapiens
tggctttcagggaagcgcttggctgtgtctagcggctccgacaactatctgggcccgcagctgctgctctgaaacagtta

SEQ ID NO: 6778098 - DNA, 64 bp, Homo sapiens
taaagggaagctgcaaggaagtgtgccagcctagttatgggttcattaatgcaggttccagtta

SEQ ID NO: 6778099 - DNA, 57 bp, Homo sapiens
tcatttcctcaaattcaaggttttagatagtttctctccatggctatgaggaaatga

SEQ ID NO: 6778100 - DNA, 58 bp, Homo sapiens
ggcatccaaataccaagatgtaggtcaacaggacctttgtatgtggatttttggtgcc

SEQ ID NO: 6778101 - DNA, 65 bp, Homo sapiens
tatttgcaagagacagacatgactcagttggtctaaatgactctagaggaactgctcttgagata

SEQ ID NO: 6778102 - DNA, 83 bp, Homo sapiens
ggagattgaaatgatggttaaacactggaggagtctctttaaaattttcctgatgctggttgtttaatctcagaatagttccc

SEQ ID NO: 6778103 - DNA, 69 bp, Homo sapiens
ctctctttttcgtgtgccgaagccatgatttctcaaattcattcagttgtgtcatacaggaaaaggaag

SEQ ID NO: 6778104 - DNA, 93 bp, Homo sapiens
acaaggtcattttaattcatagtttccttaaaagaactatctcttctgagctttcatattttgttcagaaaggtcgtctcttttaagccttgt

SEQ ID NO: 6778105 - DNA, 74 bp, Homo sapiens
gcctacacatgctatatttaggatcccagatggtgagaattaatgctcagactggtgaccctgaatctgtaggt

SEQ ID NO: 6778106 - DNA, 57 bp, Homo sapiens
tgggggctccaggctccagggaactttcctacattaggagctggggagctggcccca

SEQ ID NO: 6778107 - DNA, 62 bp, Homo sapiens
tctgggacgcctggggacatttccactttgctgggaggggagtgtcctccgggcccctcgga

SEQ ID NO: 6778108 - DNA, 58 bp, Homo sapiens
attgtcgcttatttaggtgcttcaaattttttgctgttattagcactgaagtgataat

SEQ ID NO: 6778109 - DNA, 75 bp, Homo sapiens
ccaaggacaccaggcacagctctcctgctactcagaatgagaggtcagagagggctgggcttggccccatcttgg

SEQ ID NO: 6778110 - DNA, 63 bp, Homo sapiens
agggccagatgaagccacaagcctcctccaccttgagcactgatggcagatcagctgggccct

SEQ ID NO: 6778111 - DNA, 55 bp, Homo sapiens
gaggcccagtgtggcttcctggagttgtgaacagctcctggcctccctggggctc

SEQ ID NO: 6778112 - DNA, 79 bp, Homo sapiens
agcaattactggtccacagaaattctaaaacctagctgggtacatagcgttagtttctggattagggctcaggattgct

SEQ ID NO: 6778113 - DNA, 66 bp, Homo sapiens
gtgttggatatgcatctttgaatagttgtacggatacacacaaattttaatttgcatgtatgacgc

SEQ ID NO: 6778114 - DNA, 58 bp, Homo sapiens
gctaggtgagttagtgtccaggcgtgcaaggcgatgggctgcttcctcagctgagagc

SEQ ID NO: 6778115 - DNA, 112 bp, Homo sapiens
tgtgttcctgccgtcttaattttgttgtctagcatgaggtgcaagcttggttctcatagttgcctacttgcactatggtagaatcaaaatgatcagataacacaggtgaaca

SEQ ID NO: 6778116 - DNA, 67 bp, Homo sapiens
ttgtgattgctgtttagtagttgagccaacataaaattgatgttgagctttacaacagctgttatag

SEQ ID NO: 6778117 - DNA, 79 bp, Homo sapiens
gcacttctgaacacacagatgggaaagttcaacctgtgctgtaaaccagtcagctgccccatgtgttcactgacggtgc

SEQ ID NO: 6778118 - DNA, 65 bp, Homo sapiens
ctaaagatctacagaggcttttgacatataacattacttctcagaagcctttcatggattattag

SEQ ID NO: 6778119 - DNA, 126 bp, Homo sapiens
gtgtgtgtctaattaatgagggtagaggttaaaaaatatttgttgaataaattagtattaacatttttattgctaatatgcttcaggcaaaactataggccctgatgatacaataacaaaatacac

SEQ ID NO: 6778120 - DNA, 76 bp, Homo sapiens
gcattttgagcatcttttcatagtatctattggtttcagtatctgtgagaccctggagaatgaaagtgctcaaggc

SEQ ID NO: 6778121 - DNA, 77 bp, Homo sapiens
tttcatctactggaatatttactttggataaaatgcaagttctttgtagcagtctgggggaattacaatagatgaaa

SEQ ID NO: 6778122 - DNA, 84 bp, Homo sapiens
gaagaactgggtccttgagtctagagtaagagtaattatgaaaaaagaatctgttctgatttacagagggcccagtcacacagc

SEQ ID NO: 6778123 - DNA, 113 bp, Homo sapiens
acaaagtgtgccctgtgtattaatatcagccaacagtgcttcattcacacattgcatgactattgatgtcttaatctgtggaggtactgagccagtgtggggcatatgattgt

SEQ ID NO: 6778124 - DNA, 61 bp, Homo sapiens
cttagctttaaaagtgagatctctgctttgcagataaaacaattctcacttgtgaagaaag

SEQ ID NO: 6778125 - DNA, 55 bp, Homo sapiens
cctcctttttctctcttactaaggttgactgagctttaaagaataggaagggagg

SEQ ID NO: 6778126 - DNA, 56 bp, Homo sapiens
gcagatgagtgagatagacttccttgctgacttggaagttttatgttgccatttgt

SEQ ID NO: 6778127 - DNA, 76 bp, Homo sapiens
cagtttggactttatagtaatctgtacaatttcagacttttgaaatgtactgatacttattttatggttccaattg

SEQ ID NO: 6778128 - DNA, 77 bp, Homo sapiens
gatgcagcacaaatatcaacagtgtccttctaagtcaatatttgctaggaaaagcacaggatgttcttgttgtcatc

SEQ ID NO: 6778129 - DNA, 98 bp, Homo sapiens
gccctgctctgaggaaggaggccatgccctggtctgagggaggaggcataaccctggtctgggggaggaggcatggcccctggtctgagggaagaggc

SEQ ID NO: 6778130 - DNA, 90 bp, Homo sapiens
gcatgtgtctccagatcagtgagcactctggagttgcagagggtctgcaaatattccatgctgttcatcatataaacctggggacaatgc

SEQ ID NO: 6778131 - DNA, 111 bp, Homo sapiens
aaggggctgaattaatggattggcatgaccaaagcagggaaatctatttgcatgcaatattaactgtgctaataaactccaggctgagctcagcaggccaggcagcctctt

SEQ ID NO: 6778132 - DNA, 83 bp, Homo sapiens
tggattaacttagtgaggaatctgcatagttgtactcagtggtggccctggtacaaaatgctgatatcaacataagttatcca

SEQ ID NO: 6778133 - DNA, 59 bp, Homo sapiens
gccttggtcagtcagagaatggagtcatctgatttaccatcctgtgaatggccctaggc

SEQ ID NO: 6778134 - DNA, 86 bp, Homo sapiens
ggagctgggcataggtctcgaggccccagttcctctggggtcagaacatgggagctggtcagccttgagcatttcatcccctctcc

SEQ ID NO: 6778135 - DNA, 55 bp, Homo sapiens
tatcatctgtcccaaataagagacatccctcgaagtttctgtgaggcagatggta

SEQ ID NO: 6778136 - DNA, 80 bp, Homo sapiens
atggtgtatatcaagtgactatcacagaactaggaatatatcagctgttttgctcaatggtggtcattattattaaccat

SEQ ID NO: 6778137 - DNA, 72 bp, Homo sapiens
cattagtcctgaatgcctttaggcagaaagtggtgagaattctttgaataatattaggcagatcaggtggtg

SEQ ID NO: 6778138 - DNA, 78 bp, Homo sapiens
aaggatattgattattagttcacaatagcaccaggtagacagggcttatgtgcaataaggagtaatagtaaaatcttt

SEQ ID NO: 6778139 - DNA, 71 bp, Homo sapiens
ataaagtaatgcatataatgtgcttagaacaggatggtatgtaggttacagtgcattgtacaatgctttat

SEQ ID NO: 6778140 - DNA, 91 bp, Homo sapiens
ctaggaataaacttagatgtgcaggacttttatcaaggacaggacaaaattttgctgagtggaatgaaagatttgcattctatgttcctgg

SEQ ID NO: 6778141 - DNA, 130 bp, Homo sapiens
agtgaaaagtgtgctaagcacagggtttcagcagataatcatgatgcaatgtgcacaagggacagcctctttgctgccttgtctcagggtctttgtaatgcaaaccctccattgagcccacattttgact

SEQ ID NO: 6778142 - DNA, 88 bp, Homo sapiens
gatgagtttattttccactgtcaggaattcagagtttgaatgattttaccactgctctgttcttggtgcagctgggattctatttatc

SEQ ID NO: 6778143 - DNA, 58 bp, Homo sapiens
ggttgctgggattcactgatttagggacacagtggtttcctaagtcctgccagcagtc

SEQ ID NO: 6778144 - DNA, 55 bp, Homo sapiens
gtccagcctgagtcagtcagtggctgcctgagccctgagctggtccaggctcaac

SEQ ID NO: 6778145 - DNA, 65 bp, Homo sapiens
atgtgttaacatttgtaagataagcatagctcagtgagccaatattttccaaatgatgactacat

SEQ ID NO: 6778146 - DNA, 77 bp, Homo sapiens
gcctgcagtgctgaactataaaaagctttcgttgtcaggggacccagaaactattttagtagttgggccaagcaggt

SEQ ID NO: 6778147 - DNA, 71 bp, Homo sapiens
agcgggagcctgaacagctcattcagcactaagaaaactgcatttgcagaatggcttttatggctcaggct

SEQ ID NO: 6778148 - DNA, 64 bp, Homo sapiens
gacaaaacaagtctgacagcccgaagatcttcgtcatgattagaacgctcagagttgctttgtc

SEQ ID NO: 6778149 - DNA, 84 bp, Homo sapiens
gagtctttgattcctaagtctttctctacctcttttgtccaacttggaagtcttggtagagaaggacttaggaatcagagactc

SEQ ID NO: 6778150 - DNA, 70 bp, Homo sapiens
atgtcttctgggatgactttttgaaatggatttgtgagaccacctctggaagtgacatcagggatgacat

SEQ ID NO: 6778151 - DNA, 56 bp, Homo sapiens
tcagcacactaagatgtatgcccagaacttccttgggcttctctttagtgagctga

SEQ ID NO: 6778152 - DNA, 60 bp, Homo sapiens
gcctgcagttctgtgctaggcagcaagaaagctccacagctggtggccagtgctgcaggc

SEQ ID NO: 6778153 - DNA, 75 bp, Homo sapiens
gcagggcttttctcttcaaaagtctaatccttataacaagtagtggagaggatgtggagaaattggaaaccctgc

SEQ ID NO: 6778154 - DNA, 126 bp, Homo sapiens
aggtcttcaagtatcaggctaagaaatgtggacttcatccagtaggtaatgtgatgtcactggatatctgtgcagtatctatgtgatgggttgggagtggagaagcctggggatacttaagggtct

SEQ ID NO: 6778155 - DNA, 92 bp, Homo sapiens
gccacatatcagattacctcagaacatcctggtttaaaatgacaaatatttattacctcggagtttctgtgagtcaggaatctgggtgtggc

SEQ ID NO: 6778156 - DNA, 79 bp, Homo sapiens
gcattgttaaataatctcagcattttttgggtgtaactgttttaacaagttaacacttgatgctgtttatacaacgtgt

SEQ ID NO: 6778157 - DNA, 79 bp, Homo sapiens
aaggtctggaggcttcatcctacccagagtgcatggggagctgaccagagtttggagagggtgaggcaatggagacttt

SEQ ID NO: 6778158 - DNA, 58 bp, Homo sapiens
gaggtgtggtcctcagcccccagcggatgcttatgtgggggtgcacgggccacatctt

SEQ ID NO: 6778159 - DNA, 88 bp, Homo sapiens
ggagtctcactctgttgcccagggtggagtgcagtggtacaatcttggctcactgcaacctccgccttccgggttcaagcgattctct

SEQ ID NO: 6778160 - DNA, 97 bp, Homo sapiens
gacaaacctgaagtcaattatgacaagatgacatcatggcttctgtctcaggtaacagcagccatgcacgtcattatgatgatctgacttggttttc

SEQ ID NO: 6778161 - DNA, 70 bp, Homo sapiens
gggggaaatttattatctacatcattaaacattaagattgtaaagtgccaagtagaaatgaatttacctc

SEQ ID NO: 6778162 - DNA, 82 bp, Homo sapiens
ggggagagagagtgtgtgcagcggcaggtgaagttttgatgtctgagtactctgcttattgctgcaggcagtcaatcttctc

SEQ ID NO: 6778163 - DNA, 78 bp, Homo sapiens
tcgcgaattggttttgctgctggttttgctgtgtgtggcttgctggaccagctgttatctgtagtatctaaagcgtgg

SEQ ID NO: 6778164 - DNA, 56 bp, Homo sapiens
tgccctgtgagcctgggacagttgtttgtccacttgctcaggctcttgacagagca

SEQ ID NO: 6778165 - DNA, 76 bp, Homo sapiens
gtagggtaaaagcttttgttttcgtaactgtttctgtgccacacactccaccagatagaatgcaagacctctctac

SEQ ID NO: 6778166 - DNA, 118 bp, Homo sapiens
tgtgttgttttcgtcttgctttacacatgtaagcctttctgttcacctgctcaaaaacttatttggctctgtgagaacaaaggctatacctgtcaagtattctccacagcccagcaca

SEQ ID NO: 6778167 - DNA, 65 bp, Homo sapiens
tgctctatcctgctgagtgatttatcctcaagtgagtatgagagagtgacccatagggtagagta

SEQ ID NO: 6778168 - DNA, 72 bp, Homo sapiens
tttcaagcatgtcaagttagtcctccaaagagacatttcctttgtcttgtaatttacttgttgtgttaggaa

SEQ ID NO: 6778169 - DNA, 82 bp, Homo sapiens
ggttccaagtctttgctattgtgaatagtgccgcaataaacatttgtgtgcatgtgtctttatagcagcatgatttagaatc

SEQ ID NO: 6778170 - DNA, 130 bp, Homo sapiens
ttgctacttctgtttttttaaaaaagcaagatccccaacagaaaaggatgtgtagaactgtaatgcccacataatgttgcgatgggactactgttggcacatttggggtttggaggcccaggagagtgaa

SEQ ID NO: 6778171 - DNA, 69 bp, Homo sapiens
tattttttcactgttaggagtatgctacattctcattagaagtagcagctcctaaacagtggtgtagtg

SEQ ID NO: 6778172 - DNA, 86 bp, Homo sapiens
agggactggggacagtgaatagtcgtgttgtgttagggctcagaccgagacacttcatgcattcttcactctcacctcgtgttcct

SEQ ID NO: 6778173 - DNA, 94 bp, Homo sapiens
gcaagttttcctgtgagcatatgttttcagctctcttaagtatatgcctaggaatggaattgctgaatcatatgtttaacctttcgagaactgc

SEQ ID NO: 6778174 - DNA, 86 bp, Homo sapiens
ggccagtgcagcaaagcggttgaaagtgtgcacttgaggaggcagcagagcctgagttcaatttccagctgttctgtttactggcc

SEQ ID NO: 6778175 - DNA, 63 bp, Homo sapiens
tctctcagatggagtgtgaatggtaaccagtatagtttgctagtccataaatatctgggatga

SEQ ID NO: 6778176 - DNA, 56 bp, Homo sapiens
catacacatacaccaatgtggtcatatatctgtatgaatatatgtgtgtgtgtatg

SEQ ID NO: 6778177 - DNA, 76 bp, Homo sapiens
cgtaggcagttagcactcagtttccagatgaaaaggtgaagatccttctgggaagtgagatgctgtgtgcattatg

SEQ ID NO: 6778178 - DNA, 94 bp, Homo sapiens
gttgaagtcctaaaccccagtaccccaggatatgattgtatttgaaagtaaggcctttatattggtaattgaggttacatgaggtcacttcaac

SEQ ID NO: 6778179 - DNA, 71 bp, Homo sapiens
agaagacctggagaatggaaagtaaaggtaatctcatccaaaacaaatacaccattcccaggtggatttct

SEQ ID NO: 6778180 - DNA, 60 bp, Homo sapiens
ctctgtgtggtagattccattatttccctcatttgtaaataaggaaactgaggcacagag

SEQ ID NO: 6778181 - DNA, 130 bp, Homo sapiens
tggggtcctcagctactgcagattctccctcgtcccgggccaggaagcgccactcggtgatctgcagcatggcctcccgggcctggctgatggtgaatggaatgcactgcggaggcgagagaggatctca

SEQ ID NO: 6778182 - DNA, 119 bp, Homo sapiens
tgggagaggagagtaggcgggagcccctgggcggttttcgcctacagacgctaccactgtgggagtgtgtgtgggcggaacggccccggagcagaacaattgcgcccctccccctgcca

SEQ ID NO: 6778183 - DNA, 68 bp, Homo sapiens
ctggcttccctctctccagggctgccttacaagtaatgagggagggagtaaatgagagagggaaacag

SEQ ID NO: 6778184 - DNA, 79 bp, Homo sapiens
gaagacttctgaatattgagataagaactgacatgggtcactcaaggaaatggcagtgtttcagtttttggagaacttt

SEQ ID NO: 6778185 - DNA, 55 bp, Homo sapiens
ggaacagagggagaatgagaatcagtgggcagaattatggttctctcactgtacc

SEQ ID NO: 6778186 - DNA, 75 bp, Homo sapiens
cggtgacgactgccaaagattgccttcccatgccatacaaaacaggtaaaggtctttattggtcagccactactg

SEQ ID NO: 6778187 - DNA, 75 bp, Homo sapiens
aaatgtgtatttgtatcaatctcaatatattgctttggaaacattatgtggttggttgcatatgtgtgtgcattt

SEQ ID NO: 6778188 - DNA, 129 bp, Homo sapiens
caaagcagttgttgattagcagtgtttagaattcagattgtagaagcagagacctacattacagtcctggcttcacaacttcttaattcttagaccttgggcaagttacttaacatacttcagcctttg

SEQ ID NO: 6778189 - DNA, 122 bp, Homo sapiens
aagggcaaagaggaggggtggagagaggggtgggagcaggatgggagctggggccagggatctggcctgaggcgtcccagctgtggctgactcctggtccccacttgctcctccctgccttt

SEQ ID NO: 6778190 - DNA, 80 bp, Homo sapiens
acaatgtacctggtatgtaataagtgttctaaaatcactgacaggattattagacaatatgtattttatatgtgtgttgt

SEQ ID NO: 6778191 - DNA, 57 bp, Homo sapiens
taaagcaaggcaaattgttggtgtcttgacaccaaatatatcttttgacctgtttta

SEQ ID NO: 6778192 - DNA, 73 bp, Homo sapiens
aggaagctttaaagtatagaggacaaaaacaaggcttactgtttttccctactctgactttacctggcttctt

SEQ ID NO: 6778193 - DNA, 60 bp, Homo sapiens
aagtgtcagcagcttgatttataatatctttatagtggtgatatacaagctctgttactt

SEQ ID NO: 6778194 - DNA, 66 bp, Homo sapiens
cattcctagttttggacattcctgcagcctctgggaaattgccaaaatggccaaaagctagagatg

SEQ ID NO: 6778195 - DNA, 82 bp, Homo sapiens
gttgctgctctactctctagttgttgatgaatgactgaacctcggtcgtcagttttctcatttatgagatgtggataataac

SEQ ID NO: 6778196 - DNA, 56 bp, Homo sapiens
ggtgggcacccgagactggatcgagggggagacctaccagtgcagggtgacccacc

SEQ ID NO: 6778197 - DNA, 100 bp, Homo sapiens
gctgctcatcaattaatgcagaccatggcattgagcataatagtatttaacaaactgtatgctttccaaaaatgctgtgtggtttttcagttggagcagc

SEQ ID NO: 6778198 - DNA, 60 bp, Homo sapiens
gctgctgtccttagggagttctctgtctagtgggagaacatagatacctaagacagaagc

SEQ ID NO: 6778199 - DNA, 77 bp, Homo sapiens
gaggttgtctcccaacagtgctgtccctcaaagaaaagactggttatgtggaaacagcacgtttggagagattattc

SEQ ID NO: 6778200 - DNA, 65 bp, Homo sapiens
ctcaccatggcccctggcacacggaggatgaaggcagccacgtccctgtcagggtcatctgtgag

SEQ ID NO: 6778201 - DNA, 69 bp, Homo sapiens
ctcagtgattcctcaagaattctccatttaataaggattaaatgagaaaacacagaggaggtacctgag

SEQ ID NO: 6778202 - DNA, 64 bp, Homo sapiens
ctggatctgtcttttggatcccatatccaagactctacctactgggatccttgagatgtcctag

SEQ ID NO: 6778203 - DNA, 115 bp, Homo sapiens
gggtggagccgcgtagcccacttgaggagtttggatctcatctaagtgcgtgactgacagcgtcagatacacattttaaaagatcactcctggccaggcacggtggctcacaccc

SEQ ID NO: 6778204 - DNA, 77 bp, Homo sapiens
ctcacctgggactccaggcatctgcttctgcttcatcccagtaggaggctctagtttggagtttctccacaggtggg

SEQ ID NO: 6778205 - DNA, 79 bp, Homo sapiens
tagactgagttccttcacagcagttattttactcatctttgtctctccagtacctaaaactttgaaggtgctcagtgta

SEQ ID NO: 6778206 - DNA, 75 bp, Homo sapiens
attttcctttcatgttctcccttcactttattgtgagcaacatagtgatttggcggcagagttagaaataagaat

SEQ ID NO: 6778207 - DNA, 73 bp, Homo sapiens
catgtgctcaggtcattcagaacttggccccagagcgtgcctgggcctctggttcgtggtgacctacgctatg

SEQ ID NO: 6778208 - DNA, 61 bp, Homo sapiens
tgtttatctgtgcttatgtttaaataatagttttgttagatatggtttgcataaataagca

SEQ ID NO: 6778209 - DNA, 69 bp, Homo sapiens
tgtcccccaggctggagtgcagtggcgcgatctcggctcactgcaagcaagctccgcctcctgggttca

SEQ ID NO: 6778210 - DNA, 56 bp, Homo sapiens
agtcacaaatattctcctctagcaccgataagtgctctggagaactccttgtgtct

SEQ ID NO: 6778211 - DNA, 63 bp, Homo sapiens
ccaaactttcaagataataggaatgaaaaatgtagcatttagattcctgtgtcttgaccttgg

SEQ ID NO: 6778212 - DNA, 76 bp, Homo sapiens
tttatgtaattttggagtttctgctgaggaaacctgagtgaactcatttcagatgcatttagaatatttgcataaa

SEQ ID NO: 6778213 - DNA, 104 bp, Homo sapiens
tcattagtttaagaagcttggatgggcacccaggaaagccgtgaggaggatgcacttacacactggcttgatgggtaatgcctccaagacattgaacgtgctga

SEQ ID NO: 6778214 - DNA, 75 bp, Homo sapiens
tcagagttgtattggaatagctatgaaaaatgggagtgtttgtgataaaaatagtctataccaatttgattttga

SEQ ID NO: 6778215 - DNA, 60 bp, Homo sapiens
gggaaacagagtgaagctgtgaggtcatcttggaggagctcacatctttatttctttctc

SEQ ID NO: 6778216 - DNA, 92 bp, Homo sapiens
aattattatcattgtgtgttatttatagtcacctttttgtagcagatggctctctcccatttccacaaggctggctcacaataatgatggtt

SEQ ID NO: 6778217 - DNA, 69 bp, Homo sapiens
atgtcactccagggacacaggtgcagcaaatttatggaggaagcaccttgtgtttctcctgagtcacat

SEQ ID NO: 6778218 - DNA, 104 bp, Homo sapiens
agtggggatcatgtctcctcctttctattattgtgagggcaaagtttctatcatcagatggtggagtttctctttcaaactgaaataaggatgattgctccatt

SEQ ID NO: 6778219 - DNA, 55 bp, Homo sapiens
tgttccttttaaatgagtcagtccagaaggaagggctgattgacttgagaggaca

SEQ ID NO: 6778220 - DNA, 64 bp, Homo sapiens
gcaaccctgggtcatggttgacattgttcctagtttatgtatgaggactgtggctcagagttgc

SEQ ID NO: 6778221 - DNA, 72 bp, Homo sapiens
aggaattactttgggatattattttagattcttttaaaagttttcagaatattattttaaaggcttgttcct

SEQ ID NO: 6778222 - DNA, 57 bp, Homo sapiens
gtctgagggagaaggatctgggctgggactcccaggtcctttctgtaccctccggac

SEQ ID NO: 6778223 - DNA, 65 bp, Homo sapiens
tgctgcttgggctcacgtaccttggggccttctgtctgttatggcccctgggagccctgtcagta

SEQ ID NO: 6778224 - DNA, 84 bp, Homo sapiens
gcaattgctctacttctctctccaacaattcactttagtaggaacaaagctggacattgtaggggggaaaggaaggggctatgc

SEQ ID NO: 6778225 - DNA, 80 bp, Homo sapiens
cagaggaaacactaggcgggtaccctggctcgaaaccttctggtttcccattcccacgtcctgctccagcacttcctctg

SEQ ID NO: 6778226 - DNA, 117 bp, Homo sapiens
gtatatttaaaaattgctaagggattagattgtaaatgttttcaccataaaaaattgataagtattcgaggtgatggatatgttactagtttgatttatttatttcacaatgtatac

SEQ ID NO: 6778227 - DNA, 78 bp, Homo sapiens
attatttatccatactgtaatacctaaatgaacgctatgacagagttcagtaagtgattacagtgtcaggattatagt

SEQ ID NO: 6778228 - DNA, 79 bp, Homo sapiens
tttgggaagtctgcagatactgatgataagcactctttaaagaagaatgtagtttagaagtaaggtcagatttctggag

SEQ ID NO: 6778229 - DNA, 89 bp, Homo sapiens
ggggtgaaaagaaatgttgcctaactggcctttactcacggagtgaccatcatctcagctagttagtgtatgagcggcaccagcacccc

SEQ ID NO: 6778230 - DNA, 86 bp, Homo sapiens
ctagccaggagacatgttagttagtaggagatagagggaacttcctgctcctgaattacactactacatgtctactgataagcgag

SEQ ID NO: 6778231 - DNA, 74 bp, Homo sapiens
ggttggtgcaaaagtaaccatggtttttgcaattaaaattaatggcaaaaactgcaattacttttacaccaacc

SEQ ID NO: 6778232 - DNA, 76 bp, Homo sapiens
ggcgcttcaagtacattgtgttttcctgaaagcctgggctgaggcattgagaaggaaggtaatgaactgaggagct

SEQ ID NO: 6778233 - DNA, 81 bp, Homo sapiens
ggccatgtgggaaagttaagttggtttaaaaaatggagagaaacattgccttgtctgtccatttataagcccccaaaggtc

SEQ ID NO: 6778234 - DNA, 121 bp, Homo sapiens
ggaatcatcaggagagtcttgaaaatactggtgcctgagtttaaccctcagagactctgatttaattggtttttggtatggcttatgcatcagaatttttaaaagttccccaaattattct

SEQ ID NO: 6778235 - DNA, 85 bp, Homo sapiens
ccttctgttcattcatgtagcggtctagggcttgcacctcaaagatgtggctgcagtcttccagctgcacaaagcgggcatcagg

SEQ ID NO: 6778236 - DNA, 95 bp, Homo sapiens
gaaggaatactcacggcagtggtgataaccactatcatagctaccattaaattactcgttgtgactggttgtcccactttcctcaggttttcttc

SEQ ID NO: 6778237 - DNA, 113 bp, Homo sapiens
gggggtaagttatcatcagtaattgtaaagtagtagtacaggtactctgttactaactcaaaatatgtaaactaccactgatattctattttgcttgctgtcctctgtcttcc

SEQ ID NO: 6778238 - DNA, 71 bp, Homo sapiens
ggcaagtatggaaagggagtttaatttggggccctagtaatggtgctatctgaataaatcttttcagtgcc

SEQ ID NO: 6778239 - DNA, 73 bp, Homo sapiens
ccagctctctcttctcatagctagttcttcctttgcccctatattggaggaggctctgcttatgaaaggctgg

SEQ ID NO: 6778240 - DNA, 101 bp, Homo sapiens
cttgggtttttatttagctctacatatgcgatcataggatgcagaagatatatcttctactggacacgtatatatagatgcttaaatgtggctatcccaag

SEQ ID NO: 6778241 - DNA, 98 bp, Homo sapiens
ggcgtaacgtgggagaggaaagaagtgtctcatcaggcaatatctgataacagactgataatttgcctcagcatttcagcctctactcaccacaagcc

SEQ ID NO: 6778242 - DNA, 94 bp, Homo sapiens
ctcagaatttaagagtgtgagcttcaagctgttcagaactattagatacagacatcatacttactgagcttgaattctttattctctttatgag

SEQ ID NO: 6778243 - DNA, 87 bp, Homo sapiens
tcgcggtggcccctgggggttgtagtttctgtcgcaaacaaaacgcgccggcagcatcgaaactacattccccacaagtcaacgcga

SEQ ID NO: 6778244 - DNA, 66 bp, Homo sapiens
attgacagcaggggctgtcactgctggggtctcagtgccaggggtgtcagtgctgcggacgtcaat

SEQ ID NO: 6778245 - DNA, 68 bp, Homo sapiens
ggctgctggtttcttgttttagaagattgggtttagacttgcccttaaaacctagagatcagacagtc

SEQ ID NO: 6778246 - DNA, 60 bp, Homo sapiens
ggttaatctattatgctgagaaactgtctctggggtcacagcttcctggcatggagaacc

SEQ ID NO: 6778247 - DNA, 104 bp, Homo sapiens
gcctcctcgaatgttgatgatcagactcccgttgatgacggtgcatcctcggagctcctgggcagacgtcaccgagtcgatggtcttctcgccttctaggaggt

SEQ ID NO: 6778248 - DNA, 73 bp, Homo sapiens
aggataaaggtcaagctggactcaggtgtattttccttatgttatagctgtctatgaattggcttcaaatcct

SEQ ID NO: 6778249 - DNA, 63 bp, Homo sapiens
tctaaggggccaggactaagttaactgccttgaactacatggaagtatcctggcccctatgga

SEQ ID NO: 6778250 - DNA, 69 bp, Homo sapiens
tactgcagtgattctttttatgccttgatagaccttgttttatagggaggaactgagtcaggagcagtg

SEQ ID NO: 6778251 - DNA, 64 bp, Homo sapiens
ctctgactttaaatacaggatgaaatgactcttagttttggcgtaatgcctttaaggtttagag

SEQ ID NO: 6778252 - DNA, 80 bp, Homo sapiens
tgcatgcacagcccatggccccgccgacacaggatagacgctccatgaaaggccaccatgccagggactagtgcggtgca

SEQ ID NO: 6778253 - DNA, 55 bp, Homo sapiens
gctgtcgtcacagaggggctgcgctgcgtcactgcattcctcccctgacgtcagc

SEQ ID NO: 6778254 - DNA, 58 bp, Homo sapiens
gctgaagctctaaggttccgcctgcgggcaggaagcggaggaaccttggagcttcggc

SEQ ID NO: 6778255 - DNA, 73 bp, Homo sapiens
gtttgtattcccaggctccacccaaatctcccaaggctgtgagagtgagatttgttgtgagcaggaatagaac

SEQ ID NO: 6778256 - DNA, 120 bp, Homo sapiens
actaccaggagagattggggtagggcaggctgagaaatatactactcctgtgtgctcgggaagaaaatatattgtctctgccttgtctggactctcagtttaccttctctcctctgtggt

SEQ ID NO: 6778257 - DNA, 81 bp, Homo sapiens
agagcaacattttgctattagggtcctgtcatctcattactgcttgatgtgattgacaaccctggtatgagcagtctgcct

SEQ ID NO: 6778258 - DNA, 55 bp, Homo sapiens
ctctttgcctgctacttccgaagaaatcatatccaagaagaagttggccaaagag

SEQ ID NO: 6778259 - DNA, 68 bp, Homo sapiens
cccactttagtggcaagttctttagtctttgcctttttgagcttgagaatgtgagccacagatctggg

SEQ ID NO: 6778260 - DNA, 76 bp, Homo sapiens
aaatagggggcattatttcccatggtactcaaaacttcctagagtgtcatgccaggaaatagtccctgatctgttt

SEQ ID NO: 6778261 - DNA, 79 bp, Homo sapiens
aagactgtgtctatggctactcacttaaacaagaaaattttatggtcagttctgcctatatagaaactcacacagtttt

SEQ ID NO: 6778262 - DNA, 83 bp, Homo sapiens
ctgctcataaactttctgttccttcatcccctgatctgttgattctgtaacattatagagggaaggaagaatggattaagcag

SEQ ID NO: 6778263 - DNA, 57 bp, Homo sapiens
tgtccctgcagcccctgagccttcatagggaatggagaggcaggagctacaggtaca

SEQ ID NO: 6778264 - DNA, 78 bp, Homo sapiens
ggctggcacctttgcccagagcaggcaccaagacttctggctctgggtgtgacctcagtctgggtaaaagccccagcc

SEQ ID NO: 6778265 - DNA, 75 bp, Homo sapiens
agaggaccagcaagaaatcattgaattatttgctaattgtgagcaaaatttgtattgatttttctctgtctctct

SEQ ID NO: 6778266 - DNA, 63 bp, Homo sapiens
tgaaattccacagctagttgaatatgaatgtcattaattcaagagctggctttgaaatgctca

SEQ ID NO: 6778267 - DNA, 96 bp, Homo sapiens
ggattcattagctgttattttgctacccatcagtttcattaataggagctttacaatttggaaggggggaaaatagcactagataattaatgaacc

SEQ ID NO: 6778268 - DNA, 66 bp, Homo sapiens
tatgaaagcagtttttcaaaattacatgatctactggttcctaaatttgaaggactttagttcata

SEQ ID NO: 6778269 - DNA, 71 bp, Homo sapiens
cgcctcccgcgggcccctccatccatcaccggggcggcggcgcccgggtctggggaggggcgaggggggcg

SEQ ID NO: 6778270 - DNA, 83 bp, Homo sapiens
gttttcttgcctagtgacaaaacggaacatacagaacacagaacatgttccgtatgttcagatttgtcaataggcaaaagaat

SEQ ID NO: 6778271 - DNA, 63 bp, Homo sapiens
gggacaatcgggagctagggcttggtgccctcaaggtgcagcaggggccctctcacctttccc

SEQ ID NO: 6778272 - DNA, 57 bp, Homo sapiens
tggattgccactgtgtttttgaatctgtaattctagatgtagctacaaggcagttca

SEQ ID NO: 6778273 - DNA, 98 bp, Homo sapiens
gcagaagcagcatcgggccagcttcatgggtgtgcaacctgtgcagtcacacaaggtcccaggcccagaagggcctcataattggtttgatgctctgc

SEQ ID NO: 6778274 - DNA, 61 bp, Homo sapiens
gggcacgggtggtaatgagaaaaggaaatcattaaagtttcttttcctaccacctgtgatc

SEQ ID NO: 6778275 - DNA, 85 bp, Homo sapiens
ggaagggatgaggcaggagcggggaccctgccctgcaagactccaaagcccaggtttaggggtccctcctcctcgcctcccttcc

SEQ ID NO: 6778276 - DNA, 82 bp, Homo sapiens
agagaaagactgcaagtctgggaaaggagaaagtttattttcctctctgctacctctgactccagttttgcttcctatttct

SEQ ID NO: 6778277 - DNA, 95 bp, Homo sapiens
taatatttgctctctgtgctcacaagggcagttgaaatattgaacatccttccaccatctgttctcttgtccttggattacagacggtaaagtta

SEQ ID NO: 6778278 - DNA, 89 bp, Homo sapiens
cctcaacccccttcccctgcgtgcagaggcagcactgatctggtgaggacattgtctctgccatgcttgagggtgagcagggtccctgg

SEQ ID NO: 6778279 - DNA, 55 bp, Homo sapiens
gatggagtggggactgcagtggaacaaagacagatgattcattcaccacttcatc

SEQ ID NO: 6778280 - DNA, 69 bp, Homo sapiens
ctattaaaggattcagctctatatgactagtctattataatttagtctacagtgaatgggtcctaatgg

SEQ ID NO: 6778281 - DNA, 66 bp, Homo sapiens
acttcattactaatttgccaattgaatatcccataagatattggaaggcattagtgaatatagagt

SEQ ID NO: 6778282 - DNA, 79 bp, Homo sapiens
attccaaccgacttgtgaggagaggcagcatctttccgagggaagagcagcacgttgtccccacatagtgggcaggagt

SEQ ID NO: 6778283 - DNA, 56 bp, Homo sapiens
gaactgaggtttacttgaaggagaagaaattctgcctttgactatagcctcagatc

SEQ ID NO: 6778284 - DNA, 71 bp, Homo sapiens
ttattaatgcttaccataatggtgtcactctaaatttggagggtgaattaatgatggtaaggccatgataa

SEQ ID NO: 6778285 - DNA, 95 bp, Homo sapiens
tcacttcatacttgttgatggcaaccgatgactgagtccagatgagagcttaactgaagcttcagtggactgtagtgtgtcatctaattgagtga

SEQ ID NO: 6778286 - DNA, 69 bp, Homo sapiens
ggagcctccccaaatgggttgagttctgttgtcccaacagcggtagctgttttcttattggtgagttcc

SEQ ID NO: 6778287 - DNA, 67 bp, Homo sapiens
ggggtggggcctgctccagcggccacggggaggggccgggggtcgctagaaggaggccgaccagccc

SEQ ID NO: 6778288 - DNA, 63 bp, Homo sapiens
tatggcatttagaaatgtcagaccaaggttttaaaggccctttgaacatttctagattacata

SEQ ID NO: 6778289 - DNA, 79 bp, Homo sapiens
catggagcagtagaggtgacttttgcctggaaaccctttcctcattttgtttcctagtcacttccagctgtgtttcatg

SEQ ID NO: 6778290 - DNA, 118 bp, Homo sapiens
gcaccacaacgagattctcttacctctgcgactgcacagaaccttagaatatctataaagaatataaatgtgattggaaattttgtgtaagatggtgaagcttctagatatgaggggc

SEQ ID NO: 6778291 - DNA, 61 bp, Homo sapiens
ctctggtggggcagtgtggagccgtgtcaagtcttggcacaggagcactgccctggttgag

SEQ ID NO: 6778292 - DNA, 83 bp, Homo sapiens
attcagggcagtgattctggggtgggtgtggtgggtgcgtttttcagcttcagatgtccttccagagatttaatgttgaggat

SEQ ID NO: 6778293 - DNA, 55 bp, Homo sapiens
gtaggcagccaaaaagaagtcctctgctaaggtatgaagggaattggctgcttgc

SEQ ID NO: 6778294 - DNA, 61 bp, Homo sapiens
gtgcttcctcagtgtttaaggacgaccagaactgtcacatttgagtccacattgggaacac

SEQ ID NO: 6778295 - DNA, 65 bp, Homo sapiens
tcagtttttgttgttttttaaatggctgaatagcataccctttacaggaacagcaaattttctga

SEQ ID NO: 6778296 - DNA, 58 bp, Homo sapiens
gctggagccggcgagccccagcccagagaacaaaaggcctcgctagccggcgtcccgc

SEQ ID NO: 6778297 - DNA, 57 bp, Homo sapiens
ggccacattcctggtgctcagcagccacgcgtggctgtgcagatgtagggagtggcc

SEQ ID NO: 6778298 - DNA, 129 bp, Homo sapiens
aaaacagaatgaaaaaatgtcttatgaagttcaccagtgtagatagtttagatttcaaagaaaatttcttaattgtgtgtctatactatctgaatgccttgattattgactagatttttaccatgtttt

SEQ ID NO: 6778299 - DNA, 56 bp, Homo sapiens
gggaagaggcagactggaaacctgggccggtccagcccaggcagcagcatcttctc

SEQ ID NO: 6778300 - DNA, 102 bp, Homo sapiens
cccaagacagcaggctagagctatggtggctgagctgagtttcccagctagacactcccctagacacttggctcagataccatgccctagcagtgcctgggg

SEQ ID NO: 6778301 - DNA, 65 bp, Homo sapiens
ggctgagcttgaattattctgctcttactctttttggagtgagaaagatgacattaaagccagct

SEQ ID NO: 6778302 - DNA, 62 bp, Homo sapiens
ggcaccgttcactctccgccagaagttccctgcttgctgtgttcccagagagagctggtggc

SEQ ID NO: 6778303 - DNA, 73 bp, Homo sapiens
ccttcacctgcccagcacctgggatctggttaaaaggcctgttcggattcaggaggtctgggcagggctgagg

SEQ ID NO: 6778304 - DNA, 74 bp, Homo sapiens
ttctcagccaatacaattaccagttaatcacaatagtgattgacctctgttggttggattataccatctgagaa

SEQ ID NO: 6778305 - DNA, 61 bp, Homo sapiens
tcccagaaccttttagcttcactgcttaaaaagtggacgatggagcagggaggatttgggg

SEQ ID NO: 6778306 - DNA, 62 bp, Homo sapiens
ctcctctatttctcctggcattgatacaaagcattggcactttaagctaggagagggaggag

SEQ ID NO: 6778307 - DNA, 59 bp, Homo sapiens
tgtacccaaagcccattgggccagtcacgctagagtcttggtcccggagttttgctata

SEQ ID NO: 6778308 - DNA, 86 bp, Homo sapiens
gtgaggccctgcctggtgctgattcactgacttctgttcagtctctgcaccagagcgtccagtgaattccaggccccgcgtctcac

SEQ ID NO: 6778309 - DNA, 69 bp, Homo sapiens
gagattctctgcaagatggtcttagaggttattaaagaatatctcagaaaacccttgctagtgagtttt

SEQ ID NO: 6778310 - DNA, 105 bp, Homo sapiens
agacccttcctattacagccgataggccagtgttttccaaactacgttctttggaatgttattgaactacgagctcttagtagatgtaactgaaagaatgggttt

SEQ ID NO: 6778311 - DNA, 79 bp, Homo sapiens
actcaggagaaagccaattagagtgaacatgtgtcactcctttgacccacccaacacctttgaatgtcttctctctagt

SEQ ID NO: 6778312 - DNA, 105 bp, Homo sapiens
agagacaatcaaaagtgacaaccagcaggacttagtgaaccttatatttgcacatcacgaaaagtttttgttggttttgttttgcttgtttgttggattgtcttt

SEQ ID NO: 6778313 - DNA, 70 bp, Homo sapiens
atggctagggctcgcaagggctggagctgtaggatctggctagctccatacctacctgagctctggttgt

SEQ ID NO: 6778314 - DNA, 86 bp, Homo sapiens
ttctatttattctcattagtctgtattccctatttctattatccgttcgaaccgagagggaattcagtacagtgtgatatatagaa

SEQ ID NO: 6778315 - DNA, 79 bp, Homo sapiens
ccaattcctgaagaaacgcacccttggcttcatcctgcctttgggaatgaagccaaggatgcctttctctaggaattgg

SEQ ID NO: 6778316 - DNA, 93 bp, Homo sapiens
attacagatttgtctcatggtaagagggataatatgtattgtaacctcatatttacatcatgcttatccctttcatggagacgagggtgtaat

SEQ ID NO: 6778317 - DNA, 89 bp, Homo sapiens
ggggctggggggtcttggaagccattccttctgctcccggcaggcctgggagtccctggaatagctccttcctgggccagaacagccct

SEQ ID NO: 6778318 - DNA, 82 bp, Homo sapiens
ggccccccggggcgtacctgtctcttatggtcgagtctgcagagatgaaatacactccagtctcccatagcgctcccaggct

SEQ ID NO: 6778319 - DNA, 70 bp, Homo sapiens
gagtggcgggcaggctggtgcaggcgtctcagcagcaccctggaggcacagcacacctggcccccagctc

SEQ ID NO: 6778320 - DNA, 120 bp, Homo sapiens
tcaaagacatattcagaaaaaaattccatgatgtacatgtttaagtgaaggataactgtatgtccttacatagtgctgaaatatgtagaacattatagagctcatggatataaaatttga

SEQ ID NO: 6778321 - DNA, 92 bp, Homo sapiens
tagtgtgcaaaattgagaggcgctcactctcaggttcctgaagtgcagggccggcacctgacagtgaatgcctctgtaaattttgcacccta

SEQ ID NO: 6778322 - DNA, 56 bp, Homo sapiens
agatacctacttggatctgttctggggttccaatctctccaaatcctaggatgtct

SEQ ID NO: 6778323 - DNA, 90 bp, Homo sapiens
ggaggagcaagacacaggtcatgaaagtgccaggccatgggggcttcagtcctggctgctgtcactgaccatggacacacttgctttccc

SEQ ID NO: 6778324 - DNA, 65 bp, Homo sapiens
agggaggggaggaggaactatggagctgggttggcaactcattcctttggactcctccttgctct

SEQ ID NO: 6778325 - DNA, 68 bp, Homo sapiens
ggggcccagcacccctcctcgccccatccccgtccgggtacgggggcgcggcaggggtccccggcccc

SEQ ID NO: 6778326 - DNA, 77 bp, Homo sapiens
cattgcccagtgtgtggcctgtggaagttactcattaaatactgggtacctaacttacctaggtccacatggtaatg

SEQ ID NO: 6778327 - DNA, 77 bp, Homo sapiens
ttgaggcaggtagtcttgttatcccagttttacagatcaggaaactgaagcacagagaaactaagacatttgcccaa

SEQ ID NO: 6778328 - DNA, 63 bp, Homo sapiens
gtttggttcaggtagttttggagtggcagtgagttagtccacttcatcagccagaaatcaagc

SEQ ID NO: 6778329 - DNA, 64 bp, Homo sapiens
gccttttctcagtttccttccttgtttttgatgacttgagagcactgaggaaagctggttaggt

SEQ ID NO: 6778330 - DNA, 55 bp, Homo sapiens
tcctcctcagtctggtcagggctctcaaaagagtgaccaacaatgctgagaagga

SEQ ID NO: 6778331 - DNA, 72 bp, Homo sapiens
acctggcaggtctcgctgacgtgtctagccccattcaggacaccttttcagcctgaccagttgctccaaggt

SEQ ID NO: 6778332 - DNA, 88 bp, Homo sapiens
gtgacaacgttactcctctgtggaccgggctttggccactgctaggtggcccattgctcatggtgtattattagagggtttgttgcac

SEQ ID NO: 6778333 - DNA, 80 bp, Homo sapiens
gttatagtttcatccgatctggtctcaagtttatagtcttaagtgaactgatatatacatggagaaagaccatctatgac

SEQ ID NO: 6778334 - DNA, 57 bp, Homo sapiens
tgtagtaacgggagagtgcatcttttagcaaccgtagctcgtttttccgggattgca

SEQ ID NO: 6778335 - DNA, 56 bp, Homo sapiens
agggggcaggtgggcgggagtggtgggctcgccctgacctggccgctgtgccccct

SEQ ID NO: 6778336 - DNA, 77 bp, Homo sapiens
tcagaactaaaacagtacttccagtgtaggcataccagcaaagcatacatgtgggactcctgctgtttttattctgg

SEQ ID NO: 6778337 - DNA, 59 bp, Homo sapiens
gtgcagctttaaacattggaaatatggtcatatggccctatttctattattatggccac

SEQ ID NO: 6778338 - DNA, 63 bp, Homo sapiens
aactggaatgaagttaatctgatagtcttttctactgacattaaatcgtaattttttccagtt

SEQ ID NO: 6778339 - DNA, 92 bp, Homo sapiens
ttcatgtgtgaaactttcatgaatataagatgctcctaaaattgactttaataagtagaaatctttgtacagtttgaaggcatacatatgaa

SEQ ID NO: 6778340 - DNA, 130 bp, Homo sapiens
tccacaataataacatgaaatatataagggaaatcttatgcatgtactctggctggctaggttgccagtaatctgtttccattagagtcataccataagctttcctttttgtttcctcttttattttgga

SEQ ID NO: 6778341 - DNA, 74 bp, Homo sapiens
tcaaattggactgcagcacaaaagccaaaataagtgtttcttccactagagggctggtgcttggtctgttttgg

SEQ ID NO: 6778342 - DNA, 73 bp, Homo sapiens
acagtcgcaatttgtaaacacagaaaagaggaatgaaatgaaaggccgtgtctgtgctacaaatcgcgtctgt

SEQ ID NO: 6778343 - DNA, 60 bp, Homo sapiens
ggagcaagattgtcctggtgccctggctcagcccccctgggtcagtggctttcttgcacc

SEQ ID NO: 6778344 - DNA, 89 bp, Homo sapiens
attcccaccttagtttggggtgttttgaagaggttcagagactaaatcttaaaccttatttgaataccaacgatagctattttgggaat

SEQ ID NO: 6778345 - DNA, 67 bp, Homo sapiens
cgggtgggtgttgggtggcgttgggggagctgcgcctcgcccagagcctcgcccggagcctcgcccg

SEQ ID NO: 6778346 - DNA, 91 bp, Homo sapiens
tggaaagaatattaggaagttatccatagtttgtttacatgcttgctaagtgcattataaattatgaatggcccttttatggtaatttcta

SEQ ID NO: 6778347 - DNA, 74 bp, Homo sapiens
tggtattagtactaaacagagaaccaatatattatgccgtagagtttggcactctgtttagtaagtcattacca

SEQ ID NO: 6778348 - DNA, 55 bp, Homo sapiens
ttttacccacatttgggagtatatctctaggatccatcaccacatgtgggtcaaa

SEQ ID NO: 6778349 - DNA, 55 bp, Homo sapiens
catatgctctaactataaaacattcaaaaggttgcttttatatgtagggtatatg

SEQ ID NO: 6778350 - DNA, 78 bp, Homo sapiens
ctgcaggatctggaggtaagaggccctgggccgaggtgcagtgaccctgcaggccagccctccaacctcctcccacag

SEQ ID NO: 6778351 - DNA, 104 bp, Homo sapiens
ttccgaaacttctacagtgttgcaggaagaaagatgctgagatcatttgttggagtgaatcatggctgtgtcttcagcagctgccctgtgcaggaaggctggaa

SEQ ID NO: 6778352 - DNA, 82 bp, Homo sapiens
ggcgaggcttagtagagcagttgtgggtaccagttctcccaggaattagtgcccaggctgcctcttcacacccccacctccc

SEQ ID NO: 6778353 - DNA, 74 bp, Homo sapiens
agcagctcaggtcttcagcagaagcagggaggttctcccagtggttttccttgactgtgaggaactagcctgct

SEQ ID NO: 6778354 - DNA, 75 bp, Homo sapiens
ctgttccatgtctctctctgagtgccagaaaggttcttacccttgtctgagtgcactaggaggggcaaaaggcag

SEQ ID NO: 6778355 - DNA, 80 bp, Homo sapiens
tttattgtgtacctgctatgtgagatacattatgtaaagcactgagcatgatgtctctcacatagaaggtaaggcatgaa

SEQ ID NO: 6778356 - DNA, 66 bp, Homo sapiens
cttattgtctgtggctgctttcatgctacaatggcagagttgaatagctgtgacagacatcataag

SEQ ID NO: 6778357 - DNA, 69 bp, Homo sapiens
tttagaagactgtcccagacttattaacacagaatatctgaggaatgagccctggaggcattttttaaa

SEQ ID NO: 6778358 - DNA, 61 bp, Homo sapiens
gccagcctcctctaactgccgaggcaacaaataaagaaggcttcatgctggaggggctggc

SEQ ID NO: 6778359 - DNA, 120 bp, Homo sapiens
gcccccgggccagctgtcacccgagtggggtgggagtggggtgactgcctgcccagcggtcagggcagcagccacccagctgctcattaactcagaggcagccactggcttcagggaggc

SEQ ID NO: 6778360 - DNA, 82 bp, Homo sapiens
tttatcgttaaatcaatatagcctctgacttgaagtcaatttgcttagagttgtatatggctttattgatttgaatcataaa

SEQ ID NO: 6778361 - DNA, 68 bp, Homo sapiens
ctgtgaaggcaatgataagagtgacagccagaatggggaccacctagtttactcttctcgttttacag

SEQ ID NO: 6778362 - DNA, 88 bp, Homo sapiens
ctacaaagtcaaagaaggacatagaagtatcaagatcttgaaaagaagtttacaaccgtcttgattctttcggttattttttctgtag

SEQ ID NO: 6778363 - DNA, 75 bp, Homo sapiens
agccaacactcacaggtagaataacaacatcacagtacagagatgtgagtggcatctgcctttgagtaagggact

SEQ ID NO: 6778364 - DNA, 81 bp, Homo sapiens
ggctttagaatgaacagagttaagtttacatcctggttctattctctatgtgatcagaggaaattaactctctcagtctcc

SEQ ID NO: 6778365 - DNA, 77 bp, Homo sapiens
gggacctgagagtataatttgcaatatctgattattaatcttgaggatgtgtgctgcatagtatattttatggtgtc

SEQ ID NO: 6778366 - DNA, 55 bp, Homo sapiens
gaatgtttttcaaacctgtggcatgcatcatttcagctaagggagaaaaacattt

SEQ ID NO: 6778367 - DNA, 130 bp, Homo sapiens
gcctgtcccagcaaggactcccaggggcctgggattctcaaaggggtgccacctccattggatgcccctttccttgagaaaccccaaagccctttcagaggctgttcagctgtaacctcactccaagggc

SEQ ID NO: 6778368 - DNA, 69 bp, Homo sapiens
cctttcaaataccataaacctaatgaagcagatgattgacataaggtcagatggtgtttgatatttagg

SEQ ID NO: 6778369 - DNA, 74 bp, Homo sapiens
ggttaggagtggggtccatccacacgtgcttccagccctggagaccagcagcatggatgggcctcagcctagct

SEQ ID NO: 6778370 - DNA, 66 bp, Homo sapiens
gaaatggcatgtggctgggttttcatagcacctttactttgaggctcagagcacctgctccatttc

SEQ ID NO: 6778371 - DNA, 72 bp, Homo sapiens
cctggctctggctggctgggcctcagtggggaaggtctgcccctgatacttgggatggtggccagagcgagg

SEQ ID NO: 6778372 - DNA, 85 bp, Homo sapiens
cggtcctgcttccccagaggtgaggcagcttttggccatgttgttggtagcaaagactcactttcagctctggaagctttggctg

SEQ ID NO: 6778373 - DNA, 84 bp, Homo sapiens
ggccccgccccgcctgccgtgtcccgcggcgagcgcaggcgcgctgcactcggtcaccgcgggctgcggcggctgggcggggct

SEQ ID NO: 6778374 - DNA, 69 bp, Homo sapiens
ttgaggcacacacaggttgcattgtgatgccaaccacatcctttatgttgtaacactggtgtttctcga

SEQ ID NO: 6778375 - DNA, 83 bp, Homo sapiens
aactaacaaaaaagcagtataagtaacggaaggtttctcccacactcaaaccatttattataagtattgctatttggtcagtt

SEQ ID NO: 6778376 - DNA, 90 bp, Homo sapiens
ggactgaacctgagtcttttgatttgcttttcacagctacttgatgctgccatggggattgtaaaccagaaaactcaacaggtcaggtct

SEQ ID NO: 6778377 - DNA, 80 bp, Homo sapiens
actggcgaccaggtgacctttgtcctaagtttcaagattctggctctagtgtcaacttagccacatggtcatcatccagt

SEQ ID NO: 6778378 - DNA, 89 bp, Homo sapiens
atcctgggctgcccagccctgtgtgtccttgacctcagtggctgcaatagcctcttcacctcgggcacactgctggctcagccagagat

SEQ ID NO: 6778379 - DNA, 75 bp, Homo sapiens
tgagtagaggagtgtgtgcaggctccagtccccaaagtctctaggactgtcctagaacctgcagctcatctgtca

SEQ ID NO: 6778380 - DNA, 66 bp, Homo sapiens
gtgctgccctggcattgggttggataagtgagttattgctgtcatttcccgtgttaggagtcacac

SEQ ID NO: 6778381 - DNA, 64 bp, Homo sapiens
tggtctgccatttcctactctgatatcttataaatataagatatccttttcggaagagcagcca

SEQ ID NO: 6778382 - DNA, 55 bp, Homo sapiens
gctgtcaaggttgggaggagatgagtactcgcccatcctgctgaccttcacaagc

SEQ ID NO: 6778383 - DNA, 70 bp, Homo sapiens
gctattccacaggtgtgtcctggtcttgtggtgactgccacaggccctgggtacatgacctgccttcagc

SEQ ID NO: 6778384 - DNA, 72 bp, Homo sapiens
gcctggacttgctgcagaaacctttcctgatttgagtccttccaaagctggaggctttctgtatctctaggt

SEQ ID NO: 6778385 - DNA, 58 bp, Homo sapiens
aaagtaattggcaggattcagtctctggttgttacagattctaagtcctagttatttt

SEQ ID NO: 6778386 - DNA, 77 bp, Homo sapiens
actgagagtgatgatggaggcaccactggctgcccgctatcaccagcaggcaactggggctttcttcccaccttagt

SEQ ID NO: 6778387 - DNA, 73 bp, Homo sapiens
aggagttctgataggcctttctctaggaatgtgccttggcaccggcctggcatggggtctccagccagctctt

SEQ ID NO: 6778388 - DNA, 58 bp, Homo sapiens
aatgctgctgcatgaacagcggtcacgatgctagtgggccagggagtgcaggagcatt

SEQ ID NO: 6778389 - DNA, 125 bp, Homo sapiens
aggctctgcgtctgtgcccccaagtagtcagagagcccagatcccaccctggagaaatgggaagtgtcccatcacatccacagggatgcctgcggcttctagtttctggcccaagaccaggactt

SEQ ID NO: 6778390 - DNA, 89 bp, Homo sapiens
cttgtcactatgggaacatttgttagaactgaagaagattaaggccaaggaaactggcagatctcccagtacagatttcctaggctaag

SEQ ID NO: 6778391 - DNA, 89 bp, Homo sapiens
ccctcctcaaccctgaacttcaagtccagctcatgctctaggccatttcctagaaagtgcctcccttgggagctcagggacggggaggg

SEQ ID NO: 6778392 - DNA, 80 bp, Homo sapiens
cagaaaatggggcaaaggccacacagagcagggagccaaccaagtggggtttcttttgccctgtgggttagtgtcccctg

SEQ ID NO: 6778393 - DNA, 67 bp, Homo sapiens
tgactctgtttccttgcttcctgccttctgaggatttgaagacagtgcccaaaggaacagaaagtca

SEQ ID NO: 6778394 - DNA, 59 bp, Homo sapiens
ggtccctggttccctctgagcttgggaggactatgtgagacagaacaggaccaggggcc

SEQ ID NO: 6778395 - DNA, 70 bp, Homo sapiens
tacagaaatatttggagatggagagagggcattaaactagaagcattctgcattttcaaagaagtttgtg

SEQ ID NO: 6778396 - DNA, 86 bp, Homo sapiens
tggtttagtaaggtgaactggtaatgacagaagttgttttatactgtagttttttgtgattgcttcagttttttcttgtcagacca

SEQ ID NO: 6778397 - DNA, 82 bp, Homo sapiens
agctctcaagtgagtcacaagtttgctttcattccaaaagcaaaacataacagtgagagaggcccagggccacttaagagct

SEQ ID NO: 6778398 - DNA, 77 bp, Homo sapiens
agacagacggggaaggattgagttgacccaacatcatctatctggctggacgctcatttttcttctcctgcctgtct

SEQ ID NO: 6778399 - DNA, 64 bp, Homo sapiens
gagctgaggctgaggcctcactgtcaccttctgtgaggtccatgacatcctcactcctgagctc

SEQ ID NO: 6778400 - DNA, 65 bp, Homo sapiens
atcaggatcctcttttcctaggaaggtgatgtcatcattcctatgtaaaggatggagaaactgat

SEQ ID NO: 6778401 - DNA, 62 bp, Homo sapiens
tgaattcataggacacagggtgagggtttatttctataaaaataatcgtgtcttggggttca

SEQ ID NO: 6778402 - DNA, 62 bp, Homo sapiens
gaaacaccacgcggtccctcggatcccactctgtcctgcctctgagatccttgtgttgtttt

SEQ ID NO: 6778403 - DNA, 77 bp, Homo sapiens
gcccaagagtgcagtttctaggtcacacaatgaacacgtgcttattagtgttgtaagaagctgccacactctcatgc

SEQ ID NO: 6778404 - DNA, 72 bp, Homo sapiens
tgagcagaacacgggatccatggggcatccttgtgtaggtcctccgtggcttggatccctgtgcactgctca

SEQ ID NO: 6778405 - DNA, 125 bp, Homo sapiens
tgaattcttgctgatcaaccaaagagtttgtcaccagggagcttgtcctctgaatgagctggatttatattgcacctgccagaacacagcaccctggtgccatggggatgccagacatggattca

SEQ ID NO: 6778406 - DNA, 77 bp, Homo sapiens
agccatgaaaacagctgtatactgtagctgtaaatagtgtttacagttatatacatgtagctgtttgtaacatggct

SEQ ID NO: 6778407 - DNA, 69 bp, Homo sapiens
ggggggtctagaggtggccaagcgaggaaggggcaagcagttccccaagcaggcaatctcccgctcctc

SEQ ID NO: 6778408 - DNA, 69 bp, Homo sapiens
agttccctttgaagtgagaggggctggggtgggtgtgtccagcccagcccccacacccaccggagagct

SEQ ID NO: 6778409 - DNA, 57 bp, Homo sapiens
gtgagggatctaggttgcgctgtccttatgagagtctaatacctattgatctgtcac

SEQ ID NO: 6778410 - DNA, 92 bp, Homo sapiens
tgttttcttactagggaagaaaggcatggaactctggggccaactagtagtgtcccatggcttttctggtggcttcctatggtgaggggaca

SEQ ID NO: 6778411 - DNA, 56 bp, Homo sapiens
gctcaggctctcccaggggaatgtagaggcctgtcctgggttcccagggtctgagc

SEQ ID NO: 6778412 - DNA, 80 bp, Homo sapiens
agctccaacaacaagctgaggcttagctaaaaattttctctaaagctttttggagagtttcattcttgtttttactggct

SEQ ID NO: 6778413 - DNA, 60 bp, Homo sapiens
tgtaaagaaagctgttgttgtattctgctcaatggaatgtatgatacagtttattttaca

SEQ ID NO: 6778414 - DNA, 56 bp, Homo sapiens
ggtagcaagcgcttgccctgcggctgctgcatggggctaactaacgcttcctcacc

SEQ ID NO: 6778415 - DNA, 65 bp, Homo sapiens
tcagagctggcacagaaggatcttagcacatatttgctgagtgaatgcaatccctttcagtctga

SEQ ID NO: 6778416 - DNA, 66 bp, Homo sapiens
gtcaatgttcactgtctcctagggggacttcctggaggaggccaactttggagaacaggcattgac

SEQ ID NO: 6778417 - DNA, 104 bp, Homo sapiens
gtgtctcaaatcaatcagatgaaattcaccttttacgtggcctgaatcctgatagctcagcacacttgataggtaatttaatcacgtctggtgtagatgaacgc

SEQ ID NO: 6778418 - DNA, 96 bp, Homo sapiens
gtgaaaagaagtttcctgttttgtatttagagtgttttaattcgatcttaaagcatttaagcttctgcaaagcattaattttggcattcttttcat

SEQ ID NO: 6778419 - DNA, 81 bp, Homo sapiens
gtgaatagccaacttgaaaacctcatgaattgtacagttcagatacctgtacaaattgttttggtttataaaagctatcat

SEQ ID NO: 6778420 - DNA, 70 bp, Homo sapiens
agtattgagacttccagtatatgagagtgttcagtagagacagtaaatcagaatactggaagtatcagct

SEQ ID NO: 6778421 - DNA, 66 bp, Homo sapiens
tgtttattggatgactagaaatgtcaactttcattagcaaagtgaatgtttggtcctttataaaca

SEQ ID NO: 6778422 - DNA, 68 bp, Homo sapiens
ctccttagagatattaagatgctattggttttcaatatctgaaagccaatgagttttaattcctagag

SEQ ID NO: 6778423 - DNA, 103 bp, Homo sapiens
tggaaaaagatctgaaaacacaatcttggtgcagaagaaagcagtcatttccttaatgggaattactgtaattttctacagcagacattcagagtcatatccg

SEQ ID NO: 6778424 - DNA, 56 bp, Homo sapiens
tctgctggcaatattgagaaaagaagctctctttttcctcaggaatgctaagctga

SEQ ID NO: 6778425 - DNA, 69 bp, Homo sapiens
cagaggaacttctctccacccaagtccctgggtttggttcaaggactattggaggaggggagggctctg

SEQ ID NO: 6778426 - DNA, 58 bp, Homo sapiens
caggcacacccactggtgcagaaggccatttcctcctgtgaaccgtggggtgagcctg

SEQ ID NO: 6778427 - DNA, 68 bp, Homo sapiens
tctttgaatgttttaggtacttaagaaaatggagcatttcttatagtatgaaggaaaacatttgtggg

SEQ ID NO: 6778428 - DNA, 66 bp, Homo sapiens
ttctgtgttccagaaggtgactcagggagttgtgcaaatgactgactcatatttcatggatacgag

SEQ ID NO: 6778429 - DNA, 59 bp, Homo sapiens
ctcttgggatttcctgagtgcggaagggctatgtttgttctaggctaggggaattggag

SEQ ID NO: 6778430 - DNA, 95 bp, Homo sapiens
ccagaccaatgtgttgtttttctttattattatttcttaaagcttcccttgagagaataaatggtaatggagagaactacttaacaaggtcctgg

SEQ ID NO: 6778431 - DNA, 123 bp, Homo sapiens
tcccggcacacggtgctgtgtttctccactcttgggctctgcagtgacttgaggggtcaagtctatgatcccacgggaggctgggctaatgaggggaccagagacctcagtgctgtgcaggga

SEQ ID NO: 6778432 - DNA, 56 bp, Homo sapiens
gcagggctgtttagtgaataggggtaccctaccttgttctagactagtagccctgt

SEQ ID NO: 6778433 - DNA, 90 bp, Homo sapiens
agagacgtttgttttcagcatcctgcactcaggatatcactgaaactgttagtgttcctgtgctttggatgcttagaaagcacatcctct

SEQ ID NO: 6778434 - DNA, 68 bp, Homo sapiens
gggtgagacagaaagagcaaaagagcaaagagaaattgaatatattttgattgctttttctttcacct

SEQ ID NO: 6778435 - DNA, 75 bp, Homo sapiens
gggcgcaggaaagaaggaatgtgggggctgatttgtggagctccagcttcctgtccaggccccacatcctgcctc

SEQ ID NO: 6778436 - DNA, 77 bp, Homo sapiens
aagatcacagtagctaatattgcattatgatgatactgccttcccagaaatgattgcagtcttgctgctgctgtctt

SEQ ID NO: 6778437 - DNA, 59 bp, Homo sapiens
gcctgccagctggtctgtgctcatgttggctgcactcatggacttgaccggctgctggc

SEQ ID NO: 6778438 - DNA, 56 bp, Homo sapiens
tgcctgtgtagttcagcctgtgaaggctccctttcaagtaggccagctgcatggta

SEQ ID NO: 6778439 - DNA, 65 bp, Homo sapiens
ggcctcctcattgctctgaacccagggcaccattctggcatgggtcatgggtggagctgggggcc

SEQ ID NO: 6778440 - DNA, 83 bp, Homo sapiens
ggccagagcactttgtggacagagccctggtttggggtgggagacccgagtcccgtactttggctctgccactacctttagtc

SEQ ID NO: 6778441 - DNA, 70 bp, Homo sapiens
taatgagaatgtcacagattcacgagggcataacaaaacaaaactcttggtagataaagcattttcatta

SEQ ID NO: 6778442 - DNA, 86 bp, Homo sapiens
ccatatgaagggtatagtttgaaggctgttctactcagaagcactgagagaaactaaatggtcttctaaattattgtttcatttgg

SEQ ID NO: 6778443 - DNA, 103 bp, Homo sapiens
tgattcttgtgggggatgaagacattaaataaagaagcaaatggttgtattatcttacccgtttgcctctttatttactgtcttcataccctgtaagaatgca

SEQ ID NO: 6778444 - DNA, 66 bp, Homo sapiens
tagacttagtacaactcacttgattttagccaaaaggctgagaagcaatgacttagtacaactcta

SEQ ID NO: 6778445 - DNA, 60 bp, Homo sapiens
aaagcagtatagtggaagggctggggctataacgttgacgtcctaacactagtactcttt

SEQ ID NO: 6778446 - DNA, 67 bp, Homo sapiens
gccagtgatacagtcatctgatggtgctgaaagattcacttccagactcactcatgtgactattggc

SEQ ID NO: 6778447 - DNA, 78 bp, Homo sapiens
ctagcagtcgagagatgggttggcaggggctcaggttactccatgtccctgataagagccatcgatctgggctggtgg

SEQ ID NO: 6778448 - DNA, 66 bp, Homo sapiens
tctgccaggcattgtgctgctcattaaagatcaagagacacaaagcacagtccctgactttgcaga

SEQ ID NO: 6778449 - DNA, 72 bp, Homo sapiens
ccccagcacctgggacccagaggcaccagcgggtactgggaggtgccggtggccctggcccagctgcagggg

SEQ ID NO: 6778450 - DNA, 81 bp, Homo sapiens
agcacaaagagatggaggaaggctgaactcactctctgcctgcattttgagctcagacaccattcttctgccttttgtact

SEQ ID NO: 6778451 - DNA, 61 bp, Homo sapiens
gtgtgcagaggcaggaggtgctgagctgttggtataagcagacttcccttctctggcacac

SEQ ID NO: 6778452 - DNA, 65 bp, Homo sapiens
ctgcctgttgtctgtgactgctggtgatccaaaggggcgtgggtgggccacggcataacgggcgg

SEQ ID NO: 6778453 - DNA, 74 bp, Homo sapiens
gcctcacccatataagaatcggtcgcaacagaggaggacattctctggaaaactgaaattcttgggacagaggt

SEQ ID NO: 6778454 - DNA, 79 bp, Homo sapiens
acggagatgatgcaacagtcagtacatccgggaaaagcacttatggtagctctgtgtactattgttgcaatttttctgt

SEQ ID NO: 6778455 - DNA, 76 bp, Homo sapiens
gggacctttggaaggaattaaggtcatgagggtggagccttcatgaatgggattaatgtccttacaaaaggggacc

SEQ ID NO: 6778456 - DNA, 77 bp, Homo sapiens
gactgtttcccatgtgatccatctgtatcctgtacatgcctctgttacagcacattgtgatggcactggaaactgtc

SEQ ID NO: 6778457 - DNA, 91 bp, Homo sapiens
gcaacagacttgctcattgcttctctcttatgtaatgtatgtaaatgcatttcatgccgtggaagtcctgtgcattcaaagcttttgttgc

SEQ ID NO: 6778458 - DNA, 56 bp, Homo sapiens
cctgtgtcctcccactcagtccacaaaaaccagggctgcagcaggagagaggcagg

SEQ ID NO: 6778459 - DNA, 72 bp, Homo sapiens
tctagagcagtgttctaaattgggtgtgattttgtccccaccccaaccctggggatattgtcaatttctgga

SEQ ID NO: 6778460 - DNA, 79 bp, Homo sapiens
catggtagatggtgactgagcagaacaatgggagccgataccttggtttattcatctctgctgcataccatttgctatg

SEQ ID NO: 6778461 - DNA, 56 bp, Homo sapiens
ggctgtcttgggagctcccccgcggccccgaagccccgcggtgctctcaggatacc

SEQ ID NO: 6778462 - DNA, 77 bp, Homo sapiens
gtactggtgatacatctgtgatcaagacagacagtgttgcatacatttttgtgagggaaacaggaaagttatcaggc

SEQ ID NO: 6778463 - DNA, 61 bp, Homo sapiens
tgggttagaaagcaatctacctcttcccctaaaccagagtgtggagagtgattttgatgca

SEQ ID NO: 6778464 - DNA, 83 bp, Homo sapiens
ttagtaatgtttgttgagtaccttctatgtgcttggtattctgtaaattttaggcatatgaaatagaatgtacacattgttga

SEQ ID NO: 6778465 - DNA, 67 bp, Homo sapiens
agcatggcaagggcccgagctataaggaggatcacccaccgaggtggctaaaggctctagtcctgct

SEQ ID NO: 6778466 - DNA, 97 bp, Homo sapiens
ccgcacactgtctgagatctgctcagccgatctgctccggccgtagtaatccgtgaagaggccgtcagggttgagcaggtagatggcaatggagtgg

SEQ ID NO: 6778467 - DNA, 71 bp, Homo sapiens
gaagagactgggccaaggtcagcagctttaagtggaaaagctgggatgtgaatccagatctttttctcttc

SEQ ID NO: 6778468 - DNA, 72 bp, Homo sapiens
catgaactctgggacagcttgcctggtactgcaactggaggacatcattgcatccagagagcttcccacatg

SEQ ID NO: 6778469 - DNA, 124 bp, Homo sapiens
gtgagatgagaatccttagagtctggttcactatgactgggattgttcctgtatgggggaagagctattcccaagcttagggctctcagttacagtgaattatctcacaaggatctttaattac

SEQ ID NO: 6778470 - DNA, 60 bp, Homo sapiens
atgatgcttccactgttctgctctccctgggaaagcggaggcagaacggtgaagcagagt

SEQ ID NO: 6778471 - DNA, 126 bp, Homo sapiens
gtcacttttggatggaagcttttttgccagtgagatagtcttacttttctctgctacattgcatgtaattggtagagatggtgggtactttagcagcttggctgacagctacgttgaacttgtggc

SEQ ID NO: 6778472 - DNA, 57 bp, Homo sapiens
ttaggagatcagagaggactcagtcccatactctgttttgtttctgctattttctaa

SEQ ID NO: 6778473 - DNA, 79 bp, Homo sapiens
caaattatattgaatatgtcctgtattggtgttactccctgatatcacaagacaagacaaattgcaatccagggatttg

SEQ ID NO: 6778474 - DNA, 64 bp, Homo sapiens
gtcagctatgaagaccacatggttattgtgagaaataacatttaacctttctcttgtggctgac

SEQ ID NO: 6778475 - DNA, 79 bp, Homo sapiens
ggagtgtgtttagctctgggacctggagcggctgctatagaaagacagaggcatcgggagttcttgaagacacacatct

SEQ ID NO: 6778476 - DNA, 57 bp, Homo sapiens
gcccaggcctcactgtgcatcccttggggcgtctcccccacagcaggatggctgggc

SEQ ID NO: 6778477 - DNA, 85 bp, Homo sapiens
atcaatgctaaatatttctactcaactgagagttgtttctctccccacagaggggctctcttggctttggagaaattagcctgat

SEQ ID NO: 6778478 - DNA, 77 bp, Homo sapiens
aaaggaactttgtatgtgataagactattctgtatcttgatggggtatgttatgtatacactgcaatcagttccttt

SEQ ID NO: 6778479 - DNA, 56 bp, Homo sapiens
ggtccgtggagattttgtgcagggttatttcaaatcccccacattagttccatgcc

SEQ ID NO: 6778480 - DNA, 65 bp, Homo sapiens
gggtcagagatgtgagctgtcttgctaagaattatagtgctagactggctctgcatttttggctc

SEQ ID NO: 6778481 - DNA, 76 bp, Homo sapiens
ttctcaaacaggggtgactttgtcccccaggagacatttgggaatgtctggagacttgggtcatcaaaactgagaa

SEQ ID NO: 6778482 - DNA, 70 bp, Homo sapiens
aagtctttgctattgtgagtagtgccacaataaatatacgtgtgcatgtgtctttatagcagcatgattt

SEQ ID NO: 6778483 - DNA, 69 bp, Homo sapiens
gtgtaagccaggccttagggagaggcaaacaccactaacttgttcctgccctcccaatgcttcggtcac

SEQ ID NO: 6778484 - DNA, 60 bp, Homo sapiens
ttgagccctacctcagactttctgaataagaatccctagagaatgtccagtggggctcaa

SEQ ID NO: 6778485 - DNA, 67 bp, Homo sapiens
caggacaatcaataaccatagtggttacaattccaagccattgtactacatgattattgaccagctg

SEQ ID NO: 6778486 - DNA, 65 bp, Homo sapiens
ctgcaagtccaggagacaagcctcaggagaaaagtcctgccaacaccttgatcttggacttccag

SEQ ID NO: 6778487 - DNA, 61 bp, Homo sapiens
caggctgactggggttcattggtgtccactgggggcagctcccgtgccttcagcagtcctg

SEQ ID NO: 6778488 - DNA, 69 bp, Homo sapiens
ggcgtccctctgctgatgcctgtggctgtgtttgtgcatttacacgtcacattagcggagatgaatgcc

SEQ ID NO: 6778489 - DNA, 63 bp, Homo sapiens
tctcctctgtgccacagcttgggaaagccagatctagtccaatatctttgttacagatgggga

SEQ ID NO: 6778490 - DNA, 99 bp, Homo sapiens
gaggtaggagaatctctggaacctggaaggtggaggttgcagtgagctgagatcatgccactgcactccagcctgggcgacagagcaagactccatctc

SEQ ID NO: 6778491 - DNA, 69 bp, Homo sapiens
gttatgcaactagatcctgttagagaatagaatgaatgaaaaatcaattctgtcctcacagagcataac

SEQ ID NO: 6778492 - DNA, 89 bp, Homo sapiens
ggggagagttggagacagtgtcagccattgaaaagaccaaacaatttaaggcccttttcccctgggaacattgattctttaatctcccc

SEQ ID NO: 6778493 - DNA, 81 bp, Homo sapiens
cttatgttttgaaacttaatccccaatgcaacaatattaaaaggtatagatgtggcctttgggagattattaagtcatgag

SEQ ID NO: 6778494 - DNA, 79 bp, Homo sapiens
gacttattttttgtggtcctatcttctagcctgagtgttaaccaggtggacaggcagattaggattaggaaataagatc

SEQ ID NO: 6778495 - DNA, 84 bp, Homo sapiens
agctggggcccaatgatgttgacctcgatgaacggccggaagatgccagaagtctgccacttgaggtcattggcagccaccact

SEQ ID NO: 6778496 - DNA, 69 bp, Homo sapiens
gaagaaactggggcataggaaagtttacaaattgggatttgaagcaacaagtctggccccaggatcttt

SEQ ID NO: 6778497 - DNA, 70 bp, Homo sapiens
attaggttgctgcaaaagtaattgcggtttttgccattcttaatggcaattacttttgcagcaacctaat

SEQ ID NO: 6778498 - DNA, 56 bp, Homo sapiens
ttcttcacatttgcccttatgtgtgtcaggaagatacaatcctagatgtggaagaa

SEQ ID NO: 6778499 - DNA, 61 bp, Homo sapiens
gggaatgaggttggcataattaaatgaatgcagtttattctttggggctgatcttattgcc

SEQ ID NO: 6778500 - DNA, 58 bp, Homo sapiens
tgacttccagcacctcaagcggaactatgtacttgtggttacctgaattgctgaagca

SEQ ID NO: 6778501 - DNA, 57 bp, Homo sapiens
tgttatctgagcaacgtcgacgggggagaacacccctgcccgaggttaaagatagca

SEQ ID NO: 6778502 - DNA, 82 bp, Homo sapiens
tgtgatcagagagataataggagccaggtcacataggccttacatgccattgtgaataacttggcttttactctgagtgaca

SEQ ID NO: 6778503 - DNA, 76 bp, Homo sapiens
aggtctctcatttgtgtgagtgatttgacaacctgatccttggtgttagctcaatcttcacagaggaggtagactt

SEQ ID NO: 6778504 - DNA, 130 bp, Homo sapiens
ggccttgaggtcacaaaatgaataatgatccttacattcctgcatctgcttttggggctcgccctgttaaaaccacaggtgaggacaacatgggaagatttatagttctcagcctgtgtacctacctgcc

SEQ ID NO: 6778505 - DNA, 66 bp, Homo sapiens
ctgctgggatatttcatgtaaatggtggacattttagacaccatgtgcatccttaatctccctagg

SEQ ID NO: 6778506 - DNA, 116 bp, Homo sapiens
tcaaggctgccaaaagaatttactgtttgttccagcccacacctgaagctggagcccctgcttcccagcctctgtgtgagggtaggagcctaacgttaactcatgtccagctttgg

SEQ ID NO: 6778507 - DNA, 82 bp, Homo sapiens
gttcccactttatagatataaaactgaagcttagggaaatcaaacaagcagcccaagtttacagatgtagtaggggtggaac

SEQ ID NO: 6778508 - DNA, 60 bp, Homo sapiens
gggttagcccagactaaaacctcagtctatctggctccaggcaaagtgctgggctgctcc

SEQ ID NO: 6778509 - DNA, 59 bp, Homo sapiens
caggctgactgtgtgaccttgggcaagcatcatctcttgaaatgcacacagacagcttg

SEQ ID NO: 6778510 - DNA, 107 bp, Homo sapiens
gggcacctgcatgatgacctcccacacctgcatgtttattgggcctggtttatgcatccaaggatcaggaagtgtgagggtggtgtaggggatcataagagtgcacc

SEQ ID NO: 6778511 - DNA, 59 bp, Homo sapiens
tctctttcagggtgtagtggtaggttccacaaaacttatggcttgaaactctaaggaga

SEQ ID NO: 6778512 - DNA, 59 bp, Homo sapiens
tgctgagagaggtactcagggaagacaagccaactagcctgggtgaaatctctcctgca

SEQ ID NO: 6778513 - DNA, 85 bp, Homo sapiens
gctgctgaccatggggctggaggggggcagccctcgactcccactccccgcggtgctgcagctcgccttccggcctggcagccgc

SEQ ID NO: 6778514 - DNA, 66 bp, Homo sapiens
aaggtggtaatttaatcctacactgttgggaatacctcagcagaatgtttcctgggttgctacttt

SEQ ID NO: 6778515 - DNA, 73 bp, Homo sapiens
catatacacagccctgacctgtggaagcttcaaatctggtagaattcagtgacagaggcaggcctgtgggatg

SEQ ID NO: 6778516 - DNA, 76 bp, Homo sapiens
tctgggttgttggagaggaggactagccctaggccaggtggctgaggctcaatccccttctgacagtcactccaga

SEQ ID NO: 6778517 - DNA, 96 bp, Homo sapiens
tgagccaggatttgaacccaggaagtttgactggaaagtttatgcaaataaacaacatttcagacagattcttctcagtataaaaacaatggctta

SEQ ID NO: 6778518 - DNA, 66 bp, Homo sapiens
gtgtatgcacgtgtgtgtgtgtgtgtgtgtgtgcacgcacatgcatacaagcacatgtagtgtcat

SEQ ID NO: 6778519 - DNA, 67 bp, Homo sapiens
gaagattctaggccctaccccacacctaccaaatcagagtatctgaaggtggggcttaggaatcttt

SEQ ID NO: 6778520 - DNA, 125 bp, Homo sapiens
aatgtaaattattttgtgagctagaactccctacatttcagagctcctctctgagtcttggtgtggatgtggagaaggacagcctgagaaaataagataagggactctagttcttcttttacatt

SEQ ID NO: 6778521 - DNA, 117 bp, Homo sapiens
catttgtattagtcagggttctctagagaaacagaaccaacagggtgtgtgtgtgtgtgtgtgtgtgtgtgtgtcctgttggtctgtttctctcgaggaccctgactaatacacttg

SEQ ID NO: 6778522 - DNA, 89 bp, Homo sapiens
gagatgcaagatactttggctcacctggagcctgttgagtcagccaagtgttttaacaaggtttctggtgaagacaagctatcagtctc

SEQ ID NO: 6778523 - DNA, 95 bp, Homo sapiens
atgaaaaagtaagttataggccagtaaaatgtttcagtatcttgtatacctagaaggactgctgtgacaattgtgcctgtatagatctcatttat

SEQ ID NO: 6778524 - DNA, 56 bp, Homo sapiens
tggcccaggcgaggtgggcagacatgactctcgcgtcagcatcttccctggtgcca

SEQ ID NO: 6778525 - DNA, 129 bp, Homo sapiens
tggctttcttcttgtggaaaataagaggggtagatcttgcttctgggttggtgtacagtggaacccctgtacagaagctagagcaaatgaaggtatcttgatgttacatctttcacaggaagaatacaa

SEQ ID NO: 6778526 - DNA, 84 bp, Homo sapiens
gagatctcagggcagatggaacttccccgagagaaggacctctttctcaggcctctgggaagtcctctgtcatgctcatgtctc

SEQ ID NO: 6778527 - DNA, 65 bp, Homo sapiens
tcaaagattgaaactaaggagaaacaacaattccacgcaacttgagatcctggtttcaatcctga

SEQ ID NO: 6778528 - DNA, 71 bp, Homo sapiens
cttagattggagaggcatggtgggaatgcgactcatgagttagaatttacagccttgccatctatatcaag

SEQ ID NO: 6778529 - DNA, 82 bp, Homo sapiens
ttagagcctaacatttggggatgagcggatccagactcatcagtgtgtctgatgtcccacatcctacagagactggctctgg

SEQ ID NO: 6778530 - DNA, 130 bp, Homo sapiens
tattctggattcaagaatcataactcacaatttcataagattaatttggcctaggtatctctctgtctatcataacaccaggagatgttgttcaaagattttagaaggacgaaatgatttcttgagagtg

SEQ ID NO: 6778531 - DNA, 81 bp, Homo sapiens
tcttgaatgatgggctgatgagattaaattaaatagaaaaattgaagtcttcattgcagtgtcattcgccccagtttaaga

SEQ ID NO: 6778532 - DNA, 83 bp, Homo sapiens
tgggggtatcataggtccctggaaggccaagcttggctgtcccacagcctctgggcaggaccagtggacccagtgtgcctcca

SEQ ID NO: 6778533 - DNA, 72 bp, Homo sapiens
cccgggggcccctcggacacgtgcgggccagatgccggccaccgggccccgccgtgtcgacaggccctgggg

SEQ ID NO: 6778534 - DNA, 62 bp, Homo sapiens
gcctggcacagtagggacccaataaaatatgtgaaaacacaagtgtccctgatgggccaggc

SEQ ID NO: 6778535 - DNA, 61 bp, Homo sapiens
gatgctgctcgggtgcctgggagctcctggctgggaggtctctgcatgtcctgagcacatc

SEQ ID NO: 6778536 - DNA, 61 bp, Homo sapiens
atttttagcatcgaagtaaatttaggttatatacatagtctaggctataggtgttggagat

SEQ ID NO: 6778537 - DNA, 63 bp, Homo sapiens
tgcacacagatggtacatgcatatccagatgcacacgcgcactgacgtgtccacctgtgtgca

SEQ ID NO: 6778538 - DNA, 69 bp, Homo sapiens
cttccttttcccatgggtgccgaccatggtgccagctccaggtaccccatggggacaccatgaaggagg

SEQ ID NO: 6778539 - DNA, 57 bp, Homo sapiens
tccagagctacttgctcaacttattaataatttgtagagtgttatagtagttttggg

SEQ ID NO: 6778540 - DNA, 59 bp, Homo sapiens
caatgctaggcagatcctgcgtgttacccatattgtcatgcagcctctgcccagcagtg

SEQ ID NO: 6778541 - DNA, 71 bp, Homo sapiens
catgtgtgaagaggccgtgtgcaggtgaggtctattaaagaacatcgatgaagtccacgtggcttcacatg

SEQ ID NO: 6778542 - DNA, 79 bp, Homo sapiens
gggtgggcaccagcctctggggaggggaggtgccaggccagcggtagctccagcccgggggcaggtgaccccagcaccc

SEQ ID NO: 6778543 - DNA, 77 bp, Homo sapiens
gttaaatgttcattcttgcgtatgccatggtttattagaaatgactgtcaggaaatgtagagaatcctatatttaac

SEQ ID NO: 6778544 - DNA, 126 bp, Homo sapiens
gcagacaatagcaaatgacatcccaagaactaccagtcactctgtgagagctacggttacttgagttgtgatggttgagtctggagagattggcagtgctcttgagttttatgctaagttgcctgt

SEQ ID NO: 6778545 - DNA, 72 bp, Homo sapiens
attctaacttggtgtagctgtgcaaatgtttttaccaaaaagggcatttaaacaagcatacaatttaagaat

SEQ ID NO: 6778546 - DNA, 77 bp, Homo sapiens
gaggaagaagggaagccggccatgtggtcttgtgctgctgagtcagcactttctgctgcctggtgccctgtctcctc

SEQ ID NO: 6778547 - DNA, 130 bp, Homo sapiens
cttgctgctcgtaatggatcaacaagtgtagtctaccagcttcttcagcacaatattgatgtcttttgccaagatatatctggatggactgcagaagactacgctgttgcttctaagtttcaagcgtaag

SEQ ID NO: 6778548 - DNA, 100 bp, Homo sapiens
ttctacacaccataccacagaacgtttggccctttgtctgtgggcaataatagagaatctgggaagatgttaagttgggtgagtgtttaagtgtgtggag

SEQ ID NO: 6778549 - DNA, 95 bp, Homo sapiens
agccctcaactctcagggtcagaacgctgtgacactgaactccaaagcaattgcgtttctcatcagtttctgatatctagaagtaaggtagggct

SEQ ID NO: 6778550 - DNA, 78 bp, Homo sapiens
aggcagagcctggctctggttccctcagctcactgaggtatgagtttacaggggacagaggccatgttagctttgtct

SEQ ID NO: 6778551 - DNA, 56 bp, Homo sapiens
gggagctggagttgtgttgccttaagtgaaggaagaccaagtatggcgcagccccc

SEQ ID NO: 6778552 - DNA, 130 bp, Homo sapiens
aggggtgaggcaagtgaggtgcttagcctataaaatttaaggtagcactcactctcagctgtggaccctgcacttgtaggaccctgagagtgagtgccaccttaaactgtgtcccagatgctttgctcct

SEQ ID NO: 6778553 - DNA, 80 bp, Homo sapiens
taggcaataagtttttggctaaggaaaaggagctagggattattctctcctcttttatagttagagttatttgtatactg

SEQ ID NO: 6778554 - DNA, 78 bp, Homo sapiens
acatttacagttaccaagagggcttatggatcatagagatttccagataggcttccgagtcttggtatcttagaatgt

SEQ ID NO: 6778555 - DNA, 58 bp, Homo sapiens
aaggcactacgctgctggggcggttgtcctatttctgtctatgccagtgtggtttctt

SEQ ID NO: 6778556 - DNA, 82 bp, Homo sapiens
ggctgtgtctttaaagcagcggtgtctttactgcagtgtgagttttcacggcggtggacggactccttgctggacgtcagcc

SEQ ID NO: 6778557 - DNA, 80 bp, Homo sapiens
aagactctgccagcctctcccctcccaaggcgggagtcgagtttgctccctccgcaagggggagagcctggcggagtgtt

SEQ ID NO: 6778558 - DNA, 61 bp, Homo sapiens
agggtatggtttactaatttgttgggtaaaagaaaatctccaacaaatagttacatatcct

SEQ ID NO: 6778559 - DNA, 83 bp, Homo sapiens
ggaacaggcccaggaagaggcagccgtatttcaaaggctctcctgcatggtctgggatcgatggggctgcctgcctgggctcc

SEQ ID NO: 6778560 - DNA, 60 bp, Homo sapiens
tgtgacttcatttcatagttgttaaggccctggtatacaataacagtaagtgatgttaca

SEQ ID NO: 6778561 - DNA, 80 bp, Homo sapiens
ggcctactgcagcagggagaaggaagtggaatatttctggttgatgtggcacttctctccttgtaagtaaatggcaggcc

SEQ ID NO: 6778562 - DNA, 121 bp, Homo sapiens
ggagttgagtggaggacaggggagcttgaggcatggcctgatcccaggcttatattccatagtacagcatttatccccaggtcgggcctctggcatcctctgctctctgaaaatctgctcc

SEQ ID NO: 6778563 - DNA, 75 bp, Homo sapiens
ggagtgcaggataaaaaaatctgaagaattctgcctagagttcttacatcagtttattttgtaaacttgcacacc

SEQ ID NO: 6778564 - DNA, 65 bp, Homo sapiens
ggcctggccatagggcccaggaaaatgcaggtatcattaacagcctggagcactgtggcctgtcc

SEQ ID NO: 6778565 - DNA, 80 bp, Homo sapiens
gtgagaggtcttgtgaaggactgtgccctcagcctgtgaagtctgcctaactctggctagtccatcgcaagtcactgcac

SEQ ID NO: 6778566 - DNA, 62 bp, Homo sapiens
tcaagaagtaatattaggaactcccgagtttgtgttagtttcattctaatgttacattttgg

SEQ ID NO: 6778567 - DNA, 64 bp, Homo sapiens
ggggtgatgggggcctgaacaggcaaaaggcccactatgcactccacacggcctccataacccc

SEQ ID NO: 6778568 - DNA, 58 bp, Homo sapiens
gggcagggcagggcaagaactgggtgtggcttcctttggcccaggctctgccctgtcc

SEQ ID NO: 6778569 - DNA, 90 bp, Homo sapiens
tgatggtgaagcatgggctctgaagtcagtctgcttgtatcccagtcttacctctagctgagtgatctagggcctagttatgtaacctca

SEQ ID NO: 6778570 - DNA, 72 bp, Homo sapiens
gcacttggaggacattttagcagaaggagcatttgaacttggtcctaaaagtagagatgtttgctaagtagc

SEQ ID NO: 6778571 - DNA, 61 bp, Homo sapiens
tttgtacagaaactgcatttggaggttggaggaacctccaactgctggagtctttgtcgag

SEQ ID NO: 6778572 - DNA, 62 bp, Homo sapiens
gctctgagggctgtggaaggctaaccccactgggggacatccagctcacagctcatctgggc

SEQ ID NO: 6778573 - DNA, 59 bp, Homo sapiens
caggttgggatcggttgcaatgctgtgtttctgtatggtattgcacttgtcccggcctg

SEQ ID NO: 6778574 - DNA, 104 bp, Homo sapiens
tttttagaatgtcctcctgctgcttttactatcactctctatttgttcttgacaaggttcatagaacaggagtgaaaggaaggaggcaggagggagtatagaga

SEQ ID NO: 6778575 - DNA, 69 bp, Homo sapiens
ctacatctcttctgagcaattcctgtttttggaatttgaaaatggattgattcttagaaaaggtgtcag

SEQ ID NO: 6778576 - DNA, 76 bp, Homo sapiens
attgattcaactttcttgaatgcaattttttaaaacatttaagttgcgtaatattgatcgagtcatttgattcagt

SEQ ID NO: 6778577 - DNA, 81 bp, Homo sapiens
atgtgagtattccttctgcctccttcatgctgaattccttggaaatagaagaggaaaggggcatgtagggatcactcagat

SEQ ID NO: 6778578 - DNA, 89 bp, Homo sapiens
ccagcgtgacattactggaagcgccgaggagcttcgcgcaggctcagaatcgctcagctggttgacgttatccaggagaatcgcgttgg

SEQ ID NO: 6778579 - DNA, 70 bp, Homo sapiens
cacagatatttgtgtattcactgtcaactgcagtgccctgaacacagtgaatgcccaagaaaagtctgtg

SEQ ID NO: 6778580 - DNA, 57 bp, Homo sapiens
gttgtttcagaacaaacacagcatattgtaaattttctgtgttccctccgagacagc

SEQ ID NO: 6778581 - DNA, 90 bp, Homo sapiens
taaagcaggctgagtggtaatactagaaagctgagcatctcactcagtgtttattcaatgttattcattcagaaaacataacctgcttta

SEQ ID NO: 6778582 - DNA, 64 bp, Homo sapiens
ggcagtaaggaagaaaaatgaatctaggataatttctagattcaatatttttctgcctagggcc

SEQ ID NO: 6778583 - DNA, 69 bp, Homo sapiens
cagatggcagaggtcagtgtcttgtgtattcaatgtagtcaataataaagtcaggacttatgctacctg

SEQ ID NO: 6778584 - DNA, 83 bp, Homo sapiens
atggtaagggtatgtgtttttaagtaaacatttgttcatgtgtatatgtgttagattaccttgtaaaacatattccttattgt

SEQ ID NO: 6778585 - DNA, 128 bp, Homo sapiens
aacaaagtgtatttacattgaatgcatctcacttgtcccatggacacaacttcttctaaaaacttggaaaggatttattgcctgtggaacatgaggtgttatgtttaattttgcacatacattttgtt

SEQ ID NO: 6778586 - DNA, 58 bp, Homo sapiens
ttgacatgtagtatagttgcatctcgctaggttatagcattgctatgtctgcattcag

SEQ ID NO: 6778587 - DNA, 91 bp, Homo sapiens
aatgttaagtgagcatagtaatatctatcttttagatttggggaggataaaactactgaaagataaatcagttagcatgcatactaacatt

SEQ ID NO: 6778588 - DNA, 101 bp, Homo sapiens
cccgaggcctcacagctgggaaaggagaggagggatttggttttggatcacaagtccaggcctccctctcctgcacagtccttgggctggaggagtcaggg

SEQ ID NO: 6778589 - DNA, 58 bp, Homo sapiens
gcccaggctggagtgcagtggtgtgatctcagctcactgcaacctccacctcccgggt

SEQ ID NO: 6778590 - DNA, 70 bp, Homo sapiens
cgcctcagggccctggacaaccctccctcctagggggtggagtggggggagctgagggggccctgaggtg

SEQ ID NO: 6778591 - DNA, 55 bp, Homo sapiens
gcccttcatgagtccacaggacctcacggttcacaaatatgcacttacgaagggt

SEQ ID NO: 6778592 - DNA, 65 bp, Homo sapiens
agagggtaacaagaggcctggatgcatgaaataagactatttgggccatcatcttgtgactttct

SEQ ID NO: 6778593 - DNA, 73 bp, Homo sapiens
taacctacaagggtaactcgttttgatgtctttcgaaagaaaggtgtctggccatttgcccattgtgatgttg

SEQ ID NO: 6778594 - DNA, 101 bp, Homo sapiens
ggattagagaatgatgccctcatcaacagtgtcagatgatgcacatgaaagacccgtgcaggccctccccagttgtggatgaggccactcgttctgggtcc

SEQ ID NO: 6778595 - DNA, 63 bp, Homo sapiens
taaggaggctgctgtgaagaaaggacatgcaattcctcctgccatcacactgtggcttcttta

SEQ ID NO: 6778596 - DNA, 60 bp, Homo sapiens
agttcaacctttggacctggggcttaccatcactccagaatccacaacagaagttgaact

SEQ ID NO: 6778597 - DNA, 75 bp, Homo sapiens
gcgggggctcctctcccagagctgcagggtcaggatttggctgattttcagcagcagagggagggccctatttgc

SEQ ID NO: 6778598 - DNA, 130 bp, Homo sapiens
actttccagcctccagaactgtgagaaatacatgtccgttgtttaagccacccaatctgtgatatttaatcttgttatagaagcctgagccaactaagacaggtgtttacagtgttttctgctttaaagt

SEQ ID NO: 6778599 - DNA, 60 bp, Homo sapiens
atgacatccagtgacagtgtgggagcaggctactctccagggacatgtttctggaggcat

SEQ ID NO: 6778600 - DNA, 57 bp, Homo sapiens
gatcaggatgacaactgctgggttctactttccctgttcacccaccatcacctggtt

SEQ ID NO: 6778601 - DNA, 65 bp, Homo sapiens
gagcatgggtaccccttctgtgcagaaggagacaccacagtgtcttgcagcagaagcccatgctc

SEQ ID NO: 6778602 - DNA, 128 bp, Homo sapiens
gacttgtcatcccaagataattcatgatggattttcaaaggttttatgctaagagaatcttcccaagaaatgtatatggataaaacgttctgaaaaacaatgtggaataatgtctgggcttgagaatc

SEQ ID NO: 6778603 - DNA, 88 bp, Homo sapiens
ggagaatcactggaacccaaaaggtggaggttgcagtgagctgagatagcaccactgcactccagcctgggtgacagaacgacactcc

SEQ ID NO: 6778604 - DNA, 55 bp, Homo sapiens
ttgggcaccagtgcactgacagtctctgaagaattattaggtcagctggttccaa

SEQ ID NO: 6778605 - DNA, 55 bp, Homo sapiens
ggctgcctccactgcttgtcccagagaatacagaggcgttggcagtttggcggcc

SEQ ID NO: 6778606 - DNA, 100 bp, Homo sapiens
gcccggggaagaaagaggaatggagactaaacgcttaggacgatatttctgtgaaaagctctgtggtagctttagctccatttccttaaattacctgtgc

SEQ ID NO: 6778607 - DNA, 69 bp, Homo sapiens
ggtgcaggaacgccagtagactgaacctttcacgacgtgaatatcagaatccagctgttgctccacact

SEQ ID NO: 6778608 - DNA, 59 bp, Homo sapiens
cagagaccctaggcaggtgacagagcccagcctggcatgcatcggccttgagggctctg

SEQ ID NO: 6778609 - DNA, 67 bp, Homo sapiens
agaatctatggagggtaggccagggtatgggcatatttccaaaactctgcagttagtttctagttct

SEQ ID NO: 6778610 - DNA, 69 bp, Homo sapiens
tacttattggttcagaagtttagattttataggtgagctgggtgctagactagtggtgccatttaagta

SEQ ID NO: 6778611 - DNA, 84 bp, Homo sapiens
ggattaagtgcattttatagtgaggtacagatttgatagtaaatttacatagactttgcacttcaatataacttggtttagtcc

SEQ ID NO: 6778612 - DNA, 57 bp, Homo sapiens
tgtgtgtgtgtgtgtgtgtttgggctggagagctgtaaaggccataatcacggagca

SEQ ID NO: 6778613 - DNA, 75 bp, Homo sapiens
ttcactccccagctgagactgtcttctgtgatcctgttcgagggttaagtctggaacctcatgctggcgattgaa

SEQ ID NO: 6778614 - DNA, 56 bp, Homo sapiens
tgagatgagatttcactgtcctccaggctggaatgcagtggggcaatcatagctca

SEQ ID NO: 6778615 - DNA, 80 bp, Homo sapiens
ggacagtgactcatgatgagattagccgcaatcctgacttgatccagagtcaccactgtgatagtcgattgtcactttcc

SEQ ID NO: 6778616 - DNA, 65 bp, Homo sapiens
ttgcatgggcaacaggaggtggaagcaatcaaagccaagcccaagccccttctgatgcccatcaa

SEQ ID NO: 6778617 - DNA, 55 bp, Homo sapiens
gccacttgtgtcagtgacgtctgctgtgcaagcatgatgtcttggtcacagtggc

SEQ ID NO: 6778618 - DNA, 75 bp, Homo sapiens
gtgataagtctgggccagggcacagcctaatgtggcaaaaaagtcctgggagctgtattgtggttcagacttcac

SEQ ID NO: 6778619 - DNA, 57 bp, Homo sapiens
gctggtaagcgacaaagtcaggtttgactcacacagcctggctccagaacttccggt

SEQ ID NO: 6778620 - DNA, 56 bp, Homo sapiens
tcacccctggcccagtcttggagagaggataaccactgctggtaaactgggggtgg

SEQ ID NO: 6778621 - DNA, 61 bp, Homo sapiens
tcctcttctgcccatcagaggcgcggtggtctcccatcgatcgttgtgggccggagcaggg

SEQ ID NO: 6778622 - DNA, 129 bp, Homo sapiens
ttacacattagacatatttctcagaaaccttaacataacttttccttgaccctcaaaacagataaatggttaagggggatgatggaaaagtctgttatcaaagtttttacattatatggatgtccgtga

SEQ ID NO: 6778623 - DNA, 58 bp, Homo sapiens
accactttacagaaatggaaaggtcaccaacaaccttcatgttgttaagtatagtggt

SEQ ID NO: 6778624 - DNA, 55 bp, Homo sapiens
gcattcttcacagtattcctccttgatctatccgaaggagaggctggagggatgc

SEQ ID NO: 6778625 - DNA, 67 bp, Homo sapiens
gtctcccaggcagccccagaagcttgctccaggccaaaacttggcaagtgcggtgctgcctggggat

SEQ ID NO: 6778626 - DNA, 55 bp, Homo sapiens
aggcttaaatgctgtaaccgaaacattagatggtaggaatgcagcatttcagctt

SEQ ID NO: 6778627 - DNA, 65 bp, Homo sapiens
tcaaagtgctctagaaattgtcagtggtttacatgaagtggccatgggtgtctggagcaccctga

SEQ ID NO: 6778628 - DNA, 94 bp, Homo sapiens
gtgtcatgctctgtcctgtcttcaggacccggaattttggggtctgagtgacaccagcattcactggacctgcagagaaggacaaagctgatgc

SEQ ID NO: 6778629 - DNA, 56 bp, Homo sapiens
gcttttggacctctgatgtttctcctgaaaatcactgttatgaaggatccaggggc

SEQ ID NO: 6778630 - DNA, 72 bp, Homo sapiens
cccaatgcatcgatctatttactcttttcctagatccttaggctgtggaaggtttagataggtaaaataggg

SEQ ID NO: 6778631 - DNA, 91 bp, Homo sapiens
cttatagtgaagattaattaagaaaatgaatgtatagtgcgccaggcatggcaaattgtagcaatttctcttaattgcctttttatatagg

SEQ ID NO: 6778632 - DNA, 66 bp, Homo sapiens
gcttcagtttcttccctgtgaaatggggcaaaaaataaccccatagtgtggttggaaaactgaagt

SEQ ID NO: 6778633 - DNA, 68 bp, Homo sapiens
tttacagagcctggccagccctgacctgcccctcccatcctggggctgcagggtccaggccctgtgga

SEQ ID NO: 6778634 - DNA, 85 bp, Homo sapiens
cagatgcaaaaatagacacagatgatcaggtgtggacgtcagtaaaaaatgttgtgccacttctttcatttctcctttgtttctg

SEQ ID NO: 6778635 - DNA, 66 bp, Homo sapiens
cctttcctcgaggtatagggagggtatctctcaaatgaggagtctacgacctgcttcaggggaagg

SEQ ID NO: 6778636 - DNA, 56 bp, Homo sapiens
cccagagttcaaaccctgcgtcaagggagcactgtagatggagtctgaggtctggg

SEQ ID NO: 6778637 - DNA, 101 bp, Homo sapiens
accgagtttaattaaatatcatgagtaataaaagagaggtccaggggtgattgctgagaacacttatggattattctgaatttgaaaatttgactctcggt

SEQ ID NO: 6778638 - DNA, 56 bp, Homo sapiens
agcaagtcatccaggatgatgtcggatatggtgctgatcttcttggccagcttgct

SEQ ID NO: 6778639 - DNA, 76 bp, Homo sapiens
agaaatttattagtgcctactatgtgccggacatcattctgtgtggagatatactgtaggccactataagaaatct

SEQ ID NO: 6778640 - DNA, 90 bp, Homo sapiens
ttcagcaatcatgttatttgtcccctttttttggtatcaaaagggccttttctttatgaaatgatggggaaaatagatggtagttttgga

SEQ ID NO: 6778641 - DNA, 85 bp, Homo sapiens
ggtgtgagaaatgaggttgtagatgttctcttgaaaaatatacctttctgtttcttaagaaaccatcacattcctttttcacttc

SEQ ID NO: 6778642 - DNA, 91 bp, Homo sapiens
gagccattccatacatggttgtattttgttatgctactgcacagagtttctgttgtatgtagtttcacaaaatatagcttttgttaatctc

SEQ ID NO: 6778643 - DNA, 80 bp, Homo sapiens
gggctgcaggatgcgcaagccacacagcctggggggagtcagagacgactcagggctgcactggctggtctcctgggtcc

SEQ ID NO: 6778644 - DNA, 67 bp, Homo sapiens
ttttcacaggatgctgttttataataaggtattttaacttattttataaatcagctctgagtgaaga

SEQ ID NO: 6778645 - DNA, 104 bp, Homo sapiens
aatctgtttaattcttccaaattctgctttaatgtaagatataccaatatattactttatcatggtaaatcttcaatgaggcattatatgggtggatatagatt

SEQ ID NO: 6778646 - DNA, 91 bp, Homo sapiens
gggctgcctctgtggcttgggggtgaggcctggccctggggtttgtcaaagctgcaggaaccagaaccttcccccggaatcaggagcaccc

SEQ ID NO: 6778647 - DNA, 58 bp, Homo sapiens
cccagcagcaggcagagcagacaagagcaacttctcctggagccaatgtgctgctggg

SEQ ID NO: 6778648 - DNA, 83 bp, Homo sapiens
ctggacggttggtctcttcttggagatgttgtaaagacaaatttatttcccccatcttcaaagaagccttggattaattgcag

SEQ ID NO: 6778649 - DNA, 60 bp, Homo sapiens
ttacagtgaagtaccattaaaattaactccacagttctttagtggtatacttttctgtgg

SEQ ID NO: 6778650 - DNA, 63 bp, Homo sapiens
gacataggagctctgtgcctcactgactatgagcttgtcagagaactgcagcccttccttgtc

SEQ ID NO: 6778651 - DNA, 63 bp, Homo sapiens
gattggaagcattctgaatgtccatcaaaggggactgagttggaaacattctgaatgtccatc

SEQ ID NO: 6778652 - DNA, 80 bp, Homo sapiens
ggcaactagagcagtgattggtaacctggtgtatggaatctacctccacctgcctgggaaccaatcctggctttagtgct

SEQ ID NO: 6778653 - DNA, 63 bp, Homo sapiens
cactagctttaggagctgtaacactcacaatgaaggtctgcagcttcactcctgaagccagtg

SEQ ID NO: 6778654 - DNA, 83 bp, Homo sapiens
tctgcaactttgtgcttttaattctggtgagtactcctttaaagctaaagtgctcatgatgccttttaaaagaagactgtaga

SEQ ID NO: 6778655 - DNA, 70 bp, Homo sapiens
agttgttttccaaggcagacacattttttgtcttttctaaaatatcgtaagatatgtgtctgttacaact

SEQ ID NO: 6778656 - DNA, 63 bp, Homo sapiens
agtggatcctgcctagttatttgccaacaaaatactcggcaaatacctttcctgccattcact

SEQ ID NO: 6778657 - DNA, 56 bp, Homo sapiens
cccaggaggtggagcttgcagtgaaccgagatcgcgccactgcactccagcctggg

SEQ ID NO: 6778658 - DNA, 74 bp, Homo sapiens
gccatgcaggccaagcaggaatctggcctcaggagagagccactagaggccatgctagaggcctgggacatggt

SEQ ID NO: 6778659 - DNA, 60 bp, Homo sapiens
agagcctctctgatgtgacagctacaggaagtccggtgctgtgctggcggcagaggccct

SEQ ID NO: 6778660 - DNA, 63 bp, Homo sapiens
tgctttctcaattatgcttatattctagtttcaaactagagtaagaagtacagttgcattgca

SEQ ID NO: 6778661 - DNA, 55 bp, Homo sapiens
tgtcaacagatctcaaagctggctgtctcctatagctaggaagatgtgtatgaca

SEQ ID NO: 6778662 - DNA, 103 bp, Homo sapiens
gcacgaatgcggtgtttacctccctggggaagggcaagcaagctgctggcgtggttcagcatgcaccttcccctgggagcccggagagcacattagcagaggc

SEQ ID NO: 6778663 - DNA, 75 bp, Homo sapiens
gtttactttcctcattgtggatttttcattacagtatagagttttgcagaagtgagtcatgaggaataggtaaat

SEQ ID NO: 6778664 - DNA, 58 bp, Homo sapiens
cattcaaagcaagacacaattcctaggtagttaaatttaggagactctgtattgaatg

SEQ ID NO: 6778665 - DNA, 60 bp, Homo sapiens
gcacctggggtacacagctacaaacacacccagctacatgcagttgtcacacccctgtgc

SEQ ID NO: 6778666 - DNA, 64 bp, Homo sapiens
ggtatttggaggcagtgaacaattcctgtgtgttggtttgctaggaccactgtaacaaagtacc

SEQ ID NO: 6778667 - DNA, 55 bp, Homo sapiens
tactttgtctttccatgcttttgtgcagccatgggaccaggacaagacaaaagtg

SEQ ID NO: 6778668 - DNA, 67 bp, Homo sapiens
ctttgcctagatgtctacctgctcctccctcttgcctgagatgatgcaggttgtatctgaagccaag

SEQ ID NO: 6778669 - DNA, 63 bp, Homo sapiens
gtgggagccctcagggaggtgcaagctggagaggatcgggtcacctgcctgcaggggctccac

SEQ ID NO: 6778670 - DNA, 56 bp, Homo sapiens
ctgtgtgcacgactaggcttggtccctgactgaaggccttgccacatgtgccacag

SEQ ID NO: 6778671 - DNA, 55 bp, Homo sapiens
cataggagccacacaagttgaacagctttgaagctggttaatgtggcttactatg

SEQ ID NO: 6778672 - DNA, 122 bp, Homo sapiens
gcaggaaataatcagaagggggaagttgcaggtttcagcgattctttcagggaaccaggaattcctggaatcccgcaatggaggattcaagccaaggacgtgggactttgccacccacctgc

SEQ ID NO: 6778673 - DNA, 63 bp, Homo sapiens
ttaacctgttatgcccccagagccctcagtggagcgcccgtactttgccggcatgacgtttga

SEQ ID NO: 6778674 - DNA, 71 bp, Homo sapiens
agagggcccactgggcaggccaggactggtaaaaccttgaatttcccctctggttgacccaggagctgttt

SEQ ID NO: 6778675 - DNA, 72 bp, Homo sapiens
ggatgcctgaatatcatttacatttggagtctaagcaagtgaatgattcccaatgacacttgattttcatcc

SEQ ID NO: 6778676 - DNA, 70 bp, Homo sapiens
ctccctaaattaatgccaattctcagcattttcttatacctgctagagtgatcctaattgatttgggtag

SEQ ID NO: 6778677 - DNA, 62 bp, Homo sapiens
tttacgaatggggtgacaacttatgataaaaactagagctagtgaattagcctatttgtaaa

SEQ ID NO: 6778678 - DNA, 77 bp, Homo sapiens
tcatttttctccattgtctatgaaatatttgaagtggaaatggcttatttcaacaccagagaccatgcgggaaatga

SEQ ID NO: 6778679 - DNA, 76 bp, Homo sapiens
ccgtaatttagtccaatgtgaatattttattacccttgctttaaaaatagacacattggaatgaatgaaaagttgg

SEQ ID NO: 6778680 - DNA, 59 bp, Homo sapiens
gccagaggcagggggagaaagatgatgtctcatgatgccagcgcttcctcttcactggc

SEQ ID NO: 6778681 - DNA, 68 bp, Homo sapiens
gtgactctgggaggtgtcggacgagccccctgaggtctgtctgtgggcaacgcctcccaaagtgtcat

SEQ ID NO: 6778682 - DNA, 91 bp, Homo sapiens
ggattctgcctctttgttgtctgtgtgtactaaggatatatttaataatttgctcttatgtatgtatacgatgtaaaaagaggttaattcc

SEQ ID NO: 6778683 - DNA, 101 bp, Homo sapiens
ttgagatgggagaattgcttgaacccaggaagtggaggttgcagtgagccgagattatacccctgcactccagcctgggtgacagcgagattctgtctcaa

SEQ ID NO: 6778684 - DNA, 113 bp, Homo sapiens
aaaatctttgcaaccacctaaccccaattttcacatttgtgcaacgtatccacagagtttaagtaattttctaggaggcacacaagtagttgggattagatcccaagggtttt

SEQ ID NO: 6778685 - DNA, 62 bp, Homo sapiens
ggctggagtgctgaggtgcagtggtgcaatcatagctcacggcagcctcaaactcctgagcc

SEQ ID NO: 6778686 - DNA, 62 bp, Homo sapiens
taagccctattatgcaaatattcctacctgagtagaaacctcaggaggcatgaggggattta

SEQ ID NO: 6778687 - DNA, 98 bp, Homo sapiens
ttttattttgattctatgcataggtaggccctcgacgggactggttagtgtataatccagctttgtctggtcttcgaatgctatagttttacatgaaa

SEQ ID NO: 6778688 - DNA, 59 bp, Homo sapiens
gaatggttaagcctatatcttgaagcgcttctttcagatttagactgccttaatcattc

SEQ ID NO: 6778689 - DNA, 56 bp, Homo sapiens
gtgcttcctaggtaagtaggtagcgttgtcctcagtgaaccacaccaggggagcac

SEQ ID NO: 6778690 - DNA, 127 bp, Homo sapiens
cttctggagaaaacaaggtggcattcttgaataatttctatcattcctgtttcactcaatgtaaaggaaactctaggacgatgggatagttgacctttattgtgctttcttctatgctctcacgaag

SEQ ID NO: 6778691 - DNA, 94 bp, Homo sapiens
tccaaaaccttttatgccagtgcttgggaaactggggaaaccaggcactctgggtgtggtttcaggttcttatgcacggtctggggggtgggga

SEQ ID NO: 6778692 - DNA, 74 bp, Homo sapiens
ggattatgcagactttccaggtcctgggctatgatgaaattatagctggaggcttgtaaagtcgtgcactgttt

SEQ ID NO: 6778693 - DNA, 91 bp, Homo sapiens
gggagtcctggtgcaagtaattggcgaggagtttagacaattgtgcaacctggatgtctttgccatgcatgtgtcagggttgaacacttcc

SEQ ID NO: 6778694 - DNA, 57 bp, Homo sapiens
gcatccttgtccgtggccgttggtgcatttgcttatatggacaggggcataggttgc

SEQ ID NO: 6778695 - DNA, 65 bp, Homo sapiens
agcaaaggcactagctaggtcatggaggactgtgaacacgtccaggaggctgaagtgtttttgct

SEQ ID NO: 6778696 - DNA, 76 bp, Homo sapiens
gatttctgctctaatgtacaccagcaggctggaagaacaagcctcagcaagctgtggaaattagagagactggatc

SEQ ID NO: 6778697 - DNA, 57 bp, Homo sapiens
catcactttgaatggtaggcatcaatatgattgaaacggctgccacttaatgtggtg

SEQ ID NO: 6778698 - DNA, 82 bp, Homo sapiens
ccccaaccagcgccaggccacgccccggcgtgtgacgcaagcacgctccgtgcgcgccgtcgcgtcgcggcgctcactgggg

SEQ ID NO: 6778699 - DNA, 58 bp, Homo sapiens
gagagattcatgtttactgtaggcaggcgtgcctgtctttacatactgatgagttctc

SEQ ID NO: 6778700 - DNA, 75 bp, Homo sapiens
gagattgaaggtgtggaaaagccccacaggactcgctaggcaaggcggctgtcccttgtcccaccttgcagtttc

SEQ ID NO: 6778701 - DNA, 97 bp, Homo sapiens
gtcaggccttcagttctaaagtagaatgtctgtttcaaaatgctaactagaacagcctggtggaaaaacattctgtgggattccagaaaggtctgat

SEQ ID NO: 6778702 - DNA, 60 bp, Homo sapiens
ttgccaggctgaacagggtcttactacaaggtggtagtaagacattccatgccatggcaa

SEQ ID NO: 6778703 - DNA, 68 bp, Homo sapiens
gctaatcagtttgatctgacagattttaattacattaattagggcttttctgaataggcctgattagc

SEQ ID NO: 6778704 - DNA, 77 bp, Homo sapiens
ggctgccctagaagtacagagagcagttgttgcatagttaagcgaaaaggcagcattttatgtctgatagagcagtc

SEQ ID NO: 6778705 - DNA, 58 bp, Homo sapiens
agtggtgtcttttttgattaggagaaacatttcttctagttatagaaaaagcattatt

SEQ ID NO: 6778706 - DNA, 60 bp, Homo sapiens
tcttatttggtgagctttaatgaaacacttgcactggaattcagagtacaccagatagga

SEQ ID NO: 6778707 - DNA, 69 bp, Homo sapiens
ttattgatgacgagggaaatcatttgtaagctctggaagaaacaactagggagttctctgcatcagtga

SEQ ID NO: 6778708 - DNA, 76 bp, Homo sapiens
gagagacagctggacagacactgatgacttactaaacctccctcttggtcccaggtcccggggccagctgctgctt

SEQ ID NO: 6778709 - DNA, 84 bp, Homo sapiens
gttaaaaagggattaataacagggttgatttgcaatagagtccaaactcacattgctttgactctttgttcttattctgataac

SEQ ID NO: 6778710 - DNA, 98 bp, Homo sapiens
gggcggctcagtgatgacgttcctgtgtgactcaagtggtttctaaaaggcaagaagccatccccgtgaggcatacggtgaccagtgctgaatcttcc

SEQ ID NO: 6778711 - DNA, 60 bp, Homo sapiens
gaatgacccactatcaagagactggacttccagtttctactctgtgtgggtgttgcattc

SEQ ID NO: 6778712 - DNA, 78 bp, Homo sapiens
tacttcttacagactgtgagtatgcatagtgttgtcattactgaaattcatactcgacagtggggcttcaaagaagta

SEQ ID NO: 6778713 - DNA, 81 bp, Homo sapiens
gctggccagtgtgccagacagggcagtggtattggaataaacagtgacgaacacactgactgctgaagtcagattgacagc

SEQ ID NO: 6778714 - DNA, 66 bp, Homo sapiens
gtttgactacaaaggggtagcacaagagaaaaactaagtgcaatgaaactgttttgtggtcattac

SEQ ID NO: 6778715 - DNA, 64 bp, Homo sapiens
gattcagaggtagaactggccctcacttgtagtttgagaaagtgacttttcctgcctctgtttc

SEQ ID NO: 6778716 - DNA, 73 bp, Homo sapiens
gcagattctgagttcctttcaatctggaaggctgcatgcctatttgagaggtgaaggaattgagggaatctgc

SEQ ID NO: 6778717 - DNA, 70 bp, Homo sapiens
ctgaatgatctccgattagtcctttaacaattcagatcctaaatctaaaggctaaaagagaatcatttag

SEQ ID NO: 6778718 - DNA, 130 bp, Homo sapiens
gtcttgccttatgttttcaacataatgggaatgttttctacggagaaaaatgttttcaatatttccctccagggaaagcttacagttctccaacatgatctatgactcaacaggtaagtctaactaattc

SEQ ID NO: 6778719 - DNA, 64 bp, Homo sapiens
tatattgcttcccacaaagatgtattgactctggaaacagcatgggttagtggaaagcagtcta

SEQ ID NO: 6778720 - DNA, 57 bp, Homo sapiens
aggagaatggtacaatatatctctgaaatgggaagagatttagtggctgttctacct

SEQ ID NO: 6778721 - DNA, 59 bp, Homo sapiens
agcaaatgttgggtgaacggctgtttcctcttattcaagccatgcaccttactcttgct

SEQ ID NO: 6778722 - DNA, 64 bp, Homo sapiens
cctcactgcccagcaccaccatctggttgagcagcagccatgtatgtaggatgggccagtgagg

SEQ ID NO: 6778723 - DNA, 62 bp, Homo sapiens
cctttgaagaaggacacatttgtgatcggataaatggaatggctgtgttcattcatcagagg

SEQ ID NO: 6778724 - DNA, 77 bp, Homo sapiens
cccagcgtcccgtttcactccttgccagcccctggacatcacccactcggctcaagaccaagggagcggggaatggg

SEQ ID NO: 6778725 - DNA, 56 bp, Homo sapiens
aagggtgctgtgagtgaattccagggccaatttgttgactttacatcagcactctt

SEQ ID NO: 6778726 - DNA, 72 bp, Homo sapiens
ctctcccgtgacagtaactgagagatgtaatatcctccagccggtggaagaagttggtcctcagcgggaggg

SEQ ID NO: 6778727 - DNA, 100 bp, Homo sapiens
cataattaagaaaggggagtgaacaagttctactgggacatcagtgaggaacaggcccagttgactgatttcttagaactgcttcaattgctaaattatg

SEQ ID NO: 6778728 - DNA, 64 bp, Homo sapiens
gagtgttggagcccagggtggttgcagtcggaggggcctgcctgccttggcctccaggagactc

SEQ ID NO: 6778729 - DNA, 58 bp, Homo sapiens
attgtattctgcacctttgttacgtacccgcaagtatcaaactggtgagaatgtcagt

SEQ ID NO: 6778730 - DNA, 113 bp, Homo sapiens
tggaattttgagtcagaacaggtcttgtgaatataagttccatgtgtttactacctacagtgaaaaatacgtggttactctatagagttacaaaaccactgctttaaattcta

SEQ ID NO: 6778731 - DNA, 55 bp, Homo sapiens
gtggttcctcaagcgctggcggcagggcaaggttttgcccagcgaaggggatgac

SEQ ID NO: 6778732 - DNA, 76 bp, Homo sapiens
tggtatgcctgtcacctgccagcatacccatgatgtacttccctggtgctgggtactgagccaggtgacatgacca

SEQ ID NO: 6778733 - DNA, 69 bp, Homo sapiens
atcttcctttgccatgggatagtgtttttaaaaaaatccctggagcctgccccaattataaaagaagat

SEQ ID NO: 6778734 - DNA, 63 bp, Homo sapiens
ttcttccataattaagtggagagaaagggggactttactagtcaataacttaatgtgggagaa

SEQ ID NO: 6778735 - DNA, 69 bp, Homo sapiens
acaggattgcaaatcacaagagcagagccctgactccagctctgatgctactgtgctttgtgaccttgt

SEQ ID NO: 6778736 - DNA, 73 bp, Homo sapiens
ttcaaaggttattattactattgtccagagtgttaccacctgataaatattgacagtggaatgaccctttgag

SEQ ID NO: 6778737 - DNA, 76 bp, Homo sapiens
gtggccccatttttctggagcctggagtagttgtgggggagcagggagcaggaaggctgcagaagaatagggtcat

SEQ ID NO: 6778738 - DNA, 92 bp, Homo sapiens
acttggagttaatttaaggtgagcctccttcaagcagtaaaaataacagggtttttatattgagtgagagttcccatggaaccactctgagt

SEQ ID NO: 6778739 - DNA, 87 bp, Homo sapiens
gcaacagggaatgatttagtgttcaaggaatatcattcttcacataaattgatgtcacagattctttgaatagatgttcccagtggt

SEQ ID NO: 6778740 - DNA, 72 bp, Homo sapiens
gctattgccgaatgccaccacagagaatttccccgcagagtgaaggctgtgctctggcatcgctgcaatggt

SEQ ID NO: 6778741 - DNA, 68 bp, Homo sapiens
agcttcgactgaggatgccacagtgagacaccatctgggtctggagggtccactgtgaggcagaggct

SEQ ID NO: 6778742 - DNA, 86 bp, Homo sapiens
gccacctttattctactctgccccagccaataatgggtacccttgaggcttacaggctgcagggctagagggagatgagaggtggt

SEQ ID NO: 6778743 - DNA, 88 bp, Homo sapiens
ccctagatggcacttcagttttccctcctgcaggtagcatcagcactaggcactgtagtgggggagaaatggtctgagatgcacaggg

SEQ ID NO: 6778744 - DNA, 115 bp, Homo sapiens
gatgcaacccttggtgggcacaggatgcaggcctgtctgaggtccccacttgcagtaggtcaagggactagtatagagctcagcatctggtaagtgcacaatgaatggctgcatc

SEQ ID NO: 6778745 - DNA, 62 bp, Homo sapiens
gtcatggccaactgaaatgaaagatacatttctcatctttgcattgagtagtggcatgtgac

SEQ ID NO: 6778746 - DNA, 90 bp, Homo sapiens
ggttaaaaccataccaaacaaatccccattcttagtcattagttatgaaaatgtcatgcttgaatgggtatttttggaggttaaaggacc

SEQ ID NO: 6778747 - DNA, 55 bp, Homo sapiens
cacctcattaagaccagaagcaaactctgagcaaaagctgagtgatgatggggtg

SEQ ID NO: 6778748 - DNA, 101 bp, Homo sapiens
gtagatgactccagaggggagacaggatttaaccaaagctaactagcagaactagttggagctcttagtttggtgttctttctgctactcacagtcaatac

SEQ ID NO: 6778749 - DNA, 73 bp, Homo sapiens
ggcgaggccgaggcggctgaggctgctttagctcctgctccgggctggagctgccagggctgccgccgccgcc

SEQ ID NO: 6778750 - DNA, 76 bp, Homo sapiens
ggcagtataaatgtgggggccacgggctttaggtctgagcgctgtgagctgctggctcctcaggttatcggctgcc

SEQ ID NO: 6778751 - DNA, 102 bp, Homo sapiens
gaggagtaaagacacttcggtttcctcctagcctccagccgcggaccctcgcgggcgtccctgcggcttggtggttgggagagacggaggcacttttccctc

SEQ ID NO: 6778752 - DNA, 64 bp, Homo sapiens
gaaagtagatgacccatctctgagccaatgacaacaggagtactcatggattttctctgctttt

SEQ ID NO: 6778753 - DNA, 57 bp, Homo sapiens
ggtttgcttagctagcagtgtagcctgttctccagaagcactgttacaaagcacacc

SEQ ID NO: 6778754 - DNA, 99 bp, Homo sapiens
tgagacaaagtctcgctttgtagcccaggcggagcttgcagtgagccgagatcacgccactgcactccagcctgggcggcagagcaaaactctgtctca

SEQ ID NO: 6778755 - DNA, 83 bp, Homo sapiens
gttataaactcagttacatattagaataatgcaaaaattgaaagtgctattctgtgtgatatgtaaatgaagcattttataac

SEQ ID NO: 6778756 - DNA, 58 bp, Homo sapiens
ggagcggagggagggccactgtgctggtgtgaggcaaggggctggcgacctgtgtttt

SEQ ID NO: 6778757 - DNA, 64 bp, Homo sapiens
gtagttatccatattcagactgtgaattctaaacctggattctctctagaatgtggatttttac

SEQ ID NO: 6778758 - DNA, 60 bp, Homo sapiens
ggtgtgcagttcagagtggtcttggggaagcggtggtgctagaccctctggactgggccc

SEQ ID NO: 6778759 - DNA, 65 bp, Homo sapiens
tgcagaccggaaaattgagatttacagaggttaagtctttagtcttaagtaattcatggaatgca

SEQ ID NO: 6778760 - DNA, 91 bp, Homo sapiens
acggtgtagacatttcccccagtatgagcacagtgcctggacctgaatgatcatcttggcagttcttgtgcttttactttgtaaacattgt

SEQ ID NO: 6778761 - DNA, 109 bp, Homo sapiens
tctgcttatgtgaaatacggagggtgtataatgtcaagagtgatgttaagagcttaatataatgttcagttttgaaaacattgaatgcaatttgtcaactcagggcagg

SEQ ID NO: 6778762 - DNA, 56 bp, Homo sapiens
cagcagtgtggctctctcagaatgtgtagctctagctacatgtggctaagctgctg

SEQ ID NO: 6778763 - DNA, 76 bp, Homo sapiens
gtctatgagaaaactgaggccaagtgaggaaagatgaaattagaaacattatctcctgatgcccagattcatagac

SEQ ID NO: 6778764 - DNA, 56 bp, Homo sapiens
gcaaaaaggcaaatgaagaaaattctgacttttggaattctttgtttccttcttgc

SEQ ID NO: 6778765 - DNA, 62 bp, Homo sapiens
tgcttctatacctataatcagcctcaggttccagcagcccccagagaatgaggtacgaagca

SEQ ID NO: 6778766 - DNA, 84 bp, Homo sapiens
aaaatgtcccatttgtcaaacaaattaccaaactggaggtacatgagcctgcagatatattttatttggtcaatggtttgtttt

SEQ ID NO: 6778767 - DNA, 83 bp, Homo sapiens
gttgacttcttaccatgtgctcagcaatggaacaagagggtccgggggcttcctctgtgatttctgagccaatgaggattaac

SEQ ID NO: 6778768 - DNA, 75 bp, Homo sapiens
tcacttcaaggaatatctagaaaaattgggagtccatgttgcaggagttctctagtttccagatttcttgaagga

SEQ ID NO: 6778769 - DNA, 55 bp, Homo sapiens
aacccagagcacagatgcaacgtgctcaccaggagcatgaatgagctgtgaggtt

SEQ ID NO: 6778770 - DNA, 87 bp, Homo sapiens
aaggctgaataatatttcgttgcgtggctagaccacactccgtgtacccattcatctgttcatggccacccggattgttttcgcctt

SEQ ID NO: 6778771 - DNA, 59 bp, Homo sapiens
tggtctttgaccagggtctgatcacttctctctggtcagtcctacacgctcagggacca

SEQ ID NO: 6778772 - DNA, 86 bp, Homo sapiens
ctgccagacactcccctgggcaggcaatgtgcccaggccctggcatgaattccacagaatcctgtccactctgggagtgctgggag

SEQ ID NO: 6778773 - DNA, 82 bp, Homo sapiens
gttgggatcctgtcacatttatactccatttgcagccatactcttggggatgcatgttgaaataactgtgcaatgtcaaaac

SEQ ID NO: 6778774 - DNA, 89 bp, Homo sapiens
tgttctatggcctgtttcctctgaaagaatctgactgtcctggaatcttggcacatgaagggtccttcagaggacggcagccaggaaca

SEQ ID NO: 6778775 - DNA, 73 bp, Homo sapiens
tcaagcagggaagtctgtcttagaataaggggtgagggataacctcaaatgagagaggggactgcctgcttga

SEQ ID NO: 6778776 - DNA, 92 bp, Homo sapiens
cactgtgtctaatgctaaatttttaggactaaactattgacatagtggtgagcactcagtaattgttaagtttattctttctaatttcagtg

SEQ ID NO: 6778777 - DNA, 81 bp, Homo sapiens
cttcaaagagcaactgtaagacaaatgacttctaaacagaaaaagtagaagtcagaaagtaatggagtggcatcttcaaag

SEQ ID NO: 6778778 - DNA, 58 bp, Homo sapiens
agagaatagcctttgagccactgggaaagaaattgctgagaatcacaggttataatct

SEQ ID NO: 6778779 - DNA, 60 bp, Homo sapiens
gggctggctggtagaattgtgacctctgaatgacagatccagttagaccacagttacccc

SEQ ID NO: 6778780 - DNA, 60 bp, Homo sapiens
tagaagaatgatgtcagagttttcttaatataagatgaaaacctctgcatcaatcctttg

SEQ ID NO: 6778781 - DNA, 58 bp, Homo sapiens
gcaggaacccggccgccctggcttcaaccaagccacagaattgcacgtggggttctgc

SEQ ID NO: 6778782 - DNA, 66 bp, Homo sapiens
gctgggccgtttggactggcgcacggccccacgctgggccagctgcaggtgttccagatggccagc

SEQ ID NO: 6778783 - DNA, 97 bp, Homo sapiens
tccatagtacatgttacctaatgtctttctcataacagatatggtttactgagtatttgttatgtagaagacactggaccaagtagacaactttgga

SEQ ID NO: 6778784 - DNA, 69 bp, Homo sapiens
agggcacaggatactacaacaggactgtctaattccaaagcccacactctttttgtggttgtctaccct

SEQ ID NO: 6778785 - DNA, 91 bp, Homo sapiens
gagcatagtacacagtggaaataacgtggactttaggatagtattattatagaaatccagtttgtcatttcccagctgtgtgaccttgttc

SEQ ID NO: 6778786 - DNA, 77 bp, Homo sapiens
gcctacctgtcaagtgcttctgggattaggagtgcgcattgccaactccccactctggaagaacttgatgggtgggc

SEQ ID NO: 6778787 - DNA, 68 bp, Homo sapiens
gtgatttaaaagtttttcaatttttgacaatgaaaactcatggtcaaaaaggcctagacacaagtcac

SEQ ID NO: 6778788 - DNA, 57 bp, Homo sapiens
ggctttgcgaagatggcggcgctggtgagtttggtgtggtttcttcctcgcgtagct

SEQ ID NO: 6778789 - DNA, 96 bp, Homo sapiens
cattggaaataatgctatatttgacatgattatgattctctatttgtgccatcagaatcagcaagcatggttaggtgtatgtcatttcatttgatg

SEQ ID NO: 6778790 - DNA, 72 bp, Homo sapiens
ctctgttcccagtgtgtttaatgcattccaggagtctgtttgcattttaaatgcattgcattttgaactgag

SEQ ID NO: 6778791 - DNA, 59 bp, Homo sapiens
gttaagatgctgtcatactggattagggtgggccctactctaatgacaagtgtcttcat

SEQ ID NO: 6778792 - DNA, 87 bp, Homo sapiens
tattaagttggtgcaaaagttattgcggtttttgccagttccaaaaccaatggccaaaactgcagttacctttgcaccaacctaata

SEQ ID NO: 6778793 - DNA, 64 bp, Homo sapiens
ctgaggggcaggattattgggatttttcacttctaaaattttgtttaagtgatctgctttttag

SEQ ID NO: 6778794 - DNA, 57 bp, Homo sapiens
tagggatgatggagcctatgtacctggtaactacgtggaactgccaagccatcccta

SEQ ID NO: 6778795 - DNA, 95 bp, Homo sapiens
tttttaggtttagaggactgatttagatttcacacgtgagtctaggatttgtcaaccttgtgagaactgagtcacactaactaaatacctaaaaa

SEQ ID NO: 6778796 - DNA, 104 bp, Homo sapiens
agatatgaaagtgttggcctcatattgctttagaaagaaaaatataatatttattcagtgtatttttacaatttgaaacaaaaggtgggcaaattttacattct

SEQ ID NO: 6778797 - DNA, 59 bp, Homo sapiens
gttggcagccctgacccaatgggccactggctcagaggcaagcaaggagctgacccgac

SEQ ID NO: 6778798 - DNA, 71 bp, Homo sapiens
gtgccttcttcatgctgtgctggggctgctggaggggactgggctgcacagtggacagtgaagatgggtgc

SEQ ID NO: 6778799 - DNA, 59 bp, Homo sapiens
tcttattgttcttgtgaataatagtcatatgtatggctttatacttaagcacaatagga

SEQ ID NO: 6778800 - DNA, 127 bp, Homo sapiens
atgaggagtcattgagttggtgcgttttgcatgatttgatacatgttatgtggttagagcagtgcttggcacatagtaagctttacataaacatttattattcgtattcactaagtccactttccat

SEQ ID NO: 6778801 - DNA, 60 bp, Homo sapiens
ttggatcagtgtgtggatcctcccaggacttcctcggaagtgctgggcacacatttccaa

SEQ ID NO: 6778802 - DNA, 67 bp, Homo sapiens
ccagggcgaggctcactggcttcaagacgagctcatctctcaccagccaggggatcttgggccctgg

SEQ ID NO: 6778803 - DNA, 88 bp, Homo sapiens
gcttcctagagagagttatattctgcttctggtggcctgcggttttatttggttaccaattatggaagctagttgtgtttcaggaagc

SEQ ID NO: 6778804 - DNA, 62 bp, Homo sapiens
cttcaaggaagccacgttgggaggctataccattatcccaatgatgctgccattgctcaaag

SEQ ID NO: 6778805 - DNA, 99 bp, Homo sapiens
catttttatcctattgcaacctgaaactacattcttgattctgaccaaatacaaaaattgaattacgagaatgaagtatcaggcagatagctatcgatg

SEQ ID NO: 6778806 - DNA, 62 bp, Homo sapiens
gtaataatgtcaattaaagtttgtaggtggatcaatctccacttaattatgttgcattatac

SEQ ID NO: 6778807 - DNA, 70 bp, Homo sapiens
ttggcgtgcctggaagggaaattcagatcttcagtttgtgctgttcatctgtttctttcctcaacgctag

SEQ ID NO: 6778808 - DNA, 64 bp, Homo sapiens
actttttttctcctgcctcagttcagctcagtgataaataaggaactgaggttagataacaggt

SEQ ID NO: 6778809 - DNA, 55 bp, Homo sapiens
gcagctgttcaatctgcagcatctaggatttggtagcagcaggggaaacagctgt

SEQ ID NO: 6778810 - DNA, 80 bp, Homo sapiens
tcccgagccaaaattgagaaaattcgagcaagtttatttaacaataatgacttgattggtttgtcaagtttggatggtga

SEQ ID NO: 6778811 - DNA, 68 bp, Homo sapiens
cacggcccagtggggagcttctgccttggactgcaggcagctcaggggagtttgctactaggtgggtg

SEQ ID NO: 6778812 - DNA, 84 bp, Homo sapiens
tcttgaaatggcattatttggtttgatccatgtgagcactcaatatattattcacatgtcaaaaactacataaaaacatttaga

SEQ ID NO: 6778813 - DNA, 83 bp, Homo sapiens
gttaaagggcaggctcctgggtgtggccgccagagatcctgattctgtgagttaccacgacacccgggagtctgcagttcaac

SEQ ID NO: 6778814 - DNA, 63 bp, Homo sapiens
cacaggtgtcatgccaccgtttcccagagtgtcttctgggtggtagtattggcatggaatgtg

SEQ ID NO: 6778815 - DNA, 126 bp, Homo sapiens
tattctggtatgatttcctaaagaggaagttgagggcatctagagcctaatcctctcgcttgaaagaggattgaataagtagcatgtcttttttggctctcctctccttctcttcatgtttggata

SEQ ID NO: 6778816 - DNA, 81 bp, Homo sapiens
cccattgcagtcaaagattggaccaattgcagtttccaggacatctggctaaaattaatcagtccaagtttgagcactggg

SEQ ID NO: 6778817 - DNA, 77 bp, Homo sapiens
actttataaggaattgtgaatgcctgtcagtcttttctcctattgcaagaaggctgaccagtttacactttattagt

SEQ ID NO: 6778818 - DNA, 60 bp, Homo sapiens
gaagtccaagatcaaggccccagcagattcagtgtatggtgagggcctatgttttgattc

SEQ ID NO: 6778819 - DNA, 64 bp, Homo sapiens
ctctgagactcaagtgagtggggctgaagcagatgagggtggccccctttctgggtctctggag

SEQ ID NO: 6778820 - DNA, 65 bp, Homo sapiens
ggttggtgagtgagtgcgttcctgaggcttagctgggcaaaggaaaacgtctcagcttgctgact

SEQ ID NO: 6778821 - DNA, 56 bp, Homo sapiens
caggcagcaggagccctgctcgcatctcccattgtagctgtggccttgctggtctg

SEQ ID NO: 6778822 - DNA, 124 bp, Homo sapiens
tgaagctgtttttatataataacttttagctcactgacagagattgaaaatggtaaatattaaaattctgtggttttacaaactcttcatgaatgattgtcatttatatttagggcaatcttca

SEQ ID NO: 6778823 - DNA, 56 bp, Homo sapiens
gcctctgaggcagtgagtgttcttgaggtggaaagcccaggtgcagcctctgaggc

SEQ ID NO: 6778824 - DNA, 55 bp, Homo sapiens
caagtgaatgtagcaaacttgaacctggaataggtgtctgcctttacttcacttg

SEQ ID NO: 6778825 - DNA, 68 bp, Homo sapiens
attttaatcagttcttctgtttttcagagacaattctgtttcctggattaatagggagctgttgagat

SEQ ID NO: 6778826 - DNA, 59 bp, Homo sapiens
gtcccagggatgcagacatgagggcattggtctgtcttccatgatgccatttcctgggc

SEQ ID NO: 6778827 - DNA, 62 bp, Homo sapiens
cctgaggagttattttttgatattctttcacaagagaatttcagttgctaataagttctggg

SEQ ID NO: 6778828 - DNA, 61 bp, Homo sapiens
acctggattcttacttctaagcaagctgccctctaggcagtcatttatacgggaaccaggt

SEQ ID NO: 6778829 - DNA, 56 bp, Homo sapiens
cccaggagctgagcagggagcctcagaggaggctgctgcaagagccagctcttggg

SEQ ID NO: 6778830 - DNA, 98 bp, Homo sapiens
gaggcaggaaaatgacttgaacccgggaggcggaggttgcagtgagccgagatcgcgccactgtactccagcctggtggcagagcaagactctgtctc

SEQ ID NO: 6778831 - DNA, 83 bp, Homo sapiens
ctgctgggctctgcaaaagtagatacttgataatatatttatttttcattttaaaaagaatttgtatttgcaggaaatggtag

SEQ ID NO: 6778832 - DNA, 78 bp, Homo sapiens
gggcatgttaaatcttacatcagaggagagtgcttcacttttgataaactctcccttatctaactttacgttctgcct

SEQ ID NO: 6778833 - DNA, 60 bp, Homo sapiens
ggtagttctttagcagatttgtgtgttctaatttttccaatttctgctattagaattgcc

SEQ ID NO: 6778834 - DNA, 70 bp, Homo sapiens
tgaatttgacatacatgaaaccagattgtatgttattatcctgtgtcttgtttctgtagctcagtattca

SEQ ID NO: 6778835 - DNA, 95 bp, Homo sapiens
tattcactgtagtccaagagatgtaacgaagaacaagactaataagattcttactttttcaaaattacatcctcattgggagacacagatgaatg

SEQ ID NO: 6778836 - DNA, 56 bp, Homo sapiens
ccaagcaattaagtccatcagaacggaacaaccgttaaggaaggtgaatttcttgg

SEQ ID NO: 6778837 - DNA, 59 bp, Homo sapiens
cctcttcccttccctcaggtgaatgacaacgtacgtttaacaggatctcgggcaagagg

SEQ ID NO: 6778838 - DNA, 77 bp, Homo sapiens
tttgtaggatgtgttttggtaatttctgctttgcatgagtaaatttcagatccctgttttcaagacaatcttgcaga

SEQ ID NO: 6778839 - DNA, 69 bp, Homo sapiens
caaagggcagcccttgagttgtgccaggtccccatattttgatatgaacattgaagaggagcccctttg

SEQ ID NO: 6778840 - DNA, 65 bp, Homo sapiens
gtctcacttggggtctctcatgaggttgtagtcagatggcagtcatatgaagactcaagtagggc

SEQ ID NO: 6778841 - DNA, 70 bp, Homo sapiens
caggataactatctgaggaactctgtccttggcccgactgccagactcctcagtcaaatagttggtcctg

SEQ ID NO: 6778842 - DNA, 59 bp, Homo sapiens
tttgctttctgacgggtacatatgactaagtatatacacctgttttcagaaaatgcaga

SEQ ID NO: 6778843 - DNA, 60 bp, Homo sapiens
caccagcttgggctgtggaaatgctattttatagttggcaattccaccatgagctaggtg

SEQ ID NO: 6778844 - DNA, 92 bp, Homo sapiens
gggagctgtctgcacattttaagggcttttaggtatttagtaagttactgctttgacgcacttacctaatagtccatagcaaaacagttttc

SEQ ID NO: 6778845 - DNA, 62 bp, Homo sapiens
gcagattattattaggctgagttggcctcatctggcctttttttaagtgcaatatggtctgc

SEQ ID NO: 6778846 - DNA, 62 bp, Homo sapiens
gggaagggagtggcagggtgagagcaggcaggactgatgagactttgggcactttcctgccc

SEQ ID NO: 6778847 - DNA, 60 bp, Homo sapiens
gggattagctttcttggagaattacatggtcatgattttcacccagaatagctgctaccc

SEQ ID NO: 6778848 - DNA, 55 bp, Homo sapiens
ggctttgcattttgatggaggtgggtttttccttctgagtaaccatgacgaagcc

SEQ ID NO: 6778849 - DNA, 110 bp, Homo sapiens
gagctgttgagtcaatgccagcatctgctctcctctacactttgtattatatgagaaaaatgaactaccttatagtgaatgggggttatgagacttgcagggaaaagctc

SEQ ID NO: 6778850 - DNA, 56 bp, Homo sapiens
ctccctctctaaggcaaagagatatttcaatgttacctgggacctgagaaaggggg

SEQ ID NO: 6778851 - DNA, 58 bp, Homo sapiens
cccaattttgggcacaacgaaatacaacaaacatcaattttgggccaacaagattggg

SEQ ID NO: 6778852 - DNA, 71 bp, Homo sapiens
ggagatgaaacaagagacatgaatactcgaaggtgcagatctttgaggtgtcatctctgtggctagtctcc

SEQ ID NO: 6778853 - DNA, 88 bp, Homo sapiens
ctcccccggaactcgcgaatcccctgtcggaacagtggctcagacggcagcccctccccactgttggcccgaaggggtctgggtggag

SEQ ID NO: 6778854 - DNA, 81 bp, Homo sapiens
gtgagaggtgagttacaggaggaggtccagaccctgaccttggatctctttgtaattaacttaatgaccatgagccctcac

SEQ ID NO: 6778855 - DNA, 82 bp, Homo sapiens
ggctagattttattcatatgctttaacattaaacaacagtttataactgattgaatgcagaagcaagtatgagaatccagct

SEQ ID NO: 6778856 - DNA, 81 bp, Homo sapiens
tggcaagagaaacctattgcatttgcaagattagagctaattggttttgcagagtgcaataaatcagttttgaaaatgcca

SEQ ID NO: 6778857 - DNA, 66 bp, Homo sapiens
gggctcttcccactccccctgagtgatccctctccccaccttccagggcatgtgggagaggagcct

SEQ ID NO: 6778858 - DNA, 55 bp, Homo sapiens
gtgccagagattcctaaactttctgtgttcagggtgccattagttgtcttggtac

SEQ ID NO: 6778859 - DNA, 57 bp, Homo sapiens
ctggttttgtcagaagctttatttcattgatggtttactgcatctacttagagccag

SEQ ID NO: 6778860 - DNA, 59 bp, Homo sapiens
gtcagtacccagtgcaactggagtctctgcaacagggaacccgcacgctgggtgcaaac

SEQ ID NO: 6778861 - DNA, 73 bp, Homo sapiens
aatctaacacagtgacctctttaaaaggggccaaagcaagactcctattttgtgtggtcaactgtcttaagtt

SEQ ID NO: 6778862 - DNA, 78 bp, Homo sapiens
gataactttctaagaagggtacaataaggcatactctctaactgtgtgaccacaagacgcttatttttggaaaatatc

SEQ ID NO: 6778863 - DNA, 103 bp, Homo sapiens
cttggcaggttcaccaggaagctgtgttatttaaactcggatggtctaggagaactgtagacttccgggtgctagatgattcctgctctggaaactcaccgag

SEQ ID NO: 6778864 - DNA, 55 bp, Homo sapiens
tacctcagaatcccccaaagatttgttatcagtggcaccaggcattctaggggta

SEQ ID NO: 6778865 - DNA, 84 bp, Homo sapiens
gaagtgcttatttgtcaggaaatctatttcttaccaaaggattattgtatgtaaaggtactgaaatagcactctgatgcatttt

SEQ ID NO: 6778866 - DNA, 55 bp, Homo sapiens
tgaggattttctagtgctccgttggtatctgatgggccactatagaaatctctca

SEQ ID NO: 6778867 - DNA, 59 bp, Homo sapiens
gtcagctcatccatcccggtggagcagatctttctccaccatcagtactggatgctgac

SEQ ID NO: 6778868 - DNA, 66 bp, Homo sapiens
gttttggggtctggccatcagtggggagggctttccccccaccaccaaggctcagttttctaaagc

SEQ ID NO: 6778869 - DNA, 74 bp, Homo sapiens
gggaggagccctgttccccaggcctgacagtgcaggagctgtgggcctgcaggctgggctgggctgcccctccc

SEQ ID NO: 6778870 - DNA, 63 bp, Homo sapiens
gctgttcctgcttagaggtcgggaagttgagaccgtgctgcgatctctagaggcagaaacagt

SEQ ID NO: 6778871 - DNA, 64 bp, Homo sapiens
gttctgcttgatttcccctcgtctgtttttctccaggaagtagaccaggttgaccaggtaggac

SEQ ID NO: 6778872 - DNA, 96 bp, Homo sapiens
atgatcatatggcatattctgaatgacccagcttaagtcacatgttcaacattgaactgtggccagggactggagtatagttcatgtctaggtcat

SEQ ID NO: 6778873 - DNA, 110 bp, Homo sapiens
gtccatgccatggatgttatggtcagctctggattgaagtcgagtcacatttcaaaacagatgcaatttcaagaggccagagcgaggccgccgcatctgctggctgtgat

SEQ ID NO: 6778874 - DNA, 58 bp, Homo sapiens
caggcctgtctgcacatgaggctgtgagggcacaggcctgtgtgcacacgaggccatg

SEQ ID NO: 6778875 - DNA, 73 bp, Homo sapiens
cggcggctgcggccgggcatcgtatggcgctagagaacttcggcggcgagcgggacctgcgcctgggccgccg

SEQ ID NO: 6778876 - DNA, 60 bp, Homo sapiens
tgtgccaggggccgcttgcctttcataagcgtgaaatccatttaggcaacctttggtaca

SEQ ID NO: 6778877 - DNA, 63 bp, Homo sapiens
tgcattgcatgtgtgaaatgcacagaaggtctttatgttctgttataaatcacactgcatgta

SEQ ID NO: 6778878 - DNA, 82 bp, Homo sapiens
ccaggagacactggcttgtttctatttgccaggtaggatgtcagtggctgcttggccaacagcgacagggccagcttcctgg

SEQ ID NO: 6778879 - DNA, 102 bp, Homo sapiens
tgataaataaagcttttatttatagaaagactaactagaaagtgcactcttaagtgcagctcaatggttggctttaatagaagtagatattttatattatta

SEQ ID NO: 6778880 - DNA, 130 bp, Homo sapiens
ttacagaggaatgcaaagcagaagaatttagaattggtgacttagtaagaagggggtgttacatttttcaaggctagttttaattaggaaatttcatatgctcaggaaataatatggtagacccctgtga

SEQ ID NO: 6778881 - DNA, 60 bp, Homo sapiens
ccacactcaagtcctgcatagcatctgtgtcactgacagatggtgagatactgggtgtgg

SEQ ID NO: 6778882 - DNA, 55 bp, Homo sapiens
tctgacttcctccacatctgttccaaatttaaagaactcatgtgatgaagttagg

SEQ ID NO: 6778883 - DNA, 89 bp, Homo sapiens
gtgggggtgagtgacactgatattaaacacaatttaatagattcacccatgaggattatattgggtctggtatcaggttctgattaaac

SEQ ID NO: 6778884 - DNA, 56 bp, Homo sapiens
ttgaagcattgtggcttgtattttgcaaagcaactgcgggcacatccatgtttcaa

SEQ ID NO: 6778885 - DNA, 61 bp, Homo sapiens
gagtgctgctaatgcaagggtgcttctgacttagcacagtgccatcacatggcgagcgttc

SEQ ID NO: 6778886 - DNA, 58 bp, Homo sapiens
gagtgtgagcaggtcaggagatgtgagaggcagcatgatcctggagctgcttgaattc

SEQ ID NO: 6778887 - DNA, 67 bp, Homo sapiens
gtgcaatccagttgatttttacattgaaaggtcacagttccccctctgagagtctgacggattgtac

SEQ ID NO: 6778888 - DNA, 87 bp, Homo sapiens
ggctaattaaaacttcagctcagggaggcccccttggggcatggattgcctcagtcagcttccctgggggagtcccctaattggacc

SEQ ID NO: 6778889 - DNA, 113 bp, Homo sapiens
ggagggtgaggacagaagcagggacaccaactgggaggctgtggcagggccccccgagagagatgccagggcctcgggctcagtgggtccatctggcctctgcttcaccctcc

SEQ ID NO: 6778890 - DNA, 55 bp, Homo sapiens
gagaggagagagaaacagccacctactaaggaagaagggctttttctcccctctt

SEQ ID NO: 6778891 - DNA, 70 bp, Homo sapiens
attgctttttctagtggttgcatgattatcatgcctctgatgataaatctgcacccactgaaaatgcagt

SEQ ID NO: 6778892 - DNA, 55 bp, Homo sapiens
accttttacggtgtgactagcaaatgccgtggtttttgcaaagtcagtgaagggt

SEQ ID NO: 6778893 - DNA, 68 bp, Homo sapiens
gtgccatcttaggtgatgattgatgtgaagtaatatatctgtcaattattcacataggcctggggcat

SEQ ID NO: 6778894 - DNA, 59 bp, Homo sapiens
caggtttagttccacacagctccttcgactggaaattgttagacctggggcttagcctg

SEQ ID NO: 6778895 - DNA, 57 bp, Homo sapiens
tgttactcctggttgagcttggtgctgatgacctgtttacccagcccaggagtggca

SEQ ID NO: 6778896 - DNA, 92 bp, Homo sapiens
ccccacattccttgcaaattgcgaggcagggaagctgcaaaagccggggagccccgggctgggccgtcgccctccttgctctgcaaaagggg

SEQ ID NO: 6778897 - DNA, 79 bp, Homo sapiens
taagtttgtgcttggtgtagggtagctcaggcagttggaagaaacaacatgtctgggtattcacaaggacactgattta

SEQ ID NO: 6778898 - DNA, 60 bp, Homo sapiens
agttcccaagagaaggtaggccctttaaagtttttccagaggggttgaccctcttggact

SEQ ID NO: 6778899 - DNA, 85 bp, Homo sapiens
agcctgggaagttcctcagtgtcatttccacgacattcagttggtattcaattggtatgaatgagtcactaaggccagccaggct

SEQ ID NO: 6778900 - DNA, 66 bp, Homo sapiens
tgggatataatctgaaaagtatttgtgaatcagtctatggattcaccttacttggattgttttcca

SEQ ID NO: 6778901 - DNA, 76 bp, Homo sapiens
agggtagcatttcaggaggaagatacgggctgactggcaatcaccccctctctggtctctttctggaagcttccct

SEQ ID NO: 6778902 - DNA, 58 bp, Homo sapiens
actctgtgaagtcttattatgcacatcttacaaatgaagcaactgaggcttatagagt

SEQ ID NO: 6778903 - DNA, 65 bp, Homo sapiens
tgtcattctccaagaacccgctgctgcgacgcaggccaaacagctgggtttagtggggtgtggta

SEQ ID NO: 6778904 - DNA, 77 bp, Homo sapiens
ggtcacagggaaatcacctttcttgctgaagagattccagggaagacaggaagattgtggaggtggtttcaatggcc

SEQ ID NO: 6778905 - DNA, 70 bp, Homo sapiens
acatttgaagtctgagatggtctctttgttactctgttgattgactggaattcgtctttgcttctattgt

SEQ ID NO: 6778906 - DNA, 87 bp, Homo sapiens
gcattgagtgcaccctagatgcctctccatgtgctgcagagaacaaccccagctgcagcgtgatcccgcatttaggtgcccagatgt

SEQ ID NO: 6778907 - DNA, 77 bp, Homo sapiens
aagctccagcatttcctgcaggccccagttcacagggtcctccctgagagggcttcctgtaggtcctagcagagttt

SEQ ID NO: 6778908 - DNA, 80 bp, Homo sapiens
gcacccttaggccagagtccttgcgactgggacgggaggcccctgtggcacatgcagggattcactgggctggctggtgc

SEQ ID NO: 6778909 - DNA, 62 bp, Homo sapiens
gtgtgtgtatgtagaactatgtatatagaacaatatgtatgtatagaactatatatatatat

SEQ ID NO: 6778910 - DNA, 55 bp, Homo sapiens
ccccgtcagcctctcctttctgagaactgagtatggagtcagggtctggctgggg

SEQ ID NO: 6778911 - DNA, 60 bp, Homo sapiens
gtctggctagactcggccagccacagcctccagctgtctcttggcactgtctggtgaggc

SEQ ID NO: 6778912 - DNA, 78 bp, Homo sapiens
cctgtgctgggcagagttggtggagtcagttgcccagacagggcaacgtccacgtcaggctctgggctcctagcaagg

SEQ ID NO: 6778913 - DNA, 73 bp, Homo sapiens
tggtttcttcaacacattcctgtaggtgtttggtttttctgagctccacatgcagagtgtcacttgaaaacca

SEQ ID NO: 6778914 - DNA, 115 bp, Homo sapiens
gtgcagctggtgcagtctggggatgagatgaagaaggctggggcatcagtgaaagtctcctgcaagacttgtggatacacctaccttcaccagttactctatgcactaggtgcgc

SEQ ID NO: 6778915 - DNA, 59 bp, Homo sapiens
ccatgatctcagtagtgtcctgaagccaagaggaacaggctccactccctgggatgtgg

SEQ ID NO: 6778916 - DNA, 58 bp, Homo sapiens
gggacttcatagctaggcacttgcataggtacgcagcgcccacagtgaggaggatccc

SEQ ID NO: 6778917 - DNA, 117 bp, Homo sapiens
gctactgttgctgtggttgtattttatttgttgaacaatcctgtactttgaaatgattcatttaagagccatgaaacattcaaagcaggatgtgtgactcacatagcaaacagtagc

SEQ ID NO: 6778918 - DNA, 103 bp, Homo sapiens
actacttagaggagcccttcaggatgcatggggtggcagttaccttcatacatttgtcttttaaggtgtcactttatgttcagtgtttaggaggcccagtagt

SEQ ID NO: 6778919 - DNA, 83 bp, Homo sapiens
tccaagaatcatctccagccacagaatgatccctggggtttcactcttggagagccttggtgatctgggctggaagagatgga

SEQ ID NO: 6778920 - DNA, 55 bp, Homo sapiens
ggtttctcaacagagtatgcccttgacatcaggtatgaatctctggtgggaattc

SEQ ID NO: 6778921 - DNA, 70 bp, Homo sapiens
agctccactaaacagaatactcagctctacagatgatttatacaatgaggaagagtgtgtgtagggagtt

SEQ ID NO: 6778922 - DNA, 80 bp, Homo sapiens
gccaactgccactaggccatatagatgagggaaagtgtttatttattgctctattatggcctaaaccggcattatttggc

SEQ ID NO: 6778923 - DNA, 60 bp, Homo sapiens
gcaccagctactccagggccgtggttgtgaagatcgagacacgtgatgggaagctggtgt

SEQ ID NO: 6778924 - DNA, 67 bp, Homo sapiens
tcaaaccttttaaaccattcacatcccagaaagctatgcgctttggaaaaagaagaggttggtttga

SEQ ID NO: 6778925 - DNA, 67 bp, Homo sapiens
agaaaccaaggtcattgcacctccctgtaggggcccctacaaggaggctaatgatgacacaggttct

SEQ ID NO: 6778926 - DNA, 59 bp, Homo sapiens
tgaagcagggacctatgacgatggaaatttctgacaatttcaccccaatccttgcttta

SEQ ID NO: 6778927 - DNA, 72 bp, Homo sapiens
gggctcctggtaagtaataagtgctcaataaacactctctttattctctgatgttcacttttccaggagtcc

SEQ ID NO: 6778928 - DNA, 76 bp, Homo sapiens
atgtagagctccttgatcctcccttgacaaaggagaccctcctgcactttagacagggttaaggaggcacctgcat

SEQ ID NO: 6778929 - DNA, 105 bp, Homo sapiens
gctatcttttagtggagctttgaaattatgtttcagacaacttcgattcagttctagaatgtttgactcagcaaattcacaggctcatctttctaacttgatggt

SEQ ID NO: 6778930 - DNA, 108 bp, Homo sapiens
ctcaccaggcttcaagctgctgcctggatggctctgagcagggctggctgtttcaccccaagctgagcaccatctgatcacctagaggcagtgctggggcaggctgag

SEQ ID NO: 6778931 - DNA, 79 bp, Homo sapiens
atggtgtcttttgacagacaaatgtttttaactttgattaaatccaacgtattaatttttgtttggcagtttacgctat

SEQ ID NO: 6778932 - DNA, 73 bp, Homo sapiens
ggggttcctttctacagatgcctcttgcccaggctgggcatgtttaatctgcatggagcttaaaggtaaccct

SEQ ID NO: 6778933 - DNA, 63 bp, Homo sapiens
agtgtgaccttatttggaaacagggtctttgaagatgtgatcaagttcagatgaggtcatact

SEQ ID NO: 6778934 - DNA, 98 bp, Homo sapiens
ccaattgctcactatattgcttgaggccaggaggtgtcaacctcctggagttaggtatctggtcaacctcctggcctcaagcaatcctcctgccttgg

SEQ ID NO: 6778935 - DNA, 86 bp, Homo sapiens
gggagtcacacttccttttagaatcatgaagaccctcagggggtcctgcctttcatgaaaaaggtagtatttaaacagtgacttct

SEQ ID NO: 6778936 - DNA, 57 bp, Homo sapiens
gaggagagggcagagaaatgtagttgagcttcctgtttggctagctgcctacttttt

SEQ ID NO: 6778937 - DNA, 74 bp, Homo sapiens
agacacagattctctgaggcaggggcagctggagagactttctccatgcctcctattccttttttctcttgtct

SEQ ID NO: 6778938 - DNA, 82 bp, Homo sapiens
ggcaggggcagctttctttttgcatgtctctagtgtgaattctttccttcaagaagaccaagaaccggaggactcccttgcc

SEQ ID NO: 6778939 - DNA, 82 bp, Homo sapiens
tttgagtaagcacttgtgtgtcttcttcactgccctagtctctgtgcctagagcagtgtctggcacatactagatgctcaga

SEQ ID NO: 6778940 - DNA, 66 bp, Homo sapiens
gcattttaagatgacctggtttcatattactgtcaagcaagagagaacagtgtcatcctataatgt

SEQ ID NO: 6778941 - DNA, 61 bp, Homo sapiens
tggaaggggagccaggggcttgggtggactcgtcccactggccccctggactcctcatcca

SEQ ID NO: 6778942 - DNA, 114 bp, Homo sapiens
aaagtacgatgaaaagtgcccaaattctgcttttgattaggattccataagtttaaagaactttatggaaaatacaattataagcatagtatggtgttaattaaaaatgacttt

SEQ ID NO: 6778943 - DNA, 56 bp, Homo sapiens
atgtatttctccatgacactcataaaaacaagaaatgaggtatttgggagatatat

SEQ ID NO: 6778944 - DNA, 91 bp, Homo sapiens
ataatcttggagtcaatatatggaggtaagaatatttttttgaaattaaaatatttcaaagtcaatatcattaccatgtgttgtagattat

SEQ ID NO: 6778945 - DNA, 130 bp, Homo sapiens
gcaggccctggcttgtgtctacttgcgcctcagtgctgatcgtccctcactcctgggtgctgaccagcgttgtcctagtgacctgggagctcaggtgtgggaggcagaggtgcagtgcagcctggcttgc

SEQ ID NO: 6778946 - DNA, 61 bp, Homo sapiens
ggcttctgtttcttaatgaggccagactctctcagtctgcagatcagagcaaacagaagcc

SEQ ID NO: 6778947 - DNA, 59 bp, Homo sapiens
tccagccagctggcactgtgagtagagaagctctgactctccaagtgctgtaggtagga

SEQ ID NO: 6778948 - DNA, 62 bp, Homo sapiens
caccagtattcgatctggccagttctacaaaggatcctttggttgactggggttggctggtg

SEQ ID NO: 6778949 - DNA, 56 bp, Homo sapiens
gtcacagtgccctggtggtgttctgtaaaagcgacactcaccttagcattctgcac

SEQ ID NO: 6778950 - DNA, 66 bp, Homo sapiens
gttcccagttgctgccagttttcctatcagtgggcaccaccaggaaaaataaggcagcagggcagc

SEQ ID NO: 6778951 - DNA, 96 bp, Homo sapiens
ggagtagattctgttgttggagtaaaaataacttactgaatcttttatatggaacactataggaaattagaagtgctcaggaatagagtttagccc

SEQ ID NO: 6778952 - DNA, 75 bp, Homo sapiens
gagtctctagcacagtgggaatataagtggcctggcttcccaaacacataagtcccctgtgccaagcagtgactc

SEQ ID NO: 6778953 - DNA, 76 bp, Homo sapiens
ggactatctgtgccttctcccagacttagcaacttatgttagagctctgtggagagagaactgcttgcagatgttc

SEQ ID NO: 6778954 - DNA, 130 bp, Homo sapiens
cacagtgaaacattttgcttttctgaaagaacattatattcattttgcccttgctagatcactggtatcattacttatgctagtctctaggaggggaaaagagggattttattgaagtgatttacttgtg

SEQ ID NO: 6778955 - DNA, 55 bp, Homo sapiens
gcacggcctcgcccttggaaccccactcgggttcccagagcccccaggccgctgc

SEQ ID NO: 6778956 - DNA, 59 bp, Homo sapiens
ggcctggtttcacttttcttgatctgcttacacaccagaagggagataggaatcaggcc

SEQ ID NO: 6778957 - DNA, 56 bp, Homo sapiens
gtgctctatgttgattccttgatgcagtgcttaaggctttggtcaccatggagcac

SEQ ID NO: 6778958 - DNA, 58 bp, Homo sapiens
gaggagctcttctaaagatggcaatgaggcaacttaagtgctaccaaaagaattcctc

SEQ ID NO: 6778959 - DNA, 97 bp, Homo sapiens
gacagtgctgctctgccagtagcaagccccagatggaggaagctgggcccatttctggccacttccacccatttggagctttgccagaggagtcgtc

SEQ ID NO: 6778960 - DNA, 64 bp, Homo sapiens
ggtgctaggtgagggcccaccacccatttaatttctggtgggtctggggcaggcatctgacacc

SEQ ID NO: 6778961 - DNA, 64 bp, Homo sapiens
tcccatgccccactctgcttttctgctggctggtgcaggagacaatggctgtggggcatgtggg

SEQ ID NO: 6778962 - DNA, 73 bp, Homo sapiens
gcataatattttcagagatgctcaactcatcctgagcctaaagggatatggatattctctgaatattttatgt

SEQ ID NO: 6778963 - DNA, 58 bp, Homo sapiens
aaaggtcttcagtgctttcactagtgaatgaacactctgaatgagcatctggactttt

SEQ ID NO: 6778964 - DNA, 66 bp, Homo sapiens
ggctacaggtggtgaagaggcatgaacaagtcaggccaggctcagctttgccaccagctgtaagcc

SEQ ID NO: 6778965 - DNA, 89 bp, Homo sapiens
ggactggatccaccattgctggcttgaagatagaggagccaagagaggctcctgggtaacagccagcaaggaaatgggaattttagacc

SEQ ID NO: 6778966 - DNA, 74 bp, Homo sapiens
gtttaagtgatacctaggaaatcaaggtttaatattgtaggaaaagctttgtatttcataggtacacagaagac

SEQ ID NO: 6778967 - DNA, 59 bp, Homo sapiens
tacaacaggaatttcaactttgtcttcaatttatggcagggtttagaatctcttttgta

SEQ ID NO: 6778968 - DNA, 126 bp, Homo sapiens
tcatttctttgggaaaattacctctgcttctcaagctctcagtttcctcaactgtaaaatgatcacacacttttataatgagaaactgagagtagtgacgtgaaggaaggatacaaagagctgtga

SEQ ID NO: 6778969 - DNA, 79 bp, Homo sapiens
cactgtctgaccctttagagaaagtttgtcaacccctggcctagaacatgggtggcttcttactagggctcagtaagtg

SEQ ID NO: 6778970 - DNA, 65 bp, Homo sapiens
tgccttttaccttgtaattctggtgatcttacatccataacctctgggattgctacagaagggca

SEQ ID NO: 6778971 - DNA, 105 bp, Homo sapiens
ttcttatatctgctttaaagctatctggttctagatgagatgatgagacctgatgactcagtctcataggtttggaaccaggtagcactaccaagggcttaagga

SEQ ID NO: 6778972 - DNA, 69 bp, Homo sapiens
tcaccctgtttctcttttgtctgttccttgttgatagctctattgatggatagaaggaggctgtggtga

SEQ ID NO: 6778973 - DNA, 61 bp, Homo sapiens
tcccagtgctacagacagggcacaatgggcaaggccacactgtacaaagtagctgctggga

SEQ ID NO: 6778974 - DNA, 68 bp, Homo sapiens
tctccacgtccagtgatctagggagctggactttgagtggtaaggtctttggtcactggtagtggtga

SEQ ID NO: 6778975 - DNA, 63 bp, Homo sapiens
tagatgagtgggagctgctacctccttccatgcccatgggcaggggtagcattccaagtactg

SEQ ID NO: 6778976 - DNA, 68 bp, Homo sapiens
tgtgaacacatctggttagttgatgaaactgttttcacagtacatctggctggatagatacaaccaca

SEQ ID NO: 6778977 - DNA, 92 bp, Homo sapiens
tctccacatttctgagcagttttactcctgtgttctttgttaattggtcctgaaaaatgacacaattttagagctgaaagaaactttggaga

SEQ ID NO: 6778978 - DNA, 67 bp, Homo sapiens
ttctgtaaatattgtcccatgagcgataacattacaaagtccttaggagtgaggagtgtttacagaa

SEQ ID NO: 6778979 - DNA, 56 bp, Homo sapiens
gaagtgacagaagggatgggcagcttcctgtctaaaactgacccttctaccagttc

SEQ ID NO: 6778980 - DNA, 85 bp, Homo sapiens
gaggcgtggggggatgggaaccagggcatgcaggactgtggcagagtgctcctctgccacctgtgcagcctccattctgggtctc

SEQ ID NO: 6778981 - DNA, 67 bp, Homo sapiens
ggcctacccgggagactcctctagggctgtgtcgaggagggcagcccccaggagtctccacgccgcc

SEQ ID NO: 6778982 - DNA, 71 bp, Homo sapiens
gcctccagtgtggtcaaaggggaatgttcaccaaaggagtgataggagtttggtttgggccagatggaggt

SEQ ID NO: 6778983 - DNA, 93 bp, Homo sapiens
ggagcaactctgtgcatcggaatcacccgggatcccagcaggtctgggagggactgagattctgctcccaggtgatgctgatactgctgctcc

SEQ ID NO: 6778984 - DNA, 55 bp, Homo sapiens
aagtgccttttcttcatagttactttgaaaaaaggtgaatagggaaaggttactt

SEQ ID NO: 6778985 - DNA, 74 bp, Homo sapiens
agggtaattaagggttccttttgatagagctcagaatgctgaacttatattcaaacagctcaagaagttactct

SEQ ID NO: 6778986 - DNA, 73 bp, Homo sapiens
atacgtgtatcagtaactgtggacagtagagaagatgcgctttttatttgtttgttgttgttggtattagtat

SEQ ID NO: 6778987 - DNA, 68 bp, Homo sapiens
tttggcaatgactgcatccatgatgcctgtcaagcaggtcctctctcctggctgcagctcttgccaaa

SEQ ID NO: 6778988 - DNA, 57 bp, Homo sapiens
tgcctagtagggttgttgtagggattcacaaaaaggccctatgcccagactaaggta

SEQ ID NO: 6778989 - DNA, 87 bp, Homo sapiens
ggatttaaacacagggattttatggagtaactatagtctctgtacgagcagacatttagacccctgtagttccctacgtttttatcc

SEQ ID NO: 6778990 - DNA, 124 bp, Homo sapiens
cttgtctgcctgtgtatgtcctccccaaacacagacatggccttcacctcccctgccttcatcttgtggggtggggagcagcaggaggttatggatgctggcctgataacatctggcaggcagg

SEQ ID NO: 6778991 - DNA, 63 bp, Homo sapiens
ctcatgccacgttgttttttctctcggctctgctcagagtgaagttcatcgtgcagcaatgag

SEQ ID NO: 6778992 - DNA, 65 bp, Homo sapiens
cagaggtatatattctccatattggggtttctccaaccataatgtgggtgttaatagtgcctctg

SEQ ID NO: 6778993 - DNA, 76 bp, Homo sapiens
atagcaatcagtgtatttgaaagtccatgtaagcctttccccttatccctgaccctgaaataactgaaattgctgt

SEQ ID NO: 6778994 - DNA, 77 bp, Homo sapiens
gagatgcagatcaccacatgctcaccaagtccctggagtaaaggactccagactctggagttgtctgatctcatctc

SEQ ID NO: 6778995 - DNA, 59 bp, Homo sapiens
cagccacttcccctctatgggtctcagtttcctcacctgtagaatgggtgaaggggttg

SEQ ID NO: 6778996 - DNA, 67 bp, Homo sapiens
tgtgacaaatgtttctacagcgtccactgagccaggctcagtaggtccctgggacatatatgaaaca

SEQ ID NO: 6778997 - DNA, 75 bp, Homo sapiens
tgataggcttaattttcctgtcaaatgtggacttcccttgtaaacatgtcaattgaggaaagttcaagcttgtca

SEQ ID NO: 6778998 - DNA, 78 bp, Homo sapiens
ccttttctgacagaagcagtgtgaacccatgtaactatcaggaattgtcacgtagggtatattcttgtgtcaggatgg

SEQ ID NO: 6778999 - DNA, 69 bp, Homo sapiens
ctcaacaggaggcagggatgctgcttaggcagttggctaaccagaagcaatggcatcttgcttttcgag

SEQ ID NO: 6779000 - DNA, 81 bp, Homo sapiens
agaatctcatcaggcacacatccgtgagagatcacatgaccttcgcgtcagatgtgtgtgctgtgtggaaaagaagattct

SEQ ID NO: 6779001 - DNA, 62 bp, Homo sapiens
catctatattctggaatgtccatttactttaatgtagtgtagtggaatttagagtataattg

SEQ ID NO: 6779002 - DNA, 64 bp, Homo sapiens
gccattgcgcttgggcaaatcgcttagactttctgggcctcagtttgcttaatgtgtagagggc

SEQ ID NO: 6779003 - DNA, 99 bp, Homo sapiens
aagattaatatttccatagtgagacatgtgaatatttgtactaggtagaatgtggaataagttaaataacctcatgtccgttggaaaattgttggtttt

SEQ ID NO: 6779004 - DNA, 93 bp, Homo sapiens
tcagcaggcagatttggggaagagggagctggaatgatgtacatgtgaatcatctcagttgctttcttttcctgtctgctcttcttctgctga

SEQ ID NO: 6779005 - DNA, 58 bp, Homo sapiens
gtctgctgacagagcatggacctcagttttaggttctacctaccctctgcatacagac

SEQ ID NO: 6779006 - DNA, 77 bp, Homo sapiens
cctgggtcttctactgtgttgagctgttgctggggtgtccccagtgtctgttgcttttgcagtggacagtacccagg

SEQ ID NO: 6779007 - DNA, 83 bp, Homo sapiens
gctgcttggaaggctgaggcagtgaggcagagtttgcaatgagccgagatcgcaccattgcactccagccaaactacaagagc

SEQ ID NO: 6779008 - DNA, 123 bp, Homo sapiens
tttgcatggtgtaaaatactctcactgtggctgatttcaacctaacagtatgacctcacggagcatgtagttgggaagaaaagcacagtagcacagtattatatggtattttcaccatccaga

SEQ ID NO: 6779009 - DNA, 66 bp, Homo sapiens
ccctctgtctcttggcctgtgtcctgtgtctggcagaggctgcccatggtccaggaagacagaggg

SEQ ID NO: 6779010 - DNA, 65 bp, Homo sapiens
catttgcagagggtgacactctgagtgattaaacattttacccaaagttacacatctagtaagtg

SEQ ID NO: 6779011 - DNA, 69 bp, Homo sapiens
tccttcagcctttgtttatcagaattcctgtgcttaccagtgtttggtggtctgtgagcaacgtgagga

SEQ ID NO: 6779012 - DNA, 56 bp, Homo sapiens
catcattccacatgtaccactagcagttgccccctttgctagtgtgtggtgtggtg

SEQ ID NO: 6779013 - DNA, 75 bp, Homo sapiens
acagagcattttctgggcctgcaggagatggtcagtcagacttttcacaggaatacccggctttctaatttctgt

SEQ ID NO: 6779014 - DNA, 68 bp, Homo sapiens
ctggtgccagctgtttcagagcccagtgcgggattttcctgaagctcctccacggcaggtggcaccag

SEQ ID NO: 6779015 - DNA, 60 bp, Homo sapiens
ttcacttcacagatatttatttggtatttactatataccaggcactcttgtggcagtgga

SEQ ID NO: 6779016 - DNA, 88 bp, Homo sapiens
ggacgtgcaccctggccatggaccccgagctgacctcggcccctccctgactcggttgctctcaggtccaaggccactgctgctgtct

SEQ ID NO: 6779017 - DNA, 130 bp, Homo sapiens
tgttcattcagatgagtaaatgtgtccttagtgaaggctgtcacctgcacctttcatctgtgttactgctgtgctcctgctagggttaggggctgccattattaaatgctgacctcatttggaactgcca

SEQ ID NO: 6779018 - DNA, 70 bp, Homo sapiens
gcagtatcacgtagtgacaagatcacagggccaagaactaggagcctgggtctggtcactaagtcactgt

SEQ ID NO: 6779019 - DNA, 70 bp, Homo sapiens
tagtggataatggataacattgtcaacaaatgttgatttaaaagaaacattgtctgtatattgtctacta

SEQ ID NO: 6779020 - DNA, 77 bp, Homo sapiens
gttctggagcatttcttccccatggggtaagtcagaattttctaggcaaaccacaggggaggaatgatgcccgggac

SEQ ID NO: 6779021 - DNA, 77 bp, Homo sapiens
gtaatgtgatcaatatgggaatccaccctttaaaatgcacatgcagaaattaaagtgggtttcctagggagcactac

SEQ ID NO: 6779022 - DNA, 107 bp, Homo sapiens
cagagtgcagagcaggcacctgtacccaacaggctgtataggagagacttccacctctgttcctgctatggtttgttgcagacataattcccctgtttctggctctg

SEQ ID NO: 6779023 - DNA, 84 bp, Homo sapiens
ccagccctgctctcgtgtatctcatgttcttctctggaggaatccggagctggccgggtgaatgcatcagaggaccagtcttgg

SEQ ID NO: 6779024 - DNA, 72 bp, Homo sapiens
ctggggaggtgatggtttcctaccttccaacccactgacccagggaggcagctgacctagcaccatccacag

SEQ ID NO: 6779025 - DNA, 62 bp, Homo sapiens
ctctcgacagcctggcacagtggcattccggtgtgtgctacccgtgcctggctggtgaagag

SEQ ID NO: 6779026 - DNA, 119 bp, Homo sapiens
gaactgttttttaatatgagactgagggatgatatcctggatctcacaggggctggattttgcctgagtgttagagctaagataacatcttattcttgtctatatttcaagaagcattc

SEQ ID NO: 6779027 - DNA, 91 bp, Homo sapiens
caggttatctggggaaaaaaatcagaatgtggtgggttacatttgcacaagtgaaacttcacattttgatagatttctccttaataatttg

SEQ ID NO: 6779028 - DNA, 66 bp, Homo sapiens
tctgaaatgtttgagcatctggaagaactgttgctagaaatttgacagatctcagagcattttgga

SEQ ID NO: 6779029 - DNA, 61 bp, Homo sapiens
gtgacgttgctgcccgaggccctacttaaatcaagtgtagctgttggggccagcaggtcat

SEQ ID NO: 6779030 - DNA, 85 bp, Homo sapiens
cattgaaggccataatttgtaagtcagagaggctaaacagtaactgtaatgctttgttttgatctaacttggtggttttgtaatg

SEQ ID NO: 6779031 - DNA, 57 bp, Homo sapiens
ccagggaagattagaagccactcatctgactgagacgcatcctctgacttttcttgg

SEQ ID NO: 6779032 - DNA, 60 bp, Homo sapiens
ttcacattatcaggattgtttcagtgattctcaatctcatatgcattctgttaatgtgga

SEQ ID NO: 6779033 - DNA, 82 bp, Homo sapiens
gctcactgtggatgagggagtgaacaaagatacctgacatgttttagtggacttttatcactgttctcaccatcagactagc

SEQ ID NO: 6779034 - DNA, 58 bp, Homo sapiens
gagagaagaatgttccgaggccgagcggggaagcggcctggtttgattttcttctttc

SEQ ID NO: 6779035 - DNA, 67 bp, Homo sapiens
tagggactcatgagaatgattagattgaattgtaatttttctgttaatgcacatctgtgagctccta

SEQ ID NO: 6779036 - DNA, 65 bp, Homo sapiens
tgtgtctgaacatgctttgtaaatgggaatatcatctgttaattctagagcactgtacagatata

SEQ ID NO: 6779037 - DNA, 78 bp, Homo sapiens
gcctgcagagcacggagactgtcagagctggggtggggcctatcgtccagccccacagcctgcggtctcagcccgggc

SEQ ID NO: 6779038 - DNA, 99 bp, Homo sapiens
gaggcaggagaatgatgtgaacctgggtggcagagcctgcagtgagctgagatggcgccactgcactccagcctgcgcgacacagcaagactccgtctc

SEQ ID NO: 6779039 - DNA, 64 bp, Homo sapiens
ataggaaagataatgaagggttggctgttgacattagtcaatagacaacacttattattcctgt

SEQ ID NO: 6779040 - DNA, 71 bp, Homo sapiens
gaaaagtagtattcatggttttaatttggcagtgcaaatgtatcaaccaactactcgtgttgcttcttttc

SEQ ID NO: 6779041 - DNA, 60 bp, Homo sapiens
cctggagcgcgggtcaagctgggcacgtggccgggcaccagcgggcgctcgcgcgccagg

SEQ ID NO: 6779042 - DNA, 61 bp, Homo sapiens
tgtcaatcataatgaagtgaagaaccccataactggttcattctctattgtgtattgcaca

SEQ ID NO: 6779043 - DNA, 126 bp, Homo sapiens
gggagaagtcacttctaaaaccggggagatggaggaaagcagttagaatgtctgttactaatttttgttaacgtgctgctgtttcctacatctcattcaggcattagtttcaagttccattttccc

SEQ ID NO: 6779044 - DNA, 67 bp, Homo sapiens
gctcaaggaggcctgggctggaagggaggggagctgagaagccccctgggtccaggcttctctgggc

SEQ ID NO: 6779045 - DNA, 96 bp, Homo sapiens
cagcagtcaatttgtccatgttggtcagaattaggtctagagtagcaatttcccggcttacttcctctattttctgagaaacaaaattgcctgctg

SEQ ID NO: 6779046 - DNA, 61 bp, Homo sapiens
ttgcccttctgagtataatctgctgcttgttcattattacatgcaggctgctcagaagcaa

SEQ ID NO: 6779047 - DNA, 58 bp, Homo sapiens
gtctgatttggctgcttcaacagctcaggccagagctagtgacagcatgaattaggac

SEQ ID NO: 6779048 - DNA, 89 bp, Homo sapiens
gtgtgggtgtgtgtatctcgtgtgtgggctgaatgcatgtggatctgtgcccaggtatttatgagagcacatatgagtgtccccatcac

SEQ ID NO: 6779049 - DNA, 88 bp, Homo sapiens
tgtcccatggtcaaggtggtcttgcctgaaactaagacatagctcattgtactgttcaagtcagagcaagccaagtgtgctttggaca

SEQ ID NO: 6779050 - DNA, 82 bp, Homo sapiens
ggggaaggggttggggatagggaatggggttgcatcagcagcagctcttttgattctccctgtccacacattctccatttcc

SEQ ID NO: 6779051 - DNA, 58 bp, Homo sapiens
gccctggcccacgtgcagtccatgtggtgtggctgtgaggaccaggtggggcggtggc

SEQ ID NO: 6779052 - DNA, 74 bp, Homo sapiens
atgcaggctgagaccaccacaccagtgtttgatgactacatcagcatcgggtggtggtggggcttgtcctgcat

SEQ ID NO: 6779053 - DNA, 74 bp, Homo sapiens
gactaaataaaatgaaattgctgtttctgtgggccaaaacctgataagcattagcaatttcataagttttagtt

SEQ ID NO: 6779054 - DNA, 88 bp, Homo sapiens
tctatgtatatctcttttgtaacctgtgatttaatcaatttagacaactgcctttggttagatttgggtaactaagaatatgcatgga

SEQ ID NO: 6779055 - DNA, 129 bp, Homo sapiens
gcttgggtcttgtttggtcaattggtcaaagactggattctctttgttttactcagaggcatgcttgatatccatgcctaaaagaaaataaacattaagttaaagacaatgttgagtaaaagattattc

SEQ ID NO: 6779056 - DNA, 67 bp, Homo sapiens
ccaattttctgattggagagttgaggctagaatttcatttactggaacacttcaagcagaaggttgg

SEQ ID NO: 6779057 - DNA, 71 bp, Homo sapiens
ggatggaggcctctgctgtggctgcccactggctgtgcccaggccttgaagccacagcgaacctctcttcc

SEQ ID NO: 6779058 - DNA, 58 bp, Homo sapiens
gcctggctctgagtttctctcctgcagtcttcaggggacagaaagcaggagtttaggt

SEQ ID NO: 6779059 - DNA, 92 bp, Homo sapiens
taggagaccgcctcaaagcagtcaggctgcgcttctctgataatggaccgttcctatgagactggcagtagctgctgctggccttcctcttg

SEQ ID NO: 6779060 - DNA, 88 bp, Homo sapiens
tttgaattgtcccttattatttcacctagctgcctctagcaccttgcttgggcaggtaggtgaaataatgagggcccctcttttcaaa

SEQ ID NO: 6779061 - DNA, 84 bp, Homo sapiens
tccccaaatcccaatattctggatacacacaggcctttgcaacatggaacagaggctaagagtgtccaaagtttatgggaggga

SEQ ID NO: 6779062 - DNA, 63 bp, Homo sapiens
tgggcaaactgtcaaccatgtcagaacatacggaatactctggatggctcaaagtgttgccca

SEQ ID NO: 6779063 - DNA, 64 bp, Homo sapiens
tgttttcatgttgcagctcagtcagaaatattttttactggccttttgctgaacaaggaaaata

SEQ ID NO: 6779064 - DNA, 99 bp, Homo sapiens
ctgagaaacagacgggtgctgacaactctttggtggaaaaataagttgcagacttatacaagttgcccaaatgattatcaagccgagtttgtttttcag

SEQ ID NO: 6779065 - DNA, 85 bp, Homo sapiens
cagcaggaggagccggtttagatacaaatggattccatggcaactcctgactccacatgacttctaataactggcatttcagttg

SEQ ID NO: 6779066 - DNA, 69 bp, Homo sapiens
gagcaaggtcctgactccacgttctagaggccacttggccgattggagacccttggagtcaacctgttc

SEQ ID NO: 6779067 - DNA, 80 bp, Homo sapiens
taacagtgtgtacattgacaagaacaccggtttgagctttaagttaaatgaaattcaaatcccagttctaccacttgttg

SEQ ID NO: 6779068 - DNA, 93 bp, Homo sapiens
aggaaagttctgggcatgttacattctgtcttttacattctgtaactacaaatagcagtaatagtgcatgctaagaaaataaatgactttcct

SEQ ID NO: 6779069 - DNA, 91 bp, Homo sapiens
tcaggctatgtattcaagtgaagctcaggctctgcagggactaaggatgcctttagccctcagcttggagcgtgggaatgctgatgtctga

SEQ ID NO: 6779070 - DNA, 67 bp, Homo sapiens
ggctaggctctcagggtccctgcggaggagcccacagcctttctcccccaagccctgggagtgagcc

SEQ ID NO: 6779071 - DNA, 56 bp, Homo sapiens
aaggcctccaaggacgggcgccgtgcgcggcaactgcctgcagttttgaagccctt

SEQ ID NO: 6779072 - DNA, 92 bp, Homo sapiens
acctctgattttttttgcttccaggtctttggccttggcactctttgtcatattagagttcctgggtctaggcctgggcaggattcataggt

SEQ ID NO: 6779073 - DNA, 69 bp, Homo sapiens
gaagtaggatatgagcccagatcttctcattctaaatctaaagttcttcagctctgtgtatcctgcctc

SEQ ID NO: 6779074 - DNA, 97 bp, Homo sapiens
gggaaacacagctgacgttaattttattctgttattctgcagtgagattgctaactggggcagtttagtagatgacattatttcagctctgttttct

SEQ ID NO: 6779075 - DNA, 113 bp, Homo sapiens
atcacctggaggattgttagaacagattgctgggcttcacctccagagtttgtggtgcatggatttggaggagggccagaaaagtctgcatttctcacagccttccaggtgat

SEQ ID NO: 6779076 - DNA, 72 bp, Homo sapiens
tctaaatcccaacatgatatcaggagcttctacatgcgctttgtaagaatggtgtctggtgggagttttaga

SEQ ID NO: 6779077 - DNA, 91 bp, Homo sapiens
cacggagctgtctgagaacttcaaatgtgacaatgtgaatattccaaggaaaagttcaagtttactttgaagtttacttttaagtactttg

SEQ ID NO: 6779078 - DNA, 70 bp, Homo sapiens
ctggactgtgtctctgtgtccttctggggctccaggacgtctgggccacctggactcagagccaggccag

SEQ ID NO: 6779079 - DNA, 73 bp, Homo sapiens
cttggctgtgacagtttctcagactttccttgttttttgatgatcttgagagttttgaggaatagcaatcagg

SEQ ID NO: 6779080 - DNA, 55 bp, Homo sapiens
tgcaggaacttggttttactcagaacaaaagcgatgtggaataaagtcttctgca

SEQ ID NO: 6779081 - DNA, 68 bp, Homo sapiens
ggcaactagaattttaattgggtatatattgacaaattatgttacatgagagaagttctaaagttgcc

SEQ ID NO: 6779082 - DNA, 88 bp, Homo sapiens
gcacaggccatcatgaaaacttgacaagtgaggtagtaggaattaatactcctttttttagttaagttgtctatgagggattctatgc

SEQ ID NO: 6779083 - DNA, 65 bp, Homo sapiens
tttttaagctcctttgatgtcaggcattatttcttgctcttcttgcctgacattgagctgagaaa

SEQ ID NO: 6779084 - DNA, 84 bp, Homo sapiens
gttggtcaggccagggcactgctctttagtttttgaaactttccttccttttcatgtcttgaggtttggtgcttggttgatagc

SEQ ID NO: 6779085 - DNA, 103 bp, Homo sapiens
ttagatgggaatattgctcaagccctggaggttgaggctgcagttaactgtgattgcaccactgcagtccagcctaggtgatagagcaagaccctttctctaa

SEQ ID NO: 6779086 - DNA, 100 bp, Homo sapiens
ggggcatgtggaagggtcttagtttctgtttaggggtgatgtgatggtgctggtttcatggttaagtccagaaaggaagccaggttccctttctactccc

SEQ ID NO: 6779087 - DNA, 55 bp, Homo sapiens
tctctctttttaatcatgtaatgtgctataaagcatgatatattgacaagaggga

SEQ ID NO: 6779088 - DNA, 60 bp, Homo sapiens
ttgcagatatttccgatgctatacaagatatatctcatagtatgggtgtagattctgcaa

SEQ ID NO: 6779089 - DNA, 85 bp, Homo sapiens
agtgtatatgcatgcatactgtgaacatacatgcatgcattcacatgcatgcataaatgtacacacacgcacagacatatacatt

SEQ ID NO: 6779090 - DNA, 71 bp, Homo sapiens
ttgatgctgttgtaagaattaattaatgttttgaaagtgttttgaacatgaaaagtcttacacgcatacaa

SEQ ID NO: 6779091 - DNA, 60 bp, Homo sapiens
cagaggtggagctcttggcatcatggcagactaagttgatgttgacagttcccattgctg

SEQ ID NO: 6779092 - DNA, 73 bp, Homo sapiens
acttgcactggtccactcccatgggtggtcttatctgccaagatgtggccggctagggagagcccttggaagt

SEQ ID NO: 6779093 - DNA, 65 bp, Homo sapiens
actgaggcctaactcttgactttttgacagtggtgctcataagaaagtttggggctgggcacggt

SEQ ID NO: 6779094 - DNA, 97 bp, Homo sapiens
tccagaacaatataaagcagtgtaacaggttgaagagactttaaattagatcatctggtacagagcttctcaaacttggcactattgatattttggg

SEQ ID NO: 6779095 - DNA, 57 bp, Homo sapiens
atggagagtagacagtgagtttccgcacaaggaaattatcatcacctaattctctat

SEQ ID NO: 6779096 - DNA, 64 bp, Homo sapiens
gagccagttggctatgaggaggagggaagcgcattcaccttttgtcttctttatgttatggctt

SEQ ID NO: 6779097 - DNA, 71 bp, Homo sapiens
ggtctggattcagagcacagaagaataggtgctgtctctccagcacccagcatctgtgcctaactccagcc

SEQ ID NO: 6779098 - DNA, 58 bp, Homo sapiens
tagggaagctcctgattcccctgctctattcacaccagggagtcatgatgtttccttg

SEQ ID NO: 6779099 - DNA, 117 bp, Homo sapiens
catttctattttatgtgccaaagttactacgaatgtgagcaatactactgatctcggttttattttaaagtgattagtatttgcagatttgtgtcaatttacatatttatggggatg

SEQ ID NO: 6779100 - DNA, 112 bp, Homo sapiens
agagctcttataaaattgccaaaataactgatttgatctggttaacagagacctaatccacagtgtttccttttggctaggtgtgaaaaagtttggcactatgaatggtttt

SEQ ID NO: 6779101 - DNA, 56 bp, Homo sapiens
aaattgcaggtaggtgggtgattgacttggccaatgatgtcaccttctgtcagttt

SEQ ID NO: 6779102 - DNA, 72 bp, Homo sapiens
gtttctcgctatagcaagctttgagctttcagagaacttatatttgaaaactggatcttctatggcagagac

SEQ ID NO: 6779103 - DNA, 56 bp, Homo sapiens
acttggaatctgtttccctagactatactttctcttgggcatcttggattccaagt

SEQ ID NO: 6779104 - DNA, 56 bp, Homo sapiens
ccaaccattggctaagaattggtgtatatcacatctctggcttggattatggttgg

SEQ ID NO: 6779105 - DNA, 83 bp, Homo sapiens
ggaaagggtgcgacctaggagtgagcaaggtctgggggaataccatgcaccatcttcattcactcctcagtagttctcttttc

SEQ ID NO: 6779106 - DNA, 56 bp, Homo sapiens
gcgccagctttgtttttactagagatagatacatgttgctgagagcagggctgggc

SEQ ID NO: 6779107 - DNA, 83 bp, Homo sapiens
tgagcttggggaagtgggtcagggacagatcttgcaaggttgggatgtaatctgatttctgatttatttcataagaaggtcca

SEQ ID NO: 6779108 - DNA, 57 bp, Homo sapiens
attgttgctaggattcaatgagttaacacacacatagaacagctcctagcacataat

SEQ ID NO: 6779109 - DNA, 56 bp, Homo sapiens
ccttgggggagattgtgcatctctaagaaaccaaatctttgagtgctctccctggg

SEQ ID NO: 6779110 - DNA, 77 bp, Homo sapiens
tgatacaactaaccaataaccaataagatacagactttgagttttgtgtttcagaagttatgggttgcaatgtttta

SEQ ID NO: 6779111 - DNA, 70 bp, Homo sapiens
gtaccttagcaaggcagaattcagactcaggcttttctgatcacaaagcactttctgcttcctaatgtgc

SEQ ID NO: 6779112 - DNA, 123 bp, Homo sapiens
agtgttggtgtctatatctgggccctggatgtacaggcatgttgggttgttcaagaataatgcagtgcttcatatgcctgtaatagcaacccagggctggtctttgttgttcacacccacact

SEQ ID NO: 6779113 - DNA, 89 bp, Homo sapiens
ggagaatcacttgaacccaggaggaggaggttgcagtgagcagagatcatgccattgcactccatcttgggcaacaagagtgaaactcc

SEQ ID NO: 6779114 - DNA, 130 bp, Homo sapiens
gcgagctccagaggtgcctcccatgaacagaaaggatgctgtcaggcctgtcgtgagtcccagggcactgagctgtgcagggactggcacagggctgggagctggtaggtcccagaaacaggagctgtgc

SEQ ID NO: 6779115 - DNA, 108 bp, Homo sapiens
ttttttcaggctttacattgcagtaatctggtgaaattgttgacagtgctactgtgacccataaatacattttattcagatacctgcagattgaaatttctgaggaag

SEQ ID NO: 6779116 - DNA, 85 bp, Homo sapiens
gctctcgcctggtgtcatggatgtcacatgatagaaagttttatgtttgtttctgacattaggcaaacaaaaaccttttgagggc

SEQ ID NO: 6779117 - DNA, 77 bp, Homo sapiens
gttaaaaatgcagtttcctgagacccactctatttactggctcttttagatggagctctggagtctgcaattttaac

SEQ ID NO: 6779118 - DNA, 55 bp, Homo sapiens
agtttcatatgagcctgtggttgccagagatgtaaacattggttcaaataaaact

SEQ ID NO: 6779119 - DNA, 77 bp, Homo sapiens
tcattttgtgctagacactatggctaaaaccaaataaagacaaggttcttcccttcatggtgtttacatactggtga

SEQ ID NO: 6779120 - DNA, 98 bp, Homo sapiens
ccatgctgatcagtttggccatatattatggactgcagaatctcccaagcattctcattttatgtgcattcacataattatgatcctggtcagaatgg

SEQ ID NO: 6779121 - DNA, 66 bp, Homo sapiens
gatgaaggaagccttgctcttgaaaaagttgtatttggtgtaacccaggagcaggtttccgaagtc

SEQ ID NO: 6779122 - DNA, 96 bp, Homo sapiens
cagggacagccacagaactcctgaggcccagttccttgttcctaaaatgggggtgataatggagcctgccttccagggttttctgagctgtaactg

SEQ ID NO: 6779123 - DNA, 66 bp, Homo sapiens
gaattatgcaatttttatcaattcagcaaaatgtacacatgtgctgtggtgagggtttcatctttc

SEQ ID NO: 6779124 - DNA, 62 bp, Homo sapiens
ccgcaccgcagccagcgctgccgtcaggccgtccctgggcatcccgcgtctggctgctgtgg

SEQ ID NO: 6779125 - DNA, 86 bp, Homo sapiens
aagcagagttgattactgtatttagaaagaactccctgaccttctctgtggatattctttatagatacagtcttaaactcaagctt

SEQ ID NO: 6779126 - DNA, 59 bp, Homo sapiens
tttggaaatgtgtttcgaaaactggtgtccccatttaggacccagcacattatttcaga

SEQ ID NO: 6779127 - DNA, 92 bp, Homo sapiens
cactgaaagtacaaagcagtggttattcagtcactacagagacagttctgcaaaagtgataatgtggtaattatttaagactgtgctaagtg

SEQ ID NO: 6779128 - DNA, 90 bp, Homo sapiens
cctgagttttaatatgagctctgacactgactagccgtgtgactatggtcaaggcacttcatgtctcagttttctcatttgtaatttggg

SEQ ID NO: 6779129 - DNA, 78 bp, Homo sapiens
gttatggaactgggtgaaggcacgtgaaggtgtgttatgtcattttaattttgtgtgtgtttataagctttccataat

SEQ ID NO: 6779130 - DNA, 130 bp, Homo sapiens
cgtgctgtataccaattgtaagcatgcatctttctcagactttggattcattatctggatataaaattcatatcctaataaaatgaagtatgtagtgagaagtgtgctcaagtcaagcagcccatgaaag

SEQ ID NO: 6779131 - DNA, 62 bp, Homo sapiens
agcagagtctggtaggtgctggtgaagctcatgacagcccactcatcatgtgctgagctgct

SEQ ID NO: 6779132 - DNA, 55 bp, Homo sapiens
cctcttggtgtgttctcctgggatctttttgttctagactctcacagccaggagg

SEQ ID NO: 6779133 - DNA, 55 bp, Homo sapiens
gcttagctgaagagggtattgtaggtaaaagcttcagagtcttttttagtaaagc

SEQ ID NO: 6779134 - DNA, 76 bp, Homo sapiens
gtttccaagctcctgagtagctttactcatcaagtagaggcattttggtacaagcagactcagcagaggtggaagc

SEQ ID NO: 6779135 - DNA, 115 bp, Homo sapiens
aggcctgacgctgcccctccttccagccggcacccaggccgagctcagccacacctgaagagccgctccggccagggaggacatgcccggcagagacagggtgcagagacagcct

SEQ ID NO: 6779136 - DNA, 63 bp, Homo sapiens
gctttgaatggatgcttaaggacacttgctgcctgcagtaaactttctcaggctccctagagc

SEQ ID NO: 6779137 - DNA, 83 bp, Homo sapiens
atatagggaatgttaactaatggtctaacatttcttaatctttactttgtatcaaatggggctattacttaaattctttgtat

SEQ ID NO: 6779138 - DNA, 56 bp, Homo sapiens
gttggtggcccctgggagatgctggcccgggagccaggggctagggggccaccagc

SEQ ID NO: 6779139 - DNA, 85 bp, Homo sapiens
ttctgaatcacaggtgaagtcctttagaatactgcttcatgtaggggagaagaagtgtctttatagactgacaattgattaagga

SEQ ID NO: 6779140 - DNA, 110 bp, Homo sapiens
gctaatggagttggggaatgggtttgcaggttgaatcagcagactgtagaaaaaagcaaacagtccgtttcatgccacacttgctccacacccgtcctctctctatcagc

SEQ ID NO: 6779141 - DNA, 76 bp, Homo sapiens
cctttgtctagtgcctcttgtctacggttttctgctagatacagaaagtatcaagggaagcattttggatcaaagg

SEQ ID NO: 6779142 - DNA, 57 bp, Homo sapiens
ctggtgcaaggctttggaatccaacaaatataatttggaatctggtctgacactcag

SEQ ID NO: 6779143 - DNA, 84 bp, Homo sapiens
tgtatgtgagtgtgtatttgtgcatgtgtgtgtgtgcatgcatacctgtgcgcacacactcaattgcataagcacctccaaata

SEQ ID NO: 6779144 - DNA, 101 bp, Homo sapiens
ggcagcaactgtgagaggatgaacttgattctgctgatctcggacggaaactgattcttgggagagagacagaatcaaacggctctgacatttgaaaagcc

SEQ ID NO: 6779145 - DNA, 58 bp, Homo sapiens
ggtgttcttctgcatggtgactgagaatgtgagcctcagaatgaaatgtaagaacacc

SEQ ID NO: 6779146 - DNA, 55 bp, Homo sapiens
tgtgacccctgaaaatggctgctgccattaggtaatggccatggcgggggtcaca

SEQ ID NO: 6779147 - DNA, 87 bp, Homo sapiens
tatacaagtgtctgtttgtatccctgctttcaattctttcgggtgtacccctgggattgaattgggggatcacataggcattctata

SEQ ID NO: 6779148 - DNA, 66 bp, Homo sapiens
gcacaaaaaaactggaagccctcgaaggagacctaagttcagatcagggctcacacgttttctggc

SEQ ID NO: 6779149 - DNA, 60 bp, Homo sapiens
ggaattcaagctttatgtgttttaaggacctcttattatcttagcatagacttgagtccc

SEQ ID NO: 6779150 - DNA, 78 bp, Homo sapiens
atcatttgtctgttcgttcagtcaacaaatgtttattaaacatctattatgtgctgagcaccaaaataggctgatgat

SEQ ID NO: 6779151 - DNA, 92 bp, Homo sapiens
ctcaccctttgaagggcagaggcagggccctcctccaccccttcctgcccaaagggctggtggcagcccagcctctgcttacataacctgag

SEQ ID NO: 6779152 - DNA, 64 bp, Homo sapiens
tgtggtgatggatgcacaattctgtatatatactaaaacccactgaaatgtacacattaccaca

SEQ ID NO: 6779153 - DNA, 90 bp, Homo sapiens
tgttgggtccgggtgctctgtgggactctgaggaaaagctcgcaccaggtagatgctgttctgtccccatgggtaaaggacaccccaaca

SEQ ID NO: 6779154 - DNA, 70 bp, Homo sapiens
tttgtcatttaatagcttttgtcttttttctatgggaaagacaaggttgtactattaaaatagtgataaa

SEQ ID NO: 6779155 - DNA, 57 bp, Homo sapiens
ttcatactcactccaataactggataacacaggccttggggggattttgagtttgaa

SEQ ID NO: 6779156 - DNA, 130 bp, Homo sapiens
actcctgggttctatctgaagtcaaataccaaggagaaggtgcaagcttcgccttctggaataaattcagtgaactgccaagcttccattctctctccttggtacttgacttcagacaggacccgggagt

SEQ ID NO: 6779157 - DNA, 82 bp, Homo sapiens
acctggcttgcctacatcataatttcattgtgtacatcaagtaagactttatgtactaaagaaatttgcaggccatacaggt

SEQ ID NO: 6779158 - DNA, 58 bp, Homo sapiens
gaaggcaaggcttccagctcccctttggatgcaccactgggaagtcccgcctgtcttc

SEQ ID NO: 6779159 - DNA, 63 bp, Homo sapiens
gtgcaattttgcatctgtatgctgcatatactttgcgttctctgtatgacatgcgaaatgcat

SEQ ID NO: 6779160 - DNA, 68 bp, Homo sapiens
tagctggctagggttaggtgatcagatgggtcagcaaatatttattgagcacctaatgctgggcactg

SEQ ID NO: 6779161 - DNA, 78 bp, Homo sapiens
attgtatacaaaatgttttctctgtgaacacattcccatgtgcagcttttctagagaaggcccatgcttttatacaat

SEQ ID NO: 6779162 - DNA, 67 bp, Homo sapiens
ctgttggctcatggaattagctattatttcggcaatggaaaggaattatggttatctagagcaagag

SEQ ID NO: 6779163 - DNA, 60 bp, Homo sapiens
ggctcctgtggcaagacagcttgctcccagggagaagcttcctctgagtagcaggagacc

SEQ ID NO: 6779164 - DNA, 75 bp, Homo sapiens
tcccaggcctcaaactgcaatgacaggtaggagatcctcctctcctcctctatgcggggcagtgtgatctggaga

SEQ ID NO: 6779165 - DNA, 77 bp, Homo sapiens
cacacacaggccttagtaggtgctcccttcccccatcatgcagccatctgccagggggcactttcttcttgatggtg

SEQ ID NO: 6779166 - DNA, 76 bp, Homo sapiens
gatgagatcatgataccgcagattcatggcaatttcgacaaacagcacagaactctatattcatgaacaactcatc

SEQ ID NO: 6779167 - DNA, 71 bp, Homo sapiens
agagccctgactgatgcagtgggtcacctcctaaggttttactagcagagggctgatgccattgcagctct

SEQ ID NO: 6779168 - DNA, 97 bp, Homo sapiens
cataaacagtgtatgcttcaagaagggagaacaaagattctgtaaagatctatgtcctaggcatttctcttatatttgacagccaatagtgtttatg

SEQ ID NO: 6779169 - DNA, 59 bp, Homo sapiens
ggcatatccagcctacatttattccctgccttgagagaaaagatgagaactggatggct

SEQ ID NO: 6779170 - DNA, 130 bp, Homo sapiens
agtgttgatgtgtggttttcattcctggtgcctctcgcctttccatcttccttccttacctattaagggcttaagggcattctgcagctctggggtaaggggtggggagcaggcgcccacacttcggcct

SEQ ID NO: 6779171 - DNA, 79 bp, Homo sapiens
agctttgaccgtttagtgagaaatgtgacaaaatgaacactcaaattacacatctagcttacaaaacaggtcaagagct

SEQ ID NO: 6779172 - DNA, 69 bp, Homo sapiens
ggatgaaggcaccaaggaagaatctatttgaggccgtctccggcccattcccacatggtggctccatcc

SEQ ID NO: 6779173 - DNA, 65 bp, Homo sapiens
gagtaggcaaggtagctctgttaatttattgtcaggaaatttgatgaagttgctctgcttgactc

SEQ ID NO: 6779174 - DNA, 67 bp, Homo sapiens
gctggcccctcctctggtgctgccaacccgctgccaggcagaggggaggcccagaggagagggaagc

SEQ ID NO: 6779175 - DNA, 74 bp, Homo sapiens
ttcttgtctgcttgatgagtgtgccaagcaataatctcttgttttggtgttttcatctaagctgttgagaagag

SEQ ID NO: 6779176 - DNA, 61 bp, Homo sapiens
atgtctttcgcatcagtagctagggcacaaatatttctgccttctgatttcgagaagatat

SEQ ID NO: 6779177 - DNA, 74 bp, Homo sapiens
ctccttttgccatggaaggtaacatgtccacaggttccagggattaggacatggacatcttcggtgaacaggag

SEQ ID NO: 6779178 - DNA, 63 bp, Homo sapiens
ggcagagctatcttctggatttggctcctttcacattttgccaatgccaggagatggcctggc

SEQ ID NO: 6779179 - DNA, 58 bp, Homo sapiens
gtgttagcagtggagtggacacggaatgttctctgattcctcactctatgctgatcac

SEQ ID NO: 6779180 - DNA, 72 bp, Homo sapiens
gtatagcaaagattagacatatagtcacataggtatatattcatatgaagatatatctgatctctgctatac

SEQ ID NO: 6779181 - DNA, 67 bp, Homo sapiens
tattcatgtgttggaaaggaactgggataattaaatgctttcctacattcctttccttcattggatg

SEQ ID NO: 6779182 - DNA, 66 bp, Homo sapiens
caggtcagaggcgcagcccccacctccagccccctgaacatgtgggggttgtgttttcttgacctg

SEQ ID NO: 6779183 - DNA, 61 bp, Homo sapiens
tgtcttctgtctgtctggcatgtgtcttatttgagggtaaatgccagggagacaggaacca

SEQ ID NO: 6779184 - DNA, 63 bp, Homo sapiens
tgtgtctgtgtttgtggccggtctgcctctgtgcctgggtcagaccccagaccagcagacaca

SEQ ID NO: 6779185 - DNA, 59 bp, Homo sapiens
aaattatgaatacgagcaactagcatctaggcaactgggtctgctctgtttaatgattt

SEQ ID NO: 6779186 - DNA, 91 bp, Homo sapiens
gtttaactgctttgctgagtcttgcctgtgctgtctcccagccacctatcatagtgcctgacatatggtaagagctcaacaaatgttaaat

SEQ ID NO: 6779187 - DNA, 84 bp, Homo sapiens
atgttggcagtccctccaacacagtattagaatacttctgtctctattctacattatgtttattgggactggggaggctaacat

SEQ ID NO: 6779188 - DNA, 62 bp, Homo sapiens
tgatggacaatagtgttttaagaaccagacacaaactctgccttattcactgttatttatca

SEQ ID NO: 6779189 - DNA, 63 bp, Homo sapiens
gtggaaatgtgtgtggtagaatatttgagacaagaacatgtattcaagccacatacattgcac

SEQ ID NO: 6779190 - DNA, 87 bp, Homo sapiens
gcattaataaagacaatttcgagctgtagtcaaatttggagggaataaactaccccttttccttatactgaaagtcttttaatatgc

SEQ ID NO: 6779191 - DNA, 59 bp, Homo sapiens
ggaagcagctgtttccaggcgttgttgccttccttggagcaatgcacacagctgcttct

SEQ ID NO: 6779192 - DNA, 56 bp, Homo sapiens
tccttatagcccaagtgatggagtcagcctccctcagagcacatgggttttgtgga

SEQ ID NO: 6779193 - DNA, 56 bp, Homo sapiens
gtataggtagccatatttgatagtatagatctatatgtgtctgtggttacctatat

SEQ ID NO: 6779194 - DNA, 59 bp, Homo sapiens
gcacctggctggcaatttataatttttaaaaggtgattctgattaccagccaggcttgc

SEQ ID NO: 6779195 - DNA, 62 bp, Homo sapiens
gcctgctggcccatgaagacgcagtcgatgcactgggtcttttcctgtggccaatttcaagc

SEQ ID NO: 6779196 - DNA, 81 bp, Homo sapiens
gtgccccatgggctccaggagccctaagagagtccttttcactattgtgacttcttgctgggcctggggcacctggaacac

SEQ ID NO: 6779197 - DNA, 83 bp, Homo sapiens
aataatgggaaaagtttaaagtaagatttcatggttttttattatgcagtaaaaagcagctgagattttctatttctattatt

SEQ ID NO: 6779198 - DNA, 78 bp, Homo sapiens
ggcttggtctctaacacagctttcagtcattatctcagtgctttgagactagtaaagaggatgtgttaaaggcaagcc

SEQ ID NO: 6779199 - DNA, 59 bp, Homo sapiens
ggttgcttccacctcttagctattgtgaacaatgctgctaagaacctgggtacgcaact

SEQ ID NO: 6779200 - DNA, 70 bp, Homo sapiens
gataagcaggtaagaatggcagaacactggcttattgtcaaccaatgtttttttatatacctgaagtatt

SEQ ID NO: 6779201 - DNA, 69 bp, Homo sapiens
ttgcttgaggctgaggaggtcgaggttgcagtgagccaagattgcaccactgcattccagcctgagcaa

SEQ ID NO: 6779202 - DNA, 79 bp, Homo sapiens
gcgcattgagactttctgaagtttaagttctaacttacgtcttctaaattagcaaacctggactacagatcaaagcagc

SEQ ID NO: 6779203 - DNA, 69 bp, Homo sapiens
cagaccgctggcaatgcgtacatctgcatgctgtacaggccagaagctgcagctcattgctggggtctg

SEQ ID NO: 6779204 - DNA, 83 bp, Homo sapiens
aggtagttttttgccattgcctgtcagttgtgagagatcattgcctcaggccacagcgactaggtgtgtggcagagttaacct

SEQ ID NO: 6779205 - DNA, 72 bp, Homo sapiens
tgcctggcctgaagtgcagagagttggtctgtttaacaaagcaggcacgctccctgcgcgatggtcctggca

SEQ ID NO: 6779206 - DNA, 129 bp, Homo sapiens
ggaaggtctattgtcccttccttactggtgtgtgcacatgtgtatgcatgcatgcatgtgtaatagcacatgcatttatgtgtgtacattgcatgtgtggtgtggtggagggcaccaaataggcctttc

SEQ ID NO: 6779207 - DNA, 86 bp, Homo sapiens
gtgagagttaaatgaaatggtatgtacgatgtgcttcacagaattcctggcatataacacatgctcattaaatattagctattcat

SEQ ID NO: 6779208 - DNA, 67 bp, Homo sapiens
ggaaggaatatgggccaattctgagggctaattgtctttgctctcaacaagagcccatgctttttcc

SEQ ID NO: 6779209 - DNA, 100 bp, Homo sapiens
tcttagttattgggaataaagttggagtgaacatgagattgtcgatgtctgtttgatgtaccaattttcaattccttcagatatatacccaaaactgaga

SEQ ID NO: 6779210 - DNA, 60 bp, Homo sapiens
cttccatacgcacaaagataggggtaggggaatattccctgtgacactgtttgtggtaag

SEQ ID NO: 6779211 - DNA, 60 bp, Homo sapiens
agcataatattgaagagccttggccacggagtcaggctacctaagttctcaatattggct

SEQ ID NO: 6779212 - DNA, 116 bp, Homo sapiens
tctcctttaccctatagttagataaccaaaacctgccatgctcttttatgaagactagatattatattctaaaagtttacgtgaaggtgttatgtgttcaaactacagcttggaga

SEQ ID NO: 6779213 - DNA, 76 bp, Homo sapiens
ctgcgctggggtcacctctgacctgctcctcctcttctggagcttttgaacatctcagaagtgaccctgagcccag

SEQ ID NO: 6779214 - DNA, 57 bp, Homo sapiens
gatggtggaggaatcgctgaagagcccagtaccagttcagcaagtgtctctactgtc

SEQ ID NO: 6779215 - DNA, 128 bp, Homo sapiens
gctgtactccagcctgccacacttctgaaggcactcagtgcttagtgtgttttgggctctgtatcctgagacctcccacagcatgcaggcctgacacttgccgtgggtgtggaggtgtggaaagtggc

SEQ ID NO: 6779216 - DNA, 65 bp, Homo sapiens
gagagttcttgcctgggtattattttctttgtcctaaaagaatgggcccaagtcagtgaactctt

SEQ ID NO: 6779217 - DNA, 83 bp, Homo sapiens
gcccttggccacgtagaagtgccgcgagatgaagctgacaatggcgtccgtgcagcggtagttctcgtggaagaccaggcggc

SEQ ID NO: 6779218 - DNA, 75 bp, Homo sapiens
agttgagcctggggagaagcgactcggctggcacgctggcttccagccctgccctgtccttcccgccggccagct

SEQ ID NO: 6779219 - DNA, 55 bp, Homo sapiens
ttagagttaggatttgtctttaggtctttcctcaaagccataagcctaatactaa

SEQ ID NO: 6779220 - DNA, 74 bp, Homo sapiens
tccatttccttcggacagtttgggtttggttttcttttacctgagactcaaagaccctgaatgctagaaatggg

SEQ ID NO: 6779221 - DNA, 62 bp, Homo sapiens
tttgagtctgcttccattttcacttcttggcactgcctgtgtgagtgggaaggggactcgga

SEQ ID NO: 6779222 - DNA, 119 bp, Homo sapiens
cacaggtgccggccggaggggagccgcgagggtgctctgagcccttttgtatccgccctctgctgccagcttcaaaagggctcagagcacagccacgccccttgtccagcccagcagtg

SEQ ID NO: 6779223 - DNA, 55 bp, Homo sapiens
tacagtcttaagtctccctttttcatgtgtaagacaagggagaataatgattgta

SEQ ID NO: 6779224 - DNA, 74 bp, Homo sapiens
catgtatagtttaaaagttagggatgatctataatatagtatgatcattttctaaaatttttgaaaacaatatg

SEQ ID NO: 6779225 - DNA, 55 bp, Homo sapiens
tctcacagatcagcagggggctctaaaggctgctcctcccaccctggtctggaga

SEQ ID NO: 6779226 - DNA, 72 bp, Homo sapiens
gggctgagggaggctgaactgagttggagaccgtacaccttgtcctgaagggagcagcctctactcagctcc

SEQ ID NO: 6779227 - DNA, 74 bp, Homo sapiens
tttgactcaagcctttctttaggagacacaggagggtcccaagaagtttccagaagaaatgccaggaagtcaga

SEQ ID NO: 6779228 - DNA, 87 bp, Homo sapiens
agggtggtctggagcagcttggaggaggatctaagagtctctggattggtgaaatcataggtcctcctcaggcgaagccttcacttt

SEQ ID NO: 6779229 - DNA, 89 bp, Homo sapiens
agagaaaatcttgtcttgtatttgaacaaaatgctctcttaccttagagttggtatatatttgtctaattgcaaggcaagtcaagctct

SEQ ID NO: 6779230 - DNA, 59 bp, Homo sapiens
tagagactgtgccagccccatgctgaactatagcagtgaatgggcagacacggtccctg

SEQ ID NO: 6779231 - DNA, 78 bp, Homo sapiens
cagccactggactctggaggtttcgtatttctactgagaccatttctcaacctatgagcttccagtgttgcatggttg

SEQ ID NO: 6779232 - DNA, 65 bp, Homo sapiens
aggagggaagtcagggactggaattagaataacaatgggttcttctttctactttgtttccccct

SEQ ID NO: 6779233 - DNA, 71 bp, Homo sapiens
catgtaggcattctcctgtatatgtgcatacacacactcctaagttgtgtaaatgtgtacctgcctgcttg

SEQ ID NO: 6779234 - DNA, 82 bp, Homo sapiens
agctcagatgattgcaatgcccgtagcatcctagccataaacaggcttgtgtaccttgggtacttgctgtgttgttctgact

SEQ ID NO: 6779235 - DNA, 70 bp, Homo sapiens
gtttttgcagctcagtaaaagaggagcagctttgctggttgttctgattttcattgacgttgtagtcaac

SEQ ID NO: 6779236 - DNA, 82 bp, Homo sapiens
agcttcttgctgaaggaacttcccagaaacttccccaatcctaaaacagaactttggaatggtaccttcagttgggaaagct

SEQ ID NO: 6779237 - DNA, 57 bp, Homo sapiens
ttgtggagtatcagaacagtttttgtttagaagttggtgaaagctgttattccagaa

SEQ ID NO: 6779238 - DNA, 55 bp, Homo sapiens
tctcttcttgtgttttcctgcctcttcagacagcctgagactagctaagaagaga

SEQ ID NO: 6779239 - DNA, 70 bp, Homo sapiens
gatcccagcctccaaggccccaaggtccacagctctgattctggcaaaggcagatggaagaggctgggtc

SEQ ID NO: 6779240 - DNA, 75 bp, Homo sapiens
gccgttgcgcccaataggagccttcgccgtcccgcttccgtgccggctgggctcgctgattggctgcgctggggc

SEQ ID NO: 6779241 - DNA, 56 bp, Homo sapiens
tgtctcgttgacccagtttatcttcctcaggataaactgtgctggatgatgaggca

SEQ ID NO: 6779242 - DNA, 79 bp, Homo sapiens
tgagtatggggtgaatctttgttgtccgctgagtagggacctaagctgtggacgattgaaagatgctctggggtgctca

SEQ ID NO: 6779243 - DNA, 68 bp, Homo sapiens
gcaagagcagacatttagatttgaactgtattaatgtactctgcagtaaattttaatgctactcttgt

SEQ ID NO: 6779244 - DNA, 69 bp, Homo sapiens
aattcagtttggtacatagttcaaaacagcccctgggtgccgttttatactcatgtgaccaactgaatt

SEQ ID NO: 6779245 - DNA, 58 bp, Homo sapiens
aaggccttgaagaaaaatccaatgagctatgagacgtcactcagggaatcttggcctt

SEQ ID NO: 6779246 - DNA, 58 bp, Homo sapiens
atgagcaggtttaagagaggcctggagaaaatgctgcctctcttgagagttgcatcat

SEQ ID NO: 6779247 - DNA, 57 bp, Homo sapiens
ctggaattctagaattcatggagtcctagagtggactccaggacttgagaattccag

SEQ ID NO: 6779248 - DNA, 63 bp, Homo sapiens
gttacagtaaatgtggtagaaactgttaatcgcttaatgccagtttaaatcatgttttgtaac

SEQ ID NO: 6779249 - DNA, 57 bp, Homo sapiens
gggagagagctgaggggctctgggctgtggcagttacagttgcccccagcctcgccc

SEQ ID NO: 6779250 - DNA, 71 bp, Homo sapiens
cagcagtctcatgattaacatttccaagcaggtcattaatctctaggaaaagcttattattttgattgctg

SEQ ID NO: 6779251 - DNA, 62 bp, Homo sapiens
atgaaacagagtacttaatatattgtgtattgtgattatgtagcagagtatctctgttttat

SEQ ID NO: 6779252 - DNA, 87 bp, Homo sapiens
attacttaagtttatgatgaaaatcttgagatgtcgacttaaaaatgggtaaagaggttacatgggttttcaaactccttaagtgat

SEQ ID NO: 6779253 - DNA, 55 bp, Homo sapiens
tcatgtttgttggaaatgtggcctcttaatggggctcactgaaccagagacgtga

SEQ ID NO: 6779254 - DNA, 88 bp, Homo sapiens
tgagtgtagatgctgtagaagtggcaacactcagaaaaaacagttgaggactatttctgcttttgctatcttaaaagcgatacactta

SEQ ID NO: 6779255 - DNA, 56 bp, Homo sapiens
ctcatctcaacatccctatggagtgcgtcctatcaggatgcccatgtgtagatgag

SEQ ID NO: 6779256 - DNA, 64 bp, Homo sapiens
tgtactataggtaatgtagaccatgaaatttgtttccgttggtctgcattatctgtaatggaca

SEQ ID NO: 6779257 - DNA, 80 bp, Homo sapiens
tttaagattgtttaagacattggcattgactgtaacacctggctgttagaggtctttccaattttatgggttctcttgga

SEQ ID NO: 6779258 - DNA, 59 bp, Homo sapiens
ggctcctggaccagggctattgggggctcgtgtgccagacccagggtccagggaaagcc

SEQ ID NO: 6779259 - DNA, 68 bp, Homo sapiens
tctgacgacagaggctggagcacctcctgaggtcacagcactgctctcagcctctgctatgcatcaga

SEQ ID NO: 6779260 - DNA, 61 bp, Homo sapiens
ctggctgtggtcacaggtaactgacagtttgtgcttcccaagaatcctgtgatccggtggg

SEQ ID NO: 6779261 - DNA, 59 bp, Homo sapiens
cctcttgctgaggtaaccatatcctgcagccatggctggagaaggtggctcagcaaagg

SEQ ID NO: 6779262 - DNA, 82 bp, Homo sapiens
cattacttcatatatgaaaggcttaatgttgttgtaatgttctggttattacaaaagatttaagatctgaaatgaagtaatg

SEQ ID NO: 6779263 - DNA, 65 bp, Homo sapiens
gagcctcagttttaaatttcccatgagatagtatcccatgagacctggtttaaggcacctggttt

SEQ ID NO: 6779264 - DNA, 78 bp, Homo sapiens
gagcatattcttttgaaactattttaatgttaggcttaagagagaatatattgaagtagttccatttgtgagtagctc

SEQ ID NO: 6779265 - DNA, 78 bp, Homo sapiens
ctcagcctcccaaagtgctgagattacaggtgtgagccaccacgcccggctaatggtagcaatttttaagaggctgag

SEQ ID NO: 6779266 - DNA, 87 bp, Homo sapiens
gtgggcacacactgaagggttgcccgcagggtctccagatgagggggagcctgcaggatgggcagcaccttctcctggcttccccac

SEQ ID NO: 6779267 - DNA, 64 bp, Homo sapiens
gtgcctgaattcatttacaactgttgctgctttaaacacttcaggcagaataagtggatggcac

SEQ ID NO: 6779268 - DNA, 72 bp, Homo sapiens
ccataggaatgtacatttagatcatttctgcataatttgtgtgtgtgtctatatgtgcgtgattccagatgg

SEQ ID NO: 6779269 - DNA, 72 bp, Homo sapiens
aaagcactctgtgaggtgcattctatagtatatagcctatgctacagatttatcatgttatatagtgacttt

SEQ ID NO: 6779270 - DNA, 89 bp, Homo sapiens
gcagggaagccgatttggaacttaaacaagctcccaagttgtgatcagtcgagcttggcaagcactgtttgagagagtaggtgtcctgc

SEQ ID NO: 6779271 - DNA, 84 bp, Homo sapiens
agattagcttagtgctacttcatgggttctctgggataggtgtgaaataaaaacagtgggaaagtgaagagcattaaatagtct

SEQ ID NO: 6779272 - DNA, 63 bp, Homo sapiens
gtgcttgcttgaggcgagacatttggaatgctagtttagaatgttttatagctcaagcaatat

SEQ ID NO: 6779273 - DNA, 59 bp, Homo sapiens
gttcttccctttggggattgtgaacatcatgttcaaggcaatatccaaatggaaacgac

SEQ ID NO: 6779274 - DNA, 66 bp, Homo sapiens
actatatcttcttgggttgttataaatatgtaaagtaatcatgacagagtccagaagtagtgtggt

SEQ ID NO: 6779275 - DNA, 83 bp, Homo sapiens
gaccttagggaagttaccgaacctctccatgcctcagttgcctcttctgttacatggagataatggtgcctaccttgtaggtt

SEQ ID NO: 6779276 - DNA, 61 bp, Homo sapiens
gccatgtaaagatgtgtaccttgtgccctggagagctccagggcatcctcacatcgcaggc

SEQ ID NO: 6779277 - DNA, 103 bp, Homo sapiens
attaccatagcagtgaaatttatatgcaacagcattattacaattttcggctactaatgaaattattgtttctgtttgcgatgtgttttggcgctataatgat

SEQ ID NO: 6779278 - DNA, 71 bp, Homo sapiens
tccatccatttgtttcccttgggaaacagcagctcctctgaggtttcccatatctagggagaggaggtgga

SEQ ID NO: 6779279 - DNA, 72 bp, Homo sapiens
tacctatctgctggatttgttgttagggctgaatgaactaaaatgccctcacacggtggccagcagtaggtg

SEQ ID NO: 6779280 - DNA, 57 bp, Homo sapiens
agaatgatggactctccttgagttttgttttagctcacacaggagtttcttctttct

SEQ ID NO: 6779281 - DNA, 69 bp, Homo sapiens
tcgtgcacagtcaacacttattcaccatcaggcaatccatggtgtagggaaacttgactaatgtaatga

SEQ ID NO: 6779282 - DNA, 68 bp, Homo sapiens
tccaggagatacactgcaccagccaagaagcacgaaacacaggaatggaagtggagtgtcttcctgga

SEQ ID NO: 6779283 - DNA, 65 bp, Homo sapiens
tgaggggaggttggggcacatcttgcacctgctcgttttgatttggcctccacactcacccctta

SEQ ID NO: 6779284 - DNA, 60 bp, Homo sapiens
tataccagtattagactgagaaatggagtctctcctgagaaccatctaagtactggtata

SEQ ID NO: 6779285 - DNA, 84 bp, Homo sapiens
gtgaatcgtgtcttaaacagaaagcagatgtacttatctacttagagttattctagagtatttctgtttcctgttcacatttat

SEQ ID NO: 6779286 - DNA, 55 bp, Homo sapiens
atggcccaaaacctcctccctcaatagtgtcttgagtgcggagtctgtgggctgt

SEQ ID NO: 6779287 - DNA, 65 bp, Homo sapiens
ggctctatttgtgtgttcgtaaacatcctctgatggcttctaggaactggacactgaggtgagct

SEQ ID NO: 6779288 - DNA, 64 bp, Homo sapiens
atttggggctctgaaaaagatgtagtaaaaatatattatgagtttgttatttagtgccccaaat

SEQ ID NO: 6779289 - DNA, 55 bp, Homo sapiens
taattgcagctatcattttagtgtgctcagtgctttacatatgtagctgcattta

SEQ ID NO: 6779290 - DNA, 95 bp, Homo sapiens
gcagccctaacaccctaaaccaaagcttttcctctcatttgccagaagcaagcctcagactcatggcaggtgacggggatgagtatggtttctgc

SEQ ID NO: 6779291 - DNA, 90 bp, Homo sapiens
gaatactttaaggccttcttcatgatgtactaccaaacaatgatgtggaatcatggcagttggtcatcatgaaggattttatgaatattt

SEQ ID NO: 6779292 - DNA, 78 bp, Homo sapiens
tgcagcagcctcatctggtttcttattatttccattttatatatataaggaagctgaggcacagagaggttaaatgca

SEQ ID NO: 6779293 - DNA, 55 bp, Homo sapiens
gtgcttctccgttctgcagcacttggctgaggtgccagcagggaatgggaaggac

SEQ ID NO: 6779294 - DNA, 71 bp, Homo sapiens
ttttgaaaactgataaggaaagggagagaatcaagcatgcattctacttttccctatacagtttgtcaggg

SEQ ID NO: 6779295 - DNA, 55 bp, Homo sapiens
actcatatactgttgtttttaagtcttttaaatttagatttgtaagtatgtgggt

SEQ ID NO: 6779296 - DNA, 62 bp, Homo sapiens
ggcgcacgccattggccgtgcgcagcgggtgaggcccgcgtgacggccgctgagcgtgcgcc

SEQ ID NO: 6779297 - DNA, 100 bp, Homo sapiens
tgtgaagaataaatttctgttgctttcaagcctctcagtctgtggtgttttgttatagcagcccaatggactgagacagcataagaggttcctcttctca

SEQ ID NO: 6779298 - DNA, 76 bp, Homo sapiens
ggacagtacaggtagaagtcactaactgggacagtacaatcaaaacaatccaagtgactactgatttttactttct

SEQ ID NO: 6779299 - DNA, 73 bp, Homo sapiens
gggggaaagcaataaagtagcagctcatcagtattttacttgcatgacttgttattttatagggctttttctt

SEQ ID NO: 6779300 - DNA, 92 bp, Homo sapiens
ccaaggtccaggtgagtaggaggctcgctggtcgcacagcctgcccccacctttgggtgctggctcaagtgtgcttcccacctggcacctgg

SEQ ID NO: 6779301 - DNA, 88 bp, Homo sapiens
atagttgtaagcccaattcttctctgtatagaaaggaaacattgtgtacttaatgaattatttatacagagcatttgttgccaactgt

SEQ ID NO: 6779302 - DNA, 82 bp, Homo sapiens
ggaagaacacttcatgattcatttctcaactaagagaatagtgctcttatttttctagtgatcagcttgaagtagttttttt

SEQ ID NO: 6779303 - DNA, 80 bp, Homo sapiens
acaccttctgctctccccagaagacttggagttgctatcatatttctgtggcagctcccagagcttccaagctgaggtgt

SEQ ID NO: 6779304 - DNA, 69 bp, Homo sapiens
accagaactggggactgaggcactgaaggtgctctcctgggctcccacgtacctggtccctcttttggt

SEQ ID NO: 6779305 - DNA, 64 bp, Homo sapiens
gtttccagcttgggcccggggattggagatgtccccactgagagtagggcacaagtgaggaaat

SEQ ID NO: 6779306 - DNA, 59 bp, Homo sapiens
gttcacaggttctctttctaagaaattttagaaaaggagttagagggttgcctgtaaac

SEQ ID NO: 6779307 - DNA, 88 bp, Homo sapiens
tgattgattagcatgtgtgtgtgttctcaattattgatggtaatggcccgtggatgtaatgtgaacttgccaatgctgctgataatcg

SEQ ID NO: 6779308 - DNA, 108 bp, Homo sapiens
gccaggtaagatcaagtgaggaggctgaaccttaggaagcacacagtaaatattcacacttctaatggatagtgctttagttcagctttcttcattcctctgcctagc

SEQ ID NO: 6779309 - DNA, 105 bp, Homo sapiens
gaggctgaaggaggagaatcgcttgaacccgggaggtggaggttgcagtgagccgagatcgcgccactgcactccagcctgggcaacagagcgagactctgtctc

SEQ ID NO: 6779310 - DNA, 66 bp, Homo sapiens
cagctggccctcgtccgacaggtgggttgtccgtgttcctaacccccgggtcctcgggggctgctg

SEQ ID NO: 6779311 - DNA, 64 bp, Homo sapiens
ccctgggcagtgagctgtggtggggtagaggacccttccctccctgccaggcccaacccatggg

SEQ ID NO: 6779312 - DNA, 66 bp, Homo sapiens
ttccacagtttcagaatttatgcagacaattcaaggagattgctgcagttattgaaactatgtgaa

SEQ ID NO: 6779313 - DNA, 66 bp, Homo sapiens
tagataatgaatgccatgacattttccaaataattctatgcaaatgaaaatggtgtttataatctg

SEQ ID NO: 6779314 - DNA, 79 bp, Homo sapiens
gtgacccttgcttgttttgaagaaagatgacagatttcctgcagctctttctacaagcaggcagctgcggaaacatcac

SEQ ID NO: 6779315 - DNA, 80 bp, Homo sapiens
gcaaccactacaccacctccgaggtcagggtctttggtgtcccagaggttctggagaacttggaggtgagtggcatctgc

SEQ ID NO: 6779316 - DNA, 94 bp, Homo sapiens
gaggattctttattgggagagacttctgccttagcaagaagcagcctagaagtttcttgcctggggcagatggttgattctgtgtgcaatcttc

SEQ ID NO: 6779317 - DNA, 55 bp, Homo sapiens
tgtcttattccttctgttcagcaggtgtgtgcatgtcttaggcaagaataagaca

SEQ ID NO: 6779318 - DNA, 91 bp, Homo sapiens
gctaaatgagacaacacaaggaaattgtttggtataacacctgacatgttgtgctaagcaatttgcttaatatttgctattatttttaagc

SEQ ID NO: 6779319 - DNA, 127 bp, Homo sapiens
gggaggcgcaggggccgcagccagccgggtgctgcagcagtgcgggcagctccagaagctcatcggcatctccgttggcagcctgcatgggctgcgcaccaagtgtgctgtgtccaaggacctcacc

SEQ ID NO: 6779320 - DNA, 59 bp, Homo sapiens
ggtgtgtggttttgatacagtctgtggcatcagacagcaaaaatacaaagccataaacc

SEQ ID NO: 6779321 - DNA, 60 bp, Homo sapiens
ggacttcatgtgcaagcgctttgccttaatgagtactgcagcaaatgcacagtgagggac

SEQ ID NO: 6779322 - DNA, 76 bp, Homo sapiens
gaagttcttcaatgtttgttcatgaaaatagtgtgttccttattattaatgttaaagtggataagctgaatgcttc

SEQ ID NO: 6779323 - DNA, 69 bp, Homo sapiens
tgatggcacacaggagagtgctggaggttagtgtcagtttatcttatctctgtacttcctgttgcctca

SEQ ID NO: 6779324 - DNA, 58 bp, Homo sapiens
gtggggcatgcacgctgctcctgatgccactccgtcagagcagcgtggatggccccat

SEQ ID NO: 6779325 - DNA, 61 bp, Homo sapiens
tgccaggcgattgctatcagcaacaatgcctctaaattgctgaaaatgcagctccctggta

SEQ ID NO: 6779326 - DNA, 67 bp, Homo sapiens
tgaaacttcagtgaatgacttatgtttattttaaaatcttagtggcatgaagtcactggagctttca

SEQ ID NO: 6779327 - DNA, 115 bp, Homo sapiens
gggaaacggctggggaggctccacctctttcctccccacaaccatttactgggaagttgtgtatacttggcagtgtgggaggaaggtacttggaagaccctgccagccatctccc

SEQ ID NO: 6779328 - DNA, 58 bp, Homo sapiens
tccccccagcccccacttaccccaagggaacctgggagtgaaaggagggctgcaggga

SEQ ID NO: 6779329 - DNA, 56 bp, Homo sapiens
catttgattcctttactcttattttttaggatctcaagagttagaggagacaaatg

SEQ ID NO: 6779330 - DNA, 69 bp, Homo sapiens
ggctccccaggtccaggagctgtgtcttcagagtggtcattaagagaagttccatggaagggatgagtt

SEQ ID NO: 6779331 - DNA, 82 bp, Homo sapiens
atgggaggaatcctgctcgaatcaaagcagttttaaatgggaagcaccaaaaactgaagtagattctgaaatttcctcctat

SEQ ID NO: 6779332 - DNA, 59 bp, Homo sapiens
gcaagggtgggactgggcggggcctgaataccctctggccacaaatagtctcccctggc

SEQ ID NO: 6779333 - DNA, 71 bp, Homo sapiens
ttttggctttaaggtttaggaagcaatagatctagttacttattgtaatttcccaagccttgaagaaaaaa

SEQ ID NO: 6779334 - DNA, 56 bp, Homo sapiens
tctgaagctataaggaccggtgatactatggagagagcactggctttagcatcaga

SEQ ID NO: 6779335 - DNA, 57 bp, Homo sapiens
ggcaggcaggaaggactaagtaactgcgccattatttttatgccttcctgtgttgct

SEQ ID NO: 6779336 - DNA, 63 bp, Homo sapiens
ctaacctgctaacctactatgattctgggaaggccttccaacagaaatgggtggttgggttag

SEQ ID NO: 6779337 - DNA, 81 bp, Homo sapiens
ggccctcgcatacaaggagtttggggattagtcaggagcccgataaacagctcaggaatcacaaaactccatgtgagtgct

SEQ ID NO: 6779338 - DNA, 55 bp, Homo sapiens
tcagcttgcgttctgggatttactcttgtcttcttgggaaatgtttgcgagctga

SEQ ID NO: 6779339 - DNA, 120 bp, Homo sapiens
atggagccatttattaggattgtacgtagcttcaggatgagggcttaagggactctgtgtgtgaagagcataggctttgtggcatctttgctgctccaagacctttttagattgctttat

SEQ ID NO: 6779340 - DNA, 74 bp, Homo sapiens
ggggcatggaggtgccaggtgtgagggaagaagccattttcacagtcccacccgtggagcctccagatagctcc

SEQ ID NO: 6779341 - DNA, 67 bp, Homo sapiens
gtcagtcatattgtacagatatgttttattctttccccacacatattagcctggatctgtgactgac

SEQ ID NO: 6779342 - DNA, 68 bp, Homo sapiens
ctcagacttagctcaagattaatatgaaaacagggccctccctcaagtcttctttgagttcttctgag

SEQ ID NO: 6779343 - DNA, 58 bp, Homo sapiens
caagcaggttatgaaatatagaaagcctactggttttcctgagtcacaaaacctcttg

SEQ ID NO: 6779344 - DNA, 89 bp, Homo sapiens
gctatgcagctgggagatgctgtgtctgttcccttgatacatatcctgggaatgcaggggactaggacaccatcacctgcccatatagc

SEQ ID NO: 6779345 - DNA, 76 bp, Homo sapiens
ctctctttactggctgggtgactcaggcaagtggctttgcatcactgagcctcagttttctcatctgtaaaatggg

SEQ ID NO: 6779346 - DNA, 66 bp, Homo sapiens
tacttttcccctctcagattggagcagaatagaatggggaaagtgtgctccagagagggagaagtg

SEQ ID NO: 6779347 - DNA, 89 bp, Homo sapiens
acaaggcagaggagatgagttctgtaaatgctcctgggctctcagctgtgtcctaaggtttcgatagagctcttcttcttttaacttgt

SEQ ID NO: 6779348 - DNA, 61 bp, Homo sapiens
ttctcagtctcttgcttcattagttggccctcaggctagtgctagaagcaaagacaaagag

SEQ ID NO: 6779349 - DNA, 76 bp, Homo sapiens
ctctctagaggaccatttcagagttttggcctttgctgataggcagccttgggctgagccatttgaaccttgagag

SEQ ID NO: 6779350 - DNA, 103 bp, Homo sapiens
gagagctataaattcttagcagtttttaagtttgaaaataccttttgtgataccttaattatagcatttattccagatttggagaatggagtttgaagttttc

SEQ ID NO: 6779351 - DNA, 73 bp, Homo sapiens
gggagaagggagaaagtgcacaccttccaaagagctcccaaagctctccgatgtgcacatctccttgtccacc

SEQ ID NO: 6779352 - DNA, 91 bp, Homo sapiens
ggtgaagttttcaggtctgatggtattttatgtcaaaataacaagtcatgagaattgatgaaaattctatgcaggccaggaatccagaacc

SEQ ID NO: 6779353 - DNA, 57 bp, Homo sapiens
tgtccttataaatgaggccctggggcattgctttgtcccttctgccatgtgaggata

SEQ ID NO: 6779354 - DNA, 55 bp, Homo sapiens
ttgatattgataataaccatgaatctgaatgatgtggaagggttatcaatatcaa

SEQ ID NO: 6779355 - DNA, 66 bp, Homo sapiens
actttggagggtgttgtagatgaaaacacaagtttcctaagctttttacacatacctctttaaagt

SEQ ID NO: 6779356 - DNA, 57 bp, Homo sapiens
cagcagcagctaaaggaaagagctctgaggttcccagtttcttgtcggctgttgctg

SEQ ID NO: 6779357 - DNA, 63 bp, Homo sapiens
tgcttaagcaaagtttataaggctcttggtgtcccaaccaagaatacaggctttgtataggca

SEQ ID NO: 6779358 - DNA, 55 bp, Homo sapiens
ggtgagtaggtttcattttgcaatgaaataagatttgcaaactgaaaaattcact

SEQ ID NO: 6779359 - DNA, 77 bp, Homo sapiens
gattttgggtctataccacccatccagagccaggtgtattacatgagctggaagtctgtggtcagagtcctaagatc

SEQ ID NO: 6779360 - DNA, 81 bp, Homo sapiens
ctgaatttcacttccttctgtaagaccagttgtaccagtctcaggttcagagctggcaggagcgggaggctgtggaatcag

SEQ ID NO: 6779361 - DNA, 92 bp, Homo sapiens
agatggaagctggcatctctcagaggtcttcagcctctggaaacaggcccaggggactgaccgaccctcagcatttgatgttggcaacatct

SEQ ID NO: 6779362 - DNA, 123 bp, Homo sapiens
ggggagctgttgactctattagaaactagttgtagagaaagatctttcattaggcactgtcagctatgtgtctgagttagctcttctcagtaattaactaattaaattaagttgtcagcccct

SEQ ID NO: 6779363 - DNA, 130 bp, Homo sapiens
ggcatttttaacatctgggtggtgaccctgctgccatcagagttcaggaattgctgagaggagaagcagcacctgttccctgggtctctgcagtggcagcagctgagatggtaataggtgtgctgatgcc

SEQ ID NO: 6779364 - DNA, 60 bp, Homo sapiens
aggaaatgcaggcaaatactcttccttgagttaaatctgatgtctgtttcctgctttcct

SEQ ID NO: 6779365 - DNA, 61 bp, Homo sapiens
tgctggtagagtaggtacaggaggggcccgctgccctcagctgccacctgctccatcagca

SEQ ID NO: 6779366 - DNA, 92 bp, Homo sapiens
gggcaggacgagctgcaagggggaggatgccaagctgtgcacacggaaagcacctactgttacggccatggcaacctcagctgctcctgcct

SEQ ID NO: 6779367 - DNA, 58 bp, Homo sapiens
tatattaaccatagggttctagtagctgttccagtagtttttcctgtggtttgatatg

SEQ ID NO: 6779368 - DNA, 56 bp, Homo sapiens
ctaccacccaggacaaaatatggaatgtcactggcactccaagagcctgggggtgg

SEQ ID NO: 6779369 - DNA, 79 bp, Homo sapiens
tgtactccttctacattctggaattttattgatcaaaacaaaacttaggtgaggtattagtaaattccatgggagtata

SEQ ID NO: 6779370 - DNA, 86 bp, Homo sapiens
ctgacttcccagcacccacctctgagttggcctgtcttgtctgtcactaccagagagaggccccctcaggctgcagggctgagcag

SEQ ID NO: 6779371 - DNA, 114 bp, Homo sapiens
cttggtcttgaaatgatttttctttaggtcacctttcatagttaaaatagtttgctttcttatagtttactttttgtctgctgagttaaagtggcagagagaattgagcccgag

SEQ ID NO: 6779372 - DNA, 67 bp, Homo sapiens
ctcgctgcagccctgcggatcacttctccaggcctagggctgagggatctctggggactgcactgag

SEQ ID NO: 6779373 - DNA, 128 bp, Homo sapiens
tagatgctgatgaaggtgtggagaaataggaacacttttacgctgttggtggccatgtgagttagttcaaccattatggaagacagtgtggtgattcctcaaggatctagaacctgaaataccatttg

SEQ ID NO: 6779374 - DNA, 80 bp, Homo sapiens
ggcgttggagtcttcagatagagtatttaaggtaacgatattaacatattcagaaagctagaaatgaaaattccaaagct

SEQ ID NO: 6779375 - DNA, 128 bp, Homo sapiens
gagaaaggaagaagttgatgtggtagaaattggggagatgaattgatgttggacagatgaccaatagggtttgttacaaggtttattcagaatatttgacattttttaatatttataaattccagctt

SEQ ID NO: 6779376 - DNA, 76 bp, Homo sapiens
ggcttgcggatgatcagcccatgtttgatcagcttctggatttgctgatgggagttaacattggtctctgggagcc

SEQ ID NO: 6779377 - DNA, 70 bp, Homo sapiens
atcagacatttactcactacctactatgtatcaagtatggtgctgggggttcagatgagtaagacttgat

SEQ ID NO: 6779378 - DNA, 61 bp, Homo sapiens
cacccagcacagagggaggcgagtccacaacccctctccctccccttcccacagctgggtg

SEQ ID NO: 6779379 - DNA, 82 bp, Homo sapiens
tgtaaatgttgtaagtacatctaaggtatgtcaggctaagctatagacgtttggtaggttagatgtattaagtgcattttca

SEQ ID NO: 6779380 - DNA, 103 bp, Homo sapiens
tatctctatgtacattaagagaaacaggaattgagtcgcttgctgaaaacttctaaaaagtccatgacaagacttcagatcttgttcttttgtgtaaaagatg

SEQ ID NO: 6779381 - DNA, 90 bp, Homo sapiens
gtccaacttcattcttttgcatgtggatatccagttgtccaaccacaatttgttgaagagacgatttttccaccattgaatgatttgggc

SEQ ID NO: 6779382 - DNA, 79 bp, Homo sapiens
gaacagtgtttgttgaagtaaacactttataacctggggcaggttatagtattaggtactcaacaagcttcgtttgttc

SEQ ID NO: 6779383 - DNA, 62 bp, Homo sapiens
agctttacatcgaagttcagtcctcaggtagagggctaaatcaaaggctttcaagtaaagct

SEQ ID NO: 6779384 - DNA, 127 bp, Homo sapiens
gtttttcttacttcctggtttctccccaatacttgaaacattctcctattgattcattgcatccatttaagtatctaagttgccagggagtgttcatgatgttggggggatacaggggggacaaaac

SEQ ID NO: 6779385 - DNA, 59 bp, Homo sapiens
tgtatgctgaagtgtgtttgaagtatactgctgtattcaacttatgttttcagcataca

SEQ ID NO: 6779386 - DNA, 68 bp, Homo sapiens
gctctggtgcagtagaaggccgacttctcctgtgtggaagaagttcccctgctctgctgtgggagagc

SEQ ID NO: 6779387 - DNA, 100 bp, Homo sapiens
ctgcctttgcccataactcagatgcgatgcattcaggctgcaggtaccacttcatgctagggctctgcatttacagttagaggagctttctgaaaggcag

SEQ ID NO: 6779388 - DNA, 64 bp, Homo sapiens
cagagatcaacatgtgtcacagactcccagcctgtccgcctctaagacacagttggttcctttg

SEQ ID NO: 6779389 - DNA, 86 bp, Homo sapiens
gtgttgttgttgtttgtttggtagaagtgagagaatttttatactctcagtatagagttttattttccaataaactataatagaac

SEQ ID NO: 6779390 - DNA, 91 bp, Homo sapiens
gggggctgtgcacacaaaaggtatggcctctccctctgccagccacgtctgtagggaaggagaccaagccacagatggatgcacaactccc

SEQ ID NO: 6779391 - DNA, 82 bp, Homo sapiens
ggtatccattgggccttctgaaaccttaattgtagctcgggagtctcagttgcagccttcaggagaccccaggtggaattcc

SEQ ID NO: 6779392 - DNA, 61 bp, Homo sapiens
cagccaactccctctcattgagcatacacttttgagatgtgccagggaagagagttggctg

SEQ ID NO: 6779393 - DNA, 103 bp, Homo sapiens
ttctgattgatgggccatcagttgcacagttgttgggcagtgattgattttccaacccagctgctccagctgtgctgcagatgcgccttgtctgaagtcagag

SEQ ID NO: 6779394 - DNA, 63 bp, Homo sapiens
tgggaagctttaaatgggtgtctggtttgttactttgagtcattttcacccgaagccttctta

SEQ ID NO: 6779395 - DNA, 71 bp, Homo sapiens
ttttcaaaatgggtttcagaaatggtttatgcaatgctaacattggtaaaagaattctgaacttttgagag

SEQ ID NO: 6779396 - DNA, 129 bp, Homo sapiens
tcggcctcccaaagtgctgagattacaggcatgagacaccatgtccggccgcaatgggtagtttagaaaggtcattttgaggcagggcatggtggcccacaccttaaccccagtactttgggaggcaga

SEQ ID NO: 6779397 - DNA, 73 bp, Homo sapiens
gggagccggccttgcggaacgctcaggcgcgctacttcagagcatgcgcagcaagaccgcgcggcccgttcct

SEQ ID NO: 6779398 - DNA, 70 bp, Homo sapiens
gatgctttattgttaggtcatgtaaaaataagcctttgttgtacagttaaatgccctaaaatggagcatc

SEQ ID NO: 6779399 - DNA, 78 bp, Homo sapiens
ggatgggggtatagggtgctcctgggtgtggctgcccctcctctgaggtgcccaggctcaggggctacacccccagcc

SEQ ID NO: 6779400 - DNA, 63 bp, Homo sapiens
tgttttaaagccattgcctttctgcaccttataattgcttgttcttgggggaggcttggaaca

SEQ ID NO: 6779401 - DNA, 95 bp, Homo sapiens
gcaccatgtctggggcagttcaggaaatcaagaagcagatgagtgaatattatttttctgtctgatcatgattgtttctactgctagcttgttgc

SEQ ID NO: 6779402 - DNA, 76 bp, Homo sapiens
gattggtatcgcctggttgctatttgcttaagaacaaatattatacagatgagatcaggcataattttaaaagatc

SEQ ID NO: 6779403 - DNA, 73 bp, Homo sapiens
gcataactctgcatgctataggtactgagaaatcgacacatgccagttctcttggcatgcagtgttcctgtgc

SEQ ID NO: 6779404 - DNA, 67 bp, Homo sapiens
aaggcattgagcagttacagtaaagggcagacatcaggcctctgccagtatgtacctgctgtgcctt

SEQ ID NO: 6779405 - DNA, 99 bp, Homo sapiens
aggttgtcgttgcaagtcaagtttccctagaaagcagactttgtcatggaaactgcatgtatgaagtttactggggagatcacctgggatcaacaacct

SEQ ID NO: 6779406 - DNA, 73 bp, Homo sapiens
tgactgcctccccagcatggcttgagtgtttcctggatgtgtccaggcgggtatcacatgctgggtggcatca

SEQ ID NO: 6779407 - DNA, 85 bp, Homo sapiens
tcttgtctgtctttgtttgcttttctataagaactttcaagtaagcttgtctagttcctaagagaattgtcagggatactcaaga

SEQ ID NO: 6779408 - DNA, 61 bp, Homo sapiens
gaaggaagactggtttaaatgtgcagatatctgcatattgacattgctgctagcttctttc

SEQ ID NO: 6779409 - DNA, 106 bp, Homo sapiens
gagaagacattttaccaaatgttttacctgtggcaactcccttctgtttgttacctctgaagaagcaaagtgaattttgccaagaagcaacgtgaaatgtgttctc

SEQ ID NO: 6779410 - DNA, 80 bp, Homo sapiens
agctcctatcctggtgcctccaacagcccatcctagagggaccttttagtattgggctctggaggctgaaagaagtggct

SEQ ID NO: 6779411 - DNA, 59 bp, Homo sapiens
ggtgacattgcatgtgacttctggagcctgccacgctccctgggctcacacaggtcatc

SEQ ID NO: 6779412 - DNA, 98 bp, Homo sapiens
caaggtcaagaggaggaggtggagggaaagcctctcgactttcttttggggaaggcttccctgtacctaacagcaaaaatccttcaaaatgactattg

SEQ ID NO: 6779413 - DNA, 65 bp, Homo sapiens
ggagggtttctgtcattgtcactattaaccatggctaaagtacccatcacagtgcagaaccctcc

SEQ ID NO: 6779414 - DNA, 87 bp, Homo sapiens
attatctgttatccatagaataagtcatcttacctaccttccgcagtagggatcttttgatgaccattcatgtggggcacaaataat

SEQ ID NO: 6779415 - DNA, 79 bp, Homo sapiens
attagctttggaactttgacaacacgttatttgcctcctgtgggggtgccttggtgtgctgtagggttctgtggttgat

SEQ ID NO: 6779416 - DNA, 55 bp, Homo sapiens
tttctagaggctccaggggagtattgttttccttgccttttccagcttctagagg

SEQ ID NO: 6779417 - DNA, 59 bp, Homo sapiens
tacagtttcccagcagatgcaagccttcaggacttgttattttggtgaggaaattagtg

SEQ ID NO: 6779418 - DNA, 82 bp, Homo sapiens
taattatccctctttagccaggagctcgtaacagtaaagaatctgaagtttgttctttgttgagcaagtaggacgataatta

SEQ ID NO: 6779419 - DNA, 66 bp, Homo sapiens
ctggcggagttgggcgggcggccgcggcggggagcggcgctgtcggctgctcggccgagtcctcgg

SEQ ID NO: 6779420 - DNA, 78 bp, Homo sapiens
aatacatgggattcagtttcatggcacagctatatttagctgaagatagctgtgccatgaaactgaaacccacatatt

SEQ ID NO: 6779421 - DNA, 89 bp, Homo sapiens
gcagacgagcaaatgccatagaaagtattatggaatttcagattaacattgaagtattgtagctttttgtgttgttattcatcatttgc

SEQ ID NO: 6779422 - DNA, 127 bp, Homo sapiens
ctggacactggacctggctggcaccactaggggcccacccatggctgctggctcggtccctggggccctgccccactggcactggtcccagtagcttgggtccctaccagccaggtgctctgtccag

SEQ ID NO: 6779423 - DNA, 59 bp, Homo sapiens
tccaaaaagggatattgacattctagctcccagttcctgtgaatatttccttctttgga

SEQ ID NO: 6779424 - DNA, 59 bp, Homo sapiens
tgtgcctgccctgaaaactgcccatggccctgggtgaggcagcatttgggcagggaaca

SEQ ID NO: 6779425 - DNA, 66 bp, Homo sapiens
gtttggccctagaggcactaatactactggtaactaccatttgtggacagcttctaggtgccagac

SEQ ID NO: 6779426 - DNA, 58 bp, Homo sapiens
gcaggctccaactggaggagttgagaaaatttaactttaatcaagtttggagttttgc

SEQ ID NO: 6779427 - DNA, 74 bp, Homo sapiens
gctcttctgagataaataggtcacagttctctattgggagaacatttgtcgatcaatttgtataacagtagggc

SEQ ID NO: 6779428 - DNA, 85 bp, Homo sapiens
ggaggggttaaattggtctagaattcagggtgacaggggcacatggagcaactttctgaattctgacaatttgaatatagctttc

SEQ ID NO: 6779429 - DNA, 66 bp, Homo sapiens
ggcaggtgaagaggataaaaagttgggaaaaactggactcaaccatgttatttattatcacgtgtc

SEQ ID NO: 6779430 - DNA, 70 bp, Homo sapiens
aaagttaaacatagtttaaaaatgtgtgtgtggatggcacattgacaaagattgagctgtgctggatttt

SEQ ID NO: 6779431 - DNA, 64 bp, Homo sapiens
tgttctttgttcaggaattcgtgcagacactgatcagctgctctgtacaattgagaagagaaca

SEQ ID NO: 6779432 - DNA, 61 bp, Homo sapiens
aggtcaaggttcacaggggatcaagaaatattattcttgtataatctgtttactttgacct

SEQ ID NO: 6779433 - DNA, 55 bp, Homo sapiens
tgggtgtgactgactgtgtttctggatgagattaacattgaacttggcacaccca

SEQ ID NO: 6779434 - DNA, 65 bp, Homo sapiens
tccttacagtgcagtgtgatgagtattctaatggagggatgtactaggcttgctgcagtggagga

SEQ ID NO: 6779435 - DNA, 82 bp, Homo sapiens
aggccacaggtcctggcaggcaagaggaagggaggcctgagaacggcctttgttcccgggatctccggaccagatgtgccct

SEQ ID NO: 6779436 - DNA, 57 bp, Homo sapiens
ctctccaggctgggacaggacctgacccccttcttcctgtcctcagatgtggacgag

SEQ ID NO: 6779437 - DNA, 57 bp, Homo sapiens
agtctttccttttggaagaaaaaagctcacttctttcagtcacataaggaaaagact

SEQ ID NO: 6779438 - DNA, 59 bp, Homo sapiens
accatccaaactgctttctgtggatccaatctgtaatctgcagagcgcgtctggattgt

SEQ ID NO: 6779439 - DNA, 80 bp, Homo sapiens
taggacccttgcgtgaactcctatgacccactgaactccctgggagtgggtgggtatgagggggcctcactagggtcctg

SEQ ID NO: 6779440 - DNA, 73 bp, Homo sapiens
tttggaaaatattgaactggttgaaattagttataatgttctaagaaatgatattagttcaatgtatttcaga

SEQ ID NO: 6779441 - DNA, 91 bp, Homo sapiens
aatttgccactaatagctggctgggattttaaagagcatagtactatgttttaaaatgtattaaaataccatctgttaacattgttaaatt

SEQ ID NO: 6779442 - DNA, 60 bp, Homo sapiens
tcttgcatctaataacatggtacattgtaaatgctcaataaatgtttgttggatgtttga

SEQ ID NO: 6779443 - DNA, 128 bp, Homo sapiens
ggagcaggaaatgagcggttgcagccggcgtggagcgggaagctgttcagtgtcatgggccttatctgggaacaggctgcccaattacagggccgtgcccgctgcacccggcagctgccggctcctcc

SEQ ID NO: 6779444 - DNA, 97 bp, Homo sapiens
aggaatggggcttcgggcgctgggcgcgctccgaacccggcgcacgtaagagcctgggagcgcccgagccgcccggctgcccggagccccatcgcct

SEQ ID NO: 6779445 - DNA, 64 bp, Homo sapiens
gggtagaaagagctttgcttcctttcagaaaccactgagggtgtgctgttgggtctttcagctc

SEQ ID NO: 6779446 - DNA, 99 bp, Homo sapiens
gaggcaggagaatcgcttgaacctggcaggtggaggttgcagtgagccaagattgtgccactgcacttcagcctgggcaacagagtgagactctatctc

SEQ ID NO: 6779447 - DNA, 101 bp, Homo sapiens
ttgaggcaggagaatcgcttgaacacgggaggcggaggttgcagtgagtccagatggcaccactacactccagcctggcgataagtgagactctgtctcaa

SEQ ID NO: 6779448 - DNA, 62 bp, Homo sapiens
ccaggctgcttagccttatcttagtcctcatccgctttcagcccagggagaagcagccatgg

SEQ ID NO: 6779449 - DNA, 69 bp, Homo sapiens
taaaagctcagtgagtttagtcactttttatctttccctttaaatctgaatgattgtactgagctttta

SEQ ID NO: 6779450 - DNA, 107 bp, Homo sapiens
gagaagtcacagcttaatttaccgagcacctacctacctcatgccatgtcatagaggatgacagatgctgtggggaggtaaaaggaactcgttttgcagtgcttgtc

SEQ ID NO: 6779451 - DNA, 77 bp, Homo sapiens
atgaggcatctaacattgcaaaaagaacgttgtctataaataaattcagtctgattgggatgtattagttgtctgat

SEQ ID NO: 6779452 - DNA, 100 bp, Homo sapiens
tttagtgttcattgttcctgctggttattctcttggcctaattatgtgaggaaaacagaatgaaggcaaagggatgggaagcaagggcaatgtggctaaa

SEQ ID NO: 6779453 - DNA, 59 bp, Homo sapiens
taaggctttatttttacaatgccttctctggggttttttgttcaatctgtaaggccttg

SEQ ID NO: 6779454 - DNA, 59 bp, Homo sapiens
tgcagtcaggagctgctgcattgtaagtcatcttacagtacagtctagactctggagca

SEQ ID NO: 6779455 - DNA, 55 bp, Homo sapiens
tatgtacaccaaggattgaaaaggttcacatctttccaatcaaaagtgctgcatg

SEQ ID NO: 6779456 - DNA, 107 bp, Homo sapiens
gtcctctcacccccagcagttgccatggggtttccttccagattcgaggatccttgccacttgaagcctggactcagggtgctccagcgctggggagtggtgagggc

SEQ ID NO: 6779457 - DNA, 60 bp, Homo sapiens
ctcaaagaagggaggtatttggtttcaaattatcaaaacagccttgtactcttcttggag

SEQ ID NO: 6779458 - DNA, 93 bp, Homo sapiens
gccaggagaggggatgcttccaaggctaagacaagaccccttcatttgtgggcttaaatagtttgttttatgagaaatatgccctcctctggc

SEQ ID NO: 6779459 - DNA, 72 bp, Homo sapiens
tgtcctgagtgctggtgataaagaccgaaaagataaacgttatctggtccttgctacccagcaagcaagaca

SEQ ID NO: 6779460 - DNA, 59 bp, Homo sapiens
ttgaagccctaatccccagtatttcagaatgtgaccatattgggagatagggcctttaa

SEQ ID NO: 6779461 - DNA, 62 bp, Homo sapiens
atagtgaggttaaaaattcctgcaatgctaaaacagacttttgcagcatattgatctcctgt

SEQ ID NO: 6779462 - DNA, 66 bp, Homo sapiens
aggaggcatcaggggagatctggtggtcaagggttctctccaccagagccttcccatgctcctcct

SEQ ID NO: 6779463 - DNA, 77 bp, Homo sapiens
ttggtaatttcagtattaggtactgatactaaggaagtaagcatttgcttagattcagcactttttctgagaaccaa

SEQ ID NO: 6779464 - DNA, 79 bp, Homo sapiens
ggtaatctgagccagaaatgaggtagtaacagtaggaatggggagattacattcaatttctagaggtatttagattatt

SEQ ID NO: 6779465 - DNA, 66 bp, Homo sapiens
tgctatagatgttaagcttctagaaggcagggaacctacctgatcttagcagctagcctgtatgca

SEQ ID NO: 6779466 - DNA, 55 bp, Homo sapiens
ctgtcagctgctttcctccgttaccaaggccgaggctggcctcagggctgtgcag

SEQ ID NO: 6779467 - DNA, 130 bp, Homo sapiens
ttcattactcacagaaacagcagtggccaaagtacaaacatttgccctggttctttgagtctcaggaagttgcacaggaaccagggcaaatgtttgtactccggccgctgctgatgctgtgaataataaa

SEQ ID NO: 6779468 - DNA, 63 bp, Homo sapiens
aagcagtcaactgcattaggaaatgagggcaagcttttgttcagtaatgcatttgataagttt

SEQ ID NO: 6779469 - DNA, 84 bp, Homo sapiens
gtatctgcatataaaatcaaggctagaggttaaaattttaatgataggagattaaaactaaaatgcctgatttgtgcagcttgc

SEQ ID NO: 6779470 - DNA, 87 bp, Homo sapiens
aaagcatgctcccctcctcaactctggcttccaggagatgctcccccttggtgtgagaggttgaggaagggtgtgattggatgcttt

SEQ ID NO: 6779471 - DNA, 118 bp, Homo sapiens
tgaggatcggttaaaagctttgccacatttttcacatttgtagggtttctctccagtatgaataatcttatgtgtagaaagggttgaggacagtttaaaagctttgccacattcttca

SEQ ID NO: 6779472 - DNA, 93 bp, Homo sapiens
ggtagtcagatttcaccttgagaaggaggaagggcttttgaataatccaagttgttaaggtagaattgcctccctcaggaggaatgagattcc

SEQ ID NO: 6779473 - DNA, 101 bp, Homo sapiens
aaaggtgtccagttattccagaagtcaatgtgaaaggtttataggaattaccctgttctctaataccctgtattcacattttagaatgactttatgtcttt

SEQ ID NO: 6779474 - DNA, 65 bp, Homo sapiens
tccagccctctggcccgcggtgtgatgcctctactcatggcaacaggcgtggacaggtgctgaga

SEQ ID NO: 6779475 - DNA, 76 bp, Homo sapiens
aaaggatttaatcagtctctctgaagtattaagatgtattatgtcatacctggcagagagatccctgagacccttt

SEQ ID NO: 6779476 - DNA, 69 bp, Homo sapiens
catggcttcatgagggttttgccaataactagggttgtgggaagcacaggctctcttggggacaccatg

SEQ ID NO: 6779477 - DNA, 72 bp, Homo sapiens
gggagcatgtcagtctgggtctccacagtcagcacaggcacacttgcaacaggagagttcagggcagtttct

SEQ ID NO: 6779478 - DNA, 69 bp, Homo sapiens
tggaagccatagatagaggttcctaatagaagtacctttggttatgagtctgttttttatggtctttca

SEQ ID NO: 6779479 - DNA, 115 bp, Homo sapiens
atgtgcgcatttattctggagttataatcgggatggggtgtggcttatggctattacgtgaaggcaaataagcaattccattcttcaagcatgacctcagatcacacatgcacat

SEQ ID NO: 6779480 - DNA, 77 bp, Homo sapiens
ggaaaagggggacaggagcaaatgatgggggcaggcggtaaatgacccaaatttcagtgtcttcttctccctcatcc

SEQ ID NO: 6779481 - DNA, 58 bp, Homo sapiens
ggtggtgctggtgttcagatgctacctcttcggtacaaatgtacacttgtataaatcc

SEQ ID NO: 6779482 - DNA, 109 bp, Homo sapiens
ccctctacccactagtagaaaagcaggcttgacaaggaaattactagctggattgattgcagtcttagaagttcatgttccagcttatatttgctaagtggctgcaggg

SEQ ID NO: 6779483 - DNA, 63 bp, Homo sapiens
ttgttggtgaatagggtggaattgggacaagtaggaggaggttttaccctttttcataaataa

SEQ ID NO: 6779484 - DNA, 83 bp, Homo sapiens
tcatgggggctgccttgggcagagttacggagccgctcactcagcgctcatgtcggcaggactcgcccattgtgccacccaga

SEQ ID NO: 6779485 - DNA, 64 bp, Homo sapiens
gagggtgggtagacagaattattcaacccggacaggtgttagatgttcactctatccccccctt

SEQ ID NO: 6779486 - DNA, 57 bp, Homo sapiens
agccgctctgtctaacttaaacagagaaggaatttgttacaagcaccacaggtggct

SEQ ID NO: 6779487 - DNA, 125 bp, Homo sapiens
aggcatcacttccagtacttctccagggaccactgggctgggcagggtcttgggaattggggacctggtcccagtcctgtgtgaccctgcacaggccactccttgtctctgggctgtgtgcgcct

SEQ ID NO: 6779488 - DNA, 94 bp, Homo sapiens
gcgatgatcttgtcatgcacggattggtacctggcaggcttagttttctctaggatttctgccaccaactgtcactacatacttttcaatttgc

SEQ ID NO: 6779489 - DNA, 65 bp, Homo sapiens
cacaaggccttatctccaaatacagtcacattctgaggtactcggggttagggcttcaacttgtg

SEQ ID NO: 6779490 - DNA, 94 bp, Homo sapiens
ccagaaacctgaacactggctatgagggagatgggggttggaggagatcttgtgccctccaccatggttaagtgaattgaatttaggtatttgg

SEQ ID NO: 6779491 - DNA, 65 bp, Homo sapiens
tgtgttaggcttttatctgaagccacagaccaaatcttggaatcattcttaaaggtctgactgca

SEQ ID NO: 6779492 - DNA, 56 bp, Homo sapiens
tgggtaggaatcgagtgtatggctcagacgccatagactgttactgttcttactca

SEQ ID NO: 6779493 - DNA, 72 bp, Homo sapiens
ccatgctctagaacattatttcgtgttaaccatcctccttggccacatctgaaatgagtgttggagagtagg

SEQ ID NO: 6779494 - DNA, 67 bp, Homo sapiens
gagccattgtccaagcctgtttctctagtcagcctggcaatgcagtgtgagcttgggcaacttgctt

SEQ ID NO: 6779495 - DNA, 58 bp, Homo sapiens
gaaaatcaggccatggagaagagattcagatgagatttcacaaaccatcctgattttc

SEQ ID NO: 6779496 - DNA, 87 bp, Homo sapiens
tgtgatccaaatcatgtcagaagaacagactcacatgtggtcaaaaatgtgttggatcgggtactctggtgtttggtttggaaaaca

SEQ ID NO: 6779497 - DNA, 130 bp, Homo sapiens
ggctgggtaaaggagaacctgatgggaaagaagcaatgatttagctgagccatcattgatgacaggagcttttaatgatgtgtgctgatcaagcttctgggacatttacctctttcttgctggtgatttc

SEQ ID NO: 6779498 - DNA, 66 bp, Homo sapiens
gggaaggaaggagggagcggcgcggattctgcctctgcagcagagcccccatccctctttccgccc

SEQ ID NO: 6779499 - DNA, 70 bp, Homo sapiens
tacgcatggaaatccagttccctactcttatagcacctcgcatgagggggaactgtgattttctgcagtg

SEQ ID NO: 6779500 - DNA, 63 bp, Homo sapiens
ttttgagaaatattgcacagtgaggtgactgcagttaataaagcttcactgtatattccaaaa

SEQ ID NO: 6779501 - DNA, 62 bp, Homo sapiens
ctttcctggttggggacgtggttgttttagcctgaatccaattacaaccaagaactggaagg

SEQ ID NO: 6779502 - DNA, 74 bp, Homo sapiens
ttcaggagttcctatactcacccttctacttttaagaaagtggttttcaaagtgtgatttgtagaatgcctgag

SEQ ID NO: 6779503 - DNA, 80 bp, Homo sapiens
aggagaaagaaaagagcatgcattaatcagtttctctgcaacagacactaattaagctgctttacttacagttatctcct

SEQ ID NO: 6779504 - DNA, 57 bp, Homo sapiens
gctgctctggctctgcagtgtctgatgtgatgcttgaaaacaagaaggcagagcagc

SEQ ID NO: 6779505 - DNA, 56 bp, Homo sapiens
tgacagtgggttgagaggagcctcagacagtggaggaaccttagaattcactgcca

SEQ ID NO: 6779506 - DNA, 65 bp, Homo sapiens
gacaatcctagggcaaggcctcaggtatctggagttccagactaactttttgctctatcactgtc

SEQ ID NO: 6779507 - DNA, 78 bp, Homo sapiens
agccttgaattagcagtagacagactgggtttggaggaaccacagatttggggtctcctgttagttcatctttaggtt

SEQ ID NO: 6779508 - DNA, 66 bp, Homo sapiens
ctgagcaggccctctagaggagtgtttgtggaccacttgcaggcgtgtctctggagggacgcacag

SEQ ID NO: 6779509 - DNA, 64 bp, Homo sapiens
gagagaacagctgatttacggggctgtaacataatatggccacagtgacccatgctggtctttc

SEQ ID NO: 6779510 - DNA, 58 bp, Homo sapiens
gctgcaggcggccgtggtggcggccgccgccgccgccgccattgtgtccgtctgcggc

SEQ ID NO: 6779511 - DNA, 60 bp, Homo sapiens
agatgccaggttgggaagtgatgcttataacttcagaagacctactctcaactggcattt

SEQ ID NO: 6779512 - DNA, 68 bp, Homo sapiens
gtcaccgatgatgtgggagacactggtgttaatgcaaggatcactattgagcccccatgttgagtgac

SEQ ID NO: 6779513 - DNA, 81 bp, Homo sapiens
gctgttttagtcattcatttattagatagttgaatgctacccatatataagtgtcaagtacatggtagtgattaaaacagt

SEQ ID NO: 6779514 - DNA, 62 bp, Homo sapiens
gggcctctccggcctttgcatcctgacatcagagttcagcaggggcaggagatctcaggccc

SEQ ID NO: 6779515 - DNA, 65 bp, Homo sapiens
atcaccttgggcttcctgttacatgaattaccagaaccacagaagctgagagcccagcaggtggt

SEQ ID NO: 6779516 - DNA, 66 bp, Homo sapiens
aaacgggggctctcaggtctccccaaatttagctgtatttggacctggaggcaggagttgctgttt

SEQ ID NO: 6779517 - DNA, 58 bp, Homo sapiens
cggcagctgagagcacagcagaggcggtagctgctctttgtgccatgcagtgaggccg

SEQ ID NO: 6779518 - DNA, 55 bp, Homo sapiens
ggtggctcatgcctgtaatcttagcactttgggaggctgaggcgggctgagcccc

SEQ ID NO: 6779519 - DNA, 66 bp, Homo sapiens
gtgttgatagagacattcaacctcagattaccaattctgtcacaaccgaatgtttgtattcagcgc

SEQ ID NO: 6779520 - DNA, 58 bp, Homo sapiens
gaattcctattgaggctattgctaggtttgacaagtcagttagcctcctaaggatttc

SEQ ID NO: 6779521 - DNA, 63 bp, Homo sapiens
ccttgtgtttttacttactgtccccagtgtgctagctactgcagggacacgaagacaaatagg

SEQ ID NO: 6779522 - DNA, 59 bp, Homo sapiens
gtgtgcctatgagtggtgaacattataccagtaatcacaatattgctacataggaacat

SEQ ID NO: 6779523 - DNA, 95 bp, Homo sapiens
gcaaaatccaggccaggatgcactaggaaccagggtcagaagtgagtgagaggctcagccccctgagtcgcctgttgaatttgccatggtgttgc

SEQ ID NO: 6779524 - DNA, 56 bp, Homo sapiens
ggtcttccttgggggacttgaacatcttggtaaatgacaggtcttcttggaggact

SEQ ID NO: 6779525 - DNA, 79 bp, Homo sapiens
ttaggttggtgcaaaagtaattgcagttttaccattaaaggtaatggcaaaaaccgcaattacttttgaaccaatctga

SEQ ID NO: 6779526 - DNA, 60 bp, Homo sapiens
caggtgagagctgtgggaccctgacacagctgtctagggaattgtggttttcttagactg

SEQ ID NO: 6779527 - DNA, 67 bp, Homo sapiens
ccacagtggaaagaacatggattttggagactggttgacctgggatcagatcctgtctccaccttgg

SEQ ID NO: 6779528 - DNA, 64 bp, Homo sapiens
ggcctgggtagggcctgcgcctgtgcttgctgcgcagcagcacccctgcgtgccttcccttgcc

SEQ ID NO: 6779529 - DNA, 72 bp, Homo sapiens
gggggtgcaggcaggtgggcgggcaggtgccacccctccctggcactttcctctggcactgtctggtctctt

SEQ ID NO: 6779530 - DNA, 73 bp, Homo sapiens
cgtggcaatggagcagtcccactcagcatcaatatgcccgtgcagcagggacctctatgtgaagactgccatg

SEQ ID NO: 6779531 - DNA, 57 bp, Homo sapiens
ttgcaagaatgcctaaggatgcctattggttgtggggcaaatcacaggtaattgcaa

SEQ ID NO: 6779532 - DNA, 55 bp, Homo sapiens
agtggctcacgcctgtaatcccagcactttgggaggccgaggcaggcggatcact

SEQ ID NO: 6779533 - DNA, 84 bp, Homo sapiens
tctcccaaggggagctggttcctgccctccatgtgcaccttgatcagggggttttggagaacagggtcatcacccttccggaga

SEQ ID NO: 6779534 - DNA, 77 bp, Homo sapiens
ggtaagtaaatgtatcctacttcctgagttggctaattgtggatgttaatctctggaaaaggatcacctttcttatc

SEQ ID NO: 6779535 - DNA, 61 bp, Homo sapiens
gaaagcctaagacagaaagactgggcactataatgacaggctttgtctctgtcttgctttt

SEQ ID NO: 6779536 - DNA, 67 bp, Homo sapiens
actgatatgattccttacactatagttttgatttgtgcagaatgtcgtgtaaacggactcatgcagt

SEQ ID NO: 6779537 - DNA, 73 bp, Homo sapiens
cccgccggcccccagctcccatccctgccagccttcccacggcagggagccttcctggctgtggtgttccggg

SEQ ID NO: 6779538 - DNA, 56 bp, Homo sapiens
tccagtggcatctgtgctatgataggaaatataaggggcactggaagcacacagga

SEQ ID NO: 6779539 - DNA, 77 bp, Homo sapiens
atcacctggtgccctttccttccagagcattcattagaatgtgtaagctctgagagagcaaagtcaccacaggtgat

SEQ ID NO: 6779540 - DNA, 88 bp, Homo sapiens
gcctccctccgtgggtcccgcagggtgggcctgtctggccatgtgtccaccacagagctggcggcccgccctccccaggcagggaggc

SEQ ID NO: 6779541 - DNA, 60 bp, Homo sapiens
caccattccaggccttaagaagtgagccttaggattgtttgccttggggaatgaaaggtg

SEQ ID NO: 6779542 - DNA, 85 bp, Homo sapiens
ggtcttaggtatggtatagagggtaaagcatcacaattccaaacaaaattaaagatattgcacctctaatacattaccagaggct

SEQ ID NO: 6779543 - DNA, 78 bp, Homo sapiens
ccaggtacctgggggagggtctgctgacgatgcccaatgttcaatggcccaagcaacccgtccttgggggacttctgg

SEQ ID NO: 6779544 - DNA, 71 bp, Homo sapiens
gggcttgttcctgccaagctggtatgaggttgatgacctgcagcacagtttgcttggcagagcagttgtcc

SEQ ID NO: 6779545 - DNA, 70 bp, Homo sapiens
catgcacgtgcctcctggtgtgagagtgtctctgggatacatgcttcacagaccaggaggctgtgatttg

SEQ ID NO: 6779546 - DNA, 129 bp, Homo sapiens
ggcttggaccacgagaggcacctgagtcaggcagtcacatacttcccactggggtctaccatgtgaggcatggtgtgggatcctgggaaggagaccaagcctcatttcagtttgcttatggccaaagac

SEQ ID NO: 6779547 - DNA, 85 bp, Homo sapiens
gaagggctggcatggaagggctgagttctattggggtcccacgcgggcaagggaaccaggactcatccctgcttgtcagccaatc

SEQ ID NO: 6779548 - DNA, 57 bp, Homo sapiens
tggtcatttctaatacaggatttaaaaatacaaatcttgttttgaaagcagtggcca

SEQ ID NO: 6779549 - DNA, 78 bp, Homo sapiens
aactagaatttccctgcaagactatttagttccacaaactttgttgtcatggaaaggaagagcttgaggtttcaagtt

SEQ ID NO: 6779550 - DNA, 66 bp, Homo sapiens
atggcatttatgttgacaatggactcctacacagaggatgatcatggtctaggacataatagtcat

SEQ ID NO: 6779551 - DNA, 63 bp, Homo sapiens
gctgcaggagctggagctgtgggcctggggacaagtgtcctaacagcccccgctccctgcagc

SEQ ID NO: 6779552 - DNA, 62 bp, Homo sapiens
aggaactgtcattggggacatcagccaggaggctattgataatagaccaagtgaaagttttt

SEQ ID NO: 6779553 - DNA, 62 bp, Homo sapiens
cagccctggtagcctgctgccattgtgctgtgccagatgctgtgctggctaaccatgggctg

SEQ ID NO: 6779554 - DNA, 78 bp, Homo sapiens
tcacagtgcttgagaaagtgtagatccaacatccaaacatagttgccattgggaaggaactgcctttagcttctgtga

SEQ ID NO: 6779555 - DNA, 83 bp, Homo sapiens
atacatagaagttctaccattgggaaaacagcctgcatcctttgggctatttacttatgtggaaaagctcattcttcttgtat

SEQ ID NO: 6779556 - DNA, 89 bp, Homo sapiens
ctggggtagtttacacacaattagcatagtaaaaaggaaatgttgttgttgttattgttgttattgttgtttacttcactttaactcag

SEQ ID NO: 6779557 - DNA, 57 bp, Homo sapiens
acatgtgggtgagctcagctggggctggaagaactgccaggcagcctacccacttgt

SEQ ID NO: 6779558 - DNA, 63 bp, Homo sapiens
gaggttggaatgtctgtttcaacaagcacaatgggtccctacagtgtgaagcaggcatgcctt

SEQ ID NO: 6779559 - DNA, 130 bp, Homo sapiens
tttggggatgaggccatgattctgaggtcagtgccatgccatggtctaataaagtttgcattcaatgctgtttgtttctgtatgatcaatattgtaaagtcagtctctttgtcatggactcagctttgga

SEQ ID NO: 6779560 - DNA, 83 bp, Homo sapiens
agggctgaagtcatccactatgggggagagcagctggccattcccaggatccttcccattgcatagatggctgtgttagtcct

SEQ ID NO: 6779561 - DNA, 60 bp, Homo sapiens
ctcacctgtcttgatctggattaggacttgcacttggtcagttgatcaggcagcagtgag

SEQ ID NO: 6779562 - DNA, 81 bp, Homo sapiens
ctcaagaaggggttatgcactggaaggagggaatcttaggggcaccttagaattccgtctaccagagcaccttttctcagg

SEQ ID NO: 6779563 - DNA, 78 bp, Homo sapiens
agtaaagcactccagaatgttaccagttagtctgtcaccatagtagcagcatctggggaacattcaagatgtattatt

SEQ ID NO: 6779564 - DNA, 73 bp, Homo sapiens
ggtcctgcttgcagcaggtgcttaggaacaagtgtgagttgatttatagctgcctgcagcacagctctgggcc

SEQ ID NO: 6779565 - DNA, 95 bp, Homo sapiens
gtgcggcggtccgagaggtgtacgaagaggcgggagtcaaggggaagttaggccggctcctgggcgtcttcgaacagaaccaggaccccaagcac

SEQ ID NO: 6779566 - DNA, 80 bp, Homo sapiens
gttaggctgaaccatgaagttgctgatgtgcaaatgcatttgtcctgcaaaacaggcaatttcatgtggtttaaactaat

SEQ ID NO: 6779567 - DNA, 65 bp, Homo sapiens
attggcttttgtaacgtgtgcatgtcttttggaggaaaactctgagaacatttaggagagtcaat

SEQ ID NO: 6779568 - DNA, 129 bp, Homo sapiens
ccaaatctgcaaacttcaccattgataatctataaaaggtattatttgcaatcatttgtacttctgtctggtttatgtacacatgggaaatgatatctcatttatagatggagaaaataaaattcgaag

SEQ ID NO: 6779569 - DNA, 94 bp, Homo sapiens
tgtgcacagcttccagaacacagaatgcagagatgcccagaattaatggtctggcagcaagtctgtttctcatgttttccaatctgaatgtata

SEQ ID NO: 6779570 - DNA, 91 bp, Homo sapiens
gacattaacttcaactccatgaaagcaggaatggttttactgaatactacaaagataaaatcattcagcttcatactgttgatgtgaagtc

SEQ ID NO: 6779571 - DNA, 57 bp, Homo sapiens
tctagttaattcctttggtgttacttataatttgggtagagagggtagtagactaga

SEQ ID NO: 6779572 - DNA, 84 bp, Homo sapiens
gcaaggaggacatctaggaagttccacccaggaacactttccagagtgccctggacaagtggcttacttggacacattccttgt

SEQ ID NO: 6779573 - DNA, 79 bp, Homo sapiens
tacatagatatgacaataccatgcagaaataacataatacagaagtgtgtgtgtgtgtgtgtgtgtgtgtgtgtgtgtg

SEQ ID NO: 6779574 - DNA, 124 bp, Homo sapiens
gatgttttctgtgtcggaagtagtatctatgtttttatttgtaaacatgcattcttttggttggatttatggaagactaacagaaacatgggttttagcattgcggtctggctgcctgtgcatc

SEQ ID NO: 6779575 - DNA, 71 bp, Homo sapiens
gcagggaagacatggctgtctcttttggccactgtggtggacaggggctgctgttgtcactgcctccctgc

SEQ ID NO: 6779576 - DNA, 97 bp, Homo sapiens
ttgggttctctgcccaggcccttcctcagaagaacccctagattatggttttagccagaatttagggttttgtggattgggcttaggatggactcag

SEQ ID NO: 6779577 - DNA, 62 bp, Homo sapiens
ggttccgtcatgcatttgcaggcaggctggggtctgccctagacagagtgtggctggtgact

SEQ ID NO: 6779578 - DNA, 102 bp, Homo sapiens
gttcagctgtattgtgtattattgatttctgcttactcactgtagttttattgcacagtgggcttagggaattaatgagttttatgttaaatgcttaaggac

SEQ ID NO: 6779579 - DNA, 68 bp, Homo sapiens
tctttcttattatgctcaatgtttgcaagtttcacatgaagcctgaatgcaagcatgaagagtagaga

SEQ ID NO: 6779580 - DNA, 59 bp, Homo sapiens
ctcctatgggtactttgatttagaaactaatgttggtgtctatgtggtattcctgggag

SEQ ID NO: 6779581 - DNA, 62 bp, Homo sapiens
cagggacccaggttccttaagtgaagtggttccaccattctctaggactttggagtcctctg

SEQ ID NO: 6779582 - DNA, 55 bp, Homo sapiens
tggtctctgactctgaagacccaagagggcctgagggtagagagtagagagacca

SEQ ID NO: 6779583 - DNA, 63 bp, Homo sapiens
tcaaaatgtctacgtctaaatttggaggtagaattgtctctagatttagtggtggaattttgg

SEQ ID NO: 6779584 - DNA, 64 bp, Homo sapiens
caagacttattttgtcatctccagaaatattgaggagagtagaactgacaagataatagccttg

SEQ ID NO: 6779585 - DNA, 75 bp, Homo sapiens
ggcagaggctgtgactttgaataagagggagttgactcagtgtcaccagtttttcctttacagcaaagccctgcc

SEQ ID NO: 6779586 - DNA, 58 bp, Homo sapiens
ggcagctgccgtgagctcacgccccgaaatagccccaggggccccagccgcagctgcc

SEQ ID NO: 6779587 - DNA, 76 bp, Homo sapiens
ggaatgatcttccatgaagccttagtctttcttcttgtttcttctatgatttaggccacagggaaaatcaaaatcc

SEQ ID NO: 6779588 - DNA, 66 bp, Homo sapiens
caggtaacttgtaattaatggcagcaattagttcctctggctatttgttgcgggaattgctatttg

SEQ ID NO: 6779589 - DNA, 70 bp, Homo sapiens
gtagctacacccaagtcaacccctggcttgttttccactaacggagccaaatacaaactggggtggctac

SEQ ID NO: 6779590 - DNA, 101 bp, Homo sapiens
tcatgtggtttttgtctttggttccgtttatatgctggattacgtttattgatttgtatatgtcaaaccagccttgcatcccagggatgaagcccacttga

SEQ ID NO: 6779591 - DNA, 67 bp, Homo sapiens
tagatgaggaagccgaagcttgtagagaccaagtgggtgctacaggtcttctgccttcactcacctg

SEQ ID NO: 6779592 - DNA, 76 bp, Homo sapiens
accatcaagtaagtgccagagaatgaaaatcagatttttgactaaaaatttgatatgcttttcactataccgtggt

SEQ ID NO: 6779593 - DNA, 101 bp, Homo sapiens
agaggccccaagctaaaggcatcaatcacatttgcccccatattccaactttagtagttgagtgtgacagtgtgattcagccgcttttgttcaatgtctct

SEQ ID NO: 6779594 - DNA, 66 bp, Homo sapiens
tgggactggagtcagggaaaaagtgtcttgaaaagtgaaattttcctccatggctccatattacca

SEQ ID NO: 6779595 - DNA, 58 bp, Homo sapiens
tatttttgatgttttagcattggtagagaacaaactttgctggcaagactcaggaata

SEQ ID NO: 6779596 - DNA, 130 bp, Homo sapiens
tgcatcgcttggcctggggctggctttcttctagcagatagagacagagagcaattagcgtttgaaagcataagcaagccaatctgttttgtttatacagagagtttcccccagaagtgaggcagaagca

SEQ ID NO: 6779597 - DNA, 68 bp, Homo sapiens
ttatttctttttcttattttatgagattgactgaaaagtccagtacaatgttaaggaaagagagatag

SEQ ID NO: 6779598 - DNA, 72 bp, Homo sapiens
gtgtgtgtaagaagctgatgcccaactgaagtgggctgtgcccaaggttgcaggcctcagagactactgcac

SEQ ID NO: 6779599 - DNA, 65 bp, Homo sapiens
gcttgttaaacacagtgtgtgcagtcggacggagtcccggccgtgattcatgcactgtacacagc

SEQ ID NO: 6779600 - DNA, 63 bp, Homo sapiens
ggactacgatagctcacctttgtcacagactttggatttctgtacaagttgcttttgaagtcc

SEQ ID NO: 6779601 - DNA, 86 bp, Homo sapiens
acctaagacagtctatctagaagcctgagccaagatagtctagctacttgaattatatttctagagaaaggattgttgaataaggt

SEQ ID NO: 6779602 - DNA, 58 bp, Homo sapiens
gcggccgcggcaccggaagtgccccccacgggaggctgccctcggggtcgcaggccgc

SEQ ID NO: 6779603 - DNA, 73 bp, Homo sapiens
ggggagcaaataattgagaagagtaataaaatctaccacacttggctcttttagtaataaatatttgttcccc

SEQ ID NO: 6779604 - DNA, 99 bp, Homo sapiens
gctcagaggaggaggaggaggagcaggaggagagcctggcggtggcggagcaggtagccgactttgccagctccctgctggccgccctccactgctggc

SEQ ID NO: 6779605 - DNA, 67 bp, Homo sapiens
aagatcatcaatggatggtaaaactactgagcacattgtcgctagagaacaacattcatatggtctt

SEQ ID NO: 6779606 - DNA, 60 bp, Homo sapiens
gatcatcaagcaagaacctgattccattctaatcactgtcaatttctagcttggtcggtt

SEQ ID NO: 6779607 - DNA, 73 bp, Homo sapiens
tctagagaagtttccttttgaaaaattatagtatttcagctgaagtaaggggaaaaaaggaatattctttggg

SEQ ID NO: 6779608 - DNA, 95 bp, Homo sapiens
ctctaaatggtgaggaaatatgggactaagatgttcatagaggctggaattaaatttagaatttgactcttagcccaggactctaaccatgtgag

SEQ ID NO: 6779609 - DNA, 85 bp, Homo sapiens
gcaggctgctctgaatatttcgatagacctaacaattgcttctcaaggttgctgttttacatctggtgggttttgagcaggctgc

SEQ ID NO: 6779610 - DNA, 75 bp, Homo sapiens
tcagcatctgggatggctccgctgctgctgagtggtatctttctgagtggctagcaggctagcccagagatctga

SEQ ID NO: 6779611 - DNA, 76 bp, Homo sapiens
tcactctgtggcccaggttggagtgcagtggtgtaatctcagcccactgcaacttctgcctcctgggttcaagtga

SEQ ID NO: 6779612 - DNA, 92 bp, Homo sapiens
agatggcctttctaacttggttaagtgttcattccatttgaatctgataggaatgaaactctaacttaacaagttttggagaaataacatct

SEQ ID NO: 6779613 - DNA, 62 bp, Homo sapiens
actcctagaggccccatgggatggcggtgcagacagcaccttctcctggggccctcctgggt

SEQ ID NO: 6779614 - DNA, 66 bp, Homo sapiens
gagatgtgacaggtgtgatgatttaggctttccctgcaggcaagggagacatcatgaccttatttc

SEQ ID NO: 6779615 - DNA, 55 bp, Homo sapiens
gatttgcagggctgccaaatgactgtcatcatggctaaccaaggcctgataaatc

SEQ ID NO: 6779616 - DNA, 60 bp, Homo sapiens
cactttttcagactaatagggcataatttactttattgttttctattacctgagattgtg

SEQ ID NO: 6779617 - DNA, 65 bp, Homo sapiens
tgtggagtagctctttggtacagatgaccctactcccgggtacaattcctgtcaagctggccaca

SEQ ID NO: 6779618 - DNA, 107 bp, Homo sapiens
gctgattgaacagtcctaattgaattgtgaggcagggaaaggtgggtagctgagccttacccactttgtctcatctctgtctctcctttctgtgggcctggatgagc

SEQ ID NO: 6779619 - DNA, 55 bp, Homo sapiens
accttgagcaagagtaggaactgaattttctttcagattcttttgtgttcatggt

SEQ ID NO: 6779620 - DNA, 61 bp, Homo sapiens
ggtggctttgtgctggtagcaagctctgtatcactgggctgcaagcatgcacagatacact

SEQ ID NO: 6779621 - DNA, 58 bp, Homo sapiens
aggaaaaattttcagggatctactttcctcagagatgaggtccctaattaattgacct

SEQ ID NO: 6779622 - DNA, 92 bp, Homo sapiens
gagaatggcgtgaacctgggaggcggagcttgcagtgagccgagattgtgccactgcactccagcctgggcgacagagtgagactccatctc

SEQ ID NO: 6779623 - DNA, 59 bp, Homo sapiens
gttacatttattagaggtctctggcttcttgaaagatggagactttataaatgtcaagc

SEQ ID NO: 6779624 - DNA, 88 bp, Homo sapiens
caggtcttgagtctgtaaggatgttcagggccagatcccagaacagggaattctccaggtaaatggcatcctgcccactcactgcctg

SEQ ID NO: 6779625 - DNA, 71 bp, Homo sapiens
cctcgtggtgtcagacctgtgcatcttcaaggacataaacagatgggataagcagatgagactcacagagg

SEQ ID NO: 6779626 - DNA, 56 bp, Homo sapiens
gtgccagactgtgtcttgctaaacattgttaaatagcactagtatactgctggtac

SEQ ID NO: 6779627 - DNA, 73 bp, Homo sapiens
atgaaaccattcattctgacctcaagagaaccttctgagtgtttttgtggggggcggtgtgaaacaggttcat

SEQ ID NO: 6779628 - DNA, 91 bp, Homo sapiens
gagcaggctggagaagcagcttcagaggcgggcgcaggaggcagttctcagctgcgccctctggaagcctgtcatccagttcaccctgctc

SEQ ID NO: 6779629 - DNA, 56 bp, Homo sapiens
ctcatcatgtcacccatgtgctgcatcctattttgtagcattgtggggatgatggg

SEQ ID NO: 6779630 - DNA, 72 bp, Homo sapiens
tcatccaggctgctttctatgccccttgttagtctgcttgggctgccataacagagtaccacagatgggtga

SEQ ID NO: 6779631 - DNA, 63 bp, Homo sapiens
ccagctccaggtcagtgcacccctgtgttccacagcaggggagcccctggtcctggtggctgg

SEQ ID NO: 6779632 - DNA, 65 bp, Homo sapiens
tgtgtgttattttcagccattaagttcatagtgatcttttacgatgtatggaaaataaacacaca

SEQ ID NO: 6779633 - DNA, 63 bp, Homo sapiens
aggaagaggtgtgcaatggtgtctttggagtccaaaaaatgctgatatcttcattcctttcct

SEQ ID NO: 6779634 - DNA, 60 bp, Homo sapiens
gagattattctgcacttttaaaatatgctcagctatgcagtatatatgcaggttaatctt

SEQ ID NO: 6779635 - DNA, 60 bp, Homo sapiens
tctgtgagcaaggaagcagaccctcacctgacccaaatctgccagttccttgatcatgga

SEQ ID NO: 6779636 - DNA, 68 bp, Homo sapiens
aggctctgatcaggtggctgtggggccctaatccagaatgagcacagttattttgatcaatggagtct

SEQ ID NO: 6779637 - DNA, 72 bp, Homo sapiens
agctggcagagcatttgtggcctctgctcagatgaaattttaagctaaacaccaacagatcctctgcttgct

SEQ ID NO: 6779638 - DNA, 55 bp, Homo sapiens
agcacagcttagcacctggcacctcacgggtgcttgtgaaactgcagctgatgtt

SEQ ID NO: 6779639 - DNA, 82 bp, Homo sapiens
gtgcaaaaatttgttttcaagtcactggacataaggcaatgaaatataatgatccctgagtgattgaaaataaaggaagtac

SEQ ID NO: 6779640 - DNA, 77 bp, Homo sapiens
tggcagttcaggttggactctttcgcgggccaggggcgggagaggccagtcttttgtaatgtttgcctgagctacta

SEQ ID NO: 6779641 - DNA, 103 bp, Homo sapiens
ctgggccttgcatacaccttggcttgtccctggagcatcttcttgccttgtgtaggagcctgctctgcagggaccagaatcagggtggatctgcatggtgcag

SEQ ID NO: 6779642 - DNA, 59 bp, Homo sapiens
gaaatgtagaatctcagtggggccccaccacacacctactgaattacagtctgcatttt

SEQ ID NO: 6779643 - DNA, 56 bp, Homo sapiens
gcttcctgggcccaagatgtactggggagtctcggagacatggcatcccaggaggt

SEQ ID NO: 6779644 - DNA, 56 bp, Homo sapiens
acattctacaggactggcaatccctcctaaaggagaggaaaaccctgtagtgatgt

SEQ ID NO: 6779645 - DNA, 130 bp, Homo sapiens
ggccctctgtccagcctgatcttgcgtggaccatgctgagacacccatgctgagacacctgctgctttttctttctctttactgtgggtcccagctgtgtctgcccaggttcagcctggaaaaaatagcc

SEQ ID NO: 6779646 - DNA, 62 bp, Homo sapiens
ttgacatgtacccctgagagtcttgcggaaatgcagattctgattcagtgggtatgattcag

SEQ ID NO: 6779647 - DNA, 82 bp, Homo sapiens
cttctcctgacaccagctctaataccagtgtcttccctccagagcctgattatagacacagtttgggatgggttgggggaag

SEQ ID NO: 6779648 - DNA, 129 bp, Homo sapiens
tctaaggactcctcctgctcaaccacatccactggtcggggtccacccaggccaagcacagagctgcggaggggctgaggtggcctctgccggggaatggaaaacggctctcttggaggaactgaagga

SEQ ID NO: 6779649 - DNA, 65 bp, Homo sapiens
cagcaaaggtagaagcacaggactcaatataatggttgcctgaataaatgcttccacttttactg

SEQ ID NO: 6779650 - DNA, 77 bp, Homo sapiens
cttatggctctggcaggtcaatcattctttgtgtgatcatcactgaaaaaagaatctgatttgtctggaagcataag

SEQ ID NO: 6779651 - DNA, 64 bp, Homo sapiens
tgtcttctcgttatcttggaaatagaatcttggaatttgtatcctctttataacgtagatggca

SEQ ID NO: 6779652 - DNA, 60 bp, Homo sapiens
gacctgccacaggtgcaagaagttgcagtcaaatgattaccaacatgcacctgtgtggtc

SEQ ID NO: 6779653 - DNA, 111 bp, Homo sapiens
cagtagtatacgttgaaatgcttaaaaacagtatggtagtcaataaatgtgtggtggcaacactctaatatagtattaccactgcagttttgcattctaatattgcctctg

SEQ ID NO: 6779654 - DNA, 72 bp, Homo sapiens
tcagcacagagctcaagtcttagaaaacaaggggcaattttctgaactgacttgatgttttcttgtgtgtga

SEQ ID NO: 6779655 - DNA, 57 bp, Homo sapiens
tcctcagtctctcaaatgaggcagatattattatcatcttcattttacagatgagga

SEQ ID NO: 6779656 - DNA, 64 bp, Homo sapiens
caatggaacaccctttggaaaatggcaaagagaacgatgtcttcacataaacaaagggccattg

SEQ ID NO: 6779657 - DNA, 74 bp, Homo sapiens
atggcctgcccactccaggagcaactcattgtggaaacaagtttagtatgacctgagagtaggatgcaagtgat

SEQ ID NO: 6779658 - DNA, 92 bp, Homo sapiens
gcagctcagactggtgggtaaaaccttggaaatttgaaataagacaactcaggatagtagcccaggtatttaaaccactgtgtgacctctgc

SEQ ID NO: 6779659 - DNA, 80 bp, Homo sapiens
cagagttccagcctttcaaagtcgttttcaatcctgttttttcaggtcatgtatttgcgaggttaggaaaacctactctg

SEQ ID NO: 6779660 - DNA, 64 bp, Homo sapiens
gagaaggcttaaaacatggaatatgtcctgtatgtacatattccaaaatagttaagcactttcc

SEQ ID NO: 6779661 - DNA, 78 bp, Homo sapiens
aggctatggtggggccagcggcatggaagtcatcactgctgtaatggtcaaccagagcctgctgagccccattaacct

SEQ ID NO: 6779662 - DNA, 65 bp, Homo sapiens
tctatcccaaggtgaacttgctgtacagcttgactgatggcatgcacagtttttcacctcataga

SEQ ID NO: 6779663 - DNA, 95 bp, Homo sapiens
gccctgagcccctttgagcttcagtaacccccctctgcatgccttgctcagacatcattgttagggtcctgtgcaggggctggagtgctcagggc

SEQ ID NO: 6779664 - DNA, 60 bp, Homo sapiens
gtttctgatttccagtgaggttatgcatgtattcttaacatttattggcctttcaggaac

SEQ ID NO: 6779665 - DNA, 66 bp, Homo sapiens
tggtaagatttcaagtataagtaaggtcagaggaaagaaagttttgcaaatacagaggtcttgcta

SEQ ID NO: 6779666 - DNA, 68 bp, Homo sapiens
agcatttggggcatttagttttcatattctgaaactgtttagaagataagacaagtgctgcctttgct

SEQ ID NO: 6779667 - DNA, 87 bp, Homo sapiens
agtgcaaatattcaacatgcaaacatgtttgtgtatctgtagacataaaaataaatagatatgtatgtatgtgtgtgtgtgtgtact

SEQ ID NO: 6779668 - DNA, 90 bp, Homo sapiens
gatagagcaaagaatatttagatgcatttggattgcttcagggctcacagatgtctgcacccatatggatttgaggattctggctttgtc

SEQ ID NO: 6779669 - DNA, 77 bp, Homo sapiens
gcttagacattcagactcacatggaggcagcctttattgctgtgatttatgaccaagttagaattgatggtgaaagc

SEQ ID NO: 6779670 - DNA, 70 bp, Homo sapiens
tttgcctctggttatctggtacctggccgtggggcaattagggcaggtgcacagtggcctggagtgtgag

SEQ ID NO: 6779671 - DNA, 81 bp, Homo sapiens
gagagaccatggtttgtgtggcccagatgacagcttcctaaaactcacctgtcatcctttccatttagacttccttttttc

SEQ ID NO: 6779672 - DNA, 83 bp, Homo sapiens
tgtttaatggtttagtggaagtgggagggaagatattgcaaaaggtaatatgctagtgtgcttatacttggactttttagaca

SEQ ID NO: 6779673 - DNA, 58 bp, Homo sapiens
ctgccaggcccagctccagagctgcccactccaggaagccctgagccagcctggtcag

SEQ ID NO: 6779674 - DNA, 64 bp, Homo sapiens
gttaacaaatgtaaagcaattaaaacagtgccaagcacatagtaagtgctttatacatgtttac

SEQ ID NO: 6779675 - DNA, 65 bp, Homo sapiens
aggtatcttctttgcgccaggtttttcctaggttctttgggtagaattgtaaatagaatatacct

SEQ ID NO: 6779676 - DNA, 91 bp, Homo sapiens
ctgaaaatgtgatatgagtgctagactttggcacagaacttccattgtttgcaatcagttgtccaaagttcacatcacatcacagagccag

SEQ ID NO: 6779677 - DNA, 74 bp, Homo sapiens
tagtggcttggtctatacataagatgaataagagattggaaatattattgtattataattaggccaaagccctg

SEQ ID NO: 6779678 - DNA, 60 bp, Homo sapiens
ggctgtgatgtgcagagagctttgctttgtgtctgcatccagagttgctgtatatcttcc

SEQ ID NO: 6779679 - DNA, 70 bp, Homo sapiens
agggagatgagctaagttctcacagcaagtcagtgacagatctgctgctggatcttactcatcttaccct

SEQ ID NO: 6779680 - DNA, 91 bp, Homo sapiens
gatgccaagctgtgctaagtgggaactgcctgtctcagctctcatccagctccaagagctgagcaggctcccacttcagtgcctttgaatc

SEQ ID NO: 6779681 - DNA, 69 bp, Homo sapiens
gtcttttcaggagtgtcaggagtgcctaaaacctttttcttcttaagtaaaacctggccttttgtagac

SEQ ID NO: 6779682 - DNA, 130 bp, Homo sapiens
tgttcgatggtttgggggtgctggtggtccaggtgcctgggcatgagcttgttggagtcgatgccctggctgaacagcaactgctcaatgtccaggctcaggtactgctgtttcctcctggtcaagggca

SEQ ID NO: 6779683 - DNA, 61 bp, Homo sapiens
gatcatctgaaccaaggacagattcatgtgtcctaattcacactgtctggttcatgtgttc

SEQ ID NO: 6779684 - DNA, 66 bp, Homo sapiens
ccaaggctcctcagctggtcttgggctgagggaagcctggagtgaccaagctggtatggggtttgg

SEQ ID NO: 6779685 - DNA, 74 bp, Homo sapiens
ttgattgtagtgtagatccacaaagtacttaaaggaatgtgtcttgtctctgtgagatctgacgatgctaacaa

SEQ ID NO: 6779686 - DNA, 70 bp, Homo sapiens
tactgtatgatttcatgtatatgcactttgaaaacagacaaaccaatatataacagaagtcagaatagtg

SEQ ID NO: 6779687 - DNA, 123 bp, Homo sapiens
ttagggagcgcagatatttaggaaaaggccaggagcgggaaaaggaagaagaaacgaaaaagattctccccttttcttaccttttgcccctcctttcccctcccgaaatttgcgcctacttga

SEQ ID NO: 6779688 - DNA, 104 bp, Homo sapiens
ctgactgttgtttaaagacattcggtttttctactatacagtttctcttgaatatccgaattactgagatgaatagatggcaagatgtcttaaacattgattag

SEQ ID NO: 6779689 - DNA, 66 bp, Homo sapiens
caaacttctttgtaagacatgtaagtcccttcacaactgggggcttgccttgctttaaaaaatttg

SEQ ID NO: 6779690 - DNA, 71 bp, Homo sapiens
attctggcctttttgcttttaggaaattagaaagtctccttcttttcctatatgcaaagaatgcaaaggat

SEQ ID NO: 6779691 - DNA, 92 bp, Homo sapiens
ggtggcatcatataggagagcttggaaagctatggctgtctagcatcaagtctcagatttccatctttttcatgtgcttggagaatgtcacc

SEQ ID NO: 6779692 - DNA, 64 bp, Homo sapiens
gaggtctggggccagatggaggggtggggacccacgcttcagttcccagctggcctgggacctc

SEQ ID NO: 6779693 - DNA, 76 bp, Homo sapiens
gtggttcattctcatgaaactcgcttcctctcactggatttctgccctgggggatgtggggttcaagtgaaaacac

SEQ ID NO: 6779694 - DNA, 76 bp, Homo sapiens
cttcgaggaagtggcctgaagtgaatgctctcgtgaaggacacatgtggcacagagcaggccactaatctgataag

SEQ ID NO: 6779695 - DNA, 59 bp, Homo sapiens
gtcttctagaagctcgaaaaggaaaggaggcagtttcttccttagagtttccagaaagc

SEQ ID NO: 6779696 - DNA, 57 bp, Homo sapiens
agatggtgaggtctgtgcagtattcatctgagattaatggcttagtgcttcacttct

SEQ ID NO: 6779697 - DNA, 72 bp, Homo sapiens
gggcctctaattactgatacacataagaatttggtggctttccaagcttctttgctgttgtcagataggttt

SEQ ID NO: 6779698 - DNA, 76 bp, Homo sapiens
ggtctccaaccgtttctccacacgctctgcctttctgacagcaaatctatgtttggcaaggaatgggatggagact

SEQ ID NO: 6779699 - DNA, 73 bp, Homo sapiens
tgcacacccgagcaagattttataagttgtgctaataataagtacatgtttttctctgcctgggttttgtgta

SEQ ID NO: 6779700 - DNA, 72 bp, Homo sapiens
ggctgctgtgccaaccccggctgccctcctgtcatcagaatgcaggcagctgggttggccagaaacattgcc

SEQ ID NO: 6779701 - DNA, 79 bp, Homo sapiens
catctatatatggaagcctgtattttggaacagacatatgaaagtgtttcttccaaaggcacgttctcctgaaaagatg

SEQ ID NO: 6779702 - DNA, 56 bp, Homo sapiens
tatgtcagagtgcttgggagggcggaatgtctccctccccaccagactctaacata

SEQ ID NO: 6779703 - DNA, 68 bp, Homo sapiens
tgaggcacatgtgtgtatacgtatttataagcataacaatttatagatacattgttatatttgtctta

SEQ ID NO: 6779704 - DNA, 67 bp, Homo sapiens
cattcccaacttgcaggattttgctgctgtagaatttacgatgccacaaacctgcatttaaggaatg

SEQ ID NO: 6779705 - DNA, 105 bp, Homo sapiens
tatatcaaactgtttgagagcaattgaatagatgcattatactatgagagaaaaaagattagtaaagcatgatttaatcaagtgcaatcttatagagtagatatg

SEQ ID NO: 6779706 - DNA, 66 bp, Homo sapiens
cctctctgcaccctgtggtcctctagagtagctagctctgaggccccaaggtgggtacaaagcagg

SEQ ID NO: 6779707 - DNA, 82 bp, Homo sapiens
cttggtcctctgaggcctgttccttcttctccctggatcttacctttaaatggctgaagatataatgcctcagagacttaag

SEQ ID NO: 6779708 - DNA, 60 bp, Homo sapiens
gactgactcccacagctttatttgctccaagcaggtgagcttatacatgtgaagtcagtt

SEQ ID NO: 6779709 - DNA, 69 bp, Homo sapiens
ttctcaagtgagatggccctggcatgtagctcagattcctcagctaaacagggccgtctcctctgagga

SEQ ID NO: 6779710 - DNA, 58 bp, Homo sapiens
gccctggacagtttctgcatgtgctgcagctgcaaagacagaaagcatgttccagggc

SEQ ID NO: 6779711 - DNA, 62 bp, Homo sapiens
gccctctattagtctttgctaaatagggaaaaaggtccttgggcaatttttggtagaggagt

SEQ ID NO: 6779712 - DNA, 114 bp, Homo sapiens
atttagtttcctgctggttgataattaactcattatagatatatgtccaagggtattcattgtatactttatttatgaaaggtatagtctttatcaaaaagaaatatactgaat

SEQ ID NO: 6779713 - DNA, 90 bp, Homo sapiens
gtagaggttgctaggactatagtgtacatgtagacacccttggggatgccagtcctatatgtccacctgtatgctaaacttctcttctgc

SEQ ID NO: 6779714 - DNA, 62 bp, Homo sapiens
tttgggctggagatgatctgctgtagttgtcactctcagtctttgatgcatcctagcctgag

SEQ ID NO: 6779715 - DNA, 86 bp, Homo sapiens
gcctggttcctttttctcacacaacgaaccaaaataagtgtgtatatgtgcatgtaggaatgtttgtgtatgggaaaaggtctggc

SEQ ID NO: 6779716 - DNA, 56 bp, Homo sapiens
tgttactctggctgaggtttggatccattgggatgaagaccctcagcagggtttca

SEQ ID NO: 6779717 - DNA, 63 bp, Homo sapiens
atgtctttgacataggatgtatcagtcatggtgttctgtgactaacttcatgtttaagaacat

SEQ ID NO: 6779718 - DNA, 130 bp, Homo sapiens
actgtgggttcttgggtgagtcactttgcctccaaaggcatcagtttcctcatctgttaggtgagattatacagactggcctagcagggaagcagtgaggatggcattaaatcaagcactaatccagggt

SEQ ID NO: 6779719 - DNA, 97 bp, Homo sapiens
gcctccataggagagtgtgtgatgtaaagaactggggatgtagcagttcagttactgcaattcctcagcttttatttcacttgccttttagatgggc

SEQ ID NO: 6779720 - DNA, 63 bp, Homo sapiens
ctggctgtgtcttggaggagctgggctggccctccaggccaactttgccaggagacagcacag

SEQ ID NO: 6779721 - DNA, 56 bp, Homo sapiens
ggagcataatcagcagctctaccttaagggcagtggtgggattgttttttagcttc

SEQ ID NO: 6779722 - DNA, 74 bp, Homo sapiens
gaaggtttgaggcatcaggagtatagccagaaccttgaggttctttctttggagtttgttgcctgtaaatattc

SEQ ID NO: 6779723 - DNA, 81 bp, Homo sapiens
tttgtggacattttgtttgtttgcagtgggatgatttgttttctttaaatagctttcccagcataacaaactgcccgcaag

SEQ ID NO: 6779724 - DNA, 71 bp, Homo sapiens
gataacccttcactgtggaggtaggagcaggacagctatctgactctgccacactcctccatagggttttc

SEQ ID NO: 6779725 - DNA, 55 bp, Homo sapiens
gtgcacccccaaggaggtggagcataattctcccctccttaaatatgggctgcac

SEQ ID NO: 6779726 - DNA, 68 bp, Homo sapiens
catatagtcacacacataatctaagattatatgccaaatatattatggggtgtgtgtgtgagtgtgtg

SEQ ID NO: 6779727 - DNA, 61 bp, Homo sapiens
gtgggaggtagcagggtccagagggtggaagcacacatccaggctctgctactattaccac

SEQ ID NO: 6779728 - DNA, 71 bp, Homo sapiens
aagtaataggaattagataatgtagagatatgagctcatggagtttatggaatagttatttttcattactt

SEQ ID NO: 6779729 - DNA, 81 bp, Homo sapiens
agaaaattattcttaggctttgaaatctaatcaaggaacagacaacctttgttcattgggatttcagaactgctattttct

SEQ ID NO: 6779730 - DNA, 90 bp, Homo sapiens
ggtccgcccttgtctctgcctgtcctgaggatgagggtcatcaactgagtcggggccacagggcagccatgggtgcgcgagtgcagggcc

SEQ ID NO: 6779731 - DNA, 61 bp, Homo sapiens
gatctatcatgccattgctttttcttaatgatattgggaagaagcaggagtgtgtagcatc

SEQ ID NO: 6779732 - DNA, 82 bp, Homo sapiens
tgcccagtgtctccttgtggatctcaaggatgtgcttccacatagcagcatgttcttcagatggacaaggagacactgggta

SEQ ID NO: 6779733 - DNA, 91 bp, Homo sapiens
tcacctgggagattgtttgaaatgcagaacctcagaccccaccccagcccctgtgaatcaaagtctgcattttaacaagatccccaggtga

SEQ ID NO: 6779734 - DNA, 70 bp, Homo sapiens
attcttcactaagtgccgagtttagttccttcccctggaactgtgatgcttatgccttagcctaaagaat

SEQ ID NO: 6779735 - DNA, 73 bp, Homo sapiens
cccattgtgaaggtccagagagatgatcaggacagctcatggctcagtcctggcacctcactggctacaaggg

SEQ ID NO: 6779736 - DNA, 55 bp, Homo sapiens
taggagttctttcccatcgaggggatgcaacttcctagcagggagaggatacctg

SEQ ID NO: 6779737 - DNA, 57 bp, Homo sapiens
ctcttgaagggcatctgagttacacatctccttggtgactacacatgactgcaggag

SEQ ID NO: 6779738 - DNA, 70 bp, Homo sapiens
gtcttcaatgctaaaagaatgtacttttcatgttgctttgcattgcaaatgagcttcattcttggaagac

SEQ ID NO: 6779739 - DNA, 56 bp, Homo sapiens
ggcaggagctcaggttggttccccacattttcgggcttactctgacgtgtcctgct

SEQ ID NO: 6779740 - DNA, 93 bp, Homo sapiens
tattgtactagttctgtcatgattagctgaagaatatgctggcagagacacgaataacgctcagaatttttcactcaatcttctagtgcagta

SEQ ID NO: 6779741 - DNA, 85 bp, Homo sapiens
ttggagatttgtcttaagaaattgcatttgtggtaatacttttaaatagactactttttgcaaatattttttaaatgaactctga

SEQ ID NO: 6779742 - DNA, 60 bp, Homo sapiens
tactataatataatttttccctttgcctttgctggtattggagaaggacaatgttgagta

SEQ ID NO: 6779743 - DNA, 81 bp, Homo sapiens
tcagctgccacttgacgacttctccccgtctctctgaggcccggaaaccacggctggaggtggggaggggatggcggctga

SEQ ID NO: 6779744 - DNA, 90 bp, Homo sapiens
ttctattgaattgttcattctcttagcatagtccttgtgattgtctttttaacagttagtattgtctaatagagtaaatgagaaaaagaa

SEQ ID NO: 6779745 - DNA, 63 bp, Homo sapiens
tgagagtggtagaaaatgcagctcgaggagaaagatcttagtagctacagctttacacttcca

SEQ ID NO: 6779746 - DNA, 80 bp, Homo sapiens
ctcttcacacctgggagtgcacaggtttcgttgattccatttcaggaatgctcagcctacgtgtttcccagaataaagag

SEQ ID NO: 6779747 - DNA, 74 bp, Homo sapiens
acctgctcctgggtgtggcctccctgctctatcttagacatacttcttggagcccatgagccataccagcaggt

SEQ ID NO: 6779748 - DNA, 66 bp, Homo sapiens
tcatgagagagaggcccaagaatacagatggacttgcacttgagtccactgggcttgtcctcgtgg

SEQ ID NO: 6779749 - DNA, 64 bp, Homo sapiens
gagcctcagggacggaggcttgcggattccagggctgagtctgggttccaggtctctgaggctc

SEQ ID NO: 6779750 - DNA, 56 bp, Homo sapiens
ctggtctagttcccagcacgctggacccgcagagtgatttcagggaacagaatcag

SEQ ID NO: 6779751 - DNA, 79 bp, Homo sapiens
ggtatgagtgtcccccagctctgagtgaatcagtaggaggtgctggacctgggctgattctcacagtgggacctcaact

SEQ ID NO: 6779752 - DNA, 88 bp, Homo sapiens
cagaatgatgctggcattgttcacagaatttgcgaagatctgagccctcaggtcctccatggtcttgaagtaatgcccccaatctctg

SEQ ID NO: 6779753 - DNA, 102 bp, Homo sapiens
ggccacagatgttgtctatttttgtgagatgatttgaaagtgtgcaaaaagaaacatctgtatggttatctcagaagtttaaagaaaatatcttattgtgcc

SEQ ID NO: 6779754 - DNA, 65 bp, Homo sapiens
tgctcctgcctctagacctaggttgggttgttcaggagctgggtctggaagcagatcagaaagca

SEQ ID NO: 6779755 - DNA, 68 bp, Homo sapiens
gggtttttttcataaggtaagagagatgaataagttatcactttttcattgatgggtgatagaaactc

SEQ ID NO: 6779756 - DNA, 68 bp, Homo sapiens
gctctagctccctgtgacagtatctgcttgagtttttcatgcaatctcttgttcaggatgctgatagc

SEQ ID NO: 6779757 - DNA, 63 bp, Homo sapiens
ggtttataaacaggttacaagacatttgctgaagtaactagctcatgtcatctgtttaaaacc

SEQ ID NO: 6779758 - DNA, 83 bp, Homo sapiens
attgtatctatgctcttccatcttcagctgcttataatatagccatttataggttctgatttgttggggagggtggagataat

SEQ ID NO: 6779759 - DNA, 55 bp, Homo sapiens
gatcatccgacatggtctctctggtgatgctgacaaggtgacgttttggatgatt

SEQ ID NO: 6779760 - DNA, 72 bp, Homo sapiens
taataatttgagaagaaccaactgaagttattgggtttgagaaaaacaatttggttccttctgaaagtattg

SEQ ID NO: 6779761 - DNA, 92 bp, Homo sapiens
gaagcattggctacttttaaatgtagatatagaaaaagactgacccactcaggattgggttatatgtttctgtttggaggcatccctgcttc

SEQ ID NO: 6779762 - DNA, 70 bp, Homo sapiens
tttgttcgggaggattgctatgaaaaagaggtaatagcttctgtaactcaaagtagttttatccaataaa

SEQ ID NO: 6779763 - DNA, 72 bp, Homo sapiens
acaaacacagtccctgcaccccattttacatttacattctccgtgtgtgtgtgtgtgtgtgtgtgtgtgtgt

SEQ ID NO: 6779764 - DNA, 57 bp, Homo sapiens
ggcctcatgcttctgaactcactgctcagaatgagaagtggggtctctgtggaggcc

SEQ ID NO: 6779765 - DNA, 61 bp, Homo sapiens
ggctatatgacattgctttttagaacttatctgtgagttttatgtagacaattcatttgcc

SEQ ID NO: 6779766 - DNA, 90 bp, Homo sapiens
gagagttagcctacaataaatgttattgtgattattacttttattatcattagttactagtcacttaacatttgctgcagctggcttctc

SEQ ID NO: 6779767 - DNA, 62 bp, Homo sapiens
accctgaggtgtttagtaggggcggagcagcagcatgagctgggccgtgaccacctgggggt

SEQ ID NO: 6779768 - DNA, 64 bp, Homo sapiens
ctggcaaggtttcgagttcccaaccacagcaccctcagtgatggttttcagaagaccttgttag

SEQ ID NO: 6779769 - DNA, 63 bp, Homo sapiens
gtgctgggcgttgtgcttagtaatttcattcatatgcaaagagcaccctcaatgtctgagcac

SEQ ID NO: 6779770 - DNA, 61 bp, Homo sapiens
aagtgcttggagcatacctgttacatagtaaatgctacgttaatgtgtgctactatcattt

SEQ ID NO: 6779771 - DNA, 55 bp, Homo sapiens
gggcaagtgtcaagcatgtcatttaaacaatcaaaatgtggcctcgcatttgcct

SEQ ID NO: 6779772 - DNA, 55 bp, Homo sapiens
ggcttcagctggttatttccttctctcgtgtggaaggccagagcagactggagtt

SEQ ID NO: 6779773 - DNA, 60 bp, Homo sapiens
tgtgggctcccctggcatgtccatgacagcccttcatggctcacttcctgggagctcaca

SEQ ID NO: 6779774 - DNA, 67 bp, Homo sapiens
ttgtgagaagtttaatgtgttttttaaaaattaacgcaattttaagtgtacagcaacttctcagcaa

SEQ ID NO: 6779775 - DNA, 86 bp, Homo sapiens
gagagacaacaatggaattctgggagagatctgacatcagcaggttcatctgatctctctcaggagagagaagtgtttgtttactc

SEQ ID NO: 6779776 - DNA, 68 bp, Homo sapiens
gcctccctttgcattccaaggcagcacttcaagcagcactttggtaaatgtcaaaaagttggagaggc

SEQ ID NO: 6779777 - DNA, 64 bp, Homo sapiens
gagggggtggtcacgctttccagggtcttttctgtttctgacaggctgtgattccaccactctc

SEQ ID NO: 6779778 - DNA, 56 bp, Homo sapiens
tagttgatgtgatgatgcttttcattcactaaagaaagtgctaagtcacccagcta

SEQ ID NO: 6779779 - DNA, 67 bp, Homo sapiens
gtcactttattaattttggtgagaaatgcttgtggcctgagttggagtgccagttaatggaagtgat

SEQ ID NO: 6779780 - DNA, 66 bp, Homo sapiens
ggataggaatgtctatgcagtgagggacaggaggcttccgtgtgtttcactagaacgttcttgttt

SEQ ID NO: 6779781 - DNA, 67 bp, Homo sapiens
ccagatggggctcagtgtggaggccagacagaggtgtgtgcctcccagtgagctgggccctgcctgg

SEQ ID NO: 6779782 - DNA, 84 bp, Homo sapiens
aaagaatgacattgaaaagacattgccccgaggtttggtagagcaaaagtctggatcatttgtactgttcaatgtcatgccttt

SEQ ID NO: 6779783 - DNA, 85 bp, Homo sapiens
ccaggaagcttttccataactgaccgaatgcatgaccctttacagatcagtttacatgtaacttcctcagggatggttttcctgg

SEQ ID NO: 6779784 - DNA, 116 bp, Homo sapiens
gttttctttgagcagaaaagtgtaacatgagcaaatttgccacttgagttcggcagcttcaggaagtctcaattagctacatgtatagacgaaatattctgaaccttggagaagat

SEQ ID NO: 6779785 - DNA, 85 bp, Homo sapiens
cctggatccgctcccggccccaagctccacacagccgggaaggaagctcgcgtttgttttgctggcgccagggatacggtccagg

SEQ ID NO: 6779786 - DNA, 61 bp, Homo sapiens
gctgggcttctcaatgctgcctctgagaggagagaggtgagggcattgtgggtgccacagc

SEQ ID NO: 6779787 - DNA, 56 bp, Homo sapiens
gtgatgaagtaaatgttatttaaacttccatcatgggttgtagcctacttcattac

SEQ ID NO: 6779788 - DNA, 78 bp, Homo sapiens
gccaggttgtaatttgcaaatgtattgtctggcccttaggggttggcagctaacaattgtttgcagaaggagcctagc

SEQ ID NO: 6779789 - DNA, 58 bp, Homo sapiens
tgttagaagactcttttacctataattttgtgttcagtgatgttgggggtcttctgca

SEQ ID NO: 6779790 - DNA, 104 bp, Homo sapiens
cctgcgaggcactcgccgaccctcccagcagtggaactacccagggacatgatgaatggctcctcactgggcactttggagacagggtgggagtagcaagtggg

SEQ ID NO: 6779791 - DNA, 89 bp, Homo sapiens
gagtctactgccaatctcacatagctaggagtagccaagccctttcatcctgcagctgcctcctgcctgtgtggaggccttattgactt

SEQ ID NO: 6779792 - DNA, 68 bp, Homo sapiens
ggcttgggggagctgttattggcagggaggcctttgtggctcgccagttgcctgtcttccccatggct

SEQ ID NO: 6779793 - DNA, 71 bp, Homo sapiens
actgtttgcgtgcaactttttttgtcattgtaataaagcgacaaggattaaggtatgcaacactgcacagt

SEQ ID NO: 6779794 - DNA, 61 bp, Homo sapiens
gtttctgacaaattctggttcctgtttcttggaatccaatcctactcagaaagttagaagc

SEQ ID NO: 6779795 - DNA, 57 bp, Homo sapiens
agtctttgctgcctcctcgtataatttctaaaaattgaaatacaagcagcagagatt

SEQ ID NO: 6779796 - DNA, 59 bp, Homo sapiens
gtcaggagagctgggagtttgagtcctcgagggcacaggagtcacagcatttcaggggc

SEQ ID NO: 6779797 - DNA, 65 bp, Homo sapiens
ttcttttaattgtgggggagtgtgagttgcttacgtccttactcaaatccctcagaattatagaa

SEQ ID NO: 6779798 - DNA, 65 bp, Homo sapiens
aagacactgggggctgcagccaagagagcagaaggagttggtggcagcatggtcccagtgtactt

SEQ ID NO: 6779799 - DNA, 69 bp, Homo sapiens
acaagatactcagctacaagactggcaaagaaatgcagaagacttaaaggctgaatgtaggattcttgt

SEQ ID NO: 6779800 - DNA, 124 bp, Homo sapiens
agttctggggctgcaggcgttcctcctgtgtccgccagtcagccggggctctctggcgcctggctgtgtcaggcctgtcccagctgaggacggtgaccctggagccgcgcccgcgcctggagct

SEQ ID NO: 6779801 - DNA, 84 bp, Homo sapiens
atggaatcttctacagaagcacttgcttagatgtggttatgttatacccatatgcatgtaatgcttttgcccaggtagctccat

SEQ ID NO: 6779802 - DNA, 64 bp, Homo sapiens
ggtccacaaccgccattgtctggtcgtgccatctaatggccactgcctccgccatggctggacc

SEQ ID NO: 6779803 - DNA, 86 bp, Homo sapiens
acgtcataatattttaccactgtgtatgctagtgagatgatttactcacattgcatgtgtatggtaggaatattaaataatgatgt

SEQ ID NO: 6779804 - DNA, 59 bp, Homo sapiens
gatcaggaatattggaaagtacttaaaggatgaagtacactaccaatagttctttgatt

SEQ ID NO: 6779805 - DNA, 61 bp, Homo sapiens
tttgcattcctgcctgcattcagtagataaacaaagaaagagcaggtccctggcatgcaga

SEQ ID NO: 6779806 - DNA, 112 bp, Homo sapiens
tctttgaggagtagttcaggtgactacctcatgattaatggcttgccttttctgtggaatgtcaaggcaagcagtcagtctatgaggacttcagttgtttattctgtaaaga

SEQ ID NO: 6779807 - DNA, 59 bp, Homo sapiens
ggaacagggatttggcctggttttttctgtgaactggggctaggcccagtttctgttct

SEQ ID NO: 6779808 - DNA, 118 bp, Homo sapiens
gttggtaattttaaaatgtctttcaccttctagagttaatatttatgtaaataaaaactgagaaatgagtgaaattctggtaaaggaagttggttgtaacattttaacttatatccac

SEQ ID NO: 6779809 - DNA, 102 bp, Homo sapiens
gttgcacaagttgtgcactgcacatctctagcaggcatgatttatgtggaatactatgtaaatggcaacccctagagctgtcaaatgtacagtttgtgcagc

SEQ ID NO: 6779810 - DNA, 77 bp, Homo sapiens
tccttccatgttgttatgtgaactgaaatttggaatgaagaatgcaaatgtgtaggtttacatattcccaggaagga

SEQ ID NO: 6779811 - DNA, 55 bp, Homo sapiens
ctgtcttctgcaaggtgcgtgggggtgtggccatgcacaagccagcaggggacag

SEQ ID NO: 6779812 - DNA, 60 bp, Homo sapiens
caaactgcaacatgaagtgtcccctgaatctccagcctgctcttctaccttgcagatttg

SEQ ID NO: 6779813 - DNA, 74 bp, Homo sapiens
ttctttatgttaacagtaaagaattgtgcaaggaagcttctaactgggccagttctttactcgtccataaggaa

SEQ ID NO: 6779814 - DNA, 97 bp, Homo sapiens
tcttttaggcccagctcttgtcttccaagatctacagcagtttagggtttgtgctttgaggcctgctggaaggtgttcccaggaggtgggaggaaga

SEQ ID NO: 6779815 - DNA, 58 bp, Homo sapiens
gttctctaaaagaaactttcaagacttatatatatcttgaaagtgttttaaagaggat

SEQ ID NO: 6779816 - DNA, 130 bp, Homo sapiens
ctcctatttgtccaaccccacagctggtgctctaaaccataatggctattgatttcttttgggaagaaagttctgtgagaaccagtgccagggtagaaaacctgaactgtaactgatgaactgatgggag

SEQ ID NO: 6779817 - DNA, 62 bp, Homo sapiens
gaatgacgccctgtggtcacttagcaatttctcttcttgaggccaggcacagtggcttattc

SEQ ID NO: 6779818 - DNA, 57 bp, Homo sapiens
gcagtgttggtttgctctgcagcctttcattttgctgccgtcttaccaaacagctgc

SEQ ID NO: 6779819 - DNA, 70 bp, Homo sapiens
gtgtacttctaatagcttttatgcagtctgtaatttatctacacttgtgttgaaagctgttagccaccac

SEQ ID NO: 6779820 - DNA, 67 bp, Homo sapiens
ctggcctgggctccgggagttactactcagatctgaggaaggtgagggcccccggggcttgggtggg

SEQ ID NO: 6779821 - DNA, 78 bp, Homo sapiens
ggacaaaactccttgggatggttgagccccagattgatgtatcaaatgacaccaaggtttagccactcaaggcttgcc

SEQ ID NO: 6779822 - DNA, 90 bp, Homo sapiens
tgagctcagagcctttcctgctctggcattcatgcaatagagaatgctggaagctgagatctgccatgacaggggcaggctgctggctca

SEQ ID NO: 6779823 - DNA, 61 bp, Homo sapiens
agttggggtgagtgattgatttacaaaccagcagtagattaaggctgcactggccttaact

SEQ ID NO: 6779824 - DNA, 72 bp, Homo sapiens
ctttttctgcctgcagtctgcagcggaggctgttcaatgtgctgcccgctgcagctggctgcagggaaatag

SEQ ID NO: 6779825 - DNA, 58 bp, Homo sapiens
tgcagtgtgacctgtagcgagctcagacaggcctgtggacatgtggtcacactcagca

SEQ ID NO: 6779826 - DNA, 100 bp, Homo sapiens
ggaagagaagttaattcatttcccaaagttagcattctctcttgcttaacctaagtcagtagaaaagtgtgacattggattggtatgaaatttatcttcc

SEQ ID NO: 6779827 - DNA, 130 bp, Homo sapiens
ggctccggcagctggcattcttcgggggcagcctcagctggcacctcggggggcaccaggcagtggccagagcagggggtctccaggtgccggggactgaggctacccctgctgtgggctgcagcttgct

SEQ ID NO: 6779828 - DNA, 63 bp, Homo sapiens
ttttatgtgtgtcgcaatagtgtagttagttaattatagctttctcattagcaccacgtagag

SEQ ID NO: 6779829 - DNA, 70 bp, Homo sapiens
agaacttgcttcccagtttagctctggcataaatccagagtccatatattgatttgttgagcaatgtttt

SEQ ID NO: 6779830 - DNA, 78 bp, Homo sapiens
ggaggggtgctactgggaactagtgggtttgaggacaaaaacggcattaagcttcctaaatgcacagggcagcccccc

SEQ ID NO: 6779831 - DNA, 102 bp, Homo sapiens
gtctggtttgcatgtttagtttcatttgtgggaactgcttgtccaagagtgagctcaggtcagggcagtttgtgcctatgagaattagctcagctatcaggc

SEQ ID NO: 6779832 - DNA, 86 bp, Homo sapiens
agtgtcttgctctgtggcccaggctggagtgcagtggtgtgatcatagctcaccacagcctccatctcctgggctcaagtgaccct

SEQ ID NO: 6779833 - DNA, 60 bp, Homo sapiens
tgtccgctcgtgcctcttcagtgtgtatgtgcacgagaaggtcttcccacagagcgggca

SEQ ID NO: 6779834 - DNA, 62 bp, Homo sapiens
gagcatgagactagctcatgagcagggaaaaccctgcctattcgattgttgtcttaaaactc

SEQ ID NO: 6779835 - DNA, 84 bp, Homo sapiens
ccaccgaagggcagagctgggcctcagaacacagtccaggagcccaagcccagcgttcttttaagtgcccagtgctgcctgtgg

SEQ ID NO: 6779836 - DNA, 97 bp, Homo sapiens
gttcatttctgtatctccagcactcaatacaatggttggcacatataacagtagtgctcaataactattcattgaatgaatgaatgaatgaatgaat

SEQ ID NO: 6779837 - DNA, 60 bp, Homo sapiens
tcagccttcccagtcaccaggactacagccacattccactgtgcctggctgggaatctga

SEQ ID NO: 6779838 - DNA, 57 bp, Homo sapiens
cagtagccactagacacatgtaattattgtgtatttgaagtgtggctggtgcagctg

SEQ ID NO: 6779839 - DNA, 102 bp, Homo sapiens
gctgttgtgaccctggacaaatcattctctgtgtctgtttgctcgtttgaaatataggactgaaaatgatggtactgtcctcatagggtcattgaaaggagc

SEQ ID NO: 6779840 - DNA, 58 bp, Homo sapiens
ccaggaggtggagattgcagtgactgagctgagattgcgccactgcactccagcctgg

SEQ ID NO: 6779841 - DNA, 121 bp, Homo sapiens
taagaagaaatgattaggtaaaatgaagcatgtttccagaccttatgacataaattttatcttaacatgaaataggaaacagatgtttctcctcctttgcttgcagtattttcctctctta

SEQ ID NO: 6779842 - DNA, 59 bp, Homo sapiens
aagaggaccagtagataaattttgtgcttaattttgtacttctttataattggcctctt

SEQ ID NO: 6779843 - DNA, 69 bp, Homo sapiens
ggacttttttgaaagcaatggagcactcttaatctgggcttagctctattactttcaataaaaaactcc

SEQ ID NO: 6779844 - DNA, 64 bp, Homo sapiens
attcattgcttacagctatttctgtatgtgtctgatatagtagaaagaacgctgaagtaggaat

SEQ ID NO: 6779845 - DNA, 65 bp, Homo sapiens
gatgtattttctgttttgttgaaaagttgtgtcgaagcaacaaaacagcaaaatgaaaatggatt

SEQ ID NO: 6779846 - DNA, 63 bp, Homo sapiens
gttttctctgagaagagttcaagtaaagataactttctttgtctcattcttgtccagtgaaac

SEQ ID NO: 6779847 - DNA, 56 bp, Homo sapiens
atattatattcaaagaaagagaggagacagagcctctctagtattaaatatagtgt

SEQ ID NO: 6779848 - DNA, 56 bp, Homo sapiens
ccaggccctgctgctgagaccttgacccctccaagtccctccacgcagcgggctgg

SEQ ID NO: 6779849 - DNA, 62 bp, Homo sapiens
aagcatgaatccaaacctttctgacctggatataggtcagcagtttctttgaatttctgctt

SEQ ID NO: 6779850 - DNA, 62 bp, Homo sapiens
gctgtttagctgggtaaatggagacaaaacaatgttagtcttcaagaagcccaaagactagc

SEQ ID NO: 6779851 - DNA, 83 bp, Homo sapiens
tgcaagaataaaatacatgttgatgacagtgatgaccgaaagcataagaatgtctctgccatcagcttatttccttctgtgta

SEQ ID NO: 6779852 - DNA, 83 bp, Homo sapiens
cctcaccatggactggacctggagaatcctcttcttggtggcagcagccacaggtaaggggctcccaagtcccagtgatgagg

SEQ ID NO: 6779853 - DNA, 92 bp, Homo sapiens
agctttgctgcttcagttgctagaagggggaaccaagtggagaacgtgatggcctattaacccttctgccaagaaaactgggttgcaaggtt

SEQ ID NO: 6779854 - DNA, 85 bp, Homo sapiens
agccaaagagatgtctgtacgagttacaatggggtcgaccaggaggcagtcaaagtaaaagtatagagtttgtatttttttagct

SEQ ID NO: 6779855 - DNA, 71 bp, Homo sapiens
tacaatatgtgaactttggtgtgtagcttatttcacttagcataatgtttttaaggttcatccatgttgta

SEQ ID NO: 6779856 - DNA, 63 bp, Homo sapiens
ctctgggcctgtccctgattgaggattctagcaggagttctcaaacactgctgggcctaagag

SEQ ID NO: 6779857 - DNA, 68 bp, Homo sapiens
tctccagggctccccaacatccagtccagtgcctgctgctccatctgaggctggggggtccctggaga

SEQ ID NO: 6779858 - DNA, 94 bp, Homo sapiens
ccacatccccttatttcatgcttgggatgctgaccatgtgaagacttggttgttggagctgtggtggcctccctgccatgatgaggggagaagg

SEQ ID NO: 6779859 - DNA, 64 bp, Homo sapiens
tgtggcaagtgacacagacggggactcccagctgggggtccctggaattacttgacatcccaca

SEQ ID NO: 6779860 - DNA, 84 bp, Homo sapiens
tagccttcacaaggcctccatctcccaggcattctaacctctgaagaaagctctctgtcccctggactgcctgtgtggagggta

SEQ ID NO: 6779861 - DNA, 68 bp, Homo sapiens
ctaactgggtctctattttggttttggctgccaagaagctcacagccagatctgagagatctttatag

SEQ ID NO: 6779862 - DNA, 79 bp, Homo sapiens
gagaaggagcaacaggggaatgtgcatgtagttttgattcattcaatatataatgagtactttccatgtgttttgtctt

SEQ ID NO: 6779863 - DNA, 71 bp, Homo sapiens
gactatttagtttcagattagttgacaaagtaacgaacaagcttggggtgatcttgaactaaataaacgtc

SEQ ID NO: 6779864 - DNA, 76 bp, Homo sapiens
gcagagaagatgggtgcctgttcccagaatacactcccaagttcttcaatgggcacagagtcccatctgcctctgc

SEQ ID NO: 6779865 - DNA, 66 bp, Homo sapiens
caaatagctctttagtcctggccattccagaccagaagctcggagtcagagcagaagggctgcttg

SEQ ID NO: 6779866 - DNA, 56 bp, Homo sapiens
gatgatgtgatttgcatttcagaaggctgtctctgctcctgaattatctcatcatt

SEQ ID NO: 6779867 - DNA, 61 bp, Homo sapiens
tgctggaagaaaattctttaacatcctgaaaaagaaagggtccaagaaggatctttcagta

SEQ ID NO: 6779868 - DNA, 82 bp, Homo sapiens
gcattcctgacactgagaaatattcagacattaaattaacataaaacaatgtctgtcagtagtaattcattgactggagtgc

SEQ ID NO: 6779869 - DNA, 57 bp, Homo sapiens
ctccaagtggtggaggccccagatggtctgggtcaggtgcttccagcactgcaggag

SEQ ID NO: 6779870 - DNA, 63 bp, Homo sapiens
cccaaacttcagaagttcttattttaaagcactcgagcacctaggaaatactgtaagtttggg

SEQ ID NO: 6779871 - DNA, 77 bp, Homo sapiens
tcttgtcaaaatgtaatcttattgcagaatttcttacgctctctagaatgatgtaactggttataatttttgactga

SEQ ID NO: 6779872 - DNA, 65 bp, Homo sapiens
gggctgagtgggcctcttacttgaaaagattcatgttcccttctagagagaaggccatatggtcc

SEQ ID NO: 6779873 - DNA, 115 bp, Homo sapiens
ggccggggcttgaccgggtctgggggctcgcctgcggtcagtcagcccgcgcactcggagccggggtctgggttgctcggcctttcccgtgccctcggccctggtgacccctgcc

SEQ ID NO: 6779874 - DNA, 76 bp, Homo sapiens
gagctgtgaatctcaaattaagaattttattgaaaaagtccatggagttttaagagcttaatctggatcgtagctc

SEQ ID NO: 6779875 - DNA, 57 bp, Homo sapiens
tgtagccaccaggctggatctgagagtctaagagggacaggtggcctggctggcaca

SEQ ID NO: 6779876 - DNA, 94 bp, Homo sapiens
aaagactgatgagaaatgattcagggagttttcaggagctatacctcaggggtctctttttagcctcttctgatcaacatttttgtcagtgttt

SEQ ID NO: 6779877 - DNA, 81 bp, Homo sapiens
tgtctagcagggtcatctgagggacgagatttcagagtgaacaccttgaactcttggtggtcattagatggtcctgtgata

SEQ ID NO: 6779878 - DNA, 119 bp, Homo sapiens
atttgaactaagtaattcatagaatactactacatttcatttgcagtatggataatgctaaattatccacatctaaagagaaatgttcttggggtttctggttttcccttatttcaagt

SEQ ID NO: 6779879 - DNA, 84 bp, Homo sapiens
cactctatcttttgagcaaggagacctacattttatataatcaaaatgtgtttagatggtttattgcttgtttaggatgttgtg

SEQ ID NO: 6779880 - DNA, 77 bp, Homo sapiens
actgtaaaaaaagatctttattggtggcattaaagaagacactgaaaaataatgcctaagtaattattttgaacagt

SEQ ID NO: 6779881 - DNA, 76 bp, Homo sapiens
ttaaattactgcagattgtgtggagcaaagaaatattattgaagcatttcaaaattccaggcaagcctgaatttaa

SEQ ID NO: 6779882 - DNA, 67 bp, Homo sapiens
cgcgtgggtgcctcaccccctggcagcgcctccagggacgctgctccgggaaagagcagccgccgcg

SEQ ID NO: 6779883 - DNA, 70 bp, Homo sapiens
gctttttgcgagctggtaactgcacacttcatctgttctcttagtgtatcttttatctgctgcaaagggt

SEQ ID NO: 6779884 - DNA, 56 bp, Homo sapiens
tttgctgtgcccttcttgtggcagcactttctgctacaagagcaagcatggacaag

SEQ ID NO: 6779885 - DNA, 76 bp, Homo sapiens
agctatgatattgatttataaggcccttcttttgttatcgtaacagtggggtcttaatagaacataggtcatggtt

SEQ ID NO: 6779886 - DNA, 128 bp, Homo sapiens
gggactcattgctctttggaaactctttaacctttacaacaaaggcacgtgcatgggattcatgattcctaaaggctcgtattgttgtgtgttaaattgtgttctctcaaaagatatgttgaattccc

SEQ ID NO: 6779887 - DNA, 61 bp, Homo sapiens
gcttgggctgtgggccaagtgcatggagtcccaggacacttccaggggccagcacccaagc

SEQ ID NO: 6779888 - DNA, 56 bp, Homo sapiens
ggaggtctgagtctatatacattgaggagatagtcaacacatgattcatggcttcc

SEQ ID NO: 6779889 - DNA, 130 bp, Homo sapiens
atagggagaaaaaactaactctggtccactttacatttaagagaaatatttagttcacaatccgtgaatgaataacaatcctctggagcttgaagaacgatctagatgaattacacttcttcccagttat

SEQ ID NO: 6779890 - DNA, 130 bp, Homo sapiens
gctacatttgggaattccagctggggctgggaggaagtgaaagaggaggacggttcccagaaggcgcataacaggcattttcagtgggggctttccttctgccactccgataagcccctcgagttcctgc

SEQ ID NO: 6779891 - DNA, 60 bp, Homo sapiens
cattgatttgcttgcctctcaatgctgttcaaacgtcagtaacaaggcagcatgttagtg

SEQ ID NO: 6779892 - DNA, 84 bp, Homo sapiens
ctgctaagtctgcagggtatttgtggctggattgattttacctcattaaatatgaaaatgaataagttaacccaggcttagtgg

SEQ ID NO: 6779893 - DNA, 108 bp, Homo sapiens
ttctggagctaggtaaattgggatcattcctggcttgtcacatctacgtgggacatttagactatccacgggctggataccttaggaaagttccttctggctctggga

SEQ ID NO: 6779894 - DNA, 69 bp, Homo sapiens
gcaggaaatgttaggggagagatgcaagtgtactactgatttttataactcttttgtgacaagcctagc

SEQ ID NO: 6779895 - DNA, 79 bp, Homo sapiens
gactgggtccttcatctggagcctggtcccacatcagtgtgacaagcaggctcctgaagaaataaatgacatgctagtc

SEQ ID NO: 6779896 - DNA, 57 bp, Homo sapiens
aagagacttgtccgaagttgtaaaattcagccattggaactttagacataatctctt

SEQ ID NO: 6779897 - DNA, 74 bp, Homo sapiens
atggatgtattttagatctgctttgccctatatgattgctacatgtgtctactgagcatttgaaatatgactat

SEQ ID NO: 6779898 - DNA, 77 bp, Homo sapiens
gacccttggtgaaattcaaataagatatgtagattagttaatagtcttgtatcaatgttgagttcctagtttgggtc

SEQ ID NO: 6779899 - DNA, 81 bp, Homo sapiens
aataaccatgagtatgattatacccagtaaaatcggctacctaaaaagactatactgttgatttcatgtttatggattgtt

SEQ ID NO: 6779900 - DNA, 66 bp, Homo sapiens
agtctgtcatgaggcaggagtgcagtggcacgatctcagttcactgcaacctccgcctcccagatt

SEQ ID NO: 6779901 - DNA, 85 bp, Homo sapiens
gatgttccaatgactagtggcatcctaaccctctaacacgtagatcaaggtatatcaagggtgactaactcagtcctgaaacatc

SEQ ID NO: 6779902 - DNA, 71 bp, Homo sapiens
agtgagtgctgagatgggtccattgaaagaagaaagatttctgaagtggccaatatgtcatgctcttcact

SEQ ID NO: 6779903 - DNA, 66 bp, Homo sapiens
gtgcacagatctttgagatgattctattgtgtttagactaataacttcatcttcaggataggtgac

SEQ ID NO: 6779904 - DNA, 107 bp, Homo sapiens
ggctgaggcaggagaatcgcttgaacccaggaggcggaggttgcagtgagctgagatcatgccactgcactccagcctaggcgactgagtgaaactctgtctcagcc

SEQ ID NO: 6779905 - DNA, 63 bp, Homo sapiens
gtttgtactcaggctcagcctctcctgccctttcagagaggctcccgaacactgagtattcac

SEQ ID NO: 6779906 - DNA, 66 bp, Homo sapiens
taggatagatgctgaatgggttaacttgaattttattatgtcattgaagacccaggctctatcttg

SEQ ID NO: 6779907 - DNA, 56 bp, Homo sapiens
agagttttatgccataaaactggatacgtttattctgtaagatgggataagacttt

SEQ ID NO: 6779908 - DNA, 83 bp, Homo sapiens
ggccactgccaacttctccctgaagaaacaaaaacacatgattagttgaccattctcagggtagaggtgacactggcatggcc

SEQ ID NO: 6779909 - DNA, 65 bp, Homo sapiens
ggtgagttaacgccatatatatgctatccttcatctgcacatggcatcatatgatgttgctcatc

SEQ ID NO: 6779910 - DNA, 64 bp, Homo sapiens
tgggcagatgtcctctgaagtggcatgggctgcttgctcactggccttcccaggaccctgccca

SEQ ID NO: 6779911 - DNA, 61 bp, Homo sapiens
cacagggaaggatttagtgggaagaatatgttagttttccactgtgtcattccctacagtg

SEQ ID NO: 6779912 - DNA, 105 bp, Homo sapiens
gtctggtaagtctggaacttaggacactaatgagaaaggaattaatttatttttgtattcaacgttattaagctctttttacatgttaggttctacacgctaggc

SEQ ID NO: 6779913 - DNA, 60 bp, Homo sapiens
cctcattacatcaccctgttttataaaatgagttgtcactggaaagtgcatgtaatgagg

SEQ ID NO: 6779914 - DNA, 71 bp, Homo sapiens
caggaccccgaggagaggtccaggcccttgggcttctgccaggccctgctgaggcctccctctctgtcctg

SEQ ID NO: 6779915 - DNA, 55 bp, Homo sapiens
ccatcccattagaaaaaggtcacacatctttggccccttttaatttcaggggtgg

SEQ ID NO: 6779916 - DNA, 67 bp, Homo sapiens
cctttgaagatacagctctggccagatgtgggcactcctatgttcctggggctgtggtcaaagaagg

SEQ ID NO: 6779917 - DNA, 64 bp, Homo sapiens
ggcagagaggaggccagcgcagctgcgctgcccgtcagcttctgctgctctggtttcctctgtc

SEQ ID NO: 6779918 - DNA, 60 bp, Homo sapiens
ttccactgctgtagggacataagccatattccatggaggactgtgcccttggcaatggga

SEQ ID NO: 6779919 - DNA, 97 bp, Homo sapiens
actgcaggtctttaggttgagtgcaaattcaatgaacatgtttaagcgactaaaaatgttccagcaaacattgatttgttagtagcttagatgtagt

SEQ ID NO: 6779920 - DNA, 55 bp, Homo sapiens
gagcagggtttgctagttgttggacaggcatttgacttaacagtaagccctgttt

SEQ ID NO: 6779921 - DNA, 60 bp, Homo sapiens
catggcccctggtcactatggcctcctgtccccatggccgctggtcaccatggcgtcctg

SEQ ID NO: 6779922 - DNA, 69 bp, Homo sapiens
cagtagaggagagagcttgggttttgaatttgatatagtaaagagcctgtctgcctttctacctcactg

SEQ ID NO: 6779923 - DNA, 67 bp, Homo sapiens
gagttcatttctgttggagaatttgcctcttcaattccttgagcaggctttccacagaaggaggctt

SEQ ID NO: 6779924 - DNA, 69 bp, Homo sapiens
caggtggggagagtgtggagcagctcttggattaggattaggaaaggagggctgctcttcctacacttg

SEQ ID NO: 6779925 - DNA, 81 bp, Homo sapiens
tctgtaactgcatttggtggatcgtgctgaaatacatcgcataggcttgtaaactcagtatgttttacttccatctacaga

SEQ ID NO: 6779926 - DNA, 60 bp, Homo sapiens
gctacaaagtggtaggaggtcacatgaaattccaaagcgtggccttttcccaccatgtgc

SEQ ID NO: 6779927 - DNA, 87 bp, Homo sapiens
gtgatgtctgctttggaaatatagactcaaggcacatagatgaaatattttactgggattttaaattttgaaagcaacaagcattat

SEQ ID NO: 6779928 - DNA, 70 bp, Homo sapiens
tcgttgttgtttatatcatccagtatacatttttgttatagtaactgacactgactaagacagcaactga

SEQ ID NO: 6779929 - DNA, 67 bp, Homo sapiens
tgaatgatttggcacacaggaggggcttgttaaacattagctgtgatgatctccttccaaatcttca

SEQ ID NO: 6779930 - DNA, 70 bp, Homo sapiens
ccaggatgtggcctagaggtgcaaggaaccagacaccactggcctacatcaaactccaggccacagatgg

SEQ ID NO: 6779931 - DNA, 98 bp, Homo sapiens
ggagcggggagtagacagtttagggatgctgtggcagggctgggtgccatcggctgggactcagtcctgatgacaggcccaagctatcattcctgccc

SEQ ID NO: 6779932 - DNA, 77 bp, Homo sapiens
tagttgacttctctatcccagctcctggtttaataattagacattccgggaataactgctttggcagaagtcagcta

SEQ ID NO: 6779933 - DNA, 94 bp, Homo sapiens
cagattgctgggtgccacccttagagtgtctgattcttggtctggggtaaagaccagagaatgtgcatctctaacaagttcccaaatgatgctg

SEQ ID NO: 6779934 - DNA, 81 bp, Homo sapiens
tgttgcccagctctggcagtttgccaggagctcggccgtggggcgcggtgtctggcgaagcatgccggggaggaggcagca

SEQ ID NO: 6779935 - DNA, 66 bp, Homo sapiens
ggcagaaggcttggaccagctacagtgggtcatgggaggcccctgctggtgtccaggctttggacc

SEQ ID NO: 6779936 - DNA, 86 bp, Homo sapiens
agatgtggttacagaataagtaattgtaaaatgaatgagtgaacaatttttttcccaaaggcaattgcctgttcttactaccatct

SEQ ID NO: 6779937 - DNA, 74 bp, Homo sapiens
cttcagagattgttgccacaaggcaattctgttatagatatagaagtgttttgtgaagacgggagcaaatggag

SEQ ID NO: 6779938 - DNA, 82 bp, Homo sapiens
gcaggcaacactgggctgtgagtttgtcctccatgagattctattccatccagggcagccatggcctggtggattgtttagc

SEQ ID NO: 6779939 - DNA, 67 bp, Homo sapiens
gcacatgtgggcagatacatttgatatgtgaacttctgatacctgcaaagtctctgcccatctgtgc

SEQ ID NO: 6779940 - DNA, 80 bp, Homo sapiens
gtgttctattgattcagccatctccatgctgagcacagaactttgcccagaatagatgggctgtgtcaatcaaagcccac

SEQ ID NO: 6779941 - DNA, 58 bp, Homo sapiens
tggccagacctgactgtcagggtgcagtcaccctgggatggattggcaggaatggtta

SEQ ID NO: 6779942 - DNA, 82 bp, Homo sapiens
agaagatgggttggggaaaggcagggcaggctcttcctggtaacacgggcgaccaggcttggctgtctcccagcccagtgct

SEQ ID NO: 6779943 - DNA, 75 bp, Homo sapiens
tgagaacagtgaagcttgtttggatcaggaaaatgcactttacatgtacaaggtaaattagcttcaagttctgca

SEQ ID NO: 6779944 - DNA, 116 bp, Homo sapiens
agtatcacacagtcaagttcaaagagaatcattagagagaaaactttgaggacggcaaaaaaaatcaaaagtgacacatttgtgatgaattaattttgaatgaggatagagatact

SEQ ID NO: 6779945 - DNA, 81 bp, Homo sapiens
actgcaaacaaactttggacaatttattactgttttgtctttgttagattacagtcctgttgtcaaagcaatgttgacagt

SEQ ID NO: 6779946 - DNA, 106 bp, Homo sapiens
tgtatttttagtagagaaggggtttctccatgttggccaggcgggtctcaaactcctgacctcaggtgacccacccgccttggcctcccaaagtgctgagattaca

SEQ ID NO: 6779947 - DNA, 61 bp, Homo sapiens
gtctgtgggtttcagggggctgtcagtttcctagtagacagcccagttgtacccaaacagc

SEQ ID NO: 6779948 - DNA, 66 bp, Homo sapiens
agtcataggagagatatcactgtgtgattgattatcacaaattgtatagatgataattcctagact

SEQ ID NO: 6779949 - DNA, 88 bp, Homo sapiens
agtgcgtgttaaaacaacaaaccactgcaccagctcatatgtgcaggctgagtgagctgcatggagctgtctgcatggtttacgtact

SEQ ID NO: 6779950 - DNA, 57 bp, Homo sapiens
tttgtgggcatatggctggctgcagtggggtaaggctgagcagatgttgcccagaag

SEQ ID NO: 6779951 - DNA, 82 bp, Homo sapiens
gcccttagttttaatagctgattagcctacaataaggtcgaacttgtgttttgtttctaattagcagtaaaaacaacagggt

SEQ ID NO: 6779952 - DNA, 79 bp, Homo sapiens
gcttcctgctttcagcaccctggtagagcccagtctcaggacaggcaccacactaggggctgacactgagggcaggagc

SEQ ID NO: 6779953 - DNA, 96 bp, Homo sapiens
ggtgtttttcttagagcccagaaaatgcagaacatagaatctctagggaaaccagcttctatggtctgtagctggttacttctaaaaaaaactacc

SEQ ID NO: 6779954 - DNA, 63 bp, Homo sapiens
agggacacttgctttcaggcccaacacatagtccttccaaggcccatcttgagagaagaccct

SEQ ID NO: 6779955 - DNA, 66 bp, Homo sapiens
tgcttaatcaagaagcctatttaataatttctgagcacttgagtaggagattgattgattaatgcg

SEQ ID NO: 6779956 - DNA, 59 bp, Homo sapiens
ccctcatgaccaatctacctgaagaatgttcattttacaaggaagtattgtcatgaagg

SEQ ID NO: 6779957 - DNA, 65 bp, Homo sapiens
gacacatatcaaaaccagaccgaactttccgcccctcctggcagaaacatctctgcttttgtgtc

SEQ ID NO: 6779958 - DNA, 76 bp, Homo sapiens
gtggggccaggtatgcagcacactccaggtactgcccagcagcagctgcttctgctttacttggttcatttcccac

SEQ ID NO: 6779959 - DNA, 60 bp, Homo sapiens
gtggtgggactcttctttggcagtgccatcatcatgtacatggcccccaagtcccgccat

SEQ ID NO: 6779960 - DNA, 72 bp, Homo sapiens
acctctaagctgattccactttttccacagagctgctccagggcggtgtgggtggaggggggatcaggaggt

SEQ ID NO: 6779961 - DNA, 71 bp, Homo sapiens
aggtttctgcaatgtgtgtacactggagccattagaacgaagacccagacacacgatgcgtgcagaagctt

SEQ ID NO: 6779962 - DNA, 64 bp, Homo sapiens
tgaaagaattaggtgataggattttgctataaagcaaataaactaagtttatgtagttctttca

SEQ ID NO: 6779963 - DNA, 55 bp, Homo sapiens
tagcatgagctctgcaccatacgcctaaagggtgacctaatgctgagttctgctg

SEQ ID NO: 6779964 - DNA, 130 bp, Homo sapiens
gtcctggagagtagtatttcggatgtctgggctgtgggatgtgggaggaatgtcactgagccattcctcaggtggcacatgccattcctgccccgtccccacataggaatgcgggccacttctcacaggc

SEQ ID NO: 6779965 - DNA, 78 bp, Homo sapiens
agctggactttgaactcctggttcccagttgagatgtatcatacaatttctgctaaccaaggagagatgtgttcagct

SEQ ID NO: 6779966 - DNA, 93 bp, Homo sapiens
cagccttaaatgacatttattatcttacagttctagagatcagaagtctgaaatgggtctcactggggtgaaattggagtgtcagcagggctg

SEQ ID NO: 6779967 - DNA, 56 bp, Homo sapiens
tcctaaatcctgaaaaaaaggtttgatgcacaatctttacagcagcaggatttgga

SEQ ID NO: 6779968 - DNA, 55 bp, Homo sapiens
tgctatgtctcactccctagtcagattatagatttctagaggggagatactagta

SEQ ID NO: 6779969 - DNA, 58 bp, Homo sapiens
ctttaacatgggctcttaagatatatgttttaatctacagagaggcctgtgcttgaag

SEQ ID NO: 6779970 - DNA, 56 bp, Homo sapiens
acaggagtttctgacagagacaggtcaatgcgcttgtctcctagctgtctccatgt

SEQ ID NO: 6779971 - DNA, 97 bp, Homo sapiens
ctctgcctagttaatgacctcttatttacctggattcttacttccttttttctaagagtacaaatttaggtgaactgttaggtgaaagattccagag

SEQ ID NO: 6779972 - DNA, 65 bp, Homo sapiens
gtgctggaaggtgggtgaagtgcagatactcctttttgtgtgtggctgtggatgctttccagcac

SEQ ID NO: 6779973 - DNA, 83 bp, Homo sapiens
tttgcctcaaggttgagtaaattgttgggatgaatagaaaaagatccgaaacaggatcttagcccttgggatatgtaggcaga

SEQ ID NO: 6779974 - DNA, 65 bp, Homo sapiens
tgtccataatgggatgtaaatgtgataacataaatgtgttgtacaattgtttcacatgcaggaca

SEQ ID NO: 6779975 - DNA, 102 bp, Homo sapiens
ttttcacaaatggctaacaagaagtgagagaaacagataagaggacttgggcagggaacctttagttgttatttcttcacacaatttgtaacatttgggaaa

SEQ ID NO: 6779976 - DNA, 58 bp, Homo sapiens
aggagtctgttgaaatgtctattatcttgtggtatatcagcacattaaacatactcct

SEQ ID NO: 6779977 - DNA, 64 bp, Homo sapiens
ccttgctgtgtgtcagtcactggtaaggatttctccaagcacttccagtactgcacactcaagg

SEQ ID NO: 6779978 - DNA, 55 bp, Homo sapiens
ttctgacccttggttggcagatgtccaaaaatgatactgacatcccaggtcagaa

SEQ ID NO: 6779979 - DNA, 64 bp, Homo sapiens
cttccttctcagccctcgaggatgcatatagctaattaagcaggcccagagacagagagggggg

SEQ ID NO: 6779980 - DNA, 62 bp, Homo sapiens
tagcacagctttttaaaatggcattctcagagttctagagagtggcagcaaaaagtgtgctg

SEQ ID NO: 6779981 - DNA, 64 bp, Homo sapiens
tgcccaaacgctgtgtgaagtgctgacctcagctcttttcaagctcacacggtgtttgcttgca

SEQ ID NO: 6779982 - DNA, 110 bp, Homo sapiens
ttggaggataaaaagaaaggcctttttgtgagggaggagaatacaggactttcactagctgttcctcctagatgtcttcagagaaacattttgtctctttgtctctttga

SEQ ID NO: 6779983 - DNA, 67 bp, Homo sapiens
gttcaggacaattgagagtttgttgacattctttcaagatttgttataaactattaatttcctaggc

SEQ ID NO: 6779984 - DNA, 64 bp, Homo sapiens
gtgggcggggttccgtgccccagagtcgagggagccgtgggcttggggtccggatcgcggccgc

SEQ ID NO: 6779985 - DNA, 111 bp, Homo sapiens
tctggaatgtttgtctgtgcctgggcctgtgctgggtgtgagggacataacaagtgtgtcactgtcctccagggctccagcctaggacaaggaacaggctcacaagccaga

SEQ ID NO: 6779986 - DNA, 84 bp, Homo sapiens
gtaatcgggcatcacagcagttcaggccgcagagggctccaggctctttaccttttacaagctgtgtgaccttgggcagattac

SEQ ID NO: 6779987 - DNA, 77 bp, Homo sapiens
gctgcaaaggggaaagacatcaggttgcctgcatcagctgatggcagcttgccctggtctcaactcaacttggcagc

SEQ ID NO: 6779988 - DNA, 56 bp, Homo sapiens
gctggtgatcttgggcaagtcacttatctctgtgaagtcccagtggattcacctgt

SEQ ID NO: 6779989 - DNA, 66 bp, Homo sapiens
ctttatagccagtgcacaaataaatattatgtgcgtgtgtgcctgtgtgtgtgcgcttgtgtgagg

SEQ ID NO: 6779990 - DNA, 60 bp, Homo sapiens
atacagttagaaaaaaagccttttctctaggtaggtagttatgtttttttctgactgtgt

SEQ ID NO: 6779991 - DNA, 55 bp, Homo sapiens
gcccaaggtatatcagagacagtagatcaacaagtcaactggtagacttttgggc

SEQ ID NO: 6779992 - DNA, 62 bp, Homo sapiens
ctgcctggcatagtctggtcgaattttcatgataccaggtgatcagcactaagtcaaggcag

SEQ ID NO: 6779993 - DNA, 77 bp, Homo sapiens
tggatgaggcaggctggtctgaagagtgcactgataactagaagctcattactttttagcacagtgtgtgccatcca

SEQ ID NO: 6779994 - DNA, 97 bp, Homo sapiens
gccttcttcccgaaaccagtgatttctgtgtgggtagctcctgtttatccagaccaaactgatcaacttacccataagaaagctgttcttcaaaggc

SEQ ID NO: 6779995 - DNA, 80 bp, Homo sapiens
taggaagataaaataactatggaatactcctttatatttataagcctaagaggaaccagaagttcattttgtgcttccta

SEQ ID NO: 6779996 - DNA, 58 bp, Homo sapiens
gaagattagggttagcataagttacacctcatattggctgcggctggccttaattatc

SEQ ID NO: 6779997 - DNA, 74 bp, Homo sapiens
cctcttactaagacattgatattaggcagtgtaggggatgtcttttgttgcctacttattaaaattgtaagggg

SEQ ID NO: 6779998 - DNA, 124 bp, Homo sapiens
gactacatcacagcagcatacgtggagatgaggcgagaggcttgggctagtaaggatgccacctatacttctgcccggaccctgctggctatcctgcgcctttccactgctctggtaagtgccc

SEQ ID NO: 6779999 - DNA, 56 bp, Homo sapiens
gtctccagccattctctgatcatctctgtatgaactgaaatgagaatgctgagcac

SEQ ID NO: 6780000 - DNA, 85 bp, Homo sapiens
gccttgtaaacagtagtatttaaactgaactaacagacaatagaacaagaaagttagaagtttgtgaaattactgtacgaaaggc

SEQ ID NO: 6780001 - DNA, 55 bp, Homo sapiens
cgtaccacagcagtgtctggtactgagtaagagctcaatgaatattgcttggacg

SEQ ID NO: 6780002 - DNA, 67 bp, Homo sapiens
gtcctgtcccccaaggctgtggctgtccatcagtcctgcctgttgcagccatgtggggatttagggc

SEQ ID NO: 6780003 - DNA, 93 bp, Homo sapiens
tttagggaaacacaaaataaggccagcatgaatgcagcagtgagaactacttattattcagtcattgattggccttgatagtatttatctaaa

SEQ ID NO: 6780004 - DNA, 64 bp, Homo sapiens
cctcaggaaccctggtctcctgctctaccaagtcagcacggagttgaggggtgcagacctgggg

SEQ ID NO: 6780005 - DNA, 68 bp, Homo sapiens
tcagagttgtctggtcctaaagctaccttgtgtcttataggtggcagctggtatgcagacagaactga

SEQ ID NO: 6780006 - DNA, 70 bp, Homo sapiens
ggcttggcttgaaattaaggttatctcacaggactagaataaaaagtaaacctaaaagcaagaccgagtc

SEQ ID NO: 6780007 - DNA, 57 bp, Homo sapiens
atggcactgggagtctgtgggggttcttatctgattacttcaatttctcagtgaagt

SEQ ID NO: 6780008 - DNA, 88 bp, Homo sapiens
gctcatctggccagtgcctgtgggccccgggcagggcactgtgcacagggcagagacgcagggggcccatcggcactgctgtgatggc

SEQ ID NO: 6780009 - DNA, 68 bp, Homo sapiens
gcctggcataaagcaggtgctcagtgaccagtgggtatcagttggtcccttgctgctttgagttgggc

SEQ ID NO: 6780010 - DNA, 58 bp, Homo sapiens
gctctgccttctcactgggttcacctcccaaggtttccagtctcctgaaaggcagcgt

SEQ ID NO: 6780011 - DNA, 62 bp, Homo sapiens
tcccagccttccagtctggttttcatcgtttcagaataaacgtcaaggcttagaaggtgggg

SEQ ID NO: 6780012 - DNA, 73 bp, Homo sapiens
cctatgcaaacactcttgcatttgccaccgagtgtatctaatagcttgcaagaatccagggtgtttgctgagg

SEQ ID NO: 6780013 - DNA, 74 bp, Homo sapiens
ttctcagcctctgcttgggctcctagctccaggaggggggtcagtgacatgctctcaggcataaaggctgagaa

SEQ ID NO: 6780014 - DNA, 98 bp, Homo sapiens
cagttatttaagaaaatgtgcagagccattatggagacttgcaggttgacttacaaagtaggtctccataaggcagaaacatttttaaaatctgactg

SEQ ID NO: 6780015 - DNA, 95 bp, Homo sapiens
ggccaggctagtctcaaactcctgacctcagatgatccacctgccttggcctcccaaagtgctgggattacaggggtgagccactgcgcctggcc

SEQ ID NO: 6780016 - DNA, 71 bp, Homo sapiens
gaaagtgcatgtcaccttcggtggcacggtctgcagtgggtgggcctctctactggaaggtgaccaccttt

SEQ ID NO: 6780017 - DNA, 130 bp, Homo sapiens
agatgacatgctgataggatgccatgttgttccaaatgctgtaccacactttttattctgactcatagtgtggtccctaggaaagcagtgttggaaaatcagctcaagatggcagaagcaactaattcat

SEQ ID NO: 6780018 - DNA, 67 bp, Homo sapiens
ggcaggctgtaggggctgggctgctgcggccaccagcacagacagccctgtccctgagggacctgtc

SEQ ID NO: 6780019 - DNA, 69 bp, Homo sapiens
tccctcctcaggcagaaacacctaacagcttggatggctggcagtgggctccgttgcctggggcaggga

SEQ ID NO: 6780020 - DNA, 71 bp, Homo sapiens
aagggaagtgataggacgtctctgcacacagcacatatccatgcaggatggtcagtactgtcgctttcgtt

SEQ ID NO: 6780021 - DNA, 55 bp, Homo sapiens
agtttgaaggagttgaatcaccttgcattgctgggaagttcatgatctttctgct

SEQ ID NO: 6780022 - DNA, 97 bp, Homo sapiens
ggccaggctcacgggtcttcgggttgccttttgctctgggggcaggggctttcgtccccgcttcttccggatgggatccttcagctcgggtttggcc

SEQ ID NO: 6780023 - DNA, 65 bp, Homo sapiens
tggacaaaggtctggggaacctgcagaaccgctctgggctggtgttcaaacagactttgtgtcca

SEQ ID NO: 6780024 - DNA, 69 bp, Homo sapiens
aaagggtcagattctgctagtgaccaagctacagcttgggtgcatggtgtggacagaattagacacttt

SEQ ID NO: 6780025 - DNA, 81 bp, Homo sapiens
gttttaaaaaatggatctttgccaggtctggaaattcagtttccttgagttcttctgagacagcaaagattcttcagagac

SEQ ID NO: 6780026 - DNA, 99 bp, Homo sapiens
ggcaccggccttgtcatggggagacacctagggaaagatgggcaaagagacaagaatttccaagtttcctctgactgctcccctgcaacacggagagcc

SEQ ID NO: 6780027 - DNA, 96 bp, Homo sapiens
cgtgggacagtgttaaatcatgctagtattacatttttgtgtgtatggtttagatacatttccagaacgtattgctgacatacgcattgtcttgcg

SEQ ID NO: 6780028 - DNA, 83 bp, Homo sapiens
gtactcattaaagctagaattgttccagcaagttcaaattacatatttgttcaatgtaaataattcctaggctttttgagtgc

SEQ ID NO: 6780029 - DNA, 78 bp, Homo sapiens
tcatcagaggagctcccagccctaagccacagaagaaagctgcacttactggcattctgggagctagctctgagctga

SEQ ID NO: 6780030 - DNA, 75 bp, Homo sapiens
ggttcagttacatgctcatgtcatcattgtcccatagcaatttgaacatgctgcatgataattatttcttgagcc

SEQ ID NO: 6780031 - DNA, 63 bp, Homo sapiens
ctccaacgaggctggggtacaactagaggcggttgtctccattgacccgagtccttcttgggg

SEQ ID NO: 6780032 - DNA, 65 bp, Homo sapiens
gtacatcccagctgcccagacattgaatcaggaaatttttctgagaaaggcaggtgggtatgggc

SEQ ID NO: 6780033 - DNA, 56 bp, Homo sapiens
attctacagatgaaagcggctgaggcacagagcagtgcagcagctcatctgagagt

SEQ ID NO: 6780034 - DNA, 112 bp, Homo sapiens
ttctgtctgtgagattgtcctgggcttacgacctctgactggcagttgaatctttgcaacactcttacagtagcagagtcagtcgtgtgttagcagtctcatgaacacagaa

SEQ ID NO: 6780035 - DNA, 56 bp, Homo sapiens
cctctggcatagcaagtggcctctacatggtgtgaaggtcaaaggcatccatgagg

SEQ ID NO: 6780036 - DNA, 97 bp, Homo sapiens
gcatgcagaagttggaagatgagggaaggcatcacagaggctgtggggtgaactgacttcaaggaatgggtccttcccttcagagccacatgtgtgc

SEQ ID NO: 6780037 - DNA, 81 bp, Homo sapiens
tcattagtagccaatgatatatatttgtatcatgtatacatatttgtgtaatgatacatatgtatcgttagtagccgatga

SEQ ID NO: 6780038 - DNA, 74 bp, Homo sapiens
cccagagatcatccagtttttcagcctctttatagatagggaaactgagggctggaggtactgtgacttctggg

SEQ ID NO: 6780039 - DNA, 63 bp, Homo sapiens
acaggttcactaggaacccattatttactaggcaaaagtaaagctaaccttagtgaacactgt

SEQ ID NO: 6780040 - DNA, 82 bp, Homo sapiens
accaagttaggttttatcctctgtttacatgtgtgctttagagagggcacatgtgtaaaagtggataaaagtgacccatggt

SEQ ID NO: 6780041 - DNA, 61 bp, Homo sapiens
atgaaacctttgcagtgaatccataaatatttgtgtgtttaggttagctccaaaggttcat

SEQ ID NO: 6780042 - DNA, 87 bp, Homo sapiens
cttttcacacttccgattttcagcacacatcctgtgagcatagtaagtgctcaataaatgttagttgaattgaggagtgctgagaag

SEQ ID NO: 6780043 - DNA, 78 bp, Homo sapiens
taagcaagttaataaagttgagattctttcagtgcacaaatagctcttagtgtcactgtcaatgtcaactactgtttg

SEQ ID NO: 6780044 - DNA, 70 bp, Homo sapiens
gcttctgtaggtactggctggggccaaggtatctgtgtgctttgaaagctcccaggacttactaagaagc

SEQ ID NO: 6780045 - DNA, 104 bp, Homo sapiens
ttgagacagagtcctgctcttgttgcccaggctggagtgcaatggtgcaatctcggctcactgcaatctcagcctcctgggttcaagcgatgctcttgcctcag

SEQ ID NO: 6780046 - DNA, 88 bp, Homo sapiens
agattgcttcttgatttattctacccagaatgtacacctagatctgctactaagcttttggataggatagaacagaatttggtactct

SEQ ID NO: 6780047 - DNA, 80 bp, Homo sapiens
gcttgattgagagaaacttgttttaagtaggtagcgtgaccagccacagttgaggacttaaacaaaactctttgttaggt

SEQ ID NO: 6780048 - DNA, 85 bp, Homo sapiens
gtccagtttaaagccctgccacccattcactgtaaatctagaaatactggacttgaggaggtaggtaggaggcattttattagac

SEQ ID NO: 6780049 - DNA, 61 bp, Homo sapiens
gagcacacttgggtgggaaggctctgctatgaagggtaccaagggcttgccaagtgtgttc

SEQ ID NO: 6780050 - DNA, 98 bp, Homo sapiens
ctttggagctctcaggtggctgctctccatcccaggcctggctgtaggaggctacctgggtggggtgcaggcccatgcctggggtcctggctccagag

SEQ ID NO: 6780051 - DNA, 60 bp, Homo sapiens
gccaccagtagctaacaacagtgattgttgttgatgattttgctgttgtgttctgttggc

SEQ ID NO: 6780052 - DNA, 59 bp, Homo sapiens
tattacagctcttactccgaaattttaaaaatgaggtttcacaatttagagcagtgatg

SEQ ID NO: 6780053 - DNA, 59 bp, Homo sapiens
ctatggacagtgctcagaaatttgtgggtctaaccacagttttatacttattgtcctag

SEQ ID NO: 6780054 - DNA, 62 bp, Homo sapiens
ggtttctgccaaagaagtaaatggaatctccaaattccattatttccatggccagtttgact

SEQ ID NO: 6780055 - DNA, 59 bp, Homo sapiens
aatctcctttttactgaggcttttgtgtttccaaaaggctcagcccctgggaggagatt

SEQ ID NO: 6780056 - DNA, 64 bp, Homo sapiens
gccaacttctctatttagtattccttgtttcctgttcagaccaaatccttaatgaggagttggt

SEQ ID NO: 6780057 - DNA, 70 bp, Homo sapiens
cctggcgaggcagggctgtgggcactgggctgtccattgtagggtggcagtgctggttctgcctgtgggg

SEQ ID NO: 6780058 - DNA, 104 bp, Homo sapiens
ttccctttcttttctggttgcctcatactcccagccagctgtctcttctcctttaaggctgagcctggcatgggggtctggtggggtactgagtagcgggggaa

SEQ ID NO: 6780059 - DNA, 61 bp, Homo sapiens
tgaggaaagaaaggcatgcatgaaggctccattccttttcaaacataattttctttcttta

SEQ ID NO: 6780060 - DNA, 60 bp, Homo sapiens
tgaccaatgagatgtgtgaggaagtctgcagggaccttcaagaaacatttccttggctca

SEQ ID NO: 6780061 - DNA, 77 bp, Homo sapiens
aaaggtataagttcatctttttttgcatgtggatattcaattggaccagtgaccatttgttgaaaagattatccttt

SEQ ID NO: 6780062 - DNA, 58 bp, Homo sapiens
cacattcttttaacggctttacctgattcataactggacccagctgccagggagtgtg

SEQ ID NO: 6780063 - DNA, 81 bp, Homo sapiens
gccccagcctcccgagtagctgggattacaggctcccgccaccatgcccagctaattttgtatttttagtggagatggggt

SEQ ID NO: 6780064 - DNA, 84 bp, Homo sapiens
ccagaggtcaggagtggccctgtgaacagcgcagtcccgtggtacagtgggagggtgctgtggctgggccggtctgggtcctgg

SEQ ID NO: 6780065 - DNA, 129 bp, Homo sapiens
gagattttttatattaatgtgtgtattttgtaatgtatgtggtatgtgtatatatatgtttattttagacacatttgactacatttatatattcatagagatttacatagaggcattaaaaaaacaggc

SEQ ID NO: 6780066 - DNA, 60 bp, Homo sapiens
ctggcagcagttatgaaacaatgttacttgttcttagtaaagttcaggcacttttgccag

SEQ ID NO: 6780067 - DNA, 82 bp, Homo sapiens
acctggaaagctacatcaccttcacgaaccattcaggggtcctgaccccagtcatcctgcaggtgaaagagctgatcagtgt

SEQ ID NO: 6780068 - DNA, 72 bp, Homo sapiens
cagtgagtgaagcattgcagcaaatgaaattctggctttcttttcattttgaacaagagcttcacattattg

SEQ ID NO: 6780069 - DNA, 62 bp, Homo sapiens
gatatgtgtccaggagcagtcattgccttatctctcaatgttgttctctgcaaacacaattc

SEQ ID NO: 6780070 - DNA, 65 bp, Homo sapiens
tgtgggagccacagtgaggtgcatggttgcggggtacagctggcttctctgtggtggctccccca

SEQ ID NO: 6780071 - DNA, 125 bp, Homo sapiens
cttttaagaatatatttagcagtgttaaacttgctgaagttgctcagctccatccaataaaaggattgaccaagagcaaattagcatttcattaactattttaaatataatactaacttattgag

SEQ ID NO: 6780072 - DNA, 55 bp, Homo sapiens
cccaaacatccaggtgctggacaaggactcctaccattgcatctgaatgtttggg

SEQ ID NO: 6780073 - DNA, 55 bp, Homo sapiens
gctaaataatcttcttctgacatgtatagcagcacagtgtgaagtgttgtttagc

SEQ ID NO: 6780074 - DNA, 98 bp, Homo sapiens
tccctgggggctaagagttaggaaaggccttgggcctgctttccttggccccctgccactgaggcctgggcccagggaactaatctttgctcctggga

SEQ ID NO: 6780075 - DNA, 114 bp, Homo sapiens
ggtccattttctatgagaataatcctgttgctggctcattttgcgggcattgagagcttgggctttgtgatagaatgagctaaaggcaggaataacttacagcagaatgtaacc

SEQ ID NO: 6780076 - DNA, 73 bp, Homo sapiens
gtgactggtacaggaaggagggagtttcagagtcctgataatgttctatttcttgatctagcatgccagttac

SEQ ID NO: 6780077 - DNA, 78 bp, Homo sapiens
tctgtatactcatttatccagctcctctagttgtagacatttattttaaagagagaattggataaattggtaaacaga

SEQ ID NO: 6780078 - DNA, 119 bp, Homo sapiens
gtttcagttagattactttgtggcatagacaacttggtaactttttaattgcttatctcaccaaaagaagtttaaaaggggtattaagtccatttattgccattacatctatagcaaac

SEQ ID NO: 6780079 - DNA, 57 bp, Homo sapiens
gcccaggctggagttcagtggtgtgatctcagctcactgcaacctccgcctcccggt

SEQ ID NO: 6780080 - DNA, 98 bp, Homo sapiens
aaacagaatgctaaaggaaggaatgtggccacttttttctgggcatacaattagtctagtcaatagaggtcacactggaccaagcatttgagatgttt

SEQ ID NO: 6780081 - DNA, 60 bp, Homo sapiens
ggcattgcggcgtggtccggggcgcgactcgggagggagcctcctgggctgcgtcttgcc

SEQ ID NO: 6780082 - DNA, 85 bp, Homo sapiens
ctatggtattcttgatgcaaggtatgttattgttatcatttatttatcagatgctcagtatatgctctttcatcaaatagtatag

SEQ ID NO: 6780083 - DNA, 97 bp, Homo sapiens
gtgagaaataatagtagctaccaatgtattgagtgtttgcatatgtgtgcatgtgtgtacatgccagcctctaagcactttacattcatattctcat

SEQ ID NO: 6780084 - DNA, 58 bp, Homo sapiens
atgtttcccataagattttctgtgcagttggtgaagccagatttgctctgggaaacat

SEQ ID NO: 6780085 - DNA, 60 bp, Homo sapiens
ggtggggcttacctctgaagctggcatctcacctctgtcagcattcttggccagtccacc

SEQ ID NO: 6780086 - DNA, 110 bp, Homo sapiens
gcttactttttacacctgaatgcctctagtctcagccttcacctaaagggtcagcagcttctctttgagcgtgtagggtggggcaagaaggacgccaggggattgtgggc

SEQ ID NO: 6780087 - DNA, 63 bp, Homo sapiens
catggtcagaggcagcaaggactgacatggatttcagtttgccactgtggactctagatcatg

SEQ ID NO: 6780088 - DNA, 55 bp, Homo sapiens
gaactccagggaacagagccaccacattgactgtggcctgatacttccagagttc

SEQ ID NO: 6780089 - DNA, 109 bp, Homo sapiens
ttttgtaaataggaaaacagactcagggaggttacgtgtattctgtgaggttactcaccaagtaaatgtcaaggacgtgcatgaaccccaggtttgtctatatacgaaa

SEQ ID NO: 6780090 - DNA, 77 bp, Homo sapiens
gaggctgttgttttaaacgcgctcattagccacacaaatcagtcctgttgacagagcgcctttgaattaagcatctc

SEQ ID NO: 6780091 - DNA, 65 bp, Homo sapiens
catttttaggtcatgtttttcttctctgtatatttatctgtgaagaataaatgacattaaaggtg

SEQ ID NO: 6780092 - DNA, 99 bp, Homo sapiens
gagaagagtccctgggaaattaaataatatttgaagcttcaaagctgtatgtttaggttttagaacatcagatattaggacccagtgataagaattctc

SEQ ID NO: 6780093 - DNA, 81 bp, Homo sapiens
cggcctcctctagggctgggtacactcttgccatggacatctgcctcctggttcctgtttggcccagttcagcccaggccg

SEQ ID NO: 6780094 - DNA, 59 bp, Homo sapiens
taacatagtcatatacttgcttgagttttcacatagggcacaggaaatgactcatgtta

SEQ ID NO: 6780095 - DNA, 61 bp, Homo sapiens
tcaagagatatatgctggtttaagatacacaaaaacttgaacagtacttgagatcttttga

SEQ ID NO: 6780096 - DNA, 56 bp, Homo sapiens
ggccaggggctctggatttgtttccacccagcctgcaagtccctaagtctctggcc

SEQ ID NO: 6780097 - DNA, 82 bp, Homo sapiens
acttaactgcttgctttcacaccatgcctataaaacctttttggttttagaggttctatgtgtctggaaagtacagtgaagt

SEQ ID NO: 6780098 - DNA, 58 bp, Homo sapiens
gggctctgcctggctgggagtaggggatgttctaaggactgggtgggaggcagagtcc

SEQ ID NO: 6780099 - DNA, 57 bp, Homo sapiens
tccttatgccaggatggctgctataaagtaagctaagccttgatcttggtaacagga

SEQ ID NO: 6780100 - DNA, 75 bp, Homo sapiens
gtgaacccgcttctctgggttagtcttgtcgttgtacaaatgggaaaactgaggctcccgagggtgtgggtctgc

SEQ ID NO: 6780101 - DNA, 60 bp, Homo sapiens
ctctggagcaccgggctatccagaagggagaccatgatcctggagcttggagctcttagg

SEQ ID NO: 6780102 - DNA, 72 bp, Homo sapiens
gagggagagagagaaacacaactcaggatgtccatcaggatttatctgcagcagtgtgtctcattttaactc

SEQ ID NO: 6780103 - DNA, 74 bp, Homo sapiens
ggggctaccaagaatggcagagtggaccatactcaactcattgtaggagttggcaccctcttcaactgtacccc

SEQ ID NO: 6780104 - DNA, 64 bp, Homo sapiens
ctgcagctcaggaaggaaggccggccttgcaggagggggcctggggccagcttgggctgagcag

SEQ ID NO: 6780105 - DNA, 97 bp, Homo sapiens
aggcacagcacacacagtgggagagagagtgggagccggccccctcctcgccttggcctctgccctcactcctgtctgcagtgcaccctctgtgcct

SEQ ID NO: 6780106 - DNA, 107 bp, Homo sapiens
ggtagcacatacaaatagaaagagcatttaagaagttggtaaggaatgataatgacacactttgtcagggcctgcttccttcttgttcattgctcctagtatttgcc

SEQ ID NO: 6780107 - DNA, 86 bp, Homo sapiens
attggatattcctctggtcctaaagccctactccaaatcttagtccatatggataaggctggacctagatctctgaaccttccagt

SEQ ID NO: 6780108 - DNA, 91 bp, Homo sapiens
agtgcctccttctactttgtgtttatatgtgtgtgtgtgtttgtgtgtggtgacaggtgacctgctcatatgaaagtcttcagggggtatt

SEQ ID NO: 6780109 - DNA, 95 bp, Homo sapiens
aaggcagagacctgattcgtacagtagtaaaagtgaatgaacattggcaacatttattcaccatttattatgtgaagtcctgaaaatcctgcctt

SEQ ID NO: 6780110 - DNA, 64 bp, Homo sapiens
tctcatggtttgtgattcaaatatatactattctttatgtttcatgaacccacaagctgagaga

SEQ ID NO: 6780111 - DNA, 68 bp, Homo sapiens
ggcctggcccagtgctgttcacccagtgctgtaattgcactgtgattacctgcactggccctcctgcc

SEQ ID NO: 6780112 - DNA, 59 bp, Homo sapiens
ggcttgcactcattgggcatccgctggtgtcggctcagctgggtggcctgcgtgaagct

SEQ ID NO: 6780113 - DNA, 91 bp, Homo sapiens
cacttcttgaatagtcctgtccatttcagtgtcttgtgatgaagagattttatttgaagactagtgaaaatatagcgaaattcattcagtg

SEQ ID NO: 6780114 - DNA, 80 bp, Homo sapiens
ggaggaaaggcagtggttgggtggaggaggggatgactgttttgctcagagcctccttcagttcaattagtccgtcttcc

SEQ ID NO: 6780115 - DNA, 55 bp, Homo sapiens
ggaatcagcaaggaggctcaccatccccagggaggatgtgtttccagtttattcc

SEQ ID NO: 6780116 - DNA, 80 bp, Homo sapiens
ggtgactggactcttgaggagtgggttggaatttgcgctcccttcgtgacctgtgcagctgacccactccagtccctccc

SEQ ID NO: 6780117 - DNA, 65 bp, Homo sapiens
tctggccaatgcctggggaatagttaagatagatgacattggaatagtgcccagcattagtcgga

SEQ ID NO: 6780118 - DNA, 69 bp, Homo sapiens
tctaactatacaaagaaaacatttagatttcaatatttttctctgtgtgtgtgtctgggtgtgtgtaga

SEQ ID NO: 6780119 - DNA, 56 bp, Homo sapiens
gaaacagcacggtccacagtcagtattgaacactgcactggagaatggctgtattc

SEQ ID NO: 6780120 - DNA, 71 bp, Homo sapiens
gtctctgaaccagggagccaggaacgcaggtcggacacatctttggcaggcaagttcagctccaccaggat

SEQ ID NO: 6780121 - DNA, 55 bp, Homo sapiens
ggcagtattcataatcaactttcttattgtaagagagctgactgtcaagactgtt

SEQ ID NO: 6780122 - DNA, 70 bp, Homo sapiens
cagtttctggtgtttttacctaggtcatctcaactctagatgacatccggccactagactccaggagctg

SEQ ID NO: 6780123 - DNA, 80 bp, Homo sapiens
ctgcagatgtaatggaactgtggatggatgtttgaacagattcctattgttaaacattgctccacgggttacatagagag

SEQ ID NO: 6780124 - DNA, 57 bp, Homo sapiens
cagaaatttattggactcacagttctgaaggctgagaagtcccagatcaaatttctg

SEQ ID NO: 6780125 - DNA, 56 bp, Homo sapiens
gtaggcactctgtaagcatttgtcaaataaatgaatgaatgaaaacaaaggcctac

SEQ ID NO: 6780126 - DNA, 67 bp, Homo sapiens
tggttttgtgagcccataaatgccaggaagcctccaagatttctagctttgtgaagtttacagacca

SEQ ID NO: 6780127 - DNA, 129 bp, Homo sapiens
tatagttagaggccatctctaaagagttgctctccccctgctggcaagtcttggaattgttcagtttggggaaggaaccaggacagctagagagagaacgttctcagtaagatgctcttgtcattaaaa

SEQ ID NO: 6780128 - DNA, 58 bp, Homo sapiens
agtgttaatatctggccctaggcccgaggcttctggttaagctcagtgtgttaacact

SEQ ID NO: 6780129 - DNA, 104 bp, Homo sapiens
ggggaggctattaataaatcacaatttgcagttcatgttggaaaatgaatttcacttaccaaggagaagtgcaaaattggtattatttaagatagttctaccct

SEQ ID NO: 6780130 - DNA, 61 bp, Homo sapiens
tcttaccaggatcatgtttttgttgttggacaggtgaaaaagacaatgagtcctgatggga

SEQ ID NO: 6780131 - DNA, 121 bp, Homo sapiens
gtcctggaggagcactggattaggaatctggaggcccagtttcagctctgcctttgcactgacactaggggctgaggctgagattggtcttgggaatctttaagctcctctcagttttgac

SEQ ID NO: 6780132 - DNA, 75 bp, Homo sapiens
gttatctgtgtgcatggcatcattgcagccaccatcctccggtcttgtctttggctggccattcaaacaggtagc

SEQ ID NO: 6780133 - DNA, 66 bp, Homo sapiens
tttttatactttgctcaagattcacattcccccaaagagggagtccaattggtcagagtaaagaaa

SEQ ID NO: 6780134 - DNA, 129 bp, Homo sapiens
aagagtggaattattaaatcttacagtaggtgtaggtataatattttgaagaaaccgacaaactgttttgcaaagtggttgtactattttacattccctcccagcaatatacatgtgttccacttcctt

SEQ ID NO: 6780135 - DNA, 80 bp, Homo sapiens
ccattgataactataaaaggataaaccagaaagaagctagtatatttctttttggtttcccttcttatggttatcaatgg

SEQ ID NO: 6780136 - DNA, 130 bp, Homo sapiens
tttgggaatatagttaaaagggttatgtgattgtttttaggtacattttaagtgttgactaataaaaggcaaatatcagaacaaaagaacagtttaacgtagcattttcaaaacctttcggcattctaag

SEQ ID NO: 6780137 - DNA, 58 bp, Homo sapiens
atgtatgatgctaggctctcagtgtccccggcacaagttccattgttgcatcgtgcat

SEQ ID NO: 6780138 - DNA, 76 bp, Homo sapiens
gagccttgctggaatttttctaggatttttatgccaacttaaacattggaggttcaagagagtattccatgggctt

SEQ ID NO: 6780139 - DNA, 79 bp, Homo sapiens
gcgtggccaggtgctggctgctggcctgaggatgccaactggcattcagggttcacggtcaactccacctgagtcaggc

SEQ ID NO: 6780140 - DNA, 67 bp, Homo sapiens
acttgtcacattcatgcagaatcaaaatgatgcttctttggtcctctctctgtgtgtgtgtgtgtgt

SEQ ID NO: 6780141 - DNA, 59 bp, Homo sapiens
ctgagcaacacattgaatgaggattctgttcgtaattcttataaaaagtgttgacttgg

SEQ ID NO: 6780142 - DNA, 75 bp, Homo sapiens
gctgctatggcagtgacttgaagggtagaaatttgattaagaagtcaatattagcctcagttcttcatagccagt

SEQ ID NO: 6780143 - DNA, 87 bp, Homo sapiens
ggggagtggaacctgagcccaggtggcatttggtggccctgtagtttcagagagtgagtgccaacctgagctggttccccctgcccc

SEQ ID NO: 6780144 - DNA, 58 bp, Homo sapiens
atgtggacagagccagttggaggtaggaagtgaaattatggtctaggttcttccacat

SEQ ID NO: 6780145 - DNA, 83 bp, Homo sapiens
cctttatccctcttagtttgtaaaaataatttttgagttttgtcatgataatatttcagacttggagatatttggagtggagg

SEQ ID NO: 6780146 - DNA, 55 bp, Homo sapiens
aacaccaggaagtctcccaggcattctattctagcctttatatttttctggtgtt

SEQ ID NO: 6780147 - DNA, 98 bp, Homo sapiens
agattttccaatgtgtgcttacaggccagtggcatcatcctcagtcacaggttaaagggcagctagggctggcctgctgggcaccaccgtgagaatct

SEQ ID NO: 6780148 - DNA, 56 bp, Homo sapiens
tgctttgactgccgaccataacatgtcctaatatgctatgacaacgcagcaaggca

SEQ ID NO: 6780149 - DNA, 57 bp, Homo sapiens
tgagttcttgggcccaggaccatgttttatgctctttaatatctgccccagagctta

SEQ ID NO: 6780150 - DNA, 90 bp, Homo sapiens
tcaaaaggcgcacacagggcacaagcaggcagcaacctctatgagtcagagcctgcttggcctacttgtcctttgcaccatgtcttttga

SEQ ID NO: 6780151 - DNA, 88 bp, Homo sapiens
tattattgacaccacttttatggatcatttcttactgtgtttcccttagggaaacacgtataatgtgacagagaggttggtaatgatg

SEQ ID NO: 6780152 - DNA, 61 bp, Homo sapiens
aggaagtaaggcaggtagatgactacggagaaagtcagtagaaaggatctggcttcttctt

SEQ ID NO: 6780153 - DNA, 56 bp, Homo sapiens
ggagtgctgggccgctgccaacactaggaagccaggggtgagcacggcctgcctcc

SEQ ID NO: 6780154 - DNA, 66 bp, Homo sapiens
cacactgtcaggtaaataacacgggctccgttttgttgtcacgtgatgttttctcctggcagagtg

SEQ ID NO: 6780155 - DNA, 76 bp, Homo sapiens
cagaagaggacactgaagtccagagtaagggactgacaagtcctaatgctctgtcctttttctgtttcctcatttg

SEQ ID NO: 6780156 - DNA, 66 bp, Homo sapiens
tcttgagaattttcagtttcactttgttttgaactttgaatccaaagactgctgagaattttagga

SEQ ID NO: 6780157 - DNA, 66 bp, Homo sapiens
ggttgcaagggataggggatgagggtcctaacctatccagaggcctcctgttccattccctcaacc

SEQ ID NO: 6780158 - DNA, 68 bp, Homo sapiens
aactggaaatgatcctgtcacacctttgacgatattttgtgcacaggacttaagtcatttataaagtt

SEQ ID NO: 6780159 - DNA, 60 bp, Homo sapiens
ggtgagagattgattgtagcggcagaagatgaatttgcccatagtctctttctttcttcc

SEQ ID NO: 6780160 - DNA, 104 bp, Homo sapiens
tttctcctgtgctgcttcctggccttaacgcttcctggggacttaccgtcatttgctcagttacggtttctatgggatgagtggggaagccgcgtggtgaggaa

SEQ ID NO: 6780161 - DNA, 59 bp, Homo sapiens
gtctctcttgctctactggagtcttctgccctggtcttcagagatcttcaggatgggac

SEQ ID NO: 6780162 - DNA, 63 bp, Homo sapiens
agctggccattgtgagtggccttccagcaagtgcccatagtaaccactcggaatgtgctagct

SEQ ID NO: 6780163 - DNA, 81 bp, Homo sapiens
gtgcattggcctggggacctggccaccttcccacttctgcccctcaggtcgcagatgaaggtggcccgggttgacctgcat

SEQ ID NO: 6780164 - DNA, 63 bp, Homo sapiens
gcatgcagtaaaattcagcaacagtccggttagaaatgtgttgctggattcatttttgtaagt

SEQ ID NO: 6780165 - DNA, 77 bp, Homo sapiens
gcatgaaataggctgcttctgatttctaatgtagtgcactttacaacattatgtttaggagcagaccagtttaatgc

SEQ ID NO: 6780166 - DNA, 55 bp, Homo sapiens
ccagcaggggaatatttttaggggaaatacttccctaaaaacataacacctctgg

SEQ ID NO: 6780167 - DNA, 63 bp, Homo sapiens
gcctccctggccagagcagcagcccctgcgctctcctcagccgctgctgtgggccagggaggc

SEQ ID NO: 6780168 - DNA, 64 bp, Homo sapiens
ctgcggtatggatgtgtgacccagtgacaatgttcactgccagttgttttgtccagtgccacag

SEQ ID NO: 6780169 - DNA, 55 bp, Homo sapiens
ccctccccaggccctgtgcctgtagctttagggcacgagggcacacgtgggaggg

SEQ ID NO: 6780170 - DNA, 86 bp, Homo sapiens
cccggtgtgtctgcagggcaggctggcccccgggggctgcaaccgcagtcctcagtaaggatcgtcagctctgacaggcgactggg

SEQ ID NO: 6780171 - DNA, 78 bp, Homo sapiens
ctctggttttaatgttatgtttatgataccctcagagggaacagggaataataatgaagatgataatgatagccagag

SEQ ID NO: 6780172 - DNA, 90 bp, Homo sapiens
agtaccaaattcacccttgtaatgattgaaatactgtgtttttttcagatacagtgccccttttcacatggactaggctgaataaatgct

SEQ ID NO: 6780173 - DNA, 71 bp, Homo sapiens
attcaactgctgattatgaaagtgacacattctaggatgatgcacctttaaattcagcagtaaacatgaat

SEQ ID NO: 6780174 - DNA, 78 bp, Homo sapiens
aggagcaatgaggtagaacaggaattgaattatttctaattgggaaggaattgcacatttcagtgttctgttgctctt

SEQ ID NO: 6780175 - DNA, 67 bp, Homo sapiens
acttaagtgagttatttgaaatgcctctagacaactgtgaccagaaggctaaagtaacttagtaggt

SEQ ID NO: 6780176 - DNA, 61 bp, Homo sapiens
ttctatctcaagattattgggtttctataaggaaatgtatttcagtgattttgaagaggaa

SEQ ID NO: 6780177 - DNA, 86 bp, Homo sapiens
ctgtgcacgactgttactggacgcacgcagctgatgtctcttgtcatgaaccaggtgtgccgggagcagtttgtccgcttgcacag

SEQ ID NO: 6780178 - DNA, 75 bp, Homo sapiens
acctacctgagacctcttggtatcgctaggcagaagcaaaccgcctgtacttgtattaaaggtccgggtcttggt

SEQ ID NO: 6780179 - DNA, 87 bp, Homo sapiens
tttattgggctggtgcaaaagcaattgcagtttttgccattacttttatggtaaaaaccacaattatttttgcaccagcctaataaa

SEQ ID NO: 6780180 - DNA, 79 bp, Homo sapiens
gtccttgtgggacacgggtctccccttctccgggctcgcgggggactggtccaggagggggagccgtgccggcaggggc

SEQ ID NO: 6780181 - DNA, 69 bp, Homo sapiens
tcgccctcggtggtcccagccccggagcgcgaggccgagcgcgtctgagttgcgggggctcacgggcga

SEQ ID NO: 6780182 - DNA, 59 bp, Homo sapiens
agggagcttctacttcaaggcatttacattggctgttgccttagcttagaacgctcttt

SEQ ID NO: 6780183 - DNA, 73 bp, Homo sapiens
ggcctaatggaagagacagatgcatcaagctacagaaggcttgattcaagctactgttactggtcctaaggct

SEQ ID NO: 6780184 - DNA, 91 bp, Homo sapiens
gtaggggcagctctgggtgtagaaagaaccctctggggtcgtgtcaaagatggaccagagggagagtctggaggccgggagaagctggtgc

SEQ ID NO: 6780185 - DNA, 84 bp, Homo sapiens
tagatgagataggagagctgaactattgtctgcagtgtagacttaaagcaatacaggaataggatcagcaaatctacttattta

SEQ ID NO: 6780186 - DNA, 56 bp, Homo sapiens
ttgagatggagcttcactcttgttgcccaagctggagtgcaatggcgccatctcgg

SEQ ID NO: 6780187 - DNA, 74 bp, Homo sapiens
gttcccctggctctgctcttgacttaccaggcaatggaccttcctgttcaagttgcagggctgggctgaggaat

SEQ ID NO: 6780188 - DNA, 56 bp, Homo sapiens
gctacaaataaaatgggtgactaatccccagttcttggacccattatatttgtagc

SEQ ID NO: 6780189 - DNA, 105 bp, Homo sapiens
aagatgaacaagtggtgcagaaggctcactcagttaagaatgaagaccataaaatatattggctacaatctttatgttgagtggtttatcacagcttagcatctt

SEQ ID NO: 6780190 - DNA, 56 bp, Homo sapiens
atgaacatctctgatccaagcatttgcccaaagacatgcctggattagaatgtcat

SEQ ID NO: 6780191 - DNA, 73 bp, Homo sapiens
ctgaactttgccactacattcatgctcgtgttggccaagggctgaagtttcgagatggatgtggaaagagcag

SEQ ID NO: 6780192 - DNA, 81 bp, Homo sapiens
agagaagaaccttgaattgactgagatttgagtttttgtgattcagcaaaatatctcagatagttactgagattcttatct

SEQ ID NO: 6780193 - DNA, 81 bp, Homo sapiens
tatttggcatgtaggagttggtgctctccaaataaggatatgattttatttgtatttgtgagctactgtcccagccaggta

SEQ ID NO: 6780194 - DNA, 61 bp, Homo sapiens
ggtcattcagagtctgctagtgccacggcctgcccaataggagctggcagaattttgaacc

SEQ ID NO: 6780195 - DNA, 83 bp, Homo sapiens
tatgacttgcctagaattcctagtccagatgtgttgacaactcaaattattgcaggactgggctaaatttttggattgttata

SEQ ID NO: 6780196 - DNA, 63 bp, Homo sapiens
tgcatttctcagtctccaaatttgggcccagagccctggagacccaggaggctgagaagagca

SEQ ID NO: 6780197 - DNA, 59 bp, Homo sapiens
gtgttagccttgggttcaaggtaggttgctgccttagcagtgggtaccagggcttttac

SEQ ID NO: 6780198 - DNA, 57 bp, Homo sapiens
caccatccaggtgagggagacctgccggcttctctgtaggctcctccaggatgtgtg

SEQ ID NO: 6780199 - DNA, 61 bp, Homo sapiens
caacagacctggattcaaaaactacctttctatattgggattcttgtttccaggtctggtg

SEQ ID NO: 6780200 - DNA, 89 bp, Homo sapiens
tgacagaatggccacccagtcaactacagaatcatagaaaataacaactcatgttgttttaagccactgagtattggtatggtttgtta

SEQ ID NO: 6780201 - DNA, 58 bp, Homo sapiens
gtgaacacacacctatgtacaaacaatttttcaacatgtttgatgttttgtgtgtcat

SEQ ID NO: 6780202 - DNA, 81 bp, Homo sapiens
aaattgtgtcattgtgatgcatcattttcataaattatgttattatgcagatttaggaagcatgagcaattggtataattt

SEQ ID NO: 6780203 - DNA, 96 bp, Homo sapiens
gaggtaaggaacttgccagaagttatgcagctgagggtagtggagccaggatttgagcccaggcagcctcactgcagtccttgagttcctaacctc

SEQ ID NO: 6780204 - DNA, 59 bp, Homo sapiens
gtaggaaatcaggggtttaagccttcagaactgagagcctcaaacagagatttacctgc

SEQ ID NO: 6780205 - DNA, 73 bp, Homo sapiens
ggaggaagaacatttggatttgtaaatttagtgtgttaaaaaaatcacttatcacagatgtttggaatcttcc

SEQ ID NO: 6780206 - DNA, 60 bp, Homo sapiens
gtcattgtaatattctcatttagtttgggtcctgagacttataaagagaataccggtggc

SEQ ID NO: 6780207 - DNA, 56 bp, Homo sapiens
ccagtgtgtgctgttccccggagggtgaagcagcagccctttcagacacacgctgg

SEQ ID NO: 6780208 - DNA, 80 bp, Homo sapiens
gatccttctcaatcagagcagtgtgactttaccacattactactagggttttcatcaagattgttctggaggaaaggatt

SEQ ID NO: 6780209 - DNA, 130 bp, Homo sapiens
ttctttaataatattaatagctatcacttgtgtgtctaatatgtgttgtctactgtactaaatggctattactcacttaattgtaggaatgcagtgagacacagagatgttaagtaacttgattaaagaa

SEQ ID NO: 6780210 - DNA, 62 bp, Homo sapiens
ggtaacactgcttcattttggagagtgatctaaatctgttattcccaatgagcgtgtgtacc

SEQ ID NO: 6780211 - DNA, 71 bp, Homo sapiens
ggaaaggctcaggagtcccttaagctgtttctcacagcagaagaaactaaggatttactgagaaactatct

SEQ ID NO: 6780212 - DNA, 59 bp, Homo sapiens
tagtaacacactggtatttggaatctcactgttttgctgttttgaagctaggtgtactg

SEQ ID NO: 6780213 - DNA, 115 bp, Homo sapiens
gcacagtgtgttatgctcatggggatttacctggatagggctgtggactgggtcttgggagacctgggctcagtcctggttctaccctttagttagtctctacaggacactgtgc

SEQ ID NO: 6780214 - DNA, 62 bp, Homo sapiens
gaggtcacagtatttgtctagaatgagttaaagataagagtctatacctttgctgtgacttt

SEQ ID NO: 6780215 - DNA, 80 bp, Homo sapiens
ggtgccttgctacatgtatacatatgaatgtcagccatcaaagaaaatggtagcttaggatgaatgctgtagaatggccc

SEQ ID NO: 6780216 - DNA, 88 bp, Homo sapiens
ccttattacctctgctgaagtcttacatgtcatctaatagctttgttatgtcaaaagagatcatatgaaaaatttcaaggacttaagg

SEQ ID NO: 6780217 - DNA, 76 bp, Homo sapiens
tgcagatgtcatcaggctaagacactggcaaggaggatgggaagctagggtggagagactagatgacaatgatgta

SEQ ID NO: 6780218 - DNA, 98 bp, Homo sapiens
gtacatagtcagtagaaaatgagtccccccagggcatctagtaaaataaaccattcctacccaaagatccccaggaccatccttctgtgcctgtgaac

SEQ ID NO: 6780219 - DNA, 67 bp, Homo sapiens
tcagtcaataagtaataggcatctaatttgcattaagcacaattctaggattccacttattgcctgg

SEQ ID NO: 6780220 - DNA, 85 bp, Homo sapiens
tcattctgtctggaacctgctgttcttggtcccctgctgtggctcccactggcagtagagggagcgcattgccagatatgaagga

SEQ ID NO: 6780221 - DNA, 69 bp, Homo sapiens
acaagttaatatatagaattttgaaccatacctggcaatggtaagcattatgtatgtgttagctgctgt

SEQ ID NO: 6780222 - DNA, 65 bp, Homo sapiens
tggatattgagaagtgagtcccttgaggttatgtccttagtaatcttacaagtttctaataacca

SEQ ID NO: 6780223 - DNA, 93 bp, Homo sapiens
gtgctagcaggtctcccaatatgcagatgctgccttgttgagtcaaagaacattccaagtagaagcatttgcattctggggactagcttctat

SEQ ID NO: 6780224 - DNA, 61 bp, Homo sapiens
atgtatagtggtgatgattacacaacgatgtgaatgtatgtagtatcactgaactgtacat

SEQ ID NO: 6780225 - DNA, 57 bp, Homo sapiens
cataatgttccagaaaaatccactttggctgccaaagtagcccttctggaatttatg

SEQ ID NO: 6780226 - DNA, 58 bp, Homo sapiens
gaggccacagctatcagggacatagctgaagccagtgtctttgatgtctatgtgcttc

SEQ ID NO: 6780227 - DNA, 61 bp, Homo sapiens
gaaaacaaggtgcactggaagcaccgtttagcttcgtcaggtttgtggcacctgggttttc

SEQ ID NO: 6780228 - DNA, 59 bp, Homo sapiens
tggttactttcactggtctgggtaacaagcacagtcctgaccacagtcaaagtgattca

SEQ ID NO: 6780229 - DNA, 70 bp, Homo sapiens
gtcccacgggccatcatagaggtctctgcagtgagcagggggtgcccagatgaaggatgaactctgggac

SEQ ID NO: 6780230 - DNA, 102 bp, Homo sapiens
gcgtttgggtttaaggtcagagtgagctggcccctccgctggctgccacatcggtttgcttgggtgctggaggctgccgcccgtctgacttccctaattggc

SEQ ID NO: 6780231 - DNA, 56 bp, Homo sapiens
ttttctggaaaataatactttttttgaagaaatttagggtattagttttcagagag

SEQ ID NO: 6780232 - DNA, 60 bp, Homo sapiens
gcagaggtgaccagcagcagggaatttctgcaatattttctctctgctgtccacatttgc

SEQ ID NO: 6780233 - DNA, 55 bp, Homo sapiens
ggtggctcatgcctgtaatctcagcatgttgggagtccgaggcaggcagaccacc

SEQ ID NO: 6780234 - DNA, 94 bp, Homo sapiens
ggagaatcgcttgaacccaggaggcggatgttgtggtgaaccaagatcacaccactgcactccagcctgggtgacacagcaagactttttctcc

SEQ ID NO: 6780235 - DNA, 80 bp, Homo sapiens
gactcctttttggctcactgctttgcccaagagggcagcctttgtctttctgacccaaggtagttgctggagctcaagtc

SEQ ID NO: 6780236 - DNA, 80 bp, Homo sapiens
cccgaggagagaggcctagggcttggaagctggggaggttctcagcactgggaccactagaacaaagccatttccgtggg

SEQ ID NO: 6780237 - DNA, 85 bp, Homo sapiens
aggttgggcactcctcaattccagtaggcaccactcatcacagtctgaatggatggattctctggagttatgcagtgcacagcct

SEQ ID NO: 6780238 - DNA, 64 bp, Homo sapiens
ggggatggtagaccggtgacgtgcacttcatttacgatgtaggtcacccgtttgactatccacc

SEQ ID NO: 6780239 - DNA, 63 bp, Homo sapiens
ggaatggtcatgtgatgagattttggataatgaaacccaagacaatattgctgtgaacgttct

SEQ ID NO: 6780240 - DNA, 66 bp, Homo sapiens
ctggaggtttattattttagattgttgtgaggcacctgaatattttgcaagacaatgagcctctag

SEQ ID NO: 6780241 - DNA, 75 bp, Homo sapiens
gatacaaaagaggcagtggtgatgaatggttgttagtgacccaatatccatacacaccctttgtctgttattatc

SEQ ID NO: 6780242 - DNA, 90 bp, Homo sapiens
ctttacttcttagctttgtcctaggtctctctttccctccttgttgtccccactggagaagagaccttttgtgatagagctgcagtaagg

SEQ ID NO: 6780243 - DNA, 75 bp, Homo sapiens
ttccttgctctggtagcatgtctttttagcctttgcaacatatgcagggctcagaaatgtctacgggtagaggag

SEQ ID NO: 6780244 - DNA, 56 bp, Homo sapiens
gaattcattagggaagctatctaaattggttagattttatgctttcaaatgagttc

SEQ ID NO: 6780245 - DNA, 57 bp, Homo sapiens
gagctgtggtaggcacagagaacaagaaactatttcttgaaaagcctacagcagttc

SEQ ID NO: 6780246 - DNA, 84 bp, Homo sapiens
gatgcacttgtccagatgtttgttaggtcccttgtactcatgttctctagtgcacatcaaaggcatttggacaaataggccatc

SEQ ID NO: 6780247 - DNA, 61 bp, Homo sapiens
ttggacagaattttgtgtgtgtgctgtccacaagccatggggtgcatggggtgctgtccag

SEQ ID NO: 6780248 - DNA, 62 bp, Homo sapiens
gactgttgggtactgttttctcctggctagggagccaccattgaaatacttacccaactgtt

SEQ ID NO: 6780249 - DNA, 69 bp, Homo sapiens
gggctcagactgaaacaatctgcaggcaaatcaaaagctttgcttagatatttgtttcagctctgtccc

SEQ ID NO: 6780250 - DNA, 128 bp, Homo sapiens
tgcagccccaagatgagcctgcagtattttccttacatgatctggtcctactgtgggcagcgctgctgcccagagcctgagaggattatgaaaacatggcaacggaagtgaggccaggggacacagca

SEQ ID NO: 6780251 - DNA, 86 bp, Homo sapiens
gatgtgtcgctagtcccatttatccccaacaaccctgtggtttctattatccagtgttgcataggatggggatttttagacgcatt

SEQ ID NO: 6780252 - DNA, 76 bp, Homo sapiens
tgcctgagcatgctcctcttttccatctgtgttgttttttaccccagcatactgttggaagggttgctcgaaggca

SEQ ID NO: 6780253 - DNA, 69 bp, Homo sapiens
aatcatctcagagaggtatgttagtcatatctttcagatgtgaactttaatactcttttctggattgtt

SEQ ID NO: 6780254 - DNA, 78 bp, Homo sapiens
tcttgaaaatccatttagtgtcgttttattcaaactgaagtgcttcaggatggtcagatgcattgtctaggatcagga

SEQ ID NO: 6780255 - DNA, 58 bp, Homo sapiens
tgccccttcaccttcagtcttgccccaggcagtactcacctagaggagagatggggca

SEQ ID NO: 6780256 - DNA, 77 bp, Homo sapiens
tcagatatttggaagtagttctgtgtttgtattcctttttcaggtgcaaagtcgcaaaattcttctctccattctga

SEQ ID NO: 6780257 - DNA, 59 bp, Homo sapiens
ggcagaggccaggtccagagtttgtggtatgatcggccaggctaaggagcttgccagcc

SEQ ID NO: 6780258 - DNA, 59 bp, Homo sapiens
agaagtggggaaaacatgctgtgtagttaattaggcccagcagagtaattctcacctct

SEQ ID NO: 6780259 - DNA, 65 bp, Homo sapiens
tgaattctagctgttgctgtttatagcaagaaatagcatcccagctgaggcagcacagctagtca

SEQ ID NO: 6780260 - DNA, 88 bp, Homo sapiens
gtgagcagttccctttacagatggataattgtttgtgtaagaccaaccagataaagtccaaactgtgtagaacacacgtgtgcctcac

SEQ ID NO: 6780261 - DNA, 58 bp, Homo sapiens
cccttgctgcagccaacatttgattgtgattaatttgtcagggatggctgtacaatgg

SEQ ID NO: 6780262 - DNA, 69 bp, Homo sapiens
gtgaagtcctttggccaggcatgaataaaagaactgtctttatttgttcttgtcccaatttctcttcat

SEQ ID NO: 6780263 - DNA, 107 bp, Homo sapiens
gctgagatctttcctccaggcaactcctccttggtttagcctctgatacagccaaacctctggattcagggaaacctaaggaagccaggcaagaagggtcccgcagc

SEQ ID NO: 6780264 - DNA, 58 bp, Homo sapiens
gtggatatagcacattttgttcatgcattcatctgttgaacatttgggttgtttctac

SEQ ID NO: 6780265 - DNA, 65 bp, Homo sapiens
ttgacagctaggaaattgaggctgagacaagtgaagtgtcttgccctggtttcccagctagtgag

SEQ ID NO: 6780266 - DNA, 73 bp, Homo sapiens
ggcagtccaggcgggtatagaggctcagagaaatccttaaggattgaagctctttttatcttcctgatctgct

SEQ ID NO: 6780267 - DNA, 74 bp, Homo sapiens
gggacgcattttctgctaaaatggctgtgcgaggctgccacctcgtggccagcacaaggcagtgagtgtgtccc

SEQ ID NO: 6780268 - DNA, 128 bp, Homo sapiens
gaaggaaaggatgaagtacaaattgtgtaagggttgactttacagttttcttagggcaatagtctgctctatgaaaaactgttaagctcttttcatgacagaatacctttatgacatccctttcattc

SEQ ID NO: 6780269 - DNA, 73 bp, Homo sapiens
ttgttatagtgtgcccttcagcttggaaacaaacgtatgtgataagtttcttgattctgaaatattatgataa

SEQ ID NO: 6780270 - DNA, 70 bp, Homo sapiens
taggaccagcagggtcagggtctgcagcagagcgatttatggacctggctctgtctgctgtgtggtccta

SEQ ID NO: 6780271 - DNA, 87 bp, Homo sapiens
ctggtttacctgggcctgatggctttcctgggacatgggccaatcactgcccaaactgggaaagtcattggcaaaaggacaaattgg

SEQ ID NO: 6780272 - DNA, 69 bp, Homo sapiens
gggggtgacacagagcagtcaggctaggacactgctttccatgagcatccaggggactgctgggccctc

SEQ ID NO: 6780273 - DNA, 70 bp, Homo sapiens
ggaacttgcaacctctggtcacgctgaacactttgcccttgctggtgtggccatgagaatgtgcaggtcc

SEQ ID NO: 6780274 - DNA, 63 bp, Homo sapiens
ggaatgtatcggagcttggggtgggacctcagggcccacatctaagccttcatgatatgctcc

SEQ ID NO: 6780275 - DNA, 59 bp, Homo sapiens
tgttcagagacagaaattctaaaaatggtgacattttgcaagagaggatgtctttagca

SEQ ID NO: 6780276 - DNA, 88 bp, Homo sapiens
ttttagattcctagttagcataatttgtagaaaatcaaagctagacagtagtgatgtctctcaaatttgtttgacaagaggtctaaaa

SEQ ID NO: 6780277 - DNA, 84 bp, Homo sapiens
ctgccccactgctaaaatgtacaacttgattatatacaaaataatttcaattaagaaggtaatacatttttgctgtggtaacag

SEQ ID NO: 6780278 - DNA, 98 bp, Homo sapiens
agagtgtgagcattcaagggcacctagaaactgacagaatatttcccttaagtattattaccttctaggtcacctgccttttgctttctctgcacttt

SEQ ID NO: 6780279 - DNA, 80 bp, Homo sapiens
aaatagatggtttttgttgtttgtttttaaaggagttagacatagcctaacaaactggaaattgacatttccatctattt

SEQ ID NO: 6780280 - DNA, 73 bp, Homo sapiens
tttattgattgcttattttatgccaggcactgttctaggttctggggacataacagtaagcaagacagataaa

SEQ ID NO: 6780281 - DNA, 86 bp, Homo sapiens
ccccaagccattagcagagtgaaatgtcaccaagggtgagaagtcaattgttccttgggaccctcacatttgatgaggctttgggg

SEQ ID NO: 6780282 - DNA, 68 bp, Homo sapiens
ctggatagaagctgtgaaatagattacacagtggttggtggtatgagttcctcagcttcagtgtccag

SEQ ID NO: 6780283 - DNA, 58 bp, Homo sapiens
tggtccttctgtcttccgcacctcacaccagtgtgtggcacatacacaggagggcaca

SEQ ID NO: 6780284 - DNA, 105 bp, Homo sapiens
aggttcttaagtttgagggacactggcaggtttcctcctcatagtaaccctgttggggaggcagtgccaggagatcgtcactgccttttacagatgggaaggcct

SEQ ID NO: 6780285 - DNA, 78 bp, Homo sapiens
tttcattctaccactaaaaacattctgtggaaggcaggaccttccatacacattgaattttagtacggtagtgtgaag

SEQ ID NO: 6780286 - DNA, 92 bp, Homo sapiens
gctgggccagggtgaggccacttccccacagccctggaaatgggaggtcccgggctaccttgggaggatgaattagcccacatcctgctagc

SEQ ID NO: 6780287 - DNA, 61 bp, Homo sapiens
gtgcgcccacttcaggctaacgggagaacatctcccagagcccaagttggagagggcgggc

SEQ ID NO: 6780288 - DNA, 73 bp, Homo sapiens
ggggctgccatggttgataaatgcttgaggtttggttgatgatctgaggcccagttcaactcttggcttcccc

SEQ ID NO: 6780289 - DNA, 76 bp, Homo sapiens
gtagatattgtcacttttatgttacagatgagtatgttgatgaaatcaaaaggtaacataatgtggccaaagtcac

SEQ ID NO: 6780290 - DNA, 111 bp, Homo sapiens
gaggacagtgagatttgataggctctggaatgttggattacccacccttgccaacttttctgtttaagccatacatttcagactctggtttcctttcttacctcgttcctc

SEQ ID NO: 6780291 - DNA, 89 bp, Homo sapiens
acggagtttctgggagcaggcagggccgtgtctgttactgcccaacccagggtagccccggacggagtttgccgggttccctgctctgt

SEQ ID NO: 6780292 - DNA, 62 bp, Homo sapiens
gaatgagaggtcagaacaggaaagtgtgtgataccaccacacccctttttgacttgtcattc

SEQ ID NO: 6780293 - DNA, 66 bp, Homo sapiens
ctgggtgtcaggagacatgatggagaggaaagcatcatcatggtcattctctgtctcactgtccag

SEQ ID NO: 6780294 - DNA, 71 bp, Homo sapiens
aggggaaagaacagtcttcaggcctacaacaaagagctaaaggttttcttagacaggttctcccatcccct

SEQ ID NO: 6780295 - DNA, 57 bp, Homo sapiens
cagttgaaggcccagccacagaatgggaaacaagccattcccactgtgccttccctg

SEQ ID NO: 6780296 - DNA, 72 bp, Homo sapiens
gggatctgggcgctctggcaggcacaggagggctccccgcccgtggcctcgccggagatgcacccggctccc

SEQ ID NO: 6780297 - DNA, 56 bp, Homo sapiens
ccgaggctggagtgcagtggcgtgatctctactcactgcaacctccgcctcccggg

SEQ ID NO: 6780298 - DNA, 74 bp, Homo sapiens
ttgctccagtgtacaaaagctatcttctttaagtgctatgaaaatgaggattgttgaatgtaacactggggtgg

SEQ ID NO: 6780299 - DNA, 111 bp, Homo sapiens
aagaagggacaagaaggcacttcagtaccaagacataagatttttgaggcctgaccaagaaaacaagtctgtatgtttctctaggtagcttgactgccttttttttttctt

SEQ ID NO: 6780300 - DNA, 64 bp, Homo sapiens
agcttttccaaatgagcagaacaagcatattgggctattgtaggtatttgtatttgggaaagtt

SEQ ID NO: 6780301 - DNA, 69 bp, Homo sapiens
tacataggagtctggtgaagaggtcaacttcatatggggacaaatggcctatttcatcagttcaatgtg

SEQ ID NO: 6780302 - DNA, 61 bp, Homo sapiens
tctgagtccttttcatagcagtgggaatgcacattcccgacttggcccaggggacaccaga

SEQ ID NO: 6780303 - DNA, 74 bp, Homo sapiens
ttgtgttggcgaaagcatgtcacttggtccagcccctacagaggcaggtatgcagacatgtctttctcacacaa

SEQ ID NO: 6780304 - DNA, 82 bp, Homo sapiens
cacaatgtggttgaaagagcatggacttgaaattcaggctggtctggttcaagtcttggctttgccacctactaaccatgtg

SEQ ID NO: 6780305 - DNA, 86 bp, Homo sapiens
cgccctcccacctctgggggcttccttaccctcttattttgattgtaaaacaagcatcccagggtcaggttaagggagtcatggtg

SEQ ID NO: 6780306 - DNA, 116 bp, Homo sapiens
gttaagtttgaatttcagataagcaatgaataatgtttttgtataagcatgactcaaatattagataggacacacttaaaacgttatgcattgtttatctaaaatccaaatttaat

SEQ ID NO: 6780307 - DNA, 85 bp, Homo sapiens
tgaaactaattgtgtgttctgtgaatgcttagctctcttgaattggggtaatggttattgtttatagagcataagccaagtttta

SEQ ID NO: 6780308 - DNA, 65 bp, Homo sapiens
tctctgcaataactactttaatgttggttttccccacaacgctagcagctgcaggaaggcagaga

SEQ ID NO: 6780309 - DNA, 77 bp, Homo sapiens
gttgtgactaaatttatcacttgcaggagtttcaattctcaaacatgagctcctgtagttgctaagtttgtttctac

SEQ ID NO: 6780310 - DNA, 62 bp, Homo sapiens
tctgcttgtgtctgtccagcctctggctccactgcttggctgagatcctggcccatagtaga

SEQ ID NO: 6780311 - DNA, 60 bp, Homo sapiens
cgcaggctggcgcggagtggcaggaatcccccgcgcaggggcgctctgccccggcctgtg

SEQ ID NO: 6780312 - DNA, 130 bp, Homo sapiens
cagcatctcaatttctcatctgatttgtattagtcttctcagatgtagaaagattgtgaggttagctggggttatgtcacacagctgctctgttttattgagaaggctggtccagggaagctgagagctg

SEQ ID NO: 6780313 - DNA, 62 bp, Homo sapiens
gtgggtgagggagtggaacgaggtgccgggactcccagcccagggttctgctctgcaccagc

SEQ ID NO: 6780314 - DNA, 59 bp, Homo sapiens
tgcactgtatggtatctggacataagcattgtcaaaagtagacatagagccagcaggca

SEQ ID NO: 6780315 - DNA, 59 bp, Homo sapiens
agctgtgttttgttaactttgtacataggatcttctttagcaactagggagacacagct

SEQ ID NO: 6780316 - DNA, 56 bp, Homo sapiens
cttagaggcccttaacgagatccatgctccatgcttctcgttgtatggtcttgggg

SEQ ID NO: 6780317 - DNA, 63 bp, Homo sapiens
tttgtaatgggatatctgaaggatttgccaagctgcaaacagtcaggagagcccatctacaaa

SEQ ID NO: 6780318 - DNA, 72 bp, Homo sapiens
gggtgggtgacgtggagtggggagaagttggggaagcttgacatcttaataaatctcctccctgtcacactc

SEQ ID NO: 6780319 - DNA, 100 bp, Homo sapiens
tcttgaacttaagtacacttaaacttacgtagtgtgtgtatggtgaagggtgtgcctatgcatacctgcccacatatatatgtattcttaaattctgaga

SEQ ID NO: 6780320 - DNA, 74 bp, Homo sapiens
cttaaagaactactgtcttattttagataaatgtatcctcaataaatttgtatatttaagagggtaggtttaag

SEQ ID NO: 6780321 - DNA, 58 bp, Homo sapiens
tcaagtttcatgatgtaattattgcttggcaaagtaaaagatgggtctggaatcttga

SEQ ID NO: 6780322 - DNA, 73 bp, Homo sapiens
tagtagagagaaataggtggcaacaaaatatctcatttggctttttctcacagcatttgttagctttctactg

SEQ ID NO: 6780323 - DNA, 75 bp, Homo sapiens
tcccttgaacccaggaggcaaaggttgcagtgagccaagatcatgccattgtactccagcctgggtgacaagaga

SEQ ID NO: 6780324 - DNA, 80 bp, Homo sapiens
tcctctacgtcttcgttggcagagatttccaagaaaagtttttccagtctttgacttctgccctggcgagggcgtttgga

SEQ ID NO: 6780325 - DNA, 60 bp, Homo sapiens
agagattctgtagtcaggcatctaagcatggcttagctgaggctgctggctcagggtcct

SEQ ID NO: 6780326 - DNA, 69 bp, Homo sapiens
caacagggtgagaccccatctctacttaaaacacaaaaattagcagggcatggtggtgcacacctgttg

SEQ ID NO: 6780327 - DNA, 77 bp, Homo sapiens
gtcatgcgactggtggccaagtttgaggcaggtccttggcttctcacagacaccttggccacagtcactgcgtctgc

SEQ ID NO: 6780328 - DNA, 56 bp, Homo sapiens
cttacttcatgtactttaggaagggcagagcttcctccaagcctttgtgaagtgag

SEQ ID NO: 6780329 - DNA, 71 bp, Homo sapiens
ctaatggttaactggaatgtggtatcagtagaaagggacatcctaaactggtatgatatccttgccactag

SEQ ID NO: 6780330 - DNA, 55 bp, Homo sapiens
ttggttgtttacactgcagaattggggtgagttccagcgaaggtgtggcaattaa

SEQ ID NO: 6780331 - DNA, 60 bp, Homo sapiens
ggaggagatggatgggggacgtttagcgaagaaaggcatctcccagatcctttagcctcc

SEQ ID NO: 6780332 - DNA, 85 bp, Homo sapiens
cattaggttctcataaggagcacaaacctaggtcccttacatgcacagttcacagtagggtttgtgctcctatgagaatctaatg

SEQ ID NO: 6780333 - DNA, 56 bp, Homo sapiens
cacaacccgatcttagttcctcatcagtaaaaagaggagtgttgagttgggttttg

SEQ ID NO: 6780334 - DNA, 63 bp, Homo sapiens
ctgcagtatggctcttatgctcaggagatagagtagtcagacccaagagagccatgattgtag

SEQ ID NO: 6780335 - DNA, 59 bp, Homo sapiens
cagtaataaagctaagtatttccttggtctctctgaccgctatactgggttttattttg

SEQ ID NO: 6780336 - DNA, 81 bp, Homo sapiens
gtatcacaagaccagtgacccctttcctataacctgaattcgaaaatcctccagagtaaaatgggtttctgttttgtggac

SEQ ID NO: 6780337 - DNA, 59 bp, Homo sapiens
gcaggtacagtttggtgaaaaaagacacttttcttctcagtctcagactgtgcttctgt

SEQ ID NO: 6780338 - DNA, 71 bp, Homo sapiens
tcggccatttatcaggacagggatgccaaccaacagtgtccagtgtctagcagatgacaggtgtgtgccga

SEQ ID NO: 6780339 - DNA, 88 bp, Homo sapiens
cttagaacatttgagtcttagaactacagtgcctagaactataagattttagaaatgtggattcttggactcttaaccatggtcctag

SEQ ID NO: 6780340 - DNA, 78 bp, Homo sapiens
gaccttgagaaggctagtgttgatgggacctggtagtgatattcagtgcaggtaagagaggctggcttccacagagtc

SEQ ID NO: 6780341 - DNA, 61 bp, Homo sapiens
taccctgcatcccccacattcacaaagtaactgtggcctaaatgggatgatgcagaaggta

SEQ ID NO: 6780342 - DNA, 89 bp, Homo sapiens
ggtcattgtgtgtccaagggtttgtaggtgttcaccagtccactgggaagccagtgacagcacctgtgccctgatggagaccaccaacc

SEQ ID NO: 6780343 - DNA, 59 bp, Homo sapiens
tagattccatccagagtttgggaagctgaattcttcctacaactgtgtgaaggaatctg

SEQ ID NO: 6780344 - DNA, 67 bp, Homo sapiens
gcacctttggaatgaaaagttgcaagaggtacctccaaaataaagtgtaactttcccataagagtgc

SEQ ID NO: 6780345 - DNA, 125 bp, Homo sapiens
tccatttctaggttgttgttggctgtgtcaccttgggaaagttgttgaacacattgagtcaaattgagagagacatcaattcagcattttaaggaatagatacagttatcaagttacctaatgga

SEQ ID NO: 6780346 - DNA, 80 bp, Homo sapiens
ggctactcatctgttgaaacgaaggcccttctggtaaatcaatcttgatcagggtcttctttcagcctaaacttgtaacc

SEQ ID NO: 6780347 - DNA, 59 bp, Homo sapiens
caaaaggcaggggaaagagtgccattaaaaatacgtacaaacctttttccttccttttg

SEQ ID NO: 6780348 - DNA, 82 bp, Homo sapiens
ggcaaggtctgaacagctgtcagggaatgcaagtgatgctaagaacactagctccagcttcaactgcacagtcaacctttcc

SEQ ID NO: 6780349 - DNA, 63 bp, Homo sapiens
gctagatggctctcccagagatatcacttttcagatttacgatgcctgggattatccactggt

SEQ ID NO: 6780350 - DNA, 72 bp, Homo sapiens
ttcctgtgaaggccagtggataaaacctcttatgttattcatgaggggtattcatctgccctaaagcaggga

SEQ ID NO: 6780351 - DNA, 130 bp, Homo sapiens
caagtaactatgcatgaagatacaccaggaacagctgccagcgactcatcctctgggggacccatccagctcagccagtcagtcagttgctggcatttgttcacaggttgcaaacaacagaaagtgcttg

SEQ ID NO: 6780352 - DNA, 73 bp, Homo sapiens
agcggactaggagccatacctttcccagcctctcgcacagctgggcagagagctggaactccttggcatagct

SEQ ID NO: 6780353 - DNA, 56 bp, Homo sapiens
cctgtggaatagaatcttccctcgccttgtctaggagaggtgctgtgtctcacagg

SEQ ID NO: 6780354 - DNA, 66 bp, Homo sapiens
caaagccggctgatgaaatttgagcagcacagggctgctctagagagcattagtcactggcgaatg

SEQ ID NO: 6780355 - DNA, 57 bp, Homo sapiens
taggccaacgtggaagggtccagaagaaccatggaggaccccctttcctctggcttg

SEQ ID NO: 6780356 - DNA, 58 bp, Homo sapiens
tgtgtgaggtggttctgagaagagacatttgaaagttttcataaaccattctcatgca

SEQ ID NO: 6780357 - DNA, 83 bp, Homo sapiens
ctggccaggccggcctgttgccagctgaatgggtcccaggcttggaagtactcaccccagctggcagccctggccctgcccag

SEQ ID NO: 6780358 - DNA, 72 bp, Homo sapiens
ggattgcccctcttcctgaagaggttggtcaggaaaattttttgttaacttttattttaggtttgagggtcc

SEQ ID NO: 6780359 - DNA, 70 bp, Homo sapiens
atgactattgtaatagaggctaacatgtattaaactctcacaatatgacaggctctgtcataagtgtcat

SEQ ID NO: 6780360 - DNA, 63 bp, Homo sapiens
gattctgatgcaaggagccactatactctgaaaatcacagcttaatggaacttgctcaaagtt

SEQ ID NO: 6780361 - DNA, 85 bp, Homo sapiens
tgggttcacactgcctttatgagctgtaacactcaccgcaaaggtctgcagcttcactcctgaagccagtgaaaccacgagccca

SEQ ID NO: 6780362 - DNA, 67 bp, Homo sapiens
cggagtgcaaggaggtgttcaccctgcacctgcatacttctgggagtgagcaccttcttatattttg

SEQ ID NO: 6780363 - DNA, 85 bp, Homo sapiens
tttttaaagtacgtatgcccaggccccaccccagactaagtcagaatctctgggaatgaggcttgggcaatgacatttttaaaaa

SEQ ID NO: 6780364 - DNA, 60 bp, Homo sapiens
tccccagcccctcagcagcgtccccccacaaggtgggctggctgataaagggttgaggga

SEQ ID NO: 6780365 - DNA, 82 bp, Homo sapiens
aaaagatggagagactgatgtggctatgtagctcaaactgactccttcctactacgttttatattatcttacctcttctttt

SEQ ID NO: 6780366 - DNA, 76 bp, Homo sapiens
tcacatgcacaacagagataggagcatagtcctggtcttcagaacccatgtgctcttttgtacccagcagacgtga

SEQ ID NO: 6780367 - DNA, 81 bp, Homo sapiens
gccaggttttttagtgacattgtggttattaaatgtttaaattaatttgatacatatgacagcttaagtcacttatttggt

SEQ ID NO: 6780368 - DNA, 77 bp, Homo sapiens
agtagaggaaagtggtaggaagagagcactgagtttgggaaagaaccagtaagctgtatttactcaccccctttact

SEQ ID NO: 6780369 - DNA, 129 bp, Homo sapiens
aggaagcatttgtcatgagtagcactggtgactcaaacttattttttagccctgccagccaagagcaacaggaatgaactcgagtgatctgatttattagtgaaaaaaaaccaactacaaacttttcct

SEQ ID NO: 6780370 - DNA, 59 bp, Homo sapiens
caatttccatagagcgtctcacagaactagtgttttgtggaataaaatttaggaaaatg

SEQ ID NO: 6780371 - DNA, 75 bp, Homo sapiens
gtgtgagagggggtgcatgtgtggcagatttgagcccagtgtaaactgcttctgcccacagcctcctgtccacgc

SEQ ID NO: 6780372 - DNA, 67 bp, Homo sapiens
aaatgcaggttcttgagccaagcccagctctactgaatgagaattgctggcccagggatctgcattt

SEQ ID NO: 6780373 - DNA, 112 bp, Homo sapiens
atttccagggacaatttttgcatcctcaggggctagcacttaatgtttcttgaataaacaaatagtaaagtggtagccatcattttgggattcaattgttttgaatggagat

SEQ ID NO: 6780374 - DNA, 62 bp, Homo sapiens
gtcttgaaagggagcatggctgcagggaattaacaaaaatccatgcatctccttttagagac

SEQ ID NO: 6780375 - DNA, 80 bp, Homo sapiens
gagtggaagcctgaggttcccgtgacttcctttctctgctccctgagttgtttcacagggcaggccccaggcctctactc

SEQ ID NO: 6780376 - DNA, 69 bp, Homo sapiens
atccctggggtggtggcaggaagtcttgaagaaagaagccagtggactgctgcccagccactgagggat

SEQ ID NO: 6780377 - DNA, 121 bp, Homo sapiens
tctgtgtgtcactcgagatgatgctcgcacaggtgccctgtaaaagccatgcatgtcttaaacgtgttggctgtggctcaggtaaacaaatgtgggagcaaatcgtcccgtggctcagaga

SEQ ID NO: 6780378 - DNA, 58 bp, Homo sapiens
cccatggacactgcctgttttgggaccctctggtccctcagacagatgtgttcctggg

SEQ ID NO: 6780379 - DNA, 71 bp, Homo sapiens
ctggaacccagaggggttaagtgctagtccgggcagagcccatggccagattctttcttctcaggatccag

SEQ ID NO: 6780380 - DNA, 60 bp, Homo sapiens
agtcacatggactcaggatgacaaaagaagaatccttgacatctgttttgtccctgtgct

SEQ ID NO: 6780381 - DNA, 58 bp, Homo sapiens
aggaggtggtggcagtgacaattcctcactggatttggaatgtgtttgatcaccaact

SEQ ID NO: 6780382 - DNA, 55 bp, Homo sapiens
gtcctgagaatactaggcacaacaaaaggttctgtttaagcttgttatccaggac

SEQ ID NO: 6780383 - DNA, 55 bp, Homo sapiens
tgcaaacatcaatggcctgagcattgtgtattattaacctcagagcatgtttgca

SEQ ID NO: 6780384 - DNA, 66 bp, Homo sapiens
aataacaactagcaggtattaattttgtgccaaggggcatagattttgtgaatgctacttgtcttt

SEQ ID NO: 6780385 - DNA, 67 bp, Homo sapiens
tggcctatttaaataaatctcctttgaactcacgttatattaaatggtggctcttttaaattggcca

SEQ ID NO: 6780386 - DNA, 55 bp, Homo sapiens
ggtgagcttggacaccttggcaggttcagacaatgaacagacttcaaagctcacc

SEQ ID NO: 6780387 - DNA, 127 bp, Homo sapiens
taaaacttaaaatcatgagaaggcatcagaagatgtaagtggaatatagaatcagacttagatatgtttcgtgcatcatgtattcccatttctcccttgattggcttgcttatggggaagagtttta

SEQ ID NO: 6780388 - DNA, 91 bp, Homo sapiens
ggtttgccacttacagagttacttggagccagctgaagttagagctggcttctcccctttgagtcttcaattctgtgtttatgtgcaggcc

SEQ ID NO: 6780389 - DNA, 86 bp, Homo sapiens
gatagtagtataggaacagggaggtgggccaaggtaagataaattatcagacaatgtctcatattcgtgttccatttctatttatc

SEQ ID NO: 6780390 - DNA, 58 bp, Homo sapiens
ggttggaggtgggaatagctagttatccatgacccaatttatagctctatttctagcc

SEQ ID NO: 6780391 - DNA, 81 bp, Homo sapiens
gggttctctagagccagctgagttactctgaggtcttggcaagtgcagagattgagagcacagactggtgttggacagccc

SEQ ID NO: 6780392 - DNA, 77 bp, Homo sapiens
ggacaaatctaggctcatcctggtcccacaggaagttttaaagtgtgaatggcaccaggatcagtctgtcattgttt

SEQ ID NO: 6780393 - DNA, 60 bp, Homo sapiens
catgtgctgtagcagagaggaacccactacagctgggatcctggactgacacagcgagtg

SEQ ID NO: 6780394 - DNA, 66 bp, Homo sapiens
gttctccgtgccccatgctgggccctggaaataccacccatgggttaacatggtccatggaagagc

SEQ ID NO: 6780395 - DNA, 87 bp, Homo sapiens
ctcctgggtcccactgcttgcctccctcagctcacagctggtattactagctctgtgtggacagggaggctgcagagggacggggag

SEQ ID NO: 6780396 - DNA, 57 bp, Homo sapiens
tttcttaatacttgtggtttcttgtctaagtacaattcaaatacaagtgttagggaa

SEQ ID NO: 6780397 - DNA, 94 bp, Homo sapiens
tttctcgtttgccttcttgttgttcatcgtttataactatagttcttttggggcagagtcttagataagtgaccaatgggagggtggtgaggaa

SEQ ID NO: 6780398 - DNA, 55 bp, Homo sapiens
cctgcatccgaaagtgatcataggctgcctgtgcctaggtcattgatagtgcagg

SEQ ID NO: 6780399 - DNA, 66 bp, Homo sapiens
cataaagtaaagatgtcttccaggacaattttaattcctggaaaggaagaaactcttttctttgtg

SEQ ID NO: 6780400 - DNA, 68 bp, Homo sapiens
gtaagcacgctgtaataattgtgttctctacaaaaatggagaaatacttaatctttgcaggtttttat

SEQ ID NO: 6780401 - DNA, 56 bp, Homo sapiens
ttttccatctttgtgccctggtgttggtgcagcatacctagggccaaaatggaaaa

SEQ ID NO: 6780402 - DNA, 77 bp, Homo sapiens
gaaggggggaaaattaggtcctggaaattgacggaaagctgtttggcatcttgaaattaaccaggactccccctttt

SEQ ID NO: 6780403 - DNA, 62 bp, Homo sapiens
tgaggggacctgggcttcaagggttgagaggggcacacccgacccctccccgggtctcttta

SEQ ID NO: 6780404 - DNA, 65 bp, Homo sapiens
gtcgctcacatagcccatggactggtcagctgcctcggactgactggatgtgctactgcagcggc

SEQ ID NO: 6780405 - DNA, 72 bp, Homo sapiens
taaatatgtatgtatatagtatgtgtgtatatatgttgtatatatgtgtacgtgcagtatatatatttttta

SEQ ID NO: 6780406 - DNA, 77 bp, Homo sapiens
accctggctcttgagagtggcttgttgactgctggctgcatagctcagtattctgccatgttctgagtagaagaggt

SEQ ID NO: 6780407 - DNA, 82 bp, Homo sapiens
gtggatcatcttgcacaagctctgggatgcagacatcccaatctggagattcccatcctcagcagcagcatctgggatccac

SEQ ID NO: 6780408 - DNA, 68 bp, Homo sapiens
ctctacaggatatcacttcatttctttaacaaataattgcatggaaaagagggaggtggactgaaggg

SEQ ID NO: 6780409 - DNA, 74 bp, Homo sapiens
atttctgttgtttaaggtcccttgtgtgtggtgttttgttatggctgcctaaggaaattaatgcaactgggaat

SEQ ID NO: 6780410 - DNA, 85 bp, Homo sapiens
gagaggtccaaggttagagtgtctggtagctgctctggctttaacagttggctcgaatggcaaccaacactaatatctgcctttc

SEQ ID NO: 6780411 - DNA, 72 bp, Homo sapiens
tattttccttttatactcgtctgaatgattctttgaaagagaatgttttcatgagaatgaataggggaaata

SEQ ID NO: 6780412 - DNA, 75 bp, Homo sapiens
gcttgagtgaacctagcatggattatcaggtataaaatatctgggagatgacctgtactgggtattctctcaggc

SEQ ID NO: 6780413 - DNA, 69 bp, Homo sapiens
caatggcttatgtaatgctgtttacttttcctgctatgtctagcttaaacagtatttcaaggaccattg

SEQ ID NO: 6780414 - DNA, 70 bp, Homo sapiens
ttcttcagagttattgcattgggaattatgtaggaaaacaaatccatttcagaatgcattctttgaagga

SEQ ID NO: 6780415 - DNA, 84 bp, Homo sapiens
tgacgcttccttggcctccatctcctccagtactccagtccagcgccatgggtgcaggactcctggaggaaggtaccaagctca

SEQ ID NO: 6780416 - DNA, 62 bp, Homo sapiens
ggagaaaggcaaaggctggtatggctgccctggcagtgatctatcaattttttcttctttcc

SEQ ID NO: 6780417 - DNA, 55 bp, Homo sapiens
ggagaatggtgatgatgctacctgttctatgacatgtagcatgaggcactgtgcc

SEQ ID NO: 6780418 - DNA, 64 bp, Homo sapiens
tttttccttggatgtgtctctctgagagaagccagctactttatcatgagaatctatggagagg

SEQ ID NO: 6780419 - DNA, 61 bp, Homo sapiens
cactgtattattaggaatgacatcttggcaaagaaaatgccaattctctagtggtgcaatg

SEQ ID NO: 6780420 - DNA, 75 bp, Homo sapiens
taagccaatgtacaaaataattacacatctgcttctatagtatgcacagatgttgctgttgttgtcattgatttg

SEQ ID NO: 6780421 - DNA, 99 bp, Homo sapiens
cattaacaaaagcaccaaaaggaatgttttccagacctagatggtttgagaagcatctaggtttggaagatagagtccttcctttagctgtagttgatg

SEQ ID NO: 6780422 - DNA, 61 bp, Homo sapiens
taggttaccacctaacccctaattgtgtgtcttaccacataatgcaagtggtggtaatctg

SEQ ID NO: 6780423 - DNA, 86 bp, Homo sapiens
aaagattctttacaagtttacagaatgatggactgagctatagcttccagaaaatattttttagttaacaagtgcaggaaatcttt

SEQ ID NO: 6780424 - DNA, 84 bp, Homo sapiens
gaatgttttatgtactcagaagatgtgggtagatagaagagaaaatgcagccttctgtctggctgtctctgagtatagacattc

SEQ ID NO: 6780425 - DNA, 97 bp, Homo sapiens
tagagagttcagggaaagtgtctcagtctgtttgggctattataacccataaaccatgtggcttacaaacaacagacatttatttttaactgttctg

SEQ ID NO: 6780426 - DNA, 66 bp, Homo sapiens
ggaatacacagcaaggtctgactttgggatatggagtgtaaactaggtgactatgctgatggctct

SEQ ID NO: 6780427 - DNA, 78 bp, Homo sapiens
agccctctctaaacaaatcattctgaccttgggccaaacctatcactgtgattctgtatggattccatctgaggtgct

SEQ ID NO: 6780428 - DNA, 81 bp, Homo sapiens
tccctcccccatcagccctggcccaggtgccttagcaaagcttcttccctgacacctggaagctgcggtttggccaaggga

SEQ ID NO: 6780429 - DNA, 89 bp, Homo sapiens
cagaagctttttgatagcctttggctacaagcgctgcaatcctaacctacctgggttaaagtgtcagaagccaaaattaaaatctcatg

SEQ ID NO: 6780430 - DNA, 58 bp, Homo sapiens
tgtcttattgcgtatgtatacaaggcattgttttgtagtactttttgtaataagagca

SEQ ID NO: 6780431 - DNA, 77 bp, Homo sapiens
ggcaagaggtccaagaggtctcagatgagccccatgtgactctggggttctttaatggcgctctctgcattcttgcc

SEQ ID NO: 6780432 - DNA, 129 bp, Homo sapiens
acctgggtacacccttcagaagtgggcacctgcctctaagcagcaggtggggtcagagggaaagtcagttctcaaaggttgttgagagtgcagggttctagcctcacttctcagggattgcttgttggt

SEQ ID NO: 6780433 - DNA, 94 bp, Homo sapiens
ccaggggaggctgtcagcgagggctgtgtactatgaggaggggaagtacaaacatctctgggctctgcgaagcccttctccagccctttcctgg

SEQ ID NO: 6780434 - DNA, 89 bp, Homo sapiens
gtatgtctctctgtctgtttctcttaagtttctttattagcttgtccttggttggctgcaattaagaaactaaaccactagaggcatgc

SEQ ID NO: 6780435 - DNA, 59 bp, Homo sapiens
caggtcataactatgcatgaacattttttatcaggaatggccgatgtgtatgtgatttg

SEQ ID NO: 6780436 - DNA, 68 bp, Homo sapiens
gccacagaggagtgcacactctctgggatcacttccagagtcagagaggtgattatttcatttgtggt

SEQ ID NO: 6780437 - DNA, 58 bp, Homo sapiens
ttggagttcctttgaaaggctctgcttttagtcagagtagctattttgggaactcgaa

SEQ ID NO: 6780438 - DNA, 72 bp, Homo sapiens
tgaaatgcatactggacaagaatgactgttggtagcaaccactgaaacaatttttgttgtctaagctgttca

SEQ ID NO: 6780439 - DNA, 69 bp, Homo sapiens
gagttggagccctgggtcccagtcctggctttgtcactgacctgccagggaacccaagggcctcaattt

SEQ ID NO: 6780440 - DNA, 61 bp, Homo sapiens
tttgatgtgacaggattgcagagtgccaccaggcacatgccccattcttgtcacttccaga

SEQ ID NO: 6780441 - DNA, 62 bp, Homo sapiens
ggatatttattctcatagttatgcctcaagaaaagctggcaagcttgaatcaatggatatcc

SEQ ID NO: 6780442 - DNA, 95 bp, Homo sapiens
gccacaagagctgggacagagcatggatactgggataagctcaccagaaaagtgggctcatcccagtgtccatgctcaggcccagctctggtggc

SEQ ID NO: 6780443 - DNA, 103 bp, Homo sapiens
atagaccaaagtgatgtttgcttttctatggttcccttctaaaattccacaaagtctttcaaagtaacaaccacgaggagtcgtaagcacatgcttcatctat

SEQ ID NO: 6780444 - DNA, 58 bp, Homo sapiens
ggaaatacggaaacacatgatcagacatctgtgaagtgactgaaatgtgttttcctcc

SEQ ID NO: 6780445 - DNA, 68 bp, Homo sapiens
ggtagtttaagaaataattgttgattgggtgaataaatataggtcataaagttatttctaaatttacc

SEQ ID NO: 6780446 - DNA, 92 bp, Homo sapiens
gtgatgctggtgggaggcttgcatggctttcttggtgtggggttcatttgccttctaggtcccttcatcagtgagcaagcctctccagccgc

SEQ ID NO: 6780447 - DNA, 74 bp, Homo sapiens
ggaatgagcatgcaccgagccactgtggcttctcccaccacacggcccagctgcagaggtttgtgcaacattcc

SEQ ID NO: 6780448 - DNA, 84 bp, Homo sapiens
cagcacgtgctactggaagaataatgggccttagagctagcaaaactgagttcaaatcctgcttatgctaccagttgtgtgctg

SEQ ID NO: 6780449 - DNA, 130 bp, Homo sapiens
caattctctctccttcatcctcagatttggcagtagaagcttgtttttcagaacagggctggagtggcctctttgaaactctgaacatgtttcaactgtagaatagagccataatgggtgatcttggaag

SEQ ID NO: 6780450 - DNA, 77 bp, Homo sapiens
ttagacttcttcaattattggaaagaaagattcattttattaccttgtctttaaacatatctgttgagggagtgtga

SEQ ID NO: 6780451 - DNA, 72 bp, Homo sapiens
ggttgatggtgggcaggtagtgatgtcttagataccaaggatgacatcaccactacaaacatcattgtgacc

SEQ ID NO: 6780452 - DNA, 94 bp, Homo sapiens
ttcccatatagctcccagaccttggctgggctccagcatctacaaaggaggaagagatgctgggcccagatcccaggatcttggacatggtgaa

SEQ ID NO: 6780453 - DNA, 70 bp, Homo sapiens
gctgccatttggacctaactgggctagtcagagaaactgatgggaagagccagcagtatgtcctggcagt

SEQ ID NO: 6780454 - DNA, 82 bp, Homo sapiens
ggatgatccccctcttgggctataaatataaccatatgatgccatacatgaatatatgaagttcaacagggatagggtttcc

SEQ ID NO: 6780455 - DNA, 62 bp, Homo sapiens
ttcttacatgccgatgacttcttaatgaaagtccacctaagaactatctctggctgtaggag

SEQ ID NO: 6780456 - DNA, 60 bp, Homo sapiens
tcaggagaatcagggctgtcctttgctgccagaagcagagggcttgttcctttttcttga

SEQ ID NO: 6780457 - DNA, 79 bp, Homo sapiens
ccatgaagcatgtcgggaatcgaaaggcaagctggttcggctggcccgcctggcacattcccgcgcatgctctgcgtgg

SEQ ID NO: 6780458 - DNA, 94 bp, Homo sapiens
ggctgtcacgctgcccgttgtcctgtgattccagctcttctcccagggtgacagaggactgaaacttacaggaaaggagctctgatgacagacc

SEQ ID NO: 6780459 - DNA, 64 bp, Homo sapiens
acctcctctgccttgtttcctctttccagagccactagggaggacggtccagggcaaaggctgt

SEQ ID NO: 6780460 - DNA, 79 bp, Homo sapiens
ctttggcgcatacctgattctcagcagtgtgctcattagatgctcagtgtgagtgagaagtgcagtgtggttgctagag

SEQ ID NO: 6780461 - DNA, 68 bp, Homo sapiens
cagactccttcagaaacttctggtgtcaaataactcttattttcagcaagtttttcttaaggtgtctg

SEQ ID NO: 6780462 - DNA, 98 bp, Homo sapiens
actataactcttttatctcagtatttctagtttcttccacagtagctcctcaaaacgtggttgtagatttggaaataaatgtaattgagtggaccagt

SEQ ID NO: 6780463 - DNA, 58 bp, Homo sapiens
ggatggatactataggaggcacatttgagatctttcaaattgctccagctgaccatcc

SEQ ID NO: 6780464 - DNA, 84 bp, Homo sapiens
gggaggctttaaaaatactgattctagggctccactcccagagattctgattaaatttctgtggggtggagctcaggaattccc

SEQ ID NO: 6780465 - DNA, 75 bp, Homo sapiens
agaagataggcagtagcaggatctgccataattctaaaagtgtgcatgggagaatcttgctctgctacctctttt

SEQ ID NO: 6780466 - DNA, 63 bp, Homo sapiens
caggaccaggagatttgagctaggcttgggaccttctctttgctgggtctctccctggtcctg

SEQ ID NO: 6780467 - DNA, 75 bp, Homo sapiens
ttgtgtataaaacttcattgcctcctgacctccatataagttcttgtcctgtcagtgaggcagatgaaagcataa

SEQ ID NO: 6780468 - DNA, 95 bp, Homo sapiens
tcgctgtagcatctgaagttgctcagagagtttcacaagtttccgttttaatgggtcttgatttctctaaggactgggggtggtaggaacagtga

SEQ ID NO: 6780469 - DNA, 91 bp, Homo sapiens
aacttaccaacttttttgttgcctatgcttttggtgctatatctaaaaatcctttgccaaatacaaggtcatgaaggtttacccgtaagtt

SEQ ID NO: 6780470 - DNA, 69 bp, Homo sapiens
gcctgccctggttacactggagtccaaggtgaagcggatgaccgtgtactctcagtagaccggatgggc

SEQ ID NO: 6780471 - DNA, 55 bp, Homo sapiens
tctccaggtagatatgtcaggaatcatttgaaatacttatatgtctgctggggga

SEQ ID NO: 6780472 - DNA, 92 bp, Homo sapiens
tctaatttagtgtaggctttcacagctggactccctaccctataaaataaagtgaaagggagtaaagttgtctagctgtaaactagagagga

SEQ ID NO: 6780473 - DNA, 79 bp, Homo sapiens
ataccttgtgtactgatgctgagagcaatttcataagaaatttcaaaaatgctttagcagtgattagtgcttgtggtgt

SEQ ID NO: 6780474 - DNA, 75 bp, Homo sapiens
ggtgatgttatgaagatgaatgtacaacttatatgcaggtatgtaatataaacacaatgtcatcataatgtcacc

SEQ ID NO: 6780475 - DNA, 74 bp, Homo sapiens
cttgcctgggattcccagaggggcaggggcttcctaaagacctgtgtctggtgctctgtgatgtcccagccaag

SEQ ID NO: 6780476 - DNA, 64 bp, Homo sapiens
tccagggccgcccgcctgacgagcgaccggggctctcctgtgacgttcctgctggcgacctgga

SEQ ID NO: 6780477 - DNA, 92 bp, Homo sapiens
ctcggcgctcatccccagcacagccctccccaggctgcggcaaagactgttgctgtcctgctgagggatgtgcccccggggattcaatcgag

SEQ ID NO: 6780478 - DNA, 121 bp, Homo sapiens
ggtgtgaggaattggaaagctcagaaatggaaaatagttaacgttcagagtagcagatgaacacagctctcacatttgcattttccctttcgttctgactcatcttcccctctccccaccc

SEQ ID NO: 6780479 - DNA, 75 bp, Homo sapiens
caaacaaaatgacatacttttagatagatgggctttgaagagaataaccatcctctacaggttcaagagtgtttg

SEQ ID NO: 6780480 - DNA, 109 bp, Homo sapiens
ggcatcaatatgttctaatgtcctaggcatgattttgtgaaatgtttagtttatttttataaagttacacagccatagagacatattagcatagttccatttgtttgtc

SEQ ID NO: 6780481 - DNA, 85 bp, Homo sapiens
tgaaagcttcagtcatacagagaaggataataaagccaatactcctcttgccgaggttttatgagtttctgtgctgaagacagca

SEQ ID NO: 6780482 - DNA, 58 bp, Homo sapiens
aatacgtcccatcatctttttcactaacaggtgaagggtattctagatgagatgtgtt

SEQ ID NO: 6780483 - DNA, 57 bp, Homo sapiens
agagacagtacaaaagtcactgatgcaacatcatcattaagtgtgacatgctgctct

SEQ ID NO: 6780484 - DNA, 98 bp, Homo sapiens
ccgagggcgctgggagtctgcaacctgagaatgggggcatgtgtccctggggcagtatcccccatctttcatccaacaggcttggccgggctgcttgg

SEQ ID NO: 6780485 - DNA, 112 bp, Homo sapiens
tgtataagcattccatgttaacagaacttgcagtggcagttagaaaatattccagtcaaatttctggttttggagctgagtttattgcctgtttgttgtttgatcttattca

SEQ ID NO: 6780486 - DNA, 69 bp, Homo sapiens
cacattgtagtaaaagctgctgtgaatgttataatggtggttgctatgggcaacagcagtcacaatgtg

SEQ ID NO: 6780487 - DNA, 66 bp, Homo sapiens
acgctgaggtacgctggctccctggcacctagatccagcggctgtaggggccagtgaccttcgtgt

SEQ ID NO: 6780488 - DNA, 82 bp, Homo sapiens
gcagggctgtatttctgtctggaagctctaggggagaatccatgtccttggtttttccggcttctagggaaatgcttcctgc

SEQ ID NO: 6780489 - DNA, 55 bp, Homo sapiens
gcacctccaggggccgcccaccactggtgggttgtggcttggcgtctagaggagc

SEQ ID NO: 6780490 - DNA, 59 bp, Homo sapiens
tcaacctgtggaagatgggagtgggtggatccatacccagctttctcacacttggtgga

SEQ ID NO: 6780491 - DNA, 56 bp, Homo sapiens
tcctgagggactggttcctcgctgggaggaggaggatgtagccagaacctctggga

SEQ ID NO: 6780492 - DNA, 76 bp, Homo sapiens
aagtagcataatatggtaaaagaacttgagctttgtaattggacagagcctggttcaaattttacctctgctattt

SEQ ID NO: 6780493 - DNA, 59 bp, Homo sapiens
tagaggccagggtgtcttgagtgctgtaactcccaagcactgggctagcctgacttctg

SEQ ID NO: 6780494 - DNA, 59 bp, Homo sapiens
tgagttgctatctagatccagagttgacacttttaaccactgtgctgtattgtaactca

SEQ ID NO: 6780495 - DNA, 59 bp, Homo sapiens
ggcttgccatgagtgcacctgtgcttcggttgccagcccagcaggtgagccgtggctcc

SEQ ID NO: 6780496 - DNA, 127 bp, Homo sapiens
ctgctgattctagctgtgagcatttgttccacagcgcagccagcaccctttaaattccgtttgagcaccttgtgactggctgctgtgtgaggaacaagacaaaaatcctcccagctgcctccagcag

SEQ ID NO: 6780497 - DNA, 123 bp, Homo sapiens
tcagacagagagagtagacttgacacccctcaactggatatatttagagatgttttcttccataaggagacactggaaagtattacaaggggtcattcattgtactccattttaaaagtctgg

SEQ ID NO: 6780498 - DNA, 61 bp, Homo sapiens
ttgtaactttgcatactcctgttcccccatccccagtgagtctgtgctgaagaagttacaa

SEQ ID NO: 6780499 - DNA, 68 bp, Homo sapiens
tccctgcctcctggctgatgggtaggcagcacatgccagcccagagaaggggcccgtggaggcaggga

SEQ ID NO: 6780500 - DNA, 56 bp, Homo sapiens
gcaggcggaggttgcagtgagcccagatggtgccactgcactgcactccagcctgc

SEQ ID NO: 6780501 - DNA, 68 bp, Homo sapiens
ccctttggaagaggctcactgaggtaaatattaaggtcactaggtctcaggagcagctgtaggaaggg

SEQ ID NO: 6780502 - DNA, 55 bp, Homo sapiens
tcagccaggccaccttcagctttatccaccagtctttgaatttggcctgagctgg

SEQ ID NO: 6780503 - DNA, 62 bp, Homo sapiens
atcatccaagcgtagttcttctatagtcctgggcaaaccccagggaattgtgctaaggtgat

SEQ ID NO: 6780504 - DNA, 76 bp, Homo sapiens
tggcagatgccatgccttcctttccctggaaaattccccatgactctttcaggatgcaaggaggccccaactgcta

SEQ ID NO: 6780505 - DNA, 101 bp, Homo sapiens
ggggagattttttgattatgaacatcctaggaggcatttgttaaaacctttttactaaaaaatgccttttgatgtgttgagattgtcacatggatttcttc

SEQ ID NO: 6780506 - DNA, 61 bp, Homo sapiens
gctccccacctggaagcctgcagactcgccgagctgagagaatcatgctgcaggtgggggc

SEQ ID NO: 6780507 - DNA, 64 bp, Homo sapiens
ggggtggccactgcaaggccttcgaagacatgagtcatgaagctgtgggcagtggagccacccc

SEQ ID NO: 6780508 - DNA, 66 bp, Homo sapiens
gagtaacatagtttgtgcttcatcattgcttgctagttggaggagtcacaaattctgtagatgctc

SEQ ID NO: 6780509 - DNA, 55 bp, Homo sapiens
gagtccagttctttccagcagtgaccacatggtaccctgggatgggcttggactt

SEQ ID NO: 6780510 - DNA, 64 bp, Homo sapiens
cagccataaaattaatatgtactatgtatatatatttatatgggtaaataataattttaggctg

SEQ ID NO: 6780511 - DNA, 92 bp, Homo sapiens
tgcttttttaaattgtgccagctgagaagtgtaaagtgatatttcattgttattttaatttgcatttctcggactgttagtgaatctgagca

SEQ ID NO: 6780512 - DNA, 71 bp, Homo sapiens
tagatttcacactcagagtctgtttggtacctgaaacaacaggtagctatccagacgctgaatggaatctg

SEQ ID NO: 6780513 - DNA, 77 bp, Homo sapiens
gagtggaatggtggtgttggtgggggagtgcctgtttactggtagtaggagtaactctcgtcatcatattccagctc

SEQ ID NO: 6780514 - DNA, 64 bp, Homo sapiens
ctgtgagccagcacggatttcccaggaacgttgctgttcgctaggccacgtgctggcctcacag

SEQ ID NO: 6780515 - DNA, 63 bp, Homo sapiens
ctggcatgtgatgttcagtacctagaagactcggtttccttggtagagagaatatttggctag

SEQ ID NO: 6780516 - DNA, 68 bp, Homo sapiens
tccagagggcctccagggcagcagtggcttgtcccgagctgatggcatatgactgggggttccctgga

SEQ ID NO: 6780517 - DNA, 76 bp, Homo sapiens
atgaaatattagccagaaatgaatgatgataggtactgatgttcaaatttatttattcattctgtctgtctgtcat

SEQ ID NO: 6780518 - DNA, 56 bp, Homo sapiens
ggagagtctgagcctgctggaggctctaacactcaggcttgcttataggattctct

SEQ ID NO: 6780519 - DNA, 57 bp, Homo sapiens
gtttggttggctgtctttaacacctttgttaacacaaaggaagaagccctctaacac

SEQ ID NO: 6780520 - DNA, 77 bp, Homo sapiens
tttccatcctaataaaagaagttactcagatggatattccagatgtatttaagctgcttttattaggacaatggaga

SEQ ID NO: 6780521 - DNA, 71 bp, Homo sapiens
catttgaatagaggcccctcagaaaattcacatttccatatttactgggggatttttgtttattacaaatg

SEQ ID NO: 6780522 - DNA, 86 bp, Homo sapiens
tgttccatgtcctgtggcttgctaggaggtgtgctcaagcctaacaaagagcattctagacagctacagaaagacccagtggggta

SEQ ID NO: 6780523 - DNA, 68 bp, Homo sapiens
ctggcagcaaggtctccctgcacctggtctcacagacaggccagatcctggtgaggcttagcttccag

SEQ ID NO: 6780524 - DNA, 58 bp, Homo sapiens
ttgcaggtgagggaaatgactgagaatcccgtttcttatcaactcccccaacctgtga

SEQ ID NO: 6780525 - DNA, 65 bp, Homo sapiens
cctcactaattggaacactttttgcctctgccagtgctaggaaagagggacccagcttggttggg

SEQ ID NO: 6780526 - DNA, 71 bp, Homo sapiens
atgtgactgtgggtttctggttcctgacccataaatggaaaaggcagggctgaaagctctcacagtctcat

SEQ ID NO: 6780527 - DNA, 72 bp, Homo sapiens
tggtggtttcagtttgggccccagttttgactaactctaagaactcaaagaaaaacacaactgaaaccacta

SEQ ID NO: 6780528 - DNA, 60 bp, Homo sapiens
caggtgtacacattgtgtttatatttgtatgtaaatctatacgcataatgtttattcctg

SEQ ID NO: 6780529 - DNA, 89 bp, Homo sapiens
gcaaaggacaaggcattgaaatttccttcagctttcactgggaactttcagtatgatgagagggaaatttaacatgtctggtcatttgt

SEQ ID NO: 6780530 - DNA, 70 bp, Homo sapiens
cactgggagatgaacaactagaaatgtaaattcaaacagttttacattcacagttgttcatctcccattg

SEQ ID NO: 6780531 - DNA, 97 bp, Homo sapiens
gaatgtaagctgactcaagaatggatatccggctcattaatatttgcttcatagaaataggctcaaatgttcttctcgagtctgagtaggtacattc

SEQ ID NO: 6780532 - DNA, 64 bp, Homo sapiens
tatagagtcgccttgaaaacactcggatgttaagagagactgggtgttatgagggcgatctata

SEQ ID NO: 6780533 - DNA, 104 bp, Homo sapiens
cccacctccccctgcagcccaaagcaggcaccagctctctcccgagcagccggctccaccctgggcagctgggcctgagctggaagctgcaggggccaggaggg

SEQ ID NO: 6780534 - DNA, 61 bp, Homo sapiens
tttcttgtctttagtatctggcttctcaactttttcacctgccatcttgcaagatgagaaa

SEQ ID NO: 6780535 - DNA, 90 bp, Homo sapiens
gagaaagcaccatttggagcagcacaagaaaggggatttcagatgcctctgtcctcacttctgttgcttcagactgagtcttcacatctc

SEQ ID NO: 6780536 - DNA, 70 bp, Homo sapiens
agaggattacttctgcttgcccagtgactacagaccagctctggcatgggcaaaccagggaaactcctct

SEQ ID NO: 6780537 - DNA, 70 bp, Homo sapiens
tatgaagtcattgctgtgggcatttgctgcctgaccagagcacaagtcctccgacagcacgttcttggtg

SEQ ID NO: 6780538 - DNA, 62 bp, Homo sapiens
cagagctgtcatttgccagtgagagcctccgacagggcaggtactgtgccagggcagctctg

SEQ ID NO: 6780539 - DNA, 55 bp, Homo sapiens
ttcccctttttgtgtgcagctgagtgtatctctcgtttgccagaagggaggggaa

SEQ ID NO: 6780540 - DNA, 90 bp, Homo sapiens
gtgaaatttcttttgattaaaacaggtgtcagcaaactatggctcatgggccaaagctgcccagctgcctgtttttggaataagctttat

SEQ ID NO: 6780541 - DNA, 82 bp, Homo sapiens
tctgcaatcagcatcaacaatgaacataaataagtacacttcctttttattaatagttacatagttgaaatgcagttgagga

SEQ ID NO: 6780542 - DNA, 63 bp, Homo sapiens
ttgctggatggtttggtaaaagtatgtttagttttgtagagaaacaaccaaaccatcttccaa

SEQ ID NO: 6780543 - DNA, 79 bp, Homo sapiens
acacttaagagggactcgtaaatgcttgtttagtcagtaaagtgttgaacatgaacaaatcctgcgagtatgtaagtgt

SEQ ID NO: 6780544 - DNA, 67 bp, Homo sapiens
ctacatcctgtttgtcactagaaaatagaaaagagctatttattttcagatgggaagcaggaggtag

SEQ ID NO: 6780545 - DNA, 62 bp, Homo sapiens
ctgactctctgagctcaaggttaaacttaagttcgaagacttgggctcagaaggactgtcag

SEQ ID NO: 6780546 - DNA, 61 bp, Homo sapiens
acacagtggtgagtctggacctgtaaaacatcatgacatgacttcactcttgccattgtgt

SEQ ID NO: 6780547 - DNA, 56 bp, Homo sapiens
cactgcacaaaaagctgcaactgtctgtccagtggagagtagcagaaagtgcagtg

SEQ ID NO: 6780548 - DNA, 61 bp, Homo sapiens
ttcttcagcttctacctgcgtcccaatcctgaagtgggagagaataggagaaattgaagga

SEQ ID NO: 6780549 - DNA, 75 bp, Homo sapiens
tttttggcaaagtaatctgattttatagctatctctttaaatgagaaggcttctttttcagatttcttccaagaa

SEQ ID NO: 6780550 - DNA, 85 bp, Homo sapiens
ttccatttactattgtctggctcgctctcgcccgtcccggggggccggggcaggggacaagggccaggttaggagcaaactggaa

SEQ ID NO: 6780551 - DNA, 82 bp, Homo sapiens
atcctagttatccaggaaatcataaattgctttgtcattaacagtaatcatatgattttctcaaatggaatgtggtaagggt

SEQ ID NO: 6780552 - DNA, 57 bp, Homo sapiens
attgtcttctgtcttatagttcctgatccaatagaaaagataagaccagaagacaat

SEQ ID NO: 6780553 - DNA, 97 bp, Homo sapiens
tcatttgcatcgattggaagtgttgacttctgtgaatttctgtttcatgtgaacttgacagaagtcagtacttttgctccatcacagatgcctgtga

SEQ ID NO: 6780554 - DNA, 55 bp, Homo sapiens
tttgaaactcccttttgtctagtagactgtgccctacagtagaagggatttcaaa

SEQ ID NO: 6780555 - DNA, 70 bp, Homo sapiens
gaaatggttacagagatttttaagatgtgttttccatgcctacatgctcttgtaactgctgtaccatttt

SEQ ID NO: 6780556 - DNA, 85 bp, Homo sapiens
catttaatcatttggatattcacggattggagttctttatgtcactacagacaggacagcaaccgttattcacactagttgaatg

SEQ ID NO: 6780557 - DNA, 59 bp, Homo sapiens
aagatcaacctgtgcttaagagttggcacagaaaacaattctgcagccatgttggtttt

SEQ ID NO: 6780558 - DNA, 83 bp, Homo sapiens
catttagctatcgattatagcttgccattttataaatattccatgtaagaatggaattaaaaggccaaggctgttcctaaatg

SEQ ID NO: 6780559 - DNA, 73 bp, Homo sapiens
cctattcttggtgcagatgcaggtcactgggcacatccccaattcctgggttctgccacaaagctggagtagg

SEQ ID NO: 6780560 - DNA, 85 bp, Homo sapiens
ctgactggcccagatgagtgtgggctcagctatagtgcctgtaaagcaggattatcgtatctcttggtcttcattcagcctttag

SEQ ID NO: 6780561 - DNA, 56 bp, Homo sapiens
cccaagagctggctcttgcagcagcctcctctgaggctccctgctcagctcctggg

SEQ ID NO: 6780562 - DNA, 80 bp, Homo sapiens
ttcctctaggtccacagatttggtttctgctggattgttgccattttcccaggggtaaagccagaggtggatttggggaa

SEQ ID NO: 6780563 - DNA, 57 bp, Homo sapiens
ttagaggtcaggtcgcagaggaagcactggttaccaagtcgcagacctgagttctaa

SEQ ID NO: 6780564 - DNA, 95 bp, Homo sapiens
gtcattctgcgcggtgtagtcgtacatcccaatcacctggcacactgcaggagacagggctgggtgagcggctgcacacccgccggagaatgcac

SEQ ID NO: 6780565 - DNA, 69 bp, Homo sapiens
gtgagagtgagaagcacagtctgggtcggtaggacaatctagttgtctatctgtgctttaaactcctat

SEQ ID NO: 6780566 - DNA, 56 bp, Homo sapiens
aaacccatggctgatatcactaatggaaatccagagtgctgacagtatgtgggttt

SEQ ID NO: 6780567 - DNA, 67 bp, Homo sapiens
tcctcttccacttatcttacttccccttcatgttgaaccaacgttaataggtgcaaggtaaggagga

SEQ ID NO: 6780568 - DNA, 72 bp, Homo sapiens
cccacgggaggaataacattggaaccctgaagagagggacctcttgagggtctgaatgttggttccagtggg

SEQ ID NO: 6780569 - DNA, 74 bp, Homo sapiens
tggccatgtgcactggcttttgcctgtaattctaacactttggaaggcaaaggcaggagggtcagttgaggcca

SEQ ID NO: 6780570 - DNA, 64 bp, Homo sapiens
tgtgctgctctcagtgacagcctctatagtttgggaagccttgtgtcctgggagccacagcaca

SEQ ID NO: 6780571 - DNA, 70 bp, Homo sapiens
ggggccattctgcatgggctgttggcgtcaggtgcccaggcgatgggaccccacagccctgcaatgtctc

SEQ ID NO: 6780572 - DNA, 75 bp, Homo sapiens
aagtctcagaaaactagtgtggctccttttaaaatttttgctggaccctattccacgcaggttttgttgaggctt

SEQ ID NO: 6780573 - DNA, 61 bp, Homo sapiens
aggagggaagaaagcggggaggtggagacccttcctagtaagcggctttctgggccctcct

SEQ ID NO: 6780574 - DNA, 76 bp, Homo sapiens
tgtggcaaaattgcacaatatagacatgactgcttatattttgttgtctttattttatgcttgtgcaaatcccaca

SEQ ID NO: 6780575 - DNA, 63 bp, Homo sapiens
atgtgggaatttgtaagtgttcagcatggtggaagcatggaggtcacagggcaggtctcatgt

SEQ ID NO: 6780576 - DNA, 80 bp, Homo sapiens
gtcagctgtagggcttagtgcttagtgcccagggtcctcgctggtggtggtgtcctcactatagcaagtctgcaggtgac

SEQ ID NO: 6780577 - DNA, 72 bp, Homo sapiens
gcttcctgggctcacaggcggggctggcgctgggagccctggggcctcaggccgccctgctgctcagtcagc

SEQ ID NO: 6780578 - DNA, 66 bp, Homo sapiens
tctggtggagaagcctaggatttcaactttttgtcagaggattcctgttgggacagctttaccaga

SEQ ID NO: 6780579 - DNA, 59 bp, Homo sapiens
ccagctgctatcatgccatttcttggaaaatgcctgaaattctgttatggtagagttgg

SEQ ID NO: 6780580 - DNA, 62 bp, Homo sapiens
gtgatttagagagtgtaaaaatatatccttactgggaagtatttaggagctgtttaattcat

SEQ ID NO: 6780581 - DNA, 58 bp, Homo sapiens
atccaaagaatgcttagacctgcagccaatggctcttggtgggtctggttctctggat

SEQ ID NO: 6780582 - DNA, 59 bp, Homo sapiens
ctccagaaggtgggggagccactagaggtaaggagcctggacccctcgatcatctgggg

SEQ ID NO: 6780583 - DNA, 66 bp, Homo sapiens
cagttccggtgccgccgctgcggccgctgaggtgtcgggctgctgctgccgcggccgctgggactg

SEQ ID NO: 6780584 - DNA, 72 bp, Homo sapiens
ggtatggatcagatgggctcaaccctgccacctcacccctcatccacaggtatgagttcagtatccagattc

SEQ ID NO: 6780585 - DNA, 88 bp, Homo sapiens
gtgcctttgatggtatcaatgaattactgtaaaatagttctgttaaaagaaaagaacttccatgtgattctttgatctatgaaagcat

SEQ ID NO: 6780586 - DNA, 67 bp, Homo sapiens
gttttcaaaaatcattcttgtagaaattgatttctcattggctgatttctacaggatgaatgaaaac

SEQ ID NO: 6780587 - DNA, 58 bp, Homo sapiens
agagatgcaatggtatatggtcacctaaagtaggataatggacatctattgcttttct

SEQ ID NO: 6780588 - DNA, 62 bp, Homo sapiens
gccatgattgattctacttaaaacatatggagatctatgaaattgttggtgaatctaatggc

SEQ ID NO: 6780589 - DNA, 64 bp, Homo sapiens
agtatttggagtaagtatgccttggtggggtcctcatttggatgtaattactctgatctgtgct

SEQ ID NO: 6780590 - DNA, 85 bp, Homo sapiens
gatggaaataagatcatcatgcccacttgagacttcagattattctttagcttagtggttgtatgagttacatcttattaaagtc

SEQ ID NO: 6780591 - DNA, 55 bp, Homo sapiens
aggcccatagtagctctgggcaggaagagtccctttggagcataaactatggcct

SEQ ID NO: 6780592 - DNA, 78 bp, Homo sapiens
gcacagggcgcttggggcaggaagcaggagaagtgaaggaaaacgtagctgatggtcctgtctcaaggagccttttgc

SEQ ID NO: 6780593 - DNA, 71 bp, Homo sapiens
tctggctccaggcatagaaggcacgcactgggctaagaaacctgggtgtgaatatatgacctggggcaaga

SEQ ID NO: 6780594 - DNA, 60 bp, Homo sapiens
tgctgtgggatatatgttcaaagtgctttatgaacagtaatttattgaatactcatagca

SEQ ID NO: 6780595 - DNA, 58 bp, Homo sapiens
aggctgtgtttaagtggtaatgttaatggaattatccgttgctgctggagcactgtct

SEQ ID NO: 6780596 - DNA, 55 bp, Homo sapiens
gcggtcgcagtcgcggtccaggggcagggttcctggcaatacttgtcttggccgc

SEQ ID NO: 6780597 - DNA, 55 bp, Homo sapiens
gtcctgcttgcagctctcactggcagccagggctgcatttgagttgggagcaggc

SEQ ID NO: 6780598 - DNA, 56 bp, Homo sapiens
ggttctttgcttaatgattcttttaagaaagaaaagaatcagtaagtaaggagacc

SEQ ID NO: 6780599 - DNA, 75 bp, Homo sapiens
ttgcttgagcccagaagttgaggctgcagtgagccatgatcatgccattgtactccagcctgggcagcaaagcaa

SEQ ID NO: 6780600 - DNA, 73 bp, Homo sapiens
actagaaatcttttcatctcatttgaagccatgattataattgacttcacaggaggactgaaagatatttggt

SEQ ID NO: 6780601 - DNA, 62 bp, Homo sapiens
tggcataggtatcaaggataaagctgttttattcatttcaactacctttgtcaccaatgcca

SEQ ID NO: 6780602 - DNA, 79 bp, Homo sapiens
aacctttggtcaattaaatttctcacttagggtatttgaacgcaaaaagcttaaatgagcagttcttggtggctgggtt

SEQ ID NO: 6780603 - DNA, 105 bp, Homo sapiens
acttaatactggaaggaatctcaagtgtcattttgtccatcttctcattgtatggatgaggaaatgaggcctatggcaattaagtgatttgttccagcttttggt

SEQ ID NO: 6780604 - DNA, 119 bp, Homo sapiens
gctgtatttcttctcctttgacttagaatggaaggttgagaagaactgtggcctgttcaaccccaggccttctcttagcactttgtgttactgtgttgggggccaaaaaggaatcaggc

SEQ ID NO: 6780605 - DNA, 84 bp, Homo sapiens
ccagggctgtggggtgggatgccgctgtctccacctcttagctgcatgagatggagcatgcgtctcaacccctcaaagcctcgg

SEQ ID NO: 6780606 - DNA, 65 bp, Homo sapiens
ccttgcatctcatttcattcttcttctcacaaccatgatctgaggctcagagatgagatacgagg

SEQ ID NO: 6780607 - DNA, 61 bp, Homo sapiens
ctcacgccttcccctgtatagtatagcacccctaactgtatgtgtaaggagaaggagtgag

SEQ ID NO: 6780608 - DNA, 62 bp, Homo sapiens
caggcatgatgggaagtgcctggaccattatgatactggtctagcacttggcgccatgtctg

SEQ ID NO: 6780609 - DNA, 63 bp, Homo sapiens
ttgcccaacaggaaatctctatactgagtagcattgaaccatctagatttctctcttgggtag

SEQ ID NO: 6780610 - DNA, 88 bp, Homo sapiens
ccctgattccttcaacttggagcacatttggctgcagtgcgctgccgagtcaactgtactttaggtacgtattattgacaatcagagg

SEQ ID NO: 6780611 - DNA, 65 bp, Homo sapiens
tctcatctagaatgacctcctcttagcttgattatatcgggggtaggacttgtctttctagggga

SEQ ID NO: 6780612 - DNA, 62 bp, Homo sapiens
cctcactgcatttgcttctccactgtttcaggagaaactcagtcataaagcgaatgcagagg

SEQ ID NO: 6780613 - DNA, 88 bp, Homo sapiens
ggagaatcgcttgaacttgggaggcggaggttgcagtgagctgagatcacgccactgcactccagcccgagcaacacagtgagactcc

SEQ ID NO: 6780614 - DNA, 66 bp, Homo sapiens
aatggggtaagggaccccaagtgaacaataagtctcctcttagaacttggttggtctcaccctgtt

SEQ ID NO: 6780615 - DNA, 63 bp, Homo sapiens
tgttctacaccagtgaaaattagctgcaccttcctctgtagctgcctctgctggtttagaata

SEQ ID NO: 6780616 - DNA, 60 bp, Homo sapiens
ctttgttggggcccaatctctggatgttaagtcagctgagtctgagtgcactcaataaag

SEQ ID NO: 6780617 - DNA, 55 bp, Homo sapiens
acaagtgtgtgcagtttgtaaaaactcaatgagctgtacatttgtgtacacttgt

SEQ ID NO: 6780618 - DNA, 58 bp, Homo sapiens
tcccctgtatttcctgttcatagattgccaggtctagagcttgattggattcagggga

SEQ ID NO: 6780619 - DNA, 68 bp, Homo sapiens
tgcaacaccagttcagaagaatctgtttccccagtaactcagaattctgtaattgaactgtgttgaca

SEQ ID NO: 6780620 - DNA, 55 bp, Homo sapiens
tcccccaactcttagcactgtagccaggtgtagttataaataaacgttggggtga

SEQ ID NO: 6780621 - DNA, 108 bp, Homo sapiens
tgttttggtgaataacagtttatggccccacttggagagaaaggcctgagtccctgtaggtggatttcctcttgactctaaaggtcacagctgttgccatcataaaca

SEQ ID NO: 6780622 - DNA, 65 bp, Homo sapiens
ttctgacactcagttccatattggtaagtgaaaataatcacacctatcccattgggttgttagga

SEQ ID NO: 6780623 - DNA, 109 bp, Homo sapiens
aggaggaagggaaaagaggcggggggaagtatttgtttttgcatccatcaaagaaagcaatgtttttggatgctgcattgaatgcttgctcccttacttccagccacct

SEQ ID NO: 6780624 - DNA, 73 bp, Homo sapiens
ccttcttgccctcaggcttccagctgggtttggcaaatgggagacacagctaggaaaccagagggcaggaagg

SEQ ID NO: 6780625 - DNA, 77 bp, Homo sapiens
ggaagggcttcctgccagcagcccagtgggcaagggaagagaagttggaaggtttattgggcctggaggatctatcc

SEQ ID NO: 6780626 - DNA, 74 bp, Homo sapiens
taatcacatgttgtttgccccagttgttattgccatatcaggcaactgcagtgttaaacaactgctgctgatta

SEQ ID NO: 6780627 - DNA, 76 bp, Homo sapiens
ggctttcagaaattatattagatgcccagcctttctcattcagagatgcctgtattattatgttatttcgattgcc

SEQ ID NO: 6780628 - DNA, 77 bp, Homo sapiens
ggaggccaggtgggcgtgtcttcaccttccctcttacgggtgaggatgttgtagagatgcccagttgaaaaggcccc

SEQ ID NO: 6780629 - DNA, 79 bp, Homo sapiens
ttcatctgaaaggctcttactagttacggctatgctacttttaagacatactgtatatctgagagcccaaggagatgga

SEQ ID NO: 6780630 - DNA, 73 bp, Homo sapiens
ggcccaccaaggcagcagactgttaatcagacaaacagatctctgagaaggtgcatcagctgctttgaaggct

SEQ ID NO: 6780631 - DNA, 78 bp, Homo sapiens
tttcctccagtgaatcattccaatgtatgatagacttagcagaaactatttctctgtatatgtggaaagaggaggaaa

SEQ ID NO: 6780632 - DNA, 97 bp, Homo sapiens
gccccttgggggaatcacattttgttgtgcgtttgtttggttttgatcaactctaaacactatgtaagcaagaaccttgtctggctttctcactggc

SEQ ID NO: 6780633 - DNA, 80 bp, Homo sapiens
ggagcatgattcatagaaagcatcaattctcccttatatagaatgagcccagggaattcctttcaaattatcatggcttc

SEQ ID NO: 6780634 - DNA, 71 bp, Homo sapiens
cgggtgctggaggagaaggttgctcataagtagattgcatacctataagccccaagtcctttcagcacctg

SEQ ID NO: 6780635 - DNA, 59 bp, Homo sapiens
tggcaccatgttggcaaatgtttcgatgtagcgcacaatttcaccacatgatggtgcca

SEQ ID NO: 6780636 - DNA, 57 bp, Homo sapiens
tagcctctctcctccacaacctagagagtctcagattgtactgagtgggagaggctg

SEQ ID NO: 6780637 - DNA, 130 bp, Homo sapiens
agacagagtagtgtagcagtgggaggagggggtagatgctactttacatagggtggccttcccttaccattcctatgtaaaatagcatacaacatcactcctgcattccctttttttccattatttttct

SEQ ID NO: 6780638 - DNA, 83 bp, Homo sapiens
gcatcttaacctgactgctctttagaattagggagcatctttaaaaaattccattctgattcattaggtctagggaagggtgc

SEQ ID NO: 6780639 - DNA, 130 bp, Homo sapiens
aattacttaattaaaaaatggggagaaacataatttgagccctttacagtatggttgtatcaaaacacattttattgagagatcaaacttgtaaatgatccaatttgtgattttccatgcctttgagatt

SEQ ID NO: 6780640 - DNA, 64 bp, Homo sapiens
aggtctgggctcctggcaggcagccttctccacagggcgctctgtctcaggggtccagcagcct

SEQ ID NO: 6780641 - DNA, 76 bp, Homo sapiens
ttcttcttggcacaaatttctgaaataagataagcagatgtcttggttttagcaaatctgttgcttcaagtaggaa

SEQ ID NO: 6780642 - DNA, 59 bp, Homo sapiens
tcttttcttgcattattgcactggttacaatctctatgttcaatgatgcctagaaatga

SEQ ID NO: 6780643 - DNA, 77 bp, Homo sapiens
ctgcagggctgctgcctcaacattttaggttctgatagctgtattctcagtcctggagtgacaggtgtagcctgcag

SEQ ID NO: 6780644 - DNA, 78 bp, Homo sapiens
gaattcctgctctctggtagactgacaccctttttccatgaagaagtggtctgtcttccagatccctgttttgaattt

SEQ ID NO: 6780645 - DNA, 57 bp, Homo sapiens
agggatcacggtggacttggataaccttctcctcaaagggtcctgacttggtctcct

SEQ ID NO: 6780646 - DNA, 64 bp, Homo sapiens
cttattgaagatctattatgagtcaggtccatgcatgggctttacattaatagacttatttgag

SEQ ID NO: 6780647 - DNA, 102 bp, Homo sapiens
tcctccagctgattgatttttctaattatgtttgctttagatggatatttaaatgcatttgcattccctgagctcacatggcaggatatggaggttggagga

SEQ ID NO: 6780648 - DNA, 55 bp, Homo sapiens
tcccatagcaatctgtattttgcctgaaaatcctctagattatagggttatggga

SEQ ID NO: 6780649 - DNA, 65 bp, Homo sapiens
gggttccatctgaagtgatcatcatttctcttcctctggggatctgagaaacttcaggcaagccc

SEQ ID NO: 6780650 - DNA, 74 bp, Homo sapiens
gtcttccctgttgaaaacctttatttggtactattctacaaagggtaatagcaaacaaaaggtacatcgaggat

SEQ ID NO: 6780651 - DNA, 62 bp, Homo sapiens
caggagagttcagttgtagccatattggttgggcaccagttttgtggtctgaacttattctg

SEQ ID NO: 6780652 - DNA, 72 bp, Homo sapiens
tctgtgcaagcccaagataaaacccaaaacaacttgttttttaatggtttggttttgccaggcttgaactga

SEQ ID NO: 6780653 - DNA, 79 bp, Homo sapiens
ggagagacaagagcatggtgcttcagtgaaggcgtttctgtgtctgaattaactggggttgccatgtgtcagtctcttc

SEQ ID NO: 6780654 - DNA, 62 bp, Homo sapiens
acaagaatgaggggaaaaaaacagggcgatttgtttggtttgctgcagtctcgtcatcttgt

SEQ ID NO: 6780655 - DNA, 75 bp, Homo sapiens
ttttcagggaagagagatctcctagtgttatccatacccagaaattattgagggatatcttcaattccctgaaaa

SEQ ID NO: 6780656 - DNA, 88 bp, Homo sapiens
cacattgcctcttggtcctagccagggctctgctgttcctggaggagcggctgtgggccagctagacccttgtccacagaggcgagtg

SEQ ID NO: 6780657 - DNA, 69 bp, Homo sapiens
ctgatatttctctatgggacatttttggctgccctcccaaaggtgtcattgtttatggagaatgatcag

SEQ ID NO: 6780658 - DNA, 65 bp, Homo sapiens
tcactcccctgccccgtgtcccttcatgcagaaacacgcatcagggcatgaagcagaggacgtgg

SEQ ID NO: 6780659 - DNA, 55 bp, Homo sapiens
atattccaatgtcagttatatcagtaacctgatctgaaaatgatgttgagaatat

SEQ ID NO: 6780660 - DNA, 93 bp, Homo sapiens
taagaggaggagattggaaggaggggcaaagcagttcatggggatccctggaactgagtccagctcatccaaagcttctatcttctgctttta

SEQ ID NO: 6780661 - DNA, 76 bp, Homo sapiens
gcattgtttcctctgatgggaatcccctagtgtttttcaaccaacaaatgcctatttgttccttcaggggcactgc

SEQ ID NO: 6780662 - DNA, 84 bp, Homo sapiens
ttgtggtaaacctctgaacatttttaagactctagtgtgtagagaacctttctttagaaattcagatctggtgggataccataa

SEQ ID NO: 6780663 - DNA, 109 bp, Homo sapiens
ttgagtgccagtactctgctcatagtagtgggaaatgggggcggaggtggggttgtgcttccactgtaaccattatcaccatatttttggtggagaaactggtgttcag

SEQ ID NO: 6780664 - DNA, 72 bp, Homo sapiens
ctgtggttttgtatatattgaagactccaatgtactggaggattggagtattcaatatatacaaatgtatgg

SEQ ID NO: 6780665 - DNA, 81 bp, Homo sapiens
gtcatcttgcatttcgcagatcctgtggttttcctgtgcatgatgcatgcccctcagggaacgggtatcttgcaaagagac

SEQ ID NO: 6780666 - DNA, 61 bp, Homo sapiens
accttactctttagtcttccttgttggttcacagtagggaatacattggggtaaattaggt

SEQ ID NO: 6780667 - DNA, 86 bp, Homo sapiens
agtagcaaaaactttagagatgttggacccatagagttagtggacaaacaagcactgtggtggaagcatcaagaagtttggccact

SEQ ID NO: 6780668 - DNA, 72 bp, Homo sapiens
ttcttgagggctaggacagttaggacaactgacttcttttaggaggtcaggctcaagctgggccctgaagaa

SEQ ID NO: 6780669 - DNA, 73 bp, Homo sapiens
aagtgaaggcttcaaaaggtgtaattgaaagagcatttttagcttcctaattactttattgaactttttactt

SEQ ID NO: 6780670 - DNA, 87 bp, Homo sapiens
actgtgtgggctgagagcagtgtttttaaccagtcttactatcctgaggggagtggtttaacctgtctcttattaactcatagcagt

SEQ ID NO: 6780671 - DNA, 90 bp, Homo sapiens
gttgggcctctcttctgcagtctccttactccgcatgtgcactggtggtgtatgcagagtgggagaggtgcgggctctctggggcccagc

SEQ ID NO: 6780672 - DNA, 57 bp, Homo sapiens
gtttgccttttagataggaatgctgaaaataatgagacacttctgtctggaggaaac

SEQ ID NO: 6780673 - DNA, 85 bp, Homo sapiens
cagctaccagttagccactttgggggtgagtttatcctacacagtttatccttgctctccccagagtgagggattgagtgggctg

SEQ ID NO: 6780674 - DNA, 82 bp, Homo sapiens
tgagcataacagtccacaggggcccacgagccgcttctgcgtcccaagccctcgtttctgcatcctgtcttcactctgctca

SEQ ID NO: 6780675 - DNA, 63 bp, Homo sapiens
cctagagggtggtgaggcctggttcacagatctgctgcgctgtgtaacccacagccctctggg

SEQ ID NO: 6780676 - DNA, 57 bp, Homo sapiens
tcagaacagtgcctggcactaagtaaccattcaacatatgctagttattgtttctga

SEQ ID NO: 6780677 - DNA, 130 bp, Homo sapiens
tgctgtgtccactcagggttaaatggattaagggcggtgcaagatgtgctttgttaaacagatgcttgaaggcagcatgctcgttaagagtcatcaccactccctaatctcaagtacctagggacacaaa

SEQ ID NO: 6780678 - DNA, 77 bp, Homo sapiens
ttttccagccaaagagaaagtatttgggttttgagcatctttttaactgagaacattcctcttcctggctatgaaaa

SEQ ID NO: 6780679 - DNA, 57 bp, Homo sapiens
tcctagtcacctgaatcatgcaaagaaattccgctttccaggagcacgggactagga

SEQ ID NO: 6780680 - DNA, 62 bp, Homo sapiens
tttcttgccagagaaaaagagttaaacaaaatcaatagccagagtttatttttggcaagaaa

SEQ ID NO: 6780681 - DNA, 61 bp, Homo sapiens
gcatattttcacaagctcttggtcttaggtatttgaaaattcaagggctaaagagaagtgc

SEQ ID NO: 6780682 - DNA, 65 bp, Homo sapiens
tgggcaatttatttggtcatcaatctttttatcctcctgacatttgatttctagatattggccca

SEQ ID NO: 6780683 - DNA, 58 bp, Homo sapiens
cagaatgatttgttaccgcattttcttcttggaaagaaatgcatgagaaagtattctg

SEQ ID NO: 6780684 - DNA, 61 bp, Homo sapiens
cgaaggcactgactgtgcaggggacggagttcgtttctcatcccccactctcagtgcctcg

SEQ ID NO: 6780685 - DNA, 62 bp, Homo sapiens
tgcatgtatgtgctcacatgtgtatacccatgtgtctatgcataggaatgtgcatatatgta

SEQ ID NO: 6780686 - DNA, 79 bp, Homo sapiens
ttggcagggtcagtttatcaatgatttttggatgttttaaaccacatgacacaaatgcagcataaagtgaacttgttaa

SEQ ID NO: 6780687 - DNA, 56 bp, Homo sapiens
ctgcctcaccacagctgtttctcttcgagaaatcttggagtctgtggtagaggcag

SEQ ID NO: 6780688 - DNA, 62 bp, Homo sapiens
gcctgatgcagggattcagggagcccttggaatctctctgctccctgtccctgcacttaggc

SEQ ID NO: 6780689 - DNA, 58 bp, Homo sapiens
ggggcgtggttgctggtggcctggagtgagctgcctgctgtggcctccagcactcccc

SEQ ID NO: 6780690 - DNA, 83 bp, Homo sapiens
ggggcagtgacttctccgtggcaggataattggaccctggagtccccacatctgtgcacaacggggaaggaacacacagcccc

SEQ ID NO: 6780691 - DNA, 83 bp, Homo sapiens
cctggtccaggccccattcacataatctgcagcaagcgtgtgaggaatgtgcatgagagtgtgaaggtttctggagtaccagg

SEQ ID NO: 6780692 - DNA, 80 bp, Homo sapiens
gtccagcctatagttgactttggcttaagcagcagttgttggaacaatctgttgtggccaagatcataaggtctcaggac

SEQ ID NO: 6780693 - DNA, 61 bp, Homo sapiens
gtcagccttgggaagaaacatgtccatcattgtttatgtggcatttcttcccagtgcagac

SEQ ID NO: 6780694 - DNA, 73 bp, Homo sapiens
ggaagagtaatagtttgaagaggtaagatctaaactgcagaggatcttaatcttcagggactcttgcttctct

SEQ ID NO: 6780695 - DNA, 74 bp, Homo sapiens
cagcccctccttgcagttgttcaaatgagccagatcctgtatgtcagggctcagggactgcagaaaggaggctg

SEQ ID NO: 6780696 - DNA, 82 bp, Homo sapiens
ggacattatttttagcctttatctcttagtggttttgttttctttccgccgccttttgacctgagagctggaaataaagtcc

SEQ ID NO: 6780697 - DNA, 120 bp, Homo sapiens
atactccattgaataggagtgtgggactaaactgctctgcatgcaatggaagggaatttaaaaatttttccttgatgaattggggaggcagggttttatgactcctaaaatgtggagtgt

SEQ ID NO: 6780698 - DNA, 58 bp, Homo sapiens
taggctttggaggattaaggggacatctacctgaaactgttagtctgacaaagaccta

SEQ ID NO: 6780699 - DNA, 60 bp, Homo sapiens
ggagggtcgatggagtggggtcaaaggggcatcatttgacggccttgctctgtgaccccc

SEQ ID NO: 6780700 - DNA, 73 bp, Homo sapiens
gaatatcatgctaaaatatctgaagattatgctataagcaaagtaaacacaggtgttttgtgtagttgtgttt

SEQ ID NO: 6780701 - DNA, 72 bp, Homo sapiens
ctgtgtataaatataatgctgttttatgccaaaaccgttggtgaaaagtcatgcaatgtaaaatatatacag

SEQ ID NO: 6780702 - DNA, 62 bp, Homo sapiens
ctctgacaggtggcattatctcattatccctatttttcagatgaggaacctggggctcagag

SEQ ID NO: 6780703 - DNA, 83 bp, Homo sapiens
ctaaattatgctaaagatttcaacatttgaaatgaatgaattacaatagtgatattactcataatgtgttgatagcatattag

SEQ ID NO: 6780704 - DNA, 57 bp, Homo sapiens
gccaggtcgtctccatgtccaaacgtcaagcacggggatgagtggggagaccctggc

SEQ ID NO: 6780705 - DNA, 71 bp, Homo sapiens
aataaagcatgaggcatttatcatttcatgagtcatcttgacataaaaggataaatgcctcatgctttatt

SEQ ID NO: 6780706 - DNA, 71 bp, Homo sapiens
gctccatgaattcttttaaatggcagtagtatttgactagtatagcaactccaaagagactttgttggagc

SEQ ID NO: 6780707 - DNA, 74 bp, Homo sapiens
gggtctccttgtaagtaaattttactatgacaaagccattgggatatttggagaaattattcataatgagatct

SEQ ID NO: 6780708 - DNA, 86 bp, Homo sapiens
tgcctaatatgggattagtgagaaagaaatccctagcactctgaaccctcagtgactactggatttgtttctcctgccctcaggta

SEQ ID NO: 6780709 - DNA, 71 bp, Homo sapiens
tctgtatgtttctcaacctgcattgaatttttagactaggtctggcaagttggtgggtttagtgcatcaga

SEQ ID NO: 6780710 - DNA, 62 bp, Homo sapiens
ggggatcatttaaaacaagtctctattttacaggtgaagaggaagatggttgagtggtcccc

SEQ ID NO: 6780711 - DNA, 114 bp, Homo sapiens
accttgtgtattagctttctagggctgctgtagaaaactgtcacaaacacggtgagtaaaacacagaaacttattgtcttacagtaatagaggctagaagtctgagatcaaggt

SEQ ID NO: 6780712 - DNA, 58 bp, Homo sapiens
gaatgtgtcaccctgtcccatgccacagcctgagacagtgtgcaggtgtttcatattc

SEQ ID NO: 6780713 - DNA, 64 bp, Homo sapiens
tgacctttctggctgggattgtaggattggtactcacaagatcttacagcagcaaggaagtaca

SEQ ID NO: 6780714 - DNA, 69 bp, Homo sapiens
cgtgaggtgtatgctcagtggacggactggagtggttttggaatggccctggctgagttagatttggcg

SEQ ID NO: 6780715 - DNA, 69 bp, Homo sapiens
acattctgtgagtcatgttttattactttagggccttttgtaaaatttctgagctgatttcacagaagt

SEQ ID NO: 6780716 - DNA, 66 bp, Homo sapiens
gggtcacactgcagccccctattaggactcgccatggcgtagtgatggggccctgcactgattccc

SEQ ID NO: 6780717 - DNA, 65 bp, Homo sapiens
ctggagttgttattgtaagaggtgactgcatattgccttgcattacactaatgtgacaacaatag

SEQ ID NO: 6780718 - DNA, 65 bp, Homo sapiens
ggtctgagtggactgtcctgcaggtaaagtacttctcttcctggtcaggttgtcacgctcttact

SEQ ID NO: 6780719 - DNA, 109 bp, Homo sapiens
agtgacttttcccactgaaggggacacagaggaaactatgattaggagtttccagacacctgtgttccagccatggtttccctatgtcctcgccttgggacccagcact

SEQ ID NO: 6780720 - DNA, 83 bp, Homo sapiens
ttaatccaataacaaggttcaaattgaaggactaacagctcaaaaataagtcatctatggatctcatcttgtttttggattaa

SEQ ID NO: 6780721 - DNA, 59 bp, Homo sapiens
ttgtgacagagatcacgtggcctttaagcctgagagatttactatgtgactcttcagaa

SEQ ID NO: 6780722 - DNA, 70 bp, Homo sapiens
ctgaagttttgtaactgggatttttcaatgtgtccacatggtcatatttaccttccagtaaaaacattag

SEQ ID NO: 6780723 - DNA, 69 bp, Homo sapiens
agttgggaagaatggaggtggttagaattattactatatttttttataccatcccccttcaaccaaact

SEQ ID NO: 6780724 - DNA, 62 bp, Homo sapiens
acactgtaaacatctcaagcacttggatagtctcttcaaatgttttattctgtatgcagtgt

SEQ ID NO: 6780725 - DNA, 62 bp, Homo sapiens
tgtctgcaccctgtgattgttttcatttttgaaagtctccaaagatcacagccttgtagaca

SEQ ID NO: 6780726 - DNA, 55 bp, Homo sapiens
acaccatgatgagtgatgtagctctcctgctgccagcttacctatcatcggctgt

SEQ ID NO: 6780727 - DNA, 84 bp, Homo sapiens
tgtgtttgccaggattctccactgtaaggttattattattttttgttattaatattttatagggagatattttggtagtatgta

SEQ ID NO: 6780728 - DNA, 70 bp, Homo sapiens
gctccctgagcctccagggcagcatggcagtgggcagcacgtgcggctcccatggccctggaggcagagc

SEQ ID NO: 6780729 - DNA, 61 bp, Homo sapiens
tgtatgcctttttctgttgtaaccagatctaattttttttaattaagagaaaaagcatgca

SEQ ID NO: 6780730 - DNA, 67 bp, Homo sapiens
tctctgtgggcatttataatctggtccagaaggctctcaagcctcctccaataaagctctataggga

SEQ ID NO: 6780731 - DNA, 102 bp, Homo sapiens
gttgatttggggtggagagttctgtagatatctattaggtctgcttggtgcagagctgagttcaattcttggatatccttgttaactttctgtctcgttgac

SEQ ID NO: 6780732 - DNA, 90 bp, Homo sapiens
ggactcctagaccaagacagagctgctttaacacactcagcattccatctgtcttaggttaaagctggtttattttggttttgcaggtcc

SEQ ID NO: 6780733 - DNA, 58 bp, Homo sapiens
gcaagtttgttttgagtgttaaataagataatcctttaaacatttagaatgtacttgc

SEQ ID NO: 6780734 - DNA, 66 bp, Homo sapiens
tgtaatcatttacaaactcagcattgtaaggcttaaaattctagcgaaggctgttgtaaagttgca

SEQ ID NO: 6780735 - DNA, 71 bp, Homo sapiens
cattccaacatacgagcagtttatagagaggcatttaaggcaattcaaatattctgctcgtcatgcaaatg

SEQ ID NO: 6780736 - DNA, 57 bp, Homo sapiens
ctgcctggctccatccttgagctctgggcaccacctagggtgagggagagcctgcag

SEQ ID NO: 6780737 - DNA, 62 bp, Homo sapiens
ggaatgggagcttggcagtgtcactagggagccacacttcctctgcctgtgagcttccatcc

SEQ ID NO: 6780738 - DNA, 82 bp, Homo sapiens
gactgatgttgctatgtgttagtaatggacttgctcactacaataattaaaacaagatgccattggcacaagtagcttcatc

SEQ ID NO: 6780739 - DNA, 130 bp, Homo sapiens
tacttactaggcttgggtattaagtttatattagatttattaaattatttgggaaacttttcacttacatattttggaacagtttgaataatttagataggattatatgatccttaatagtttagttaga

SEQ ID NO: 6780740 - DNA, 65 bp, Homo sapiens
gggttgggggaaggagcttggcgtgcctctccacgtagcagagctctgttcttatctccttgcct

SEQ ID NO: 6780741 - DNA, 70 bp, Homo sapiens
tcagcagtggcacatggaccttgtcagatgccctgcagtatgtcaagttacccgtggtgccacacgctga

SEQ ID NO: 6780742 - DNA, 57 bp, Homo sapiens
agctatctccttttctcaccctataatcacgggcatcaaagggaagtggagaaagct

SEQ ID NO: 6780743 - DNA, 88 bp, Homo sapiens
tgaaatatatttgacatctggaacaggaccttttctgtttcgctaaacaggaaattttgtgatctgttcttctttacttatgatttca

SEQ ID NO: 6780744 - DNA, 61 bp, Homo sapiens
ccagggcccagtataaggcccagtaggtacagaagagctattgggcctctggtgcctctgg

SEQ ID NO: 6780745 - DNA, 76 bp, Homo sapiens
gatgcagggtctccgtgtgacgaatgaggaggaaaaaggcaagacactctttctcacatgaatgactgagtaattc

SEQ ID NO: 6780746 - DNA, 97 bp, Homo sapiens
aagtattattttcaaggcccacaagttctattgtcactttattatgaggatgcctggaatggtccagtgacagataggcactgtggctcgaatgctt

SEQ ID NO: 6780747 - DNA, 76 bp, Homo sapiens
gggacatgtcctcagaagcctgcttagcttcttagccactagcaagaaggcagacttaccttctggggagatgcct

SEQ ID NO: 6780748 - DNA, 77 bp, Homo sapiens
agaaagcaggaagtttctggtgaggacgaggtgagagatcttacagcttttggctagccaagaaacaaaatgcttct

SEQ ID NO: 6780749 - DNA, 65 bp, Homo sapiens
ttacctgtgtcagtatatgagaaaaatgaatttaaaaaccctcagaatgtcactgacgcaggtaa

SEQ ID NO: 6780750 - DNA, 55 bp, Homo sapiens
cttctggaggcttgaggggagagtacatttctttgccttttccagtttctagggg

SEQ ID NO: 6780751 - DNA, 67 bp, Homo sapiens
tttttatgttagaaacacattcttattgattggacacagtcagaagctagtagtttttaaagagaaa

SEQ ID NO: 6780752 - DNA, 55 bp, Homo sapiens
ttccatgtgtacatatgtgtttatatgtttgcatgtgtgtatgtgcacatgcgaa

SEQ ID NO: 6780753 - DNA, 80 bp, Homo sapiens
gctcagtgtgttgttgattgaatttacttttcattctaatgaacttgagaacattaatagttaattttgccatgctgagt

SEQ ID NO: 6780754 - DNA, 129 bp, Homo sapiens
atggaagaagaggaattggaaatgagtaatgtgaagagggaaactaagtaccattctcactgttggagggctcagttggtcttggatatgtttgccttcatttttgctggtctaccttctcactttcat

SEQ ID NO: 6780755 - DNA, 78 bp, Homo sapiens
tccctgcctttcctgccccatctgcccagtctgccttgcagatgagggctggaggtgagcaggacaggatataaggga

SEQ ID NO: 6780756 - DNA, 70 bp, Homo sapiens
gttgattagttgattaagagtcagactgcctgggtttgatcctgactctgacacttattagctgtgtgac

SEQ ID NO: 6780757 - DNA, 66 bp, Homo sapiens
ggaatgatggagggtggtaagacagagagaggccacttcctttctttgcatcccttccatagttcc

SEQ ID NO: 6780758 - DNA, 88 bp, Homo sapiens
ggagcaagagttgccatggtttcctataactcaggcaccagctatctcatccgctggtctgactacaataggaagaagcagctcctcc

SEQ ID NO: 6780759 - DNA, 56 bp, Homo sapiens
tggtcatttctgggttctgaccatcatgtggaagatgatagagagtgaagtggcca

SEQ ID NO: 6780760 - DNA, 60 bp, Homo sapiens
tgttctcttgccagtattttatatgaagttgtatgacttggttaaatgggaagagcaaca

SEQ ID NO: 6780761 - DNA, 95 bp, Homo sapiens
ctatatggtggttgagaaatatgctattgctgtaatttaactcactgtatgtgggcttcaagatgcacagtggcattccaaaccaacttttaaag

SEQ ID NO: 6780762 - DNA, 93 bp, Homo sapiens
ggcggtccctcccaccatgggtgggttgagggctaaggtcttcactgggctcagccctagccttcggcctacccatcaggggagttcgctgcc

SEQ ID NO: 6780763 - DNA, 65 bp, Homo sapiens
actctactgctggacagtgaatgagtctttgtattccaggttcattcactgcccagcagtgtagt

SEQ ID NO: 6780764 - DNA, 78 bp, Homo sapiens
acaaacctctaaggtggccataggaccagcctgggctccaacacccagcccatgcacacctggccattgcaggtttgt

SEQ ID NO: 6780765 - DNA, 57 bp, Homo sapiens
ggccagagagccgctgttaggagtccggccgtgcaacccttcctagcggcctcggcc

SEQ ID NO: 6780766 - DNA, 129 bp, Homo sapiens
ctgtgtcacctgcagcagttcgtggttgcttagtagcaggtggctgcttgtcagcagctggcctctgagaaggaggcgctgcacaggcagttactgctgcagacctggctcatggaccagctgcagcag

SEQ ID NO: 6780767 - DNA, 73 bp, Homo sapiens
tcgctctaccttgggctgctgtctgcacatgctcgtaacgacacccccagcaggggcccagcggcacgggcga

SEQ ID NO: 6780768 - DNA, 69 bp, Homo sapiens
attgcaggtaccttgggttgagttcattctggcaccagtgagctttcaccccaaggaggcagaagcagt

SEQ ID NO: 6780769 - DNA, 78 bp, Homo sapiens
ggtttgggtaagtcagatttacaatgtcagccatcatctggccatgtttgaaagtctaggcttacagtaatgcaagct

SEQ ID NO: 6780770 - DNA, 123 bp, Homo sapiens
gccgcacggtgggagtttaaaagtgttgctccatcttggtcttcagtaagactgtgaggctcaatattatttttcaaaaattttctgaggatgaggacttggtaattactcacttgtagtggc

SEQ ID NO: 6780771 - DNA, 128 bp, Homo sapiens
ttgtttctccccatcaaacttgccttcccacagacatgctgctctggctggagcaatgacttggccatctatccaagcatatggcacagagcagctgccagggcagggtgggatggaggtgggggcag

SEQ ID NO: 6780772 - DNA, 66 bp, Homo sapiens
ggtccctgccctcctgggactcagagcttcaccttctcatctctgaggccacagtggggtgggacc

SEQ ID NO: 6780773 - DNA, 61 bp, Homo sapiens
tgctgtagccctgcacagtgcaagagagcaagcttgttggaatgtgctgggttactgggca

SEQ ID NO: 6780774 - DNA, 55 bp, Homo sapiens
gtgagccacctctgctccacacagcacagaattgtggcacagcaagtgggctcat

SEQ ID NO: 6780775 - DNA, 103 bp, Homo sapiens
ggtcgctaaagcccttcccacagactaggcacttgtaaggccgctcgcccgtgtgtgtgcgctggtgcttggtcaagtgggacgtcttgctgaagcctttgcc

SEQ ID NO: 6780776 - DNA, 62 bp, Homo sapiens
cctgccaactgtagatgggaaccatagttcctaaaattacctaccagtttagttgcggcagg

SEQ ID NO: 6780777 - DNA, 75 bp, Homo sapiens
tcagtcctccctcattttttctcttgacactgtctctagagtggcatggggtgtatgtggcacggaggaagctgg

SEQ ID NO: 6780778 - DNA, 80 bp, Homo sapiens
atatctctggcattgatgggtgtggttgctctactaattcctagggcagggcagcgctgattagggtttgccagacttgt

SEQ ID NO: 6780779 - DNA, 69 bp, Homo sapiens
agctattctctctgtgtctcatgttcctatttcgtaaaataggtgcatcagcacagggtcaaaatacct

SEQ ID NO: 6780780 - DNA, 101 bp, Homo sapiens
tgaggcaagggaatcgcttgaacccaggaggtggagattgcagtgagccgagatcccgccactgcactccagcctgggcgacagagtgaggctccatctca

SEQ ID NO: 6780781 - DNA, 57 bp, Homo sapiens
ctaagtgtttaatggttttgatgagtcaatttgactagtcaactagtgagcatatgg

SEQ ID NO: 6780782 - DNA, 55 bp, Homo sapiens
tgtatttcaattttagcaccaatttatttattggttgctgctactttggaaggca

SEQ ID NO: 6780783 - DNA, 69 bp, Homo sapiens
ctgtcctggggaaagccagccctgcttcctctcccaggtgggggctctgggcctggctgcgcaggacgg

SEQ ID NO: 6780784 - DNA, 57 bp, Homo sapiens
ctactgggagaaactgacaccttagatactgcatttgggagagagaattcccagtgg

SEQ ID NO: 6780785 - DNA, 58 bp, Homo sapiens
gtggaaataacactagggatgaagccaattgagctccttcttagtaactatcttccac

SEQ ID NO: 6780786 - DNA, 55 bp, Homo sapiens
taggctggagcttcggtgtgtgcttttgctatacagcttacagttctaatgcctg

SEQ ID NO: 6780787 - DNA, 82 bp, Homo sapiens
tctggctctctctttaaagactgttgttattgaattttgatcaccaacagtggtagcaaggacaacatatgagagagataga

SEQ ID NO: 6780788 - DNA, 69 bp, Homo sapiens
gtcagcacttgtcagcggtggcggggcaggacgaggagcctgctcaggccagccggacagagagagggc

SEQ ID NO: 6780789 - DNA, 116 bp, Homo sapiens
tgcattttctttgttttaattgaagcccagtaccttcagtgagggagatgatggctccaacttattaagaatgggcctgctcaattaccactcaatacacggacaaactgaaagca

SEQ ID NO: 6780790 - DNA, 102 bp, Homo sapiens
gagagcacacacagaatggatgggcatgtgtggaagttcagggatctttgttttgttcactggcatttcctcagtgctcagaatagtgcatggtgggctctc

SEQ ID NO: 6780791 - DNA, 62 bp, Homo sapiens
atttacagaaacttaatcatagcagaaatatgcaaaatgctgtttgttgagtacttgtgaat

SEQ ID NO: 6780792 - DNA, 65 bp, Homo sapiens
ctctactcgatgtgtccacttggctgtctaattggtgtcccaaagttaacacatccagaatagag

SEQ ID NO: 6780793 - DNA, 77 bp, Homo sapiens
gccaaacttttgactactgatggtgtacgcgtgccctggcagggatggccattgtgctgtcagtatcaagggatggc

SEQ ID NO: 6780794 - DNA, 55 bp, Homo sapiens
ttagatgtttatatacagatttactgaaagggaggtctgataaattaatatctga

SEQ ID NO: 6780795 - DNA, 56 bp, Homo sapiens
agctgtgtgtttgtcatgggcgtagacagctcaggacagcacagaacagcacagct

SEQ ID NO: 6780796 - DNA, 91 bp, Homo sapiens
atggtagtacaggaactgttatctcagatgttgaagaagatgctggggaaatgagcagagacagtatctgggaactttcctgtgaaactgt

SEQ ID NO: 6780797 - DNA, 66 bp, Homo sapiens
atgccacaggtgccatctcttcatggaatattggcaagggtctagaagagcaggcatttggaaaat

SEQ ID NO: 6780798 - DNA, 56 bp, Homo sapiens
gggaaggtgatgctttagtgacctcatgcaggtgtctttcagtcatggcttctccc

SEQ ID NO: 6780799 - DNA, 93 bp, Homo sapiens
ttactatggcaaatagctgacagatacaatcagatttggaatttagatagatttgtttgtacactgtgtagagaatggattggaacatggtaa

SEQ ID NO: 6780800 - DNA, 65 bp, Homo sapiens
gttggccctccgagggtcagcccgtggcccccgttttcctctggcttggccctcaagggccctgc

SEQ ID NO: 6780801 - DNA, 66 bp, Homo sapiens
ggaaagcaggcattccagagacaattgcttaaaatgcaatacttttggcctggaatgttgtactcc

SEQ ID NO: 6780802 - DNA, 81 bp, Homo sapiens
ctcaggtgcagccaggagctccccctgctccagagctggcagaaggactggggctccggggctgcagcccgttcttctgag

SEQ ID NO: 6780803 - DNA, 65 bp, Homo sapiens
tgtctggcctcaaaagccatttgtaaagctaacaaacaaatcacaaggcaaattgaggccagtca

SEQ ID NO: 6780804 - DNA, 69 bp, Homo sapiens
tttgcagacttttgacattaatacagctgagtttaaggatccacttcagctgctgtcagatatttcaaa

SEQ ID NO: 6780805 - DNA, 70 bp, Homo sapiens
accagcatccttcctattaacagccacaaaatgaacttatctgtgcaatagagagtggggcaggatgggt

SEQ ID NO: 6780806 - DNA, 85 bp, Homo sapiens
atattaatggtcaaaatttaattatgttttattgatttgattgatcttaatttatatcagacagaaagcattgacccgtgaatat

SEQ ID NO: 6780807 - DNA, 82 bp, Homo sapiens
gctgtgtactgcacaactccaggagaggcgcgtaatccagactgtgatatgaatgatgcagcctggagtcatgcaacatggc

SEQ ID NO: 6780808 - DNA, 97 bp, Homo sapiens
agggaaagtgttaaaattaggtctgggttttagactggcgagttttaagtgtaaacatgttgattagagagcttagagtctaacccacgctgtccct

SEQ ID NO: 6780809 - DNA, 115 bp, Homo sapiens
gtttactgctaaaattcctaaaacagagctgagtatcccactgaagtcccaaaatatgactgcctgatgtggacttaaagggaaacttgagttgtgagaaatcttatttatgaac

SEQ ID NO: 6780810 - DNA, 55 bp, Homo sapiens
cagcccaggactgcaggtgttttaagcattttacttcacttgcccacttgggctg

SEQ ID NO: 6780811 - DNA, 65 bp, Homo sapiens
taaaccatgcagacagctccatgcagctcactcagcctgcacatatgagctggtgcagtggtttg

SEQ ID NO: 6780812 - DNA, 62 bp, Homo sapiens
ttcactgaggattcccatacttgcaaggtaagtccaaaattgcaaaatgagtcttgagtgaa

SEQ ID NO: 6780813 - DNA, 66 bp, Homo sapiens
tgtaaagttttattgttccttctataactagtgaatatcttggaggagatactttgaaactctgca

SEQ ID NO: 6780814 - DNA, 81 bp, Homo sapiens
tcagaaattcgcttcagcactgtctattagtgagaactggaagtggttttcactaaatatgctgataactatgctttttga

SEQ ID NO: 6780815 - DNA, 97 bp, Homo sapiens
taggggtcacatcaccaaatatgagaatattgttttaggccccgcaatgctttctcagctgtgtggtgtctgacagctcacccaggttgcgccccta

SEQ ID NO: 6780816 - DNA, 65 bp, Homo sapiens
caaagtatagtgtaggatggcaaaatagtcatgtacatttatttaaatattttgcatttactttg

SEQ ID NO: 6780817 - DNA, 55 bp, Homo sapiens
atgcaatatatgacaatggagcaaagctccactgtacttacgcatatacaggcat

SEQ ID NO: 6780818 - DNA, 66 bp, Homo sapiens
gtctctagccaaagcacaatccattgaatattatttattgtttattagagatatttggttagggac

SEQ ID NO: 6780819 - DNA, 56 bp, Homo sapiens
cactgggaatctgggaaagagatcccagcaccagcctctctcgtaggatcccagtg

SEQ ID NO: 6780820 - DNA, 110 bp, Homo sapiens
atggaaagaatactagacaaagagttaggtgacttcagttcaatcagatcgtgattactcactctgtgacattgaacatctacacactccaggcttcagttttctcacat

SEQ ID NO: 6780821 - DNA, 97 bp, Homo sapiens
atgagttttgttatattggttccaatatttctcatatatggaaaatgtcattttccctgggaattaatatttggaactggtgtttaagaaaaaccat

SEQ ID NO: 6780822 - DNA, 93 bp, Homo sapiens
agcagacactgatgcaggtggtttaaaaacaaagcatttaatcaggcagggttttacttaaactacttgatgattcatcatccagcctctgct

SEQ ID NO: 6780823 - DNA, 104 bp, Homo sapiens
atttaacaaactatattttatagaacacttattttactcaattccgatggttagtttattgaggagtgtttagggtgaggtttcatgagcaaagtttgggaaat

SEQ ID NO: 6780824 - DNA, 80 bp, Homo sapiens
ccattacaaatgatccttggctattaaaaatgggtgattggttcaggcggtttaagggtggaggaacaaatgcgtgatgg

SEQ ID NO: 6780825 - DNA, 57 bp, Homo sapiens
ccagggtggaggctggatggaggtatctactcgtggcccgcattgcctctgccctgg

SEQ ID NO: 6780826 - DNA, 81 bp, Homo sapiens
tgattttcatttttcttgtctgtgaaatggaaatagtaatgaaaatactaatctctgctttatgatgtattgtgagaatta

SEQ ID NO: 6780827 - DNA, 84 bp, Homo sapiens
ttcaatttattagcaagtcctgtcacctctactttcgaaatcagattatattttgagtctaacaggacttgctggtaagttgga

SEQ ID NO: 6780828 - DNA, 69 bp, Homo sapiens
agctgtttaatatgcttacctgcatgctacatatgttcttgtgtgtgcatcaaacccatttaaatagtt

SEQ ID NO: 6780829 - DNA, 64 bp, Homo sapiens
ggttatagtcagggatgcaattatgtgtgggctatacatgattttgtcatctgaattcttagcc

SEQ ID NO: 6780830 - DNA, 67 bp, Homo sapiens
aatactgcccccactctgcccagatcccctcaggaccttcactgggaagagtgtcggttgaagtgtt

SEQ ID NO: 6780831 - DNA, 62 bp, Homo sapiens
ctttctcctcttattcatccctctctcttgctaatgatcaagttggaagtaggaagaggaag

SEQ ID NO: 6780832 - DNA, 55 bp, Homo sapiens
gtctttctcttctctctgatggagcaaatagagtcatctgctgagaatgaaaggc

SEQ ID NO: 6780833 - DNA, 73 bp, Homo sapiens
aattatactaaactgttcatcagcatctctgccctacctcagagggaggatagtagtcagtttagttataatt

SEQ ID NO: 6780834 - DNA, 67 bp, Homo sapiens
gatcaaacattgaatttcagtgctgtgatagaaaatccttttacacgtgcaaattcaatgtatgttt

SEQ ID NO: 6780835 - DNA, 59 bp, Homo sapiens
ctgtatttctaggatgatggctacttaaaatggggtggctcaccttcagaatataccag

SEQ ID NO: 6780836 - DNA, 55 bp, Homo sapiens
gaggtaggctgtgaaagggggtgggaacacaccttctggaaccactgtcttcctt

SEQ ID NO: 6780837 - DNA, 83 bp, Homo sapiens
gcctctgggtctctgcagggcttaccttgctctgaaaaaccatttgccagcagcgtaggtgactctgaacaggccggggaggc

SEQ ID NO: 6780838 - DNA, 58 bp, Homo sapiens
ccccagcacttggagtggggagacacaagctggcagctccctaagccagatgctgggg

SEQ ID NO: 6780839 - DNA, 62 bp, Homo sapiens
gactacccagggcaaatgtcttcccttcccttcctgaagccacaggaaagcaccctggagtc

SEQ ID NO: 6780840 - DNA, 107 bp, Homo sapiens
gtgtctgtttcacaaacaaggaaatctgccaaaatcatgccaaaaaatttctctgtttcaggcctgcaaatgaatggtagaatctatgtgtgtgtgtatatagatat

SEQ ID NO: 6780841 - DNA, 88 bp, Homo sapiens
tgccagctccttgggcaaaccttataacctgagagtgtctgggttgccagactctgcagaatcagattgcctaagtgaagggagggca

SEQ ID NO: 6780842 - DNA, 68 bp, Homo sapiens
gagagcactgagaatattggctggcacacaataagtattgtgtgttttctattattctcaaaactctt

SEQ ID NO: 6780843 - DNA, 58 bp, Homo sapiens
tggcaagtggcttgtatacgccatgtggcttgtatttgaggtccaacccacttagtta

SEQ ID NO: 6780844 - DNA, 81 bp, Homo sapiens
attggaagggaacaccatttgaccttgtaagcatggctatacttattattggaagtgcatggcaaagtgtgtccttccagt

SEQ ID NO: 6780845 - DNA, 55 bp, Homo sapiens
aactgatagattcatgtaactgttcagctcatcgaacatggatcaaatgtcagtt

SEQ ID NO: 6780846 - DNA, 74 bp, Homo sapiens
tctgtaggctggaagtccaagatcaaggtgccagcatgtttggtgtcttctgagacttctctttggtttgcaga

SEQ ID NO: 6780847 - DNA, 72 bp, Homo sapiens
gtaagatctacaggatagtttaatattgaggaatagagattttaaatgttctaaaggtcctgaaggatttac

SEQ ID NO: 6780848 - DNA, 65 bp, Homo sapiens
attccaagtatacatgttttacataagtgatttatagataagtgacttgtatatgtgactgggat

SEQ ID NO: 6780849 - DNA, 64 bp, Homo sapiens
aaaaggttcttttcaatggttgtaaaatatttcaaggtatggctataggtagaaggaatctttt

SEQ ID NO: 6780850 - DNA, 55 bp, Homo sapiens
atatctttgtttttgccaagatgccaaattccaagctctataagagcaaagatgt

SEQ ID NO: 6780851 - DNA, 77 bp, Homo sapiens
tctgctgctggcatgaatacctgaaaatcctgggactgtgggatgtggtccaggctctcaggtgtcagcatcgcagg

SEQ ID NO: 6780852 - DNA, 88 bp, Homo sapiens
ggaaacgcaggcgcagaaggccaggggcctggagggctaactccagcctcagccccccatagtgccccaggccttctggcttcattcc

SEQ ID NO: 6780853 - DNA, 74 bp, Homo sapiens
gctagcaatttgtctaccattggaaaagtaattgacatttgggttactgcttcatatatgggagacttgctagc

SEQ ID NO: 6780854 - DNA, 64 bp, Homo sapiens
agatgaatgttacaggacctaagatgaaaaaaatttgctggatggatctgtgacagtttagtct

SEQ ID NO: 6780855 - DNA, 60 bp, Homo sapiens
atgagtccacattattatatgtctgtgactgaaattacagaattctagtatgtggcttat

SEQ ID NO: 6780856 - DNA, 85 bp, Homo sapiens
aagttagcctgttaagctttaagtgtcagtcagccaggatttagcttggctggttggtggttgtggcattggcacctgttaattt

SEQ ID NO: 6780857 - DNA, 69 bp, Homo sapiens
tctttgtcttcactgattaaccaaatgccaatggcccagcagctttctttaacagttgaagaacaagga

SEQ ID NO: 6780858 - DNA, 63 bp, Homo sapiens
gagacaggccaggtggtacttaactgactaagtccagttcaagttcaagtcacagcctgtctt

SEQ ID NO: 6780859 - DNA, 62 bp, Homo sapiens
ggtttcaaatcttttgagttattttaaatcatgtaatacatggagctgcaaaaggtggaact

SEQ ID NO: 6780860 - DNA, 58 bp, Homo sapiens
cggtacactagctattaacttcacatggctattgcacactggaagtgtggctagtctg

SEQ ID NO: 6780861 - DNA, 68 bp, Homo sapiens
gtgcccccaaagtaactgcctttccaatttgttcctaattcaaactggaaaggcagttatttctgcat

SEQ ID NO: 6780862 - DNA, 68 bp, Homo sapiens
gtgctgaggatacagctgtgaacaagagagacaagggctctgcattcacagagagtatattctagtac

SEQ ID NO: 6780863 - DNA, 61 bp, Homo sapiens
tgagagtgggctgagcttgctgggtgttcagcctgagcactaagtcaacagcctctcttca

SEQ ID NO: 6780864 - DNA, 56 bp, Homo sapiens
ataacattttctttgctgtgtgcgttacacactgcacagtgaatttcaagtgttgt

SEQ ID NO: 6780865 - DNA, 64 bp, Homo sapiens
ggaaggatgtgtcactctcaggaggttgtaagtcattgggacgcctccagggatgattccttcc

SEQ ID NO: 6780866 - DNA, 78 bp, Homo sapiens
gcatcctctgagcctgtgtttctctggcaggtggatcaattacttccacatgtcttggaaggcaggctttccacatgt

SEQ ID NO: 6780867 - DNA, 88 bp, Homo sapiens
agagatggaggggaggggacactggggactctggccttttgacaggacatgtgtcaaaatgccgagtgcccaggtcgatcagatttct

SEQ ID NO: 6780868 - DNA, 79 bp, Homo sapiens
ccagtcaatgtctattttacagcatacattatttaacaaaaaatagtagtgaaattgctgtaagaggaaatgcagatgg

SEQ ID NO: 6780869 - DNA, 56 bp, Homo sapiens
gtgagctgtcaggtgtgcctagaatgtaagcattgctggagtcatgggacactcac

SEQ ID NO: 6780870 - DNA, 72 bp, Homo sapiens
ttttaaggaaatatcacaacatggtattaaattgtggaagaagttgctcatactcatgttgtgattttgaag

SEQ ID NO: 6780871 - DNA, 97 bp, Homo sapiens
ggtttcctgagtattttcacatgttacagtcctttgtattgtttaatcctcactttaactctcagagacagggactgtcataattgccaaggaagcc

SEQ ID NO: 6780872 - DNA, 69 bp, Homo sapiens
cctgagagattctgatttcattgggctgggtgatacccaggcagtgttatttttcagaaattctccagg

SEQ ID NO: 6780873 - DNA, 58 bp, Homo sapiens
tatgttgtgatcattatcttgatgacaaacatttcgtcccaagatttgttcacacatg

SEQ ID NO: 6780874 - DNA, 78 bp, Homo sapiens
gtaggagaggtgagaggtacaagttcaattcaaatcaacaagtaacttttgagcaggtgtatcggtcacctacaatat

SEQ ID NO: 6780875 - DNA, 69 bp, Homo sapiens
catacatcatgaaagcatacatcatgaaatatttgtgagacagagttgatgctgctttcttgaagtatg

SEQ ID NO: 6780876 - DNA, 73 bp, Homo sapiens
caaccctagttggctgttactatgttcttaattacgaaaagtaatgaagatggttcaactggcctttgggttg

SEQ ID NO: 6780877 - DNA, 129 bp, Homo sapiens
tggcagcctaatattttgttatgctttatacaggtaggaaggagactaggctgattgaagagattcattataatatagtttcagctccttcatcctgtctgatggggaaaagtgaagaagaatctgcta

SEQ ID NO: 6780878 - DNA, 84 bp, Homo sapiens
ggtagagtgtgtctatggaaggggttgtcatggtaacagcttctgttggcttctagccctaccttttctggacacattcatgct

SEQ ID NO: 6780879 - DNA, 118 bp, Homo sapiens
tcttgctgctgctcactctttgggtccacactgtctttatgagctgtaagactcaccgtgaaggtctgcagcttcactcctgaagccagccaagaccacgaacccaccagaaggaaga

SEQ ID NO: 6780880 - DNA, 56 bp, Homo sapiens
gatagcaggacttctgttggaacagctgtttgttgatccagctgacattctctttc

SEQ ID NO: 6780881 - DNA, 56 bp, Homo sapiens
caccagggtacaatttcgcagattcttgcttctgagctctaaatagtacccttgtg

SEQ ID NO: 6780882 - DNA, 63 bp, Homo sapiens
gcagctgctcacattctcacaactcaactgttcaaaactctgttgttgaatgaaggaggttgt

SEQ ID NO: 6780883 - DNA, 88 bp, Homo sapiens
ttctgtgttttcccattgggtcttaatttgaaaacttctgccataaactcttattttcagaggaagccttggtgggagtaatacagaa

SEQ ID NO: 6780884 - DNA, 60 bp, Homo sapiens
gggaaatctggggcagtctgattatttcctattggcaaatcctgctgctgtggacttctc

SEQ ID NO: 6780885 - DNA, 56 bp, Homo sapiens
tcgggacggtggcatttgtgccccctgggaaggggatgagcactgctgcctcctgg

SEQ ID NO: 6780886 - DNA, 55 bp, Homo sapiens
ctcaggctgcaagaaaggcattcagcttaagcaaagctgaaattgcatccatgag

SEQ ID NO: 6780887 - DNA, 87 bp, Homo sapiens
tggctttgggggcagtggtttccctcctcatgttttattttcaactcttggggaaggatcaccacaatcttttgtgctacaaagtta

SEQ ID NO: 6780888 - DNA, 94 bp, Homo sapiens
cttccccaagcctccttctctacatgatgctcatcctttcttactcaaaggtgtggaattgatgaggcacattagagagatggctactgagaag

SEQ ID NO: 6780889 - DNA, 77 bp, Homo sapiens
ttcctgatgtaattattctaaatcctcttagaggcaaatggatgcttctggcagattgagtgagtatatacttggaa

SEQ ID NO: 6780890 - DNA, 79 bp, Homo sapiens
gaacaccagccttcaaggcttagctcagaagtaacacttgtcacatttggtagtttataggccatggaggctcatgttt

SEQ ID NO: 6780891 - DNA, 64 bp, Homo sapiens
ttattaacatgttctgttggtttttgaggaatagtctccgaaaaagtcattggaatattaatga

SEQ ID NO: 6780892 - DNA, 83 bp, Homo sapiens
gtgtaaaaacttgtcacttgctgaaatcatgggaaataattttcctaagatagaagatagtgaaaattatgagtaatttacac

SEQ ID NO: 6780893 - DNA, 105 bp, Homo sapiens
aacattattattacttaacagcttttatgggaccagccattcctgagattaaatgagaaactaaagtgagtccctggttagaaggttgtgatctaatacattgct

SEQ ID NO: 6780894 - DNA, 61 bp, Homo sapiens
acactgagcatctctagaggcacattaaggaacagtgtttattaatgagatgtctttgtgt

SEQ ID NO: 6780895 - DNA, 60 bp, Homo sapiens
tctcagggagttgaggctgcctgaaaacgccttgcaggtggcctcagccaacccatgggg

SEQ ID NO: 6780896 - DNA, 129 bp, Homo sapiens
cagatccgataccgcaaggaccgtgtggtggcgcgacgtgccccctgcttcccgacggtgaccagcctccaggacctggccagtggggccgcgctggccgccaccatccactgctattgtccccagctg

SEQ ID NO: 6780897 - DNA, 84 bp, Homo sapiens
gtcagaaggagtgagccgtcaggacttagaactcgtaacagggggaaacctctaggggtcttgttggcatcacgttttgcagac

SEQ ID NO: 6780898 - DNA, 55 bp, Homo sapiens
gcatgtgtgagaccttttagcattatcaaagattttgtggagtctgcatatgtgc

SEQ ID NO: 6780899 - DNA, 90 bp, Homo sapiens
actggacactctggggcaaataattctctgctctgggggctgtaggatgtttcatagcacccctggacggtagggccaccagatgccagt

SEQ ID NO: 6780900 - DNA, 55 bp, Homo sapiens
tcttaagtgcccagaaaccaaatgtctacgtgcagatgacactgaggccttagga

SEQ ID NO: 6780901 - DNA, 105 bp, Homo sapiens
caagttctgtcaatgggatttttaaaaagtattttcaaaccaccagagaggcagcctggtgttgcggaaaacactttgatctgaaagtgttgattcaaggacttg

SEQ ID NO: 6780902 - DNA, 109 bp, Homo sapiens
gcttttcttatgaggagtggtacttagtgggaaggacactggactggaagtcaagagattttagacaagatccttctgaattgtaatttccattcctctaaaataaagc

SEQ ID NO: 6780903 - DNA, 83 bp, Homo sapiens
ggttcaaggccctgttcaagtgttacctctcctgtgaagctcccttccctggggaaggtgacctttcgctgccttctgactcc

SEQ ID NO: 6780904 - DNA, 71 bp, Homo sapiens
gctcatattcctggctagttttgctgaaataattgctttgaattacttcctcaggactgcccaggtgacgc

SEQ ID NO: 6780905 - DNA, 67 bp, Homo sapiens
ccaagattttatctccgtttctgtaattctccctaaagatttagagatggcagattgaatcaaatgg

SEQ ID NO: 6780906 - DNA, 121 bp, Homo sapiens
tgaggagaaaatgagagtacagaatggtatatgccagaagccaaaaaatattctctgtaaaggaccaaacagtaaatatttcaggcttcttgggccagatggcctctgttgtaactcctca

SEQ ID NO: 6780907 - DNA, 80 bp, Homo sapiens
cgcggcctctgcttctctgcccatgagcaatctgcgggaaagacctgatgagcccggctcggcggggagggcgggccgcg

SEQ ID NO: 6780908 - DNA, 61 bp, Homo sapiens
gaaactaagactaatgaagaactagtgttcgtttttctaggactgcattcttcttagtctc

SEQ ID NO: 6780909 - DNA, 71 bp, Homo sapiens
tactaatacataatatctccgattacttgcaggttgttctctcctgacaggcgttggggtgttggttagtg

SEQ ID NO: 6780910 - DNA, 62 bp, Homo sapiens
ctggcttcctgagtccattacctcttgttggatgagatggaggagatggagcggcaggccag

SEQ ID NO: 6780911 - DNA, 73 bp, Homo sapiens
ccaccaaggtggctatatttgaggatacgtcctgtgaggaggtgataagtgttaaataaagtcataagggtgg

SEQ ID NO: 6780912 - DNA, 77 bp, Homo sapiens
gtaaatgagtcaaatgggggaagaccatgaggcacactgggaaatctgccttttcagtccctcgtttcttcagctgc

SEQ ID NO: 6780913 - DNA, 60 bp, Homo sapiens
ggagccagaaatgctgtggttggggcatttcatcaaccaaatcacagttgttctgccttc

SEQ ID NO: 6780914 - DNA, 61 bp, Homo sapiens
gattcctttgtttataagtactgtgcttgcatagtttaataaaacagtaaagaaaggaatt

SEQ ID NO: 6780915 - DNA, 59 bp, Homo sapiens
cagcacagtcctttgcttactgaaagtcaaggcttctggaaaagccgaggctgaagctg

SEQ ID NO: 6780916 - DNA, 75 bp, Homo sapiens
gtcacttaataatttgttccacacatatttactggatacctactaggtttatgtttggtgcaggaggaagtagac

SEQ ID NO: 6780917 - DNA, 56 bp, Homo sapiens
tttagcctgtcaaattggagcctagcctcccctggcctcagtgatgatgggttaaa

SEQ ID NO: 6780918 - DNA, 64 bp, Homo sapiens
actgcattaggctaatgcagtggtccaggtaaagaaaactgggcttggagtaggctgatgaagt

SEQ ID NO: 6780919 - DNA, 57 bp, Homo sapiens
gcaggcctcctgtggagcataaaggatcttttctatgaaacgttgcaggagggctgc

SEQ ID NO: 6780920 - DNA, 73 bp, Homo sapiens
gctttagtagtacacattagtcaagagtttgaaccaagttcagccatttgttaactatgtgttcttgggaagc

SEQ ID NO: 6780921 - DNA, 63 bp, Homo sapiens
ggtttctaagctgttggagatccttaccacacaggatctccagtatcctagtattgtgaaatc

SEQ ID NO: 6780922 - DNA, 58 bp, Homo sapiens
gggaggagacagtaaaaagcacgcaaacacagtgtgttcagaatttgctgctttgacc

SEQ ID NO: 6780923 - DNA, 73 bp, Homo sapiens
gagactcataatagctgctcactaaaaagtttatggatgactgcatgggagttagttatactgtgacaatttc

SEQ ID NO: 6780924 - DNA, 78 bp, Homo sapiens
ccacgagaaccaggagggaccctggtggccgcaggagttcaggcccaggaacaggtcccaggctccctcttgtcctgg

SEQ ID NO: 6780925 - DNA, 59 bp, Homo sapiens
ggtctgggcttgagtccttttgggatgaatataaacagaaggaactttagaacatggcc

SEQ ID NO: 6780926 - DNA, 122 bp, Homo sapiens
tctgttgtaggcccctctgctgttggtgatgaagggcctgttgggcattgagactcctgagaacacaggcaacttcaaatctcacttaggcattggttttcctcacaatggcttcaatcaga

SEQ ID NO: 6780927 - DNA, 71 bp, Homo sapiens
ttaatttatctgattacttctgtaatgaccttatttccaaataggtcacattctgaggtattaggggttag

SEQ ID NO: 6780928 - DNA, 79 bp, Homo sapiens
agaagagaaaattaagtgtctgggaagcctccagattagcaataaagatgtggcttcttagaatttgacttactctact

SEQ ID NO: 6780929 - DNA, 56 bp, Homo sapiens
agaggccagcccaggccaccgagcctgcatcctacctcgtgcctgggtctccctct

SEQ ID NO: 6780930 - DNA, 74 bp, Homo sapiens
ggtcatgtgtcagtgtatgttaaactttataagcaagtgcataactgtaaaagttatatagatgacacatggct

SEQ ID NO: 6780931 - DNA, 63 bp, Homo sapiens
tcaggacaacatgttgctaatctgagcaaaaagttcatttaccaagtagcaatgttcttgtga

SEQ ID NO: 6780932 - DNA, 79 bp, Homo sapiens
tattttatatgcttctgaagatcttgcatagctttccttgttaatcatttgcagtgtttttcagggcatattgcaaata

SEQ ID NO: 6780933 - DNA, 70 bp, Homo sapiens
atcacccaagctggagtgcagtggcaccatcatagctcactgcagcctcaaactccccagctcgggtgat

SEQ ID NO: 6780934 - DNA, 67 bp, Homo sapiens
tagtcataattttgatgtttgtcagtttactattttctttcttactgaaagcatttacttgtgattg

SEQ ID NO: 6780935 - DNA, 67 bp, Homo sapiens
cttggcctgacatgtggcagggttagaacacacctcctatcccctgccagcccgcgttcatgccaag

SEQ ID NO: 6780936 - DNA, 80 bp, Homo sapiens
cagtcaatcagaacagaagctggctataaacagtgagtatatcacacagttgtatcagctgctaagttctactaagactg

SEQ ID NO: 6780937 - DNA, 57 bp, Homo sapiens
ctgcggcctgaggcttgaaagagaaaagccctcctctgggcctcaagtgggtggcag

SEQ ID NO: 6780938 - DNA, 58 bp, Homo sapiens
ttgttcttccatcatccctcagcctgcagagaacagagcctgatggtgggagtgacag

SEQ ID NO: 6780939 - DNA, 84 bp, Homo sapiens
aagagctgaaatcattggatgagtctgagattgggcatcaagagatctcactctttcacttaccagcagtgttgaaagctactt

SEQ ID NO: 6780940 - DNA, 63 bp, Homo sapiens
ctgagattgggggtcaggctcaggtcagaccaggagtctgtgcctgagccctctccatctcag

SEQ ID NO: 6780941 - DNA, 66 bp, Homo sapiens
tcagttgctcaatgtggctgtggagctgcagaagcaatcacgctgctttcacagtgagctcactga

SEQ ID NO: 6780942 - DNA, 69 bp, Homo sapiens
aatggaggtacataatgatggtgatgagtcatgaagaaaacgactacattatgtgctgtgtcctctgtt

SEQ ID NO: 6780943 - DNA, 63 bp, Homo sapiens
tggaaggtgtcagcaagtcaaagccttcacatatctgtggctttttattactgacaactaaca

SEQ ID NO: 6780944 - DNA, 102 bp, Homo sapiens
gctggttgggaagaaaacaacacagggatatttcaggtggtgccgcacaacaaacagcggtagtttatggtctgagatagtctctgttcttttggaaccggt

SEQ ID NO: 6780945 - DNA, 67 bp, Homo sapiens
ttgctgagtcatgcagtgtgtatctacttaattgaactcaattaagtgaaccagctgtactctacag

SEQ ID NO: 6780946 - DNA, 75 bp, Homo sapiens
tccattcttctgtatctctgtgtttcttgatctaattctgggaatccaggatccacatgagactggagaggggga

SEQ ID NO: 6780947 - DNA, 68 bp, Homo sapiens
ctgcgtttccaggccagaatggtcacatgctcacagagcatgtttatcatgtgtcctgtggttggcag

SEQ ID NO: 6780948 - DNA, 74 bp, Homo sapiens
tattttgtgtgaggaacaggactagagcactaatttacttagtcttttatgtattgtttcttaaaacaacaatg

SEQ ID NO: 6780949 - DNA, 66 bp, Homo sapiens
gctttttctagatgatacggtatgtgacataatcacttgttactattaatgaaatctaggaaaggc

SEQ ID NO: 6780950 - DNA, 106 bp, Homo sapiens
gcagaagcctcggtttgttgctactgttagttcctggaacctgtctcactctcatttcttcagggttgattttccaggaagcagttagcagcctatcctagtttgc

SEQ ID NO: 6780951 - DNA, 81 bp, Homo sapiens
ggcattctgcttttaagttagttgtgggttcattcttttataaaactcgaatcacaagatacagttagaagcagggctgcc

SEQ ID NO: 6780952 - DNA, 74 bp, Homo sapiens
tcttttttattaagctaaattgagctgggtttctgtcatgtgaaatcctaaaagtttgacttaattcagaaaga

SEQ ID NO: 6780953 - DNA, 83 bp, Homo sapiens
ccagcagcacctcctggctccctgcacagggctcccaggagcctggagagccgtgagggtgggaggcgggtggcaggctgcgg

SEQ ID NO: 6780954 - DNA, 107 bp, Homo sapiens
ctgccacctctccatagtcagccccactcagggcttgagtgtccaggaggagtcctgcctgctggcctggccctgaggccctgtgtggtggtcctgaggggcggtag

SEQ ID NO: 6780955 - DNA, 62 bp, Homo sapiens
gtggtgacaatctgtttgatctgagcacaattactttatttggatggagccattgccaccat

SEQ ID NO: 6780956 - DNA, 75 bp, Homo sapiens
gagagatctgactgctgtctttatttcactgctaaattaaggttaagcaaaactaaagacacagacagcaatctt

SEQ ID NO: 6780957 - DNA, 95 bp, Homo sapiens
gaggttcatggcatgttcgttgcatgttttcttgtctggagaagtgttggaataagaaacactggggcaggaaagtatgctgtactttgaatttt

SEQ ID NO: 6780958 - DNA, 67 bp, Homo sapiens
tgagatacagttgatatagaaaaaagtgagtaaatgcttaattcttttctgtgttaaccacttttca

SEQ ID NO: 6780959 - DNA, 83 bp, Homo sapiens
tttggtagtggtttcttaggaatgagatttctagtgagcttgatgtttttctctctgaaattcattcctagtggcataccaaa

SEQ ID NO: 6780960 - DNA, 68 bp, Homo sapiens
gaatttatctacgttaagtatggcatgcttacagtacattattgcctgtgatactggaggataaattt

SEQ ID NO: 6780961 - DNA, 69 bp, Homo sapiens
tcaggcttcagcatccacttagttgccagtataaaccattggtgacacagttcatgcatgaggtctaga

SEQ ID NO: 6780962 - DNA, 69 bp, Homo sapiens
agctgcaattaaagactgtgaagtagtgctgctgaggactactgtaagtttatgtgtttacttgtagct

SEQ ID NO: 6780963 - DNA, 74 bp, Homo sapiens
ggggagtctaagtcttcatagtctaatgtccaagtgggttgcactagatgtagacacttggaggcttacttttc

SEQ ID NO: 6780964 - DNA, 80 bp, Homo sapiens
caggctttccacagctgtcctgtaacaggtgtgtcaactggggattttcctgttgccccaggactgctgccaagaccctg

SEQ ID NO: 6780965 - DNA, 55 bp, Homo sapiens
gaggatgctgggtaatgcctgggcctaacagccaggcagaccacctgtagccatc

SEQ ID NO: 6780966 - DNA, 55 bp, Homo sapiens
agctgcctcagtcactcatggccaaagtgatatggcccaatgaacctgggcagct

SEQ ID NO: 6780967 - DNA, 69 bp, Homo sapiens
ggtctggacctcactgtgtttatactcagcatcacgaagcccgtgagcttgtgtatacaggaggccacc

SEQ ID NO: 6780968 - DNA, 125 bp, Homo sapiens
gtttgaagctgaagttgaatggtcactcctacttctactgtgaatctggacttgtctgtgaagagatctgtttctttagggcagttttagaggccactgggaaggaccacaggcctgcttcttat

SEQ ID NO: 6780969 - DNA, 58 bp, Homo sapiens
tgtattatctagtaactgatagtggctaattcctgccatgaagtaaatagaaaatata

SEQ ID NO: 6780970 - DNA, 73 bp, Homo sapiens
gtgtggcttgggtgtctcagctcttcaaggattttgtaatttgaaggactgtctaaggcctccaagctgtcac

SEQ ID NO: 6780971 - DNA, 83 bp, Homo sapiens
acagttctggaggctgggaagtccaatatcaaggcagattcagtgtctggtgagggcccacttcttagtttttacaggactgt

SEQ ID NO: 6780972 - DNA, 60 bp, Homo sapiens
tttcccatcttagcagattaaaagggggaaacccttataatctcttcaagagaaggggaa

SEQ ID NO: 6780973 - DNA, 97 bp, Homo sapiens
ctagccctcaataaagttaatcagttttagctagagcaaaccagctaacattaagaagttggtctctggctatagctgagatgtagatgacacctag

SEQ ID NO: 6780974 - DNA, 82 bp, Homo sapiens
gagacaacagagcactgccctgtgccgctgttgagcacgttatatagacagaagtggggggtagtagttctggtaataaatc

SEQ ID NO: 6780975 - DNA, 80 bp, Homo sapiens
cattacttatgggaaaaatcagtcttctatttgggttggcaaaaatcagctgaagagaggtgctgagtggccaggaaatg

SEQ ID NO: 6780976 - DNA, 79 bp, Homo sapiens
ggggcttcccaagggctttgggctttcctgggctctcccaaaaggagtcctggcccaatctgcccatgatgatggccct

SEQ ID NO: 6780977 - DNA, 69 bp, Homo sapiens
agtttatgaacactgatggaaagtatgtttctttctgtggaaattcatttttcttagtgtgcattatct

SEQ ID NO: 6780978 - DNA, 72 bp, Homo sapiens
aacttgggctagagaatatgagggagtgaatcacatggcttcaaatctcttctaactctgaaactccaagtt

SEQ ID NO: 6780979 - DNA, 64 bp, Homo sapiens
tgtcaagctctggacatttgagacaacactgaacgtccacattctgcagtctctagagcttacg

SEQ ID NO: 6780980 - DNA, 74 bp, Homo sapiens
gggttgggaagatgataattcacagtgcccagaagatagtaaatatagtaagtgaattattttctcctcctccc

SEQ ID NO: 6780981 - DNA, 60 bp, Homo sapiens
gacagctgctgagaagcctcccttctgcccagcctgggggcaggccgtcttacagcagtc

SEQ ID NO: 6780982 - DNA, 56 bp, Homo sapiens
tatactgggtttgattgtttcatgaggattaaatgagacaacatgcagaaagtata

SEQ ID NO: 6780983 - DNA, 61 bp, Homo sapiens
ctctgtgtgtcagtaaggcagaaagaatactctggagagtaagtcttacaggcaacatgag

SEQ ID NO: 6780984 - DNA, 82 bp, Homo sapiens
gaggagtgcttgctggcagcctataaggcctcactgggtggggttaacctagtgatggcatcgggtccagcatctggtcctc

SEQ ID NO: 6780985 - DNA, 78 bp, Homo sapiens
ccatggtgtacagccagatgtagaactgaaaccactataatcgaagcccatttctacttgactgctgtgtcaccttgg

SEQ ID NO: 6780986 - DNA, 82 bp, Homo sapiens
atagttgttgttttttgtctacaactaagtttagggtgatttgtacacatctatagacaagcgtaacaagaagcaatagtat

SEQ ID NO: 6780987 - DNA, 56 bp, Homo sapiens
gtgttcaagcaagtcctttgtgcatggttcacaacacatgcatttatgcttagcat

SEQ ID NO: 6780988 - DNA, 77 bp, Homo sapiens
agcctggccaacatggtgaaaccccgtctctacaaaaaattagtggggcatggtggcacgcacctgtaatccaagct

SEQ ID NO: 6780989 - DNA, 78 bp, Homo sapiens
ttccatcttaacacctgctttcttggactactcatggtaccaactgttgagttctccaggaagcagactgagatggag

SEQ ID NO: 6780990 - DNA, 65 bp, Homo sapiens
cagatgttgagtgatgggccagtctgtgttattgtcagactagaactgcccaccagttaacgctg

SEQ ID NO: 6780991 - DNA, 58 bp, Homo sapiens
gcctcggaggttgaggctgcagtgagctgtgatggctcttctgcactccagcctgggc

SEQ ID NO: 6780992 - DNA, 127 bp, Homo sapiens
gccgacaatgtaaggcatcctaagcttgtccttgcattcacattgtggttgcacgtgctttgtattatagcttcagtcctgacggcaaacactgtatgaatgctggccaagtaatgccaaatatggc

SEQ ID NO: 6780993 - DNA, 57 bp, Homo sapiens
gccctttgtgattttagccatcatccgtgtaatggctaaaattcagaagaaaacggc

SEQ ID NO: 6780994 - DNA, 66 bp, Homo sapiens
gttctattctccagttacatattttgaagcgtggttactgtatgtttacgctggtagaattagaac

SEQ ID NO: 6780995 - DNA, 72 bp, Homo sapiens
gggccttcagtgacagccacccaggcaccatgcataactgcaccaggtctgctaagctgtcattctgagcct

SEQ ID NO: 6780996 - DNA, 56 bp, Homo sapiens
gggtcatcaggttttccaatggccatggtgggaggctcaagaaggctgggtgatcc

SEQ ID NO: 6780997 - DNA, 66 bp, Homo sapiens
ctgctgctgagaaaaatgaaaagctcttaaaggccatagacaaagcttcattgacctccgcagggg

SEQ ID NO: 6780998 - DNA, 71 bp, Homo sapiens
gagcacagtccttttgttaaaattattttttgctttaaaatgcttgagttagggatagagggatagtgttc

SEQ ID NO: 6780999 - DNA, 69 bp, Homo sapiens
tttgttcgttcatgcacggtaggcctcagagccagttgtggaaggaaccagtggatgaatgataacaga

SEQ ID NO: 6781000 - DNA, 86 bp, Homo sapiens
gttcagctcctttcctcttatataacatccccactggcaacttcagataccagtggggatgtcatataagaggaaaggagctgagc

SEQ ID NO: 6781001 - DNA, 58 bp, Homo sapiens
gcctccctgcttcaactcagattcctatagcagagaaaagtctgttgagcagagaggc

SEQ ID NO: 6781002 - DNA, 104 bp, Homo sapiens
gaaatgcaggatatctgtagagttaactaaattaagagacaacagggttgaattttttccccatttgctcattaatgtagagtaacacttacgatgcctcattc

SEQ ID NO: 6781003 - DNA, 75 bp, Homo sapiens
gggtgaaggatgggacctttgagctcagctgaaactcagtgaacccagacacggccagatcctgcttcctcaccc

SEQ ID NO: 6781004 - DNA, 101 bp, Homo sapiens
agtgtttcctttcaacctaattttaactggtaattgcttctccatggttcctctggagaatctgtcagtgtggtagtgggaacaggggagaaggaaaaact

SEQ ID NO: 6781005 - DNA, 112 bp, Homo sapiens
ggttaatttctttactatagtcataaaagtgggacttcaccttgtcagagagaaagcctctctgagtaagtgacagttcagctgaaatctaaaggttaagtaggtattaact

SEQ ID NO: 6781006 - DNA, 83 bp, Homo sapiens
ggatgagctgggattcaaactcagatctccaactccagggttctttccctggtatctgaaagtttagaattcttgtcctatcc

SEQ ID NO: 6781007 - DNA, 76 bp, Homo sapiens
tatgatcaatctaataaaactgatgcctttaaaacatttcttttgaacatttgatggagttagtaggttgaacatg

SEQ ID NO: 6781008 - DNA, 89 bp, Homo sapiens
tgcgtttcatagtctacctgtttgggcaagtgattttctctgtgagcttgcatgagacagcttaattggtggtcactagaatagatgca

SEQ ID NO: 6781009 - DNA, 60 bp, Homo sapiens
agatcttgttaaatgctgcctctggttgagcaaaataggttggcatttctaacaaggtct

SEQ ID NO: 6781010 - DNA, 60 bp, Homo sapiens
cccaggaagagtgagtggcatttgaaatccatatcgtcttgctagtctgctgtcctaggg

SEQ ID NO: 6781011 - DNA, 118 bp, Homo sapiens
gaatgttagcactagagttgttagtacacatgctaagtcataaaagagtatcactcttcagcagaggactttaaattatatgactgtggtggattgtattaaagttcagcaaacattc

SEQ ID NO: 6781012 - DNA, 59 bp, Homo sapiens
tggcaggctctgagtagcacctgtgtcctttagatcaagcatctgctgccagtttgcca

SEQ ID NO: 6781013 - DNA, 58 bp, Homo sapiens
ggtcaggggctgctctacagagcctcagtgaagaggacctgggcgctagttcctgatt

SEQ ID NO: 6781014 - DNA, 66 bp, Homo sapiens
cagttcaaagttaagcagcagttgcacaacttccagcaactttctcagccggctactaatgagctg

SEQ ID NO: 6781015 - DNA, 69 bp, Homo sapiens
tggcactgtggatttcacaagtttcctgacttctgtgagctgttatgtaacgtggagattgacatgtca

SEQ ID NO: 6781016 - DNA, 76 bp, Homo sapiens
agaccaaacacaagtctcaacagcagccagctgccatgggcctcacgctgttgggctgtcatgagactagtggtct

SEQ ID NO: 6781017 - DNA, 67 bp, Homo sapiens
tctgagtggtagtacaggagataccggggagggttccctggcttttgttggtaccaccttatccaga

SEQ ID NO: 6781018 - DNA, 60 bp, Homo sapiens
agcttcaggaacaggcagcctgtaacattctacaaggcagacgcgtgtctccatgaagtt

SEQ ID NO: 6781019 - DNA, 61 bp, Homo sapiens
cagaccagctctatgaacccaatcctctttgcgtcccaggtgttgtggtcaagctgggctg

SEQ ID NO: 6781020 - DNA, 75 bp, Homo sapiens
ggtaggggagagccccctgagctgggacaaggttgctgtgggccagtgccgagctgggggctcctgacccctgcc

SEQ ID NO: 6781021 - DNA, 56 bp, Homo sapiens
aaagtccttgcagtttcctcttactgaactgaaagaggtgggaactgaggggcttt

SEQ ID NO: 6781022 - DNA, 62 bp, Homo sapiens
gtactacagcatggcaaagccaagaaaattccaatttgatgctggtgccttgttgttgttac

SEQ ID NO: 6781023 - DNA, 59 bp, Homo sapiens
cagcctaacccatctgatgcagggtttctctcagtcacctgcttagctgaagtaggctg

SEQ ID NO: 6781024 - DNA, 62 bp, Homo sapiens
gagatcagctgggtggggctaaagactgtcagggagagcaactttattccactgggcagctc

SEQ ID NO: 6781025 - DNA, 59 bp, Homo sapiens
tgttgggggcggcggggagaggctgagactgtctggaaggaccctgccagctcccagca

SEQ ID NO: 6781026 - DNA, 61 bp, Homo sapiens
cctttctttagcaattctttcatgccatccatatgttgtgattacaagggccaaagaaagg

SEQ ID NO: 6781027 - DNA, 73 bp, Homo sapiens
ttctgcactaaatatcaaatatctgaaatgaaaggatttatgggaggttttatgtttgctatttaggcatgga

SEQ ID NO: 6781028 - DNA, 70 bp, Homo sapiens
tctgcacccagcacagcctgcccagcccagccctgcccccgggcactgcacagcctgtctgggggccaga

SEQ ID NO: 6781029 - DNA, 76 bp, Homo sapiens
tgtcagccacaatggtgtactctgaactgggcacatgctttaactaatgttcagagacacttattggaaattgaca

SEQ ID NO: 6781030 - DNA, 79 bp, Homo sapiens
tttccaagtctagcaaatagaattcagaaagggaatatcgtctctgttattctgtctattgccataagaatccaggaaa

SEQ ID NO: 6781031 - DNA, 107 bp, Homo sapiens
acaaaaaacaaaaaggtgccaatccatgtattttaacaatcagaggaagaagcttacttttcccaagtgaagtgaagccagtggatggccctttcttgtgcgtttgt

SEQ ID NO: 6781032 - DNA, 85 bp, Homo sapiens
tcttctcccttccctttctcccccactcaacacctaggccatctctggcccttgagtgtagtgggtgaggaaggaaggaaggaga

SEQ ID NO: 6781033 - DNA, 74 bp, Homo sapiens
ctgggaggagtcccctggtggctggagctgctctgggtttgagcagctgcagagaccgggtgggaaggtctgag

SEQ ID NO: 6781034 - DNA, 88 bp, Homo sapiens
gggtcttgctctgttgcctaggctggagtgcagtggcgcaatctcagctcactgcaacctccacctcctgggttcaagcgattctccc

SEQ ID NO: 6781035 - DNA, 60 bp, Homo sapiens
acttggtacttagggagtaaaaaccattccatgctgtaagagtctctctgagtgctaagt

SEQ ID NO: 6781036 - DNA, 56 bp, Homo sapiens
cctgagttgtcagttgctgtagcttctctgagtcaaagtaacttagcaactctagg

SEQ ID NO: 6781037 - DNA, 76 bp, Homo sapiens
ttcttggctctttctcagtcacgttccctaggctgtgtcctagcccagagctgcactgctgggagggatttgagaa

SEQ ID NO: 6781038 - DNA, 97 bp, Homo sapiens
atctatgtacttttctctatgtgtgttgtagtttgatgaaaagttaatacacacaagcacaaacacacacacatttagggacttctgggttataggt

SEQ ID NO: 6781039 - DNA, 55 bp, Homo sapiens
tccacacaccccttacctccagggtccgtatctcctgctgggtgaggtcgttgga

SEQ ID NO: 6781040 - DNA, 72 bp, Homo sapiens
ctgaagcctgaactgtatatgtcaaaacatcctgttagggctttctgatattggacaattcagggcatttgg

SEQ ID NO: 6781041 - DNA, 80 bp, Homo sapiens
gttccgactatccaccaggctccatgttcagtgttggaaatgcaagactgaaaaagacatcttggtaaggtagtaggagc

SEQ ID NO: 6781042 - DNA, 61 bp, Homo sapiens
tcttgctggtattttctctctcaggttcttctcagttactgtgatagaaagtatcacaagg

SEQ ID NO: 6781043 - DNA, 72 bp, Homo sapiens
ggctgggatgcaaggccttgctcagcactgccaggattaaggagcatggctgtggcaagtcctgcacctgcc

SEQ ID NO: 6781044 - DNA, 69 bp, Homo sapiens
actgatgcccctggacctgtgactctgaattttcttggaggacaccccgggtaccaggtctgcatttgt

SEQ ID NO: 6781045 - DNA, 98 bp, Homo sapiens
gctgcccctgagaaacaggtaacgagggaggggctaagcgccactggcagatgctcagcttgaagctgcctccctgtgcttgtcccctcagcctgagc

SEQ ID NO: 6781046 - DNA, 128 bp, Homo sapiens
agaaataaaccactgtagtgggccaggagggaacaatatgaacagtcatttagaatgtgctgctgcagagagaataactaaatggcagttctttgaagccactttgctaaactatagtttgtatatct

SEQ ID NO: 6781047 - DNA, 57 bp, Homo sapiens
accatcttgcttttagtagtcaatgcagtttgcaaactagaaatcagcaagataggt

SEQ ID NO: 6781048 - DNA, 78 bp, Homo sapiens
attttttgaacagtttctatgttagtggttcttaatcctaactgcaagccagaaccacccaagaggcttttatagaat

SEQ ID NO: 6781049 - DNA, 75 bp, Homo sapiens
aagacagcagcagattcagcgtctggtgaaggcctgcttaccagttcacaaatggctgtgtttttgctgtgtctt

SEQ ID NO: 6781050 - DNA, 61 bp, Homo sapiens
ggtgggtgtgggtaagagggacagagccataaagggcagctcttcctgctccacactcccc

SEQ ID NO: 6781051 - DNA, 64 bp, Homo sapiens
ggacccaccaggccgggctccagtggtcccctcagcccaggacaagggagctgggcctggttcc

SEQ ID NO: 6781052 - DNA, 72 bp, Homo sapiens
ctcctgtttgggttccttggagtctcctacacaatacacagttcagagatctgcaggaatgtgtgcagagag

SEQ ID NO: 6781053 - DNA, 57 bp, Homo sapiens
ggtttgtggatgcaaggcgctgcgtgagtactcagtgctacggttaccatatatgcc

SEQ ID NO: 6781054 - DNA, 128 bp, Homo sapiens
gaagaaataggactggagctggaggacaggcaccgggggcatgaatgaggataggcggattggggctgagtcctgcctatgagacgttttgcctgtttgaacttgagcgaatgcccttccttttcttt

SEQ ID NO: 6781055 - DNA, 61 bp, Homo sapiens
ctgacctgggctgggcgtctcatgggagacagactcactcatcagagcccagtgcagttag

SEQ ID NO: 6781056 - DNA, 63 bp, Homo sapiens
gatcgcatagccctgcatgatactggaatgttccgtggtgaggtattgcagagttatgtgctc

SEQ ID NO: 6781057 - DNA, 92 bp, Homo sapiens
ggggtgactgctctaagttgtatataccgctttaagctataaaatcattattttgagctctttatgcaataaaactcagagcagtgcatccc

SEQ ID NO: 6781058 - DNA, 64 bp, Homo sapiens
agtttgaccatcctgaatacctgatggggaatcacttcccattattataggaggctcattagct

SEQ ID NO: 6781059 - DNA, 80 bp, Homo sapiens
ggaaaatgagtttgcctctagatagcaaggcttgttttatagacaatctgattttcctagtcagaggcaaggcatttttc

SEQ ID NO: 6781060 - DNA, 116 bp, Homo sapiens
tggtgggtggtggggatggagttctcctctgtctaccacgagggtaagtctctttttggcgcttttgtggtgatggagaggcactccgggaaggggaatgtctccgccgcctgcca

SEQ ID NO: 6781061 - DNA, 73 bp, Homo sapiens
ctggggcaaggtagggcaaagtagggcacctgggacaagctttccacccctctgggcccctgcttctccttgg

SEQ ID NO: 6781062 - DNA, 76 bp, Homo sapiens
tccttttctgacttacctcaagcatacaaatctggaacaggagtgttgcttcagggaagccagcatcagaatggga

SEQ ID NO: 6781063 - DNA, 111 bp, Homo sapiens
tattgctcttcagggatttgtgaacacgaaccaagacagtaaattctatgaaaacaatggtacaatatttgcttctggaactttctgttcacccactcaagaaatgcagta

SEQ ID NO: 6781064 - DNA, 97 bp, Homo sapiens
ggccttgtgtcttgtcacgatttatctccagactccagggctccctgggcctcgtgacaggggctcctggcctggagagcaggacagatggaaggct

SEQ ID NO: 6781065 - DNA, 60 bp, Homo sapiens
agcctttaagctgccacagctgctaagagatgccttatatgctggaagggctagagggct

SEQ ID NO: 6781066 - DNA, 55 bp, Homo sapiens
tcctaaatgggagacggcatggtcacatgtgaaccaaatgctgtaatgtttggga

SEQ ID NO: 6781067 - DNA, 73 bp, Homo sapiens
tctgccatgccaggctgtttggcctcagggaagcagcttccctgaccagtccttagcacctggcacgtggtga

SEQ ID NO: 6781068 - DNA, 73 bp, Homo sapiens
cctcaggttctggagaagggccaggtatttccatgtcaaccctgctttttataaccagagagaacatatgagg

SEQ ID NO: 6781069 - DNA, 112 bp, Homo sapiens
tcattcagctcctctctgtcaatgtctcttatagacactcttctatatagaaccaggagcacaatggttatagactgtctgtaagaaacattgacagagaggagctgaatga

SEQ ID NO: 6781070 - DNA, 57 bp, Homo sapiens
gaaggccattagagcctgtgccttttctttggcttccttgcagtctctctggtcttc

SEQ ID NO: 6781071 - DNA, 56 bp, Homo sapiens
ccacgagggaaccaggtggggtgcactcgtgcccctctctcctggatcccctgtgg

SEQ ID NO: 6781072 - DNA, 56 bp, Homo sapiens
cacctagcatgaaattcagcagaaggcaaagactcctactgaactctgattaggtg

SEQ ID NO: 6781073 - DNA, 58 bp, Homo sapiens
tgggcagccatcccagcctctctgcagcctggggagagaggctggggtgttttgccca

SEQ ID NO: 6781074 - DNA, 71 bp, Homo sapiens
gcatggctgggtgcaagtataaccagaggaaacagtctgatcttttctctggactatttgcactcctatgc

SEQ ID NO: 6781075 - DNA, 68 bp, Homo sapiens
acaggctccaggagggccttggccatccctgagggcaggaggcttggccggggtgctgctgagcaagt

SEQ ID NO: 6781076 - DNA, 64 bp, Homo sapiens
ggttctaaatgttttttgtacatatttgttgtaagcataacacatatttgcagtaagcagaacc

SEQ ID NO: 6781077 - DNA, 67 bp, Homo sapiens
tgattgtaaacagtaggactaaagagaaggaaaatatccttcctttcatttacactgcttactttta

SEQ ID NO: 6781078 - DNA, 122 bp, Homo sapiens
tcaccttcttacaccgcatataagattttttgatagcaggaacatgagtgtggattaaaatctgtgctgccattggattctaatgcacttcaaattgttgtggtacagttttatgtagctga

SEQ ID NO: 6781079 - DNA, 99 bp, Homo sapiens
gggcagagttggccctggggtctgcctggaggcagctgctgcagcttccatgcctattcagagcagcctccagggggagccctcagccataccgtgccc

SEQ ID NO: 6781080 - DNA, 57 bp, Homo sapiens
gggctgctgcccaggaggcaccaacaattaaaggctgagatcgtggtaagcagatcc

SEQ ID NO: 6781081 - DNA, 127 bp, Homo sapiens
ggtccttccagacctggaacactgtggaagagtttgggcaagtcataaatgatgctctcgatcactcccacattctgcgactgtccccagaccctccgcctcttctcagaggtctgccatcaggatc

SEQ ID NO: 6781082 - DNA, 61 bp, Homo sapiens
gacagcatgtcttggaaatgcatgtgtgtgtgcatgtgtaatatttcgtggcatgtcagtc

SEQ ID NO: 6781083 - DNA, 94 bp, Homo sapiens
caggcccatctctgtgtccagggccacacggaagggaacattcgcatctgcatgctgcccatgttgccttcgctgtggtcagagatgtggattg

SEQ ID NO: 6781084 - DNA, 75 bp, Homo sapiens
aggttttaacattgcctgccactctgtgaggaatattctggagattcctttataggagcagacaacttaaggcct

SEQ ID NO: 6781085 - DNA, 64 bp, Homo sapiens
tggcaaaagaatcacatccttcagcaagtccatgggaacaactagggctaggggctgtgagcca

SEQ ID NO: 6781086 - DNA, 89 bp, Homo sapiens
ggttgacattcgctggcagctgattagatggtgcccaccagatgaagggtgggtctgccttccgcagcccactgactctagtgttaatc

SEQ ID NO: 6781087 - DNA, 96 bp, Homo sapiens
ggtgatcaccttagctgtttgttcatatttaactaagataggggccttaaaattggctgtcctgtaagcatgggtagaacgtgttgagtggttgcc

SEQ ID NO: 6781088 - DNA, 55 bp, Homo sapiens
tccaagggctctaagtcacaagatggtcttgaatcatttgaactgggcttttgga

SEQ ID NO: 6781089 - DNA, 58 bp, Homo sapiens
atgcagctatttgagcatgtcattctcaaagccccattgaaatgctctacagcagcat

SEQ ID NO: 6781090 - DNA, 102 bp, Homo sapiens
gccctattgttccaagagccccagagcagggagaggtgcagggagggaggtttcagctccctctgagtgacagcctcctctcaatctgggctcacagagggc

SEQ ID NO: 6781091 - DNA, 77 bp, Homo sapiens
acaaaaccacacagagccaggctcccatggggcagcattcaatgtttccctacttttggctgcttagtggttcttgt

SEQ ID NO: 6781092 - DNA, 65 bp, Homo sapiens
ctatcctgttttacctggcacagtgagtgaatataaaaccttctaggctagaagagacaggctag

SEQ ID NO: 6781093 - DNA, 61 bp, Homo sapiens
tcttcctgcacagaggagcctggcccaaaaaagataccccaggcttctccgtgcaggaaga

SEQ ID NO: 6781094 - DNA, 55 bp, Homo sapiens
gggagagcgtcatatgcccaggaggcagttctgcctctggctctttgctcctccc

SEQ ID NO: 6781095 - DNA, 81 bp, Homo sapiens
ttttctaataagtcaaaatgaatttgtgatttaatgttcctcttatttcaaaggaatttgattttgatgtagtttggaaaa

SEQ ID NO: 6781096 - DNA, 130 bp, Homo sapiens
cagctaaccaggcccaagatgaccttgctgttcactactcattagtttagccttcatggaggaagagcatcagctccaaggctgcaaaactacatgggttgcacaggtcaaggactggttgccatgctag

SEQ ID NO: 6781097 - DNA, 58 bp, Homo sapiens
agctgcagccctcctgcatggctgcctgtcactccagctaagcagaggagctgccgtt

SEQ ID NO: 6781098 - DNA, 56 bp, Homo sapiens
gaacgctgtgcactgggtccaggatgacttgcacaccctgttcactgcgcagtttc

SEQ ID NO: 6781099 - DNA, 58 bp, Homo sapiens
gggcacagctgctgcttctcactggggccatgcctctgacctctagccagctctgcct

SEQ ID NO: 6781100 - DNA, 72 bp, Homo sapiens
gcagagtccaggagtctaactcaagagacgatgaccttaacctctctgatatgacctggattttataaatgc

SEQ ID NO: 6781101 - DNA, 84 bp, Homo sapiens
gcgaggcgggcggctgcagactgtgtctgaacctggtcacgtaggctgagtgacgagaagcaaagtctgttttcctaaattcgc

SEQ ID NO: 6781102 - DNA, 70 bp, Homo sapiens
cctgaggcatcagtgttggcttctcagagccccaggtgagtaaagcagaacagctgacattgtaagcagg

SEQ ID NO: 6781103 - DNA, 58 bp, Homo sapiens
tccttcattcattaatttagccctggacccagggctgactcctattggatgaactgga

SEQ ID NO: 6781104 - DNA, 66 bp, Homo sapiens
gcatgcagcagctcagaggcaccagggcctgcctgcagtgccaggtgcatggctgagtctccatgc

SEQ ID NO: 6781105 - DNA, 58 bp, Homo sapiens
gggcaggagaaggtggatgtcccagatccaggagggcaaattcgccctttctctgcct

SEQ ID NO: 6781106 - DNA, 77 bp, Homo sapiens
ctaagctagtaatagagtagacctggagccagatgtcctgaaattctagcccagtgctatgcctattacatccttag

SEQ ID NO: 6781107 - DNA, 56 bp, Homo sapiens
aaagaggatggagtagtcagctcctgttttgctgtcagcaacttttccaccttttt

SEQ ID NO: 6781108 - DNA, 58 bp, Homo sapiens
gccaggaagttgggccagtctatattcaattccttcaggactgtgctttcaatttggc

SEQ ID NO: 6781109 - DNA, 57 bp, Homo sapiens
ggcgaggcagccctcaggtgttagtccaaggtgaggtctattgcagagctgcctgcc

SEQ ID NO: 6781110 - DNA, 130 bp, Homo sapiens
gggctgcagtgaggttagagtgagcgttatcatagtttggaaatctggcattgaatacctgaattttacttgctattctgtttctcagcaactatatgacttggcttagtcagtgctcctctcacagctc

SEQ ID NO: 6781111 - DNA, 59 bp, Homo sapiens
gaatgaacaaggatgttcatccggtatattatcctgcaagttgagaaccatgttcattc

SEQ ID NO: 6781112 - DNA, 88 bp, Homo sapiens
ctttacaacacaccaggagagtagactgcaacattgtaatgtgccacaatatattgcaacattgtaagtttatattaggtataggaag

SEQ ID NO: 6781113 - DNA, 57 bp, Homo sapiens
ggccggggcctgctcgcctgtgcgggtgaccacggactcgctggggggcccctggcc

SEQ ID NO: 6781114 - DNA, 62 bp, Homo sapiens
cacattaatgggatgaggtggaaagttggacacactacctcacagtctgcctttcccttgtg

SEQ ID NO: 6781115 - DNA, 82 bp, Homo sapiens
aagagaaattcatcagaatgcagccagcagttattatttgactatgcctgttgattcttatttttgccatagaaattctctt

SEQ ID NO: 6781116 - DNA, 82 bp, Homo sapiens
tttagtgttttggagggatttctgtgaaatgaacgagcatctctttagattgaagtttataacatagcctccttgcagtgag

SEQ ID NO: 6781117 - DNA, 55 bp, Homo sapiens
gtggctttataggaagaggaacagagatcactctttctccaccatgtgaggacac

SEQ ID NO: 6781118 - DNA, 84 bp, Homo sapiens
gtgtctgagtctatgacagcagcagagatactggtttctttttgggagggaagcatatccatgttgcagccaaggagcaggcac

SEQ ID NO: 6781119 - DNA, 69 bp, Homo sapiens
tgggcctggatcagtgggagatgctggttttgtagtttaccacagctggaggccccattgtccagccca

SEQ ID NO: 6781120 - DNA, 103 bp, Homo sapiens
gtaggaagcctgtcagccagcagcatgaattcgagccacatgtgcatacaatatggtgaatgccgcagtctgttgctaggtaggttgaattcaagctttctgc

SEQ ID NO: 6781121 - DNA, 84 bp, Homo sapiens
ggcctactctggagtaagtctgcaagtgaaatcacctttgatgaggtgatgtttgagttgagacaggaatcacagaaaggagcc

SEQ ID NO: 6781122 - DNA, 60 bp, Homo sapiens
atgggaatagaacaagatagagatttggggtcccatgtctgcttctgtattttttcccat

SEQ ID NO: 6781123 - DNA, 62 bp, Homo sapiens
atactcatgactgatgaatacctgctctgtgcctgaccaggacaacagcagctcatgagtgt

SEQ ID NO: 6781124 - DNA, 67 bp, Homo sapiens
cttccttaacttgtctagaggttagacaaagttagctgctgtcccaaccctgagaagattctggaag

SEQ ID NO: 6781125 - DNA, 69 bp, Homo sapiens
gggtcaactgagcagcaattgctggcccagagacctgactctgggtcagagctgtgctgcccagggccc

SEQ ID NO: 6781126 - DNA, 60 bp, Homo sapiens
ttccagtttgcagttgacactaacgttttgttggtagtgaataacaagcttataagggaa

SEQ ID NO: 6781127 - DNA, 106 bp, Homo sapiens
agttctggaaggaataactgagagtcagtagcagcagcagcatcagcagcatcctaatcctattagcagctgctgttgacggactggctgctccctgccaggcact

SEQ ID NO: 6781128 - DNA, 57 bp, Homo sapiens
ggtgaagagagaggattcggccttggagaggctggatttgggagcctttccttcacc

SEQ ID NO: 6781129 - DNA, 97 bp, Homo sapiens
tgaagtagctcatggctaccaacgcaaggtcactgagtgcagagttaggaagaaattctcacagttgtcccttgtgagtgggcatgagctggcttca

SEQ ID NO: 6781130 - DNA, 66 bp, Homo sapiens
tccctggcacaagaaggctgtccagtgatgaagacttcagatgaaatggcatgctggtgcagggga

SEQ ID NO: 6781131 - DNA, 86 bp, Homo sapiens
gcctcttggtcaatactccctcagttagagcacaaatgcatgtattcacttatagagtgttctgattgctaaaggtggctggaggt

SEQ ID NO: 6781132 - DNA, 68 bp, Homo sapiens
aatatggcaaacatgtgctcattttgtgttgctgagcaatcaccggcgaggaatatgtttgctgtgtt

SEQ ID NO: 6781133 - DNA, 80 bp, Homo sapiens
aatagggtttgtcatggaaacagcaatgctaatgggacagtatcccaagtagccttatggttttccagacacgtcctatt

SEQ ID NO: 6781134 - DNA, 55 bp, Homo sapiens
ctggctccctcgctgaggtgctccttcagtgcccactcatcagcgagggcaccag

SEQ ID NO: 6781135 - DNA, 130 bp, Homo sapiens
cctcgccacagctgctctacctctaggaaagcatttcctgggtcaggtgggctcctagctgactgattttgggagtccattgtcccaggcatgctttcatggttttcttgagatagggccctgaggaagg

SEQ ID NO: 6781136 - DNA, 75 bp, Homo sapiens
cagggttctggtccagagtccttgctagagactggtcttctatcctgtttcctcatggcactgggctggcccctg

SEQ ID NO: 6781137 - DNA, 61 bp, Homo sapiens
gaagaactgacaaactagatcactctggggtggccctgtatgtgtctgtctgtctctcttc

SEQ ID NO: 6781138 - DNA, 73 bp, Homo sapiens
cccagatctgaggccctgcaggcagtgtgggacagtgcagtgagccatgtgcctttgggtcagagggtctggg

SEQ ID NO: 6781139 - DNA, 83 bp, Homo sapiens
tgcaggtgcagggtagcgacggcaggactctaagagtgagtctctttcctccccgtttccccgtcctactttcactctaagca

SEQ ID NO: 6781140 - DNA, 66 bp, Homo sapiens
gggttgtataggaggcctttgaaagattccagaatatctcccagaagtcctcagtacaaaaagcct

SEQ ID NO: 6781141 - DNA, 56 bp, Homo sapiens
tgagatccagagaccttagaatgcttggcaagggcagttctgttatgctggactca

SEQ ID NO: 6781142 - DNA, 102 bp, Homo sapiens
acctggaggcctcattacagcacaaaaacattcccagagtttcttatccagtagatccaaggtggggccctgagaatgtgtgtgtctaatgggtttccaggt

SEQ ID NO: 6781143 - DNA, 56 bp, Homo sapiens
gtttctgctcttcaggggctaccagacttctcctgtccctcctgggctgcagatgc

SEQ ID NO: 6781144 - DNA, 78 bp, Homo sapiens
ttgagcccttgtacataatgaaaggaggctgtgcataaaagccagttattcatttattctgtacattagaggcttcaa

SEQ ID NO: 6781145 - DNA, 63 bp, Homo sapiens
gccaagggggcgctcctgcgctacttcaggctcatagagcccaactgcaggagtgaccccggc

SEQ ID NO: 6781146 - DNA, 128 bp, Homo sapiens
gggagaagcagatgttttcagatgagatgtgtgtgaaaaatgatttgttaactgtaaaccacagtacagttgtctcttgaggtcatttatctaatttctgtctgaattagaaaatctgtggtgtttcc

SEQ ID NO: 6781147 - DNA, 55 bp, Homo sapiens
gcttggctttgtcttgttcactgtcacagcctgagcatctaaaacagagccaggc

SEQ ID NO: 6781148 - DNA, 69 bp, Homo sapiens
ttactctcagttcccaggaggaaggggtacataggaccacacagggcctcctgggaagcactggggtgg

SEQ ID NO: 6781149 - DNA, 61 bp, Homo sapiens
gaatgctggaagcctcagtagatttggggagtccatatcagtttggtgctttcagtgattc

SEQ ID NO: 6781150 - DNA, 77 bp, Homo sapiens
tcagtttaaccgcattagtgctcttttaagcttgaaagaggtagtttgagagagtaattgagtggtaaacttactga

SEQ ID NO: 6781151 - DNA, 63 bp, Homo sapiens
ggccactttaactcacatttcagcttgctttctcaagtggaggttattgagttaaggttggcc

SEQ ID NO: 6781152 - DNA, 59 bp, Homo sapiens
taggcatggccctgccaggaggaacaaggcacacaccgttgtcctttagggcttgtctg

SEQ ID NO: 6781153 - DNA, 55 bp, Homo sapiens
atgagggagtcggactagatgattcctaagagtccttcccatctgacaccctgat

SEQ ID NO: 6781154 - DNA, 128 bp, Homo sapiens
tgtaatccagctagtggttcgtaggtatggctcccctactgcatggggaaccttggactgtatctttctcatttctgtctccctgatgtagagcaggcctgcctcaatggatactagttgaatgaaca

SEQ ID NO: 6781155 - DNA, 90 bp, Homo sapiens
ggttctttcccctcctccccgctggcgtgtcaaagatgggaggttatctttcctgtgttacccttgcagtgagggggaggcctgaggact

SEQ ID NO: 6781156 - DNA, 66 bp, Homo sapiens
tgggcctagaagtgtgtaccagcttatactccccaccaccctgaaagttagtgcatgaaaggttca

SEQ ID NO: 6781157 - DNA, 61 bp, Homo sapiens
gcaagagcaactttatggagcttgccctgtacataagctgaccatggggagtttttcttgc

SEQ ID NO: 6781158 - DNA, 60 bp, Homo sapiens
ttgagagttaccagcagaggaaacgaaggtattgtgctttctttgtaaatagcttctcaa

SEQ ID NO: 6781159 - DNA, 84 bp, Homo sapiens
gtagtcaataattctgagcgaaaaatatttccttcaaaggaggattatttccttaggatgagtttttgcgtttggagtaactat

SEQ ID NO: 6781160 - DNA, 58 bp, Homo sapiens
gcatgtaccagaatattcttccattttaaggctgaataatattcctctgtgtgcgtgt

SEQ ID NO: 6781161 - DNA, 129 bp, Homo sapiens
ggatttttcctgtttttaatgtctgggcccattgggctgcagacctagcataaatggggatggcgagtacgtctctggtctcctgtagctacagagggctcagagcagacataaaacaggcttacagcc

SEQ ID NO: 6781162 - DNA, 74 bp, Homo sapiens
tgcacaaagttcttagattaatcactgattgggctagaaatcagtgcacaaaaatatctaggaatgctatggca

SEQ ID NO: 6781163 - DNA, 63 bp, Homo sapiens
aacaaacctgggtggagaaaggacgccctccctgaactggtcctttctgtgcccaggtctgtt

SEQ ID NO: 6781164 - DNA, 100 bp, Homo sapiens
accttggagaggagcagccccagggaggatggcctcggtggctgccgtggatctgaagcagcagcagcaggaggctgtccaccaccatgctccccacagt

SEQ ID NO: 6781165 - DNA, 99 bp, Homo sapiens
gaccttggagccctcctgctgaggagtgagaaattggtttcctctgcctttctgtgtcatggaagccaccctccttccagccccagaggatcttctgtc

SEQ ID NO: 6781166 - DNA, 57 bp, Homo sapiens
tcccacaaacacccacttgagccaactcaaatctgctctcaaattggggttctggga

SEQ ID NO: 6781167 - DNA, 68 bp, Homo sapiens
gcatttcttccatacagacaatgcaatgcaatgacatcatttcattatatggaatgttggaaatatgc

SEQ ID NO: 6781168 - DNA, 98 bp, Homo sapiens
ttttcttggcaagtccaaaccctggggctgctctgcctggtggtccgaggcgagggggacagagcgagcgccccaggacggcgacttcccacggagga

SEQ ID NO: 6781169 - DNA, 57 bp, Homo sapiens
atttctcagtaggtgcacagtggtttggaaaatttccagctctgcatttatggaagt

SEQ ID NO: 6781170 - DNA, 58 bp, Homo sapiens
agagtctgatgtcaacagttctggaagagattccacagaattggtcttaccagacttt

SEQ ID NO: 6781171 - DNA, 87 bp, Homo sapiens
catgaatagaatgctggctgcctttcacctcatctcatccattaactgtgaaaggtgagagccagccttatttttctaaatatcatg

SEQ ID NO: 6781172 - DNA, 64 bp, Homo sapiens
gtgtctgtgactcttacctacccagcctgggtttcccagtcttttatgtaaaagtcaaatatac

SEQ ID NO: 6781173 - DNA, 58 bp, Homo sapiens
caaatctacatgaacccaaagaggactctcctactttcccataatgcatgtggatttg

SEQ ID NO: 6781174 - DNA, 82 bp, Homo sapiens
cttgtctatttgcatttgtatgtaaaggtcttcatgttgttttcattatggagcattttcatgcccctgtaactgagacaag

SEQ ID NO: 6781175 - DNA, 56 bp, Homo sapiens
ggctaagtcaatggagctgtttttaaagccttaactacagtttattttacttggtt

SEQ ID NO: 6781176 - DNA, 72 bp, Homo sapiens
gctttgtggtcttggaagaagttgctaccagtatgaggagagacaatcagtttcctccaggatccagagagc

SEQ ID NO: 6781177 - DNA, 69 bp, Homo sapiens
gtcccttgacccctgcaggactgtgacatgggaagggacactctattctgagtccatgggggcagggat

SEQ ID NO: 6781178 - DNA, 72 bp, Homo sapiens
tccccaagggcatttggctcaacctaagtaagagaggataagcttgagggagaaagctgaggtgtctgggga

SEQ ID NO: 6781179 - DNA, 95 bp, Homo sapiens
ttggcaggatcagttgcccactggctgttggtcagaggcctcttctggttcctggccttgtgaccctctccgatgggcagctcacagcctggcag

SEQ ID NO: 6781180 - DNA, 102 bp, Homo sapiens
tctgcacaccaggcgtggccctcctgtagcactgacaccatatgtgtcattacatgtggaaagtcaagttccaggatggattgtaagggcagggagtgcaga

SEQ ID NO: 6781181 - DNA, 82 bp, Homo sapiens
cttagcagctttgggggaggtagtctgtggcaaagctaaaccacattctccatagagccctgaccccaaggtaacagttgag

SEQ ID NO: 6781182 - DNA, 65 bp, Homo sapiens
ttcaatatcattgtttagtctcatgcttttggataccagaatgtttactaaaaatgatgtttgag

SEQ ID NO: 6781183 - DNA, 57 bp, Homo sapiens
tctgtttaatgggaatgatactaactacttcataggctgtcgtgagaattaaacaga

SEQ ID NO: 6781184 - DNA, 71 bp, Homo sapiens
cctctgtacaggtcagcatctaggagcgcaaagcacgatgaacaagtgtatagagccaaactgtacagagg

SEQ ID NO: 6781185 - DNA, 61 bp, Homo sapiens
tcttttcttataaaaggcagtttgaggattttactttatttgtctttcttataagaattga

SEQ ID NO: 6781186 - DNA, 80 bp, Homo sapiens
tctctttgattaggactggtttcaactcagatggttcaaatgaagggataatttacagagatacagtcagggtaaaggga

SEQ ID NO: 6781187 - DNA, 58 bp, Homo sapiens
gaccccaggaaagacaggctcaagggcacaaggttctgagtcagtctgccctggcttc

SEQ ID NO: 6781188 - DNA, 90 bp, Homo sapiens
agacagcttgccttctacaacgtggtactatgaacagcaaagaacatgactgccctctgacctgttggcatgttgagaggcaagatttct

SEQ ID NO: 6781189 - DNA, 87 bp, Homo sapiens
gctctttgacaacagggcttacgtgataacttctcaaaaacaagccaaaaatactttttaagacaatcatgtactgtagtcaaaagt

SEQ ID NO: 6781190 - DNA, 59 bp, Homo sapiens
taaggtttggctgtctcttggttcctatttgaatgccacattgagacagtcaaagtttg

SEQ ID NO: 6781191 - DNA, 61 bp, Homo sapiens
gtttctcagaggcccccaaacaagctgttgttataagcaggtgggaagtcatctgggacac

SEQ ID NO: 6781192 - DNA, 57 bp, Homo sapiens
gaactgagttttctgcctggacagtgtcctaagactctctggcaagatctctggttt

SEQ ID NO: 6781193 - DNA, 88 bp, Homo sapiens
ctctccccatgaaggagcaccacaggttgaggggaccacatcagttggtcctggagtatttctgtggtgtctgctttacctaggagag

SEQ ID NO: 6781194 - DNA, 59 bp, Homo sapiens
gtttagaatgaaacttttgagcacaggttattggactcaggcaaaccttcgttctaagc

SEQ ID NO: 6781195 - DNA, 62 bp, Homo sapiens
gtattattaggtgctctctgacaagacaaatgttttcattggaaatggctaccttatgatat

SEQ ID NO: 6781196 - DNA, 65 bp, Homo sapiens
ctcagaaaccatgttgtcttgaataggcatgttctgcgtcatctgttcatacacatgcgtttgag

SEQ ID NO: 6781197 - DNA, 68 bp, Homo sapiens
tggcgtgatggccaagatcacagacttcagtgcttaattgcctgggtttgaatcttggctttctgctg

SEQ ID NO: 6781198 - DNA, 67 bp, Homo sapiens
catgaaggaccatttcacggtctcattcaaacggacatgattgcaacctagtagggggtcctttatg

SEQ ID NO: 6781199 - DNA, 66 bp, Homo sapiens
ttagtgagagcgataggagaaagtagtgctccacctttcccgtgacatcctggtgcttgacactga

SEQ ID NO: 6781200 - DNA, 57 bp, Homo sapiens
ttgccttgggcttgacaagctgtcaaggattcttgccaaggctgccaagctcagcaa

SEQ ID NO: 6781201 - DNA, 60 bp, Homo sapiens
aggaccagccttgactgccccagcacagaaatggctacagtggctcagtgctggtgtcct

SEQ ID NO: 6781202 - DNA, 61 bp, Homo sapiens
ctactttgtgctgacatttgggtcataatgaaaatgtgataagacagtaggcacaaggcag

SEQ ID NO: 6781203 - DNA, 105 bp, Homo sapiens
catcttcgttttttccgagaatctgcatcttagtcaaaatctgtttacttgaggcagatgtttgtactaggaggtaaagatggatggctgaagcaatggaagatg

SEQ ID NO: 6781204 - DNA, 110 bp, Homo sapiens
gggtctcataagataacccatgtgtgttatgtgggccagggcaagagccagtgaaatctgagtccttcctttttacataatcacatttgtacctgcagctcatgaagccc

SEQ ID NO: 6781205 - DNA, 60 bp, Homo sapiens
ctcagatgtgagaaatatattgtgataaaacaagttgtccaatgccctttccacatggag

SEQ ID NO: 6781206 - DNA, 57 bp, Homo sapiens
ggctccctgttctattccctggggttcagcagcccccctaaatggttcagggatgtt

SEQ ID NO: 6781207 - DNA, 70 bp, Homo sapiens
gtcttatggcagtttaagtttgaatgctgaaattaatttttgacagccccaataaactgcacattgagac

SEQ ID NO: 6781208 - DNA, 60 bp, Homo sapiens
tttagcagaaactgttacagaaggcacaattgtctcctgaattagcagtttgtgtctgaa

SEQ ID NO: 6781209 - DNA, 68 bp, Homo sapiens
caagtacaagttgtcagggcaactgatgttaagtgattaaacagtacttgataatttgcacgtacttg

SEQ ID NO: 6781210 - DNA, 62 bp, Homo sapiens
gcactttctgcctctcaggcgctgttccaggcacagagatggagtgggagagggcagactgc

SEQ ID NO: 6781211 - DNA, 56 bp, Homo sapiens
aaagcaccggggagccttgggaacgtggatctcacagtcccagcttcttgggcttt

SEQ ID NO: 6781212 - DNA, 129 bp, Homo sapiens
ctggtcttccctctgtgtgccccactgccaggtggcaccttaccctgcgcaggcgctcagcctgcgcggtggtacagatgcttcactcacacttgccgggggctaaaatcacagcctatgaccaacctg

SEQ ID NO: 6781213 - DNA, 96 bp, Homo sapiens
agtgttccatgttgcttaaacaggaaagagccaggtcatcctgctacttggggtaaatttggtgtgttttttcttgtgttgccgatattagtcatt

SEQ ID NO: 6781214 - DNA, 72 bp, Homo sapiens
gtttgagttttgttttgagtcaactccacgggcagctctgtgaaggatggatttcaaagggacaagtctgac

SEQ ID NO: 6781215 - DNA, 58 bp, Homo sapiens
gtattcagtgacagggtattatgagctctttgtgcacataattccatgttatgaaaac

SEQ ID NO: 6781216 - DNA, 65 bp, Homo sapiens
gctcttcttttcctagtgtaagagaaaagtgacccttcttatgcctaaacacagggagagggagc

SEQ ID NO: 6781217 - DNA, 75 bp, Homo sapiens
tgaattttctaggtacaaggagggattcttgatacttaatctatcctgtgttcctgtgtgccaagctgagaatca

SEQ ID NO: 6781218 - DNA, 69 bp, Homo sapiens
gcagacgaatctaaatgccattgcaaggggctagaacattctgatgctgcactaggatttgctttctgt

SEQ ID NO: 6781219 - DNA, 65 bp, Homo sapiens
atagagcagatagtgaaacagaatagtgtatttatctatatgtgtctttctgtgcatctttctat

SEQ ID NO: 6781220 - DNA, 61 bp, Homo sapiens
cgcacttggctcctgacaatgtgacaccatgtggcgatacaggcaggcatggccaaatgtg

SEQ ID NO: 6781221 - DNA, 84 bp, Homo sapiens
gctcacatgtctggggagggccaatgtgtccctgagctcgtactaggcggcctgtgggtgtttggctctctcacacgtgagagt

SEQ ID NO: 6781222 - DNA, 67 bp, Homo sapiens
gacataacagtgaaccatgcggacccttggccttcggggagcttcctgcaggtcactgtgccctgtc

SEQ ID NO: 6781223 - DNA, 63 bp, Homo sapiens
agggatatttttaggtgatgcaggccctgctaggcagaagcctgagttaatgagaatagtcct

SEQ ID NO: 6781224 - DNA, 76 bp, Homo sapiens
cacttttcttagctttcattttagtactcctttcactgtatcaactggccatttgattgaaagcctgagaaagctg

SEQ ID NO: 6781225 - DNA, 96 bp, Homo sapiens
gggtggcaggtggtattggagagtgggaggagcactagctttgtggccaggccaggcagacatgggatctattcacagctttaccacttcccagcc

SEQ ID NO: 6781226 - DNA, 59 bp, Homo sapiens
catatcagcccaagcaatgggctctggtggaacttccaggctggtgggggcttgacatg

SEQ ID NO: 6781227 - DNA, 69 bp, Homo sapiens
gtatattttagacaccctcacgcaacctttctacttctgagaccaggcctgtcggtgtctggtgtctgc

SEQ ID NO: 6781228 - DNA, 57 bp, Homo sapiens
agaaattcatctctgctaggtttcatgttcagcatctctaagtgttggtgaatttct

SEQ ID NO: 6781229 - DNA, 67 bp, Homo sapiens
tgacgtccttcagggagtcaaacactttggaaagaaacgcgaactgaaaatgctattggaggacgca

SEQ ID NO: 6781230 - DNA, 58 bp, Homo sapiens
ctgaagaagtctctaggctattaagttaaaccttgaatgccatattggatttcttcag

SEQ ID NO: 6781231 - DNA, 55 bp, Homo sapiens
ctgggtttctaaggaatctctgagcacttagactcagagattttagtagccacag

SEQ ID NO: 6781232 - DNA, 77 bp, Homo sapiens
gcctggacgggtgcttgttcccgctgcttccggctatggctgagagcctggcctgggcaggcacatgccacaaaggc

SEQ ID NO: 6781233 - DNA, 96 bp, Homo sapiens
cacccactgatatataacctgctggaaggtgttatctgtatcagtcttcccatagagaccccatacctcagcaggtataattcatgagtgaaggtg

SEQ ID NO: 6781234 - DNA, 60 bp, Homo sapiens
gctggttcttttccgtattatattacttatcacacagtatcgtagtgtgggaaagaaggc

SEQ ID NO: 6781235 - DNA, 123 bp, Homo sapiens
aattttaactcctttatgtgcgtctttagagctgagtagtgtttatcttggggaaaggataaggtccttcttcaatagcaagcgcataaatagactgataaggggacgtgcagagttgaaatt

SEQ ID NO: 6781236 - DNA, 74 bp, Homo sapiens
gccaggagctgtatttagggagtccctttacaatacttctctggacccaccctactagcagtgtcccacgtggc

SEQ ID NO: 6781237 - DNA, 62 bp, Homo sapiens
aaaaaggaactcaagcctgactcctgtctttaatagtgagtgcaagttttgggtttcttttt

SEQ ID NO: 6781238 - DNA, 69 bp, Homo sapiens
tcatttatcgctgccttttaaaagctaaagagggaactttacagcatatgaagggtgagatataagtga

SEQ ID NO: 6781239 - DNA, 58 bp, Homo sapiens
ttttgtggtgtgtgatatacaggtaagggatggtctaatctgtgcacctgctacaagg

SEQ ID NO: 6781240 - DNA, 61 bp, Homo sapiens
aggcctcagtgatcatcatcagaccatccttcttattgaacagatgaggaaactgaggcct

SEQ ID NO: 6781241 - DNA, 95 bp, Homo sapiens
ggccccacgcccgctgcccgctgctgctcagtctgtgctgcgccccagcccggcggaaccgtgcggcagcgccccctggcggccggggtggggct

SEQ ID NO: 6781242 - DNA, 61 bp, Homo sapiens
actgtcaatgggttcattgagtgagtaagaaccttgactatggcagtgacctaaggatagt

SEQ ID NO: 6781243 - DNA, 62 bp, Homo sapiens
tgcataatacgtttcctataactggggctgaaagagcttaaattagagttagctgttatgca

SEQ ID NO: 6781244 - DNA, 63 bp, Homo sapiens
ggtaggggcaagtctggccatttctctggaatgtcaaccgagaggccaacttcttgcccctcc

SEQ ID NO: 6781245 - DNA, 76 bp, Homo sapiens
ttgcatcttagattaaccatttcttgctttagaatctactacagagtcaaataagagagagatgttgatgatgcaa

SEQ ID NO: 6781246 - DNA, 67 bp, Homo sapiens
gcttccttcagtaggcaggagtgagtgtaggagcagcctgccatttccagccaactgcctagggagc

SEQ ID NO: 6781247 - DNA, 58 bp, Homo sapiens
ggtccctgccctaaaactcgtcagtgcctcataaccagcaaggacaagtggaggggcc

SEQ ID NO: 6781248 - DNA, 83 bp, Homo sapiens
agattttgcctcgggtttttaaagatgttttataagttatgggtctctttaaaatttttaatcatcttaatgaggtataattt

SEQ ID NO: 6781249 - DNA, 56 bp, Homo sapiens
cccaggctggagtgcagtggtgtgatctcggctcactgcaacctccacctcccggg

SEQ ID NO: 6781250 - DNA, 78 bp, Homo sapiens
tccagaccacattctcttacattttctcagccttgctctgtgagttaggtaaagacagtgaaagagggtcaaaatgga

SEQ ID NO: 6781251 - DNA, 76 bp, Homo sapiens
ggtgggtccctgggtcttcttacgtccctagtcagtctggaagactaaggtttgagccaggcctttaatgagcccc

SEQ ID NO: 6781252 - DNA, 72 bp, Homo sapiens
cacagccctgagaatgtcccgaatggtttcctctcacctggagagattggggatgaatctttcttggctgtg

SEQ ID NO: 6781253 - DNA, 60 bp, Homo sapiens
tgtttgttttcttaggcagctgcaatttggggtaatttgcaatgccgcaatagataaata

SEQ ID NO: 6781254 - DNA, 74 bp, Homo sapiens
tagaggaggggtgggcacatgtatagccaggatttggggacttgacttggtatggatggtgtggctttcttctg

SEQ ID NO: 6781255 - DNA, 85 bp, Homo sapiens
tccactgagaggcgacccagggccacagcccgcagtagatctgttgctacagccaaaggggcttggccctgggccaaacaggaga

SEQ ID NO: 6781256 - DNA, 72 bp, Homo sapiens
ctgggcgtgatggtggatgcctataatcccagctacttggggggctgaggcaggaaaatcgcttgaacccag

SEQ ID NO: 6781257 - DNA, 95 bp, Homo sapiens
tcttcaagaacaaatattgtccacatcactcacttgtcatttattgttagttgacgtgtgtgtgtgtgtgtgtgtgtgtgtgtatctgtgtgaga

SEQ ID NO: 6781258 - DNA, 64 bp, Homo sapiens
cacctagacagaggcaagcgcattacttcatcttgtgagctgcattacagcctctgttttcgtg

SEQ ID NO: 6781259 - DNA, 56 bp, Homo sapiens
aggctcagaggtgagcatctgctaacaaatgtcagtgcagtcccatttctgagcct

SEQ ID NO: 6781260 - DNA, 67 bp, Homo sapiens
gtggcaggattgggctgaaggagtgggatggagcattctgtgctattctgttaaccgaacctttcat

SEQ ID NO: 6781261 - DNA, 59 bp, Homo sapiens
gatccacagggccctggcccaggaagaaactcaaacctgaccccaaagccctggggatc

SEQ ID NO: 6781262 - DNA, 57 bp, Homo sapiens
ccttagtctttcatcagaggttatttagtttttctgaattttgaaggaagattaagg

SEQ ID NO: 6781263 - DNA, 71 bp, Homo sapiens
gccatggcttcgcgcgtccccgctgccgctgctgactcgacacaatcggcgggtcgcgcgggggccgtggc

SEQ ID NO: 6781264 - DNA, 61 bp, Homo sapiens
tggaggtacatgaggatacacaggacactctctattggcctgtgaattgaatctaccacta

SEQ ID NO: 6781265 - DNA, 60 bp, Homo sapiens
ccattagcttctttctgacgtggtctgggttccctggagcctgggggagggagttggtgg

SEQ ID NO: 6781266 - DNA, 55 bp, Homo sapiens
ctagttctagatccctgaggaattgccacactgacttccacagtggttgaactag

SEQ ID NO: 6781267 - DNA, 87 bp, Homo sapiens
gagatggaagggagtcctcagatacctggcagatcaactgtgctagttatagctgtcatgtactgagcatactctcccatcctcctc

SEQ ID NO: 6781268 - DNA, 55 bp, Homo sapiens
ctagttctagatccctgaggaatcgccacaccgacttccacagtggttgaactag

SEQ ID NO: 6781269 - DNA, 63 bp, Homo sapiens
gtttgaagctaatgtcatttcagtctcatttggaggcttcagagatttcactagtttctccac

SEQ ID NO: 6781270 - DNA, 84 bp, Homo sapiens
gtgtcacactcttctcatgaaatgtagggagcctagacattgatattttcatggcatctttgggctgcatggaaggggtgacac

SEQ ID NO: 6781271 - DNA, 61 bp, Homo sapiens
tacagcagagacctggcagccacctggaacaaatcttaccagctgcctgtttctgtaagta

SEQ ID NO: 6781272 - DNA, 70 bp, Homo sapiens
cctgagagtctgagagcctaatgaccttgatttaaacaatgtcaggcatttaattctgctcagctacagg

SEQ ID NO: 6781273 - DNA, 76 bp, Homo sapiens
tttgtaaatatgaaggatacacctctgattttcattttattgggttgagaacagggcagttccttatagtggcagg

SEQ ID NO: 6781274 - DNA, 61 bp, Homo sapiens
gcctaaaacgctctcagtaatattcctgagtcatccctcagggctgggcttggtgttaggc

SEQ ID NO: 6781275 - DNA, 65 bp, Homo sapiens
gggtctatgtctaccaagctcactgtagagtcacttttaccttttgctatggtggaatgggatct

SEQ ID NO: 6781276 - DNA, 69 bp, Homo sapiens
ctttggaatgtctgctctactcaggaggtgatctggtgccagcctcttgcagagaaggagacaaaaaag

SEQ ID NO: 6781277 - DNA, 56 bp, Homo sapiens
tcctgtggcgttatcatgtgattagttcacatgacctaaatactaattttgtagga

SEQ ID NO: 6781278 - DNA, 123 bp, Homo sapiens
ctgcgaaattaatgttgaacttctaacctgcaatgtgaccgtatttggagatagagcctttaaggaggtagttaaggttaaataaggtcataaggtcaggtccctaatcaaacagaattggag

SEQ ID NO: 6781279 - DNA, 80 bp, Homo sapiens
aggagaaaagaaagggagaaggatggtgtgtcagaaactattgattattctcacaatatcagttcttcttttctttccct

SEQ ID NO: 6781280 - DNA, 93 bp, Homo sapiens
gaaagctgtctgagctgtggggcaggcagcgagggtttctgtagggaagcctgcctctctcctcctcgccctgactcagtctgtccagctttt

SEQ ID NO: 6781281 - DNA, 64 bp, Homo sapiens
gataaaagtagaatttggatggggaataacttccaatgttgagatcccaaaattctactttatc

SEQ ID NO: 6781282 - DNA, 105 bp, Homo sapiens
cttttatacttgaaaatgacaggcttaaatgctcatatcagtcacaaatccaggatgtactgtcttgttgtatgtgagctttgtagagatttttaaaaatataag

SEQ ID NO: 6781283 - DNA, 71 bp, Homo sapiens
gttggttggcaatgtttcgatgggagctgtcttttcacaggatggttcacttaagtaaacggtcaactggc

SEQ ID NO: 6781284 - DNA, 82 bp, Homo sapiens
agaattatttcaatagatccagaaaatttattattgatctcagttgcctgaggtggtacctttctgggtttgaagagattct

SEQ ID NO: 6781285 - DNA, 78 bp, Homo sapiens
aacatgctctgctttttaaaaggagtccaacttaagaactgccagattaaaacgggcttgctaagaagagcgcatgtt

SEQ ID NO: 6781286 - DNA, 81 bp, Homo sapiens
ccaccagctccctcctgctcaggtcctgttttcttttgaagggaaagaaacctagtctggagcagcagtgggaggaagtgg

SEQ ID NO: 6781287 - DNA, 88 bp, Homo sapiens
ttccccgagtggagttcccagcggcccgcggctgacggccagatctgtcctgaggggtcgtgggagcccagcgcctgccttgagggaa

SEQ ID NO: 6781288 - DNA, 79 bp, Homo sapiens
gcatccagggaggtagcctcaaaagcagctctgtagtctcccagggtggctgcaatggctaacttctgactggacacgc

SEQ ID NO: 6781289 - DNA, 84 bp, Homo sapiens
gtttggaaggtagtcaaatatctggcacttaaatgagaatttgggcctcaagatctcgctttgagggtcagttgcctatcagat

SEQ ID NO: 6781290 - DNA, 80 bp, Homo sapiens
tatgtttgttttatactggctagtgttttttaatggaaaaatagtgttttgattgacattagactaatgtagcatttatg

SEQ ID NO: 6781291 - DNA, 97 bp, Homo sapiens
agttcattcaactaggtaagtggcagagctgggctgcgacccaggtgtgtctgagactgagcccatgctctttctacgatatttgctggtatggatt

SEQ ID NO: 6781292 - DNA, 80 bp, Homo sapiens
gcaaacagagtaatggcagacctcctggccacaaagcaaagtagtttgtgctagcagaactgtcgtcatctctggagtgc

SEQ ID NO: 6781293 - DNA, 59 bp, Homo sapiens
cctgttgcgtctagtccatgagctctttagcccaaatgcactcagatgctcacaacagg

SEQ ID NO: 6781294 - DNA, 101 bp, Homo sapiens
ggagctgggcaagagccatccatgagagcgtctgggtcggttaaggtccctttctgtaccctcgcgattctcctctgaggcctatgtctctgtccgtctcc

SEQ ID NO: 6781295 - DNA, 69 bp, Homo sapiens
ttgtagccaagatttatattgaataatattacttgaatgtaatagtatttttaaaaatattggaggcag

SEQ ID NO: 6781296 - DNA, 80 bp, Homo sapiens
gctggatggggctctgcggctgctccccacttccccagcccggcgtgtagggaagagaccgtaccctggcccagtccagc

SEQ ID NO: 6781297 - DNA, 116 bp, Homo sapiens
atcaaattcaggccaatggaatggaagcaggaatgttgcatgtgatcttctgggaacctttcctaaaggagtcttggtgcacacctgcagtcccttcctctatcctaatgactgat

SEQ ID NO: 6781298 - DNA, 60 bp, Homo sapiens
ggggtgagggtgtggctgggtgagaggcggaggccaccctagccagccacttcctgctcc

SEQ ID NO: 6781299 - DNA, 61 bp, Homo sapiens
gctaagttgtaatttgtatacctccttgaaatctaatttggtatgataattacaaaatagt

SEQ ID NO: 6781300 - DNA, 64 bp, Homo sapiens
gatggtaaagatctggctgccaggattcagtaagaaaaggaggattctggctttcttatccatc

SEQ ID NO: 6781301 - DNA, 91 bp, Homo sapiens
ctatctgagggtgtaaattataggtgccaccttggaggttggtgatcacagtccatcttttgggttcttatgatttatatcccttccatag

SEQ ID NO: 6781302 - DNA, 69 bp, Homo sapiens
ggtagatgaggcatatcctcctatggttcaagtcagaatgaaccatgcaggctattttcaaatcatacc

SEQ ID NO: 6781303 - DNA, 67 bp, Homo sapiens
tccaagaagctcagcaaacatcagcttttcctagctctgtgtcctcctctgcttggggcatcttggg

SEQ ID NO: 6781304 - DNA, 79 bp, Homo sapiens
ttggagatctgcacggataagctgctgaactcattatatgtagagtacatgcaaggatatttgtgcggcgctcttccaa

SEQ ID NO: 6781305 - DNA, 66 bp, Homo sapiens
gattggacagctcgttcactctgcactaatgcacagtgataggcagttgtgctcaccttaccagtc

SEQ ID NO: 6781306 - DNA, 61 bp, Homo sapiens
gtggctcatattgagtgatttctttgggaaaagctaaaggaaagacattactgtgggctat

SEQ ID NO: 6781307 - DNA, 108 bp, Homo sapiens
accaacaataacaagaagccaatttcgtatatcaaatttgcaagggctataaaaataatagtattagaaagagtataccagaaacaagcattcttagacattgttagt

SEQ ID NO: 6781308 - DNA, 100 bp, Homo sapiens
gcacattgcttcacctgggctgcatgatggcatttcttacatggaagaaaactgtcactagttgcccagaaaacagactcacatttgaagcataatgtgc

SEQ ID NO: 6781309 - DNA, 78 bp, Homo sapiens
taggaaatgttttccccaaatgatcttcccttgtatagtcaggatgaacggaagattgggcaaaagacataaatctta

SEQ ID NO: 6781310 - DNA, 58 bp, Homo sapiens
gtgaaggcagtgaatgaaacagaggcttccaaggcctcggtgtgttctctgccaccac

SEQ ID NO: 6781311 - DNA, 82 bp, Homo sapiens
tattgacaaaacctcagccgtaatgcagatagctctcacgtttttattgtgttcatgttgattcatagcggttttgtcaata

SEQ ID NO: 6781312 - DNA, 98 bp, Homo sapiens
tggtaatatatttgagagaggactttgtggtacattagtgctacttggggacagctaggtgtatgaactacagtgcattttcttaagctgtatgtcca

SEQ ID NO: 6781313 - DNA, 56 bp, Homo sapiens
acagcttcttagtctttccttgtttattcatgagcttggcagtcttgaggagttgt

SEQ ID NO: 6781314 - DNA, 68 bp, Homo sapiens
gccaggcttgagcaaatcagaagtttagatgctaatgtatttgagcttcagtgatgctttctgcatgc

SEQ ID NO: 6781315 - DNA, 89 bp, Homo sapiens
tgaggtctcctaaattaatgagttaaacaggacaggatatagcatcagaagagagttcctgctgtttacctacaatggttgcatcctca

SEQ ID NO: 6781316 - DNA, 74 bp, Homo sapiens
ggacatttatgtatatatacgtgcatatatatatgtatgtatgtatgcatgtatgtatcgctagaggaatgtgc

SEQ ID NO: 6781317 - DNA, 70 bp, Homo sapiens
tgatttgggagtattgcttgagcccaggagtttgagacaagcttgggcaacacagcaagaccccacctca

SEQ ID NO: 6781318 - DNA, 64 bp, Homo sapiens
ctgcgggatgacagtggccaacagagattaagcaagaacttctgcgggttggtggcatatgcag

SEQ ID NO: 6781319 - DNA, 76 bp, Homo sapiens
gctagtgggccttatttcctgtgtgaaacaacttttatcaaaatgtatttgacactgggagtgtgggtgaactggt

SEQ ID NO: 6781320 - DNA, 70 bp, Homo sapiens
atatgcaaagtttggctctcatgacattttggtgaccttaagttgatgtcagagatcaggcttaatttat

SEQ ID NO: 6781321 - DNA, 122 bp, Homo sapiens
gccagtcccagccagagtgtaaagacgtttagagaggctatgaggttctgtgtgcagggtactgcatcatgagaagccataccctagtgaaacctttgccactttgctgagctggacatggc

SEQ ID NO: 6781322 - DNA, 60 bp, Homo sapiens
cccaaccccactacacgttggagaagccatttatcttcaggtagtgagtggggtgcaggg

SEQ ID NO: 6781323 - DNA, 55 bp, Homo sapiens
ctggttctgattcctagtgtttgctggttaaagatgacactgaatgtagaattgg

SEQ ID NO: 6781324 - DNA, 129 bp, Homo sapiens
gcgcaggtgtttgagcagcgcagagccctggccgaagcccttggcgcacaccgggcacttgtggggccgcgggccgccgtgcgtgcgcaggtgctgtgccaggagcgagccgtgcccgaaggccttgcc

SEQ ID NO: 6781325 - DNA, 71 bp, Homo sapiens
gcacacatcaggtgtggtcaccacagggtctaatcacagagctttgtgcacactcacctgaccacctgtgc

SEQ ID NO: 6781326 - DNA, 56 bp, Homo sapiens
tctcctgggaggacaaggaaggggctctgagacccaagcctggtcttgtcaggaga

SEQ ID NO: 6781327 - DNA, 95 bp, Homo sapiens
gttgcagagctgcagagagggaatgtctagctttgccaggccccacagaaggctcacattggctcagcaagacattgacctccactgcctccaac

SEQ ID NO: 6781328 - DNA, 72 bp, Homo sapiens
gagtcactgcctgatgtggtgaatattttgaggccaaaaatttcccccaaatattcctgccattaatgactc

SEQ ID NO: 6781329 - DNA, 71 bp, Homo sapiens
ggggtagaatgctcctgggaactcggaaagctctgggatgccagcttttcccacatgttctcactcacccc

SEQ ID NO: 6781330 - DNA, 60 bp, Homo sapiens
gggcagcccataacatttgaggcctcccctatgccatctggaggctttggtgggcagctc

SEQ ID NO: 6781331 - DNA, 55 bp, Homo sapiens
gttcttgaatatgctttgcaatcctaagcccctggctgttgccaaatttgaggac

SEQ ID NO: 6781332 - DNA, 66 bp, Homo sapiens
ctccgcatatgcctggctagctcctccacaaatgcgtgtggaggagctagccaggcatatgcagag

SEQ ID NO: 6781333 - DNA, 84 bp, Homo sapiens
tgggcccccagtgaatatctttgtatggttcagcaggttgtacaaaactagttagatgccatcaagggcttgcagtggggctca

SEQ ID NO: 6781334 - DNA, 57 bp, Homo sapiens
gggcgaggctgggggcaactgtaactgccacagcccagagcccctcagctctctccc

SEQ ID NO: 6781335 - DNA, 130 bp, Homo sapiens
tccagggccccacacctgcagcatagcctgggacgactctgtaccctttccaggacgaggaggagcacggcgtcgagggcttggagagcgtcccggaggagggcgtccaggaggcatggggctgctgcgg

SEQ ID NO: 6781336 - DNA, 66 bp, Homo sapiens
ccagcaagccaggtgtgcccaggatcctgaccacttccttctggtgcctggacacttggcaaatgg

SEQ ID NO: 6781337 - DNA, 58 bp, Homo sapiens
gggcatgttttcgtaaactcagtttaaaccacacgtgaactgatcctataacatgccc

SEQ ID NO: 6781338 - DNA, 61 bp, Homo sapiens
tttgtcctgcttgggcttaaaagggctttgcctttatccaaagcctcaagcagaagacaga

SEQ ID NO: 6781339 - DNA, 57 bp, Homo sapiens
ggggtctcactttgttgcccagattggtctctaactaagtgactcaagtgatcctcc

SEQ ID NO: 6781340 - DNA, 81 bp, Homo sapiens
aggagtgctcttgccactggccacagggcctggatttggggaggaagagcagggtccagggccagtggctgagcacggcct

SEQ ID NO: 6781341 - DNA, 111 bp, Homo sapiens
ctgctgtagaggaagaaggagccgtcggagtccagcacgggaggcgtggtcttgtagttgttctccggctgcccattgctctcccactccacggcgatgtcgctggggtag

SEQ ID NO: 6781342 - DNA, 64 bp, Homo sapiens
cacttgatgttgtcactattgccatgtgacactttggttagtctaatagtgactcatgaagctg

SEQ ID NO: 6781343 - DNA, 64 bp, Homo sapiens
atgctgtgtttggaggtttgccaggagatatttctaactgagcagcaccttcaagaaacaggat

SEQ ID NO: 6781344 - DNA, 75 bp, Homo sapiens
tcagccacttttgctggggtgtgaaatctgatgatagttcatctaacttatgttttaccaaattagcatggctga

SEQ ID NO: 6781345 - DNA, 70 bp, Homo sapiens
caggagattgtgccagtgccttgggtattaggagtctggttccaatcgcactggctcatttagagtcctg

SEQ ID NO: 6781346 - DNA, 73 bp, Homo sapiens
tggttttggggatcagggtgagtgggaagcagcgtcaccttctgagctgctcttgctcttcctcccttgacca

SEQ ID NO: 6781347 - DNA, 75 bp, Homo sapiens
gaggaaagctggtttaaagtatctgagtgaaataagaggaaaaccccaaatacttcacctaacccagtttccctt

SEQ ID NO: 6781348 - DNA, 86 bp, Homo sapiens
acatatcattatacatttgtcaaaacacagagaacaccaggaatgaactctaatgtaaactggatttgagggtggtaatgatgtgt

SEQ ID NO: 6781349 - DNA, 80 bp, Homo sapiens
cttaatgctccagatccagctgagctgcagctgcatgcagctgcctgagtgaccccagctaagatcacatggagcagaag

SEQ ID NO: 6781350 - DNA, 55 bp, Homo sapiens
cctgtgctgggaaaacacggaggttgctaagccctttgtgtgtcacgtgcacagg

SEQ ID NO: 6781351 - DNA, 60 bp, Homo sapiens
ggtgtggcagtggacctgtgaagagggagaatctagccttcagcctgtccagtgttaacc

SEQ ID NO: 6781352 - DNA, 75 bp, Homo sapiens
gccgggctggggagctggccgcctatgtgcaggagaacctggaggccgcacagctggctggcgagctggcccggc

SEQ ID NO: 6781353 - DNA, 72 bp, Homo sapiens
tggaaaagctcattgataaaaagtcctgtgtgagcagagactttaagtaagtcaaggagccagatttatcca

SEQ ID NO: 6781354 - DNA, 68 bp, Homo sapiens
tttattagattatcaaagaggtgagaccaaaaaaagattaagggactgcttcttgagaatctggtaaa

SEQ ID NO: 6781355 - DNA, 70 bp, Homo sapiens
cagttaattcagtcagggttcagggtctaaacaggaagtaaaatctgacctgagccttgaggagtgactg

SEQ ID NO: 6781356 - DNA, 81 bp, Homo sapiens
cttcgcaagatcacacagcaaggtggaggcaggtgtgagcccaatagggcggctgcttcaccttgtctgataccaacgggg

SEQ ID NO: 6781357 - DNA, 88 bp, Homo sapiens
gggtgggctgatatagttagggaagtgtataggggtcatgcaggggctatcacctctcctactccctgggatcagctctcagtcaccc

SEQ ID NO: 6781358 - DNA, 56 bp, Homo sapiens
gggcacgggggctgtgggtaccttgtgcatggctttttaccctgggctctctgccc

SEQ ID NO: 6781359 - DNA, 79 bp, Homo sapiens
gagctgtgtggggactgagtggaggcttctgaggactcaccagggttaagacgggtgttcattcaatgctccccagttc

SEQ ID NO: 6781360 - DNA, 77 bp, Homo sapiens
taaaggtgagagggaaattttccagtggaatcctgcccagcagttaattacaaatggcaaattttaaatcatctctg

SEQ ID NO: 6781361 - DNA, 68 bp, Homo sapiens
actccaagggctttgctggggccccaaggttaatgttgaaggggctttcaaagactttcccttagagt

SEQ ID NO: 6781362 - DNA, 63 bp, Homo sapiens
gcctgagccaggaggcagagactgcagtgagccatgattgcactactgcactccagcctgggt

SEQ ID NO: 6781363 - DNA, 65 bp, Homo sapiens
gagggggtgcattgtttatttgaacaaataaaacaatactttgagtttaaatatatttccccctt

SEQ ID NO: 6781364 - DNA, 70 bp, Homo sapiens
attttctgtcaaactcacaggccgagtagtgtaattgaaagaatgctaggccaggagtcagacagattat

SEQ ID NO: 6781365 - DNA, 92 bp, Homo sapiens
ggctagtatttttaattttgatgaggttcagtttattaattttttccttttatggattttgcttttggtgtcaagtcttacaaatatttgcc

SEQ ID NO: 6781366 - DNA, 61 bp, Homo sapiens
gcagtgggaggaagagatgcctctagatatagggtgattagaacatctctcttctgccagc

SEQ ID NO: 6781367 - DNA, 73 bp, Homo sapiens
aagggggagaatatgtgaagggggcttccatgggaggcttcgatggcccacccacccttccattcttcctctt

SEQ ID NO: 6781368 - DNA, 114 bp, Homo sapiens
tgctccagggtcatttggagtgatggttgcctggtatttgaataaagagctcccctatcagaacattcaggttcaaatcttagtgcctctgttcctactgtatgaccttgggca

SEQ ID NO: 6781369 - DNA, 129 bp, Homo sapiens
aatgctgaatgcacctcggttgtaacagggttggagatgccagtgttataaatagatattttatgtaagtgtagtgtgacataggtgtccaccaatattcaactttagtcaaatatgcaaagaaacgtt

SEQ ID NO: 6781370 - DNA, 74 bp, Homo sapiens
gctaggttgtcagactacttgtgggctgggctgtgacatctgttgggtcctccagtggtactggccaattctgc

SEQ ID NO: 6781371 - DNA, 83 bp, Homo sapiens
gggtctgaagggacaattgtgcttcctgggttgtaggttacttggttttaacagctttattgaggtataattgatatcccccc

SEQ ID NO: 6781372 - DNA, 63 bp, Homo sapiens
tggtatagcacctgatacctagtatgtgtttaactaatataactttcttaggtctataagcca

SEQ ID NO: 6781373 - DNA, 79 bp, Homo sapiens
ggagaacaggatgctctgtctcttgctgttcagggcagggatggcctccagccgcaagaagtacagcagcacctcgtcc

SEQ ID NO: 6781374 - DNA, 83 bp, Homo sapiens
gaagttgcctacattgttggatattgagtaaataaaagtggcaacattttctagctgacaaaaatgttttacaaagcaacttt

SEQ ID NO: 6781375 - DNA, 59 bp, Homo sapiens
cagcccacctggcacgtgtgttatccccgatagccacggcccttcaaggtggcttgctg

SEQ ID NO: 6781376 - DNA, 58 bp, Homo sapiens
ttgaggaaatgtctcttgatttttggatccctggaaaggggtagagaacatcactcag

SEQ ID NO: 6781377 - DNA, 66 bp, Homo sapiens
gaagcacatacataggacttagacctggattcaggtctgccacactggttcagtggatgtgagttc

SEQ ID NO: 6781378 - DNA, 55 bp, Homo sapiens
gcagccagaagactcagaacaaaagtacacattttactctgtgtacactggcagc

SEQ ID NO: 6781379 - DNA, 95 bp, Homo sapiens
gcagggacaaggaggtgtctgtgatgggagcgatccccggactgagctgggctgtctgctggcacgtcacagataataaaaccgcgtcgtcctgc

SEQ ID NO: 6781380 - DNA, 100 bp, Homo sapiens
ctgggtggagactctgcctttggccctgaggaggcagctgctcccttttgagctgggaggagcagcttctgtaggtgtcacgcccagaaactccacgcag

SEQ ID NO: 6781381 - DNA, 77 bp, Homo sapiens
ccctgtgctctgtgagcatcccttaccggaagttccaccaggagctgggcaaggctgaagctaccaggtgtggaggg

SEQ ID NO: 6781382 - DNA, 107 bp, Homo sapiens
gttctgtaacaaatacccactatgttctcggcactatggatgcctactatgtgcttggtaccatgttagttactgggaatgttgtaatgaatatatttgaagtgaac

SEQ ID NO: 6781383 - DNA, 89 bp, Homo sapiens
gccacatgtgagcagctcagggtggtctctagaataattctcatgttcacagtggtgagacctgcagctgtagtctgcgagcatgtggt

SEQ ID NO: 6781384 - DNA, 62 bp, Homo sapiens
gtaagttttcctgaaactgatggtgttattaggcatgacctcgtcagacttagaaaacctgc

SEQ ID NO: 6781385 - DNA, 99 bp, Homo sapiens
cttgtgccaagagccaggagcccagatggtagccctagaattcagctgctcaccagaagttgttctgctaatttgatggccttgtctgttgggagcagg

SEQ ID NO: 6781386 - DNA, 61 bp, Homo sapiens
atagaaatggcagctggtgctatttcactttaaataaatgtttggtactagcgctgtctat

SEQ ID NO: 6781387 - DNA, 55 bp, Homo sapiens
gcagcctcagggcactcagatgcttacatggtgtctcagggccccaaaggctagt

SEQ ID NO: 6781388 - DNA, 98 bp, Homo sapiens
ctcgcagcgagttaacatttcttagagactgagagtccctaagtgaaaggtcacttgcatgacctctgtgcctcagtttcatgtgtcgactccgtgag

SEQ ID NO: 6781389 - DNA, 59 bp, Homo sapiens
tggtctccatgacatcacagtggagtgaaacacctcctagaatagtgtgtctggagcca

SEQ ID NO: 6781390 - DNA, 88 bp, Homo sapiens
ctgttttcatttttttcaggctatgttttaggagcttagtaacttaccagccccactatttcaaaaccatggccagaaatcaaagcag

SEQ ID NO: 6781391 - DNA, 56 bp, Homo sapiens
acctggagcttccaactcaactttaattaaaggccctttgcgtggaagctccaggt

SEQ ID NO: 6781392 - DNA, 60 bp, Homo sapiens
cagtgtagacggttatgtatttaggtcttttatgggccacatttcctaacgtatacactg

SEQ ID NO: 6781393 - DNA, 69 bp, Homo sapiens
gggcaggagaaacaaatccagtagtcactgagggttcagagtgctagggatttctttctcactaatccc

SEQ ID NO: 6781394 - DNA, 87 bp, Homo sapiens
cttaggaagatgcactttccctgtgaatatttaaagagaggcagtctgttaaatgctcagctcggggactctggccatttgcctaag

SEQ ID NO: 6781395 - DNA, 84 bp, Homo sapiens
ttttcctatatttattcctagtaaaaatgcgcacctttagaagaagagtgggtaaaatatattggagagtagaatatacaaaga

SEQ ID NO: 6781396 - DNA, 60 bp, Homo sapiens
cattttgatctcccagactaaggagttgctgcatctccttagctcagggagttcactgtg

SEQ ID NO: 6781397 - DNA, 61 bp, Homo sapiens
gatggtgtccgttctccattctgacctgcatacatgtccccactgtggagacagatgcctc

SEQ ID NO: 6781398 - DNA, 66 bp, Homo sapiens
ccacctgcagccgcctgccgtcttgcacctcccagaggcgctgccacagctggccgcgcgggtcgg

SEQ ID NO: 6781399 - DNA, 56 bp, Homo sapiens
gctgcctgaaatgttgcctagcttcaaacacgagcaggtaagaccgtttaggcagt

SEQ ID NO: 6781400 - DNA, 69 bp, Homo sapiens
ggctgggagggtaggtaatttctcatgaccacatagccacacagagaaagtcctgatctctctaatgcc

SEQ ID NO: 6781401 - DNA, 99 bp, Homo sapiens
acctgttcctcttctgatggccatcatttggtttgacccaaaagccttgtgtctggggctgagggttaagatcagacagctgttcactggagagcgtgt

SEQ ID NO: 6781402 - DNA, 56 bp, Homo sapiens
cagagccaacgccacctgcccattgctgcccaatgggcagaccacactggcttctg

SEQ ID NO: 6781403 - DNA, 65 bp, Homo sapiens
ttggattatacacatacatgtacgtcacatgtgtgcacacatgcatacatgtttgtgtattttgg

SEQ ID NO: 6781404 - DNA, 55 bp, Homo sapiens
tggggcgcgcggtccctcccgcaggtctccgagggagccaggacctcgcgcccca

SEQ ID NO: 6781405 - DNA, 109 bp, Homo sapiens
tggccttctttccttctagcaccttgccttgtaaggatcacctatgcatatcctagtattggtcaattctgtgaggcaacatttgctcctgaatgttagagaaggcaca

SEQ ID NO: 6781406 - DNA, 88 bp, Homo sapiens
tggtagagtcaatacatacaaactgttattattattgtggcgccaacaaccaaattaggatggcagttttgatatgcttagcctgcca

SEQ ID NO: 6781407 - DNA, 108 bp, Homo sapiens
tgtgtttcttttacccagaagaggaagtggagaataatttcatagttggtgttagccaaaaattactttacactttcatcttcaattaaatatggtattacaaacaca

SEQ ID NO: 6781408 - DNA, 84 bp, Homo sapiens
tcaagtaggcactgtgggaagccataccctgatttctgtggtgctgccattatcatcatgtgtttgccttggaatcctatttga

SEQ ID NO: 6781409 - DNA, 79 bp, Homo sapiens
cagggccctgcgcttagaagggctctgagcttggtttaactatgtgaaactgttcatcctttttgaacaaagggccctg

SEQ ID NO: 6781410 - DNA, 90 bp, Homo sapiens
gaataccattaatctgttcactaggagattaatttgcaatttgttggcaaatcacatgtgggtcttgtagcaagagcgtgggtggtgttt

SEQ ID NO: 6781411 - DNA, 74 bp, Homo sapiens
gtgtccttgtaaagctcatgtctactctgcagctcagaatgtggctgtgttggaaatagggtctttgcagacat

SEQ ID NO: 6781412 - DNA, 60 bp, Homo sapiens
tgtgttgggattacaggcatgagccaccacacctggctcctccctgacttctacagcaca

SEQ ID NO: 6781413 - DNA, 87 bp, Homo sapiens
ccctcctccttttcttccaatctcccgcctctgggatctaaggtggatgaaaggggcactagaatgggagacttttggggggcaggg

SEQ ID NO: 6781414 - DNA, 93 bp, Homo sapiens
ggctgaggcatgaggatcgctagagcctaggagtttgagactagcctgggcaatatagtgaggccctgcctctggaaaaaaaaaaaaaaagcc

SEQ ID NO: 6781415 - DNA, 81 bp, Homo sapiens
gaggccagctctacccttggacttcctaagtaatgagctaacacactcccctcctgcttagtctagttggagttgagtctc

SEQ ID NO: 6781416 - DNA, 89 bp, Homo sapiens
ctaccttaatctcctagttggctctgatccactgggacatttattccggctttattatgtggccatgtgactgtgggagcttaaggtag

SEQ ID NO: 6781417 - DNA, 77 bp, Homo sapiens
attcacactgtgtgagttcttattgctcatctttcttgtaggatacagatagttgggaacatatagtgcctgtgaat

SEQ ID NO: 6781418 - DNA, 103 bp, Homo sapiens
tacctaggaatgcttagccatgggtccctagaagcctggtttttcaaacatacaagtgcttaaaacagcactgagccgccattcagaggacagcatccaggtg

SEQ ID NO: 6781419 - DNA, 59 bp, Homo sapiens
tggcaacttgcaacctcattctcatggaagagataataggggatgatgtaactatgcca

SEQ ID NO: 6781420 - DNA, 62 bp, Homo sapiens
gtgcatgtgtgtctgggcatgggtgtgtgtgcatatgtgtgtgtctgaggatatatgtgcat

SEQ ID NO: 6781421 - DNA, 61 bp, Homo sapiens
ggagggagggagaatctcatcggccaccacagaaggaaaaggcccagggtttcctctctcc

SEQ ID NO: 6781422 - DNA, 87 bp, Homo sapiens
ttagaagctctaagtctttaagtaatgataggcatacttgcgtaatacatagcacattgcctttattttaggattttaatcttctag

SEQ ID NO: 6781423 - DNA, 79 bp, Homo sapiens
ggaatgaataagcacttagcaagatccttccctggcgtgagtgactttacgcaagtggtttttctatgttcttcattct

SEQ ID NO: 6781424 - DNA, 67 bp, Homo sapiens
ggaaaggaagggcccattctctcagaaaacatgtgttttctgtttacagagggacctgtccagttcc

SEQ ID NO: 6781425 - DNA, 125 bp, Homo sapiens
tcgcgcgccgcgtacgtgcagcaaccgactccgcccagcgaggcggagcctagggaagccgcgggcggcccgccgctgtcctggagctgctgctgctgctgcggcggctgcaccggcggcgccga

SEQ ID NO: 6781426 - DNA, 55 bp, Homo sapiens
gatcacagattccatgtgccgggtccatgctgagggctggcagcctgtctgtgtc

SEQ ID NO: 6781427 - DNA, 62 bp, Homo sapiens
tatgtctacttccaggctagtaatcgttaataagaataaaactgccaggccagtagaacata

SEQ ID NO: 6781428 - DNA, 66 bp, Homo sapiens
cagtaccacacagtcttggttgcatagctttgtggtcagttttaaaatcaggaagtgtgtgtcctg

SEQ ID NO: 6781429 - DNA, 60 bp, Homo sapiens
ttcctgacctcgtgatctgccagccttggcctcccaaagtgctgggattacaggcatgag

SEQ ID NO: 6781430 - DNA, 55 bp, Homo sapiens
tagaggttggccttagaaagattcaaaatagaaaaattttaagctattacctctg

SEQ ID NO: 6781431 - DNA, 62 bp, Homo sapiens
gttgtacctaaaggtaaatgggcatatggcgtgtgaaagtgttgtagacctgggggtatagc

SEQ ID NO: 6781432 - DNA, 62 bp, Homo sapiens
ctggagactctgcatctgtgacagctattaggcagtaattagttgtgacacagaattaccag

SEQ ID NO: 6781433 - DNA, 81 bp, Homo sapiens
tgcaatgtgatatgctgattatatctttggttttaattaattatttcactagagccaagcctcttttagtgtgacattgca

SEQ ID NO: 6781434 - DNA, 72 bp, Homo sapiens
gggtctgaagcgctggtgttgtagaaatcctcatcacaaagaggtgactgcgttccagttgctgccaggcct

SEQ ID NO: 6781435 - DNA, 57 bp, Homo sapiens
ccatatctcaatttcttgtcagtgtggtttctatattgagcaggtgcagggaagtgg

SEQ ID NO: 6781436 - DNA, 84 bp, Homo sapiens
tcatctacagatgccccagatgtttggatggtttttggtgtgtagaaagtattcaaaaatatttggtcgaattattgtaaatga

SEQ ID NO: 6781437 - DNA, 85 bp, Homo sapiens
acgtgatatatttacttccccagttgtggtgtaagcatcctctaaaaatgcttacaccacaattggggaagtaaatatatcatgt

SEQ ID NO: 6781438 - DNA, 58 bp, Homo sapiens
gtgctttatatgtgggtatccaaagtatcttcctatggcatagctatgaataaagtac

SEQ ID NO: 6781439 - DNA, 68 bp, Homo sapiens
ttccccatggcctgtcctattcctgtctgtctcacactgacacgtttgaaccaggatagaccagggaa

SEQ ID NO: 6781440 - DNA, 70 bp, Homo sapiens
gacagtgtgaacatctaatagtactatgttactcttatgggttaattccttgttggatttcatgactgtt

SEQ ID NO: 6781441 - DNA, 98 bp, Homo sapiens
ctgaattgaaaaagatgatttctcttggcaatatgttgctttatctaagcaacatacagagtacagagatatacaacaaaccctcttttttatgtcag

SEQ ID NO: 6781442 - DNA, 67 bp, Homo sapiens
agtgaatgcttccaaaataccaagcctgttccttctggtttgggcagtattattggagttatgggct

SEQ ID NO: 6781443 - DNA, 57 bp, Homo sapiens
ttatctgctttaagccccttgctttccacaggaaaacaccaaggctcagagagataa

SEQ ID NO: 6781444 - DNA, 68 bp, Homo sapiens
ctcgcgtggcccgaagatccgagggtcacactacgtgacttctgggtgtctgtgggtactgctgtggg

SEQ ID NO: 6781445 - DNA, 55 bp, Homo sapiens
tcagagaagtaaggtggggtgcaaatcgacaggccatctgccttttactctttga

SEQ ID NO: 6781446 - DNA, 55 bp, Homo sapiens
cagacatctgtacccagcctgtggttttgcctggctggtagggtacagaagtctg

SEQ ID NO: 6781447 - DNA, 77 bp, Homo sapiens
tcgcttgaacccaggaagtggaggttacagtgagctgagatcactccactgcactacagcctgggcgacaagagcga

SEQ ID NO: 6781448 - DNA, 62 bp, Homo sapiens
cctcctatcactgccctcacagctgggacctacaagggcccacttcatgggcaggaaggagg

SEQ ID NO: 6781449 - DNA, 75 bp, Homo sapiens
ttatcagataaaattcttattttacccgtactattgaaagataattgtgtttgatgcagaattttaggttggtaa

SEQ ID NO: 6781450 - DNA, 68 bp, Homo sapiens
gtgcaagtcagcagcctggccaggagagggctctacctcatcccagaaggttgctgctcgaagtgtac

SEQ ID NO: 6781451 - DNA, 73 bp, Homo sapiens
ggtaagagcctatcagggatggagttgagaattgaacctgagttctctggctccaaattctgatgttctttcc

SEQ ID NO: 6781452 - DNA, 120 bp, Homo sapiens
ctggatgtaaatgtaaaacttcgcgactttataaaactggcattcctaggggaggggctatttatcctacaggtccctgcctcctggcagtgccatggtatgtgtgcatggatataccag

SEQ ID NO: 6781453 - DNA, 66 bp, Homo sapiens
gtggcttcgctttgccatgagtttaccgcagaaaccggctctgaaatcaggcacagcgactgcagc

SEQ ID NO: 6781454 - DNA, 88 bp, Homo sapiens
attttaacaacatatgtttctagtataagtgtctgttcttgtgtaaattgaatgtaacacctaactgaggcattcttgatgttgaaat

SEQ ID NO: 6781455 - DNA, 81 bp, Homo sapiens
ttctatgcccagtttataagaaagaaaaccaagttcaagagctgtagcccaaggttttaattgtcagggctggaattagaa

SEQ ID NO: 6781456 - DNA, 61 bp, Homo sapiens
taaagtaaaactgtattaatgtcttcatccacagagtaggcaactgacagtttctgcttta

SEQ ID NO: 6781457 - DNA, 112 bp, Homo sapiens
aggcctgatgttattggcaaaagtaaagcatggcatagtttgactttgaggactttaaaagtgcttcaaagggtcactatttatcaacttatttgctgacttatcttggctt

SEQ ID NO: 6781458 - DNA, 66 bp, Homo sapiens
ctcagactgacagtgtgactgatgctctatagaagtaataggctatcatccttgtcagtgactgag

SEQ ID NO: 6781459 - DNA, 105 bp, Homo sapiens
ccaatggggtcagcatcatccaacaggttgagagtctgaatagactgaaaaattgaatgaaagttgaattctctttctgccttattgcttgaactgatatattgg

SEQ ID NO: 6781460 - DNA, 65 bp, Homo sapiens
agaaatcccattttataccataagagcaagcatattaggttgcactcaaataagatggggtatct

SEQ ID NO: 6781461 - DNA, 56 bp, Homo sapiens
ttcctgccggatcactgggctctgccaacttcagtccccagaggttgcggcaggag

SEQ ID NO: 6781462 - DNA, 88 bp, Homo sapiens
gaagaagaagttctctggggacttggttggagccggacctgtccgatatggtttccaatccaaacttcacctttaaggaagtcttctc

SEQ ID NO: 6781463 - DNA, 60 bp, Homo sapiens
aaattgagacttttttcctccaaatatgttttgactttggagatttagaaggatcaattt

SEQ ID NO: 6781464 - DNA, 86 bp, Homo sapiens
caatttacagttgttcattgctggtatataggaaagcaattgacctttgtatgttattcttgtatactacaatctttctgtaattg

SEQ ID NO: 6781465 - DNA, 87 bp, Homo sapiens
gtcggggggctcccgggagatgacgggtgggcggaccccaggcgcaggtccagtcccattacccacatttcccggagcccagtctac

SEQ ID NO: 6781466 - DNA, 63 bp, Homo sapiens
agaggaatatgggtgcactagaaccaggagggtcccaaatcccttatgcactcatatttttct

SEQ ID NO: 6781467 - DNA, 73 bp, Homo sapiens
gaggaaagatgagtgagagcatcaacttctctgacaacctaggccagtaagtagtgcttgtgctcatctcctt

SEQ ID NO: 6781468 - DNA, 104 bp, Homo sapiens
ctggggaacagccataataggacaagactgaccctggtagccactgtaataacagccaccagggtcagtcctgtcctccacgctgcaatgggttatttccccag

SEQ ID NO: 6781469 - DNA, 77 bp, Homo sapiens
gggccctgggtccaaggcctggacgggcagccagtgtgggctggatgtgtctggaagggctatgtgaccgtgggcct

SEQ ID NO: 6781470 - DNA, 88 bp, Homo sapiens
tcatttgaagctagtcaagcttagataacgataatgataattaaatctcatgcttcagtatctaagtatgataatgcttcaggcatga

SEQ ID NO: 6781471 - DNA, 77 bp, Homo sapiens
cattcttcaagtgtttccgggagacttggtttctttgctcagagccgtgtcccatttaggaaagtactaggagtttg

SEQ ID NO: 6781472 - DNA, 71 bp, Homo sapiens
gagcagctgatgtgtccggagcagctgtgtccggagcatctaccacgtgctaggctcagacacacagcctc

SEQ ID NO: 6781473 - DNA, 74 bp, Homo sapiens
actgccacctccagcctcttgaaagttgttagcttccttcagcacagctgaaagggtgttggagtgttctcagt

SEQ ID NO: 6781474 - DNA, 61 bp, Homo sapiens
gggctttaacacccagtcaggggcagatgtgaaaatcacagcctcttgggtggcagaggcc

SEQ ID NO: 6781475 - DNA, 103 bp, Homo sapiens
ggtgcttagagacagtagtatagatatggaattttattctaagcacgtataaagttattatagtgttgatagcagtggagtgccatagtctgatttaagcatt

SEQ ID NO: 6781476 - DNA, 73 bp, Homo sapiens
gaggtagtcctggctgcagtttttgcagaagaatgaataacattttctggaaaccctcagccagtgtctcctt

SEQ ID NO: 6781477 - DNA, 90 bp, Homo sapiens
ttatgtggttagagagaaggggctggtgaattctaggatggctttgacttcctgaacattatgcaagcttcatttttttctatcatataa

SEQ ID NO: 6781478 - DNA, 74 bp, Homo sapiens
agtatgaattatattctattttatcttatatgcacacagtgtaaaaaaatctagaggaggatgtgatgcatatt

SEQ ID NO: 6781479 - DNA, 67 bp, Homo sapiens
ccgagatgagttgcatccatcggctcccgattaccaagaatcaagaggcgatggatggaaaccttgg

SEQ ID NO: 6781480 - DNA, 78 bp, Homo sapiens
ccctctccctgtccccaccccagaactactaggggtccccttttccttcaagttgtctgagggtgggcatagtgaggg

SEQ ID NO: 6781481 - DNA, 86 bp, Homo sapiens
ggcgcagggggtgggagagtgggagcaactgttgctcaagtgaggcaggtgccctcttctccacgagtcccaggtaccctctgccc

SEQ ID NO: 6781482 - DNA, 55 bp, Homo sapiens
gtgctggcccagtatggactgcaggtttgacttttgcaggattccaggtcagtat

SEQ ID NO: 6781483 - DNA, 58 bp, Homo sapiens
tccagttttggaggtagagagtgtgtgatttctcttcccctttcctttaacagctggg

SEQ ID NO: 6781484 - DNA, 56 bp, Homo sapiens
ctgcccttgtcctgcaggtggctgggagcccgagccccacacctgccgggcagcag

SEQ ID NO: 6781485 - DNA, 130 bp, Homo sapiens
tccccatctgcagaaaggatctgggcacccttcctccagcctaagcctcgcctggcccccaggagtgtccaagtcatcctagggtcagtgtggcaggagaaggaggtgcctgtaggagagatgcagccga

SEQ ID NO: 6781486 - DNA, 105 bp, Homo sapiens
cattgtcctactttttaggggcaaatttgtcttaagacacccatctgcaatacaaaaataatggataggtgtttcataaagtttgtcctgagaatagagataatg

SEQ ID NO: 6781487 - DNA, 70 bp, Homo sapiens
gtcgtgctgcccctcagatattgctggagggaatgtaaaatggtgcagcaactttggaaggcagcttggc

SEQ ID NO: 6781488 - DNA, 64 bp, Homo sapiens
aaggtctcaagttttccaaagtgtgagagaggcaccatgaattagtggagaaaactgggacttt

SEQ ID NO: 6781489 - DNA, 78 bp, Homo sapiens
caggatcttctcctgcttcaactgatggacacgctcaatgtgtctaagaggtgttcagtgctgttggaggagactctg

SEQ ID NO: 6781490 - DNA, 64 bp, Homo sapiens
aatgatagcaccttagaccagcaagatattttttggaagtcatcttgagtctaagattatcatt

SEQ ID NO: 6781491 - DNA, 58 bp, Homo sapiens
ggtgagagctgctccagatctctctgtcacacagaagagacacggaacattctcagcc

SEQ ID NO: 6781492 - DNA, 86 bp, Homo sapiens
tgggtctgaagactgctgagaagttactcccaagactttgctcttcttctggtaatttaatcttcttagctcttcttcataattca

SEQ ID NO: 6781493 - DNA, 74 bp, Homo sapiens
gtagttttctaattctgtaaatgccaagtcaaatgatcctttttatctctggcttttatgggatgagagcttac

SEQ ID NO: 6781494 - DNA, 62 bp, Homo sapiens
gggctgctgccaatcacagcctcccagcatccagggctcagaggaagatgggcagcttgtcc

SEQ ID NO: 6781495 - DNA, 59 bp, Homo sapiens
aatacaatagtatgtataaatacctagacctttgctgggtatataggaaatattgtgtt

SEQ ID NO: 6781496 - DNA, 63 bp, Homo sapiens
gaaatgttttgtttgtgactaagcataccatagttgggtgctttgcaaataatagaatgtctc

SEQ ID NO: 6781497 - DNA, 58 bp, Homo sapiens
aggagccctccgttgcttcatcctcactaaccctgtcccagagcagaggagggttttt

SEQ ID NO: 6781498 - DNA, 65 bp, Homo sapiens
agatccttggtgtttatggagtgcttgctggccctaagatattttctctgagcccaccaggatct

SEQ ID NO: 6781499 - DNA, 60 bp, Homo sapiens
ttccagagaggctcatgttccctcgggtactggaacaaaatgaaagcttttcaagtggaa

SEQ ID NO: 6781500 - DNA, 122 bp, Homo sapiens
tctttgattttcaaattattatttatacttacttagcattatgtaattactaggactgagaattcagaattaggagctataatgtgaagtctaaagtttctggatctgattaaaatcaaaga

SEQ ID NO: 6781501 - DNA, 84 bp, Homo sapiens
tccaaagaggagcctttgaagccctcagagatcttcagagcaaagtgctgggtgaggtcagggcattcaagaggcctggatgga

SEQ ID NO: 6781502 - DNA, 102 bp, Homo sapiens
tgtaaaagacacttacatttgggtattctgtgattgacatgtggctttataatggttttctggttcttcagtcacatcacagaaattcccatgtcttcaaca

SEQ ID NO: 6781503 - DNA, 76 bp, Homo sapiens
tcctttggtggtataatgtttgtgtgattatttgttatctgtgtagctttgcattgatgtctatacgctgaaagga

SEQ ID NO: 6781504 - DNA, 81 bp, Homo sapiens
catcttaattcctagaacctctgattatgttacttgtcatggcaaaaggagctttgcagatggattaaggaccttgagatg

SEQ ID NO: 6781505 - DNA, 82 bp, Homo sapiens
tggtttgagaagactcttggtcattggcattaagtgatatatggcttttcatgcacaaatgagcaaggaaaatttcaaacta

SEQ ID NO: 6781506 - DNA, 56 bp, Homo sapiens
gtcatggaaggagtggccaagtggagtttctgtctgcacagcttgccttttatgac

SEQ ID NO: 6781507 - DNA, 84 bp, Homo sapiens
cctgggaaccttgttaaaatgcagattctgattctcaggtctaggctggagataatgattctgcatttctaattaactcccagg

SEQ ID NO: 6781508 - DNA, 82 bp, Homo sapiens
aggtagcctgatacagaagttttccacttatttagccaatttgacttaggtgctaatctttcttatgttaaaagtgctatct

SEQ ID NO: 6781509 - DNA, 61 bp, Homo sapiens
cctgtttacatcatcaaggacttcctattttgcttagggtaagtccaaaatgtgtaatagg

SEQ ID NO: 6781510 - DNA, 129 bp, Homo sapiens
gtgtgaggtaggtttacgtatgaaattcctgggccgtcatgtcattttgcattaaaccatcaatttcttggtctgagatgacaagcatatgacacgtccaaataatttttctgtcaagtctattcagac

SEQ ID NO: 6781511 - DNA, 57 bp, Homo sapiens
tctcccaatcagctgctaagtgtgttttcctcctcaagtagcagctgccaaaggaga

SEQ ID NO: 6781512 - DNA, 63 bp, Homo sapiens
gagagggccagggtgagaactaatgttcaagagagtgagattttgtaatcctcttgccctctc

SEQ ID NO: 6781513 - DNA, 62 bp, Homo sapiens
tgaagtctttcagggctagaatcaagtctctggcatttttttctagttctgaaagcctgaca

SEQ ID NO: 6781514 - DNA, 129 bp, Homo sapiens
ggcccagtagatgcagacaatcttgggtgaaagtgggaccggagctgccggcccacagtactacttgtgagaagtagcaccatacccggcagctcgagactcacattcaccacattgtgggtggggggc

SEQ ID NO: 6781515 - DNA, 110 bp, Homo sapiens
actatgtttgccaggctggtcttgaactcctgacctcatgatccacccacctcggcctcccaaagtgctgggattagaggcatgagtcactgagcccggcctgacatagt

SEQ ID NO: 6781516 - DNA, 60 bp, Homo sapiens
ctcctagagattggatttaatggccaaatggctggatttggccgtgtccatgtctcagag

SEQ ID NO: 6781517 - DNA, 76 bp, Homo sapiens
ctgttttctgagttagaattccttctgataccagcacaaaatgaatcagcagctaaggaactaacaatcagtccag

SEQ ID NO: 6781518 - DNA, 56 bp, Homo sapiens
gggccttcagccttggactgagaattacaccattagcttccttggcgctgaggcct

SEQ ID NO: 6781519 - DNA, 71 bp, Homo sapiens
ggtggttttgctttattattattattgttattattattagtagcagtatattttaaggaagcttttttatc

SEQ ID NO: 6781520 - DNA, 73 bp, Homo sapiens
ggtaaatgcattctcggtttgtgtgttggaaaatcttggatcttatgtccaatacataatttaaatgtatacc

SEQ ID NO: 6781521 - DNA, 71 bp, Homo sapiens
tggagtatcaagagtattgacaagaccaatttactgattgattggtttatatatcacatctgattgcttca

SEQ ID NO: 6781522 - DNA, 95 bp, Homo sapiens
tcagaatatgtttagatataatgtctttgttgaaatctggtaaaatgttcagatgactaacatagtattgctgtcttcaaggaaataatgtttgg

SEQ ID NO: 6781523 - DNA, 70 bp, Homo sapiens
gctgttgcattacatttgctcagtctagttatgtctcttatattttgagacttggaaatggaatgtcagc

SEQ ID NO: 6781524 - DNA, 98 bp, Homo sapiens
agaagataaggttttccccagcctcagtctctgtatcctgagattttgccagataggttatagaaactgaggctcttccgggaaaacacccaacttct

SEQ ID NO: 6781525 - DNA, 63 bp, Homo sapiens
gaggcaggcagagcaactggtccagagtgagttcactggggtccagaggttttggctgacatc

SEQ ID NO: 6781526 - DNA, 57 bp, Homo sapiens
atagcagggattaaagtttttctgggataccttagaagttctttcttctcatgctgt

SEQ ID NO: 6781527 - DNA, 67 bp, Homo sapiens
ggggagtgttttcatgggcttgaaatgcagttcaaaatctgttaaagggtaaggaaaatgattcttc

SEQ ID NO: 6781528 - DNA, 67 bp, Homo sapiens
acagagcatataaagtgctttgcatagactttgtacaatgtctgtattaagcagtttatatatttgt

SEQ ID NO: 6781529 - DNA, 67 bp, Homo sapiens
cctggctaaggctatgtgttaaggcagattgggaaatcccagctgcctcacctatgaccttgccagg

SEQ ID NO: 6781530 - DNA, 75 bp, Homo sapiens
aggggagctgcctgagctggcagagcttgctgagccctcctgcttgctgagccctcctgcttgctgagccctcct

SEQ ID NO: 6781531 - DNA, 88 bp, Homo sapiens
atgaatgctctgatctggagaggtcttcacaaagaacagcaggtgcctgtgggtttttgtgaagatctctccagatcagagcattcat

SEQ ID NO: 6781532 - DNA, 69 bp, Homo sapiens
cctgtcatgaagcctgctggaccaagctcatgctgtagccagtacaagtgaaatcagaggctttgcagg

SEQ ID NO: 6781533 - DNA, 62 bp, Homo sapiens
cttgttcagtcctgacttcctgacagatgccattattcgcatttaaggaagcaggaaacaag

SEQ ID NO: 6781534 - DNA, 62 bp, Homo sapiens
ggcctacccaacagttctcatagcagattcctacaacatggagtcctgagtactttgggccc

SEQ ID NO: 6781535 - DNA, 60 bp, Homo sapiens
ggaggaggggtgactgaatgctttcccgcactggttgcattcatagggtttctctccacc

SEQ ID NO: 6781536 - DNA, 96 bp, Homo sapiens
tcccattcgcgctaccaccgcggccgcagccccaggagtcgccgcggagccagcgtcgccctccagctgttgcgcgtcggaagccggaagcaggga

SEQ ID NO: 6781537 - DNA, 59 bp, Homo sapiens
cagttctacccaggtataaatgcattatcctcatatctgcaccacccgtgggaggactg

SEQ ID NO: 6781538 - DNA, 57 bp, Homo sapiens
gctctaattgaaaaatactgcactttaatgtctgcattgcagtttcaggacgagagt

SEQ ID NO: 6781539 - DNA, 56 bp, Homo sapiens
tttgaatgctgtgatttattaagtatcaaaaatgcttgaaagttatttcatttgaa

SEQ ID NO: 6781540 - DNA, 62 bp, Homo sapiens
ataatatgattagttgaggcagacttacagtcttaagttagcttcagaaatatcatcattat

SEQ ID NO: 6781541 - DNA, 69 bp, Homo sapiens
cttcccatgtctagcttcagggtcaaggtgctcattcacccagctactgatgatgttggttgtgggagg

SEQ ID NO: 6781542 - DNA, 56 bp, Homo sapiens
agggatgttggaaaatgcagtctttacctgggctgtcctatgcagctaaaattcct

SEQ ID NO: 6781543 - DNA, 87 bp, Homo sapiens
tatgatgccctggtcttgccaagttcagggagctgggtgccaagtctatcagcattcctctggggccaggccaacaaaggtagcgta

SEQ ID NO: 6781544 - DNA, 118 bp, Homo sapiens
gccggcagagatcctggtggaggcagatcgcttttgcgccagtagctggtggtggcttttgatttggaagcttcctcgctgggcagaggcagaccagctctactgtagggctgcaggc

SEQ ID NO: 6781545 - DNA, 66 bp, Homo sapiens
gggctgtgtgcagtacgggtcccctgaccagtatgcaggtcattaaaccaaaccgcatgctagctc

SEQ ID NO: 6781546 - DNA, 71 bp, Homo sapiens
aaagtgtgcgtcttatttcagggcaaagttcttaagtgaattgtcaaacacaaataagagtcgcacgcttt

SEQ ID NO: 6781547 - DNA, 59 bp, Homo sapiens
gtaggaacagcttccttggtattagaataccaacaaacacaggaaggtgcacatcttac

SEQ ID NO: 6781548 - DNA, 92 bp, Homo sapiens
taggggttggtaaactatggcttctgggccaaatttagcttgctgcctatttttatatggcctatgagctaagaatggttttcacatcctta

SEQ ID NO: 6781549 - DNA, 59 bp, Homo sapiens
agaaagcccagtgtaaatggaactcaactttaatttgagcagagatgactgggcatttt

SEQ ID NO: 6781550 - DNA, 71 bp, Homo sapiens
ggtaggaggctcacttaagcccaggagtttcaagatcctcctggacaacatagtgagacctcatctctact

SEQ ID NO: 6781551 - DNA, 75 bp, Homo sapiens
ataacatgatgttaacttggtagtctaagtgtttagctatcaagccggattccttagtagaccaaatcttgttat

SEQ ID NO: 6781552 - DNA, 66 bp, Homo sapiens
tctctagcaaagacgcttccttaacggcgccactgctccaggatggggttgaggtgttgctgggga

SEQ ID NO: 6781553 - DNA, 67 bp, Homo sapiens
tgatgtctgcattattggaaagtccttcatgttgagatgaaagtttcccaaagtaatgtgaatatca

SEQ ID NO: 6781554 - DNA, 66 bp, Homo sapiens
aattacagatcagttattttgtagactgtccctcaatttagggttgtctgataactggttgtgatt

SEQ ID NO: 6781555 - DNA, 80 bp, Homo sapiens
acctgaagtggaattgctggataatatcagatagagtttctttttaaggtgatgaaaatgttcagcaattaaataatggt

SEQ ID NO: 6781556 - DNA, 62 bp, Homo sapiens
gctgaactctggaagggtgaggctgtgtctagcttgctacagctgtatccccagagctcagt

SEQ ID NO: 6781557 - DNA, 76 bp, Homo sapiens
tcacattgtgataaaatgctgactccactgacggatcctgctggtcagtgatttcatcattttatcaagcatgtga

SEQ ID NO: 6781558 - DNA, 69 bp, Homo sapiens
gtagaaagaaattcagattggctgccttatcagctctcactatgatcaagtagcctggttcctttctgc

SEQ ID NO: 6781559 - DNA, 64 bp, Homo sapiens
ggactgggagaatggaggcaagaaaagggcatagtttgactccctctgtgtctcttcccagttc

SEQ ID NO: 6781560 - DNA, 66 bp, Homo sapiens
gggtctgggtaataggaagtgcagtgacatgcaaactgaaccttatttgcctagaaaaagaacccc

SEQ ID NO: 6781561 - DNA, 61 bp, Homo sapiens
gggtgaataggggaaggctatttatttatttattttgagacagagtcttgttctgttgccc

SEQ ID NO: 6781562 - DNA, 129 bp, Homo sapiens
gtgatgcttgagacaaagtccccattcttgaatggtttctgccaatccgactttgtgaataaactctaatgacaatatttttgagaaaaccatcgtaagaatgccatcaatgtcttggaagtgaattat

SEQ ID NO: 6781563 - DNA, 112 bp, Homo sapiens
gggtgtagtggcacatgcctgtaattccagctacttggaaggttgaggcaggagaatcacttgaacctgggaggtggaggttgcagtgcgccaagattgtgccattccactc

SEQ ID NO: 6781564 - DNA, 79 bp, Homo sapiens
ctcagcagtggagatacaagaggcctgacgtgtattgattgcccacgacatggcaggaatcatgtgttttggctgctag

SEQ ID NO: 6781565 - DNA, 87 bp, Homo sapiens
tctaatttgtaaaagaataccataatatagaaagatgtgtccactgtttgctcttttgtttctatagtatacttggtatgaattaga

SEQ ID NO: 6781566 - DNA, 71 bp, Homo sapiens
ctgcataattagctctttgactaatcttgcttttgccttagggtaagaggcagtttaggatgcaaaagcag

SEQ ID NO: 6781567 - DNA, 107 bp, Homo sapiens
aagcaacagcatagtcatattgtaggattggactattcattgtaggattagacgattcattaagtagtgaatagtccaatcccgcaatctgactgtgcttggggttt

SEQ ID NO: 6781568 - DNA, 69 bp, Homo sapiens
gggtctgtcacttcaggaatgcagggagtgggatttatttgttgtcttgatcccccctgaagcagaccc

SEQ ID NO: 6781569 - DNA, 73 bp, Homo sapiens
gtgcactagtgccaagaacaggtcagtatctataacttttggagccttgcaaaatttttggcaatctgggtac

SEQ ID NO: 6781570 - DNA, 59 bp, Homo sapiens
gccgtcaaagtgtcttgtgctcatctatctccagtacaagtactgtggctttgaatggc

SEQ ID NO: 6781571 - DNA, 57 bp, Homo sapiens
ggtccagcacaacactggcatgagccaacaggagccacgccggccacctgctgggcc

SEQ ID NO: 6781572 - DNA, 77 bp, Homo sapiens
gcctccatggtgctgggtgttcacccgaggcgctccctcgaggacagtgctttccctgaaaccttcccagtggaggt

SEQ ID NO: 6781573 - DNA, 59 bp, Homo sapiens
tattattgaatcagttctttgacaatagcacttctgtttatagtactgattctgtagta

SEQ ID NO: 6781574 - DNA, 60 bp, Homo sapiens
gtgtacaaatggttgaatggatgaatgaatacatttatgaatgctcaactgtgtgtacat

SEQ ID NO: 6781575 - DNA, 71 bp, Homo sapiens
tcctttgagaaaaatggggctccctgtgccaacttttcaagagcttgatggcagggcagcctctcagaggg

SEQ ID NO: 6781576 - DNA, 60 bp, Homo sapiens
gtgggaagtctctcggaggaagtgccaggtcataaatttcacccaacaagaggctcccat

SEQ ID NO: 6781577 - DNA, 67 bp, Homo sapiens
gtgagacctccttgggctgactctgtccctctacctaagatcacagctcctgtaaggtggtcgtcac

SEQ ID NO: 6781578 - DNA, 123 bp, Homo sapiens
tttccatctcctcttgagttctctaaattatgtttggcagtaagcaaaagttaatacactgcctgatgtggttctaaattaatagaagaaatatttaagacaattatacacaggggaaagaaa

SEQ ID NO: 6781579 - DNA, 61 bp, Homo sapiens
tggaatcagaaccactggagggttctgtgttttaacaaacactccagtggattctgataca

SEQ ID NO: 6781580 - DNA, 72 bp, Homo sapiens
acagaattgggctggctgaacttcaacctgatcccatcaggcagggaagcttccagtcaagctgaatgctgt

SEQ ID NO: 6781581 - DNA, 59 bp, Homo sapiens
gtgctgctctgctggagggaaagagaattctgggctgaatttaacagtcatggcggtat

SEQ ID NO: 6781582 - DNA, 95 bp, Homo sapiens
gtacagactgtgcactgcacaactccagggtcaccattcacatagtctgcaatgtgattggcatcccttggaattgtgcggtgcacaacctgtgc

SEQ ID NO: 6781583 - DNA, 57 bp, Homo sapiens
gcagcagaaggccaaggggagccctagagaatcagctgccctttgtcaccatgttgc

SEQ ID NO: 6781584 - DNA, 62 bp, Homo sapiens
ggggcagaggaaggcttcacctgcaaagtagacacttctgggccatggccttcctcagccct

SEQ ID NO: 6781585 - DNA, 75 bp, Homo sapiens
atggtggtttgggagaaaaagcagatcccattgacagccagtattatgctgtgttttctccccagagaccatcat

SEQ ID NO: 6781586 - DNA, 58 bp, Homo sapiens
cctctgcagaagaattaaggacaggctcagtgaggctgcccagcatcctctgcagagg

SEQ ID NO: 6781587 - DNA, 99 bp, Homo sapiens
gtccatatttgtcttatctgtacttttaatgagcattgctgtcttcattttccaaaggcatgcgccaatttattagagtcatagagcaagtttagtggc

SEQ ID NO: 6781588 - DNA, 100 bp, Homo sapiens
atgagactattttgaaagataaacaggattactggattatgacatatatgatagatatgttgattaatttgattgtggtaatcatttcaaaatgtatcat

SEQ ID NO: 6781589 - DNA, 67 bp, Homo sapiens
ggcagatatgtggattctattagccagagcctgattctagaagctgctcatgatccaaattcctgct

SEQ ID NO: 6781590 - DNA, 86 bp, Homo sapiens
tgaggtggataggaaatgctgtcttattgtagttttaatttgcatttctttgattactagtaagattgggtatttttcatatctca

SEQ ID NO: 6781591 - DNA, 66 bp, Homo sapiens
ccactgctctgtgagctcttgatatccttgtttttcaaaagaaggaactgaggttcagagagatgg

SEQ ID NO: 6781592 - DNA, 67 bp, Homo sapiens
ggtggggctggcctctttgcacctctttcttgttacctgacagggctgcagatagccagccaccacc

SEQ ID NO: 6781593 - DNA, 106 bp, Homo sapiens
tctcaccaacatcacattcttttttccatgtattgtctcttccatggatggctatttggaatgatgttaagaagaggcagtacttatggggtggtggagggtgggg

SEQ ID NO: 6781594 - DNA, 69 bp, Homo sapiens
tggccaggcacagtggggtcctctctggtgggtgtgagccgcagggacctgccactgctgtctctgcca

SEQ ID NO: 6781595 - DNA, 80 bp, Homo sapiens
tcactaatcttcctcttataagttttcccaggatttgtgactaaccagaatcctggagaagctgtacctggatacagtga

SEQ ID NO: 6781596 - DNA, 56 bp, Homo sapiens
cagtgggcagagatctggatcaaactgccaccccgtagagtcccttgggcccgctg

SEQ ID NO: 6781597 - DNA, 65 bp, Homo sapiens
gttcttccagagatagggcctcaagtgaggagtttagcgtggccctttacatttactgggtgaac

SEQ ID NO: 6781598 - DNA, 88 bp, Homo sapiens
gggtctcgctctcttgcccagggtggagtgcagtggcgtgatctcggctcactgcaacctccgcctcccaggttcaagagattctccc

SEQ ID NO: 6781599 - DNA, 72 bp, Homo sapiens
ggcctgggccctggtggccatgcctcccagagagcaggtgggccctggaggcaggggccccagccccaggcc

SEQ ID NO: 6781600 - DNA, 61 bp, Homo sapiens
gttcttttctacattatacttcttgaagcttctgttttattcagtttgtgtagaggtgaat

SEQ ID NO: 6781601 - DNA, 55 bp, Homo sapiens
cctggccaggcggcccctgcatgctcaggtgggcagtgctgagagcctggccagg

SEQ ID NO: 6781602 - DNA, 71 bp, Homo sapiens
ggctgtgagtgtctattaacacgtgcacttttgcttcacaaatggaggaaaaacctgttaatggtagagcc

SEQ ID NO: 6781603 - DNA, 65 bp, Homo sapiens
gcattttaggagatcactgagcacaatctgccatttgcccaagtgctggagactcactcaggtgc

SEQ ID NO: 6781604 - DNA, 60 bp, Homo sapiens
gtggtagtactgggtcaaagggtgagattgttcacaaggctcttgattcatattaaccat

SEQ ID NO: 6781605 - DNA, 57 bp, Homo sapiens
gcaagggtccagtaacagatgccagatattcttcaggtgattatactgggctttggc

SEQ ID NO: 6781606 - DNA, 82 bp, Homo sapiens
ttgatgaaacatgggcagtttgggaaaatggtctgaacctccaagtatcagtgttccttgagactgccaattgatacattaa

SEQ ID NO: 6781607 - DNA, 56 bp, Homo sapiens
gagcaagattctatctcaggcaaaatccagtgttggcctggcaggtggaagggctc

SEQ ID NO: 6781608 - DNA, 68 bp, Homo sapiens
gtgagttggggtcccactcagctcccctggcagcgggctccagaggggcgggaactcaacctcatcac

SEQ ID NO: 6781609 - DNA, 57 bp, Homo sapiens
ctgagtgtgagtgcaccagtgtttctcattcatgttactgtgtactcatgtcctcag

SEQ ID NO: 6781610 - DNA, 72 bp, Homo sapiens
tcctaggtagtgacacagtagaaagatgatgagccagtaggactggttctgccactagtggttaccttagga

SEQ ID NO: 6781611 - DNA, 88 bp, Homo sapiens
catttctttccacaaagtgttttcttattatttttcctagtcattcctcctggtgtccctgggagatgatgatgagggggtagaagtg

SEQ ID NO: 6781612 - DNA, 57 bp, Homo sapiens
gggcaagagaggaagacagtggcatgagaaaggccatgtcaagactatactttgcct

SEQ ID NO: 6781613 - DNA, 89 bp, Homo sapiens
tcagtgtatacaacaatcatttttccccttcagttctgctgctttatacaacagtgtgattgacagaaaattggatggcatgtgcctgg

SEQ ID NO: 6781614 - DNA, 59 bp, Homo sapiens
aattgtacaagccttgtgccatagttaccagctttgtgcatgtctgggcctgtaagatt

SEQ ID NO: 6781615 - DNA, 89 bp, Homo sapiens
cctgtcctgctgcacccctgccccacaggcttggtagggccaaggccctcagccgccctgccggggcccctggtgtagggcggggtggg

SEQ ID NO: 6781616 - DNA, 73 bp, Homo sapiens
gtgtgccatcaaagtatctcaatatggtagaattttttctcctttgtggaaatacttgtggtgccatgtacat

SEQ ID NO: 6781617 - DNA, 69 bp, Homo sapiens
ctgggcctggtagggcttgaaacatgaaagaacaatgaaaagttaagcattaagcattattactcccag

SEQ ID NO: 6781618 - DNA, 89 bp, Homo sapiens
aagtttgacctttaaatccggagggcctcaggtagatatctaaagaaattgttttcctgagggacttttgagatttaagacacaagctt

SEQ ID NO: 6781619 - DNA, 92 bp, Homo sapiens
acagatgtattcctgaatgagttgatcacaatctgaatttttgtaaaccatgccagagttgcgattcacaacatttctgggaatactactgt

SEQ ID NO: 6781620 - DNA, 74 bp, Homo sapiens
ggttggtgcaagtgtaattgtgatcttttcccttactttcaatgccaaaaatcacagttacttttgcatcaacc

SEQ ID NO: 6781621 - DNA, 56 bp, Homo sapiens
gcctggcttttgtttataaattctcaagggagttctccttcaacaggagccaaggt

SEQ ID NO: 6781622 - DNA, 68 bp, Homo sapiens
gcatctgttagagtgtgcatgcgggccgtggggcctcacagcatgtgtgtgcacaatctggcatgtgc

SEQ ID NO: 6781623 - DNA, 80 bp, Homo sapiens
cctggagggaaacatgggcagaattgtggtagttaaagtctttgtttggaattaacttttatttctgctcgcccaccagg

SEQ ID NO: 6781624 - DNA, 87 bp, Homo sapiens
aaactccatcattctgactctccattagtctttggtaactggctctgcatctatcagaaggcacatggagtctccctgattaagttt

SEQ ID NO: 6781625 - DNA, 57 bp, Homo sapiens
gttgcaggatgattttataagggggaccttattttctatgaaagtcactacttcaac

SEQ ID NO: 6781626 - DNA, 103 bp, Homo sapiens
ggagcagtaagagatgtgcagatgagggatgaaaatgaaggcaagaccttttattctacacatttttataacttgattctgcattcaaattttttgatcatct

SEQ ID NO: 6781627 - DNA, 83 bp, Homo sapiens
gagtcactgaaagctcgggtaggtgccagcgtctgttcccagactgctcacgcattacttgagcaggacatggatggtgactt

SEQ ID NO: 6781628 - DNA, 72 bp, Homo sapiens
gcttgagtccaggaggttgagactgcagtgaactgtgatcacatcactgcactccagcctgggcaaaagagc

SEQ ID NO: 6781629 - DNA, 95 bp, Homo sapiens
gctttggactcacactgaaacactggctagtactgggtcttgaggctattggccttagactggagctatgccgtcagcgcttgtgagcccccagc

SEQ ID NO: 6781630 - DNA, 104 bp, Homo sapiens
gcatctgactgagaaggcctcagtaattcattaatttcagggtagtaaatcttttcagctgtgtaaatggactgtgaattacaagagtctctcagatcagaagc

SEQ ID NO: 6781631 - DNA, 64 bp, Homo sapiens
tctctgagaatatcccataagagcccttgatgcagaggccatatggcatggtacttccagcaga

SEQ ID NO: 6781632 - DNA, 61 bp, Homo sapiens
ggtcatgcagctagattttccagtgtcatgacgctgatgctgagcagagctgacatgcact

SEQ ID NO: 6781633 - DNA, 71 bp, Homo sapiens
gggctcagcaaacccagtcttccccgcagtcttacctggagccattgcctggggaagagggtgttcaggcc

SEQ ID NO: 6781634 - DNA, 85 bp, Homo sapiens
gttagggatatttctggattttaaattttctctgtagagtttgaacaaggtggagaaaatttgaagtttatggataaaattagac

SEQ ID NO: 6781635 - DNA, 55 bp, Homo sapiens
tctgctacagggaaggaccccttgtcagcaccttcagggatttctttgtagcaga

SEQ ID NO: 6781636 - DNA, 74 bp, Homo sapiens
gaatattgcctcagtgtagcaggcttcttagcattcaattgctgcagaatttccttctcattattctaatattc

SEQ ID NO: 6781637 - DNA, 64 bp, Homo sapiens
tcctagaaacttaactgtcattcttagtatttcatttctattaagtgattccaagtttcaggga

SEQ ID NO: 6781638 - DNA, 76 bp, Homo sapiens
gagtagaaggatgagacaatacgaaggccagaagaggaatacttttttcctagcgatttgtcagcattcagtattc

SEQ ID NO: 6781639 - DNA, 61 bp, Homo sapiens
tgcttgattagggaagtcacatcttcagttttactagatagtgacttttcaagtctttgta

SEQ ID NO: 6781640 - DNA, 61 bp, Homo sapiens
actgtggcacagaaatgttgactgttaataacttgcccaacgtcaatgtctggccaatggt

SEQ ID NO: 6781641 - DNA, 63 bp, Homo sapiens
acagggcccttgccagcacaaggtctagggaaagagcaatgctggaggtgtggcaaggtctgt

SEQ ID NO: 6781642 - DNA, 83 bp, Homo sapiens
gtgggtggggcagtgggaagtgtgcctgggggggtccgtggacgattcctccttcgggactgcttgaccactgccttccccgc

SEQ ID NO: 6781643 - DNA, 111 bp, Homo sapiens
tgaccatctggagaaaattgctgttgggtgactcttcagactatccagggcaaaagtagccaggagagcagtcagttatgcatgtatatttttcccaaggtaaataggtta

SEQ ID NO: 6781644 - DNA, 58 bp, Homo sapiens
ccagttcttggacactctggagtccatcctgagactcactgggtcccggaagccctgg

SEQ ID NO: 6781645 - DNA, 129 bp, Homo sapiens
gttcaactttcaactcttaacatgtgctgcttgatttgaatttgaaacttggcactgtgtgtcctcctgtgcctggttattattcttggaatgcaaaaaggtacatgtttttgtaattctctgaggaac

SEQ ID NO: 6781646 - DNA, 57 bp, Homo sapiens
tagatgctgtgggcacatggaaaaacataacttatgtttcctaatacacagtgtctg

SEQ ID NO: 6781647 - DNA, 58 bp, Homo sapiens
gagccctgtagcaagtcatgtccctgtaacgatgagtgagctgacagctaaggggctt

SEQ ID NO: 6781648 - DNA, 55 bp, Homo sapiens
atggttggtgcctctagaggtagccattaagcatatggtccttggcatcagctgt

SEQ ID NO: 6781649 - DNA, 60 bp, Homo sapiens
ttctgaaagtctttttaagttaattgaattattccaattgccttagagaaatatttagag

SEQ ID NO: 6781650 - DNA, 78 bp, Homo sapiens
caggtgctgcttccttcctctaaggacctagtgaatattgagatgttcctgacggccaaagaggtggaggagtccctg

SEQ ID NO: 6781651 - DNA, 95 bp, Homo sapiens
taattccagttgatctacattctcaccaatgtttggtatcattgattttgttcattttaaacaacatggtgggtgtgtagtcatattgtgggtta

SEQ ID NO: 6781652 - DNA, 62 bp, Homo sapiens
gcaagttgttataaaaaagcaagtttagatgtagtctaaacacttgaatgtgtagcagctgc

SEQ ID NO: 6781653 - DNA, 73 bp, Homo sapiens
ggacatataggtgcttcctgtcttttgctgttgtaaaagcaatgtggcaatggttagcactgtacatatgtcc

SEQ ID NO: 6781654 - DNA, 75 bp, Homo sapiens
atgctcagagaaccactgacctcggggcatgtagttaacacctgcagtgcttgaagaggtggccagtttgaatgt

SEQ ID NO: 6781655 - DNA, 70 bp, Homo sapiens
agtgactatgactgcaagatcactgtgtgcagaaatctctagaaatgtgtgtcttgtagctcaagttatt

SEQ ID NO: 6781656 - DNA, 121 bp, Homo sapiens
ggatgagaaaagactggcccacaacttgagtgcattgttcactgtgaatcttgataataacaggtatccctcatcaagcacttctacatgacatgcactgtgctcggcttaaaaaacatct

SEQ ID NO: 6781657 - DNA, 89 bp, Homo sapiens
cagtgttttttcaacatcttagaatttcagtgtttccaggtttgtgaaatgcccctgggtgaatgatattctaaatgccaaggacactg

SEQ ID NO: 6781658 - DNA, 55 bp, Homo sapiens
ggggtttgctatgttgcccaggctagtctcgaactcctgggctcaaagcatcctc

SEQ ID NO: 6781659 - DNA, 57 bp, Homo sapiens
gctgcagatcccacccattcccagagaccagggctgaggacagtgtgatctgccagc

SEQ ID NO: 6781660 - DNA, 123 bp, Homo sapiens
cccatgctgaggcagacgccaagaccctgggcacttgctcacagctcttcagacaccacaagctgaacaggagcttccctgtgagagggcctgtgggactttcactaaatttgcctcagtggg

SEQ ID NO: 6781661 - DNA, 62 bp, Homo sapiens
ctggggtgctttctgaagcacacggaagaaccacctgctgcttctgatgtgagcagccccag

SEQ ID NO: 6781662 - DNA, 76 bp, Homo sapiens
gggtcctgtgggagcattgctttgtgtatctattattccttcattttacagagctctctttgctactacagtgttt

SEQ ID NO: 6781663 - DNA, 60 bp, Homo sapiens
ctcaggcagttctgtagcctccattccctgtttatggagctgcaagactccctgtctgag

SEQ ID NO: 6781664 - DNA, 69 bp, Homo sapiens
cattgaccgaacacgtcataaatgccagaaactactggacattttcacctgtgacacatttggtcattg

SEQ ID NO: 6781665 - DNA, 55 bp, Homo sapiens
tgttagccatactaagcaggtacgcacaacaacgtgattgctttgtaagcttgca

SEQ ID NO: 6781666 - DNA, 109 bp, Homo sapiens
atgggcatgtagtacaccagtgaaagacttccctagttctaagtctgtttctgcagcgaaacagactcacagctagagaaggagaaatgtgtctctgcttcttgctcat

SEQ ID NO: 6781667 - DNA, 79 bp, Homo sapiens
gctcagacacaacacctaaaaatcattgttgacccctccctgggatcaactctgtctgggatgtagctctggtctgagc

SEQ ID NO: 6781668 - DNA, 114 bp, Homo sapiens
cacgttttcctccttatctgcttccctggtgtttattgaatgatactgtacccaaaaccctgtgatagacactgtatgagctgggtggggaggatacaaggaatattagacgtg

SEQ ID NO: 6781669 - DNA, 57 bp, Homo sapiens
aggtaagcatggtggctgctgtgggtgcccaccactacacatctttcacgtttgcct

SEQ ID NO: 6781670 - DNA, 71 bp, Homo sapiens
ctgaaagtgtgatgatactagttgacataatccatacatttacttcatcatgagtgtcatcagctactcag

SEQ ID NO: 6781671 - DNA, 78 bp, Homo sapiens
ttttccttttttcttgtgcctaattttgggccagttcttctggttagatgattgaggtgaccagaacatacaggaaaa

SEQ ID NO: 6781672 - DNA, 61 bp, Homo sapiens
tgagacaataaggctgagaagctgagaatttgtgaagcattaattttagtttattgtctca

SEQ ID NO: 6781673 - DNA, 77 bp, Homo sapiens
ggacccttattaaggcgttggcgtgcttatttatggaacattaaataccgtttgtttgcgctgtgacgaggccatcc

SEQ ID NO: 6781674 - DNA, 81 bp, Homo sapiens
tgatagataactggagagagcatgagtcaaatggagcaacaaggagcacgctggctcagatgctcttccagtgcaatatca

SEQ ID NO: 6781675 - DNA, 60 bp, Homo sapiens
ggagtggggagcgaggctcagccctgtcctctggacagcctggactggctctctgcatct

SEQ ID NO: 6781676 - DNA, 55 bp, Homo sapiens
tctcagacactcagctgcaattcttgttaaaagcaacaggttgagtaatctgagg

SEQ ID NO: 6781677 - DNA, 66 bp, Homo sapiens
ggtgggtggaaacagcatgtaccttgccattggagaagctgggtttatgctgtgattcacccagcc

SEQ ID NO: 6781678 - DNA, 66 bp, Homo sapiens
ttcagttgtttattcttcagcaacatctgagtatcctcgagaaatgagtggaatgaaccgctagag

SEQ ID NO: 6781679 - DNA, 60 bp, Homo sapiens
ctcacatggtggaaggggctatctttctccctgtggcctctttaatcccatccatgtggg

SEQ ID NO: 6781680 - DNA, 69 bp, Homo sapiens
gtctgtgacgctgcatccattctgacaggcccttctgtccctcagaatgttcctgctgtcagtccaggc

SEQ ID NO: 6781681 - DNA, 91 bp, Homo sapiens
tctggccctctgcagtcttggtctccctggcagctccctttcaccaaaggaccagctgggcactatggggatttgattgaagtaggcagga

SEQ ID NO: 6781682 - DNA, 72 bp, Homo sapiens
tttccactgagccaggagcaatatcatccatgaaaagatgagatggcggtgtagctaggcaagaactggaga

SEQ ID NO: 6781683 - DNA, 65 bp, Homo sapiens
cggctcgggcaccctggttctggtggctgtgctgacccacactctcctccgggctgcccgggctg

SEQ ID NO: 6781684 - DNA, 58 bp, Homo sapiens
ctggctgaagggagtgctgagtctgtgggagccatagcccgccccaccctttaggcag

SEQ ID NO: 6781685 - DNA, 130 bp, Homo sapiens
tattgtattttaattgtatgttatccttcctttgcatcatttctagaaagttaattttaatgatactaatgactgaagctgagtttgtgcatagaggaagaatcagataaaatagaaatctcatataata

SEQ ID NO: 6781686 - DNA, 78 bp, Homo sapiens
aatattcaaatgtacagtggaaaatggattcgttgtgtaaatttcacaatggtcagcatgctttacttatagaatatt

SEQ ID NO: 6781687 - DNA, 129 bp, Homo sapiens
cacttccattttccttcccacccttaggtttaaacatctggagcttaagcttatataaatgatcccatgctgccagtttttatgactaagctgttccagttagactcagcttctaggaattacgaattg

SEQ ID NO: 6781688 - DNA, 61 bp, Homo sapiens
ttctgccttagtgactaaagcacacacaatcatgtgggcaaagggactagggccattagaa

SEQ ID NO: 6781689 - DNA, 64 bp, Homo sapiens
ggccagttggagacccttggaaagcccttcaagtgagagcatgaggcttggatctagacaggcc

SEQ ID NO: 6781690 - DNA, 84 bp, Homo sapiens
atgactgggcctatgaataacaggtggacacagcagcagtctccttcagcactgcttggtgtgtcccttgatacggctcttcat

SEQ ID NO: 6781691 - DNA, 59 bp, Homo sapiens
tttattgacccaaagcgagagtcaatatttaccttggctctcactctatggtcagtaaa

SEQ ID NO: 6781692 - DNA, 72 bp, Homo sapiens
aggcccactaagctgtgtggttcactcagcatcacgtggctaatatgatatgaagccacactagcttgtcct

SEQ ID NO: 6781693 - DNA, 88 bp, Homo sapiens
tccagagccaccggctgtgtcccacacgaggtgtatgtgtctgtgtgctcatgcttgtgtctggacatgcactgcatgtggctgtgga

SEQ ID NO: 6781694 - DNA, 79 bp, Homo sapiens
ttctttaggaattagtttactccttactaaaaggaacatagcatcacagttgtttccagtgtggagatgatctaaggga

SEQ ID NO: 6781695 - DNA, 62 bp, Homo sapiens
agtgcttcttaaacctttctacttatattccccttaaaagtagaagacaagaggaaggcatt

SEQ ID NO: 6781696 - DNA, 115 bp, Homo sapiens
agtgatatgctttatcgttgttgtagtgagtggtaattaggaataaaatgggaaacaattcccataaaagattgtgattagcattgattatgcagacaacccgaggttttccact

SEQ ID NO: 6781697 - DNA, 69 bp, Homo sapiens
ggctatgtgatcaaaaaagtttggagatttcatttttaaaaatctttaactttgagagatcatttagcc

SEQ ID NO: 6781698 - DNA, 66 bp, Homo sapiens
tgtgtcagcacagtatcaattacccagaccatatctgaaggcctaatatatgcatgtgctggcata

SEQ ID NO: 6781699 - DNA, 57 bp, Homo sapiens
aggcacaggtcaaatctgactcaggaagaaaacttcttactatgatttgagcctcct

SEQ ID NO: 6781700 - DNA, 60 bp, Homo sapiens
gcagagggcgatggtttcagtttctccccaaaaaagatagctgtagtcgttcctccatgc

SEQ ID NO: 6781701 - DNA, 59 bp, Homo sapiens
tgctctgtgagtctctgtgcttttctactgggctgtgggcagcagaggcttgacagaca

SEQ ID NO: 6781702 - DNA, 92 bp, Homo sapiens
gatggtccagttcacagccacatcaggtaataggctctttttaagaaacttgacatgcttgttttccttgaagtgcacttgaactgtctttc

SEQ ID NO: 6781703 - DNA, 87 bp, Homo sapiens
gccactgcttcaatgatattatatatcatctgcctcatcactgcatgccctgctggcatgtgtggtcagatgatatctgcagctggt

SEQ ID NO: 6781704 - DNA, 58 bp, Homo sapiens
gctccagccacatggtagaaggttgatgataaataaatggtggcctgtggttgggagc

SEQ ID NO: 6781705 - DNA, 106 bp, Homo sapiens
gtcatgagttcagtgttaatcaatcaacagtattaaataaggtgtctttaaacagaaaaatacaaaacatggtgatgttttgattgattgataaatatattgtgac

SEQ ID NO: 6781706 - DNA, 61 bp, Homo sapiens
gagagtcgcctgcacatgtcagggttagccagggagccatggcaggaaccaggaggctctc

SEQ ID NO: 6781707 - DNA, 62 bp, Homo sapiens
cacctaggagttgaggtggccagatttggtgttccagtatctaatcaccagatttgtgggtg

SEQ ID NO: 6781708 - DNA, 85 bp, Homo sapiens
tttgaacaaatgtggtttctcagcattctctgtgcaagatgcccattttgaatgattcctgagagatcctaaacttgtgttcaaa

SEQ ID NO: 6781709 - DNA, 79 bp, Homo sapiens
tggggctttggggaggggattaggctatgagggtaaagccttcaagactgcgactaatgcccttgtaaaagaggcccca

SEQ ID NO: 6781710 - DNA, 59 bp, Homo sapiens
acattttgtagtattttgtttgagatagttcagaagacagttgatatactataaaatgt

SEQ ID NO: 6781711 - DNA, 60 bp, Homo sapiens
aacagacagcgtttgcggcctgaaaactgagaagcctatttcagcagcatgttgtctgtt

SEQ ID NO: 6781712 - DNA, 56 bp, Homo sapiens
ggggcaaaaaaagggagttatttaatacttcccctaataactctttccttttcccc

SEQ ID NO: 6781713 - DNA, 72 bp, Homo sapiens
tggtacaaacagcaggagtatctgtagtagcagtagcggcaactgcaggatgtgctcctattgtctgtgtcg

SEQ ID NO: 6781714 - DNA, 81 bp, Homo sapiens
gggtcttggatttatgtttgagtatatgactcagatgcaattttgaattatattcacgagcaaattctttatctcagattt

SEQ ID NO: 6781715 - DNA, 58 bp, Homo sapiens
gtctcagaaagattccctttgaaactcacataaaacaaaattggttcctttctgaggc

SEQ ID NO: 6781716 - DNA, 70 bp, Homo sapiens
tcagatgtctctgttatctcaagtcacaagagtgttgactttctttgcttgcattaggtaacatatttga

SEQ ID NO: 6781717 - DNA, 82 bp, Homo sapiens
ctctgctccactgtcccatgggacttgatttacaaaatacaaagatgaaattgtttaaaagttcaaggtgatagtggcagag

SEQ ID NO: 6781718 - DNA, 55 bp, Homo sapiens
gcctgggaaatggtggggtcagtggctggcagctcacaatctcagttcctcaggc

SEQ ID NO: 6781719 - DNA, 129 bp, Homo sapiens
ctctaagcatgatattgggtgtgtggtttaagctgccctttgactccagagccctttgtccaagtgtgacaaaatatcagcaaagggtgacatgagctacagccgccaccctcgggtcaggcgttgggg

SEQ ID NO: 6781720 - DNA, 126 bp, Homo sapiens
gtccttagcatttgtgaaccaggttgggaatgagagtcagcccaggaggggccggtggctcatttacttcagggcatgatctggctgttcccaaagtgcctcttgggttcagggactgtgaaggac

SEQ ID NO: 6781721 - DNA, 70 bp, Homo sapiens
ggtcatggtctgctgagcagcaagaagctgccctaagcaagccctcttccagccagcacagacatggacc

SEQ ID NO: 6781722 - DNA, 106 bp, Homo sapiens
caatagaagaaaccttgcaatttgggccttggtgccatggccagttaccatgtaagatgttgtaacaccgtgagaccaccagatcataaggaaatataagttgttg

SEQ ID NO: 6781723 - DNA, 80 bp, Homo sapiens
ttccagctgtcgattcagctcttcagagatatcggggtgcacacttgcctctttctctggtggttggactggggttggag

SEQ ID NO: 6781724 - DNA, 65 bp, Homo sapiens
agtcagagcaaactggacagactggatccaccctcctttctgttctagttgtgcttttgtagatt

SEQ ID NO: 6781725 - DNA, 83 bp, Homo sapiens
gccagggcctggggccgcggccttccctcgaggagcagcgcaggtctcagggtgcgatcctgggctgtggccccgggcagggc

SEQ ID NO: 6781726 - DNA, 59 bp, Homo sapiens
tcacttctgtgactcctcagagattttgcaccagtgaactctggctagcatagaataga

SEQ ID NO: 6781727 - DNA, 76 bp, Homo sapiens
gaaagttccttctagcagcacctacacgtcagagcctactgtgctcatgaagctggggctctaaacaggttttttt

SEQ ID NO: 6781728 - DNA, 96 bp, Homo sapiens
ttgagaaattattgcacctgtctctgtgttgggacatttttttggtcccaggtagttggaagagacaaagctgtaaattatttactagtttttcaa

SEQ ID NO: 6781729 - DNA, 59 bp, Homo sapiens
gtgaggcaggtgagccagttgtaaggggacatgacaaaatggctttagacgtgccttat

SEQ ID NO: 6781730 - DNA, 66 bp, Homo sapiens
ttcattcctattcctatttctaaacatatggcactcatcttcttgccattatagggaagggaagaa

SEQ ID NO: 6781731 - DNA, 74 bp, Homo sapiens
gccgcgccgtaaatgcaagcctgtagccaaatgcttcccccattattctaaggtttgtgtctgcgtgtgcgtgt

SEQ ID NO: 6781732 - DNA, 79 bp, Homo sapiens
tacaaattcatgtttgcctatttgactttgcaggtgaacttagtatcagtaagttgaatgcgtacgtgacatacttgta

SEQ ID NO: 6781733 - DNA, 60 bp, Homo sapiens
cagagtaatagaaagagctctttctccttaaaatgctacggggctctggccaatgctttg

SEQ ID NO: 6781734 - DNA, 104 bp, Homo sapiens
gacaaaggagtaagagcacatgaataaattggaaagtgacgttcaactgtgcttaatgtgtagagttagataagttacttctctttcctgagcttcgctttgtc

SEQ ID NO: 6781735 - DNA, 111 bp, Homo sapiens
gccccattggaatgttagcctctgagccagtttagtgggcagtgtagagcacagatgtctcaggcattcccacatagaatcattagtagaaagtgcactgcatccaaaggc

SEQ ID NO: 6781736 - DNA, 61 bp, Homo sapiens
gtgcagttctaagtagacaagtccctgtgaggaaggggagtgagtactggagtagctgtgt

SEQ ID NO: 6781737 - DNA, 58 bp, Homo sapiens
tctgtcttcaacaagtgtttactctcatgggggagagagtgctgaatgcgagaacaga

SEQ ID NO: 6781738 - DNA, 59 bp, Homo sapiens
ctctggagtgcagcctggtggcttttaagaggagacacccggcgaaatgctctccagag

SEQ ID NO: 6781739 - DNA, 58 bp, Homo sapiens
ggacctgtgcacagtcagccctggggggagcctgtcccccaagcctggcacgggatcc

SEQ ID NO: 6781740 - DNA, 59 bp, Homo sapiens
ggaagtgacaccaactcttgttaattaacccttttgacataaacagaaggtgtgcttcc

SEQ ID NO: 6781741 - DNA, 67 bp, Homo sapiens
gttactagccataggaagacacagaagacacaaatgtgctgactgggctgcctgtgttagaagagac

SEQ ID NO: 6781742 - DNA, 77 bp, Homo sapiens
cactctttctctcacggggtttctgtcatctactcatttaatacagaatatgtcctgctagccccggaggacgagtg

SEQ ID NO: 6781743 - DNA, 74 bp, Homo sapiens
ggggccgggaggaggagagaatcactgaggccggtatatgatcacctcatgagttcttctgcccatccaccccc

SEQ ID NO: 6781744 - DNA, 59 bp, Homo sapiens
gtgaatgcaaactgtttctgatcctctttcctgattgggcttaaatagaatgcattcac

SEQ ID NO: 6781745 - DNA, 85 bp, Homo sapiens
ctctctagagatgaatgatgcaaaagacactgtagttagttatggttctaggtagtgacttttcatctcagttctacaaagagag

SEQ ID NO: 6781746 - DNA, 65 bp, Homo sapiens
catctcagaaacatatctaatccttaaaaataaatgaagagaggagatctgaaatgactgagatg

SEQ ID NO: 6781747 - DNA, 85 bp, Homo sapiens
ggggtctgatatgccaggggagtcaaacagtgccttgagagacccccactagtttctcctctgttggccttccctgcctgaccct

SEQ ID NO: 6781748 - DNA, 57 bp, Homo sapiens
ttagttgatgctaagggatcccagaaacactggggtccgacaaaacagcacaactaa

SEQ ID NO: 6781749 - DNA, 81 bp, Homo sapiens
cagttgtgggatgagtgaggacagggtggcagtgctggagtctcagttgcacacccttcattccactctctccctgtgctg

SEQ ID NO: 6781750 - DNA, 61 bp, Homo sapiens
acttctgaggagcaccgaggcttggtggaaatatctcttgcatgctttttagagtcctggt

SEQ ID NO: 6781751 - DNA, 58 bp, Homo sapiens
aaggccactttaccttaaatcctgttgattttaattttttttagtgttaagtggcttt

SEQ ID NO: 6781752 - DNA, 75 bp, Homo sapiens
ggctgcagctctggctgggttccaggattccattagccagacaatgggtggccccagctgagccaacaggcagcc

SEQ ID NO: 6781753 - DNA, 84 bp, Homo sapiens
gtctctgtcattaaacagctgtcattgttttaaaatgtacacattatttaatttaattgtatggctgagtagagacatgaagat

SEQ ID NO: 6781754 - DNA, 63 bp, Homo sapiens
ctgagccttcctcagaagctcctgagaagaaaagaattcaggggcctcatgaatgaggctcag

SEQ ID NO: 6781755 - DNA, 77 bp, Homo sapiens
gtctggcatgcagtaggtgctggataaagaatggtactgggatagaccttccgctttccacactgttgcccccagac

SEQ ID NO: 6781756 - DNA, 86 bp, Homo sapiens
gcgcacagccggcggctctgatcctggcgctctcccccagcatcccctggggcgggctctggatggagcctgcaggctgagccggc

SEQ ID NO: 6781757 - DNA, 55 bp, Homo sapiens
atcctcacaaattgttaaacagggaaatagactctggcaatggatttttgaggat

SEQ ID NO: 6781758 - DNA, 64 bp, Homo sapiens
tttttgttctgtttgaatatagctatacaatttctgataagtggctatatttgttgaataaaaa

SEQ ID NO: 6781759 - DNA, 97 bp, Homo sapiens
gtcacttgcttccccttctgctttggttccatggatggccatcggccctggctctgcagcctctgtggtgactgggagcagacggggaacatctgat

SEQ ID NO: 6781760 - DNA, 59 bp, Homo sapiens
gggggctgggaggaagaagagactgacttcagtctgagcctgctgccctgtcagcctct

SEQ ID NO: 6781761 - DNA, 62 bp, Homo sapiens
cctcttcagacccttagctgtgattaatgtaaaaaggcacttgtcaaaagggtttgaaatgg

SEQ ID NO: 6781762 - DNA, 82 bp, Homo sapiens
gtgttcaaggctgtctttcctctttgtgacacagctgatgaacttaggtgtgattcgaagagcaaagtgcaggtgtgtttac

SEQ ID NO: 6781763 - DNA, 87 bp, Homo sapiens
gatttttaggatataatccattcagaaattgggaattgtgtgtccactagcatgttattcctattgagtgatttcatttaaagagtc

SEQ ID NO: 6781764 - DNA, 62 bp, Homo sapiens
cctgtctgtcctgagttcaaccagtcatgaaaaatgactttggttggataggacacagcagg

SEQ ID NO: 6781765 - DNA, 82 bp, Homo sapiens
ccagccctggcttggaagccaccagatactcagcccattgttgcctcgtgactgggcagatctttggtggctaggccactgg

SEQ ID NO: 6781766 - DNA, 70 bp, Homo sapiens
tggcaaaaagacgtcacctcatccatctgcaactgaacagggttatagcatggtctgacatcctttgcca

SEQ ID NO: 6781767 - DNA, 63 bp, Homo sapiens
gtcacactgaaattctttgatgttacctaaggtcataggaatgtttagaatgtcagaatgtgc

SEQ ID NO: 6781768 - DNA, 103 bp, Homo sapiens
tgctccagcaaggactcagggaggagcttctgggccaaatacctctggatttagggagggcaaaggtcgcagtggcttctctctgccggtaaccctggaagcg

SEQ ID NO: 6781769 - DNA, 58 bp, Homo sapiens
gtgcaggatctcagaacaagtgccccaggtagcaaagtgttttataaggagacctgac

SEQ ID NO: 6781770 - DNA, 93 bp, Homo sapiens
tctcttctttcatcaacgtagatcttctgtgtattcatgtttggaatacatggtttgaagatttatggtgttatttgtgatggataattgaga

SEQ ID NO: 6781771 - DNA, 95 bp, Homo sapiens
gggagagggagtcagagctggagattctggggacagtgcatgctgcaatgctcatactgtcccagcaaatttcaagttctgggactctttttccc

SEQ ID NO: 6781772 - DNA, 62 bp, Homo sapiens
ttcctggtggtttatgagaagtgagggggaaaagaaatttctggctctgatgactagaggaa

SEQ ID NO: 6781773 - DNA, 77 bp, Homo sapiens
catcaaggtcaagctggaggctgagatcaccacctaccaccgcctgctggaagatggtgaggacttcaatcttggtg

SEQ ID NO: 6781774 - DNA, 58 bp, Homo sapiens
cagaaactagatttagacacaaatctgtaaactgacagttgtgttttttatgtttttg

SEQ ID NO: 6781775 - DNA, 114 bp, Homo sapiens
agattgtttagtgccatggaaaggtttcttaaatactattgaccaggtctctgcaatcatagacatgaatgtttatagtaccttgagatataactcatcccagcctataaattt

SEQ ID NO: 6781776 - DNA, 61 bp, Homo sapiens
attgaatgccacgcttcccccatctgctgtaataacagtgctgggtctgcttggcttcagt

SEQ ID NO: 6781777 - DNA, 90 bp, Homo sapiens
gatccaggcttatgacccagagcactgggtgtgggcgcgagatcgcgctcgcctttcctagagctccagggaccgtggaggcctgaggtc

SEQ ID NO: 6781778 - DNA, 56 bp, Homo sapiens
gaaaatgtgcctttgggtattgctaattcagatataatgcccttggcacatgtttc

SEQ ID NO: 6781779 - DNA, 75 bp, Homo sapiens
ggctgaaataaaactttttctaatgcagtgtttgcaatgcaagatattctatgtagaatgagctttattacagtc

SEQ ID NO: 6781780 - DNA, 69 bp, Homo sapiens
caaagtacagtgcttcctgggaaatggagtttttcatgtgctcatagtctcagaatgggctgtactttg

SEQ ID NO: 6781781 - DNA, 68 bp, Homo sapiens
taaagatgtcagtcagataggattagggcccattcatatgaattcattttagctgaatgacttcttta

SEQ ID NO: 6781782 - DNA, 71 bp, Homo sapiens
gaatgtctccaacttggggaaaagctctgtctacagtagatcatgctgcttttctgaagtttaagacattt

SEQ ID NO: 6781783 - DNA, 80 bp, Homo sapiens
atgattctcaaactttggtggacgtaagagtcacttagtgtgtttaacaaatacagattcttgtgtctatttgggattat

SEQ ID NO: 6781784 - DNA, 64 bp, Homo sapiens
tcgtcatccagaacttcaatgcacacactactgaatcgcattgagaatccatttgagatgagga

SEQ ID NO: 6781785 - DNA, 56 bp, Homo sapiens
ggcccagaagccagaagcctcctgaccacccccagggatgcttctccagctgggcc

SEQ ID NO: 6781786 - DNA, 79 bp, Homo sapiens
gttaattaaaaacagtgttttatcagtaggtattgtcataaaattaaaccttttgagacttccactgtgtataattgat

SEQ ID NO: 6781787 - DNA, 74 bp, Homo sapiens
tgggacaaggtcaggaggaaactggattcacttcatgttgtgcagaagcatcattcacttccttctggctcccg

SEQ ID NO: 6781788 - DNA, 105 bp, Homo sapiens
cttaggggaaaggactagaaatacagtagacaatctcatgaaaacgctgtctgcctcactaagcttttcaggacagactgctactgtatcagtcatgctcttcag

SEQ ID NO: 6781789 - DNA, 62 bp, Homo sapiens
ctgttgcctaaatgcctttcctacctaacagtagctgttcagtgggtgcattggccctacag

SEQ ID NO: 6781790 - DNA, 68 bp, Homo sapiens
agggacagtctactgttcactgaatgtatgcttacaaaaagtgacatgtggtaggcatagttgtcctt

SEQ ID NO: 6781791 - DNA, 118 bp, Homo sapiens
gacttattttctgatattgtctgcatatgtatgtttttaagagtctggaaatagtcttatgactttcctatcatgcttattaataaataatacagcccagagaagatgaaaatgggtt

SEQ ID NO: 6781792 - DNA, 58 bp, Homo sapiens
cttgacttagaaattcagttttgtcacatactagctgtgtgatattctcctagtcagg

SEQ ID NO: 6781793 - DNA, 78 bp, Homo sapiens
aaggcactgttatgcactggtactattcgtgtacactataaggaatgatgtatcagttttacgtctaatcagtgtctt

SEQ ID NO: 6781794 - DNA, 58 bp, Homo sapiens
tttgctttgtttaaaagtggtatttcatgtatttcgtgaccctcttgcacaaagcaaa

SEQ ID NO: 6781795 - DNA, 79 bp, Homo sapiens
tcacaaaatgatttattacttacattagcaaacaaggtttctctaagccctgacacttggtggaagtattgctttgtgg

SEQ ID NO: 6781796 - DNA, 67 bp, Homo sapiens
aatacaagacgagggaagttcttttgacatacaagtttgagagaacttcttttgtagttcctttatt

SEQ ID NO: 6781797 - DNA, 65 bp, Homo sapiens
atttcctgacagtggaaccttatagttcttgatttttaagagagagcattcttctgttagttgat

SEQ ID NO: 6781798 - DNA, 57 bp, Homo sapiens
atggtcataatccttgattcaaataattctaattaaaggaaataaggatatgattgt

SEQ ID NO: 6781799 - DNA, 70 bp, Homo sapiens
cttcccaggctggattttgcagttcacgaactcttgagccatgcagatgggctgcgatctccccgggaag

SEQ ID NO: 6781800 - DNA, 79 bp, Homo sapiens
aggtgtcagtggtgtctaaagtatagtgataaatggttcaggatgaatgtttgtcatcccttttgaaactgagacactt

SEQ ID NO: 6781801 - DNA, 57 bp, Homo sapiens
gcgcctttctgcagccagccggcccgcccttcctccgggtgtctgagagctgggcgc

SEQ ID NO: 6781802 - DNA, 75 bp, Homo sapiens
gctcccacggggagggtcaggccacattcttctctggctggagcctgaggggtggctggcacctcctggtggagt

SEQ ID NO: 6781803 - DNA, 77 bp, Homo sapiens
gagggagagacagacagtggacttgataaaggaaatgcattgagcatcctcaacttcacgttctgaataattccctc

SEQ ID NO: 6781804 - DNA, 57 bp, Homo sapiens
ggtttcagttcagaagtcaagagtaacagctaatgcttttacttcaggagtgaaatt

SEQ ID NO: 6781805 - DNA, 56 bp, Homo sapiens
gatggtttggaatgaagtagctattcatggcagaatctaccatctcccaaaccgtc

SEQ ID NO: 6781806 - DNA, 77 bp, Homo sapiens
agccagctgttagcttagtagctgtttcttctaatgaataaaagtccacagcacagagtttttttatatagtaggct

SEQ ID NO: 6781807 - DNA, 73 bp, Homo sapiens
cttcagtctttcctgggagggcccagatgagaaacgctcagctccgccttcaggaaagtcccactcagagaag

SEQ ID NO: 6781808 - DNA, 69 bp, Homo sapiens
gcctcccaaagtgctgggattacaggcttgagccactgcgcctggcccagttttcccatgtcttgaggc

SEQ ID NO: 6781809 - DNA, 58 bp, Homo sapiens
ggggttcttattgcttatacatcctgagaatgcttacccttatggtactgggagcccc

SEQ ID NO: 6781810 - DNA, 70 bp, Homo sapiens
ggaagatagaagttcaaaagttatcggtgcaaaaggagtgatacacaaaagacttcaatttctatctttt

SEQ ID NO: 6781811 - DNA, 60 bp, Homo sapiens
gtaattgtggtttgttgataaatatttcaggtctctagacctggaacaaactgcaatgac

SEQ ID NO: 6781812 - DNA, 57 bp, Homo sapiens
tcaggacatttgtcagcaggagccaaatgggaaattctgagcaacaggtgttcctgg

SEQ ID NO: 6781813 - DNA, 57 bp, Homo sapiens
tcctctgaggtctaggaccatggcttatttgccattctattccccaggcccagaaga

SEQ ID NO: 6781814 - DNA, 129 bp, Homo sapiens
gaatatggttggttttggccttagggagggctctttttgtaagtttgctgtttattaactccacacgtaaacagtgtactaaatagtaagaggaatcctctgctaatgttctgcctcaaacctaagttc

SEQ ID NO: 6781815 - DNA, 68 bp, Homo sapiens
cctgcagccccttggggtccagctgcctctgcaggaggctctccatcagctgctccagggagctcagg

SEQ ID NO: 6781816 - DNA, 69 bp, Homo sapiens
cctgtgttgtgacccagaccaagaagaacctcctccaaggagcttgctacatgtgggtggcagcacggg

SEQ ID NO: 6781817 - DNA, 69 bp, Homo sapiens
ttaggaggctatgcatgaatgctctttgcatctaatgaataccaaatgcagatgtgtagagaatcctaa

SEQ ID NO: 6781818 - DNA, 76 bp, Homo sapiens
atgtattatctatgccatggaatcacctccagctagtaagggcaggctggaaaggattccgtgatacagataacat

SEQ ID NO: 6781819 - DNA, 59 bp, Homo sapiens
ggtggttacaaataaagtcgctataaacatttgtctatagattttattgtgtatccatt

SEQ ID NO: 6781820 - DNA, 73 bp, Homo sapiens
gctttcctgggaaaggggtgtctctgtccctaagcaaaaaggcagggaggaagagatgcttccccagggcagc

SEQ ID NO: 6781821 - DNA, 68 bp, Homo sapiens
gtagcttatggtctctagggaatgcagtaaatcaaatgagttaccaaattcactgggacatgagttac

SEQ ID NO: 6781822 - DNA, 81 bp, Homo sapiens
ctcaagtcacaagttatctactatagtgccatgcatcacttttatagttgaggtagggttaatggagatataggattttag

SEQ ID NO: 6781823 - DNA, 127 bp, Homo sapiens
agcaagaaagctaccagatacccctcacagcatctgtgtgttgagttctcagctctgagtaattgtctaaagaattaagcaatgctagggctagatatataatgtctaaatatgtagagtagctgct

SEQ ID NO: 6781824 - DNA, 61 bp, Homo sapiens
tctctcttggcctctctttggagagcagaggcggaaagcaggcttagaggccacagacaga

SEQ ID NO: 6781825 - DNA, 105 bp, Homo sapiens
caggtcactcaggggtgactgaactggagatgctcagggcttcagagggcacccctcctgcaagctacccctagcatcagctcagggccaccctgagctggcctg

SEQ ID NO: 6781826 - DNA, 61 bp, Homo sapiens
tgaagccaatctgccaggcagaagggaaaagagatgatttgtttgctctgggattgggtca

SEQ ID NO: 6781827 - DNA, 89 bp, Homo sapiens
gtccccaggcagagcacaggctgctgtgaactgtggcccaactgcagggccagtccagggcagggcaagaccagtgtgggctgaggggc

SEQ ID NO: 6781828 - DNA, 55 bp, Homo sapiens
gcaaaaattccagggacgactcccattggcaggagcccgtctctgaaattttcgc

SEQ ID NO: 6781829 - DNA, 70 bp, Homo sapiens
ttggagaagtcctttaatatcacatagtgtaaatatacttgcacttaattggagataaaggctgttccaa

SEQ ID NO: 6781830 - DNA, 66 bp, Homo sapiens
taataataaccttggctgttattgtgcctttccatcaaggcacaatactagccaaggttattatta

SEQ ID NO: 6781831 - DNA, 62 bp, Homo sapiens
ttcttttgaaaatatcacaggagcagctgttcctcagctattttgagtggattttctgagaa

SEQ ID NO: 6781832 - DNA, 65 bp, Homo sapiens
ctccacatatactggctctgcaacccccacacacctttatttggttgggttgggagcctgttgag

SEQ ID NO: 6781833 - DNA, 66 bp, Homo sapiens
ccatccatggagctggtagtttgctgattggagtagagtcattgaatttcacagctttatgaatgg

SEQ ID NO: 6781834 - DNA, 69 bp, Homo sapiens
gatggcttggagatacaagtggtacctcctgaaaaagacacccaggtagcagttgtatctgaaagtctc

SEQ ID NO: 6781835 - DNA, 130 bp, Homo sapiens
actggcaattcattttctccataacacatggattggaagctactttaatgtaattgctacaaaatataattctgcagttgcctgaagggctttctaaaatccaccagtttttgttcctacagttccagat

SEQ ID NO: 6781836 - DNA, 90 bp, Homo sapiens
ctggattgtcaaaaagtagtcatttctgttttacatgattagctaaaacagccgactcatggctttttggaaacaacactcttcctccag

SEQ ID NO: 6781837 - DNA, 79 bp, Homo sapiens
taggttggtgcagaagtaattgctgtttttgccattacttttaaatggcaaaacccacaattatatctgtaccaaccta

SEQ ID NO: 6781838 - DNA, 68 bp, Homo sapiens
ctgtaattaaggctgggaattgctgagctgctctatctgcagctggaagatcctggttttgtgtgcag

SEQ ID NO: 6781839 - DNA, 89 bp, Homo sapiens
cagggtcttgctctgttgcccaggctggaatgcagtggcgccatcttggctcactgcaacctctgcctcccgggttcaagcaagtcttg

SEQ ID NO: 6781840 - DNA, 82 bp, Homo sapiens
ccggagtgggaagaggtggcaggaaggggatctgaggaggagaacaggggtcctggtggtctgtgcttcttcccagacacgg

SEQ ID NO: 6781841 - DNA, 126 bp, Homo sapiens
ctgcagcatggggtaccctcctggtggctctgaacatggggaggagtcaccggtcatttccaggcagggtccctccttgtttgtgagccttgttcatgtgccagagtgggtcccctcttgcagcag

SEQ ID NO: 6781842 - DNA, 68 bp, Homo sapiens
tcacttgaacctgggaggcagaggttgcagtgagctgagatcgtgcctctgcaccccagcctgagtga

SEQ ID NO: 6781843 - DNA, 61 bp, Homo sapiens
agacaagagatgctttacatcggatggcggttctgctgatccataggacatttcattgttt

SEQ ID NO: 6781844 - DNA, 71 bp, Homo sapiens
gtctttattacaaatccttttcataacccacaaaggatgtggttcagaaagatggtgtaataatgtgagac

SEQ ID NO: 6781845 - DNA, 77 bp, Homo sapiens
tccacagagctatgtttccagatatgtcaccctcacagagcatgatgtgaatggcactcctggaggttctggatgga

SEQ ID NO: 6781846 - DNA, 77 bp, Homo sapiens
acactaaaaggggtaggtaagacaagatgcatctattaggccaagcctaagagctctttgatttgcttctcttgtgt

SEQ ID NO: 6781847 - DNA, 86 bp, Homo sapiens
aagagcttcatggaggaggaagggcgttgtggtggactgtattttccaaagatctcccaacaatatctcttgttccacatgctctt

SEQ ID NO: 6781848 - DNA, 58 bp, Homo sapiens
gtggcaaattgcaagcaagcttttagaattttttatatggaagtcttggaatttccac

SEQ ID NO: 6781849 - DNA, 70 bp, Homo sapiens
ccgttattgtaggaacaaggtgtgcaggtctgaaatgggactagggcatcttaatttctaacaggcacgg

SEQ ID NO: 6781850 - DNA, 64 bp, Homo sapiens
accccgagaacttttcctgaaaagttggctcttgtttgttgactgacagttggagttttggtgt

SEQ ID NO: 6781851 - DNA, 125 bp, Homo sapiens
gggaccaaggtttacgcccccaagctgatccgtccctggctgggggctgccttgggtgaggtggctactctgttctaccaaggcagttccccagagggctgacagctctgtgaccttgaagtcct

SEQ ID NO: 6781852 - DNA, 56 bp, Homo sapiens
tgggtccaaagtgaacatatttggaacaattccccacataagttcaactggaccca

SEQ ID NO: 6781853 - DNA, 74 bp, Homo sapiens
ggccaagccctctgtgcctcgtgtcctctgcaccgcgatggcttcgctgggggagggagtggggagagctggcc

SEQ ID NO: 6781854 - DNA, 66 bp, Homo sapiens
agggctgtggggtaaagcaaagaaggggtcagtgtattagactcctatgttttcccctagagaact

SEQ ID NO: 6781855 - DNA, 65 bp, Homo sapiens
gtcacccccaagtgtgtcagtccccagaacaacagccagattggactcaggcaccaggggatggc

SEQ ID NO: 6781856 - DNA, 75 bp, Homo sapiens
taaaatttgttcaacaggtgaaatagaagatggtgaaaatgtcaatctgttttgaatctgttgaattttgttttg

SEQ ID NO: 6781857 - DNA, 72 bp, Homo sapiens
tgttgaaaggctgtatgtttccatttgaactcatcattgtttaatgtggctacaatacagaaccatacaata

SEQ ID NO: 6781858 - DNA, 67 bp, Homo sapiens
tctgccacatctatctttagtatgaacacccagtgtctgtactatctatagatatagtagtgggaga

SEQ ID NO: 6781859 - DNA, 78 bp, Homo sapiens
cctggctgagggtagcggcatttctgggatcgggcacttttcttggctttggtctctgtaggctaccccatagtgagg

SEQ ID NO: 6781860 - DNA, 79 bp, Homo sapiens
ggtggtttggcacatgaacctatttttttgagaacaaggagaacccaatgactaggttcttggcacatcagaagccacc

SEQ ID NO: 6781861 - DNA, 80 bp, Homo sapiens
tgattatctcatccttcagtggaagacagtagcagagacatttgctctgctggccatgaagagagaatttgggatctgca

SEQ ID NO: 6781862 - DNA, 64 bp, Homo sapiens
gagcatccagaggtgttttctcccaaatgaaaggcatttacactaaagacacctctgagtgttt

SEQ ID NO: 6781863 - DNA, 79 bp, Homo sapiens
gggctacaggtataggtttggctctctccaggtggtatttgaggccctgggagtgactgaatctataagagtgagaccc

SEQ ID NO: 6781864 - DNA, 55 bp, Homo sapiens
ggggcagttctctattctgtgcactgtctgcccactgcagggtgttgactgtccc

SEQ ID NO: 6781865 - DNA, 130 bp, Homo sapiens
attgattaaaattagtatcactataaattgaaggcatatgatagcaggacatttaagcctggttgtgtatatgtcctggcatgtcatttttagagttgtatcaatatgtagataaaaattttaagtcagt

SEQ ID NO: 6781866 - DNA, 57 bp, Homo sapiens
aagatgttaaatctgtagaattccaccatggtctaaagttacaaggtgtgacatctt

SEQ ID NO: 6781867 - DNA, 62 bp, Homo sapiens
agcagaaaactttcatgctctgaaccctgaagagaaagaatttgcctatgagggttcctgct

SEQ ID NO: 6781868 - DNA, 75 bp, Homo sapiens
aacccatgagtcccaaagtattagcatttcaacatgtaagcatgtcggtaagatagttgtgctttgcttagggtt

SEQ ID NO: 6781869 - DNA, 57 bp, Homo sapiens
ccaccctaacaatccttactgtattcaactaaaagaaaccaaggatcttggtggtgg

SEQ ID NO: 6781870 - DNA, 107 bp, Homo sapiens
gcccaataatgaacatttgttctttcataataggttgtagaagtgtttaagagtctgagagtagcttctaggggcaatgtgcaaggacaagtgtgagagtattgggt

SEQ ID NO: 6781871 - DNA, 79 bp, Homo sapiens
atcccaaagagcaagaggagaatggctgattccaatgcaatctacaagaggttctcctctctactcagctcttcagggt

SEQ ID NO: 6781872 - DNA, 70 bp, Homo sapiens
gggggctcagtccttccttgccccttgggctgcccttcagggttaagtagagggtcccagctgagctctc

SEQ ID NO: 6781873 - DNA, 59 bp, Homo sapiens
tatggggttttttttaagctctggaagcccacagccttcagaaaagagaaaatcttata

SEQ ID NO: 6781874 - DNA, 60 bp, Homo sapiens
acatttctcttgatgtctctattaatgcaaaatattgagcaagagaccgcaggagaaggt

SEQ ID NO: 6781875 - DNA, 80 bp, Homo sapiens
tcttgtgagaccttggaagaaatatcaatagtgttcaacaatcctgagtcaagatgagaattctttttaatttcacagga

SEQ ID NO: 6781876 - DNA, 83 bp, Homo sapiens
tgttttgatttatttttaatcagcaggggtttgtaatttcagcttttagttactcctgctattaagtattgaatggacaaaca

SEQ ID NO: 6781877 - DNA, 61 bp, Homo sapiens
cccataactgagtgagcagcgactccttttataggatactctaagggagatgctctcaggg

SEQ ID NO: 6781878 - DNA, 66 bp, Homo sapiens
agccctggttgagaaccactggtatagaatttactcctccaggaaggtgtttaactagagatggct

SEQ ID NO: 6781879 - DNA, 57 bp, Homo sapiens
ctgtgaatttaaagcacacatctttaaatctggagctgggtggaatggaattcacgg

SEQ ID NO: 6781880 - DNA, 88 bp, Homo sapiens
gtactttctcaaatattggggatgtagaaatgaacaacaggcaaaaattactgctgttgtaaatcttacactctagtggggaaagaac

SEQ ID NO: 6781881 - DNA, 82 bp, Homo sapiens
tctgattatgtatccgtggttttattcatgaaatttgtttttagctaatacagcttttttcggaataaatacgaacatcaga

SEQ ID NO: 6781882 - DNA, 55 bp, Homo sapiens
acattgaacatggcaggacattgtttttatggcatatgtacctgtatttcattgt

SEQ ID NO: 6781883 - DNA, 94 bp, Homo sapiens
atcgggtgcctgaaccgatcttggtcaaggcttggagatagtagcaactctgtttcttcttcctgccttagacttggctctccatgcacctgat

SEQ ID NO: 6781884 - DNA, 73 bp, Homo sapiens
aggtcaggagtggtgtgagggactcccatgcccatatattccatggcctctcatttccatcactttcttatct

SEQ ID NO: 6781885 - DNA, 56 bp, Homo sapiens
cccataattcaatcacctcccactgggttcctcccatgaaaggtgggaattgtggg

SEQ ID NO: 6781886 - DNA, 100 bp, Homo sapiens
gtagatgtatgtggagttaagtcgtggatgattcttcggtttaaattattttcttgtttctgtgggatcccatgactttccagacatcactcacctctat

SEQ ID NO: 6781887 - DNA, 102 bp, Homo sapiens
gtacagatgaggaaactgaggcctagagaggttaataatctgacttgtggtcagacagcttgtagacttatctagatatagcctctgtccttaagctgctgc

SEQ ID NO: 6781888 - DNA, 94 bp, Homo sapiens
ctacctcttctgcttcacggtgatgcccttctgcttcagggctttctcattggccatctgcaggagctggatctccttgcgggagaagaggcgg

SEQ ID NO: 6781889 - DNA, 55 bp, Homo sapiens
tcttcaaagcatatgcaggcatttaattatatgatggtatacggtgctttggggg

SEQ ID NO: 6781890 - DNA, 77 bp, Homo sapiens
gggtggctggaccagcttctgcatgtgatggatacagactcagaccaaggccccaggcagagctggaaccaggaccc

SEQ ID NO: 6781891 - DNA, 60 bp, Homo sapiens
gctgatgatgcttttctgagggcttggcatgtcccatcttcagttcacatgtatcatggc

SEQ ID NO: 6781892 - DNA, 61 bp, Homo sapiens
ctgggaagaaagacatcaactggcttaacttttgctgggctcattgggcgctttctaacag

SEQ ID NO: 6781893 - DNA, 76 bp, Homo sapiens
gttgtgtgcacagcatctgcataatgccttcccaatacaagcattgggctgggcctctgggatgtgtgtccaggac

SEQ ID NO: 6781894 - DNA, 71 bp, Homo sapiens
ttgatggaaaagtaattgcagtttttttccattaaaagtaatggcaagaaccgcaattacttttgcaccaa

SEQ ID NO: 6781895 - DNA, 57 bp, Homo sapiens
agtgtgtatatgagtctgagtgtacatgcctgggtatgtaccagagcatatatgact

SEQ ID NO: 6781896 - DNA, 94 bp, Homo sapiens
ctgcccaccacagagccagtcagcatctgcactgtgctgggtcagatgtctctccagcggtatggcaaatgctggctggcccagggatggggag

SEQ ID NO: 6781897 - DNA, 101 bp, Homo sapiens
ttaaggctcttttagaaagagagactgagggctaccccggggcaaacactgcatgactctggcagtagatccagtctctctgcttcagacatgggccttaa

SEQ ID NO: 6781898 - DNA, 69 bp, Homo sapiens
attaatctgtattttgagtccaatctcctctcatgggagagtgagaaaaaggctgaaaataagcttgat

SEQ ID NO: 6781899 - DNA, 58 bp, Homo sapiens
ttactttatcctgcaggccacgggggagcccttaaaaggctttaaagcagaggagtga

SEQ ID NO: 6781900 - DNA, 57 bp, Homo sapiens
tgttgttacattcctgtgtcccttggtcatttggatgggacatgtaaatgaacagca

SEQ ID NO: 6781901 - DNA, 95 bp, Homo sapiens
ctcaagaacagatgtgcttctaaatcaagcctgtctcaccagtgctaatatttagtagtggtcaagtttgttggagagctcatctgtaacttgag

SEQ ID NO: 6781902 - DNA, 67 bp, Homo sapiens
tacggaattttcaggtagcaatttcattaaagccccagttatttggaagctatcagaaaattcagta

SEQ ID NO: 6781903 - DNA, 56 bp, Homo sapiens
gagtctgtttggaatctgtagggaatgaactcaacctaaggaaagccaaagaggcc

SEQ ID NO: 6781904 - DNA, 83 bp, Homo sapiens
cctccaccctccctgcacagccgagccatgcacacaattactgctgacgtacttcaggctgctgcttggggagagaggggagg

SEQ ID NO: 6781905 - DNA, 58 bp, Homo sapiens
gctgagagtgggtttagtttgggttcatgtctaaatttactaatcatccagtcacagt

SEQ ID NO: 6781906 - DNA, 78 bp, Homo sapiens
ttacagcttgatgtttgtgtgttctaattctaagagttctttattccagatcatatagagtagttaagacaactgtaa

SEQ ID NO: 6781907 - DNA, 77 bp, Homo sapiens
gttacaggcgacctgcagctgagaaaatgactggcccatccattcacttctccaagctagcagaatcatgccatgac

SEQ ID NO: 6781908 - DNA, 123 bp, Homo sapiens
tctctatcgatgaaactgctttctcaaatacgtcagcaatgggattcaggctttgcttacaatgtgaaggaagttcttagtctcatttgcacaaagaaggaaggagggctaaagataaaaaga

SEQ ID NO: 6781909 - DNA, 67 bp, Homo sapiens
gccagtactggaaggctggaagtcaggacaggagtacatctgactctggggcttccagaaagctggc

SEQ ID NO: 6781910 - DNA, 62 bp, Homo sapiens
caggactggcacctagatccaaaggcaccaactaggtgcttgggaatgtggagtcagacctg

SEQ ID NO: 6781911 - DNA, 121 bp, Homo sapiens
cgctctgtagatgaggaaatggaggctgaaggaggtagagtgacatatacaaggtgatatatctagttattacatttagtcttctgattcctattctagcattctatccacagacacagtg

SEQ ID NO: 6781912 - DNA, 65 bp, Homo sapiens
gttctcacctctactcagcctagttcaggccctcctgaactctctcatctgtcagttgtgagagc

SEQ ID NO: 6781913 - DNA, 86 bp, Homo sapiens
tcagtgccagtccatgctcatttcttctcgaaaagacccactgatttttatagggtaaggagggggaatgattggcaaggcactga

SEQ ID NO: 6781914 - DNA, 55 bp, Homo sapiens
gtatatgtgtgcaagtgcatggtatatacacatagcacacatgcatacatgctat

SEQ ID NO: 6781915 - DNA, 56 bp, Homo sapiens
gtggatacatttgtttggagtgaaagtataaaaacattcatgagaatgatatccac

SEQ ID NO: 6781916 - DNA, 81 bp, Homo sapiens
caccttgccaacactgagcattatcttggattttgtatctttaacaggaaataaatggtaatgcattttaagtttgcagtg

SEQ ID NO: 6781917 - DNA, 75 bp, Homo sapiens
gatattatagtagatgcttcctttgtatgctgatttaattgtcaaaacatactacaaggtatgtgctaaaatatc

SEQ ID NO: 6781918 - DNA, 61 bp, Homo sapiens
gcaatgtgtcaggaaaagggccatgtgcttttctgccatgtccttttctgggatagatagt

SEQ ID NO: 6781919 - DNA, 97 bp, Homo sapiens
tagtatttattatccagagtaaggcggttataggttttatgttaaagataccttttgaaagtaaggcttctggcccttaactttgtttataatacta

SEQ ID NO: 6781920 - DNA, 59 bp, Homo sapiens
gaatagatatccttgagggtctgtttgagctctcagatcccaaggaaaactgtctcttc

SEQ ID NO: 6781921 - DNA, 71 bp, Homo sapiens
ctccttctcagccagtgtgcacctggagtcagctgtgtttggccttaaggtgtccatggtccagcagggag

SEQ ID NO: 6781922 - DNA, 87 bp, Homo sapiens
cttcctagtctctaatactgaccaagtcaccacaccctcttggaatgtttactggggctgagtgagtggaaagtgagggatgggagg

SEQ ID NO: 6781923 - DNA, 103 bp, Homo sapiens
gggcagcatgctggggggcctctcctgcctccagaggtgcccctgctccccactgtggccctctttagacagagtaggagctcgggctacccacatgcagccc

SEQ ID NO: 6781924 - DNA, 67 bp, Homo sapiens
ccagatctgggtcagtatgttcttgggatcacatttaaactcagggaccaccactcacccagcctgg

SEQ ID NO: 6781925 - DNA, 70 bp, Homo sapiens
ggcaggagtgcaggtggtgaggcaggcagacacagtgcccagcctgggcctgactcacctgcctcccgcc

SEQ ID NO: 6781926 - DNA, 76 bp, Homo sapiens
ttaagttcgcccatcatgtctgtagaaccgaatgatagcatttattttacggtattatgattgcctatttacttga

SEQ ID NO: 6781927 - DNA, 66 bp, Homo sapiens
gcctgactcactgagctgcattggacaaatgattcattcactggccttgacctcagtgggtttggc

SEQ ID NO: 6781928 - DNA, 126 bp, Homo sapiens
gaagcaggagctctttgcttcattgagctgaacactacaggggtccacagctgattgtcaagagtctgatgtaggcttttctgggagaaaatacttcagctcaatgaagcaaagagctcctgggtt

SEQ ID NO: 6781929 - DNA, 122 bp, Homo sapiens
gcttattcagtctctttaaactgtagtttcttttccttgcagtatgccttttaattttgtgttgaaaggtgaacatgatgcactgggtaaaagaaactatgttttgtttttttttaataagc

SEQ ID NO: 6781930 - DNA, 97 bp, Homo sapiens
gccactgctcctgcgtgtaggcctggatctctgggagcagtgtgcccaataactgctccagcaccaagagctccagcatctgctccttggagcaggc

SEQ ID NO: 6781931 - DNA, 76 bp, Homo sapiens
cctgcgcgggccctggggatgtggacgcgggggctcttccctgccgcctacgcactccggggcatgcccgcgcggg

SEQ ID NO: 6781932 - DNA, 129 bp, Homo sapiens
gaccttttcaactctaacagacatttttttacttcttgaggggggctatgactcaggtaaattcttttaaaaaagtcacttgggctcctgttttaaaaggtgaacttatttttagagatgataagaagc

SEQ ID NO: 6781933 - DNA, 55 bp, Homo sapiens
tcctaaaatacctattattggctttttttccagccaaaaggataggaaattaggg

SEQ ID NO: 6781934 - DNA, 65 bp, Homo sapiens
tcggacacccagcttcggcaagctctctccaagggtgagtgggccagtgggacctgggtctccgg

SEQ ID NO: 6781935 - DNA, 73 bp, Homo sapiens
aaggctcaatagtagcatgcaatattatagagatggttttacatctgttttgcataatgttcttttggtcctt

SEQ ID NO: 6781936 - DNA, 61 bp, Homo sapiens
ggtcagcacaaatggccgtgttcaaagaagtctctgactctttgccaagtcgtttggcacc

SEQ ID NO: 6781937 - DNA, 58 bp, Homo sapiens
tacctggggctgggctttgattctgtcatcttcagaagtagtgtcactcttccaggta

SEQ ID NO: 6781938 - DNA, 95 bp, Homo sapiens
tcctgtgtctctcccttccttagtgcctcttccgctgcacatgctgggtcctgggcgaggtactggggctgtaacggggaacgaaacaaacaggg

SEQ ID NO: 6781939 - DNA, 71 bp, Homo sapiens
atgcttactgtacattccgtttgttgcacagtagacagttggcaataaaagtgtgaagtgcagagaggcat

SEQ ID NO: 6781940 - DNA, 129 bp, Homo sapiens
agattttcagaataatagagatttatatcaagaaaaggaatctagattttgttgcattgtaggagcaaacaaggcttcatattctttttaaaatgacttgaaattttattataaatttccatagtttct

SEQ ID NO: 6781941 - DNA, 58 bp, Homo sapiens
gctgctgtcacccacatctgtcttggtaatgaaacattaacagtgttgtgagagcagc

SEQ ID NO: 6781942 - DNA, 61 bp, Homo sapiens
gtccagggggcttaagcaaactccttatatcttgtggatcttactaatgttccctctggat

SEQ ID NO: 6781943 - DNA, 127 bp, Homo sapiens
ccagaagatctgatgtcctggcatgggtctgatgcctcatgttgctcgcatctgcattcagatcttatgcgtgtgactgataggtggaacgatcatgtgcctgacccttgatggtgcagattcctgg

SEQ ID NO: 6781944 - DNA, 66 bp, Homo sapiens
ttccactggcaaactgaagtcacaatgtcttttctgttcgtggtgatttccagtgagtcagtggga

SEQ ID NO: 6781945 - DNA, 63 bp, Homo sapiens
tctctctttaggcatacttttgggagaaaaaatatttcttctcatttgtgttctaatttgaga

SEQ ID NO: 6781946 - DNA, 74 bp, Homo sapiens
ccttccgacctgccatgcagttagtccctcactagtagtttgtgctaatgagtacttcctgatgagctgggagg

SEQ ID NO: 6781947 - DNA, 86 bp, Homo sapiens
ttgttaaaacagtgtcttaggttccattgccagagtctctgattcagtaggtctggagtggggcctgagaatctgcactttaacaa

SEQ ID NO: 6781948 - DNA, 62 bp, Homo sapiens
tgctatgctttctcctgtctgaaagattacaccaagattgttcagaaatggggaaaggagca

SEQ ID NO: 6781949 - DNA, 68 bp, Homo sapiens
gcctgcaaagctgaatcaagttaagttcagccaccatgtagaacactgagaaagtcagctttacaggc

SEQ ID NO: 6781950 - DNA, 55 bp, Homo sapiens
taccatcacatatgctgtattggctattttctgtgagtacaatgtgttgttggta

SEQ ID NO: 6781951 - DNA, 61 bp, Homo sapiens
cactggaattggaatctggagctctgaacacacagtcacagctcccaaggcagattcagtg

SEQ ID NO: 6781952 - DNA, 65 bp, Homo sapiens
agatagcctcaagtgaagtggttagcagactgtcaagtggtgctctgctttacttcagaggatct

SEQ ID NO: 6781953 - DNA, 55 bp, Homo sapiens
ggagtcaggctagaggtgagtctgggataagaaccctagtttgccaccagattcc

SEQ ID NO: 6781954 - DNA, 76 bp, Homo sapiens
tataagcttttggtaacaagtcattttaaattatgtgtgtaaagcacatagtggaatgcttgttccttagtaggta

SEQ ID NO: 6781955 - DNA, 62 bp, Homo sapiens
gtgttgctagtgcagtttcttgtgttcaccatcacagttgagatactaagcatttccagcac

SEQ ID NO: 6781956 - DNA, 64 bp, Homo sapiens
tctgttcactgagcaatggcaaagctattaacatgcttgatattaacctgctaagtgagtcaga

SEQ ID NO: 6781957 - DNA, 62 bp, Homo sapiens
ggggcaggggggctcattagcccctggagcacactccgggtgactggctaccccccagcctc

SEQ ID NO: 6781958 - DNA, 129 bp, Homo sapiens
ctgtccgagttcatcagccgctacaagtcctccggcttcatcgacctgctccacgacaagtggtacaagatggtgccttgcggcaagcgggtctttgcggttacagaggtggggcagggcctgggacag

SEQ ID NO: 6781959 - DNA, 59 bp, Homo sapiens
gttcatgctctgggcttctggggaaccaaatgatttcaccctgcaggccagggctgagc

SEQ ID NO: 6781960 - DNA, 56 bp, Homo sapiens
tgcccactgtgtcaaagaaatagcaatggggcaagtgtgactaagcagagtgggca

SEQ ID NO: 6781961 - DNA, 64 bp, Homo sapiens
gaggcaaaaagtagattgtacccacctgcaacaggtgaggcaggcattctcctttctgtggctc

SEQ ID NO: 6781962 - DNA, 62 bp, Homo sapiens
gtcatcaacatataggcaacctgtaagttatttaccttaaagtttgcctatgtgttgtttac

SEQ ID NO: 6781963 - DNA, 91 bp, Homo sapiens
ggaggcccttgccaatgggaaatgagagacaggaacgagctgggcagatgaatttcctctcgttctctctcccccaatgtgcagttcctcc

SEQ ID NO: 6781964 - DNA, 88 bp, Homo sapiens
ggagtcatgaagcaaatggagtgaagagctggagtttgaatctggattttccaactctctgttttatgtgcttcctgatcatggcttc

SEQ ID NO: 6781965 - DNA, 60 bp, Homo sapiens
gccggtgcaggtgagtgcaggggctcacaagggtgagtccaggtgcttacctggacaggc

SEQ ID NO: 6781966 - DNA, 56 bp, Homo sapiens
gcagctaccacccaggaaggaccatgaaaatgtttgctgaatgaatggatggttgc

SEQ ID NO: 6781967 - DNA, 72 bp, Homo sapiens
ggtgtccagaaagaagtggggatagaggtctttaaccataaatattgcagcttctccattcttctggctgcc

SEQ ID NO: 6781968 - DNA, 83 bp, Homo sapiens
ccttgtctgtggaaaaatgtggtgactgagtaaagttgttttttaacttccaaacctcagtttcttcatctccctaacaatgg

SEQ ID NO: 6781969 - DNA, 57 bp, Homo sapiens
agcccaggagtccttaaggacccaggtgggtggagtaaaaccaggagggcctgggct

SEQ ID NO: 6781970 - DNA, 85 bp, Homo sapiens
gccctgcaagctggggagaattgggttatctaagggatgtaattctgtcctaaaggtttaactcttttccaccagccagcagggt

SEQ ID NO: 6781971 - DNA, 65 bp, Homo sapiens
attccacaggactaccaatgtgcaatcctctctccttgagattttcaacttggagttcttggagt

SEQ ID NO: 6781972 - DNA, 88 bp, Homo sapiens
ggggaagtgggaacatataaaataaggtatgaaggtggaggttaaaaaggatagccactttactttcatattttaattctgcctcccc

SEQ ID NO: 6781973 - DNA, 90 bp, Homo sapiens
ctttatttggcttcagtttagagttatttaatctgagaagagcaactgatgctttaaagaggaaaagaccctagacaagttcaaggaaag

SEQ ID NO: 6781974 - DNA, 126 bp, Homo sapiens
taataactctgatctatatgaaagagccctgaaactcaagaaatttacagagaagatataacatacaaaatgtctgtaaaacttctttgtaaatagtaagtggctatatgcattggaaggttatta

SEQ ID NO: 6781975 - DNA, 109 bp, Homo sapiens
ttcggagatctcagattacccgcccttctgatcaactgactccaaatctggggtcttctcaaaacacccctcaggttagatagtttattagaactcacagaactcagaa

SEQ ID NO: 6781976 - DNA, 63 bp, Homo sapiens
ggtgcaaaaatctatcaccagcaacagaaggtgcagactgtgttggtggcggtaattttgtcc

SEQ ID NO: 6781977 - DNA, 100 bp, Homo sapiens
gcccttggcacccacgtaggcagggggctgtggctgtccagtccgtggacttgcactggattgggccattgcctcttctgttctcgatggcgctaggcgc

SEQ ID NO: 6781978 - DNA, 85 bp, Homo sapiens
cctttgctgaccccaagagaagagaatttatactgtaagactgacagtcctacagaactgagaattctctatcaatgggcaaagg

SEQ ID NO: 6781979 - DNA, 66 bp, Homo sapiens
gtcagtggagccaaggccagttctcagggcccagctcttggtgaatatgatcttggtttgatcgac

SEQ ID NO: 6781980 - DNA, 55 bp, Homo sapiens
ccagtctgaggcctggtgagggtgagataaaacatcccacaagcagtgaggctgg

SEQ ID NO: 6781981 - DNA, 76 bp, Homo sapiens
ctgggccaacatagaggtgagattgtggtgctgctggtggtggcagatcttactccagctctagattggaagtcag

SEQ ID NO: 6781982 - DNA, 73 bp, Homo sapiens
ctggaactcctggggagctggtggtcaggatatagaaaatccagctccagacctgctgtcccaggagggccgg

SEQ ID NO: 6781983 - DNA, 75 bp, Homo sapiens
ggtcggggatggccaggctcccaaggtccagctcaagaagagactgagcaaagggtgccggcccttctcccggct

SEQ ID NO: 6781984 - DNA, 63 bp, Homo sapiens
gtgtcaggagaattagggctttccttgtgtggctggcttgggagccctacttgtttctggcat

SEQ ID NO: 6781985 - DNA, 78 bp, Homo sapiens
cccatgattttcaggacagactagactagcgtggcattctttcacagctataatcgtcttctgcctcattattaaggg

SEQ ID NO: 6781986 - DNA, 74 bp, Homo sapiens
tttatattcacaaaatcaaatgcctttgatggtctcgtgggatatgtaaatgtgagtgatgcggtgaataggaa

SEQ ID NO: 6781987 - DNA, 90 bp, Homo sapiens
caggagacttggggatttatctcacagcctgagaagcacgtgggaaaaatagctactcaaaactttgtgaagaaaattcctaatttgctg

SEQ ID NO: 6781988 - DNA, 110 bp, Homo sapiens
tgtgggtcacagttaccacatgggacagcgcagatagagaacattcttgtcactgcagaaagttctcctggattgtgctgctctagacagtaattgctgtaaaacccaca

SEQ ID NO: 6781989 - DNA, 69 bp, Homo sapiens
ttgtggctcagacctcccagctccagtctaccaggattgtgcagaatcagtgggggccctgaatcacag

SEQ ID NO: 6781990 - DNA, 83 bp, Homo sapiens
acattgtgatctgcccaattctaggaaattcatacgcactgccatatgaatggtgcttcctggagttgtgcagtgcacaacgt

SEQ ID NO: 6781991 - DNA, 72 bp, Homo sapiens
aatatctttatagctgttataattttgttcctctttttggaaccttgataataagttgttgctttagatgtt

SEQ ID NO: 6781992 - DNA, 60 bp, Homo sapiens
ctttttcttccccatgggactgtaaataagtaacctgaacacacaatagggaagagaagg

SEQ ID NO: 6781993 - DNA, 128 bp, Homo sapiens
gagccccaggacccatcagtcctgctggacaactgtgagactgcttctgaacccagtgacctccatctctgggagcagttgcatctccagtggtctccaccacaggctggacagggtcaaggtggctt

SEQ ID NO: 6781994 - DNA, 71 bp, Homo sapiens
ggttatgcagctggttaagaacacagctagaagtgattcacgtttctgtgattctcagccaactgtccact

SEQ ID NO: 6781995 - DNA, 61 bp, Homo sapiens
agaggctgatattagctcatggattttcacggatagaaaaatcatgaaatatcagttcttt

SEQ ID NO: 6781996 - DNA, 115 bp, Homo sapiens
caaggacaagaaagatcttcagtgtgaagagcagcacaaatgtcccccttcttcaggaattgctacttatttttgactgctctgaacactggggatttataatatcttggccttg

SEQ ID NO: 6781997 - DNA, 57 bp, Homo sapiens
accatgaggaaatacatttgtgtttaagccactcagtctcgggtatttcgttatggt

SEQ ID NO: 6781998 - DNA, 66 bp, Homo sapiens
ttgaattttggactgcccaggattaatgctgatctaaagtccaatctttgcaggccaaattgttaa

SEQ ID NO: 6781999 - DNA, 60 bp, Homo sapiens
tcgctgtgaaaaccttggacaaatcccttccctgcggactcctgggttgtactacagtga

SEQ ID NO: 6782000 - DNA, 88 bp, Homo sapiens
tgtcccccctgcagacgtcttgatgcctcttctctctcaagtccaaaaatggaagcaaaggcagcaaatgtctggaacagctttaaca

SEQ ID NO: 6782001 - DNA, 63 bp, Homo sapiens
ggtttactgtttttaactaattgtgccttgctgggtggcaatacaatagaaagagtaaagacc

SEQ ID NO: 6782002 - DNA, 123 bp, Homo sapiens
taattagatattctctaaaatattaggatgagttaattcatttttaacatcatggatttaggaaggtgattctataaatcctaaggagaatatgatttacttggaattgaagaggaataatta

SEQ ID NO: 6782003 - DNA, 79 bp, Homo sapiens
ccctgctgaatgcaagccatggggggaactgctgaggtctggctcagagccaatcatggtgcatttggactcagctggg

SEQ ID NO: 6782004 - DNA, 66 bp, Homo sapiens
atacagccaagatatatgtatgattccatttgtataaaaagagcatatatgtatgtttgtatgtgt

SEQ ID NO: 6782005 - DNA, 58 bp, Homo sapiens
gacgtggccgaaactctctttaatgctacagcacaaaggccagagagaggctagtgtc

SEQ ID NO: 6782006 - DNA, 62 bp, Homo sapiens
catgcagatgtcatgaggcatgtctggcaggtcactgcttttgtgtctaatctgattgcatg

SEQ ID NO: 6782007 - DNA, 57 bp, Homo sapiens
atagtcagctttgagtaatgtgaaaagataaaatccacagggcatgcagctggctgt

SEQ ID NO: 6782008 - DNA, 64 bp, Homo sapiens
ggattagcaaattctaattcactacttcagctatttaggattagtgaattctaattgtttgtcc

SEQ ID NO: 6782009 - DNA, 72 bp, Homo sapiens
ttcaaaattgtaagaagaaaaatgctgcaaagttacaagattctatgcagtgttacttggtttgcagatgaa

SEQ ID NO: 6782010 - DNA, 92 bp, Homo sapiens
agcagacaaagttaaatcttctttgaaagtggtatctactattatctttatcatgcctcagtcttaaggaaagattagcatttgtaactgct

SEQ ID NO: 6782011 - DNA, 92 bp, Homo sapiens
agtcatgagcaatctagacaaaaataacttggtttcatcagaggctatttccactgctccttttcaagttgtattgtcatattgttttgatt

SEQ ID NO: 6782012 - DNA, 70 bp, Homo sapiens
ctggaagggagcactgtagagagacaagggcaaaaatcaggcagcgtctctagcagtagcccaaatccag

SEQ ID NO: 6782013 - DNA, 70 bp, Homo sapiens
aaagtaaaaactctacatggtcgcaaaaatgtgtttatttctaatgtccttgtggggtcattgttgcttt

SEQ ID NO: 6782014 - DNA, 65 bp, Homo sapiens
tattggtatggtaagaattgaagagggcaatgaaacatgccctaagttcttctcccatatccata

SEQ ID NO: 6782015 - DNA, 60 bp, Homo sapiens
tcagtttcctggttttaatattactatgattatgtaaaatataacctttgggggaactga

SEQ ID NO: 6782016 - DNA, 78 bp, Homo sapiens
gataggcattttagaatataggtagtttacttgtttattttgttggtaaatccctacatctgtgttttgatacttatt

SEQ ID NO: 6782017 - DNA, 70 bp, Homo sapiens
tgctttgaaatagatttctctgggtttgtcctatatagggtttgcaaaccttcttgaatctgtctctgca

SEQ ID NO: 6782018 - DNA, 73 bp, Homo sapiens
cttgtttaggaatggccaattgaattttaattattgacaatagggagtaggaagttggccacttttgatcagg

SEQ ID NO: 6782019 - DNA, 55 bp, Homo sapiens
tcacagtatcacacaaggattaaccttaccctggatttccattgttctactgtga

SEQ ID NO: 6782020 - DNA, 114 bp, Homo sapiens
gtgcagacagtaccctgggctgtggcagcatccgcccggcaccctccagcgtgctttagctgaaggagctggggtcgggaaggtccctgcagtacttgggtcttatgtctgtac

SEQ ID NO: 6782021 - DNA, 74 bp, Homo sapiens
tcccaatgagatgaacagggtacctcagttggaaatacagaaatcacccacctgctgtgttggtctcgatggga

SEQ ID NO: 6782022 - DNA, 71 bp, Homo sapiens
gcggcagagagcgagggctttccaggagccaatgagtctttaactccaagaggaagccctgcattctccgc

SEQ ID NO: 6782023 - DNA, 82 bp, Homo sapiens
gggtcagagagggagtcttgtcttgcaagggctgaggaaggcccttcttgccctcaacaagagcatgatccccactgacacc

SEQ ID NO: 6782024 - DNA, 58 bp, Homo sapiens
ctaagggcacagccaatcatcacagaaaatcgctgggtgacgtggctcatgcctgtag

SEQ ID NO: 6782025 - DNA, 71 bp, Homo sapiens
ttaatactggattgattcacaacactagctgaccccaaatataagatgagctagtgttaacccagtgttgg

SEQ ID NO: 6782026 - DNA, 64 bp, Homo sapiens
accacgcctggttaattttctgtttttagtagagacggaatttcatcatgttagctaggctggt

SEQ ID NO: 6782027 - DNA, 101 bp, Homo sapiens
tgcagctccagtctgccttgatgaccaaagggggaggcgaggcccagggaaagccactgagatgcctgtctctttcaatctgagagcgcctggagtgtgca

SEQ ID NO: 6782028 - DNA, 55 bp, Homo sapiens
ggtcctggaagtgtaagtggcaaggggattttctctgggacttctttctaggatc

SEQ ID NO: 6782029 - DNA, 102 bp, Homo sapiens
tgaggcaggagaatcgctggaacccatgaggtggaggttgcagtgagctgagatcacgccactgtactccagcctgggtaacaagagtgaaactccatctca

SEQ ID NO: 6782030 - DNA, 56 bp, Homo sapiens
aatttcaggcattagccagacagtaagaacacctctgtcctggtgaccctgaaatt

SEQ ID NO: 6782031 - DNA, 60 bp, Homo sapiens
aactctggctgcttcccaggtcaacagtcaaatggaaagaggaaggtgcagccaagggtt

SEQ ID NO: 6782032 - DNA, 56 bp, Homo sapiens
tggattctcatgggaccagtagggatatccaacccagctagttccaccggtattca

SEQ ID NO: 6782033 - DNA, 86 bp, Homo sapiens
gtgatctggtggtttctttggctgccttcacccctggccacatctgggtgtgttctttgggctaaggcagtaaatcaccagttcat

SEQ ID NO: 6782034 - DNA, 58 bp, Homo sapiens
gccaactctgcacaagcctggtgttagactgtagagtgtggggcacatgcagattggt

SEQ ID NO: 6782035 - DNA, 72 bp, Homo sapiens
ccagctccaggactgggagctgattggtttaagttagtcagtgtaacccaagcccctggccatggagtatgg

SEQ ID NO: 6782036 - DNA, 66 bp, Homo sapiens
ctttgggcatatgccaaattcattttccatgtctcttgggacccatatatggctgtgtgttgggag

SEQ ID NO: 6782037 - DNA, 77 bp, Homo sapiens
ggcctcattagaaccaggttcccggcaagtaaccagttccagacactggccttggaagggagcccgtgctgctggcc

SEQ ID NO: 6782038 - DNA, 77 bp, Homo sapiens
tgtgtcgccaaggagctgctgctcagttctagccaggacagcagggtgagctggatccaactccgtttggtggcata

SEQ ID NO: 6782039 - DNA, 70 bp, Homo sapiens
ggctgtaaatacctggaggctggcctcatggggggcactttacaggctgcctaccaagtatcataaagcc

SEQ ID NO: 6782040 - DNA, 65 bp, Homo sapiens
agaatactctttaaggaaagtgttgatctgaaataggatcagcaatcaaattgcagagtgtgact

SEQ ID NO: 6782041 - DNA, 58 bp, Homo sapiens
ggcaggtgccagttggcttgggggcttgaaagccataaaaaggagccagggctttgtc

SEQ ID NO: 6782042 - DNA, 121 bp, Homo sapiens
gaaattatttctgcttttgttctttaacccaatttgtttggtattagcctcagagctaaaaatacagtatgatctgagctatccagatagtatttaaaaagctggaaagcagaatcatttc

SEQ ID NO: 6782043 - DNA, 78 bp, Homo sapiens
actctgtaaacttacagagtggttgtccaactctgtaaacttacagagtggttgtccaactctgtaaacttacagagt

SEQ ID NO: 6782044 - DNA, 56 bp, Homo sapiens
aggagccgtaggggattcacatgcttacagacaggtgaaggtagactgggcttcct

SEQ ID NO: 6782045 - DNA, 98 bp, Homo sapiens
gaattgacatctgtttaatggcttgcagagaaaagaggtagagcttgttatattcctatctctatttctatgcagctgaaattgatcagtacaagttc

SEQ ID NO: 6782046 - DNA, 58 bp, Homo sapiens
gtgtatgcccatctttggaagctggatggaaacagatccctgaggtgaggggcatcat

SEQ ID NO: 6782047 - DNA, 77 bp, Homo sapiens
ggtttatggaaaggctgtggaaacttaacgctatcatcacagtatgttaagaatgacaaccataccatttccatgcc

SEQ ID NO: 6782048 - DNA, 70 bp, Homo sapiens
gtgctcacactgacacaggtttatctcagtctgtgatccttgggaggagaccctgtgtcagtttaagcac

SEQ ID NO: 6782049 - DNA, 59 bp, Homo sapiens
gcttgatcaaggaacaaaaaggagtatcttgtacatctgtcttgttctgttgtttgggt

SEQ ID NO: 6782050 - DNA, 59 bp, Homo sapiens
agaactgtccccagagagcactaatcaatcagtgtgacctccaaaggggacccagtcct

SEQ ID NO: 6782051 - DNA, 55 bp, Homo sapiens
gaattgcagatgatccccaagttaggagctcctgcatggggctatactgctgttc

SEQ ID NO: 6782052 - DNA, 130 bp, Homo sapiens
ggggcatggggtctgctgtcctgagtacggagaatcctctgcttggggttagggtgtcctgacgctagagggcctggtcccaggacagtggcaatcctagactcagattgtaggaagaaacatgtaaccc

SEQ ID NO: 6782053 - DNA, 60 bp, Homo sapiens
tgtgactatcattctaaacatctgatgaaatcaaatttcagtgtttggaatggtagtaca

SEQ ID NO: 6782054 - DNA, 62 bp, Homo sapiens
agggtgaacaatcataccacaattattttgtaagaggaaatttggaagatgttgtttatcct

SEQ ID NO: 6782055 - DNA, 60 bp, Homo sapiens
aagacaggctcggcactagcctcagcccctccctatgctgaggaagccaaaggctgtctt

SEQ ID NO: 6782056 - DNA, 106 bp, Homo sapiens
catggtaactcttcctggttggagaatgtcatttaaaataattctgtctttaaaactgtgggatgaggggaaggaaaatgtcacctccaaccaggtcctcaccatg

SEQ ID NO: 6782057 - DNA, 55 bp, Homo sapiens
gcgtggacctggaaggcccaaagactgaagcctccgggggcttacaggtgccagc

SEQ ID NO: 6782058 - DNA, 90 bp, Homo sapiens
taggaacctttgctccattcaacactgtattccattggacaaacacgcagtggccattaaacattgtttggaggagtgagagggttcctg

SEQ ID NO: 6782059 - DNA, 80 bp, Homo sapiens
ggactacatttcccagcagcccctggggcataccagctggggcgagtcagggcctctagggctgttgggaattggagtcc

SEQ ID NO: 6782060 - DNA, 59 bp, Homo sapiens
gaggctgttatgttgtaaactgtaaaattccaagtgctgtatttacaacttagagcctc

SEQ ID NO: 6782061 - DNA, 68 bp, Homo sapiens
ctgtaatcccagctactcgggaggctgaggtaggagaatcgcttgaacccgggaggcggagattgtgg

SEQ ID NO: 6782062 - DNA, 79 bp, Homo sapiens
cctggtcccccgcagagagtgagatcctcctggggatgacctcgttgtcctccagttccttggtttcagtgggaccagg

SEQ ID NO: 6782063 - DNA, 74 bp, Homo sapiens
ctgggggatgggagtcatgggggtggccctgtccctgggggagccaggccacacagatgactgctttccccaag

SEQ ID NO: 6782064 - DNA, 92 bp, Homo sapiens
tggtgtggttactgcttctgatattggggtcagagtagatctcgccaagaaggtgatattttaataggacctggatgagaaggagccaccca

SEQ ID NO: 6782065 - DNA, 111 bp, Homo sapiens
ggtttctttacctgtgggtctaagtgttccagtgctgtttgaggacctggtgtggggctccttcccagcccatctcaaaggtctagagcgggacttccaggtgaagtcact

SEQ ID NO: 6782066 - DNA, 70 bp, Homo sapiens
gctccttaagcttctcccgagtgggcagcaccagcttccgggctggcctgggcagaggctatggtggggc

SEQ ID NO: 6782067 - DNA, 79 bp, Homo sapiens
agagacacattagatgactctttctttctgttcatcactaacactaagctagaggggaagaacaatttaatttgtttct

SEQ ID NO: 6782068 - DNA, 76 bp, Homo sapiens
gggtgattcttacctgatcttaacaaacattactctatgatgtctgtcagatattaagtttcaggtatgtgtccct

SEQ ID NO: 6782069 - DNA, 82 bp, Homo sapiens
tcttttatctagcaagtaacatgctgacttatgtgggtagaatcccccagcacagtgcaaaatgtttctcctgttagaaaga

SEQ ID NO: 6782070 - DNA, 74 bp, Homo sapiens
atttaaggttgccaagcaggagtttcagagccaaatgttgcacatgtaattctagagtttggacagctaaaaat

SEQ ID NO: 6782071 - DNA, 66 bp, Homo sapiens
gtaggagggttagagggaaatattcttttgctattttgaagaaagtatcttggaaaactcttctat

SEQ ID NO: 6782072 - DNA, 68 bp, Homo sapiens
tcccactcagtccttttcagttaattctaatttaaaaatgttttaaatgattaggtgactgggtggga

SEQ ID NO: 6782073 - DNA, 80 bp, Homo sapiens
taggatcagggactggccagggtttggaatagatacacatgatataattattctattgtgaattcattcccttttttcta

SEQ ID NO: 6782074 - DNA, 72 bp, Homo sapiens
gctggcagttggggcttctctcagtttctggccacttgggcttctgcttagagcagctcacaacatggcagc

SEQ ID NO: 6782075 - DNA, 77 bp, Homo sapiens
aggatcacagtagtcagtggccatattagtagagaggatttcatacgttacaataaggttttgactattgagagcct

SEQ ID NO: 6782076 - DNA, 76 bp, Homo sapiens
tattttctgattattttgattttcccagtggaatatgaagttaggtcgtcagctgagaatcaagatggagagggta

SEQ ID NO: 6782077 - DNA, 62 bp, Homo sapiens
tgcactgcagtgactcgtttatgttctttacacctaaggaggacagcattctactgtaggca

SEQ ID NO: 6782078 - DNA, 73 bp, Homo sapiens
gtcatgtctcatctcttaaccccactcactctcagagagtagagacagtggttttgaaagaggaagacagaac

SEQ ID NO: 6782079 - DNA, 70 bp, Homo sapiens
agtgatatgtctctcaggtttaactttaagcaatagatgtttcaagcaaactctgagaaataaattagct

SEQ ID NO: 6782080 - DNA, 66 bp, Homo sapiens
agctattcccaccccaatggtggcacactaccccctaagaatggtggccacatatgtgggacagct

SEQ ID NO: 6782081 - DNA, 73 bp, Homo sapiens
aaatctgggacactggccacatttcaaaatactacacttaggaatttctgtaattggccaagtcacatgattt

SEQ ID NO: 6782082 - DNA, 66 bp, Homo sapiens
tttaccaactgtagatctgctaataacttaattaaccctagcagaacatgccagaagtatggtaaa

SEQ ID NO: 6782083 - DNA, 57 bp, Homo sapiens
cggcgcgctggctggccagccccggataggcgccgccggcagccaatcagcgtgccg

SEQ ID NO: 6782084 - DNA, 72 bp, Homo sapiens
caattcagcatggttatgtgatttttctgcagcattggaaggcacagagggagaaaagaatcagttggattg

SEQ ID NO: 6782085 - DNA, 78 bp, Homo sapiens
cccagtttctttattagggtaaggcttttcttaggaccaaagtttttgggcaggcttttccctagagggagtgctggg

SEQ ID NO: 6782086 - DNA, 95 bp, Homo sapiens
tctagtgttacattccactgtcccattaagtatttcagttactgttcttcccagggcaaattgtgtgttaatggtgttttatatgtaatatttga

SEQ ID NO: 6782087 - DNA, 77 bp, Homo sapiens
gttttaaaattttgttttagtggaggctgtgttcagttctagtgcagtttatgcagctggaatagaatttatagaac

SEQ ID NO: 6782088 - DNA, 74 bp, Homo sapiens
tgtatctaggtattcatgtttcgtggccataatgaagtacaatttaagccataggatgggatacttaggtaaca

SEQ ID NO: 6782089 - DNA, 61 bp, Homo sapiens
ctctctgatgccatcagacagtcattcatcacattctgccgattgtcagccttcagaggag

SEQ ID NO: 6782090 - DNA, 56 bp, Homo sapiens
tgtgagtatgcagtgtgtatactggaaaattgccagtgtttcaccgtatgttctca

SEQ ID NO: 6782091 - DNA, 64 bp, Homo sapiens
ctgatagatcaaagtttcatagccagccaaggggcagagctggtactcaagctttgatcatcag

SEQ ID NO: 6782092 - DNA, 78 bp, Homo sapiens
ttgagttataggaaatagttcatgcgatcagttctcactactcatgggtcagttctgcataactatttcccagaccaa

SEQ ID NO: 6782093 - DNA, 95 bp, Homo sapiens
ctgcctgtccgtccgtccctccacccccgtctgtgtctgtctgtctcggttggatgctcagacaccgggcgggggttggggacccgggtaggcag

SEQ ID NO: 6782094 - DNA, 56 bp, Homo sapiens
caggtggttccatgtttcatgacacctctagggtttctggacttgctgctcacctg

SEQ ID NO: 6782095 - DNA, 95 bp, Homo sapiens
ctggcagagcaaagtaagaattggaattagtaagatcgttttaataaaaacatttgtttggcttcaattactgaaataactgctttctcggccag

SEQ ID NO: 6782096 - DNA, 79 bp, Homo sapiens
gtcttgtaatttacataggtatctttaatgaacagctcgtttatagttccactgagtttttcctgtgtgtgttgcaggc

SEQ ID NO: 6782097 - DNA, 82 bp, Homo sapiens
caggcagcacaaggtatgtgaagagattaaaaaataggggatggtctgcctctttctctctacagtactttcatcctgcttg

SEQ ID NO: 6782098 - DNA, 110 bp, Homo sapiens
ctgaactaccaccagctatgggaatgtgagtgatttgtaggcaaggccattattaaggtcacctgcaaagttgcatcaaaacccaacaagttggtgtttcagaggttcag

SEQ ID NO: 6782099 - DNA, 79 bp, Homo sapiens
gaacttatcaaggtctcactaacacggaatgaaatgcaccaattttaactgtacacttcagtgagttttgtcaaagttc

SEQ ID NO: 6782100 - DNA, 129 bp, Homo sapiens
atgttgagggtgaggacgaatccagtggtggtggcggtagggatggccactgtcattacagagacctctcagacagcagctaacccctgggccacatcctgggtttctgtcgtcattctctcctggcgt

SEQ ID NO: 6782101 - DNA, 69 bp, Homo sapiens
ggaacccattcttttagctctgcaaggaaagctagacttgggctttccattgttggagcataaagttcc

SEQ ID NO: 6782102 - DNA, 86 bp, Homo sapiens
ttcttggaggatgtgcggctgcccgagctggatgtaggcgattggctggtcttcccctccatgggtgcctacatgtcctccatgag

SEQ ID NO: 6782103 - DNA, 89 bp, Homo sapiens
ggctggcacagtgttttggttatgttttctgtgctgtggtggccagcagcttcacacagatgcaacctgaccgagtcttgccacaagcc

SEQ ID NO: 6782104 - DNA, 65 bp, Homo sapiens
gagagaaaagggggaattgattctagttgttttcagatgacttttttctattccttctttctttc

SEQ ID NO: 6782105 - DNA, 66 bp, Homo sapiens
ttcttcaacaaggacactgttaagtaatactggctttaaaaaatacaggtactttgtaatgaagga

SEQ ID NO: 6782106 - DNA, 71 bp, Homo sapiens
tgagtggcaatggttgattaaaatttagccttaggaacagaattaaattaagggtacagccaacctactca

SEQ ID NO: 6782107 - DNA, 63 bp, Homo sapiens
atcgcagagtggaaattgatgagctcttgtctcttgaggcatgcaaattctttactctgtgat

SEQ ID NO: 6782108 - DNA, 55 bp, Homo sapiens
ggcagctcctctcagcaaaagataaagtctatttcaccctgaataggggctggcc

SEQ ID NO: 6782109 - DNA, 61 bp, Homo sapiens
ttccttgagctcaatctggtcagtaggaaaggaaatttgaccatgatgcatccttaaggaa

SEQ ID NO: 6782110 - DNA, 88 bp, Homo sapiens
cctcagtacttggctctcaaccactttgtaatcttaccaacaatccccagtaaagccagagtgtgttagagacaacagcttactaagg

SEQ ID NO: 6782111 - DNA, 56 bp, Homo sapiens
cctgagagtggtgtacaggagatatcaaatctctatagcataaacccatttttagg

SEQ ID NO: 6782112 - DNA, 58 bp, Homo sapiens
tgggatgggatctcgctgtgtcacccaggctggagtatagtagcgagatctcagctca

SEQ ID NO: 6782113 - DNA, 125 bp, Homo sapiens
gcctgcctttctgcttctgtgcctgggatttcctccagtctcactaggaacttgcttggcccatgctagggcacttcagtcagactgagacgacccaggagctaccatctgcggatgtcacaggc

SEQ ID NO: 6782114 - DNA, 73 bp, Homo sapiens
ttctcctatcatttttgctttcccaatttattagtataaagacagatggcaaggatgatgagaaccaggggaa

SEQ ID NO: 6782115 - DNA, 64 bp, Homo sapiens
ctaaatctcatctcaaattgtaatccccacctgtcaaaggagggacctggtaggaggtgattgg

SEQ ID NO: 6782116 - DNA, 70 bp, Homo sapiens
ccaagtgacacctgattgtgttcctcacgttcttgtctgataccaagaaggccaatagggtgcactgagg

SEQ ID NO: 6782117 - DNA, 71 bp, Homo sapiens
atgaagatagataggcagatggaaggacagacggatagatagagtcagtgtgtaattctttgtttcttcat

SEQ ID NO: 6782118 - DNA, 69 bp, Homo sapiens
tcaaggtaaggatcattggcttccccgaaacattgtatctgggaatacacactgatttatctattttgg

SEQ ID NO: 6782119 - DNA, 112 bp, Homo sapiens
aaaggttgaagcaattatctggataattcaggtagaacttaccaggcctctgggacccctttctccttctgctacttttgcctgagtaaccagggaatcacttcaatccttt

SEQ ID NO: 6782120 - DNA, 82 bp, Homo sapiens
agctggaagtctgaattcaaagccgcttgggaatcagagtgtgatgagataccgggttgagtggcttggacccagagtagct

SEQ ID NO: 6782121 - DNA, 56 bp, Homo sapiens
gcctccttcagtctgcgtggctgtgttgttatcaaggctatgtggaatgaaggtgt

SEQ ID NO: 6782122 - DNA, 58 bp, Homo sapiens
aaacctgttttttcactgacctttagatgtttagactcttcagtggatgaacatgttt

SEQ ID NO: 6782123 - DNA, 88 bp, Homo sapiens
gatattaatgggaaaaatagagtatactttaaaattgtggataggaattaaaatatcaggttaaatatatgctgtattcattgatatc

SEQ ID NO: 6782124 - DNA, 65 bp, Homo sapiens
cctggcagcattggtagagatttttatttaaaatctgaacaccactctctgcaatctgtccatgg

SEQ ID NO: 6782125 - DNA, 91 bp, Homo sapiens
gttttcctgttctgtgacctcaggtttgtaatggacacaaagagttgtgttggcgtttagtgcctggggcagtgccaccaacatggagagc

SEQ ID NO: 6782126 - DNA, 81 bp, Homo sapiens
gtggataggaaagcacagctggaaaataaatcagaaaaaattctggtatttgggtattgtgtttgattcattcctttccac

SEQ ID NO: 6782127 - DNA, 56 bp, Homo sapiens
aggaggcctgcagcgtggtccctgagggctctcggggacccatgaacaggttccct

SEQ ID NO: 6782128 - DNA, 77 bp, Homo sapiens
gtgaagtgatacaggttgaattttcttttaaaaataatttgggtaaaagataagagatcaactgtatacgatttcat

SEQ ID NO: 6782129 - DNA, 64 bp, Homo sapiens
gctcaaagtcataattataaacatcagttattcttgtggactgattttggttgttacttagggc

SEQ ID NO: 6782130 - DNA, 57 bp, Homo sapiens
cagtggggtctgtttttgtttccaagcaggtgatggctggaagaggagatgcctctg

SEQ ID NO: 6782131 - DNA, 60 bp, Homo sapiens
tccatcatttgtttgcatgcaggattttatttgacagtcctgtattgttttagatgtaga

SEQ ID NO: 6782132 - DNA, 103 bp, Homo sapiens
gtgggacccggggccctggctgtctagggaggctgtcaccccgaggcgaccggctcttccggggctgggacggctgtaggcggcaagaggcctcggcacccgc

SEQ ID NO: 6782133 - DNA, 61 bp, Homo sapiens
tgcctgtgacccaaggatgcgataactaccaaaattttgctggggctgttgggaacaggta

SEQ ID NO: 6782134 - DNA, 79 bp, Homo sapiens
ggactccggcggcggcggcggcggcggcggcggcggcccgagctggtcgctgctcctgagtcccgcgcgccctgggtct

SEQ ID NO: 6782135 - DNA, 114 bp, Homo sapiens
ggttcatcaagaggctgagggatccagttgtggctccgatgtttgggtgcccttgggatacccgggaggcaggagtcatagatttggagcgtcccgagtggccagacgagagcc

SEQ ID NO: 6782136 - DNA, 57 bp, Homo sapiens
cacaagggagcttagaaaacatgtgtcacttactactttctcagtaagtcctttgtg

SEQ ID NO: 6782137 - DNA, 79 bp, Homo sapiens
ccccagaacacctgtcagacgccctgtggttcgttagctggcttgcagagcagccacacctgtcctgccagctctgggg

SEQ ID NO: 6782138 - DNA, 90 bp, Homo sapiens
agttgtggagaaagcttacattaagtaagagattgaactgaatgacctctaaatttcatttcagtgctaatgtaatatgcttctatgact

SEQ ID NO: 6782139 - DNA, 58 bp, Homo sapiens
aagaggtacgtgccccaaacaagaaaattattttttggctccagtggtttgtgccctt

SEQ ID NO: 6782140 - DNA, 77 bp, Homo sapiens
tgtagttaccatagatggttagctctggggttgccaatccgatgctgacagagcaggtatctttggtgaatgaagca

SEQ ID NO: 6782141 - DNA, 59 bp, Homo sapiens
ccgccttctgacagcaaaactcagcctgtctacagataactggtcaggtcaggcggcgg

SEQ ID NO: 6782142 - DNA, 69 bp, Homo sapiens
ttgtgcaaaaggacttctgggttgaaacgagtttactcacatcagagaagccagatccattttgcatgg

SEQ ID NO: 6782143 - DNA, 74 bp, Homo sapiens
gcggacattcctttcagtgcagtcggaactactgttgatcaagcagagagtggcagttactgaagtgtccctgc

SEQ ID NO: 6782144 - DNA, 80 bp, Homo sapiens
gaggggcggaggtaggggccagaaagacttagaagatgtcccatatgtttaatgtctttggcctttaattctgatttctc

SEQ ID NO: 6782145 - DNA, 56 bp, Homo sapiens
ctcagtgtgtagtagcggtagttttcaatcctactatccgttagaatcatgctggg

SEQ ID NO: 6782146 - DNA, 64 bp, Homo sapiens
agcctgagcacccatctgcctgttgggccaccgggcagcttctgcagatgggagtcatcaggct

SEQ ID NO: 6782147 - DNA, 56 bp, Homo sapiens
cccctaactaaagggaagctaaagaagttacttctacacttttcattagctagggg

SEQ ID NO: 6782148 - DNA, 67 bp, Homo sapiens
ctgctggcagctgctgcattacgttgttatgttaatgcctacagaactgcagacagtgccaatgcag

SEQ ID NO: 6782149 - DNA, 85 bp, Homo sapiens
aagatgctacagagatttaggggggaagatacggcttccaaagaagcgtgtattaaaaccttaattctatttggaagattatctt

SEQ ID NO: 6782150 - DNA, 72 bp, Homo sapiens
gcacagcttttccacggtggtactggggagaggcctggcctgctccagggcctccagtggggaggaagttgc

SEQ ID NO: 6782151 - DNA, 84 bp, Homo sapiens
tggaaactcttctctgaagtgtcatttacatttctacttgcttgcatggtggaaatgtttcttgagctcagaacagaaagtcca

SEQ ID NO: 6782152 - DNA, 69 bp, Homo sapiens
gagtcatttttcactgcatatagagtcacttgagatataaaaagtctttttgtagtaatgaaagaactc

SEQ ID NO: 6782153 - DNA, 73 bp, Homo sapiens
gtaaaattttaaggcttcaatttttggtaaaatatgacttgctgtcaggtatatgagttggtagctttgatgc

SEQ ID NO: 6782154 - DNA, 90 bp, Homo sapiens
ttgtattcggtcagtgcaaaagtaattgtggtttttgccattactttcaatagcaaaagccacgattacttttgtaccaacctaatataa

SEQ ID NO: 6782155 - DNA, 74 bp, Homo sapiens
ccccaccagccaggccactcccgggtcctgcccaccatgggtgcccagaacctggagggcttgcccaggtgggg

SEQ ID NO: 6782156 - DNA, 63 bp, Homo sapiens
gctgaaattagactgcagaagtccttgctggttgcagaatggttgtaaatctagtttcacggc

SEQ ID NO: 6782157 - DNA, 59 bp, Homo sapiens
ggacggtgggggcaggagggaaagccaaggccgtgggttctaatcctgactcagctgct

SEQ ID NO: 6782158 - DNA, 68 bp, Homo sapiens
atagcaaaaggcaccagagtgaaagagaaaccactaagacaattttttgttcttgggcattttgctgt

SEQ ID NO: 6782159 - DNA, 82 bp, Homo sapiens
atccaattcagtcattaagacaactggagtaaccagactgtaaaatggttggtctggttatttcttaatgatgtaattggat

SEQ ID NO: 6782160 - DNA, 61 bp, Homo sapiens
gccctgtcatgtcagtgtctgtgtgtggcctcccagcccaaccagaaattgacagagaggc

SEQ ID NO: 6782161 - DNA, 74 bp, Homo sapiens
aattgtcagttatgcttatttgttggaaatagtgctttctctttcttttcgtttcttaagtgtaattgacaatt

SEQ ID NO: 6782162 - DNA, 77 bp, Homo sapiens
agcttctgattatattcacagtgacagctatacagagaaaagctttttccaataaagtgtcattgttggcagcagct

SEQ ID NO: 6782163 - DNA, 63 bp, Homo sapiens
actatttttaagttcccctgtagcctccagtgcaccaaatgcagggcagaacatatagatagt

SEQ ID NO: 6782164 - DNA, 71 bp, Homo sapiens
ggaaaccagtcagtctctattccagccacctctgtcagaacagggctggggaaagaggctaactggtatcc

SEQ ID NO: 6782165 - DNA, 94 bp, Homo sapiens
ttcctctttgcccaaagctgagctgtctgaatggtgaggattctctcctccactttgtctagcaacagcttggcccttgatactgcaggaggag

SEQ ID NO: 6782166 - DNA, 83 bp, Homo sapiens
ggtccaatagaaagggtggaattgttggcatcggagatatcttggttcaaattcatgcactatttcttctagctattgtgacc

SEQ ID NO: 6782167 - DNA, 68 bp, Homo sapiens
gagctgaggccagagtcttctgctcggtatctgacatcaagtctctgccttgggcttggcttcagctc

SEQ ID NO: 6782168 - DNA, 128 bp, Homo sapiens
tcctttctcctccctgggcctcattccttgacatgtgcatgatggtttagatggggttacctgagtgagtctggctaaacaacatcatgcctcaagaagttgatgctctatcgaggtggagaatagga

SEQ ID NO: 6782169 - DNA, 57 bp, Homo sapiens
cccaggcctggccaggggatgcctgcaaccatgcggataccccacaccagggctggg

SEQ ID NO: 6782170 - DNA, 119 bp, Homo sapiens
ttccagaaagaacctttgtttatagtctaatgctgtggttcccagagtggatcagagcaccctgagcactgtggggaactcacagagttaccactggatagtccaaattttttatggaa

SEQ ID NO: 6782171 - DNA, 55 bp, Homo sapiens
aaggcagccatagcaccatccagggatttcatcttgggggagaattggttgcttt

SEQ ID NO: 6782172 - DNA, 78 bp, Homo sapiens
agatgccatcaagactgtctgcctgtctctgtgcaaacgtgactgtccttacagaaagcagtagacatatggctatct

SEQ ID NO: 6782173 - DNA, 89 bp, Homo sapiens
caaaatgggattcaatagagtgtttagcatgaagttcattaggtagtacctttctcctaataatgctgggcattctggaagtcattttg

SEQ ID NO: 6782174 - DNA, 64 bp, Homo sapiens
ttctaagtcctacctgaaagcaaatatcaggtttgataaaccttgcagggctggaggcttagaa

SEQ ID NO: 6782175 - DNA, 71 bp, Homo sapiens
gggagttgaagagtttccagttgtggctcagtcactaactagtgctgagactgcgaggcacttcagctctc

SEQ ID NO: 6782176 - DNA, 64 bp, Homo sapiens
ctggactaggcgctggcgggcgggggtgcgccggagagtgccccggcgtgttcgcttagttcag

SEQ ID NO: 6782177 - DNA, 77 bp, Homo sapiens
tggcaaacatttacagaaactctaggtcaattgaggggcatagttcttttaaagtcagagtttttccagtgtagcta

SEQ ID NO: 6782178 - DNA, 80 bp, Homo sapiens
acagtcttcttctctgtcttctgtactttgttcctatgaccccagggaggccatagtttgggagtcagggggaagagtgt

SEQ ID NO: 6782179 - DNA, 78 bp, Homo sapiens
cagaggctgggctgccagctctccagatgctgtcacagtgatctcatctcaactaggaggctggcactcagtcttctg

SEQ ID NO: 6782180 - DNA, 59 bp, Homo sapiens
aggctccaagaggttaagtcactggcatttatgcttatagcttgtgagttttggagctt

SEQ ID NO: 6782181 - DNA, 75 bp, Homo sapiens
gtagtctataaatatatatgcctgataaaagtgattagcaatcaggaaatacttatttataatgtgtgagactat

SEQ ID NO: 6782182 - DNA, 61 bp, Homo sapiens
attcaaagaacaaattagctgttttatacaaatgtttaatgtggctgagttgttctagaat

SEQ ID NO: 6782183 - DNA, 91 bp, Homo sapiens
gtgaccaagcaaaatctgtttatgcatcgttaataccaatgggactcatttcatcatggtccaattattgatgcaataaactgtgggtcat

SEQ ID NO: 6782184 - DNA, 72 bp, Homo sapiens
gggacggtcacgagcagagctcccaaggggaccgctggggactgggcgggggctctgcttctcacctgttcc

SEQ ID NO: 6782185 - DNA, 109 bp, Homo sapiens
gagtatggtctagatttcccattgattgggagagtgtgtgaatgaatgagtgaatgtcctttctcacatcattaagacttctcctggttaaagaatttaggttatgttt

SEQ ID NO: 6782186 - DNA, 106 bp, Homo sapiens
ttgagacagagtcttgctctgttgtccaggctggagtgcagtggcatgatggtctctgctcactgcagcctccacctcccatgttcaagcaattctcctgcctcag

SEQ ID NO: 6782187 - DNA, 75 bp, Homo sapiens
cggcaatcctgttaacccagggtgaggggagtctagccgggctgcttttctcactccctggaaaactttttgctg

SEQ ID NO: 6782188 - DNA, 69 bp, Homo sapiens
cttgaggacgtgaggagtatttttaggtgctgaatgcagccctgaaatatttccacggccactcccgag

SEQ ID NO: 6782189 - DNA, 73 bp, Homo sapiens
tagacccaatttcctggagcaggcaccagagtgatcctggtgcagcctctctgcttcaggaacttgccatcta

SEQ ID NO: 6782190 - DNA, 55 bp, Homo sapiens
gtccttggaggtgtggaatctgactgtgtaaagtaagtggttacccacccaaggc

SEQ ID NO: 6782191 - DNA, 78 bp, Homo sapiens
actgcctcaacagctagaaatatagagaacttgcaaacttctttgtttctgtctttgcattttatgccgttatgtagt

SEQ ID NO: 6782192 - DNA, 64 bp, Homo sapiens
cagcatggagggactcctgcttctagtaatgatgtgctaaggagctggaatggtccttttgctg

SEQ ID NO: 6782193 - DNA, 74 bp, Homo sapiens
gccctgcgctggctcccggggatcgagcaccgcgagaggttgggcgcccggggccgcgggggtgggcgttgggc

SEQ ID NO: 6782194 - DNA, 57 bp, Homo sapiens
ctgcttctctccctcataatcgtacaattccctcagtacatgcttgagaggatgcag

SEQ ID NO: 6782195 - DNA, 98 bp, Homo sapiens
gtctgggggacaggcacagctgacagttctgaccagtggccacctgaaaatcagggccagggcctggggactgtcccctctgcctccatcccctgggc

SEQ ID NO: 6782196 - DNA, 61 bp, Homo sapiens
ccgggaagttcaaggtcaaggccctggcagatttggtgcctcatgaaggtctgcttcctgg

SEQ ID NO: 6782197 - DNA, 73 bp, Homo sapiens
gccctgaggggcaaccaggggtgacaactagggtgcattactcagacttgcttcctggtgccacttcagaggc

SEQ ID NO: 6782198 - DNA, 89 bp, Homo sapiens
tggggaagctggggaaaagaaggatgggagaaatcctatgggattacttcaggacttcttagatgccttccgttacctagtggccacca

SEQ ID NO: 6782199 - DNA, 65 bp, Homo sapiens
aacaagccagtattcaatggggctagggggaaaattacctgggcttcaggaattacaggagagtt

SEQ ID NO: 6782200 - DNA, 56 bp, Homo sapiens
gctctcccattttactgataagaaaagcaaggccacattgcagttgggtggggagt

SEQ ID NO: 6782201 - DNA, 59 bp, Homo sapiens
cgttcttttcatatttacatggaggaatttctgtggccacatggatgtgagacagaatg

SEQ ID NO: 6782202 - DNA, 81 bp, Homo sapiens
tgactggagttatttatgtttgacaatgatctggagattgcgagtaaacctgattattgtaaatatatttgctcttattca

SEQ ID NO: 6782203 - DNA, 67 bp, Homo sapiens
aggtatgttatgtagtctcttctcaactagactgtagtcccagaggctaggaccatgtatcatactt

SEQ ID NO: 6782204 - DNA, 59 bp, Homo sapiens
ttccaaggcagttttctctctgttccccattagcagggtctaaaaaaacagcctttgaa

SEQ ID NO: 6782205 - DNA, 71 bp, Homo sapiens
gcctgttttcctgctgtggttgggagacattcaatccagacaactcctcctccacagcagctgacaatggc

SEQ ID NO: 6782206 - DNA, 62 bp, Homo sapiens
ctatgatggcagcgattgctgagagtggatacaaatacttaatgcggggcattgccattgag

SEQ ID NO: 6782207 - DNA, 76 bp, Homo sapiens
aggtgatttctgttcttggggatctgaaggcaaggtctgaactaagcacctgcccacttcccatgacatgacacct

SEQ ID NO: 6782208 - DNA, 66 bp, Homo sapiens
tgagtgggccagtggcctgtcagaagccgtggggagccctctccagacatactgccaccccacaca

SEQ ID NO: 6782209 - DNA, 86 bp, Homo sapiens
gcaacaaaatagatccctacattgaactatgagttcagttagctgggaagctgattttcagtgctgggggtcatagattttattgc

SEQ ID NO: 6782210 - DNA, 129 bp, Homo sapiens
tgtcaatgattgttggtgtattatatacgtgccgggtgcttcactgacctgttttcacaagatagccctattttatggatgagttcaatgaggcagagggcggtgaggtgatctgctcactatcacaca

SEQ ID NO: 6782211 - DNA, 78 bp, Homo sapiens
atctgccttgagcttacacaggaagcagcctggagccagactgcccaggttcaaatagctgtgtgaccttggacagat

SEQ ID NO: 6782212 - DNA, 60 bp, Homo sapiens
attttagaaataacgaaacactcagtgccactggtactgaattttggcatattctgaaat

SEQ ID NO: 6782213 - DNA, 65 bp, Homo sapiens
tgggcatcaaacacgggccatgtcactttgaatgtctcctgcttcaagggctgtgttcatgccca

SEQ ID NO: 6782214 - DNA, 60 bp, Homo sapiens
actgagcagtagattttctgttgtgattttatttagcatatgtagaaactgaggctcagt

SEQ ID NO: 6782215 - DNA, 76 bp, Homo sapiens
agacagttggcccatttttagtagatttagtgattaaagactcagtatgtcagagtgaaaatggtcccaaaagtct

SEQ ID NO: 6782216 - DNA, 63 bp, Homo sapiens
tctgtggaagctgacacggtggttctcagtcacatggaacttctgtgcctttcatttcccaga

SEQ ID NO: 6782217 - DNA, 57 bp, Homo sapiens
ggggctgtttttggaatggctgaatgttcatgctgcgtgcctgtcctgaactgcctt

SEQ ID NO: 6782218 - DNA, 64 bp, Homo sapiens
tcatgtaaattctttgagaaatactgggtcaaattattgtcttggtcagctcgagagtttgtga

SEQ ID NO: 6782219 - DNA, 100 bp, Homo sapiens
caggtcatttggggattttgtagagaatgttaagcactttgggtattatcctaactgcagtaggaatttgttgcaaggttttaatcaaaagaatgatttg

SEQ ID NO: 6782220 - DNA, 60 bp, Homo sapiens
tgtcttctgactaaggtgaattaattttcaatcactggattgcgtacctggaagaagata

SEQ ID NO: 6782221 - DNA, 66 bp, Homo sapiens
ttttttccaccaggagatatttcaaaatgtctggaaatgttttgattgtcacactggaggggaaaa

SEQ ID NO: 6782222 - DNA, 99 bp, Homo sapiens
ggacattagatgtggtcaaggcatctctagagcaatggttctcaactctatccacatatttgaatcacctggggatatcctttgaaaatactagtgtct

SEQ ID NO: 6782223 - DNA, 98 bp, Homo sapiens
ggaaaggcaagttcttcttcttcagttcccttcttctggcccctgtctcctgaatggcattgtcagtgagggagaggacctcaagaactgtacttttc

SEQ ID NO: 6782224 - DNA, 80 bp, Homo sapiens
cctgccacacccactcggcagcctatagtcacatggctacaagtagctgtgggaatactgcgagtgtagtttttggcagg

SEQ ID NO: 6782225 - DNA, 85 bp, Homo sapiens
gtttgtaatctagggaaagaagcagatacataaaccactaggtgaaatactagtgtatttgtctggcttctccagaaaaacacac

SEQ ID NO: 6782226 - DNA, 69 bp, Homo sapiens
gagggagagaaggtcactaaggacccacagatgccaaccttgtggtgttccggagggcctctctctctc

SEQ ID NO: 6782227 - DNA, 95 bp, Homo sapiens
gcaatgtctatagcacaactttctgggttatctgatcctaattatatggtagctattttataactctgaaagttatagatggctgatagcaatgc

SEQ ID NO: 6782228 - DNA, 81 bp, Homo sapiens
actgagtgggacttagcagtataaatccaggtagttcctatctctcaactgtcttatttatatttctgtcattaactcagt

SEQ ID NO: 6782229 - DNA, 125 bp, Homo sapiens
atagcaggtttaattttcttattcccaatctcagaatgaaagcttttaacaatttaccttgaattatgattttgcttaaggcttagaagctatctgctattgcagtaagaaagtttcccttctat

SEQ ID NO: 6782230 - DNA, 57 bp, Homo sapiens
gaggtccagagcaggttcagtggttcaaacgtgctcagctccccttctctgggcctc

SEQ ID NO: 6782231 - DNA, 60 bp, Homo sapiens
tagtcattaattagtaggaaggtgagggacagcatcatatctaactatctgttatggctg

SEQ ID NO: 6782232 - DNA, 77 bp, Homo sapiens
gggcacattctaagacatttatgtttctctaggaaaaattcctggtttgaaatacttgtcctggacttaatgtgtct

SEQ ID NO: 6782233 - DNA, 81 bp, Homo sapiens
ctcttttttccttccttgctagcctgagctactagtgcctctttcacagaacttaggaatgtaaagggaggacgcaaagag

SEQ ID NO: 6782234 - DNA, 78 bp, Homo sapiens
aaggagccaatcaaaagcttaccttttcagtctttgttattgttcaaggatgattggtaatgacactatcttctcctt

SEQ ID NO: 6782235 - DNA, 75 bp, Homo sapiens
tgcctcttcctgtcctcaccttggcaggggggaggctggtcccacctaggctgagtgtggacccaggaagtagca

SEQ ID NO: 6782236 - DNA, 66 bp, Homo sapiens
ttcctagacacctgcgtgtgtaagtcccaattctcaaaacggggaatgcaaggccagggtcaggag

SEQ ID NO: 6782237 - DNA, 62 bp, Homo sapiens
gaacatccatgccaactttttcagagaacattccaaaacagtatggcatgtggtccatgttc

SEQ ID NO: 6782238 - DNA, 72 bp, Homo sapiens
cgggtgggggatcgaggcgttcccgaggcgaatgaggctgtttttcaaaatccgggaggcgcccctcgcccg

SEQ ID NO: 6782239 - DNA, 123 bp, Homo sapiens
gatataatcatttatgcaaatgccaggattctattcgctgaagaggttccaggttgagttacatttgagaagctggagaatgtggatgatcctggagagccgtttagcatacaaagagatatt

SEQ ID NO: 6782240 - DNA, 59 bp, Homo sapiens
gtctgctgtgttcagagctgtgacctttgtgcctacatagcgcctgcaacaaggcagat

SEQ ID NO: 6782241 - DNA, 91 bp, Homo sapiens
tctgaaattctgtaagtctatggttgttttgttcctggacccagtaaaaacatgcagaacagaattaccgaagatctgacaaattatcaga

SEQ ID NO: 6782242 - DNA, 93 bp, Homo sapiens
ttacatagaatagtgtatgatttcactggaattttaacatttctgcaaaaagagtaaagagtccaagtgggccacaattactattttatataa

SEQ ID NO: 6782243 - DNA, 55 bp, Homo sapiens
gcacacgaggctggagaccagcccagatagttctagttagcctcagagcctttgc

SEQ ID NO: 6782244 - DNA, 110 bp, Homo sapiens
tgacaactgtgaaacacaatgcttctgagggaattacagcatattactttttgctttattttatttaatcttctgtttctctcctcaggaagtgttatttattatcctca

SEQ ID NO: 6782245 - DNA, 60 bp, Homo sapiens
gttagagacatctctggtttctgttcccagcctaactgcacagaaaagagatattctagc

SEQ ID NO: 6782246 - DNA, 81 bp, Homo sapiens
ttagtgacaggaattacatttgtgttactgcagattgtattcacagtgtggaagtgattacaatgtagtatatgtccctga

SEQ ID NO: 6782247 - DNA, 55 bp, Homo sapiens
cccaggcttttaagttagacagacttgggttgcagtcttgcttgtaggacctggg

SEQ ID NO: 6782248 - DNA, 80 bp, Homo sapiens
gacatgggagggacaggaggtgggacaaagagaagcaggacttactggaccaaagccttctgatatctcttggcatagtc

SEQ ID NO: 6782249 - DNA, 97 bp, Homo sapiens
caggtgaacagtttgtcaaacctcaaaattagtaacaaaggccaccacccttgacctgggactttgagcaattctgagatgcaacaagcttcacttg

SEQ ID NO: 6782250 - DNA, 66 bp, Homo sapiens
ggagaaaggaggcagaactcacatggacacacccagtgcagtccagagtttgagtctccttccttc

SEQ ID NO: 6782251 - DNA, 107 bp, Homo sapiens
ggccagccttccatagggagctgtggtcagctcagtcgctcactgcagagctcagtactctctgaccattgctccctacaaaaacaaactcccggccaagtttggcc

SEQ ID NO: 6782252 - DNA, 111 bp, Homo sapiens
tctgctttgcagcaaatatggttatagcaagattccagtttatttccaagatgacaaaaatgaatttgatatgttaggaagactgatttgaacaaatgtagcagagacaga

SEQ ID NO: 6782253 - DNA, 112 bp, Homo sapiens
tatgtaccagtcacgtgcaggatatgtattaacattaataaaatggcattcataggataccattaatattagtgttaatattagttagcatgaataggatgacatggacata

SEQ ID NO: 6782254 - DNA, 84 bp, Homo sapiens
ggccacggcacctgttggggtctgggtttccccaccacacacggggcagtgtgcggtgagctgaggccctggaggctctgggcc

SEQ ID NO: 6782255 - DNA, 55 bp, Homo sapiens
gttattgacatgtattaagcacagaattcccaaatgctaaatgcatgttaataac

SEQ ID NO: 6782256 - DNA, 78 bp, Homo sapiens
aatatgtgggtttcagtttcatggcacagctatcttcagctaaatatagctgtgccatgaaactgaatcccatgtatt

SEQ ID NO: 6782257 - DNA, 70 bp, Homo sapiens
ttgcttgaacccaggaggttgcagtgagccgagatcgtgttattgcactccagcctgggtaacagagcaa

SEQ ID NO: 6782258 - DNA, 62 bp, Homo sapiens
ctgtggctctcagaggctgctgtttaccctcaggtgcattcttggcctctgagatgccacgg

SEQ ID NO: 6782259 - DNA, 84 bp, Homo sapiens
aggcagttccagtgagacgagtaccctctgataagaaatactcatagtggttcttggcaatggtattcatccattcagaagcct

SEQ ID NO: 6782260 - DNA, 120 bp, Homo sapiens
acttgtagatgggttctctggagagatatggaagagcctgggaatttagcggctcaaatcagctggcaactggagttcatttaggtgattcacatacaatttccggctttccttgcaggt

SEQ ID NO: 6782261 - DNA, 73 bp, Homo sapiens
tccccaccccttctaccactatgagccagtgttattaacaatagtgtgtcttatcctgggagaaaagagggga

SEQ ID NO: 6782262 - DNA, 130 bp, Homo sapiens
tcccaccatgcctcctgtccaacactgaagataacaattcaacatgagatttgggtggtgatatggtttggctgtgtccccacccaaatctcatcttgaattcccacgtgttgtgggaacaacctggtga

SEQ ID NO: 6782263 - DNA, 82 bp, Homo sapiens
accaccttctgataattgagaacaggagtgttcttttaggattttcctggatacctaccacctgttctcacacgaggctggt

SEQ ID NO: 6782264 - DNA, 72 bp, Homo sapiens
aaactttggcggtggaggtagtggaggtaacggcgtgagctttacagcacagtgcttttactgaacaagttt

SEQ ID NO: 6782265 - DNA, 70 bp, Homo sapiens
ggtggcccagctgcagatggtggattagccccaatgctgtctgccattgatgagctggcattatgccacc

SEQ ID NO: 6782266 - DNA, 62 bp, Homo sapiens
tttagtgtgaaagcagccatagattaatatataaatgatgaacatggctgtgttccagtaaa

SEQ ID NO: 6782267 - DNA, 62 bp, Homo sapiens
ctcagaagaacaaaggctctacaacctgacaggccagccatgggaccctgggttcttctgag

SEQ ID NO: 6782268 - DNA, 99 bp, Homo sapiens
ggtgcaaaatgtaagggggcactcactttgagggtcgtgcaggttcaggatcagtactgacacaaccctgagaatgagtgtctcctaaaattgtgtgcc

SEQ ID NO: 6782269 - DNA, 79 bp, Homo sapiens
ctgcacctatggcacttggtcacttcctgcgggtaactgtgaagaagaagaggaagtgactaggtaacccaaagcacag

SEQ ID NO: 6782270 - DNA, 71 bp, Homo sapiens
tgagctagggttagagatgtctcctgcacattacttagcaatagaaagtgttctacactttgaccttgtcg

SEQ ID NO: 6782271 - DNA, 71 bp, Homo sapiens
aacacctctggctctgcacctttcttaaaaatcgctttgcagtgattcagcatggagggcagatgggtgtt

SEQ ID NO: 6782272 - DNA, 62 bp, Homo sapiens
cggggagctgctgaacacaagggtctcctgctggagaccctgaattcctgttgcactccctg

SEQ ID NO: 6782273 - DNA, 68 bp, Homo sapiens
ctgtaatcccagctacccaggagactgaggcaggagaatcgcttgatcctgggaggcggaggttgcag

SEQ ID NO: 6782274 - DNA, 120 bp, Homo sapiens
tttggctgtagtatatcataactgtgagttctgtgagtctgcctagcacatcaccaaatctggggatggacttggggactccaggcacagaaccataactggaatagacttacaggtgaa

SEQ ID NO: 6782275 - DNA, 84 bp, Homo sapiens
gagaatcacttgcacctagggggcggaggttgcagtgagctgagatcatgccactgcacttcagcctgggcaacagtgagactc

SEQ ID NO: 6782276 - DNA, 66 bp, Homo sapiens
ggtgaccctggaacacatctcgctgcagggcaaatgtccttggggtgtcatgttcctctggtttcc

SEQ ID NO: 6782277 - DNA, 66 bp, Homo sapiens
gtggtctgggtctcttaccatgtgactggtaaggcatcagtcacatgggattagaacccatcctat

SEQ ID NO: 6782278 - DNA, 99 bp, Homo sapiens
ggctacaagagctctcccttttcacttcctatgtaggcttttggggcaaaacttgctcctgacagagtccatatggcctgtaagcagtgctctgtggcc

SEQ ID NO: 6782279 - DNA, 87 bp, Homo sapiens
tctgggaaagccaggtatttgttatttgagagtgcggctgctggaggtgcagtttactcccactgaatagaagctgagggccccaga

SEQ ID NO: 6782280 - DNA, 63 bp, Homo sapiens
ttggcagctgcacagactccatgagcactgaaatgcttaggtattatccatgtgagctgccaa

SEQ ID NO: 6782281 - DNA, 77 bp, Homo sapiens
tggggtgaggatgtgtgataacagggcatgacgggcaggtagaactgctcgcttgtgttttacacacaggcgcccca

SEQ ID NO: 6782282 - DNA, 57 bp, Homo sapiens
tttgaagacaatgtgatttttgtgcttggcaggggctagatcatgaatgtcctcaaa

SEQ ID NO: 6782283 - DNA, 71 bp, Homo sapiens
tccccagggccaagtccaggacctcggtggcacccagaccggaccggcagcctgggcttgggcgctgggga

SEQ ID NO: 6782284 - DNA, 58 bp, Homo sapiens
gctgggagacagacttggaaccaggagttctccaggccccgccatggtctctccctgc

SEQ ID NO: 6782285 - DNA, 82 bp, Homo sapiens
cttcattcaactactttgtgtgtgagtttcttctgtaaaattgggacgctaattatattcatatcatagagttattgagaag

SEQ ID NO: 6782286 - DNA, 56 bp, Homo sapiens
gcttggacattttaggcttgagatgtttattagacactcaagtggagatgccaggt

SEQ ID NO: 6782287 - DNA, 59 bp, Homo sapiens
ataagcaggagatgcaggaatgtattaatagatatattccagttcatctcttgatttat

SEQ ID NO: 6782288 - DNA, 89 bp, Homo sapiens
tacgtgaatggcccagcagctggttatacctgtggtttctgctaattagcctgaggttgtgctggctgcctccttgggctttcagagta

SEQ ID NO: 6782289 - DNA, 68 bp, Homo sapiens
tccaaactagtatcttccgtgccatgcaataagagctacattgcaaggctgcagagggtgctactgga

SEQ ID NO: 6782290 - DNA, 87 bp, Homo sapiens
aattgtgatgatagcagctcactaactctgcgtttgtggtgtgatgagcagctagtgtagagtagctgaatgctaataattatggtt

SEQ ID NO: 6782291 - DNA, 74 bp, Homo sapiens
gtgggagagaccccgcttagggaaagtcgagggaagttcctcattactactcctggtgcctggagctctccagc

SEQ ID NO: 6782292 - DNA, 85 bp, Homo sapiens
agtattattatgctctgtttcacatttgaaaattactacttcatcttggtagtgaaatgatagtgtaaatacagccaatgatgct

SEQ ID NO: 6782293 - DNA, 123 bp, Homo sapiens
ggagaattttgaccagagaacagatggccaataggtaatgatatggagaaactgaacacaagagtcggcacactggagtttttccagttgcctcagtcagtttgttgctctagcaatttctct

SEQ ID NO: 6782294 - DNA, 82 bp, Homo sapiens
ggggcatggaggggaggatcagggctggggatattctggtgggaccctcaaaagaaccgggttctggtctcaccctgccacc

SEQ ID NO: 6782295 - DNA, 98 bp, Homo sapiens
ggccgatggagcctggagacagatggtcagtgttgaagttctacttgaggcatattcacaagatttgctttagatactcccaatgtccttccattgcc

SEQ ID NO: 6782296 - DNA, 77 bp, Homo sapiens
gaaagaacgtctttgaaaattcatctcatagcagagtcaatattgcttctgcatgtggatttttattatcatctatc

SEQ ID NO: 6782297 - DNA, 59 bp, Homo sapiens
ggggagtttacagcctagcgcttcctacttgctttgcacactggtctgtcatgctcccc

SEQ ID NO: 6782298 - DNA, 58 bp, Homo sapiens
aaactaagggaccagaggtgaaaggcccagtgactgcactgctgtggtcctttatttt

SEQ ID NO: 6782299 - DNA, 73 bp, Homo sapiens
gtctggtcttacttgagaatagtgaataatggaatctacattcacatggcatgttcatttcagggagccagac

SEQ ID NO: 6782300 - DNA, 77 bp, Homo sapiens
tgggggctgaggtgggaggttgcttgagcctaggatgtcaaggcttcagtgagctgagctcacaccactgcactcca

SEQ ID NO: 6782301 - DNA, 71 bp, Homo sapiens
tcaaggtgccagatagatttggtgtctggttgatatggtttggctgtgtccccacccaaatctcatcttga

SEQ ID NO: 6782302 - DNA, 81 bp, Homo sapiens
gaaactatgaaagtaccaaagacatgaccctaattctccaaggagcacagttgtagggctgctttgggtctctctagtttc

SEQ ID NO: 6782303 - DNA, 74 bp, Homo sapiens
gcctgcccagctgtctggcagggatgggggtggcggtggcgctgctcatcccggcagcaggcagctggggacgc

SEQ ID NO: 6782304 - DNA, 61 bp, Homo sapiens
cagttgtaaatgactggcattgggactaacaatagttcccactgatgttgggttttaattg

SEQ ID NO: 6782305 - DNA, 99 bp, Homo sapiens
ggctatgcaggggtgatagaattttatgttttatggctatatcatcagttcatatcgatgattgggaccttgaaataggatttatcatcttatttagtt

SEQ ID NO: 6782306 - DNA, 55 bp, Homo sapiens
cagaggtgcatacaggtcattagtgacaggactggaatctgacctgtgtcctctg

SEQ ID NO: 6782307 - DNA, 103 bp, Homo sapiens
aattcaatagagtctttttaaaaggttctggttttgtttggcatatagattttgcagtctggaataggacaaaaccaaaatttcaaaggaagtttaatgagtt

SEQ ID NO: 6782308 - DNA, 87 bp, Homo sapiens
attctcagaaagtcccagtcttagacagaagagttattttataatataaaataatgacattcttagactggattttattttgggagt

SEQ ID NO: 6782309 - DNA, 66 bp, Homo sapiens
cttagctgcagtagccacatttcaagtgcttaatagacacacatggtcagtggctactctgttggg

SEQ ID NO: 6782310 - DNA, 98 bp, Homo sapiens
ggcgggtcttgctgcctcgtgagctctgagcagctggaggtcgtgacactgaaatgaacacacctgtctccaagcagggctgcaaggcagctcctgcc

SEQ ID NO: 6782311 - DNA, 60 bp, Homo sapiens
cagtcttgctttactgagatggctaatttgtttagcagttattttgagaatgcatgactg

SEQ ID NO: 6782312 - DNA, 76 bp, Homo sapiens
gtccttaatcattgctctttgtcatgtccttaactgtctgagaagacaggcagggcatggaaaaagtcttgagggc

SEQ ID NO: 6782313 - DNA, 73 bp, Homo sapiens
gcttgccactggctggccatgcgggcgggcaggctagacattcttgccgcgcaggcgcagttcgtggcgtcgc

SEQ ID NO: 6782314 - DNA, 84 bp, Homo sapiens
gagtgggatgctggccagaggtgagggggattcttgtcctgtgcaaccctgggcaagtcactttgactctctgggcctccattt

SEQ ID NO: 6782315 - DNA, 63 bp, Homo sapiens
aaggattggaaagaacagagttgtgtaaagagcagtagacatagagttcaattttcagtcctt

SEQ ID NO: 6782316 - DNA, 55 bp, Homo sapiens
aagttatgctgggatggtttcagagcctgtttgttctggcatcccagtaaagctt

SEQ ID NO: 6782317 - DNA, 57 bp, Homo sapiens
gatcatctcaggcatgggtactgcagtcaagagtgtagaaatacagcagggatgatc

SEQ ID NO: 6782318 - DNA, 65 bp, Homo sapiens
gattcctcaaactctgcctgcatctcccccaagccagagaggatgcagggtagacaggtgaggtc

SEQ ID NO: 6782319 - DNA, 77 bp, Homo sapiens
taggttggtgcagaagtaattgcggtttcaccactgaaagtaatggcaagaaccgcaattacttttgcaccaaacta

SEQ ID NO: 6782320 - DNA, 93 bp, Homo sapiens
ccttttgttccaatccccaagctctttccactaaaccactgcagaatagcaatcatgatttagaagaaattaatcctaggtatggataaaagg

SEQ ID NO: 6782321 - DNA, 68 bp, Homo sapiens
tgtatctgtaatcccagatcaatactgaaaatgctttcagggtcattcttgggcatgcacagactgca

SEQ ID NO: 6782322 - DNA, 89 bp, Homo sapiens
cagctgcctggtggacagcagccagcagcctggcagcgtggggctggtgagctgctgctgctatctacccaggcaactccattttgctg

SEQ ID NO: 6782323 - DNA, 81 bp, Homo sapiens
gcctcctgacggggtcatagaagcagggcagggaaaagcaaatcactttgctcctgctgcatgcatctcccacaaggaggc

SEQ ID NO: 6782324 - DNA, 71 bp, Homo sapiens
ctcttggctcatggctggaagctcagttagtcaaatgaagattgacttggtgcacagccaaacctcaagag

SEQ ID NO: 6782325 - DNA, 79 bp, Homo sapiens
gaaatctcatttacaacatgaggactgtagttagtaaaactgtatggtattggggttctttgttaaataagtaggtttt

SEQ ID NO: 6782326 - DNA, 77 bp, Homo sapiens
agcaggtgtagagtcggcacctggccagaggagaggataggggttgcttcctcgaggccagcgtggtctgcactgct

SEQ ID NO: 6782327 - DNA, 60 bp, Homo sapiens
ccttcaaggcaaggagggctggctggccagggcttacagcctcaacttctgccatggagg

SEQ ID NO: 6782328 - DNA, 103 bp, Homo sapiens
gaaaacctgaataaaaggacaatggccttcaggcttagtgataagaaaagttaacagtgacctgaatgtcaattttttggcctatttgttctttgaggttttt

SEQ ID NO: 6782329 - DNA, 56 bp, Homo sapiens
tttgcaaggattttctggctcagctgcttttgagcagccagtgtttgtctttcaag

SEQ ID NO: 6782330 - DNA, 106 bp, Homo sapiens
gagagagataatatagactctttcaatgtcatctgtgaatgcattaatcaagttctttatgtgctacagagcattgcaaggtaataagtctattgcacctttcatc

SEQ ID NO: 6782331 - DNA, 112 bp, Homo sapiens
gtattcatgggcagctccaatgtgagcaatcagcactgtcttttatttgaaggatactgtcctttaagcgtaagtcatgctgacatgtaataaatggagtatctatgtttgc

SEQ ID NO: 6782332 - DNA, 56 bp, Homo sapiens
aggttatattgttaagtggcagagccagtgtactgaactgtcataatatatcacct

SEQ ID NO: 6782333 - DNA, 71 bp, Homo sapiens
ggactctgtcgggattcagtccaagcgggggcgaccttggcctctgcctcctgcttgtcccgacgcattcc

SEQ ID NO: 6782334 - DNA, 86 bp, Homo sapiens
atccctgtgaccctctcaggatctaatacatggtaactttgtgaccctcttgccaagaggtccaggtgggaaggcaacatggggat

SEQ ID NO: 6782335 - DNA, 79 bp, Homo sapiens
ttcgagaatgtaaaccgtgcactcccaggaaaatgcagacacagcacgcctctttgggaccgcggtttatactttcgaa

SEQ ID NO: 6782336 - DNA, 59 bp, Homo sapiens
gaaggccacaaaaaatgtcatagtaggtgataatgtctttgatatcattttttggcctc

SEQ ID NO: 6782337 - DNA, 110 bp, Homo sapiens
gagggattcagaataggggaagtctatggttgtcatcttgcagggaatgagcctgtaaaaaggcttaaagaaattgaggagaggattccatgctcccctgaatatccttc

SEQ ID NO: 6782338 - DNA, 82 bp, Homo sapiens
ggtgtctgtgtcagggctgagaatgacagggccgggcaagtccaaacctgcctcttctcatgccatcgtctcacatggcgcc

SEQ ID NO: 6782339 - DNA, 117 bp, Homo sapiens
tttggatggattgagttatgtattattgttaccattttataagttaaagtatggaaattcaagtagtttgctcaagttaggtgggaaaaccatgattataacttagttctttctgaa

SEQ ID NO: 6782340 - DNA, 96 bp, Homo sapiens
ctgtaaagttctatacagtgtgaggttgggggagcaaaggttttagaccggtgactttgctctttggattcctttacaaactgattgaagatacag

SEQ ID NO: 6782341 - DNA, 88 bp, Homo sapiens
tgccatgctagaaggaagcccagcacttctctgaagatggcaccaaaaaggtagaactaggaaggcaggttcctaactctggcatgca

SEQ ID NO: 6782342 - DNA, 85 bp, Homo sapiens
gtattatgagctctttgatgggagtgtttctgcagtggcttcacattcattagtacagttccatcaaagcaggccacataatcac

SEQ ID NO: 6782343 - DNA, 80 bp, Homo sapiens
ttttcatggatcataaatgtgctaaagttaattctcccaagctcaatgattatattttagcagatctatgtatgtgaaaa

SEQ ID NO: 6782344 - DNA, 65 bp, Homo sapiens
agatgtcctgtgtgcctcctgtgatcaggccctggcatggcaggaaggacatgcactgaatatct

SEQ ID NO: 6782345 - DNA, 71 bp, Homo sapiens
ttaggatattgagagagtgaggtgtagaatttaaagttaaaaaattttacatcactttacttaataattga

SEQ ID NO: 6782346 - DNA, 56 bp, Homo sapiens
ctgaaatggttgcctggagaatccgtgattcaagattctcaagtgcttcaattcag

SEQ ID NO: 6782347 - DNA, 58 bp, Homo sapiens
gccccgagggattgaaggcaactaaaaatagtgcattaaatataatctgttgaggggc

SEQ ID NO: 6782348 - DNA, 59 bp, Homo sapiens
gctctgtggctacacaaacctccaaagcctcacccatggaggtagtctgagtcataggc

SEQ ID NO: 6782349 - DNA, 98 bp, Homo sapiens
gaggtggaggattgcttgagcccaggaggtggagattgcagtgagccctgatctcgccactgcactccagccttggcaacacagcgagacttcgtctc

SEQ ID NO: 6782350 - DNA, 100 bp, Homo sapiens
ccttgaaacaacttatcttcctatcttggggatagcctaactcatcgaggagattgtgtttggtgttccagagaagagggaggaaaagagggtgacaggg

SEQ ID NO: 6782351 - DNA, 56 bp, Homo sapiens
ctgtgtgtgaccagaagagagcactctctgagctcagaagtttggttgtaacatgg

SEQ ID NO: 6782352 - DNA, 80 bp, Homo sapiens
ggtcttagagccagagccccagagaacagtggaacatcattgatgagctttgtcccttgggggctcagggctcttctacc

SEQ ID NO: 6782353 - DNA, 127 bp, Homo sapiens
tcccgccgtgtccggggcaactacaccgaaggccgagcggcggcttcacggtaccggccgggcaccgccggaggggcccaagccggagctgggagagccgcggcatcctggagcccggcgggcggga

SEQ ID NO: 6782354 - DNA, 84 bp, Homo sapiens
tgcctttgggagagccaaggccagtccattttggaagatgagaagcttttgatttccaagactccagttctcccagagagggca

SEQ ID NO: 6782355 - DNA, 74 bp, Homo sapiens
gggggctaagagtgaaggttagggagatcctgagtgcagctgctcaggcaccctctattttcatcaactccccc

SEQ ID NO: 6782356 - DNA, 64 bp, Homo sapiens
ggacactggagactgtgtcttttgattcttctttctgagaattctttcaaatagcttcaggtcc

SEQ ID NO: 6782357 - DNA, 70 bp, Homo sapiens
cccacagcgccccccacgcacttggtaagggcccctggtccaggctgctgtacttggggggtgctgttgg

SEQ ID NO: 6782358 - DNA, 67 bp, Homo sapiens
cccgccggcccgcaggtgacccagcgctggaaaaacgccagcgacgtggcctggcgagctggcgcgg

SEQ ID NO: 6782359 - DNA, 55 bp, Homo sapiens
ttataaagatggtttaatctctagagatggagactgagcattagtatttttataa

SEQ ID NO: 6782360 - DNA, 78 bp, Homo sapiens
gagttaggagacttgagtttttgtcttagttttgttaggaagtagtcctgtaagtataaaaattcaagtcctttcctt

SEQ ID NO: 6782361 - DNA, 76 bp, Homo sapiens
cctgtttgagttagaagggcagggagaggccagtgcttggctctgtcctccacctgctttcaggagctggggcggg

SEQ ID NO: 6782362 - DNA, 64 bp, Homo sapiens
gggagcagctggagatgcccagcaccgggttttatgactctgttggaacttttcagtctttctc

SEQ ID NO: 6782363 - DNA, 72 bp, Homo sapiens
atgccctgggcgtttacacacatggtacaacaaactaaccttagaggtacttgtgtgtcatgtgcagagcat

SEQ ID NO: 6782364 - DNA, 103 bp, Homo sapiens
gacttacagaaggagccagcagggctgatgttattgacgaagagatactttagaccctttatttgtcagcagggagccctgctctgtggttcctctatgagtc

SEQ ID NO: 6782365 - DNA, 60 bp, Homo sapiens
cccatccctgagtcacaggagggctctgtgtcagtgtccagctgtgctccaggaggtggg

SEQ ID NO: 6782366 - DNA, 85 bp, Homo sapiens
caaggcagcagggctcaggtggctggttgctggctacggctgtgccttcagtctggcccaagccatctgggtatcctgtgctttg

SEQ ID NO: 6782367 - DNA, 67 bp, Homo sapiens
cttctagaaatgtgggtgatagcgatattatgaatttttaataattatcatgccacatatctggtag

SEQ ID NO: 6782368 - DNA, 72 bp, Homo sapiens
gtccagttcagcagggctacccaggggcccttcttcctccatcccatggtggcctgccctgatccctggcac

SEQ ID NO: 6782369 - DNA, 63 bp, Homo sapiens
attttccacaatgtatgaataagattaccttttcctaattttaaaaaaagcattgtggtgagt

SEQ ID NO: 6782370 - DNA, 119 bp, Homo sapiens
agatgatgcatatgacattaaagcttgagatgcactgcactagaatgcaggggcgtcattttgcttgctgctgtatccttagtgtcagaacagtacttagcacatcataagcactcact

SEQ ID NO: 6782371 - DNA, 86 bp, Homo sapiens
gaacccatgatccctgccctcgggctgccctaggctgctagagagaaaacgggcagtcctgggtggctgggggcagggctgggctc

SEQ ID NO: 6782372 - DNA, 68 bp, Homo sapiens
gtgaaattctatccgtacagttaggacatttatcctttactgtcaaatttatggaaagagaattttac

SEQ ID NO: 6782373 - DNA, 55 bp, Homo sapiens
tgacacacagggggatggagttggtccttgtccattctctcacccttgctgtgca

SEQ ID NO: 6782374 - DNA, 63 bp, Homo sapiens
ggcagagatgagctatcaggacagaagggaccatactagcccctgccttgttccatttcttct

SEQ ID NO: 6782375 - DNA, 85 bp, Homo sapiens
tctcaatctacttgttatgtaaatgttaatataaaactgacagaaatatgcatctgcagaactttatgagcaaagagaactgaga

SEQ ID NO: 6782376 - DNA, 63 bp, Homo sapiens
ttctctaagccttagtttcttcagctgtaaatacaggataacaaggagctatgcttcagagga

SEQ ID NO: 6782377 - DNA, 78 bp, Homo sapiens
aatggtaggacaaatgctcaagactaggctcaactgctgcccaagctcagcactagcctgttttgctgtgctgctgtt

SEQ ID NO: 6782378 - DNA, 70 bp, Homo sapiens
gtgcaaccagatgctttgtggagttaaagttgacatttatttaaatgccacttggtgtctggtttttcac

SEQ ID NO: 6782379 - DNA, 64 bp, Homo sapiens
tacttaaaactgatagaatctcatcatttagatgaatccataattgtgtcagtgaatttgagta

SEQ ID NO: 6782380 - DNA, 80 bp, Homo sapiens
tcacatgtcggcataaagctcttaaattgacctgctttagattaaagcacaatatgggttttatagtttgcctcaggtga

SEQ ID NO: 6782381 - DNA, 70 bp, Homo sapiens
gattcacacccacatggaaattcacagtcctgagggcagggctgtgttgggaatcatgtgggtggagatc

SEQ ID NO: 6782382 - DNA, 64 bp, Homo sapiens
gcttcagcctgggatggggcctgagaatttgtatctctggcaggttcccatgttatgctgatgc

SEQ ID NO: 6782383 - DNA, 58 bp, Homo sapiens
atcagggttgagaatttcaatattctggaaggaatactggttttctttcagcactgat

SEQ ID NO: 6782384 - DNA, 81 bp, Homo sapiens
tcctctgtgcatgaagcaggcagctcctggctgttgataaagtgccgtggacaccttctgcttcgtgcagatgcacgatga

SEQ ID NO: 6782385 - DNA, 65 bp, Homo sapiens
tctcctggctttctgcacagaattggttgggtgccatcctcctctgcagcagagagccagagaga

SEQ ID NO: 6782386 - DNA, 60 bp, Homo sapiens
ggaaagacctgagataggaataatctaggtagctttaaatgttcctgttctctaggatcc

SEQ ID NO: 6782387 - DNA, 75 bp, Homo sapiens
gggcacctgtttcacatgtatataggcattatttctttttaacataggaattattgccagcatgtgtaacacccc

SEQ ID NO: 6782388 - DNA, 69 bp, Homo sapiens
gaagattatccagaatgtcttgctggagaatttgtacaattttctgcagtgatgtgctggcaaattttc

SEQ ID NO: 6782389 - DNA, 61 bp, Homo sapiens
cacctgttgtttattcatctctcaagtgtggctgacttcagggatgagaataaacaatgtg

SEQ ID NO: 6782390 - DNA, 94 bp, Homo sapiens
gtcacctgggtgggagcttgttataaatgcagaatggcaggccaatctcagacctgctaatcaatattcattttaacaagatcccccaggtgat

SEQ ID NO: 6782391 - DNA, 81 bp, Homo sapiens
gagggtggagtggctatgggaagatggcagggggaggcacagccacccttgcagacaccccattcccagcactccttcctc

SEQ ID NO: 6782392 - DNA, 77 bp, Homo sapiens
caattttcatttactgtaaaagattctcttcctggtcctttgcatctcagggagacaatgcagtggatgaggctttg

SEQ ID NO: 6782393 - DNA, 69 bp, Homo sapiens
gtgagggggcacacacctcccttgggatggagaagagtgaactgagagaggtgcagaggcctcactcac

SEQ ID NO: 6782394 - DNA, 76 bp, Homo sapiens
tcaggacaaactctaaagtgtggcttatattccagattccctttggggatcaggctgaagctaggactttgcctga

SEQ ID NO: 6782395 - DNA, 63 bp, Homo sapiens
ctggaaagaagctttagatggctatggcactcaatgctcataggctttctcatttctttctgg

SEQ ID NO: 6782396 - DNA, 61 bp, Homo sapiens
ccagtttctctcatacatatttgcatgtcaaacatacaaataagtgattgatggaaatcgg

SEQ ID NO: 6782397 - DNA, 111 bp, Homo sapiens
ggtgacggccacctctgcccatctgcccctcgacgcaatgaaggggacggccacctctgcccatccgcccctcgatgcaatgagggggaaggtcaccactgcccattcgcc

SEQ ID NO: 6782398 - DNA, 130 bp, Homo sapiens
ttagaatcacctggagagctttttagaaatgtcaatgctggggcctccccatgcccagggactcactttcaattggtctggaataggtcctgagtattaaatgcttttaatagcttctaagtgattctaa

SEQ ID NO: 6782399 - DNA, 77 bp, Homo sapiens
cagctctaagtctgcggccgtgtgcttgtgctcccctccaggcagggaggacatgcactgctcagggttccgagctg

SEQ ID NO: 6782400 - DNA, 58 bp, Homo sapiens
acttgtaccagctcatttcagaacctactctattgggtcaagatagtgtggtactggt

SEQ ID NO: 6782401 - DNA, 59 bp, Homo sapiens
ccaggtgcaatgagacagctctgggctacccaggccttcctgtctcccattgtttctgg

SEQ ID NO: 6782402 - DNA, 117 bp, Homo sapiens
agccattctcctgcaacttgtccatgataggtgctaggcccatgaggtttgctggacctacaagagccccaggcagccatgtgggaccttgagcaagaggaccacgcaggagaagct

SEQ ID NO: 6782403 - DNA, 108 bp, Homo sapiens
ggaagcagaactaatgtgatatatagatacatgtcaagagacttatcgtagggaatttactaacccaattataagggctggctatgaagtcttcacatgactgtttcc

SEQ ID NO: 6782404 - DNA, 67 bp, Homo sapiens
atattgctcatacatcgtttattttagttcaactgtagtttggattagtttaacaatgtggcagtat

SEQ ID NO: 6782405 - DNA, 67 bp, Homo sapiens
gccttcctgcagctctgagcgtgccgagcctagcaagcttgtgcttccacctagagctgcaaagggc

SEQ ID NO: 6782406 - DNA, 67 bp, Homo sapiens
ttcaaatgcatgaaccatcactccttggccttttggccaagatcaagtgtagtatcaaatgcatgaa

SEQ ID NO: 6782407 - DNA, 55 bp, Homo sapiens
ctgtggacaaggatgttagctagatccatagctggttgaacaaccatgtccaaag

SEQ ID NO: 6782408 - DNA, 71 bp, Homo sapiens
attcacctaagaatagagttgcgcttgagtcccaacctaacaacatatcagctctgtggccttgggtgaat

SEQ ID NO: 6782409 - DNA, 72 bp, Homo sapiens
ttgcaatttttccttgtgtaaactctccatcatttatctttagtgacttcagttgttagggaagttttgtaa

SEQ ID NO: 6782410 - DNA, 125 bp, Homo sapiens
gggaccctggactttcgaagggcgggcagagccgggaggcagcgagaggaaagtcccactcggctccttcctgtgtgggccccttggtttcctgagccactgtcatttaccgaaagtcagggccc

SEQ ID NO: 6782411 - DNA, 63 bp, Homo sapiens
tggtatcctccagctcctgcttctgcgtcttcgcgtcggccacgcaggtgcggtaggtggcca

SEQ ID NO: 6782412 - DNA, 58 bp, Homo sapiens
aatgtgttacttagcaagccacggatgaatacctggaattacctgctgagtgcccatt

SEQ ID NO: 6782413 - DNA, 62 bp, Homo sapiens
cctgggcatgaaaaggatgccaggctgcaggactgcagttggcttctccttcctgacccagg

SEQ ID NO: 6782414 - DNA, 77 bp, Homo sapiens
gcaagcctagctctttgtcactcatacagtcacagtgagaacagtgacccctccaggagcaaggggttgggctgggc

SEQ ID NO: 6782415 - DNA, 55 bp, Homo sapiens
cctcaaattgtcaaataagaatttccttaagtaatttttatgagataatatgggg

SEQ ID NO: 6782416 - DNA, 90 bp, Homo sapiens
ggtgctcagaacttgtttcattggctccctgatgaatccaaaaatggcaagaggagtccccaggactcagttagtgataaggtgagtgcc

SEQ ID NO: 6782417 - DNA, 55 bp, Homo sapiens
cctgtttctccttgttcatctttcttctttattaagtgtacaaggattatgcagg

SEQ ID NO: 6782418 - DNA, 76 bp, Homo sapiens
tggcttagactagctttcattctctagcacctaggaaatttcctgctccagaaaaacttgagactctgttaagcta

SEQ ID NO: 6782419 - DNA, 94 bp, Homo sapiens
gcccccacccgcaccctgatgctacttcctccagctctggccttgggaaatctccaaggacccgagcctgcgggagcaggaagcaggagggggc

SEQ ID NO: 6782420 - DNA, 72 bp, Homo sapiens
gtttcctctccttaaagctgttagagtagtaagagtgccccttttagtagacagctttgatgaagattaaat

SEQ ID NO: 6782421 - DNA, 74 bp, Homo sapiens
caggcagctgctgtctcactggtgtggtttgccaagtagccagttagacctgtagatagcaggaggtttgcttg

SEQ ID NO: 6782422 - DNA, 57 bp, Homo sapiens
ccactgaaaggcaatgctgacagtccaggttggctgggctgaagtcttttcagctgg

SEQ ID NO: 6782423 - DNA, 79 bp, Homo sapiens
ccatgagatgtacaaatccttccacacatgcattccatttctagaaatgtatcctatgggaagatatgtatgttcaagg

SEQ ID NO: 6782424 - DNA, 56 bp, Homo sapiens
ggctaacagtggaagctgaccaagccgaggctgtcattttcccagcaattgtggcc

SEQ ID NO: 6782425 - DNA, 58 bp, Homo sapiens
ctgtccagcacatgtctgccccaagtcatgagaggacggggcaggagtgtgtggatgg

SEQ ID NO: 6782426 - DNA, 81 bp, Homo sapiens
ctcctctttggtctgtggctctccaatggagggaggaattcttagctgccaaaagggtgggctagataggaagaagaggag

SEQ ID NO: 6782427 - DNA, 68 bp, Homo sapiens
gacaccagtaaatattcaaaaggagctaatcagtaaatattagctccttttgaatatttactggtgtc

SEQ ID NO: 6782428 - DNA, 105 bp, Homo sapiens
ttcctagaaagccgaagggccttgcttagaactggagaaaatcaccagggatctaatggtaatgatctggaagtctccgaaggcaggtcctgaggcttttgagaa

SEQ ID NO: 6782429 - DNA, 55 bp, Homo sapiens
tgggatcaaagagtgccatcaggactctcaatgatgaggtattctttgccttcca

SEQ ID NO: 6782430 - DNA, 61 bp, Homo sapiens
gctcagctggagagggacgggttgggacgcactgtccttttgcccttccccctccgcgagc

SEQ ID NO: 6782431 - DNA, 76 bp, Homo sapiens
agtcattctagtcattgcagctgaggttatcctagattagctgagctgcagatgactgtaagatccatgagtgagt

SEQ ID NO: 6782432 - DNA, 121 bp, Homo sapiens
gggtatcatgcttgggcacccatggctcccaggaagggatgccaaggaagcagggcagagagaacaagcatccccttcctgaggcctcccttcctagacctcaggcacaggaaaagagccc

SEQ ID NO: 6782433 - DNA, 56 bp, Homo sapiens
ggcggtgggtgcttaagggagcaaaataatgtatttccttgttctacatccctgcc

SEQ ID NO: 6782434 - DNA, 65 bp, Homo sapiens
ggaatcttaatggcatggagtttcaagctagaaggcaattctgatttccaagccattttggttcc

SEQ ID NO: 6782435 - DNA, 129 bp, Homo sapiens
tttatggatgccccctcagaaaaatatgcaaaggggtaactggcttggaaatgggtatttatgcatagtaaatcccactcacgagttttgcctatttgaagcttctctcaatgacagtgcatctgtgaa

SEQ ID NO: 6782436 - DNA, 58 bp, Homo sapiens
atttgatgtatgtgagtgattggcgtaataacatagtaagtcacatgcatacacaagt

SEQ ID NO: 6782437 - DNA, 102 bp, Homo sapiens
ccactcttggcattaagtcttctctcagggagagctgctggcatgtggcatgtggcatccttttccctggattgggactgatgtggctgatgccaggagtgg

SEQ ID NO: 6782438 - DNA, 55 bp, Homo sapiens
aggcagccaatcagaggctgactcactccactgagtcctcttctaaggctgacct

SEQ ID NO: 6782439 - DNA, 75 bp, Homo sapiens
taatcctttgtttctgcattcatttttcctacatgaatataatgtgatgatcaagtagtgtgagacttaggatta

SEQ ID NO: 6782440 - DNA, 97 bp, Homo sapiens
agttcttgttttgttgctcaatgggaataagaatgatgcagtagagtagaaaaatggattattcaggagccaattggcaacagagacacaaataact

SEQ ID NO: 6782441 - DNA, 59 bp, Homo sapiens
tctggatggtcagctcttcctgctctgtgacaggcagaaaggcagggcagggccccggg

SEQ ID NO: 6782442 - DNA, 75 bp, Homo sapiens
cttgttcaggagagggtggggaaaggatttctcccagctgatggggaactggagaatgccctctttttggccagg

SEQ ID NO: 6782443 - DNA, 63 bp, Homo sapiens
taatttggtgcctagaatgttaatgcctcgattgagatgctctgaagttcgcgggcaagatta

SEQ ID NO: 6782444 - DNA, 59 bp, Homo sapiens
ggtcatgcctggcttcttagacaaaagacatagaagtagatgtgtgaggccaggtgacc

SEQ ID NO: 6782445 - DNA, 74 bp, Homo sapiens
tgagggagtcctcttgcaagagctgattcagatatatgattttctgtggcaagaatctgcagaggaattcttca

SEQ ID NO: 6782446 - DNA, 59 bp, Homo sapiens
gtaggggctctgtgacagtaaccctttcactgccagaggaaactgaaggggccctctat

SEQ ID NO: 6782447 - DNA, 59 bp, Homo sapiens
tttgtaacattatggactgcttttcatggcttataataaagcagtgccatctgtacaaa

SEQ ID NO: 6782448 - DNA, 89 bp, Homo sapiens
tcaggcagccttatctgtcatcctagaactccaggacagtcccacattgtgttgggagtggccacgactgggagatggatctgctctga

SEQ ID NO: 6782449 - DNA, 78 bp, Homo sapiens
cattcagtaaatgtcacttttctccctgctggcccttgtctgacattactcagcatttcagaagtggcatatactatg

SEQ ID NO: 6782450 - DNA, 95 bp, Homo sapiens
cagagacttgggacaggagatgacttggccaaaggattgttgctacaataggctttgtgttttgttatcctttgtaactaccccaacactttctg

SEQ ID NO: 6782451 - DNA, 93 bp, Homo sapiens
ttttaaaaaggtcagaatggttcactacacaatatatttcagagtgtttgtaaagcatttgaatgtgtgagttaacttttttgaaaaataaaa

SEQ ID NO: 6782452 - DNA, 67 bp, Homo sapiens
gttctcactcttcatgtatagaaagttaacaatttttctcagagcacggggagtgaatggttagaac

SEQ ID NO: 6782453 - DNA, 64 bp, Homo sapiens
tgctctgtgggtgaagacaagggagagtgtctcatacctctttggtgaatggtcatccagagta

SEQ ID NO: 6782454 - DNA, 68 bp, Homo sapiens
atgtttccatagaagtcacagttgtaaggggagacacaccgtaatgggcagtggcttctgtggaatat

SEQ ID NO: 6782455 - DNA, 60 bp, Homo sapiens
tgggccagcatatagagtgaagtagatatgtaactcctttgccctgtattctggacctca

SEQ ID NO: 6782456 - DNA, 69 bp, Homo sapiens
aagccaacagttgtgtattagtttgctggctgtggctgtcataacaaattattacaagctagttggctt

SEQ ID NO: 6782457 - DNA, 80 bp, Homo sapiens
ggcaggttcacagcccagtcattcctaaccaagaacatcagcacctgactggagggtgggaatgaggttcctgacctgct

SEQ ID NO: 6782458 - DNA, 130 bp, Homo sapiens
tcttttttcacgcctcttctctattgtgctgcaagcatcatgtctgcaggaatgtgttgtgaccagaatacacaatacagatcccacagcatgtgactgacagcgttatttagtcagtggtccaaaaaga

SEQ ID NO: 6782459 - DNA, 63 bp, Homo sapiens
cacaagctggatcctagggctttgacctccactgctcactgccacatgggatccgtctctgtg

SEQ ID NO: 6782460 - DNA, 77 bp, Homo sapiens
ttgggctgagacttataacctggattctggcactaaccacagttagagccatggacgagttagttaccctcgcccag

SEQ ID NO: 6782461 - DNA, 66 bp, Homo sapiens
tatctctaagtacctccaagggtgactatatttggagacagagcctttacagaggtaattaaggta

SEQ ID NO: 6782462 - DNA, 58 bp, Homo sapiens
ccaattcacctcctatgcacatttttcatatcataaattactgcagggtggtgactgg

SEQ ID NO: 6782463 - DNA, 60 bp, Homo sapiens
gttgaaggctctaggatccatccttatttcacaatgagaaccaagaccaagggcctcaat

SEQ ID NO: 6782464 - DNA, 100 bp, Homo sapiens
ctatggttttcttccacattaaaaaagccttaataagatgtttttcagctatgatgttcttacattactcatgaatttaattgttagaggaatgccatag

SEQ ID NO: 6782465 - DNA, 123 bp, Homo sapiens
cttattgcaccatatttttatttcagcatctcttcactgccataaataagagaaagtagaatgtttacttttctgtgtggcagtcaccatgctagacatttacaaccagtgtaaatcattgag

SEQ ID NO: 6782466 - DNA, 62 bp, Homo sapiens
tagtgtattttcttgctaggaatgtgagagtacttatgaatccctagaagggaaatatagtg

SEQ ID NO: 6782467 - DNA, 57 bp, Homo sapiens
gtggcttggtgggtgcttgtggaagtcatgaaaacgcaataaactctctcaagccac

SEQ ID NO: 6782468 - DNA, 62 bp, Homo sapiens
cagaggcaggcggggcccaggtggcgtggaccgcccgtcaccagctctgcctcgccagtctg

SEQ ID NO: 6782469 - DNA, 56 bp, Homo sapiens
agcaggaagggaaaggttgactcctggaaaggctcaggggttgtcctccttcctct

SEQ ID NO: 6782470 - DNA, 59 bp, Homo sapiens
ttatgacagggtctttattttattcctctgtatgagtcaaggtaggatcggtgtcataa

SEQ ID NO: 6782471 - DNA, 62 bp, Homo sapiens
tctttgagggttggaatacccactaaacatctaagcaaatgtggacatttacccttcaggga

SEQ ID NO: 6782472 - DNA, 114 bp, Homo sapiens
gctaatattagaagcatgttcaaggagcagcctctggggttaatagagtttaatttgcaagacaaatgaaagcttattttctcctaggctctctgctcataattctagtagggc

SEQ ID NO: 6782473 - DNA, 74 bp, Homo sapiens
gtgcgtggggctggcaggagcagtcaacaggaatagttagagtcagacctgggcttacaagccagctgtaccac

SEQ ID NO: 6782474 - DNA, 62 bp, Homo sapiens
ggctgtggtgccgagagtctggacgcggggcgctgaccagagtcacggcgccgatctcggcc

SEQ ID NO: 6782475 - DNA, 83 bp, Homo sapiens
gctgacgtttatgtggttgaagaattacatctaagtaatatttgaatatatgcgatttttgacttcataataattgacgcagt

SEQ ID NO: 6782476 - DNA, 63 bp, Homo sapiens
ctggtccctgcccacctgggagctcctacctcgcaggcagtgccagtctctggcaggggtcag

SEQ ID NO: 6782477 - DNA, 59 bp, Homo sapiens
tttccaactgtaccccagtgtttatggtaaagtggtaccaggaattggacagttggaaa

SEQ ID NO: 6782478 - DNA, 60 bp, Homo sapiens
ccatagaattcaagagttccctggggatctctgcaaacctcaagctcctgaactctgtgg

SEQ ID NO: 6782479 - DNA, 66 bp, Homo sapiens
ctgcagccagtatcctctgagattttgtcgttagaaatcagggtctggagtaggatgatggctagg

SEQ ID NO: 6782480 - DNA, 78 bp, Homo sapiens
cttggctttgatgctttggtggtggttactccaaaagtttcaagttttgtaacatcaccatcaaaatccagatacaag

SEQ ID NO: 6782481 - DNA, 83 bp, Homo sapiens
gtgattttacctttacttccttcactttaagccaatcatgaaatttcagtgatttctggggtgagggcgaaaggtggtgttac

SEQ ID NO: 6782482 - DNA, 65 bp, Homo sapiens
cagttctacatgggtaggttaagtcatatgttatttggtgttactccttccctactcatgtcctg

SEQ ID NO: 6782483 - DNA, 74 bp, Homo sapiens
cctgggcatcactagaataatgagagacttgcacaaggcaatctctaaagtctgttcagctctgatgccatagg

SEQ ID NO: 6782484 - DNA, 76 bp, Homo sapiens
ttggagtcagaaggtatgaattggaatactagttgtactgactgtgtgactttcaatagcatacttttgctctcaa

SEQ ID NO: 6782485 - DNA, 91 bp, Homo sapiens
ttgcagtagtccagtggttcagttttggtctggcttccttttttctgtggtgactgtctagcccacaagctgagttatggagatgctgcag

SEQ ID NO: 6782486 - DNA, 60 bp, Homo sapiens
ttcaggcttgtttaggaaagtaggaatacttcagtttggctaaggggaacaggcttagaa

SEQ ID NO: 6782487 - DNA, 91 bp, Homo sapiens
aaagacaggctggaactcttaggcacaggcagaagttgcagttcacaggtgaaatttgttctttatcctggaagcctgggctctgctcttt

SEQ ID NO: 6782488 - DNA, 55 bp, Homo sapiens
tgcaggagcgcgtggccaacgctcccacctttctgcctggctcctgcctcctgca

SEQ ID NO: 6782489 - DNA, 76 bp, Homo sapiens
ggcacctaactcactccaaaaaggcattctggcaaaaattacctttgatttgcgatgcactggatgagtaggagtt

SEQ ID NO: 6782490 - DNA, 78 bp, Homo sapiens
gtagcttacaaagaatcactcatctttagcagtagaaagcacacacagctgaacagactgaagttctgatagagttac

SEQ ID NO: 6782491 - DNA, 100 bp, Homo sapiens
gcagtgggctacccaggccctgggagcagagatgcaaaatcggcccctcgcccttgtcttgccttctctgatctccagggccagagggtggggccagtgt

SEQ ID NO: 6782492 - DNA, 62 bp, Homo sapiens
ttacacttgaaaacaggatttattttcagcctcccttatctggtttccttttttcaaggtga

SEQ ID NO: 6782493 - DNA, 82 bp, Homo sapiens
taagctctgcaggcttataggatgggtgtgtcaggcatcatttaggggacagacccaagtcatctggcttgtttagagctta

SEQ ID NO: 6782494 - DNA, 55 bp, Homo sapiens
tccagggctgggttggctcagctctacctcgtgttatctctcatcctcccctgga

SEQ ID NO: 6782495 - DNA, 69 bp, Homo sapiens
cttaaggaagtacccattcttagggtcatgcttgtgcagtcagcccctgagagtgagtgccaccttaag

SEQ ID NO: 6782496 - DNA, 103 bp, Homo sapiens
gagtgcattagttactcggtccaatatcattctaattctcctcgtagttcattgaatttgagcctgttaggagataaaatgtatctttagctactatgtactt

SEQ ID NO: 6782497 - DNA, 74 bp, Homo sapiens
gcatctcagatattgaatttaaattgtttgtgttgtaacagtgatacaaaaatgttcaatagctctttgaatgc

SEQ ID NO: 6782498 - DNA, 68 bp, Homo sapiens
aagttgaggctcagggtgagaaattgatccatggcatcatgctggattactcattcttgtcttggttt

SEQ ID NO: 6782499 - DNA, 77 bp, Homo sapiens
gcggaactttaagtgtggaattttggagccagatcacccaccaggtggctaacagttaagatttcatcattggtagc

SEQ ID NO: 6782500 - DNA, 75 bp, Homo sapiens
ggtgtgaagcagcagctggggacagttcagcccggcttaggcatgacctctgttttcatctgcctgcgaggcacc

SEQ ID NO: 6782501 - DNA, 129 bp, Homo sapiens
actcctcagtccgacacaggcccttggaccatggtgggtgtggtagtgtgtggcctgtggtcacttcttggctggcctcttctgctcatactttcactggtctgggttcttgtgctgctagtatcgagt

SEQ ID NO: 6782502 - DNA, 62 bp, Homo sapiens
ctgtgttccctgatccattctgacatctaatttttgagttctgataagggagagggaagcag

SEQ ID NO: 6782503 - DNA, 64 bp, Homo sapiens
attagcggttgaagggaggaagagttttgatatccctggcttgatcctccaaccagctgctaat

SEQ ID NO: 6782504 - DNA, 106 bp, Homo sapiens
gttctaagtgctatttagagttataatgcttttcctgtggtgtatgcagcattcccagctgctggtgctaagatgaggtaggtaagacttatggtggactttatgc

SEQ ID NO: 6782505 - DNA, 78 bp, Homo sapiens
ggcctggagctgctgtccttgggtgaaattgctcgtgggctcaccttctattcgggggacacagaattccactctgtc

SEQ ID NO: 6782506 - DNA, 74 bp, Homo sapiens
cctgctcccagggaggcccaggctctgctccgagggcagatggcgcaggggctgggttggccctaggaggaagg

SEQ ID NO: 6782507 - DNA, 130 bp, Homo sapiens
tggaaccgcatggggggcagcaggcatcaggtggggagacccaggagctctggggtcctctgcccccagggtgcagtcattccaccctcctgccccatgggattgtgtgcacccaaccccgctgtgccca

SEQ ID NO: 6782508 - DNA, 63 bp, Homo sapiens
tgtggcccaaacgggtccagtgaaagtcagtcctgggactttggctgggactattggggaaca

SEQ ID NO: 6782509 - DNA, 62 bp, Homo sapiens
gctcacagtctgccccacagcaaatgattgtttaacccaaatatctgtgcagcaaactgagc

SEQ ID NO: 6782510 - DNA, 69 bp, Homo sapiens
gcagggtgaaggtcacatagaaacagtttttgttcttgtgctcttgctttctgttgtgacctctcttgc

SEQ ID NO: 6782511 - DNA, 56 bp, Homo sapiens
ctcaggagcaagtgcagactagagacttatggaggtctccagtatccttctctgag

SEQ ID NO: 6782512 - DNA, 61 bp, Homo sapiens
gaggttgagaggtgtcaacgtgctggtggtcctcgctcgctctcagcgcctcctcggcctc

SEQ ID NO: 6782513 - DNA, 56 bp, Homo sapiens
gtgtgtatatgtgtgtgtgtgtgtgtgtatgtatgtacatgcacgtgtgtatatat

SEQ ID NO: 6782514 - DNA, 84 bp, Homo sapiens
ttaggctataaaagtttgagaaaaccagaaagatcttgacttcatagattttttgttgttgtctcatagtaaattttattctga

SEQ ID NO: 6782515 - DNA, 66 bp, Homo sapiens
tctgtgtagtgctgcaaaacttgcctaatcctcatagtcacacggaaagctttgcagaaatacaga

SEQ ID NO: 6782516 - DNA, 65 bp, Homo sapiens
agtgctctgattcagtgcattttagtaagtttttaaacaatacatgaatttgagtcagaggaact

SEQ ID NO: 6782517 - DNA, 64 bp, Homo sapiens
agggccagagtatgtttagctttgcgggccacagatggcctctgttgcatatgctgctgggtct

SEQ ID NO: 6782518 - DNA, 94 bp, Homo sapiens
ccaggatgaagcagtgggcttggcacatgggctcagcctcagggcgttaggagctcagcatggttgaggtgatgccagccctgccctttcctgg

SEQ ID NO: 6782519 - DNA, 65 bp, Homo sapiens
gtgcctgccctctcggcatagcaggggctgctcagctgcccccaacaggtgccaagggggagcac

SEQ ID NO: 6782520 - DNA, 73 bp, Homo sapiens
aatttaggtaagatgtttgatgtgcgtcagtggaattattttgaatttttacatagaatatttcacttaaatt

SEQ ID NO: 6782521 - DNA, 60 bp, Homo sapiens
gcgttcttgccagcatcctcaggttcccgagccggtgaccagggacctgtgcgggaaagc

SEQ ID NO: 6782522 - DNA, 63 bp, Homo sapiens
tgtctggtacatggtatattctaatggcaataaaatggcacaagcagccttgtgtgccaggca

SEQ ID NO: 6782523 - DNA, 65 bp, Homo sapiens
acttgactgggagaaaccaatttcctgggggaagtctcaataaaattgttttcctatcatcaggt

SEQ ID NO: 6782524 - DNA, 89 bp, Homo sapiens
ggttccgataactttgctgggaggagtttgaaaaccttgcttgttgaaacccagtttcacaatttccttgcttcactttgcaaagagcc

SEQ ID NO: 6782525 - DNA, 88 bp, Homo sapiens
cttccagaagacagaatgtatatgatctaaggtattgagcataccacctcatgtttgccctgtcataagcattttggtcattcggaag

SEQ ID NO: 6782526 - DNA, 76 bp, Homo sapiens
ttttctgttctgctgctgcagctacactatctacttgttagcataaccagggccaccagcaacagatgctagagga

SEQ ID NO: 6782527 - DNA, 56 bp, Homo sapiens
gttgggagaagttgaactgtgatccggtcacagcaaaggcttcggctgatcccaac

SEQ ID NO: 6782528 - DNA, 56 bp, Homo sapiens
gctggagaggggtcactctgagatacacttcaaaggtgaatgaatccctcttcagc

SEQ ID NO: 6782529 - DNA, 62 bp, Homo sapiens
cataacattaagcctctatttcacttatgtatctgcatttgtttctagagtgctttgttgtg

SEQ ID NO: 6782530 - DNA, 65 bp, Homo sapiens
ggccgtgaagccttcggttcagttctccccttgtagaaagtgttgcgatgaagagcttcacggct

SEQ ID NO: 6782531 - DNA, 62 bp, Homo sapiens
tcggatccttggataacgcatgaatgtttcaggcatcagatggtactaatttaaggatctgg

SEQ ID NO: 6782532 - DNA, 66 bp, Homo sapiens
gcctcaggcttgtgagccttcagaggggcaaagcaatgcctagagctgctctcccaggtctgaggt

SEQ ID NO: 6782533 - DNA, 71 bp, Homo sapiens
agctctgcaccatcgtatgcttaattaaaatatctaatacggtttaattaagtatgcaatggtgcagtgct

SEQ ID NO: 6782534 - DNA, 78 bp, Homo sapiens
ccactgctcctccagggcttgacagggtgcctcgcacaaggcagaggcccaatggctattgggtgaatggatagatgg

SEQ ID NO: 6782535 - DNA, 118 bp, Homo sapiens
ctagctcataaactccgacttaaaagccagtctcagttactctccctggtacttggaggtcccagtgccagagagagtgactgaggctagcttataagtcggagtttctccaggctgg

SEQ ID NO: 6782536 - DNA, 84 bp, Homo sapiens
gaaatagatggttattaaggcctctttcagttgtgactcgtggagttccacattgcttgtctctgagcctcctgcttctatttc

SEQ ID NO: 6782537 - DNA, 96 bp, Homo sapiens
accagatcaaatgccagaattgttgaccttattgtgttacacaacagtaaggttgtaaaaaagcagtttgaatagccctaggcctagtgaactggt

SEQ ID NO: 6782538 - DNA, 60 bp, Homo sapiens
agggaacagaggtagcgccagagctggagcccacaccagccccgccctgcctgctgccct

SEQ ID NO: 6782539 - DNA, 61 bp, Homo sapiens
atgtcatgttggctgaaattctggagctcttaattgctgctggtatttcaggacaagacgt

SEQ ID NO: 6782540 - DNA, 58 bp, Homo sapiens
caacaaactgacttatgttctcagcagtgtagacactgaagggcctgagcagatgttg

SEQ ID NO: 6782541 - DNA, 60 bp, Homo sapiens
tctgtcctgttggggccactgtaacaaaataccataaagcagtggtttataaacaacaga

SEQ ID NO: 6782542 - DNA, 55 bp, Homo sapiens
tttttgctgagtatactcataccctgagtctggttcaggtcctgatcagcaagga

SEQ ID NO: 6782543 - DNA, 130 bp, Homo sapiens
ttgtcacacactggaaaacgagcgagtttctatttcaggctgtggggtgagttagcgtcggcttggccggctgtctggcagaggctccgattcatcaatgacagctaagtgtggtttgctgtgtgtcagg

SEQ ID NO: 6782544 - DNA, 72 bp, Homo sapiens
tgagtggcccttgttcaaatatgtcacatacatgtatgtggcctatgtaccagggtttaataagcctactca

SEQ ID NO: 6782545 - DNA, 113 bp, Homo sapiens
agttcttagacttttgctcattacactgctgcatttgcagtcctttaacccacaggattgagggtgaaaagattgggaatgcagcagtataatgaacaaaagtaatgaaaact

SEQ ID NO: 6782546 - DNA, 78 bp, Homo sapiens
ctttgctattgtgaatagtgccgcaataaacatacgtgttcatgtgtctttgtagcagcatgatttataatcctttgg

SEQ ID NO: 6782547 - DNA, 79 bp, Homo sapiens
attgcaatgcattgcaaatctcttgtgtttggttgcaaactttcaactgaaacactgagtgaattgttgcctctgcaat

SEQ ID NO: 6782548 - DNA, 57 bp, Homo sapiens
ggagatctgagagctggaagtggggagcgtgttaccttccagttgccagatccttcc

SEQ ID NO: 6782549 - DNA, 79 bp, Homo sapiens
gcagttgtatgaaataggatttttggaaatactggtaactaaacctctcctttgaaaagatctatgggcatttagctgt

SEQ ID NO: 6782550 - DNA, 58 bp, Homo sapiens
tttcagagagatcaacatagcttacattttgttatggctatggttggttgttctgaga

SEQ ID NO: 6782551 - DNA, 114 bp, Homo sapiens
gaagctctgtagtcctacactgaagtgtgttcccttggctgttcatatggggctgggtttggttgaacttccattctgtataaatgctagaacacagttactacagattgattc

SEQ ID NO: 6782552 - DNA, 84 bp, Homo sapiens
atgactgcctcttttagagatgaaaattggtaaaacgacctttttgatccaatgtctcctagaagagaatcacttctaagtcat

SEQ ID NO: 6782553 - DNA, 93 bp, Homo sapiens
tttcatattaactactcttagtcaatgtgcatatttagctagaagcctatcagctatttgagtatgtacattattaggtaaggaatgatgagg

SEQ ID NO: 6782554 - DNA, 72 bp, Homo sapiens
agttaccgttacagcttgacccataatgtctcacaaatagatgttgccgttaagttgtgtaggcaggatgct

SEQ ID NO: 6782555 - DNA, 69 bp, Homo sapiens
tcttgggcagttaagaagtgagtagaagtaatgtgtacaacttctagatcaagtccttataggcaaaga

SEQ ID NO: 6782556 - DNA, 59 bp, Homo sapiens
ctaggcagtaaaggataccaagtctcatagatgatctggaatgtctgattctgctctag

SEQ ID NO: 6782557 - DNA, 85 bp, Homo sapiens
ctctctacagctttccaaaccatgcagtctgtgtacatatacgtgtatatgtcagtgagtgtatgtggctgagcgtgtacatgag

SEQ ID NO: 6782558 - DNA, 91 bp, Homo sapiens
ttctgcccttacttagcacgaacatttactttccaaacaatttacccaagtgaggaaatgattaaatatgtttatatgctaaggggaagaa

SEQ ID NO: 6782559 - DNA, 57 bp, Homo sapiens
gcagctatgtaaagaggatctctgcaagctgcagtcccatatctttaacatatctgt

SEQ ID NO: 6782560 - DNA, 70 bp, Homo sapiens
gaccttcggagataatgacagccacttcatctcactgcaagaaaaaagttatctgatatctttgagggtt

SEQ ID NO: 6782561 - DNA, 73 bp, Homo sapiens
tgtacaaaattatctggttccctcgccttctagattctggttgaatttggccacttgggagtccaggttgaca

SEQ ID NO: 6782562 - DNA, 65 bp, Homo sapiens
gcatgagcccttcactatggcctggcgagtgaggtgttctgattggtcaggctgtggtgacatgc

SEQ ID NO: 6782563 - DNA, 55 bp, Homo sapiens
cagggttggggtagataagaaatgataaataggtctgtcttgcatgccagcgctg

SEQ ID NO: 6782564 - DNA, 89 bp, Homo sapiens
ttattttttctctttgggccaagaacagcatttcctagacctaaaagcagctccagtaaatgattattttgccaacggatgaagggtaa

SEQ ID NO: 6782565 - DNA, 105 bp, Homo sapiens
cctctgggactaattaccctgatctgactagactggttgttagatctgaattatagtcatgaataagttagatcttaattaaagtcatgtatggggtccaagagg

SEQ ID NO: 6782566 - DNA, 71 bp, Homo sapiens
tctctgcaactacatcttagggctgctgtaagtacttgctttttgcctttcctataggtgtcctgcagaga

SEQ ID NO: 6782567 - DNA, 58 bp, Homo sapiens
gctaaaactggcctatcagcatgagtcttcactaacagattacaatgggctagctagt

SEQ ID NO: 6782568 - DNA, 74 bp, Homo sapiens
tgtgttacagctgcttttgtgaaataaagattgtccatttctttttatgattattttaaagcagcttttatgca

SEQ ID NO: 6782569 - DNA, 60 bp, Homo sapiens
ctgtagtccctttagtctggagagctgccagcagggctaagctctacagaagggctgggg

SEQ ID NO: 6782570 - DNA, 85 bp, Homo sapiens
gcctctgcagctgtggactatctttattacataggaattctttactagcttgtcctgtatttaaaaatattctaagttttgaggc

SEQ ID NO: 6782571 - DNA, 126 bp, Homo sapiens
tatcccaggcctaggaattgtctgtcttggaaggaaaagtaacaaaactgtgtgccagaatgtgagagagaatgctggacatttgttgtttttcccatcaacatcttctccttgccccatggggta

SEQ ID NO: 6782572 - DNA, 57 bp, Homo sapiens
ttgattcatttattgagtgcctattttttcagatgctgggcattcagtagtgaacaa

SEQ ID NO: 6782573 - DNA, 86 bp, Homo sapiens
aagggatcaggtttctgaaggccttggtacccagtgggtgccccacacctaccctgcacctggcactacaggcacctgtcttcctt

SEQ ID NO: 6782574 - DNA, 56 bp, Homo sapiens
gttttctaggatcccctccaagcattttccaaagcccgaggggctgcttacaagac

SEQ ID NO: 6782575 - DNA, 77 bp, Homo sapiens
tatagtgattagaaatcatgtcttatttctatcaacccataacaagatggagtcatgtaagagtttaaattactatg

SEQ ID NO: 6782576 - DNA, 87 bp, Homo sapiens
ctgaattttcaatagttcctttgtgaaggcatctgttactcacataactgaaaagatgtttgtgcagtggcatgcttgagagtacag

SEQ ID NO: 6782577 - DNA, 92 bp, Homo sapiens
tctcagtctgtttccctatgcgtgcctctgtctgtctgtgggtgtctctaagtctctgtagatagacaggtaggtagggagagagaaagaga

SEQ ID NO: 6782578 - DNA, 68 bp, Homo sapiens
gggatagcttggcttctgatgtattcctgatttgtgtgtcgtgaacagcaggttgccagaaaggttct

SEQ ID NO: 6782579 - DNA, 60 bp, Homo sapiens
gacatagcttggtactaccagggagtcagaatactcagaactcaggagactaactatgtc

SEQ ID NO: 6782580 - DNA, 76 bp, Homo sapiens
tggtgatattgaatctgagaatggcttgcctcagttctgtgaggcttcaatgtattcacattcagttcttccacca

SEQ ID NO: 6782581 - DNA, 116 bp, Homo sapiens
gaccaataaataaactaataagctggggattgcctattttgaagatttttgccagtgaatacaatagattcacaggcttttacagtcagtcaaactcagcttatagacttgtggtc

SEQ ID NO: 6782582 - DNA, 78 bp, Homo sapiens
gaaggcaaaggggaatgcttgtgggttctagttcatttttgagggctccagctcaaattcagcttccagtttgtcttt

SEQ ID NO: 6782583 - DNA, 66 bp, Homo sapiens
acatgggtgaatcttaaagacattacgctaagtgaaagaagccagtctccagaggttacatcctgt

SEQ ID NO: 6782584 - DNA, 67 bp, Homo sapiens
ttttcttattggcatatttatgttgaggtcattaggaattcatttcatttctatggcaatgggaaaa

SEQ ID NO: 6782585 - DNA, 91 bp, Homo sapiens
ttctgtcatttttgggggattgttcattgctagtactttcccatgagggcataaagtggtagacaaagataattggtcaatattgtttgag

SEQ ID NO: 6782586 - DNA, 106 bp, Homo sapiens
gtgtgtctgggccgcgggactgcggcgaggcaggcgccaggggctcgtctggaaccagatgtgccgcggcgccgctctggccgccaccagcgcggcgcgctcgcac

SEQ ID NO: 6782587 - DNA, 82 bp, Homo sapiens
agggcagcttattatagctcatatgttgaatggttaaaaagccgtatcaaagcaaaacatatttctattaaagacctgcttt

SEQ ID NO: 6782588 - DNA, 84 bp, Homo sapiens
aagaggcagttaggacacagcttgatgagggctttgctggggaaagtactggtgctccagaagctcgtggtcaaggtgcctctt

SEQ ID NO: 6782589 - DNA, 95 bp, Homo sapiens
tgaaggcttggcccatcaggttggcaccctgggagacagcttgctactagctctgtctgggctaccagagttctaactttggcgccacgccttca

SEQ ID NO: 6782590 - DNA, 74 bp, Homo sapiens
gcaagatttcttttaggtgaagcagaaactctctagagtaagagaatgagtagatttacttgaaaaatctttgc

SEQ ID NO: 6782591 - DNA, 82 bp, Homo sapiens
gagtaatggtgttgagtctctcttcacatgtcctttggccatttggatatcccattctgtgaggtgcctaataccgtgactt

SEQ ID NO: 6782592 - DNA, 69 bp, Homo sapiens
gaggctttttggatccagagaaactggtcagatagggcaggcctgacctactctggcttccaaagcatc

SEQ ID NO: 6782593 - DNA, 65 bp, Homo sapiens
tgtctgcctgtagaggttcgcagacaaggcagcacccactaagccctgctccgctaaggcagaca

SEQ ID NO: 6782594 - DNA, 64 bp, Homo sapiens
ccaagtggatcttactgatctctgatacacgtgcatggaacaaaggctcagtaaatctttgtgg

SEQ ID NO: 6782595 - DNA, 68 bp, Homo sapiens
gtctggagaagaaacttgctctgggaagtgatgagaagccatccagatcaaggtgtttcatccgagac

SEQ ID NO: 6782596 - DNA, 109 bp, Homo sapiens
cattgctccaggtgtctcctactcaccaattgctgatatgcagaagactcatgtgacacagaacgtgtctgtgcttattcagcaggggctgtgggcaggacaggcaatg

SEQ ID NO: 6782597 - DNA, 69 bp, Homo sapiens
agtgtgtaagtctcctcttcccgccttgctgccaacatatttgatgctggggagaagagactgcaggct

SEQ ID NO: 6782598 - DNA, 66 bp, Homo sapiens
tagaaagcaggattgccaccactcctcgaagcaccccacgattagagtgtctgagcgctgcttctg

SEQ ID NO: 6782599 - DNA, 71 bp, Homo sapiens
gacgcatcagctggctatcctattgcatactttcattggcactgcaatcaggtaccatttgattctagctc

SEQ ID NO: 6782600 - DNA, 61 bp, Homo sapiens
ggttttcaggccagaagatagacctagagacagaatttgggtctggaacgaggtctaagcc

SEQ ID NO: 6782601 - DNA, 58 bp, Homo sapiens
agcacctggatttgatagtcagtgagccttggttcttgtctgtgcttttccagttgct

SEQ ID NO: 6782602 - DNA, 75 bp, Homo sapiens
gaagcttgtttggatgaaattatgaattatatgtgtaccatagccaattccaaatgttttcaatccaaaagtttc

SEQ ID NO: 6782603 - DNA, 88 bp, Homo sapiens
ggagtctcgctctgtcaccgaggctggagtgcagtgacgcgatcttggcccactgcaacctccgcctcccaggttcaagcgattctcc

SEQ ID NO: 6782604 - DNA, 83 bp, Homo sapiens
gtcatggggaatgttagaggagtttagttttgtaattgtataaaaaacagaacatattgcttctctcaagagcaacccatgat

SEQ ID NO: 6782605 - DNA, 108 bp, Homo sapiens
attgctggcgggactataaattgatataggcttcatgacagaggggcaatttggtgttcctctcaaaaagcatgtatcctttgacccaggggttctgattctagcaat

SEQ ID NO: 6782606 - DNA, 60 bp, Homo sapiens
ctccctctgcctttgctttggctgtcacagtccctgactttgcttcagggcagcagggag

SEQ ID NO: 6782607 - DNA, 91 bp, Homo sapiens
ggagtctcactctgtctctcaggctggagtgcagtggtgcaatctcagctcactgcaacaacctctacctcccaggttcaaatgattttcc

SEQ ID NO: 6782608 - DNA, 98 bp, Homo sapiens
agctccctggaaagccagccatggccagtctgcagcccctggggactctgtgagagtctggatgcagacaggccaggggctgccacctcaggaaagct

SEQ ID NO: 6782609 - DNA, 71 bp, Homo sapiens
gtaccgaaccctgtatacgctacattttttcctatacattggtgagtgggtagtgtatacagtgtggatac

SEQ ID NO: 6782610 - DNA, 76 bp, Homo sapiens
agggtcagggagtgagtatttagtgagcctgctcggtgcaccaacccacttaatatgcttcatctcctgggaccct

SEQ ID NO: 6782611 - DNA, 106 bp, Homo sapiens
ggctggtgtgtggcccctgggtgtgcatgggggcagctccaggaattggggacccttacagtcctctgcaacaccccttcacaccccgggagcccacacctctgcc

SEQ ID NO: 6782612 - DNA, 74 bp, Homo sapiens
tgtataatcttagtttagattagcaattcgggatctctttttccctgaattctaaccattaagccaagcaagca

SEQ ID NO: 6782613 - DNA, 76 bp, Homo sapiens
gagcctgttatatgtcaggtgttatgctaagtattcttacatagatgacttcatttcatttgcacagtgacagctc

SEQ ID NO: 6782614 - DNA, 116 bp, Homo sapiens
attgggtggggagaagatccccttgcttcttgagatcatttatttacctttcttgcttagaaagacaaataaatggtctgaaagtgcttatttggggggtagtttttttttttaat

SEQ ID NO: 6782615 - DNA, 66 bp, Homo sapiens
gagcagggaggcggtgtgctggcgctgcggctgagcctcgccgggaactgtgcgcttctcatgttt

SEQ ID NO: 6782616 - DNA, 81 bp, Homo sapiens
gagagaagtcaagttgtgcagaaagttatcacctggcactgatgattgatcttaggtgtgacattttgttcctcttttctt

SEQ ID NO: 6782617 - DNA, 91 bp, Homo sapiens
gtattggactaagtgaatttacatttgtaatggaaaatggaatagggaacaattatttagcattactaaaatgaaaacttggatttggtac

SEQ ID NO: 6782618 - DNA, 64 bp, Homo sapiens
gagacctggatgtgagggaagtaatgcccctctagggcctgtctcccgggtttgtccaggcctc

SEQ ID NO: 6782619 - DNA, 110 bp, Homo sapiens
atttatatctctagcctgactattccttgtgctccagaccaatatatgcagttcttggattggactgattgagaaggaaggggatcctgaatgttacaatagccataagt

SEQ ID NO: 6782620 - DNA, 74 bp, Homo sapiens
ctgaggttcaatggagtggagttaatattagcactgtcttcagtgtttcttggtcttttctattaaatatacag

SEQ ID NO: 6782621 - DNA, 92 bp, Homo sapiens
tttctcaggtactctccccactttcctgcccttgccttccttccaagagctctcctggaagccaaggtcagaaggagacaagcttgaagaga

SEQ ID NO: 6782622 - DNA, 82 bp, Homo sapiens
gcaacttgcatggcttccaaggccctccgtgatccgatcctgcccaccttcacaggctccggccttgcagcccttgccctgc

SEQ ID NO: 6782623 - DNA, 95 bp, Homo sapiens
aacttacctcgtttttgatttagccaatattatatgtccatagattactttgcaggacatttctattgagctaagaccaaccacaaggctaagtt

SEQ ID NO: 6782624 - DNA, 83 bp, Homo sapiens
cctgagaagggccctgagaggtgctggtggctgcagatgcctgggtgcccaggctgcgcccacttgccctttgaggcctcagg

SEQ ID NO: 6782625 - DNA, 91 bp, Homo sapiens
gttaggaattactgggaagtgagaaatgacaaatgtgtcgatgccctgaagtcttgaccacattgatttctcatccattcagtttcttggc

SEQ ID NO: 6782626 - DNA, 88 bp, Homo sapiens
gaaaaaatggctcactctgttagaggaaagtgctgacagccatggaagcaagcacttcctcaacaagtcccgcctctgtcatattttc

SEQ ID NO: 6782627 - DNA, 64 bp, Homo sapiens
ggcccagccggtccagggctgtgggaaggaggcacacccgggagtccactgccggaccggggtt

SEQ ID NO: 6782628 - DNA, 74 bp, Homo sapiens
aaaagcaggtgtgagccagtgggccccacgtcccctcttcagccagggcgcctgctctctctgcttctgctttt

SEQ ID NO: 6782629 - DNA, 74 bp, Homo sapiens
actgcatcagaatcattggagggcttgttacaacacaggttgctaagcgctacttccagggttgctgattcagt

SEQ ID NO: 6782630 - DNA, 75 bp, Homo sapiens
gagattacagttgtcctatctaatccagtcctgttttgttccctcgacccagattgagaaggatacattgttctc

SEQ ID NO: 6782631 - DNA, 58 bp, Homo sapiens
ggaagtgaggagaggccagttgtgactattcagtggcagggttttatagatctcttcc

SEQ ID NO: 6782632 - DNA, 59 bp, Homo sapiens
tctctgtccccatcttctagctggaatccagagttccttgttaggaggttggacatgga

SEQ ID NO: 6782633 - DNA, 104 bp, Homo sapiens
gagtcattaagaaacatgccacagtggccacagttcaactctacacagtctttccagagcctgcacagtgaccactgagcaagtgctattctccactgtgactt

SEQ ID NO: 6782634 - DNA, 77 bp, Homo sapiens
atttgtttgtggagttaaagggctcacaaggtaaggacagctgtaagaactgtctgccctgagctcccagtgcaggt

SEQ ID NO: 6782635 - DNA, 77 bp, Homo sapiens
gggagtgagacacaagtgaatattttaaggaggtttataagattaaactctaaaatttcgacattgtaatcagcccc

SEQ ID NO: 6782636 - DNA, 85 bp, Homo sapiens
catcaaaggttatttagggggaaggtagtggccaaaaatctactgagaaattctttctttcactctaggtgtatacccaaatgtg

SEQ ID NO: 6782637 - DNA, 60 bp, Homo sapiens
gctctagaaagaaggatgtgggatggaaatatacatatgcttccccttctttttggatgc

SEQ ID NO: 6782638 - DNA, 69 bp, Homo sapiens
gctcctccttccctgggcaggttggggacagactgacagaggaccccagccttccatgggaattggagc

SEQ ID NO: 6782639 - DNA, 102 bp, Homo sapiens
tagtggtgtgcacctgtagtcttagctactcaggaggctgatgtgggaggatcaattgagcctgggaggctgaggctgcagtgagctgtgatcatgccacta

SEQ ID NO: 6782640 - DNA, 112 bp, Homo sapiens
tccaatatggtctgtcctcaatcttccttcactttctcccacttctgcttcatattcctttaagttctgccctgtgggaggtgggaaggggtgtgaggaaacagacattgga

SEQ ID NO: 6782641 - DNA, 75 bp, Homo sapiens
cccagtcctcccatcttttgaggtccagctggtcccaaataagactttcttttacctcaaggatgaggctctggg

SEQ ID NO: 6782642 - DNA, 68 bp, Homo sapiens
gacagctgaaaaatgtaaggtaaatgaaattatgcttctatcgccaactttattttgttccagctgtc

SEQ ID NO: 6782643 - DNA, 98 bp, Homo sapiens
gatattgatgctgctggtccaggaaaccctctttgagtagcaaatggctggaacatctctccaggagggcttcctgtgatgatggaatgctctgtatc

SEQ ID NO: 6782644 - DNA, 67 bp, Homo sapiens
ccaattaatttttctgacagccacagccctcctaaggctgatcctagctgacagaggaatagaaagg

SEQ ID NO: 6782645 - DNA, 128 bp, Homo sapiens
gcctcgcgcccaccgcgctcggcagtggctgctcgggctccggccccgcgccaggcgggcggaagcgggtcgcggccccgggctggggctccgggcgccggaaccccgggcgggcgcggcgccgaggc

SEQ ID NO: 6782646 - DNA, 122 bp, Homo sapiens
gctacaaagttaaatattatttggtgatatgtttctcaacatactgttgttattaaaaaggatttgcttactggcactatgttggagaaatgataacataaagtttatttgatccattgtgc

SEQ ID NO: 6782647 - DNA, 129 bp, Homo sapiens
tattggcaccacctggggagttttgataacaactgatgcctgggttcccaccccaaagattataatttaattggtcttgggtgtgaccttggcattgggagtgctacaaattgccaggtggttcctatg

SEQ ID NO: 6782648 - DNA, 67 bp, Homo sapiens
gcgccgggagctgcgcgccaggtggccgcggacagggagtgccgcgcccgccaggtgtgtcccgcgc

SEQ ID NO: 6782649 - DNA, 72 bp, Homo sapiens
tagcaaatgtattgaacatacatatccacaccttcttcccaagaagggattttgttgttcattatcgtgtta

SEQ ID NO: 6782650 - DNA, 64 bp, Homo sapiens
ccaccacactgtggggtttaccatgctgtgttacacatagaaaaactgaggcccgcagaggtgg

SEQ ID NO: 6782651 - DNA, 85 bp, Homo sapiens
gggttccgagatgccaatggccttggctgcagagacatggctgctgtaagtccagccggtgccacagggccaggaatctcaaccc

SEQ ID NO: 6782652 - DNA, 65 bp, Homo sapiens
catgatctgatagtttgcaaatgaattctgccaggaagtttcaaatggttagactgttagccatg

SEQ ID NO: 6782653 - DNA, 76 bp, Homo sapiens
tctcttcattcccatttgtgtggtctggagcacatcctgtaggagttcttgagtgcacaaatgtgattcagagaga

SEQ ID NO: 6782654 - DNA, 67 bp, Homo sapiens
tgagtggtgtggcctcttaggttttagcaacattactactgccttcaaacagcgccacccctgctca

SEQ ID NO: 6782655 - DNA, 74 bp, Homo sapiens
tgtggacttttgagaaactgctgctccaacacccccaccacgttcagagcagctggttcccgagggcgtctgca

SEQ ID NO: 6782656 - DNA, 76 bp, Homo sapiens
cagtgtcatttccctcctacaaagaggcactgcaaactcagcaggtatgggtgggctcagggaatggttttcactg

SEQ ID NO: 6782657 - DNA, 61 bp, Homo sapiens
gtgtgtgcgtgtgcctatcaataaaggctgtcaaagtccttgcaggaagcagatggcacac

SEQ ID NO: 6782658 - DNA, 72 bp, Homo sapiens
tatccccaagatcctgaaccatctctgttctgtattaggaaagtaaagtttctcagtgatgttctggggatg

SEQ ID NO: 6782659 - DNA, 67 bp, Homo sapiens
tagtgtctcggggcccaggattcctggcacagggctggcccagtctttcctgggctttggtttactg

SEQ ID NO: 6782660 - DNA, 83 bp, Homo sapiens
tttatcagaggccatttctcagagtgtgacttggtcatgagttatcagccattaacattcctgatagctggtgtagtggtgaa

SEQ ID NO: 6782661 - DNA, 70 bp, Homo sapiens
gagctgggctttagggcaggcagtgttagacctgaggactgatgcactagccgtagagattactagactt

SEQ ID NO: 6782662 - DNA, 59 bp, Homo sapiens
agtgttgtttacatattatgcatgggtcactgacaatcaatgtgtctgtaaacaactct

SEQ ID NO: 6782663 - DNA, 64 bp, Homo sapiens
cagtgatatttatcctactcacacgtccatccataggctgtctgtgagaagaaaaatatggctg

SEQ ID NO: 6782664 - DNA, 89 bp, Homo sapiens
tgttataccctttgtcaagcacagaagaaataatggaaactacattcacctttattttctatgcttgatagaactagtggtgtatagca

SEQ ID NO: 6782665 - DNA, 80 bp, Homo sapiens
gatttgctgctacgttgaatgtccatttgagatttgagggcaaggatttaaagtgagaacagtcagcacagttgtgggtt

SEQ ID NO: 6782666 - DNA, 80 bp, Homo sapiens
gactctgctctcactgttcacccagcactagcagtaccagatggttctgtggagtcctggggaatggagagagcacagtc

SEQ ID NO: 6782667 - DNA, 55 bp, Homo sapiens
gaagttttctgaggctgtagctttatgcaaatatgctactcaagaagaaggcttt

SEQ ID NO: 6782668 - DNA, 60 bp, Homo sapiens
ccctggcataaaacttctccagagataaaatagctttctgacaggagggttgtggcaggg

SEQ ID NO: 6782669 - DNA, 68 bp, Homo sapiens
ttcaccatattggccagacttatccttcagagctttttaactggaagatatgctgccagtctggtgaa

SEQ ID NO: 6782670 - DNA, 70 bp, Homo sapiens
gcttagtggcttgctgaggggcttgctagctgagaggctttttgagggcctgattagcaggctagctggc

SEQ ID NO: 6782671 - DNA, 72 bp, Homo sapiens
agctgggctggcagccaagtgaagagggctgggattgagcggactcttgtctgtgggctgctgcctccagct

SEQ ID NO: 6782672 - DNA, 66 bp, Homo sapiens
ggtccacttgctgtgttcttaattgggatagtgtgaatctgactaagtgcaaggcaagctgcttcc

SEQ ID NO: 6782673 - DNA, 60 bp, Homo sapiens
tgaatccttcgcacttagacattgggcattttgtaaatgtaagttcagtgaatgggttca

SEQ ID NO: 6782674 - DNA, 59 bp, Homo sapiens
ggtgagtagcaggccctgaaattattctggcatccttggataatttaccctgcaccact

SEQ ID NO: 6782675 - DNA, 77 bp, Homo sapiens
gagtcacttccataataacctgagagaaagtggcaatttttcattttttatctcgtattgcttatggagctgagatt

SEQ ID NO: 6782676 - DNA, 81 bp, Homo sapiens
caggagtttcaaaatgccagtaaatctgaggatatcaaagatttctgagccagcaagttaattggtattttgatccttttg

SEQ ID NO: 6782677 - DNA, 70 bp, Homo sapiens
ctgttctcaatatgtgctttggccacttgggaagtggtcccaagtcattgtttagtcatgttagctacag

SEQ ID NO: 6782678 - DNA, 129 bp, Homo sapiens
tggtgatcaaaagtacgtgctgctggggaaaatagtgggaaagttaacaaagacaggttacataacagctaacagtcacattgttcaacttttttttcctgctccaatttctcttttgccattgcatta

SEQ ID NO: 6782679 - DNA, 79 bp, Homo sapiens
gagccctggagattggcagtagtctcggctacccctcatggtgccggggtccgaattactcgcctctctgggacagctc

SEQ ID NO: 6782680 - DNA, 117 bp, Homo sapiens
gattctgtagaaaatgtatgactgcatgaacttttctgaagcccagtcaaacccgaggttaggagttcctgaattgagctttagaaacagtaataaatacattgtcttgcatttatc

SEQ ID NO: 6782681 - DNA, 76 bp, Homo sapiens
gcccccagactcctgctacataccttccttccagagcagtcaggctgggtggaatgtaggcagggaggtagggggt

SEQ ID NO: 6782682 - DNA, 80 bp, Homo sapiens
cttcctttctttaacctgaagtgatctgctgaattttaatcctttatccacacttcatagcaaggttggagaattggaag

SEQ ID NO: 6782683 - DNA, 56 bp, Homo sapiens
actggaaaaccactgaaatgagcccatgaggcacatgtgttttcagtattttcagt

SEQ ID NO: 6782684 - DNA, 63 bp, Homo sapiens
tcatagctaaggttcttctttgatttcataagttaataatatcgaagaagcaataagctgtga

SEQ ID NO: 6782685 - DNA, 87 bp, Homo sapiens
gatgtactatggccaccatctctaaaacacagcagcactacttactttactgccagtaagttgactgagatgtggttttagttcatc

SEQ ID NO: 6782686 - DNA, 68 bp, Homo sapiens
gtgggcctccccagcctggagttcccagccatggtttggaaagccatctggctgctgggagagttaat

SEQ ID NO: 6782687 - DNA, 89 bp, Homo sapiens
ttccctaagggaaatcaggatgatgttccagaataccatttttaacaacccccgctgttctttgatactccctgatttgcttgggggaa

SEQ ID NO: 6782688 - DNA, 57 bp, Homo sapiens
tgaggccagggattccatcattagtgtcctgaaacgcctatgacagtgcctggccca

SEQ ID NO: 6782689 - DNA, 60 bp, Homo sapiens
tgtgtgctttttctggattctcattatctttaattttcttgttcctgggaaaggcataca

SEQ ID NO: 6782690 - DNA, 99 bp, Homo sapiens
tttcctcaaagaattaaatgtgacttgccatcttgagttttgttacaaaagattgtaatgctattcaatagtggtatcatatgttatttaccatggaaa

SEQ ID NO: 6782691 - DNA, 65 bp, Homo sapiens
ttgcctctgggttctataactgagtcagataccagcaaacctcagggacgtgagctcagagtcaa

SEQ ID NO: 6782692 - DNA, 79 bp, Homo sapiens
tccctatgatattttatgagctttcataaatgggtcatttgtccagataagaaatttagttatagaatgaacatagaga

SEQ ID NO: 6782693 - DNA, 55 bp, Homo sapiens
tcaccccctgccctactccagggcccaggccaggccttagggctctagggagtga

SEQ ID NO: 6782694 - DNA, 60 bp, Homo sapiens
ggccatggcagcatgggattggtagatttcttatccctccatttgcatgctgtcttagtc

SEQ ID NO: 6782695 - DNA, 96 bp, Homo sapiens
accgaaattcaaataaataggctgtataaccccatgcgactgtaattttccttttatagtcagcttgtttactgtttattgaagagaatgtctggt

SEQ ID NO: 6782696 - DNA, 60 bp, Homo sapiens
actttgcaaataaactctctaatgctcaagtatgtataaggtggtatttaattgcagagt

SEQ ID NO: 6782697 - DNA, 87 bp, Homo sapiens
agggcaaatccataagaaataatgatgatgacactataagacattaaaaagtaagttatcctccattttcattaagggatttgtctt

SEQ ID NO: 6782698 - DNA, 67 bp, Homo sapiens
gtgaacaggaggtggagatatgcaggaaaaagcccccataaactgtttctatgtcttgtgccttcat

SEQ ID NO: 6782699 - DNA, 55 bp, Homo sapiens
gatgccatgcaaaaagctattggccactcactcatggctatgcatgcattgtatc

SEQ ID NO: 6782700 - DNA, 83 bp, Homo sapiens
cctcgcttccagacctctgggtggtctcactgagtgcccttgtcttagtgatcaggatccctatatcaggtctttgagccagg

SEQ ID NO: 6782701 - DNA, 101 bp, Homo sapiens
tgaaagtgaatatatatgctatgttgaataatttgagtaatttgcatggttcagggcctttagtttgcaaatagtttttcatgtattatatatctctttta

SEQ ID NO: 6782702 - DNA, 91 bp, Homo sapiens
ttttgtgtaaagatcaattatgacagactaatatgaaatttgacctttatttggaagaaatctgtcacaggttgtcattgattacatgaaa

SEQ ID NO: 6782703 - DNA, 63 bp, Homo sapiens
gggagtcacagctgaatctcccttcagagctcctgggccagaggagggtcgtgctgtgttcct

SEQ ID NO: 6782704 - DNA, 86 bp, Homo sapiens
ggagatgtcatagatttttgtcttaagtagattacagcctgagagccctccaagttgtctctggaacttgagctataaacatctcc

SEQ ID NO: 6782705 - DNA, 70 bp, Homo sapiens
gaagtgtagctgggagtgtctgatgggtggggcaaagtgttttgcacttgtcacctctcagctgctgctc

SEQ ID NO: 6782706 - DNA, 56 bp, Homo sapiens
gaggtcctctgtgtccgcgggctcgggcgtctccgcagagtggccgcagaggcctc

SEQ ID NO: 6782707 - DNA, 70 bp, Homo sapiens
aatgggagactggtttatgtatcatctagaattgtgatatggttcaaggggataataaaccttacttatt

SEQ ID NO: 6782708 - DNA, 95 bp, Homo sapiens
gggaaggcagcattcttctggatagttagttgataataccagcagataatatcagagagagctggcagttgataataccagagagagttgttccc

SEQ ID NO: 6782709 - DNA, 60 bp, Homo sapiens
tgtgtttgtgtttcagacgaatcaaagtaaaaatgctttaagtgatgaaatgcagataca

SEQ ID NO: 6782710 - DNA, 64 bp, Homo sapiens
atgctggcatactgtggacattcaataattagagctactgtgtactgcacagtgtgctaagcat

SEQ ID NO: 6782711 - DNA, 60 bp, Homo sapiens
ctgagggcttcctaagctctggggtgatgtttggacttggagacagtggggagctcctag

SEQ ID NO: 6782712 - DNA, 65 bp, Homo sapiens
agtgttgtgtgctttggtagtagaagtgtgcaaaaaacacaaagttagcaaagcaaacacatgct

SEQ ID NO: 6782713 - DNA, 67 bp, Homo sapiens
acttttggcagactgacaatctgttttaccaaatctatgtaatgcattttgaaggtctgtttagagt

SEQ ID NO: 6782714 - DNA, 124 bp, Homo sapiens
aaccctccttgggaagtgaagctcaggctgtgatttcaagccagggggcgtttttctataactggatgaaaagcacctccagagcttgaagctcacagtttgagagcaatcgtctaaggaagtt

SEQ ID NO: 6782715 - DNA, 67 bp, Homo sapiens
ccacacgcgcacactcaggtcaagtattctgaaccaaaggcacaggttgactcttgagagccgtggg

SEQ ID NO: 6782716 - DNA, 76 bp, Homo sapiens
caaaagctcacttctgaaggtagttggcaggacttcaaggaatggtcttgcactgctttgcaaagctgagacaatg

SEQ ID NO: 6782717 - DNA, 57 bp, Homo sapiens
ttgtgctgtatcatatttgtatttttcctgctcagcagtgcttatgatatagtagaa

SEQ ID NO: 6782718 - DNA, 58 bp, Homo sapiens
taatgtctgatagtgatggctccaaaaatcatggagaaagattgctcagtagacattg

SEQ ID NO: 6782719 - DNA, 68 bp, Homo sapiens
gctagttatctgttagtattccaggccagcagcagctgcatgggaaaaagaactccagataagcaagc

SEQ ID NO: 6782720 - DNA, 125 bp, Homo sapiens
caacagatcttaacatctcttgctgcaaattttccagtgtgttctggtctaccttggtatcttaaaaccaggctcactgactaccacatgagaaatgacagtggggtgtcttaaatgatctgttg

SEQ ID NO: 6782721 - DNA, 71 bp, Homo sapiens
cacacggctgttgacagaaccggatgctgttgcccatgggcccgaaggtctgagtttgttgttggctggtg

SEQ ID NO: 6782722 - DNA, 83 bp, Homo sapiens
aatacaacagttttttcaacattggaatgtaatttctgtttaatgtcaagctaatacatttaatgtcgagctattgtagtgtt

SEQ ID NO: 6782723 - DNA, 58 bp, Homo sapiens
cctgtgatgaagagtccaagaacagcctgagataaggatgtcattcttctttcacagg

SEQ ID NO: 6782724 - DNA, 58 bp, Homo sapiens
agtaaacagtatctttagtgtctgagcaaattttttgtggtaacagatgctgtttgct

SEQ ID NO: 6782725 - DNA, 105 bp, Homo sapiens
gaagttagatatataacgcctttgttttgggtaaatgtttaagcatagactataccttagtaatagtgccattacccaagagtaagatagttagcatccaacttt

SEQ ID NO: 6782726 - DNA, 76 bp, Homo sapiens
atacataccatctcctggaaagctgaaagaagaagatatattcttaatgaggttttaagagagaaggtcatcgtat

SEQ ID NO: 6782727 - DNA, 70 bp, Homo sapiens
ccttttgaggcttgggctcagatctagtataacaacatctttgccacaaaacaagtccaaaatcagaagg

SEQ ID NO: 6782728 - DNA, 72 bp, Homo sapiens
gatccttcaaacttcacctcagagaggcttccagataactcatgccaagtttctctcagggactgatggatt

SEQ ID NO: 6782729 - DNA, 74 bp, Homo sapiens
gcatgggaggcagccctgtggagaggcccacgttagtgagcttggaagtggattttctacggcctgccaccagc

SEQ ID NO: 6782730 - DNA, 78 bp, Homo sapiens
aattggttgttttcagcagtttatgacttgttatttaacatttaacagaatggctatttattttggaaacaaccaatt

SEQ ID NO: 6782731 - DNA, 59 bp, Homo sapiens
gcccctccctgggcgtgccctggtgctacacgcacctgtgggcagcctcgggagtgggt

SEQ ID NO: 6782732 - DNA, 85 bp, Homo sapiens
ctgcccagctccttggatgggcaggcttgataaccaggaacacctgccttttcagctctcctgtccagggaagggaggtgggcag

SEQ ID NO: 6782733 - DNA, 62 bp, Homo sapiens
gtttggctcattctactctccctgggtcttattgactttcagggagcctagaagagctggac

SEQ ID NO: 6782734 - DNA, 93 bp, Homo sapiens
acctcacttttagaagtatttcaaggctattaatataaatgctttttaaaggttgcatctattagctctgaaaatttcattgacttgtgaggt

SEQ ID NO: 6782735 - DNA, 81 bp, Homo sapiens
gagacgagagcttcactttgtactttgtcaggactgccattggcctgtgggagatggggtggagatagtaacactcgtctt

SEQ ID NO: 6782736 - DNA, 79 bp, Homo sapiens
ggctagtattcaaatcaccatccttaattataattgttggctgcaatgaataatctgtggatggttttgagttgctgcc

SEQ ID NO: 6782737 - DNA, 55 bp, Homo sapiens
cactctcactgagctcatgccaaacttaaagaacttggtgttagaccagagagtg

SEQ ID NO: 6782738 - DNA, 71 bp, Homo sapiens
cctgcccttattgagcttagtctagtagattaacagatcagactagtctgcattacaaaataggtaccagg

SEQ ID NO: 6782739 - DNA, 71 bp, Homo sapiens
gctggtgctgcgatgattttacagagaagagacattcctactgtttacagctttgggtcatacagacaagc

SEQ ID NO: 6782740 - DNA, 98 bp, Homo sapiens
ggcaaaagctgtcaaatgcaattcaggaagacaagtgtaatgaatatgtagcataatatgggtagatttcttaccggatgcattttgaatatattgct

SEQ ID NO: 6782741 - DNA, 65 bp, Homo sapiens
agtcttaggctccattagtagatccatcagggagactcttattctgcatatggagtgttgagact

SEQ ID NO: 6782742 - DNA, 65 bp, Homo sapiens
tccagtttattatgcatttacaactcctttggacatggggtcatgtggttgcctagtgtgctgga

SEQ ID NO: 6782743 - DNA, 114 bp, Homo sapiens
gcaaaggtctaacaggggtattgatatcagagtgggttttaaaagtgtattaactataatcttacttttagcctatttgattctacttatttcagaactattaatgacgtttgt

SEQ ID NO: 6782744 - DNA, 68 bp, Homo sapiens
acacttggaaaagtagcactatgtttgcctgtgaagaacaataaactagtatgtatattaccaagtgt

SEQ ID NO: 6782745 - DNA, 70 bp, Homo sapiens
gcaccaagattgagaaactctgggttagaatcttcttcgctgactttgaccactctttctcagcctttgc

SEQ ID NO: 6782746 - DNA, 66 bp, Homo sapiens
ccacatccttcagctgagcccagagatcatgaatggggttgagctgggcacatgtggaggttgtgg

SEQ ID NO: 6782747 - DNA, 101 bp, Homo sapiens
tttcctagtcatgcatcatctgagccagagcttcccccgagtgtggtccggagatccctgggggccctctggttagtctataatgcttcatgaggaggaag

SEQ ID NO: 6782748 - DNA, 80 bp, Homo sapiens
tgcccttagttatccccacctctgttaaggactccggcagctgagcctgtacctctagcccaggtgggcattgaaatgca

SEQ ID NO: 6782749 - DNA, 68 bp, Homo sapiens
gcgggcttcctccagggaagtgcttggccctccaccaccacaggcatggccttcagggacagctgggc

SEQ ID NO: 6782750 - DNA, 121 bp, Homo sapiens
cagagcatctcctccctgttcttggggctgggagaagagaaggattctgagcctgggtcatcccctaacctgtcctcaacccatccttctccccaacccttcatcaggtctcctgagcctg

SEQ ID NO: 6782751 - DNA, 56 bp, Homo sapiens
gaagcagtagcaactgtgtcttccactgttcggaaaacaacagttgttacttcttt

SEQ ID NO: 6782752 - DNA, 56 bp, Homo sapiens
ctggccctggtaaggacacccaggagagggccagggtgcctgtatttggggcacag

SEQ ID NO: 6782753 - DNA, 93 bp, Homo sapiens
ggccagcctggcctcaaactcctgaccttgtgatccacctgctttggcctcccaaagtgctgggattacaggcttgagccactacgcctggcc

SEQ ID NO: 6782754 - DNA, 124 bp, Homo sapiens
ggtgagtcatatatgtatcatgtcctaactttgtcatcttccctttctgaatcagaacatggattgtcaaaggtaagactgattagaagaatgaagggctaagattgctgactaaagactcact

SEQ ID NO: 6782755 - DNA, 57 bp, Homo sapiens
gctgaccattaggaggacgatacaagagacctttgtctctttctcccaatggccagc

SEQ ID NO: 6782756 - DNA, 69 bp, Homo sapiens
gtgttttcacatgtgtggcagtgcaagtaaataacacattatttgactgaatcaggcatgatactgcac

SEQ ID NO: 6782757 - DNA, 58 bp, Homo sapiens
gctgggaacacagccatgagagattctgacaagtcttgacttcattcagcttcccagt

SEQ ID NO: 6782758 - DNA, 75 bp, Homo sapiens
acattcaagggctcaaacggtggttgcctcccactagggagggcagggggccgccagagagagccttgattatgt

SEQ ID NO: 6782759 - DNA, 59 bp, Homo sapiens
ctctagctctgtgctctggatctgttggtattccaatgattcaacacttggagtaagag

SEQ ID NO: 6782760 - DNA, 70 bp, Homo sapiens
gttaaacggaccttcctaagtgcaagaagctattaactttttgcatttgatcttgggttctcattttaac

SEQ ID NO: 6782761 - DNA, 98 bp, Homo sapiens
tttgattaatcttcttggattttggaagcagtgtacactgtacttgaaccagtttatcaggtgaccagaaaggcttccattttcaagtgggattcaga

SEQ ID NO: 6782762 - DNA, 55 bp, Homo sapiens
gggagatggctcagaggccgcgccacagggtgtgcccacatgggaccattctctc

SEQ ID NO: 6782763 - DNA, 66 bp, Homo sapiens
gcacgcagccttttccctgcacgctttggatgtaacagtgcaggtcatgtggcgggactgacgtgc

SEQ ID NO: 6782764 - DNA, 95 bp, Homo sapiens
ttttcttagtttatttgttgtttggtaatatgggggtagttattcttaaactattttgactgcattacagaacagagaaaaataaatttggaaaa

SEQ ID NO: 6782765 - DNA, 97 bp, Homo sapiens
cctgggacatggtgtgtgcgcttcttcctgagccaggttgaggttgggaccactgatccattggaagcctggtgaggggtacagccagttctccggg

SEQ ID NO: 6782766 - DNA, 66 bp, Homo sapiens
acatgccaggaatggaggcatttatgaacaagctacttgtgtgcctctctctcattcctggtgtgt

SEQ ID NO: 6782767 - DNA, 66 bp, Homo sapiens
gtctcacagtgctgaaagcccttcaagtctcaatggtctattgaggaggcctttcagggcttgaac

SEQ ID NO: 6782768 - DNA, 77 bp, Homo sapiens
tactaatggcagcctttaagcttggataggtgggtaatagtgcttgaccaatctgcttaaatgctgactgtagagta

SEQ ID NO: 6782769 - DNA, 70 bp, Homo sapiens
ctgggggtttttaagtaccagaagcaacattatttctatattttttgttctgccactgaaaatgcctcag

SEQ ID NO: 6782770 - DNA, 67 bp, Homo sapiens
tgtcaaagaacatttgtccattggcttctcgaatcgtttattcagtcaaacaaatgtttattgagca

SEQ ID NO: 6782771 - DNA, 89 bp, Homo sapiens
agaatgtgcgcacaaaggctgtgaaaagaaaagccgtcactttgcgaagtttggtcttaatttttttccagactatatgtaaatactct

SEQ ID NO: 6782772 - DNA, 61 bp, Homo sapiens
cctagtcaggtgcacctgcattcagcagctcctcattccagcatgcatctgcattgacagg

SEQ ID NO: 6782773 - DNA, 60 bp, Homo sapiens
ggccctgcacagcctggctctcttctggtagcaggtcaaggagaatcagctggcagtccc

SEQ ID NO: 6782774 - DNA, 55 bp, Homo sapiens
gtccatgccctcacctggtgggtgaaacaactcaaaggtcagacttaggctgggc

SEQ ID NO: 6782775 - DNA, 59 bp, Homo sapiens
gccgaattcccaggtcaggctgcagcagggctggttcctgaggcctctcctgggctggc

SEQ ID NO: 6782776 - DNA, 60 bp, Homo sapiens
tttaagcacagggataaagttacccttcaggtggtaaagtcagagatccttggctttaaa

SEQ ID NO: 6782777 - DNA, 57 bp, Homo sapiens
tcttagttttgcccctttgaagccacaggagtggcttcccaaggagccaggatgtga

SEQ ID NO: 6782778 - DNA, 129 bp, Homo sapiens
aagaccctattttcaagtaagatcacattcacaggtaccagaggtcaggacttcattatagggcaaattcatatgttgaaattctgaccttcagtacctcggaatatcactgtatttgaagacagtctt

SEQ ID NO: 6782779 - DNA, 58 bp, Homo sapiens
aactattgccctctggctgacaggctgttaacatacagtcttctagctgggtttggtt

SEQ ID NO: 6782780 - DNA, 77 bp, Homo sapiens
ttcctcaagtgattttcctacttgctaaagtctaaaaatcactgtaaggacatttcaagtagagggatcgctaggaa

SEQ ID NO: 6782781 - DNA, 78 bp, Homo sapiens
aaggcccaattattctctaggttgatataaattatttgttattgggggacaatggtttagcaacttagggaaagcttt

SEQ ID NO: 6782782 - DNA, 58 bp, Homo sapiens
tgttgtttgccatgctgttggaaattaaaaacttcagtccaaggattggcaagcagca

SEQ ID NO: 6782783 - DNA, 80 bp, Homo sapiens
tttctctgggtagcaaactgaactgtgtgaaaaagtttcttctttatatgtgaaggtttgcagaaaggagcacagagaaa

SEQ ID NO: 6782784 - DNA, 92 bp, Homo sapiens
gcagttgtttactgagtacttgttttgtgctgatgcttatactaagcaccttaaagcttgtgctgtagtatttaatccttcaatcttcctgt

SEQ ID NO: 6782785 - DNA, 76 bp, Homo sapiens
gggatcaccttcatcgtatggccgaatgtacattgttgatttcaagtatgttaagtgagcttatgatgagggtccc

SEQ ID NO: 6782786 - DNA, 55 bp, Homo sapiens
gtcgcagggggcacagaccgccgggggttgacggtgaaggtgtgtccactgcggc

SEQ ID NO: 6782787 - DNA, 66 bp, Homo sapiens
tgagtccaaagttccacgtgggttagaggaggatttaaaaacattgtgaggacattggaggactca

SEQ ID NO: 6782788 - DNA, 62 bp, Homo sapiens
gagtctcacttgcaagctgtggccttgcagactgcaaagatgctggctcagtttgcagactc

SEQ ID NO: 6782789 - DNA, 97 bp, Homo sapiens
tgaatatgccacagaattatcccttaaggaaggaggataggacattatcctctgactcctgtccccattgtttgagggttagccccagtggtattca

SEQ ID NO: 6782790 - DNA, 109 bp, Homo sapiens
gctgagtaggaaaagtgcatctggaaagaggatagtgggtaggtggggagacacttctttcctttttaccttcccagatccttttcactgtacccaatacctcttcagc

SEQ ID NO: 6782791 - DNA, 99 bp, Homo sapiens
cagagtctagacctttaaccactgtgttatgctttccatgggtaaagcaacctaaaaaagcccctggaatcagttacatgtggttggagactaactctg

SEQ ID NO: 6782792 - DNA, 62 bp, Homo sapiens
tgacctttctttgagattcctgggcagtttatgtgactactaggttgtcatcaaagaagtca

SEQ ID NO: 6782793 - DNA, 56 bp, Homo sapiens
tccttgttgtcttaggtagcattccctagaagcagagcctaaggcagacatttgga

SEQ ID NO: 6782794 - DNA, 55 bp, Homo sapiens
ctggtcattctgttctacagtagcaagtcaaagcttgttattgggaatgatatag

SEQ ID NO: 6782795 - DNA, 121 bp, Homo sapiens
ggcctgcctgcccctgtggggtgctgtggggtgctagcctgggacccagaggccccttggcatttgctggcagcctcccagctgcattcctcagcatggagcccgagggagagaggaggcc

SEQ ID NO: 6782796 - DNA, 64 bp, Homo sapiens
agactttcagcaactctactttgagggaacaaaccgactccctgaatactggtgctgaaagttt

SEQ ID NO: 6782797 - DNA, 87 bp, Homo sapiens
ctaggtgaggggatgccaggagccagcttcttagcattctcagtgatgccgacctagctccctggctctccctcattttctccctgg

SEQ ID NO: 6782798 - DNA, 67 bp, Homo sapiens
cttggggaaagatagttttctctagagcaattcctgagacttgcataggatctctattctccctaag

SEQ ID NO: 6782799 - DNA, 55 bp, Homo sapiens
cagctgctttagttttccatccctcattaatagaatctggagcctacagtagctg

SEQ ID NO: 6782800 - DNA, 75 bp, Homo sapiens
ctgtgtgctgggagtcaggagcaggctgggctggcagaggactggaagcagagcttggtttgatagagcagacag

SEQ ID NO: 6782801 - DNA, 68 bp, Homo sapiens
gcctttcaaagttttgccatgctcgtggtaagttgctagagagcagtggagcgagatgtttaaaaggc

SEQ ID NO: 6782802 - DNA, 56 bp, Homo sapiens
ctactgagagcacacccctgtgtgaatggtccaactgcagtatctgctttgggtag

SEQ ID NO: 6782803 - DNA, 76 bp, Homo sapiens
tcactctgttgtctaggctggagcatagcagtgcaaccatggctcactgctgcctccaactcctgggctcaggtga

SEQ ID NO: 6782804 - DNA, 61 bp, Homo sapiens
acgcggttaggcatcaggtatataaacatttaatgttttcatggttatgtgtctaatgtgt

SEQ ID NO: 6782805 - DNA, 61 bp, Homo sapiens
atgagtaacaaatacttcagtagtgttgctgtgaatattaagagagatatttgtaacttat

SEQ ID NO: 6782806 - DNA, 92 bp, Homo sapiens
gttaattagtgcacttgggtttgagaggtgggtaacaagctgccgctctgcatttggtggttccttttccgaacaggtggcaactgactgac

SEQ ID NO: 6782807 - DNA, 58 bp, Homo sapiens
tcatctgtgcaggactcagaaggaagcagctgtttgttgtgtcctaagcaccagatgg

SEQ ID NO: 6782808 - DNA, 63 bp, Homo sapiens
attgattctgatgaaagtccatttgagagccaagaatgagtgtgctggtccatctgaatcaat

SEQ ID NO: 6782809 - DNA, 58 bp, Homo sapiens
tggtggcccttgaagctctgacccgcttccgcgaagctgtccccttcaagggcatcca

SEQ ID NO: 6782810 - DNA, 79 bp, Homo sapiens
cttgaagctttgactccactcctaactcctagcaccctcaaaccctcaggggaggagataggggtgtcagggggtcaag

SEQ ID NO: 6782811 - DNA, 67 bp, Homo sapiens
gctgttggcgtgctacaagtcctcacccaccttccacggagaaggactaaggcttgggcccagcagc

SEQ ID NO: 6782812 - DNA, 61 bp, Homo sapiens
ctccaagtatgttaaaatctaaccatcaatgtgatggtattaataggtgaatactttggag

SEQ ID NO: 6782813 - DNA, 76 bp, Homo sapiens
gagcttcaaatggacgaccttttccctctgcaatctgttaagggccaaactcagaggatatctttatctgaagttc

SEQ ID NO: 6782814 - DNA, 69 bp, Homo sapiens
gagttccggtgtcctcggattcagggcagacttgggcagtgcctgtcctgcagttgggggcaggaactc

SEQ ID NO: 6782815 - DNA, 58 bp, Homo sapiens
cacataatgtgtgccatatcacctgggttgtgacctgggttattggaaatattgtgtg

SEQ ID NO: 6782816 - DNA, 103 bp, Homo sapiens
agtaacaagacaacctcaaggagtaaatattttatgtaatgaattaaccatgcaaggttcattcattcatgaatgttaattagaatcctgaggttaaattgct

SEQ ID NO: 6782817 - DNA, 63 bp, Homo sapiens
atatctcattaccttgctgttctgcttcattatctgaccagcctcgggcagggtgctgggtat

SEQ ID NO: 6782818 - DNA, 72 bp, Homo sapiens
gcttgagcccaggagttcaaggctgcagtgaactgtgatcacattactgcactccagcctgggcaacacagc

SEQ ID NO: 6782819 - DNA, 73 bp, Homo sapiens
aaacagaatttggctaccttcttccataggagcatctgctctacgaatggtccccggtgtgcccattttgttt

SEQ ID NO: 6782820 - DNA, 79 bp, Homo sapiens
tcacgtctgttatgcccttggtgggcccaataggatgccagtggggttccggagtccaagccaatggtacacaaagtga

SEQ ID NO: 6782821 - DNA, 64 bp, Homo sapiens
gatgtctataataactcatcttttgggaagctaactagcttccaacaatgtgttattgttcatc

SEQ ID NO: 6782822 - DNA, 75 bp, Homo sapiens
cttggttaatttctttctctccacaaggcttgggaaattcaaggaccttgtcaagagaaaataatttgcaacaag

SEQ ID NO: 6782823 - DNA, 57 bp, Homo sapiens
ctgaattatttaaggtgaagggctatcctgtctgcaacttaccgtgaaatggttcag

SEQ ID NO: 6782824 - DNA, 62 bp, Homo sapiens
gaagcaagcaggagaggacaagcctggaagcacaggtgtttcttcatgtctctgcttgagtc

SEQ ID NO: 6782825 - DNA, 87 bp, Homo sapiens
cataaagccagttatgagccagaggcccaaggacagctgttgatcctgaaaatggttttaatttgtctctgtctcattagcttaatg

SEQ ID NO: 6782826 - DNA, 61 bp, Homo sapiens
ttccagttcactccatttctggaaacaactcacccatctccaggaaaaatggaaactggag

SEQ ID NO: 6782827 - DNA, 71 bp, Homo sapiens
agtgtcagatgaagagctgcacatatttatatctggctttccagaatgcagttcatttctctatgtgcact

SEQ ID NO: 6782828 - DNA, 63 bp, Homo sapiens
gagagctgggcatgtgaccaacagaactgcacatgtgttctgcgggctgtctgcctttttctc

SEQ ID NO: 6782829 - DNA, 60 bp, Homo sapiens
actgccaatggcattgcaaatttgtctacccgctttgggtggactgcgctgctatgcagt

SEQ ID NO: 6782830 - DNA, 69 bp, Homo sapiens
agagcagagcttctcagcttcagaactgttggccagataattctttgttgtaagaggctcttctgttct

SEQ ID NO: 6782831 - DNA, 56 bp, Homo sapiens
ctgtgggagaagttgctggagtccaaccccggaagtagcaagtgcctctcccacag

SEQ ID NO: 6782832 - DNA, 110 bp, Homo sapiens
ctggatctgaattgacatgcttttgacaggctgcatcccactttgtgtaaatatttatacattttaccacagcaagattagcttgttggattatggtgtttttcccccag

SEQ ID NO: 6782833 - DNA, 78 bp, Homo sapiens
tgtttttaggtattaacatgtgtattggtttcctattgttggcatagcaaactagcacatgttaggtagattaaaaca

SEQ ID NO: 6782834 - DNA, 78 bp, Homo sapiens
tggttggtagatgtcagagatgaaattcaaatacagatttgtatgaccacaatctgacgtctattacatgatagacta

SEQ ID NO: 6782835 - DNA, 60 bp, Homo sapiens
tcatgtgtgtcatgaatatctcagtatacatctctaactcagaaatacatgcatgcatga

SEQ ID NO: 6782836 - DNA, 84 bp, Homo sapiens
gggcatgcaattagtttccaaattttcattattaagaaaacagaattaacatctgtgtgaacatttctggttatttgctggccc

SEQ ID NO: 6782837 - DNA, 58 bp, Homo sapiens
gcacttcacatgccttttcctggacacaagcataagtcgggggtaggctagtgggggc

SEQ ID NO: 6782838 - DNA, 66 bp, Homo sapiens
ccttggcttccttccctctagacaagtgaagctttactctttgaggaggaaaagggggtaccaggg

SEQ ID NO: 6782839 - DNA, 67 bp, Homo sapiens
gggtggcagctcttcctcccaccggacaccgacccgcccgctgctgtgccctgggagtgctgccctc

SEQ ID NO: 6782840 - DNA, 81 bp, Homo sapiens
gccaggttctcccaggcaggtcagtgaagaaggaggagcaggtgctcactcggctcacgaactgcttggttggcctctggc

SEQ ID NO: 6782841 - DNA, 63 bp, Homo sapiens
ccaggctcgtcatacgcctgcttgctgatccacatctgctggaaggtggatggcgaggccggg

SEQ ID NO: 6782842 - DNA, 79 bp, Homo sapiens
tatcacattctgctagaatttcaagtgtgacaacagtgaactctgtggctccatgatagttcttacaggagagtggata

SEQ ID NO: 6782843 - DNA, 67 bp, Homo sapiens
gcccagcggggcccttagcagagcctctccaatcctcggcgcctcccctacacagggttcgctgggc

SEQ ID NO: 6782844 - DNA, 59 bp, Homo sapiens
gactctgagctcctaggtaaaactgcctgcaattgcagtcacatcttagcagccaggtc

SEQ ID NO: 6782845 - DNA, 85 bp, Homo sapiens
tatttcactctcagttttccacatgtgaggctacggttatcttaactgtacatcttaaatggaaaaattcttgagagaaaaaatg

SEQ ID NO: 6782846 - DNA, 91 bp, Homo sapiens
gagacacagtttcactctgtcgctcaggcttgagtgtagtggtgcgatctcggcccctccacttcctgggttcaagcgattctcgtgtctc

SEQ ID NO: 6782847 - DNA, 107 bp, Homo sapiens
tgccaaaaaaacattggattctagcatactgggtcttgagcaacagggataaagtggcttgaggcagggatcaggatggtgtggaggaaatagggaagacagtggca

SEQ ID NO: 6782848 - DNA, 129 bp, Homo sapiens
gcaaaacagtgatggtatagtacagaggttggtggggaagctatcagtgagcagtatgcattgacctgatggatgtccagctcatgatactatctttattcatcctgtgcactaattttctgagtcaac

SEQ ID NO: 6782849 - DNA, 71 bp, Homo sapiens
gtatctttctcattctctagaccctggttcccgagggcagtgaaggagtcagatatgggaaagtttcatac

SEQ ID NO: 6782850 - DNA, 97 bp, Homo sapiens
gccccctcttctccagggatgcgtgtgtgcaaaccattgcccctgagagtagatgcggctgtgtgtgtacatccttgcccctgagaagagaggtggc

SEQ ID NO: 6782851 - DNA, 61 bp, Homo sapiens
ccttgtaagtacattgaaacatcttgttattaagtacaaggatagttttatatttatgagg

SEQ ID NO: 6782852 - DNA, 65 bp, Homo sapiens
caatctgcctgtgatttttctctagtagtctaaacacgagcatggagaaggccacaggtggtttg

SEQ ID NO: 6782853 - DNA, 57 bp, Homo sapiens
gtggttgtgggactgaagttaccattttcttgctggctctcagctcccagcagccac

SEQ ID NO: 6782854 - DNA, 57 bp, Homo sapiens
tagaaatggagagagctggactttgacccaatcagtctggctctgaattcacttctg

SEQ ID NO: 6782855 - DNA, 75 bp, Homo sapiens
tccctgcagatgccttttatttattgtcaatgtaaacagatgttaatgacattgtaagagcttttgagagaggga

SEQ ID NO: 6782856 - DNA, 60 bp, Homo sapiens
gtcctggcccactggcaggctggacaggcggccagcaggagagccagtgggtccaggtgc

SEQ ID NO: 6782857 - DNA, 89 bp, Homo sapiens
gattttggtgaatgaatgcaggttggatcctatgcccagcctttggtgaagggtttgtgggactttaacctgcagctctcacagatttc

SEQ ID NO: 6782858 - DNA, 70 bp, Homo sapiens
ttagtttcctccctggaaattctcttcccgccccctgggaaagctgtgggaagctccatggaggtgctgg

SEQ ID NO: 6782859 - DNA, 83 bp, Homo sapiens
ccatggtaactggaaagtgcactgagctaggagtggagggagggcggtccctcctcggccattgctcgtgcctgttaacatgg

SEQ ID NO: 6782860 - DNA, 79 bp, Homo sapiens
ccatccctctgctgtgtccctggtctcctggctctccactatcttactgtcagccccagcggtcaggcagctgggatgg

SEQ ID NO: 6782861 - DNA, 57 bp, Homo sapiens
attgtttatatgacctgcctcacaaaattattgtgaggggaaggcatgataaataat

SEQ ID NO: 6782862 - DNA, 92 bp, Homo sapiens
ggggggaaaacacgtttgtgtaatttttcaggctgtgagaaagcaattattttctttggtcagaaagattacactcgatagtttttcactcc

SEQ ID NO: 6782863 - DNA, 129 bp, Homo sapiens
gcaggaggcaggagaccatgaggtcagcaggagaatgggagccagcctttccttgggggccaggagcgaggaacctgggcttccatcctagtctgcttgtcctccctgggcctcagtctacccacctgt

SEQ ID NO: 6782864 - DNA, 80 bp, Homo sapiens
ctgattgtcagggctggagcttccaggcacaagctccactcctcacctggccctgggagctcacaggcctggctccacag

SEQ ID NO: 6782865 - DNA, 83 bp, Homo sapiens
gtgaaggtgttttaactgatagcattatttacaattagtacagccattgtatgagtacaaatgtttcagctgaaggccttcac

SEQ ID NO: 6782866 - DNA, 85 bp, Homo sapiens
tattaacttttgatcagtgtggtatgtcttctttctaaagttatttacattctttgcagaaatcaagatgaatcaaaggttaata

SEQ ID NO: 6782867 - DNA, 78 bp, Homo sapiens
gcctcccttttatttcctactttctttcccaagaggtgggagctgagtccacgggattgagggtgggggttagggggc

SEQ ID NO: 6782868 - DNA, 63 bp, Homo sapiens
gctgcaggactgaaagatgaggtcaatctgctcaaggacggggctctgctcacagcccgcagc

SEQ ID NO: 6782869 - DNA, 65 bp, Homo sapiens
aagtccagctgtagctcaacagggatatagttttaatgaaacccagatgagctgcaactgtattt

SEQ ID NO: 6782870 - DNA, 101 bp, Homo sapiens
cctgttttttatcttttttgcattcatcatttgaaagcccaaagcaaatcttagtcttgggttataaaagtaaaaaatggatcaggagagataatatcagg

SEQ ID NO: 6782871 - DNA, 71 bp, Homo sapiens
cagagggaaaattacccagagtgcaccacccaacaataccagtgttaacatttcaacgaattttccttctg

SEQ ID NO: 6782872 - DNA, 89 bp, Homo sapiens
cctccagctcctgatggtgagtggtctgtgggatccagagccagctgaactcaagtctcaatagcaactctatcctcagggatgggagg

SEQ ID NO: 6782873 - DNA, 87 bp, Homo sapiens
tagaattgcactgtattatgtatttggtatagtttggctaaatttacctgctagaatacttgaatactgtaattacaaacatctctg

SEQ ID NO: 6782874 - DNA, 119 bp, Homo sapiens
aagagaatgtccactatgtgttgccttctcttcccccatattacatttcattcaatataccgcagagggatgcttgctaatagtgggaaccaggctgacctatatgggctgcatttctt

SEQ ID NO: 6782875 - DNA, 71 bp, Homo sapiens
gcgtttctggcgccggggcaggccggcgatgtccgagtcgtcgaagggcatgcacccggtgaccatgacgt

SEQ ID NO: 6782876 - DNA, 64 bp, Homo sapiens
ggagccctgaagcaagaaagtagcttgaccatccaaaactgtcttctttgtcttccacgggtcc

SEQ ID NO: 6782877 - DNA, 55 bp, Homo sapiens
agcagccagaaatccagaggtgaatgacataatgggatagaatttcatggctgct

SEQ ID NO: 6782878 - DNA, 71 bp, Homo sapiens
gggctggccagggctgctcgcggaaagggcaagcgtggccccgcagtgatccacgaggctctggttagccc

SEQ ID NO: 6782879 - DNA, 72 bp, Homo sapiens
ttagaagtgaaatgctgcagaggagagatttactctctttgccatattaagtataatttcactattctctaa

SEQ ID NO: 6782880 - DNA, 72 bp, Homo sapiens
tagacaaccagaaaggatgcctccttccggcttctaaggccaggactagaggccttctttccctacagtctg

SEQ ID NO: 6782881 - DNA, 72 bp, Homo sapiens
cttatgatctagaactaggtattttgcaatatgataaccttttgcaatatgatgctgattccagactatgag

SEQ ID NO: 6782882 - DNA, 86 bp, Homo sapiens
tgttttgtaattcattttggcttgagtcgagattggccgtgggaacctggctttatgtactcaagtcactatgaggaatgaagtca

SEQ ID NO: 6782883 - DNA, 76 bp, Homo sapiens
aaccatgcctgaaaatcaaggtagtttggtggtctaaggatagccaggaaattaatgatatttcaggttcagagtt

SEQ ID NO: 6782884 - DNA, 55 bp, Homo sapiens
cttcaacaaccatgtgctgtctgtgcggatcaaggggggcatgtgagtgctgagg

SEQ ID NO: 6782885 - DNA, 88 bp, Homo sapiens
agaatggtatagtataatattctttgaacagttttcctgtgcatagtaaaatacctatggaagaattgtcggggatgtgctccattct

SEQ ID NO: 6782886 - DNA, 55 bp, Homo sapiens
atggaggatgtgcagcatgggcaggaaaagagccttcagtggtgtacatttccat

SEQ ID NO: 6782887 - DNA, 78 bp, Homo sapiens
ctgagacctcctggatggagctgccctcgccaccgggcccttggccctgcacggagctctgtccaataaagttctcgg

SEQ ID NO: 6782888 - DNA, 96 bp, Homo sapiens
tacttaccctctcttgcttcagattcctcttctgtaaaatggagctggtgctggggttgtggggaggatttgatgagacagtgagagggtgcagta

SEQ ID NO: 6782889 - DNA, 87 bp, Homo sapiens
gactgatgggtggcaccaggcggggtggctgtccaaagccatcacatggacagtctttgcaaagtcctggtgcagatcctaaacgtc

SEQ ID NO: 6782890 - DNA, 58 bp, Homo sapiens
gaggcactgagagtgggggatgagaaacgaactccgtcccctgcacagtcagtgcctt

SEQ ID NO: 6782891 - DNA, 59 bp, Homo sapiens
gctttcaaccctgtacctgtttactgcgttgatctcaccaccaggtgcagaggcagagc

SEQ ID NO: 6782892 - DNA, 58 bp, Homo sapiens
gcaagatggttataaaaaatgttgaaaaagagacattcttccttttgtagcatcttgc

SEQ ID NO: 6782893 - DNA, 61 bp, Homo sapiens
catcctgcacattaaacttcacgctaaaattggctttggaggacctatgtgcaatagggtg

SEQ ID NO: 6782894 - DNA, 57 bp, Homo sapiens
aagtgagtgacagagccaggggcactgattatagcccatgctccttaccactcactt

SEQ ID NO: 6782895 - DNA, 73 bp, Homo sapiens
ggttttgggaaaaataatgcacagatattgtgtgtaaaatgctaatattttgtatctattgtttccataaacc

SEQ ID NO: 6782896 - DNA, 57 bp, Homo sapiens
aactgcagagaacatctgggttagctcaccgtttctagacccagaaatttgtcagtt

SEQ ID NO: 6782897 - DNA, 80 bp, Homo sapiens
ttgggcccataatttagatgatgtgactctcttgcatgggccctccccataaaggtagtgtgacatattgttgagcccag

SEQ ID NO: 6782898 - DNA, 60 bp, Homo sapiens
gtcctgtgccgaggtgggaagccagtgcccctctctaaagtcttcagcctggagcaggac

SEQ ID NO: 6782899 - DNA, 57 bp, Homo sapiens
taagagcagaacagcaacatatagggagaggtgcatatgtgtttgttttgcatctta

SEQ ID NO: 6782900 - DNA, 57 bp, Homo sapiens
gggcgagcagaagccacccctgctgggtagacagcagtcagggttgtaggctcaccc

SEQ ID NO: 6782901 - DNA, 63 bp, Homo sapiens
tgttttggggtattttcatcattttaatctggatgatgttattttcagaaacatcctaaaaca

SEQ ID NO: 6782902 - DNA, 71 bp, Homo sapiens
tgagtaggagaagcaaaagaatggccaagtttcatgatttctgttctgatacttgtttctatgtttgctca

SEQ ID NO: 6782903 - DNA, 71 bp, Homo sapiens
gatcatgttgactattcacaattacaatagttctatcaaaaaattattttaattgcatggtctgaaggatc

SEQ ID NO: 6782904 - DNA, 64 bp, Homo sapiens
aacactccaagcttgctttagccacagggcctttgcacttgtggttcctgctgtttggaatgtt

SEQ ID NO: 6782905 - DNA, 68 bp, Homo sapiens
tctgtaggaagatataaaatatctggaggcgcttttgcatctgtatgtatcccctatcattttacaga

SEQ ID NO: 6782906 - DNA, 97 bp, Homo sapiens
aagagggatgccatcatgattatttgattctgcagagttcaatgtcaacttggcctctgtttttcaatagttcttgaaatgtctgtgtattcctctt

SEQ ID NO: 6782907 - DNA, 62 bp, Homo sapiens
tctaccagaatgtgataatggcttccatgagggcggaagccatgtgtctttattctgttaga

SEQ ID NO: 6782908 - DNA, 70 bp, Homo sapiens
ttcttactggcatggacttcctcatggactgctacttcatggatgatagcttcattgctttgggtaggga

SEQ ID NO: 6782909 - DNA, 64 bp, Homo sapiens
caccatgggcaagtgcctgggctctggtggcagaagaatccatggctcaggtttgggctttgtg

SEQ ID NO: 6782910 - DNA, 83 bp, Homo sapiens
ggatgttaggccagccttgatggatgaggaagtttcatttaggggctcctgtcacttcccatcttcaggccaagctgacatcc

SEQ ID NO: 6782911 - DNA, 59 bp, Homo sapiens
atgagctagttgtgcttggaacagggtctttccatctatgtagtgccagctagtatcat

SEQ ID NO: 6782912 - DNA, 61 bp, Homo sapiens
aggctctccagagagctgcttttctgcacatattttataagaatcagctctctaagagtct

SEQ ID NO: 6782913 - DNA, 56 bp, Homo sapiens
cagggaattcagcttctggtatggacaagcaagcttctaccatgttgactttcctg

SEQ ID NO: 6782914 - DNA, 130 bp, Homo sapiens
catgttccattaaaaacagctcgttagtccctttacaactggtaatctccacggtcaaatcagcatgaagtattcgttgtgtgactgagatttcagaaagggagctttgagtctggtactgatggaactg

SEQ ID NO: 6782915 - DNA, 64 bp, Homo sapiens
ccttctcttctgttctgtgactccctggaaggcccacagttcacagcaaagtggggaccaaagg

SEQ ID NO: 6782916 - DNA, 59 bp, Homo sapiens
ttggggtctgggtcaaggggtgtgaggccactaacccacactttatgtctagatctggg

SEQ ID NO: 6782917 - DNA, 78 bp, Homo sapiens
tctcagatggccagagaggccagcctggtaaagtaattgagtgaagcatgccaagttggagctatggccagcttgaga

SEQ ID NO: 6782918 - DNA, 70 bp, Homo sapiens
gcggccaactcatggatgggaagtgcgacagggttagctaggtttcacagactttccatagattggctgt

SEQ ID NO: 6782919 - DNA, 86 bp, Homo sapiens
gagaggctgggagattgattcaattaagattagcagagtcggaaaaatggcatgggttagttttgattagtattgtcttctctctc

SEQ ID NO: 6782920 - DNA, 67 bp, Homo sapiens
tggggcaccttgtatctctaagaaggctatttttgaaacaaacctcagtaggacacaatgtgcccca

SEQ ID NO: 6782921 - DNA, 58 bp, Homo sapiens
tatgtctcatggaagggcattatctgctctgggatgtcctgcagaaacatgagaaatg

SEQ ID NO: 6782922 - DNA, 62 bp, Homo sapiens
agactctggctttggtcccctgtgcctgcaatgcaggcaacaaacaaccaagctcagcctct

SEQ ID NO: 6782923 - DNA, 80 bp, Homo sapiens
ttaggttggtgcaaatgtaattgcagttttcgacattacttttaatggcaaaaaccacagtaacttttgcaccaacctaa

SEQ ID NO: 6782924 - DNA, 65 bp, Homo sapiens
tagcttagggacaaagagctgaggcctttactatagcagagctcctgctctttgtccctaagcta

SEQ ID NO: 6782925 - DNA, 60 bp, Homo sapiens
actgccatctggtctctatgggtggaactaaggtcacatgccaagagggcagagggcagt

SEQ ID NO: 6782926 - DNA, 86 bp, Homo sapiens
gcccagggttggagttgagcacggaggcctagggtgccaccaggtgtgtcctggcaggtggtcctgccccgtgcacagagctgggt

SEQ ID NO: 6782927 - DNA, 67 bp, Homo sapiens
gagtgctgtgctcagtggagttaggtatatgctcacattgtacacataccactgagtgaaggaactc

SEQ ID NO: 6782928 - DNA, 82 bp, Homo sapiens
gtgggggtgaaaagcatttatagataagaatttgaaattcaaatgaaggaacaagtagtctgtctaaaatgctggcctccgc

SEQ ID NO: 6782929 - DNA, 78 bp, Homo sapiens
tgcaatggagatccagaacacagtggaagaatatattgaaatatgtgtatctaaggtgttctataaattctcatttca

SEQ ID NO: 6782930 - DNA, 55 bp, Homo sapiens
tgctggctcctgggtgggcaggtccatgaccttcacagcatccgtgagctcggca

SEQ ID NO: 6782931 - DNA, 60 bp, Homo sapiens
gcagagtggggtggggtgttggctttggtgctccctggagttgacacatcttggctttgc

SEQ ID NO: 6782932 - DNA, 106 bp, Homo sapiens
tgggaggtggaatccactggagaagccgctgctacccagaaccttcccatacgtgcctgggctccaaactgggagctggcggattccccaggcctggaaaccccca

SEQ ID NO: 6782933 - DNA, 104 bp, Homo sapiens
gggtctattactgtgccacctggggcaggcacagtgattcagatctgccctacaccacactgaacatctgccttgtggctgcctctggtacacaagatagagcc

SEQ ID NO: 6782934 - DNA, 89 bp, Homo sapiens
gtgcctctgcgatggtcctgccaaggtcctttacctgacggcctggtgaaggtgaaggtcagagcaggaaaaacgcaagagtggtgcgc

SEQ ID NO: 6782935 - DNA, 60 bp, Homo sapiens
ctagttcactcagtctcccaggggttaaagggtccgttgagacttctagaagtgagatag

SEQ ID NO: 6782936 - DNA, 76 bp, Homo sapiens
tctccaattatactcttactgcagggcctataaatgttagatacaggcctggaaaggaaggagtggaatgaggagg

SEQ ID NO: 6782937 - DNA, 80 bp, Homo sapiens
tgttgtataccagagttacagttactgtgggaatcataatttgaaattttgactcctgtgtttctggaatctttacaaca

SEQ ID NO: 6782938 - DNA, 65 bp, Homo sapiens
tagggtctccctttaatctaactaaggctctctaagcccctgttggtccctgaagagagaccttg

SEQ ID NO: 6782939 - DNA, 59 bp, Homo sapiens
gcagagcctgggggtctgcggatcatggtaggagcccctcaggtcccctaagactctgc

SEQ ID NO: 6782940 - DNA, 57 bp, Homo sapiens
tgtttatcagggtaaagtgtagcaatttagccttgtcccatcttgccctcataaata

SEQ ID NO: 6782941 - DNA, 70 bp, Homo sapiens
ccatgtgctctgtttgattgcttgttgataatgaatggtgacaagtgccatcatagcatggctgctttgg

SEQ ID NO: 6782942 - DNA, 63 bp, Homo sapiens
acagatgctgaaggttatagcatgaaggcagacatttctgccttcaccaggccttcagcctgt

SEQ ID NO: 6782943 - DNA, 98 bp, Homo sapiens
gagacggagtcttgctgtgtcaccaggctggagtgcaatggcgtgatctcagctcaatgcaacctccgcctcctggattcaagcgattctcctgcctc

SEQ ID NO: 6782944 - DNA, 57 bp, Homo sapiens
cctttcctgtgtccttttaaggttgacacagtgctttaagagcctaacacagaaagg

SEQ ID NO: 6782945 - DNA, 55 bp, Homo sapiens
tagtgccaaagcctggtgtcatggctaaaccctgcacaccaaagcattgtcactg

SEQ ID NO: 6782946 - DNA, 80 bp, Homo sapiens
agtgcatttctcttgtggctaagtagcctttggatttatcttttcaaaggtttcacagtagcccatcaagtggatatact

SEQ ID NO: 6782947 - DNA, 105 bp, Homo sapiens
gtttattgctgtgatcgcttttttgaagaaattactgctcttgaagaaacaaacacgcactggtttatttaagaacaagcagcgcagagttacagaattattgac

SEQ ID NO: 6782948 - DNA, 62 bp, Homo sapiens
tggctaccatgttaaaaggcttttttttaaaggcatcaagtctaatatttaatatggagtta

SEQ ID NO: 6782949 - DNA, 86 bp, Homo sapiens
ttttggtaccactcaaatgtcctctgactcagccttgggaaaggttgtgacaagttccttgagtgaggggcattagaaaaccgaaa

SEQ ID NO: 6782950 - DNA, 63 bp, Homo sapiens
cataaggtgtctctctgcttcttggagctggacggtttccaagggctgagatacatctagatg

SEQ ID NO: 6782951 - DNA, 91 bp, Homo sapiens
tgcaaagcttaaaagtatttctagttggttctactattgaaaatttctcttctcataggagtgggcatagcagggaatacaagctattgca

SEQ ID NO: 6782952 - DNA, 96 bp, Homo sapiens
ttcaccttaggtcgataatttatttccatttgtatgcgtttgttgatttatacaaaataagtttgcagattatattagtgtcattttaaggatgaa

SEQ ID NO: 6782953 - DNA, 81 bp, Homo sapiens
tcttagtgggggcctgacgcagaagacctctagttctcccacagtgtcttctggggccaggcccgctgtttctcactgagg

SEQ ID NO: 6782954 - DNA, 59 bp, Homo sapiens
agagtaagtggtagagtcagggttagaaactaggcagtctggctcaaaatacgtactct

SEQ ID NO: 6782955 - DNA, 95 bp, Homo sapiens
atgttgtgtccttccttctgtaggcttagctagaagtgatgccttagtaattttcaactagttcaggctttagattggaaggattaaaatggcat

SEQ ID NO: 6782956 - DNA, 76 bp, Homo sapiens
agttccatatggtgtactactgggtttcgaggcagttttatcatagttttccttctccagttatattatgttaact

SEQ ID NO: 6782957 - DNA, 97 bp, Homo sapiens
ggtaattaataaaagcatggatagtacaccttggaattgtcccatcatcaacgaacttcaaggcaagtactttaatttatttctgttacattttacc

SEQ ID NO: 6782958 - DNA, 88 bp, Homo sapiens
tgctgagcttttaccagtatgatgagttaatggtttatttttaggcagccagtggatttccttgcatattggtaattagacaaaagca

SEQ ID NO: 6782959 - DNA, 86 bp, Homo sapiens
acattgctattttagacaccattccagtactgtaactgacgagttagagtacagtactctaatgaaaagtgctttgatattagtgt

SEQ ID NO: 6782960 - DNA, 56 bp, Homo sapiens
ctgtgaggcctttggccagatatcctggcaagtctgggcaatggatgcactcacag

SEQ ID NO: 6782961 - DNA, 72 bp, Homo sapiens
gacacacaaagctcttcattttcaattttgtaaagtaagaattacacagaggaaagtgtgaagggaagtgtc

SEQ ID NO: 6782962 - DNA, 55 bp, Homo sapiens
ttgcttgatgcttatatacttgcagtgcatctgcagagtctattgtatcagtcaa

SEQ ID NO: 6782963 - DNA, 57 bp, Homo sapiens
tagtatgtcttactctaatacacacattcatatatctgtgtgtatgtggatacacta

SEQ ID NO: 6782964 - DNA, 62 bp, Homo sapiens
gcccaggctctgtgatccacaatgagtaaagtgacccatgagtgctgctcagaggcctgggc

SEQ ID NO: 6782965 - DNA, 101 bp, Homo sapiens
ttgcaaggcccagcccaggcacaggcctcagcacccaggcaggctcagagcacttgaggttggaggccttgcctggctagatgctcagctgtggcctgtga

SEQ ID NO: 6782966 - DNA, 59 bp, Homo sapiens
ccccaagcatgcaatctatccttaggaagacttcctggaaattatgctcacctttgggg

SEQ ID NO: 6782967 - DNA, 79 bp, Homo sapiens
gcattgtttcaatatttgcatcattagctattcagtaatttatatctgggtgcagttgctcaaatattcaaagcaatgc

SEQ ID NO: 6782968 - DNA, 58 bp, Homo sapiens
tctgaaattccttccagactttcagttcagatgacctttgggactttggagattcaga

SEQ ID NO: 6782969 - DNA, 75 bp, Homo sapiens
tgggagatagagagaaatggaggaggatgggatttgctgcagccaatctcttgtatttcctttgacattctccca

SEQ ID NO: 6782970 - DNA, 104 bp, Homo sapiens
tttttacaacctcgacagcactgactgaatcaatagttgcaagtattagcctgaataatgaaggaagtagtgtacatctgttgatttctctgcatttgtgaaaa

SEQ ID NO: 6782971 - DNA, 83 bp, Homo sapiens
gcatagacgttccagagtgctgacgcagacccctaagttccaagggctttgcaaaatcggcttctgttgtgaatgtcatttgt

SEQ ID NO: 6782972 - DNA, 80 bp, Homo sapiens
ctgcccctggggagcggcggcggtgccactcagcgctgcgcagccagcctgagctgcctgccgcctcgcctcgtactcag

SEQ ID NO: 6782973 - DNA, 62 bp, Homo sapiens
atgtgcggtacacttatttgggaaaaaaatacaacaaaccatctgaatagtgtattatacat

SEQ ID NO: 6782974 - DNA, 83 bp, Homo sapiens
gcctggaccggctgctgctgtcagcaggccttgtttctcaccagcagcaggggcaagtgacagttgctttttctgcttcgggt

SEQ ID NO: 6782975 - DNA, 88 bp, Homo sapiens
gcctggtgtagtatttgctcctggagttttttggttgactctgggggcaccgagtgtcactctgactccagtaagtaatgccaatggc

SEQ ID NO: 6782976 - DNA, 127 bp, Homo sapiens
agctggtgctgcacacagtgaaatgagtaattagccaggatgattttgattaaaatggaacataccaattaataaatgaaagtgctggcatacttgctaatttaacaacttgttcatggtgccagct

SEQ ID NO: 6782977 - DNA, 59 bp, Homo sapiens
ggggaggagaatggcgatataagagaagcatgagctagtttctagtcaatcttctttcc

SEQ ID NO: 6782978 - DNA, 84 bp, Homo sapiens
ctggaagagggtcaattctgaggtccgtttggcactatctcttggagttctccaaggaaacgggaccttaattgcccacaacag

SEQ ID NO: 6782979 - DNA, 71 bp, Homo sapiens
aggaaatttacacagctgggaaaatttgtacaaataatcatttgtacttatgagatcctagtcgtgttcct

SEQ ID NO: 6782980 - DNA, 65 bp, Homo sapiens
gctgtgtcctatgaaagagggttaggtatcctggcagatacttaactctcaaacattggtacagt

SEQ ID NO: 6782981 - DNA, 64 bp, Homo sapiens
ctcattcctgccaaagcatgtactgggcacctactgtgtaccagcctctgttgggggtggtgag

SEQ ID NO: 6782982 - DNA, 63 bp, Homo sapiens
ggagttgtcttcacgcaactttccggctcctaggcccgcgggggaagcagtggcggcaactcc

SEQ ID NO: 6782983 - DNA, 125 bp, Homo sapiens
ctagtattataggtctccactaaatggattatatgtttcttagctgacacctgttcagagcacttaggtattaggtgactcagagattgaaaacatatccatatctattgattgagcctatatag

SEQ ID NO: 6782984 - DNA, 75 bp, Homo sapiens
gtcctagtgttaggaagtggtaaggttctggagtgttcccattgcaatccctactcctttcttgtctcattggac

SEQ ID NO: 6782985 - DNA, 73 bp, Homo sapiens
tgctaatttgcatggccgacttgctctaatttttagaagggatgggaacttggtagggcatgatgaaagagca

SEQ ID NO: 6782986 - DNA, 66 bp, Homo sapiens
gataactttgaatcttctaactgtatatatcattatgtacaaagttttcttggattgagagtattc

SEQ ID NO: 6782987 - DNA, 56 bp, Homo sapiens
tttagaataggatccaaactctgcaggttggccttcaagtcctgacctagtctaaa

SEQ ID NO: 6782988 - DNA, 104 bp, Homo sapiens
aggaaccaggaagctctctgagctgaacaatggtctctgtttggggctggcaagggttcatcttttctgattctgcagagaccctgtgagttttctttgttctt

SEQ ID NO: 6782989 - DNA, 57 bp, Homo sapiens
gccacagttatgggaaacgtagtttcaagagctgctataatctgccataactgaggc

SEQ ID NO: 6782990 - DNA, 57 bp, Homo sapiens
cccgtgtggacagcgtgccagtttgacggctcagaatcggaagggcacccacatggg

SEQ ID NO: 6782991 - DNA, 74 bp, Homo sapiens
taagaaaaagctgtagctgtgctgatttctagtcttcctttgagtctggtcctcttcacagtggcattttttta

SEQ ID NO: 6782992 - DNA, 68 bp, Homo sapiens
ctgagagaaacatgactcaggaggatttgttcaaacccctagttcctcatgaacatgcttatcctcag

SEQ ID NO: 6782993 - DNA, 58 bp, Homo sapiens
aaatcagaatttattgaatcttttatgacacagtgaaagaattaaaggactctggttt

SEQ ID NO: 6782994 - DNA, 109 bp, Homo sapiens
tgataaacagttttaacctcgatgctcattttggcattgttttgttctaaacacatgtgttacaaagatagtgttagagtaaattagttgagggaaaagcttcctatca

SEQ ID NO: 6782995 - DNA, 73 bp, Homo sapiens
gctaattagtaacctaattccatctgtaatgtctgatcacatcagcacctggattagtgtttgactgaatagc

SEQ ID NO: 6782996 - DNA, 80 bp, Homo sapiens
gtggcaaccactcaactctgccttttgcagtgtaaaagcacccctgagcaatgcataacagagtgggcctggttgcacgc

SEQ ID NO: 6782997 - DNA, 83 bp, Homo sapiens
gaggtctcacttctttgaaaggaagccacacagctgttttttcctgacagctgtgaggctactttccaagggagggagtcttt

SEQ ID NO: 6782998 - DNA, 65 bp, Homo sapiens
tctaacactgttattaaactgctctcttttgttagaaaaggtgctgtttgtcagcagtttgtaga

SEQ ID NO: 6782999 - DNA, 81 bp, Homo sapiens
ttggttcattattttttagtcttttgaattgtttagtcatcctcagctgactagatggctttctgaggtatttagaaccag

SEQ ID NO: 6783000 - DNA, 72 bp, Homo sapiens
gtcacaactattcagctctggagttgtatagcgtcaggggccatatacaatgagtgagtgaatgggtgtggc

SEQ ID NO: 6783001 - DNA, 117 bp, Homo sapiens
gaacttgagagaattggtctttctacatcttatgaagagcaacttgaataagtttattatagagcagttttatttcatgagactgttgatatgtggccctaagtgtctattatgttt

SEQ ID NO: 6783002 - DNA, 69 bp, Homo sapiens
tcagtgttggagataattgcacagagacctgtttcccttttcttcttatccatttatctgcaacactga

SEQ ID NO: 6783003 - DNA, 58 bp, Homo sapiens
gtttccagagggaatatttgctctgagatgtgagagcttcctgtttcttactggaagc

SEQ ID NO: 6783004 - DNA, 64 bp, Homo sapiens
cacaggcttggggctcagacagatctgggtttatatctcacttctgctgctgaccaacactgtg

SEQ ID NO: 6783005 - DNA, 88 bp, Homo sapiens
cctggaactgagctggggtcagctcccctgtcaaagggtcgaagctgtaaaatgtagggcgagtatttaatgacctgagctcagcagg

SEQ ID NO: 6783006 - DNA, 69 bp, Homo sapiens
actgtcatcagaagatgaaaatttcatgggttcttaacctgggatacatgcatctttggatagaatagt

SEQ ID NO: 6783007 - DNA, 85 bp, Homo sapiens
gcctgattggaatgcacactgagcctgcctagggaaattaggcttaattctggctcagtttcctgtattctcctgtaatactggc

SEQ ID NO: 6783008 - DNA, 60 bp, Homo sapiens
cgttaaacatgcatgaagaagttatattttgtgtaaatgtacttcccagtgtgattagcg

SEQ ID NO: 6783009 - DNA, 83 bp, Homo sapiens
tggatttaagtataatttacatttggtattcaaaatcttttagcatttattaatagcaatgatgtaggttaaactgagattca

SEQ ID NO: 6783010 - DNA, 79 bp, Homo sapiens
ttgctcttgttgcccagaggctggagtgcaatggcgtgatctcggctcactgcaacctccacctcctgggttcaagcga

SEQ ID NO: 6783011 - DNA, 57 bp, Homo sapiens
ggaccatgtgtggagagtcagttacttccctctgtggggctgacccttttacattcc

SEQ ID NO: 6783012 - DNA, 88 bp, Homo sapiens
ggagtcttgctctgttgcccaggctggagtgcagtggcgcaatcttggctcactgcaagctccgcctcccgggcccaagtgtttctcc

SEQ ID NO: 6783013 - DNA, 58 bp, Homo sapiens
ggagtctcaggctggaatgcagtggggcgatctcggctcactgcaaactccgccttcc

SEQ ID NO: 6783014 - DNA, 101 bp, Homo sapiens
tcattgtaaaattatttcagcttttctgtatgtttgaaattttcattaaaaaatgatgaaaaaagacgagcatataaagggagagaagtaaactactttga

SEQ ID NO: 6783015 - DNA, 84 bp, Homo sapiens
gcactctagtgggtaccaatgtgaaaaggtgctgtgcccaggaatcaagcaggactgtgtctcacagtggtaccagtgtagtgc

SEQ ID NO: 6783016 - DNA, 61 bp, Homo sapiens
ttgggaagttatcagaatgctgctttccctggcatcgtcttggagggcttgatggacccga

SEQ ID NO: 6783017 - DNA, 107 bp, Homo sapiens
ctgggggctcaggatccagcaaggggcggcaggagtaaaggaggaaggaatgacaggtgcaaataccttcccaccaaagcccttgttgccctctgtctcctccccag

SEQ ID NO: 6783018 - DNA, 126 bp, Homo sapiens
ggctcagacttgcacttttctctccctagtgcctctttctccagcttttctgccttccaaaaggtatcaagaatgtgggggaaaagagtgtgggcagtggggaagcagagtcaaggctccagagcc

SEQ ID NO: 6783019 - DNA, 86 bp, Homo sapiens
tgtcttgcactgccagctgggtccctgctggggctctgggacttccacttctcagtccacataggaacccagcttccactgagtca

SEQ ID NO: 6783020 - DNA, 87 bp, Homo sapiens
caaccctcgctctagagtgcagcgctttgcagtctgctctttttctctgcagaccgtgcattattctagggtgttaatttctcgttg

SEQ ID NO: 6783021 - DNA, 71 bp, Homo sapiens
gttcttctttaatcataaccaagatggtaacctatattcccttagctcgtattggttttgattaataaggc

SEQ ID NO: 6783022 - DNA, 105 bp, Homo sapiens
tttagaaagaagaggcacatcttgataacatgctgagaactgaggcaactgatgtctttaggctcttatagtcccagcatgtttttaagagctactgaatttgaa

SEQ ID NO: 6783023 - DNA, 79 bp, Homo sapiens
gaagaacacaattttttatctatgttttcgcgaaggggaccagagcgttccttcctttgtggggcggtgggtaatcttc

SEQ ID NO: 6783024 - DNA, 56 bp, Homo sapiens
tgcaccttcgatttggaagcctgtgtcattgaggtaaatttctgaaagaaggtaca

SEQ ID NO: 6783025 - DNA, 57 bp, Homo sapiens
attccactgttataaaatgtccagaacaagccaatttctggagataaatagtggaat

SEQ ID NO: 6783026 - DNA, 69 bp, Homo sapiens
agcttggctacaaatgggttaaaatatagtgtgaaatattatactttctcctatttgattttgtctgct

SEQ ID NO: 6783027 - DNA, 129 bp, Homo sapiens
cctgcctgccctgtttttctgacatgtcaccccctccacttggccttaaccaggttgtacctgcccccaggaacagcttgtagaggccctggcagagctggggggaaacagtcccctcaggcaagcagg

SEQ ID NO: 6783028 - DNA, 100 bp, Homo sapiens
gcatgcatgtgtgtgcgtgtgtgtgcatgcacgtatctgcgtgtgtgcgtgtctgcatgcacgtgtgtgcgtgcgtgtgcgtgcacgtttgtgtgcgtgt

SEQ ID NO: 6783029 - DNA, 66 bp, Homo sapiens
gagcttgagtgcccaagcaagaggaaattaccaataattttaatagtatgtggcatctctgagctc

SEQ ID NO: 6783030 - DNA, 82 bp, Homo sapiens
ggtaggtgtggttgcaggagctggaaagtgatgttgattcaggggtgaagaaaccatcatacccactgttgtacacgccact

SEQ ID NO: 6783031 - DNA, 58 bp, Homo sapiens
gacctgcaggtgggagcctgcctctcatcgacagtggccagcaggcttttcctgggtc

SEQ ID NO: 6783032 - DNA, 58 bp, Homo sapiens
ggctgtagggtgggctttatcctcgggacgtcctcctccccaagtccagcctgcagct

SEQ ID NO: 6783033 - DNA, 58 bp, Homo sapiens
acctgtctgggctacatttgcataagctcacaaaatgcaggggaggcttaaagcaggt

SEQ ID NO: 6783034 - DNA, 69 bp, Homo sapiens
gcccagagcatcttgaaggcaggctttattacttatttggctctgctggtaagatgcctctggtaaggc

SEQ ID NO: 6783035 - DNA, 77 bp, Homo sapiens
gagtctcagagtcgaggactggtggaagggcctttcccctcagaccaaggccctggccccagcttcttctcagagtc

SEQ ID NO: 6783036 - DNA, 82 bp, Homo sapiens
agtacatcctaggagtttgaaaacttaactaaggtttaaaatttaccttgtttaaagaacttctgacttttgaggaaaatct

SEQ ID NO: 6783037 - DNA, 93 bp, Homo sapiens
tgtgcattcacctacttggacattgggattaaatacatggaattccaggatccatgactaggaaaccagtttccaagttctggagagtgtgta

SEQ ID NO: 6783038 - DNA, 67 bp, Homo sapiens
ctacaagccaatgagagaggcctcagaagaaatcaattctgctgacaccttgatcttggaattgtag

SEQ ID NO: 6783039 - DNA, 55 bp, Homo sapiens
cacactgtgttttgatgaagccataccactaggcttctcccaagtatgcagtttg

SEQ ID NO: 6783040 - DNA, 60 bp, Homo sapiens
atgcctgaggcccatccccccaaaatctattttaattgatttggagtagggcctgggtat

SEQ ID NO: 6783041 - DNA, 69 bp, Homo sapiens
gcaattaaccagaccttgattcaatcgtggctctactattgactgtctgcaaggcctggatctagttgc

SEQ ID NO: 6783042 - DNA, 88 bp, Homo sapiens
cttcgttatcgtgatacctgccagggtgtgaggcccggtgtgacaggtgtcagtttcacagtctgtgcagatcctcacatgtactgag

SEQ ID NO: 6783043 - DNA, 72 bp, Homo sapiens
gccttctgtttccaaggttagtttttagggtgaagattttcatcttgattacagctcttggtaaatgaaggt

SEQ ID NO: 6783044 - DNA, 102 bp, Homo sapiens
aagaaatggcggtcctactgtgtgcaggcactattctctgtattcatctattgattatctagaatgatcctgttcagtcggtagatttttcagtctcttctt

SEQ ID NO: 6783045 - DNA, 76 bp, Homo sapiens
atgaatgtggtggtaacggcaatagctccctccttggcactccccgtcggggctggctcttaccgacagcgtttgt

SEQ ID NO: 6783046 - DNA, 63 bp, Homo sapiens
ttctcagatatttgtatggaactcttagacatcagaaagagctacaacgaaggtatctgagga

SEQ ID NO: 6783047 - DNA, 67 bp, Homo sapiens
gagaagggcatggtgacatcatgtgaatgcctggactgggccttatttaaaactagtgcctcttctt

SEQ ID NO: 6783048 - DNA, 80 bp, Homo sapiens
tggggtaccatgtgatgtgttgatttatgcatataatttgaaataattaaactgagcaaattaacatatccatcacctca

SEQ ID NO: 6783049 - DNA, 119 bp, Homo sapiens
ggcccacttggaggctggtagagagttatgggatgcgggcccgctccactgccagggagcattgctgcggtaggggggccggcccccaggagtgatgctttcctgctccgtcttgggct

SEQ ID NO: 6783050 - DNA, 78 bp, Homo sapiens
cttccctaaatgccccttctggtcttcaatggtgaacacgcttcactaatgaaaaccagaagagacattctggtgaag

SEQ ID NO: 6783051 - DNA, 66 bp, Homo sapiens
tactgatcaggggcccctgtagactgtaagatgttagatcgccaggagccagccctgttctcagta

SEQ ID NO: 6783052 - DNA, 77 bp, Homo sapiens
atggtggggcagaggctctgaggaaccagttagctcttccagaaagatccacactggcacagacctagccccaccat

SEQ ID NO: 6783053 - DNA, 83 bp, Homo sapiens
ctgaatgtgtccaggccctgcttagcacccttgcaccagaccctgtagtacggtgggtatagttagggcctctgacactccag

SEQ ID NO: 6783054 - DNA, 59 bp, Homo sapiens
agcaaggttttggtcatccctcaggcgatcacatgattctgggagccagaccctttgct

SEQ ID NO: 6783055 - DNA, 57 bp, Homo sapiens
ctacctttcctataaggtccaggtatataagcaccatggacattatggagagagtag

SEQ ID NO: 6783056 - DNA, 82 bp, Homo sapiens
cagagtccggacaccacctgtgagactgtccctctgcctggggatgcggagggactccgtgcacagtggttcagggggtctg

SEQ ID NO: 6783057 - DNA, 70 bp, Homo sapiens
tgccaggtaacaaggccgatagaaacaggaattatccctttgtcttctagatgttttaattgcacgggca

SEQ ID NO: 6783058 - DNA, 59 bp, Homo sapiens
tttgacattgccaatttgctcacagtcattgactgctgaaacagatgccaatgatcaag

SEQ ID NO: 6783059 - DNA, 61 bp, Homo sapiens
agcagacagggctacagaggtactttttctccctgaaagtactgtaatttccctctttgtt

SEQ ID NO: 6783060 - DNA, 98 bp, Homo sapiens
gaggcaggagaatcgcttgaactcggcaggtggaggttgtagtgagccgagatcacgccactgcactccagcctgatgaaagagtaagactccgtctc

SEQ ID NO: 6783061 - DNA, 58 bp, Homo sapiens
ggtgtcagcctgggagcctagcattctagccctttgcaaggctgccaggtctcacatc

SEQ ID NO: 6783062 - DNA, 96 bp, Homo sapiens
acagtcagagagaacaaaataccaatattcaaccaacctgaggaaaagtgaattctatgtcaggagggattgttgcctattttggctcactgctgt

SEQ ID NO: 6783063 - DNA, 65 bp, Homo sapiens
cgtcaggtgtgattatttttcagagagagtagagattgctacctactagagtgctcaacttgacg

SEQ ID NO: 6783064 - DNA, 55 bp, Homo sapiens
gccttcttattttcctgaggaagaagctagtgtttcttaaggggaagtggggggc

SEQ ID NO: 6783065 - DNA, 66 bp, Homo sapiens
cattcctggtgaaagaagttaactaggaatcctggtaacctggttaactctatacacaccagaatg

SEQ ID NO: 6783066 - DNA, 77 bp, Homo sapiens
gagagtgtgggatgctgtatttaaggggaagtctgaagagggacttgctgttttacttacaagctctctcactactc

SEQ ID NO: 6783067 - DNA, 57 bp, Homo sapiens
gtgcagccatttgcatgcttccccacaaagttgtgacacagttgatgctggctgtat

SEQ ID NO: 6783068 - DNA, 118 bp, Homo sapiens
tagaatcactggcagagcttttaagaaattttagtgcctgggccagttccagatacatagttgctctgggatggggcccaggcattgatgtttttaaaaaactccctaggtgattcta

SEQ ID NO: 6783069 - DNA, 62 bp, Homo sapiens
cagacatatccctgctcccttagattttatggtctcatggtggaatacagggaagtgtgttg

SEQ ID NO: 6783070 - DNA, 71 bp, Homo sapiens
gcttgcctgaggaacagagggtactggtctgtcaccttgtatgcctgataactgtgtctctcagggcaagt

SEQ ID NO: 6783071 - DNA, 84 bp, Homo sapiens
tcaacaacggatagtttttttcatgtaagaatgttccagtattgcatgggaccaacgcatgcaaaaaatgtatttgttgtttga

SEQ ID NO: 6783072 - DNA, 77 bp, Homo sapiens
gccttgcttagtcccatgctgccctgccccagccatggttgattggatgagggctgagcactgggaccaacagcagc

SEQ ID NO: 6783073 - DNA, 83 bp, Homo sapiens
ttacacattgtcatttccatactatactactggttacacagttcagtcctatttagtatgggagtggacaacaaaaagtgtaa

SEQ ID NO: 6783074 - DNA, 55 bp, Homo sapiens
cagctgggtggctcttctgctccatttgactttggctgggtcactcaggcagctg

SEQ ID NO: 6783075 - DNA, 129 bp, Homo sapiens
cagacttcctcaaaatcctgcaaactaatggttaatacatggtgtattaggaggcctcgccagactctgtgactatctgattaatcagtgctttgctatactagtttttaaatattttgataattgctg

SEQ ID NO: 6783076 - DNA, 65 bp, Homo sapiens
ggctcctctggcaggcttgggcctctttccctctctctctgccctgagctgtgctctcaggagcc

SEQ ID NO: 6783077 - DNA, 78 bp, Homo sapiens
atgcaaatatttctcttgctattctgtggccccaaattttgctggaccagatgagggtgtctcagaatggatttgcat

SEQ ID NO: 6783078 - DNA, 84 bp, Homo sapiens
tgaagctctagatgaaatctgttttaaagtttgtgcctgtaatacagtccgtgatatactggaaggcagaacaattagtgttca

SEQ ID NO: 6783079 - DNA, 57 bp, Homo sapiens
taggaccaggggctgccaggaattcagcagggggcactttgggggtccctggttctg

SEQ ID NO: 6783080 - DNA, 69 bp, Homo sapiens
gagatgggaggatcacttgaggccaggagttcaagaccagcctggtcaacagagtgagacccccatctc

SEQ ID NO: 6783081 - DNA, 83 bp, Homo sapiens
tttccaccaccccgtttcccactgtggcagagcctcgcatagaagattcgagggcctgggtgggagaagaggcactggggaaa

SEQ ID NO: 6783082 - DNA, 69 bp, Homo sapiens
gcttctgtaccccaaagaggaacatgtcagacccacagatgacacgggccactggtggggaacggtggc

SEQ ID NO: 6783083 - DNA, 63 bp, Homo sapiens
agggccaggaacacctgaaggggcaacaaagatctgactctcctagtaggggttccaggccct

SEQ ID NO: 6783084 - DNA, 100 bp, Homo sapiens
ataacgggatatgtctgttacttcttgaaaatagccatgtacatatgtacaatatatgtattactgggttttcaagttacgaacctgacttttacgttat

SEQ ID NO: 6783085 - DNA, 66 bp, Homo sapiens
gtgccatctgtttcttccagggtgcccgagtgatacaaagctgattcaccttacagaaacaggcat

SEQ ID NO: 6783086 - DNA, 67 bp, Homo sapiens
ctgcaaagtgtcctaaaagccatatgggagatagacttcttcgcagctgcaaaggaaacatttgcag

SEQ ID NO: 6783087 - DNA, 73 bp, Homo sapiens
cctcctgtattgcttcagcttcctgggctgccttggtttcatggcacctgcatgatgtctgaagcaagggagg

SEQ ID NO: 6783088 - DNA, 96 bp, Homo sapiens
gttcattagatgcgtgtacatattacagacaaagcttgaaaccccaattgagtttaaagaaattgtacttaatatgtgacttgtgaaagaatgagc

SEQ ID NO: 6783089 - DNA, 97 bp, Homo sapiens
gctgagtgtttgtgtttatgcaaaggggcctcttcctgcatatttaatctagagtaaggcagtggcttttgttgtgtttagcccacataccttcagt

SEQ ID NO: 6783090 - DNA, 55 bp, Homo sapiens
taacctttgaccttgcttgtgcttgtgaaggcaggatgctggaggtcaaaggtta

SEQ ID NO: 6783091 - DNA, 59 bp, Homo sapiens
gggccacagagccagcggtagtcaagggaggaaccatctgcagctcctctctgtgcccc

SEQ ID NO: 6783092 - DNA, 56 bp, Homo sapiens
aatgatgagttctaatagaccctgcttttgcctctggatagtggaactctatcatt

SEQ ID NO: 6783093 - DNA, 70 bp, Homo sapiens
atcctcccaaataggctcaaggtagagggtgcacctcctaacaacttgcttttatcttagggaaaaggat

SEQ ID NO: 6783094 - DNA, 62 bp, Homo sapiens
gggttgatgttatttacattgtagtattgttgcgattaagtgaaatagcatttatgaagccc

SEQ ID NO: 6783095 - DNA, 68 bp, Homo sapiens
gaggctggtcagccctaagatcccttttaactacaataacctgggattctaactggcttgacagtttc

SEQ ID NO: 6783096 - DNA, 58 bp, Homo sapiens
gtcacagtatcatgtttgaatgactgcataaataaagtcagaatgaacatgctgtgat

SEQ ID NO: 6783097 - DNA, 59 bp, Homo sapiens
ttttgtgtttgtgtgtgagtgtggtggagtcagctacctcaagaatgtataacacagaa

SEQ ID NO: 6783098 - DNA, 59 bp, Homo sapiens
cgcccagactcctcggaccaatcagcggagctccctctccgcagcgtgtgaggagggcg

SEQ ID NO: 6783099 - DNA, 61 bp, Homo sapiens
caggagtcttgaaggacaggcagagttagggcgctaactctgaggaatgtacaggaccctg

SEQ ID NO: 6783100 - DNA, 62 bp, Homo sapiens
gtgacttatgaagaatacttagctgtttttttaacccagtctgagtcttttaataggtgcac

SEQ ID NO: 6783101 - DNA, 130 bp, Homo sapiens
agtacatacttgtagtgaagttcctgcagaagccatggactaggaaagataaagattgcaccactgggaactttatagtccggtctgagaatgaagcaatctgctcagctattacttaggaggttcttct

SEQ ID NO: 6783102 - DNA, 69 bp, Homo sapiens
gtgtggaacaatgaggtttgcagggagcaggttaacaaaataatccattctgccatgcttcatctacat

SEQ ID NO: 6783103 - DNA, 83 bp, Homo sapiens
ttttaaaaccccagtgtttaggtcccatctcagactaattaaattctctggagttgagacctgggcactgtgaggttttcaaa

SEQ ID NO: 6783104 - DNA, 68 bp, Homo sapiens
caggtgacttctgaggccttcagaatcactgctctgagttcaactgacagacctctagattacatttg

SEQ ID NO: 6783105 - DNA, 62 bp, Homo sapiens
ttgttagatggtggtccatagctggtgatcgaagtggatcagtccagctcctcatttcccaa

SEQ ID NO: 6783106 - DNA, 57 bp, Homo sapiens
tggccattcctcactatatttcacagggcacacgctgatgaaggagggggatggcca

SEQ ID NO: 6783107 - DNA, 76 bp, Homo sapiens
acttctctctacttagtcttctttgtacaagatgcagataaccatactgtctaataagattgatgggagaggaagt

SEQ ID NO: 6783108 - DNA, 66 bp, Homo sapiens
gtttcagactattctgtttctgtagctgccatttaaaggtagatcagaagagaggtagacggagac

SEQ ID NO: 6783109 - DNA, 130 bp, Homo sapiens
acgtgcaagatccaggctctgcgtgataagctgtggatcttcctggttcagtctttctatgctgttcgtcacacagaaagctggaagctgatgagcacagatgatcaacagaaaatccaagcaggtacgt

SEQ ID NO: 6783110 - DNA, 68 bp, Homo sapiens
agcctcaaatcaagcagtgaaaaatgctagtgaatgatcacattttaatgctgcttaatttttaggct

SEQ ID NO: 6783111 - DNA, 69 bp, Homo sapiens
ctcttgttctctggcttaggttgagtgcagcccatgaggtgctgcagcaaaaggtcagagggaggagag

SEQ ID NO: 6783112 - DNA, 106 bp, Homo sapiens
tatatatgctaaagggggatttagactatttttaatccataagctgtacaattattgttgtagtatattgctcttaatcatagaaacttcttgtttagtgtatata

SEQ ID NO: 6783113 - DNA, 58 bp, Homo sapiens
tgtggcaaagattgtgtacaacttaataagagaagtgttgttacattcttatggcata

SEQ ID NO: 6783114 - DNA, 57 bp, Homo sapiens
ggaattccatagtacagtgatgagtgttacatacttataagagtgctatggggatct

SEQ ID NO: 6783115 - DNA, 86 bp, Homo sapiens
ggattatttggatttgtacagtgaaagcgaggttattccatccctgaactaacctgtaaaaagactggcagcttccactttgatct

SEQ ID NO: 6783116 - DNA, 72 bp, Homo sapiens
gctgggcagaggctgatgtgggatgggctgctcctggtcccttgccctccttccccagccctctgccccagc

SEQ ID NO: 6783117 - DNA, 69 bp, Homo sapiens
tttctcttctgacttgagaccagttagggcttcagtagttgctttgatatgtggtaagtggaagtggaa

SEQ ID NO: 6783118 - DNA, 72 bp, Homo sapiens
ggcctaaaagggaaaatatttagacatatgggtcacaaaagccatttatgcttaaaatatttccttaaagcc

SEQ ID NO: 6783119 - DNA, 73 bp, Homo sapiens
gctggggtgggctcccagaaggctgaaacctgaggagaggatcccagggcagctctgggagtcccacccctgc

SEQ ID NO: 6783120 - DNA, 103 bp, Homo sapiens
tcaagatctgtgactaaagccagggttcagtctgtgactgggatttggtatttgatgctctgctagaaacagcatatattagccctccttagtctggtgttga

SEQ ID NO: 6783121 - DNA, 95 bp, Homo sapiens
ctttactagcatgcagtcttaatagagaaaaactgtgctgaagtttagaaaggcatagtttacatatgttgagatatatattgctgttcgtaggg

SEQ ID NO: 6783122 - DNA, 75 bp, Homo sapiens
cctaggattttagagtacctaagtgttgggttttctcaatattagcaaatgggtagactgatagcaaagactagg

SEQ ID NO: 6783123 - DNA, 74 bp, Homo sapiens
gagtgaggctggtcctcaagggcacagccagattcccacaagtgaggctggtcctcaagggcacagccagattc

SEQ ID NO: 6783124 - DNA, 109 bp, Homo sapiens
cattgcacaattctaagaagcaccattcatgtctcatcatatttctatgctctgggagttgcctttcacatagaatatgtgtgattgttatccctagaattgtgcagtg

SEQ ID NO: 6783125 - DNA, 97 bp, Homo sapiens
ttttaatgcactgaatcagtatctgcaggcctagagtccttaaataatacaagtatactttggactgcatgatgatctggaacacaggatattggag

SEQ ID NO: 6783126 - DNA, 60 bp, Homo sapiens
ggtgtagaggtgtttgtcgttggcttcgtgttacccagtgctgagacagacctctgcatc

SEQ ID NO: 6783127 - DNA, 66 bp, Homo sapiens
cgtggtggtggagcgggcccaggccgagccgttctgcttgccctggtgcaggttccacaggctgcg

SEQ ID NO: 6783128 - DNA, 105 bp, Homo sapiens
ggcatgacatcaaaggtctgggcccatccatatgaggcacattggttaactgataccaaagtttgcacatggatgattttgttcagtcctcagatcaatcttgcc

SEQ ID NO: 6783129 - DNA, 67 bp, Homo sapiens
tacacatgacagtggactgagatgctttgtctgagttagttcttacatctcaattccaatatgtgtg

SEQ ID NO: 6783130 - DNA, 86 bp, Homo sapiens
gtatttctcattctccaacatgtctccagtgcctgacacagaatgatctgtgtgatcaggtgatcatgtgagtggatgagaaatac

SEQ ID NO: 6783131 - DNA, 57 bp, Homo sapiens
tgtctttagccacttgcctctttcattttgttgggagagtgcacatggctgaagata

SEQ ID NO: 6783132 - DNA, 102 bp, Homo sapiens
ctgggagtgctattggggagagacattttcgttggagaggttggctgcaaattctttttcctcagttttcccaaatgtctccttcccatagcgccagtctag

SEQ ID NO: 6783133 - DNA, 68 bp, Homo sapiens
gaggcggagagaacgtagatgacctaaattctagtcctcattatctgcagtttgttttctcttgtctc

SEQ ID NO: 6783134 - DNA, 77 bp, Homo sapiens
cctactgcttcatgaaaatcactggtcaagcttctcacttttggaaatggcttttggatattttattgaagggtggg

SEQ ID NO: 6783135 - DNA, 79 bp, Homo sapiens
cgagagagaatctctttccaaaggaggaaccagtttatttagggagaaaaattgctttggaaagagaaaaactctctcg

SEQ ID NO: 6783136 - DNA, 79 bp, Homo sapiens
gggaatcttgttaaaatgcagattctggttaagtcaatctggaattgtgcctgagagtctgcgtttctgattagctccc

SEQ ID NO: 6783137 - DNA, 116 bp, Homo sapiens
aacattcctgagatctcagggaaacggtcacccatgttttagttttgtctcatactatataaattagaagcaaagtaaatttctgcatgtgtactcccctgagaccagacaatgtt

SEQ ID NO: 6783138 - DNA, 77 bp, Homo sapiens
agaatgaagttaagaggatgctgggcctgcctgccttcctcatgggacagtgagagtctacaccctcaatgcatttt

SEQ ID NO: 6783139 - DNA, 67 bp, Homo sapiens
ctcacagggagcaagagataaataatccaggattcaagattaaaatcgctgttgcttctgtggtgag

SEQ ID NO: 6783140 - DNA, 72 bp, Homo sapiens
gccatttattgaagattttgtggttgctgatagttgtgacattttatgacagcaaaccaagagacttctggt

SEQ ID NO: 6783141 - DNA, 59 bp, Homo sapiens
ccctatttccaaataaggtcacattctgaggctctagttagatgtgaatttggggaggg

SEQ ID NO: 6783142 - DNA, 61 bp, Homo sapiens
ataggtctgaaagtgtatcctgcttgattttctgttcaagtggattggagaacagatttat

SEQ ID NO: 6783143 - DNA, 79 bp, Homo sapiens
tggaagtgttttagaggttagaggctgatagtggagatgatgttacctcctctgtttgtgatttctacgattttctcca

SEQ ID NO: 6783144 - DNA, 73 bp, Homo sapiens
atgatctttaggtctcaattcctgctcctgttgtcgtttttgcaaccaggaagctgtgagacctttgggttat

SEQ ID NO: 6783145 - DNA, 61 bp, Homo sapiens
tcttggactgcactccatgttctgaaaaactgaattagaaacgctggggatggggtctaga

SEQ ID NO: 6783146 - DNA, 62 bp, Homo sapiens
ttcttcaggtgtattgatgtctgtgattgttcattacagcatcaaagctgccttcttaagaa

SEQ ID NO: 6783147 - DNA, 75 bp, Homo sapiens
gtttctaattggaaaagcacagtcagaatataaagagaatcttgcttttcactgaagtttcttccatgtagatat

SEQ ID NO: 6783148 - DNA, 64 bp, Homo sapiens
gtattttgagatcagtctcgcagtaagattcatgttgctctgtgaaatctgaactcaaagatgc

SEQ ID NO: 6783149 - DNA, 68 bp, Homo sapiens
gggagggggccttgttagtggatggagtgtggattgataacactctgaggataagatgctcccgaccc

SEQ ID NO: 6783150 - DNA, 63 bp, Homo sapiens
tgtggaagacactgaatatgcaactactgaccttgtgcctgggcatcttgaaggtcttccaca

SEQ ID NO: 6783151 - DNA, 111 bp, Homo sapiens
ctcagggcgagaccagcggggcacatgcagagggagggccaggcagctcccagggggccaggccaggcatgtcctctgcagaacttgttctttggtgggctcctacctgag

SEQ ID NO: 6783152 - DNA, 63 bp, Homo sapiens
tctagatgcgtgttcagcatctgacatgtttcttaatagcaaaggccttggacacgctgtaga

SEQ ID NO: 6783153 - DNA, 63 bp, Homo sapiens
tctgctctctgggtggtgggcaacagggaggctcctaagtaagtcagtggcccagagtttgga

SEQ ID NO: 6783154 - DNA, 60 bp, Homo sapiens
ggcccccagggtgggtgtagacattcatctctgcttcatttgatccacctctgcttggcc

SEQ ID NO: 6783155 - DNA, 99 bp, Homo sapiens
cctttagaattctgctaggttgacctcctcctccttctccatccttaattatgtaattaatgtctgaggagtggggctgaggccacctttcaggggagg

SEQ ID NO: 6783156 - DNA, 62 bp, Homo sapiens
ggttggggtagggagagctgaagggagattcaaaggttcttcagctctcacagatctcaacc

SEQ ID NO: 6783157 - DNA, 69 bp, Homo sapiens
cctcgtctctccgcaggggccttcaagaagtacagatcactttggcggccagactgggggaggcagagg

SEQ ID NO: 6783158 - DNA, 82 bp, Homo sapiens
actgaaagtggagactgactgcctgtatttgattatgtaatggattaaatacagtcatcaagtctttgcccctcctttcagt

SEQ ID NO: 6783159 - DNA, 121 bp, Homo sapiens
gtatgcatgagttttgtatattcctatgtggcttgtttccactgtgtgaagcattttgtgttcaccctgtgtttcatgtggacatagttgtacataagaaaatctcaaatctgtgctatac

SEQ ID NO: 6783160 - DNA, 82 bp, Homo sapiens
cctggcacatgtagatacatcttgaacttctagaatattaatttaagtctagagatgtagtgtgtattgctgacagtttagg

SEQ ID NO: 6783161 - DNA, 70 bp, Homo sapiens
ggtagtggtggcgtggtggtgcagggatgtttttgaattggctctgtgccctactgctcagctttctgcc

SEQ ID NO: 6783162 - DNA, 87 bp, Homo sapiens
gcggccaatgccccagcagcaggggcgggctccaggccagctccacctgcctgggccttcccacctctgggcggggatggtgaccgc

SEQ ID NO: 6783163 - DNA, 65 bp, Homo sapiens
tgaccataagctgccttagagggagtggttctttgattaaggcggctctctgtggcagcaggtta

SEQ ID NO: 6783164 - DNA, 65 bp, Homo sapiens
gaggctgtgctggtgttctgtgcatgtcgtactgttataggcagacaattatgccagatggcctc

SEQ ID NO: 6783165 - DNA, 59 bp, Homo sapiens
aatacacttggaaatggaccatataaggagaatgctttataaatattttcaggtgtgtt

SEQ ID NO: 6783166 - DNA, 72 bp, Homo sapiens
ctgaacacatttctctgactgtagtgtgctagttatttgccagccctctgcctattatggaattgtgtttag

SEQ ID NO: 6783167 - DNA, 126 bp, Homo sapiens
tttccccgtctgcgcgccccacatattcgctttccgcaggttctctcgctgagattcgcgtccttcaaactaatggaactttgcaagggggccctgcggcggcttcgcgtgggagcgccggggaaa

SEQ ID NO: 6783168 - DNA, 71 bp, Homo sapiens
ctagggcctgacattcagtaggtgctctgtaaatgtggaagaataaatgcacctacttggtaggaccctgg

SEQ ID NO: 6783169 - DNA, 77 bp, Homo sapiens
atgtctaattactcagtggcactttggaatttttatgagtaaatagccaatgaagcaattgaaatttagttagatat

SEQ ID NO: 6783170 - DNA, 61 bp, Homo sapiens
atctattagcctgttgcattttcactgctaagcatttgagacgtgtacagagcttcaggat

SEQ ID NO: 6783171 - DNA, 68 bp, Homo sapiens
gtttctggcacagacatttaatagccttcaatggtctctgaaggaaattagtcagtgttgccaaaaat

SEQ ID NO: 6783172 - DNA, 80 bp, Homo sapiens
aaaagcaaactggagagtctagtgcacctagtttttgaatacacccataagtcaggtgtctgatttgaacagttgctttt

SEQ ID NO: 6783173 - DNA, 84 bp, Homo sapiens
atttaaatgatctgtgtggctctttatgtgttattggataacagaaagttaatcaagagtgaacagagccagtgatatttagat

SEQ ID NO: 6783174 - DNA, 84 bp, Homo sapiens
aggttttcagcactgtagcagccatagtccctggggtctctgcagaatccaggcacttgtttgccaggcagacctgaaataact

SEQ ID NO: 6783175 - DNA, 58 bp, Homo sapiens
tgctcagtagcagtgtgctgctcatggctattgtattcagcagcattgttctagagca

SEQ ID NO: 6783176 - DNA, 58 bp, Homo sapiens
tgagctgagatcgcgccattgcactccagcctgggtgacagggcgagactcagtctca

SEQ ID NO: 6783177 - DNA, 94 bp, Homo sapiens
ccctggcttgactgggcagggcttccagagaacgatgaaagctgggggaactgagctcaaagtgtctcttgactttcccgggaagaagctgtgg

SEQ ID NO: 6783178 - DNA, 127 bp, Homo sapiens
gacggaaaccaatttgagtgtgacagctgatttgagaaagaatgaattaagagattcaggctcttctgctatgttgaaatcatttttactgaaagattagctgtttggaacagggattgactttgtc

SEQ ID NO: 6783179 - DNA, 65 bp, Homo sapiens
tcttataaagtccatctgaacaaggaccttttttgtcattgttttttgagactttctacatgagg

SEQ ID NO: 6783180 - DNA, 87 bp, Homo sapiens
aactgtgcccagtctgtgccagtgtattcctgtgacattgctcattgatggtcatggtgaggacactggagcaggagtggcatggtt

SEQ ID NO: 6783181 - DNA, 61 bp, Homo sapiens
gtaagatggctagaaaagtgaatggcacatagttactattcaaagtactagctatttttac

SEQ ID NO: 6783182 - DNA, 65 bp, Homo sapiens
ctactttccaggcacctgatgcctcactgctgctctgcttggcattcttagggcctggggtgtag

SEQ ID NO: 6783183 - DNA, 65 bp, Homo sapiens
gcagagtgaattcgactggaacttaaattggagtaaactgttcagatatgaattcatatctctgc

SEQ ID NO: 6783184 - DNA, 56 bp, Homo sapiens
tctgagaaggagaaaacagagagcctgggagggttctttgtttgcctttatcaaga

SEQ ID NO: 6783185 - DNA, 62 bp, Homo sapiens
gacaagcaagtaggtatttgacaaatgtttatcagtttgattggttacctatttgtgatttc

SEQ ID NO: 6783186 - DNA, 61 bp, Homo sapiens
ggtggtagtggtggtgtccaaattcctgactcttttgtttggaacactttcagtagctatt

SEQ ID NO: 6783187 - DNA, 94 bp, Homo sapiens
atcatttgttgaattttaaaagtccactgaagttgactgaagatgaacttgaaatcatttgttgaactttagtgcgctttagatgactgatgat

SEQ ID NO: 6783188 - DNA, 66 bp, Homo sapiens
ataaacatcaagaattgggagctattgaacagatggtttattagtgtcctaattcttgatctttat

SEQ ID NO: 6783189 - DNA, 64 bp, Homo sapiens
cccatcttaatgagtttcacttcctcatctaggaagtggctctccaagaagtcacagagatggg

SEQ ID NO: 6783190 - DNA, 76 bp, Homo sapiens
gttgcatgactgataagaaagattcctatttggacactgccatttcttaggtgtctttctgtccttgttctgccac

SEQ ID NO: 6783191 - DNA, 67 bp, Homo sapiens
gggctgacagtttcccctgaaacttggcaatgaggggaacaaggacataggcagagctgtgcagcct

SEQ ID NO: 6783192 - DNA, 77 bp, Homo sapiens
atgctgcaggagggcccaccttgggagtggcatctggggtcccacagaggccaccagaggtggtgcctgggcagtgt

SEQ ID NO: 6783193 - DNA, 105 bp, Homo sapiens
ccttgttggtgtggattctgactgcacatagtgggctggcctgagagtctgcctttctcacaggtgcccaggtgatgcccttctgaggtccatgaacaacactgg

SEQ ID NO: 6783194 - DNA, 89 bp, Homo sapiens
gctagaagttacagagtttacatgcatgcaagaatgaggaactttaaattgatcctcaaagtcatggcaggctcagattgacttctggt

SEQ ID NO: 6783195 - DNA, 81 bp, Homo sapiens
tgtgatattcatccatgtggttgtgtatagcagtagctcattcttttcattgctgtatagtattccattgaggatattcca

SEQ ID NO: 6783196 - DNA, 59 bp, Homo sapiens
agacatatattgcaattcactgggcgtttgagtgagcttggaagattgccatgttgact

SEQ ID NO: 6783197 - DNA, 75 bp, Homo sapiens
aggctctagtcaagaatgaattcgagtgaaggaaagctgtgtgacacctggccttcctctatgttcatggagctt

SEQ ID NO: 6783198 - DNA, 68 bp, Homo sapiens
gggtacatatgcacaacatgcaggtttgttacatatgtatacatgtgccatgttggtgtgctgcaccc

SEQ ID NO: 6783199 - DNA, 88 bp, Homo sapiens
ggagtcttgctctgtcacccaggctggagtgcaggggcgcgatctcggctcactgcaacctctgcctcccgggttcaagtgattctcc

SEQ ID NO: 6783200 - DNA, 62 bp, Homo sapiens
ggctgggggtgagcagcagcgacggtgccatcggctgtcgcatcggcgtcctcagccccgcc

SEQ ID NO: 6783201 - DNA, 78 bp, Homo sapiens
tcaggctcagtatagctggcaagtcaatattatcaacagtaatcaaaactgccagcaatgtgaaagaaatcagtctga

SEQ ID NO: 6783202 - DNA, 56 bp, Homo sapiens
cttaaaatacttcagttgctctctgtgcatagcagaggcactgtttgtggtttggg

SEQ ID NO: 6783203 - DNA, 109 bp, Homo sapiens
agagagagagtaaattttcttaggtggtgcaaaagtaattgtggttcttgccattgaaattaatagcaaaaactgcaattacttttgcaccaacctaatgctttcctct

SEQ ID NO: 6783204 - DNA, 123 bp, Homo sapiens
gtggccctcgggcggctctgaggtgcagggttgagcctgggctttcggcggcttcctccgtttttcggagcgaagggcacgccaaggcttgtttgcctctgtcttgagtgtcgcccaggtcac

SEQ ID NO: 6783205 - DNA, 85 bp, Homo sapiens
gccccgaccatcccgccccgccgcgatcctctgcgggccgaagctgcaggcgcagagccccattgctggcggggcaggcgggcgc

SEQ ID NO: 6783206 - DNA, 80 bp, Homo sapiens
aaatgagttagatgagaaaataagcgagggttaaatattgcctcttcctcttctcttctttcctcattcctaattgattt

SEQ ID NO: 6783207 - DNA, 63 bp, Homo sapiens
gtgtagtaatagtacattagaatgggcatcaggagcctaggaatgtaatctctgttatgcaac

SEQ ID NO: 6783208 - DNA, 68 bp, Homo sapiens
agccttaaaaatgtgcatatcgccaggcgtggtggctcacgcctgtaatcccagcactttgtgaggct

SEQ ID NO: 6783209 - DNA, 57 bp, Homo sapiens
agggaagagccaatgttgcagatgaattccaagggccatctgctggcagaattccct

SEQ ID NO: 6783210 - DNA, 59 bp, Homo sapiens
ggaccacagcacttggcttgagagtaaaatccaactcagacccaggttatctgaggtcc

SEQ ID NO: 6783211 - DNA, 75 bp, Homo sapiens
gctgagctgtgactcaggctagacaaagccccagttaacctagcagggagctggctggcgtgagttctgcccagc

SEQ ID NO: 6783212 - DNA, 108 bp, Homo sapiens
agtcctccagctttattgatgggtggtaaagctggagctggaagcttccacaccagatttccagcctaatgttcttcccacctcatcatttagttcaacccaatgact

SEQ ID NO: 6783213 - DNA, 62 bp, Homo sapiens
gccactgtattagttgtattagttttctttgctggatagaaaataaccactaatatagtggc

SEQ ID NO: 6783214 - DNA, 77 bp, Homo sapiens
ccaggggctttgcctgcaggatgctctctaaggttttctggttctgagaattctgagtttcttccaggagccctggg

SEQ ID NO: 6783215 - DNA, 56 bp, Homo sapiens
attttcttggcaatcagatgtccagggggccaccgtggttcattgttcaggaaaat

SEQ ID NO: 6783216 - DNA, 70 bp, Homo sapiens
gcttcatttgtgcttcatggacttgaagtatttttggacttcaaacttgcgtcatgtcatgaaatgaagt

SEQ ID NO: 6783217 - DNA, 78 bp, Homo sapiens
ctttccaaggtctgttggccttctctgactcctcagccccatttgaggaatgttttgagtgccgagagcctgggagag

SEQ ID NO: 6783218 - DNA, 84 bp, Homo sapiens
tctgtaatttttttatgttgaccatgaatcatgagctgtttccatagaaacagcttcatcacatggcatagccagtttcacaga

SEQ ID NO: 6783219 - DNA, 73 bp, Homo sapiens
gcactacattcttcctttcctgcaaaagcatctgtttaaatacttttggcctcaaaggaaagaacgttagtgc

SEQ ID NO: 6783220 - DNA, 63 bp, Homo sapiens
aatagctatttgagcatattccagctgtattgtagggtctggagaagcattcaaataattatt

SEQ ID NO: 6783221 - DNA, 75 bp, Homo sapiens
gaaacagattgcttgaattaccatgtaataaacccagctacattttattatgtgtgcttttggcaaactgtgttc

SEQ ID NO: 6783222 - DNA, 57 bp, Homo sapiens
gtggagggtgtagtgctgtggctcggccccgccgcgcacagctccgcttcctcacac

SEQ ID NO: 6783223 - DNA, 61 bp, Homo sapiens
tgccatctttgcagcactgttcccagaccactgcttgtgttggttggaatggtgcttggca

SEQ ID NO: 6783224 - DNA, 83 bp, Homo sapiens
taatccaccacagggagcggagtcccatgccttgtggttcttttcatccctacttaggtaattgctcagctcccattgggtta

SEQ ID NO: 6783225 - DNA, 59 bp, Homo sapiens
cattcttgctcctgattcccttacacacctactcatagtaaggcagcaggccagggatg

SEQ ID NO: 6783226 - DNA, 85 bp, Homo sapiens
taaattctctgcttctccttggagggctcagttgttctttggcattccagaaatcaatgaagtctgctaaggtattgggagttta

SEQ ID NO: 6783227 - DNA, 79 bp, Homo sapiens
cttgaggacgttatgctaagtgaaataagccagacacaaaaaagcactgtgtggttctacttatatgaggtccctagag

SEQ ID NO: 6783228 - DNA, 88 bp, Homo sapiens
tacatgtatactgacaaattaatgtatttcagtggccttatgtttctgttgaacagccatgagatgttttatttgcagcatctgtgta

SEQ ID NO: 6783229 - DNA, 128 bp, Homo sapiens
gtcttatttgcatggcagggctggaggctacactgtgacttggcattcatgggacaacaaaatgaccagtcattctgtgttccatggaggccagtcagagcaggttccttggtggtgtgctcagggac

SEQ ID NO: 6783230 - DNA, 94 bp, Homo sapiens
ctggtacctcttcacccctttgctcaccagtttggttattccctccaggtaagttcctagaggagagttgctggatggaaggtggagatgccag

SEQ ID NO: 6783231 - DNA, 108 bp, Homo sapiens
atttctgtattagttttctaaggtagtcagaactttgaaatttattgttcttcagtttattttacttcatttgaaatgcctaattgaagagttaatgggcaatgaaat

SEQ ID NO: 6783232 - DNA, 63 bp, Homo sapiens
tcaaaagctgttgttcatcctgaattgaattttcttagtttgggtggaacagagtcgttttga

SEQ ID NO: 6783233 - DNA, 94 bp, Homo sapiens
gggaacagacttctcagaaggacacatcagattgtcagcttggacgcacaggctcacagctggcctgatctcatgctgtcctcctccctgtccc

SEQ ID NO: 6783234 - DNA, 94 bp, Homo sapiens
aaataaaaatcagggactgacaaggttgaattgtcccatcttgtaagcaaatcttttactggaattttgctttgtcaggccaggtcttttattt

SEQ ID NO: 6783235 - DNA, 63 bp, Homo sapiens
gatgtgttaaatttatctggggtttggaagaaacagtctgctctggagtgaatttgacaactc

SEQ ID NO: 6783236 - DNA, 71 bp, Homo sapiens
cgttcattcagtatttaccaagcacctacaatatgccaccgtgagaggtgctaggtgtgtagtggagagcg

SEQ ID NO: 6783237 - DNA, 73 bp, Homo sapiens
tgtttcattttcggtgcataatatcctatgcaaagaacaaaaggtattggtataggcattgaaacttgaagca

SEQ ID NO: 6783238 - DNA, 94 bp, Homo sapiens
gttggctggaggcctcagtttcttaccacttggacctctttacaggcttgctagagtgtcctcatggtggggcagctggattcctccagatgac

SEQ ID NO: 6783239 - DNA, 59 bp, Homo sapiens
cacaaaaatattctgtagtatgttttagttaagatgacatagaacagaatatatttgtg

SEQ ID NO: 6783240 - DNA, 60 bp, Homo sapiens
tttcagtgtgtaaattgaaatagcaactaatagttggaatttcagtgtatgacagtgaaa

SEQ ID NO: 6783241 - DNA, 83 bp, Homo sapiens
ggctaaatatattctcaggggtgagttggggctaccctgacagtgactccaggcaagcatttaaccactcatggcattaagtc

SEQ ID NO: 6783242 - DNA, 64 bp, Homo sapiens
ggctgatcattagcttttcaaaggagtctaggtgaattttaaagtgatatggctatgaacagtc

SEQ ID NO: 6783243 - DNA, 97 bp, Homo sapiens
gtgccacttttagctctgtgaccctgggcaagtcacttagcctctgtgcctcagattcctcagggctagtgcaaggattgctgcagagctgtggtac

SEQ ID NO: 6783244 - DNA, 77 bp, Homo sapiens
aatgcagctggcaagtgtctgaggttttgtattagcccacaaagggcataattatctcagacacttgtttattcatt

SEQ ID NO: 6783245 - DNA, 76 bp, Homo sapiens
ggtcgcttaaatcccaatgctagacccggtggcaatcaaggtctagccaccaggtctagcattgggatttaagccc

SEQ ID NO: 6783246 - DNA, 63 bp, Homo sapiens
ttaataagcctgtgtgactaactcccaccaggagaggatgggcctgtgatgctgggctattaa

SEQ ID NO: 6783247 - DNA, 61 bp, Homo sapiens
ggggtgctttacatatgttatttcgtgtaaatgttacaagagaactaatgtaagtcattcc

SEQ ID NO: 6783248 - DNA, 65 bp, Homo sapiens
cagtcaatagaatcaaattgccatgccttgaagtgatgccagcaaatagaagattctgttgactg

SEQ ID NO: 6783249 - DNA, 61 bp, Homo sapiens
tgggcctggggcagcccaaatcctacagatgagggaattggggaagtgtgccacaggtcta

SEQ ID NO: 6783250 - DNA, 79 bp, Homo sapiens
tgcctccttgagccaaggctgggtttgctgcccctcctgtgggttttcagggtccagtccttgcctctgtcagggggca

SEQ ID NO: 6783251 - DNA, 79 bp, Homo sapiens
cttgtaggataagcagtggagggaaatgggaaggggcactggcattcatcatccattgtcctcacattagccctgtgag

SEQ ID NO: 6783252 - DNA, 67 bp, Homo sapiens
acaattctgggtatttatatagggtaattaaaacttaaaggctttttgtatgtatactgagaatcgt

SEQ ID NO: 6783253 - DNA, 80 bp, Homo sapiens
aggacaacggggtacccagcccctggagaggcctcggctggctatctcattctccaggggctgctgtgccaccttgccct

SEQ ID NO: 6783254 - DNA, 91 bp, Homo sapiens
gccaggatggtctcgatctcctgacctcgtgatctgccggccttggactcccaaagtgctgggattacaggcatgagccaccacacctggc

SEQ ID NO: 6783255 - DNA, 58 bp, Homo sapiens
gcctgacttattagacatcttcattgtgtaagcatgatgaagaggctgatgataaggt

SEQ ID NO: 6783256 - DNA, 89 bp, Homo sapiens
aaggttacctagaaagtaggtggaggaggagggatttgaaatccagagcccttgccctcagtcaccctgactttatcctggttaacctt

SEQ ID NO: 6783257 - DNA, 57 bp, Homo sapiens
actctgtgccaggcactttggggtatgctatagacaaagaagtgtatgccacagcgt

SEQ ID NO: 6783258 - DNA, 69 bp, Homo sapiens
gcatttggaccttcaagtgggttcgaatcttctttagaatcacacgcctcttgaaggtttccatcctgt

SEQ ID NO: 6783259 - DNA, 56 bp, Homo sapiens
ttctcatatgcactctatttgacaatcattatgttagactggaagtcatttgggag

SEQ ID NO: 6783260 - DNA, 94 bp, Homo sapiens
aggggcttagaacaacagaatattttatttagatcacaattttgtggattgtcttgtgatagatgggatatttgtgatgtttgtgatggctctt

SEQ ID NO: 6783261 - DNA, 77 bp, Homo sapiens
gagaagatgcatgagaagaaaccatactgatatagtcatcaacacctcagtgtgaattcattttagatagttttctc

SEQ ID NO: 6783262 - DNA, 61 bp, Homo sapiens
cttctcccaaaatgcagaagggggtttatagacactatttcctggattttgacggggcaag

SEQ ID NO: 6783263 - DNA, 64 bp, Homo sapiens
cgagcttatgactcagaagatattttccagttagtagttggtaaatatgtcttttgagtttttg

SEQ ID NO: 6783264 - DNA, 60 bp, Homo sapiens
gcagttggagctggggagcaaactttctataccctgaacactgaccccacgctccagagc

SEQ ID NO: 6783265 - DNA, 71 bp, Homo sapiens
agcccgcaccaggagtgagaatgaagggggcatcctgggcattaccccccttccttgtgactggtggggct

SEQ ID NO: 6783266 - DNA, 86 bp, Homo sapiens
gttcagtcctcttgtgatctctactcttgtctccagccaatgtctctgtgacccttggctctgaccaggtagaggagatactgagc

SEQ ID NO: 6783267 - DNA, 65 bp, Homo sapiens
gaagagctgttctttggtcaaaggtatacaggtggtatactgatgatgtgaagaaacacaacttt

SEQ ID NO: 6783268 - DNA, 68 bp, Homo sapiens
ctgtaatcccagctacttaggaggctgaagtgggaggatcacttcagcccaggagttggaggctgcag

SEQ ID NO: 6783269 - DNA, 77 bp, Homo sapiens
gggggacgacacagcgtgtgcctcggggtacacggggccataggtgatgctgtgtgccccggcacattcttgccctc

SEQ ID NO: 6783270 - DNA, 81 bp, Homo sapiens
cccagaactttacctctcttggccgcagtcttctcatctgtaaaatgaggataagatactaggaggggttgagggtccggg

SEQ ID NO: 6783271 - DNA, 79 bp, Homo sapiens
gcttgaccagacatcaatttcaaaggcatgacaaagaccccaacaagcatcttccaggaagctgatgtctagtcatcgc

SEQ ID NO: 6783272 - DNA, 58 bp, Homo sapiens
ccaatgcattgaattaggttttgattctgagtgagaaaaggagccatcagtgggttgg

SEQ ID NO: 6783273 - DNA, 58 bp, Homo sapiens
gcctagagctattcaaggttttatggaagattctatagacctacactatagcttctgc

SEQ ID NO: 6783274 - DNA, 116 bp, Homo sapiens
cctgcaatgaaccatgcctcctggtattcatgcccaaatatagcttcctcctttcaaatctggactggccatgggatttatatttggttgatagaatactgtggaagtgatgcagg

SEQ ID NO: 6783275 - DNA, 117 bp, Homo sapiens
gcctggggggctatcaccggccctcagctccctgtgggaactcctgagttgggggccacccacagggcttctcatggggtgcagagctgggcagggatgggggagggcagcttaggc

SEQ ID NO: 6783276 - DNA, 57 bp, Homo sapiens
gcagcctaattctttgccatgtaaagtaacatttacagattctgggtattagggtgt

SEQ ID NO: 6783277 - DNA, 87 bp, Homo sapiens
gtggggttttccagcagataaatagacttggtcagactatttactagaaatcagaagaaggtatatttatactatgggagaagtcac

SEQ ID NO: 6783278 - DNA, 70 bp, Homo sapiens
gtggataaaccagattgggagtttcagatggcaacccatggagcatactaacccactctggtattgctat

SEQ ID NO: 6783279 - DNA, 65 bp, Homo sapiens
ttctttctgtccataatgagacatacctcatttgtactgtcctgagatttatggagggataagga

SEQ ID NO: 6783280 - DNA, 58 bp, Homo sapiens
agagcagagggctctgggacaagaatgtttctctcttctccctcccttttcctgctct

SEQ ID NO: 6783281 - DNA, 60 bp, Homo sapiens
tggctcacacctgtaatcctagcactttggaaggctgagataggtggatcatttgagcta

SEQ ID NO: 6783282 - DNA, 72 bp, Homo sapiens
ttctctgcccctaaacatgcaagagcttctgggtcctctgaaggccacatacaagccatggggggatgagaa

SEQ ID NO: 6783283 - DNA, 89 bp, Homo sapiens
ggattaactcggataagcaataagggatcctctataagtcaaaggggtgatttagggagatttgcttagttgtggtttgaaggatggcc

SEQ ID NO: 6783284 - DNA, 75 bp, Homo sapiens
gcaaggggaggcaagatgaagtgaggcagggaccacatcttgtaacaccctcaggcttcgtcttccaccccttgc

SEQ ID NO: 6783285 - DNA, 103 bp, Homo sapiens
ccgcaagggtacttctctgccaagtatagtaatattgttgtagcagtgttcaaggttgtcagcaattctggcttactctgcagagagccataatagtgtgtgg

SEQ ID NO: 6783286 - DNA, 59 bp, Homo sapiens
ctgcttgctgccttcctctcagaccaactgtttagcaatgaaggaatggctttaagtag

SEQ ID NO: 6783287 - DNA, 64 bp, Homo sapiens
tgtctggtgaattgaccaaaatcagacttcaattcggtcatttattctggtcaattcacaagca

SEQ ID NO: 6783288 - DNA, 90 bp, Homo sapiens
agggggcgggccgagaggggcgtgcttcggtagtgcagaactctcgctgctactaggggagtccacgcctccaccttttccccgcctcct

SEQ ID NO: 6783289 - DNA, 59 bp, Homo sapiens
gagggacgggtggcacaggagctgtgtgccagccaatcctgatctaatccaactccctc

SEQ ID NO: 6783290 - DNA, 95 bp, Homo sapiens
tggagcctaacttccttccacttgcatgtgtgctggacttagtgactcaattgtaaagcacagaatgaggtggaagtgatagtgtgtcatttcca

SEQ ID NO: 6783291 - DNA, 63 bp, Homo sapiens
gctggaagggaggcccagccggcagccaccacctcctcctccaacctgtcctcccatccacgc

SEQ ID NO: 6783292 - DNA, 61 bp, Homo sapiens
gaggaggctgtttctctgcattctaggtcatctccagagaaactgctggtaacgtttcctc

SEQ ID NO: 6783293 - DNA, 91 bp, Homo sapiens
gctgatatttcaaggactagacttaggagctgacatctcttagataattgtcagagggattcagaattcccaggacgcttttgaattcagt

SEQ ID NO: 6783294 - DNA, 88 bp, Homo sapiens
gtagttattagagcaagaattgtacaaactgggtggcacaatcagttgtaaacttcccgagttttggaacttttgttttgttcactgc

SEQ ID NO: 6783295 - DNA, 57 bp, Homo sapiens
agcaatcagcttctttgtgtttgaccaatgacggatgagcacatggttttgtttgct

SEQ ID NO: 6783296 - DNA, 90 bp, Homo sapiens
ggtggggtgttcatttactctgacctggccttggtgggccattttcttctaaatcgttctccttccagctcagggaaatgctattctact

SEQ ID NO: 6783297 - DNA, 122 bp, Homo sapiens
tgcccagatattttcaaagtaggcaaagctggcaaggttgcatgcttctagggtctcactaaatcgaggatgggggcatggaccagcctggctggcccaaatatttgccgtgttgctgggta

SEQ ID NO: 6783298 - DNA, 79 bp, Homo sapiens
ctcagttggggcccagtgcatggtgttttgattatgaaaagaacatccctaaagtccatgcatgcctgaaattgctgag

SEQ ID NO: 6783299 - DNA, 80 bp, Homo sapiens
atgtaggaaggcctagaggaatggccagggagcctataactgctattctaaccatgcctctgaggtcaacatttcctcat

SEQ ID NO: 6783300 - DNA, 99 bp, Homo sapiens
cacatgtatttgttaatgttttggagttacctgacatataggtataggtataggaaaacctattccaggtattcttcaagaggtgatagttgttgtgtg

SEQ ID NO: 6783301 - DNA, 76 bp, Homo sapiens
tcctcggaatattgcttcatgtacagttattggagatgagtaacttacattctcttaattgtaatggttccttgga

SEQ ID NO: 6783302 - DNA, 130 bp, Homo sapiens
gtagtttcatgataacaaaattgttaactctgcttatagtttgtccacagtcatgcatataaaagtttaaaggacattgcatggatacagctgatagcaggatttgactcactcttttttctaatactgc

SEQ ID NO: 6783303 - DNA, 94 bp, Homo sapiens
gcaactgtgtgatctcagctcactgtaacctccacctcctgggttcaagtgattcttgtgcctcagcctcctgggtagctgggattacaggtgc

SEQ ID NO: 6783304 - DNA, 70 bp, Homo sapiens
ggttctgtgtctccggaggaatcagccctgactgctgggtcctaagctgtacttctggatccgcagggcc

SEQ ID NO: 6783305 - DNA, 76 bp, Homo sapiens
cttagagttatggaaatgttgagcttcatggtaccttagaaattaatgagaatcaacatttcatccatggatcagg

SEQ ID NO: 6783306 - DNA, 78 bp, Homo sapiens
agttctattgattttctgtatgtgaaatttgccttaatttttgtttcagtttctcatgtggatatgaattgtagaact

SEQ ID NO: 6783307 - DNA, 63 bp, Homo sapiens
agcgggtccatattcctgtggctccttctccagattctttgcccacctggatatgacccagct

SEQ ID NO: 6783308 - DNA, 61 bp, Homo sapiens
gtgggctcagaactgctctgaaacacgagaaaacccgtggactcagggccatgagcgccac

SEQ ID NO: 6783309 - DNA, 130 bp, Homo sapiens
gcgctggtggacacggtagtcactggcactctaaatgtggcttttatgactgaggacataaatgtttaactttgattgtgttatatctaaatagccacatgtggctaaaggctactgtgttgaacagcac

SEQ ID NO: 6783310 - DNA, 58 bp, Homo sapiens
caaaggctggtagaatgagccaataaacccaggttcaacaattaagtatcagcctttg

SEQ ID NO: 6783311 - DNA, 59 bp, Homo sapiens
tatcagcatagtatgataagtgacaatattagtattgttactttgtcgctatgataata

SEQ ID NO: 6783312 - DNA, 56 bp, Homo sapiens
agtagttgttaatactcagtagggttgttatcagttctttagttattaacagcact

SEQ ID NO: 6783313 - DNA, 90 bp, Homo sapiens
ccagactcttcaatcctcacttctgaatccaagtggctaatgggaaccttatctttctgccctgttcaagggatgattgaccagagctgg

SEQ ID NO: 6783314 - DNA, 75 bp, Homo sapiens
tctggaggctgggaagtgcaagatcaaggtgctggcaggtggtgtctggtgtggaactacttcctggcctccaga

SEQ ID NO: 6783315 - DNA, 102 bp, Homo sapiens
ggtgaccaactatcctggttggtccaggacttgtgattcctgggacattgatctttaatgctgagctgggacagtcctgggtagacaggatggctgatcacc

SEQ ID NO: 6783316 - DNA, 68 bp, Homo sapiens
gcatgttagaaaactacatttctttatgggaatgtcattcatcctagcttgtcagttctctaaaatgc

SEQ ID NO: 6783317 - DNA, 73 bp, Homo sapiens
ggcttaggctgaaccctgggagatttctccatttgtactttctgtccagagcaattttcccttagtctttgtt

SEQ ID NO: 6783318 - DNA, 64 bp, Homo sapiens
gcccttatgagccagcctcagaagtcacgcagccttactgctgccacactctgctgctcagggc

SEQ ID NO: 6783319 - DNA, 58 bp, Homo sapiens
catggataccagctcacacaatctttgtgatcagcatcaaagaaagagctggcctatg

SEQ ID NO: 6783320 - DNA, 78 bp, Homo sapiens
aaaaagtctgatttatgttaggagaatttagcttgccctttggtctctcagtttttaaatgatataattagacttttt

SEQ ID NO: 6783321 - DNA, 58 bp, Homo sapiens
tgctgctgttatcattttaccagcaaaccacctgccatgcaatgcattgacagcagca

SEQ ID NO: 6783322 - DNA, 58 bp, Homo sapiens
gactctggatgaggtcctgtctgttttcaagaaagagaccctggagttcttcactgtt

SEQ ID NO: 6783323 - DNA, 68 bp, Homo sapiens
aggaatctggaagacacagctaccataataccatctgttgatggaaggcctgttgtgtcctaggccct

SEQ ID NO: 6783324 - DNA, 86 bp, Homo sapiens
gaggagagaaaaagctggcaaggcaatttggattatgcttcagaggagaaaaagttgatctttctgtacccttgtcatctctcctt

SEQ ID NO: 6783325 - DNA, 129 bp, Homo sapiens
aggacaattggcccagattgcaagtgactgtttaaaaatgacacattcccccttcctgttacataattataaaacagtgtaataagagctatggtgggagttggcaccagggacttaggggcagagact

SEQ ID NO: 6783326 - DNA, 64 bp, Homo sapiens
gatagtattacaggaaatcataaagatattaagtataagcatggatttctctgtagagattatc

SEQ ID NO: 6783327 - DNA, 82 bp, Homo sapiens
gcatgaatgaatacaaaaagtggtgagtgtatactctaaagtggttatatactaagctcattacattttggcttatgactgc

SEQ ID NO: 6783328 - DNA, 62 bp, Homo sapiens
ctggttttcaggccttgggacccagactggaactattccactggcttttcctaggtctccag

SEQ ID NO: 6783329 - DNA, 56 bp, Homo sapiens
ggggatctgcactgtggttgctgcatgaagacagtagctggcagtgcctggacctc

SEQ ID NO: 6783330 - DNA, 71 bp, Homo sapiens
agggatgggtattggcagaagagggcaaggcttagccgcaaagctactctcgccacatacacaccatgtct

SEQ ID NO: 6783331 - DNA, 93 bp, Homo sapiens
cagcacagctgaggagcagccaactctgtaccatggggcctgcaggaaagcctctgagctgctgtggcagattggattctcctaagctggctg

SEQ ID NO: 6783332 - DNA, 99 bp, Homo sapiens
tacttcaaccagggcagcagctactcttctgtttagttttatataatgaggttccatataagattatacttaaagagaaagtgccggtttggttaagta

SEQ ID NO: 6783333 - DNA, 72 bp, Homo sapiens
tggggattctttaaaacattgcagggaaaatattggagatcagccaactcaaaacaatgttttagatctcta

SEQ ID NO: 6783334 - DNA, 59 bp, Homo sapiens
ccagggttataaatgcatctgtctgggcacattatctaaattgttatgtatcaccctgg

SEQ ID NO: 6783335 - DNA, 61 bp, Homo sapiens
aattgttccagcataatgttcaagcaaagataatagcttgagcctgctgatagacacaatt

SEQ ID NO: 6783336 - DNA, 86 bp, Homo sapiens
cctttctgtgcctcagtttctcccctctgaaatggggctgataccacagtctcagtttcactggggtgatgagctggggtgcctgg

SEQ ID NO: 6783337 - DNA, 113 bp, Homo sapiens
ggcgaggccgcctccgcccacacccctgtgcgctccggcgagtcagcggcaccgcccaggggccgctgggttggggcggcgggggtcgcgctgggtggccatcctacctcgcc

SEQ ID NO: 6783338 - DNA, 58 bp, Homo sapiens
ggactctgtagaggttctcattcacatctcatagtgctgaaacaatcagacagagtct

SEQ ID NO: 6783339 - DNA, 109 bp, Homo sapiens
tatctgtaaaatgggaagggtatattagatgtgaattaggctgatgtaagaaagcaaaagatgttacacagaacctggtgtacagtgggtatgactattgttgaagatg

SEQ ID NO: 6783340 - DNA, 70 bp, Homo sapiens
taataatacttgcctttatgtcctgcatgctctgagagtgtcagagtgttataaaggccaagttttattg

SEQ ID NO: 6783341 - DNA, 60 bp, Homo sapiens
cagggaggggaagagctgagggcagaggaaagggagccccctgaggatgtctccttcctg

SEQ ID NO: 6783342 - DNA, 68 bp, Homo sapiens
ttgtctttcagttttattgtactgctatcctgaaatagatgttagctcagagaactggtatgtgacag

SEQ ID NO: 6783343 - DNA, 92 bp, Homo sapiens
cttgtgcttcatggttgttttgttgaagggaatttacctctgttgctgtgtgttggatattctgtctttttaaaataatacttcagtatgag

SEQ ID NO: 6783344 - DNA, 73 bp, Homo sapiens
tagagcaaatggagcttgtctactaacatgtgaagtttcctcattgcaagtagataccagttctttgacttta

SEQ ID NO: 6783345 - DNA, 62 bp, Homo sapiens
cctgcagctgcaagtccaggtcagccacactgttctggtcctggcctgaggtcggctgtagg

SEQ ID NO: 6783346 - DNA, 94 bp, Homo sapiens
accccatgacattgattagcacatcttcttggcctgcaactcattcatatgtgcatattttgtcggcccaatgagagtgttagcagaaaggggt

SEQ ID NO: 6783347 - DNA, 84 bp, Homo sapiens
gtgggaaggtattagaacctcctgggagctttctccaggtacacctgaccaagcttttcctcaggagagtcttatatctcctac

SEQ ID NO: 6783348 - DNA, 85 bp, Homo sapiens
tcttagcattactcttggcactcagcaagtgttaattaaatcttatttgctattattattgttgatgttagggttattgttaaga

SEQ ID NO: 6783349 - DNA, 105 bp, Homo sapiens
gtgtatgtttttttgtgtcttggggaagctttgaaatacttgctgatttatggagagtgaaaagtgaaccagactttctcagaacatttagaaaaactcagacac

SEQ ID NO: 6783350 - DNA, 61 bp, Homo sapiens
agccaagtgtatgcaaaatgagtgagatgttctttgccttcaaggtgcatacattctggct

SEQ ID NO: 6783351 - DNA, 123 bp, Homo sapiens
agttatttgatattcttagagcatttaattcagtgtttgatttttaggggaagcttattgtagaactgttagcttcttgtagaactcaaaagtagagctgaatctaaaaaaatacagatttct

SEQ ID NO: 6783352 - DNA, 76 bp, Homo sapiens
ctcctggaagtgacacaggccactttggctcacagcatagctcaaagataatcctatgtctccaacttccaaagag

SEQ ID NO: 6783353 - DNA, 94 bp, Homo sapiens
taatgaagggattaaatcatgtaactatttaaaatgcctaacagtgcctgacacttaataggcacttaataaatggtatatgttcctgttatta

SEQ ID NO: 6783354 - DNA, 80 bp, Homo sapiens
ctcagtctttctgcctgctcctatctgggctcattgcttaaggaagtgaacaaaggtagtgagcatcatagggtgctgag

SEQ ID NO: 6783355 - DNA, 56 bp, Homo sapiens
ggaggtgggatgtgtgtgctactggcatctagtggctgctaaacatcctacactgc

SEQ ID NO: 6783356 - DNA, 78 bp, Homo sapiens
atgagaaacgaggatgttgaataggtgaaatacaaaagtaggccacatttttgccatttctttcaatattcttcttat

SEQ ID NO: 6783357 - DNA, 65 bp, Homo sapiens
ctgaaaggaaacaagtttagaataatgaattgttcctattggagctgttctttggacccttttag

SEQ ID NO: 6783358 - DNA, 116 bp, Homo sapiens
tttatggtaggtcatgccagtttaaaggtattggtctggtcttcctgcttaaaataatgaatggcagaagagagaaccatatatcttgggatctgaactggtgacctaaacataag

SEQ ID NO: 6783359 - DNA, 77 bp, Homo sapiens
agtaactgctcagtgagtatttttaagctattagcatgatcaaatttagagaggagaaatataatggagcagtttct

SEQ ID NO: 6783360 - DNA, 71 bp, Homo sapiens
ttttgtaattgacaaataatgctgtcagttgttttccttgaagtgacagcctcactttgttaattttagag

SEQ ID NO: 6783361 - DNA, 56 bp, Homo sapiens
tgtttatgctttgtgttcattttcatatttagaaaatagaacaccaggcatatata

SEQ ID NO: 6783362 - DNA, 59 bp, Homo sapiens
atcttttgtttatgtagattatatgtattaatatgtaatttagaaatgaacacaaggat

SEQ ID NO: 6783363 - DNA, 81 bp, Homo sapiens
ttctttgtgcagtaagggtgcccaggagatggactggctactcccatagtcttgattcaggtactctggctgtgttaagaa

SEQ ID NO: 6783364 - DNA, 121 bp, Homo sapiens
gcttaattgctgtggcaccaaagcgtgggcggcattctctctctaaatgttgtctgggtacattgcaatacgcttaggagaggcatgagtattgtccctgttgagtatcatttgcttaggc

SEQ ID NO: 6783365 - DNA, 76 bp, Homo sapiens
agctgcttaggcattcactcagcgatgccagtatgtcttactatacaaaacagtgctgagttaatttcacacagct

SEQ ID NO: 6783366 - DNA, 109 bp, Homo sapiens
cagggtgtggtggtgtgtacctgtaatcccagctacttgggaggcggaggtgaaacagtcacttcagcccaggagttggaggctgcagtaagctatgatcacaccgctg

SEQ ID NO: 6783367 - DNA, 73 bp, Homo sapiens
gcttggccctaggctgcccatgagtttgccaaaggtgtactgtagcccactctgaggcaggtcagggcagagc

SEQ ID NO: 6783368 - DNA, 129 bp, Homo sapiens
atagttcatcattaatgtttgtaaaaattaatggtgtcatttatgtttgggaataaaaaactagaaatataactttatttgatagagataaatgatagacataaagtttacataaagcaagagaataat

SEQ ID NO: 6783369 - DNA, 90 bp, Homo sapiens
ttaagttcttccagctttggacaataactgcttttagaaactgtaaagtagttacaagagaacagttgctgcccaagactcagaatttaa

SEQ ID NO: 6783370 - DNA, 59 bp, Homo sapiens
ggtgccttgaggtcccaaacccactgaggccacccacagtgagcaaggcccagggcacc

SEQ ID NO: 6783371 - DNA, 72 bp, Homo sapiens
caggtggaaatgtaaatcagtccatgttactcacctcggagaagcagaagtacgatttactattgttgcttg

SEQ ID NO: 6783372 - DNA, 75 bp, Homo sapiens
ggtggattaaaagtttaggctttgaaaccagcctatctaggtttattttctagtataagcttcagttttctcatc

SEQ ID NO: 6783373 - DNA, 88 bp, Homo sapiens
tctgagggacctgccttttcaccctggagcttttctggccctgagtgacagataccacagcctccagggatgctgcaggttctttgga

SEQ ID NO: 6783374 - DNA, 130 bp, Homo sapiens
ggatggctggagaggctcctggggccaaccactcccacttgggcccatggggctaagctaagtggaaacaaatgttccctggctttcccccagcccagttgtggtgggcgagcagcagcccctccttccc

SEQ ID NO: 6783375 - DNA, 93 bp, Homo sapiens
ggctactgttatggatgaccttcagtgtgtttctcacatgtgggtgtgacatatggtgttaagcaagcagaagtaataaccatgcagtgagcc

SEQ ID NO: 6783376 - DNA, 75 bp, Homo sapiens
gtctggaagggcggaagggcacagcttcttagatcttagggatggagagctggccagcttcagtatgtttcagac

SEQ ID NO: 6783377 - DNA, 66 bp, Homo sapiens
gtgtggctcagcgcggcctggtctttcccgggaattgcgaggaaggccacacttgctggccagcac

SEQ ID NO: 6783378 - DNA, 68 bp, Homo sapiens
aaccctggagaaggctttggatgtattgaggtactagaatgaagttcaaggcagttctatgtagggtt

SEQ ID NO: 6783379 - DNA, 75 bp, Homo sapiens
gttcaagggataaattgagttcaggcatggtttgatccaggagctcctagaatgtcaataactttatccctcagc

SEQ ID NO: 6783380 - DNA, 59 bp, Homo sapiens
ccaaagtccatagtttacataagggttcactcttagtgttgtgcattctatgggtttgg

SEQ ID NO: 6783381 - DNA, 70 bp, Homo sapiens
ttattcatctctgcatatagagtcaggcctgtggtaggtgctcaaggacttctctgcatgagataagtga

SEQ ID NO: 6783382 - DNA, 72 bp, Homo sapiens
ttttctttattcagagcttagaatggactactgtgctttgcagtgatagccccagggctctgagaaagagaa

SEQ ID NO: 6783383 - DNA, 55 bp, Homo sapiens
ggggcctgtatgagggaggcctgtctctgcaaaaaggctgtcctttgccagccct

SEQ ID NO: 6783384 - DNA, 61 bp, Homo sapiens
ggagctacactgaaaaggagatccctcttacgtcctagattctccagttgacagtgtctcc

SEQ ID NO: 6783385 - DNA, 59 bp, Homo sapiens
ggggagggttcaggcgagtgtgattctagaagacaatgcagcctatggatccagcaccc

SEQ ID NO: 6783386 - DNA, 95 bp, Homo sapiens
tctgaaaatttattaaaaatcattgagttgcacttttactaggggtgaattttatggtatgtaaattgtaactcaaaaagtgttaaaaatgaaga

SEQ ID NO: 6783387 - DNA, 73 bp, Homo sapiens
aagtcactggtttttttgtagagcattagttagcagctgccgtacaataaatcatgccaaaatccagtggctt

SEQ ID NO: 6783388 - DNA, 58 bp, Homo sapiens
cgtttagaaagtgctactgacctgaaaattgcattttgaggagcagcgctttttaccg

SEQ ID NO: 6783389 - DNA, 75 bp, Homo sapiens
ttctctaagtctgcatattgttaatggaatgaagactattttgctcctagtttcatgtatgtatatttaggtgaa

SEQ ID NO: 6783390 - DNA, 58 bp, Homo sapiens
tgtgtgcacatacacatatatgtatgtacgtacatatacaggtggtatgtgtaaagca

SEQ ID NO: 6783391 - DNA, 111 bp, Homo sapiens
ggatatctcacaggatttatgtagaatttttaaggcagtgaaactattctgtacaatacgacaatggtggatacatgtcattatacatttgcgaaaatccatggaatatcc

SEQ ID NO: 6783392 - DNA, 59 bp, Homo sapiens
ctgaaatatttagagagtaagtttgcaggatgtctataacttactgtcaagtgttttag

SEQ ID NO: 6783393 - DNA, 58 bp, Homo sapiens
aggactaaagggagcctagacttcttgtgctcaaaagtcatcactccactatagtctt

SEQ ID NO: 6783394 - DNA, 65 bp, Homo sapiens
gtaagatgtttcgtggaaaaagagtctcatgatcagatagacttgggaaacgccaaacattttat

SEQ ID NO: 6783395 - DNA, 61 bp, Homo sapiens
ctgaacccaggaagttgcagtgagctgagattgcatcactgcactccagcctgggtgacag

SEQ ID NO: 6783396 - DNA, 72 bp, Homo sapiens
agaagattgttgtatagagggcatgaatctaatgtcttagaaattagtccttttgcaaatcaaatgtcttct

SEQ ID NO: 6783397 - DNA, 55 bp, Homo sapiens
caaaatgcatctgagaccaggcacggtgactcatgcctgtcatcccagcattttg

SEQ ID NO: 6783398 - DNA, 130 bp, Homo sapiens
actccaatctgactaatatttgctttgcttgtgctacactttcaaagctaatttctttagcatttaaacttatcccttgggtttcagctggtaaaggagtagcgagtacatttacattttattacagatt

SEQ ID NO: 6783399 - DNA, 74 bp, Homo sapiens
gggtttgcacaaggctcctggcgtgcgtctgccccatggggtgggtgctggatgccaggctgcctggccagcct

SEQ ID NO: 6783400 - DNA, 55 bp, Homo sapiens
tgcacataaagttgagacagagatggagacatctcagcctcacctctatggagca

SEQ ID NO: 6783401 - DNA, 79 bp, Homo sapiens
gtgaccggtgagcggctgctcttttcagatcccactcttcccaaggtggactgcaaacttgacagctcgtcacctccac

SEQ ID NO: 6783402 - DNA, 65 bp, Homo sapiens
gtgagggctaaattgtggcaggtactgtaattgattggctaggtactcatgtcatatgttttcac

SEQ ID NO: 6783403 - DNA, 84 bp, Homo sapiens
agctttctccagagacttgcatgtgcttggattaacaaacttgcgatccagggatgctaagcaggtgccttctgtgaccaagct

SEQ ID NO: 6783404 - DNA, 69 bp, Homo sapiens
cattcagagcatctctaaagccagaaaataagagcaaggttagctgttggggttgggggtgtgctgatg

SEQ ID NO: 6783405 - DNA, 85 bp, Homo sapiens
attctcagtaatcaatctgtttaacagatttctgtttattttcaaatgtacctaacagaaattgggcaaatggaaggatgagaat

SEQ ID NO: 6783406 - DNA, 99 bp, Homo sapiens
gcgcctggcggatccaggctctcctcgggtcgcaggcgggggctgggggccgcgggctccaggccatggctgcggaggtgggcctcgagctgcaggggc

SEQ ID NO: 6783407 - DNA, 102 bp, Homo sapiens
tgttggccagatgcagtggcttacgcctgtaatcccagcactttggaagcctgaggtgggcggattcatgaggtcaggagatcaagaccatcttggccaaca

SEQ ID NO: 6783408 - DNA, 89 bp, Homo sapiens
ttctgtgggcccagcaacagcccctcttctctcctcggagccagggccaggctattccaggaggactgagggggctggatctatcagag

SEQ ID NO: 6783409 - DNA, 79 bp, Homo sapiens
gctcctactagccagaggagtgtggatgctaaagaaggacttctcatctctggctgatattcctctgctactcctgagc

SEQ ID NO: 6783410 - DNA, 84 bp, Homo sapiens
ttccagttggctgtattttcatcttgtccttggatgacaggctgtgttatcagcagggatggttgaggtgcagctgagatggag

SEQ ID NO: 6783411 - DNA, 74 bp, Homo sapiens
acaattgagggggttaattaggagagtagctggatgggatttgcactttaaaaagagccttctaaccaaattgt

SEQ ID NO: 6783412 - DNA, 77 bp, Homo sapiens
aaagaaggctgaagaagatccgttttctgtttgataggctcaaaccatcatggcagggcttctgtttagttttgttt

SEQ ID NO: 6783413 - DNA, 56 bp, Homo sapiens
tccaggccccactgaagccccttgcaaacttctggggcagttgatggaggtctgga

SEQ ID NO: 6783414 - DNA, 81 bp, Homo sapiens
atcacagttttagctgttaaatagaatgctttggggaatgatgttaatatctgcagatagcttaacagcaaaactgttgat

SEQ ID NO: 6783415 - DNA, 67 bp, Homo sapiens
tgataatgggggtgccactcagcatgataaatgttcaggatgctggagggggtaccactcaacatca

SEQ ID NO: 6783416 - DNA, 64 bp, Homo sapiens
gcagcttcctgagtgtggacagcaagccaggaggcctgggggaatgccgtcctcagggatctgt

SEQ ID NO: 6783417 - DNA, 65 bp, Homo sapiens
gttttattttcaggccgtactttgtatacattgtaaggcaatagttcggtcctgaaggccaaaac

SEQ ID NO: 6783418 - DNA, 81 bp, Homo sapiens
cattgctgttccatgtgtgtacagtgccttgctctccacttttacctgcaagcatctcctcatcatttgggtctcagtttg

SEQ ID NO: 6783419 - DNA, 59 bp, Homo sapiens
gagcacttattttgtgccagttgctggagatgtagctgtgtacacaatagatgaggttt

SEQ ID NO: 6783420 - DNA, 78 bp, Homo sapiens
caatgggtgtctctgtgtcctccagggagatgtgaagaggattttacatctccctggaggacacagagacacctattg

SEQ ID NO: 6783421 - DNA, 62 bp, Homo sapiens
gtggcttagctgggttgcttgggctccgattctcacatggagctgcagtcaagctgggccac

SEQ ID NO: 6783422 - DNA, 55 bp, Homo sapiens
agctggtgctgaagctcttgagacctttgaaccacttaagggcagcactctggct

SEQ ID NO: 6783423 - DNA, 77 bp, Homo sapiens
ttcagtttctcatttccattcagaaatctggctacaaagtgatttgtctgctactcgggatggtacagagtgctgaa

SEQ ID NO: 6783424 - DNA, 74 bp, Homo sapiens
ccaagaaacacaaggatctcagctcactccctttcttgcttacatagggaggtaaaggtgggttcttagtgtgg

SEQ ID NO: 6783425 - DNA, 77 bp, Homo sapiens
gggaaatcatcctggccggatcacatggcgcgagaaccagctcttcagtgcttatattctgagcctcatgttttctc

SEQ ID NO: 6783426 - DNA, 84 bp, Homo sapiens
tttggcaaaatgtggaaattcctttgaggacaactgtggctcattgtcagagataatcctttcaggaattccatgtctggcaaa

SEQ ID NO: 6783427 - DNA, 60 bp, Homo sapiens
tgcagaacgggtcttctagcaccttccaggttttcgttatgaagcacttcttaggctgca

SEQ ID NO: 6783428 - DNA, 60 bp, Homo sapiens
tttttttgattttacttcaagttctgggatacttttaaggacttgcttttgtcaggaaaa

SEQ ID NO: 6783429 - DNA, 80 bp, Homo sapiens
gaaaggagatcatgaggctgagtgagcctgctgggagttggtccaggctacgtgaggctgcgttagcctcactccccatc

SEQ ID NO: 6783430 - DNA, 56 bp, Homo sapiens
cccatctaagaaagcacttcaggagcaattaattgcagtgtatgaatctggatggg

SEQ ID NO: 6783431 - DNA, 88 bp, Homo sapiens
tcacagagaagcaatggcaaaggggctgtggatgggcctgactgtctggacatggccaaatctgctgcccagccacttgctcttgtga

SEQ ID NO: 6783432 - DNA, 71 bp, Homo sapiens
ggtgattgagggactttctctattattcggctttgaagtgccacagttcagggggaaatgtccttcccgct

SEQ ID NO: 6783433 - DNA, 90 bp, Homo sapiens
aagtatgtgtgccctagcatttataatcatgtgttcattcacatgatcataagtggacacatgaccataaatgctaaagcacacttactt

SEQ ID NO: 6783434 - DNA, 90 bp, Homo sapiens
gctctggttgagccttgtacaggatattataggctttaaaagaagaagaagaaagacctggtatgctgtacaaaaaactgcaaaccaggc

SEQ ID NO: 6783435 - DNA, 57 bp, Homo sapiens
catcttgcaggaagcgagtcacgtcccagcgctgctccctggagtttctggaagatg

SEQ ID NO: 6783436 - DNA, 78 bp, Homo sapiens
cttaggatcacaagctttggagtcagaaagacctaggttcaagccttggttctgccacttagagctttgtgacctggg

SEQ ID NO: 6783437 - DNA, 76 bp, Homo sapiens
ttgtacttgtcatggctgtttagcttctctgcttcactagaatatacagggagaaacagcttaggatgtgatacaa

SEQ ID NO: 6783438 - DNA, 78 bp, Homo sapiens
gccatttccacatttccacctaaggaagcaaccccagggcgattccttggcattggttgccaggctgtgagtgttggc

SEQ ID NO: 6783439 - DNA, 67 bp, Homo sapiens
tcaagcgctgctgatggggtgatttgcttgcaatgggatgacacagcaagcccattaccatgcttgg

SEQ ID NO: 6783440 - DNA, 69 bp, Homo sapiens
gaggagaggccatcgttgttattaaaaataagaatataaattgttaccaaacactgaggcctactcttc

SEQ ID NO: 6783441 - DNA, 80 bp, Homo sapiens
gttgttggccgtgatggcatttgaccgctttgtggctatttgcaagccacttcgctacactgtcattatgaaccctcagc

SEQ ID NO: 6783442 - DNA, 74 bp, Homo sapiens
tctgtctttttatttcccactgctgctgtggtacatctccagtagcatagtttggaaatgcaggttttgataga

SEQ ID NO: 6783443 - DNA, 60 bp, Homo sapiens
cagggtttcatcaatgatttcttattgtgcaaagaaaaagagatgaatcttgagactctg

SEQ ID NO: 6783444 - DNA, 76 bp, Homo sapiens
cccctttcctcctgtgaggcttaagcccagggtcacctcctctgtgaatcttcccttccctcataggaggtggggg

SEQ ID NO: 6783445 - DNA, 79 bp, Homo sapiens
ctcctccgggggacgctggggagcctcggggcacggcggaaaacgcaggtggggggcttccgagcctgacctggaggag

SEQ ID NO: 6783446 - DNA, 71 bp, Homo sapiens
tgttgtctgttgtgtgtgctatcatatctctagtgtctagaatgtgcctggaatacagtaagcactcaaca

SEQ ID NO: 6783447 - DNA, 69 bp, Homo sapiens
cttgttgcccaggctggagtgcaatggcactctctttgctcactgcaacctccacctcccaggttcaag

SEQ ID NO: 6783448 - DNA, 112 bp, Homo sapiens
atttggttcatgatctgtcagatgttagttttggtgagagtacagaattcttacttaggttcaaatagtatcctcagcaatcaacaacactgacatgatacggaggctgaat

SEQ ID NO: 6783449 - DNA, 129 bp, Homo sapiens
ctctttctctggctgatccagtatctcaaattctgcctggtgagggcttgtaagtgggtggagcgggtgactgttcactaagtctggcagcctgtgcggcacagtgctggctgtgggtggaggcaggag

SEQ ID NO: 6783450 - DNA, 93 bp, Homo sapiens
atctgtgttatctcttcagcaacatttcaaggtctttaggatcaaggacttttatgccttccacaaagtctatgagagttgcaaggcacagat

SEQ ID NO: 6783451 - DNA, 57 bp, Homo sapiens
cagcagagtatggcactcaactactaatgtcttcttcattagtgccatattgtgttg

SEQ ID NO: 6783452 - DNA, 60 bp, Homo sapiens
ggaaggtatttctccttgagtgttgggcctattgtgccaagctcagtggagaaatgcacc

SEQ ID NO: 6783453 - DNA, 70 bp, Homo sapiens
gccttgcatgtgctaacgacaagcaatgacttacatgcatagcttgtacatcactggcagatgggatggc

SEQ ID NO: 6783454 - DNA, 89 bp, Homo sapiens
ccaagatggtaccttcacagggccactggcaggaggcctcagttccttaccatgtgggctctccataggccctggtgtcctcatgttgg

SEQ ID NO: 6783455 - DNA, 89 bp, Homo sapiens
gtggcctggaagctcaaactgggtggagtccaccacagctcaaagaggcctgcttgcctctgtagactccacctttgagggcagggcat

SEQ ID NO: 6783456 - DNA, 60 bp, Homo sapiens
caggcctcctatgagcactagcagaatacaaactctcctgtcagatcctggggtggcctg

SEQ ID NO: 6783457 - DNA, 71 bp, Homo sapiens
tccattaattgtcatttaatgcctttgccatccaggttacttggagaggaaagaaattaaatttgaacgga

SEQ ID NO: 6783458 - DNA, 55 bp, Homo sapiens
gcatgtgttatttctctgtgggtcctcatggtccaggcagggattgacacattgc

SEQ ID NO: 6783459 - DNA, 76 bp, Homo sapiens
ccaggtaggcacctcagtcagttattatgccagtcacacatgtgacagggcaggtggctactggtcattgcctcgg

SEQ ID NO: 6783460 - DNA, 86 bp, Homo sapiens
atgaggcctcccatctatccttatctgtctggttgagtcattctgggctgactgggcaccatcatgagatgggcaggaggtctcat

SEQ ID NO: 6783461 - DNA, 125 bp, Homo sapiens
tttatgacagttctacttctttgtcctctgggtaaaagtgtatatatgacttataaaagtgatattcatgtttatagtatatgctattctgagctagaagcaaaatggagaaactttgttataaa

SEQ ID NO: 6783462 - DNA, 76 bp, Homo sapiens
tcactctgttgcccaggctggagtgtagtggcatgatcttgactcactgcaatctccatctcctgggttcaagtga

SEQ ID NO: 6783463 - DNA, 71 bp, Homo sapiens
gcagacatctttgtttcatctgtccagcatcctctcccgtgccttggtactgggctttgaagccaggctgc

SEQ ID NO: 6783464 - DNA, 60 bp, Homo sapiens
ttgagattcatgtgtttcaaggtcctccacaggtaaggcagttgaaaatatggatctgag

SEQ ID NO: 6783465 - DNA, 102 bp, Homo sapiens
actaaaggttataccctcttttattaattcagcttcaaatttggtgaagtacagctaaatttcaagaggcatttcacattaatttgatgctcagcctttagt

SEQ ID NO: 6783466 - DNA, 96 bp, Homo sapiens
tgaatgaatttctgatgtttgaggctataaatataattgtttttatacaaaaggataattggcatttgtaggcatttgcttttggaaatgtattta

SEQ ID NO: 6783467 - DNA, 66 bp, Homo sapiens
gggctggcttgggccaagagcagctggcactgcagatctgttggaatagctctgcccaggctgccc

SEQ ID NO: 6783468 - DNA, 87 bp, Homo sapiens
gcctgggtagaaccctttctcctgggagagttagtttgactccaaattccagcctgaccagagagaacaagcgcattctatccaggc

SEQ ID NO: 6783469 - DNA, 71 bp, Homo sapiens
ttatgtgagtcgtgcatatttcctgattcaaccaaacactaccaacaggtattgagcaccttctcacgtaa

SEQ ID NO: 6783470 - DNA, 57 bp, Homo sapiens
gaggctgcccacacctgcgccgaagggaaactgctcggggctaggcaggcagaactc

SEQ ID NO: 6783471 - DNA, 80 bp, Homo sapiens
cttctcttggtagttcttgttggatgaaactatattgctgttgctttattaaagtaaaacaagaatatgccaatggcaag

SEQ ID NO: 6783472 - DNA, 60 bp, Homo sapiens
cccaaatgcatagtttataagaaggttccctcttggttttgtataatctatgggtttggg

SEQ ID NO: 6783473 - DNA, 55 bp, Homo sapiens
tctctgtaagagaggctttcatgtagtactatagtatgaagccacattgcagaga

SEQ ID NO: 6783474 - DNA, 64 bp, Homo sapiens
cagccacagggaggcgttttcagggcccatctggggttggaagacattgctttcctttgtcctg

SEQ ID NO: 6783475 - DNA, 81 bp, Homo sapiens
ggattgttggagtgactttatctgagctaagttgcctcacttaatgtgtctaaacaatcagatatagtcatttaaataacc

SEQ ID NO: 6783476 - DNA, 78 bp, Homo sapiens
tatatctcttttgctataaaagggtcacacgatctgagaaaattatgtgtgtaatccagttgtagcaaatcagaaatg

SEQ ID NO: 6783477 - DNA, 62 bp, Homo sapiens
ttgcagagccatgaggctggctcagcaacacaaaagccaggggcaagcctcagctctagcag

SEQ ID NO: 6783478 - DNA, 91 bp, Homo sapiens
ggcatatggttgattaaaacaactttcctttttttccaccaaaacatttaattggctttagagtcaaggaaggttcatagtcaaagatgcc

SEQ ID NO: 6783479 - DNA, 64 bp, Homo sapiens
tgtggggaggaggcagagtctagaggggacaaactaatcacagaaatctgttttttctattgca

SEQ ID NO: 6783480 - DNA, 57 bp, Homo sapiens
tgaatttcacaaggtgaggataaagagaacattccttatcctctcctgattaattca

SEQ ID NO: 6783481 - DNA, 78 bp, Homo sapiens
tggctcagtgttggcattcagaaatgttaaataacaataataataataatacatctgagtgtgacgctttaatagcca

SEQ ID NO: 6783482 - DNA, 57 bp, Homo sapiens
ccacctggatgccacaaagccaccttctatgaggggcttccgtagcttccagggctg

SEQ ID NO: 6783483 - DNA, 72 bp, Homo sapiens
tgttaagataaggtaaataggaagaatcatgtacaaactgtagtggttccgaatatttatttcttctaaata

SEQ ID NO: 6783484 - DNA, 55 bp, Homo sapiens
gagagctccttcaggaagcttcaaggtcaggagccatctgctaaggggagctatc

SEQ ID NO: 6783485 - DNA, 81 bp, Homo sapiens
tgacttggctggctttcttgtatttactttgatggacctagggttagggcttttgtaggtactagagaccagatgtggtca

SEQ ID NO: 6783486 - DNA, 68 bp, Homo sapiens
ttatcagactatacccttttttggtgatttgttgttgtataaatcctttttgagggtatcattgatga

SEQ ID NO: 6783487 - DNA, 76 bp, Homo sapiens
ctagtacatgtacttatgcttattgtttatgggagggctagacttttattaatgagtacaagttatttctgactag

SEQ ID NO: 6783488 - DNA, 88 bp, Homo sapiens
gacaacttcatttccggtgagctgcgggcgaggactggggtgcggctccttagccagggcagctcaaaatccaggagtgcccaaggtc

SEQ ID NO: 6783489 - DNA, 109 bp, Homo sapiens
cctgctggactgggaggcacggctccctttgattcctggcactgcagtggttgattggtaagtggatattgagtgcacaggatcgtacaccatcccaatgtccaccagg

SEQ ID NO: 6783490 - DNA, 81 bp, Homo sapiens
gagatctgctgtgtaacaatgtgtatattagttaacaattctgtacagtatgctttaaactttgttaagaaggtagatttc

SEQ ID NO: 6783491 - DNA, 60 bp, Homo sapiens
tccttggaggtcaacgggacggacatccctccttgtactgtattgttattctttgaagga

SEQ ID NO: 6783492 - DNA, 62 bp, Homo sapiens
ttctttggtgtcatgttggacccttcagactttgattgctggaaatcagcatacacagagaa

SEQ ID NO: 6783493 - DNA, 61 bp, Homo sapiens
ctgcaggcttccagggctgtggggccaaatgtgccctctcctgccctcatggcagcctcag

SEQ ID NO: 6783494 - DNA, 77 bp, Homo sapiens
actgctgattagcatttctggaatcacaagaagttagtaaaagctgtttgccattaaagaaagacctttttagcagt

SEQ ID NO: 6783495 - DNA, 66 bp, Homo sapiens
tggcccccttcccagaggccctgcaaggacttcagatgtggtcagcgaggtatgtggatggtgcca

SEQ ID NO: 6783496 - DNA, 79 bp, Homo sapiens
aggcttataggaaatttatctcctgggttgtaatagaacactgtgtaatcccaggaaatatgtttcttaactatagcct

SEQ ID NO: 6783497 - DNA, 70 bp, Homo sapiens
tgcacttacttttaaggggccttgatttaggagtctggtattacctaaatgctctttaaaagtgcttgca

SEQ ID NO: 6783498 - DNA, 69 bp, Homo sapiens
tcttctcctggtatgtatgcacctggtgagagatcatggaacaggaaacatatgtgcttgaggatcgga

SEQ ID NO: 6783499 - DNA, 61 bp, Homo sapiens
gttgcttctcctctctgaccctctgtctccttctctgtctggtgggcttagtgagagcaac

SEQ ID NO: 6783500 - DNA, 117 bp, Homo sapiens
taagttttgattttaaagaaattccttgcactacagccttttcttaaaatgcaagattctcactttgaaggttttgtgttggaagaaatgctactggtttttaaaaagcaaagctta

SEQ ID NO: 6783501 - DNA, 82 bp, Homo sapiens
tctctatggtctgcagcatttctcagcttttgttttaattagtttgtcttgtggaacacagtttagaaaatgctgctagaga

SEQ ID NO: 6783502 - DNA, 104 bp, Homo sapiens
gggacttgaaacatgcttttcacatctgctgctgactggagtttctcaaatgccatatttagcattcagctctgtgaagccagcagttcctagagctaagcacc

SEQ ID NO: 6783503 - DNA, 91 bp, Homo sapiens
tttactgcaaaatgcttttattgagttgcctttactgaagaggccctgcatgccttttcaccagcttgctacaattaaaagcagcagtaaa

SEQ ID NO: 6783504 - DNA, 80 bp, Homo sapiens
gactttgaagtcagatggtctgagtttgaatgtagactctgccttggtcaagttgcttaacccatctgtgcttcagtgtc

SEQ ID NO: 6783505 - DNA, 117 bp, Homo sapiens
ccttcaaccccccaccttagataagtcactggatctttctgggcatctgtaaaatgggaatagtacagccagaggtggtcctgggtctgggctttgtggaggtgggggcagagaggg

SEQ ID NO: 6783506 - DNA, 59 bp, Homo sapiens
tttctagatgtttttctctgaaatagttgactggagacagagagaggagagtccaggag

SEQ ID NO: 6783507 - DNA, 67 bp, Homo sapiens
ccctatcatttggtggataaaaactgtgacgcctaatgagataaagtatttcaccaggtagataggg

SEQ ID NO: 6783508 - DNA, 63 bp, Homo sapiens
gtgcctgtccattcccaggctccttgatgccagaaaaccttggaccatcggaagggcaggcac

SEQ ID NO: 6783509 - DNA, 76 bp, Homo sapiens
acatccttcagctgccctgttaccaaggtgcacagccttgaacaagtaggaagtggcagggagggttgaggaatgt

SEQ ID NO: 6783510 - DNA, 72 bp, Homo sapiens
gctctgtttcccaggctggaatgcagtggtgtgatcttggctcactgcagcctccatctctggggttcaagc

SEQ ID NO: 6783511 - DNA, 95 bp, Homo sapiens
cttttctgcgggactcttctgtcttgcacatgaggagccagttctggaaagaaaagttctgagtgatgttgagtcagaatgtccacccagaaaag

SEQ ID NO: 6783512 - DNA, 61 bp, Homo sapiens
catgaaatgtgttaatctcttgaaaagaaagataatcaaatgagattattgcacattcatg

SEQ ID NO: 6783513 - DNA, 123 bp, Homo sapiens
ttatcatttcccatccaattcagtctgctttgctttcgtgaactgtaggtcaaattgtgtatggatgaattggcagaactttatatattcatgaacacagattgaaagtcagaagaatggtga

SEQ ID NO: 6783514 - DNA, 57 bp, Homo sapiens
ctcactgcaaaaaaccaaggccaatgtctcaaacactggtgtagttttctgcagggg

SEQ ID NO: 6783515 - DNA, 57 bp, Homo sapiens
gtcagaggggacaagacacagatggcaaaaacatctggcctgtctgcctctattgac

SEQ ID NO: 6783516 - DNA, 83 bp, Homo sapiens
aggtagacactgtttccctaaagctcagggggcatgtgttcaggttgatgctctgccaccatgcttcctgactagttatacct

SEQ ID NO: 6783517 - DNA, 59 bp, Homo sapiens
agtctggaggtggcaggtgtgtagttgagaactggtaagcaactgccaccctctacact

SEQ ID NO: 6783518 - DNA, 72 bp, Homo sapiens
gtttccggatcctggcacaggttggtcccaggctcctctgccggggcgactatgtccagggcctttgggaac

SEQ ID NO: 6783519 - DNA, 59 bp, Homo sapiens
tacacaactgacaaccattctgattagtcagaattagtgcctgtgttgatcggttggtg

SEQ ID NO: 6783520 - DNA, 62 bp, Homo sapiens
tctggcgccggcgggcagatgggtatgctggccagtcctgtcagcctgccagctggcccaga

SEQ ID NO: 6783521 - DNA, 81 bp, Homo sapiens
ccctgaggataggtttgtttatgtatcattggtctctctcagaaacagactgtatgatatccaaattgataacctcctggg

SEQ ID NO: 6783522 - DNA, 63 bp, Homo sapiens
catcctcttttaaatgtttgttcttcagcagtgatcctctgaggaaaacgtattgaaaggatg

SEQ ID NO: 6783523 - DNA, 80 bp, Homo sapiens
agcatgcagtaaagcccatgtctctggtgtgcagcaggcacaccttggcactccttgggttatctcctgttgctgctgct

SEQ ID NO: 6783524 - DNA, 68 bp, Homo sapiens
ttatactgtagtctgaaagttgacattcagtttaccaggctgtaataatttttaagacaacagtttaa

SEQ ID NO: 6783525 - DNA, 61 bp, Homo sapiens
gatatcttcaatttagaatggatttatctgaacataaccccatcataagttgaggagcatc

SEQ ID NO: 6783526 - DNA, 66 bp, Homo sapiens
tctctcgatacttagatgagccagggtcaccaagaatgctggctgacacaaaggtatcgaatgagg

SEQ ID NO: 6783527 - DNA, 76 bp, Homo sapiens
gttttgagctttatgcttcctacaagcttgtaccaggtgattacacctatagagcgtagaaggtaaagtataaaac

SEQ ID NO: 6783528 - DNA, 92 bp, Homo sapiens
ggtaacgggctgaagaggatgggtggagggtgacacggatcgccccgaggttatttattttcccttccactcaatctcttcctccccaaatc

SEQ ID NO: 6783529 - DNA, 66 bp, Homo sapiens
gctgaaagtttggattctaagcttgagagaaaaatcaagcatagagacacaaatttgggaataagc

SEQ ID NO: 6783530 - DNA, 69 bp, Homo sapiens
ttcttgaatttccagaatagatggagctctaaggtaaactggaactctgattttttggacattcatgaa

SEQ ID NO: 6783531 - DNA, 63 bp, Homo sapiens
ctaataacatgaactactttctgaaaataaagaaggtaatgtcttcccagttctagttgttag

SEQ ID NO: 6783532 - DNA, 57 bp, Homo sapiens
cggggagagcggccggctgcggacgccggccccgggaaaggctgctcgctctccccg

SEQ ID NO: 6783533 - DNA, 67 bp, Homo sapiens
aatgtgttcttattccccattgcttcttctaatactgagttgggaggagccatgagttggatatgtt

SEQ ID NO: 6783534 - DNA, 102 bp, Homo sapiens
tggcaaatctaacacacccaatagtatctgtggttgctggttccagcacagcaaggccgagaggatgctattctgggtctgaaatgtgagaaagatttgcca

SEQ ID NO: 6783535 - DNA, 59 bp, Homo sapiens
ctttgcagcaatttctgttaaagtgtatgacatgtgcaacataggagggtgctttagag

SEQ ID NO: 6783536 - DNA, 74 bp, Homo sapiens
ttgctacagaaacctgatgtatagattctagatgtgcaaacataaagaatgtatatcaagggagaatgtgacaa

SEQ ID NO: 6783537 - DNA, 83 bp, Homo sapiens
agctgagccatcagtgctggctcagtctggggaatggacctaaaggtaagacccagctaagccacactcagatggcttcccct

SEQ ID NO: 6783538 - DNA, 55 bp, Homo sapiens
ggcggaaagtgcaaaagtgtgataaacattctcacactggtgttaacttttggtt

SEQ ID NO: 6783539 - DNA, 73 bp, Homo sapiens
ttctggaactccctgactcgttttgggaagctgttgattggcccacagtgggttcctgagcagggatctggaa

SEQ ID NO: 6783540 - DNA, 129 bp, Homo sapiens
ttcagaatctcagcttggctgtgccttcttgcttgtctcatgctctgaacccatcttgtgaccttttatggttcatattactttgagtgcaggctagagttggctcttagctagctgtcaaattgggag

SEQ ID NO: 6783541 - DNA, 78 bp, Homo sapiens
aatgcttgatgagctgctattagaggttcctgaaaataaataccaggtgacagtttgcactgttcatcaaagagcatt

SEQ ID NO: 6783542 - DNA, 70 bp, Homo sapiens
tgtgactattgctttggtcttacatgtggctgatatcagcttgttttgaaaatccaaacactagtccaca

SEQ ID NO: 6783543 - DNA, 62 bp, Homo sapiens
atccttaatttacttgcatcttacctagcctgaagtaaaaacggtgcttgtagcttaagggt

SEQ ID NO: 6783544 - DNA, 57 bp, Homo sapiens
gatccagtgggtagtgaagcaggtatagacagaaagcccaatcattgctcatgggtc

SEQ ID NO: 6783545 - DNA, 78 bp, Homo sapiens
atgtagtgggagtccctgtccccatacgagcaggaggccttcaaggcatgtatgccgggcaggggctttgcttaacat

SEQ ID NO: 6783546 - DNA, 90 bp, Homo sapiens
cctttcgatgctcacttgttctagaaaaaaactgctgtggaagtcccttcaaagcaatgtcttttctgaaggacaatggagagcagaagg

SEQ ID NO: 6783547 - DNA, 124 bp, Homo sapiens
tgaagtcctatttcctatgttaaatatcttattcctgtaacatttatggtggctctgctttgctgaccaaaccaggactaataaaaatgttcatacaagaatggttctacgggaagtgacttta

SEQ ID NO: 6783548 - DNA, 71 bp, Homo sapiens
gtccacagtttgtgttggccatgggcaactatctcaacgatggacagcccaaaaccaacaagactacgggc

SEQ ID NO: 6783549 - DNA, 60 bp, Homo sapiens
ttgagttgggtgtctatcacctacaaactaaatgtcagtgcacagtcaagcccagcttag

SEQ ID NO: 6783550 - DNA, 83 bp, Homo sapiens
tgttggttagatttagtaccaagttgtaacattttaattggaagctaagcttattttacacttgggtgtggattttaccaaca

SEQ ID NO: 6783551 - DNA, 56 bp, Homo sapiens
tagtcagtcagtcctggatatgttttgtatggaaatctgccaggttagattgacta

SEQ ID NO: 6783552 - DNA, 72 bp, Homo sapiens
ttttcttttaccaaagtactctgaggcagagaaattaaatttctatctaatactattggtgaaaacagaaga

SEQ ID NO: 6783553 - DNA, 74 bp, Homo sapiens
cgccttctgtgtgcccacgtttattaaattaccacagatgtcgtgtgaacagatgggcgcacccctgagaggcg

SEQ ID NO: 6783554 - DNA, 74 bp, Homo sapiens
tggcatgaggttttaatcatctccgaaaaaagagtaggtaagcttcctgctggaaatgaaagaactaaatgtca

SEQ ID NO: 6783555 - DNA, 81 bp, Homo sapiens
tgctcagcactcttcagtctcccagagttcccacaggcacccaaacaaaagcccctagagtctggagctgcaggctgggca

SEQ ID NO: 6783556 - DNA, 59 bp, Homo sapiens
gggcagagttctgcagccggggactaagtgtacagcccacacagcagatcctttggccc

SEQ ID NO: 6783557 - DNA, 55 bp, Homo sapiens
ataactgcctgatgactctcaagctcaggtgtgaccttcatagacaggctgttgt

SEQ ID NO: 6783558 - DNA, 129 bp, Homo sapiens
atactattggtcccgagggaaagatcattgctcttagttgccttaattttgtttctattatagggccttttctcaaagctttgcagacaaaattccagctgaggtttttccttcaaggcagcattgtat

SEQ ID NO: 6783559 - DNA, 103 bp, Homo sapiens
ttgagatggagttttgctctcttgccgaggctggagtgcagtggtgcagtcttggctcactgaaacctccacctctcgggttcaagcgattctcctacctcag

SEQ ID NO: 6783560 - DNA, 95 bp, Homo sapiens
ggccacatcattttccttcccctgccctcttcatgaccaccctggggggtttagctgatgtaagagctttgcagggaaaggctgtgagtgctgcc

SEQ ID NO: 6783561 - DNA, 71 bp, Homo sapiens
agtgttacacaggactgtatccttggagaaaactctcagttctttcttcaattcacagtcccttgtatatt

SEQ ID NO: 6783562 - DNA, 130 bp, Homo sapiens
agtaggcttcactccgcaagactatctgcaagtaaaatctgactttggaacatactgctgagcttggtctcaatcctggagcactgtggttccaaattgtctgcttcagccagtgcgaggttgcagaact

SEQ ID NO: 6783563 - DNA, 71 bp, Homo sapiens
gtgaccttgtgctagccattttctcccaagtgccaccattgtctcatctgtgaagtgggtagcacattcac

SEQ ID NO: 6783564 - DNA, 73 bp, Homo sapiens
gcactgttggaggaggaagaggagttaatttcatcaattaactcttccaacactccttccatttagtaatagc

SEQ ID NO: 6783565 - DNA, 64 bp, Homo sapiens
cagaggctagactgtgcttcctggctttcccacgaatcatggagcattttggtcacagcctttg

SEQ ID NO: 6783566 - DNA, 82 bp, Homo sapiens
aggaactgtgagactgagtccccaactatgatgtatttcaaatgcattccacacccatagagattttgatctcatcagtcct

SEQ ID NO: 6783567 - DNA, 72 bp, Homo sapiens
gggttttggttttttggtgtatcttattccttcaaagcaggaatgtgtcattatccagaataaccataactt

SEQ ID NO: 6783568 - DNA, 78 bp, Homo sapiens
gtaggagtttgaggtcttcatgagttgcccgattcatgctcccatgctggtatttggtgatgcctccaaactatttac

SEQ ID NO: 6783569 - DNA, 62 bp, Homo sapiens
cagggtctgctacacttggcaagggttaagattagaattagagtcaggattagtaaactctg

SEQ ID NO: 6783570 - DNA, 91 bp, Homo sapiens
ggggcagctggtggctccactgcccctgggcaccggggccctgcgtgccagtctggtgcacgtgggcagtcggccatacaccgagttcccc

SEQ ID NO: 6783571 - DNA, 75 bp, Homo sapiens
gctctctgactcacttagcaggttaatatcaagcatgttaatagctttgccattgctcagtgaacagattctagc

SEQ ID NO: 6783572 - DNA, 60 bp, Homo sapiens
ggccttagtgaaagtattaaacagctggttagctgctgggtagtaaattttcatagagct

SEQ ID NO: 6783573 - DNA, 68 bp, Homo sapiens
gtatttgacaccagtgaatggtccccttataaatcattggtctccatggcacttttgtgtctaaatac

SEQ ID NO: 6783574 - DNA, 57 bp, Homo sapiens
tgtaagaccaggctgggcagctctcattctccgattggcggtccatccgattttaca

SEQ ID NO: 6783575 - DNA, 119 bp, Homo sapiens
tgttattggagtccttgattttgctcctggctgtgtgtcctcggacgagtttatttccttctctggactgctctgtggaacgaggaattggagtaggtaaacattgacatcccttgata

SEQ ID NO: 6783576 - DNA, 55 bp, Homo sapiens
cctcctgcacctccaggaactccagctcttgctgcagcttctgcgagcagagagg

SEQ ID NO: 6783577 - DNA, 99 bp, Homo sapiens
tcctctctgtagctcccaaggccaccctggaggtgcatggactagcggatgtggcaggctggctcagggtggtctgggtctgccaagctacgtagagga

SEQ ID NO: 6783578 - DNA, 83 bp, Homo sapiens
ctgatagaaggaaatgcactgaatattccaaatgtttctgctgcattttggatttttctgttttctgcatttaccctcttcag

SEQ ID NO: 6783579 - DNA, 88 bp, Homo sapiens
gtggcttttaattttctcaggattcttggggctgacaggaccttttcccagtccaggtccacacagtcagtttccaagaattagtcac

SEQ ID NO: 6783580 - DNA, 58 bp, Homo sapiens
agagtaatattctccgaggtgaacctatgtaattattctctttggagtcttttactct

SEQ ID NO: 6783581 - DNA, 80 bp, Homo sapiens
actttgtaaatgattagaatatgtcagtcataatcatgccaagagattatggatttatgcatattttgttttgctgtagt

SEQ ID NO: 6783582 - DNA, 63 bp, Homo sapiens
gccacttctttaatgtatacaaaagacatgaaaaatgtccctttggtcttaaagaaggctggc

SEQ ID NO: 6783583 - DNA, 115 bp, Homo sapiens
gacatttttataaacaatctgtgagaggaagacatctccatatttgaagaataaattttgcttttccaagtactgagctgtcaaactggttggggataaactgcctaaaaatgtc

SEQ ID NO: 6783584 - DNA, 77 bp, Homo sapiens
tcatatcttggaatcaagtttttggagaaagaaaaatctcttagatttctttggttctctattccatttagatatga

SEQ ID NO: 6783585 - DNA, 83 bp, Homo sapiens
caccactaagtcttgttgactcttaatttgcttttgcagctgaagcaataaatgtaaaggttaagaaagaaagctttagggtg

SEQ ID NO: 6783586 - DNA, 79 bp, Homo sapiens
gtcagcagatgggctttggttttgaactacaatatcagatcttccttggttctccagcctattggcctatcctgcagac

SEQ ID NO: 6783587 - DNA, 68 bp, Homo sapiens
gatgagtactgtgacagttgccagatggcaaatattcaattgctgttggcctttcatcagtaatcatc

SEQ ID NO: 6783588 - DNA, 80 bp, Homo sapiens
gggaagcatagacaggagatggagtattccagtttgtgattctgagtcgctgaccccccagctctatctctgcttttccc

SEQ ID NO: 6783589 - DNA, 66 bp, Homo sapiens
gccttgtcattgactttgctgtaaggattttctcgacaactccatgcaagtgtttctgacagtggc

SEQ ID NO: 6783590 - DNA, 79 bp, Homo sapiens
cgaagattaaggcattggaagattctgtgtctggtgaggtcctgctcctcaaagacagcaacttccacctgtgtgtttg

SEQ ID NO: 6783591 - DNA, 64 bp, Homo sapiens
cccaggatctgcccaggcctttggaggccagacctccctgatggcacagtggcaggcatctggg

SEQ ID NO: 6783592 - DNA, 58 bp, Homo sapiens
aggctgcagtagagctgggatttgaaccctggttgttctgatcccaaacctctgccct

SEQ ID NO: 6783593 - DNA, 55 bp, Homo sapiens
ctgcaccatccttcatgctctggaccctgggtccgtgcatgacttcatggagcag

SEQ ID NO: 6783594 - DNA, 77 bp, Homo sapiens
cacctcaggtctcctgcccccggtgcttgggctctctctgtccaagcacaggggttaggggcatgtggtctggggtg

SEQ ID NO: 6783595 - DNA, 66 bp, Homo sapiens
gagtctggggtccttttggctttacccgcacataatctcttgggtggatcaaaacctcttcaactc

SEQ ID NO: 6783596 - DNA, 59 bp, Homo sapiens
tcatagtgcaggattgcggcttccgtaaatggacctgaagcggcagaccctgcatttga

SEQ ID NO: 6783597 - DNA, 83 bp, Homo sapiens
ggagttctggcatgcagtcaaccagtaagggaatgtttcacaacagtaataaccccttaccagctgggactgccccatgctcc

SEQ ID NO: 6783598 - DNA, 59 bp, Homo sapiens
gggaggcgcgcgggggtgcgtgcttcgcgaggatgccaggctcacctctgtgcgccccc

SEQ ID NO: 6783599 - DNA, 130 bp, Homo sapiens
ttggctggttgaaaggaacacttgattctttgtcagaaagcagccttgcgcttctaaggggtctgctgtctgaaagaagccttcgaggctcgcagacctggggaagaactcaacctgccttcagcccatg

SEQ ID NO: 6783600 - DNA, 57 bp, Homo sapiens
aatgttgacagtggtgatctcatccacacctttggtcttgatggccatttcaatgtt

SEQ ID NO: 6783601 - DNA, 62 bp, Homo sapiens
gtgggtcagaaatttaggctggacttggctgggaacctctgctactggatgagcttgcccac

SEQ ID NO: 6783602 - DNA, 57 bp, Homo sapiens
gaccagaatgtttagtcagttagttgtgaatatcaattgcagaagaacgttctggtt

SEQ ID NO: 6783603 - DNA, 98 bp, Homo sapiens
gtttggagtttagaccccaagaagttagctgtggcctcatgtttggtgtttgagtcacgaatgtggggaagccatggctgatgtgtcagctcacaaac

SEQ ID NO: 6783604 - DNA, 70 bp, Homo sapiens
gtatgttaagagaagctctctctgatgaaaataactctgcacttagggagaaatgcttccctcaagatac

SEQ ID NO: 6783605 - DNA, 66 bp, Homo sapiens
gtgccaggacaaggaccacatggtattcaacattgcttcctcagtgcctggtactatgtctggcac

SEQ ID NO: 6783606 - DNA, 90 bp, Homo sapiens
gctgtgcccacagttcctggcctggaacagcccacccctcacctccgagtttgtggcgctcctcccggccctggtggacgctggcacagc

SEQ ID NO: 6783607 - DNA, 70 bp, Homo sapiens
gtgtaaagtgcattataactgaatgttgttcttgtatttcatggacaccagttgtcatgctaatgtgcac

SEQ ID NO: 6783608 - DNA, 83 bp, Homo sapiens
ctggacagtgtgggaagtaaatggcacagtatgggattaaagaaggatatttggtaagtcctgaacttgtgtcccacaatcag

SEQ ID NO: 6783609 - DNA, 56 bp, Homo sapiens
gcttgggctgaaggcctgggtctctgtgttgctggcacaggcttacagcagcaggc

SEQ ID NO: 6783610 - DNA, 78 bp, Homo sapiens
gccaggtacagcagggcacagttatggaggtggggtaccatggcagggcaccaccctggttactgtgccaggcctggc

SEQ ID NO: 6783611 - DNA, 94 bp, Homo sapiens
cctgtcctgtgacaaagcatgctggtcagccagtggatgcccccatcggttccatgccagtggctgcaccgggacccctgcttgcaggcacagg

SEQ ID NO: 6783612 - DNA, 64 bp, Homo sapiens
cctgaagaaaattccacgagaactcagtgcctctggggttcaggtcttctggatttcctttagg

SEQ ID NO: 6783613 - DNA, 82 bp, Homo sapiens
acggggatccttgcatggccctgggtctaggttatgtgctttccacacagaagcaccctgcactcccagccatagaccttgt

SEQ ID NO: 6783614 - DNA, 77 bp, Homo sapiens
ctttcctgctttccatatgaaaaagctgttgctcagggagggcatgcggtttgctcactgtggcacaaaggggaaag

SEQ ID NO: 6783615 - DNA, 59 bp, Homo sapiens
ctctgaaagacaagctctcattattcccatcttcctgatgatgagcagtgtgttcagag

SEQ ID NO: 6783616 - DNA, 62 bp, Homo sapiens
ttgcagccaaggtgcactggttaatgtccatatggattgacaaagtggttgtttggttgtaa

SEQ ID NO: 6783617 - DNA, 78 bp, Homo sapiens
ctcagagacagcatcaccaacttgagcaattttcttattatacagagttaattaggtgtgtgcctgttagcctctgag

SEQ ID NO: 6783618 - DNA, 74 bp, Homo sapiens
gcaaattcaggttcccaggtccagggcttcatttcacaatattacttatgaagatccttgggaaattgacctgc

SEQ ID NO: 6783619 - DNA, 62 bp, Homo sapiens
agacatcccctttctggataacgtctccccaggtgctcctgggcatcacagagggggagtct

SEQ ID NO: 6783620 - DNA, 57 bp, Homo sapiens
ctgattctttggttgtggatttgcaaagcaatttgcaccagtttctcagagaatcag

SEQ ID NO: 6783621 - DNA, 64 bp, Homo sapiens
aaaagttgggaatggatgctaagtgctaaccttttagctactcggaaaccatgctcaaactttt

SEQ ID NO: 6783622 - DNA, 87 bp, Homo sapiens
ctgtacacgagatgggagagctgggtggacttgtagttcagctggttgttgggcatgaacttgtgcagctcactctttttgtagcag

SEQ ID NO: 6783623 - DNA, 58 bp, Homo sapiens
gggtgggagagatgagagcagcaaccaggctctgctcacagaacttctcttcccaccc

SEQ ID NO: 6783624 - DNA, 75 bp, Homo sapiens
gggcgtcaccttggagacagcagctgaggagctcaaataggtgttaccgtggaagctcctgtctcaagggagcct

SEQ ID NO: 6783625 - DNA, 65 bp, Homo sapiens
ggagatgggggaaagtacgagcatggccttgtcgaccatctcctggcctttgttccccccactcc

SEQ ID NO: 6783626 - DNA, 79 bp, Homo sapiens
gagcatatttataatagttactttgaagtctgtctggtgattccagaacctgtttagagtcattttatattgactgctt

SEQ ID NO: 6783627 - DNA, 130 bp, Homo sapiens
ctggggctgcggcacgtctctgagccggggctcaccaggtgtggggaggactcacagaacaggcagcactgagtgtggcctccccacttctggggacgcctggggttggtggtggcgcccagagtccctg

SEQ ID NO: 6783628 - DNA, 57 bp, Homo sapiens
ttacctgcagagacgtggaggcgtgagggagaacatgcttgttaaatatgcaggtag

SEQ ID NO: 6783629 - DNA, 65 bp, Homo sapiens
atcttggcatcaccacttacttactagtccctaatggtggcttctctgtggggtgttgtgaggat

SEQ ID NO: 6783630 - DNA, 87 bp, Homo sapiens
attcttactcaatgattagtcttcaacattctcacatactctcagccactttgagtaaacgaagatacatcattcaggagtgagaat

SEQ ID NO: 6783631 - DNA, 94 bp, Homo sapiens
tctattacggttcaaattgccagtgtaaactaatatttaaaatcattttagtgtggtgttaaaatgctttatagtagattttgcctgtggtaga

SEQ ID NO: 6783632 - DNA, 65 bp, Homo sapiens
gggatggggatgaattgagtcagaagggcttccactgagtcgccctttctcccttcaccgcaccc

SEQ ID NO: 6783633 - DNA, 82 bp, Homo sapiens
aaggtctgtgtgattatctggcatggatgttgacattgaataaactgaaatcataaaacacaccaggtagttagcatatctt

SEQ ID NO: 6783634 - DNA, 82 bp, Homo sapiens
gtgggcactagcagagaaagtggttgcctctgtgcagaatgcatttatgagtagaggctccaccttctctgtccatgtaaac

SEQ ID NO: 6783635 - DNA, 66 bp, Homo sapiens
tttcaagcataactgggaagagagcatgaaaactccactttccactcttgtgctccgtgtctgaag

SEQ ID NO: 6783636 - DNA, 55 bp, Homo sapiens
gcttccaaagtcatgttgctgatattgaaatgtcaattccttgacctttggatgc

SEQ ID NO: 6783637 - DNA, 62 bp, Homo sapiens
gtcgagagtaattggtagctggcttgattgaacctgctatcatgcctgtacctgctttttac

SEQ ID NO: 6783638 - DNA, 58 bp, Homo sapiens
aggctggtgcctgcagtgaatcatataattaatttggtattacatgacactccagcct

SEQ ID NO: 6783639 - DNA, 71 bp, Homo sapiens
ttgcttaccagagcttacatgctagaaagtgatttttctctttgtaaactaaattgagttactggtagtaa

SEQ ID NO: 6783640 - DNA, 58 bp, Homo sapiens
cttcctgccttcttatctgttttaggtgaaagtggagaaacagtgaggagattggaag

SEQ ID NO: 6783641 - DNA, 73 bp, Homo sapiens
ccttgaagagcaccattcaatagccaggattaattaagttctaagttctgctatgaaaaaagtgctgaagagg

SEQ ID NO: 6783642 - DNA, 56 bp, Homo sapiens
aagacagcgtaacagattgaatacaaaagaaggtatgagaacccatacgctgtctt

SEQ ID NO: 6783643 - DNA, 58 bp, Homo sapiens
ctgatccccttaagcttttctgtttaactacgggggtatgaagtggctaaggggacag

SEQ ID NO: 6783644 - DNA, 79 bp, Homo sapiens
tctgttagtcatgaggccaaccttttcataaatgtgactccattggtctctatatgaaaaggtggccaatgtagataga

SEQ ID NO: 6783645 - DNA, 104 bp, Homo sapiens
gtgctaggacttactgatggacatgtaagtgtaattttggtatactattcttgctacagaatgattgaggttatcgcagtatgtcagctatatcctcaaagcac

SEQ ID NO: 6783646 - DNA, 66 bp, Homo sapiens
ggtaactgtgtttcactggttatgcttagctgtaaatccatagcatatacagttttacagggtttc

SEQ ID NO: 6783647 - DNA, 73 bp, Homo sapiens
cttctctgttttccaggaatctcatagagcactgcaccctaaaaattcttctatgaccttaggaagcaagaag

SEQ ID NO: 6783648 - DNA, 61 bp, Homo sapiens
taaagcagtgttgggtcggacgcaattgtggaccagaaaaataatccaatgcactgcttta

SEQ ID NO: 6783649 - DNA, 57 bp, Homo sapiens
ggcaagaatgagctggcagttctcatccccctggtggtgaagagtgcgcacattgcc

SEQ ID NO: 6783650 - DNA, 71 bp, Homo sapiens
atgttctcctgaagaccatgtgcacttaggtctacgggacccctcagagccaatcttcagagcagagacat

SEQ ID NO: 6783651 - DNA, 92 bp, Homo sapiens
ggcatgcccctgcctcagtgcctcatcccctgctgtcaggtcctgacccaacaagggcctgggctgctcatggggatgataggtggtttgct

SEQ ID NO: 6783652 - DNA, 75 bp, Homo sapiens
ggccaccaacacatggcccagccagtgctgctgggctctggtttctgtgttctggtgaggccatggggtggggcc

SEQ ID NO: 6783653 - DNA, 66 bp, Homo sapiens
agtctttgaccttgttggtaggtatttcattggtgatggatgccagattctaaagggttaaagatt

SEQ ID NO: 6783654 - DNA, 68 bp, Homo sapiens
gagatcaaagcagccattagtctagagctgattttttccaactataggcaatgccctgctgagaactc

SEQ ID NO: 6783655 - DNA, 73 bp, Homo sapiens
tcttgtttccagtttgaggtttcaagatgtggataccacattttaaagtgagacctgaaaccatcagtcagga

SEQ ID NO: 6783656 - DNA, 68 bp, Homo sapiens
gtgtgtgtgtgtgtgtgtgtgtgaattctttttaattctaagactttcatacagaaacatcacttcat

SEQ ID NO: 6783657 - DNA, 66 bp, Homo sapiens
gagacgactgggtgatagaagaatgctgaatgctgtgttcgtatcctgcttcatgcccagagtttt

SEQ ID NO: 6783658 - DNA, 78 bp, Homo sapiens
cctaacagttcgttcttcatgggttcttttaggatatgttgaagccgacctcttcctccccaaagagagcgtgtcagg

SEQ ID NO: 6783659 - DNA, 109 bp, Homo sapiens
ggccttgaggtgtgaccctgaagacccctgctagtgtcatttcctacgggaaattgtccctaacacttggcgctggtctctttaaaggtgtgtatctcactgcagggcc

SEQ ID NO: 6783660 - DNA, 76 bp, Homo sapiens
gatttttttaaatagttcaggttagtggttatagaaaatgctgtgttcaccctagcacttaactcctttgagaatc

SEQ ID NO: 6783661 - DNA, 60 bp, Homo sapiens
cccggcctggaatcctgcatgctccagctcctgctgtgtctgcctgggatccattctggg

SEQ ID NO: 6783662 - DNA, 99 bp, Homo sapiens
ccatgaatagctgttgaatggatgagtgaaggagtgaatgtttagtctttccctaggctctgccaattccttcctctccacccactcacctcccaaagg

SEQ ID NO: 6783663 - DNA, 57 bp, Homo sapiens
tggtcctggccttgaccccaggcctggaggcttgcaatggcactggggccaggacca

SEQ ID NO: 6783664 - DNA, 73 bp, Homo sapiens
agcccaggagcctttggagggtttcaaacagagtctggagggtgtctgactgacttttcaaaatgttccggct

SEQ ID NO: 6783665 - DNA, 61 bp, Homo sapiens
ttcctatccttttatgtttatgtctcctcagaagacacacctgatataaagagatggtgaa

SEQ ID NO: 6783666 - DNA, 61 bp, Homo sapiens
atccattggttgacttgggcttatgacttggttgggtcaatagcatagcaattaatgtgat

SEQ ID NO: 6783667 - DNA, 58 bp, Homo sapiens
gaggccacagtcagtgttcatctattttgtgaagtgcatcagcactacctgtggcttt

SEQ ID NO: 6783668 - DNA, 62 bp, Homo sapiens
ctgggacccagcccaagtctttctggctgtctccagctggaacagaagtggcttggtctcag

SEQ ID NO: 6783669 - DNA, 115 bp, Homo sapiens
gaatgtaaataaggacctggccaatttgttctagcactgcctggaagacagggaatcttggtcaaccagaagttgtgtaggtcattcttaaattgccaaagtcccaaagtcattc

SEQ ID NO: 6783670 - DNA, 75 bp, Homo sapiens
ggaggcgtggccctcgccgttgaccatgtacagcacgtagtgctccatgcgctcggccggcggcagcggcgcccc

SEQ ID NO: 6783671 - DNA, 58 bp, Homo sapiens
acagaagtgagtggcaagaacttaactaaagagttacaatgccatcccttatatttgt

SEQ ID NO: 6783672 - DNA, 55 bp, Homo sapiens
ttgagatccgggccatgctaaccatttctcaggtttgcattaaatccagactcaa

SEQ ID NO: 6783673 - DNA, 80 bp, Homo sapiens
ctccaggccaagattaagtaattttttgtgaagcaccaagagccacagctggatatcatattacttaatctctcctggag

SEQ ID NO: 6783674 - DNA, 81 bp, Homo sapiens
cataaaggcaaggaaagcctcagtcagggagccttgagggatctgcagagtcccctcctctctgctgagtcctcctgaatg

SEQ ID NO: 6783675 - DNA, 114 bp, Homo sapiens
ggtcctgccttctctgcccctctgcaaggccctccagtagccacccagacccccaaataggggtcgcaagcacggggggcctgccaggtctacagggcactgggggccatagcc

SEQ ID NO: 6783676 - DNA, 69 bp, Homo sapiens
ttgtttctagatgagggtgggggcgggtgtccttagcccaaagcttgtgccagtctctatcagaaataa

SEQ ID NO: 6783677 - DNA, 58 bp, Homo sapiens
gccgaagttctgggatttccacagtgccaagttactgtaagagcctccggactgaggc

SEQ ID NO: 6783678 - DNA, 79 bp, Homo sapiens
gctacattcaaccaatgtttgctattattatatgggcctggcaaaaggcaaatggctagacaggttgtaaaatgaatgc

SEQ ID NO: 6783679 - DNA, 59 bp, Homo sapiens
taaattttccaccttctaacctataattaaagacactgtgggtgaggatggagaatttg

SEQ ID NO: 6783680 - DNA, 84 bp, Homo sapiens
acgcgtgcacatatactgtgttaaatacagagatgggtggtcgcttacctgtgtgtttgatacataatagtatttggtcaaagt

SEQ ID NO: 6783681 - DNA, 56 bp, Homo sapiens
agggagacaaaagcagctgccatggagtcttctatgattcagaggctattctcctt

SEQ ID NO: 6783682 - DNA, 67 bp, Homo sapiens
tctgtccaggtcagcctacattctgtaaaactcttaatatattcagatggatggctgaatggacaga

SEQ ID NO: 6783683 - DNA, 72 bp, Homo sapiens
gcagtgatttgttacagcagtgatttcagactaatacatgctttctctgagaatgcctttgaacatcactgc

SEQ ID NO: 6783684 - DNA, 74 bp, Homo sapiens
ggggtgtctagtgcttatctctttactttgcacatgttaaatggctgcttgtctcagataaaactatgcattcc

SEQ ID NO: 6783685 - DNA, 88 bp, Homo sapiens
gaattaggcaggtattctccagtggtcacgttatttttagatctccaaatgatggagctggaatgggccatttgaggcctgctggttt

SEQ ID NO: 6783686 - DNA, 84 bp, Homo sapiens
tttttagacatatatttaatttaaaatgcctattaaacattcaggtggagaggtcaggtaggaagttaactatgagtctagaga

SEQ ID NO: 6783687 - DNA, 79 bp, Homo sapiens
agttggggaggtggctgtcagcttcacttgaacctgaaggtctgggagtggaaggcatgacagccgcccacctccaatt

SEQ ID NO: 6783688 - DNA, 85 bp, Homo sapiens
ccctaagacccacaggcaggggcagagacacacaaggagcctgttggagcttggcctgtctagcccattgatcttggccttgggg

SEQ ID NO: 6783689 - DNA, 68 bp, Homo sapiens
caagatgccatgccccaatacaggacaccttgcgtgggccttggtgggtcttgcggggcagcttcttg

SEQ ID NO: 6783690 - DNA, 66 bp, Homo sapiens
tccttatgttttaagtgtgtatcttagcctctcaattattataaggtaaatatgaagacagaagga

SEQ ID NO: 6783691 - DNA, 62 bp, Homo sapiens
gagaattcagtttctatggagtgttcattcatatcaatgctgccatctcaactgcccttctc

SEQ ID NO: 6783692 - DNA, 59 bp, Homo sapiens
gtgcccactcttttgatttgtgtttctgcctagacagtgcacagcatgagtgttggcat

SEQ ID NO: 6783693 - DNA, 56 bp, Homo sapiens
aggtgggcctcgagcatcccctgggctgtgtcagcacagggctctgggcctggcct

SEQ ID NO: 6783694 - DNA, 55 bp, Homo sapiens
ctttgtacaataagagatctgttaggcaccagatagatgcttgctatgtatagag

SEQ ID NO: 6783695 - DNA, 113 bp, Homo sapiens
gggagagatgaatgtagaaaagctggcctggggcccaggcctgcctgctgtgcatccctgggtggatgccagccctctctgggccccaaggctctgcctgacttgggtctccc

SEQ ID NO: 6783696 - DNA, 72 bp, Homo sapiens
gttcaggatgcccctgcctggcccagaaaccacactgccatgaatgggtcaggacattttaccatcctgtgc

SEQ ID NO: 6783697 - DNA, 57 bp, Homo sapiens
ggctctacactagacctactgaattaagaaatctaggttgaagagtcaggtagggcc

SEQ ID NO: 6783698 - DNA, 64 bp, Homo sapiens
acttgcaaagtgagggagtgttatcttacctagacccaagattaatttctcagactttggaagt

SEQ ID NO: 6783699 - DNA, 65 bp, Homo sapiens
gtcaggtacagccacagccattgggatggccttcactggcccagccctgggcttggctccatggc

SEQ ID NO: 6783700 - DNA, 59 bp, Homo sapiens
gcaggcttcaagcacagcttttagagactgcaactcagctggtgtgtgctggggcctgt

SEQ ID NO: 6783701 - DNA, 58 bp, Homo sapiens
ttggcagagggaccagcctacaggaactacacctgcagaagagctcagccactgccag

SEQ ID NO: 6783702 - DNA, 72 bp, Homo sapiens
gactttggccaagggctctttaggctgagaagtcttcagtggcgactggcaaggagccttagggacacagtt

SEQ ID NO: 6783703 - DNA, 82 bp, Homo sapiens
gctctgggctcagtctcctgggggctgttgttgctcacattctgtgaaaggcagcagagcctaggagcactccctccacagc

SEQ ID NO: 6783704 - DNA, 57 bp, Homo sapiens
tcactttagtttctttatacttttctcatgggaagtacactatggtaactggagtga

SEQ ID NO: 6783705 - DNA, 60 bp, Homo sapiens
tttctagtaaaagctaattaccgtgctcaatacagtactttaaacagtatttactaggag

SEQ ID NO: 6783706 - DNA, 64 bp, Homo sapiens
gattaatagttccttctactacctcctgagagtctgtttcaggaagtggtaaaggatgttggtt

SEQ ID NO: 6783707 - DNA, 60 bp, Homo sapiens
attgtattgtttgcgtctgtgttcccagtgcctgtgagcacagtgcctgacatatatggt

SEQ ID NO: 6783708 - DNA, 55 bp, Homo sapiens
gcatgcatttgtacttgattttctaaatatgtgaaggttgcagtccaagtcatgc

SEQ ID NO: 6783709 - DNA, 87 bp, Homo sapiens
gaaatccaatgtgttttgtgaaatgaagtcacaactgggactcatatcccagtaatgctgccatttctcaaaatatctttagaattc

SEQ ID NO: 6783710 - DNA, 70 bp, Homo sapiens
tctcaaataggccttggtcctgacctaactgaacaggataggttaggtcaggaccaaggcctgtttgaga

SEQ ID NO: 6783711 - DNA, 83 bp, Homo sapiens
gtggatcaaaaatttgaataggactcagcagtgatcatctgtctgtgatctgtgatggtcttgatcatcaagatttgatccat

SEQ ID NO: 6783712 - DNA, 98 bp, Homo sapiens
taaagctggatcttctatttatatatttttgtgatatttgattttccccaaaaagcagttagaatcaagagttgtgtaatatttaaggaaaagcttta

SEQ ID NO: 6783713 - DNA, 67 bp, Homo sapiens
acttcctgggaccgagggaagagctgcttctgcttcagtaacagcctctgatggctcccaaggaggt

SEQ ID NO: 6783714 - DNA, 108 bp, Homo sapiens
gctgactgaggtgtgttggggggttccagggtgacaagtggcaaggagctgggtttgcccttctccccagccctggtattctgatcacctcctatgaactccattggc

SEQ ID NO: 6783715 - DNA, 91 bp, Homo sapiens
ctgtgttcctttactctttcattgtatggatgctcgctgagcactttataggtgtcctcgctgagcatcttataggtgtcctggaatatag

SEQ ID NO: 6783716 - DNA, 101 bp, Homo sapiens
gagacaattcatatcatatggcctttactttctcaagtatataggaggcgagattcctattggctgaaagtgaagaagatacacatggatttgagggtttt

SEQ ID NO: 6783717 - DNA, 91 bp, Homo sapiens
tagtataggatgatgacagtgagggaggctgtatgtgtgggagaggaaggcatatacaggaactctctacactttctgttcaattttgctg

SEQ ID NO: 6783718 - DNA, 91 bp, Homo sapiens
ctgccatgtcttgggagcattctgtggctgtctttccagaggggctgatgggcttcctggttagtcacagggtacccagagagtctaccag

SEQ ID NO: 6783719 - DNA, 72 bp, Homo sapiens
gctcgcatcacctttgttctccaggcctcaaaacatgtggaaaagactgcctttaagaaaggaggtgtgggt

SEQ ID NO: 6783720 - DNA, 65 bp, Homo sapiens
tgctcaggtttcagttcctgatcatctcctctgtttggatttgtcagtgagttgggtcctgagta

SEQ ID NO: 6783721 - DNA, 118 bp, Homo sapiens
tatggtagacaatgaagactgaatttgttggaaatgaagagagaattttctgttcaatgcagtgcttgaccagagttttattagttctaagacacagtttaccttctcatctatgata

SEQ ID NO: 6783722 - DNA, 59 bp, Homo sapiens
tgggttgagagcagacttccagccacaagtcttcagggctacagaagctctcctatcca

SEQ ID NO: 6783723 - DNA, 78 bp, Homo sapiens
tgtttggggctctgctgctgaatggtagttcaaggactctggacataccatcattgtcacaccggaataaaccagaca

SEQ ID NO: 6783724 - DNA, 110 bp, Homo sapiens
tgtgtctgtcttgcaaattaagctgtgtccttctcgaaggtagggatgatacccttcatttctcatcacctagaatttaaaacattgctgatatatggcaggcagtcaca

SEQ ID NO: 6783725 - DNA, 77 bp, Homo sapiens
ggtgatgtgcaggccttgcagtctgttgtaatcaatcattatagaagttttgctgcgatgctggcctgcccaacact

SEQ ID NO: 6783726 - DNA, 61 bp, Homo sapiens
ccacagcttctgtctgattagcaagcttttaaagaagcaatttgcttacatggaagcgtgg

SEQ ID NO: 6783727 - DNA, 79 bp, Homo sapiens
cttatatatacacacacaggtatatatatgtacatatacacacatatatgtatatgtacgtgtgtgtgtgtgtgtcaag

SEQ ID NO: 6783728 - DNA, 61 bp, Homo sapiens
ccctggcccagccctacctacgtgctctgatcctgggagcccacagctgagctggccaggg

SEQ ID NO: 6783729 - DNA, 105 bp, Homo sapiens
cctggatttcctaattctgttcttttgttataaactgtgtattattttactggctttatggtttcacaaacaaaaggttcggcagaatctttggacatcaaatgg

SEQ ID NO: 6783730 - DNA, 96 bp, Homo sapiens
tacatttggcttcagttgttttcctcttttgtcagtaggtcatcaggaatttaccatgaggccatgggaagaggtggagagcatgttgtcagtgtg

SEQ ID NO: 6783731 - DNA, 61 bp, Homo sapiens
ccatttattatgttcatggattctctgagtcaggaatttagacagggcataaagaggatgg

SEQ ID NO: 6783732 - DNA, 56 bp, Homo sapiens
tgggctctgaaattctcacttttaggaaactggtttctgcagagtttcagggacta

SEQ ID NO: 6783733 - DNA, 63 bp, Homo sapiens
ctaaggcttggcttaattaattaaggccaattaattaaaattagttaaggccacttgcctaag

SEQ ID NO: 6783734 - DNA, 56 bp, Homo sapiens
tgatttacagtagtgtctaaacattgagtggccctagatatttctactgtggatta

SEQ ID NO: 6783735 - DNA, 76 bp, Homo sapiens
taagatatgacagctctagcacacagtaggtactcagaaaatgttagcctctgtgctggactgatttcatatttta

SEQ ID NO: 6783736 - DNA, 56 bp, Homo sapiens
gattgcatcttccctggagggctgcagagttttagggcactcacggaggatgaatc

SEQ ID NO: 6783737 - DNA, 74 bp, Homo sapiens
ctctgttcattccacgagtgtctgtcaagtgaaacttccaagtcactatgctgggtaccatggaggagacggag

SEQ ID NO: 6783738 - DNA, 83 bp, Homo sapiens
tagggctgttttgaagactaatttagataatgtaactagggtaggcagttccatgtctgagtcatggtacttctgaaccccta

SEQ ID NO: 6783739 - DNA, 71 bp, Homo sapiens
cttaaagcccctgagagttgatattccctgtggaggagaattgtattgatttttcagaggtaaaatttagg

SEQ ID NO: 6783740 - DNA, 88 bp, Homo sapiens
ccaggctgttctcaaactcttgccttgtgatctgcctgccttggcctcccaaagtgctgggattacaagcgtgagccactgcacctgg

SEQ ID NO: 6783741 - DNA, 71 bp, Homo sapiens
gcatccagctccaagtttgggcatcagcaatcctgcctgttggctgctaccaatgttggatgctaggctgc

SEQ ID NO: 6783742 - DNA, 92 bp, Homo sapiens
ggatcactggtcactgcagcttcataatgaggtcctagaggctctccagagtcattagaggcctttgtgaccatgcctctggagactgggcc

SEQ ID NO: 6783743 - DNA, 55 bp, Homo sapiens
tggcagttctagcaaactaatactgagaacctcagttcaagtcctagtattgcca

SEQ ID NO: 6783744 - DNA, 79 bp, Homo sapiens
agttcagcccctcagagttcagtatcaggtcacatttgtaggtggtctggccccatctggagtctgagttcttgtaact

SEQ ID NO: 6783745 - DNA, 96 bp, Homo sapiens
atttttttattaaaggtaagcagtcattatgggtaaagtttttatgttggctcttcttattaacacaaagacaacccactgacttaataggaaaat

SEQ ID NO: 6783746 - DNA, 87 bp, Homo sapiens
ttgcagttttatatgagtatgcatatatcacgtgcatgcatgcatgcgtgcacgcacatgtgtgtgtatcatcaattgagggagcaa

SEQ ID NO: 6783747 - DNA, 81 bp, Homo sapiens
gtttgaagcaattactcactcccattagaaatttgtgatttccaattttataaattattaaacagtgggatgctagcagat

SEQ ID NO: 6783748 - DNA, 66 bp, Homo sapiens
tttttcctgtgtgaatgtgtgtgtgtgtgtgtgtgtgtgtgcatacacacgtgcacgtgggaaaga

SEQ ID NO: 6783749 - DNA, 77 bp, Homo sapiens
tgtggcactttcagcaggcagacagaatacaaattaacttgaagcagtcggtctgcttctgagagcttctagccaca

SEQ ID NO: 6783750 - DNA, 59 bp, Homo sapiens
cttcacggtgcctacttgtgtctatgcttgtctctgcttaaaacacaagcaccttgagg

SEQ ID NO: 6783751 - DNA, 67 bp, Homo sapiens
gtttcaagtgtatgtgtgtttgtgtgaatgtgtacacatcccacagaaacatacataatattggaat

SEQ ID NO: 6783752 - DNA, 64 bp, Homo sapiens
taaactattgttttctttgttagaaaggccttcagaaaagaaggtagcttagaaagcaatttta

SEQ ID NO: 6783753 - DNA, 82 bp, Homo sapiens
gtgttctgttttgttttcagacttctactgaagtcactcaagaagagctagaggacttcaaaggtcaaacatcgcaggtcac

SEQ ID NO: 6783754 - DNA, 62 bp, Homo sapiens
acataacctagaggaagatgggtcagagaatgcttctcagagctgagtcttcaaggttgtgt

SEQ ID NO: 6783755 - DNA, 62 bp, Homo sapiens
caagtttaaagtgaggtttgaacttgaaacacaagagcttcaaaccttcacttgcagagttg

SEQ ID NO: 6783756 - DNA, 56 bp, Homo sapiens
ttcttggttgtcacgtggtcttggagaaatgcacggccatgtttccttactaagag

SEQ ID NO: 6783757 - DNA, 90 bp, Homo sapiens
ctttctcctttgggcaggggaagcctgtcacttcccttgcttagtttttaagcaggggaactgacaggcttagatctctattttagaaag

SEQ ID NO: 6783758 - DNA, 69 bp, Homo sapiens
ttaagtgggcttttaggggcttgttcctgcatatagaggaggcagagttcctggaaagcaaccatttga

SEQ ID NO: 6783759 - DNA, 56 bp, Homo sapiens
tacttctgttcttaaaccaagatgtttatcttcctgaggtggattgagcagaggtg

SEQ ID NO: 6783760 - DNA, 56 bp, Homo sapiens
ggcaggcacatttgggggccgtgagcacctcagcacaccctcttgcagtgtctgct

SEQ ID NO: 6783761 - DNA, 58 bp, Homo sapiens
gggatgcagtatgtatattttctaaatgaaaagttgaaagtgggcaacctgcactccc

SEQ ID NO: 6783762 - DNA, 76 bp, Homo sapiens
ctgatgacggggtgtaccactctactaagggttcccaacatgaaggtgagggggcccctgggaattctgtgattgg

SEQ ID NO: 6783763 - DNA, 83 bp, Homo sapiens
tttctcttggacttcagtgttattagatgaggtttgggaaagttttattagcactttttatcatgacactgggacaggagaga

SEQ ID NO: 6783764 - DNA, 95 bp, Homo sapiens
caggatttcctagacttttctggagtgtggaccgctgttttggaggcacacctaaaacttctgtccagcagtcttgcatagtctaggaaacactg

SEQ ID NO: 6783765 - DNA, 63 bp, Homo sapiens
gaggcctggggagcatgaattagaacagcccatagggactctggatcgggttcctcaggtctt

SEQ ID NO: 6783766 - DNA, 71 bp, Homo sapiens
ttggcttcttcgcacagcagtagtcttctaaatctcattttggactttgctgtaaagagaagaaagcacaa

SEQ ID NO: 6783767 - DNA, 128 bp, Homo sapiens
aggtaatctcattccactagagtttttcaaaccagtgatagactagacacagagcacatgccctgtaagatgtgtgtggtgctgttttgtctttggattgtattactgtgccttgaatgacattagtt

SEQ ID NO: 6783768 - DNA, 78 bp, Homo sapiens
aaattgtggatagtcctccctcccaaaatttgaactaattatcatttctcaattatgtggaagaggattaaacaattt

SEQ ID NO: 6783769 - DNA, 62 bp, Homo sapiens
agcagagggagccagcagcccgcggttggcgctgaggcccggcttctgaaatcccatctgtt

SEQ ID NO: 6783770 - DNA, 60 bp, Homo sapiens
gcctgtccatggcaatgatgcagaaggccacgaaggtctctgggttcagcttggaggggc

SEQ ID NO: 6783771 - DNA, 74 bp, Homo sapiens
tcacctagcttggagtaaggatgaaaaggtgccacaaaaccattcccagccaagtttacttgaagcataggtga

SEQ ID NO: 6783772 - DNA, 84 bp, Homo sapiens
attctgatgcaggctctgggaccctctcgctgttccgtagaggggagctgttgtctcagagcttcagaaagcacccatcagaat

SEQ ID NO: 6783773 - DNA, 77 bp, Homo sapiens
tggctaacagaagaaaacatattggagaaaaaatttctgaagcactgatttgtactccaatttgatctctgaggcta

SEQ ID NO: 6783774 - DNA, 77 bp, Homo sapiens
tggctgcttggtgatgtgttgctctattatggaaaacctttccaggagccttaggaaatacatctcagagctgtgca

SEQ ID NO: 6783775 - DNA, 85 bp, Homo sapiens
gggctacgcaaagagtgggctctggacaaacccttgctttttcctggtccaaaaaggctgagggccgcatagggtcatactcccc

SEQ ID NO: 6783776 - DNA, 84 bp, Homo sapiens
ctctaagaaggtacacctgcagtttgttgtgaccccgtttcagaacggacagaaccaagtgcaggcttactctatttggtagag

SEQ ID NO: 6783777 - DNA, 61 bp, Homo sapiens
agcaagagctgcccaaggtgaacagtccaacacttgggcttccccttgggaagctcttgct

SEQ ID NO: 6783778 - DNA, 57 bp, Homo sapiens
aaatgcagagatttggattcaaacttggtctgggatgaggctcacaaatctgcattt

SEQ ID NO: 6783779 - DNA, 82 bp, Homo sapiens
ctcttgtcaggtaaggatgattttaatctgcatttacagatgaagtaaggagaggttatttcatccttccctggatcatggg

SEQ ID NO: 6783780 - DNA, 70 bp, Homo sapiens
ggaataaacctggtggaacggtgaatactcagaatgtgtaggctggttgtacacaggaccattttgtttc

SEQ ID NO: 6783781 - DNA, 64 bp, Homo sapiens
tctgttcctggaatgccgtatgaagaggtaggaacaggccatgatcagaaggctccagagcaga

SEQ ID NO: 6783782 - DNA, 81 bp, Homo sapiens
taacacagcaatcgggtgatatgcaatttgccacttgtactttcaatttacagacctattgcatgccacttgtgttggtta

SEQ ID NO: 6783783 - DNA, 86 bp, Homo sapiens
atgtttctatggatctttctgcttttgaattacatggcctgaaaatgaagtaatctgaaagctaggagttctcatgcataaaacat

SEQ ID NO: 6783784 - DNA, 101 bp, Homo sapiens
tttccctcatggagtttataagagcagaggttgaataaataattacaagtgcatcatttactttagtaaacttatgttactttttatattctagaaggaaa

SEQ ID NO: 6783785 - DNA, 57 bp, Homo sapiens
gcctgagatgtagcgcagtggcaaaacaaactgccatctgaaaattacatcctaggt

SEQ ID NO: 6783786 - DNA, 109 bp, Homo sapiens
gccccctttccatgagtgtggatgggcggggcaagccgtcggggagcctggggaagctcagccctgaggggcttactttgcccgtggaagccagtgtgaaggttagggc

SEQ ID NO: 6783787 - DNA, 57 bp, Homo sapiens
accatctcctgtgcctccagcttcgcttttggggttggtggcttgtaggagggaggt

SEQ ID NO: 6783788 - DNA, 103 bp, Homo sapiens
tggctgctcccggggaggagcagaggtgagcccacctgggcagttctaggggatcatctcccccaggagggtggcctctgccctgagcccccaaggacagaca

SEQ ID NO: 6783789 - DNA, 78 bp, Homo sapiens
ggctgtctcatgtgtctatcatgtgggtcatctggaggcttggccatccaggctggcctcgcgtgacatgtggcagtt

SEQ ID NO: 6783790 - DNA, 61 bp, Homo sapiens
tgggtttctgaactcatagtgcattggttaagagccacctggctgcggttacagagacaca

SEQ ID NO: 6783791 - DNA, 86 bp, Homo sapiens
aggatggacagagggcagtgatggggatctcactggccagagacatctctctagtgctctatgctgacttgactctgttccaaact

SEQ ID NO: 6783792 - DNA, 88 bp, Homo sapiens
ggattcctggccaggggcggtggctcacgcctgtaatcctagcactttgggaggccggagcgggtcgatcgcctgaggtcaggagttc

SEQ ID NO: 6783793 - DNA, 58 bp, Homo sapiens
gtgaggtttataggcatcacagcatacattgcatttgttacatgagccctggcctcac

SEQ ID NO: 6783794 - DNA, 57 bp, Homo sapiens
tttcctgttcttctatttaaaagggtcactcttctatttaaaaagagtcacaggaga

SEQ ID NO: 6783795 - DNA, 64 bp, Homo sapiens
gagaatcaaggtgaagcccacaggtccatacatctgatagggctgaattttgagagggtttctc

SEQ ID NO: 6783796 - DNA, 72 bp, Homo sapiens
gctatgaagagagcagtggatcacctagcacagtgcttgagctctgctaagggataggctgcctcctcaagt

SEQ ID NO: 6783797 - DNA, 87 bp, Homo sapiens
tttgtgctgataccataggaaaggatcagccttccacttgtgtagaaagaaagaatattaggcagccttccttatggttcatacaga

SEQ ID NO: 6783798 - DNA, 105 bp, Homo sapiens
ctccctaatatgcaagcttaggttgctttggaattttccaggtacagtgttggagaagttgtaacacaggaggaggccagagcgtaggtttagtgtggtggggag

SEQ ID NO: 6783799 - DNA, 60 bp, Homo sapiens
acccagagccagggtcaggagcttagtagaagggcctgaagtagcccctgggatctgggt

SEQ ID NO: 6783800 - DNA, 80 bp, Homo sapiens
ccctgtccccctctcagagggaagctgcctctgaagaggcaggaagctgaggctctgagagggaagtgggttgcccaggg

SEQ ID NO: 6783801 - DNA, 82 bp, Homo sapiens
ggaagatcattctaggcctggcttgggcccagtccttgctggaagcttgaacagggccaggctctggagagaatgttcttct

SEQ ID NO: 6783802 - DNA, 94 bp, Homo sapiens
tgagaaatatgttgcaattccactttttcctttcgttcagtctttttcaggacacttgcagaaacaggagaaagggatccaacactgtatttta

SEQ ID NO: 6783803 - DNA, 59 bp, Homo sapiens
tctcttctgccctcctttcctggccttttcctgccttgatcctaggccggcagcagaga

SEQ ID NO: 6783804 - DNA, 89 bp, Homo sapiens
ggatactgcacacagacaggcctcttgtcttcctcacatgtgctgggccaatgacatgtggtgagaagaggctgtaaagtgagcctgcc

SEQ ID NO: 6783805 - DNA, 60 bp, Homo sapiens
cagccttctgaatgaacgtactggattccgaaagcagtgtggagttacatgtgaaggctg

SEQ ID NO: 6783806 - DNA, 64 bp, Homo sapiens
gcaggcagaaaaatgtaaaaagagagactggcctagtctcccagcctacatctttctcccatgc

SEQ ID NO: 6783807 - DNA, 68 bp, Homo sapiens
gtcactgggggaatggaaaggcttcgttgaagagtgacatttaatgtctttcaaattctgcctagaac

SEQ ID NO: 6783808 - DNA, 79 bp, Homo sapiens
acgtcctccagggcagtgactacagcggccgccaccccagggctgctgagcatcagggctgcccttggaccctggacgt

SEQ ID NO: 6783809 - DNA, 92 bp, Homo sapiens
gggtaagttggggttggattgtcacagaccttgcatgttgtgctaaggcatgcagaggtttccaggcaagttttgacatgatcagattgccc

SEQ ID NO: 6783810 - DNA, 71 bp, Homo sapiens
ggcactgctccccgagttagctggccagttcccctcggggctgccttgaccctggctccggaggcagcgcc

SEQ ID NO: 6783811 - DNA, 66 bp, Homo sapiens
gaattcaggcattccttctcctgtcttttggttaagctgacccaaagactgaggaaagtctctgtc

SEQ ID NO: 6783812 - DNA, 70 bp, Homo sapiens
ggaatccgtgtgatgtggactaggcctgtctctctccattgccagtaagctctccacatggctttattcc

SEQ ID NO: 6783813 - DNA, 91 bp, Homo sapiens
gtgggtagagggatttgctgccttttttccttagcattgaagccctggatatccccatggctatgcatgaggaaggtatccctgtggctac

SEQ ID NO: 6783814 - DNA, 109 bp, Homo sapiens
tcctataaactcctgaaaccagcctctagataaggatttctcaacttcggaactatggacattggggttaattattcgttgttgggaggctgtcatagacattatagga

SEQ ID NO: 6783815 - DNA, 111 bp, Homo sapiens
ctgtcagtgtgtgggacagtgacatccatggggcccaggatgagagccaagaccccctcctttagtttcccaggctcctgcttgatctctgtcctgtctatacaaaaacag

SEQ ID NO: 6783816 - DNA, 60 bp, Homo sapiens
tgtttgggaacatggaacccgaagacttaaactgtagactttctccaggtgccccaaaca

SEQ ID NO: 6783817 - DNA, 86 bp, Homo sapiens
catttgcaagctaggaaacagattcaacctaagacaatctagtcctctggagatccaggctgagtctttcgatttttagcagaatg

SEQ ID NO: 6783818 - DNA, 81 bp, Homo sapiens
gactctacattattaattaccataaagtttatctttctggccattttcattagaaaggtttatggtcagttgttgagactc

SEQ ID NO: 6783819 - DNA, 75 bp, Homo sapiens
gtgtttgggtgtacacgtggccatctttacacatatggggtcttggtgtgaaaatgtcactgtgcagatcaaagc

SEQ ID NO: 6783820 - DNA, 60 bp, Homo sapiens
actggacgtcaattaatattcttccaaaggactggcaggaagccatggtggacgtctagt

SEQ ID NO: 6783821 - DNA, 102 bp, Homo sapiens
cagagagggtggaaactggcgcaggtgtgggagcagcctcccttcggggtctcctcgaagtacccagggctctccccagcgctgcccgcccccagccttctg

SEQ ID NO: 6783822 - DNA, 80 bp, Homo sapiens
atttttgcttggtgtgaacttgttcttcatccagactaaatggtggtcttgaaagaaggggtctacatccaatggaaagt

SEQ ID NO: 6783823 - DNA, 58 bp, Homo sapiens
ttcagtagttgcttccctgactgcaaaggcaagcttatttagttgagtagctcctgaa

SEQ ID NO: 6783824 - DNA, 63 bp, Homo sapiens
gtgattccttcgtgagcagatgttagaggtctccctttgacagcttgttacaaagttgatcac

SEQ ID NO: 6783825 - DNA, 83 bp, Homo sapiens
agttttagctttgatggaatattttttgaggtctagtttaggttacactagaagatattccatactttgagctgtaaggaact

SEQ ID NO: 6783826 - DNA, 108 bp, Homo sapiens
ggaggcaggggcgagacaggattgcttgagccaggagtttgaggctgtagtgagctatggtcacaccactgtactccagcctgggcaacatagtaagaccctgcctct

SEQ ID NO: 6783827 - DNA, 66 bp, Homo sapiens
ggggtgtggatcatctgaggtcaggagttcaagaccagcctggccaacatggtgaaaccccatctc

SEQ ID NO: 6783828 - DNA, 80 bp, Homo sapiens
ggatctgcccactgcagatgtacatctttataacaagctttatcataatagagtatgattacatttgttagttgcagtcc

SEQ ID NO: 6783829 - DNA, 129 bp, Homo sapiens
agtaagacttctttaatgtcagcctctctcacctactctttacatagtgtggactactctttaagcagaccactggtccacactgtgtaaagagtaggtgagagagactgacattaaagaagtcttact

SEQ ID NO: 6783830 - DNA, 103 bp, Homo sapiens
aaatggttttaacacaggtatcagcatcagtattgtttaggaatataaaagagtaatatttcaggagcttttgctggttttgccttactaagtggcaccattt

SEQ ID NO: 6783831 - DNA, 92 bp, Homo sapiens
gctaatgaggacagtgctgctgaggagtttcttatatgtgtcttccagtacatgtgtgcaaagatttctctggggcatgtttttcagtctgc

SEQ ID NO: 6783832 - DNA, 78 bp, Homo sapiens
gaaaggccgataatgaatcagcatagggtgaggcatcctttttgtaaaagtcttatatttgcttgtttcatttctttc

SEQ ID NO: 6783833 - DNA, 68 bp, Homo sapiens
gtttagacagtctgggcacacatgaaaagtataattacatttttaccctgaggcctagctgtaaagat

SEQ ID NO: 6783834 - DNA, 62 bp, Homo sapiens
aagcagtgcctggatagcaacatgagtgatgctcacttcatgtggtctggccggtacttctt

SEQ ID NO: 6783835 - DNA, 58 bp, Homo sapiens
tgcaggagggagggttacagtttctaaaaagagctggaaagacactgctctgctggcg

SEQ ID NO: 6783836 - DNA, 79 bp, Homo sapiens
gcatacatcaaggcacgtactaggaagttcctggagaggtaggagcctgatcataaacacactagtatgattgatatgc

SEQ ID NO: 6783837 - DNA, 68 bp, Homo sapiens
tggatgtgcaagatgagaaccagttgtcaaggattctttcttcttttgaatttctcttgcaatattta

SEQ ID NO: 6783838 - DNA, 62 bp, Homo sapiens
ttggaggcttctggaaagcctggcagttggtggagtgctgctggagcccaggcggcctttga

SEQ ID NO: 6783839 - DNA, 68 bp, Homo sapiens
gaaaacttggatttggttaatttaggtttctagaatataaatcctgaagaattcaaatccagattttt

SEQ ID NO: 6783840 - DNA, 90 bp, Homo sapiens
gcttatggtgtgatgtgggtgaaattagtataggcagggtgtttggaattatgtaactagataatgctatttaccacacatcatttaggc

SEQ ID NO: 6783841 - DNA, 130 bp, Homo sapiens
agaagcatcccgggctacattttcatcttcgccgtcttccaatcttgcataatctataataatgtgattccaaatgcattttagcaaatgcaagatggaatgggactcccccggctgctcccgaacatct

SEQ ID NO: 6783842 - DNA, 75 bp, Homo sapiens
gtgcgtctatctcctggtacccttcctagcatcaattctgtatttgtaggagtccaatcaggagacacaaaccac

SEQ ID NO: 6783843 - DNA, 75 bp, Homo sapiens
tttcctactgccctatacacacaagcctattttattactttgtttgaagactgggtgtgtctaatgtagtggaaa

SEQ ID NO: 6783844 - DNA, 62 bp, Homo sapiens
tttttaaatatgcttttggcttcgagtggcaataactagattcaagacagcatatttaagaa

SEQ ID NO: 6783845 - DNA, 70 bp, Homo sapiens
gtcttattctgtgtatctccaaaggcactcattgttagagtctgggagtgaagcaacagatggatgagat

SEQ ID NO: 6783846 - DNA, 62 bp, Homo sapiens
atttggcagccacagcaatctttgtgaaatatgacttttatcctgctgggatcctgctaagt

SEQ ID NO: 6783847 - DNA, 75 bp, Homo sapiens
ggggagaagtacagtagaatttttagtaactttcttaatcacagcagttcactttctctgtacaaaattcttttc

SEQ ID NO: 6783848 - DNA, 83 bp, Homo sapiens
agacttttgaagaggccagatcatcatagatgggagaaataaatctcaacacaggctaatgaatttggtctactcatctgtct

SEQ ID NO: 6783849 - DNA, 68 bp, Homo sapiens
gcatcactgcccattaaaggtgctttgactctatatctctttttcagtagcccactagtatgcagtgc

SEQ ID NO: 6783850 - DNA, 56 bp, Homo sapiens
tgcggctgggttcggggtgggtagttgcagtttcattcatgagataaccagctgta

SEQ ID NO: 6783851 - DNA, 58 bp, Homo sapiens
acccaggctggagtgcagtgatgtgatctcggctcactgcaacctccgcctcccgggt

SEQ ID NO: 6783852 - DNA, 58 bp, Homo sapiens
gtctaggctggagtgcagtggcgcgatttcggctcactgcaacctctgcttcccaggc

SEQ ID NO: 6783853 - DNA, 87 bp, Homo sapiens
tctgggccgaggaaagccatgctctgcagcagacctgtgcgcccccagggctgcaggctgctggcagtagcttcctgatcagccaga

SEQ ID NO: 6783854 - DNA, 75 bp, Homo sapiens
gctgccaaaggccaatgttgttctcttgtgatgcctttttggcgtgttacataacattgagcagcattcctcagc

SEQ ID NO: 6783855 - DNA, 100 bp, Homo sapiens
tgaggcaggaggatcacttgagctgggaggtcaaggctgcagtgagctgtgatcccgccagtgcattccagcctgggcaacagagcaagaccctgtctca

SEQ ID NO: 6783856 - DNA, 82 bp, Homo sapiens
gtcggctcagacctggcagtagctgacacacttgctgtctagacaaggctaagagctggtgtgccactgttggggagtgggc

SEQ ID NO: 6783857 - DNA, 56 bp, Homo sapiens
ctgaaaggccaagcatgaggtggacagagaagtgaccattacatctggccttttgg

SEQ ID NO: 6783858 - DNA, 76 bp, Homo sapiens
gtatttgctcaacacattgaagctatgatgattcactgaaacatggatctcaattagtacaagtgtgagcaggcac

SEQ ID NO: 6783859 - DNA, 61 bp, Homo sapiens
tctctagtcacacagtaaggacgggctaagccagctctgaatccagttgtgtgactccaga

SEQ ID NO: 6783860 - DNA, 68 bp, Homo sapiens
gctcaggacctgaactgtaggcttccctcacaatgagaagtaaagctaagtataggtgaatcctgagt

SEQ ID NO: 6783861 - DNA, 60 bp, Homo sapiens
gctcagagagaggatatgttatggctcaatgactagagttttcattccccatctctgagc

SEQ ID NO: 6783862 - DNA, 77 bp, Homo sapiens
ggaattagctctctaaatgccctacaatgactggctgccttgtcagtcctctgagggcgatttgagtacctaactcc

SEQ ID NO: 6783863 - DNA, 85 bp, Homo sapiens
gtagccagtaagtggtagagttgagatttaatcccaggactgactgattgcagaacctcaactcttaaccactatactaccctgc

SEQ ID NO: 6783864 - DNA, 58 bp, Homo sapiens
cttcagctttttaacataggatgcgttagatttttctattcttattgagcagctgagg

SEQ ID NO: 6783865 - DNA, 60 bp, Homo sapiens
actcaactgccatacagctccatggttcagagcactgttttaggagttggtggcctgagt

SEQ ID NO: 6783866 - DNA, 71 bp, Homo sapiens
tgggagctaataaattgtagtcattaagagagggacctctggagtcaatgtctagagttttaagcttacca

SEQ ID NO: 6783867 - DNA, 75 bp, Homo sapiens
gaaaggcatggatagtgaattcagagcttatcagtgctgtctcttttatttgaaattcattgttttatgtgtttc

SEQ ID NO: 6783868 - DNA, 81 bp, Homo sapiens
cctcatggtatgttgatcataggtaaaagacggccatgttaggaccaagtctcagggaccatgatgatgactccatgtagg

SEQ ID NO: 6783869 - DNA, 55 bp, Homo sapiens
ctcccgctggactgcgctgcggtttctctgcacagcgcttgtcgggtgtgttgag

SEQ ID NO: 6783870 - DNA, 87 bp, Homo sapiens
tgatagctatggggaatataggacctctgggaacagaaaattaatttgtctcattattttctatatctcactattccctaagctgca

SEQ ID NO: 6783871 - DNA, 58 bp, Homo sapiens
ggcctgtctcacccccgggtgcctgtgctctcagcagacagttgggggtgaacaggcc

SEQ ID NO: 6783872 - DNA, 81 bp, Homo sapiens
ttcacacacaacacactgagaggcatcgtggttgaataacccatctgaggccaatagctactgagtagtgtagtgggtgaa

SEQ ID NO: 6783873 - DNA, 65 bp, Homo sapiens
aggcaatcctcttacagatgggggagaggctcaggcccacccatcagagtctagaggaagtgcct

SEQ ID NO: 6783874 - DNA, 56 bp, Homo sapiens
acttgaaaagctcagcagtagtggtgaaaaaatgataatgagctggcatttcaggt

SEQ ID NO: 6783875 - DNA, 56 bp, Homo sapiens
gctctcaactgagactgcatgaagtctacagcttcatttcatccagccttgagagt

SEQ ID NO: 6783876 - DNA, 60 bp, Homo sapiens
ggtgtggcatttttcaaggggcacaggcggcatttgtgccctgtgttgggaatccacacc

SEQ ID NO: 6783877 - DNA, 57 bp, Homo sapiens
gctgaccagcttaattccctatcataacagatgaagcaagatagaaagctgctcagc

SEQ ID NO: 6783878 - DNA, 86 bp, Homo sapiens
tagccttgggtgagttttgtaatattcaagatctgcatgagtaaatcactcatttgataatgctgcaacagctcatctgatcccta

SEQ ID NO: 6783879 - DNA, 82 bp, Homo sapiens
tgaggctagaccagttctgacacaagcacagttgccctgatctccggtggctgagtgaggtccagagcttggcagggcctca

SEQ ID NO: 6783880 - DNA, 63 bp, Homo sapiens
taaagttcaaagctgcagtaatggaaattggaagagtaagtttcctatgagttttgaatttta

SEQ ID NO: 6783881 - DNA, 70 bp, Homo sapiens
catacttctaagctcaaattggtatatttttaacatggtatatggatgagataatgagccatggaagatg

SEQ ID NO: 6783882 - DNA, 55 bp, Homo sapiens
atggcaatgaacgtctacggcacaaccgcagtgctgtgactgttgcatttgtcgt

SEQ ID NO: 6783883 - DNA, 72 bp, Homo sapiens
ttcatctggctgtgttcatcctgcccaggtcccggcccctggccacttggtcgtggtgcagcatggcgtgaa

SEQ ID NO: 6783884 - DNA, 66 bp, Homo sapiens
gagtaaaatgtaaagtgctttctgagcataagtcattatttaaaaggagagtgcttttcattgctc

SEQ ID NO: 6783885 - DNA, 72 bp, Homo sapiens
ttcattttgtttagctgtctggccaggcctagctcataggtcaagtttagatagagttaaaatactagtgaa

SEQ ID NO: 6783886 - DNA, 126 bp, Homo sapiens
gtttcagcttctccttccaacttgtctgaaatttaaactgttgattttatgaagttggtgtgtttattttacttcttcaccctgcattaatagtttgatagaatgaccaactggggaagcagagac

SEQ ID NO: 6783887 - DNA, 78 bp, Homo sapiens
gatttgaaagcagagcagggcacttatggccaacatttaatggtttttaaacatatggctctatttgctcttcaagtc

SEQ ID NO: 6783888 - DNA, 75 bp, Homo sapiens
gggtactgggcctgggagggcagacgctgagggcagagcaagggccctggagtcagaacccaggcttctagtccc

SEQ ID NO: 6783889 - DNA, 62 bp, Homo sapiens
cactgactttctgacaccctctgtgctatgatgaaaaaagcgagggtcagagagcgtgagtg

SEQ ID NO: 6783890 - DNA, 79 bp, Homo sapiens
gggagaagattttcacaaagctggagcatttcctccactgcctgcactgaggagttgccaaggcttgaaaatctcttct

SEQ ID NO: 6783891 - DNA, 100 bp, Homo sapiens
gatttggggtggagagttcggtagatgtctattaggtctgcttggtgcagagctgagttcaattcctggatatccttgttaactttctgtgtcgttgatc

SEQ ID NO: 6783892 - DNA, 55 bp, Homo sapiens
tccatacatatccaaagagaagttcctcattcttttctgcatatgtatgtatgga

SEQ ID NO: 6783893 - DNA, 56 bp, Homo sapiens
ggcaggaggtgagtggcgggtgagcgagcattgccacctgagctccacctcctgcc

SEQ ID NO: 6783894 - DNA, 130 bp, Homo sapiens
agaaggaaatacaaccttcattctaagaggttctccgaggtcatgcgggcagcttctcccaggctgtttgtgaaatatggggggaagatgctctcggaggacccaagcaaagaagcctatttatccttgt

SEQ ID NO: 6783895 - DNA, 61 bp, Homo sapiens
gctaggctcttccatcagggcaaacacgtttgtgagtggggtcaggtgggagtagcctagt

SEQ ID NO: 6783896 - DNA, 128 bp, Homo sapiens
ctcattgtaaatacatattaactctcaccatgatgagaaggctgatgacagattctgctcaccttaatggtggggcagggccttggtcatctttttaacccggtgattagtgggatgtctgcagagag

SEQ ID NO: 6783897 - DNA, 72 bp, Homo sapiens
tattccctgacagatgagggagtattctcaggcagacctctagaatcactgtttccatctaggcagggtgta

SEQ ID NO: 6783898 - DNA, 70 bp, Homo sapiens
tatgggataataaacacagccggagtctgaagcaccttgagggacatcctgctgtgcttattatcctgta

SEQ ID NO: 6783899 - DNA, 123 bp, Homo sapiens
tctcggtttgatgaaccttgatggctcatctgatcattgaacaggcactggagctggaaatactttcagatatttccactggctttcagtgatcttgaaagctagaaagaaaaaagaaagaga

SEQ ID NO: 6783900 - DNA, 69 bp, Homo sapiens
cagaagtatttagtcttcattcctgtgtttgaagcagaaaaaaaggtattgagggctaaccagactctg

SEQ ID NO: 6783901 - DNA, 55 bp, Homo sapiens
gcataaatttggcctgggctggcatattaaagctgagtcacatccatttttgtgt

SEQ ID NO: 6783902 - DNA, 65 bp, Homo sapiens
tcaagtgcttttttcttgaggccattagagcaccatgtcactggttggcaagagagaagtattga

SEQ ID NO: 6783903 - DNA, 65 bp, Homo sapiens
ggcctcccaaagtgctggggttacaggcatgagccatcgcgcctggcccctacatttttaatgcc

SEQ ID NO: 6783904 - DNA, 55 bp, Homo sapiens
ctgctgcttagcatagcagaggcagcatccagattgtaagctggtcaagcagcag

SEQ ID NO: 6783905 - DNA, 129 bp, Homo sapiens
tacaagaagtcatgatggaaagaaggaggtttggagaggggctgagttgggtcggtctttggcccttgccacagtccactcactcttagtcactcaacctccatttccaagctgcattcccttcttaaa

SEQ ID NO: 6783906 - DNA, 86 bp, Homo sapiens
atccttgcctattaattcttgccaattctccttgtacaaattcaaggtggatttgcctggagaagtgggaggaagtaatagaggat

SEQ ID NO: 6783907 - DNA, 58 bp, Homo sapiens
gtggctcatccatttgactttttctttcataggaagaacaggacactgggatggctac

SEQ ID NO: 6783908 - DNA, 69 bp, Homo sapiens
gagcaaaagttattacagaagttgcaaacatatcactgaagaaactgcttgtagtgacttgccttgctc

SEQ ID NO: 6783909 - DNA, 59 bp, Homo sapiens
agaatgcttgtacctttgttttgttggggaattcactgaagagggaggtacaagatttt

SEQ ID NO: 6783910 - DNA, 56 bp, Homo sapiens
tagggaaattgtggaacttttaaaatacagaggggttccagagattgtttcacctg

SEQ ID NO: 6783911 - DNA, 91 bp, Homo sapiens
gtctcagagaagagtggaacagcttttttggtcagcattttgaaataaaaattgtggaccaggtagagctttttggcattccatctgtgac

SEQ ID NO: 6783912 - DNA, 96 bp, Homo sapiens
tgcattatgtattttatattgtttatttttgtctgcatgaaagattggaatagtaaccgtgtatgataaatgttaataataataaagtgaaatgta

SEQ ID NO: 6783913 - DNA, 75 bp, Homo sapiens
cctgctggccaggatgccttagttcatgcccttactgctattgcttgggctctgactgagcttcctgcctccagg

SEQ ID NO: 6783914 - DNA, 65 bp, Homo sapiens
ctcctgcggtactactgtgcttgctgtgtgttcatctctgcaggaagcagacagagcggcagggg

SEQ ID NO: 6783915 - DNA, 56 bp, Homo sapiens
atttctccttgttgcaatgcagttcaagtacaagagggttcggtgcaaggagagat

SEQ ID NO: 6783916 - DNA, 64 bp, Homo sapiens
ctgctgcctagtccaagacgtgcctacactaccatcatattatactcttgttcctgggctgcag

SEQ ID NO: 6783917 - DNA, 87 bp, Homo sapiens
ggctcttgtaaccatgtcttgttttcctagttgtttagaacccaaacactagaagccagaaaaccttcagagaatggactcagagcc

SEQ ID NO: 6783918 - DNA, 67 bp, Homo sapiens
ccaccagtgccctggacggcggccccagcaactttggagctggccgcagtgtaccaggtatgtgtgg

SEQ ID NO: 6783919 - DNA, 62 bp, Homo sapiens
gtcctgagcttgatccttctgtctctatctctgtacacctgggacaccttgcaggctcagac

SEQ ID NO: 6783920 - DNA, 80 bp, Homo sapiens
acaaagctggtaattaagtgcacagtttggaggctggttgcctgtgttccagtcccatctctgtcgcttactagctgtgt

SEQ ID NO: 6783921 - DNA, 59 bp, Homo sapiens
ggagttaagtagatgaagtttttggtaaataaccaggcttcaccagactcttaatctcc

SEQ ID NO: 6783922 - DNA, 60 bp, Homo sapiens
aggggcatagattagctctctcttatttccctgaagaagagttgtatcctatgtgcttct

SEQ ID NO: 6783923 - DNA, 98 bp, Homo sapiens
gaattgactgttgtaaaatgtgcgtggatagtggttgattgtttctttggcagagtcattatttatgcaattatttgtagtacacacattaacaattc

SEQ ID NO: 6783924 - DNA, 73 bp, Homo sapiens
agctcccaaactataaacaagtgtccttttcacagtctacttaaaagtggcacgctttttggagttttgagct

SEQ ID NO: 6783925 - DNA, 63 bp, Homo sapiens
atggcttcctctggattggatttcccttggcttccctgagggcaatcccccgaggaagcacat

SEQ ID NO: 6783926 - DNA, 95 bp, Homo sapiens
gttggaagtgcatccttaaccagcatcacttcagaggtgctttaactggaacagcacaaaatagttcagtgttggttaagatgatgatagctgat

SEQ ID NO: 6783927 - DNA, 121 bp, Homo sapiens
gcgaaatctgagccttggggggtgcaaatggacccctttcccttctggctcagggaggttttgggcttacgctcgagtcctggccgaagtggaaagggcataactcagttttggagaacgc

SEQ ID NO: 6783928 - DNA, 77 bp, Homo sapiens
gatgaggtcatcggccggtggtgcagaggactgatctcccctaacaattgaccagctctctagccctggtcctcgtt

SEQ ID NO: 6783929 - DNA, 73 bp, Homo sapiens
agaggtcatgcaaggctgaaacatggtgggtttctggcccaccaaaagtgaaaagacctttctgggtacctct

SEQ ID NO: 6783930 - DNA, 75 bp, Homo sapiens
acactgatgttggccctggtcatatggaaggtgattggtcataacatgacatgtctgaccagaggccttcggtgt

SEQ ID NO: 6783931 - DNA, 55 bp, Homo sapiens
caagtccagggccatgaagttgcacacctccaggtggttggtggccctggagttg

SEQ ID NO: 6783932 - DNA, 79 bp, Homo sapiens
gcaaaagaagattcagttaagcactataccctaaggcatccattgcattgtatgtagtgacttaatttctctcttatgt

SEQ ID NO: 6783933 - DNA, 63 bp, Homo sapiens
tggggatcttgttaaaatgtagattgtgattcggtaggtctgcattggagacaagagtctgca

SEQ ID NO: 6783934 - DNA, 67 bp, Homo sapiens
agcctgttcagggagacagactaaactaccatggtaacagtgtggacttttcctaggaggttaggct

SEQ ID NO: 6783935 - DNA, 72 bp, Homo sapiens
ctccttggtgtagtactgagcaattcatcttcctcttgacactgccctcacctgtatctgaatgccaagggg

SEQ ID NO: 6783936 - DNA, 64 bp, Homo sapiens
ctaatgtaaactatgggctttggaggacaacgatgtgtccttgtaggttcatcagttgcaatag

SEQ ID NO: 6783937 - DNA, 58 bp, Homo sapiens
tagtcctgggagatgggaccctgaagttcctgcctcagttctgccatccccagcactg

SEQ ID NO: 6783938 - DNA, 86 bp, Homo sapiens
tttgttaacagtgaacatacttttgcattgttccacaaactcttaagatggttttgggcagtagatgtatcacttttagaaacaga

SEQ ID NO: 6783939 - DNA, 63 bp, Homo sapiens
tgcaattcctctggagcctatgttgtcaacagctcactggcctgaagaggacgaactgttgca

SEQ ID NO: 6783940 - DNA, 88 bp, Homo sapiens
agtcatttctaggccctttttccctccaaaatgcattactgagggctcttttttgagttggaatggagagggggtttgtgagaagact

SEQ ID NO: 6783941 - DNA, 86 bp, Homo sapiens
atgtagactcctttttcaggcatgcattctgcaggttagaatttgtctctcctaaccacattgtggttgtgtccctggaactacat

SEQ ID NO: 6783942 - DNA, 94 bp, Homo sapiens
agtggggacacgccttctttaaagtcctttgaattgaattgccggactctcacaatcagacagaaggactatttgaatttcaggcctccccact

SEQ ID NO: 6783943 - DNA, 61 bp, Homo sapiens
ttcctggacaggattgaaatgagaattcagaagtactagagcttagtatcctgttaaggag

SEQ ID NO: 6783944 - DNA, 78 bp, Homo sapiens
gtacattgcacaactacaggaaaagtcattcataaagtctttgatgtgaatagtgttccctggagttgtacagtgtac

SEQ ID NO: 6783945 - DNA, 107 bp, Homo sapiens
ggcagagttgctagtggttaacttcccaaaacactggttgttaatagtaacagctgatacgctgttgtctggctgcagctgtgctgggaaatcaatagttctttgtt

SEQ ID NO: 6783946 - DNA, 57 bp, Homo sapiens
ctgatttctccagagtttctctcactggcagttgactctagtgtttttctggagcag

SEQ ID NO: 6783947 - DNA, 60 bp, Homo sapiens
ggcaaatgttatcacttgtaaaagcaattaagaaaattgttaggctgtggtgacagtgtc

SEQ ID NO: 6783948 - DNA, 64 bp, Homo sapiens
tgagcatcattgtccacatgtgtactcctgtttttgtatactctgtagatgtggaaatgcgtca

SEQ ID NO: 6783949 - DNA, 81 bp, Homo sapiens
gatgccaggcagcagtcagtaatgtggcacctgttttcctccaaaggcacatcatgacatgtttctgactctgatggagtc

SEQ ID NO: 6783950 - DNA, 79 bp, Homo sapiens
ataagttggttggagagaaaattagtagagagcaatttgtcaatgcctttacaaagcaattttgtctctaggtatttat

SEQ ID NO: 6783951 - DNA, 61 bp, Homo sapiens
attccacagtgccttccgtgaacactgcacacagcagctcatctgtaagtatctgtggagt

SEQ ID NO: 6783952 - DNA, 59 bp, Homo sapiens
gagaatgtttctgtctgcccttggccatctgagccacacaagaggtagataagattttc

SEQ ID NO: 6783953 - DNA, 57 bp, Homo sapiens
tgggtgggaatgggcacacactccctgagccccattgtttaaggccatttccaccca

SEQ ID NO: 6783954 - DNA, 59 bp, Homo sapiens
ggtgtgtgtggattagcatgccctgactactctgggtctgctggtgacacggtcacatt

SEQ ID NO: 6783955 - DNA, 72 bp, Homo sapiens
tttcagtgcctggtgtagcatagggagggatagagtaggtgtccaatcatgagtctatactaggagatgaga

SEQ ID NO: 6783956 - DNA, 102 bp, Homo sapiens
tctttaaatcaatagagctttgtctctttttctcttgttcagatgaatttccaattggaaatgtcatttaaagacaaagaaagagctctgatgacttaagga

SEQ ID NO: 6783957 - DNA, 91 bp, Homo sapiens
aaagaaaactggcggtgcctgtgtgctcttctgtgcattaatacctcatgcattcctggacaaacatcaaaagcactgctggtttgtcttt

SEQ ID NO: 6783958 - DNA, 130 bp, Homo sapiens
ttgccatttactggctctttcacttgacttagttgagttcctcaaaaaggagagccccagaaaatgccttgggtgcaggttgcttatttgagggtgactgcaggaaatgagagtgagggtataaggacag

SEQ ID NO: 6783959 - DNA, 70 bp, Homo sapiens
cgctcaacagactgtcatgacactatataatagattgatttttaatgtagtgtagagattagtctcagtg

SEQ ID NO: 6783960 - DNA, 69 bp, Homo sapiens
gctgggcctgggccctcaccgccggtggtcctctccccaggcgcgccgtcggcgggcaccgggccttgc

SEQ ID NO: 6783961 - DNA, 58 bp, Homo sapiens
tgagatgaaagcagaaagacttcagtgtacatttattgagtctgacatttttctctca

SEQ ID NO: 6783962 - DNA, 64 bp, Homo sapiens
tcttcaggtgcgagagaggctggggtcagcgacctggggctttctttgtatcattttatgaaga

SEQ ID NO: 6783963 - DNA, 72 bp, Homo sapiens
ttgtgtgtttgtagaaaatccatttcaagtcatgtcatcattagaggaatattttctactgttaacacacga

SEQ ID NO: 6783964 - DNA, 69 bp, Homo sapiens
cattcctggtgagatttcgttctgtccagttccagctcccacaggacccttgatctcacttgaggtttg

SEQ ID NO: 6783965 - DNA, 67 bp, Homo sapiens
ggtcagagggtgggctgcctgtcatttctgcagccacagcctgggtgctgggcagctccctctgtcc

SEQ ID NO: 6783966 - DNA, 76 bp, Homo sapiens
tttctacttgaaaacattttctcttgattccgtgtatgaacaggatgatggaatggaggacatgtgggagtggaga

SEQ ID NO: 6783967 - DNA, 58 bp, Homo sapiens
tgaaaaacactaattggaaagcaatactattttctggtttccaatttgtatgttttca

SEQ ID NO: 6783968 - DNA, 79 bp, Homo sapiens
agctgtttattacccagagtgggcgtggtcgcaacagacaatctgtctggcaagctcgtttgggtcagaaagaatggct

SEQ ID NO: 6783969 - DNA, 55 bp, Homo sapiens
gcctcgcccgccagcagcacgttgcccaggtgcgagatgtagctggaggccaggc

SEQ ID NO: 6783970 - DNA, 67 bp, Homo sapiens
gcggcaagacagaccttacaagggactcagggccaagccctggcccagactctgctcttatccacgc

SEQ ID NO: 6783971 - DNA, 100 bp, Homo sapiens
gaggcaggagaatcgcttgaatccgggaggcagaggttgcagtgagccaagatcaggccactgcactccagcctcggggtcaagagcgaaactctgtctc

SEQ ID NO: 6783972 - DNA, 59 bp, Homo sapiens
agtcataactgtcctgggtgagaaaaaatggacccccactcggctggacactgtgcact

SEQ ID NO: 6783973 - DNA, 84 bp, Homo sapiens
cttggtcggtgtacatgctccactttctcctgtgggacttagttttctcatcagaaaaatgagaagagctgcttactggttagg

SEQ ID NO: 6783974 - DNA, 119 bp, Homo sapiens
catattgaacatctgttctataccaggcatagtgtttgacactgagataaataaaacgaaaaatctgttttaagaagtgcagaggcttgtaaggaataaaatataaaaagtttaatgtg

SEQ ID NO: 6783975 - DNA, 69 bp, Homo sapiens
tagagggaatatcagagcaacatcagggcctaggtcatatagagccctgtggttctggtaaggattttg

SEQ ID NO: 6783976 - DNA, 59 bp, Homo sapiens
gtgttactgcttttatctaccaagagctctcatcctgaggctcatgaaagctgtggcat

SEQ ID NO: 6783977 - DNA, 68 bp, Homo sapiens
tcagtgtgcagccccgtgcagtgagaaaacaaatgcccaaggcttctgatgatggcggctggagctga

SEQ ID NO: 6783978 - DNA, 115 bp, Homo sapiens
ggatacctgtatgacttctggtcacatctctactacccaaagcaaaattacttgattgtatcccttgtgtgttggtgtagttatggtggatagtgctaatagtttcccagtatcc

SEQ ID NO: 6783979 - DNA, 83 bp, Homo sapiens
gctgcaattagggacaactatttccgaagcagagaggggtttctctgtgtcttctctattacagaaatggaatcctttgcagc

SEQ ID NO: 6783980 - DNA, 114 bp, Homo sapiens
aggcctcctgggggctgacagcagctgccttcaggctctcagggtggggtccttcaaggagcaactgagcagctgctgtgctccatctttctcttgcccatcctgggagagcct

SEQ ID NO: 6783981 - DNA, 57 bp, Homo sapiens
ggtcagtgaatgtttgagcagagtcttctatgcctgcttggacagcaattattaacc

SEQ ID NO: 6783982 - DNA, 102 bp, Homo sapiens
tgagacaggagaatcacttgaacccaggaggcggaggttgcagtgagccgagatcgcatcattgcactccagccttggcaacaagagtgaaactccgtctta

SEQ ID NO: 6783983 - DNA, 124 bp, Homo sapiens
atccagggaggatttgtgaagggaagatggtgaagctgaggatacatgaagcctccctcaaccaggtaggcttcatgtgtcctgggtgacccaggcctttgctcccctccttcctccctcggat

SEQ ID NO: 6783984 - DNA, 60 bp, Homo sapiens
gcacacgcttgtgtcgctcctgcattctagatagattgggctgatgttacacaggcctgc

SEQ ID NO: 6783985 - DNA, 59 bp, Homo sapiens
ggtgcatggggagcactctcagggcctctcatgcgcatcctgagcccttcctgtgaacc

SEQ ID NO: 6783986 - DNA, 61 bp, Homo sapiens
tcagagaaggaggcacgagggctacaaagctagctaaagagcccatgcttccttctgttgg

SEQ ID NO: 6783987 - DNA, 62 bp, Homo sapiens
gtgcagcaaactagtgcgagggtcatgtcagctccctattttctatctctagtccgctgcac

SEQ ID NO: 6783988 - DNA, 59 bp, Homo sapiens
cctgccaaagccatatctcagtaagcaaaggaagtgcttcttgaattgttttgagtagg

SEQ ID NO: 6783989 - DNA, 83 bp, Homo sapiens
acagcaaacagtttattgaaagcatggatttggatttggactgatctaactttgaatccaagtttcgctttttgtttgcttgt

SEQ ID NO: 6783990 - DNA, 62 bp, Homo sapiens
tttttattaagccatcttttagctgacatgtgaagagtgagcaaatgctggctggatgagga

SEQ ID NO: 6783991 - DNA, 66 bp, Homo sapiens
tttgtgtccctgcggctgaggagaaacggctactccgcgccacctcatccaccgacaggccacaaa

SEQ ID NO: 6783992 - DNA, 67 bp, Homo sapiens
gtaaacagccatcagtaaagacagcttgtatacaattctgaaaaggcggtcattgatggttgttaac

SEQ ID NO: 6783993 - DNA, 86 bp, Homo sapiens
tgcatgcgtgccacttgttcagctgtatcttgctgcacttgctatcaccagggcaagcagcatgctatgctggtggctgcagagta

SEQ ID NO: 6783994 - DNA, 58 bp, Homo sapiens
ccgaagaaagggctattgttctccaggatcccctggctcttaaccgttttttcagcgg

SEQ ID NO: 6783995 - DNA, 78 bp, Homo sapiens
tctgacctaataaactgctacgcttagttatcatcaactgagatgaaaaagctgaggggggcaggtttggaaggaaga

SEQ ID NO: 6783996 - DNA, 64 bp, Homo sapiens
gccctgctgcaggttcacctacctgaccatgacgggcgaggaggtggagctgtgcagccggggc

SEQ ID NO: 6783997 - DNA, 73 bp, Homo sapiens
tattgcaaaaagttccagtttttgcattttctcagttttttaaagaggaagatgtgcaaagttggaagcagta

SEQ ID NO: 6783998 - DNA, 81 bp, Homo sapiens
ggagatggcggaggctggtggttagttccatttaaatgagcccattggggtgaactcataaaccttcagttttcaatttcc

SEQ ID NO: 6783999 - DNA, 66 bp, Homo sapiens
gtgcccatgtgcaggaagctctcagtttgtttataagtgaaaaaggctaagcatcttgtgctgtac

SEQ ID NO: 6784000 - DNA, 58 bp, Homo sapiens
gccttggcttcttcatatgtgatcttagggttcctaagggcagcaagagaagccaagc

SEQ ID NO: 6784001 - DNA, 55 bp, Homo sapiens
ggtggttcatgcctgtaatcccagcattttgggaggctgaggcaggcggatcacc

SEQ ID NO: 6784002 - DNA, 58 bp, Homo sapiens
ctatcaaaaggagttgaaaggggcttccttagaccctgaccaccagctccatttgtag

SEQ ID NO: 6784003 - DNA, 74 bp, Homo sapiens
tggctgctggtcggggtcagggagatgaagcagtgccagctccgtggtctgcactgatcctgaccagtgaacca

SEQ ID NO: 6784004 - DNA, 70 bp, Homo sapiens
tgagtctaggggaggcggggagcagggaagcctcccacagcctgacctgcccttctttccccagcattca

SEQ ID NO: 6784005 - DNA, 78 bp, Homo sapiens
tgctattgtgaatagtgctgcaataaacatacgtgtgcatgtgtctttatagcagcatgatttataatcctttgggta

SEQ ID NO: 6784006 - DNA, 80 bp, Homo sapiens
tgagagcaaccacctaacagtggggaaaagagttggtggagaagcaccaccatcttgccctccttgagtgggaactttta

SEQ ID NO: 6784007 - DNA, 95 bp, Homo sapiens
tatggagggctaactatgttccagagatgggattaatcatgttttatgtaatttgtcctcatattaaaaccatcagctgtaagatagcctctatg

SEQ ID NO: 6784008 - DNA, 103 bp, Homo sapiens
cagcctgctgggctggaggaagtggagctggtgccgtccctgctctcttgctgggaagcaactgagggggcggcgcggcaggccccggcagccgaagaggctg

SEQ ID NO: 6784009 - DNA, 58 bp, Homo sapiens
gatggatggacaggtggataggtggattggtagatcatctgtttctttgctatatatt

SEQ ID NO: 6784010 - DNA, 62 bp, Homo sapiens
atgccatctgaaatctgtcatatgagaatgaaaggagcatagacaggttttgagtgtggggt

SEQ ID NO: 6784011 - DNA, 101 bp, Homo sapiens
ttgaggcagaattgcttgaacccatgaggcggaggttgcagtgagccaagaccgctccattgcactcctgcctgggcaacaagagtgaaactctgtctcaa

SEQ ID NO: 6784012 - DNA, 75 bp, Homo sapiens
gtatttttccaggatgactctagagaagaagactcttcatcttcctcaggactgttgacttcctggtttgattgc

SEQ ID NO: 6784013 - DNA, 56 bp, Homo sapiens
cactctaacctccatcttccatcaagagtagcaacgatgaagggtggggtggggtg

SEQ ID NO: 6784014 - DNA, 56 bp, Homo sapiens
ccccagccctcggtagtcccatagaagctgtgggctcctgcagctcaggcctgggg

SEQ ID NO: 6784015 - DNA, 64 bp, Homo sapiens
tttgactctgggtgctttttcggatacattttcttcaacactgttaaggggcctcactgtcaga

SEQ ID NO: 6784016 - DNA, 57 bp, Homo sapiens
gcaaacatgctgagaaataagatgtctggcggctactcttgatttgaggctgtttgt

SEQ ID NO: 6784017 - DNA, 88 bp, Homo sapiens
ttgggaagcagctcactaacttcatataaaggtctctaatctaattagatgcaggattagaaagttgcctctgagttgcttttctcaa

SEQ ID NO: 6784018 - DNA, 77 bp, Homo sapiens
atataaagacaatgttctgtctgacttgtcagtgcttatatgatcatagacaggctcacattgactgttctttatat

SEQ ID NO: 6784019 - DNA, 66 bp, Homo sapiens
gcatacatgtatgtgtacgtgcatgtgtacgcgtgtgtgtgtgtgtgtgtgtgtgtgtgtgtgtgt

SEQ ID NO: 6784020 - DNA, 59 bp, Homo sapiens
ccctccagggcgctgggggtgtctccatgtatcacaccatcctgcagttcctaggaggg

SEQ ID NO: 6784021 - DNA, 84 bp, Homo sapiens
cagtgatacttggttttctttagaggtgagagatttttagctcaccactggcttcatcaacctctggagaaatcaggaatcctg

SEQ ID NO: 6784022 - DNA, 62 bp, Homo sapiens
gttcctgatgcattacaaaagtgattattgatgataatgattattgatgagagcaccaggac

SEQ ID NO: 6784023 - DNA, 70 bp, Homo sapiens
ttcacaagcagttactatttactattatattactcccttgggaactataatggagtgtggctgcttcgag

SEQ ID NO: 6784024 - DNA, 117 bp, Homo sapiens
caggccaatgtggagggaaagctggggtggtgcaggcctcatgcagctgggtccctcctaccaggcctccagagtcctgcaccagctccaggacagccctctcctccccatggcctg

SEQ ID NO: 6784025 - DNA, 79 bp, Homo sapiens
tttataatgaaaagaggtttaactgactcacagctccacatggctgaggaggcctcacaaaacctacaatcatggtgaa

SEQ ID NO: 6784026 - DNA, 80 bp, Homo sapiens
gcaaatttctggattctacccgcctccccgcactccgacattacgatgtagcagctctgtggtaggatccaggaatctgc

SEQ ID NO: 6784027 - DNA, 56 bp, Homo sapiens
ggctttatgcagggatagaaatgtaaatatgacagattcttgactttcataaagct

SEQ ID NO: 6784028 - DNA, 103 bp, Homo sapiens
tacaaatacagagtctagcacagtatggtatcagattgctattcaataaataatggatattatagggctaatattgttgctgaggtcctgtattctaactgtg

SEQ ID NO: 6784029 - DNA, 106 bp, Homo sapiens
atggatgaaactcaaggatattatgctaagggaaataagccagacacaaaaagataaatactgcatgattccacttatatgattcatcttgagtagtcaaatccat

SEQ ID NO: 6784030 - DNA, 71 bp, Homo sapiens
gagatatagttttaaatccaaattgaggaagtgttatattatttcaacacttttggaattagtggtgtctc

SEQ ID NO: 6784031 - DNA, 66 bp, Homo sapiens
gacattattatttttcctactttacagatgaggaaactgatccacagagaggaagaatagtttgtc

SEQ ID NO: 6784032 - DNA, 95 bp, Homo sapiens
agtctggaaatatctttgtgtttgcttacttgtatgctgcctctattcctagaagtctgcaaactcagtgagataaaagtggacctttccaggct

SEQ ID NO: 6784033 - DNA, 69 bp, Homo sapiens
ctggccaggatagcagcatttcttccaaggattgtcgcttgacctctcttggacatgtggctctgctag

SEQ ID NO: 6784034 - DNA, 62 bp, Homo sapiens
cactgccaggtaagtgctcctgccaatgcatcagtgtagagcaagcctgccacctggtggtg

SEQ ID NO: 6784035 - DNA, 76 bp, Homo sapiens
tcatttgaacccaggaggcacaggttgcagtgagcccagatcatgccactgcactccagcctgggtgacagagtga

SEQ ID NO: 6784036 - DNA, 57 bp, Homo sapiens
gagacaggtctgtgtgcacagtgctcgcggctgttgacatgcgcatgcagactgctt

SEQ ID NO: 6784037 - DNA, 129 bp, Homo sapiens
gataagcacttcaggtgattctaatgaaggtttaaatatgaaaatcactgtcttcccccacagaggacatttgactctgttcatattattaagcccagtgcagatacaccctgaagaatgctttatatc

SEQ ID NO: 6784038 - DNA, 98 bp, Homo sapiens
gaagctgactttggttttcaaattctgtcaccagcacctgaaaaagtattttgacagttgcaatggtgatctcgatcctgagattgtaaagtcatttc

SEQ ID NO: 6784039 - DNA, 62 bp, Homo sapiens
gcacccgcgggtcctagcgagctgtccggccagctggtctagcatgcaggtcccgcgaatgc

SEQ ID NO: 6784040 - DNA, 85 bp, Homo sapiens
tttgtgttcatccattatctatcaacagggacttggattgcttccatcttttagttattgtgaataatgcttcagtgaacacgga

SEQ ID NO: 6784041 - DNA, 66 bp, Homo sapiens
agaatgtgtgtgtgtgtttgtgtgtgtgtgtgtgtgtgcattcgcacattaacactcatatcttct

SEQ ID NO: 6784042 - DNA, 56 bp, Homo sapiens
ggcctagcctctcctgagagaggcagaaaatgtaaggctcagagaggggcagtgcc

SEQ ID NO: 6784043 - DNA, 55 bp, Homo sapiens
ccaggtgaggtaggtatggtagatgtagttttaaacccaacttctcctcttctgg

SEQ ID NO: 6784044 - DNA, 62 bp, Homo sapiens
tggacactgttccacactaagaagggaagcaagtctccttactgcgaagggggcagtggcca

SEQ ID NO: 6784045 - DNA, 71 bp, Homo sapiens
cttctgtgcaattgtggaggagacaccaaagcatctgaaattggagcccttccttgacagttgggtgggag

SEQ ID NO: 6784046 - DNA, 66 bp, Homo sapiens
cagcatctggcacctggcagcacattgacagacatttgtggagtgagtgctgggctgaggctgctg

SEQ ID NO: 6784047 - DNA, 80 bp, Homo sapiens
gccccgcctgagagcttgttagaaatgcaggcgctgctaatcagaagctgcctttaacaagatctccagatgagtggggc

SEQ ID NO: 6784048 - DNA, 57 bp, Homo sapiens
ttcctggtagtaagacatctggaatccatttggatgtgtggtttttacaccaaggaa

SEQ ID NO: 6784049 - DNA, 102 bp, Homo sapiens
tgcctgagacaagttaaagatgagtctgcaaatatgttcatgtggtttcctaaacttacattgaagatatttgcagtatcatttataagttaaatataggca

SEQ ID NO: 6784050 - DNA, 58 bp, Homo sapiens
catgattggtggtcagcagtatggcttcagagcctgtgctctcaatcaccacttcatg

SEQ ID NO: 6784051 - DNA, 78 bp, Homo sapiens
ggggagaggggaggaggggcagggccactggggagcacctgggacgctgcatctccccacatttctccctgtctcccc

SEQ ID NO: 6784052 - DNA, 57 bp, Homo sapiens
tgcatgaggacctgagtatggaaaaagagcatccgtgctggcatggtcttggtgaca

SEQ ID NO: 6784053 - DNA, 74 bp, Homo sapiens
gtctctgagacttagcatctacatttttcataaaatggagactctatgtgtagagtgtgtaagtatcaactgac

SEQ ID NO: 6784054 - DNA, 97 bp, Homo sapiens
gcacatgatttttattaatatcctgatatttctcctattaatattgagcatttaggtttcagaaatgaagcaggagttattagataggaattagtgt

SEQ ID NO: 6784055 - DNA, 64 bp, Homo sapiens
gggttttccagtgaataaagataaagtacacaagaataggtactgcatagacactgggatatct

SEQ ID NO: 6784056 - DNA, 62 bp, Homo sapiens
gtcacccaggctggagtgcggtggcactatcttggctctgcagtctccacctcctgggtgat

SEQ ID NO: 6784057 - DNA, 94 bp, Homo sapiens
cctaagtccagagccctcagaagccctccatactctgttggctctctgagctggcagctttaaaggaggctctgaggtgtgttctggaaggagg

SEQ ID NO: 6784058 - DNA, 77 bp, Homo sapiens
agactattaaacctgctcttctgaaataattttaataggcatatgtttccagccctgcaggtttaagagcctagtct

SEQ ID NO: 6784059 - DNA, 75 bp, Homo sapiens
gggttgttggcattggtaccaaagctgtatagtatacaccactgtgctgttttcttgatcattgctggctgactc

SEQ ID NO: 6784060 - DNA, 64 bp, Homo sapiens
aagttccttgaatgaagctagggttctctacctgggctacactttagagtcatctagggaactt

SEQ ID NO: 6784061 - DNA, 60 bp, Homo sapiens
gtaatgtactgcagccagatgtgctgtgaatgaagagccttttggcttcaagtgcattgc

SEQ ID NO: 6784062 - DNA, 78 bp, Homo sapiens
aaataagctagttaaagctacacattattaatccagattacctgggttctatgcctggctttgccactaaatttgttt

SEQ ID NO: 6784063 - DNA, 87 bp, Homo sapiens
cgctggtgcaggacagcacatctcctgccagtgtctcctccccctacagcctggtcaggtgagaggcggtcctgcatgtcatcagcg

SEQ ID NO: 6784064 - DNA, 55 bp, Homo sapiens
cttcacagtctttatttcctcccctctaaaatgagagagaagaagttatgtgaag

SEQ ID NO: 6784065 - DNA, 68 bp, Homo sapiens
tggactttgttgagaaattttcctaggatcttcctcagtcgaaccaggaagcttggcaataaggtttg

SEQ ID NO: 6784066 - DNA, 55 bp, Homo sapiens
gggatgggacttgcctcaggccaaataggaactcccggctgagcaaattcctccc

SEQ ID NO: 6784067 - DNA, 94 bp, Homo sapiens
agcactatttgttttcctgtctggaacatggcctgttctgttgacccgatttgggttatgattcatgttatagagagtcagacaaataagtgtt

SEQ ID NO: 6784068 - DNA, 72 bp, Homo sapiens
acctctgtctaaggtatagtctggaaaagggcattttccaagctgtgttttgagatattattaacagtaggt

SEQ ID NO: 6784069 - DNA, 70 bp, Homo sapiens
tgagggggcttcggggccgtctctgcccctggcttcggcaaggcctggcctgggcggcattgacccctta

SEQ ID NO: 6784070 - DNA, 66 bp, Homo sapiens
atcatggtctgagggagtgagtgggggctgaaatcacgccaataactctgctccctaagccatgat

SEQ ID NO: 6784071 - DNA, 75 bp, Homo sapiens
tggtgcatgcagcttgtattagttaatgactgaggcattagaaactcagtaagttaatacaagcatatgcacaca

SEQ ID NO: 6784072 - DNA, 58 bp, Homo sapiens
ccactcccttccggtccagggcatgtctgctctgctgtaaaatgggaagggaaagtgg

SEQ ID NO: 6784073 - DNA, 70 bp, Homo sapiens
ggaagcggaaggcttggttttttcaacaccttcaagcgttggtgtttttgaggagctgagcttgggctcc

SEQ ID NO: 6784074 - DNA, 72 bp, Homo sapiens
caggagtttgagtggggcctcagtaatttcttaggcactgcagtctattactgaggttttatggagtttctg

SEQ ID NO: 6784075 - DNA, 57 bp, Homo sapiens
gagaaaatcttgggtcaagaatatattgccccttatggtcatgtccaaatttttctc

SEQ ID NO: 6784076 - DNA, 66 bp, Homo sapiens
tatgctctgattggagtctgttgccatggaaaagctgtaggcaggctaactacaatcaagggcatg

SEQ ID NO: 6784077 - DNA, 57 bp, Homo sapiens
tattgctgccaggaccctatcccagaaagctggagtgacttggttttggtagcggtg

SEQ ID NO: 6784078 - DNA, 57 bp, Homo sapiens
ggtttattaggcaaagctaagtgtgtagcttctacatatgtaattgcctgatggatt

SEQ ID NO: 6784079 - DNA, 57 bp, Homo sapiens
gcttaggtgaggttacaagagttcatgtcaaaatggagctttaaatctctcctaggt

SEQ ID NO: 6784080 - DNA, 72 bp, Homo sapiens
cttgcacccattgccctcagcgcttccagatcttttagaggaagggaaggctggaaggcaagtaggaaagag

SEQ ID NO: 6784081 - DNA, 85 bp, Homo sapiens
tctaggctgcctgcccccaaagccctcgcatttacaaatcagccagccagaggggcttcagctggggatggagcaggttgccagg

SEQ ID NO: 6784082 - DNA, 96 bp, Homo sapiens
gcatgtagcagaacctcatcattgtaccaaggagttcacaccttgaaactttgaccttggtacaggtttacatcttggtgcaggtttacattgtgc

SEQ ID NO: 6784083 - DNA, 102 bp, Homo sapiens
ggaagccagggacctccctcacggtgaaggccgagtgaccagtgggagtcagggtaaaccttcactgtgagtcaggaacaagctcccctggatatattttcc

SEQ ID NO: 6784084 - DNA, 76 bp, Homo sapiens
tataaagaatccagaagagacacgtacagaaatgacccttcagaactgtttatggctgtgtcttcctttctttatg

SEQ ID NO: 6784085 - DNA, 61 bp, Homo sapiens
ccatcttgtgccttttaggagaaagggaccatttcccaggtcctgcaggaggcctgagagg

SEQ ID NO: 6784086 - DNA, 76 bp, Homo sapiens
tctagaggctggaaagttcaagataaagctgctgtcagatttggttcctggtgagagtctgctttccggctgtaga

SEQ ID NO: 6784087 - DNA, 56 bp, Homo sapiens
gcaattcaagttgagtacagcttctctttggcaggaggctgagaaaactgaaatgt

SEQ ID NO: 6784088 - DNA, 73 bp, Homo sapiens
gtctcagctgacctaaggtcagaagtctagtgatgtttagccagacattctttcaccttgtgtccagtctgac

SEQ ID NO: 6784089 - DNA, 70 bp, Homo sapiens
gctgattctgtttaaaatgaggcacttgtgacactttgaatgcactctggttctgaacaggatcttgagc

SEQ ID NO: 6784090 - DNA, 82 bp, Homo sapiens
cttaagcccacttttaactgcaggtcatcctcgcatcagccaaggctgtggtgctgttgatgccgcagttggacagcatagg

SEQ ID NO: 6784091 - DNA, 56 bp, Homo sapiens
tttggcagcttccatattcacttgtttttctccccagtgaaatggcagttgctaaa

SEQ ID NO: 6784092 - DNA, 72 bp, Homo sapiens
cctgcaaatgactctgagattggaggtaccacaatctatgttttatcagcaactcagagcagtctctgtagg

SEQ ID NO: 6784093 - DNA, 89 bp, Homo sapiens
tgctatgtggtcttctccataggcagttcataacatagaagcaagctgctatgttatgaactgcctatggacttgcaagtccactagca

SEQ ID NO: 6784094 - DNA, 78 bp, Homo sapiens
gtgggtggaggtagtgtctggactaggggaaggcctgtttctagtttgatgcctgtctttattccaacctcccctcac

SEQ ID NO: 6784095 - DNA, 85 bp, Homo sapiens
ctaaagcctgtgatgtttgcactagaatgtatggtttttcacattctatattgttaaaggttatagctgtatttaactgctttag

SEQ ID NO: 6784096 - DNA, 93 bp, Homo sapiens
gtcacctagaagctctgacaacacaggcttccagtccccagctcagatcctctatatcagcatgggctctggaatctgtgtatggctggtgac

SEQ ID NO: 6784097 - DNA, 55 bp, Homo sapiens
agcaggcaggcccagcggctgggtttctctagcacctcggcattgtctgcctgct

SEQ ID NO: 6784098 - DNA, 79 bp, Homo sapiens
ggtcacaggcctaccctggacccatcatggctgctggatgatggcagctctgattggttcagcctgggtcatgtgtgcc

SEQ ID NO: 6784099 - DNA, 62 bp, Homo sapiens
gtaatttttgctagaagatcagcagctaagagtgctgttcatttactgtaggcaaaaattgc

SEQ ID NO: 6784100 - DNA, 59 bp, Homo sapiens
tttacagcactgaagccaggggaattacgtggtccctcccctggtgtttggagtttgag

SEQ ID NO: 6784101 - DNA, 130 bp, Homo sapiens
gagttctgcacatgctctcccgtgacagctggatagggatggcctcctgagaagccacaggctatggccctgccagcctggcactgaggcagggcgacacttccagctgaagggagtgttcttcaatacc

SEQ ID NO: 6784102 - DNA, 113 bp, Homo sapiens
actttctcattaccagccatggccaagcatgcctgtggccaggcaatgcttgttttgcattcaggggccactagagcaagagcttttaagctatggcaaagtaaaagaaaagt

SEQ ID NO: 6784103 - DNA, 56 bp, Homo sapiens
tatggtgatggcacagaccagcaattctggacacttctggagtcatctttaccata

SEQ ID NO: 6784104 - DNA, 82 bp, Homo sapiens
ccgcccccgcggcgaggtctggaccaagtcgcccctagcaacaacagccgggccggctttctcaggccatgctgattggcgg

SEQ ID NO: 6784105 - DNA, 100 bp, Homo sapiens
ggctcagggctcccctcttacaagctcgggcagctcattaaggaaaattccccgtaactgtttgcctgggctcagtcagtgtacagacccaaacagagcc

SEQ ID NO: 6784106 - DNA, 62 bp, Homo sapiens
gtacgctgagaacagaacaaaaaggtttctcagccaaatgaaccttcagtgttctcagctgc

SEQ ID NO: 6784107 - DNA, 65 bp, Homo sapiens
gaaaaaaatccacagtgggggtggcggaagatctatgacttctaacaacccattctgtggttttc

SEQ ID NO: 6784108 - DNA, 65 bp, Homo sapiens
ttcagctgagagggtgctgggcgaagctggtgggtaggactcaaatccagcaccctcacagagaa

SEQ ID NO: 6784109 - DNA, 93 bp, Homo sapiens
ggaatctctgatcctgcagatatgctctctttcgagactttttcttgtctctggactcgagcttactcatcatctaaagagattagaggttcc

SEQ ID NO: 6784110 - DNA, 72 bp, Homo sapiens
ggctgaaatagatatggagatttcgcacttaattaaaggagaagtgtgctcaattcaagtcttttcaaaacc

SEQ ID NO: 6784111 - DNA, 57 bp, Homo sapiens
tcaaagttggaaaagctggcccttttctaggaaatcttcagatttttctaactttga

SEQ ID NO: 6784112 - DNA, 95 bp, Homo sapiens
tgagtgattattaatggtgttttatttcctggtgtggaagtatttcgcagagaagcggaagttccaggatgccaggaaagtaccaggaacactca

SEQ ID NO: 6784113 - DNA, 69 bp, Homo sapiens
ttggatgacagataacagtattaaattaacatttttaatttgtatacattatgtgtgtttgtggtccaa

SEQ ID NO: 6784114 - DNA, 56 bp, Homo sapiens
ctagtatttctttttaaatgtgggggttttgccccactgctagtctgaagtactgg

SEQ ID NO: 6784115 - DNA, 71 bp, Homo sapiens
gatcacgggagttgttgattcagacttactggtgctttatgagttgaagtcttcaataagcttaaatgatc

SEQ ID NO: 6784116 - DNA, 81 bp, Homo sapiens
cttatttaacacgcatagaaaattgcactagaaatacccattatttgacttctagtgggaattcatgttgtgtttattagg

SEQ ID NO: 6784117 - DNA, 83 bp, Homo sapiens
atgtgatttggggagtttctgtaattccctgtaacaatgttttcatctgttaaaagtggaataatagttgctaccttacacgt

SEQ ID NO: 6784118 - DNA, 60 bp, Homo sapiens
atgcaggcagacactgtgggcaggaagggcatctcctgtcacagtgggtggtgcctacat

SEQ ID NO: 6784119 - DNA, 86 bp, Homo sapiens
ggcagtctgctccttggctctgcatgtttgcctctccttaggaaagactcaagtgggaatagaaatgaaggtctggggttgttgct

SEQ ID NO: 6784120 - DNA, 100 bp, Homo sapiens
cccaaataaaaatctacccacaatcttagagagattcttttatgatgtattggggtaaatgtgtggaaggtttcttaaggttctagggagggagtttggg

SEQ ID NO: 6784121 - DNA, 55 bp, Homo sapiens
tctcccccagtctctacagcagcatccagcatgtgtgtaaggaaaggggatgaga

SEQ ID NO: 6784122 - DNA, 58 bp, Homo sapiens
tcagatgtttctttaacgcatggttgcaaaacgtgctgttagtaaggaacatgactga

SEQ ID NO: 6784123 - DNA, 82 bp, Homo sapiens
gttaggaaaggcctagagctttggagggcaaggaaaggcctccttgccgtcctgccaaagctctaagatctgccttcctcac

SEQ ID NO: 6784124 - DNA, 55 bp, Homo sapiens
catacttaatgtcagtttgatgttctgttagaactcggactggcataaggtaatg

SEQ ID NO: 6784125 - DNA, 86 bp, Homo sapiens
ctgtgtaatcctattcctttgacttagtgggactctgaatatgatgattagatcattttgtatagcaaaggtggagggattcacag

SEQ ID NO: 6784126 - DNA, 75 bp, Homo sapiens
tgctgataatttcttatgaagactgaattgtctgaaattattattatttcagttttgttttgataattgttggca

SEQ ID NO: 6784127 - DNA, 59 bp, Homo sapiens
gcagtaaataggtcgattgtgacaaaaaggtttcagtcgttgcaattgcttcttgctgc

SEQ ID NO: 6784128 - DNA, 90 bp, Homo sapiens
cagcccagctcaacatagccttgtgctgcccatccctgctactaaggcttgggatccatccgtgcagcagagggaatgaggctgtgggtg

SEQ ID NO: 6784129 - DNA, 64 bp, Homo sapiens
gggccgggcccggcggggcctgcaaggcggagcctcggcctgtggccgcgtcgggcggcggccc

SEQ ID NO: 6784130 - DNA, 72 bp, Homo sapiens
agggacaagtaatttatgcaaacggaccagaatattatatcatctacttcttttgcactgatgcatctccct

SEQ ID NO: 6784131 - DNA, 69 bp, Homo sapiens
aggatggcagagattagtgcccttaaggatctaatgaatccaggttccggggatagtgtttcccatctt

SEQ ID NO: 6784132 - DNA, 73 bp, Homo sapiens
tttagcgggctttcagccaaaggacaacctggagcatgtttcggccctgaagctgagggtgttaactgctgaa

SEQ ID NO: 6784133 - DNA, 72 bp, Homo sapiens
agcctgtgactcacaggacaatttgaagaatctttcagtcaaagctcagtagtgtgccagtgggcataggct

SEQ ID NO: 6784134 - DNA, 74 bp, Homo sapiens
gctgatatgccagggacatttccaagagaattccttttttgagagaaatctcctttgatatcccatcagtcagc

SEQ ID NO: 6784135 - DNA, 56 bp, Homo sapiens
ccacaggatccaagggaaggcagaatgcgtcctctgtagcttggatggttctgtgg

SEQ ID NO: 6784136 - DNA, 62 bp, Homo sapiens
cctctgcatgtgaatatccatttgtttcagcacaatttgttgaaaagactgttctgtagggg

SEQ ID NO: 6784137 - DNA, 73 bp, Homo sapiens
gaaacgtagtcaaaagtgcactctcagtgctgctgccgaccgggcacggcgctgggcctgcatttgcgctttc

SEQ ID NO: 6784138 - DNA, 56 bp, Homo sapiens
ggcgagcagagcactgccaggatatcctgcccagatttcccagtttctgcctcgcc

SEQ ID NO: 6784139 - DNA, 66 bp, Homo sapiens
ctgtgtccatttatcattgtcatgggctgaaactttccacttgtggtaatgattaaaaggataaag

SEQ ID NO: 6784140 - DNA, 60 bp, Homo sapiens
ttttgctgcattgaagtcagataccctcttattagggagcagctttcaaagcagtcagga

SEQ ID NO: 6784141 - DNA, 68 bp, Homo sapiens
tggggttgaagaaaggatctaggaatctgcatatcagactttgaaccaatcttcctgtttcagcccca

SEQ ID NO: 6784142 - DNA, 67 bp, Homo sapiens
tggaggccgaattagagcgttggctttaggaatgggaattcagtgcctgttctggttcttctctcca

SEQ ID NO: 6784143 - DNA, 78 bp, Homo sapiens
tgaagaattgtgggtttgtaggttaattttctttgaacagctacaaagttctttttctataaatcccaattagtttca

SEQ ID NO: 6784144 - DNA, 72 bp, Homo sapiens
aggtgactgcacagaaatgtctacacatgtgttttcacatacatatgtctacccatgcctgtgtggacactt

SEQ ID NO: 6784145 - DNA, 85 bp, Homo sapiens
ggaggactctggggagagagggaggagctttgaggggggtcacccttcacagttcctgactttaactccactactaatgttctcc

SEQ ID NO: 6784146 - DNA, 63 bp, Homo sapiens
gtgcacagggacctgtgagctccatagactcatctgggaagacctgctccagtccctccgtac

SEQ ID NO: 6784147 - DNA, 72 bp, Homo sapiens
tccctgtgatttaaaaggcgttgactatccgtttttaaaagggtaggatatgtgaaatcatattaaatggga

SEQ ID NO: 6784148 - DNA, 67 bp, Homo sapiens
cctctactcaggcctccttctgtcctttgtgctacaacaatgggcggaaacacagccttgttagagg

SEQ ID NO: 6784149 - DNA, 56 bp, Homo sapiens
agagctgttagaagggattagatcatttcagtttgcacagtcccatcttcagctct

SEQ ID NO: 6784150 - DNA, 80 bp, Homo sapiens
actgcggagttttgggaatatgtaattatcgggagactaaggaaacatctctgatttacccaagtctcaaaactgtcagt

SEQ ID NO: 6784151 - DNA, 58 bp, Homo sapiens
ctgtgacttccggatgacatgattattggccaaatcacttcacatctgtaagtctcag

SEQ ID NO: 6784152 - DNA, 76 bp, Homo sapiens
ggtgttggcacatggtgtgaatgagcggataactacttgtagttgtgctctgatacatacattcaccagctttacc

SEQ ID NO: 6784153 - DNA, 77 bp, Homo sapiens
agtctcgttttgtcacccaggctggattgcagtggcgcgatctcggctcactgcaatcgctgggttccagcgagtct

SEQ ID NO: 6784154 - DNA, 72 bp, Homo sapiens
tcctatagtccatgttgatatcctcatgctaattattattatgggcaaatgtcacacatggatttaagtgga

SEQ ID NO: 6784155 - DNA, 72 bp, Homo sapiens
ggagtctgccttcaggagcagactctgcctggcatcccagaggagtctgtgtcttgaagcagtcagtgctcc

SEQ ID NO: 6784156 - DNA, 62 bp, Homo sapiens
aagcttgtactccaggatgtagaatcagagattatttttgcttgctcctgagagttatgttt

SEQ ID NO: 6784157 - DNA, 71 bp, Homo sapiens
gatgtggctttggcttctgtcatttctgttaaatcctctccagccagctctgacccttgccgagctacatt

SEQ ID NO: 6784158 - DNA, 84 bp, Homo sapiens
gagctgtgcactgaagacaatagtttgaggtaactgaaataggtacctaccaatcagaatggacccagactatagtgctggctc

SEQ ID NO: 6784159 - DNA, 98 bp, Homo sapiens
cacagagctggtttccaaactgtcttcctccatcccgcggagcaggcatgggagcatctgcctgcagtggaggtgggctggacagtgtcctttctgtg

SEQ ID NO: 6784160 - DNA, 80 bp, Homo sapiens
cccaatctgctctgctgtcttcttgcaggctgggaaactgaggcccatacaggagacaggagggacacacagaagtcggg

SEQ ID NO: 6784161 - DNA, 128 bp, Homo sapiens
ccgtgggtgtactggactcagccttctcacagcgccggcatgggctgctcagtgggaatctccaaggctgtcaggccatgtgggccttgcctgagccagggatcggagggacagcgagcagccagcgg

SEQ ID NO: 6784162 - DNA, 67 bp, Homo sapiens
ggcctggagcagagcctacaccctcatcccagcctctccctgagtctccaaggcctccctccaggcc

SEQ ID NO: 6784163 - DNA, 67 bp, Homo sapiens
tgtcacccaggttggagtgcagtggcgtgatctcagctcactgcaagttccacctaccgggttcaca

SEQ ID NO: 6784164 - DNA, 88 bp, Homo sapiens
ctgtttttgtgtacttgactttctgctatactttctgtccctggagagggagcagccttggtgtcagaaagtccgtttacctatgcag

SEQ ID NO: 6784165 - DNA, 73 bp, Homo sapiens
gagaggcgtgtgtgtgctccccaggagagctgtaacgacactccctttccaggaaacacaaaccaggcctctt

SEQ ID NO: 6784166 - DNA, 78 bp, Homo sapiens
aggttaatggggctcagcaggctctggttgaccattacagcagtgatgacttccatgccgctggccccaccatagcct

SEQ ID NO: 6784167 - DNA, 101 bp, Homo sapiens
tgagacggagtctcgctctgtcacccaggctggagtgcagtggcgggatctcggctcactgcaagctccgcctcccgggttcacgccattctcctgcctca

SEQ ID NO: 6784168 - DNA, 57 bp, Homo sapiens
tgttatcctcagcaagtgaattttcataatatgaaaggccatttctgagggtttgca

SEQ ID NO: 6784169 - DNA, 55 bp, Homo sapiens
tagagccagcacctagcagactacctggatctgctgccatggtcgctggtgtcta

SEQ ID NO: 6784170 - DNA, 77 bp, Homo sapiens
gtctgatgggtttatagggaggctaactctgaaacacataccagactgagactgcccctgtaacaattccaatagac

SEQ ID NO: 6784171 - DNA, 56 bp, Homo sapiens
cagcagtcacacaaactctggaatcatggcatttgatttctaagttttgcttgctg

SEQ ID NO: 6784172 - DNA, 99 bp, Homo sapiens
tttgctcggtgatggtagaaaaaacactgggctgggagtcagaatgtctagactcaaacaccaggtcttttgcttacttcttgtatcaccttgagtaag

SEQ ID NO: 6784173 - DNA, 58 bp, Homo sapiens
ggcgattttgacattgcggcattgctcagcatggcgggctgtgctttgttaggttgtc

SEQ ID NO: 6784174 - DNA, 68 bp, Homo sapiens
ttcttgcctaagaacactggctggtttcaagactttgcagctagctttaactcttagacagcaatgaa

SEQ ID NO: 6784175 - DNA, 60 bp, Homo sapiens
tagatagattctcctatagagtggcagggctcacgtcatcattaggagagaatttattta

SEQ ID NO: 6784176 - DNA, 81 bp, Homo sapiens
gcccaggaagccaggctggagttacctttaggggagcctagagtcctctccttggggtaactccagcctggctttctgggc

SEQ ID NO: 6784177 - DNA, 76 bp, Homo sapiens
tcttcacatggtgtgcagcgtcaaatgtgacatcattgtaggaaatcatattatgcaactctgcaataccaggaga

SEQ ID NO: 6784178 - DNA, 91 bp, Homo sapiens
gagacgcactaaaggcttgctacttagagtgcagcagcagaccagtttgctgttggaataacctggtagctggctagaagtacagaatctc

SEQ ID NO: 6784179 - DNA, 70 bp, Homo sapiens
gggttcaatgcagataccttccagagatgatagcacttcattgactgccaaagaggatgtcagcataccc

SEQ ID NO: 6784180 - DNA, 128 bp, Homo sapiens
ggaggcagcacagacattaaacacggtattttcagaaggagcagacataaccttacagaagtgctttattttctgtaactagattttgttttactggaggcagctttgtataaggttcaggcgtctct

SEQ ID NO: 6784181 - DNA, 87 bp, Homo sapiens
gcatgtgacctgccatgtgatttgaagctgtctttcagaatcactatcagtggcccctgaggagcgtcagccatggtaggtacatgc

SEQ ID NO: 6784182 - DNA, 66 bp, Homo sapiens
taggcattacctaacattacctattcatgcagaagagggctatttggtgtgttagtgtaatttctg

SEQ ID NO: 6784183 - DNA, 60 bp, Homo sapiens
tttcccttttttctagtaggtaggtcggacacttagacttcctacttctgagaggtgaga

SEQ ID NO: 6784184 - DNA, 81 bp, Homo sapiens
cagtgcagtgaagacaatggagcacagcagtttgcctttctagtgcacagctgccctactccatgtgacttcgacgcactg

SEQ ID NO: 6784185 - DNA, 55 bp, Homo sapiens
attcaatatctgtgtattggaaatcagaactaattccaatatatagtgagtggat

SEQ ID NO: 6784186 - DNA, 58 bp, Homo sapiens
aggacgcaatgatcacttgtcctgtgaacagtctacttttgtcatcattgcaactcct

SEQ ID NO: 6784187 - DNA, 65 bp, Homo sapiens
gccccatgcatattgtgaaaatgtagattggtatgcacgaactattgcatattgtgtaccagggc

SEQ ID NO: 6784188 - DNA, 87 bp, Homo sapiens
tcctgagtgccgggccctgccccgtggctctgatggattctcccagcgtgtcctcaccactctttggagcaggtgccacattcagga

SEQ ID NO: 6784189 - DNA, 68 bp, Homo sapiens
gatagtaagcgcaaagctatgtatttaacaatgtttgttgttaaataactagttatgtttttgaaatc

SEQ ID NO: 6784190 - DNA, 56 bp, Homo sapiens
actgtcactgacagaatcaacatatattgtctgaaatttccaaagtcagaggcagt

SEQ ID NO: 6784191 - DNA, 55 bp, Homo sapiens
gctgcgccggatcccacgttccactcaccgaggttgggggtcttcacggtgttgt

SEQ ID NO: 6784192 - DNA, 59 bp, Homo sapiens
cctaaaatggttttattcctattgggttatttccttgaccaggtagcaaaccttttagg

SEQ ID NO: 6784193 - DNA, 72 bp, Homo sapiens
ctttgagggcaatatatttgaatcaggaacaagaacatcttgcttctaagtataaatatgaaccttttagag

SEQ ID NO: 6784194 - DNA, 93 bp, Homo sapiens
gtggctctttgtacccagttttggtgatatttgagaaggcatgctctccttccttttaaaatggcaaagaaacgtaaggtgttttggaggtac

SEQ ID NO: 6784195 - DNA, 65 bp, Homo sapiens
ataagaagggagagaaagttggttactgctacagtctgaatgtttgtgtctcccaaaattcttat

SEQ ID NO: 6784196 - DNA, 77 bp, Homo sapiens
tctctctcttcagagataccttgctgcttagagggaaacttgacactacccatgcctgcatatctttgaaagagagg

SEQ ID NO: 6784197 - DNA, 62 bp, Homo sapiens
ctttcctagactttgcatagatcttgacttacaaactgctgagcaaggcacagtgaggaggg

SEQ ID NO: 6784198 - DNA, 89 bp, Homo sapiens
taggctgtatgctgttaatgctaatcgtgataggggtttttgcctccaactgactcctacatattagcattaacagtgtatgatgcctg

SEQ ID NO: 6784199 - DNA, 58 bp, Homo sapiens
tcctttctgttgttcatcttccttagtgcactaattaggaagacagcaaaagaatgga

SEQ ID NO: 6784200 - DNA, 66 bp, Homo sapiens
gtttgcagatgatcaagaattttgtattccagcaggagttcaaatcttttggatcttctcgccaac

SEQ ID NO: 6784201 - DNA, 106 bp, Homo sapiens
tacctttctccctttccttgctatttacagaatctgacattatatttaataccacgctgccggttgtctgcatgattctaggcaggaaaattgggttagaacggta

SEQ ID NO: 6784202 - DNA, 62 bp, Homo sapiens
taatatggacagagtggtggttgagggtgccggctctggcatcaaaccactttgccaagttg

SEQ ID NO: 6784203 - DNA, 100 bp, Homo sapiens
tgattttttttagatattcaccccatttccacattgtgttatgggaatctgaactcacacacatctccagaagtgggctgaattggtctaaggataatca

SEQ ID NO: 6784204 - DNA, 80 bp, Homo sapiens
gggactcagtgatttgacatgcctggaacagtgacaccaggggatgtggtggcaaagaaggcatgaagttagtgggtgcc

SEQ ID NO: 6784205 - DNA, 56 bp, Homo sapiens
attcttggtccagttgaagatgcagacacattttagtctagacagggcacaggaat

SEQ ID NO: 6784206 - DNA, 95 bp, Homo sapiens
aggtaacactgtgatatagtaggacacatcatgaaaaaacagtctgcttttcatatattttcatggtgatttttgctgtgctcacagttctccct

SEQ ID NO: 6784207 - DNA, 61 bp, Homo sapiens
tgggtgaatcaatgaattgcacttcaacagcaaaattggattgtattgattggttggctca

SEQ ID NO: 6784208 - DNA, 60 bp, Homo sapiens
agtcaaaacgaagacacttttgaatacttagtgtatttatctgtgggagttgtttggatt

SEQ ID NO: 6784209 - DNA, 90 bp, Homo sapiens
ggggaagaaagcccagcgaggaggagggacccgcctgcaacttttccccaggtatgtgctgagctttccccgcgtgctgctttctcctcc

SEQ ID NO: 6784210 - DNA, 69 bp, Homo sapiens
tctacaatcagcaggtgcctcagattctttctgtattactgaagtctctggttgcttgcatgggttgga

SEQ ID NO: 6784211 - DNA, 56 bp, Homo sapiens
ggtgaaatatttttgatatgttgggttacataaaatatattaagattaatttcacc

SEQ ID NO: 6784212 - DNA, 96 bp, Homo sapiens
tgcatggagtgtcaggaaggggacgcagcacaggagtgctggatttacagccagccagcccctgactgtgtcctgctcaccccttcccctcctgca

SEQ ID NO: 6784213 - DNA, 80 bp, Homo sapiens
ttggttattgcattgtatctaataattctgatgataggattgaagtcctgtttgttggctattgacagtgtagaggtcaa

SEQ ID NO: 6784214 - DNA, 57 bp, Homo sapiens
cacatgtcccctctaggggctttattttcacttaaattcttctgcagggtgacagtg

SEQ ID NO: 6784215 - DNA, 90 bp, Homo sapiens
ctggtggaaatattttgagtgaaatccagggggactgaggtatagaaactgtactcaatttcttatgggtttccttacttcctcctctag

SEQ ID NO: 6784216 - DNA, 74 bp, Homo sapiens
cctcacctcagagccctgaagcagagctaaagttggactgctccatgctctccttagggctaccccaggtgcgg

SEQ ID NO: 6784217 - DNA, 76 bp, Homo sapiens
agtgtgtcaggaggcccaaagggcgcagagacaaaagcactgggaatttgtctcctctgggtctgatgataccact

SEQ ID NO: 6784218 - DNA, 109 bp, Homo sapiens
tagttctgaggttctgagtggtggcatgacatggcctgacttaggttttgaagatgtcacttcctgctgtctgctgtgttaagcacttaactgcattttattagaatta

SEQ ID NO: 6784219 - DNA, 122 bp, Homo sapiens
ccccttccctgaaatatgtatggatttaagtaaaattctgtttccttagcttgtaagtaagtagatgcaaaatggagtttagatatgcttatgttcatgttttggggaaaaaaaggaagggg

SEQ ID NO: 6784220 - DNA, 91 bp, Homo sapiens
cctccatgagggttaagggtttggttacagttgtaccccaacttacatgtatggctttacattgtatcaaccctcaactgtctatagaagg

SEQ ID NO: 6784221 - DNA, 109 bp, Homo sapiens
cagatcatcaggcattagattctcataggcacacaacctagaaccctcgcatgctcagttcacaacagggtttgtgctcctatgagaatctaatgctgctgctgatctg

SEQ ID NO: 6784222 - DNA, 76 bp, Homo sapiens
ttcggaggaggggcaggaagttggggcgctgatatcagatgctgttagatagatgctcgctttccccctgactgga

SEQ ID NO: 6784223 - DNA, 68 bp, Homo sapiens
attttccagatgaattccacagtggaagtatgttagctctatattgttggactatctccagggaaaat

SEQ ID NO: 6784224 - DNA, 122 bp, Homo sapiens
tcagttccaagacagactaaattagaatccccaggagagaggccagttggcctgtgtatatttaacgctagccctggctgattcttctcaggcaattttgggaaattatagctttaaattga

SEQ ID NO: 6784225 - DNA, 102 bp, Homo sapiens
ccaattgtaggaagcagcactatgtgtgactaatacctatgatcaagatataaagtggaaaatatgggtattttatacataacctgccactagcagccttgg

SEQ ID NO: 6784226 - DNA, 87 bp, Homo sapiens
ctgtgacatcagttctattatttacctattttacaggtgaggaaactaaggcatttgagatggtaaataactttccttaggtcacag

SEQ ID NO: 6784227 - DNA, 79 bp, Homo sapiens
gttctggaggctgggagtccaggatacagatgccagcaggtttggtgtctggtaagaacctggactctgtttccaagac

SEQ ID NO: 6784228 - DNA, 58 bp, Homo sapiens
cctccaggtgtttgtcaattccatcctggctctggggaacaaaacaagtgcctgcagg

SEQ ID NO: 6784229 - DNA, 87 bp, Homo sapiens
aggggctctacaggtcagctcctatggtctctgatgtccagtccaagtttccttcagtttccatggctccttgccctgtagccacct

SEQ ID NO: 6784230 - DNA, 63 bp, Homo sapiens
ttcctatagaaagctgtgtagactgctttctataggagcagtctacacagctttctataggaa

SEQ ID NO: 6784231 - DNA, 70 bp, Homo sapiens
ggaaactgaggttactagtgcctatcgctggctccgaggagctcacagcctagcactgtgacacaattcc

SEQ ID NO: 6784232 - DNA, 105 bp, Homo sapiens
tgcactcacacagggtttatgctgaacttgttaggggcctccaggactcaggagacctggactcaagtccaagttcacgtctaactgttgactctgggtgagtca

SEQ ID NO: 6784233 - DNA, 61 bp, Homo sapiens
caccctgtatgtccccagcaaacctctctccctgtggtcagcgctgtgggacagcagggtg

SEQ ID NO: 6784234 - DNA, 66 bp, Homo sapiens
gaagaagagctaaggagagttcaatttaacttgtttttggatactgtcctggagctcacactcttc

SEQ ID NO: 6784235 - DNA, 89 bp, Homo sapiens
cctgggctgcagcaagaaggaagccttcctgtatgctccaccctcaaccgtggagcagctggacaggcctccctacactgcagcttggg

SEQ ID NO: 6784236 - DNA, 62 bp, Homo sapiens
gggtggctgggattagtagcccatgtggggaacctgttggaatgcttgttcctagctggccc

SEQ ID NO: 6784237 - DNA, 68 bp, Homo sapiens
ttggtgagcctcttagcagcagtctactcttcccagtgtgatttacctgtcactgatgggctcaccag

SEQ ID NO: 6784238 - DNA, 79 bp, Homo sapiens
gctggcagcatttctactaagaaagttgattagatcctcaagtcacacatctaatccctttagtgaattgtcattcagc

SEQ ID NO: 6784239 - DNA, 90 bp, Homo sapiens
gagccaaatttggcaattcaccaaggctcgctggaggccgacttctcctccgtttgttggctgcttggcgagttgcttttgttttggttt

SEQ ID NO: 6784240 - DNA, 84 bp, Homo sapiens
cccgatttgcatcagtgctctgaggtccagggtgaaaggaaagaatccccagcagcccgggccccagggcaagtggaggtgggg

SEQ ID NO: 6784241 - DNA, 77 bp, Homo sapiens
ttatgagagttaaggacctactcagttattccctaattaaatcttggggttcctgagcagtttcttagggctcataa

SEQ ID NO: 6784242 - DNA, 70 bp, Homo sapiens
gccttgggaagtaatatggtggtctcacacactctactgacaggccttcatctcatgtgactccttaggc

SEQ ID NO: 6784243 - DNA, 68 bp, Homo sapiens
cctggcacatcactcctagtttacagctgaagaaattgactgtcagaaaggttgagtcatgtgccagg

SEQ ID NO: 6784244 - DNA, 77 bp, Homo sapiens
cacagataaggctttgtccccagctcagttcgctcccatcccccacctgtgcattccgggactgagccttgtttgtg

SEQ ID NO: 6784245 - DNA, 79 bp, Homo sapiens
tgtctacatatgcttttaggctatgatggcaccactgcgtcactgcaacagaggttatctagaccaaaagcctaagata

SEQ ID NO: 6784246 - DNA, 88 bp, Homo sapiens
atgtgttaaggaatgcaagttgtaaatgtagccagaagatcctaattcttctagggcatcatgacaaattacagaaatttaacttcat

SEQ ID NO: 6784247 - DNA, 67 bp, Homo sapiens
aggggcacaattgaactgaatcctggattgctgtactgcagcactaaccagcaagttcactgccctt

SEQ ID NO: 6784248 - DNA, 60 bp, Homo sapiens
agcagtgcaatttgagtgctgatgaggccaacaggtttgattcagaaggttgttattgct

SEQ ID NO: 6784249 - DNA, 104 bp, Homo sapiens
gagtggcccgggtaccgggggtgtggccagcgccaaagctgtgaaggatttgctcacaggctggtggtcctggccatggccatgctgcaggcctgaggtccctc

SEQ ID NO: 6784250 - DNA, 83 bp, Homo sapiens
tcctcatctgtctgtcactgtgctctgttcatttcttctgaagtgctaaccacaatccacagtgactgaaaggcagagaagga

SEQ ID NO: 6784251 - DNA, 73 bp, Homo sapiens
aacaatattgacacagggaaagcggatccatactccatgggtttggaaagctactctgtgttcaatatgtgtt

SEQ ID NO: 6784252 - DNA, 76 bp, Homo sapiens
gttcctgcctccagctttgacttgagatctcagcacaataagagtattctcaattcatgaagttggaattagtcac

SEQ ID NO: 6784253 - DNA, 91 bp, Homo sapiens
ttctggctactcacagtgtgtcttggatcagtagcatcagcgtctccctggagctgtctagaaatgctgagtctcaggccccactccagaa

SEQ ID NO: 6784254 - DNA, 79 bp, Homo sapiens
agtgtctagcatgcatggttcactgacatctcttcccacccccatccgtcacccaacagcatattcatgccagactact

SEQ ID NO: 6784255 - DNA, 70 bp, Homo sapiens
tcctggtaaagttactttgctgtgcttcaccccagtgttaaatgtgaagagggctgaagaacttccaggg

SEQ ID NO: 6784256 - DNA, 80 bp, Homo sapiens
ggtaagatttgctaagttcttgggtatatttttacaggagtatgttccatgagcccgttaagaatgttccaggtcttgcc

SEQ ID NO: 6784257 - DNA, 59 bp, Homo sapiens
ttgggaggctgaggttggcagatcacctaaggtcaggaatttgagaccagtctgcccaa

SEQ ID NO: 6784258 - DNA, 68 bp, Homo sapiens
atggaatcacagaagttgaatttgcatgactaaatttaagtgaatattttcttctgtaatttttccgt

SEQ ID NO: 6784259 - DNA, 73 bp, Homo sapiens
gccattggttataaagactcttaactccctagcgcttggtttgggcatgttgggaagggaagagtgagcctgc

SEQ ID NO: 6784260 - DNA, 83 bp, Homo sapiens
ggaaatgtgtaaaatgtcttatctcagttatgtttctgaaactctatgatctatacactggtttatgatattgtcttgtttcc

SEQ ID NO: 6784261 - DNA, 56 bp, Homo sapiens
gctgcccagggtggagccggctgctcgggagagagctggtgcctgctttgggctgc

SEQ ID NO: 6784262 - DNA, 68 bp, Homo sapiens
agggaaaggaagtagatctattcatggttgccctttagggctcaatgaggttttactgccattttcct

SEQ ID NO: 6784263 - DNA, 59 bp, Homo sapiens
ttagggtctagaatggatgagcatttttttagaaggagctcagcaactctagaatctga

SEQ ID NO: 6784264 - DNA, 66 bp, Homo sapiens
aagaatctatggtacatccaagaggtcggcaaatagtcaaattatctggatgtatctggatgtctt

SEQ ID NO: 6784265 - DNA, 61 bp, Homo sapiens
ttttggtgggaaagtagcagcctctccctcagagggagtaacaattgtctacctagcagaa

SEQ ID NO: 6784266 - DNA, 56 bp, Homo sapiens
gtccttaatctgattggtgcaggatcagggcatgttgcatctcaggtattaaggac

SEQ ID NO: 6784267 - DNA, 64 bp, Homo sapiens
gaaggcaggcaggtgggaatcagggcatgaattgagaaaactagagatttacctttgagccttc

SEQ ID NO: 6784268 - DNA, 66 bp, Homo sapiens
gatgtagggagatgcaagggacggagtatcaggagaacagtacctgttctgggctctccgctaatc

SEQ ID NO: 6784269 - DNA, 62 bp, Homo sapiens
gagtgtcagcagggcagagcactgggtgaggtcttaggccactctgagtttctgctgacctt

SEQ ID NO: 6784270 - DNA, 79 bp, Homo sapiens
gggtgcgtggcctcgctggggtgtctcgtctgccattgttcctcagttccaccgagtgacacctcgttagtctccaccc

SEQ ID NO: 6784271 - DNA, 83 bp, Homo sapiens
tttaaaagagattaagtctaggaggaactaggtgcaaataccataaacaaaaacttggcttttcttggtctttataaattgaa

SEQ ID NO: 6784272 - DNA, 60 bp, Homo sapiens
aatcagtcctgtgggttaaagagttgcttatggaaggggccttaaacacagagatagatt

SEQ ID NO: 6784273 - DNA, 89 bp, Homo sapiens
ccacaggggaaaatggaagagtgaagttgatgcttcctctggttttagactgtgactgaaggcttaactctttcattttcagcttgtgg

SEQ ID NO: 6784274 - DNA, 98 bp, Homo sapiens
ggatctagggaccagctctggggaccatggcatctaaaccaagctgttctccaggtgtgattgggtcatggccccagacctctggctttcttggatcc

SEQ ID NO: 6784275 - DNA, 71 bp, Homo sapiens
ttcctcttgctgtaggcacaacaaggaagtgagcaaaaacccttctagttacagtgcatagcaagattgaa

SEQ ID NO: 6784276 - DNA, 67 bp, Homo sapiens
gtagctcatgccagggactttgaagagatgagtgattttaggcaaagcaccttggctatgatgccac

SEQ ID NO: 6784277 - DNA, 63 bp, Homo sapiens
ccaggtccagctgggaaaacaggacagcctcacagcaggggtggcatttgagctggaccctgg

SEQ ID NO: 6784278 - DNA, 67 bp, Homo sapiens
aaagccatgacgtttttaagttgaaaaagatatagtctaatccagacccagagatgtcaatggcttt

SEQ ID NO: 6784279 - DNA, 105 bp, Homo sapiens
gctacatgtcaggatggatctaatatgccacttctctaagtcatgtatttgaaatgccacttatgttgacctttaagtagtatgtttgatttctgataatatggc

SEQ ID NO: 6784280 - DNA, 108 bp, Homo sapiens
agaaatgcctatgccagtcttttgggcatttttagtattggtttttgtccacttaggtgtgacaagcattgtatattggtttttgtccacttaggaccattagtttct

SEQ ID NO: 6784281 - DNA, 69 bp, Homo sapiens
tcaacagattttttcgctcaatggctgcttgaagttctactcacacagtacattcgaaaaattctgtga

SEQ ID NO: 6784282 - DNA, 72 bp, Homo sapiens
ccataatttttccacgtacactgggtacactgagtacccaggtaagaaaatgtacctgtgggaggattaggg

SEQ ID NO: 6784283 - DNA, 59 bp, Homo sapiens
gggacctgaggccctgctccactggcccagaagctctgtggaaatagcagccaggtccc

SEQ ID NO: 6784284 - DNA, 101 bp, Homo sapiens
gagaaggctgatgatggctgtccagtttctagagaagaaacctctccttaagaggaaacccttatctttagctaactggatgccaaaacgaaaggtttctt

SEQ ID NO: 6784285 - DNA, 86 bp, Homo sapiens
agggagtaactgggctccacagcagtgagtggaatggaaataaatgacagtgttcaacaaatggctagtcggagagggttttcctt

SEQ ID NO: 6784286 - DNA, 89 bp, Homo sapiens
cagtggaatagcatcaacatttatatgggttcatgaagctatgctgtgctttttactttcgttgtataaatagttgccctagttcactg

SEQ ID NO: 6784287 - DNA, 62 bp, Homo sapiens
agagttgaaactttgctattcagtgtagttgtaagcacatgcagtagaaatttcattgctct

SEQ ID NO: 6784288 - DNA, 79 bp, Homo sapiens
gtatgcacagccacgtaatgtggtcatcagcactgtcctgctgagctgccctggccacatgctgagctgccgccactac

SEQ ID NO: 6784289 - DNA, 56 bp, Homo sapiens
cctccacaggtaggcagagcgagtctgcatctgttggctgccttccctgctggagg

SEQ ID NO: 6784290 - DNA, 67 bp, Homo sapiens
acatgaaactgttgcattagaacatctttaaggtctttgccaattctagacttgtatagtttcatgt

SEQ ID NO: 6784291 - DNA, 59 bp, Homo sapiens
tcttggaaagggtggggaactatgaaggaatgaaaatgtccccagtgccctctctaaga

SEQ ID NO: 6784292 - DNA, 60 bp, Homo sapiens
ggattatttattttgcacccatcgcctgaccccaagagatgagtgcttagagagtaatcc

SEQ ID NO: 6784293 - DNA, 67 bp, Homo sapiens
cagtgactgtgggacccagccaagtaccctctaaagagttgcagcaggcttgtcaccatagctactg

SEQ ID NO: 6784294 - DNA, 129 bp, Homo sapiens
tacaggagtacttccgtgtggtgcgcatttactcgtgttgatggattttcgaggtaaaagtaataatattaccagtcattagttcattatgcagattaaatgagtagaattcaataaaagctcttagtg

SEQ ID NO: 6784295 - DNA, 90 bp, Homo sapiens
tttagaatggtctcgccatcagctttggcgctgagcatgaagtcgagtgtgctgtgccatgccgctgccatagtgaggcgagaccctgag

SEQ ID NO: 6784296 - DNA, 62 bp, Homo sapiens
cgattgcagaggctgttgctaattggagaagccccactaagcagcggcagcttcctgcttcg

SEQ ID NO: 6784297 - DNA, 57 bp, Homo sapiens
gctgctggcaagcccagttggagcagcacatttgttagctggaaacatgccggaagc

SEQ ID NO: 6784298 - DNA, 62 bp, Homo sapiens
gttgtggtgtcaaagcaaggattaaatgtattcatacatcttcaaagtgctttgcaagcggc

SEQ ID NO: 6784299 - DNA, 59 bp, Homo sapiens
tgcctgctaggcactttcaaactcggaaaaatgggagtatgagggaggctaagtaggca

SEQ ID NO: 6784300 - DNA, 56 bp, Homo sapiens
ggctcttctacttcagatggggagcacccgcttcccactaggcagacagaaaagcc

SEQ ID NO: 6784301 - DNA, 90 bp, Homo sapiens
tggcttaattcttggcacagaaaaactcactgtgagtgtgtgtctgtgtgtgtatatactgagttttctgtgccaattaaattatgtcca

SEQ ID NO: 6784302 - DNA, 70 bp, Homo sapiens
ttgggttccaagaatgggtgtttccagtgacagactgtggaagcttcctgttcttgaggtctgggcccag

SEQ ID NO: 6784303 - DNA, 62 bp, Homo sapiens
cagagggagccctccaggagcagggaagtcatatccgtggaccatttgtaggtttccctctg

SEQ ID NO: 6784304 - DNA, 57 bp, Homo sapiens
gaaattgtggggttaaaaggctgtgggaccacattcgttcattcattccacaacttc

SEQ ID NO: 6784305 - DNA, 55 bp, Homo sapiens
tcaagactctgggagttgaatcctatgttggaaaccattctccctagaattttga

SEQ ID NO: 6784306 - DNA, 100 bp, Homo sapiens
tgagatggagtcttcttctgttacccaggctggagtgcagtggtgtgatctcagctcactgcaagctccgcctctgggttcaagagattctcctgcctca

SEQ ID NO: 6784307 - DNA, 84 bp, Homo sapiens
cgtttggaaatctcagttacatcttgcctctgttctctaaatgcttgaaagaaaggaagacaagcagtggctgagcatccaccg

SEQ ID NO: 6784308 - DNA, 79 bp, Homo sapiens
gttgaaaatgaagtttcctgagtcccacccactgaattacaatttctggagatgaagcccaggaatctacattttaaac

SEQ ID NO: 6784309 - DNA, 66 bp, Homo sapiens
tctgtagcttctatcctaccatgtcttgacttgtaaacagtccaggcataactgatataagccaga

SEQ ID NO: 6784310 - DNA, 77 bp, Homo sapiens
gcagcccaggagctcggcgagaaactttgccatatacaagcggtgaggcagggtccctcccgatgcgccgtttctgt

SEQ ID NO: 6784311 - DNA, 105 bp, Homo sapiens
ccaagcagaggaactgcctctcggggcagccaagaaccacagacccaggcggctgcagctcctacttctgaacttctggtctcccgagtgacagcttctgcatgg

SEQ ID NO: 6784312 - DNA, 59 bp, Homo sapiens
gtctcagattcagacatctacaggtaatttggatcagtaaagggtgctggatttaaggc

SEQ ID NO: 6784313 - DNA, 112 bp, Homo sapiens
tacttctctggaaagcttgctacacattggccaaaagtttttccaattccaattccaatttgtatctattgaaagattttgggctcatggaagagcattagctggggaagta

SEQ ID NO: 6784314 - DNA, 99 bp, Homo sapiens
gaggcgggaagatcacttgagcccaggaggtcaaggctgcagtgagctgtgattgtgccactgcactccagcctgggtaacagagtgagactctgtctc

SEQ ID NO: 6784315 - DNA, 65 bp, Homo sapiens
ggaggaagaggttcagagaaggcgatcttgggcaagatgctccctgtctgggcctcagtttcacc

SEQ ID NO: 6784316 - DNA, 57 bp, Homo sapiens
aggcgggagggatgttgtagactcctcactccatgagcatacagtattttctcgcct

SEQ ID NO: 6784317 - DNA, 63 bp, Homo sapiens
gcttaggagaagggtttggatgaggcagtgaacggcctgaattctcaacttttctctttgggc

SEQ ID NO: 6784318 - DNA, 62 bp, Homo sapiens
ccacttgcaaaagagaaagttatttttccaatggaaattaggctttaaaatttttgccaggg

SEQ ID NO: 6784319 - DNA, 67 bp, Homo sapiens
agatacgggaggagggagtgtcctgtcttttcctctgaggctggtgacttcatctcctcccctctct

SEQ ID NO: 6784320 - DNA, 64 bp, Homo sapiens
gcagggcttgcaggtgctgaatttggactcccactgagcccatttgcggcttctgtcaccttgc

SEQ ID NO: 6784321 - DNA, 69 bp, Homo sapiens
ggcgcttgcaggggctcccccagttctgcgctgtgagccggggcacaaagagccctctgcactagcgcc

SEQ ID NO: 6784322 - DNA, 69 bp, Homo sapiens
cacttacatgctggtgactgtagacaaggcttccctcctgtctagcgctggtctcctgtgtgtcaagtg

SEQ ID NO: 6784323 - DNA, 76 bp, Homo sapiens
aggaggccggaagggaggatctttctctagcatgtagtgtatcaagtttgaggagaagactttgcttccccttcct

SEQ ID NO: 6784324 - DNA, 72 bp, Homo sapiens
gaggtttccaggggtcagtgtcctcctggggctggagtcagggactgttactgcctttggttttcatgcctc

SEQ ID NO: 6784325 - DNA, 56 bp, Homo sapiens
tcattctcacactcgtcaatgtctgcaaaaggaagggcatgagaggtgtcagaaga

SEQ ID NO: 6784326 - DNA, 98 bp, Homo sapiens
ggttaggtacattcttgatggtttggttcatgagaaaactttttgggggcaggatagaccccagaatcttggaactcagatcacagaaatccctaatt

SEQ ID NO: 6784327 - DNA, 64 bp, Homo sapiens
ttgctttttgctattttgagtctattctgcagcatagaggtataccaaaaaggcatctgagcag

SEQ ID NO: 6784328 - DNA, 81 bp, Homo sapiens
ttggaataaatacatttgaagttagatctgatgctgccaattatcagttatggtcttagccaagtttctttatctctccaa

SEQ ID NO: 6784329 - DNA, 60 bp, Homo sapiens
ctgccctccaccgacgaacccacaccaatgagctcagtgctggggtagtttgtggcacag

SEQ ID NO: 6784330 - DNA, 69 bp, Homo sapiens
caaatggcgtctgttgacgattggctggtgactagcgccaccagccaatcagcgctcagacgaccagtg

SEQ ID NO: 6784331 - DNA, 114 bp, Homo sapiens
catgcttttcagaatgcagctgccggattgtaaccatgatgagcaggtatagaagtggatgtgcggatcctgatcttcatggttctgacctcagtgaattcacggtaaagcatg

SEQ ID NO: 6784332 - DNA, 101 bp, Homo sapiens
agtgagtcgattaaagaagtaattaaagtgtaaaacagcaggaaaaggacttgcttttaaaagatgctgtaatacttaaggttaagtcaaatcagcttact

SEQ ID NO: 6784333 - DNA, 88 bp, Homo sapiens
gaggttagggggcaagattctgtgaatgcctaccctgtgctgcatcctcagctgggcactgtcccataggctctttagtccccacctc

SEQ ID NO: 6784334 - DNA, 58 bp, Homo sapiens
tccatagaaactagattgatagcggaatatttattcctttgtcctgtggtatcttgga

SEQ ID NO: 6784335 - DNA, 97 bp, Homo sapiens
aagtgggggtcctctctcagagtctctgggaggctgggtctggctaagggaaaggttgcaagattgagcctcgctaagattgggagagctgccgctt

SEQ ID NO: 6784336 - DNA, 56 bp, Homo sapiens
gcccacaggcaggtgcatgggctggtcccgccagcacctgcaaccttcttgtgcgc

SEQ ID NO: 6784337 - DNA, 64 bp, Homo sapiens
gattctaatcttcagccagcatgaaaaacactggattaggagtgctggagtgagattatgagtt

SEQ ID NO: 6784338 - DNA, 65 bp, Homo sapiens
agcttgtttatcaccttggagattggttgctaaaatgttcaagtttaaggcactgataagtagct

SEQ ID NO: 6784339 - DNA, 69 bp, Homo sapiens
tctggtgcacctttgtgcttgcatagcttgcgtctaaagcagcagcaggacatggaggagtaaactgga

SEQ ID NO: 6784340 - DNA, 71 bp, Homo sapiens
tgtatactgggttgggcttttgagttgattcgaagttccgtatttccttcatcagcctatcctgttataca

SEQ ID NO: 6784341 - DNA, 66 bp, Homo sapiens
ctctttgccaggtaagtactatgctctaggagggctaataggatggttatattgcctagtgaagag

SEQ ID NO: 6784342 - DNA, 74 bp, Homo sapiens
gagagttttttacactatgaatgagaatatatctagtaagtagttctgggtatgttgtggcctgaataactgtc

SEQ ID NO: 6784343 - DNA, 109 bp, Homo sapiens
ggtgctctgcttctcgaaactgggctctgcatcactcttactggcttttgattgggattatatcaattctctgtggtgatgctggtggccctgtgctgaattgggcact

SEQ ID NO: 6784344 - DNA, 64 bp, Homo sapiens
gtagatcatgagaatgtttttgttgttccgtgataaaggatcaaaagctttgtttctgttctgc

SEQ ID NO: 6784345 - DNA, 56 bp, Homo sapiens
gagcttggtgctgcctgttgtctgcctgcccctgacctgaaggacatgcccagctc

SEQ ID NO: 6784346 - DNA, 81 bp, Homo sapiens
ttctgcaggttcacagttaggacaactgcttcacacttgttaaatgtgttaagttgtggttctaaccatgtgatatcagag

SEQ ID NO: 6784347 - DNA, 94 bp, Homo sapiens
ctgatacacaatgtgtgatatatgcatacaatgagatattccttggccttaaaaaggaatgaagtactgatgcatactacaagatggataatag

SEQ ID NO: 6784348 - DNA, 104 bp, Homo sapiens
ttgagatggagttttactcttgttgcccaggctagagtgcaatggcgcgatctcggctcattgcaacctctgcctcccagattcaagtgattctcccatttcag

SEQ ID NO: 6784349 - DNA, 55 bp, Homo sapiens
ggagtgatgcttgctgcctccaaaacctggagagccctacaaggcgttttgcttc

SEQ ID NO: 6784350 - DNA, 95 bp, Homo sapiens
agatatgaagtttcgttaatagtatttttccaaagttaatttcctagtattaggggaaaatgagtgaagagtatatttagtgaaatctctgtact

SEQ ID NO: 6784351 - DNA, 76 bp, Homo sapiens
gccaggttcatgttgaactggcagactcagctgtttagaaatagaacttgagctttgaagttcaatatttcttggt

SEQ ID NO: 6784352 - DNA, 56 bp, Homo sapiens
ttgagatggagcctcagtcttgtggcccaggctggactgcaatggcgccgtctcag

SEQ ID NO: 6784353 - DNA, 65 bp, Homo sapiens
agcatgtgtgcctgagtgatggacttggtatttacaccagccacgctgataagtgcacatgtgtt

SEQ ID NO: 6784354 - DNA, 64 bp, Homo sapiens
gtctgatttatggtagaaaaactgagtccccaggaactggggaagtgactggcaagaagaggac

SEQ ID NO: 6784355 - DNA, 69 bp, Homo sapiens
ttgcacttaaggtaggtgtgaaagttagacacatttccaggatgactttcagcctgacctttagtgcaa

SEQ ID NO: 6784356 - DNA, 60 bp, Homo sapiens
gaggagctggcagcgcaacccagatgtccaggattatctcattcagtgctctagtttgtc

SEQ ID NO: 6784357 - DNA, 75 bp, Homo sapiens
ctcacaattcagtaagtcaaggtggcatttgagagggacggttccctttagcgtagctgacagctaatttgtggg

SEQ ID NO: 6784358 - DNA, 63 bp, Homo sapiens
ctcttgcttgtttgtttgtttacttggtgttgtgggccaactgctaagcaaagaagcaggttg

SEQ ID NO: 6784359 - DNA, 74 bp, Homo sapiens
tcaattggcccaatagagaaatagtgaaattcagcagacactgttattttctgactctattgaggtatcattga

SEQ ID NO: 6784360 - DNA, 66 bp, Homo sapiens
ggcactgtgttttgtgcttttgtgtaaggaacagcaaaaagcatgcaaaggcacagcaacagagct

SEQ ID NO: 6784361 - DNA, 88 bp, Homo sapiens
ggagaatcgcttggacctgggaggtggaggttgtggtgagccaagattatgccactgcactccagcccgggcaacagagtgagactcc

SEQ ID NO: 6784362 - DNA, 72 bp, Homo sapiens
ttttttacctagtttttatcttttgtttctcacagcactttttaaaggaatctttggcagctaggtaaagaa

SEQ ID NO: 6784363 - DNA, 112 bp, Homo sapiens
actcattgaacattgaatactctcagctcagagataatcaagagacagttcattcttgagagtgcaggttttcagaatgttctgagaaagagtgaatgattttaaggtgagt

SEQ ID NO: 6784364 - DNA, 59 bp, Homo sapiens
tagcaagaagctgtcacaggtgtgactttgtgacatgtgtgggtggtcagtttcttcta

SEQ ID NO: 6784365 - DNA, 56 bp, Homo sapiens
aaatttgaagtgccaattttgtgctaaacgtaggtagaaaatggcgttttagattt

SEQ ID NO: 6784366 - DNA, 62 bp, Homo sapiens
ccttctgggaggctggctgtcataactccttatgtttgcacagcattccacggtttataagg

SEQ ID NO: 6784367 - DNA, 73 bp, Homo sapiens
atgccattggaatagggactcaatgctctcaggactctttctctccctccattttctctgcttctcttggcat

SEQ ID NO: 6784368 - DNA, 78 bp, Homo sapiens
aagacatttatggctgtgttacccaaggtcaggaaaatgttaaaacctccttggctagtactggccagcttgtgtctt

SEQ ID NO: 6784369 - DNA, 91 bp, Homo sapiens
gctgttcatttttactctacctcgttttggaatcactaatgtggccaatttatagccaaaaatcagtatcgtagagtgagcaatgaatggc

SEQ ID NO: 6784370 - DNA, 62 bp, Homo sapiens
gtggatggattttgaggaatggtagagattctaaagagtgagtccacatcagagtttaccac

SEQ ID NO: 6784371 - DNA, 61 bp, Homo sapiens
gttactctttggtgttaagttcacaagtcttagctgggatgaattttgacactagagaaac

SEQ ID NO: 6784372 - DNA, 61 bp, Homo sapiens
cagtagcttggccctttgttctttaagaaaactgcataggaataaccttgccatgctattg

SEQ ID NO: 6784373 - DNA, 70 bp, Homo sapiens
ggtgagcatggagggaggacccccaacacctcagagacctgtgctgcagggccttccctgcatgagcagc

SEQ ID NO: 6784374 - DNA, 82 bp, Homo sapiens
tggccgatagtttcttctgtcttgcttccaggaaccttttcttggtttgaagccaccgaaccagaagagagaatttttacca

SEQ ID NO: 6784375 - DNA, 69 bp, Homo sapiens
tgttatagataaaaaggctgagtcaccagcagcagcagagacttagcaggtactttcatatttttaaca

SEQ ID NO: 6784376 - DNA, 100 bp, Homo sapiens
atgtccacctaaatctgtgtatgtgaccttatctggaattagggtccttgaaaaatgcaatctcattaagatgaggtctgactggattagggtaggtcat

SEQ ID NO: 6784377 - DNA, 66 bp, Homo sapiens
gaggcgggcgaatcatgaggtcaagagagcgagaccatcctggccaacatggtgaaaccccgtctc

SEQ ID NO: 6784378 - DNA, 56 bp, Homo sapiens
tcgctttaattgtctaatatgcttcaaagagagaagcaatgaaaacaataaggtga

SEQ ID NO: 6784379 - DNA, 75 bp, Homo sapiens
tcctaggcaggcctgtcttgctcgcccttgcatctgggaagcagtgggcagggtgggctagactcttccccagga

SEQ ID NO: 6784380 - DNA, 59 bp, Homo sapiens
taagtgggctcaggtgcttggacctgctcttggccgatctgagatctgaagcttactta

SEQ ID NO: 6784381 - DNA, 68 bp, Homo sapiens
gagtagcagtagtccaagccagatgctgacatctattattttctgcccttggtgtggctgatgagctc

SEQ ID NO: 6784382 - DNA, 76 bp, Homo sapiens
ttctatgaatgacacagataatagaacgaaaaccatgttcttttcttggaatattgctttgtgtcataagcaagaa

SEQ ID NO: 6784383 - DNA, 130 bp, Homo sapiens
ttgtggtccagtagcattagcaccacttggcatcttgttgcaaatgcagaatcacggttctcattgagacttattgaatcagaatgggcattttaataagattcataggtgtttggcatgcacattgcag

SEQ ID NO: 6784384 - DNA, 79 bp, Homo sapiens
cttgtttatctctgtagccctggttttgtttaccacttaatagtattcacctcattgggctgctggaagactgaacaag

SEQ ID NO: 6784385 - DNA, 82 bp, Homo sapiens
gcttcccagcagccctgcagaggagtcagcctgggcagaggctgcctctgccctctcgctgcttggcagtgccaggggaggc

SEQ ID NO: 6784386 - DNA, 98 bp, Homo sapiens
agaaaaagaagccagtaggttttctgcaggtagcaggtacggttgtgtgattaagaacacgtgtatttctatacctaaactttctggccccctcttct

SEQ ID NO: 6784387 - DNA, 82 bp, Homo sapiens
caaggcacacaatattaccaatgcttggaaaaattagatttgaatttcaaaagcgtacgtagtgaagtggctctatgccttg

SEQ ID NO: 6784388 - DNA, 78 bp, Homo sapiens
catcacctgcctcccagtttttctccactaaggcaatcatggttgccttagggactaatagactgtcaccaggttttg

SEQ ID NO: 6784389 - DNA, 65 bp, Homo sapiens
gggattaagcacttggggaaaggatccagaccagccctcaggatcccctgccttgggtgagtccc

SEQ ID NO: 6784390 - DNA, 87 bp, Homo sapiens
cagtggctggaccactgtgctccccagcaggctccggggctccctttatttcaagtcctgctttgggcagctttgtggccctcactg

SEQ ID NO: 6784391 - DNA, 55 bp, Homo sapiens
atgatgtgccctaagtatccagagcagagtctggcatacagtaggtgctcaatat

SEQ ID NO: 6784392 - DNA, 60 bp, Homo sapiens
agaaaagtttaaatcttggcactctcttctctttgagaatgcagagatttttacttgtct

SEQ ID NO: 6784393 - DNA, 82 bp, Homo sapiens
cctctcgtttatttcaacgtatgaaaagctgtttctagcagggcgcagtggttcaacgttgtaatctcagcactttgggagg

SEQ ID NO: 6784394 - DNA, 69 bp, Homo sapiens
gggttgtcattctgcaggccgagggctgatccctgtggaggggccctggctgcttgtagtctggctctc

SEQ ID NO: 6784395 - DNA, 66 bp, Homo sapiens
gttaatgtaagggctttgggttttactctgcaaaagaatggagctctggaagttctaagcagaggc

SEQ ID NO: 6784396 - DNA, 58 bp, Homo sapiens
ggatggtttgccaaaaaagtctaagagaaattttagctaagcattatgtaaactatcc

SEQ ID NO: 6784397 - DNA, 60 bp, Homo sapiens
cctggaattgggttaggagccatgcaatacaacatactgcaccatccaatccatttcagg

SEQ ID NO: 6784398 - DNA, 88 bp, Homo sapiens
gtttagtatatgatgaatatggtatttcacacttgatcttagccaaaagcctgagaagtaatgaatacggtatttgaaatgacagggc

SEQ ID NO: 6784399 - DNA, 106 bp, Homo sapiens
agagcttgtggccaagaagatggagttgcaggtggtttggccatagagctgatgcttgctaaatgtgttatatctgtgatggtcattttaggttaataaaagctct

SEQ ID NO: 6784400 - DNA, 108 bp, Homo sapiens
aaattgccttttcttggagaaaaaaatacttacagattgtggctgtggtctattatgctcaagtaaatcacatcgaaatctgggtgtgttttatccaaaagacaattt

SEQ ID NO: 6784401 - DNA, 66 bp, Homo sapiens
gcttttttgatgcaaaaactctaggaatagtagccctatgtctcagagtgttgtattagagaatgt

SEQ ID NO: 6784402 - DNA, 70 bp, Homo sapiens
agccttggaaggcagccagatggcagcctgcagtaggacctggcaggctcttctttctgcccagccggct

SEQ ID NO: 6784403 - DNA, 62 bp, Homo sapiens
ttcctgagcttttaacctagtctattccaattttaagctgacaataggtaaaaagagaggaa

SEQ ID NO: 6784404 - DNA, 70 bp, Homo sapiens
cgtgaatcccacaggtggagcttgcagtgagctggattggctactgcactccaacctgggtgacagagcg

SEQ ID NO: 6784405 - DNA, 63 bp, Homo sapiens
ggcagtggtacttagcgtggcatcatggacataaaagtgtacatgtatgtgttaatatctgcc

SEQ ID NO: 6784406 - DNA, 96 bp, Homo sapiens
cctttcccaaaggcaggccccctgtgcagcttcaactattcactctatttataatgttgttcctggatattgggcttgcttccacttgtggccagg

SEQ ID NO: 6784407 - DNA, 74 bp, Homo sapiens
ttctggccctttgcattatccttgattgagcctgtgagcttcaaggacaggagataatataaagataaacagga

SEQ ID NO: 6784408 - DNA, 63 bp, Homo sapiens
ggttcagcaaaggaccagcacaggctttggtcttaggcttggctggctgaccttgcaaagacc

SEQ ID NO: 6784409 - DNA, 124 bp, Homo sapiens
ttctagggacacagaggtggggattggggcttgcaatcccctaaaaattcatcccccaaactcttccaccccagagttgggaagtatttttagtgggaggcctgtgatcattggtgacttagag

SEQ ID NO: 6784410 - DNA, 74 bp, Homo sapiens
gcttgactacagaagctctctatggattctagcccagccagcttgaattccactttggcttttggggtcaaagc

SEQ ID NO: 6784411 - DNA, 69 bp, Homo sapiens
gctttatggaatcaaagactggaaggaaatcaaagcacccttccatccagctccattattttatatagc

SEQ ID NO: 6784412 - DNA, 62 bp, Homo sapiens
ccatgtgaccatcagtgtgaaggacttctgtcaatggactactcccatgttatggtcactgg

SEQ ID NO: 6784413 - DNA, 61 bp, Homo sapiens
ttcccaggatgcaattttgaatcagccctggctactgagagctgtctctggctcctgggaa

SEQ ID NO: 6784414 - DNA, 130 bp, Homo sapiens
tggctcacttttcagaggtgcatttactctttgacccactagggtactatttagtgttctagaagaggtaatttagtaaattgtaccccagtggcctgaaaaagttaatgcaactctgaaaagtgagcca

SEQ ID NO: 6784415 - DNA, 86 bp, Homo sapiens
gtgatatgttctacattcatttgcactggattactggggtgctttttagcatgtgccaagaaattgagtcataatgaagcatatcc

SEQ ID NO: 6784416 - DNA, 62 bp, Homo sapiens
gggtacaatttatggctgtaaagaatgaggtttatcttaacagacattccataatgtacacc

SEQ ID NO: 6784417 - DNA, 55 bp, Homo sapiens
cttcccagaggagatttgcttatatttgagtgtaatgagcaatctttctgggcag

SEQ ID NO: 6784418 - DNA, 82 bp, Homo sapiens
gccttcattctgagagtcttgagtccgtgagtccacaaatgattctgtgattctggaattctaagattctgtgaaagggagc

SEQ ID NO: 6784419 - DNA, 63 bp, Homo sapiens
ctttctcctctcttacctggtacaatggattatcatttcttgttggaggtggggaggggagag

SEQ ID NO: 6784420 - DNA, 68 bp, Homo sapiens
tgtaatttattgtcaaaaacaggacactttggagaactaaagtggacgttggtgataattaagctgca

SEQ ID NO: 6784421 - DNA, 102 bp, Homo sapiens
tgaggcacgagaattgcttgaacctggaaggcagaggttgcagtgagctgagatcgtgccactgcacttcagcctgggcgacaagagcaaaattccatctca

SEQ ID NO: 6784422 - DNA, 83 bp, Homo sapiens
gttctaagagtaaaggccctagactggggctaaggaataaatcatattaaaaggcctggagctccagggtctcctcttggcac

SEQ ID NO: 6784423 - DNA, 62 bp, Homo sapiens
ggcacagctgttgcgtcaggcaaggtcacctgcatttatttattgagcagcagtgctgtgtc

SEQ ID NO: 6784424 - DNA, 67 bp, Homo sapiens
gagccagagattcacgttccaggagccctgactgtctcatctcagggaattgaatctccttgtgctc

SEQ ID NO: 6784425 - DNA, 58 bp, Homo sapiens
tgcctgccttgctgctggacaggacacagaaatctctttccagatattaagacaggca

SEQ ID NO: 6784426 - DNA, 88 bp, Homo sapiens
taatgccattcttttgatgtgcttgtagcaatacacaagtttcttaagagctaaacattactacgagctaggcaggagaaaagcatta

SEQ ID NO: 6784427 - DNA, 64 bp, Homo sapiens
cctgcagacacttgtccagcaagtggccactccaggatttggaccaaggtgatgtgtcttcagg

SEQ ID NO: 6784428 - DNA, 55 bp, Homo sapiens
taatccctagagttgagcaaataaaccatgtctggccaatcagctatagggattg

SEQ ID NO: 6784429 - DNA, 56 bp, Homo sapiens
ttctgcctggcaggaggactgtggcccggttgtccaatcgataatgcccagcagag

SEQ ID NO: 6784430 - DNA, 57 bp, Homo sapiens
gtgagggatcgaggttgcgctgtccttatgagagtctaatacctattgatctgtcac

SEQ ID NO: 6784431 - DNA, 69 bp, Homo sapiens
tggcccgaccacaggacaccttagctaaaattcagaaacttttggatattgttttggttcctcaggcca

SEQ ID NO: 6784432 - DNA, 62 bp, Homo sapiens
atgtccatttttataagtgaagctgaaagaggtagagaagttttattaacaactgtggacgt

SEQ ID NO: 6784433 - DNA, 60 bp, Homo sapiens
gggtggggtgggctgccatgaagtcagaagctgccatctggctttatgctcacccagcct

SEQ ID NO: 6784434 - DNA, 64 bp, Homo sapiens
gtcatcctgcaccaaagttggcttggagaaactgcccctcctccagcccttgctgaagggtggc

SEQ ID NO: 6784435 - DNA, 60 bp, Homo sapiens
acagcctgacttttgttgtcacacgggtactaagccatattgagaggaagtgcaggctgt

SEQ ID NO: 6784436 - DNA, 102 bp, Homo sapiens
gatacctgaggaaaggtctgtggtcggagctgagtgggtttattgatcttactggaaaatgggcatttcagcttctctccaaggaaccagcccagacgtgtc

SEQ ID NO: 6784437 - DNA, 78 bp, Homo sapiens
gggcaggtgcctccctcctgtctccttattctacacttggcacaggtgtatctgacagtggagcggaggacacagccc

SEQ ID NO: 6784438 - DNA, 63 bp, Homo sapiens
cagagcccaggtgttctttgtccctgttcatgcagttcctatgaatatgcatgcacctctctg

SEQ ID NO: 6784439 - DNA, 76 bp, Homo sapiens
cagtgtagaaatcggagcttggaagcttcctcttaaccgggagaaagccatagcccagctttacgatttcccattg

SEQ ID NO: 6784440 - DNA, 98 bp, Homo sapiens
agaaagagtttcgctcttgttgactaggctggagtgcaatgatgggatctcggctcactgcaacctctgcctgccagattcaagtgattctcctttct

SEQ ID NO: 6784441 - DNA, 72 bp, Homo sapiens
gtgaagtttaggaaacgctgctattgactttgatgctggttcttcacagtcgattctgtttcttaattttac

SEQ ID NO: 6784442 - DNA, 59 bp, Homo sapiens
aggtgaagttgaggaggcagaaagacattcttgtcagtcccttctctgtgcttctgctt

SEQ ID NO: 6784443 - DNA, 73 bp, Homo sapiens
cacttgcattttcagcctcacaattggcaactttaccagaaaaaagtagctattttgcttggaaatacaggtg

SEQ ID NO: 6784444 - DNA, 101 bp, Homo sapiens
aaaaatgaaataaaaacagattcttcaccatggataatttggtctaccttaccagggcttagtaatcttaggtcaagatagtttactttttgttcattttt

SEQ ID NO: 6784445 - DNA, 85 bp, Homo sapiens
taaactcttcctggctactaggtaccatttagaactgtggggcaataatttacttcatggtaccttggtgacctcaaaaagttta

SEQ ID NO: 6784446 - DNA, 113 bp, Homo sapiens
tttttctccatcctttaactaacatttaaaattattttgcactttcatttgtaactacctaggggtgaaatgcaacagttatttttgtggtggttagagtggtccctgaagaa

SEQ ID NO: 6784447 - DNA, 80 bp, Homo sapiens
gagcttcggttgcctcattcggaattcggttccctttcagggttgctgtgagggtctagtgaggtgatgtatgtaagttc

SEQ ID NO: 6784448 - DNA, 59 bp, Homo sapiens
agcatggagctcgcacacagctctctcgccttccaggcgtggctcagtggcaccatcct

SEQ ID NO: 6784449 - DNA, 112 bp, Homo sapiens
gcctgtacagctctgtgatttatgatgacatcacgtcctttcagagataacactattatgtcactgaacctgaagtggtgaggtcagaagtacatgtgaagtaattatgggc

SEQ ID NO: 6784450 - DNA, 78 bp, Homo sapiens
gcccttgaaataatgagctgtgatctatgataaatgtgccaataacacattttccagggcagcatatttcagatgggt

SEQ ID NO: 6784451 - DNA, 80 bp, Homo sapiens
ctgcaggaaacctaaattattgtcatgtctacttgttcttaataggtccaagagaactgaaataggacaggatttttcag

SEQ ID NO: 6784452 - DNA, 70 bp, Homo sapiens
tgggcatgccttagttgaatggtgtataaatttgagggctatacattgattcaggatataggcagttcca

SEQ ID NO: 6784453 - DNA, 66 bp, Homo sapiens
gggagaaaaggggtgacacatatcagtgcagtggctgtggtgatctgtgtgcccccagcagctccc

SEQ ID NO: 6784454 - DNA, 63 bp, Homo sapiens
gaatcctgtcatcatagtacttgaaggtttgatgatacttggagatcattctgactaggattt

SEQ ID NO: 6784455 - DNA, 57 bp, Homo sapiens
gcagggcgaatgctgcttgtgtcttatccaggacagactggcctgtctcgcacctgt

SEQ ID NO: 6784456 - DNA, 76 bp, Homo sapiens
tcaggggacttttccatctatttgtttctgcccctggcaaggcagcaggcagccatttggaaggcacagcccctgg

SEQ ID NO: 6784457 - DNA, 59 bp, Homo sapiens
gcagtgggattgggattggaacctaggtagtttagtttgggagtcacattctttactgc

SEQ ID NO: 6784458 - DNA, 61 bp, Homo sapiens
gcttcctttctccaagaatagtttcaggggccaagaaggctgggaaactggggtcaggagc

SEQ ID NO: 6784459 - DNA, 60 bp, Homo sapiens
aatcaaggtgccaggagggaatttaggttaaaaaatccaacctccttcttgtcacaagtt

SEQ ID NO: 6784460 - DNA, 64 bp, Homo sapiens
gcctgagtgcatctgcagacattatgtgagtggtagggcttagatggaattagagcactgaggc

SEQ ID NO: 6784461 - DNA, 86 bp, Homo sapiens
ccgggtgactcgtacgtagtcagtgctgggaagcgctggtctacagtcatgtttctcaagcttgaatgcacatccgaatcccccgg

SEQ ID NO: 6784462 - DNA, 79 bp, Homo sapiens
tctcatttgattgacaaggaaactataccagaatcctcggtttaaatgttctggttttggtgtacttggcattatgaga

SEQ ID NO: 6784463 - DNA, 58 bp, Homo sapiens
gggctagaacagtcaaagtgagctctgtcatggaagggctgaggtcctgctctagccc

SEQ ID NO: 6784464 - DNA, 63 bp, Homo sapiens
tgctcatttcaaagtgaataatgtggctctcttgggctgtgtttattctcttgatttgatgca

SEQ ID NO: 6784465 - DNA, 75 bp, Homo sapiens
ttcatgtggcaaatatttctgagttaagtatgccaaatactttgttagttcctggggaacatttgccaatatgaa

SEQ ID NO: 6784466 - DNA, 78 bp, Homo sapiens
gagtcaggcactgctgctgctctccgatctgcctgccctgcttccaggctgagttatgcggcaacagtggcctgattc

SEQ ID NO: 6784467 - DNA, 66 bp, Homo sapiens
ggtcaggatgttaatatagcattaaggaagcaaatgtgtattaaactttattagcagctcctgggc

SEQ ID NO: 6784468 - DNA, 88 bp, Homo sapiens
agtttttgatgtctgtgattctaaattaaggcctgaaagggcaggttttcttacaggagagatttagtaatcatcacatcagaaaact

SEQ ID NO: 6784469 - DNA, 77 bp, Homo sapiens
gcttaggggacttagggatctttggcaaggtagggtgccatatacctaggctctgatctcctgggtccccatgaagc

SEQ ID NO: 6784470 - DNA, 108 bp, Homo sapiens
tggcttagctgggactgaggcataatcaggattgggactcagagttggtacttagcctgaggtcagagtttagtctggagttggtgccaagtctgggatcgggggtca

SEQ ID NO: 6784471 - DNA, 82 bp, Homo sapiens
gataagatttgcacagatgagggtgatgctatggggtcccccagagcaattaatttattcatttcttcagtaaatatttatc

SEQ ID NO: 6784472 - DNA, 71 bp, Homo sapiens
ggctcctcttaactgtgacagtttctcagactttccttgtttttgatatcattgacagttttgaggcagtt

SEQ ID NO: 6784473 - DNA, 60 bp, Homo sapiens
gagtttggcagataagtctaaagtggggatgaaatgttctaggacttggtttccaggctc

SEQ ID NO: 6784474 - DNA, 107 bp, Homo sapiens
aaccacaccctgaccctgtgccccacaaagcagaggcctaggtggaaggcccagggtgtgggccgctccctggaccactgcagtggtggcttgggcagagtggggtt

SEQ ID NO: 6784475 - DNA, 64 bp, Homo sapiens
ggtggccagtgtgcaggtcagagattaaactggtttgatcttcagttcctccattgagactacc

SEQ ID NO: 6784476 - DNA, 62 bp, Homo sapiens
catgtctgtctccgtgaataggccttccttagttgggaaagtcatttaaaagggaacacatg

SEQ ID NO: 6784477 - DNA, 59 bp, Homo sapiens
tggagtgcttttccatagccaatgggcacatgtttgtgtatctgtgggaaggctttcta

SEQ ID NO: 6784478 - DNA, 108 bp, Homo sapiens
ccttttcttaaaaaagagtctcttataatgtagccaaattaagatgaggtcatgctggagtagaataggcccttaatctgatatggctggtgtctttgtaagaagagg

SEQ ID NO: 6784479 - DNA, 79 bp, Homo sapiens
gccactgctctggccatcttgaggtgccagtctgaggggcaatctgagcagaggcaccatctggaacagccatggtggc

SEQ ID NO: 6784480 - DNA, 56 bp, Homo sapiens
agctgagctcaggctgatgtaatcatgcatcccgggaatcagcccagagcccagtt

SEQ ID NO: 6784481 - DNA, 85 bp, Homo sapiens
ttggatttgtggcactatgagttataagtggaccacggaaatgaaactaatgtccaccctataattttttaatgtacaaaattga

SEQ ID NO: 6784482 - DNA, 59 bp, Homo sapiens
gctttaggagacacgaaacagcctaaaacagcatggtttggggctgtttctccagaagt

SEQ ID NO: 6784483 - DNA, 81 bp, Homo sapiens
gaatagtgacagagtaaatccaagaacgctgtagaaggaagacacttctttaggcctcttagagttaactgcttcctattc

SEQ ID NO: 6784484 - DNA, 81 bp, Homo sapiens
gtgtgagatctgcatggtatttgcttttcatggtgcccacccaagcaatgattggcactagatacacagtgggtcacatgc

SEQ ID NO: 6784485 - DNA, 59 bp, Homo sapiens
ttccagcagggtacttgtaattcccagcttcatgggagtcaagatgcatctgtgaggaa

SEQ ID NO: 6784486 - DNA, 67 bp, Homo sapiens
ccatgaagggggccactgtggagaaacaccccagggtgccatcagttcttctcagggtcccacatgg

SEQ ID NO: 6784487 - DNA, 72 bp, Homo sapiens
ataaagatattgagatgaggatattaacctgaattatccaggttggccctagataatctcaaggatacttat

SEQ ID NO: 6784488 - DNA, 94 bp, Homo sapiens
gacttggagctccacaaagcaattacaaaagggataagttgtatccagcaaacttgtctaacaaagttgttttgaagtttaaataatataggtc

SEQ ID NO: 6784489 - DNA, 70 bp, Homo sapiens
tgggtaggttgaattaaacgacttttaggtattttccaaatacactggctccctgatttgaagctgccca

SEQ ID NO: 6784490 - DNA, 63 bp, Homo sapiens
tagcagtactgggcatgtgtttgttgttgttgtttttcttagcctcagattcccagtttgctg

SEQ ID NO: 6784491 - DNA, 79 bp, Homo sapiens
tggttgcaggagaatgctggaaggtaaggagccaaggaatccctgggagtcagtcgttctcagaggtccctgcatgcca

SEQ ID NO: 6784492 - DNA, 56 bp, Homo sapiens
ggctccctagggagagtgggagatgaggagcctgcctggtgggtccctggggggcc

SEQ ID NO: 6784493 - DNA, 55 bp, Homo sapiens
taaagcatgtgttagaagtgcagacatgggtattctctagcaaagaaatgctttg

SEQ ID NO: 6784494 - DNA, 76 bp, Homo sapiens
gtctaggagcactggttttgctgataaggcaaactctatggggctgacttattggttaactagtcattgtctagat

SEQ ID NO: 6784495 - DNA, 61 bp, Homo sapiens
tgtgcagcccatgggggatagagatgaataaactgcagtttctgccctccaggagctcata

SEQ ID NO: 6784496 - DNA, 66 bp, Homo sapiens
gcagcttcagactggagcagaggaagatgtaggtcatctgacttttttgtgtgtgaagcataatgc

SEQ ID NO: 6784497 - DNA, 58 bp, Homo sapiens
agcagcaggtccagcttaggctccagagcctcctgctcctcaagtgcctcctgctgct

SEQ ID NO: 6784498 - DNA, 68 bp, Homo sapiens
ctgtagtcccagctactcaggaggctgagttggtaggatcatttgagccagagaggttgaggctatag

SEQ ID NO: 6784499 - DNA, 64 bp, Homo sapiens
ttgtttgagattttctgccattgcagcactttgttattcaaaagtgagcagaaaagtcaaggga

SEQ ID NO: 6784500 - DNA, 56 bp, Homo sapiens
cacaggccgccttggcagaagtgtcgagtctgcagctgctgcccagagcacttgtg

SEQ ID NO: 6784501 - DNA, 106 bp, Homo sapiens
gaattctgaggtgaagctacagcccagcctccttccagtttaaatattgacatggttaaaaagtctgcaaaggaggttgggagtgtggttaatcacaggtgaattc

SEQ ID NO: 6784502 - DNA, 81 bp, Homo sapiens
ccctggggtggggtggtcagggtgagcaggtgggctctgtgagcctgtttccccatgccctgactcaccccaatccctggg

SEQ ID NO: 6784503 - DNA, 123 bp, Homo sapiens
ctaacattttttaggtactcatgtttttagttattaggaatttccatttaacatttctaatatattttccttagcaaagttttgtggtgattaggtatagctaaaataatacagaagtgttag

SEQ ID NO: 6784504 - DNA, 59 bp, Homo sapiens
gtctgcttttctgccctttcatgattcaagtcatgaaacctaatgcgaaaaggcaagat

SEQ ID NO: 6784505 - DNA, 59 bp, Homo sapiens
aggctgcgagctcttgttctgagagccctctggcctctcagaacctcagtttgctctct

SEQ ID NO: 6784506 - DNA, 57 bp, Homo sapiens
ggcataagggcagctggacagtggtacattttataccactgttagtatacttgtgcc

SEQ ID NO: 6784507 - DNA, 64 bp, Homo sapiens
gattggaacaaattagttgcaagactgggggaattcattcttgatcactagttagtcccagatc

SEQ ID NO: 6784508 - DNA, 57 bp, Homo sapiens
ccatcatgccgggtcactgttaggaacatccaagattctgctgtgctcgagtgatgg

SEQ ID NO: 6784509 - DNA, 130 bp, Homo sapiens
atttatgtgaaagcaaagagagtagaatatataaggcactttggaatagggaatcaaagtttactttaagcatgtaaatttcctaatgttttgttgataaataacagactttttttctttttttattggt

SEQ ID NO: 6784510 - DNA, 83 bp, Homo sapiens
ggagcaggctgtgacacaatgtgcaggacacctgtcagatttcctctggagcaagctgtccatgccattgttcaagctgctcc

SEQ ID NO: 6784511 - DNA, 56 bp, Homo sapiens
ccttgccctgcgttaccatctctttctcaacaggaaaggggtgcaacaagggaagg

SEQ ID NO: 6784512 - DNA, 57 bp, Homo sapiens
gcagctgaaagaaggaagtgtcattcttgtgaccttagatgcctgactttcagtagt

SEQ ID NO: 6784513 - DNA, 55 bp, Homo sapiens
tccacactcctctggcccaaggtgctgtcatgaacttgggcttgtagatggtgga

SEQ ID NO: 6784514 - DNA, 56 bp, Homo sapiens
ggggtctgggcttagctggaatctccatcattgttcctgtggctcagtgcagcccc

SEQ ID NO: 6784515 - DNA, 59 bp, Homo sapiens
acctgctggtttaagctttcctctcagctgaggattcctagagctgcagaccaggaggt

SEQ ID NO: 6784516 - DNA, 56 bp, Homo sapiens
cagagacacttaacaggaatggtcttggatcatgtgactattctttgatgtctctg

SEQ ID NO: 6784517 - DNA, 76 bp, Homo sapiens
acatgtacaaggcagtacaatgatgacacattttctgtttgctgagtgtgagtaataaactgtcttgctctgctgt

SEQ ID NO: 6784518 - DNA, 75 bp, Homo sapiens
gggcccggcatgcagcagagtgggcctgggtggcccccacagtccccgccctcacctgctgctgggcctggatcc

SEQ ID NO: 6784519 - DNA, 66 bp, Homo sapiens
tcctgcctgttccaagtcagaggctccctaatattcccgagtgtctgaaagggatgctgggcagga

SEQ ID NO: 6784520 - DNA, 70 bp, Homo sapiens
taggaaggtgtttttaaggagcagttgcattctttcctcttctgccttctccttcccctgcgccacccta

SEQ ID NO: 6784521 - DNA, 64 bp, Homo sapiens
gaaatctgggaaccaaagggtgcttaagacttgttttaagtctaagtacagtggtatggatttt

SEQ ID NO: 6784522 - DNA, 81 bp, Homo sapiens
agttcttcctcctgaggtcagccattcttgcccttgggtgatcctgccctggtaatgagccttgatctcaggaggtgagct

SEQ ID NO: 6784523 - DNA, 65 bp, Homo sapiens
agccctgaagctggccatgtcccggtctgcggggtgggaagagacaggtggcgggctgcagggct

SEQ ID NO: 6784524 - DNA, 56 bp, Homo sapiens
acttcccaagctgcagagctggaccatgatgaatctgagctacagcatggcgaggt

SEQ ID NO: 6784525 - DNA, 72 bp, Homo sapiens
agacgttctaacaacagatgtctcaggcagacctttatctttgtctcctgataatgtaattgttaaatgtct

SEQ ID NO: 6784526 - DNA, 84 bp, Homo sapiens
tacacttgttcaaacagcaaaatgattcatttacatattttaattactttacttggttgactccctgctatttgaagaagtgta

SEQ ID NO: 6784527 - DNA, 68 bp, Homo sapiens
catgcattagcaaatatcttgaaacagggaggctctgttttctctgtattttgactaataaaagcatg

SEQ ID NO: 6784528 - DNA, 57 bp, Homo sapiens
agagctctggcctattggggcctcaagatgacttccctcaatgcctgccagagctct

SEQ ID NO: 6784529 - DNA, 60 bp, Homo sapiens
tagagaagatggtcagatctccactacagaactctcctctggcttcagccattttctctg

SEQ ID NO: 6784530 - DNA, 88 bp, Homo sapiens
agttgggggaaagaaaatgaagtaaattcagaagtgatgaagccagagaccactttagatacattctcatttgttttcttaattaact

SEQ ID NO: 6784531 - DNA, 58 bp, Homo sapiens
ccttcaaagtacacatctttatcagcatcataaaaaatagagatggtattttgtgagg

SEQ ID NO: 6784532 - DNA, 86 bp, Homo sapiens
tgaactatgttttgcttccttttaatggtactgtttcccctcatcttttaacagtgatcttttaaaaagaagtgtgattctgttca

SEQ ID NO: 6784533 - DNA, 70 bp, Homo sapiens
tccgggaaacagctgtgagaacaagaatgctttgataggttccatcaaagcttccttcacgtctcctggg

SEQ ID NO: 6784534 - DNA, 61 bp, Homo sapiens
tttctagtgggtattccctgttgcataaaataccacagcaatagcaaatgctcatttgaaa

SEQ ID NO: 6784535 - DNA, 80 bp, Homo sapiens
aaggtggatatatggagagagaactttgtaaaggcttcctgaagcccaatatgaacatctcatttcccttgatctatctt

SEQ ID NO: 6784536 - DNA, 130 bp, Homo sapiens
tggggtcttgtcttgtcacccaagctggtcttaaacttctgagctcaagcgatcctcccacttggacctagccaggtgctgggattatgggtattagagtttaaatttctttgctcaacaccactcccca

SEQ ID NO: 6784537 - DNA, 56 bp, Homo sapiens
gagaagggctttttctcccaccagtcatagttgtattctgggaagaaattcttctc

SEQ ID NO: 6784538 - DNA, 79 bp, Homo sapiens
cacaagcctgagttgatattctgtccaaagagaggttcttgacacttgagttaggtttactttggagaggcagtttgtg

SEQ ID NO: 6784539 - DNA, 74 bp, Homo sapiens
gtgattctctgcctgggccggccaccctctgtcctgaggacgctggagcctggcccggcccttggcagccccac

SEQ ID NO: 6784540 - DNA, 59 bp, Homo sapiens
gctggatccacaaataactttgcatgagcaggaaatcagttttgttgtgttaatccagt

SEQ ID NO: 6784541 - DNA, 116 bp, Homo sapiens
ggggtggacggcgcggggggaggggcgcctggctggaacgccgaggcggcggctcggccaatcagcgcgcggccgccggcggtttcaaggtgccccgcgccgcgcgcccccacccc

SEQ ID NO: 6784542 - DNA, 81 bp, Homo sapiens
tcagcacgaagtcctcgcggcactcgggccggatgtccttgcgcagcttggccagcagccgcgacgcccacttctgcttga

SEQ ID NO: 6784543 - DNA, 55 bp, Homo sapiens
caggcaagcacggtgaacctggaaggtctcacccacaggactcgagtttgacctg

SEQ ID NO: 6784544 - DNA, 93 bp, Homo sapiens
tcctgcccactccctccctctcttgggcgtggctcagtatttatcttcattccctggagctgagttggttggagggagaggggtgctgtagga

SEQ ID NO: 6784545 - DNA, 61 bp, Homo sapiens
cctagccatcatgtctatctggctactattagttcaggtctgggcacatggtacaattagg

SEQ ID NO: 6784546 - DNA, 78 bp, Homo sapiens
tttgaggttagtttataattcatttctgtctgttgtgcctaaaatcttggctattcagaatgatgacggctcctcaga

SEQ ID NO: 6784547 - DNA, 86 bp, Homo sapiens
actgaactattaggttggtgcaaaaggaattgtgatttttgccattaagaaatcgcaattacttttgcaccaacctaatatatagt

SEQ ID NO: 6784548 - DNA, 88 bp, Homo sapiens
gcaaatgctaaatacttgcaagtcaaagattttcatacggattttatggtgtagaaaatgttagcttcatagtcattgttgcagttgt

SEQ ID NO: 6784549 - DNA, 75 bp, Homo sapiens
tgatgacatcagacttttgggaggtctgtggccacagtttaatttgaaagttacagttagaatctgatgaaatca

SEQ ID NO: 6784550 - DNA, 74 bp, Homo sapiens
gatttgacacagtgacgtttatttgagacgcattatatatgcagtcagagcgatgaattcattctgtttatatc

SEQ ID NO: 6784551 - DNA, 100 bp, Homo sapiens
gacaaaaacaataactacaggttgcaagatgtttaaaaagatgactctttggtaaatgaattaaaaagtttctaaataaaggccatgcataccttttgtc

SEQ ID NO: 6784552 - DNA, 129 bp, Homo sapiens
ccttttgaaccacagagataatttattagatgccagaatgtgttattagagaaggagtaatgaagaagaacactcttttatgttaatacttttttacattttgtatatgtcgctatgttaggcaaaggg

SEQ ID NO: 6784553 - DNA, 70 bp, Homo sapiens
tatttggggagacagcacaggccactgggagcactaatggtctaaggtggcatgtgttgcactccaaata

SEQ ID NO: 6784554 - DNA, 60 bp, Homo sapiens
cttagagattatgtggcaggactaaagtatgtgttaacaagccctgccattgattctgag

SEQ ID NO: 6784555 - DNA, 62 bp, Homo sapiens
agtgaccatgttatttatttgattattgtcctttcaacacaagagcaaattgatatggcact

SEQ ID NO: 6784556 - DNA, 63 bp, Homo sapiens
tggagcctaggaacctacgtattatgtattacagcaaatgcctctgggttattctaggagcca

SEQ ID NO: 6784557 - DNA, 80 bp, Homo sapiens
tcatttaaacacagatgcttggaccaggcaatgatgtagtcagcactgatgactggaatcccaggctctgtgggggatgg

SEQ ID NO: 6784558 - DNA, 55 bp, Homo sapiens
gtgcccagtgcaatttcctagatttgctgccttgtcgtaggaggctcctgggggc

SEQ ID NO: 6784559 - DNA, 79 bp, Homo sapiens
ggttcttcctatagttttggctactgaggggtcagttaaaggaaaaaccagctcagaagccagaaagatgggacagact

SEQ ID NO: 6784560 - DNA, 61 bp, Homo sapiens
tacaatgttcctagcaggaaaggtcaattattattcacagttttcatgtaaggacattgta

SEQ ID NO: 6784561 - DNA, 61 bp, Homo sapiens
cttgaactggggcagtggaggttgcaattagccgaggtcgcaccattgcactccagccagg

SEQ ID NO: 6784562 - DNA, 73 bp, Homo sapiens
cttcatctgcaaacctgaggagagaggattagcgccatgcaaggtggcatcctctcttctgagtgccaagaag

SEQ ID NO: 6784563 - DNA, 62 bp, Homo sapiens
gggagaagcaacacattaaatcagctgacgagactaaattgggatgtgttgtgatcatcacc

SEQ ID NO: 6784564 - DNA, 60 bp, Homo sapiens
gcctgggctcagcccatgctgtcccgctaagccacgcggaggactgggtgcgggcctggc

SEQ ID NO: 6784565 - DNA, 64 bp, Homo sapiens
tacaagctcacaaatttttaagagggaaaggaaatactcttttgatagattcaagtgagctgtg

SEQ ID NO: 6784566 - DNA, 79 bp, Homo sapiens
gccggggcctggcttctgaggctgaatggactccgtgaaaatggcagacacgggccttctcttcaggcgaggcctgggc

SEQ ID NO: 6784567 - DNA, 55 bp, Homo sapiens
tctactggacatgatttttttgtccctatatgggatctggaaattctgccagaga

SEQ ID NO: 6784568 - DNA, 67 bp, Homo sapiens
aggtaagagttgatgttgcagtcttgaggagaattccttctccttcagaaaacctcagtctttgcct

SEQ ID NO: 6784569 - DNA, 63 bp, Homo sapiens
gtgttctgaatggtgtgtggaaaattttctctctgttgacggatgccaggcacctttaaatat

SEQ ID NO: 6784570 - DNA, 71 bp, Homo sapiens
tgtcccatcactagctgaaagcaattcaacctaactggctttctaattgaccttaggctgtgctggtgata

SEQ ID NO: 6784571 - DNA, 82 bp, Homo sapiens
agtattaacatgaactgacttttcatttcctgcaaatcttaaaatcacccaagggaagagacagtaaacatgtgtctatgct

SEQ ID NO: 6784572 - DNA, 79 bp, Homo sapiens
gggccacataacaacctctatcggtcaggaagcctttgatctgggccaggctgccgacccacaggggttaattgtgcct

SEQ ID NO: 6784573 - DNA, 59 bp, Homo sapiens
atctgaagaggtcatggctgacatttttccaatataaatgaaaatgtgacttctcagat

SEQ ID NO: 6784574 - DNA, 72 bp, Homo sapiens
actgtgtataagtgagaatgctgttttagttttttaaaagacagtcctaagataattgtctcttgatacagt

SEQ ID NO: 6784575 - DNA, 72 bp, Homo sapiens
gaggccatatttggaattcagatggcttagggatattatgcctaagtttatcatagttttacatgttacctc

SEQ ID NO: 6784576 - DNA, 71 bp, Homo sapiens
ttccatcgtgaaggtctcagtcccctacagactaatggtgagtggatgtaacatgggacctgcgaaaggaa

SEQ ID NO: 6784577 - DNA, 113 bp, Homo sapiens
gatgagtatagtttgaatctatgaggatattcactgttaagtatgaagtaaggcagtctcattgttgagcaaacagcttaacagtgtcctcaagaattcaggctctttccatc

SEQ ID NO: 6784578 - DNA, 78 bp, Homo sapiens
gcttagggactcttggtacatgcagatatttagttatggttataatgacaaaaagtaaatgtgccaggagtctgaagc

SEQ ID NO: 6784579 - DNA, 78 bp, Homo sapiens
ttggttaccatgcctaagtaatgaagctgtgaattccttgacaagaatcgttgccttggagtgagcagtgggtgccaa

SEQ ID NO: 6784580 - DNA, 76 bp, Homo sapiens
ttcagttattttccagtctgagaggagccaagtattgtcctgaaaggtcaatattccattttcatgattaattgaa

SEQ ID NO: 6784581 - DNA, 66 bp, Homo sapiens
ataggtgggtgatgatatttttggggcaaggatacccaaaccttaccttttgtcattaccacctgt

SEQ ID NO: 6784582 - DNA, 72 bp, Homo sapiens
gcaaaaagtccagagggcacactgaaggattcttacaggaagcttatagcctgtctcctttggctaatttgc

SEQ ID NO: 6784583 - DNA, 87 bp, Homo sapiens
gtgctcaaggcttgtccttctggttgtctttgcgtgggagggagaggagcgcaggacgtaacccaggacagccttccagaaagcagc

SEQ ID NO: 6784584 - DNA, 59 bp, Homo sapiens
gagtagcagaggcccctttcccaggaggataacctgggcttatggagggctttgtactt

SEQ ID NO: 6784585 - DNA, 75 bp, Homo sapiens
agcaaggtgtcactggttgggagcacagacactgcaggaagactgtcctgttcaagcccagcttgaccacctgct

SEQ ID NO: 6784586 - DNA, 93 bp, Homo sapiens
aaaggtaaaggttataaaggttaggggaaagggaagaattgagcatgaaccccaggcttctagccttgatgactgggagagtgagatgccttt

SEQ ID NO: 6784587 - DNA, 60 bp, Homo sapiens
agagattacagcagggtccagcgtttgcttggagaaaactcttgatcttgtgtagtctct

SEQ ID NO: 6784588 - DNA, 78 bp, Homo sapiens
gcgagcaggcgcgccagcagcggggctgtggccggaggcagacccgggaggcttcgcagctcggcagccgccgcttgc

SEQ ID NO: 6784589 - DNA, 83 bp, Homo sapiens
gcttctattttgttggcatctctgtggtctattcatagttcacctgttttagctgacacatggagccagttagagatgggcgc

SEQ ID NO: 6784590 - DNA, 84 bp, Homo sapiens
ggtatgtgtgcttttgctctgcccacctgcctcccaccctacccttcagtgcaggtctcgggttcagcagtgagtgctcatgct

SEQ ID NO: 6784591 - DNA, 65 bp, Homo sapiens
gtcccaagttggaaggcagagtaacatgtaagttcctattctagttctgccactaattaggtgat

SEQ ID NO: 6784592 - DNA, 64 bp, Homo sapiens
ccagacttcagaactgtgtaagacagtgacagctatgctatacagtgactagaagtaatgatgg

SEQ ID NO: 6784593 - DNA, 92 bp, Homo sapiens
cattcttaaacacttgttggatcacagacagaatacaccacacagctgcacggttcattcctcagtgatggattcaacgaggcctgagtgtg

SEQ ID NO: 6784594 - DNA, 60 bp, Homo sapiens
cacctggctattccctcaatctgggccctggggccatggcaatgtggaatggtccaggtg

SEQ ID NO: 6784595 - DNA, 58 bp, Homo sapiens
tacagaagcttttgaaaagatgaggaacctttggatctgggaatggaagccttctgtg

SEQ ID NO: 6784596 - DNA, 66 bp, Homo sapiens
gatgacatgctcatttcctgggttcatctgctgaggagggctggcaggacctgggctgatgtcatc

SEQ ID NO: 6784597 - DNA, 63 bp, Homo sapiens
agtgggcagaaatcagtatcagattgtcaacttgcaaatatttggtgaaattgctgacctact

SEQ ID NO: 6784598 - DNA, 66 bp, Homo sapiens
gctatctgtagtctcatggttcctgcggtgacttcacccactccagtgccatggctgctagatggc

SEQ ID NO: 6784599 - DNA, 71 bp, Homo sapiens
ggccctgcaaaggttttggtaaggctttaaagatttcaaaaaattttaaggtattaggacctttgcaagct

SEQ ID NO: 6784600 - DNA, 55 bp, Homo sapiens
tctagggaacctatcctatgatgtgacagaagagtcaattaaggaattctttaga

SEQ ID NO: 6784601 - DNA, 63 bp, Homo sapiens
cagccacttcgagcttcctgattaattggtgagagacaatcagggcacattctgcagtggctg

SEQ ID NO: 6784602 - DNA, 70 bp, Homo sapiens
gctgtgcaggtgttctaagccgggcagtgacataatcatactggcattctagaacaatccctgcggcagt

SEQ ID NO: 6784603 - DNA, 69 bp, Homo sapiens
tgtgcattagcctgtgtgctgatgacgacagaggctggagagcttctgttgtacccaggtggatgcaca

SEQ ID NO: 6784604 - DNA, 76 bp, Homo sapiens
gctggagcctggtctctttcatgtcagtgcctcctgatccatactgctagtgtatagggaccagtgttctgttagc

SEQ ID NO: 6784605 - DNA, 63 bp, Homo sapiens
gagtcttcatttagttgatccagaatgttgctgcatactcaatcaaggtcatgaaatagactc

SEQ ID NO: 6784606 - DNA, 76 bp, Homo sapiens
acccatatatacttggagactatcattgttctaatgggaaagatcaatggacgcttagccagcatatgtaatgggt

SEQ ID NO: 6784607 - DNA, 81 bp, Homo sapiens
gcttcggatgtccttggcctggccttctgcctttcagcaatgcccgtggcataggcagggtgggctggcctggcctgaggc

SEQ ID NO: 6784608 - DNA, 55 bp, Homo sapiens
tactcagaatgcttttgagattcatccgtgttgagtctggtggtattttgtagtg

SEQ ID NO: 6784609 - DNA, 59 bp, Homo sapiens
ccatcacagggggctagaagtctaagtcaaagctttggcaagattggttccttttgagg

SEQ ID NO: 6784610 - DNA, 67 bp, Homo sapiens
tctcttttttgatttccctttgatagtaaatataatcagaacttcaaagggtagcccagggaagaga

SEQ ID NO: 6784611 - DNA, 81 bp, Homo sapiens
gaatgatctagtattttaccctatatttaagctgaattacctgtcacagtttcatggatgttggtagaaaacatgacattc

SEQ ID NO: 6784612 - DNA, 83 bp, Homo sapiens
tgctgacataaattttcataaacaaattaaggcctggtccaaaaaattcaaatttcattttttcaggctgatttgtgttagta

SEQ ID NO: 6784613 - DNA, 57 bp, Homo sapiens
ccaggaggaaattctaaaggtaacccagtccctggagccactgatgttatctcctgg

SEQ ID NO: 6784614 - DNA, 117 bp, Homo sapiens
caggaggtggggcctggtgggcggggcctcagcgtaggccttaggtctcaggggagcagcacgcctgagcaccccaggacctgcgctcaggtgagatgcgctatgccttccttcctg

SEQ ID NO: 6784615 - DNA, 75 bp, Homo sapiens
ggttcagaggcctgagcaggtgagtctagggcagagcacagcagctgtccctcatcacctctgggtctctgggcc

SEQ ID NO: 6784616 - DNA, 55 bp, Homo sapiens
gaacctctatatttgtgacatccattagaggagccacaagacacatagggtgttt

SEQ ID NO: 6784617 - DNA, 81 bp, Homo sapiens
ctgtcttacctaatttactacttcattgacttacgggcagaaggattcagtggttatcaagtattaaagtagaaaggatag

SEQ ID NO: 6784618 - DNA, 78 bp, Homo sapiens
attcagattattttatagtagtgcctttattgatagcagataattcttattaataagtgactactagctggtttgagt

SEQ ID NO: 6784619 - DNA, 58 bp, Homo sapiens
ggctggctcagggcttgagagaatctagcaaaatgattctatgactcgtcagtcagcc

SEQ ID NO: 6784620 - DNA, 70 bp, Homo sapiens
cagtaaactttcctgtttgtaactaactgaaatcagctttgcctcacttaggtgcaaagggaacttgctg

SEQ ID NO: 6784621 - DNA, 60 bp, Homo sapiens
ggcaattacgtattagtcatgtgagcggagacagaaccgattatgacaagtactagttct

SEQ ID NO: 6784622 - DNA, 55 bp, Homo sapiens
tttgagatagtctagagtaactgttataaacacagactttggggtctttctcaga

SEQ ID NO: 6784623 - DNA, 79 bp, Homo sapiens
ggttccggcaggaaggcataactgagcagcctgggcattttcaaccaaggtgcagagaccactgtgccttcctgctacc

SEQ ID NO: 6784624 - DNA, 71 bp, Homo sapiens
ccatcactagcttgcgggcctgcacaagtctgaacctgtgtctcttggggtttaaagctggtcatcgttgg

SEQ ID NO: 6784625 - DNA, 84 bp, Homo sapiens
ggaaaggaaatagaatatattagaaattctgatttctaataggatgtaagaaatcatgtttcagatgagttttttagcatttcc

SEQ ID NO: 6784626 - DNA, 107 bp, Homo sapiens
tcatcaacattggccaggcgcggtggctcacgcctgtcatcgcagcactttgggaagccgaggtgggcggatcacaaggtcagggaccagcctggccaatatggtga

SEQ ID NO: 6784627 - DNA, 58 bp, Homo sapiens
ggtacaggccaaaaggtaattcaaaaagcgaaacgaatctcatctcctgacctgtgcc

SEQ ID NO: 6784628 - DNA, 68 bp, Homo sapiens
tatgttatttgaaccaaatttgtttggaagaaatgattctgtgggcaaaatggtttaaaagtggcata

SEQ ID NO: 6784629 - DNA, 58 bp, Homo sapiens
gtggcatctcagaggccaagaatgcacctgagggtaaacagcagcctctgagagccac

SEQ ID NO: 6784630 - DNA, 60 bp, Homo sapiens
gaggtgtgagggacagagaaaggggtgagacccgtgcccagattgcttctcctcacaccc

SEQ ID NO: 6784631 - DNA, 61 bp, Homo sapiens
gcagttaatgtgggccaagttcttcaagttcttcacccagtgcctggcacatattaacttc

SEQ ID NO: 6784632 - DNA, 83 bp, Homo sapiens
tgtgtgaattccataaaacatgaaattttattggaatgtgaagtgaaaattatggaaatgaaattttattggaatgtgaagca

SEQ ID NO: 6784633 - DNA, 80 bp, Homo sapiens
gtcaggcagctctgcttctaagaacctgcagcttttggaagaaaggcaccctgtggtttcagaagcccaagagtccctgc

SEQ ID NO: 6784634 - DNA, 62 bp, Homo sapiens
gctccacctagcaatggaggtcactgaagtcgctccagagaactccagtggctggcggaagt

SEQ ID NO: 6784635 - DNA, 66 bp, Homo sapiens
tgggaattacatggcataacttgggatacctgttttacagctaaatcatttgtgatctgatttcca

SEQ ID NO: 6784636 - DNA, 62 bp, Homo sapiens
tctgagcgcctcaagtctcatgatgaagcaaagttttattgtttagaagggggctgctatga

SEQ ID NO: 6784637 - DNA, 59 bp, Homo sapiens
taactacaaactgtccagcccagaggtttccaatctgtgggtctagatttttgatgttg

SEQ ID NO: 6784638 - DNA, 99 bp, Homo sapiens
ccctgccttctgcttcagggaaaagtcacactgggtcggctccaaagagtgtccctgctgattcactgtggctttctctgatcattagccaaaccaggg

SEQ ID NO: 6784639 - DNA, 55 bp, Homo sapiens
tgaagggtccttagaggtcccatgtctatgcaggtgtctcttttcagactcttca

SEQ ID NO: 6784640 - DNA, 60 bp, Homo sapiens
cattttagtgactgttggaggcacatgatccagcatgtgtgaatagcagtggctggtatg

SEQ ID NO: 6784641 - DNA, 57 bp, Homo sapiens
gccttcctggtatgggttgatttggagatgggatcactttacctcattcaggcaggc

SEQ ID NO: 6784642 - DNA, 60 bp, Homo sapiens
cagtgcaattttgctttcccaatgacagcaccctggaagcattgggggtagattgctttg

SEQ ID NO: 6784643 - DNA, 126 bp, Homo sapiens
gtaatgtattcttgctgttacaattgtatgttaaatttgttaaaagtgagtgacagttgactaatactgtcctgcaattaaggaagacatacaaaaaaatcaggtattggctaatggatacatgac

SEQ ID NO: 6784644 - DNA, 56 bp, Homo sapiens
tagaaacatataggatggcaggtctccaaggcctggcctgaatcactgtgtatctg

SEQ ID NO: 6784645 - DNA, 82 bp, Homo sapiens
cacaaactctagtagcctggctgcaaaatctattcactctcatcaggaactgtcatgtattgctcatggctatctgtgtgtg

SEQ ID NO: 6784646 - DNA, 81 bp, Homo sapiens
ttacattgctttgagaaacagacgaaagacatgtttttttacaattgtcttacagcaatctgttctgagagtaacatgtaa

SEQ ID NO: 6784647 - DNA, 69 bp, Homo sapiens
gacaataagaacagatactgtgttttcttgagatcaaattgagatcaactgtattttttcttctttgtc

SEQ ID NO: 6784648 - DNA, 78 bp, Homo sapiens
tccaggtcccgggagcttggtgtcccagaagtactaactctcagtaccttgggagacgccaggccctctagccctgga

SEQ ID NO: 6784649 - DNA, 81 bp, Homo sapiens
cctcttgggtccccagctgaaggagagaatgaaagataccccttctcattatcttggctcatttctgttggaactaagtgg

SEQ ID NO: 6784650 - DNA, 60 bp, Homo sapiens
ggagtaaacagtgtgtgttacaaagtagtacataaagtttgaaatgcacacatttactcc

SEQ ID NO: 6784651 - DNA, 65 bp, Homo sapiens
agcccatggggagatgtatcagactgcacgggatacctgtcagaggatcatgtccctactctgct

SEQ ID NO: 6784652 - DNA, 56 bp, Homo sapiens
tgctgggggctttctggataccgtgaaactttgtctcagattatgaggtctcagta

SEQ ID NO: 6784653 - DNA, 74 bp, Homo sapiens
ggctcatgctggtggttgatggcaggatgcaggtactcaccagaggcctccttccattcctcaccacgtggacc

SEQ ID NO: 6784654 - DNA, 130 bp, Homo sapiens
tacttcacgggatttctgagatatatgccttctagactttcatgttggtgaagggttcataaagttggtcctgaatttatcctaccatgaaaggcttctggagtgtggttcttggaaattccttgaatta

SEQ ID NO: 6784655 - DNA, 55 bp, Homo sapiens
agctgccagggtggggccgcgttttggcgacggccactcggccacccctgccgct

SEQ ID NO: 6784656 - DNA, 70 bp, Homo sapiens
tgtcctacactgggctctcgcccgctctcatgcagaaataagggcctggaactggagaccacagaggaca

SEQ ID NO: 6784657 - DNA, 113 bp, Homo sapiens
ctctatgttgttcacgggttgttcgcagtttagtcctgccaccatgggttgaaggcacaaaataaataaatccaatgcagataagacaaacacctcatggtcataacctagag

SEQ ID NO: 6784658 - DNA, 70 bp, Homo sapiens
tataaatttaaatgcctgcttttccccaggcactgtgctgtgcactggtgatgaggcagttaggtttata

SEQ ID NO: 6784659 - DNA, 128 bp, Homo sapiens
gtatcagaatcctggaaggcttgttaaaatacagattgatgggctttaccctcagagcttctgatttgggaggtccagggtggggcctgagaatctgcatttctagtaagttccggtgatgctgatgc

SEQ ID NO: 6784660 - DNA, 59 bp, Homo sapiens
cacattctatagcaagctgatctcaacgagccctacttgggagagctgcttggagtgtg

SEQ ID NO: 6784661 - DNA, 80 bp, Homo sapiens
gaggcataagctgcagatgtgcctgtggatggcagcttctgacagctgttcctggacactatcagcagacaaatgtactc

SEQ ID NO: 6784662 - DNA, 105 bp, Homo sapiens
ggttattggagcaccttctgtacaccaggggccattctggatgctgagaatagagccaccaacacagcaaacaaggtccctgctgtcagggagttcacagtttcc

SEQ ID NO: 6784663 - DNA, 69 bp, Homo sapiens
gcacctcacaaggctgtggggagaactgagtatctcttagctgtctcatatggtttagtggtttagtgc

SEQ ID NO: 6784664 - DNA, 61 bp, Homo sapiens
ccaatcagagacatccatgttagttgggatgtcaactgccccaatgcacatggtctcttgg

SEQ ID NO: 6784665 - DNA, 59 bp, Homo sapiens
gttagcatggtgtagtgtgatttagtgtggtgtctgcatggtgtttgcatggtgttaac

SEQ ID NO: 6784666 - DNA, 120 bp, Homo sapiens
attttaacgtttggccattttggtgataatctgaaatagtcttatctgagcattgactcactgatctatattgaggggtttgaggtaaggtatttagtacaatcaccggtgacttaagat

SEQ ID NO: 6784667 - DNA, 65 bp, Homo sapiens
gaggcagggcttgcatgtctgacatgtcctctggaatgtatctagacttgctggctttttgcttc

SEQ ID NO: 6784668 - DNA, 98 bp, Homo sapiens
cttcctttgtcatgtagactaacagcctaaaataatcaaatggatgcatttaacacatctattttaaatggcagtaaacgtggattcagagtaaaaag

SEQ ID NO: 6784669 - DNA, 71 bp, Homo sapiens
caaagtaattaaggcaatattgagtttcccttgcagagcaagagcagatgattatattgccataacctttg

SEQ ID NO: 6784670 - DNA, 55 bp, Homo sapiens
ggtggctcatgcctgtaatcccagcactttgggaggccaaggcaggcagatcacc

SEQ ID NO: 6784671 - DNA, 114 bp, Homo sapiens
gttccagccaggcagtctgtagtggcaattaaggaccacctagggtgggggtgaagctgaaggtggctctgaccctaggaggtctacagtcacttcagtgtacctccttggaat

SEQ ID NO: 6784672 - DNA, 61 bp, Homo sapiens
ctttctcagtgtttaaaaagatttccagagacttaattctggggttctgatacagagaaag

SEQ ID NO: 6784673 - DNA, 59 bp, Homo sapiens
aatatatgatattgctttgggcatttacaatttcagtaaatggtataatgtcatgtatt

SEQ ID NO: 6784674 - DNA, 79 bp, Homo sapiens
actgacccttcaaatatcctcaaatgactttcatttacttgtttttgttacttttaagagatgtctgaaaagggctggt

SEQ ID NO: 6784675 - DNA, 93 bp, Homo sapiens
tggctgtatctttagaggcataccagagtgtggggatgctcaggtctcaataaaatccctgggcttcataattggtcctagaagacacagcta

SEQ ID NO: 6784676 - DNA, 64 bp, Homo sapiens
tccaggctggtctgaatttctagtgcctgtatctggcttctcttctattttcactagcctgtga

SEQ ID NO: 6784677 - DNA, 84 bp, Homo sapiens
cagtcatttgccttactgaagaaggagctctgccctgcttactgaaatgcggttttttttcctctgtgatggcaaataagactg

SEQ ID NO: 6784678 - DNA, 55 bp, Homo sapiens
atatggaatggtaatctacaatcacactgtgtggtaggtattattatctccatat

SEQ ID NO: 6784679 - DNA, 72 bp, Homo sapiens
taatccccaggatttggaagggagatgggattttgagctctctttatctttagacctttgcaaagggggtta

SEQ ID NO: 6784680 - DNA, 57 bp, Homo sapiens
gcgcagctttgtaaagatctgggcgtgcggcccagttctgccacttactagctgtgc

SEQ ID NO: 6784681 - DNA, 58 bp, Homo sapiens
ttcacggctagtgcaacctggttattaagccatagcaggaattggctgcagctgtgaa

SEQ ID NO: 6784682 - DNA, 57 bp, Homo sapiens
gcctggagtagcatggcaagcctacagctcactaggaaagtgcagctgctcccaggc

SEQ ID NO: 6784683 - DNA, 70 bp, Homo sapiens
ttagcatctctgggctttgagtttgttcagccctaaaacaggcaataatatctacctcagagggtgctga

SEQ ID NO: 6784684 - DNA, 91 bp, Homo sapiens
caacttgaaaggatttggtgccaagcgtccagagtcccgagttcaaaacccagctctgaccataacgcgctaggcaagtcctttcaacttg

SEQ ID NO: 6784685 - DNA, 85 bp, Homo sapiens
aaaggtaatgagatgggggcaagggagacaggaattcaggtaagcaggctttacacttttctggttactcttgcttattgccttt

SEQ ID NO: 6784686 - DNA, 58 bp, Homo sapiens
tataatggactcagtaatagtgactgcttaacagtcactattatcatggtgtattatg

SEQ ID NO: 6784687 - DNA, 107 bp, Homo sapiens
aaataatagacttcatgagaattctagagattggacttcctagatttggcagatactatttctaagaagccctctaaaactttaggaaagtgcaagcactattgttt

SEQ ID NO: 6784688 - DNA, 61 bp, Homo sapiens
aaatgcaagatcaaatctaacacaaattgtgatggcacgtgtttggtgtgatcttgcattt

SEQ ID NO: 6784689 - DNA, 58 bp, Homo sapiens
ggagtcagcctgtcagagtgtaggctttatgcttgtgtctgtgcctgggctggctgcc

SEQ ID NO: 6784690 - DNA, 65 bp, Homo sapiens
ggattaatattgtgacacatgccgtcctgagaaatgtctcagacttttgttcaacgagttaatcc

SEQ ID NO: 6784691 - DNA, 65 bp, Homo sapiens
aacttctcaagggacactggtattccgtgaaacatagtctgggaaatgctgttccttgtgcagtt

SEQ ID NO: 6784692 - DNA, 71 bp, Homo sapiens
tttcctcatttgtgaagtgaagggttagatttgatgaccaccaaagttcagcccttttcacgaaaaggaga

SEQ ID NO: 6784693 - DNA, 66 bp, Homo sapiens
gtgcctctcctcatccctaccgacttgcagccgtgatagggatgcttagtaggacccaggaggcac

SEQ ID NO: 6784694 - DNA, 84 bp, Homo sapiens
cggggctagtggggagccctgttcaggcctcctcactttatgaaggatgagaaggcccagaatagaatggcctgcagtgccttg

SEQ ID NO: 6784695 - DNA, 67 bp, Homo sapiens
tgcatgatggatgtgcacttcgctgggttataacgtgtccagttaagaaacccacgccgtacgtgta

SEQ ID NO: 6784696 - DNA, 65 bp, Homo sapiens
atgtatgagtttcttcattctcttgtggtgccctctttcagtaacaaggagaagaaattggtcat

SEQ ID NO: 6784697 - DNA, 59 bp, Homo sapiens
gcagagcctgtgtctgagcaaagcagatgatgtagtgcttgtgagaggcagtgctctgt

SEQ ID NO: 6784698 - DNA, 55 bp, Homo sapiens
acactttctgtgtatcttccattgttctaggcactgtgggcaccacagagagtgt

SEQ ID NO: 6784699 - DNA, 56 bp, Homo sapiens
ctagtctggacatctcacatgtatggaatcatacaatatgtgctctttgggactgg

SEQ ID NO: 6784700 - DNA, 71 bp, Homo sapiens
gctcacaggtccttcctgccctggggtccgggcttggctctgcccctccagcgcgggggggagttgggggc

SEQ ID NO: 6784701 - DNA, 93 bp, Homo sapiens
ggcttcctattctgtgtttttagtttgttctgtgacagttctatgctaccttaatttttacagtttctagtaatacttgatatctggtaggcc

SEQ ID NO: 6784702 - DNA, 113 bp, Homo sapiens
gcagagatttgctttcatcacaccatattggcatcctctccctcctccttgcggtaagccaaggggactgaatgccagtctatggaagatggttttcaagaagcagtgtctgt

SEQ ID NO: 6784703 - DNA, 58 bp, Homo sapiens
ggcgcactggccgcacgcgtagggcttctcgcctgtgtggatgcgccggtgctcggcc

SEQ ID NO: 6784704 - DNA, 86 bp, Homo sapiens
gggtcttgactcttttctggaaggcagggagaacccaggactagtttcccagggaccctgtacctgccagaggagcgtcatagccc

SEQ ID NO: 6784705 - DNA, 84 bp, Homo sapiens
gtgttgcatgtatgcacggtgttaggatgtctctgcatgtgtgtaggtatgcttgtccaagtacatgtgtgtacatgtttgtat

SEQ ID NO: 6784706 - DNA, 61 bp, Homo sapiens
tggtgaactggtaatcagtccactttgaccagggaggaaatgatttctgccaagttcacta

SEQ ID NO: 6784707 - DNA, 87 bp, Homo sapiens
ttcatttacattcttcctcaaatgcaggtcataacctgagtttgagatgcagggaatgacctgcgttttagagaagaggaaagtgag

SEQ ID NO: 6784708 - DNA, 90 bp, Homo sapiens
atacacagcactgtaccataatgaccctagaccatcaagtgctctagaccatcaggtgctctagggtcattatggtacagtgttgtgtat

SEQ ID NO: 6784709 - DNA, 82 bp, Homo sapiens
ggatgtgtcaggtaggcagtgtattgctagcggctgttaatgattttaacagttgctagttgcactcctctctgttgcattc

SEQ ID NO: 6784710 - DNA, 70 bp, Homo sapiens
ggtgtattactgctgttaggatattttttagtactggaaaaatgacactaacagctgtatgaaataaacc

SEQ ID NO: 6784711 - DNA, 68 bp, Homo sapiens
gcagccggcctggagtttggggaatagaggtgtgccctttctctaccaccacacaccaggcaacgtgt

SEQ ID NO: 6784712 - DNA, 75 bp, Homo sapiens
tggtggtaatattgaatgtcaagttctacccagatgattgggttttatagatgtggacattcatagttattacca

SEQ ID NO: 6784713 - DNA, 80 bp, Homo sapiens
ccctgacattgacaagcagtatgtcttagtgaccattttcatagtagaattagttgctgccaatttgtgtaatttcaggg

SEQ ID NO: 6784714 - DNA, 56 bp, Homo sapiens
ttactcttccaaatgaatttcaagtcctatctcaggactggtttctggaggaataa

SEQ ID NO: 6784715 - DNA, 71 bp, Homo sapiens
tggggcaggagcccttcttcagctggtggctgcaatgtccctcgctgctgctgctaagcgtttctgttcca

SEQ ID NO: 6784716 - DNA, 61 bp, Homo sapiens
ggccaggctggcctctacagggaggcaggactcctgctccctgctcagagaggccagggcc

SEQ ID NO: 6784717 - DNA, 65 bp, Homo sapiens
aggtagcagaactattcattctcattagcgtcatagatgttttcatggagatggtggcgttgcct

SEQ ID NO: 6784718 - DNA, 60 bp, Homo sapiens
ccacagttctttgtttatagcttgataaaaggctctagctcctgtagcagggaagtgagg

SEQ ID NO: 6784719 - DNA, 78 bp, Homo sapiens
ttgcagtgggaagctgaggggatgctgggctcctctgtagcaaaggtgggtgcagcagagctcctctgtcccctgtgg

SEQ ID NO: 6784720 - DNA, 76 bp, Homo sapiens
ctgtgcagctccaatttcaagggaatatgaaattcagggactgagtagctctggatcgcttccatgaaactgtcag

SEQ ID NO: 6784721 - DNA, 80 bp, Homo sapiens
gagaaaagatctgataggcttctttctatctggctgaaatgaaggcctagaatctccaagtttactcacttctgattttc

SEQ ID NO: 6784722 - DNA, 92 bp, Homo sapiens
ctggctcatagtctttcacctgggctttctctggaactcacctaggagttccccagtgtggtaggtccacaggtgtagagggaaggaggcag

SEQ ID NO: 6784723 - DNA, 64 bp, Homo sapiens
agagaagtactacagtttctcattaaatgtaataacattcatgacaggatagtagtgcagctct

SEQ ID NO: 6784724 - DNA, 93 bp, Homo sapiens
cagtccttttctttatggctggtgctttttatgtcttgtttgagaaatccttgtctttgaggctaaaggtgaccagattgtgctgggggactg

SEQ ID NO: 6784725 - DNA, 57 bp, Homo sapiens
caaagtgctgggattataggcatgagccactgggcctggcctcttctagttactttg

SEQ ID NO: 6784726 - DNA, 82 bp, Homo sapiens
tctagccctctcttcccagctcggatgggcccttggccccaggtctccagtggcaagtccgggcgggctccggggccataga

SEQ ID NO: 6784727 - DNA, 65 bp, Homo sapiens
atgatctcttttgattctgttctcttcattttacagaggagacaatggaggccaaaagaagtgat

SEQ ID NO: 6784728 - DNA, 63 bp, Homo sapiens
ggggtaatgtgagggaagtcataatgttctagttggagaaacggagcacttctttcgtacccc

SEQ ID NO: 6784729 - DNA, 75 bp, Homo sapiens
taccataaaaactatagtttgcaaaagagcactgtatttccagatgttttgtgcacttctatagcagttttggtg

SEQ ID NO: 6784730 - DNA, 90 bp, Homo sapiens
tgccttgcaagggtcatccctcactctgtttgtgaaacccatagctgcatggcacaggcggtaagggtgtggtgagaccttaccagggca

SEQ ID NO: 6784731 - DNA, 65 bp, Homo sapiens
catgtgtccattcactgcaacacttgaacaagtgagtatcaagtggagccaatgtggatctcatg

SEQ ID NO: 6784732 - DNA, 100 bp, Homo sapiens
aggctgtggtccaggtgcatcttgtgcttcttctttagctactcacaagaggtgagctgaggttgaagagtgaacgaaggtaggtgttgatcaacagtct

SEQ ID NO: 6784733 - DNA, 81 bp, Homo sapiens
ggataaaagccaaagagctgagtacatgtaaacctcttttggaagatttattacatgtcacagtgtggctataacttattc

SEQ ID NO: 6784734 - DNA, 119 bp, Homo sapiens
aggtggaaaggcaaaaggaagacaggccagctagttccctcctgcccttttgtaagacacgaatcccatccatgaggacagagccctggtggcctaatcatctcctaaaggctccacct

SEQ ID NO: 6784735 - DNA, 112 bp, Homo sapiens
gggtggacccaggacctctgggtagggctgcaatggtagtgactcccccagggctgcctcagcccgcatctcgctaaagatagccctcttacttcctggggaaaaaccaccc

SEQ ID NO: 6784736 - DNA, 62 bp, Homo sapiens
tctagttttccccaggtagatagataatccagtagacaaatctgcatacttcgggaaccaga

SEQ ID NO: 6784737 - DNA, 92 bp, Homo sapiens
atgcacacaatttaatacacctgctcacctgatgtggcaactcagcctgtgcttgctgtgggttgccacaggatgagacatggtctgtgcat

SEQ ID NO: 6784738 - DNA, 88 bp, Homo sapiens
ggcactgcttgttttagccattgagcaaggtgggtaagcatattgaatttgctgtcatatcctccttaaaggtgcagcaatgcaggtc

SEQ ID NO: 6784739 - DNA, 100 bp, Homo sapiens
gaggaagaccaagaatgcacatggggccaggtgttcgcagtcggggattctgggggaagggacacttggtggcccattgtgaagttttggcatttttctc

SEQ ID NO: 6784740 - DNA, 55 bp, Homo sapiens
caggcctcaggggctcaggctgggcactccctgccctgccctgccctgggtcctg

SEQ ID NO: 6784741 - DNA, 72 bp, Homo sapiens
ctttgctgagttggagatcactttgaagggtttgcatttctcaatggtgagagtttaatttattatgcaaag

SEQ ID NO: 6784742 - DNA, 98 bp, Homo sapiens
cactctagctgccagggtgtgagggcctctgctgctccacatatgctaatatgaggcagcacatgggattgtcagactccctgatttttgctagtctg

SEQ ID NO: 6784743 - DNA, 68 bp, Homo sapiens
gacaatggtactagatatcttcagagttcacactacacttttaccttgaaaaatatagtcccattgtc

SEQ ID NO: 6784744 - DNA, 61 bp, Homo sapiens
ctggaagggtttgtctccctcaaggcgtaaagcgctaggatttgaatgcagatccgcccag

SEQ ID NO: 6784745 - DNA, 57 bp, Homo sapiens
atgtttaagagcctgtacaaatattttatgttagtgaagtgttggctgtttaaacat

SEQ ID NO: 6784746 - DNA, 81 bp, Homo sapiens
ctgtaactcaaatgtgtagtgctgtaactcaaatctcttcaaatatattttgtagtactgtactcaacatgtgagttttgg

SEQ ID NO: 6784747 - DNA, 69 bp, Homo sapiens
cattggaatatcatgcagaataaaggtgatctatatgtattgggccctatgtgtagtgtgatcccaatg

SEQ ID NO: 6784748 - DNA, 69 bp, Homo sapiens
atcttttcatagatcagtgagggaccactaagccaaaaggcagggattatttcactggcttgataaggt

SEQ ID NO: 6784749 - DNA, 73 bp, Homo sapiens
aggagccccgtcctggggaatcttgcaggggaaggcatggaacctggcctgcagctctcagggaagggttcct

SEQ ID NO: 6784750 - DNA, 66 bp, Homo sapiens
tgtgtttcttgagcaatataggttgtaaatgtctttatatataaattaatgtgcccatgagacata

SEQ ID NO: 6784751 - DNA, 95 bp, Homo sapiens
agtgctgtctgaagggctttatatagacactcaatctttacaacaatctgaagaagcaggtatttgtctcagattgggttccttcgaaacagact

SEQ ID NO: 6784752 - DNA, 117 bp, Homo sapiens
cacctctggcaagttttaaaagtactgatgcctgggctccacctgctcctgtgatttggattcaattggtgtgggatgaagccccagtgtaagtaatttttttaagttatccaagtg

SEQ ID NO: 6784753 - DNA, 67 bp, Homo sapiens
ggagaatttaggaaaggaacattgaaacgttcttttataacatttcaatgttttttccttgacatct

SEQ ID NO: 6784754 - DNA, 70 bp, Homo sapiens
ccaggcagcggagtgaaaacccgccctgggggccacgccatccccatgctggcccacacccgctgcgtgg

SEQ ID NO: 6784755 - DNA, 55 bp, Homo sapiens
actttttttcatgttaagagcaagaaggcttttgttcttggagcaggcagagagt

SEQ ID NO: 6784756 - DNA, 58 bp, Homo sapiens
tcctcaatttgaaaaacagctagcttgtagaagagagtcctttttataaaattgagga

SEQ ID NO: 6784757 - DNA, 90 bp, Homo sapiens
gggcaatctgtgagtagataaagcaatgggatggggtgaggttacaggcatcagcccattctaagctttgctcttcaacacatactgtcc

SEQ ID NO: 6784758 - DNA, 64 bp, Homo sapiens
tcttgcatgatattctgtatttactggctttttgttgagttagatacagaacattgatccaaga

SEQ ID NO: 6784759 - DNA, 55 bp, Homo sapiens
tgaggggtgtttgagggtggggcggtcagcttctatagatcagtaaatatctcca

SEQ ID NO: 6784760 - DNA, 58 bp, Homo sapiens
gccagctctgtggctgtacttgtgcccagagagacaggtggcagcggcagagttaggc

SEQ ID NO: 6784761 - DNA, 63 bp, Homo sapiens
gcaagacagcaatacctgaatgagaagtctgaactacttttcccttggtagagttgcttcagc

SEQ ID NO: 6784762 - DNA, 119 bp, Homo sapiens
gctgggtgtggtggtgcgcgcctgtaatcccagctactcgggaggctgaggcaggagaatcacctgaacccgggaggcggagattgcagtgagccgagatggcgccactgcactccagc

SEQ ID NO: 6784763 - DNA, 65 bp, Homo sapiens
gaagagcttagttgtcctagaagccaaacgtagtatttgaggttcatgtgggcatctgattcttc

SEQ ID NO: 6784764 - DNA, 73 bp, Homo sapiens
tggaggaggggacagtacttgtgccaggccagggcgggggcagcgggcggaacagcactgttccttctctcca

SEQ ID NO: 6784765 - DNA, 126 bp, Homo sapiens
ggatgctccgaagccagtgttagtatttgttctcattgacctctgtggtataagcgtcctgaagaagctgggccctttatcatggaggtaaatatgcatagctgccccatgaaaaaaggagaatcc

SEQ ID NO: 6784766 - DNA, 58 bp, Homo sapiens
ggcagttatgttttaagttctttgggaagtctccaaactgctttccacagtggctacc

SEQ ID NO: 6784767 - DNA, 62 bp, Homo sapiens
cccttaagttacacattttcattgtaatgtacaatgctgtatgttgatgtgctactcaaggg

SEQ ID NO: 6784768 - DNA, 85 bp, Homo sapiens
ggccttggaagcaggtacattcgtagacccattttgcagacaaggaaagtacagtgcaactagatgatgtagcttgtccaaggtc

SEQ ID NO: 6784769 - DNA, 73 bp, Homo sapiens
tgtctccaaatagctggatgatggtgtcatatttgcaatgcatagattatgccatcatgtcagatttgggaca

SEQ ID NO: 6784770 - DNA, 65 bp, Homo sapiens
cagtttcgtctcctgggtcttctctaagctgctccacccacagaacccaggggaagcagaaactg

SEQ ID NO: 6784771 - DNA, 73 bp, Homo sapiens
gaagccatttattctctgtctttttgaaaacaggcagaaacatgccttggaagacattaaagagagtgacttc

SEQ ID NO: 6784772 - DNA, 79 bp, Homo sapiens
tcccttctttcccctgctgccctccagttcccacagtcatcttggactccaggaccctgtgagggtaaaggctaaggga

SEQ ID NO: 6784773 - DNA, 61 bp, Homo sapiens
tcatttccatgtcggtattttataaatattcggtctgtactcctccaggcatgaggaatga

SEQ ID NO: 6784774 - DNA, 60 bp, Homo sapiens
aggagctcttcagtattggaaaagggaacaacacctttcctcttcatcctggaagctgct

SEQ ID NO: 6784775 - DNA, 56 bp, Homo sapiens
gggctatggaacagtgaggctgggattcgaacccaggctgtctgaccccagagccc

SEQ ID NO: 6784776 - DNA, 66 bp, Homo sapiens
gtctgggaggtactgggaggtgtctcagcaggagataagcagcggggacttgccgtcttcctagat

SEQ ID NO: 6784777 - DNA, 73 bp, Homo sapiens
ctctttaaaggtttgacaagcgaagtaccataatgtcatgagagatatggttcttgtcacctttccaaatggg

SEQ ID NO: 6784778 - DNA, 78 bp, Homo sapiens
tgtttcctgctttaggggctggccattgtacaaggtgaaattttaaaattctaaagcaatgaaagttttgcagaaaca

SEQ ID NO: 6784779 - DNA, 125 bp, Homo sapiens
agttgcttcactgatgaatctattgaacaattacttgatattttaaacatacagtcattcttttctttaggaggaaagtgtgttaaaaatttaggaattgttttgtaaaaaataactaagcaact

SEQ ID NO: 6784780 - DNA, 85 bp, Homo sapiens
caggaaggaggactagaggaacatcgagcgatggactgcaagatctataatagatgtcctttgcttctctggtccatcctttttg

SEQ ID NO: 6784781 - DNA, 75 bp, Homo sapiens
catttcctcccaggcctgattgggaatcttgcaccggcatcgcgagccccgctcttcggcctccaggagcgagtg

SEQ ID NO: 6784782 - DNA, 108 bp, Homo sapiens
gcaaaactcaacagcttatttcttggaggagatagggagagaatgtcttttaattatttgtctccaccatcatcttaccaaatcatatttaacctcttgacccgttgt

SEQ ID NO: 6784783 - DNA, 109 bp, Homo sapiens
tcaaaatatatttgtgtttatgctaatatgttctattctgattattatagtgcaaggactagaaattagttgaacaagttaagtaaaatggccagcttatgttaagtga

SEQ ID NO: 6784784 - DNA, 64 bp, Homo sapiens
acctgaaataataatactgtgcaatggatagtatatatttaaggcccacagtggttaatcaggt

SEQ ID NO: 6784785 - DNA, 68 bp, Homo sapiens
tggcagctgctggagagcgagactgttcctgagccgcccattaaacgtgtctcctgcagcagtggcta

SEQ ID NO: 6784786 - DNA, 59 bp, Homo sapiens
actgaggtctatcatgagccaggctgggtgctggggacacatagtgaatagacctcagt

SEQ ID NO: 6784787 - DNA, 71 bp, Homo sapiens
gcccatcacccatgtgtctcccttataagaaaccttgtccttatgggtcgagtgccccatgggataatggc

SEQ ID NO: 6784788 - DNA, 130 bp, Homo sapiens
cacaaacgccatcttgtttatttctgttttccagaagctggtacaaggcctagagcctagttggttctggataaatgtttgctttagatagctgactggatgggtggatgagtgaatggatggatgggtg

SEQ ID NO: 6784789 - DNA, 101 bp, Homo sapiens
ctgagtgtgcctaaaggcagtagaggtatgggatgttagcactggctttcatgccagggtggcttcagactgtgcttctgttgctgtgggcccatactcgg

SEQ ID NO: 6784790 - DNA, 115 bp, Homo sapiens
gaggcaatcccagcaccttcacagcaccaggatctctccaagagccttcccagagaaaagggccattcagaccatcctgctgttagtgagctactttgggtgctgggtggacctc

SEQ ID NO: 6784791 - DNA, 67 bp, Homo sapiens
gatatttgcatttgcatatgaagaagtaaggggaaaaaccccttaagtctctgaaagtgcatgtatt

SEQ ID NO: 6784792 - DNA, 79 bp, Homo sapiens
cccacccgtttctcagcagacctgttgccacggtgactgaagcccccagctctgtctgtagaaacttcagatgggtggg

SEQ ID NO: 6784793 - DNA, 94 bp, Homo sapiens
gtctaagagtgtggctgatgagctgctgttattcatcagaactgggaaacagtgaatatccattctgtgctaactgcaggccaggctccgagac

SEQ ID NO: 6784794 - DNA, 61 bp, Homo sapiens
ggtgagtttcatggttgtttacagtcaccaagaagtgaatatacaatcatagaaactctct

SEQ ID NO: 6784795 - DNA, 69 bp, Homo sapiens
ctcaagcagggaaggggcatgctggagtttacttttaggattctggaaggcctcatccttgtcaatggg

SEQ ID NO: 6784796 - DNA, 61 bp, Homo sapiens
tctagtcatattttttcagtattttcaaggatgaataaaacctgaaggtgtatgtgctggg

SEQ ID NO: 6784797 - DNA, 56 bp, Homo sapiens
cagaggtctccatcaccctcctcctcactggttgaaggttgtccctggaacttctg

SEQ ID NO: 6784798 - DNA, 70 bp, Homo sapiens
ttggtgcaaaagtgattgttgtttttgcaactacttttaatggcaagaactgcaattacttctgcaccaa

SEQ ID NO: 6784799 - DNA, 64 bp, Homo sapiens
gtttctgcagcggagaaaggttatgcttcatatgacttcgttttctctctgcaaattaagggac

SEQ ID NO: 6784800 - DNA, 73 bp, Homo sapiens
ctgggaccagggtttttccctgacctgtttaggggattttcttgatgtctggctaaaatccctggtgccccag

SEQ ID NO: 6784801 - DNA, 106 bp, Homo sapiens
tccctagtaggggaggaaaggttgtcctggagtggcatggcatggacagtagtaaaaagactccttcacagccccacacaggagcactgcctgtgttctctgggga

SEQ ID NO: 6784802 - DNA, 62 bp, Homo sapiens
ccctgggctgttctgcccctgggtttgctgtcccaaacagtgggcctagccggaaaccaggg

SEQ ID NO: 6784803 - DNA, 94 bp, Homo sapiens
taggctggtgaattctttaggtgaatttctacaagcaacacctggagcttctgacatcttagaaattcaatgctctgagtagttggctagcctg

SEQ ID NO: 6784804 - DNA, 56 bp, Homo sapiens
aggtcctgacgtgctccagggctgactcggcctcctccctccagcaaccaggactt

SEQ ID NO: 6784805 - DNA, 76 bp, Homo sapiens
accttcagagtattgcaggcttcaaactctcctagcaataccttgggtttggtatggagtctgagtttctagaggt

SEQ ID NO: 6784806 - DNA, 92 bp, Homo sapiens
tcacctccgagaatcaccaccttcctgcgtgtctcttcactcatgtaagacttgaccaggttgaaggctacggcgaatagcttgggggctga

SEQ ID NO: 6784807 - DNA, 70 bp, Homo sapiens
tggggagcagcagggctgggatttgagcccaggcagcctggctccagcgtccacgtcctgtgctcactca

SEQ ID NO: 6784808 - DNA, 75 bp, Homo sapiens
tcttgttcacagatggcttttttgttgctatgttctaacatggcagaagggaataaggagctttcttttataggg

SEQ ID NO: 6784809 - DNA, 85 bp, Homo sapiens
tctaaacatttagtatgagtctctgtaaccttaacaataaaattagggttttggatacagtgatttctactggtgttttcaaaga

SEQ ID NO: 6784810 - DNA, 62 bp, Homo sapiens
gcagtgattccagcatcagaagatgtgctggtccagccggcccctctgctgctgcgtcctgc

SEQ ID NO: 6784811 - DNA, 60 bp, Homo sapiens
ttctgtcgtgttcactgtggcctaggacattgcctggccaacagtaggagctcgattgaa

SEQ ID NO: 6784812 - DNA, 102 bp, Homo sapiens
agaatattgtctaaaaattagattcaatggagtatttttcaagctgtattatgaaactgatttctattgttaaaactccattggtttggaaagatttattct

SEQ ID NO: 6784813 - DNA, 65 bp, Homo sapiens
ttgtggactgaagttacagatgacaccctgcagaagagttcccagctggaaatttcagtttgcag

SEQ ID NO: 6784814 - DNA, 62 bp, Homo sapiens
gtgtcggggagagagcctgcagggaagggtaaagcccgtgggggcagggctctcccagatgc

SEQ ID NO: 6784815 - DNA, 55 bp, Homo sapiens
ccagtgggaacactggcattgctgctcttttgccacaatgccaatgtccttctgg

SEQ ID NO: 6784816 - DNA, 77 bp, Homo sapiens
gcaggactcgtgtttaagtgtcagaggcttagaggggtcagctctgaactagaagtctctcacatatctggtcctgc

SEQ ID NO: 6784817 - DNA, 66 bp, Homo sapiens
gcatctttggcttgcactattacactgttagtcttctttgtaagtgtgtctgtgtaaccgaaatgt

SEQ ID NO: 6784818 - DNA, 78 bp, Homo sapiens
gctgtcagctgcccagatgtggctctggctttccaggcgggactttttgcttgtcctcagccactgtgcactgattgc

SEQ ID NO: 6784819 - DNA, 101 bp, Homo sapiens
tgctcacgtacatagctatatattgtttaaaataaacagggaccttatgttatgtccattgtgattatatacaaaagcgttgctgtgtgctcgggtgagca

SEQ ID NO: 6784820 - DNA, 76 bp, Homo sapiens
gttcaagactgtagacatgaccattaacattagcaagacattaaatgttaaagaacatggctatttggtcgggagc

SEQ ID NO: 6784821 - DNA, 62 bp, Homo sapiens
tggtagcccagaggccagaagaggggctctgttcctttctcttgtttcctttgcgctatcca

SEQ ID NO: 6784822 - DNA, 62 bp, Homo sapiens
atggttctgctgggtaatgcattctgagttccaactcattatgcaaaataaggcagaaacat

SEQ ID NO: 6784823 - DNA, 66 bp, Homo sapiens
gggggcgagaggccaagggatccgtgaggccacctctctggtcatccgggccggcctctggccccc

SEQ ID NO: 6784824 - DNA, 77 bp, Homo sapiens
ggaaggtatatgatgcggtgaaggaagggtagtactacgataatgcagtatgccctgaattacccacaagattttcc

SEQ ID NO: 6784825 - DNA, 71 bp, Homo sapiens
ttctacatgtcaagtctccaagcccctactttcatgaataatagagaacttagagggttgtatatgtggaa

SEQ ID NO: 6784826 - DNA, 82 bp, Homo sapiens
gaggggcagaggtgccagatgcacagctgaattgagcagagctatttcagatgttcagtctgttcctacacttctgctcctc

SEQ ID NO: 6784827 - DNA, 69 bp, Homo sapiens
ggccggggtggggaagcaggttcctgggctcacgggcaggcatctgcctcctctacccctgcacaggtc

SEQ ID NO: 6784828 - DNA, 66 bp, Homo sapiens
ggtgagcctgatgaaacaggcagactcattccttttcaagatttgtttgcagttttacaggctccc

SEQ ID NO: 6784829 - DNA, 61 bp, Homo sapiens
tcagtttcctggttgtgatattgtactacagtttgcaaatgttaccaatggaggaaattgg

SEQ ID NO: 6784830 - DNA, 74 bp, Homo sapiens
cacggccacatttactgatgtatgtattgtctatgactgattttgtgctacattggtagagttcagtagttgtg

SEQ ID NO: 6784831 - DNA, 55 bp, Homo sapiens
tatgcatctgtgatgtactgcctcatgatttcagtgcagtctgtcacagagcatg

SEQ ID NO: 6784832 - DNA, 82 bp, Homo sapiens
ttaatgagatgtggcagttttgacatcacaaagttttgacatattttattttggtaatggtgttgctgtttaacctcattga

SEQ ID NO: 6784833 - DNA, 55 bp, Homo sapiens
gctttcttgaggctgtgctttcttccctggcttgaagagtgtacaagcagaaggc

SEQ ID NO: 6784834 - DNA, 85 bp, Homo sapiens
ccgttcgtggcccaccgtggtggtcaccaaattgagggcttcctggaaggacctcctcacggtgcccatccactgggtcatgtgg

SEQ ID NO: 6784835 - DNA, 82 bp, Homo sapiens
ccatgataagttgaaatttgtgataatttagagaatgatatcaagcaactgctttaaaatcatagacttcagtaactaatgg

SEQ ID NO: 6784836 - DNA, 84 bp, Homo sapiens
gtgtctcagcttggaatatcttgtatctgacctcataaaattgatcctgattttgtgggtggtaaaatacaatgatagaggtgc

SEQ ID NO: 6784837 - DNA, 121 bp, Homo sapiens
ggccatggcaattgaaaacaaggctatcagaagagctgtgggtggtagtcctgtctctgagaaaggaacagggccactggctgacggctgcattccagaacgcctccagatgcagagggcc

SEQ ID NO: 6784838 - DNA, 68 bp, Homo sapiens
ggcatttatctaatatagtttatggctatgtgagcatatggagagcagaattatgctagagaggtgcc

SEQ ID NO: 6784839 - DNA, 66 bp, Homo sapiens
ttacacataccaattagagtttgttgcagggaatagccactcaaactagcctgactggtattgtaa

SEQ ID NO: 6784840 - DNA, 61 bp, Homo sapiens
aggtcttaggacctcagctgtgagtgtggggacctgcactctgctcaaagtcctgaggcct

SEQ ID NO: 6784841 - DNA, 62 bp, Homo sapiens
gtacatccttgattatgtaaggattccatagagaatcttttactacaaatcaggtgatctac

SEQ ID NO: 6784842 - DNA, 64 bp, Homo sapiens
tcggggaggggcctgaaaccttacaaactaaatcgaatgtagcacaggcaggtgcctctcccga

SEQ ID NO: 6784843 - DNA, 57 bp, Homo sapiens
ggtcagtcttgcttctcttgggtcagcatgctgcctgggagtgcagaggcttttgcc

SEQ ID NO: 6784844 - DNA, 55 bp, Homo sapiens
atgtggcagaaagcatgtggacagataataactgtttgtatgactttgtatatat

SEQ ID NO: 6784845 - DNA, 70 bp, Homo sapiens
gtggcccttgaccgaatatgatcacttcaggacactttgctgtattcattcatttggttatgaagctcac

SEQ ID NO: 6784846 - DNA, 57 bp, Homo sapiens
agggctgctttgctaaatatggaagcccatgtgacacttgacttagcaaaaggcttt

SEQ ID NO: 6784847 - DNA, 65 bp, Homo sapiens
gtatttgcaaatctaaaagagaaccagtcggtttgtatcagttcttttgggttcattgcagttac

SEQ ID NO: 6784848 - DNA, 66 bp, Homo sapiens
gctgaacttatgtgggactgcaatggcagtgaaccagtgtgagcagagcctgacatgaggagcagc

SEQ ID NO: 6784849 - DNA, 78 bp, Homo sapiens
ggccgtcctcctcgtctttgtggtccaggaagtggccggggtccactgctcggcctcaaagaagctggcagcctggcc

SEQ ID NO: 6784850 - DNA, 75 bp, Homo sapiens
tgactttcttcagtagctcaagaaatttttattaatttggaaaaatgttcttaagagggttaagtgaagaaagca

SEQ ID NO: 6784851 - DNA, 74 bp, Homo sapiens
ggtaaatggaagctctaaggtcattgcattgtctgagaagaaaagtgcccattgatattagactttggtaaact

SEQ ID NO: 6784852 - DNA, 62 bp, Homo sapiens
ggcactctcgctgattagcgtaaaacctctcatgctttttatgagaattaagtgcgagtgcc

SEQ ID NO: 6784853 - DNA, 62 bp, Homo sapiens
gtgagtcctttcacgtggaaggagattgaaaaagataagctttcacatagaaagtgatttac

SEQ ID NO: 6784854 - DNA, 68 bp, Homo sapiens
gatgtctggcttctgaaatgctgctgttatcattttatctgcattacttctttcataggtcaggcctc

SEQ ID NO: 6784855 - DNA, 57 bp, Homo sapiens
aagtcagacagctgagctgcctaccagctgtgcagctttgggcaagttgcctggctt

SEQ ID NO: 6784856 - DNA, 60 bp, Homo sapiens
gcaggtagtgggctgccttgaggtgattttcagtctttgtaaggccaagtctatttctgt

SEQ ID NO: 6784857 - DNA, 58 bp, Homo sapiens
gccagcaccttctcatatgtttatcccctgtactggtcagcaatgaggcaggtctggt

SEQ ID NO: 6784858 - DNA, 81 bp, Homo sapiens
taggatgtatttggatctggcagaatatatgtatgtagtttgcagtcacttgctatatagctgctattttcaatcatccta

SEQ ID NO: 6784859 - DNA, 111 bp, Homo sapiens
attgttttattaagttcttagctttatggaaatgtattatatttggaatgactataatttatcatccaatatgagacacttttgtgcatgcaaagggctactattaacaat

SEQ ID NO: 6784860 - DNA, 99 bp, Homo sapiens
tgtatttgtgtttctaagtatcttgcagttttctcattgacctgttcttagccagcattttctttaggttttaagactgtagtaagaaatcgctataca

SEQ ID NO: 6784861 - DNA, 77 bp, Homo sapiens
gtaacggatcttgaggtggtgacattatccttgattatcttaataagcttgatgtaactaaccacaagggtccttat

SEQ ID NO: 6784862 - DNA, 102 bp, Homo sapiens
cttccgtggcacgtgttcgtccttctgagcctgcagctttcacagcatccacttggatgagggctttgcaggactttagcagagcatgtgctcacttggaag

SEQ ID NO: 6784863 - DNA, 65 bp, Homo sapiens
tttctgggaagtagaatcagatgagtatagcttctaatacatttatctgaaaaaactcttggaga

SEQ ID NO: 6784864 - DNA, 85 bp, Homo sapiens
ggaaacacatgaaagttggtgagtaaaatctaggtgaaatacaactgacaatagaaaaatactcacttgaatttgcatggtttcc

SEQ ID NO: 6784865 - DNA, 102 bp, Homo sapiens
tcttcactgttgttattggacatttattgagtgtggtgattctatagagatccactctaataaccaaacattcactgagtctagttaccaggcttgtgaaga

SEQ ID NO: 6784866 - DNA, 63 bp, Homo sapiens
cctagaacgtctttactcttacgaatgggacacctatgaaaagttaccagtgaggacttcagg

SEQ ID NO: 6784867 - DNA, 88 bp, Homo sapiens
acgcctagaagtccctgtcctgggggaggagtggggggtgcatgtcctgcgtccagtctcccagggctgggactgatgctagctgtgt

SEQ ID NO: 6784868 - DNA, 101 bp, Homo sapiens
gtatggttatcccttggctattaggtatgtggttgctatgactagggtttggaatagtatcacaacgtcatatagctatttacaatagcaaatgggcatat

SEQ ID NO: 6784869 - DNA, 71 bp, Homo sapiens
catctacttattgtgaggtattgagattcactcagtagtgaagcaaacatatatagtaagatccctggatg

SEQ ID NO: 6784870 - DNA, 68 bp, Homo sapiens
gagtcgaaccatgagtggtcaggatggacttatagcatcccccaggtgaaatcttcatggttcctctc

SEQ ID NO: 6784871 - DNA, 64 bp, Homo sapiens
ctggaaggttctttgtgtgcctgatgctgtgttggctactgttgggacgcaaaggactttttag

SEQ ID NO: 6784872 - DNA, 88 bp, Homo sapiens
ggccttcatttagtgtcaagatgacagatagatgatatgtgttgccatttctctgtctgtgccactctttcaagtctgcgtggagtcc

SEQ ID NO: 6784873 - DNA, 83 bp, Homo sapiens
gtaaagtagctcaggtctgtggttctgagcaggacaccatgatgtgtgtcttcatctcagacacagtttcaagtggactttgc

SEQ ID NO: 6784874 - DNA, 61 bp, Homo sapiens
agagaaatttccctgccttctgagcctcccaatagtttagcaggtaggttgaaattttcct

SEQ ID NO: 6784875 - DNA, 65 bp, Homo sapiens
gcctctttgggttcagatttggtctcttctttcctgccagtcatctcctgagaacccacagtggt

SEQ ID NO: 6784876 - DNA, 62 bp, Homo sapiens
cagttccagtgctccatagcatagtgtgttggtcactctgtcctggagggcataggacgctg

SEQ ID NO: 6784877 - DNA, 59 bp, Homo sapiens
gcccaggcacccagcccagtcgcacgggtccctgttaggactttgggctgtgcttaagt

SEQ ID NO: 6784878 - DNA, 84 bp, Homo sapiens
tgacactcgcagaggcacgagtgcagaaatgatccgaagccccgtccaagtcatgatttcttattatgtgctctgtgaatgtta

SEQ ID NO: 6784879 - DNA, 64 bp, Homo sapiens
tcttagatttcagcatttatgtctttgacagcctgtatgactgaagatgttttgaagtcttgga

SEQ ID NO: 6784880 - DNA, 71 bp, Homo sapiens
tctctggtttcaatgggtacgattattgtaagcaggatccattcaataatcggacccatttaaaccggaga

SEQ ID NO: 6784881 - DNA, 63 bp, Homo sapiens
ttggacaccagaattgctaggaaaattgatctcagaatttcttgcatcactctgctgttccaa

SEQ ID NO: 6784882 - DNA, 57 bp, Homo sapiens
caggggagaaacttaataaatattggttgagtattattaaaatgtgtttctcttctg

SEQ ID NO: 6784883 - DNA, 55 bp, Homo sapiens
gatggattattggaaaatctgtgtactcccctgcacagttcatgataactccatc

SEQ ID NO: 6784884 - DNA, 69 bp, Homo sapiens
cttgaacccaggaggcggaggttgtggtgagccaagatcgcaccattgcactccagcctgggcaacaag

SEQ ID NO: 6784885 - DNA, 60 bp, Homo sapiens
ggggtcgccgggagcctgagtgacatctcttcccaacactgccaggccctgtctggcctc

SEQ ID NO: 6784886 - DNA, 87 bp, Homo sapiens
tctcaaacagtaacactctaaagggatgcacgatcttttcttttatacaacagacagtgcttccatctagagggtcactgcctgaga

SEQ ID NO: 6784887 - DNA, 66 bp, Homo sapiens
ctcagtttcttatcttcaaaattgggcaataatcatgctgcacagttgtcaagaggatgagatgag

SEQ ID NO: 6784888 - DNA, 64 bp, Homo sapiens
gcttagagaggggctgggcagtccctggatgaaaacacatttgcatgagcagcccctcctctgc

SEQ ID NO: 6784889 - DNA, 75 bp, Homo sapiens
aattgaaaatatagttttccagactgaaggaaacaaagcctcaggattggatatcagatttgagtattttcagtt

SEQ ID NO: 6784890 - DNA, 72 bp, Homo sapiens
ctgggactactcacttccccacaccccttggaggctgaggccccagggtcagtgtgtggagggtcagctcag

SEQ ID NO: 6784891 - DNA, 105 bp, Homo sapiens
gctaaaggctgcggtttttgtggtgtgagtggacataggactctttcatcagggtaatttatagtccaatgtccatttgttttagaacagactgaaattgctggc

SEQ ID NO: 6784892 - DNA, 57 bp, Homo sapiens
ttgacatctttgatctcatttagacccagagatggggctgaatttattggatgttaa

SEQ ID NO: 6784893 - DNA, 63 bp, Homo sapiens
tgctttagggaatagaagatctgaaagactatcatgttttttaattttcctcttcctggagta

SEQ ID NO: 6784894 - DNA, 59 bp, Homo sapiens
gatgtgtgggtacagatgattgttgcaaaaaactttgaagcaaccaacacccgcacctc

SEQ ID NO: 6784895 - DNA, 73 bp, Homo sapiens
tgctttcaggattgagcaaatggattatatacacaacttggattatctatccttactcatcctgcacgaagta

SEQ ID NO: 6784896 - DNA, 61 bp, Homo sapiens
ccgcaccaccgcgcgcgcccgctctgcgcctgcgcgcaggcaatgctccgcgggggcgcgg

SEQ ID NO: 6784897 - DNA, 77 bp, Homo sapiens
tggctctgaagtgcttggttcaatgaaggttagcctactttagtttgggaccacatcaatcaggtactgcagggcca

SEQ ID NO: 6784898 - DNA, 61 bp, Homo sapiens
acctctcagggtttcctaatgcaaatccttgaaccctgcagaagtgagcatccagagaggt

SEQ ID NO: 6784899 - DNA, 81 bp, Homo sapiens
acagactggctgtgggatgagagcctcagaagccaccactctcccctgtggaaatgaaggttccattccatgtgcagctgt

SEQ ID NO: 6784900 - DNA, 64 bp, Homo sapiens
gggtctctgtgcatgcgcggagctgaaagggagcgttttgcagatctccacgcgtgcgcaactc

SEQ ID NO: 6784901 - DNA, 69 bp, Homo sapiens
aataatcaattccacgccagtgacgagacaggaggtgattcagctagctggctggcagtaaaggttgtt

SEQ ID NO: 6784902 - DNA, 55 bp, Homo sapiens
ttctcatgtcccagtaaagcttggaaacaacatcactatcactgggcactgagga

SEQ ID NO: 6784903 - DNA, 66 bp, Homo sapiens
cacttgggtgcaagcaagtggcacagagtccattggcactcaggcagctagttttgcacctctgtg

SEQ ID NO: 6784904 - DNA, 62 bp, Homo sapiens
tggaaatatttgctcattatctccttaaattttcagtggagtcacaaatgaatatgtttcca

SEQ ID NO: 6784905 - DNA, 87 bp, Homo sapiens
aaaataagtgagcaggacacctatatcactggtagagaatatttattttccctggacaggtttgggtgcctgttcttaaattatttt

SEQ ID NO: 6784906 - DNA, 56 bp, Homo sapiens
tgggctggaaggccctttgttgatctcaagagagagaccttttgccttctagttta

SEQ ID NO: 6784907 - DNA, 84 bp, Homo sapiens
gctcaactgtgtacagcagaaagagcagtggactagagttagacagctgggcccacatgcctttctgccattcagcatttgggc

SEQ ID NO: 6784908 - DNA, 71 bp, Homo sapiens
tatatgtgggattatttgtgctgtcatctgctaatttcacagatgtcttctcaactgtagaccttcatata

SEQ ID NO: 6784909 - DNA, 116 bp, Homo sapiens
ggagttaagggagtgggggtgagtaggggtgaaaggagaaggttccaggtccttcacctacagtgaagggctctgctgtctctcccctcctctgcttctctccctctttttcctcc

SEQ ID NO: 6784910 - DNA, 58 bp, Homo sapiens
attgtccataaattcacaagtgtatataagtatatgcataagtgctttagtggggagt

SEQ ID NO: 6784911 - DNA, 82 bp, Homo sapiens
tctcttcctctctggtctcttcaggagcttgagcgccttaaccaggtgctggaggccgagaagcagcagttcgaggaggtgg

SEQ ID NO: 6784912 - DNA, 90 bp, Homo sapiens
cctcaatttggatatcaatatctgtggccatacaatttagatgtgaaaagcaaaaattgtaggatcacatgacctatattcaaatgtagg

SEQ ID NO: 6784913 - DNA, 76 bp, Homo sapiens
ggcttagagtcatggagttgaactgtgcttccttataccaagagaagtgagcttgttcactcttccctctaaagcc

SEQ ID NO: 6784914 - DNA, 56 bp, Homo sapiens
aggcagcaaagaaatgatgctgtccacagaacaaacagcagcctctcctgctgcct

SEQ ID NO: 6784915 - DNA, 70 bp, Homo sapiens
gcgagcaggctagcagggcccagggcagcttgctcggccacatctgccctggagctgctgtctgctgtgc

SEQ ID NO: 6784916 - DNA, 57 bp, Homo sapiens
catccatttaattgaggggaaggagagtattagcctcatccttttttctaagtggtg

SEQ ID NO: 6784917 - DNA, 70 bp, Homo sapiens
tttcctttattattaaatccataggaagtctatattactttactttggaatattttattgagaagggaga

SEQ ID NO: 6784918 - DNA, 99 bp, Homo sapiens
ggaagtgcccccgttgtaccccctacacacccctcttggcattgagtgccagtcctctgccaggctctgtgttacaagttggggagggcggcaaagtcc

SEQ ID NO: 6784919 - DNA, 73 bp, Homo sapiens
gtgcggctgcgttacaggggcctcagttgtgatgtgtcattctgaggtctattttgaaactgctaagctgcgc

SEQ ID NO: 6784920 - DNA, 81 bp, Homo sapiens
gccactctggaccctcctgctgagagccccagctgagacacagacccttggccaaccccaggaatgtccagccctgtgagc

SEQ ID NO: 6784921 - DNA, 78 bp, Homo sapiens
cctctggacagccttcctcctctgctggccagttgcatgatctccttgctggtctgtctgccaggttaggctgtgagg

SEQ ID NO: 6784922 - DNA, 81 bp, Homo sapiens
ggctctcgctccattgggcacaagcagcccactgacattgctgagatgtatgtgctgctccgtgctgaccaaggcagggcc

SEQ ID NO: 6784923 - DNA, 60 bp, Homo sapiens
ggggcttgtgtcaacctgtggccgggtggggatgctccttcccagctggtaggctgcccc

SEQ ID NO: 6784924 - DNA, 66 bp, Homo sapiens
ttctctggggaaaagaatataaattatcctatctaaatttcaaggatgactattcccacatgagag

SEQ ID NO: 6784925 - DNA, 61 bp, Homo sapiens
cctccacgccaggctggggttagatcctagttccccaaaatagccccagctgcgtctgagg

SEQ ID NO: 6784926 - DNA, 68 bp, Homo sapiens
ttgagtgtaattatgaaatggagttagctatacccaactgcacaaaacacattgctaattacattcaa

SEQ ID NO: 6784927 - DNA, 82 bp, Homo sapiens
ggtccctgaggagatccccccagaagtggtgcaggagtatgtggacatcatggaggagctgctggggccttccctcggggcc

SEQ ID NO: 6784928 - DNA, 67 bp, Homo sapiens
gccaaaattaagaggtttggctacaaagcccctgcttttagccatatagtgctcttgtattttaggt

SEQ ID NO: 6784929 - DNA, 77 bp, Homo sapiens
aaattgcagacttttatcagttacggatgtcacccatgttacggatgaagaaactgtggctgagaaattgacaactt

SEQ ID NO: 6784930 - DNA, 76 bp, Homo sapiens
tagggagaatgcaatatagggaagatagattattaactttctaaaaatgtggttcatctttgtattgcttccccta

SEQ ID NO: 6784931 - DNA, 72 bp, Homo sapiens
gacaagtgtttatggttattgttaaaccttgagattttacctaatggttcagctaataatagacactatttc

SEQ ID NO: 6784932 - DNA, 74 bp, Homo sapiens
ccccatttaacacagagttttccaacctctgcactatggatattttgggctggataatctttgtcttggagggg

SEQ ID NO: 6784933 - DNA, 98 bp, Homo sapiens
acctggatggtctggctggggagggcgtcaaggccaagtacctcatgccgccctttgtcacgatgacctccccgtcccacttcaccgccatcccgggt

SEQ ID NO: 6784934 - DNA, 62 bp, Homo sapiens
ccagcatagatctgtcatatcctgttgtcagcggcagagtgggtgggcagatgtgtgcatgg

SEQ ID NO: 6784935 - DNA, 57 bp, Homo sapiens
cagctgttgttatgtctgcaggggaatcacagtctttggcagccccttacacagctg

SEQ ID NO: 6784936 - DNA, 62 bp, Homo sapiens
ccagcttttcagaatctgcctgaaagtggcctaagaatggcacaggccttcaggatggctgg

SEQ ID NO: 6784937 - DNA, 63 bp, Homo sapiens
gggctggccaatcacggcactgaattcctcttgctagcgattcatgtagtgattgagtcactc

SEQ ID NO: 6784938 - DNA, 60 bp, Homo sapiens
caaggcagtaggtgtttcaaactgagtctggattgacctagctggaacctctactccttg

SEQ ID NO: 6784939 - DNA, 87 bp, Homo sapiens
gggagagctgaggagaggggctcccaagagccgactggtgcttccccttgtctgccttgacttgtctctcctcctgtcccctctccc

SEQ ID NO: 6784940 - DNA, 57 bp, Homo sapiens
cttcccatgggggctgtgctcgagaaggctgcatgcctctccaggtcccaggggaag

SEQ ID NO: 6784941 - DNA, 55 bp, Homo sapiens
cctgagcctgcagccgagcagagcgcgctcactctcgccggtcctggaggccagg

SEQ ID NO: 6784942 - DNA, 56 bp, Homo sapiens
tgctgcatagcagctcctgaaattagtagacacttgtttggaagctgtgtgtagta

SEQ ID NO: 6784943 - DNA, 68 bp, Homo sapiens
ggaatggtggctcacgcctataatcccagcactttgggaggccaaggtgggcggatcacttgaggtcc

SEQ ID NO: 6784944 - DNA, 66 bp, Homo sapiens
ggtgcgtatggatgctggaagatcattttctcctggagagacatctcccatgcatttttatgagcc

SEQ ID NO: 6784945 - DNA, 69 bp, Homo sapiens
caccaaatgaaagagaaatttggagctatattcaggctctaaagaagagggttctgcggtcaattggtg

SEQ ID NO: 6784946 - DNA, 74 bp, Homo sapiens
attacacaaccacattctcagcatacaagctggctccctcttggctgctgaaatatgttctggggttcagtagt

SEQ ID NO: 6784947 - DNA, 58 bp, Homo sapiens
ctgagatttggttttgttcactgatgcatcctctgtgtctacaacaatgccaatccag

SEQ ID NO: 6784948 - DNA, 98 bp, Homo sapiens
agatccttcactgcactcctaagagctgagcctcgtattcaaatctgaatgaatcaggttctgattcagtctcttcaggagaattgtctgagagatct

SEQ ID NO: 6784949 - DNA, 76 bp, Homo sapiens
ctcagactgtactcttatagccatctgaaatacgttttctaggtagagatagattgtgtaagggtacagttgtgag

SEQ ID NO: 6784950 - DNA, 85 bp, Homo sapiens
gcctccccagatagtattcatcatttgggtggtgtgtgtgaatattcaaagcatggccaggaaaggtagaaacctctgggatggt

SEQ ID NO: 6784951 - DNA, 58 bp, Homo sapiens
tccaggagatctcgccattgtctgggttgcagccaggggcccagacagatatcctggg

SEQ ID NO: 6784952 - DNA, 82 bp, Homo sapiens
attgtttgaattaattaactgagctggtgctcaagggatctagtacaagatttttagacaaaagctgggaatttacaataat

SEQ ID NO: 6784953 - DNA, 59 bp, Homo sapiens
ggcaccgaggcgcagcccggaggagacagcgcaccctgaccctccccgccgcctccgcc

SEQ ID NO: 6784954 - DNA, 56 bp, Homo sapiens
cccaactctcttagttatctcattggaatagtgtagaagtgctccagtgagttggg

SEQ ID NO: 6784955 - DNA, 130 bp, Homo sapiens
attggggcatgttattgggaggaggttggggggatttttggttatgttaaatgtttgatgtttaaattgttgcatgttgaattcaaactttttaacaagtccttgatgtttcaatttgaaagtgaccaat

SEQ ID NO: 6784956 - DNA, 66 bp, Homo sapiens
agggcaaatctttccctttactatccagagctttccctttggataagaggttgatggtagagacct

SEQ ID NO: 6784957 - DNA, 96 bp, Homo sapiens
gtgtgtgataggtcaagaaaattgagaattgtgagtttggagaattatagcaatctttattagggtttcatcaaggctcttgacaagtttacacac

SEQ ID NO: 6784958 - DNA, 84 bp, Homo sapiens
tcttctttggtgtttatttgtgaatcatttatctactttatagaacaattggtagagttatccttcacaggtatattcagaaga

SEQ ID NO: 6784959 - DNA, 77 bp, Homo sapiens
ggctgcctgcaccaggcttagagccccaggcacattgtctctcagctttgagacctgctctgtgctagacaacagct

SEQ ID NO: 6784960 - DNA, 73 bp, Homo sapiens
gggatgaatgttgcaagttaaatcttactgagtttagagcacttagatgattttatgtcttgtcatttttccc

SEQ ID NO: 6784961 - DNA, 82 bp, Homo sapiens
tattaggttggtgcaaaagaaatcagtttttgccattactttctatggcaaaaactgtaattacttttgcaccaacctaata

SEQ ID NO: 6784962 - DNA, 74 bp, Homo sapiens
cagccaaaatgtggggctggaggcaggagactgtgtcattcagaatctgtgcctgcttccccacccatgggctg

SEQ ID NO: 6784963 - DNA, 69 bp, Homo sapiens
gtagcaatacagtaagagtactgtaactttgcatatgtgctttatatactgtatattactgtgttatac

SEQ ID NO: 6784964 - DNA, 90 bp, Homo sapiens
ttgtatggttaagactgccagcttcttacggctgccttgttgagaggaagagaggcaggctggaagctgggaggcaagacattcatgcga

SEQ ID NO: 6784965 - DNA, 61 bp, Homo sapiens
tgagccagccttcttctgaggtcagtggaaagagctcagaatgggaggggttgactgctca

SEQ ID NO: 6784966 - DNA, 90 bp, Homo sapiens
cagacttactgaatcagaatctctggggttgggccaaggaaactgtctttcaaacactcattcccagatcattctgattccagtgatctg

SEQ ID NO: 6784967 - DNA, 98 bp, Homo sapiens
ctcccttgattctaaccatggagtgtcaccttcctggttattggagaaatctatagcagcttcattaaaccagagtgacactctacagattttaggag

SEQ ID NO: 6784968 - DNA, 65 bp, Homo sapiens
ggctgtaacttaatgagaggcagatgtcaacggggagcagatgtttgcagctcttcagttatatc

SEQ ID NO: 6784969 - DNA, 60 bp, Homo sapiens
gtggtttcctgaacaccgatggtgtgcaaggctgtgtatgaggtattacaggaaatatac

SEQ ID NO: 6784970 - DNA, 55 bp, Homo sapiens
tgtgggatcaaagcagctttgctgtagtcccagtgcagctttgctctggtcccca

SEQ ID NO: 6784971 - DNA, 57 bp, Homo sapiens
gccaccctggctactgtgaaagctacaggtgggggtcctgacagagagcagggtggt

SEQ ID NO: 6784972 - DNA, 86 bp, Homo sapiens
ggctgctgcttgctggacacactggagtctggcagggtcagctgagcagctcttgtctcctcggctgtccagccagcctggcagcc

SEQ ID NO: 6784973 - DNA, 55 bp, Homo sapiens
ccctgaggaaagggtggagggcacaagggatccaataccatctcttcctcatggg

SEQ ID NO: 6784974 - DNA, 67 bp, Homo sapiens
gagctgccgtttctatcactgatcctccaggagaaagcctttggaattagtgttgaaatcagggctc

SEQ ID NO: 6784975 - DNA, 55 bp, Homo sapiens
catttgtatagtgcttagaccagcatctggtatctttttaagtgctatgcaattg

SEQ ID NO: 6784976 - DNA, 55 bp, Homo sapiens
ctgaagatagtgtctgatcatgactttgcaaagtaacagacgaagtgatcttcag

SEQ ID NO: 6784977 - DNA, 63 bp, Homo sapiens
agctattgctgaatgttggcatttcatgcaatctggaaatatcagtattttaagcagtgagtt

SEQ ID NO: 6784978 - DNA, 71 bp, Homo sapiens
cccaaactcttggctgcgtcctggctgtggacctgtatcctagaaacactccaaggcagccaggaggtggg

SEQ ID NO: 6784979 - DNA, 130 bp, Homo sapiens
gagggcaggattgctccctggttcccaggaactttgttcacagggttgttgtagtgacttcctttagtctttgcttctactctgtcagcagagttctgcagctgtgggcttctcccaattcagagccctc

SEQ ID NO: 6784980 - DNA, 101 bp, Homo sapiens
tccttactaggcagtttcctgaaaagtaagggacaagggctattgttcaaaatcctgtagtgttcccatctttatctaggcctaaatctgcctagaaagga

SEQ ID NO: 6784981 - DNA, 72 bp, Homo sapiens
gtgacattcaagtctgcccagagtcagcagccaagcagcgtgctctctgatctacagatttgcattgttcac

SEQ ID NO: 6784982 - DNA, 85 bp, Homo sapiens
cagctcttcacaggggatgatcctcccgcagcgtgcctcgtcttcaggcctggctgccgcagatgaatctccatgaatcaagctg

SEQ ID NO: 6784983 - DNA, 58 bp, Homo sapiens
ggtgacagggcttttaatcagtagttgtaaattggcaaatattgtttagctctgtgcc

SEQ ID NO: 6784984 - DNA, 88 bp, Homo sapiens
tatcatctgagtatttgaaacgattcctaccacatcctaattctagcaaggagaaaggggaaaaagtgttaggagtatacttgtgatg

SEQ ID NO: 6784985 - DNA, 83 bp, Homo sapiens
gtttttcctcttattgctgtttaatgatgtcttatcatagtagctagaacctatagggcaatgttgaacaacaatggaacaac

SEQ ID NO: 6784986 - DNA, 94 bp, Homo sapiens
gatgcatacttgaaatcttccaatggtcacatcaatctgaaatcactgattaattctaaatggtgtgccatatggagctttcctgtcctgtgtc

SEQ ID NO: 6784987 - DNA, 80 bp, Homo sapiens
tctgcataataggtgcttgaggaacggaggctgtgtgtttctgcacgccagcccagtgcatttgtgtactcacatgtaga

SEQ ID NO: 6784988 - DNA, 64 bp, Homo sapiens
ttttggatgcttaaatcgtttgaataatttggagagacaagattcaaacagtttgacaccagaa

SEQ ID NO: 6784989 - DNA, 58 bp, Homo sapiens
gcccaggttggagagcagtggcaagaccttggctcactgcaacctctgcctcctgggc

SEQ ID NO: 6784990 - DNA, 106 bp, Homo sapiens
gtttgtcactgcaacttttctcttcccactttctgtatttttttaagaagctaggagcccctcaggtggaaatcgggaaggacgaggaaggtatgctgtgctgagc

SEQ ID NO: 6784991 - DNA, 57 bp, Homo sapiens
actttctatggcttattatgaggtttaattttatcttgtaataagcaatatggaagt

SEQ ID NO: 6784992 - DNA, 81 bp, Homo sapiens
ggtcccttactggcttccataatcttgtttatttacgggacacccatatgaaatgccattactggaagaagtcttgggacc

SEQ ID NO: 6784993 - DNA, 65 bp, Homo sapiens
tagagtttgtgggaatggagtattgcacagatgcagctgcacaatggtcttcctccacccctctg

SEQ ID NO: 6784994 - DNA, 68 bp, Homo sapiens
cccctgagtgacctccaagcctcagtttcccgtttgtgaaagtgggcagcccaggaggtcttgagggg

SEQ ID NO: 6784995 - DNA, 75 bp, Homo sapiens
ggctgggctcctgtgggtgggccagatcaggttgggtattggaaaaggcctccccataggaattgcatttcagct

SEQ ID NO: 6784996 - DNA, 85 bp, Homo sapiens
atgcaccttcctgggctcccacccatagggcgagtccatacttcccttggactcgccctgtgggtgggaggccagaaaggagcat

SEQ ID NO: 6784997 - DNA, 74 bp, Homo sapiens
gtgagtgatagggagtgctgaagataataaacagaactcattatctgaagttatcagtagttcggttttctcac

SEQ ID NO: 6784998 - DNA, 67 bp, Homo sapiens
agtcatgctttgcctccaaagaaaaagttgtgatgaaatagctctactgtaaaagggaagcatgact

SEQ ID NO: 6784999 - DNA, 80 bp, Homo sapiens
gttatataactctcatctcggatcagaagtgatcattgaaatggtgtcgtttttgggaggtgggggttcatttttgtgac

SEQ ID NO: 6785000 - DNA, 118 bp, Homo sapiens
cccatttgtcatctaaatggtccgtccccttcttaaacatcattttggcccaaggtccattcatggggcctgccgggtgttcctgggaagatgggcagaaaatcccaaggcaagtggg

SEQ ID NO: 6785001 - DNA, 61 bp, Homo sapiens
gctgggagctctgagcctgctatgggtcttctccatgggccttactctaagggcttctggc

SEQ ID NO: 6785002 - DNA, 67 bp, Homo sapiens
ggcagtggaaatagtttggttatagaggtgttgaaaatctctgtcaaaaacttctttctcactagcc

SEQ ID NO: 6785003 - DNA, 76 bp, Homo sapiens
ctctgctcctgcttcattaatgtctataagtttgttacaaagacagaaactgacaggaaatgaatttagggtaggg

SEQ ID NO: 6785004 - DNA, 81 bp, Homo sapiens
tctcctggcccctgtaaaatgtacatgtatatgcagcatataatatttatctacagttcagagatgcatgggcccagatga

SEQ ID NO: 6785005 - DNA, 61 bp, Homo sapiens
ctattcattggtcctgctcctggactgtaacacagttgagagaaaggagactagtgtttag

SEQ ID NO: 6785006 - DNA, 99 bp, Homo sapiens
gagcagtgatcctatttgaatgcaatagcatttttaagggaatcaggtccagccaatttctgattctgtaaggctaaattctattaggcattaaaactc

SEQ ID NO: 6785007 - DNA, 58 bp, Homo sapiens
atgggtaggagaacaaatataagccatgagcttatagctattgattttctctacctgt

SEQ ID NO: 6785008 - DNA, 126 bp, Homo sapiens
atcagttaaaaattcttaacatgttatttcaagctgcctagagttgaatgtctacaaaatatgatgtttggggataccacgtagctttggcagtagagagttatggcagaaatacattgtactggt

SEQ ID NO: 6785009 - DNA, 73 bp, Homo sapiens
agtgtacatctagttaattgttctaatgtttggcagcacaatgcatatagaacatttgacattatttgtgact

SEQ ID NO: 6785010 - DNA, 85 bp, Homo sapiens
catagttgcattcaatgtatcaaccagaaagttcagggaaatacgattctggactagggatgacatgttttctcctgtaactttg

SEQ ID NO: 6785011 - DNA, 70 bp, Homo sapiens
acagttatgcaagtgctttcctcacacttggcatgcagcctaagtgctttgtggagaatttgtattttgt

SEQ ID NO: 6785012 - DNA, 68 bp, Homo sapiens
gggtggggagaagagaacagaagagactcgtttctgcagatgaggcagcccttcccttctccccatct

SEQ ID NO: 6785013 - DNA, 73 bp, Homo sapiens
tttgggatacaggcatgtggactccctaccttggtgggctctgggatttatgtcccattccctgtatcttaga

SEQ ID NO: 6785014 - DNA, 70 bp, Homo sapiens
aggttacccctaaggtctcatgcagcttttagattctcctagatgctgacggttctttagaaagtggctt

SEQ ID NO: 6785015 - DNA, 79 bp, Homo sapiens
gtggacatctacgaaggctgtttgagcaaaaaacctgtacttatgcatctttctgaaacatggtctttgtagtggacac

SEQ ID NO: 6785016 - DNA, 127 bp, Homo sapiens
tctttatgcatttaccatgtgtctggagctgtgctagaggtgaccatgatgtagctactgtccttaagatggtggcagctgagtgtcaggtacagacatacccaagtcattgctgagtgtaaagaga

SEQ ID NO: 6785017 - DNA, 118 bp, Homo sapiens
gccagtgtctggcatgtaggaaagtctcaagtgttagtattattctgcttctatgtaagactgagggataaacactgatgatatggggcttttgaagtcctgaaatgtaaaagctggt

SEQ ID NO: 6785018 - DNA, 71 bp, Homo sapiens
gtacagcaggggctgtgaaatccccatcatcagtgaatgtgcatgtggatcatatgtcctatttcctgtac

SEQ ID NO: 6785019 - DNA, 55 bp, Homo sapiens
tctactctgtgccatgaagacccctcccagctggaggggctgcatgcagagaaga

SEQ ID NO: 6785020 - DNA, 118 bp, Homo sapiens
tggatggggtccctcagtcgagacttatgaccctggttgttaactggccttaagaatttctgtcttaaggccaattaacaaccagggtcataagtctcgactgagggacacttattta

SEQ ID NO: 6785021 - DNA, 107 bp, Homo sapiens
ccttgggtattgtcagagtagaggaggctgggtccagataataaaagactttgagtgtaacagttgctttcatttgtttggaagatgctttttcctcttaccttagg

SEQ ID NO: 6785022 - DNA, 66 bp, Homo sapiens
ccagctttagagaaaacatatttgtggctcaactcaccacaggtgcgggtttgactctgaagtggg

SEQ ID NO: 6785023 - DNA, 55 bp, Homo sapiens
acaacacagagttagatgaatagaattagctatctcaagcttcactgtgtgttgt

SEQ ID NO: 6785024 - DNA, 73 bp, Homo sapiens
gtcagagcctcaggagcatgctgatgccagaaggcaccacttggtggtgattagcagcatccattggcctcac

SEQ ID NO: 6785025 - DNA, 80 bp, Homo sapiens
ccagccccacggcttcagtctcatcatcgcctgggctggagtttatccggtgagatggatgaggccaggaaggggtctgg

SEQ ID NO: 6785026 - DNA, 97 bp, Homo sapiens
tctctggtttatctttcacagcataatgaaatatacttttatcattagagtcaagtagaatcttattaagacttgctgtgcaaggtaactccaggga

SEQ ID NO: 6785027 - DNA, 65 bp, Homo sapiens
tgtctgaggcctgaggccctgggagctgctgggaccactcgggaacccagagccatagccagaca

SEQ ID NO: 6785028 - DNA, 60 bp, Homo sapiens
gacttcttcagatcaggatgcagcaacattttcaaacaggagaacatcctgataaaggtc

SEQ ID NO: 6785029 - DNA, 129 bp, Homo sapiens
ttagcttttcaacagccaggactgaagcaaggaggatacctgggttccatttctccctgctatatggaattattaggcatcaggctgtatatcttgcactcagtaggcccttggttgatactggctaca

SEQ ID NO: 6785030 - DNA, 58 bp, Homo sapiens
tgaattctgaaataaatgtgtcctccaatttgttgggggagcataaactcagatttca

SEQ ID NO: 6785031 - DNA, 64 bp, Homo sapiens
gtttccattgagtattccaagccagaaagccctcgccacagctggatttggaagcttaaataac

SEQ ID NO: 6785032 - DNA, 56 bp, Homo sapiens
tgtctctgtcttccagggctgttcactctacagctagatggctcagcacagagaca

SEQ ID NO: 6785033 - DNA, 72 bp, Homo sapiens
ttctgcccagtttgtgctcaggttgtggagacaaggcttcctacgagatgcacacacagaaatttggcagaa

SEQ ID NO: 6785034 - DNA, 73 bp, Homo sapiens
gttgatcatctccatacggtctcgcagcggctcggggatggtgtccgtgacgttggccgtgcagatgaacagc

SEQ ID NO: 6785035 - DNA, 64 bp, Homo sapiens
tctttttacctcagtgctctgtgctctaatatctcaactcattgcatgcacagaggccaaagga

SEQ ID NO: 6785036 - DNA, 56 bp, Homo sapiens
gggatctgaccaaggagacgtctctcacccactgtgcgtccccttgagcaggtccc

SEQ ID NO: 6785037 - DNA, 86 bp, Homo sapiens
ctagaaagaagctttctgagaaactgctttgtgatgtgtgtattcacttcacagagttaaaagtttcttttgaatcagcactttgg

SEQ ID NO: 6785038 - DNA, 76 bp, Homo sapiens
ggagtattctccaggtgctaagtgtgccttttgctccttttgcaaatagacttgcaggctgccctgggggagctgc

SEQ ID NO: 6785039 - DNA, 62 bp, Homo sapiens
tggcctgctgctggttagatggggcactccctggaatggcccatcactgcagcaaatggcca

SEQ ID NO: 6785040 - DNA, 79 bp, Homo sapiens
ctgccctcctctctgacagccttcattatgcaattcaggcagagtccaccctgcaaagaagggctgaggagcagggcag

SEQ ID NO: 6785041 - DNA, 60 bp, Homo sapiens
tggcagtcgatcatattcagcaggagagaccaggatgtttgctatttgatggattgcaca

SEQ ID NO: 6785042 - DNA, 71 bp, Homo sapiens
gaatatgactcagaagttgcatgctttggctcacattccattggtcagaatttagctccttggtcatattc

SEQ ID NO: 6785043 - DNA, 68 bp, Homo sapiens
caggtgggcttgggagaacactggggcaggctaagtcacacagcctaatttctttctaagtccacttg

SEQ ID NO: 6785044 - DNA, 79 bp, Homo sapiens
gctccttcccctgagccaagcagcttcccagggcgccaccagccccgagggccgaaagctgctttggctcccgcagagc

SEQ ID NO: 6785045 - DNA, 102 bp, Homo sapiens
gtgtatgtgctaggggaatctggcccagtctcagagtgtcagggaagacttccctggaaacctgtcattggatccaggtggtaagtaaggttaaccatacac

SEQ ID NO: 6785046 - DNA, 61 bp, Homo sapiens
agttatttcacagctaagagctaagtaacgacttcgttactgagttaggttggatatcact

SEQ ID NO: 6785047 - DNA, 123 bp, Homo sapiens
gtctgtaaacactttcaagatcagcttaggcgtcctctggtaactgaagcagaaggaagcattttcaaagtgatgccagagcaaaatgcccttaagctttgagtattgaagcagttttcacac

SEQ ID NO: 6785048 - DNA, 120 bp, Homo sapiens
aggtaggaaacaaacttgcaaaaaacgatgacttgaaataagagtgtagacctttattcttggccccatagattagccctatagttttacaagatattttgggcaggatattttctatct

SEQ ID NO: 6785049 - DNA, 90 bp, Homo sapiens
acatttactgtatgagaaaatgtatacttcatagccatatagacaaatatatcagtgcagaatagtgatgcatttgaattagtgagtagt

SEQ ID NO: 6785050 - DNA, 100 bp, Homo sapiens
taccaagacctgagtaccttatgtgggttaacagtttataccagagcagacacagaatgcttggtgcaggttgtggcctgtaggtagtcagtaaatggta

SEQ ID NO: 6785051 - DNA, 88 bp, Homo sapiens
ggtgaagaggttcaggatgtgaggtggtaaacagggacagaaagcctcccagatgtgccccaacccctcatatcttcccatcatcact

SEQ ID NO: 6785052 - DNA, 105 bp, Homo sapiens
cagagtatgtcacgtggagatggggcaagggctcacggtctgctgggactgggataccaccacctagacactgtgtgagtctttgcctctgccacctgtgctctg

SEQ ID NO: 6785053 - DNA, 128 bp, Homo sapiens
gccagctttgttgttgattggatactgatgaatggcattgctgtgctccactgcagcacttcataaataacattgcacagtagatacagtacaatggcaattcctatttttgcagtgattgggctggt

SEQ ID NO: 6785054 - DNA, 83 bp, Homo sapiens
ggagcctagacagagaagcgagtggaggcgctgtcctgggccctcactcctcccagggtgcccaccgcttctgcccagcctcc

SEQ ID NO: 6785055 - DNA, 66 bp, Homo sapiens
gagctgggagctgggatttggatctgcagctgggcgactccgaagcttttgctctttctaatgctc

SEQ ID NO: 6785056 - DNA, 73 bp, Homo sapiens
aattgtttaatatcgtgaagtacttgggactgttactgaaatgtagtaagtactataaaagtgttaaatagtt

SEQ ID NO: 6785057 - DNA, 81 bp, Homo sapiens
taagtgtttgaaataggagttggtgtaaggtctatgcatacgtttaaggccttgatttaaattttgattttcaaggactta

SEQ ID NO: 6785058 - DNA, 70 bp, Homo sapiens
gtccagagagccacggacaggggcaggcttcccccaagcttttctctagaattctggggctgttctgggc

SEQ ID NO: 6785059 - DNA, 78 bp, Homo sapiens
ttggtttactgaattcctggaaatgaactgttttaagagtttgtacatttcagaaattcatggagttcagaatgccaa

SEQ ID NO: 6785060 - DNA, 69 bp, Homo sapiens
tcctttcctgccccatccttgccacggagggccagggccctgcctggcaagaggggctggctctaagga

SEQ ID NO: 6785061 - DNA, 71 bp, Homo sapiens
acactacttgagctgaggctagcagtcacatgattttggctgtctctgacctgaagcttttgaagtaaggt

SEQ ID NO: 6785062 - DNA, 68 bp, Homo sapiens
ggtgatcagccttctgatttctggagttgcaagagtagagtacaggcccattgagaaggggactcacc

SEQ ID NO: 6785063 - DNA, 124 bp, Homo sapiens
tgattatatgattggactgctaactccattggacattctgtaactcactcagccactcatcccccatagaggtgagaggaacaggcagtaggttttattagtcatgttacagtcatagtaaaca

SEQ ID NO: 6785064 - DNA, 76 bp, Homo sapiens
gggtgctttgaggggctggggttgactccaagacccccgcgtccttggagaaagctgcaggctctggacagcatcc

SEQ ID NO: 6785065 - DNA, 57 bp, Homo sapiens
ctgctgttccacctctgaatgctgggccacgtctggcctggcttcgtgcagcagcag

SEQ ID NO: 6785066 - DNA, 64 bp, Homo sapiens
gattctggcttgcatcaacgctcttcaaggacagctccttggaacattgatccaaactggagtc

SEQ ID NO: 6785067 - DNA, 56 bp, Homo sapiens
gcaagtagtgggaaagaagatggattcaactctatgtcatttaaaatgctgcttgc

SEQ ID NO: 6785068 - DNA, 70 bp, Homo sapiens
cttcttgcagtttcactggcattgctctatgtggaagacataaggcattctcatgctgtgaaatcagaag

SEQ ID NO: 6785069 - DNA, 62 bp, Homo sapiens
tcccaaagtcagtgctcagtcgtccttgccctccaggactttggcatctagacattgttgga

SEQ ID NO: 6785070 - DNA, 61 bp, Homo sapiens
ccagctctagccccatgtggctgggggccagctattttcattgtggggttagactccctgg

SEQ ID NO: 6785071 - DNA, 58 bp, Homo sapiens
ggcactgggttgtaggaattaaatgagctaatgtctgtaatttattcagcacagtgtt

SEQ ID NO: 6785072 - DNA, 108 bp, Homo sapiens
tgcaacatacagattttattggattgagctgttcaccaagtagcactattgattaaattctaagataaatgctttgatgaaatcttgaaatcaataaatctatttgca

SEQ ID NO: 6785073 - DNA, 93 bp, Homo sapiens
tcgaagagatctagtgtaaacttatgctgagcccgacagcctagtgtcattgtgctactggccgagcaaagattgcgtaatctatggctttga

SEQ ID NO: 6785074 - DNA, 64 bp, Homo sapiens
tctgagctgctattgcatgccaggctccatgcttggacctgggagtatgcagtggtgagaaaga

SEQ ID NO: 6785075 - DNA, 78 bp, Homo sapiens
tgtgaatcagaatccttggggaatggggcccatacctgtatgggttttgaaaacttccccaggtgattctaatgcaca

SEQ ID NO: 6785076 - DNA, 62 bp, Homo sapiens
ttgtggcttgagggaaataactgatgctttccttgaaaggcatggcattcctcaagcaataa

SEQ ID NO: 6785077 - DNA, 72 bp, Homo sapiens
atactgtaccagacacagtgttcttgccattcttgagcaaacatcagtgatgtctgtgacatgttacagtgt

SEQ ID NO: 6785078 - DNA, 74 bp, Homo sapiens
tacaggtgtaacacagggggctgcacatgtttactaaagtgggtttgaaatgctttcacctgtttgcacccatg

SEQ ID NO: 6785079 - DNA, 58 bp, Homo sapiens
ggtatcatgggttatgacattcttctctgagagagaaggccagaatttcaatggtgcc

SEQ ID NO: 6785080 - DNA, 67 bp, Homo sapiens
aaactctagctactaggataacatctgttggtacctaatatagagatattttacattgctagtgttt

SEQ ID NO: 6785081 - DNA, 86 bp, Homo sapiens
ggggccctaaatcaaggtgagcttcccccacctccgtgcacttgcattctgtgtgggcaggaggccctgccctgaaagggggctcc

SEQ ID NO: 6785082 - DNA, 72 bp, Homo sapiens
tgcactgtaaaagaaggtctttgcaaacgtggtagctttcatctgctgagtgtactttcttcttatactgta

SEQ ID NO: 6785083 - DNA, 103 bp, Homo sapiens
aaaaataatgagctaccaatggttcaattgcttggcagtgtaacatctcagagagaatgggagaatacattgttcatgcatgagaaaaggagtttttattttt

SEQ ID NO: 6785084 - DNA, 56 bp, Homo sapiens
ggggctcagttcggacagcctgtctgcctaacgtagccctgagacgactgagctcc

SEQ ID NO: 6785085 - DNA, 70 bp, Homo sapiens
ggcccccaggcacctcacgtgggtcccacagggcgtgcatccattgtggggcctggcacttttatgggcc

SEQ ID NO: 6785086 - DNA, 56 bp, Homo sapiens
ctcggtgtttctttcagcaattgttagtttcatttgctgagataaagaatgcaggg

SEQ ID NO: 6785087 - DNA, 60 bp, Homo sapiens
tgcttagtctattgtgtgcccagctgttatccattgcctcacacagtagcaattagtgca

SEQ ID NO: 6785088 - DNA, 93 bp, Homo sapiens
gtagtattcaaggaagatcctgagctgcagaaggggttttcctgatgcaaactggcaggaaaaaatctttggctcaaggttagcctatgctat

SEQ ID NO: 6785089 - DNA, 56 bp, Homo sapiens
gaggccagaggcagcaggcctttggagagatctggaagggcctgctctgtggtgtc

SEQ ID NO: 6785090 - DNA, 70 bp, Homo sapiens
tcaactcctaccctagtaatgtgtagtcccaggcctgggagccaggtcatggattaaattattaagttga

SEQ ID NO: 6785091 - DNA, 82 bp, Homo sapiens
ctcccagcaattcaacagctgtctgcctatctctgagctgcaggcagtttagtgagagagcagatacgctgtctagaaggag

SEQ ID NO: 6785092 - DNA, 58 bp, Homo sapiens
ggcttttcgcccttacctgggtcctgcttccagccaggcagagccggggcgagaaggc

SEQ ID NO: 6785093 - DNA, 87 bp, Homo sapiens
tagatttttgaatttcaaaacagttttttaagtctctagggatacaaaatatcccaagggcaagctcttttggcttgcagaagtctg

SEQ ID NO: 6785094 - DNA, 75 bp, Homo sapiens
tctgggagaccttctggtgcagaccatgtcttggctataacttcaagatccagtcaaaattagtaaggtccaaga

SEQ ID NO: 6785095 - DNA, 102 bp, Homo sapiens
cctcattattaccaatctcactgattagatcaatactaaagaagttacgttttttgtatgcttttagtattgttttatagcaggtagaagtttaaggagagg

SEQ ID NO: 6785096 - DNA, 57 bp, Homo sapiens
ttctaccagctactcactgataggtaaagttcaatgagttcatttgtggtggtggaa

SEQ ID NO: 6785097 - DNA, 78 bp, Homo sapiens
gctttctcatgcatgtaggaactcacagatattctcaaagaagacattggagaagaagagctcctcagcagagtgagc

SEQ ID NO: 6785098 - DNA, 122 bp, Homo sapiens
ggagttaacggcagtgactcacttggggcattcacagcaggtcagctgaaactctcccttgctgtatagagaatttagtcctgctgggcatgcgcccaagactgtgagctgaggttgataac

SEQ ID NO: 6785099 - DNA, 78 bp, Homo sapiens
gaaaactctgatgccagtcaaagaagatgacaagaaaaccttgttaaaaatactcatttacttgttaacagagttttt

SEQ ID NO: 6785100 - DNA, 81 bp, Homo sapiens
agggactgacttaccgaagctgcttttgcatgtgttgaagggctgcatgcaggaagggcttggggacgttcacagatttct

SEQ ID NO: 6785101 - DNA, 69 bp, Homo sapiens
ccttgggcctgccccaggcttcagctcatacaaaaggtgcaagggtccatatggggcaggagcctgagg

SEQ ID NO: 6785102 - DNA, 87 bp, Homo sapiens
ggatgaagtgagatccacacatttagggtgcttggcacatacctcatgccaagaaaatgcactgtgagtgttgatggtgtgcgttcc

SEQ ID NO: 6785103 - DNA, 65 bp, Homo sapiens
tgggcacatacagaaagattcttcaaataaaagctaacataaattgaggatttattatgtgctca

SEQ ID NO: 6785104 - DNA, 93 bp, Homo sapiens
ggaagtaaggctggaaaaatgtgctagagccagagtgcctaagacctcaggtgagatcagagagtttggattttaggacatctagtgacttcc

SEQ ID NO: 6785105 - DNA, 66 bp, Homo sapiens
ccaaccagggaatttcttgagggtagaatgtgtttcatgatccctggcaaaatccctggtacatgg

SEQ ID NO: 6785106 - DNA, 63 bp, Homo sapiens
gacactctgtataatctctcctctactcaagtgtgggtgggactgagaatatgatggggtgtc

SEQ ID NO: 6785107 - DNA, 64 bp, Homo sapiens
gcaaagcagaaccctctctatccagcacaccttatcctggctcctggaggatgcttctctttgt

SEQ ID NO: 6785108 - DNA, 93 bp, Homo sapiens
cagcacttttgtgaaatcgtagcttgaatcactggtagcatttggtaagcttcacagagctgatttgattacagtgctgacatcactgtgctg

SEQ ID NO: 6785109 - DNA, 62 bp, Homo sapiens
gctggtaaacttctggtgccattggattagagaaaattccctcacctctgaaagtttccagc

SEQ ID NO: 6785110 - DNA, 72 bp, Homo sapiens
ggtgctggttacacaagtgtgtgcagtttgtaaaaactcaatgagctgtacatttgtgtacacttgtctgct

SEQ ID NO: 6785111 - DNA, 85 bp, Homo sapiens
tgtgtcatttatcatcagaagtcatgggatgcacaattataggacccaggattgagttaatctttgagggataaattgtggcaca

SEQ ID NO: 6785112 - DNA, 90 bp, Homo sapiens
ttatgtcaagcagtagtttgttgaagtaacacacccaaaaggtatgggaacaaatctggacagtgttactatgacagtttctactcataa

SEQ ID NO: 6785113 - DNA, 55 bp, Homo sapiens
ggttgcactagacacatttcaagtgctgaataggcacatatgactagtagctacc

SEQ ID NO: 6785114 - DNA, 73 bp, Homo sapiens
ggagaagcaaatttggggttgttagaggaggcatctagccaggctcttctggagccccaagatctgtacctct

SEQ ID NO: 6785115 - DNA, 59 bp, Homo sapiens
tgatgctgatgcccccatcactgagaacaagaattctctccctgaggttgttagcatta

SEQ ID NO: 6785116 - DNA, 56 bp, Homo sapiens
ttggtgaaagtaaagcaactggtagtactatttctactaaccttaaccatcaccag

SEQ ID NO: 6785117 - DNA, 95 bp, Homo sapiens
tgttgtaaggtaaagctttaaatgagttaataaatgtgaagtgcttagtgcaacactcagcacacagtattagccattgttactactttagaacg

SEQ ID NO: 6785118 - DNA, 57 bp, Homo sapiens
ggcaaatcaaagggccagcagctctctccctgcttctgccaaaggctttgttttgcc

SEQ ID NO: 6785119 - DNA, 67 bp, Homo sapiens
gtgatgaggcaaaggacggcactgccattcctccccttggtgtgccatcactgaacttctgaaacac

SEQ ID NO: 6785120 - DNA, 69 bp, Homo sapiens
gacctaggctgcacctaggatggcttctggaactcgacccaccagcagtcctgtgtccagtcattggtc

SEQ ID NO: 6785121 - DNA, 62 bp, Homo sapiens
ggctgtgaacactcttagcatccattcaaagataggaagaggtgcagggattcttcacagcc

SEQ ID NO: 6785122 - DNA, 62 bp, Homo sapiens
ctcggtagccattggcaatgaagcctcagaaatgttttcaggagtcatgtcaatgtctctag

SEQ ID NO: 6785123 - DNA, 79 bp, Homo sapiens
gaggtggcattaagattctggttgtagtcactgaaggccctaaaacggccctggttcttcagaatctgtgagctatctc

SEQ ID NO: 6785124 - DNA, 56 bp, Homo sapiens
tagcagactttgtgtctggttttgcaaagctaactagacagactaagatctgacta

SEQ ID NO: 6785125 - DNA, 77 bp, Homo sapiens
tcttagtattttcacatatggttgttgattgcagagcaacatgctggcctcagcctacagtgtagagcagactaaga

SEQ ID NO: 6785126 - DNA, 77 bp, Homo sapiens
tgccacaggcttaggagggaggtctgaacaaaaatgcaagaaaaaggaacttctgtcctccaagccacgtcgtggta

SEQ ID NO: 6785127 - DNA, 66 bp, Homo sapiens
gccagtaaatagtgagaaagaaactgaagttaagtctaagttcacagctccttttactcaactggt

SEQ ID NO: 6785128 - DNA, 57 bp, Homo sapiens
tcagcattcctgaagacaagcataaaaagaagtatgcagttatcaagaggatgctga

SEQ ID NO: 6785129 - DNA, 71 bp, Homo sapiens
gggtacctggccaggccccttgcagggcagaacctcaggtgaatgggcctctcagggtctggccgggtccc

SEQ ID NO: 6785130 - DNA, 56 bp, Homo sapiens
catctgcccactcgggtctctggcaatactaaccaggcttcacgatgggtgaggtg

SEQ ID NO: 6785131 - DNA, 69 bp, Homo sapiens
ggttcttcctttccacattcacagctacttctggaatcagaggtcaatgggacttggatctgaagaact

SEQ ID NO: 6785132 - DNA, 67 bp, Homo sapiens
cctgagtgattgcccaagagttaagtctctgctcctggggagcagggatgtgtacttggtaagcagg

SEQ ID NO: 6785133 - DNA, 56 bp, Homo sapiens
tatatcaatgattaatagtgttgtcagtagtgctggcagaagtttgcattggtata

SEQ ID NO: 6785134 - DNA, 59 bp, Homo sapiens
tggccagctttttgtagtgctccttctggctctgggagatgtgctgccagcggctgcca

SEQ ID NO: 6785135 - DNA, 76 bp, Homo sapiens
gcaagaaattatagtcatatacattacatgcttgattctcaggctctgtctgtctgtaatatatataactgtgtgc

SEQ ID NO: 6785136 - DNA, 65 bp, Homo sapiens
tccagtttgcactgtataatagagactacagaaaagacatgttttgtttacagttagaatctgga

SEQ ID NO: 6785137 - DNA, 97 bp, Homo sapiens
ccggagcccaaggattgctgtgtccacagaggagccagcacactgtgacatgccggcatcgtgatctggaattccctgtggtacacgtgggttctgg

SEQ ID NO: 6785138 - DNA, 55 bp, Homo sapiens
agagctgtttattgatgtcacagagaagatgggacgagccttatagacagactct

SEQ ID NO: 6785139 - DNA, 81 bp, Homo sapiens
gaaggtctgtgagatactgtgagggtactggaacagaggggactcttttcctcctcctgcatagatgttcatcaggcagtc

SEQ ID NO: 6785140 - DNA, 56 bp, Homo sapiens
cctttaagaggtgacatttcgaaatgtttgagtataagggtcactttgtttaaagg

SEQ ID NO: 6785141 - DNA, 109 bp, Homo sapiens
ctggacacttgaacttttaaggagcagaggctgtggagcactgttcctggcatggatttggccagcctggggcacttctccaaaccctctctcgctgtccaaggtgcag

SEQ ID NO: 6785142 - DNA, 128 bp, Homo sapiens
ggaagcttgagtcttggtaatggatcaaaagtcttactcaatagctcactgatttctcttttggctgtaagagaagaaaggaagtagcttttagtgtttctcttgggaattctgaaactcaagcttcc

SEQ ID NO: 6785143 - DNA, 73 bp, Homo sapiens
attgtatgatttttttgtcccagagagcctggattaatagaagtccagtttctatcaggcaattatcaacagt

SEQ ID NO: 6785144 - DNA, 77 bp, Homo sapiens
catccttagttatcactaactttattacagctaattttcaatatattatcaggaggaagttagtgtaatgcagggtg

SEQ ID NO: 6785145 - DNA, 73 bp, Homo sapiens
cctgaaatatgcaccccttttccagctgaaactctccacctttataatcagctcagaggtgaaatgttttggg

SEQ ID NO: 6785146 - DNA, 61 bp, Homo sapiens
aaggctgtgtcagaagctccctgggggggttgtgggtccccagttcctggcacgcagcctt

SEQ ID NO: 6785147 - DNA, 62 bp, Homo sapiens
atggtcagggggatctgtgaggtagcgatgcacgctaagggtcaaagatttcccctggaagt

SEQ ID NO: 6785148 - DNA, 130 bp, Homo sapiens
ctagaaacagggagcttctatttcctgaagggcacagaggttgcctccagatcagagaaaccttctgaccaattgtagttctggaactttctgatgcttatcctatagggaatataaacttgtttttaag

SEQ ID NO: 6785149 - DNA, 69 bp, Homo sapiens
tgagcagtgagaaaactaagacattaatgccaaagaaaatcaaagttgatgacttggattcattgccca

SEQ ID NO: 6785150 - DNA, 69 bp, Homo sapiens
gccttgctcatcccccagtgcctcattttataaataaaaggcagtgcagtggagggatagaagcagggt

SEQ ID NO: 6785151 - DNA, 59 bp, Homo sapiens
agagacctgaaagtgtgggcgacctggagctaccaggcccctcagtcatcacggtccct

SEQ ID NO: 6785152 - DNA, 57 bp, Homo sapiens
gataagagcagtgcgagtgtctgctggtgtcatcatcatttgcttgactctcttgtt

SEQ ID NO: 6785153 - DNA, 61 bp, Homo sapiens
gcagccacatggagcaggaggtggggcaggcatttgtcttacctgcctctcctgtgcctgc

SEQ ID NO: 6785154 - DNA, 100 bp, Homo sapiens
tgcctgggaggcaggcctgaggccaccatcttgtccccagatatccagatcttgggggactttggcatggaaaggggccagagcctgcctttcacaggca

SEQ ID NO: 6785155 - DNA, 67 bp, Homo sapiens
ggcaacgtggagagaatagggcaccagacagggttgtttggaaagattaaatcctccaaagttagcc

SEQ ID NO: 6785156 - DNA, 70 bp, Homo sapiens
tgagcagctggttagcaatctaagtgagattcctatgtctgactaagtcagattgctaaccagctgctca

SEQ ID NO: 6785157 - DNA, 79 bp, Homo sapiens
ggcatttacttgtttggggtgttcagggtacttctgggggaacttgagaagccccttcccacccccacccagtgaatct

SEQ ID NO: 6785158 - DNA, 84 bp, Homo sapiens
tatcagggacaaaatgtacttccttatcaaacagagacctaaccaaggacactcataaggcaagctgtcagtttgtcctttata

SEQ ID NO: 6785159 - DNA, 59 bp, Homo sapiens
gtttgttcatggctgatgcttgctcgcagcctcgccctaagcatgcagccagagccaac

SEQ ID NO: 6785160 - DNA, 57 bp, Homo sapiens
ctgaccttgtgatccacttgccttggcctcccaaagtgctgggattacaagcgtgag

SEQ ID NO: 6785161 - DNA, 55 bp, Homo sapiens
tccctggagataacttctgggagaaaccacctcaccagaattttcttccaggtga

SEQ ID NO: 6785162 - DNA, 80 bp, Homo sapiens
gttgaaccatttttaatcttggaacttattattgtagaaaaaaatttttcctgcatatttgcaaggttaggaatgttaat

SEQ ID NO: 6785163 - DNA, 70 bp, Homo sapiens
gaggctgtcctgtggaaagctagccgctgcttcctccatgaaagctgttagaaatccgggggatgacctt

SEQ ID NO: 6785164 - DNA, 57 bp, Homo sapiens
tgagtccagatgggccagcagggaggaaaaccgcagcctggtgccttctgcgattta

SEQ ID NO: 6785165 - DNA, 64 bp, Homo sapiens
agatttcacacataacatgaattgggaattgtacagattttatgcatataaatgtgtgaattct

SEQ ID NO: 6785166 - DNA, 79 bp, Homo sapiens
ggttgttggccagctttctcagaggcttctaggcagatgtgtcttcatgtctccttgggaaggcttcagtcgtgtggct

SEQ ID NO: 6785167 - DNA, 62 bp, Homo sapiens
ctagaaagcagcttccctggctcctggtgcatcgcatgaggagtggcagggctgctccctag

SEQ ID NO: 6785168 - DNA, 58 bp, Homo sapiens
gagacagagaggtactcaacatttgcagaatgaatgaatgagaaatggtctctgtctt

SEQ ID NO: 6785169 - DNA, 73 bp, Homo sapiens
cccctgggtgttgcagggtctgatggagtaaggggggcctctccgaggcttctgggcacctgaacaggagggg

SEQ ID NO: 6785170 - DNA, 62 bp, Homo sapiens
aggagatgtatttgtttcttgagataattttgagattattcagagaatggtatgcttttcct

SEQ ID NO: 6785171 - DNA, 79 bp, Homo sapiens
gaggtaacatgactcaaccaaggttaagacaccaccaaaattgtgtctcaaagtctcttggctggtttcacattacctc

SEQ ID NO: 6785172 - DNA, 84 bp, Homo sapiens
accccaagaatattaggattttatcttgccaatgaagctgtttaacaatgctatttggaaatgataaagtactgttcctggggt

SEQ ID NO: 6785173 - DNA, 116 bp, Homo sapiens
ccaaatctgtgggtgactagatgtcctgtgtaagccaggacaatcctgagaaatcatggtcattgtcaaccgtggcctacacttgaaaggtatggcatgtccccattttcccttgg

SEQ ID NO: 6785174 - DNA, 59 bp, Homo sapiens
gtgtgtgccatcaagagctttcacacactgatggtgggagtttggtttggtacaaccac

SEQ ID NO: 6785175 - DNA, 106 bp, Homo sapiens
agaagtgagggcaagggctgtggatcagaggacttcccactcatctggccactggactctgccctgaggaggtgaagtctccatcattcccctctccttcccttct

SEQ ID NO: 6785176 - DNA, 85 bp, Homo sapiens
cctgcctagaccccccactgttgcctcaaatatcaaaccaatgttgtcttgtggggcagacggtggcaggtttggggtctgcagg

SEQ ID NO: 6785177 - DNA, 105 bp, Homo sapiens
atcacaaatccaaattctttcagaaaacttatcatcagttaaattactaataggaacaaagtgaggttgcgattagttttttatgaagtagtttgggtgggtgat

SEQ ID NO: 6785178 - DNA, 63 bp, Homo sapiens
tgatctacgacttcatgaatttatttggctcctcctcggggccagggtgagtgtcatgggtta

SEQ ID NO: 6785179 - DNA, 63 bp, Homo sapiens
ttcaccatgtatttattgagtgctgtctagcactatgggaggcactgaagctacaatggtgag

SEQ ID NO: 6785180 - DNA, 79 bp, Homo sapiens
cagtggccctccccaccctggctctctggccaccgcaggtgcctcctgggagcagagcaggggtggagaaggcagcctg

SEQ ID NO: 6785181 - DNA, 64 bp, Homo sapiens
ggctgccctgatatgatttagaacatgaacaccatgacctaaatgttctcagagggtaatagtc

SEQ ID NO: 6785182 - DNA, 91 bp, Homo sapiens
attcctgaagttgtatcagatggccttgatagcctaaaacaaacctgaaacaagtaatgtcaattatcaaggttcatttaattacagggat

SEQ ID NO: 6785183 - DNA, 67 bp, Homo sapiens
gtaccagttgcttaaacaagacagtcatttctttactacacaaatgatgtctggaggcatgctgtac

SEQ ID NO: 6785184 - DNA, 79 bp, Homo sapiens
tggccattttcatttttccctggacagccttgcctggggtactgcctgctgccggtgagggttgctaggaaaccggcca

SEQ ID NO: 6785185 - DNA, 57 bp, Homo sapiens
cctgtccccaggggtgtcatacaggtcctggaagcctgccatctctgtgggaccagg

SEQ ID NO: 6785186 - DNA, 123 bp, Homo sapiens
tccttaaatgttctcttggtgctctctcttagccacttaaacctatttctgactgtttctgacaactgtcactaatagggggagcatagggagagaagagaagagccggagaggaaaagagga

SEQ ID NO: 6785187 - DNA, 70 bp, Homo sapiens
cactttgggaggccaaggcgggtggatcagctgacttcaggagttcaagaccagcctggccaacatagtg

SEQ ID NO: 6785188 - DNA, 66 bp, Homo sapiens
ggtaacaggtgaaaaagcaaccatattcgaatgaatgtggactcttgtatttttcactagattatc

SEQ ID NO: 6785189 - DNA, 64 bp, Homo sapiens
gcagctcccaagcagagaggtcaactaataagagatagtctcttcccttttttatgctagctgt

SEQ ID NO: 6785190 - DNA, 87 bp, Homo sapiens
ttcctatttttgctggaggagcatggactggagtcagatctacttggcattgaatcctagttctgtttcttcatcaacaaatatgag

SEQ ID NO: 6785191 - DNA, 115 bp, Homo sapiens
cagcttcaggtatttccctggtatttcttctaccgtggaggtcaacttaagtccctattcactagggggtgccagtcacgtataagaaaatcatagatgagataaccttcagctg

SEQ ID NO: 6785192 - DNA, 55 bp, Homo sapiens
ttcaggagctagggatgtgaaagtagaaagctgagtatcttttttaactcctgag

SEQ ID NO: 6785193 - DNA, 67 bp, Homo sapiens
atcgctttaagaatgtgtaaaataactttgcatttgcagtagttgaatgttacagttctaaagagat

SEQ ID NO: 6785194 - DNA, 110 bp, Homo sapiens
ttctgtattaataaaggcatagaggcataaaagtgtttaacatgttcaagaaacataatatggtttgtgttagatgtgttggcatatgtgcttgttgtgtacttgcaggg

SEQ ID NO: 6785195 - DNA, 83 bp, Homo sapiens
ttattctttctcccttggccatgagagcagtgcaactcaaacaggagctgctccttcagccaagtccttcagtaaagatataa

SEQ ID NO: 6785196 - DNA, 74 bp, Homo sapiens
ggggtgactcccagctcctgggccccacagagagtccatgttctcagtgcagtggctgagctggaggacgccct

SEQ ID NO: 6785197 - DNA, 106 bp, Homo sapiens
ggcggcggggagcccccggcgcgccgcgcaccatcctccgccgggcaccgcggcggcgcctctgccaagggggctgcgggtctgggccgggggcgccgccgccgcc

SEQ ID NO: 6785198 - DNA, 72 bp, Homo sapiens
ggtgcactggtacactgaatggcgttcaaagttggtgaatttgctggaaatgccataaaggtaccactggcc

SEQ ID NO: 6785199 - DNA, 63 bp, Homo sapiens
gttccccttgtgttgttgcccatgtgttgctaccatggtaatcctgctcagtacgagaggaac

SEQ ID NO: 6785200 - DNA, 91 bp, Homo sapiens
gggagctagggaaagaggtggcttcctgtctttctgctggtggaggcaagactctgagacatgaaccatcatcatcagcccgcagccttcc

SEQ ID NO: 6785201 - DNA, 71 bp, Homo sapiens
gacaattatgggagttaggattctatctgcccagataccaaaagacagaggccctctctctcctgatggtt

SEQ ID NO: 6785202 - DNA, 79 bp, Homo sapiens
acagcttgcacaagggaactcacttaaaaggagaaattgtgtagttttaaaatatattttgtgtaaaataacttgctgt

SEQ ID NO: 6785203 - DNA, 70 bp, Homo sapiens
ctgttgccaggctggagtgcaatgacatgatctcggctcactgcaacctccacctcccaggttcaagcag

SEQ ID NO: 6785204 - DNA, 66 bp, Homo sapiens
gaattagagacacattgcctgtaggtaatctacaagtgcaactaaatgtgtatctactcaaaattc

SEQ ID NO: 6785205 - DNA, 74 bp, Homo sapiens
gggcttcccggcgctgggaggtgggtctgcttttacagagacctccgtgtacacctcccagcgccatttgcacc

SEQ ID NO: 6785206 - DNA, 58 bp, Homo sapiens
ttggatttcaacagagctttcctgcatatttgccaaaaggccactgaagaaatcacaa

SEQ ID NO: 6785207 - DNA, 96 bp, Homo sapiens
tcccctggggaggatgcaaaattacattgagaaccactgcttagagcaattttgagcagtggttctcaatgcaattttgagaaccactcagtggga

SEQ ID NO: 6785208 - DNA, 56 bp, Homo sapiens
tctatttctgggtttgtgtggttaagtataatcacatatatgcaccaagacataga

SEQ ID NO: 6785209 - DNA, 65 bp, Homo sapiens
gctacagagccagcagtggggacagggaggagcacacacccttccacacttgtatggttctaggc

SEQ ID NO: 6785210 - DNA, 56 bp, Homo sapiens
tttccttctcagggagcttcaatgggaaaggtctcgaaagcttcaggaggagcaga

SEQ ID NO: 6785211 - DNA, 122 bp, Homo sapiens
gggggcgcccggcccgcggctccccggtcagagcggtagcaccgcgagacttggggctgcggacggcgggacccccaagttgggcgccggcgactggcgggggcagagggccgggcgctccc

SEQ ID NO: 6785212 - DNA, 95 bp, Homo sapiens
gtgtttaatctatgcccagcacagtgttaggtaatttgatgaaagtatttcatttaatcaccaagtgaccctgtgaaggatgtattattaaacac

SEQ ID NO: 6785213 - DNA, 76 bp, Homo sapiens
cagcacctgggccttctcaatgcactggatgctcaaggtctccagggatacaggtgagagtgatggtccggggttg

SEQ ID NO: 6785214 - DNA, 60 bp, Homo sapiens
ccacttccagcacagtaggaaatctgtacacagtacattctcaaatatttgtggaagtgg

SEQ ID NO: 6785215 - DNA, 62 bp, Homo sapiens
aaggaagttagttcttggcaaaggcatttcatgcagtgtactttgtcattctaaccttcctt

SEQ ID NO: 6785216 - DNA, 57 bp, Homo sapiens
gccaaggggttcaaaatgtataatgcgagtcaagaagcagtttgcatttctcttggt

SEQ ID NO: 6785217 - DNA, 69 bp, Homo sapiens
ttggggaatgaacaatctgttgacttctgttatttggaatgaagacatgttgtttgttgaattctctgg

SEQ ID NO: 6785218 - DNA, 72 bp, Homo sapiens
gggagaaagtctgctttctggatggcagagacgaccttcacgccatgcacaccagcaggcagacacttcccc

SEQ ID NO: 6785219 - DNA, 86 bp, Homo sapiens
tttttcctcttgtatcactgttcatgtgtagtcaccatgtgtattaggtactcatgcaatgagtcaggaggcatttccaggaagaa

SEQ ID NO: 6785220 - DNA, 57 bp, Homo sapiens
gggctagggaaggcaggcttgggagcagcatcctcatcagcctcagtctgtggaccc

SEQ ID NO: 6785221 - DNA, 116 bp, Homo sapiens
ctaactcagggtgtgggcctgggcaacaatcaaggaaacctgttttcttctcatctaggcctgaaactagaggggaaaaaggtcttgtttgtggcccaacccaacatcccaagtag

SEQ ID NO: 6785222 - DNA, 56 bp, Homo sapiens
gtgatgtgtgaaggtctgcaggcagggattccagcctgctgggccatcttgcatgc

SEQ ID NO: 6785223 - DNA, 72 bp, Homo sapiens
cagacactgtgtacacatactattcaaagagatggagctagtcattgctgttgaaaagtgtgtgtgtgtctg

SEQ ID NO: 6785224 - DNA, 130 bp, Homo sapiens
aattgacatctatttatactctcgttgtcaatggtgtgatggtaaacatttaacaactagttctcttgaaataaaagccctatttttttatgtttgccaatttccatggtgtaaatgctcatagttgatt

SEQ ID NO: 6785225 - DNA, 81 bp, Homo sapiens
ccacactattgtggacattttttgtcagtagacaaaatttgtaactactgatgtacaaaatgatgtctgtaattcttgtgg

SEQ ID NO: 6785226 - DNA, 61 bp, Homo sapiens
cccaccctttttgtggaggcctggcgcttacaacgctgcaggtggctccacgaggggtggg

SEQ ID NO: 6785227 - DNA, 104 bp, Homo sapiens
gaactttctttgtcaacataagattatacttatttatgatgtggctaaagaaatgataagaagtcacagaaataagatagttattgcttgcataataaaagttc

SEQ ID NO: 6785228 - DNA, 70 bp, Homo sapiens
gcacagtgaaaattctattgatttctgttgactttcaaaagtctagtgaaagacaatgtgattattgtgc

SEQ ID NO: 6785229 - DNA, 70 bp, Homo sapiens
caccttgggaggctgaggcaggtggatcacctgaggtcaggagttcgagaccagcctggccaacaaggtg

SEQ ID NO: 6785230 - DNA, 55 bp, Homo sapiens
gtgatatcttacaattctcttttaggacagagtccagacaggagagaagagtcac

SEQ ID NO: 6785231 - DNA, 74 bp, Homo sapiens
atttccactaaaagtatttatggctatgtaaaatgaatttgtagttttaagccatttgtatgcttcagggaagt

SEQ ID NO: 6785232 - DNA, 64 bp, Homo sapiens
tccaaaccaggacaattttgaaagtaaaagaagttgcttttaataatttaactggaaccaggga

SEQ ID NO: 6785233 - DNA, 104 bp, Homo sapiens
aagtttattaagttgcaatctcagttttgaaaaggtaagctaggcaaactattcatctgtcagtagcattcgcagctgagtaattgccctattcttaaatactt

SEQ ID NO: 6785234 - DNA, 55 bp, Homo sapiens
gtgtagtttatagtttgagaagggtttttctcctttgaaaatttaagtgctacac

SEQ ID NO: 6785235 - DNA, 79 bp, Homo sapiens
ctgctttttaaaattgtagtttaaacttcagtgacacgttttgccgtttgctaatttaaagctatttttaaaagagcag

SEQ ID NO: 6785236 - DNA, 63 bp, Homo sapiens
cagcctcacaccatcttaaggggacttcttaagcacttgattctcttagatgatgtgttcctg

SEQ ID NO: 6785237 - DNA, 90 bp, Homo sapiens
accagcccacagctccggccgcggtgcccagcgctggagaacggaagtactagggggtgggcggagcggaagccggaagtgtgggtgggt

SEQ ID NO: 6785238 - DNA, 99 bp, Homo sapiens
gaggcacgagaatcgcttgaacctgagaggtggaggttgcagtgagctgagatcgtgccactgcactctagccttggtgacacagcgagactctgtctc

SEQ ID NO: 6785239 - DNA, 55 bp, Homo sapiens
cacagttgctgccaacttggcctaaacacagagcccagtggtgctggcatctgtg

SEQ ID NO: 6785240 - DNA, 58 bp, Homo sapiens
ccctctcctggctgcatggagcacctccaccacggtgcaccccgcttgagagagaggg

SEQ ID NO: 6785241 - DNA, 74 bp, Homo sapiens
gcaggacagcaggatgcttagacaggagggcatttgcaatccccctcagctcctccacagcatcctgctcctgc

SEQ ID NO: 6785242 - DNA, 93 bp, Homo sapiens
aagcctgggccaatgcccactcaatgtgtccctcaagcatttccatgacactaataatggcatatgttacattgagaggtggttgcctggttt

SEQ ID NO: 6785243 - DNA, 78 bp, Homo sapiens
tttagaagtccagtaatttgtttttctgaaattgaatatatttgtttactgtctcagagagacaaatatatttctaga

SEQ ID NO: 6785244 - DNA, 82 bp, Homo sapiens
gggagcttggcaggcctggtttacatggtagaaaacaggggcccctgggcctgctccaagccagccctgcagcagagcttct

SEQ ID NO: 6785245 - DNA, 130 bp, Homo sapiens
tatttttacttttattttttcagtaatatgagaagctgttggagaatttttggttgaagagtaacatgttctaactcctgctttaaaaggttcactctggcttctgtgttgggaattaggagtagaagag

SEQ ID NO: 6785246 - DNA, 82 bp, Homo sapiens
ttcctaacaaacatctaccagaattgctataaatctgcctagttccatgttttggcagtgctggaagattaaaagttggaag

SEQ ID NO: 6785247 - DNA, 83 bp, Homo sapiens
gtgtgtgtgtgtgtgtatgtgtttgtgttgcagctcttgtgtttaagggcttcaatagcagaggcgtgaatcaaattcatcat

SEQ ID NO: 6785248 - DNA, 58 bp, Homo sapiens
tggtgggagtgacgttgccttctatgcatagcagtgttgcaaagtttagctcccacta

SEQ ID NO: 6785249 - DNA, 63 bp, Homo sapiens
tttattgtgtactacagtatgccacactgttaaatattgggcatgtagaagtgacatgatgaa

SEQ ID NO: 6785250 - DNA, 59 bp, Homo sapiens
ggaggggctctttaatagtaacactgaatagcaaccagtactagcaactgggctccttc

SEQ ID NO: 6785251 - DNA, 75 bp, Homo sapiens
gctccccattatactcccacatcactgacttttgtagattatctgatcagtcagatgatgtgaggagtgggtggt

SEQ ID NO: 6785252 - DNA, 94 bp, Homo sapiens
gtgtatatgtgcgtggatgtgcatgcatgtgagcatgcatatgagtctgtctctgtgtgtgcacatgtgtgcctcctccaagccttcctatcac

SEQ ID NO: 6785253 - DNA, 56 bp, Homo sapiens
tcttagaattgaagtcagagggtcatctactccggtctgtaagctcagtcctaaga

SEQ ID NO: 6785254 - DNA, 59 bp, Homo sapiens
cctctggctcacagcaccaacttctccaagagacttaaggctggggtgtggggcggagg

SEQ ID NO: 6785255 - DNA, 78 bp, Homo sapiens
tagtgcctatgtttcatatatagtaactgaaattcatactcttcatggaatttcaaactatgtgtcaggcaggtgcta

SEQ ID NO: 6785256 - DNA, 56 bp, Homo sapiens
ctaccttcaggctgccctttgatccctttaagggatcaaagtccatcagaaggtag

SEQ ID NO: 6785257 - DNA, 75 bp, Homo sapiens
tgataattgctgggaggatgtgtgttctgtggactgccatagcacatgggaatgcattttgcccaggcaaggtca

SEQ ID NO: 6785258 - DNA, 69 bp, Homo sapiens
ccaggagggagaagagggcagagctcaggtccgtctgacaccagagccctgcccacttgtctgagctgg

SEQ ID NO: 6785259 - DNA, 58 bp, Homo sapiens
ggcttcctgaatcagaaactctgggggtgagacccagcaatctgtgtttcagcaagcc

SEQ ID NO: 6785260 - DNA, 129 bp, Homo sapiens
cttgctaggccccaaatacatccagcacctgcagaccctcaagtgtgatctgaaaaagatgccactcatatctttcattctagtctgaggttttgtctgagagggcatgtccatgtggccttgtgcagg

SEQ ID NO: 6785261 - DNA, 57 bp, Homo sapiens
gtactctgttgatttcaagtttctctttctctgaaatttgagaattggtcagagtgc

SEQ ID NO: 6785262 - DNA, 122 bp, Homo sapiens
gaacttctgccagagctcttctgaatccccctggagctcttctgagtgtgctactatttccttaatggcacttctcactcagatcagctctgttgggatgacaaagaattctgctgaggttt

SEQ ID NO: 6785263 - DNA, 59 bp, Homo sapiens
ccaaagttcatagtttacattaaggttcactcttgatgttgtacattctatgggtttgg

SEQ ID NO: 6785264 - DNA, 75 bp, Homo sapiens
ccctctttgcctgtctgcagggctgtcattgtgtgattcataactcaatattaaccacagatgagggaggagtgg

SEQ ID NO: 6785265 - DNA, 72 bp, Homo sapiens
catgtgaatctgaactgtttctgatcctctttcctgattgtgttaggacagaacacattttcagagtcaatg

SEQ ID NO: 6785266 - DNA, 61 bp, Homo sapiens
gttgatcattcttccagagtgaactttaagaaactcattctcacaggctggaatgatgaat

SEQ ID NO: 6785267 - DNA, 102 bp, Homo sapiens
taccatcccctctcccagagttgtggtgagttctttgtcatctctggagtaccgcttgcccaggagttgaagggctgacttttactggaggtggagatggta

SEQ ID NO: 6785268 - DNA, 129 bp, Homo sapiens
ttattctctcatcattatcaacaactactaggctttgttgccttgactccagaggcaaaaatcttatctcccaacaatgtctcttaagttaagtgtaattcattatttgatattcttgtttcaaaatgg

SEQ ID NO: 6785269 - DNA, 55 bp, Homo sapiens
gggggaggtgaatgcaataagggtggagatgcactctgtggtatggccatcttcc

SEQ ID NO: 6785270 - DNA, 69 bp, Homo sapiens
ggacagagtggggagtaggaggggaacagagaggacatcctctctggctctccagtgctcttagtgtct

SEQ ID NO: 6785271 - DNA, 66 bp, Homo sapiens
tctttatctgcctttctactttgtgatgctttctaatacagtattagggccaaaggcaggaagaga

SEQ ID NO: 6785272 - DNA, 77 bp, Homo sapiens
ggggcgggtcagagggagccagagttgggagctctgaagcagaggaccctgtgactggctaccttggacagagcttc

SEQ ID NO: 6785273 - DNA, 90 bp, Homo sapiens
gtgtttcaggctggccacagcaatgctgtgatgtcacgttccagttcctgtgactcatggaggctgctgggctccaggacttgaaaatgc

SEQ ID NO: 6785274 - DNA, 66 bp, Homo sapiens
tcattgatggtgaagggcagaatgcccagacacagttgctggtatttaagacttcactcctagtga

SEQ ID NO: 6785275 - DNA, 71 bp, Homo sapiens
gtgcccaaacctggctgttgataattaataatagttaacagtatcaacaatagccagtgtttattgagcac

SEQ ID NO: 6785276 - DNA, 65 bp, Homo sapiens
ttggagaaagggcctttcaaaggtgattaagttaaaatgaagccttagaatgggccctaatccaa

SEQ ID NO: 6785277 - DNA, 64 bp, Homo sapiens
gaatgacctcagagcacccagaacagaatttatcaggcccttctacacacctctgaggacattt

SEQ ID NO: 6785278 - DNA, 61 bp, Homo sapiens
gacaaaactgagatcacactgttagaatatagctgattgagggtttggtcccaggtttgtc

SEQ ID NO: 6785279 - DNA, 57 bp, Homo sapiens
gctggttcacctggctcctcccaggtcaagctgggaacacgaaagaaggaagccagc

SEQ ID NO: 6785280 - DNA, 70 bp, Homo sapiens
catctgcaagagccccatttccatataaggtcagattctgaggtacaggaggttggggctacagcatatg

SEQ ID NO: 6785281 - DNA, 99 bp, Homo sapiens
ggtttgtggcttcactgttcctgtagggtgcatgacaagatcccttctcttgaggaaggacaaaattgatcaccctagcagcagtgatgcatagaaacc

SEQ ID NO: 6785282 - DNA, 81 bp, Homo sapiens
caagctagccttcccgagatggcccaagacgcctcctcctggggtctggggtgaaggccgtccttggggactgggagcctg

SEQ ID NO: 6785283 - DNA, 83 bp, Homo sapiens
aagtggtttgagtcagccctttacttcctcttttcctgatgggcagcagggcccagtggagagctgagcttacaccccaactt

SEQ ID NO: 6785284 - DNA, 85 bp, Homo sapiens
cattaagtagctggtgtgaccttcatgctaagttggatacagcagagtttaaacaaatgaaatagtcaatctaccagacttactg

SEQ ID NO: 6785285 - DNA, 57 bp, Homo sapiens
gaagataactttaaaaagtggccatactgtttgaggtctgctttttagtgcatcttc

SEQ ID NO: 6785286 - DNA, 59 bp, Homo sapiens
tgccatcacacggaacccgattgtgccatctggcaacaatcggatttcgtgtgatggca

SEQ ID NO: 6785287 - DNA, 60 bp, Homo sapiens
gagctggtcagtttcaggagagtgcacagagcaggacctcgtgggactggcctagagctc

SEQ ID NO: 6785288 - DNA, 55 bp, Homo sapiens
aggttatgaagtggtagagctgagatctggaccagctctgatgactttacaactt

SEQ ID NO: 6785289 - DNA, 69 bp, Homo sapiens
ttatgtattatctgtgactgctttgcactacaatgtcagagctgagtagttgctgcagagaatacatgg

SEQ ID NO: 6785290 - DNA, 105 bp, Homo sapiens
tctggagagacctgtgatcgtcatgccacagcttcccagaggggctatccaaagtcttctggctggcagtgatggtgtgcaccatgatcacgagtccttccacga

SEQ ID NO: 6785291 - DNA, 64 bp, Homo sapiens
tgtaaattgtcctccccctggtatttatgacctacagtttcccaataccagagtacagtttatg

SEQ ID NO: 6785292 - DNA, 68 bp, Homo sapiens
ggatgggatagggctcttgctggccaggtgagcccctgcacttcctggctgagcccactatcttggcc

SEQ ID NO: 6785293 - DNA, 59 bp, Homo sapiens
gagtcttgttaagattttggaataataatattaatatttcagtttttataatagggctc

SEQ ID NO: 6785294 - DNA, 71 bp, Homo sapiens
agaggagcctcagtttgcagcctctgccccgagaatgcagttgagtggggactggctggaatgggcttcct

SEQ ID NO: 6785295 - DNA, 60 bp, Homo sapiens
ccagagcctgagtccaacaggctgaccagtgaggggctaagtggatcagtcaggacctgg

SEQ ID NO: 6785296 - DNA, 72 bp, Homo sapiens
ggagtctgcgggtgaagctcctgcaggggcccgcgatacagcagggcagcaggagctcgctccactggctcc

SEQ ID NO: 6785297 - DNA, 100 bp, Homo sapiens
taccagagacaccacatgggaacaggcatgatcataggagtttatactgtactccaattagttgaaaattatgaacatgcatgttacatggtagctggta

SEQ ID NO: 6785298 - DNA, 78 bp, Homo sapiens
tgaagtctgaaggcaatctgctgacagaattctctcttgcttggggaaggtcagccctttgttctgttcaggtcttca

SEQ ID NO: 6785299 - DNA, 66 bp, Homo sapiens
tcagaggcagctgatgttctgtctaagctttgtacatgtggtgtgatttgtcagcagtgctactga

SEQ ID NO: 6785300 - DNA, 76 bp, Homo sapiens
agcgtcactggagcttctaaggaggagtccgaggcagcttctgacttcctcctctgaagcacagtggaaaaacact

SEQ ID NO: 6785301 - DNA, 59 bp, Homo sapiens
tagtttccttggctattaggcagaaatcctcgcatagccttttagcacaagtgacattg

SEQ ID NO: 6785302 - DNA, 61 bp, Homo sapiens
tttgtgaagggaacagaagtgtctgactggacacttgaaagaagtttccttaaaatacgaa

SEQ ID NO: 6785303 - DNA, 97 bp, Homo sapiens
gtacagctcagagttggcccctcattagtggcaagggagctggggtatttatatactggctcccatcagtcattggttgagggttgctctgaggtgc

SEQ ID NO: 6785304 - DNA, 74 bp, Homo sapiens
gttactctcactttctgcttttactcaatcctgcatttatgtacttgcaagaaattaggaagtgaacatgtgat

SEQ ID NO: 6785305 - DNA, 70 bp, Homo sapiens
gcaggagtgacatatgcacacctttatttttcagagacataatctgacagtagtgcatgggttggattgc

SEQ ID NO: 6785306 - DNA, 81 bp, Homo sapiens
tttcttttctttaggcattgtgtagctctgagagctttctatatatctggcttctatggtgacacagtgacaggaaagaga

SEQ ID NO: 6785307 - DNA, 66 bp, Homo sapiens
tgtatacctatttgtgtgtgagggtatagtgtgtgcatacacgctatatttatgcataggtacaca

SEQ ID NO: 6785308 - DNA, 129 bp, Homo sapiens
ttataggtaactgtgggtcatcacctttgagctgtcagtctaccatggaggattgtgctctgttctgggcaccccatttaaagtggtagattggcagtagggaagatacacagatgtggcattctgtga

SEQ ID NO: 6785309 - DNA, 74 bp, Homo sapiens
aggatattttggggggttgaggagtagatagtagtctaaatatgcttactaattggcttacccaaaggaaacct

SEQ ID NO: 6785310 - DNA, 72 bp, Homo sapiens
cccagggcagaggctgggaggctttcaggccacagatttccaccatttgccaagcttccctgctctccaggg

SEQ ID NO: 6785311 - DNA, 72 bp, Homo sapiens
ctggcaagtggttgggatggatttgccccgagccagtcacactctctttgcttccattgtgaccactgtcag

SEQ ID NO: 6785312 - DNA, 59 bp, Homo sapiens
ctatagatgtcattttacatccactgcatggtgggcactgaatttcttggcatctttgg

SEQ ID NO: 6785313 - DNA, 79 bp, Homo sapiens
gtgtgattctcaaggcatgaaaggagtgagtgttgagttataattacgatttatttcttcctttaatgtggaattgtac

SEQ ID NO: 6785314 - DNA, 64 bp, Homo sapiens
acattcttcttgtgaatttactacatgggtattttctacacttgatttccaataaggagaatgt

SEQ ID NO: 6785315 - DNA, 62 bp, Homo sapiens
agataaaatgattttctggatcttcgagttaatattgataatgcagctatatcattttgttt

SEQ ID NO: 6785316 - DNA, 55 bp, Homo sapiens
agggagctgactggctgccattttgaatcacaacaaaaacttgccagagctctct

SEQ ID NO: 6785317 - DNA, 67 bp, Homo sapiens
ggcagacctgtagacatttgcctgtggcataaatgactttagaatagagtgtctaatccaggctgtc

SEQ ID NO: 6785318 - DNA, 60 bp, Homo sapiens
ttggagggaagcagatcataccagaccacgaatggccttatgtgtcctgttttatactaa

SEQ ID NO: 6785319 - DNA, 89 bp, Homo sapiens
gtatttcacccctgggaagcaagtcagggcacaatggcataaaattgagaactctgtatgtccagcttgctttccaatctgataaatgc

SEQ ID NO: 6785320 - DNA, 83 bp, Homo sapiens
gggttagtttgtagagctcctggcttctgaaatcgtggttttgaaggacgattatgactttggataggcaggaaaggtaatcc

SEQ ID NO: 6785321 - DNA, 91 bp, Homo sapiens
ggttgcctaagatagctgtatgaagaagttctgtgaaatgatatgtactgcttcgttgcatagcatttttataatcttctgactggcaact

SEQ ID NO: 6785322 - DNA, 69 bp, Homo sapiens
ctgctggaggattaaacaagtcagcctctccactaattgagctttgacttcattggtcttttctagcag

SEQ ID NO: 6785323 - DNA, 67 bp, Homo sapiens
gtcagagccccacatgggcgtaatgtccatggttggaaccgtggctccctgcctattgtggctctgc

SEQ ID NO: 6785324 - DNA, 60 bp, Homo sapiens
caccatgcctggctaatttttttgtagggatagagttttgccatgttgcccaggctggtg

SEQ ID NO: 6785325 - DNA, 58 bp, Homo sapiens
aagcccaatgtacaaataactccaatgtttatcaacagtagagaggtacatttggttt

SEQ ID NO: 6785326 - DNA, 64 bp, Homo sapiens
ggctacaaatgctccagcagttctctctgctctcagaattgggcaggtttgctatggagcagcc

SEQ ID NO: 6785327 - DNA, 91 bp, Homo sapiens
ggaatgagaagtcatcaaagtgctaattgaccatttgatatagcttttgctatggtacaatgtgtttgttaggtgagagaattcttattcc

SEQ ID NO: 6785328 - DNA, 83 bp, Homo sapiens
ctcaatggctattagtaatgtgctcaagtccctgtgtgttattacgccaacacacaaattgtaggataattgctggcactgag

SEQ ID NO: 6785329 - DNA, 87 bp, Homo sapiens
ctcctcccctagacacacagggctgcgcctgaccccaggccatcagcaggcggaggcagggggcagtgggtggcagtgagggaggag

SEQ ID NO: 6785330 - DNA, 57 bp, Homo sapiens
atcagagccataggggcagtaaactatagtttctctgctgtgaaacatggttttggt

SEQ ID NO: 6785331 - DNA, 80 bp, Homo sapiens
tgcatttgcatgttatccatggccaatcaaatacaaacagggctttatgtttgtggaagccggtgggaagcagagatgca

SEQ ID NO: 6785332 - DNA, 66 bp, Homo sapiens
tgaataccatccatatttcactccatttgttcttgacaaatggtgaagcttcatgggtgtttttta

SEQ ID NO: 6785333 - DNA, 105 bp, Homo sapiens
gccgggcatagtggcacatgcttgtaatctcagctactcaggaaagtgaggcatgagaatcatttgaacctgggtggcagaggttgcagtgagccgagatccggc

SEQ ID NO: 6785334 - DNA, 78 bp, Homo sapiens
tctttacttttcacaatcctgtaagagtcaggcacagatactttgcttcagacctgaaaggaaaaagagaagcaaaga

SEQ ID NO: 6785335 - DNA, 61 bp, Homo sapiens
gcacatattgtagttcaccaggatgactttgaagtttttctgaaatagaacaatatgatgt

SEQ ID NO: 6785336 - DNA, 58 bp, Homo sapiens
gtctgttttggtggtcactgtttctttagcacctagcaagcagtccaaaagggcagac

SEQ ID NO: 6785337 - DNA, 59 bp, Homo sapiens
tgagatggagttctgctcttgttgcccagactggagtgcaatggcacaatctccactca

SEQ ID NO: 6785338 - DNA, 59 bp, Homo sapiens
ggcctgtggcaaggtgagaatgacaaatcaatatcattgtcatagtagaagccaaggtc

SEQ ID NO: 6785339 - DNA, 81 bp, Homo sapiens
cctggtttgccaactgcagccagactttgtgcgaaattgtattttaccactttttaaaaggttatgagctgtcaaacctgg

SEQ ID NO: 6785340 - DNA, 64 bp, Homo sapiens
cactctgtccccaggagcccagtttcactgattatcagaagcagctttcctctggggtcaggtg

SEQ ID NO: 6785341 - DNA, 105 bp, Homo sapiens
gcatgtctgggaggctgctggtggtcccttctggccctggtcatacatgcagactgtggccaggttggagttggcctttagggtccccagctccttgccccatgt

SEQ ID NO: 6785342 - DNA, 60 bp, Homo sapiens
ccatgcagggtgctaacactgtgacatcattaactgatatcatttcagctctctgcctgg

SEQ ID NO: 6785343 - DNA, 104 bp, Homo sapiens
ttttgtattcttattcgagggcatgtacataatctagaaatcattacaatggcaaatagtgatttcttgaccactatgttgatatagccattgggaatatttga

SEQ ID NO: 6785344 - DNA, 76 bp, Homo sapiens
tgcggggtgtcccaagggggaagtcattacttgccgtggtaattggagaaggtggcatgtcccctggccactagca

SEQ ID NO: 6785345 - DNA, 68 bp, Homo sapiens
gggtggggtgcaggcaggtgcaacactcactgagaccactgtgttgccagacttctgtggctccatcc

SEQ ID NO: 6785346 - DNA, 84 bp, Homo sapiens
gtctgaacacaagaggtagctctttatgggtaaatgccaattgtccacacttggtgtccatagtgagcactggtgatctcaagc

SEQ ID NO: 6785347 - DNA, 83 bp, Homo sapiens
ggtgggtgtccacagcatcccagagcccagagctgggaccttctgctgccctagctgcactgggacctgctccagcatcctcc

SEQ ID NO: 6785348 - DNA, 71 bp, Homo sapiens
caatgccagagggcttggtttgggccaagatatcttgctgcccttaaaacaaagtccaggctctggcaatg

SEQ ID NO: 6785349 - DNA, 130 bp, Homo sapiens
ggtcccgcccttgacatgtggggattattacaattcaaggtgagatttgagtggggatacagagccaaaccatatcattctgcctctagctcctcccagatctcatctcctcacatttcaagacacaatc

SEQ ID NO: 6785350 - DNA, 62 bp, Homo sapiens
agcacaagtttctggcagacagtgattactttctcacacattgttaactggcatcttgtgct

SEQ ID NO: 6785351 - DNA, 88 bp, Homo sapiens
ggagtctttctctgtcacccaggctggattgcagtggcaagatctctgctcaccgcaacctccgcctcccgggttcaagagattctcc

SEQ ID NO: 6785352 - DNA, 55 bp, Homo sapiens
aggcagttggtcattgctcttttacaactgaggaaacagcatgagtaatttgcct

SEQ ID NO: 6785353 - DNA, 82 bp, Homo sapiens
gttgcctgcggtctccgtgggtgagggaaaaggcacagggaggtgcagaagcgttcctggcgccacggagccggtcagtgac

SEQ ID NO: 6785354 - DNA, 56 bp, Homo sapiens
ctttctccccactctcatgtaccaaggaaaggccacgtgaggacaaagggagaagg

SEQ ID NO: 6785355 - DNA, 64 bp, Homo sapiens
ctaggaatccctgtctcacctcagtctggcttgaccagctgagaaatggggaaagggctgctag

SEQ ID NO: 6785356 - DNA, 57 bp, Homo sapiens
ggcacagcaggagctatgtgaatgaatgagtcatttaagctgaaccttgtgtgtgcc

SEQ ID NO: 6785357 - DNA, 71 bp, Homo sapiens
agtttttgagatctatggcacagcagggtgactatagccaataatagtgtgtgatatgtttcaaaattgct

SEQ ID NO: 6785358 - DNA, 100 bp, Homo sapiens
agaattgaatacaggcagcctttgctttgcacagtgctgtgttaactgaaactcatttgtatcagaagtgtgcaaagcaagggctgctgtatgcttttct

SEQ ID NO: 6785359 - DNA, 93 bp, Homo sapiens
gcttcctgcgcctttgcaacgctttgctagcactgcgcttcccttggcagcgcctggaagcggcgctagctgagatttgcgaggccagcgggc

SEQ ID NO: 6785360 - DNA, 80 bp, Homo sapiens
gcattcagaaggagagctgtcagcgtagcaccgaattcaagaccaaggcgtgctacctgagctgacagctttttgaaagc

SEQ ID NO: 6785361 - DNA, 82 bp, Homo sapiens
gctcacattctgaagggtgcctgctgttctgctgattacattcagaaatgttccacagatatagcatgcagtctctgtgtgt

SEQ ID NO: 6785362 - DNA, 67 bp, Homo sapiens
tgtatttaattgctgataaaataaaccaagatggttgctttacttcatggtttcagtgtcagctgca

SEQ ID NO: 6785363 - DNA, 89 bp, Homo sapiens
ggagaatctcttgaacccaggaggtggaggttgcggtgagccaagattgggccattgcacaccagcctgggcaacaagagtgaaactcc

SEQ ID NO: 6785364 - DNA, 80 bp, Homo sapiens
ggcaggcagccagaggggcctggcactgagctggcacggaggagaacggccctgctggcccaggccccttgctgtctgtc

SEQ ID NO: 6785365 - DNA, 62 bp, Homo sapiens
gggctgagccacagcttttgttctgatggcgaccaggcgtagagggccggggctccgggccc

SEQ ID NO: 6785366 - DNA, 70 bp, Homo sapiens
ggcagccagcagaatctgtccttggaagatgtgtgaaactctaatctcaactggttctgttccggctgcc

SEQ ID NO: 6785367 - DNA, 87 bp, Homo sapiens
tcagatgtggcttaacatttgctctataacaagcatttgtatgtcttgatgtacaaatttcataggcaaattttaaaggaactttga

SEQ ID NO: 6785368 - DNA, 60 bp, Homo sapiens
aggaggatgagttgcattataaatgtaccccctttggtactaatgcttaacacatcccct

SEQ ID NO: 6785369 - DNA, 62 bp, Homo sapiens
ctgccagggttcattgattccaggctcttctagaaattccaggaggccagtcagtctggcgg

SEQ ID NO: 6785370 - DNA, 122 bp, Homo sapiens
gagggtttcttcaagaatacttcagttgagtggaatcttgaccctcaaatagttgcctaggttagcaggacctgaggcaatccctagggtaaggtctggtcagataagttaaagccgccttc

SEQ ID NO: 6785371 - DNA, 77 bp, Homo sapiens
ggtgaatcatttcatctgaggcaccagagcatacatggtttcctctgtgcctgtcaccctcagagagctgattcatc

SEQ ID NO: 6785372 - DNA, 130 bp, Homo sapiens
aggatagatgaaattttttagtagcttgtttcaagcaatattttagaaaggtatctgtggaagtcaagaaaacagatttaccattgaatgaatatgctgattaatctgctgtttaattatatatagactt

SEQ ID NO: 6785373 - DNA, 61 bp, Homo sapiens
tgtttcaggaagctcaagtttatttctgatacttgcagccaaactgaccttgcctgagaca

SEQ ID NO: 6785374 - DNA, 72 bp, Homo sapiens
ctctggggttcaggagagagaaattggggctagatttaagaatttcatagccttctttactgaagcctgggg

SEQ ID NO: 6785375 - DNA, 84 bp, Homo sapiens
aatatgtatctgaggagtaaacatttcagatttattttcatttgtataaggtaaatgaatgtttagtctttttccagacgtatt

SEQ ID NO: 6785376 - DNA, 63 bp, Homo sapiens
gcaggagagctggtatatgaagacatgaattcagatattctgtttccattttcagtactctgt

SEQ ID NO: 6785377 - DNA, 71 bp, Homo sapiens
tatgaaagggctttggataaaaatcccatttgaatatgtcgctgttattgatatctaatgctctgtccatg

SEQ ID NO: 6785378 - DNA, 79 bp, Homo sapiens
aagtatagacagctaggccttttcagtttctgatatttattgtcaggattattttattaaaagaagccttactatattt

SEQ ID NO: 6785379 - DNA, 70 bp, Homo sapiens
caagaatgtatttggtaggatggtacatggttaatggtattgtgtaatcacctgcacaaatgtgttcctg

SEQ ID NO: 6785380 - DNA, 63 bp, Homo sapiens
tcagtggcagttcgtggccatgcaggcaattctgctggcctggttgttgctgccgtttcctga

SEQ ID NO: 6785381 - DNA, 56 bp, Homo sapiens
cagttaccatcttcagtgatgaagcctcgtttttcagtgtgagtttgtggtaactg

SEQ ID NO: 6785382 - DNA, 57 bp, Homo sapiens
gcctgcagaactgtgaggcaatacatctgtattgttttaagccagtctgcctatggt

SEQ ID NO: 6785383 - DNA, 58 bp, Homo sapiens
tagaggagcacatgaggctgagggcatatggacgatgctcttgctgatgtctccttta

SEQ ID NO: 6785384 - DNA, 62 bp, Homo sapiens
gtggcagaaatattcttgctctgggtcttagcaatcatgagagcataagcattatttgccac

SEQ ID NO: 6785385 - DNA, 87 bp, Homo sapiens
gaatgagtaattcagtatatgccagagagatagctacactttatagattttgtagttccttacatgtactgttaacaatgcttattt

SEQ ID NO: 6785386 - DNA, 58 bp, Homo sapiens
tgctttcatttgataagaatgccatatagctcacttggcagctgtgtaagagaaagca

SEQ ID NO: 6785387 - DNA, 85 bp, Homo sapiens
cagggattggggcttgccctgtgatgtgctgttgaccaagttagaggggtataggcaagcagcaaagtattgggcaagatcactg

SEQ ID NO: 6785388 - DNA, 60 bp, Homo sapiens
aagaaagggagtggacaacaggcacagcggcaaaacaagctgtgtcagtttccctttctt

SEQ ID NO: 6785389 - DNA, 59 bp, Homo sapiens
tgagaaactgctctgattctgcaagttcctaaaccaagatactgtttcagagcttctca

SEQ ID NO: 6785390 - DNA, 65 bp, Homo sapiens
agcctcacagaacaagcctggtggaggggtaagaatctctttttagattgtttgtgaaattcgct

SEQ ID NO: 6785391 - DNA, 64 bp, Homo sapiens
gcccaggaggtggaggtgcagtgagccgagattacagattatagcattgcactccagcctgggt

SEQ ID NO: 6785392 - DNA, 108 bp, Homo sapiens
ccctctccacgtgcctccgtgtgggtgcgctgggctgctgtgttcctgaggcaccggtgggtgcgtgacgatggcagctcccacccagcagagccgcgaacagaaggg

SEQ ID NO: 6785393 - DNA, 80 bp, Homo sapiens
ccttctgaagtgacttcttaaaccatggtcctctttcttgatcagatcgaagatcaggtattgggaagcgaacagaaagg

SEQ ID NO: 6785394 - DNA, 76 bp, Homo sapiens
acagtattaagaaactgcagagccatggttcaacccaagctgggtctgacaccagaatctgagctctttccactgt

SEQ ID NO: 6785395 - DNA, 78 bp, Homo sapiens
gtcaccatggcttgggagaggcttcctctttaacaaaagctgttaggaaagaagtacattctcatgccccggcttgac

SEQ ID NO: 6785396 - DNA, 61 bp, Homo sapiens
gttgttccatcatgagaattaggctaaaagtcttagcttactgccccatggaaggaaggac

SEQ ID NO: 6785397 - DNA, 87 bp, Homo sapiens
ccatgctggagagggtgcatgtaggcagttgagtgcttggctaatggttagcagcaatgactggctatatgatttgctccaccttgg

SEQ ID NO: 6785398 - DNA, 65 bp, Homo sapiens
atttggggaagggagtcatttgattagggaatcatccacctcaatcacatgcttattcctggaat

SEQ ID NO: 6785399 - DNA, 80 bp, Homo sapiens
ctgggcaacttttcttgatagtaaataacactgttaaataaaactaaagtgttatgaacttctagaaaacagctgcctag

SEQ ID NO: 6785400 - DNA, 79 bp, Homo sapiens
tggagcccagagaaggcccctgaccctgccgggcccccttcagcctctgggcctgcagggtgatgggctgcctgctcca

SEQ ID NO: 6785401 - DNA, 80 bp, Homo sapiens
agtagctggattggggtagctgtttcacaccactaatgctagcagattggctggcgaggctctgtgacaatcaagctgct

SEQ ID NO: 6785402 - DNA, 61 bp, Homo sapiens
gaaatgatgacaggataaagaacaatgatcaagttgtagcttgaattcttgtcattcagtc

SEQ ID NO: 6785403 - DNA, 74 bp, Homo sapiens
atcattacaggttttagagtggattctagaaagaaagaacgttcattcagaatctttctagagtctagaatgat

SEQ ID NO: 6785404 - DNA, 59 bp, Homo sapiens
gctccgtttctcggtcacggatgagacaggtggcctgaggctgtgggcggaggaggggc

SEQ ID NO: 6785405 - DNA, 79 bp, Homo sapiens
gtcaggcacctttggaaactgcctcagctcttccttctgggggtggcaggaggggaagtttatggtaaaggtgtatgat

SEQ ID NO: 6785406 - DNA, 94 bp, Homo sapiens
aatgaattctggaaagagactctccagatgggaagaaatggctgtagtaacaatcccaattcatcctctggggcttcatttttcctatggcatt

SEQ ID NO: 6785407 - DNA, 64 bp, Homo sapiens
ctaggatgaagtagttatacagcattttgtatacaattaaggctgtagaataatttcattttag

SEQ ID NO: 6785408 - DNA, 130 bp, Homo sapiens
atgtaataaattggtgaacgtctactttagaagggtggcaccacatatcatagaatcattaattttctgttgattattattgtggaattgctacttttttgtagggcaatattttcactttagaatgcat

SEQ ID NO: 6785409 - DNA, 87 bp, Homo sapiens
tacctagcatatagaagctgttccataagtgatagcctgttgttgacattgactaacatttattgagcacttagtatatgccaggtg

SEQ ID NO: 6785410 - DNA, 88 bp, Homo sapiens
tgtttatttcctttggcatgttcttcatttggtggcaatgcatcctggggtcacataaataaaaacagcaattagaggaagtttagca

SEQ ID NO: 6785411 - DNA, 79 bp, Homo sapiens
ttatagaagccctgtaaattgcccttaattttggatgatatatcattaactcttaacggtcattgactgggttctgtga

SEQ ID NO: 6785412 - DNA, 87 bp, Homo sapiens
cagaaaataactgagagcttgagtatcactggcaaagaatttagctgtgattccattagcacagttgtctcaaagcttctttttctg

SEQ ID NO: 6785413 - DNA, 77 bp, Homo sapiens
ggctcaggctgctggcttcctcaggagcagtgggtgactacagctgtaaaaggaatgtcttcctgcacttctgagcc

SEQ ID NO: 6785414 - DNA, 61 bp, Homo sapiens
atctaacacctgttagctctaattttctttcctgagaagcacaccagtagacagggtagat

SEQ ID NO: 6785415 - DNA, 109 bp, Homo sapiens
tagaaactaaaaatctgagcttttacttttcatttcagccatactggatggtggacatctctgactcaatgggctgagtgaggaaaaggttatagggtagtggtatcta

SEQ ID NO: 6785416 - DNA, 55 bp, Homo sapiens
tttttaaagccttctgcagaaattgtatacatctctgccttgatggcattgagaa

SEQ ID NO: 6785417 - DNA, 95 bp, Homo sapiens
tatcagtttggatgaatttttctaagcttttgtataaatctcaagaaggaaggcaggacattggaaaagtttcctatagaccatcccaactggta

SEQ ID NO: 6785418 - DNA, 89 bp, Homo sapiens
gctgccttttcttttcttctttagtattttttgaacatgaagtgagggtcgtattgatgagagatcactaaagaaggttaagcctcagc

SEQ ID NO: 6785419 - DNA, 57 bp, Homo sapiens
gaggcaggcggcccctgctctgcttccctgctggtgtcctacagggccgcaggcctc

SEQ ID NO: 6785420 - DNA, 73 bp, Homo sapiens
tgaacacaaatattttggggttcttgataatgtatctgcaagtaaaatccactcactccagaagttgtgttca

SEQ ID NO: 6785421 - DNA, 75 bp, Homo sapiens
gtgatttcctgtggtgtttcccagacagccacctccaggaggttagcagtgtgctgggaaatggcaggatatcac

SEQ ID NO: 6785422 - DNA, 79 bp, Homo sapiens
gcctggagttcagcatgtctgggccggtgcaccctgggccctggactcagtctggcctgcccagagcagctctgcaggt

SEQ ID NO: 6785423 - DNA, 56 bp, Homo sapiens
gctgtatccatactaattgctaaatcccatgggatctcactaagatgagatatagc

SEQ ID NO: 6785424 - DNA, 100 bp, Homo sapiens
ccatttagatctcctcttctttgtggcagctctcttgatttccctaggctcctcagttggaagtagaaggggttggaattccacataagggatctcctgg

SEQ ID NO: 6785425 - DNA, 101 bp, Homo sapiens
tataagtcttgcatggacatgtacttcaatttctcttgagtaaataccaagtaataaaatgaggatatgtttaactatgtaaaaactctgtcagatttgta

SEQ ID NO: 6785426 - DNA, 84 bp, Homo sapiens
ggggtagattccttggcctctttccccaaggcctgtgttctattacaacatcatgctgtgaaaaagaaggctgacatttactcc

SEQ ID NO: 6785427 - DNA, 93 bp, Homo sapiens
tttgggtattttgcaggagtggggttgagtgatttattttaaaaaagtgagtaagaatagaatcattggaaccacatccaagaagtttccaga

SEQ ID NO: 6785428 - DNA, 72 bp, Homo sapiens
cttgacctggcagtcacggccatgtgctgtttccaacacagcgctcctcctggccaggctgcccagctcagg

SEQ ID NO: 6785429 - DNA, 99 bp, Homo sapiens
gtagagactgaaatgtcctctcttctaattttcccgagtatttgagttaactacacagttatacatctggatgaataggagagtgattgtagtgttcac

SEQ ID NO: 6785430 - DNA, 55 bp, Homo sapiens
gtgcatcagagtgtcctagacaagggggtagcttggcctattgctctctgggcac

SEQ ID NO: 6785431 - DNA, 61 bp, Homo sapiens
gaggtctgccttcaggagagttcttagtatcaccccgcctccattttgacctgcagacttc

SEQ ID NO: 6785432 - DNA, 71 bp, Homo sapiens
actcactcttaatcagactccctcaggagcagagattactcttgacacctaagtctgttaacacagtgagt

SEQ ID NO: 6785433 - DNA, 81 bp, Homo sapiens
tttgcaatttagatttttccccattttagtgtcttaaagcctaaagagtgacagcagaatgtgaagattttgaattatgaa

SEQ ID NO: 6785434 - DNA, 97 bp, Homo sapiens
tgggtgcttggttcatctctgtgggagtcaggaagtataatcagattcacatgggtgaaagaggctgtctttttgctttcaagatgaactacaccta

SEQ ID NO: 6785435 - DNA, 86 bp, Homo sapiens
ggccaaggcatcttccctccctggctgccatttcctcatctgtaaatgaaggggttggattacttagggagaagtaaactatggct

SEQ ID NO: 6785436 - DNA, 60 bp, Homo sapiens
gaaccctgggggtggccagtgccagctttgttaggtcacgaatggcttctcccaggcttc

SEQ ID NO: 6785437 - DNA, 78 bp, Homo sapiens
atgggctctgcacattttaccaatactctggggcccagtttggtcatttgtaaaatgtgaataattcttagtacccat

SEQ ID NO: 6785438 - DNA, 63 bp, Homo sapiens
tcacttgtcactgcccactctcaaatggtattacactgcctgagctgcggggcagtgctctga

SEQ ID NO: 6785439 - DNA, 58 bp, Homo sapiens
aatccaagctctctatgccatgattctgcaaagagcattgtatattggaggttgggtt

SEQ ID NO: 6785440 - DNA, 103 bp, Homo sapiens
tgagtagtgcatatacgggcaaaactgcaccttttagaagtcatttttaagacacagtgtcctagaatgcatctaaaagcagagatagcttgtgtaggactta

SEQ ID NO: 6785441 - DNA, 76 bp, Homo sapiens
caggttgaacaatgttcctgtagctgagccaggatttgaacccaggtagttggttgcagggatggagttcaaaatg

SEQ ID NO: 6785442 - DNA, 69 bp, Homo sapiens
cacaaaattagccgggtgtggtggaactcctgaggtcaggagttccagaccagactggccaacatggtg

SEQ ID NO: 6785443 - DNA, 67 bp, Homo sapiens
ggcaaagaattgagggtggcctctggataacagccattgagggccagaatccctcagtctaatagcc

SEQ ID NO: 6785444 - DNA, 55 bp, Homo sapiens
tgtccatagtgcctggcataccaaaggtggtcaataaatgtctgtgcactggata

SEQ ID NO: 6785445 - DNA, 67 bp, Homo sapiens
tatgcttcactgtttggttcacagcagttatttcctgttaacagccagatttggtgatttaagcata

SEQ ID NO: 6785446 - DNA, 77 bp, Homo sapiens
ggttggagatctcatctatggccactttgtggttgctaataaagacatggaactagagatggtgtgtattgacagct

SEQ ID NO: 6785447 - DNA, 86 bp, Homo sapiens
ttgaatttgacatttaattaagatgatatagcaaaatggtggatatcatttttgatgtctgatgtttgttgtagatgtcggtttaa

SEQ ID NO: 6785448 - DNA, 89 bp, Homo sapiens
gccgccatggacccagggctgagctgtgaccatgagggctatcccgacgagctgccgtggacccagggctgagccgtgaccatgagggc

SEQ ID NO: 6785449 - DNA, 76 bp, Homo sapiens
ttttaggaagtagtgtgacaattaatatttgatgtgaaatactaacagatattgtgcatactgctgttttctaaga

SEQ ID NO: 6785450 - DNA, 55 bp, Homo sapiens
gatggactgccacctcctccgggctctgcttagtgtcacaggggtacagttcatc

SEQ ID NO: 6785451 - DNA, 86 bp, Homo sapiens
atcttctgggaccatctgtgtctactttttcaaaaagcagattgtgtgaaatgacaggtgggtaggacacagaaggtaatagagat

SEQ ID NO: 6785452 - DNA, 89 bp, Homo sapiens
tcccatccaatactagatggttgggtgtgtgaaacagactctgcgtttacctgcacagccagccatgtggatgacggttggaactggga

SEQ ID NO: 6785453 - DNA, 71 bp, Homo sapiens
gaatatttaagggggaagatcatattttatatttaggaagtaaaatgtgaagtctttcttctgccatattt

SEQ ID NO: 6785454 - DNA, 81 bp, Homo sapiens
ggccttccaggcgcatgctcccatctgcgttatctgcctcagatcaaaagagaaaatgcatgagaatgtgctcggaaggcc

SEQ ID NO: 6785455 - DNA, 87 bp, Homo sapiens
gttgtaatatcattttttcagaaaggcttatcatgctataagaagacttatggaagggagctggaatttggaggataattttgcaat

SEQ ID NO: 6785456 - DNA, 120 bp, Homo sapiens
gtagatactacaatcatctcaaagtccaggatctcagggatgttgtacagtcctccccattgggtccagattggctccctgtgatctggtgacttgtgaactagaagacaagttatctgc

SEQ ID NO: 6785457 - DNA, 94 bp, Homo sapiens
tcccatttttggaaggcccctcacagcttggggcaggagagggtgaggggtggctcccactgtctgtcttgctgcagggttggcggggatggga

SEQ ID NO: 6785458 - DNA, 57 bp, Homo sapiens
tgggcacctgaggcctggcaggcccgggcgagctgaggccccagccagggctgccca

SEQ ID NO: 6785459 - DNA, 81 bp, Homo sapiens
gatgagatccccgtgtccctcattgacgctgtgcccaccagcgccgaaggcaagtgtgagaagggactggataatgccgtc

SEQ ID NO: 6785460 - DNA, 123 bp, Homo sapiens
tgtgcacacagcagctgcgtgatctatggagttggctgagcagtttggcgcgttggtcagcaacttcctgcagcttctcagcccacgcagatcctcaggtctgcagtgctgggcttgtgtata

SEQ ID NO: 6785461 - DNA, 59 bp, Homo sapiens
cccggggatcccgtctgggcgagcacccctcgaccctcgcttagaagggacatcctggg

SEQ ID NO: 6785462 - DNA, 61 bp, Homo sapiens
tttctggaaactgtaaagaggacaaggccagcaaattgttcatttgcctgtggttcagaag

SEQ ID NO: 6785463 - DNA, 85 bp, Homo sapiens
ggggacacagagaggtttgcccagagctgcctgttacaggcaattactgctgtaaatggccccctttgcgtcgaccctcttcccc

SEQ ID NO: 6785464 - DNA, 77 bp, Homo sapiens
acaggtggcctctagaagctggaaaaatcaaggagatggattttctcctagatgcttcagaaggcctgcagccctgt

SEQ ID NO: 6785465 - DNA, 58 bp, Homo sapiens
ggttgttctgtccttggaccacagtcaccagcactgacagtgccagccacaggacgcc

SEQ ID NO: 6785466 - DNA, 88 bp, Homo sapiens
tttaaaaattttatgtagactttgatgacgccagtggaagctgtccgaggagatatattcaaaagtttcacatagagatatttttaaa

SEQ ID NO: 6785467 - DNA, 69 bp, Homo sapiens
ctttcacttatttacttatttttaaattttccacagcagagggagaagagttaaatgaatgagtggggg

SEQ ID NO: 6785468 - DNA, 67 bp, Homo sapiens
gttcccctgcttctcctgcgcaggcccagggaagacccccttcctgcctgagcgtggaggagggagc

SEQ ID NO: 6785469 - DNA, 73 bp, Homo sapiens
ttttggcattttgtttgttcacttgacagacattttcttgggtgtttattgtgtgccaagcactgtgccagga

SEQ ID NO: 6785470 - DNA, 63 bp, Homo sapiens
aagacagttgctgaagtatgaaaaagacagttactaaactgtctttagttcagtaactgtctt

SEQ ID NO: 6785471 - DNA, 77 bp, Homo sapiens
aggccatctgtaattcactagggtcagcgaaggagaccgtccccatcttatgctctctatgaattcacagctgccct

SEQ ID NO: 6785472 - DNA, 65 bp, Homo sapiens
gccacagacagagagtctagtgtagtgctaaaggtgcatgagctctggagatcctctgcctgggt

SEQ ID NO: 6785473 - DNA, 91 bp, Homo sapiens
ttagggttgggattaggggagttattagacagggagtcagggcctcctgccatgggaacttcttgtcagtgatttcttcccttggccctga

SEQ ID NO: 6785474 - DNA, 115 bp, Homo sapiens
tcagggaaatatcctgtatatcttgctttgtgtggtgattgcatgggtatatgtattccactaacatgggtatatgtaaccaccacacaaagcaagatgcaggacattgcactga

SEQ ID NO: 6785475 - DNA, 73 bp, Homo sapiens
ctccttaaaaaggggttggtcggggggctgagcccaaggcccagtttcccttgcaaacccatttatgagagag

SEQ ID NO: 6785476 - DNA, 63 bp, Homo sapiens
ggaggctgatggtgactagaatcatgtacagtcactgaggactcactaggcaccaggcacccc

SEQ ID NO: 6785477 - DNA, 112 bp, Homo sapiens
gcagcatagcatattgtgaaaatctggaaccggcaccttgagagaatgaggattaacccccttgagttattaatggctgagtttgaaggatacctcactgtccctgtgttgc

SEQ ID NO: 6785478 - DNA, 79 bp, Homo sapiens
agggagggaggggaaatgcatggatcttggcagatgcaaatgataagctttacctagtataatgcaaccttctttgcct

SEQ ID NO: 6785479 - DNA, 93 bp, Homo sapiens
taggttttattcagtataggtcagatacaggtttttgttagatgataggttatttggggatccttgtgtctggggtaactgatgtagaactta

SEQ ID NO: 6785480 - DNA, 60 bp, Homo sapiens
caccatggggagagtctgggtcagtgattgctctggccaactgtggggtccccgatggtg

SEQ ID NO: 6785481 - DNA, 84 bp, Homo sapiens
agtcctcacacagcctgcccagggaggctgtcttatgcctgctttacagatgaggaaacaggacccccagggaggtgaaggact

SEQ ID NO: 6785482 - DNA, 55 bp, Homo sapiens
cccaggaggcctgcctggccggagggaggaggggctgggggcagggactcctggg

SEQ ID NO: 6785483 - DNA, 61 bp, Homo sapiens
ggtagtcatggatagctatgagtcacaaattgaaacaaatggtgtccgtgaattagttact

SEQ ID NO: 6785484 - DNA, 67 bp, Homo sapiens
agattggttatttgataaggaaagtggagcagacttgttctagaaacttcttataaatggcagatct

SEQ ID NO: 6785485 - DNA, 82 bp, Homo sapiens
aagtgtttccaatgccattaagctttagggtgcggggctctaattctgggactctaatgctaatagtattttttgagcattt

SEQ ID NO: 6785486 - DNA, 88 bp, Homo sapiens
atatgaatggaatcatacagtgggtggcctcttgagtcaggcttcttagcacagtgcatttgagagtcatccatttccttgtttgtat

SEQ ID NO: 6785487 - DNA, 102 bp, Homo sapiens
ttccaagttatctctgaatttagttatagcagtgtctttatttattttacttaacttcatagatgattttagttgactaaacttaagaagaagaacttggaa

SEQ ID NO: 6785488 - DNA, 69 bp, Homo sapiens
ggctacgttgttctgcaatacccaagcctcatgcagaaagtggcagtggggttggcaagggcggctgcc

SEQ ID NO: 6785489 - DNA, 58 bp, Homo sapiens
tccatagttatagcaaatgagttggtactcattccaaatgacactttgttgctgtggg

SEQ ID NO: 6785490 - DNA, 130 bp, Homo sapiens
atctgaatccatttagagtagaaatggtatccctgtgattggcttccttcttattgtcagtctctgctaaaagagtgagaagagatgaggaagaaaatgggaagcagaatctcctcttttgggttctggt

SEQ ID NO: 6785491 - DNA, 63 bp, Homo sapiens
ggactagaagagcgtacctatcctgtctcctttgcgagtaccacttgggtggtttttctctcc

SEQ ID NO: 6785492 - DNA, 64 bp, Homo sapiens
ttgaaaagcaaatgatgggtagtgtgatgaagcattaaaaccatatcccatcagagttttataa

SEQ ID NO: 6785493 - DNA, 89 bp, Homo sapiens
gccctgtggtctttacagtctctgtggcaacaattcactatgccatcatagtgggaaatgagctacagataatctgtaaccaaaagggc

SEQ ID NO: 6785494 - DNA, 99 bp, Homo sapiens
cagggtgttgatgagaaggcatttcatggcagactttaaccctggactggattctggggaaggttacaagtctccatctcctgttcttatcaaaacttg

SEQ ID NO: 6785495 - DNA, 73 bp, Homo sapiens
gtgtctcccagaaaccggctgctttggcgtccctgaggatcactcactggccaggcacagctgtgggaggtac

SEQ ID NO: 6785496 - DNA, 77 bp, Homo sapiens
ttacattcactcaactttctatagacttctctgagggggaagtgtctccagggccaagtcatggaaccaaaatgtaa

SEQ ID NO: 6785497 - DNA, 81 bp, Homo sapiens
cccgggagccatctttaccagacagtgttaggagcttcacaattagaccatccaacactgtactggaagatggacccaggg

SEQ ID NO: 6785498 - DNA, 67 bp, Homo sapiens
ggatggtggtaaggatgtattgagaggattcttgtgtagcaatgttgttggtatcctacccacatcc

SEQ ID NO: 6785499 - DNA, 72 bp, Homo sapiens
ggggctgctggggggctactgacagaggagacatcttcatccatctctctgtgagatgccttcctgagcctt

SEQ ID NO: 6785500 - DNA, 61 bp, Homo sapiens
ggttcaggtctcttcagcttggtcttgtcaggactccagggctgaacgaggcccaagaatc

SEQ ID NO: 6785501 - DNA, 56 bp, Homo sapiens
ttcccagaatgaatggatggaggcatttagacccccatcccatgtcattcagggga

SEQ ID NO: 6785502 - DNA, 83 bp, Homo sapiens
ttgccatattgaccagactgacacacatctaataatttgaggccaatataaaagactgtgcagctgagtgctaatttgtgcaa

SEQ ID NO: 6785503 - DNA, 60 bp, Homo sapiens
cctgggcatcccttcttccagtgtcattcctctggcagagggagaggaggatgcataagg

SEQ ID NO: 6785504 - DNA, 61 bp, Homo sapiens
cgtggaatattataatggcacataacatgcacttctttgtgttgcctttgtgatgtacatg

SEQ ID NO: 6785505 - DNA, 60 bp, Homo sapiens
ggagaaaattgaatcagtagctgatgtggaagtattttgctagcttgttcaatttcatcc

SEQ ID NO: 6785506 - DNA, 70 bp, Homo sapiens
ccagccactctcctttactgcagagagcgggaccgtgtcccccttcatccccctagaacggtagggctgg

SEQ ID NO: 6785507 - DNA, 86 bp, Homo sapiens
ggctgctgacacagtaaccccaggactgggaccctttatcagtttgggtgcttcagctttcttggtgtcaccatgtttcagctgcc

SEQ ID NO: 6785508 - DNA, 62 bp, Homo sapiens
ttgcctcatcaaagatgtaaaaggtgtgtgggtatttactcgaaatcagcatcttgaggcaa

SEQ ID NO: 6785509 - DNA, 69 bp, Homo sapiens
ggtgaagctcatggttttctctaaaattgtaactgggattttattttagaagttcacttgggtttcacc

SEQ ID NO: 6785510 - DNA, 88 bp, Homo sapiens
gggttggttccaagtctttgctattgtgaatagtgccacaataaacatgtgtgtgcatgtgtctttatagtagcatgatttataaccc

SEQ ID NO: 6785511 - DNA, 59 bp, Homo sapiens
tttctaggaagttcagtctatactgattcttattttatggaatggctattttctaggga

SEQ ID NO: 6785512 - DNA, 59 bp, Homo sapiens
ttggctctggcaaggggcaccgggttcaccccgccgaggtctccccttgcagagcgcag

SEQ ID NO: 6785513 - DNA, 56 bp, Homo sapiens
ttgatgaggcatgggatcaaaatgatattagtcatttgattgagtgccttatgcag

SEQ ID NO: 6785514 - DNA, 57 bp, Homo sapiens
caggtaattctttgttgtggggtgcctgtaatccctatgctttgggaggatcacttg

SEQ ID NO: 6785515 - DNA, 80 bp, Homo sapiens
gggagagagagggaggaaagaagcaagggagctaatatagaaaggtaggataaatgcttgattctgtccctttatttctc

SEQ ID NO: 6785516 - DNA, 86 bp, Homo sapiens
gattcactctcattcactcacttagcaagcattcaagtgcctgcaatctgccaagcaagcatctggctaggtggggaaggtgtgtc

SEQ ID NO: 6785517 - DNA, 122 bp, Homo sapiens
gagtggagtgggacaggctttggtggctgacagcacagagctaggagtggagggagtggatttcagtttctgaccctgccactggcttgctgtgtgaccttgggcaagtgtcttgccctctc

SEQ ID NO: 6785518 - DNA, 67 bp, Homo sapiens
ggaagctcaggaaagagtctggttaaagttacattgagctggaaaccaatttcctcctaatgcttct

SEQ ID NO: 6785519 - DNA, 82 bp, Homo sapiens
tctcctgcaatttggaaaacactgaaaattttggtcatcttatctgggacagtcttaattcagtgatttttcaaccagggga

SEQ ID NO: 6785520 - DNA, 71 bp, Homo sapiens
agtcacactctgtgttaaattgggtttttgtgggcacaccacaaactctaatcaaatatagcattgtttct

SEQ ID NO: 6785521 - DNA, 93 bp, Homo sapiens
tgggccactcagtggaaccaggaagtatgacccaacagaccacagagactttgttccctgcctccgttgagtcagcttcggacccacggttca

SEQ ID NO: 6785522 - DNA, 66 bp, Homo sapiens
gcttggtttccgggagacaggtggactatctgagaacacaatggtccctggatttctggaacaagc

SEQ ID NO: 6785523 - DNA, 93 bp, Homo sapiens
taaagtttaacaatttaatatcagaaggggaggtaaagaaggactcactttccctctttacctccccttctgatattaaatggttaaatctta

SEQ ID NO: 6785524 - DNA, 70 bp, Homo sapiens
attgccttgactccactctttccccggtgggtggagacacagctgggctaagagtagaggccaagccaat

SEQ ID NO: 6785525 - DNA, 68 bp, Homo sapiens
atgttaagattctgaatattatggtggcctaaagtaggcttcttggtacaccagattatttataacat

SEQ ID NO: 6785526 - DNA, 75 bp, Homo sapiens
ctgttttgataagctgtggtcaccaggtggcgctacacacacgctgtcaagtccaacagtttttcagacctgcag

SEQ ID NO: 6785527 - DNA, 72 bp, Homo sapiens
tatgccagagctgtgggagcacatgacagataacacactgtccctgtttgtccccatccctcagcaggcatg

SEQ ID NO: 6785528 - DNA, 60 bp, Homo sapiens
ccaggccttccagtacgcagaagagcacgcggaagtttgtcccgctggctggaagcctgg

SEQ ID NO: 6785529 - DNA, 82 bp, Homo sapiens
gcccaatgacaatagagttctcataggacaccgttactactgcctatttggtgtctcctcagtgaagtcattgtgttgtggc

SEQ ID NO: 6785530 - DNA, 65 bp, Homo sapiens
ttgaatctcatcccaatgttgttttgttgttctgcaaaagtggcaagcatggagagagaggtcag

SEQ ID NO: 6785531 - DNA, 68 bp, Homo sapiens
tacatgtgttctgtttcaagttaatttggtttgctgatgaaaggtcattgaagtcagaaatatatgtg

SEQ ID NO: 6785532 - DNA, 68 bp, Homo sapiens
cttctctaggtcgccgccctggtagatcatgtccagtatctggctcacccaggtggtgcctggagagg

SEQ ID NO: 6785533 - DNA, 56 bp, Homo sapiens
aggaattatttgtcttagtcttccttctaaaccaaggaggagtagaaatagatcct

SEQ ID NO: 6785534 - DNA, 72 bp, Homo sapiens
ttcaggcaggtgtgagaaacgtgaccagttggtggagtcgcttaactggggtgtcttcagactgagcctgag

SEQ ID NO: 6785535 - DNA, 64 bp, Homo sapiens
gccaggcactcagtctggatccctctgagatcaggtattgggggttgggtgagtgttggatggt

SEQ ID NO: 6785536 - DNA, 69 bp, Homo sapiens
tcccaatctgtgaaatgggaataatagtagtacctgctcatagttattattcccatgttacaggtggga

SEQ ID NO: 6785537 - DNA, 82 bp, Homo sapiens
gatcttcacatttcataccacagcttctttgtgactgagctgcactgggcagagctgagtatgaaggatgtgagacaagatt

SEQ ID NO: 6785538 - DNA, 79 bp, Homo sapiens
ccaaaatgcataatggctgaaacataatagaagtattttcatttcttacttatctaaagttgttctagtcagcaagtgg

SEQ ID NO: 6785539 - DNA, 67 bp, Homo sapiens
gcaggaggatgggcggcatccctgcaggtcttggtcaccggcttccagcaggtgctgcgcctcctgc

SEQ ID NO: 6785540 - DNA, 84 bp, Homo sapiens
tcttggtgttcgctctcaaatgggctcttttcagtatcacatatcatatgcaggatgcagaggggcccggcttacataccgaga

SEQ ID NO: 6785541 - DNA, 58 bp, Homo sapiens
ggggatgagtttgagatagtagagtgtgggcacttgttctggctggaaacttagcctt

SEQ ID NO: 6785542 - DNA, 55 bp, Homo sapiens
ggaggcaaagcatgtggctcaggatagcagtcctgagtttcctgttcttgcttct

SEQ ID NO: 6785543 - DNA, 69 bp, Homo sapiens
ctgtagggctgagagaaggcctgggggtctccttgcagtgccctgttcatttctctccctcctgtgcag

SEQ ID NO: 6785544 - DNA, 58 bp, Homo sapiens
gtgaattatatattaaggtcctttagcacagtgttgcaggacattagttatgaattac

SEQ ID NO: 6785545 - DNA, 68 bp, Homo sapiens
gaggcagatgcatcacttgaggtcaggagttcaagaccagcctggccaacgtgatgaaaccctgtctc

SEQ ID NO: 6785546 - DNA, 116 bp, Homo sapiens
gctgaggctcagagaggttaatgaactaagccaaggctcactgttaataaatagcaaaggtaaaattaaattccatatctgcttgagatagaggccttgctcctaatagctgcagc

SEQ ID NO: 6785547 - DNA, 91 bp, Homo sapiens
gatgctggcagggtagctgatggcctgctgtgcatgcttgcttctgcctgccctgcccaggcccaggccagtggttcccttctctagcatc

SEQ ID NO: 6785548 - DNA, 67 bp, Homo sapiens
tttattatagtggtggggactgctattgcctcccacaatatctttcactcccttctatagtaataaa

SEQ ID NO: 6785549 - DNA, 92 bp, Homo sapiens
ggggagttagagagaggtgacactgtgtatttacgtctgagctgcggccccccagggccccgacatgagacatggcacagctctggtccccc

SEQ ID NO: 6785550 - DNA, 71 bp, Homo sapiens
cactatctactattgtggttatactaataagagctacaagttaacttgtataaccacaatagtagatagtg

SEQ ID NO: 6785551 - DNA, 128 bp, Homo sapiens
atttcccctggagtcaaaagcctacttttggagccgccacaccctcgtgctccctcccgcatctcgggggttccgggggatgcacgtgggggtggccccaggagccctgggtgggatctcggggaaat

SEQ ID NO: 6785552 - DNA, 58 bp, Homo sapiens
tccatagctttggcactccgctggcagcaggacgaagccaggtaggcagtggcatgga

SEQ ID NO: 6785553 - DNA, 86 bp, Homo sapiens
gagctagaggcttgcaggctacatggaacctgctacttggtcttagataggtcgaccacttggcctgcatggaatatctgttgctc

SEQ ID NO: 6785554 - DNA, 83 bp, Homo sapiens
ggtgacacaattggcatgacagatttgaggcttgaaatcaccagtccggctgtagatctccgtgcttagctacctgtgacact

SEQ ID NO: 6785555 - DNA, 125 bp, Homo sapiens
atcctcaaagatcaatgagccgattaggcaatggaagtaaagatggtattttggagtttggtatatcagataaaaacccagccaatacttgtaacctgtgtatatggccattgcttttgattttt

SEQ ID NO: 6785556 - DNA, 93 bp, Homo sapiens
gttctgggaggctgagggttagagagtcaaagagcgagagagagcaacagcctattgagcaatgactttctggactttcacttgttaaggtac

SEQ ID NO: 6785557 - DNA, 62 bp, Homo sapiens
gatagggagacaggagaacactgaattaagaatcaagatgctttgctctgtctctagctatt

SEQ ID NO: 6785558 - DNA, 87 bp, Homo sapiens
ggtgccaaacttaatattctgcctgtagtcccacacctccatctggctctgacttggggtggctggttattacaggcaagtggcatc

SEQ ID NO: 6785559 - DNA, 73 bp, Homo sapiens
aaatgctggcacaaaagaaaactgccaaacaccagctggtctggtagtcaacatttatgagctcttggcattt

SEQ ID NO: 6785560 - DNA, 59 bp, Homo sapiens
gggttaatcccatccgtgtctcaaggcctcagcagtctaggggtgcagaagggatcccc

SEQ ID NO: 6785561 - DNA, 61 bp, Homo sapiens
aagatttgtgtgtggataggtggatgtgtactggtgtgtgcatgcatacatatacaagctt

SEQ ID NO: 6785562 - DNA, 58 bp, Homo sapiens
gtgtggcttgggtgaggcgcctgcatgagggcagggctaactgactgataggcttcac

SEQ ID NO: 6785563 - DNA, 87 bp, Homo sapiens
gttcagtagttttcaaggggaagtgattttcaggtcaaagcaactgtcaaacttagtgaaatggagtttccctgtgaaaatgctaac

SEQ ID NO: 6785564 - DNA, 64 bp, Homo sapiens
atccagcatggcagccatgagccacatgttactattgagagctttatatatggctggtctggat

SEQ ID NO: 6785565 - DNA, 70 bp, Homo sapiens
tgagcacaatgctaaaaattctgtacatcctttggatgaagctactgaatatttggtgtaaggttgttca

SEQ ID NO: 6785566 - DNA, 68 bp, Homo sapiens
gcctctcagcttttagaaccgagccttccgagatgcttggagagttctacctctgaaggcgagcgggc

SEQ ID NO: 6785567 - DNA, 56 bp, Homo sapiens
ggattttggcgtgggagaccctaagcagaggacccagttaagccatgccagacttc

SEQ ID NO: 6785568 - DNA, 58 bp, Homo sapiens
gtgcccttatggaagaaacctcagagagctacctgctccttctgttatatgagggcat

SEQ ID NO: 6785569 - DNA, 76 bp, Homo sapiens
ctttgagattctgtcttgatcactttctcttcttgctcaatgagctctatctgggaaattgtcaacactctcaagg

SEQ ID NO: 6785570 - DNA, 77 bp, Homo sapiens
tctctgattctcctggatccccttttacttagaggaacctttataagtacatttgggaccacctggataatctgaga

SEQ ID NO: 6785571 - DNA, 79 bp, Homo sapiens
tggagggacttaaagagatgatgatgtgatgatagctaacattcagtggttacatacattacctcatttagtccctaca

SEQ ID NO: 6785572 - DNA, 83 bp, Homo sapiens
ggattgcctgagcctgggaggcagaggttgtagtgagccgagattgtgccactgcacttcagcctgggtgacagagcaaggcc

SEQ ID NO: 6785573 - DNA, 91 bp, Homo sapiens
acattaaccaggcatatgtttattccaaattgcattgttttaaaactctcagtggcaatgaataaataatgtttagacaaaacgttattgt

SEQ ID NO: 6785574 - DNA, 66 bp, Homo sapiens
gtgaaaggcttgtccagtaaggggaaaggatttaatgcctgattgctatgtggataacctttatac

SEQ ID NO: 6785575 - DNA, 60 bp, Homo sapiens
ctcctgacttcagggggaggtgagaaacaggcagttgtctccgcctgcttggagcaggag

SEQ ID NO: 6785576 - DNA, 94 bp, Homo sapiens
ttgatgtattagagtgaaaacctaatcatgcagttgttcatcctcattaatatggataagtcatgtgttcatctttcattctaatttaattcaa

SEQ ID NO: 6785577 - DNA, 119 bp, Homo sapiens
ttcttttaacataagttcagtaactcaattaacagaaaataaaatgtcattgttcagaggtatggacaatgaaaggtattctgaacttaaagagggattaaatagagaggttagaagaa

SEQ ID NO: 6785578 - DNA, 79 bp, Homo sapiens
tgaggcttgagagtgccaagcatcctccgagctgtttgtcatcgagccccaaggagcccttggcacctagtaggcgtca

SEQ ID NO: 6785579 - DNA, 105 bp, Homo sapiens
gggtctggttcttgtgtataagctggccggccacctccagggttgcagagcaggagaagctgcgcccgttgtcctctggggtggccttcagcaggagctgggccc

SEQ ID NO: 6785580 - DNA, 68 bp, Homo sapiens
gacttgtgaggttaatttcctcatctataaaataaggatgataataataagatttacctcatatagtt

SEQ ID NO: 6785581 - DNA, 110 bp, Homo sapiens
cttcagcacctcatgcagggcctggcactgcctcatgctaataaatgcctgtggacaatggtcagcagaggcgtgcactgcccagctccctgccagagctgcccttgaag

SEQ ID NO: 6785582 - DNA, 100 bp, Homo sapiens
ggaaaaagggggaaaggctaatatatgttcatgtcaaacaaatgccttcaagggcgtagttgtgcagcgaggatagtcctttacttttgcctcatattct

SEQ ID NO: 6785583 - DNA, 56 bp, Homo sapiens
tgtgcctactgatagagccaagggctgatatcctatctggctctgtcgaaggcaca

SEQ ID NO: 6785584 - DNA, 63 bp, Homo sapiens
tcgctaggcccagttccgcctcccggaagcctttcctccttctgagacgctggggcctggtga

SEQ ID NO: 6785585 - DNA, 59 bp, Homo sapiens
gtgtggcaaaaccctgcctactaaaaatacaaaaattagccaggcatggtggtgcgcac

SEQ ID NO: 6785586 - DNA, 90 bp, Homo sapiens
agagataaccttatgttcagtagaagcagaggttgtatcacatatgtacttcaactggcacatgcttctgtttcaagaactaattgtcct

SEQ ID NO: 6785587 - DNA, 64 bp, Homo sapiens
gcttctttgcagcctccctggcagaagcatcaattgctttgctgatagagaggctgtccagagc

SEQ ID NO: 6785588 - DNA, 68 bp, Homo sapiens
gttagcgggaggcctcagtaccttgctttgtgattctctccatagggctgctggggtatcctcatggc

SEQ ID NO: 6785589 - DNA, 63 bp, Homo sapiens
tccatagaattaggggctatgccggttaacatatgagctgagctgtggccaccaatttaggga

SEQ ID NO: 6785590 - DNA, 107 bp, Homo sapiens
gagacctctcagaatcttacgaggttggagagttgtttggaatgctgggttctggtcttgtctctgcttccaaccagctatggaatcttgtgtattctttcagtctt

SEQ ID NO: 6785591 - DNA, 67 bp, Homo sapiens
gggcgctggagagacattgcaggagacgagtttcccttcctgcttctggtgtgttctctctaggctc

SEQ ID NO: 6785592 - DNA, 63 bp, Homo sapiens
tgccctcatggtacttactgtagctgtctatgcagctacgactgggaaccataagagaatgca

SEQ ID NO: 6785593 - DNA, 60 bp, Homo sapiens
taccagctgttaggcttggtgctgtaatgcagaggcagtactgagagaggctgttgtgta

SEQ ID NO: 6785594 - DNA, 85 bp, Homo sapiens
cttaaggtgtctactagtactgtctggttacctgacagtactgcagctgtcaggtatgcaacagaatgcaactgaattccttggg

SEQ ID NO: 6785595 - DNA, 57 bp, Homo sapiens
ggtacatcattaattgcatgttttcacttgagtttggcagctatagatggtgttgcc

SEQ ID NO: 6785596 - DNA, 67 bp, Homo sapiens
tggtgttgacgcctgtctcctcccaacttatggcattgatcatcttttggtaggagccgggctacca

SEQ ID NO: 6785597 - DNA, 57 bp, Homo sapiens
cttgactctgtgatgaccttgaactcagaggtttttaggtcctctatccaagttaag

SEQ ID NO: 6785598 - DNA, 60 bp, Homo sapiens
tgggggagctcatgatgtctttgtctgcaggagaagagatattcccaagagtttctttca

SEQ ID NO: 6785599 - DNA, 63 bp, Homo sapiens
gaagttggcagtctgcaacctggacgagggccaccagcaccctcatctcggacttctagcttc

SEQ ID NO: 6785600 - DNA, 83 bp, Homo sapiens
ttctctgcatatttcatttgcctgactttggtggacaggataattaatattaatatccaggcttcatgaattatgcacctgaa

SEQ ID NO: 6785601 - DNA, 75 bp, Homo sapiens
gtagatgacagcagaggaccagaaaggggcccagtatttccacctgggtagtagttggcttctgtgtgacatagc

SEQ ID NO: 6785602 - DNA, 75 bp, Homo sapiens
ggggatgggtgcccgcgcagccctgtgaaggaaagacaccatctttccgcacggaaactgcgtatacccctcccc

SEQ ID NO: 6785603 - DNA, 83 bp, Homo sapiens
tgtctttaaaacctgaaacttggctaccagcgttaaatattctaatattttagttatgtggcccaggatttgacaccaagaca

SEQ ID NO: 6785604 - DNA, 56 bp, Homo sapiens
atggcacaggagaggagggctgtttgtgcacgggcagctcctgcagctgctgccgt

SEQ ID NO: 6785605 - DNA, 56 bp, Homo sapiens
tccccattcagagtgatgcagtgagggccagatgtcttcctgctgtgtgaagggga

SEQ ID NO: 6785606 - DNA, 64 bp, Homo sapiens
aggttgcgcattctagttttgcacacctttccctctcctcgcatgtcctggagctgtgtaacct

SEQ ID NO: 6785607 - DNA, 67 bp, Homo sapiens
tagattcagataaattgttttgtgatgaggctggtaacctcattatatgaacccttatttatatctg

SEQ ID NO: 6785608 - DNA, 68 bp, Homo sapiens
tggtgtgggcttgcttattttctccaatgtcaatgctgtgcttgggggaagtaacagacacacacaca

SEQ ID NO: 6785609 - DNA, 59 bp, Homo sapiens
gcgaagaggagagacccacagccaggcccgtaggtagcagtggaatcttttgtccatgt

SEQ ID NO: 6785610 - DNA, 56 bp, Homo sapiens
ggaagttgcaaggggtggattaaggaaaatagcccgtctttttaattgcgatttcc

SEQ ID NO: 6785611 - DNA, 81 bp, Homo sapiens
caaagaccagcatagaaggaaagtcatttgaatctgaggatatggtttattagagttttctgtctgttgtgaatttctttg

SEQ ID NO: 6785612 - DNA, 81 bp, Homo sapiens
agagtggactggtgcgggaacacgtggccccggtgccaccagctggtcacagtggggtcacagtgtggtcactagctgtct

SEQ ID NO: 6785613 - DNA, 69 bp, Homo sapiens
gaagtcagaatttttgttacccttgagggtggaggtagtacttcgagggcgctgatagtgttctgtgtc

SEQ ID NO: 6785614 - DNA, 64 bp, Homo sapiens
ggagaatatctgtctctaatgcatattgtttaacactaaactgtatgcatttggcatattgtcc

SEQ ID NO: 6785615 - DNA, 82 bp, Homo sapiens
caatccaagtaatgattgttgcctggctttgaccttcagcacaacccctggaggcagtttaggcagcgatttatcaccattg

SEQ ID NO: 6785616 - DNA, 76 bp, Homo sapiens
ttacttgagcccaggaattggaggctgcagtgagctctaatcccatcactgcactctagcctgggtgacagagtga

SEQ ID NO: 6785617 - DNA, 60 bp, Homo sapiens
aaacagccatgtcagctttgcagctctcctaaacatttgatagactgaaatggcttgttt

SEQ ID NO: 6785618 - DNA, 58 bp, Homo sapiens
atctcaggccctagtgacctcacctataaatttggggtgggcagtgataggcctggat

SEQ ID NO: 6785619 - DNA, 56 bp, Homo sapiens
tccccttcctgagctacctgcccactgaggtcagcgctgggtggcaagcaaggggg

SEQ ID NO: 6785620 - DNA, 59 bp, Homo sapiens
tgagtgaatgtgtatcccttgtgatcagttatttgcatttgcagttacaccttcattca

SEQ ID NO: 6785621 - DNA, 56 bp, Homo sapiens
actctggagatggatgtcaggagtcattcaggttctgacattttctagtccaaagt

SEQ ID NO: 6785622 - DNA, 60 bp, Homo sapiens
attcttggggtgatgggcatgggggtggaggagatcacttctagagtcagctccaagttt

SEQ ID NO: 6785623 - DNA, 59 bp, Homo sapiens
ttccatgatgaattcagcattgaggaaagaacaggtaacctcagctgggttctcaggaa

SEQ ID NO: 6785624 - DNA, 87 bp, Homo sapiens
caccacgatgacatgagaggctgaagtgtacatgggtgaagagcactccatcatctctctacctcagtctccagaacttgtctggtg

SEQ ID NO: 6785625 - DNA, 67 bp, Homo sapiens
tctgacaaaagagaagtgtcatttcagttttgggctctccaaatttaaaatgatgtttcaaatcaga

SEQ ID NO: 6785626 - DNA, 59 bp, Homo sapiens
ttgtcatcaagatgcattggtcacattcactgagtgacactttgggtcttgggtgataa

SEQ ID NO: 6785627 - DNA, 85 bp, Homo sapiens
tgggcccactgtatcttccttgaatttacaaattctgcttctatgaaaaagcagacaaatcgtggaagacaccagtgggctacca

SEQ ID NO: 6785628 - DNA, 86 bp, Homo sapiens
ctcaaaacacagacctcctcactctcagagaacaagggtactgcatggaaaggcaggcccagagggtcaggagctgatgttaagag

SEQ ID NO: 6785629 - DNA, 65 bp, Homo sapiens
gcttcaggcagcgaagggcagtgggaggggagatattaacttgcctctggcctttggtgcccagc

SEQ ID NO: 6785630 - DNA, 75 bp, Homo sapiens
tgcttctccattgatgctaagtatgaagtgtcatttatattgaatctgcactagtatttttcttggagtaaagta

SEQ ID NO: 6785631 - DNA, 93 bp, Homo sapiens
tgcagcactttttgcctcctgacgtcacttcttagtctattttctgtgtctacactagtaggtcagacataagaggacaaggatgttgctgta

SEQ ID NO: 6785632 - DNA, 60 bp, Homo sapiens
cattaatgggatgaggtggaaagttggacacactacctcacagtctgcctttcccttgtg

SEQ ID NO: 6785633 - DNA, 85 bp, Homo sapiens
tagattttacttagttagacattttgcatgcaatagaattgttaacagtgaacttgttgccaaatgtaaaatatgtaaatattta

SEQ ID NO: 6785634 - DNA, 101 bp, Homo sapiens
gttattgttctgagtttattatcctattttgattttaataggcttctccttcttgctgagaagcctttgcctaaaacattaaataggtgagatgcaatgac

SEQ ID NO: 6785635 - DNA, 123 bp, Homo sapiens
gaattttgaaatctagttttctttaaagcaagacacacccatagcattagtttctccactacatgtgtcatctaagctttgggtgctcagttttctttcggggaatactaggggatgagattc

SEQ ID NO: 6785636 - DNA, 86 bp, Homo sapiens
gaggaaatagatgagaggtaacactgttcagtgggcacttttgtactaggtccagtgttggaggttttaccatcattatttcactt

SEQ ID NO: 6785637 - DNA, 85 bp, Homo sapiens
tgaaacgcgtttcttttcccatgtacattttcagacggtaaaagtgtttcgatttgtttgggggagaagtcaggcgctggtttta

SEQ ID NO: 6785638 - DNA, 60 bp, Homo sapiens
gggaaatgatgtatgtataaggcagggtttcttaactctaagtaaaatttgtcatttcct

SEQ ID NO: 6785639 - DNA, 113 bp, Homo sapiens
aatgaaatattttagtttaagactctaggacatttataaagctgaaatacattgcaaagtgatgaaagctttcttaaattctgttatagtcatgcaccttaaaattattcatt

SEQ ID NO: 6785640 - DNA, 62 bp, Homo sapiens
gaacttgtgcactgctggtgatcagcatccctttggaaccagttatgtgtgtacagaagttt

SEQ ID NO: 6785641 - DNA, 130 bp, Homo sapiens
taaaatatacacatacatgcataaaaaaagagtagatataaatatatcaatgtgccaagtgactttctacagtatggcattagcgttgaattttattttctttagagatatatgtatgaggaatatttta

SEQ ID NO: 6785642 - DNA, 75 bp, Homo sapiens
ttttgcctaaaaaacagcacagtatgtttgactttcagaaaataaacatccatctgagctgtcttttcagcagaa

SEQ ID NO: 6785643 - DNA, 94 bp, Homo sapiens
ggttaaaagcacagcctttgaagtcgagctgtctggatttggatcctcccttcacaattcaccagatgggttacttcaagcaagctgtttaacc

SEQ ID NO: 6785644 - DNA, 77 bp, Homo sapiens
ctgttttatttgtgtcacctacaacatataatctgttgattgaggtatgttgaatagatgaatggcaaagaaagcag

SEQ ID NO: 6785645 - DNA, 64 bp, Homo sapiens
gttactcaggctggagtgcagtggctattcacaggtgagatcctggtgcactacagcctggaac

SEQ ID NO: 6785646 - DNA, 63 bp, Homo sapiens
gtgagtgccttacttgatgatctgagggaacaggccccttatcttcacagacagagcaatcac

SEQ ID NO: 6785647 - DNA, 105 bp, Homo sapiens
tctcctcattttccaagggtaagaactagtcttacagcctcacccagatggaatggggtggggtggaaaaatgtagtctagttatatgccaggaaaaagaggaga

SEQ ID NO: 6785648 - DNA, 68 bp, Homo sapiens
ttggtagtctgttgggcaccatttgggaaagaaataaattggtctcagtgtagcagacttgtagccaa

SEQ ID NO: 6785649 - DNA, 68 bp, Homo sapiens
ggggacggaccgtgtgcagagacccacatttggaaccaaaggatagctctgtccacaggtttgtccct

SEQ ID NO: 6785650 - DNA, 70 bp, Homo sapiens
ttaatataaagatctggatttgattctggctcaaccactgattagctgtaaatctcagggaatatattga

SEQ ID NO: 6785651 - DNA, 79 bp, Homo sapiens
ccatttccaacttctgacctcaagaactgtcaagatgacacaattggcagtgatttgtttcagcagcaataggaaatgg

SEQ ID NO: 6785652 - DNA, 106 bp, Homo sapiens
caactagatggtgagcttcatgaaggtgggcccatgccctcgactacagtagccctccagtgttggcctcagggttgggcccattaaggatgcttattttaggttg

SEQ ID NO: 6785653 - DNA, 59 bp, Homo sapiens
aggaggtagttctacaacttggagcaagacatccatggaagttacgctattactctcct

SEQ ID NO: 6785654 - DNA, 64 bp, Homo sapiens
ctctggctctgacagttgatccaaagcacgctacaggaagcacactggttagctaaagttagag

SEQ ID NO: 6785655 - DNA, 65 bp, Homo sapiens
acagctggttatcagagaggcctaggccagaactcatgccagcgcctctcccatggctatcctgt

SEQ ID NO: 6785656 - DNA, 73 bp, Homo sapiens
gaattctatgatgtaaaataagttgtgagctttgagtaaaggccttcccacattccttacatgcatagggttt

SEQ ID NO: 6785657 - DNA, 63 bp, Homo sapiens
tcctggtgttgaacctcagcaggggctgtccctggcctgctgaaacagttcagctgaccagga

SEQ ID NO: 6785658 - DNA, 115 bp, Homo sapiens
gcaccccatggaagtttgaaagataactcatttccagctccggtgtgcttatttccagaacgtgagaagtggggagcccgtgaggcccctggagtttccttgtccatggatgtgc

SEQ ID NO: 6785659 - DNA, 88 bp, Homo sapiens
tttgttttgtttttaccgagtacttaaaaattatcaaagtggaaagctttttttacttgaatgttttgggtgtctggaataaagcaaa

SEQ ID NO: 6785660 - DNA, 60 bp, Homo sapiens
ggatgctgagggaaggcggcaaaagctgcagctgctgtgctgccctgccttcagctctcc

SEQ ID NO: 6785661 - DNA, 65 bp, Homo sapiens
gctcatcagccagcagatgctcccctcttgcacaaaactgagcagaggtgtcctgtagcttgagt

SEQ ID NO: 6785662 - DNA, 91 bp, Homo sapiens
ggctctgagaaggtctgcattgagagcttgtgaggcattgcttaacctgatgtctctgggtgattcagtcctggacctttgctgcagagtt

SEQ ID NO: 6785663 - DNA, 66 bp, Homo sapiens
ttcagggatatttagcatattgcagaggaagtgttatttcacgtcaatacactaaacttctctgaa

SEQ ID NO: 6785664 - DNA, 128 bp, Homo sapiens
gttctggcccagtgcttacagtgctgcagtgcggggtaccacagcaaccttcctgttttgtctcagacatggctactaggtacgttgctgttggtggctctgcaagtcctggaggctgagccactcac

SEQ ID NO: 6785665 - DNA, 69 bp, Homo sapiens
tgagttatgcatgagataaaaattggcagccatccttgtgctctcagctcttggttatgcatgaatgca

SEQ ID NO: 6785666 - DNA, 67 bp, Homo sapiens
ctttaagtggtcagagataatttgggacacatggatcccaagataaacaatttctactactataaag

SEQ ID NO: 6785667 - DNA, 121 bp, Homo sapiens
tattatatatccctgaaatctaaagtggataacacatgtggagagagaatgacttatctgattaaaagaatgatgtcattttaatttctaatcaatgtgttggttactaggatgtatagta

SEQ ID NO: 6785668 - DNA, 58 bp, Homo sapiens
cacagttcctgaatatatcacatgtggtgataaacatgaagatgtatgaaaaattgtg

SEQ ID NO: 6785669 - DNA, 109 bp, Homo sapiens
tgtgtgccgtcaccacgtgccatgtgtacacacgtgccaggcgctgtcttgagacattcgcgcagtgcacggcactggggacacgtggcactggctgaactgccacaca

SEQ ID NO: 6785670 - DNA, 67 bp, Homo sapiens
ttgagaagttctaattggctcttttcttgtaacaacacccaaaggaaaacagcaattgacttttcga

SEQ ID NO: 6785671 - DNA, 88 bp, Homo sapiens
cgtttcaaacactgacattctaacattgtacagatatgtttagatgaggtgcctgaactaagagttgggaaatcaggtttctgagatg

SEQ ID NO: 6785672 - DNA, 129 bp, Homo sapiens
ccttgacatgtggcgttacatgaaagtcagtgtggcacgtgttctgtggcatgggtgctggcatcccaagtagcaggatacatgattgttggtctatatatgacacatgacaaatgtccatgtcacagg

SEQ ID NO: 6785673 - DNA, 80 bp, Homo sapiens
cctctgtaaggtttccgaaatcaaacttgggcttctggctagccttttctaggtcttgatttttcagtgctttccagagg

SEQ ID NO: 6785674 - DNA, 66 bp, Homo sapiens
ctttcaggacaggccttccacaggctgctgacagcactgcagggatgtgaggcccgttcctgggag

SEQ ID NO: 6785675 - DNA, 68 bp, Homo sapiens
tggctccaggaattcataacagctatgtggcaaccacctgtctgaatcatgatttcctgtttaagcca

SEQ ID NO: 6785676 - DNA, 56 bp, Homo sapiens
ttcactctcccacagtttaccccaggagtccaacaggcagagtgtgagagggtgaa

SEQ ID NO: 6785677 - DNA, 55 bp, Homo sapiens
ttcttcaatgtgccctgttttcttttattggagaatagttttagaaattggagaa

SEQ ID NO: 6785678 - DNA, 82 bp, Homo sapiens
aagtctatggtcaaagataaagtgatcttagaaccaagcctttaaactactgagatcactgaaatactttgccctccttctt

SEQ ID NO: 6785679 - DNA, 57 bp, Homo sapiens
gggggccctctcagtctgtgtagccctgtctcaaccgcacacatgaggagggacccc

SEQ ID NO: 6785680 - DNA, 75 bp, Homo sapiens
ggcaccatcttttggaggggaatttagcagcgtgctgacactctgacccagcaattccccttctaggaatctgtc

SEQ ID NO: 6785681 - DNA, 61 bp, Homo sapiens
ctctgtttggggtgaggtactctaagctcttggacatgagtgatgtcacccacagacaagg

SEQ ID NO: 6785682 - DNA, 60 bp, Homo sapiens
gctacaaactgtcatggtgcttaaaggagtgggtgccaaatgacttgtatgtttctgagc

SEQ ID NO: 6785683 - DNA, 63 bp, Homo sapiens
tagttctagggcatcatcccagacattattttgagaatctctgtggtgaggccctagaatctg

SEQ ID NO: 6785684 - DNA, 120 bp, Homo sapiens
atgaagtaagggtgtgtatgtccagcaacacagctaatttctgtcaattggccaatgctcaacaattgacaaattagtagactgtgcttgagttgacacttttacaatccagtgcttcat

SEQ ID NO: 6785685 - DNA, 57 bp, Homo sapiens
gaggggagaggcttatggatcaagtcccatattcttgctgctgtaatctctctcctt

SEQ ID NO: 6785686 - DNA, 68 bp, Homo sapiens
ggtgtctttaagttgtaacagattctaacataatttgacttgtgggtagaagttacgatgggtatgcc

SEQ ID NO: 6785687 - DNA, 90 bp, Homo sapiens
tcacccaggaacttgttagaaaggtagaatgttgggtcctacacagacctgctgatgtgggatctgcagtttaacaaaatcttcaggtga

SEQ ID NO: 6785688 - DNA, 77 bp, Homo sapiens
gtgtattgtcctaggagacacaatctcatttacatttattagaagtaatgatatcgtgtcctgcagataattaacac

SEQ ID NO: 6785689 - DNA, 64 bp, Homo sapiens
tggtgagtgtttggggggagtgacttttaagcaccaaagagagcattctctccaacatttaaca

SEQ ID NO: 6785690 - DNA, 84 bp, Homo sapiens
ccccaggaccttctctcgttggcgagtcgatggtgcgggcgcgcgcccgctaggcctccggtcgcgcagtccaggaagtggagg

SEQ ID NO: 6785691 - DNA, 86 bp, Homo sapiens
tggggagacctaggctctagatgtggtctttgccccaattcacagtgcaacagagggcaagacatctctatgggcctgtttcccca

SEQ ID NO: 6785692 - DNA, 77 bp, Homo sapiens
gtttttaaacagaggaatagtgatgcttaaattttcatcttaagcagatgctttaaactgttcatctgttcagaagc

SEQ ID NO: 6785693 - DNA, 63 bp, Homo sapiens
ggtagagctccctgcctacacggaccttccattatagaaggggaggcaggcagagctagtacc

SEQ ID NO: 6785694 - DNA, 80 bp, Homo sapiens
tttcctcagaatgggccttcctgtcccacctgggagtcaagagtggggccggagctgtcccagaggattctgcaaggggg

SEQ ID NO: 6785695 - DNA, 129 bp, Homo sapiens
taaccagtcgtgaagattcttgttagtggggcacttatgatgtgccacatgctttacgtgaattatctcctttaactttcacagtggcccaacaatacagtgcctattatcatccttgcttcatgaaga

SEQ ID NO: 6785696 - DNA, 64 bp, Homo sapiens
gtgccagagtttgaggacaattttgtatgacttactggttccattctgttgttcttgtctgcac

SEQ ID NO: 6785697 - DNA, 74 bp, Homo sapiens
tttgtgttgtgttaccattgtctaggtcattgttacttaagtacagtacttgccatatggtattcaagtacaaa

SEQ ID NO: 6785698 - DNA, 57 bp, Homo sapiens
gtgtctgccttctatttagaaagaaagttaatctttttgaatctgatatggcagcat

SEQ ID NO: 6785699 - DNA, 82 bp, Homo sapiens
ttggagacagcagcttcctgactgtactcatttacatggctaatcaccatgagcagcacttgtcaggcagctctatctgtag

SEQ ID NO: 6785700 - DNA, 91 bp, Homo sapiens
gcacagtggcagggttccaattccttatggcagtgagtgtgaagacatttctgcatgtagggtaatatttatggctttgtcagctgttggc

SEQ ID NO: 6785701 - DNA, 76 bp, Homo sapiens
tcgctcagtcgcccaggctggagtgcagtggggcaatcttggctcactgcaacctctgccttccgggttcaagcga

SEQ ID NO: 6785702 - DNA, 56 bp, Homo sapiens
ctagattcaaggggaaggacagtaggaggaaatgccaccattcctctagaatttgg

SEQ ID NO: 6785703 - DNA, 60 bp, Homo sapiens
gcttagcacagaatgagagttctaacttactgttgttgctattatggctgttgctgttgc

SEQ ID NO: 6785704 - DNA, 69 bp, Homo sapiens
gtgcatctatttggtaagatatgttacacaatcattgaaaacaatgcttgccaagtgtgataaaaacac

SEQ ID NO: 6785705 - DNA, 57 bp, Homo sapiens
tgccatgttgtcaaaattcagtcttcatgttacattacatcttggcagcatctggca

SEQ ID NO: 6785706 - DNA, 64 bp, Homo sapiens
attctttgcatttttgagcacgaagttgagtggtaattttgtaattttgaaagtagccaaggat

SEQ ID NO: 6785707 - DNA, 75 bp, Homo sapiens
tattagtttggtgcaaaagtaattgtggttcttgtcgttccttttaatggcaattactgttgcaccaacctaata

SEQ ID NO: 6785708 - DNA, 57 bp, Homo sapiens
ctgggccctggaccctccagcttagacctagcactgaggtgcagagccagggaccag

SEQ ID NO: 6785709 - DNA, 130 bp, Homo sapiens
cacaaagctgaagtagggattgctctgcctaaattatgcagctgcctccaaggtttccaatagagcattgatgtagcctggcagggagattgtaagaaggcaagaacaactgttctggttagaactaatg

SEQ ID NO: 6785710 - DNA, 71 bp, Homo sapiens
gtatgtatttagtataatggggcaaaagtattttagggggctaaagtcctattagcatattgaatacacac

SEQ ID NO: 6785711 - DNA, 64 bp, Homo sapiens
ctatgctttgatttcctcagctgtgagttgtgaacaatgcttgttgttgagagttagaacatgg

SEQ ID NO: 6785712 - DNA, 91 bp, Homo sapiens
acctcccaaattatttatcctcttggtctataaaccaaggtctcaatctcagatggtccagggaggaggtgaatatttctgctgaggaggt

SEQ ID NO: 6785713 - DNA, 55 bp, Homo sapiens
tccctcctgagcatccccagctgctccacatcagtgccagggagatcaggacgga

SEQ ID NO: 6785714 - DNA, 86 bp, Homo sapiens
tgaagatctaaatatggttatgtaatcagttgttcagacaagagaaacgtagattaattgaattagataatcccagtggtctctca

SEQ ID NO: 6785715 - DNA, 87 bp, Homo sapiens
ttcactctagtgctttatggctttttattcctatgtgatagtaataaagtctcatgtagggatggaagccatgaaatacattgtgaa

SEQ ID NO: 6785716 - DNA, 65 bp, Homo sapiens
tttaggggacaccatactcatgttggttccacaccagtgcaactgaacatgtgtgtggccctgga

SEQ ID NO: 6785717 - DNA, 69 bp, Homo sapiens
gggcggctgaggctggcgtttgaggaagcccggaaatgggcctctttcaccgtgcctgtcccgctggcc

SEQ ID NO: 6785718 - DNA, 55 bp, Homo sapiens
ggtggctcacacctgtaatcccagcactttgggaggccgaggcaggtggatcact

SEQ ID NO: 6785719 - DNA, 61 bp, Homo sapiens
ttcctgcttctcgaggtgcagactgcatgaagcccgtggaagatgcccagaaaagcaggga

SEQ ID NO: 6785720 - DNA, 64 bp, Homo sapiens
tagtggacacagcactgtacaaggaatagaggacacctgggtttcagtgtagtctgtgctatta

SEQ ID NO: 6785721 - DNA, 72 bp, Homo sapiens
ggacaggttcttttggtagagtgtgcatcttgttcttttggtagggtgtgcatcttggtaatggagctttcc

SEQ ID NO: 6785722 - DNA, 84 bp, Homo sapiens
gagtgtttcccaaataagattgttgatagcactttagcaaaagtcctctcacactttgcagagatcagcaggtttgagatactc

SEQ ID NO: 6785723 - DNA, 85 bp, Homo sapiens
gtatgttcacatctactgaatgagcagtgttgatgggcagacttgagctttgttacattcctcatttcagtgaatgtgtatttat

SEQ ID NO: 6785724 - DNA, 58 bp, Homo sapiens
tcagtaaaataaaacatgggaccccacagactttcagggtcttatgaaaattttttga

SEQ ID NO: 6785725 - DNA, 85 bp, Homo sapiens
actttttttctccttgttttgatctgaaattgcattagtattgctttggggatgctgtagatgagaacattggaccaaaaaaagt

SEQ ID NO: 6785726 - DNA, 58 bp, Homo sapiens
cagaacaggtcatgcttgctgtgctagaatatagaacggcaggccctaagcctgtgtg

SEQ ID NO: 6785727 - DNA, 64 bp, Homo sapiens
tagtctattccctcctaattaggctgtacttaagtgaactatttcggaaggggaaaacagatta

SEQ ID NO: 6785728 - DNA, 83 bp, Homo sapiens
catttggttggattaatatatgtactctaatttgtctcattgatctcctgtcaatagatatttgagttgtttccaattttgtg

SEQ ID NO: 6785729 - DNA, 70 bp, Homo sapiens
gaggttctgggctgtgccctcagcctttcctacatcctgcagtggcccttgaagcagcttcatgaacctc

SEQ ID NO: 6785730 - DNA, 82 bp, Homo sapiens
gagtatctctgttcttacggaacttatcttttaaggtattgaatttaatttgctttttagaaagttgttcagtaagaaactc

SEQ ID NO: 6785731 - DNA, 130 bp, Homo sapiens
ctgtagagtctctcttttacagggatagttgtgattggattaagggcccactctgaataatcccatttcaagatccttaatttaatcacatccccgaagatcccttttccttatcagataaaatttacag

SEQ ID NO: 6785732 - DNA, 73 bp, Homo sapiens
aggtcctattctggcaggcacaggaatgtcagaacactccccagataccatgtgccaagcttagaaagaacct

SEQ ID NO: 6785733 - DNA, 65 bp, Homo sapiens
agtgaagggtccaaggctttgcgtttagcactgctacttagtggctatgtgaccttaaaatcact

SEQ ID NO: 6785734 - DNA, 63 bp, Homo sapiens
gagggcactgctttcctttcaaaatgtagggttcaaatccgatgaaggggtggcagtgtgctt

SEQ ID NO: 6785735 - DNA, 60 bp, Homo sapiens
cagccctgccatggagcctcctgaagactccactctttgcaggtctgaatgtcagggctg

SEQ ID NO: 6785736 - DNA, 110 bp, Homo sapiens
agggagggcagcagcaggggtccatgctgcagctgcaggatcagatgtggttcgttaaatcagttcaatttttgaaactgtcagcttggcttgcctcaatgccccttcct

SEQ ID NO: 6785737 - DNA, 67 bp, Homo sapiens
atacatgaatatacatcctgatggcaatatgaaatgaaatacaggcctcttgtgtgtatgcatgtgt

SEQ ID NO: 6785738 - DNA, 76 bp, Homo sapiens
tcaggaagtcaccagtggaattaaaaataagtgcatttttgtgtgacatattttcagttttacttgcgctttgtga

SEQ ID NO: 6785739 - DNA, 81 bp, Homo sapiens
ctacatggtgttcttcactgatgggacagctcaagaatattttcaattctggtttctgtgtcagttgacaaatacatggag

SEQ ID NO: 6785740 - DNA, 60 bp, Homo sapiens
gctgaggaccagtgagtctggcaagtggtaatgcccactgcctgtgcactggtcttttgt

SEQ ID NO: 6785741 - DNA, 116 bp, Homo sapiens
cttgggatggacacagatatacataggtttctatgcatggtagcagaaagttgagggcactcttgtctggaatttctattttgtctgtaagatattaggtgtggtcacattctgag

SEQ ID NO: 6785742 - DNA, 84 bp, Homo sapiens
gcatacggctctcttacaggtgagaccttccacgttacctgcagagcagccacctgggagtcacacctgagaaagagcagaagc

SEQ ID NO: 6785743 - DNA, 93 bp, Homo sapiens
tattctaagcagccttctctgatcactccacagggactgcttctgtcttctagagcatctctgggagtcatccgtcacttggcacttagcata

SEQ ID NO: 6785744 - DNA, 58 bp, Homo sapiens
ggaatttcacaccccaccccatcctacccttaaggtgccctggaggggttgaagggcc

SEQ ID NO: 6785745 - DNA, 118 bp, Homo sapiens
aattccctatccatcttcctacacactttcatagcctttgtcgtctgagggaaaaagaaaggttttcatcatgccagttaaaggctgtgaatgtgacctagataattcttggggaatt

SEQ ID NO: 6785746 - DNA, 55 bp, Homo sapiens
gcctgcagctgttgcctggaaaaggagctggctcctagcaacagtatcagcaggc

SEQ ID NO: 6785747 - DNA, 127 bp, Homo sapiens
cctaataaattacattatttttttcctgggatgaggaaacaaggacagagttgaaacaccttcccccagaaatgtgcttgcctctctcagaccacaggtaagggcttaatatgatgtgagaaagagg

SEQ ID NO: 6785748 - DNA, 95 bp, Homo sapiens
tcaaggatacttgagtagaactggttatctaatattatacattttatatattgggtaaagatccagttttcattcaagcacatatatttccttga

SEQ ID NO: 6785749 - DNA, 60 bp, Homo sapiens
gtggtggtgtttggggcgggagagtgctaatattattccaaaatcccaaactgccaaaac

SEQ ID NO: 6785750 - DNA, 82 bp, Homo sapiens
ggtatgatggcactataactgatttccctgttacccaccagcatgaagggcatgaagacagggaacttcattagctgtcccc

SEQ ID NO: 6785751 - DNA, 56 bp, Homo sapiens
gcagagccatcatgatatggagtgccataagaggaagcccacatccatggctctgt

SEQ ID NO: 6785752 - DNA, 109 bp, Homo sapiens
tcttttaagtaatcatttacaactgttggagtctatgcaacttttagtgggagtgattagtaaatgcacttacactttaaatccagcttgtttcctaagatttaaagga

SEQ ID NO: 6785753 - DNA, 69 bp, Homo sapiens
taagagcccagttctatattgtgtttaatggcaaacgtccatgcaacacaaagaagctgcaggatctta

SEQ ID NO: 6785754 - DNA, 114 bp, Homo sapiens
gacttaatgtaacttcttcagtaaagcacagtatgagcattgggaaaaatcggagctactcaatccatcactcagttcaaactgtatgtttcactgatgagaaagctatgtgtc

SEQ ID NO: 6785755 - DNA, 69 bp, Homo sapiens
ggcaggccttgggccatagtctcctgcatccctccagagcctgcagcaggagctgggcccaaggatgct

SEQ ID NO: 6785756 - DNA, 65 bp, Homo sapiens
gagtccctgaggctctcctgaataatggccaccacagcaggccttgactgaatgcctctggactt

SEQ ID NO: 6785757 - DNA, 66 bp, Homo sapiens
atgatgactgcacaactagggcgtttgatagtttgcttgctatcaattattttgtgcagttaacat

SEQ ID NO: 6785758 - DNA, 83 bp, Homo sapiens
gcatgttgaatcttctctttctgctgggctggaaggattatcttactgtgcttcccatgttctgggaggagaaatacaacagc

SEQ ID NO: 6785759 - DNA, 60 bp, Homo sapiens
gagggtgttcctgtaaaggctgctgttataatgatagcaccaaaactgaagaacatgctc

SEQ ID NO: 6785760 - DNA, 117 bp, Homo sapiens
ttcctagtggcacccactccccagagctgggggagggcgtcagaagctgggggggtttgtgcctttaactccagctttagctctccagggtgggaggagtgggttggacataagggg

SEQ ID NO: 6785761 - DNA, 90 bp, Homo sapiens
gtgttccagttctctgtgacagctgctctatatctcagccttcaaagtgctgggtctgagagcagctgaacagagagaagtctgtggtgc

SEQ ID NO: 6785762 - DNA, 58 bp, Homo sapiens
cctctgcaccatagccttcagcaaatgctgctggaggaggctggaatggatgtaaagg

SEQ ID NO: 6785763 - DNA, 77 bp, Homo sapiens
gctgttgctgccccctcttgtgggctcaggtcagcacaggtaatctgcaggactccaggggaggggaggaagacagc

SEQ ID NO: 6785764 - DNA, 76 bp, Homo sapiens
acaaggttaaatcgtcttaagcacactgagaactgtgttagcagtgggcctcagtttccttaggatgtctctttgt

SEQ ID NO: 6785765 - DNA, 61 bp, Homo sapiens
tttcccatggcagaagccctgtgtttttgctggcaatggggtgtttgtgctgcctggggaa

SEQ ID NO: 6785766 - DNA, 120 bp, Homo sapiens
cagaaattctttgcattatatgtatatgtggtcatttacatgtggccagaaatttgagagaaaccctttcagcatttcttgagctcatggagaaatgatatacatggcagcagaaatctg

SEQ ID NO: 6785767 - DNA, 68 bp, Homo sapiens
caggtgaatttgtgactggccttttgctttcttgggaggagagacacaggcattataaatttcacctg

SEQ ID NO: 6785768 - DNA, 59 bp, Homo sapiens
aagttgcatagctgcaaggacgactgggaaatatatttattctgggcagccatgtactt

SEQ ID NO: 6785769 - DNA, 60 bp, Homo sapiens
gggcctggaaagattgcagttgctgtccttgtggatgcaaagtaacgttgttccctgctc

SEQ ID NO: 6785770 - DNA, 81 bp, Homo sapiens
tattatgccatgagtcatttctctagtccattctgagacactgataaaaaagatttgtgatagaaatactttggtataatg

SEQ ID NO: 6785771 - DNA, 83 bp, Homo sapiens
ggggtgaacccggcgggcactcagggtcgaggtgggggccatcactcccttgagccctgaggtccctactggagggtcacccc

SEQ ID NO: 6785772 - DNA, 79 bp, Homo sapiens
gatacatacacccttcattgttgggttacatgaggtgataccttaacaagtgatatataatggaaggaaaaagtgtgtc

SEQ ID NO: 6785773 - DNA, 56 bp, Homo sapiens
gggagcaggtggcaatgtggcagcaccttgaactgtgcatcactgggcctgctccc

SEQ ID NO: 6785774 - DNA, 72 bp, Homo sapiens
gctgaggataacttgctgttagtcagctgtgattgttacagtgcagctattacaacagtgtactttcccagc

SEQ ID NO: 6785775 - DNA, 80 bp, Homo sapiens
ggtggcgccgggtgacgccaggtgatgccggggctgcgcgggtactgcagccttccgtggacctggacacgcgtgcaacc

SEQ ID NO: 6785776 - DNA, 118 bp, Homo sapiens
ggaggcaagaacgagcatctgctatgccgcagccggatttcccccatctcagcaggagaggggagaggtgagggtgcaggcgttctgggcaggtcagtgcagttcgatgaacgcctcc

SEQ ID NO: 6785777 - DNA, 84 bp, Homo sapiens
gacactttccttcaactatttaagaataaaaggggcaacaaaaatatactgtgcctcagttttctcagatatgaaatggtgatc

SEQ ID NO: 6785778 - DNA, 99 bp, Homo sapiens
ttgagtcaggagaaacacaagcccaggtggcagaggtttcagtgagctgagatcacaccattgcactctagcctgggcgatggagcaagactgtctcaa

SEQ ID NO: 6785779 - DNA, 61 bp, Homo sapiens
agccctgctgtgtccctggctttctctcctggctggggggatggaagggacaggcaggact

SEQ ID NO: 6785780 - DNA, 111 bp, Homo sapiens
ccagtagaaatggaaaggagaggacacacatgaaagacattaaggtgagaaaattagctattttcactaatatttccctttagtgcattctttactttaataatcagctgg

SEQ ID NO: 6785781 - DNA, 70 bp, Homo sapiens
ctgtagtccttatgtcataatattgttgtgaaaattacttgacagaatgcattgacgtacgatggctcag

SEQ ID NO: 6785782 - DNA, 69 bp, Homo sapiens
atggagtaattttcttaaaacatcatgatggccgaaataatggtgatgccatagtaaaatttgcttcat

SEQ ID NO: 6785783 - DNA, 106 bp, Homo sapiens
aggttgcattaatttatactcccacctgcagagtacttcagggtctcatccattctttgaagccattactgtgttagggggcactgtctttattcatgaacagcct

SEQ ID NO: 6785784 - DNA, 66 bp, Homo sapiens
ctgatgttctcttttgctgttgatgtatccaggccatttgcagggaacagaaagagagaatgtcag

SEQ ID NO: 6785785 - DNA, 69 bp, Homo sapiens
gagctctcaactcccatcgtggctacagagcctggcctctgtccatctcttgggagtgaccttgggctc

SEQ ID NO: 6785786 - DNA, 76 bp, Homo sapiens
tgtgttgtgtggggtttttttggtgtgtgtgtgtggaatgacagatacatatagaaaacatcaacaaagtgtcata

SEQ ID NO: 6785787 - DNA, 110 bp, Homo sapiens
cctggatttggggttgtcaccgctgctctatgtcctcacccaggggtagctccaggctggagaccccttgggaggggtcatgtgggctctggtccacccccacctcgagg

SEQ ID NO: 6785788 - DNA, 55 bp, Homo sapiens
tgcttctttagccatactctagtgcagctgtttaagatcctgtggctgagaagta

SEQ ID NO: 6785789 - DNA, 56 bp, Homo sapiens
accaaacattttaaataagggatactcaaccggtatctgttctctgagtgtttggt

SEQ ID NO: 6785790 - DNA, 82 bp, Homo sapiens
gtgagagttagcattttctgggctgaaataaaggttctgaagttataaccctccgtttcccctgggaaggtgctttgctggc

SEQ ID NO: 6785791 - DNA, 67 bp, Homo sapiens
accagattgagattgtgttttcaaaaaatacagcttcactggaaagaaatcactgtccaatcttggt

SEQ ID NO: 6785792 - DNA, 58 bp, Homo sapiens
gcaaggctggccttaatgatttttgggagtggtccaaatagagataggccagctttgc

SEQ ID NO: 6785793 - DNA, 63 bp, Homo sapiens
ccagctcctgaaagctttgcttctaagagtgtgcacctttgaaagctactttcgggtcactgg

SEQ ID NO: 6785794 - DNA, 65 bp, Homo sapiens
accagaccgggctaatttttgtatctttagtaaagagagggtttcaccatgttggccaggctggt

SEQ ID NO: 6785795 - DNA, 88 bp, Homo sapiens
ctcaagtggtaattgtgggtaaaacaagatttagcaatttggagagactagggagtagatcagtttttgtctataagaatcacctggg

SEQ ID NO: 6785796 - DNA, 55 bp, Homo sapiens
cagcagcccacgcgtgctgtccagccgtccctgggcatcccgcatgtggttgctg

SEQ ID NO: 6785797 - DNA, 100 bp, Homo sapiens
ggctgttgtaaagaggaatgtcagtgacattacagcagtgcctctcattggagtaagcacacatgtgagtgtcctttcttcctcctttattcctttagtt

SEQ ID NO: 6785798 - DNA, 68 bp, Homo sapiens
ccagactttcaagcaagaacactttgagatgataagtcttgtattgttttaggctatgaagtttctgg

SEQ ID NO: 6785799 - DNA, 71 bp, Homo sapiens
aggtatattgaatgcttacttaatatatcaaaaattgtatgatatgggcaaaaataggcatcaaattacct

SEQ ID NO: 6785800 - DNA, 75 bp, Homo sapiens
ggaggcctggccagaggttcctctgccctaagaaccctcaaggagtagcaggtcacctgtgtgtccaggctggcc

SEQ ID NO: 6785801 - DNA, 66 bp, Homo sapiens
tctggtcagctctcttatccatgaggtgaaaaaaatgcaccttatatcataggagtgttggaaaga

SEQ ID NO: 6785802 - DNA, 77 bp, Homo sapiens
agcatcacctacaggattaataaaaaattgtatcataatattgatgatgtttttagaagtccacaaaggagattgct

SEQ ID NO: 6785803 - DNA, 74 bp, Homo sapiens
ttcagttcatcagttgtactagccacatttaaagtgctcagtagccacatgtggctggtgactgccgtactgga

SEQ ID NO: 6785804 - DNA, 86 bp, Homo sapiens
tgcccgtttcctctgtaacatgtaggagagtcacaatgcccacaccacgtggatgtgttaggaaccctagtagcagagcacgggta

SEQ ID NO: 6785805 - DNA, 73 bp, Homo sapiens
ctatgagattttaaaacttcactttatggggagactttaacaccatcgatgtagagggacgaaatcgccatag

SEQ ID NO: 6785806 - DNA, 60 bp, Homo sapiens
ttactgatcccccaggtgacccacagcgggaaattatacttcaactggcaggattagtag

SEQ ID NO: 6785807 - DNA, 68 bp, Homo sapiens
tcaagcatgcatgtctgccagttgcttaggtagctgatctaaatgggttggaggcagcaaagctgtga

SEQ ID NO: 6785808 - DNA, 77 bp, Homo sapiens
atgtttaatttgccttcaggctagtttctggactgaacacaatttccttcaggctctgagctgatgctaatttgcat

SEQ ID NO: 6785809 - DNA, 80 bp, Homo sapiens
caaatatggccctatttggaaatagagccttggcaaatatagtcgagttctactcaatttaggtgggccctaatccagtg

SEQ ID NO: 6785810 - DNA, 77 bp, Homo sapiens
gagggtgagaccagatttcaaagttttccttcttctagaacttagaagaaggaagtgtggacatcactatcatcatc

SEQ ID NO: 6785811 - DNA, 85 bp, Homo sapiens
gagatttcatatatacatttttcaatccttatataatgccttccatataattggtggcttataaaggatgatggcttatggtctt

SEQ ID NO: 6785812 - DNA, 86 bp, Homo sapiens
gtcatgtcttagtttataatggcaaagggaatttattaagggagaattatttgacaggaatctttttgttattataagttacatgc

SEQ ID NO: 6785813 - DNA, 64 bp, Homo sapiens
tcattcagaattgcttggtctctgtctcctgaagactgtggctaggattattcctgatgaatga

SEQ ID NO: 6785814 - DNA, 79 bp, Homo sapiens
cagcgactccaaagcataggtggagattagtgttttcagccaactaacgaagcatttattgacctgctgctgagtactg

SEQ ID NO: 6785815 - DNA, 62 bp, Homo sapiens
gttcatgtggaaatttaaaacattatttgaattttatgtgttttaccttcttccacctggat

SEQ ID NO: 6785816 - DNA, 55 bp, Homo sapiens
tgttttccctggaaagaagtttttgtaaccctcagactctttagaagggaaaaca

SEQ ID NO: 6785817 - DNA, 121 bp, Homo sapiens
ccaactagctctgtgagcaaaaggcatataaagccatttctgctgtatttgcttggtatgacttccatttaagtgagatctgaaatgaaatgctttctttgtgttctcagtgtgaaattgg

SEQ ID NO: 6785818 - DNA, 65 bp, Homo sapiens
tctcactgtcctgggtccctgctagaaggcggtctgctttccagcacacgctccggatagagagg

SEQ ID NO: 6785819 - DNA, 89 bp, Homo sapiens
gtattagggtgggagtgtcccgattttccaggtgccgtctgtcatggcggcttccctttgctaggaaagggaattccctgaccccttac

SEQ ID NO: 6785820 - DNA, 87 bp, Homo sapiens
tctcatgcaaggctattaatagtgcctatttaagatttttaagaattcacttgatgacattaatggcaaattaattattgcagaaga

SEQ ID NO: 6785821 - DNA, 62 bp, Homo sapiens
gggccttccagtgatatgcgtgaatcagcattagatccgcttatctcagctggcaggagcct

SEQ ID NO: 6785822 - DNA, 57 bp, Homo sapiens
gcatcagtttggaacattcaggcctgagcgttcaggacggatgaagccgactgttgc

SEQ ID NO: 6785823 - DNA, 110 bp, Homo sapiens
cctaattaaacatatttctgttcctatagtgaaatttatgcacagctacacaaattgggtagtattataaatagacttcaatttattcaggtagagttatgttgactagg

SEQ ID NO: 6785824 - DNA, 77 bp, Homo sapiens
ccttcaaatataaagtctgaaagataagagtgatataatcaaatgtcaattatgtctgtagactctgtacttgtagg

SEQ ID NO: 6785825 - DNA, 92 bp, Homo sapiens
ggtttcacatattagctttacttgaaagcctttgatttagccctctacctgaggactgaacttcgatgtaaagctgggcactttgtgaagtc

SEQ ID NO: 6785826 - DNA, 62 bp, Homo sapiens
ctggaatgtcagctacaagagggcagggactgtggctattttgttctctgctacattctcag

SEQ ID NO: 6785827 - DNA, 63 bp, Homo sapiens
taggagcatgtgagatactggaggccacagaagaaaagacttctagtgtttcatgtgctttta

SEQ ID NO: 6785828 - DNA, 85 bp, Homo sapiens
gatttcaagagaaagattagaccataaagagttcaatggagaaagcagtatctccagctttggctctagctacacttttgaaatt

SEQ ID NO: 6785829 - DNA, 118 bp, Homo sapiens
tgagtaccataacatggcttcacaatctacactggcactgtgtttagatgggattggagccaaataattctatttgaattgtcacaggctaaagagaaaaagaatagagatggactta

SEQ ID NO: 6785830 - DNA, 74 bp, Homo sapiens
ctgtgaatactggcttcacctccccaggtggcttcacggagcagacgagaagggagatggagtggattcagcag

SEQ ID NO: 6785831 - DNA, 66 bp, Homo sapiens
ggtcatgttgaatggccttgatttttttcagtaaagttgggggaaggcaaggtcattctacagact

SEQ ID NO: 6785832 - DNA, 67 bp, Homo sapiens
ctatggtgtctggccagaaagacttgatgtctaaaattagacatttggagactggttagaggcatag

SEQ ID NO: 6785833 - DNA, 60 bp, Homo sapiens
aagcccactgagttacctttacaccattccctgccatctaaagcaattactcagtggctt

SEQ ID NO: 6785834 - DNA, 62 bp, Homo sapiens
cgctacatgcccttgatgtgaaagtcattcccatatggagtcatcatctgggcttgggggtg

SEQ ID NO: 6785835 - DNA, 70 bp, Homo sapiens
cccatgcttagggctcctccaatagatcataaacgaatgcttggtcccattgtttgctctaggctgaggg

SEQ ID NO: 6785836 - DNA, 72 bp, Homo sapiens
agcattcccttctgggaaaagggagccttatgtagttcacaaaagtcctttatcctaaaaggtccaaaggct

SEQ ID NO: 6785837 - DNA, 59 bp, Homo sapiens
cctggggccacaacggcgcacgcgcaaaaactccatcgcgcgcatgcgcgtgcctcggg

SEQ ID NO: 6785838 - DNA, 61 bp, Homo sapiens
ggctaagatctcttccagcctgaaatttcctcaactcgaaggcaggaatgaggtaatggct

SEQ ID NO: 6785839 - DNA, 65 bp, Homo sapiens
gcactttcagacattacagctttactgaggaacataactcagatttttgagatgtctgtttgggc

SEQ ID NO: 6785840 - DNA, 65 bp, Homo sapiens
gtctgggtcctggctttgtcagggtttctgaatgatgaaatctgtgggctctcaggatcacagac

SEQ ID NO: 6785841 - DNA, 59 bp, Homo sapiens
gtttgatttctaatagtgttgactaggaattccaagtctttaacatttggagattgaat

SEQ ID NO: 6785842 - DNA, 59 bp, Homo sapiens
ggctttgtggggtgaagtaaagggaatgaacgtgggtcctcagcccacccttaggagct

SEQ ID NO: 6785843 - DNA, 83 bp, Homo sapiens
gatatttcaaagtaaagctatacatcttttcttggcccagagaggagctacaaagaaagtatactggacgttggaaatgtatc

SEQ ID NO: 6785844 - DNA, 76 bp, Homo sapiens
tggaagacgagggaaggcatcacagaggctgtgaggtgaaccgacttcaaggaatgggtccttcccttcagagcca

SEQ ID NO: 6785845 - DNA, 66 bp, Homo sapiens
ggtttttgcacttaacttatttgaaattgattgcaatttaaagatgcagttatgtgctctctaacc

SEQ ID NO: 6785846 - DNA, 59 bp, Homo sapiens
gcaggtggggcaacccagagccatgggggctacccatgggaattgggaggtcccaaggc

SEQ ID NO: 6785847 - DNA, 74 bp, Homo sapiens
aggcccagagggcaagtgtagtccagtagaaaacctccatcttggctcctggagataatttgcattgtgggtct

SEQ ID NO: 6785848 - DNA, 74 bp, Homo sapiens
tgctctattgcctaggctggagtgcagtgacacgatctcggctcaccgcaacctctgcctcccgggttcaagca

SEQ ID NO: 6785849 - DNA, 79 bp, Homo sapiens
gcctgaggcacagctgcctgtattgtcctcatctgttctgactgaaggatggaggtgctgaataaattaggcctcaggc

SEQ ID NO: 6785850 - DNA, 108 bp, Homo sapiens
catgcttcccagagctccaagtccaggcccagcagctccacttggcttttgagacaaagataaaataagtccttatgtggaggggctaggctggggaaggggagcgtg

SEQ ID NO: 6785851 - DNA, 65 bp, Homo sapiens
ggaggtgtcactattttgcttatggtatggatttgatgatgcgcagaagcaagtctgacactccc

SEQ ID NO: 6785852 - DNA, 57 bp, Homo sapiens
ggctacagaggccgtgagcctggctttcgtccatgctgggctctggcggctgtagcc

SEQ ID NO: 6785853 - DNA, 70 bp, Homo sapiens
ctggaactgaaaactcaaggatttagacgaagctacccagtttgtttaatcatttgaagttttgtttcag

SEQ ID NO: 6785854 - DNA, 57 bp, Homo sapiens
gaagtcttcattctctctgagaagaaggtaagaccacctgagagtgaggaaggcttc

SEQ ID NO: 6785855 - DNA, 88 bp, Homo sapiens
attacctgggaacttgttagaaatgcagattctcaagccccagaaataatgaattagaatctgcattttaacaagatccccaggtgat

SEQ ID NO: 6785856 - DNA, 77 bp, Homo sapiens
ctcttgggcacctttcagtcagttaactcagaaagtgtttactttcatgacttaactgactgaaagcatccaaggag

SEQ ID NO: 6785857 - DNA, 100 bp, Homo sapiens
ttgtatccctcttgcctcaactctggaattggttaccactacttctgaactgggtggcagctacagacagaggtgagtatgcagaaaagaggaattgcaa

SEQ ID NO: 6785858 - DNA, 65 bp, Homo sapiens
tcatttttatacattcctgcactgctgatgaagcttgaacggctgcagggaatgtatggatttga

SEQ ID NO: 6785859 - DNA, 59 bp, Homo sapiens
tgcttggcttcatttaagttttagctaatacttattaagcacagacactgagccaagta

SEQ ID NO: 6785860 - DNA, 74 bp, Homo sapiens
tttagaaatgcgataacatttgtatagcgctttgtaaagggcaaagcgctatataaatgttaactgttattaga

SEQ ID NO: 6785861 - DNA, 74 bp, Homo sapiens
tggggcttgtttgtgtctgagttgttagtttccaggggacttagactgttacagggcactgaacatctctccca

SEQ ID NO: 6785862 - DNA, 74 bp, Homo sapiens
gaaaagagctttttccacccagttaaaagcaaggaaatatgaagccactgattgtccaagagaaaggtcttttc

SEQ ID NO: 6785863 - DNA, 56 bp, Homo sapiens
ggagaggtgtattcagtgggtcttgctattaaggacagactggacatgctcccttc

SEQ ID NO: 6785864 - DNA, 76 bp, Homo sapiens
gggtactgcagacactcagtaggacttcaaggccacatgagctttgggaagatgtactgagtgccctggtctgccc

SEQ ID NO: 6785865 - DNA, 84 bp, Homo sapiens
tttgtagagacaaggtttcaccatgttgcccgggttgatctcaaactcctgggctcaagtgatccacccaccttggcctccaaa

SEQ ID NO: 6785866 - DNA, 87 bp, Homo sapiens
cggcagggactgtggatttgggcagcaggagcctgggtctgaagcagaggctttccttggtgcgcctgctgcagctcccgcttgccg

SEQ ID NO: 6785867 - DNA, 73 bp, Homo sapiens
gatcctttatggcaccaaatatgtctcatttatctcactaaatgagatatagtgggtgttcacttaatggatt

SEQ ID NO: 6785868 - DNA, 61 bp, Homo sapiens
ttaaagcatcctgtcagtctgttcttaagtatgaaagtgttcggaaatcaggatgctgtaa

SEQ ID NO: 6785869 - DNA, 65 bp, Homo sapiens
tggccgttggtggagaactcagctgaggctctcagcgagggcctcaaatctcccgcttatggtta

SEQ ID NO: 6785870 - DNA, 87 bp, Homo sapiens
aattttgcattttaaactcaagtttccattctttccagggtataaagggccccaaaggtttggtagatatgacggtagatgaagatt

SEQ ID NO: 6785871 - DNA, 61 bp, Homo sapiens
ttggaaaatgtgctctgaggtgcagagggcttatttggaagtgctctgaaagacacaccag

SEQ ID NO: 6785872 - DNA, 68 bp, Homo sapiens
cctggatgtctgggaggcttccctgcttgggtgaagttgggagggcttggacccagatgtctgtgagg

SEQ ID NO: 6785873 - DNA, 70 bp, Homo sapiens
cattctagtcctaggtattttgtaaaggtaaatgaatgtttatggtcatacaaaaacttagacaagaatg

SEQ ID NO: 6785874 - DNA, 60 bp, Homo sapiens
tcctcagctcctatctctgtatggcctggtttttcctaggttatgattatagagcgagga

SEQ ID NO: 6785875 - DNA, 68 bp, Homo sapiens
tgctgtctccatagaagagactgcagttggcttccagaaacgggtgcagcctgactaggagaagagca

SEQ ID NO: 6785876 - DNA, 103 bp, Homo sapiens
gttaaggcaagaaccagccattttcacttcttttgtgattcttcacttgcttcaggccatctggatgtatacgtgcaggtcacaggggatatgttgtcttagc

SEQ ID NO: 6785877 - DNA, 71 bp, Homo sapiens
ggaaagtagagaattggagcagtgacaggtcagggacatcccttctgatgttcctcagttctcttctgttc

SEQ ID NO: 6785878 - DNA, 58 bp, Homo sapiens
gcacatttgacacctgggcattggtagatttaaagagctccaggtgattgtaatgtgt

SEQ ID NO: 6785879 - DNA, 60 bp, Homo sapiens
agaagaaatgaggccgttctgctataaaatcatgtgtagtagttattgctgtttacttct

SEQ ID NO: 6785880 - DNA, 57 bp, Homo sapiens
gtttcaccatccttggctttcctgttactccactgaggaaagatctgggattgagac

SEQ ID NO: 6785881 - DNA, 56 bp, Homo sapiens
ttactcaaggctccaggagcacagcattgcagtccctgagctccaggcgtgagtga

SEQ ID NO: 6785882 - DNA, 95 bp, Homo sapiens
tggccgggcacggtgtctcatgcctgtaatcccagcactttgggaagccaaggtgggcagatcacaaggtcaagagatcgagaccatcctggcca

SEQ ID NO: 6785883 - DNA, 97 bp, Homo sapiens
gaggcgggagaatcgcttgaactcgggaggcggaggttgcagtgagccgaggtcgtgccattgcactccagcctgggcgacagagcgactccgtctc

SEQ ID NO: 6785884 - DNA, 59 bp, Homo sapiens
cctgtttgcctcaaagtctaattttcaaagtagattaaacttgttaatgaggcaacagg

SEQ ID NO: 6785885 - DNA, 93 bp, Homo sapiens
tcgatgcagatttatttagaaagggaggcttatattcaatttttcataagtactgatatgagatcccttttcctagagacttctctgaatgga

SEQ ID NO: 6785886 - DNA, 101 bp, Homo sapiens
ggacgtaccacagggggtggcagactttttctctgaaggggtcagcatggctccattgagactttctttagagacactgaggtttccctggtgagacggct

SEQ ID NO: 6785887 - DNA, 83 bp, Homo sapiens
ctctgttagctgtcaaagtgtttaaaggggcaagaggtaatatgatccttctgaactgaaagctgctttgtcaggaatatgag

SEQ ID NO: 6785888 - DNA, 98 bp, Homo sapiens
acacatatatatataggagatgtatttgaaatttgagacatgagatggatgaataagcaggtaaacagacagatacatactagttagatattaagtgt

SEQ ID NO: 6785889 - DNA, 111 bp, Homo sapiens
gcagggtgtggtggcgggagcctgtaatcccagctacttgggaggctgaggcaggagaattgcttgaacccgggaggcagaggttgcagtgagccgagattacgccactgc

SEQ ID NO: 6785890 - DNA, 55 bp, Homo sapiens
taatatccttgcagcaagtgtttcagttgaagcctggcagcaaacgaggaggtta

SEQ ID NO: 6785891 - DNA, 55 bp, Homo sapiens
ttgacttcagaatgttgatggtagcatcaactgttttaccatcctctgaagttaa

SEQ ID NO: 6785892 - DNA, 73 bp, Homo sapiens
ccaactgcagtgcgttcttgttctcattgttctggacagagagaagcaatcagcagccacccactgcagctgg

SEQ ID NO: 6785893 - DNA, 68 bp, Homo sapiens
gagtagacaaggtacatgttctgttagttccaagcagaataaatgacatgatacgctgtcttggactt

SEQ ID NO: 6785894 - DNA, 90 bp, Homo sapiens
ttttgagttacaagaggaaataaatggggaaagtaagggaaaggagatcactctctgttcttgcttttctccaacctactaacattagag

SEQ ID NO: 6785895 - DNA, 82 bp, Homo sapiens
ctctaggtctctgctacagttgtaaagttctaggtgtgtgtttgacatgctttttaaacttaattggaaagcagagcaggag

SEQ ID NO: 6785896 - DNA, 57 bp, Homo sapiens
ggaccgtccgtggggttggctggcccttcacaatgtgaccccacttccatgggctcc

SEQ ID NO: 6785897 - DNA, 99 bp, Homo sapiens
gttcctgtgctggggcagggggttatagggtttgaatttcctgctagagctaaggaggaagggcccaggctttattatctctctttccagatgtggggc

SEQ ID NO: 6785898 - DNA, 83 bp, Homo sapiens
atatatttagatttatatgtgagaatgggcatcttacatattttaatacatgtatactcatattcacagatgcctaagtgtat

SEQ ID NO: 6785899 - DNA, 63 bp, Homo sapiens
accaggctctgccagtgtttactgagcacctactgtgccctggacactgtgcggggactaggt

SEQ ID NO: 6785900 - DNA, 118 bp, Homo sapiens
caaaatggtttaagacagaggtcatagcaagcttcagtttttactttttccccttgcatctgaacaattgcaagcagaaagaacaactgagtgctttatttctgcaaccaccatgctg

SEQ ID NO: 6785901 - DNA, 75 bp, Homo sapiens
ggttctgcaaagggctctgggctacgcactggagaaggccctgttagtgctatggccagagcccttgcattcacc

SEQ ID NO: 6785902 - DNA, 73 bp, Homo sapiens
ttcttcctgagaaaatagcatgtgtagtatttttggggacagcaaagctcagcatgctatttctcggtatgaa

SEQ ID NO: 6785903 - DNA, 76 bp, Homo sapiens
tggcttcaattttccttctaagaggaaggtcaggttattaacctgaccattgtttccagagggtgaaattcagcca

SEQ ID NO: 6785904 - DNA, 80 bp, Homo sapiens
ggcaagcagagtgttgaagcaggaaccagcagcattggcaaactggcaaatgcttctgttttgctaaacacctgcttttc

SEQ ID NO: 6785905 - DNA, 76 bp, Homo sapiens
tgctgagtcatgtaataatgctgctaatgatgctgacaatgagcagaaacacagagcccttattacatgatgagca

SEQ ID NO: 6785906 - DNA, 60 bp, Homo sapiens
tccatatttcttgttaaccagacttaaaaggaggctctggtcagtaataagaagtgggga

SEQ ID NO: 6785907 - DNA, 61 bp, Homo sapiens
aagccactttcagctgtctcagatgtcgttctacccatttctgatccggctggaagtgctt

SEQ ID NO: 6785908 - DNA, 75 bp, Homo sapiens
gctacatacgcgagctggcaagccgctgggcgcctctacgagccggcagagcttcctgctcagcgtgtccgtggc

SEQ ID NO: 6785909 - DNA, 70 bp, Homo sapiens
tatgagttgctcaggcttagagctactatatgacagagttaagtgagagatctgtctgaagcatctcatg

SEQ ID NO: 6785910 - DNA, 110 bp, Homo sapiens
atgtaactgaagttaatctttcataagctcttgaaattatgaatcttgtttagagaaaaactatagtttcatgagctttttaaagcaggatattgttattttagttatat

SEQ ID NO: 6785911 - DNA, 65 bp, Homo sapiens
cttgcctcttcttttttctgcttgacctggagggatcagaagccatatttagggaggaggcatag

SEQ ID NO: 6785912 - DNA, 67 bp, Homo sapiens
aatgatggctcagcaggttagaaactatgacatcatcttggttcaaaaataaccttctgagttcatt

SEQ ID NO: 6785913 - DNA, 69 bp, Homo sapiens
attcacagtcattcagcaaacatttattgtgtcggccatgtgccacgcactatgctggagagtgggaat

SEQ ID NO: 6785914 - DNA, 56 bp, Homo sapiens
ctgatgcactgtcttcccagagttaactgatgtgcagtgtgaatccagtgtttcag

SEQ ID NO: 6785915 - DNA, 62 bp, Homo sapiens
ctcttcctatgccaacattctgtgagtcctacaacagctacaaaatgttctgctgggaggtg

SEQ ID NO: 6785916 - DNA, 84 bp, Homo sapiens
gctttcatcattcccatggaggtctgtgactcccaaaagtccactttgttggaatctcagaaccccaaatcagaatagtaaagc

SEQ ID NO: 6785917 - DNA, 78 bp, Homo sapiens
tcctcaatttcttctctgccttgaggcaattgcttactttgagaacattttgccagctagagaagctagaaaggagga

SEQ ID NO: 6785918 - DNA, 88 bp, Homo sapiens
ggagtctggctctgttgcccaggctggagtgcagtggcgccatcttggctcactgcaagctccgcctcccgggttcacaccattctcc

SEQ ID NO: 6785919 - DNA, 73 bp, Homo sapiens
gccaggaggcgatgcaggccatggtttctttggcaggaactgacaaggcgcccagcctgccaagtctccaggc

SEQ ID NO: 6785920 - DNA, 67 bp, Homo sapiens
cggaagagaatttctctctttttatgcaggactcgaacctgggaaaatgtgagggaaaatctttctg

SEQ ID NO: 6785921 - DNA, 96 bp, Homo sapiens
gcaaagtatctcagttttaatgaatgattttatgtaaatgaatagacagcctattatttcatataatgttatcaatggattggagtgttgctttgt

SEQ ID NO: 6785922 - DNA, 65 bp, Homo sapiens
ggatatttgtgaagtgggataatagcgaagaggtcattatgttaaggtccacagtataaagatcc

SEQ ID NO: 6785923 - DNA, 67 bp, Homo sapiens
tgggtcttgaagagtaaattggtacacttcagataggctagagatgtagctgagctttccagaccca

SEQ ID NO: 6785924 - DNA, 75 bp, Homo sapiens
aggctgaggatttggcagtgaagggatcacagatccatgaaggtgtggtctccccagtgccagctctctgggcct

SEQ ID NO: 6785925 - DNA, 77 bp, Homo sapiens
ttcaccaggactttggagagacaggagtgttctccaaatctgccctcacttcatgtactgttcaaggccctggtgga

SEQ ID NO: 6785926 - DNA, 77 bp, Homo sapiens
gcccagagggcactgtctgagctggtgattagagacacaaaaacaagggtctccagactgtctggccctttttgggt

SEQ ID NO: 6785927 - DNA, 72 bp, Homo sapiens
gtctcagttgtatcacctggttctgctttagccttattctcaagaaggttctccccaggtggtgacagagat

SEQ ID NO: 6785928 - DNA, 55 bp, Homo sapiens
gctcaagatcatcaatataccaaagtagcatatgttggtgtagcatattttgggc

SEQ ID NO: 6785929 - DNA, 82 bp, Homo sapiens
catcgtgctgtaaaggatctgctgtgtttcacacctctgggaatttcacatctgttgatacagcatcaccattcagacgatg

SEQ ID NO: 6785930 - DNA, 66 bp, Homo sapiens
aggcacaattcagatggaagattctggctgtccaaggccaactgtaagtttaactgaatcctgcct

SEQ ID NO: 6785931 - DNA, 81 bp, Homo sapiens
ccatgggaatcccagctttggagtgttgttgctgttgctgcttagccagaatttaaattgcagtggctgatgtttccatgg

SEQ ID NO: 6785932 - DNA, 105 bp, Homo sapiens
cacaccaccaaaggccccgagacactgagcagggtgggcctcacaagcatgtgatctgtgcagctacccagggcctgtgcagtgcttagccttctgtggtttgtg

SEQ ID NO: 6785933 - DNA, 76 bp, Homo sapiens
ggattggtatctttggagaaagtaatgtctaaattctttgcttctgactgctttaccttcccagaaaccactttcc

SEQ ID NO: 6785934 - DNA, 66 bp, Homo sapiens
agcaaacctcttcctcacaagtgtctgtcatctgagtccaaagaaagctgaaggggtgggtttgtt

SEQ ID NO: 6785935 - DNA, 77 bp, Homo sapiens
taggctggtgcaaaagtaattgcagttttcgccattgagagtaatggcaaaactgcaattacttttgcaccaaccta

SEQ ID NO: 6785936 - DNA, 69 bp, Homo sapiens
taggcctctaggttgtagccttaattgccatgggcattggctcatgcatggatatataccctaggcctg

SEQ ID NO: 6785937 - DNA, 85 bp, Homo sapiens
gttagcctgtgcctgccgctgtctagtactggttaatgaatataaatcagatagtttatagttagcgagcacggaacaggctggc

SEQ ID NO: 6785938 - DNA, 62 bp, Homo sapiens
ggccagtaaatcttctccagtaaccagacaccataatttggactcaaaaggagatttactcc

SEQ ID NO: 6785939 - DNA, 70 bp, Homo sapiens
gatttttttctgatgcttaatattttctttgaaataagaaatagcatgggacaggtactagaaagggatc

SEQ ID NO: 6785940 - DNA, 57 bp, Homo sapiens
ggccagctctgcacagcagctgcctctcagcccgctgctgatgaagcgttgtctgcc

SEQ ID NO: 6785941 - DNA, 61 bp, Homo sapiens
gttttatcatcattataccatgttgctaggtggagagtaactgagataatgtatgtaaagc

SEQ ID NO: 6785942 - DNA, 97 bp, Homo sapiens
ctctgctccagggcactcagagattcaggctgtaacttgtaaacagttctgatttgcagccttctactgaatcctctgcatctgaccaggaaaagag

SEQ ID NO: 6785943 - DNA, 94 bp, Homo sapiens
ctgctgacccagaaacgtccagaaggtcccttagccagaacgtgatctcctgtgctgagggtaacacttcgggatccccaaagggtcatggcag

SEQ ID NO: 6785944 - DNA, 56 bp, Homo sapiens
gcgcgctctctccagcctccccgcccgggcagggggaacaccgggcagaggcgcgc

SEQ ID NO: 6785945 - DNA, 58 bp, Homo sapiens
cacagcagagggagccattgaaatttgagtgatctgtttggatgcaccttctgaagtg

SEQ ID NO: 6785946 - DNA, 65 bp, Homo sapiens
gagaggcaagcaggatttcaggccattactgacatgagcctgaatttgacctgcttactcctttc

SEQ ID NO: 6785947 - DNA, 96 bp, Homo sapiens
tgatggtataggaagattaagtgactcagtcagtgtaccaaatttagggacatgcgttggagattattagtgataactttcctgtgaaattcatca

SEQ ID NO: 6785948 - DNA, 76 bp, Homo sapiens
aggttggtgctaaagtcattgcggtttttgtcgttaccttcagtggcaaaaaccataattacttttgcaccaacct

SEQ ID NO: 6785949 - DNA, 99 bp, Homo sapiens
gaattgggtgtctccaggggcaggccagccgtatcaatgattaaattgatctaggtggtaggtctgttttgaactgttctctgtaaaggcaccaatttc

SEQ ID NO: 6785950 - DNA, 105 bp, Homo sapiens
gctgaggcaggagaatcgcttgaacctgggaggcagaagttgcagtgagccgagattgcgccactgcactccagcctgggccacggagcgagactctgtctcagt

SEQ ID NO: 6785951 - DNA, 80 bp, Homo sapiens
taacatgtcagcacgctggggactgaggctgtctgcagctgctccagctgtcacctggccccactgtgctgctgcggtta

SEQ ID NO: 6785952 - DNA, 81 bp, Homo sapiens
tctgtgaatatagggcttgttacttaaattataataataattatgcagctataaaaaatgaagaggttctatacgtataga

SEQ ID NO: 6785953 - DNA, 70 bp, Homo sapiens
ggggagcttagggtctctgaatgctgcagcttcccctgtcaagcagagaaaagcttaggttcagttcccc

SEQ ID NO: 6785954 - DNA, 95 bp, Homo sapiens
atattaaaatggatgtgtaaagttagatgtctgataaatagtatttttttagatagagttttttggcttaatacatattcagcagtttttaatat

SEQ ID NO: 6785955 - DNA, 60 bp, Homo sapiens
gctcaatactgctgaacctttgctagataatgtcccattatccaggctcagacagagggc

SEQ ID NO: 6785956 - DNA, 91 bp, Homo sapiens
agctgtatcctgacccagtgcttggcactttgaatgagctcagcaagagtttgttgaacacttagagtgtgagtgcatgagttagggggct

SEQ ID NO: 6785957 - DNA, 66 bp, Homo sapiens
gtaggtattaaagatgtgttgttggtttccaaaaaggaacactggaaataaattttgaatgtttgc

SEQ ID NO: 6785958 - DNA, 90 bp, Homo sapiens
ggtataaaatgtaagtctatgcagagttcaattgaaaattttcattgttgacttgattactcaaccataggctaatagaaaagttatgcc

SEQ ID NO: 6785959 - DNA, 79 bp, Homo sapiens
ctagcggtaaaagtttatggagagaggcttggcaggagcctggctggcgttttccaaaagcccacttgatgccgcggag

SEQ ID NO: 6785960 - DNA, 58 bp, Homo sapiens
acctaggtatttgccacttcacatttacatttgtgtaaatatgactagaatgccaggt

SEQ ID NO: 6785961 - DNA, 75 bp, Homo sapiens
gatctgattgatatttctgtttacccttagctcaggtaattaagagttgacaccaaggaagtatcatttagtatt

SEQ ID NO: 6785962 - DNA, 60 bp, Homo sapiens
gtctctgagatgtcaacacctattcttgccttctgataggagttgcatgatttttagagc

SEQ ID NO: 6785963 - DNA, 60 bp, Homo sapiens
tgttgaactgcttcagcaaagctatttgcaatacagcagacagaagctaagtagacagca

SEQ ID NO: 6785964 - DNA, 93 bp, Homo sapiens
caagtcttaaatcatcattgcctgtttcccttggaaaccaaggagaacctggttgaacaccagttggggaaatagggatgttgcctgagcttg

SEQ ID NO: 6785965 - DNA, 61 bp, Homo sapiens
gtcagagtctatcaagtggggaacttgagtagcaaaatcattttcactagtagtctctggc

SEQ ID NO: 6785966 - DNA, 68 bp, Homo sapiens
ccacacccaggcacaccccgaacggaacccgcacacccatggtcccgcacaggcatggcctggggtgg

SEQ ID NO: 6785967 - DNA, 60 bp, Homo sapiens
gagctttgttccgtggtggcacacaaatcttggcttgctgtaccatcattggcaaacctc

SEQ ID NO: 6785968 - DNA, 93 bp, Homo sapiens
ccatctttcctgtcaaacaatgccatgcacataggccaaatcatttttaatgtaaatataaatgattcttgtgtgtagccattgaggagatgg

SEQ ID NO: 6785969 - DNA, 66 bp, Homo sapiens
taaataatgagataaagctaccatgttgattttcttaggaaatcaagagttatatttcatagtttg

SEQ ID NO: 6785970 - DNA, 102 bp, Homo sapiens
ttgagacggagtctcgctctgtcgcccaggctggagtgcagtggcgcgatctcggctcactgcaagctccgcctctgggttcacgccattctcctgtctcag

SEQ ID NO: 6785971 - DNA, 80 bp, Homo sapiens
actgggttctagagggaccagaacatactgtgttccctcgcagttccccacagtatgttctggtccctctggaaccctgt

SEQ ID NO: 6785972 - DNA, 69 bp, Homo sapiens
ggcatgagctggggcggatactcagctcttcatccgaggctgcaggctggttctgcccacagcaatccc

SEQ ID NO: 6785973 - DNA, 112 bp, Homo sapiens
tcagtatattagtagaggtgagcatgtactaattgttcacacttgtttataaaagcatatatactgtgaatttttagtacgtttaatgttgacttcaacttacatagactga

SEQ ID NO: 6785974 - DNA, 56 bp, Homo sapiens
ctcctgcaggtcagcaggcttgagtggcattgagagctgctgagaattgctagggg

SEQ ID NO: 6785975 - DNA, 58 bp, Homo sapiens
aggacatgaagaaagggcaaggtttgatggaaaagctttgtttcctctaatctgtcct

SEQ ID NO: 6785976 - DNA, 91 bp, Homo sapiens
tgttgagatttttaaaaatctttagtttaagaacatgatgagaaacgacttcctttgtgtcactctgtgtttgaactcaagaggcttgaca

SEQ ID NO: 6785977 - DNA, 80 bp, Homo sapiens
tggcaagagtacattaggaaattccacctgtattctgaatgtagcagaattctagggtaaatatcctatgcactctgcca

SEQ ID NO: 6785978 - DNA, 69 bp, Homo sapiens
caacaatgtcatatagatattagacagggtttgtttttacatgtttgttgattctatatgattttgttg

SEQ ID NO: 6785979 - DNA, 76 bp, Homo sapiens
ttcaaaatcattgagtaaaatgaatacaatatttagtttaaatgtattgtaagttttatttactagtgaggttgaa

SEQ ID NO: 6785980 - DNA, 71 bp, Homo sapiens
gcctattgttgcttccaggttaggagtgattgtattaataacaacagttaacattttgggagctgataggt

SEQ ID NO: 6785981 - DNA, 82 bp, Homo sapiens
acatatgggttgttttcagtttagaagaatcatgaacaacactgtgatgaattttttggactgtgttttggtgaatatatgt

SEQ ID NO: 6785982 - DNA, 57 bp, Homo sapiens
cttattctactccacaagctcttcataggagaaatggaggcttggagtggagatgag

SEQ ID NO: 6785983 - DNA, 68 bp, Homo sapiens
ccaaacttttgaataccttgtctcatgttaatgggaaactgagcaagatgaaggattcaagacgaagg

SEQ ID NO: 6785984 - DNA, 72 bp, Homo sapiens
ggagactcaccccgcattctaggccggagaagcgggcgggcttgggatgccggcaggaggcaatgactctcc

SEQ ID NO: 6785985 - DNA, 58 bp, Homo sapiens
tctgtcatgtttcatgtttgtaggaaaatttgacaaagggcctatacatggagacagg

SEQ ID NO: 6785986 - DNA, 83 bp, Homo sapiens
agatggccactctctttaaaagaagggccagactccagaagtggagtctatttccccttctcttgaatctgagttgggcctct

SEQ ID NO: 6785987 - DNA, 94 bp, Homo sapiens
agaactaaaatgagctgtggcaaccttgtcagactgcattttacagcctcctttgtagtctgctatatgagttgccctggccaaatatagtttt

SEQ ID NO: 6785988 - DNA, 59 bp, Homo sapiens
ctcagttattggattttgatttaattccagaattacctggactgagttcaatggcagag

SEQ ID NO: 6785989 - DNA, 59 bp, Homo sapiens
ttggtaggctgaagcaggtggattacctgaggtcaggagttcaacaccagcctgaccaa

SEQ ID NO: 6785990 - DNA, 61 bp, Homo sapiens
tggacgggcatttcacagacttctccaccaggaagcagcagggtgatagtgcccaggtcca

SEQ ID NO: 6785991 - DNA, 56 bp, Homo sapiens
ccctgtctcattgatcacttgtcctgtgcctatctcaggggaggcaacagacaggg

SEQ ID NO: 6785992 - DNA, 76 bp, Homo sapiens
tacagtttgggttagaagagctaaggagtaaagtttggaagcagacagatcctggctctgtgacttattctttgtg

SEQ ID NO: 6785993 - DNA, 68 bp, Homo sapiens
cagtgctaaatattgtgtttgtcttgagctatgagctggagaatatcctacaatgattagttgcattg

SEQ ID NO: 6785994 - DNA, 63 bp, Homo sapiens
gtcagagcccttccctgatttttttcaaactgtaactaagagaagagggatggcgctctagac

SEQ ID NO: 6785995 - DNA, 108 bp, Homo sapiens
gcagcctgagctgggttctctgcttagggcctcacaaagtattggccagactgggctcttctctgcaggctctggagaagaatccgcttccaagatcattcaggttgt

SEQ ID NO: 6785996 - DNA, 57 bp, Homo sapiens
gacactgtaacttcccatctcctggtcataggaacatgattctgggcagtcagtgtc

SEQ ID NO: 6785997 - DNA, 87 bp, Homo sapiens
ctcaggacaaacttgttctgttcctgatgattcttctggaactatagtcaatgaaatcatcacgaacacaacagcgtttgttctggg

SEQ ID NO: 6785998 - DNA, 65 bp, Homo sapiens
tattttctctaccttttgattaagccattgaaaatccctggcggaatgcaaatgtaggaagaata

SEQ ID NO: 6785999 - DNA, 117 bp, Homo sapiens
gtgttgggattctgcagctagcaagtgacagagttcggattgagtttgaggtcgtctaagtgcctaatccaggctctttccactctggtgcatttgcttctcaagtgctcccaagac

SEQ ID NO: 6786000 - DNA, 57 bp, Homo sapiens
cagctattctctgaaatgaataactctgcatttgaaagaggtttttgagagaagctg

SEQ ID NO: 6786001 - DNA, 85 bp, Homo sapiens
cttttaaagagtggagaataaaataggagatgaaaatgtatattattgttaatgttattttattttatttactactttgtagaag

SEQ ID NO: 6786002 - DNA, 67 bp, Homo sapiens
tggagagaagtcaccctagggcctggactgtggtgataatggtgctggttcagggtggctgtttcca

SEQ ID NO: 6786003 - DNA, 83 bp, Homo sapiens
ttaaattacttttaactttacagaataagaatactggcgaccctatcaggtcccaatttttccttttttggagtgtgatttga

SEQ ID NO: 6786004 - DNA, 80 bp, Homo sapiens
ctacttctggacacacctctaaaatctacagtgggcttaattaatcatccatggtggatttgagatgtgttcagatttag

SEQ ID NO: 6786005 - DNA, 106 bp, Homo sapiens
tgtgtttaggaatatcctgggggttttgttaaaatgcagattctgacaaagttaatctgggatgggttggagatgctgcattactaacaaactcccaggtgataca

SEQ ID NO: 6786006 - DNA, 78 bp, Homo sapiens
gggtgttgcttcactacttctaggctcctgcagagtcctgcctcataggccgcactggtgagtgaggccagcaaaccc

SEQ ID NO: 6786007 - DNA, 65 bp, Homo sapiens
ggtgagactggacgcacaggattggggcattatttaacacttctgtcctgtagttcacgttggcc

SEQ ID NO: 6786008 - DNA, 76 bp, Homo sapiens
ccaactaaactttttcgtttctattctgatgatataagaaaaatatatattacaagaaagggcatgaattagttgg

SEQ ID NO: 6786009 - DNA, 66 bp, Homo sapiens
gcagtgctagggcagagcactcctgaatgactggaaatcacatggaggcaggctctagaaggctgc

SEQ ID NO: 6786010 - DNA, 62 bp, Homo sapiens
tacaaggtcagctgtcctgagcaggtcccaccagggcaggtccaggtgagcagatctgggtg

SEQ ID NO: 6786011 - DNA, 55 bp, Homo sapiens
agcagggggttatggcatggtcatgaataaagagacattgcttataaactctgct

SEQ ID NO: 6786012 - DNA, 66 bp, Homo sapiens
ctttgggtttctactttcagtttcagctgaagttggagacattttagataaacgaaagatgcaaag

SEQ ID NO: 6786013 - DNA, 61 bp, Homo sapiens
aggtagggaaaagacttcactgtttatatgttaagtgaacattagtttcttttccctggct

SEQ ID NO: 6786014 - DNA, 100 bp, Homo sapiens
ttgagcagcaccgtgcctgctagcccaagtgctctaggatcctgagtcatctcacgatgacacaggaagtcagcactgatggctggaggcgtgctttcga

SEQ ID NO: 6786015 - DNA, 56 bp, Homo sapiens
ccactgccgtgggccttggggacagaagttcttaaaggcactgccatggtaagagg

SEQ ID NO: 6786016 - DNA, 70 bp, Homo sapiens
gaaaacaagcactactttcataagttggattgtgaattttccaggctgagtgaaagtttgctgtgtgttc

SEQ ID NO: 6786017 - DNA, 77 bp, Homo sapiens
actcaaattcaaggaatttacaactatgagggggaaaataaggtctccttacaatgcagtttacttaggatttgagt

SEQ ID NO: 6786018 - DNA, 65 bp, Homo sapiens
tgcctgatattgcctgtggaaaataattggacaaacattgattttttatgttgctataataggta

SEQ ID NO: 6786019 - DNA, 74 bp, Homo sapiens
agaacaatgtttaaaggagtcagagactcaaagacaatagattttccaagttgatggctctattcagcagttct

SEQ ID NO: 6786020 - DNA, 110 bp, Homo sapiens
gagctgcttttgcatctgttatatggaaataaagccacctatttcctacacacattaggtaaagaagaagtgttatttttagaacagaagcaacagatataattcagttc

SEQ ID NO: 6786021 - DNA, 78 bp, Homo sapiens
ctctgccctccctgcagttccaagagctctgggtgacagctcaacccaaggctgcagtgagcatgagggaggaaagag

SEQ ID NO: 6786022 - DNA, 86 bp, Homo sapiens
aggccagtcactcctgcctgatgcatccctgttgcactgttcataaaacctgtatcatatggggaagcttcaaggctggcaggctt

SEQ ID NO: 6786023 - DNA, 71 bp, Homo sapiens
agtggtaagagcacagtgcaggatccccgtggtggctggctatgctggagaactgctctgtgttcatcact

SEQ ID NO: 6786024 - DNA, 70 bp, Homo sapiens
cttcagctgtggaaaggctgtaaggctgttcaggaagaagagctagactttccctttccatgtcatggag

SEQ ID NO: 6786025 - DNA, 130 bp, Homo sapiens
ttattatcttgactacctgaattgcgagggatttttatatattcatatgttccaaagtcagcaactctcctgttggttcattattgaatgtgctgtaaatgaagtcttttgcaactaaaatgagatttga

SEQ ID NO: 6786026 - DNA, 80 bp, Homo sapiens
agctcttcctcaagataaagccaccagaagcttccagctcaggaagagttctgcaattgtgtttatgtaaaggaggatct

SEQ ID NO: 6786027 - DNA, 78 bp, Homo sapiens
cctggattattcttaatgcagggattatccacatgtgcagatgtgtgagtaatccctgcatttaataataatccgtgg

SEQ ID NO: 6786028 - DNA, 58 bp, Homo sapiens
gactctggctgccttgtgagcatcaactatagagaatgaggatggaggcagacaggtc

SEQ ID NO: 6786029 - DNA, 62 bp, Homo sapiens
tgtccaggtgtgtctaaagagatggcttacagaagcaagtgagcttaaggcacacactggca

SEQ ID NO: 6786030 - DNA, 102 bp, Homo sapiens
gcacaaatcgccaaggggttctgttagaacgcagactctggttcagtaggtccggggtggggccgagcctctgcacttcttacaggtcctgggtgacgctgc

SEQ ID NO: 6786031 - DNA, 63 bp, Homo sapiens
gtttttggttcataatttgcactactgtgagaaacacggaggacacaatcatgagccaaatac

SEQ ID NO: 6786032 - DNA, 91 bp, Homo sapiens
attctgtagttaagactgctttggacatttttaaaaactaattgggttaaaattagtgtttaaaggtttcagagttcacttaaataggaat

SEQ ID NO: 6786033 - DNA, 59 bp, Homo sapiens
gacagaattttccatcatgtggaatgaccttaacaatacgggggtggaagtttctagtt

SEQ ID NO: 6786034 - DNA, 100 bp, Homo sapiens
gtatattagtagaggtgagcatgtactaattgttcacacttgtttataaaagcatatatactgtgaatttttagtacgtttaatgttgacttcaacttac

SEQ ID NO: 6786035 - DNA, 67 bp, Homo sapiens
gtggatgcctggtcccacctctaggtatctagattcagtaaatctggagtgggacacagaaatctgc

SEQ ID NO: 6786036 - DNA, 123 bp, Homo sapiens
ttttttgtgactcgtttcttctgtattaggttggtgcaaatgtaattgcggtttttaccattactttcaatggcaaaaactgcaattacttttgtcccaacccagtaaaagggtaataataaa

SEQ ID NO: 6786037 - DNA, 67 bp, Homo sapiens
aattcagttatttactttgctatagaccagagaaaaagggaaaatgatagtgatagataactgagtt

SEQ ID NO: 6786038 - DNA, 81 bp, Homo sapiens
ttcacgagcttcagggtcgtcacttttaagggccttttctaccttgttgggaagaaacaagccctagaagtcctgagtgaa

SEQ ID NO: 6786039 - DNA, 56 bp, Homo sapiens
ggctctgcccgcggctgcccacgagttcccaccgcccgcccgtccgtgggagagcc

SEQ ID NO: 6786040 - DNA, 69 bp, Homo sapiens
aaatagaggctttacctagtaaagtggcttccccaagtcacagagctggtaaggggtagagccatattt

SEQ ID NO: 6786041 - DNA, 72 bp, Homo sapiens
agaagtgcaataaagtagtagaattgcaataaagagatgtgcaaataaatatttacactttgtagcattttt

SEQ ID NO: 6786042 - DNA, 86 bp, Homo sapiens
gcaaacatggagagctgaagcatggacagggcgtggcagggaggatccccgctgccctcctgcatgtggtcagcactcctgcttgc

SEQ ID NO: 6786043 - DNA, 65 bp, Homo sapiens
ctggggccgcccagcccagaaaggttcggacactgcccaggtccgaatgggcaggggggtctcgg

SEQ ID NO: 6786044 - DNA, 75 bp, Homo sapiens
ccttgtttgccctaggatctcacagatccactctcccctttggagctcctctgtccagaggtcctggagacaggg

SEQ ID NO: 6786045 - DNA, 88 bp, Homo sapiens
agcagaccccttttcttagccaaaggtaaactcctgttataaaggatctttacaacagcgatttacctgtcactgcaggtggtctgtt

SEQ ID NO: 6786046 - DNA, 62 bp, Homo sapiens
cagaggtaaagctagccaaccactgtcttccactatagggaggggcaagctgcttatcactg

SEQ ID NO: 6786047 - DNA, 71 bp, Homo sapiens
ggagcatttgcatctgtggaaattggcaagtgctacaaatcgcatttcctccctccacagctggttgttcc

SEQ ID NO: 6786048 - DNA, 76 bp, Homo sapiens
ggggactgacctgtgcagtgtagtatgtttagcagcatccctgtctccaactcactgtatactaatagcaattccc

SEQ ID NO: 6786049 - DNA, 59 bp, Homo sapiens
ctgtggtgataacatggcactcatgtaggccatttggttgtcagttataatcaccacag

SEQ ID NO: 6786050 - DNA, 104 bp, Homo sapiens
caaatgagagacagagctagtatctgaacccaagcagtcagcctgaagactgatccttaatcagcaggccatgctgcttttcaagatttgctgcctctcatctg

SEQ ID NO: 6786051 - DNA, 68 bp, Homo sapiens
ggctcaggggaatgggctgccgtagctaagatggtgaagccagcggcgcctcctggttcccctgtgcc

SEQ ID NO: 6786052 - DNA, 57 bp, Homo sapiens
ctgcggaggcacagcttacaggaccgtaatggccctggggaaggtgtctccaatgag

SEQ ID NO: 6786053 - DNA, 77 bp, Homo sapiens
tagctctggatttcagttcacctgggaacccgctggaagccgagtggactccaggaggaacgaagtgccttgggcta

SEQ ID NO: 6786054 - DNA, 58 bp, Homo sapiens
gcccaggctggagtgcagttgtgcaatctctgttcactgcaacctccgcctcccgggt

SEQ ID NO: 6786055 - DNA, 70 bp, Homo sapiens
tcacaaaaacaggcactttacaatgtgtgacatagactatgatagacaataaaagtgaccaggtttgtga

SEQ ID NO: 6786056 - DNA, 121 bp, Homo sapiens
ggtgcccttatagcatgagactccagagagctgccccatccaccatgtgagggcacagccgacagacggccgcctgtggaccaggaggcagccctctccggacgccaaatctgccggcacc

SEQ ID NO: 6786057 - DNA, 80 bp, Homo sapiens
gcatctgtaaagataatcatatgttttttgtcctttattctgttaactatggcatattacattgattggttttcagatgt

SEQ ID NO: 6786058 - DNA, 128 bp, Homo sapiens
ccacgagaggtaagacccatgactcccaaattccactctacacactgctggcaactcagtctttattgatggtttcatttttggggtcaccagtgctaagaggtggaaggtgggggggcacctttatg

SEQ ID NO: 6786059 - DNA, 62 bp, Homo sapiens
tcgtttagctgggcacattcagaattttctcttttattgagcaactgtgctctgctaaatga

SEQ ID NO: 6786060 - DNA, 55 bp, Homo sapiens
tagtcaatcagtatgtattggacactttttacaatctggtacattctgatcactg

SEQ ID NO: 6786061 - DNA, 73 bp, Homo sapiens
cgatgctgattttactgttttctcctttagaccacatcagtctcatttaagaatacgttaaaagcagacgttg

SEQ ID NO: 6786062 - DNA, 87 bp, Homo sapiens
gtagtgtaggcattcaggtttctattactccaatatagtagtcgcttatttgaactggtagttggaaatctgaatttgtctgactac

SEQ ID NO: 6786063 - DNA, 65 bp, Homo sapiens
caatgaacagttactttgtagaagaggcatttcttgcttgcttctttgcagtgacttgttctttg

SEQ ID NO: 6786064 - DNA, 56 bp, Homo sapiens
ctgccccaccccaacctgaggtcagagctgaggcgtaggggccggggtaggggcag

SEQ ID NO: 6786065 - DNA, 58 bp, Homo sapiens
tttacagtctctatagtcaaaagtgatcaattccactttattctgttggtcctgtaga

SEQ ID NO: 6786066 - DNA, 74 bp, Homo sapiens
ggatttcgccagagcctcttatgaagatcgcagttctcggcagcctgcgcttctcatccaggccttgggattcc

SEQ ID NO: 6786067 - DNA, 59 bp, Homo sapiens
ctatgtactggattagctcccatatacaatgtgcagaaagagctggtctcagtatctag

SEQ ID NO: 6786068 - DNA, 81 bp, Homo sapiens
taggccaaagaagtttcctgggaggacttgtgggcttcatgtccacatatgaagccatctcctccccttcataatggctta

SEQ ID NO: 6786069 - DNA, 61 bp, Homo sapiens
gggctggctgattttcctctctaagatccgtgtgaatagggtgggccaaattaggtagcct

SEQ ID NO: 6786070 - DNA, 67 bp, Homo sapiens
ttcttgacaagcattttgcatgcagttaaatagacaaatgtattctgctgccaggattttgcaggaa

SEQ ID NO: 6786071 - DNA, 84 bp, Homo sapiens
tcggccccctgctgacgcagtgcccgccgccgttcctggatgacttcagtggtgaagtggtgcaccatgtcacaggcctgccgg

SEQ ID NO: 6786072 - DNA, 69 bp, Homo sapiens
gaagtgaactcagcatcctgcacagagaagccactgctgtctctgagctcaggagctgcaggaagcttc

SEQ ID NO: 6786073 - DNA, 57 bp, Homo sapiens
ggtcaggagcccttggccccctctccacccttgggctggggcccaagccctcttgcc

SEQ ID NO: 6786074 - DNA, 80 bp, Homo sapiens
ctggaaagctgcaggacccagagccaacttcgtgcaaaagagaaataaacctacgtatgctcaggtgctgagattttcag

SEQ ID NO: 6786075 - DNA, 59 bp, Homo sapiens
gtaacttctggaaatgcatctgccattttcatggtggtcaggcacacatccagggcagc

SEQ ID NO: 6786076 - DNA, 57 bp, Homo sapiens
gttagctactgccaccaagtctgcattaagcagcagctgtctgtggtgtcagctgac

SEQ ID NO: 6786077 - DNA, 68 bp, Homo sapiens
gccaggctgggtaaaggctgcttttctaggactggactcgtgatagaagactttatagcccagctggc

SEQ ID NO: 6786078 - DNA, 62 bp, Homo sapiens
tacacacggaaaggcatatgctgtgtacagtttggtgaattttcagagtaaatgcctgtgta

SEQ ID NO: 6786079 - DNA, 74 bp, Homo sapiens
gaatatggagactatgccagactgtgagcttcttgaaggcaggaacatcaaagtctgcatcatcttttatattc

SEQ ID NO: 6786080 - DNA, 55 bp, Homo sapiens
ttctgttactgttggtcataactgagatatcattaaagattaatcagtggcagaa

SEQ ID NO: 6786081 - DNA, 93 bp, Homo sapiens
gacttgtacctcactgaggctgagagtttgttctacttctggtctgaataagcaaatgtttagtttcagttcctcttcaaattcaggactgtc

SEQ ID NO: 6786082 - DNA, 59 bp, Homo sapiens
tgttctcctggattctgaagggcctggcacatcagagcctgaagggactccagagagca

SEQ ID NO: 6786083 - DNA, 58 bp, Homo sapiens
caagcccaggattccccagttacatcagtacctacaggtggccatgttctgtggcttg

SEQ ID NO: 6786084 - DNA, 84 bp, Homo sapiens
gataacttgcactttctgtgttgtgcaaaaatctttaaattattcttgaaacttttacaatacagaaggtaaggaagttttatc

SEQ ID NO: 6786085 - DNA, 55 bp, Homo sapiens
caggactcacttctcacatccccttgccaggtaggtaatggtagatgagtctctg

SEQ ID NO: 6786086 - DNA, 69 bp, Homo sapiens
tggccctggcacatctaactcactctccccactggctgtggaaaggcagaagtcagggtgccagggcca

SEQ ID NO: 6786087 - DNA, 75 bp, Homo sapiens
tggagggctgcacagatcttcaagggttggcttgtaaatatgtaatcagaagagctggtgctgcctgagaatcca

SEQ ID NO: 6786088 - DNA, 65 bp, Homo sapiens
tcaggattgaagatcagggaaagattctcttctcctgaggaactgtccgaggtcttccattgtga

SEQ ID NO: 6786089 - DNA, 129 bp, Homo sapiens
ttaaggaaaatgtcttcattgcaaaaagggtagtgattatttttagtataggatgacattttggagttcattggaaatctttctatttctaaaaactactttttttcattgaaaatactaaccctacga

SEQ ID NO: 6786090 - DNA, 59 bp, Homo sapiens
ggattccattagctgagatatcttgtgatagggagaggtatcacagtagaataggatct

SEQ ID NO: 6786091 - DNA, 90 bp, Homo sapiens
ggctgtgctaaggtcacacagcagccccgggtgttcacgtgtatgtcttgagcacacactgggagcagctgtgagcctggggtcacagcc

SEQ ID NO: 6786092 - DNA, 56 bp, Homo sapiens
gaataatgaggtgatgactaaggtcctcccacctgggctgcaattatttcattttc

SEQ ID NO: 6786093 - DNA, 67 bp, Homo sapiens
tgtttgtatctctctctgtggcaaaccagtttgaaaagaatcaggactccagagcagaggtggagcg

SEQ ID NO: 6786094 - DNA, 63 bp, Homo sapiens
tgttagtcatttttggaaactctgccaagagctatttaagagttttcaagttggtggctggca

SEQ ID NO: 6786095 - DNA, 58 bp, Homo sapiens
tgttcttatgaattcaagacaccttaatagtaggtggcatagaatatcattaagaata

SEQ ID NO: 6786096 - DNA, 59 bp, Homo sapiens
aaaccgcactgggagccagcagccttcaagagggaagttgggagttcctactgcggttt

SEQ ID NO: 6786097 - DNA, 102 bp, Homo sapiens
tgaattttaattggcacgtaggcttcaccttagtttcaatatttgcaacaaagtagtgttaaactcgtaggttaggcttgtagttctttaggttagaattta

SEQ ID NO: 6786098 - DNA, 70 bp, Homo sapiens
gctggggaaattctccaaggttcatatttatccgtgtgcttagcgaagggactgaactttggacttcagc

SEQ ID NO: 6786099 - DNA, 79 bp, Homo sapiens
tgtaaattaatggacaatgccaatacagttttatttacagaaacagagtaagcctgtaggccattggccagagtttgca

SEQ ID NO: 6786100 - DNA, 56 bp, Homo sapiens
gctccagagtgtggcatctgggtccaataatggccatacagagccccatctgtagc

SEQ ID NO: 6786101 - DNA, 71 bp, Homo sapiens
tgactgaggaagaccaggtagcattagggataatttctataataatttacctgtgttttttcctaagctca

SEQ ID NO: 6786102 - DNA, 55 bp, Homo sapiens
gtgaaggagctactgctctgggtgctaacagcagacaccagagctggctcctcgc

SEQ ID NO: 6786103 - DNA, 66 bp, Homo sapiens
tccttaatacctccgtaacacttgctaacctctgaaagagaaaggaaggaagcagggcgggaagga

SEQ ID NO: 6786104 - DNA, 73 bp, Homo sapiens
ttgggttttgatacatgtctaatcagactgatttctgtcacatatagaaatttagatactgtattaaacctag

SEQ ID NO: 6786105 - DNA, 62 bp, Homo sapiens
ggccacagaactggttaatagcagagtccctaccagattcttatattagagggttttgggtt

SEQ ID NO: 6786106 - DNA, 59 bp, Homo sapiens
gagctgtgaaaagtgcctggggcaccttgtgggtgttaaaaaggattggttataagctc

SEQ ID NO: 6786107 - DNA, 59 bp, Homo sapiens
ggcctcaagctaccctctcacctcagcctcccaaagtgcggggattacaggcttgggct

SEQ ID NO: 6786108 - DNA, 63 bp, Homo sapiens
ccacaggaagatctcccagaggtgcaatgaagaaacacctctggattgggttctgtcccgtgg

SEQ ID NO: 6786109 - DNA, 123 bp, Homo sapiens
tgcagctggttgagatgtttgttgaggaaaatctggtttacagcaacagtgcagaggtgcatcctgtgttggcctctccctggcctgttgctcaggcctccacagcatgttttccttgctgca

SEQ ID NO: 6786110 - DNA, 69 bp, Homo sapiens
taggataatagaactcgggctttggaatccctcagaccagggttcaagtccaagttctgatacttctta

SEQ ID NO: 6786111 - DNA, 56 bp, Homo sapiens
gaggtcatgtggcaggcagccagtgtgcctcaagggcccctgcctgctctgatctc

SEQ ID NO: 6786112 - DNA, 67 bp, Homo sapiens
tccattgatactattaagcactgggctaggaatgactagcctaagatcacttatagagtcacatgga

SEQ ID NO: 6786113 - DNA, 83 bp, Homo sapiens
aagagtgaaactagtaccacctccttgaaatgggctgagtccctcttgctcacccttgacttggaaaaaccagtttctctttt

SEQ ID NO: 6786114 - DNA, 62 bp, Homo sapiens
tgggctcaggggtctctgctcagatgccacttcctaggaggggcctcgcaggaccgctccca

SEQ ID NO: 6786115 - DNA, 75 bp, Homo sapiens
accttctggaattctgtaggatagactttgtcaaagtgagtgtataagtcagaatcctgctgagaaacagatggt

SEQ ID NO: 6786116 - DNA, 62 bp, Homo sapiens
tatttcacaagatgctgatgcttccctaacctgcaaaactctctcagtgtcttggtaaaata

SEQ ID NO: 6786117 - DNA, 78 bp, Homo sapiens
gtgccctgttttgaaacttgcatagagaggaaatgagatgaagagtcaatgtgcaatcatattttaaaatgtgggtac

SEQ ID NO: 6786118 - DNA, 55 bp, Homo sapiens
gctgggagaatatttaaaatgcctcagaagatgaagcattttaagcatccccagt

SEQ ID NO: 6786119 - DNA, 62 bp, Homo sapiens
attaggttaggggtctcaagatgagatcatcctggattatcctggtggcccctaaatccaat

SEQ ID NO: 6786120 - DNA, 57 bp, Homo sapiens
cagggagaagaactcaagtttgtatggcaacaagactagaaaatgactttctccctg

SEQ ID NO: 6786121 - DNA, 56 bp, Homo sapiens
catgaatgctgggttcatgtaaactgcacagcagatctgactccccagggttcgtg

SEQ ID NO: 6786122 - DNA, 83 bp, Homo sapiens
cagcctcatcatctccctgcctgggagcatctgtttccaagtgccctcaatgcccccaggcctggaggagcagaacggggctg

SEQ ID NO: 6786123 - DNA, 63 bp, Homo sapiens
acagggtcaagctgcgttaccttcgacaaagatgtcactagtctgaagcagccttgattctgt

SEQ ID NO: 6786124 - DNA, 89 bp, Homo sapiens
cttaaattgtacttttatttggtgtaggcctggagttgcatttgaccagcaaagaagctgtttgtacttagatagtaagttcatttgag

SEQ ID NO: 6786125 - DNA, 82 bp, Homo sapiens
gcagcatggagaagacaagctgagtgttgtccatggcctagaatgctaggtgtaagggaaccatttactttcttctctgctc

SEQ ID NO: 6786126 - DNA, 61 bp, Homo sapiens
tggattttatgttgaacagagtgggcaggggtttttctctcttaaagccaagcataaacca

SEQ ID NO: 6786127 - DNA, 70 bp, Homo sapiens
acttggctcctataggaaacatacgtgactaggccaggggctggcaaatgttttctgtaaagggccaggt

SEQ ID NO: 6786128 - DNA, 80 bp, Homo sapiens
caatcttcacatgatgtccgtgctgtggtttcttctctgtgtccaaattcctcctttttagcaggacatcagtggaattg

SEQ ID NO: 6786129 - DNA, 60 bp, Homo sapiens
ctccattcaattctaaagcccttagtcaattatctgtaggggcctgggaactgagtggag

SEQ ID NO: 6786130 - DNA, 100 bp, Homo sapiens
ccaggcgagcagagggagtagagcatctccttcaaccccatggtccctgcatgtacgttagcaggtggtccagaggagatgcctcctctgtgctgtttgg

SEQ ID NO: 6786131 - DNA, 69 bp, Homo sapiens
agcagccagggttaattatatttaactggtatgttagataaataaaaagtttaactcctggtaactgct

SEQ ID NO: 6786132 - DNA, 97 bp, Homo sapiens
atggctctttttgattctgcaagcagattgcttcaaagggacagctgtttccctggagtccacttaagtatctgcaggcatgatcttgatgggtcat

SEQ ID NO: 6786133 - DNA, 93 bp, Homo sapiens
cacaaagtgaagtttgggctgaaatgctgtggactagtgctttatactgggtgtactggataattaccagcattcagcacacttcactttgtg

SEQ ID NO: 6786134 - DNA, 56 bp, Homo sapiens
agcaatgaacatataaagagatcttgaacacaaaagattgaaattatgttcatgct

SEQ ID NO: 6786135 - DNA, 55 bp, Homo sapiens
tagcttgtgccatttactgcatggctgaaagttccagtgcaagaaagcacagctg

SEQ ID NO: 6786136 - DNA, 97 bp, Homo sapiens
gagctggatggatgatgttttttaggatctcagcatagtacgggccaaatacctgctgattatgatacttcagaatgacaaacttccaacccagttc

SEQ ID NO: 6786137 - DNA, 69 bp, Homo sapiens
agcactgggctggggctcattctccatcactcactgtaaacgttgggtccagagcctcagcccagagct

SEQ ID NO: 6786138 - DNA, 65 bp, Homo sapiens
ctgcagaaggggagtggctagtgtgtgagggaggcaatgccccaccattaagcatttctctgtag

SEQ ID NO: 6786139 - DNA, 59 bp, Homo sapiens
gggtgggcaatatgactcagtattttttccaagagatgtgaaaattatattgcctattt

SEQ ID NO: 6786140 - DNA, 100 bp, Homo sapiens
tttgggctgcataggcaggtgcataaggagcctcaggaatgctgctggattcagactctggtccctgtgtcacctctcaccctcatgtataaggcccagg

SEQ ID NO: 6786141 - DNA, 75 bp, Homo sapiens
ggctggcccgggggtccttgctgccagccaccatactggctccttaaagctgctggtaccgcgcctccgccagcc

SEQ ID NO: 6786142 - DNA, 101 bp, Homo sapiens
gtccaggctcccagctcccagtctgtgtcctttacagtgcaccaccctcatgccttgtgcaagaagccagcaccaatgggaattgtcacaggaggctagac

SEQ ID NO: 6786143 - DNA, 61 bp, Homo sapiens
tggagcctaagaattaatgaatacaccaggtaattctgctgcagatatttcttaggccaca

SEQ ID NO: 6786144 - DNA, 59 bp, Homo sapiens
gatgtgtccctttcaactcagacttttcattttagagaatggggcagatggggcaaatc

SEQ ID NO: 6786145 - DNA, 83 bp, Homo sapiens
tcagttttatagacatgttgacaataaagtctaccatgtgtgtctccctgccatggtgattattttgctcaatatgtgattga

SEQ ID NO: 6786146 - DNA, 80 bp, Homo sapiens
aggcagtaagagtggagtcaaacaggaatgcgatgtgcttcgtgtgtcctgcagacagactcaggcttcttacactggct

SEQ ID NO: 6786147 - DNA, 84 bp, Homo sapiens
aagggaaatgtcctattttgtaaagagcagcatttctacattttaaaaatcagatgttctcagtggggagcagggttttctctt

SEQ ID NO: 6786148 - DNA, 73 bp, Homo sapiens
acagtgtcaatgaacacagccctctactttgctgaattccagaaggagacgactgtgctcatgaagacaaggt

SEQ ID NO: 6786149 - DNA, 57 bp, Homo sapiens
ccttctccctctgagaggaacctggagaggcccgggttctgctgaggtaggagaggg

SEQ ID NO: 6786150 - DNA, 69 bp, Homo sapiens
tcactgaggatgaacaactgttttgttttccaggttttttggagttaacacattagttctcctagatga

SEQ ID NO: 6786151 - DNA, 60 bp, Homo sapiens
gaaggaattattttaaattggtggctggtcttggcaaaaccatttaaaattgatgccttc

SEQ ID NO: 6786152 - DNA, 68 bp, Homo sapiens
ccagcccttcatcacctaacttgtgatttacagacactgagcacattgcaggttgagaaggtgcttgg

SEQ ID NO: 6786153 - DNA, 110 bp, Homo sapiens
caaggggttgagttgtactggccagtgactccgggagccaggagaggctgctccttggagcccagcttcctcactaagtcataaatgagcctcttgcgacgggctccttg

SEQ ID NO: 6786154 - DNA, 97 bp, Homo sapiens
gggagaactagaataatttattcttataagcaaactgctgagaagatagaaagacctgaaaacctttctcaagctgttgctgtaagattgttctcct

SEQ ID NO: 6786155 - DNA, 68 bp, Homo sapiens
gttgggacagagctggggctggaatgtaggtcttccatctccgattgcccttctctttccattccagc

SEQ ID NO: 6786156 - DNA, 83 bp, Homo sapiens
tgctgttataaaatccagctgtgtcacaggtgatgtaggatgttgattatttacattggtcactagctggatcttaaactgta

SEQ ID NO: 6786157 - DNA, 83 bp, Homo sapiens
aagactcacaaaacatttttctaggtcttggtagtcccaattttagaatatcggggactagatagagtgaggctgtgtgtctt

SEQ ID NO: 6786158 - DNA, 75 bp, Homo sapiens
aaggtttgtttgatttccctcatcataacagaagtcttctgcttttgttccttaggggagatgttcttgaacttt

SEQ ID NO: 6786159 - DNA, 66 bp, Homo sapiens
cctgggaggccagggtagggcccattgtgggagcaaccacggcacctcccttcctggcttccgagg

SEQ ID NO: 6786160 - DNA, 62 bp, Homo sapiens
cagcggcctcccctgtgtccctgtgaccgtggcggcaaagacggactcaggagtgcaagttg

SEQ ID NO: 6786161 - DNA, 129 bp, Homo sapiens
ggaggcttccaggggcacactgtgagcaggagccctctctggaccccgcagggtcaggtggccttactttcattctgcaccccgcagggtcaggtggcctcaccttcattctgtacccgtggcacctgc

SEQ ID NO: 6786162 - DNA, 64 bp, Homo sapiens
gggggtcagaatcatttgggggactttgacatggtacatttgtccccaggaaattctgattctt

SEQ ID NO: 6786163 - DNA, 70 bp, Homo sapiens
ggtgggcttcttgggcaatttctctagaggtcatccaaggtgaaaccctctgtgtctccaagaggcctcc

SEQ ID NO: 6786164 - DNA, 67 bp, Homo sapiens
acttagatggctctgtaactgctttaatcaaagtatatagctgttgcataaaagagtatatcttagt

SEQ ID NO: 6786165 - DNA, 74 bp, Homo sapiens
cggagtgctgagaagagtccctggtagatagagcatttgatgtggctgctactgagggggtctggtgcacatcg

SEQ ID NO: 6786166 - DNA, 77 bp, Homo sapiens
gagagtgacagaagcagccgtcacagataggagctctcattcctcatgctctttgaatgtttcttctgaagtctctc

SEQ ID NO: 6786167 - DNA, 72 bp, Homo sapiens
atctgttgtctgggtcggtgccactgtgggggaaaacaaaggccttccctaccttcctgcccagagacagat

SEQ ID NO: 6786168 - DNA, 82 bp, Homo sapiens
ggatcgcttaagcctgagaggtggaggttgcagtgagctgagatcatgccactgcactccagcctaggtgacaaagtgagac

SEQ ID NO: 6786169 - DNA, 69 bp, Homo sapiens
cccaggggactgagccacttgctcacgtgcacatggttgtgagtggtggagctgggctcagaccctggg

SEQ ID NO: 6786170 - DNA, 71 bp, Homo sapiens
tgggcaggtcacttaccttctctgagttcaagtgattttgcctttcagatggaggcaatgttaccttccca

SEQ ID NO: 6786171 - DNA, 121 bp, Homo sapiens
aaatgatgagaaatgaaataactgttctgactttgagagtggtagagggaagacaatggcaaatgtttctaggcaggtattcccattccacttatcaaggctaaacagggctcacacattt

SEQ ID NO: 6786172 - DNA, 74 bp, Homo sapiens
ggggtggaaggcagcagtctcaggctgattggtctgtccaggaagcagcttttctctgagacctttccacaccc

SEQ ID NO: 6786173 - DNA, 74 bp, Homo sapiens
gaaatgtgtcaaagtgtggagtatttatatgacaatttcatttaagctttcagggcactattgaaacacatttc

SEQ ID NO: 6786174 - DNA, 66 bp, Homo sapiens
cggggttcatccatgctgtggcctggatcaccgcttccttcctttttgtggctggatgataccctg

SEQ ID NO: 6786175 - DNA, 98 bp, Homo sapiens
ctcaggtcttcctccaccagggctctgagctctgaagatacaggacatcctgacactgcactcccagggctctagagtgctggctggaagattctggg

SEQ ID NO: 6786176 - DNA, 86 bp, Homo sapiens
aaggctgatatgtaatagatgattgggaagtacctaagtaacactccatatacaacttaatctttatataagaagcgtgcagcttt

SEQ ID NO: 6786177 - DNA, 69 bp, Homo sapiens
tgaaaatcatagccatgaacatttgtatgcttacaaagctgccaaatgatgcatggctagtgagtctca

SEQ ID NO: 6786178 - DNA, 77 bp, Homo sapiens
ttcgccactagggggcagcattggtttacacagggtgaacaaacgttcaattctaaactaatattctttggtgggaa

SEQ ID NO: 6786179 - DNA, 71 bp, Homo sapiens
cagttctgggtgcatcagttttttagaagtaactgttcagttaacggcagatctgatgttaccaagaattg

SEQ ID NO: 6786180 - DNA, 92 bp, Homo sapiens
ccattcaggacatatttatgtacccttttttatgtcaagcattgtgtcaggcacttgggagacacaagaagacatggtctgtgtcctggagg

SEQ ID NO: 6786181 - DNA, 62 bp, Homo sapiens
tttggcctggtaccacatagatttaggtttaatttaaattttaccctcgtacacaggtcaaa

SEQ ID NO: 6786182 - DNA, 65 bp, Homo sapiens
aattccaagcactgttaattaaacttggctaatatgttaagcgaaattatttcaggtttggtttt

SEQ ID NO: 6786183 - DNA, 81 bp, Homo sapiens
tatcttgggagatcgaagtatttctgagttgcccagtgggcaaaatccttacagggcatctctgaatcttcacccaaggtg

SEQ ID NO: 6786184 - DNA, 78 bp, Homo sapiens
tacgttaggttcatgtttgagaacaaggagtccaacatccagatcagacttctagaatttcaaatctgaaataatgta

SEQ ID NO: 6786185 - DNA, 81 bp, Homo sapiens
tattttttagagctgcatactaaagtatttagggatgaaatgtcatgtctgtagtttacagtatttcagcataaaaaaata

SEQ ID NO: 6786186 - DNA, 111 bp, Homo sapiens
ttgtttgtgattgtctgtcctaacttaggtggtttatcttgaagatcttaggtaatttagcctcatagatttagatagatcgagaaatggcaggcttcaatcactgaatag

SEQ ID NO: 6786187 - DNA, 73 bp, Homo sapiens
gagcggctagggcttcaggtgtgaggcaggaggggtggggccagaactgcccacacctgagctgggccggctc

SEQ ID NO: 6786188 - DNA, 71 bp, Homo sapiens
gttggttagatttcctcactttgcaagaattcccaagtatgcacagtgattacaaagaaatcagagccaat

SEQ ID NO: 6786189 - DNA, 130 bp, Homo sapiens
tgctggagtggctccttccctgtggtgagatgaagggaccacctccaggaggtctgagtgtggacactggggcctggtcttcacacacagtcctctttctcttcagcaccattcacatgcagcctccatg

SEQ ID NO: 6786190 - DNA, 77 bp, Homo sapiens
gtttccccagcacagggcttgagaggtgtctgaggagttcttagggactctctagcaccctgtgcttttagggaaat

SEQ ID NO: 6786191 - DNA, 72 bp, Homo sapiens
gggctcaggtgatcctaccaccttggcttccccaaatgctgaaattacagcgtaagtcacagcgcctggccc

SEQ ID NO: 6786192 - DNA, 81 bp, Homo sapiens
ggctctggaagagtcaacacaagcaatattgaaattgttcatttaaaatcgcactgctgttgttaaatgctgttgtgagcc

SEQ ID NO: 6786193 - DNA, 70 bp, Homo sapiens
tctgatttatgtattagagctccatgaggggccactgctagtccacatggagccctttgtgcaagccaga

SEQ ID NO: 6786194 - DNA, 92 bp, Homo sapiens
ggagacctcatccatgggagatttctgtcctcaatggtagcccacttgctccttgggacttctcagacattttcctttgttcttgagtttcc

SEQ ID NO: 6786195 - DNA, 64 bp, Homo sapiens
ttgacagatccacccttgtagtgacacattttaaatctctgtctgtcatttatggatctggcaa

SEQ ID NO: 6786196 - DNA, 57 bp, Homo sapiens
ttgtctgtaattcagacagtaagcaccaagccaaggtttgtctgagtatgctgacaa

SEQ ID NO: 6786197 - DNA, 98 bp, Homo sapiens
gatggcaatctggctgggacccagggccagctgataatcctggtgacagtaggagctgccaccaggaagtggtggcctgggcctggacctcagccatc

SEQ ID NO: 6786198 - DNA, 126 bp, Homo sapiens
tcagattggattaggacccaccctacaagcttcattttaatgtagtcacctctttaaatgtcctgtcttcaaatacagtcacattctggggtactgggggtttagggcgtcaatatttgaatctga

SEQ ID NO: 6786199 - DNA, 69 bp, Homo sapiens
cagtccaggcatgttgggaagatgaacatccatcagggatcgttatccaccccgatgctgtgtgttttg

SEQ ID NO: 6786200 - DNA, 83 bp, Homo sapiens
tcccggcttcttcagagctatttgtagatggcacacttggcaccctcagtgggagtgtgtgccagcctacgaggagcccagga

SEQ ID NO: 6786201 - DNA, 103 bp, Homo sapiens
ggagcaaatgtgtaaaccatgtaggggtctgtggtcttgcaatggcagatggggaagtcattattgtgatgaacacaaggcttattaatgtgcaacagtgccc

SEQ ID NO: 6786202 - DNA, 61 bp, Homo sapiens
cggagcgctgggggactctgcagcgcgcaggtgaccacgcagagacagccccagcgcgatg

SEQ ID NO: 6786203 - DNA, 59 bp, Homo sapiens
ggagcctgagagcaggggtccagtggaggctgccatgttgagcccttgcctcagagccc

SEQ ID NO: 6786204 - DNA, 56 bp, Homo sapiens
tcacctagcattcctcttcctcatgttcagatgtgaatgaaggggcagctggagga

SEQ ID NO: 6786205 - DNA, 64 bp, Homo sapiens
tttcacagagaaatataacaggcctgatgtcttcctgacaattctgttattttcttgtgtggaa

SEQ ID NO: 6786206 - DNA, 68 bp, Homo sapiens
gaagtcctgtcctcaggaaagcagataacaggatactgatcctaatctgaggattgagagaagacttc

SEQ ID NO: 6786207 - DNA, 65 bp, Homo sapiens
ggtggtcaggggctgtggctatggctttccaggagcacgtggcttcccttatggcccctgtcccc

SEQ ID NO: 6786208 - DNA, 76 bp, Homo sapiens
gtgctagacatgctgtgagagtcccaaagagctcccattcagagagggacctttacacagacattcaaaatagtac

SEQ ID NO: 6786209 - DNA, 127 bp, Homo sapiens
gggcacccagccagccccaacccttctgcagtttcagcctttctggcccatctacatgtcttccctcagaggggccagctagagcatggggcaggctggacaggggctcagggctgtggcacagcct

SEQ ID NO: 6786210 - DNA, 86 bp, Homo sapiens
atctctaaggaattcttagtgtcttaattcttgttgttcagacagtactgagtatattgagtttagggcaccactctttaagagat

SEQ ID NO: 6786211 - DNA, 106 bp, Homo sapiens
cttaagggtaaaggctgcgtcttctgtttcctctgcgtcttctcgaagcactgtgtgtaagggccagagcacagaggatgtttcatacacgtgcctttgccctgag

SEQ ID NO: 6786212 - DNA, 58 bp, Homo sapiens
aggcatggaacatggaattaaatatgagctactagcattatacatatgttctctgcct

SEQ ID NO: 6786213 - DNA, 76 bp, Homo sapiens
ggtagagaaagattctgtcagttaggaggagactgtgatgttacttttcctgtgatatgatgagtacttttttacc

SEQ ID NO: 6786214 - DNA, 68 bp, Homo sapiens
gcttttcctgactttccattagcagaaagctttataaaagctgccatttatgtaaagtacagaaaggc

SEQ ID NO: 6786215 - DNA, 57 bp, Homo sapiens
actgaaaatcttgtgagatctgtgacagcaaggctctcagcagaaagcaaggtcagt

SEQ ID NO: 6786216 - DNA, 100 bp, Homo sapiens
gaggcaggagaatcgtttgaacctgggatgcggaggttgcggtgagtggatattgcgccattgcactgcagcccgggcaacaagagcgaaactccgtctc

SEQ ID NO: 6786217 - DNA, 75 bp, Homo sapiens
tgcttttgaatactgtttgaaattggcttgttctgagatgtaagaaagccaagcctctttaaatggataaaagca

SEQ ID NO: 6786218 - DNA, 86 bp, Homo sapiens
ttctgtccagtggctacactcacactttaaatcaaatcttctaacattccttgaagtaaagcagtctgtgtatgtgaactgaagaa

SEQ ID NO: 6786219 - DNA, 93 bp, Homo sapiens
aggcaggtgtgcacctcatccttagggcattgcagttctggtccatgttgtcaccaggctgagggctcctgagggcagcagcagtatctgcct

SEQ ID NO: 6786220 - DNA, 56 bp, Homo sapiens
gagccaacaggcaacctgctccaatgatttagtgagggggttgtgtggaaggtatc

SEQ ID NO: 6786221 - DNA, 82 bp, Homo sapiens
tcctccctcttaaaaacttgatatattttaaaacattctaataaagtgcctaagaaatcgttcaggtttgaagtagggaggg

SEQ ID NO: 6786222 - DNA, 75 bp, Homo sapiens
ggcaggctagaaactcaggcaagaaagaccctgctttctctgcagcattttcttgtttgagtttacctagctgcc

SEQ ID NO: 6786223 - DNA, 72 bp, Homo sapiens
ctacacagaagagtggtgtcatatgctctgaggccactgaggcctgcaggcttgtgctccactttcagtgag

SEQ ID NO: 6786224 - DNA, 83 bp, Homo sapiens
cagagaggtattctgctgctatcaggtcacccaaagaggaagcacttcatatttggtcaatatggtagcagcatatcactctg

SEQ ID NO: 6786225 - DNA, 57 bp, Homo sapiens
agcctcagtttcaggcctcctccttttaaagtggagaagagctgcacactggggact

SEQ ID NO: 6786226 - DNA, 82 bp, Homo sapiens
gtaaatacacatttcactgtatgagagggcttgataatttggtgaggagaattttttaggctttactcaatggcgaatttac

SEQ ID NO: 6786227 - DNA, 59 bp, Homo sapiens
tcctggtgatcaaaattcatttccgagttatttcctgaaatggtattttgacacctggg

SEQ ID NO: 6786228 - DNA, 59 bp, Homo sapiens
gctgcagttggttataaaaacgtgacggatgatttaggtggctgtattcagctgtaagc

SEQ ID NO: 6786229 - DNA, 67 bp, Homo sapiens
ggagacaaaggtttttctctttgacagggattctgccttttgcctcagagtagcaatttttctctcc

SEQ ID NO: 6786230 - DNA, 72 bp, Homo sapiens
ctgtggggtctgcattcactctgcaaatactgagtgcctgctctctgcagagtgctgtcgtacgccccagag

SEQ ID NO: 6786231 - DNA, 91 bp, Homo sapiens
tgagaagatggaaattcatttacataacagtaacgctgaatcaatatattttcagcttgccctgatgtggaagaaatataccatctcatta

SEQ ID NO: 6786232 - DNA, 59 bp, Homo sapiens
gaggatgttttcagtcttgtgctattacaaacaatacagcaatgactgagtacattgtc

SEQ ID NO: 6786233 - DNA, 58 bp, Homo sapiens
cagccactcggccataaaggcttcattctttatattgtggcagggctgggatgggctg

SEQ ID NO: 6786234 - DNA, 129 bp, Homo sapiens
tcgatttgggagctgagaggagagggggatgagagcgggtgtgcgtctcgctcggatttattaaacacaatgccttcaagatgccagggacgcggcgcctcgccgggcctccctctcagtctccctctg

SEQ ID NO: 6786235 - DNA, 74 bp, Homo sapiens
cagatttgttggctaagcagtttaagcaccctggaggtggagacctctctgaaagcagctgctcatcagatctg

SEQ ID NO: 6786236 - DNA, 60 bp, Homo sapiens
tatctctgtgggatgtaggcctctgcgcccggaggtggctccctgtgtcccacgtagatg

SEQ ID NO: 6786237 - DNA, 59 bp, Homo sapiens
gggcagtgcacatgtgtgcatttgtatgtgtgtgttttgcatattatgtgtatctgtct

SEQ ID NO: 6786238 - DNA, 63 bp, Homo sapiens
ttagctgtttatttctgtatgtgcatttcctagcagtctacacatacagatggttccagctgg

SEQ ID NO: 6786239 - DNA, 73 bp, Homo sapiens
ggaggaagccaggctgcacttgctgggcagtcggaggggacaggtggcaccagaaggcagttggacttaccct

SEQ ID NO: 6786240 - DNA, 129 bp, Homo sapiens
gctccctcagctctcccactttgcagaggcacacgaggtgcttccaccatttcacagtggactctcctccatccctcactgagttggggaggcccctctggccgaggtggttggctgaggacacccagc

SEQ ID NO: 6786241 - DNA, 58 bp, Homo sapiens
caagtccttagatggttctttggtttgggtggtcagagaaagcttctctaaggatgtg

SEQ ID NO: 6786242 - DNA, 79 bp, Homo sapiens
gtattggcaatgatctcaatcttctcatcttgaaagacacccacttaggaaaggatggtgaaggatcagtgccagttgc

SEQ ID NO: 6786243 - DNA, 65 bp, Homo sapiens
ccaggctcagtcagaaaatgtatctctgcctcctggggaaagaaacatttttcttgctggcatgg

SEQ ID NO: 6786244 - DNA, 103 bp, Homo sapiens
ccgcggtcggtgggtgcgggccacgtggtggcgaaggtgcgcgcagtggatgcggactcaggctacaacgcgtggctttcatatgaattgcagccggcggcgg

SEQ ID NO: 6786245 - DNA, 67 bp, Homo sapiens
gatagatggatgattagacagatgcatttggaagtatttggaatgcctctttggagttatttctgtc

SEQ ID NO: 6786246 - DNA, 88 bp, Homo sapiens
cagccaccaccctggaaagaaggtctggggaaggctacccacagtcatatcctcagcacatctttacatttccagggagagtgcactg

SEQ ID NO: 6786247 - DNA, 127 bp, Homo sapiens
gaatgctctgaattgatttggttgtagtgtagccttaaaattggtagtcactcaaaattcagggcagatggtctttagtgtttgcgtgtactcctgggcatttatcaattagaattcagcagcattt

SEQ ID NO: 6786248 - DNA, 112 bp, Homo sapiens
gggatggttaaaacattacggtacaggttgaatatcccgtatcttaaatgcttgggaccagaagtgttttggattgtgggatattgcatattacttggtggctgagcatccc

SEQ ID NO: 6786249 - DNA, 57 bp, Homo sapiens
tcactttttgatatcattctgccactattgggacaggaccaactgatatagaggtga

SEQ ID NO: 6786250 - DNA, 79 bp, Homo sapiens
gccactctactgtgagatttttaaataacttggtacatgtagctaagaagggtttaaagtttatagtaataggattggt

SEQ ID NO: 6786251 - DNA, 63 bp, Homo sapiens
tctaggaggcctattgtaaacaaaactggaatttattaatgtgttagggtatggtttcctgga

SEQ ID NO: 6786252 - DNA, 79 bp, Homo sapiens
catagctcagatgttctgttgggagaatggttctctcatgtcttgttgagcatgaggctctccaagcagatgagtagtg

SEQ ID NO: 6786253 - DNA, 62 bp, Homo sapiens
attccttagccagtaggtcttcagcatttgacaggaaaatcctgaggcccgttgtgtggaat

SEQ ID NO: 6786254 - DNA, 69 bp, Homo sapiens
aggtaacgttggtaaaagcattcagctatgtgtaaagcactgtggaatgtgcttttccttaatgttctt

SEQ ID NO: 6786255 - DNA, 56 bp, Homo sapiens
ggatgtgctcactggggtctgtgtggtgcccatgaggacaaagtgtagcagcctcc

SEQ ID NO: 6786256 - DNA, 66 bp, Homo sapiens
gggcaggatgtccccctgggcacacggcctaggacatggcttctcccaggaggacattccataccc

SEQ ID NO: 6786257 - DNA, 78 bp, Homo sapiens
agggctgataatccattacaacagttactaaatcctctttgggaattagctaattaattgtagccctatacagcacct

SEQ ID NO: 6786258 - DNA, 71 bp, Homo sapiens
tgctgcagccaggagccaggtcttcacccacttcccagggagtcacaagagcctggctgctaggctcagcg

SEQ ID NO: 6786259 - DNA, 68 bp, Homo sapiens
gtgattgctatgtgctaggcactggacaacgtgctgttcaggaatcaaccaagtcatttagttctcac

SEQ ID NO: 6786260 - DNA, 105 bp, Homo sapiens
agagcctctcctgcatgctgcaccagagcctctcctgcatgctgcaccagagcctctcctgcatgctgcaccagagcctctcctgcatgctgcaccagagcctct

SEQ ID NO: 6786261 - DNA, 77 bp, Homo sapiens
acagcagtagttacctggggtacatggttaatttgatttagcagattctttggctaaaccctagtaaattaaaatgt

SEQ ID NO: 6786262 - DNA, 77 bp, Homo sapiens
ggcgaatggatgctggtcagtttggcaaattcactgaaactcatcaagaacccagctgaacttgcattccaacttcc

SEQ ID NO: 6786263 - DNA, 63 bp, Homo sapiens
ctgcatttgagattattaatttgacgggggagggctcccattaatattgttcttctttagcag

SEQ ID NO: 6786264 - DNA, 103 bp, Homo sapiens
ctgctgtggttcaactgcactttaggccaactaggcacagggaaaagcaaccctctctgctcctcacatggcgctaaatgcaggagaaacttcctcccagcag

SEQ ID NO: 6786265 - DNA, 68 bp, Homo sapiens
tgaactatgtttggctctgtgagtgatggctgagatttaccatacaaatagagattcaaataaagtca

SEQ ID NO: 6786266 - DNA, 58 bp, Homo sapiens
tactgccttctttaatcctagttttactcttcttaacaagtctaagagaatggcagtg

SEQ ID NO: 6786267 - DNA, 57 bp, Homo sapiens
ccagcagggaaaaacccaccaacagaattagtgggacgctgggggactctctgctgg

SEQ ID NO: 6786268 - DNA, 57 bp, Homo sapiens
tgggtgagcggggctgggcaccaggcccctctggtgctggcttttatctggtcccta

SEQ ID NO: 6786269 - DNA, 58 bp, Homo sapiens
gtatcagtgtgcatctctgaatgatggtgattgtcttttatgggtcatgctgaattgc

SEQ ID NO: 6786270 - DNA, 57 bp, Homo sapiens
taactcatggagaggcggagttaaacataagttaaaccgctactggaccaggagtta

SEQ ID NO: 6786271 - DNA, 94 bp, Homo sapiens
gttcagttcagagtaggagctgatgcttattgaggacttaaccttccagacatcatgctaagcctttacaagcattagctcatttgaactttgc

SEQ ID NO: 6786272 - DNA, 70 bp, Homo sapiens
ccttataataactttatcaaatatatactgtttctacctttaatgtatagatgaggaagctgttataggg

SEQ ID NO: 6786273 - DNA, 81 bp, Homo sapiens
ttttgttctgaaaatcttcccttaatacatcacatgggtttttgaggcagatgtttggagggcatgatttttagggcagaa

SEQ ID NO: 6786274 - DNA, 65 bp, Homo sapiens
tcaagatgcctggtgagtggtcagatggtgattgggctccccctgtacagtctctgtggcactga

SEQ ID NO: 6786275 - DNA, 58 bp, Homo sapiens
cattcatccactgttggaaatttgagttgcttcctccttttccctattgtggataatg

SEQ ID NO: 6786276 - DNA, 90 bp, Homo sapiens
caggtggggacccacggcctggtgcagcaggtcgcggcactcgagcagcccggcggccagcacgcgccggtcgaaggtgaagtccacctg

SEQ ID NO: 6786277 - DNA, 69 bp, Homo sapiens
ctcccagccatactgacatcaacaaaaatagccacacacatttttgaatgcccaaggtttggctgggag

SEQ ID NO: 6786278 - DNA, 104 bp, Homo sapiens
aaaaccagaaccaagttaattaggtttactgaattagtggaacatctaaattggattccattccgctgtttagttgaagtttatcttagcttggagctgatttt

SEQ ID NO: 6786279 - DNA, 102 bp, Homo sapiens
tgaggcaagagaatcacctgaacccaggaggtggaggttgtggtgagcccagacagcaccactgcactccagcctgggtgacagagcgagactcttgtctca

SEQ ID NO: 6786280 - DNA, 129 bp, Homo sapiens
cccacagcctgtcctcctctcttgagagctgtcctggctcaggctgtggctggattctcaagcagcatcatgtggccaggttaggagcaggatgtcacagagagaggggtccaaagttcagctgctggg

SEQ ID NO: 6786281 - DNA, 73 bp, Homo sapiens
tgctgtgacctttgagtacgcacttagatcctaagatgtttacaatagttctcaaagataaagtttcacagca

SEQ ID NO: 6786282 - DNA, 65 bp, Homo sapiens
ctcagcagcagggaagaggtcaaccatgctggttcttgaaatgttttcttcccttggcttctgag

SEQ ID NO: 6786283 - DNA, 90 bp, Homo sapiens
cctgccattttgactttggttagaggtaaaaacattaagttctgggatttgtcattaccattgctgccttctgagaagttaaatggcagg

SEQ ID NO: 6786284 - DNA, 55 bp, Homo sapiens
agggcaggagctggggtgggcaggccctgaggtcagccagtaccattctgccact

SEQ ID NO: 6786285 - DNA, 72 bp, Homo sapiens
cctgttagctgtttcttgagagtattacccttcatgagcctagttaaagagggtatttcagaagctggcagg

SEQ ID NO: 6786286 - DNA, 67 bp, Homo sapiens
tttacattttagccttcaaagcattctctcagtagcagagcaggctagctttaagccaaaatgtgaa

SEQ ID NO: 6786287 - DNA, 56 bp, Homo sapiens
cactgattccctgtgaagcagggcagcgcttcagctctcatgcagtggggggtgtg

SEQ ID NO: 6786288 - DNA, 64 bp, Homo sapiens
ttaccagcagacacgtgtgctcagactgatctgactctgggttttgacatttctctctgcgtga

SEQ ID NO: 6786289 - DNA, 55 bp, Homo sapiens
agcaccaggcagtatatcaaagggtggtctacttattgtgttattttctggtgtt

SEQ ID NO: 6786290 - DNA, 98 bp, Homo sapiens
cttgtccttgcttcacacctacaatattcaaagttttgggaaataacatccaattggcttggccaaggctctgggtttcataggtgggaagtagcaag

SEQ ID NO: 6786291 - DNA, 77 bp, Homo sapiens
gctggaacagctcaaaattgaataattaattacactcagcttcaatcgcagtgactaattgatcaggggctgccagc

SEQ ID NO: 6786292 - DNA, 68 bp, Homo sapiens
gaaacggggtttcaccatgttggccaggctggtctcaaactcctgacctcaggtgatccgcccgtctc

SEQ ID NO: 6786293 - DNA, 69 bp, Homo sapiens
gagagatggaaatgttccatatattgattatgattgtagttagtgtgttaatgagtatatccatttgtc

SEQ ID NO: 6786294 - DNA, 63 bp, Homo sapiens
gagaatctgggttttggctatcgaggatgaattatttaactggtctgaagcctcaggttcctc

SEQ ID NO: 6786295 - DNA, 57 bp, Homo sapiens
cttccgtcttaagcagccaacgagcagccacgcagcgtgctgctagcgggacgggag

SEQ ID NO: 6786296 - DNA, 69 bp, Homo sapiens
caggagcaagagttgagggatgtcagttcccaccatccaggggacttggcagctcagctgtgattcctg

SEQ ID NO: 6786297 - DNA, 60 bp, Homo sapiens
ttgggaggtctgggtgggaggattgcttgaagccagaagttctcaaaaccagcttgacaa

SEQ ID NO: 6786298 - DNA, 56 bp, Homo sapiens
gggtcagatcagcgggccaactgggaaagagccagggcccactggctgtctgaccc

SEQ ID NO: 6786299 - DNA, 55 bp, Homo sapiens
atcataggtataagtaaattagacattaggtcttgctgactttagtacctttggt

SEQ ID NO: 6786300 - DNA, 56 bp, Homo sapiens
tcagcaggcccatcctccaggccaatggcccacactatgggggctgggtaagctga

SEQ ID NO: 6786301 - DNA, 72 bp, Homo sapiens
tgctgactcctggctgtgacacaaagccctctattgctccccctgggtccctcacctgccaggatttactca

SEQ ID NO: 6786302 - DNA, 71 bp, Homo sapiens
ctgacaactgcctggggcatcagtcaaggttcctgttctggagcacaggggaagccccaggcatggtccag

SEQ ID NO: 6786303 - DNA, 79 bp, Homo sapiens
gggctttgggctgcagctggagcatcttctcatcttgcatttgggtgtggtggggtcctccagtgtgggatccatgtcc

SEQ ID NO: 6786304 - DNA, 90 bp, Homo sapiens
ttattttctgtcttccttcctagagcataaactccgttaagatcattctgaatgtttcgtaaattgtctatgggaggagagaggaagtaa

SEQ ID NO: 6786305 - DNA, 55 bp, Homo sapiens
tgacagttttttgatgaggaatggaacttgttaatcctcctcacacagaacttca

SEQ ID NO: 6786306 - DNA, 65 bp, Homo sapiens
catttctgattgtcatgctgggtgtggagctcatgctactggcatctagcatccagtgagtagtg

SEQ ID NO: 6786307 - DNA, 64 bp, Homo sapiens
gacataatcctcctcacctactggtctccctgggtccctccaccaatggtgaggtgttactgtc

SEQ ID NO: 6786308 - DNA, 81 bp, Homo sapiens
actaaatagtaagtcagaaggctttcctgtaggaagacacaactacggtttgtttcactgaaagccttactactcaacagt

SEQ ID NO: 6786309 - DNA, 64 bp, Homo sapiens
ggacaaatgagccctaatttacaacatctagtctttctagatgctaaggaggttgccagtgtct

SEQ ID NO: 6786310 - DNA, 59 bp, Homo sapiens
ggccctgttccacgtggggtgtgagtgacacctcccagccgcgcgtggcagcaggagct

SEQ ID NO: 6786311 - DNA, 57 bp, Homo sapiens
tttcacagcatataggtgtacttctttgggggactagtgcaattattgtgctagaga

SEQ ID NO: 6786312 - DNA, 56 bp, Homo sapiens
taatctagtcccacatggaattcactgcaaatgatttctaaatgtgggcaggattg

SEQ ID NO: 6786313 - DNA, 69 bp, Homo sapiens
cagttgaatggaagagaagtgtcctgtgcatcaacgtgttcttcaggacacttgttcttctctgcactg

SEQ ID NO: 6786314 - DNA, 55 bp, Homo sapiens
ccagacttcacccactttgctcttgtctgcactgagtaagcgcatggaagtctgg

SEQ ID NO: 6786315 - DNA, 57 bp, Homo sapiens
ggtggatcctgaaggctcagcagctggcggctgtctgtggacttccttcattctact

SEQ ID NO: 6786316 - DNA, 58 bp, Homo sapiens
gaaacaaattcaggttgctctaggccggcctagatctggcacatctgctttggatttc

SEQ ID NO: 6786317 - DNA, 75 bp, Homo sapiens
gtctctaatgctaaggatttgttaaggaatcactaaacacggttagtgcttaatagatgtccagcatcatgggac

SEQ ID NO: 6786318 - DNA, 55 bp, Homo sapiens
acataagagcaggtgaggcactctgtcatcggtggatgcttcatttcttttatgt

SEQ ID NO: 6786319 - DNA, 72 bp, Homo sapiens
atgcagagcaaatattatgctttcctcttggaaaacctccaggagctgcaaatattagtaatccagctgcat

SEQ ID NO: 6786320 - DNA, 61 bp, Homo sapiens
ctttgctgatctctggtttaaagcatagatgaaaaatcctgaaagccagaaatcagttgag

SEQ ID NO: 6786321 - DNA, 63 bp, Homo sapiens
gtaatcctgtgtgtgtatgtgtaaaaatgtgtctatacatttgtatatatgcagcatacttac

SEQ ID NO: 6786322 - DNA, 80 bp, Homo sapiens
gagccctgctcaaatttcagactcatgaacaaaataaataaataattgttgtttcaagcctctgagttttgaggtggttt

SEQ ID NO: 6786323 - DNA, 93 bp, Homo sapiens
cactaattagctaagagacttaagaataattgagagagggagttagttagcctcaatgtcttctcaagtcttttccaatgttaatgttttgtg

SEQ ID NO: 6786324 - DNA, 126 bp, Homo sapiens
ggattagcaggtgaaggccaatgaaagtccatataatggaaaacagaagtggcaggaaattttgatatattcttatactctggaattttattcttttggctttattcccttctttgtaagtaatct

SEQ ID NO: 6786325 - DNA, 79 bp, Homo sapiens
cgccaggtctgggggttagtgcaggggatgcaggcaggataacaattagatccatggggcacaccctccaggcccggcg

SEQ ID NO: 6786326 - DNA, 88 bp, Homo sapiens
ggagaaatcgcttgaaccctggaggtggaggtgcagtgagctgaaatcgcgccattgcactccagcctgggtgacagagcgagactcc

SEQ ID NO: 6786327 - DNA, 63 bp, Homo sapiens
gggaaggagggagggaggaaagtgaggtgtctcacactctggcaagcttccacttcctatctc

SEQ ID NO: 6786328 - DNA, 55 bp, Homo sapiens
aggtaccatatgcgggagcaaccttagaatgccaggtgtgcccgcatcaggatct

SEQ ID NO: 6786329 - DNA, 55 bp, Homo sapiens
tccaggtatgtttggggtcctggaaagattgcagggttctggaatataatgtgga

SEQ ID NO: 6786330 - DNA, 60 bp, Homo sapiens
cttatcttacttccattgtgatgacccaccctcaccatcgcctgggaagagaaaggtaag

SEQ ID NO: 6786331 - DNA, 66 bp, Homo sapiens
cttaggtgcccacctgcttactctgttcccaaccccaactcctgaagtagcaggtggcgtctgcag

SEQ ID NO: 6786332 - DNA, 61 bp, Homo sapiens
gctggaacagtctttaagcaggaattagaccacatcaccccctgccttaacagctttcagt

SEQ ID NO: 6786333 - DNA, 109 bp, Homo sapiens
gtagattctgatttcagattttgtattctcaaagttaatttgcagctttcgagcttcagttgggaatttcaaaagtgtaattaaaagaggaagtgtgttcaggatttat

SEQ ID NO: 6786334 - DNA, 96 bp, Homo sapiens
gccaattatcagtcaggttctgatttctggaagcattatcccacgagataaatagacaagtcagaaataacacagcttgattttaagataacaggt

SEQ ID NO: 6786335 - DNA, 67 bp, Homo sapiens
gattttctgataggtgaaatattcaaaatgtagtgaacctacatagggttgttatctacactgagtc

SEQ ID NO: 6786336 - DNA, 81 bp, Homo sapiens
ttttaattgaaaagttttgaaacactctttttgtagaatatgcaattggatatttggagtgctttgaagccttcattagaa

SEQ ID NO: 6786337 - DNA, 78 bp, Homo sapiens
gcagcagctctcggagtggtgtttacagtaatctcatgttatatttagtgaacattacgtccgattgtattgtgctgc

SEQ ID NO: 6786338 - DNA, 94 bp, Homo sapiens
gccaaggccggctccacaggcagcctcagggcacccgaccccggcctgaagcccaagtcccctcctgaggccctgttagggtcttgcctccggc

SEQ ID NO: 6786339 - DNA, 71 bp, Homo sapiens
cagtgaatcactgggctgcatctcatgttaaatgtctcaggaggacagaggtgcccagggcaggtttactg

SEQ ID NO: 6786340 - DNA, 77 bp, Homo sapiens
atgttgggtacaatgtagagtaaaatatgttaggatactcaaattcttagcaatcaccacctctatatttactgcat

SEQ ID NO: 6786341 - DNA, 56 bp, Homo sapiens
tgcatctaagtggctaacaacccatgagtgcctgggttgcctttgcagttggatca

SEQ ID NO: 6786342 - DNA, 59 bp, Homo sapiens
tattaggttggtgcaaaagtaatggcaaaaaccacaattatttttgcaccaacctaata

SEQ ID NO: 6786343 - DNA, 67 bp, Homo sapiens
ggctgcagtgctgagggggaaggaaagctgatgtgcatcactgccggtctcctcatgccctgtaccc

SEQ ID NO: 6786344 - DNA, 129 bp, Homo sapiens
ccagagatctttccactgagccatacctagtggatatgcttcttcctccatgtgttctggattttaggaggctgcagttggaagcagctggtagatggcactcttgagtgacgaaagatatgactcagg

SEQ ID NO: 6786345 - DNA, 79 bp, Homo sapiens
gaggcaggggatcttgacgtcctcgatggggaacttatagtcataggtaatctcctcattgacgttaatgtgctgcttc

SEQ ID NO: 6786346 - DNA, 61 bp, Homo sapiens
gaggcttgggacattagttgcattgcgccaagtcagagtatcagtgactaaccgaagcctc

SEQ ID NO: 6786347 - DNA, 74 bp, Homo sapiens
ggctttattccatgtgtctatgaccaaggtgtttttctctcattggtcatagtccatggcataatgtcctggcc

SEQ ID NO: 6786348 - DNA, 78 bp, Homo sapiens
agcccttggaggccacttggcagatggcagctggcccatagctgcaaagatctgtcagtcatgaggcacctcagggct

SEQ ID NO: 6786349 - DNA, 89 bp, Homo sapiens
ggagaatcgcttaaacccaggaggcagcatttgcagtgagctaagaccgcgccattgtactccagcctgggtgacaagagcgaaactct

SEQ ID NO: 6786350 - DNA, 57 bp, Homo sapiens
ataccactctcccagctaaagagccttcacaggagggtgctcaggatggagaggtgt

SEQ ID NO: 6786351 - DNA, 88 bp, Homo sapiens
ctgtgggatttcctcctgcagccctcagcagccaaaatgtatatggagaggtgggcagctggcttgctgcaggatgcaggatttccag

SEQ ID NO: 6786352 - DNA, 56 bp, Homo sapiens
cctctgagccagcgtcttctctaatatggagatgaggatagtgctggcctcatggg

SEQ ID NO: 6786353 - DNA, 74 bp, Homo sapiens
tcccagtccggtgggctggagcaatgatttcagaggcccggaatctgaggcaagctgggcccatggactaggga

SEQ ID NO: 6786354 - DNA, 69 bp, Homo sapiens
actttgggggaagaattaaaacaagaatggcatttctttttcttcatgtaacttttcttctccataggt

SEQ ID NO: 6786355 - DNA, 88 bp, Homo sapiens
accacatgtataaatgcacatatatgtgtatacatatgtataaattgtgtgtgtgtgtgtgtgtgcatgcacatagaatattagtggt

SEQ ID NO: 6786356 - DNA, 79 bp, Homo sapiens
gaaaatacatagagaaagtattagcctagaagtcaggtcccttgacttctagattttgatgctgcttctgctgtttgtc

SEQ ID NO: 6786357 - DNA, 70 bp, Homo sapiens
tcggagctcagtttttgcttcatgggtcaaaatgtgggctggccaagtggttacaggaacagggtttcgg

SEQ ID NO: 6786358 - DNA, 65 bp, Homo sapiens
gttggaaatgaaatgaagttggcctggcttttgaagcctgtgccattttcattacacactctgac

SEQ ID NO: 6786359 - DNA, 63 bp, Homo sapiens
cagtccagagtaccccaagaagtcagaccaaatctgttgtctggtatagagggcactgggctg

SEQ ID NO: 6786360 - DNA, 72 bp, Homo sapiens
tcacacttccctcctggattccagactgtcaggagggatgcctccgaggtggtgtttggaaggaggtgctga

SEQ ID NO: 6786361 - DNA, 80 bp, Homo sapiens
taaaatgaggggacagagattctaaacttgattctgctgcaaatcagctatgtcatttggggctctgacatctcatttta

SEQ ID NO: 6786362 - DNA, 68 bp, Homo sapiens
gctgttgatgggtctcaggtttttgtcatgtggatctctccacagagcaacttgagtatcctcatggc

SEQ ID NO: 6786363 - DNA, 55 bp, Homo sapiens
ggagcttgttggggaaggagaaagggcaagtccctcgtggtccacagcaggcacc

SEQ ID NO: 6786364 - DNA, 99 bp, Homo sapiens
tgagaagcagaagtctatgaaattttaggaggtcgattgttcacacctatttgcaagacttcattgtaatattatagcaccttcttccatctgctctta

SEQ ID NO: 6786365 - DNA, 81 bp, Homo sapiens
gcagcatagggtaacaccatggttcccaaactgtgtgccaaggctcatgggggcaccatggtgaattcacaagagtgctgt

SEQ ID NO: 6786366 - DNA, 112 bp, Homo sapiens
tgatggtttgcttaattaggcagcatagctgttggaaatcctatagttcagtgattgtccctttaacatatctgtgaggttttgttgtgaaaacttgattaagaaactgtca

SEQ ID NO: 6786367 - DNA, 66 bp, Homo sapiens
ctcacagcatggtggccttagggtagcccgatttttcacatggtggctcagggctccaagcatgag

SEQ ID NO: 6786368 - DNA, 61 bp, Homo sapiens
cttaatcctcacaattacctcagttttgcagaaaaggaaactgaggtccccagaggttaag

SEQ ID NO: 6786369 - DNA, 130 bp, Homo sapiens
ctttataccaaagtctgttacaggttagattgaaggcagtgaaaggaaaaactgatatttagcataaattccataatgtctttttaactgtcattcacactaacttttacatataattttaaaataaatg

SEQ ID NO: 6786370 - DNA, 65 bp, Homo sapiens
gaggggcccgtggctcagctggcccaccaaccccaagcattggccaagccagctgcacggccctc

SEQ ID NO: 6786371 - DNA, 61 bp, Homo sapiens
gtcgcaaaggccatgcatttagaagggccccttgtctggttaaatgctgtgctgttgccat

SEQ ID NO: 6786372 - DNA, 75 bp, Homo sapiens
ggagaaggtgaatagattattttaatatgtaagcagatacatctgcaaatcatactgagatgatttttctatccc

SEQ ID NO: 6786373 - DNA, 61 bp, Homo sapiens
ctggtttgccagcctaatggagcagagtcacaactcaactccaagggagggcaaacaacag

SEQ ID NO: 6786374 - DNA, 58 bp, Homo sapiens
gatggaagctatattgttgctattgtcagctttagcaataatttaggcctttcctgtc

SEQ ID NO: 6786375 - DNA, 111 bp, Homo sapiens
gagtcttgatagaagataactttgtacctcttacctctatagcctcttgtcaaaattcttaagggaaatgctaatgaggtaatgaatacgttagaaatctctgtctgaatc

SEQ ID NO: 6786376 - DNA, 71 bp, Homo sapiens
caaaagtaccttgtgtgctttgtaacctttctgggtaactccttaaatgaacatacaagggtgcttgtttg

SEQ ID NO: 6786377 - DNA, 71 bp, Homo sapiens
ctttaagccctcagagcctctttgactttgaattgtagaaaagagagctcagagaaaactggggcttgggg

SEQ ID NO: 6786378 - DNA, 79 bp, Homo sapiens
ttattatatactcaagggtgatttcatgaaaaagttagaacatttcatgtagtggtaaacctttgggtgtttataatag

SEQ ID NO: 6786379 - DNA, 84 bp, Homo sapiens
aaattccctgagcttctatttttccagagtgccctagagatgaatctcaatgcagctttgtaaagtatgaagcacaaggctttt

SEQ ID NO: 6786380 - DNA, 123 bp, Homo sapiens
gtctcctccccctactccacctccctgtcgggcacatggcggccagcaggtgatcctctctgcatgctccatgttcctgtctctgtctgcctgcctgtctgtgtaggtggctagtgtagagac

SEQ ID NO: 6786381 - DNA, 56 bp, Homo sapiens
ttgttattttgggaccttgtgttgatcattttggcagtagtatcctggagggacaa

SEQ ID NO: 6786382 - DNA, 76 bp, Homo sapiens
gcaggctgcagggccttaaaaatagcgctgggaggatatttttagtgcaccatcctgaggtgtggctggagcctgc

SEQ ID NO: 6786383 - DNA, 69 bp, Homo sapiens
ttttcatgtgggtctgcacttttcaaaccttggtgtcaactaggaacagatgggctcagatcctgaaag

SEQ ID NO: 6786384 - DNA, 130 bp, Homo sapiens
tgaactttttagtgtaaatttaaagatttgctggcccacaaacattggtataaatagaaatgggttaacttgctagtttccatgttatacagttttttgggtttgtcaagttatttatatagttagtaca

SEQ ID NO: 6786385 - DNA, 109 bp, Homo sapiens
ggtgttgcgatatttctctttagaagaaaataacctgtttcagacatttgtttctaattgtttgagctgcaaatgaaaactaggttactagtgagaaatatgggacatt

SEQ ID NO: 6786386 - DNA, 60 bp, Homo sapiens
ggccccttcccaggtggttgggatagcctgagctgaacccagcagagatgaggaggggtc

SEQ ID NO: 6786387 - DNA, 55 bp, Homo sapiens
ctgctgcagatgacagacccaaggcttctgccccagggtagagttatttcagcag

SEQ ID NO: 6786388 - DNA, 59 bp, Homo sapiens
catggctccaagtttcctgtggttactgcccagccttcaggattaatttggggcctatg

SEQ ID NO: 6786389 - DNA, 75 bp, Homo sapiens
ttcagaactggttgggcttaggaaggtaccaggagagtgcaccttctagtacttgaaatgtccctccattttgag

SEQ ID NO: 6786390 - DNA, 98 bp, Homo sapiens
gaaaattggaacaaagaaataacagccttgatattaattgtcttgcttatctgtctaaagcagggctgaggaacatattttgtttgttttagttcatc

SEQ ID NO: 6786391 - DNA, 90 bp, Homo sapiens
gaccggtcattttttaagctggtagtgtttataagggtattattcatataataatttactaagctctacctttttttgtgtggccgtgtc

SEQ ID NO: 6786392 - DNA, 61 bp, Homo sapiens
gagcccctccagtggcataaaattaggttttatgacagattttcaggctcctagagggatc

SEQ ID NO: 6786393 - DNA, 61 bp, Homo sapiens
ccccctggtgtggctgtcacagagggaagtggacgtcctgtggtttgaccccaccagatgg

SEQ ID NO: 6786394 - DNA, 101 bp, Homo sapiens
agatggctactatagatctaagcagagatccatgtgatttggagttcagggggtctgggctggaaatacacattggaatcatctgcaaatatgtgacattt

SEQ ID NO: 6786395 - DNA, 96 bp, Homo sapiens
tggcctattttttcttatggggggagtgttgacaagattttgtggcattacttactggcccacatcatctgcatgtccccatggatcccaaggcta

SEQ ID NO: 6786396 - DNA, 58 bp, Homo sapiens
ctctgtaagtgtgcattttcggtaacttttgtaaactagttaggaaccacttgcagag

SEQ ID NO: 6786397 - DNA, 70 bp, Homo sapiens
gcacaagccttgaagtaagacagctctggaaatgaattctagttcttctccttattttatggccttaagc

SEQ ID NO: 6786398 - DNA, 58 bp, Homo sapiens
agccccagtccgctgcgggcgggcgtcgacatctgccgcgtgagcgcgagctggagct

SEQ ID NO: 6786399 - DNA, 101 bp, Homo sapiens
tgactctaaataatcttgtatttcctaaagtaatactagccctcaaaacctaacaatctagaaacttggaggagattgcaaagaccacttgcagaatgtca

SEQ ID NO: 6786400 - DNA, 59 bp, Homo sapiens
ctttctctaaggtcccgttctggatattctccctgtgttcaaggcccttttagggagag

SEQ ID NO: 6786401 - DNA, 56 bp, Homo sapiens
agttgacaataaatttaattggccatttatttgggccaattaaataaatgtcagct

SEQ ID NO: 6786402 - DNA, 61 bp, Homo sapiens
gaattttcatacatgagactagatgcatattctatgtgctcagttccatgagtggagtttc

SEQ ID NO: 6786403 - DNA, 80 bp, Homo sapiens
gtaggtttatgaatgtgtatatgaacatacaggtgtgtgtatgtgcaagtttgtgtgaaggtgtgtgcatgtgtttctac

SEQ ID NO: 6786404 - DNA, 63 bp, Homo sapiens
gaggttaggccagcgctgctagctcccggccgtctctgcctggctcctgaggcttggcccctc

SEQ ID NO: 6786405 - DNA, 59 bp, Homo sapiens
cctcctaggccagtcagccccagcctgaagtgaagggagggcttggctgcctggggagg

SEQ ID NO: 6786406 - DNA, 83 bp, Homo sapiens
ggtggagaccgcaagcctctctttattcccagctaccgaattcatggtggcttttccagaggagagtatctaaaggttccacc

SEQ ID NO: 6786407 - DNA, 64 bp, Homo sapiens
tgcatcacagcctgagcggttttacagtgtggttccagcacattcctacctgctcgggtgtgca

SEQ ID NO: 6786408 - DNA, 81 bp, Homo sapiens
gaataattctttatctaggtataggattctaggttggaaatcatattcccttagaattttgtagttattgatctattgttt

SEQ ID NO: 6786409 - DNA, 58 bp, Homo sapiens
ctgccctgttctggacaggcacaaagaccacgactttgtgggggccgggagagggtag

SEQ ID NO: 6786410 - DNA, 69 bp, Homo sapiens
gtctgggctggtacaaatcctaaggcgattgtaagaaatgaatagttttcagtttggaccagccccgac

SEQ ID NO: 6786411 - DNA, 126 bp, Homo sapiens
tctcagctatagaaaacaactttatttccatttgtgcttattctagtgagatgtttataaacattggcctgggtgtggacaccactgggactggacaagaggggcccaaaaagaagcttgttgaga

SEQ ID NO: 6786412 - DNA, 81 bp, Homo sapiens
ggagaaccttcagcttgcaacaagtcctggccgttggagaaaccatgagactagaccttgtgtaaagcagctgattctgcc

SEQ ID NO: 6786413 - DNA, 55 bp, Homo sapiens
cacatttagagttctttactccagtatggtaccgtatggaatggatttaaatgtg

SEQ ID NO: 6786414 - DNA, 57 bp, Homo sapiens
ggcctgaggccaccagcagcccggcagtggctgcctccctgtggctgacctctggcc

SEQ ID NO: 6786415 - DNA, 66 bp, Homo sapiens
ccctaaaatattcttataacatgccttgtagcataagtaactgaaggcaaagaggatattttgggg

SEQ ID NO: 6786416 - DNA, 70 bp, Homo sapiens
ggattcagtttgccagtattttattgatgatttttgcatcaatgttcatcaggtatattggcctgaattt

SEQ ID NO: 6786417 - DNA, 58 bp, Homo sapiens
ccaggtaaattacctactgaatttcactttggtttgtttctgttggtgacttgcctgg

SEQ ID NO: 6786418 - DNA, 57 bp, Homo sapiens
ctcagtggagagcggtcctgggctgaggtctggccttaatactgcaactccacttag

SEQ ID NO: 6786419 - DNA, 129 bp, Homo sapiens
tgtggggccagaagtcagtatctgggcttaatcacagctctgccatgagcctgtcctgccaagagcatgtgctgtgtggtcttcaaggcagagtgtagttaaaatgtgtggggtgactattgtctggca

SEQ ID NO: 6786420 - DNA, 62 bp, Homo sapiens
ccacctccctccaaataagactcgggctcagggaaagcctggccttaagggcagggagctgg

SEQ ID NO: 6786421 - DNA, 76 bp, Homo sapiens
ccctggatctgctcagattacagccccacatcaattggcctataattagaatggggtgaaatcaggcagaatgggg

SEQ ID NO: 6786422 - DNA, 60 bp, Homo sapiens
ctccgggctgtgagctaatgcggcaccactgctgtttgcatagctgcacagccctaggag

SEQ ID NO: 6786423 - DNA, 84 bp, Homo sapiens
tgtcattttagagcacaagagaaaggttaaagctggaatatatgtaggtgttatcagcatatttactttcttgcctgattgaca

SEQ ID NO: 6786424 - DNA, 79 bp, Homo sapiens
ccagcccccgcaggccggcgcttcccaggaggccccgcgcgcgggtttccatggggacgcgccggcgctgcggcgttgg

SEQ ID NO: 6786425 - DNA, 67 bp, Homo sapiens
tgttatcactcacagtgctattgactcagtccaggcactgaactggacaccaggcgctctgagaaca

SEQ ID NO: 6786426 - DNA, 63 bp, Homo sapiens
ttttacagcttctatactatgtgatcatgtgttatggccaagtagtccaaaggagctgcaaag

SEQ ID NO: 6786427 - DNA, 55 bp, Homo sapiens
tgtagtctgttaaagtaagagcaagcaagctttgaactcttacagaatagacaca

SEQ ID NO: 6786428 - DNA, 70 bp, Homo sapiens
cccgagcctggtggtgtcttcctctggccgccgcgtggagtgctcggagcagaaggcgccgccggccggg

SEQ ID NO: 6786429 - DNA, 82 bp, Homo sapiens
ccgcgcgtggcagcggcccaggccgtctcagccggatttttccatccccggggtaggcttggtcccctgtacactccagcgg

SEQ ID NO: 6786430 - DNA, 66 bp, Homo sapiens
tcatcctgactgggtaaagcttatccaaactgtactgtctgctgctctaagctgacccagggatga

SEQ ID NO: 6786431 - DNA, 61 bp, Homo sapiens
acatatctgtgaactggcatggccaggatgccaatccaagctttcagatttacagaaatgt

SEQ ID NO: 6786432 - DNA, 63 bp, Homo sapiens
gtgaccagttggcaggggtgggtgggctccccgcacaccacagcaccacctgcaaactctcac

SEQ ID NO: 6786433 - DNA, 62 bp, Homo sapiens
gggccacagtgttctttttaaaatttgttgagatgccccttgaaagaatgctgtgtattccc

SEQ ID NO: 6786434 - DNA, 71 bp, Homo sapiens
cctgtcccctcacaatgccactgtctaattatccatcttccctcccggaccgtaggctgcctgggggcagg

SEQ ID NO: 6786435 - DNA, 55 bp, Homo sapiens
gagctagtcatctggttgaacaagcctgaaaggcagaagtcatccatgacagctc

SEQ ID NO: 6786436 - DNA, 55 bp, Homo sapiens
cagacagggccctgtgatggtacccaacaatgaactacaaactaggccctttctg

SEQ ID NO: 6786437 - DNA, 62 bp, Homo sapiens
ctgaagcatctgtggggttcccagggggtgggagtgtgtccaggaagcagatggaaattcag

SEQ ID NO: 6786438 - DNA, 68 bp, Homo sapiens
acattatgctaagtgcaacaagccagtcacaaagagactaatactgtgtgattgcacttatatgaggt

SEQ ID NO: 6786439 - DNA, 55 bp, Homo sapiens
ggccttgcagccacagaacacagcaagtgctaaggccctgaggctggcaggagcc

SEQ ID NO: 6786440 - DNA, 119 bp, Homo sapiens
tcagattattacacaaatgtgaaattaccactggcaggccactactaagcagtcagtaccctttagataaactttgtagcacctgccagtggtactttcacatttgtgtaataatttga

SEQ ID NO: 6786441 - DNA, 68 bp, Homo sapiens
tccagattctcaccaagtcccatgatggggctctggacctgtcctgggaccctgggtgcagagaggga

SEQ ID NO: 6786442 - DNA, 62 bp, Homo sapiens
gttactctggtgttagtctttgcacagattgctgtggaagagacacttacattcagagaggc

SEQ ID NO: 6786443 - DNA, 71 bp, Homo sapiens
ggttgctatcctaccctcatgccaggagtcatggcagaacaagaatccagaagcaggtagagacagcagcc

SEQ ID NO: 6786444 - DNA, 81 bp, Homo sapiens
gtattgtcattgagatgggctttatgttcagccttgtaaacctagcaaggtctggatttgttgcccttcagggaataatac

SEQ ID NO: 6786445 - DNA, 64 bp, Homo sapiens
aataagtcttttacttagttgacatgtatcaattgtgtgttttctgggtggaaggtactttatt

SEQ ID NO: 6786446 - DNA, 58 bp, Homo sapiens
gtggctggccctggaccctaaggcctgactgagctagggggtccctccggcctgctat

SEQ ID NO: 6786447 - DNA, 129 bp, Homo sapiens
agtaaatgtaacttttctttagactaacaccagtttatttagtgctttctgtagccattgctcccatatgtgaaatgtggtggtaatgagccagatgatggatatggtggtggaattgttttggttact

SEQ ID NO: 6786448 - DNA, 77 bp, Homo sapiens
gatgggtagcagtgtgcttcgtttcatgagctttaaagagttgagaaggtcaagcaagttgcatattgctattcgtc

SEQ ID NO: 6786449 - DNA, 56 bp, Homo sapiens
ttctgatgcagggattttaagtgctttgtgccctgtcatatccccagcatctagaa

SEQ ID NO: 6786450 - DNA, 62 bp, Homo sapiens
cagtatgtctgggctcaaatcctatctccacagttgctagctgtgtgaccccagacaagctg

SEQ ID NO: 6786451 - DNA, 63 bp, Homo sapiens
tctcactgatttgagaccaaggttaagcaagcctgacaaagtggttcatcaaatcagagaaga

SEQ ID NO: 6786452 - DNA, 103 bp, Homo sapiens
gcctttttcatagtcaaaacatactttttagatctgccttcttgggatgtattcaaggatgctagccgtgtttgagactgtaaatatgtctagtgaatagggc

SEQ ID NO: 6786453 - DNA, 81 bp, Homo sapiens
tagttcatggaacatacaaaaacaggcagcagactgaatctggctcatagcctggagtttgccaatgcctgccgtgcacta

SEQ ID NO: 6786454 - DNA, 55 bp, Homo sapiens
aggggcttcccttcctgggtagcaagggaaagactagccaggaggaggggtccct

SEQ ID NO: 6786455 - DNA, 68 bp, Homo sapiens
ttgttggacagtccacctcagtgaagacagatttagctctaggtgctttaaaatggactgttttgcaa

SEQ ID NO: 6786456 - DNA, 96 bp, Homo sapiens
ccctcccgaccacatgggcagagggtctatgctaagatgggctctcatatgggctctctttaaactgcatggcttctctgttgatgaggggcaggg

SEQ ID NO: 6786457 - DNA, 68 bp, Homo sapiens
atccacactctccaagggctcccagacgtctctcaccagaacaggagctctctgtccttgggagggat

SEQ ID NO: 6786458 - DNA, 77 bp, Homo sapiens
ccatggagatcttctgcattgaaaaattcacaattctggttcagcttgaacttgggttttccaaaagtttccactgg

SEQ ID NO: 6786459 - DNA, 92 bp, Homo sapiens
ggcctcaaagatcttccacatttgaatgaggtacagagccatgttctacagcagagccaggttgggccttttctttgggcctctttgaggtc

SEQ ID NO: 6786460 - DNA, 63 bp, Homo sapiens
ccctggaggagcttagagcttgggatgagatagatatggaccattaatctgagcttcccaagg

SEQ ID NO: 6786461 - DNA, 58 bp, Homo sapiens
tcctggagggctcacaggcggcacccgcagtgcacgtgttgccactggtcttcaagga

SEQ ID NO: 6786462 - DNA, 87 bp, Homo sapiens
actgggaagcacattttattgtctgtattgcctatagttcacctttatataatagacagaaagataatagaataactccttcttggt

SEQ ID NO: 6786463 - DNA, 63 bp, Homo sapiens
tgttgcgagaaatactttaaagcagaagcttaattacatagtgctcaagtttctctggcaaca

SEQ ID NO: 6786464 - DNA, 93 bp, Homo sapiens
gagccgtggtccgcctgctctcactcctgactcaccgctgttggctttcgccaatgaacaagtcggtcaggaagccgcgctggaccatggctt

SEQ ID NO: 6786465 - DNA, 70 bp, Homo sapiens
gtccagcgtccccgccgtcgctcaggctgctgctgcgtcgtttgcggctgactttggcggggcgcggggc

SEQ ID NO: 6786466 - DNA, 78 bp, Homo sapiens
taaatgtttgtggagcatcttatgcctttccagaactactatttttatagctgaagaacgtgagatccagaaagttta

SEQ ID NO: 6786467 - DNA, 126 bp, Homo sapiens
aaggagggataagcgtcagaggaaatggaaaaggggaaatagaaaagaggaagtatggtccatgctgcccaaaccgctgcttcttattaatccttctctgtcccctcagcagtttttctctatctt

SEQ ID NO: 6786468 - DNA, 65 bp, Homo sapiens
ggagacagaggcagccactccttctggctccccggccccagggttgcctgcctctgctgttctcc

SEQ ID NO: 6786469 - DNA, 129 bp, Homo sapiens
ccagagtttgctggtggacctcaggattcgaagtgtgcaacagacggagtgcgcttgctgttcagggcggccccgtgcaggagcaccagctcaccctcaggcatctcggactggagggccagcagaagg

SEQ ID NO: 6786470 - DNA, 99 bp, Homo sapiens
ttcatctcatttagcaccgtgtctgtatgtcaatcagctgcatatatcgtaaattgtagccgcatgataccagatctcctgctgtaaatgagcaatgaa

SEQ ID NO: 6786471 - DNA, 62 bp, Homo sapiens
gtgaagtcactgcaggctagtggaggggtcccaggcagaatccaggcctgcaatgacaaagc

SEQ ID NO: 6786472 - DNA, 86 bp, Homo sapiens
acccccaaccctaagacagtctgtcaagccagctttcaagtatcagagaaagctgcagattctatctagaaggtgaaatgggaggt

SEQ ID NO: 6786473 - DNA, 92 bp, Homo sapiens
atattttaaagatttatggtatgaataatttaagagaaataaagaaagcttctaaactctctttgaattatgtaatgggagctttgaaatat

SEQ ID NO: 6786474 - DNA, 66 bp, Homo sapiens
cttccctgagcccaggcgggagctgagctcttctgagcggccgcccgaggacctgggttctggaag

SEQ ID NO: 6786475 - DNA, 93 bp, Homo sapiens
gctttctactagatatgacaatttgtgcttctgttctgaggcctttgaattgcactccaaatatcctcagggcagaggtgttaagtgagaagc

SEQ ID NO: 6786476 - DNA, 97 bp, Homo sapiens
gtattcactcattagcattacttcaaagagtatttaatgattttggaattttctatgtagaatgatttttttaagtagtcttacatgatgtgggtat

SEQ ID NO: 6786477 - DNA, 99 bp, Homo sapiens
agtctattgtaagaaaaccttctttctaatcccagcactgctttccacaaggcgaaggattagacaggcaggttatttcagtaaaataaaagtaagact

SEQ ID NO: 6786478 - DNA, 73 bp, Homo sapiens
cctgacagagaaaaatctgcctctgatggaatcattaagttaaccatccatttgtaccatttctttgtacagg

SEQ ID NO: 6786479 - DNA, 65 bp, Homo sapiens
gggtgggaacaggatgccaggaggtgcaaaaatttctgtcagtctggcactctgttccccctccc

SEQ ID NO: 6786480 - DNA, 60 bp, Homo sapiens
gctcaagggatgggagtgggtgggtgatatgttttgggatagtcccaccccatcctcagt

SEQ ID NO: 6786481 - DNA, 82 bp, Homo sapiens
gagattggagacttggatgctagctctcaaagcttccacctggaagtcacactttaacagttccattcaattttcattgctc

SEQ ID NO: 6786482 - DNA, 62 bp, Homo sapiens
gctggcagagctctgggctgggagggccaaggaggcagattgagctcagtagctctgctggt

SEQ ID NO: 6786483 - DNA, 82 bp, Homo sapiens
tgccaatcatcttgttacagtttattacatgcgtgacttgattttcttgcatgtgcgttttagaggtaacaacatattggta

SEQ ID NO: 6786484 - DNA, 62 bp, Homo sapiens
gaccccaggcagatcagggggtgcttctggtccatgtcccctgtcctgagttcttggaggtc

SEQ ID NO: 6786485 - DNA, 68 bp, Homo sapiens
actggtgtcaggaaaatctcagtgttaatcaactgtagaactactgggttcttcctggcacagtcagt

SEQ ID NO: 6786486 - DNA, 68 bp, Homo sapiens
gtctgtggtagacaggaaggcatgatttatttacctgccagcctcctccactcctgtttatcattgat

SEQ ID NO: 6786487 - DNA, 79 bp, Homo sapiens
ggaactagacctggaagccaggcccgctcctaagacaggtatcttgtgggtgggactggcttccagccccagagttacc

SEQ ID NO: 6786488 - DNA, 78 bp, Homo sapiens
aatctttctaacaactagttttaatgttcatgggtacattttacctaaggtactgttaacattgtatagagaaagatt

SEQ ID NO: 6786489 - DNA, 76 bp, Homo sapiens
gcaaatccaatgaaagcaactgcctataagaaaatactttacatttttgttataggtttgttttacatgaaagtgt

SEQ ID NO: 6786490 - DNA, 61 bp, Homo sapiens
ccaactgtacaatggctataataccctctcccttagagggctttttgggacatgtaaatgg

SEQ ID NO: 6786491 - DNA, 69 bp, Homo sapiens
acgttgctggaactcagtgaatcattaaaaatcaagtaatgatttttctgaattccatttttgtggtgt

SEQ ID NO: 6786492 - DNA, 81 bp, Homo sapiens
cggctttggcatgattgtttgccagcccctggaaagggattaccgctctcagggagggcgagtcagcgtgtactggagttg

SEQ ID NO: 6786493 - DNA, 57 bp, Homo sapiens
ctccaagatgccaaaccctgaatttctcaggatgaaaagcaggctttgattttggag

SEQ ID NO: 6786494 - DNA, 73 bp, Homo sapiens
gctgactaacacatcatggccagaggctcgcaggaacctaaacctgtgtttcctctagaagccatggttcagc

SEQ ID NO: 6786495 - DNA, 123 bp, Homo sapiens
gaggtctactggggcaggaccctgatggccagcgagtgggtcagcgttgcagcaacatgccctgctcagatctttcccattttccctccctttcccttaggagcctgttcctctcacgccctc

SEQ ID NO: 6786496 - DNA, 57 bp, Homo sapiens
tctggggcagctgatgtcctctgcttattctaggcagggcacagacagtgccaagga

SEQ ID NO: 6786497 - DNA, 71 bp, Homo sapiens
gctttattagtctgcatgtcccaaaggaacagcaaagggactgtctgccactgcatgcagagtaagaaggt

SEQ ID NO: 6786498 - DNA, 59 bp, Homo sapiens
tatggaagttagggatgaataaagtgtcaaggatgactctttggtttctgacttgcata

SEQ ID NO: 6786499 - DNA, 69 bp, Homo sapiens
ggtggcatctggagaacttgcaagaggatgtaacagacacatcctaattgcacagcttttaatgttgcc

SEQ ID NO: 6786500 - DNA, 74 bp, Homo sapiens
tgttgagcagcaggttgttattgactttttatttccaacccagagattttgaaagtaacattttgttgtttaca

SEQ ID NO: 6786501 - DNA, 60 bp, Homo sapiens
ggtttcagatattgatttttttggcattgtcaattctgtcattgaaatttttctgagatt

SEQ ID NO: 6786502 - DNA, 77 bp, Homo sapiens
agacatcctgtgtgcgtgagtaacagcaatggccctgacatcagtggcccacaacagccatctatacagagatgttt

SEQ ID NO: 6786503 - DNA, 66 bp, Homo sapiens
ggacagtgttctttgcatgaggatagagtttcacatgctctggtctcttcagaggggcaccactcc

SEQ ID NO: 6786504 - DNA, 72 bp, Homo sapiens
tttttctctaatatgaggctaaccatgatgtcctttcccaggaaggacaatctctcctttatcagggaaaaa

SEQ ID NO: 6786505 - DNA, 62 bp, Homo sapiens
ttctttctttcttttggcttctgctgctactcagaaaaggagactccaaatgaaagaggggg

SEQ ID NO: 6786506 - DNA, 77 bp, Homo sapiens
ggagggcagaaggcaggagaagattgatgcctgagctcaagcagtcaggcagagttaatttgctcctcctccccttt

SEQ ID NO: 6786507 - DNA, 81 bp, Homo sapiens
gagggtcagacttctacagaggacacaaagatcttttgaaccatcgaaggcatcaatctcccctctggaatccagctcctc

SEQ ID NO: 6786508 - DNA, 113 bp, Homo sapiens
tcagtctcagaagagggattggagggggaaccctgttacacacagcagcgtcaacttaaaattgcaccttagcagctctgtgtgtcagggccttccagcccttatgaaactga

SEQ ID NO: 6786509 - DNA, 58 bp, Homo sapiens
tcctagggtaatcagcatacattgtagcctttaagatatgtggttgtctgtcctgggg

SEQ ID NO: 6786510 - DNA, 80 bp, Homo sapiens
gaggctcctggaggccattacgagctctaaaatactatgattgctcatgttagtgtttcttagtcggtacaaggagtttc

SEQ ID NO: 6786511 - DNA, 86 bp, Homo sapiens
ttagtgtccccatagggtagcagctactttgatgattgacaatataaatttaaaagctgagatatcctgtactatcttgatactga

SEQ ID NO: 6786512 - DNA, 81 bp, Homo sapiens
gggactggaggcagttgccccagtcactcaggcattgagaaatctggggtatggctggggcaaatgtctcatgtggtcacc

SEQ ID NO: 6786513 - DNA, 91 bp, Homo sapiens
gctgctgtgagaggtgaagtgttgctgtgccacctgcttgggaagaccaagctgtgtctaatcttatacatcatttttctgctcattcagc

SEQ ID NO: 6786514 - DNA, 78 bp, Homo sapiens
ggagggaggcctgtcgagggtttcttgcacactcagatccaagtctcagagtggtggtccctctgctggcctctcacc

SEQ ID NO: 6786515 - DNA, 59 bp, Homo sapiens
ggctaagggaccctttctaatgtgctgggtattaagcagcatagattctttcctttgcc

SEQ ID NO: 6786516 - DNA, 63 bp, Homo sapiens
gcaggaaagttttaattcttaatgcacaaaaattccctaggagcccaagaagagctttcttgc

SEQ ID NO: 6786517 - DNA, 63 bp, Homo sapiens
atgtctggaggtgtggggtgtctaactggatcagatttctacaacctggcttcctcttggcat

SEQ ID NO: 6786518 - DNA, 61 bp, Homo sapiens
ggttggaatttgaacggaagtctttttttcacaaatataagacttcatgggtcaaccaatt

SEQ ID NO: 6786519 - DNA, 102 bp, Homo sapiens
aaggaatgctgtatggatgacatctaactggtttggctcagggtctcattgcagctttgtgagaacttcagcaaaaccagttaggttgtacccagaatcctt

SEQ ID NO: 6786520 - DNA, 60 bp, Homo sapiens
ttcagtgctaggtcgtgtgctgggggcactgacagccttcaggagcaggcctaggcagaa

SEQ ID NO: 6786521 - DNA, 79 bp, Homo sapiens
gttgggccgggcacaggttgaggtagatgctctctggcactttgagtttgtcattggtgatctgatgcctgagtttggc

SEQ ID NO: 6786522 - DNA, 60 bp, Homo sapiens
taggaatggtgctcagcagaaatcctgcaacatatggatctgtttacacactattcactg

SEQ ID NO: 6786523 - DNA, 70 bp, Homo sapiens
tcgaaactgtggaacgtcagttgtcacatgtgacaaccttcacatgtgaaggacttgttccattgtgaga

SEQ ID NO: 6786524 - DNA, 69 bp, Homo sapiens
gctgaactgcatcttaaataatacttaagagttccccagggaaaaggtatttttcagtgcaagaacagc

SEQ ID NO: 6786525 - DNA, 66 bp, Homo sapiens
gactggatgtttaatcaacagaggaacaaagaaaatgttccaattttgtgtgaaaatatttaagtt

SEQ ID NO: 6786526 - DNA, 83 bp, Homo sapiens
agataaggaagatttgtgttaagctgattgtgttgatgttttgaaggaactttaaaccatagtttaacataagagtcttattt

SEQ ID NO: 6786527 - DNA, 69 bp, Homo sapiens
tcacttggcccagaacagtgtcacatgtcagctagattagtagacatggaaatgttttacccattgtgg

SEQ ID NO: 6786528 - DNA, 89 bp, Homo sapiens
gattggaatgtatgttggcggtaagaaacaaatggaaagtaaggaaaattttttcaagttttatattgaagcaaacaaaatggctaatc

SEQ ID NO: 6786529 - DNA, 64 bp, Homo sapiens
ctgggcagagctaacacctgagctgttaaagatcctgcattctcaggtaagggccctgctgcag

SEQ ID NO: 6786530 - DNA, 92 bp, Homo sapiens
ttggcctgccgtggaagcttttattaaaatcttgccatttaccaagaatgtgtaatttttaaatgaaagtggagaaagtcatgcaatgtcaa

SEQ ID NO: 6786531 - DNA, 98 bp, Homo sapiens
ggttggtgggtaactcagggcaggaagggctgtttctccaagaggtcctcctggagccaggacccttccccgccctgcccagtcattcccaccctgct

SEQ ID NO: 6786532 - DNA, 65 bp, Homo sapiens
cccaaactcaagtctatgaacaaggacattctggtgtggccttgttccgtaatggccttggtggg

SEQ ID NO: 6786533 - DNA, 77 bp, Homo sapiens
acagggacaaggagtgtgcccacatctctggggcaggtacagctgtcctaggaagtggaggcacctgctgagcttgt

SEQ ID NO: 6786534 - DNA, 95 bp, Homo sapiens
tcatgacacctgaggagtctagtttatggcttcacttggaattcaagtaacagagaagaagccactatagatattctaagcaggaattgtcttga

SEQ ID NO: 6786535 - DNA, 69 bp, Homo sapiens
cctttatgtactgtgtatttgaactgctcatagaatcccttgttctttaaatacgctgtgcattcatgg

SEQ ID NO: 6786536 - DNA, 58 bp, Homo sapiens
ccaggcttgaagcttcagagtatgtaagagaggtgcagctctggttattgaagcaggg

SEQ ID NO: 6786537 - DNA, 80 bp, Homo sapiens
gaggggcgtgaaaatgaacacatcagaagccagtgttgcttgggcgcagtttcagaggtgttcattttcattggctcttt

SEQ ID NO: 6786538 - DNA, 102 bp, Homo sapiens
gctctggacctgggggtctgctgtaggtaggacagcacctccttcccttatccttggtctgtgggtgctgccctccctgcccagctactcacatacagaagc

SEQ ID NO: 6786539 - DNA, 83 bp, Homo sapiens
tgtcaacagaaggatggcttgtaatagccaaaacctcaaacaatacatttgataggcaaattaataagtcatatatctgtaca

SEQ ID NO: 6786540 - DNA, 71 bp, Homo sapiens
agtgtgattatccccgttgttctttgcttgattgggcacagacctcagagcagcctgtgatgatgcacgct

SEQ ID NO: 6786541 - DNA, 72 bp, Homo sapiens
tgatcttttcaaagggaagttatgaagtaaccctgcaaggttccccagcttccaagccccttttcaaaggca

SEQ ID NO: 6786542 - DNA, 97 bp, Homo sapiens
gaccccagggccgcaccttccctcccagtgccggggccggctaggggctctgtgggcagcgcggccgcctggcgccggggtgcgcccacgtggagtc

SEQ ID NO: 6786543 - DNA, 72 bp, Homo sapiens
gcttcccagctgggtcacctggggtgggacctggcctcagtctccacttccacgtgtgcagaattgggaagc

SEQ ID NO: 6786544 - DNA, 110 bp, Homo sapiens
agagcagggaaatatctgggaaagtaggcagaggccaagttttgaagagccatgagtatcatggaaagaatttaggcttgtctgctgtgtagaataactattctcaatct

SEQ ID NO: 6786545 - DNA, 83 bp, Homo sapiens
ttttacttctttagtttttcttactgtctgtgatcctcagctagaatgcaggttcttagtgaggtagggatggggaggtaaaa

SEQ ID NO: 6786546 - DNA, 55 bp, Homo sapiens
gtctctgtcacaactactcatctctgtaactctgctgttgtggtgtgaaagggac

SEQ ID NO: 6786547 - DNA, 66 bp, Homo sapiens
gttcttcttgctcttttaggtcctttataccctgtcataaagagaatacaagcaggcaggaagagc

SEQ ID NO: 6786548 - DNA, 82 bp, Homo sapiens
cttccacctggagctgcagtgtccttccctgttgtcaaagcactagagtttctggatgctgattccagtctccagaagggag

SEQ ID NO: 6786549 - DNA, 55 bp, Homo sapiens
tcattcagcttgtaaattgtgaatctgggatttagaaccacaactggctgattga

SEQ ID NO: 6786550 - DNA, 57 bp, Homo sapiens
gtcctacagttagggaactgggccccgagtttggccatggctctcaccctgtgcgat

SEQ ID NO: 6786551 - DNA, 73 bp, Homo sapiens
ggcatgccagggcttgctgcctggcaggacctgtgcacagcaaagcaccaggcaagtagaagctgtggtggtc

SEQ ID NO: 6786552 - DNA, 92 bp, Homo sapiens
caactcagggaaagtgaaaattccagccaatcaactattgtttggtcgaagacaagccaaacaatggctctggctgatttctcccagaattg

SEQ ID NO: 6786553 - DNA, 60 bp, Homo sapiens
ccttttctgtgtgggtaatttatctacctagaaagattacaaactcacagcagaagaagg

SEQ ID NO: 6786554 - DNA, 64 bp, Homo sapiens
ccaggtcctgttttcaccacagggtcacctccacccttcactgtgctggcatctcaggctttgg

SEQ ID NO: 6786555 - DNA, 55 bp, Homo sapiens
tctgtgtggccttgggaaagttgcttaacttcatacttcccaggacctactcaga

SEQ ID NO: 6786556 - DNA, 55 bp, Homo sapiens
ccgaggctggagtgcagtggcgggatcttggctcactgcaagctccgcctcctgg

SEQ ID NO: 6786557 - DNA, 57 bp, Homo sapiens
cacgccctgtccccgaggccggccagcgatgtgggttcgggcttggctgcggtgctg

SEQ ID NO: 6786558 - DNA, 60 bp, Homo sapiens
cctgaggtatgagtgtgccaggtgtttttagggaagagcaagggcaccagtatgcctagg

SEQ ID NO: 6786559 - DNA, 67 bp, Homo sapiens
gtcaaacagaatttacacatctctaaaatgtcctggaagttgatggaggaagtaaaatttgattgac

SEQ ID NO: 6786560 - DNA, 72 bp, Homo sapiens
ctgagtcactgtggggtgcgaggcagtgagaactcttcgtcgctggctggaaagcatcccaaggtggctgag

SEQ ID NO: 6786561 - DNA, 68 bp, Homo sapiens
gtaaacagtagtcacttctattaatggctcagatgactgggcctgtaatttcatgtgttattgattac

SEQ ID NO: 6786562 - DNA, 106 bp, Homo sapiens
tatttaatctttttagtttcttggtttctttatctgtgaatctgagagaataatatctgctttatagttcatgatgaggaaaacaggaaggtgaagcaggtaaatg

SEQ ID NO: 6786563 - DNA, 56 bp, Homo sapiens
gggggcttaccccaggggtgaggatgttgagctttccctccctggggctgccaccc

SEQ ID NO: 6786564 - DNA, 64 bp, Homo sapiens
ctctctgcccccactaagttgagggccctctcagaggaagggggtcaaaaggtgggggagggag

SEQ ID NO: 6786565 - DNA, 59 bp, Homo sapiens
caattagaacttttatcaaactatgggaaacatctgtagtcagtatgtaagtctaattg

SEQ ID NO: 6786566 - DNA, 64 bp, Homo sapiens
ctgggctcagtggctcatggctgtaatcccaggaggccgtagtgggagagtcgcttgagcccag

SEQ ID NO: 6786567 - DNA, 55 bp, Homo sapiens
ggctgaggagaacaatgagatcaaaggtcttccttggatcaggatttccctagcc

SEQ ID NO: 6786568 - DNA, 85 bp, Homo sapiens
ggtctcagcttgagcctgtgctgtgtttgctccatgattcagccttggcacgtctggaggatgacagagatgggctgttgggact

SEQ ID NO: 6786569 - DNA, 72 bp, Homo sapiens
ggttcatatttgaagggagaaagtgccatgttttatatacatcattttctcttctttaaatccagtgaaatc

SEQ ID NO: 6786570 - DNA, 60 bp, Homo sapiens
ctcctgacctcgtgatccgccctccttggcctcccaaagtgctgggattacaggcatgag

SEQ ID NO: 6786571 - DNA, 75 bp, Homo sapiens
gttttctgtattgcctgctaggccctgctgggtgattaagccactcactcagagtcttacaggccactcgaggac

SEQ ID NO: 6786572 - DNA, 61 bp, Homo sapiens
tatgtggtgtaggtctcagaggagtgtacgatgagctcctagaagcaccactcatcacgtg

SEQ ID NO: 6786573 - DNA, 58 bp, Homo sapiens
tgacagagccaagatcagtactcaaataatctggcgttagacctggggctcttagtca

SEQ ID NO: 6786574 - DNA, 70 bp, Homo sapiens
ccagcagggacataagaggaacatggaacacctaaaggctagtccagctgtgtcatttgggtccttctgg

SEQ ID NO: 6786575 - DNA, 64 bp, Homo sapiens
tagtttcagtaccatgagcatcatgtttttccctctagagatccgtgcagtatggtagctacta

SEQ ID NO: 6786576 - DNA, 73 bp, Homo sapiens
agccatcacagtattgctggagataaccctattgactttcccttgggtggtgtcaagcagaactgtgaaggtt

SEQ ID NO: 6786577 - DNA, 74 bp, Homo sapiens
caactttgaacaattcctcaagctgtactgttcaaccatttgattcagtattttcaggatttggaagcaggttg

SEQ ID NO: 6786578 - DNA, 88 bp, Homo sapiens
cccgagctgctcctcatatctgtgtttcccttttgctcaggtgctagtgcaggagctcgaggagcatcaggtacggagccccttcggg

SEQ ID NO: 6786579 - DNA, 68 bp, Homo sapiens
ggtggtttcatttaatttgtataatgtaatttttgtaaatgtattatacattttgtgtagagatcatt

SEQ ID NO: 6786580 - DNA, 82 bp, Homo sapiens
gaagacattcatgaagaagggatataatttggtgaccaattccatgggagctgtgaagaaatgccttccttagaatgttttt

SEQ ID NO: 6786581 - DNA, 74 bp, Homo sapiens
ggtttatacagttggtgatgaggctagtagggggttattcaactctcctgtggtttgcactaattgtattgatc

SEQ ID NO: 6786582 - DNA, 64 bp, Homo sapiens
cttagataaaagtgttcaataaatgtgtattgtatgagcaggttttgtgaatagtttatctaag

SEQ ID NO: 6786583 - DNA, 64 bp, Homo sapiens
ttaattactggcatggtggttgcagagttgaaatgcagctttaaaagcctttgtgagtaattag

SEQ ID NO: 6786584 - DNA, 75 bp, Homo sapiens
tataggtttggaccacttttcatgagtctgttatgggttggatcttgaggggctcatgaaagaccagcatttatg

SEQ ID NO: 6786585 - DNA, 75 bp, Homo sapiens
cctggagggttgggggtctcgggggccacccgcgttttatgcacagtggtcctgagcaccagcctgacctctggg

SEQ ID NO: 6786586 - DNA, 66 bp, Homo sapiens
gaaaacaggatgtgaggaggccatttgtggttaatggccattggtaggggggcacttcctgttttc

SEQ ID NO: 6786587 - DNA, 57 bp, Homo sapiens
gggtggctcatgcctgtaatcccagcactttgggaggctgaggcaggcaggtcacct

SEQ ID NO: 6786588 - DNA, 85 bp, Homo sapiens
gctctggcagccgattttgtttactgatcttttctgattgttgttttcttgataatggagcaagccactgaatggctgtttgagc

SEQ ID NO: 6786589 - DNA, 90 bp, Homo sapiens
ctagtggtctgaacttcagtttatcccatcatccagatgaacctgtaattgatattttggcattgggatagctggagattatattgctag

SEQ ID NO: 6786590 - DNA, 75 bp, Homo sapiens
agggctttcccctagaaattctgattcagtaggtctaaattaggtcctaggaatctgttttttaaaaagagctct

SEQ ID NO: 6786591 - DNA, 57 bp, Homo sapiens
cctgtctatttccattgcattttaatccataatgaatgtagaatggtgattggcagg

SEQ ID NO: 6786592 - DNA, 64 bp, Homo sapiens
ggcccagaatacatgaagtataatcaaagaaacagggtatttgggttactatggaattcgggcc

SEQ ID NO: 6786593 - DNA, 59 bp, Homo sapiens
ggccatgtccctgggcctggcactccctagctcggtggggtgtggcctggggacaggcc

SEQ ID NO: 6786594 - DNA, 67 bp, Homo sapiens
ggcacatgcatggtgttgggttggatgaacccatccaagatctagccccaaccccatgacacagtcc

SEQ ID NO: 6786595 - DNA, 77 bp, Homo sapiens
gaagcaggtatcatgaaagcgtaaagcccataaccctaattcatagcacacacttctcatttgatactaactgcttt

SEQ ID NO: 6786596 - DNA, 101 bp, Homo sapiens
tccaaatctatgaagtcaaagaaactcagttctttccacaatgcaataaaaagttgtacaagaggagaaaatggagttttaaactcatgtaaacctttgga

SEQ ID NO: 6786597 - DNA, 64 bp, Homo sapiens
agctctcttgtgttctgtatggctctgagtgtcagtgtaatataagttcagaaaacaaggagct

SEQ ID NO: 6786598 - DNA, 99 bp, Homo sapiens
gggctataagatatttgaaagaaaccctagcgttgtttattgaatccagggttgactcaagaagataatgtctagggttagatgttcaaaaatataccc

SEQ ID NO: 6786599 - DNA, 92 bp, Homo sapiens
gtgaagtggtgtgtgtgtgtgtgtgtgtgcgcgcgcacgtgcgcgtgcgctcgtgtgcgtgcatatgcacaaggagcaggctgtgtgttcac

SEQ ID NO: 6786600 - DNA, 57 bp, Homo sapiens
gagcctgcgctgccgccaccctttatctccaacgcgggagcgggactgcgcaggctt

SEQ ID NO: 6786601 - DNA, 79 bp, Homo sapiens
aggattagaattgtagactgattgttggtcctttaagtatgcttggaagaaaattcaatcgagtttcaaggctttttct

SEQ ID NO: 6786602 - DNA, 61 bp, Homo sapiens
gcggagccccagggaggccaggagctgttcacaactccaggaagccacactgggcctcagt

SEQ ID NO: 6786603 - DNA, 107 bp, Homo sapiens
ttagatactttttggaaagccaacaaggtacaaaacagagcacaaagtttagattcagaaatcatgtgctctaatgtgctttgttccctaagctaaatagtatgtaa

SEQ ID NO: 6786604 - DNA, 97 bp, Homo sapiens
gggtgctgccctcagggaccaggtgggtgcattccgccacccccttatccgaggtgcgcggggctccggcctgggttctgctgggggcttctgtccc

SEQ ID NO: 6786605 - DNA, 60 bp, Homo sapiens
ttgttctctggtaaacacatgcgtatttagaaagatgtatacagcatgtatcaagaacag

SEQ ID NO: 6786606 - DNA, 76 bp, Homo sapiens
gcaggctgttcagctaaggagtttcactgtactgtgaagaagcacaggctgtgaagaacctagtgaaccttactgt

SEQ ID NO: 6786607 - DNA, 76 bp, Homo sapiens
tagcaagtcacagcagtttagggttgacatagcagagttcaaatgtctgacttttctcactgttgtgtacttgttg

SEQ ID NO: 6786608 - DNA, 55 bp, Homo sapiens
tctttgactgccgttctcgaccacgtaaagtgccagtcatcgccggcagcaaaga

SEQ ID NO: 6786609 - DNA, 60 bp, Homo sapiens
cctccagggaagagctgatgttgcagccgtctggaggcagaattccttcttccttggggg

SEQ ID NO: 6786610 - DNA, 67 bp, Homo sapiens
cccagaggtgacatcccattctctaccttccaacaagggtattcagtgccaggagttaaaccctggg

SEQ ID NO: 6786611 - DNA, 64 bp, Homo sapiens
ggatgaagagctctactccttagagtctgttaaccaccagacctggagtgaagagttcccatct

SEQ ID NO: 6786612 - DNA, 82 bp, Homo sapiens
ctgcctcttccatcaacttcaactatttataaattctcccaagttccccaagggagttagatttgaatgatgtaaagagcag

SEQ ID NO: 6786613 - DNA, 67 bp, Homo sapiens
cagcaacaatgggctgtccattgctggctggtttatccccatgtgtgacagtccatttgcattgctg

SEQ ID NO: 6786614 - DNA, 57 bp, Homo sapiens
gaggcaaggtcatgtttctttctgtagtgtcaagaggagaatctgttttcttgtctt

SEQ ID NO: 6786615 - DNA, 86 bp, Homo sapiens
caaggtacaaaggaggtgcatagaacatccccgaattcttagaaagaaaagctccacgtgtttttgccttccccttttgttctttg

SEQ ID NO: 6786616 - DNA, 86 bp, Homo sapiens
gttttgactaaatagtgcaacatctacgtagaaaacataccccaaacttgagttttcctgggttgtgcattgtacattgtcaaagc

SEQ ID NO: 6786617 - DNA, 68 bp, Homo sapiens
gttgtgtgtgtgtgtgtgaaactctaaagcccctggaatttaggaaacagtgcatatatagtcataac

SEQ ID NO: 6786618 - DNA, 80 bp, Homo sapiens
gaccctgattctgtgaaatcacccaggtttaagcgctagcatttgttaatccagcgggtgattgcacaggctttggagtt

SEQ ID NO: 6786619 - DNA, 87 bp, Homo sapiens
agatttcagaagttttgtgtacagtatgttcttgaatttgggcttaagctcagactgacatatagtatttcatcactaatgtgatct

SEQ ID NO: 6786620 - DNA, 81 bp, Homo sapiens
attcatcccttctacaaatatttactgttcccctcccctgcactgggctcaggagtaggtactgaatatttgatgatgaat

SEQ ID NO: 6786621 - DNA, 61 bp, Homo sapiens
cttggtgcaggggacagggcaagcttagagatggaagaaagcggcagtcctctgctctaag

SEQ ID NO: 6786622 - DNA, 58 bp, Homo sapiens
tgtgtttcttgacgctgctctaaggtctcaccacagcctggcagtctcaagcagcaca

SEQ ID NO: 6786623 - DNA, 55 bp, Homo sapiens
gttgagactccccctgcatgggccccaacaaaccccctgcttggggcagaacaac

SEQ ID NO: 6786624 - DNA, 78 bp, Homo sapiens
tcagagctaaaggattttaattttatagaggatgggaatactcgcatattgtaaaaggttgaatccctagcagcatga

SEQ ID NO: 6786625 - DNA, 130 bp, Homo sapiens
atggctctcatgacccaaccttagatcctggctctaataggctcagacatttgtagaaagtgcccctgatgacactggtattcaagcgagcagatgtctagggctcatttagcctctaaaattgtgacct

SEQ ID NO: 6786626 - DNA, 90 bp, Homo sapiens
tgtacatgctgcaccttttctctagcaggtgccttgtaacagttagatgcctatgtggccgcacctgcagaggtgaggtgcttgggtgca

SEQ ID NO: 6786627 - DNA, 59 bp, Homo sapiens
caggctgagctctggcctgggcctctgctcccacatggtccccagctaggctcagcctg

SEQ ID NO: 6786628 - DNA, 73 bp, Homo sapiens
gtctcaaaattaagcccaggtatctggacagtcatgtaccccaagacctctgaagtacctggtgttctgggac

SEQ ID NO: 6786629 - DNA, 80 bp, Homo sapiens
ttctagctaacgatttctttctcttgatattttttagagaaatatgaaacgcaatgggagcagaaattgtttgaatagga

SEQ ID NO: 6786630 - DNA, 76 bp, Homo sapiens
gccattgggatgtcagggctggccctggagggctgtgcgagccctagggctgcagccgggctcctggctccctggc

SEQ ID NO: 6786631 - DNA, 73 bp, Homo sapiens
cattagaatcaggaaatggtgatttggttgaatctacagataatagctttaccacttcctgtgtcagctgatg

SEQ ID NO: 6786632 - DNA, 61 bp, Homo sapiens
tcttcactggaactattttaataaaatgagctataagcttttaacatagtccagagaacga

SEQ ID NO: 6786633 - DNA, 73 bp, Homo sapiens
gggtgagccagcaggcctccagtggcgcggaatatttatccctccttagccacgggatgccttctgttcattc

SEQ ID NO: 6786634 - DNA, 85 bp, Homo sapiens
gggatatgtaacaagtgcttactttgggctaggtgttgtaaatgctttagctcagcaaatcctcaaacaagcacgttaatgaccc

SEQ ID NO: 6786635 - DNA, 73 bp, Homo sapiens
ctctgtaaatgtgatcattgtgttaggcaaagaattgctcatcaacatgatgatcatggagtacacaaaagag

SEQ ID NO: 6786636 - DNA, 56 bp, Homo sapiens
gctcaggcaatccaaccgcttcggcctcccaaagtgctaggattacaggcgtgagc

SEQ ID NO: 6786637 - DNA, 106 bp, Homo sapiens
gtgcattaggcagacacagcctcagtgcagcggcagcagctcttgggaagcaagagcccagggctttgaacactgcattacaacaggggatgcgtcctaatgtcac

SEQ ID NO: 6786638 - DNA, 65 bp, Homo sapiens
tgtgtgttacagtttatgtatgctgtacatgtatgggtatagacataaacttactgaaatacata

SEQ ID NO: 6786639 - DNA, 63 bp, Homo sapiens
acacaagagagtgcgcgttgcaaagtgcggtggagcatttgtgtgtgtgtgttttctgggtgt

SEQ ID NO: 6786640 - DNA, 71 bp, Homo sapiens
ggatggtttcctttcagatctgtaactggcaaggtgtatattttgtttagagaattgaagcagagccctcc

SEQ ID NO: 6786641 - DNA, 77 bp, Homo sapiens
attttttaaacattgtacattctgtagctgtgtctgcttcaaaattatagctgcacgtggtaaatgtaaaggaaaat

SEQ ID NO: 6786642 - DNA, 73 bp, Homo sapiens
acttggagctgtaaaggtttgtgtctaatttgaatacactcagaaaacatagatgcctctgctgcttcatggt

SEQ ID NO: 6786643 - DNA, 105 bp, Homo sapiens
gaagaggatatacaatgtcattagaatgtgctgggacagtaatggttgttttattattattgctgctaacattttatggcatagcattcaagacctgtcctgttc

SEQ ID NO: 6786644 - DNA, 79 bp, Homo sapiens
gatcaaggtgtcaacaaggttgcttcttctgaggacctctctgtcttcacatgatgtttcctctgtgcatgcctgagtc

SEQ ID NO: 6786645 - DNA, 67 bp, Homo sapiens
gaatcctaaggagaaagttattattggagaagctgccagtgtattctttaaatcctcacaagggttc

SEQ ID NO: 6786646 - DNA, 70 bp, Homo sapiens
ggagactgtgcggctgcaagagagatgagtaacttgctcctttgtttccttccagcttgtgacagtctcc

SEQ ID NO: 6786647 - DNA, 84 bp, Homo sapiens
gtgagatttggatggggacacagagccaaactatatcagcatccaagatggagtcactcttgtctccacaccccacattctcac

SEQ ID NO: 6786648 - DNA, 84 bp, Homo sapiens
gtgttcagttaatttgggaaatgctgaggtaaatcagattaaaaggctttttaccctgggtatttcccaaacttttctgatcac

SEQ ID NO: 6786649 - DNA, 56 bp, Homo sapiens
agtgtgtgttgaagcagtgtctgttgcaagaaaacagtgtctgctgcaagatatct

SEQ ID NO: 6786650 - DNA, 108 bp, Homo sapiens
tcggtgcttcccagagacccctctgagctggcctgtggggcacgggaagccccctggatgggaggcggggccacaggtcggctagagggtctccaccaggcccactga

SEQ ID NO: 6786651 - DNA, 68 bp, Homo sapiens
ggtttgctaaaacctgggccatctctctgcaagtgtccttatgttagttcagaggcccagagcaggcc

SEQ ID NO: 6786652 - DNA, 103 bp, Homo sapiens
caggctggcggcacccagaggggagctgacaaccacatccttgggtagactagatggccagcggtgcaaggattgggaagcttcccctgaaaccaccactttg

SEQ ID NO: 6786653 - DNA, 60 bp, Homo sapiens
gattatggctgcagatcaagggcaggcatttatgcctcctcccagtttatagcagtgatc

SEQ ID NO: 6786654 - DNA, 89 bp, Homo sapiens
attgtgaataaatgaatgactgtctactttggggaaaatttaattccccaacataattaatgtggcatagttagtcatttcttcagagt

SEQ ID NO: 6786655 - DNA, 110 bp, Homo sapiens
ggtgtttcaaaattgttccttgagaaagacagacattcctaattagaagaatcggctctaagtgacttagttatttttgtcctccaagaagcatctttatttgaatttcc

SEQ ID NO: 6786656 - DNA, 66 bp, Homo sapiens
cgagatgccgaggcggcaggaagccggaacccatcccccgcctgctctggcgtactcggcatcccg

SEQ ID NO: 6786657 - DNA, 65 bp, Homo sapiens
tgtttgaagttcttctgtgactctcgattaaccttgatttaaagttccagaaaaatgctcaagca

SEQ ID NO: 6786658 - DNA, 56 bp, Homo sapiens
gtgcgttgcatgctgagagccaagcaccgacaaaggcccagagacgtgcaatgtac

SEQ ID NO: 6786659 - DNA, 76 bp, Homo sapiens
gggacctctctgttcctggcctcttgcccccgccctgccatctgccggccccaagagggcagcacaggtgggtctt

SEQ ID NO: 6786660 - DNA, 93 bp, Homo sapiens
attgcaggccttgtgtcccaagtcttttcagccccttcatcatagagtgaccctgtgctaagttctgcaaaagataatcatgcaggccgtgat

SEQ ID NO: 6786661 - DNA, 129 bp, Homo sapiens
gtgagtgtatataggaggagtccttaacctgggacccatgagcttcttaaaatatatgcaaattatatgcaatgttttgttgctatgtggtacacggttttaggagtccttttggaatatagctttcac

SEQ ID NO: 6786662 - DNA, 83 bp, Homo sapiens
atagttttcagtgtacagatatctcacgttcttgattaaatttatttttaaggatttgtttctttttgatattgtgaaattat

SEQ ID NO: 6786663 - DNA, 86 bp, Homo sapiens
cttatttcaagtcccagtatttcattcagaattgttattgcagggaagaccctggaaacttatgaggagattactgaagaaataag

SEQ ID NO: 6786664 - DNA, 72 bp, Homo sapiens
actccacctctcgccaccggccacaccgcgccccaaaccggcctggaggtcgctagcgagcgggcttggggt

SEQ ID NO: 6786665 - DNA, 128 bp, Homo sapiens
catcagaatcaccttatgggcttggttaaatacaaattgctgggtcccacccaagatgtttgattcaatggttgtgaggtggggcctgataattgactattctaacacattttcaggtgaagttgatg

SEQ ID NO: 6786666 - DNA, 120 bp, Homo sapiens
gggcaaaggctgagtgaaggacggcctcttcggcagcacctggcacaggagggccgtctgtaaatgcacgcgtccttcctggtgcctgggcttccctcactgtttcttcctcccgctccc

SEQ ID NO: 6786667 - DNA, 65 bp, Homo sapiens
aaagtgttagcctgcctgaagagactcactcaggtggtggccatctctgcccaggctgacagttt

SEQ ID NO: 6786668 - DNA, 82 bp, Homo sapiens
cccacctgcagcccttagctgtgtagacactcagagccagacaagaccctggtcctcagccttgtccacagctacaggtggg

SEQ ID NO: 6786669 - DNA, 113 bp, Homo sapiens
acccactctgacatcgaggttaaatgcaactttagggccagcaagtacaagccttattctgccacttactagctgcagggcctggggtggcacttggcctcccaagggaaggt

SEQ ID NO: 6786670 - DNA, 94 bp, Homo sapiens
ctttagagccagaatttggtccgaattttgtttatttccttcacatggcatggagatagcaccatgactaaacaattatacttctggcttttag

SEQ ID NO: 6786671 - DNA, 57 bp, Homo sapiens
cctgcttctctaaatgaagggctctgggccttgccaggaacctggggaaggagtagg

SEQ ID NO: 6786672 - DNA, 79 bp, Homo sapiens
atcactgaaacacatatgaacagttgatgaggtcagatactttaagacaacaccaattgatgaatatggtgatattgat

SEQ ID NO: 6786673 - DNA, 79 bp, Homo sapiens
tgtttttctagagacatcatcatgaatcataacttcacttcattatggtccctgatctaatgtctcatcagagaggtca

SEQ ID NO: 6786674 - DNA, 79 bp, Homo sapiens
tgtgtattatttgctcagtgttttccagggtctactgaaggaatttagtggccgcaaatattcagacaagcaatacata

SEQ ID NO: 6786675 - DNA, 68 bp, Homo sapiens
attcatgcattcagcaaacatttattatctgttatgagctagatagtatgtgatgctgataaatgaat

SEQ ID NO: 6786676 - DNA, 81 bp, Homo sapiens
ccgtccccagaaagaagtagaaatatgtttggatcatgcaaccagcaaaagatatggttttctcttctcctaggaggcagg

SEQ ID NO: 6786677 - DNA, 88 bp, Homo sapiens
ggagtcttgctttgtcacccaggctggattgcagtggcatgatctcgactcactgcaacctctgcctcccgggtgcaagcaattctcc

SEQ ID NO: 6786678 - DNA, 112 bp, Homo sapiens
ttaatttactaaatgatgtacactgaatgtttaagaacttgactttgagaatgttagtggttgtttatacaagtttttaaattattagtttgcagaaaaattggttacttaa

SEQ ID NO: 6786679 - DNA, 66 bp, Homo sapiens
ttcccagcagagccagcaagccgaacgcctccagcgcggccgggacggaggagcggctctggggaa

SEQ ID NO: 6786680 - DNA, 68 bp, Homo sapiens
agtttgggcagtgggcctaggtgtgagatcagccctgttttaaaatccaataattcactgccccaact

SEQ ID NO: 6786681 - DNA, 63 bp, Homo sapiens
tagagtttgtaataatgaaggaagtaagtgctgctgatggttccacatctattataggcttta

SEQ ID NO: 6786682 - DNA, 82 bp, Homo sapiens
gggtaccaaggtttctttgccaggcagttgtccctgaggaaatttccagtgcccagtctccctggtccataccttggcatcc

SEQ ID NO: 6786683 - DNA, 103 bp, Homo sapiens
ctatgtgtcaggaattgtgctaagccctgtgatcaaatggcatgggagacaaacaatccctgctttcacagagctcacagtttagcagggaagaaagacatgg

SEQ ID NO: 6786684 - DNA, 64 bp, Homo sapiens
tcccaaagtgctgggattacaggcctgagtcaacatgcctggcctcctacagtactttttaaga

SEQ ID NO: 6786685 - DNA, 58 bp, Homo sapiens
gaagataggagcagaagcactagatacagtatttggtctgagcaactgccctatcttc

SEQ ID NO: 6786686 - DNA, 58 bp, Homo sapiens
attagctagaaagtttcagctgtgagtggcaacttacaagaatttctttctggttgat

SEQ ID NO: 6786687 - DNA, 82 bp, Homo sapiens
taggttggtacaaaagtaactgtggtttttaatatatctaaaattatattgtaattgcctatttatttgtttgtgcctccta

SEQ ID NO: 6786688 - DNA, 84 bp, Homo sapiens
tcagtttagagaaaaggagtgggagtggggtgaggacagggcttatttttcactccatagcttaactctttggctctgagatga

SEQ ID NO: 6786689 - DNA, 77 bp, Homo sapiens
gctggaggcaggaggtgggagcctccagtggtagggccccagactgccccacccttgactctccttcctgtcccagc

SEQ ID NO: 6786690 - DNA, 74 bp, Homo sapiens
ggctgttccttctgcctggattccattctccagccccttctgttggcagctgtgtccaggtagaaggaatggct

SEQ ID NO: 6786691 - DNA, 76 bp, Homo sapiens
tctctggcagaggcaatggaatgggcactcggtttggagtctggcgctgcctccaccattgctcactttgcagtga

SEQ ID NO: 6786692 - DNA, 70 bp, Homo sapiens
ggctagggacacagataatcacacagataaatgtaagtcatcgtcagtgttctagtttctgtctttggtc

SEQ ID NO: 6786693 - DNA, 96 bp, Homo sapiens
gtttccctctttggtagttaaagatcataatatttatctcatggggcttttatgaagatgaaatgtatgtcatcaatcttgcacataggaggaaat

SEQ ID NO: 6786694 - DNA, 66 bp, Homo sapiens
gccatgaggttctctttaatcattctgatagtttcattagaaaatttagaactgaacttcttcggt

SEQ ID NO: 6786695 - DNA, 105 bp, Homo sapiens
gttggccttcagtcctggcgtggggtgtggccagggggccatgtcccccatgggcccagcaggagggcagcgctctgccacaccgcatgtgtggatccggcccac

SEQ ID NO: 6786696 - DNA, 75 bp, Homo sapiens
ggcaggtcagggtgtcccagaggacagggtcacatgggccaaatcatgtgaacctgggtcctgggcccttttgcc

SEQ ID NO: 6786697 - DNA, 57 bp, Homo sapiens
tgcctggccctgacagccctgggctccctctgggagaggataggggcaggggcagca

SEQ ID NO: 6786698 - DNA, 67 bp, Homo sapiens
gccctgtttggatggggacccagctggggctgtctctgacctgggtgattcctgtccaggcaaaggc

SEQ ID NO: 6786699 - DNA, 112 bp, Homo sapiens
agaatcacttggaaggtttgttaagctgtagattcctaggcctcacctcagaatcaaaacctctaggaacagtcctagaaatctgtattttaaccagcacccagttgattct

SEQ ID NO: 6786700 - DNA, 58 bp, Homo sapiens
ggatgggcggactcgggcatggaatcatgagattccagccccttgagtctgccagtcc

SEQ ID NO: 6786701 - DNA, 64 bp, Homo sapiens
tttggctgctagctaatttttattagcccgtcaccagggtttctttaggttctgacagtccaaa

SEQ ID NO: 6786702 - DNA, 62 bp, Homo sapiens
cactcaaacaggcagcactaatctctggtaatagaaatcaggatagtggttacctgggggtg

SEQ ID NO: 6786703 - DNA, 64 bp, Homo sapiens
gacccggcccactctcatctgctggtatcctgctgtttcaaaaccagccagagggcccaaggtc

SEQ ID NO: 6786704 - DNA, 55 bp, Homo sapiens
gatgttctgggcagagcacaaaaaggctggtagtcaggtgttctcttcagaaatc

SEQ ID NO: 6786705 - DNA, 61 bp, Homo sapiens
gctgctgagcctggtgcgggatgctgcgggcaaggaagacatcatcgagtggctcagccgc

SEQ ID NO: 6786706 - DNA, 60 bp, Homo sapiens
tttctttctttttcctggccatgaggacaaaaattactgagtggcccttaaagagggaag

SEQ ID NO: 6786707 - DNA, 57 bp, Homo sapiens
gaggcacaatacatgtctcaagttttggagtacaatctccccataggtattggcctc

SEQ ID NO: 6786708 - DNA, 60 bp, Homo sapiens
catgcacaaaggtaagatgcgtcaggtccctgaggaaagggaatgtgtctttcttgtttg

SEQ ID NO: 6786709 - DNA, 81 bp, Homo sapiens
gggagttatatgaagtgtctgttgtatctgggaacctcattggaggctcatagatagttttagagatttcagatacctctt

SEQ ID NO: 6786710 - DNA, 108 bp, Homo sapiens
gacaaccaaaaatgttctaatgataagtttgtctttgtaaagatattcactcatagcccattctatggtctttggaaagacaaagttcatgtcagatgttgatttgtc

SEQ ID NO: 6786711 - DNA, 102 bp, Homo sapiens
gagatttgagtatagtacatatagtaatttagccatttcaaacagttgaacaaattgtacacctgtggttagattgacagtaatgacagtgatttaattttc

SEQ ID NO: 6786712 - DNA, 57 bp, Homo sapiens
gcagcaggcacttaccgttgctgtacaataactggagtttatagtggatgccgttgt

SEQ ID NO: 6786713 - DNA, 71 bp, Homo sapiens
ggtgaaatgttggcatcggtacctggatgaatcctctttgcaatccaggtactgatgccaacattatctcc

SEQ ID NO: 6786714 - DNA, 61 bp, Homo sapiens
aggaacactgccttttattttcccccttactccatgggaaaggagagaaggaggtgtccct

SEQ ID NO: 6786715 - DNA, 74 bp, Homo sapiens
ctcttcaatttcacctatcacttaagcctctctcctcttcagaggctaaataaaaggtgggaagaaaagaagag

SEQ ID NO: 6786716 - DNA, 103 bp, Homo sapiens
gggcatggagctcagggggtcatacgtgcactgaaattgcgtacaaatttgtaagtgcaaatgtgtgtatttctaggcgaggacccctagatttcttcagcct

SEQ ID NO: 6786717 - DNA, 101 bp, Homo sapiens
ttccatcccagtaagttcccatgggataagttattttagtaaatcagaaaatttctctgaaagcaaagtaattcttaatttttggaggcttgaaaatggag

SEQ ID NO: 6786718 - DNA, 88 bp, Homo sapiens
tgggcgttcagaggggggtagccagagaagagcagggatctgagcagttggggcctctgggttctggcctgcaccccctctcagcccg

SEQ ID NO: 6786719 - DNA, 68 bp, Homo sapiens
gtggaacccaggctagaagtgaattatgatagtgcagttaattaaagtttatcatagccggggaccac

SEQ ID NO: 6786720 - DNA, 73 bp, Homo sapiens
tgctgaactactaccagtagtagtagtagtagtagtagtagtagtagtagtagtagtggtagtagtagtagta

SEQ ID NO: 6786721 - DNA, 59 bp, Homo sapiens
ttcaaacagttgcacaacttatgtcacttctcaacatagcagaaagtgcaatgtttgag

SEQ ID NO: 6786722 - DNA, 65 bp, Homo sapiens
caggactgtgtttacagagaaacacgactgtctcttgttgaagccgctgtgaacacatttttctg

SEQ ID NO: 6786723 - DNA, 70 bp, Homo sapiens
atgacctggacagcctccatcgccccgggggctctgacatgctcagatcccaggatggggctgcagttat

SEQ ID NO: 6786724 - DNA, 68 bp, Homo sapiens
ctggctgctgaacaagggaaccctgtgcactggggaattttcagttagggttttttgtgagcagttag

SEQ ID NO: 6786725 - DNA, 112 bp, Homo sapiens
agtgaaggagaaagtggcttttgtggtatgaaaattgtaaagttctttttaaaaaaggaaagaagaaacaaaaagatttttaaacaaacaaaaactaagagaattcatcatt

SEQ ID NO: 6786726 - DNA, 119 bp, Homo sapiens
aaatgtagacatgctaagagcaggaattaaactcaagtttcttaatgtcagatctgatactcttgacacttgcccttagaaacatgtagttgattatttttgtttttcatgttatattt

SEQ ID NO: 6786727 - DNA, 64 bp, Homo sapiens
aataataatgaaagccactgtgtgactatgaggacacagaagcatggtggctctcatgattatt

SEQ ID NO: 6786728 - DNA, 62 bp, Homo sapiens
tggccagttgaagacaatgctcacttactacgagataatgtgcgtgttgtctgaagctgcta

SEQ ID NO: 6786729 - DNA, 56 bp, Homo sapiens
gcctggtggtatcctggcaagaatggctcgcttaccgtggttgtgggatcccaggc

SEQ ID NO: 6786730 - DNA, 65 bp, Homo sapiens
ccaaacattttcacttcaggtggtttctgaaagagggaaagactgaggggaaagtgatgatgtgg

SEQ ID NO: 6786731 - DNA, 67 bp, Homo sapiens
agagtgccaaggctgagaaattctgccctagctacagctaaggacagaattcttttagttcatcttt

SEQ ID NO: 6786732 - DNA, 75 bp, Homo sapiens
ggcgagaaaaggagggataagaaccatcctaaagctgtaggactggaagggattttagtgactcctttatctgcc

SEQ ID NO: 6786733 - DNA, 56 bp, Homo sapiens
tggcttgaattgtgttttgataagcgtgtattgctttagtaaagccagtcaagtca

SEQ ID NO: 6786734 - DNA, 56 bp, Homo sapiens
ctgactctgacaggacttgtggagaaaaagtctaccgatttctgttttcagggcag

SEQ ID NO: 6786735 - DNA, 92 bp, Homo sapiens
aggcctgaaaaagtaaaattcaatcttcactggtaatgaaatattaaattagtgtggacacagtggagagacttttactcttttgctggcct

SEQ ID NO: 6786736 - DNA, 55 bp, Homo sapiens
cttctggaggctctggaggagaatccacttccttggctttttcaccttctagaag

SEQ ID NO: 6786737 - DNA, 86 bp, Homo sapiens
ggtggtgatggtggtagtggtggtggtagatgttgaatccctgtttcaggctcttaactctccctccttacatccccctttcctcc

SEQ ID NO: 6786738 - DNA, 71 bp, Homo sapiens
tttctcttgcttaatttctaagttttggataattcttaccaaaaagttaagagaggttcagtctggagaag

SEQ ID NO: 6786739 - DNA, 85 bp, Homo sapiens
ggcacgggttgtttgaaggcttaaaattagtacaagagaagtttgagatgttctaattactggaaatttcaaataacacgatgcc

SEQ ID NO: 6786740 - DNA, 69 bp, Homo sapiens
aaagattttgacaccagactttaatcatagctgataggtccatgacagtactggtgacaatacattttt

SEQ ID NO: 6786741 - DNA, 73 bp, Homo sapiens
ccctgtttgggaaggccttgcctgacagcaccagtctgagtggggaggctggtctgaaggacttctgaggggg

SEQ ID NO: 6786742 - DNA, 58 bp, Homo sapiens
cagtgtgtcttgactgccttttgaaagaccattggaaaggcaggcctaggacatattg

SEQ ID NO: 6786743 - DNA, 99 bp, Homo sapiens
agtccacatcttggggatcctgtcccatgcttccacctagtgcaataggacagactgttgtgaggatgtgagcgtgaaccagggcccaggacaagggct

SEQ ID NO: 6786744 - DNA, 59 bp, Homo sapiens
cacagcttatgccactgattggacatcctaatgtggtcccatgtcagatgtgggctgtg

SEQ ID NO: 6786745 - DNA, 65 bp, Homo sapiens
gcaaatctgcctctatgcgctcagatgcagaactggttctgaattgtgcaaagagccactattgc

SEQ ID NO: 6786746 - DNA, 90 bp, Homo sapiens
gggttaaagtagataacagatgtgaagtgctaatagtacataatgaaacaagtacatattaggtattattattattatttgctaggattc

SEQ ID NO: 6786747 - DNA, 61 bp, Homo sapiens
tagaaaagaattttatttgatagcttgccttgcctaagcaaataccaggagttcttttctg

SEQ ID NO: 6786748 - DNA, 68 bp, Homo sapiens
gggccacacagcagaaggcccgtgtctgctcaatgactgaagatacgcggctcttttcttgattctcc

SEQ ID NO: 6786749 - DNA, 57 bp, Homo sapiens
acttcttgggaccctggcaccgatccactgtccttggtggttggggttcagagaagt

SEQ ID NO: 6786750 - DNA, 67 bp, Homo sapiens
acgcttggtatgtgagggccaaccccaatagtcaccaaagtaaggggagccacattcttccaggtgt

SEQ ID NO: 6786751 - DNA, 103 bp, Homo sapiens
ttgagggggagtctcgctctgttgcccaggctggagtgcagtggcaggatctcggttcactgcaagctccacctcccgggttcacgccattctcctgcctcag

SEQ ID NO: 6786752 - DNA, 97 bp, Homo sapiens
tttcctctatgatgacatcgccctggggaagagaagctgagaggaactcctcactcagctagcttcaggagccatgacatcatctctaccatggaaa

SEQ ID NO: 6786753 - DNA, 72 bp, Homo sapiens
gccaacctagagctcactcagcctctccccatttttggaaatgatggaaggcttgagttcccaggtcaaggc

SEQ ID NO: 6786754 - DNA, 78 bp, Homo sapiens
ggttagttggctcccctgttcaggtcacaggctccaaggcttggttctgtcatctgtaacaggagggttgaaataact

SEQ ID NO: 6786755 - DNA, 82 bp, Homo sapiens
taacaaagtaaactgagcaagatttacagacaacttcggcgtggtttcatacgagatgtattgaagcacatttattttgttg

SEQ ID NO: 6786756 - DNA, 114 bp, Homo sapiens
ggggggcagagaaacgcttgaaaagggaagttgcacatgttcccctctctctgatctgatgggaatgcactagactgtgaaacttcctcctccacctcttctcccgagtccctc

SEQ ID NO: 6786757 - DNA, 79 bp, Homo sapiens
ctgcacaattcgtttttcatctgtagtgcaacaatccatatttgtctctgatgctgccagggaaaatatactagtgcag

SEQ ID NO: 6786758 - DNA, 56 bp, Homo sapiens
taacatgtttgagtggtacttaaagacccaatctttggccaatttagaacgtgttg

SEQ ID NO: 6786759 - DNA, 70 bp, Homo sapiens
tactgactcctgggtcccatcccaggccatttacaccaaaatctctgggggtagaactcaggcatcagta

SEQ ID NO: 6786760 - DNA, 111 bp, Homo sapiens
ttaacttctgtatttgggagagcggttgagaaatacctacttagctctggcaatatgactgagttaagtaaacatttcccagactgttcatatctcaagctcccaagttaa

SEQ ID NO: 6786761 - DNA, 56 bp, Homo sapiens
ggcaaaccagtttctgcttttcctgttctcgtggcagcagggagcatctggttgcc

SEQ ID NO: 6786762 - DNA, 75 bp, Homo sapiens
gtgtaggtatgtttgtgtgtgtgtgtgtgtatgtgtaggtggatatgtatttgcaggacatagatatggctaggc

SEQ ID NO: 6786763 - DNA, 99 bp, Homo sapiens
gtatgaaatacagttgcagtcatgtatactccatctccaaagaatggattcattcttcatgtcatggtatattgactataattttctgtttttaattac

SEQ ID NO: 6786764 - DNA, 61 bp, Homo sapiens
gttggcagcaagaccacccctggacaaaaagccgatctcagggcaggtctctgatgtcaac

SEQ ID NO: 6786765 - DNA, 77 bp, Homo sapiens
caaaaggatcttaaggcttggtctagtcatgccaggagtcctgagtgactgtggagcaagctgagaggtctgctttg

SEQ ID NO: 6786766 - DNA, 57 bp, Homo sapiens
tctcagagcttcagttattttctttgtagaacaagagaggttggactcaactctgga

SEQ ID NO: 6786767 - DNA, 80 bp, Homo sapiens
gtgggatctcatattctggatcctatgcactggactccaaggagtcaacgtttacagaatcttggactaatgggacccac

SEQ ID NO: 6786768 - DNA, 83 bp, Homo sapiens
tctaggggattaatggccagctgggagagttgatggcccagaggagggactcattaacctcagcgggccattaattccttagg

SEQ ID NO: 6786769 - DNA, 74 bp, Homo sapiens
taacagtcacttggaaatggagccccatgtttgcttagaaagacaatggagtgggccaattttagtgaaggttg

SEQ ID NO: 6786770 - DNA, 65 bp, Homo sapiens
gttccttcatccattcattctctaagtcgattgagtaccgactgtgtggcaggcagtgaaggagc

SEQ ID NO: 6786771 - DNA, 56 bp, Homo sapiens
ggacagggagtctggtcctgtgtgtccttcaccatgttacttaacctctctgtgcc

SEQ ID NO: 6786772 - DNA, 111 bp, Homo sapiens
ataattataagcacacacttttttctacaagtttgtgttaaatgttaaattcatatgaatgtggatgatgtataactaaggggaataaaaaagtgagctgctgatgagtat

SEQ ID NO: 6786773 - DNA, 67 bp, Homo sapiens
cagcctgtgactctgtgaaaccatgttcagactccatcctctcatgtcacttgtggtcactaggctg

SEQ ID NO: 6786774 - DNA, 75 bp, Homo sapiens
catgtacctaattatggtaaagttaatatgtaaaattacatatttgtctttgtactgttcggattaaggtgagtg

SEQ ID NO: 6786775 - DNA, 61 bp, Homo sapiens
ggtggacagggctgtgtgggacccagagctgagaagggagtcaccagcagcagctgccacc

SEQ ID NO: 6786776 - DNA, 68 bp, Homo sapiens
atgacccaaacagccttgagctcaaaaggaattgcatcagtccccatgagtaaaaagttaggggtcat

SEQ ID NO: 6786777 - DNA, 55 bp, Homo sapiens
catgaatgagtaatttacaaagcccattaaggcggcacagaattacttatttatg

SEQ ID NO: 6786778 - DNA, 93 bp, Homo sapiens
gtggcccagttgcggtctcttcacttgctggatggtggctcagcctgacaggtttcacaggtatccacgggtctgagtccagagctgccccac

SEQ ID NO: 6786779 - DNA, 68 bp, Homo sapiens
aagctcgcggtccatgtcccctgcctcggagtgtggacgtgaactccggggtgggctgggctgggttt

SEQ ID NO: 6786780 - DNA, 56 bp, Homo sapiens
gtcaaatattatgcagcttggatacccaatttagtatgagctgctttgtatttggc

SEQ ID NO: 6786781 - DNA, 74 bp, Homo sapiens
gttttcagggacttggttatactccaggaaccagtgatgatattggctcctgatatccaggaagctttgaaggc

SEQ ID NO: 6786782 - DNA, 64 bp, Homo sapiens
agggtgaggatgggaagggcccacctcctccaggtgagaagctgggctgcccaacctctgacct

SEQ ID NO: 6786783 - DNA, 58 bp, Homo sapiens
cattctctgccactcgaagtcaaggactcactgagtccctttcacagggcaggcagtg

SEQ ID NO: 6786784 - DNA, 74 bp, Homo sapiens
aataagaatatttcattgatcaccaaatttgtgccaggcattgtactgggtgcttcaaggaatgtcattttgtt

SEQ ID NO: 6786785 - DNA, 84 bp, Homo sapiens
gccttccctgagctcctgttccagccattctcctgttttcctttctggtgggaggaggctgggcacagtggcctcgtggaatgt

SEQ ID NO: 6786786 - DNA, 59 bp, Homo sapiens
agacatagataggcactgattgcatccgtctgcaaacatgtccttggatatctatttct

SEQ ID NO: 6786787 - DNA, 55 bp, Homo sapiens
aaagtgctgtgattacaggcatgggccccagcacccggccagtgcattgcatttt

SEQ ID NO: 6786788 - DNA, 94 bp, Homo sapiens
cttgattctgtcaagccagatagaagaactcattttatatagtgacaatagacatgagtaaattatctgttaaaaaggcacagagagaaccaag

SEQ ID NO: 6786789 - DNA, 57 bp, Homo sapiens
ccacagttaagggatgtcatgttgaacttgagggtcagcattcagtcacttatgtgg

SEQ ID NO: 6786790 - DNA, 128 bp, Homo sapiens
gcgcccagccaatacctggccttttaagaagtttgctgactcctggtatggatgacagaaaatggaataacgttttgtttctccagtctaggaaaagcaagtcaggtagtggatagactgactggcgt

SEQ ID NO: 6786791 - DNA, 84 bp, Homo sapiens
tgacatagagtaaacacagatatttaagagcttttgtgttcatgagcacagatagttacttaaggatcctactcaaacatgtta

SEQ ID NO: 6786792 - DNA, 76 bp, Homo sapiens
ttctatagtccttatttcacttaaacgtatgaggtggcatgagcctttactttagaaggaaataagttctacagag

SEQ ID NO: 6786793 - DNA, 55 bp, Homo sapiens
gagccccaataacagctgagatgaatttccaatcagctcagcaagatggaggctc

SEQ ID NO: 6786794 - DNA, 82 bp, Homo sapiens
gtttttagactgttaattgtgaattttacatttgggtcatcactgttgtgtagatttgttcacctattaaaataatgaaaac

SEQ ID NO: 6786795 - DNA, 93 bp, Homo sapiens
agttctgtaggcaaagttggtgtctgtcttgttcattgttataaacaacagtgtttggcatagagtaggcattcaatattgtgaaattgaact

SEQ ID NO: 6786796 - DNA, 130 bp, Homo sapiens
gtggaagagataacatttgtatgtgttacattttttcatgttagcaattattattaaacacttattttcctgtagtactgtaaaactggaaaacaatgagacatgtaataaagtatttattctctctctc

SEQ ID NO: 6786797 - DNA, 86 bp, Homo sapiens
gacagtaatgctaatagtagtaattattttattaatggcaactactactaaatggaatgattactatatgccaggtgttaagtgtc

SEQ ID NO: 6786798 - DNA, 96 bp, Homo sapiens
taagaaatcctgagtaatatgtaaatggttgtgacattcccttcctctgataaagaaatgcagaaaggcttcacttatttattttaggtagactta

SEQ ID NO: 6786799 - DNA, 93 bp, Homo sapiens
gtccaatgtggtttattattggaagaattgggtgaatcttgttaaaacacagctttacctgaaatttgatccctaggtgtgaacccagaggac

SEQ ID NO: 6786800 - DNA, 71 bp, Homo sapiens
ttaattcgtatttatattctcaatacctgccagatactaggctaggtattgggactataaagacgcattag

SEQ ID NO: 6786801 - DNA, 108 bp, Homo sapiens
cagatgagaagagtagaaagcccggggctacatgctggaagacaagagaccaactcctgcttctaacacttcatgagcatatgatcgggctttcagcctcctcatctg

SEQ ID NO: 6786802 - DNA, 127 bp, Homo sapiens
ctaagcactccatttcctcacaatgtcctctgtcattagcagtgccttgcctgtcttccacagtataagaagggccaggcattctaacccatttgcagagaatatctttgatttactgagtactaag

SEQ ID NO: 6786803 - DNA, 56 bp, Homo sapiens
gatgaaactcgtctttatgcatggctgcctcctagaaatagagacagagtttaatc

SEQ ID NO: 6786804 - DNA, 106 bp, Homo sapiens
gtagtttcataaatattttccaaagatgtcacaagatgtgatgactatactatgaatttacttaaaagcaacacgtttttgatattgaaaactatgtgaaaactat

SEQ ID NO: 6786805 - DNA, 113 bp, Homo sapiens
tatttttatctgcagggccgttactctcatgtttcctgtcacagaatctaaacatcacagatctgcagaggacaggcgaggatgctgagtgatgccaagcagttctgaaagta

SEQ ID NO: 6786806 - DNA, 60 bp, Homo sapiens
cagctgtgtagatgcagggtcaggttttgtttcatcctctctgtctgatctgcatggctg

SEQ ID NO: 6786807 - DNA, 97 bp, Homo sapiens
atgcacaaatggctcagggtccccaaatggtttctgtgtcctcaactttctatgtaataagagccatggatatttctgagcacagtttgacctgcat

SEQ ID NO: 6786808 - DNA, 64 bp, Homo sapiens
gcttagactaaggtgatggtatctcagctgcatagtaatctgtgaccaggaatcttttctgagc

SEQ ID NO: 6786809 - DNA, 83 bp, Homo sapiens
ctcttacactgcccggctgttcttcgggactgtccgaaagtcactcggcatccctagaatagccaggtaggttaccaaaagag

SEQ ID NO: 6786810 - DNA, 62 bp, Homo sapiens
gtttgaaacatgcacctggaggaatttatctgtgaagagtcctttcagagtttgtttcaagc

SEQ ID NO: 6786811 - DNA, 85 bp, Homo sapiens
gcaagttacccaaatgagaatgtcacaaaagcaatcaacgcaggacccagcttgagaggctgttgacattctgtgtaattattgc

SEQ ID NO: 6786812 - DNA, 68 bp, Homo sapiens
ttctccgggtggcggcgaagggaccgccgctcatcctgcctgcatccctccgccgcctgcctggagaa

SEQ ID NO: 6786813 - DNA, 72 bp, Homo sapiens
gtgaatcacaaagctatatggagtctatggggaaattcagttttatatttttatccataagcttgtgttcat

SEQ ID NO: 6786814 - DNA, 64 bp, Homo sapiens
gttgtgaatagtgccgcaataaacatacgtgtgcgtgtgtcattatagcagcatgatttataat

SEQ ID NO: 6786815 - DNA, 65 bp, Homo sapiens
tcagactgtccacatggagaacctggtttggatggctctgccagtcgtgcctctcctgggtttga

SEQ ID NO: 6786816 - DNA, 57 bp, Homo sapiens
acagttgcagcactacagattatttcagctgaataaatctgtgctccctgcatttgt

SEQ ID NO: 6786817 - DNA, 61 bp, Homo sapiens
tccgggttttacactcacatcataaaaatctgtcttgaacttgtctgtgctgagcaccggg

SEQ ID NO: 6786818 - DNA, 61 bp, Homo sapiens
gctgagagggatgcttaatagtgttacacaggaagtgacacagtgggggatccttttcagc

SEQ ID NO: 6786819 - DNA, 85 bp, Homo sapiens
ccagcttgtctgccttgtccagaactgttttttgctgctcagtgtagcagctaagaacttgagctctggattttgacaaatctgg

SEQ ID NO: 6786820 - DNA, 60 bp, Homo sapiens
tgggaattattcattggtaggcaagctaaataggcgtgccattcgatgtgataaggacta

SEQ ID NO: 6786821 - DNA, 92 bp, Homo sapiens
gaaatacacttaaaatatatacactatttttatcctattaatgaacatgataatggggtggatagaaagtgatgtggttggggttgtatttt

SEQ ID NO: 6786822 - DNA, 96 bp, Homo sapiens
tgtatacatatttcttattcttgttacatacaaatagagctgtagtatcaaataattagtgatcactatatagctatgtgtatgtatgtgtatata

SEQ ID NO: 6786823 - DNA, 55 bp, Homo sapiens
tctccattttatagataatgaaactaagcctcagtttcatgtacaggaaaggaga

SEQ ID NO: 6786824 - DNA, 72 bp, Homo sapiens
tgaattaaagacatgttttaagaatatttgtggtttataaaatacagagttatttgacgtgtttttaattta

SEQ ID NO: 6786825 - DNA, 62 bp, Homo sapiens
ggcagctaggccatttgttcagtgagtaatcatgtctcatcctgtgcacagggcctggagcc

SEQ ID NO: 6786826 - DNA, 81 bp, Homo sapiens
gtttatagtggtcacccctaaataggaaagtcaagccctgtgaatgttcacagcatttttctgagcggtaatcatcaaagc

SEQ ID NO: 6786827 - DNA, 76 bp, Homo sapiens
gaagtgtcaaatgcaccaagcctgctggggtgagaaatattttagtctcaacagatttgtgcggcattggcatttc

SEQ ID NO: 6786828 - DNA, 80 bp, Homo sapiens
gttgggtgcaccggcctgggaggtaggagtcctgagttcaaagccagtctctgccacttctaagctgcgtgtgcttcaac

SEQ ID NO: 6786829 - DNA, 70 bp, Homo sapiens
cagtagcaagattctttatcagttactcatagggagaaaacactaccagagtgacgtgaagtgtgaactg

SEQ ID NO: 6786830 - DNA, 69 bp, Homo sapiens
gggggcctgcagggagaggcgttccagaggcaggtggggacgcctctgagaggccatctctcctccccc

SEQ ID NO: 6786831 - DNA, 81 bp, Homo sapiens
caaaaagcaagaatctccattcctgttttaccttatgtaagaaggttgggcacggacaggtggggatgaagcttgattttg

SEQ ID NO: 6786832 - DNA, 59 bp, Homo sapiens
tgggcagagtcatacaggagaccaccgacatggttaactcacacactgtgacctgccca

SEQ ID NO: 6786833 - DNA, 64 bp, Homo sapiens
ggtgggtggtgaagtctggtttaagactatcctttgggtctaaacagcctcttaccaacttccc

SEQ ID NO: 6786834 - DNA, 55 bp, Homo sapiens
gctcctcttgagagctggatccactgctaatgcagctttactctccaaggtgagt

SEQ ID NO: 6786835 - DNA, 57 bp, Homo sapiens
gagtgctgtcatactgagacagacagattattgttctggctctatgtgacagctctc

SEQ ID NO: 6786836 - DNA, 68 bp, Homo sapiens
tgcaagcaaaaagtctccaaataatgtcctcatgtgtttggcggacttgtatttacttcttgattgca

SEQ ID NO: 6786837 - DNA, 84 bp, Homo sapiens
taaatctgtggataagcactgtgatttataacattttacttggatatggtagatgttatcattcagagtagcacttaggattta

SEQ ID NO: 6786838 - DNA, 55 bp, Homo sapiens
gtggcatcagagctccctccaggcttcccagtgcctggattggtgctcctgccac

SEQ ID NO: 6786839 - DNA, 64 bp, Homo sapiens
aattgctcccattgtgcaccctttaatttttaatacattttatttctgcattcagggagtagtt

SEQ ID NO: 6786840 - DNA, 83 bp, Homo sapiens
taagggccgggcgcggtggctcacgcctgtaatcccaacactttgggaggccaaggcaggcggatcacaaggtcaggcgattg

SEQ ID NO: 6786841 - DNA, 71 bp, Homo sapiens
tctttggagatggctctgcaaggtctaaggccctcccagagccttagaccttggaaagccgtctccaaagg

SEQ ID NO: 6786842 - DNA, 56 bp, Homo sapiens
aaagaatctgttgattccccactgccaagctctgtagtagggtgtacaaattcttt

SEQ ID NO: 6786843 - DNA, 58 bp, Homo sapiens
tttagaaggaagaaaatgtgcaggttgaataatgaaatgctcagattctccatctgga

SEQ ID NO: 6786844 - DNA, 64 bp, Homo sapiens
gcagcatttgtggaatgggccccaaagcattaccaaatgggaaatcagtagccctaaatgctgc

SEQ ID NO: 6786845 - DNA, 96 bp, Homo sapiens
tctaaatgatgcaaacattttaagtatttttggaaaataaaatcataaacttattgatagaaagcttggggtgtttaaaaataacatcagattgga

SEQ ID NO: 6786846 - DNA, 75 bp, Homo sapiens
gcttgctagccatgtgagggagacacctatgaagcagaacttctgcccccagtccagctctcagatggctgcagc

SEQ ID NO: 6786847 - DNA, 111 bp, Homo sapiens
gtttagactatcatttcttgcatatcaacccaagcatactgtgagagttttaaacaagaatcttaataaagctattatagttatgttttaaagaagtggatttgtttaaat

SEQ ID NO: 6786848 - DNA, 121 bp, Homo sapiens
cccacaccatgggttctgggctgcctcaccctccctcattgcctcctgcgtgcacagaacatcctttccatgggggacatgcatcaggagtagagaaggctgggcagggacatggtgtggg

SEQ ID NO: 6786849 - DNA, 81 bp, Homo sapiens
ggctcctgagcttcctctctgcactggccctgcccagtatcctaggcagatggggtgacaagagagagagacacaggcccc

SEQ ID NO: 6786850 - DNA, 71 bp, Homo sapiens
ggcagctgtctctgagttagcagcatcaggaagcctcccctggaagacactggctgcaggatgaggctgcc

SEQ ID NO: 6786851 - DNA, 73 bp, Homo sapiens
ttcagtgtcatctagtgcccctctcccttgaggcaggcggcttcgtctccattttgggggggcagtcactgag

SEQ ID NO: 6786852 - DNA, 59 bp, Homo sapiens
tgatgaagaaatgtagagcctagtaaacgaaagtttataggatctcacccttctgagca

SEQ ID NO: 6786853 - DNA, 82 bp, Homo sapiens
taagctttgtttcttcaggcttttaggaggaacacttaccttaatcctcttaggtctctgggccttgaagtgatagcgcttg

SEQ ID NO: 6786854 - DNA, 76 bp, Homo sapiens
actgatatttccagtgcactgaatagaaaagctgcaatcacagttgtattctgccaagagcaatggaactgttagt

SEQ ID NO: 6786855 - DNA, 61 bp, Homo sapiens
agtgatgaataaaaataaagcatgtactgaatacctagcccatgcttaagtgttcattatt

SEQ ID NO: 6786856 - DNA, 60 bp, Homo sapiens
ctaccctgggtctcaatcatcctaacagatgtttgcttaggaaggacgggacttgggtgg

SEQ ID NO: 6786857 - DNA, 118 bp, Homo sapiens
cttaatgaacttagctgtcacggccgctgacaaatagttccctttgcttcctgatttggaactgcgcgccggcgagaagttgttagtggcttggatggtgacctttggttcagcaaag

SEQ ID NO: 6786858 - DNA, 81 bp, Homo sapiens
tgcaaacggggtccctctctgtgtcagtttctaatggagagcgagctgacagtgcatggagggactctgccaagatttgca

SEQ ID NO: 6786859 - DNA, 63 bp, Homo sapiens
cttagaattttgcctactacaaacagcaatgagtaaccctgaaaaagtggggagagtgctaag

SEQ ID NO: 6786860 - DNA, 55 bp, Homo sapiens
tacagttagcctgtctactccctagaccatgagctagtaaagggtagagactgta

SEQ ID NO: 6786861 - DNA, 59 bp, Homo sapiens
gaagcagcatgaagggagctgggtttgggggtgttggctgggcactgagggtgctgctc

SEQ ID NO: 6786862 - DNA, 66 bp, Homo sapiens
ggctggttcctccatcagcaggaagtctaaaaaggcaagttcaattctgatgaaggcaatacaccc

SEQ ID NO: 6786863 - DNA, 64 bp, Homo sapiens
ggaggacaagctgtgagtggggttgcagaacaagtctggagaaccctgctttatgccgtcctct

SEQ ID NO: 6786864 - DNA, 67 bp, Homo sapiens
ggtggaatttctcatgtacaaaaacactgtaacacaagagtgtacttctacaatgagaagtatcagc

SEQ ID NO: 6786865 - DNA, 80 bp, Homo sapiens
gctgagctttagtgtccagagtttttattagggtttcatgatgtactgattaaagcactggccagatgattaaactcagc

SEQ ID NO: 6786866 - DNA, 55 bp, Homo sapiens
tcacagaataaatgtactggccatgttgtcatgggaaagtcatttacttttgtga

SEQ ID NO: 6786867 - DNA, 107 bp, Homo sapiens
tccaagtttgaaggagccagggacatgaacccctgcttcacctcttaagatggatgttaggtcaggagcaaggagcagtgggataaaggtttccctggaagcttgga

SEQ ID NO: 6786868 - DNA, 60 bp, Homo sapiens
ggccttgggcaaagtgtttctggagcaaaaaagatgctcagagggttttggccaagtgct

SEQ ID NO: 6786869 - DNA, 56 bp, Homo sapiens
tggatctagccagcaacatttcggagatacaacttttcatgggcaggtaagatcca

SEQ ID NO: 6786870 - DNA, 58 bp, Homo sapiens
agtggctcttgggtcactgggccattattaaggtttctgtccatctccagagtacact

SEQ ID NO: 6786871 - DNA, 127 bp, Homo sapiens
ccttgaagtggttgttccagtgactctgagattaagctcaacagctgggcgtctctgggaaagctggcagggctggcaggatccacagggatgttgagttcttagtcttccaagctggacttcaagg

SEQ ID NO: 6786872 - DNA, 106 bp, Homo sapiens
gctgtccagcagaacctgacacaacctcctgaacacccctgtggacatcatgatgcggacacacgtgctgcaggtgtgttcagtgaggctgcagggggcggacggc

SEQ ID NO: 6786873 - DNA, 96 bp, Homo sapiens
ggtgggcagggaagcgacaggcagggttttgagatggggaaatcggagcctgtggcaagtctgcctgtcactggatgtagctgctctgtgcccacc

SEQ ID NO: 6786874 - DNA, 85 bp, Homo sapiens
ggctcccctgctggggattctttgacagggtgttgggtgtcagaggcccagggccagagcaccaggggccccagtgggaggagcc

SEQ ID NO: 6786875 - DNA, 55 bp, Homo sapiens
gcttgcttaaccaaaactagtcatcagttttctgaactgccttggttcagtaggt

SEQ ID NO: 6786876 - DNA, 76 bp, Homo sapiens
aaggagattaggcagtcaaggctaagatcttttctctcccaaccagagttctttacagtcctctgtcaatctcctt

SEQ ID NO: 6786877 - DNA, 92 bp, Homo sapiens
gagcaactactgtaagtcagaccttgttgatagcttatttcaaatagagctgacttttgaacaatatgggtttgagctgtgtggacatgctt

SEQ ID NO: 6786878 - DNA, 55 bp, Homo sapiens
gattgtagaggtgaaatgtctatggtaggcaacttccaagatggcctctaagatt

SEQ ID NO: 6786879 - DNA, 59 bp, Homo sapiens
ttggtagaattttaataatggagatgttaacatgcattatgctgataagattctatcag

SEQ ID NO: 6786880 - DNA, 74 bp, Homo sapiens
tttgaatgctctgcacgtccttagttaaatacagtcctgcagtctgtaacctgggatgtagcacagacttcaga

SEQ ID NO: 6786881 - DNA, 92 bp, Homo sapiens
cagggtggtagaatgtaaagaatagaggttttagaattagatacattttagctggaatcctacttctaacacttgctaggtttgctaccctg

SEQ ID NO: 6786882 - DNA, 66 bp, Homo sapiens
ctgtccgtctgtctctccttctcaatcccttcaagctcagggaagaagggtccttggcagcgacag

SEQ ID NO: 6786883 - DNA, 77 bp, Homo sapiens
ctttggcttggagaatttaagtgactttgtaacactttcagtcatgaagtccagtgctttagattccaaagccagag

SEQ ID NO: 6786884 - DNA, 55 bp, Homo sapiens
ggagggcccctccagtgggcagcccgggctgccggccacccacgcgggctctgcc

SEQ ID NO: 6786885 - DNA, 68 bp, Homo sapiens
atagtaatcagttgttggatcagtagggtcttttaagagggatatttattttaataattgataattat

SEQ ID NO: 6786886 - DNA, 77 bp, Homo sapiens
acagctgtgggataagttttgaaatactgaagtgtgagtctttcaactttgttctttttcaaaattgttttggctgt

SEQ ID NO: 6786887 - DNA, 61 bp, Homo sapiens
gggaactgtgtggtgctctgatgaaccccatctttctatctgtagtcactgcacagctccc

SEQ ID NO: 6786888 - DNA, 58 bp, Homo sapiens
gtgctttacaaactataaagtgcggtacaaatatcgttcttgtcagtttataaagtgc

SEQ ID NO: 6786889 - DNA, 77 bp, Homo sapiens
gggagctcaatagaaatgcagagtctcaggtccctctccggccccactgaatgagagtctgcatttcatcaagaccc

SEQ ID NO: 6786890 - DNA, 89 bp, Homo sapiens
tgcagcatgtggaaatccagcgtgtgcaccttagatggcaacagtctaaagagagtgggtacatgtctcaggaatccacactagctgta

SEQ ID NO: 6786891 - DNA, 77 bp, Homo sapiens
ctgttttgacacctctgggagaggacacttggagaggaatccctcccttgtactcactcctctctgagagaaggcag

SEQ ID NO: 6786892 - DNA, 64 bp, Homo sapiens
tccaagtggccaagaaaatagatgcattggtacttttccagttctttcacttgagtcactcaga

SEQ ID NO: 6786893 - DNA, 84 bp, Homo sapiens
cacattttataattcaaaggaaaataagtagttccatttctgatttacaggcatggttatttgcactttgaagggtaggcagtg

SEQ ID NO: 6786894 - DNA, 79 bp, Homo sapiens
gaggaggctgagccccctctgcgtagggatcaaggggctgaaccctctctgcgtgggactgaggaggctgagccctctc

SEQ ID NO: 6786895 - DNA, 73 bp, Homo sapiens
gaggttctactggcatttagtgggtagaggacaaggatggcactaaatatcctacaatgcacaggagagcctc

SEQ ID NO: 6786896 - DNA, 64 bp, Homo sapiens
agaactaggcattcccgtggcatcatgtgcccaatgcacagtgccacaggaatggccaatgtct

SEQ ID NO: 6786897 - DNA, 73 bp, Homo sapiens
attgtcacaaggatttttggaatgagatggcgtgtgaaagcacctggcacaggatccgagaccttgtggcgat

SEQ ID NO: 6786898 - DNA, 69 bp, Homo sapiens
ctgtgcagtaaatttggataatggattacagttgtattttcattccttaacattcatttgcttgcatag

SEQ ID NO: 6786899 - DNA, 85 bp, Homo sapiens
cgtggaatttaaataaaatatttggtagcagataagtgcatataagacactctattgctgcttgatgtgaccttattttctcatg

SEQ ID NO: 6786900 - DNA, 98 bp, Homo sapiens
gaggcaggggaattgcttgaacctgggaggcggaggttgcagtgagtcaagattgcgccactgcactccagcctggtgacagagcaagactttatctc

SEQ ID NO: 6786901 - DNA, 126 bp, Homo sapiens
aggtggctgacatttttagcccccggggtgggatgtcacagacggctgtttttacgttgtcggggaaccagtcagcaaagtagctgctgttcttatcttgaatgttgaacatttgttcatccacct

SEQ ID NO: 6786902 - DNA, 77 bp, Homo sapiens
tggccagactgtcacaagacattgagtggcttttgaaaatgagccatgttaaatggacttgatgggggttacaacca

SEQ ID NO: 6786903 - DNA, 92 bp, Homo sapiens
gcttaataaaattcacattctagggccctactttgcacctgttgaattgaaacttctggggatgtagcctgggaatatgaattttatcaagc

SEQ ID NO: 6786904 - DNA, 128 bp, Homo sapiens
tatggcatagggactacgttccaggagccagtgttccaagaggaccagaaagaagttgtataaccctttatgtacaagttttggaagtcttaaggagtcactttcttggcagttacagccctgccata

SEQ ID NO: 6786905 - DNA, 95 bp, Homo sapiens
ttccccttgctagtctcccttgcagtctgtgtagaagcctttgacctaggctccaccagtcaggtgcatccatgggagatttcagtttgggagaa

SEQ ID NO: 6786906 - DNA, 62 bp, Homo sapiens
ctttatttccatgctcctttctaatcagaatctctctggccaaaagcagtatgcaagtagag

SEQ ID NO: 6786907 - DNA, 58 bp, Homo sapiens
agttagtaggttgcaaatttggaccctggttgttttggttccaaagtcacctctaact

SEQ ID NO: 6786908 - DNA, 56 bp, Homo sapiens
gctgcccaccccgaggcaggaaggggctcacttccctctcctcgaaggtggccagc

SEQ ID NO: 6786909 - DNA, 56 bp, Homo sapiens
tcacagaagggaaagatgccaaaagtccgcatctttgtggcatcattgatctgtga

SEQ ID NO: 6786910 - DNA, 76 bp, Homo sapiens
acccaagataggtcggtttctctttggaggtaaaattaaaagattccagagcatttggaagccacgtgtcctaggt

SEQ ID NO: 6786911 - DNA, 71 bp, Homo sapiens
gacttttctggaatcctcaaaacatgagagccagactttaggagctctcatctctggactctagactggtc

SEQ ID NO: 6786912 - DNA, 55 bp, Homo sapiens
gctcctttctgttggtggccccttcccggttgggaccaggcttgtgggagggagc

SEQ ID NO: 6786913 - DNA, 83 bp, Homo sapiens
gtgtgtgtgtgtgtgtgtgtgtgtatgcatatgagtgcaactttcccaaagttgcatatacccgcatttacataaacatatac

SEQ ID NO: 6786914 - DNA, 55 bp, Homo sapiens
gtgccatgtgatcccagaattaaacagctaatgaaattctctgctcaagtggcac

SEQ ID NO: 6786915 - DNA, 70 bp, Homo sapiens
gcttaaactgccacaagagggacatcatttaatataccagagaacttcctaacagtgagcagtgaggggc

SEQ ID NO: 6786916 - DNA, 78 bp, Homo sapiens
tgagattcagtttcctcatctgtaaaatgagaatagtcacatctacctcacagaataaattgagaagactggagatca

SEQ ID NO: 6786917 - DNA, 58 bp, Homo sapiens
gtttggtagcagcaaagcccaggagcacatttccaaagaggctgctggttacagaggc

SEQ ID NO: 6786918 - DNA, 57 bp, Homo sapiens
atatcacctgagacttagaactggcctgcaaaaagggttagttaagcacagggatat

SEQ ID NO: 6786919 - DNA, 64 bp, Homo sapiens
attactctgaatgagttaggtatagattcgttggtgtgggtgtatacctacacatttttgtgat

SEQ ID NO: 6786920 - DNA, 56 bp, Homo sapiens
ggaagccaaggtggcctctattacagtttggaatattttgggaggccttggtttcc

SEQ ID NO: 6786921 - DNA, 56 bp, Homo sapiens
gagggacccaggcaccaggcagtgagtgtggcactgatggcccaccttggtctctc

SEQ ID NO: 6786922 - DNA, 57 bp, Homo sapiens
tttgcctttcagtgttttagagattgtggtcatctaggaaagattgtaagaggcaga

SEQ ID NO: 6786923 - DNA, 57 bp, Homo sapiens
gctcagctcattctgcgggggaagtgcattaactcccactccagagtagaagctggc

SEQ ID NO: 6786924 - DNA, 72 bp, Homo sapiens
gcttgggcctggaaggcagaggttgcagtgagctgagatcatgccactgcacttcagcctgggtgacaaagc

SEQ ID NO: 6786925 - DNA, 67 bp, Homo sapiens
gcatttctggcagtgaacactttcaccattacaggccatggtgagacaaagcagctgacagaaatgc

SEQ ID NO: 6786926 - DNA, 87 bp, Homo sapiens
tttctagatttgttacttgtagaacctgtttattatagagagttctaggcttctttgaaagctgttctagagttgataaatctgaaa

SEQ ID NO: 6786927 - DNA, 75 bp, Homo sapiens
aaagatttagatgttccctctaccctgggagcttatgagataacacttgcagggttgatgaattgtctgtacttt

SEQ ID NO: 6786928 - DNA, 74 bp, Homo sapiens
tgcatataggttagctcaagtatttgggatttgttttaaagcctactaaattaatttgaggatctctgaatgca

SEQ ID NO: 6786929 - DNA, 64 bp, Homo sapiens
gggaacacatggtaacaaagtagctgagtgagtgattcagcagccaaggtaacctgtgcttccc

SEQ ID NO: 6786930 - DNA, 130 bp, Homo sapiens
gggtgggggtggggggttaggccttacctttattttctgcctgagggagaagtcacgggcagtttccacaccaggtgcggccccttcctcagcagggtgagggtaggtggtggcccctccctgcccaccc

SEQ ID NO: 6786931 - DNA, 87 bp, Homo sapiens
tgttataattaattcagtagaaggggggctgtagttctcaaatgatcattacagcctcacatttacttacaagagtaaataatgaca

SEQ ID NO: 6786932 - DNA, 72 bp, Homo sapiens
ctgggcgtggtggcaggtgcctgtaatctcagctactcgggaggctgaggcaggagaattgctggaccccag

SEQ ID NO: 6786933 - DNA, 66 bp, Homo sapiens
tattggatattgagcagcttctctgccatctgcacaccagatgccagtagcactgctttcccagta

SEQ ID NO: 6786934 - DNA, 122 bp, Homo sapiens
gggcttagctaaaaggttaaggaaatactcctttgatgaagtttagctttgaaaggaatgtgtatattctttcatctaacactacatagggtatgtttctaagtacaaacgtctctgggctt

SEQ ID NO: 6786935 - DNA, 97 bp, Homo sapiens
gtgcctcctacacagtgcctggcacagagcaggtggcctgtgatcatgtcatgagctaacccaaactgtgtctggcacagttgcaggatatggacac

SEQ ID NO: 6786936 - DNA, 66 bp, Homo sapiens
tgtagtcccagctactgaggaggctgaggcagaaggattacttcagcccaggaggttgagactaca

SEQ ID NO: 6786937 - DNA, 63 bp, Homo sapiens
caacaagggacagtgttctaaacagagagtttagttctggcttaggaatttattccattgttg

SEQ ID NO: 6786938 - DNA, 67 bp, Homo sapiens
gtgacccaaatgtccattgaatggatgagcaaaatgtggtatacccatacaatggaattgtattcac

SEQ ID NO: 6786939 - DNA, 88 bp, Homo sapiens
taagattctatgactgagcttttctagatattcgcagatagatctagagtctctggacactatttggaagattcaacgtatgatttta

SEQ ID NO: 6786940 - DNA, 117 bp, Homo sapiens
tctgcagtcaaatctactgatttctgcctcccctgtgtcttcctctgcccaggcctggcccaggcttggtggggatatggggggtggaggagagaagaggcctagattggctccaga

SEQ ID NO: 6786941 - DNA, 55 bp, Homo sapiens
ctatctctttgctttcagcagtgtatttcaacactcagcttgaatctagagatag

SEQ ID NO: 6786942 - DNA, 128 bp, Homo sapiens
atcagaatagcctggagggcttgtcaaaatgcagagtcctgggccccatcctcaaagtttctgatttagtaagtctagggcaaggcctgagaatctgcttttgtaataagttcccaggcaatgctgat

SEQ ID NO: 6786943 - DNA, 69 bp, Homo sapiens
gggtcttgattctgtatatgttttgttgtctgttatttttattccaaattaatagtgcagatcaagccc

SEQ ID NO: 6786944 - DNA, 84 bp, Homo sapiens
ctgaccatagctggccaaccactggtctgaggtacaaggcataggccatgaccttgggtgtgagtggagtggaagctgaggtag

SEQ ID NO: 6786945 - DNA, 59 bp, Homo sapiens
ttttggccatgctcaagggtatacatacaaagtcttgtatcatctgggcagggccaaag

SEQ ID NO: 6786946 - DNA, 58 bp, Homo sapiens
tcagtgaggtcagtgggcttgccagaggtcataggtaaagagcagctgcacccattga

SEQ ID NO: 6786947 - DNA, 73 bp, Homo sapiens
gctcctgcccatctccgagccattcgcaggggaaggcctggaatgagagcccggggatcctgggaccaggagc

SEQ ID NO: 6786948 - DNA, 65 bp, Homo sapiens
tctttccagtaccaggaagcggatcatccactgtatcagtattttcattcctgagtctggcaaga

SEQ ID NO: 6786949 - DNA, 88 bp, Homo sapiens
cctaggattcccaacttgtaatctcataccggtctctttgggcttcatgttcacagtattgggggtggaggaggtggggaagtttagg

SEQ ID NO: 6786950 - DNA, 75 bp, Homo sapiens
ttctggctccagatgcttctgttagaaatggtaagaaatatacatttaaatatatttggtttttggagattaggg

SEQ ID NO: 6786951 - DNA, 58 bp, Homo sapiens
agtcaagacctattttaggatatgaagttctaagcttctactatcaatagttttgact

SEQ ID NO: 6786952 - DNA, 55 bp, Homo sapiens
cacagctgccatgcagtcagtgctgaggaaaacagcctagactcagcagactgtg

SEQ ID NO: 6786953 - DNA, 104 bp, Homo sapiens
tatatcctgagtgctttctgatcagaaacagagtttggtaaatagcccttgcttattgtatggctgctatataaatgctgtttttaataagcaccaaaaatata

SEQ ID NO: 6786954 - DNA, 59 bp, Homo sapiens
ctctgagcttagtgaaatgataaaatatgtgaggttttatcgtggtcacagggccagag

SEQ ID NO: 6786955 - DNA, 119 bp, Homo sapiens
aacccattgccttcaggtgagacttcatgcagaagagagctgtttcttttctttctccaaaccttctcagagacatgatttatggactttctttttcaaagcatttcaggcaggaggtt

SEQ ID NO: 6786956 - DNA, 58 bp, Homo sapiens
tcatcactcccctcatcaggactgttctttacacccctcaggggacctgtgagcctga

SEQ ID NO: 6786957 - DNA, 58 bp, Homo sapiens
tgagatggagtctcactctgttgcccaggctggagtgcagcggagtgatctctgctta

SEQ ID NO: 6786958 - DNA, 70 bp, Homo sapiens
tcccacacatgtctctccatgctcttctctgttttacagagtggatggagatgaccatggtgaccttgga

SEQ ID NO: 6786959 - DNA, 71 bp, Homo sapiens
tcgttgcccaggctggagtacaattgtgtgatcttgactcactgcaacctctgcctcctgggttcaaatga

SEQ ID NO: 6786960 - DNA, 81 bp, Homo sapiens
gttttaggaaagtcatggatgaacactacttcagcatgagtctgaaagttgtgtgtgtgtgtgtgtgatgtctgtaagagc

SEQ ID NO: 6786961 - DNA, 76 bp, Homo sapiens
tcactctgttgcctaggttggaaggcagtggtgcaatctcagctcactgcagcctttatctcctgggctcaagtga

SEQ ID NO: 6786962 - DNA, 63 bp, Homo sapiens
atactacatgtatctatgtatatgtgcacacatgtttaagtgtattatgtagtatatgtgtat

SEQ ID NO: 6786963 - DNA, 69 bp, Homo sapiens
aagtcaactttggatgttagcgactgtcttgggaattctatcagagaaagaagcccattcattgtgctt

SEQ ID NO: 6786964 - DNA, 68 bp, Homo sapiens
gggaaactttgcaaggtactaactgtaagtcccatgctgtgcagtctgcctgtgcaaaggaaaatccc

SEQ ID NO: 6786965 - DNA, 63 bp, Homo sapiens
caccatgtgaatgacatattttgtactgctctacccaggtagaacataagtcattcatttgtg

SEQ ID NO: 6786966 - DNA, 68 bp, Homo sapiens
gagtagcatttgcaggctataatggaaacagttccaactgtgttcaatccctagtctcagagccactc

SEQ ID NO: 6786967 - DNA, 82 bp, Homo sapiens
atgagcttctgccaggccacacagggcactcaagtgaacaaggtatagggtgccctggggtcatggtaagaaagtgtctcat

SEQ ID NO: 6786968 - DNA, 78 bp, Homo sapiens
ggctcaatagtatttaatagttagctcaaaaggacgaataaagttctacatgggaagctgctgaactacagtcaggcc

SEQ ID NO: 6786969 - DNA, 82 bp, Homo sapiens
catgatgctgtgttactgagatccggcccctggaggagttttcttttacaatttcccctatgccatttcacacagacatttg

SEQ ID NO: 6786970 - DNA, 73 bp, Homo sapiens
gtgtggtgcgattggcttcacactgttaaaagcaaaactctcttttcacaggagatcttccaaggcaccccat

SEQ ID NO: 6786971 - DNA, 59 bp, Homo sapiens
agtgatttgttacacagtaagcgctaacaacaacaaaggcttactatgtgacaagcact

SEQ ID NO: 6786972 - DNA, 58 bp, Homo sapiens
agtgaaagccattgcagagcaggatttcgcaaattttcttcatgtatttggctccact

SEQ ID NO: 6786973 - DNA, 88 bp, Homo sapiens
tattaagcacctttgatctaggattttgaaatgtgccacattgtaaaatttattcagtgcatatattaaaaatcaaaggtgaaaaata

SEQ ID NO: 6786974 - DNA, 68 bp, Homo sapiens
ggatcttgaggggattggaaggaacaccccagtggcagtcagaagagctgggttctaatctcagatct

SEQ ID NO: 6786975 - DNA, 70 bp, Homo sapiens
cccgactagctgggattacaggcacctgccaccacgcctggctaatttttgtattcttagtagagacggg

SEQ ID NO: 6786976 - DNA, 88 bp, Homo sapiens
ggagtctcactctgttgcccaggctgaagtgcagtggtgtgatcttggctcactgcaacctctgcctcctgggttcaagcgattctcc

SEQ ID NO: 6786977 - DNA, 57 bp, Homo sapiens
gtccctcctccaaagccaattaggtccaaccaggcccagtgcatggagggagagggc

SEQ ID NO: 6786978 - DNA, 70 bp, Homo sapiens
ggagactctgagaactcaggattctgaagtgaatctacccagattttcccatcctaagtctcagagtccc

SEQ ID NO: 6786979 - DNA, 65 bp, Homo sapiens
ttctgaagtcatcagatggcagtttccatgcccatggtttttttctgccctagatggctctggaa

SEQ ID NO: 6786980 - DNA, 66 bp, Homo sapiens
gtggtggcagcacattgacccgggctcccctccggggtcttggcctttcagtgtgtcaccaagcac

SEQ ID NO: 6786981 - DNA, 56 bp, Homo sapiens
gattattcagttcccttcactctcatcacttatggggagaatgtagctgaataatt

SEQ ID NO: 6786982 - DNA, 57 bp, Homo sapiens
gccccaggctgtgcaaggccagcacacagacatatctgagccaaccacagcaggagc

SEQ ID NO: 6786983 - DNA, 91 bp, Homo sapiens
ctaagtattactaggtttgcttcctcatttctggtatttgagacctgagacttgtgaaggagatgaagggagtgagccgctaagtgcttag

SEQ ID NO: 6786984 - DNA, 96 bp, Homo sapiens
catgtttgtttttctagtgactgcttatatgttaaagatacctttatgtttacacgtgtctctcaacgtataatcagtgtctcctggaacaaattg

SEQ ID NO: 6786985 - DNA, 87 bp, Homo sapiens
tacagacgcgttcttctttttgtgttttgctttttgtctttccagataaatagtgtgtcataaagtctgagtttttttgtgtgtgta

SEQ ID NO: 6786986 - DNA, 60 bp, Homo sapiens
tttctccttgtgtctcctttgagttaggcatggaaatagctaaaggagaacaaagaggaa

SEQ ID NO: 6786987 - DNA, 87 bp, Homo sapiens
tcagaacgcgttggtaacagaagtttgggcataaggctgtctctacttttcagacacagccatgcccagattgctggctacatctga

SEQ ID NO: 6786988 - DNA, 80 bp, Homo sapiens
gctaggtcacaagctcacatcagccaatgatagctcagaatctttagctcagaaggaaacgatgccagcttgatcatagt

SEQ ID NO: 6786989 - DNA, 130 bp, Homo sapiens
gccaactgaattgggaaagagggaggggcactggtggggtgctgatggcatctgctactgacctaatgttggtaagccatctgctgctctccagtgtaacaacctcttcacctctccccatctcagtttc

SEQ ID NO: 6786990 - DNA, 82 bp, Homo sapiens
ggtttctgcatcttctcctaaggtcagaattgccactagcctatgtggcacatttgcacacattagaagacggtgcatttcc

SEQ ID NO: 6786991 - DNA, 82 bp, Homo sapiens
gccactttccattgatggaaacttgggtaagtcatagaaactctgtgagactcaaatttatcaactatattatgggaatagc

SEQ ID NO: 6786992 - DNA, 72 bp, Homo sapiens
tactgaagggcctacccagttcagtgtttaaaaactaacataggtttcagtgattttggggaggtttcagtg

SEQ ID NO: 6786993 - DNA, 68 bp, Homo sapiens
atgaccgggaacctctttgaagtgtgttgccccatgaaggttttgcttgaaaggggtttcccagtgat

SEQ ID NO: 6786994 - DNA, 56 bp, Homo sapiens
gtacacatgtatttatgtgtacatgtgtgtgagcatgtatatgtgtgcatgtgtat

SEQ ID NO: 6786995 - DNA, 85 bp, Homo sapiens
ctctctgtgaaaataggtgtgtaggtgtttgcccagagaaaagactgcgtcaaatagacttaagcatctgtacaaaaacagaggg

SEQ ID NO: 6786996 - DNA, 70 bp, Homo sapiens
agatccagatccttcctggttgcctcactacctgccttgtggcagcttggaaaccaggggggctgggttt

SEQ ID NO: 6786997 - DNA, 64 bp, Homo sapiens
tctaggttagaatggcacaaaataaggcatagttcttgtcttcaaagtgcttttaacctttaga

SEQ ID NO: 6786998 - DNA, 88 bp, Homo sapiens
atcctgagctgcttctgaggcagagggcagaccagactcctctggcacctctgcttctctgctttcctcttgatttagcagccaggat

SEQ ID NO: 6786999 - DNA, 104 bp, Homo sapiens
aggcataattgattggacactggtgactaatttaactttcagcccctcttcccttcctggaggctgaggggtgggctggaagttataaccctctaatcatgcct

SEQ ID NO: 6787000 - DNA, 68 bp, Homo sapiens
gagacttcttcccagcttccctcaccctggtgctcctcaggagaggccaaaatgagaagagaggtctc

SEQ ID NO: 6787001 - DNA, 95 bp, Homo sapiens
cattaatgcaggtgattacttgaattctcaggtaaaagttaagtggaagtacttgaattaggccttgagagatgaaaaggatctatctattaatg

SEQ ID NO: 6787002 - DNA, 60 bp, Homo sapiens
gggctcttttcacagtccaaaatgatttggcttaaacgtttccaactgtgatgaggtccc

SEQ ID NO: 6787003 - DNA, 78 bp, Homo sapiens
ctgcttgacattctggaaagggtcctcattctgtcttgttcagggataacgaacaccttttcccagcaggtgaagcag

SEQ ID NO: 6787004 - DNA, 61 bp, Homo sapiens
gctttaatgcttcgtggggccaaagggatcccagcttacccttcagcgagggcattaaggt

SEQ ID NO: 6787005 - DNA, 64 bp, Homo sapiens
cggcctggagtcttaggttatggtgagcccagtgttgggttttactgtggcaggcccagtgttg

SEQ ID NO: 6787006 - DNA, 130 bp, Homo sapiens
cctactctgtaaccctgcttttcgtttcctgtgtgtcctttcagagctccttttgctttcaaaagcaaatacaaatacgggcagcttctgaatggatggccaagtgactctggagcttccgcgctgtgtg

SEQ ID NO: 6787007 - DNA, 64 bp, Homo sapiens
cttcaggtgagcaggagataaacaggtaggattcaaggcttaccagtctgattcctgttagaag

SEQ ID NO: 6787008 - DNA, 56 bp, Homo sapiens
atgaaatgagtcaatgcgactaggctgaaagattgttttctgcttgactatttcat

SEQ ID NO: 6787009 - DNA, 60 bp, Homo sapiens
acatgctctcctaaggccctgtgctcctgtttggagccacaaaagcttttggagggttgt

SEQ ID NO: 6787010 - DNA, 75 bp, Homo sapiens
gaaggctgcagttctcaatttctattgatcataatttctatacatttatggaatggagaaagtctgcagctcttc

SEQ ID NO: 6787011 - DNA, 83 bp, Homo sapiens
gtccagggtgagggctcagagcaggcccactgccctcccagtccagggtgagggctcagggctggcttatcctcacaacagac

SEQ ID NO: 6787012 - DNA, 68 bp, Homo sapiens
tgcatacataaagtgctatcatgtgatctgtggttgtagcagctatttatagcagcttttattgtgta

SEQ ID NO: 6787013 - DNA, 71 bp, Homo sapiens
ggcacagctgctggggccgcaggctggagccagcgttgtgattggatccagctgctgacccagtagccgcc

SEQ ID NO: 6787014 - DNA, 99 bp, Homo sapiens
tctctatccagatgctatattgttgattgatatactataatacacttcctcaggacagatgttacagtatgatctctataatgttaacagaaatggaga

SEQ ID NO: 6787015 - DNA, 61 bp, Homo sapiens
ttgaaatgccgtgtttcttacgttcaacttctgttgcacgtacatgtcagggtaacttcag

SEQ ID NO: 6787016 - DNA, 109 bp, Homo sapiens
gcatttcatggatttactacttgacattgaatttgaatgtatgttgcaatatggcccaacaattatttaaatttatgtagatgagccttgtaaagataatataaaatgt

SEQ ID NO: 6787017 - DNA, 91 bp, Homo sapiens
gatattggtgttaaacagtactcgatttttgtagcctacttcacctgtggagttttatgaagaactgagtctgtcacctcagcactatttc

SEQ ID NO: 6787018 - DNA, 71 bp, Homo sapiens
ctttacagtgaacttgcttgtcaaatgcctctttaaaaagaaagtgaagataactgcaagtcagctggaag

SEQ ID NO: 6787019 - DNA, 88 bp, Homo sapiens
agcggtagtgatctggcttgaaggggcagtaacaagacatgcccaggtactgggcctgcttctcagtcagcttggtcaacttcatgtt

SEQ ID NO: 6787020 - DNA, 81 bp, Homo sapiens
gccttcatctgttcaacaagtcttttttcactgccttggaatacagcagcgaccagactgtgaacttgaggataagaaggc

SEQ ID NO: 6787021 - DNA, 110 bp, Homo sapiens
tccaattatacatatgcttaaattgcattagctaatggtgaagattcagacttttctaagttttgatttgtctattatttaatttgaattattgatatgatgacattgga

SEQ ID NO: 6787022 - DNA, 55 bp, Homo sapiens
ggcaaaaagttcccatcagtgtatctggatgaaggctatactagagctctttgcc

SEQ ID NO: 6787023 - DNA, 64 bp, Homo sapiens
aatgcaagtcaatgctatacccagagatgttctatcagtccctgatgtagtttggctatgcgtt

SEQ ID NO: 6787024 - DNA, 66 bp, Homo sapiens
ccagagtcaattactattttgtatttacctctcagtagataataagtctggtaataatgagtttgg

SEQ ID NO: 6787025 - DNA, 86 bp, Homo sapiens
tcagaagatcttgttcccattccttgttctttaaatgtttcaaaaatcacagaactgaaggaagcagaagcgaggtttcatgctga

SEQ ID NO: 6787026 - DNA, 64 bp, Homo sapiens
ctcgaggctttaggtcttggtttgaatccagactagaaaatcattacttattaaaagccttgag

SEQ ID NO: 6787027 - DNA, 63 bp, Homo sapiens
tgcagcatatagcttagtgatggcagaaggtaaatatttaggcagcacaagctgttgattgca

SEQ ID NO: 6787028 - DNA, 87 bp, Homo sapiens
gtccacagagatcagcagtgttgtgatccaggtcttctattttaagggacatatataagacagatgcaacctgctagctatggagac

SEQ ID NO: 6787029 - DNA, 129 bp, Homo sapiens
ggcttgaagaaaaagaagaggatagtggcatccagccagtgtggatgacttctagtggaccagaagtaccttctgccatgctccttgggtgaaggccatcatatcttcctcctctcatgcttctctgcc

SEQ ID NO: 6787030 - DNA, 67 bp, Homo sapiens
agcctgacaggatagtaggaagatctttattcaactttacagactctgttgaactattttgggggct

SEQ ID NO: 6787031 - DNA, 59 bp, Homo sapiens
gccgttcttggtagttctgagagctgtcagaacattcaaagagctgccagaactgaggc

SEQ ID NO: 6787032 - DNA, 66 bp, Homo sapiens
cctcacaagagtcataaggtgagtagcggtgggcaaatccatccccctcatcttagatttatgggg

SEQ ID NO: 6787033 - DNA, 55 bp, Homo sapiens
aagctttgactactgcctcttggatgtcatcctgaaagctggcaggtcatagctt

SEQ ID NO: 6787034 - DNA, 55 bp, Homo sapiens
tacctggtatcttccctgtcacaaggaagctgaacagggctctgacaccaaggta

SEQ ID NO: 6787035 - DNA, 130 bp, Homo sapiens
attccccagcctaacatggtgtttggctcactgtagatgctcaagaattggttgttggattgggtaccccattcagcaacatttgttgagtgcctagaatgcgctttgcactgtgctggagtctggtgat

SEQ ID NO: 6787036 - DNA, 81 bp, Homo sapiens
gcccaggctggagtgcagttgcatgatctcacctcactgttacctctgtgtcccgggttcaagcaattctcctgcctcggc

SEQ ID NO: 6787037 - DNA, 73 bp, Homo sapiens
gcagcagaggaaagcaaatctaaaacaacacaaaaggtaatagttgtttacttggtcaagctgtcttctttgc

SEQ ID NO: 6787038 - DNA, 55 bp, Homo sapiens
ctgtctgtttggggacctgtggccaaggggaccctggcccgggacaagcaggcag

SEQ ID NO: 6787039 - DNA, 126 bp, Homo sapiens
atgaaagtggttaagggttggacagaggaggcagaaatagattgctctagaaggaaagagaaatgttgtattttcccagagagacgcagatttatttcagttttagtatctcttattcaaattcat

SEQ ID NO: 6787040 - DNA, 55 bp, Homo sapiens
agccagtttgcttgtaataacatttttggcaatttgttattgcgtaagactcgct

SEQ ID NO: 6787041 - DNA, 56 bp, Homo sapiens
gtggccatgtgcttgcagggtatcgcatagcccggatgcccatgccccttggccac

SEQ ID NO: 6787042 - DNA, 59 bp, Homo sapiens
ttgctgcccttttcacctttgttgctctgcacaggacaatggagggaccagggaagcag

SEQ ID NO: 6787043 - DNA, 60 bp, Homo sapiens
acacagccagggtagtaaggctagacctaacccctgcccaactgacaccactgcttgtgt

SEQ ID NO: 6787044 - DNA, 66 bp, Homo sapiens
agcaagacctctacgtgcgtctcatcgactccatgtccaaacaggtgagtcagcgcagagggtgct

SEQ ID NO: 6787045 - DNA, 61 bp, Homo sapiens
tcttttgtgattcttcacttgcttcaggccaactggacataaaggtgcaggtcacagggga

SEQ ID NO: 6787046 - DNA, 55 bp, Homo sapiens
catttgtctttgagtgccctgctctttccactgaagagcccacagaacacagatg

SEQ ID NO: 6787047 - DNA, 78 bp, Homo sapiens
ctgattcttagcatggtctggaattctcagcctctttttacaggggttgtctttcagcactgtgctcattcatatcag

SEQ ID NO: 6787048 - DNA, 65 bp, Homo sapiens
actgtgtattcaagccgaagtcaactgcctttccttcccaggtgttgatttagtgagtgagcagt

SEQ ID NO: 6787049 - DNA, 62 bp, Homo sapiens
gtcctgttggtgaatggctcttttacataattgcaggagctatttcaaagccagccaagggc

SEQ ID NO: 6787050 - DNA, 84 bp, Homo sapiens
catctgttcctggcacctgcaggatgagccagggccttttacagcgaaggcctttgttttaatgcattgctacaagattggatg

SEQ ID NO: 6787051 - DNA, 114 bp, Homo sapiens
ccagacagatgggatatgtttgcaggcatggatctggaatcattccctttccgggactgtttctagtcctccattcacttctgccttctcacctactctatccctctagtttgg

SEQ ID NO: 6787052 - DNA, 72 bp, Homo sapiens
gatactagtgagtgttttagttatatgtatggatttttgctatccgtacagctacaaaaccttatttttatt

SEQ ID NO: 6787053 - DNA, 59 bp, Homo sapiens
gggagctggcctactattagatagatttgaaattggtattcacgagtagactagtttcc

SEQ ID NO: 6787054 - DNA, 71 bp, Homo sapiens
ccagtttcaggagtctgattcttttgcttgctaggcagaaaaagaaagtggatttgtctgctgaaacctgg

SEQ ID NO: 6787055 - DNA, 60 bp, Homo sapiens
cagagctcaaagcaagtgtggattggggttgtttataggtgcagttttgcttgatctctg

SEQ ID NO: 6787056 - DNA, 88 bp, Homo sapiens
gggcagatcataaaatgttcgaagtcaggacaagctggtgagactgactcacacactgtaaggactatcactgaacatttttctgtcc

SEQ ID NO: 6787057 - DNA, 89 bp, Homo sapiens
ttatgacaaacatggcagcaagtaggattcttatttttaacaatatgaacaaaattaaaagtcgataccttgtgtacagtttggagtaa

SEQ ID NO: 6787058 - DNA, 87 bp, Homo sapiens
tttccagaataaaactgtaagtttgaggggaaagtggatatttggtctcagtttccaccttcactttcactttaaatagcctggaag

SEQ ID NO: 6787059 - DNA, 57 bp, Homo sapiens
cggcacagggtaaacgttacccgcctcagtttctgtttgtctgtccaccctgtgctg

SEQ ID NO: 6787060 - DNA, 63 bp, Homo sapiens
cgcgggaggccggagcgtgaggactgagggccgcgtggccatcctccttctccggccaccccg

SEQ ID NO: 6787061 - DNA, 117 bp, Homo sapiens
gtatggtgtgtgctaagttttgcatttctttgcatgttgggctcatcctctccaaaaagatactttggggaagatggcccacatgtagttgcagcttatgttgtgcttacacctcac

SEQ ID NO: 6787062 - DNA, 56 bp, Homo sapiens
cccaggctagagtgcagtggcgcgatcttgattcactgcaagctctgccttccggg

SEQ ID NO: 6787063 - DNA, 101 bp, Homo sapiens
tatgtatgcaagcttacaggtgccacatgtgtgctgaggactgtgggtaactcatgtagcagccacatatgtatactgcaatgtgacatgtttgatgcata

SEQ ID NO: 6787064 - DNA, 66 bp, Homo sapiens
gtaaatgtcctaatttatggaacggtgctgataatttattgtgttgaccttatcaagggcatttgc

SEQ ID NO: 6787065 - DNA, 58 bp, Homo sapiens
aggagcctattattagcatggcatcttcatttgtggctgcttctagaattaggctctt

SEQ ID NO: 6787066 - DNA, 83 bp, Homo sapiens
tcatccggtttcagtctctgtctctggtattaggtgaaaagacatctttttccctgctgctgagactgtatgtaattagatga

SEQ ID NO: 6787067 - DNA, 60 bp, Homo sapiens
tatatccccatcctttgccatgtggatttacattcccttctaccaaaggagtggggtata

SEQ ID NO: 6787068 - DNA, 67 bp, Homo sapiens
gtcaatgcaataggcaaatttcagaagtggaaataacagaatccactctggttagtttaagcatgac

SEQ ID NO: 6787069 - DNA, 60 bp, Homo sapiens
aaccagatgctttgtggagttaaagttgacatttatttaaatgccacttggtgtctggtt

SEQ ID NO: 6787070 - DNA, 65 bp, Homo sapiens
ctgaaccccatgtatctgtttttacagtgtcttttaatgaaagatataatacggacacagttcag

SEQ ID NO: 6787071 - DNA, 95 bp, Homo sapiens
atgagaaggaggtcttctttgaatcatagtgaccaataggctgaaaggaattgacatgcccaggagcaccccagatcagagaacctccttgttat

SEQ ID NO: 6787072 - DNA, 55 bp, Homo sapiens
gagggtcttctgcaaatgcacactgataacaggaccaggcagcagagagaccctc

SEQ ID NO: 6787073 - DNA, 59 bp, Homo sapiens
ggcctagggatgatgtctaaaatcatgccacaagatgtggtaacatcagaaccctggct

SEQ ID NO: 6787074 - DNA, 56 bp, Homo sapiens
accaggtaatttaatgtagaggcacagccgctttgttcattagcattggccttggt

SEQ ID NO: 6787075 - DNA, 57 bp, Homo sapiens
aggacacagttacttattttgcctgcttgaaggtaaccattcagagattgctgtctt

SEQ ID NO: 6787076 - DNA, 66 bp, Homo sapiens
acagaggtgttccagacctagggagctttctaacaaagtcatggaagcaggtagggataccattgt

SEQ ID NO: 6787077 - DNA, 68 bp, Homo sapiens
ttctcctactccataagagccaagcagcagttcctcttgagctgtgtgcactgccttttgtggaagaa

SEQ ID NO: 6787078 - DNA, 60 bp, Homo sapiens
ggcttggctacaagccatgggcaattcctctgtcctctgcccaacaggagtgatcaggcc

SEQ ID NO: 6787079 - DNA, 86 bp, Homo sapiens
tttgccttcattctcccagaagtaaaacttgtcttattttggcaagctttaagattaagtcctagctttggtaggaatgaaacaaa

SEQ ID NO: 6787080 - DNA, 61 bp, Homo sapiens
tctgccttggaaatttcaacagcgtgcattctaggcagccaacatgaaagaatcagggaga

SEQ ID NO: 6787081 - DNA, 114 bp, Homo sapiens
tttctctttcacttaatgctcccatgaccctggcagataccgtcacaatctgcgtggactgtgaggctacctgccagggtcatgggagcatacagaatgtaaggcttggagaag

SEQ ID NO: 6787082 - DNA, 79 bp, Homo sapiens
tgctttctgctttgggaagaggaatctctggaaagcttcatccaattcacaagaattctagctctgcccaaggcaggca

SEQ ID NO: 6787083 - DNA, 64 bp, Homo sapiens
ctcacagccctcagcacaggtcacgtcccagcccagctctgggactttggttcagggctcagag

SEQ ID NO: 6787084 - DNA, 61 bp, Homo sapiens
ctgccgtctttgtcagccattgtgggtcagaattgtccacagaggcttaaatgagtggcag

SEQ ID NO: 6787085 - DNA, 80 bp, Homo sapiens
gaataatatttatatgtttatttgtaatatgtgtatatatgtatatgtatttgcgtatggacatacatggtaaattattt

SEQ ID NO: 6787086 - DNA, 64 bp, Homo sapiens
ccttgaagaagagttggtgaattaaggaaatgttctcaatgagtcactatcactttctctgagg

SEQ ID NO: 6787087 - DNA, 55 bp, Homo sapiens
gaccttagggcagaggtggtgacctccaccaccaccaccctctccccactgggtc

SEQ ID NO: 6787088 - DNA, 60 bp, Homo sapiens
gcctctgccctcgaggagcttgtgttctcccaggagacacaggcagtgaggctagagtgc

SEQ ID NO: 6787089 - DNA, 64 bp, Homo sapiens
ccatcagcagtttgaaatgaggcatagtctggaatcgtttgccataatttgatatgcttgatgg

SEQ ID NO: 6787090 - DNA, 57 bp, Homo sapiens
ggcatgcatcaccacgccacgctgtgttttgcagaaaagggttttggcatgtgtgcc

SEQ ID NO: 6787091 - DNA, 69 bp, Homo sapiens
gtctgttcagtaagtcagtcatttttgagccatcatgattttcattccttttctgatttattagcagac

SEQ ID NO: 6787092 - DNA, 93 bp, Homo sapiens
acggcaggtaggaaggcgggagctggaggcagtgctgaggtctcggtgtcagggggcaggactcacctactagcagcacttcttactagctgt

SEQ ID NO: 6787093 - DNA, 87 bp, Homo sapiens
gaggcctcagagaaatcctggcctagctgggctcagaggagccccgcctccctgagagctaaacctgggctaggaccctgaaacctc

SEQ ID NO: 6787094 - DNA, 74 bp, Homo sapiens
ccaccctacaaaagcaactaaggcaaggaaatgcaaagaattcaggtatgttcttggactaagttgttgggggg

SEQ ID NO: 6787095 - DNA, 64 bp, Homo sapiens
tacactggattagctgtcctacagcttattgttggtgaagcaaaggaaaactgattatagtgta

SEQ ID NO: 6787096 - DNA, 69 bp, Homo sapiens
gttgtggtttgtgtgctaggtctgaatcagtcgtccttcagaccagggggagcacagagagtctatagc

SEQ ID NO: 6787097 - DNA, 76 bp, Homo sapiens
gcataacttagtgtcagcatctcattgagctaggcatctcattgtggcttataatgttctgtgacactgtcggtgt

SEQ ID NO: 6787098 - DNA, 82 bp, Homo sapiens
ttggaagaatatgggggtacagaagttctaacctaacaatccaggtcaagtcaataaatctgactcccatattccacttcaa

SEQ ID NO: 6787099 - DNA, 60 bp, Homo sapiens
ctgggtcagtctgtccctagggccctctgaggcctctacccaaacaacaggactgcccag

SEQ ID NO: 6787100 - DNA, 56 bp, Homo sapiens
agttgcagtcaagatgtcagatggaactatggtcatctgaaggcttgactggggct

SEQ ID NO: 6787101 - DNA, 56 bp, Homo sapiens
cccaggcgggagtgctgtggcgcgatctccgctcactgcaagctctgccttccggg

SEQ ID NO: 6787102 - DNA, 76 bp, Homo sapiens
tcaggctgggcaattcaggatcaagttgccagtagatttggtgtctgctgatggctgttttctgcttccagaatgg

SEQ ID NO: 6787103 - DNA, 59 bp, Homo sapiens
ctttgggcactgaagtatgggtgaggtgctctgattcatgatccttccggtgcccacag

SEQ ID NO: 6787104 - DNA, 109 bp, Homo sapiens
aaattgtgggtgtcgataaatgtttactgttgtttcaaaccactcagttttggagtaatttattatgcagcaatagataaaacatttaccagtttatcacatacagttt

SEQ ID NO: 6787105 - DNA, 67 bp, Homo sapiens
tgctctttggttggttcctgatgcctgaagtctttttcttctgtgtacagttagccaccaaattgta

SEQ ID NO: 6787106 - DNA, 59 bp, Homo sapiens
gtagggactgttctcacctgagcttctccagggctgaagctgggtgtgaccatctctgc

SEQ ID NO: 6787107 - DNA, 73 bp, Homo sapiens
gctctgagatgagaatgatcctatatttggtttaataccctgatgtcaccatcttcacatctcaacaagatgc

SEQ ID NO: 6787108 - DNA, 91 bp, Homo sapiens
tacccacaaaatatccaattagagaagcttcttccattttagagagactgcttggtaaatggagacttcaaaatggatttgtgtgcaggta

SEQ ID NO: 6787109 - DNA, 66 bp, Homo sapiens
gtcagatccaaactggcaccatatgggtggccacctgtatgacattttgccagcattgcattgaac

SEQ ID NO: 6787110 - DNA, 58 bp, Homo sapiens
aaatagcagctttgacagcacagcttctgctaggctatgatagttaatattgctgttt

SEQ ID NO: 6787111 - DNA, 96 bp, Homo sapiens
gtcatggaagggagtctggactttatcccaaggttaggagggagccgttgatgggttttaaaccggggagtgatgtggtttagcttccttggtggc

SEQ ID NO: 6787112 - DNA, 95 bp, Homo sapiens
caggccaccgagccgttttaatgaggtctctcgctggccagcccgtggctttcagaggccttgagagacccggagagagggttccctggtgcctg

SEQ ID NO: 6787113 - DNA, 61 bp, Homo sapiens
gatgagagacgaggcagccatggagaggagactgcagctgcctggcttcctgactctcatc

SEQ ID NO: 6787114 - DNA, 70 bp, Homo sapiens
cgccctaagggaagatgctgggtgattgccacgcctccctctgagctcctggcttcattctcttagggtg

SEQ ID NO: 6787115 - DNA, 128 bp, Homo sapiens
aggtggactctaggggacgctcacttggaacttgcatcacccggaactgtgtctgccactgtgacttcagagcagcacagacctgaggtggatccagcaatgcccacaactgtccaacaatttcactt

SEQ ID NO: 6787116 - DNA, 85 bp, Homo sapiens
ccagctggtcccttctgatctcagctgcctctccctggaagatgtagatcttcttgtgctgggccagcttcagtggggctactgg

SEQ ID NO: 6787117 - DNA, 118 bp, Homo sapiens
tgatacggtgttctcagtttccattgctcattgaattgattcttctgaatttgcagataatgttccatgctgactttctgcacccatcgaggagtcagttagctgggacaatgtatca

SEQ ID NO: 6787118 - DNA, 66 bp, Homo sapiens
tggatgccaagttgacaaggggtggacttatgatggttaattttatgtgtcagcttggctgggcca

SEQ ID NO: 6787119 - DNA, 62 bp, Homo sapiens
cttgggatgtcacggcagatgtatcaaactacaaaaacggtacactgacaaccatccacgag

SEQ ID NO: 6787120 - DNA, 58 bp, Homo sapiens
gctgctttatgatatcatcatatgatctgaatagatagtatgaagatatgtgaacagc

SEQ ID NO: 6787121 - DNA, 69 bp, Homo sapiens
gctgattttcagtctggctggacccagagttctgtatttttaacgagtccaggtgactgagagatgagc

SEQ ID NO: 6787122 - DNA, 67 bp, Homo sapiens
ttgatgttaatctgggagagtctgtgctgaaaagcagaagcacattgacttggatgggtagcatcaa

SEQ ID NO: 6787123 - DNA, 62 bp, Homo sapiens
gtcttcccagtctgataagccaattggcatccaggtgttaatggctgatgaggctactagac

SEQ ID NO: 6787124 - DNA, 58 bp, Homo sapiens
tgagggagagtgaatgagtgcatcattggttgattctgtacacatttattctctctca

SEQ ID NO: 6787125 - DNA, 84 bp, Homo sapiens
acttttaaattataaaattctctactgtgctaaatttcggagggaaatgaagcagcaaaagagaatagtttgtggtcaaagagt

SEQ ID NO: 6787126 - DNA, 87 bp, Homo sapiens
ggaagaagagcttgtagtataacaatgtgaagacttgctggattttcctagatgtcaaggcaacatgtagtactgaagacttctacc

SEQ ID NO: 6787127 - DNA, 59 bp, Homo sapiens
taacctttggtgaaatattaacttactgtaccatgcattgataatgtccccagaggtta

SEQ ID NO: 6787128 - DNA, 64 bp, Homo sapiens
ccgccagagcctgccacctttctccctgctgcttgcggtgaggtcctgagaggcttgtgggtgg

SEQ ID NO: 6787129 - DNA, 67 bp, Homo sapiens
cttgtgaggcacttaacctactaactgaaatgccattcattcagccagtatttgagtgctcagcaag

SEQ ID NO: 6787130 - DNA, 88 bp, Homo sapiens
ggtttttgccatggctcaatagcttccaaggcatgtcttcagtaggagaatatctaggcattttgtgaagttgaaccagccgggtacc

SEQ ID NO: 6787131 - DNA, 62 bp, Homo sapiens
cctagtttttcacttgtgctgtgagagacactgagtctcactataagtcactaaaagctggg

SEQ ID NO: 6787132 - DNA, 79 bp, Homo sapiens
agtctatgaaattttttctcttgttaatgtactgaaagttgtatctcattcagtttcacttgaagaaaagacatggact

SEQ ID NO: 6787133 - DNA, 57 bp, Homo sapiens
ggggcccgggcactggccgtcagcccccagggccgcattacggctacctcgggcccc

SEQ ID NO: 6787134 - DNA, 56 bp, Homo sapiens
cccaggaggcggaggttgtggtgagccgagattgcaccactgcactccagcctggg

SEQ ID NO: 6787135 - DNA, 66 bp, Homo sapiens
gagggagagagtcctggaggcaaatgaagactcctggtggggagatcatcagccccaggggacctt

SEQ ID NO: 6787136 - DNA, 96 bp, Homo sapiens
gctgtgtgtctgtaaaatgactgacagtggtactgtaattaaaaaatatatatttatgtaaatatagtgacacttatagtctggcggatggattgc

SEQ ID NO: 6787137 - DNA, 87 bp, Homo sapiens
agatgtgcctctcatttgtgaaggctgtgtagaggacaatgatcccatgaaccttactcgcatgcttacacacaaacagagccattt

SEQ ID NO: 6787138 - DNA, 55 bp, Homo sapiens
gagtgattttgtcagcttctgcagactggatggatctgcagactacaaaaaactc

SEQ ID NO: 6787139 - DNA, 78 bp, Homo sapiens
tcccggtgtgcagcgatctcccgagagttggcgcagggccacttggctgcagagaacgtgtgcaccttcagtccggga

SEQ ID NO: 6787140 - DNA, 60 bp, Homo sapiens
ttttggaggaggatgcatttgttgtttgatggagtctacgaccttgccctcattccaaag

SEQ ID NO: 6787141 - DNA, 73 bp, Homo sapiens
atggaatactaagcccaagaacacatggtctgaccttgaaccctggttctgatctgcttctgagttattctat

SEQ ID NO: 6787142 - DNA, 86 bp, Homo sapiens
agggagggccggaggaggactgggaggcaccgcgtcgtgctcgcgagagaacagaaatgcgcttcccccagctttggcgccttgct

SEQ ID NO: 6787143 - DNA, 106 bp, Homo sapiens
ggaccaacaacctgtccccttctttcacatgtttgtgtttgctatgcggtgccagatcctgcactgggtggtggagatacaacggtaaataagacagctaaggtcc

SEQ ID NO: 6787144 - DNA, 78 bp, Homo sapiens
gtctctcagctctgctgttcttagcatgtgcctctcatgctccaggtcacatcacggtccagcacggctggtagaggc

SEQ ID NO: 6787145 - DNA, 64 bp, Homo sapiens
tgttaggaaggaagctcgatatttccttttaagaaaggaagttataaacttttcctcccagaca

SEQ ID NO: 6787146 - DNA, 68 bp, Homo sapiens
gtggccatctgctggggctgcagagctgttctactctagagtgccatgtagtccagcagaacagacac

SEQ ID NO: 6787147 - DNA, 67 bp, Homo sapiens
tctttctctatctgttcatctggaaacatactttgttttctctctatttagacaggtatggataagg

SEQ ID NO: 6787148 - DNA, 58 bp, Homo sapiens
ccagagagagtagaagtttccaagggcttgtgtgccaagcattctgcttctttcctgg

SEQ ID NO: 6787149 - DNA, 59 bp, Homo sapiens
ctctggttcatcgacctgactgctgattgaaagagctgacagtggtagatgagcaggag

SEQ ID NO: 6787150 - DNA, 97 bp, Homo sapiens
gtcttcattcttcaagggccactttacagggacatggaacaggctccactaaagtggtgtcctcttattgctcttggccctgaggacatatgaagat

SEQ ID NO: 6787151 - DNA, 80 bp, Homo sapiens
ggacctgcaggcttcgtgtctctggctcttgggaaacaggtggaaacttccttcccgagagccggaagcagccgcaggcc

SEQ ID NO: 6787152 - DNA, 62 bp, Homo sapiens
cagtatattctgcagagccttaaggaacataagagccaggctgaggagttgctgaaatactg

SEQ ID NO: 6787153 - DNA, 65 bp, Homo sapiens
ggctgccctatgcggtgggagctggggtgcccagagcctcaatgcccaccccataaggcagaacc

SEQ ID NO: 6787154 - DNA, 72 bp, Homo sapiens
gggcgagggaaaggggaatactggttggggctggaagtacggctgaggcagtccacccttgtgctcttgccc

SEQ ID NO: 6787155 - DNA, 55 bp, Homo sapiens
caggcctcaccagcggagctgcgagaggtctttccagagcttgctgagaggcctg

SEQ ID NO: 6787156 - DNA, 99 bp, Homo sapiens
gcataggttgtagaagtgtatgtcttaatccttccttaggaaagtcttaatccttgcttaagaaagcttatgatattactgataaggcaaggcttatgc

SEQ ID NO: 6787157 - DNA, 68 bp, Homo sapiens
ctgtcacccaggctggtgcgcagtggcatgatcacagctcactgcaacctcagcctcctgggctcaag

SEQ ID NO: 6787158 - DNA, 67 bp, Homo sapiens
ggttgatgtattaaggttgggtttcctgcttaggtatctctgaaacagtattctcaacctttcagct

SEQ ID NO: 6787159 - DNA, 57 bp, Homo sapiens
tgatagtatctgattatttcacagttagttttgggaataatattacagatacagtca

SEQ ID NO: 6787160 - DNA, 70 bp, Homo sapiens
ccttcctggagcccatgcagatagcctccaaaacacaaagcagccatctgcttcctgggctccatgacgg

SEQ ID NO: 6787161 - DNA, 62 bp, Homo sapiens
gaaaatagcacttatagatttggtctctagtaccaagagagctgaattcaagtgctggcttc

SEQ ID NO: 6787162 - DNA, 94 bp, Homo sapiens
cagtagaagtgaattaatattatatgtgctacatggtagtgtagttatgatactcataattttgtattgccattgtagatattttcttctagtg

SEQ ID NO: 6787163 - DNA, 56 bp, Homo sapiens
atatgaacatgacgatgatggtagctttcattgctaccatcttccatgcattatat

SEQ ID NO: 6787164 - DNA, 81 bp, Homo sapiens
ttgagccttgggacagaaaaggagaagataactgtgaatggaaagtatatcattctcctggttctggccacaggtgctcaa

SEQ ID NO: 6787165 - DNA, 58 bp, Homo sapiens
cactgtggtgccaaacctggagttctcaaatctccaaggttccaagaaatcatcagtg

SEQ ID NO: 6787166 - DNA, 71 bp, Homo sapiens
ctacttttcctggaaacaaggactttgaacatgagccccgtgttcaatagagccttctttcaggtggatgg

SEQ ID NO: 6787167 - DNA, 83 bp, Homo sapiens
agcagggaattgcatatgggggaccctggaggctgcttggtatcacagccatctcatggatccccctgtatagcaatcaagct

SEQ ID NO: 6787168 - DNA, 60 bp, Homo sapiens
ctttgaattgccgtttcatctgcaggaatgctactcctgtttcatgaaaccagattaaag

SEQ ID NO: 6787169 - DNA, 79 bp, Homo sapiens
acgattatactaatagctattatattgaaaagttactatatgtctggcaatatgcaagctattaagtatgtttaattgt

SEQ ID NO: 6787170 - DNA, 74 bp, Homo sapiens
gagtttatgatgttgttatattctggggattgatgtaagcattttaccaggacttattatagcattataagctt

SEQ ID NO: 6787171 - DNA, 57 bp, Homo sapiens
ggtgcagatctttctcttcaggggcccagcagtgacttcattgaggaagatctggcc

SEQ ID NO: 6787172 - DNA, 87 bp, Homo sapiens
gagttttactcttgtcaccgaggctggagtgcagtggcacgatctcagctcactgcaacctctgcctcccaggttcaagtgattctc

SEQ ID NO: 6787173 - DNA, 125 bp, Homo sapiens
tggtaaccagagctccactaatcaaacttctggctctgcccttaggaaggctcaccaagtgcttgtgggcagtcttattgggcctgtagtcgatttctttgatcagtctggacttgtaaagacca

SEQ ID NO: 6787174 - DNA, 72 bp, Homo sapiens
gaggctgatggtccagactttgacctctcagaaagtgctgggctgcctgagaggggtctggatgttcggctc

SEQ ID NO: 6787175 - DNA, 88 bp, Homo sapiens
ggagtggatgaaggcaacaaaagtcaaatataggttttaagtggaaactaagaatgttcaacgcttttttgctcttttatctttctcc

SEQ ID NO: 6787176 - DNA, 71 bp, Homo sapiens
gttaaaggatcaagtgccaggcaggaaatacagctcctcccagctccagcctgaaatgcctcatcctgaac

SEQ ID NO: 6787177 - DNA, 127 bp, Homo sapiens
atgcaaatagactttgatccatgacttttcttccactggccatgacctgtgattaaattccagcataaaagggcatagcacaatatcatgtctgtgaggagtaaagccatgcattaaagggctgcat

SEQ ID NO: 6787178 - DNA, 58 bp, Homo sapiens
gggacagtgaggcacggggtttgggagccggttccgcatccgtgccttgtactgtgct

SEQ ID NO: 6787179 - DNA, 82 bp, Homo sapiens
gctggcctttcatgttcccacactacacggttgttggctcaggactgcacccaggggcctgtgaaggtgcccaagggccggc

SEQ ID NO: 6787180 - DNA, 68 bp, Homo sapiens
gctctgttctaagcattctatgtggattaactcattgaatcctcgtaggaactcttttagaaatatgc

SEQ ID NO: 6787181 - DNA, 86 bp, Homo sapiens
ttgtcatttatggcctgaaaaacacactggaccaatttaactaaaaattgtaaattgtggccatttgtgtttctatgagtatgcaa

SEQ ID NO: 6787182 - DNA, 61 bp, Homo sapiens
ggagcccttgcaaggtgtggtggcccatggtatgtgtgcctctaaatgttggaggggcttc

SEQ ID NO: 6787183 - DNA, 90 bp, Homo sapiens
gctgtagtttttaatgtagtgcttcattaatattattaatattgttgttatacacgtttatggagctactaggaagttgatgagcacagc

SEQ ID NO: 6787184 - DNA, 69 bp, Homo sapiens
gagtttcaccatcagacaagttgatgtacctggggtcaagttttagttctgttattgtctgtgaaactt

SEQ ID NO: 6787185 - DNA, 68 bp, Homo sapiens
accacacgcaagacttttagaggcttttgtatcccctgaaagctctcttcccgtgagtgttgcatggt

SEQ ID NO: 6787186 - DNA, 71 bp, Homo sapiens
gttttcaaagcaaatccttctgcgaccaggttgctaaaacctaagcaatcctcagaggctttgctgatcac

SEQ ID NO: 6787187 - DNA, 73 bp, Homo sapiens
ctgagtttcttcccaatagattaaaatgattttaaaataggtcgttgaaatgtttactggggcaaatgctcag

SEQ ID NO: 6787188 - DNA, 60 bp, Homo sapiens
gaaaagagagtaattgctagttctggacaactctccagttcctggttccattcttctttc

SEQ ID NO: 6787189 - DNA, 96 bp, Homo sapiens
gtgacatgttacatatatttactgtgtaaggggaatgttgggtggtttaatagatacagttaattgaaatgatcctgcatagtctgtagcatgcac

SEQ ID NO: 6787190 - DNA, 94 bp, Homo sapiens
gtggagattgttaacccatcactttacagctaaggttgttacattttctgagactgctttggtttgtaaatgtaacattttgtcatatttctac

SEQ ID NO: 6787191 - DNA, 75 bp, Homo sapiens
caacacagtgtctgtgcttcagtgttcctcttatcaggaaggataatatgtgtgatgcatggactaactctaatg

SEQ ID NO: 6787192 - DNA, 97 bp, Homo sapiens
tgcttcctgcctgtttttgttgcagagaggccactttcgctttttagtattatttagtctaagtcgcactgtttagcaataagacaggcacgttgca

SEQ ID NO: 6787193 - DNA, 90 bp, Homo sapiens
tttcccctgacacacagatttagcaagcttaccattggccccttgggtcatccccaaaccagagctttaaaaatctgtggttacctgaga

SEQ ID NO: 6787194 - DNA, 89 bp, Homo sapiens
gaaagggagccgaaatacttaaaatctcaaacaatgcacaaaatcctcttttgtgactgtggacttttgtggggtttttgctttttttt

SEQ ID NO: 6787195 - DNA, 59 bp, Homo sapiens
tttatgatcttctgtctaatcatgttatcagagatgactgtgcaagcagagagcataaa

SEQ ID NO: 6787196 - DNA, 77 bp, Homo sapiens
tgggatgagaagatcttggtgtatttaacacataagctttgttagaaatcacctctgaagatcatttcattttctca

SEQ ID NO: 6787197 - DNA, 59 bp, Homo sapiens
agtgtattcagaatgtagcaaaattgacaggaagtagagcttatgattctgaatgcact

SEQ ID NO: 6787198 - DNA, 95 bp, Homo sapiens
accagccatcatgctcatgtccgggatctcagtcctctggggaaggtgaggtggcttttcctcagccaaggctgggatcctcagtgggtgctggt

SEQ ID NO: 6787199 - DNA, 56 bp, Homo sapiens
tcaaagtttgtcatattctgggaaagaggattttactggaaatttgacagatttga

SEQ ID NO: 6787200 - DNA, 82 bp, Homo sapiens
gaggttcagaggaggtgaggatgccttatgacttgtgatttactgggcaattactaggccagttttcactttagccaacctt

SEQ ID NO: 6787201 - DNA, 58 bp, Homo sapiens
tctgtataaggacaaacatttagtccagtcaaggtatgaatgtgcttcacttgacaga

SEQ ID NO: 6787202 - DNA, 86 bp, Homo sapiens
gaatttcgttctttgttgttttgagttttcttacttttttaccactagtagtaccaattccagaccacaagtgatttgtgaaattc

SEQ ID NO: 6787203 - DNA, 77 bp, Homo sapiens
accttcaagaaactgtgctacagagttagttattttagtaatcctttaaattctgttacagtaatcttgttgagggt

SEQ ID NO: 6787204 - DNA, 77 bp, Homo sapiens
gccagggatccatctatttggctcttctcccagtggcctgaaataggtgtgagggtgaagagctgtgagtctctggc

SEQ ID NO: 6787205 - DNA, 109 bp, Homo sapiens
ccttcatgtccaacctactttgtgacattctgtttatttcagaacagggtttactcaaaatgccctgtgccagagaggcaggagtcacctctgcaggtatcacatgtgg

SEQ ID NO: 6787206 - DNA, 94 bp, Homo sapiens
ttcagttacttcaggccatctgggcatatacgtgcaagtcacaggggatgcgatggcttggcttgtgctcagaggcctgacagtttccactggg

SEQ ID NO: 6787207 - DNA, 71 bp, Homo sapiens
actggccactgattcctcccctgcaggtctggaagactataaacagaagaaggggtgagtggttgaccagt

SEQ ID NO: 6787208 - DNA, 69 bp, Homo sapiens
ggctgcctcatgagaactgggctcctgtctcatccttaggcggtagctctgctctctatgtgtgcatcc

SEQ ID NO: 6787209 - DNA, 60 bp, Homo sapiens
atgggaaggttttgagagcgggtcagttcagggccggcagactttttaaaatcctcccgt

SEQ ID NO: 6787210 - DNA, 56 bp, Homo sapiens
gtcagaaaaagcaaggctgggcagggaaattcttcagaccgtgctgcagatctgac

SEQ ID NO: 6787211 - DNA, 58 bp, Homo sapiens
atgttttctttcagacttcccttccaccctgagaagggaagagcttgcaagaaaccat

SEQ ID NO: 6787212 - DNA, 59 bp, Homo sapiens
atagacatatggctttgtttctggactctcaatcctattccattggtctatatgtctat

SEQ ID NO: 6787213 - DNA, 84 bp, Homo sapiens
gtcagctctgccctgggaggctttcctgtttggcacgaggatgactctaggcaggtgacctggcctcccagggacctggctggc

SEQ ID NO: 6787214 - DNA, 64 bp, Homo sapiens
agagctgcagggtggacccaggcactgttcccattggcatcctgggtctcctcctgctggctct

SEQ ID NO: 6787215 - DNA, 71 bp, Homo sapiens
ctgtaataaagagcctatattcagctgcagccaattatgtctaggcagaattgtgggctctaagctaacag

SEQ ID NO: 6787216 - DNA, 68 bp, Homo sapiens
tgcattgatcataattatcttgtcatatgtcactaaaggcagtgacaaggtggtaatgaagctttgca

SEQ ID NO: 6787217 - DNA, 95 bp, Homo sapiens
ggctcctagcatatgtcctttagccctttcttctttgttccttcctcctttcacatgcctggaatgcagatgtaatggctggaggtcaagcagcc

SEQ ID NO: 6787218 - DNA, 62 bp, Homo sapiens
gggcatgagggcctggcagttttctgtcttctggggcaaggtgctgccagtgcctgatgctt

SEQ ID NO: 6787219 - DNA, 76 bp, Homo sapiens
gggcgctgtggctgcggttgtcctcggcggtgcccactacgccgatggaggagatggacagctgcgcgcagggctc

SEQ ID NO: 6787220 - DNA, 55 bp, Homo sapiens
tgcttttaagaacaatgctgctaagaatattcttgtaagcattgcttagggtgta

SEQ ID NO: 6787221 - DNA, 55 bp, Homo sapiens
gctatgcaggagcctaatgacaaggactttctctcatcatggtgacctgcctagt

SEQ ID NO: 6787222 - DNA, 123 bp, Homo sapiens
tcacagaaactttgagtacagactatctcataggtctcatcctttgaggaatgtccttagcaaagaagatgtgagtttgcttgtgagatttaaaggtgatgtgcaacagccagagtagggtga

SEQ ID NO: 6787223 - DNA, 57 bp, Homo sapiens
tagctgagtgagcttaggtaaattactaatgttcttcagctttagtttactcatcta

SEQ ID NO: 6787224 - DNA, 63 bp, Homo sapiens
gagtgacatggtggcctgacacactgatgtggcaaaagtcagttcatagtcttcatgtctctt

SEQ ID NO: 6787225 - DNA, 77 bp, Homo sapiens
tgaaaaggacacagacctttctgttctacagctctggtctggaacaggaatatgtttgaaattatatgtaattttca

SEQ ID NO: 6787226 - DNA, 56 bp, Homo sapiens
ccaggtgtggccacatggctggcctgaaatcatgcagctatttcgggctgacctgg

SEQ ID NO: 6787227 - DNA, 67 bp, Homo sapiens
tttgcttcaaaaggcagcttaatgtcatcattgactccctgaatcattttctgcctttggaaccgag

SEQ ID NO: 6787228 - DNA, 67 bp, Homo sapiens
tgccctcattataagaggctcacaggaatacctgatattgagaaatactcttattttctgagtggca

SEQ ID NO: 6787229 - DNA, 67 bp, Homo sapiens
gtggaggttctatgtgtaggaggtcccaggatagtgagtcctcttccttctcactgtggaaaagaac

SEQ ID NO: 6787230 - DNA, 61 bp, Homo sapiens
tatgctttacttttcattgtgaatcattgtgaatatatacaaaggtgaaaagtgaagcata

SEQ ID NO: 6787231 - DNA, 110 bp, Homo sapiens
ctccatcaaggtgtaccagggcctcaaggagctggcctgacctgaggctgggttggagcagccctcctgtgcctgaggccagctcccaggcccttggatcaccgcgggag

SEQ ID NO: 6787232 - DNA, 75 bp, Homo sapiens
ctgaaaacataatactgctagatgaaaatgtaggggataatctcctttacattggcctcagcaataatattttag

SEQ ID NO: 6787233 - DNA, 112 bp, Homo sapiens
gcttgtggccctggttttccatcaggtgacctgagccactatgggttaccccttccatggcatctgtgtggcctccaaggttcctgaagagcagacatcttgggccatgggc

SEQ ID NO: 6787234 - DNA, 71 bp, Homo sapiens
atggcagggctgagcccaggcatgtagtaagccctccaagcttgttacccacctttctcatgccaagtcat

SEQ ID NO: 6787235 - DNA, 67 bp, Homo sapiens
tagagcctgggctgctgtccactagggttccagaaaaggactcttggtcagaacaattcaggttttg

SEQ ID NO: 6787236 - DNA, 106 bp, Homo sapiens
gaactatttttgaaagcaatgatgtagagtagaagagatattttcactagattcagaatatttctgtttatttgtacatcactgttaacatttgtaaaagtatttc

SEQ ID NO: 6787237 - DNA, 115 bp, Homo sapiens
atccctcatggacaggcccaaacccacctctttttcagcaacttccggaagtccatcagctccttcctgaggtctgaaaaaggagcaggaatgaggcctcagtcccaggtgggat

SEQ ID NO: 6787238 - DNA, 59 bp, Homo sapiens
agtttagccttccatttcactggataagcatatgaccctagatgagatggaagaagact

SEQ ID NO: 6787239 - DNA, 64 bp, Homo sapiens
gcctgcttgcctgcatgaggagagctggctccaccagccagagaaagctcacaggcagtgaggc

SEQ ID NO: 6787240 - DNA, 82 bp, Homo sapiens
caggtcctctagtgattcctgttgccctggagataaaatcccggcatctcagggtggccaggagctttctcagggagacctg

SEQ ID NO: 6787241 - DNA, 83 bp, Homo sapiens
cctcttggctgagcttccctctgcagtccctgatgagctaagcaccctctctgggcagatggagaagctctgcacagtctagg

SEQ ID NO: 6787242 - DNA, 60 bp, Homo sapiens
gcctgtgtcttttgtttggggtctcaaaccatttcttgggcccttgaaaagctcacaggc

SEQ ID NO: 6787243 - DNA, 57 bp, Homo sapiens
gctgcaagcatgtcatcctcacatttggccccttggcccagagatggcattggcagc

SEQ ID NO: 6787244 - DNA, 64 bp, Homo sapiens
tgccttctcccttggaccctgagggctgggttaaacgcttcaggggtctcacaggcaggaggca

SEQ ID NO: 6787245 - DNA, 130 bp, Homo sapiens
caggtaggctgtcgtcagcacaggtctgacaggccccagccacggtggcccacaggtgcaagcaagaaataagcagtgccaactgtagccgctgcgctgttggagatctttgttactgcagcacaatctg

SEQ ID NO: 6787246 - DNA, 129 bp, Homo sapiens
gtgattaaataatctcaagtacccaaagttcaagtgtagagtttggtttcaaagctaattcattttgattggctacatgaactcttaagtcacaatgatacttggtttactacttattattctaatctc

SEQ ID NO: 6787247 - DNA, 56 bp, Homo sapiens
aggaggaagtatttgaaaagaggactgacccatattctcttcaaatattttattct

SEQ ID NO: 6787248 - DNA, 59 bp, Homo sapiens
tctcaagatatagagggttctagagttggttgattcagtggcccaatgtcatcatgaga

SEQ ID NO: 6787249 - DNA, 62 bp, Homo sapiens
aaatggagctgcatttagggagcctttttacagtggagtgtaaggctgctatgtatctattt

SEQ ID NO: 6787250 - DNA, 84 bp, Homo sapiens
ggagccgagctttcccttacaggctgtggggggtttgcccaccttgcccatggcaaagccttcttcggtctgtgattctgttct

SEQ ID NO: 6787251 - DNA, 67 bp, Homo sapiens
gctgctaacatgcagagtttagcttttgcctgtttttggcaaaagtgtgactcaccatgtcaggagc

SEQ ID NO: 6787252 - DNA, 65 bp, Homo sapiens
cccagccccttcgtggaagtgcattctccagtgaggcatcgcacgtcctgaagtggatgactggg

SEQ ID NO: 6787253 - DNA, 81 bp, Homo sapiens
cacttatgtgttccagtattttttattctgtggtatataatgtatgtcaaagttaagaaatagggataaaaacactgagtg

SEQ ID NO: 6787254 - DNA, 107 bp, Homo sapiens
agaacctctcagaatctgtttggagacattttaaagagccatgctgaagtttttcctggcactgcctatgcaaatgtactctaagggtaggaaggaatggaggtttt

SEQ ID NO: 6787255 - DNA, 99 bp, Homo sapiens
ggctgtgtttttgttggcggtattgctgctggagccattttccgtttggagggctcctgataggagaatgcgggtcagcgagtttagaacagcacagcc

SEQ ID NO: 6787256 - DNA, 75 bp, Homo sapiens
ggtggtcaaaacttgtcaccatatttcattttgaacaatatcaaactaagtgtgggaggcagaatgttgaccccc

SEQ ID NO: 6787257 - DNA, 77 bp, Homo sapiens
cgcacgccgtagggggcgggccgttcgggcttggtttcctgggcgaccaccgctggctagtccgttagaggcgtgcg

SEQ ID NO: 6787258 - DNA, 77 bp, Homo sapiens
gacttgtgtgcacatatgtcataggtatgtgtatacatacaaggtacatatactgcatacatatgtgtacatatatc

SEQ ID NO: 6787259 - DNA, 75 bp, Homo sapiens
aatctcctccagaaaggctgaggatggctgcaaaggctcagacaggctctaaataaagtctcttcggaggaggtt

SEQ ID NO: 6787260 - DNA, 104 bp, Homo sapiens
cggggtgggaggcggtgttgaaagacccttttcagactcaggtacccagactccagggatttacagatctaagggtcacattcattgcacagacatacaccccg

SEQ ID NO: 6787261 - DNA, 81 bp, Homo sapiens
taaaacattagttacagaatgtacagaggtttatggtttatttcccagatagcttgtgtttttctaagtatctgattttta

SEQ ID NO: 6787262 - DNA, 67 bp, Homo sapiens
tttggcttggggtcataaagaggaaaaaaactttaaattttttttccaacttaagacttcagtgaaa

SEQ ID NO: 6787263 - DNA, 58 bp, Homo sapiens
tcttagcatttcataacaactgtgaccaatttttattatgtagttggaagtgttaaga

SEQ ID NO: 6787264 - DNA, 82 bp, Homo sapiens
ggtacagtgtgtaaagagaatggtatatggaactcatcacaactaatttggaatcctggctatactatttttcatttgggcc

SEQ ID NO: 6787265 - DNA, 67 bp, Homo sapiens
cgtcgtccggtactcgtattgcgcctcgatggcctcggggccgtagaccacgtccgggctctcgacg

SEQ ID NO: 6787266 - DNA, 59 bp, Homo sapiens
ctctcctagtccccaagtgtgagtctaaactgccactcatgcatggatttcagtgagag

SEQ ID NO: 6787267 - DNA, 55 bp, Homo sapiens
gctaggaaggactgcagcatttggtccccaagggccaacatcagttctgcctggc

SEQ ID NO: 6787268 - DNA, 78 bp, Homo sapiens
atcactctatcacccaggctggagtgcagtggtgcaatctcagctcactgcaaccttgacatcctgggttcaagtgat

SEQ ID NO: 6787269 - DNA, 79 bp, Homo sapiens
cctgtggtcatgtatgtgcttgttctttgaagttacaaatgaacaatgactacatattgatgataagtataaatacagg

SEQ ID NO: 6787270 - DNA, 128 bp, Homo sapiens
agagacgggatttcaccatattggccaggctggtctcaaactcccgaccttgtgatcctcccgccttggcctcccaaagtgctgggattacaggtgtgagccaccatgcccggcctgttcccatttct

SEQ ID NO: 6787271 - DNA, 79 bp, Homo sapiens
catatttcatatacttgtagcaggtggcatttattggtttattctattaaacgctacacatgccacgttaggaaatgtg

SEQ ID NO: 6787272 - DNA, 92 bp, Homo sapiens
ccattatgtctttagttgcttagatttgatcttgacccggggctgatgaagaggagctgggcttgcagctctgagactgaggctatggatgg

SEQ ID NO: 6787273 - DNA, 57 bp, Homo sapiens
agaacatctgaagatacaaagtatttaataaccaggtgatgtgttcataggtgttct

SEQ ID NO: 6787274 - DNA, 58 bp, Homo sapiens
ctactgctaagggaaatgtaaattggtttgtttgcttctttacactcctgggcagtgg

SEQ ID NO: 6787275 - DNA, 85 bp, Homo sapiens
atgaaagaatgttgtttgtgcaagatctgatgagcagaagtgcctattaggtgtaccttgttaaaccagcgcctcatttaatcat

SEQ ID NO: 6787276 - DNA, 62 bp, Homo sapiens
cccaacagaaaatctaaaaatctgaagttggaccatgcaagagttttctgttttctgtaggg

SEQ ID NO: 6787277 - DNA, 55 bp, Homo sapiens
agagggaggaaggccagcactcaaaaaacaagagaagcaatgctttttttcctct

SEQ ID NO: 6787278 - DNA, 80 bp, Homo sapiens
cacgtaaggtatcaaaggctatattcattattctcttgagtgcaaaagagtctgtgtctgtgtctatgtatgattgtgtg

SEQ ID NO: 6787279 - DNA, 92 bp, Homo sapiens
gtgtatgtgtgtgtgtagtgagggagcccagtctgggtctcctggacatctgaccaccactgggcttcacttggcacatctggcacatgcat

SEQ ID NO: 6787280 - DNA, 67 bp, Homo sapiens
aagtcatctgaaactggcttataaatgcacagattagtaacatattagggttggtttcagagggctt

SEQ ID NO: 6787281 - DNA, 68 bp, Homo sapiens
cttaccttgtaaaggccctgtctccaaatacagccccattctggggtacggggtcggtgcagggtggg

SEQ ID NO: 6787282 - DNA, 104 bp, Homo sapiens
tccttggtggtgtgagacctgttgggttatgtcctggtgggttaaccaatcctcccgaacctcgccaggactcttcctagaaggtgctcaagaatttatctgga

SEQ ID NO: 6787283 - DNA, 112 bp, Homo sapiens
attcttgttcctttaacagccttagacactgatgttcagctcaatggacagcttcttcacacagcctactgagctgaacatcggtgtctaaggctgttaaggtaacaagaat

SEQ ID NO: 6787284 - DNA, 74 bp, Homo sapiens
aatccctggaggggtttccaaagatagagtagtatccggacatatttttctttctttttaaattccaggtgatt

SEQ ID NO: 6787285 - DNA, 55 bp, Homo sapiens
aaatggaggattttgagctgcagccagaaaaacagtagcaatgagtgttccattt

SEQ ID NO: 6787286 - DNA, 56 bp, Homo sapiens
agtccttcctgcaccctcctggggaaccatatacactccaggaatggtagaggact

SEQ ID NO: 6787287 - DNA, 58 bp, Homo sapiens
gagtgggtaaaggtgcttggctttggtgtaagaaaggcctcactttgaatcccggctc

SEQ ID NO: 6787288 - DNA, 63 bp, Homo sapiens
gggccaggcctttgggaatcaccacagaaatggaagcctggtgtgtgcttcctggaggcccct

SEQ ID NO: 6787289 - DNA, 62 bp, Homo sapiens
ctgcccctcagccaggtgggaggtgccagcctcctgtcatatacatacctcctcaggggcag

SEQ ID NO: 6787290 - DNA, 82 bp, Homo sapiens
gccagcagggaagtcttacttttggaaagtggccaggtcccatcacgagggcctcacctggctgaacaaagtccctcctggt

SEQ ID NO: 6787291 - DNA, 80 bp, Homo sapiens
agggctccagagcctttccacccacttggcttacaggaaccgcaactgggagaaagaggtgccaggggttttgtagctct

SEQ ID NO: 6787292 - DNA, 65 bp, Homo sapiens
ccctcttctactggcctggctgctcctccctcaatgaggagaggcagctggctcagagaggtggg

SEQ ID NO: 6787293 - DNA, 56 bp, Homo sapiens
ctatcttaccttgcactggtcatagggtcccctgccaatgcacactaggaagacag

SEQ ID NO: 6787294 - DNA, 56 bp, Homo sapiens
tggagctggccctctgagtttgtacaagtgacatagaaacaccatggtcagttcca

SEQ ID NO: 6787295 - DNA, 56 bp, Homo sapiens
actgctgcatttggttgacttttcttccagctgagaagcaggtaaggcacagcagt

SEQ ID NO: 6787296 - DNA, 86 bp, Homo sapiens
aggacagttgtgtgctggtaaatgtttgtaaattggctctgaggagcagggagccctgatttgcagcatttgtcagtatctgttct

SEQ ID NO: 6787297 - DNA, 66 bp, Homo sapiens
aggcaattttctgatgatgaagcacgtgcttattagcatttgtatagcttcctcagtaaaatgtct

SEQ ID NO: 6787298 - DNA, 73 bp, Homo sapiens
tggtgaacatttattgaatggttaatatgtgccaagtacagtgcttaggcaccttcattcaatccagtcacca

SEQ ID NO: 6787299 - DNA, 58 bp, Homo sapiens
aggctttactggatttttcgcttggaacaaacccaggcttagggaattcccggagcct

SEQ ID NO: 6787300 - DNA, 60 bp, Homo sapiens
ccttagccaggctaaatgagccatgataattttatcactcctgttaatgactggcttagg

SEQ ID NO: 6787301 - DNA, 81 bp, Homo sapiens
cttctgagctgattccatggttgctagcatgttcatagtatccccaccgtctgtgtcctggctctgtggatccctcaggag

SEQ ID NO: 6787302 - DNA, 60 bp, Homo sapiens
tgaggaaaagagagaataagggaggatagattaatcaccttccagaaatctctttcttca

SEQ ID NO: 6787303 - DNA, 79 bp, Homo sapiens
gagtgagttcgcaattaattcgggccacagtgtgccaaggcacatttccaaactgggcctggattggcgtgtcatcctc

SEQ ID NO: 6787304 - DNA, 62 bp, Homo sapiens
gttccaccctgccgtgggctgcttgtggcactgctgccacctcgcagacaggcaggggaggc

SEQ ID NO: 6787305 - DNA, 61 bp, Homo sapiens
ggcttgaactcccaatcatttagaagcatcctgggtgattgtttggtattcacattctgcc

SEQ ID NO: 6787306 - DNA, 68 bp, Homo sapiens
attctagccattgtattcttcctgttttgcctgaaacaataattcaaggagaatacatgtgctgtgat

SEQ ID NO: 6787307 - DNA, 60 bp, Homo sapiens
gtttctcctgcagtcagcagtctcactccctgccagtgggaaaagcagatagagagtgac

SEQ ID NO: 6787308 - DNA, 83 bp, Homo sapiens
gatacatgagatgcacgtttatttgcttgtgatttctttttcttgaaatcaggatccaccttgagcctgatatctacattttc

SEQ ID NO: 6787309 - DNA, 61 bp, Homo sapiens
tcctttagtttgtgatacgaagattgttagtttctctattattttttcatagactattgga

SEQ ID NO: 6787310 - DNA, 75 bp, Homo sapiens
ggaacacagtgccttacaaactgtctaaaccatacagtttatacagtttagacagtttgtaaggcactgtgttct

SEQ ID NO: 6787311 - DNA, 86 bp, Homo sapiens
tttctcacaatttggatacagctatgaggagattggacatgaaagttatttttcaggacacagctgggatttaaagttgtgtgaaa

SEQ ID NO: 6787312 - DNA, 62 bp, Homo sapiens
aacatgaatagggtattctttggctggatcaaaattataaaggtccaatttctattcatgtt

SEQ ID NO: 6787313 - DNA, 55 bp, Homo sapiens
caaatgattgccatgtagatgagatagaagtcatccatgcttaagtaatcatttg

SEQ ID NO: 6787314 - DNA, 55 bp, Homo sapiens
gatgatgtcatgatgaagacgatgatgccatattgttgataatcgtgttgtcatc

SEQ ID NO: 6787315 - DNA, 83 bp, Homo sapiens
acagagttttattcattgccataatagagccatgtaggaaatgcactgactgcatgttattgtggcaagaatatcctaaatgt

SEQ ID NO: 6787316 - DNA, 56 bp, Homo sapiens
tgtcatggactggatttctgctgtgagcttccattaggacttgtccatccaggaca

SEQ ID NO: 6787317 - DNA, 73 bp, Homo sapiens
gctgctgggccccttgaaaggcgtctccctgggcctgggaatgtctggacggctctaagggggccagtgaagc

SEQ ID NO: 6787318 - DNA, 120 bp, Homo sapiens
tgctgctgccaccaaacatgctgtgtgttccacataacacatctacaacatggtataatttcagttcttgagtgactgtgtggatcacaatctactagcaacccttgcgggcatgtagca

SEQ ID NO: 6787319 - DNA, 74 bp, Homo sapiens
tctagggaatgttctgtgctggttctgggggtgcccctcctcatctccttgccttcttactgaacttccctaga

SEQ ID NO: 6787320 - DNA, 69 bp, Homo sapiens
ccagctgagctgccagactactgccttagagtgaaaatgagcccagtgtctttcagactcagaaactgg

SEQ ID NO: 6787321 - DNA, 70 bp, Homo sapiens
gagatgcatgtgtgtgtatgtggcattttttgagtccttgctatgttcaacagtttgcacacattatctc

SEQ ID NO: 6787322 - DNA, 65 bp, Homo sapiens
gccagtaagtggtagagacttaaatctggtaggccctttgccattcttctctacttactgctggc

SEQ ID NO: 6787323 - DNA, 72 bp, Homo sapiens
ggggtgtttccaggcagggttaagggtcctgggggtggaatctcagggggtgtctctgattgggttagctct

SEQ ID NO: 6787324 - DNA, 58 bp, Homo sapiens
gagtatacacatatcttctaggcctgtaaatgctagagccctctgatatgttaaactc

SEQ ID NO: 6787325 - DNA, 55 bp, Homo sapiens
tgtacctagcatgtgcttttcctctagcagtgggaggaagtggcacaggagtgca

SEQ ID NO: 6787326 - DNA, 130 bp, Homo sapiens
ctggggcccagggctgtgtgtgtgtgtgtgtgtgtgtgcgcgctcataggtgtgtttgcaggcatgtgtacgtgtgtgtgtatgtgcatatgtgcacacatgcatcttcagggactcatgacaacctcgg

SEQ ID NO: 6787327 - DNA, 62 bp, Homo sapiens
ggtatggtgctaggtcaggtagctgtagtttccaactggctctcttaactggccatcctacc

SEQ ID NO: 6787328 - DNA, 119 bp, Homo sapiens
tgttaggaaaattgagaaagtttgccatgagttaaatcacccatctcctaatctgggctcctatcagattgcaaaatgggtgatttaattcatgggaaactttctcagttttcccaaca

SEQ ID NO: 6787329 - DNA, 71 bp, Homo sapiens
tggattccggattgcagggtccctgccatcggggagattgtctggattgcacctctgcccggaatagacca

SEQ ID NO: 6787330 - DNA, 63 bp, Homo sapiens
gctcaagtgtgtagggccaagagccacaaaattactaggctgtggccaacaaaccacttttgc

SEQ ID NO: 6787331 - DNA, 60 bp, Homo sapiens
agataatggagggatttgcattttgctgaagaaaccccaaagtgccctccgacattgttt

SEQ ID NO: 6787332 - DNA, 58 bp, Homo sapiens
gtgggttgggtttttgaagggaagccagtcatggaagcttttctagtcccagccccgc

SEQ ID NO: 6787333 - DNA, 59 bp, Homo sapiens
ggaaggcagagtaactatttctaaaactcattccaggaaacaggtagccctagccttct

SEQ ID NO: 6787334 - DNA, 86 bp, Homo sapiens
gaaattacgggaacacagcttctctttccaaatattaagaaaatgtacgtatttaggcaatagatggcagtgtttccacaaatttt

SEQ ID NO: 6787335 - DNA, 66 bp, Homo sapiens
tagggtgcagttaagtggtcctctcttcagaggagcttcagagaccacttaactttgaccacttta

SEQ ID NO: 6787336 - DNA, 129 bp, Homo sapiens
ctcacttctcatttccaagagcccctgaggatggagcccctcacccacacctgcggggtccctgagcccactcaggacaggggaggaggctgctcaggcctcggtgggatctgacggtgatgaggctgg

SEQ ID NO: 6787337 - DNA, 84 bp, Homo sapiens
agcatcttatgcataaaaggaggtcactttattcctgctcaactctggggggagatctgagatcttattttttgtaaatgtgct

SEQ ID NO: 6787338 - DNA, 61 bp, Homo sapiens
gctgaggtcaatttgcctccccagagtgtgttagtctgcaggcatttttggttgtcacagc

SEQ ID NO: 6787339 - DNA, 77 bp, Homo sapiens
gagaactgaatttgtacaaaatgtttataaataattcgaaagaggactttaaaagtactttttgcaagtttgttctt

SEQ ID NO: 6787340 - DNA, 76 bp, Homo sapiens
gccccccaagtaactaggattacaagcgtgcgccaccacacctggctaatttttgcatttttagtagagaaggggc

SEQ ID NO: 6787341 - DNA, 62 bp, Homo sapiens
ggagtgttgttatgtcatattgtaattcgtaggaaaattatagaagattattgcaacagtcc

SEQ ID NO: 6787342 - DNA, 64 bp, Homo sapiens
actctgaggggtatgttcctatgtaaatccccatacatcaagataaaaatatacttctcagtgt

SEQ ID NO: 6787343 - DNA, 92 bp, Homo sapiens
ggctttagtggaaaagagggtagtgttagggatgaggttaaagactgatattaatttaacacatatttatcaattgcacatttccataggcc

SEQ ID NO: 6787344 - DNA, 67 bp, Homo sapiens
gtttcccaggtaattctgaggcagagtgaggattcagaactagttgctttaaggtatctggagaaac

SEQ ID NO: 6787345 - DNA, 60 bp, Homo sapiens
gatctgccagtgggaagaatacattttgaagaggcttcagtgtctttccatggctggatc

SEQ ID NO: 6787346 - DNA, 70 bp, Homo sapiens
ggaggaggcactgagaggctcttcctaaggctttgttttagggacaaagagctccagtctgagctgctct

SEQ ID NO: 6787347 - DNA, 90 bp, Homo sapiens
gttagcatattaatacatatcttagcatgcatgtataaatatatgcttgtgtgtatacgtgtgtggctgtgcctgcatagatatgctaat

SEQ ID NO: 6787348 - DNA, 120 bp, Homo sapiens
cataaactggactaaataatcaggactccctcaattcatctacggattcaatgaaatctctatcgaatttcaagctggcttctttgtagaaattgaaaagttgatcctaaaattcatatg

SEQ ID NO: 6787349 - DNA, 59 bp, Homo sapiens
gttctgtagtgggaaatagtaaaaggattcttcactcccttttcttttcccctcagcac

SEQ ID NO: 6787350 - DNA, 57 bp, Homo sapiens
ggaaggaagaggaccgagctggtgcaaagccagcttctctcagggtatctttcttcc

SEQ ID NO: 6787351 - DNA, 71 bp, Homo sapiens
agtgggcccagtgttgccagacctgaaatatacctcatgtgggtgtttgtctctggtactctgggttcatt

SEQ ID NO: 6787352 - DNA, 87 bp, Homo sapiens
gaaaaaatagtgcgtcctcttcatggtgaccatctctggaaatcagtaaggaataggaactaggaacggggtttgcactctgttttc

SEQ ID NO: 6787353 - DNA, 69 bp, Homo sapiens
tgttgattacctcatttaagtcactattacactcatagtgtccagagtggaggtgagtgtggtacagca

SEQ ID NO: 6787354 - DNA, 69 bp, Homo sapiens
gtcactaaggagacaggtaaatttcccagtgctggaatcagattggtgaggaagacctgctcctgaggc

SEQ ID NO: 6787355 - DNA, 55 bp, Homo sapiens
tagtgtgggaggggcatggagatgaattgctcactgcccaccaagctccacactg

SEQ ID NO: 6787356 - DNA, 66 bp, Homo sapiens
gggggtggagactgggtccaggacctagcagccctacctcgaggccctgcttccaggctcaccccc

SEQ ID NO: 6787357 - DNA, 80 bp, Homo sapiens
ggggctttctgggaaggaagggctggctgtcttggccctggccttggccctagttcccttccactgcccagatgtgctcc

SEQ ID NO: 6787358 - DNA, 76 bp, Homo sapiens
tgcaaaagcaggacgtatttctatcctagcaacagggtgttttcacaggatagtcaatatgttctcagtctatgta

SEQ ID NO: 6787359 - DNA, 66 bp, Homo sapiens
tgaaggtctatggagaagactgaggatgggaattgtactatacatccttagccaaatgtgccttca

SEQ ID NO: 6787360 - DNA, 57 bp, Homo sapiens
aagatttttggtcatgtaagacatatatttctagtctgttcactgacttaaaatctt

SEQ ID NO: 6787361 - DNA, 62 bp, Homo sapiens
ggctcttgggagctcagagttgaagctttttcaatggtatttactctggtgctccaagagcc

SEQ ID NO: 6787362 - DNA, 83 bp, Homo sapiens
caaaggtagtcaggatagaacaggcataagcatttgcattattttagtaagctttgtgatggcttcctgcctgattacttctg

SEQ ID NO: 6787363 - DNA, 57 bp, Homo sapiens
gcgctcgcgttccagctgcgggccgtcacgtgatcctcgcggctggcgcgcggttgc

SEQ ID NO: 6787364 - DNA, 75 bp, Homo sapiens
ggctgcggctgtggaggtaccacctgtggagaaactgcaaagatgctgtctgtgtgtgtctccgcggccgtagcc

SEQ ID NO: 6787365 - DNA, 62 bp, Homo sapiens
gggctccaggactcaggcccctgggaaagggcccccactcagcatccagttcctgcgagccc

SEQ ID NO: 6787366 - DNA, 72 bp, Homo sapiens
ggaaggagagggcgcccgagctctgctcccgggcttgcgcctggcctggagtggacttggcccctcacttct

SEQ ID NO: 6787367 - DNA, 56 bp, Homo sapiens
gggtgtggaggtgacacatttgactgacatcagcatctgtgttccatccaccaccc

SEQ ID NO: 6787368 - DNA, 77 bp, Homo sapiens
attcccccaatcccccatggccaggcccagggcccaggagactgagcactgaggcaggcctgagattgggatggagt

SEQ ID NO: 6787369 - DNA, 99 bp, Homo sapiens
agccctgagcccttttgctcctgcttctgccttgaggtcctcagctctgcatgcacggtcggtcctagggcccggggcagcccaggtgagggggcggct

SEQ ID NO: 6787370 - DNA, 56 bp, Homo sapiens
ccatttcactcttcctgaaggacccggcaggcgggtggaggaggggtgggaaatgg

SEQ ID NO: 6787371 - DNA, 61 bp, Homo sapiens
tgctgatttttaagtgctgtctgtccttctgcaacagatcagtgctgggagatgtcagaca

SEQ ID NO: 6787372 - DNA, 87 bp, Homo sapiens
ggcaaactggagcatgtaggctgatgttgatactggagaaagcattaccaggcctccaggttacttagcctagctctccaatttgtt

SEQ ID NO: 6787373 - DNA, 55 bp, Homo sapiens
tgctttcttcaacctcattctgcagaaacaattgctgcaggtgttggagaaggta

SEQ ID NO: 6787374 - DNA, 97 bp, Homo sapiens
ttcctgtggcgtgccgttttacagtagtatcttcatttgttgattcattcactcagtcaacatttagtaaatattatgtgacaggcagccatgggaa

SEQ ID NO: 6787375 - DNA, 70 bp, Homo sapiens
ttcctgttatgtccctatttatgggaaagtgagaaacttgaccgattctagtggacattaacaacgggaa

SEQ ID NO: 6787376 - DNA, 58 bp, Homo sapiens
tctgcaccctgacctctgtttctgtgtttataaagggaacaaaaggcaagggtgagga

SEQ ID NO: 6787377 - DNA, 67 bp, Homo sapiens
ttgagcccgggaggttgaggctgcagtgagctgtgatcatgccactgcacttcagcctgggtgacaa

SEQ ID NO: 6787378 - DNA, 74 bp, Homo sapiens
gagcgagagagacaggaatggcattaagatctgctttaagtacagttatctgaaatgttctcttgttttgactt

SEQ ID NO: 6787379 - DNA, 76 bp, Homo sapiens
ggggagaggcagtgctcacccacagcagcaaaatcccttccaagctctttgggccgacactcgtcaaacccttccc

SEQ ID NO: 6787380 - DNA, 71 bp, Homo sapiens
gaggagctcatgaaagcggtgttcacagcatgctgcagttgctcacatcgtagttcataaggcattttctc

SEQ ID NO: 6787381 - DNA, 70 bp, Homo sapiens
tctgtgaaagatactaggcagaggcaagatcctttctcacaagacttcctctgttccctgtcatcactga

SEQ ID NO: 6787382 - DNA, 55 bp, Homo sapiens
gtcaggctagcccagtgcttgggagttacagcactcaagacaccctggcctctac

SEQ ID NO: 6787383 - DNA, 57 bp, Homo sapiens
gtatgtcacctctcctaagcacagcattaaatgattgggagaggaaaatgagcatat

SEQ ID NO: 6787384 - DNA, 68 bp, Homo sapiens
gttgtgaattatgaaagacatttctgttgggttactgaatgtcccttggggtttttttcatttataac

SEQ ID NO: 6787385 - DNA, 63 bp, Homo sapiens
gtccctgcctctcagacttcctttcatgcaaatcgccctgagtgaggggtgaggggtagcaac

SEQ ID NO: 6787386 - DNA, 81 bp, Homo sapiens
gtatgaaggcagttcttctcggctgtcagatagtttgaccagtgtcaggctatcccgacgagagcagcataccttcattgc

SEQ ID NO: 6787387 - DNA, 84 bp, Homo sapiens
gagcttgtaatgccagagacacttggaggtagaagaatgaagttcaagacccggttctaccactaagtgtgctttgatcagctc

SEQ ID NO: 6787388 - DNA, 69 bp, Homo sapiens
tatgcagttcaacctaatacagcagaaagaatgtgggaatttctttctgctgtattaggttgaaccata

SEQ ID NO: 6787389 - DNA, 57 bp, Homo sapiens
cagagtcatatcagagaatatgaactgtcagtgtttccaatgtttctcttggctctg

SEQ ID NO: 6787390 - DNA, 57 bp, Homo sapiens
tgagatggaaggtgaggcagtagactctgaagtcagaaagcctacctttgtatctca

SEQ ID NO: 6787391 - DNA, 70 bp, Homo sapiens
ccaagcttgtttctcctgggggtgctctttcgaggatatttgggctgcctccggagtcacagtgtcttgg

SEQ ID NO: 6787392 - DNA, 71 bp, Homo sapiens
ggaggaaggtgacaagtttaggttaccataatgagtaatgatggtgatcagtcaactgtcttccctcttcc

SEQ ID NO: 6787393 - DNA, 68 bp, Homo sapiens
tggtttttgtctttatgcacactgacttgggtggtttttaagtcaaattgtctaaagaaataatttca

SEQ ID NO: 6787394 - DNA, 60 bp, Homo sapiens
gtagatatgtgttgggcactcaaaaactgagtcagtttagtataccagtacatcttctat

SEQ ID NO: 6787395 - DNA, 59 bp, Homo sapiens
tagagctatacactgagtaaaaacagagcttgaaagtttttgacaggtggagagcccta

SEQ ID NO: 6787396 - DNA, 93 bp, Homo sapiens
gcagagaagagcatcctggttttatgaagtcctgttgtaaccataatgaaagaggaaaagaaacttcaaagccaggattgcgtaggtctatgc

SEQ ID NO: 6787397 - DNA, 71 bp, Homo sapiens
tcacttcttttgtgattattcagttacttcaggccatctggatgtatacgtgcaggtcacaggggatatga

SEQ ID NO: 6787398 - DNA, 59 bp, Homo sapiens
gctcctgcagttttgttgtcctaggcataaatctgtctgtcaactgcctctgaaggagt

SEQ ID NO: 6787399 - DNA, 84 bp, Homo sapiens
gtcgaccttttcagaaggcaacttaaaaagagaatggtggaatgtttgtatcattgaatataagtgctatttttgaaaagtgac

SEQ ID NO: 6787400 - DNA, 68 bp, Homo sapiens
aactatgtgatatcatccttgctttcaaattttaaaagcaggagggctggagcgactttcacaaggtt

SEQ ID NO: 6787401 - DNA, 57 bp, Homo sapiens
tgtaggaggcagagagggaaagagcagtcttaggtctctttacatttgcctcttgca

SEQ ID NO: 6787402 - DNA, 55 bp, Homo sapiens
tgatccttctgtcatcttattttaaagccagagtctaaggtggcagcaggtatta

SEQ ID NO: 6787403 - DNA, 108 bp, Homo sapiens
aagaggcacattaggtgtgtgtgtgtgcgcatgagtctgtgcatacacgtgtgtttgcatgtgtgtgcatggcgcacatgtgtgcgcttgcatgtatatgtctctctt

SEQ ID NO: 6787404 - DNA, 88 bp, Homo sapiens
ggaatcctgtcagcaatgtaataaagactcctctgttacagaaagtgaggtaacagcttgggatgctttatttcatgatcaatgttcc

SEQ ID NO: 6787405 - DNA, 57 bp, Homo sapiens
ggcaagagggcagatggagtgcagggagatggcgtgacttccatctatcttcttact

SEQ ID NO: 6787406 - DNA, 60 bp, Homo sapiens
gttgggagtggtgttgaagtaactgggaaaactccacagaggctcagcgtccacctctac

SEQ ID NO: 6787407 - DNA, 86 bp, Homo sapiens
tgtttaagcagctggagcacaagttggccagtaaatgcatgttatatagacatttaataccacttggtgctttatcaggctttaca

SEQ ID NO: 6787408 - DNA, 69 bp, Homo sapiens
ggctgccctgactgaccttttgaatatgagtctcagagataagttttcaagcagctcagggacacagtt

SEQ ID NO: 6787409 - DNA, 58 bp, Homo sapiens
agtctgaaggatggaaggtaccgtagagatcatcgacccattccttcatctttcagct

SEQ ID NO: 6787410 - DNA, 55 bp, Homo sapiens
gcccagacatcaggggctagatcccctcaagaggaggttggacctgtgtcagggc

SEQ ID NO: 6787411 - DNA, 55 bp, Homo sapiens
ttccagtgatgggcaatttggtgtttttttaagaccatttatcccattaatggaa

SEQ ID NO: 6787412 - DNA, 56 bp, Homo sapiens
ttctaagtcatcagctgttctctagactagaaaggacagtagtgtggtatttagaa

SEQ ID NO: 6787413 - DNA, 55 bp, Homo sapiens
tcacctgttgcaaccaatttgaaagactcattggattggcctgtttacagagtga

SEQ ID NO: 6787414 - DNA, 116 bp, Homo sapiens
tagtaggccagaaaataatgttttactaagcaggctgccctagcttggacatttaaagggaagccgtatgttgaaggatgaagggcagttgaagttttgtgaagaatggccggcta

SEQ ID NO: 6787415 - DNA, 56 bp, Homo sapiens
acactttgttgatgaaatagttttgttacttacagtcctgtgaattcagcaaaggt

SEQ ID NO: 6787416 - DNA, 118 bp, Homo sapiens
gggtaattattaattctttggtgttgtcaattctctcattggtatgatgtgtagactagcatagatctcatttttctccaatgggaatttgataacattaaggtactttaaatttctc

SEQ ID NO: 6787417 - DNA, 70 bp, Homo sapiens
tcaactaaggcacaatctctaattctgtatctgcattgatgactcagtgattttagaggttgtgagttga

SEQ ID NO: 6787418 - DNA, 56 bp, Homo sapiens
ccagcagagggcgcttcacacccctcatggaaggggccgggagggcgctctcctgg

SEQ ID NO: 6787419 - DNA, 71 bp, Homo sapiens
ttaaaaatgcctccgcatgtgcctttgattctgtagaatggaagtgtctacatgtggagtaatgtctttga

SEQ ID NO: 6787420 - DNA, 99 bp, Homo sapiens
gaggcaggaggatcacttgagcctgggaggttgaggctgcagtgagcaaagatgctgccactgcacttcagcctgggtgacaaagtgacatgctgtctc

SEQ ID NO: 6787421 - DNA, 128 bp, Homo sapiens
atccagtggacacaattcagtcattaagtcacactgctgggaactctatatgccattttattccatatcaaacagttgtttcctgtaggtagactcatgctgcaagctgtcctaaatgtttttggtat

SEQ ID NO: 6787422 - DNA, 58 bp, Homo sapiens
attccaaacgcctcgcggacttttcccttttacagcaagggccgcgaggcgtgagaat

SEQ ID NO: 6787423 - DNA, 62 bp, Homo sapiens
ccattgttttgaaactccatcaaattgggcagctctttccagaagacagtctcaagacaagg

SEQ ID NO: 6787424 - DNA, 70 bp, Homo sapiens
ccatattccttgtttcactgaaaagggacttagtgtcatagctaaacctttcactggagaagagaaatgg

SEQ ID NO: 6787425 - DNA, 61 bp, Homo sapiens
tccccttaaggaagacacagatgaagtgacctctttttcatttcttcaacttcctggggga

SEQ ID NO: 6787426 - DNA, 130 bp, Homo sapiens
tattgaggctataattatactgagtgtgagtctcttgcacattgtattaaaaagaagcagactcacaattatttttaaaaacattgaattaggatgcagtttacactatgtatacatatggacattgata

SEQ ID NO: 6787427 - DNA, 125 bp, Homo sapiens
tactaaaaataatgtaaactgtatattctgccataatggatatcttgggatttgtcatgcaggtagtatatttcaagaacttctatccataatgtgtatcatgcttgcttcatttaaaatcagta

SEQ ID NO: 6787428 - DNA, 80 bp, Homo sapiens
tgctatttgaaaagagtctagagaaaatgatagcaggaacttattctatgacctttattatctctatatctaccaaggca

SEQ ID NO: 6787429 - DNA, 68 bp, Homo sapiens
ctctggctatggcacggcgctcagcttccccattcaccaacactgagtgctggctgaaaggcacagag

SEQ ID NO: 6787430 - DNA, 67 bp, Homo sapiens
tctgcactgagcatctaaccttataggcatatcttcctttcttgtgaatgtttattctcggtgcaga

SEQ ID NO: 6787431 - DNA, 61 bp, Homo sapiens
gctttgctggaatcaacgaatgtgcttaattcgaaggtgtctttgtcggttacagcaatgc

SEQ ID NO: 6787432 - DNA, 56 bp, Homo sapiens
atgtttcttgcaggtactggggtctttggaaacccttgcagtctagtgagaaatgt

SEQ ID NO: 6787433 - DNA, 109 bp, Homo sapiens
ggctcagggcctccagcggctgcacagctcagggcctggctgcggactctggcgtgcatggggtctgggtctgggctgtggagagtgagatgcatggacctctcgagcc

SEQ ID NO: 6787434 - DNA, 88 bp, Homo sapiens
cacagatcaaaggcgcagcccaggaggcgggagcccctgcacactttccacctctgctgggcttagcctcttggctggttggtctgtg

SEQ ID NO: 6787435 - DNA, 68 bp, Homo sapiens
gaagcaaagagctagtgccgcttcagatactcattcccacagaagaggatggttttagttcttttttc

SEQ ID NO: 6787436 - DNA, 59 bp, Homo sapiens
gagcagggcttgtcctcctcatcagacctgaccctgatagcaagggctgttttctgctt

SEQ ID NO: 6787437 - DNA, 63 bp, Homo sapiens
aacaaagaagactggttatttttggtcccacagaaaatccgagaatagcttatcaatcttgtt

SEQ ID NO: 6787438 - DNA, 56 bp, Homo sapiens
tcttgtcctttttaacgatcaagctttccagatgggaagtttgcagaaggatatgg

SEQ ID NO: 6787439 - DNA, 85 bp, Homo sapiens
gtgatgcaatcttcaggcaaatagggtgtttttgggggttctgaaagaaagattttgtttcatttggtttggtagattgtattat

SEQ ID NO: 6787440 - DNA, 80 bp, Homo sapiens
attaaaattgtaatgctgcttttcacagagacaagatttcaacccaatcttccgtaactggagtagcaaacaatgttgat

SEQ ID NO: 6787441 - DNA, 61 bp, Homo sapiens
atttccacaagacttgggttaagagaagctagcagtgacctcatcctagttttgtgaaaat

SEQ ID NO: 6787442 - DNA, 65 bp, Homo sapiens
atgtgacccttggtcagagtgccctagagaagctagagccaaactgtggcaaggccagtcttcat

SEQ ID NO: 6787443 - DNA, 86 bp, Homo sapiens
agaatcatatgctgaagaatcacagggactgacaggggaaaaatgtaaatgtcatagttttgctaattactttagcatgtgtttct

SEQ ID NO: 6787444 - DNA, 122 bp, Homo sapiens
tggcactggagctgggtttcctggtgactttactctctgtcttggcatttggtctgtgtttatagtcaaagcaacagacatgaggtaatgaagcagagaagggaatcacagaataatgacca

SEQ ID NO: 6787445 - DNA, 62 bp, Homo sapiens
agacggggagctctgcagcttaggaaggcttcagcctcctggttaccaagcagctctcctct

SEQ ID NO: 6787446 - DNA, 77 bp, Homo sapiens
ccccttgggtaggaaagggagtgaagggaaggtcactcctgagtttccatgctttcctctttctctccttgaggtgg

SEQ ID NO: 6787447 - DNA, 62 bp, Homo sapiens
tatgaatatgcttatacataatgtacaggtcatcttgtatgcttgtgtataatataattatg

SEQ ID NO: 6787448 - DNA, 56 bp, Homo sapiens
ggaaggcatctgacctcagggtgtctgggggaagccagaggaacgcagagctttct

SEQ ID NO: 6787449 - DNA, 92 bp, Homo sapiens
ggcaagagggagctttgatgtgcatactcttggccagcttgtattattagaaagctgttaggtcatgaggcacacttgcccctcctgttgcc

SEQ ID NO: 6787450 - DNA, 58 bp, Homo sapiens
tggtccatgtcctccatctctcctgcttatgaacaggagggctgggctctgtggatca

SEQ ID NO: 6787451 - DNA, 82 bp, Homo sapiens
gggtcatggtgctagttaaatcttcaggggggcatctcagtatatagctacctgttcaaggtattaattatcatcatgactt

SEQ ID NO: 6787452 - DNA, 67 bp, Homo sapiens
ggagcccgtcttccctccctgggtgtgtccatcagctctgcccaaaccaggctgggagggcagttcc

SEQ ID NO: 6787453 - DNA, 79 bp, Homo sapiens
ttctaggcaaatcacactatgtattgtatgggctggtggctgccatgcggccccgaatgctggttacgtttgatgagga

SEQ ID NO: 6787454 - DNA, 69 bp, Homo sapiens
tactgatatttgtattcctgttgcattgcagagtctattttgcattccacagtagtattttggtcagtg

SEQ ID NO: 6787455 - DNA, 64 bp, Homo sapiens
ctgagaaaagacatttctagatgatatagccagtgaatttaggaatttatgtcttagttttcgg

SEQ ID NO: 6787456 - DNA, 72 bp, Homo sapiens
catagcaccaaagtcctgttagggtctgctttctgttttccaccttgatggggctgttggagttttgctttg

SEQ ID NO: 6787457 - DNA, 56 bp, Homo sapiens
acaatggcggcgccaggccctaattggggacagaggcacccgcgcgcggccattgt

SEQ ID NO: 6787458 - DNA, 74 bp, Homo sapiens
ctattgtcagtgagtaaaggttcattgaatttttcttctgatgaataaaatggtcagttttctcagtgcaatgg

SEQ ID NO: 6787459 - DNA, 62 bp, Homo sapiens
ttacctggaaagatgatcagactctgcttccttttgcttgtcagagtcagattccaaggtga

SEQ ID NO: 6787460 - DNA, 62 bp, Homo sapiens
acctcatctgagaagagcatacaagtgtgatagcaagtcagcttttcccccagatggagagt

SEQ ID NO: 6787461 - DNA, 62 bp, Homo sapiens
aaagaaaaagaaggaaggtgctcagaaaaaggtttggctgaagttcctgcttcattgtcttt

SEQ ID NO: 6787462 - DNA, 60 bp, Homo sapiens
tcagtgcattaataatatcagtcttttaaaagaagagggctgacctttgagatgcactgg

SEQ ID NO: 6787463 - DNA, 73 bp, Homo sapiens
tagctttctggagcaagtgacctttacgctgatatctgaaaatcaagaaggagttatttattcaaaggagcta

SEQ ID NO: 6787464 - DNA, 59 bp, Homo sapiens
ggacccatgcgtttaatttctcttgggcaaatgcccagaagtggaatggccgtggggtc

SEQ ID NO: 6787465 - DNA, 58 bp, Homo sapiens
gggtgggtctggggtcctcttggccgcgacggtggctcgcgggccctggcgtccgccc

SEQ ID NO: 6787466 - DNA, 57 bp, Homo sapiens
agacttgttccactgccaaagaagtcactctctgatttcaacaaagggaataagttt

SEQ ID NO: 6787467 - DNA, 77 bp, Homo sapiens
atggggcagaatatttgaaatctgggttactctgggaaatccaggagacagtgttattttatttatggtgccactat

SEQ ID NO: 6787468 - DNA, 74 bp, Homo sapiens
aatcgctgaggcctccaacaagcagcagagcagcaatctctgctaaggcatttgcttggagtttgtctttgatt

SEQ ID NO: 6787469 - DNA, 73 bp, Homo sapiens
taacttacctgaatgtttccctttcctgattacatgccaggtaatactgaaagggaaatgtccagaaaggttg

SEQ ID NO: 6787470 - DNA, 66 bp, Homo sapiens
cttatccttgctgcctttgagctaagatgaagccttctctctgcttaacaacagcacagagaaaag

SEQ ID NO: 6787471 - DNA, 64 bp, Homo sapiens
tatatataatcctgaaaattgaatggaaggtatatcttcctttattgttttcagataatgtatg

SEQ ID NO: 6787472 - DNA, 78 bp, Homo sapiens
gaactaagtggtggagccaggaaatgtggtttgcattatcatatgtggcttcaagttttgcctccccatcctcagttc

SEQ ID NO: 6787473 - DNA, 78 bp, Homo sapiens
atacttgttgagagaaaaaatttattggtaaaactatctcaaagcttatcaatgaaattattctttcattttgggtgt

SEQ ID NO: 6787474 - DNA, 92 bp, Homo sapiens
gaaaagaacaaatctagaataccgtaactgaatcagacttgaaaatgatcatctgtacaagattttatgcgtatctacgatgtgttcagttc

SEQ ID NO: 6787475 - DNA, 62 bp, Homo sapiens
atctacaggaagagaaagggccgttatactttgagactggggttctttcctttgtggtagat

SEQ ID NO: 6787476 - DNA, 56 bp, Homo sapiens
gttccatgggcagctgagcggcgtgctctcttgtgctagccagtgcctgtggcaac

SEQ ID NO: 6787477 - DNA, 86 bp, Homo sapiens
caccccagattccagactatttatactgccagctgacatcgtatgaacttaagtttgtctttgcagtagaatggatttgtgttgtg

SEQ ID NO: 6787478 - DNA, 58 bp, Homo sapiens
agagtcctgaggactaacaggaaggagaaatgcttctcatgaaagtaccttaggttct

SEQ ID NO: 6787479 - DNA, 67 bp, Homo sapiens
agaggctgcctgcattctttggctcatggccccctcctccatctttgaagccagcagcgtagcatct

SEQ ID NO: 6787480 - DNA, 91 bp, Homo sapiens
cttggctgaggataatcgcaggatcacaaattgccttgttagagcatcagggctctaaaaggcacttggatgctgagtccattagccatag

SEQ ID NO: 6787481 - DNA, 67 bp, Homo sapiens
cacgtacagggataagatccggaacgcgttcctgcagaacgcctcagccgtggtcatcttcaacgtg

SEQ ID NO: 6787482 - DNA, 60 bp, Homo sapiens
ctctctgtaattcctctgcatgaagtcaattgattttggctgttgggaattattaaaggg

SEQ ID NO: 6787483 - DNA, 82 bp, Homo sapiens
taacttactggctcagtgcatcattccaggctctgattatcaaagctgtggatcttgattgtgtcctcagtgataacagtta

SEQ ID NO: 6787484 - DNA, 57 bp, Homo sapiens
atcatcctttgcttttgtgggtcccttctgtgtaggcctgcagatatataggatggt

SEQ ID NO: 6787485 - DNA, 82 bp, Homo sapiens
aaaacaatcgcaatgtctagtttcccaaatccgtgcgtaatggtacaggagttaggagtgctcagaacatctgtcttgtttt

SEQ ID NO: 6787486 - DNA, 76 bp, Homo sapiens
gtattcacacacatttagagcagaatttgattccaatactctaatcaatgaacatctagcaaagtgtggtgaatat

SEQ ID NO: 6787487 - DNA, 90 bp, Homo sapiens
ggtttgtcccggcccctgttggagtcattccttccaggcctgaaggctgtggactgaaagaaccggcagttaggggcggttagaaaaact

SEQ ID NO: 6787488 - DNA, 89 bp, Homo sapiens
aggaggtttcagaaaccctatattacaggcttgctctaggctgctcctgttctggggctggtaccgtaatatatggattgaatcctgct

SEQ ID NO: 6787489 - DNA, 58 bp, Homo sapiens
cgtaagaaatagcttgtcaaagcaggtagctgaggcatggcaagccatttctcatatg

SEQ ID NO: 6787490 - DNA, 119 bp, Homo sapiens
attagggcaatgtttaatttactgtctcatggctttttgagtaaatataaattgtcatactaaagtgacaggtgtaaaacccaggatggctgtgttagagaggttaatctgctgttaat

SEQ ID NO: 6787491 - DNA, 66 bp, Homo sapiens
tggaacaagggttcatttaaattgtaaggcagtatacaagcagcaattaaatgatatctttttcca

SEQ ID NO: 6787492 - DNA, 93 bp, Homo sapiens
gacctgtaggcagaatgggttgtaggccatttaggaaaggtgtatcctaaggaccagggcttccagcctgtggagattcctgtgtgcaaggtt

SEQ ID NO: 6787493 - DNA, 77 bp, Homo sapiens
cagctttatatttaatgaattctaatagatggtaggaagtaaagcgccatgagaaaagaatttttaaaaataagctg

SEQ ID NO: 6787494 - DNA, 88 bp, Homo sapiens
ggaggctggaggcccggccctgggacttggtctggggtttcttgaggaagatctgagggtccaagggaggaaggatgccctggccttc

SEQ ID NO: 6787495 - DNA, 55 bp, Homo sapiens
ggagtgcagtggctattaaccgatgtgatcatggcttactatagctttgaactcc

SEQ ID NO: 6787496 - DNA, 56 bp, Homo sapiens
ctacttcctgtcttcagtctctttgatttctttaaagactctccagagggaagtag

SEQ ID NO: 6787497 - DNA, 110 bp, Homo sapiens
gggggtgagagaggcctgagtgtgcggtccctgcctgaggctggcctggcttgtatccaggacttgcctggggagggattttgggagccactctcagcctccccacccct

SEQ ID NO: 6787498 - DNA, 63 bp, Homo sapiens
ccccagtgtcttcagagtaaatctttacaactgagagtttgtagctgaaggcaactaaagcgg

SEQ ID NO: 6787499 - DNA, 77 bp, Homo sapiens
actgaggaatgtagaggagtttctggtctgagggtaggcttttcagatctccaaggtgaagcatcctgtagctcagt

SEQ ID NO: 6787500 - DNA, 110 bp, Homo sapiens
acaagtttttgctgtgctttcctagcacttccatatgtacgtagcaggaggaggctgaatgccatctgctctgtctgccatgttgctgtaaatcacagtgagttttttgt

SEQ ID NO: 6787501 - DNA, 56 bp, Homo sapiens
agtactttgcactttgctcagacttacatgactaggaagagcagaaccatggtact

SEQ ID NO: 6787502 - DNA, 63 bp, Homo sapiens
ggcagctagaattgtgatgctgcacacaagcatctagacagcacataccacaatatcgttgcc

SEQ ID NO: 6787503 - DNA, 64 bp, Homo sapiens
gcttccagagttgcgttctcggtcttagtccttaatatgagatcagctccatcactctggaggc

SEQ ID NO: 6787504 - DNA, 56 bp, Homo sapiens
ggagaaagctatgtgggggagtccagagaaaaccaggcgcttccatggtcctctcc

SEQ ID NO: 6787505 - DNA, 74 bp, Homo sapiens
ggttggtacaaaagtaatcgtggcttttgctattgaaagtaatggcaaaaaccacaattacttttgcactgacc

SEQ ID NO: 6787506 - DNA, 96 bp, Homo sapiens
taattgagggtacaaccagttaagttacaaagcacttcaagtgaaatcattgtttcatcaagaagtgtctgtattttatgaggtaaactaagatta

SEQ ID NO: 6787507 - DNA, 127 bp, Homo sapiens
gcttttggcctttcaatcatcacttccagtgacacaatttcagaatttatcatctgtgctcctacaattttaaactctgatgaattggaaattctgattactgtggtggtttcacagaacctgaagc

SEQ ID NO: 6787508 - DNA, 83 bp, Homo sapiens
tattgcctgtttttgccctctttgttgatgtgtcttccctttcccagagggatatacagagaagggaggcaaaataaccaatg

SEQ ID NO: 6787509 - DNA, 75 bp, Homo sapiens
aattcaatactgcagccaggaaatatttgctgaaaggggattctatgcagtcatatttcttctgcaacttgaatt

SEQ ID NO: 6787510 - DNA, 68 bp, Homo sapiens
ttgcagtgaagtgtgcacatcttacaagtatagctcagtgaagcttcgtatatgtgtacaccatgtaa

SEQ ID NO: 6787511 - DNA, 56 bp, Homo sapiens
gaactgtataggagcagtgtttctttatttcactggaaatattttcttgacagttt

SEQ ID NO: 6787512 - DNA, 123 bp, Homo sapiens
tagatcaggctagagatggttaccatgaggcatgcaatttttggttctctatcttggttgaagtcactatgtagatattaaaaatggcagtgcttagagtgtggctttgaatcttatgattta

SEQ ID NO: 6787513 - DNA, 69 bp, Homo sapiens
gttagagggcctgctgctatgacttcctggggaagccttccacagggaatccagcaggaggttgctgac

SEQ ID NO: 6787514 - DNA, 64 bp, Homo sapiens
tgagacgtgggtcttcccttggctgtgtttaattcactcttctatggaataccaatgattctca

SEQ ID NO: 6787515 - DNA, 86 bp, Homo sapiens
aggtcctcagtcactgtttcctgtactggacagaaccacatttactaggctgtgcatcaagagaaaacagtggtgttggggcacct

SEQ ID NO: 6787516 - DNA, 76 bp, Homo sapiens
aggtgaactggacactagaatgaatctggaagattttaattgctctaggaatttcatctagttctcacagtgactt

SEQ ID NO: 6787517 - DNA, 78 bp, Homo sapiens
cagtgttttcaacaacttggttcaaatgggtttcccctaagatccacccacccatttggccattcagttgttccactg

SEQ ID NO: 6787518 - DNA, 55 bp, Homo sapiens
tcgaaccacgtagtaaacaacagaaataacttgttgtaataaagcgtggtgttga

SEQ ID NO: 6787519 - DNA, 117 bp, Homo sapiens
tggcagttgcttatattcttgtatttatttgcccactcatgcttttgataaatacacagggagtgcttatcaagtgccaggtgtggttctaggtactgtgaacacagcaacaaacca

SEQ ID NO: 6787520 - DNA, 57 bp, Homo sapiens
tcagcttgcaagctcaggtcccaggttcgttcctggaatccagggtgtgtaagagga

SEQ ID NO: 6787521 - DNA, 75 bp, Homo sapiens
gtattttctgtcctttagcaacgatgatgatatttgccaccagcgagtgtgatctgtgaggcgattttaaaatgc

SEQ ID NO: 6787522 - DNA, 108 bp, Homo sapiens
catccaaaaataattttaaaagacatctatttcaggcagctcatgtataaaatgattctgctgtgagtttggaggtctacagttatctttgaaattgtggcaggggtg

SEQ ID NO: 6787523 - DNA, 83 bp, Homo sapiens
ccacgaagaccatggctccccagttctcatggcactgcagcctggcagtgcaggtttagggctggggcctgctgtgtttgtgg

SEQ ID NO: 6787524 - DNA, 64 bp, Homo sapiens
gagtgaccaaagatatttttcagtacctctaatggtatgtgctggaaaagaactttcaacactc

SEQ ID NO: 6787525 - DNA, 69 bp, Homo sapiens
tcagggagctaggatcctgaaggtgggaagggagcagatgtccaccagacactgggcctggcttctaga

SEQ ID NO: 6787526 - DNA, 87 bp, Homo sapiens
atgtatggaagtttagtagggacagatggaagattgggctcagttgagcccttctttttctccattcagtctctggaaccctgacat

SEQ ID NO: 6787527 - DNA, 83 bp, Homo sapiens
ggttatgaaagagcaggagtgttctagatccactgccggatcccagtggaggctggcagggagtggagactccctagaagacc

SEQ ID NO: 6787528 - DNA, 65 bp, Homo sapiens
gctgagtggagcagtcagcgctggagagagcagagagagtagggctggcttctatagccaccagc

SEQ ID NO: 6787529 - DNA, 108 bp, Homo sapiens
gagcctcagtggccttacttctaaaatggacatcataactcatgctctggccacctccccaggctgtttttatagagtccatagtatagaaggtgctgctgatgtctc

SEQ ID NO: 6787530 - DNA, 96 bp, Homo sapiens
tttctggtccagtgtgtgagcttctggactctgcagagaaaagtaacttaaaaaaatttgctttgtgttccaggttcagcaggcactagccaggaa

SEQ ID NO: 6787531 - DNA, 86 bp, Homo sapiens
atcatagattatttaagggctattcctataagacgtggccagcttagctactgcctcgtaagatagaatttaccttgagctatgat

SEQ ID NO: 6787532 - DNA, 74 bp, Homo sapiens
ggtgctgtccctgggcgcctccgtgctctcagccaaccacctctgagagcgcccactcgagcgccccgggagcc

SEQ ID NO: 6787533 - DNA, 69 bp, Homo sapiens
aggtctcatcatgggaagagcgagccagttctgtttcacagggtttggctatttctcccatggtcacct

SEQ ID NO: 6787534 - DNA, 113 bp, Homo sapiens
tagacagggctccagctcccagcccagcgctcaggcctctgcatcacactggtccccaggagaggagatgctggcctggccatctggggatggaagcaggagcctcacgtctg

SEQ ID NO: 6787535 - DNA, 59 bp, Homo sapiens
gcagaatgttgtgttagatgaagtttctgcttgggaactaaatttgacagacaacatgc

SEQ ID NO: 6787536 - DNA, 97 bp, Homo sapiens
gcaggcacaagagtcttcatctggttaggtctctccttggcctgaaatgctggcccaggcttttgaggacaaagcccaggtgctggtctctgcctgc

SEQ ID NO: 6787537 - DNA, 64 bp, Homo sapiens
aggtagattctgtaaataatcaaggcattttattttaattaatggccttgttacagttctgttt

SEQ ID NO: 6787538 - DNA, 78 bp, Homo sapiens
ttactacaacttaatatttctccaaatgttttcaaaatggcataattggaaaaactggtgaaatgcagtctgcagtga

SEQ ID NO: 6787539 - DNA, 56 bp, Homo sapiens
ggagtcttggcctgctgagaaaatgcttgacagagtacatttcgaggcaagtctcc

SEQ ID NO: 6787540 - DNA, 83 bp, Homo sapiens
ctgtaaggtcctcccttctggggctggatgattatggcccaacagccaccatctccagtgcccaaaggaaatctcccttatgg

SEQ ID NO: 6787541 - DNA, 67 bp, Homo sapiens
ccccctcctacacttctaaggttggggtgcgagtcacttgaggatcctggcccaggtgtggaggggg

SEQ ID NO: 6787542 - DNA, 107 bp, Homo sapiens
aggcaaaccagtaaggcccggctaacagatattttcagaacattcattcacttcaaaatcagatcagtgaaaggttgagaatattctctgggaaatctggtctgcct

SEQ ID NO: 6787543 - DNA, 96 bp, Homo sapiens
gacatttacagataagggattatactactatcaagtagagcttgctttgatctttcaaaataaacttttgatagtctttcaatatatgtgattgtt

SEQ ID NO: 6787544 - DNA, 62 bp, Homo sapiens
gtttcacactgtcccgggtggaaaatgcaaaccctgtggattttcaccctctcagtgttgac

SEQ ID NO: 6787545 - DNA, 96 bp, Homo sapiens
ttcatgagcagggatttgtgtgtgctttgtttaccatgacatccccagtgccatggctggcacacagcaaccactaataaatacctgttgaatgaa

SEQ ID NO: 6787546 - DNA, 81 bp, Homo sapiens
agagggagtaatgagatttgaatgcagccagacatcagaaatgtagtcagactctttattgcactgtctcaatacccttct

SEQ ID NO: 6787547 - DNA, 57 bp, Homo sapiens
ctgtgtgtggtatgagtaatgctatagtcaaggcatgtgcaaagtgctacagtatag

SEQ ID NO: 6787548 - DNA, 62 bp, Homo sapiens
caagaggaggggagaggagaggagagtggtagcttgcattcttcttgtctgccctcacattg

SEQ ID NO: 6787549 - DNA, 128 bp, Homo sapiens
ccaaaggtaagtgttttatgaacgtcactcaatgctggtgcttactttcctcaaacctgcccctgtatatgtcacagacacattgcaggagagtaaataaaaggatttgggggcttcattttatacgg

SEQ ID NO: 6787550 - DNA, 63 bp, Homo sapiens
tatttttctggaagaggtgtaagtatattatcaaaaattataagaattcctttcagaaaaatg

SEQ ID NO: 6787551 - DNA, 57 bp, Homo sapiens
gttacttctgttagctctgagagttcagtttagatactctttggctaaagaagtcac

SEQ ID NO: 6787552 - DNA, 62 bp, Homo sapiens
cacagtcctcctgggcctgccttcctgcttgttgtattaggaaagctcccagtagggctctg

SEQ ID NO: 6787553 - DNA, 129 bp, Homo sapiens
ctggggccctggcccaggcccagtgtgtgcgtgcatggccgtgtgtatgcggggcccctggagagggacgggaggagaggtagcatcacacgcacatacacacacacagatgggctgggcctggcccag

SEQ ID NO: 6787554 - DNA, 90 bp, Homo sapiens
tgagaatcgcttgaacccaggagacaggttgcagtgagctgagatcgcgtcactgcacttcagcctgggtgacagtgcgagactgtctca

SEQ ID NO: 6787555 - DNA, 81 bp, Homo sapiens
cagactgagctgggacatggggagagcctctgtccccaggttgttttctgctgggcaactcccctccagagttcagttctg

SEQ ID NO: 6787556 - DNA, 57 bp, Homo sapiens
tagcttcgagtcaaaagacacagttccagtctcagctgtgtcactaactagaggcta

SEQ ID NO: 6787557 - DNA, 62 bp, Homo sapiens
cttctctctgcataggcatgggttttcaaacacaaccctggtgccatgcgtgcaaagggaag

SEQ ID NO: 6787558 - DNA, 74 bp, Homo sapiens
caagtatactagtgcagcatgtatttagttttcattaatttggaaaaaacatactttgctacattgtacatttg

SEQ ID NO: 6787559 - DNA, 77 bp, Homo sapiens
gaggtcctggttatagttctgactcccatttgctgtctaggtagccatgagcagatcactatacctctttggacctc

SEQ ID NO: 6787560 - DNA, 88 bp, Homo sapiens
aggggttttaaaaacatgagtgctgggcctccacccctgtactgtgggggtgacgcccaggcaacttcctatttagaaaacttcccct

SEQ ID NO: 6787561 - DNA, 68 bp, Homo sapiens
ggctaggggaagggcactccttggcagctctgcccagggtagaacctccagagtggccccctctttcc

SEQ ID NO: 6787562 - DNA, 79 bp, Homo sapiens
gaatacaattgaggagcagagatggggtatacagcaagcactctgtgtattaagtgattgttgttcctcgtctgtcttt

SEQ ID NO: 6787563 - DNA, 60 bp, Homo sapiens
ctctggtccttctgacaacctgcccttgggactgggtcaggggctcagaggggcccagag

SEQ ID NO: 6787564 - DNA, 83 bp, Homo sapiens
ataatatcacagggagtgtgcacacatggtatacagtccctgcgacatggtgtacacatggtgtacactccctgtgatattgt

SEQ ID NO: 6787565 - DNA, 70 bp, Homo sapiens
ctgggagaccccatgagaaagatacagagacagactttcctgcatccttccatgggtttcaaaaatccag

SEQ ID NO: 6787566 - DNA, 58 bp, Homo sapiens
ctctggcagaaggcagaaattcattttctttagatgagagctttagcttcagccagag

SEQ ID NO: 6787567 - DNA, 74 bp, Homo sapiens
gggtacacatgctccagtctccaggatctgtccctgaccaatctcctgagatgtggagctccatgtgatcaccc

SEQ ID NO: 6787568 - DNA, 92 bp, Homo sapiens
tgctatggagtgttaataggcttctaacatagctgtcatttcaagtaataggtgccaagctttcagcagcttattaacacattataacagca

SEQ ID NO: 6787569 - DNA, 80 bp, Homo sapiens
ctcgggccgggtcactcagctctacgggtgcgcatcaccctctacctgtcacccagtgagcccgaccgatgggcaccgag

SEQ ID NO: 6787570 - DNA, 114 bp, Homo sapiens
cagacatagaatgttcgctgcctttctaatgacattcacagagttatttttatgcttaatcaaatgagtctcagacagcttttgaatatggaaaggatgatacacaaatgtttg

SEQ ID NO: 6787571 - DNA, 102 bp, Homo sapiens
gcctgagaatgggttggaactggatttcatgtagctgtagttctaaaataattatctctcttgctgctatagattttaagttataactcaactgctaaaggt

SEQ ID NO: 6787572 - DNA, 72 bp, Homo sapiens
cttggctgaccagaacctgccccagttttgacacactcctctgtgcacagggtgaggctctgggtagccaag

SEQ ID NO: 6787573 - DNA, 130 bp, Homo sapiens
atgttgtttgggtctattaaatgtgatgcagaagtaaatgtgactccacctgagttgttctcattgaatgtgacacaggctcatcctgagtgtatttatttcgagtaccaccaactgacagggaggaaat

SEQ ID NO: 6787574 - DNA, 70 bp, Homo sapiens
gccgaggtcacagcccaagtcacctgcaggagcgaggttcttgtttggattttgggcagtaggaatcggc

SEQ ID NO: 6787575 - DNA, 58 bp, Homo sapiens
ctgggcctaggatggaagggcccctaaatacatccagccagtcccaatccagggccag

SEQ ID NO: 6787576 - DNA, 59 bp, Homo sapiens
tctcaggtgcagcatttgtaagcagctccctggctggttctgattttgctgcattgaga

SEQ ID NO: 6787577 - DNA, 60 bp, Homo sapiens
ctatggtctggaccgaggtccttgaatgccaggccccatgggcctcggacttcatcgtag

SEQ ID NO: 6787578 - DNA, 80 bp, Homo sapiens
ggaatgttttatccattgcagatttcttcttacctgttagtcaagctgatgggcattctgaaatcttggcagaacatttt

SEQ ID NO: 6787579 - DNA, 58 bp, Homo sapiens
gagaattcttttttaaggaatagaacagactttgttcaaatccaaagaaagaaatctt

SEQ ID NO: 6787580 - DNA, 56 bp, Homo sapiens
gccgcccttctgtgatcctgaccctattccaggctcaggaaacagcagggcttggc

SEQ ID NO: 6787581 - DNA, 68 bp, Homo sapiens
cttaacaattgaacagctgttacattgttacgagtttttgtggtggtggcgatagcagttggtgtgag

SEQ ID NO: 6787582 - DNA, 121 bp, Homo sapiens
gtcaatggtcttaagtaataaagataggtagatcttagtaatgaaaaatttactcgacccaacctgtctatggaaatttcattattctagaactgacctaagcttatcactgacacttgac

SEQ ID NO: 6787583 - DNA, 65 bp, Homo sapiens
tacgagcgctcttgctggccaacggatactgagtcttctgtgagtggtttgagctgggtgttgtg

SEQ ID NO: 6787584 - DNA, 69 bp, Homo sapiens
ttgtaagccctgcagtctctgccacagctattcaactcggctattgtggtgagaaagtagtgtggacaa

SEQ ID NO: 6787585 - DNA, 59 bp, Homo sapiens
agagtgacagccactgcagtaaccacaagaccgtggatgacttagtccctgctctctct

SEQ ID NO: 6787586 - DNA, 74 bp, Homo sapiens
gcttcactggcagacagcaaatagcaatgcaacagacgttgcattgcacgggcgtctgtctgttggagatgggc

SEQ ID NO: 6787587 - DNA, 55 bp, Homo sapiens
ctgagtgaggggagcttgatggtgtatatatattcctctcaaggacctcactgag

SEQ ID NO: 6787588 - DNA, 57 bp, Homo sapiens
tgaaacacaagcctggttagtggtatagttagtatatacttcaggcctgatgtttta

SEQ ID NO: 6787589 - DNA, 66 bp, Homo sapiens
gggcaggtttgtgttttcagtccttccctttcctgtgggagaaatgaaaccaaagcctagagcacc

SEQ ID NO: 6787590 - DNA, 71 bp, Homo sapiens
tatttggaaaagtttcttcaactgccgcccaatttatttataaaaggcagaagatgctttaatcacaaata

SEQ ID NO: 6787591 - DNA, 71 bp, Homo sapiens
tggtagtgggtgaccttgagcgagaactgacaagctgcgtccttgcagtcctcgtaaaggtcgaagcgccg

SEQ ID NO: 6787592 - DNA, 66 bp, Homo sapiens
tggtgctgtctactttgtgcagttcctgctactaaatagcagctaacctgtattgagtgattacta

SEQ ID NO: 6787593 - DNA, 65 bp, Homo sapiens
gcttgcacgggatgttcggccgggtcagaagtcccttctgcctgccgagaacacctaccgagagc

SEQ ID NO: 6787594 - DNA, 70 bp, Homo sapiens
gtgggggtctgaggaggctgtgaaacctctctgtccttggtcaggtcacaacgcctctgcaaatccttac

SEQ ID NO: 6787595 - DNA, 93 bp, Homo sapiens
tgagttcaggacagtgtttctgagttccagctcccttggaagtaattcatctgggtttgagctcattcagaaccatgctgtactgtcgcctca

SEQ ID NO: 6787596 - DNA, 57 bp, Homo sapiens
attttgaaatcacagtagctatcagactggctgctagacagcatgtgagctcagaat

SEQ ID NO: 6787597 - DNA, 64 bp, Homo sapiens
ctgtctctgtctctgttcgtctccctctctggcacctgtccaggaatgactgcagatggggcag

SEQ ID NO: 6787598 - DNA, 79 bp, Homo sapiens
aacatgagtacagatggatgtaagccagagtcttgatggcaggaagataaagacatgcttataggcatcatgcaatgtt

SEQ ID NO: 6787599 - DNA, 57 bp, Homo sapiens
tttctcaacattgtgagctgagtgcccaagagcattcaaaggcaatatgctgagaaa

SEQ ID NO: 6787600 - DNA, 83 bp, Homo sapiens
cctgcttaggcaaagcatgagctttcaaaccagatcccctgtaggcatttgggcagtgtaggacttggctggctttggacagg

SEQ ID NO: 6787601 - DNA, 71 bp, Homo sapiens
ccacaaattatgtagctggcctgtctagagccttactactcaaagtgtggttgcaggaccagcagcattgg

SEQ ID NO: 6787602 - DNA, 74 bp, Homo sapiens
atcttttcttttattatctttgaatgggactcattattgtctgagctatttattaaaatggtgaaggaaaagat

SEQ ID NO: 6787603 - DNA, 68 bp, Homo sapiens
ctgcagagctaggctgagtgaatgaagggctaggtgaggtctgtgaactgctgggcttgggtttgtag

SEQ ID NO: 6787604 - DNA, 55 bp, Homo sapiens
ccatggggaacctttgaacagggaaaaagaccctgttcacaggaggggcttatgg

SEQ ID NO: 6787605 - DNA, 73 bp, Homo sapiens
gggcttcagcttcaacatcctctgtgtgggtgagtgtcagggcctggcctcagacagagggtgggtgagaacc

SEQ ID NO: 6787606 - DNA, 58 bp, Homo sapiens
ggaagagggtattgcaaggactaggggggccatttagagtccaggcctgcccacttcc

SEQ ID NO: 6787607 - DNA, 76 bp, Homo sapiens
ggccgaggcaggtggatcacctgacgtcaggagttcgagaccagcctgggcaacatggtgaaaccccgtctctgct

SEQ ID NO: 6787608 - DNA, 79 bp, Homo sapiens
gaccttgaatgccttgcagacattccagagcttttccccttgggtgatggggagacgtggaaggtctagaggtcaggtc

SEQ ID NO: 6787609 - DNA, 68 bp, Homo sapiens
gggaagggggggcgcctgagatttgccagcccctcgggccctcaggtctctgcagcccctctgtgccc

SEQ ID NO: 6787610 - DNA, 65 bp, Homo sapiens
gcagagttcagtgacttggcctgtggtgggtttgcactgcagtaggtctgctaaactgtaactgc

SEQ ID NO: 6787611 - DNA, 60 bp, Homo sapiens
gcttattttcaccttctctcaggatggagcctcagaatagagaccaggttgaaaatcagt

SEQ ID NO: 6787612 - DNA, 130 bp, Homo sapiens
ctcctggtggctcaatggcactatctgtgactgtgttggatgcacacaggtggtcatctcccagtacagtgtgagtcattcagcacctcaagtcactgaagagtgcctgacagaccctaggccctcctag

SEQ ID NO: 6787613 - DNA, 55 bp, Homo sapiens
tccgaggccaaagctgtgaatagggtgaccccttctgggctgtggaagcctcggg

SEQ ID NO: 6787614 - DNA, 63 bp, Homo sapiens
gccttaaacaattgcctgttaagagtgagctttcaagcactatcataggtcattgcttggggc

SEQ ID NO: 6787615 - DNA, 79 bp, Homo sapiens
tgcggccagaaggttccacggcctaccagcgagccctggctcgtccaggaagatcggccgatggtgccgagctggccca

SEQ ID NO: 6787616 - DNA, 62 bp, Homo sapiens
ctttttaagcatctgctatgctagtgtgtgagtgcatgctagtgtgtgagatgttcaacaag

SEQ ID NO: 6787617 - DNA, 62 bp, Homo sapiens
agcctcctcaggaagccacagtgcctgagcccggaaggtgcgagtggttttctgaggagtct

SEQ ID NO: 6787618 - DNA, 122 bp, Homo sapiens
aaagacaaatgttgtattattccacttttctaaggcacctagagtcatcaaatctatagagacagactggacaatggtggctaccaggtcctggggagggtggtgattggggagttgttttt

SEQ ID NO: 6787619 - DNA, 57 bp, Homo sapiens
ctgaaggagcatagtcagtttttctttaagaaaacgtgcacttgtgcacctactcag

SEQ ID NO: 6787620 - DNA, 63 bp, Homo sapiens
gacatgatggaaaaaaatgctctgctgttttcttgttgcttttcatggttttagcatcatgtt

SEQ ID NO: 6787621 - DNA, 100 bp, Homo sapiens
tccctaaaaacagaatgtgtcaactatgttaataagtttcattatttatggtaacaatgaccctgattggcaagttgcacctcggactgtggactagggg

SEQ ID NO: 6787622 - DNA, 63 bp, Homo sapiens
ccttgtcctctggtttcctgtttctggccagtggggagccttgacaggagatctgaggaaagg

SEQ ID NO: 6787623 - DNA, 55 bp, Homo sapiens
gtgagacacgtgtgtgacctggtggcagcctgtgggatgtgcatgtgtaactcat

SEQ ID NO: 6787624 - DNA, 59 bp, Homo sapiens
tcttctgccttggactagattacagcaccagttttcctggttctccaggctgcagaggg

SEQ ID NO: 6787625 - DNA, 79 bp, Homo sapiens
ccctggctctgtgccccgatggtcccctccctgccccattaaggccaggagcccaggctggggttcagagtgtccaggg

SEQ ID NO: 6787626 - DNA, 87 bp, Homo sapiens
aaatgagatgaggataacatgtggagagaatggtgaaagtttgagatttcacacaaagctaaacacatgtgtgtacctactttattt

SEQ ID NO: 6787627 - DNA, 68 bp, Homo sapiens
gcatgagcagcgggcactccagcagaaatcttgaggctgcataatttgctgcggatgccccaaaatgc

SEQ ID NO: 6787628 - DNA, 62 bp, Homo sapiens
ctctcccaactcagactcgttatctccatcatggtggagggaccttgatgggtttgggacag

SEQ ID NO: 6787629 - DNA, 73 bp, Homo sapiens
taggacaggtgaggggctgtgggcacacaaacatttcacttacttaatggtggccatggccacatctgtgctg

SEQ ID NO: 6787630 - DNA, 56 bp, Homo sapiens
ctcccttctgagccttttgttaagttctcatggggatccacgaacctcagagggag

SEQ ID NO: 6787631 - DNA, 118 bp, Homo sapiens
tggggctcccaccaacaggatgaaggtcaatgcccttaaggtccctagaaatcctactgcttgattgaggaggaactgtgaggcaacccttcatctctgtagagtgactagagtctca

SEQ ID NO: 6787632 - DNA, 61 bp, Homo sapiens
cattcttcatcagccaagtttttgacctagctaattcagttactgttggaagtggagaatg

SEQ ID NO: 6787633 - DNA, 91 bp, Homo sapiens
tccatttagtatgtttttattgtgtaaatgtgggagtgtaggttttgaaagcccctatgttttacagtattgaaaattccaaactaaagga

SEQ ID NO: 6787634 - DNA, 83 bp, Homo sapiens
cacattacgggctatcgcttcatccgtgaagccaaagaaatgtgtttatttggtttggtttggggtgtgtgtgtgtgtgtgtg

SEQ ID NO: 6787635 - DNA, 76 bp, Homo sapiens
aggtagaaacaaaggaataagagtcaaaatggtttaattcagggccatgttgtatctcttatcggccttctgcact

SEQ ID NO: 6787636 - DNA, 60 bp, Homo sapiens
ggagtctcacagcaaggaggtaaggtagcagattgcccctcactaaggctgtggttctct

SEQ ID NO: 6787637 - DNA, 63 bp, Homo sapiens
gtcacaatgtttgagtaggagcataagattaaaaatattttattagcttttagattttgtgac

SEQ ID NO: 6787638 - DNA, 86 bp, Homo sapiens
tctaaaatcccatgatgctgagtcttgatatgtagatctgttttcttccattatgttgagcattcagtgatctctttggatttgga

SEQ ID NO: 6787639 - DNA, 56 bp, Homo sapiens
gtccagcaggcagcttcactgcccacaaaggcagctgaggccaatagcccctggac

SEQ ID NO: 6787640 - DNA, 85 bp, Homo sapiens
gtgacagagtgcttatttggaaaagggaagggacattatcatgatctgctgtcttctatatcatttccagatgctggtctgttat

SEQ ID NO: 6787641 - DNA, 55 bp, Homo sapiens
atgtggtgaatctatgtgtgactaattgaagttgcacacagtgatctatccacat

SEQ ID NO: 6787642 - DNA, 82 bp, Homo sapiens
ggtccctgaggagatccccccagaagtggtgcaggagtatgtggacatcatggaggagctgctggggccttctctcggggcc

SEQ ID NO: 6787643 - DNA, 100 bp, Homo sapiens
gatttggggtggagagttctgtagatgtctattaggtctgcttggtgcagagctgagttcaattcctggatatccttgttaactttctgtctcgttgatc

SEQ ID NO: 6787644 - DNA, 124 bp, Homo sapiens
agtggcaggttatatagatagactcttaaatttggggcaaagatgatctacaagttcattcattgacttgaatgaagttctattcattttctttggttggagatttatctgcattcttgttgct

SEQ ID NO: 6787645 - DNA, 69 bp, Homo sapiens
gcataatatgatttgtatgtcctgatatcttaaaatgtcaacatctagagactataagttatgttctgt

SEQ ID NO: 6787646 - DNA, 79 bp, Homo sapiens
aagatttggagttaaaggcatctcagctaagatccaggctctgcctttcagctggatgaatttggaacactctaaactt

SEQ ID NO: 6787647 - DNA, 78 bp, Homo sapiens
ttagtgacttagataaaactatgtttgtattagaagacctagtttacatatttgtcggagtctcaaaatggaaactga

SEQ ID NO: 6787648 - DNA, 82 bp, Homo sapiens
gctctgggaactggggagtcaagcatcaaggcaccagccagttctgtgtctgatgatagtgtctctcctggttcatagatgc

SEQ ID NO: 6787649 - DNA, 99 bp, Homo sapiens
tcacctggagcctgcattgtttcctctttaaatgcttttatctggctccccatgatgagccattagcagcactgtaaagtgatgcaagctacctagtgg

SEQ ID NO: 6787650 - DNA, 58 bp, Homo sapiens
cctgagcagctctgaggggcgagtctctgacggtggggctccccctcgtcctgccagg

SEQ ID NO: 6787651 - DNA, 68 bp, Homo sapiens
tcagtatcttatgaaccctgatcatgattcaccatcctaaaactgctctgatgtagggaagatgctgg

SEQ ID NO: 6787652 - DNA, 60 bp, Homo sapiens
gtgagagtggtttatgtccatgtagaaaatcttgactactgaacataaataactctttac

SEQ ID NO: 6787653 - DNA, 111 bp, Homo sapiens
ttaaatatatttttaccacaataatgactacaaaagcactgggtattaatattgttcttattgctgctattgccattgcttttatgatgtattaggtctaaatctatttga

SEQ ID NO: 6787654 - DNA, 74 bp, Homo sapiens
gtatgtatgtatatgtttaagagaaattactgaggaaactctgagggccatatctttaatatgtaaatacatac

SEQ ID NO: 6787655 - DNA, 63 bp, Homo sapiens
tcatttaaaatgtaccaggattaaaggtcatttaaatgactcatctctggaaacataaagtga

SEQ ID NO: 6787656 - DNA, 62 bp, Homo sapiens
gggctaggggaataatctgtggtagttttatgagtgaccatcattgttttttctcttagtcc

SEQ ID NO: 6787657 - DNA, 57 bp, Homo sapiens
ggattttctgatttgcatgtagtacctgcacatattcatgtaacattagagaaatcc

SEQ ID NO: 6787658 - DNA, 71 bp, Homo sapiens
cacagatgacaaaagatatctggttggtaatataacactgctatttccagtgaaccaggtgtttttcagtg

SEQ ID NO: 6787659 - DNA, 56 bp, Homo sapiens
ggctcagggaatgaggaagaattctgtcttttgacttctgtctccttctcctagcc

SEQ ID NO: 6787660 - DNA, 63 bp, Homo sapiens
ttttgaagcccagtctacgaaggccacataattcctcctagacattaagcttgggttttagga

SEQ ID NO: 6787661 - DNA, 58 bp, Homo sapiens
ggatgagggcagctatgtaagtgtaagtcattatcattaaactaaactgccttcctcc

SEQ ID NO: 6787662 - DNA, 85 bp, Homo sapiens
gtcttctaaggtctatgatatgcaaaagatactagttagagggggctaactgtagtcctagtaacttatgcgtgccttttgagat

SEQ ID NO: 6787663 - DNA, 73 bp, Homo sapiens
ttgtgaagataagaaaagtgggacccgtaaagattgagaccttggctaggttcacactttcatgatttcatag

SEQ ID NO: 6787664 - DNA, 83 bp, Homo sapiens
ggacttctagggaatttagtgtaagtgaggatggcatgtgaaacaaatgcctcctgacttacactgagcttataaagatctcc

SEQ ID NO: 6787665 - DNA, 56 bp, Homo sapiens
gtggattgaagcaattgttcctagctgccatgcagtggagatgcctctcagtccat

SEQ ID NO: 6787666 - DNA, 76 bp, Homo sapiens
ctcagactgtactcttctagccatctgaaatacgttttctaggtagagatagattgtgtaagggtacagttgtgag

SEQ ID NO: 6787667 - DNA, 70 bp, Homo sapiens
tgggtctggtttccatttggagctcgcagcctggcacccagcttgacagacagatggtagcaaaggccca

SEQ ID NO: 6787668 - DNA, 68 bp, Homo sapiens
ggactgagatgacactcaacccgtgttttccagaatgatggttgacgctttggctgtgtctcttctcc

SEQ ID NO: 6787669 - DNA, 81 bp, Homo sapiens
gtggggcgggtaggggttcagcccacagagggggccggcgggaagctgcacctgctggtcgggctgcatcttccggcccac

SEQ ID NO: 6787670 - DNA, 66 bp, Homo sapiens
tctgggaagacggatggaccctaaagagctagctgcaaactaagtgagtcacatttgtctcccagg

SEQ ID NO: 6787671 - DNA, 108 bp, Homo sapiens
gctggtgccctccaaaggcagtatctcacctcctgcccaccctcctcccaaccctcaggagggtgcttgcagtgagatgagatgccgcagggaataaaaaccaccagc

SEQ ID NO: 6787672 - DNA, 73 bp, Homo sapiens
gaaggatgaagggcgagtgagtctatggataatgaaataatcagtgactgaaaccattttcccatcatccttt

SEQ ID NO: 6787673 - DNA, 130 bp, Homo sapiens
gtttgattacatcaacaattgcatgttgatgtttgattacatcaacaattgcatgttgatgtttgattacatcaacaattgcatgttgatgtttgattacatcaacaattgcatgttgatgtttgattac

SEQ ID NO: 6787674 - DNA, 83 bp, Homo sapiens
tcgacttcttgtcttgtgtgtagaatagaacatgggaaagaacaaaaacgcttatggcaagaaacacatagataagaagctga

SEQ ID NO: 6787675 - DNA, 110 bp, Homo sapiens
ctactgtcttcttcctttattggtcttgtttttcttgtttgttttgtttattgtttggttggttttttagcacagaacagagaaatagccaataacatggagggcagagg

SEQ ID NO: 6787676 - DNA, 85 bp, Homo sapiens
ctaaaggggatttttggtggaatttttagttttctatgtatatgttgcctgagaacagagataattttacttccttcctctttgg

SEQ ID NO: 6787677 - DNA, 59 bp, Homo sapiens
ccagtatttgcatgttagggacctagactaggtcactgagagcacccaagtccctctgg

SEQ ID NO: 6787678 - DNA, 56 bp, Homo sapiens
gagtacatgtatagagattaacctgatcaaagattagtttagccccacgtgtgctt

SEQ ID NO: 6787679 - DNA, 64 bp, Homo sapiens
atgtttttaatacttcattacttaggtagggtcaatttgtattgtgaggtattaggacctacat

SEQ ID NO: 6787680 - DNA, 87 bp, Homo sapiens
ccttgggagaggatgagtgtattttgcacgtgagaagaatgattcacattcttctcacgtgcaaaatacactcatcctctcccaagg

SEQ ID NO: 6787681 - DNA, 58 bp, Homo sapiens
ggcttcacagttgtagcagctcaccaccaaggctcttagttctgccagctgtggggcc

SEQ ID NO: 6787682 - DNA, 80 bp, Homo sapiens
acagccccaccgtgtcagtagattattacaataaaggcccacatctcactcttgttgctggtgatgtgctattgggttgt

SEQ ID NO: 6787683 - DNA, 55 bp, Homo sapiens
ggtgaggggctcctctgcccggccgcccctactgggaagtgaggacccctctgcc

SEQ ID NO: 6787684 - DNA, 56 bp, Homo sapiens
tctgttgccctagcctagccattacaattgcccagtggcctttcttgggctacaga

SEQ ID NO: 6787685 - DNA, 68 bp, Homo sapiens
aggaaataagctggagctatattgagcacgtagagcctgctccgtttggaaagccagcttgaagtcct

SEQ ID NO: 6787686 - DNA, 61 bp, Homo sapiens
gctgctgctggtctggggccacactctgagaacacagaaaagcctgggggtgagcagcagt

SEQ ID NO: 6787687 - DNA, 69 bp, Homo sapiens
ttttaagatttttttgataattttgcgtaagggattattctaactgccaagattatcgaagtcttaaaa

SEQ ID NO: 6787688 - DNA, 63 bp, Homo sapiens
tctatagcaaattctttaggtgctttccatgcatgtgttgtaagctttaaggaattttatgga

SEQ ID NO: 6787689 - DNA, 59 bp, Homo sapiens
caactctcccaatcacatgcttttgtgtggtacataagagcatttaattaggagagttg

SEQ ID NO: 6787690 - DNA, 72 bp, Homo sapiens
tcattgaaatgtttccttttgtatgctgtattattaataattgcaaatacctaaatgggaacatttaaatga

SEQ ID NO: 6787691 - DNA, 66 bp, Homo sapiens
agagctcagaggggagagaggccagccccacagtgatggggagtccagccctcctcactgagctct

SEQ ID NO: 6787692 - DNA, 56 bp, Homo sapiens
tcagtgtgttaacccaggggcaggaatctgtctagtttctgtttgtagcttactga

SEQ ID NO: 6787693 - DNA, 79 bp, Homo sapiens
gtgcatttgttccatgagtaaggctataatcggtacttagaatcagaaaattagtttttagtcatggtatcagtggcat

SEQ ID NO: 6787694 - DNA, 76 bp, Homo sapiens
tggcagtaccatttgtcacacatagtttatcctaaattcaccactgagaatgaactacatgtgacaattgaagtca

SEQ ID NO: 6787695 - DNA, 93 bp, Homo sapiens
agaaagggtgaagccacagccacagggctctagggtagagctgtcttctcagtggccctagccatcctgtgctctgcttccttttccctttct

SEQ ID NO: 6787696 - DNA, 79 bp, Homo sapiens
atatgaccagctttgcattttgataagatcactttggctactgtgttgaaagatgttaggaaagttagggtggacatat

SEQ ID NO: 6787697 - DNA, 129 bp, Homo sapiens
gcctttatttcatattcatatatgctttaatagtatacaggtagatttgtattatgttcttcatttgtcattatcgtaaatacttgttcctgttgctatagagtctgcatgattattctatttgttggc

SEQ ID NO: 6787698 - DNA, 79 bp, Homo sapiens
cactcgatttattctccagatggcgagactgtgccgccctgccgcgagggaccacctcttccactggagtgtaaaagtg

SEQ ID NO: 6787699 - DNA, 76 bp, Homo sapiens
aggggcgcctccagacagctgggtgctcttctggctcaggctgtgagtcagggatccactgctcttctgtgcccct

SEQ ID NO: 6787700 - DNA, 84 bp, Homo sapiens
tacttaccgcacagtagtctctactctgcacttgaggattacagtagtattctcagagggaggattactgccgtgggttgagta

SEQ ID NO: 6787701 - DNA, 71 bp, Homo sapiens
tttcagtttaagacaagggggtgtagtggggaattatcgtgtaaaactacaccagtatcttaagcatgaaa

SEQ ID NO: 6787702 - DNA, 78 bp, Homo sapiens
ctaatggcacatgaagagagtctagtaatcacataattactttgccattactaagaaatcattttcagagtccatgag

SEQ ID NO: 6787703 - DNA, 130 bp, Homo sapiens
atcaaatcaaatttatattaaaaataagatctttagatgctgtattctccctctgaggagctgaaataaaagcagtttagaaatacaagtgaggttgatatttagcatatgaaaacatgaaaatttgact

SEQ ID NO: 6787704 - DNA, 73 bp, Homo sapiens
atgtgtatctttacttagtgacttatggagtcgtaactattaggacacatacagcagtaagtctaaggcatat

SEQ ID NO: 6787705 - DNA, 85 bp, Homo sapiens
gctgagagaaagaactaatgtgcaaggtttctgaatctggatttaaaaagaatctgagacattgtaatgttggtctgagtttagc

SEQ ID NO: 6787706 - DNA, 88 bp, Homo sapiens
cacttgtcccaggagaggaggctccctcaactctgggtgctcactgtgggcacccacagacaggcagcccttcagcagggtgcaggtg

SEQ ID NO: 6787707 - DNA, 59 bp, Homo sapiens
ggttgcaatttctggaactaattctgacaaactattgttggaagaatagagattgcact

SEQ ID NO: 6787708 - DNA, 72 bp, Homo sapiens
aacatggctgctcagtggagataattgctagtccttcttattagtagtttccatttctgagtttgctttgtt

SEQ ID NO: 6787709 - DNA, 69 bp, Homo sapiens
cctctgtgtatccaagttcaggtggccatagggcacggtggacaccatgaatagtgggtgtatgagggg

SEQ ID NO: 6787710 - DNA, 71 bp, Homo sapiens
ggagaaaatggaagacagataaggcagaaaatatgctttacaactttctgttctgtattctgttggaatct

SEQ ID NO: 6787711 - DNA, 129 bp, Homo sapiens
tgtctgtctggagatttgagttgttcttgctatctcccttttctctgttagcaaagtcagcaaatggttgaatcaaggtagacaatgaagtattcctgtttgtggtctccagtttctgtcctatagaca

SEQ ID NO: 6787712 - DNA, 57 bp, Homo sapiens
gtctctttctagcaggcccagggacacattatttcaccctgtggagcaagaaaagat

SEQ ID NO: 6787713 - DNA, 79 bp, Homo sapiens
gcaccgactggcctcaggcctctgcctcattggtggtcgggtagcggccagtagggcgtgggagcctggccatccctgc

SEQ ID NO: 6787714 - DNA, 74 bp, Homo sapiens
ccaggcccaccccagctggctcatgttgcctttccccaccagagagcctaggctgggcatgtctttgggtctgg

SEQ ID NO: 6787715 - DNA, 85 bp, Homo sapiens
ctgaattcagagaagtgtgggttttatggagccctgtaattttcaagcagttccactgatggcctacaaatgtactgagtgtaag

SEQ ID NO: 6787716 - DNA, 102 bp, Homo sapiens
aattctgcatccagattgttgggtctgcctcaagtgagccttttgtggaaggtcaccagagagcaggacttcactgagctgacccagcaggttataagaatt

SEQ ID NO: 6787717 - DNA, 60 bp, Homo sapiens
tctgaggggctggaagggctgctttcttgtgaaaaagagtcctttttgagtcccttgaga

SEQ ID NO: 6787718 - DNA, 58 bp, Homo sapiens
cacattttctaggttaaagcggttttatgtttgtttacacacaggcttaggaaatgtg

SEQ ID NO: 6787719 - DNA, 71 bp, Homo sapiens
ggaagttagagaatgaacaaatgtggtggagagtgctgattctgctctgcaagataatgttacgtgcttcc

SEQ ID NO: 6787720 - DNA, 102 bp, Homo sapiens
ggattctccctgcctccaagtggctctcccagtcaggctcaggattgggctcccagtcctgtgctcagacatgggggttcaaatttagtgctataaggatcc

SEQ ID NO: 6787721 - DNA, 84 bp, Homo sapiens
gcttaatatatttctatcatctagttattaaaaattgaatctaattaaataatggtagcaggtgtgatagaaattttttgtagc

SEQ ID NO: 6787722 - DNA, 119 bp, Homo sapiens
aacagtaggaaaggtaaacacagaagacagctgtttcactcgattgtggaaaaagcagagtgcatgtcctgggtgaatgcatttgttcctgtgatttatagtttcactctttccttgtt

SEQ ID NO: 6787723 - DNA, 77 bp, Homo sapiens
tgtgtcctggctttcttgctgcatggtggctggattccaagaatcagcatcgtaagaaagaaagccaggtagaagca

SEQ ID NO: 6787724 - DNA, 68 bp, Homo sapiens
agctgcaggactcaaatctgaaggcaggatagtctgcctctgaagtgattctgagtctctctggagct

SEQ ID NO: 6787725 - DNA, 58 bp, Homo sapiens
tagtgggaagatcagaactaacgtctgtctgacaccaaagcctctgcccttcccactg

SEQ ID NO: 6787726 - DNA, 60 bp, Homo sapiens
gcacacagggcagagagctggctcagggttcccgggggctctgtggttgtgctttgtggc

SEQ ID NO: 6787727 - DNA, 80 bp, Homo sapiens
tcatgtgcaaccagttttggggaaccactgaggtaggctggagtctggcctcttagcagttccttaaaggtagtctatga

SEQ ID NO: 6787728 - DNA, 81 bp, Homo sapiens
gcaaacatgtatacatagtaccacatttgacatggaacagacattcttttaagtggtagctagtattcggtaattgtttgc

SEQ ID NO: 6787729 - DNA, 62 bp, Homo sapiens
cagaataaacagaaacgtagctgtgtaaaggtatcacttagaactacgtttcgttagttctg

SEQ ID NO: 6787730 - DNA, 72 bp, Homo sapiens
ggctatcagctgcccaggaagcctggggtttccaggggaaccaaaggggtttctgcgcacccaggatgagcc

SEQ ID NO: 6787731 - DNA, 97 bp, Homo sapiens
cagaatctgtcccatggttaagccaagaccatctcttattgattaaaggtcaacaagaatgtagattagttaagctatgaagagacctaacattctg

SEQ ID NO: 6787732 - DNA, 58 bp, Homo sapiens
cagcatatctgagttgaaagagtagcgaacaatattcttttggttatgtaatatgctg

SEQ ID NO: 6787733 - DNA, 56 bp, Homo sapiens
aggggattttttgtgcaggtgtattagctatctattattgcataacaaattaccct

SEQ ID NO: 6787734 - DNA, 59 bp, Homo sapiens
tatataggcagtccagcccctcatttacttatattaggggctgacgaaggccatgtgtg

SEQ ID NO: 6787735 - DNA, 73 bp, Homo sapiens
gagacctctctattaagactcatttgcgatttggtaccatattgcaaatgagtcttaatataaaagatgtgtc

SEQ ID NO: 6787736 - DNA, 89 bp, Homo sapiens
gttttagcagtggatgcaggagttgatgaacagacaagcaagttctgcttctgtcctgtttcctcctgacagctccattcttttgaagc

SEQ ID NO: 6787737 - DNA, 109 bp, Homo sapiens
ctctttagtacattgaaagaaagtgcaactcagagaggtgaagctactcgtctgtcagcttgccagggagaggttgaaacctcagtgatgtcggcacttctttaaggag

SEQ ID NO: 6787738 - DNA, 101 bp, Homo sapiens
gggcggggcggggcggagcgggagctgcgggattccggcttcaggggcggggcaccggcctctgggcggagatctgctgccgcgttctacccttccggccc

SEQ ID NO: 6787739 - DNA, 60 bp, Homo sapiens
actgaatgcagatgtgggttctgagggctcctttctctttgaattcctgcagcatttagt

SEQ ID NO: 6787740 - DNA, 60 bp, Homo sapiens
gttttctgttattcagtatttgacatatgctcaggtgtggagggcagaataacagactac

SEQ ID NO: 6787741 - DNA, 77 bp, Homo sapiens
gaggaagttatcctgaaggttaactgtcagttatcctgactttcagggctaatgagatcatatcttctgagctcctc

SEQ ID NO: 6787742 - DNA, 76 bp, Homo sapiens
tatactgaggaatttttcatgactcaggaataaatttccatgaaacatcagagatttctctagctaatagggtgtg

SEQ ID NO: 6787743 - DNA, 55 bp, Homo sapiens
tgctgtttgagcttattttcagttgaacttctgctgagagaagaaagaacaagca

SEQ ID NO: 6787744 - DNA, 81 bp, Homo sapiens
ttttgctggcataagctctgttatccagagccctgattaaagttagaggccatgataaaacagagaccaaagtcagtaaaa

SEQ ID NO: 6787745 - DNA, 80 bp, Homo sapiens
gtgctgccctggtgtggaggcgggccttatgctcactgtatgcctaagaaagctggggcgcccccactccacagaagcac

SEQ ID NO: 6787746 - DNA, 129 bp, Homo sapiens
ggtccacttcctgttttactcaataaagttttattggaacacagccatgctcattctttatggattgtctatggctgcattcccataacaacagcagagttaagtagttgcgacagagactgtatggcc

SEQ ID NO: 6787747 - DNA, 82 bp, Homo sapiens
gtccctcagtttcttccattagggttctcaggttggcatgtgctttcatctcaggaggaccctgatgctgtgtttcaggggc

SEQ ID NO: 6787748 - DNA, 128 bp, Homo sapiens
ggtggccaggggtggaggggcagctgtggtcactggcccagtgggagggagctaggccactaggaaccggtcaggccagcaccatccctatccccatgctagccaccacacccaccagctctgccacc

SEQ ID NO: 6787749 - DNA, 63 bp, Homo sapiens
ggcacaggcctggagaggagaaagggcccagagattctcatgtgccctcctcttaggctggcc

SEQ ID NO: 6787750 - DNA, 85 bp, Homo sapiens
tttctttaccgctcaaggccgccccttcatgctcctgcgggggagttagcgggacctctggagtcggccttacgcaaagaagaga

SEQ ID NO: 6787751 - DNA, 91 bp, Homo sapiens
gaagactcgcttgaacccaggaggcggagtttacagtgagccgagattgtgccactgcactctagcctaggtgacagagcgagagtccttc

SEQ ID NO: 6787752 - DNA, 78 bp, Homo sapiens
gtcagaagcagtactatctgggaggaattagaatccagattatattaatcggtacctacatcctctcgacttcgtgac

SEQ ID NO: 6787753 - DNA, 68 bp, Homo sapiens
taggactttgagaattgttattaggtgagtttgacaatagcacagggtaataatgtctcagacaccta

SEQ ID NO: 6787754 - DNA, 64 bp, Homo sapiens
atattcaagtcaataggttagtaggtaccaaacactgtatctgacaacctattgacttgaatat

SEQ ID NO: 6787755 - DNA, 97 bp, Homo sapiens
ttttgcgatggagtctcgctctgttgcctaggctggagtgcagtgtggcaatctaagctcactgcctgggcaacaagagtgaaattccatctcaaaa

SEQ ID NO: 6787756 - DNA, 89 bp, Homo sapiens
ttctctttttgcctcttggcatctactgcaatttgagatttcactcctgactggtgatcaaggccagggaatgtaggggtagaggagag

SEQ ID NO: 6787757 - DNA, 73 bp, Homo sapiens
aactaaggctcaaagaagctaagtgacttgcccaccattactctgtaagtagctgaaagttgagtctttggtt

SEQ ID NO: 6787758 - DNA, 64 bp, Homo sapiens
ccgcaaggactggtcacccgcgctgagacaccgccagctgcctatgacctagcctccaaagcgg

SEQ ID NO: 6787759 - DNA, 79 bp, Homo sapiens
gaaaaagtgtcatggaaaattgcaatggcattgttttgatttaatgtcattggaaaatgtcttgacaatcaactttttc

SEQ ID NO: 6787760 - DNA, 88 bp, Homo sapiens
gggaagccagactctgtgtggacagtgatccctagtcataggaaactttgcctgtgctgtcatcagtgtccatggagaactgcttctc

SEQ ID NO: 6787761 - DNA, 86 bp, Homo sapiens
ggctctgctttcataacaagacctggagacctgagtggtataaacaactaaaatttatttcaccatcccagtatgggtgcactgcc

SEQ ID NO: 6787762 - DNA, 80 bp, Homo sapiens
gtggcgagggtgcaggtgggggtcggtgcatctgttctggccgcgcgcaggtgtgacctccctccttgaccttggcacgc

SEQ ID NO: 6787763 - DNA, 87 bp, Homo sapiens
gtggaattcaggcagtatttcagattcagaaatgtaggtcacaatttcttatctgcagttcggaagcctgaaaagcactgaaaacac

SEQ ID NO: 6787764 - DNA, 91 bp, Homo sapiens
gttcctgtcggaagggcgggcctgctcatcctggcgagaatttgcttttctgctttataggggattgcaggccaggcccactgacaggagc

SEQ ID NO: 6787765 - DNA, 71 bp, Homo sapiens
ggtgattctgccccactgtttggtattgagtaagaaagtaagaggatctcagagaactcgggcagatgacc

SEQ ID NO: 6787766 - DNA, 72 bp, Homo sapiens
cctctgaggtgaacttgtgtactttttattgattgattttgttttcaagatagttacaagtttattcagagg

SEQ ID NO: 6787767 - DNA, 77 bp, Homo sapiens
tgttaaaaaaatgactgtagtcatattaaggaataaaaggctccatggctacctaatgactgcaagttatttcaaca

SEQ ID NO: 6787768 - DNA, 69 bp, Homo sapiens
attgagctttgtatggtggcacttccgttcttcctcaagaactgagcttagtgattattcaaacttggt

SEQ ID NO: 6787769 - DNA, 68 bp, Homo sapiens
tccctgtgtgtatataaacggtggcgatatatacagcctattctaaactgtttatgatgatagagggg

SEQ ID NO: 6787770 - DNA, 83 bp, Homo sapiens
gagaatgtcttaccctgaaatcagcatgttcttaggagggatgtaaagtggggctgtatgttgactcagagtgagggtagctc

SEQ ID NO: 6787771 - DNA, 74 bp, Homo sapiens
gagccatttccccctgatttgtgtctgacaggggagcactgaggctgagatatcagggaggaagacaaaggctc

SEQ ID NO: 6787772 - DNA, 60 bp, Homo sapiens
ggtacacatttttctttctcttgcataatcatattttagagagagtttgtgtcaggtacc

SEQ ID NO: 6787773 - DNA, 66 bp, Homo sapiens
agaggcctggaattccagcctgggccatgggggcctgagctgtttaatcccagataacctgcctct

SEQ ID NO: 6787774 - DNA, 62 bp, Homo sapiens
agtggcagagctggtacttgagcctgggtctgcttggttctaaagctcaagctcttgccatt

SEQ ID NO: 6787775 - DNA, 68 bp, Homo sapiens
gtgttaatttattcattattatttgctgaatgcccataatgcaccaagcacaaagatgagtaaaacac

SEQ ID NO: 6787776 - DNA, 129 bp, Homo sapiens
taacttgccccaatttctatagagaaagtgagctatctaatgattgcattaagagactagagctacttggaagggtgtgaacattcagatcaagctcacatctctgagatcttagggatgtgcaagttg

SEQ ID NO: 6787777 - DNA, 98 bp, Homo sapiens
tgagagtcaggcctgaatctttgatgtgtgcccattcacaacgttgaccctattggtttgtggtggggcaggacatcgaagatatcattgactcatca

SEQ ID NO: 6787778 - DNA, 57 bp, Homo sapiens
tcccaacaggagtcagacctaggaggagaaaggtcctaggctcactcaccttgtgga

SEQ ID NO: 6787779 - DNA, 60 bp, Homo sapiens
ccactggccctttggtttatgactgagtcccagactcagtcataaaccaaagggaagtgg

SEQ ID NO: 6787780 - DNA, 78 bp, Homo sapiens
tgcttgaatctgctacatctacctatatagtatacgcagtatacaaagtagtcaaagtagatgatggtggaattagta

SEQ ID NO: 6787781 - DNA, 67 bp, Homo sapiens
ctgctctgaccctttcaccttccacaaggcggtttgttttcttagctgggagggtcagggatcccag

SEQ ID NO: 6787782 - DNA, 75 bp, Homo sapiens
gtgaacaaatagtaatgtggataccaataaagcaagagaatatctgcattggtaaaatacatacacactgtatac

SEQ ID NO: 6787783 - DNA, 69 bp, Homo sapiens
ggttcacaagagttacagacagacactttgctgtttttatttcagcagtttgtggttactgtgtgagct

SEQ ID NO: 6787784 - DNA, 55 bp, Homo sapiens
tcgatggcagtggtgtctgcacaggccagggccagcaagggtccactgtcacaga

SEQ ID NO: 6787785 - DNA, 57 bp, Homo sapiens
ctgggaggcgggaggcaggtggtgggaggaagccttctgcagcccaaagtctcttag

SEQ ID NO: 6787786 - DNA, 74 bp, Homo sapiens
tgggaatggggccagctggggaatctccactcggagccccacccacaaccagctggctgtgcccatggctccca

SEQ ID NO: 6787787 - DNA, 55 bp, Homo sapiens
ataacatgagccagattgaaagggagtgattttcattcatcttaggtcatgttat

SEQ ID NO: 6787788 - DNA, 83 bp, Homo sapiens
ggttaatgttagactatgtgatattttgacttgaattgcctgtgacaattctgtatgtacatatgtgtattagaatataaacc

SEQ ID NO: 6787789 - DNA, 77 bp, Homo sapiens
ttcggttaatcagtgtttcaaatgtaatctggggtttagtgccaggtggcatgcctgagacataaagattttatgga

SEQ ID NO: 6787790 - DNA, 65 bp, Homo sapiens
tcccttcaggggcacagtgtgcttccttgtggaggaggaaccagcagacaggcccagtggaggga

SEQ ID NO: 6787791 - DNA, 55 bp, Homo sapiens
cggggctccgaagagctcggttcagatcccggccgcctgggctccaggagccccg

SEQ ID NO: 6787792 - DNA, 65 bp, Homo sapiens
gctaggaaagggaagggctgggattcaaacacaggcagtttggctccagacctccctctcctagc

SEQ ID NO: 6787793 - DNA, 89 bp, Homo sapiens
acactagggtttgggcacagtcaaacttataggcacatttgaaaaataagtaaagtttttgtaagttgattctactcttcctttaatgt

SEQ ID NO: 6787794 - DNA, 56 bp, Homo sapiens
tggtctacagcagttacacacaggcagtggtatctgtgagcagctctgtggactca

SEQ ID NO: 6787795 - DNA, 74 bp, Homo sapiens
tttttctcagtatttgcattatctcacttatatatgtatgtgtcacttgagaatgtaagctccttggagaaaag

SEQ ID NO: 6787796 - DNA, 88 bp, Homo sapiens
gccgagcccaccgcccgcgtcggctttgcggcggccactgccctctagtggccggtgccgcgaagccgggcgccgtagtgagcgcggc

SEQ ID NO: 6787797 - DNA, 81 bp, Homo sapiens
gcagctccatttccttatctgcacaatggggataataatagcaccttccttatagggtgtgatgaggatcaaatgagctgc

SEQ ID NO: 6787798 - DNA, 67 bp, Homo sapiens
ggagaccccagtcaacccaagatttgcataaagcatgagcaagaaataaggctttgctggggtttct

SEQ ID NO: 6787799 - DNA, 76 bp, Homo sapiens
tcaaattaagatgaggtcatcctggattagggtagatcctaacccaataattggtggccttagaagagaaatttgg

SEQ ID NO: 6787800 - DNA, 62 bp, Homo sapiens
agttagaaggaattctagaaggttttgtttaagataacaaaagtgtaggaattccttatgct

SEQ ID NO: 6787801 - DNA, 71 bp, Homo sapiens
tccccagaagcatttggcatgaaactcttgttcttcaaagaatatctttcaggcctagtgtttaatgggga

SEQ ID NO: 6787802 - DNA, 119 bp, Homo sapiens
cattattaagtcttcgtaaatggcattattaatagctgcatgagtataggatagagaaacaccagtgtcttcttagtagccattatataatttccagtattttatgattattattaatg

SEQ ID NO: 6787803 - DNA, 62 bp, Homo sapiens
tgtgataatattttgaatcataagtttctcaggagattctgatagatttgagaattattgca

SEQ ID NO: 6787804 - DNA, 59 bp, Homo sapiens
tgtggttaaacatcaggaatgaaaacctctaggaggatttgcactggtgtttgagcaca

SEQ ID NO: 6787805 - DNA, 73 bp, Homo sapiens
gcttgccaaatattcaggcacctattatgtgccaatatgaatagcacataataggtacctgaataatgtaagt

SEQ ID NO: 6787806 - DNA, 62 bp, Homo sapiens
agttaccctgtctgtattggtttgctatggttgccataaaatatatcacagactgggtggtt

SEQ ID NO: 6787807 - DNA, 93 bp, Homo sapiens
agctttgtttaacgaagtaacattttgagcagtaggctttatcaataatttgttaggcctaagataaagtgatactctgtattaggcagggct

SEQ ID NO: 6787808 - DNA, 57 bp, Homo sapiens
gagctgccaagattacaatcagttgaattaacttagggctgtgttcttggtagattc

SEQ ID NO: 6787809 - DNA, 59 bp, Homo sapiens
gtcaacctgtcactctgaggagagaattctttttatttccagagtcttcgacggtaggc

SEQ ID NO: 6787810 - DNA, 58 bp, Homo sapiens
tagacacttatttagtgggagttaagatcttttaacctcatttccaagtaggtgtgta

SEQ ID NO: 6787811 - DNA, 75 bp, Homo sapiens
ctagtagttggaacctgagttctggctagccccaccaccatgggctaaactgctctggggttctaaataaactgg

SEQ ID NO: 6787812 - DNA, 77 bp, Homo sapiens
cagtgttcagagatggagttagcagtgacatctggataaaaaagattcacaattctgtttttcatctcttccccttg

SEQ ID NO: 6787813 - DNA, 61 bp, Homo sapiens
agagtgaggcccagccacctaggttttaacaggacctcccaggaatgctgaggctcacttt

SEQ ID NO: 6787814 - DNA, 62 bp, Homo sapiens
tctgactttggactggtctgggtgatgcaggacccataggccacggtcagcccacagtcaga

SEQ ID NO: 6787815 - DNA, 63 bp, Homo sapiens
taggacagagctggttacaatgctgtgtggttttgagcagcttacttaacctctctgaacctg

SEQ ID NO: 6787816 - DNA, 63 bp, Homo sapiens
gctcacagaggtacaagctaagttgggggaaaggttagcatccaaaatgtgtgctttttgagt

SEQ ID NO: 6787817 - DNA, 65 bp, Homo sapiens
agcagccttcctcactcccctagtaataaggcaacttgttctgggcctcctaggacaggcatgtt

SEQ ID NO: 6787818 - DNA, 59 bp, Homo sapiens
gtaactcgatgcaattcactttgtggaaccaagccacaaagtgaaaagcatcgaattgc

SEQ ID NO: 6787819 - DNA, 57 bp, Homo sapiens
ctgaccttgtgatctgcccaccttggactcccaaagtgctgggattacaagcgtgag

SEQ ID NO: 6787820 - DNA, 76 bp, Homo sapiens
agagttgcccaggccgcctggggagaggccctgtcaaggtccagcagggcctctggggggaggcttgggaggctct

SEQ ID NO: 6787821 - DNA, 112 bp, Homo sapiens
gtctaattcttgtacctttccttcactgtttcatcctacttctatgctcactgataaaaatgggcatgttggaagctcggtgcagagggtgaaggactgattaaaattagat

SEQ ID NO: 6787822 - DNA, 56 bp, Homo sapiens
tcaagcagcagatcaagagctagataccagagcctggtcttggtctgacagcctgg

SEQ ID NO: 6787823 - DNA, 72 bp, Homo sapiens
gatcacctggcttggtggtcacagccctgaggaatggagtttctggagaatcaccaccaggccagatcgatc

SEQ ID NO: 6787824 - DNA, 129 bp, Homo sapiens
ctaggaaggtgcccaggatgcatgttttaaggaagcactcactcttggggctttgcaagtacaaggctagcaatgggagatgagtgcctccttaaagttggcttcttgggccttgtttgcctgacctag

SEQ ID NO: 6787825 - DNA, 58 bp, Homo sapiens
cagcagggctgtgctaccccatgacacctctgagaatatggaaccaacaactctgctg

SEQ ID NO: 6787826 - DNA, 75 bp, Homo sapiens
ctcaggctcaggaagggtggtccacagggaaatataagtcaaataagccttatggccccaccctgaccgcttgag

SEQ ID NO: 6787827 - DNA, 67 bp, Homo sapiens
cccagtgtgactgtatttgagatagggccttttaagagacaattaaggttaagtaaggtcatatggg

SEQ ID NO: 6787828 - DNA, 66 bp, Homo sapiens
tttgtatttccatagagcagtaagtctggtgttttgtctgaaccctttcttgcttgttctaacaga

SEQ ID NO: 6787829 - DNA, 81 bp, Homo sapiens
aaattctctactgttttcctaatgagcaagagtgtataatttctggctacttctttttaggagaattaagctgagcaattt

SEQ ID NO: 6787830 - DNA, 65 bp, Homo sapiens
gcagttagtcagaagggccagtggatttgagtatttcagatcagattctgcctttgtgacactgc

SEQ ID NO: 6787831 - DNA, 63 bp, Homo sapiens
ggctgtgtcctgtatgattatttatggaaagagagtcagacaatcaggccgaggacatcagcc

SEQ ID NO: 6787832 - DNA, 95 bp, Homo sapiens
gtctaagtcctgcaggcaggtgggggagctagtccagctgaggccagtggtccagctggcctggcctctcctgcccgaagctgtgggatctggat

SEQ ID NO: 6787833 - DNA, 60 bp, Homo sapiens
gtgtctccaggatctcaggcctctctcaagcccaaaaggggcccaggatctctgaggcat

SEQ ID NO: 6787834 - DNA, 81 bp, Homo sapiens
ctatgctactctgaccaaagagttgcttgtattcggccctctagtggatgagacgtgtaatttttatggtaaggtgcagag

SEQ ID NO: 6787835 - DNA, 78 bp, Homo sapiens
acgtttcaacatctcctgcttttagattttgccttgtactatggcaagccagattccttaagcacagctttgaaaggt

SEQ ID NO: 6787836 - DNA, 75 bp, Homo sapiens
gtttgaatctcagggccgccctggtgtctccccaagaccttatcttgggagcacccgtggcctcaaggcttagac

SEQ ID NO: 6787837 - DNA, 80 bp, Homo sapiens
gtattggaggaatgaatagagttttatggagtccagtggagaaatcacagtctgcatatgacctgtagtgattccaatac

SEQ ID NO: 6787838 - DNA, 74 bp, Homo sapiens
gtatgtatgtgtatgcgtgtatgtatgggtgtttgcacacatgcacaggtgctgatgcacgcacatgtgagtgc

SEQ ID NO: 6787839 - DNA, 77 bp, Homo sapiens
gcagatttatgagaggggatgggtctacctggagtgacttgaggaatacccagaagaccccgtccacctcctcctgc

SEQ ID NO: 6787840 - DNA, 128 bp, Homo sapiens
gcaagagcccggttctggagtgggagtagaaggtacaggcattgctgcagcggcaggacaggagcccattgctgacagagtgcctggcctcaaattacactgtatcagagctcgggcataaaattggc

SEQ ID NO: 6787841 - DNA, 67 bp, Homo sapiens
gaatattgaaacggatgtgagacgtgcattttgggttacagtaacatgttttaagtcctctctattc

SEQ ID NO: 6787842 - DNA, 56 bp, Homo sapiens
aggcctgccttgagcaaccagcttggatagtcctgctgtgtgctgggcatggcact

SEQ ID NO: 6787843 - DNA, 71 bp, Homo sapiens
ttatctttgaagaggaaatgaatgcctattggatcttaaccctgattggcatttgacctttatgaagataa

SEQ ID NO: 6787844 - DNA, 64 bp, Homo sapiens
gatcactcccagcactgtaattctttggctattggtgcctgagatggccagtgctgggatggtc

SEQ ID NO: 6787845 - DNA, 63 bp, Homo sapiens
cggccagtgccgctctcgcctcgcggtctccgtggggcgccccgagggtgcgcacgtggcgcg

SEQ ID NO: 6787846 - DNA, 72 bp, Homo sapiens
cttccctttgagtcatcagcaggcaacactcttggcaactaggtcaaagagtgccttggtctggaagggagg

SEQ ID NO: 6787847 - DNA, 60 bp, Homo sapiens
tctccctgcaacctcaggactgatgatcataaggtgtctgtggagccctttgttgggaga

SEQ ID NO: 6787848 - DNA, 68 bp, Homo sapiens
ttggtgcacttcccttttggcataaatgaacttcagaagttccatgacaccgagggaagtctctccaa

SEQ ID NO: 6787849 - DNA, 63 bp, Homo sapiens
actgagggccttgacagttaagagaccttccaaaggtcacacaactgtcagaggcaaatcagt

SEQ ID NO: 6787850 - DNA, 83 bp, Homo sapiens
ctcaggtcctctttgggaagtgggagcaaggtgatgaaggaggaatgcacatgcccagaacttctcattagcaggtctctgag

SEQ ID NO: 6787851 - DNA, 104 bp, Homo sapiens
ggagcgcgatgagccagtccgcgcgcaggcgtggaacgccgagacgctggcgcggagccggctctgcggcgtgtgcgcaggcgcgaggtcggcggctcgccccc

SEQ ID NO: 6787852 - DNA, 70 bp, Homo sapiens
gctacatcaggcagaagcagaaagatgcttccccttgcttagggcatttgtctgtctactgtctgaatgc

SEQ ID NO: 6787853 - DNA, 78 bp, Homo sapiens
ggcttcaccctatgacctcatttacctctaattacttcagtaattgtcctcggtccaaatgaagtcacactggaagtc

SEQ ID NO: 6787854 - DNA, 63 bp, Homo sapiens
gaaagtggcagagtctgtacttggatccagatctacatttccattaggtacaaacccattttt

SEQ ID NO: 6787855 - DNA, 70 bp, Homo sapiens
aacttaacccgtcacatgccagtgcacacaggagccagacccttcgtttgcaaagtgtgcggaaaaggtt

SEQ ID NO: 6787856 - DNA, 102 bp, Homo sapiens
agctgcttccatacttcttcctggagggcttttggctgctgtgatcctgtagccagctataggcacatagtgtccggaacacctagaggtatttttgcagct

SEQ ID NO: 6787857 - DNA, 129 bp, Homo sapiens
gttgaaatgtcatgatctcccagctgtgagcaatgtttgagatagtccaggttaatccctgccttttagaaaggaagaaaggaaagcctggccactagctccacatcacccctaaaggtaataacaaac

SEQ ID NO: 6787858 - DNA, 78 bp, Homo sapiens
ccttgaagtgcctgagtcttatccataccagatatgccactatcgagaagcagatgacaggctcaggccttaccaggg

SEQ ID NO: 6787859 - DNA, 64 bp, Homo sapiens
atgtcagagtccctcagtggagcgtgttaacttgaagagctggtccagtggggatctctgatat

SEQ ID NO: 6787860 - DNA, 86 bp, Homo sapiens
gaatagcaaagtgacagggaagcagtcagcagtcaggcatcattcagctgcccaggataatgctgtccctgtgcacagggctgttc

SEQ ID NO: 6787861 - DNA, 63 bp, Homo sapiens
gccgatgttgtggcaatggggtctgcagtactggagctgcaagagcccaccacacacttcggc

SEQ ID NO: 6787862 - DNA, 56 bp, Homo sapiens
gacaggtgggttctcgtatctggttctgcattcagtctgttgtgataccacctgtt

SEQ ID NO: 6787863 - DNA, 129 bp, Homo sapiens
gccactctcccctaggcctaaaaaggatccctgctgcattagtgcatcttcagtgccggtgctcagtttggtttctgaggaattaatacagaacaggctcagctctagggaggcctctgggaaagaggc

SEQ ID NO: 6787864 - DNA, 73 bp, Homo sapiens
agttgctatgttatgaaccttaacctttgcatatacctctgttttattcatgggaggtcacaacttggtaatt

SEQ ID NO: 6787865 - DNA, 70 bp, Homo sapiens
cagctaaatttttccatgactgctttaaaagtgatttccatttaaagctaggtggaacaaattcctgctg

SEQ ID NO: 6787866 - DNA, 121 bp, Homo sapiens
tttagttgaatagcatttatattagtggatggtaccttccctttgtacctgcagagtatcatctcactttagcaggcagggatgggtgtctatgtatgtgtgtgtttgttgttctcatgaa

SEQ ID NO: 6787867 - DNA, 57 bp, Homo sapiens
tcatctcttttgtattggggtttgaattctagatcctgggagcatgaagagggatga

SEQ ID NO: 6787868 - DNA, 99 bp, Homo sapiens
ggtgcacggctctctggccctgcaggctcagactggagtgcccgtgagcatcctgggagcactctctgaagccctgaggggagcagcaggctcttcacc

SEQ ID NO: 6787869 - DNA, 75 bp, Homo sapiens
ggtcgcttggcaactctgctcctgtcctgtgcccccgtcagggtgctgggagcccaagggagctgccgggagacc

SEQ ID NO: 6787870 - DNA, 56 bp, Homo sapiens
tgcttagtaggctatctgaaatattaactatattaaggaacaaagccttttgagca

SEQ ID NO: 6787871 - DNA, 62 bp, Homo sapiens
tacttatataagagataaaatctgatttttaaaaatcagcaagattgtgtcttgtaaaggtg

SEQ ID NO: 6787872 - DNA, 59 bp, Homo sapiens
ttaaaaggaatccccccagctttaaaaaaacattggagcatagttgtggggccttttga

SEQ ID NO: 6787873 - DNA, 75 bp, Homo sapiens
tctgcccatgggtgggggctggaaatcttgccaggatttgtggccagaaaatggtcccccatggccagggacaga

SEQ ID NO: 6787874 - DNA, 70 bp, Homo sapiens
attggaacagaaacagacaaatagaatgaaaaagataatgagttctgtttgggacctgttgtgtttcaat

SEQ ID NO: 6787875 - DNA, 56 bp, Homo sapiens
atggaaagctttagaattgtactcagtcaagctgacagttcagacaagtgttccat

SEQ ID NO: 6787876 - DNA, 55 bp, Homo sapiens
tattcctatgttacagcgatccagcacaatactggttcttcatgacactggagta

SEQ ID NO: 6787877 - DNA, 67 bp, Homo sapiens
ccctcggcacatcttaattgttactgctcctaattggcccggcactgtcgattatgatgagtcaggg

SEQ ID NO: 6787878 - DNA, 84 bp, Homo sapiens
ttctgttcacttttatattcttggcttctaacacgtagtaggtactcattaaatatctgttagctaatgaatgagtgaaatgaa

SEQ ID NO: 6787879 - DNA, 62 bp, Homo sapiens
tctaggccgtaggatacagagcacagaatcagtgtgtgtgtgtttgtatgctatgacctgga

SEQ ID NO: 6787880 - DNA, 97 bp, Homo sapiens
gtgcagaaaactacctgaacgcaacggaaaagatttcaatgacatctcaatcaagtcaatggcattctctttttgttagcttgaggttaatttgtac

SEQ ID NO: 6787881 - DNA, 66 bp, Homo sapiens
gatgtggatgatcttagatggtttagtaggtaaaataatgatctgcctaagaggtccttccacatc

SEQ ID NO: 6787882 - DNA, 57 bp, Homo sapiens
ggcatttactagagccacattttgctgacttgagctagatgtagcaaaagaagtgtt

SEQ ID NO: 6787883 - DNA, 63 bp, Homo sapiens
gcagcacttggtcaatatccagcctcatctctcccatcttgaggagggtctgacaagtgtagc

SEQ ID NO: 6787884 - DNA, 76 bp, Homo sapiens
atgccattagtgcagacagctgcatgctgcttttagatcttaaaaagttatatgtgtctgtcgtgcataaatgtat

SEQ ID NO: 6787885 - DNA, 76 bp, Homo sapiens
gcagctctgttttccatggcatttcccttcttgtccaagtctgggacttagggacccatagagagaccagtgtggc

SEQ ID NO: 6787886 - DNA, 64 bp, Homo sapiens
gattaagagttatcagagagagcttactttcaagtaagtttaaccctctgggactaatggaatt

SEQ ID NO: 6787887 - DNA, 79 bp, Homo sapiens
cttctcagagagacctgagatcctcgacatttcctaaattcatggaaaacctcgacagtgttcaggactcccaaagaag

SEQ ID NO: 6787888 - DNA, 59 bp, Homo sapiens
ccattgaattagaaggggaaggagattcatgtcaggtgttttgctttttgatttaatgg

SEQ ID NO: 6787889 - DNA, 62 bp, Homo sapiens
gcaaaatcaagtgtatggttaagtcttattcataaagacatatgcctaatactggtttctgc

SEQ ID NO: 6787890 - DNA, 69 bp, Homo sapiens
acgggaccttggtgactgtttcctcatctgaaaatgagcagagtgggacacgggcgctgtctgtcctgt

SEQ ID NO: 6787891 - DNA, 69 bp, Homo sapiens
tgcactctgggaatcctcaccttccagtgaacacaccccatgaggagcagtgtggattccacggcagca

SEQ ID NO: 6787892 - DNA, 80 bp, Homo sapiens
gcctcctttgtgtcagattaatagcaataataagtgataatcacttgctacatctaaatctgactaaagcaggtggaggc

SEQ ID NO: 6787893 - DNA, 94 bp, Homo sapiens
cattttcacaggcccacttgaaatggagctcaatcttataagtatagaagtctggggtgagcgtctaggaatttcaacaggcactgagaaaatg

SEQ ID NO: 6787894 - DNA, 127 bp, Homo sapiens
gaatcacctgggcagccctcaaaaaaatgaaactactcatgcctgggtctcatcccagattaattagatcaaaatagctgagggtgaggcccaagcattggtttttaaaaattctccccaggggttt

SEQ ID NO: 6787895 - DNA, 65 bp, Homo sapiens
ttctaaatttgaagatcactctggctgctatgagtcagcaaggccagaggggcacaaaagtagaa

SEQ ID NO: 6787896 - DNA, 69 bp, Homo sapiens
gctatgagactgtggctgcgtgtaaggaactaagcaggttcttcttacctcagccatatttctcaaagt

SEQ ID NO: 6787897 - DNA, 57 bp, Homo sapiens
aggggcacgcgcgtttcttggcttagagttgtgagatctaagatggcaagtgtctct

SEQ ID NO: 6787898 - DNA, 56 bp, Homo sapiens
tcatcccctttccaagaatctttctcaaagattcctgttgtatggaggggggatgg

SEQ ID NO: 6787899 - DNA, 73 bp, Homo sapiens
tgcctaattgctcttagttttttcctcatgaaagcacttttacttttattattgtaattaagaaggtgaggca

SEQ ID NO: 6787900 - DNA, 82 bp, Homo sapiens
gtggggcagcacagtgtagcatggtagcaatgagagcagcttctgcagccagactaccttgattgtcacccagctcctccac

SEQ ID NO: 6787901 - DNA, 55 bp, Homo sapiens
gtcccacattaccctgactgacaactaagcaattgctagactgtgtgagtgggac

SEQ ID NO: 6787902 - DNA, 103 bp, Homo sapiens
ttgagacacagtcttgctctgttgcccaggctggagtgcagtggcacaatcttggctcactgcaacctccgccttttgggttcaagcagttctcctgcctcag

SEQ ID NO: 6787903 - DNA, 83 bp, Homo sapiens
agtaagtgcagctcctcaaatgtttcttgaacaccaacaacggggtccatgttgagtgctgaggatacaggagccactctgct

SEQ ID NO: 6787904 - DNA, 62 bp, Homo sapiens
gaacttggtgggggagggaatagatgtctgccgaccatattcacagctgccgcactcagttt

SEQ ID NO: 6787905 - DNA, 130 bp, Homo sapiens
tgtagagaaatagatttgtgctatacctcatgtatgaataaatggggctgttcctctcagccagacagaggtgaatagatcctcatttattgatttatctggagtgtttttgtttgtttgcttttggtta

SEQ ID NO: 6787906 - DNA, 55 bp, Homo sapiens
ttgcacaggcagtaattgcttggaagcaggtgtcaattatcaactgtctttgcaa

SEQ ID NO: 6787907 - DNA, 75 bp, Homo sapiens
agagcaacatctgtcccagcagctgggttctctgcatgagtgggcagagcgacacattgggacaaattctgttct

SEQ ID NO: 6787908 - DNA, 56 bp, Homo sapiens
ggatggaggcgggtgtggaaggtgctctgatgcagcagcccagatgccttccatcc

SEQ ID NO: 6787909 - DNA, 69 bp, Homo sapiens
acccggcctgttttgacattcttaatgatcttaataatttggcatctgaaagtctgaaacagtgtcagt

SEQ ID NO: 6787910 - DNA, 56 bp, Homo sapiens
ctttctgatccctgcaaccctctttcctcgagctgtcagggcacagggacagaagg

SEQ ID NO: 6787911 - DNA, 74 bp, Homo sapiens
gttctacaggctcagggagccctctctccttcagacctccactgtctgtaaatagattctctctgacttggaac

SEQ ID NO: 6787912 - DNA, 74 bp, Homo sapiens
cgggggcagggctgatgctgctggccagacataccggcccccaccctgccccagcagctgtggctttgcctctg

SEQ ID NO: 6787913 - DNA, 65 bp, Homo sapiens
gaggacaactagatcaaggcaagcacgtggcctgggtgtgcttcagcagggatcggggggtcttc

SEQ ID NO: 6787914 - DNA, 114 bp, Homo sapiens
ccaggcaggttctggccctgggtgctcctggccacccgacagaagtccgggatgggaaggccggatgtgtgtttgtgttgggggcagggaagagggtctaggatagggtactgg

SEQ ID NO: 6787915 - DNA, 80 bp, Homo sapiens
agtgcatacttttaatgactgtttaaaaggagggaagcaaataaactttcatcaatgaagaagttacctaaagttgtact

SEQ ID NO: 6787916 - DNA, 80 bp, Homo sapiens
gaaggcctgcttcctagaaagatgtcttttcactgtagcctcacatgacagaaatggggcgatatctctctggggccttt

SEQ ID NO: 6787917 - DNA, 67 bp, Homo sapiens
gattagctaaactctcaggttctttccagctcagatgtttttggattctgagagtctgtgcttagtc

SEQ ID NO: 6787918 - DNA, 72 bp, Homo sapiens
acaaggcctggaggcacccttcattgagtttgcatgagaagcatccaaacctcaaggtgctccagggcttgt

SEQ ID NO: 6787919 - DNA, 88 bp, Homo sapiens
gggaggaggggcttccccttcatttagtcaaggacacgtggcctgtggtcccccgatgtcctcctgaagggaagatccccccactccc

SEQ ID NO: 6787920 - DNA, 77 bp, Homo sapiens
agggagagagagaatgtttctgtggttcacaattttaggcaaagtcagtggtagaaaattctcatattctcatcctt

SEQ ID NO: 6787921 - DNA, 62 bp, Homo sapiens
tgttgtctgctactaggtagagtgaatatggctgacataattactctaccagggcagcagca

SEQ ID NO: 6787922 - DNA, 67 bp, Homo sapiens
ccagttcatgaaacctctaagaaatggaaggtcagaggctgctgttttcctgtggagacatgactgg

SEQ ID NO: 6787923 - DNA, 58 bp, Homo sapiens
gcaagactggagagtgaataattccctttagaagatgtattcacaaagccagtgttgc

SEQ ID NO: 6787924 - DNA, 106 bp, Homo sapiens
cattcacagggcagcagggagaagtgggccagggccaggcctccaggacatgggaaccatcctggggagggttctggctccttcccccagtgttgtattgtaagtg

SEQ ID NO: 6787925 - DNA, 78 bp, Homo sapiens
agttgaaggttggctgatccatgccaggctcagctgaatggctctgctttcagttctggatctggctggccttcgatt

SEQ ID NO: 6787926 - DNA, 86 bp, Homo sapiens
tcctacagagttcacaggattttatgagggctcaatgagtctacatacgtaaaatgctgttatattatttccgagtcatgtaagga

SEQ ID NO: 6787927 - DNA, 55 bp, Homo sapiens
tcatgctgtgaactgtatacatatgcatacctgcaatgtatattactggctgtga

SEQ ID NO: 6787928 - DNA, 60 bp, Homo sapiens
gtggcctggggtttttgaggctgtcagagagaaactgaattcttaaatccccagggccat

SEQ ID NO: 6787929 - DNA, 68 bp, Homo sapiens
gtcaatgtcttttgatacaagttacagcagagagcagctgcatgaagacttaaaaaagcaacattgat

SEQ ID NO: 6787930 - DNA, 72 bp, Homo sapiens
gttggtcattttaaactagtgaagtgtacctaaaatttaaggaaacacttagaattagtgtagaatgaagac

SEQ ID NO: 6787931 - DNA, 96 bp, Homo sapiens
tgcttatctgccctgcctaatttcttttacaggttaccaagtttcaaatgaaggcacaggcagccttgtagaagaaaggggcaggaataggaagca

SEQ ID NO: 6787932 - DNA, 60 bp, Homo sapiens
ccacaggcactgctaacttgggaggggttcagatacccctcctgggcacaggcctgatgg

SEQ ID NO: 6787933 - DNA, 118 bp, Homo sapiens
ttctatgactgtaacagaaataggaaactctcagctggtcatcacttctatttggtataagagtggcatcatatgtacttagctggcatttcctgattgactgttggtttttatagaa

SEQ ID NO: 6787934 - DNA, 102 bp, Homo sapiens
aatcaacacacgcttgctctgaatttatgcatgtggatagacggagatgtaatttaaacacatctgttcaaatatgcatttcagatcaacttggtgccgatt

SEQ ID NO: 6787935 - DNA, 69 bp, Homo sapiens
tgtaggaatggattctagaaggaagatgaagaaatgagaaagcatggtaattctagaactgttctctca

SEQ ID NO: 6787936 - DNA, 64 bp, Homo sapiens
ttgctctggacgctgagtggtttcatgctcaatttgaagcaactggctcattgtctcagggtgg

SEQ ID NO: 6787937 - DNA, 81 bp, Homo sapiens
agagaggcagccaccactgttcagtccaatgttggaaaatcctgctgaggttttcttgctgcactgaactattgcctctct

SEQ ID NO: 6787938 - DNA, 57 bp, Homo sapiens
ttttgagagccaaagactcaattatgtggcagaccttattaggagtggctttcagaa

SEQ ID NO: 6787939 - DNA, 58 bp, Homo sapiens
gccttcagtaactgagacggaatgtttagaatacagatctttatcgttgtctgagggc

SEQ ID NO: 6787940 - DNA, 86 bp, Homo sapiens
aaccatgaaatgacattatctgagagtgtcctacaacttcagctgttgtaatttcacacctcatggtggcctctgatttcaaggtt

SEQ ID NO: 6787941 - DNA, 86 bp, Homo sapiens
gtgagaggcaagacagctgaacaggtgggataaggcctttgttttgtggttgtttttgttgtcattgctgtttgttcagttctcac

SEQ ID NO: 6787942 - DNA, 59 bp, Homo sapiens
tgagcagtggggcctgcattctgccacccccatttgaaaaccatgccctagctagctca

SEQ ID NO: 6787943 - DNA, 62 bp, Homo sapiens
ggggcatttggtgagacagaaatcaagggtttggcttgggacctgatatgtttgatcaccct

SEQ ID NO: 6787944 - DNA, 60 bp, Homo sapiens
tagaggagccagactgtgcgcgatgggcttgggccagttgaaagatgtcttggttcccta

SEQ ID NO: 6787945 - DNA, 109 bp, Homo sapiens
gtccagcgagaacatccagaaacttcatttgcaagcttggggttaccctgaaggaaatcctcatggcttgcaagattcagttcctggggcttggctctctttcctggac

SEQ ID NO: 6787946 - DNA, 102 bp, Homo sapiens
gtgcatattaaagtttgagaagcccagctgtccttggaagctcagataaactggaggctacagtagataaggacggtcggggcacttgcttctgagtggcac

SEQ ID NO: 6787947 - DNA, 111 bp, Homo sapiens
gccttaactgcatcaaccgggtttacgaaacagcctgatttccagccccacccatcgcaactgcagctgtcaggtttcccggctcacgtttccctggatgagcagagaggc

SEQ ID NO: 6787948 - DNA, 57 bp, Homo sapiens
tctgccagtggattcttattctaggacccagaataaggaagagagtctaatgggaga

SEQ ID NO: 6787949 - DNA, 108 bp, Homo sapiens
tccactactaattgatcagagctggcacttgggacaaaatctatttgctctccccgcattaaggtattgtccagagtttctctttgttaaaatgtcaatacttgtgga

SEQ ID NO: 6787950 - DNA, 56 bp, Homo sapiens
gggggcgcaagcatgtgtctgggtgtctacaccgagcagggtgtttgcgcacgtcc

SEQ ID NO: 6787951 - DNA, 93 bp, Homo sapiens
cagtgccccagagcccttctgttcaggcctggcatcccacagaggtggcattctgctcaggagcttagagcacagacgaagaggcaggcattg

SEQ ID NO: 6787952 - DNA, 69 bp, Homo sapiens
gctgtgtaaggagccagtgtttgatgtctggggtcagaactgctgctcctgcaaatcatcggtctcagc

SEQ ID NO: 6787953 - DNA, 72 bp, Homo sapiens
gtagcagcggtggtgtcggcagcggctgtagcaaagagtttggcgcgatgtctcacaccattttgctgatac

SEQ ID NO: 6787954 - DNA, 94 bp, Homo sapiens
atgcacatatacatacaaacacttacacattgcagatcaaaatgagctgtctacatttatctgacagatggtctgtgtgtctgtacgtgtgtat

SEQ ID NO: 6787955 - DNA, 56 bp, Homo sapiens
gatacttgggtagaagtttcccaagcaattactttatcaaacagtgcctaagtgtc

SEQ ID NO: 6787956 - DNA, 75 bp, Homo sapiens
ctgttctgaagggcccgcagggcttaagggaggaaagcggcttcccacaggggctctgtgggttcttttggggag

SEQ ID NO: 6787957 - DNA, 111 bp, Homo sapiens
tcccaccaaagcttggcatggcagtggcaaatgcctgtgagagtggtggcctaggcagggtgcctgggtcttgttccccacactgcccaccaccagtcatggcgagtggga

SEQ ID NO: 6787958 - DNA, 90 bp, Homo sapiens
tgtacagattgtttgactgtaatatgaaggtcctattgctttttaaattaatgttccatagtagagctatgttacagccaaaaatgtata

SEQ ID NO: 6787959 - DNA, 112 bp, Homo sapiens
gatctaacgcctattctaatcactctaccttagcaggaaattgaataagggttgtgggatccttagcttacaagtcttctggtgactctgattaaaattaagaggttggatt

SEQ ID NO: 6787960 - DNA, 58 bp, Homo sapiens
gcaccctgccctgtcactggctagggctgggaggctctgtagaaacagggcagaaggc

SEQ ID NO: 6787961 - DNA, 59 bp, Homo sapiens
agtaatgtcctaaggctggcaggaagatgggaagttccctggcctggaaggatatcact

SEQ ID NO: 6787962 - DNA, 62 bp, Homo sapiens
aggtcatcttggcccagtggcttgttttaaaggaggaggaaactgagggccagagaggacct

SEQ ID NO: 6787963 - DNA, 59 bp, Homo sapiens
agccatcatttctgtcactggctatagcacatgcacagaaggacagtagagtgcaggct

SEQ ID NO: 6787964 - DNA, 109 bp, Homo sapiens
ggcatgtaatatggagataaaagtttgagaagcttatagatatctaacttgcaaagttggggaagagatactatgggttctgttttaaacacgttaagactgaagtgcc

SEQ ID NO: 6787965 - DNA, 79 bp, Homo sapiens
ctgatcatgctgggcagattaatgcagtggctgttgtttattgactggtcagtgtttcatctgtgaaagtcaagattag

SEQ ID NO: 6787966 - DNA, 91 bp, Homo sapiens
taattgcatgtgctttatttggtagtacctgacagtttattaaagcaaaaagaaactgttgtggtttatcattaaactcccactgtaatta

SEQ ID NO: 6787967 - DNA, 84 bp, Homo sapiens
gtcattatggacatcaaataactcttgtcactaactcagatcctactgaggcacttagagctatttgtctgtccattaaatggc

SEQ ID NO: 6787968 - DNA, 71 bp, Homo sapiens
attcagttattggaaaagggctgtaattgagtagggtagtaaatactaattgcttgtttctttaactgaat

SEQ ID NO: 6787969 - DNA, 64 bp, Homo sapiens
ctttatctagggtaagaaaaccaggaaaagaggtgggaatggtaagtctggactacagatgaag

SEQ ID NO: 6787970 - DNA, 81 bp, Homo sapiens
agccagaattactgcagtaaccactgtaggtgtgtgtggtgtggctttagacacttatttgtggtagtgtttattttggtt

SEQ ID NO: 6787971 - DNA, 79 bp, Homo sapiens
agtatttaaactgctccagagaatagagagggaagaaaatcatccaaactatttacaatggaatcaaaatttagatact

SEQ ID NO: 6787972 - DNA, 62 bp, Homo sapiens
gctttgtacatgttcagggagatccaagtgtttattggagattacttgaatgttgcagcagt

SEQ ID NO: 6787973 - DNA, 130 bp, Homo sapiens
cttgtgtaatttgacaaatgcagtcctgtctgttgctcagaagccacttgtctgccagactctaaggggcagcagtgccgcatcttgtgaccattcacacagctgactgtatgttttcaaggttcacgag

SEQ ID NO: 6787974 - DNA, 89 bp, Homo sapiens
agattaaatgagatgatacatgatacttagtacgtagtaagtgctgaagaaacatttgctgctatctttgttcacatcattattaatct

SEQ ID NO: 6787975 - DNA, 68 bp, Homo sapiens
ggactcttcatacagtcatctaatacagctaatatcaataatgctctattaaacagtatgtagagttt

SEQ ID NO: 6787976 - DNA, 72 bp, Homo sapiens
tttagatcacagcagcctcctcactggcatctttcaaggctccaagctgactgtgctgttgtgctgtttaaa

SEQ ID NO: 6787977 - DNA, 73 bp, Homo sapiens
gtgctatgttccttggtgaaatggaaatgttgttatacatacttccagggcagcaagtgaatggaatagacac

SEQ ID NO: 6787978 - DNA, 80 bp, Homo sapiens
ggcttgtctcacagtgcactaagctccggggcccggccagccctgggtgctggggacagggtgagactgggggagcagct

SEQ ID NO: 6787979 - DNA, 63 bp, Homo sapiens
ggcttctctcttcacatggctttccatgtggtttatccacatagtctttgtagcaggggagcc

SEQ ID NO: 6787980 - DNA, 68 bp, Homo sapiens
tctgaaagctgcactacttgagggaccaaggaaaatacttggtctatctcctggtgctgtgaaacaga

SEQ ID NO: 6787981 - DNA, 72 bp, Homo sapiens
ccagctatttgtaggaaaactgtactttggagatctacccagacttttcacagcctcctacaaaatgcctgg

SEQ ID NO: 6787982 - DNA, 70 bp, Homo sapiens
ttcttccctaaatagagtcagatgtaatgttctttccacattggccatctgctctgttttatgtgaagaa

SEQ ID NO: 6787983 - DNA, 55 bp, Homo sapiens
gtagcccacctggggagggcgagggggaggtcctgcagctgctcgcgtgggctgc

SEQ ID NO: 6787984 - DNA, 79 bp, Homo sapiens
ctcatgagcttgatttttatatggcattcagaatattctgaatgatatattgggaataatcacaccaagttctcaagag

SEQ ID NO: 6787985 - DNA, 68 bp, Homo sapiens
ttgcatactgtggagatttttcaggtttcttttcttctatttaatgtgaccaatccacacagatgtga

SEQ ID NO: 6787986 - DNA, 73 bp, Homo sapiens
gtgccagttctcataaatgacagagaagctttcaggatagaaatcctgggagtaattgagtcatgattggcac

SEQ ID NO: 6787987 - DNA, 55 bp, Homo sapiens
tatgtgtgtgtgtgtgtgtttgtgcatatatacagatatacacccatatcacata

SEQ ID NO: 6787988 - DNA, 62 bp, Homo sapiens
tctgagccagtatagaatagttaaggacaagggagccctgcttgcttctgtttgggcttaga

SEQ ID NO: 6787989 - DNA, 64 bp, Homo sapiens
cttccatccctgccattatagcccattgttcataagctcattgggtgatgacaggggtggctgg

SEQ ID NO: 6787990 - DNA, 77 bp, Homo sapiens
gggattgtgttaggatgcagattctgattcaataggtcttgggtaggcctgagaatctgcatttctaataagctccc

SEQ ID NO: 6787991 - DNA, 63 bp, Homo sapiens
tgcagagagatcctcagggttttacaaccaaaaagaaacagtagatttgatggcctctctgca

SEQ ID NO: 6787992 - DNA, 90 bp, Homo sapiens
tctgacatggctgatttgggttgacattgactgttttatcttcgtgacactctgtaatgtcacactcctacaaagatcctccttgtcaga

SEQ ID NO: 6787993 - DNA, 55 bp, Homo sapiens
tccattggtctctgtgcccaggtggttttggatcccttggagcagcgctaatgga

SEQ ID NO: 6787994 - DNA, 57 bp, Homo sapiens
tctgcctgagcagagggaggccagtcaagtccagcctctcctgctcctgtaggcaga

SEQ ID NO: 6787995 - DNA, 79 bp, Homo sapiens
gctgtgtccgtctcttttgaactcactggatgagttaacactcagccagttaaggcttagacaggctcggacttacagc

SEQ ID NO: 6787996 - DNA, 79 bp, Homo sapiens
gccagctgtggctctgacaggaggggtctctggccctatctccaggacccaggggtctctctgtcccaggaagcatggc

SEQ ID NO: 6787997 - DNA, 58 bp, Homo sapiens
actagcagaaactgatcatggctggactccactggccaggatagccagttctggtagt

SEQ ID NO: 6787998 - DNA, 76 bp, Homo sapiens
tggtcttgatctcctgaccttgtaatccacctgacttgacctcccaaagtgctgggattgcaggcgggagacacca

SEQ ID NO: 6787999 - DNA, 129 bp, Homo sapiens
cttcctcttataaggacccttgtgattatatggagcctttctagataatccaggataatctgcccatctcaaatccttaatgatgtctgaaaagtcaaagtaacgtatgacagggtccatgggattagg

SEQ ID NO: 6788000 - DNA, 56 bp, Homo sapiens
cacagtggcaaaggggcttgggccctgcattggggatgatcagccctggcgctgtg

SEQ ID NO: 6788001 - DNA, 55 bp, Homo sapiens
gggtcccaggtattgtgtgtgtacattaaagtttgagaagcactgccttgggccc

SEQ ID NO: 6788002 - DNA, 61 bp, Homo sapiens
tgtatataaggtaaagcgattgttaacgcgtatgtgtctatatgtgcgttacctgtatata

SEQ ID NO: 6788003 - DNA, 57 bp, Homo sapiens
aggtggctcacacctgtaatcccagcactttgagaggcctaggcaggtggatcactt

SEQ ID NO: 6788004 - DNA, 59 bp, Homo sapiens
tgggtgttttactttagctaatgctgcagagataatgcagacagagaaatgaggcccca

SEQ ID NO: 6788005 - DNA, 59 bp, Homo sapiens
gctctgactggtgggccacagtgatgttttggatctcttggaatgtgtcagttcagggc

SEQ ID NO: 6788006 - DNA, 66 bp, Homo sapiens
ttttaggaaagggttttctaacagaagttggttgcgtaagcttttgaggcaaactcttttctgaaa

SEQ ID NO: 6788007 - DNA, 68 bp, Homo sapiens
gctccaagaagtgtcagctttttaaattataaattaggttttttaaagagcatgggcatttaaggagc

SEQ ID NO: 6788008 - DNA, 80 bp, Homo sapiens
ttgattatacattcattgaagtcaagaactgtgaatttatgttcaacagtgtagtgtgatgtcaaaatgtgtataaacaa

SEQ ID NO: 6788009 - DNA, 103 bp, Homo sapiens
gtttacttccattttgtgcagaggttataaaatgagcgataaatgattttgaatccttgtcattggtaattatttttgacatgcacagtagatttgggaaaac

SEQ ID NO: 6788010 - DNA, 129 bp, Homo sapiens
gtaatttttatgaggtcagttgagtttagagttggagattaggtagccaccagggggctccagtgaggagttgtaaaggttttgttggttctcttcctggtgaatcctctgaatactgtgtaatgttat

SEQ ID NO: 6788011 - DNA, 93 bp, Homo sapiens
tgattccaatgagatgctgaaaactcaaccattgtgacaatttttcctctgtataatggacaggatttcagcttatttgtcctattgccttta

SEQ ID NO: 6788012 - DNA, 130 bp, Homo sapiens
cggagagagtgacagaacccaggacgagatcgggagactcaaggaatgacatagaaaggggagaggcatggggcgtcctcaagtcattccggagacctctgcccatcttccaccatgagaacacccagag

SEQ ID NO: 6788013 - DNA, 58 bp, Homo sapiens
gtggtcagtgagacaatttaagccccaagagattatgggctttgacttcactgcccac

SEQ ID NO: 6788014 - DNA, 109 bp, Homo sapiens
ttttagccgggcacattagggtaagcatgtctctgttccataatgtctgaggcctcagcttgcaggatgaaggcagaggctgaatctgaatctgcaatagaggctgaaa

SEQ ID NO: 6788015 - DNA, 58 bp, Homo sapiens
ttagaaaatggaggtgggagggtggttcttgacatccttagacatgttcattctctga

SEQ ID NO: 6788016 - DNA, 58 bp, Homo sapiens
agactcagacagaccaaagttctgtggccctggtgcatttcttaacctttctgagtct

SEQ ID NO: 6788017 - DNA, 59 bp, Homo sapiens
ctgatccatgaaggtgcctgcggtcataaccattcctgacccagagctcctggatgcag

SEQ ID NO: 6788018 - DNA, 101 bp, Homo sapiens
ctcttcctggggatctcagaggattgcctcagcgagcaggggagctggagaacaccccaggggctcaggctgaggcagcttctgtgggggccaaggaggag

SEQ ID NO: 6788019 - DNA, 70 bp, Homo sapiens
gatgcaagaaaggtctctgcccgctatttgcctaaaagcagggcatagtttttcaaagacaaaaggtatc

SEQ ID NO: 6788020 - DNA, 55 bp, Homo sapiens
ctaggaggtgacaggtgggaaaggctgcgacctcactcatctctgagcctcctgg

SEQ ID NO: 6788021 - DNA, 69 bp, Homo sapiens
ttacaagaagaggcagagctggaagttaacctgtggtgcttttttcatccagtgctgtttccaatgtaa

SEQ ID NO: 6788022 - DNA, 91 bp, Homo sapiens
ggtgcattaacttcctggaaccactaggctaccaattagtaacagactgcttctttgtgcctattggtgacccacaggagataatgtcacc

SEQ ID NO: 6788023 - DNA, 93 bp, Homo sapiens
gtctttctcactagactatctctagctctctcacctgctctctctctctgattgaagccagctgccaagttgtgagatgctctctggaaaggc

SEQ ID NO: 6788024 - DNA, 56 bp, Homo sapiens
gccaggcttccctgagaggctgccgtgagccaggtggcctccccggaatgcctcgc

SEQ ID NO: 6788025 - DNA, 85 bp, Homo sapiens
cctggccaccgagccccctggaacccatggccagtgtagagcagctacagcttgtctggtttcaggtccacctcagggtgtcagg

SEQ ID NO: 6788026 - DNA, 55 bp, Homo sapiens
gcttgccggagcaaacgtgcttgaacgtgtcttggttcttgcagccccagcaggc

SEQ ID NO: 6788027 - DNA, 89 bp, Homo sapiens
tccatgtaagccagatttgggtgtgtgcactggtttggttttgtttactttggcagctgctacaattcacatctggatatatatacggg

SEQ ID NO: 6788028 - DNA, 60 bp, Homo sapiens
tctacttctagaagtttaggcatcatcactctgtctaagtgccacctctctagcagtaga

SEQ ID NO: 6788029 - DNA, 114 bp, Homo sapiens
agtctttagcagttctgatgtggtaagtggaagagaagcaactagaacatcttgttctggaacacctgagttaccacttcgccactcacctttaatgaataaaaactgtggact

SEQ ID NO: 6788030 - DNA, 60 bp, Homo sapiens
ccagcacacagtctgcaccaggccaccaacaggtgggatcaatgcacagctgtgggctgg

SEQ ID NO: 6788031 - DNA, 84 bp, Homo sapiens
catttgaagttgacgtacaagtattcatgacattgcatatgcagtggaaacactcagctcatgattctgtatgagaagcaggtg

SEQ ID NO: 6788032 - DNA, 114 bp, Homo sapiens
gctgactaagacaggcaggagcaaatagtacacactgcaggcctgagaagagacactgtcacagtgcaccagtgtgaagcttgttgaagcctgcaaagaactggtcatcacagc

SEQ ID NO: 6788033 - DNA, 63 bp, Homo sapiens
ggctcagcccccacgcttcttcgtccactttttgctttattggaatgaaggtctggggttgcc

SEQ ID NO: 6788034 - DNA, 57 bp, Homo sapiens
tcttaagcatttggctctgtcttccttcaatagaaaagagctgggacttgcctgaga

SEQ ID NO: 6788035 - DNA, 66 bp, Homo sapiens
ttcctctttcttatattctgtcattgtttgctttggcaacagctactatcctagggccaggaggaa

SEQ ID NO: 6788036 - DNA, 58 bp, Homo sapiens
tctcctggaagtgattcccctgagtcacacctcagatatgggtctcccctttcagaga

SEQ ID NO: 6788037 - DNA, 69 bp, Homo sapiens
ccttaagttcaatgaactcagttctctcttgaaaggaaaagcacagaactgaggcaattgccttgtagg

SEQ ID NO: 6788038 - DNA, 55 bp, Homo sapiens
cacacactcattatatgtgtataatgcaaatgtatatgcatatatgtggtgtctg

SEQ ID NO: 6788039 - DNA, 56 bp, Homo sapiens
gtcaggggcagaaccaagggcacactccatcccagcttgtcctgtcctgctctgac

SEQ ID NO: 6788040 - DNA, 61 bp, Homo sapiens
ccatgagatcttaagctggttagggctttagagaagcagctggctgagctagagtccatgg

SEQ ID NO: 6788041 - DNA, 64 bp, Homo sapiens
tgaaagggacatagactgtacatctggagcacaaaggcaggtttaaccagctttgtcctgctcg

SEQ ID NO: 6788042 - DNA, 57 bp, Homo sapiens
aagacttatagtcagtaattcttacataatagacatttactgcatactatgggtttt

SEQ ID NO: 6788043 - DNA, 59 bp, Homo sapiens
tctgggaaccattggtggggatgggagagggggagcgtgcccacctctgggtccacaga

SEQ ID NO: 6788044 - DNA, 75 bp, Homo sapiens
ttcctctagcttttgtcttccgccttccccaggtaggttttctattcctggaggcaaagcagaggcatggaggaa

SEQ ID NO: 6788045 - DNA, 82 bp, Homo sapiens
tctctctacgtgaattctttccctgtcactcccatgctcctcagtctggaaggtgaaatggatggaatttgatgtgggtaga

SEQ ID NO: 6788046 - DNA, 69 bp, Homo sapiens
ctatattatgtgttgttgtgaagattaaatgagttaacataaagcactttagaacaatatttggtatag

SEQ ID NO: 6788047 - DNA, 56 bp, Homo sapiens
ctgctgaccatgaagtgggggaaactgaggctccacacagtttatccagttagcag

SEQ ID NO: 6788048 - DNA, 58 bp, Homo sapiens
ggccctttcctcccagcctcgggcttcctgtgcaagccactgaggaggaaaaggagct

SEQ ID NO: 6788049 - DNA, 68 bp, Homo sapiens
agacagcatggataacaaggcactacacatttgcccaaggatgttgagtgttccctgttcatgctgct

SEQ ID NO: 6788050 - DNA, 85 bp, Homo sapiens
aaacactaaggctcatgtaattagagataaccgtatctgtgaaactaactacaggtcctaagttatatgatactgaaagtcgttt

SEQ ID NO: 6788051 - DNA, 58 bp, Homo sapiens
tgacagacacaccttaggaaagtggccccaccggtttccccagcctggagtgctgtta

SEQ ID NO: 6788052 - DNA, 63 bp, Homo sapiens
gtggtctgtgaaaaggaagctcattataggttttatgtgatgagtcaccacagttacagtcac

SEQ ID NO: 6788053 - DNA, 104 bp, Homo sapiens
gtggtgaatgggcagtcaagtggatgcagagattgtttttcaacattactgaatcatgacagagtctgccatcctaaatcttggctaagattcctttacatcac

SEQ ID NO: 6788054 - DNA, 67 bp, Homo sapiens
gaatcaacaggtttgctgctgttttaggatttgccaattgttaacatagtggcgcatctgctgtttc

SEQ ID NO: 6788055 - DNA, 70 bp, Homo sapiens
ggagaatggctgtgttagatgctaagttgctcattgactgaggctgctttaactggacggctccatttcc

SEQ ID NO: 6788056 - DNA, 79 bp, Homo sapiens
tccaagtgtgacatttatcaaaaccttgacttttaatgtaaactttattatatgagttggggtttgagttgacactgga

SEQ ID NO: 6788057 - DNA, 63 bp, Homo sapiens
cgaaggaatcacttaacactttcaaagctataaatggtttacaaagtggtaaggattattttg

SEQ ID NO: 6788058 - DNA, 61 bp, Homo sapiens
ctgtagaggtgagatattttattttgctgtacactgtctgtaaagcaatctcttctcttag

SEQ ID NO: 6788059 - DNA, 55 bp, Homo sapiens
gcaatgctgtctgtgcacagatcatgaggaaggtctgtgggttttgcagagttgc

SEQ ID NO: 6788060 - DNA, 62 bp, Homo sapiens
ggggaattccctatccagtgtcctgtggggacacccagaaaggagcaccgtgggggatcccc

SEQ ID NO: 6788061 - DNA, 70 bp, Homo sapiens
ggggaggttctagagggacagggcaagtgagaagatgcaatgcaggtcagtcctgttcctgaaccttccc

SEQ ID NO: 6788062 - DNA, 69 bp, Homo sapiens
tacccttcaattattccctcctgttgcttcccatcttattgacttgtgtgcaggcagggaatgggggtg

SEQ ID NO: 6788063 - DNA, 67 bp, Homo sapiens
tcctcctttggcagtcagtcttggtgcttccataaggagtgtgctgtagaagggcttgcgtggggga

SEQ ID NO: 6788064 - DNA, 122 bp, Homo sapiens
tgaggtcattggagtgccaggaaaagtactagagactgtttagagagaccttgagaccactcagatgtgggatgcaattctttgtagaagctctccttcctctggcactgcatttaatctta

SEQ ID NO: 6788065 - DNA, 65 bp, Homo sapiens
agttttagatcattgtggatgttatactagggccatggaaaatgcctgttcacagatctgtaact

SEQ ID NO: 6788066 - DNA, 56 bp, Homo sapiens
gcttcatagcattcattgcctgtgcttgccacaccttggttgatgtgctgtggtgc

SEQ ID NO: 6788067 - DNA, 60 bp, Homo sapiens
acaaagtctgaaacctgaggcaatggacccacagaactattccttggtgtcagaatttgt

SEQ ID NO: 6788068 - DNA, 64 bp, Homo sapiens
caacacagttcagcacagaactgaaccaagccctctgcagaattcccttctctgagctgtattg

SEQ ID NO: 6788069 - DNA, 59 bp, Homo sapiens
gcacctaggctgctcaccaggctcagaggcggctctgaggtttactgacagccttgtgt

SEQ ID NO: 6788070 - DNA, 70 bp, Homo sapiens
gggctggagttggcaaggcatgtacagcaggacaaggtgataccaaactttatatgcagccaacactccc

SEQ ID NO: 6788071 - DNA, 67 bp, Homo sapiens
aaggcttctatgagatgataggcgttctaacaggtgaactgactccctggacatcactctaagcctt

SEQ ID NO: 6788072 - DNA, 79 bp, Homo sapiens
acagcatgtgcagacagggaccagcctgcccagggctagagcatggctggagccctggggctggtcttggaaatgctgt

SEQ ID NO: 6788073 - DNA, 67 bp, Homo sapiens
ggtaatatgaagtcagttccggttggtgtaaaacccccggggcggcggcgaactggctttagatgct

SEQ ID NO: 6788074 - DNA, 84 bp, Homo sapiens
gtgcccgagcaagtcagcaggactcagatttgcttgcagttgttagccaagctgatctcctgctgacacgtttagctcggggac

SEQ ID NO: 6788075 - DNA, 84 bp, Homo sapiens
gtggcagtgttgtcaagggcaatgtgaggaacaccccttgccttggagtgtcctgcgagtgcgcttttggtcagcagtggccat

SEQ ID NO: 6788076 - DNA, 82 bp, Homo sapiens
tcatgtggtactcttctcaagagggaggcaatcatgtgtaattagatatgattgacacctctgtgagtggagtaacacatga

SEQ ID NO: 6788077 - DNA, 71 bp, Homo sapiens
tgatgctctatttcttcacctacaaggtggttttctgtcaccttgctagaggctgtgtagagataagatca

SEQ ID NO: 6788078 - DNA, 59 bp, Homo sapiens
ggatctcagatctacagatctacagtggcaaggaactgagatctacagatctcagatct

SEQ ID NO: 6788079 - DNA, 60 bp, Homo sapiens
gccagccatctgaaggacaaggcgccgaggggtgctgcagacctcatgcaggtggctggc

SEQ ID NO: 6788080 - DNA, 62 bp, Homo sapiens
tgtgtcaggagatagcaaagggttcacatatatttccttagtgttcaaatttttcctgtaca

SEQ ID NO: 6788081 - DNA, 91 bp, Homo sapiens
tttaagtaaagaaacatctgcccaaaaagcttaggtaacaagcctccatcatcatgtggctttggcttggcttttgatctcttttctcaaa

SEQ ID NO: 6788082 - DNA, 59 bp, Homo sapiens
cggggacacactggcagctcctaccaattagtgacctaaccctgccagtgtgctctccg

SEQ ID NO: 6788083 - DNA, 70 bp, Homo sapiens
gccttccacaccttgtcacagtggccacttcctaaggaaggcctccctgtgtgcaggtgtgcagaagtgc

SEQ ID NO: 6788084 - DNA, 83 bp, Homo sapiens
gttcagcttaagactttttgcatttttgattgttgaaacattgtattagtcatgaaatgtatgagtctgggttctttgtgagc

SEQ ID NO: 6788085 - DNA, 129 bp, Homo sapiens
catgggctgtgatataaattttgacagcaatacagtaggtttattggtgagacaatgagtgaaattgcattgaatggcttctgtgttgctcgtgaaatgtgaggtgtgagtgacagttgagaggaaggg

SEQ ID NO: 6788086 - DNA, 120 bp, Homo sapiens
gtgtggtcctggaggcaggtctaattatcttgtgcagatgaaagaattaggatgtcataacctgactcatggaaaatctgcatactagatttgattgcttctgctcttctatgtttatac

SEQ ID NO: 6788087 - DNA, 65 bp, Homo sapiens
ctcaatggaataattgttattatatctatagagccagatggcacttggtgtaaacagccattgag

SEQ ID NO: 6788088 - DNA, 85 bp, Homo sapiens
ttagagaaaagagcttggaggttcaaggtctgagtttaacacttactgactatgtgactttaggcagattactttttttctctaa

SEQ ID NO: 6788089 - DNA, 71 bp, Homo sapiens
agtttgattgggctgaagtagagggcagaatcttaccagcctctgcttatttctgtttagcttttcatatt

SEQ ID NO: 6788090 - DNA, 62 bp, Homo sapiens
ccaattctttagctctggattaagcagaaagtcaggaagctatgctgtaatcagagtattgg

SEQ ID NO: 6788091 - DNA, 61 bp, Homo sapiens
tctccagcccttagataaacctggccgtgtacattggcagccaggaccgggggctgcggga

SEQ ID NO: 6788092 - DNA, 72 bp, Homo sapiens
tcctcccatctcagaggcaggaataaagcttaccttgttcagcaagcagagtactggctcttgggtggagga

SEQ ID NO: 6788093 - DNA, 59 bp, Homo sapiens
tgttgttagcaaagcaaaggttaagaaacaaaagatgactctgtgttttggtggcagca

SEQ ID NO: 6788094 - DNA, 107 bp, Homo sapiens
ccttctttttccttggtgactacaggccggcatcagagagtccgatttataacatgggctctacctttgcaatgcagttactttcttttccttggggagagggaagg

SEQ ID NO: 6788095 - DNA, 85 bp, Homo sapiens
ttctaaccagagcagcagttgttacaatgatgccttactaaaagaaggtagattattttagagattgcttaggtaaaggtcagaa

SEQ ID NO: 6788096 - DNA, 68 bp, Homo sapiens
gttctcaggactcctgcctgcttaggacaagtaaaagcttccatctcaagaggcaggacttcaggagc

SEQ ID NO: 6788097 - DNA, 92 bp, Homo sapiens
gtcttctcaaaatgggttcagattgacccagtgggtctatttataaatgtaaccaatgaaaggtcaattctataggtcataatttgagaagc

SEQ ID NO: 6788098 - DNA, 96 bp, Homo sapiens
agataggttaaaaagccatcagtaaaatgatttagaattcgtatgcacagtgaatgtgtgggccaagtcatttgctgaggtggcatctacctgtct

SEQ ID NO: 6788099 - DNA, 81 bp, Homo sapiens
cctgtctgctcaagccaggttccatggaggagcagaacttcatcctgctctgcatttagggcctgcctcggagacagtagg

SEQ ID NO: 6788100 - DNA, 65 bp, Homo sapiens
gttgccattgaggtaaaatgttcatggttagacagtgaactctgaattaattgctctcaatcaac

SEQ ID NO: 6788101 - DNA, 76 bp, Homo sapiens
ggtaattcaaaacaaatttcaagctgtgacaataaaatggttcttgtagtaggttggggtttgtgctgaaattgcc

SEQ ID NO: 6788102 - DNA, 64 bp, Homo sapiens
ttgcctagttctttagcttccgttggaccctctagggggctagcatggaataggaaagaggcag

SEQ ID NO: 6788103 - DNA, 70 bp, Homo sapiens
tattttgcgttgagtcagatttccctcgtgttaagacagtctcctgggaatgtctaaaaaatgtaaaata

SEQ ID NO: 6788104 - DNA, 84 bp, Homo sapiens
atacatttgcttcactcttcctttccttccagcccttaaggaggttattgtctaggaggaggtaagaaaagcataaaaatgtgt

SEQ ID NO: 6788105 - DNA, 55 bp, Homo sapiens
gttctgggttcagtgacatctgttatcacctgggagcttgttattaattcagaac

SEQ ID NO: 6788106 - DNA, 76 bp, Homo sapiens
ctacttgcttggaactgatttgtctatattcaaatatgatgatttcatctttgttttggatataatcagcaggtag

SEQ ID NO: 6788107 - DNA, 76 bp, Homo sapiens
gaccattccatcaggcaccccttgagtaggggatgaggtctcatcctctgaaatacatggtgatgtgtgggaggtt

SEQ ID NO: 6788108 - DNA, 73 bp, Homo sapiens
gctcaggcttgtggcggttgtgggcatccgagactgttttgtgcacttgtccaaagccgactgacatctgagc

SEQ ID NO: 6788109 - DNA, 72 bp, Homo sapiens
tattcactatgcacactcctagaccaaaaggtggccaaggaccaactgtgggagtgggagtgggagtggata

SEQ ID NO: 6788110 - DNA, 124 bp, Homo sapiens
aagagtagaggaaataatgtctataggttcacagttctgaggtctgcattacatagtgcagctctagtgtgtaattcagtgcccagcacagtcagaactacaagaagttatttactctcctctt

SEQ ID NO: 6788111 - DNA, 68 bp, Homo sapiens
ggatggggctgaaacatggaagagaggtacaagatccagcccttctggctccactcagccccacagcc

SEQ ID NO: 6788112 - DNA, 125 bp, Homo sapiens
cttttcctgcactgtcttcccttctgcttctgtatctttcttcaagattatattctcttcccttagatcttgttatagtaggatcagttcccaagcggatttgagagcagtttctcaccgagaag

SEQ ID NO: 6788113 - DNA, 72 bp, Homo sapiens
gccttgattctgttctccttgagaatgtgggatgttttataaacacattaagagttacaaatagagtagggc

SEQ ID NO: 6788114 - DNA, 63 bp, Homo sapiens
tcagaggggagaatttggtgtgctgcattataatagcctgtagatttctctttccctggctga

SEQ ID NO: 6788115 - DNA, 62 bp, Homo sapiens
cattgcttgtctcccatccccagacattctgtttactttgtctgggagagtcacaggcattg

SEQ ID NO: 6788116 - DNA, 62 bp, Homo sapiens
gcaggatccctggaagcaatgtttattttgagataaatctgacaatacctccagggacctgt

SEQ ID NO: 6788117 - DNA, 63 bp, Homo sapiens
tactgctctaggtccattgcgggaaataattctttatgttgcccagggtttctaagagcagta

SEQ ID NO: 6788118 - DNA, 67 bp, Homo sapiens
ggagctagttgcgtgtcccagaatggagggtgttctgacaccccaccctgagccgcaagagcagtcc

SEQ ID NO: 6788119 - DNA, 60 bp, Homo sapiens
gctgcagacttctcatctcattagttcttttagaatactgtgggtgaagacagctgtagc

SEQ ID NO: 6788120 - DNA, 104 bp, Homo sapiens
gagattgttgaacagctgctttctcttactatggagtcgacattaacattaagcaaaaaggttggagcataggaatgtgagtgaaagcataattcttcagtttc

SEQ ID NO: 6788121 - DNA, 75 bp, Homo sapiens
tctgggaatcttcaggatgattaaagtccctctctagccagttgcaatgactctaagtcctagatgattcacaga

SEQ ID NO: 6788122 - DNA, 83 bp, Homo sapiens
tctgtctagtactgtcagcagggtgttgaagtctcccactattattgtgtgggagtgttaagtctctttgaagtgctctaaga

SEQ ID NO: 6788123 - DNA, 57 bp, Homo sapiens
ggtactgccgtcatgaagggcccagttggctaagcacaggccttcagactgcatgct

SEQ ID NO: 6788124 - DNA, 56 bp, Homo sapiens
tggcttctaaaatgacatccagcttggttctccaacatgtgtgcaaatggaagcca

SEQ ID NO: 6788125 - DNA, 98 bp, Homo sapiens
tctaaaatttaagaagcactgtattcctactagaatctagatgattcatagaatctagattattctaatgggagttcaccgcttctgaatcaactaga

SEQ ID NO: 6788126 - DNA, 71 bp, Homo sapiens
gctggtcactatgtgtccctttgaccacgggtaaatatttctatttggtccctggaaggcactagtgatgc

SEQ ID NO: 6788127 - DNA, 93 bp, Homo sapiens
tcgatggaatcttatagaattagagagattttgatcacagtgatgtagtcccctagagaatctctccaatatctgcctgcctgataccatgga

SEQ ID NO: 6788128 - DNA, 96 bp, Homo sapiens
gacagcataaagttttgggagaatgaattatatgctttataaactaagacatgctaattactggttcaatcttccaatttaagtttttctgctgtt

SEQ ID NO: 6788129 - DNA, 75 bp, Homo sapiens
ttcggcagtggcagagtgcactcaggcaccatggcaaccagtgcgtcagcctgggtacacttagcagcagcggaa

SEQ ID NO: 6788130 - DNA, 66 bp, Homo sapiens
gcactctggcttggtaaaaacttctatacagtgtacaggctggcagaagccaagaacagacagtgc

SEQ ID NO: 6788131 - DNA, 63 bp, Homo sapiens
gccaactgttgcaaatctttgccagaaggctgccctcaggcagctggaatttgctcagctggc

SEQ ID NO: 6788132 - DNA, 65 bp, Homo sapiens
gctacagaatatttctgccctgagctcattatgaacagagttttggactgacttgtctttgtggc

SEQ ID NO: 6788133 - DNA, 58 bp, Homo sapiens
atccaaagatggaaagaactttactgaggtaaagtttatttatgttcatcatttggat

SEQ ID NO: 6788134 - DNA, 125 bp, Homo sapiens
cctcataattttataattcaatgcagctaaatgttgcttaaaatttggctccatatgtgtcatctgttaaataattaatgtagcatttagctgatttagaaagaattgaaatatttttatgctgg

SEQ ID NO: 6788135 - DNA, 70 bp, Homo sapiens
ggacctgtgtctacagcatgtgcaaccccaactttcctttatgccttgctttgcctggacaatcaggtcc

SEQ ID NO: 6788136 - DNA, 61 bp, Homo sapiens
gcgggtgatcacctgaggtcaggagtttgagaccagcctggccaacatggtgaaacctcgt

SEQ ID NO: 6788137 - DNA, 105 bp, Homo sapiens
gttggatttatcaacctcttaccatgatttaaaatactgtgttaagtttgggttttaatctaactgaaacgtatttttgagattggtgtgaggttgaaatctaat

SEQ ID NO: 6788138 - DNA, 87 bp, Homo sapiens
ggtgacccgcacgtgcagagcccctgggttgggagctggcagaagcacagcaccagagctatgggcctgcagagttcgggggaagcc

SEQ ID NO: 6788139 - DNA, 80 bp, Homo sapiens
gtttactttgtaaaaccagcaactcctgtagcttatgcatagttagtgccctatatgaatttgctgaggaccaagtgaat

SEQ ID NO: 6788140 - DNA, 125 bp, Homo sapiens
agctttagcccatgaattacttagtttttacagtctatgttgaattaagacagctttgttatattctggaaattgattacaaagtagatacattgatgaattgggaaattaatcggatcaaagtt

SEQ ID NO: 6788141 - DNA, 76 bp, Homo sapiens
tgaggcaccactgcactgcatcctgggcaaaagggtctcactctgttgctgaggacgcagtgcagtggtgccatca

SEQ ID NO: 6788142 - DNA, 57 bp, Homo sapiens
ccacagctgacaatggatagactgttatcaatcaaactgttcccattgcagttgtgg

SEQ ID NO: 6788143 - DNA, 65 bp, Homo sapiens
aggctttgatttctctggtccaatcctctcagtgtcaaggtgggtaggtggggagattaaagtct

SEQ ID NO: 6788144 - DNA, 81 bp, Homo sapiens
ttactaaataaggcactagcagaattagtgaggtagataggcttatttctttttacttgtggcagtgacttttcttagtaa

SEQ ID NO: 6788145 - DNA, 75 bp, Homo sapiens
tcatcatggctgtagccctgtgaattagtgccttgatgatagggccacagaacagctacaggacacccatggaga

SEQ ID NO: 6788146 - DNA, 69 bp, Homo sapiens
aggatcaagcagcaacatatatgaaactgtgcttcagcaggggaaatacagttatgttcctgggtcact

SEQ ID NO: 6788147 - DNA, 57 bp, Homo sapiens
agaggacacagatgaacatttattgagtgccctctttagaaatcagctggtgcctct

SEQ ID NO: 6788148 - DNA, 57 bp, Homo sapiens
tctctatgtgcacaccttggtgccataaatgaaaatacttttctgtgtacatatgga

SEQ ID NO: 6788149 - DNA, 93 bp, Homo sapiens
aaagatgtaactattttctttgttggcagtacattaagcaaaagttcattaaaagtgtgtgactgttaagaaggaggatggaaggatttcttt

SEQ ID NO: 6788150 - DNA, 76 bp, Homo sapiens
gtttctgggcgggatctggcggggagaggaaggaagaatgactttttctctgtgctgggtcctgaggcttgggggc

SEQ ID NO: 6788151 - DNA, 69 bp, Homo sapiens
catgttctgttgttgatctttggagggtacatcatccagttcctatccaaaggaacaatcacagccatg

SEQ ID NO: 6788152 - DNA, 55 bp, Homo sapiens
gcacctggctgcccaggtggagagcacattgccccgccgcttggcagtaaggtgt

SEQ ID NO: 6788153 - DNA, 79 bp, Homo sapiens
ccacccctgtcatgaagcctgctggatcaagcttatgctgttttcagtgaaagtgaatccagaggctttgcagaaaagg

SEQ ID NO: 6788154 - DNA, 118 bp, Homo sapiens
gtttgtttttgtttctggcaggtaggtagaatagagacagtttaacaatatagtcagagattgagatgatatatagttgggtttcattctacagatacacttctggtttattgcaagc

SEQ ID NO: 6788155 - DNA, 58 bp, Homo sapiens
tcagcagtggctctcatgcagtcaataggattggagggcgaggagaggccagtgttga

SEQ ID NO: 6788156 - DNA, 58 bp, Homo sapiens
gtcaggcagcctggagattcagggaaaagttatagtccaactccaaatgcagtctggc

SEQ ID NO: 6788157 - DNA, 72 bp, Homo sapiens
agcaaaacaaggggatgtttggatgctgggtctgtttatttagactcaagatctcatatcctaatgtgaact

SEQ ID NO: 6788158 - DNA, 56 bp, Homo sapiens
gtggcttgaccatccctgctactggaagtccatccagcagacagatgcacgcacac

SEQ ID NO: 6788159 - DNA, 68 bp, Homo sapiens
cactatagccagggtaaggtacttagtatgcttaaggtcgtgttaagttctaacttatcctgtgtgtg

SEQ ID NO: 6788160 - DNA, 75 bp, Homo sapiens
cttggcccggagccccatgaagctgccatcgcccagcccagcttgcatgaaacaagggccatgggaaactccaag

SEQ ID NO: 6788161 - DNA, 64 bp, Homo sapiens
ccagctctgtgcattgcccattaggcagtgcttccttctgtcctctgggctttgagcagtctgg

SEQ ID NO: 6788162 - DNA, 72 bp, Homo sapiens
atcacacatgccctccttctgcagatatcaagtgtgtcttggcagtcctgcacatggagggcaatgcctgat

SEQ ID NO: 6788163 - DNA, 55 bp, Homo sapiens
agttggtatttactgcagttggatattagtctgttttgcaaagtgaatagcaatt

SEQ ID NO: 6788164 - DNA, 84 bp, Homo sapiens
tttacagatttaagttgcgtgggtttgaatccagtcctgcagcccactactggggatctgggcctcacacacattatctgtaaa

SEQ ID NO: 6788165 - DNA, 89 bp, Homo sapiens
ttaggagacatgattagacgttgctgtgagatagattttagacttgaacatgtagaagagctgttcaacgtagcaatgagcattcctga

SEQ ID NO: 6788166 - DNA, 83 bp, Homo sapiens
gcttgaaattctagaaacttgatttagaactaaggctgccaaggcagaacccttaggatttagacaggtagcctagattaggc

SEQ ID NO: 6788167 - DNA, 122 bp, Homo sapiens
ggagtgcagtggtgtgatcatagctcactgtagcctcaactcttggactcaagtgatcttcctgcctcaacctcccaagtagttgagactacaggtgtgtgctgtctcacccagctaatttt

SEQ ID NO: 6788168 - DNA, 74 bp, Homo sapiens
aatgaggttcacttcctgaaatagctcttgaacacaggagtgaatgggctgtggattcaggtggaatatttatt

SEQ ID NO: 6788169 - DNA, 56 bp, Homo sapiens
tcttgaacttctgcacactcagcgaaaattatgctcgcgttgtgagaggtccaaga

SEQ ID NO: 6788170 - DNA, 70 bp, Homo sapiens
gagatgctcttgtcagatgattctcaggagacggcagtagctgtttcttagacatatgccatgacatttt

SEQ ID NO: 6788171 - DNA, 64 bp, Homo sapiens
ttcttaagtgagaaagcaggagaaagtcagaggaaaaagaatagatttacctgccatttaagaa

SEQ ID NO: 6788172 - DNA, 70 bp, Homo sapiens
cttcagtctagggtgcacttgatacaacttttaatttggctttttatcgtgcattctagcagctctgagg

SEQ ID NO: 6788173 - DNA, 61 bp, Homo sapiens
aggaatagatatggaacagagagatgtaaattgtatctttgttattgctttatctattcct

SEQ ID NO: 6788174 - DNA, 58 bp, Homo sapiens
tgttctgtgggtcctgctgcatctcccacctcacgggcagcagcaggaccccagagca

SEQ ID NO: 6788175 - DNA, 67 bp, Homo sapiens
cctggagcacagaggagcctgggtctccttttcatcatgctcttctgtggctctcaccacccacagg

SEQ ID NO: 6788176 - DNA, 129 bp, Homo sapiens
ataagaattccgtagggagttttaggaatacagaagactagtctttaccttcagagatttggattcagtaggtctcaggtagggcctaggaatctgtgtttagaaaatcactctaagtaatgctaatat

SEQ ID NO: 6788177 - DNA, 72 bp, Homo sapiens
cctttcaactttttactaggaagctcaaatagtccttcaggcaaggcagtttagtgaaaagaaaatgagtgg

SEQ ID NO: 6788178 - DNA, 129 bp, Homo sapiens
atatggttttattctggacacagttttataaatttattgaagaacatctgtgatctctttgggagtatttatgattcccaacgttatgcatgattcttttattatgaatgcttgtctaggtttccatgt

SEQ ID NO: 6788179 - DNA, 79 bp, Homo sapiens
ttgcctttagccagctggacagtctacatttgtatataccctttagaggagtacagatgacttgtctgctgtaaggcaa

SEQ ID NO: 6788180 - DNA, 84 bp, Homo sapiens
gcatggtgactctgtgtcagctgggtgtgcatgggtaccctgcattgttgaccagttgtgcatttgagctaatatttaccatgc

SEQ ID NO: 6788181 - DNA, 94 bp, Homo sapiens
ttgagactggatgcttccttaccagaagatgaagagtcctcacagcctgtgccggatttctcactttctgtgggaatgtgtctccctgtttcag

SEQ ID NO: 6788182 - DNA, 129 bp, Homo sapiens
cttcttttgaagcacgatttgctccctacaagccacaagacattttgttgaaacccttgttgtttgaagtaccaagcataacaacagactctgtgtttgtgggaagggattggctctttcaccagatag

SEQ ID NO: 6788183 - DNA, 121 bp, Homo sapiens
cctccagacctccccaactcctcgcctccccacctccctgcctcttggcgtcagcgaaggctctgctgcctgcagggcagagaggagagggaggaggccagcgagagggagcctctgtcgg

SEQ ID NO: 6788184 - DNA, 58 bp, Homo sapiens
atgtgcagcctttcttcatcatgtctgtcaccttatagtcacaagatggctgcagcat

SEQ ID NO: 6788185 - DNA, 84 bp, Homo sapiens
cctctgtgagatgtctggagctggagggcaaggcacacacggacagttcttgcttgccaaggagctctgcccatcttagggagg

SEQ ID NO: 6788186 - DNA, 60 bp, Homo sapiens
tttttggtatctcgtaattagatgttttattgtgagacattgatactgagatacaaagaa

SEQ ID NO: 6788187 - DNA, 66 bp, Homo sapiens
tgcacattcacttaggtattgtctatagctgctttgtcacaacaatgccagagttgagtagttgca

SEQ ID NO: 6788188 - DNA, 59 bp, Homo sapiens
tatttgttttgtgtgtgctgcactaggcctggggaatacagcagcaaacaaaacaggta

SEQ ID NO: 6788189 - DNA, 63 bp, Homo sapiens
cttggaagcagagagctatcaccagacaccaagcctgttggtgccttaatttctacttccaag

SEQ ID NO: 6788190 - DNA, 82 bp, Homo sapiens
tccaacttctgtcactgagctcaggattcccaggcaagcccacggagtgccccacagggtcagagccgtaacaggacttgga

SEQ ID NO: 6788191 - DNA, 74 bp, Homo sapiens
actgcaggctcatgacaaaataaatggtctctgtcttacgccgctaagtttagagtgttttgttaggcagcagt

SEQ ID NO: 6788192 - DNA, 72 bp, Homo sapiens
ttagaccaagacaggaagtaacataaccagataatatcatcgttgatatttgttgaggttctgcttgtctaa

SEQ ID NO: 6788193 - DNA, 71 bp, Homo sapiens
gggctacaggtatatagatgaaacaagattgccttgtttatactattctatctactttgtacctgttttct

SEQ ID NO: 6788194 - DNA, 64 bp, Homo sapiens
ggccaccttaagttaaggatattatttatatccttagaaaatttacttgagaattgtcaaggcc

SEQ ID NO: 6788195 - DNA, 87 bp, Homo sapiens
gttcagttgccctggaactcctaggcaagcagaaaactctggaaacagaaaccatgaaacctacggagttcccagaggaaactggac

SEQ ID NO: 6788196 - DNA, 81 bp, Homo sapiens
gatcagtgccctttttgtttgactttggaagagcaacacaaataaatacagtaggttccatttaaacaaagaactctgatc

SEQ ID NO: 6788197 - DNA, 81 bp, Homo sapiens
aagacgatgcttcttttggagaagtcttggactggcccataaaaaatatagtaaattgacttcttggaaagacatcgtttt

SEQ ID NO: 6788198 - DNA, 121 bp, Homo sapiens
gctgagcccaggtcgccccctgcccaccctcgcgcgttggtgccagtctgtgccactcagccggtgcccggtgcccggtgccaggcgcggggggaaggcggggaggagccgaggctccagc

SEQ ID NO: 6788199 - DNA, 60 bp, Homo sapiens
agcagaattccatgtgagagggagcttgtcgagcgtggcctcttcccacttggggctgct

SEQ ID NO: 6788200 - DNA, 58 bp, Homo sapiens
aaacttctttctcaggattaggaatgaaagctccatttattattgagaaatgaagttt

SEQ ID NO: 6788201 - DNA, 59 bp, Homo sapiens
ggtgggggctggctcgtcctgtgcccaaggctgggtgggagagcactgcagccccggcc

SEQ ID NO: 6788202 - DNA, 77 bp, Homo sapiens
ctgcagtaggagaaaaggccactcctaggagctctggtattttccagaagctttcagtcagccttcccttgtatcag

SEQ ID NO: 6788203 - DNA, 55 bp, Homo sapiens
ttagggaaataaaattatcagtacagtaaactggaaggctgtttcttttccctga

SEQ ID NO: 6788204 - DNA, 130 bp, Homo sapiens
ccggggctccacatcacacaactccagcagtttccaccattcatgctaatattcttagtaaaaagcacccctggagtagaaagcattgtgaatggtgccccctggagttgtacgaggcaagaggccctgg

SEQ ID NO: 6788205 - DNA, 73 bp, Homo sapiens
cctgggacagggtggctgatagggctctgtgctgtgatggggatgggccccgtccacctgctctgctcccagg

SEQ ID NO: 6788206 - DNA, 56 bp, Homo sapiens
gctcctgcaggacccaggagacacccaaatacagtgacttccccaactgcaggagt

SEQ ID NO: 6788207 - DNA, 76 bp, Homo sapiens
ttgcttctttcatttattcaacacgtgtttatcgatggtctcatatgggccagcactgttctaaggaaacaggcaa

SEQ ID NO: 6788208 - DNA, 67 bp, Homo sapiens
ggcagctaaacagagggggacccaacccccaacatctggggcagtggcttcaactctgtcggcagcc

SEQ ID NO: 6788209 - DNA, 57 bp, Homo sapiens
gcaagttttgttatcttagatatctgactctcagaatatcttttagagcaagcttgt

SEQ ID NO: 6788210 - DNA, 68 bp, Homo sapiens
tagggaaaatccttccttcatttgacaggtgaagaggggactcaagcccagaaaggggaggatccttg

SEQ ID NO: 6788211 - DNA, 65 bp, Homo sapiens
acattgttgtttgcagcacaggtactatgctggagcagttaactgtgttacaaactgctagatgt

SEQ ID NO: 6788212 - DNA, 57 bp, Homo sapiens
taattacagctcagactctgtaaagttagactttaactggttgaaggctgttaattg

SEQ ID NO: 6788213 - DNA, 78 bp, Homo sapiens
acgcagattttagctttcagaactttgtttcaggaagatgtatttgaagcaggtgggcatgaaagctgaaagctgagt

SEQ ID NO: 6788214 - DNA, 62 bp, Homo sapiens
tccatttttcatgactcctcaagctagtcataaactccatagaaaggaacatgaacaatgga

SEQ ID NO: 6788215 - DNA, 68 bp, Homo sapiens
tctttgctcttacacagttagtgaattaaatgagattttacagagaagagactgtgaagagcaaatga

SEQ ID NO: 6788216 - DNA, 82 bp, Homo sapiens
accaaggaagctggattcctcttttgagataatgctgagccagtagcagctgttagaaacaggaagccgtgtggactctggt

SEQ ID NO: 6788217 - DNA, 77 bp, Homo sapiens
gagctcaaagggaaatgtgttgttcatttctaaaaagtgtttagggtattatgaaatatgttttcttcattgacttc

SEQ ID NO: 6788218 - DNA, 58 bp, Homo sapiens
tagctgggcctatacagctgggtataatgactattttagtgtaaggcaggcacagttg

SEQ ID NO: 6788219 - DNA, 65 bp, Homo sapiens
agttgtatttgcatcgcattggttcaaacttattcacgtagtttccttgggatgcaagtgagact

SEQ ID NO: 6788220 - DNA, 70 bp, Homo sapiens
ctcatttagagtttatgataactggtgacctaattgatttgtggtccccaaattaaagacactagaaaag

SEQ ID NO: 6788221 - DNA, 69 bp, Homo sapiens
tggcatgtggctttgagtcatctgattggatgcattcccctcacattttgaacccagagctcatgacca

SEQ ID NO: 6788222 - DNA, 56 bp, Homo sapiens
gagagactgtatcattttacattctcgccaattatgtatgaatgatccggtttctc

SEQ ID NO: 6788223 - DNA, 61 bp, Homo sapiens
aggctagctttggctcagtaaatttgctgtgtaatgattttctaatgagttaggctggctt

SEQ ID NO: 6788224 - DNA, 86 bp, Homo sapiens
gttttgcatgatccagagtagctatttgtgccaaattatttctaagcccctgctttttaacatataggttacaggatcgtgaaaac

SEQ ID NO: 6788225 - DNA, 58 bp, Homo sapiens
ctgggctcagatgagaggaagggttggtggtgggcgcccctggggcagctgggctcag

SEQ ID NO: 6788226 - DNA, 59 bp, Homo sapiens
tcagcagggagaggagaatgcagagttgccaaacttcacactctcccaatccttgctga

SEQ ID NO: 6788227 - DNA, 76 bp, Homo sapiens
ttcaactacttttttggggtgctttcaaagcaaagggggtgtctgtgctttgcaggaaccctaagcatgggttgaa

SEQ ID NO: 6788228 - DNA, 97 bp, Homo sapiens
gtgcacagcagactcagcagtagggccaggagggaggctctggggtagtgtggaatccccggctcctccgcccttgctcacgcacacctgttttcat

SEQ ID NO: 6788229 - DNA, 100 bp, Homo sapiens
gaggcaggaggattgcttgagcccaggaggttgaggctgcagtgagccctgttcacatcactgcactccatcctgggcaacacagcgatactcttgtctc

SEQ ID NO: 6788230 - DNA, 65 bp, Homo sapiens
ttatggtcgggttggatggagtgtgagcacaagtaagagtgtgccatttctaagcctggctatag

SEQ ID NO: 6788231 - DNA, 61 bp, Homo sapiens
cttaacctctggggacctcagtttccttttctgcaaaactgaggtaattgtgaggattaag

SEQ ID NO: 6788232 - DNA, 55 bp, Homo sapiens
cccaggctggagtgcagtggctcgatctcagctcactgctacctctgcctcccgg

SEQ ID NO: 6788233 - DNA, 59 bp, Homo sapiens
cggtgccagctacagaggccacatggcttctaatgaggccaggcccagttgtagctccg

SEQ ID NO: 6788234 - DNA, 84 bp, Homo sapiens
aaattgctatttgttcttttccaacttgtgaaaagatgagactcacttctctgtcttcacatggagaagcaactcaggtcattt

SEQ ID NO: 6788235 - DNA, 57 bp, Homo sapiens
ccactgaaggctgcagctcagcctaggcctcgggcccatggcagtgcagtctcaggg

SEQ ID NO: 6788236 - DNA, 64 bp, Homo sapiens
ctgcaactctctccagaggctgcaatgcactggctgtgcagaaagcctagggtgagaggggcag

SEQ ID NO: 6788237 - DNA, 56 bp, Homo sapiens
caggcagcagccactctggtatttgtgtgtttcgcagtcctacagtgtgtttcctg

SEQ ID NO: 6788238 - DNA, 59 bp, Homo sapiens
gggtgcatggccagggtggtctggagtaactccccacaatattgctgaccaaagcaccc

SEQ ID NO: 6788239 - DNA, 70 bp, Homo sapiens
gtcgctgtgtcattgccatgaaaaggcagggggtatcttccaggtgttgccatggcaatgataaactgac

SEQ ID NO: 6788240 - DNA, 55 bp, Homo sapiens
tggagaggtttaaacaaaagttggctacaacgtagtgaaattagacttcttacca

SEQ ID NO: 6788241 - DNA, 70 bp, Homo sapiens
ttttcagacagtagtagttaaactgtgtatttgtatctaaataaaaggttaacactactggcatgcagaa

SEQ ID NO: 6788242 - DNA, 92 bp, Homo sapiens
gagatggagtctcgctctgtcgtggaggctggagtgcagtggcgcgatctctgctcactgcaagctccccctcctaggttcactccattctc

SEQ ID NO: 6788243 - DNA, 58 bp, Homo sapiens
aatgtcttttcccttactttccactaaaacatttacgaaggtaatgggagaaaatgtt

SEQ ID NO: 6788244 - DNA, 65 bp, Homo sapiens
gtgtgccttttggtgaagttgttgagaattttaatgcattttagttctcattcatcacggcctat

SEQ ID NO: 6788245 - DNA, 59 bp, Homo sapiens
gggagctgaaggagccggcggggccagctcacagtgttccagctgttccatcagctctt

SEQ ID NO: 6788246 - DNA, 122 bp, Homo sapiens
ctccctgtatccaatccgctcaacttggtgacctactgattcttcaagaaacagcccaaatgttattttctctgaagctgttgtagtctcctgaatcttgagcaacatggatgctttgggag

SEQ ID NO: 6788247 - DNA, 56 bp, Homo sapiens
ttaagtacttccctgttggacaagccattttcccagacaggcaaggagtcacttag

SEQ ID NO: 6788248 - DNA, 102 bp, Homo sapiens
gtatgtatggagatgccaaagcaacatgtctgatctctgtgaactcaaacatatctgtgtttgtgagctacagactatgtgcaggaacaattctatatttgc

SEQ ID NO: 6788249 - DNA, 76 bp, Homo sapiens
catacagtatgtaggcttttcagattggcttctttcacttaatcctatgcttttgagattcctccatgtctgtttg

SEQ ID NO: 6788250 - DNA, 60 bp, Homo sapiens
gctgttgcagatgagactggatttggtgcccatgttgaagatgaagatatctgcaggggc

SEQ ID NO: 6788251 - DNA, 82 bp, Homo sapiens
tttctgccatctacccctttgactttcctcacaagtctggagatatttctagcccagaagagggaagcaacagaggcaggaa

SEQ ID NO: 6788252 - DNA, 91 bp, Homo sapiens
gtaggtagctctttggaggcccagcttgaagtgggaagggtttcctattgaaccctctcccttgggtgggctttggtctgtgactatctgc

SEQ ID NO: 6788253 - DNA, 88 bp, Homo sapiens
gccctggcacccaggacaaggtcccagcccctcttggcccagcagagcgagggaccaggagaactgaggccactctggggcccagggc

SEQ ID NO: 6788254 - DNA, 66 bp, Homo sapiens
ccagtggtctaggtcttgtggtgtccacttgatggaccagccaagactgcctggaatccctactgg

SEQ ID NO: 6788255 - DNA, 130 bp, Homo sapiens
gtgtttattcccaaaacaagattttgttttgggggattgtataagtctatttacaatgtacgcttgtctgtaaaattgtacatatgatgtatgtaatatttccaaggcaaattattttttcaggaatcac

SEQ ID NO: 6788256 - DNA, 58 bp, Homo sapiens
aggctgccctgccgccagtgggcctcccaagcggccctgcccacagcagggatagtct

SEQ ID NO: 6788257 - DNA, 56 bp, Homo sapiens
tcagtccacacagcctgctgctgtggcactgttccacagcagagcaaagtggctga

SEQ ID NO: 6788258 - DNA, 61 bp, Homo sapiens
gctttgccaatggacggttggctgtgatttccagggacagttgttcttccagaagcaaagt

SEQ ID NO: 6788259 - DNA, 58 bp, Homo sapiens
tttttagttagtagtccttgtgatcccccagagataatcagggcctaagagctgaaaa

SEQ ID NO: 6788260 - DNA, 76 bp, Homo sapiens
tttcctctccccttccgccagctcttgacgcatttggccgtggtggggagtcacagggaggggaatgttgaggagg

SEQ ID NO: 6788261 - DNA, 77 bp, Homo sapiens
tgcgcgaggctgcactggctaaaggctgggtgccattgtctttcagcaaatagccttggtttgtgcacctggctgca

SEQ ID NO: 6788262 - DNA, 89 bp, Homo sapiens
gtggaaaatcatgaagtaggttcaggagatattgcacagtccacgtggtcatgggctgtgcgggaagccagagcactgctttatgccac

SEQ ID NO: 6788263 - DNA, 70 bp, Homo sapiens
tcacacaagagcataaatgagaagggtaagaataagacatgaaaagccagttagtcagctccttgtgtga

SEQ ID NO: 6788264 - DNA, 72 bp, Homo sapiens
tgcacagatgtgacttcagtcttcttacatattaataaggtggagggggctggattttactccttgttagca

SEQ ID NO: 6788265 - DNA, 83 bp, Homo sapiens
catttttggcagtgtagcaggacccttcatgaagggactctcttcattcaaggggttcctgattgcaaactgtatcaagtctg

SEQ ID NO: 6788266 - DNA, 56 bp, Homo sapiens
gatcctttcctatttggagctgtggggttggggaagtgacagggaaggataggatt

SEQ ID NO: 6788267 - DNA, 64 bp, Homo sapiens
tctagctgaattttgctttctaattacagaatcagaatgtaaggagaaaatgttttcagctgga

SEQ ID NO: 6788268 - DNA, 70 bp, Homo sapiens
tcctttacaaacaatttaacatgcaaattgtttgcatcaaagtatgagtgtgagtgagtttgtggcagga

SEQ ID NO: 6788269 - DNA, 71 bp, Homo sapiens
tgcccactctttggccacagatccttgggggtagggattgtgtcatattcttctgtgtacaatgagtagca

SEQ ID NO: 6788270 - DNA, 64 bp, Homo sapiens
gcagaatagtgactttccttaagctcaaagtttgatttgagattaaatgtgaatattattctgt

SEQ ID NO: 6788271 - DNA, 74 bp, Homo sapiens
attgctctcaggaaaatattgaagaagtggtatttatattatacatttcataaaaactttacctgaggtgtaat

SEQ ID NO: 6788272 - DNA, 58 bp, Homo sapiens
gcagctttgcttcttttccatagcaaatgcttcaccgctgctaggcaagcaaaggtgc

SEQ ID NO: 6788273 - DNA, 81 bp, Homo sapiens
tcaggactagctcagcaagttgagagaaagcccgtgttgtgatcatacacggaaatatcataatgagctcagctcttctga

SEQ ID NO: 6788274 - DNA, 98 bp, Homo sapiens
gataacataagcaaagggatagctattattatttctgttattatttagatttcaacaagcagtcaacagaagtgatagctattattaagagtgatatt

SEQ ID NO: 6788275 - DNA, 58 bp, Homo sapiens
attttatgcagaactgcgagcccagttctttcctgcgttcttcagtttaatataaaat

SEQ ID NO: 6788276 - DNA, 55 bp, Homo sapiens
cataatatactacattgatgaatattacatgatatggtggatgtaatatattatg

SEQ ID NO: 6788277 - DNA, 67 bp, Homo sapiens
ggtgtgaatgcaggtggccgtcagaagggctgtccaccttccttcagggggccgcctgcaccagacc

SEQ ID NO: 6788278 - DNA, 65 bp, Homo sapiens
ctgccttgttccaggaaggatttaagatggtttatattccagtcctttaatgctggaatggctag

SEQ ID NO: 6788279 - DNA, 57 bp, Homo sapiens
gcctgggccactgccctggctacaccgggaagtctggagctagaaagtgggccgtgc

SEQ ID NO: 6788280 - DNA, 117 bp, Homo sapiens
actcttggctgagtctttgtgcttctgttctgtcctgaaggacacgtgaggagccagaaacatctggcagcctctggtccttagttcagatacaacatccatgaagctgccaggtgt

SEQ ID NO: 6788281 - DNA, 60 bp, Homo sapiens
cagaggaaatgggaaggagataagccatactgatttccttgtaagacctatttttgtctg

SEQ ID NO: 6788282 - DNA, 60 bp, Homo sapiens
tttctgcttagtttaccggagggtatccagagttcttgaaactttagtaaactaaggaaa

SEQ ID NO: 6788283 - DNA, 55 bp, Homo sapiens
gtcctttcgagggtgagtgaaagcacatgctgtcctttacatgcttgaggcggac

SEQ ID NO: 6788284 - DNA, 56 bp, Homo sapiens
gagaggcttgtgtgaagaacaagtacacagctcactgttcttccaataaggctttc

SEQ ID NO: 6788285 - DNA, 60 bp, Homo sapiens
aaagccagaagagcagtgacttatggcctccaaggaaataatcctgcttcttctcccttt

SEQ ID NO: 6788286 - DNA, 55 bp, Homo sapiens
aggagtgccgaggtgttcaaggagccctctttatcctccacgtctcaggcaccct

SEQ ID NO: 6788287 - DNA, 104 bp, Homo sapiens
cagatgtgctctcagaaataatgaattcttttgcaaagtccattgaagttatgggagatggttgccttaatgatgaacacttggaagaactgggaggaatactg

SEQ ID NO: 6788288 - DNA, 77 bp, Homo sapiens
ccatgcagtctctcggtggcatttggcacagttggctactcccaacccatatgtatgtactgtagattaccacatgg

SEQ ID NO: 6788289 - DNA, 130 bp, Homo sapiens
gaaaaaaagggaatgcaggagtgatgttgtatgctattttacataggaatggtaagggaaggccaccctatgtaaagtagcatctaccccctcctcccactgctacactactctgtctttgcttttgttc

SEQ ID NO: 6788290 - DNA, 79 bp, Homo sapiens
tgagccaacagcatccctgaagataaccagagccaaatgtttactcaatggaagtcattattcagtgagctgctgctta

SEQ ID NO: 6788291 - DNA, 99 bp, Homo sapiens
ttaccagggtgctaaatagcttttgtatgatgaaattttggcaaaataattttatgtctctattatttatgtcatatgaaagttggagttttctggtgg

SEQ ID NO: 6788292 - DNA, 57 bp, Homo sapiens
aacataggtctgagagcatcctggttaagaggaacctggcttctttacatctgtgtt

SEQ ID NO: 6788293 - DNA, 74 bp, Homo sapiens
ggcctcccaaagtgttgggaggtcagatgtgagccactgcatctggccccgcatgcactttatagaggagggct

SEQ ID NO: 6788294 - DNA, 62 bp, Homo sapiens
gagcttattacacaggatttgccttactctgggaaggaaccagacctgctgaaatgaagttc

SEQ ID NO: 6788295 - DNA, 59 bp, Homo sapiens
tagaatgttttacagatcccattaggctctaatgattagtgggttacatagaacatcta

SEQ ID NO: 6788296 - DNA, 64 bp, Homo sapiens
ctgtcagctcccagtcagagagaaagggcctcttcagtctgtctcaggagactgggagaaacag

SEQ ID NO: 6788297 - DNA, 59 bp, Homo sapiens
cttgcaaattaaagaggatagcaagcaggcagctttctttcctcatttagtttagcaag

SEQ ID NO: 6788298 - DNA, 70 bp, Homo sapiens
gagaaatgaaggtgtcagcagggctggttccttttggaggctctgaaggagaacctgttccatgcttctc

SEQ ID NO: 6788299 - DNA, 75 bp, Homo sapiens
tttaaacatcagtatatggtgatgtgtgtgtgcatttagtccatacatgttgtaccatatgttttaacctttaaa

SEQ ID NO: 6788300 - DNA, 82 bp, Homo sapiens
agcatgtgaaagcacaggttgaggattattctggaattttcttcaggtctttgttgtttgcttggttgcttgtttgcttgct

SEQ ID NO: 6788301 - DNA, 63 bp, Homo sapiens
agagtgctatagggtctcagttctgaaattattcacaagtactcagcagactcagtgcacttt

SEQ ID NO: 6788302 - DNA, 60 bp, Homo sapiens
gcagcaagggttatatcaaagatgtattaaaatgtcttaagtctattttcctcatgctgc

SEQ ID NO: 6788303 - DNA, 88 bp, Homo sapiens
agcacagtaatagatgtcattttgatttgcactctaggagaagtaaaatagttgcatgtcaaccaagatgagatatatagaatgtgtt

SEQ ID NO: 6788304 - DNA, 65 bp, Homo sapiens
ttcctggatcctaggaggtgggtatttgcattgtctttaattgccatgctcatagggtcgaggga

SEQ ID NO: 6788305 - DNA, 60 bp, Homo sapiens
ctcatggctctcatggactgagtgacaatatagttgcaatagcaatacgtggaccatggg

SEQ ID NO: 6788306 - DNA, 95 bp, Homo sapiens
ctttgtcacctcagtgcctggaaagtgtctccatcctggttatacttagggttgtatccagtgattatgcacatctggcataaggcctcacatag

SEQ ID NO: 6788307 - DNA, 57 bp, Homo sapiens
gccaggctgaatatgttccagggtcacccaactctgtccttgtacagttagccaggc

SEQ ID NO: 6788308 - DNA, 130 bp, Homo sapiens
ttctgatgaagtcttctatctcagattaaagacagtcactttttcactgtgtcctcacactgcttttcctcagtgcacgtgtgcagagagagtgaaagagaaagctctctgtgtctcttcttaaaaggaa

SEQ ID NO: 6788309 - DNA, 118 bp, Homo sapiens
ttagcccaatgcctcttgtataacattcaaaaaagttagctattagtaggtgctataaaattataaagtttttactctctgacctttggagttgaaacagtggcattagatgggttga

SEQ ID NO: 6788310 - DNA, 84 bp, Homo sapiens
aggtactgaggtcccatcaatgactaataaaatagcccccacatggtggctgttttattattcatttgagggacgtcagtacct

SEQ ID NO: 6788311 - DNA, 129 bp, Homo sapiens
catctgtgattttactctggtgaataaatttattttcattggcataatctaaggacttagcattgctggttttaatggcacctctggttcctatagatacagtggtcgaaagggtaagctttgcagctg

SEQ ID NO: 6788312 - DNA, 75 bp, Homo sapiens
tttttaaaagctgtttttcttagaacatcagaaaagttgtctgaataaaagagaggaaacataggtttttaaaaa

SEQ ID NO: 6788313 - DNA, 80 bp, Homo sapiens
ctcaatgtgtgcagactgtcaaatctgtctctaggagaactgattcactctggacagacaaaaatagtaagcacatagag

SEQ ID NO: 6788314 - DNA, 62 bp, Homo sapiens
ggctaatgaggggaaccatctgtagtactttgccggcagatgtgtccccctcatactgtgcc

SEQ ID NO: 6788315 - DNA, 59 bp, Homo sapiens
gctcctgtgggattcatgacattaattctccagaatttttgggttgtgattacaggagt

SEQ ID NO: 6788316 - DNA, 67 bp, Homo sapiens
agttacaagtacaggctttggaattgggcagatagtattaaaaccccaactctgccacttagtagct

SEQ ID NO: 6788317 - DNA, 56 bp, Homo sapiens
ctccccttcttgccagatcctttggattcttgggacagctgagcaagaatggggag

SEQ ID NO: 6788318 - DNA, 88 bp, Homo sapiens
atgcagccttgtagaccattttaagggttgtttttaaattctagaatcaatgggaagtccttgaaatgttctcactggggtacagcat

SEQ ID NO: 6788319 - DNA, 58 bp, Homo sapiens
acagaagtccccatgaagaagctatcattatcatcagcatcttcgtggggttttctgt

SEQ ID NO: 6788320 - DNA, 73 bp, Homo sapiens
cttcagctgtggtctccaaggctcgggactgggcccagggcagtgtagaaggtcatggagattgtagctgagg

SEQ ID NO: 6788321 - DNA, 59 bp, Homo sapiens
ggcaagcctcttgttctgagagctgttgatggataggaaatcagagaaagaggtgagtc

SEQ ID NO: 6788322 - DNA, 93 bp, Homo sapiens
gcatggtccactcattctcagtatcagccagccctggggcttcccggaggccatgccgacttgagagccaggcctgagtggtagccagggtgc

SEQ ID NO: 6788323 - DNA, 68 bp, Homo sapiens
acattgctgatggaattgtaaaatagtacagccactttggaaaactatttggcggttcctcaaaatgt

SEQ ID NO: 6788324 - DNA, 60 bp, Homo sapiens
agagctccctgctgatggagctgcccagactgagcctgtcagtgatttgtagggaattct

SEQ ID NO: 6788325 - DNA, 58 bp, Homo sapiens
agtaggcttgctcgttgccaattatcctcttgaaaactggtcttatgcaagcactatt

SEQ ID NO: 6788326 - DNA, 61 bp, Homo sapiens
aatggcgaagaaggttataattgttttaccaagacagttactcaataattcttgcgctatt

SEQ ID NO: 6788327 - DNA, 56 bp, Homo sapiens
aggacaattagactctttgtttctcctatgatcctaagagtcagcttgactgtcct

SEQ ID NO: 6788328 - DNA, 77 bp, Homo sapiens
gactgggtgggaaggatgggagtggaggaaaaaagttacttttaacttatcacccatttcctcctaaatccactgtc

SEQ ID NO: 6788329 - DNA, 63 bp, Homo sapiens
tctacattttgatgggtggagtagcagccacatggctaagacacatgcgtacaagataaaaga

SEQ ID NO: 6788330 - DNA, 58 bp, Homo sapiens
ctagcttccctagctaaagaggtcctgactcctggatcctatgtgctggggaggaggg

SEQ ID NO: 6788331 - DNA, 56 bp, Homo sapiens
cattttcctagtcatgtgcttctctggattgccacagagacactggatggaaaatg

SEQ ID NO: 6788332 - DNA, 72 bp, Homo sapiens
gtgaaatacactggacatcattgcattttgatagaagggtctgagtttttgatgaagtctagtgtactttac

SEQ ID NO: 6788333 - DNA, 66 bp, Homo sapiens
tcagctttttgtggtccctgtgattggcctcaagaggaaatatctggagcagggccacaaggctga

SEQ ID NO: 6788334 - DNA, 83 bp, Homo sapiens
atttgagtatagtttggggaactattcaagaacatattaaaatgtcactgtaatgctctctgccatagctaactaactcaagt

SEQ ID NO: 6788335 - DNA, 61 bp, Homo sapiens
ggtgtatgtgagtgcatgcatgcacatgtgtgagtgtgtgtgtttctgctcatacagagcc

SEQ ID NO: 6788336 - DNA, 83 bp, Homo sapiens
ctagcagcaggctctatggttttatatgtctttgttgcaaaacagtagcacaggtaatccgaatcattcatagcttgctttgg

SEQ ID NO: 6788337 - DNA, 65 bp, Homo sapiens
ttggagattgggctgctatcttccttgatttttacatgtcaaagagatggctctcagatctttga

SEQ ID NO: 6788338 - DNA, 86 bp, Homo sapiens
atcaaaggtctgattttttattcccagactgagatattataatatgaaagtacaggtgaattggggataaagaatgaagacaggat

SEQ ID NO: 6788339 - DNA, 78 bp, Homo sapiens
cttggagaagcactggtctaagacattgggaccttggacagctcctcgtgaccttggaccaaggtttcaggacccgag

SEQ ID NO: 6788340 - DNA, 58 bp, Homo sapiens
ttctttcttcaagctggtctcaatctgacaccactgtctgattgagtttaagaaagaa

SEQ ID NO: 6788341 - DNA, 76 bp, Homo sapiens
gggcagtgttccttctggagggtgtacgagagaatccatttccttgctttttccagcttctagaggccacttgccc

SEQ ID NO: 6788342 - DNA, 94 bp, Homo sapiens
acctacccagataatccagtataatgccccctgtggggtataatccggggggataatcccttggggggacattattctgctatcacaggagggt

SEQ ID NO: 6788343 - DNA, 66 bp, Homo sapiens
ttctggactgaatggaagatatatggataatcactgtgaatttagtgtacttccattcatcctgaa

SEQ ID NO: 6788344 - DNA, 64 bp, Homo sapiens
tgaggcatgtctggcctgtcccagtggagactttaaggccctgggccctgccaggcttgcctca

SEQ ID NO: 6788345 - DNA, 56 bp, Homo sapiens
ggctgaccccagcaaggactctccatgagtggagtgtggcagcgctgtggttagct

SEQ ID NO: 6788346 - DNA, 71 bp, Homo sapiens
tgctggactacagctgtgtgtttatgtgcagtgcacacctgcaggggcctgacaaatagctgtagtatgca

SEQ ID NO: 6788347 - DNA, 62 bp, Homo sapiens
tgagttttgatgtcctgtaatgaggttgtttgcagaatatattactagattgtcaagattta

SEQ ID NO: 6788348 - DNA, 71 bp, Homo sapiens
gggggtctcttttggctcatctcagtcctaggaggggacatgtgcctcctgaccctttgaggcggatcccc

SEQ ID NO: 6788349 - DNA, 58 bp, Homo sapiens
ctttgcattcactgtatgcatgacatactactgtcttatagtgcaatgaatagcagag

SEQ ID NO: 6788350 - DNA, 58 bp, Homo sapiens
gtgtttacagataaagtgagctggacattgggaagtccactggcaacttctgaaatac

SEQ ID NO: 6788351 - DNA, 125 bp, Homo sapiens
cagtcctcgggatccccagcccacagaaagaatgtcttccctggcaggccaaggttttcaaggtgcactttcaaaagttggcttgttaaaaatgcaattgctctggggtggagtcctggaaactg

SEQ ID NO: 6788352 - DNA, 56 bp, Homo sapiens
ggagagtctttctcctgcactgcccttcatcctgtaggagctggagaaaactttcc

SEQ ID NO: 6788353 - DNA, 107 bp, Homo sapiens
gagctgttcttaatgcaagcggactgtcccattggagaacggtcatgtaagccaggtttcagtgtgtttgctgccctctcctgtccgcttacgtgcactgcagtctc

SEQ ID NO: 6788354 - DNA, 84 bp, Homo sapiens
gggttaagaggagagagcatcctggaaccatgaagaatgctttgaaagttagagtcaagctgcatgttctgttctctcctaccc

SEQ ID NO: 6788355 - DNA, 69 bp, Homo sapiens
gtggtaccagggttggcaagcaaggcttcagcgaatagctcaaaggctggcgatgtgtagccctgccac

SEQ ID NO: 6788356 - DNA, 93 bp, Homo sapiens
gtgtaaaataactctttgagatagtgattttattttgtttggatatatacccaggatgagattgctgtgttgtataggagttctatttttcat

SEQ ID NO: 6788357 - DNA, 99 bp, Homo sapiens
ggctcacagcagtgaagatgggcatagtaaccgtttgctttggagatggggcctaagctcttcagttggtcactattctcgcctttactattgtctacc

SEQ ID NO: 6788358 - DNA, 101 bp, Homo sapiens
ggtcttctttttcaagttgcattatcttgtagagatattttcgcaagtggttattctagtggaataatcctccagggctctgccgcttgagaagtaagtcc

SEQ ID NO: 6788359 - DNA, 82 bp, Homo sapiens
gcctagtgaaaagcccatggggagatggggaggccagcttgttttcatatgctaggcttcaaaatctccctgctgacttggc

SEQ ID NO: 6788360 - DNA, 69 bp, Homo sapiens
tcctgtgtcagcaagacatcagagtgacttatttaaatgattagtttgtaatgtgcttctgttttagga

SEQ ID NO: 6788361 - DNA, 58 bp, Homo sapiens
gagtgcagtatgagaggctgctgcctgagttctaaatgcaacctctcttttgacattc

SEQ ID NO: 6788362 - DNA, 65 bp, Homo sapiens
ggaagttaacatttgagctaaaaggcagaaatgaatcaggctttctggctgaagtgatgaattcc

SEQ ID NO: 6788363 - DNA, 65 bp, Homo sapiens
tcttggttgagggtgtgcggcccagacaggccgaatgcttgttttgtctgttgcctttctccaga

SEQ ID NO: 6788364 - DNA, 82 bp, Homo sapiens
tgtgcagtgtgggcgtggcagtcaggaaaaggtgagaaggagactcacattcactggatgttactacccaccagccagcaca

SEQ ID NO: 6788365 - DNA, 78 bp, Homo sapiens
gacacagttctcgcgcccccaagcgtcattgggctctccctggttccagtggctacaggggggttgagtgggggtgtt

SEQ ID NO: 6788366 - DNA, 64 bp, Homo sapiens
ggtactgtcatgcattatggcatgttttagcatccctggtctcatatgccaaatgccagtaacc

SEQ ID NO: 6788367 - DNA, 68 bp, Homo sapiens
tgccaaatcccaagtccaggccattccctactcttctgcaaacagggggtgactggagaggggtagca

SEQ ID NO: 6788368 - DNA, 55 bp, Homo sapiens
tgcaggccaacctgtgtctggagataatgcaagccagtgcaggggttagcgtgta

SEQ ID NO: 6788369 - DNA, 85 bp, Homo sapiens
taggaatacaggctttaaatttaaaaccaacgcttcaaagtgcattgtcatggagaatgggatgaatgtggaggctgtggtccta

SEQ ID NO: 6788370 - DNA, 114 bp, Homo sapiens
tgggagcagagggcaaattggacatcaaagagttgctaaaggcttttcggctgtggaaggccgaggagctgatgattctttgatctccacttccccctacacacactgctccca

SEQ ID NO: 6788371 - DNA, 58 bp, Homo sapiens
atggctttgttccaataaaactttataagaacagacagtagatttggcccaaagccat

SEQ ID NO: 6788372 - DNA, 94 bp, Homo sapiens
ggagaggggatacagaatcaggcatgtgtgagtatatcttatccacctgaaaatagaaggtgaagagcttagacagaatcaaagtgcccctcct

SEQ ID NO: 6788373 - DNA, 129 bp, Homo sapiens
agtacattactcaatgctggatgcatagtcagtgctttatgtttagtatccattttcagtaaattattatattttttgaaaactcaaaatgtggagcactgatcagtcttgtatatgtgtacatgaatt

SEQ ID NO: 6788374 - DNA, 60 bp, Homo sapiens
cttcactacggtcacgaccctgggcttcagagggctgttctcaggatgtgctgagtgaag

SEQ ID NO: 6788375 - DNA, 76 bp, Homo sapiens
gagggaatgggcaggcgtgatcctggtgggttctggagctctccgattccacggctcagcctcaacgttccgactc

SEQ ID NO: 6788376 - DNA, 104 bp, Homo sapiens
cagcagtgtcatgctctgtcctgtcttcaggacccggaattttggggtctgagtgacaccagcattcactggacctgcagagaaggacaaagctgatgctactg

SEQ ID NO: 6788377 - DNA, 64 bp, Homo sapiens
aggctgtcacctggcaacctctgtgtttcttttcccaaggccacagctccagtcaggtgaccct

SEQ ID NO: 6788378 - DNA, 96 bp, Homo sapiens
gtagtttgcagcgtcaggcagcgggtccgcgcccagcgagcggctccccagctcctgggaggatgcggacccgggacgcccccgtgagctcactgc

SEQ ID NO: 6788379 - DNA, 61 bp, Homo sapiens
cctggcacgaagggctgaggttgggaaaccccatgacaatccaatcctaggccctgccagg

SEQ ID NO: 6788380 - DNA, 76 bp, Homo sapiens
ggccgtgatgatttactcccacttagagcctgaacacaaaactgtggctttcttgagggactgagaatcacaagcc

SEQ ID NO: 6788381 - DNA, 84 bp, Homo sapiens
ccctggctggtctcccaatccgggacagcctggcctgctccacagaactgggggttcagagggtgttctgattgggggacaggg

SEQ ID NO: 6788382 - DNA, 56 bp, Homo sapiens
catggccttgagtgactgcactggtcaaacgtccatgcagcgtggcacaggttatg

SEQ ID NO: 6788383 - DNA, 66 bp, Homo sapiens
ggtcaagagttgaggttcaaatgggctcctcaaggccaagtctctctgtttgaacagctttccacc

SEQ ID NO: 6788384 - DNA, 87 bp, Homo sapiens
gatctgagcaggggaaggatgtggctagaggggcattttagacagacaagatcctctgtggattacacctaggctaagcaacgggtt

SEQ ID NO: 6788385 - DNA, 67 bp, Homo sapiens
ccgagctgtggtctcttttacggcttcatgaaaggaccgtgccctcacggaggggaccacggcttgg

SEQ ID NO: 6788386 - DNA, 68 bp, Homo sapiens
ggttccactgctaacttgctgcagcttactgggtgatctgtaaataaaaagggaggtggcggtggtcc

SEQ ID NO: 6788387 - DNA, 58 bp, Homo sapiens
cagaggaagctgggtgtggagtatatggaaactccgtactatcttcacagctattctg

SEQ ID NO: 6788388 - DNA, 63 bp, Homo sapiens
ggcagtgtccttgcagctctacccagctcttggctctgggaaaagggaacaatggacgctgtc

SEQ ID NO: 6788389 - DNA, 61 bp, Homo sapiens
gtcatctgtgcttttggtaggaaatgtgctgaccatgtcctgcattttaaaaggcagttgc

SEQ ID NO: 6788390 - DNA, 79 bp, Homo sapiens
tgagcctgtgagccccaactccatccaaggcctgcctgcaatctggtgccacctgatggcagttgttccctccagctta

SEQ ID NO: 6788391 - DNA, 118 bp, Homo sapiens
gggctggaatataagctgcacttaagagatgaagacatagaggcagaacgagcttaagtgatttatttatccaaggttattctctatctcatccctgtgtatatttccttgccagccc

SEQ ID NO: 6788392 - DNA, 57 bp, Homo sapiens
aaaatctaagtagcgagtaaggctaattgaccagcatttactccttaatgaggtttt

SEQ ID NO: 6788393 - DNA, 94 bp, Homo sapiens
ggcacccgcaggcttggggcagcttccagagctttgcgcttggaacagaaggttccccttgggctgtggaggagtagagggcttgtgcgtgacc

SEQ ID NO: 6788394 - DNA, 64 bp, Homo sapiens
gtcattaatcaccgtggagccaatggcagctctccaggccctattcttcatgatgattaatggc

SEQ ID NO: 6788395 - DNA, 73 bp, Homo sapiens
ctgctggccgggttcatcgaggctgctgggtcagtttgacacctgctcagccctggtgaggttggctatgtgg

SEQ ID NO: 6788396 - DNA, 75 bp, Homo sapiens
atgtatcaacagtttgttccttttcattgctgaggactattccacagtacagattaataatatactgatgagcgt

SEQ ID NO: 6788397 - DNA, 58 bp, Homo sapiens
gtatgggccctaatctgatgattggtgtcattataagtggagattagggaacacgtgc

SEQ ID NO: 6788398 - DNA, 67 bp, Homo sapiens
ttagaacagtgtttgcctcgctctcactcactctcataaatgctagtgatggtcatgcactgtctga

SEQ ID NO: 6788399 - DNA, 83 bp, Homo sapiens
ggcaaactcctgggcatgggccaccccactgcccacgctgcccatggccaggcgggggtccgggggtccaagctcggagggcc

SEQ ID NO: 6788400 - DNA, 107 bp, Homo sapiens
atcttgaatgctgctttttggatttggcacaatatttatagaagacaagtggccttttgtgtgtcattaattcagagaacagtcagtacagtattaatattcaagat

SEQ ID NO: 6788401 - DNA, 64 bp, Homo sapiens
tctgtcagttctctgcattgtctcgtccaccttttatgggagatcggtaaagagcatgcacaga

SEQ ID NO: 6788402 - DNA, 93 bp, Homo sapiens
gcccgccgccctcctccaccgccatggcgttgtacaggtccagcatgaacatgggtgccgagttgtgcttgccctggaggtgcgggcgcgggc

SEQ ID NO: 6788403 - DNA, 75 bp, Homo sapiens
gtgtgtgtactttgtggaggggaggttttgcctctccatggtacctagcccagctcctccacagaatagactcac

SEQ ID NO: 6788404 - DNA, 90 bp, Homo sapiens
gcagtggctaagtcacccagggcatcatgggttggcttaagtcacagaggttggcaaatgatggcttgctggctgaatctggctcactgc

SEQ ID NO: 6788405 - DNA, 90 bp, Homo sapiens
caagtctaaactgcagcttaaaggagttcaataaatttcaagttgtttttaatgtcaaagggttgaatttagacaagctgtgttgacttg

SEQ ID NO: 6788406 - DNA, 70 bp, Homo sapiens
tcagggtgggaggacccttgaggccacattataactctctagggcatgaatttcctccacagcaccctgg

SEQ ID NO: 6788407 - DNA, 56 bp, Homo sapiens
acactcactcactctctctggaatgtccatttatacagagctgaagggtgtagtgt

SEQ ID NO: 6788408 - DNA, 91 bp, Homo sapiens
agtgccagtggtacaacctggccctagccctgggattagaaattccattccttttgtggggtctgggcgcctggataggctcgctgcgcct

SEQ ID NO: 6788409 - DNA, 55 bp, Homo sapiens
tagctttgaccaacgactggtcctcactaatgggagaccaggagtatcagagctg

SEQ ID NO: 6788410 - DNA, 76 bp, Homo sapiens
tggtgtcttccatatttctgcttaggactctgtggaccatgagtgtataaacttaagcaggaacctaggagagcta

SEQ ID NO: 6788411 - DNA, 84 bp, Homo sapiens
gtgttttaatcccatcaggtttaggtgggagagtctcaagattcaaatctttttttcctgagccttgtggtctaattgaaaggc

SEQ ID NO: 6788412 - DNA, 69 bp, Homo sapiens
ccaaattctcatctcttcattagcattattgggaattgtagcccaggagtaggtgaaagagagagatgg

SEQ ID NO: 6788413 - DNA, 68 bp, Homo sapiens
gctgcctcctgaaagcgctctggttaggtaagacaagccattccgttaatgtgttacaggagtgcagc

SEQ ID NO: 6788414 - DNA, 62 bp, Homo sapiens
tcatgaacacatgtcctccttggattgccacagcagcagggaatgatgcctgtgtttcttga

SEQ ID NO: 6788415 - DNA, 61 bp, Homo sapiens
tccctgcatttcccattgtgtggctccaggattcgtttgggtggccggggaggtgggggga

SEQ ID NO: 6788416 - DNA, 73 bp, Homo sapiens
cagctgctgagattggaatgatggatgggtatatggatggacacatgctgataactttcagtgacagcagctg

SEQ ID NO: 6788417 - DNA, 64 bp, Homo sapiens
cctttgaagttagatgtggtcactgacttgcttaggccagcagtgacatatatctcacttgagg

SEQ ID NO: 6788418 - DNA, 88 bp, Homo sapiens
gctttgggtattttatggcctggggcctaacttatctattccccaaagatgaaagatgtagtaccaggttttctggggtatgtaaagc

SEQ ID NO: 6788419 - DNA, 85 bp, Homo sapiens
ttgagaaggctgcacatttgccactgagctcctcggaacccctgggatttagagagcagatgtaacaaggcgtagcattctacaa

SEQ ID NO: 6788420 - DNA, 71 bp, Homo sapiens
ctctagcacttagtacagctgacattggcagctatttgttgagtggctgagtgagcggtcttaggctggag

SEQ ID NO: 6788421 - DNA, 92 bp, Homo sapiens
cctaaagatgtatttgaaatcatttatgccccaattagatgggtcatctcataaactaattggggtatagttatatgatcaaagtgttaagg

SEQ ID NO: 6788422 - DNA, 57 bp, Homo sapiens
catcaggtgcctctgtgcagtgagcaacctgaattactgtaactggtggcctaggtg

SEQ ID NO: 6788423 - DNA, 88 bp, Homo sapiens
tctacttatattcaatttccagaatagggaaattcatgaagacagaaaatagattggtgatttcctaggtctggagaagatggggaga

SEQ ID NO: 6788424 - DNA, 60 bp, Homo sapiens
aatctgggctcagccctggctttggtggcaaaatatcctccccaggtctggggccagatt

SEQ ID NO: 6788425 - DNA, 72 bp, Homo sapiens
tcacctctgcctaatttctgactcacatactgactggtttcatgtactgtcgaagttgatggatggaggtga

SEQ ID NO: 6788426 - DNA, 80 bp, Homo sapiens
atggttaagtgtcctggagttataatgcctgaacataagtgaccattaaatgattaggtttttctttgacactttactat

SEQ ID NO: 6788427 - DNA, 77 bp, Homo sapiens
cagggtagaaggagtctcccctgttggccaggttttcaccagaaatactgtccaccatggagcaaggccttgccctg

SEQ ID NO: 6788428 - DNA, 83 bp, Homo sapiens
aattcaaatagctgtattctccagctcactgtccatattgtgtatctgtgtgtgtatgtgtgttgggggagaggtgttgaatt

SEQ ID NO: 6788429 - DNA, 73 bp, Homo sapiens
cttgatgtcctgtagcaggaaaactgctcccaagctgcaatctgtggcttgaattctgcttgcaaatatcaag

SEQ ID NO: 6788430 - DNA, 86 bp, Homo sapiens
tggctatgtttttgaaagtctcgttgctttataaatagataataattatgtattgtgtgcgatgagtgctttcctagtgccagcca

SEQ ID NO: 6788431 - DNA, 71 bp, Homo sapiens
gcctgtgcaaattgtgtttgcttttctctttcatgacaggccatgcagagactcaaaacagtgtgaaaggc

SEQ ID NO: 6788432 - DNA, 73 bp, Homo sapiens
gaaagaattacagaatagtctttgatggtttcttggggttctttctcaaacatatctgattttccattctttc

SEQ ID NO: 6788433 - DNA, 79 bp, Homo sapiens
tggttattttttgtaacagctgtttatatagtaaggatatcaaccctatgcttgtcatagttgttacaaatatttatca

SEQ ID NO: 6788434 - DNA, 84 bp, Homo sapiens
aagcttagtgattaaatggcttggcctttgctgttaaaaagtcttgatttcacatcagagcccggcaatttatttgttatgttt

SEQ ID NO: 6788435 - DNA, 76 bp, Homo sapiens
gctccctgtgctcagagccctgcctcattcggccttgaatccgtagaggccagcagagtttctggcacattggagc

SEQ ID NO: 6788436 - DNA, 68 bp, Homo sapiens
cttttcttgtattggatgccccaaccctcatgtgcatgggggaaagaggcattgcagtgcaggagaag

SEQ ID NO: 6788437 - DNA, 63 bp, Homo sapiens
gctggctctacatttgaggtcattaatggattgtttaatgtgtattccattgtagcagctagt

SEQ ID NO: 6788438 - DNA, 70 bp, Homo sapiens
tttgggggttagtttaggaaattgggtattagaggtcatcttcttttccctctgaactgatataaccaaa

SEQ ID NO: 6788439 - DNA, 75 bp, Homo sapiens
aggagaggaggccaggcccacacctctgcacggccagtttcaggctgaataggtcctcgggctgcttcctgttct

SEQ ID NO: 6788440 - DNA, 68 bp, Homo sapiens
ccaggctttgtctccagccaagccccaggcaggcagcactgcctggacaggcaagcaagacatactgg

SEQ ID NO: 6788441 - DNA, 62 bp, Homo sapiens
gggtgagctggctgccttctccttaggccattgtggcccctaaagcccagccagcttcatcc

SEQ ID NO: 6788442 - DNA, 88 bp, Homo sapiens
gaggattgaagcagcttgctcaaggttatagatctcttaattggcaaagctgggacttagacctagggaaggtagctgaagatctctc

SEQ ID NO: 6788443 - DNA, 72 bp, Homo sapiens
aggagagatgttggagtaggcagagagaaccatcagcagtggggttaactgcctgccttcagcagggctcct

SEQ ID NO: 6788444 - DNA, 95 bp, Homo sapiens
tatagggtcatctttaaaacatattaactgcactacactattaaatgtctgtagatgaaatgtgtgttattatgaatgaagaatatgggtctatg

SEQ ID NO: 6788445 - DNA, 84 bp, Homo sapiens
tcctttgcctttctctgattccttttaatgatgggacaactaattagccattaaggattagtcaaagagggcttaagcagagga

SEQ ID NO: 6788446 - DNA, 93 bp, Homo sapiens
gtggaggtgcagacaagctctcgaagagacttcccagctcctgaatccttcccagaagaagtatgggaggtcagttttgagctgtacctaaac

SEQ ID NO: 6788447 - DNA, 68 bp, Homo sapiens
gacgctacacttacagtattgttaaactctttcaccagaaggagaagattaatctgtaatacagcgtc

SEQ ID NO: 6788448 - DNA, 66 bp, Homo sapiens
aaagaactgagtgaagggtcgccaccagggtgcttgtggacacaggtggcttctttcatcttcttt

SEQ ID NO: 6788449 - DNA, 72 bp, Homo sapiens
gagtaggaagagctcaggactggggctgggggtcaggagacccaagttcaagtcctggctctgccactgctc

SEQ ID NO: 6788450 - DNA, 96 bp, Homo sapiens
gggccctgcactcggagcagccggccggccctgccggccccgggcaatgaggggtttagcacccgggccagcggctgcggagggtgtactgggtcc

SEQ ID NO: 6788451 - DNA, 64 bp, Homo sapiens
tgatttcggactttagcccttcggaacttaaataaacttctgtaagctaccaagtttgtggtca

SEQ ID NO: 6788452 - DNA, 62 bp, Homo sapiens
ggcctggctgcttagcctacttcccttgggcctctgtgggcctgggcggccatgtgtaggcc

SEQ ID NO: 6788453 - DNA, 83 bp, Homo sapiens
tagataactggtaaatagtgaaagaagagtgaggagtcaacagatgattctgcttcttatttcacgtgctttagtggtattta

SEQ ID NO: 6788454 - DNA, 62 bp, Homo sapiens
gcaaaagggtaggcccctcttgcttggggtcctacacccctcggaactggctctgcccctgc

SEQ ID NO: 6788455 - DNA, 68 bp, Homo sapiens
cacactgcctttctaagtggataattgtaatcaatgtttgatcatccatactattgagaggcatattg

SEQ ID NO: 6788456 - DNA, 68 bp, Homo sapiens
tcagccatttagagaagattacaaggacatgaagctcagtcactgtaggaatctctaaattgggttga

SEQ ID NO: 6788457 - DNA, 84 bp, Homo sapiens
gctgccctgagaggctcataggctcagggctttgccaactcttcctagggttagagcctcatggcctcagcctccagggacagt

SEQ ID NO: 6788458 - DNA, 60 bp, Homo sapiens
agctttatcagaggagtctctacttttctaaggattaggtcaattcctctgttagatgct

SEQ ID NO: 6788459 - DNA, 59 bp, Homo sapiens
cttcacactgtttttcatagtggttgtactagtttacattcccaccagcagtgtagaag

SEQ ID NO: 6788460 - DNA, 80 bp, Homo sapiens
ctggaaagactcaggaaatgagaggctctcttgttctgacaaggcaggctgagagctctcatttagggtcatcactccag

SEQ ID NO: 6788461 - DNA, 59 bp, Homo sapiens
gttttctcaaatataagctaaatgtggttgacagaccactgatggtgatttgaggccac

SEQ ID NO: 6788462 - DNA, 130 bp, Homo sapiens
tcaaataccttttacttctttgaaaaatgtagtacttattgtgataccatgcagtagtcctgaaaatgcttcaaaaggattccaagtactttatgttactgtaaactgcaccatgaatgtggaaagttga

SEQ ID NO: 6788463 - DNA, 59 bp, Homo sapiens
taatgctgccaagccatgcagagatggaagagaattttaggtatgttttggaagtgtta

SEQ ID NO: 6788464 - DNA, 123 bp, Homo sapiens
taaaagttttgaagcattttcagctcatggtgaatatatgtattgattcattattgaacaaatatttgtaagaatacatgttttctactattctggaggctttataaaaacataaaactttta

SEQ ID NO: 6788465 - DNA, 73 bp, Homo sapiens
aggttggagttcagtggcgcgatctcggctcactgcaagctccgcctctcgggttcacgccattctcctgcct

SEQ ID NO: 6788466 - DNA, 75 bp, Homo sapiens
tccttacccttcaggaatgaggataaacattgctcccccaggatagcattgcgtcatttctggagtgtcttagga

SEQ ID NO: 6788467 - DNA, 107 bp, Homo sapiens
ttatatggaaagtaatcaaagaattttggggggattaatttatttgtttttatatatcagatactagttacagcactcaaagttttcaggttagcctttaaatatga

SEQ ID NO: 6788468 - DNA, 64 bp, Homo sapiens
agagatttctactgcactctttggttacctgttctgggacaaatatagtccattagaagtcttt

SEQ ID NO: 6788469 - DNA, 56 bp, Homo sapiens
ttaggtagccccacagtacatgtttatattgagcacaatttctgtggctaacctaa

SEQ ID NO: 6788470 - DNA, 94 bp, Homo sapiens
gggggaggagggaacaaggaagggtaggcttaggctggaaggggccttaagagccaacttatccatctccttgcttcctgacagcaccttaacc

SEQ ID NO: 6788471 - DNA, 65 bp, Homo sapiens
ttggtcacagggatgagcaggtatctaagactgggctgatgatagaactccatccctctgaccaa

SEQ ID NO: 6788472 - DNA, 58 bp, Homo sapiens
cactgtcttttgtgaagacaatgaggaagcacgtactcttttgtagcaaatggcagtg

SEQ ID NO: 6788473 - DNA, 61 bp, Homo sapiens
cttctaagaactttgtagcctgttctggaggcattagaaagctacttaggttttaaggaag

SEQ ID NO: 6788474 - DNA, 89 bp, Homo sapiens
agagtttttaattatgaagtgatgttgaattttgccagatgctttttctgcatcttttgagataatcatgtgatttcatcctttattct

SEQ ID NO: 6788475 - DNA, 76 bp, Homo sapiens
ctgggagcttgttaggaatgcagaatctcaagctcctccctactgaatctaaagctgcattttaacaagatcccag

SEQ ID NO: 6788476 - DNA, 82 bp, Homo sapiens
tagtggaatgcaattaggaagcctaaattaagtggtaatggagaaccagctcttgaaactggggtttccacggcaaccactg

SEQ ID NO: 6788477 - DNA, 73 bp, Homo sapiens
ttgtaatttccctttgggtcctggctggcctagatgcacattcaagtgggtgggcgactgagaggggtttcaa

SEQ ID NO: 6788478 - DNA, 83 bp, Homo sapiens
ctataaccaggctgttctggctgaaaatacatctttaaaacattttaacagtgtgtccagtcagtttcatccactggatatgg

SEQ ID NO: 6788479 - DNA, 56 bp, Homo sapiens
ggcagtagtttatggctaaacctatatttcttatctgggttccacttactacagct

SEQ ID NO: 6788480 - DNA, 97 bp, Homo sapiens
tggaagatgtctctgaattcagatatggagtctaaaaccacagaatgaagtagagctcaatggtttgggaaacatatttctgcaagacatccaacca

SEQ ID NO: 6788481 - DNA, 67 bp, Homo sapiens
ggtgctggctacaagtgtgtttagtttgtgacaattcatcaaactgtatatttatggcatgtgcgct

SEQ ID NO: 6788482 - DNA, 56 bp, Homo sapiens
ccagcagcatcctgcagcactttaaagaagtgtgcattgatcgaggagctagctgg

SEQ ID NO: 6788483 - DNA, 55 bp, Homo sapiens
gatagtgcaaggcttttcagaagaagctgatattttctgagaagcaaacaatgtt

SEQ ID NO: 6788484 - DNA, 78 bp, Homo sapiens
tcttccaggccattgactgcatcctcactgcacatactggatggctaaaaagggtatgcagtctatggcctggaaaga

SEQ ID NO: 6788485 - DNA, 71 bp, Homo sapiens
gtgcgaggagaggggccttggggaaaagctcagacccaccctaacttgtctcctgggtcccttccacccac

SEQ ID NO: 6788486 - DNA, 89 bp, Homo sapiens
tgtagttcatttctgatacagtcccaacacaaatggctgtcctatttagatggcattggtcaagactgatatcaagataggtaactata

SEQ ID NO: 6788487 - DNA, 107 bp, Homo sapiens
aaagatcttgaggtcacagaaaaggtcaaaatggaggcacagctgaatcaatccacttattcaacccaagttctccattttcctccaatttctggacctaatttttt

SEQ ID NO: 6788488 - DNA, 130 bp, Homo sapiens
agtgttgtcaattatttagctaacaggcagaaaactaggcttttattgacatccaaagggactctcctgagtgtaataatgaaggcagtttattgaatgcctgtgaggttgctttctaattgtacgcatt

SEQ ID NO: 6788489 - DNA, 86 bp, Homo sapiens
tcattgtatgcattatttgtccattctactgttgatagatattaggttgtttccaatttttaagtggatgactaatgctgctatga

SEQ ID NO: 6788490 - DNA, 56 bp, Homo sapiens
gctggcagacttcctctggaacttcctctggacatctggagggacgtcctgtcagc

SEQ ID NO: 6788491 - DNA, 72 bp, Homo sapiens
ctgggctttgctccgttgtcctcggccaagcacctgccctggctgcaagggcacggaccctgccacgcccag

SEQ ID NO: 6788492 - DNA, 127 bp, Homo sapiens
gcagcgtggaacgacgggctcctcggtggccagcagctggtgagacacagccgcagccgtagctgcagggctaagacatgtccgccggcctcgcggtttgagaggcggcctgtaccaagcacgctgc

SEQ ID NO: 6788493 - DNA, 63 bp, Homo sapiens
acagccactgtggtctagctgcactgtctggcagtcagctccagagttgcacagtgaccctgt

SEQ ID NO: 6788494 - DNA, 100 bp, Homo sapiens
tattttagcctcatgcttctattcagttcacctctgtatgatgaattcttgatgtgtaactctcctatagatactgggtatggagatgaaaaagaaaata

SEQ ID NO: 6788495 - DNA, 72 bp, Homo sapiens
tcccaaagcttgttgggtcagttttgggggactgcattttcatgaaccagagctgcatccagcaggttgggg

SEQ ID NO: 6788496 - DNA, 79 bp, Homo sapiens
gatgaatttatagtcattctgcagaaatataaaggaactagatctcctaatggccttagtgatgattaatacgttcatc

SEQ ID NO: 6788497 - DNA, 62 bp, Homo sapiens
gctttctcagattccccttttaatattgtgatgtaaaggagggaaattttggtaaaggaagt

SEQ ID NO: 6788498 - DNA, 85 bp, Homo sapiens
ctgtttttgttctcactactctagctctagaaagatctagcctctctagatgtcagaggtggagatagttgggaaggagtaacag

SEQ ID NO: 6788499 - DNA, 71 bp, Homo sapiens
aggctggagtgcaggcttggctcactgcaacctccacctcccgggttcaagcaattctcctgcctcagcct

SEQ ID NO: 6788500 - DNA, 56 bp, Homo sapiens
agtctttggctgcctgaagcccaagtcaacatctgactgcagccacgtgagagact

SEQ ID NO: 6788501 - DNA, 55 bp, Homo sapiens
tgaacctgcaaggctcacattgaactgaatttttcagatctgagttttgggtcca

SEQ ID NO: 6788502 - DNA, 76 bp, Homo sapiens
gtacctaggtacacagtaagtgctcaatagacacttgctattatcgttacttgagtactggctgtgtgccaggtac

SEQ ID NO: 6788503 - DNA, 55 bp, Homo sapiens
ccatttcttgttccaactgtgtactgttcaagggaacacttgacaccagaaatgg

SEQ ID NO: 6788504 - DNA, 63 bp, Homo sapiens
ttgaatgagatttccagaaagcgcaatgcaagtgttaaatttgtatctctggaaattcttcaa

SEQ ID NO: 6788505 - DNA, 75 bp, Homo sapiens
aagtccttgctcttttcactgtaatatgctgcgtgtctgatcacatggaatatttgtggtaaaggtaagaaactt

SEQ ID NO: 6788506 - DNA, 83 bp, Homo sapiens
ggtagagatattagtttggagactacaattggagtgatcatagattacaaaagcattatagtcccagacagtatgaaactacc

SEQ ID NO: 6788507 - DNA, 73 bp, Homo sapiens
tcggaaatgtcagaaacgccgcagtctgcgccactttgaaaaaggggcctcacagatgggcttttctgcctga

SEQ ID NO: 6788508 - DNA, 55 bp, Homo sapiens
ggatcttgggccacaatgagccgaggagctgaggtgactgggggcgccagggtct

SEQ ID NO: 6788509 - DNA, 65 bp, Homo sapiens
ggtcatgaatgttattcaggggaattcaaattgaattctctccagggtaacatcaccataaaacc

SEQ ID NO: 6788510 - DNA, 66 bp, Homo sapiens
ttgtccatacagtggcacacatctttgttttatactcactgggatgatttgccattatattgtcaa

SEQ ID NO: 6788511 - DNA, 56 bp, Homo sapiens
acaggccataaaggcaggcccttcttcctccctcgggtggccccctttatggatgt

SEQ ID NO: 6788512 - DNA, 97 bp, Homo sapiens
gcctgtgttatttatcagatttacgaccgctagtagcacttatcaaaagtgacgtttattgggtgtgaaatgttctcatttgttagataacacaagc

SEQ ID NO: 6788513 - DNA, 89 bp, Homo sapiens
gccagaagcatcttctgccaggaaagccttgagtttgacaataaactttggaagccagggattcctgagggagatgtttgcttctaggt

SEQ ID NO: 6788514 - DNA, 67 bp, Homo sapiens
ggtgttttggtagattgattatggaagtctggatagacaagccacactaaactgctcaaaccatacc

SEQ ID NO: 6788515 - DNA, 62 bp, Homo sapiens
ggttccttgtttgtagctctgggagccatcctgggggctccctcgctagaaggccgggaact

SEQ ID NO: 6788516 - DNA, 114 bp, Homo sapiens
tataatgatgaagtaagtgcagacatgtgttctaacaggagctttgcaggaagacaaagcaaatccatttctagaataagtgtttcccagtaagaaaaagaaattctctctata

SEQ ID NO: 6788517 - DNA, 58 bp, Homo sapiens
cctcacgaaaagtcatctaggggtaataatagcatctccttagatcattaccatgagg

SEQ ID NO: 6788518 - DNA, 76 bp, Homo sapiens
ttgatcagatgtttgctagatctttggcaggtaatcatatttgtggaccacactcatctattagatatctgttcaa

SEQ ID NO: 6788519 - DNA, 83 bp, Homo sapiens
taaatagggtttatcaactgttgtgttcccatggtctttagaatatgaatatgtagaaaacaaaagttgaaaacttaaattta

SEQ ID NO: 6788520 - DNA, 78 bp, Homo sapiens
tattttattttccagacagcttaggaagtttctattattcaaggttattggaaaatatggtttctggaaaatactgta

SEQ ID NO: 6788521 - DNA, 129 bp, Homo sapiens
ggctgcgttccccgcacctcaagaggtctgagctcgccccactgtctgctcggggttcccacctggcccgggccaggaggagcatcgggcaggaggcgggtctcagggccgggcagtctgggtgtgccc

SEQ ID NO: 6788522 - DNA, 101 bp, Homo sapiens
tcccagaatccttgggtgagagtttctcccaggcaacaatttacaacctgcagtatgtgtggtcctggggagacatgaactgttccaaaggctttcaggga

SEQ ID NO: 6788523 - DNA, 65 bp, Homo sapiens
ggaggtgagcagcccttcctccggccactcaagtagtggggactgggaggaggggcgctttgtct

SEQ ID NO: 6788524 - DNA, 58 bp, Homo sapiens
cagcttacagctctttcccatgggagagtcaacagcttaatgggatggagagtaactg

SEQ ID NO: 6788525 - DNA, 80 bp, Homo sapiens
gcagagcaattacacccagcattggctaagagaggactctgttcatctcgcctatctggagtgaacctgttgctataggc

SEQ ID NO: 6788526 - DNA, 59 bp, Homo sapiens
accatgtcatttattggccaaaccagaacaatttggagagctattaataatgatgtggt

SEQ ID NO: 6788527 - DNA, 61 bp, Homo sapiens
tcccagttttctttcatctatcagcaatgagaacactgcttcaggatggaagagggtggga

SEQ ID NO: 6788528 - DNA, 61 bp, Homo sapiens
gtggtcacactctctgcaggggcactgggcccagcctctgtgggaagctgggtgtgagcgc

SEQ ID NO: 6788529 - DNA, 119 bp, Homo sapiens
tgtgctctaggccagtgaccatgtgatccatcatggggcccatgtgctccaagccagcctccatgcctgcaagcaccatgtgctccatgttcaggcccacgtgttcgatggcagggcca

SEQ ID NO: 6788530 - DNA, 74 bp, Homo sapiens
ggcccccacctggggctctctggaatgcttgtggtcaggcccacagggggctgctgaggcccgggtgtggggct

SEQ ID NO: 6788531 - DNA, 63 bp, Homo sapiens
ccacagctcctgccctcttgcaattcccacactggtggggaacaaatgtgcagagccatgtgg

SEQ ID NO: 6788532 - DNA, 55 bp, Homo sapiens
caggaacccaatgggccaggccttgctctgccaggccatcctgcatggggtcctg

SEQ ID NO: 6788533 - DNA, 63 bp, Homo sapiens
tcccagtgggaagcagcacgctccctatgatggttggtagtgagatgcagtgacccactgggg

SEQ ID NO: 6788534 - DNA, 69 bp, Homo sapiens
ccacctgtgcttggtactccataccaattattttgtgtaagctaccttagtactctccaaagtaggtgg

SEQ ID NO: 6788535 - DNA, 68 bp, Homo sapiens
cagccttgttgctaccagatgcccatatgtgattcatgcccatggcttctgagtggacaataaacctg

SEQ ID NO: 6788536 - DNA, 91 bp, Homo sapiens
gcccctcttgtctttcctgggccagggtgagggctgagaggtcttcctggggaagattgagcagacggcactttggctggggaagaagggc

SEQ ID NO: 6788537 - DNA, 71 bp, Homo sapiens
ctacagatttggggagtaaagttaactggctctaaaattttaaatgggttaatttagtcaacagactgtgg

SEQ ID NO: 6788538 - DNA, 55 bp, Homo sapiens
gtttgcccgttgccaggtgcccgggttccggccctggcactagcgacggccatgc

SEQ ID NO: 6788539 - DNA, 58 bp, Homo sapiens
tctgattcaccagatttgccatgggacttaagcatgtgcattcttcatgtgattcaga

SEQ ID NO: 6788540 - DNA, 118 bp, Homo sapiens
ccaaggtgttaggccaactcctgatgctctgaaatagtagtaaaaaactatgcaattataatggtgtgtttgttagactaatgttacaggaacaatcatgaggttggggacacagtgg

SEQ ID NO: 6788541 - DNA, 81 bp, Homo sapiens
gaataagtgcacttcattagagcagataatatgtgtgttcagttcatcctgtcaagcgcacctgctctaaagtggctattc

SEQ ID NO: 6788542 - DNA, 103 bp, Homo sapiens
gtagtcaagctgtcaaagtttctgtcatctgaatgcttgagtggggctggagaatccacttccaagtttattcatgtgactgtggctgttggcaggagacaac

SEQ ID NO: 6788543 - DNA, 72 bp, Homo sapiens
tgaatatgatactttggagacttgagtatattattttgcttaagtaatgcaaatgtgtgcatttattattca

SEQ ID NO: 6788544 - DNA, 58 bp, Homo sapiens
tgcaggaactcgaaaactatagtgaaggaggtcctctctataaaaatggttctttgcg

SEQ ID NO: 6788545 - DNA, 60 bp, Homo sapiens
gccaggtggtctggctccagagcctgcacttttaacctcctcttgagcatttcatttggt

SEQ ID NO: 6788546 - DNA, 73 bp, Homo sapiens
tcccattccagtgctctgtcaacatgtcaaagggctattaagcaagtgactagttgccggggctggggaggga

SEQ ID NO: 6788547 - DNA, 77 bp, Homo sapiens
agtatggttttgtctgatgttccctcatgattagacatatataatcatttagagtatacatttttggcaggaatact

SEQ ID NO: 6788548 - DNA, 70 bp, Homo sapiens
taatacaccataaattagagaagcaagactatgagtccactgctgtcaatttagtttacctggtgtctta

SEQ ID NO: 6788549 - DNA, 81 bp, Homo sapiens
agatctgctcctaccagaggcaggacttctgcagcaggtgactgtggctgcaggagttcccctctgcctggccaaaggttt

SEQ ID NO: 6788550 - DNA, 56 bp, Homo sapiens
agggcagcaaatctgagtctggtagggtggactcttaccaggttttgtagtgccct

SEQ ID NO: 6788551 - DNA, 123 bp, Homo sapiens
ctggctacattaaacaagtaaatttgtagcttagcacggtttacttaacaagcccagttatgacagagctggagaggagagaaagctgtgttggagaggcaggaaggtgtgatgttcagccag

SEQ ID NO: 6788552 - DNA, 61 bp, Homo sapiens
tggagctatcagagttatagtcattggactggcagtccagctgctctcatagatggcttca

SEQ ID NO: 6788553 - DNA, 60 bp, Homo sapiens
ggagggtgtgcctgccgggtggccaggctatctgccttcctggcagcagcacatgccttc

SEQ ID NO: 6788554 - DNA, 60 bp, Homo sapiens
cataaatagctttttgctttccaatttctaaaagatgcttgaaggcagaagttggatatg

SEQ ID NO: 6788555 - DNA, 79 bp, Homo sapiens
agagtctgtgttgttcgaactggtcagtttagcccactgtacaatgctcatgacagtactgatattaacagacaactct

SEQ ID NO: 6788556 - DNA, 113 bp, Homo sapiens
tcagttacatccacggaatatgaaagttcaagctgtggtacttgattcacaattaaacagatttgaaggagctacagcttccaacattcttgaattcttaaagtgataattga

SEQ ID NO: 6788557 - DNA, 130 bp, Homo sapiens
caccatgaaccgcttcctaactcccccagacagaaatgccgcctgtttcttcttttctgagcaatacactgttctagaaactggagcaaacagacactgcccctgctctcctggagcacatattctggtg

SEQ ID NO: 6788558 - DNA, 76 bp, Homo sapiens
gctaagatcagatctgctgtcaagctgcacactctgatgtgggctgtgcaaatgagttgcagatcaggactttagt

SEQ ID NO: 6788559 - DNA, 85 bp, Homo sapiens
actaggcatgagagtaggtatccacattgaggaggggaactcagtaaaagggtgctttactctaaaatttctactatgtctcagt

SEQ ID NO: 6788560 - DNA, 63 bp, Homo sapiens
tgcaagaccatcctaaagatagacatctgggtcatcagctgtgtgtgcttgggattatgtgcg

SEQ ID NO: 6788561 - DNA, 85 bp, Homo sapiens
aggtacatgtatttgtattaggccctagggagtttcaagacaagctgaatttccttcagtgtttaatacttcataaataaagcct

SEQ ID NO: 6788562 - DNA, 56 bp, Homo sapiens
ccataggttatcagtttggatagtggatgaagttaatcagataaggtgatctgtgg

SEQ ID NO: 6788563 - DNA, 71 bp, Homo sapiens
cagtgtcttttccacaagctcttttcctatggcctttaggggcacatgactttgaggaaaccagacagctg

SEQ ID NO: 6788564 - DNA, 105 bp, Homo sapiens
ccttatccccaaggagcttaaaatctggcagttagctataaagtgcaataaaagtaaaaaacgtaaatagtggttcaaaattgcgcaggttttcccacaggaagg

SEQ ID NO: 6788565 - DNA, 58 bp, Homo sapiens
aggatttggaagaccgggtcacaaggtttttgctttgtgactaataatccacaatcct

SEQ ID NO: 6788566 - DNA, 66 bp, Homo sapiens
ttgaatggagaccctaaggaagaggtagaaattacttgttcaataactcttagaggtctttttcaa

SEQ ID NO: 6788567 - DNA, 100 bp, Homo sapiens
tgcagcctgccccattttattaggttggtgcaaaagtaattgtggttttttgcattaatggcaaattacttttgcaccaacctagtgggtgttagctcca

SEQ ID NO: 6788568 - DNA, 59 bp, Homo sapiens
gaatcatggcagcaccaggttgcaagctgtattagttacttattgctgcacaatgattt

SEQ ID NO: 6788569 - DNA, 76 bp, Homo sapiens
tctaaggccttgaggatagaacatccctcatcctagcaggaaataatgaaaccttctaaccttaaagccctttgga

SEQ ID NO: 6788570 - DNA, 124 bp, Homo sapiens
ggatgtcacttccccgactgtctcttggttggcttgtccttgtgcaagacccagcctgtcacgacagagcctgggcacttcagaggaggagccaggatcgaatggaaggggggaattggggtcc

SEQ ID NO: 6788571 - DNA, 130 bp, Homo sapiens
catctatgaagtacattgtgaaaacttcattattgaaccttgttttttgggagaaggaagctgagattcagagaaactgaggtttagagaaaccaagtgatttgcccctgaactacatggctattaaatg

SEQ ID NO: 6788572 - DNA, 63 bp, Homo sapiens
atttggcagacagagggaggaagaaacaagcctacaagaattcttaccagcctcctgcctgat

SEQ ID NO: 6788573 - DNA, 87 bp, Homo sapiens
tatttaaaatatggaactcttggcagtaaaagaaaatgcttaggaacctaagtttctgatattgttaaagctacatgtgaaataata

SEQ ID NO: 6788574 - DNA, 75 bp, Homo sapiens
gggaggtggcactggagtcagtggctattgggcacctcccagtgccctggagtcagtggctattgggcacctccc

SEQ ID NO: 6788575 - DNA, 55 bp, Homo sapiens
tgtacagaacttgctgtcccttaagccggctcagggatgggaagaaatttgtata

SEQ ID NO: 6788576 - DNA, 111 bp, Homo sapiens
ttgaaatagtttatttgtccacagtgtgatttctgttgagaaacatgggctcaccgacttttgggtctcttctaacactagaaattcctctggttttttagactatttcaa

SEQ ID NO: 6788577 - DNA, 67 bp, Homo sapiens
gctgggtcaggagcggctgcccgaggtccagaggaagtgtgtggacagcgcggccttcctggccggt

SEQ ID NO: 6788578 - DNA, 108 bp, Homo sapiens
gtcctagagcagctgtgctgactgtgttccttctggattagattctcagcagttctaatcttcagcactccagagactgggatatataggcaccaggctcctctggac

SEQ ID NO: 6788579 - DNA, 59 bp, Homo sapiens
gcaactactgtgtttaagaaacagcaaaaaggctgtgtgctgaaatgcagtgagaaagc

SEQ ID NO: 6788580 - DNA, 94 bp, Homo sapiens
agggaggtctcagctgttggagtatgggtgcttctagttttaaagaggtgtgggctctgctaaagtttccgtctttcattcagtcacactccct

SEQ ID NO: 6788581 - DNA, 78 bp, Homo sapiens
gtgaacttgctgtgtgccatcagggctgtatttgaaataaaattctggcctgagaatggaacagttagcattgttcac

SEQ ID NO: 6788582 - DNA, 80 bp, Homo sapiens
tccttttgtctcttcagtaaatgacactgttggggaaatgattgtccagttatgtcaaagtcactgaggcaataaaatga

SEQ ID NO: 6788583 - DNA, 61 bp, Homo sapiens
tcttgttgtaactactttatctgccttgggattttgaggctgaggtacatttacaggaaga

SEQ ID NO: 6788584 - DNA, 67 bp, Homo sapiens
tgtcaggttattgccatgcaaaagagtggtaacttccaggtgttgccatagcaatggtaagctgaca

SEQ ID NO: 6788585 - DNA, 68 bp, Homo sapiens
aatgtgtcctataactagaaatgtgttttgagcaatttgtaggctcagtttatggtctagttcatgtt

SEQ ID NO: 6788586 - DNA, 63 bp, Homo sapiens
gtgcctgctctgtgccacagttgggagcaaaacagacatggcctcggggctcagagagtgcac

SEQ ID NO: 6788587 - DNA, 61 bp, Homo sapiens
tccctcagcttctccctgcagctcttgtcgacaagacccaggccagatgagaggtcaggga

SEQ ID NO: 6788588 - DNA, 61 bp, Homo sapiens
ggggaaggaaagttattagcagagatctcccagaagtcctctgtaactgtcccttttgccc

SEQ ID NO: 6788589 - DNA, 80 bp, Homo sapiens
tccttatggaactgtcataatttttttaagtcagaacaagctctggcttgttttgagaaacttaagatatttcctttgga

SEQ ID NO: 6788590 - DNA, 88 bp, Homo sapiens
atgttgaactgtgaactttggaaatgagaagccacctttcgccgcttctgaaggtgactcacaaagccagtttcacttggttccacat

SEQ ID NO: 6788591 - DNA, 110 bp, Homo sapiens
gattcacttaaatctgttttaaatgaaaaattatgtggatattaatgaactttacatattgaactctggaaatctacatggccatattatttgagacagccgtgtgaatt

SEQ ID NO: 6788592 - DNA, 74 bp, Homo sapiens
gctaatagatgtctgacacagagaaaaactaatcattatatttagattttgtcaaatatcagcatgttattagt

SEQ ID NO: 6788593 - DNA, 122 bp, Homo sapiens
tttttgcccaggtgtgaaaaccttatttgtataagccttgtctacgggccatggggtttccttctttatgcatctctaggaagggccatgtcacaggaaggggagcacatttggggcaaaga

SEQ ID NO: 6788594 - DNA, 87 bp, Homo sapiens
gtctagaggcattagttagctgttcagagaagaccactctgtcttactctttagtgtggccttttagaataaactcttcctctgagc

SEQ ID NO: 6788595 - DNA, 78 bp, Homo sapiens
gggtctcttctggcaaggcaagcctggcttgtactctctgtggaaacttaactagccatggctgcagctagagggccc

SEQ ID NO: 6788596 - DNA, 75 bp, Homo sapiens
catgtctgtctttgctcatcattgcagtggggtggtgagcccatcccttgtcctgtgggaagagctcagtgcatg

SEQ ID NO: 6788597 - DNA, 73 bp, Homo sapiens
cctaggcagcgcttggctgtgctttgcccagtttccctccaggctttttctaggtagccaagtcctgcctggg

SEQ ID NO: 6788598 - DNA, 86 bp, Homo sapiens
aggccattttcacttcttttgtgattcttcagttacttcaggccatgtaggcgtataggtgcaggtcacaagggatgtgatggctt

SEQ ID NO: 6788599 - DNA, 55 bp, Homo sapiens
gctagaggcaacaactttataggcggaaggggccttatagatcacatcttctagc

SEQ ID NO: 6788600 - DNA, 97 bp, Homo sapiens
ggtgctcattcagagaggggctgtcatctgggagcctgtgcccctgggtcctcgagggttatggcttgtccctggtcagtcctgtctgatcgaggcc

SEQ ID NO: 6788601 - DNA, 82 bp, Homo sapiens
ctgacagctgtcaagtttgcatttgtttagaacctgaagttatctgtcagttgtctatgaaattcactgctttagctttcag

SEQ ID NO: 6788602 - DNA, 76 bp, Homo sapiens
ctgttctgcccaccctgagccttgatggctgagccttgagcagctcagctaggggaccaaggtggcccaaggacag

SEQ ID NO: 6788603 - DNA, 126 bp, Homo sapiens
tagggagcggctgtgtcatacattcgtatatctcctgtatgggactggcgagtaggaaaactttctctcctcccatgtaggagatgatgtcttttgaattacttctacttttacagtggtttcctg

SEQ ID NO: 6788604 - DNA, 72 bp, Homo sapiens
cccactgttcagtcttgttgaaaacttggcacacatgcttgaggagtttaatagggatcttgtccagtaggg

SEQ ID NO: 6788605 - DNA, 76 bp, Homo sapiens
atagatgtatggataggtgataatgaagcagccagaattaaagagcttatatatctgttcatgtttatatgtctat

SEQ ID NO: 6788606 - DNA, 56 bp, Homo sapiens
tgctgccattggattttcacattttactctttgaaatgagactaccagtggcagca

SEQ ID NO: 6788607 - DNA, 112 bp, Homo sapiens
gcatatggtcggtgcacaaaaataagtatgctttatataacagagactgctatgtacgttaaagtgatggtgatgttatagtaaacaactttacaaattgttgcacatatgc

SEQ ID NO: 6788608 - DNA, 87 bp, Homo sapiens
aatctgtagtcataagcagtgtgggtgaaatacaaagtgtatatttagactttagtgttgctcatacatatgcattgtttttagatt

SEQ ID NO: 6788609 - DNA, 113 bp, Homo sapiens
ccccagcacctccagccaccctgattcagggacatcgcagagattggtgtttgacgctacggcagcagaggcgcagactcttgagtgttggagggtgtctggagggcctgggg

SEQ ID NO: 6788610 - DNA, 56 bp, Homo sapiens
gttcccacccctgagctccgatgctcatcacatcgggagtttttctggatgggggc

SEQ ID NO: 6788611 - DNA, 56 bp, Homo sapiens
cgtgccgctccaggtctcgcggtgagcggaacagcttctcgcactcggagcagccg

SEQ ID NO: 6788612 - DNA, 83 bp, Homo sapiens
tcatagcacaaagccttcataatcttgggctttcctcttgatgaaatgggaagccacagagattgtgggggaggtggtactga

SEQ ID NO: 6788613 - DNA, 67 bp, Homo sapiens
tgacttgcctaaagaacaaatggtcttgaagaaaattcacgtgtttattgcatcttagtgtaagtca

SEQ ID NO: 6788614 - DNA, 78 bp, Homo sapiens
gacacctaacaattattcagtgacttaagagatatactagtctgtttcttagtcatgtaatagtccaggttaggtgtt

SEQ ID NO: 6788615 - DNA, 55 bp, Homo sapiens
ccgcccagtcttccctctttagcttcctccaggctgaggggttataacagggtgg

SEQ ID NO: 6788616 - DNA, 66 bp, Homo sapiens
ccggcaaaggccccttccccaggacagaggtgtggtggcacagtgctgggggccagggaccgctgg

SEQ ID NO: 6788617 - DNA, 71 bp, Homo sapiens
cctgtggggggacttgtttcatgcccaaccccgtgcctgggcagaaggccaggaacgatcctacccttagg

SEQ ID NO: 6788618 - DNA, 82 bp, Homo sapiens
atgggccacagtgaagtttaaagtgtagatgttttccaattattcagggcatttatgctaattgtactgacaaagagtctat

SEQ ID NO: 6788619 - DNA, 78 bp, Homo sapiens
aaggggtcttctttggtctcctctctgccagtctcctgaaagaggggaggggtggaaggagtgcctggaaggtctctt

SEQ ID NO: 6788620 - DNA, 73 bp, Homo sapiens
cattaattagctgcagagtagggcatgtacctgttcaactttacaatatactgccaaattgcagcaatgtatg

SEQ ID NO: 6788621 - DNA, 55 bp, Homo sapiens
agctatgcaggatatccctaggaggacagaaccttctggaccaccttgtaaagct

SEQ ID NO: 6788622 - DNA, 65 bp, Homo sapiens
aacctcattttacataaggaaggtttaactcataagggttaaataaacttggtcaagatcaggtt

SEQ ID NO: 6788623 - DNA, 111 bp, Homo sapiens
ttttgtccctccctttgttttcttgtcaagattgacaagcatccatgtgttaccaagtgacataaagttcttgcttgaataatcatgactaaaatccagggtattttaaag

SEQ ID NO: 6788624 - DNA, 64 bp, Homo sapiens
gtttccaggagaaagagagccttgaagtgagtcttcaaggaaactagaagttttcctggtaaat

SEQ ID NO: 6788625 - DNA, 55 bp, Homo sapiens
gggacctggacatgtgtgtgctctccgagctgagctgtgtgcgcgtccgggttct

SEQ ID NO: 6788626 - DNA, 90 bp, Homo sapiens
gtggtgggtgtcaccaataataacttgagaattgagaagtacatattctcgcttcactcgttttcatgcctatttttggacatccaccat

SEQ ID NO: 6788627 - DNA, 55 bp, Homo sapiens
ttagtatttgtggtgccaatgtgaatgccacaaatggccaaaaccatattattaa

SEQ ID NO: 6788628 - DNA, 72 bp, Homo sapiens
gaattcctgcccaatactgaacttaaaagtatgaatttcattgttagttttggtatgtggcaagcagagttt

SEQ ID NO: 6788629 - DNA, 65 bp, Homo sapiens
gcaaagacccaggtgtctatccacttgctagaaaccatcatgagagttagataccagttttctgc

SEQ ID NO: 6788630 - DNA, 62 bp, Homo sapiens
ggcgcttgaacagggttgggtgagagaggaagtcccttacagtatgacactgtccagaagct

SEQ ID NO: 6788631 - DNA, 56 bp, Homo sapiens
tagtgcctttaaactgatcatcagggagaatcttgaaaaaatcatttgaagggctg

SEQ ID NO: 6788632 - DNA, 87 bp, Homo sapiens
tcggtcatgtgtttttcatctttgtatccctaacacataacagtacttggcatttgttagtaatcaataagtgtaccacatgactga

SEQ ID NO: 6788633 - DNA, 61 bp, Homo sapiens
gcagagcagtgggggtctggagccaggggctgggtccaggttctgccgcttactgctgtgc

SEQ ID NO: 6788634 - DNA, 56 bp, Homo sapiens
ccaggtggggtccagagctcagtgcgtcttgctggctcccagaggccccagcccgg

SEQ ID NO: 6788635 - DNA, 97 bp, Homo sapiens
ctggggacctagcagatgcctgaaggagctgggtttggcacctttgccagctccaggaccccagctcttttagcggcatctccatggcattccttgg

SEQ ID NO: 6788636 - DNA, 74 bp, Homo sapiens
agatagagctgcctgacaagtgctgctcatggtgattagccatgtaaatgagtacagtcaggaagctgctgtct

SEQ ID NO: 6788637 - DNA, 83 bp, Homo sapiens
acaatagtagcattgattcagcattcattatgcgccagttgctggactgtgctagttgctgctgaccgtatgtgctttattgt

SEQ ID NO: 6788638 - DNA, 68 bp, Homo sapiens
ggacaggcagagcatcccctgcagtacaactacactttctggtactccaggagaacccctgtctgtcc

SEQ ID NO: 6788639 - DNA, 73 bp, Homo sapiens
agtgagtggatgtaggaattggggtaaatgagcaatagctgccttgtcatttcaagttctgtgtcttactcct

SEQ ID NO: 6788640 - DNA, 59 bp, Homo sapiens
tgggcctgctggggcattttcaaaagacaaatagtcctgctgctgctccagaggaccca

SEQ ID NO: 6788641 - DNA, 62 bp, Homo sapiens
gggccccatggttatatgtacacactgtgatcctgtgagtctgcatgtgtggcttggggtcc

SEQ ID NO: 6788642 - DNA, 56 bp, Homo sapiens
aggtcagagatgaggtctaaagtctatccaagcactttatcctatatctttgttct

SEQ ID NO: 6788643 - DNA, 70 bp, Homo sapiens
tgagatatgtttgttatcacaactaggtagtgctagtggcatccagtgagtagaagacagagatagtaca

SEQ ID NO: 6788644 - DNA, 57 bp, Homo sapiens
tgattctgcttatgggtggatttattattctatatgaagaacccattcagtgaatta

SEQ ID NO: 6788645 - DNA, 62 bp, Homo sapiens
cagctccatcttgcttataccagagctggggttgacagtgggttcaaagcctgatggggttg

SEQ ID NO: 6788646 - DNA, 82 bp, Homo sapiens
acttttagcttcacttgaagggtatctgtgaaccagatacacattttcacagttactccttcagatgaaatttggctttggt

SEQ ID NO: 6788647 - DNA, 55 bp, Homo sapiens
gaatacatttgccgtggttctcctggagagccaacacatgtaaatgcacctattc

SEQ ID NO: 6788648 - DNA, 56 bp, Homo sapiens
ttcctggggtactggagaaaataagtataatactgaacttcacagatccacaggaa

SEQ ID NO: 6788649 - DNA, 59 bp, Homo sapiens
atcttcaactgcctggaactttcctgatttcaaaatggtaagtttcatgctctggggat

SEQ ID NO: 6788650 - DNA, 57 bp, Homo sapiens
ctctgactcctgcccccctcttggggcttcccacaggatcctggtacaggagcagag

SEQ ID NO: 6788651 - DNA, 57 bp, Homo sapiens
gaccagagacccagtggggagttaccgtctgaacctctccagccacttccgctggtc

SEQ ID NO: 6788652 - DNA, 56 bp, Homo sapiens
agatttctaacacagcacgccattctattctaatgggcatgcattgttggaaattt

SEQ ID NO: 6788653 - DNA, 87 bp, Homo sapiens
ggaagtctttttttctccctgaattcagtggctctcctgtctctttctgatgggtaagaccagtgttttagttagaagtgggctccc

SEQ ID NO: 6788654 - DNA, 58 bp, Homo sapiens
gtgttttaagaaagaagctcagctttggaaacaaaacagtgggagctttttaggatac

SEQ ID NO: 6788655 - DNA, 129 bp, Homo sapiens
tttcccaaattaggagttaattagtaccaaaatgtgcagtgcgttgaccggccttccactgggttcccaaagcagagaactgtctcattttgaaagtacctaattgtgcctgcatctctgtttggagaa

SEQ ID NO: 6788656 - DNA, 116 bp, Homo sapiens
gtgttttattttgcagtgttagttttgacctcattatgctcattatgctgttgtaaggctaagtatgtcatgggtcaaaatgaaggcaaaatagacctttctcagcattaaagcac

SEQ ID NO: 6788657 - DNA, 64 bp, Homo sapiens
gcttccttttggccaggtcagtgcagggaaccaacaaagacagggacctgtggccagaagaagc

SEQ ID NO: 6788658 - DNA, 59 bp, Homo sapiens
aaacctttctgctctcagcgtagactgctggaaagcacttcctgtgggcaggagggttt

SEQ ID NO: 6788659 - DNA, 81 bp, Homo sapiens
ctgaatttggaatgccttggttgcaagctgaagttagattttaactagtacatagtcagtagcaaggtattttgagcaagg

SEQ ID NO: 6788660 - DNA, 99 bp, Homo sapiens
tgttgctgttgttcagtaagctagtttctctccttactctctggataccattacagtctcaggatgaggtagaggcagataccatttcaataagcaata

SEQ ID NO: 6788661 - DNA, 63 bp, Homo sapiens
ttcatacatgtgtactgttccagggatttatttttgatctaatggtatatatcacatgatgag

SEQ ID NO: 6788662 - DNA, 86 bp, Homo sapiens
tcacaatgccagtgcttgtgtctgagcagaaacttgtttccagtctctgttgctgcttaatagtgcactggtttcctttaatgtga

SEQ ID NO: 6788663 - DNA, 63 bp, Homo sapiens
tctttaatctcttggcgttgaatacttaatccagttcagattcttggcaaggagatttaaaga

SEQ ID NO: 6788664 - DNA, 60 bp, Homo sapiens
gctgagggcatgtgtggcgactgaagggctgggctatagctagtgcgcatgcgcctcagt

SEQ ID NO: 6788665 - DNA, 89 bp, Homo sapiens
taaggatgagtccattgtcaactgaaaaccaagacacgccacctttagtctgtcagttcatcagttggctaaaatgtatttattacttg

SEQ ID NO: 6788666 - DNA, 69 bp, Homo sapiens
tggtgacgtctccatgttgtattgtctcaagcacatatggctggacagcaaacatggagagaatcatga

SEQ ID NO: 6788667 - DNA, 71 bp, Homo sapiens
agcttggcgagggagctcagttggaagcggtgaaacaagcatcattctattgttgagctgcctcgccagct

SEQ ID NO: 6788668 - DNA, 66 bp, Homo sapiens
tctggtaacttctctgattctgtgcctcttagatttgtgaggtcagcatgagtagaaggtaaaaga

SEQ ID NO: 6788669 - DNA, 129 bp, Homo sapiens
cacagtcatcttccttcaagcttggagaaaggacagtcttcccttattccactcagaggtgtccatgtgtaggagaaaggggagggtgggcctcagctctcagctcctctgatcaatctacgctgcttg

SEQ ID NO: 6788670 - DNA, 75 bp, Homo sapiens
gagtaagatgctggagttcatattggacataagcagtggacattgttttccttctgatactccatttatctgatc

SEQ ID NO: 6788671 - DNA, 76 bp, Homo sapiens
tagctgtttttctgtgattttctattctatccagctttgtcctcaggctggcatttctaagatcacaaaatagctg

SEQ ID NO: 6788672 - DNA, 73 bp, Homo sapiens
gtgagtcttcgtagcatcgtgctggctgagcatgcttgccagctagacaaaatgcaatggagatcgttttcac

SEQ ID NO: 6788673 - DNA, 62 bp, Homo sapiens
ctctttctcacgattacggccatctgtgtgctggcaatggcagtagttgcatgagagcagag

SEQ ID NO: 6788674 - DNA, 95 bp, Homo sapiens
tctgttgtccatgtgtggctaggcgagggctgcagccagacccatggccttatctgcctgcagggcccgcctgagccctcagtgacagacacagg

SEQ ID NO: 6788675 - DNA, 57 bp, Homo sapiens
tgaagtcctaacttccagtacatcagaatgtgactgtacttagagatagggtcttta

SEQ ID NO: 6788676 - DNA, 57 bp, Homo sapiens
gaaaatgttttctttctggggcaatcaggcaaaatcttggaaagatgaacttttttc

SEQ ID NO: 6788677 - DNA, 106 bp, Homo sapiens
ggtttcgctccctcgctgagtcccttctccccgccaacaaaaggtgatgattcctagcggactgggcacgcctggacggcggagggtggctgggaggggcgaggtc

SEQ ID NO: 6788678 - DNA, 57 bp, Homo sapiens
tatgaacattttggtatatatgtgtgcatgtacatttttatagggagcatgttcata

SEQ ID NO: 6788679 - DNA, 67 bp, Homo sapiens
tctgcctaaggcttggggaaaagtgaggcccagtcgctgccctcaaatagcccccagtctagttaga

SEQ ID NO: 6788680 - DNA, 66 bp, Homo sapiens
acatgtggcataaaataggttactgtgaattggttatcacacaaagtgttagatgccactctatgt

SEQ ID NO: 6788681 - DNA, 56 bp, Homo sapiens
ttgctcctcctcctcattgcaggagtttccagacacaactgctagggggagagtag

SEQ ID NO: 6788682 - DNA, 70 bp, Homo sapiens
ctgtccagggtcctgaccattccttgtctccaggctggttccagatgggatgagttgttaggactgacgg

SEQ ID NO: 6788683 - DNA, 88 bp, Homo sapiens
gggcaagtgagtcagagacaaacttcctctctgaaaggttcattgagagagccaattagccagggaggaggtgctgttctgcatgccc

SEQ ID NO: 6788684 - DNA, 71 bp, Homo sapiens
atgtttgctccagacctaagcatcagtgcattgaaaatggagttgatcattgtgggtttggcagtgagggt

SEQ ID NO: 6788685 - DNA, 56 bp, Homo sapiens
gcctgggatggcatcagccttcttgatgtaattgagagatggatgttattatgggt

SEQ ID NO: 6788686 - DNA, 70 bp, Homo sapiens
gcttcctagcattagccattgccagggggccaaatacagtaaatggatcaatggcctgatgctattaagc

SEQ ID NO: 6788687 - DNA, 87 bp, Homo sapiens
caggtagaggctgggctgtgacaacaatgtcagaagctatctattgagggcttcttgtgtgtcaggctctgagccaaacactgcctg

SEQ ID NO: 6788688 - DNA, 69 bp, Homo sapiens
gaaaggaaatattctaagcactaatctgagtttcatctgccggatggaaatgctagtatattacctttc

SEQ ID NO: 6788689 - DNA, 58 bp, Homo sapiens
atatttcctatacagttgtccatagctagaataaaagctgtatgctattaggaagtat

SEQ ID NO: 6788690 - DNA, 59 bp, Homo sapiens
caagttatgtgctggagcccagagtcagtgtgaaagggactccataagcacatggattg

SEQ ID NO: 6788691 - DNA, 64 bp, Homo sapiens
aggaaatatttcacatgtgggaaacataagtgaaagcattatgtgtttcactgtgcagtaacct

SEQ ID NO: 6788692 - DNA, 62 bp, Homo sapiens
ctgtagcatttgttatggcaatcctagcaaacaaatacaggtaccaacagcatctgctgcag

SEQ ID NO: 6788693 - DNA, 96 bp, Homo sapiens
tttctgcatttgtccttcttcattcagtcccgaaccgacagccacaagtggcgcccgaacagggacgtgagtgaagaaggtctgctggagcagaga

SEQ ID NO: 6788694 - DNA, 68 bp, Homo sapiens
gcccggggcccagggctgcaagtggacgctgcagcgcttccggcagtacctggcgtccaaacacgggc

SEQ ID NO: 6788695 - DNA, 77 bp, Homo sapiens
aaaagcactcgttagtatttctgcaaacccaaggatttggtactcctggcaaagcagggctatttggaggtgttttt

SEQ ID NO: 6788696 - DNA, 79 bp, Homo sapiens
ccagggctgtccctgagccccagacataagtagggggtcaggaccctgactagtgtcagggggcagaggcagctgctgg

SEQ ID NO: 6788697 - DNA, 64 bp, Homo sapiens
gacaaaccctgcccttcccaagatggcggcggcggcagggcaaagggcggggttagacgctgtc

SEQ ID NO: 6788698 - DNA, 58 bp, Homo sapiens
agcaccttgttgtaggtacaaaagagaacatttctattatatttacacgagagttgct

SEQ ID NO: 6788699 - DNA, 65 bp, Homo sapiens
tgttctttgcatccgaaacaatttctcttgtttgcatagggttcttgtttcagatgcaagaaaca

SEQ ID NO: 6788700 - DNA, 88 bp, Homo sapiens
tcacccggggttcgtgttaaatgcagattctgactcagcaggtctgagtgggtccaggattctgtgtttctcatatgttcctgggtga

SEQ ID NO: 6788701 - DNA, 56 bp, Homo sapiens
atctgtctatgatatagtctgtgtcctcaggatacacacagtataatagaagagat

SEQ ID NO: 6788702 - DNA, 64 bp, Homo sapiens
gacttgggtccggtgcccatatagacatggcaggcatcatctgtccaggtctggaccctgagcc

SEQ ID NO: 6788703 - DNA, 77 bp, Homo sapiens
gggctagcttaccttaggccataagtattatttgttgagatgcgtgaatacaagaatgtcttaaaagctctaggctc

SEQ ID NO: 6788704 - DNA, 89 bp, Homo sapiens
ggggcaggattaaggtgaggggagtaaagtcatgttacacagaaaaaaacattcagtaatcaacatgcttccctcacttcacctggccc

SEQ ID NO: 6788705 - DNA, 65 bp, Homo sapiens
tatgtgtagctcatattagtgttactgaggacatgcccactgacagaaaaatgtagctccatgta

SEQ ID NO: 6788706 - DNA, 76 bp, Homo sapiens
ggacccctgggctccaggatcactgcctggggcccctgagtgcacccacaggttctgggtcctgggtcctgggtct

SEQ ID NO: 6788707 - DNA, 55 bp, Homo sapiens
ccatccccagcccagatgcatcacttctaaagagcagcttggtgaaaggtgatgg

SEQ ID NO: 6788708 - DNA, 78 bp, Homo sapiens
cagacttaaagaggttaaatttctcaggggcatagtacgaataactggcccaaagagctttgatctcagccttgtctg

SEQ ID NO: 6788709 - DNA, 57 bp, Homo sapiens
gttttacacagaaacgcaggcttggccagacataagactgtcttttctgagtgacgc

SEQ ID NO: 6788710 - DNA, 69 bp, Homo sapiens
gtcctcctcaggtaagattatcctccaagctcttgcttcagtgagcagaggcatataattgctggggac

SEQ ID NO: 6788711 - DNA, 59 bp, Homo sapiens
agcattcggagagttcatgaagacccgggttcccatcttgatcctgctactcacgagct

SEQ ID NO: 6788712 - DNA, 59 bp, Homo sapiens
ctatacttttctctgactttgtatagtatctgtaactttatgatacagggaagggttgg

SEQ ID NO: 6788713 - DNA, 69 bp, Homo sapiens
ccctctaaagcagaatttcccacactgggactgggaggcctcagggatggtggaggaatttcaagaggg

SEQ ID NO: 6788714 - DNA, 55 bp, Homo sapiens
gcctcatgactgccatcaatcttaaagcggaaattgctgaggtgcagtaagaggc

SEQ ID NO: 6788715 - DNA, 78 bp, Homo sapiens
taaaagtcacaaatcctgcagctggagaggcgatgtgagaacctgactttgtacaggtgcaggcatttgtgaggtttg

SEQ ID NO: 6788716 - DNA, 69 bp, Homo sapiens
ggcactcttatgggaaagttacactttattttggaggtacctcttgcaacttttcattccaaaggtgct

SEQ ID NO: 6788717 - DNA, 55 bp, Homo sapiens
gagagagaggcctggaagatcttggaacaggaacatccagccctgcttctctctt

SEQ ID NO: 6788718 - DNA, 81 bp, Homo sapiens
gaaggtagcttcataacattacagacaccttgtgttattttaatatgacacttttagctatgagttaatgagactgccttt

SEQ ID NO: 6788719 - DNA, 58 bp, Homo sapiens
atgcttccatgaacgttcttgtcaatgttgacaaatgcaagagctttccatggggtat

SEQ ID NO: 6788720 - DNA, 88 bp, Homo sapiens
ttcacagctttcagggattaagaggtggtcgtgtctgtgtggatcccattcagcccacgccaccttcttgggacctggaagaaaagaa

SEQ ID NO: 6788721 - DNA, 103 bp, Homo sapiens
gtagggatgctgtttggatattcagcataaacttcatggataatataaagctcctaaacagaaaacaaagggagccatggtgttaaggctgaaaaacacccac

SEQ ID NO: 6788722 - DNA, 75 bp, Homo sapiens
cctggtgtctgtttacagcagcctcatgtcagtggagtcaaagctcaatggccagctctgtgaaatttcaccagg

SEQ ID NO: 6788723 - DNA, 72 bp, Homo sapiens
aaagagtaggatgaaggccactcactttagggaggttcctggtttgggtagttattattattattatttttt

SEQ ID NO: 6788724 - DNA, 55 bp, Homo sapiens
gtgggcaggccccaaagcagggctgaggatggccctggccgagggacctgctgac

SEQ ID NO: 6788725 - DNA, 88 bp, Homo sapiens
cgtggagccaggtcgggccgcggcgagcaagccgacccccccaactttcgaggggtctcgccgccccgctcctctcccggcttcgtcg

SEQ ID NO: 6788726 - DNA, 67 bp, Homo sapiens
gttctctatctaacactctctgccatgactctccaactttggcaggcaccaggatcagttagagaac

SEQ ID NO: 6788727 - DNA, 82 bp, Homo sapiens
ttagttcaacaattagtgtcatgttgaggacttgccaattacaatatacggcaagtgtcttttatgaattaaaatgaactaa

SEQ ID NO: 6788728 - DNA, 98 bp, Homo sapiens
ttgagaccatgagttttggtgtctttctaaatgttccttgattatctttaaaggtgttggaaatatgtaggaactcatatttaaacttagggtttgga

SEQ ID NO: 6788729 - DNA, 67 bp, Homo sapiens
ggtcttcaaaaaatatccatcagttacgtcatttcttttggcaaaattcttgatgtttgtgggggcc

SEQ ID NO: 6788730 - DNA, 78 bp, Homo sapiens
acatatactatgacacaggccattatatatgtatgtgtgtatatgtgtgtgtgtgtctgtgtacatgcaccaatatgt

SEQ ID NO: 6788731 - DNA, 100 bp, Homo sapiens
agggctgtcaaggcagacgcactcgtgactttgacaaagggaagcagctggaaggttgcgggtcccagggtcacaggcagctgtattagtgacaggttct

SEQ ID NO: 6788732 - DNA, 70 bp, Homo sapiens
ggattaggcagccattcagtagactcaagctgctactctgctactactagatcagtatgcctcaaaatct

SEQ ID NO: 6788733 - DNA, 76 bp, Homo sapiens
tcctccatgcactgcccctctgcacctcccagaagattagggtgggggtggagtgggagcggtggatcttttagga

SEQ ID NO: 6788734 - DNA, 64 bp, Homo sapiens
aagagccagattcagtagaagtgcaggctccagagaggttggagtcctgtagctgtctggtctt

SEQ ID NO: 6788735 - DNA, 60 bp, Homo sapiens
gagacccacagctgggacacgaaggatgctttcgatagaatatactagctgtgtggtctt

SEQ ID NO: 6788736 - DNA, 94 bp, Homo sapiens
gaaacaccagaatcccggggagtgtcccaggagaggagacaatggggtgctggctaggaccccaactccctccttccccagggattcaaatttc

SEQ ID NO: 6788737 - DNA, 56 bp, Homo sapiens
gagatgtcttatcgtgaggaaaaagaaacttccttttgttcacatttaggactctc

SEQ ID NO: 6788738 - DNA, 83 bp, Homo sapiens
gatgtagaactggtgggcagatttaagatatttgtattgcaatagtccagtgagaagctgtcttagatcagtgcagtagcatc

SEQ ID NO: 6788739 - DNA, 65 bp, Homo sapiens
ctagttcagtggtggattatgtcaattaattaaattagacatcatatgattcagcattgtgttgg

SEQ ID NO: 6788740 - DNA, 91 bp, Homo sapiens
tggtacctggctcagtgtgaatgctcagtaaatgttatctcctactaaatcttgcataaatgagttttttgctggatacgacagagtacca

SEQ ID NO: 6788741 - DNA, 64 bp, Homo sapiens
ggctgcagggtgaagggatgtgtctcacccagggaaagcagagcacacactttgatcttgagcc

SEQ ID NO: 6788742 - DNA, 79 bp, Homo sapiens
atttttgggttgctagaaggagtctccaaaggatttgctgagaaggcctctgggtctcctctgacatcaacttaaaaat

SEQ ID NO: 6788743 - DNA, 56 bp, Homo sapiens
ttgagtctcctcagcagggctatggcctccagatttctctgctttaggagagtcag

SEQ ID NO: 6788744 - DNA, 59 bp, Homo sapiens
atcatctccattgcttttgacaaagtctaatacacctggtcaaagcaaagggagatgat

SEQ ID NO: 6788745 - DNA, 84 bp, Homo sapiens
cttgctacagagaattgtgtgatttttagatctattaatttgaaatggaaagtcatgcagttgaacttttgaaatgctagcaag

SEQ ID NO: 6788746 - DNA, 58 bp, Homo sapiens
tctctatgacaaggtttggttgcatatctacacctgcaaccaatcactgtcaaggaga

SEQ ID NO: 6788747 - DNA, 80 bp, Homo sapiens
tcagttgggctgtgctggtgcctccagctgcttctcctgataggaaggagacacagaaggtggctctaactctgaactgg

SEQ ID NO: 6788748 - DNA, 75 bp, Homo sapiens
attaaatgcttcatcattctactgtgcaaattgttttcaagctgcctgtaaaatgtgtgatgccagcaatttggt

SEQ ID NO: 6788749 - DNA, 69 bp, Homo sapiens
ggtctgggagaactaggtcctcagtagatgctctctgagctctgggtgagacagacctggttcccagcc

SEQ ID NO: 6788750 - DNA, 70 bp, Homo sapiens
ttttgtaaatagcagtactcatgtgacccagttaataattgtctcagtccatggggttgctatagcaaaa

SEQ ID NO: 6788751 - DNA, 71 bp, Homo sapiens
atctcctctacttttcctgtgaagctgtttcttctccttctggaagataacagcaggatgatagaggaggt

SEQ ID NO: 6788752 - DNA, 76 bp, Homo sapiens
gggcaagggttttgtctgtattgtttgctgctgtatctccaggtctaaaacagtgccaggcagatgccaggtgccc

SEQ ID NO: 6788753 - DNA, 87 bp, Homo sapiens
tctgctcctatcccactattctagattacagtataaaggatttaactccttaatactagcctggagtactgggtgcgtcaggataga

SEQ ID NO: 6788754 - DNA, 64 bp, Homo sapiens
ccatcttgctgggttttatcatatcagggttgttaagatacagtatataaagccctcaggatgg

SEQ ID NO: 6788755 - DNA, 62 bp, Homo sapiens
caggaggcatcatggagcggactggcttggctagcatacatttggcttcataatggtttctg

SEQ ID NO: 6788756 - DNA, 58 bp, Homo sapiens
tctgagattgatctttggctatcttccaggctctttggtagttattgatctattcagg

SEQ ID NO: 6788757 - DNA, 65 bp, Homo sapiens
gagttgtctattctgaattgattatagtgagaggagattagaagatcagttaggaagaggcactc

SEQ ID NO: 6788758 - DNA, 130 bp, Homo sapiens
ggcaacatgacaacgtgcctaccttcaccagagagactgctgtcaaaaatcactccatccatgcaaggaggaacgatgcagacacagaaattctctgctgtgagggccagcactgtagtatttactgacc

SEQ ID NO: 6788759 - DNA, 102 bp, Homo sapiens
gtttgtttgtttgttttttgttgttttgagatggagtcttgctctgttattcagggtacagtgcagtgcgccatctcagctcatcaacagcacacaggaagc

SEQ ID NO: 6788760 - DNA, 86 bp, Homo sapiens
aacctactagattgcagatgcataggtcaggcctaggggtcttgcttgcttgcctgtgtctgaccatgcacatgcacttgtatgtt

SEQ ID NO: 6788761 - DNA, 66 bp, Homo sapiens
acctgcccattttcaagtctaataaaaatgtcctgacatttgcatgacctttgcaagtgggttggt

SEQ ID NO: 6788762 - DNA, 59 bp, Homo sapiens
ttgaaggtttgatccttatttataagcttcttgcttgtgaatagaagtcagacctacaa

SEQ ID NO: 6788763 - DNA, 85 bp, Homo sapiens
catttttaaaatattacaaattaggtattttctggacagggccctagctatggtctcttccttgacctattgtaatagaagaatg

SEQ ID NO: 6788764 - DNA, 55 bp, Homo sapiens
ttcatgcatggccttactccctttagtgggacagaaactgtgagccatgcatggg

SEQ ID NO: 6788765 - DNA, 59 bp, Homo sapiens
gaggatcgcttgaggccaggagtttgagaccagcctgggcaacaacacagcgagacctc

SEQ ID NO: 6788766 - DNA, 70 bp, Homo sapiens
agcttggggtgtggtgaagccaaagacagactcctcagaggagctcaaggcttccccacagtcctgagct

SEQ ID NO: 6788767 - DNA, 55 bp, Homo sapiens
ttgacattttgttggcagccttcagagcacttcaggcttctctgcaagatgttaa

SEQ ID NO: 6788768 - DNA, 66 bp, Homo sapiens
ctccacagggattcacccaaaaggttgcccaggcattcttttcttccactgtgtcctctgtaggag

SEQ ID NO: 6788769 - DNA, 62 bp, Homo sapiens
cttcctaccatatttagtgctttctccaattttcggagaatcttcaacagaatggtaggaag

SEQ ID NO: 6788770 - DNA, 55 bp, Homo sapiens
cattgggtaattaaatagtctgaggctaattgcgcctgactgtgttattccaatg

SEQ ID NO: 6788771 - DNA, 99 bp, Homo sapiens
ttacttgagctgagattttaaaagctttgttaataggtttggaagagggtattctaagttaaccctgttaatagatttggaagatagcattctaagtgg

SEQ ID NO: 6788772 - DNA, 59 bp, Homo sapiens
agccagaagaggagaagttgggtttaaaactacatctaccatacctacctcacctggtt

SEQ ID NO: 6788773 - DNA, 88 bp, Homo sapiens
gatattgttctgtttttggaaggagatccacacttattttcagcgctggcagcagtggggtctcctccagcccccggaagcatgtgtc

SEQ ID NO: 6788774 - DNA, 77 bp, Homo sapiens
tcgcttgaacccaggaggcggaggttgtggtgagccgcgattgcaccattgcactccagcctgggcaacaagagcga

SEQ ID NO: 6788775 - DNA, 72 bp, Homo sapiens
accttcaagagcatctaacacataagcctgatgaaaacagttgctgcagtttaagtttgggtgggtgggggt

SEQ ID NO: 6788776 - DNA, 56 bp, Homo sapiens
gccctaggaaatgaatacagtacacaaatgttgccagcatgtgagtttccttgggc

SEQ ID NO: 6788777 - DNA, 64 bp, Homo sapiens
cagtggttgaacccaaatacttggttgtctgggctaaacatacaaatttgggtgatagccactg

SEQ ID NO: 6788778 - DNA, 55 bp, Homo sapiens
ggcagctgtggtgctgagataggagcttggaatgctccatggtgccaagactgtc

SEQ ID NO: 6788779 - DNA, 62 bp, Homo sapiens
tacctggatgtgaaggtggtatgactgagaccttagtcatatgacccttcacaaactttgta

SEQ ID NO: 6788780 - DNA, 69 bp, Homo sapiens
cccttacagggattgttttaatcacctgctattcatcctgctggtgagaaagggattcctgttccaggg

SEQ ID NO: 6788781 - DNA, 99 bp, Homo sapiens
ggccactcagaggggatctgagctctgggagtagggccagtgttctcctagcagagttgggagcctggctcctaagagcacaacacctctgtctgtgcc

SEQ ID NO: 6788782 - DNA, 115 bp, Homo sapiens
tcttttgattatattctgaacccaaacaaagctactctggcctgcagatccatgctccagtgagctgtgtagggaatcagagaaaggcatgattggttgaagtgaatcacaagga

SEQ ID NO: 6788783 - DNA, 66 bp, Homo sapiens
ctccactcaacaagcccagtgtatggcctagaactcccatcatacctgtgcaccaattgaggagag

SEQ ID NO: 6788784 - DNA, 63 bp, Homo sapiens
ctttccccagtaacatacatgtgatgtcagacagtcacatcacagctatgttactggggaaag

SEQ ID NO: 6788785 - DNA, 57 bp, Homo sapiens
aaagtttcctgctaagtgctataaaggaagatatccataatgtacagtggaggcttt

SEQ ID NO: 6788786 - DNA, 87 bp, Homo sapiens
gtatttttaaaatgtgtttctgtatggtttgtgcccattcttggcgtggctgtggctgtacagagaccattgttctttgaggaatat

SEQ ID NO: 6788787 - DNA, 67 bp, Homo sapiens
agtgattcctgtgcttattccagtctgggaatcacctgccgagatggagtgtggccaggcagtaact

SEQ ID NO: 6788788 - DNA, 59 bp, Homo sapiens
gtccaggctgcccagggtcctggctggagtacctgggtgggtctgtggggagcctgaac

SEQ ID NO: 6788789 - DNA, 83 bp, Homo sapiens
gtctgccctctaacagggctttgaacaggcatcaagggcctcttgcccttgttgattggacacagcccacaaagagaccagac

SEQ ID NO: 6788790 - DNA, 62 bp, Homo sapiens
tgacattttgaaatccctctgatgcgtgggacacatgtgtccctgtcacaaaggatgtgtca

SEQ ID NO: 6788791 - DNA, 63 bp, Homo sapiens
gtaatgggggttgatgagggagggacagtgaaaacaactgtaaaaccaaatcaatctagttat

SEQ ID NO: 6788792 - DNA, 82 bp, Homo sapiens
tgaaacaagaatagcatgcagtagaaactgggtgatgaatacatgacgtctctccatttttgtgtatgcttgaaatttttca

SEQ ID NO: 6788793 - DNA, 76 bp, Homo sapiens
ttttgtatatgtcatttcaatacagtttgtaaatgggcttactgatacatttcagactgtgttggaaaatacagaa

SEQ ID NO: 6788794 - DNA, 104 bp, Homo sapiens
aaagtctttgtaattgggctaagtgtgctttcatgatgattctattctccccaaggaagaatcatcctgcaagagtctcctcagccattatgcaaacagatttt

SEQ ID NO: 6788795 - DNA, 69 bp, Homo sapiens
ctgagccccaggcttttccgtaaacagcaggagtgggacctcttcttcaggaagagcctggactctcag

SEQ ID NO: 6788796 - DNA, 58 bp, Homo sapiens
cttttcatttctcttagtgctttctgcattgcaggcaggcactccggaagtgtctgag

SEQ ID NO: 6788797 - DNA, 107 bp, Homo sapiens
caaaggttatgtgtagaaaaattcttatttgtgtggatggaaggcagtagggctgtggatgctgtgtgtttcctctatagaaaaatatatctatactcattcctttg

SEQ ID NO: 6788798 - DNA, 87 bp, Homo sapiens
ggagctttgaaaattaatatcttggcccaactccagaccaattattttagattttctggtggtaggcctggatattagcagtgtttt

SEQ ID NO: 6788799 - DNA, 65 bp, Homo sapiens
cagatgtaaaagtcatagtcgggaaagacatcgctttagtggtgttttcaaatgacctttaaatg

SEQ ID NO: 6788800 - DNA, 66 bp, Homo sapiens
ggacaaagcacaggacgtagagcttggaggccaagtgcctgccatgcctttacctggctgtggtct

SEQ ID NO: 6788801 - DNA, 96 bp, Homo sapiens
aactgaggcactgtggaaactcttgggctgcatgctgtttaatgatcattttcaaaccaatgtggtttaggagcagtctgctggtggtctccagtt

SEQ ID NO: 6788802 - DNA, 94 bp, Homo sapiens
taattttttaattgatacaaaattgtacatatttatgagcgacacagtgatgtttcaatacatacaatgtatagtggtcaaattagggtaatta

SEQ ID NO: 6788803 - DNA, 63 bp, Homo sapiens
gtctctctgcagcatctatgttctccagcagtgaggactatttataatgctgcagaaatgggc

SEQ ID NO: 6788804 - DNA, 61 bp, Homo sapiens
tttttcagacaagagggtcaagctcagcaatattctttgttgtaactcctggtctgaaggg

SEQ ID NO: 6788805 - DNA, 115 bp, Homo sapiens
tgttgggggagactcacactgacagtgatgttctctgggtgtgtagactgagttcatctcttcctgccctgcttctgagggaagctgttaaaaggtatgaattctctccccagca

SEQ ID NO: 6788806 - DNA, 84 bp, Homo sapiens
tattaggtgggtgcaaaagtaattgtggttcttgccattgctcttaatggcaaaacccacaattactcttgtgccaacctaata

SEQ ID NO: 6788807 - DNA, 55 bp, Homo sapiens
tgagatcattgacttgttcctgggggcctctctcaaggacgaggttttgattaca

SEQ ID NO: 6788808 - DNA, 70 bp, Homo sapiens
ttgaatactgtaggatttgaggaaatgtgggtgtgaaacagaacatttcttttcatctctatatttttaa

SEQ ID NO: 6788809 - DNA, 122 bp, Homo sapiens
cccagggttacatggctagcaagtggcatagcagggattgaatccggtgcctcctcactccaagcaccatgctctcctctatgctattcccctagcccttcacagcccagtgtgcccctggg

SEQ ID NO: 6788810 - DNA, 57 bp, Homo sapiens
cgtcttctaagtatcaaagcagagattcacttttcatttctgggtatttggaagatg

SEQ ID NO: 6788811 - DNA, 78 bp, Homo sapiens
ctaaggtatgcaactttttctgggatggagggtggaagattcaaagaaagacaccttgttacccaaagagtgccttgg

SEQ ID NO: 6788812 - DNA, 130 bp, Homo sapiens
ggaatggaaattgatggataaacaccctagatcctcactctttggtgggatgattctgagatatgttctgcagtcctcagagggtctcctccagaatgaactcaagttatccatattcaatgaacattct

SEQ ID NO: 6788813 - DNA, 76 bp, Homo sapiens
ttccattcttgttggaaagaagcaacttcagtgtttttcactaaacaaattgcagttgtctttcctaattttggga

SEQ ID NO: 6788814 - DNA, 99 bp, Homo sapiens
ggcattgcctgaaattcagtcactgacccagtattgtgaaattgatgtcttctgtggcattagtgagggtactgtgtgactgatgttatggaatatgcc

SEQ ID NO: 6788815 - DNA, 81 bp, Homo sapiens
aatatgtggatctgggctggagactgagaatttgcagttctagcaagttcctagttgatgcttcttcaaagaccacatgtt

SEQ ID NO: 6788816 - DNA, 68 bp, Homo sapiens
cattcatgttgtagtatgtatcagtacttcattcctttttatggctgaataatattccattatgagtg

SEQ ID NO: 6788817 - DNA, 55 bp, Homo sapiens
tgccttcttaattgagcctttctgggagctgcacaggctggctggaggagggaca

SEQ ID NO: 6788818 - DNA, 56 bp, Homo sapiens
atttgctttgggacagcttaaactgaaaactttctgtcttgtggaccaaagcaagt

SEQ ID NO: 6788819 - DNA, 76 bp, Homo sapiens
tgggatggcctgaatttgggctacaacctctgaagaagtcacttcctcatttatagccaaagtaaatgggcaccca

SEQ ID NO: 6788820 - DNA, 70 bp, Homo sapiens
tgtgtatctcctattggttctgtttctttggagaacccagactaattgaacaagtaatagaagagtacca

SEQ ID NO: 6788821 - DNA, 79 bp, Homo sapiens
cgtccctgcgcccgtcggagcggcgccctggccgaagcctgtcactctcggaaggggccgcgctcggacaccaggggcg

SEQ ID NO: 6788822 - DNA, 77 bp, Homo sapiens
catcctacagccacacgccatttaagcgaactcatttgagaatgtttcaggcttgcatgattggagtgggtggggtg

SEQ ID NO: 6788823 - DNA, 130 bp, Homo sapiens
gagggtgcccccgagacagccgagcgtttccagaggtagccgagtgcaatcgggtcggcgagggatccgagactgggctcggctgggcttagagacgcccgagcgctttcggaaatggccgaacactctc

SEQ ID NO: 6788824 - DNA, 59 bp, Homo sapiens
ttttgaggctggtaatcgctttgtttgacaattcaaactgttagatttcagctctgaaa

SEQ ID NO: 6788825 - DNA, 89 bp, Homo sapiens
agagaatgtaaatgagtgtggaccagctatcaatgccagggcagctccagctgtgatggcgggtggttggcacttattaacagcactct

SEQ ID NO: 6788826 - DNA, 130 bp, Homo sapiens
ataagacttactcagagaatgctaattaaaaattcagattcttgatcctgtagcctgtctttatgatttactagaacagaaatggagcccaggaatctgaatttttagcagtttccctgggtgatcctat

SEQ ID NO: 6788827 - DNA, 66 bp, Homo sapiens
ggtcacaaattcttcgacaccactcccttgtgatagtttgtatagcaggagtgatgttgtgtgact

SEQ ID NO: 6788828 - DNA, 67 bp, Homo sapiens
acagtcagatttttaagacctttaacagagtgccttgcctatagaaagttcttgataagtccactgt

SEQ ID NO: 6788829 - DNA, 58 bp, Homo sapiens
ttgaccactaggaatatcttaccacaagaacgtatctgtcagtgggacctgtggccaa

SEQ ID NO: 6788830 - DNA, 130 bp, Homo sapiens
gtgttctgatgatctcctgctccataacaaatcacccccaaaacttggtgacttccatcaatagtttatgatggactttaccctttgggtagtgtttgtgtctcagtttcaaggtagttactggaattac

SEQ ID NO: 6788831 - DNA, 61 bp, Homo sapiens
gggtgctctgtgtccacagctggaaaaggatcaaagacttttgcggtagcacaggggacct

SEQ ID NO: 6788832 - DNA, 62 bp, Homo sapiens
ctcggcttccacattttttcatgtcattattaaactcatggagaatacaaccagaagctgag

SEQ ID NO: 6788833 - DNA, 105 bp, Homo sapiens
tctttgaacttctcctccttctctatatgaaaggtgacatttcttggatcctaaaatcttttgaagtcatcctttttatcttagtcaagggagaagcccccaaga

SEQ ID NO: 6788834 - DNA, 74 bp, Homo sapiens
gcctgagtgttatttacagaggggttttacaggtattataaacactggaaagatttctttggagtccactgggc

SEQ ID NO: 6788835 - DNA, 57 bp, Homo sapiens
tatcctaaatgttgaactgtgattaggtttccctaaataatggtgacatctgggata

SEQ ID NO: 6788836 - DNA, 58 bp, Homo sapiens
ggtgggagaagccctgttcgtagtatttgttgatgcccatagtgtaaattctcccatc

SEQ ID NO: 6788837 - DNA, 98 bp, Homo sapiens
ctgtgtctcccgcccaggctaataactgcagctgacatctggctgggccccgcgggggcgcagcgggcagcgttggggggttgggcagggcagggcag

SEQ ID NO: 6788838 - DNA, 76 bp, Homo sapiens
ataggctttgctgaagaatatttactggaggataaagcaatgattccttaagctagtgtttctcagaagggcctat

SEQ ID NO: 6788839 - DNA, 58 bp, Homo sapiens
cctctacctactctttgcattttccaaaatgggaaactgaatataagaaaggtaaagg

SEQ ID NO: 6788840 - DNA, 83 bp, Homo sapiens
aaattatccaagctgactcaagataaactaagtcacttccagttcacaactcagtttcttttgcatagtcagtttggtagttt

SEQ ID NO: 6788841 - DNA, 56 bp, Homo sapiens
tcagactttctccttgcttagttcttacatctaggcaacataacacgaaagtctga

SEQ ID NO: 6788842 - DNA, 55 bp, Homo sapiens
caaggtctggttcctctgggtgcctgtttgcacggccagaggctgacagactttg

SEQ ID NO: 6788843 - DNA, 69 bp, Homo sapiens
ttcttgggaatcagacagttctggattcaaacctcattctcacatttgaatcaactgtctgaccatgga

SEQ ID NO: 6788844 - DNA, 58 bp, Homo sapiens
ctgggccaggaccagggttgaaaactctagattggactagacctttgatcctgcccag

SEQ ID NO: 6788845 - DNA, 64 bp, Homo sapiens
cccactggtgaagggccaggatccaaattgtgaatgatctggtggtctggctttatatcctggg

SEQ ID NO: 6788846 - DNA, 67 bp, Homo sapiens
gtgtgcgggttcctgagggctgggactcccagggccccatgggaaagtgtagcctgcaggcccatac

SEQ ID NO: 6788847 - DNA, 68 bp, Homo sapiens
tttcaccaagcttcgtggaggaagttactcatgaactgagcagatgttctccagggagattgtagggg

SEQ ID NO: 6788848 - DNA, 61 bp, Homo sapiens
gcagagccacagtggtggcccacgtgctggctcaagcatctgggtgacgcagtggctgtgc

SEQ ID NO: 6788849 - DNA, 120 bp, Homo sapiens
tcattactataagccaaggtaaattcttctaaagcctgtcctatcagaatgaatgtattcagtgaatgagataactttagatttttggaaaattaccctgaatatgtggatagaaataga

SEQ ID NO: 6788850 - DNA, 78 bp, Homo sapiens
ggggtaaatgatagtctttttaataaataatgctagaacaatagtagatatatatgagggaagatgaaatttgacccc

SEQ ID NO: 6788851 - DNA, 56 bp, Homo sapiens
tgcgcatccttgacccactcctgggggccaggagctgggcgagccggggaagtgca

SEQ ID NO: 6788852 - DNA, 77 bp, Homo sapiens
tcgcttgagaccaggaggttggaggctgcagtgagctgagatcatgccactgcactccagcctgggtgacagagtga

SEQ ID NO: 6788853 - DNA, 76 bp, Homo sapiens
agtatggtgactttgcactaagttactcatttattcacataattaatgagtttctattagtgttaggcaccgttct

SEQ ID NO: 6788854 - DNA, 77 bp, Homo sapiens
caggggatcccttcagaaggaaggaagcattctgttcaagacacgggcaggggtggccttcctttgggggcttaatg

SEQ ID NO: 6788855 - DNA, 64 bp, Homo sapiens
cttctgtggatatgttctctcttcttgtatggtgtttatgagaagagaaatatttccatggaag

SEQ ID NO: 6788856 - DNA, 56 bp, Homo sapiens
agaggctctaaggttggatcaaatacagtccagtgttctgatttgcctgagcctct

SEQ ID NO: 6788857 - DNA, 100 bp, Homo sapiens
gcttttggaggccctggggctctcccgacaccccctctgtgtgtctggcaatgcgcaggtgcacctgagggtgtcatcggatctgagggccacaaacagc

SEQ ID NO: 6788858 - DNA, 62 bp, Homo sapiens
catgacttttccttttgaatgaaaaagattttattttcttcttctcatgggataagtacatg

SEQ ID NO: 6788859 - DNA, 65 bp, Homo sapiens
gtgtttaagttctgctccttattttgttcacctacagagtaggaagttctaactagaaaagacac

SEQ ID NO: 6788860 - DNA, 58 bp, Homo sapiens
ctggtctgaaaaggaggcatgccagcacctcccactgagcgtttctattgaggatcag

SEQ ID NO: 6788861 - DNA, 101 bp, Homo sapiens
gcccaaatgattgctaactgatacaatgaccatattatgtaagagtagagaagtagttttataaacagaaatggcatcctggatcaataggaattaagggc

SEQ ID NO: 6788862 - DNA, 101 bp, Homo sapiens
agtttatcaatgaaaatgaacttgatgcctgagctataattgaaatctttatagcgtctctgctgtttgtccattgtgttacagagcattcattgaaaact

SEQ ID NO: 6788863 - DNA, 67 bp, Homo sapiens
aggaacacatctttgtagcagggctgcagagcatgcagcctggcctagaccgcaaggatggagtctt

SEQ ID NO: 6788864 - DNA, 115 bp, Homo sapiens
gtaaggtttgaggatcggttgaaagctttgccacattcttcacatttgtagggtttctctccagtgtgaattctcttatgtgtagtaaggtttgaggatcggttaaaagctttgc

SEQ ID NO: 6788865 - DNA, 62 bp, Homo sapiens
ctcaccagacatggaacctgtcagtgccttgatcttagactcccagcctccagtactgtgag

SEQ ID NO: 6788866 - DNA, 69 bp, Homo sapiens
gtgtccgaaagttttctcacacagtaatgtaatcaaccccattttgtggctgtggaaattgtcaggcac

SEQ ID NO: 6788867 - DNA, 55 bp, Homo sapiens
gccaggtccagggtggagcgctcacacacagcagcccccatctttaggaccaggc

SEQ ID NO: 6788868 - DNA, 59 bp, Homo sapiens
tcactgggccctgaggtgggacatcaaataattagaaattcctttttatggcttagtgg

SEQ ID NO: 6788869 - DNA, 73 bp, Homo sapiens
ccactgaacagttgtgtgatgttgggcaagtgacaacctctctgagccttattttactcaactgtaaatgtgg

SEQ ID NO: 6788870 - DNA, 80 bp, Homo sapiens
attttcaatttgactgtgctttgatcttatgaatccactttcaaagatgaccgtatgtcagagccagtcttataagagat

SEQ ID NO: 6788871 - DNA, 67 bp, Homo sapiens
ttcctaacaaggggtattcatccactgactctccattggtcattgtctgagtgtcgcttcttgggag

SEQ ID NO: 6788872 - DNA, 59 bp, Homo sapiens
ggcaatgatgaataaccttgagcatatcattaatgatgcccttggttattgtcatggcc

SEQ ID NO: 6788873 - DNA, 63 bp, Homo sapiens
gctctctttgtgccacttaaggacatagtgagaaggtggctgtccgcaagctgggaagagagc

SEQ ID NO: 6788874 - DNA, 70 bp, Homo sapiens
tgaaccagaagtcatcagagctgaggcatggccttgaacatgtcactcagtctctggggcttctgtttca

SEQ ID NO: 6788875 - DNA, 62 bp, Homo sapiens
tctggcaaatgtggatgttttcattgttttattcattaggaaacagttctcatttgtttaga

SEQ ID NO: 6788876 - DNA, 64 bp, Homo sapiens
gcttggaggcagagtcttgctgaggtgcccgtgggtctgcctcagcaattacctgtgtctctgc

SEQ ID NO: 6788877 - DNA, 88 bp, Homo sapiens
aacagggggcatcaggattttcatcattacagtcatgttatggtattgttttccaaacaaaagacgaatgataatctagttctctgtt

SEQ ID NO: 6788878 - DNA, 64 bp, Homo sapiens
gcagaaagagcgtgaattttaacatctgataaatttggattcaaattccagttcttttacctgc

SEQ ID NO: 6788879 - DNA, 97 bp, Homo sapiens
taaatgattttggacggaaaggctacgggggccgtgtgcagacaaaatcagctgccgcgtcgatgccctctagttctgaagttcactgctttattta

SEQ ID NO: 6788880 - DNA, 89 bp, Homo sapiens
tgtactgtcagtccccagctcccagtgttgttttctgatgccggctccctctctgtattgaacggcaatgggaacaagaatgactatca

SEQ ID NO: 6788881 - DNA, 96 bp, Homo sapiens
gctttggctcacttgcctgggtttcagctgcagctactgtactttgatactgaagaagcagggctagatatttgcaagtccaagcaggagggctgc

SEQ ID NO: 6788882 - DNA, 58 bp, Homo sapiens
tgggctcctcgtcactcgctgtgtcctcactggccatgtgctgggaatgagcagctca

SEQ ID NO: 6788883 - DNA, 61 bp, Homo sapiens
gaggagctctgctccatccttcaagatgacttacgttggaggatggcgattcgagcacctc

SEQ ID NO: 6788884 - DNA, 63 bp, Homo sapiens
gcctatttaaaataagccccagtggatgcaatgagtcttccatggagtgaattttcaataggc

SEQ ID NO: 6788885 - DNA, 74 bp, Homo sapiens
gcggtgcctggctctgcgtgcagctccgtgccgcagatgtggaagctggggctcagggaccaggtgcccaatgc

SEQ ID NO: 6788886 - DNA, 61 bp, Homo sapiens
ctttccaagctccctggagacactggtttgcagaggtgtgctctttgggatctttggaaag

SEQ ID NO: 6788887 - DNA, 58 bp, Homo sapiens
taaagtcatctttaaacatgccatgcctttatgtggagtgttgagtttaggtgcttta

SEQ ID NO: 6788888 - DNA, 61 bp, Homo sapiens
gcaccctgctctatccttgctatatgggatgggtaagaatgtaacaggataagtaggatgc

SEQ ID NO: 6788889 - DNA, 70 bp, Homo sapiens
gccgcctgagggagctggagcagacgccgtgggacttttcccctgagttattgcagcttcctcctggagc

SEQ ID NO: 6788890 - DNA, 66 bp, Homo sapiens
cttgtctctgggacatggtattagcaggatgtacagagttcctttttggtgccatgctaggaggag

SEQ ID NO: 6788891 - DNA, 91 bp, Homo sapiens
gggcttgttcttgggactcagcttcctgtcttctgcacaaaatcccctgggctttgttgtcatcagtgatgagtcctcaggccccaagtcc

SEQ ID NO: 6788892 - DNA, 120 bp, Homo sapiens
ggctcaacaggccccagagcctgcctggtgtctccctctgtaagatcaggggttgcctctgagctccagccaggaccctgcgcctgctcttcagaagggaggggctctccctgttgggcc

SEQ ID NO: 6788893 - DNA, 58 bp, Homo sapiens
cattgcttcctatgtcccttctgattgaagtgaaaagaggggtgggtaggaggtgatg

SEQ ID NO: 6788894 - DNA, 68 bp, Homo sapiens
tgcttgggccccagagaaagtcagcagcatctaaagccaaaacacgggatgttttctggagtcctgca

SEQ ID NO: 6788895 - DNA, 60 bp, Homo sapiens
ttcacagattgactggattcctgccatatatataaccaggattgttccaggctctgtgga

SEQ ID NO: 6788896 - DNA, 70 bp, Homo sapiens
ttcattatctgttcccctatgctctctatttttatcagaaatctgagcaggaaagagcagagagaatgag

SEQ ID NO: 6788897 - DNA, 70 bp, Homo sapiens
gtgtatgtgggcaaggggcgcatgtgtgtacagtatcttctgatcttctgcctaccctgcccgcagacac

SEQ ID NO: 6788898 - DNA, 74 bp, Homo sapiens
tgtgtagcaagaagggagatggggttctatacacaatgttttgaaccttcacttgcttcatttgacaatacaca

SEQ ID NO: 6788899 - DNA, 61 bp, Homo sapiens
ccgctgccgttgaggagctgtcgatctcgtgaaggtgacagcatgaggaatcaatggtcgg

SEQ ID NO: 6788900 - DNA, 129 bp, Homo sapiens
tctcacatatgcagtaagggttaggggagaaggtcccagctcctcttgtctctagcagagtgtaaactggctctgctgaggaggtggctgtgcttttattccttctcctgagaactgtttatatattaa

SEQ ID NO: 6788901 - DNA, 61 bp, Homo sapiens
ggtggctcatttgatcttcataatgcacagggaaataaacaagatgaagattgtggccatc

SEQ ID NO: 6788902 - DNA, 116 bp, Homo sapiens
tttccaggccaggggagtaggaggtgggctgcctgtctcattctgtgagctgtggaggagcccacagagcacagggccaagtaaaccctacctccaaggagctcacagtttggaga

SEQ ID NO: 6788903 - DNA, 67 bp, Homo sapiens
ctggatgacggatgcagattagctctggttctaaagagttacaactgagtgcatttagtacatctag

SEQ ID NO: 6788904 - DNA, 101 bp, Homo sapiens
gggtggggctcaggcacgaccgtcagtggggttcagggcttggtctgggaagggcgaggcaggagcaagccctacaagacaggagtggcttagctgcactc

SEQ ID NO: 6788905 - DNA, 77 bp, Homo sapiens
atttgcttttccttttctctctattcttaaaaagcattggagaaactgtaggagggaaaggaaggagggtggcagat

SEQ ID NO: 6788906 - DNA, 63 bp, Homo sapiens
gatgcagcagaggccttgtgatactccccttcagatggagtattacaaagcaagtgctgtgtc

SEQ ID NO: 6788907 - DNA, 97 bp, Homo sapiens
gcgactggacttcgctcagcttcagaccctgggctgcagctgcctaatgaggtgggatggggccctgggtgtgtaaagtggagggaggggcagtggc

SEQ ID NO: 6788908 - DNA, 80 bp, Homo sapiens
gcctcactgtgaggctggcaggggccaggctctggggcagctcccagccctctctgcttctcccggcttcaccgtggggt

SEQ ID NO: 6788909 - DNA, 74 bp, Homo sapiens
tcctcagctgtgaaatgtggatgttaatagtagctacttcctagagtttgttgattaaacacatcatgtaagga

SEQ ID NO: 6788910 - DNA, 75 bp, Homo sapiens
gaatggtaagtgcgtatttaattttgtaagtaactgacaaactattttccagagtgactgtgccactttacattc

SEQ ID NO: 6788911 - DNA, 60 bp, Homo sapiens
gtacagccttcctggaagggcattttggctaagaattaagtctttaaaaaaggctgatac

SEQ ID NO: 6788912 - DNA, 55 bp, Homo sapiens
tagaattgggcctaacttccatctatagtactagatgatcttgggcaagttactg

SEQ ID NO: 6788913 - DNA, 92 bp, Homo sapiens
gtggtgctgtcagctttcatcagtgacactcatttccatgacattctagcttaacagatatggtgcaccagaaagctgcctagcaatttcac

SEQ ID NO: 6788914 - DNA, 55 bp, Homo sapiens
gctgccagctcactctcctgagaactggctgacttggagtacttgagctggaagc

SEQ ID NO: 6788915 - DNA, 88 bp, Homo sapiens
gagaggtcctaaaaactgatgctagaagagacgttttttgttgttaataaatgattctgctggtacatttttattaacacattctctc

SEQ ID NO: 6788916 - DNA, 63 bp, Homo sapiens
gcagtgtgtagagtttaggaaataaaactctttgtttttctgcttctttcatctacacgttgt

SEQ ID NO: 6788917 - DNA, 72 bp, Homo sapiens
ggagaatataaaacaggttgaggtcaaatgcaagtccaatttgctcagagctctatctgttgggagttctct

SEQ ID NO: 6788918 - DNA, 59 bp, Homo sapiens
tgcccatgcatgacagatggctctgacatcacagatcccaccctgtgcaggcgtgggta

SEQ ID NO: 6788919 - DNA, 66 bp, Homo sapiens
gggaggccgggccaggggctggtggcttcctccgcgagctctgccagtttctggcctcaggtaccc

SEQ ID NO: 6788920 - DNA, 128 bp, Homo sapiens
gagctccgggccctcagcctgctaaattggtgcaaggctcttctcctgacgagagccggctctgaaatctgccggcttcaaagggagcgagatcatgtataaaccataatgtgggtgcaccgtggctc

SEQ ID NO: 6788921 - DNA, 56 bp, Homo sapiens
gtagagaaagtgttagagcagaggcctgctggcttgtttctttgtattgtctctat

SEQ ID NO: 6788922 - DNA, 80 bp, Homo sapiens
gaggcagccagctccttatccagcatggccctgaagcaaaggcacagggtggcagttactggagcaagtcctggggtctc

SEQ ID NO: 6788923 - DNA, 88 bp, Homo sapiens
gctgaagtcaagagactggctttggagcctgtgttctgcctcttctgagagagcacagtgagcttgagaaagatagtctaccttcagc

SEQ ID NO: 6788924 - DNA, 85 bp, Homo sapiens
tgataatgattgactcaatatgccagaggggaaagtagaaatctcagcattcccttcctcatgttgtttatctttgacattatca

SEQ ID NO: 6788925 - DNA, 55 bp, Homo sapiens
aggcattaagttgataatcatacaaatatctgtatgactgcaattacaagtgcct

SEQ ID NO: 6788926 - DNA, 71 bp, Homo sapiens
ccctctagggaggcaggactgagggaggctgggcgccccgtccctcctgcacttgctttccttcagtaggg

SEQ ID NO: 6788927 - DNA, 58 bp, Homo sapiens
atagagcagaatggttaaagtggaatttcagtctacacagagctgttgttgactctgt

SEQ ID NO: 6788928 - DNA, 129 bp, Homo sapiens
ctcagttaaatttgaagttcagataaacaacatatgcttttttagtataagtatagcccatgaaatagttgggatatacttatgctaaaaaatgttttgttgtttgtctgaaattgcagtgtaactggg

SEQ ID NO: 6788929 - DNA, 72 bp, Homo sapiens
agaaaaatatgtctgcagaaacctgcagcattagaaaacctattctttgctgcagattgcagattaacttct

SEQ ID NO: 6788930 - DNA, 60 bp, Homo sapiens
caagtaacatctgaacatgatgtggaccattcatatcctaaagacataggtgttaccttg

SEQ ID NO: 6788931 - DNA, 81 bp, Homo sapiens
tcccctccttctctaggggtttctctttctctctcaaaacaagagtttagagaattaacattccatggctagtgagtggga

SEQ ID NO: 6788932 - DNA, 85 bp, Homo sapiens
gtgaaataagaaatggacatgtttgacaaggtttcatttaaaaaaggatgagaccctgtatgtgtttagttttctgctccgtcac

SEQ ID NO: 6788933 - DNA, 108 bp, Homo sapiens
gtgccttgttatgccgtatcttagagggacatatattttctcaataaattccctaaagctttacgaatggtataatagaagtatgtccagtggggcataagagggcat

SEQ ID NO: 6788934 - DNA, 76 bp, Homo sapiens
agagccttcagttccctttctcatctcttcatgtagggcttatgagggtgttggggagatgggaaatgaaggctct

SEQ ID NO: 6788935 - DNA, 64 bp, Homo sapiens
caggaaactgtgggcttaaatctcagctcttccatttgttgtgtgagctcgtgtgggtttcctg

SEQ ID NO: 6788936 - DNA, 66 bp, Homo sapiens
atacacctaacagagtccttgtgacagttaagtgggataatatatgtgaggactctgctaccgtat

SEQ ID NO: 6788937 - DNA, 62 bp, Homo sapiens
aggactgtatactctaggtgaactgaattaccttccgttcactatgcccagaatacagtttt

SEQ ID NO: 6788938 - DNA, 66 bp, Homo sapiens
catcgagaagtgactttcttatggccacacaacttgacggtggtcagagctgcacattctatgatg

SEQ ID NO: 6788939 - DNA, 68 bp, Homo sapiens
agtgtaatcagcagactaggcagattacttgaaatttcaatttctttcccctctgctgagagtacact

SEQ ID NO: 6788940 - DNA, 56 bp, Homo sapiens
tgggtagtacgagggtttgtttcagattccttgaatcagagccctgagtctgcaca

SEQ ID NO: 6788941 - DNA, 61 bp, Homo sapiens
ggcttctagaatgtgtggcgggcaaactccaaagctccctccagcacatgttcttagagcc

SEQ ID NO: 6788942 - DNA, 77 bp, Homo sapiens
ccgcaagcagagtactcttagggctgtggctgcagcagccgagtcacatgatccctgggcctggtaacaccttgcgg

SEQ ID NO: 6788943 - DNA, 79 bp, Homo sapiens
gtggttgtggggctgagtggagccagaagggctggatcttgtacctctcttccatgtttcagccccatccttcaatcat

SEQ ID NO: 6788944 - DNA, 71 bp, Homo sapiens
aggggccatttgtccagggaatagaattaaaatcaataattattcctttcacctggcacatgtgagcctct

SEQ ID NO: 6788945 - DNA, 67 bp, Homo sapiens
tgctacaaagagagcccactctactagctgctaagtgatgctgcttagatagctctctctgtcagca

SEQ ID NO: 6788946 - DNA, 75 bp, Homo sapiens
tcttatttccccaaaggcggaactgagtctctagggagacacccagaagagatcacacctgccctgggcataaga

SEQ ID NO: 6788947 - DNA, 64 bp, Homo sapiens
cttttccacactcactgcactcatagggcttcacccctgcatgaattatctggtgttggaaaag

SEQ ID NO: 6788948 - DNA, 57 bp, Homo sapiens
ttcattcaggtgtatttatgggtttatatttacccaataaatataacaatggatgaa

SEQ ID NO: 6788949 - DNA, 105 bp, Homo sapiens
cttaagaagtaagtttaaatctacttagggtggctttagactagatagcttcctgaaagctttctgtcatagttatctttgtgcttttattgcctatcacataag

SEQ ID NO: 6788950 - DNA, 84 bp, Homo sapiens
aatatgttttgtatctgtttgtttttatgtgtttctgttgttgcaagaaacatcattggaacacaagtgggtaattgttgtatt

SEQ ID NO: 6788951 - DNA, 67 bp, Homo sapiens
gtagcagagctgagagtggaacccaagtctctcaaagggctctgcttccttctctctgctctgctgc

SEQ ID NO: 6788952 - DNA, 80 bp, Homo sapiens
gctccttaccgagttggtgccgaggatctgcaggttgggtttctctgactccagcagcttggccaccatcttgaggaagc

SEQ ID NO: 6788953 - DNA, 85 bp, Homo sapiens
aagggggatggagtaaaagatgaggcagtagaaatgcctttgaatggttttctgtagctaattctctttaaattttgtcctgctt

SEQ ID NO: 6788954 - DNA, 63 bp, Homo sapiens
gttcaggcctgtcttctttctttccaaatggtgctgtttggacgcgtcagacagtgctttgac

SEQ ID NO: 6788955 - DNA, 70 bp, Homo sapiens
ggaaggcagcagtggctgctattgtctcattttcagatatgaatgggtggtttgcccactgttgccctcc

SEQ ID NO: 6788956 - DNA, 68 bp, Homo sapiens
ctgaggcctaagacatgaatgagttgagcaagtcattattgcttcattcttgaaatcctaggcctcag

SEQ ID NO: 6788957 - DNA, 81 bp, Homo sapiens
caggcagggtggaaagtgggcaggaggatgcacccaggcccagaatgaacctctgtgctttgtccagcctcccctagcctg

SEQ ID NO: 6788958 - DNA, 120 bp, Homo sapiens
tccctccctgcgccaggtttctactctcatgtgacccaaagcagggtcattgggccaggctgaatctaggctggggttctgagactgctgggtgggagagttgatcccaggagggaggga

SEQ ID NO: 6788959 - DNA, 64 bp, Homo sapiens
tttgggagaccgcagctggctccaggggctgagagagccagggtcctgcccccggtcgcccaaa

SEQ ID NO: 6788960 - DNA, 75 bp, Homo sapiens
gcttccatccttggagaatcttgttttactaagagaattgcacttggatgataacagcatttcaactgtggaagc

SEQ ID NO: 6788961 - DNA, 105 bp, Homo sapiens
ggggagaccattgaagtagaagcctcaaagcagacttttccctttactgtgtgtactccaggacgaagaaggaagatcatgcttgatacttagattggttttccc

SEQ ID NO: 6788962 - DNA, 69 bp, Homo sapiens
atcctttactgctgtcaaaaactagatttataagccatatctagtgggttaactagaagttaaaaggat

SEQ ID NO: 6788963 - DNA, 79 bp, Homo sapiens
gctgagctggctgctggacaggccacatggaggagaatcgaggcattccaccagcagcctgtcagcctctggctgcagc

SEQ ID NO: 6788964 - DNA, 66 bp, Homo sapiens
gtgggcacacaagcttcctgactggtgctcttacaacccagtttggtggcctcgggaagctcccac

SEQ ID NO: 6788965 - DNA, 64 bp, Homo sapiens
gtgttcttgccaaggccaacattttcatgttcactctgttaaatgctgtgtctagcaggaacac

SEQ ID NO: 6788966 - DNA, 88 bp, Homo sapiens
gtttaccctggagaagagaagacttaagggtgatttaatgctgttattgaagcataagagggttcttttctagagcctcctggtaagc

SEQ ID NO: 6788967 - DNA, 65 bp, Homo sapiens
aaggtccttttgcagtgtgatctcgctgatgattactgaagctgacatatctgctaaaggatttt

SEQ ID NO: 6788968 - DNA, 67 bp, Homo sapiens
ttctgtcacagcatcctatgcagggtgtgcacaaccaagcaccaataaaagtgagttgttgaaagaa

SEQ ID NO: 6788969 - DNA, 104 bp, Homo sapiens
gtgcttgtttgttatctgtctgtctgctgtccgagtatattctcacagataaaatggggaagagctccaaaaacagtgagagaaggtattcacagataaagcat

SEQ ID NO: 6788970 - DNA, 58 bp, Homo sapiens
gcagtcatgtgaggagcccagacaggaccagcaaagtctggctcagtcaactgactgt

SEQ ID NO: 6788971 - DNA, 69 bp, Homo sapiens
gttcaaactcaaagtcagatcagagatgaaaccccagctccatctctttctatatgtgagtctttgggc

SEQ ID NO: 6788972 - DNA, 62 bp, Homo sapiens
gatatttctgattgctctcttttttgctttccacttctggctcatgagcaatcagaaatatc

SEQ ID NO: 6788973 - DNA, 68 bp, Homo sapiens
aaaaggttgaattcaggatccacagatctgcttcatcaattagacaagtgtttcctgaatttcctttt

SEQ ID NO: 6788974 - DNA, 69 bp, Homo sapiens
gtaatcaggaaagatatttattggcaacagctgcactgaagttggtggcattgtattttccctgaatgc

SEQ ID NO: 6788975 - DNA, 62 bp, Homo sapiens
ggtcagtggcagggggtacttcagtattatacaactgctgtgaccagacttgtatactggcc

SEQ ID NO: 6788976 - DNA, 115 bp, Homo sapiens
gggataagttggtgaaaggtttaggtgtacaaagtatgaaccagtttctctcaggcttatgttctttttgcctcaggaagctcattttgacatatcccctcacagactattaccc

SEQ ID NO: 6788977 - DNA, 60 bp, Homo sapiens
tagcatcttgatttcagaccagcatatcagcctgtcagaattgtttgaatcataatgcta

SEQ ID NO: 6788978 - DNA, 74 bp, Homo sapiens
cctgacccttagctgagtcctttggaaagtagaaacattatgtacattcaaaattaggttagttgtgggtgagg

SEQ ID NO: 6788979 - DNA, 72 bp, Homo sapiens
ctcagagagtgaattcctgcctctgccgctcgtggctgtgtgacctcaggcaagcgactcaccctctctgag

SEQ ID NO: 6788980 - DNA, 71 bp, Homo sapiens
tcgatttctagtccagtgatctttccaggctgcctcttggttgtgtcacttagattagaaccttaaattga

SEQ ID NO: 6788981 - DNA, 93 bp, Homo sapiens
agaaagtttatcaaaagaaacatgaaattcaagtgtgatgtttccttcaccttgcactggaatgtcatcgtgactttaaaggtaaaactttct

SEQ ID NO: 6788982 - DNA, 78 bp, Homo sapiens
tctggtgatgtccctgacaatggtggctcatcagctcaatgctggcaaccttgagcctgtggggtgacaaccattaga

SEQ ID NO: 6788983 - DNA, 76 bp, Homo sapiens
tcccaggacaagcccttccgtgctgctggatgtctccctcttgacacctgggcatgaggagtggggatgcctggga

SEQ ID NO: 6788984 - DNA, 60 bp, Homo sapiens
gtggccattgaaagattgggaactggatttctaggttacaacattgattcatttggctat

SEQ ID NO: 6788985 - DNA, 79 bp, Homo sapiens
ctcatttattactcagtttgaggggtaggtgttatttcataaaagaacaaactatgactcaagaagactgacaagtgag

SEQ ID NO: 6788986 - DNA, 72 bp, Homo sapiens
ccttccactgtttgatttctctcagttagggagatgagatgactttactgaaataatgaaacacatggatgg

SEQ ID NO: 6788987 - DNA, 125 bp, Homo sapiens
gagagaagaaattagacagctagctggcagcagctaactcatctaatagctggaaaagaaagatcagctttcactttcaattatgagatgctgagtagttggtagtttgaatagtatttattctc

SEQ ID NO: 6788988 - DNA, 55 bp, Homo sapiens
tattattcacaatagccaaggtatggaaacaacctgtgtctgttgctgaataatg

SEQ ID NO: 6788989 - DNA, 55 bp, Homo sapiens
tatggatgactccagatgactgtagccccaactaacatctgcctgttatcacata

SEQ ID NO: 6788990 - DNA, 60 bp, Homo sapiens
gtgctgttcattagaaatagaatgcaagaagtatacttttacattttctggtgaatatac

SEQ ID NO: 6788991 - DNA, 72 bp, Homo sapiens
gcccttgatgtcctgcaactgaaggagaaggatgtccttaaattccttgcagcaggaactcatttaggtggc

SEQ ID NO: 6788992 - DNA, 86 bp, Homo sapiens
aacctttccctctcacattgatgtgatgcagaagtggcagtggtacaaactctaccatgcagtgcttaatgatgatggtagaggtt

SEQ ID NO: 6788993 - DNA, 61 bp, Homo sapiens
gcaggagtgagttggggtctacacaaaccatgacaggtctgtggcttctcttcactcctgt

SEQ ID NO: 6788994 - DNA, 78 bp, Homo sapiens
agcttctcagaggtatccatgtgccccttacagaaccctgctgtgtaggacacagatatctctgagattatccgagct

SEQ ID NO: 6788995 - DNA, 93 bp, Homo sapiens
tagactattttgattggtgtgctttattcttacctatttcggtttacaaaaatatgcaaataggtgtaatgacaaccttcagaatgtattcta

SEQ ID NO: 6788996 - DNA, 129 bp, Homo sapiens
accattaaactaatatttagaaaaagatcttgagctttcacagggtctcattgccagaaagttattcccttggcttgaaactatgtagagttccagttttgctagtaatataaataaatctgtgatggt

SEQ ID NO: 6788997 - DNA, 74 bp, Homo sapiens
tatgagtactgtgaacgagaattagttacttaacctctctgagcttctatactctcatttataaagtgctgata

SEQ ID NO: 6788998 - DNA, 82 bp, Homo sapiens
gtaggacaagggaaagatcaaccacgccgggttgccaggacaatagtgaatggaacagctgggttgggtgccttggctgtgc

SEQ ID NO: 6788999 - DNA, 58 bp, Homo sapiens
cttctccgtaggggccttgcctgggactacaactcccaggatgccgcaggcggagaag

SEQ ID NO: 6789000 - DNA, 67 bp, Homo sapiens
tatgactttgtaaagttgggttcttctttgagttcagatagtcgaaggaacctcaattttcgtcata

SEQ ID NO: 6789001 - DNA, 80 bp, Homo sapiens
gcatcatggctgggaggagagtatgatggagactgaatcctccgccaaatataattctccacctttagtgccactggtgt

SEQ ID NO: 6789002 - DNA, 62 bp, Homo sapiens
acttgcctccatattttattgccagctcttacctagctatgataatcgtgagggaggcaagt

SEQ ID NO: 6789003 - DNA, 75 bp, Homo sapiens
gcagagctcaagaaatatggtcaggagaagggctgtcatgacgcttgcttgattatgatcataaaactgctctgc

SEQ ID NO: 6789004 - DNA, 79 bp, Homo sapiens
tttaaagaaccagatctgggatgtagctatcaatttttattggtgttaggttttcagattcaatgtatgattctttaaa

SEQ ID NO: 6789005 - DNA, 59 bp, Homo sapiens
catgtaactccttaaagcagctggaaaaagacaggtctgttaggttgctttaagacatg

SEQ ID NO: 6789006 - DNA, 65 bp, Homo sapiens
tgcattagaatcacctggagggacagttgaaacacagattaccaacctaactccatgattttgca

SEQ ID NO: 6789007 - DNA, 96 bp, Homo sapiens
ccagagtagaatagagaggcacagcagagtttggcttctaatggtatctagccctccttcccattatcttgccaacactgtcccctttatctctgg

SEQ ID NO: 6789008 - DNA, 71 bp, Homo sapiens
gtgccctgcatgccccgggtatgccccgtgtcccagagggaaacgtttacttgctcggcgctgctggtcac

SEQ ID NO: 6789009 - DNA, 58 bp, Homo sapiens
tgacaggttcgttagtcatgttgctgggataatacaagctacaatctgaaacctgtca

SEQ ID NO: 6789010 - DNA, 56 bp, Homo sapiens
aaatcagcagcacctgtaagccgtgagtggcacaggacacagggtgtggctgattt

SEQ ID NO: 6789011 - DNA, 65 bp, Homo sapiens
ctagagggacaataagataaaatggtaggagacaaagtactatccttttatactctgtcctctgg

SEQ ID NO: 6789012 - DNA, 92 bp, Homo sapiens
ggtgagagagccaggccctgggcaggcacagagctatgcaggtggccccctctcagtgcctgccctaggctctgcttgtgactctcttctcc

SEQ ID NO: 6789013 - DNA, 130 bp, Homo sapiens
agcgaaggtggccatcggtgagtgagcaagtgatcgcctggctgggcaccaggggaggcggaaagaacatgagaacaagcctccccactgctgcccgcctggaagctgtcgatctcccacagggcccgct

SEQ ID NO: 6789014 - DNA, 75 bp, Homo sapiens
tttcttcagacattgtaaactttattcactacctggcagtaggtgtaaaataagaatttacttgtcaagagggaa

SEQ ID NO: 6789015 - DNA, 71 bp, Homo sapiens
ttgattttattcccaccctaagtagtaggtcttatagatcttattttatagtggagggaactgaagatcag

SEQ ID NO: 6789016 - DNA, 84 bp, Homo sapiens
gagcccacgtgggattcacacctcctagagttcacagcacaagtttgctgtaacagtagataaggtcttggttgccctgagctc

SEQ ID NO: 6789017 - DNA, 61 bp, Homo sapiens
gggaggcagccagcacatggaagagggaaggacccaagaactgcagagctggctggctcct

SEQ ID NO: 6789018 - DNA, 59 bp, Homo sapiens
gttttccaggtgcatagaaaacaggctttttcatgtaggtctgctgagccctgggaagc

SEQ ID NO: 6789019 - DNA, 55 bp, Homo sapiens
ctggcttttttcccattatgcagagtgttgatttggaggggggagtaaaagccag

SEQ ID NO: 6789020 - DNA, 72 bp, Homo sapiens
ccatggggctggcgcaacagaaaatctggagaacatacgtcatgctattttcagtgttgtccctccccgtgg

SEQ ID NO: 6789021 - DNA, 63 bp, Homo sapiens
tcttcttatgtgccattatctcctttccctactcatgggagtaagagacatgtagatagaaga

SEQ ID NO: 6789022 - DNA, 128 bp, Homo sapiens
ctccagttttattattctgtgaagacagtttggtgtaaatgatttaagaggttagtcagaatggagttctctgttcaaatgatcttcttaaatttctgtactgagctctactcataggaaacgtggag

SEQ ID NO: 6789023 - DNA, 67 bp, Homo sapiens
atctggaataggataatatctatttgatttgaaattgaacagatggtagcattatgttggtccagat

SEQ ID NO: 6789024 - DNA, 106 bp, Homo sapiens
gcatgttcaaaactttcaaaaagactctggatgatggcttttttcccttcatcatcctggatgccatcaatgacagagttaggcattttgaccagttttggagtgc

SEQ ID NO: 6789025 - DNA, 80 bp, Homo sapiens
ctcagcagtgtcaatcttcttacataggcccatgagtctatgcccatagtatgagtgtgtgtagaaggtacactacagag

SEQ ID NO: 6789026 - DNA, 117 bp, Homo sapiens
agctcaattcagttcagttgtgctatatgtacatgcacatgtatctatatacaaattgtgtataatttgggctatggatacattgtagtacattcaattgaaagtgaagtgggagct

SEQ ID NO: 6789027 - DNA, 64 bp, Homo sapiens
caaatgagaaaaaggagaggagccataaagtgacttgcttaaggttacatcctcttcctctttg

SEQ ID NO: 6789028 - DNA, 75 bp, Homo sapiens
aaaggaagcagagttgaattgatgctgttcccagtgtctgtaaactttgagaagtatgaattcattgttttagtt

SEQ ID NO: 6789029 - DNA, 100 bp, Homo sapiens
ggccacgccgatggccacccgggtggagcctgggctgtgggcttcgcctgcgtccccgcggcctgtccacgcgtccggcacccggagctagggcgtggcc

SEQ ID NO: 6789030 - DNA, 94 bp, Homo sapiens
gcatctagtatcttccctggcacataataggacctcagtaaatgatactaatatttattgagcacatgctatgtgccaaggcactgttctatgc

SEQ ID NO: 6789031 - DNA, 66 bp, Homo sapiens
aaaccttttctaatacttgctttggatgtatgtttcatatatattcttaagtagtgtagagggttt

SEQ ID NO: 6789032 - DNA, 80 bp, Homo sapiens
ccacagactttgcagcctctgcttttgcacagtgacccagggaaccagtggcagaggaagggtgctgcgaaagcctgtgg

SEQ ID NO: 6789033 - DNA, 76 bp, Homo sapiens
aacgtgctccctccttgttactctctctaaatgctttacagtagccagggaaggataacaagaagaacagcgtgtt

SEQ ID NO: 6789034 - DNA, 74 bp, Homo sapiens
ggcccagaggggttgagcatctcagcaatattatatacccagtctgctcgcctgctcgcctcctcctgctcgcc

SEQ ID NO: 6789035 - DNA, 59 bp, Homo sapiens
ggaaacagtctgggagttccttataaggttaaacagttaccttataacccagaaattcc

SEQ ID NO: 6789036 - DNA, 114 bp, Homo sapiens
gtctctgctgatctgtgcacttagttcagtatttgaggtttcggtcacggttgtgaaaactactgagactgaatctgaatgatggattacttctgatgcatgtctgccagaggc

SEQ ID NO: 6789037 - DNA, 77 bp, Homo sapiens
aaggattgatacatgcacagcaagggtgagagaatggacaaggaccaactccatccccctgtgtgtcaatcagcctt

SEQ ID NO: 6789038 - DNA, 58 bp, Homo sapiens
gagggtggcatacaacatagaggcttgaaccaaaggcctctgcaatgttgtcacactc

SEQ ID NO: 6789039 - DNA, 90 bp, Homo sapiens
tctttaaaagtctaacactgtcagcttagcacttattggccatttactttgtgtgaggctccatgctaagcgatatgggggaaataaaga

SEQ ID NO: 6789040 - DNA, 72 bp, Homo sapiens
agtatttacctattgttctgagaattggatttagatagctcatgttcaagcacttacagtctggtaaatgct

SEQ ID NO: 6789041 - DNA, 64 bp, Homo sapiens
caggaggtcaggagctccatggtgagcacaggaagtctgtctttggatatcgctagaccgtatg

SEQ ID NO: 6789042 - DNA, 74 bp, Homo sapiens
agcttcttttcatttttcaggggtagttacttataacaattaggtatgtatccttttaagaagaaaagattgtt

SEQ ID NO: 6789043 - DNA, 62 bp, Homo sapiens
tcagaacttaaagccgattgggccacagaatcaggtaaatcagatcttgcattaagttgtga

SEQ ID NO: 6789044 - DNA, 92 bp, Homo sapiens
catgagacagcagggataaatcatgaggacattatgccaagtgagataagccactcaccaagtgacaaatgccatatgattccacttccatg

SEQ ID NO: 6789045 - DNA, 85 bp, Homo sapiens
gaaggtagatgcagaagatgcagtgtctgagaattttcaagattgtatttctctcataagcatcaatcacagtgcatctttcttc

SEQ ID NO: 6789046 - DNA, 68 bp, Homo sapiens
tgaggtggcagaataattgaaggtcagactcaaaatagagaggcctccataaatattttctcagttca

SEQ ID NO: 6789047 - DNA, 78 bp, Homo sapiens
gttcctttcatcagatttactgcagagcagattcatcaacatgaagttcaattcccagtagactaatgaaaagagggc

SEQ ID NO: 6789048 - DNA, 77 bp, Homo sapiens
actgttcctccatgtatgtcagggttgtccagagaaacagaaccaataagataaatagagatatataggaggaaagt

SEQ ID NO: 6789049 - DNA, 91 bp, Homo sapiens
gccccacggggcagcttggaagagaagctgggagggatgaggggctccactagcattccttgtggcttctgagtgtagctgccctgggtgt

SEQ ID NO: 6789050 - DNA, 66 bp, Homo sapiens
agctgttgtacttcaaaccctttggtttctggctttcagatcaccaataattgaggtgaaatagct

SEQ ID NO: 6789051 - DNA, 64 bp, Homo sapiens
acaggcaagtcacacaacttgtacaagaattcatcttgggccaggtgcagtggctcatgcctgt

SEQ ID NO: 6789052 - DNA, 106 bp, Homo sapiens
aggcattcttctttttgttgtatataattgacacatagtaatcgtacatgtttgcaggatacattgtgatgtttcaatacatgtatacactgaataatgataaact

SEQ ID NO: 6789053 - DNA, 71 bp, Homo sapiens
gtggcccgtcctgacgccgcgcccagctccgccagccggccgacctgcgcagcaatcagagaggagcacac

SEQ ID NO: 6789054 - DNA, 66 bp, Homo sapiens
gtttcaggggctttatgattcagaggcttgctgccaggctatgtaatttgcaagacccagtgaaac

SEQ ID NO: 6789055 - DNA, 114 bp, Homo sapiens
atcacctgagagcttattaaaatgcacaggactgggacccacacctggaatctctgattcagcaggtcaggggtgggcccaggaatctgcatttctagcatgttcccaggtgat

SEQ ID NO: 6789056 - DNA, 85 bp, Homo sapiens
agccaactgcttttcttcagcagcctgatgccccattctttcttgagcaaaaatatgagatactctgaagtgagttaagttggtt

SEQ ID NO: 6789057 - DNA, 74 bp, Homo sapiens
acttattttcctcagcactttgaagatacttttctactgtcttctggactttatggtgctgataagaaagaagt

SEQ ID NO: 6789058 - DNA, 69 bp, Homo sapiens
tcaactggttataggatgatttcttctgtgtagttatttgaatgctatattcattttaaagccatctgg

SEQ ID NO: 6789059 - DNA, 78 bp, Homo sapiens
actaagaatctccaaggaagccccaagggatctgggatctagactttagaaaaggggccctccttggatgatgctggt

SEQ ID NO: 6789060 - DNA, 57 bp, Homo sapiens
cttgggtgtgacttttggaaaacatgcgtttgtatttctgttgggtatatatccaag

SEQ ID NO: 6789061 - DNA, 76 bp, Homo sapiens
tggggacagcagactgtaaagggccagaaagttaaaattttagcctttgtgggttttacaatctctgttgcaacca

SEQ ID NO: 6789062 - DNA, 61 bp, Homo sapiens
gtagaggtcgcatgtggtgtaaggcctaaaagtaaggcccaatattgtgtgctaccttgac

SEQ ID NO: 6789063 - DNA, 76 bp, Homo sapiens
ggattcaaatccaggcagtgtgacgctagggtttacactttgtgttgatcagtgaactatactgcctcttcagtcc

SEQ ID NO: 6789064 - DNA, 57 bp, Homo sapiens
ttaggcctttgattggggtgctctgtgctacaggtagtgccaaatcgagggctctga

SEQ ID NO: 6789065 - DNA, 112 bp, Homo sapiens
ctgtgaagtattgttgccagtcaacaaggtttgcttatctttcttccagctaccttgctaggacatctaattgtaggtataactttgtgagtggtccacttatatgccacag

SEQ ID NO: 6789066 - DNA, 75 bp, Homo sapiens
tcctataagtagcgatcaggattaaagtccaggtgttctacccatgaatctttaagtctttgattgacagtagga

SEQ ID NO: 6789067 - DNA, 81 bp, Homo sapiens
gtccctcttgcttcagcttcatgtccaggtactgtgttagatgcagatgctgtgtgaatgttgggcaacatcagaggtgat

SEQ ID NO: 6789068 - DNA, 79 bp, Homo sapiens
actggtttcctagaataagactgtttctttccagagaagagtaaactggcccttttcgattttgttctagcaacacagt

SEQ ID NO: 6789069 - DNA, 66 bp, Homo sapiens
ccggcagcagtgttgtggagtctattgtgagggacaaactctcagaacctcctagcagtgttctgg

SEQ ID NO: 6789070 - DNA, 58 bp, Homo sapiens
ttacttcagattgtggaaggcattcaccagctaaaagttcctttccaattcgaggtag

SEQ ID NO: 6789071 - DNA, 111 bp, Homo sapiens
tctggcaagaatgtgcggccacaggattcacagggcagcagctgagcctgggcactctgaaatgcagcctcgttagttgcctgaagactgtaggacccactgctgctgaga

SEQ ID NO: 6789072 - DNA, 59 bp, Homo sapiens
tttgagcaggaccctccaagggaccatccttattctgctctctgagaggtctgcttaga

SEQ ID NO: 6789073 - DNA, 66 bp, Homo sapiens
ctcctgagtcactgtttcccggctctgccaggccaggcgggaaaagggggagcggggcggagggag

SEQ ID NO: 6789074 - DNA, 82 bp, Homo sapiens
actggtagtgggagaaggtgtgcagggccaaagtttgaccaatgtccagcatcctgcttgctgtctgtgaatcactgccagt

SEQ ID NO: 6789075 - DNA, 60 bp, Homo sapiens
gagtcagacagggtcacccagaaaggaagaggtgcatcttctgaccgtgtcacatgattt

SEQ ID NO: 6789076 - DNA, 58 bp, Homo sapiens
cagaggtggggttttgttcttgaactcatgtgagaacacattcgtgccctacattctg

SEQ ID NO: 6789077 - DNA, 82 bp, Homo sapiens
tagcaagctcaaactaatatggggctaaacatgatcaatatttgttgaatgaatggtccatatagaaggttatgggaggctg

SEQ ID NO: 6789078 - DNA, 65 bp, Homo sapiens
taagaatattgggaatggatgggaaaagaccctgaaggctcaaatcatctgtattcctgttcttg

SEQ ID NO: 6789079 - DNA, 65 bp, Homo sapiens
gtggcagacgcccccacacacgctcccttctagatgaatatgaagaaagcagggcattttgccat

SEQ ID NO: 6789080 - DNA, 62 bp, Homo sapiens
ggtcagaaactttggccctcaagccaagtagactttggtttatatcccgaagttttctctcc

SEQ ID NO: 6789081 - DNA, 57 bp, Homo sapiens
gtctctgggcttgttttctgtgtcctgcatgaatcaggagttgtatgtccaagggac

SEQ ID NO: 6789082 - DNA, 78 bp, Homo sapiens
aagtggtacagtatttatggcttgagtatttcatatttgtgactcagtaatattcaagctctaagacaggtatggctt

SEQ ID NO: 6789083 - DNA, 55 bp, Homo sapiens
ccccacaactcatgttgaaacttaatttccaatgtggcaatactgagaggtgggg

SEQ ID NO: 6789084 - DNA, 63 bp, Homo sapiens
atacgtgggctgtggcatccctccacagtagtggcactgacgctggagtctgagcccaggtat

SEQ ID NO: 6789085 - DNA, 57 bp, Homo sapiens
ggtggaggaaatagagctctcagcaccaccctgctgagcccagttttccctcttgcc

SEQ ID NO: 6789086 - DNA, 83 bp, Homo sapiens
gctgctctgtcatatctcctccagcacaggcctgactctccaaatctttaggctttcttgaaggggatatgattctagttggc

SEQ ID NO: 6789087 - DNA, 56 bp, Homo sapiens
actgtaaccagtgtggtgagagaaacaattctggtctagtccacatggttacctgt

SEQ ID NO: 6789088 - DNA, 68 bp, Homo sapiens
tggaaaaggtggttctatctgggttctttctccaaatctgggcagagactgatggagctcactctcca

SEQ ID NO: 6789089 - DNA, 130 bp, Homo sapiens
ttacaataattagctaaaaagatgtgagcacattatttcaagatagtaaaaacctggagaagaggggatggggcaggtgactactattttaaaatattagtgtactaatactattttgctttttaagtaa

SEQ ID NO: 6789090 - DNA, 63 bp, Homo sapiens
gacttgaccttctattagctgagagatatttgtctatatcgtgctaacgtttaaggttatgtc

SEQ ID NO: 6789091 - DNA, 77 bp, Homo sapiens
ctggaaatgagctacagacccaccttggaagaacctgcagttgaggggcttctttcatttggttttgtacttttcag

SEQ ID NO: 6789092 - DNA, 94 bp, Homo sapiens
gctgaggcgggctgatcgcttgagctcaggagtttgagaacagcctgggcaacaaggatgagaccctgcctctacaaaaaatataaaaattagc

SEQ ID NO: 6789093 - DNA, 130 bp, Homo sapiens
gtgactatgtatcagaaatgcagatgctccacctacagaaattccaaatcaactagtctagggtggtgcccaggcatcggtgtttgggatttttggttgttgttgctgctgctgttgttgatcttgttgt

SEQ ID NO: 6789094 - DNA, 126 bp, Homo sapiens
ctatgcagtccaactttgggggacattcacactatggccttctgaatggctgtgtatgctcaactccaatgggcatcattcagatagactgcaatgtgaatttatccccagaattgtgcaacatgg

SEQ ID NO: 6789095 - DNA, 57 bp, Homo sapiens
gtccctggaaacttgtaactggacacactgtaatttgtccagctgtctttcagagac

SEQ ID NO: 6789096 - DNA, 68 bp, Homo sapiens
agtacccattgctgggcatttatgcagatggtcccctcatggtaaagagctgcccaagttctgggtct

SEQ ID NO: 6789097 - DNA, 69 bp, Homo sapiens
tttatttgctacctttgataaatatttctgagtgctaagtgtactaagagttagggctagcaatatgga

SEQ ID NO: 6789098 - DNA, 73 bp, Homo sapiens
gctttctaagttctgcttttattgccagagttgttgccttatacctttgaaatatagtgaagtcatggagagc

SEQ ID NO: 6789099 - DNA, 70 bp, Homo sapiens
aggtgggtgagttcaggcccacacacaggctcagggcctgtaagtagtttgcctgagctacctcttgcct

SEQ ID NO: 6789100 - DNA, 60 bp, Homo sapiens
tagagagtcgggaacttacctgaggccacaaagcaaacccagggccaatcctgacctcta

SEQ ID NO: 6789101 - DNA, 58 bp, Homo sapiens
atttgctgagctcaaagaaaaggcattacaaatgcagttgatctgtggcttagtagat

SEQ ID NO: 6789102 - DNA, 63 bp, Homo sapiens
gaacacagtggttgtttggaggagctccagaggaagtgcctctccttaccccattgtatgttc

SEQ ID NO: 6789103 - DNA, 94 bp, Homo sapiens
tggggtttttttgtgtgtggtgacaggacgtacaggcaattctttctttcatgtgtttgccttctggcatcactcgcaagagcacttagcccca

SEQ ID NO: 6789104 - DNA, 76 bp, Homo sapiens
agctgtgatgtggagggtgctgagacgggctttggtatcaagtgaggccattaatcgtccctcctgcttcactgct

SEQ ID NO: 6789105 - DNA, 71 bp, Homo sapiens
gcagagtggaagtgcttgggctttgatgttggaaggaagctttttcctggccaagttactctctgcactgc

SEQ ID NO: 6789106 - DNA, 86 bp, Homo sapiens
gaaattaatcctctggggcgtggtcctggaccctcagacaagaggagaggtcctctgctaggtgccccatagtatcctttgttttc

SEQ ID NO: 6789107 - DNA, 66 bp, Homo sapiens
gcaggaacttgcaaaatgagcaattatctctcttaaatttcatttgattaggtttgcatttcctgc

SEQ ID NO: 6789108 - DNA, 58 bp, Homo sapiens
gcctggctgggctgaatgcttatcacctaattatatcaagcatagagcaccagaaggc

SEQ ID NO: 6789109 - DNA, 86 bp, Homo sapiens
gagttttgctttgtcacccaggctggagtgtagtcgcatgatctcagctcactgcaacctccgcctcccagtttcaagcgattctc

SEQ ID NO: 6789110 - DNA, 56 bp, Homo sapiens
aggttacagtcatctcagaatcactagcacatgtgcttttagagagacattagcct

SEQ ID NO: 6789111 - DNA, 83 bp, Homo sapiens
tgtgaaaatgtagtgacatttcattgaaagtaggttttgaatcattaagcttactttagaaatagtcatcaaaacttgtcata

SEQ ID NO: 6789112 - DNA, 68 bp, Homo sapiens
cagtagatttttcatctgattgataactctgcaattagggctttttgatgcagtatggaacatctctg

SEQ ID NO: 6789113 - DNA, 71 bp, Homo sapiens
gttaggaatcatccttagcacccaccaaggacttcctaagtgctggaccctgtgctaagcctgtttcctgc

SEQ ID NO: 6789114 - DNA, 65 bp, Homo sapiens
gctgagtctctatcatagctgaaccctgaggacagcctcatagctcatgtatcagggacttttgc

SEQ ID NO: 6789115 - DNA, 55 bp, Homo sapiens
tggccaggtgtgggttctcagaaatgttctttttgattccccttcactctggcca

SEQ ID NO: 6789116 - DNA, 59 bp, Homo sapiens
ggcaacaggagaaatctggtcaaaagccagtttgtctccagttttcttctgcctttgcc

SEQ ID NO: 6789117 - DNA, 69 bp, Homo sapiens
cctgattcatgtagcttagcagagaggctggcctgcagcctctgtgcaggaaatacatgtgaataaagg

SEQ ID NO: 6789118 - DNA, 77 bp, Homo sapiens
tctgatgcattccgtcaggtgcaggtcagtgtcctagaaccaggttactgccatgcacatggctgtaatgacccaga

SEQ ID NO: 6789119 - DNA, 68 bp, Homo sapiens
gggggctgtctctcaccacagacacacaggatggctaagtccttaacctctgggagggacaagtctcc

SEQ ID NO: 6789120 - DNA, 67 bp, Homo sapiens
cagattggttatgtctgttcttaaacttcatataaatggaaccatacagtacataatcctgagtctg

SEQ ID NO: 6789121 - DNA, 59 bp, Homo sapiens
tctcaaaatatcacttgtgtttagatttgttagagatcaatgaagtggctattttgagg

SEQ ID NO: 6789122 - DNA, 95 bp, Homo sapiens
gaaagttgagcaatgattcttgtgaattatgagttaattaatggtatgactgcattttgttgaagtctcatgatttaaagatgtgctcatttttt

SEQ ID NO: 6789123 - DNA, 130 bp, Homo sapiens
ctgagattatgtttatttttaagttgttctttgattctgaagacttattaaggcattaatgaagagagtaacttgatggatgtcaaaggagtttccagtgaagagttgccaaggatgggcttgattacag

SEQ ID NO: 6789124 - DNA, 56 bp, Homo sapiens
gcattgaagatcttagactaggggcctgggtgtctcctgtctctcctcttcattgc

SEQ ID NO: 6789125 - DNA, 69 bp, Homo sapiens
taggaggaagttggcaatagtgtcaaatgctgacatcttagcagcatttctgagccaactctcttcttg

SEQ ID NO: 6789126 - DNA, 62 bp, Homo sapiens
gaggctgctgagggatgggtaggagggctaccagagcctggctgtccacatcacagagcctc

SEQ ID NO: 6789127 - DNA, 106 bp, Homo sapiens
catgtaccaggcatgacagtgttttgtgttaagaaagtacagtattgaaacagcagagaaactattgtcatagtttaatacagaacttgtcagggccagtacactg

SEQ ID NO: 6789128 - DNA, 82 bp, Homo sapiens
gtttagtcttggtcttgtgtgaaatcatatgctgtatgtgtgtttatacatatattttcacacatggtttttccttttgaac

SEQ ID NO: 6789129 - DNA, 65 bp, Homo sapiens
agaatataacagattcaaagataagtctctaaagaggaaggcaatctttgcatcagttgttttct

SEQ ID NO: 6789130 - DNA, 77 bp, Homo sapiens
agattttgtgcttgctgagataaatgctgtcttcatggtggctggagattagttttatttatctttgtaaaaagttt

SEQ ID NO: 6789131 - DNA, 61 bp, Homo sapiens
caggaggtcactaccaggaggtcactatcacttgacctcctgggatcaagtgatcctcctg

SEQ ID NO: 6789132 - DNA, 58 bp, Homo sapiens
tctctccagttagcagttcctggggcatggctgctccagctgttgcagcactgagaga

SEQ ID NO: 6789133 - DNA, 58 bp, Homo sapiens
cctttgtcttggcctcagttttctgttctatgaaaagaaaatagtggtaggacaaagg

SEQ ID NO: 6789134 - DNA, 79 bp, Homo sapiens
tgttgtatagagtcttgcttttgctgatgattaagccaacaggtgtcaggagtgctaaagcaagttggctttgtgccca

SEQ ID NO: 6789135 - DNA, 65 bp, Homo sapiens
gctccaaatcatacagaacctgagcacttctagacaactatctgggcaggaaattgtatgagagc

SEQ ID NO: 6789136 - DNA, 58 bp, Homo sapiens
gagattagagttgtttcattgtgtctgcagcctcactactggtcacttctctgatctc

SEQ ID NO: 6789137 - DNA, 79 bp, Homo sapiens
aacatatttgtatttgtattgctttttacttggcctaactttacacagccagtgattcctagtaatataattatgtgtt

SEQ ID NO: 6789138 - DNA, 79 bp, Homo sapiens
ctgttggtggcctggctgcctaggtgctaggggtgggtttggccacaccctggaggctggaggcagtaggggccagtgg

SEQ ID NO: 6789139 - DNA, 56 bp, Homo sapiens
gggagagatgctgattgccaatgtcttatttcctttggcaaggtagcatttcttct

SEQ ID NO: 6789140 - DNA, 55 bp, Homo sapiens
gaaggatttcctatcagttttcctggaatcaccaggaacatgtttcagattcttt

SEQ ID NO: 6789141 - DNA, 80 bp, Homo sapiens
cctctggctgggtgagagcttctctgagaaagagggatgtttccaaccttgccccctgggaattctctcccggcctgagg

SEQ ID NO: 6789142 - DNA, 62 bp, Homo sapiens
gccctggatggcaggagccatcaccagtggccacgaatccctgctataaatgtacccagggc

SEQ ID NO: 6789143 - DNA, 72 bp, Homo sapiens
ggtgtctttttcctttaagagaatggtatattttgaatatgcattggtcttaatcttcaggggaaaagcatt

SEQ ID NO: 6789144 - DNA, 101 bp, Homo sapiens
ggcggctgtccctgttttctgttttccctttccacggcttggcatttattctacgtgggagaagcatggggtgcagagcggtggcactgggactgcgtgcc

SEQ ID NO: 6789145 - DNA, 70 bp, Homo sapiens
ggcttccagctgggccttggaggacagggtccacccctacctcctggtctccttcctcagcttggaagcc

SEQ ID NO: 6789146 - DNA, 92 bp, Homo sapiens
caggaacagacaacagtcctggggtctagtggaagcacctctctatcaaaactggagcagggttccttaaggccatacttttgctgggcctg

SEQ ID NO: 6789147 - DNA, 60 bp, Homo sapiens
gaaccttatggtaaatctagaggaagtttgtctctcatgatagatgctgccataagattc

SEQ ID NO: 6789148 - DNA, 62 bp, Homo sapiens
ctctagggaatataatgtatgccattctgaaaggtggtatttcagcttttgtatctttgggg

SEQ ID NO: 6789149 - DNA, 57 bp, Homo sapiens
gtgggatatctaattgatgatatgtgcattacaatgcatcagatttagaagttctat

SEQ ID NO: 6789150 - DNA, 60 bp, Homo sapiens
tgtcctacattttctttcatttccccaccctcataatgaaatggctttgagggtaggaca

SEQ ID NO: 6789151 - DNA, 63 bp, Homo sapiens
atggcacatgttgccttcgaatatttaaagtgaaaatgttttctgatttgggctatgtgctat

SEQ ID NO: 6789152 - DNA, 79 bp, Homo sapiens
gccccaaatcagtctagtattggtcattggtaacaaaacttagactgtcaccgactgagaatacttggcttgatggggt

SEQ ID NO: 6789153 - DNA, 65 bp, Homo sapiens
ctagagaggtggtgttgggtggcagaaagagccagggtttgaaacctagctctgcctcttactgg

SEQ ID NO: 6789154 - DNA, 88 bp, Homo sapiens
ggtgggggaatggaggccagtgaaagtagattcagtttctaaagaaatccatcagtcaacatttattcaagcctcttaaatcttcacc

SEQ ID NO: 6789155 - DNA, 91 bp, Homo sapiens
gccaggatggtcttgatctcctgaccttgtgatccacccgctttggcctcccaaagtgctgggattacaggtgtgagccactgtccctggc

SEQ ID NO: 6789156 - DNA, 64 bp, Homo sapiens
gagcaggaatcacatgcaactggaggggtcagcaatgagggccaggagctgtgtgcttcctttc

SEQ ID NO: 6789157 - DNA, 87 bp, Homo sapiens
ggccagttctttaatgtctacatcagcagagagtaactgatgccctctcattcttgctgtgtggatgtgaagaatctgtagtcggcc

SEQ ID NO: 6789158 - DNA, 78 bp, Homo sapiens
gccagggcccgcctcccagctgccccggccgccggggggcctggcggtgacggcggcgcctggcggcggggatttggc

SEQ ID NO: 6789159 - DNA, 67 bp, Homo sapiens
tcctccagcagcagggaggggaggactggctgtctcagaatcttttaaaagccctgctgtctgagga

SEQ ID NO: 6789160 - DNA, 93 bp, Homo sapiens
tgcagtaaatgttttatggctatcttgcagccaagggcagctgacatgaagaagcaagggacttgcaaatagcctgatgaaagaatttctgca

SEQ ID NO: 6789161 - DNA, 59 bp, Homo sapiens
tttgatttcatagattgtaaatccctgcagtactgcaagaagccatttatgaaattgag

SEQ ID NO: 6789162 - DNA, 95 bp, Homo sapiens
gttcataccactgttgagctccctgaggcatctaacagagatctttactggtagggtaggggttcttggaagcttgaggttaacaatttgggaac

SEQ ID NO: 6789163 - DNA, 92 bp, Homo sapiens
gggcccaggtccctgcgccccggcctcccggcccatttcactccggcttggggccaagagtctgtggagcaaagggaccaaggaagcagccc

SEQ ID NO: 6789164 - DNA, 74 bp, Homo sapiens
agacacagacacattagtgctctgtctcatatttttttccatggtttgtgaatacacaaatgtgtttagtgtct

SEQ ID NO: 6789165 - DNA, 92 bp, Homo sapiens
cttttctgtcatatggggaaactatttccttgtccagaagaaagatgattctgggaagagaggaggtggtttcgtctgtaatgagcgaaaag

SEQ ID NO: 6789166 - DNA, 58 bp, Homo sapiens
tcgtaatggtttatgttgcaggaatttctatttatttctggaaacacaaactatatga

SEQ ID NO: 6789167 - DNA, 57 bp, Homo sapiens
ctcaggctgtgatgtgatggcattggcggagcccagtcaaggcactgacagcctgag

SEQ ID NO: 6789168 - DNA, 56 bp, Homo sapiens
ccggctgtgggcaggaaacctctgttcctctcacaggggcctctccacacagccgg

SEQ ID NO: 6789169 - DNA, 74 bp, Homo sapiens
ggacctcacggcctcctttgtgttgtccatggaagaccaacttccgggcaactgaagggaggtttgtagggtcc

SEQ ID NO: 6789170 - DNA, 74 bp, Homo sapiens
ctcgctctaacaccacagtgtggtttggacgtggccacagtgccgtacaaaccacagtgtgctgctggggcggg

SEQ ID NO: 6789171 - DNA, 79 bp, Homo sapiens
gctggcctttgctccagaggtctgagaggctggccctgcctcttctgcttcaggagcacttctttgcactgaggcctgc

SEQ ID NO: 6789172 - DNA, 91 bp, Homo sapiens
agctagtgtatcatagactttccactctaagaacacaaaggcccagagcagcagctctggcttagagtgtagtggtgatttcccgctggct

SEQ ID NO: 6789173 - DNA, 60 bp, Homo sapiens
tagaagagtgagttagtgccaaagactatcctcaacagcatttacagactcacttttcta

SEQ ID NO: 6789174 - DNA, 56 bp, Homo sapiens
ccagtctgtgtgccagcctgcgagcctgcccaggggatgggatggccaaagactgg

SEQ ID NO: 6789175 - DNA, 84 bp, Homo sapiens
ttggctccattttcttttgtttgtgggtgctaagatggactatagtagtagcctgtcagtagaccccaagctagtggccgccag

SEQ ID NO: 6789176 - DNA, 102 bp, Homo sapiens
ctctgttttctcagttcggttgatcacatctttatgagtatttgtgcttcaaaacttaccaagaatgtggcaatgcctaagatagatgagagagctatggag

SEQ ID NO: 6789177 - DNA, 78 bp, Homo sapiens
agctcttcgttttctttgtgggaaccgtgtgggacaagaaagcccacaagtcctaattttaggaggagaggggagact

SEQ ID NO: 6789178 - DNA, 57 bp, Homo sapiens
ctcatcttgagtccaggggatgataagacagtaagtcccgtggagaaaaggaatgag

SEQ ID NO: 6789179 - DNA, 56 bp, Homo sapiens
gaatgtgggggatgctagcttgtggtgaaactcccaggaagaggccatccacagtc

SEQ ID NO: 6789180 - DNA, 59 bp, Homo sapiens
agggcaatccagccagctgatctgagcatacacttttcccctgggctgaggtctgcctt

SEQ ID NO: 6789181 - DNA, 82 bp, Homo sapiens
ggaaacttacatgttattgggtcccaactaggtgtctgatactgtggcaacttgttgggacccaataaatactatggttttt

SEQ ID NO: 6789182 - DNA, 63 bp, Homo sapiens
gcagaactgccgtgtttgagaattggtaccatcccaattagacatttattggccagattctgt

SEQ ID NO: 6789183 - DNA, 64 bp, Homo sapiens
ttccagaccatgtgagaggcgcaaggtctcagagagactgtgcattctgggtgcatggctggga

SEQ ID NO: 6789184 - DNA, 58 bp, Homo sapiens
ggcagctcccctgggttttattttcctttacatgagaagaaccacaaagggatttgct

SEQ ID NO: 6789185 - DNA, 87 bp, Homo sapiens
cctaaaatttttgctgtcattatttgaggatagactatagacactgtagatgccttgtaaaataggacaagtcctgagaaccttggg

SEQ ID NO: 6789186 - DNA, 71 bp, Homo sapiens
cagcaagacaggattcccgtgggcccagtgtccctgtcctcgctgggattttctctcttgagatttcactg

SEQ ID NO: 6789187 - DNA, 57 bp, Homo sapiens
gtgttctgtgcatcagagttgagctggcttcgctatctgcatctgagcacaaaacac

SEQ ID NO: 6789188 - DNA, 67 bp, Homo sapiens
tctgaaacagctgagccacagcagcaaaagcatcagagctgggcaactgtggtacagctgggacgga

SEQ ID NO: 6789189 - DNA, 87 bp, Homo sapiens
ggaagaatgaatggtctttatggaaaatgaatggcagaataagtgatttgtcaagttcattgaactataaattccatttttactgtc

SEQ ID NO: 6789190 - DNA, 58 bp, Homo sapiens
atcctgtctgcctctcattatttcatttgaaatagctcacggttagtgtaggcagggt

SEQ ID NO: 6789191 - DNA, 63 bp, Homo sapiens
gcacctcagccttctgaaggtggtcccattggtccttgtggcctgagcttcagagttgggtgt

SEQ ID NO: 6789192 - DNA, 65 bp, Homo sapiens
accccagccctgcttctgggaggctctcctgagcctcagtcccctcaggggtgtggctgctgggt

SEQ ID NO: 6789193 - DNA, 55 bp, Homo sapiens
gtggaagctctcaacttccaacctcaaaacagagagggacagggggagcttttat

SEQ ID NO: 6789194 - DNA, 100 bp, Homo sapiens
gatttggggtggagagttctgtagatgtctattaggtctgcttggtgcagagctgagttcaattcctggatatccttgttaactttctgtctcattgatc

SEQ ID NO: 6789195 - DNA, 95 bp, Homo sapiens
cactctgtccacagtacacagggttgtggccttaaaggctcagcaaggtcatcatttctgagcctacagtaacagccctgtggtctcacagaatg

SEQ ID NO: 6789196 - DNA, 64 bp, Homo sapiens
tctctctccagtcaggaactctgacgaggtacactggtgaggagaaggtggcaggagaatgagg

SEQ ID NO: 6789197 - DNA, 84 bp, Homo sapiens
cccatctcagcctcccaaagtgctaggattacaggcgtgagccatcgcgcccggcctaatttttgtattttttgtagagatggg

SEQ ID NO: 6789198 - DNA, 73 bp, Homo sapiens
tgcctgctctctttctaattttgataccgcaatgattaattctgtgaaaaaagttctagaaggatataaggca

SEQ ID NO: 6789199 - DNA, 75 bp, Homo sapiens
taaagcgtataaggctaagttgattaaattgtttcaaaatttcattggaacaattttctgtactagcttgctttg

SEQ ID NO: 6789200 - DNA, 63 bp, Homo sapiens
gggactcagggctgggttctctgcaaacctgtccacagggaggccacagtcctgaggcatccc

SEQ ID NO: 6789201 - DNA, 56 bp, Homo sapiens
aggccctgatacaagtaaggtctacgttttcctaagactgactcttattatggcct

SEQ ID NO: 6789202 - DNA, 66 bp, Homo sapiens
tccaggttagctgacaccctgattttagcctggtagccggtggagtgctcagctgaacccactgga

SEQ ID NO: 6789203 - DNA, 90 bp, Homo sapiens
tacgctgggcaggacgacaaacacgagacgccactgtggaatgagcaacttcggagcacggggtgacttgcttgggaccgtgcccacgtg

SEQ ID NO: 6789204 - DNA, 78 bp, Homo sapiens
actcctgaggttctggagctgactcacaccagctagcaagagacagctgtggtcagaattcagttccatcttgtgagt

SEQ ID NO: 6789205 - DNA, 78 bp, Homo sapiens
tgggatggtgcaaaagtaattatggtttttgctattaagactaatggcaaaaactgcaattatttttgtaccaaccta

SEQ ID NO: 6789206 - DNA, 63 bp, Homo sapiens
gaatcaatcaatcaccctctttttagtaaaaatccaaatgggttttggtggtggttttggttc

SEQ ID NO: 6789207 - DNA, 91 bp, Homo sapiens
ccacaatgctggatcttaggcttttgaggaggggatacctgctggtgttggcatctctgagagagtttgatgcacctggttctgatagtgg

SEQ ID NO: 6789208 - DNA, 67 bp, Homo sapiens
tggagagcagggctggagttcagacaaccacctgagtgttattcctgttactcagccctgttctcca

SEQ ID NO: 6789209 - DNA, 56 bp, Homo sapiens
ctcgttcctagcaaggctgctccatctgcatgggctcggcgctgctgggatctggg

SEQ ID NO: 6789210 - DNA, 78 bp, Homo sapiens
gcaagtcattctggtcctacaggtcactgagaggagtttggatttaagactgagtgagctggggagccggtggagggt

SEQ ID NO: 6789211 - DNA, 62 bp, Homo sapiens
gtgagcgctatgaggggtcagccacggggagggctacggggctgactgctggtagcgggtat

SEQ ID NO: 6789212 - DNA, 104 bp, Homo sapiens
agctggaggaccttgatgcagttttgaaggctgttctaggagagtgggaatggagggttccatcttatctcttagagctcctctgcccattcttcaatctggct

SEQ ID NO: 6789213 - DNA, 69 bp, Homo sapiens
cagctatgctcatttgtttatgtgttgtctatggctgctctcaagctgtaacacagagctgagtggttg

SEQ ID NO: 6789214 - DNA, 79 bp, Homo sapiens
ttggaccatctctaaggttcctgagatcaggaagagcacctgattcaattctggtcctcaggaactggcaaaggtctag

SEQ ID NO: 6789215 - DNA, 64 bp, Homo sapiens
tttgacctcagagagccatcaaaaatgtgctgcaaggaacaattctgtggttgtctgtggcaga

SEQ ID NO: 6789216 - DNA, 76 bp, Homo sapiens
gccacttttcagagtcaatgtccaagaagctaaagaaatttaactttgattttgtcattattcttggaggtgtggc

SEQ ID NO: 6789217 - DNA, 80 bp, Homo sapiens
atacaccatcttatctcgtttattcctttaagccacatcaaatcatttataggaataaagtggggtataaataagtgaat

SEQ ID NO: 6789218 - DNA, 59 bp, Homo sapiens
tttatttggtggtcaggcagccctgggttcaaatcctggctcgattgctaccaattaag

SEQ ID NO: 6789219 - DNA, 71 bp, Homo sapiens
ttttctgactatacattgaatgttaaggtaatcctacaatttatactttgaatttaagtgtatacagagag

SEQ ID NO: 6789220 - DNA, 59 bp, Homo sapiens
ggcttctggtaacttcctccctggccctataaaggccacaggaggaacaattagatgcc

SEQ ID NO: 6789221 - DNA, 94 bp, Homo sapiens
tggtcctgtcagttttcactaggttgggagtcagaagtctcaggcttttgagcaggcactgacaattctggactgctggatcttgactaggcca

SEQ ID NO: 6789222 - DNA, 56 bp, Homo sapiens
tgggaggagccctctgggaagggacatgatttccacttgccagggagctgctctca

SEQ ID NO: 6789223 - DNA, 57 bp, Homo sapiens
taacactgtaacagcatcattttctaatgtatggagagtttgttagtacagctgtta

SEQ ID NO: 6789224 - DNA, 84 bp, Homo sapiens
ggcctgaggtctgagatgccctgtggcagtacatatttgggtcctatccaggtggcagttacaggggcaaattatgtcatggcc

SEQ ID NO: 6789225 - DNA, 56 bp, Homo sapiens
aagaagataatgcaactaacattgcccaacagtgcaagattaggggctttcttctt

SEQ ID NO: 6789226 - DNA, 61 bp, Homo sapiens
gccgaggtcgggtggcccaggctgcagggctccagcggcttgctcacacccacctccctgc

SEQ ID NO: 6789227 - DNA, 90 bp, Homo sapiens
tttcaatatatttacaggtagaatgggtgtacagtgaatttctactgtgtacacacttatatacgatgaaatctgaaagatatagagaga

SEQ ID NO: 6789228 - DNA, 56 bp, Homo sapiens
acacaaacagtctatagcaccagaaaattctagttgttgctgttgagtgtgtgtgt

SEQ ID NO: 6789229 - DNA, 90 bp, Homo sapiens
ggagtttcactcttgttgccgaggctggagtgcagtggcgcaatctcggctcactgcagcctccgccttccaggttcaaagcgattctcc

SEQ ID NO: 6789230 - DNA, 69 bp, Homo sapiens
gtcccagaaacatattgctggtcccagatttaattgaaagggatagcaaattttaatttctaatgggac

SEQ ID NO: 6789231 - DNA, 88 bp, Homo sapiens
gcgagtgggggtcctgtggggaggccgcgcgcgtgggcgtccagggcggcggccccgtccaccgcgtcccacacgctccccgcggcgc

SEQ ID NO: 6789232 - DNA, 82 bp, Homo sapiens
attctgtgtactttagaatgtgactgtatttgaaggtaaggcctttaaagaggtagttaggtttaaatgaggtcataaggat

SEQ ID NO: 6789233 - DNA, 63 bp, Homo sapiens
aaggctttctcaggccctggaaacctccctagtctttgtctctttcctgggctgtttagcttt

SEQ ID NO: 6789234 - DNA, 64 bp, Homo sapiens
tcattttctgttctctgtgttagaactagacaatgttatgttctaataggagaaaagacagtga

SEQ ID NO: 6789235 - DNA, 78 bp, Homo sapiens
gagacgcccatctgggtctgaagataatgatgccatgaaatggaaatctaagttttaggccacagtcagggcagtctt

SEQ ID NO: 6789236 - DNA, 59 bp, Homo sapiens
gcccaaaatggccaaatccatgaggacttgagagaggcacgtgtgtggctattttgggt

SEQ ID NO: 6789237 - DNA, 106 bp, Homo sapiens
ctagaagaataaaatgtaatgaaaagtgtctcatttcttggttggaaaaacagagtattgatatatatcttcataacctagagatagcaaggtcgtatttctcaag

SEQ ID NO: 6789238 - DNA, 59 bp, Homo sapiens
tctgaatgagaacaacagcattgctcttttcgtagtgttgtaataaatatcatcttaga

SEQ ID NO: 6789239 - DNA, 97 bp, Homo sapiens
gtgaaatatatttttaaaagtgtcacagaaggagggaagctagtttgcaggctcacacattgggcttccatatttctggtgtcacaaataaagtcac

SEQ ID NO: 6789240 - DNA, 63 bp, Homo sapiens
agggtatcagtagataaacggattgcataaaactatgtgcaattatagctcttctgatatttt

SEQ ID NO: 6789241 - DNA, 67 bp, Homo sapiens
gggtgggtgtcacagcctccgtcttgctgaaaataggagcatggtcagtggagctgggccccactcc

SEQ ID NO: 6789242 - DNA, 82 bp, Homo sapiens
ttctacaggtaatttgtgtggtagcttcattgaacagtgctggtgctgttcactgaaactaccacacagatcacctgtagaa

SEQ ID NO: 6789243 - DNA, 63 bp, Homo sapiens
catcccagatcccagcctgcagaataaagataactaaactctgacaggttgggatatggaatg

SEQ ID NO: 6789244 - DNA, 60 bp, Homo sapiens
cagtaacaagtgccaacgttagattagatgagaaaattttcaatggaggcactattgctg

SEQ ID NO: 6789245 - DNA, 57 bp, Homo sapiens
gggggtgaaggccacggtctctcagcaagctcgtggtggggatgggccctcaccctc

SEQ ID NO: 6789246 - DNA, 79 bp, Homo sapiens
tcttgtcttcctgttgttgtgtgcatgttgtattcgccaccaataccgtcatatccatattacaagcagaaagatggga

SEQ ID NO: 6789247 - DNA, 126 bp, Homo sapiens
gggaaaaatcgaaaaacaaatgtaagtctaaatctccttacagagaagaaaatgtagtgtggcctggcctaatattacgacttttccaaggagttactatatatggtttaacagaagattatttcc

SEQ ID NO: 6789248 - DNA, 68 bp, Homo sapiens
ctgcaaatgactgcagtgtgatactcccttggttccatggagtgtcacttgatgcagggcatttgaag

SEQ ID NO: 6789249 - DNA, 62 bp, Homo sapiens
tgtgactctcaactgattgtattgtattttaatattccacttaatgttcagttgggatcaca

SEQ ID NO: 6789250 - DNA, 90 bp, Homo sapiens
cactgtaggcccattggctcaaagttctgctcttcatcatagatccagcctggtgatgagagaaccaggaccttcctatggggctaagtg

SEQ ID NO: 6789251 - DNA, 78 bp, Homo sapiens
ggaaaccggctggagaggatttagaaggactacagtgtgatggtatcttgcttccttttaattaccagctgagtgacc

SEQ ID NO: 6789252 - DNA, 59 bp, Homo sapiens
tgcctaggtcacacctcatacctactaagttgtgtgggaggcgtgggggtgaccaggca

SEQ ID NO: 6789253 - DNA, 85 bp, Homo sapiens
ggaacagggccatcaaagtggccctaggccaaggggaggtctctgcccccttccccagcccggggctacccttgggtcctgctcc

SEQ ID NO: 6789254 - DNA, 60 bp, Homo sapiens
ggctggagctcccgcagccattttggaccaagtcagggccttggaaatggaagctcagcc

SEQ ID NO: 6789255 - DNA, 79 bp, Homo sapiens
ctcttctggggaatgcacttccacactcgaggccaatgctgaaataggcatgcaaggggtgtgaagtgacctggaaggg

SEQ ID NO: 6789256 - DNA, 67 bp, Homo sapiens
cagggttagcccagaaagcaaatgtctctgatcagcagggcaaagggagcctctggagctgagtttg

SEQ ID NO: 6789257 - DNA, 64 bp, Homo sapiens
ctgtaggacattttagctacatatttctgtatcagaaataagttaaactagaatgatcttagag

SEQ ID NO: 6789258 - DNA, 65 bp, Homo sapiens
ctcattcagaagtcacttaggaaagggggcgacttagattttctctgcttagtgttttctatgag

SEQ ID NO: 6789259 - DNA, 68 bp, Homo sapiens
tcacctgaggctgggtggcggaggttgcagtgaactaagatggcaccactacactccagcctgggtga

SEQ ID NO: 6789260 - DNA, 62 bp, Homo sapiens
ggacattattttccctcagatcttatagtcctgtcttatggaactatggaggaaataagtcc

SEQ ID NO: 6789261 - DNA, 60 bp, Homo sapiens
gaaaggcttggttttgaatatatgaacagcaaccatatatattcagacaagggctctttt

SEQ ID NO: 6789262 - DNA, 101 bp, Homo sapiens
gtgattgttaaacacgatacgtgtgttggaggtccccgagatcctccccatggtggatttgctagggagactcgcaggactcaacatgtagttgttgtcac

SEQ ID NO: 6789263 - DNA, 85 bp, Homo sapiens
tctctgatttggtagctctcaggtagagcccaagaatgtgtttccaacaagttcccaggtcatgctgaagttgctaatacagaga

SEQ ID NO: 6789264 - DNA, 89 bp, Homo sapiens
gccttctgcgggtcgcgttgcagctgctgctgcctgtcctgcccgcgcgccgcctgctgcagcagctgttcggcgatcaagccggaggc

SEQ ID NO: 6789265 - DNA, 56 bp, Homo sapiens
tccttacagttaaaatgggagtgatgctagctgtcatgtatcccatggtgtgagga

SEQ ID NO: 6789266 - DNA, 89 bp, Homo sapiens
gctgactgagtgccaggtcctgaaagtgtactatgtcatgaacactctaaagtattctctgatcagtattactactgttcactcttagc

SEQ ID NO: 6789267 - DNA, 64 bp, Homo sapiens
actggagaggagaattaggcctcaaggactctcatatctgagctcttaacacttctttgccagt

SEQ ID NO: 6789268 - DNA, 66 bp, Homo sapiens
tcaatagcaatcaagccttccaagcatgggtgttttaatgctggctggaggctgaatgcagtctga

SEQ ID NO: 6789269 - DNA, 104 bp, Homo sapiens
cttttttgttatagtttaatgactatacggaatagccaaagtaagtcttttaaaattaagtttgcattgtaatatttagttcaaaagaaactagagcctaaagg

SEQ ID NO: 6789270 - DNA, 84 bp, Homo sapiens
ggccacggtgggtagctgttatctgttattgccagttcttcagtaaggaggagcacgaagtagatacagaattccacagttgtc

SEQ ID NO: 6789271 - DNA, 77 bp, Homo sapiens
aacaacagcacaaatacctcaaagtaatgatgtgattaagtcactctgaatggtactgaggataagtgttgtgagtt

SEQ ID NO: 6789272 - DNA, 72 bp, Homo sapiens
taagcctctgactaacgtaactcttaagttttgctcagcaattgcattgagagtgacttggacaattaatta

SEQ ID NO: 6789273 - DNA, 64 bp, Homo sapiens
gagggacaggatgggtctctttcccttcctcttctctaaagaagagacctttctcctgcctttc

SEQ ID NO: 6789274 - DNA, 61 bp, Homo sapiens
tttattgttgggtcttaagctgagtttacacacttggtgtcagaatgattccggcaatgaa

SEQ ID NO: 6789275 - DNA, 75 bp, Homo sapiens
agggatgtgttgaaagagaacacacatgtaaaatgcttaatttgtaacattgtaaatacctttatcaccatccct

SEQ ID NO: 6789276 - DNA, 97 bp, Homo sapiens
gatgagggagctgaggttcagagagtcctggtcatttgcccaatatcataggactagcagatgtcaggctgtttttccttctggagtctcccttatt

SEQ ID NO: 6789277 - DNA, 98 bp, Homo sapiens
gttgggtaggatttgcttctctgtgccctctactgtctcagattctatgtatctgccagatggcaggggtacctggaagccagtagcccttacctggc

SEQ ID NO: 6789278 - DNA, 62 bp, Homo sapiens
tgaagctatataagttacagcatgtgttgagattcagacttgctagtaggttgtgtagttca

SEQ ID NO: 6789279 - DNA, 74 bp, Homo sapiens
ggaaaaatcccaaggctgtaaaaagatttatgctaattaggcactgaatttattagtatagtctctgtttttcc

SEQ ID NO: 6789280 - DNA, 70 bp, Homo sapiens
gtcaggatgatgagtagagtgtgaatataagattagttctaggagtcacctgtgttcatttcttcctgat

SEQ ID NO: 6789281 - DNA, 65 bp, Homo sapiens
aaaggtggtgagtacagttaggtgtggcaattaatgagccaccatctgctgaaacatcacacttt

SEQ ID NO: 6789282 - DNA, 81 bp, Homo sapiens
gaggagagggtggcattaagttttcatactgaatgataaacctatctcatttaaataacaaactgaatgaaatcccttctt

SEQ ID NO: 6789283 - DNA, 72 bp, Homo sapiens
aaaagctaaggtagcattggagacctcctaagaattttattaggtggatctcatgatgattattttactttt

SEQ ID NO: 6789284 - DNA, 57 bp, Homo sapiens
atatttataaggcaggcaagtaaaacacaaaaacgacttgcttgctcttaaaaatgt

SEQ ID NO: 6789285 - DNA, 60 bp, Homo sapiens
tccccacctaagatacccatctcccattcctcgggccagagggaagagcttagatgggga

SEQ ID NO: 6789286 - DNA, 84 bp, Homo sapiens
cactatggagctgttcattggcaaggaaattagttctcctgccgtaaccagcaaggaactgaagctcttgctaacagctatgtg

SEQ ID NO: 6789287 - DNA, 74 bp, Homo sapiens
gataagccaggtcacagggttgaagtacttcttaactctaaagggaagtttaaaactttgggacattgattatt

SEQ ID NO: 6789288 - DNA, 69 bp, Homo sapiens
ctgaggggaatggtgaggagtgcattgagagggtcaccttcagttttgcttttaatcatgaactaacag

SEQ ID NO: 6789289 - DNA, 55 bp, Homo sapiens
cattcaggtacactcagtgctaggggacctccctccccagtctgggacctgcgtg

SEQ ID NO: 6789290 - DNA, 62 bp, Homo sapiens
tgaaggtccagcgtggccaagtcttcctgatctttcaggggcaaaggaaatctggattttta

SEQ ID NO: 6789291 - DNA, 112 bp, Homo sapiens
gtgaggggtgggggacagggagagaagagacagggagggcaggcagggcagggacaggcccctgcctcagtctaaagtctctcactctttttcctgtggccgccctcttcac

SEQ ID NO: 6789292 - DNA, 67 bp, Homo sapiens
gatggcatgatggcttggggtgctgtgtgggcttatttagcatttgttcttcaggccaatgctcatt

SEQ ID NO: 6789293 - DNA, 76 bp, Homo sapiens
aggcaaataagtaaatagttctgtcaatctcaggggaccctagggtgtgattatattgtagtacattatagtgtct

SEQ ID NO: 6789294 - DNA, 116 bp, Homo sapiens
cattttctgccatactataataaggcagtataggtcgtatgtctttctagtatctgccacatagtagatgctctagacatactggctatgtccagtcttcatggtattagatagtg

SEQ ID NO: 6789295 - DNA, 72 bp, Homo sapiens
gatgcaggtttaatggagatatttcagaacctggatggcagcttttgaaattaagatattgtccattgcatc

SEQ ID NO: 6789296 - DNA, 62 bp, Homo sapiens
gtcctgttgtgagctgccttccctaacccctctgctaaagaacacagctgcaggctcaggac

SEQ ID NO: 6789297 - DNA, 70 bp, Homo sapiens
gcctgccttcttgtctcaaaaccattatttatagccatagaatgacagagatagaagggatgtcacaggt

SEQ ID NO: 6789298 - DNA, 55 bp, Homo sapiens
acctagaactgcaggctatttttgctggtttcaaaagtgacctgtagctccaggt

SEQ ID NO: 6789299 - DNA, 60 bp, Homo sapiens
gtttgaggctgcctgggccctgaccaacatcgcttcagggacttcggagcagactcgtgc

SEQ ID NO: 6789300 - DNA, 57 bp, Homo sapiens
ggaaagtgctctgtgaactctgattgctaaatgcaggtgggtacatcacagagaccc

SEQ ID NO: 6789301 - DNA, 94 bp, Homo sapiens
taatcagcacgtgacgagcacagaaaaaaattcacagtgaatatttgctgagtaaacacgtggggtttctttccatgcttttcaaggctgattg

SEQ ID NO: 6789302 - DNA, 63 bp, Homo sapiens
ttgaaatctcaaagatggccagaagagacgagtctgctgtctatagcatctatgagaaatcaa

SEQ ID NO: 6789303 - DNA, 57 bp, Homo sapiens
tgatgtaggacattattatttcaaatgtgcatcacttttatgataatgtttgcatca

SEQ ID NO: 6789304 - DNA, 56 bp, Homo sapiens
gttacataggtgtgttcagtttgtgaaaattaattaagctgcatatttatgtgtac

SEQ ID NO: 6789305 - DNA, 73 bp, Homo sapiens
ctttgatctactcactaaacaattcatcctctatagaactgagggtgcaaaggtggttggtagtgggttaaag

SEQ ID NO: 6789306 - DNA, 79 bp, Homo sapiens
gcaccaccacacccagccatgttcagttctctagagtatatacctagaaatggaattgctgggtcatatggtgaactgt

SEQ ID NO: 6789307 - DNA, 63 bp, Homo sapiens
gcaatctgtttagttctgcgtatgcttcaattcaatttcatggcaatttcataaacaggttgc

SEQ ID NO: 6789308 - DNA, 57 bp, Homo sapiens
gacctggtttcaggaacataatctatttgtcataatttgagtttctgaaaccatgtc

SEQ ID NO: 6789309 - DNA, 129 bp, Homo sapiens
taggtgtgttaggacattttttccctcttcttgccacttatttggattcttatttagcactgtgtattaatcagtgttctccagagaaaccgaaccagtaagaggagaaagagagagacagacacagaa

SEQ ID NO: 6789310 - DNA, 71 bp, Homo sapiens
aatatagttctggtattgttaaccttaaattccttctggcagtaattagatagcaaagccagatgtatatt

SEQ ID NO: 6789311 - DNA, 61 bp, Homo sapiens
gaagtggagccaggagcctgggagtcacctgctgcctccctgtttcctgctccaaccagtc

SEQ ID NO: 6789312 - DNA, 94 bp, Homo sapiens
gaattgctgaattgattgtggcctgtgtggcttcctgggagatggcccaggctagctggttgggatgctcacagctgtggtcattcaccaattt

SEQ ID NO: 6789313 - DNA, 57 bp, Homo sapiens
ggtcctgctggctcagctgagcttgtgcagagaaagggctgggtcatgcagctggcc

SEQ ID NO: 6789314 - DNA, 58 bp, Homo sapiens
tcagaggcttctgctcacctcacactttcttgatacttctgagcagaggctcaactgg

SEQ ID NO: 6789315 - DNA, 101 bp, Homo sapiens
catgttggtcaggctggtctcgaactcctgaccttgtgatccacctgttttggcctcccaaagtgctgggattacaggcgtgagccagcctgacccatatg

SEQ ID NO: 6789316 - DNA, 76 bp, Homo sapiens
ccagttgagaaacacagtcttatcccaaccaccactgtagtagtgggttgttggttatgtgattgttcttttctgg

SEQ ID NO: 6789317 - DNA, 57 bp, Homo sapiens
atggccaccatttaatgaagctcactttgtgcccaaagccatcctgaatggtgccat

SEQ ID NO: 6789318 - DNA, 69 bp, Homo sapiens
ccaaacaaaagggcagatgaaaagcagtgtaatccgtgggaaagcatgtgtcatctgcctttcgttagg

SEQ ID NO: 6789319 - DNA, 83 bp, Homo sapiens
cattcccaaggctgttctctgtaacatgcatttttccccctttttctttaaatgctgtggcgttacggcgaacaccttttgtg

SEQ ID NO: 6789320 - DNA, 74 bp, Homo sapiens
agaaatgtacacagagcatttctatgtctcgagccaactggaagggaaggcctagggatgctctgcgtgcctct

SEQ ID NO: 6789321 - DNA, 56 bp, Homo sapiens
agtgttcaatttgagctcaaaggcatctgcaagtaattgaggagatattgaatact

SEQ ID NO: 6789322 - DNA, 70 bp, Homo sapiens
tctttcggcatttgtatagagattggtgctgtcccccattagcagccagagatgtgaaaatgccggagga

SEQ ID NO: 6789323 - DNA, 55 bp, Homo sapiens
gccccagcgtggctgtgttaggagtcctttgcccaacattgtgctgcactggagc

SEQ ID NO: 6789324 - DNA, 79 bp, Homo sapiens
ttgagccaggaatatagagcaaaagatagttggagcagtgctaaagctatctgcatgttttgctagaattatggttgaa

SEQ ID NO: 6789325 - DNA, 58 bp, Homo sapiens
tccgactgtcttgtttctaagatgagggagactttatttgaaccttgcaaggagcgga

SEQ ID NO: 6789326 - DNA, 72 bp, Homo sapiens
gttctgaattcagtctgtgagatgtcctttggagattaaattatctttgaaattcttcagctgaagcagcac

SEQ ID NO: 6789327 - DNA, 79 bp, Homo sapiens
tatgctggctactggagtattgtttaataccagagtgctttattgcctctggtggagaatagttcagtactaaagtgta

SEQ ID NO: 6789328 - DNA, 56 bp, Homo sapiens
gctctctttttccagtggtggtctacagggttgctacatttttggaagactagagc

SEQ ID NO: 6789329 - DNA, 67 bp, Homo sapiens
atccggaatggagctatgaagtcagggccgattaaatacggaattgactgcgtttgcttcctaggat

SEQ ID NO: 6789330 - DNA, 70 bp, Homo sapiens
cagtatgcagtggtatcattttaaagacatagattttgtatttaacatggaaatacttgactgtttactg

SEQ ID NO: 6789331 - DNA, 114 bp, Homo sapiens
gttcttggcacctttgttgataatgaattcatttgcttttacactgttggtgggactataaactagttcaaccattgtgtaagacagtgtggtgattcctcaaggatgtagaac

SEQ ID NO: 6789332 - DNA, 96 bp, Homo sapiens
aaatacacattaagtagcaggtattctggtgtgaggggtacaattctagacagtttcactccagaacctgtgctctttatgttggtttttgtattt

SEQ ID NO: 6789333 - DNA, 77 bp, Homo sapiens
gtgggaatcgtttcctaccagtggttccagatctcaaaaatgcaattggttgtggaattatttaggaccattcccac

SEQ ID NO: 6789334 - DNA, 74 bp, Homo sapiens
gaggatggtttgacatgtattagtcatgcacagaatattatcataattaatgcattaataatacagctgtcctt

SEQ ID NO: 6789335 - DNA, 70 bp, Homo sapiens
cgggcgtgttcagcaagaatgtttctattttgctctatgtcatgataaattacgcttgctggctgcatcg

SEQ ID NO: 6789336 - DNA, 85 bp, Homo sapiens
ggctctgagcttgcttgcggcagcctgtgtattaatttaacttcgtttttataggccttttgcatgcaatgttaaacacacagcc

SEQ ID NO: 6789337 - DNA, 68 bp, Homo sapiens
actggagatagcggaacaagaagttgtggggtgcctgggtggtccccctgcatctgtccctcaccagt

SEQ ID NO: 6789338 - DNA, 93 bp, Homo sapiens
gaaaatctggcagattgttttcagatcctggctcggctactcactaacatgtagtcttggcaaatttttgaggctctttttgcctgggttttc

SEQ ID NO: 6789339 - DNA, 108 bp, Homo sapiens
aataagaaacgcctgtgaaattatcttagtaccaacctaaaaacaacatatatcacatcaggtgattcactcatattttacgtttacttttcacattcaatttctatt

SEQ ID NO: 6789340 - DNA, 56 bp, Homo sapiens
tgacccctgacacaggctacacagacatgggattgtggccagaagttaagtggtta

SEQ ID NO: 6789341 - DNA, 55 bp, Homo sapiens
tgacacagttgtcgactctacagaagagtctttagagcttcagcgaatgtgctca

SEQ ID NO: 6789342 - DNA, 57 bp, Homo sapiens
ttttcagcaaacactgagttcttgtcttgtaccaggctctgtgctaattgctgaaaa

SEQ ID NO: 6789343 - DNA, 90 bp, Homo sapiens
tctactcctgcagaacaaaacatattcagatgccaagtccagcaatggctgggaaggaggtggcttgaagtgagtctcttgggagtaaga

SEQ ID NO: 6789344 - DNA, 74 bp, Homo sapiens
tgcaattagtttttacactgttaatgacaggttcccataaaatgccttgcattgaaatatggaaactgatggca

SEQ ID NO: 6789345 - DNA, 92 bp, Homo sapiens
atgatgaaaagtattaatgtcaatatcaggcagacctaaggctacacttcctacagctgtactagtgttggcaatttatttacctttctcat

SEQ ID NO: 6789346 - DNA, 64 bp, Homo sapiens
ggagtggccaaggtgcagagcagctgtgaaaaccggaacagccttcgttcctgcgggctcgcct

SEQ ID NO: 6789347 - DNA, 67 bp, Homo sapiens
gcacttttcaaatgggaaactcagaaactgagacctcccttcagaacctgtccatatttgaaaatgc

SEQ ID NO: 6789348 - DNA, 100 bp, Homo sapiens
ggagagagtgttggtccccgatatccacatgtggctgagtcttgaagatcaaagtctctgactcctatgccccatgggcctcagggaaacactactgccc

SEQ ID NO: 6789349 - DNA, 58 bp, Homo sapiens
gaagggaatgaggctatataaacaaagtgatgttgatttgtaaatggctttttccttc

SEQ ID NO: 6789350 - DNA, 62 bp, Homo sapiens
tgtcgactctctggtcagaatttgctccggactctcttatggcagaatcaggtcaggtgaca

SEQ ID NO: 6789351 - DNA, 69 bp, Homo sapiens
ttgttgatcactgtacagagaccgtagatctgagtaactgagagatacatctttgtctatgaccagcag

SEQ ID NO: 6789352 - DNA, 108 bp, Homo sapiens
caggcccatttccattcactaagaaatgctctttaagactaaattagagtttggtaaattactagacaatgaatagatttgagaagctcttctggaaatgcagggctg

SEQ ID NO: 6789353 - DNA, 64 bp, Homo sapiens
gccttccagcagcgtgggagaagtatttgccatggcaactattgcatcatcctgcaggggtggc

SEQ ID NO: 6789354 - DNA, 63 bp, Homo sapiens
tgggctaggtaaactgaattggatactgtgtgaactcattcatacatcagttttcttggctca

SEQ ID NO: 6789355 - DNA, 56 bp, Homo sapiens
gaggcataaatcacagtgttcagattaaagttctgcctgtcatttggaaatgcctc

SEQ ID NO: 6789356 - DNA, 114 bp, Homo sapiens
tcatgagcaattacattcacatttctctgaaatatatacaggaattgaattgtttaaacaaataatttatggtatgtgtgtaatagtggatatgtattgatgggtgtgtactga

SEQ ID NO: 6789357 - DNA, 68 bp, Homo sapiens
tggaaaacttttctgtgttgtccgggatccaacataggacatatcagcattctggacagcagaaacca

SEQ ID NO: 6789358 - DNA, 60 bp, Homo sapiens
gaaaggcctgagggggttagactgacctttgtctgtcctgtagctccatcagtctcactc

SEQ ID NO: 6789359 - DNA, 71 bp, Homo sapiens
atgcattggagtggaatgtgtctaccatgccagtaaatgatccctggttgttttatttcacttttgggcat

SEQ ID NO: 6789360 - DNA, 84 bp, Homo sapiens
agccaggcgcggctggaccacgacgtggcggccgccgtgagcggtgtctaccgccgtgcaggccgcgacgtggccgccctggct

SEQ ID NO: 6789361 - DNA, 70 bp, Homo sapiens
tggggttggtggggaggaagctctcagttccaagtctttacttggcacagaccttatcttctctgcccca

SEQ ID NO: 6789362 - DNA, 107 bp, Homo sapiens
gagaacatgtttgggttacataagcctccttgatgttggtgggttcaggtgggacatttgaaatgcctatgaagtcaggagggaattgaatatcctgatttgttttt

SEQ ID NO: 6789363 - DNA, 128 bp, Homo sapiens
ggaggagaaaaaaacagcctaaagattcttctcttaattctgacaacagtggcgtttgagcaaggcagcgccatgggtcagattgggcagaacatcccaggctccttttccctgtatttgtcttttcc

SEQ ID NO: 6789364 - DNA, 75 bp, Homo sapiens
gtcttgatctcctcaccttgtgatcctcttgccttggcctcccaaagtgctgggattacaggcctgagtcaagat

SEQ ID NO: 6789365 - DNA, 75 bp, Homo sapiens
gccctagaagtacacatcgttggccccgaaggagccccagcagccatgtcggaccgcgaggtgaccttggagggc

SEQ ID NO: 6789366 - DNA, 88 bp, Homo sapiens
gcagtttacaaagcattctcttctgttgcttcatttgattctcccatccaccttgtgtgtatgaggggagaatgttttcatactttgc

SEQ ID NO: 6789367 - DNA, 56 bp, Homo sapiens
gcattcatctagtatcactctgcaccaggtagaaaggatattgagatgaattcagc

SEQ ID NO: 6789368 - DNA, 56 bp, Homo sapiens
ctgatccagtagcctggggtggggcacaggatgtcctgctgctggggtctgggcag

SEQ ID NO: 6789369 - DNA, 61 bp, Homo sapiens
ctccccctggcagctgtttggcttggcgggggcccatctggcaggctcagcagccaaggag

SEQ ID NO: 6789370 - DNA, 64 bp, Homo sapiens
gctgttaggtgccctgaccttgtccacataaagatgtgatttatgaagtgcagggcacagcagc

SEQ ID NO: 6789371 - DNA, 72 bp, Homo sapiens
gaggaggggcacagcgataatgcggtgcacacctcgggggtgtcacctgttccagttgcggtcccaggcctc

SEQ ID NO: 6789372 - DNA, 56 bp, Homo sapiens
agttttatctgtaagctgttcagggccctgcttggccttgccttttggatggaact

SEQ ID NO: 6789373 - DNA, 63 bp, Homo sapiens
gaactatggatgttctagggatgtgatgatggaaaatattacaaatgcccatacatctagttc

SEQ ID NO: 6789374 - DNA, 56 bp, Homo sapiens
taatgggccacagaaccattaaaaagctcacttttgaaggttactgaaatccatta

SEQ ID NO: 6789375 - DNA, 55 bp, Homo sapiens
agagcctgaaatacaggtcactgagtagcctttctgtggcctacatttaggtttt

SEQ ID NO: 6789376 - DNA, 55 bp, Homo sapiens
ctttgccagagaggctggcacatgtctgaagactggttggctccctctgggaagg

SEQ ID NO: 6789377 - DNA, 59 bp, Homo sapiens
ccaaagtccacagtttacattactgttcactcttagtggtgtacattctatgggtttgg

SEQ ID NO: 6789378 - DNA, 65 bp, Homo sapiens
agttctgttgtctagggaagccaggctaagacatggttcaatgggtgtccttagaaagcagacct

SEQ ID NO: 6789379 - DNA, 77 bp, Homo sapiens
gataaatgaaatactgtaaagttattattatttttcagctgagcagagtaatcattttacagtgttagaaacttgtc

SEQ ID NO: 6789380 - DNA, 129 bp, Homo sapiens
aatccagtgaaatgttccggatgttttggatgagggaattctatttcatacaggtcacactcccttaccaacctcaggcctggctgaaggaagattcttctaatccaaaacatcctgcaattttaattt

SEQ ID NO: 6789381 - DNA, 74 bp, Homo sapiens
aataaggcgtgtatagtgcctatagtgcctgacacaatgtgtagcacaagatagatacttcctacatgatagtt

SEQ ID NO: 6789382 - DNA, 79 bp, Homo sapiens
tgagagagtttgttgcccttaggattccagataaatgacagcgttgtatttatattagaatggttgcttaactttctca

SEQ ID NO: 6789383 - DNA, 55 bp, Homo sapiens
gtagctgggatttgaacccaggcagccgactctgggttaatttattgccagctgc

SEQ ID NO: 6789384 - DNA, 63 bp, Homo sapiens
agtcgtggcgtggaggtttctgggaaacgtagtcttaaatccgaatggctcgcgcgccacact

SEQ ID NO: 6789385 - DNA, 72 bp, Homo sapiens
gtgcttaaaaactaagtgctctaacagtcaaaaaaggttagctattactttgggcattagtaagttaagcat

SEQ ID NO: 6789386 - DNA, 57 bp, Homo sapiens
gggcttgtttgtgcctctgcagaaccaatccagttttacaggaacaaaaacaaaccc

SEQ ID NO: 6789387 - DNA, 77 bp, Homo sapiens
aggtaatgtttagaggaacctcctgaaaagtataccctctttgggtgctggagaaagtttttctgaactcatttcct

SEQ ID NO: 6789388 - DNA, 55 bp, Homo sapiens
tgagcacactcctggtgagcgaggcagaaaagctcctttccaggagctgtgttca

SEQ ID NO: 6789389 - DNA, 130 bp, Homo sapiens
caggggacactgcttctccaggggacatggcttctccaggggacacggcttctccaggggacatggcttctccaggggacactgtttctccaggggacactgtttctccaggggatggcagcttctccag

SEQ ID NO: 6789390 - DNA, 100 bp, Homo sapiens
tcccaaatcagtgactctcccccctaatcagtggcaactcactgactaggtgaggagttatttgcaggaggggcagaggtaagacactgatgactaagga

SEQ ID NO: 6789391 - DNA, 80 bp, Homo sapiens
gttttgccaagccctgtgctgtattagtgtttcagtaaaaggctgctaaaatatgtaagattagcactagattggggagc

SEQ ID NO: 6789392 - DNA, 55 bp, Homo sapiens
ctccagaattgtccattggaaacacgagttcaagtgcctcagggagattcaggag

SEQ ID NO: 6789393 - DNA, 79 bp, Homo sapiens
aggaagtcagtgacagagacaaaaatcagattttaggcctcataaaactgtgcatttcatgtcttttcctggtctttct

SEQ ID NO: 6789394 - DNA, 61 bp, Homo sapiens
cttctgcatgaggaggctacaatcctttcatttgaagatcctgtactttcctcacttgaag

SEQ ID NO: 6789395 - DNA, 62 bp, Homo sapiens
agtattcttgagtggcaactaggtggtgggccaacaaccctagaatgtacttaatagatgct

SEQ ID NO: 6789396 - DNA, 58 bp, Homo sapiens
ggtgttctgggatgattgtagtgttctctgaaaagagtatcattgtttccagaagacc

SEQ ID NO: 6789397 - DNA, 97 bp, Homo sapiens
gctaattaagcataaatggaataattttgatcagaagggagcagtgttttttgttgtttcctttttaattaatctaattatgagatgcttactgggc

SEQ ID NO: 6789398 - DNA, 130 bp, Homo sapiens
tttgccactctgctaagcatttgtgtttgctaattcttaatcccataaagtgaggataattgttttcttcagttttaaggtttgagaattgaagtaaagatatattaaaccttagccagtaagtggcaga

SEQ ID NO: 6789399 - DNA, 83 bp, Homo sapiens
gagctgggaagagctggccatggcctgcgccatccctggatttccacactggtggctgcaccctggctaactctttagggctc

SEQ ID NO: 6789400 - DNA, 82 bp, Homo sapiens
gagttggcaaaaattaataataatgagcccattttgagtacactgaaatgaactgattatcattgcaagctgttgctaattt

SEQ ID NO: 6789401 - DNA, 61 bp, Homo sapiens
cataacttggtgttggaaactgacctaagccaatttgcttatacacagcatccaagttatg

SEQ ID NO: 6789402 - DNA, 97 bp, Homo sapiens
cctgtgttctcagctgcagggggattccctcctcctccagagagtgttgtgcagagcacatgagatggtggggatccctggagcattttagaaatgg

SEQ ID NO: 6789403 - DNA, 86 bp, Homo sapiens
atttcttgcagtcctctcagcatatttctgatcacagtcccaaatgacattgagaagccctgataggaaaatgctgtgtaagaaat

SEQ ID NO: 6789404 - DNA, 62 bp, Homo sapiens
gttttatagttcgggacctgttcctctagcccaccaagcttcagttcccctaactgtgaaat

SEQ ID NO: 6789405 - DNA, 88 bp, Homo sapiens
ggggaagtgagttaagtggatttagataatgctttttgttctggctgaaagtattctccctgaattttcttccttgaatcccttctcc

SEQ ID NO: 6789406 - DNA, 69 bp, Homo sapiens
gactagctacagaagccgtggtcaggaaatatctgttgaattcatgaataccccttctgtaatgttgtc

SEQ ID NO: 6789407 - DNA, 62 bp, Homo sapiens
ggtcccaagtgcttttcctgcaggtgctcctgatctttgcatggaatcgaggcatttgggcc

SEQ ID NO: 6789408 - DNA, 87 bp, Homo sapiens
gtattccgggttgggtcagagaaagtggtagtagatttaattctatttctttatctcctttgtctaggctccaaacacttttagtac

SEQ ID NO: 6789409 - DNA, 55 bp, Homo sapiens
tgtgaaggctaattaaacaagttcgcttttgaaatatgacctcttagcctttaca

SEQ ID NO: 6789410 - DNA, 103 bp, Homo sapiens
gcggttctcacagactctcctgcaaagcctctgatttcacttgtactggctacagcatgagcttggtccagcaggcttcatgacagggatttgtgtgggtggc

SEQ ID NO: 6789411 - DNA, 61 bp, Homo sapiens
aagtacagattcctagtgagatattggatctactgacttgaaatctttagggatgtggctt

SEQ ID NO: 6789412 - DNA, 87 bp, Homo sapiens
aggataacaggtgtatagtcactgttttctcagagctggtcacatgaaaggagaaagcagtgatgcatacagctgtatttatatcct

SEQ ID NO: 6789413 - DNA, 59 bp, Homo sapiens
agaggccctgggctggtgtgcttcaggggacaaagaagtgggccacatcccagggctct

SEQ ID NO: 6789414 - DNA, 55 bp, Homo sapiens
tgagattgctctgatggttcaaggtgctattgagctctaaccagggacaattaca

SEQ ID NO: 6789415 - DNA, 76 bp, Homo sapiens
ccatccagctggtccacagcctgtggaattccgtcactctccaggctgccttccaggctgatgggccacagggtgg

SEQ ID NO: 6789416 - DNA, 95 bp, Homo sapiens
agatgctgctttaagttgttttgagatgtggttcaagggtgtttgttgatcaaacaccaagagctagctattaccaagaataataactagcattt

SEQ ID NO: 6789417 - DNA, 82 bp, Homo sapiens
ctgacagttctcaacagccagtcccatcctcctaaagatctccagaatcagccacatggacctgatgctagaggcctgtcag

SEQ ID NO: 6789418 - DNA, 59 bp, Homo sapiens
atagggcagcaagcccaagttaggggcttttcttcacccactgggcatacctgtcctgt

SEQ ID NO: 6789419 - DNA, 82 bp, Homo sapiens
caagctataattgagaaactgtcaagagattcaaattcatggaaaaccatgaaagaataatgtttgcatgtttcagagcttg

SEQ ID NO: 6789420 - DNA, 79 bp, Homo sapiens
ttgctttctttcatgaacagacaaggaacttctgattttctgcccatagaccgttcgcttggctttcttggaaaagcaa

SEQ ID NO: 6789421 - DNA, 57 bp, Homo sapiens
ccgcgtctcggggatgcagagtgggctcttcggcgcgccctgcagccatgggagtgg

SEQ ID NO: 6789422 - DNA, 87 bp, Homo sapiens
ttttcattttatttctagatggtcaattttgtctatggtgaactcattatctcatagtagaaggcatatttggaaaaaatgtgaaaa

SEQ ID NO: 6789423 - DNA, 63 bp, Homo sapiens
gcctccttccacagctcacactggtctgccccttctcatgccagtgattgcctggaaggaggt

SEQ ID NO: 6789424 - DNA, 61 bp, Homo sapiens
atttggacatatgaaagtagcctttgcttcttctacctgtggttgctttctagcttcagat

SEQ ID NO: 6789425 - DNA, 77 bp, Homo sapiens
tctttcttctggaacaagtggccttgcaagacacttcactccctgttttggcaaacacacttgttctgtgagagcga

SEQ ID NO: 6789426 - DNA, 63 bp, Homo sapiens
aaggctcatctctggatagcaagcaaaaaatttgatctttcagctgtcacagagtatggtctt

SEQ ID NO: 6789427 - DNA, 57 bp, Homo sapiens
ggtttgctgaaacacagattgctgggccaacccttgaaaattctgtttcagcagatc

SEQ ID NO: 6789428 - DNA, 77 bp, Homo sapiens
ggcatggccctgttctgtacctcataaaccacccccaaaaccacatgtagtagtaggttcacagcgggccgatgacc

SEQ ID NO: 6789429 - DNA, 77 bp, Homo sapiens
ctctttgctcaagatccagaaataggagtactttatgggaaaaatctctctcctgttgtcatggaataagttaagag

SEQ ID NO: 6789430 - DNA, 110 bp, Homo sapiens
ttcagttaagaaagcgtatactgtaaactctttattggagaacagacttaaaaatacatagcaattatttttccggagtccctccacaaaagggtagtttctgaactgaa

SEQ ID NO: 6789431 - DNA, 61 bp, Homo sapiens
ggcagcaactcattattcctgtaaatttccaggtaaagaaatcaatggctgggttgttgcc

SEQ ID NO: 6789432 - DNA, 73 bp, Homo sapiens
gatgaggctctgtgggtgagtagaatctttgctacttgtagatggattttgtttctctctcacaagacctttc

SEQ ID NO: 6789433 - DNA, 64 bp, Homo sapiens
tgggctgttctttggcttcctttccgtcttatgtttgatgtggatcacacaaggagctggtcta

SEQ ID NO: 6789434 - DNA, 83 bp, Homo sapiens
tttcctggctttgaggatcccctcttaaactagaaaaggcccttgaagtctccagagaaggggggatataaggctactggaaa

SEQ ID NO: 6789435 - DNA, 109 bp, Homo sapiens
caaggagcaagcacggaaggggaaggccagcctgtagagcttgcagccgtctctcctgcttcgccacagcaccgctgccagtccccttcttgggtggggaagctccttg

SEQ ID NO: 6789436 - DNA, 110 bp, Homo sapiens
atgggtgtcaccaatgggttatcaatttcagatgtcataaatataaagggtttcacatacctctagtatatttagtgtatcatgaaaattagatgcctctggtaccccat

SEQ ID NO: 6789437 - DNA, 78 bp, Homo sapiens
ctcaaccgttccttgtatttcagacatgatctttttggctcattacctgaaaaacaagagagaaattaacagtttgag

SEQ ID NO: 6789438 - DNA, 60 bp, Homo sapiens
atgagagaaaggaagtgcatttaagcatctatgctctaagttgtattcccttgcttttat

SEQ ID NO: 6789439 - DNA, 72 bp, Homo sapiens
ctgttctttagttccactgcaatggctggccaatcgtccccctcctccttgtagctgaaagtaaagaagtag

SEQ ID NO: 6789440 - DNA, 94 bp, Homo sapiens
tctgctgactttttgctgaggtgctactttcaaggttttaaaattcagtaaatccttgatagtttgccctaatttggagagaaggtcaatcaga

SEQ ID NO: 6789441 - DNA, 64 bp, Homo sapiens
agctaacatggaggaaaaagttactaagatgaaaaaaattaggaacaaacctcagatgttggtt

SEQ ID NO: 6789442 - DNA, 62 bp, Homo sapiens
gttggcccctgagcttcattctgtgtgatccatacacagcagagacactcaggaggcaatgc

SEQ ID NO: 6789443 - DNA, 121 bp, Homo sapiens
atggacaccagatggcggaagaggctgcagaggtgctgccagagacaaggctagggtccacccctctggctgctacctttgaaaaggctatggcttcttccttagaaaaggggcatcacat

SEQ ID NO: 6789444 - DNA, 68 bp, Homo sapiens
tgggtcttgacttccagccttcaaatctgaatagcatatcagaaaagaagtttgggattcagtttcca

SEQ ID NO: 6789445 - DNA, 82 bp, Homo sapiens
gaggagattgactacaaagaaacatatgagaacttttgggggtaatggaaatgttctatatcattattgtgacagtttcttc

SEQ ID NO: 6789446 - DNA, 64 bp, Homo sapiens
tcctagtgtggggtcaccggcccagggggttgctatcctaggtttttcctgacctcaaccaggg

SEQ ID NO: 6789447 - DNA, 56 bp, Homo sapiens
gatgaggcagctgctggagaacgtcaaagggtgggggcgtggcaagcatgttcatc

SEQ ID NO: 6789448 - DNA, 65 bp, Homo sapiens
ggaaggctcgaggatgcttctggtttttcatcttccagtctccagcagccttccttttgcttttc

SEQ ID NO: 6789449 - DNA, 72 bp, Homo sapiens
caaatcttcacattcttccctgacttcttaggcagcaaatgtcaaagaaacgaagtgatgtgagaggaggtg

SEQ ID NO: 6789450 - DNA, 60 bp, Homo sapiens
tttagtaggcactaggaggggaattctctcacaccagtggccctcctaggggcccctaga

SEQ ID NO: 6789451 - DNA, 85 bp, Homo sapiens
tagagactgctggtgcacagtacctgctctcaagcaaacgcctctcttggctttactgagcatgtactatgtgccaggggcttta

SEQ ID NO: 6789452 - DNA, 73 bp, Homo sapiens
ggcagatcagcttggtctcgggagctatttctacacaaatcacgtggggctcagaaggccatgctctgctgct

SEQ ID NO: 6789453 - DNA, 60 bp, Homo sapiens
gcccaagatcacattaataatgaatctagtatttatacacaagaaatgtgattctagggc

SEQ ID NO: 6789454 - DNA, 78 bp, Homo sapiens
gacccccttcattcccttcatttacactgttgttctagaacctgggatgacactctgcagggtgaatggagactggtc

SEQ ID NO: 6789455 - DNA, 58 bp, Homo sapiens
gagtcccacctccagagatggccttccctaccacatccatccatgagagtctggattc

SEQ ID NO: 6789456 - DNA, 68 bp, Homo sapiens
gagtgagaattgttgtcctgtccttgaagcaaatcaccttcaagtattacagtgtaatattcacattc

SEQ ID NO: 6789457 - DNA, 81 bp, Homo sapiens
tgactctgagaggaggaggagaaggtttcagagaagggtagttgaatggctggcctggactttcatttccccttggggtca

SEQ ID NO: 6789458 - DNA, 91 bp, Homo sapiens
ggaatgattgtatgaaactttaggaaggaatttacatgctttttgtttaaaacctgtgaattctacttcctttgaagagctaactcattcc

SEQ ID NO: 6789459 - DNA, 90 bp, Homo sapiens
tatttgaaataatgtgtttccctttgaagtcaggaagagggaaaagttatcttgtcttaacataaaaggaaatcacgtttgatataaatg

SEQ ID NO: 6789460 - DNA, 76 bp, Homo sapiens
aaatgcagattcttgagttctatccacagagattgtgaatcaataggttctgggtgggcccgagaaatcttcattt

SEQ ID NO: 6789461 - DNA, 71 bp, Homo sapiens
tctcaaagggagtacagccctggagacatgagagaaggcgtcattcagactgctggtgcttccctcagaga

SEQ ID NO: 6789462 - DNA, 63 bp, Homo sapiens
acaactgtcagtaaagaatattttgaagatattgtcaaatccttcttgtgagtgacaagttgt

SEQ ID NO: 6789463 - DNA, 84 bp, Homo sapiens
aagtagtatacattcatgggttttacattataagggctgtttaacagacaaataaaatgtaaatgcccgtgatctaaattactt

SEQ ID NO: 6789464 - DNA, 59 bp, Homo sapiens
tctgctccagaggcttccctagagtgaagagctctactatgtatgctttatgcggcaga

SEQ ID NO: 6789465 - DNA, 73 bp, Homo sapiens
atcacagataaatgtcacataggcaaaatgttttagagatactgtaatcactggcttatgggagatttgtgat

SEQ ID NO: 6789466 - DNA, 77 bp, Homo sapiens
cgcattgtgaagtagccaaaacattttaggttgtgcttttcacgtcaatttatttggcaatgcttcaccataatgtg

SEQ ID NO: 6789467 - DNA, 56 bp, Homo sapiens
agcatagagtcctgagggcaggggacacagcctgctccatctagagctctgcagct

SEQ ID NO: 6789468 - DNA, 56 bp, Homo sapiens
ctgctatcctggtctaattagaatacactgtgctgttttcagatcttggatagcag

SEQ ID NO: 6789469 - DNA, 72 bp, Homo sapiens
cattaagatagactcttggggatccagtgttcacaggcactgttactccacctggattttgtctacagagtg

SEQ ID NO: 6789470 - DNA, 59 bp, Homo sapiens
gcctgaactctgctcatctggtctgagacagagcccagcagtaagattagagattaggt

SEQ ID NO: 6789471 - DNA, 59 bp, Homo sapiens
tgggggctgggatgtcactttcatggttcccctatttataacaagtgattcagccctca

SEQ ID NO: 6789472 - DNA, 56 bp, Homo sapiens
gtttgactgcaggcaaatcactaaaattaaggataatgccagccctgcagttaagc

SEQ ID NO: 6789473 - DNA, 77 bp, Homo sapiens
caaagtcaatcaaagccagatgtccttcctcacacctcaccgtgtctgcagagggccatgtggcttttctgaagttg

SEQ ID NO: 6789474 - DNA, 61 bp, Homo sapiens
gattgtggaggtttaagtaatgggaaacgagtgtctctggtgaaactatacttctatggtc

SEQ ID NO: 6789475 - DNA, 130 bp, Homo sapiens
taccatcacctggagaacttaaaaaaataaagactgctgcctgggcctcaccctagaccaattagatcagaatttccaggagttgaggtctgaacatcattaattttttaaagctccccagcggatttta

SEQ ID NO: 6789476 - DNA, 57 bp, Homo sapiens
atatttgttagctgctttggaggcataatgatagtatgtttctgcggtgacagatat

SEQ ID NO: 6789477 - DNA, 102 bp, Homo sapiens
tgatggggaaggaggcgcgcggtgcccagggctttttattagctgcctcgacttctcgagcctcagcccgaacgtctgcacctgtgcaccccctttctctcg

SEQ ID NO: 6789478 - DNA, 81 bp, Homo sapiens
tatggttgtaacttggatacttgtgttaggttacttggcctttaatataaagtaatttctcatggattcagttataccata

SEQ ID NO: 6789479 - DNA, 55 bp, Homo sapiens
aggaaacatgaatctgccttgaagggatgtgtccccaatgcatttcatgtttcct

SEQ ID NO: 6789480 - DNA, 58 bp, Homo sapiens
gggtttctacaaccacactctcagcccgactgacttgctgcgagtgctggtggagctc

SEQ ID NO: 6789481 - DNA, 65 bp, Homo sapiens
gctttttctaccaggtcactttttacttttatgtgagaaaactctggctctgggtaggagagtgc

SEQ ID NO: 6789482 - DNA, 76 bp, Homo sapiens
gcgcagccctcctgtcctgcaccgtgggggcgccgccctcccaggcgggcctcggagcgggtcagagaggggaagc

SEQ ID NO: 6789483 - DNA, 70 bp, Homo sapiens
atttcatgtttcatctacctaataagcataattcttcccttgcagaactagtgggggtgaaatatgagat

SEQ ID NO: 6789484 - DNA, 63 bp, Homo sapiens
ctgttagaaagtttatagttcctcagtgtagtgtgagatagaggaagtattctttgttagcag

SEQ ID NO: 6789485 - DNA, 62 bp, Homo sapiens
gtcggggcacggagccaaggagggagctagggcaggctaaggctgggctcggtggccctggc

SEQ ID NO: 6789486 - DNA, 71 bp, Homo sapiens
atgctcaccgtcttgggatctacatagctatgtacactgggccttgtgtgcagaatctcaggagtgattat

SEQ ID NO: 6789487 - DNA, 124 bp, Homo sapiens
ttgggcatcactgaattgcatgtggcttgtcttcagggttcttgtaccttgaaattatctctcttaattcccaggttctcagaaggcagtcacatctggacagcattccttgactacgcatcaa

SEQ ID NO: 6789488 - DNA, 67 bp, Homo sapiens
gtaataatttgctacctggtgggatattgtgaggttgagtgaatcatcagtgcttgcaaattattat

SEQ ID NO: 6789489 - DNA, 62 bp, Homo sapiens
ctgtgctcctcacagtgtggccctgcgactgacacggagcccagggcagcttgaggagccgg

SEQ ID NO: 6789490 - DNA, 101 bp, Homo sapiens
atgtattatcagctactctgggtgtagcccagtatgaggtatgggggatccagtagaatcccagttcctttggagctatacccagtaggaaaaatatgcat

SEQ ID NO: 6789491 - DNA, 81 bp, Homo sapiens
caggaagtggcaggcgcagggtttggacccaggcctgggtgaccccagaacctcatgggatcctgtgacctgttgaccctg

SEQ ID NO: 6789492 - DNA, 82 bp, Homo sapiens
tactcagtgatagcagaatagattagaaagagtatgtgtttaaaataacacacaactttattaatttatacaactttgggta

SEQ ID NO: 6789493 - DNA, 63 bp, Homo sapiens
tggctggattattggctagtacaactctgagtccttctatctgctcccaatcaattccagcca

SEQ ID NO: 6789494 - DNA, 60 bp, Homo sapiens
gcatcagcaccaaccttccaggcaccttcaggacggccagagaggtgttggtggctgtgt

SEQ ID NO: 6789495 - DNA, 78 bp, Homo sapiens
ggacccacacagatcctgccaatggaagcaggtggggctctgccatcctctgctgcagcaggattctctgtgcactcc

SEQ ID NO: 6789496 - DNA, 57 bp, Homo sapiens
gttcagttctgggtctggacacacagaggttaggcaggctctggctcaggactgaac

SEQ ID NO: 6789497 - DNA, 61 bp, Homo sapiens
cttttgactctgtccttagctgcactcatcccccagtttgcagacaggattgggttaatag

SEQ ID NO: 6789498 - DNA, 82 bp, Homo sapiens
taataaatgctagtttttgatactcaagaggggtagattttgttcagaagattactttggttttaaaaattaatatttatta

SEQ ID NO: 6789499 - DNA, 64 bp, Homo sapiens
ggacctgccctggctcagatgctccataccccacaggagccaatagctcttggggcagcagtcc

SEQ ID NO: 6789500 - DNA, 62 bp, Homo sapiens
gcaagactggggtgtctgatggtaagggggctcggccacattgtcacagattctcagcttgc

SEQ ID NO: 6789501 - DNA, 73 bp, Homo sapiens
ggtcccacagaggatgcccaagcgatctccaagcccagactttgtttcggttgcctgtggctccctgttaacc

SEQ ID NO: 6789502 - DNA, 69 bp, Homo sapiens
acatgaaacctgagtctaactctccttccctgttgacctccagggacatccaagtgccatgttttatgt

SEQ ID NO: 6789503 - DNA, 123 bp, Homo sapiens
acttgtcgtttcctatgttttctagcttgattgcttatggtatatattcagtaaatgtttgcttaatgaacagatacacataggcatattttggaaaaggacttagaggaacctagaccaagt

SEQ ID NO: 6789504 - DNA, 73 bp, Homo sapiens
tttccttgtgagagccagcagtaaagacattgggggaatctgaatgtgatttggatggtatacacaagagagg

SEQ ID NO: 6789505 - DNA, 58 bp, Homo sapiens
tggattagagtgaaccaaggccttacctctttaattgggctgggggttttctggtcca

SEQ ID NO: 6789506 - DNA, 79 bp, Homo sapiens
ggacttgatgtaaagtgattcatgggagaagttctactcatgtcctaagctcatcctatgtgtcaagatattaatttcc

SEQ ID NO: 6789507 - DNA, 58 bp, Homo sapiens
acccaggctggcgtgcagtggcgtgatctcggctcactgcaagctccgcctcctgggt

SEQ ID NO: 6789508 - DNA, 55 bp, Homo sapiens
ttattcacaaatgttgccctgtcatttgaatctggtagggtttgctgatgaataa

SEQ ID NO: 6789509 - DNA, 105 bp, Homo sapiens
aacttcgaggcttagaacatgtatttagctcgtgatataaggtcgtcttcttcatgtatctgaggtcagctgtgtgtgcatgaggtggttctacttctgagagtt

SEQ ID NO: 6789510 - DNA, 75 bp, Homo sapiens
gggtgggcattcgttgtgccgcttttgagctttgtgggccagagctgggtgtagggctggacaatgagcctcctc

SEQ ID NO: 6789511 - DNA, 117 bp, Homo sapiens
tgacctttgacttactttctgacagttacatgtagcacaataatttttttaagaggacaagaacaagtgtcctctacattatagtgtctgcctgtgtaggaacacaaataaaggtta

SEQ ID NO: 6789512 - DNA, 64 bp, Homo sapiens
tggcaagcagagtctggtggggggccttaaacaaagctcacccagcatgtcttctgccttgcca

SEQ ID NO: 6789513 - DNA, 69 bp, Homo sapiens
ctgacttttccaaataatacttcctctgacaacactttcaaagtggtaagatagcttggaaaagtacag

SEQ ID NO: 6789514 - DNA, 73 bp, Homo sapiens
tttcctgcagctattgtctcctgggcccagctgatggagacagacaaagagggtccagccaattccaaggaaa

SEQ ID NO: 6789515 - DNA, 71 bp, Homo sapiens
aggggtattgatctgaaggtcttgaggcaggagtaaggactcactgtccatgggcgtcaggcaggaaacct

SEQ ID NO: 6789516 - DNA, 130 bp, Homo sapiens
ctgaacagccagacctcgggtattgagtagtggctaagggagcagactttggtgcaaggttgctggctaatttctggcttccctacttactatgtgtactatcttacattggttgtttaatctctgtcag

SEQ ID NO: 6789517 - DNA, 70 bp, Homo sapiens
tcactcacagatgtggttaacatgtacatagcctactggtctatgttacactgtttcacgttccagctga

SEQ ID NO: 6789518 - DNA, 70 bp, Homo sapiens
tggcaggagttttggcagagctgggtgtcctcaaggttaacaactagttttagccacagaacatttgcta

SEQ ID NO: 6789519 - DNA, 67 bp, Homo sapiens
ggtggcagcggtgtgcaaggagggcctgatgggtcaagatcctctttgcccaccgccctgcatcacc

SEQ ID NO: 6789520 - DNA, 83 bp, Homo sapiens
aaatttttaccacatggatagatagggacatagctataaatatgtagatacagatgtgtcttatttgattccacaaaagattt

SEQ ID NO: 6789521 - DNA, 64 bp, Homo sapiens
cagccaggagggaaaggacaattttagggccacaatctgaaagtggtctgcatcccttctgttg

SEQ ID NO: 6789522 - DNA, 73 bp, Homo sapiens
cttgggtgttcatctttcccaccaatcttatctcctacaagtgagatgggtgtccagggaggatctgcccagg

SEQ ID NO: 6789523 - DNA, 64 bp, Homo sapiens
gttcaccagtaccctttttgcggatgtggccgtggagccatgaggggggtaatcactgggttac

SEQ ID NO: 6789524 - DNA, 81 bp, Homo sapiens
gtgttacatgttttcaatcatagtggtcaacaatatataacgctgttattaaccaggtcctttgaaaacaatttgtgacat

SEQ ID NO: 6789525 - DNA, 112 bp, Homo sapiens
tttcttattcatgttacttgttggttggaggccagctatgactctgctccatggtctcgtctctttggaaggagcaggtggcatctgggcacgggtattcatgtgtcagaag

SEQ ID NO: 6789526 - DNA, 84 bp, Homo sapiens
tggccaggctttaacctgcttactgggagagcgaccagattcttaaaactaaggatcctacatccggtgcactgaagcaagcca

SEQ ID NO: 6789527 - DNA, 59 bp, Homo sapiens
tatttggccctaatctgcagtacttgtttcatcacctggcatgcagcaagtgctaaata

SEQ ID NO: 6789528 - DNA, 61 bp, Homo sapiens
ccctctggagttacttcatgccaaagtggctgctatttggcaaccaggtggtctagggtgg

SEQ ID NO: 6789529 - DNA, 58 bp, Homo sapiens
gcggtgggaccgggtatgggggcgtggaaacatgaactctaccaggagtctccaccgt

SEQ ID NO: 6789530 - DNA, 82 bp, Homo sapiens
ctcaaaccatcaaggagccaaacatattgagagagattgagttttctttcccctacatttggttaaagacatgggctttgag

SEQ ID NO: 6789531 - DNA, 56 bp, Homo sapiens
aggcagaggaagggtggatttgctctctgcttgagctggaacatccatcttctcct

SEQ ID NO: 6789532 - DNA, 75 bp, Homo sapiens
gagagaatgaaatgaatggctatcggattattaggatcttttttaaacacccaagtcatttctttctatctgctc

SEQ ID NO: 6789533 - DNA, 77 bp, Homo sapiens
cgaccgggagcggcagtccttccagtacaggctcgcatcgctctacctgcactacctggggctgctgcgccgcttcg

SEQ ID NO: 6789534 - DNA, 127 bp, Homo sapiens
ctaaggaaatttcccaggtcatgtagcaaatatgttggagcagggattcagctgaaggaggctaatactggcctccttcctgtgagtcactgcacatatcagactgcctctctccatgtttccttag

SEQ ID NO: 6789535 - DNA, 58 bp, Homo sapiens
gggcactgagggcccacaggatgtgagcacatttctgatcctgtgagtctcagtcccc

SEQ ID NO: 6789536 - DNA, 55 bp, Homo sapiens
ggccaatgtgctccacgccagagcccatgtgctctatggtctggcccacatggtc

SEQ ID NO: 6789537 - DNA, 72 bp, Homo sapiens
ttctaaccttgagaccaagactataatgagagggcagctttctgtcacccctgtttctggctaaggcaagga

SEQ ID NO: 6789538 - DNA, 95 bp, Homo sapiens
ggggttagactttccttctcagagatggtataattaagttagatgtctttttttagacaatcacacatgcaattatacagatgggaagtagcttt

SEQ ID NO: 6789539 - DNA, 57 bp, Homo sapiens
gccctggcgccgagctctggggaaggcagaggcatggttctcaggctgggcggctgc

SEQ ID NO: 6789540 - DNA, 71 bp, Homo sapiens
ctggcactcataggccagttcaccaggtctgagcagagacagcaccaactgagctccttgaggcatgccag

SEQ ID NO: 6789541 - DNA, 79 bp, Homo sapiens
ccaatgccttatcatgtctttctcatcacatctagttgctgaagtcacttggatataaaggcataaggcacatctttgg

SEQ ID NO: 6789542 - DNA, 56 bp, Homo sapiens
ttgcacccatagcacacactccttgctaaaagcctaggaggactgtgatgggtcaa

SEQ ID NO: 6789543 - DNA, 65 bp, Homo sapiens
tttcttaatttctgtctgacatccctgcctctctggggaggtagaggtaggaaagaatatagaaa

SEQ ID NO: 6789544 - DNA, 93 bp, Homo sapiens
gcccagcctgtcccccatgaagggctcctcgggaaggcccccagggagccgtgaggccttgccaaggagcccttaagcggggagaggctgggc

SEQ ID NO: 6789545 - DNA, 76 bp, Homo sapiens
gcattcatctacccagaactatttttggtgtgtgttcatagacagcacacaccaaagtatttggtatttgagatgc

SEQ ID NO: 6789546 - DNA, 60 bp, Homo sapiens
gttgacagtcaggtgaatgttatacacaagtttattgtctgtaacatttacatggccaac

SEQ ID NO: 6789547 - DNA, 72 bp, Homo sapiens
ttcagccgaataacattcggtcatggaggctgcacgacagtgattatctgtgagctgaagtgacaggctgag

SEQ ID NO: 6789548 - DNA, 72 bp, Homo sapiens
agggttaagaagagatcaaccagtagaaatgtgtattttccagtttcttgctgaaaacaaatctctttccct

SEQ ID NO: 6789549 - DNA, 56 bp, Homo sapiens
ctgcccagcaacagctctgatgccatgtcaaactggttagagctgcttcctggcag

SEQ ID NO: 6789550 - DNA, 55 bp, Homo sapiens
tttgatctatgcgtggtttcccagtttgagatggaggatcatgacaagggacaaa

SEQ ID NO: 6789551 - DNA, 71 bp, Homo sapiens
gtgttgcgaacggcctagagcagggctaaggtcatgacaggtatgccaccacttgctcagggtcccagcac

SEQ ID NO: 6789552 - DNA, 60 bp, Homo sapiens
ggcagaatttgcaggtaaagaggcttagggctgcatgttctctgtgtgccttcatctgcc

SEQ ID NO: 6789553 - DNA, 74 bp, Homo sapiens
taatcttggagtcagaggaaggcttgctctgggtgacattcctggaaagttctgctctgattggcttgagattg

SEQ ID NO: 6789554 - DNA, 79 bp, Homo sapiens
ttccactggtaaatccaagaagtttcgttaaatgttctctgtgaggacctttttaattcttgtattctattcagtggga

SEQ ID NO: 6789555 - DNA, 93 bp, Homo sapiens
ggagccagtttggtgtgccatcctcccacaagcaggtggtgagtaatttcatccagttgtggagagggaatcttgagacaccaaagtcaagcc

SEQ ID NO: 6789556 - DNA, 62 bp, Homo sapiens
tggaaggcctgtgaccatccatcctgtcctctctccagatggttggtccataggcctaacca

SEQ ID NO: 6789557 - DNA, 78 bp, Homo sapiens
gcttcaggaatggagggagtgagagccttttccgacaatgccgaagaaggctcatccctcaccccagacgcctgtggc

SEQ ID NO: 6789558 - DNA, 85 bp, Homo sapiens
agaatcacttgaacccagaggcggaggttgcagtgagttgagatcgcaccactgcactccagcctgggtgacagagcaagattct

SEQ ID NO: 6789559 - DNA, 70 bp, Homo sapiens
ccgctggcaccaggtgctggaggacatcaacgttcagcttgaaaagccggccagcatcggtatccctcgg

SEQ ID NO: 6789560 - DNA, 67 bp, Homo sapiens
gagtgcctcttctgtgcttggaaaatggttagatcctgagcgtggtctcccacagaaagaagtattc

SEQ ID NO: 6789561 - DNA, 84 bp, Homo sapiens
ctgaggcctttcaagctcccagggctgggcaagttttatgaaacgtcttcccagaagccactgggagaaccagggcagcctcag

SEQ ID NO: 6789562 - DNA, 81 bp, Homo sapiens
gctgttagcattggtaggttaaatttacgttccccagatcaaaatctggagaaacaacacttgatgcctttgactaatggt

SEQ ID NO: 6789563 - DNA, 59 bp, Homo sapiens
gctgaggacgccaggccctaagtaaacacctcattcaaactaggccctagctctgcagt

SEQ ID NO: 6789564 - DNA, 96 bp, Homo sapiens
cttctcctccaagcaatggggcttgggaaatgtgtttctggaccaccaccctgtggtatctaggcattttccaagaggaaccagctcctggagaag

SEQ ID NO: 6789565 - DNA, 57 bp, Homo sapiens
ggagtttctgtcatcccgtccccgtggcaacgccccccgggaatgatggaagacttc

SEQ ID NO: 6789566 - DNA, 62 bp, Homo sapiens
gtgcagctgggacactgaggccagagagaagcttcttggctcaaaacttagattccaggcat

SEQ ID NO: 6789567 - DNA, 69 bp, Homo sapiens
atgtcttgaaatgtctcacttagactttcttatgttcagagaaatacagagagaacatttcctagatat

SEQ ID NO: 6789568 - DNA, 60 bp, Homo sapiens
ttaggaaacacgagggggatttcatgtgaacgagaaataaacttccactgtgttttttaa

SEQ ID NO: 6789569 - DNA, 79 bp, Homo sapiens
agagtttaaagcatacatattttctcaagggatgttaggaagattcaagaaatgatctatgtgaactgctttaagctct

SEQ ID NO: 6789570 - DNA, 67 bp, Homo sapiens
tgggaccaagtcatttctttagatcttttgctcttgtcaggtggggtattaaggaggttgggtccca

SEQ ID NO: 6789571 - DNA, 78 bp, Homo sapiens
tattcataagttgttgaatggataaataaattatatttatgtatgcagtggaatactattcagcaatgaaaatgaatg

SEQ ID NO: 6789572 - DNA, 60 bp, Homo sapiens
tgcaccttggtgtgattcttcggtactttttcagaagttaaggaagtcatactatgtgca

SEQ ID NO: 6789573 - DNA, 60 bp, Homo sapiens
actgggaagatggaggcaagcagtgggtagaaaatggtgactttcccccatgttcctggt

SEQ ID NO: 6789574 - DNA, 57 bp, Homo sapiens
gggcactgggacagcacagggagcaaataaacaaaagcccctgcgctcaaggtgctc

SEQ ID NO: 6789575 - DNA, 55 bp, Homo sapiens
ggtggctttatggcgacccagccacgtgtatggtaaggagtcactagaagccatc

SEQ ID NO: 6789576 - DNA, 69 bp, Homo sapiens
caggagtgtggcaggaatgactagaactaaagccaaggtgctactcaattcacctgccactctatcctg

SEQ ID NO: 6789577 - DNA, 76 bp, Homo sapiens
ggataacattcttttatggtgaagttactatatgcattgtcaaatggaatgtcataccataaaagaaagtgtttcc

SEQ ID NO: 6789578 - DNA, 60 bp, Homo sapiens
gctcctggctcagatgctaaattgtcaccagtaacagggagctattagggttagtgaagc

SEQ ID NO: 6789579 - DNA, 64 bp, Homo sapiens
gtaattttcctttgtggctctcattctttttcccccattgaaggctatgaatgtagaaaattat

SEQ ID NO: 6789580 - DNA, 69 bp, Homo sapiens
tatgcatctattgattgcctggctagtttaattcttgactgaccaaatgaaaggatggatggatgggtg

SEQ ID NO: 6789581 - DNA, 75 bp, Homo sapiens
gagaactgtagtgcaaggttttgccaactttttgaccagaatcctcggtgagtaataaattttgcactgcagctc

SEQ ID NO: 6789582 - DNA, 75 bp, Homo sapiens
gtttagaaggcgagccgctaagccgggtgggagacattggtggctggcagtaggctagtggcagctgacttgaat

SEQ ID NO: 6789583 - DNA, 84 bp, Homo sapiens
ctggatggccactccctgttgtcaccccatgatctgggtgagatccaggattgcaggtgcacaactgcccagagagaggtccag

SEQ ID NO: 6789584 - DNA, 56 bp, Homo sapiens
ggaatgagctcggagcagaagggtcacatctgtttccttttcttgggtagcattcc

SEQ ID NO: 6789585 - DNA, 65 bp, Homo sapiens
gcttagctagatgaaatgcccacaggatcctgcccccgatggtttgcacattgcatttgttgagc

SEQ ID NO: 6789586 - DNA, 129 bp, Homo sapiens
acttctttagcatttgtatatttaaaatgttggctaaaaataaattgcatgatataagtctactttgcaataaggttacttgcatgctatttgttgaactagctatcatttcaacttgttgataacggt

SEQ ID NO: 6789587 - DNA, 79 bp, Homo sapiens
tgcaaccctgagaagcaggatggatctagtgttctcctgaccaggaggcaagatctaatcttacttcccagaggtagca

SEQ ID NO: 6789588 - DNA, 67 bp, Homo sapiens
gggttctgctgctggctctgtcacccactagtcacatgaacttgggtggaacagcctgtgcaaacct

SEQ ID NO: 6789589 - DNA, 75 bp, Homo sapiens
ccagccctcagggaccactgacttcactgtgaaatcacccatgtggagtcccagtgagcgccccttaggaactgg

SEQ ID NO: 6789590 - DNA, 89 bp, Homo sapiens
cactcaccttttttgagaaatgctgttcactggcatgcttcccaaagaagcagccatttaaaatgaattggtatttctttccgggagtg

SEQ ID NO: 6789591 - DNA, 68 bp, Homo sapiens
gcatctgtcaccatggcaatgagccagatgaaccacctcagcaccattgcaaatatggcagcagcagc

SEQ ID NO: 6789592 - DNA, 96 bp, Homo sapiens
ctccctggtctgcaaaaggtggttcgctggtacccaggtccctgtgcgaatgagaggagctgacgtctatgaaagccactccctgcacccggggag

SEQ ID NO: 6789593 - DNA, 63 bp, Homo sapiens
gttcatggcccagtagtgtgctagaggagcagtagaattctagaaggcaggctgggccagagc

SEQ ID NO: 6789594 - DNA, 55 bp, Homo sapiens
ctactgttgtgttttaaaggtagaaaccttccttcgtgatgttgcattgcagtag

SEQ ID NO: 6789595 - DNA, 67 bp, Homo sapiens
cagtgctgagtgctttacctagataatgttatttcaatctcatgataacttggttaagtaggcactg

SEQ ID NO: 6789596 - DNA, 81 bp, Homo sapiens
tttatacatagaacatctgctgagggccaactatgctgcttgagaacataaatatggctaatagatgtttcctgtcataaa

SEQ ID NO: 6789597 - DNA, 57 bp, Homo sapiens
ttccttcctctttcacaacagccagttctgttttcccccctgtgatagagtaaggag

SEQ ID NO: 6789598 - DNA, 98 bp, Homo sapiens
ttttttcagcattgtgcctttcattctaataatgttaattgagccccaattttgtgccaggcaatgtgttagaagcgaaggataaactactgaacaaa

SEQ ID NO: 6789599 - DNA, 57 bp, Homo sapiens
tcaccactggaggtcttggctttttttcatcataaaggaaccccctcgggtggctga

SEQ ID NO: 6789600 - DNA, 69 bp, Homo sapiens
ggagcatgcgctctgtgaccgagtgagaatttacccaaccccgcaaaattgaccaagggtgcgtgctcc

SEQ ID NO: 6789601 - DNA, 75 bp, Homo sapiens
gattctaggggtgacatagcaagacgggtgactagcaaggtgctgtaggctgaatgcttgtgtccccccagagtt

SEQ ID NO: 6789602 - DNA, 88 bp, Homo sapiens
gcagccagatcaggagttttcagaaggattttaacacatggacacccacatacaacctgtctataatttccttcttctcctcagttgc

SEQ ID NO: 6789603 - DNA, 69 bp, Homo sapiens
cctgagggatgcctggtttgttttccctcatgaataatacctttcagaagcacagaccagatctccagg

SEQ ID NO: 6789604 - DNA, 58 bp, Homo sapiens
cacacatgggtggggagctaagtgatgagagatttattccaactctgcatgtatggtg

SEQ ID NO: 6789605 - DNA, 72 bp, Homo sapiens
tgcgctggaaagaattcctatggttcaaacacttgttagtgaattctgaatgaatagaattgttccagccca

SEQ ID NO: 6789606 - DNA, 72 bp, Homo sapiens
gtttttcctgatgcatgtgggtgcagagatgacactggccaaatcaagtaccaaatctgtattaggaaacac

SEQ ID NO: 6789607 - DNA, 66 bp, Homo sapiens
ttcctcacctccaaataaatatgtgtgtgtctgtgtgtgtgtatatatgtatgtggcggagaggga

SEQ ID NO: 6789608 - DNA, 79 bp, Homo sapiens
gggcaggtcccatgggaggcatccttgtgcgtggtggttacaggctgtgagaggtggctcccaagcaggaggctttccc

SEQ ID NO: 6789609 - DNA, 59 bp, Homo sapiens
agtataatgaaatgtgtcagtagaactgtttctaagttatttgacagtttctttatatt

SEQ ID NO: 6789610 - DNA, 75 bp, Homo sapiens
cagtccttcattcctcctttgaatgtcatattacaacacacacagcattcccaggacagtggaatttagggattg

SEQ ID NO: 6789611 - DNA, 91 bp, Homo sapiens
tcgggatagggcgggccctttaaggatgtgtcgcagccatccatttaatttgtgactcccgtcctaagtggctaccataccttttttttga

SEQ ID NO: 6789612 - DNA, 71 bp, Homo sapiens
caggtggtgtttggttacatgagtaagttccttggtggtgatttgtgagattctcgtgcacccatcacctg

SEQ ID NO: 6789613 - DNA, 77 bp, Homo sapiens
ctgagaaatgcaaacagccttgaaagagggacacacctaaggcagtgattctcaaagggtggtttgcaaacttttag

SEQ ID NO: 6789614 - DNA, 66 bp, Homo sapiens
ttattgagtgtccattctatgtaaaacagatccctggctgcatcgaacagtggagacaatcgataa

SEQ ID NO: 6789615 - DNA, 77 bp, Homo sapiens
gctccgcccttgctgccacagctgcccagtctccccacagccctgggccctccgctgtggaagccaggggtggctgc

SEQ ID NO: 6789616 - DNA, 58 bp, Homo sapiens
gcccaggctggagtgcagtggcacgatcttggctcactgctacctctgcctcccgggt

SEQ ID NO: 6789617 - DNA, 74 bp, Homo sapiens
tactgaaaaacatgtgtctggctagattgtagtagactgtactgtagcaaaagaaggcaaggcacaattcagta

SEQ ID NO: 6789618 - DNA, 64 bp, Homo sapiens
tcacacccgtcagaatggctgttattaaaaagctaaaaaataacagatgttggcagggctgtga

SEQ ID NO: 6789619 - DNA, 66 bp, Homo sapiens
ggctcctggcatctggtgggtagaggcagagatgccgcaaaatatcctccaatgcacgggacagcc

SEQ ID NO: 6789620 - DNA, 79 bp, Homo sapiens
tccctttgtcacacttcacccctgctcccagtgaagtatatggctaagctgagagaaaagtgaggttctggggaaggga

SEQ ID NO: 6789621 - DNA, 81 bp, Homo sapiens
gctctttattttatcttcaacttggcaaacatttattaagcccaggacccttgtttgtcaatgaagatatgaataatgtgt

SEQ ID NO: 6789622 - DNA, 56 bp, Homo sapiens
acaggtgtaggtacatttgcatacattgatttgttgcagttgttgctactacctgt

SEQ ID NO: 6789623 - DNA, 76 bp, Homo sapiens
gtggtggtggcttgaccaggattgaggggctgaagccttcttcgcggccagtcctgctccctgaccaccagaccac

SEQ ID NO: 6789624 - DNA, 73 bp, Homo sapiens
gtaggaattcacagttactgctgaaccattatatttaataaaacacaatgtgttcttttattgtgaatttcac

SEQ ID NO: 6789625 - DNA, 58 bp, Homo sapiens
acacttacggttccttcatccactgatgaatagttcaagaggtgaaaaactgtgatgt

SEQ ID NO: 6789626 - DNA, 73 bp, Homo sapiens
taagctttccatgattggtcatcatagaaaatagaatcttgatttgctatggttccagatggtggtttgctta

SEQ ID NO: 6789627 - DNA, 94 bp, Homo sapiens
cctggccaccccagttgagtgtccgtctgttccatcattcagcagatgcttggtgagtgcctgcaacggaccagacactgggctagaggccagg

SEQ ID NO: 6789628 - DNA, 88 bp, Homo sapiens
tgcaacagtatctaccattgtttgaacacaactcagaatgctggtaaaaggattactgattctgaagtgtttgtgatattgaattgca

SEQ ID NO: 6789629 - DNA, 63 bp, Homo sapiens
ggcactttgattttgagatgcatcaatttcccacactccagatcatctagaactcagagtgct

SEQ ID NO: 6789630 - DNA, 57 bp, Homo sapiens
gggagggaaggaggcgccgtgtcagagaggaccacccagcccatcccttctgctccc

SEQ ID NO: 6789631 - DNA, 128 bp, Homo sapiens
tggccatgagcagggctgggtatcctgggctgtgcagggagtgggtttggcctaggccccaaggagtgggggccaggcgatgacccctccactctccaggacacccatgctctctgtgcagtgggcca

SEQ ID NO: 6789632 - DNA, 79 bp, Homo sapiens
gtctcattcaggtagcgcaatttcctgggactggggcctcccttaggcccaggtaggtgtgttactttcctcatgagac

SEQ ID NO: 6789633 - DNA, 72 bp, Homo sapiens
tgatggcatttgttggcatggcccctaccactcatttttgtatgtgagctgcaagtctgccaacaactatca

SEQ ID NO: 6789634 - DNA, 89 bp, Homo sapiens
caggtgtgtgccaccacacctggctaatttttgtgtttctagtagagacaggatttcaccatgttggccaggctggtctcaaactcctg

SEQ ID NO: 6789635 - DNA, 78 bp, Homo sapiens
cagtgcctgttggccaaagctcaccagtgctgtgggatcagactcaggcagcgggctcaagtggccagcagggcactg

SEQ ID NO: 6789636 - DNA, 76 bp, Homo sapiens
tcctctgccaaagggagttgccttgcctaagtttatacctcctccctaggctaggggcagcctctgtggaagggga

SEQ ID NO: 6789637 - DNA, 70 bp, Homo sapiens
gggggaagtcctgaggtcaaataagtttagaaagtattctattaaagttgtttaccgtaggacttttaac

SEQ ID NO: 6789638 - DNA, 77 bp, Homo sapiens
tcttgcttctccctaggtgccctaaggtgccctaaatcatctgggtctgcaggagagtgccctagagaagagcagga

SEQ ID NO: 6789639 - DNA, 75 bp, Homo sapiens
tcgcttgaacctaggaggtggaggttgcagtgggccaggatcgcaccactgcactccagcctgccaacagagcga

SEQ ID NO: 6789640 - DNA, 121 bp, Homo sapiens
tgaagttcctactcacctgctcacccatttcacagtatcagttggcacatattaaagtgtcatgttcaaagtattgtgctgctgctgacgtttataagtgtgagttgattggaaaaagtca

SEQ ID NO: 6789641 - DNA, 61 bp, Homo sapiens
gggtagcttgcagtttctgctgttttaaaatcttttagaacgaaagagagctacaagcccc

SEQ ID NO: 6789642 - DNA, 65 bp, Homo sapiens
cttatcatttaacgctttttgaggtagataaattgtctatagtcttcagaagagttaagtgtgag

SEQ ID NO: 6789643 - DNA, 55 bp, Homo sapiens
agaaaggtggatgctctggaattacctctgtgctttcagagcagttggcttgtct

SEQ ID NO: 6789644 - DNA, 82 bp, Homo sapiens
tgagcttccagtggaatatataggggatttgagtcaacatttgatctccttctaaagtcccttcctatattgcagaggctta

SEQ ID NO: 6789645 - DNA, 56 bp, Homo sapiens
gttgccttcactggtcttggcagccccatcatgctgctgacccatgtggagtcaac

SEQ ID NO: 6789646 - DNA, 66 bp, Homo sapiens
gaacttttgggaagccgtgtgactgtcatcattccagctagaacactttcttcctccagaaagttt

SEQ ID NO: 6789647 - DNA, 91 bp, Homo sapiens
gaggagtgccagggcactgacctggacacccgcaactgtaccagtgacctctgtgtacacagtgagtcctctctgccctgaggtcctcttc

SEQ ID NO: 6789648 - DNA, 103 bp, Homo sapiens
tgtacagaatgagggaaattgcatcagtttatacttataaatcttagtgattctcctgggcattttgagatgatctgactgatagtgatcccttaactttaca

SEQ ID NO: 6789649 - DNA, 64 bp, Homo sapiens
tgcatcaaaactggactccttcaactcagactcagcaatctggtaaaggagcaattttgaagta

SEQ ID NO: 6789650 - DNA, 70 bp, Homo sapiens
tccggtgcctggtttggggaatgttcgtgggatatgttccaaaggactgatggacctatcaggtactgga

SEQ ID NO: 6789651 - DNA, 64 bp, Homo sapiens
ggaactctgacagggggcaaaagttatgtcaacatgttctggtagctccactgtctagggaccc

SEQ ID NO: 6789652 - DNA, 89 bp, Homo sapiens
tagtcctcggttgcctgggaggcagcagtgactctgccttctagaagtcgtctgaactgtctgctttccaaacaggggcgacaggactg

SEQ ID NO: 6789653 - DNA, 57 bp, Homo sapiens
ggtttgattcctgcttctgtgctcacagcatgtgacctgaggcaaggagtttaagcc

SEQ ID NO: 6789654 - DNA, 76 bp, Homo sapiens
aatatgcttgtttgtaaggctcttagaataactgtctttgactgctcatttttagtcttgctgcaatcagtatgtt

SEQ ID NO: 6789655 - DNA, 73 bp, Homo sapiens
tccttgtcctcatcagaaatctaggattcagaatcttctgggttcagtcttagatattttgttgggatgaaga

SEQ ID NO: 6789656 - DNA, 57 bp, Homo sapiens
agctttggatttcttatagcccaccgaagtgtgtgtggttataagctggccagtgct

SEQ ID NO: 6789657 - DNA, 128 bp, Homo sapiens
ggagattctatcaggagcaaacagaatgggtggaagggagaaaacttgtggcttattgtaaaagtggccatgtgttattttcttctctctatccatgacctttggtagtgccatcccacactgtctct

SEQ ID NO: 6789658 - DNA, 58 bp, Homo sapiens
tttattcactggggtctgcccgtgggttccagtctaagggtttgcacttctgaatgag

SEQ ID NO: 6789659 - DNA, 58 bp, Homo sapiens
agtttcttgccgtgctttccattggcataccctaactgaaagccactggcaagagact

SEQ ID NO: 6789660 - DNA, 70 bp, Homo sapiens
tcctgactccaaggccagctatctttccacatctgctgcaaatgtcatgaggctagcccccaagttggga

SEQ ID NO: 6789661 - DNA, 87 bp, Homo sapiens
caggcagccttatctgtcatcctagaactccaggacagtcccacattgtgttgggagtggccacgactgggagatggatctgctctg

SEQ ID NO: 6789662 - DNA, 64 bp, Homo sapiens
gctgtctgggatgtcactgctgctgaaatgtcgatggcgtctgtctagcagtactcacagaagc

SEQ ID NO: 6789663 - DNA, 89 bp, Homo sapiens
tgtttgtgaagcacacagaggcaggcttgttgaagtaaaatagggcccaaatctttgtatttttatcaagttgctaagtgcttcagaca

SEQ ID NO: 6789664 - DNA, 74 bp, Homo sapiens
gaggcagctatggatggaaagggccaagctaatggagcaggtctctgcaggctggtctttcttccatatgcttc

SEQ ID NO: 6789665 - DNA, 70 bp, Homo sapiens
ggggagatgtttcagcatttgctccttgagcttgctcaagcaggagccaaaagctgaacaagatcttcct

SEQ ID NO: 6789666 - DNA, 61 bp, Homo sapiens
ctttcttgttattattcatctacttttccttcatgttcaggaagaggtgataacaggtgag

SEQ ID NO: 6789667 - DNA, 67 bp, Homo sapiens
gggctgtgccactgataaatcagaatgcctgggatgggatctgggcatctctgtttaagaggcaccc

SEQ ID NO: 6789668 - DNA, 61 bp, Homo sapiens
ctttgcacccctcctcttcctcgtcccatccctgtccatgtgggcattggagggggtacag

SEQ ID NO: 6789669 - DNA, 65 bp, Homo sapiens
tagacagaatccagcccacgcctgtagccctaatgctgccctgacgtggtctggatttgggtttg

SEQ ID NO: 6789670 - DNA, 61 bp, Homo sapiens
cctgtgctccaggctgctgaagatctaccgccaggcgcagaagcagcttctggagtatcgg

SEQ ID NO: 6789671 - DNA, 58 bp, Homo sapiens
tctgctcccaagtctactagaagtaaatggaaggctctatcttctgacttgagaaaga

SEQ ID NO: 6789672 - DNA, 68 bp, Homo sapiens
ccacatggagagatggcagaggggagcagtcaccctttattctggtcccagctggtcactgtcagtgg

SEQ ID NO: 6789673 - DNA, 66 bp, Homo sapiens
agtttttaacgccatgtttgaacatgaaatggaagaaagcaaaaaggtaaacatggcttaaaggct

SEQ ID NO: 6789674 - DNA, 73 bp, Homo sapiens
aagtgatgcttttacactcatctgggagggggtagggtcagcatcccctggcagaaggtgtagaagcctattt

SEQ ID NO: 6789675 - DNA, 64 bp, Homo sapiens
tctatttggtgttttcaggaatatacgtgaaaagacatgccatgttttggtaaataccatcaga

SEQ ID NO: 6789676 - DNA, 82 bp, Homo sapiens
ggtttagagtcacaaagatggggtttctaacactgcatgcctctcctgcaactctaggaaacatccttatctattctaagcc

SEQ ID NO: 6789677 - DNA, 97 bp, Homo sapiens
gcatggttctggtaaagttccagaactggaaaaggactttctaaatcatcaggcctaccgtctattctggaacgtaagaccacctaagaactatagc

SEQ ID NO: 6789678 - DNA, 84 bp, Homo sapiens
tggaactaacatctgactgtttgctgaaaggtctggacttttggccatgacaggaggcagctgggcagagtcagagaagttcca

SEQ ID NO: 6789679 - DNA, 89 bp, Homo sapiens
ggagacgaagagaggcaaactgaacacgaaagtctttcttgttgagtttaagaaaaaatctttttcttcagttgttattttttgtttct

SEQ ID NO: 6789680 - DNA, 108 bp, Homo sapiens
gattcttagaccaggaatatttgctcacaatcaattatcaatcacttaatatatatctgataatgtttgattgagcagatagatatgccaggtttcctagagagagtc

SEQ ID NO: 6789681 - DNA, 69 bp, Homo sapiens
gctggcaggctgcaggcagagccccagggagcgctttctagggagaagctctgtctgtctgcctatagt

SEQ ID NO: 6789682 - DNA, 60 bp, Homo sapiens
ccattagtaggctcttggcaggagtccagatgagcaactgtggggcctcgtgctagctgg

SEQ ID NO: 6789683 - DNA, 82 bp, Homo sapiens
ggaattatagttccttttgccaggaacacaagaatgatggcactgtcacaaaatgtttccctggaagaggagagatggggcc

SEQ ID NO: 6789684 - DNA, 88 bp, Homo sapiens
ccaggtcatagttagttaattgctaggtgcatcatcttgacaacatatgtccaggaatctgtgcctagccctgatggtgatttcttgg

SEQ ID NO: 6789685 - DNA, 64 bp, Homo sapiens
ggagccagaggctgctgctgtggccagcatggacagcactaaaccaaagccgcctctgttctcc

SEQ ID NO: 6789686 - DNA, 130 bp, Homo sapiens
ggtaagatatcaagttatttctccaggtgtgtgtgtgtgtgtgtgtaaggtgccttagagactgcagcattttataccatcatttcagaaataaggacacagaggccttggagagaggaattgatttgcc

SEQ ID NO: 6789687 - DNA, 65 bp, Homo sapiens
agggccatgcagggaaaagagatattatttaatattttaatgatttatcttctctttgctgccct

SEQ ID NO: 6789688 - DNA, 78 bp, Homo sapiens
gagcaatggcatcgctggtgatcaaaggcctggccgagctaccccaggctccataccatctccggagatgcctggctt

SEQ ID NO: 6789689 - DNA, 101 bp, Homo sapiens
gcaccttccttgctccccctgagtagcactaagtaatctcacaggacaggcaaggcctttctgaagaggtcttagagtgcagggaattgcatgacaggtgc

SEQ ID NO: 6789690 - DNA, 81 bp, Homo sapiens
aatgtgtaattggattgtaacatagagtaaatgcttgagggagtggataccccattttctatgttgtaattgttacatatt

SEQ ID NO: 6789691 - DNA, 70 bp, Homo sapiens
tctcatcatcaaccctgggactgggaattacactatcacctcccctggttctcaggcctttgggatggga

SEQ ID NO: 6789692 - DNA, 97 bp, Homo sapiens
cagtttcttgagatacagcttggctgttttatctcctggtggcccggcgttaatgtcactactggtattaggatgaggccaggctttggagaagctg

SEQ ID NO: 6789693 - DNA, 60 bp, Homo sapiens
aatttgcccagaatattaatgtaaaacatcatgtttcagtgtaatcttattgggcagatt

SEQ ID NO: 6789694 - DNA, 68 bp, Homo sapiens
ttctgtggaaattgtcagcttctttcagtagaaagtcctgcactggaagccagttgacaatcacagaa

SEQ ID NO: 6789695 - DNA, 83 bp, Homo sapiens
gacaagaaaaatgagtgtatacttgcatatatatataaatttttatgtcacattgccgtctgtgcacttgtttgctttttgtc

SEQ ID NO: 6789696 - DNA, 58 bp, Homo sapiens
aaaggcaaggtacatggtcaagatccacatcagtgggatagggaaatgtacctctttt

SEQ ID NO: 6789697 - DNA, 58 bp, Homo sapiens
tgttttcttggatgtgaaactagggcactgggttgctcttaggtaatacaaggagatg

SEQ ID NO: 6789698 - DNA, 68 bp, Homo sapiens
ttgggcttctctgatcaatatttcacagaactctacaataaaatatgtgagtcacagaagaagctgaa

SEQ ID NO: 6789699 - DNA, 58 bp, Homo sapiens
agcagcaggaggccattgtctttaaaagagaaatgaatggcccaggcctcctgtggct

SEQ ID NO: 6789700 - DNA, 87 bp, Homo sapiens
acttctgttggagagcaaagtaatcaaattaagctaattgcttgtacaaagttaatggcttgtgttattcacattttccaaatcagt

SEQ ID NO: 6789701 - DNA, 87 bp, Homo sapiens
gagcagcaggctctggcgctcttcctcagggcggatgggcaggttcagctcttcttcctcctccctgggaaagccagagtcaggttc

SEQ ID NO: 6789702 - DNA, 73 bp, Homo sapiens
tacatttccaggcagagtgagaagcccttgtcaagccccaacagggagctggctggctgtgccaaggacagta

SEQ ID NO: 6789703 - DNA, 76 bp, Homo sapiens
gcaagtcatgtgattttcttatacgatcacatgggtgggctgtcttccatcttgtgtgatgatgagaaagctatgc

SEQ ID NO: 6789704 - DNA, 61 bp, Homo sapiens
taaataaagggattcaacatgggggcaacagaagtgctgagcagagctatccctttattta

SEQ ID NO: 6789705 - DNA, 63 bp, Homo sapiens
ctttctagcctatccacttttcaatcacaaaagagctttggagggggagtttcagttagaaag

SEQ ID NO: 6789706 - DNA, 70 bp, Homo sapiens
tctttctgaggagctgtcatttgattcacacttgcaggataagtaggaattttacaggtttagagaggga

SEQ ID NO: 6789707 - DNA, 58 bp, Homo sapiens
tggtcctttgctgcctcagcagttgttagctgcagctggctgagtgttccaaggagca

SEQ ID NO: 6789708 - DNA, 61 bp, Homo sapiens
ccaggcttttagctgcatggcagagtttgtcctgagaaagatcttgcccagctcagcctgg

SEQ ID NO: 6789709 - DNA, 65 bp, Homo sapiens
gagtttttgagatgagaggtcaatggtaaataaaaccagattgaaatgatctatttcagtagctt

SEQ ID NO: 6789710 - DNA, 85 bp, Homo sapiens
tctttatccttaagctattttttaaattttgagtatcttttatttgcttgagaagttgagaataagagatagtttattttccaga

SEQ ID NO: 6789711 - DNA, 129 bp, Homo sapiens
ctgcagtcagctcctagggactggtctaatggcttggctcttttcagagtcttggattacagtcatgccttggctgcttccagtgggtctggcaagaccacttaagcaaaaagatcagtaggtatgaag

SEQ ID NO: 6789712 - DNA, 57 bp, Homo sapiens
tctcaccaaagccttgaccataggcagagggtaccagtggaaaaggtggggtgaaga

SEQ ID NO: 6789713 - DNA, 78 bp, Homo sapiens
atgtggataatttcgggcaggtatttacatgtgatgcaaatatctttacattgtggacccactcccaaatatccatat

SEQ ID NO: 6789714 - DNA, 63 bp, Homo sapiens
gcttattcatttatgtattgtctatgacagctttcaagctgtaatacagaaatgagtagttgc

SEQ ID NO: 6789715 - DNA, 72 bp, Homo sapiens
aagagcagacaggacttcactgtgttgcctctgatccaggaggctgcataggcagaagctgtgtctgttttt

SEQ ID NO: 6789716 - DNA, 70 bp, Homo sapiens
gtttcataacatcttattggcaaagatatttaaatctgataatatcaagtgttagggagatgtgggaaac

SEQ ID NO: 6789717 - DNA, 67 bp, Homo sapiens
aatatgttgggtgaggaatagtttatagaagggcacagtttaaatttcacttcctcctcaccatgtt

SEQ ID NO: 6789718 - DNA, 61 bp, Homo sapiens
gtagcggcatccattctgcagttctgtttggaactgttcttgtgtttgctatgtatgttat

SEQ ID NO: 6789719 - DNA, 55 bp, Homo sapiens
gcccaggttggagtgcagtggcacaatcatgactcactgcagccttgacctgggc

SEQ ID NO: 6789720 - DNA, 57 bp, Homo sapiens
aaggatgtgttactggtacctagtgagtagaagctagggatgctgtgatacatcctt

SEQ ID NO: 6789721 - DNA, 55 bp, Homo sapiens
gccaaagactgagtggtaagtgtcttactgttagacaaaagcctcagtcttaggc

SEQ ID NO: 6789722 - DNA, 96 bp, Homo sapiens
gccccccaagtgacatggatccgattgcacattcctgaagcctgagtcattcctgggtcctgctcaggctcaggaatgtgtttatgctcatggggc

SEQ ID NO: 6789723 - DNA, 113 bp, Homo sapiens
ggtgccttaatgtctctagcatcagtttccttagctgtgaaatgagaattattataattcctacatacaaggctaaaattagctgatatagataaggcatttagaaaggtgcc

SEQ ID NO: 6789724 - DNA, 62 bp, Homo sapiens
gctgttgctgggaacgcatgtcacaacatgatttaattatggcaaagcattcttataacagt

SEQ ID NO: 6789725 - DNA, 78 bp, Homo sapiens
gacatgaaaataaagcaatctgtttttgaaactttgtatttcaaatactagggggtctatagcaggaatttgtgtgtc

SEQ ID NO: 6789726 - DNA, 93 bp, Homo sapiens
tgcagattgatatgaatattccttaagcataactaaaaatgatttccgcaaaatgaggaggttaattttagttgtctcaagggtctctctgca

SEQ ID NO: 6789727 - DNA, 65 bp, Homo sapiens
ccttctgcattattggggcctgtttcttcattcttagaaggcaggccaataagtagtgccttagg

SEQ ID NO: 6789728 - DNA, 84 bp, Homo sapiens
atttgggatttgaccatgatggctatccttgcttgccaaaacctgacgccctggcaggtaactttcatcaggcatctctgaaat

SEQ ID NO: 6789729 - DNA, 73 bp, Homo sapiens
gaatactgttgtttaactgattagagatatttttaaacctgagataatgtctttctagttaagagctatattc

SEQ ID NO: 6789730 - DNA, 57 bp, Homo sapiens
ccctaggagcttcagagagaacctggccctgccagcaccttgatttggggcttcggg

SEQ ID NO: 6789731 - DNA, 99 bp, Homo sapiens
gtttcccattgatttcattattaaattttaaatgtatttcctcttggtgagggatacctgcagtattttattgtttaatgtagtggctcatggggaaat

SEQ ID NO: 6789732 - DNA, 77 bp, Homo sapiens
aagagtatctggggagaaaatcatttgttttggataaacttctgtctcacaatatttatcttccaatttgatctctt

SEQ ID NO: 6789733 - DNA, 73 bp, Homo sapiens
gtggtgcgggagctctgggaggtgttactatctgcgtggctaaggcacacacaggcctccttctccccatcac

SEQ ID NO: 6789734 - DNA, 77 bp, Homo sapiens
ggttcatgaagtttgttagaatcagaagagaggtattttttcagtctagcttttctgactcagactagttcgtagcc

SEQ ID NO: 6789735 - DNA, 63 bp, Homo sapiens
cttctcctgaaccacagaaacgtgctctgccttaagcacctgtaacctggaagtttagggaag

SEQ ID NO: 6789736 - DNA, 93 bp, Homo sapiens
tggagggtttgttaaatgcagggtgctgggctccaccccagaggctgtgagtcagtggctctggcgtgaagcccagaatatgcatctctacca

SEQ ID NO: 6789737 - DNA, 69 bp, Homo sapiens
taggtttgcttttttgaatcaggagggggaaaattccatatggctctgggtttaggaaagaaaaactta

SEQ ID NO: 6789738 - DNA, 69 bp, Homo sapiens
ataggctgttgtcttctggtaggaccagagtcaggtatgatgctcaactgcaggaagtatggtgcctat

SEQ ID NO: 6789739 - DNA, 90 bp, Homo sapiens
ctcaggttgcagcagaacctggtcctcatgaaggaggcgctgagggccaccatcatggacgtcaccatggtcctgcccagcaagctggag

SEQ ID NO: 6789740 - DNA, 66 bp, Homo sapiens
ggctgcagcctttgggaaggacagggacacccatgcaacacccatgcccaccccttagagctcacc

SEQ ID NO: 6789741 - DNA, 67 bp, Homo sapiens
attgaggtgggaggtgaggcatgatgtttggtaattatataggatcatgtacatgcctactatcaat

SEQ ID NO: 6789742 - DNA, 57 bp, Homo sapiens
ttcctgttctcactttcaactaggggagccatgtgatcctggccaatgagataggaa

SEQ ID NO: 6789743 - DNA, 62 bp, Homo sapiens
gggtcttgcaggcacctcacaattcagtaagcctagttgtgctgtgatgcaggatagcacct

SEQ ID NO: 6789744 - DNA, 80 bp, Homo sapiens
tgcctttgggagctggatgccctaaactggggtggcagagccaggtctgtctgccctggggcatcagtttcccatctgca

SEQ ID NO: 6789745 - DNA, 59 bp, Homo sapiens
gttgcaggcattaattaaaactggtgttgcaaatcacagcattttggaatgcctgcaat

SEQ ID NO: 6789746 - DNA, 93 bp, Homo sapiens
gcaggttggatgcttgatgaaaggaacaaatgagaaaatatggtaaacatttaaaaaattgttatttgtccttattaagatctgttcacttgc

SEQ ID NO: 6789747 - DNA, 72 bp, Homo sapiens
agctggctggccccttcctgccttcccgtaagtcggcccaacggagccaggaaggtatgtggcccagcggct

SEQ ID NO: 6789748 - DNA, 73 bp, Homo sapiens
ggactttaagtttgtaaaattagggaattcaaaggatttttgtaacgctctaattttatgtttgtaaagtacc

SEQ ID NO: 6789749 - DNA, 61 bp, Homo sapiens
ttctgaagtatttacagggacaataatatgttaggtggggttgttttaaaatactccagaa

SEQ ID NO: 6789750 - DNA, 73 bp, Homo sapiens
ggtggggggctgcaaacccaggtccctttaaacagatagcatagatcctggctcattatgtgcccccagcact

SEQ ID NO: 6789751 - DNA, 72 bp, Homo sapiens
aattttatctctaagcaggctttctcactgtgtgggcatcccaactgctaagtttgtttaatagatcaaatt

SEQ ID NO: 6789752 - DNA, 73 bp, Homo sapiens
cctgcttctgtctctagggaaaggttttgccctgatccatgacagagactattacctaaaagatacaagtggg

SEQ ID NO: 6789753 - DNA, 75 bp, Homo sapiens
gctattggtgtctcaactgtattggtggctcaacattggtctctgccactggcagtttgagaatgcattgtcagc

SEQ ID NO: 6789754 - DNA, 60 bp, Homo sapiens
cttgcctgtgagctccgtcctagtcgggccaccgctgaccagctagatgagcttggcaag

SEQ ID NO: 6789755 - DNA, 79 bp, Homo sapiens
tttctctcgatcctcactctgtacaaggattgctcccaatcactgcatttcctgcaaggagtgggttttcaagaagaga

SEQ ID NO: 6789756 - DNA, 79 bp, Homo sapiens
ttagctacatcttgaaggttctaccatacatgttcatcactaaggctgctgtatggtaggggttttgagctgttaatga

SEQ ID NO: 6789757 - DNA, 57 bp, Homo sapiens
tcaactgcagagttgttattttgtttccatgatatggatatgcaactttggggttga

SEQ ID NO: 6789758 - DNA, 94 bp, Homo sapiens
tctagagagaggaagggagacaatttatgtgccagatttgtctcttactgatctgagattggttccacaaagattgtctctctaagcttataga

SEQ ID NO: 6789759 - DNA, 82 bp, Homo sapiens
caaaaagacttcattattcactcagaaatagaatgaaccagaagaaaatggtttttctggtttgagttagtgttctttattg

SEQ ID NO: 6789760 - DNA, 61 bp, Homo sapiens
cacattgctcatggctggatgcgggaacactattgcccagacattgcaggcagagtaagtg

SEQ ID NO: 6789761 - DNA, 130 bp, Homo sapiens
agtgtaaaatgcagagtgttgtcaacttatcacaccaagaatatttttttgcacctttttagtttggaagggtcaaattgagatgacagaggaatagtggataagagctatagtgctattaaattacatt

SEQ ID NO: 6789762 - DNA, 58 bp, Homo sapiens
ccatgtggaatgctcctaagtgaatattattgtttactagacttattccatcttatgg

SEQ ID NO: 6789763 - DNA, 57 bp, Homo sapiens
gtgagcatcaaaaacgtgtatgtgtgtgtgtgtgcgtgcatgcctgtttggtctcac

SEQ ID NO: 6789764 - DNA, 59 bp, Homo sapiens
tactgtaaaagacaggcttcctagagattggtaagggaacaactgtttaaattacagta

SEQ ID NO: 6789765 - DNA, 59 bp, Homo sapiens
gttcagtacttagtggagaattattatcaattgatcattttccactttagtgcaataac

SEQ ID NO: 6789766 - DNA, 123 bp, Homo sapiens
caggtgattctctctgtttccatgttatttatcttcctcccttcctattgaaggcgtcatatggagtgttgaaggctggtggtaaggaggaaaaaggaatgaacactgaatcagtaatatctg

SEQ ID NO: 6789767 - DNA, 61 bp, Homo sapiens
tccttggcaagacacagcacagctcactaagctctgctgcacactattgtttagctaagga

SEQ ID NO: 6789768 - DNA, 62 bp, Homo sapiens
aaatagctgaaagttcctagatttttgatgctcttattctaggtttgattttcagtatgttt

SEQ ID NO: 6789769 - DNA, 109 bp, Homo sapiens
agaaatatagagcttttcagttctcatgagcaaggtggtttttattactcccttagatagctttcactatgttcggagaactctgattatttgaacagttttttttttt

SEQ ID NO: 6789770 - DNA, 61 bp, Homo sapiens
cagtcaatggtaaacaaagtgatggatggatgccatcagatcacaaaagtttctattactg

SEQ ID NO: 6789771 - DNA, 71 bp, Homo sapiens
ctcccaaagtcaggcccagtgtttgacacctgcaatatggcagagtggggacagggcctgtcctcagggag

SEQ ID NO: 6789772 - DNA, 56 bp, Homo sapiens
agcccaggttctaaagccaaaccaagttcaaattctgctttggccatgacctggct

SEQ ID NO: 6789773 - DNA, 77 bp, Homo sapiens
gtgatttagatgttgaaagtgactaattgccatttcatatacatgcatagctatcatttctaaacgtctgtaatcac

SEQ ID NO: 6789774 - DNA, 91 bp, Homo sapiens
gccggcccttccttcaagtttaattgagatgtttagagttgtcggtgcttttgaacatgatctcagtaaactttgctcattgatggctggc

SEQ ID NO: 6789775 - DNA, 57 bp, Homo sapiens
gtccctataactaaacagaaacacagtcatctgtccatctgtgcagtttaggaaggc

SEQ ID NO: 6789776 - DNA, 94 bp, Homo sapiens
gggcatggtggcacctggctctgactccgcatatttctcgagtatgaagtgatgtgaagtggggtccctgggtgtcctctgcatccacctgctc

SEQ ID NO: 6789777 - DNA, 64 bp, Homo sapiens
gaagagctggaagtgaagataacctgaaatgcaggatgttttcccctcctttccctgctctctc

SEQ ID NO: 6789778 - DNA, 83 bp, Homo sapiens
caccttgtatgtggctttctgcgttttctccagagcgcacaagggctggtgagaagatgctggaagtgtggcaactcagggtg

SEQ ID NO: 6789779 - DNA, 87 bp, Homo sapiens
gccccagaggtagcatgctgtggctttagctccaaatcaccatctactgcaaggacaggtcacatacaaatgctcctttcattgggc

SEQ ID NO: 6789780 - DNA, 113 bp, Homo sapiens
ggatgggcacactgtgaattcattagcatggtagccaggtcagcagagtcattagtggtcattttaatgatgacttggaaaccctgcctggtcaatttaagtgaggctcattc

SEQ ID NO: 6789781 - DNA, 101 bp, Homo sapiens
agcgagaggccatctcttcctgcctttgtatgggccctcacagagccaatctcccagggccaccagagcagggcagtaagacagcacgaggccggtaggct

SEQ ID NO: 6789782 - DNA, 76 bp, Homo sapiens
tgcttatttgaatttattctcataaggggattttagatggcatagtttagaaaagagagaatgaatttaagtagca

SEQ ID NO: 6789783 - DNA, 90 bp, Homo sapiens
atcagtcttttaactttggaatttagtaaaataatgcagtaacacataattgtgtaattagtagtaaattcaaaagaagcaagaatagat

SEQ ID NO: 6789784 - DNA, 99 bp, Homo sapiens
ctgtttgccgtggaagaaacctgtgtgctgtgatgaatgccactgtgccgagtcagcatggcggacagtttaactccatgaccttccgcaggtagacag

SEQ ID NO: 6789785 - DNA, 129 bp, Homo sapiens
tgaacttgggagctcaaatgatttgccctcctcagcctccaaagtgctgtgattacaggcatgagtcaccacactcggtctgtgccttagactttagagtcggaaagctggatttgaatcctggcttca

SEQ ID NO: 6789786 - DNA, 101 bp, Homo sapiens
ctggcctgatgtgtgacttaggcatcacgggggatgcaggtagcccacccctgggacctgtgcctccaagtggtctctggggagaacaacgacaaggccag

SEQ ID NO: 6789787 - DNA, 129 bp, Homo sapiens
ggcggctgggggccgccaggacctggggtctgtccgtagtaagcggcctgctgtctgtaatattccgcccaggcggcactgtagtctggctgggagcctgggggagctcctggaccccctccggtggcc

SEQ ID NO: 6789788 - DNA, 105 bp, Homo sapiens
gttgatcatataaatgctaagatagattgatgagtatatatgaactatttaattgttatatttgttcaaacaattcagtgtagttattatctttgcctgatcaac

SEQ ID NO: 6789789 - DNA, 130 bp, Homo sapiens
attgatcttacttggagaatgcttcttaggatttttgcttgcattggagtagatagttcaagatatggatatgaattcatttttccaattaggataaagatcaagaaaaacaattctgggaagtcaaatt

SEQ ID NO: 6789790 - DNA, 58 bp, Homo sapiens
atgtcacatggtcacctctagctgcaagtaaccagtttgaggtgaaacatgttgacat

SEQ ID NO: 6789791 - DNA, 92 bp, Homo sapiens
taattatatgaatgttgaaaagtctaagtttgtaacttggagagtgtctctattctggaaactaaagatgaatcaacacaaatcataagttg

SEQ ID NO: 6789792 - DNA, 85 bp, Homo sapiens
tcctagtctaatattaacatattgtgtggcactaggcaggtcactcctcctctttgactatagtagttaaaatgtagactcagga

SEQ ID NO: 6789793 - DNA, 77 bp, Homo sapiens
aaatcacacaggtgggagtgtgttggagaagagatggagattctaggacttgcctaacaaattcccccttgagattt

SEQ ID NO: 6789794 - DNA, 129 bp, Homo sapiens
ataagttttctttaagtgcaccccttccaaaaatcagataactgaaatatcataccatccaaggaaggaattgtgcttttagtttagaagtttaagttttggttggaggtctactggtaatgaactttt

SEQ ID NO: 6789795 - DNA, 100 bp, Homo sapiens
tgaggcagagaattgcttgaagccaggggttggaggttgcagtgagccaagatcgtgccactgcactccagcctgggcgacagagcgagattccgtctca

SEQ ID NO: 6789796 - DNA, 55 bp, Homo sapiens
aggcttctgagcatggagttttgcaaagacagaaacaccaatgtgcctggagcct

SEQ ID NO: 6789797 - DNA, 66 bp, Homo sapiens
actcgcttgttgggggcaggatgggtttccttcctccgctttttcctcctggccttctcgggcagt

SEQ ID NO: 6789798 - DNA, 99 bp, Homo sapiens
gccgcggtcagcttgccagcccggcgcgctttgttctcaggtagctgggctccagcagaggcagccggggaaaaggactgggaagccgtgggatctggc

SEQ ID NO: 6789799 - DNA, 79 bp, Homo sapiens
catgacctctggaatagcttgcgaggcagtctatttagaggctaccattgtaccaaggtaattttccacgaggcgcatg

SEQ ID NO: 6789800 - DNA, 69 bp, Homo sapiens
ttgccatgcataggaaatgttttttgacagcacagctggctccaggatatatctctagtgttggggcaa

SEQ ID NO: 6789801 - DNA, 90 bp, Homo sapiens
cggaatttactgtttctactgttgccaaggtcacagggaagtggacactttcatgtgcaattagcaatataagttaggacaatatttctg

SEQ ID NO: 6789802 - DNA, 73 bp, Homo sapiens
tgtcacttatgccctgttgtcggacgtcaaggttttttccaatcttaaatggactaacagtgctaagatgaca

SEQ ID NO: 6789803 - DNA, 72 bp, Homo sapiens
agttttgtctgctcctcccagcctcattcagagttccaagggagtaaggcctgagagagagcagatatttct

SEQ ID NO: 6789804 - DNA, 108 bp, Homo sapiens
gggaagtgggcgatttggggttgaagatgaccgtggctgagagcttcatgccccctgtccggtgggcgatcatctcagccgtctctgcgtcatccgcacccacctccc

SEQ ID NO: 6789805 - DNA, 69 bp, Homo sapiens
tcattagatcacgggtgttctggcaaggagttaagaacttctcagaggccagaagctatgtgaaagtga

SEQ ID NO: 6789806 - DNA, 128 bp, Homo sapiens
cagaaggtcctgggtcccaaagttcctgttactcactgctgattgggcacagatgagagtgcctagttttcattcagcagcctgttgtgggtacagggttatggctgcaatgaagcagggcctttctg

SEQ ID NO: 6789807 - DNA, 59 bp, Homo sapiens
gggatcttgggaacacccttacagaacccaagatttggttcaagggctaccaaggtctc

SEQ ID NO: 6789808 - DNA, 69 bp, Homo sapiens
caagctctcttggtgacttaaaatgttcccatttctcatatgaaacacagaagtgccaagagccaattg

SEQ ID NO: 6789809 - DNA, 57 bp, Homo sapiens
gtacatctctaattcctaaaccttcactaagagggaggtgaagggagtcaggtgtgc

SEQ ID NO: 6789810 - DNA, 106 bp, Homo sapiens
atatgttgacagcagttccctcccttcacaggcagagccttcactgtgcagtattttcaggccctgcattgtactgaggggagacaggactgtgaggttaatatgt

SEQ ID NO: 6789811 - DNA, 72 bp, Homo sapiens
ctgcattcagtctgttgtggcatattgttttggttgaagtatataaagatatggcctcatacagacatgtag

SEQ ID NO: 6789812 - DNA, 60 bp, Homo sapiens
gactctaggctgcccaggagctgagcggtatagaggttgagagcctggcagcctgggttc

SEQ ID NO: 6789813 - DNA, 89 bp, Homo sapiens
tctggctagggcgtggcctgggaggtgactggcgccgtaggtatggtggcacctgggtgccttcctgccagccgcaaccctggactgga

SEQ ID NO: 6789814 - DNA, 130 bp, Homo sapiens
atcaatcagaacaagtactttatgagtttgaacatatggggagaatttagcaaatgaactttttatcttaaaagttaatagattctccacatgtagcaatgcattagtgaagctattatctcggaaagat

SEQ ID NO: 6789815 - DNA, 63 bp, Homo sapiens
ctggatttttgaaggacttttttttacttgaaaaaggctaaagacagtggattcaaaatccag

SEQ ID NO: 6789816 - DNA, 76 bp, Homo sapiens
tacagaatattggcctaaagaaatgacagacaaactcagctatattgtctgtcaattcataggtcattttcctgta

SEQ ID NO: 6789817 - DNA, 59 bp, Homo sapiens
tggcctgtcttgttgtgctagatatacccatccccgcagccactgcagacagaaagcca

SEQ ID NO: 6789818 - DNA, 66 bp, Homo sapiens
tgactggtctgcctgttttcctgctgctcataggactcctttcagcaggttaacagaggctggtca

SEQ ID NO: 6789819 - DNA, 57 bp, Homo sapiens
aggagactcagagacctggccgaatcctgcctgcaggacaggccaactgagtcacct

SEQ ID NO: 6789820 - DNA, 76 bp, Homo sapiens
ccttaagagcaaaaactgaggtttcctgaagaagaaagaattctgcttctaggcagcctgagtttcttgcctttgg

SEQ ID NO: 6789821 - DNA, 59 bp, Homo sapiens
tttccaagtcacccttagggtcacatgcctgcaagttgacccctaggttggctcagaaa

SEQ ID NO: 6789822 - DNA, 76 bp, Homo sapiens
ttgcttgaagccgagaggtggaggttgcagtgagccaagatcgcaccactgcactccatcctgggaaatggagcaa

SEQ ID NO: 6789823 - DNA, 76 bp, Homo sapiens
catgtatctttaagtaggtttcctcagtgtctttaatatgctaatggacaatgtgaaactacaagaggagaatatg

SEQ ID NO: 6789824 - DNA, 57 bp, Homo sapiens
ggaggggatttagtagatgctactttataagcttctttaactgtaaaatcctccttc

SEQ ID NO: 6789825 - DNA, 56 bp, Homo sapiens
gatacattccgggagggctacctggttgaggtgacatgagcccagcggagtgaatc

SEQ ID NO: 6789826 - DNA, 64 bp, Homo sapiens
ggtgaatatcaagccctaggtggataccgagccccaggtggatacctggatcctggtagacatc

SEQ ID NO: 6789827 - DNA, 77 bp, Homo sapiens
gccaggcccagaggcttcctgccacctgagaggagccattgaagacctccttgggtggtcagagcttagggaaaggc

SEQ ID NO: 6789828 - DNA, 128 bp, Homo sapiens
agaaggaaacgtcaccacccactgaaggattattgttggcatgatgactgaggcgtggcgcctgtgcacatggcagtgtcagttgccttgtcataagtggcagtaatgctaggggatacttttcttct

SEQ ID NO: 6789829 - DNA, 83 bp, Homo sapiens
ggggctgagcaaaaggaggaggagccaggagacattgggaatggacccaggagttccggacgcccgtcttccagcgcagcctc

SEQ ID NO: 6789830 - DNA, 62 bp, Homo sapiens
catgactgagaagttgtgcgtaatatgtatactcacatcccattggccaaatcttagtcatg

SEQ ID NO: 6789831 - DNA, 80 bp, Homo sapiens
ctctgctcattgctgttggtagttctgcttgtggccagcaaagccacataatacctaggacagtttgatgacatgcaggg

SEQ ID NO: 6789832 - DNA, 57 bp, Homo sapiens
tacagggaccaataataactatagaacagtgctgtataaatgttgggcatccttgta

SEQ ID NO: 6789833 - DNA, 82 bp, Homo sapiens
gcctctgcacagatgctgggaggctgagtgcagccctggatgcaggcatggctggcttctccctccccatctagtttcaggc

SEQ ID NO: 6789834 - DNA, 73 bp, Homo sapiens
ctgtgtccttgtgtgagacctgataaccagagccacactggctcagggccagttctcgcagcagtaagcatgg

SEQ ID NO: 6789835 - DNA, 70 bp, Homo sapiens
ggtgagcttaattgagctgagtttaaaagctgctctgaacatgtccagaaagccagctctgagctgcacc

SEQ ID NO: 6789836 - DNA, 90 bp, Homo sapiens
cagaaagcctgtacccctcagtgacctattgcattcaggctagctttgtgtggaacacaagtcattgaggggccgcataaaagcttattg

SEQ ID NO: 6789837 - DNA, 92 bp, Homo sapiens
ctttctgggtgcaaacactttgcaggagtatgtgataatcagtatgcttttagttattgtttatcctgcaccccgtgttgctgcctaggaag

SEQ ID NO: 6789838 - DNA, 72 bp, Homo sapiens
tatgcaacactgtggtcttttcagtaaaggatcattcaccctttgctttcttttagacttagtgttttcata

SEQ ID NO: 6789839 - DNA, 72 bp, Homo sapiens
gagggacaaggaggtaagaagaaagggagggctttgctttcaagtttgtatttctgtatttctaagttcctc

SEQ ID NO: 6789840 - DNA, 88 bp, Homo sapiens
ttatccagcatttccaagtgtcaggtgcaaaaggatgtgcttcctgtgtttttggttctgacatattgactggaagttgctgtgatag

SEQ ID NO: 6789841 - DNA, 93 bp, Homo sapiens
ggaaatatttttcagaatgcatgtttcctctcagcagacactctgaccaccagttggggaggcaaactatcagtgtattttgaaaaagtttcc

SEQ ID NO: 6789842 - DNA, 63 bp, Homo sapiens
gtcaggaggcgtctcgctggggcaagagggagcttgctcttaggcagagggcgtctttgtgac

SEQ ID NO: 6789843 - DNA, 58 bp, Homo sapiens
cgcacccagcttttgcatcctccgagtatctggacttctagggggacagctggctgtg

SEQ ID NO: 6789844 - DNA, 75 bp, Homo sapiens
aaggcagctggtcaataatcatgtagtacaatggcttggaattgtaaccactatggttattgattgtcctgtgtt

SEQ ID NO: 6789845 - DNA, 58 bp, Homo sapiens
gtgctgtcggcggctgacttgccggtttgggatcccccaggccagtgccctggctcac

SEQ ID NO: 6789846 - DNA, 64 bp, Homo sapiens
gatggaaagagcatggaatggagatccaggaatcctgggtttcagtctatgctttgaactcatt

SEQ ID NO: 6789847 - DNA, 76 bp, Homo sapiens
tgcctgacatgctgcctcagggcgtccgcctggctcgcaccccgggcctcttgtccatcaggctgcctgtcagcca

SEQ ID NO: 6789848 - DNA, 117 bp, Homo sapiens
ggaagtatcacttctaatacaaaaacagtctgggaaagtcactttaatgatttgtagaatgtttcacaggcaatttagagatcatctgaaactgagtcctagagaagtggtatgccc

SEQ ID NO: 6789849 - DNA, 61 bp, Homo sapiens
tcctggtccctgatacaggctgtcatccagctccactggctcagcctcagcaggcccagga

SEQ ID NO: 6789850 - DNA, 69 bp, Homo sapiens
ctttcacacagcagcatcatttatctggtagtagcaagacagccgtatgactttttgttgttgttaaag

SEQ ID NO: 6789851 - DNA, 63 bp, Homo sapiens
gtgctccaggtaggagagagggatcctgagtcagacaggatccccatccccatctgactgcac

SEQ ID NO: 6789852 - DNA, 59 bp, Homo sapiens
gaagtggctgtttggttctgtttgggtttcccagccagtatattccaaagccttttttc

SEQ ID NO: 6789853 - DNA, 70 bp, Homo sapiens
gtagaggttgggtggaccacgagcccaagcagacaagctcagtctgcagcttccatctccactgccctac

SEQ ID NO: 6789854 - DNA, 87 bp, Homo sapiens
gagtgtaggttggtaggtttgtggtttagaactggaccttaaaatctgtccagggcccaggctgcaaataacaactagcttgaattc

SEQ ID NO: 6789855 - DNA, 67 bp, Homo sapiens
ttttggtagtccagagtttagttccccagaagacaccaatgaggggaaaattcgactaaaaccagaa

SEQ ID NO: 6789856 - DNA, 60 bp, Homo sapiens
tatacagaaccgcctgaagtctgcatcatgacttgatggttacccaggggtttatgtgtg

SEQ ID NO: 6789857 - DNA, 83 bp, Homo sapiens
gtcccctcctagcctcaagagattcagggacagatcaccagtcctgtcctctgggagccttgagccttttgaaggaggcagac

SEQ ID NO: 6789858 - DNA, 100 bp, Homo sapiens
cttttgggtcctgataacatgcatcagaatgttagagaagggaaaaagttaaccactggctccctcaatgacattttgaaaagttcagtagattcatgag

SEQ ID NO: 6789859 - DNA, 59 bp, Homo sapiens
agggtctctggagagctgaggaggaaagtcagatctcgtctctatctccggaagaccct

SEQ ID NO: 6789860 - DNA, 80 bp, Homo sapiens
accaatggtacaaaatgtataaagtcaaactgggcattcaagaagcttctcaggaaagactttttaccttgaatcatggt

SEQ ID NO: 6789861 - DNA, 70 bp, Homo sapiens
actgagactgagaatgtttcttgggtcatagattcccattgtcagcttacagcattcttagtgtctcagt

SEQ ID NO: 6789862 - DNA, 73 bp, Homo sapiens
aggggaagctgctctcacaacactgttaatgtttcattaccaagacagatgtgggtgacagcagcattctctt

SEQ ID NO: 6789863 - DNA, 106 bp, Homo sapiens
agtaccctcctgtaggctcaggactagggcagagcttgtacacgatagaggagatgctcgatcgggttctctctccaagtcctgcttctcatggatttaaggggct

SEQ ID NO: 6789864 - DNA, 56 bp, Homo sapiens
tgggtcatggtctaagggcgatgtacctgggtggtgcagagctctgctgaggccca

SEQ ID NO: 6789865 - DNA, 55 bp, Homo sapiens
ggtggctcatgcctataatcccagcactctgggaggccaaggtgggcggatcacc

SEQ ID NO: 6789866 - DNA, 124 bp, Homo sapiens
aggattgcaggggtggtacaggctgcagatttgttgccatggtgctcaacaggtgaaagagaaagtgactgcttccttgggaaacatcatgtaatacacctgtatcttttcccctctccctcct

SEQ ID NO: 6789867 - DNA, 80 bp, Homo sapiens
ggtctttagtggctggtttcctgcatgcaacatattttcaagattcatccatgttgtagcatcaatcagtactttattcc

SEQ ID NO: 6789868 - DNA, 70 bp, Homo sapiens
caaatcaccacttaatgggttaaagcagaaaccatattatttgctcacaactctatgggtctgtgatttg

SEQ ID NO: 6789869 - DNA, 57 bp, Homo sapiens
acctccttctttctgttgtgatcagcatttgttgcatctagaggcaatgaaggaggt

SEQ ID NO: 6789870 - DNA, 82 bp, Homo sapiens
gaagaagggggcgaagacgtgattgaatgtgtcggtgctcattagttcttctgtcagtcgatcacgaggtgccgttttcttc

SEQ ID NO: 6789871 - DNA, 64 bp, Homo sapiens
gcagtaccagctacttgggagatggaggcaggaggatgacttcagcccaggagttggaggctgc

SEQ ID NO: 6789872 - DNA, 66 bp, Homo sapiens
gtgacctggtttgcaccctgagtgccatcatcatcaagcatgaaaaccttatgcagatcagttcac

SEQ ID NO: 6789873 - DNA, 68 bp, Homo sapiens
ccagcacggtctgatccggaaatacggcctcaataagtgcagccagtgtttccgtcagtatgtgaagg

SEQ ID NO: 6789874 - DNA, 86 bp, Homo sapiens
aagtcacctctgtccccacccacatgcgcactgctacacgctgtgcctaccaaggctggcagaagtgtgctggctgggagtgattt

SEQ ID NO: 6789875 - DNA, 65 bp, Homo sapiens
tggccttgagatgcagcagccagtctaaggccactatatgtggaggttggtgtgtccagtggcca

SEQ ID NO: 6789876 - DNA, 57 bp, Homo sapiens
ggactgcagaataatttaagcttttcatctgagttagaatctgtatttctgcagttc

SEQ ID NO: 6789877 - DNA, 62 bp, Homo sapiens
acttcaaaatgagtttcctggtttacaacaagcattaatgtcaggaaagtcaattaagaggt

SEQ ID NO: 6789878 - DNA, 55 bp, Homo sapiens
agcagttgagtgggaatcaggcattggttttgcttagaagcctaccagaattgct

SEQ ID NO: 6789879 - DNA, 78 bp, Homo sapiens
attacaggcatgagccactgcacccagccttttaaaaaactttttggccaggttgttttataggctcatgcctataat

SEQ ID NO: 6789880 - DNA, 79 bp, Homo sapiens
ctgagcatgagatttttggacacttttacatgttcgtatttgggaataactaaagtaaccaaggatatcactgggccag

SEQ ID NO: 6789881 - DNA, 61 bp, Homo sapiens
gggttttgtgccctttaaagcaagaatcagttattaaaatgctttcaaagggcataagcct

SEQ ID NO: 6789882 - DNA, 69 bp, Homo sapiens
gcccgagttgacgggctccccggtgcgcggatgcagccaggtcgtgcagcggagctggtcactgcgggc

SEQ ID NO: 6789883 - DNA, 70 bp, Homo sapiens
gacacttgagtctgggctccgagtggtgcacgtttagccaagccacctcccagctctgagcttgggtttc

SEQ ID NO: 6789884 - DNA, 80 bp, Homo sapiens
ccccaggagtacagcgcatggcatttgtgtgtgttttcaagagaatggcagaaagaaccatgtgcaaggcaattatgggg

SEQ ID NO: 6789885 - DNA, 71 bp, Homo sapiens
aggtgtatttcctcagggctgcttcttgcttgttctcagagaagttggccaatcactgacaaaatgcattt

SEQ ID NO: 6789886 - DNA, 58 bp, Homo sapiens
catcaagctgtgctactgggtaagcagaaggtggaaggccccaggagcagtattgatg

SEQ ID NO: 6789887 - DNA, 68 bp, Homo sapiens
tgggtagggcctcaatcacgtgttccatgttctgcagcttggtgcggatggacgtgatgccttagcca

SEQ ID NO: 6789888 - DNA, 64 bp, Homo sapiens
ggaaagaagggtcttgtttatataaggtggtttaaaatgaatccacccctacaaggccttctcc

SEQ ID NO: 6789889 - DNA, 63 bp, Homo sapiens
gtgggtgagcagaacaggtggcttctcagattcccttgtaggattcctgtgactgtcattgac

SEQ ID NO: 6789890 - DNA, 79 bp, Homo sapiens
cgcaggcttccctggggcccatcgagggctgaggatggccgtccagcccactccccagggcccccctcggacagctgcg

SEQ ID NO: 6789891 - DNA, 69 bp, Homo sapiens
cattttcaggccgcgtgtgaaggccagctttgatctacaccaaggactggagcagtggtcctggagatg

SEQ ID NO: 6789892 - DNA, 66 bp, Homo sapiens
caaaccttcctttgatgctggtacctaagcaccaaacaatagataccagcatcaaaggaaggtttg

SEQ ID NO: 6789893 - DNA, 96 bp, Homo sapiens
caatttgtttatgccactttggtgtctgaaaataacagtaaaaataaatttaaagtatttttgacaggcattaccagagaatcattaataagtatg

SEQ ID NO: 6789894 - DNA, 66 bp, Homo sapiens
gggtctgtgcgcctgtaagtccagagtcccaggcttggggagtgggtgatggcgggggctcggctc

SEQ ID NO: 6789895 - DNA, 84 bp, Homo sapiens
gtgctgctccacaggtacagacaagtagttcagacaagatcctctcactacccaaactcttgcctacttgtcaaccagcagtat

SEQ ID NO: 6789896 - DNA, 97 bp, Homo sapiens
aattgcttctcgtaaatatgttccacttaaagctggcattctcctttcatccctgtgactgtgggtttgattgcaacatgtcttgatgaagccaatt

SEQ ID NO: 6789897 - DNA, 73 bp, Homo sapiens
gttgcagtgtaattgggagatgctggtacttagtgtgttgtgcatggcggaatgtgagattacctgctgtaat

SEQ ID NO: 6789898 - DNA, 115 bp, Homo sapiens
ctttgctgccactgtgtcagttgggtcttctccaagtagaagctaagttgcaatcgtgtgtgcaggtactctactggggagaaatacctgtgaatgaaagccagaggaagcaagg

SEQ ID NO: 6789899 - DNA, 116 bp, Homo sapiens
ggatgaagatgggagttgggaatgaggtgttgagaccagcactggagcagctacttgggtgttgttcatgtctcattattttatatcatggcgagtctcactctctcatgtcatct

SEQ ID NO: 6789900 - DNA, 66 bp, Homo sapiens
aggcgggtggttcacttgaggtcaggagttctacactaccctggccaacatagtgaaacctcgtct

SEQ ID NO: 6789901 - DNA, 81 bp, Homo sapiens
tctgaattaaaacaaaacacagctaacttaaactaacctaaactcgtttagagaggtttgaattggctgcctaattacgga

SEQ ID NO: 6789902 - DNA, 61 bp, Homo sapiens
ggctgcctatgactctgattctttagacaaggccctgcatggctgttaggagttagaagct

SEQ ID NO: 6789903 - DNA, 86 bp, Homo sapiens
tgaactaggccgggcacagtggctcacacctgtaatcccagcactttgggaggccaaggcaggtggatcacgaagtcaggagttcg

SEQ ID NO: 6789904 - DNA, 87 bp, Homo sapiens
gaaggggaaggaaagggtcatcattctgacaagtctacataccaaattggttgcagagcttaagagagagcccacatcttctgtttc

SEQ ID NO: 6789905 - DNA, 88 bp, Homo sapiens
tccatttttttccattatactttgtgttcaacgtagtagattacacgtaaagacagcaagatacaaaatataaatggagagaaataga

SEQ ID NO: 6789906 - DNA, 90 bp, Homo sapiens
atgcaggcagaggaaacagaggtgccacaatatcatctgtttgcatctggattctatattgccttgcctacttttccatctcacctgcgt

SEQ ID NO: 6789907 - DNA, 63 bp, Homo sapiens
gacagtctggcctaaagggttatggtaccaacatcaaatattctactaaagccagattttgtc

SEQ ID NO: 6789908 - DNA, 57 bp, Homo sapiens
ccctgcagatcagtgagaactttggtctaaagacagtttgtctgtggttctgcaggg

SEQ ID NO: 6789909 - DNA, 75 bp, Homo sapiens
tgaatttcatgctcacaaaagatggcaaactgattgtctaagagaaatttgccctctatttgtggaacaggttta

SEQ ID NO: 6789910 - DNA, 63 bp, Homo sapiens
ctggattcggctgcagaagtacttccggatgagttcccggctggaggccgcctgcagctccag

SEQ ID NO: 6789911 - DNA, 67 bp, Homo sapiens
tctcatatttagtaggtgagagactttaggaaagttattaaatcggtttcttatctgtaaagtggga

SEQ ID NO: 6789912 - DNA, 90 bp, Homo sapiens
ctgtgaggtactggaggagccccaacttgttaaagctcctgcatgattgcagcttgggtttgacagcttggggctgtcccagctacgcag

SEQ ID NO: 6789913 - DNA, 76 bp, Homo sapiens
ggcatcgagttctgatgtcccttctttcagcagtaacaggacagactggcagaagagggcctcgggctcggatgcc

SEQ ID NO: 6789914 - DNA, 70 bp, Homo sapiens
aagaatgcatcaaaagtcagagttccaaataaaattgaaaatggtcaatgactaaattgatagcatactt

SEQ ID NO: 6789915 - DNA, 62 bp, Homo sapiens
tgaaacaggcaaaactgcagatgctgtgcaaaatcacacctctagtctgtttgcttgattca

SEQ ID NO: 6789916 - DNA, 85 bp, Homo sapiens
tgagcttccggtttataaggcccaatatttctttcctttctcaaatataaagaaatatgagtcttatagaagcaaaagaagttta

SEQ ID NO: 6789917 - DNA, 78 bp, Homo sapiens
gatggataccaaggcctcagactcagtgcgttgtgaccttgggcaggtcgctcgccctttctgggccattgatccctc

SEQ ID NO: 6789918 - DNA, 84 bp, Homo sapiens
taaaatacagctttgcattgatcctaaaatggaatagactcagtaatatctgatctcctagaatctttgtaagattgtaattta

SEQ ID NO: 6789919 - DNA, 123 bp, Homo sapiens
cattctccatactcaatcactacagcctgctttgggttgcttcatgttatatgcttctggaaaagtcgtcatcattttccatccataccacttggagacagccaggttttgcactggagagtg

SEQ ID NO: 6789920 - DNA, 65 bp, Homo sapiens
gcccaaagggggatgcactagcatattcctaagttacttggtgcccatgtatcccttcactgggc

SEQ ID NO: 6789921 - DNA, 101 bp, Homo sapiens
ttacctgtttaaccacttgatgggctggggaagctcactcctgtggttccagcaggagggcgcatcatcccattatgtcagagtggcaaggaactgggtga

SEQ ID NO: 6789922 - DNA, 85 bp, Homo sapiens
ctaagaaaagtgccaagtccacaacatccacaccctccccagtgaagcagggtgggaaccacaggactcggcacatttcccttag

SEQ ID NO: 6789923 - DNA, 68 bp, Homo sapiens
cttaagcagctgaattcttcagactccagtgagcggagattgagtgtgtttgaagtcagctggtgaag

SEQ ID NO: 6789924 - DNA, 80 bp, Homo sapiens
attagagtcagagtggtctttaagatttaattatctctccaattagagataacagacttagagttacaagggaccttgat

SEQ ID NO: 6789925 - DNA, 95 bp, Homo sapiens
tggcatatccgattcagaatggcagtgtttgtgttctcacatgtggaacaggctttttacatcatcagaagaaatgctgtcaaatggttatgcca

SEQ ID NO: 6789926 - DNA, 61 bp, Homo sapiens
gcagttgttaagagccaggactgctgcagcaggtagtaaactcctttggccttagagctgt

SEQ ID NO: 6789927 - DNA, 72 bp, Homo sapiens
tcaaggtgatggtcttgttttcccaagctgctacagagcttctgcagctccaagcatgaccactatatttgg

SEQ ID NO: 6789928 - DNA, 57 bp, Homo sapiens
ccagagaaagtgaagcaaatgtgtgaggttgcgtttgttagcatttatttaatctgg

SEQ ID NO: 6789929 - DNA, 95 bp, Homo sapiens
gcctcccttttaaaataatgaaacaaacattgtttaagttaaattgttacttggttcctccccacagtgttacttgatagtgtatgttacgaggt

SEQ ID NO: 6789930 - DNA, 81 bp, Homo sapiens
gcttatctataaacttaatggttccgaatggccttaattattttttcagtatttggaccgtcaggtctgttgtagatgagt

SEQ ID NO: 6789931 - DNA, 73 bp, Homo sapiens
gtgtggagtagagataagccatgagaactgtaatactgaacagttccaggaagacatctcaggaactgcagat

SEQ ID NO: 6789932 - DNA, 74 bp, Homo sapiens
gttgtttgaacttttccagacaaggaaagatgattttttccatatttgtgtggcaaaagggatattctgacagc

SEQ ID NO: 6789933 - DNA, 72 bp, Homo sapiens
atctggtttgtgcctcatcatccaaggtctccagctgcccttgacctgttcatgtgaggcatagtcatagat

SEQ ID NO: 6789934 - DNA, 70 bp, Homo sapiens
tatttgtttcttatgtgcagagtgagtacagacttaacagcaggtgttcattttaatataagaacaaatg

SEQ ID NO: 6789935 - DNA, 79 bp, Homo sapiens
ttttgtggacctgtggaaatgatatggagcaggatataaaagtggaatcattttgctcagcttcagaggatccccaaga

SEQ ID NO: 6789936 - DNA, 116 bp, Homo sapiens
gaagggctggggaaaaggaaataatgtagcaaggtaagcgagagatgaggtttgtttgagtgctcgcttcagtctagtctcttactgtggctaactttctgcatctctaaaccttc

SEQ ID NO: 6789937 - DNA, 74 bp, Homo sapiens
ggtcagccctagatgtatagtatgtaatttctgcacagctctctgtttagtaaatacatcactatatactgatc

SEQ ID NO: 6789938 - DNA, 56 bp, Homo sapiens
ctgaattgaagcacttgagaatcttgaatcacggattctccaggcaaccatttcag

SEQ ID NO: 6789939 - DNA, 56 bp, Homo sapiens
tgtactgcattgtcttaatgttgaatttaaaatgagacacaaagcaatggagtaca

SEQ ID NO: 6789940 - DNA, 75 bp, Homo sapiens
ggccattttctgctttcagagtgagacaaagttcaaaatgacagtctgtcagctcattgaaggcacaagataccc

SEQ ID NO: 6789941 - DNA, 58 bp, Homo sapiens
tctgtttagatttccactgttgttgccgtagtgtattcagcagtgtgtctgagctaga

SEQ ID NO: 6789942 - DNA, 92 bp, Homo sapiens
ctgcatttgatcgatgtatcatcttaaatctagaatgtggtgctgctaccagactctacattttccttggggatattagttgttacatgcag

SEQ ID NO: 6789943 - DNA, 67 bp, Homo sapiens
ttttcatggactttttcatgttttctgacttaaaaaatgagctatttaacattgaaagtctagaaga

SEQ ID NO: 6789944 - DNA, 66 bp, Homo sapiens
aatgaaggcaagactgaggtgtggaaagcattcatctgcctcttcaccccagctcctgtcatcatt

SEQ ID NO: 6789945 - DNA, 90 bp, Homo sapiens
taccaattcaaatgagtttgttctattatttgcgtgcgtcttaaaacacccaaatcagatcagagacaggctcctggttgaaatttggta

SEQ ID NO: 6789946 - DNA, 76 bp, Homo sapiens
cttgcttacctagttagctccacataggcatcctcacatcccattgctttggttaagtttttctggtcaaagcaag

SEQ ID NO: 6789947 - DNA, 66 bp, Homo sapiens
ggctttggtttgttcatcgtccttgctctgtaggattacagagatggagagaatcaaagcaaagct

SEQ ID NO: 6789948 - DNA, 70 bp, Homo sapiens
ctctaaatgattctggttgctttaagtgcagtggttctcacactttactgtgcattagaatcacctggag

SEQ ID NO: 6789949 - DNA, 63 bp, Homo sapiens
tttgtaaagtcacagagcaggtgcaagtgggttttgcttcctggatgtgactttgttggcaaa

SEQ ID NO: 6789950 - DNA, 73 bp, Homo sapiens
tgggggcagctcccttaggccttgccgggagataacaggtgtttccagttgcgtgagggtgctgaggccccca

SEQ ID NO: 6789951 - DNA, 56 bp, Homo sapiens
gtctacaatgagcagtcatggcctggacttggcatgcaaagtgctgtcatgtagac

SEQ ID NO: 6789952 - DNA, 57 bp, Homo sapiens
ggacatctgttgtggtagaggagatttattttcccttccatttcttcagcagagtct

SEQ ID NO: 6789953 - DNA, 67 bp, Homo sapiens
gttatttggaaaattttctaagtctgctagtgttctgtgtacagaaaaagtgaattttctaaatgac

SEQ ID NO: 6789954 - DNA, 130 bp, Homo sapiens
ggtttaacatgtatgcatcataaaaggctgctgtaatgtgttaagtcacttaaatcaagtagtataagaatttcttggctggctgacaatgtagcagtaacctctgtatgagaaaaatatttcccttgcc

SEQ ID NO: 6789955 - DNA, 90 bp, Homo sapiens
ctgggtctagactacaagcccagaagattattagagactttgtccttccagcacatgggatctaaaataatcttgctgtctgaagcccag

SEQ ID NO: 6789956 - DNA, 87 bp, Homo sapiens
ggagaagatctcagcgttgttattggttaagagaaagaaaagccattatctcaactaccatataacaagtttaggagagacgttttc

SEQ ID NO: 6789957 - DNA, 77 bp, Homo sapiens
gactgtcaaaaccttggaggcaagggttatcatttataattaggtactttctgcaaccccctagtgtttttacagtc

SEQ ID NO: 6789958 - DNA, 73 bp, Homo sapiens
gatctgctgctgctgctcagtgtgaacaagggctgctcccttgtcttgcacagatgcagcctgcacagctgtc

SEQ ID NO: 6789959 - DNA, 93 bp, Homo sapiens
gggaggcctgagaggagctgcttcaagatcatctcccacttgcctccttatgtcccttggcaagtttcatgagacagattttcatagcctccc

SEQ ID NO: 6789960 - DNA, 73 bp, Homo sapiens
gtgttcttaactggaaaatgtcagagccctttttatacattcggggtcttctgtcagggccattaatgagcac

SEQ ID NO: 6789961 - DNA, 76 bp, Homo sapiens
ggacagctgtggaagaggctcaggcaggaatggcggatccactgtcggcctcactgtcggcctcgcccgggaatcc

SEQ ID NO: 6789962 - DNA, 70 bp, Homo sapiens
gcgcatgaggggggcgccctgcagtgcaggcctcattcctcccctgcctcggccctgcccgcctgtgcgt

SEQ ID NO: 6789963 - DNA, 64 bp, Homo sapiens
cagagcagcggctgcagttttgtctagtaagctatactacacccccttgtgagtggttgctctg

SEQ ID NO: 6789964 - DNA, 57 bp, Homo sapiens
ctgggacaagctctgtctagcttaggagaggaggataaagacagatgtgtgtcccag

SEQ ID NO: 6789965 - DNA, 61 bp, Homo sapiens
ggctccctgggggtcggagagtctagccttctgcagcgtggctgcctgcccctcgggggct

SEQ ID NO: 6789966 - DNA, 70 bp, Homo sapiens
atagctgttagattggggtcgaaaaccacctgtcttctcctacaggtgagctgcaaattctaacaattat

SEQ ID NO: 6789967 - DNA, 59 bp, Homo sapiens
acccgccccctgccagggcaaccagtgaactcagtgtccatggggaaggggaagtgggt

SEQ ID NO: 6789968 - DNA, 88 bp, Homo sapiens
ccttattgtaatactggccaaggaaaatcttcagaagagagccactcgggaactgaagatgttctttttggttcctttggcagtaagg

SEQ ID NO: 6789969 - DNA, 69 bp, Homo sapiens
ggccagctttctggaagccccagagtcagatgtactcctgtcctgacttccagccttccagtactggct

SEQ ID NO: 6789970 - DNA, 57 bp, Homo sapiens
cccggcgaggccccgaagctctctgaaagctggacagccagtcggggccatgctggg

SEQ ID NO: 6789971 - DNA, 129 bp, Homo sapiens
gtcattaataaccaccctcagagtgcattttcctgggctttctgtgtaatctttatgttcttccttttgaatagtccagaatttgcatgaatgaggcccagaagagtactctgtctgagttttaatgat

SEQ ID NO: 6789972 - DNA, 70 bp, Homo sapiens
gaatgtaaagacagataaaacagcatcagtcttttctttcctttgatgcagttgaccatgctttatattt

SEQ ID NO: 6789973 - DNA, 55 bp, Homo sapiens
gaagggctgcaggtctgggccccctttttgggtacgctggcccctatctcccttc

SEQ ID NO: 6789974 - DNA, 65 bp, Homo sapiens
attcaagtacagttttcttctttgctgggagtcattgtacacatgcttgaaaactctgcttggat

SEQ ID NO: 6789975 - DNA, 79 bp, Homo sapiens
tttgctactgatgtttgctcggagcatcagcaagatgtgatggtgctgcctttgcttagcgaataaacccagtttcaaa

SEQ ID NO: 6789976 - DNA, 66 bp, Homo sapiens
tgctatgttgcctagtgtaatatcgcttgatatagtgttcatagtagttactctggcattatagta

SEQ ID NO: 6789977 - DNA, 116 bp, Homo sapiens
atttaaattttccaatatattactttttcccttgaataaagatatcttcattaggattcagaaatttttgctttaggggggctgcacccagaagtagtagaataggaaataggaat

SEQ ID NO: 6789978 - DNA, 72 bp, Homo sapiens
taggccctgtcttcctgaggctcactttgaatgttgtggcaaaaccactgacagagctttttgaagagtcta

SEQ ID NO: 6789979 - DNA, 96 bp, Homo sapiens
ggctgacagtgaggcttaatgcaggtaaccacacttcacatcctgtgccgggtttgaagtgctctggtgatctgcaaagagagcctcaacacagcc

SEQ ID NO: 6789980 - DNA, 74 bp, Homo sapiens
actagagggcagcagagaacacaatgatggcaagatggccattttgtccagtctttgtcttcagctctcctagt

SEQ ID NO: 6789981 - DNA, 73 bp, Homo sapiens
ttcccgggagcaaatcacttcagtcatttcctccctgaggaagttgctaatgatgtgtttgctcttctgggga

SEQ ID NO: 6789982 - DNA, 72 bp, Homo sapiens
taaattgttccacctgagcatgggtaaggagaacaggtgttaattatttttgctgcgaggggaaataattta

SEQ ID NO: 6789983 - DNA, 87 bp, Homo sapiens
tggaattaggagcatcttctgaaactagtgggaaagagctgaatctatcagaacttctcagttgcaagtgtcagaaacctaactcta

SEQ ID NO: 6789984 - DNA, 67 bp, Homo sapiens
gaaagtcctgtgatcacatagtttgatggtattgcccttttattccatccagcccacagtgactttc

SEQ ID NO: 6789985 - DNA, 84 bp, Homo sapiens
ttgaaaatggcctcagagaagaggaaagaggaaagacatggggattccatgtcacctttacccttttatagactggcttttcag

SEQ ID NO: 6789986 - DNA, 82 bp, Homo sapiens
tccacctgttgggacagcactgctacccctgctcatgtgactccaggaggaaaggggctctagtctcattcaatgaggtggg

SEQ ID NO: 6789987 - DNA, 65 bp, Homo sapiens
tgaggaaatggcactcatataggcaaaattacaggctttttgtttgaatgggtctatttttctta

SEQ ID NO: 6789988 - DNA, 68 bp, Homo sapiens
gttatgtctgcagcaagaggtttctgttgaccactggtggttcacagggatccttgttgaaaaataat

SEQ ID NO: 6789989 - DNA, 76 bp, Homo sapiens
tgtcaatgtgggtcccagaggcaaaggactatgaggggataatctagaattttccaactggggcagtgttatgaca

SEQ ID NO: 6789990 - DNA, 76 bp, Homo sapiens
tttcacctgggggtagccaaataaatctattttaagtcactttaaataacttgtatggttattccacagcatgaaa

SEQ ID NO: 6789991 - DNA, 76 bp, Homo sapiens
gtgattcatcagaataggagttttgcaaaatcccacgcatatgctgttgagcaaaacttgctatggctgaaatcat

SEQ ID NO: 6789992 - DNA, 67 bp, Homo sapiens
cctaagttgagaagccagtagctgagagctatctctccccaattcttactggtgtttcagtcttggg

SEQ ID NO: 6789993 - DNA, 76 bp, Homo sapiens
ttgctcacacactcttcctggcacctagcacaattcttggcacagagtaggtgctcgggaagtgtttgttgagtga

SEQ ID NO: 6789994 - DNA, 57 bp, Homo sapiens
tgaaaccttttctccaaacatgtgttctttggagcaatttgggaaatgcaggtttca

SEQ ID NO: 6789995 - DNA, 63 bp, Homo sapiens
gactcagtcccagacatagtaagggatttaatgaaggtcattttgctggtaagggacacagtc

SEQ ID NO: 6789996 - DNA, 78 bp, Homo sapiens
gaggtttggagtcagctctggctttggggagcttccaggctgaggaggctcagcaggcagcagctccctcccaccctc

SEQ ID NO: 6789997 - DNA, 80 bp, Homo sapiens
ttttacagcagcaattttggttcctggagttctgcaggttcctttctggcaggaagattagaccaagagctgcattaaag

SEQ ID NO: 6789998 - DNA, 69 bp, Homo sapiens
taacactacagggccattggaggattatatgagctactgcatgtgaagaatttcccaaggtccttgtta

SEQ ID NO: 6789999 - DNA, 64 bp, Homo sapiens
tcaggcgctccaggcgagctggaccagagctttgttctgattggctgaggcctggattgcctga

SEQ ID NO: 6790000 - DNA, 61 bp, Homo sapiens
aggggatggagctggaaggcagttgagggtcacctgatgaggccttttggtgcagtgcctt

SEQ ID NO: 6790001 - DNA, 129 bp, Homo sapiens
actgcttttagggaatgtgtatattagaatagcttgccttgtgctcgatttgcttttgttggattattcctgtttaagcagagcaagcgtatttattctactgtgaaccatttaataattacatgcagt

SEQ ID NO: 6790002 - DNA, 62 bp, Homo sapiens
cttcaggagtagttacctagcattgtatgagaaagatcactcttcagaggtaactattgaag

SEQ ID NO: 6790003 - DNA, 63 bp, Homo sapiens
aaagccagggtgttgtgcaaaggtctgttctatgcccactgtggcactaggcaccttaccttt

SEQ ID NO: 6790004 - DNA, 67 bp, Homo sapiens
caaagatcattctctggtccagatgctctgagctgcacaaatctgaagacaaggagggtggctggtg

SEQ ID NO: 6790005 - DNA, 66 bp, Homo sapiens
atgttcatccatgtcgtagcagttcctttccttttattactgtgtagtattccatggtatggatgt

SEQ ID NO: 6790006 - DNA, 72 bp, Homo sapiens
ctcttgaacccaaaaggcggagtttgcagtgagccgagattgcgccactgtactccagcctgggaaacagag

SEQ ID NO: 6790007 - DNA, 74 bp, Homo sapiens
ggtcactggtcagtgaaacagtatttcctaagtatgtctgacttccacaatacttgaatttcatgtcaggggcc

SEQ ID NO: 6790008 - DNA, 71 bp, Homo sapiens
tactcaagaccagcttttaacacataaatgatcttgaaagtcctgtgtgattggaagctgagacttgagta

SEQ ID NO: 6790009 - DNA, 88 bp, Homo sapiens
tgatctctaaacctctctgtgccctgacttttctatctttaaaatggacgtaacaacagaggtttaataataagaggtttggaggtta

SEQ ID NO: 6790010 - DNA, 75 bp, Homo sapiens
gggcgtgagagcagttaactgggctctgatcccatctctgagatcttgagcaagttgcatcccctctctgagcct

SEQ ID NO: 6790011 - DNA, 55 bp, Homo sapiens
gccccttaaagacataggatcagggagatggaatcatctctcagccgtctggggc

SEQ ID NO: 6790012 - DNA, 77 bp, Homo sapiens
tatttaccatataagaaaggcatgaatagttttcactctaagtggaatacatgttcctattttatgctgtgtaaata

SEQ ID NO: 6790013 - DNA, 94 bp, Homo sapiens
tgggggtcagaggtcactgtatccaggttccagcttgttccctggatgtaatgcaggctggctgacagatttggggtgctgaccctctccccca

SEQ ID NO: 6790014 - DNA, 59 bp, Homo sapiens
agctctgtgcaggcagaggcatggatccctgtttctgatcagcctctgttgacagagtt

SEQ ID NO: 6790015 - DNA, 68 bp, Homo sapiens
gaaagctgattgcaggaagagagtagggtaagaaatcgactactagatctgctaatggttagctgttc

SEQ ID NO: 6790016 - DNA, 59 bp, Homo sapiens
gattgaggctgttaatcataaaggccctgtagctagaatgatgagcaatagttttaatc

SEQ ID NO: 6790017 - DNA, 60 bp, Homo sapiens
agcactgctttagagcctctgcgtgtctggctgtggcctcaggggtctagcagcagtgct

SEQ ID NO: 6790018 - DNA, 62 bp, Homo sapiens
ggttccaggaggcctcatttcctgtatgttagaagaataaatagtaaaatgtgtcctggacc

SEQ ID NO: 6790019 - DNA, 72 bp, Homo sapiens
agaggtgccacatttggataaatatttaatgttctttaagcatgttttaagtgttcaaacgtacacatttct

SEQ ID NO: 6790020 - DNA, 64 bp, Homo sapiens
ccacaaggggactcgttaaatgtactctcactggtctaattgcatttaattaagtcccttgagg

SEQ ID NO: 6790021 - DNA, 61 bp, Homo sapiens
gacaacctcaggactcagcttgtgggggccctcctctgcaaagcttttcctgagagttgtc

SEQ ID NO: 6790022 - DNA, 80 bp, Homo sapiens
ccagacacacagcagatctgtggcagtgatgagtcttctctgcactgagaggcctcctgtctgggttgctttttgtttgg

SEQ ID NO: 6790023 - DNA, 62 bp, Homo sapiens
tcttgctgcacttgagtttaggaacatgatttgccatccttgaagcaacgtgcagacagcga

SEQ ID NO: 6790024 - DNA, 83 bp, Homo sapiens
gcaggatgggagctggggccagggatctggcctgaggcgtcccagctgtggctgactcctggtccccacttgctcctccctgc

SEQ ID NO: 6790025 - DNA, 93 bp, Homo sapiens
gaggataaagggaatcctgaatctgaagcagatgtggctgagatctttggcccatgaaaggtgctcagtgagtgcttcatttcctttgtcttc

SEQ ID NO: 6790026 - DNA, 79 bp, Homo sapiens
gatgtcttctgtaattaatgcagcaaggagtgagatcttttgttcctcaactcttatagtattggttattaggagcatt

SEQ ID NO: 6790027 - DNA, 62 bp, Homo sapiens
agggtggtgaatgggattttcctgaagaaaaatgggttgtcagtatgttccttcccacacct

SEQ ID NO: 6790028 - DNA, 81 bp, Homo sapiens
tgaattggaaaatgttataaagtttcgaaagatgtatcaaccagatacagtgtgtgtgaactttattttaatcctgattca

SEQ ID NO: 6790029 - DNA, 66 bp, Homo sapiens
gatgccccagagtggactcaggaggatggcatgtgttagcatactgagcacagctctgtgggcctc

SEQ ID NO: 6790030 - DNA, 68 bp, Homo sapiens
gcgcattctctttccttgcgggcggggtgcggggccaaaggctcccaccccctccaaggaggaagcgc

SEQ ID NO: 6790031 - DNA, 77 bp, Homo sapiens
ttctagggctgccataatgaagtactacaaatgaggtggcttagacaaaagaattttattgtctcccagttctggaa

SEQ ID NO: 6790032 - DNA, 93 bp, Homo sapiens
ggtgctgaggctacatccagggttggtattcacctggaaaacacccgcatggctggcgtcctggtcagtgccaaactggtgtccttatgtacc

SEQ ID NO: 6790033 - DNA, 67 bp, Homo sapiens
atgttttcttacagatttggtgaatgactgtccacagaagggaggtctcaccatctgaagaaggtgt

SEQ ID NO: 6790034 - DNA, 57 bp, Homo sapiens
gtgagatcatcttgggaaacaaagatgtggccccacattacatccctggtgatacat

SEQ ID NO: 6790035 - DNA, 59 bp, Homo sapiens
cagcattgagcacagaaggaaaacattagccctgtagttgcttttgttgtcagctgctg

SEQ ID NO: 6790036 - DNA, 95 bp, Homo sapiens
tgattgaaacagggccaactagagtcttcctgtgggatttttcaatgccatcctgacaggcgtttttctctagtatggtattgctgtaaggatca

SEQ ID NO: 6790037 - DNA, 78 bp, Homo sapiens
gtgggttgtgtctctcattcctccatcagcagtggcagccacagttgctggagcggaggtgagccaggcacttcctgc

SEQ ID NO: 6790038 - DNA, 68 bp, Homo sapiens
ccacatttctttttgcagggctggtaggaccaccacctcaggcagtctttcactgccctgtaacgtgg

SEQ ID NO: 6790039 - DNA, 100 bp, Homo sapiens
tctgcagggggcaggagagtcaggtggcccctcgaggcctcagggagtcaccccttggcccagccacctcggctttctctgctcacctacaacttgcagg

SEQ ID NO: 6790040 - DNA, 71 bp, Homo sapiens
gtaaaagccagcttctttacggtggcatccaaggcctttatgatgttgcctccctgaactgtgctttctac

SEQ ID NO: 6790041 - DNA, 100 bp, Homo sapiens
ggctaaaatcaaggcaacagcagagctttctggaagtctaggtgagaatctgtttccttaccttttccagcttctagaggcatccccttggttcatggcc

SEQ ID NO: 6790042 - DNA, 73 bp, Homo sapiens
aggcagctgtgtaggatggttttggacagaggctgaataacagcaaaatgaccagctacttgtacagttcact

SEQ ID NO: 6790043 - DNA, 102 bp, Homo sapiens
gcaaagaggagagggtgtagcccctgctggcagattggggtcagcagtgcctgtcggctaggagcttgctgatgtatctgcatggcttgccctttcccctgc

SEQ ID NO: 6790044 - DNA, 83 bp, Homo sapiens
ctttgagttgggcttagtgagtctgacaccagtggctgcccaaggggagtctgctggtgggaatttacaagagcagcttcggg

SEQ ID NO: 6790045 - DNA, 129 bp, Homo sapiens
tctgaccttttcttttaaaatgtttttcaagggaagtcagtgctggcagcagggtctagattgatggcatcagatgctgagaagtggagcctctgcctcacgtcgcttcaattggtactttgggtcgga

SEQ ID NO: 6790046 - DNA, 78 bp, Homo sapiens
gctcttgtgcctttaagcttcatatcaaaatatggaacatagcctgtgatttccatgaagctgaaggcagcttaaggc

SEQ ID NO: 6790047 - DNA, 58 bp, Homo sapiens
ggcatttagattgaatttctgtagggcagaagccttgttttattcttctttgaatgcc

SEQ ID NO: 6790048 - DNA, 82 bp, Homo sapiens
aattcttggcaagccagtgttaagtgactggttttacacttggtgtgactgaatgggtactgaggctcagcttgcctgaatt

SEQ ID NO: 6790049 - DNA, 83 bp, Homo sapiens
tttgggtccacgctgcctttatgagctgtaacacacaccacgaaggtctgcagcttcactcctgaagccagcgagaccacaaa

SEQ ID NO: 6790050 - DNA, 58 bp, Homo sapiens
attctgaagattgggtttgttttgtatatttttgtacagtaatcccgttcttctgagt

SEQ ID NO: 6790051 - DNA, 103 bp, Homo sapiens
cccctcggtccccggagtcggagggtggaccggagctggaggagctgggtgtccggggtcagctctgcaaggtcacctccccgctcctggggaaagactgggg

SEQ ID NO: 6790052 - DNA, 88 bp, Homo sapiens
cagaaagggtgcggcctggctgacagcttaattccagctttacgaaaccctgagtagagaattcagctaaggtgagcccagatttctg

SEQ ID NO: 6790053 - DNA, 94 bp, Homo sapiens
gcaatggcttaaaatgtattaactgaataatagagcttcattaattttttcagtgaagtctttctgatcatttactacaggccaagtctcatgc

SEQ ID NO: 6790054 - DNA, 64 bp, Homo sapiens
ctccctcccccgagagcataggctgcgtttgtgggaaaccagggctcagcgcgctgggagggag

SEQ ID NO: 6790055 - DNA, 74 bp, Homo sapiens
gcttactgtaagtaagcaacaaggtgtttaaatttcacacatgtgaaatacatattatgttgcctagcaggggc

SEQ ID NO: 6790056 - DNA, 95 bp, Homo sapiens
ctggagcatggaatttctattcacctttgtgaatatgcagaaaatatgagagcatattctgtgtatgtcataatgtttagttttgtgtaatttag

SEQ ID NO: 6790057 - DNA, 66 bp, Homo sapiens
aggcagggtcttgctatgttgcccagattggacgtgaactcctgggctcaagcaatcctcctgcct

SEQ ID NO: 6790058 - DNA, 123 bp, Homo sapiens
gtatctcccctgttgtttcatttagtatcctttctctgtcctcctcttggtgtatatattttctaggaaataagggacaagacaaagggcaaatagttaagaaaaaaacaccagatgagatat

SEQ ID NO: 6790059 - DNA, 57 bp, Homo sapiens
ggagggctgtagaggagacctgaatttagggcccatcagattttcttctttacctcc

SEQ ID NO: 6790060 - DNA, 56 bp, Homo sapiens
cgcgaggccaggacatgaaagctgaggggccatcctctcatgtggctggccacgtg

SEQ ID NO: 6790061 - DNA, 73 bp, Homo sapiens
gacagttgatagtgtctgacatttaagagcacttatactttttaagttctcttcaactggattctaaattgtc

SEQ ID NO: 6790062 - DNA, 70 bp, Homo sapiens
taaaaggctgagagtcacagtcctaatggtctcatcttctgccctatgactgtcagatctaggccctttg

SEQ ID NO: 6790063 - DNA, 88 bp, Homo sapiens
tcacacattaggttggtgcaaaagtaattgtggttctttccattaagtgtaaaactgcaattacttttgcaccaacctaatagtttga

SEQ ID NO: 6790064 - DNA, 62 bp, Homo sapiens
caggtcctctgagatgggaggtctaaagggctcctttgctctgcttctattgtagtggcttg

SEQ ID NO: 6790065 - DNA, 69 bp, Homo sapiens
tccttattctgtgactaccgtcccacacagagccatcttgggagtgtgtattgtgggtcatagaaagga

SEQ ID NO: 6790066 - DNA, 130 bp, Homo sapiens
agtatcagtatccttcctcactagttcacttgcttttgtcattgtgattttctctgaattttgagaaggtatatgtacaatagacatttaagttggatactaaaagggtataaaggacttctgatttact

SEQ ID NO: 6790067 - DNA, 79 bp, Homo sapiens
cagctcagactaagttctgctgacggccagcccagctatgcttggctgagcacaccaggacttaacaaggtctgaattg

SEQ ID NO: 6790068 - DNA, 66 bp, Homo sapiens
ggctagctggccctgggactcccggctggagagaagccacgccgagggcaggagcccgctcgggcc

SEQ ID NO: 6790069 - DNA, 73 bp, Homo sapiens
cactgtaattcttggggctgctctgacaattaacaaacacaaatgtccacgtagcaccttagcatttctagtg

SEQ ID NO: 6790070 - DNA, 55 bp, Homo sapiens
gatgcaaagcatttttgtgtgtgtgtatgtgtgtgtgcaagaatgtctgtgtatc

SEQ ID NO: 6790071 - DNA, 70 bp, Homo sapiens
gaaaagagtgatggagtcaaggctagaacagcatcatgagggctgttctataaatactttcggacttttc

SEQ ID NO: 6790072 - DNA, 58 bp, Homo sapiens
cgtgggccaggacccgctgtccgcccgccgcccgaggtcgggtggacgcttggccccg

SEQ ID NO: 6790073 - DNA, 71 bp, Homo sapiens
tgtgtccactcaggaatgcagaccagtccaaggtgaggtgttccagagcctgtctgtgctgggtggacaca

SEQ ID NO: 6790074 - DNA, 79 bp, Homo sapiens
gtcatagaaacttggacatgcagctgggtgaaataagttccattcagcattcatttccaacttcagccaatctcatgac

SEQ ID NO: 6790075 - DNA, 60 bp, Homo sapiens
ttcactctctagtccaggagctggagtttacatagcctagcactctggagtaggagtggg

SEQ ID NO: 6790076 - DNA, 75 bp, Homo sapiens
gaaaatagaaaggatcttggctgcctcataaaaagaaagtccctatatgcacacctgggtccttgtcttattttt

SEQ ID NO: 6790077 - DNA, 78 bp, Homo sapiens
ccatcacctgtcactttgtttgtttgggctgcagtggaccaatggtttcccaggcacactgaagtgacatgtagatgg

SEQ ID NO: 6790078 - DNA, 72 bp, Homo sapiens
tacttttcccatcagcaactgtgcctgacacacagtagatactgtgtgtactacttgttgaatgaatttgta

SEQ ID NO: 6790079 - DNA, 57 bp, Homo sapiens
gcaaggagcctggaggtgagtgcattccctggccctgctcagctgcttggttcctgt

SEQ ID NO: 6790080 - DNA, 69 bp, Homo sapiens
cttgggtttatgagggtcattccgtgggccagtgtgtaacagtaggtctggaggcccgtcagccctaag

SEQ ID NO: 6790081 - DNA, 57 bp, Homo sapiens
cttgtattgcaaactggccaggcattacttctactgcgttctactgggcaatgcaag

SEQ ID NO: 6790082 - DNA, 66 bp, Homo sapiens
tggcttgggggctaccctaacattgcctgtatgaaatgcaggctttgacttggggcagccaggcca

SEQ ID NO: 6790083 - DNA, 60 bp, Homo sapiens
cagttatgagctatattagagaagaggtgctaatcaacagtctcttttagcttacagctg

SEQ ID NO: 6790084 - DNA, 64 bp, Homo sapiens
ctgtgttttaaatggaaatttgactctgtgtttgctgttgtcaatctgttccattagaacatag

SEQ ID NO: 6790085 - DNA, 77 bp, Homo sapiens
gcagttgtgaggtctcagctgggaagactttcaggatgagggtcattcaatggttggggctaaaatcaccttgctgc

SEQ ID NO: 6790086 - DNA, 72 bp, Homo sapiens
gaaaacaagagctgtataataatgaaaatagcctaaactgttttcattgttactatgagctatgtgcttttc

SEQ ID NO: 6790087 - DNA, 70 bp, Homo sapiens
gcggggcccagaggaccggggcgccctggaccacatggtcaggatgaccacgagcctctaacagccccgc

SEQ ID NO: 6790088 - DNA, 68 bp, Homo sapiens
gagttgaacagatttgtgaagctactcagcacagccaaagttgaatagcttccagattgttaatattc

SEQ ID NO: 6790089 - DNA, 59 bp, Homo sapiens
agtagtctcagtttctctaggtgggtcccctacctcctgcccaggactttgcagacact

SEQ ID NO: 6790090 - DNA, 88 bp, Homo sapiens
ggtagtgtttgcatgcacatgcaatagtgctttcgtgtgtttaggcatgtgcagaagtgctttgtatgtttgtgtgcaaacatctgcc

SEQ ID NO: 6790091 - DNA, 77 bp, Homo sapiens
acgtttctcaactatcaagcctcagaatcttctccattcagctagtgaataaggaaagagggagggtggaggattgt

SEQ ID NO: 6790092 - DNA, 69 bp, Homo sapiens
ggcgacagcaggtgtccttttggtggagaatctccaggtctgtgagctaaatggtacacttgctgggct

SEQ ID NO: 6790093 - DNA, 86 bp, Homo sapiens
tcacagtgtgacatgatggcgtcatgtaacaaggctaagaatcggttgcatgacaattgccgtcaagtttcgtggaggtgctgtga

SEQ ID NO: 6790094 - DNA, 93 bp, Homo sapiens
tgtgtctcttgcatctgctgtgggtctatattttactggacactccagatgctatatctttggatccacaactgcatgcccactaagatcata

SEQ ID NO: 6790095 - DNA, 62 bp, Homo sapiens
ttccttaggggacagggggataccagaaagagtctctgcccttctgttaaccatctgggggg

SEQ ID NO: 6790096 - DNA, 86 bp, Homo sapiens
aaccccgagcagcttaaaaaatatgcagctaatgtcatgtagttaaactgatgtagcatgcatgttgttttgcaagctaaccggtt

SEQ ID NO: 6790097 - DNA, 68 bp, Homo sapiens
tgtgcaacctgatggcaagtatttgttttagaagtcattctaaaatcattctggtgtcagtatgagca

SEQ ID NO: 6790098 - DNA, 63 bp, Homo sapiens
tcactttggattatgtaatttctttctattcataatgagcagctcttacatgatgccaagtga

SEQ ID NO: 6790099 - DNA, 71 bp, Homo sapiens
ggaggggacacgctgtgccacagttcacatgccacaagccagtgctgccttgggacagtgatggctcctcc

SEQ ID NO: 6790100 - DNA, 70 bp, Homo sapiens
ccaaaggcggtattttttgaggatagaaactacatctcatggagtttatcactcagagtgcctacttagg

SEQ ID NO: 6790101 - DNA, 85 bp, Homo sapiens
gtgacggagctctgttctcgtcctgctggagtgccctgccattcacgccgcgtgccagcggtggggaggaaagatgctaagtgac

SEQ ID NO: 6790102 - DNA, 57 bp, Homo sapiens
taaaatagccagtgcccctctgagttttaaaccttcagaggggcactggctatttta

SEQ ID NO: 6790103 - DNA, 87 bp, Homo sapiens
gcaagtttcaccaagccgatgaaattgatcttgaacttttggtgagagaaaggaagaaaggtcattttagaagtgagtggaatgtgc

SEQ ID NO: 6790104 - DNA, 76 bp, Homo sapiens
gctgcaccgtcattgatcatgcagatgcttcacttttccactaagatgaggtctacattgttaaaaatagttcagt

SEQ ID NO: 6790105 - DNA, 91 bp, Homo sapiens
tttcgatgtctatttttatctcatggtttcctgtcgagcattttaaaaaagaattggaatggcaattcagtgaaattatagaacatgggaa

SEQ ID NO: 6790106 - DNA, 80 bp, Homo sapiens
gatgagtctgccagtgagagcctgtctggatgtcgtcagctgtgatgggcctacaggttgtcacggacttggcggctctc

SEQ ID NO: 6790107 - DNA, 89 bp, Homo sapiens
gcggggacatggcagaggcaatgattctgacttcacacctcggtttgattggctcttcaaagtctctgcttctgtaacatgaaaccagc

SEQ ID NO: 6790108 - DNA, 62 bp, Homo sapiens
gaggatgtgatagttctcccaggcaagcctccagtcatctgctagggatgccagtacttctc

SEQ ID NO: 6790109 - DNA, 63 bp, Homo sapiens
gccatgcaatggaataaaatcacatgttagagaatcatgataaaatttgatctgttgtaaggc

SEQ ID NO: 6790110 - DNA, 57 bp, Homo sapiens
gccacttctgcctggcagggccaggtgctccctgtcactaggctctgtgcagatggc

SEQ ID NO: 6790111 - DNA, 82 bp, Homo sapiens
gtaacttcagatgacctgggttggagttctgatcctagaacttattagtcagaattctgaccttgggtcatcatagagtcac

SEQ ID NO: 6790112 - DNA, 59 bp, Homo sapiens
gaggcgggtggatcacctgaggtcaggagttcaagaccaacatggtgaaaccccgtctc

SEQ ID NO: 6790113 - DNA, 59 bp, Homo sapiens
cctgctggcgcttgtctgggagaggcaggatctccgagaggtgtggaagggccggcggg

SEQ ID NO: 6790114 - DNA, 65 bp, Homo sapiens
gatgatatatatggaaagcctagtgcaaaaactggcacctagcaggtccttcatgaatattcatc

SEQ ID NO: 6790115 - DNA, 62 bp, Homo sapiens
caatttgtgactgggttcgtgccttcaggaattctctgtagggcatgtaagtcaccatattg

SEQ ID NO: 6790116 - DNA, 57 bp, Homo sapiens
tatcctcatttgttgaaaatgtaatagtgaaattctcgtacattgctggtggggatg

SEQ ID NO: 6790117 - DNA, 77 bp, Homo sapiens
tgacttttcatccccttcacaccctctgcatttcccttttggagagctcagagggaggtgaagtgggaagaaaatca

SEQ ID NO: 6790118 - DNA, 67 bp, Homo sapiens
tgtgcatatgtttcatctctatgtgtctggtgtattagaaggagcagaaagatgaaagcaaatgaca

SEQ ID NO: 6790119 - DNA, 58 bp, Homo sapiens
ctaggaggcccgtgcaccagggcttagctgtctgcaagcttccttgactggcccctag

SEQ ID NO: 6790120 - DNA, 82 bp, Homo sapiens
gatggagaaagccctggcgggtggagggccctgaggctcctactgctcccggctctgcgcctgcggggactttgaattcatc

SEQ ID NO: 6790121 - DNA, 83 bp, Homo sapiens
ctgcttcttgtaatatcactcatgagggtcaagttcttctagttctgatcctggaaattgtgggaagatgttgcaggagagag

SEQ ID NO: 6790122 - DNA, 76 bp, Homo sapiens
cttggagattcattgcctgaaactctaattttacacataaacatctagaggttcaaagggcaactgattttcctgg

SEQ ID NO: 6790123 - DNA, 60 bp, Homo sapiens
gacacaaaagatagcatcttaacatagtattacttaacaaagatggctgtcatttctgtc

SEQ ID NO: 6790124 - DNA, 81 bp, Homo sapiens
gctgtggagcgtgctgcctgccagcttctgggtgcttcagagatttgccaggcccaggagggggcaggaggcgcccggagc

SEQ ID NO: 6790125 - DNA, 62 bp, Homo sapiens
gctgtgtctttaagtttcccatttataaaatgaatcataatacgaacttggccaggcacagt

SEQ ID NO: 6790126 - DNA, 129 bp, Homo sapiens
acctctagatgttaattccttcatcttataaccaaatctataaagctgcctgtgtctattccttttttcccttccattacaaaggaaagaagtattagaacataggcatctttgatgaggggcattatt

SEQ ID NO: 6790127 - DNA, 65 bp, Homo sapiens
gactggaagtaagtcaccagcggttcagcgcaaaggctcaggactgcaacaggcttattcaagtc

SEQ ID NO: 6790128 - DNA, 63 bp, Homo sapiens
agctgtgccattccaagatcagggtttctttaagcattcccccggccttggaatagcacagct

SEQ ID NO: 6790129 - DNA, 85 bp, Homo sapiens
tcaccaacttatattacaactctgaactacagaggttttgcagtgtcaagaacctgagtgatattgagtgtaatgaagtctgtga

SEQ ID NO: 6790130 - DNA, 92 bp, Homo sapiens
ttccttgctgtgtatttgtttcagggccttggtatcagagttgcaatttcagtctccgaacctgggtcattgtaacaacatccagcagggaa

SEQ ID NO: 6790131 - DNA, 56 bp, Homo sapiens
ggcagagtctccctgtgttgccctggtttcaaacttgggccaagtgattctctgcc

SEQ ID NO: 6790132 - DNA, 99 bp, Homo sapiens
aggttgctttaccagcatgaatctcatttttctggcttaaaatctgagacagtgaaattattccataggaaagtgaatgttattttgcagaattagcct

SEQ ID NO: 6790133 - DNA, 81 bp, Homo sapiens
gtactcatcgctgctctcctgtgccatgcagggcccatgctgacagcaggccgtggcactgggtgagtgagtgaaggatgc

SEQ ID NO: 6790134 - DNA, 73 bp, Homo sapiens
cctgtaacacatgagtcacttgattaaagaaatactcaaatatcaagtttgtgattctctctgtgtgggcagg

SEQ ID NO: 6790135 - DNA, 55 bp, Homo sapiens
ctaagggcttgctggagccagggctgacttcatcaccaccctttagggcccttgg

SEQ ID NO: 6790136 - DNA, 62 bp, Homo sapiens
tctctttaaaaatagtgaaatacctggcaactagtccaattttttgctgttttagaatgaga

SEQ ID NO: 6790137 - DNA, 114 bp, Homo sapiens
gattctctcttttcagcaattcaggtgtcaagcagggagctgagatgtaatggtttccttcagatttctcctaaatgacctgatttactcaaagaatgaagatatctgagaatc

SEQ ID NO: 6790138 - DNA, 96 bp, Homo sapiens
atctccacctcctgaggctgggcgtccttgtgccagctactactcagctcttgcacaggcctgagtgtgggcacgggggccttggccgggtgggat

SEQ ID NO: 6790139 - DNA, 75 bp, Homo sapiens
gcacatggctgtcacttctttgtacttctttcccaattatgtgtttggaacagagccctaaggacagttttatgc

SEQ ID NO: 6790140 - DNA, 60 bp, Homo sapiens
tgtcactgtgggtcccagactggagtgtttcatttcatttgttcatctatagacaagaca

SEQ ID NO: 6790141 - DNA, 57 bp, Homo sapiens
taacagggcctggctccaaaagatgacaggccgcccatcatctgccggcctctgttg

SEQ ID NO: 6790142 - DNA, 80 bp, Homo sapiens
ctcttctctctgatgtatcctaagaatctagctaagatcctagcacatagtaggttctcagggaatatttgttgaatgag

SEQ ID NO: 6790143 - DNA, 59 bp, Homo sapiens
ttgaaatgtttatctctcctgctgagggtatctcagccttggtatgattgacattttgg

SEQ ID NO: 6790144 - DNA, 75 bp, Homo sapiens
tatctggaacaaatgacacattgatgtgagtacatagcagaaagtgttgttcaatgcctagtatgttcacagatg

SEQ ID NO: 6790145 - DNA, 65 bp, Homo sapiens
tgagggctggtcccgggtcctccggctgccgcatcagcgagtgcaggagggaggggaagcctcca

SEQ ID NO: 6790146 - DNA, 56 bp, Homo sapiens
gagtgataggtgtgcagtgatgctgggaagagagaattcattgaacataattactt

SEQ ID NO: 6790147 - DNA, 55 bp, Homo sapiens
gggatcttgaaacagctggattcttaatgcatattcatattgtttcaatgatctt

SEQ ID NO: 6790148 - DNA, 78 bp, Homo sapiens
gagaatgccagcaggctactcctgtgttcgttaaccactactggacagggaatatttgagtagaatgcttacagcctc

SEQ ID NO: 6790149 - DNA, 79 bp, Homo sapiens
tcattgtgaacatgctttgataaataaaagacctatagaaaagagttttgtattattgtcaaagatgggaccagaatga

SEQ ID NO: 6790150 - DNA, 130 bp, Homo sapiens
ggagatggtgaaaacggattggtttgtaacctactggggacttgcagacacaattgggttatttttcatgtgggctggagttcctagatgagcagatgggacaagaaccagtgaaatttaagctaattct

SEQ ID NO: 6790151 - DNA, 94 bp, Homo sapiens
aactatggcataattaaggaggctcaatacaaggttgtatgaaaacaattgcataaacaataagtattgggcttttgaggattgttacaaagtt

SEQ ID NO: 6790152 - DNA, 69 bp, Homo sapiens
gccactcctcggccttgggttctagtagcaactgaaagctaggacacaggcaggaggagatcaccaggc

SEQ ID NO: 6790153 - DNA, 98 bp, Homo sapiens
tcttggttgcttccaagtttttgcagttaaaaataaaccttcatattcagattgttgcgtgaatgtaagttttcagctcatttgggtaagtaccaaga

SEQ ID NO: 6790154 - DNA, 88 bp, Homo sapiens
ggagaatcgcttgaaccagggaggctgaggttgcagtgagctgacatcatgccactgccctccagcctggatgacagagtgagactcc

SEQ ID NO: 6790155 - DNA, 58 bp, Homo sapiens
cgccggcccagcgcaggtcctgccctgccttggccctccgtggcctgcgctgggtgcg

SEQ ID NO: 6790156 - DNA, 82 bp, Homo sapiens
gggctttggcctctattctcaactggtttacatttaaaatcaataatgaaacatatttaggaataaaagtgcatcagagtcc

SEQ ID NO: 6790157 - DNA, 61 bp, Homo sapiens
ttgcctgcgtgcactgggtgtatttcccgttgttttgattatacagtcagggcacaggcag

SEQ ID NO: 6790158 - DNA, 59 bp, Homo sapiens
ggttccagaattttgttctgcttgttaagtaataggcattccccaaaatttctgctact

SEQ ID NO: 6790159 - DNA, 64 bp, Homo sapiens
ttcctattgggatttgggttggtttctcattaatttaattagccaggcttgaccctagtgggaa

SEQ ID NO: 6790160 - DNA, 64 bp, Homo sapiens
ggatgtttttgcagagaagttatcactcacacaggtttttaaggtgacaactctgagaacgttc

SEQ ID NO: 6790161 - DNA, 62 bp, Homo sapiens
tctgtcacttcagttttgaaacaagctgttttagcttggtgattccaaaataaagtttcaga

SEQ ID NO: 6790162 - DNA, 56 bp, Homo sapiens
tggaaattcaaatcacttgaattgggtgcttctcggagtgaattggggagtttcca

SEQ ID NO: 6790163 - DNA, 77 bp, Homo sapiens
agagatgttccagccaatgggaatgggaggttgaggtgtataacatgggaacatttgctattaggctgagcatctct

SEQ ID NO: 6790164 - DNA, 60 bp, Homo sapiens
gtatggatgtgtgaactggttagtttgggatcctttgcttgttattcaccacaaccgtac

SEQ ID NO: 6790165 - DNA, 61 bp, Homo sapiens
agctcctgtctctgttaccacatttgtgcacatgcatgtgtgtgtgcaggagagagaggct

SEQ ID NO: 6790166 - DNA, 102 bp, Homo sapiens
ggaggagagggagatggggtggaggagaggggtaggattaatttgcagcttagattttagggccaaggattgaagcctcttcctgcactcctcccctcctcc

SEQ ID NO: 6790167 - DNA, 64 bp, Homo sapiens
ggatggagttaactctgaaaagacatttatttaaaaattagaataatcacagttaactctttct

SEQ ID NO: 6790168 - DNA, 63 bp, Homo sapiens
cagaaccagcctgggctataggcctcctatggaaacaggcaggctcaggcccatgcttatctg

SEQ ID NO: 6790169 - DNA, 67 bp, Homo sapiens
gatatgtaccacctcttaaaagttagatcgaaatggaattgacagagaggaagggggtggacatttc

SEQ ID NO: 6790170 - DNA, 57 bp, Homo sapiens
tagaggtggggaagtcctgctgagcctctcccacagtgagccttcccctcaccactg

SEQ ID NO: 6790171 - DNA, 55 bp, Homo sapiens
ctttgtggaaagctgcaaccttgaggattttcttatactggagccatccccaaag

SEQ ID NO: 6790172 - DNA, 65 bp, Homo sapiens
ctggacttgggctggtctgtttctgatttcataggtaaattgtagaaggttcctgtcctgtccag

SEQ ID NO: 6790173 - DNA, 96 bp, Homo sapiens
cttgaccccgtaaccacttcgacagccatcagcacacgctgcagcaccacacatgcagtgtgtggtgagggctgcccaactgcttagggggtcaag

SEQ ID NO: 6790174 - DNA, 79 bp, Homo sapiens
tggcaggaagccctgtgatggagactagaggccaagaggtctaaagacactttttacagggggctctttgtatcctcca

SEQ ID NO: 6790175 - DNA, 66 bp, Homo sapiens
tgttggattagaaaatttgcttctttggagagctattatctttagggagaattttttaagaatgca

SEQ ID NO: 6790176 - DNA, 90 bp, Homo sapiens
cagatcatcacataagagtcagggctgttcgctggggcctgtggcgttggcagcagtgtcctcagccagcagctactgtgtacatggctg

SEQ ID NO: 6790177 - DNA, 83 bp, Homo sapiens
gagagtactctcccttggagcctcaggctgcagctgttcagcactcagatggggacttgagcattccaatggggattgctgtt

SEQ ID NO: 6790178 - DNA, 57 bp, Homo sapiens
attccactttatgtctgtatgaatttgatgcttctaggtaccagatataagtggaat

SEQ ID NO: 6790179 - DNA, 57 bp, Homo sapiens
ctgcctgtgaacatactgggggtaacacactctaatgccttcaggttgggtaggcag

SEQ ID NO: 6790180 - DNA, 57 bp, Homo sapiens
cagtggagggcaggggagtccgtccgcttcttgaggacagtccggggtcctccactg

SEQ ID NO: 6790181 - DNA, 79 bp, Homo sapiens
cgcttgtgcttctgcaggttgactgaagtttggctcatgtagactagacttcgttccaggctgtggttagctttgggtg

SEQ ID NO: 6790182 - DNA, 76 bp, Homo sapiens
ggggatgtgtgtgtgtgtgtgtgtgtgtgtgtgtgtgtgtgtgtgtgcacatatgcatacccaaagcagtattctc

SEQ ID NO: 6790183 - DNA, 82 bp, Homo sapiens
gaattcactgtgcttgtagtaaacactattctgatcttctacgtgaagcttgggcaacattttacttcacaggtaagtattc

SEQ ID NO: 6790184 - DNA, 66 bp, Homo sapiens
gtagacagtttgggccgaaatttttccagtataacacttggtttgtttctgctccaggaagttaac

SEQ ID NO: 6790185 - DNA, 77 bp, Homo sapiens
tctgcagggagggctttccaggcatgccactggtctcacccaggggaaaagcccatggaaaacctgtcctctgcaga

SEQ ID NO: 6790186 - DNA, 85 bp, Homo sapiens
ggggccagtgtcctagagactggggacttcctttggggccaaccccatctgggctcgaatcctagctctgctgccaactggcctc

SEQ ID NO: 6790187 - DNA, 74 bp, Homo sapiens
cactgtcaatgaacactggtagtattgaaatggacttaccaagccagtcagccatgcttacctgtgtgatagtg

SEQ ID NO: 6790188 - DNA, 64 bp, Homo sapiens
atttagtaagtacttgttgaatagatgaatgaagtcatatgattaactcaagtatttactgagt

SEQ ID NO: 6790189 - DNA, 99 bp, Homo sapiens
acatgtcggggatggcagagaggaccagggtctgggctctaccttccttccatggaggaagcagagccaccagctttggactgcccatctctgaattgt

SEQ ID NO: 6790190 - DNA, 85 bp, Homo sapiens
ggaagactaaagagtatgtcttttgatgaataataagttctcccctgagtaactgaacataatgaaagccaaattcttgttttct

SEQ ID NO: 6790191 - DNA, 74 bp, Homo sapiens
gggcttgagccatgctgaccctgtgcaggcatgatgctgtctgcttttgctcagcttcggacatctctctgcct

SEQ ID NO: 6790192 - DNA, 73 bp, Homo sapiens
taactatagttgcagctattttctcattaaggatccccgtaaaggaaattgttggtgaaaaatgggtgagtta

SEQ ID NO: 6790193 - DNA, 56 bp, Homo sapiens
ctcagccctccccggggaataactctgcctttgggcttcctcaggggtggggtggg

SEQ ID NO: 6790194 - DNA, 62 bp, Homo sapiens
gttctgggcgccgtgggaaacagccggagccaaaggcccggcgccttcacggggcttagggc

SEQ ID NO: 6790195 - DNA, 84 bp, Homo sapiens
ccgagaccgtggcaaccctgtggctgcccgtccaagcatgcccagtgtttgctgccaccaccgccacagcatctatggtcttgg

SEQ ID NO: 6790196 - DNA, 80 bp, Homo sapiens
gcagagccttaggagagattcaaccacgggaaaagacactggcattgggttgatgtctcaggagaatctgtaggctttgc

SEQ ID NO: 6790197 - DNA, 57 bp, Homo sapiens
ccaattttctggccagaggctcaaccaagaaggggagcccagggaaccaggaagtgg

SEQ ID NO: 6790198 - DNA, 85 bp, Homo sapiens
tgtggctcagtgcccagtagaaaacttgctcgagcctgttgttctgtgacaacgggtgtgggtttttaactgcctgcaagtcaca

SEQ ID NO: 6790199 - DNA, 66 bp, Homo sapiens
ttctctaaactctagtaaaatgtattcaggcaggacctcaatcaataaccctggagttgaagagaa

SEQ ID NO: 6790200 - DNA, 81 bp, Homo sapiens
gtccttttgaaatgacaactttaatgggtttcagctcttttatctagagcttgagataattcaagctgagtttttcagggc

SEQ ID NO: 6790201 - DNA, 62 bp, Homo sapiens
agatgggtaggaatctcaaggtttcagttacacacacaaaatctagaatgacctactcatct

SEQ ID NO: 6790202 - DNA, 64 bp, Homo sapiens
tggagtgaagcaggagctgctgcaggggctgagaaagcaggaaggagctctttgctgcattcca

SEQ ID NO: 6790203 - DNA, 125 bp, Homo sapiens
tcttcattcgtccctcttgggagtaaagcaaaatgtagagattgtgcaaggttgaagcttctcattcccagtcctcagcattttgttttctccttgaaactcctgagagtggagggcctggaaga

SEQ ID NO: 6790204 - DNA, 86 bp, Homo sapiens
ggcgctcgcggctgcggaacagcagctcgttctcgatggacgatccggacgcgggagccatgggagctgcggctgcagtgagtgtc

SEQ ID NO: 6790205 - DNA, 68 bp, Homo sapiens
gtgtcagggaggcctggcaaccacagtgttctttctcctgtttatttgttcttggatcttcctgaagc

SEQ ID NO: 6790206 - DNA, 82 bp, Homo sapiens
gtcccttctctgtgcttcctctgccaacactctgtgcggtgtttccgggagtcagaatggcagggtggtcaagagtacggac

SEQ ID NO: 6790207 - DNA, 87 bp, Homo sapiens
ccaggagtaggttaaccacataggtttctgaacaggcttgtttcaacaagggctgcaagtcacagaaacagtgattgatcacattgg

SEQ ID NO: 6790208 - DNA, 82 bp, Homo sapiens
cagaatatctgcaagctgaggctcccctgagggattctgttccactccaggtctctaggggagccccgtttgtacaggcctg

SEQ ID NO: 6790209 - DNA, 58 bp, Homo sapiens
gtggcaattcccttggtcaacagagggtaagaatgctacctagattatggaatgctgc

SEQ ID NO: 6790210 - DNA, 110 bp, Homo sapiens
agaaaatcttaaaccaatcttaaaccaacttaaacccactcatgtagattagcatagattagcgtgatctgctcaggtagtttaggcttggggaaaaagttagatattct

SEQ ID NO: 6790211 - DNA, 65 bp, Homo sapiens
ggttctcagtgaattggaggatggccacccaagtgagggaggccatttgctttattcacttcacc

SEQ ID NO: 6790212 - DNA, 62 bp, Homo sapiens
tgtcatatctattaaatgtctagcacagtggttggcacacattaggcaattagtagataaca

SEQ ID NO: 6790213 - DNA, 60 bp, Homo sapiens
gcgtcgttctctgccagggcgttggtgtagaacagcaaagcctggggagagtaaggaggc

SEQ ID NO: 6790214 - DNA, 103 bp, Homo sapiens
ttcatataatgcccttgaggtctatccatgttgtgtgtatagttttttcctttttattataagtagcattccatggtatagatataccacaactattaatgga

SEQ ID NO: 6790215 - DNA, 120 bp, Homo sapiens
tctctttgggcactcaaccaaccgaatctctttcttacaaacaagatcattgaccagttaggatctgtctcaatgtgtgtgtgggaagaggttctctcccccacacttttcccaacaaga

SEQ ID NO: 6790216 - DNA, 58 bp, Homo sapiens
ggcagaagtggtaccgtgtggcctttgcaaggctaaatcaggccttacagcttctgcc

SEQ ID NO: 6790217 - DNA, 67 bp, Homo sapiens
gggcctgggggcagcttgtgtcccccgattggggtcttggctggaacagaggctgatcttcaagccc

SEQ ID NO: 6790218 - DNA, 81 bp, Homo sapiens
gcctgggtcaccggctccaacgaggtgagtgggaaccaggatgtctgctccctgatgtgggctgcgtgacaagccccaggc

SEQ ID NO: 6790219 - DNA, 64 bp, Homo sapiens
gcttatattatcatcattggcaggtgagaaattcttctctttctacagtgtgattgtgtaaagt

SEQ ID NO: 6790220 - DNA, 121 bp, Homo sapiens
atacttagccggaaatcacttgaacccaggaggcagatgttgcagtgagccaagatcatgccactgcactccagcctgggtaacaaagcgagactccgtctcaaaaaaaaaaaaaaagtat

SEQ ID NO: 6790221 - DNA, 63 bp, Homo sapiens
gtggagcattagtgatgctagtcagaaggtgcggctgtttgattacacaccacagtgctccat

SEQ ID NO: 6790222 - DNA, 92 bp, Homo sapiens
agtaaaaacagaccctttttgaacagtagcttaggtgtgggtacacaaatacacagtttctagacccattgttcagagagtggagttttact

SEQ ID NO: 6790223 - DNA, 70 bp, Homo sapiens
ggtaaataaagcctgtctctttagagtataacatttcaaagtgcttcggtgaattgcaggctttaagacc

SEQ ID NO: 6790224 - DNA, 128 bp, Homo sapiens
agtaggactttcagtgtcttcctcccaaaaacttctaagctgattccactttttccccagagctgctgcagtgcggtgtgggtggagggagggatcaggaggtacagaaggaaacagtgacccctgct

SEQ ID NO: 6790225 - DNA, 63 bp, Homo sapiens
aaggctaagtaaggctctttctctgcctgtctttgagctgagacatcagtcttattttgcctt

SEQ ID NO: 6790226 - DNA, 83 bp, Homo sapiens
gttatttgcctttttcactgtgatggtgcagaggcagtgatgggtaaaactgccagcaccttagcatgaatcaaagcagtggc

SEQ ID NO: 6790227 - DNA, 60 bp, Homo sapiens
gcaggattggcctttgtaagggaaaatttcttgttcagctcatacatatgccattcctgc

SEQ ID NO: 6790228 - DNA, 65 bp, Homo sapiens
ggagcctgtgtttcctgtagccaaaggcttttgcaaagatttgtggctatgaaagataaaccttc

SEQ ID NO: 6790229 - DNA, 58 bp, Homo sapiens
tttctcaagaagagcgagaaggcttggaccacagcctccgcttcctcttctggagaaa

SEQ ID NO: 6790230 - DNA, 64 bp, Homo sapiens
agctccatgagtgtcatctcagcagctccgaccttggcggactgcatgtgaccactgtggtgct

SEQ ID NO: 6790231 - DNA, 76 bp, Homo sapiens
cctccactaggtttcagaggtgccgggaagtctgagccttcgccctcctgctctccctccatgtccacctaggagg

SEQ ID NO: 6790232 - DNA, 60 bp, Homo sapiens
ttgagcatttgttttgaaagagtagtaacagagaaggttccaagatagacagatgctcaa

SEQ ID NO: 6790233 - DNA, 81 bp, Homo sapiens
cttgagggacttccagcgggtcatggctgctccagcccctgctccgagcagctcaaagcctgcaaggaacagaatcacaag

SEQ ID NO: 6790234 - DNA, 98 bp, Homo sapiens
ctgtggggcagtgtgcatggtggttgaagcacagaccctgccgtcacatcccagggtcctatccacttttctattatcagcacttactagctttgtgg

SEQ ID NO: 6790235 - DNA, 76 bp, Homo sapiens
tcatatcacattatagttgctacagagtatcttgaaacagactcactactctctggaaattatagtgatgagtaga

SEQ ID NO: 6790236 - DNA, 57 bp, Homo sapiens
cttcctcccccacacactcactgaacgtgtgccaggcactgtgtgggggaaggacag

SEQ ID NO: 6790237 - DNA, 78 bp, Homo sapiens
ctgcaacagagacctgcccatttacgctgaggaagcagaaacagctacagacaggatggcaggtactttaaggagcag

SEQ ID NO: 6790238 - DNA, 57 bp, Homo sapiens
gcttcttctgccccctggtggcttttggggaaaagtcactgaaagggcagaaagagc

SEQ ID NO: 6790239 - DNA, 61 bp, Homo sapiens
gacgtggaaggggcgaggcactttccacccacaggtgcgatgaccagtgccccatcctgtc

SEQ ID NO: 6790240 - DNA, 87 bp, Homo sapiens
gtgtgtgctcccaagtgtagtccacaagcaggaagtgagccttccccttggctccgagggctccttgccttgtggggagggcaccgc

SEQ ID NO: 6790241 - DNA, 68 bp, Homo sapiens
attacacagcggttactactagagccaggactagaatcttgattctttatttagtgcttttgtgtaat

SEQ ID NO: 6790242 - DNA, 60 bp, Homo sapiens
gtgtgagtatatgcatgttttagactgtatgtatttgtgtgtatgtacatgtactcacac

SEQ ID NO: 6790243 - DNA, 75 bp, Homo sapiens
caagagacatttatctctcagttctggaggatgggaaatccaagatcaaggcactgacagattctgtgtctgttg

SEQ ID NO: 6790244 - DNA, 71 bp, Homo sapiens
gcttccctgcccagcggctccaacctccagcctgggcacccagacccagagggctgctgggagggacatgc

SEQ ID NO: 6790245 - DNA, 62 bp, Homo sapiens
ctgtcagttattttgagcaattggtaccttgggaatcaattcagtccaacagtaattggtag

SEQ ID NO: 6790246 - DNA, 64 bp, Homo sapiens
aggtcccatatactttttctggtccatgtgcagagtaatggtccaaaccagtgctgtggtccct

SEQ ID NO: 6790247 - DNA, 74 bp, Homo sapiens
tggtcatatcattctgatgtatatcttcaaatcacaactgaaaatatgtaaagaattggtaacctcagtgacca

SEQ ID NO: 6790248 - DNA, 63 bp, Homo sapiens
tgtaaaagtttttggaacggcattgtccaatagaactttttgccgtgttagaaatgttttaca

SEQ ID NO: 6790249 - DNA, 61 bp, Homo sapiens
gcagtttgtttgtggacaccttgagctaatgagaagccagggaagaaacatgaagggctgt

SEQ ID NO: 6790250 - DNA, 86 bp, Homo sapiens
ccagattgaatttcacgagcaggacagacaggcaccaccaaactgggtccagtgtcctggctatggcttctaattccctaatctgg

SEQ ID NO: 6790251 - DNA, 69 bp, Homo sapiens
cttgaacccgggaggcggaggttgtggtgagccaagattgcaccattgtactccagcctgggtgacaag

SEQ ID NO: 6790252 - DNA, 58 bp, Homo sapiens
gacacagaaggtcacatgttcatcttgcaaacaaacaggctatgtgaatttctgtttc

SEQ ID NO: 6790253 - DNA, 70 bp, Homo sapiens
gtccatttatgttgtagctagtaataaatgaggaatctatcattctaaataactaatacagcacatgggc

SEQ ID NO: 6790254 - DNA, 59 bp, Homo sapiens
gggcatagaggcacggaggctgcatggagatccctcactgcattgtccgctgtcttccc

SEQ ID NO: 6790255 - DNA, 62 bp, Homo sapiens
tctgagaagctagaggacaaagtaaggagactttccactgaatatcctttgctatcttttga

SEQ ID NO: 6790256 - DNA, 62 bp, Homo sapiens
gttcagagaaagagacaccttattgtccatcacatgggctttgaaaagctgtttctttggat

SEQ ID NO: 6790257 - DNA, 99 bp, Homo sapiens
tccctaaagtaaatagttggcataaggttaatttagtagagtccagatatgtgtacaggcaccttatcagctgctacattggcctcttttcaacaggga

SEQ ID NO: 6790258 - DNA, 57 bp, Homo sapiens
ccccactctgggatcttgaaaagagtggaatgaaagtactattctcagagctgtggg

SEQ ID NO: 6790259 - DNA, 75 bp, Homo sapiens
tttagctcttgagaacagggttaggtaacttgggctccctctggtgtcggcctcgttcctttttcagtagctaaa

SEQ ID NO: 6790260 - DNA, 64 bp, Homo sapiens
cttaaaatgctatactcagtgaaaatatccttcaaaagtgaaggcatagtaaagacattttagg

SEQ ID NO: 6790261 - DNA, 91 bp, Homo sapiens
ggccgcatctcctttgagctgtttgcagacaagtttccaaagacagcaggaaactttcatgctctgagcactggagagaaaggatttggct

SEQ ID NO: 6790262 - DNA, 86 bp, Homo sapiens
gcgtggtggggaatgggaggtgctcaagagggcatcctctctgaaaggggtgacagccgcttggcgctagctaattattgccacgt

SEQ ID NO: 6790263 - DNA, 78 bp, Homo sapiens
gcaaagtaaggaggcagtcattatcaggtgccggcgtgcactggtgcggctgagagtgagtgtctccgtaaattttgc

SEQ ID NO: 6790264 - DNA, 60 bp, Homo sapiens
gagggcccactatgtctgagcaaagcccttcacacagtgtacagcaccgagtaggccctc

SEQ ID NO: 6790265 - DNA, 95 bp, Homo sapiens
attttagtctttcttctctttagacatctcattgtgtaacacctgaacaatcagtttttgtatttttagatggaagagatagcagagcatagagt

SEQ ID NO: 6790266 - DNA, 95 bp, Homo sapiens
aactgtagtattaggttggtgcaaaagtaattgcggtttttgtcatcactttcaatggcaaaagccccaattacttttgcagcaactatatagtt

SEQ ID NO: 6790267 - DNA, 56 bp, Homo sapiens
ccctgatacttgggaaatctagcagatatagagacagtgacccaggtatccaaggg

SEQ ID NO: 6790268 - DNA, 59 bp, Homo sapiens
tcacctcttttttaacaggcttccatccttatctcagtgaccagcctgggaaggagtga

SEQ ID NO: 6790269 - DNA, 71 bp, Homo sapiens
gtcatgcatgcaaatgtgctaatctgaatccttgaaaatggcttcagatttatgccattgtaatcgttgac

SEQ ID NO: 6790270 - DNA, 65 bp, Homo sapiens
gccataatagagtgtgaggaatagcagcaaatgtttatggagcccttcctcaccacctgacaggc

SEQ ID NO: 6790271 - DNA, 130 bp, Homo sapiens
ttttattattactgtattgaacttaaggactgtcctgagccagactgtcagagaggactgaggtatctggggaggtatctggggaggtatctgtagtctgactacatggggcagcttcagattaataaga

SEQ ID NO: 6790272 - DNA, 88 bp, Homo sapiens
atcatttttcccaaatgttttgagtgtaagaatgctgtttccttttctctcaggtctacatatctttactcatcatctcaaaggtgat

SEQ ID NO: 6790273 - DNA, 93 bp, Homo sapiens
atctgagactaccttattgcaaccaggtggtgatgtctgagaggaacttaggatttattacaagccatggtttaaaggtaaaagatttcagat

SEQ ID NO: 6790274 - DNA, 57 bp, Homo sapiens
tccatcatttgtcctggaaagacagccagccgggcggtacccaggtggaatcgtgga

SEQ ID NO: 6790275 - DNA, 56 bp, Homo sapiens
aggctcatctgagcagaaacctgagctaacagcaaagagaactgtcttgatggcct

SEQ ID NO: 6790276 - DNA, 75 bp, Homo sapiens
attaccttccgaaggtcggtctggagttgtcgaagaattaattccagctgattgactttcccggtcagtggtgat

SEQ ID NO: 6790277 - DNA, 59 bp, Homo sapiens
gtaattagtctctggtccctgagacaccaaccacgtgctggcacatagagactggctgc

SEQ ID NO: 6790278 - DNA, 77 bp, Homo sapiens
ttaaatattggaaaacacaagtgactgagcagtatggtcactttacagcttttcatatttgtgttatataattttga

SEQ ID NO: 6790279 - DNA, 64 bp, Homo sapiens
tcaccttaacaatctgaccatctcatttaacctcctcatgtagctgtctcagatgttagggtgg

SEQ ID NO: 6790280 - DNA, 97 bp, Homo sapiens
gggtgtctttcagagcagttgtgggcaggcagcccttgaatggctggtcatgaggccttttcatgacaatggtagcctgttaacttgagagactctc

SEQ ID NO: 6790281 - DNA, 86 bp, Homo sapiens
gcaggacaggggcctggggtgagactcctgggaagcacatgggcaacattagcttccaggtcattctcaccctgccctcttcatgc

SEQ ID NO: 6790282 - DNA, 63 bp, Homo sapiens
gccaggattgggaagccctcatcttagctgtgtccaggggagagtcctttccagttccctggt

SEQ ID NO: 6790283 - DNA, 77 bp, Homo sapiens
ttcctcccacgctcacccctacctcttcctgcactgagtgtccctgtgcattttgaggctgggggagcaggatggaa

SEQ ID NO: 6790284 - DNA, 86 bp, Homo sapiens
ttctaggatttttatttacccgagtgaaaccttaagtctctgagacatcctgaactttggtaatttactgggaataagaccttaag

SEQ ID NO: 6790285 - DNA, 67 bp, Homo sapiens
ctagtgtctcttctatttgagactatttctacaagcagaaaaactcaaatcagggaggaggaattag

SEQ ID NO: 6790286 - DNA, 90 bp, Homo sapiens
ggagccccaggtgggttaaggggagtgggcttattggacatggaacccttctgtctgcatacccctttagcagagtcagcttggggctcc

SEQ ID NO: 6790287 - DNA, 63 bp, Homo sapiens
ctgggcacagaccccctgggcctcctgcctcttgacctgagtgcccaaagacctgctgcccag

SEQ ID NO: 6790288 - DNA, 68 bp, Homo sapiens
ctggtttagtcataatggagaaatgtccttcagttgcatgatgctcttcctatgaatgaggaaaccag

SEQ ID NO: 6790289 - DNA, 57 bp, Homo sapiens
gtttctcgaaagttgagaaaatcagtttcctcttctgaggaactcacttagagaaac

SEQ ID NO: 6790290 - DNA, 128 bp, Homo sapiens
gggccaaggagagaaattcactggcttaatgcagctgcccaagccccagatgtcagtcagttgatgcactgggaatgagggcagctttacctggagccagtcacagtgttgccaatctcctgggacct

SEQ ID NO: 6790291 - DNA, 81 bp, Homo sapiens
tgcttcgcggcctgatcctgtctccgcaccgtgttgctaggtgattctcaacaccgcggggtttagggaaacatgggggca

SEQ ID NO: 6790292 - DNA, 63 bp, Homo sapiens
ccttgtgactaacttacaccattacacatactttgcttctgatggttaagttctgtcaaatgg

SEQ ID NO: 6790293 - DNA, 70 bp, Homo sapiens
gcccacaagatggtcacataagtgcagctgctgtggttttgctgcaggtttctgtgatcgttttgtaggt

SEQ ID NO: 6790294 - DNA, 61 bp, Homo sapiens
tctctctgcatgacttcagttaggtcttttcttccaaagaaaagagaatcctgtacagaga

SEQ ID NO: 6790295 - DNA, 58 bp, Homo sapiens
tccctaggaatttatattggaaccaaagaatctggcaatccagtgtctctctggtgga

SEQ ID NO: 6790296 - DNA, 74 bp, Homo sapiens
ggatgactgctttttgtaggtcccagaggcaactgttcatagatctttttggtagccaacaaaatgttgtctcc

SEQ ID NO: 6790297 - DNA, 59 bp, Homo sapiens
gggccattgtaagtttggaaagctcttgaatcagagtatagtctcaaaaataatggctt

SEQ ID NO: 6790298 - DNA, 66 bp, Homo sapiens
tctgtgacctgtgcagttggtccagcaggacagtttcagggtgctgaccaatttcagaggtgcaga

SEQ ID NO: 6790299 - DNA, 60 bp, Homo sapiens
tagcactttagcattggtttacacccatgctcttggggtcttaccatacctacagtacta

SEQ ID NO: 6790300 - DNA, 79 bp, Homo sapiens
agcaatggaattgtcttggccagtgagaagggccttttccttcacgatggctgagacggtattttagttttctattgct

SEQ ID NO: 6790301 - DNA, 88 bp, Homo sapiens
tcacctctaaactccatgaagatagctgcacaggaagtaagatttaactaggggttgaatcagtgacagttggatggggtggaggtga

SEQ ID NO: 6790302 - DNA, 58 bp, Homo sapiens
gtagaccatttatctggggagttttatctatgggaacaatccagatgatatggattac

SEQ ID NO: 6790303 - DNA, 66 bp, Homo sapiens
gcctggggcagggagagaggcagagagtgagttccttgagcccagcttctcctcccgctcccaggc

SEQ ID NO: 6790304 - DNA, 76 bp, Homo sapiens
taagttgatttctgatacaggaaaaggagaatctactacttacgctccttggctgtcttgtgtgggaaacaatttg

SEQ ID NO: 6790305 - DNA, 79 bp, Homo sapiens
tcaatttgtcctttaaatggatgttcaactgattaagagaagctaatcatcagttacgaaatccataaggcacagatga

SEQ ID NO: 6790306 - DNA, 103 bp, Homo sapiens
ttctgctatagtcagacactatttttttgatggcatcagacatatgtatgtgttgcaagatgctggtttcatgataacatagtagctggagacaatagtagag

SEQ ID NO: 6790307 - DNA, 61 bp, Homo sapiens
ggaattgtctagtactcacggccactatgactctaaggtgatatgagttcattagacttcc

SEQ ID NO: 6790308 - DNA, 99 bp, Homo sapiens
taccctacaaaggtttcacctttggccacttcatagatcattggctaatgttgagtcagttgtctatccgtggttcaattggttataaccggaggggta

SEQ ID NO: 6790309 - DNA, 93 bp, Homo sapiens
gttttcaatataattgatgtgattgttagtttatataatgtagtttttaataatggctgtatttaacaactggctcacaaaattcttgaaaat

SEQ ID NO: 6790310 - DNA, 66 bp, Homo sapiens
aaccccctcacacccatgcttctgaggctctgagtgcagagactgagtgccgggtgggaggaggtt

SEQ ID NO: 6790311 - DNA, 67 bp, Homo sapiens
ggtcaacatagttttaggtagaaactggctctttgaagccattcaaacctgagcctattggttgact

SEQ ID NO: 6790312 - DNA, 72 bp, Homo sapiens
gatgccagtagcacactgtcttgattactatgggtttgtaagaagtcttaaaattaggtagtgtttgtcatc

SEQ ID NO: 6790313 - DNA, 76 bp, Homo sapiens
aattcctgtgacaagtctgaacattctggttgtaatttcagaggcctctgttgttcagacgtgttaagaatgagtt

SEQ ID NO: 6790314 - DNA, 68 bp, Homo sapiens
gaggtaacatgtatggagcatttaccataggccaagcactgttctaagaacttcggacatgttatctc

SEQ ID NO: 6790315 - DNA, 79 bp, Homo sapiens
cctcatcgtgttgtttctttgcttgttttagtttcttctatgtgtgctaagcattatggtaaagaagtaaatgatgagg

SEQ ID NO: 6790316 - DNA, 118 bp, Homo sapiens
tttgcaggtaggcagtaaactataatagctatggtggaagaggctcaggaattaattgagtagtttcaaatcctgattctgccactactagcctttgaaatgctttgccacttgtgaa

SEQ ID NO: 6790317 - DNA, 57 bp, Homo sapiens
gctccttctggctcccttttggctgggccattcggcttggtgggggtgagagagagt

SEQ ID NO: 6790318 - DNA, 81 bp, Homo sapiens
ccaggaggcctggcctttgctggccctcaggctgagggctgctccagctggtctgagtgggcaggggccgggggctgctgg

SEQ ID NO: 6790319 - DNA, 74 bp, Homo sapiens
ctgttcctctctaggtgcagtcactgctcctgattgaatgaggttggatgagatcacttagggagtgtgaatag

SEQ ID NO: 6790320 - DNA, 56 bp, Homo sapiens
aatactctagggcagtgcttctcaactaaggagaattgtgcttcccaggggctatt

SEQ ID NO: 6790321 - DNA, 64 bp, Homo sapiens
ctgaatctaccttattcgatatttaaaagaatgttttaaatgtactattatgaggtgggggtag

SEQ ID NO: 6790322 - DNA, 55 bp, Homo sapiens
gcagtcaccatctgacagttttcattgctatcaaaaacagtcaaatgttgattgc

SEQ ID NO: 6790323 - DNA, 129 bp, Homo sapiens
ggaccccagaaagcagtctgctctcagtttttactacagggcaatgggatgtgctgggctagtactagttgaaggacatcctatttctagaagagactggaacagagcctgggctgttctggtcagttc

SEQ ID NO: 6790324 - DNA, 86 bp, Homo sapiens
taccctctagggtaccagggaaggctgttgatggggaggtgtgtcagtggagacaccctgctacaaagcctcctggtgagggggtg

SEQ ID NO: 6790325 - DNA, 65 bp, Homo sapiens
atgagatgatgtgcatgaatgtgcctatgctaaagcaggaggctgctttattcacaatagctgat

SEQ ID NO: 6790326 - DNA, 73 bp, Homo sapiens
cctggatgtctagtacttgctcttgaacaggcttagacacagctcctcaggaagctcttgctgattctccagg

SEQ ID NO: 6790327 - DNA, 113 bp, Homo sapiens
tggctaaaactaggggcgcaacaggagctgatccccagggcaggcctcccgcagcaggcaaacctgagatctgggaagggcctgcccttcctccctgcggccctggtgagtca

SEQ ID NO: 6790328 - DNA, 73 bp, Homo sapiens
aactcatttgtcagtgaatggatttctttgagtcaaagatgttagagagaggtttatttactccatctgtgtt

SEQ ID NO: 6790329 - DNA, 65 bp, Homo sapiens
accagcctggccaacatggcaaaaacccatctctaccaaaaatacaaaagttagccaggtatggt

SEQ ID NO: 6790330 - DNA, 61 bp, Homo sapiens
ttacagcatttaatgagatctggcattttataccccagatcaaagctacagaatgctgtaa

SEQ ID NO: 6790331 - DNA, 86 bp, Homo sapiens
tgttaccaacaccaataacttgtacactctggagacgttcattgaatgtttcatgactgagcaaaatttattattgttttctgaca

SEQ ID NO: 6790332 - DNA, 76 bp, Homo sapiens
gggcagttgaagacttaattctgcaagtgtagcaatctggatgatctgaaagtgctgagtttaagggtaattgctc

SEQ ID NO: 6790333 - DNA, 111 bp, Homo sapiens
gaattatgacctgccatgggcagtatttttcagttaggagcttataaatatctcaagggcctgaagaaatgactccaaacagaaaacgaataaaccctacaggaatacttc

SEQ ID NO: 6790334 - DNA, 66 bp, Homo sapiens
tgggtgctctgcgaccgtagggagcaagtctgccttgttcattcctgcctcgcggcacagcaccca

SEQ ID NO: 6790335 - DNA, 59 bp, Homo sapiens
tcagctctgtgtacagttagcattaggctgttccaatatgactgattgacatggactga

SEQ ID NO: 6790336 - DNA, 62 bp, Homo sapiens
ggggcaggacagacatggcggagcctgggccagacccccaggtgcagccctggacctgcccc

SEQ ID NO: 6790337 - DNA, 59 bp, Homo sapiens
ttggcactgcattgaccacaccctgaggaggcttggatctgggtggcaggcagtgtgag

SEQ ID NO: 6790338 - DNA, 75 bp, Homo sapiens
ttgtgcagtcaggaatagcatagagttaaaatgcaggaggtctgcctttgtattctcttggtatctactgtacaa

SEQ ID NO: 6790339 - DNA, 91 bp, Homo sapiens
ccaggctggtcccaaactcctgggctcaagcagttctcccgccgctgtctggcaggtagctggggctacaggcgtgtaccaccatgcctgg

SEQ ID NO: 6790340 - DNA, 65 bp, Homo sapiens
caaaaccaaatattctagggaatgttaggcaaggaggacttgtttgcattaattagaaggtagtg

SEQ ID NO: 6790341 - DNA, 59 bp, Homo sapiens
tgtaccatgcttgagatacagtgaatactaagtatttaatgaattaaggcatgagtgca

SEQ ID NO: 6790342 - DNA, 92 bp, Homo sapiens
gccaagatatgattctggacactcttgataaagctgtgagttactatatttatgtcacatttgtgttttattagagaaagttatatcttggt

SEQ ID NO: 6790343 - DNA, 65 bp, Homo sapiens
gattgtggtggaggaagtgcagttctactacagcaaaagttgagttagaaattcctgccacagtt

SEQ ID NO: 6790344 - DNA, 55 bp, Homo sapiens
caggcttccgccaggtttccagtatccaggctgcagggagcctggcaggggcgtg

SEQ ID NO: 6790345 - DNA, 95 bp, Homo sapiens
agctgtcttccatctcatagggatagggctctgactcatttctatttctgcagctctttggtcaggagctcttccctggtgtgactagaatagct

SEQ ID NO: 6790346 - DNA, 98 bp, Homo sapiens
ctgactttgcccaagctgtaggttattctgttccagtggttctcagccctagctgcacatcaggatcacagaaacttttatagcttctccggaatcag

SEQ ID NO: 6790347 - DNA, 56 bp, Homo sapiens
atgtctgtctttgtactccacagtgcctagggcagtgctgggtacacagcagacat

SEQ ID NO: 6790348 - DNA, 55 bp, Homo sapiens
aatcatgtgggatagtctgctctaaatcatgtttagagcagactgcctctagatt

SEQ ID NO: 6790349 - DNA, 74 bp, Homo sapiens
cctaccagtaggaggccagagatgaggctttagagcaaagagatttctgtagtctgacctaaggaattggtagg

SEQ ID NO: 6790350 - DNA, 63 bp, Homo sapiens
gctccccagcccccatgctctaagtgtaggctatgattaacagcttcaccatgggactggagc

SEQ ID NO: 6790351 - DNA, 77 bp, Homo sapiens
aggcttggctctaggaaccaaagtgatttgttcttgttccaacctgggctttgtgactttggttagtgccactacct

SEQ ID NO: 6790352 - DNA, 65 bp, Homo sapiens
acaattggcatgaggtctatgaatatgtagttcacaggtatttttcatatttctcttgctattgt

SEQ ID NO: 6790353 - DNA, 56 bp, Homo sapiens
accatacttagatggatgcccctgctcggctgcagagcagtctgcctctgtgtggt

SEQ ID NO: 6790354 - DNA, 69 bp, Homo sapiens
cctgcacatgtccctaagtgtcagctcctccccattatggtagatgaattactggcacatgtagccagg

SEQ ID NO: 6790355 - DNA, 61 bp, Homo sapiens
ttgttaggtattcagtcagtcctaattagcagttctgaaatcaattttgattatctgacaa

SEQ ID NO: 6790356 - DNA, 75 bp, Homo sapiens
ataaccgaattctgtcacttaggaggtcataaaatcagacacagacatgtgacactgaatggcagaactagttat

SEQ ID NO: 6790357 - DNA, 96 bp, Homo sapiens
gcagtatctgaggtgttgatgaaacagcaggaacatcttgccagtggtcacttttatctcccactggtctttgctgttgcatttcttatgtgctgc

SEQ ID NO: 6790358 - DNA, 81 bp, Homo sapiens
ctgagttcagctgttcttccagttgggggacagatgtgtgtttctctccctcagtccctggacaggcacaactgctctcag

SEQ ID NO: 6790359 - DNA, 58 bp, Homo sapiens
cacccttgaagtgaacttgagggcccagccccaatttcaggctgcatctgtaagggtg

SEQ ID NO: 6790360 - DNA, 129 bp, Homo sapiens
aggagcctccccagcccaccagagagcctcgggtcccaggcaggccactggcaggccactgacagtccctgggctttgcctgtgagttaagccgggagttgagtaattgctggctgggttctggctcct

SEQ ID NO: 6790361 - DNA, 80 bp, Homo sapiens
catggaatttacccgagatgggataaatataattttgtgttttttaacagaataaggtttatctctccacagtttccatg

SEQ ID NO: 6790362 - DNA, 85 bp, Homo sapiens
agagagagagttgtacatttgcttatgtacaaggcgatttcttcagatgtcgccccagatgcaagacaaagaacagtctctctct

SEQ ID NO: 6790363 - DNA, 81 bp, Homo sapiens
gagtagcatgcagtgaaattgatatccagttttttaaaactttcatatgaattggtatgatgatcactagcagatttattc

SEQ ID NO: 6790364 - DNA, 57 bp, Homo sapiens
gcagtcaatgggactgccctgtttttacctaatagatgttttctcctaattggctgc

SEQ ID NO: 6790365 - DNA, 76 bp, Homo sapiens
gggcctcatcagtcagtcaacgcagttttctccatctcatagccaaggagactgagactcagatctgcccctgccc

SEQ ID NO: 6790366 - DNA, 76 bp, Homo sapiens
tccatccattcattagagattataaaatgatgacattctgtgtctatcatttcttcttctcttactggttggagga

SEQ ID NO: 6790367 - DNA, 80 bp, Homo sapiens
ctccctggtcttggcctctgtggctcagccttgctctggtctgcctgagtgcaggggccaaggggcacagggccagtgag

SEQ ID NO: 6790368 - DNA, 57 bp, Homo sapiens
agaagctggggtcacttatccttgggaaggaacaggattgagacagagaccagttct

SEQ ID NO: 6790369 - DNA, 106 bp, Homo sapiens
catcaaatccttactctgtgcaaatggcttagaagatataagatctagaagtaacatctatctgagtgtcttaataggctcttcaatatgaataagttctatgatg

SEQ ID NO: 6790370 - DNA, 59 bp, Homo sapiens
tcaaactgaactaagatccaactgtccaatgaactcatgagctgggttttagggtttgg

SEQ ID NO: 6790371 - DNA, 86 bp, Homo sapiens
ggcaacaagaaacagagttcttaaagcccagatgataagggcctcagtctgggtgtgaatgaacttggcctgacttctttgctgcc

SEQ ID NO: 6790372 - DNA, 81 bp, Homo sapiens
ccactctacccatgaggatgagtttggtcctggcttgcaaggttgctgcaagacctgccagcctcatcctggtagcaaagg

SEQ ID NO: 6790373 - DNA, 87 bp, Homo sapiens
ggagtcttgctctgttgccaggctggagtgcagtggcgcaatctctgctcactgcaacctccacctcccgggttcaagcgattctcc

SEQ ID NO: 6790374 - DNA, 72 bp, Homo sapiens
ggtggtgccatgtgattccattaggctgattgatgacaacttctctctcagtttgaattatgtggcaacccc

SEQ ID NO: 6790375 - DNA, 65 bp, Homo sapiens
gcacagagatcggaacagaagtagagaagtgaacctctgtctcctgcccttctgactctctttgt

SEQ ID NO: 6790376 - DNA, 59 bp, Homo sapiens
gctgtggctgtccaaggccttcacgcctctgcactccaggaggcctctggactggcagc

SEQ ID NO: 6790377 - DNA, 56 bp, Homo sapiens
attgagctatttcttgtatacagtaaagcacacaaactgtacatatagagctcagt

SEQ ID NO: 6790378 - DNA, 65 bp, Homo sapiens
tcttgtttttcccatagtgttgcagccttctctgagccacactgctgtatcactgctgaacaaga

SEQ ID NO: 6790379 - DNA, 93 bp, Homo sapiens
ctgtgcaccatttctagaaatccgttgcaaatgtttcataacagtagcagcttgttcaccctttatggaatatttgtaggaaagaaggtacag

SEQ ID NO: 6790380 - DNA, 57 bp, Homo sapiens
ggcggggaggctggcgagaggcttaatgaaactgctaacgcgttagtgattcctgcc

SEQ ID NO: 6790381 - DNA, 62 bp, Homo sapiens
ctgcagctgctcatgttacttgtgggagtggaatagccaggagttgctaaatgcggcttcag

SEQ ID NO: 6790382 - DNA, 58 bp, Homo sapiens
ggtctcttgtggtttataaagatatattttatgtcttttatgattacgggatgatgcc

SEQ ID NO: 6790383 - DNA, 62 bp, Homo sapiens
cccatttatttaagtaggtcttgccttaacggaaagggagtctatcttctcaaataagtggg

SEQ ID NO: 6790384 - DNA, 58 bp, Homo sapiens
ggagtgggtgccaagcgggtgcaacaggctcctggctgctcttcttggcgacctcttc

SEQ ID NO: 6790385 - DNA, 69 bp, Homo sapiens
tcccaggtgggggcagggcggtcctgcgtcacggctgacactgcaggcttgcccggcctccttctcgga

SEQ ID NO: 6790386 - DNA, 59 bp, Homo sapiens
tttgacttgatggcttacatccaaaatgatgtcatacatgcttgagctacatggtcaaa

SEQ ID NO: 6790387 - DNA, 69 bp, Homo sapiens
gggcaggccctcgtggtgagctgggatcacagacatttgttgagttcctgccatagcgaggaactgttc

SEQ ID NO: 6790388 - DNA, 61 bp, Homo sapiens
aggaagagtgttacctatgggtaccttgtagttcaggaaggacctgggaaaaccttttcct

SEQ ID NO: 6790389 - DNA, 59 bp, Homo sapiens
gagttacttggttcaactagaatgtgaaaaatgtgcatattctatggaccagtatattt

SEQ ID NO: 6790390 - DNA, 100 bp, Homo sapiens
aatctactgaaaaacactggcatttagtttaaggccttgtttaaatgtgaatttacttggaaaggagtttttagctatttttagtcagtgtgagtggatt

SEQ ID NO: 6790391 - DNA, 69 bp, Homo sapiens
gaagccactatactctgacttttcaggcctcaaccttgacatttgctgtttagcagtagagtgtgcttc

SEQ ID NO: 6790392 - DNA, 68 bp, Homo sapiens
ctacttgagccattttggtaatgataacaatttgataaaattaaagtcataagagtggatccgagtag

SEQ ID NO: 6790393 - DNA, 85 bp, Homo sapiens
gggtttccaagaatacttaaataattgctgctattccggccctcagattggcggtttgtttgagtaatagctctggcatgaaccc

SEQ ID NO: 6790394 - DNA, 85 bp, Homo sapiens
tagggctttaccccatagggcctgctggtgcttccattgagacatccactctcacaacaggaaggaccagctggcctcagctctg

SEQ ID NO: 6790395 - DNA, 55 bp, Homo sapiens
tctgttttgtgaattgtttctttggatttttccgattagctctttataaaactga

SEQ ID NO: 6790396 - DNA, 59 bp, Homo sapiens
agatcgtttctaaacctaagattctacttttctataattctctggttctgaaatggttt

SEQ ID NO: 6790397 - DNA, 78 bp, Homo sapiens
ggctactgagtgctagcattagtatataagagtaccttatactcttatatactgtggtagtactgtattacagtagtc

SEQ ID NO: 6790398 - DNA, 81 bp, Homo sapiens
gcccactctgtgcttgttgaagatggtgtcttcttgatttcacttatttgcctgaagccacccaataagtcagtagtgggc

SEQ ID NO: 6790399 - DNA, 75 bp, Homo sapiens
acaagagttcctatactgggtcagtcctttgcatacaattaagggggtctataaacttatatgggaaaaacttgt

SEQ ID NO: 6790400 - DNA, 75 bp, Homo sapiens
ggggtggccccccttcccggtttacatattgtatctatgtaacgttttgtatattccagagggtagggccgcccc

SEQ ID NO: 6790401 - DNA, 68 bp, Homo sapiens
gtgcaggcaggagaggaggatttctggaatttctaaagttggcaggagtctgcctgttctacctgtgt

SEQ ID NO: 6790402 - DNA, 86 bp, Homo sapiens
tgagctccaagaagccaggcactgtgcctcgctccctgctgcaaactcagcaccgggcacggtgtctggtgcagactagatgctca

SEQ ID NO: 6790403 - DNA, 92 bp, Homo sapiens
tagacaatggggaggagttgttctgcaggagagaaggggacagtccttcctccagcctggagcacttcctgcaccgctccccaccccgtcta

SEQ ID NO: 6790404 - DNA, 66 bp, Homo sapiens
gcatgtatccatgtctgcatgtccaaaatgagtgtgtgtcattgtgcatgtgtttcatggatctgc

SEQ ID NO: 6790405 - DNA, 61 bp, Homo sapiens
tactgttatttcttcctgtccttcaaacacccctgcaagacagacaggaaggctaccagta

SEQ ID NO: 6790406 - DNA, 65 bp, Homo sapiens
tttacctgtttctgaaccactaaaggcaattcgtgtctgtttcagctggtttaggaaaaggtagg

SEQ ID NO: 6790407 - DNA, 74 bp, Homo sapiens
gtagcagaggtaagggaaatacaattcactctttgtatggagaggaggtggtgatgctttaaccttcctgggac

SEQ ID NO: 6790408 - DNA, 67 bp, Homo sapiens
ggcaaagaattcacttgacatttgcatagcactttgtatgtgtaacatcacagtgatgtttgatgct

SEQ ID NO: 6790409 - DNA, 63 bp, Homo sapiens
ttcttaccatgtgagaaacaaacaaacaactaacaattgtgtgtttggcaagcgtgttgagaa

SEQ ID NO: 6790410 - DNA, 60 bp, Homo sapiens
caccgtggaggagctggagggctctccactgtcccgatccctggagctgcttgcatgttg

SEQ ID NO: 6790411 - DNA, 56 bp, Homo sapiens
gccccaggataaatttgtaagatgcttgaggagcaatgcaaacattacttgggtgt

SEQ ID NO: 6790412 - DNA, 88 bp, Homo sapiens
gtaaaataagcgaagatcaatggttgaaccctgtcatgagtggggtattcgatcatgcaggtttccagccagatttttagaaatttgc

SEQ ID NO: 6790413 - DNA, 76 bp, Homo sapiens
ctgtggtggcagtgagaaggagaggtgtaggctcttctttcgtgcttttcttcctccctcctttctgtctctgtgg

SEQ ID NO: 6790414 - DNA, 72 bp, Homo sapiens
acactttttatcttttttctagatgtactaattggagatctagagtggaatgtagaaaaaagatgttggtgt

SEQ ID NO: 6790415 - DNA, 76 bp, Homo sapiens
atatgctcagagaaatataaagttccatgaaaagggagtagagaaaatgaagactggcataattctctgaggatat

SEQ ID NO: 6790416 - DNA, 80 bp, Homo sapiens
gctcccacagccttcagggctgcccagtgtgagagctgctgtgagtctatatgggtagcttggtttctctgattgggagc

SEQ ID NO: 6790417 - DNA, 110 bp, Homo sapiens
gagaggaacatgcttctggatttagttggcattttgtgactacggctgctaattgctaaatggcttggctggtttgacaaactgacaatgatccatgtatttaaactctc

SEQ ID NO: 6790418 - DNA, 81 bp, Homo sapiens
gattttcgaatgctttgaagtttaacttgctggacattttagcttgtgtaagttatattaaaatttcagagctcagaaatc

SEQ ID NO: 6790419 - DNA, 60 bp, Homo sapiens
gactgaaagcttggaatgttcctatatcaattttaataaggagaaattccctttcaagtc

SEQ ID NO: 6790420 - DNA, 62 bp, Homo sapiens
ctttcgcctctgggccatgttgtcagcgaagtacttaagcacaggggctccgaaggtgaggg

SEQ ID NO: 6790421 - DNA, 55 bp, Homo sapiens
cagagttgctgttggagcagtgagtaaaccagcttactaatttatagcaattgtg

SEQ ID NO: 6790422 - DNA, 64 bp, Homo sapiens
tgattctgtttactcagaaatacaacgttattaaaatgttgttcttttgcttagacagatagca

SEQ ID NO: 6790423 - DNA, 55 bp, Homo sapiens
ttccagttggagcctgcctttatccctgacgtactggattggcttcctgctggaa

SEQ ID NO: 6790424 - DNA, 78 bp, Homo sapiens
gggtgggcaggtggtcttggcccacccaggagtggcagcatgggctcttacctggacagggccaggccatgctcatcc

SEQ ID NO: 6790425 - DNA, 129 bp, Homo sapiens
agagaaattcctctgtcctctgacttcttcacttagtacgctgcgaccttcccatgttgttcaacatcctcaactcggagcgtcactggctggaggtggtctataaatggaattggcttaactatctct

SEQ ID NO: 6790426 - DNA, 69 bp, Homo sapiens
caggactgcatatgatagatgccttgcaataatttcccagcaaggaaaatatcatgttagtgattcctg

SEQ ID NO: 6790427 - DNA, 99 bp, Homo sapiens
gcctgttgcaagtggagaggcagccctgagataggactctgctggctcagccctcctcctgagtcttgatgcctctctcctcattgcttccactcaggc

SEQ ID NO: 6790428 - DNA, 57 bp, Homo sapiens
tgtattgaattgtgttatatctgcttatgtgcaatgataaaagatacaattcagtca

SEQ ID NO: 6790429 - DNA, 72 bp, Homo sapiens
gagagcctatttgtggagtcattgaatgtacccccacagacctgtgtccatacaggcagtggctctgctctc

SEQ ID NO: 6790430 - DNA, 94 bp, Homo sapiens
tgaatattagtgaacattagtgaacatcagattacatgagagcaaatcttctcgagagctctaatagtccgtgatgtactggttcatccattca

SEQ ID NO: 6790431 - DNA, 130 bp, Homo sapiens
agattgtgccattaattgagggagcatatataaagaggagtacatttaagagggaatatggtgaattcagatttgaatattcctttcggatatgcacagtttttcccaaaataaaaaaatggcccaagtt

SEQ ID NO: 6790432 - DNA, 60 bp, Homo sapiens
ggctgctcacgcagccctccctgtggcctgttctccaggagatggggctgagtgacagcc

SEQ ID NO: 6790433 - DNA, 65 bp, Homo sapiens
tcaaagtgctctagaaattgtcagtggtttacatgaagtggccacgggtgtctggagcaccctga

SEQ ID NO: 6790434 - DNA, 60 bp, Homo sapiens
cattttcttaagccagctattctcaaggcctcaaaatagctgccattgctccaggaagtg

SEQ ID NO: 6790435 - DNA, 57 bp, Homo sapiens
ctttcctaatcagacaccagggcaaatgggctgacccatggtctgatcataggacag

SEQ ID NO: 6790436 - DNA, 83 bp, Homo sapiens
ctttcagtacatgactacttggaatgttttaacctttcctttaatgagccattaagatagaacccagtagtctttgttgaagg

SEQ ID NO: 6790437 - DNA, 82 bp, Homo sapiens
ttctctctccggtactttaagactccagtagcaaatcttaatgttgtgctttgggtgtgaagtgtttgctgcagtaagagga

SEQ ID NO: 6790438 - DNA, 74 bp, Homo sapiens
cttaagtctagtatccttcttgactttgaaagtatcttccacttctgaaagtcaggaaggatactagactgaag

SEQ ID NO: 6790439 - DNA, 58 bp, Homo sapiens
acgatgtgttggattacaaggtgatgcttcagtatcaccttgtgaggttacataatgt

SEQ ID NO: 6790440 - DNA, 65 bp, Homo sapiens
tgggagaactgagcaccactgatgttatgtaaggttatagaacatcatcctaattcagattccca

SEQ ID NO: 6790441 - DNA, 57 bp, Homo sapiens
tctgacaataactgagtttaactgagtttagacagtttaatttagttcttgtttaga

SEQ ID NO: 6790442 - DNA, 112 bp, Homo sapiens
ctaggcccatgaaatagatgagcatttaatgagcatattgaatcaacttgtgggtgtgcgtctctttgcagcaagctgtgatttatgtgaattttgaagccatgggcaaaag

SEQ ID NO: 6790443 - DNA, 67 bp, Homo sapiens
ctcagaggtgtatgagggtgagaaggatgaagatggattcctgtacacggtctatgcctcccaggag

SEQ ID NO: 6790444 - DNA, 76 bp, Homo sapiens
agttcaagagtaactaatttcaggtctggcaggatccagagtctgaaataatgtcactaaggtttaacttgtcact

SEQ ID NO: 6790445 - DNA, 69 bp, Homo sapiens
atgtgatatgcacatacaatggaatcttatttgactgtaaaaatgaagttccagtatatgcagtaacat

SEQ ID NO: 6790446 - DNA, 82 bp, Homo sapiens
ttcagaaatgttttcaagcatctggggcattgctatggttacaactacaggcctacgaagtcaggtgcgagaactgcttgga

SEQ ID NO: 6790447 - DNA, 94 bp, Homo sapiens
gaggagcagctacatggactgtgttcacacttacaaatgtcttttcccagagatgttggtaaatctagagcttagctacattggaactgccttc

SEQ ID NO: 6790448 - DNA, 76 bp, Homo sapiens
acaattatccttttggcatctgtctctgcttgtacttctctgcaatcaattggctcatgtatgaaagggtgtgtgt

SEQ ID NO: 6790449 - DNA, 123 bp, Homo sapiens
tttaaaatttcattgttcccatgtctgcattcagatttagaatctaacattcttatctgcaggctgcaagattgtttagattctaaactttctgttggaggatggcgaagaatatattttaaa

SEQ ID NO: 6790450 - DNA, 101 bp, Homo sapiens
agacagaattgtttacttctgagtggctcagttgggtctcttgtttttcccagtaaccaagtctagcttggtcacttggagccccatgcagtcctttgttt

SEQ ID NO: 6790451 - DNA, 79 bp, Homo sapiens
cactctggagggagttaggacccggagcctatttttctctgtgtgcccttaattctgggcctcacttttttcatctgtg

SEQ ID NO: 6790452 - DNA, 58 bp, Homo sapiens
agccccacgttgtctagcacctatggctttactatcacctctctagtagtgtggggct

SEQ ID NO: 6790453 - DNA, 72 bp, Homo sapiens
ggcctctgtaccccacgtcttcctgtgctctccagctttggaggctgagaagacagtggggtggagacagcc

SEQ ID NO: 6790454 - DNA, 63 bp, Homo sapiens
gtggggtgtccagcagcgagctaggcaattctctgcattcagttccaaagctgggcagttcac

SEQ ID NO: 6790455 - DNA, 123 bp, Homo sapiens
aatttatattcctgtgcatgttttttacatcttgtctatgtcctggtgtcgaccaacgtggacaatgtaaatcaggatagcattagaacaaagcaagaaagatgtacagaggggaacggaatt

SEQ ID NO: 6790456 - DNA, 79 bp, Homo sapiens
acaactgtagactgcatgataataatagcagatctgattgcatggatctctgtgaaggtatgtgtgtgtctgcagatgt

SEQ ID NO: 6790457 - DNA, 70 bp, Homo sapiens
ccattgaaacagatgtacccatgtctcctcctttctctcttggggtgtaggtcttagcactgttagatgg

SEQ ID NO: 6790458 - DNA, 59 bp, Homo sapiens
gaggcagaggcagaccctgagaatgcgtgtgtcattttcaagggagaggcctctgaatc

SEQ ID NO: 6790459 - DNA, 70 bp, Homo sapiens
gctactcaggaggctgagtcgggaggatcacttaagcccataagttcaagaccagcctgggcaatctagc

SEQ ID NO: 6790460 - DNA, 60 bp, Homo sapiens
gcaagctgctcttatgtggaggtttctccccactctcctctgtatgggggtctggtttgt

SEQ ID NO: 6790461 - DNA, 103 bp, Homo sapiens
tttgggccagtttcttacattctttgggccactttagtttccttattgaaaaatggggataataatagtggctacatctcagtgtgattctgaggaaaccaga

SEQ ID NO: 6790462 - DNA, 56 bp, Homo sapiens
taaaaatcgtgggaaactagaacatgtatatacatttcaagtgactatggtttttg

SEQ ID NO: 6790463 - DNA, 71 bp, Homo sapiens
gataaccattagcaaaacaacttttctattgacaacagagcaaagaaaggtgtgtttgcagatgaattatc

SEQ ID NO: 6790464 - DNA, 64 bp, Homo sapiens
tgatgtgtagttggctatcatttgtttttaaaagtaaggaggaatacaatccagcagcacttca

SEQ ID NO: 6790465 - DNA, 58 bp, Homo sapiens
gcgataggaaagtaagatagctttatgtcatttgcaaagctcttttacaatcctaggc

SEQ ID NO: 6790466 - DNA, 58 bp, Homo sapiens
caaactgtatgaccctaggccggcaatttacctctcctggcctcagtgtccttgtttg

SEQ ID NO: 6790467 - DNA, 55 bp, Homo sapiens
ttgtgggagctatgtaatgagatggggagtttcatctaatgacatcctctgacaa

SEQ ID NO: 6790468 - DNA, 56 bp, Homo sapiens
ccatgtaactgtagctaaccgatgagagcaagctctcctcctagatacagtcatgg

SEQ ID NO: 6790469 - DNA, 60 bp, Homo sapiens
ggtgaagccagattatcacaagccatgaaaaccttctggaggtgacgtctgagctttgtc

SEQ ID NO: 6790470 - DNA, 75 bp, Homo sapiens
agtgatgtaaatcaagcagtgctggttttgtccagatgctttcgcgtcagccggcactgctgatttcaaatagct

SEQ ID NO: 6790471 - DNA, 62 bp, Homo sapiens
ccaggacctcatcagtcacaatgagatgttctccgacatctagaagatctgggagattgtgg

SEQ ID NO: 6790472 - DNA, 56 bp, Homo sapiens
ccaccaatatcctttgaaatgaaggtttatccttgacatcacagaatattgagtgg

SEQ ID NO: 6790473 - DNA, 65 bp, Homo sapiens
ctgggccaaatgtctgcataagttcaaagtctttcttttcatttccagcagcatatttgtctcag

SEQ ID NO: 6790474 - DNA, 74 bp, Homo sapiens
atcgagggacattaatcatttctgcattatctcactcaccagtagaatatgtaaatgtgattcctgtcaatgat

SEQ ID NO: 6790475 - DNA, 84 bp, Homo sapiens
tgtattagagtgaaaacctaatcatgcagttgttcatcctcattaatatggataagtcatgtgttcatctttcattctaattta

SEQ ID NO: 6790476 - DNA, 55 bp, Homo sapiens
ggccagtggaagggcaggggagtcaccccagggacagctctgaccgccacttgct

SEQ ID NO: 6790477 - DNA, 82 bp, Homo sapiens
cactaggagagttgagcagtgtctttcatatcctccatcgggtttactcatctgtgcaggtttaggaagcagctcctccgtg

SEQ ID NO: 6790478 - DNA, 56 bp, Homo sapiens
ccagggatgtggggcttgcagtgctaaaattgcaaatattccaggtacatccctgg

SEQ ID NO: 6790479 - DNA, 79 bp, Homo sapiens
ttatgtttattcctaaagtaatacactagaattttggattgctggccaatctcctgtgattttggtgaatatgacatag

SEQ ID NO: 6790480 - DNA, 99 bp, Homo sapiens
agtgctatttaaaatgcagattcatgagccccatacctgaaactcctgatttggaagatttgggctgaggcccagggatctccacttttaacaggtgct

SEQ ID NO: 6790481 - DNA, 58 bp, Homo sapiens
gtgagtggcggctctggggcgtaaacccagtcctggcaggctcctgggcctcactcat

SEQ ID NO: 6790482 - DNA, 58 bp, Homo sapiens
aatggcctggagggaatacagatacatacattgaagtttttgccttcccttggtcatt

SEQ ID NO: 6790483 - DNA, 82 bp, Homo sapiens
gacttacatgttttatagctgaaaacctaaggagtgacaatagtacatgtgacattcttaacagttaaaaactgagtaagtc

SEQ ID NO: 6790484 - DNA, 82 bp, Homo sapiens
tagaaacctttcaacagtctcaatgcagtcaggctcatttgatacgagttttatgattacaaaagattgtttgaagactctg

SEQ ID NO: 6790485 - DNA, 79 bp, Homo sapiens
gggtgtggactgagatgaggaagaatctagaacttcggcagaaacatctgaattagaacttttcaactccattccaccc

SEQ ID NO: 6790486 - DNA, 81 bp, Homo sapiens
ctcctgtgcacaacccccagggctgccgcatccctggtagcatctccttggcagctgggtgggctggccctgggcaaggag

SEQ ID NO: 6790487 - DNA, 55 bp, Homo sapiens
cccagcctggtagagccctttggggaaagcctcagagagttttcactagggtggg

SEQ ID NO: 6790488 - DNA, 87 bp, Homo sapiens
ggagttgggaaagggaagagatggggggtaagccttggattgtgactgtttactgggctgttccttatttctaccccacgtcgcacc

SEQ ID NO: 6790489 - DNA, 75 bp, Homo sapiens
acagtggaaggtggccctgagcatgacaatctctgagaccagcgttggaatgagtagtggccactgtgaccctgt

SEQ ID NO: 6790490 - DNA, 98 bp, Homo sapiens
gtgtgacagtcatgacagaggagctggaatgattctgtttttcagatctgttctttttctctctgcatttgaacgttgataaccctgacaaatcacac

SEQ ID NO: 6790491 - DNA, 76 bp, Homo sapiens
ttaggcggagaaagtgagtaacagctggatggagagaaacaacgggcttttctcccgctggctgctcttcccctgg

SEQ ID NO: 6790492 - DNA, 81 bp, Homo sapiens
gggggccgcagaggggcttgaggccctgatggccaaggaagacggagccaggggcagggccatgggcctcgtgtggccccc

SEQ ID NO: 6790493 - DNA, 71 bp, Homo sapiens
tggaaaaagagttctatgatctttccagccacacatgtgggaaggggtggagggagtggaaattcgagcca

SEQ ID NO: 6790494 - DNA, 75 bp, Homo sapiens
catagagcttgctgctctgccggtacagctgcacggtgctgaagaggctgggctccgggagcatgcggctctgtg

SEQ ID NO: 6790495 - DNA, 71 bp, Homo sapiens
cctggcgcggtggctcacgcctgtaatcccagcactttgggaggccaaggcgggcggatcacgaagtcagg

SEQ ID NO: 6790496 - DNA, 66 bp, Homo sapiens
ggaaacagtgagaacttttcctgaaaggggctgctccactgcagggaaatgttttcggtgtatttc

SEQ ID NO: 6790497 - DNA, 56 bp, Homo sapiens
atcttagagagtttttatatcctaaaaagatctttgaaggagaaagctttcttggt

SEQ ID NO: 6790498 - DNA, 60 bp, Homo sapiens
ctcctgccaccgcggtgtcctgcccctataggcctgagtaggagatccccggggtagggg

SEQ ID NO: 6790499 - DNA, 56 bp, Homo sapiens
ctatacattttaactccttttaggcgtctcagtgagaaggcatcagaagtgtgtag

SEQ ID NO: 6790500 - DNA, 89 bp, Homo sapiens
tgaactgaggtcactggtagatgcttaaggtgtacatatgtgtgtgtgactcagtacagttttcagtgttcactgaacacttcagttta

SEQ ID NO: 6790501 - DNA, 69 bp, Homo sapiens
tcagagaactttaaatctgatggtgtacatgttatttacttgttctatcaatttaagggaaatttctga

SEQ ID NO: 6790502 - DNA, 80 bp, Homo sapiens
aataaaatgtcttagaaatatggtgctgccgccgtatgtaaggtgcagggtggcagcaccatgtttccaagattagtatt

SEQ ID NO: 6790503 - DNA, 92 bp, Homo sapiens
tttgggaggctgaggcaggtggatcacgaggtcaggagatcgagactatcctggctaacacggtgacaccccgcctctactaaaaatccaaa

SEQ ID NO: 6790504 - DNA, 76 bp, Homo sapiens
tgcagggctgttcaggagggtgggttgtgcttgggcttgcatgcctctgacctccatgccctcctccatccctgca

SEQ ID NO: 6790505 - DNA, 111 bp, Homo sapiens
cctgaccttctccctggtgcccctttagcccctgcagagacttctgcctttccctaggatacatggttgctgggggtggcagagctagaaccagggtggtgggaaggcagg

SEQ ID NO: 6790506 - DNA, 63 bp, Homo sapiens
agggcagggcaaggacagatgctaccatccactgagccatagcattgatctttattctgcttt

SEQ ID NO: 6790507 - DNA, 67 bp, Homo sapiens
aggcactgcttctaagtaggaatcacactgcagtgggttagtgacaccctgctcagaaatggtgcct

SEQ ID NO: 6790508 - DNA, 62 bp, Homo sapiens
tgggctttgaagagattactgtgctcttggtgcaatccagggccaataaggtcttaaatcca

SEQ ID NO: 6790509 - DNA, 60 bp, Homo sapiens
cttaaggaaaagtctcttttaaaacataaatgatgtgttgggagaattctgttccttgag

SEQ ID NO: 6790510 - DNA, 87 bp, Homo sapiens
gcatgttcattcattcattcattcctcattatttactgaggacttaacaagtgccaagcatggggaggaatgatgtgatgattatgt

SEQ ID NO: 6790511 - DNA, 83 bp, Homo sapiens
agggtgatacagtgcaaataggactgtctttccttttgttgagggaaaagtctccccgttctatttgagtctgttctcatgct

SEQ ID NO: 6790512 - DNA, 73 bp, Homo sapiens
tgttaagagtcttatagtgtaattaaggggcccctcagtatttcttgaagtatattttatagggctctgaata

SEQ ID NO: 6790513 - DNA, 58 bp, Homo sapiens
ggtcagctgtacttgatgtttccattctacatggtgggctgtatcaagaagtctggcc

SEQ ID NO: 6790514 - DNA, 57 bp, Homo sapiens
ggattatgtttttagacttgaggattacattctgtcccttagtcttccacatagtcc

SEQ ID NO: 6790515 - DNA, 66 bp, Homo sapiens
gtaggtggcagcaggagatgtggaaacttggccattgaaaagttcctatttcctgatgcaacccac

SEQ ID NO: 6790516 - DNA, 60 bp, Homo sapiens
agcatgctggtgttcatggcaggatattaggatgaggagcctgctggaacatcagtagct

SEQ ID NO: 6790517 - DNA, 105 bp, Homo sapiens
cagtaataataccattcagatgtgcacagtatttgatagatttcaaaggactttttacaaaatcttatttgatcctgtcagcagtgttttgaggtattatccctg

SEQ ID NO: 6790518 - DNA, 55 bp, Homo sapiens
ccttggggaacttcagtattataagaaaacttataacactgatttgttctcaggg

SEQ ID NO: 6790519 - DNA, 59 bp, Homo sapiens
ttgtccagctgcagctgggcagaactcaaggagttgtggtcccccactgcagctgacaa

SEQ ID NO: 6790520 - DNA, 115 bp, Homo sapiens
ggatatgaaggaagtttgaagaaggtttatttgtagaatggattaagggattgaggtcaatctttccccttgtattttcattcataaaagtcacctcagccttcaacaagtattc

SEQ ID NO: 6790521 - DNA, 59 bp, Homo sapiens
ttgtttgtttttcccttggtgccaagcagagtatttagcacctgggattagatacccaa

SEQ ID NO: 6790522 - DNA, 62 bp, Homo sapiens
ggctggtgaggtggctggatctcagcctggcgggccagctgaggaaccagtccctgctagcc

SEQ ID NO: 6790523 - DNA, 63 bp, Homo sapiens
ggggccagatatcactaaggttccagatttctgattctgtgacctggggtgtatctggcaccc

SEQ ID NO: 6790524 - DNA, 58 bp, Homo sapiens
gattatggatggacagtggagccctgagttctaaatcagaatctgtccatttctagtt

SEQ ID NO: 6790525 - DNA, 67 bp, Homo sapiens
aaaggccaatgtatcaagaagcatcagtaaagggacagtctgtaattgatgacttgattacactttt

SEQ ID NO: 6790526 - DNA, 88 bp, Homo sapiens
atgttaatttaagtcactaagttttgggctgtttgttatacaacaataggtaactgatacaaaagcacttgggacatagaaaaagcat

SEQ ID NO: 6790527 - DNA, 73 bp, Homo sapiens
actcttgacgggtgaggatatgttgtttaaagttgtatagactgtgtcatattttttccaatttgtcaagagt

SEQ ID NO: 6790528 - DNA, 83 bp, Homo sapiens
gtccaatctctgccttactcatttttataaagaatacagttgtttctacagtttcttagatgattaatgatgggggattggac

SEQ ID NO: 6790529 - DNA, 67 bp, Homo sapiens
cattcctccacagtgagttctgtactctggtgactctagtttactggaactcactagttttggaatg

SEQ ID NO: 6790530 - DNA, 56 bp, Homo sapiens
ggaaggtcagagatggggagatgcccggcgtgcccttcctcctttctctgccttcc

SEQ ID NO: 6790531 - DNA, 64 bp, Homo sapiens
gctctagggtcctcatctgtaaatgagggcagtggtgttatttataagtgaggatccactgagc

SEQ ID NO: 6790532 - DNA, 78 bp, Homo sapiens
gcctataggaagtattcaaagactgatgagttcatatcaaaagatcttaggagccagcttgaaggagtttccatgggc

SEQ ID NO: 6790533 - DNA, 130 bp, Homo sapiens
ctggaaaaagagttctttagaagccatccagatactgttcctggagtcccactgggaactgggacatcatctgttcttaaaggggtgctgcaagtaacagatcttatgaattcagaggagcaatagccgg

SEQ ID NO: 6790534 - DNA, 63 bp, Homo sapiens
aaatgctgtcagtgttattggaaaatgagctgtggtttatagcaataatactaacaggtattt

SEQ ID NO: 6790535 - DNA, 84 bp, Homo sapiens
tattaggttggtgcaaaagtcattgcagcttttgccattattttcaatggcaaaagctgcaatgacttttgcaccaacctaata

SEQ ID NO: 6790536 - DNA, 107 bp, Homo sapiens
ggagtgtccttttagggcccgtgactggctccagctcaagtatggcacgagtgggtcgccgtgaaggggtggagcaggtgatgggaatagagctgacagggcactcc

SEQ ID NO: 6790537 - DNA, 58 bp, Homo sapiens
agctttgagctgctcctgcctttgagacacattggctgaaggtccttggctggaagtt

SEQ ID NO: 6790538 - DNA, 80 bp, Homo sapiens
ggtctggtggaggtgcatttcggagcttggagactgccccacccacccccgtctgctctaggagtgcacctccccccacc

SEQ ID NO: 6790539 - DNA, 72 bp, Homo sapiens
tcttttgtcctgatgctttggccccatcatgaggtatcccaagggaggccaaggcattcagaggatgtatga

SEQ ID NO: 6790540 - DNA, 109 bp, Homo sapiens
ggataaaaggattggtggattcaggttcgttgcttggtttcctctaatcaaacatgattatggaggaataacagcaaccttagggcttcttctgaatatctttttgacc

SEQ ID NO: 6790541 - DNA, 76 bp, Homo sapiens
cagtgctcctggagtcctttcctattcttgtatggggggaaggaagggatttgaggaaagggtaaaaaaggtactg

SEQ ID NO: 6790542 - DNA, 66 bp, Homo sapiens
ggaatgagtctgtgggctgaacgaatcgatctgtcacagagcaacagattgcagctatagactgcc

SEQ ID NO: 6790543 - DNA, 55 bp, Homo sapiens
tgcccagcctaaacttggcaagataataaatcacctttttaagtgtcgttgggca

SEQ ID NO: 6790544 - DNA, 56 bp, Homo sapiens
gctgccttgccaggggcagaaacaaatagatggagaagtcccctgagcgatgcagt

SEQ ID NO: 6790545 - DNA, 114 bp, Homo sapiens
tggtagaaactgaagttgagagaatatagtgacttgctcaacactgcatagaaacatggtagaaacaggatataagcatacagtccttgtattcttctcctttatttattgcca

SEQ ID NO: 6790546 - DNA, 80 bp, Homo sapiens
ggcttgcccgaaggaggggaggattaatgacaaagacggccccgctctttcccattcaatcccgctctgcgaggcgcgcc

SEQ ID NO: 6790547 - DNA, 103 bp, Homo sapiens
ctggctccctgctgggtagtgctgcagcattagtacaagtctcatgctctgaagggtgaaatgtgatgatctgctaagtgaaggctctgtcaggagaagccag

SEQ ID NO: 6790548 - DNA, 59 bp, Homo sapiens
gctttgcactctgatccttcccaatgttcagatagcaagatggagtgaagagtgaaagc

SEQ ID NO: 6790549 - DNA, 85 bp, Homo sapiens
cctgagcagctctcattgtcttggtgcccccgaaacctggactagcagctagcccgaggaggcactagttagtgacagtttcagg

SEQ ID NO: 6790550 - DNA, 68 bp, Homo sapiens
aggcacctcatagccagcccccactacatctctctccctgatgtctctctggctgtggggaaatgctt

SEQ ID NO: 6790551 - DNA, 80 bp, Homo sapiens
ctgttcatttctgcaggcctgaagggaggtggggctagtaagtctcagccccttctctgcaagcctgctctaaacagcag

SEQ ID NO: 6790552 - DNA, 63 bp, Homo sapiens
acatgtctacacattctgcaatagttaatacatgccattctacagtggaatttgtagatgtgt

SEQ ID NO: 6790553 - DNA, 85 bp, Homo sapiens
cacacataaagattaggctgaggagggatgttgcttatttctttaggaaaatatgatccttagtgagactgatctcaaatgtatg

SEQ ID NO: 6790554 - DNA, 55 bp, Homo sapiens
ggcctggagaaggcccagggagcttaggacacgtctccctcgctatcttcaggct

SEQ ID NO: 6790555 - DNA, 61 bp, Homo sapiens
ggtaattgcatcatttcctggccgtgtctagtatataacgcggagaagtgaagcaattgcc

SEQ ID NO: 6790556 - DNA, 69 bp, Homo sapiens
ctattccccatcatctattatagtgcagagatcactgcaggggcttaaaagtgggtgatgaaggaatag

SEQ ID NO: 6790557 - DNA, 67 bp, Homo sapiens
atttgcctggcatatcttcacagttggtctccttatcaaccaactgactcccatgattaggtcagat

SEQ ID NO: 6790558 - DNA, 79 bp, Homo sapiens
tttacaagaatgttcagtgcctttaaacatacttctcaaatgatagagtctgtgtcctcaggcactacgatcaggtaga

SEQ ID NO: 6790559 - DNA, 57 bp, Homo sapiens
atttcaggaccagttgccatttgctttcttcagctatgttatcattggtccttaagt

SEQ ID NO: 6790560 - DNA, 85 bp, Homo sapiens
aggaagccgaggtggccttgagtgggggtgaggggtcactgctggccccagccctggaccttagcccccacgcctggtggctcct

SEQ ID NO: 6790561 - DNA, 70 bp, Homo sapiens
cttggaggcaaggacagtggcttagtcctcttgtaagatagcatctttcttccattgtttgttgcccaag

SEQ ID NO: 6790562 - DNA, 56 bp, Homo sapiens
aaagtgctggaattacaggtgtgagccaccatgcccggcctgtccagtagcatttt

SEQ ID NO: 6790563 - DNA, 69 bp, Homo sapiens
tagtatctttttgttggatttcaattggagttatattgactatatagattgatttgaacaaagatatta

SEQ ID NO: 6790564 - DNA, 68 bp, Homo sapiens
gattattttactattcctgacacctaggcactcagtaaatgcctaggtgtcaggtatagaatttaatt

SEQ ID NO: 6790565 - DNA, 56 bp, Homo sapiens
ctgcaagggatcttcaggtagcactcattgctgtcaatctggctcagatcctgcag

SEQ ID NO: 6790566 - DNA, 82 bp, Homo sapiens
gggcttcgggattctctgtttggcgctgctccttctctcgtgtgggagggaacgggaggcagagccaggcaagtcctagcct

SEQ ID NO: 6790567 - DNA, 74 bp, Homo sapiens
tctgttattaacattagtcaatgaccctatgtggatgggtagacattgccctattcatggtcgtggctagcaga

SEQ ID NO: 6790568 - DNA, 75 bp, Homo sapiens
gctcagagaggctggtaaagtctgaactgatttcggaagagttctctggtatcctcttttctagcctttatgggc

SEQ ID NO: 6790569 - DNA, 77 bp, Homo sapiens
gcttaccagttagatatttttatatgtgttgtgttgagcttacatacatctatctagatgctcagactgtgatgagc

SEQ ID NO: 6790570 - DNA, 57 bp, Homo sapiens
ttacagagtagtgcagaactcacagtagcttctggtaattctgcatgtgctcagtaa

SEQ ID NO: 6790571 - DNA, 87 bp, Homo sapiens
tccagatgtaaagatggtcccaaaaggacatgggaagttctattagggaactatttccaattgttctttggaatctctctctttgga

SEQ ID NO: 6790572 - DNA, 98 bp, Homo sapiens
gagaagaaaggggtattttagggaaaggaaattatttctgcaatggatgagaacaacagccatcatcagatttctatttcaaatacattttctggctt

SEQ ID NO: 6790573 - DNA, 81 bp, Homo sapiens
ttgtctgcctcatgctgtggtctggcagacagcaactcgtttaagtcttcttccagccaatagcgtccttgagtaagacaa

SEQ ID NO: 6790574 - DNA, 86 bp, Homo sapiens
tttctttctgaagggtgcttctgggcatagcaggatagctgcaagcaatttctcctatacaatcagggttgaccttcagaaagaag

SEQ ID NO: 6790575 - DNA, 104 bp, Homo sapiens
aggacccgtccgcggcgtgaaggctgctgggaagtgtggtccaagcgcggattagggcctgctcggagtcccaggagcccctcttgcagctgccggatcggcct

SEQ ID NO: 6790576 - DNA, 75 bp, Homo sapiens
gcacatgaggaggcaggggctggctcacccagggctctgaggaccaggctgagcacctgcctttcaccccatggc

SEQ ID NO: 6790577 - DNA, 57 bp, Homo sapiens
gggtgtagtgtaataataactgaacatatttatcagtcacttttgcctgctacatcc

SEQ ID NO: 6790578 - DNA, 59 bp, Homo sapiens
ggcctctgcagagcattatagcaaaaggttaactacttttctagaggatctgcagagcc

SEQ ID NO: 6790579 - DNA, 63 bp, Homo sapiens
ccccagacaggctgcagtgttcctatctgaccgaataagtggaactctggggctcattagggg

SEQ ID NO: 6790580 - DNA, 59 bp, Homo sapiens
tcagacaagtaaaataatgtaaagggctacaggagccacaccttacttacttgttgtga

SEQ ID NO: 6790581 - DNA, 82 bp, Homo sapiens
gggctggggagcgaaagatgggtgatcctgggaggggaacactgaattgtttggcaggagtcccccataccgcgtcccatcc

SEQ ID NO: 6790582 - DNA, 128 bp, Homo sapiens
ggcgggcgagagtccgcagggcaggcgctgattggctgaggtgggagcagcttcccttccgatgattcggctcttctcggctcagtctcagcgaagcgtctgcgaccgtcgtttgagtcgtcgctgcc

SEQ ID NO: 6790583 - DNA, 63 bp, Homo sapiens
ggctaattggtgttgaattttcttaccaagctgtctcacagtgactctgcaccaaattaagcc

SEQ ID NO: 6790584 - DNA, 67 bp, Homo sapiens
gaattacagccagaagaatgaaatgttttgaacctgaacagcccatgtaatttctctggggtgattc

SEQ ID NO: 6790585 - DNA, 75 bp, Homo sapiens
agaggaccacttggaaaggttttacaaagcgctggctgcccagctgcccgggccatttaccaggcttgtccatct

SEQ ID NO: 6790586 - DNA, 57 bp, Homo sapiens
cagcccccaggatgcaaaatgactatgatcacagcaattgcaaagattggggagttg

SEQ ID NO: 6790587 - DNA, 80 bp, Homo sapiens
ggaggaaagttggagctggagctatggatttttgaggggccagcatgcacttctctttagcctcctttctttttcaatcc

SEQ ID NO: 6790588 - DNA, 69 bp, Homo sapiens
tgagatggtgctgttcaaaactaaatgattcaaaattctttttgtgtaacttatgaatagcttcatcca

SEQ ID NO: 6790589 - DNA, 88 bp, Homo sapiens
ccattattcatatatatgcactacgtaccctcctagatttagtttctgttcctgttcctgtgtatgtaggtatgtatgtgtttggtgg

SEQ ID NO: 6790590 - DNA, 55 bp, Homo sapiens
agctttagagagccaagactcactcatgtggaacagagatctgctccctggagct

SEQ ID NO: 6790591 - DNA, 68 bp, Homo sapiens
gtcagggttgtgaaggaaagggggttaagattgcggtttatctcattgcttggtttcacaaccttgac

SEQ ID NO: 6790592 - DNA, 61 bp, Homo sapiens
tagctgtataagcaatatgcaaatatgggaaaataatgtaggcagtgtgtatgaatagctg

SEQ ID NO: 6790593 - DNA, 70 bp, Homo sapiens
cctaactttgagtcattgcctctttccaccctcctataaaaaagggaaaagaattgtgagtcaagatggg

SEQ ID NO: 6790594 - DNA, 59 bp, Homo sapiens
cagtcatattcctcactaggctattttgttgggggcaaaatgctctggggataagactg

SEQ ID NO: 6790595 - DNA, 58 bp, Homo sapiens
ctttgctgcattcaggagcacagttgtatttcatctactgcttgagaatgcagtggag

SEQ ID NO: 6790596 - DNA, 91 bp, Homo sapiens
ggttcatgcgttggtcagggacttggctttcttggggagacacaattatttcctagggcagccttatagctcccagacagctagtgaggcc

SEQ ID NO: 6790597 - DNA, 84 bp, Homo sapiens
caggtgagaggagctgggggtagtcatgaagctccccagcctatttgagagagcactgcctctgagctccagcagtctcagctg

SEQ ID NO: 6790598 - DNA, 72 bp, Homo sapiens
ttgttaaatgagtgttgctcattgcagaaacaccttatgggatttcatgaaagaagctgcattcatctacaa

SEQ ID NO: 6790599 - DNA, 55 bp, Homo sapiens
gaggtttcaccatgatttttagctgtctctacatagctggaatgatagagacctc

SEQ ID NO: 6790600 - DNA, 63 bp, Homo sapiens
gcaggggagttctgagaggaactgtgattgtccagagtggagtttctttgagacttgccctgt

SEQ ID NO: 6790601 - DNA, 58 bp, Homo sapiens
gtgctagagctgggtggtggtgactcacttacatgaggcatttgcttcccagtttcac

SEQ ID NO: 6790602 - DNA, 68 bp, Homo sapiens
gggaggccaaggaaggggatgcctgaggatctgtacacactgcaccatacccattcccctctgccccc

SEQ ID NO: 6790603 - DNA, 64 bp, Homo sapiens
tttacttttatgtgatgaaatctgcctctgtattaagaggcaagaacttgtaagtgaaggtgaa

SEQ ID NO: 6790604 - DNA, 129 bp, Homo sapiens
ggttagcttgctttttggttttccaccaagtgaggacacggcattccatccctccagaggatgcagtaatgaagcaccatactggaagtggagagtggccctcttcacacaaccaaacctgccagcact

SEQ ID NO: 6790605 - DNA, 61 bp, Homo sapiens
ctaagatagattttttcactttcctctcctgatctggaagctgaaataatatctatgttgg

SEQ ID NO: 6790606 - DNA, 63 bp, Homo sapiens
tgaggaagagaacagtcaccatgcacagagcatttctgtgtgccaggcactgtattcacctca

SEQ ID NO: 6790607 - DNA, 55 bp, Homo sapiens
ggctgctgtaattttgtttataccacaggttgggtggcgtaaacagcagacagtt

SEQ ID NO: 6790608 - DNA, 55 bp, Homo sapiens
ctttgcaatagaggcacacatgttttcatgatgccactggattctgcttgcaaag

SEQ ID NO: 6790609 - DNA, 107 bp, Homo sapiens
ggaaattgcatgtgcattttgggtgccctgataatgtcctgcagtaaattgttttcatataaattgcatgcttaattaatcgctttcaaaaatgctcatgtatttct

SEQ ID NO: 6790610 - DNA, 90 bp, Homo sapiens
gggggccacagagcacacccgtggagaagcaggagcgggccctgggcctcctcagcttggccacggagttgctgccctgccttggtttcc

SEQ ID NO: 6790611 - DNA, 68 bp, Homo sapiens
agagtttggctgtcatttgaaaatgttttcctgctaaatgttttcatttagaagctaatttatactct

SEQ ID NO: 6790612 - DNA, 71 bp, Homo sapiens
tgagattgtccagatcacattagcaaggcctatagcggccacgtgtgctcagtgagtctgtgacaggatca

SEQ ID NO: 6790613 - DNA, 79 bp, Homo sapiens
agaaccaaaaggcagaggaaggtctagtttgctctcacttcttgagctaaggcatccatcttcttgtgtccctggttct

SEQ ID NO: 6790614 - DNA, 78 bp, Homo sapiens
gaatctgtcacccaggctggagtgcagtggcatgatctcagctcactgtaggctctacctcatgggttccagtgattc

SEQ ID NO: 6790615 - DNA, 67 bp, Homo sapiens
gaatttggagagagattaatgttggctcactatgcatagaaaaacgtcactttctctctctctattt

SEQ ID NO: 6790616 - DNA, 99 bp, Homo sapiens
tttcaggttagaaggaataagtacagagaagggctctgatgttttgccagtcaaatcattgctcctttctctggtaaactgaattgctgtggcctgagg

SEQ ID NO: 6790617 - DNA, 67 bp, Homo sapiens
gattctccctggctctgagcccacctccagggtgacactcaaactttaggagtgggagagcgagatc

SEQ ID NO: 6790618 - DNA, 56 bp, Homo sapiens
catgctgggtaaaggtggtgaagatgtgccttaggttcacatcctctcccaacatg

SEQ ID NO: 6790619 - DNA, 55 bp, Homo sapiens
ttctagaagctctaggggagaatctgtttacttgccttttttttagcttctagag

SEQ ID NO: 6790620 - DNA, 75 bp, Homo sapiens
ccagagtctgtgcctcaagctaaagaagtgaaagctcctttcattcattcatccagcttgaggaagagaccctgg

SEQ ID NO: 6790621 - DNA, 90 bp, Homo sapiens
gtactatccaaggactaggtaagaaaggacagccactcaggtctcgtggtgccaggggctctgtggcttccttcttagtcaaacaagtgc

SEQ ID NO: 6790622 - DNA, 60 bp, Homo sapiens
tacattttaaatgcagatggagatgtcaggtttcactgaatatatgtgcatatgtgtgta

SEQ ID NO: 6790623 - DNA, 77 bp, Homo sapiens
tggataaaatttgggtaaaatttaaatacatggcatagaccatgtattttaagatttgcctcaaggtttgtaaacca

SEQ ID NO: 6790624 - DNA, 66 bp, Homo sapiens
tgcttttctgtttatgaaattgtgttacagactgcgagtaacatagcttaaatgagaagataagta

SEQ ID NO: 6790625 - DNA, 66 bp, Homo sapiens
gcttccccttggcttggtcaagaggctgagctccgtgttcccaggctagatgccaaggggcagagc

SEQ ID NO: 6790626 - DNA, 60 bp, Homo sapiens
tgtaatggttaccaggtgggggtatccatataatttactatccaaaccaggaccattaca

SEQ ID NO: 6790627 - DNA, 64 bp, Homo sapiens
ggcccctagcacggagttcttcccgggctccacctgccctggaaggttctctggctcaggagct

SEQ ID NO: 6790628 - DNA, 99 bp, Homo sapiens
catttcactttagttaatttctgtaaattcaactatgtatagtcttctttacgaaaaggagagaacatacttgagaaatataatttaagagtgcaagtg

SEQ ID NO: 6790629 - DNA, 60 bp, Homo sapiens
ggagagtgtttttgtgaagatttagagcatgtctctggatgaacacatgtacacatttct

SEQ ID NO: 6790630 - DNA, 63 bp, Homo sapiens
agcacatggtgtgtcctgatctgacctgggtgggaatccctgctagaccgctcacgccgtgct

SEQ ID NO: 6790631 - DNA, 58 bp, Homo sapiens
gtcatccttctggaactagtctaagtcatccttctggaactagtctaaaagggctgac

SEQ ID NO: 6790632 - DNA, 84 bp, Homo sapiens
ccccgccccaccaaccctctcgatgtcctactggttctgctcctctgaagaagcctgactaataggagttgaggtggcacgggg

SEQ ID NO: 6790633 - DNA, 129 bp, Homo sapiens
cttgaagctttgcaatatgttgggatggttctgtagggtctttggtgtcccttgggtcaggaagatctcaggcccagcccgaatccctaaagcaattgacatcagaatagaggtaaagaagttatcagg

SEQ ID NO: 6790634 - DNA, 88 bp, Homo sapiens
acgtgttttcatttgattctatgaggtaagctattatcccccatttaatagaagtcaattttgccttcatggagtgtctgaaaactgt

SEQ ID NO: 6790635 - DNA, 56 bp, Homo sapiens
ttgaatgcatggttcactctgtcatttcctttcagggtctgctcagtgtcgttcaa

SEQ ID NO: 6790636 - DNA, 66 bp, Homo sapiens
tgtttgttcactgagcaatgattagctatttgtctgcatcatttataatgtctttgtgaataaaca

SEQ ID NO: 6790637 - DNA, 63 bp, Homo sapiens
gctctggctagttacctcttaccctttcctgaaaagactcaggaactaagtgactgtcacagc

SEQ ID NO: 6790638 - DNA, 70 bp, Homo sapiens
acttcctgtacttccagccaagtgagacaaatgaaacctcttcatcctgtgcagttgaagtgcaggaagt

SEQ ID NO: 6790639 - DNA, 71 bp, Homo sapiens
ctgaggaaacactttaagtgaggaggatcttagcaatgagtagattttcatcaaaattaaagatttctggg

SEQ ID NO: 6790640 - DNA, 57 bp, Homo sapiens
catttgaatggcatttcactttgtcgtctgggattctgtgaaaaatccgttctgatg

SEQ ID NO: 6790641 - DNA, 93 bp, Homo sapiens
ggctgaccctctgtgggcctggctgggctgccggggccaccctggcggtgaccacccctggcagcgccgaagctggccccatgtgggaaagcc

SEQ ID NO: 6790642 - DNA, 65 bp, Homo sapiens
gctgaaaactgttcttgtaacacttaaattgtggtgagcagtttaaattatgtgagcagtttagc

SEQ ID NO: 6790643 - DNA, 98 bp, Homo sapiens
tatgcatgatgtggtctgcacttgcacacatgtacatgtgtatggtgtgttattttactgtgtgtgtgtgtgtgtgtgtgtgtgtgtgtgtgtgtgtg

SEQ ID NO: 6790644 - DNA, 62 bp, Homo sapiens
aaggttcactggccgtggccaggcaaaatgcggggacagtgcctggcacagggtccgtcctt

SEQ ID NO: 6790645 - DNA, 83 bp, Homo sapiens
tattaggttggcacaaaagtaattgcagtttttgccattaaaagcaattggaacaccgcaattacttttgtgccaacctaata

SEQ ID NO: 6790646 - DNA, 72 bp, Homo sapiens
ggctggggacacagagccaaaccatatcaccctgcaaatccaagggggcactcctctggtccagccccagct

SEQ ID NO: 6790647 - DNA, 79 bp, Homo sapiens
ggagcaatggagaaaagatgagagggagccagccatccgaaagaagctgccctgcttggtttattttcagctttgctcc

SEQ ID NO: 6790648 - DNA, 82 bp, Homo sapiens
tgtacctgtcctcacctgctaccagttgttttatgagataataaatgtattaagtaaagcaggtagttgggacacagctata

SEQ ID NO: 6790649 - DNA, 64 bp, Homo sapiens
agctatttgaagttgcagagatgatcagggaagccttccttctcactgtggaactcaaaaagct

SEQ ID NO: 6790650 - DNA, 89 bp, Homo sapiens
tgtgttgtctgtagtgtgtgacgtgatttgatgtgatggaaaagggaagcacatatatatatagtcacactttgcaggcactttacaca

SEQ ID NO: 6790651 - DNA, 79 bp, Homo sapiens
agaatacaaagacctcaagatttgaggaacttgcccaagatctcagagccagttccttttatctgagtctaagttttct

SEQ ID NO: 6790652 - DNA, 100 bp, Homo sapiens
cattcaaaaaatgtgccagttacaagtgattcttggtgttttattacaatatatctcactgaacacctatgtggaaatcagcttgtaatttcactgaatg

SEQ ID NO: 6790653 - DNA, 129 bp, Homo sapiens
gaggaaaggtgcttactaaattcaagaaatggtgtttttttctccttattcatagttgtctccttggagagaccatattgaggggaacctgccaggaacactttttgaaaaagtcaattattcttcctt

SEQ ID NO: 6790654 - DNA, 77 bp, Homo sapiens
ggcggcagtccagctggaacggcagcccagcagggacacaaccccagctcgggcgccggccacgctaccttgctgcc

SEQ ID NO: 6790655 - DNA, 55 bp, Homo sapiens
tgcctttcctcagggtgagtggtaggaaatctggttcaggcagtggggaaaggca

SEQ ID NO: 6790656 - DNA, 71 bp, Homo sapiens
gtatatggaaaaatgtatcttgtcatggctcaaaagacacaacattgttaagatgtcaattttccacatat

SEQ ID NO: 6790657 - DNA, 65 bp, Homo sapiens
cagcctctgctgctgttgagcaccgtcgtggagagcgggctgcattgttagcattgctgaggctg

SEQ ID NO: 6790658 - DNA, 60 bp, Homo sapiens
ttgtaagacatggaatgttggagctggaaggaaactcccagttcatccccatgttttcaa

SEQ ID NO: 6790659 - DNA, 57 bp, Homo sapiens
ggtagattgatgagtcatgggggttgacgtttccatgttattattagcagtcttgcc

SEQ ID NO: 6790660 - DNA, 70 bp, Homo sapiens
tctttaaggcaaagagacaatgacacttgggaggtagcagcctcaaggaaacactctctctgcctaggga

SEQ ID NO: 6790661 - DNA, 56 bp, Homo sapiens
caggtaactccaggcgcttggaggatggaaagtttccttttggctggagtgatctg

SEQ ID NO: 6790662 - DNA, 57 bp, Homo sapiens
tgttgaagtatcgctctgctctgctaacaaccacagccaggcctgaggatttcagca

SEQ ID NO: 6790663 - DNA, 58 bp, Homo sapiens
tagtttttctgttccaccccactctgcaaggagtgttacttgccatacagaaaaagta

SEQ ID NO: 6790664 - DNA, 63 bp, Homo sapiens
ttccatctgtcctctctacctttgactcactgatgagtaaggaagaactggaaagaaaaggaa

SEQ ID NO: 6790665 - DNA, 72 bp, Homo sapiens
tggagatctcaaaggcttctttgctccatgtctgtctagatgggaagaacggggatgccttggatatctcta

SEQ ID NO: 6790666 - DNA, 75 bp, Homo sapiens
tcagagactccacatgtattaaagtagatatcagaagacatattgaatttcactttgatgacattgtagctttga

SEQ ID NO: 6790667 - DNA, 84 bp, Homo sapiens
tctgtcctgataaagcattctgatagccaggtgtggtggctcaggcctgcattcctggcattatgggaggctgaggcggatgga

SEQ ID NO: 6790668 - DNA, 62 bp, Homo sapiens
ttagccttagaagcttagcaaatggctttaaatatgttttaatttgagctttgaaggtctga

SEQ ID NO: 6790669 - DNA, 85 bp, Homo sapiens
tcaatgtaaatgggggtggcagattgcaatgagttgtgaaaacccagcagtgactttggcagtgaagccctctcatcaattttga

SEQ ID NO: 6790670 - DNA, 96 bp, Homo sapiens
actaattatagagcatctttcaactggaatacatgtagatactaacacctggttgtatttgatgtaatttcagtgcatacagtgtgtgtaatctgt

SEQ ID NO: 6790671 - DNA, 69 bp, Homo sapiens
gttagtaagcatgctacagcccaactgtgaagtttgagctcacagagcacgtatcatgcctgtgctggc

SEQ ID NO: 6790672 - DNA, 79 bp, Homo sapiens
atagtgtcttctatcatacttgaatacattaatccaaataaatgtgattaatgtattcaaatatgataggaggcactgt

SEQ ID NO: 6790673 - DNA, 80 bp, Homo sapiens
cttataggagacatctaactgtaggttttatgtgaatcaaaaattgaagttgctaatgtgcagggatgtctctctatagg

SEQ ID NO: 6790674 - DNA, 67 bp, Homo sapiens
gaacctgaaagcagctgctctggccttgaccatgggtcatgcctggtgccagttgctagtctggttt

SEQ ID NO: 6790675 - DNA, 57 bp, Homo sapiens
tgatggagggcagccccactaaagcatcgtgtgcagtgggtcctgcgtctgccagca

SEQ ID NO: 6790676 - DNA, 74 bp, Homo sapiens
agtgttatttattgtttcataaaacttccaattagtgaatcaactgggaaccttgatagatagttattagcact

SEQ ID NO: 6790677 - DNA, 57 bp, Homo sapiens
ggaaggggggcacgctgaagagctcacgcacacggatctccagggtgcccttgttct

SEQ ID NO: 6790678 - DNA, 65 bp, Homo sapiens
atttactcgtgtctccagtgctgtcaaaacttctttgacatttttggcctggtgaatgagagaat

SEQ ID NO: 6790679 - DNA, 83 bp, Homo sapiens
catgcatattcctggagtgtgtctgtgtatgtgtgttcccggtgtgtatttgcacatgcatgcatattcctggagtgtgtctg

SEQ ID NO: 6790680 - DNA, 69 bp, Homo sapiens
aatgctgaggatgttcagagtgcttgcttatgaaactgcttgagagctggattctggataggtggcatt

SEQ ID NO: 6790681 - DNA, 63 bp, Homo sapiens
ctgactccctccccaaagctggcgcttctgtgagattccagactctggtggagggtgtagcag

SEQ ID NO: 6790682 - DNA, 55 bp, Homo sapiens
ttccttccgggcaccaggcactcttccaacctagtgctctgccatcattaaggaa

SEQ ID NO: 6790683 - DNA, 78 bp, Homo sapiens
gttttacagtggttttatatctaagcttgcctttggcatcttacctcgctagatgttaaaaaaaactatatgtaacac

SEQ ID NO: 6790684 - DNA, 76 bp, Homo sapiens
ccttccctcccagccaggggaagccagtggtgaagactttgacctctggcaccccctggcttgggagtggggaagg

SEQ ID NO: 6790685 - DNA, 102 bp, Homo sapiens
tgggcatacctcaaacatcttaggaacatatgtgcttatatccatgagcaaacacattcgtggattgagtatagatgtatatagattggagaaacatgccca

SEQ ID NO: 6790686 - DNA, 56 bp, Homo sapiens
cttggcatgttgtaggttacttcttggctcagattgaatgtatattttatgccagg

SEQ ID NO: 6790687 - DNA, 101 bp, Homo sapiens
gcctttcggttcaggacctacagccccttgcacttccccacgcctgttacacaagcccaggctgggagcagagggcgagctccacgacagcctgcagaggc

SEQ ID NO: 6790688 - DNA, 55 bp, Homo sapiens
aggacttgagagtgctcataggtacattacttactgaattgcactccagcgtcct

SEQ ID NO: 6790689 - DNA, 84 bp, Homo sapiens
gagacacactggtttcatctcagtgtacagggagtctagttactaagtggacgaagaactcccgcacattgagatctggtcctc

SEQ ID NO: 6790690 - DNA, 57 bp, Homo sapiens
tgccctctgtcctcaatcttgcttaccagcaacaacagcaaatgggacaggaaggca

SEQ ID NO: 6790691 - DNA, 72 bp, Homo sapiens
actggtccctccgagaagcataaagcaggaatgccgtcatttttatttatgtttgtttgtttactaactagt

SEQ ID NO: 6790692 - DNA, 64 bp, Homo sapiens
tgttggggtttattactgcatgcaaggtacacactggcctcccacagtggtacagccctgaaca

SEQ ID NO: 6790693 - DNA, 73 bp, Homo sapiens
ggggagtgtaacttggttggtgggcaggagaatttaaggtctctccatggattcccactcaagtcagctccct

SEQ ID NO: 6790694 - DNA, 95 bp, Homo sapiens
acctcgagcttgggacagctgactatagatcaattctgcttccacagccaatttctgttgggcatgattatctgaaggcagctcttggctcgtgt

SEQ ID NO: 6790695 - DNA, 103 bp, Homo sapiens
gctgttttccaactctgatatggtgactaagcaggtatgacatagatatgtcctgtttaggagtgtcagtgtccttatctgaaaacccaggtttggtgatagc

SEQ ID NO: 6790696 - DNA, 59 bp, Homo sapiens
gacaatagtgaataaaccggtgaaataataatcaagtctgtggtttatttactagtgtt

SEQ ID NO: 6790697 - DNA, 73 bp, Homo sapiens
tttgtcctgtgactgacttatttcatggatcataatgtcctcaaggctcatccatgtcgtaacatatgacaag

SEQ ID NO: 6790698 - DNA, 79 bp, Homo sapiens
agtatctcagtctcattttgctcttcaatcctttggccatagatcagccaaagagatttctgtaaaatgtaaaggtgct

SEQ ID NO: 6790699 - DNA, 60 bp, Homo sapiens
gggcccgctgaggctaacctcgagagacagttataaaaggctgtgagaggctagctgccc

SEQ ID NO: 6790700 - DNA, 80 bp, Homo sapiens
ggcctgggtttgtcagcaggcaggaggcatgccaggagttctcctaggtgtcaggcctcctccagccgcttccctttgcc

SEQ ID NO: 6790701 - DNA, 61 bp, Homo sapiens
cctaattgactgagggaatgctggtactgttagaaagtattagtgaaagaattagtttggg

SEQ ID NO: 6790702 - DNA, 56 bp, Homo sapiens
ggaatgcaattttacaattctgggctcgcattccagaattgtgcagattgctttcc

SEQ ID NO: 6790703 - DNA, 63 bp, Homo sapiens
cgtgatagatttctgctcaagcttagttccaggaaacgtttggtttctgcagatgtttacatg

SEQ ID NO: 6790704 - DNA, 72 bp, Homo sapiens
accctgttatggtgtaacatttgattattacgttttattgtcatgtcactacatcataaatatatgcagggt

SEQ ID NO: 6790705 - DNA, 69 bp, Homo sapiens
ctgccttttcttttatctgctacataactcttttgaatgagagctgtctacagcaataaaggaaggaag

SEQ ID NO: 6790706 - DNA, 55 bp, Homo sapiens
taagggctttccagctattcttgttcacaagggaatgtagaggggaagaccttta

SEQ ID NO: 6790707 - DNA, 71 bp, Homo sapiens
ggagctaggcattgagcttcagtagccactaacatcacaaaaagctagagaggcagatgtcctgtgcctcc

SEQ ID NO: 6790708 - DNA, 129 bp, Homo sapiens
ctacccataagaagaaacagaaatatttggtaaatggcactatatattacctttgcaaactcattaaggtagggacaggttgataaggtgatattctcagtgcaccagctgtgcgtgggagggggttag

SEQ ID NO: 6790709 - DNA, 69 bp, Homo sapiens
caaattgcgaattctgagattcactgagagtcatccaagctctcagtggatctcagaatttttgctctg

SEQ ID NO: 6790710 - DNA, 98 bp, Homo sapiens
cactgactccccacagccaggtgctctgacaccctccttggtgggaccctctctcttcaaggcgcccagagccacctggctgtccttggaactaagtg

SEQ ID NO: 6790711 - DNA, 68 bp, Homo sapiens
ggctgccagtttgattcgggccactgtgatatcctggcctaacagtgccctgacacacctggtgtgcc

SEQ ID NO: 6790712 - DNA, 70 bp, Homo sapiens
ctctctcaagcattttgatgaaagctactatttactttagggaagtgaaagtgtatttattatgagggag

SEQ ID NO: 6790713 - DNA, 86 bp, Homo sapiens
gtaaggacgttggcttttcatctgaaatagagatccagtagagggttttgagcagagaaaggacatgacctgacttatgtttttgc

SEQ ID NO: 6790714 - DNA, 70 bp, Homo sapiens
ctttggttttcagtaggtatcatatgaagtcagtggctctcctgcatctaatgcctgctgtattccagag

SEQ ID NO: 6790715 - DNA, 57 bp, Homo sapiens
cagtcagggaggctgggacgggtgctgaccctagccctggagcactctccctggctg

SEQ ID NO: 6790716 - DNA, 68 bp, Homo sapiens
tcgcctgaggctgggaaggtaaagttgtagtgagccgtgattacttcattgcattccagcctgggtga

SEQ ID NO: 6790717 - DNA, 73 bp, Homo sapiens
acctagggtgctgcttgttctggttagtctagaaggatagttttagcactgaaagtccaggaaaactctcggt

SEQ ID NO: 6790718 - DNA, 67 bp, Homo sapiens
gagacggtggatcacctgaggtcaggagttcgagaccagactggccaacatggtgaaaccccgtctc

SEQ ID NO: 6790719 - DNA, 69 bp, Homo sapiens
tccattatgattcaggattgaaccatttcttttgaggaggtaaatgaactcttcctgcatccccctgga

SEQ ID NO: 6790720 - DNA, 81 bp, Homo sapiens
gatgtaagattcaaggctaaactttcagagtatgtgatgatttggggcttgatttactgctctttggccttggtttgtttc

SEQ ID NO: 6790721 - DNA, 64 bp, Homo sapiens
tttggaaggcccagctggacaaactgcttgaccccaggagtttgagaccagcctgggcaacaag

SEQ ID NO: 6790722 - DNA, 62 bp, Homo sapiens
ctagggagcagccctgccactcctcatgtgatgcgccaggagccagggaagctgctttctag

SEQ ID NO: 6790723 - DNA, 61 bp, Homo sapiens
caggatatagggtatcttatccaggactcacaatcatccaagtcctccctttggtgtcctg

SEQ ID NO: 6790724 - DNA, 80 bp, Homo sapiens
tctatcccggatttggccccaccctccaggagcagggagccagctctgcatcaggagaggcgggcaaggcctggggagga

SEQ ID NO: 6790725 - DNA, 129 bp, Homo sapiens
agagccagagtaaccatgaagatatgaaccccaaggaattctcagaaatgttgataagggtactagatttcccatagaacatgggatagagtttttgaattgtgggtttagaggaagcaggcacgagct

SEQ ID NO: 6790726 - DNA, 60 bp, Homo sapiens
ctcccgtgcccccacctggctggcctgtgttacccgccaggcactcacggggcactggag

SEQ ID NO: 6790727 - DNA, 62 bp, Homo sapiens
cgggagcttgtacttctcagagtgccttgtttaataaagctctcctgaaggacaagctgccg

SEQ ID NO: 6790728 - DNA, 65 bp, Homo sapiens
gtccctgcctcagagctacacacacgcaggcccttcgcctgggcactgcagctcagggcaggggc

SEQ ID NO: 6790729 - DNA, 82 bp, Homo sapiens
cttcttacatcataccaggaatcatgtataagtaatgaatccttttttatcatgctaagattgattcttaggtatctggaag

SEQ ID NO: 6790730 - DNA, 70 bp, Homo sapiens
gagaggaatgaattatttgataatttaaaaattattctctatgaagtcagatggttccatcatttttctt

SEQ ID NO: 6790731 - DNA, 60 bp, Homo sapiens
cagagaaagttgagaagttccctttggaaaaatccaaaccacacttagcagtttcgtctg

SEQ ID NO: 6790732 - DNA, 130 bp, Homo sapiens
ttgtttttaccaccttagaactgcaattgtatctcatagaatgatttgtttgtttagtgatctagattagaaactagccacacagaatacacctggaggcataactaagtaaaaacaataaataaaacaa

SEQ ID NO: 6790733 - DNA, 56 bp, Homo sapiens
gacccgaagccaagacagatgaacttgagtccccaaattcacacttcctttgggtc

SEQ ID NO: 6790734 - DNA, 59 bp, Homo sapiens
ttgggtcttgctcactccacactcccatcaggttgctgggcttctgagaaagcacctaa

SEQ ID NO: 6790735 - DNA, 62 bp, Homo sapiens
acatggaagcaaagttctattttaaacttgataagctggagatgtctgctatgcttccaagt

SEQ ID NO: 6790736 - DNA, 86 bp, Homo sapiens
aaaatagagtactgtgccatcattcaataaattcaaagcagccagcttttcctccagctttgaaacagattgatggtttctatttt

SEQ ID NO: 6790737 - DNA, 89 bp, Homo sapiens
ccttgctgagcctcagtgtcctcctctatacatatgggataatatcacccatgtcatggcgttgtggggactaactgaaatcacttagg

SEQ ID NO: 6790738 - DNA, 93 bp, Homo sapiens
ggcaggtaggtgctggtggctgggacagctgagacaggagagggcagttactattttccagtctctgcctccaagggcatctactgtactgtc

SEQ ID NO: 6790739 - DNA, 79 bp, Homo sapiens
agaaattaagttactttctgatcagtgtgtccaggctttcatgctgctttctgacatcatcagtgagtgaatagttttt

SEQ ID NO: 6790740 - DNA, 87 bp, Homo sapiens
agcagaaccacagcactgttgaggaacacccccttcagagcaacaaacagaacagaaaggcagtcagtaacgggctcgtgttttgct

SEQ ID NO: 6790741 - DNA, 119 bp, Homo sapiens
tcattttcagcttcacaaagaggatgcagccccacctcccagcgggagtcagttctgctctgagacgtgaggctcagaatcagatgaagactcctgctgctgcatcttgaagataatga

SEQ ID NO: 6790742 - DNA, 84 bp, Homo sapiens
ccctgcacagccataacagtgttttgctctttgcccagtatgctctttgtcggcaggcggaaaagactgcattgtctagtaggg

SEQ ID NO: 6790743 - DNA, 85 bp, Homo sapiens
gccagtaatcttttatcctgtacaagagccatctggatgtagcaaactgcagttcactcttttgcagggtaagggctcagctggc

SEQ ID NO: 6790744 - DNA, 57 bp, Homo sapiens
caaatgcagtccctttgttgctatggtaatacatttggttaggggggctgtcatttg

SEQ ID NO: 6790745 - DNA, 58 bp, Homo sapiens
agtggccatggcaggtgagcatccttttcctgggcacgtacatctgcagtggctccct

SEQ ID NO: 6790746 - DNA, 80 bp, Homo sapiens
gtttactggcttctgtgtgtgagtcatctgttgcccaccggctttaatgaagtcacgcaaagcaataagtcacccaaaac

SEQ ID NO: 6790747 - DNA, 57 bp, Homo sapiens
tgagagacctgtgagtgtatttcagaaggccatgaaatgttgccatgaggtctccca

SEQ ID NO: 6790748 - DNA, 59 bp, Homo sapiens
ttgtcagctgcagtgggggaccacaactccttgagttctgcccagctgcagctggacaa

SEQ ID NO: 6790749 - DNA, 69 bp, Homo sapiens
tctacacagtctcaagatggcctctctgccagggtacacctcagaagggatcttagaggctgcgtatga

SEQ ID NO: 6790750 - DNA, 59 bp, Homo sapiens
gtggaaaagatgggatgcaggagtgggagataacttttcactgtatgtctttttttgat

SEQ ID NO: 6790751 - DNA, 84 bp, Homo sapiens
ggtcagctcctttcctgggaagatttgccaatcgggggagggaggacaaagctctcctgggagtcttcctggatggggtcggcc

SEQ ID NO: 6790752 - DNA, 56 bp, Homo sapiens
gggggcggctggcaaacgcctagcacaacttgagcaaaggcggctcgcgcgcctcc

SEQ ID NO: 6790753 - DNA, 56 bp, Homo sapiens
cagggatgtgcagcatccagacactgcttaatcacagtgagctgccgtcttccctg

SEQ ID NO: 6790754 - DNA, 79 bp, Homo sapiens
atgttagaagatctagtttctggttcttgctctggtgctaaccagccagatcactcaaccagagctctttatccaacat

SEQ ID NO: 6790755 - DNA, 75 bp, Homo sapiens
agattctctgtcaccagtgctcccagaggccagctgggcccggccaggtctgggagagctgctgtcagagcgtct

SEQ ID NO: 6790756 - DNA, 55 bp, Homo sapiens
cacagtacccagcactactgagcaaacagatactcagtgtgttcctcttactgtg

SEQ ID NO: 6790757 - DNA, 102 bp, Homo sapiens
acctaaaaacagctttttaaagctagtagtatttcaatgttgactttaattggaaggaaactatgagatgaataactcctgctaagaaacctgtatataggt

SEQ ID NO: 6790758 - DNA, 71 bp, Homo sapiens
tccagggatgtcctgtagcactaacctaggtagttttattattttcacaggcaatacaaggcatctctgga

SEQ ID NO: 6790759 - DNA, 82 bp, Homo sapiens
tcataaaaattgactgccacagaaacccaccaagtcatcatctcatcatatgttgattcagttggttttgttcagttcttga

SEQ ID NO: 6790760 - DNA, 82 bp, Homo sapiens
ggtgtaaagcaatacaagtggtcattgagctttgattttcctattcagaacaggttaatctacttgtaaattgagttattct

SEQ ID NO: 6790761 - DNA, 62 bp, Homo sapiens
gcatctccaggattttcacactcagagatgaccactcttatgagtagaactcctggagatgt

SEQ ID NO: 6790762 - DNA, 121 bp, Homo sapiens
ggcggcaatagaactaagattaaaatcaacagctggagtgttggtgaggtatctgtgtttcttggcaccaattttgttattcatttaggaatgttgttttaaggggtgttcattagctact

SEQ ID NO: 6790763 - DNA, 58 bp, Homo sapiens
accagagtcaattattttgccagtagaagaatcaaaaggcagtttaattgatttcagt

SEQ ID NO: 6790764 - DNA, 57 bp, Homo sapiens
ctgtgatcacacaactttggtagctcagtttgcgctggaactgtgcactggtcacag

SEQ ID NO: 6790765 - DNA, 62 bp, Homo sapiens
cctgcactcctggagcacttgggtgggactaggggaggtgccactgactccaggagctgagg

SEQ ID NO: 6790766 - DNA, 128 bp, Homo sapiens
ggagccagaggcagagcccagctgggagccggggtttcactggtcagtcggtcagtctctgcagctgcagcctgagatcagccaagcccctcctgaggctcctacctggctcactttgccctttctcc

SEQ ID NO: 6790767 - DNA, 56 bp, Homo sapiens
ttctgaaagaggcaggagatgggtatttgctctcaccaggctcctctccttcagga

SEQ ID NO: 6790768 - DNA, 127 bp, Homo sapiens
tgcattggaagatttctcctttcttacaggtcgtgtcctgcaactgaaaggccctgggagagagagccgtgagggcatggcagtgaggatggcagtgtggtggaaagggggagttttcaatcagaca

SEQ ID NO: 6790769 - DNA, 61 bp, Homo sapiens
atttgtaaagtgcttaaaagtatgccttgcaaaggaaatgctatgtaagcatttattaaat

SEQ ID NO: 6790770 - DNA, 68 bp, Homo sapiens
actgtgtgtgtgtgtttttttaatgtgagttttatatttatctgaggaaagcagacaatagacacagt

SEQ ID NO: 6790771 - DNA, 76 bp, Homo sapiens
tgcttcagtttctgtggtctcttttcatcctgcttgaagattcggagtgtggaaggaggctaggaagtctggtgca

SEQ ID NO: 6790772 - DNA, 74 bp, Homo sapiens
gggctctacagcagtggtgtatttgaggctttgtggaccatacagtctctgtggcaactatgctgttgtagcct

SEQ ID NO: 6790773 - DNA, 126 bp, Homo sapiens
ccttttaccaagcccatgcgccttctcctgggctgcttcaggcaagggaaaaaaatctcccagtgtcacagtgaggcagttcttgtactcagaagaggccatggaaaatttttgcttaagaaaagg

SEQ ID NO: 6790774 - DNA, 59 bp, Homo sapiens
gcccagggcttcaaagagagaacagagagcatcatccccttcctcacaagtccctcggc

SEQ ID NO: 6790775 - DNA, 101 bp, Homo sapiens
gctgtctgcttaccctgtaattgaatgtctgagagtgattgaaaaaatgttatttcttctcagtattacatgctaatgtacagagggcaaaaggagacagc

SEQ ID NO: 6790776 - DNA, 56 bp, Homo sapiens
atgggggctataaatagtcagcacaccttgcttttgtgctgctgcttcacccccat

SEQ ID NO: 6790777 - DNA, 119 bp, Homo sapiens
agtggcccaggtatgtgatgctccggactctgcagtggcccagcttgcaggcttcaaacagaggtgctccccaggaccagcctttgagcaagggctgcgtagagacaggcctgggctct

SEQ ID NO: 6790778 - DNA, 71 bp, Homo sapiens
attctagatacctaggggatttgtccagatttcagatatatactggaacacacttctaagtcatttggaat

SEQ ID NO: 6790779 - DNA, 76 bp, Homo sapiens
cttgtaccaaccattgcctgaaaacagaaagtctcatgggaatagatgtgatctgttcaggacaagttctagcaag

SEQ ID NO: 6790780 - DNA, 79 bp, Homo sapiens
tagcttttacttactcttttataaagcatcttgatgtacacttattctcaaggtgcaatggaactgatagtgaagggta

SEQ ID NO: 6790781 - DNA, 130 bp, Homo sapiens
ggtaaagaaaaagaaaatctaattatgtggcatgtttcagccaggtgttcctggttccaatgactcagaccctattggagccctgaggatctggataattgggcctgcatagacagagatgaaggatgcc

SEQ ID NO: 6790782 - DNA, 60 bp, Homo sapiens
gatcatgcagaggtgccacgaggcttaatttattaatgtttgtgttacactctgcagctc

SEQ ID NO: 6790783 - DNA, 62 bp, Homo sapiens
tcttctccctttttgggtagcaactgtaaaagtaacttacaggaagcagatggggtagaaga

SEQ ID NO: 6790784 - DNA, 79 bp, Homo sapiens
caggagctcagaggattctggggaggacattgggaaggaccctgtggaggactcttgggagtgctctggagaagacttg

SEQ ID NO: 6790785 - DNA, 76 bp, Homo sapiens
gcccttaagtgcttcagtatcctccacatgttaagatttctctcattaaattagagcatttgaagcaaatgggggt

SEQ ID NO: 6790786 - DNA, 59 bp, Homo sapiens
agattctgtagattgagaatccaggagtaggttagctgggtatttcaggctcagagtct

SEQ ID NO: 6790787 - DNA, 64 bp, Homo sapiens
ggaggagctgctgtgggggcccagccctcccagcgggcagggtccctgatcagaggcatccccc

SEQ ID NO: 6790788 - DNA, 60 bp, Homo sapiens
ggtcactgatgtgttccctgggatctgtcctcctgcagcctgggaatcttgtcagtgact

SEQ ID NO: 6790789 - DNA, 58 bp, Homo sapiens
aaaaacagaatgtgtctaactctagaaactgtgaggggagacagcatctcttgttttt

SEQ ID NO: 6790790 - DNA, 79 bp, Homo sapiens
agttgctgaaattattgtgtaaaatgaggcttttgctttaaaggtttcatttgtcagtgaataattcattccagcaatt

SEQ ID NO: 6790791 - DNA, 56 bp, Homo sapiens
cctcggacttgggtgggctcctttctcttaagcgagggcccaccttggtgctgagg

SEQ ID NO: 6790792 - DNA, 56 bp, Homo sapiens
aatatgttagttttatatttgtgggtttagaaaaacccaccaaagtgcagcatgtt

SEQ ID NO: 6790793 - DNA, 95 bp, Homo sapiens
gcccggcgccaggaagcttgggcttgggcccccacacgagctcggcgcgcttcgggcgggtctcgggcgcgggcccgtggctctccgggccgggc

SEQ ID NO: 6790794 - DNA, 93 bp, Homo sapiens
gcaaccctgggctactcagttcctgcttcgtggatctgcctggggtcaggacataacatctgtgaagcaggaaggacagtgcccagagcttgc

SEQ ID NO: 6790795 - DNA, 79 bp, Homo sapiens
cgccatttgaaattcattctatatgcagagctgttccatgttgaaaatgatttctgtgcagtaaatggtgatgatggtg

SEQ ID NO: 6790796 - DNA, 60 bp, Homo sapiens
tcttggagtgctagagtatgttggtgctggtgagagcacggcttcatctttacttcaaga

SEQ ID NO: 6790797 - DNA, 63 bp, Homo sapiens
cagcaaggactgggcatgtgaaatgccaatggtttggctaatcaacacgccacagcttagctg

SEQ ID NO: 6790798 - DNA, 71 bp, Homo sapiens
gtaacctttaagggtggtgtgtttatttttcccatgttaaaactaagaaaatagaagcatgctaaggttac

SEQ ID NO: 6790799 - DNA, 57 bp, Homo sapiens
ccttctttggcttggatatggttggctactcgttgccaatcacatgtcaagagcagg

SEQ ID NO: 6790800 - DNA, 71 bp, Homo sapiens
ctaagcctggacccagcaggaaagactactagaatttattagtgatgtctgccatgggtatttaggattag

SEQ ID NO: 6790801 - DNA, 59 bp, Homo sapiens
gggaaatagatcagaactgctgccagtgtaggcttgtagattccagtggtctgtgtcct

SEQ ID NO: 6790802 - DNA, 58 bp, Homo sapiens
agttttctaccagggaagagagtcccacttcatgggattaagatcattgtagaagatt

SEQ ID NO: 6790803 - DNA, 62 bp, Homo sapiens
tcacacactgattcctgattccgcatagaagggattctccgggtaggaacatcaggatgtga

SEQ ID NO: 6790804 - DNA, 57 bp, Homo sapiens
ttgcttcctctagtttcttgaaggcatgcattactgtcttcacattggaagaagtag

SEQ ID NO: 6790805 - DNA, 56 bp, Homo sapiens
tgggagttattggctgttttgagagactcaccttcttgatgcagttggtactctca

SEQ ID NO: 6790806 - DNA, 71 bp, Homo sapiens
gtaagagcaggaaagaaaaatctgtgtgttctagattggacatcaatggtttatcttccaaatggttttgc

SEQ ID NO: 6790807 - DNA, 78 bp, Homo sapiens
gtggggccttggcccagtgggcctcggcaggatttccctgtgttcagggagtgactctcggggccactagccccccac

SEQ ID NO: 6790808 - DNA, 118 bp, Homo sapiens
tggagctgccccggggcctcttcctccatgccaagcgcttggcacacttggacctgagctacaacaatttcagccatgtgccagccgacatgttccaggaggcccatgggctagtcca

SEQ ID NO: 6790809 - DNA, 80 bp, Homo sapiens
ctactaaatgatatattgtctgcaaaggtttataaagataatcttggtgtctcttagtacatagatttatcatatagaag

SEQ ID NO: 6790810 - DNA, 56 bp, Homo sapiens
attgatggagagatttccattgggttgaagtgcctttcaggaatcgtgtcctcagt

SEQ ID NO: 6790811 - DNA, 98 bp, Homo sapiens
ctgtgccagcctgcttacctctagctctttgcttgtgacattttctccaactagaacacagagcaataacagggagaggaagagcgtggctgatacag

SEQ ID NO: 6790812 - DNA, 75 bp, Homo sapiens
agtaggtccctggctgctatagcagcatgtgctccatgccagggcaggtgtgtggggagcagcagggggtctact

SEQ ID NO: 6790813 - DNA, 64 bp, Homo sapiens
agccctggctggatggagcccctgggggagccagttcccagggactccccatccatgtctggct

SEQ ID NO: 6790814 - DNA, 73 bp, Homo sapiens
tccaaggaggtctggtgggtggtgccatccttgacgctggtcaccctcacggggactccttttttgaattgga

SEQ ID NO: 6790815 - DNA, 76 bp, Homo sapiens
cacagacagggtggtggacacacagtaaggtgacccccagggagtcctgcccttgtgtagtcccttcccctgagtg

SEQ ID NO: 6790816 - DNA, 62 bp, Homo sapiens
cacatttaggttcctatagccatgaacccatgaatctaatgcaaagtaggaaactgcatgtg

SEQ ID NO: 6790817 - DNA, 118 bp, Homo sapiens
tgcatcaaatgtttgagtgtgaagttcggtcctgacagcatctgtgattctctgtggagacatccgcagtgcagtttcccagatgctgtctgtattcacacgagaagagtttgatcca

SEQ ID NO: 6790818 - DNA, 69 bp, Homo sapiens
tgccagccagggagggcaaatgagagttgaaagccagcccacactccatttgccaagccttgcgctgca

SEQ ID NO: 6790819 - DNA, 61 bp, Homo sapiens
ttcttatatgtgtttttttgtgtgtgtgtacacacatgaaataatattatgcatatatgga

SEQ ID NO: 6790820 - DNA, 81 bp, Homo sapiens
cagaagtccaatctgccccaagaaggccctcgcttctctctggagttcaagagaaccttctgggtattccagatacctctg

SEQ ID NO: 6790821 - DNA, 83 bp, Homo sapiens
gccctgggctcccagccttcgccagtctgaaaaagggccatgaagaatcagacaactctggaggctggctgctggcctggggt

SEQ ID NO: 6790822 - DNA, 68 bp, Homo sapiens
ctgattttttatatctgggggttatttaggattattcacataaaaccctttaagatttgaatagtcag

SEQ ID NO: 6790823 - DNA, 62 bp, Homo sapiens
aggctgaagacaatggaattgactgtgccaggcacacttctcaccagactgtctcatcgcct

SEQ ID NO: 6790824 - DNA, 99 bp, Homo sapiens
gaggtgggaggatcgcttgagcctgagaggttggggctgcagtgagctgtgatggcagcactgcactccaacctgggcaacagcgcgaaaccctgcctc

SEQ ID NO: 6790825 - DNA, 61 bp, Homo sapiens
gacagtccttgcccagtatctagtccccgtcgccccgtgcaggagacgtaggtaggacgtc

SEQ ID NO: 6790826 - DNA, 73 bp, Homo sapiens
gaacactggacaggaggctaggtccacttagtaagtagtcactcttgcataccagcctcctggtcttcagttc

SEQ ID NO: 6790827 - DNA, 61 bp, Homo sapiens
ggcccaggcaagtgtggcttactcagaaaccagtcagagtggagaaacgcttcgtcgggcc

SEQ ID NO: 6790828 - DNA, 100 bp, Homo sapiens
tcaccaaagatctccaactgtcaaatgcaatgaactcattctcagtcttcattttccttgatgagtttgcagcatttgacatcattggcaatttcagtga

SEQ ID NO: 6790829 - DNA, 80 bp, Homo sapiens
tctcatgtccagatcctaccccaatcctgaccatttcatggaagtctacagtctgggtcgggtgtacaaatggcacgaga

SEQ ID NO: 6790830 - DNA, 63 bp, Homo sapiens
gggaaggaggtggacctgcccctttgtcctggctggggtggctgggccgggcccctccttccc

SEQ ID NO: 6790831 - DNA, 86 bp, Homo sapiens
gaaggggttcattggaggcctcaggtgtttctggagaagtaatcactcatgattatttcctagggaatttgcctccctttcccttc

SEQ ID NO: 6790832 - DNA, 73 bp, Homo sapiens
ggagccctaagaggaggacagctgactccgagatggtcagttccgtctgagagtagagctgcctcttttcttc

SEQ ID NO: 6790833 - DNA, 73 bp, Homo sapiens
ctctgtcaaatgctgagttcaaatggtgaagctgcgtattgacagcttcttctgatttgtcagtctggcagag

SEQ ID NO: 6790834 - DNA, 66 bp, Homo sapiens
gcatggagacttagctgtgtgatttccattaccgttaatgggcatttggcaactaagtccctgtgc

SEQ ID NO: 6790835 - DNA, 55 bp, Homo sapiens
gttttatactcattttgttttcttgcaataagaaagcttaactgggtaataaagc

SEQ ID NO: 6790836 - DNA, 72 bp, Homo sapiens
cctggaaagtgggaatttcagtgctaaaaccaggacaagttggtccctccaaagtgattcccattttccagg

SEQ ID NO: 6790837 - DNA, 62 bp, Homo sapiens
agcaacaggaccatggagcccatcattatgtgttttggctttggaacatggtctgtgtagct

SEQ ID NO: 6790838 - DNA, 66 bp, Homo sapiens
acttagagtgctttattagatgtagcttggagattatagggtgccactaaagaaccactcccaagt

SEQ ID NO: 6790839 - DNA, 66 bp, Homo sapiens
gttgtttgtaatgacaggagacaaagaatggctgctgagagtgatctcttgttttacaagctcggc

SEQ ID NO: 6790840 - DNA, 90 bp, Homo sapiens
tgagccactgcgcccggcctgctctctgttcttaagcttgtaaataacaaaaccaggagatgtgggctgaacggtttagtgtagtgatca

SEQ ID NO: 6790841 - DNA, 128 bp, Homo sapiens
ggaaggagatttcctttgctctcagaataagtacctggtgagatctttgcttgaaggatagagtgaaagcattcaaatctttaattgaggaatcatgaaccattacgttctgggactaggaacaagcc

SEQ ID NO: 6790842 - DNA, 73 bp, Homo sapiens
gggaagggctccttttattgcaaggaagcctcatgtacttcccatttcagcctaataaaagaagccttcaccc

SEQ ID NO: 6790843 - DNA, 68 bp, Homo sapiens
ggtcagttacagccacggcgggtgctggccaagccggtatgcagggcttgcctggtgtgtggctgacc

SEQ ID NO: 6790844 - DNA, 65 bp, Homo sapiens
caccattgtggaatatatcctgctaatctggctaaagatgactgcaggacaaaatttccagggtg

SEQ ID NO: 6790845 - DNA, 61 bp, Homo sapiens
agcgcaggactcctgggcctaagaactgcatctgaagcagccaggcctggggttttgcact

SEQ ID NO: 6790846 - DNA, 115 bp, Homo sapiens
gtgaacttgaactagaaggaaaggattttcaatagcataagatgtcaaatagaagaggctttttaatttctttatgctgggtacatgatagttctttactctcagccattctcac

SEQ ID NO: 6790847 - DNA, 63 bp, Homo sapiens
ttatatatatatgtgctattgagtttcctttgattgacagctcctgtagtacatattatttag

SEQ ID NO: 6790848 - DNA, 82 bp, Homo sapiens
atgcatattccccccacatttctgtcacgttcttttatttccacaatattttggggctacagaaaattcagggaatgcgcat

SEQ ID NO: 6790849 - DNA, 77 bp, Homo sapiens
cagcgatttggaaggtctgttctaggtgagggtttggtgaagattttcaccctgaatatattgatccgaaaatgctg

SEQ ID NO: 6790850 - DNA, 55 bp, Homo sapiens
agtgaaatgattctgagcaagataagtaatctcttggaacctcagtttcatcact

SEQ ID NO: 6790851 - DNA, 72 bp, Homo sapiens
ttcctctcccttttactgtgaaaagaaactggagcttctactcctgctacagtttaaaggggaagtaaggaa

SEQ ID NO: 6790852 - DNA, 69 bp, Homo sapiens
tgtctaaagagctctgatgggaaatcgattcacagaaaatgctgtgaaccctatcagactttttaaata

SEQ ID NO: 6790853 - DNA, 83 bp, Homo sapiens
ttccatgagcttcagtttcattatcgtaaaaggggataaaatgcctatgttaggaagttatagtggaaatgaagtcaaaggaa

SEQ ID NO: 6790854 - DNA, 73 bp, Homo sapiens
gttttggatctcaggcagtcatgactccagatcccaaagccctctggagtctgatactgagttcctcatgaac

SEQ ID NO: 6790855 - DNA, 60 bp, Homo sapiens
caagtgtggctgtctgttctcctaggtcagacaagactggaagggggacagccacacatg

SEQ ID NO: 6790856 - DNA, 58 bp, Homo sapiens
gtggagctggcccaagaagctgcatttctaacaagctcttttgtggagcagctgccac

SEQ ID NO: 6790857 - DNA, 114 bp, Homo sapiens
ggaggctaattttgcaagtagtcagctcgaacttcctgttatgtgtgcctcttataaaatgacgcgaagaggattatatgacaggaacagttgaatagctacagcaaagtttcc

SEQ ID NO: 6790858 - DNA, 94 bp, Homo sapiens
ggctgcgggaggcctgcattcacacggctgacggccagtccacaggacgcgcccgtagacttggaccaacagctgaagtcagcccctgacggcc

SEQ ID NO: 6790859 - DNA, 57 bp, Homo sapiens
gcctgggttcctgcttttgtgaccacatttaataacacaatgcatggaactcatggc

SEQ ID NO: 6790860 - DNA, 66 bp, Homo sapiens
atgctgtggtagacagcattcctttttccctcccatagaaaatgatatgttgtttactcatagcat

SEQ ID NO: 6790861 - DNA, 96 bp, Homo sapiens
ttttacaagctagtaagttggtatcagtcttttgccctgaggagtcttgaattgtaagaccaggaagagattccaatttacttaaatcttttgaga

SEQ ID NO: 6790862 - DNA, 55 bp, Homo sapiens
gctcatttgttacgcagcagatgcacgctgacatctgttttgtaccagatacagc

SEQ ID NO: 6790863 - DNA, 67 bp, Homo sapiens
gttgggtctaaaatgagtcttcctaggttagaaaaacttttcaaattagagactcttttaggataac

SEQ ID NO: 6790864 - DNA, 77 bp, Homo sapiens
gggtccttgagggaggcaggaaagttgtctgtctggatgtttcctcggacctctgtctgcttcctactccagggcct

SEQ ID NO: 6790865 - DNA, 60 bp, Homo sapiens
ctcctgacctcatgatccacctgccttggcctcccaaagtgctgggattataggcatgag

SEQ ID NO: 6790866 - DNA, 67 bp, Homo sapiens
caggtggcttctccctaggccaaaactatagcactttgagctgaaccacctaggagagaatcatctg

SEQ ID NO: 6790867 - DNA, 62 bp, Homo sapiens
gttcaggttaaatcacagattgctttcacttaaataaggtagttggtgggtgtgagctggac

SEQ ID NO: 6790868 - DNA, 56 bp, Homo sapiens
gttagccaggatggtcttgatcttctgacctcgtgatccatccatcttggcctaac

SEQ ID NO: 6790869 - DNA, 57 bp, Homo sapiens
ttgacagagctaggtcaactctgcttcacagggtgttggttgacactggctcttcag

SEQ ID NO: 6790870 - DNA, 99 bp, Homo sapiens
gcccaggcactgcccgtccatctgctgttgcttcctggcagggcgagcgggccatacatcacttagccatgccgaggaggctgggccgggcagctgggc

SEQ ID NO: 6790871 - DNA, 114 bp, Homo sapiens
tgggggtgatggtcgtaagtggtcagattccagggctgttttgaaaacatcctcagcaacatcaaggacagatttcaaggccttctggttcagtccactccagcctcagatcta

SEQ ID NO: 6790872 - DNA, 69 bp, Homo sapiens
ggaggctgcccagagagggcatgatcaccgttcctggtgccctgtgcctggtccctgagtcgagcctcc

SEQ ID NO: 6790873 - DNA, 97 bp, Homo sapiens
tccaagatctgtttagatattagaggtagatggtcagccaatgatggaaacgaatattctgctaccttctcttttaagtctcacatctcactatgga

SEQ ID NO: 6790874 - DNA, 60 bp, Homo sapiens
ggctgtcacaggttcaaactcccctactcgtggctgagtcaatgggatctgtttatggcc

SEQ ID NO: 6790875 - DNA, 56 bp, Homo sapiens
gaatttgtttatgtctttgtgttgtcctcagggcaatatttatataggcaagggtc

SEQ ID NO: 6790876 - DNA, 99 bp, Homo sapiens
agtcttttgtatcctgcagctcaagctggtgaggtggtctgaatgtgagggactatctcactaagagcatgaggcactctgataaagatacggaagatt

SEQ ID NO: 6790877 - DNA, 108 bp, Homo sapiens
ctacatgttgatattttctgtgtctctgcacttgcacataagctttgtgaaactttatcaccacagcctaaagcaatgcatggcatatggtaggtgctcaatagatag

SEQ ID NO: 6790878 - DNA, 67 bp, Homo sapiens
gactttatgaagagatgaccaatgggctatagactgaatttcagacaatggtcagatttcagaagtc

SEQ ID NO: 6790879 - DNA, 70 bp, Homo sapiens
tacagcatcttctagatccaggctatcgagcacttgaaatgcggctaagtctgaattgagatgtgctgtg

SEQ ID NO: 6790880 - DNA, 68 bp, Homo sapiens
ccactcttcactgcttttctaagattctgtgggaatgttaactcccacagcaaaggacagagagttgg

SEQ ID NO: 6790881 - DNA, 79 bp, Homo sapiens
gtggtagtggccatacccaggccccttcccatggaaggccttatcttctgttccctaggacctggggaggccttatcac

SEQ ID NO: 6790882 - DNA, 55 bp, Homo sapiens
ccagatatcactgccgtgttgttccactagtttaacaatatgctcagtggtttgg

SEQ ID NO: 6790883 - DNA, 66 bp, Homo sapiens
gccatcaggatttgagttattcgaacgcaagaactttatggcatgaatctttctaaccctggtggc

SEQ ID NO: 6790884 - DNA, 58 bp, Homo sapiens
ctgagttttgcgagaatcgttagtgatatagacacagctagcattccagaaaactcag

SEQ ID NO: 6790885 - DNA, 60 bp, Homo sapiens
tatttctattccccaggcaagtaaattgagcttccaagaatttagtgggggatagagata

SEQ ID NO: 6790886 - DNA, 86 bp, Homo sapiens
ggaagagtgacacacttgtcctggtcttcctgggactttcctggttgcttctgttctgggaaagccaggacaattcgtcactttct

SEQ ID NO: 6790887 - DNA, 88 bp, Homo sapiens
ggaattgtagaggtcaggaagtgctgaggctgcttctctgaaatggggctgaaagcagggcaggcactccaagactcatacacattct

SEQ ID NO: 6790888 - DNA, 77 bp, Homo sapiens
tcactcttgttgcctaggctggaatgcagtggtatgatcgcagctcactgcaacctccgcctctcaggttcaagtga

SEQ ID NO: 6790889 - DNA, 61 bp, Homo sapiens
gtttccatggctctgttaatgggaagtatcgactctttgtaggaatagagccactgggaat

SEQ ID NO: 6790890 - DNA, 81 bp, Homo sapiens
tttccctaagggaaggttccattatacttcagcagtggaaagcatctagtagaatgtatgctgtggtatcttctcaggaag

SEQ ID NO: 6790891 - DNA, 87 bp, Homo sapiens
gtgtgctagtttcagtaggacttgtgctttcattgcaattgtcagtatgcttaagcaggggtctctgctaatgaaattcgagcatat

SEQ ID NO: 6790892 - DNA, 60 bp, Homo sapiens
ttggcactagcactatctattgcatgcaaaagttttgctcaaaagaagtgttgatgttgg

SEQ ID NO: 6790893 - DNA, 57 bp, Homo sapiens
ggaaaaggaaagcagtataaggttttccctacttcttctctgctttgccttcattcc

SEQ ID NO: 6790894 - DNA, 100 bp, Homo sapiens
caatacctgggtaataagggactgactcgagatggggttccagctactgcaatgaatttcccagctttgatcagttttcaccagtactttcgtggtattg

SEQ ID NO: 6790895 - DNA, 59 bp, Homo sapiens
tcctctgaaatctagattgtgatgcaatgtatacgttctctaaatcagatttctgagga

SEQ ID NO: 6790896 - DNA, 67 bp, Homo sapiens
gtcttcttttgtccgggtgctggggttggtgggcaaatgtcctcagagtccagtttggcaggaagac

SEQ ID NO: 6790897 - DNA, 62 bp, Homo sapiens
gccagtgtggctccaaagcatgggcccctgagcaggggcctctcatgcccagagccaagggc

SEQ ID NO: 6790898 - DNA, 70 bp, Homo sapiens
tgtgcatctatctcctggtacccttcctagcatcaattctgtatttgtaggagtccaatcaggagacaca

SEQ ID NO: 6790899 - DNA, 68 bp, Homo sapiens
gctcctcccagtgtgcccctcctgcagctgccccagagcttgggagggaggccgctgtgcaggggagc

SEQ ID NO: 6790900 - DNA, 76 bp, Homo sapiens
gtagaattttctcctttggcatagaattatacattttaagataattaggaaaatgaacagaggaatagaattctgc

SEQ ID NO: 6790901 - DNA, 67 bp, Homo sapiens
cagaccatcttgaagcaaactgcatgtgccacatttaaaagggaggcatgcttccagggtgtgtctg

SEQ ID NO: 6790902 - DNA, 64 bp, Homo sapiens
gtagtctcagctacttgggaggctgaggcaggaagattgcttgagcccaggagttagaggctgc

SEQ ID NO: 6790903 - DNA, 94 bp, Homo sapiens
gtctctacaggcctaaagaaaggtaaatcagatgtattaaaagtgccttttcaacttatgagaatctgcagtatgcttagttctttgctgggac

SEQ ID NO: 6790904 - DNA, 66 bp, Homo sapiens
gaggtcttgactcagtctggggtggggctggggacacccataaccctgcccattgagcaggacgtc

SEQ ID NO: 6790905 - DNA, 71 bp, Homo sapiens
agcctcggcctggcctgaactaggaggtgaaatgcagatagcacccaccaccaggcaggacaccgaaggtt

SEQ ID NO: 6790906 - DNA, 66 bp, Homo sapiens
tgtgacaggtgctgggggcagtgtgttatttatagacacagagcccttccttgcaccatggaagca

SEQ ID NO: 6790907 - DNA, 67 bp, Homo sapiens
gtgtgctagctgcttcacacaggtaactaatttaaccctaacattctgtgaaatagctatgctacat

SEQ ID NO: 6790908 - DNA, 76 bp, Homo sapiens
cctcttgtctgcagatactttgaaagtggtggaattgagctaaaaatattcagaagtagctaagcagtcagactgg

SEQ ID NO: 6790909 - DNA, 74 bp, Homo sapiens
cttctgccgtccctgcagtacaggcaacagaaagtcatacaaattgcaaagagggactccagggatgacagaag

SEQ ID NO: 6790910 - DNA, 83 bp, Homo sapiens
cctcccctctctccccaagcagcagcctgaagtacgtcagcagtaattgtgtgcatggctcggctgtgcagggagggtggagg

SEQ ID NO: 6790911 - DNA, 68 bp, Homo sapiens
aactcaaagatgcatgacgctttcattctttttacaaagcccttttctagtcattgtgcctttgggtt

SEQ ID NO: 6790912 - DNA, 57 bp, Homo sapiens
ttgctcagcaaaggggatgcgtcctaagaactattaggcagtttcattgttgtgcaa

SEQ ID NO: 6790913 - DNA, 67 bp, Homo sapiens
ccaggcccagtggttcacgtgtaaccaggtgtgatttctgaggaacctggaccaaacactggcctgg

SEQ ID NO: 6790914 - DNA, 65 bp, Homo sapiens
agacaagtatttaaggttagtatattttattttaacaaagtattgctacatctgatgcttggtct

SEQ ID NO: 6790915 - DNA, 83 bp, Homo sapiens
tgagtgtttggaatcctcagtatgatcagggagggcactcagagagaagagctggaatgatctatgtgagggttccccattca

SEQ ID NO: 6790916 - DNA, 103 bp, Homo sapiens
cctgcctccagctcccctggcagcccaacctagagtctctcggggtaaactcagagtccaggaggctcaggaggagctgccggaggctgtgcggaggcctagg

SEQ ID NO: 6790917 - DNA, 81 bp, Homo sapiens
ctctagaggtaaagtatgttgtggcttttaaaatagaatttctgtgtttaaaaaatgtccatttatgcattgtttctagag

SEQ ID NO: 6790918 - DNA, 60 bp, Homo sapiens
catcagcttttctatgtggtgaccagcactgtcagtttaatagccaccaaaaagctgatg

SEQ ID NO: 6790919 - DNA, 123 bp, Homo sapiens
tcttgccacctcatgggctacaccttgacctaacgtttttatgtgtatacttgtgcttactctataacctttttagggtttgctgcagatgggcatataggccaggggcaagaggtggtgaga

SEQ ID NO: 6790920 - DNA, 68 bp, Homo sapiens
gacctcaagtctcttaatgggcagaaagtgttacaaaatatgggcactaggaagagattctagaggtt

SEQ ID NO: 6790921 - DNA, 61 bp, Homo sapiens
gcttttagtgacatctagtggactgttatcatatggtaacttctgttccgtgtcaggaagc

SEQ ID NO: 6790922 - DNA, 74 bp, Homo sapiens
tgcctcaaatatttcatatatttagaacctttttgggggcctttgaatagtgttttcagtatacttttggggta

SEQ ID NO: 6790923 - DNA, 92 bp, Homo sapiens
aaagccgttgttgtagatgactcctgaagtcagctctgggaggcaccgtggcttgttgggatgtttcagagtctggctgcagcctggacttt

SEQ ID NO: 6790924 - DNA, 125 bp, Homo sapiens
acggtgaggccaagaatatcctgcctactctggcgggcgggcgagccacgaagcctgctggaagggcatgaatcatggtccctgcctgccaagtgctcacttgggatgtgttcgaggctggctgt

SEQ ID NO: 6790925 - DNA, 74 bp, Homo sapiens
ggctgagggtcaggggccatgggccaaggaggtcagtcagatctccttggatctggaggccctggctttcagcc

SEQ ID NO: 6790926 - DNA, 70 bp, Homo sapiens
aggaatatttttaaagggactaattgcaaacaattctgcctgttgagatttatctttaaaaacggttcct

SEQ ID NO: 6790927 - DNA, 65 bp, Homo sapiens
ggcctcctagggcatcaggggcagccgatgtgagcagcactgtctgccctgagatgccagaggcc

SEQ ID NO: 6790928 - DNA, 100 bp, Homo sapiens
tgacagagaataattacaaggaaagttcaaaggcagattggtttaaacattacttgtaaattgtctctattttgattcgctagtgattcttgttctgtca

SEQ ID NO: 6790929 - DNA, 102 bp, Homo sapiens
gaggaacccgaagcactagggcatctggcttctgggccagggcagacaaagttgtggctgtggactcagatggctcctcgccttgtgtgtgcagaggccctc

SEQ ID NO: 6790930 - DNA, 78 bp, Homo sapiens
cattgagaataaaccatcctgattttcagagtccagataaataattcaatctgtctctgctcagatgatttatcaatg

SEQ ID NO: 6790931 - DNA, 55 bp, Homo sapiens
ttgagatggagtctcgcactgtccaccaggctggagtgcaatggtgccatctcag

SEQ ID NO: 6790932 - DNA, 71 bp, Homo sapiens
ggatgtgctgacctaaattgaggaagagttttcttttctattaactcattttgcatggtaacagcatatcc

SEQ ID NO: 6790933 - DNA, 66 bp, Homo sapiens
ccaggatgtcagggctctagagatacaactcagtgattctctgggtttttgtcctgtacgtaatgg

SEQ ID NO: 6790934 - DNA, 130 bp, Homo sapiens
ggtacagaaacagctagattggttacggttggcattattggtacactgtttgaactgtggtcggcctgcaattggctgaaactcagcagctgtgactggatgagacctagccacttgttacaagagtacc

SEQ ID NO: 6790935 - DNA, 67 bp, Homo sapiens
aagtctttgctactgtgaatagtgccacaataaacatacgtgtgcatgatttatagtagcatgattt

SEQ ID NO: 6790936 - DNA, 111 bp, Homo sapiens
ggccataaggccaaactgaactgacagaggagtctgagcagggctgcagatggagagaagcgtcccagcccagctctgactaaccctgtgtccctgtggggcctcctggtc

SEQ ID NO: 6790937 - DNA, 57 bp, Homo sapiens
cagcttgtgcaaaggtcctggggtaggaatgtgtccaaggaacagcaatgcaggctg

SEQ ID NO: 6790938 - DNA, 89 bp, Homo sapiens
gaatatttagagtggcgagtggtattttaaaatctagtttcaaaggagaactgagggttttatggttcacttgcaatgtcattgtgttc

SEQ ID NO: 6790939 - DNA, 64 bp, Homo sapiens
agcctcaagtgtaagacaatgcgagctgtgcaaaggttggcaggtctggagggcactgggggct

SEQ ID NO: 6790940 - DNA, 55 bp, Homo sapiens
gcaactttcaagcaccatggggggaaaaccaaatgggatagagcttggaaattgc

SEQ ID NO: 6790941 - DNA, 70 bp, Homo sapiens
ggtgaacagatcacctgaggtcaggagttcgagaccagcctgaccaacgtggtgaaaccctgtgtctacc

SEQ ID NO: 6790942 - DNA, 85 bp, Homo sapiens
cattttgctagcagtttgtgctttttgtaggaatgtgactgacacggatattctagccctggaacggcgactgctgcaaaccatg

SEQ ID NO: 6790943 - DNA, 60 bp, Homo sapiens
actcaattacctctctctcttctctctgtgccgacatggggcccaaagagaggtctgagt

SEQ ID NO: 6790944 - DNA, 56 bp, Homo sapiens
agagtgctagcctgagggaggtggagaacctagaatcctctcttttctggcatttt

SEQ ID NO: 6790945 - DNA, 87 bp, Homo sapiens
ggttagatttgttctgtgtaatataattaggactttgatagttgttaactgtgacttgaagcctggttatgtcaataaacattaacc

SEQ ID NO: 6790946 - DNA, 72 bp, Homo sapiens
ccgcccccaccgctgctcgtgccaggacgcgcagtttgcagttgcagctcaggcactggcgcgggatggcgg

SEQ ID NO: 6790947 - DNA, 86 bp, Homo sapiens
aaggtgaaaaataagcttttaggagaaaaacttgaaattccttttctaggatttctgtaacttatgaaagttcactgttttccctt

SEQ ID NO: 6790948 - DNA, 85 bp, Homo sapiens
agagctcaggtggtaatgcgagtgatgcagagtggctgcaaatacagatgaagctttgtttgctcacccgccgctcacctcctct

SEQ ID NO: 6790949 - DNA, 58 bp, Homo sapiens
gggtttgtggagctggaaacactgaatgaatgtcagtgcagctggatctcagagagcc

SEQ ID NO: 6790950 - DNA, 110 bp, Homo sapiens
aagactcagtctcaggaatgcagtctgtctggtgtaccttggctcaggcactcattcactggctgggggaacagggacatcttaatggcagacctctcaagactgttctt

SEQ ID NO: 6790951 - DNA, 76 bp, Homo sapiens
tcctggctccccttgctcccagactgaccagaggtgtgtggcatctggggctgtggggagctggggtgggccagga

SEQ ID NO: 6790952 - DNA, 61 bp, Homo sapiens
gaggggggttttcttaaccatgtctttgtccttgctggactttaaaaagatgacctttttc

SEQ ID NO: 6790953 - DNA, 58 bp, Homo sapiens
tggcaggagttagggtaaaaatgacctaataggtcttttccaactctgatttctatca

SEQ ID NO: 6790954 - DNA, 56 bp, Homo sapiens
ggcctctctccagtcagtgcagcccagttgttgtgcggatgaggcctggaggggct

SEQ ID NO: 6790955 - DNA, 82 bp, Homo sapiens
tgaagtctgctgtgcaacattgcacctatagttaacaacacaacagtgggtgtgtaaaaatgtgctaacaggatagatctca

SEQ ID NO: 6790956 - DNA, 61 bp, Homo sapiens
gctcagatctggaaagtgtggtggagagaatttctttcacttgactttccagtcttggggc

SEQ ID NO: 6790957 - DNA, 58 bp, Homo sapiens
acccaggctggcgtgcagtggcatgatcttggcgcactgcaacctccgcctcctgggt

SEQ ID NO: 6790958 - DNA, 79 bp, Homo sapiens
tacaggacgtctgtgcaattcgatggagctcatcacttttcggtctatgagcaattaaattgcaccaggaagccctgta

SEQ ID NO: 6790959 - DNA, 129 bp, Homo sapiens
caagctctagaaagtaacgggcaaagagtttaggaatctgggcccaactgtgccgagataatcaaagccacagaggcctaagattcaaacaagacattttgcagggatactttgtattagtttttaggg

SEQ ID NO: 6790960 - DNA, 58 bp, Homo sapiens
cagttttgtctccatgtgatctagaatgtttatgtgagaacagatgtgggcagacctg

SEQ ID NO: 6790961 - DNA, 56 bp, Homo sapiens
ttcctcatctgtgcacctcactggcagacttctaaggagatggacagatgaagggg

SEQ ID NO: 6790962 - DNA, 129 bp, Homo sapiens
tatttcctaaagagtgtgtcaaagtgataaaagaggtgaggaatggactcataaacagagtgattttgaaattactgttggtgtatccatagcacgtgttcttctaaactttggcttttaaggatttca

SEQ ID NO: 6790963 - DNA, 70 bp, Homo sapiens
cagtaagtggcaggtgcaggatttgaacccaaatctgcctatttccgaagcctgtgcttatcacttgctg

SEQ ID NO: 6790964 - DNA, 55 bp, Homo sapiens
gttttggctcctggaggccctttagggtctcaccctctgtcccaggaggcggaac

SEQ ID NO: 6790965 - DNA, 109 bp, Homo sapiens
tccttgtctgcgtgacgtgagagtgactgtgggtgagagcgttccagcaagacaatgatgatctctgctgtctgattcccacttcccagattctcacagtagacgagga

SEQ ID NO: 6790966 - DNA, 56 bp, Homo sapiens
ttccagatgtgtcaggggtcagttgggaaaccagagagcttgcaagcattatggga

SEQ ID NO: 6790967 - DNA, 57 bp, Homo sapiens
tccttcaagatgccacagctttccctttacttaggaatcttggcatctgtgaagtga

SEQ ID NO: 6790968 - DNA, 78 bp, Homo sapiens
tcagtttcttgcctttcaacagattgtattaaggttagatcttttatctgaaatgaattatcctgtgcaagaaaatga

SEQ ID NO: 6790969 - DNA, 75 bp, Homo sapiens
gtgaatgtacttaaggtggctgaattatatacttaaaatggttaaaatggtaaattttaccttatgtatatttac

SEQ ID NO: 6790970 - DNA, 117 bp, Homo sapiens
ggggccatcagccatggaaggcaggctgcctctggaagctggagaaggcaaggaaacagattcttctctagagcctccagaaggaatgcagcctgctgatacctggattttagcccc

SEQ ID NO: 6790971 - DNA, 100 bp, Homo sapiens
gttgtatcaatcagtaaaggctaggttatgctgtgataacaaagaattccaaaatctcagtggcttaaaatgacaggtgtttatttctttttgttacaac

SEQ ID NO: 6790972 - DNA, 60 bp, Homo sapiens
gctgcctgcctgcatttaatccataaagcaatagtgctgtttgatagatggggaggcagc

SEQ ID NO: 6790973 - DNA, 62 bp, Homo sapiens
caggtgattagagctagatgaggtcatgagagggaggccctcatgaaaggctcagtggcctg

SEQ ID NO: 6790974 - DNA, 99 bp, Homo sapiens
ttatccaaataattttaactataaaaggtcagtgcactaaaatgagagtttctttaagaaatatcattctggtgcacagaacaactccttttaggataa

SEQ ID NO: 6790975 - DNA, 67 bp, Homo sapiens
aaaaaaaggtttatttaatcagggagcctctgaagacacctggtttctgttgaatatatcttttttt

SEQ ID NO: 6790976 - DNA, 95 bp, Homo sapiens
ggggaggccctcggttcctggagagtgggcgagcacagcttggcctggggttggccgctggctcccggggatgcttctgcgagggtgttttcccc

SEQ ID NO: 6790977 - DNA, 64 bp, Homo sapiens
gccaggactgcctgtatctcttcttcctggtgacagggagacagttcagatagtttcttttggc

SEQ ID NO: 6790978 - DNA, 65 bp, Homo sapiens
gaaatggtttcttgggagaagtcaggagctgtcatcagcatctgatgagcccaggtgaccatgtc

SEQ ID NO: 6790979 - DNA, 70 bp, Homo sapiens
ggaggtaaaggaatatcagtttggaggcaatgtattaggtcactgtcaatcagaacaattccatgcctcc

SEQ ID NO: 6790980 - DNA, 64 bp, Homo sapiens
tccaggtcgccagcaggaacgtcacaggagagccccggtcgctcgtcaggcgggcggccctgga

SEQ ID NO: 6790981 - DNA, 75 bp, Homo sapiens
catatgtggctagtgactaccataatggatagtacattatgcactgcccattatggtagtcactagccacatatg

SEQ ID NO: 6790982 - DNA, 56 bp, Homo sapiens
gaggctctggagtaggtacacagaataagacatggtgcttgtctttaaggagcctc

SEQ ID NO: 6790983 - DNA, 73 bp, Homo sapiens
gtcatatggcaggtggaaggaaggcagtgtggtcacctgccccgtggtgttcccacgcctgctagtctgtggc

SEQ ID NO: 6790984 - DNA, 72 bp, Homo sapiens
gtgtccaaactcctccactgatcctgactttggagcagccctgaccaaggccctcagtgggaggcgggacac

SEQ ID NO: 6790985 - DNA, 76 bp, Homo sapiens
ggagtttgaattttattctaagtttaatgccatcaattagaggctttattaagcagggtaagtaaatgtagactct

SEQ ID NO: 6790986 - DNA, 64 bp, Homo sapiens
ctgactgggacctgagggcagcctggggaaaagtcaattccaacatgcagtcaggcctagttgg

SEQ ID NO: 6790987 - DNA, 67 bp, Homo sapiens
ctatttttccttctagagcagatttcaggcagcaaattcagctgggaattctagtgcaggataatag

SEQ ID NO: 6790988 - DNA, 55 bp, Homo sapiens
ctcactaggaagtaaagtttgtaagcccaaggccaatatgctaatttttagtggg

SEQ ID NO: 6790989 - DNA, 105 bp, Homo sapiens
catagcaggagtcagtttggagggtaattcaggctcaagaccgagacatgaaaaagtggctcagtttgggggattgaagagatgcacttttttgtaaactgcttg

SEQ ID NO: 6790990 - DNA, 69 bp, Homo sapiens
tttccctgtgttgcctttcccctctggaagcatcttgggatgttttgaggggaaaggcaaatagggaaa

SEQ ID NO: 6790991 - DNA, 58 bp, Homo sapiens
tctttgctttcacatgtttgaatgctatttaatagggcatcttaattgaaagcagaga

SEQ ID NO: 6790992 - DNA, 55 bp, Homo sapiens
tctggaagttagaggaggaaagattagcattttcaatttctgctgacttatcaga

SEQ ID NO: 6790993 - DNA, 60 bp, Homo sapiens
ggaaacccttgataagatgagccataaacctatggtgaacagttcattttatcatgttct

SEQ ID NO: 6790994 - DNA, 60 bp, Homo sapiens
gttgagacgtgtattggaatctctgactagtcagaatacgttcttagttatattctcaat

SEQ ID NO: 6790995 - DNA, 72 bp, Homo sapiens
agatatgcagagtgaggaagaactgcatgaatactgatcattggtgccgaggacgtctttactctggaatct

SEQ ID NO: 6790996 - DNA, 69 bp, Homo sapiens
ggagtgagaatggcacaagaggtctggctttctgacgatgtaactgtctctctgtgtacagtctcaccc

SEQ ID NO: 6790997 - DNA, 81 bp, Homo sapiens
ttgccgtttttgtaggacatagtcttgttaggactttctttattatcttcaagagacaattgttctaagtaaaaatagtaa

SEQ ID NO: 6790998 - DNA, 74 bp, Homo sapiens
tctgtgtcttccctccatttcattttataaggcattttagtgcattgtatgtggcaaatgggggaggagacaga

SEQ ID NO: 6790999 - DNA, 72 bp, Homo sapiens
gggattttgatagggattttactaaacccaaaggtccatttgggaagagtaaccctctgattttaaagtctc

SEQ ID NO: 6791000 - DNA, 87 bp, Homo sapiens
tgcacattcaaagtacaacttttctatcatgtggaagcttgaagaacattttttatgtgaagaggatttatcatactctgaaatgca

SEQ ID NO: 6791001 - DNA, 67 bp, Homo sapiens
tctccaccagctgcaccagctgcacccagtaggtctcctctgccaggcttggtgctagatgtggaga

SEQ ID NO: 6791002 - DNA, 55 bp, Homo sapiens
catgtttgtccacatggtagactgcactagccttctccaatgtaggataaatgtg

SEQ ID NO: 6791003 - DNA, 72 bp, Homo sapiens
gccttctgctgcagagctgcgggtgcctggggtgagccagtgtgcagttgcactctgtgcccagcagagggc

SEQ ID NO: 6791004 - DNA, 74 bp, Homo sapiens
gcttcagaagttgggctctgaccaccagggtctaaatcttggtcctgccattctttagatgcctaactctgggc

SEQ ID NO: 6791005 - DNA, 65 bp, Homo sapiens
ggcagccctcgctagctctcccccatgcacatcctggggttgagctctccgggagggcactggcc

SEQ ID NO: 6791006 - DNA, 87 bp, Homo sapiens
gggaccgtggaccaaagggcagaacatgagcatgttgttcatgctcaggtcgttctgccccttgctcatgaacatgtccatggtccc

SEQ ID NO: 6791007 - DNA, 61 bp, Homo sapiens
acaggtgaggggttctaggctgtatggagaaagaaaggaaagccaggaagtccccaactgt

SEQ ID NO: 6791008 - DNA, 62 bp, Homo sapiens
tattgtctatcgctgctttcatggtacaacatcagagctgaatgcttgtgatagagacagta

SEQ ID NO: 6791009 - DNA, 57 bp, Homo sapiens
ccaggcaggcagcgttctcagggcctggcccccaggctgtgggatgtgtgtgtctgg

SEQ ID NO: 6791010 - DNA, 118 bp, Homo sapiens
ggtttccagatgaccctcaggttcttccgcgttggttagagagggctacgcatcttctactgctcagccacagtctgtagccagcttagagcttagaagacattgcagtctggatgcc

SEQ ID NO: 6791011 - DNA, 123 bp, Homo sapiens
tcccttggttgcattcttagggaacatcttcagtgtgcacatggtagcagtccctcacccacattcctagggaatgtcttcagtgtatacatggtggcagttctttggctgcatgcttaggga

SEQ ID NO: 6791012 - DNA, 60 bp, Homo sapiens
gaggtggcctcaagcagtcttcagctacgtgcttacctgcccggctgttgatgccatttc

SEQ ID NO: 6791013 - DNA, 59 bp, Homo sapiens
gttaggaacactggagcctaaaagactcccctagcctgagggagctccattgttatagc

SEQ ID NO: 6791014 - DNA, 80 bp, Homo sapiens
gttattcctccttgcttcagagtttagctggtgtttgccttcaacaacaggaaatacttatgaggtaggaaggctatggc

SEQ ID NO: 6791015 - DNA, 57 bp, Homo sapiens
aagccttgctgcaattgttaaaagtttgaatttttaataaatcttgctgcaggtctt

SEQ ID NO: 6791016 - DNA, 59 bp, Homo sapiens
catgtcagcaaagcatcactccaatctgaactttctgatttccagctttgcctggcatg

SEQ ID NO: 6791017 - DNA, 76 bp, Homo sapiens
ttttctgaaagagcattttgtaaaatccttgcttcctttcaatttaagtggtttcttagaatgttttgctagaaaa

SEQ ID NO: 6791018 - DNA, 66 bp, Homo sapiens
ggggcactcccacaagcacaaatgacatatgtttcgtattatatgcacattctttgtgggagcccc

SEQ ID NO: 6791019 - DNA, 55 bp, Homo sapiens
ggggagattccagtaaagctgggaacttgaaccccaagttctgctgaatcttctt

SEQ ID NO: 6791020 - DNA, 90 bp, Homo sapiens
ctttagttaataataatgtgttagtattgatttgtcaattgtaacaaatgaagaaatatacaggactaatgcaatttgttaataatagag

SEQ ID NO: 6791021 - DNA, 74 bp, Homo sapiens
tttaactctttgacaattcatgacatttataggccaactcctgagggccgtattggtcagaatgtcaagttgaa

SEQ ID NO: 6791022 - DNA, 70 bp, Homo sapiens
gggttaaaacaggaagatcagctaaacatctcttttccatggctggaaaatcctgtcctgtcctgacacc

SEQ ID NO: 6791023 - DNA, 81 bp, Homo sapiens
acgggcactcagctgagccctcagccctcatggctttcccgatgctcaccggtgcagaggagccagctggggagcctctgt

SEQ ID NO: 6791024 - DNA, 69 bp, Homo sapiens
cctgatcccttggtcagatggttctgagctgtttaagtgctgagtgtcaactgtctacagggagccagg

SEQ ID NO: 6791025 - DNA, 62 bp, Homo sapiens
aggcaaggtgactctgggttcaaggctcaccagctggtgaccctgggcaagtcacctaacct

SEQ ID NO: 6791026 - DNA, 62 bp, Homo sapiens
aggacaaaagccagaacttgcagggagttgtaaattctgctaagaagtttggattttgtcct

SEQ ID NO: 6791027 - DNA, 94 bp, Homo sapiens
tttggggtgacgcaccaaaccttgaaccaatcactgtagccagagagacaggtgctctggtttgacctggtttatgtcagtcgtgtgccctgga

SEQ ID NO: 6791028 - DNA, 83 bp, Homo sapiens
tcctcttacctctccaggctcgtccaagatcgacatccatcccttcttgaagttgagcagatcgggctgtggggagatgagga

SEQ ID NO: 6791029 - DNA, 68 bp, Homo sapiens
atccatgctcagggtgtgaggtcgctgatatctattagggagtatgttccacattttgagtctgagat

SEQ ID NO: 6791030 - DNA, 65 bp, Homo sapiens
tttgctcttatgaacaaggtggtaatgggcaggcttgtgcatggatcttgctgcatatgggcaag

SEQ ID NO: 6791031 - DNA, 55 bp, Homo sapiens
tgactggtcacacatccctgcagagcctggaaccaaggcagggctggacaagtca

SEQ ID NO: 6791032 - DNA, 64 bp, Homo sapiens
ctttgtatttcgctaggtactccctgattacctgcaattaggttaccatgtggcgaatacaaag

SEQ ID NO: 6791033 - DNA, 59 bp, Homo sapiens
cacttggccctgaggttatcatctaggatcctgcaatgagaggcagcagggctctggtg

SEQ ID NO: 6791034 - DNA, 66 bp, Homo sapiens
ttctcacccctgtggagcatggtggccagcaccaacgtgggcactgtggaggcatggggaggagaa

SEQ ID NO: 6791035 - DNA, 66 bp, Homo sapiens
gaagaatggagttgtgctgtccgcggtgctgaaagttccgatcccatgtagtgacttcattccttc

SEQ ID NO: 6791036 - DNA, 56 bp, Homo sapiens
gctctggctactccaccctgttggccaaggggctgaagggtggagcactggcctgc

SEQ ID NO: 6791037 - DNA, 99 bp, Homo sapiens
aggacatggattatggcctggatttaattaactgttgctcatggcaccatgcaggctgacatttaattatattcagtttagccctttattatatatcct

SEQ ID NO: 6791038 - DNA, 75 bp, Homo sapiens
tctgaggaaatgccccggcagcccctgaacaggcttcagtagtcccttcagtgctaggctgcctggtttttcaga

SEQ ID NO: 6791039 - DNA, 69 bp, Homo sapiens
cagccccacgtgtgctgtactgtttctgtttggcccaaactagagactaagccagcatagtgcttgctg

SEQ ID NO: 6791040 - DNA, 58 bp, Homo sapiens
caggctgggaacgccacccgcttccgtagtaggaaatcaatcgtggattcccagcctg

SEQ ID NO: 6791041 - DNA, 84 bp, Homo sapiens
ggcctgacagcctgacaaaggggctcttgtcaggcgcagcaagaggggctgtcctggccgcccttgtgaggctgttctggggcc

SEQ ID NO: 6791042 - DNA, 129 bp, Homo sapiens
gagggctgaatgcttcttcctggaaaaactctcagctcctaagtgagtggttgtgatggcttttcctaagactgcctgcatccttagggtagagagtagaaaccttatattgctacaactcagcatctc

SEQ ID NO: 6791043 - DNA, 58 bp, Homo sapiens
tggtgtctagtgaaggcctactatctgacttatgtatgatggcttctcactgacctca

SEQ ID NO: 6791044 - DNA, 63 bp, Homo sapiens
tatagaaacaaactgacattgcttctaggatatctaggagggcagatttggtttgttttaata

SEQ ID NO: 6791045 - DNA, 78 bp, Homo sapiens
caatgtatggtgtgggtgatgaatttgttcttgtcacagcagaggactgagtattctttacccaaatgctatagattg

SEQ ID NO: 6791046 - DNA, 69 bp, Homo sapiens
gcaaattaggcagtgccattgtacggtaattatgttttcttaatgtttccacaacagctctgcctttgc

SEQ ID NO: 6791047 - DNA, 66 bp, Homo sapiens
tggaggtcaaaatgcttttcaggtctttaatatctacattgagtccaaaactacttttgaccttta

SEQ ID NO: 6791048 - DNA, 68 bp, Homo sapiens
acagaaagataggcacaaggtcacggttgctgaaggaaagagctattaccaaaacctatactttctgt

SEQ ID NO: 6791049 - DNA, 55 bp, Homo sapiens
agcaaagctgattaagagcacagactttggaaaaggcagttttggtggctttgct

SEQ ID NO: 6791050 - DNA, 59 bp, Homo sapiens
ctaaatgttggtgttccccacaaatttatatgttggggacctaagacccaatgtgatag

SEQ ID NO: 6791051 - DNA, 82 bp, Homo sapiens
ttttctttctgctaagtacataaacagcttctaatcagcaaacaatcggctgtagatgtagagggtttggccaggaggagaa

SEQ ID NO: 6791052 - DNA, 64 bp, Homo sapiens
tttcttggggctcctgcgccattctcccaggaaagtgaggcgaaggtgctggcgccccaggaga

SEQ ID NO: 6791053 - DNA, 100 bp, Homo sapiens
gggctggctgaggcccctctatgtgcacctgggtgggcagtcggtgcaggtgcaggcctcacagacgcatcctcaggtagaagaggtttcagaggagccc

SEQ ID NO: 6791054 - DNA, 103 bp, Homo sapiens
gccaagccagcatcctttgcacttaaagtccagactcctttgcgtggattctggtccacaggacggaggtctggccgctgccagtgttgctgctttcaatggt

SEQ ID NO: 6791055 - DNA, 58 bp, Homo sapiens
ctcagcttctacctcctgagtgaaacctcttcatcttcctcaccaggtgtaggctgag

SEQ ID NO: 6791056 - DNA, 56 bp, Homo sapiens
cgggcttgtaggtgatggagaactcgcccaggtagtggccgatcatctcgggcttg

SEQ ID NO: 6791057 - DNA, 85 bp, Homo sapiens
gaagcttataaagttttctgagactcttttagcaacagatttctgttactgaggccatgagtctcataaattgttatggtacttc

SEQ ID NO: 6791058 - DNA, 128 bp, Homo sapiens
ccaggcaagtaaatgaacatcaacttacatctacagtccataactggaacctggctaggaacagggaaacgtttgaatagaaattagcaaggtgaagtatgggtgagaaaagtgatgttccttcctgg

SEQ ID NO: 6791059 - DNA, 58 bp, Homo sapiens
ttccttgggaaatgctcgtttacatttagtgaatggtcctggtagttttgacaaggaa

SEQ ID NO: 6791060 - DNA, 88 bp, Homo sapiens
ccccagctgcaggttcagcattccacctgcctcgtcaagctccaaggcaacgtgactgaaagctgacctgtggatctaggagctgggg

SEQ ID NO: 6791061 - DNA, 80 bp, Homo sapiens
ggtatctaccatattgaatatttggttttcttgaactcacccaagaaagctgaatattctgtgtggaaacaggttacacc

SEQ ID NO: 6791062 - DNA, 74 bp, Homo sapiens
ttgtttgttttgagatggagtcttgctctgttgcccagggtgtagtgcagtggctcgatttcagctcaccgcaa

SEQ ID NO: 6791063 - DNA, 63 bp, Homo sapiens
caggggaatgagtgcccagaaagccctggctggtcctggggctgagctgccactcacctcctg

SEQ ID NO: 6791064 - DNA, 121 bp, Homo sapiens
ggatgctgaacttgataaatctgtaaggtctgtgaatctagaagtcattcaattaaatacaaacatgggtctggataattccagtaccttagagttgaaatgatcctgagttcctgcctct

SEQ ID NO: 6791065 - DNA, 88 bp, Homo sapiens
tttgatcagcatggctagtcttacagtgcattctttgaaaaagaagaaatactgcctaagactgtaacacaacaatttgctaatgaga

SEQ ID NO: 6791066 - DNA, 71 bp, Homo sapiens
gaaggggcctcggatacaaaagtttagatgctgtggcttagagcactgaatttaacttgtatccccctttc

SEQ ID NO: 6791067 - DNA, 70 bp, Homo sapiens
tctccatgttgttgtagttgtccctggattgtcttcatgtcgcagctgaccttttacaaaacatgtggga

SEQ ID NO: 6791068 - DNA, 55 bp, Homo sapiens
catttgcttatctccacagttgtttcactacagctctaatgaaggtgggcatatg

SEQ ID NO: 6791069 - DNA, 66 bp, Homo sapiens
atttaaagaagagaaggcatttatgagtaatatgctgtggtagttaaatccttatcttctttgaat

SEQ ID NO: 6791070 - DNA, 75 bp, Homo sapiens
cgggggggctcggccctcacacgcccggggtcccgggggtcccaggtgctgaaggaggccgcagggcccgccgcg

SEQ ID NO: 6791071 - DNA, 55 bp, Homo sapiens
ccagggcagggaccacgtgtctttatgtccctgaccacggggcctggcaccctgg

SEQ ID NO: 6791072 - DNA, 125 bp, Homo sapiens
aacagagcagggccaggagatggaaggggcctcccttgccctcaggagtccctgaccagggaagatccctccatgctctctgagggtggcggggctccaaagatcctggccaggagtgctttgtt

SEQ ID NO: 6791073 - DNA, 116 bp, Homo sapiens
acatctttatgccttgcccacttttctgtcttctgaatagttctattttaaaggaatgctggttccttaaactgggcattcagagaactgaagactagtctccatggcactgatgt

SEQ ID NO: 6791074 - DNA, 95 bp, Homo sapiens
gggtatccctgtctgcacagtgagagggctgggctcatgatctcacccagatctgggctgaatcccacctctgtcattgtagggcagcgtgacct

SEQ ID NO: 6791075 - DNA, 126 bp, Homo sapiens
tgtccttcatttgagctaatatcgtgactgaaagcacagcaatctgagagacatagttatttaaatttaaaattgtgctcacagcttgtttctaagagatcaatttattagtccaggtgggagata

SEQ ID NO: 6791076 - DNA, 92 bp, Homo sapiens
ttcactcatcaaggaagcagcaatgcatgattgtagcctcaagaaataaatgactttggtcatgattgggtttccttacttgtcaaagtgaa

SEQ ID NO: 6791077 - DNA, 75 bp, Homo sapiens
ggaaaagggaatgcttggcccgtctgaagaaggctccaatgtctctttccagggtaccccaggtgcttcttttcc

SEQ ID NO: 6791078 - DNA, 75 bp, Homo sapiens
ctagttatcatcacaattttatgaccctctcacttgagagtggaatgacaatgtggttatgtaacctaagactag

SEQ ID NO: 6791079 - DNA, 55 bp, Homo sapiens
aaagttaagaaagggatgcttaagggctctttggagcatccatgactttggcttt

SEQ ID NO: 6791080 - DNA, 66 bp, Homo sapiens
tgtaatcccagctactcgggaggctgaggcagaagaatcgctagaacctgggaggcggaggttgca

SEQ ID NO: 6791081 - DNA, 66 bp, Homo sapiens
tctttttcttggaaagttacgggagtaggaggaaaatcctgactctgctgtttactctctataaga

SEQ ID NO: 6791082 - DNA, 65 bp, Homo sapiens
tatcaagagtttctttagggatgtgttaagttcaatttaagatgtctaagaggagatgctgggta

SEQ ID NO: 6791083 - DNA, 63 bp, Homo sapiens
ccacctaattgctgactcaagttgctggtttgcaatgggcacagaacttctcttagtaggtgg

SEQ ID NO: 6791084 - DNA, 70 bp, Homo sapiens
aaatgttaccccagaatccttctatctgcagattaattccccctgcagattgtggggttcaggtttattt

SEQ ID NO: 6791085 - DNA, 74 bp, Homo sapiens
gcagcggggtgggaatagacctgtctatgcagtagaaacaaaccagacatggatcctgttcttactaacgatgt

SEQ ID NO: 6791086 - DNA, 73 bp, Homo sapiens
gcaatgacccttgtttatcatttctgaatattatacaaatttgcagaaatgacaaagtaagaggaagcaaggc

SEQ ID NO: 6791087 - DNA, 59 bp, Homo sapiens
tatttgctttcctgaatcatgaacttgtttctacaagcattggaagaggaagggaaata

SEQ ID NO: 6791088 - DNA, 72 bp, Homo sapiens
gagtaggaattccagagtattggtagctataaccactttgggttccctgccattgcttctggtgcctcattt

SEQ ID NO: 6791089 - DNA, 61 bp, Homo sapiens
agccactgtctgaacttctgtggaggtctggtgcaggggaggtgtgaacagataggaggct

SEQ ID NO: 6791090 - DNA, 73 bp, Homo sapiens
ctcccttttggatatggggagagggtcaggataccttaatttacagttcgccatgtctcttcacagaagggag

SEQ ID NO: 6791091 - DNA, 71 bp, Homo sapiens
gtttcacttaaaagtcttggggaaggccaggtattgtggctcatgcctgtaatcccagcacttttagaggc

SEQ ID NO: 6791092 - DNA, 88 bp, Homo sapiens
atgcagtatagagtaattctggtaaatcattgagcctatcacatcctaagttctcagtaaacattagctatgattatcattactgtgt

SEQ ID NO: 6791093 - DNA, 92 bp, Homo sapiens
gtggcaatatgtacgtgctaggaagaagggtgcttgaaagaacatatgtcctggatatttcatagctttttctttgtaatatgtgaagctac

SEQ ID NO: 6791094 - DNA, 87 bp, Homo sapiens
gctttagtggagttcaagttagagatatatttagttttggttaaatgggacctatttatgtggttttctgacaatttcacatatagc

SEQ ID NO: 6791095 - DNA, 69 bp, Homo sapiens
aatactcagagtggtagcctattttctgcatataaatgtaaaaattcctggttacaactctgtaatgtt

SEQ ID NO: 6791096 - DNA, 60 bp, Homo sapiens
cagtgaagttctactgaatggttaactcggatgctgagtatcatgactggggactcactg

SEQ ID NO: 6791097 - DNA, 62 bp, Homo sapiens
ccagtaatgcggcctcactgatagcagaagttcggagagctcttgtcagagaggccagctgg

SEQ ID NO: 6791098 - DNA, 70 bp, Homo sapiens
tgatagtgacttattgtttagaactttttaagatcaacttttaagatcaagataagcaataaggtggtca

SEQ ID NO: 6791099 - DNA, 83 bp, Homo sapiens
ggtgggcgtgggagccccgtttgcgcaaggcaggcgcgggggactaaatggctgctggtgcagagtggggctgccccggcacc

SEQ ID NO: 6791100 - DNA, 69 bp, Homo sapiens
atgtctccaagcagctgacctttaaagggtccaattcttcttttaagaggaggctgtttgaagagatgt

SEQ ID NO: 6791101 - DNA, 63 bp, Homo sapiens
cctggggctgggcatggtgttccctcaggagggctgaccctctggaggatgctcggtcccagg

SEQ ID NO: 6791102 - DNA, 103 bp, Homo sapiens
ccagccctgcccttgccaggcatgaattactgcccggctttctcggctgcagcggcagcgcagagaaatgccgggggtacaaacgcctcgaggttagagctgg

SEQ ID NO: 6791103 - DNA, 69 bp, Homo sapiens
gctcaggcgacctccatggctcagtttcagacaagtttctaagcaggtctgatggcctggggcctgggc

SEQ ID NO: 6791104 - DNA, 68 bp, Homo sapiens
ctacactttggttgactttgtgatatctacttataatatatcatcacaacagttataactaggtgtag

SEQ ID NO: 6791105 - DNA, 92 bp, Homo sapiens
gatgatagaatacttggttactgtgttggtttatatatatgtcttttaagttttcataagtgatatttagctatagagcttattttattatt

SEQ ID NO: 6791106 - DNA, 68 bp, Homo sapiens
ctggctacctctggccttcaggcatcattttgcacaacagaaagaggcctggaggcagaggtgaccag

SEQ ID NO: 6791107 - DNA, 73 bp, Homo sapiens
accctcctacactcactgaaatgtcttcagcccctaacctctagaagagctgaggacatcatggaaggaaggt

SEQ ID NO: 6791108 - DNA, 58 bp, Homo sapiens
ttgtgaaatcgtgtttggaagctagattgctctagaccactaaggtatgatttcacag

SEQ ID NO: 6791109 - DNA, 62 bp, Homo sapiens
tactgtggtaacattttaaattgccatatgtagaggcaaaattggttaaaaatgctacagtg

SEQ ID NO: 6791110 - DNA, 77 bp, Homo sapiens
actgagagtagctggagaacatttgtaatggtaagaaatagttccatagtgagtcatttacccagctactttccagt

SEQ ID NO: 6791111 - DNA, 81 bp, Homo sapiens
ggaatcaagcctaaggcatcaaaaacagtaataaagtgaatttgtagccatattgtctttggtgcttccaggacaaagtct

SEQ ID NO: 6791112 - DNA, 73 bp, Homo sapiens
gcggggaggggtgcgcgctaagccagcgtggcttccgcaggagctatttttagcggtgcgtgcctccccccgc

SEQ ID NO: 6791113 - DNA, 57 bp, Homo sapiens
gcccaggcctccctctgcacctccccaagggccttgtgcagagcaagggctgagggc

SEQ ID NO: 6791114 - DNA, 63 bp, Homo sapiens
gcatctctgtgcctgcggctctttccccaggactcagggaagcaagctgcagaccagaagtgc

SEQ ID NO: 6791115 - DNA, 100 bp, Homo sapiens
ttcacttttggagacaagccagctctttcaggccactagagattacttactaaagagaccctggtgatttgagagagtaaatgtacctccccaaagagaa

SEQ ID NO: 6791116 - DNA, 67 bp, Homo sapiens
gtggagatgagaggaggggtcagagatctggatctgtggtctggaattggaatctcttcatctctgc

SEQ ID NO: 6791117 - DNA, 69 bp, Homo sapiens
tatggtggcttcagtctcatcttggaaggctggttttctccgcacttaaatccacaagattgccccata

SEQ ID NO: 6791118 - DNA, 56 bp, Homo sapiens
actttctattgtttagattctgaaatagagtttatagaatctgagaaatggatagt

SEQ ID NO: 6791119 - DNA, 81 bp, Homo sapiens
gtttaccgggtggtagcaaagggacggctctagagttaaccgggtctgggtctctatatctctgtgctgctatcaaaaggc

SEQ ID NO: 6791120 - DNA, 58 bp, Homo sapiens
gcctggattacaaacagccaaccataacagagttatgctctggctgctggagtagggt

SEQ ID NO: 6791121 - DNA, 65 bp, Homo sapiens
agttcttacatctataaagttggggataataacaatgccttcttcatagagagatggtgagaatt

SEQ ID NO: 6791122 - DNA, 104 bp, Homo sapiens
ctcttgaggggaaagagggtgaaaactattggcctagaacaagggtgatctaccccagttgttcagaggccagtgttttcatgccttctctttccctttaagag

SEQ ID NO: 6791123 - DNA, 61 bp, Homo sapiens
tgagccaagacggggaccctcaccagacatcaaatctactagtgctttgctcttggactca

SEQ ID NO: 6791124 - DNA, 70 bp, Homo sapiens
gcccagctgaaattttttaaattaagaaatcatttttcgttgtttaagaaaattcatgttgttctctggt

SEQ ID NO: 6791125 - DNA, 75 bp, Homo sapiens
agctatggtcagggattatagatgccttgttattccaccaataagcaccagtctctgaaatcctttatcttggct

SEQ ID NO: 6791126 - DNA, 79 bp, Homo sapiens
agtcacacagtgtaagcatgcaatgtatcagtgatagcaacaaatttgttctaatacaccctattgcttgtttgtgact

SEQ ID NO: 6791127 - DNA, 78 bp, Homo sapiens
tggggcaccttcaggggtctagggggctaggggacctgaagcctaggcccaagccagaccctgaccctgtacctccca

SEQ ID NO: 6791128 - DNA, 70 bp, Homo sapiens
cagagacatcgagaattggcagctaaagctggaggatttaatgactttgcaactttagctgtcatctttg

SEQ ID NO: 6791129 - DNA, 57 bp, Homo sapiens
tctgccagtttatagacaagccagcatataggctttgacatatataagctgtcatga

SEQ ID NO: 6791130 - DNA, 55 bp, Homo sapiens
ggtgatagtggtggtgattctttgcaaaggacaaagtacttccacagctatgatc

SEQ ID NO: 6791131 - DNA, 55 bp, Homo sapiens
ttagtgtgtccagttctgaaaatcctttgggtgttaaaggaacaaggcacactgg

SEQ ID NO: 6791132 - DNA, 60 bp, Homo sapiens
ggcgcagtgttcgccctctcgccacgaagtaaacaagtgggagggtctgagagctgcacc

SEQ ID NO: 6791133 - DNA, 58 bp, Homo sapiens
gtgggtgcccacgaggccaggctggtccggagaggatgctctgggctgtgggacctgc

SEQ ID NO: 6791134 - DNA, 59 bp, Homo sapiens
tgcaggaagtttcctgaacttttagaagttgcattactgaatacaggttaccttttgca

SEQ ID NO: 6791135 - DNA, 57 bp, Homo sapiens
tttctcatgaacagaaacacctaggaagggagaactggtgagtcttttcaagaggag

SEQ ID NO: 6791136 - DNA, 66 bp, Homo sapiens
tggcctggctcatgataatcagatttataggaggctcacttacaaatcagatcatgagtttattca

SEQ ID NO: 6791137 - DNA, 77 bp, Homo sapiens
cttggcatgctcctcaacaccccccatgtttgacatcttcttagcatggtggggagatggcagcccgatgtgccaag

SEQ ID NO: 6791138 - DNA, 75 bp, Homo sapiens
ttagacaaatttcacagtgaactttgaggactctagatacgagtgtttcatgtttttctgtgaggcattgattga

SEQ ID NO: 6791139 - DNA, 71 bp, Homo sapiens
gactccccttcactgagagacatgaaggtcaccatccatgatggggcatgtgtctcacatgaaccatagtc

SEQ ID NO: 6791140 - DNA, 79 bp, Homo sapiens
gcctcggccgagcagggtcccgaccccatccccaaccccctcagcctggggatgcagtgaggagcccgcgcggcgaggc

SEQ ID NO: 6791141 - DNA, 67 bp, Homo sapiens
gcctgaggggaaggagaagatcaatgttccactcagggagtgaggcagaagttcccttttacttggc

SEQ ID NO: 6791142 - DNA, 68 bp, Homo sapiens
taggacagtatgttcttccaggacagaacattctttgctattttgtactggaagaacatgcaaaacta

SEQ ID NO: 6791143 - DNA, 63 bp, Homo sapiens
tggaaggcatgggaactgttctccattatggaaatatgggtggaatatttcatatgtcttcca

SEQ ID NO: 6791144 - DNA, 68 bp, Homo sapiens
gggaatagccagggtgccctggagccagttccttccagaagccagcagccctagggctcctctatccc

SEQ ID NO: 6791145 - DNA, 71 bp, Homo sapiens
ctgggctgtccagcacctgggctccagctgccaaaggcaggcaggtgagcaccaggctgttggaagcccag

SEQ ID NO: 6791146 - DNA, 62 bp, Homo sapiens
atgggagagggtaggaattactttgcagttcctggtgcacttaaaatcatactctttcttat

SEQ ID NO: 6791147 - DNA, 65 bp, Homo sapiens
gctgggtcagtgaggctgtgtcaccctctacaactgtagccagcagctttgattcactgcctagt

SEQ ID NO: 6791148 - DNA, 68 bp, Homo sapiens
cctgcagaggcctttctacagtgatatgcctgtaagctatcctgggggtaggagggcacttctgcagg

SEQ ID NO: 6791149 - DNA, 90 bp, Homo sapiens
gccctcttacagttgttctatcagcatgaaaagaatataccctaaccagctttcatgttctaggaagataagaaacaggtgtaagagagc

SEQ ID NO: 6791150 - DNA, 90 bp, Homo sapiens
ggggaacagtaacatacctcttgatttggctgtgaagttatacttgtgattattaatagacaagataagaggctggtgctctattcatcc

SEQ ID NO: 6791151 - DNA, 64 bp, Homo sapiens
ctagggaagaatttgcttccaagatcccttatatggttcttggccagatgcacttcctccttgg

SEQ ID NO: 6791152 - DNA, 83 bp, Homo sapiens
agtattatcaattccactttgctaatcttctgttccaagatcaaatacgcagaatacaggtggagtgaattctgaaatatgct

SEQ ID NO: 6791153 - DNA, 105 bp, Homo sapiens
cttgcttaccgacctctgccctctgccgtgtgtcctccaccttggccatgcacagcgggggctaggcgggcacatggtggaggctgccaatggtgccctggcaag

SEQ ID NO: 6791154 - DNA, 62 bp, Homo sapiens
taccatcagtttgagattttcctctttcccacccttctcagaggggcatcaaagtgctggtg

SEQ ID NO: 6791155 - DNA, 130 bp, Homo sapiens
cccaaaacattcttctagtcaggtccttagctcaggtatttccacctattattttctgtatttacagaatgagtttttaggggggcatagtgatatttgtagtggcctaagaagcctgcaattagttggg

SEQ ID NO: 6791156 - DNA, 85 bp, Homo sapiens
aaaaaaatccaagtcagggatagtttgactacagaggagaaatcatacatgaggtgtcaaattatcccctgacatagattttttt

SEQ ID NO: 6791157 - DNA, 74 bp, Homo sapiens
agtgcacaagtcctgcagtctacccaatgtgtgctgaccggcttactggggcactagttgaaacaggatgtact

SEQ ID NO: 6791158 - DNA, 83 bp, Homo sapiens
gctatatgcttttgggtttgcatatttttattcatttaaattgttactatgtatactagatgtgtaaaataagagtatgtagt

SEQ ID NO: 6791159 - DNA, 79 bp, Homo sapiens
tacgttgaggagcttctggaaagtgcacattctgactcagcaggtattggagtctgcatttctcatgagcactcaggtg

SEQ ID NO: 6791160 - DNA, 59 bp, Homo sapiens
aggaggccaggatgggaactcaaggcctgttctactttggattcagtttctgggcttct

SEQ ID NO: 6791161 - DNA, 59 bp, Homo sapiens
gaccccttatagtcaacagctggcatttgaacacgttcgctgtttaacaataaggagtc

SEQ ID NO: 6791162 - DNA, 90 bp, Homo sapiens
ttgttacccagtttttaacctgtttttgacgactgtgtctctgtttatgcaagaggcaaattgtctagaaggggtgtagctaggtattaa

SEQ ID NO: 6791163 - DNA, 101 bp, Homo sapiens
tgaggcaggagaatcgcttgaacctgggaggcagaggttgtagtgagctgagatcatgccactgcgctctagcctgggcagtagagcgagactcagtctca

SEQ ID NO: 6791164 - DNA, 115 bp, Homo sapiens
cagtaaataatctgattaggttgaaccgtatgaaatttttgacatttgaatgcttttaagctacaaaagcagcaagtttatatgtagttcaatctaatacacactaggtttgctg

SEQ ID NO: 6791165 - DNA, 68 bp, Homo sapiens
tgctgtgtatctttttgcaatgcttgttcaaatacagacgagtgggatgcaataaagatataaatgta

SEQ ID NO: 6791166 - DNA, 69 bp, Homo sapiens
caggctgtgaaactgagatgcgccatgggtgggtggtgggtctgatcacagtttctccttcccagcctg

SEQ ID NO: 6791167 - DNA, 55 bp, Homo sapiens
ggggtggctttaaatatgccacaagagattcttgctttatttggcatgccacttc

SEQ ID NO: 6791168 - DNA, 76 bp, Homo sapiens
gctgtctctccagttgggattcttggttctggggtcctcccgccccaaccaaggatgcccagctggccaagtcagc

SEQ ID NO: 6791169 - DNA, 59 bp, Homo sapiens
ccccaggaagcctcagatttgccatgttagagtctgtgtggccatctggtttcgtgggg

SEQ ID NO: 6791170 - DNA, 55 bp, Homo sapiens
ggatgcatgtgcattttgaaaaacctccccaggtaattctgactgacatgcgtcc

SEQ ID NO: 6791171 - DNA, 110 bp, Homo sapiens
ttgtgacataggtacagatattaatgctggactctcagctttgatgtgaggatcaaacatgagcattaagcctggctcagaggacatagcaaatgtgagttcctgcacaa

SEQ ID NO: 6791172 - DNA, 91 bp, Homo sapiens
cgccctccagcagcttcctgtaggcgtccagggccagttcctgtactcacgcagctgctgagccatgtcctgcttggctagctgcagggcg

SEQ ID NO: 6791173 - DNA, 56 bp, Homo sapiens
tattaagtatcttgatgacaaacagcgatatgttatttgtcagattttgcttgatg

SEQ ID NO: 6791174 - DNA, 57 bp, Homo sapiens
ccaatgaaattctttccgagcctttattaaaagatctgtttgaaagagttttattgg

SEQ ID NO: 6791175 - DNA, 57 bp, Homo sapiens
gcccaaacattcagatgcaatggtaggagtccttgtccagcacctggatgtttgggt

SEQ ID NO: 6791176 - DNA, 77 bp, Homo sapiens
gttttcccctgttctgtagtgagtttgagcttaactctgtctgccataacatttgtcatcacagagctggataggac

SEQ ID NO: 6791177 - DNA, 86 bp, Homo sapiens
ggtgagttgcatctaccatatcaaagatgggaagtctgagttacagatagactcaacatctttcgatgtaataggtgtattttatt

SEQ ID NO: 6791178 - DNA, 91 bp, Homo sapiens
gtagttgatgcttttgagctgcttcttataatgtgtctcttgtgttaaggtgcatctagtgcagttagtgaagcagcttagaatctactgc

SEQ ID NO: 6791179 - DNA, 81 bp, Homo sapiens
aagaagacaaaagaagacttacttttcaggggtaagagaaggtcatcttgattgaagtgtttaagtcttctttgtcctctt

SEQ ID NO: 6791180 - DNA, 69 bp, Homo sapiens
aaaggaagtgacttagacagctctgctcaccaggaaaaccaagagactggatttaaggacttctgattt

SEQ ID NO: 6791181 - DNA, 79 bp, Homo sapiens
tgctgagcctgctctgagggtgactgtgtggcctaaaggatagagggcacagagttcccactccagaagcgacacagca

SEQ ID NO: 6791182 - DNA, 66 bp, Homo sapiens
tacttttccctgccttccagctccacccctttccctgatcaatggggctaggaaggggaaaaagtg

SEQ ID NO: 6791183 - DNA, 55 bp, Homo sapiens
tgggcaatgtgatcactgcagagatgattgcagaggtccagcatacatttcccca

SEQ ID NO: 6791184 - DNA, 92 bp, Homo sapiens
catctcctaattgcacccttgaatttcaccttaattctgattcacacccaaagaataggaatgaaggataaggtgtggagtaagtaaagatg

SEQ ID NO: 6791185 - DNA, 89 bp, Homo sapiens
tcatccgcagcaattggacgcctgccttttgcctacactttgtgagcaacgtgtggcagaggaggcagcgtccccgcggctgccgttga

SEQ ID NO: 6791186 - DNA, 119 bp, Homo sapiens
gattattgaacaacctaatttactgatgtagttcagtgccagtttgctccttctataggactgtataagactctgcatggcacttagcaatttcaggtacattaaaatgttcaattatt

SEQ ID NO: 6791187 - DNA, 56 bp, Homo sapiens
aatgtgtcatttcccacaggtgctaagaacgctcaagccatggagagagatgcatt

SEQ ID NO: 6791188 - DNA, 57 bp, Homo sapiens
ctgcagagcagccagtcccccaatcccacatgatctcagggttgccctgccctgcag

SEQ ID NO: 6791189 - DNA, 115 bp, Homo sapiens
cagggaaatggtgggctgccgggcagggacgaggctgggggacaggctggctgtctccacggctgcgctcctggccacgttcttgctgggcttagagtctgcttccgtttcgttg

SEQ ID NO: 6791190 - DNA, 70 bp, Homo sapiens
aggcctcacccctctgcttcccgtgtctgtggcttcgtgtccagcagtgagcacggccagaggggagcct

SEQ ID NO: 6791191 - DNA, 85 bp, Homo sapiens
gtatcatgcctggcacagattagtagctgtaataactgggaataatcccagtagtagctgaaattattatgtgcaaaggagatat

SEQ ID NO: 6791192 - DNA, 65 bp, Homo sapiens
cttttttcccttcctctggattttctctttaaccacagatagaggaagttatgaagggagaatag

SEQ ID NO: 6791193 - DNA, 83 bp, Homo sapiens
tagctggagtaggctatgtggtcatataagataaataatcatacttttgatttataaagatactatatagctttctcttgctg

SEQ ID NO: 6791194 - DNA, 82 bp, Homo sapiens
gagagagagctgagatcgttggtccatgccagtgcgagagccagtacggccggaagccatgatgggactttcagttcctttc

SEQ ID NO: 6791195 - DNA, 61 bp, Homo sapiens
aggggtgagtgtcaggccgggattcctctgtactcagggctcctggctttatgctacctct

SEQ ID NO: 6791196 - DNA, 76 bp, Homo sapiens
gtcagtagctcagtaatgggcattcaaattcacatgaattcatgtgaaattgaatgcccattgctgagctacttac

SEQ ID NO: 6791197 - DNA, 69 bp, Homo sapiens
ccctgagcagcagggagactggtgcagccccaagcagctgcccggctgagctcacctgcttgttcttgg

SEQ ID NO: 6791198 - DNA, 60 bp, Homo sapiens
tgccatttctcaggctatttcacagtaaaaccaaattacagatcagcagaggaaatggca

SEQ ID NO: 6791199 - DNA, 64 bp, Homo sapiens
acagttgggcttatgtaattttaagatggaaaacattttcctttaaaattttaaaagccactgt

SEQ ID NO: 6791200 - DNA, 65 bp, Homo sapiens
gaaggaagtgctcatactagttaatctgagttgttctctgcctgaaactgtaaggcatttttttc

SEQ ID NO: 6791201 - DNA, 78 bp, Homo sapiens
tccgagaagaatagcttggacccattgctttaattgcttctttttggagaatggaccatccaagctgatctgcctgga

SEQ ID NO: 6791202 - DNA, 86 bp, Homo sapiens
gtgctgggtgaacacataggagtctggccccatacagagggtctgcagatgtagactgtgggatggctgacttcacgcttatgcac

SEQ ID NO: 6791203 - DNA, 65 bp, Homo sapiens
gaacttagtagtctacttcttattgctgtacctcaaaccagtgccaaagtatggctcttaggttc

SEQ ID NO: 6791204 - DNA, 58 bp, Homo sapiens
ggattgaaggcccttaactgatgccaaaacacccaccagtaatagaggctttgagtct

SEQ ID NO: 6791205 - DNA, 69 bp, Homo sapiens
ggcattttctttcttgctggcaaaaaattcctatcagccagtagggtggacagtagggtagacagtgcc

SEQ ID NO: 6791206 - DNA, 79 bp, Homo sapiens
acccacagaggtacctgtaccatatgagaagatgctacaagaccagtcagctttgatagtacaggggcttccagaaggt

SEQ ID NO: 6791207 - DNA, 65 bp, Homo sapiens
gtgatggcacctggccctgggaccttaagaaaatcactttacctctcagggcttggtgtcctcat

SEQ ID NO: 6791208 - DNA, 64 bp, Homo sapiens
tctctcaaatttatccattttgaagcttacttgtaaatctattgtatgtatggataatgagagg

SEQ ID NO: 6791209 - DNA, 73 bp, Homo sapiens
tctcaggaaaagattggaaatgacaatggcagttaagggttgctgttagtgtaattccagttttcacttgtgg

SEQ ID NO: 6791210 - DNA, 55 bp, Homo sapiens
caggcgatgctgctggtgctggtgcacaggccccactttgagtagcacttgaatg

SEQ ID NO: 6791211 - DNA, 59 bp, Homo sapiens
catggcagagaaggggaactggctcagaatctccctgctattctccttcctgtgtcatg

SEQ ID NO: 6791212 - DNA, 93 bp, Homo sapiens
gctgccacggagcctcctggcggccagggtagggcctgtcggcccagttgcccactgcctgctcctggctccacaaagggcttgctgggcagc

SEQ ID NO: 6791213 - DNA, 68 bp, Homo sapiens
cattattgccatcctggaacctagaatttttttaacttgttaatgctgcctaggatggcaaaataatg

SEQ ID NO: 6791214 - DNA, 73 bp, Homo sapiens
cctcccaaagtgctggaattataggggtgagccaccgtgccctgcccctcagtttgctagtattttgtggagg

SEQ ID NO: 6791215 - DNA, 57 bp, Homo sapiens
agcattatgtccatgctaaattgtgctgtaaatgatatggtatggaacatatgtgct

SEQ ID NO: 6791216 - DNA, 65 bp, Homo sapiens
ccagtgttgctggtggctaccatgttcaacagtatagaacatttctttctattcagtagcactgg

SEQ ID NO: 6791217 - DNA, 55 bp, Homo sapiens
agtggttcatgcctgtaatccctgcaatttgggaggctgaggcgggaggatcact

SEQ ID NO: 6791218 - DNA, 57 bp, Homo sapiens
gctgacattctaaaaaatatggaagggaaggtcttctagtattttagggtgctcagt

SEQ ID NO: 6791219 - DNA, 56 bp, Homo sapiens
gttatttccacttaggtgcctgtttaaaaaggaatgggagataaagtgggagttac

SEQ ID NO: 6791220 - DNA, 70 bp, Homo sapiens
tcacttttatctcatcacacagccagtatgtctttccatgaggcactgcttaggtgtgaggaaggggtga

SEQ ID NO: 6791221 - DNA, 130 bp, Homo sapiens
taaggacagcctgccccctaggctggccccttggggaggatgcaggctgcttccaggaggtgccctatgccacccctcagagccatgcctgagttctgctgccagcccctccggcaggaggttggccttg

SEQ ID NO: 6791222 - DNA, 57 bp, Homo sapiens
gactagattgactggtcagcattttataatttgttgttgcacacagtgtttctggtt

SEQ ID NO: 6791223 - DNA, 75 bp, Homo sapiens
gcttcctgggagcctggactctacttgcatttagactccgcttcctgcaggtcaatcttcaggttcctgctgagc

SEQ ID NO: 6791224 - DNA, 79 bp, Homo sapiens
tcaagccagtattcaagccaaattcaagccagtattaataatataatggctttaaaatggtttggtattcctggcatgg

SEQ ID NO: 6791225 - DNA, 62 bp, Homo sapiens
gccaatggcaaggtaattatcattttgggcatatttaaagtacttaaatggccatgtcaggc

SEQ ID NO: 6791226 - DNA, 87 bp, Homo sapiens
tttgaaagccttcagagttttatcatacgtggataaaactcataatgcaaattatccatgtatgatacaactcagaaggctctcaga

SEQ ID NO: 6791227 - DNA, 98 bp, Homo sapiens
aagtgaaggagttagagtagaatcatcaaatagactctagaatttatttcaaatagactccagggtctattttggttctggtgtcccttgattcattt

SEQ ID NO: 6791228 - DNA, 86 bp, Homo sapiens
gacaattatcacaggaagtttggaaagcctcaattctatataaaacagatgtaggtatccaaaactttttcattgaatgaagtgtc

SEQ ID NO: 6791229 - DNA, 66 bp, Homo sapiens
ctttcctctgctactgttaaaccatttggattttcttaagtggtttcccccggtagtgctggagag

SEQ ID NO: 6791230 - DNA, 74 bp, Homo sapiens
ggcccagcaggggcacttggcacctctgcagagtcggagcattgcatgcacaggtgcccacactcacaggggcc

SEQ ID NO: 6791231 - DNA, 68 bp, Homo sapiens
agaagctaatgagataaatgccatcacaggcttaattcattgtaggtggtaactagtccttagtttct

SEQ ID NO: 6791232 - DNA, 130 bp, Homo sapiens
cactggttagagaaaggaaacgtggctggaggttatggttatcctcaaaagaggaaaggtgaacttcttctacaaatgagggtcatcataaaacatttccagcggagcgtttcttttttcttcttccatg

SEQ ID NO: 6791233 - DNA, 123 bp, Homo sapiens
tcaggtacatttgcatttccgacaaacagaatcattttgtattgtaattatgtcccgtgcaataattgggacatacttaacattaaagtcatttgttgttcatctgaaattcagtgtagctga

SEQ ID NO: 6791234 - DNA, 64 bp, Homo sapiens
tgcacagctggctctccttttctgagaatgttttatcttaagaggggataagtgggtatgtgca

SEQ ID NO: 6791235 - DNA, 78 bp, Homo sapiens
ttgagaaatgtattctgtatgttttgaaaaatgcagactgcaaaaaaatgtatagagtgacatcatgttaatttttaa

SEQ ID NO: 6791236 - DNA, 77 bp, Homo sapiens
aataagtcttgttggagttcttgcagcttagctctttgagggctaaatatgcaaagcaaaaacccaataaatttatt

SEQ ID NO: 6791237 - DNA, 57 bp, Homo sapiens
tctttagagttaacaataatgaaatatggtaacagatagttttggggactctaaaga

SEQ ID NO: 6791238 - DNA, 130 bp, Homo sapiens
tagtttatttttatattttacttcagtagtaatgactattaactatgtgctagacggtgttctaaaagcattacatagattcatttagttaatttttatgaaactcttatgaagtagagaagattctttg

SEQ ID NO: 6791239 - DNA, 71 bp, Homo sapiens
aggaagcttcatgttttagctgcaaaatgaaagtatttttcaactgtactacttgaacatgtatgtttcct

SEQ ID NO: 6791240 - DNA, 85 bp, Homo sapiens
caggggaacaaggagcatggggtcctttcctttacccccaccttaggatgagtctcaggtttcccgtgcctgctttgtttccttg

SEQ ID NO: 6791241 - DNA, 66 bp, Homo sapiens
ccagagttggtccatctgagccctagccccggcagtgccatttcccagggtggtccaactttcagg

SEQ ID NO: 6791242 - DNA, 78 bp, Homo sapiens
ttgttttgagctgtgctattccaaggccgggggaatgcttaaagaaaccctgatcttggaatggcacagctgagacaa

SEQ ID NO: 6791243 - DNA, 62 bp, Homo sapiens
gccctgcccagcgcgctctaggacaccgcggcgcctccgcgcagctccggcgtgggcggggc

SEQ ID NO: 6791244 - DNA, 67 bp, Homo sapiens
gtggttacagctgcaggagctgagcacttgcagggagtagggtaatgcgcctggagcttaatgccac

SEQ ID NO: 6791245 - DNA, 80 bp, Homo sapiens
tctctggaggagggtaagggggcatgagtgttgtttgtccgatgaagcagtgcagtgcataccctttccctcatcagaga

SEQ ID NO: 6791246 - DNA, 74 bp, Homo sapiens
gccagtgtagattgatggaaaacaaatgatgaagaaaagcttctgtttcatcatgactctttcaattatatggt

SEQ ID NO: 6791247 - DNA, 66 bp, Homo sapiens
cccaggggactgccaggaacacagccccatcccggccacgtgatcattctctagccttcccctggg

SEQ ID NO: 6791248 - DNA, 63 bp, Homo sapiens
ctccttttcatagtcaagtgtgtatgagttttttagctgatggacgtaggactgttgaaggag

SEQ ID NO: 6791249 - DNA, 92 bp, Homo sapiens
tctctgcaatcagtatttcacatggaagctctcgagacatttagcagcccactaggattctgtagaacttctgttgagaaaacttgttgaga

SEQ ID NO: 6791250 - DNA, 62 bp, Homo sapiens
tagtttttgaggttgtgctggatatcttcaatttgccctctccctgcacaaatcaattacta

SEQ ID NO: 6791251 - DNA, 61 bp, Homo sapiens
gccttggagccaattttcttctacatgattggggtgagaaattgaatggctcccacagggc

SEQ ID NO: 6791252 - DNA, 87 bp, Homo sapiens
gttgatacatgctctagagttgaacttgaatagcagatccagcctatgaaacattcaggcaatcactgtggtatatatgtatcatac

SEQ ID NO: 6791253 - DNA, 58 bp, Homo sapiens
ggacgctggctccgccttccccatttatgcagctcctggggagacagggccagtgtcc

SEQ ID NO: 6791254 - DNA, 56 bp, Homo sapiens
gggaccctcctactaccctggaaacctgggtgagcctggagtcgtggaggggcccc

SEQ ID NO: 6791255 - DNA, 71 bp, Homo sapiens
ccaggcagtcagggttgtgtgttaggaggaacctgggttcctcatcttgcagagctgccctattgccttgg

SEQ ID NO: 6791256 - DNA, 91 bp, Homo sapiens
ttttaaaattagaaattattatgcccctctataatcatgggtgttatgattcagtagattaaggtggggctaagaattaacaattttaaga

SEQ ID NO: 6791257 - DNA, 94 bp, Homo sapiens
cagggaaggatcgttggagacagagctttgggggtcttgtacaagatgatatttaagttccttttcaacaactttatgatcctataattctctg

SEQ ID NO: 6791258 - DNA, 102 bp, Homo sapiens
tgttacccagatgacaggtaaccgccaactcagggtccttcacttcaggcggaaaatattaagtgcaaagggatcagattgggaagctgtcatctagtaaca

SEQ ID NO: 6791259 - DNA, 64 bp, Homo sapiens
tgctgcagctgctggtttaagggatgggttattcaagggcccatctcccaccagctgctttgca

SEQ ID NO: 6791260 - DNA, 63 bp, Homo sapiens
aagaatgcacggatatattatgcagtctggaggatatcaaataagtactgtctgtgccttctt

SEQ ID NO: 6791261 - DNA, 85 bp, Homo sapiens
actatttagctgttcaagttcctggaaaagggatatcatgtttaccttactctatttccaaagctgagttgagcaagttaaaagt

SEQ ID NO: 6791262 - DNA, 129 bp, Homo sapiens
tgcccagaatgcagagtgacccaggcttggaacgcactgtgtcttctcagatttcctgcagcagtgctagcagagaggggacagtggcaagatgtgtccaccaccatccgttcctcagtatctgggaca

SEQ ID NO: 6791263 - DNA, 75 bp, Homo sapiens
ctgtgcagggtgggggcagtgctggtgcccgcggtgcatgtggttcacatgaaggctgtctcctccttgcaccag

SEQ ID NO: 6791264 - DNA, 77 bp, Homo sapiens
aatttaaatcatatagttcatgtgtgcacctgtcctgcagtttgaggcaggtgtgaatgtgaattaagatggctatt

SEQ ID NO: 6791265 - DNA, 75 bp, Homo sapiens
ggagatgggaggggcatctctcctgtgtgctcctcgtcagccccagcacagcagccgaaatgcccttacatttcc

SEQ ID NO: 6791266 - DNA, 84 bp, Homo sapiens
gggatcaggaagcttgtgtgtattggtcacatgttcacggactggcgtggcccaaggatcattgctcataagtccacagatccc

SEQ ID NO: 6791267 - DNA, 55 bp, Homo sapiens
aacagtacataatgcgcaaaaccgggtctgatcgtggtggagtgttatgtgtgtt

SEQ ID NO: 6791268 - DNA, 71 bp, Homo sapiens
tctacacagtcaattctttgggtgagctgggaccctccacttggccatgaaaccagaggatggctttgaga

SEQ ID NO: 6791269 - DNA, 80 bp, Homo sapiens
tggtacctgaaataggttgcctgtgaggtgttcactttctatatgatgaatattatacagtcaacctctttccgatatcg

SEQ ID NO: 6791270 - DNA, 55 bp, Homo sapiens
ggcacaggggcaaactgtaggggagtgcttggctgtacctggagagctcttggcc

SEQ ID NO: 6791271 - DNA, 91 bp, Homo sapiens
agcattatagaggcttatttacccagattcacaagccaaggttgactatattaattgtggctgtctttggctaactaggtcttgtaatgct

SEQ ID NO: 6791272 - DNA, 58 bp, Homo sapiens
ccttagctgtcaaggtggctgcagtgacatccctattgtgggtgactatacagcaagg

SEQ ID NO: 6791273 - DNA, 63 bp, Homo sapiens
ggtagtacatggaagagtacacagtctagaaggcactgtatcatggctctacatgtttctgcc

SEQ ID NO: 6791274 - DNA, 55 bp, Homo sapiens
gcctggacaggtgagtgactcagggtggtgagctccaccctgccctgatttaggc

SEQ ID NO: 6791275 - DNA, 114 bp, Homo sapiens
ttatattttggaagtaaatttaagaagcattttctgtaaaagacctccaaggaaacagctagagagaggtttcctggtggctctttgggaaggacttttacattcaagatataa

SEQ ID NO: 6791276 - DNA, 65 bp, Homo sapiens
accccagctccaggcattgcatctgaattcaaagaagatacagtgtatgtatttgtaggtggggt

SEQ ID NO: 6791277 - DNA, 57 bp, Homo sapiens
tgaatgtgaaaaatgccttccgtgacatcatccttacaggaacattctttacattta

SEQ ID NO: 6791278 - DNA, 84 bp, Homo sapiens
tcagcaagttgtgaatgacagacttcactttctcaggcatatttgcatattgaaaaagaagtttgtaattcaaataacttttga

SEQ ID NO: 6791279 - DNA, 56 bp, Homo sapiens
tcggctatatggctccagtggtaatgatcttctgccacatagctatagaaagtcga

SEQ ID NO: 6791280 - DNA, 129 bp, Homo sapiens
atgaagacacaaatgatgttctttgaagccattgggtcaatgtgatatttcaagagtggggcagctggcccagctgctggtatggagatcatgatgcagcttcgttactgtcatttgtaaaacttggct

SEQ ID NO: 6791281 - DNA, 111 bp, Homo sapiens
atcatggggagctttaaaaatttctgatacccggtcaccctccagaaccaataacatcagaatttctaagggtaaaacccagggatcagtattttttaaacctctccaggt

SEQ ID NO: 6791282 - DNA, 74 bp, Homo sapiens
attctatctctatatttctgcaaaaaatttctacatgacaaaaaagtggactctaggagtgtggaaggtggaat

SEQ ID NO: 6791283 - DNA, 56 bp, Homo sapiens
tgaggcctcataatgagatttccttagaaaactcaattagacattgttaggcctta

SEQ ID NO: 6791284 - DNA, 62 bp, Homo sapiens
gcagccctgcaggcagctccagaagctcatcggcatctccattggcagcctgcgcgggctgc

SEQ ID NO: 6791285 - DNA, 88 bp, Homo sapiens
tgggcatggttcggttcttagagcaaaatggagcattaaaatagaagacggctctgggaataaaactagggactagaacctctgccta

SEQ ID NO: 6791286 - DNA, 99 bp, Homo sapiens
gtagttggtccagggtcacacagctcgtagaggacatgagtacaatctgaatccaggcagtctatctctggagcctctgtgtgttcctaaccactctgc

SEQ ID NO: 6791287 - DNA, 59 bp, Homo sapiens
ttttaatgcaggggcatgttctctagtagacacataatgaaaatggccttgtattaaaa

SEQ ID NO: 6791288 - DNA, 67 bp, Homo sapiens
cagtggccagtcccgatgcttgttcagtatgtgttagctgagctgcatttgtggagtggctgagctg

SEQ ID NO: 6791289 - DNA, 59 bp, Homo sapiens
ggaggcctcacttgtgttgcccaggctggtcttgaacttctgggctcaagtgatcctcc

SEQ ID NO: 6791290 - DNA, 61 bp, Homo sapiens
cttgtcaaagctagagagtggcagagtgggcatgtgacctcaggtctctttggcttccaag

SEQ ID NO: 6791291 - DNA, 76 bp, Homo sapiens
tgcctaggatgcctaggacatgctggcgctctcccccaggcaggccagctgttactagagccactctgcattggca

SEQ ID NO: 6791292 - DNA, 68 bp, Homo sapiens
gtttgaatgagcaaatgaagacgctgtgctgaacatgtatatgttttatcttcttgcttaaattggat

SEQ ID NO: 6791293 - DNA, 61 bp, Homo sapiens
aatctatgtgctggccctgaagagccatcgaacatctttcccaaggctggtaccataggtt

SEQ ID NO: 6791294 - DNA, 74 bp, Homo sapiens
tatttcagaggctctgccaatgtgtaatgccttctaacactggcaaaaactatcagtagagtaaatttgaaata

SEQ ID NO: 6791295 - DNA, 70 bp, Homo sapiens
ccctcagtttgattctgatcctgtctggagactgcgtggcctcctgccagtgattaaattagtctgtggg

SEQ ID NO: 6791296 - DNA, 75 bp, Homo sapiens
cagctgcaggcaggcgtctctggggcaaggctgatgctgccttcttccttgctgaggcttctgtccctgcagctg

SEQ ID NO: 6791297 - DNA, 72 bp, Homo sapiens
gattaagtttgtggacactgtctccaggataaaaagtttttaggctgggtgcggtgtctcacacctgtaatc

SEQ ID NO: 6791298 - DNA, 72 bp, Homo sapiens
ggttgatgctgctggctgctgctgtaagaaaggaaagtcttcttccatgctagcggcaaccagagccattcc

SEQ ID NO: 6791299 - DNA, 100 bp, Homo sapiens
gatttggggtggagagttctgtagatgtctattaggtccgcttggtgcagacctgagttcaattcctggatatccttgttaactttctgtctcgttgatc

SEQ ID NO: 6791300 - DNA, 88 bp, Homo sapiens
attgtacaaagtagattcatggatgtttcgttaactgtagagcattgggcaacagtaattaaacattctgattttattttgctagaat

SEQ ID NO: 6791301 - DNA, 86 bp, Homo sapiens
tcaatacgaatggtaccaacaccaaagtctttatctaggattccttcaaagagttgggtgtctgggcaacactcatttgtgttaga

SEQ ID NO: 6791302 - DNA, 65 bp, Homo sapiens
ctttcacatccattaactcatttgtttctcaaaagagaacagatgaggaaatggagtccagaaag

SEQ ID NO: 6791303 - DNA, 92 bp, Homo sapiens
gggtaacagtggataagaaatgctacacaagctccttatgtggagaaaagactgttctcctatttggaagccttgtgcccatatccatgccc

SEQ ID NO: 6791304 - DNA, 58 bp, Homo sapiens
tgacccaggtgagctgtgaccacataaagcccatggtggcctgagcacacactgggca

SEQ ID NO: 6791305 - DNA, 62 bp, Homo sapiens
tctgcaacagtgccctgtaaattaacactttagtttctttatgggagatgtatctgtgcaga

SEQ ID NO: 6791306 - DNA, 129 bp, Homo sapiens
agataatatagaaagccacaatttaaggccattgactgatatagtgaaggctgtgtgaaagttctctcactcagagacattttttagtcttgacatatttgcattggctttaaaaagttcatattattt

SEQ ID NO: 6791307 - DNA, 108 bp, Homo sapiens
agggagagcctggtgccagcctggaggaggcaggtggaaagccttagcgggctgccgtttctcctctgcactctcctggctcaccaggctggatgccaggccctcctt

SEQ ID NO: 6791308 - DNA, 108 bp, Homo sapiens
ttaagtggttttcatcaatgctttctcagagtccttcactagaccctttgcatcaggttgaagaatgaaggaagagatcaagtatgaaggatgaatgcccctgcttaa

SEQ ID NO: 6791309 - DNA, 79 bp, Homo sapiens
gacagtactttttcggtgttaacattctgatgtctattattaaactacaccagagtttgaattttgaaaagatactgtt

SEQ ID NO: 6791310 - DNA, 62 bp, Homo sapiens
tgaccctcttccccatgcgctcattcctcttgtagatgagctcctggcggaagtagctgtca

SEQ ID NO: 6791311 - DNA, 63 bp, Homo sapiens
acttgtgattcaattatctgatgctttccattgtgcaaaagagagcttgtaattgagtcaggt

SEQ ID NO: 6791312 - DNA, 88 bp, Homo sapiens
gaagtttgaactattccactgcagttggcagggagcccagatgatgaaatctgcacccaaatgccaatctcacacagtaggaaacttc

SEQ ID NO: 6791313 - DNA, 68 bp, Homo sapiens
gtcatgctgcctggggtcctagcctggcccacactctgtgtcttgctgtgtgaccctagccagtagac

SEQ ID NO: 6791314 - DNA, 68 bp, Homo sapiens
cagtgtgtctttataagaagagggagagataccagagatctccttctctaccatgtgaggaaacagtg

SEQ ID NO: 6791315 - DNA, 60 bp, Homo sapiens
cagcctgacaccagctttgggctttaaatctcattttcccaacagagctggtagcagctg

SEQ ID NO: 6791316 - DNA, 62 bp, Homo sapiens
tttaggatgttatgatgtcattttcttctctttgtagaagagaataaatcaaatgtcctgag

SEQ ID NO: 6791317 - DNA, 113 bp, Homo sapiens
tccctgggacagtatggttaaccccaccattgcaggtgatgatgtagtgtcggttattcatttcttacgatacagcatgtccttagcaaggctggaactggaggtgtcaggga

SEQ ID NO: 6791318 - DNA, 61 bp, Homo sapiens
tggcctcttgctgtagaagcaaagtgaccttctgtcaggttaacctgcagctggagggcca

SEQ ID NO: 6791319 - DNA, 112 bp, Homo sapiens
cttcctctctcctttcctgtcattctgtgtgccagagttgtgctgtctacacagcaagctcctaagcaatggtggtgatcaggctatgtatactcccgaagaaatggggaag

SEQ ID NO: 6791320 - DNA, 59 bp, Homo sapiens
tcagaagctggtgtcctttgaaaaatatcacctagaaacttcagagttcactgctatga

SEQ ID NO: 6791321 - DNA, 104 bp, Homo sapiens
gatgcttgagatccattgtgctttggaacagaatcctcttagcatccctaccataagctcagatgaaagatgatttaaagtactgtggttggctaacatgcatt

SEQ ID NO: 6791322 - DNA, 55 bp, Homo sapiens
tgtggggccaaagcccagccacaacaggaaggagtggccagctggagtctccaca

SEQ ID NO: 6791323 - DNA, 62 bp, Homo sapiens
ggatttatctgctcttcgcgttgaagaagtacaaaatgtcattaatgctatgcagaaaatct

SEQ ID NO: 6791324 - DNA, 79 bp, Homo sapiens
gattgtactgttttctttacaccatgtgccgtggctcacaaaagcataggttaaatatttgcaaggaaaacatgcaatc

SEQ ID NO: 6791325 - DNA, 68 bp, Homo sapiens
cagtgaggagcccgaggccctgagagagaaccaggctggtcctcttcagagggacctcgggaccactg

SEQ ID NO: 6791326 - DNA, 56 bp, Homo sapiens
tccagggacacagagtccttctatcttataactttagcatcctctgtggccctgga

SEQ ID NO: 6791327 - DNA, 64 bp, Homo sapiens
tccaattgtcccggatttcacactacaagccagattggttgtgcctggatctctgtgacaaggg

SEQ ID NO: 6791328 - DNA, 63 bp, Homo sapiens
aatttggggatcaatagaatgcctcatgagtcccagaacatgtaggcatgggatgcccagatt

SEQ ID NO: 6791329 - DNA, 90 bp, Homo sapiens
tcagtaggctcagtgatggggacatcacggtaatgaatggctgggtccagcggccatcagaagtgctgtccttatccctgtcacctctga

SEQ ID NO: 6791330 - DNA, 62 bp, Homo sapiens
ggttgggggcagtcagggtgtcagagaagctcgagggcggtcctctgggctgcaccctcgcc

SEQ ID NO: 6791331 - DNA, 67 bp, Homo sapiens
tacccttgatagcatccctcaataacattacatcataagaatattctgggtttgctgtacaaaggtg

SEQ ID NO: 6791332 - DNA, 72 bp, Homo sapiens
tctaaattgctactctgaaacttgcaacacattttgctatgaaaatggtgctgtaggtcagagcttttcaga

SEQ ID NO: 6791333 - DNA, 60 bp, Homo sapiens
aagtgcacagacttgcttcttgcctgctactcagggaattaagtatatgtccgtgtactt

SEQ ID NO: 6791334 - DNA, 68 bp, Homo sapiens
ttccccagcttggccagaatcttcctagtgagctcacattctgctcactcctgcccaggcttggggaa

SEQ ID NO: 6791335 - DNA, 69 bp, Homo sapiens
tgggatccggggagggcagaggctccctcagccaggcctgggctccgcctgctgccctcccccagccca

SEQ ID NO: 6791336 - DNA, 81 bp, Homo sapiens
gaacaaatatgagaaagaaatgagaatacatttggaaaactctttttgaatctttcaaatttctttgggttatgttctttc

SEQ ID NO: 6791337 - DNA, 129 bp, Homo sapiens
cacctcataaaatatgtagctgcaatgtttgtgagaacttgatcattagcatgcactggagtgtttcaggcctgctgtatgatggatctgattatataacaatatgcttgcaatattaagtatgaattg

SEQ ID NO: 6791338 - DNA, 90 bp, Homo sapiens
tgcccagcagcaccttggggtgaatgcattaagaagggggaactgtcatctcattctccctctcagatttattcacagtctcctgcggca

SEQ ID NO: 6791339 - DNA, 85 bp, Homo sapiens
tcagttgaaagatgcttcagtgtttaatttaggattcacttaaaaataatttatcttaatatgggcagtctgaatataaagctga

SEQ ID NO: 6791340 - DNA, 87 bp, Homo sapiens
gctttgcctgccaaacttaacgatgtttttgtctacaagcctactaaatcctcaagacagagctaattctaagttcacatacagagc

SEQ ID NO: 6791341 - DNA, 64 bp, Homo sapiens
catatagttttatagatattgtgtatgttcattgtacatatgtaatagacattaagactgaatg

SEQ ID NO: 6791342 - DNA, 73 bp, Homo sapiens
tctcactcctgcaaaatatcttgtccagggcagtttagaagtaaagcactgctaggatagcatgcaagtgaga

SEQ ID NO: 6791343 - DNA, 67 bp, Homo sapiens
caggtggtgcctcagggacttacaaaccagaaggttccatgccttcccctttagtgggtattatttg

SEQ ID NO: 6791344 - DNA, 55 bp, Homo sapiens
ggttcacatattgagagtattctcaaatgtgaagagtacatctcaaatgtaaatc

SEQ ID NO: 6791345 - DNA, 63 bp, Homo sapiens
tgcacagggttggcctagtcagagacttttcctgcctgtctctgaccctagcatctctgtgca

SEQ ID NO: 6791346 - DNA, 78 bp, Homo sapiens
ttaggtataacatctcatggactacattctgcttcaatagaacttgcaggaaaatagacttgagatggttgcacttag

SEQ ID NO: 6791347 - DNA, 79 bp, Homo sapiens
caggattactccagctgctggtctgagactgacaggaaggaagcaaagtcagctgagagggagtggggtattggacctg

SEQ ID NO: 6791348 - DNA, 130 bp, Homo sapiens
ccaactctgctaagagacctcagtacacacaaaacagtgttcctgcccctcaggacttcaaagcgatagacccaggtggcaaatactgtttttctctgtttacagatgttgcagattttagtgggattgg

SEQ ID NO: 6791349 - DNA, 78 bp, Homo sapiens
tgcagtggagaatgttgatagcacctattttgaaccaaaaagagatatgtccctgtctaatatttcaactccatttca

SEQ ID NO: 6791350 - DNA, 63 bp, Homo sapiens
catcaaataggaatatttggcaaatgagtctggtgtttatggatcaaatgtttctatttgttg

SEQ ID NO: 6791351 - DNA, 59 bp, Homo sapiens
acaagccctcaagacactggaggctggaatccccctgccagtgccttttgtgggtttgt

SEQ ID NO: 6791352 - DNA, 60 bp, Homo sapiens
cctcatgcctcagtttgactggctggtcttattgtcttccaggaaactgaggccatgggg

SEQ ID NO: 6791353 - DNA, 57 bp, Homo sapiens
gaccctagagcttcatggtcaagagtctagactttggatcagacagatctgggcttc

SEQ ID NO: 6791354 - DNA, 83 bp, Homo sapiens
agtacaattagtgaatcacagagtacataggtctccaaagtagctgcttattttgtatgtattcttttcattagtgttggact

SEQ ID NO: 6791355 - DNA, 88 bp, Homo sapiens
ctagagaacacagaccatgtggatccgagagtgttggaggggcagctctagcttctctgggcttttcggatccgagttctgttcctgg

SEQ ID NO: 6791356 - DNA, 124 bp, Homo sapiens
ggcaacatgaaaatgcacactcgttcaataaatatcagatgaataaatgatgaggtaatttacctagaaagttgcatttataaaatgttcgtggtttattgtgttaatgttcaacttgatggcc

SEQ ID NO: 6791357 - DNA, 60 bp, Homo sapiens
gctgattctgaggtgctttcctagctaaaagctgctatttgaagtatccaaagaaatagc

SEQ ID NO: 6791358 - DNA, 100 bp, Homo sapiens
acttgcttcgaataccacctcttcacaaagctctctttatgtgttttgtggcactggggagtggttttgggaagtgggtaatgaatgtattcacgtatgt

SEQ ID NO: 6791359 - DNA, 74 bp, Homo sapiens
aaactaggataagtgcagcaccatgttacagagccttgtggtgtctaagtaatatttgactgctcatctagttt

SEQ ID NO: 6791360 - DNA, 55 bp, Homo sapiens
catctctgtgtccccacacccagcctgacacatggagcctgggatacaatagatg

SEQ ID NO: 6791361 - DNA, 58 bp, Homo sapiens
ctgagcccttgtcttcctggtccctctgcagacctgggattggaagaaggagctgcag

SEQ ID NO: 6791362 - DNA, 58 bp, Homo sapiens
gtctattttgcatgcagagcaatatgagaaatacatagaagaagcatgtgtaataggc

SEQ ID NO: 6791363 - DNA, 69 bp, Homo sapiens
cgcggtctcagccctcgccagcagccacgcgcgtctgggggcggcgcgctgcgagcggctgagaccgcg

SEQ ID NO: 6791364 - DNA, 60 bp, Homo sapiens
tttatggcatagcggcattggatacacatttgggtgtagctaagttgtatttgtcatgaa

SEQ ID NO: 6791365 - DNA, 95 bp, Homo sapiens
gtaatttcttccacctgctgcctgctacctgaaatgccatcatggagcatctgtgatgttggtagggggtagagggcaggtgtggagggtgttgc

SEQ ID NO: 6791366 - DNA, 61 bp, Homo sapiens
tcttttgcagagtgtatctgtgtaagcatatgtatgtgtgacttgatgcactctgattaga

SEQ ID NO: 6791367 - DNA, 74 bp, Homo sapiens
atgtcggaggatgcactttgtcagtaagttaggcattcagtcttcactgtcaacacaaatgcattctgtgacat

SEQ ID NO: 6791368 - DNA, 77 bp, Homo sapiens
gaaggagcatcacactcagaacatctccctgatgagccctcacgtttgcatcagaggcagcctgaggatggtccttt

SEQ ID NO: 6791369 - DNA, 63 bp, Homo sapiens
ctcaacagctctgccatactcccattcagtgggtcctgaaggagatgcttaagagtggttgag

SEQ ID NO: 6791370 - DNA, 55 bp, Homo sapiens
tttcaaatagcaactacctgctgtgacagcggtagggacaatatgttattagaaa

SEQ ID NO: 6791371 - DNA, 64 bp, Homo sapiens
agctattgtaaggatgtttattgttatatcactgtggccttaatctgtaatttttgcaatagct

SEQ ID NO: 6791372 - DNA, 60 bp, Homo sapiens
gcagtgtgtagaaggccgatttatccacaaactggataatcttcttaggctgcatactgc

SEQ ID NO: 6791373 - DNA, 61 bp, Homo sapiens
tatctacaacccctcaaactgtgcctggtacccaacaggtatttcttgagtgtagtaggtg

SEQ ID NO: 6791374 - DNA, 79 bp, Homo sapiens
ggaaaactatgagctttggaatgagaaacacctgcacaatcctgggcaagtttcttgacctttctgagctctcatttcc

SEQ ID NO: 6791375 - DNA, 91 bp, Homo sapiens
gggtctgcagattaggacatggacagctttggtgactattattctgtcagccacagcatgtgtgtatgtaagcgcttggtctgcctttccc

SEQ ID NO: 6791376 - DNA, 58 bp, Homo sapiens
tggggtgggctgacctcatacctgccacatactgggagcccagagtcctcccactcca

SEQ ID NO: 6791377 - DNA, 87 bp, Homo sapiens
accgtctgcctggcagctggggccacacttaggcagctgccccagcatgcactaaaattaggtggcccattagacccaggacatggt

SEQ ID NO: 6791378 - DNA, 89 bp, Homo sapiens
ttgttctggtttgccttgaactgagcagtttcctgggacgtggggctgccagtgctgaaaccgtgacagttccatgcaaactgggacag

SEQ ID NO: 6791379 - DNA, 66 bp, Homo sapiens
ggctgggggtaggagctgtgggcggaagagctggggcatctgttcacagaatcctcccctgaagtt

SEQ ID NO: 6791380 - DNA, 98 bp, Homo sapiens
agtgatcaattaaatggaaactattattagcaaaaggtggatctggcagcctatgttaatccatgtagctataatacaatcatccaaactgactcatt

SEQ ID NO: 6791381 - DNA, 66 bp, Homo sapiens
agaggtaccaagtgctgcactgtggagagggtcacatggcacagaacagcaggctaggctgcctct

SEQ ID NO: 6791382 - DNA, 71 bp, Homo sapiens
tgtccaactccagctcacacagtgacccccaccaaaatgtgcccaggtctgtgctaagcttgagagggaca

SEQ ID NO: 6791383 - DNA, 96 bp, Homo sapiens
gtagaaagcgggaatttggtggggtacatttactgatgaaaagtaatttctcatttatctcctctaagaaatgtgtgcttaattcttactttctgc

SEQ ID NO: 6791384 - DNA, 78 bp, Homo sapiens
gcaaaggactgcatgtagctatgagtgagttgtctggacacagggtttggaggactctgcaggctgctccttctttgt

SEQ ID NO: 6791385 - DNA, 72 bp, Homo sapiens
agataaggaagagagcagcaaactggagtcactacaggacactagctgctccaggctgctctgtcccattct

SEQ ID NO: 6791386 - DNA, 74 bp, Homo sapiens
ccatgttcttgatctgaatggcttatgtgtgcatcccaagatacagtgccaggagacaagatcaggaggcatgg

SEQ ID NO: 6791387 - DNA, 87 bp, Homo sapiens
attcctttcctgaatttgatccaaactatgactagtgttctcaacagagggcaagtagggatgtttgggaacgagtgatggaggaat

SEQ ID NO: 6791388 - DNA, 70 bp, Homo sapiens
gtctttatatgtttcttacaaaatattacgtacatacatggtgcagagttgaggaacatgtttgggaggc

SEQ ID NO: 6791389 - DNA, 106 bp, Homo sapiens
gtaattttgttccagcccttgcctggactccccttccagaccacaacttccccggtgatatgggaccctggaggaggaagtctacaatgtgggagagatgagttac

SEQ ID NO: 6791390 - DNA, 116 bp, Homo sapiens
cttcgatggggaatgtgatctacatgaatttgggtaggagaaagaacagatcatgtgtgactttggggaacttttctcctctgctcttgtgattgtgtgaaacatgggaaatgaag

SEQ ID NO: 6791391 - DNA, 59 bp, Homo sapiens
tgagtgctctgtatgtgccagactctgtactaaaagttcggcacatgttattgcattta

SEQ ID NO: 6791392 - DNA, 71 bp, Homo sapiens
gaggcaggctgggtagcaggtgatccaggagcagtggtacacctggaccctggactgccctggcctgcttc

SEQ ID NO: 6791393 - DNA, 61 bp, Homo sapiens
gagcctgagcaatgtgatgttttcaattgatttctaaatacacacagctcagtttttgctc

SEQ ID NO: 6791394 - DNA, 74 bp, Homo sapiens
ctgaccactgaaacaagaaggaaagattgctagagtgtttctgggcatcttgcttgtctttagtaaggaaacag

SEQ ID NO: 6791395 - DNA, 65 bp, Homo sapiens
ccagcaagtgcatggtatggtctccattcctgggtgcattgatgtggcctgccatgccctgctgg

SEQ ID NO: 6791396 - DNA, 63 bp, Homo sapiens
caggagctgagaagcagcgcttgatttcctgggggaaatcaagaaaagtgctttcggctcctg

SEQ ID NO: 6791397 - DNA, 60 bp, Homo sapiens
gatttcaggcccacctttccacagcttcaccacaacctgaacagaaaggtcctagaaatc

SEQ ID NO: 6791398 - DNA, 90 bp, Homo sapiens
ctttgattttattctactcttggactctggtttagtaggggactgaagaaaatttttggttatactataaccaggagcaagaggtcaaag

SEQ ID NO: 6791399 - DNA, 65 bp, Homo sapiens
gcggcctgggctgtacctgtgcgcggcgtcctttctgcgctgagccagggcaccccggagcctgc

SEQ ID NO: 6791400 - DNA, 57 bp, Homo sapiens
tttggaagcttcacattgaacttgggtgctagagagatacccttggagacttccaga

SEQ ID NO: 6791401 - DNA, 129 bp, Homo sapiens
ggagttctggcagcaggagggctgagcctggagcctcctgggccttgctctgtgatgtgggtagggagtcaccagtcatgagcacaggtgcagggaccccagtctttctctctgcttcctaaggtctcc

SEQ ID NO: 6791402 - DNA, 88 bp, Homo sapiens
ggagtctggctctgccacccaggctggagtgcagtggcacgatctctgctcactgcaagctccgcctcccgggttcacgccattctcc

SEQ ID NO: 6791403 - DNA, 82 bp, Homo sapiens
aagatgttgtgtatgccagggtcacagtcatattttgacctatgttaaatcatgcctattgctttgtgtgtcacaatatctt

SEQ ID NO: 6791404 - DNA, 69 bp, Homo sapiens
gtgtcacactatgcactaagaattttagaaaataaggacattgtgacatttcggtgtatgtgatgatgc

SEQ ID NO: 6791405 - DNA, 85 bp, Homo sapiens
tgccttgtgacttctgtgaggatttcctgcagctttcttccctaggagacagttgaagctgccaaacctctaagtccaaattgta

SEQ ID NO: 6791406 - DNA, 63 bp, Homo sapiens
cgtaatgaatcaacattaatgatctttccaaatgggggtcatctaacaatttgattctttatg

SEQ ID NO: 6791407 - DNA, 62 bp, Homo sapiens
gggcgggactgcggcgaaggggaccccggcccgaccccaggcgccaccctccgcggctgccc

SEQ ID NO: 6791408 - DNA, 127 bp, Homo sapiens
attttgttatgggaaactgaagatgggtaaacatacaatgataatagtactttatagggctaaatctaaaagccttaaagattaatattatgtttggataaatgctgaataagtttacataaagaat

SEQ ID NO: 6791409 - DNA, 57 bp, Homo sapiens
tgatgccacaaacattcactgagcacgttctatgtgccagggtttgtttgtggttca

SEQ ID NO: 6791410 - DNA, 74 bp, Homo sapiens
cctgagagagaagcgacctggtataagccactggctgctatacacatctggttaattccttcaatccttttagg

SEQ ID NO: 6791411 - DNA, 68 bp, Homo sapiens
tgtctactttaagatcatttgtattatcccttcatttgggtttacaacttgggttttaacattaggcg

SEQ ID NO: 6791412 - DNA, 90 bp, Homo sapiens
gccatatggttctgtttctgccttccttctactcccttcttgctaattggaatcaggtcaagatggtgagggcagaagtaaccatggggc

SEQ ID NO: 6791413 - DNA, 62 bp, Homo sapiens
cagctcacagccacgccattcccctctacaacccgccctgggaggctggctgggatgggctg

SEQ ID NO: 6791414 - DNA, 56 bp, Homo sapiens
ctcagccagtgatctttcctttggaccacaacccctctgaaaagcactgtgctgag

SEQ ID NO: 6791415 - DNA, 64 bp, Homo sapiens
taaggttataaagtctaccgtattaaagaggggaagatttccttctgtggaatttcagatcttg

SEQ ID NO: 6791416 - DNA, 73 bp, Homo sapiens
tattttataattcagatcccatgttcaagtgagtgatgttgtgctgcatttgctggggatgtgattggaaata

SEQ ID NO: 6791417 - DNA, 69 bp, Homo sapiens
ttggttttgaaatagcttattgtctacatgtaagaattaagcaaagacttcggctgtggacaagattag

SEQ ID NO: 6791418 - DNA, 92 bp, Homo sapiens
ggtgtcagatgccctggccagccagaaccaaaagcatggagtagacgcttggcttttattcctggtgttggctgggtccctgtgtcctgccc

SEQ ID NO: 6791419 - DNA, 84 bp, Homo sapiens
caaacagctgttttcaataatgcaggtaaattctagtcataggaaaatctctattactgcctgagctattggaaaagttttgtg

SEQ ID NO: 6791420 - DNA, 58 bp, Homo sapiens
cagctggacttttgatagaagttggatagctgacaactcacaattaagatgccagctg

SEQ ID NO: 6791421 - DNA, 55 bp, Homo sapiens
tggtgatattactcaatggtcactcctagtttttgatcagaagtgatattaacca

SEQ ID NO: 6791422 - DNA, 71 bp, Homo sapiens
ttacctctggggcatgggctacttgaagtttgagtaactttctaggtctcagtcctttaattatggggtaa

SEQ ID NO: 6791423 - DNA, 77 bp, Homo sapiens
atcttggatagatccctgaaatcactagaccacattagcaaatttaaagtgtgaagtggttagggagttggcagggt

SEQ ID NO: 6791424 - DNA, 62 bp, Homo sapiens
ctggttcctgaagggactggtgcagaggctgacctttgtcccaccaccccctcatgagttgg

SEQ ID NO: 6791425 - DNA, 80 bp, Homo sapiens
ctgttgtttgttgttgttgtttttgaacggtggtggccaatctgcctccacaatccagacataatttcggcactaaacag

SEQ ID NO: 6791426 - DNA, 60 bp, Homo sapiens
gaggaggctgaacaatgccctggacatgtggacccagcagggtggggttccagccttttc

SEQ ID NO: 6791427 - DNA, 62 bp, Homo sapiens
tccttgtatcctgtggtacatgcacttgtgcagtgtcaccagttccaggaaataaataagga

SEQ ID NO: 6791428 - DNA, 85 bp, Homo sapiens
tcatgaaatttgcagatttaggaatgttaaaaaatcagaaatagagaaaaaagtcctctggtcaagacatcctaacatctcatgg

SEQ ID NO: 6791429 - DNA, 79 bp, Homo sapiens
cctctgggtagcaataacagaaaactttccttttcctaagatctgggaatgtgattgttgttttaattctgctcagggg

SEQ ID NO: 6791430 - DNA, 79 bp, Homo sapiens
ggtcaggtaggtccagctgtctagctttgtagagggagggcaggtccttcccaaggcacagggcagggactccttgacc

SEQ ID NO: 6791431 - DNA, 70 bp, Homo sapiens
tcttaagctcttttgtttgcaagattgtcaattctaactcaagttattgcaaataacaaggagtttaagg

SEQ ID NO: 6791432 - DNA, 90 bp, Homo sapiens
ggcagggtggggtacttgggactcctggtacctttgccagggcaaatgatgcccaggaaccaggagagtccctgaacccaagcccaggcc

SEQ ID NO: 6791433 - DNA, 56 bp, Homo sapiens
tctgctattgcccaagtcttggaaagtgcaggctccaggaaaagggtggtggtaga

SEQ ID NO: 6791434 - DNA, 74 bp, Homo sapiens
ggagtataaggaaagagtccttctttgttttcttctttggtggccaaagaagagctggaaggagtctcctttcc

SEQ ID NO: 6791435 - DNA, 69 bp, Homo sapiens
gagtccattatatagttcagaaacatggctgagtatgaacagtaccaagaatctctatataaaggactc

SEQ ID NO: 6791436 - DNA, 56 bp, Homo sapiens
gagtcatctttagggaattaaaaacatttttctgcctgtaacccagagggtgactt

SEQ ID NO: 6791437 - DNA, 56 bp, Homo sapiens
tttagttgaaggcagtcctcaaatgatgacttgtcagttcattgttttcaattaga

SEQ ID NO: 6791438 - DNA, 62 bp, Homo sapiens
ggcaggagggcggacaatgacccgggttttccaccgactccagatgcgtccctcctcctacc

SEQ ID NO: 6791439 - DNA, 72 bp, Homo sapiens
cctcatatggtggaagggggaagacagctctgtggagactcttttataagggcactaatcccttccatgagg

SEQ ID NO: 6791440 - DNA, 80 bp, Homo sapiens
gggtttgactctgagcagtttctgtgcagccacaaagattcttatgtgagacacactgctgcttcagagtgctccaaccc

SEQ ID NO: 6791441 - DNA, 83 bp, Homo sapiens
ggagaactcagagtaatgtttgagatgttggatttgagatgcctttcagatatccaaaaggagatattcagtttgagtttacc

SEQ ID NO: 6791442 - DNA, 109 bp, Homo sapiens
aagatttttgtatgtcatagaagctttaattatcttacttatgttgaaggagatcaaattctgtttcagagttatgtaagaaaataagagtttatactatgctaatttt

SEQ ID NO: 6791443 - DNA, 67 bp, Homo sapiens
taagaaaaggtctacatcactgaaagaccttgagttgagtgtttttgtgtgtgttagatttctctta

SEQ ID NO: 6791444 - DNA, 77 bp, Homo sapiens
ttttcaatccttatttgtctagttccagtgcccatgacctggctctctggaatggaaacaaactgaggaagagaaaa

SEQ ID NO: 6791445 - DNA, 86 bp, Homo sapiens
gtgtctaaaccatgtctggaccaacatagcttctggtactctacactccaccatgggtcttggtccagcatcactggcagggacat

SEQ ID NO: 6791446 - DNA, 83 bp, Homo sapiens
tctttatggacatggctctgctgggcaaagcaaggacgggcacatccagcctatgcggtccatcaggggcactcacatttaga

SEQ ID NO: 6791447 - DNA, 82 bp, Homo sapiens
acaaactcaaagcattttagataaagcatcagtctaatatattatagattgatggagtataataaaatgacatatagtctgt

SEQ ID NO: 6791448 - DNA, 58 bp, Homo sapiens
gatctcaggtcctttagtgtccagaacctcggcaacgggctcttagaggatgggggtc

SEQ ID NO: 6791449 - DNA, 74 bp, Homo sapiens
acacacacacatttaaaaaggaacatatggtcttttaagtgaacctttaaagtgtgagagaagggcatgtgtgt

SEQ ID NO: 6791450 - DNA, 83 bp, Homo sapiens
gtgatattcgaaagtcttaggcattttatttctcagtttagagatttaaaaatggccagactatttaaagattgaatacttac

SEQ ID NO: 6791451 - DNA, 58 bp, Homo sapiens
tgggcttgggatattgggttaactcgtgggtaagggtcattcatatctctcaagctta

SEQ ID NO: 6791452 - DNA, 111 bp, Homo sapiens
gaagtcaggaaatcgataaactcaatagtgtctgcttgtttctaccgaatgataaaaagaattctggaaagaaagtaaaggcgtatttcaaggtttatgttttcttccttc

SEQ ID NO: 6791453 - DNA, 58 bp, Homo sapiens
gtggtccagaagagcgcatatggctttcgcacagcagctcctgtttttgggataccac

SEQ ID NO: 6791454 - DNA, 92 bp, Homo sapiens
cccacccctccttccacccagcccctctgccttccagcaagtgaatgaagtcaggcaggccctgggccatcccgggtgaaggagggagtggg

SEQ ID NO: 6791455 - DNA, 59 bp, Homo sapiens
ctgaaagggttacatagtaagttcctgacctgctaaggaagactaggtagctatttcag

SEQ ID NO: 6791456 - DNA, 58 bp, Homo sapiens
gcattgtgggcctgtcgtgggtggggccagcagcacatgcatgccaggctcacagagc

SEQ ID NO: 6791457 - DNA, 102 bp, Homo sapiens
ctgtgcagagtagtgttccacacaatacttaccaatgtttttgtgtaggttgcaaatctccaagaccatggggctgagtattttggaatgaatatcttacag

SEQ ID NO: 6791458 - DNA, 102 bp, Homo sapiens
gcctgcttctcctgcctcctcctctttggcttctcctcctcagctcctttcttcttctctgagggtggcacaggcacaaagagagaaaacagagaagacagc

SEQ ID NO: 6791459 - DNA, 78 bp, Homo sapiens
ataaaacacatactgctgtattgtcaggtagtgataggatttatcactacctgacaatacagtatgtgtttgttttat

SEQ ID NO: 6791460 - DNA, 66 bp, Homo sapiens
tctgaccctttagggtatgtttatactaacactattagttcttggataaaatctgtaaggctcaga

SEQ ID NO: 6791461 - DNA, 59 bp, Homo sapiens
gggaatatctacagctgaaagcccaccctgcaaggcagctgttagtcagtggatgcccc

SEQ ID NO: 6791462 - DNA, 130 bp, Homo sapiens
ttattctagtttttggtgctcagagatgccaagtggctcatcttggggactgtctcttgtagcaggcatctctccaggggagtgtctcccaaactttgagatggttatctgttaatcgaaggaaaaataa

SEQ ID NO: 6791463 - DNA, 55 bp, Homo sapiens
aacaggctaaattgtccatttctccagcagttttgaggcagacaaggagtctgtt

SEQ ID NO: 6791464 - DNA, 94 bp, Homo sapiens
ccagcagaggtttagctgtgagtcatgggtgtgagcttattccataaaatctcaggagcccaagactgtacagttaaagactcccatctgctgg

SEQ ID NO: 6791465 - DNA, 56 bp, Homo sapiens
agctgcctgtgtagaaccatctgcagctcttcagaatgggaaccacacaggcagtt

SEQ ID NO: 6791466 - DNA, 77 bp, Homo sapiens
gctgttagaaaaacatgcttttgttatagtgtggttttcttaaaaagagaattgtaataataatagcatttggcagt

SEQ ID NO: 6791467 - DNA, 62 bp, Homo sapiens
ttctctactaactgtcacttctgcacatctgttgcccaaatatgattggcggttgtagtgaa

SEQ ID NO: 6791468 - DNA, 88 bp, Homo sapiens
gccacactgcttcacagttcctgggaaaacaggttttggtccctcacctcttgttactagtccaggtgctttgagcagttcttgtggt

SEQ ID NO: 6791469 - DNA, 69 bp, Homo sapiens
ggaagccagggtccggctgcctggctgtgcctttagtgctgaccgcagtggctgctgggcctcccctcc

SEQ ID NO: 6791470 - DNA, 67 bp, Homo sapiens
gctgtgcctcagacggggccatctcccaggtttctctacctggcccaggcatccttttggtcacagc

SEQ ID NO: 6791471 - DNA, 70 bp, Homo sapiens
ggccctgtgaggctcaagaaagatttgttgattgaacacaggagaacgatttcattgagctcatttggtc

SEQ ID NO: 6791472 - DNA, 63 bp, Homo sapiens
tctttgccccttctacccgtctctgtatgaccccaatggggtagggtacgaaggggagccaga

SEQ ID NO: 6791473 - DNA, 65 bp, Homo sapiens
gcaaagtgtgcacatctttggagtagtcaaagagacacacttccagaacaggtacatttttatgc

SEQ ID NO: 6791474 - DNA, 65 bp, Homo sapiens
cccacgtgtctgtgtctggctcagcgcccatacaagggtgtcaaggttgcggggaggcacgaggg

SEQ ID NO: 6791475 - DNA, 71 bp, Homo sapiens
agtggtagcattgggacttgcaccaggttttccaacatctaattcagctatgttttctcactgctgcttct

SEQ ID NO: 6791476 - DNA, 58 bp, Homo sapiens
ggccttaggctctggctactacagagctggttccagtctgcactgccacagcctggcc

SEQ ID NO: 6791477 - DNA, 73 bp, Homo sapiens
gcttatggttctgcaggctgtacaggaagcatggtgctgccatctgcttctggtgaggcctcaggaagtttgc

SEQ ID NO: 6791478 - DNA, 71 bp, Homo sapiens
ggatataaccggaagattgtatactctgagaaatgttgctccttcatttctcaaatctttgcgttgtatct

SEQ ID NO: 6791479 - DNA, 89 bp, Homo sapiens
gttcatggccaatatttcccaagtgtcttggaccaggggcttgcttttggcactcctggtccaaaatatttgggaaatacaggccgagc

SEQ ID NO: 6791480 - DNA, 55 bp, Homo sapiens
gcagctttaatctgaataagtactgccaaagtgctcttcagcaagattaagctgc

SEQ ID NO: 6791481 - DNA, 73 bp, Homo sapiens
gtggcaaattgtgtgctgagctgggatccaggagttctggaccttcatcttggctctgccactaattagctgt

SEQ ID NO: 6791482 - DNA, 108 bp, Homo sapiens
ggggtttgggaaatggaagttgcacccttcaccttgcctgaagactattcctccaggctgggctgaagggtgcttactttctttatctgcacacatttcttgagtacc

SEQ ID NO: 6791483 - DNA, 129 bp, Homo sapiens
gcacaatatatgaaagttctaatattcaacagtggacaaatgatttctacctttttcaatcaataaaacctttagaaatctcagagagacatttgtttaatattaggaatttattcacttgtataaaat

SEQ ID NO: 6791484 - DNA, 56 bp, Homo sapiens
acatacagtagcattatgtttcccttaagtagtcttgaggtagttctattgtgagt

SEQ ID NO: 6791485 - DNA, 55 bp, Homo sapiens
ggctaaggaacgcaggcttctcttacccaggttccctgaactgctttttttagcc

SEQ ID NO: 6791486 - DNA, 68 bp, Homo sapiens
ttccattgcagcaccaatggcttcctgctggaaccctccctttagccacaggtgttggccagtgtgag

SEQ ID NO: 6791487 - DNA, 61 bp, Homo sapiens
cggaaatgttgggacaaacacagtctgatctcccaagaaagattttgtctcaatacttctg

SEQ ID NO: 6791488 - DNA, 127 bp, Homo sapiens
aagtgtgtaatgtattacctgtgcccatcaaacttgtttattccttcttcctgtgatacttgcatcacaggaagtgggtagaaggaataaacaagtttgatgggcacacgtaatacattaggcactt

SEQ ID NO: 6791489 - DNA, 90 bp, Homo sapiens
gtgccttaaaggcctaggtgaacatttctttggtaaacatgggctctgaactgtgagccctgagactgaagaactgtcccagtcaggcac

SEQ ID NO: 6791490 - DNA, 65 bp, Homo sapiens
tacatgtctgtgtgtcgaaaagattatagttgtaagagttgacaaaacaacacagatttcatgtg

SEQ ID NO: 6791491 - DNA, 66 bp, Homo sapiens
actgtaggttcctggagggcagggtcatgtgtcactcatctctgtgtcctcaggacctggcacagt

SEQ ID NO: 6791492 - DNA, 64 bp, Homo sapiens
ctcagctgctccacctccgggtcaggcaggtgagcctggggcagagaggctgagagcacctgag

SEQ ID NO: 6791493 - DNA, 74 bp, Homo sapiens
ctacaggcttcagatttctcagttgtttcctcaggcaaacaataaatcttctgagcattgatctaagcctttgg

SEQ ID NO: 6791494 - DNA, 60 bp, Homo sapiens
ctgtctagaagctttgtgaaggcagaagcgatctctcctttgccacccagagcctgacag

SEQ ID NO: 6791495 - DNA, 62 bp, Homo sapiens
caccaatttcctgcaggggctggtgggcgcgattgctctggacagccctccaggaaggggtg

SEQ ID NO: 6791496 - DNA, 72 bp, Homo sapiens
cacatatctgaagggatattctgaggaaagtagaatacctcataatgtaaggctccctacagtgtatatgtg

SEQ ID NO: 6791497 - DNA, 71 bp, Homo sapiens
gggtccgggcgggggccctcctcggccctcccaacatgggggccaggaggtcagcccctcaacctggaccc

SEQ ID NO: 6791498 - DNA, 58 bp, Homo sapiens
aggatcagtgaatactcagggtcctaaaccagggatgccctgggcccttcctggttct

SEQ ID NO: 6791499 - DNA, 114 bp, Homo sapiens
gctgttttatgtgctgtattgatattagagtatttgtttggcttcagtgggtacttaattatttgtttcttcttgacagtgtgctagaattaattcatagcattatgaagctgc

SEQ ID NO: 6791500 - DNA, 56 bp, Homo sapiens
tttgggaaatattgtgttcaagtttaataagctacttgtctacagaatttctcaga

SEQ ID NO: 6791501 - DNA, 62 bp, Homo sapiens
gatttcacccacttcccagtgtcatttctcgtctcctttactgtggatggtaaggtgaggtt

SEQ ID NO: 6791502 - DNA, 72 bp, Homo sapiens
agagtttgaagcagaggagggtcgtgatctaaatgtttttaacaggctcactctgacttctaagaatactct

SEQ ID NO: 6791503 - DNA, 70 bp, Homo sapiens
tcctcggccgctctgctgctcagtggcggcctctgccttgcctgctggagcagggctcttcagccgagga

SEQ ID NO: 6791504 - DNA, 71 bp, Homo sapiens
ttgcaaattcaaacattttcctgtgcagtttaatttaatgcatggttggatgcatatgaatacacctgcaa

SEQ ID NO: 6791505 - DNA, 70 bp, Homo sapiens
gctggctgcctttgacttaagggctcagttggttaaagcccaaagctgaggctcaagtcatgggtccagt

SEQ ID NO: 6791506 - DNA, 82 bp, Homo sapiens
atgatatggacatttttgaagagtctagattggttatttagcaaaatgtcccttgatttagactttttgagtgtttcttcat

SEQ ID NO: 6791507 - DNA, 64 bp, Homo sapiens
caattgttttccatttttgttgtgtcagcctggctgcagggcaaatgtggaaaggagagttttg

SEQ ID NO: 6791508 - DNA, 82 bp, Homo sapiens
atcagtgcttttctcatagtcatgcctcttatagttttataattttttaaaaggcaatactagatgagtttaaggcgctggt

SEQ ID NO: 6791509 - DNA, 55 bp, Homo sapiens
tatcagcttcataaagttggtcagtatatcaactgagtctttcaggaagcagatg

SEQ ID NO: 6791510 - DNA, 55 bp, Homo sapiens
ttaaaccacaaggcaagttttggtaagaatccttagcagcaaatgcgtggtttga

SEQ ID NO: 6791511 - DNA, 59 bp, Homo sapiens
ggtcagaggccaaactgagcagggttttgtaggccctgctaaggattttgccttttacc

SEQ ID NO: 6791512 - DNA, 81 bp, Homo sapiens
tgagatgcacattgtgctgttattcattctttttgttaactcaaatgactttgaaaacttaaataacagcatgttcgctca

SEQ ID NO: 6791513 - DNA, 72 bp, Homo sapiens
gtttcatttattggttaggccagcagaagacggtaaacgttggtttggtggtgttgacagatggtgtgaaac

SEQ ID NO: 6791514 - DNA, 125 bp, Homo sapiens
ttgcggatctcccatatatgtcgtggtgatttagtccttcagaccagagagttttccaatatttttttctggataactgtatctctatttctaacttctgctgagatggctgaggggatctgcga

SEQ ID NO: 6791515 - DNA, 55 bp, Homo sapiens
ctgggctttcaggccctaaggccagtgggtccccctcctcggggtctgaagtcag

SEQ ID NO: 6791516 - DNA, 68 bp, Homo sapiens
aggaatggttatggggatagtagaatcatttgctaggggtgacagtggtatctgcataacttattcct

SEQ ID NO: 6791517 - DNA, 66 bp, Homo sapiens
cctttggcaatctggtgaagcagaaaaatttttaaaagatgtaaaaattataccagattacaaagg

SEQ ID NO: 6791518 - DNA, 92 bp, Homo sapiens
gctgccatctgctgactgtgagctagggactagggaaggagcagactagaacagaagctgcacttcccgcctctttgctcagcagatagagc

SEQ ID NO: 6791519 - DNA, 63 bp, Homo sapiens
ctgcctggtgcggtgcccacccagcctcatctaggtagccgctggcactgcaccagttagtag

SEQ ID NO: 6791520 - DNA, 60 bp, Homo sapiens
cagtgggtgagaggaaaagcttcagagaaaaggctctgtgaggctctttatccataactg

SEQ ID NO: 6791521 - DNA, 60 bp, Homo sapiens
gacttaacagacattatttacctccttgttctaaaagagaggtggggatggtttgtggtc

SEQ ID NO: 6791522 - DNA, 95 bp, Homo sapiens
ctgagcttttacactgtgtatataagtgagacctgcagtgccagctggtattgttaacaactcaaggcattaatgtaatacagtgatgccctcag

SEQ ID NO: 6791523 - DNA, 58 bp, Homo sapiens
cctcctcatttctctccaggtaattcattactgtactttggcagtcagaaatgtgagg

SEQ ID NO: 6791524 - DNA, 66 bp, Homo sapiens
tagcagcaattcaggtgtgatgctgtcattttttatcatggccctgaactcccagaattgttgttg

SEQ ID NO: 6791525 - DNA, 89 bp, Homo sapiens
aggttaaagggtgggatggcacaggtaatggaggatagtggttctggatagtgcttctggcttatctcgtgccttcccatctgtttcct

SEQ ID NO: 6791526 - DNA, 55 bp, Homo sapiens
tcaactttgaaaccatagtgaaatctgtattctagactaatggtttcaaagttga

SEQ ID NO: 6791527 - DNA, 64 bp, Homo sapiens
tttagtttgccagtattttattgatgatttttgcattgatgttcatcaggaatattggcctgaa

SEQ ID NO: 6791528 - DNA, 96 bp, Homo sapiens
cttcatgggatttctagaaacactgcctacactttatgaaaactacatagtattcacctgtgacaggtagagtttatcactattaattttatgagg

SEQ ID NO: 6791529 - DNA, 81 bp, Homo sapiens
tgtgtgtgtgtgtgtgtgtgtgtgcatgtccatgaatgttcttcacctcatgaacatctcaaataaccatgcttccacaca

SEQ ID NO: 6791530 - DNA, 63 bp, Homo sapiens
caggaatttttctaaaagagggaggagagccttggagagaggttttctcttttttagttcctg

SEQ ID NO: 6791531 - DNA, 74 bp, Homo sapiens
ctgctttaggtttattgtttactagtttgcagatctttgagatctatgctagaaaataattgcaggaaaagtag

SEQ ID NO: 6791532 - DNA, 76 bp, Homo sapiens
tttgatggtcttaagaagcagttaacatgacttgaaagcaacatttttcaagtactgtaaacatgctaccatggaa

SEQ ID NO: 6791533 - DNA, 60 bp, Homo sapiens
gggttttgaggcttctgagactgagtgaatcatttgcttaaactgaaagctacaagattc

SEQ ID NO: 6791534 - DNA, 60 bp, Homo sapiens
cactcctacctcaatgtttttgtataggggcggcaggccaggacagggatggggtaagtg

SEQ ID NO: 6791535 - DNA, 72 bp, Homo sapiens
agtcatacagtgtggcatgtagtcttttgtgaaataggcttgaattctatttttaccacttattgtgtgact

SEQ ID NO: 6791536 - DNA, 71 bp, Homo sapiens
tgggaggtgatgcatgtgccaaaatctgaagtgagtaagcactcaaataatgccattcatcatcatcatca

SEQ ID NO: 6791537 - DNA, 74 bp, Homo sapiens
ggcaaggcagagccctccgctccccggctggccatggcaggcaggcagggacgtgggtgggacctctgaccgct

SEQ ID NO: 6791538 - DNA, 60 bp, Homo sapiens
tcatggaccaacatctgactgatccctaagaaatctgaaggtcagaggatttggctatga

SEQ ID NO: 6791539 - DNA, 85 bp, Homo sapiens
cctgaaagcccatgtcccctaccttcaagttcctccctctcccaagaagtcgttagaaggaagaggaggcagtcctgtggccagg

SEQ ID NO: 6791540 - DNA, 78 bp, Homo sapiens
ggggactttcttgcataatttgaaaccagataaagtagagaaagttttcaggttccgtcaagatgtaaggtagttttc

SEQ ID NO: 6791541 - DNA, 55 bp, Homo sapiens
gaacagcctggagttgcagggcctctcaagctgggggccctgaccttggctgctc

SEQ ID NO: 6791542 - DNA, 80 bp, Homo sapiens
gggcaggctggctggagctgttgtaggctgtccctcatctcctggatcagcccctgtgatgtctcttgctttctcctcct

SEQ ID NO: 6791543 - DNA, 59 bp, Homo sapiens
tatcgagctggacgggctggtctgggggacctccaagctgatgcccgtgggctacggta

SEQ ID NO: 6791544 - DNA, 70 bp, Homo sapiens
gcccagagagcacaggtggtgggagggtgtcaacaaacgtcacagcccccagctggctttccaagtgggc

SEQ ID NO: 6791545 - DNA, 125 bp, Homo sapiens
caggccataagatgacctaataagcacacaatatctggagagctaagcggagttatccctcatacctaaggcgacttctctctctggatatttgtatgctggatttgtctctgaagctaagcttg

SEQ ID NO: 6791546 - DNA, 57 bp, Homo sapiens
tcatataccagagagtttatattgtttctgcagtttcaaatttttgtgtgtgtgtga

SEQ ID NO: 6791547 - DNA, 75 bp, Homo sapiens
taactcagaacagtaaaattaagggcagttaatgtttatattaatgttggcatgctcattttattttaagagttg

SEQ ID NO: 6791548 - DNA, 56 bp, Homo sapiens
ccagcgcttcccatcagggaggactgcttataactccctggatggaggagccctgg

SEQ ID NO: 6791549 - DNA, 76 bp, Homo sapiens
ccccaaatgtgccaacagtagtcccatcgcaacattatgtgggcattacagttctacacatccttttctgttgggg

SEQ ID NO: 6791550 - DNA, 70 bp, Homo sapiens
tggaaggccccagagggcctgagtttgttctctgagcaaagtaatgaactctttccctttggtgccacca

SEQ ID NO: 6791551 - DNA, 56 bp, Homo sapiens
caacgttgacagttgttttcagcaaatggctgctttactctgtactgtcaatgttg

SEQ ID NO: 6791552 - DNA, 100 bp, Homo sapiens
ggatctggcaaacagccaggcgcagaagtcttcatagaattcaaatgaggaagcacaatcccttttgcgaattttggctgaaagaaagcaatacaggtct

SEQ ID NO: 6791553 - DNA, 79 bp, Homo sapiens
ttgttgttgatgatgatgatattttgactggagaatctctcatgatttttcatagacaaaatgtcactctcaacaggga

SEQ ID NO: 6791554 - DNA, 64 bp, Homo sapiens
tctctctgaaaccttgtttcctcacctgtaaaatgaggataataacacttgggttagtgggaga

SEQ ID NO: 6791555 - DNA, 94 bp, Homo sapiens
gggtgacaaaaacaatataaacaagttgttgaaaataattatctttgggtgattgggttatgatgattttattttattgttttgctgttttctc

SEQ ID NO: 6791556 - DNA, 82 bp, Homo sapiens
ctctacttcccctggacccaggggtccacagccctcaactccatccccaagcgtggaaccctcctactccagggcagtggag

SEQ ID NO: 6791557 - DNA, 58 bp, Homo sapiens
caggtaaaaataaatttgtgagagtcacagttctggctagggaattttcttttgcctg

SEQ ID NO: 6791558 - DNA, 105 bp, Homo sapiens
tatgcatttgtacaagcttgtttatctgcactctcttgtagtgtatttacttaacaagccaagttagattgtaatcgaaagcaggtgctgtcatatcactgcatg

SEQ ID NO: 6791559 - DNA, 62 bp, Homo sapiens
gtggacaggggcagggaggattgtcctcaaagacaacagcatttcctgccctttgtcatcac

SEQ ID NO: 6791560 - DNA, 91 bp, Homo sapiens
tcttgtgaactttgcttagttaggaaacaaagttgttcatgtatgcgtagaataaatagtatgtcctggtatttgagtttgagttacgaga

SEQ ID NO: 6791561 - DNA, 74 bp, Homo sapiens
tggtttagtgtgcatggatctgtggatctagttgttcctcatgcaaactttcaactttctgtggcactaaatca

SEQ ID NO: 6791562 - DNA, 57 bp, Homo sapiens
cattcttcagtccataagtattcagagcacccactgtgtgctgagggctgggcaatg

SEQ ID NO: 6791563 - DNA, 60 bp, Homo sapiens
tacactggccaaatgcctttggcaccccatgcttgctgaagatcataaaagggtcaggta

SEQ ID NO: 6791564 - DNA, 58 bp, Homo sapiens
gcacatttttactgccaacttaaaaccattttttgaagtatggaatgtagaagtgagc

SEQ ID NO: 6791565 - DNA, 113 bp, Homo sapiens
ggcatgagttaccaagggatgattgcattgccatctgctgtaacagttttacaatgttaatatattgtttgcaacaactagatggaggtcaagtctttcttgatgattttgtc

SEQ ID NO: 6791566 - DNA, 86 bp, Homo sapiens
aataattctttctgtatgttcagtgacatctttgggtgcccaataacctaagtgtctaaaaggcagaactgcagatcatatttatt

SEQ ID NO: 6791567 - DNA, 86 bp, Homo sapiens
gggtactaggaaagggtgactctgtggctcttaggtgtgctacacatccctgaagccacagagcatctgcctcccttaaaccaccc

SEQ ID NO: 6791568 - DNA, 100 bp, Homo sapiens
aatgagctgggttggaattgcagctgggacatttttgatactgtgatcttagatacattcatctgtcagactccagctgattccaaactccttgttcatt

SEQ ID NO: 6791569 - DNA, 79 bp, Homo sapiens
ctggggctggggctgcggacgggagcccagcccccagatgacatcctggggctcagtcggcaagccccttcagtcccag

SEQ ID NO: 6791570 - DNA, 63 bp, Homo sapiens
gagtgcagatgccagccccagtccttggcccacggaccagggcacaggagtctgaagccactc

SEQ ID NO: 6791571 - DNA, 82 bp, Homo sapiens
gagccgctgcacagggtttaccattgattacgggctcaacaaaggctgttgttatcattggaggcactgtgcagtatttctc

SEQ ID NO: 6791572 - DNA, 58 bp, Homo sapiens
tcagtaacttcatgaccaagcacacaggtgtttatcattctggtgcatgagatactga

SEQ ID NO: 6791573 - DNA, 74 bp, Homo sapiens
ttctcattatgcaaatgtttcttatctattgttcaactttcatatgaccactggatatcagagatgtatgagaa

SEQ ID NO: 6791574 - DNA, 64 bp, Homo sapiens
atgacacaagagcagaagccatcttggtgaccacactcctcaacacggctgtctcttgagtcat

SEQ ID NO: 6791575 - DNA, 67 bp, Homo sapiens
ggagaataggcaggttttgatggcagatggctacacccaagccacagatcgttctgtcacttcatcc

SEQ ID NO: 6791576 - DNA, 55 bp, Homo sapiens
ctccctctcaccggagccctggcggggcaggccgggccgagacggtgggagggag

SEQ ID NO: 6791577 - DNA, 56 bp, Homo sapiens
cctggtggcttctgggtggacgatgggttggtagtttaatcaggagcctaattagg

SEQ ID NO: 6791578 - DNA, 58 bp, Homo sapiens
gttggctgtgggtgtgggagtcctcctcggagagcctggtctgacagccccagtcaac

SEQ ID NO: 6791579 - DNA, 71 bp, Homo sapiens
gctacatgaggcatagcagggatcggacgccgcagagtccctgactcttcccccctggtgtgtctatgagt

SEQ ID NO: 6791580 - DNA, 68 bp, Homo sapiens
gagattgcatgctttttcaaatgtgcatttctatggtggtgtgcatttggaactgggcatgcaaactt

SEQ ID NO: 6791581 - DNA, 129 bp, Homo sapiens
tgcttcctatcaagcagagtgtgccaagttctccttaaactttatcttgtgagaatggagattgataaacagagaaatacctgtttcaaaagatgaataaggttgattgcccgccagcatgaccaagca

SEQ ID NO: 6791582 - DNA, 67 bp, Homo sapiens
ggaaagcagatgccaagatttaccaaattaactctgatgttggcaagaactgtgcagtctgctcgcc

SEQ ID NO: 6791583 - DNA, 72 bp, Homo sapiens
aaagggccctgagttgcagccctggatccccatggaaccaaagggccctgggggctggagctgggctccttt

SEQ ID NO: 6791584 - DNA, 70 bp, Homo sapiens
acactctttcactaccttaattccagagaaaagcctcataggcttccgtattgtaggtatgcaggagtgt

SEQ ID NO: 6791585 - DNA, 57 bp, Homo sapiens
ttcttgttggcctcaggtttgctatcctccccggtagacctgatggctcaacacgaa

SEQ ID NO: 6791586 - DNA, 76 bp, Homo sapiens
caggcactgtgctgagctctgcacctttaagaggcagcaagtcgtgactggttcagagctggctcagagctgcctg

SEQ ID NO: 6791587 - DNA, 80 bp, Homo sapiens
ggagcagttttcctgagctcctcatgcaaatggacgccactcccttcggcaaagtcctgggagctcaagggaggctgccc

SEQ ID NO: 6791588 - DNA, 60 bp, Homo sapiens
tcgggctccaggcagctgggagtagccggagccggcttccctcctggtccaggagcctga

SEQ ID NO: 6791589 - DNA, 89 bp, Homo sapiens
tatacaaatgtgctattaaattaaattgatatgccgcatattcagactctttgggcaatcactttgaattatgtagccgtgaaagtata

SEQ ID NO: 6791590 - DNA, 64 bp, Homo sapiens
gtgcacacttaatactcactgtgctgtgggtgaccacagagtggcccaagattgaagtgtggac

SEQ ID NO: 6791591 - DNA, 64 bp, Homo sapiens
tagagtcagaaagtagtgtgcctatttaaacacaagttttctgggtctagtgcttttcactcta

SEQ ID NO: 6791592 - DNA, 102 bp, Homo sapiens
tgctggctcagaattgccttgattcttctcatgtgttatgggagctataaatccaacagcgaatagtagccacaagaagtgacaagtgcaattcagcttcca

SEQ ID NO: 6791593 - DNA, 83 bp, Homo sapiens
gcaaaataggcatggatgcagaaagagaatgtaatgttataggcagacatacttctttttgtaccttttcatttgccttttgt

SEQ ID NO: 6791594 - DNA, 59 bp, Homo sapiens
agccacatcctgtgtaaacttggtgctagagttctcatagggttcgccaggatgtgact

SEQ ID NO: 6791595 - DNA, 74 bp, Homo sapiens
ctggtctataaatgcagatatgtgtgtgcgcttctatgtatggatgcttacatgtacatgcataggtagagagg

SEQ ID NO: 6791596 - DNA, 66 bp, Homo sapiens
tgtttattgagtgcctactataggcctggcaagtcttctaggtactggttagcattgagcaagaca

SEQ ID NO: 6791597 - DNA, 82 bp, Homo sapiens
gcatcatcacagaatgttattggacagcagtggtcaattttgtcacccttgttaaataagatactgagactgagaatgatgt

SEQ ID NO: 6791598 - DNA, 87 bp, Homo sapiens
ggcattagagtcacgtagcatgaaccttactgtgaactgcacatgtgaggggtctaggctgcgcaccctttatgataatctaatgcc

SEQ ID NO: 6791599 - DNA, 98 bp, Homo sapiens
ttaagatgattttccttcagcagtagtgtggtaaataaatgttttgtggtaaatagacaacgtatatttctacattctagaaaggtgaattattttaa

SEQ ID NO: 6791600 - DNA, 75 bp, Homo sapiens
gttggtatggtgggaagagcttggactttcaagtcagtcatctggatttgaatcctggctttaccacttaccagc

SEQ ID NO: 6791601 - DNA, 95 bp, Homo sapiens
ggagatctcataattttctagcaagaaagaggtggaaagtgcaaatcaaacctgttcacctgttattactaggtaagaatgaattaagtatcttt

SEQ ID NO: 6791602 - DNA, 72 bp, Homo sapiens
gatgtggaacagttaagactaagctagattatgaactccactttctggcttctatgaatgtccttccacttc

SEQ ID NO: 6791603 - DNA, 82 bp, Homo sapiens
tttctagcatacaggtaatcacactgttattttagttaaagttagcttaagccagaggttgtgtgatcagtaatgctagaaa

SEQ ID NO: 6791604 - DNA, 71 bp, Homo sapiens
catggcaggtggcacagcctgggacctggcctctccctctaggtttcatgagcactgttccaactgccatg

SEQ ID NO: 6791605 - DNA, 75 bp, Homo sapiens
gtgaaaaggcttaggagtcagggaacattgccctgaggcattgggcaagtcacttaatctaagtctcagtttcat

SEQ ID NO: 6791606 - DNA, 59 bp, Homo sapiens
ggaaatatacttcactgagcctctgcattcagtacctggcagtgaaaaagtatgtttcc

SEQ ID NO: 6791607 - DNA, 119 bp, Homo sapiens
acattttggattatattcccaaacctgttctagccatgttatttattatcctcggttgtgaagtggctgacaacattggaattataactggagaacagtgggagagtaattgagaaagt

SEQ ID NO: 6791608 - DNA, 57 bp, Homo sapiens
aaatgtgcatgtatgtgcatgttttagtatgcatgcatacttgtatgtgttacattt

SEQ ID NO: 6791609 - DNA, 57 bp, Homo sapiens
ctgcctggaagagtaggcacaatttgggcaggccagagtatcgtacctttaaggcag

SEQ ID NO: 6791610 - DNA, 126 bp, Homo sapiens
aggataaatgtaatttttaactttttagaatattttctgttcaggatggctgactttgtgatttgtccaaattaggcaaaaagggcagctagctgtagaaagagctaaacaagtagaagagttcct

SEQ ID NO: 6791611 - DNA, 76 bp, Homo sapiens
attctccttttagccagctggataatgtggggtgtcctcagataactccaagtaacaactggatggaagaatggat

SEQ ID NO: 6791612 - DNA, 65 bp, Homo sapiens
caggatgttctgtttttgcttattttgctttgatgagggaaaaggcagtgcaagagagggtcctg

SEQ ID NO: 6791613 - DNA, 84 bp, Homo sapiens
agttacattttccttctgaattcaccatgttctccagaaggtaggcttgtgaacttccagatgataaacaaggagactgtaact

SEQ ID NO: 6791614 - DNA, 59 bp, Homo sapiens
ctagcatctccttagggtaaggaaggcaaaatgcccattcctgatcccagattgcttag

SEQ ID NO: 6791615 - DNA, 68 bp, Homo sapiens
gggtttccacttagtcctgcttgtctcatttcccttcaggcagtagagaagccaggctgtatagatcc

SEQ ID NO: 6791616 - DNA, 86 bp, Homo sapiens
ccttggaagcaaatgattgaagctatataaaaaagctcagcaatgctgaagctttaggatgggttcatcattgaatgtccctgagg

SEQ ID NO: 6791617 - DNA, 63 bp, Homo sapiens
tgggactttgcttctccaacctgctcatcacacagatgaaggaatggaggatcagagcgttca

SEQ ID NO: 6791618 - DNA, 71 bp, Homo sapiens
cagtattctggtttttcaggtggtagggagaagatctgattgtagtacctttacttgggctcagaatgctg

SEQ ID NO: 6791619 - DNA, 66 bp, Homo sapiens
cctgggtccctgagttagtacagttgagtagggctcctggccagcatgtgctacataggcatcagg

SEQ ID NO: 6791620 - DNA, 125 bp, Homo sapiens
ctctgggagagccagtgtaattagactaattttacaagggaaaggggaaaaatcaaggggattatgctataggccacttgtagagttgggaattgtactagtcagggttctccagaaaaacagag

SEQ ID NO: 6791621 - DNA, 67 bp, Homo sapiens
gcagccgccgggtatgctgttcaggatggtatcactcacctcttgggatttgcaggctcagcgctgc

SEQ ID NO: 6791622 - DNA, 66 bp, Homo sapiens
ctgcccagaatcactcactcgatgccttttgggatcgatgacatttgatttgtaatgagtgggcag

SEQ ID NO: 6791623 - DNA, 109 bp, Homo sapiens
ttgatagaaatttccaagtctgtcagattttcaagacgagaggtacatgtaacttcacaatgaaaaacgcttttagtttttaagacctggcaaatgaaatttagttcaa

SEQ ID NO: 6791624 - DNA, 64 bp, Homo sapiens
ttctacgtgctcctttctggcctcctgacaggttgtttactgaacaaggccaaagggcaaagaa

SEQ ID NO: 6791625 - DNA, 104 bp, Homo sapiens
cttttaatcgcttcgtcttgtttcctttgctttttaaataatgtattgatcatttttgtaagccactttaaggatgtaaaggaagaaggaggaaagtgagaaag

SEQ ID NO: 6791626 - DNA, 79 bp, Homo sapiens
aggccagacgagctgcatttgaattaccttgtgcataattaatgaattaattaattacaaatgtagactctcatgtcct

SEQ ID NO: 6791627 - DNA, 82 bp, Homo sapiens
gtgttttgcagtagagctttaaatcaatccagtgagaggactgttctacttataagatctgattgaaatgctttcctaacat

SEQ ID NO: 6791628 - DNA, 76 bp, Homo sapiens
gagagagagagagagagagtgaccgattgaagtagccttataatgtagtgatgttgctctctttttctctcttctc

SEQ ID NO: 6791629 - DNA, 66 bp, Homo sapiens
agtgcatgccttcctgtggatgggctggctgcatcatctcggaatacaggaaagcatgttattact

SEQ ID NO: 6791630 - DNA, 59 bp, Homo sapiens
gacctggggtaagcttggcaacaatgaaacatcttttccaggctattccctttggagtc

SEQ ID NO: 6791631 - DNA, 103 bp, Homo sapiens
gtttgacagctatttccttttcaaagttctggcttcttaggtgttcagagatagctctttatccaccagggactaggactaggaggctatagttctgtctggc

SEQ ID NO: 6791632 - DNA, 72 bp, Homo sapiens
ggagatgagttgggggttccagggaggcaccacagttgccaaagtcctcttgcctccctggcaagtctctcc

SEQ ID NO: 6791633 - DNA, 79 bp, Homo sapiens
caccttggcttgccaaagtgctgagattacaggtgtgaaccaccacagccagctattctagagccttttagccaaggtg

SEQ ID NO: 6791634 - DNA, 104 bp, Homo sapiens
cccagaggcagggtgtacattgtgagtgtcagtgcctggcttgtttgcctgtgcggatgtggcagccatggacactggctagcatatggacaccttgcctgggg

SEQ ID NO: 6791635 - DNA, 55 bp, Homo sapiens
tatcagcttaattctcaacaggtcccagcctgtgttgacagaattacagctgtta

SEQ ID NO: 6791636 - DNA, 61 bp, Homo sapiens
gcccatggccttacattatcttggatcaattggttggagattaaagagtggggtgattggc

SEQ ID NO: 6791637 - DNA, 58 bp, Homo sapiens
tcatggcattgttaagggttttaaatgagataatacaagttcttagcataatgcctga

SEQ ID NO: 6791638 - DNA, 84 bp, Homo sapiens
aggccgggccgtgggctccagatgaaaggccagaggcgcccctgctatctctgctgctcctcacctggtgttcctggccggctt

SEQ ID NO: 6791639 - DNA, 59 bp, Homo sapiens
tgaaagctcctggaagcttggtaaagatgagaaacaaacatgagctcctggggtcttta

SEQ ID NO: 6791640 - DNA, 120 bp, Homo sapiens
agaggtgggcaggctctggagaaagggctgagaagtggggctggcgtttccttcctcctcccctgagctccatcctctgccctactttcatgtctccccctcccagctctccctacctct

SEQ ID NO: 6791641 - DNA, 83 bp, Homo sapiens
gcctgagagtctaggcagccctgcagggttggacagacatcagggaattgaagccgatcctgcagggagccaggcttttgggc

SEQ ID NO: 6791642 - DNA, 107 bp, Homo sapiens
gtgtgtgaggacagggaggctgggagatatgaggatctggataaaaacttatctcagcgttgagagtatctttgagcagtgtatcccttttgtctttatcaaaacac

SEQ ID NO: 6791643 - DNA, 74 bp, Homo sapiens
cttccacaatctgggtcatcagtggcatggttcttctatacagaatgtctgggccctgaagacagtcagggaag

SEQ ID NO: 6791644 - DNA, 60 bp, Homo sapiens
ccgtgcttcagttcataaccttgctaatcatgtatctgaccttgtgagctgaagaacagg

SEQ ID NO: 6791645 - DNA, 88 bp, Homo sapiens
tcttcaatgtaacacaaaaggagtcccactgtcaatgctaggggctggcaacaggttggattcctgcttttgctggcttcatttaaga

SEQ ID NO: 6791646 - DNA, 72 bp, Homo sapiens
ttctctttactctgtgttattgtttagaagctaaaggagaaatagctgtcagcataacaaggtaccagggag

SEQ ID NO: 6791647 - DNA, 111 bp, Homo sapiens
tcagcttgatcgggcgggccccagaagccaggtgtttaggccagcggttgaggccaaaaccgctgccttcatcccacgcctaggctcgctgatctttccctttccagctgg

SEQ ID NO: 6791648 - DNA, 99 bp, Homo sapiens
gctagtcctgtgatggctatttagagttaagcatcaatttcttatgagtggcatcatgttctcccatgcttaactctgtacatagtttcaaggaaaagc

SEQ ID NO: 6791649 - DNA, 95 bp, Homo sapiens
actgcatcactgccacatcctctgtgcaatagaaagtggcatggaagaatgactccaatatctgccacttgcacttgggtgtggagtttaccagt

SEQ ID NO: 6791650 - DNA, 83 bp, Homo sapiens
attcatacagtccaaaactcagaaggtacagaagggaggtgtctccaggcaccctgttactctctcctgagttttttatgaat

SEQ ID NO: 6791651 - DNA, 75 bp, Homo sapiens
ggtgagacgcaggcgtcaaagcttgaagagcaattgcattacctgtgcggctgaggttttctgcctgctcaatcc

SEQ ID NO: 6791652 - DNA, 75 bp, Homo sapiens
ttggcactcaaaattttatcggggtagttcaggaagattcttgccagttccggggatagagtcttgggttgccag

SEQ ID NO: 6791653 - DNA, 59 bp, Homo sapiens
aatgtttgctctgtaggttcatggcaggaaaacctttagacatgatcttagcaaatatt

SEQ ID NO: 6791654 - DNA, 60 bp, Homo sapiens
tgggttctccagagcagacagagccagggtttaggttgctggatgtttatgaaggaccca

SEQ ID NO: 6791655 - DNA, 67 bp, Homo sapiens
ttaattaaattcatgagcattggacttggaaaaataaacttctagggaaatgtttttgaataattga

SEQ ID NO: 6791656 - DNA, 65 bp, Homo sapiens
gcccacctgcagccagtctacctggtggaaagttgccttcggtctgaggctgcaaggtggtgggc

SEQ ID NO: 6791657 - DNA, 57 bp, Homo sapiens
aaaatggatcccggggctttccaaggagcctggaatttcagctcacagatctgtttt

SEQ ID NO: 6791658 - DNA, 76 bp, Homo sapiens
tgagattgcaagtcctttgcatgcagggacagggtatcatgctctctgcatccccagggctctccttgtagtgtca

SEQ ID NO: 6791659 - DNA, 66 bp, Homo sapiens
aactttcttgaatatgggttaaactgcccatctagatgtctgatagtgcccaagatctagaaggtt

SEQ ID NO: 6791660 - DNA, 72 bp, Homo sapiens
tgtgttgaggccgccatgtgcactgcattcccaagaaatcatagcacatggggctgcttgttgttcagcaca

SEQ ID NO: 6791661 - DNA, 86 bp, Homo sapiens
catggtcctcatgttgatgaaagccctgtcctgggtgctggagacagagatgaaggatacagcgtttttcccacaaggagattatg

SEQ ID NO: 6791662 - DNA, 110 bp, Homo sapiens
acccaccttcccacagctgcggcagtggtgcttccggcggatgacggtgaagggtgctttgcacgccgtgcagaagccacaggcctcgtctggcacccactccggggggt

SEQ ID NO: 6791663 - DNA, 88 bp, Homo sapiens
agaggtgactcctttctcgtgcatgtaagtttaccgtcatgccagcaagtcctccgctgaccagtagatgcatgcaaatgttatctct

SEQ ID NO: 6791664 - DNA, 124 bp, Homo sapiens
gaagctgtataaattatcaagtaatatgagaattggaaaatatcattataagtaacttgtgaaaacccctgatgttttaaattagccatgaaatgtgacttactttgtaatattatgaagcttc

SEQ ID NO: 6791665 - DNA, 110 bp, Homo sapiens
actgatctgtgtgctggagcagatggttaagtgttctccatgagttccgcccactaggggcttgggctgtggggaagatagaaccgacacatgtgaagcagacatcatgt

SEQ ID NO: 6791666 - DNA, 68 bp, Homo sapiens
cagatgctgagagatcaaggcaggattttggcctctaataataaggatgctttgtttccagcacactg

SEQ ID NO: 6791667 - DNA, 66 bp, Homo sapiens
gcaatcccagatctgaatgtcaccttttgtcccactgtccagggtcagcttcagccctaggattgc

SEQ ID NO: 6791668 - DNA, 62 bp, Homo sapiens
gggagtctgatgtcccccaggccaggaaacagaaccactgagtcaaaggatatcagatttct

SEQ ID NO: 6791669 - DNA, 101 bp, Homo sapiens
gcctctgcagctcagtgaagtagatagcatctgtttaatgagctcccacttcattacagagctgtactacttactgagtcattctccttaagcatgcaggc

SEQ ID NO: 6791670 - DNA, 76 bp, Homo sapiens
cctttacggcaatcaggatgactataaggctgcatttggagtgggctctttttagtacacttgactgcttacaggg

SEQ ID NO: 6791671 - DNA, 130 bp, Homo sapiens
cttaaacttttctctttaatccaaaaaagcaaattatcttgcttgggcatcacctgatcttctctctcccctgctcagaaagtcagtgtcatatcaagaagatgcttgagtctgattgaagtacaggtag

SEQ ID NO: 6791672 - DNA, 69 bp, Homo sapiens
ccctgtgtgcccatctgggatggggctgtgggtgttccttgatgtcctcacagatgggtgcatagcagg

SEQ ID NO: 6791673 - DNA, 103 bp, Homo sapiens
cgaacctctttattcttgcagccatctttcttggaggaaaaagtgaaaaaagatgtagcaaatcctgccagagaggtgctggcagtttagcttggcaggtttg

SEQ ID NO: 6791674 - DNA, 59 bp, Homo sapiens
gcagcattgtgaggtcctgcccagtgtggtaatgggcagttagcttgtcacagtcctgt

SEQ ID NO: 6791675 - DNA, 76 bp, Homo sapiens
acttgaaaaaatacctgagcctgtcttcttaaggaattactaaatatagagtttggaagtcaggcttttctcaagt

SEQ ID NO: 6791676 - DNA, 97 bp, Homo sapiens
gactcttgggaggggtttgctgggggaaagagacattgagaggcaagattaaatagctcagtgtttaccccaatcagtttactccctactctttgtc

SEQ ID NO: 6791677 - DNA, 67 bp, Homo sapiens
agaaagcttatttgtatgcatgttgtttcacaaactgcagggtgcagaacaaattaagacactttct

SEQ ID NO: 6791678 - DNA, 77 bp, Homo sapiens
agctgaggccaaagcccaggagacagccatgtgtgcgagctgcggaaactggaggtctcctggtattgaccccagct

SEQ ID NO: 6791679 - DNA, 57 bp, Homo sapiens
aatatgatgctaagcggtgacatgtactgaatatttgctgttgccaggtatcatgtt

SEQ ID NO: 6791680 - DNA, 55 bp, Homo sapiens
gagtgtggatcccagaagcagatcttttcccctctgcatttcgggaactcacctc

SEQ ID NO: 6791681 - DNA, 62 bp, Homo sapiens
caaggactctgctctgtatttcactgtattccttacagtgcttagcacagagtagacgcttg

SEQ ID NO: 6791682 - DNA, 107 bp, Homo sapiens
tcctcttctgttctgtttacagtgtctttgggcagcaattcttcagaatcatgaaatgaactgagcttaattgctgattttccccaaagttatggaggggaagagga

SEQ ID NO: 6791683 - DNA, 57 bp, Homo sapiens
ttccatattcccaattttgccacctgatcactttgaggtaaaatgtggagcttggaa

SEQ ID NO: 6791684 - DNA, 55 bp, Homo sapiens
ggagctgtagatcagctaatctcatccctttggggttctggtgagtataagctcc

SEQ ID NO: 6791685 - DNA, 77 bp, Homo sapiens
tgctggaaagtgaggtgaatgagcgagtgacttcccccataaattaaccctcaccgtgattctcttactctcacaca

SEQ ID NO: 6791686 - DNA, 92 bp, Homo sapiens
tgtgtactttatttatcttgaaactttttgggaacagctgtataacaggaagtagtatttctgaggcccaggaagtgagtaagggctacaca

SEQ ID NO: 6791687 - DNA, 87 bp, Homo sapiens
agaatatgagggaagaggcctgacattttcttgagaactgaaacctttcttttaagatggcttgcctttatcaccatccgaaattct

SEQ ID NO: 6791688 - DNA, 61 bp, Homo sapiens
acctcacaagtctctgtcagctctgaaaccccatggacctctgagagagagtgtgtcaggt

SEQ ID NO: 6791689 - DNA, 57 bp, Homo sapiens
actttgagaaaagcatgttttctgtgttaacctaggaatgtatgtttatctcacagt

SEQ ID NO: 6791690 - DNA, 73 bp, Homo sapiens
gagactacacctactccctaaactgtattgacttttggaagtcaaccatttagaagagtgtggttttggtttc

SEQ ID NO: 6791691 - DNA, 97 bp, Homo sapiens
tgggtcagatgaccttgttagcgacttgacagacatgtcctggatgctctttgttcccaggaggctctcaggtcctcccccagggtcctgtcactca

SEQ ID NO: 6791692 - DNA, 69 bp, Homo sapiens
agcttggtgcaaaagtgattgcggtttttgccattattttcaatggtgcaatcacttttgcaccaagct

SEQ ID NO: 6791693 - DNA, 80 bp, Homo sapiens
agtactgggattacaggtgggagtcactgtgcccagctaagggatagtttagaagattcactatcttgtagctcaatatt

SEQ ID NO: 6791694 - DNA, 129 bp, Homo sapiens
tcgcattctctcagagacactttgctcatgtacaccatttggcaagaaagagtcattggcatgtccttggatgaccccttgtctaagtggactttttggatggtactgttgatcaatgggggctttgta

SEQ ID NO: 6791695 - DNA, 66 bp, Homo sapiens
gcctatcggcctctcctaaccttggtcttgttttctggcaggcagaggtggaggagacactgaagc

SEQ ID NO: 6791696 - DNA, 60 bp, Homo sapiens
ggctggagtgcagtgacgtaatcacagctcaccgcagccttgacctcctgggctcaagcc

SEQ ID NO: 6791697 - DNA, 62 bp, Homo sapiens
ggccaggacctgctttgtaaaatagacataaatacattttatgcttacaaaatatcttggct

SEQ ID NO: 6791698 - DNA, 69 bp, Homo sapiens
tcacctgaggtgtcttagctgataaatgcccaagctagtctgtctgatgctgagacgcaacctcagtga

SEQ ID NO: 6791699 - DNA, 61 bp, Homo sapiens
tctctgtgtgttggctgtatatccttcctggaaattgcagagttacagcttcatatagaga

SEQ ID NO: 6791700 - DNA, 98 bp, Homo sapiens
gattttctttgggatttaaataattgctgctacattctggtttatcaggagaatttacgccatagccacagttatattgagacatccgttaggaaatc

SEQ ID NO: 6791701 - DNA, 83 bp, Homo sapiens
taagacatttactactaacatgctggttcaatgaaggtgttccccaatgcacatctttttggaaacggctgagtagatgcttg

SEQ ID NO: 6791702 - DNA, 57 bp, Homo sapiens
gctttgcaggaaaccagtgcatccgtgttcgagcggttttgggatcctctgccaagt

SEQ ID NO: 6791703 - DNA, 68 bp, Homo sapiens
gtgaggctggcgggtgggtgaaagacgtggggtggagctcctgatctggtacaggcctgcagcctcac

SEQ ID NO: 6791704 - DNA, 76 bp, Homo sapiens
ggcgaagctaaacctagtggtaaaattagatggacacataattctgagtgtttactcaaagggttccagtactgct

SEQ ID NO: 6791705 - DNA, 74 bp, Homo sapiens
gccaaagctgggcttcctacctttcttctagatctttggaggagccctgggttagggtgggagcagttttaggc

SEQ ID NO: 6791706 - DNA, 79 bp, Homo sapiens
ccacgttgttgtgtgtagcaggagcagttcactgtttttcatcgctgcttattgttccatgttatatcacgatttttgg

SEQ ID NO: 6791707 - DNA, 56 bp, Homo sapiens
aaaaccagaagcactctgcagctacctgtgagttagcccattgtgcttgtggtttt

SEQ ID NO: 6791708 - DNA, 64 bp, Homo sapiens
ctgaggagggagaattaggcttaatataatgtcaaaatattatttctattactcttcttcttgg

SEQ ID NO: 6791709 - DNA, 60 bp, Homo sapiens
gtggggagcaattgcccccttagataggcacagcttctctaggtctttgtagttccccat

SEQ ID NO: 6791710 - DNA, 68 bp, Homo sapiens
ctctaggatttaaatccttaaccactattctatactatttgagccagttagagtttttaggtcctgag

SEQ ID NO: 6791711 - DNA, 80 bp, Homo sapiens
gctatggatccgagagccccacctgtgcgtctgccgcagaggttggctgcagcccaggcgtcaggtggtttggacatagt

SEQ ID NO: 6791712 - DNA, 58 bp, Homo sapiens
gacatcatagggtgggaggaaaggttgggttttctcactttctcctgtcttaaatgtt

SEQ ID NO: 6791713 - DNA, 94 bp, Homo sapiens
cctgtgccgccctcctggtggccttgtgatttcactggtgacatgtttggaaagcccacgcagtgctgagagatggcagggccttcagagcagg

SEQ ID NO: 6791714 - DNA, 62 bp, Homo sapiens
gagttcaggaagtctcagctgggaagagagagaaattttcctaagagttcttcctgaatctt

SEQ ID NO: 6791715 - DNA, 76 bp, Homo sapiens
ggctagaagaacttataggaatgtcataatgtgctgtaggggacagtgatacttttaaaggttctgacattcagcc

SEQ ID NO: 6791716 - DNA, 64 bp, Homo sapiens
gggggcagcggaggacagatgggagctcctgttaggagccacgtttcctcggctgggaacccct

SEQ ID NO: 6791717 - DNA, 102 bp, Homo sapiens
ttgagacagagtctcgctctgtcactaggctggagtgcagtggcgtgatctcggctcactgcaacctccgccttccgggttcaagcgattctcctgtctcag

SEQ ID NO: 6791718 - DNA, 64 bp, Homo sapiens
ggccgcaggtgtggtgggaagggtgttccaggagaaggagccacctggacacaggcttgcagtc

SEQ ID NO: 6791719 - DNA, 65 bp, Homo sapiens
gctttacccgtctttatcccttattccagcaaaaactagagttggaagtggcagggagacaaagc

SEQ ID NO: 6791720 - DNA, 65 bp, Homo sapiens
gagaataggacggctgcaatattggtccttgagatcaaattgaagattgcagttggacctgtctc

SEQ ID NO: 6791721 - DNA, 59 bp, Homo sapiens
gggaaggagcacaggactttgattatcataagatgtgaaaatactactgtcttcttccc

SEQ ID NO: 6791722 - DNA, 129 bp, Homo sapiens
agtatctgtgccttggacttttccatgcttgccctgcacctggactaactaactcagtagcttctgctcagataagatacgttttccagggcagaacatcatgaccaagaattctagaagccatagttt

SEQ ID NO: 6791723 - DNA, 124 bp, Homo sapiens
cgtgcctcagcccgggacaaggggggaggcggcggccgagcccggagaggagctcttcaggcaggagcccagcctgggctcggaggagcagctggagcttccgctttcccgggaaacgggctcg

SEQ ID NO: 6791724 - DNA, 56 bp, Homo sapiens
ccttccagggcagggtgcgcatgggcagcccctccttcctgtcttgtcctggaggg

SEQ ID NO: 6791725 - DNA, 100 bp, Homo sapiens
gccagaaaaggccacttcaaaagctctggttggccctggaaatctcctcccaccccacctttcagcccttcctggagcttttaatgagcctttccatggc

SEQ ID NO: 6791726 - DNA, 57 bp, Homo sapiens
gaattagtcacctgtggactactctgtcacgcattggcaggtcttcatgtggctgtc

SEQ ID NO: 6791727 - DNA, 61 bp, Homo sapiens
gctttcagcctacagggttgtctgtaacaacttctcaacaatgctgtcttagcatgaaagc

SEQ ID NO: 6791728 - DNA, 108 bp, Homo sapiens
tcctttgttcggtttctctaatgctcctttttctgccttgggctgtgttgctagcacagcagggctctgtggagggtggctgtgagttagggaaagcctgagaagggg

SEQ ID NO: 6791729 - DNA, 73 bp, Homo sapiens
ctctcagtcctgcgcgcctctgtgggccaagacacacccacagaaatgcagcatgaggcggcaggcctgaggg

SEQ ID NO: 6791730 - DNA, 91 bp, Homo sapiens
cagagaagagcctcctggaggagagcctgcactttgaccatgctgtccggatgggtgcagtgctcttttctgcaaagtgttcacttctctg

SEQ ID NO: 6791731 - DNA, 119 bp, Homo sapiens
ggttctgtctactgggctctgcagcttggacgctcctaagaccaagcgacccaccctggggagggcagctatggctttggaatagctgtccaggcccgggtgcctccaagacggccacc

SEQ ID NO: 6791732 - DNA, 72 bp, Homo sapiens
caagtgtactatatattctattgtacctctccttaaaagctcagcaaaggagagagaaagaataaacacttg

SEQ ID NO: 6791733 - DNA, 80 bp, Homo sapiens
gcctagtgggtagggacttagctggctgaataagctaagtttagcctataagggttgagtttctttcatatttgctaggc

SEQ ID NO: 6791734 - DNA, 74 bp, Homo sapiens
catgcacagcgtctgcctgagtccctccacagtgccccctgtatttggacaccaagtagaagtgactgaacatg

SEQ ID NO: 6791735 - DNA, 77 bp, Homo sapiens
ttgtttgatttttgagacagagtttcactcttgtcacccaggctggagtgcaacctctgcctcctgggttcaagcaa

SEQ ID NO: 6791736 - DNA, 88 bp, Homo sapiens
tgatttggtagtctcagtaattaatgcttttgtgattacgttaagtatttgtgactaaacgcatgaatagctcaactgaccaaaatca

SEQ ID NO: 6791737 - DNA, 55 bp, Homo sapiens
cttctgtggctggagaacttgtctaactacacgagacagacaagcagccgcaaag

SEQ ID NO: 6791738 - DNA, 80 bp, Homo sapiens
ccccaggtccctgtcccccaggcctgtaccagggtctgagcccagcactggtacaagggttgggagacagggccatgggg

SEQ ID NO: 6791739 - DNA, 57 bp, Homo sapiens
ttgatttgtaggaatggagaccttgcatgcaggtcttttacagtcctaccaaaacaa

SEQ ID NO: 6791740 - DNA, 63 bp, Homo sapiens
gcaaggatctgttgtggggccagtgtgccatgacacccttggcagcaccagcagtgtccttgc

SEQ ID NO: 6791741 - DNA, 55 bp, Homo sapiens
ggtagtagaaggtatgctttaatggaagaactatataaagacataagctactatc

SEQ ID NO: 6791742 - DNA, 58 bp, Homo sapiens
actggtcttgggaagcaggcagtttaatgaacaactcttttgatttcacaaggccagt

SEQ ID NO: 6791743 - DNA, 92 bp, Homo sapiens
aagtttctcctgggtcctgagaagactgtttctttgacctttgactttaaggagttcgttttcttagaatccaggctccatttaagttactt

SEQ ID NO: 6791744 - DNA, 117 bp, Homo sapiens
gtatatttagacaaacttctcatttctctgcagtgttcggaattcatcatgcctgtatgacaaggttgtgtttgagaacaaaaggggacctgtgtgacatgttttatttcaatatac

SEQ ID NO: 6791745 - DNA, 80 bp, Homo sapiens
aataaccacaaaattgtgtgtgtgcatgtgtgtgtgtgtgtgtgtgtgtgtgtgtgtttacagtttctcatgtggctatt

SEQ ID NO: 6791746 - DNA, 71 bp, Homo sapiens
tgactagaattgtatttagtgtatatatgagctattgtgatatgaaaagtttaaatacctggttttagtca

SEQ ID NO: 6791747 - DNA, 57 bp, Homo sapiens
gctgtgctcacatgtttcaaggataaggataattccattgagaatctgggctacagc

SEQ ID NO: 6791748 - DNA, 76 bp, Homo sapiens
ctacgtctggcctttttagcttgtggaacttatcatccccgccatccagtaaaggctacaaaggccccgagactag

SEQ ID NO: 6791749 - DNA, 100 bp, Homo sapiens
atgtacaatatgttgcaagattatcttcttcttgttaggattctgaatttaattgattcatgcaataaaaagggaatatggttttgtggcactcaaacat

SEQ ID NO: 6791750 - DNA, 108 bp, Homo sapiens
gggcattccaggtaaaggactagtctgtacaaaggctatttggaggctaaagggaatatgtggcctttgggagagtgtacatggttcaatatggctggaatttggctt

SEQ ID NO: 6791751 - DNA, 57 bp, Homo sapiens
caaggctttctcattatcctttaggctacagagaaacaaggagacgggagagccttg

SEQ ID NO: 6791752 - DNA, 72 bp, Homo sapiens
ggaaatgttttctgtctgtagtaactattcacattcaggattatgtatttttacaaggaggatagcatttcc

SEQ ID NO: 6791753 - DNA, 129 bp, Homo sapiens
catgaaaaatcataatcattgctgttcgaagctgctaagttttggggttgttacgcagcaagtgatagctgatacactccctaaaatatattctttgcataacagtgagtactcttgttaaaatgcatg

SEQ ID NO: 6791754 - DNA, 91 bp, Homo sapiens
gtggaaggaaggactggccttggagacaggacaggcagaatgggctggacaatgcccattagatgactccacgtcagttttccccttctac

SEQ ID NO: 6791755 - DNA, 108 bp, Homo sapiens
gcaatgagaatgctagcctggcagtggtgaagaagaggcctcagatatgtgagactgagaattcctcaatttacttcccactgttcagcagagagcacccttctgtgc

SEQ ID NO: 6791756 - DNA, 55 bp, Homo sapiens
gaatatatatctccactgttacacttctttgtgttgcagtgatttgtctatgttt

SEQ ID NO: 6791757 - DNA, 130 bp, Homo sapiens
tttgaaactttttgctaaaattctcttgtgctgacttgtaaaatatccagttaaggtggtactgtaaattcacgttttgccttctgccttactgtatatacagaatagccaaagaataacgtataacaaa

SEQ ID NO: 6791758 - DNA, 66 bp, Homo sapiens
gtttagtgtgtccctggggagtgttggggcgacggttacaggctgtttatggtgacaccactagac

SEQ ID NO: 6791759 - DNA, 55 bp, Homo sapiens
acatgtttgataaatatttgggagtgtttattaacttcatatttatcgtatatgt

SEQ ID NO: 6791760 - DNA, 58 bp, Homo sapiens
tttttaagcctcttggttattaaattactttgcagataactgagccgaggcttaagaa

SEQ ID NO: 6791761 - DNA, 61 bp, Homo sapiens
gtcacaatatagtctgcagagatcttggctatcttgacattctacagactataactgtgat

SEQ ID NO: 6791762 - DNA, 130 bp, Homo sapiens
cctcgtggttcccttgccaggaacaatgtatgtgttttgtggagtctgtcttacccaaggccagatgcccttggctgaactccaggatgcatcctgatcctgtttacaggcgaggaaggaccaagtctgg

SEQ ID NO: 6791763 - DNA, 79 bp, Homo sapiens
aaaccttatcagtctgttggaatatcgctgcaaaaccatgttttgaacgggtgtgttctgtcagactgattggaggttt

SEQ ID NO: 6791764 - DNA, 87 bp, Homo sapiens
gttaagagggaaatgctttatccaataacaaaatcttttgaaaacttcaaaaatgttttatattggtaggtaggaattcctcattgc

SEQ ID NO: 6791765 - DNA, 56 bp, Homo sapiens
ttacctgagcggatttgttgcagggtccagactgcaagaacctagcgatcaggtaa

SEQ ID NO: 6791766 - DNA, 59 bp, Homo sapiens
tagattgggtctgttattatgggctagtgtatagtataagtaatatacagacccatctg

SEQ ID NO: 6791767 - DNA, 72 bp, Homo sapiens
gtacagggctgtgatccttgagagaaggtaaatcagtaatgtgggccctaaaatgatctcagctttctgtac

SEQ ID NO: 6791768 - DNA, 77 bp, Homo sapiens
tcaagtgtcaatcagctgtggtaatttggaaccatagttcatacatttttactaacagctgaggatttgatatttgg

SEQ ID NO: 6791769 - DNA, 65 bp, Homo sapiens
ctgtgaaggcagcagctctgtccatgttgtttactgtagggctgaacactgaccttgagacatag

SEQ ID NO: 6791770 - DNA, 62 bp, Homo sapiens
caggtggcccgtacccagcctcttaacacccatgaactagaggccagctagcgggccatctg

SEQ ID NO: 6791771 - DNA, 55 bp, Homo sapiens
ggtatggtcaggggcacaaagcccacactaatcgctcactgacccttgaccagcc

SEQ ID NO: 6791772 - DNA, 69 bp, Homo sapiens
tttgtcctctccatgtacaatagctgtggctcaacccactgtgatcaatgtttatggaaaagagacaaa

SEQ ID NO: 6791773 - DNA, 70 bp, Homo sapiens
acataggacatgtgttttatatatgtgaaaatgtatacacatacatatatgaaatgcatgttttctatgt

SEQ ID NO: 6791774 - DNA, 64 bp, Homo sapiens
tcctagccagggagacactgtggagctcagtggaactagctcctcagaacagccttggctggga

SEQ ID NO: 6791775 - DNA, 64 bp, Homo sapiens
atgagatttggtgggggcaggggtagaatgatatggtttggctgtgtccccaccaaaatttcat

SEQ ID NO: 6791776 - DNA, 55 bp, Homo sapiens
cttgagcagctctttgaggatggtgatgtttatctccttcttcttggcagccaag

SEQ ID NO: 6791777 - DNA, 63 bp, Homo sapiens
aatcctagaacaggcagtggttcatagctctgttggtccagttgtcctgtgtctgtttggatt

SEQ ID NO: 6791778 - DNA, 56 bp, Homo sapiens
ttccatattggaaggcacaggcctagagcaatgcctggcacacagttgacatggaa

SEQ ID NO: 6791779 - DNA, 58 bp, Homo sapiens
cttcagccattgtggcttttgtgttgtataagtgttgcagatgcagagatggctgggg

SEQ ID NO: 6791780 - DNA, 87 bp, Homo sapiens
ttctcaggcagggttttcttaactcttcatagaacagaaacgttctctcttgaagattgaagacaaaggtaaacacttgcctgggaa

SEQ ID NO: 6791781 - DNA, 76 bp, Homo sapiens
ggaaggcgggtctgagtagagggctggcgactgatgatcattggaggacttggcaacccctctccactccccttcc

SEQ ID NO: 6791782 - DNA, 59 bp, Homo sapiens
ctggtccaagtgaggtggcctctgggaacattcttaagacctacatgtcattggagcag

SEQ ID NO: 6791783 - DNA, 57 bp, Homo sapiens
gctctgatgccagccgcttcctcttggtctagagccaaggaagccctgggtcagagc

SEQ ID NO: 6791784 - DNA, 81 bp, Homo sapiens
ttatgaagcaacatccatttgtcagctcttgagtcattacttttgacatcaagcaaagatacaaatggaaggcgaacataa

SEQ ID NO: 6791785 - DNA, 77 bp, Homo sapiens
gttattttgcttggtgcttaatcttgttaaataaggaagaaatttccacaaggtttggtaccacatccaaaaccaac

SEQ ID NO: 6791786 - DNA, 100 bp, Homo sapiens
gaataatgatcacagtaaatcagacctcattatgtgcaggagagccgggcagcccaactggctaggtaatgaggtctaatttaatgccctggtattattc

SEQ ID NO: 6791787 - DNA, 76 bp, Homo sapiens
ctgtctagaatttatttttgtgtgtggaataaaaatgtgatcacatgtatttcttttacattaagatttcagacag

SEQ ID NO: 6791788 - DNA, 77 bp, Homo sapiens
tgttactgagggcactgggtcttcttttgaacatatctttatcagaccaaaggaagatgccaggactctgtgtggca

SEQ ID NO: 6791789 - DNA, 105 bp, Homo sapiens
cttaaatatcaccgattgtaagacaaagtagcttgggctgtgagtcagacagcctggtttccagtccaggttctttctctaaatagctgagtgaacttatttaag

SEQ ID NO: 6791790 - DNA, 86 bp, Homo sapiens
gtggactatcttggagaatgtttcatgtgtatgttagaagaatatgtattctgctgctttaggtggaatgttctatagatgtctat

SEQ ID NO: 6791791 - DNA, 59 bp, Homo sapiens
gcaaagctgtagggctgagctggaccggattccctggtgccttgggcctacagcgctgc

SEQ ID NO: 6791792 - DNA, 69 bp, Homo sapiens
tctcacaccttttagaattactattatcaaaaagatgaaagataataactgtcggcaagggtgtggtga

SEQ ID NO: 6791793 - DNA, 72 bp, Homo sapiens
ctacagccaacaagaagggaaggcatgatttgtggtttgcagaatgcattttctatcttgtactggtcatag

SEQ ID NO: 6791794 - DNA, 78 bp, Homo sapiens
agccctgatttggaaagagatactactgcggagttttcagctctagctccccttcctggagtgtcttccccaagggct

SEQ ID NO: 6791795 - DNA, 66 bp, Homo sapiens
gatgtacaatcttggtccctttattatggacggcaataaaattcacagtaaccaaggcagtacatt

SEQ ID NO: 6791796 - DNA, 108 bp, Homo sapiens
gaagttgtttacatgtttgacaagtttgacagaagtttctaatgtttaagttctcatacattgataatggaatgttaaactgtaatttcaaaaatatgtctttatttc

SEQ ID NO: 6791797 - DNA, 56 bp, Homo sapiens
aattaatttggtttggaggcactgtgttaatggtggcagccagacgggattcagtt

SEQ ID NO: 6791798 - DNA, 62 bp, Homo sapiens
gcaattaaagaagacctgcctcaaacattttctgtgtgacctgaggcaagtccttttatagc

SEQ ID NO: 6791799 - DNA, 79 bp, Homo sapiens
ctgatctgcagtgcagccaccctcaaggctgaatccttaagtgaaggaccaagccaggcttcagggtgactgtgatcag

SEQ ID NO: 6791800 - DNA, 65 bp, Homo sapiens
cattgagtgtattacagaactgacatttcaactactagtgtacagtttgtagtactacaaaagtg

SEQ ID NO: 6791801 - DNA, 57 bp, Homo sapiens
attctgaagcagaaaaggcagagaatgaggacagaacagctctgccagttttagaat

SEQ ID NO: 6791802 - DNA, 90 bp, Homo sapiens
atgttcagttgcaggtggggaagtatgaacggaaggcctgggaatctcttccattagaccactggggtgccccttcctgtagctcaacat

SEQ ID NO: 6791803 - DNA, 62 bp, Homo sapiens
gttgcctttgacggtgcagcagtactttcttctcttttgtactctgcaatatcacaaggaat

SEQ ID NO: 6791804 - DNA, 55 bp, Homo sapiens
gaaaactgtgcttgatttcagagcacgactctaaatccacggtatagttggattc

SEQ ID NO: 6791805 - DNA, 86 bp, Homo sapiens
gtggttcaatcagaataaagtattccccaagtattctggatccctaaggaccagtgcttccaggaatacggtactgatgattccat

SEQ ID NO: 6791806 - DNA, 69 bp, Homo sapiens
agtgctccaggagccctgccacaatggtttctttgtgagatcatctttgcagcggtttcctgaagctct

SEQ ID NO: 6791807 - DNA, 57 bp, Homo sapiens
ctgtgcctgcaggccacatcaaaggacgccctgaatgtggcacagatgcaggagcag

SEQ ID NO: 6791808 - DNA, 86 bp, Homo sapiens
ttcactttatatttagcacttgctttaccatttgatctctagagtccactggaggtattgaggagagtcaggttggacaaagtgga

SEQ ID NO: 6791809 - DNA, 71 bp, Homo sapiens
tggatatgacttttctttacctgaatatgtttttctctggggcaagtttttggtagagaaaagtagggcta

SEQ ID NO: 6791810 - DNA, 79 bp, Homo sapiens
agcctgctgtagtgagcaaaggttaaacatttactatttttcagtcttgtgtttattttgtatacgtaagtatttggct

SEQ ID NO: 6791811 - DNA, 57 bp, Homo sapiens
ggaaagactgtaggattttgaattagaaagacttgaattcaaatcttcagtctttct

SEQ ID NO: 6791812 - DNA, 57 bp, Homo sapiens
gacagcttctatgtgacgagcactttcagtgtgacaggctctgaaccaagagctgtc

SEQ ID NO: 6791813 - DNA, 85 bp, Homo sapiens
ggccgaggcaggaggcttggctggcagccctgggggctccttcacctccacgggctcccctggccctgcagcccctcctctggcc

SEQ ID NO: 6791814 - DNA, 60 bp, Homo sapiens
gtaatgagtgtgcgtagagctgggccctgtacaaaacccagaaggagccacactccttgc

SEQ ID NO: 6791815 - DNA, 90 bp, Homo sapiens
gtacacactattatcgcagttggagtagaataaaggagcgacatggtctataatcctatttcaactgcttcctagattttggctttgtat

SEQ ID NO: 6791816 - DNA, 125 bp, Homo sapiens
aataaacttatttgggaagtttgcaaacatggagatgtcttgggctctagagtttctgacttagtaagtctggagtagagcctagaaatctgaatttttataaaatttcctaaagttattctgtt

SEQ ID NO: 6791817 - DNA, 130 bp, Homo sapiens
ggtgtaacacagggggctgcacatgtttactaaagtgggtttgaaatgctttcacctgtttgcacccatgaagccatctcagagtcaagacggtaaacatatctgacacctccccaaatgtcgttgtgct

SEQ ID NO: 6791818 - DNA, 80 bp, Homo sapiens
tttgttgctattccagtttatatgagggtatcaaggctacagttttatgttcttggcatataaaagatgataaaaataaa

SEQ ID NO: 6791819 - DNA, 88 bp, Homo sapiens
ctctaaggtctcttaagattgtcagcttcagcctcaagcttgaaggaggctggagatggagactggtcttgaaaagagtccaggagag

SEQ ID NO: 6791820 - DNA, 102 bp, Homo sapiens
ttgcactctgttactgctggaagtcatggttagtgatattaatttattcagtgggctgagttctgtgacaatatcattaccagggagtaattaagggtggga

SEQ ID NO: 6791821 - DNA, 77 bp, Homo sapiens
agtgctccggacctggctgactcatggggctccctcgaaccccttacttgtggccagccccatggacagttcccact

SEQ ID NO: 6791822 - DNA, 67 bp, Homo sapiens
ttaggagagcagtggggtcctcagtatggttcctttaggcagctctgctgaccccaccctttcctga

SEQ ID NO: 6791823 - DNA, 63 bp, Homo sapiens
gcagatatgcaacatctggtagaaatccctcggattctcttggatgtaggcataggcttttgc

SEQ ID NO: 6791824 - DNA, 70 bp, Homo sapiens
ctgttttggtttctgcttctcagcttctgaatgtcacccaccaagaagctgtgagctggatgctccacag

SEQ ID NO: 6791825 - DNA, 62 bp, Homo sapiens
ctagaaagcagcttccctggctcctggtgcatcacatgaggagtggcagggctgctccctag

SEQ ID NO: 6791826 - DNA, 59 bp, Homo sapiens
tcatctctctctatgcgttgttcctacttgacagggatgggaactatggtagaggatga

SEQ ID NO: 6791827 - DNA, 69 bp, Homo sapiens
gctggctgacaagacctgatcacttgtttgcgggcataatgatgggtgtcaggctggttgttgggcagt

SEQ ID NO: 6791828 - DNA, 80 bp, Homo sapiens
ggtgcacatctgtttttgttgattgcatggaatctgctgaaatattcttgaaagtacaactagaaataggtgtaaaaacc

SEQ ID NO: 6791829 - DNA, 60 bp, Homo sapiens
gcttgagtcatagattccacaatgaatcttcatagaaatatatggaatgtatgattttgc

SEQ ID NO: 6791830 - DNA, 69 bp, Homo sapiens
gtactttataaggtatgaaaagtaaatgggatttgcaatcaccatttctgcaatgtacctttgggctgc

SEQ ID NO: 6791831 - DNA, 86 bp, Homo sapiens
ctcctgcctggctccctctccctgagtcagacacagatctgcctatttggccagactgagtcaggagaggatgggggccatgtgag

SEQ ID NO: 6791832 - DNA, 65 bp, Homo sapiens
gctcctaattcctgtgcctcaggtctcagccttagttgtggttcagcctcaggacaggatggagc

SEQ ID NO: 6791833 - DNA, 85 bp, Homo sapiens
aaagagcctgattctcttcatatggcaaaggcacatattcgtatttatgaatcttaccatttggggcagagcttcagggctcttt

SEQ ID NO: 6791834 - DNA, 65 bp, Homo sapiens
attctcattagagcagtgtattatgatacgactgtcccagtctatttaggctgctgtaatagagt

SEQ ID NO: 6791835 - DNA, 69 bp, Homo sapiens
ttctcattgcaatctggtgaaaacagtttgagagttgcctctgctggtcttcaccagatgcaaaaagaa

SEQ ID NO: 6791836 - DNA, 55 bp, Homo sapiens
catcagagttaacatcatgactatctggacagacagcatcatgtgactgctgatg

SEQ ID NO: 6791837 - DNA, 65 bp, Homo sapiens
gcagagcagggagaggaggctgggtgccaggtccgcagcttggctgccagctcctcgccttgtgc

SEQ ID NO: 6791838 - DNA, 65 bp, Homo sapiens
tcctcaaggagacagaaagcaatggaccttagattctgcgccagctgctctcttctccgccaggg

SEQ ID NO: 6791839 - DNA, 71 bp, Homo sapiens
gaagtgtgcattgcatgttgtttgatctattcttaaggtagtttatgattttatgtaagtatgtagacttc

SEQ ID NO: 6791840 - DNA, 71 bp, Homo sapiens
tttgttcattgtgagattttggccttcctaagaccaggtttgagagcccaaaatttagcaagacaggcaaa

SEQ ID NO: 6791841 - DNA, 71 bp, Homo sapiens
tgcttccttgtagatataatctaaaattgttcagcagagcaaatgggtttatatttgacaactagggagca

SEQ ID NO: 6791842 - DNA, 75 bp, Homo sapiens
tctctgcagaggcagggtgggaaccttcccgcagacacatctgcagagcctccctcctctgccattctggggaga

SEQ ID NO: 6791843 - DNA, 66 bp, Homo sapiens
tgttatttttaaaccttgggcacgtattactattaaagaaaaactggcctaggggttgggaaagca

SEQ ID NO: 6791844 - DNA, 58 bp, Homo sapiens
ccttcctcaccctctctgcttcccactgggggagccctggcatgagatgtgagggagg

SEQ ID NO: 6791845 - DNA, 68 bp, Homo sapiens
gagaatgtgttatgttactaaaggtgtagtggcaaaagccagctggtccttcaatctagcataatttc

SEQ ID NO: 6791846 - DNA, 73 bp, Homo sapiens
ggctgaggggacaaggcatggctcggagtcagaacagtctctgtctgaaccctggccctgcctcctgacagct

SEQ ID NO: 6791847 - DNA, 62 bp, Homo sapiens
gttaggagtggagcaagatgaaaattccagtttctttcactctaaacagtttcactcttaat

SEQ ID NO: 6791848 - DNA, 98 bp, Homo sapiens
actttagtctgaaacatttactgctactattacattttgcaattacagtgaagtgaggcagaaaatagcagttcaaaaatgtattcaagtaatgaagt

SEQ ID NO: 6791849 - DNA, 77 bp, Homo sapiens
cctcagcaaaggtctctagaaattcagccaggcagagccatttttaattggttggggatttgaggaaaccgcggagg

SEQ ID NO: 6791850 - DNA, 65 bp, Homo sapiens
ttgtctgaaggcctgacctacattgcccctaggatataggaagaaggacaaggcatttcagagaa

SEQ ID NO: 6791851 - DNA, 61 bp, Homo sapiens
atctggagctctgcacacctggcccaaaatacacttgagcaggtgatgttgactttaagat

SEQ ID NO: 6791852 - DNA, 75 bp, Homo sapiens
cctccaggagtgtgattcagagacagcctgagacataagcaaaatactcaacagtctaaattatacccttttagg

SEQ ID NO: 6791853 - DNA, 63 bp, Homo sapiens
gtgagccctggcccggctgtgctttggagccaaccactagagccaggccaggccggggcacac

SEQ ID NO: 6791854 - DNA, 73 bp, Homo sapiens
tctgatcactgtggaattagaataaccttttgtgaatatcagcctagagagtattccctttcatggtgacaga

SEQ ID NO: 6791855 - DNA, 128 bp, Homo sapiens
cagaagcctcagagggacgcctgtgactgtgcctgtaaggtttaacgccctgtctcggatgatcatccgggcctacagaggtataaactgcactgtccaatatggtagcccccattcacaggctgctg

SEQ ID NO: 6791856 - DNA, 64 bp, Homo sapiens
gaaacctgggatatataagtttcagccttcaacactccactgacattaagtttcccagggtttc

SEQ ID NO: 6791857 - DNA, 91 bp, Homo sapiens
gctttgcatttaaattggctcagcatcttggtgccagtggaatttaccaggctggtgagagctcagctcagatttctcaatgcttcacagc

SEQ ID NO: 6791858 - DNA, 82 bp, Homo sapiens
ggaataagtgagaaaacgcgtgcagtgcttagcacagtgcctgccacacagtaagcatttcacgcacactcattactattcc

SEQ ID NO: 6791859 - DNA, 65 bp, Homo sapiens
ttcctgtgtcttctgttttgaagttattttattgtgaaaaactaaatacacagaagcacagagaa

SEQ ID NO: 6791860 - DNA, 83 bp, Homo sapiens
ggaggcctgccctggaggtgctcagctccatctctgctgtccaggctgtgagcaagaacacctaaggaaagccagcagcctcc

SEQ ID NO: 6791861 - DNA, 71 bp, Homo sapiens
caattacttagcaaggctgcctggagaatcatgtctaccttagcttacttctccggctttgtaggtttttg

SEQ ID NO: 6791862 - DNA, 82 bp, Homo sapiens
gagttaggaaatacatttgcctgctattgacaaattccaaaagtaataatggttaaaattaggtagaagttattttcttctc

SEQ ID NO: 6791863 - DNA, 55 bp, Homo sapiens
tccctgtcctgggcaatcccagcaacacaccctctgggagcagcccccttgggga

SEQ ID NO: 6791864 - DNA, 73 bp, Homo sapiens
agggcccatgtgaggaggcccaggttggggctgtgaggaggaagagccccccaagggccttctcttggattct

SEQ ID NO: 6791865 - DNA, 71 bp, Homo sapiens
agttcttcagcctcaaatagtacttcactgggtgttttcaggaacctacatctgtttggggaggaattgct

SEQ ID NO: 6791866 - DNA, 72 bp, Homo sapiens
ggcattgtaaaggattcatagagaattgcttgctttcattctaaaaattgcctttgaattgtttataatgcc

SEQ ID NO: 6791867 - DNA, 76 bp, Homo sapiens
gaggcgcaacgcttaccctcgtggaccaacaatcgaattaacatgctgatacacacatggggtgagtgacgccctc

SEQ ID NO: 6791868 - DNA, 76 bp, Homo sapiens
tttagttctctatcatgcatggtactcttgtgcatctactatgtagaaggaaatgtgtatggtattggaagctaaa

SEQ ID NO: 6791869 - DNA, 58 bp, Homo sapiens
gcggtgtgggtgtgcacgcatgtacataacatgtgcctgtgtatgtgcatgcacacgt

SEQ ID NO: 6791870 - DNA, 97 bp, Homo sapiens
catgtgatcaaaattttgtattggaaacgaaatcactccatcctaaggcttgcagtgattggctttcacaaaagcatattttgatagtttttacatg

SEQ ID NO: 6791871 - DNA, 93 bp, Homo sapiens
gggaggcaggtgtgcggtgagttgggggattagaagctcccagggctcttccgtcagctgctgggaccccagatccactgtgactttccttcc

SEQ ID NO: 6791872 - DNA, 97 bp, Homo sapiens
ggaggtggcatcagatgggcacagaagtggtgggcaggactaggccacaggtttgtaaagctttgagtgtttatcctaaaagtgatgaggagccttc

SEQ ID NO: 6791873 - DNA, 68 bp, Homo sapiens
ggactcctggggctcatactccagcccaatcatgaggatttcagcccagtatgagcccccagagtgcc

SEQ ID NO: 6791874 - DNA, 70 bp, Homo sapiens
cccaccgtcattccagaggggattcccggccgccgctggggccgcggattttcccgctggctacgtaggg

SEQ ID NO: 6791875 - DNA, 86 bp, Homo sapiens
ggcttcaggagcgtgtcctggtgctccaggtggctgcggaagatctcctgggccagctgggccaccaggtgcttgctgtagaggtc

SEQ ID NO: 6791876 - DNA, 76 bp, Homo sapiens
tgtgggcaaagcttcaggttctgttttgcaggatgcacaatgccttccccaagtaaagatcctgagatgtcctaca

SEQ ID NO: 6791877 - DNA, 80 bp, Homo sapiens
ctcaagtgccctgggccttcagggccaggatacccccatccctcaccatggcccctggaggccatacagagccgcctgag

SEQ ID NO: 6791878 - DNA, 63 bp, Homo sapiens
agaccaaactacatgagtatgcccagaaacagagtggctggctcagcttacttttgagggtct

SEQ ID NO: 6791879 - DNA, 55 bp, Homo sapiens
gttgcacaattccatgggacagccctgtgaacagggtcccccggagttgggcaac

SEQ ID NO: 6791880 - DNA, 70 bp, Homo sapiens
cagaattgatttcttactcttccaaggtctgtacattatgacagcatgggaattacaggaatcatttctg

SEQ ID NO: 6791881 - DNA, 74 bp, Homo sapiens
agccttaaacatgatgacattgtaagcttcttacagcagtgtaattgaggcatggagataatgtcttcaaggtt

SEQ ID NO: 6791882 - DNA, 60 bp, Homo sapiens
ctctgcacctacacaacaggaagtcccacatgctgggttctagttgtcccaggttcatag

SEQ ID NO: 6791883 - DNA, 114 bp, Homo sapiens
tgctgatggatttcaagcagacagcaagacaaggaacaaactgtggtgattagcattgtcagagcagttttgaagtgcttgttttgtacttttctttatcggtcctaatcagca

SEQ ID NO: 6791884 - DNA, 69 bp, Homo sapiens
tcgatgccaggccagtcgtggcattaactcctggcaaagtatccgatgccaggctggccatggtattga

SEQ ID NO: 6791885 - DNA, 101 bp, Homo sapiens
ccttcttttcctctaccagtaatcttaacactggcgggattgctaataacagcaatggaatgaatagcagggcccactaggggagattactgagaagaagg

SEQ ID NO: 6791886 - DNA, 121 bp, Homo sapiens
cccacaccatgtccctgcccagccttctctactcctgatgcatgtcccccatggaaaggatgttctgtgcacgcaggaggcaatgagggagggtgaggcagcccagaacccatggtgtggg

SEQ ID NO: 6791887 - DNA, 68 bp, Homo sapiens
cgtgaaacagtggttaagtggactgggttcatgaagatttagctatggataacaaccaccgtgacatg

SEQ ID NO: 6791888 - DNA, 57 bp, Homo sapiens
gaaaatgaggaacggatcatggctccctccacctggctttttccagtcttcattgtc

SEQ ID NO: 6791889 - DNA, 61 bp, Homo sapiens
gcagaaatatcttaggagtatatgagggagtaaccattcagctttccaaaaagatgtctgt

SEQ ID NO: 6791890 - DNA, 127 bp, Homo sapiens
tttataaaattccttatactaagacatttctttccaaatcataactagagtgaaatgttgaaattttaattgttacatcaagttataaggaagggtattctatagactttcagagggattgtatcaa

SEQ ID NO: 6791891 - DNA, 72 bp, Homo sapiens
gtgtgttggtttgtcagcctcttgcttatcaccttctggtcacaagatggctgctgcagcccccaacatcac

SEQ ID NO: 6791892 - DNA, 129 bp, Homo sapiens
gagtgtgccttgggatcacctgaagggcttgtcagatgcacgttgctgagtttctggatcattaagtcttgggtagtactcaagaatttgcattttcaataagttcccagatggtgctagggcaaactt

SEQ ID NO: 6791893 - DNA, 78 bp, Homo sapiens
tggatgtgtgtgctgggagatagagggaggtggcaacaggattctccttgctacccagtatgtcactgctcacatcca

SEQ ID NO: 6791894 - DNA, 72 bp, Homo sapiens
gattgtgcatattcaaggtgtacaatgtgacaattttatatgtgtatacattgtataatgattatcacaatc

SEQ ID NO: 6791895 - DNA, 61 bp, Homo sapiens
actcagaggaaagttgagattgccctagacaccttgggagttggaaggctattctctgggt

SEQ ID NO: 6791896 - DNA, 58 bp, Homo sapiens
gatgtcagttctgttcctagttatattccaagtctttattgggaatcagaatctcatt

SEQ ID NO: 6791897 - DNA, 62 bp, Homo sapiens
gtaattctaatcaccagcacaaagtcttatcattcctcacagtggctgctgaagagaattac

SEQ ID NO: 6791898 - DNA, 72 bp, Homo sapiens
ggtatgattcagaaacatcagtggatggattgggtacaacctatccattactgaactgtattcttattaacc

SEQ ID NO: 6791899 - DNA, 64 bp, Homo sapiens
agtccaagcatagaaatcaggtgagaatctggtcagccaggcatgctgtgtctatgcgggggct

SEQ ID NO: 6791900 - DNA, 65 bp, Homo sapiens
tactcaaattgcctgagtatgtcacatgcagaaatgcttatgtccgtcacttggtaatatttgta

SEQ ID NO: 6791901 - DNA, 55 bp, Homo sapiens
tgccaccttgtgcagcaggaggtccttccatttcctgagctgtccagggtgagca

SEQ ID NO: 6791902 - DNA, 55 bp, Homo sapiens
acttacccacccctgggttgagggtatggtatcatttcccagctggtgggtcagt

SEQ ID NO: 6791903 - DNA, 55 bp, Homo sapiens
ccaaggagaatgacaccatggatactatactgtttcctgaagtgatctttcttgg

SEQ ID NO: 6791904 - DNA, 108 bp, Homo sapiens
catctgaaaattgcccattatgttgcccatccatcacagatgttgtgtggagtaaaaataatactaagacactaacatggtgccgggtcataatacgtcttcagtatg

SEQ ID NO: 6791905 - DNA, 58 bp, Homo sapiens
ccttcatgtcaccaggtctgatgcagccacgtgtggctgtcattgaacaggtgaaggg

SEQ ID NO: 6791906 - DNA, 89 bp, Homo sapiens
gccgctgtgtaactgtgagccccttctgcagtcaggtttccaggatgcctgtggacagggctgtgggaggagcagcaggccaccagggc

SEQ ID NO: 6791907 - DNA, 68 bp, Homo sapiens
aattatacatgaaggcattatatgtatggacattattaagtcatacttgctttgcttccattgtaatt

SEQ ID NO: 6791908 - DNA, 61 bp, Homo sapiens
agggtctggtgtagaagttctccacattcccttgcaacatgactcatctactccagaccct

SEQ ID NO: 6791909 - DNA, 60 bp, Homo sapiens
ttttgtatagtcaaagacaagaacatcactggaaggagtctttgttttgatgatacaaga

SEQ ID NO: 6791910 - DNA, 79 bp, Homo sapiens
gtatagcagctggctttgtcaagggcagcaggaagcatgcgtgaccctgctggccttgacaaagtagacagagtcttac

SEQ ID NO: 6791911 - DNA, 66 bp, Homo sapiens
gtcagaagaggactgggtagctcattgtgtgtcttttacaatggtaacgacttttccttttctcac

SEQ ID NO: 6791912 - DNA, 60 bp, Homo sapiens
gactacatttcatccagggagagctatctggatggctctgatttaggatgcaggtgtgtt

SEQ ID NO: 6791913 - DNA, 60 bp, Homo sapiens
ggcaggcatcatgtggtcattaaagtttcccaagacgatgtagccgggatggtgcctgtc

SEQ ID NO: 6791914 - DNA, 64 bp, Homo sapiens
aggctgcttcagctgcagggagccagtgaaatcgacaattggagcccacagctgtaagggctct

SEQ ID NO: 6791915 - DNA, 61 bp, Homo sapiens
tcagcagtcaaagagaatctctactctgtagattaaattactgattcttgatgtttgctgg

SEQ ID NO: 6791916 - DNA, 129 bp, Homo sapiens
actttttttttttttcccgagatggagtttcgctcttgttgccaggctggagtgcaatggtgcaatcttggctcactgcactccagcctgggtgacaaagtaagactccatctcaaaaaaaaaaaaggt

SEQ ID NO: 6791917 - DNA, 55 bp, Homo sapiens
gctgaataagagtctactttgctagtagatttgctctagagactcattgctcagt

SEQ ID NO: 6791918 - DNA, 55 bp, Homo sapiens
gtttgttgatatgcccctttgtgctccgtattcacaaaggggcacctcaacaagc

SEQ ID NO: 6791919 - DNA, 76 bp, Homo sapiens
agagtttggaaatgattgcgctcattcagattctcttctgatgtttgaattgctgccatcatatttctagtgctct

SEQ ID NO: 6791920 - DNA, 99 bp, Homo sapiens
gggcactctataaccccaagtacaacgcatacagagaaaaccctgaaagtagtactcagtttcttccattcgtctgttgtgcattgttgttatgtgcct

SEQ ID NO: 6791921 - DNA, 83 bp, Homo sapiens
ctgtgctttttttgtgagaaatcttaatcccaaacatttatctgtaaataagttggcgagattttttataggtgtcagtagag

SEQ ID NO: 6791922 - DNA, 99 bp, Homo sapiens
ccattcattttaggcgcttcattattcagttgtctactactgcctggcacacagtagatgctcaataagtggagaacagatgaataagtgaatgaatgg

SEQ ID NO: 6791923 - DNA, 55 bp, Homo sapiens
ctggcctgaggccgccttcagatgccttcttcctagtgccataacttcaggccag

SEQ ID NO: 6791924 - DNA, 57 bp, Homo sapiens
aagagggagagccaggagtggctactcccagctgtggcctgcctgcgtgaccctctt

SEQ ID NO: 6791925 - DNA, 66 bp, Homo sapiens
ctaattaaggggcatttttctgatgcagccttccggtgcagtgaaaaaagaatgtccagttgttag

SEQ ID NO: 6791926 - DNA, 67 bp, Homo sapiens
cctgagtggtgctaagcagataactcgtggttattccaagatagcatctgagtggagccacttcagg

SEQ ID NO: 6791927 - DNA, 78 bp, Homo sapiens
gagtctggaatgtagagacagcttaggagctcagaatctgaacattgtcactgtagcctgctctccagtttcaaattc

SEQ ID NO: 6791928 - DNA, 63 bp, Homo sapiens
ggcaggcatgggccatgggaagtgggcagttcttagtgcccctgctcaggcgtgtgccctgct

SEQ ID NO: 6791929 - DNA, 67 bp, Homo sapiens
ctgcatccatctcctagcacagcaaaggacaaccctgtagcattgtagcaaggattagatgggtgag

SEQ ID NO: 6791930 - DNA, 74 bp, Homo sapiens
tctgtttaaacgaaattgctcagaagccctatatgtaaaataggtataaatggagcagctttggttgaagcaga

SEQ ID NO: 6791931 - DNA, 60 bp, Homo sapiens
taaagggaagatgactacagaaaaaagatgccagttatggcattggtcattttaatttta

SEQ ID NO: 6791932 - DNA, 68 bp, Homo sapiens
gaggaattacctgtatttggctctgaaaatagccatactattagccattttatacaagtgtattcttc

SEQ ID NO: 6791933 - DNA, 75 bp, Homo sapiens
gggaggcggtgctgggatttagttttaaatggaaaatgcctctggcttttaattttctgggcccagcagttttct

SEQ ID NO: 6791934 - DNA, 78 bp, Homo sapiens
agtcaagactgttatttcaccactactgaatttctgatatctttctgattagggtgtactggaatgattttcttttct

SEQ ID NO: 6791935 - DNA, 81 bp, Homo sapiens
gacaagttgttaatatgcaaaacggatgcgtgatatttcttgcttctcatgatgcatgtttctgtatgttaatgacttgtt

SEQ ID NO: 6791936 - DNA, 79 bp, Homo sapiens
gaagctaacagagctattggattgtcggatatcattggaccaaaccacctcaatgtattgtccatgtgtctgttagctc

SEQ ID NO: 6791937 - DNA, 70 bp, Homo sapiens
ccatattcctggcacattgtaatatatacacatatgtatgtgtgtgtctgtggaagtgttcctggtttgg

SEQ ID NO: 6791938 - DNA, 58 bp, Homo sapiens
agctcaagtgcagttgggggatcagagaagctgtcctgccgggcatagcatttgagct

SEQ ID NO: 6791939 - DNA, 74 bp, Homo sapiens
ttaatgaaggaccagttgagtgatcttacgagttcagtggaaaagtggtaagatactttattgagccatattaa

SEQ ID NO: 6791940 - DNA, 76 bp, Homo sapiens
gtgagcagagaccagtgttttcatcctcccttgggtaccatgaacccctcaagggcaggagcctgttttgcctcat

SEQ ID NO: 6791941 - DNA, 63 bp, Homo sapiens
cccagctcccacatggaatagcagggaagaccactgtcttccctggaggtgctgggagctggg

SEQ ID NO: 6791942 - DNA, 81 bp, Homo sapiens
agggggcaggagagggagttgttttcatgtaacttttgcttttatacagactgaagatatttccccccatttgtgtctctt

SEQ ID NO: 6791943 - DNA, 63 bp, Homo sapiens
atgtaagatgctctattctggacaaatatagacaatttcttcctgaggaatggcatctcacat

SEQ ID NO: 6791944 - DNA, 61 bp, Homo sapiens
aagtttaagagcataggcttgaaaataggacacttaggtttcagtctctgctctgctgctt

SEQ ID NO: 6791945 - DNA, 68 bp, Homo sapiens
tggctgcaaatgatatttagagcataaaaaaatcaaatctagctttaagtgattagaatttgctgtca

SEQ ID NO: 6791946 - DNA, 113 bp, Homo sapiens
ccttacatatttttaaaccacagtatcagcagagcttaaaagagcatttggcagatactagatatcctatcttatgagtattgttgaatatgtgtcagttattcatagtgagg

SEQ ID NO: 6791947 - DNA, 81 bp, Homo sapiens
agaagaaaagctctctcatgacagtgcagttagcagaataaaaatttggctgtagtggtatgagtgaataatttgtcttct

SEQ ID NO: 6791948 - DNA, 74 bp, Homo sapiens
ggcttgacttcacttctgaatttaaaaaccacagaatttaaagatattttaaagtttggacgaagtcaaatgcc

SEQ ID NO: 6791949 - DNA, 57 bp, Homo sapiens
ccaattggatttggttttagttggtacagactggctgcaattgcctgatctcattgg

SEQ ID NO: 6791950 - DNA, 66 bp, Homo sapiens
cacttgattgaattttgaaaatctagtctcaataggaatagaggatggatcaagattaaatctgtg

SEQ ID NO: 6791951 - DNA, 103 bp, Homo sapiens
cagggcctcgggccagtccccaccccaggtgccctgcttgaggtcgaaattcatgaactcctcgccgttcagggcgaacttggcggtgggcaccgaggtgttg

SEQ ID NO: 6791952 - DNA, 57 bp, Homo sapiens
tccctgtctcccttgagactagaacaagaaaattggacctaatttgaggagaaggga

SEQ ID NO: 6791953 - DNA, 73 bp, Homo sapiens
ggttgttcctttcgcaaagcattcgtgacattgttagaacttgtcattaagtcctttggcggagggctctacc

SEQ ID NO: 6791954 - DNA, 88 bp, Homo sapiens
tccttggagcatagatgtttagaggtcaggtgaggaattaagatttatatcttaacagtttcctgagcctgagttgtaattctaaggg

SEQ ID NO: 6791955 - DNA, 106 bp, Homo sapiens
tctcagatttctaaaacaatgatcaactgccccaaatgtatttgagcatatagaaaatattgaaagatatcattgaggttgttgacatgtgttatggagaatgaga

SEQ ID NO: 6791956 - DNA, 79 bp, Homo sapiens
ggttatatgtcataattgtgtctgtatatatgaaggtctgtcattaagccttataaacacgattacatgatttattttc

SEQ ID NO: 6791957 - DNA, 57 bp, Homo sapiens
ctgtgttcatattcatcctgtcatttgagctctgtgacagccttgtgatggagacag

SEQ ID NO: 6791958 - DNA, 70 bp, Homo sapiens
ccctatattgttcctctgtgatgatccctctaaaatattgatcaaaagagagggcagggaaaagataggg

SEQ ID NO: 6791959 - DNA, 69 bp, Homo sapiens
gccagcccttgtttctaaagctgcaacttggagcctttccattagggcagccaagagaccagggcaggc

SEQ ID NO: 6791960 - DNA, 94 bp, Homo sapiens
ggattgcttgaggttaggagtttgaggctttggttcactataatcatgcctgtatatggccactgtcctctagcccagacaacatagcaagacc

SEQ ID NO: 6791961 - DNA, 84 bp, Homo sapiens
cttctgtttttactctctagttctatttgctgatttttgttaatatttataataacagaaatagtaggtgagggaaagcaggag

SEQ ID NO: 6791962 - DNA, 76 bp, Homo sapiens
ctcaccctcagagcctccagaaggaatcaaccctgccaacacctagatttcggacgctgggctctagaactgtgag

SEQ ID NO: 6791963 - DNA, 76 bp, Homo sapiens
gcattaacaggcagcatgggccccagctccttcaagcagagcaaggagagaggagcccactgctgttgaatggtgc

SEQ ID NO: 6791964 - DNA, 63 bp, Homo sapiens
ggctttggagttggctacatatttctcttccaagatgagctgtttgcttcaattccagaagct

SEQ ID NO: 6791965 - DNA, 90 bp, Homo sapiens
ctgaattattgcagtcccagtttgagactctggagcccccagcagctccagaaaactttatccaaataagtgtggacaaaaatgtttcag

SEQ ID NO: 6791966 - DNA, 57 bp, Homo sapiens
gtttcagatttggtttcagaagggttttgtcagctttctgtaaactgcgtctgtaat

SEQ ID NO: 6791967 - DNA, 78 bp, Homo sapiens
cacattccagaaacctttgtcttaatcaacctgagagaatccagctttcagccagagggggcaaaggaagggtgtgtg

SEQ ID NO: 6791968 - DNA, 99 bp, Homo sapiens
ctggagggatttttggatccctggccacgaagctgcccagggtagctggggcctgggcgctttctgggtcagggctggagaaggaggcatttgttccag

SEQ ID NO: 6791969 - DNA, 71 bp, Homo sapiens
gtatcatcaggatctctctggaatgcctctcactctctgccactgaggatttatatattccttgatgatat

SEQ ID NO: 6791970 - DNA, 89 bp, Homo sapiens
ggagttcctattttcacttatttctgctactaccattagaaaatggaatattttagccaggcaattatgggtgatcaaatagctatttc

SEQ ID NO: 6791971 - DNA, 64 bp, Homo sapiens
gttggctgctcctcagctgtgctgttgaaagatgtcagagtagtttagtaagaggagagctgac

SEQ ID NO: 6791972 - DNA, 65 bp, Homo sapiens
tgtccagtccttggggtgctgtcctctggaaggcgtctgcagccaagaccccaagaactggcaca

SEQ ID NO: 6791973 - DNA, 57 bp, Homo sapiens
tctctttgtctgctcttagttgagcttccctgtaaagactgagtctagaccaagagg

SEQ ID NO: 6791974 - DNA, 66 bp, Homo sapiens
ggagacccagctcagggaggcagttggcagtgcagtggatgctgctccgtctgagctctggttgcc

SEQ ID NO: 6791975 - DNA, 94 bp, Homo sapiens
gcaactacttacatagcatttacattgcattaggtattataagtaatctagtgatgatttaaagtatatgggaagatgtgtgtaggttatgtgc

SEQ ID NO: 6791976 - DNA, 83 bp, Homo sapiens
ttttataaaaacatgaaatcacaataatcccactatataccagcataaccgggttcagctagaatttcatgtttttggtgaga

SEQ ID NO: 6791977 - DNA, 85 bp, Homo sapiens
ctgattgggggggaattgtatgaggatagcaagaagcttcaaataattatgccagcctgctgaacctcatgcagtctctgattgg

SEQ ID NO: 6791978 - DNA, 77 bp, Homo sapiens
ttcatttaataaagttctgctggcatatatgatgtttctctaaattggttgctacttaggagctttattctaatgga

SEQ ID NO: 6791979 - DNA, 130 bp, Homo sapiens
ccctgtagatttgcctggtgcatgtaatgaaacctgcagctttatggggtgatggcagtgctctgctgccttactttcaagtggctgggggtttttttagtttggcaggtacagattttttttaattggg

SEQ ID NO: 6791980 - DNA, 60 bp, Homo sapiens
agttggttattcatgagtgctactgatccctcaacagtgaccatcagagaataacaaact

SEQ ID NO: 6791981 - DNA, 69 bp, Homo sapiens
cagggctacagatagcactaagggatctgcgcatggctgtgcagctcattcatggcatttctggtcctg

SEQ ID NO: 6791982 - DNA, 58 bp, Homo sapiens
ctttccttccccacataagcaagagggcgaactcctcctgtctgcggaggagtggaag

SEQ ID NO: 6791983 - DNA, 91 bp, Homo sapiens
gggattacaggcgtgagccactgagcccggccattgtttgtttatatgctctgctaataatggtttggctctgtgtctccacccagatctc

SEQ ID NO: 6791984 - DNA, 60 bp, Homo sapiens
ggccccagccactgtgtgaccagctgtcctcctgtggggccagcctcaatagtaggggtc

SEQ ID NO: 6791985 - DNA, 73 bp, Homo sapiens
agcaggtgaggctgaacagatgaaaagccttcaaacaagtccactgttatttcatttgtctacttcacttgtt

SEQ ID NO: 6791986 - DNA, 65 bp, Homo sapiens
accatgcctggctaacttgtgtatttttagtagagattggatttcaccatgttggtcaggctggt

SEQ ID NO: 6791987 - DNA, 102 bp, Homo sapiens
ttcccctgtgaagtcataatcccccatttgtgacatcacagtctttccactgcaatcaacagtgatgtttcaagctggggattaaatgcttcagaagaggaa

SEQ ID NO: 6791988 - DNA, 84 bp, Homo sapiens
cctgcacccactaccttactttaaccctgcaagctggtactatcatgatccccattttgcagatgaagaaagtggtaggacagg

SEQ ID NO: 6791989 - DNA, 55 bp, Homo sapiens
tgacaatttcagaactatctgggagtgatgatgtttactgtcatctgagaggtca

SEQ ID NO: 6791990 - DNA, 99 bp, Homo sapiens
ggcctatgaataagcaaaagaccaaaaagcctctgtttttccttttaaaatgtggagataattaagactgcccatgtttttatttgtttgactagagcc

SEQ ID NO: 6791991 - DNA, 78 bp, Homo sapiens
gctcccaagatttttgatctgagcagttggagagctagagttcccactgactgagatggaaaaagctgcgagaggagc

SEQ ID NO: 6791992 - DNA, 67 bp, Homo sapiens
atgtacattcttctcaccgaaggggtatacttattttcttacctttagtctttgaagtaatgtacat

SEQ ID NO: 6791993 - DNA, 116 bp, Homo sapiens
cccactctcctctcccagtccaggagggctggagctctgggcatctcagggtcagctgcggtgagcctggccacagggctctgcattccttctgggctttgcttggtttgagtggg

SEQ ID NO: 6791994 - DNA, 70 bp, Homo sapiens
gaggctctggggaaaactaaaaagccttggctctagcaactagctgcctgcctagttccacagtgtcctc

SEQ ID NO: 6791995 - DNA, 74 bp, Homo sapiens
gtcattagttgctgttaagccacaattagatcactttttgacatgacataaaattagtttggcataactgatgc

SEQ ID NO: 6791996 - DNA, 61 bp, Homo sapiens
attctagatgctgtaagtagcaataataaaagaggaagcaaacacgtgcagcttctggaat

SEQ ID NO: 6791997 - DNA, 74 bp, Homo sapiens
atgtatctaattgatttcaggggcaggaagtggtttttataaaatgtattgccaagcccttgaaatagatatat

SEQ ID NO: 6791998 - DNA, 56 bp, Homo sapiens
gcttactctcagggttagtacaggaagatttgatttcactgtttctgtgagtgagc

SEQ ID NO: 6791999 - DNA, 59 bp, Homo sapiens
tgccaaatatgcacgtgtatgcatgtgtttgtacgtgtgtgcacgtgtgtgtgtgtgca

SEQ ID NO: 6792000 - DNA, 81 bp, Homo sapiens
tagagggcagcccagaggttccaggctagggaggaactctttctgagctttggaagtttcaccagggccacatgcatttta

SEQ ID NO: 6792001 - DNA, 68 bp, Homo sapiens
tctgggctggcccaccacacctcgagctttcccagccataagtaatatcgagggcgtggccactcagg

SEQ ID NO: 6792002 - DNA, 78 bp, Homo sapiens
atcctttgcaatagcagttaaaaatcagccctggagacattgagggctgtttggtaaatgcatgttcgtttttaggat

SEQ ID NO: 6792003 - DNA, 75 bp, Homo sapiens
tttaaataattttagacttagagaagaattcctaaaatactatagagagtttctctcagtatagaatagtataga

SEQ ID NO: 6792004 - DNA, 56 bp, Homo sapiens
gaaggcaagtgagccaagagaatgcttttccacattccttacattcatatggcttc

SEQ ID NO: 6792005 - DNA, 69 bp, Homo sapiens
cccaccagctgctgcaccgtgcatgggtctgaggtggccccatgtgacctgtgtcagttgctttttggg

SEQ ID NO: 6792006 - DNA, 67 bp, Homo sapiens
tgagtactcgattccaaaggaatcccaggctctacatcagagttaaggagagttggaatcagaacca

SEQ ID NO: 6792007 - DNA, 68 bp, Homo sapiens
ctcagttcctggcacatgatagtcatccaataaatatttatcgagtaactgaatgtgtccaagctgag

SEQ ID NO: 6792008 - DNA, 77 bp, Homo sapiens
ttgggactacatttatagtcgtctcagtaataaacaactatacaacttttattattgtaagggctataagtccacaa

SEQ ID NO: 6792009 - DNA, 75 bp, Homo sapiens
cacacgggattatgtgcatattactacctactccatccaagggtagtggggtatgtgtgtgtgcacatgtgtgtg

SEQ ID NO: 6792010 - DNA, 130 bp, Homo sapiens
ttgaactaaatgaaaaggtgacctgaaatgagatttgatgttgctcttaacagtatgatgccaccaattatattgcaatagatgcatcattttaaaggttttaaattactttctttgccttttttgtcaa

SEQ ID NO: 6792011 - DNA, 71 bp, Homo sapiens
tgcttctgtgctcgagccaaccacacgtatacttgaacacgaaggaatgtgcttgagcattaaggaatgta

SEQ ID NO: 6792012 - DNA, 74 bp, Homo sapiens
tcctagttaaggtggatgggtatgaagtggtagataactgaaatacttttcttcatgttccctccttctggtga

SEQ ID NO: 6792013 - DNA, 70 bp, Homo sapiens
gatacgtttgcatgtctcagtacactccgatgttgaggtattctgaacatcagtattaggcatgtgtatc

SEQ ID NO: 6792014 - DNA, 112 bp, Homo sapiens
accttctgtcccatgctctgaaattcttttacggctctactttcccttcagtgatctttcttcaagatgacagtgacagccaaaggctttttcatagcttggaacagaccgt

SEQ ID NO: 6792015 - DNA, 56 bp, Homo sapiens
agtccatcttctcttgctggtctgagaacaagagaccagaaagaacccggtggcct

SEQ ID NO: 6792016 - DNA, 106 bp, Homo sapiens
caaatgtatacaccacatgctaacctcacaaaattggaataagcttttgaaaagaaattggtccttgaagcttgtatctaatattggcactggattatagaatttg

SEQ ID NO: 6792017 - DNA, 59 bp, Homo sapiens
tagtactccagaatcgagatctcatatccttgattttgagtcttgagctttggattctg

SEQ ID NO: 6792018 - DNA, 56 bp, Homo sapiens
gatatggcacattttgtttatccatttatctgtcgatggacaattgagtgtctgtc

SEQ ID NO: 6792019 - DNA, 55 bp, Homo sapiens
tactttccaccagctttttgaaagatcctcataattaaagcagccgtggagggta

SEQ ID NO: 6792020 - DNA, 59 bp, Homo sapiens
acaagctgctctccaagaacacgtgctaggaaaagtgcttgatcagagtgtcagcttgt

SEQ ID NO: 6792021 - DNA, 62 bp, Homo sapiens
tgaattctgggtcagcagcttgcaatgtgccccatgtaagcatgttaatgactcaaagttta

SEQ ID NO: 6792022 - DNA, 85 bp, Homo sapiens
gcagcatccctaccattccagactagactgttataaatcctctttaatagtcttagaatcttgagtgtgttttacagaatggtgc

SEQ ID NO: 6792023 - DNA, 58 bp, Homo sapiens
attacatgggccatttagacatgcatgtaagtagaattatcatttggccctatgtgat

SEQ ID NO: 6792024 - DNA, 61 bp, Homo sapiens
gcaggtccgagagggtcgggtatagggggaccccaatcttgcctgtgtatttccggcctgc

SEQ ID NO: 6792025 - DNA, 64 bp, Homo sapiens
ttgggttttcccttgaaactgaatagtcacaacttcataaaatgttttaagggagaaaacctag

SEQ ID NO: 6792026 - DNA, 70 bp, Homo sapiens
tcacacctgccttcagcattgccatgagggctgggcgaggtggcccgtgcagtcctggaggaaggtgtga

SEQ ID NO: 6792027 - DNA, 122 bp, Homo sapiens
actatagcccccatgcctggaacagtgcttgccaccaagtaacaaccccataaagacttgctcagtctttaagggatgttctgcttttagggaactctgattcaggtgaacaggtatctagt

SEQ ID NO: 6792028 - DNA, 84 bp, Homo sapiens
actgaatgctcccgttttaactagtgggctaccgtgagtagtttaggtcacaggagttaacataattaagagagagtatttagt

SEQ ID NO: 6792029 - DNA, 65 bp, Homo sapiens
gcggcccacaccaggggccacagtgcacccgccacttcatggcacgtggccaacaggatgggcgc

SEQ ID NO: 6792030 - DNA, 68 bp, Homo sapiens
tgaaaacctttaatgcagtcttaagagtatgattttattccatgcaatagattcactgaaggatttta

SEQ ID NO: 6792031 - DNA, 88 bp, Homo sapiens
tttctttgtttgggctgtgataatgcaggactcctcacaactctatggggtatatactgttgttatcactgatctacagataaggaaa

SEQ ID NO: 6792032 - DNA, 60 bp, Homo sapiens
ccctgctcttagtgcctgtgtgaatgagtgaaattgatgctggtgtttttgggaccaggg

SEQ ID NO: 6792033 - DNA, 55 bp, Homo sapiens
ggctcagagagacaatgtgggacatttgaggtcagtggctcatcctttctgcgcc

SEQ ID NO: 6792034 - DNA, 73 bp, Homo sapiens
ttgtcctgggtggatgcttcattgttaccatgaagaattgtgggtcaggaagtgagcatttatcccagcataa

SEQ ID NO: 6792035 - DNA, 66 bp, Homo sapiens
ggtgtgcaactttcattaatatttggtaatgccttttcttatatcccaggtattgaagttgacacc

SEQ ID NO: 6792036 - DNA, 56 bp, Homo sapiens
tggatacagtaaagtttgagaagcactgcaaaggcaaactcagacaggctgtgcta

SEQ ID NO: 6792037 - DNA, 58 bp, Homo sapiens
gaggcttttgtggtgtggaatggcggttattcattgttagtcagcttacggtagcctc

SEQ ID NO: 6792038 - DNA, 55 bp, Homo sapiens
gcttctgtggtgaggtcaccttttctggaaatccctgtgatttctttccacaagc

SEQ ID NO: 6792039 - DNA, 74 bp, Homo sapiens
ataagtcttacaacggaattgtttcgtcaagcacactgcatgcttgacaaagcagtttcattagtgtgatttat

SEQ ID NO: 6792040 - DNA, 57 bp, Homo sapiens
ctgagggcttcctgatatggaatgaaggacaacttacattgtggatggagtcctggg

SEQ ID NO: 6792041 - DNA, 61 bp, Homo sapiens
tgctgcacaattggaaagtatcacatgagatacttctaagacaatattcagctgagcagta

SEQ ID NO: 6792042 - DNA, 106 bp, Homo sapiens
gtgagaacttgttagaaatgcaattcttgggatccatcccaaatctactcaatcagcagctttggagatagggcctagcaatttatgtctttctggtaattctgac

SEQ ID NO: 6792043 - DNA, 60 bp, Homo sapiens
ttcctgtggtccagagtcatcctcagtattcccggtgaggactggctattccacaaggaa

SEQ ID NO: 6792044 - DNA, 77 bp, Homo sapiens
gtgcactgacaccaacacagtgtttttcctggtgacaggcaccagggcagcttcctttgttaggtcagtcagtgcac

SEQ ID NO: 6792045 - DNA, 62 bp, Homo sapiens
gaaagtggtgggtgctaggattaactgtcagattggtttggttccaaagcccattctctttc

SEQ ID NO: 6792046 - DNA, 98 bp, Homo sapiens
gaaggtttcctcacactggctgcactcataaggactgggtctctggtgaacatttattccagtgctgaatgaggaggtctctgtggtagaaggccttc

SEQ ID NO: 6792047 - DNA, 108 bp, Homo sapiens
gccaccccccacagcctctccagcagagtgggagcccagggctgggcaagcccccgccttgtccgcaggtgcccacatctcttgggttggcagtggtaggcagatggc

SEQ ID NO: 6792048 - DNA, 94 bp, Homo sapiens
tgtaggatcattctgacatgagctcattgagaataagacccatggttgattaatcttttgtctgtcccaatagccaacaggatgcatttctgca

SEQ ID NO: 6792049 - DNA, 75 bp, Homo sapiens
gtgaaaagcggacttcaggaattctctacacctggacatctcccttgctctggttcctgatagattccttttgac

SEQ ID NO: 6792050 - DNA, 77 bp, Homo sapiens
gtgatgacagctggacttccctgggctgaaagctgagtgtggctgctccagctctgttctggggaagctgttgtcat

SEQ ID NO: 6792051 - DNA, 69 bp, Homo sapiens
acagcagatttggagccgtggaagaacagcgagaaatctcttcacatgaccttcatgtcttcctcctgt

SEQ ID NO: 6792052 - DNA, 86 bp, Homo sapiens
ctgagcatgttatgcatattgtgatggatttcagggttaatatacctcctttttcctcatcacaatgtacgttaaaatgtgcatgg

SEQ ID NO: 6792053 - DNA, 107 bp, Homo sapiens
gagccattttgaattctttaaagaagaaacgttggcataagtttatgctctggtgtataaagtttctgcttgtttttcccccagtctttgttgaatttaaatggctt

SEQ ID NO: 6792054 - DNA, 94 bp, Homo sapiens
gaagacaaaattccacttcagccaagcgtaggatattggggtcaacatatgtctttgttccttatttttggctataaggaagtatttagttttc

SEQ ID NO: 6792055 - DNA, 67 bp, Homo sapiens
gctgttccttttactgcatgcgtaggaatctcccagaaggttgatattgcagacatgaagggaatgc

SEQ ID NO: 6792056 - DNA, 57 bp, Homo sapiens
gaattgcctgttgaagattcgacagcaaatacctgttgaattttctatgggcatttt

SEQ ID NO: 6792057 - DNA, 126 bp, Homo sapiens
ttttagatggtttagtcggagctgttacatttggcagcattccttgttagcatttgataaacaattattgccaaatgttagcaaggaaacctgccaaatgttacagctcagatttaactgctgaaa

SEQ ID NO: 6792058 - DNA, 76 bp, Homo sapiens
tggcctgtgactgcctctgggcagatggtagatccctctgatggggaacagggaggcccagagggagccaagccca

SEQ ID NO: 6792059 - DNA, 82 bp, Homo sapiens
ctcagagtctagttttcttcccaggtgagaaagtgctaatttgagacactgacccatgttgtgaaggaaaatgggctctgag

SEQ ID NO: 6792060 - DNA, 68 bp, Homo sapiens
cctgtcccctgtgcggggaagggctcactcagtggggctgggtgtccagaccctgcacattccacagg

SEQ ID NO: 6792061 - DNA, 58 bp, Homo sapiens
gcacacagggatttttgaatgggtcggaagtgagcgagctgctcagaaacttgagtgt

SEQ ID NO: 6792062 - DNA, 60 bp, Homo sapiens
tcccaagactatgttctgtgtgacagcctccatctgtgtggcataaggccaattttggga

SEQ ID NO: 6792063 - DNA, 95 bp, Homo sapiens
aggtcacagagtcagagagtcagagagttaggctgaatcctgggttctgccagcacagtctgtgtacctttggccttctaccatttttgtaactt

SEQ ID NO: 6792064 - DNA, 56 bp, Homo sapiens
ggtcctttaaagtagacctgtttgtaagacactaagcatgtttacactcaggggct

SEQ ID NO: 6792065 - DNA, 91 bp, Homo sapiens
ctggctggcaggcaggctggggagctggggctcagtcgtatccctccctggctagcattccatcactcagcaccccaccctccccaggcag

SEQ ID NO: 6792066 - DNA, 60 bp, Homo sapiens
agcagttttagggagacacattaggagctggagtgaacacttatcatctctataactgct

SEQ ID NO: 6792067 - DNA, 84 bp, Homo sapiens
gtgttttaaaggtgcttgtatagtacaaagcactgtatatagtataatataaaggattttgtataatataatcattaagagcac

SEQ ID NO: 6792068 - DNA, 80 bp, Homo sapiens
gccaggctgggtggtactgggggcccacaggggaggccaacggctggcctgctggaggagcctcagggcctcccagaggc

SEQ ID NO: 6792069 - DNA, 82 bp, Homo sapiens
ggaatattaagtgtcttgctcaggttcacagagttagtaaaagagctagcatgtcaacttagagctatggcatatataatcc

SEQ ID NO: 6792070 - DNA, 56 bp, Homo sapiens
caggaggacggagttagtcacatcttcctgcttctgagacagactttcgtcccctg

SEQ ID NO: 6792071 - DNA, 86 bp, Homo sapiens
ctctttgatgtaatcattgtctgtactttaaaaatgtttggctgaattaaaaagatacaaatcagacagggaattatagcagagag

SEQ ID NO: 6792072 - DNA, 55 bp, Homo sapiens
gggatggagctgtgtaccctgggcagggaatggcctcagaccacagctcacaccc

SEQ ID NO: 6792073 - DNA, 130 bp, Homo sapiens
gagcagccttctctttccctctttctgggtctccatggaacagacagctgagacaaggtaaggtcacacttgtgaagttctgtgccgtgaagccacagaaaggatagtcaggttagggaacaggctcatc

SEQ ID NO: 6792074 - DNA, 88 bp, Homo sapiens
gtatctggctcaaagtaagcacacaataaatgttgccttttaatagtgtagttatttattattgtggttacttctgggtaccagatac

SEQ ID NO: 6792075 - DNA, 76 bp, Homo sapiens
gcaatgcggggagggctgagactggggtctgggctgttccggacttcaacactcaccccttgtccccccgcagggc

SEQ ID NO: 6792076 - DNA, 58 bp, Homo sapiens
caggcagctgactgtcagatatgtgactgaagcggcttctctgaccatcagctgtttg

SEQ ID NO: 6792077 - DNA, 57 bp, Homo sapiens
gccttttaaggcagagggagatccctatggcgttagtcttcccaggccttaaagggc

SEQ ID NO: 6792078 - DNA, 57 bp, Homo sapiens
aggaaggggagaagttaaagcttctctcttccatctgcgttggcttctttccttcct

SEQ ID NO: 6792079 - DNA, 81 bp, Homo sapiens
ggattacttgtttcagttttttacttcctctgctatgagactttgcagtacagtaaagcaagctgaatatgcatcccatcc

SEQ ID NO: 6792080 - DNA, 117 bp, Homo sapiens
ctatgacactgtctcttcttcttaaccaggatttaagattctagagggctgagatggtttcttacaaattcttgagttttcaatcattgtgtgcagtacaaggcatggatgtcatag

SEQ ID NO: 6792081 - DNA, 77 bp, Homo sapiens
tcagctttgctcgttacactaactactgttgacttcaattatcttactcaattttaagtgataaagagtagagatgg

SEQ ID NO: 6792082 - DNA, 79 bp, Homo sapiens
ggctgtgaactcccagtgtttacagttgaacaaatgatttggccatctgttcagaattgtaacactcacagttcttgcc

SEQ ID NO: 6792083 - DNA, 64 bp, Homo sapiens
tgaaggcatttgagttggtgagccctaatttaacctccctgggtcaccattttttttgctttca

SEQ ID NO: 6792084 - DNA, 91 bp, Homo sapiens
tccagactccatactatcagccacttgtgatgctggggaagttcctctacacaagttcccctggtgccacgatctgcttcacgagtctggg

SEQ ID NO: 6792085 - DNA, 62 bp, Homo sapiens
cagtaataggtaacattgccctgagaagagcaaatcacagaataagcaagcacctgttattg

SEQ ID NO: 6792086 - DNA, 60 bp, Homo sapiens
gctcttccctaatcaccatcttcagtggagtgtctgagtttggtatctagggggtcaagc

SEQ ID NO: 6792087 - DNA, 68 bp, Homo sapiens
gtttaatacttttcaagctggtttttggacagtctacatttggacagaagctagcaggaaagttttgc

SEQ ID NO: 6792088 - DNA, 57 bp, Homo sapiens
aggcactgaaaggtggccagagcctgaacataaatggcctggcaccttgaggggcct

SEQ ID NO: 6792089 - DNA, 103 bp, Homo sapiens
ttcaaatttccaatcccaccaaaatgtaaaacatgttttaactaggagggctcattgtttctcctttcaacatgtttgctttggagtttgggatgggtttgag

SEQ ID NO: 6792090 - DNA, 59 bp, Homo sapiens
gcatttcctctttgtaccttgactaagccaaagctgggaaatcagcagggagggaaggt

SEQ ID NO: 6792091 - DNA, 60 bp, Homo sapiens
acatccactatccttgcttgttacttccactagaaagaagtttctgagggctggggatgt

SEQ ID NO: 6792092 - DNA, 69 bp, Homo sapiens
cctctgagaggctgccctgccatcaagctcttgaaaagttggcacagggagccccatttttctcaaagg

SEQ ID NO: 6792093 - DNA, 82 bp, Homo sapiens
ccagttttgcatcttgcttcctaagaaggaaagattgccttaaaaaatatcacctccgttaggtaagtaggatcaaaaaagg

SEQ ID NO: 6792094 - DNA, 63 bp, Homo sapiens
atcaatttcatttaacatgcagcatgatctcaatatttaacagctgtgttaacaggaattggt

SEQ ID NO: 6792095 - DNA, 57 bp, Homo sapiens
aggatggggaattgaccgcggatcttcatgtgaagagcatcggtggagcccccacct

SEQ ID NO: 6792096 - DNA, 79 bp, Homo sapiens
gacctcaagttggtctcctgtagcaacaacttgggcagagccaattgagaagagtccaagcagttgccaggatgaggtc

SEQ ID NO: 6792097 - DNA, 58 bp, Homo sapiens
gccatcttagtcaaaacttcagagaaaactgaaatgaattaagttttgatataatggc

SEQ ID NO: 6792098 - DNA, 60 bp, Homo sapiens
tgtgcacagcaagttggtagtgagatatcacctgctgggacactgaagacttcttgctca

SEQ ID NO: 6792099 - DNA, 77 bp, Homo sapiens
aggaagtacttggaaaaatgcccactccagttgttatttgtaaaatgtccagttggcattttatttaagtatattct

SEQ ID NO: 6792100 - DNA, 130 bp, Homo sapiens
acattagaatcacctcggggaggtttgtgaaaatgcagattgctggtctccactcccatccaattcagtaggtccgagctgaagtctgagaatttgcaattgtaacaacctcccagatgacactgctggt

SEQ ID NO: 6792101 - DNA, 62 bp, Homo sapiens
aagcggcagcatcccatggaccgcatggggcctctccaggtggagcagggagcatgcctctt

SEQ ID NO: 6792102 - DNA, 101 bp, Homo sapiens
gaattctgtctagttgatgtaccagtccttagattttactgccaagttgctaaaaccatatggggtaaaatgtaggagatacgtacacacagacttagttc

SEQ ID NO: 6792103 - DNA, 90 bp, Homo sapiens
ggtgggacccaaatgttgagattactatgaactagtggaaagaaaattttaccaggagtagaatatctgtgaccagggtttggtcccatc

SEQ ID NO: 6792104 - DNA, 71 bp, Homo sapiens
gggccgggcgggtccacccaggctgtgggtcagccctgcagggttgagctgcctggctgtggctcaggccc

SEQ ID NO: 6792105 - DNA, 75 bp, Homo sapiens
cactggtgtattagagctagaataaaattcttaaggggaagacaaatcagggagaagctggctcagaacaccatg

SEQ ID NO: 6792106 - DNA, 70 bp, Homo sapiens
aagtctttgctactgtgaatagtgccacaataaacatatgtgtgcatgtgtctttatagtagcatgattt

SEQ ID NO: 6792107 - DNA, 68 bp, Homo sapiens
gcaatgccttggttctctacttggaggagcttgtaagagccaccaaaattggaaattaaggctagtgt

SEQ ID NO: 6792108 - DNA, 60 bp, Homo sapiens
ttcactgtgcaggatgccttttaatgcctattggatattatagagcagatgcaatgtgaa

SEQ ID NO: 6792109 - DNA, 82 bp, Homo sapiens
gagctgctgtccaacctgcactcgcgtgggaacgagaagacactcgtggaggcgtcggcagagcaggcagaccaaggagttc

SEQ ID NO: 6792110 - DNA, 67 bp, Homo sapiens
tgagtggtaggattcttacaattctccagccatgtgagggagaaagctaataggaatcctactgcca

SEQ ID NO: 6792111 - DNA, 76 bp, Homo sapiens
gcccagccgctcctaagggctggcacacggctgcatcagagaagacgtgaaaagcaacattgtggaccggctgggc

SEQ ID NO: 6792112 - DNA, 78 bp, Homo sapiens
gaagaaagtgggtttattgtatttcccttaagattgtgagggagtgtggatacagtagaatgagccaacagtttcttt

SEQ ID NO: 6792113 - DNA, 76 bp, Homo sapiens
ggtaacataatgtttgaccaaaaaactgcatgaagactggcttttagctatgcattcttggtgacattattttccc

SEQ ID NO: 6792114 - DNA, 79 bp, Homo sapiens
gtcatatactgagagcaaatacattcttcctagacataaaagtttataaacgtttggatgtgtgctcatatatatagat

SEQ ID NO: 6792115 - DNA, 61 bp, Homo sapiens
cagaagaggtttttaagggaaggtttgcatatcacacctttccctggttaaccattttctg

SEQ ID NO: 6792116 - DNA, 60 bp, Homo sapiens
accctcatcccactagggaacactgcgcctcacgagagccagcagagtggggtggagggt

SEQ ID NO: 6792117 - DNA, 100 bp, Homo sapiens
ctgccaacctcctgagcctcatggtcatcttgagtcaagggaattgtgtgagatccactcaagtggccttgatggctttcttcttgcaaaggttgggcag

SEQ ID NO: 6792118 - DNA, 60 bp, Homo sapiens
gcagggctgggaagcagggggcctttgtcaggctcacggcctgaggtttctggcctctgt

SEQ ID NO: 6792119 - DNA, 57 bp, Homo sapiens
aaatggagtcctctctcacctgggagagccaggtgctgccccgagaaggatgcattt

SEQ ID NO: 6792120 - DNA, 56 bp, Homo sapiens
ggcagccttgagggaggcctggcaggttcagatgccagggtaatccatgggctgct

SEQ ID NO: 6792121 - DNA, 80 bp, Homo sapiens
ttagcactagtgtttaagaagatgactttggagttggagagacaggttcaaatccagactctgtcacttcctagtaatga

SEQ ID NO: 6792122 - DNA, 68 bp, Homo sapiens
attgtagtattacacagattatgacttaccctttagaagaagaagggcagatctgtaggtactaccat

SEQ ID NO: 6792123 - DNA, 61 bp, Homo sapiens
agccagtctgcatggcaggagagaggagatgcttctccatttctaccaaatgtgactggct

SEQ ID NO: 6792124 - DNA, 56 bp, Homo sapiens
cagtcacaggtggagaaccgagtagcatgaacggatgcctgtcttcaccagtactg

SEQ ID NO: 6792125 - DNA, 69 bp, Homo sapiens
cacagggtgctctctgacttgtgtttataaatttcgtaaaaatacattagacggagagttacaatgatg

SEQ ID NO: 6792126 - DNA, 79 bp, Homo sapiens
gaggcactgggtgggaaggtgaactggtctcccagggtagaaaatgaagggacagtgtgggccatctcactcaggcctc

SEQ ID NO: 6792127 - DNA, 77 bp, Homo sapiens
ctgtgtgctgtgctaggggcactaaaagctgaacctcccagtcttagcaaaggcccctacacccaagcttgacacag

SEQ ID NO: 6792128 - DNA, 86 bp, Homo sapiens
ggttgtacactgtacaactccagggaacactattcacatcaaagactttatgaatgacttttcctgtagttgtgcaatgtacaacc

SEQ ID NO: 6792129 - DNA, 62 bp, Homo sapiens
tgtcctgctgttattggcctctgtttttgtgaaaacagatgagttataatagcccaatgaca

SEQ ID NO: 6792130 - DNA, 57 bp, Homo sapiens
ggttttcagtttgtgagctctgaatccacacaaaaacaggactgcattctgaaaacc

SEQ ID NO: 6792131 - DNA, 57 bp, Homo sapiens
acttccattatgtgcttctgtgtctgaaaaggatgcacaagttatatgtatggaagt

SEQ ID NO: 6792132 - DNA, 80 bp, Homo sapiens
gcacttactgagcagaatggagggaagagtcaccagaatcatttctattcattctttctctctaatcaagcacatagggc

SEQ ID NO: 6792133 - DNA, 118 bp, Homo sapiens
cttcagcactcagctttgaagacgtcttgttaacctctattgttttgtatcagtgggctacatgctcatctgaagaatgaatggaattagcacagtatttttaagcaattagttggag

SEQ ID NO: 6792134 - DNA, 103 bp, Homo sapiens
gagacaccccctggggggcaagaagcagcacagcaatgactctattccccgggatggagtggaatcattgctgtgttgcttcttgcctttcccacctgggctc

SEQ ID NO: 6792135 - DNA, 61 bp, Homo sapiens
gaatctagcctttcaaggggtagagtctgttttccctcctcttgaacctaggcaagacttc

SEQ ID NO: 6792136 - DNA, 77 bp, Homo sapiens
gcacccagtacctagtacattcgcttgctggcttttcgtggggccctccagctcaagcgtgggctgggcgcgggtgc

SEQ ID NO: 6792137 - DNA, 56 bp, Homo sapiens
gctttcacagtcatatgatgaattttcttataggttaccatagagactatgaaagt

SEQ ID NO: 6792138 - DNA, 57 bp, Homo sapiens
acctcagtgcttgccaggtgtgttacaagccactttggaataatcaagctctgaagt

SEQ ID NO: 6792139 - DNA, 58 bp, Homo sapiens
tagtttagcactaagaaaaacaagagtccggggacaggttgttggaggtgctgaatta

SEQ ID NO: 6792140 - DNA, 81 bp, Homo sapiens
attccctcttcaccagtttggcagtctcatcttcagagcaaaagatacggtgtgaggctgaaactggcgatagagtgggat

SEQ ID NO: 6792141 - DNA, 86 bp, Homo sapiens
agaggctaatttgcccaaggttttgtagctaggaaacagcagaattgggattttcactgcttttttggctatgtacattgtccttt

SEQ ID NO: 6792142 - DNA, 68 bp, Homo sapiens
cctggtgatactgttggtagaaagttaaagctttgaaacgatttgaaaatctacaaagtggcatcagg

SEQ ID NO: 6792143 - DNA, 102 bp, Homo sapiens
ttttccatctgtcacatggaaatccttttctatacagcataagtgaacacttctcagctgtgctccataagggagaggcaattccatgaagggcagggagag

SEQ ID NO: 6792144 - DNA, 75 bp, Homo sapiens
ttatggttcaaataccaagtgataataggaaagcatgataaatagctctccattaaaatgcttgggatactataa

SEQ ID NO: 6792145 - DNA, 57 bp, Homo sapiens
gagcaggatggcacttctgtgaagtgggctgatgctcacacagtgctgtcactgctt

SEQ ID NO: 6792146 - DNA, 82 bp, Homo sapiens
tggtacctgaagagaggttttctgggtttctgtttctttaatgaggacgaaacacacctggttaacctcttttccagtatca

SEQ ID NO: 6792147 - DNA, 103 bp, Homo sapiens
ttgagatggagtcttgctctgtcacccaggctggagtgcaggggtgcgatctcggctcactgcaacctctgcctcccgggttcaagtgattctcctgcctcag

SEQ ID NO: 6792148 - DNA, 65 bp, Homo sapiens
aaaataatggtctttttgttatgagagaggcttagcttttctctttcaaaggaaaccatcatttt

SEQ ID NO: 6792149 - DNA, 76 bp, Homo sapiens
accttcttttgggattattggaatgttatatttgcagagcaagtcagacacgttttccattagtactaaaagttgt

SEQ ID NO: 6792150 - DNA, 58 bp, Homo sapiens
cagacaggttgcaaaacttcaaacagaagagagttgttggagttatgtgatatgtgtg

SEQ ID NO: 6792151 - DNA, 65 bp, Homo sapiens
gaaagtattataggatggaccccaaattctgaagtcactgggatttggaatctcctaatgccttc

SEQ ID NO: 6792152 - DNA, 62 bp, Homo sapiens
acaaaatcactttctgttgcagtagatcaaagatctagctgtgcccagggaagttgttctgt

SEQ ID NO: 6792153 - DNA, 58 bp, Homo sapiens
gcttttatttcctccttaatagaggaaaaatgctctgtgaattgaggacatcaaaagc

SEQ ID NO: 6792154 - DNA, 85 bp, Homo sapiens
ggctccggcgaggccactggcacgcccacgtaggcactgcacttcacagtttgcaaagccttcctgtggccaccttgtccgagct

SEQ ID NO: 6792155 - DNA, 57 bp, Homo sapiens
agaaggcaaagagatgacaggggccagatcatgatggatgttatgactttgcctttt

SEQ ID NO: 6792156 - DNA, 87 bp, Homo sapiens
tttcaagtgccctttccctgcagccctcctttcactcccaggttcccttggggtaagtgggggctggggggagtggtaaagatggaa

SEQ ID NO: 6792157 - DNA, 61 bp, Homo sapiens
agtcctggtgacactcctcttcattgcctccatttggcaagtggatcctcaactgtgggct

SEQ ID NO: 6792158 - DNA, 67 bp, Homo sapiens
tgaaatggttttgctttagtattctactctaattagaaagaatacaccacaggccgaaatagtttca

SEQ ID NO: 6792159 - DNA, 75 bp, Homo sapiens
caggtttgtctgattgctggattagcaggtgccttccaacttgctcaatccttatgtaattccttgatcaacctg

SEQ ID NO: 6792160 - DNA, 62 bp, Homo sapiens
tgtgccctcagaagagtacatcagccaaaccaagagctaagacttgcagcttatgagggcca

SEQ ID NO: 6792161 - DNA, 91 bp, Homo sapiens
atatgactagaaatttctgtggaacatgtccatatacattttaatagaaatgtatatagaaatgtctaaagataatggcctaatagcatat

SEQ ID NO: 6792162 - DNA, 70 bp, Homo sapiens
aggttaggaaaatggagtccttttatcatgttacataatgcaaagtcaaaagaaacaccatgttcctcct

SEQ ID NO: 6792163 - DNA, 66 bp, Homo sapiens
gtcatagatttcatctgatttgatccctctttcttcagatgagggcgcttcagagagatgaatgac

SEQ ID NO: 6792164 - DNA, 76 bp, Homo sapiens
ctggcggcagccccggggtggggagacgagctccggagtcggaagagctgggttttcttccgggcctagccaccag

SEQ ID NO: 6792165 - DNA, 67 bp, Homo sapiens
gaggcgggtgatcacctgaggtcaggagtttgagaccagcctgaccaacatggtgaaacctcgtctc

SEQ ID NO: 6792166 - DNA, 69 bp, Homo sapiens
cagacccggttaactctagagccgtccctttgctaccacccggtaaacgattcctctggaggggctctg

SEQ ID NO: 6792167 - DNA, 119 bp, Homo sapiens
ctggactcattgattttctcctcccccccacttacattgtcattctatgctattcagttgtattttataattgggtggtggcagtaatgagaaagaagagtatgagaaatgatgtttag

SEQ ID NO: 6792168 - DNA, 55 bp, Homo sapiens
taggaaccagagcactctgggcacaggaatttttggccagtagcctggtattctg

SEQ ID NO: 6792169 - DNA, 90 bp, Homo sapiens
tgcaaactcccaacagtgtgttttgttattaagagagaaatttggtggttttggctttgatgaggaagcaactgggagggagagaatgca

SEQ ID NO: 6792170 - DNA, 65 bp, Homo sapiens
caaattctttgaatacaaactatctgagcactaatctcagatgcagacttggttcaggcagtttg

SEQ ID NO: 6792171 - DNA, 66 bp, Homo sapiens
cccagggaatgactctggcctttttcctgggccccattggcctgggaccagcagagcagccctggg

SEQ ID NO: 6792172 - DNA, 80 bp, Homo sapiens
catactcttacataccatacatggtgagatgaaatcctatttcaggatcatagccgtatggccagatgtaagaaagtatg

SEQ ID NO: 6792173 - DNA, 59 bp, Homo sapiens
gtggccatgttgctttcctttggctacataaccggaaaaggattgtttttactggctac

SEQ ID NO: 6792174 - DNA, 67 bp, Homo sapiens
gctagagatgcactttcttttcaacagttctaagaaatgagaaggttagatatcaaggcatctcagc

SEQ ID NO: 6792175 - DNA, 89 bp, Homo sapiens
gtagtttctgacacacagagcaggtgctgggaagatgctcatcatcattttcctcccatgcacattgttctctaaaactcagtcactgc

SEQ ID NO: 6792176 - DNA, 121 bp, Homo sapiens
cccatacaaaatataatgtccatgcaatatttatttaaaagtttattttagctccggaaaggtgttgaagattattctattaaaagttgaattgtgtttgggatattttctattgtatggg

SEQ ID NO: 6792177 - DNA, 79 bp, Homo sapiens
tggagtgtttcctcctattgtggttttcatgattgtgctatgaagtgttcttggaaactaggatggaagaaatgggcca

SEQ ID NO: 6792178 - DNA, 101 bp, Homo sapiens
taggaggattaggttaaaacttgttttggaacagagtgaatggagaaatgtacaatctattgatttagctcaagacacatgttttaaagaaattgggactg

SEQ ID NO: 6792179 - DNA, 79 bp, Homo sapiens
taaactcttcctgaacttttctgtgatgctgacagtccgatgtggtggggctgcagctatgggaaataggatgggtttg

SEQ ID NO: 6792180 - DNA, 66 bp, Homo sapiens
gggtcaaagtgtccttggggtgaatacattgtacttttaaaatttacagacattcaattttgaccc

SEQ ID NO: 6792181 - DNA, 81 bp, Homo sapiens
gtttatgagagcgtttcacagcccagaaagcctaagggggttaagtctccattctttctgaggctgccaactctcacagac

SEQ ID NO: 6792182 - DNA, 98 bp, Homo sapiens
gtgaccagggcggggcctggaatagtggcctcaggggcagaaaccacttccctcccctcaccaaggcctcctggctccaggccttgctatggtgtcac

SEQ ID NO: 6792183 - DNA, 64 bp, Homo sapiens
gctaagtggcttttgatcttgctgcagagtgaagatgccccacagaagccaggagccgctgggc

SEQ ID NO: 6792184 - DNA, 82 bp, Homo sapiens
gcctggctgctgctgtgacagagtctcatggaggcggcactgcctccagcagccacacctctggacacggaaggcagtctgc

SEQ ID NO: 6792185 - DNA, 59 bp, Homo sapiens
tctgcttactggattgtggggaggttccagggtgggggccgggcagccagtgcagcagg

SEQ ID NO: 6792186 - DNA, 85 bp, Homo sapiens
cctttgctctttattcctttatagttgtatctattccaaccaattcattttgggggaacacatttattaagggatgttgacatgg

SEQ ID NO: 6792187 - DNA, 84 bp, Homo sapiens
cgtttttgactaggcatcttctttggatgaaagaatatggtcgccatctgtaacacacagaggagaatctgtaattcaaaaatg

SEQ ID NO: 6792188 - DNA, 78 bp, Homo sapiens
caggatgagtctgctcatgctaccgcgggccgcccagcaaggaagcaggctgcccgccaggctggcacgcgcctcttg

SEQ ID NO: 6792189 - DNA, 76 bp, Homo sapiens
gacgaagtgaattcttctctttctcagggacgcagccttggaccacgtggccctctgatacagaagaatgtttgtc

SEQ ID NO: 6792190 - DNA, 62 bp, Homo sapiens
gtgcacacaagcacatgcatacatacctgcacatacatgcacacacgtgtgcttgtgtgcac

SEQ ID NO: 6792191 - DNA, 88 bp, Homo sapiens
cacctgtggcaggactcaggcaggagcagtttgtggacaacctcatctgtctactctactgtctgtgcctaggccagagttatgggtg

SEQ ID NO: 6792192 - DNA, 91 bp, Homo sapiens
catgcatagcttttacatctattaggctctatttgtttttgctttctcggataaggactttggggtctacaaattaatgtgaaacttgatg

SEQ ID NO: 6792193 - DNA, 66 bp, Homo sapiens
gctgtgtctcatttcctcctgctgtgcccgtgatgtcctggcccagtgtgacgaggtgaggcaggc

SEQ ID NO: 6792194 - DNA, 130 bp, Homo sapiens
tttgtcaaaatgctactttataaatattgataattaatttcagtaatctccttaggtttacagtaatatactatgtggtacatgggacattgacattaattattaagattataatgcaaattttgactga

SEQ ID NO: 6792195 - DNA, 82 bp, Homo sapiens
tcatactgaggagccaacttagaagaaatttgattgttattcttactatgtcaatgtgtttatgtctggcttaaaagtatga

SEQ ID NO: 6792196 - DNA, 64 bp, Homo sapiens
cactgtctgtgtgtccttggggcaaattccttcacttctcatccttcggattgcatatacagtg

SEQ ID NO: 6792197 - DNA, 63 bp, Homo sapiens
gtttcacagcaaagttccctgttttattaaaatccaccaggggatgttttcaacttgtgaaat

SEQ ID NO: 6792198 - DNA, 78 bp, Homo sapiens
tcctgcaaccatttctattttaggatctgagtacttccttgagatgtaccaagaaaagggattaaatgtgtgtcagga

SEQ ID NO: 6792199 - DNA, 56 bp, Homo sapiens
agtccggggtctggacacctggtccctctggctggccaggtcttggtccttggact

SEQ ID NO: 6792200 - DNA, 80 bp, Homo sapiens
acatggtttctgtctcttttcaagctaccctttgtccagggtgtgtcaaagagtagctcaagaagagacagaagtcatgt

SEQ ID NO: 6792201 - DNA, 66 bp, Homo sapiens
cagaaagcagagctgagcctttcacaatttaggagtccaagttcagcgctgcttctaacacatctg

SEQ ID NO: 6792202 - DNA, 84 bp, Homo sapiens
gactggtttattcactactgtcctcatttgtttgaacacactacaatgttctgtgggatagtagctgagagacaagcaatagtc

SEQ ID NO: 6792203 - DNA, 77 bp, Homo sapiens
attctttatctttgttttgttttctggcttttgcaaagaattgtgcaaaaggtagttgccaaataagggtaattaat

SEQ ID NO: 6792204 - DNA, 74 bp, Homo sapiens
gtgatccttacctccatgtgggcccttcaccagcttgggcctcatctctggtgtccagcatgtgtggaagtcac

SEQ ID NO: 6792205 - DNA, 77 bp, Homo sapiens
ttccatccgcgaatgtttagcttgttggaacaattgatttgtcggttccagaagcgagtaaactgacctgcgaggaa

SEQ ID NO: 6792206 - DNA, 79 bp, Homo sapiens
gaataaagatctttctaggcttggctttagtttctgtgtagtatgtagaggaatatagttgtgctttgaagattgtgtc

SEQ ID NO: 6792207 - DNA, 99 bp, Homo sapiens
ctccttctttcctccctctctctgggctttgtcctgagacatccggaaaggaaagggcagtcagacagcagccacagggagagggtggtaagtggggag

SEQ ID NO: 6792208 - DNA, 60 bp, Homo sapiens
tctctttagtgcttagacgtctggtcaataaagacaaaccagaacaagtactaaaggaga

SEQ ID NO: 6792209 - DNA, 72 bp, Homo sapiens
tcagcatagctgtattaattgttatgatactgaaattcttctgaatcactggctaaataactgctgtcctga

SEQ ID NO: 6792210 - DNA, 72 bp, Homo sapiens
tgagccagtctgtctgggtgaaatttttagctccccatatactaactatgtgatctcaggcaagacagctta

SEQ ID NO: 6792211 - DNA, 66 bp, Homo sapiens
ccaattcatttcttcccctggttcccatgcctcctgcaggctacatgttggggtggaaggagctgg

SEQ ID NO: 6792212 - DNA, 56 bp, Homo sapiens
tctgtctgtgtgcatgacatgtgttatgaagaaaacacattgaatacagagatgga

SEQ ID NO: 6792213 - DNA, 103 bp, Homo sapiens
ggagtccacaggtctgaaatccaggtgtgggcagggccgtgctccctccgaaggctctaggggaggatccttgctcaacttatttttgagacagtcttgctcc

SEQ ID NO: 6792214 - DNA, 88 bp, Homo sapiens
tccagcccactgggtggagttgatcagagtaggaggtcatcacctgaccctcttgggctgatcagagtctccctcatgggactctgga

SEQ ID NO: 6792215 - DNA, 64 bp, Homo sapiens
gatagttgcctgggatttggaatgcacctctaccatcagtgggatacagatccaggcagctatt

SEQ ID NO: 6792216 - DNA, 83 bp, Homo sapiens
ggcaggtttgtgtgtggggaggcagcagatgttggtgatgagggaagctggcagacctgcccccgctccaccacctgacagcc

SEQ ID NO: 6792217 - DNA, 111 bp, Homo sapiens
gtgtagggagtgaaaggtgaggaagcagctgtttggtttagtgactttgcagtcatgcaaaggcacagaagggaaaccaaacagatttccttaacctttcagtccctagac

SEQ ID NO: 6792218 - DNA, 64 bp, Homo sapiens
ctttttgcctgagggcttcttcaagacagaagaatatgcacactctgcccacagagcatggaag

SEQ ID NO: 6792219 - DNA, 56 bp, Homo sapiens
tcattgatggcttctttcttgctgttaggaaggccaagccagagaagctaaaatga

SEQ ID NO: 6792220 - DNA, 56 bp, Homo sapiens
cctgatgagggaagtttttttgagcacgtgctatgtatctcagaccctgtgtcagg

SEQ ID NO: 6792221 - DNA, 84 bp, Homo sapiens
ttgttgtcccattcttcatacaagtctaagaactacttttgattatttttgtatgccttagattttaagaagggaggtaaataa

SEQ ID NO: 6792222 - DNA, 61 bp, Homo sapiens
tagggtggatggtctatggcgtccttgcaaagtcagctgtggcagtctattcctcccccta

SEQ ID NO: 6792223 - DNA, 76 bp, Homo sapiens
tggctctagagcaagctggaggggctcatgaatattcattatcaatttgtattcagagttggtttttttagaggca

SEQ ID NO: 6792224 - DNA, 130 bp, Homo sapiens
ttcaggactgtctcaagcaactggggtcctcagagatgcttggattgcattttgctagcaactatttttcactaggcaatggggcttcaggcaggctctttcaggaacacattcaccaatttgctcggta

SEQ ID NO: 6792225 - DNA, 55 bp, Homo sapiens
gggggcatgagatggagctcacctgagtggatgcgcctctccaaatcctgccttc

SEQ ID NO: 6792226 - DNA, 63 bp, Homo sapiens
agaatgaattaatcaactggaagacaagattcaggaagtcttccagaggaagaagtcatgact

SEQ ID NO: 6792227 - DNA, 74 bp, Homo sapiens
ccaactgtgaaagcatgcttgccaagctttcagcaccacagcatcgggggaagcgggaggcacgtttgtactgg

SEQ ID NO: 6792228 - DNA, 67 bp, Homo sapiens
ggatgccatgcgtttcttctttagcaatgattaagaataactgcagaggaaatgcatctgaccatcc

SEQ ID NO: 6792229 - DNA, 130 bp, Homo sapiens
tctgtaggtacaaatgaagctgtcaaatttgatcaggcgcttgatatgacaggctgtgggagtcaggaccccttgaacagagtgggccttgtctgtcacagtccgcctgacacttcccataatgcccaga

SEQ ID NO: 6792230 - DNA, 94 bp, Homo sapiens
aggcaacagatttattgttcatattgggatttatgacctaatctaaagggttaaagttgtgaggattaaatgagctaataaatagaaagtgctt

SEQ ID NO: 6792231 - DNA, 130 bp, Homo sapiens
ttatttgtaaacatttttaaagatattattcagatgagcattggaacttaggtaaaattttcaaaattgatatttaactggtcccaatatattttttgaattagagtatatatacatcactgactcttaa

SEQ ID NO: 6792232 - DNA, 70 bp, Homo sapiens
gtgggccctgggccaagatgccagggtctcatccagttgtcagtgacctggctctgggcaccgtgtccac

SEQ ID NO: 6792233 - DNA, 93 bp, Homo sapiens
ggaggctagaaatctgaaatgaaggtaatggcagagtcatgctttctgatagctctatgggaagagaatctttccttgccttctctggcttcc

SEQ ID NO: 6792234 - DNA, 80 bp, Homo sapiens
ctagctcagatatttaagtgataaagcttctgaaataaatgacacattgtttgaaacccgtcactttgagtgtctggtag

SEQ ID NO: 6792235 - DNA, 101 bp, Homo sapiens
cttagattccagacatggccctgctcaaagcccagatgggagcatttcatataatgaggccttttctgtctggctactagtgggctctcttgatatttaag

SEQ ID NO: 6792236 - DNA, 74 bp, Homo sapiens
ctccctatcagcgctggcccacacctaatcgttccagctagcacccaggagtgggctcagcttccagtggggag

SEQ ID NO: 6792237 - DNA, 72 bp, Homo sapiens
gctaggaagcactgtgctgctaagttgtcaatgaaaacctttaataaccctgtatttacgtgctatcctggc

SEQ ID NO: 6792238 - DNA, 73 bp, Homo sapiens
gactattttctaatcatgccacatgtagggaccatcttggggacaagacagcatctgtgtggcaggagtagtt

SEQ ID NO: 6792239 - DNA, 64 bp, Homo sapiens
actctttgtctgttgccgcttactctaaagatggtctttcttaaacaacagaacaccaaggagt

SEQ ID NO: 6792240 - DNA, 101 bp, Homo sapiens
tctgtgatggtgggtttgagaagtggtgaacaggagaaagtgatggaagggagactttccaatgtgtgcctgtttatatttttaggctttgagtcacatga

SEQ ID NO: 6792241 - DNA, 65 bp, Homo sapiens
caggagtttcctctggcctataagcctttttctactacctggttatggcagtgagaagactcctg

SEQ ID NO: 6792242 - DNA, 89 bp, Homo sapiens
ccgagtgttctgtaaactgctgattttaggactgttaccagatgtcttcacagtttaacagttaagagcagatagtaaagaagtcttgg

SEQ ID NO: 6792243 - DNA, 61 bp, Homo sapiens
gggagtgctggaggtgtgagtgggaccctaacccccacctctacccaccccagtggatccc

SEQ ID NO: 6792244 - DNA, 72 bp, Homo sapiens
ctgttctcttttcctgctgagccaactgagggggagcctagccaggaggagcggcagatggagtgggagcag

SEQ ID NO: 6792245 - DNA, 59 bp, Homo sapiens
agaattgagctttggaggggtccaggagtggaaggtccaacatggggaagctcagattt

SEQ ID NO: 6792246 - DNA, 107 bp, Homo sapiens
tcctgcaggaggtttagggtccaggtctggggggtggccagcacatcactcacatgcatattttggtggccagaactcagacatgtggccccatctaacttgaggga

SEQ ID NO: 6792247 - DNA, 76 bp, Homo sapiens
ttagtccccttcataatctgaaatttgtaaggtgttatctccgttttacagataagcacattgtgactgggaagag

SEQ ID NO: 6792248 - DNA, 76 bp, Homo sapiens
aaatatagatgcctgggtgatatcccagttatacattattagtgtctctggagagggagccctggcagttgtgttt

SEQ ID NO: 6792249 - DNA, 88 bp, Homo sapiens
aatgtttttccctttctcattctgctctgaacgaagtctttttggtcagataagtcaatgtatctttaattcagagaggtgaaacatt

SEQ ID NO: 6792250 - DNA, 92 bp, Homo sapiens
ctctctcctagtggcaattgaataactgcagttggtgacaataaccctgtgtttctgtggcgttcaccacattgcggtgtagctggaggaag

SEQ ID NO: 6792251 - DNA, 73 bp, Homo sapiens
gcatatcacctagcagagcactactgcattaataattcatcacttaatgtgtacaggccttgctagactctgc

SEQ ID NO: 6792252 - DNA, 71 bp, Homo sapiens
atttggcagggttcctctctagcatttggtaataattccataccaaatgctagggagaaactctcccaaat

SEQ ID NO: 6792253 - DNA, 56 bp, Homo sapiens
tcccctaggccgaagtgaggtaccttgtctaaggtcctgtttcttccctggggaga

SEQ ID NO: 6792254 - DNA, 55 bp, Homo sapiens
aggctttgtggtagtggcattgttcctaaagagtgcatgaaagcatacaaggcct

SEQ ID NO: 6792255 - DNA, 107 bp, Homo sapiens
ggaggacggtgccaggtgtctgcaggccctgggcaggatcagccagtatccagctggactagaaccaagagcccttgggcgctggagctgcttgggcctgtgcctcc

SEQ ID NO: 6792256 - DNA, 57 bp, Homo sapiens
ttgtccttacctcaatctggaatgggagattcccatctgtcagatcaggaaggataa

SEQ ID NO: 6792257 - DNA, 61 bp, Homo sapiens
gtgacagaaacagggctagaatgcaggtctctcgtccctactctgccactttttctgtcac

SEQ ID NO: 6792258 - DNA, 77 bp, Homo sapiens
aagtggtttttcctgtcgaatacagacaaggcttgggcccgcatctcagtcttcatttgtgttcaagacatctactt

SEQ ID NO: 6792259 - DNA, 60 bp, Homo sapiens
cattggcctgtctttgtataccactggtcatattggttctatgtagtagcagagccaatg

SEQ ID NO: 6792260 - DNA, 130 bp, Homo sapiens
aggtagccctgagacacttcagaggcaaatttcactgggagcggctgtcactggtttgctttcaccatccgcaaatctgccctttcccagtggtttttctcatctacaatcccatgtctcaaagttgctt

SEQ ID NO: 6792261 - DNA, 85 bp, Homo sapiens
tgtggacagggatggggaggctggggggcagaggcttgctgatgagtttggtgtctccccactggtcttccagtgcccatttgta

SEQ ID NO: 6792262 - DNA, 60 bp, Homo sapiens
gtaatgtattcctttttctttctgttctgtcttgggtggagaggaagaagagtgtattat

SEQ ID NO: 6792263 - DNA, 75 bp, Homo sapiens
gtttatcgcaatgtttagaattttgttatgttcaatcgaggactttacaaaattgtgttaaactttatgatggat

SEQ ID NO: 6792264 - DNA, 74 bp, Homo sapiens
agccttttgggaactgattaagtcatgagaacatcacccttgtatatggaattagtgtccttataaaagaggtt

SEQ ID NO: 6792265 - DNA, 75 bp, Homo sapiens
tcctttccttctggccatgcaacctcttctgctccatggccagttcagaggacacatgactccagcaggagggga

SEQ ID NO: 6792266 - DNA, 55 bp, Homo sapiens
cagagatctgagagcagtcagggagtctgtcctggactttcttaccagatttttg

SEQ ID NO: 6792267 - DNA, 56 bp, Homo sapiens
tctttatgtacatatccacaaggaaccaaaatactggatctatatggacatagaga

SEQ ID NO: 6792268 - DNA, 130 bp, Homo sapiens
gcagtttcaggaaagtctgccaggcatgagctgagaccttaagagatgtcagctagaattagccactgtcagtatatctgcttctgggtcccactcttcatcctgcttttcaaggttttcaaatatacac

SEQ ID NO: 6792269 - DNA, 59 bp, Homo sapiens
gtcactggtttcaaaggaccgcacaacttgttaagttgtgaagtgttctgagacagggc

SEQ ID NO: 6792270 - DNA, 58 bp, Homo sapiens
atcaagttggattttgtatggctagatacagatggtgccatacagatgtatccatgat

SEQ ID NO: 6792271 - DNA, 84 bp, Homo sapiens
attctgggatctcaagattccagaattgggagccttgaggatgattctacaagtctcagttttggattcaaaggatcctgtgat

SEQ ID NO: 6792272 - DNA, 76 bp, Homo sapiens
tggaacctcagtgtctcaaaacaagttgcttcccaatttggggaccaggctgtgaagtgagactagtgacgtttca

SEQ ID NO: 6792273 - DNA, 64 bp, Homo sapiens
agtggaagatttttcggtagctaaatgagaattgctcatcaagtcatcaaagaattcatcggct

SEQ ID NO: 6792274 - DNA, 63 bp, Homo sapiens
ttgtgtctaatagactatagcagttttctctcttttatcgattctgtcatttgttagatgcaa

SEQ ID NO: 6792275 - DNA, 70 bp, Homo sapiens
gagcctgcagctgacttcataggaagacacaaaatagttggtgtctcccttttgagaggctcagatgctt

SEQ ID NO: 6792276 - DNA, 80 bp, Homo sapiens
caaggagagtccaggtgtggctggggcagaggcctttgtaaggcaggttctatgccaacacctgtctatggacatccttg

SEQ ID NO: 6792277 - DNA, 81 bp, Homo sapiens
cactgcctaggcaggttcgttccacaatggacctgagtgcaaagggctcccagggggatgaacactgcctggagatgcgtg

SEQ ID NO: 6792278 - DNA, 125 bp, Homo sapiens
gagagtccacctcagtcaagaactccttcctctgaaatggcttggaaaaatcaatttgccttcctgtctgagatttcttggtcacttttcacggacataggtgtccttggtatgcagtagctctt

SEQ ID NO: 6792279 - DNA, 58 bp, Homo sapiens
ggtggccaggccagctctggccctgtggggttcctgagaaggctggccctgggtggcc

SEQ ID NO: 6792280 - DNA, 81 bp, Homo sapiens
attccaagacaaaacacagctttcatcatgacacatctctgttcagacttcttgactggctttgctttttgtgttgtgaat

SEQ ID NO: 6792281 - DNA, 92 bp, Homo sapiens
tatcaaatgtgttttatatgtatattcttcctgaagtaagaaaaagttctggaattttgagtcagagaatgtgaatattaaaccatcattta

SEQ ID NO: 6792282 - DNA, 88 bp, Homo sapiens
gggctacctgagattgcaggtgccaccagttgcaatctgggccacatgcaagctggtgtcacctccagtccaccagtgaatttagccc

SEQ ID NO: 6792283 - DNA, 74 bp, Homo sapiens
cctggcacacaggatgaaatcagtgtttattctgtattgtgcaattattactgttacttcacactgtgtccagg

SEQ ID NO: 6792284 - DNA, 69 bp, Homo sapiens
gctcatgattctgcaggctgtgcaagaagcatggcatcagcctctgcttctggtgaggcctcaggaagc

SEQ ID NO: 6792285 - DNA, 97 bp, Homo sapiens
tggaaaatagcagtctgggttactaaaggattcttgattgtcatggatgagtatcacatgaacaacagatgtccattgttactaactgccttagcca

SEQ ID NO: 6792286 - DNA, 130 bp, Homo sapiens
gtgggaaatagaggtggcacaagcctcagctggcattcttctttccacttctgggccaaattctgccccaggctgcagaggtgtacagagggaggccagctcagggagtgtgtcatctgtcagggcccat

SEQ ID NO: 6792287 - DNA, 81 bp, Homo sapiens
gcccagcagctctgatttccttattctgtcaccagtcagatctcttccctgaagtgacagagtcggggcaagctgtgaggc

SEQ ID NO: 6792288 - DNA, 55 bp, Homo sapiens
ctactgagtccttcagctgccattcttagactggcaccatgaaatattccggtag

SEQ ID NO: 6792289 - DNA, 74 bp, Homo sapiens
tatatagcatgattactaatttcttgggaacaaaggtgaaaaccttgacagtcccaggaaaatagaactatata

SEQ ID NO: 6792290 - DNA, 130 bp, Homo sapiens
acattgagcaaatttggctgcattggggcattcacttggtttcttcaaagatgtctgttggagctattcccatacccactgaaggatctgtagtcttgtcttcattctatgtagccatgttcaaggatgt

SEQ ID NO: 6792291 - DNA, 100 bp, Homo sapiens
gtataccaccgatatcctggtgttctcagcaacaaaactgatgggaggaatgtccattctgtgtgtactgagatgggcttggatgtgtgtgtggcaatac

SEQ ID NO: 6792292 - DNA, 69 bp, Homo sapiens
ttgtctttttgtagaactgatatcgatgctgagatctaaagtagaagaagtcagccctacagagagcag

SEQ ID NO: 6792293 - DNA, 121 bp, Homo sapiens
gagctgcccagttgggagtcagccccactctcctcaaaggccctttagcagaggaggggactgcagctcctccaggtctagggtggcttcagggtggaaggcactctccctgacatagctc

SEQ ID NO: 6792294 - DNA, 66 bp, Homo sapiens
tctgctgcctatggctaattctttactgaccaaaccttggtgatgtggtggtgccaatgcagcaga

SEQ ID NO: 6792295 - DNA, 65 bp, Homo sapiens
agttcgcacaggcacagacactgggatgatgaggggtaccatcccactgtcttctcgtgctcgct

SEQ ID NO: 6792296 - DNA, 65 bp, Homo sapiens
aggcaagacttgaactcaagcagcctggttctggagacggtgctgagctgctgttcatcctgctt

SEQ ID NO: 6792297 - DNA, 69 bp, Homo sapiens
ggaactgggttagggtctcttcccccgtccacagatattggggtatgtgggtccctgagtcttcggtcc

SEQ ID NO: 6792298 - DNA, 63 bp, Homo sapiens
gaagcccagctgtctggttccagagccagtgttacatggctctgacctcccaggcagttcttc

SEQ ID NO: 6792299 - DNA, 127 bp, Homo sapiens
cacagccttcctttcccatagactcctgccttcgacgcctcctggttgcaatgaaatggttcttacgaccgcttgggttgttaggggttttggtagtgcaggtgttttttgcaaggggagggctgtg

SEQ ID NO: 6792300 - DNA, 56 bp, Homo sapiens
ctgtggttgggctaggactaggaccttggaccttagacctctgctctaaccattag

SEQ ID NO: 6792301 - DNA, 55 bp, Homo sapiens
gtgctggccctgtcctcgagctgcttccagtgcagcggggagggcaggaccaggc

SEQ ID NO: 6792302 - DNA, 65 bp, Homo sapiens
gaagatgctagctgtctgaagctctgaagcaaaggctttctaggtagcgatacagcagcacgttc

SEQ ID NO: 6792303 - DNA, 58 bp, Homo sapiens
tcgccgaggctggagtgcagtggcgcgatcttggctcactgcaagctccgcctcccgg

SEQ ID NO: 6792304 - DNA, 95 bp, Homo sapiens
cccaacacattaaagtagaattggcagacagtgttacaatttaatggaatttcctcctttaacattagcattgtttctttttgcttatttttggg

SEQ ID NO: 6792305 - DNA, 65 bp, Homo sapiens
ccctgaatctatctaatcttcagctgtgaacactcagaaacactaatgcagatggagattcaggg

SEQ ID NO: 6792306 - DNA, 109 bp, Homo sapiens
gatccaattgctgaggagtacaggcgaggtagctgtcagtttcctctggtgtcttcaacgaaagtcacaggaaacaggcagcctttgaacctggtcttgagcgatgatc

SEQ ID NO: 6792307 - DNA, 116 bp, Homo sapiens
gagttctgggcaataacacaagtcctaaaatattgatgtggctacttctaaagtatagcaatattacatagttatatgcagtgtgtcattcaagctgttttcattgcccagaaatc

SEQ ID NO: 6792308 - DNA, 58 bp, Homo sapiens
gctgggcctgtggcttggctctagggctgcttctggccccctaggcacagagcccagc

SEQ ID NO: 6792309 - DNA, 60 bp, Homo sapiens
ggctgtcctaagcttctaaggtgtcctcccggacagtatctagaatggctgggcacagct

SEQ ID NO: 6792310 - DNA, 80 bp, Homo sapiens
acagcccttgcttggctgtgcagtcagatgggtgagaagaaggatccacagaagcaaagactcaggcaagcccaggctgt

SEQ ID NO: 6792311 - DNA, 59 bp, Homo sapiens
tggcaatttcagaaaatagaataaagattagtcttagtttagttttgatgaaaatgcca

SEQ ID NO: 6792312 - DNA, 66 bp, Homo sapiens
gatcagaaattcagctgactccacatggttttaaggaaatgcaatgtagttaatgagcttttgatc

SEQ ID NO: 6792313 - DNA, 90 bp, Homo sapiens
agaagggaagctgttaggggaaatgagggggcaacattcctggctttttctgcaggactagaaatgtcgtctccacatttgctcccttct

SEQ ID NO: 6792314 - DNA, 74 bp, Homo sapiens
gtagctattttggagtcagatgactgtaggacacacaagattatgtgtcttttgtatgactgccaattagttac

SEQ ID NO: 6792315 - DNA, 75 bp, Homo sapiens
ggcctgggagggcagatggggcacaggctgagctcggggtcctctgcttagcctgccctcgtggccttccctgcc

SEQ ID NO: 6792316 - DNA, 64 bp, Homo sapiens
gcatttattttgtgccaagcactgttccacgctctttatatgtgctggcttatttagtaaatgt

SEQ ID NO: 6792317 - DNA, 55 bp, Homo sapiens
aaggcttcttatgcaattgtttttgaccttacaaggacatctgcttttgagcttt

SEQ ID NO: 6792318 - DNA, 73 bp, Homo sapiens
ggataaatagttcttatctagaagcatgttttaagtgttcttattgcaatctctgagaaagtactgtatgttc

SEQ ID NO: 6792319 - DNA, 58 bp, Homo sapiens
ttccagtctgtttctgagaaacagaacctgttcctcaggttctgttgaaatactggaa

SEQ ID NO: 6792320 - DNA, 60 bp, Homo sapiens
gaatactggaaaactcattttattgaattatttcatattgaatggcaagttctagtattt

SEQ ID NO: 6792321 - DNA, 70 bp, Homo sapiens
tcttgaaattcctgccaggattcctattctgtctcagcttgggatccagttctaggctaggggagtaaga

SEQ ID NO: 6792322 - DNA, 72 bp, Homo sapiens
gcaccagtgtggaatatactcagaacaggctcctctgagggatggggagctctggtatttctttaatcctgc

SEQ ID NO: 6792323 - DNA, 75 bp, Homo sapiens
gagcagtattcacagtggaaacagctaagccttgaggcaaacatatcagggcttaaaatcttgttccacttgctc

SEQ ID NO: 6792324 - DNA, 68 bp, Homo sapiens
ttgagatggaaaatagaacaggaagagtaatttcaactaaattgagataatgttctgatccatttcag

SEQ ID NO: 6792325 - DNA, 80 bp, Homo sapiens
gtttaaggacaggtgctgcgtggcggagctggtatccaaactcaggacccgctccaaagactggctcctgatccttagac

SEQ ID NO: 6792326 - DNA, 60 bp, Homo sapiens
tgggtttcatcctgactcccactggccagacattgtccactgggcatgatgagtcaccta

SEQ ID NO: 6792327 - DNA, 57 bp, Homo sapiens
tcattcatcagttggtagagatttggactgttcccactttttggctgttatgaatga

SEQ ID NO: 6792328 - DNA, 121 bp, Homo sapiens
tggattcttcttgattcttacatacttgagcaattttggctttatctacttatgcgctttattcagtagatgaatgtgaaaggctcttgatgtgtccaaacaagagatcaaatagacttca

SEQ ID NO: 6792329 - DNA, 78 bp, Homo sapiens
taggagtcgctgctttctgttaggaattgggggcagggggagtttccttccaattaacggagtggcggcgacctttta

SEQ ID NO: 6792330 - DNA, 78 bp, Homo sapiens
cttataatataccaggtccttgggatagaaagatgaataaaatatggaatatttccccaaggagccagatgttaagag

SEQ ID NO: 6792331 - DNA, 69 bp, Homo sapiens
gtgatactgagaatagcaaaagctgtcagaaattcagatctgatatctgctggtattttactgtgtgac

SEQ ID NO: 6792332 - DNA, 55 bp, Homo sapiens
cccctcttggcattgagtgccagtcctctgccaggctctgtgttacaagttgggg

SEQ ID NO: 6792333 - DNA, 58 bp, Homo sapiens
agatcaaggacatgaagaggctgagtgcctccatgagcttcattattttccatgatct

SEQ ID NO: 6792334 - DNA, 55 bp, Homo sapiens
ggccctgttagagctcccacaaccttcctgttgccctggtcatggctacagggct

SEQ ID NO: 6792335 - DNA, 55 bp, Homo sapiens
ttcattggtttgatattgccatggcaactctgcaacatggtaacacgccagcgaa

SEQ ID NO: 6792336 - DNA, 67 bp, Homo sapiens
gaagcaaataacatgacctgtgcttcacagatgaacatctaggggctcagaaatgttaggtggcttc

SEQ ID NO: 6792337 - DNA, 124 bp, Homo sapiens
gctggttgccatgtggagaatggagctgacagcggggctgctgtagagaacatgttgagggcgggcagatggtcccagcaaggtgagggatggcaggacctgcatcagtgcagtggcagtgggt

SEQ ID NO: 6792338 - DNA, 74 bp, Homo sapiens
ggactgctgtgtctcccaaggagggtcactgggtcaaagaggccccctggagccttgtgagaccacaatagtct

SEQ ID NO: 6792339 - DNA, 75 bp, Homo sapiens
gtactcaatttgtcttcttttatttcaagggtgtgattactttagagtcccttggtaaaaggggttatcgagtac

SEQ ID NO: 6792340 - DNA, 75 bp, Homo sapiens
ctgctcatgattattacctacaccgagctcaccaggaccagcaggtgaagtggcaggtgtgtagtatcccagcag

SEQ ID NO: 6792341 - DNA, 78 bp, Homo sapiens
ttggcagcctggaagagctcatatatggtaactatagtgattattattaccatgatcaggctcatccttgtttgctaa

SEQ ID NO: 6792342 - DNA, 88 bp, Homo sapiens
ggggttagggcttgcataggaaaagtggctcagtgttcatgtgtggggttctgccagccactgggccactgccaggaagcccgactct

SEQ ID NO: 6792343 - DNA, 80 bp, Homo sapiens
atgctgatagggtgccttttattgctgtgaaatattggctgcagtgtagacatgatagctggagggcaccttgtaaccat

SEQ ID NO: 6792344 - DNA, 57 bp, Homo sapiens
ctgtaatcccagctacctgggaggctgaggcttgaacccgggaggtggaggttgcag

SEQ ID NO: 6792345 - DNA, 57 bp, Homo sapiens
cggcagccagcggctcgagcatgcgctgagagtttgtgcagctggccctggctgccg

SEQ ID NO: 6792346 - DNA, 76 bp, Homo sapiens
aacatataagtttcccttaaattatggcatctatttggtaaacagtatagaataatctgaggaaatgctatgtgtt

SEQ ID NO: 6792347 - DNA, 55 bp, Homo sapiens
tattctattctccctctcagtacagaatctgtcaggacagggcagcaataggata

SEQ ID NO: 6792348 - DNA, 90 bp, Homo sapiens
atgttctactgtttccatgaagggcagcctctcagtgcaaaaagacgtctctgagttggttactgttcctgaataaatccaagtgaatat

SEQ ID NO: 6792349 - DNA, 58 bp, Homo sapiens
gccagccatccccacagggccccatccttttgtccctgcttccctgggagaggcgggt

SEQ ID NO: 6792350 - DNA, 85 bp, Homo sapiens
cccacctcagacgatgccacggacttgttcctggaaaagttccagagccagccttaccgtggcggctttcatgaggaccagtggg

SEQ ID NO: 6792351 - DNA, 95 bp, Homo sapiens
ggatcccagagtggcctgacccgggcctgctacgccgccccctagataagcttttcggaaagcggctcctgcaggctggtcgctacctggtgtcc

SEQ ID NO: 6792352 - DNA, 87 bp, Homo sapiens
gcacagcccgctcgcttgcaggtctccatgagtgcgaggggaacaagacctttgtgtgctgagggcctgctgtgcaggggactttgt

SEQ ID NO: 6792353 - DNA, 66 bp, Homo sapiens
gttaaaattcaggaggcagtttcagaagtcagaaatctagatttttatagaaatcctccagttagc

SEQ ID NO: 6792354 - DNA, 85 bp, Homo sapiens
acataatttttggttgaggggatgggggctgttctgtggactgcatagcatttagcagcattcctggcttctatccaatgtatgt

SEQ ID NO: 6792355 - DNA, 65 bp, Homo sapiens
gggcatgtggcaggagagacacagccatccctgagggaggggcggttccctgctgtctgatgccc

SEQ ID NO: 6792356 - DNA, 60 bp, Homo sapiens
tgcatctgtagtggaaaccttagcagacagtaactgctctggggctgtcaaatagatgca

SEQ ID NO: 6792357 - DNA, 91 bp, Homo sapiens
gattgtaaactctgggtctatgtgtgtgtctggtatcccatagtgaacagagtgcagtgccaggcatgtagtagacttgcagtaaataatt

SEQ ID NO: 6792358 - DNA, 101 bp, Homo sapiens
tgaggcaggagaatcatttgaacccaggaggcagaagttgcagtgagccaagatcacgccattgcactccagcctgggtgacagaatgagactctgtctca

SEQ ID NO: 6792359 - DNA, 55 bp, Homo sapiens
accctggggtcacccttctctgtatagtcttgataggaaaggaagtccccagggt

SEQ ID NO: 6792360 - DNA, 78 bp, Homo sapiens
acttacaaaggccttttttaaactccaagtctcatgccaactgcatcaaagagagtatgaaacaaggcttctgtcagt

SEQ ID NO: 6792361 - DNA, 60 bp, Homo sapiens
tgccaagtcactagcaagtgggtctcttcaagggctgaggctctccttgccgacttggca

SEQ ID NO: 6792362 - DNA, 61 bp, Homo sapiens
gtgattctgaccttcagggagttccagaataaagttagactcctacatggccatgagtcac

SEQ ID NO: 6792363 - DNA, 75 bp, Homo sapiens
agcagatttgtgtctatggtttgagcatcccctgcctagaaagaagcaaaagatctcaaatcagggacatctgct

SEQ ID NO: 6792364 - DNA, 64 bp, Homo sapiens
ccacccaacgcttctggaagagcccaagccaacgtatggctcaggatcccaggggtgtgcgtgg

SEQ ID NO: 6792365 - DNA, 130 bp, Homo sapiens
tgggcattggggcccggggaccagccaacctcttgaacacctgggtcccctggggcctacccgtgtaagttgagcctgagcccaggtgtgcagaggagaggctgggagccatgcccagccccacagccca

SEQ ID NO: 6792366 - DNA, 73 bp, Homo sapiens
gatactttcttcagcaggtttgtgagattttattattaatattatttctgaagaccttctgagaaggcctgtc

SEQ ID NO: 6792367 - DNA, 62 bp, Homo sapiens
taggttcctcagttgtaaaaaatgtgcctctctggtgggggatgttgataatggggaggctg

SEQ ID NO: 6792368 - DNA, 80 bp, Homo sapiens
cagcccttcctttgcttaggagtttcaggctctcaactgggataggtgggttctggtctcttgaggtgaggaagaagctg

SEQ ID NO: 6792369 - DNA, 62 bp, Homo sapiens
atctatgtcagacgctgtgctagtcagtagcacaagactgaacaacacatgtctacatggat

SEQ ID NO: 6792370 - DNA, 60 bp, Homo sapiens
gtcagctgttgtgctgggcagttaccttatattaacccacaatccccacaacagccaggc

SEQ ID NO: 6792371 - DNA, 77 bp, Homo sapiens
ttcctccctgcaggcagaggaagtctgggtctgaggggtgggctggtatttacccaaagaggcttccttgggaggag

SEQ ID NO: 6792372 - DNA, 83 bp, Homo sapiens
gggctcggggagtgtcctggggctcgaggactagactacttcctgactatccttgaaaggggctgcagggcactcctgagaac

SEQ ID NO: 6792373 - DNA, 59 bp, Homo sapiens
agggacaggccctctggtcagcttggcatctgccatctggtcagtcaggcactgtctct

SEQ ID NO: 6792374 - DNA, 64 bp, Homo sapiens
ggtcactggtctctgcttccatcagctcagggctggttccctcggagtggaggccagcgtggcc

SEQ ID NO: 6792375 - DNA, 98 bp, Homo sapiens
ggagttaccgttgtggttataggttggtgggaagcaatgtaaattattttattacaatgtctctcacctgacttctctttggctaactcagtggctct

SEQ ID NO: 6792376 - DNA, 68 bp, Homo sapiens
tgtgtttttagtttaagtttttgcagtgccttagttgcataagtgcaagagcccaaactatatacaca

SEQ ID NO: 6792377 - DNA, 71 bp, Homo sapiens
gatggagtgtcctggagtgcttgggggaaggggccgcttcctgctacaatggctattttggggcctgaatc

SEQ ID NO: 6792378 - DNA, 55 bp, Homo sapiens
gaggggtacctattgtgggggctcaggaatactagctctggcctactgttccctc

SEQ ID NO: 6792379 - DNA, 69 bp, Homo sapiens
gaaacctgttttgattaacaagtaacgctgtgacggcatatctcttacaatttaatgaaaagaggtttt

SEQ ID NO: 6792380 - DNA, 61 bp, Homo sapiens
ttgtggatgcttgatcaggtcctgatagttcactaatgccatcaggctcaaatcatcccaa

SEQ ID NO: 6792381 - DNA, 84 bp, Homo sapiens
gaagctaagtacagagagaggcccgaggctgcttgtagtttcccagctaggcatgcctattgcctcctctgtctatttgccttt

SEQ ID NO: 6792382 - DNA, 81 bp, Homo sapiens
cttggaactagtgaagtgcaaagcagccagtttttcaaacatcacacagagaacaggctgacatttgcattttttcctgag

SEQ ID NO: 6792383 - DNA, 77 bp, Homo sapiens
ttcttttagtgcttctgtccaaatatatgaagattgaaataaatagtaaaatatatttgattgaaaaattagaggag

SEQ ID NO: 6792384 - DNA, 85 bp, Homo sapiens
ctgctccttgaaggatccagctgcagcccagtttcttcccaccagtgcctggtgtagctgggcagtgcttggattcagggagcag

SEQ ID NO: 6792385 - DNA, 73 bp, Homo sapiens
cacaaagtagcagtagttttatgggctggtattaacacctattatgaccagccaggcattgcaaactgatgtg

SEQ ID NO: 6792386 - DNA, 60 bp, Homo sapiens
tgggtgaagaggctatgctactgttgcatctaagggaatagtggcactgtttcttcccta

SEQ ID NO: 6792387 - DNA, 82 bp, Homo sapiens
ttgagatttgattgagcctcctgaccctctgtgggtaccactcccatttaagtggaggccaggaaggctcggagagttttag

SEQ ID NO: 6792388 - DNA, 73 bp, Homo sapiens
agactggtagatcaaatcccaggacgtaccctcgcacagccaagtggggtcctggggtcctgactgcttccct

SEQ ID NO: 6792389 - DNA, 62 bp, Homo sapiens
gtcttggtgttgtccctgcccaatctagctgaaaaggcaggcagatggctgcaccaaacggc

SEQ ID NO: 6792390 - DNA, 76 bp, Homo sapiens
aaccacaccgagatttgcaagagtaagaatttctgcctattggctagaatttcaggactcctgtattcgggttgtt

SEQ ID NO: 6792391 - DNA, 65 bp, Homo sapiens
agttactgttatattccaggcaatctgctaggtattgaagataaaaactggattaagacagtgct

SEQ ID NO: 6792392 - DNA, 130 bp, Homo sapiens
ggctggaatctcatgcctctggctttattggtctgggatctctggggcatccccatccctaaacctccaatggactttgccctaatgaggtctctttgcagtggccctgaccctgtgattgttctctgcc

SEQ ID NO: 6792393 - DNA, 55 bp, Homo sapiens
tcctgagctacagtagtatgatcttccatagcacgtcataactgtctgtttagga

SEQ ID NO: 6792394 - DNA, 82 bp, Homo sapiens
ggtgccatatttagcagctgtcagaagttggaatctggcaagatcaacaacttttgaatagctcaaaattcgctaaagtccc

SEQ ID NO: 6792395 - DNA, 69 bp, Homo sapiens
agtcattacaaattatagaaaattgagctatttgaaagcttttattggctgtcatttgacgcattgact

SEQ ID NO: 6792396 - DNA, 81 bp, Homo sapiens
agttatgaagggttgagacaagggtttctatgcagagctgactttgtatattgcctgagtctttcctctaattctttagct

SEQ ID NO: 6792397 - DNA, 57 bp, Homo sapiens
ttctatgtaaactgttggatttgacaaggaggagttgtcaaaggcagattactggga

SEQ ID NO: 6792398 - DNA, 73 bp, Homo sapiens
catggttaggaggggtggccaggcttaggcgtttaatttgattaatgataagcatacattctctcctttcctg

SEQ ID NO: 6792399 - DNA, 100 bp, Homo sapiens
acagaatagtagtagagaagttggcaaaggtaggtattctgaccacatgctgtaggatacctaatgcttttgcaaagctgtgttacatgtgttattctgt

SEQ ID NO: 6792400 - DNA, 59 bp, Homo sapiens
gattagtggtatctatcatagaatatgtgtattattcaattaaataggtatggctaatt

SEQ ID NO: 6792401 - DNA, 80 bp, Homo sapiens
ctggggtcactccaccttctccacctccccctgcgccaacttcgaggaccgagcgttccaggtggcgaggtggacctcag

SEQ ID NO: 6792402 - DNA, 80 bp, Homo sapiens
gattctattttcaagaaagagtggctattccatttttataaattagatggaatatccactctttcttgaaaataagagtt

SEQ ID NO: 6792403 - DNA, 104 bp, Homo sapiens
gggccgaagcctggtctcagagaggggccgggccttctcaagtggttctgctgccgagaaaggtgccagcccctccactgaccactggccacctgcagaagccc

SEQ ID NO: 6792404 - DNA, 65 bp, Homo sapiens
ttcactgtggagcaaatttatttatctgagaatagtaaagatagaagtattccctcctcagagag

SEQ ID NO: 6792405 - DNA, 64 bp, Homo sapiens
agctgctgtttcttgcacgtattcttaaaatcaacaaaatacctccacaagacaactggcagct

SEQ ID NO: 6792406 - DNA, 88 bp, Homo sapiens
caggggcacaaggctgggaggcaggggagctgggattcccaagcaggaagtttggttccagagcccatgctctaggccagtggttctg

SEQ ID NO: 6792407 - DNA, 70 bp, Homo sapiens
ggcaagaatatagttaccaaattctgatgctgactcaaaagctaacaaaatgatgtgattttattgtgcc

SEQ ID NO: 6792408 - DNA, 56 bp, Homo sapiens
tgactttcagctgtatttatctaggattaatcttggaagagtagagttgaataaca

SEQ ID NO: 6792409 - DNA, 87 bp, Homo sapiens
ataaaagctagggatgatgataggttattttgtgttgtgtggtatgtttatatgatgccaaataacctgtttaacttacgtttttgt

SEQ ID NO: 6792410 - DNA, 68 bp, Homo sapiens
ggttccctgagttagctgggtggttcatctggtcttggctgggctcactcatgcaactgcagttagct

SEQ ID NO: 6792411 - DNA, 70 bp, Homo sapiens
tcacccccatctgagagcatgtgcccgccctctgtccctgaggtcactgcaggtctgagatgggggagga

SEQ ID NO: 6792412 - DNA, 129 bp, Homo sapiens
atttttggtgtatctgagatgctaatggcctttcattttcaagtttttatttcccagttggcagtaccacttttacactttgaagatggaaacttggcaggaaaattgtatgtcagggtgtatttctgt

SEQ ID NO: 6792413 - DNA, 82 bp, Homo sapiens
tagaatggaatacttagtctttctgatgaaatggatcttacttaatttcattgatttttgaggactggtattctccttttta

SEQ ID NO: 6792414 - DNA, 88 bp, Homo sapiens
agatggtgttttctacagctgggctaaaaataaataaataaataaaaagtctgtgctttgtaaaagcccaagctgtaggggcccttct

SEQ ID NO: 6792415 - DNA, 107 bp, Homo sapiens
ctcctataatataactatgacatgttagggacagagtatgtgtaagaactacatactttgtccttaacgtacatttattctgaagttactaatgcaaaaattaggag

SEQ ID NO: 6792416 - DNA, 60 bp, Homo sapiens
ggacctggaggcttttcccaagacatcatgatggagtcttcagggtctgccccaggggcc

SEQ ID NO: 6792417 - DNA, 81 bp, Homo sapiens
tcatattactctaggaatgcatgggggattctggggcccaccagagccccggacctcttctgttccttgcagtggctatga

SEQ ID NO: 6792418 - DNA, 59 bp, Homo sapiens
ccctctgttttcccaattacagaagaggcactatgcatctgggttgggagaaaagaggg

SEQ ID NO: 6792419 - DNA, 57 bp, Homo sapiens
cagattagttgtgctatggcctgttcatttcaccttctatagatacagctcaatctg

SEQ ID NO: 6792420 - DNA, 107 bp, Homo sapiens
tcttctgaaccctgcttcccgctgctgtctggaactgtgatccaggtggctgatagttgctctgggcctcaccttcttggcagccctgggtttcagtaactgggaga

SEQ ID NO: 6792421 - DNA, 88 bp, Homo sapiens
ttatgatagtttactgagaatgatgatttccaatttcatccatgtccctacaaaggaaatgaactcatcattttttatggctgcatag

SEQ ID NO: 6792422 - DNA, 74 bp, Homo sapiens
ggaggcttgatgatcttggataaatgtggaaatttgcacttctaaataactagtttaagtatcattaagccttt

SEQ ID NO: 6792423 - DNA, 67 bp, Homo sapiens
gtatctttccagtctcttggggcctcacttcgtggtcaggctacttcctttgaggctgcagaggggc

SEQ ID NO: 6792424 - DNA, 57 bp, Homo sapiens
tttgtttactcattcattgatggacacttttggctatcatgaacatgagtgtacaaa

SEQ ID NO: 6792425 - DNA, 128 bp, Homo sapiens
tggaaagaaagtgggaaccttggcagtttagataattcacttcatctggtggccagctatgttaacaatcacatcatatgccagcacttagatgagatgaaaggagccccaggggcactgaagctaca

SEQ ID NO: 6792426 - DNA, 79 bp, Homo sapiens
ttatttgaacatattcttgggataaaatatactactatgagtcaaagatagttgtaattactccaggggtaaagaatga

SEQ ID NO: 6792427 - DNA, 76 bp, Homo sapiens
gggaacagggccacaggggcggggtaatgggtattcttttctgagttaggccccagccctgtggaccatggttccc

SEQ ID NO: 6792428 - DNA, 85 bp, Homo sapiens
actctgaggaggtggcatgtggggcatggcctaaaattgttggggctacagtttaggcaggctcctatggtagaccttggatggt

SEQ ID NO: 6792429 - DNA, 102 bp, Homo sapiens
agtgaggccaccatcaatggcccaagtgccctgacctgaagcgtagggagcctcctgtccttttggcagggagggtcgctgggccttgttggattccctcct

SEQ ID NO: 6792430 - DNA, 76 bp, Homo sapiens
tcctcattactacaatgacagtgttgggccagatgctcaccaagcctcttcctgcactgacattttgtgatggcga

SEQ ID NO: 6792431 - DNA, 87 bp, Homo sapiens
ccagcagcaaataataggtatcaaataaataaacattttcatttattaattagagaggtgcctgttgtgtgtctttgcttttgctgg

SEQ ID NO: 6792432 - DNA, 73 bp, Homo sapiens
atcattcatatacttttctatagctttctcaaatgtccaaaacaccatgagggcttggaagagagtagatggt

SEQ ID NO: 6792433 - DNA, 96 bp, Homo sapiens
gaatgacgcttaggaaaatgcttagtgaggaatgaatttgttcttcaaaaccagagcatacatttaacatttggatcatatttgtgagtttcattt

SEQ ID NO: 6792434 - DNA, 63 bp, Homo sapiens
gttctggaatgcctgttctaattctccaaggagaattagaaaataaaaggcagagtctagagc

SEQ ID NO: 6792435 - DNA, 102 bp, Homo sapiens
tattactttttggtttagttttcaaggaactctgtctgtgggaggaattctaagtatcatttacagatggcagtttcttgagctggtttaatcacgtcaatg

SEQ ID NO: 6792436 - DNA, 102 bp, Homo sapiens
tggtaagggacaaaacaaaccctgggactcggatgctggaaaaatcatttgcttttaatagagttgatccttttcataggtttacccatttggtctttgcta

SEQ ID NO: 6792437 - DNA, 69 bp, Homo sapiens
gttaacatcacaccacaggcattttctatcagcatactcgagatactgtgtggtgtggttctaattaac

SEQ ID NO: 6792438 - DNA, 74 bp, Homo sapiens
gagcattgaaacaatgttgtctccaagaggaaataaataatcctcacacttagggagggcattgtaatatgttt

SEQ ID NO: 6792439 - DNA, 80 bp, Homo sapiens
ccacatcttagagatcacgcctcctatctgtgtgccatttgcagctcagggtggccctgtggtctcatggagggatgtgg

SEQ ID NO: 6792440 - DNA, 74 bp, Homo sapiens
gatatgcctctgagctgtgtcctgggggcagtgtacaatgtgctgtacgaatccacacagctggagcaggattc

SEQ ID NO: 6792441 - DNA, 84 bp, Homo sapiens
gacaactaatatagcacagttatctattatattcagcaaatacttactgagtactccctaggtgctgtacattgtgttagggtc

SEQ ID NO: 6792442 - DNA, 63 bp, Homo sapiens
catggccactgaggaggtgaggacagaggctgtccaggctctctcctctcccctctggttgtg

SEQ ID NO: 6792443 - DNA, 64 bp, Homo sapiens
tttgttgtgtgtgtatatggtatctggaacatggacctgtgattaccagcctgacaccaacaaa

SEQ ID NO: 6792444 - DNA, 81 bp, Homo sapiens
tactagctattctaaagctgacctgattgcttttcagtgttttgaccctgcagagacctaggtcaggtttagtagcttgtg

SEQ ID NO: 6792445 - DNA, 96 bp, Homo sapiens
acctcaggggaatcatgtaacttctgtgaatctgacttttctcatcacaggatgctgtcaggattaatgggagtatgctgtgatatcctctgtggt

SEQ ID NO: 6792446 - DNA, 92 bp, Homo sapiens
agatctgagaggctgataagttgcatgttgagaaattcagaccccatgtcctctctcgggtttcacactgcagcatcagagagcttgaatct

SEQ ID NO: 6792447 - DNA, 79 bp, Homo sapiens
cagactgaaacctgagccatgagcctgcgcccagctccctgcgaggttggaaagcgaggagttggcatttttcagcctg

SEQ ID NO: 6792448 - DNA, 65 bp, Homo sapiens
tccaggctttcctgtcactcatgctgatattagcctgatgagcaagggagagcaagagagctgga

SEQ ID NO: 6792449 - DNA, 62 bp, Homo sapiens
accagcagaggcatcatccttccccagacaggttcctggggaggctttcagtatctgctggt

SEQ ID NO: 6792450 - DNA, 59 bp, Homo sapiens
tagactctgcatttacctcccaggtaattttgaccatgggacaggagtcagaggatcta

SEQ ID NO: 6792451 - DNA, 73 bp, Homo sapiens
cagtaaaaagttggggctccggggaaggagaaacactgccaactcatttcacagatcctacagcttgtgattg

SEQ ID NO: 6792452 - DNA, 73 bp, Homo sapiens
taattagctgctctctccaccatgcctggtctactgtttacatgtgatcaagaatgtgggagatggctaatta

SEQ ID NO: 6792453 - DNA, 118 bp, Homo sapiens
ctaggtgatataggggcaaatattaataactatgactatttatcaagtgtttcctggggctggtttcagccacaaaggcaggtgctgaatattctgagctgcccttttaagcactaag

SEQ ID NO: 6792454 - DNA, 81 bp, Homo sapiens
ttgtgtatgaatacatggaagagtccccatggatgagtatacaatactgtgcctgatgcttttactactattcatccacaa

SEQ ID NO: 6792455 - DNA, 69 bp, Homo sapiens
cggagccttcaaaggaggtgctgggtcttgtcctccagcccgagcgcacctgtggaaatcatggttctg

SEQ ID NO: 6792456 - DNA, 86 bp, Homo sapiens
ggggtctaaagccaggcagggctctcgctctctgggtccctttcagcacagagcagcgagccagctctgcgggtcctccctacccc

SEQ ID NO: 6792457 - DNA, 95 bp, Homo sapiens
tcatcatttttctataaaggtttggttttttaggaaacaagttttgattattaaggcacttttctaaagaccttgttttgatgggcgagtgatga

SEQ ID NO: 6792458 - DNA, 83 bp, Homo sapiens
tgactgcataatgttagaacagtataggctaaacattaatagtctgatgtgaggttaacctactgttagaatgtgtgtgatca

SEQ ID NO: 6792459 - DNA, 76 bp, Homo sapiens
aagattgctgtcacttttactggttaacataggacggaaaagttatgttatcttcggaagcaagtgatggcaactt

SEQ ID NO: 6792460 - DNA, 59 bp, Homo sapiens
ctagggggttctatgcatttattatgagtaggtcattcatttcacagtgagcttcctag

SEQ ID NO: 6792461 - DNA, 55 bp, Homo sapiens
tgagcaagacccggcctctgccccatggagctccgagtctagccaggtttgctca

SEQ ID NO: 6792462 - DNA, 80 bp, Homo sapiens
tgcaaataaagttgttatttcctggagccagtttaccttctgcatagaacggatgaccatctagggagaagaatattgca

SEQ ID NO: 6792463 - DNA, 83 bp, Homo sapiens
gccacatatttgcataatgctggacttttcaatgtttttgtagttcttcttcattgaatgcatccaaattgtgggaatgtggc

SEQ ID NO: 6792464 - DNA, 55 bp, Homo sapiens
gcaggtggtcagttccagcagtcagctatagtggctggctggagtggccatctgt

SEQ ID NO: 6792465 - DNA, 87 bp, Homo sapiens
gcaagcattatttgtatgttttgtctgctcttgaaggtgcctaaaattttcaaaagactcagatgtagcgtgcatagcagctcctgc

SEQ ID NO: 6792466 - DNA, 70 bp, Homo sapiens
ttgccgtttgggagtgaagattcatttaccaagagagattcttttactagttttcattaccatgctgcaa

SEQ ID NO: 6792467 - DNA, 64 bp, Homo sapiens
tatttcacattctcacaagaggaaaattttataagcttttctaatctgtgggcatgtgtctgta

SEQ ID NO: 6792468 - DNA, 112 bp, Homo sapiens
aggttttatcatataaatttacttataatacacacaactcattgtgtaatatttgtgtgtgcgtgtgtgtgtgtgtgtgtgtgtgtgtgtgtgtgtgtgtgtgatggagtct

SEQ ID NO: 6792469 - DNA, 85 bp, Homo sapiens
acaggagccactgtgcttggccttagcttcttcttaaatggcagcagtttgagtagtgagactaggcagaagcacccctccttgt

SEQ ID NO: 6792470 - DNA, 91 bp, Homo sapiens
gccttcgatgttcttgctgacttctggcaggcaatcggctctgggagtttctgtctagggacccctccagcagcagtatctgcgtaggggc

SEQ ID NO: 6792471 - DNA, 91 bp, Homo sapiens
gtctgttgcttttgtaatcactgaagatttggctgtaaagcacttgcagaaataaaaagtgctatggaaatctttaataacagttacagac

SEQ ID NO: 6792472 - DNA, 65 bp, Homo sapiens
gtggtccagaaaggccaatccctaaagacttcctaaacttttggatggagccactttgaaaccac

SEQ ID NO: 6792473 - DNA, 62 bp, Homo sapiens
ggtggcatttgtggaggggaatgaaagtagaatctgcacacgtcagtccaagcgaatgcccc

SEQ ID NO: 6792474 - DNA, 60 bp, Homo sapiens
gttgtctggaaaggggcttttatctcccgtcagggaacaggctcttcatttccagaggat

SEQ ID NO: 6792475 - DNA, 55 bp, Homo sapiens
tcaccctcagtttgtttcagcagtgtgagctggctgaggtcctgctgagtggtgg

SEQ ID NO: 6792476 - DNA, 57 bp, Homo sapiens
ttccttggccacactggtgcttgttcaataagccaacatacagagtggccacaggga

SEQ ID NO: 6792477 - DNA, 72 bp, Homo sapiens
gtatcgcccaggctggagtgccagtggagccatctcggctcactgcaagcaagctccgcctcccgggttcac

SEQ ID NO: 6792478 - DNA, 87 bp, Homo sapiens
gctgagataaactgctggaatatgtttgctaaccaaacttccagcagcttggcagcaagaataatttgggtagtacatcacttcagc

SEQ ID NO: 6792479 - DNA, 110 bp, Homo sapiens
cgctgtatactccccaaattaacttgtaggctcgctgggaagattagaaagaaattaaggcatagatccagttccaagaagcttacaatctaattgaagacatacacgcg

SEQ ID NO: 6792480 - DNA, 61 bp, Homo sapiens
tgatctgactcaaggccctggggtgcagaaaaaggtcactaagcccctgggtgagttctca

SEQ ID NO: 6792481 - DNA, 99 bp, Homo sapiens
tgggacattcagtccttggtctactagagaaaaagacttagaaatctaggctcttaaagtctgagtgaagctaagggcaagtacagaggggatgaccca

SEQ ID NO: 6792482 - DNA, 77 bp, Homo sapiens
gcccatgtagcacttggatatacaaatgaagtagcatcattttatttccctgtaataatcccagttttctcatgggc

SEQ ID NO: 6792483 - DNA, 80 bp, Homo sapiens
agaatgtacatagacaaagatcagaagagtttgaaataacacagtttatattcagttgtaatctttgttagttacatttt

SEQ ID NO: 6792484 - DNA, 62 bp, Homo sapiens
gttgtgtgagggttaattgcggtctgaatataatgcacttggcccagtgtctagcgcacagc

SEQ ID NO: 6792485 - DNA, 80 bp, Homo sapiens
tggcttctggaaattccagctaggaaaagcttccctttgtggcccgtttggaagcactcaggctgggattcacagaaaca

SEQ ID NO: 6792486 - DNA, 66 bp, Homo sapiens
tcctgctgttttctggcccacaaatttggcctttctactacccagcactggccacaaacagtagga

SEQ ID NO: 6792487 - DNA, 68 bp, Homo sapiens
cagcgctttcatcatcaactggcaggtaagttaccacaacttacacagaatgccaatgaatgagcctg

SEQ ID NO: 6792488 - DNA, 56 bp, Homo sapiens
agtgacagattaccggcagagcactaagcagctttttacagctgggttctgtgact

SEQ ID NO: 6792489 - DNA, 59 bp, Homo sapiens
gtcttgtaatttagctttgaggcttctacctgagatgaccacagaacaaattgcaggac

SEQ ID NO: 6792490 - DNA, 55 bp, Homo sapiens
ggggttgatcacagaggggtctctgtatccgcaggaatctcctttcttcaagctt

SEQ ID NO: 6792491 - DNA, 63 bp, Homo sapiens
ctcatcagtggatatagattagcgtggtcattagcatggctttataaatccactggtttagag

SEQ ID NO: 6792492 - DNA, 58 bp, Homo sapiens
tgagcagaggccagcacctgggagatagagcagtccagtggtgaaaagcttcagctca

SEQ ID NO: 6792493 - DNA, 62 bp, Homo sapiens
tgaagacaagtgtgctggtgtttgccatccacccaactttgtaatttgccagtattgcttca

SEQ ID NO: 6792494 - DNA, 58 bp, Homo sapiens
acagtagtgtgtgaaacttgccattttagtgccattagctttgcatactttgggctgt

SEQ ID NO: 6792495 - DNA, 64 bp, Homo sapiens
tttgaggcagctggacataactaacctggaaagaatttaggtaaatgtgatggctgtctacaaa

SEQ ID NO: 6792496 - DNA, 72 bp, Homo sapiens
cagacagagtgagggggcactgagacggcactggatttgatcagataccttctctgcaccccacttttgctg

SEQ ID NO: 6792497 - DNA, 58 bp, Homo sapiens
gcaccaggtgccctgctgtgcccttcttatgctcagggaaggacagaagggcatgtgc

SEQ ID NO: 6792498 - DNA, 129 bp, Homo sapiens
cgtaacttcctccataagttttttttaggatcttcctccttgcctcctcgctggggctcatcaaaagggataccaccccagggaaggcagatggaggatgtcgaagaggcccccaagtagaggaaggcg

SEQ ID NO: 6792499 - DNA, 67 bp, Homo sapiens
atcatcattcttggataaagcaattggccttttacatcaagaccatggcctgtctaacagaggtgat

SEQ ID NO: 6792500 - DNA, 130 bp, Homo sapiens
gcagcacagggcagcatgaaggggaagaggaactagcattttgtgggttctgctgatgtactgattatcccagaacagtcagttgaatccaaggagcctgttaacaccattccagcagtcctacagctgc

SEQ ID NO: 6792501 - DNA, 80 bp, Homo sapiens
gaggcctgctctaggtgcacaccggcccctctgcaaatccccggctggccgaacggtgccctggcagacaaatggctctc

SEQ ID NO: 6792502 - DNA, 103 bp, Homo sapiens
ggaacccaaacaagagtcctgtctcaccctgtcagttgcaggataggtatctcagccttctatagtcactcttagggcagaggaaggtacctgtctgggttcc

SEQ ID NO: 6792503 - DNA, 55 bp, Homo sapiens
gaggagaagaatgaggctggaggggccacatggctgccccagctccacttccctc

SEQ ID NO: 6792504 - DNA, 75 bp, Homo sapiens
acctcttgtgtggcatgtaacatctccagattctagctcctgctgtgactatagtaagtgtacatgtgacaaggt

SEQ ID NO: 6792505 - DNA, 83 bp, Homo sapiens
gattcaggctcctgagggtccttgttgtaccctaagcaccaaaattgctagttacagatctaggactgttttttcctagaatc

SEQ ID NO: 6792506 - DNA, 86 bp, Homo sapiens
gtagtcaaattgtgcagctttctggctttaagagttatccagaaactaaacttgagatttcctagagagatgcatgaattgtttat

SEQ ID NO: 6792507 - DNA, 84 bp, Homo sapiens
cttggttgaggggatcagtatttcaacccatatgtgttggaaacctcaagtctaattcataggaaaatgctggccccttccaag

SEQ ID NO: 6792508 - DNA, 57 bp, Homo sapiens
tgattcagtagcgttctgtatattcacggtgttgtgcagccgattctattgaattca

SEQ ID NO: 6792509 - DNA, 80 bp, Homo sapiens
gtgggactagggaggctacttcttgtaggcagtgctgcctttcagctgcagtttacccagagcagtgactcccagcccat

SEQ ID NO: 6792510 - DNA, 110 bp, Homo sapiens
tcagcagatttgaatggtcaaagcacatctcacctgcctcatgcttttagaaatcctgacgatgaaataaaacagcagggcagagaagtttaaatcttcaaacttgctga

SEQ ID NO: 6792511 - DNA, 60 bp, Homo sapiens
gagacagtggttgcagaagctctaggatcagactccctgagctggaatctggctgtgctt

SEQ ID NO: 6792512 - DNA, 67 bp, Homo sapiens
atcagaggtgagggagagccccactggctaggggccaggcaaacgtaggcctcctcgcacccctgat

SEQ ID NO: 6792513 - DNA, 129 bp, Homo sapiens
tgtggggcaggactcagcttcccatgggcattgatgctgagggcctcagttcccagttgactgttggccagaggtgtcctcagttctctgctacatgggctgtctgacacttggcatcttgcttcataa

SEQ ID NO: 6792514 - DNA, 71 bp, Homo sapiens
agtggattttaaattgctgtggttgccaatagacgcaggccatgcattcttgcaccacacaaaaatttgct

SEQ ID NO: 6792515 - DNA, 79 bp, Homo sapiens
acttgtccacagtaatgcatacaagttagtgagtggaccaagatctgctgctaattagtttgcattactttagacaagt

SEQ ID NO: 6792516 - DNA, 78 bp, Homo sapiens
gccagggcagtgtccagggtggtctgcatccagtgttgtgcaactctcttgtgagaccatcctggcacttccctctgc

SEQ ID NO: 6792517 - DNA, 110 bp, Homo sapiens
ttgaggcagagtctcactctgtcccccaggctggagtgcagtggcgtgatctcagttctcagctcactgcaatctccatctcctgggttcaagtgattatcctgcctcag

SEQ ID NO: 6792518 - DNA, 57 bp, Homo sapiens
tgggaaccatgtagctgagatgtatttgtttagatgaaaagtctacactggttctta

SEQ ID NO: 6792519 - DNA, 114 bp, Homo sapiens
gcccataagactgttggagaagaggaaaaaaagatcacatgtggttgaaagtaaatttggtttgtgtttttatcttgtatgtgtctcttctcatctttcacactggcttggggt

SEQ ID NO: 6792520 - DNA, 55 bp, Homo sapiens
tgagtttatgtctttcattgttctttgtccacaaaggacagtgagacatatctca

SEQ ID NO: 6792521 - DNA, 84 bp, Homo sapiens
tgactatttctgtagttttctctgatgttaatagttttctcaagtgacatcaatgtgcagagatgaacgtttagaatctagtta

SEQ ID NO: 6792522 - DNA, 55 bp, Homo sapiens
gcaacactttgcaggcgggcagacttggcgggcctctcctttgcagcggtgttgc

SEQ ID NO: 6792523 - DNA, 74 bp, Homo sapiens
ggtccccagcaccagctgtgtcctggctgcagccttctcctgtgccatcctagggctgctgaaatctgggggct

SEQ ID NO: 6792524 - DNA, 73 bp, Homo sapiens
gcgagaagagttggtgagcccctgtgctgatgatcccatctagatcagctaactttccagttttcttagttgc

SEQ ID NO: 6792525 - DNA, 68 bp, Homo sapiens
tttgttcaaattttcctatctgggttctaaggaatgttctattttcaggtagaaatagatttggcaaa

SEQ ID NO: 6792526 - DNA, 67 bp, Homo sapiens
ttgccatggttgtttgcttattttaagaaaaatgcctttctacttcttgttgcaagccatcaggcaa

SEQ ID NO: 6792527 - DNA, 66 bp, Homo sapiens
atgtggcaaagtaggggtctgttgggggaaaaaaaaggcctcaagagccaagcttctttctcacat

SEQ ID NO: 6792528 - DNA, 129 bp, Homo sapiens
ctgtgtgctccttctcatctggattctcccttcctgaccacactgccttctgctccaagtctggccaagctgatttgcatgtttgtttgagagggatggaaaatcattagagtttagagtggtattttg

SEQ ID NO: 6792529 - DNA, 59 bp, Homo sapiens
ttgcttcattttctttgaagaacgttttcacttacttccatgaaagtgaaatggagcaa

SEQ ID NO: 6792530 - DNA, 65 bp, Homo sapiens
gatgtgaatgttgtctaacggcttgctactcaaagtgtaatccacggaccggcagcattggcatc

SEQ ID NO: 6792531 - DNA, 65 bp, Homo sapiens
ctcctaatttttgagatagctgtgttttgccaccagaacattactgcttgggagaggtaagggag

SEQ ID NO: 6792532 - DNA, 61 bp, Homo sapiens
ggaggccctctgtaactatttgttgaatgaacacatcacagtagagtaaaagggagcctcc

SEQ ID NO: 6792533 - DNA, 75 bp, Homo sapiens
cctcttgggctttggtcttagaatcagtatttatttattaggagctgggagaaggactaaatggcctagaagagg

SEQ ID NO: 6792534 - DNA, 64 bp, Homo sapiens
ggcttctttctcaagccaaggtgagccggaataaggtcattcttgaaacatatgagtaagtgcc

SEQ ID NO: 6792535 - DNA, 64 bp, Homo sapiens
ggaagttgtatgatcggggaatctaaagcccggagtagaatccccagagagaagtacagcttct

SEQ ID NO: 6792536 - DNA, 119 bp, Homo sapiens
aagcgattgtgaagagaacatagggattttatcgtcatccttctggaacttatttgtcttcaaagtgtttagtttcaaagggtccttaacatgagatccagttccctgaaaaagtcctt

SEQ ID NO: 6792537 - DNA, 75 bp, Homo sapiens
cctgagtgcatagatgttcaatcagatatttggtggataattgactaagtaacatgggaacatctgaacaatagg

SEQ ID NO: 6792538 - DNA, 95 bp, Homo sapiens
gacctagaatcattcttatttcacagcaacctgtgtcttgactaatgttaaactgactaatttgttttgaagctgagaatgagaaattggaggtc

SEQ ID NO: 6792539 - DNA, 76 bp, Homo sapiens
gaggctaactttatacacaatgacttaagatgtcaaggaaaaattagctttgattcaaatattgtgtatgatcctc

SEQ ID NO: 6792540 - DNA, 83 bp, Homo sapiens
gcaagaagagaggtgcctggagtgtgttcaggattccagaggagtgcctgggccgtattcccagaaggagagggcgttgttgc

SEQ ID NO: 6792541 - DNA, 62 bp, Homo sapiens
agggttgtatcctcagggcctagcatagtggctggtacataataggtcctcaggatgaccct

SEQ ID NO: 6792542 - DNA, 71 bp, Homo sapiens
aggtacagaggtcaagatctgaagtgaggaatccaatttccttctttggcttacgtctggcctgtgttctt

SEQ ID NO: 6792543 - DNA, 73 bp, Homo sapiens
gaagaacttgcagctggttaatgggagaattagaattaaaatcagcctcctaactcccaggccagtgctcttt

SEQ ID NO: 6792544 - DNA, 87 bp, Homo sapiens
tcttagtagaggtgtgtgtgtgtgtgtgtgtgtgtgtgtgtgtgcatgtgtgtgtgtgtggatacaaaaacaatctctaccctagga

SEQ ID NO: 6792545 - DNA, 75 bp, Homo sapiens
ttcagttttggtcctttctaggtatccacatcttacccagggttgggggaatgcctagagagaaccataactgaa

SEQ ID NO: 6792546 - DNA, 77 bp, Homo sapiens
cctgtccatcattttggttgttgctttccttttcctggcagacagggcctaaagtttcaatagaggaagtggggagg

SEQ ID NO: 6792547 - DNA, 81 bp, Homo sapiens
ggatgtcagcaaagctctttgacctgggcctggcagtcatcactctggtcccatctggtcagggtggctgagctgacctcc

SEQ ID NO: 6792548 - DNA, 61 bp, Homo sapiens
ctctagtcatttgcggtgtctgcggaggtctgcaagatcacaatcttcaaatcgattcgag

SEQ ID NO: 6792549 - DNA, 88 bp, Homo sapiens
gcagtggttatctattggaaagaagaatgatagaaggtggggtcggcatgacatgactatttccctcatcatcttccactagccctgt

SEQ ID NO: 6792550 - DNA, 65 bp, Homo sapiens
gtagaaatggtgtgtttcttctctgactaaatgtaatgcccagagaatggactcagagtttttat

SEQ ID NO: 6792551 - DNA, 90 bp, Homo sapiens
gcatcttcatgtgacttatggtcccagtgtcgcctctagggtcaccagcatctagaggtgacactgagaccataactcacctgtaggtgc

SEQ ID NO: 6792552 - DNA, 99 bp, Homo sapiens
ctagggaggagggcaggctccccagctggggcaacgcaccagctccttgaagctgttctgtggctcggccagctgctgaagcctctcctcctgctctgg

SEQ ID NO: 6792553 - DNA, 71 bp, Homo sapiens
tctccatagccaagcacagaggtcatcttgttgccaagcacagagtcgccttgtagctggcacaatgggga

SEQ ID NO: 6792554 - DNA, 55 bp, Homo sapiens
ggggcagcaaaggagccctggatgacagaacaaggcagggttacccgctgccacc

SEQ ID NO: 6792555 - DNA, 66 bp, Homo sapiens
ggaggtggagccctcatgaataaggagcccttataaaagggtcctgagagaggctccttgcccttc

SEQ ID NO: 6792556 - DNA, 65 bp, Homo sapiens
ctctggggcttctcctcatctctgcagctctgctgggacctcctgaggtggagcagggtctagag

SEQ ID NO: 6792557 - DNA, 68 bp, Homo sapiens
gtttgcaaaatttaaaatctctgtagaccaaacaaaactggtcttcatgccaaatgagttttgtaaac

SEQ ID NO: 6792558 - DNA, 65 bp, Homo sapiens
gtcagttcactaccactccatttgtttaactttagctaagccagggtagggtcagtgtcactggc

SEQ ID NO: 6792559 - DNA, 74 bp, Homo sapiens
ctggggggatgcacaggtgagcaggtgcagcccacgctgtcaggaatgccctgagagcctggcaacactcccgg

SEQ ID NO: 6792560 - DNA, 60 bp, Homo sapiens
tagtccttggtaaaattctatggatcacctgttgtatatagagatttaacccaaggcctg

SEQ ID NO: 6792561 - DNA, 62 bp, Homo sapiens
ctgcagctaaggaatgtggttgacgttagtcagaaaatacgctccaaattacctggctgtag

SEQ ID NO: 6792562 - DNA, 63 bp, Homo sapiens
cgtctcctgtgttcgagccattcccctgcctcagcctccagagtagctgggactacaggtgcg

SEQ ID NO: 6792563 - DNA, 76 bp, Homo sapiens
ccacgggtgatcactttgtctgaggcaactttgttaataaggcagctgttgtgtatcaggcagagaacctgactgg

SEQ ID NO: 6792564 - DNA, 63 bp, Homo sapiens
gccccaggcatcccattaaggagcatgaaggacattgctcttagcaataggaggcctgagggc

SEQ ID NO: 6792565 - DNA, 64 bp, Homo sapiens
gatctgtcatcagcaccacaggtgctcactcagaacacctggaagtgggtgctatggcagtgtc

SEQ ID NO: 6792566 - DNA, 90 bp, Homo sapiens
tgttaaattaggcatgactttaacttctgacatgatggctcgtatatttgtgtggaacaaaatgttgggagaaagttgtggagttttaca

SEQ ID NO: 6792567 - DNA, 60 bp, Homo sapiens
gctgactgctcagggccagctggctttggctcctgcaggtttggtctcagagcaggcagc

SEQ ID NO: 6792568 - DNA, 70 bp, Homo sapiens
ttttgttgttgttattattgtctcccatgaactcttgtgttttctggtcagagaagtagggacaatgaag

SEQ ID NO: 6792569 - DNA, 67 bp, Homo sapiens
gaatcaaccctggtgggaatatttgcaccttggaaatctgcaaatggtacaaatcagggcttgattt

SEQ ID NO: 6792570 - DNA, 59 bp, Homo sapiens
cagctgctgttcagttttgtttccttcttttcattggcctccaaaactgacggcatctg

SEQ ID NO: 6792571 - DNA, 68 bp, Homo sapiens
cccacactgtgcagattccctgtgaggtttggatctaagaactcacatgtactgtctgtgacatgggg

SEQ ID NO: 6792572 - DNA, 71 bp, Homo sapiens
gaagcagaagacctgggttcgagtcctaactgggttatctgttagctgtgtgaccttggtcaagttgcttc

SEQ ID NO: 6792573 - DNA, 59 bp, Homo sapiens
ggaggcactggacatgctctggccgtgtcattcccttgctcagagccttcagtgactcc

SEQ ID NO: 6792574 - DNA, 70 bp, Homo sapiens
cttgggagccagggagccctgaaccagagggtcaaggacccctggacggagtattccccgggctcccggg

SEQ ID NO: 6792575 - DNA, 55 bp, Homo sapiens
gcagcctgtgtccatactcctccagccaacaatctgaacatgaggcataggctgc

SEQ ID NO: 6792576 - DNA, 72 bp, Homo sapiens
gcgtgggctgcactgctctttatcgctgaggctcccctgggctgcttgtgggaaggagagagcagtccaggc

SEQ ID NO: 6792577 - DNA, 83 bp, Homo sapiens
agctccaaaataaattgaataatattttaaaatcatgtcatttccattttagagcagtggttttagagtatattcagggagct

SEQ ID NO: 6792578 - DNA, 66 bp, Homo sapiens
gccttttacagatcatcaaggtataatgattctgttcattcatactatggtggctgtcccagaggc

SEQ ID NO: 6792579 - DNA, 78 bp, Homo sapiens
attgggttgataggtctcgggatttgtataaggtaaaaagcttttcttaaagtaaaatgggacctatttcaactggat

SEQ ID NO: 6792580 - DNA, 78 bp, Homo sapiens
acagatttggctggttccatagtgagaggaggagagtgtcaggcttctgagacctgcctctgcactaggccgccctgt

SEQ ID NO: 6792581 - DNA, 101 bp, Homo sapiens
gcagtggaggttacccagagggacttctgaggcgcgatcataagaggcctaggagcatctgttctggcctcttgggatgctccctctgggaacccagctgt

SEQ ID NO: 6792582 - DNA, 63 bp, Homo sapiens
ggctctgttgtatttccaactatgtatggtatgtggttgttttagatacaccctgcagtagct

SEQ ID NO: 6792583 - DNA, 79 bp, Homo sapiens
ggactgaatgacttcttcagatactttgcaaggcatgactgtatataaggcaagtattctgtaaaaagtcaactagtct

SEQ ID NO: 6792584 - DNA, 79 bp, Homo sapiens
tctttaagtaaagtgtgcatggtcaaatatattttcgaaatatgtagctaaaactgtgcacgactactcagcttaaaga

SEQ ID NO: 6792585 - DNA, 87 bp, Homo sapiens
agaagcctgctctgtccttgtgcagctgcggcaggcaggagctggaacatatgcctgtctgaaagaggacgagctgggaaggcttct

SEQ ID NO: 6792586 - DNA, 57 bp, Homo sapiens
ccacgctgggtggccactggccactgctcctttgggtgtgccaggcaagacaggtgg

SEQ ID NO: 6792587 - DNA, 85 bp, Homo sapiens
ctaatccaaaatcacatctgttacccctgtgaggtacatggatgtgctccaaggtttcagaacaaatgatgtgaggttggcttgg

SEQ ID NO: 6792588 - DNA, 74 bp, Homo sapiens
tgtatatgttttcaacttcattgactttgctgcctttccttctcagaggctgagctggtagtgagtactatata

SEQ ID NO: 6792589 - DNA, 116 bp, Homo sapiens
gcaagagaagcctaggttgtgagcactggctcagggctgcatctgcctggtgaaagggtgcccttttcaagtaacacaaatgcaccctgtgggctactggctacccgggtaaatgc

SEQ ID NO: 6792590 - DNA, 81 bp, Homo sapiens
caagtgacctactcaggatcacgcagtgagtgcagcccagccggggctcagctccaggtgtgcatcttgatatggcatttg

SEQ ID NO: 6792591 - DNA, 100 bp, Homo sapiens
ttttttcaaggctgttttgtctgtttttaaatgctgttgtcttatataaatcaggctacttgctttaaagtaccagaagaatcctataatactgaaaaaa

SEQ ID NO: 6792592 - DNA, 74 bp, Homo sapiens
agggcctgcaggccttatgtaaacactcaggtgcctgtctgtacaaatgtggggcctcgacaccggcaggctct

SEQ ID NO: 6792593 - DNA, 78 bp, Homo sapiens
tgatatgaaagcatggccccaaatcccatgcatagccatccactccactgtgtagggtggagccatgtgaacagatca

SEQ ID NO: 6792594 - DNA, 110 bp, Homo sapiens
cagatgttgtaaagatactctttcaagtttcctgtgcactaggaatctgcagatgtacgttggcagggctacagtcagagtgcagcgggaggctggggtttacacatctg

SEQ ID NO: 6792595 - DNA, 89 bp, Homo sapiens
ggagccccagcttgtggtgaccagtgtcccctctgaggagtgagagggagaccctgaccccacaggggtgctagagccacctgagttcc

SEQ ID NO: 6792596 - DNA, 69 bp, Homo sapiens
aagagcggtaggagagacagaagttagcgtttaggaagtaaattaatttcttcatctctgcagctactt

SEQ ID NO: 6792597 - DNA, 74 bp, Homo sapiens
tagaaaagtttgttgcttacaaagaagacggcatagaaagctgaaagttctacttgttgcaacttactgttgtg

SEQ ID NO: 6792598 - DNA, 79 bp, Homo sapiens
cattgctgggtgtggtggtttttctcatttctgtataaattttcaatttgaaaacagagtggagccaaactttgcaatg

SEQ ID NO: 6792599 - DNA, 55 bp, Homo sapiens
tttctgaattgaacacctaagtccctgctcagggaccaccctgtttatccagagg

SEQ ID NO: 6792600 - DNA, 78 bp, Homo sapiens
accattctggattcctaacagcaacaggtgagtgtacttttgctccacatctcactagcgtttggagttttcagtggt

SEQ ID NO: 6792601 - DNA, 85 bp, Homo sapiens
tcccttggcctgcagaggctgtggggcccaagccttcttttgggtctgaagtgcccctgccccaccgcctttgctgcctgtggga

SEQ ID NO: 6792602 - DNA, 64 bp, Homo sapiens
cagtggtggaggaagatttgaatctatgcaatctggccctggagtccacattcttttacaactg

SEQ ID NO: 6792603 - DNA, 82 bp, Homo sapiens
tctttatttgcgtggtctccattcttcacatggataggatctgactcaacacagccccatgttgaagaaagaattataagga

SEQ ID NO: 6792604 - DNA, 106 bp, Homo sapiens
gcaggcctcagtcatcctgagaacatgggcatgcacagcgggtgtctgtcaggggaagcccctctgggggacttgctgtggtccctggggtggctggtgaggccgc

SEQ ID NO: 6792605 - DNA, 57 bp, Homo sapiens
tcactgtctgaaagaaatggccagagacacatatctacataatttcatgggcagtga

SEQ ID NO: 6792606 - DNA, 88 bp, Homo sapiens
ggattgggatgtagacatctttagggaccattattctgcctagcagagttgtcttctgatcccaaaagattcacacatgtcccaagcc

SEQ ID NO: 6792607 - DNA, 67 bp, Homo sapiens
gtcagatcatgtctgggagcagactccagttggaattctgtgtctgcccttagtacatctttctgat

SEQ ID NO: 6792608 - DNA, 80 bp, Homo sapiens
ggcggctcttcggctggagctgagaaaggagcgcttccccggactcggctcggctccgaggctctgaagccgacgccgcc

SEQ ID NO: 6792609 - DNA, 56 bp, Homo sapiens
cagttttagggcaatgtgaagagtgcatttctctctcacctgttgcgatgaagctg

SEQ ID NO: 6792610 - DNA, 84 bp, Homo sapiens
ggcaggaggagggggtctctttatcagtgaacacgggagcagcatgagaagttcaaagaattttgagacctgactccacttgcc

SEQ ID NO: 6792611 - DNA, 59 bp, Homo sapiens
cggtagaggcagtatacaatccgagctatttggctctccatcctgtgctcttcacactg

SEQ ID NO: 6792612 - DNA, 86 bp, Homo sapiens
ggagtcctcatgggtaaagcaggaagagagtgggaaagagaaccaccccactctgtcttcatatttgcatttcatgtttaacctcc

SEQ ID NO: 6792613 - DNA, 84 bp, Homo sapiens
aaggagaggagaagggaactgtgggagggtgagagaaccagtgctgactggcttctctcgccttccctcgccttccctcacctt

SEQ ID NO: 6792614 - DNA, 76 bp, Homo sapiens
acaggacttaaaagtaacaataaggttctattttccatttggagagtaggctcccggttgtttattttatgactgt

SEQ ID NO: 6792615 - DNA, 90 bp, Homo sapiens
gaagttcaaagagctcatgtgtcaattttcattcctactgtcatcagggaagcaatattagatatcagtgaatatgctttgctgaacttc

SEQ ID NO: 6792616 - DNA, 103 bp, Homo sapiens
accttgactgcatatcgtttataattgagtggtggtgacaaatataaaatgaatcattataggagtcattataccattataattgtgtcaagtgctacaaggt

SEQ ID NO: 6792617 - DNA, 69 bp, Homo sapiens
aagtgctggacatgtgtattacctcgattgtgatgatagtatcacaaatgtttgcatgtgtctaaactt

SEQ ID NO: 6792618 - DNA, 73 bp, Homo sapiens
gcaggaattagtaggctaacagagagcttcagcacagatgtttgacttaggcactctgggtttaaattctagc

SEQ ID NO: 6792619 - DNA, 100 bp, Homo sapiens
atgaactttgaagacattatggtaagtcaaataagactgtcataagagacaaatgtcctatggctgcacttatctgaggccctagagtcatcaaattcat

SEQ ID NO: 6792620 - DNA, 63 bp, Homo sapiens
tttcagtggatgtgaattggcgcaaaaggaacacttcttttccttctatacatatcactgaaa

SEQ ID NO: 6792621 - DNA, 69 bp, Homo sapiens
cctggagcctggagtggggaacggtagcagactgctgatgccctcagccacctccaagttcttctcagg

SEQ ID NO: 6792622 - DNA, 125 bp, Homo sapiens
gggtttgggtttttctgacaacaacgctcccctctctagggtccacagggtcagccgggtcctcgaggtgccactgggaactctggagctaaggtcagtggtctctgcagggctccccctgaccc

SEQ ID NO: 6792623 - DNA, 64 bp, Homo sapiens
aaatgcttcacctcattaaacttagaaggcaatgacattcatggcaggatggggtggggcattt

SEQ ID NO: 6792624 - DNA, 70 bp, Homo sapiens
gtttcactgttcttctataggcgtctgtcagaattaaaaagaggagatgtttatgctgggacaggaagac

SEQ ID NO: 6792625 - DNA, 66 bp, Homo sapiens
aagcactgggactgtttctctttcttccctgacctttggaattcctgaagcgtttcccacttgctt

SEQ ID NO: 6792626 - DNA, 58 bp, Homo sapiens
ctgtatacatggtccatgttatacatgagataagtaggacatgtactaatgaatacag

SEQ ID NO: 6792627 - DNA, 80 bp, Homo sapiens
agaaggaaaagaagacagcaagaatgagaaagtgaatgaagttaatttctttgaacttggctgatctctcagaaacttct

SEQ ID NO: 6792628 - DNA, 83 bp, Homo sapiens
gtgaggaaaataaatgataataatgctagtgtttattgaatgtttaacttgtgctgttttaagtgttcttatcatttcctcat

SEQ ID NO: 6792629 - DNA, 62 bp, Homo sapiens
tgcagaccaagccttccaggtcatcagtcaccacgtggcccttgtcctgggagagttctgca

SEQ ID NO: 6792630 - DNA, 69 bp, Homo sapiens
cagtatcatccatctagcgcggggggtgcggagtagcctcgtcccctcgtgcctatggaccaaacgctg

SEQ ID NO: 6792631 - DNA, 128 bp, Homo sapiens
gctgtgctaatttgtgggtatgaagacaattcctagactctgagctgcaagggtgagcctgggatggagtctgggtggcctgaattagctcagggtgggaaaggaaatgtcccttgcccctagctagt

SEQ ID NO: 6792632 - DNA, 56 bp, Homo sapiens
gctgggattacaggcacccgtcaccatgtctggtggctagtttttgtatttctagt

SEQ ID NO: 6792633 - DNA, 59 bp, Homo sapiens
gaggagccaggaggtctccctgctccaatctgcctaaggcttcctcttcctgcctcctc

SEQ ID NO: 6792634 - DNA, 77 bp, Homo sapiens
ttttataaagtgagaagtgctatgcacaggtaaaggatcattacccagttaattcatgggatttctgctttgtgaga

SEQ ID NO: 6792635 - DNA, 65 bp, Homo sapiens
cctcagcttcctgcctcccaatgtcgttacaaaagaacttgacgcaggagtgggtggagtggagg

SEQ ID NO: 6792636 - DNA, 69 bp, Homo sapiens
gctgtctctcccaggatccatgctgctcctagccccgttctggtcctgtgtgccccctggaagagcagc

SEQ ID NO: 6792637 - DNA, 78 bp, Homo sapiens
tacagagtatttttaatatggttatctgatttattcacatggggattgatatgtctgctaggttgaaaataagttgta

SEQ ID NO: 6792638 - DNA, 66 bp, Homo sapiens
tggccagggcactgccaggccacaacagcagccttcccctccctctgctggcaaatgctttggcca

SEQ ID NO: 6792639 - DNA, 93 bp, Homo sapiens
ctctgcctggtgtcccatgtatcccctgcatgaggagctgagtcaggtctgcagtcctggtgaggggacatcacggacaatctgttggcagag

SEQ ID NO: 6792640 - DNA, 87 bp, Homo sapiens
ggtcagtggtatttgagagaatggataacttgaagttgtccaaattccacagatttctctatttccattcttgaggtcccactttcc

SEQ ID NO: 6792641 - DNA, 64 bp, Homo sapiens
gtaatcccagctactcgggagactgaggcaggagaattgcttgagcctgggaggcggaggttgc

SEQ ID NO: 6792642 - DNA, 67 bp, Homo sapiens
ggagccatgaccttgcagacctgctgctgccatcgcgggtacatgggcggtgtggggttctggcttc

SEQ ID NO: 6792643 - DNA, 87 bp, Homo sapiens
ctgagacctctgacgccttcatttcctgcgttggccaccaggcacagatgctgtgtccatctgacaggagaggaagcggggtcccag

SEQ ID NO: 6792644 - DNA, 81 bp, Homo sapiens
ggctcagtgtctgggctcagaggcagctggcctttgatccaggtcccagacataggctgcctctgatgtgcagacgatgcc

SEQ ID NO: 6792645 - DNA, 74 bp, Homo sapiens
tcctctgaccctgggtctcttacaggctgtgcccaaagagttggactgcaaagtctcaagacccaagtggagga

SEQ ID NO: 6792646 - DNA, 114 bp, Homo sapiens
gtcaggagactgggtaatatgacttttttatatcaactgaagtcttgattattaaagttggggtgtaagggttgaaatggaggtctcatcaatttttccacccagtttactgac

SEQ ID NO: 6792647 - DNA, 79 bp, Homo sapiens
tccagcctgaccccagagcagaaccggaacaccaggttggggccctggtgctgccacctcctctgctggtcgggctggg

SEQ ID NO: 6792648 - DNA, 58 bp, Homo sapiens
tatcctgtgtactgtctagtacattaaatgtatgtttcttgggcattgcacatagata

SEQ ID NO: 6792649 - DNA, 110 bp, Homo sapiens
gataaacaggcacccccgtccccagcagaaatagcatcagatagcaatttgggcaggggcttttctctgttttgttgtgtttctgtgctgaaatggggccctgttgaatc

SEQ ID NO: 6792650 - DNA, 88 bp, Homo sapiens
tttctccctttcctattctgggctacaggctgtgcctggcacattgttagtacttggtaaatgcttatggaatgaaggaagggagaaa

SEQ ID NO: 6792651 - DNA, 58 bp, Homo sapiens
gtttaattcccacacctgccctagaaggcacttcctagggtcggtatagggattaaat

SEQ ID NO: 6792652 - DNA, 58 bp, Homo sapiens
catactctcttaggtgggactcgcctcctgggcagttttccatgactcagagagaatg

SEQ ID NO: 6792653 - DNA, 60 bp, Homo sapiens
aactcttaattttcatgaaatgaggtaaactttctcagggacatgaaaatataatgagtt

SEQ ID NO: 6792654 - DNA, 58 bp, Homo sapiens
atagtacctatgcataaggctggtatgaagattcaataaatcagtgcatgagtgctgt

SEQ ID NO: 6792655 - DNA, 61 bp, Homo sapiens
tagcagagtgtgaaggcagggcttaagtcactagaccagagctcatatcacggctctgctg

SEQ ID NO: 6792656 - DNA, 65 bp, Homo sapiens
aggcagtgctgtgccctgaaccctctgataagtactacagtgaggcttcagggcatttgctgttt

SEQ ID NO: 6792657 - DNA, 73 bp, Homo sapiens
ggtgtctgctccattgcctgttagggtttaggattgttgagtccttaatgtccagggcgttggagttagcatt

SEQ ID NO: 6792658 - DNA, 82 bp, Homo sapiens
aacttctttaggacaggctcagctctggccagtgcaccccttactgggaagcctgagtcctctgagtttgggttaggaagtt

SEQ ID NO: 6792659 - DNA, 56 bp, Homo sapiens
atggtcaagccacactcatccagctgtctgcagcttctgggtgagtggctggccat

SEQ ID NO: 6792660 - DNA, 124 bp, Homo sapiens
cgcgcacctggctcggcccggcccgcggccccgggaagttggcggagagcggacttggcctgggaggtcgtgttacctgagccatctcgttcggccgcgagtagaagccgctgccaggtgcgcg

SEQ ID NO: 6792661 - DNA, 60 bp, Homo sapiens
acagagatgggaacattcaggttagtttgacatatctttgaatgtttttattatctttgt

SEQ ID NO: 6792662 - DNA, 66 bp, Homo sapiens
ttttgatgccatttgcatcagcggttttgttatataacaaactactctgaagttagtggcttaaaa

SEQ ID NO: 6792663 - DNA, 129 bp, Homo sapiens
aattaaaagaactgattagtgtgaacatctttgtggctagttcaaattgttgtgttgtcattttagtgaaccacatgcaaagtgaataacacagcctgaatctgtttataaaacatggttcatttgatt

SEQ ID NO: 6792664 - DNA, 79 bp, Homo sapiens
ctgaagaggtctgaagcacagcatataaataaagggattctaccagttcttagctcctttgttgtcctctcctcttcag

SEQ ID NO: 6792665 - DNA, 55 bp, Homo sapiens
agccgggggtcaggcctcccaggactgtcaagctgggctgcttgagtccctggct

SEQ ID NO: 6792666 - DNA, 96 bp, Homo sapiens
ctctgtcgcccaggctggagtgcagtggcatgatcttggctcactgcaaggtccgcctcctgggttcatgccattctcctgcctcagcctcctgag

SEQ ID NO: 6792667 - DNA, 56 bp, Homo sapiens
catttcggtagcttgaactttacaaggttaagccatgatttcaagatattgaaatg

SEQ ID NO: 6792668 - DNA, 62 bp, Homo sapiens
ttacctcagagattttatttaacccacactaatgtgtgcagttggtatgactctgcaggtga

SEQ ID NO: 6792669 - DNA, 60 bp, Homo sapiens
atagtgtgtgattgcttcctcataattccaatggattggttcttggcaatctcacattat

SEQ ID NO: 6792670 - DNA, 80 bp, Homo sapiens
ggggtccaagcctcaaggctggggaaggtcagatttgagcctgtgtccctgttcctccagtgtctggggccttgggtcct

SEQ ID NO: 6792671 - DNA, 63 bp, Homo sapiens
tctgagctaccccagccccttcttacagacctttacccagaggaagagcctgggtccctcaga

SEQ ID NO: 6792672 - DNA, 60 bp, Homo sapiens
tattgctggtgctgttctgaatcaccaccaagtgggctttctcaacagcaaccggtagtg

SEQ ID NO: 6792673 - DNA, 55 bp, Homo sapiens
ctcagcaacagcgacttaagggcctgctaggagcggggagaagttggttgctggg

SEQ ID NO: 6792674 - DNA, 66 bp, Homo sapiens
ttatggcttcttgtgttactgtgggagaaggaaactttatacgcacatgcacaggttgagcaataa

SEQ ID NO: 6792675 - DNA, 61 bp, Homo sapiens
ttcagctccctgagcctgtgctatggggagtaatagcatctgccaaggctcagaggctgga

SEQ ID NO: 6792676 - DNA, 78 bp, Homo sapiens
ggggagtataagtgtagcagaacctgcctggcagccaagccacgtgggctcctgggcagctctgctccttggctcctc

SEQ ID NO: 6792677 - DNA, 78 bp, Homo sapiens
agctgtatggctgcagagacctgaagaaggaaagcttaagtcccctttttgatcttgtttctggggctatgatatgct

SEQ ID NO: 6792678 - DNA, 62 bp, Homo sapiens
ggattcaagatcgagtttaaagtgatcttcaaaatgattaaagccatctagattttgagttt

SEQ ID NO: 6792679 - DNA, 73 bp, Homo sapiens
aaagccctggccagacaccagttcattagtggaaataaaagcttcctaaattgcagggaactggctgggcttt

SEQ ID NO: 6792680 - DNA, 70 bp, Homo sapiens
cagagctctccctcagtgccctccgttgtggttgtatcaccctcccaccagctgagtaggggagggcctg

SEQ ID NO: 6792681 - DNA, 102 bp, Homo sapiens
gcatctcacattagcctcctgcctcttcatttgtgagacagttgatagtgtttgtctcttaattcagaggcagttatagcccccgttaaatgtgaaaaatgc

SEQ ID NO: 6792682 - DNA, 91 bp, Homo sapiens
ttagacaacgagtaatagatgtagtttctaaaagccttgatgtgtctgcagtgacaagtgcagaggaataacctcattgctttttgtctga

SEQ ID NO: 6792683 - DNA, 77 bp, Homo sapiens
ggtcagggaagggcaaagatttgaaattaggcatcactgggttctcagctgggcctccaagttcccctcctctcact

SEQ ID NO: 6792684 - DNA, 64 bp, Homo sapiens
gcattagcctgagagccaagctgtgcagcagatggcttatggctaaggcttgtcaggtctttgc

SEQ ID NO: 6792685 - DNA, 55 bp, Homo sapiens
gctgtgtgaccttgagcctgctacttaggttctctgaggctagtgttacacctgc

SEQ ID NO: 6792686 - DNA, 84 bp, Homo sapiens
ccatgtccatgtccagcagtgtgggctgcacgctggggggcccagggctctccggagtgtctggcctgctgggaggcgagatgg

SEQ ID NO: 6792687 - DNA, 56 bp, Homo sapiens
tttcagttgcagtggttgtctaacagttctgctgtatggacattggcaaactgagg

SEQ ID NO: 6792688 - DNA, 62 bp, Homo sapiens
catcactgcttctaaaatggtgttatatcttaggattttcatttgtttttaggagtagggtg

SEQ ID NO: 6792689 - DNA, 63 bp, Homo sapiens
gacatcccagcagcttgcacagtgctggcggggcacgctgtaagtgctcagctgatggttgtt

SEQ ID NO: 6792690 - DNA, 75 bp, Homo sapiens
aatggataagagacttgtgaaaccagtaacttcactaacaccacaattgttattgtatccagtcttattaccatt

SEQ ID NO: 6792691 - DNA, 92 bp, Homo sapiens
ctctgcacaagccaggtcttcactttactgaagccccagctgacccctctgggctcaaactttactgaagtgaagacctggtctgtgcagag

SEQ ID NO: 6792692 - DNA, 68 bp, Homo sapiens
catcctggttaccccatagtcatgccaatctaagtttatggcactgactgacagtggtgccaaggatg

SEQ ID NO: 6792693 - DNA, 92 bp, Homo sapiens
tgccaacgtcagggaaaggattctgctgtcggtcccactccaaagttcacagaatgggtggtgggcacagaatctggactctgcttgtggca

SEQ ID NO: 6792694 - DNA, 60 bp, Homo sapiens
tgtcagatgtgtctccaagtgcctccagaacatggactgcagctgcaagcacttctggca

SEQ ID NO: 6792695 - DNA, 70 bp, Homo sapiens
cagagcccgggatggactgacggtagcgcggggttcgaatcccagctctgtaaattccttcatcgttctg

SEQ ID NO: 6792696 - DNA, 99 bp, Homo sapiens
ccattgccctgtgtggagagagactggagtgtctttagggttctacctgctagagtcccagggacactccagacttggaaactgcacgtggttcaatgg

SEQ ID NO: 6792697 - DNA, 69 bp, Homo sapiens
tgcccaggggctgctggtatttccagtttggctgcacgaagtcaactggcttttcagatggcccaggca

SEQ ID NO: 6792698 - DNA, 72 bp, Homo sapiens
tgtctgcaatactcatcattggagatagcttactgctgaagttaaagtacaatattgagattgataaagaca

SEQ ID NO: 6792699 - DNA, 60 bp, Homo sapiens
ttcagtgtcacccaagggtccaccatgtgctcactggtggacatcccagggtgaaatggg

SEQ ID NO: 6792700 - DNA, 93 bp, Homo sapiens
cctcggctcatcttacatcatatatttactctcctgttgcaggtttgaggctgcaaacaggagagtaagtatatggtgtaagatgagctgagg

SEQ ID NO: 6792701 - DNA, 73 bp, Homo sapiens
ccacaaatgcaagtctctggaggcttgaggaaatccaatttcaattaagcttgcagggcataatttgcagtgg

SEQ ID NO: 6792702 - DNA, 85 bp, Homo sapiens
cttgcatgatacttgaatttggaaggttcctggtagacgtagaaacggcccagactgcctgttcagagctaagcatcatggtaag

SEQ ID NO: 6792703 - DNA, 82 bp, Homo sapiens
tctgttgacagtaccactgaaagtctgttcccttcctgaagcacacaggatacctaggcaggttggtggcatggataactga

SEQ ID NO: 6792704 - DNA, 81 bp, Homo sapiens
ttttggagccagaaagggatggagctttaatataatgtctgatgacatattgaggctttgatttaacagaagttaccaaaa

SEQ ID NO: 6792705 - DNA, 76 bp, Homo sapiens
tcatattcttttctctgaaagcagactgtatattgattatttttatatggcaattttctcagggaagagaatatga

SEQ ID NO: 6792706 - DNA, 58 bp, Homo sapiens
cctctgtctgtcactggggcagagtacattttctgcatgtccataatgaagatagagg

SEQ ID NO: 6792707 - DNA, 69 bp, Homo sapiens
tcccccataagctagaagcctcctctgccagattgcaggaacagggcttcaagcttcatgcttggggga

SEQ ID NO: 6792708 - DNA, 83 bp, Homo sapiens
tttgggtccacactgcctttatgagctgtaacactcaccgcaaaggtctgcagcttcactcctgaagccagtgagaccacgaa

SEQ ID NO: 6792709 - DNA, 112 bp, Homo sapiens
atagatacttggacatgctgacctcaaaatctacctcgcttttttgctggggaggtgaaccttctgccagagactggctgagagatcttgggttaatgctctgagtctctgt

SEQ ID NO: 6792710 - DNA, 55 bp, Homo sapiens
gtaagacgggagtcaggtgagctcgtgcacgggccgtaactgcctctcgtctggc

SEQ ID NO: 6792711 - DNA, 58 bp, Homo sapiens
atgtagaaagttattgtcactgatctggcatgtcagagcctgcaatagctttcttcat

SEQ ID NO: 6792712 - DNA, 71 bp, Homo sapiens
atattggttccaatatttctcacatatggaaaatgtcattttccctgggaattaatatttggaactggtgt

SEQ ID NO: 6792713 - DNA, 86 bp, Homo sapiens
gatgggggctggtgaaggcctggtgagatgcaacggccaaaccccttgttctgggccagtgatttttccagcagccagctcccatc

SEQ ID NO: 6792714 - DNA, 101 bp, Homo sapiens
ggattccgaggcccaagcccacgcctttatattacatttggaagctgaatttgtttaccttatgtaaataagagtaactgttgggattggaagctttttcc

SEQ ID NO: 6792715 - DNA, 64 bp, Homo sapiens
tagaatacagtttaagaactactgctctgccaaaccagattgttgagtttcctgactgtatctg

SEQ ID NO: 6792716 - DNA, 91 bp, Homo sapiens
ctgattctttgctgagattggaagctagattggcattcatttcttaagctggaaacctgtgctgatttgttagaaatgctgcaaggaacag

SEQ ID NO: 6792717 - DNA, 91 bp, Homo sapiens
gtcactgttatctgcaggatgtgcttttcttaaggatgaacatattttggtccacaagtttccaagacaagcacattcctgccaacatgat

SEQ ID NO: 6792718 - DNA, 79 bp, Homo sapiens
agagaccctttgcctggagggacatggagacctgggagcagctgggccttcaggtgtccctgtgggcctggtagtctct

SEQ ID NO: 6792719 - DNA, 88 bp, Homo sapiens
accctgcagcagggcagcacatctgattatatgactctgacgaaatgtcagagaaatgaaaacaaatggctgagcagtccctgggggt

SEQ ID NO: 6792720 - DNA, 80 bp, Homo sapiens
gaaaggggacaactttggaagtgatagatatgatgaatacaacacattctgtgaccttgcaaagaaaatagtcacttttc

SEQ ID NO: 6792721 - DNA, 55 bp, Homo sapiens
cagtgattcacgcccttgggcccaggcatccagcgggtttggggtatggaggctg

SEQ ID NO: 6792722 - DNA, 58 bp, Homo sapiens
tcaccccttaggagcattgtgtgaattagtgtgatttagcacatgcccagagggatga

SEQ ID NO: 6792723 - DNA, 61 bp, Homo sapiens
gttggacaatgaacgctttttaactgtgtgtggttcacagtactgctgttcttgtcctagc

SEQ ID NO: 6792724 - DNA, 63 bp, Homo sapiens
ggttcactctcaagtctgcctatcaccatatgttttgcttgggcatgaaaaatgagaagaacc

SEQ ID NO: 6792725 - DNA, 76 bp, Homo sapiens
gaggacgtggcatgttttgggaagtcagctctgggaagtcacactgggctgctccactaagccatcccatttcctt

SEQ ID NO: 6792726 - DNA, 63 bp, Homo sapiens
ggcttcacttccgcatgctggcctttctcccccggctgaggccacagcctgggaggtgacgtt

SEQ ID NO: 6792727 - DNA, 85 bp, Homo sapiens
tctttgttactcctgggaccttggctaggcattgtttcagcatgtcaatctggcatagtgagagcttttagggagtcattgaaga

SEQ ID NO: 6792728 - DNA, 61 bp, Homo sapiens
ccagtagtagctctttgtgctcaagaatcaaatgatgactgttggcagggattaaaactgg

SEQ ID NO: 6792729 - DNA, 70 bp, Homo sapiens
gtccctaggccaggttcctcaatcttgacagtatttacttttgaggttggataatttgttgtaggggggc

SEQ ID NO: 6792730 - DNA, 74 bp, Homo sapiens
gctttttccttggagagggagaaaaataacattctggtttcagatgctgttctttccctttttaaatctatggc

SEQ ID NO: 6792731 - DNA, 56 bp, Homo sapiens
cagctggtggctgatgaccgtctgcttggggctgcagatgttcacgttaccagttg

SEQ ID NO: 6792732 - DNA, 63 bp, Homo sapiens
atacaagacagtaggaaactgaacaactaaattagagggatttttttcactgctgttttgtgt

SEQ ID NO: 6792733 - DNA, 58 bp, Homo sapiens
ttgatatctctgctgtgttaggggatgctcacgagacagctgaaagggataatattaa

SEQ ID NO: 6792734 - DNA, 70 bp, Homo sapiens
ggctttgtgctccatgaatttgagctttgtgttgtgtatacattgctcctggttcactggtaatgctgcc

SEQ ID NO: 6792735 - DNA, 62 bp, Homo sapiens
gaggctgctcagtagatggagcttacacaacaatcgctgcgggcctggattgaagtagcttt

SEQ ID NO: 6792736 - DNA, 55 bp, Homo sapiens
gtatttccaccctcagtaaggaatggaaacctgtcccgtctggggtgtgaagtgc

SEQ ID NO: 6792737 - DNA, 60 bp, Homo sapiens
ctaagcatttggataaagttcctaatggtattccactttctagctttgccaaaaacttag

SEQ ID NO: 6792738 - DNA, 124 bp, Homo sapiens
atttatcaaattactatcattaatgtcttagtatgaactcatttattttcctctttctatggaaaagatgaccaaaacagggaagtacatagggttcttcttagagaaggtggttttggtagat

SEQ ID NO: 6792739 - DNA, 63 bp, Homo sapiens
ggagtgttgaagataaagttctcattttgcaagtcccaaaatgatgctttttttcagtgcacc

SEQ ID NO: 6792740 - DNA, 106 bp, Homo sapiens
ggcaggtacccaagtttatctgtgtttatggggatctgcagtgttgatctgtggtgcatggaagcgtgcaggtccgtatactccatagtcaattacgtttcctgct

SEQ ID NO: 6792741 - DNA, 67 bp, Homo sapiens
tcttctcagtgtcttattgtacacatcttatctcctaggatgagttttccgacattggctcaggaga

SEQ ID NO: 6792742 - DNA, 89 bp, Homo sapiens
tcttcctcaaatatctgggtgtgttacaatgatgccgacatcattctggttttggaattcaagttgtagcttagccagcatgtggaagg

SEQ ID NO: 6792743 - DNA, 61 bp, Homo sapiens
ctgcctcattctggccttggttcctctgtctaatgggggacctgaacataaaacgaggcag

SEQ ID NO: 6792744 - DNA, 62 bp, Homo sapiens
ggcagatttttagctgtgactcggttaaattgtctctccagatttcaggctggaagtttgcc

SEQ ID NO: 6792745 - DNA, 117 bp, Homo sapiens
ggagagttagaagaaaaagtcacactgaggacacatgctagaataaatctccaggggcccctcctgggttccttcttagagtgcctcttcctgtgtgctgattgttactaattttct

SEQ ID NO: 6792746 - DNA, 66 bp, Homo sapiens
agtaagacttccaggaaaaggtggtggagcaatggctcctttccattttgtctcctgaaatctact

SEQ ID NO: 6792747 - DNA, 69 bp, Homo sapiens
gaaggccggagcagcagcttttactgggggacaacccatttccagcagctacctgctcttgtggcgttt

SEQ ID NO: 6792748 - DNA, 60 bp, Homo sapiens
ggtagatgggaataattatcttcttacaagaacataaagaagtaatgtgtctcttctacc

SEQ ID NO: 6792749 - DNA, 79 bp, Homo sapiens
taccagtatgcttaataatgaacatttaaaacctgtttcctacagccaaacaggtcatagttgagtgataccagtggta

SEQ ID NO: 6792750 - DNA, 101 bp, Homo sapiens
gcagtgtacaggtccaattccattatttgctcaataatagttttatgcttaggctcagcgtatgaggctgataattgtggcatgataagactgcacagtgc

SEQ ID NO: 6792751 - DNA, 108 bp, Homo sapiens
gggcctgctttagagtccatgccgtgttagttattgcctaggagcagcttgtgggacaagtggccttggtgcaatagcagtgatggatttcaatgaatgtcagagccc

SEQ ID NO: 6792752 - DNA, 55 bp, Homo sapiens
ttgtttaccattgttccccatgtgtagcatcatagttagcatacaatggaaacaa

SEQ ID NO: 6792753 - DNA, 66 bp, Homo sapiens
gacccttgttgaggcccacagggagtaccaagccacggctgggcctaccctgtggccctgggggtc

SEQ ID NO: 6792754 - DNA, 75 bp, Homo sapiens
tgccatggtgcacgtggctaatgacagttacccaaagccattgtccaactgtcacatcatgtgcccaaatgtgca

SEQ ID NO: 6792755 - DNA, 57 bp, Homo sapiens
ctagaaggtctgggcctgggaaatctgtagtttgtaaggtcaatcaagaccttctgg

SEQ ID NO: 6792756 - DNA, 74 bp, Homo sapiens
cctgcctgtctttctatctctagatttattcagtcatttctgctctaagttctgaagataggaaatggtgtagg

SEQ ID NO: 6792757 - DNA, 90 bp, Homo sapiens
aatcctgcgtggacccaggggtccatttctccttcctaggctgttgggaggattgaataagaatgtgaagctcttggggcatgtaggatt

SEQ ID NO: 6792758 - DNA, 61 bp, Homo sapiens
ctctctctctgctgtctgaagacacagcaagaaggtgtctgtctgcaagccagaaagagag

SEQ ID NO: 6792759 - DNA, 67 bp, Homo sapiens
gatttttctttagttgctaatgaggttggtcccttctacccaatcttcaagggaagaaagagtagtc

SEQ ID NO: 6792760 - DNA, 77 bp, Homo sapiens
tgacaggcagagaggaagagagaaagggaattactctttccatttactattctcatatcgctttctcgtatttgtta

SEQ ID NO: 6792761 - DNA, 65 bp, Homo sapiens
cagctcaggccggagctacaggctcctggatcctttccccatccgccccgcccggccctgagctg

SEQ ID NO: 6792762 - DNA, 91 bp, Homo sapiens
gtgccctttcaaggcaactgacagctggagccctatggctggtggaggcagacacagggcaggggctctcagctggccaggaagagggcac

SEQ ID NO: 6792763 - DNA, 61 bp, Homo sapiens
tggctgggaaacagaaggatatcactgtgaattttgacaatcgtccagtgttttccagtca

SEQ ID NO: 6792764 - DNA, 72 bp, Homo sapiens
tggtgcttctacactggaggagagctgttgctattctcaagttgcaagcttcctctcagtgactgtgcatca

SEQ ID NO: 6792765 - DNA, 87 bp, Homo sapiens
acagttagagggcaggaaggggcaccaggacatgactcccagctcgcagctgtaagtccactggcctgccctttgccatctaattgt

SEQ ID NO: 6792766 - DNA, 71 bp, Homo sapiens
gccacagcagtctttcactaaataaaggagaaaagtgtctttcccatgtaagtgacagaggctgtggtggc

SEQ ID NO: 6792767 - DNA, 83 bp, Homo sapiens
cctcaacctgtcttaatatatcaatgattctttttactgtagttatagatagggttaattggtgtcctgaggcatcatggagg

SEQ ID NO: 6792768 - DNA, 65 bp, Homo sapiens
ggttggtagcaggttctctgctccttagttcctgagtacttctgagcagacacttgtgaccttcc

SEQ ID NO: 6792769 - DNA, 57 bp, Homo sapiens
aggtctctgcccacacaggcttccaacttccatggcatatctcctgggtaggggcct

SEQ ID NO: 6792770 - DNA, 78 bp, Homo sapiens
aagcatgataaaatctagtactagttaggaagagtatttctatagtctaatctgactagaattaaatcaaccatgttt

SEQ ID NO: 6792771 - DNA, 79 bp, Homo sapiens
aaagttcaagagttcagttttgaaatgttaattcctttttgggaaattgacatttgtagaataatggtttaggaatttt

SEQ ID NO: 6792772 - DNA, 78 bp, Homo sapiens
gttctcccttggggtctgcgccactgtctgcgaagaacctacttcaagacagaaaggagggtgtcaggcaggggaaac

SEQ ID NO: 6792773 - DNA, 60 bp, Homo sapiens
ttttcagtaatgtctacataatagtacccatctcagggagctcttgtagcttactgaagg

SEQ ID NO: 6792774 - DNA, 72 bp, Homo sapiens
gtttaattttaggttgtcaagccagccttatgcatcacaacttttaggcctcttgtcttgcttagaatagac

SEQ ID NO: 6792775 - DNA, 88 bp, Homo sapiens
gtctgtttattctcatctaaaatggccttaatcctacttgtcccacagggcttttttgaaaaagatgatgatgatcataataacagac

SEQ ID NO: 6792776 - DNA, 58 bp, Homo sapiens
tttctaatccttcactctcacagccacacaatcctcagctgagggtgagctttggaga

SEQ ID NO: 6792777 - DNA, 57 bp, Homo sapiens
ggatttccaaccagaaaggttcctctcaaatcttaagagctttctccttggagctcc

SEQ ID NO: 6792778 - DNA, 93 bp, Homo sapiens
tgtccctgcttttatttaaaagaatgcagtgccttccagcccccaccttgcactcttaggcgcttctaggcaaatgtattctgaagcagaaca

SEQ ID NO: 6792779 - DNA, 95 bp, Homo sapiens
tagattattcttagcttgacatgtcagctctttattgaaacaaaaatggaaaaaatccatagctgtccttcaaagagttccatgaagaataactg

SEQ ID NO: 6792780 - DNA, 67 bp, Homo sapiens
gtggatttcaggctcccctcagccctgtaacctggcatcaggatctgagggctggtctgaagtctgc

SEQ ID NO: 6792781 - DNA, 91 bp, Homo sapiens
ggtatgggcaacagcggcagcagatgtgatcaggaccctgtctgtgcaacagcctgcagctcctgctgtctgtgaatggtttgcctgtgcc

SEQ ID NO: 6792782 - DNA, 62 bp, Homo sapiens
tgggtttcttgattagctgtggctcagctgagtttggctgggcttaggttcaagtgggctta

SEQ ID NO: 6792783 - DNA, 111 bp, Homo sapiens
tattagcacgtaaccttgggggagtcacaaagcctttcttattgtcaatcttttcatttgtacaatgaggatatttgtagaattagacaacctctagtttaatggctaatg

SEQ ID NO: 6792784 - DNA, 96 bp, Homo sapiens
gcaccacagcagcgttcctccgtgtgtttgctcagcattccaagctcctccactctgatactgccttcatatggatatgaacctctgtgattgtgc

SEQ ID NO: 6792785 - DNA, 77 bp, Homo sapiens
tgattacttaagacaataatctttgagtagagttgagctatagcttaagacaggctcaaagattaatgtggttttca

SEQ ID NO: 6792786 - DNA, 80 bp, Homo sapiens
tgctattgttttgaatatggctgtgagacaaagagctgcttaggtcaagcgctataaattacagttttcatacaatagta

SEQ ID NO: 6792787 - DNA, 85 bp, Homo sapiens
ggtcctttaagaaatgaggagaacagggcttagaaatctgttgcctagcaacatggtactaactttgccttccattttccaaacc

SEQ ID NO: 6792788 - DNA, 58 bp, Homo sapiens
actttatacactgagtttagaacctctatgtgagatgttattcttcagtgtgttgggt

SEQ ID NO: 6792789 - DNA, 63 bp, Homo sapiens
atattgagtactgctgcaaacagaggcattcttataaacagtttggagaagtgctatcagtat

SEQ ID NO: 6792790 - DNA, 118 bp, Homo sapiens
tcagtaattgttttagcccactgcaaagctgttcacaaatttcctgattctatgaaatatgcaagggagatactgatgaacaacttgcaatgtcatggcttacaaaaatgttagatga

SEQ ID NO: 6792791 - DNA, 60 bp, Homo sapiens
gaagataatgtgtttatttctgtgaaactaaaaaacagaatatcgtagcatattatcttc

SEQ ID NO: 6792792 - DNA, 66 bp, Homo sapiens
gtcgcactcagccaggccaggcattcacactcagggtgagtgggaaccaggactggctgaggcagc

SEQ ID NO: 6792793 - DNA, 89 bp, Homo sapiens
taagaggggtaagagactcatcataatatggaatcttgttctgacatcttcggaaaagttctctatggtgtaaaaacttcaacctcttg

SEQ ID NO: 6792794 - DNA, 55 bp, Homo sapiens
gcttttagtgtgctcattgatgagtgaaagtcgccacacatgtcaagctaaaggc

SEQ ID NO: 6792795 - DNA, 68 bp, Homo sapiens
gtgactagcccatgtgcgtgttggggggggctgtggctctgcctcatacccatgtgtggccatctcac

SEQ ID NO: 6792796 - DNA, 84 bp, Homo sapiens
agcattccacaatagctgcttcagtctaggtctcagaatacatttagatgaaggagaccagaatgaagacaaagcctggagtct

SEQ ID NO: 6792797 - DNA, 56 bp, Homo sapiens
ggaggcctggctctgccctcctggcccttccagtccagtggggaggagaggcctct

SEQ ID NO: 6792798 - DNA, 86 bp, Homo sapiens
catttgactacaatgagtaatttctgagaaaggatagtgagggagaagaacttttctgtcagcgtcagaaattcttaagtctgatg

SEQ ID NO: 6792799 - DNA, 73 bp, Homo sapiens
taatgtataacaaatactcatcccaggaactggctccaagtagtcattcaataaagggtatctgttgtcatta

SEQ ID NO: 6792800 - DNA, 72 bp, Homo sapiens
aagatctggaatgaatgaggttctgtggtccccttataaagcctcttgcattccaaatgtgtaaatgatttt

SEQ ID NO: 6792801 - DNA, 127 bp, Homo sapiens
ttcactggaggattatacatccctttctgactgacatcagaaatagtcatgttactttttttgctgatgaagtgtggatgaatatattatatgtcatgtctaggtagaatctgtaatagccagtgga

SEQ ID NO: 6792802 - DNA, 78 bp, Homo sapiens
ggggcacctgcattctatttcttaagagttatttagcaaaaagcaaggtgcagtgaaggaaaaggaaatagctgcctc

SEQ ID NO: 6792803 - DNA, 83 bp, Homo sapiens
ggtgcatgccgggaagcagcatcctgggcagaccttgaaaagagacactaggtcggccggggaggctgctggcatctgaaacc

SEQ ID NO: 6792804 - DNA, 94 bp, Homo sapiens
gaggagccatggagtgggggctggctctgtctgtatgttcagcaatggatccagcagagaagatgcccaggcttccagacacccttggccactc

SEQ ID NO: 6792805 - DNA, 57 bp, Homo sapiens
aaggagtctgggccattcagagccagcctcaggcagctttgtcccccagtattcctt

SEQ ID NO: 6792806 - DNA, 104 bp, Homo sapiens
acactgaaatgcaatcgtttgttaaaaggctgttctcttctgttgtcaataaatttccttttgctgacagttactgctgtaacagatgtctgtatgttggttgt

SEQ ID NO: 6792807 - DNA, 55 bp, Homo sapiens
gaccccagtctgcactccttccccctccgtgggggaagctctgtggcttggagtc

SEQ ID NO: 6792808 - DNA, 61 bp, Homo sapiens
ttgtgtcccctgttctacctgtagtattgcttaattgaataatgggattatggggacagaa

SEQ ID NO: 6792809 - DNA, 68 bp, Homo sapiens
agcagggccagggctatggtgaagtgtgggaggtgcccagtccccttcactgcagtcatggctctgtt

SEQ ID NO: 6792810 - DNA, 56 bp, Homo sapiens
ctatgaatgtatataggcagatttatatgtatgtgtgtgtatatatatattcatag

SEQ ID NO: 6792811 - DNA, 73 bp, Homo sapiens
gtttgactacatagcgtcttctaggtatagttcttccaaactccagcttgggatatgctgatgtaaacaaaac

SEQ ID NO: 6792812 - DNA, 83 bp, Homo sapiens
gactttgctgtggtcccataggtaagcgtgcaggtccaagcgtcggctctactgtttactgcctgtgtgaccacgggcaagtc

SEQ ID NO: 6792813 - DNA, 106 bp, Homo sapiens
gtcccccttcaaacctgaagtgctgtctccttcccccgggggcctacttgccgctttggggcgcaccccgtgggagagacacgcaccctgggtgcaagccagggac

SEQ ID NO: 6792814 - DNA, 59 bp, Homo sapiens
ccaggctcaatggccacttgggcccttggatgagggctagctgcatttatgagacctgg

SEQ ID NO: 6792815 - DNA, 85 bp, Homo sapiens
ctgtcacatcgtctgtctgatgtgctaggggagggccagggtgggaaccctgttcaccctccatgcacagaacagacggtgacag

SEQ ID NO: 6792816 - DNA, 61 bp, Homo sapiens
tcagcaccttccttaactccaggacaaagtgggggttgggggaagaatggggaggtgttga

SEQ ID NO: 6792817 - DNA, 58 bp, Homo sapiens
ttgtaaacttcttttggttttatggccatagtgcgctttagacataaagagtttgcaa

SEQ ID NO: 6792818 - DNA, 78 bp, Homo sapiens
caagtatatactcagggaattatttctgtcctattgataatttagaaggatttgattggctctactgagtagtccttg

SEQ ID NO: 6792819 - DNA, 57 bp, Homo sapiens
tgagatggagtctcgctctgttgcccaggctggggtgcagtggcgagatccggctca

SEQ ID NO: 6792820 - DNA, 94 bp, Homo sapiens
gcaggattgaagcctgtttcatggcttgtaataaatttatagatgctataatcttcatttccaagccactgtgtgataaaagcccccatcctgc

SEQ ID NO: 6792821 - DNA, 78 bp, Homo sapiens
ttcagaggtttccgggccatgccgttctgcccctcccaccccagagcatcccgcacagcccgaggcagcttctctgaa

SEQ ID NO: 6792822 - DNA, 72 bp, Homo sapiens
acatagcaagtgctcaataaatagaagctgttaggattgtgttaactgacatttactgagcacttactatgt

SEQ ID NO: 6792823 - DNA, 63 bp, Homo sapiens
agctctgtgtttgacaggcggtctcccttatggttagtggatccctcttttctagcacttgct

SEQ ID NO: 6792824 - DNA, 73 bp, Homo sapiens
tcgaggggagagcagggaggctgctctgttgcccatgggcctcaggaagccaggccttcctgccgccgctgga

SEQ ID NO: 6792825 - DNA, 75 bp, Homo sapiens
gctgttgtccttctgtaatggactgtccctggtgcgctctcagacgcagcaggacacgatgcggcaggacccagt

SEQ ID NO: 6792826 - DNA, 57 bp, Homo sapiens
gctatataccaaaatatcagaaagggaggatcttttgaaatatttggtatatatggc

SEQ ID NO: 6792827 - DNA, 90 bp, Homo sapiens
tatctttctttcacttatttcttgagtagcatttatggaaagccagcggcggtgttggatggtgttttcagggtgggagtgacatggatg

SEQ ID NO: 6792828 - DNA, 63 bp, Homo sapiens
tgagcctaggccttgctatgaagcagtgtccaaatggaaaatgttgaatgaatgtctggctca

SEQ ID NO: 6792829 - DNA, 58 bp, Homo sapiens
ccagcaactggtgtaatttctgacgtgtgtcataaatcatactccatttgcactttgg

SEQ ID NO: 6792830 - DNA, 61 bp, Homo sapiens
agtagctgtatctgccacctgctatgccgtggtgggcactgtatggcattgattagttact

SEQ ID NO: 6792831 - DNA, 67 bp, Homo sapiens
ctgttgaaagccacatccttggttgattaatcaagtaaaatttgcattcggctttagggatgtacag

SEQ ID NO: 6792832 - DNA, 65 bp, Homo sapiens
ggcgtcagggtgcacagtgcaaccgtgcccataggcagagacacattgagcgaccctgcatgact

SEQ ID NO: 6792833 - DNA, 87 bp, Homo sapiens
tcccaagcctaacatagaacctggcacatagtaagccaacacttgtcaagggcttactatgtgccaggctctgtgttaggcttggga

SEQ ID NO: 6792834 - DNA, 55 bp, Homo sapiens
ggcaaggccaggcctccaagaccttcctccgcgggtctgtggtcaaggccttgtc

SEQ ID NO: 6792835 - DNA, 63 bp, Homo sapiens
tgttcttcaggagctccgggggctgagcatcactttaggccaggacagagcttccagaagaca

SEQ ID NO: 6792836 - DNA, 62 bp, Homo sapiens
gtagacgtgaagttggcctgtcccggattgaaactctgacagcagccacctctcacccatgc

SEQ ID NO: 6792837 - DNA, 76 bp, Homo sapiens
cagctgcactgaagcaggtttggagggccctaggaaggcatgggcagaaactgacctgctctctaggggcatgctg

SEQ ID NO: 6792838 - DNA, 66 bp, Homo sapiens
ttccggggcctagctgcacaccctcctgtccgtactcaccggagagctctgcactaggccctggga

SEQ ID NO: 6792839 - DNA, 55 bp, Homo sapiens
caggctgcagtgcagtggctattcagaggcatggtcatagctcactgcagccctg

SEQ ID NO: 6792840 - DNA, 116 bp, Homo sapiens
gggagagtagctggagatgaagccaaaaagcttgatagtggctatcaagccagagagacaaggaatgatggtgacttcgagtgtctgtttgttgtatttcttacagcagctctttc

SEQ ID NO: 6792841 - DNA, 70 bp, Homo sapiens
tagccctgagtctctcaacctcggcactattggcatttggagcctgataattcgtggttgtggagggctg

SEQ ID NO: 6792842 - DNA, 60 bp, Homo sapiens
gaatggctgggttcttctataggtataggtttaacttaatcagaaattgcccagctgttt

SEQ ID NO: 6792843 - DNA, 105 bp, Homo sapiens
gttctgttttgcctttgtgaagaacagtgaacatgctctgcacttttctaaagtagaaaaatgagctgatgtcagggattctttcaagaaggcaaatttcagagc

SEQ ID NO: 6792844 - DNA, 69 bp, Homo sapiens
ggggctacagtgaggtggtttcctttactactaagtgaagtcatgccctgcctcaatgatttgagtccc

SEQ ID NO: 6792845 - DNA, 55 bp, Homo sapiens
ggagacagatggcgtctcagttcccagctctgggtctgaccagcagcctgtctcc

SEQ ID NO: 6792846 - DNA, 62 bp, Homo sapiens
atctgcttgtaatccttgcagagactcatatgtcactttaaagggttaacaggaaactagat

SEQ ID NO: 6792847 - DNA, 97 bp, Homo sapiens
gggagatatcagtgattcaggtattgctatttctgacttaagagataaaatgatagtaacacattgaacgatcgctagatacgaaatgacccctccc

SEQ ID NO: 6792848 - DNA, 67 bp, Homo sapiens
gccaggtgtcctcacagtgaggccttgggcttacagacctgagtacttcccatgggagatacctggt

SEQ ID NO: 6792849 - DNA, 75 bp, Homo sapiens
tattcaccactgtatccctagcacttagaacagtgttcagcacaaagaaagtgctcagggaacatttgttgaatg

SEQ ID NO: 6792850 - DNA, 89 bp, Homo sapiens
tttcaaacatgctgttctgtattgattctgttaggcattgggaatccaaatgcactgattttagttaattagctcagatatgcaagaaa

SEQ ID NO: 6792851 - DNA, 59 bp, Homo sapiens
gcccaggagaggccagggctgagccagcatggaaatggaattgcccctgcctcctgggc

SEQ ID NO: 6792852 - DNA, 62 bp, Homo sapiens
gagaggacagtcagctcagggtgttggttctacttagtcattgtgagctggctgagcctctc

SEQ ID NO: 6792853 - DNA, 63 bp, Homo sapiens
acacagcctcttaagagaatcagaatttgtttcttcctttgtctgtctcataaaggggtgtgt

SEQ ID NO: 6792854 - DNA, 61 bp, Homo sapiens
gagtcattactgttgaatgcttggagttccgtgacatccatacagaatgcagtaagggctc

SEQ ID NO: 6792855 - DNA, 55 bp, Homo sapiens
catatctgtttcctatgcatgtgaatttgttttcataaggcatgtaacagaaatg

SEQ ID NO: 6792856 - DNA, 78 bp, Homo sapiens
cagcgtgaggggcggcgcattcatcttctcaagcaccacgtgcgtgtgagcactgtgatgctgttccctcctacactg

SEQ ID NO: 6792857 - DNA, 57 bp, Homo sapiens
tcattcactgatgccttaatgtgaatgagttttacattagaaggtagagtggaatga

SEQ ID NO: 6792858 - DNA, 78 bp, Homo sapiens
gaaaggagaaagctattgcttgtccaaacagattgttttttccttctgtttggcaacctcaatggctctacctgtttc

SEQ ID NO: 6792859 - DNA, 86 bp, Homo sapiens
gtcatggataacaaaggattctgggcagtttattcagttctgtcaaaacgatcactgaacttctagcttgctcaggccttccatgc

SEQ ID NO: 6792860 - DNA, 70 bp, Homo sapiens
ttccaaagaacatgaacacaatgtttagaaattggtttctgagcccttggtatgttcattgttgttggag

SEQ ID NO: 6792861 - DNA, 88 bp, Homo sapiens
aggcaaaccttgccaatttttagtttgatcaatggcagccttgtatatgcaagtccaccagtcagactaggaaataccagggttgcct

SEQ ID NO: 6792862 - DNA, 90 bp, Homo sapiens
gtgctgggcagatccttctgggccaacttccaggagcttctagatgagggtcctgaagtcacaggctctgagcgtgggtctgggcagcgc

SEQ ID NO: 6792863 - DNA, 69 bp, Homo sapiens
gtaggcaagagtgtgacacccagagcccactgggagtgaactggctggtgttacagtcggcagcgctgc

SEQ ID NO: 6792864 - DNA, 72 bp, Homo sapiens
tgctttgcccaagggccctaccctctcagggacatggcaagtgcagccaggaaggggagggtctgcaaagtg

SEQ ID NO: 6792865 - DNA, 78 bp, Homo sapiens
gtcctgtgctaagcactttatatgcattacctcatttaaccaaatgagcatacatatgtaaagtgcttggcaaagtgc

SEQ ID NO: 6792866 - DNA, 83 bp, Homo sapiens
tgactcatacagggataaagcccactgtttggacctcactttacaacccaccaacccctgctcagttatccgtgtgtgactca

SEQ ID NO: 6792867 - DNA, 86 bp, Homo sapiens
ggggtgggcaggtgttgtcaatctaatcaggttatgtgttcttaaccattgtattggccatatcatgctgagtaacagattacccc

SEQ ID NO: 6792868 - DNA, 60 bp, Homo sapiens
gcacgaggcaccgctgttttgttaaagaccagcatcgttggcaagcagggtccattgtgc

SEQ ID NO: 6792869 - DNA, 90 bp, Homo sapiens
gggaggctaacttttgtcttcttgactttcctatgcaagctactcaattttggagaggaagtgtcagggataacgataagataacttccc

SEQ ID NO: 6792870 - DNA, 60 bp, Homo sapiens
ggccctacagtgtggagattttagaattactgccttctcagttctatagtcttcacagcc

SEQ ID NO: 6792871 - DNA, 95 bp, Homo sapiens
gttttgttttttgttttgttttcttttgttctttttaaatagctggccaaggttagagactaatgggagcggaagtgactgagcagaaacaaagc

SEQ ID NO: 6792872 - DNA, 75 bp, Homo sapiens
ctgttaagaactgtgaagtatgtgaaattttatcttacttataattttacaagtttacttcatggatgctgacag

SEQ ID NO: 6792873 - DNA, 62 bp, Homo sapiens
gtgggagacagaagagggctgggctccacactcaggcaccttagccctctctgtctgtgtac

SEQ ID NO: 6792874 - DNA, 63 bp, Homo sapiens
gtctctgtgtgtgattgtgggtctgtgtgtctgtgtgtgtgcggaaggggtcataatggagac

SEQ ID NO: 6792875 - DNA, 59 bp, Homo sapiens
gtgtgtgtgtcctcagtagtggcatggttcttaagctgtgaatctatgacatatagaac

SEQ ID NO: 6792876 - DNA, 67 bp, Homo sapiens
ctgccttgtgatggagaagcaacatctggacctaagacctagcagacagctgcctccaccacagcag

SEQ ID NO: 6792877 - DNA, 111 bp, Homo sapiens
cttgtaaggcacatttattcataaagtaatttttctatgtataaagttgtgctttgttttactggatgtctaacaacattatacatagaaagctttgatggatggtacaag

SEQ ID NO: 6792878 - DNA, 94 bp, Homo sapiens
gcctagaattataatacaatataacacatcgtaatatcggatattataccacgtttacctcccattaggatgtgtatattgtgttaggctgtgc

SEQ ID NO: 6792879 - DNA, 63 bp, Homo sapiens
gtagttatcatcatactccagaccaatacttctcatctgtgtctgggttattatgatggctac

SEQ ID NO: 6792880 - DNA, 63 bp, Homo sapiens
aaagcacatagtagaaggatttgctgagcaaagaattaaagcaaagtccactgtatgtgcttt

SEQ ID NO: 6792881 - DNA, 70 bp, Homo sapiens
gtctggtttcagggcaggtgagccagcccagaagtcaggcccaatggctccggcgctctgagacagggac

SEQ ID NO: 6792882 - DNA, 55 bp, Homo sapiens
agggatgatcagggtagaggctcaatcctgatgatgggccattcagattctccct

SEQ ID NO: 6792883 - DNA, 80 bp, Homo sapiens
gccatttcaggatggcacccaagctcttagtagtcatcccaagatggcatccaagttctgggtggccattccaagatggc

SEQ ID NO: 6792884 - DNA, 69 bp, Homo sapiens
ctttttgtctcttaaagcccttggcagagttccccacaaagtgccttgctctcccgggggttcagaaag

SEQ ID NO: 6792885 - DNA, 57 bp, Homo sapiens
gtgagtggaagtgtgtatatttgtgtgcaagtgtgtactcatatacttccaccttac

SEQ ID NO: 6792886 - DNA, 58 bp, Homo sapiens
tactttcttcttatgcattaaggaactgcttttgtttctcttttgccggagggaagtg

SEQ ID NO: 6792887 - DNA, 91 bp, Homo sapiens
tgatgtcggtatttactttgtgtttatatgtgtaagtgtatgttcatatatactttcatgtctatacatatttatgtacttctatgcatca

SEQ ID NO: 6792888 - DNA, 76 bp, Homo sapiens
tcagttacttaaagtttgaatgatatattagtttgctagggctgctataacaaaatatcacagactgggtgactga

SEQ ID NO: 6792889 - DNA, 76 bp, Homo sapiens
gtgtttgcaagaacaggcagttggttggatttggcccacaagccgtagttcactgacccctgttttagataaatac

SEQ ID NO: 6792890 - DNA, 64 bp, Homo sapiens
atatgtgcatgtgtgtgtgtgtgtgtgtgtgtgtgtgtgtgtgcttgcatacatgttaacatgt

SEQ ID NO: 6792891 - DNA, 75 bp, Homo sapiens
tgacaccaagtctgatcatttcttctatatgctgctgtttcatatatgaggaatctggtacagaatatatagtca

SEQ ID NO: 6792892 - DNA, 129 bp, Homo sapiens
tagttttatgtgtcaacttgactaggctatagtacccagatattcaaccaaacactaatccaggtgtgctgagaaggtattttgtgaatatggttaatacctaaaatcagttgactttaagtaaagaag

SEQ ID NO: 6792893 - DNA, 57 bp, Homo sapiens
agatgctcaccctgggctgatgagtcactctggcttccagtccaggctgcagcatct

SEQ ID NO: 6792894 - DNA, 60 bp, Homo sapiens
ccggtcagtcttgaacagccccctgtgtgcatgtgtgtatagtggggacaggatggttgg

SEQ ID NO: 6792895 - DNA, 55 bp, Homo sapiens
tatgctttgaaaatgtgctgaaatcatttattccttagcatgtgtagaaagcatg

SEQ ID NO: 6792896 - DNA, 99 bp, Homo sapiens
ttgttagggtaagggtgacctatcttggtctccaggttgagctgagcagaccccagctatgttcatcctgacttggattagtgctcttaccagtaataa

SEQ ID NO: 6792897 - DNA, 56 bp, Homo sapiens
taagagatggttatcaaaagcacttgcatgccaatgttttcttgtgccatttctta

SEQ ID NO: 6792898 - DNA, 67 bp, Homo sapiens
tgttcagatttcatgagtaattgccatgtaaaaggtaacttggcggtgggctcagtgaagctgaaca

SEQ ID NO: 6792899 - DNA, 67 bp, Homo sapiens
tttcatggggttgtactgaatgggaatatgtaaagtttcatttgttatttacaacaatcctatgaga

SEQ ID NO: 6792900 - DNA, 102 bp, Homo sapiens
gagctgcagagtgggaaactatgggatgggctgggaatacacaggggaggatgcctccttaaagtaggcttcggactatgtatatggatcccctttgggctt

SEQ ID NO: 6792901 - DNA, 72 bp, Homo sapiens
tgaatgtaggcatcactctctcttgggcagttatcacattggcagactgaagggatgtgatttctacagtca

SEQ ID NO: 6792902 - DNA, 91 bp, Homo sapiens
gaactccacagttatccacctttttgcctgtgaatactatcttgcctcacactggaagatggagcacgagcagaagcagaaattggagttc

SEQ ID NO: 6792903 - DNA, 58 bp, Homo sapiens
gtatgaattacccatcataattgttctgtcttaaggcaaatatgctgggagtttatat

SEQ ID NO: 6792904 - DNA, 68 bp, Homo sapiens
tcatcaatacatcaggtcaaaatgtgacacatcaacaatgacatcacaggagattgatctattggtgg

SEQ ID NO: 6792905 - DNA, 122 bp, Homo sapiens
tgtactttatttggtgcttttggaaagagatcaagcaagatagagttgcaaatattcagcctttattgagtgttgtgagttttctcctgttctctgacatcaagagtactgcacagggtata

SEQ ID NO: 6792906 - DNA, 70 bp, Homo sapiens
ctagctgagaggtggcaagctgtaggcatcattcacacattcagaaaccgtaccttgaacctccacctgg

SEQ ID NO: 6792907 - DNA, 71 bp, Homo sapiens
gggtaaggaggcgaggtggtgagcagctgagccatgttaacagccttgcttgcccatctccctccttcact

SEQ ID NO: 6792908 - DNA, 60 bp, Homo sapiens
aggttagtgctgaaatgacatgggaactagaccatttctaaactggattcagcctggctt

SEQ ID NO: 6792909 - DNA, 86 bp, Homo sapiens
ggctcatgtgcttgtctctctgtgcccactcgatgccatggagaaggtgagagtgcagaggacagaggaagggaggctcaggagtt

SEQ ID NO: 6792910 - DNA, 81 bp, Homo sapiens
ccagcgtcagcatgcgtgtggtgtctgcagtctgcctctgacaagcagggcagaggagtgattatgccgtgtggaaaatgg

SEQ ID NO: 6792911 - DNA, 83 bp, Homo sapiens
ctggtcaagcagagaccggctaatggagaaggggttgtttcctcccctccctccttgcctcggtcgatttgcattgatcccag

SEQ ID NO: 6792912 - DNA, 130 bp, Homo sapiens
ttctttcgaaaagtatgaataagccattagaatttaaaatttacagatgcattgcagtggaatgggagaaagacatccttgtacaacgttttaaatttgacagttctcagttgattcagatgcagagaga

SEQ ID NO: 6792913 - DNA, 130 bp, Homo sapiens
tttaaggcaggggtcatgtctgtttaaattatggtattctcagcacctagcacaataaattactgtgggtgtaaacagaagattatgatatttattattagttaaatcagataatatgaatctcagtaaa

SEQ ID NO: 6792914 - DNA, 67 bp, Homo sapiens
atgaaagaatgagcatcatgacttaagatctgagatattagagaagttactatgactcttcttttgt

SEQ ID NO: 6792915 - DNA, 109 bp, Homo sapiens
caacttacacaggtagcccagactcaagtggcttggtattaaggtgccagttacgagactggtccatgctccaggcacattcttctttgcgttggctgtcttaagcttg

SEQ ID NO: 6792916 - DNA, 78 bp, Homo sapiens
ggaaccagaggccacatgtggctgctcgtatttaagttaattaaaatggaacgatggccgggtgtggtggctcacacc

SEQ ID NO: 6792917 - DNA, 64 bp, Homo sapiens
gccaggcagcctttatggaaaggcctggcatttgctttgtgaaggtcacatggaggttgaaggc

SEQ ID NO: 6792918 - DNA, 65 bp, Homo sapiens
agctactatagaactacagtgatacagctgagccatttggatcaagtcgctgtgttcatagagct

SEQ ID NO: 6792919 - DNA, 80 bp, Homo sapiens
aacaatgcttccatctttgacagctaactttccaataaatgaatctaatgttggagtttcttaacaggtggaagcttgtt

SEQ ID NO: 6792920 - DNA, 59 bp, Homo sapiens
ttcagatgtggctttgtcaggcgttgccaaagttcccttgttttacaagccacattgaa

SEQ ID NO: 6792921 - DNA, 129 bp, Homo sapiens
cattctttacttcttaactaagagctcctcaagggagaaagaatgagtttaggagaagaacctaacatgctagactccacatgaccactctttacttcttactaagagctcctcaagggagaaaggatg

SEQ ID NO: 6792922 - DNA, 79 bp, Homo sapiens
tattatgttaatagtggcagagcatgagtgttaaagatctatagactcaaatatcagctctgtcacttactaaccaatg

SEQ ID NO: 6792923 - DNA, 86 bp, Homo sapiens
ggctgcattacagtttgagtccattatagttattgcaagttaaattgtttatagtaagtgatttgtagtatactatgacttcagcc

SEQ ID NO: 6792924 - DNA, 75 bp, Homo sapiens
gagtacactttcattgatatagttttaaaatgctgtagcagcattttagtgcctgattaatgggtttatttactc

SEQ ID NO: 6792925 - DNA, 65 bp, Homo sapiens
ctcatcagccacacttagtcacaaagatgttcctccagacagcttgatgaaagtgggtgctcggg

SEQ ID NO: 6792926 - DNA, 55 bp, Homo sapiens
cctatctggggtcctttggctccatacacaccagacccagagcccgccagatggg

SEQ ID NO: 6792927 - DNA, 91 bp, Homo sapiens
gaggctttggagttagataaacctgggtaggattctctgcctgttactagctatgtgttccttcccaggttgctttacttctcagagcctt

SEQ ID NO: 6792928 - DNA, 72 bp, Homo sapiens
agttgaaattgtctttatcacagttcaaaaatagttaaatagttgaggctgctgatggtgaggacaaaaact

SEQ ID NO: 6792929 - DNA, 89 bp, Homo sapiens
tcgcctttcaaaaaagggagtggcaggaggaacagcgagtcagacttgaaatgaaacttctccacccactcttttgttgccagaggtga

SEQ ID NO: 6792930 - DNA, 73 bp, Homo sapiens
tgttatgcataggtcattatctacagaagtgtgttctggaaaaaggacgccaatggtgtagtgatgtataaca

SEQ ID NO: 6792931 - DNA, 60 bp, Homo sapiens
tctcatttaattctgcccaaaagcaaatgtacccaggcttttgggcaaaattaaatgaga

SEQ ID NO: 6792932 - DNA, 82 bp, Homo sapiens
gcaataaatggatttaaccatacggtagcttcacttgtaaagataaatgtgaagttggtcctaggagttgagttaaatttgc

SEQ ID NO: 6792933 - DNA, 90 bp, Homo sapiens
catctgtacatgtgcatctatatctgataacagtcttaattttgcccagaaagtgcttttattatatacaggagtcatgaatgtacagtg

SEQ ID NO: 6792934 - DNA, 85 bp, Homo sapiens
ccggatccttcccggcttctcccccactcttcgcccccggggcccctccctgctgagcgggggctgccgggatttgggattgcgg

SEQ ID NO: 6792935 - DNA, 65 bp, Homo sapiens
tctggtcactgtccaattctattaggtccaggaaagtagcagatatgagaattgttcagtctaga

SEQ ID NO: 6792936 - DNA, 68 bp, Homo sapiens
attacagaaacagcgtggttagaactccagaaatctgggtttttccaattctgattctattatgtaat

SEQ ID NO: 6792937 - DNA, 92 bp, Homo sapiens
cctggggaagcggatggagcaaatggggctgcaggagtcccaggagtcccaggagcttctgtgcctcatctggttcaggattttcttccagg

SEQ ID NO: 6792938 - DNA, 56 bp, Homo sapiens
tggcaagagcaaaatgtacagttagatattaaattattgtatgaaaactcttgcta

SEQ ID NO: 6792939 - DNA, 77 bp, Homo sapiens
ggccttttcccgctcctgaagagcctccccgaagcgctgtcgggaagcgctctcctcagggtcctgcgggtcaggcc

SEQ ID NO: 6792940 - DNA, 57 bp, Homo sapiens
ggctagagtggaactggagcggggttactgacctcctcacagtcaacactttgagct

SEQ ID NO: 6792941 - DNA, 69 bp, Homo sapiens
tgtgtgttctatggttcagggtgggatgtgggaaggggaaggccatgcaccaccctccaggaacacata

SEQ ID NO: 6792942 - DNA, 62 bp, Homo sapiens
gtcacacaggttgaaatgcagtggcacaatcatggctcactgcagctttgaccttcagtggc

SEQ ID NO: 6792943 - DNA, 55 bp, Homo sapiens
gggaaagggtggccagaagatgggctttgtgctgtcaactttgctaccctatcct

SEQ ID NO: 6792944 - DNA, 63 bp, Homo sapiens
ctctccatctgtgtgacctcccccatttgaggctgaaaatttggggagaagggctgatgagag

SEQ ID NO: 6792945 - DNA, 128 bp, Homo sapiens
gttctcctctttgtgtgggtacctgtgagcatggtggctgaagtgggcaggagggaggccgttctgtgtctcttcctccttatttcatgtgatgctgctccagaggcctggcttgaaaagagcaggac

SEQ ID NO: 6792946 - DNA, 61 bp, Homo sapiens
tatggactaggcactgggctattttgctgtggcataaatctgttcccagagcttgtctgtg

SEQ ID NO: 6792947 - DNA, 60 bp, Homo sapiens
atcagaccatccagcgtggatgcaataactcccagctgcttcatgctttttggctctggt

SEQ ID NO: 6792948 - DNA, 79 bp, Homo sapiens
gaagtggaacacacacagaaaaatgatccctacgtggtttaattaaggggaaagtgaattgtgtagtgttttaccattc

SEQ ID NO: 6792949 - DNA, 72 bp, Homo sapiens
agacacaaatggaaaggcttaaaggacatggcatacgtttttggacccaagtccagtttttccaggtggtct

SEQ ID NO: 6792950 - DNA, 64 bp, Homo sapiens
tgcctgactgctgccaccactaacaaatcaatgggcccctagggttggaggtggtgcaggggca

SEQ ID NO: 6792951 - DNA, 55 bp, Homo sapiens
cttctgctgtcttttctccatcctgcagcctggaactcagatatgatagcaggag

SEQ ID NO: 6792952 - DNA, 69 bp, Homo sapiens
ggcattctttttccagtggttttgaaatattatgttcattagagaatatagtgccaagcctctgatgcc

SEQ ID NO: 6792953 - DNA, 56 bp, Homo sapiens
tctggcagcacagcatgccccaggatggagctggctcagacagctgtgcagtgggg

SEQ ID NO: 6792954 - DNA, 59 bp, Homo sapiens
gtgtccttatattgtggaaggggcaagggagctctctggggtctcttttatagggacac

SEQ ID NO: 6792955 - DNA, 63 bp, Homo sapiens
ggtttcctttgcttctcctgagtatgaggcacaatgaaacctaaaggaacagcagggaacgcc

SEQ ID NO: 6792956 - DNA, 110 bp, Homo sapiens
agcgcctggcgggcaggaggaaggagggcgtcggagctggtcagtttcagggccagattacacgtggatggcagagacaaggccgggcctcgcccctgcaccccggggct

SEQ ID NO: 6792957 - DNA, 70 bp, Homo sapiens
ggcggggctggcacatggctcagggcctacagtggtgggctccagctgtttgccatgagatcgtcttgcc

SEQ ID NO: 6792958 - DNA, 63 bp, Homo sapiens
gagggtctggagtagatgagtcatgttgcaagggaatgtggagaacttctacaccagaccctt

SEQ ID NO: 6792959 - DNA, 109 bp, Homo sapiens
tgttcaatatcagcttgcatcagaattacttggagggcttattgattaaaacacagattgctgggccctgcaaaaaaagtttctgattcagtaggtctggggtggaaca

SEQ ID NO: 6792960 - DNA, 116 bp, Homo sapiens
gacttcattttcctggaaggaattttgatgatctatagtttcctacatttctattgtaggatgaaactgaaatcaatcagtgattcagagacatgtccagtgcctcttatggagtc

SEQ ID NO: 6792961 - DNA, 71 bp, Homo sapiens
tctttgctgccttccgaatcctctcctttgtgatcctgtaatttgtgagagagcctggagggtagcatgga

SEQ ID NO: 6792962 - DNA, 60 bp, Homo sapiens
gtgaactgtggcgtctctggctgagcctggagggcaggaggctaggatgctggggtttcc

SEQ ID NO: 6792963 - DNA, 59 bp, Homo sapiens
ctttgttagcagccaatttgttctacttgatccagagcatttaggcaacgctaccaaag

SEQ ID NO: 6792964 - DNA, 67 bp, Homo sapiens
gagacacaagacgcaactctgtcttcattgctcaacaaatgctaacagggtgtgtgcttctgttctc

SEQ ID NO: 6792965 - DNA, 95 bp, Homo sapiens
tattttcctgagtaggcaattgggcaagagggttcttcagcccaactgcgactggttgaatgctcacatgcctaggtcaccctacaagggaagtg

SEQ ID NO: 6792966 - DNA, 78 bp, Homo sapiens
tgacccacatgcaagcagccgtgcagatcatccagcgcttcctcatgggtacatatctgcttgttgcatgtctgttca

SEQ ID NO: 6792967 - DNA, 125 bp, Homo sapiens
gcactgaaggcccatttacagttaaggtctctgatgattggaagcttagacagattgctatcaagtggttgggtatatcagaggctttggtacttaattcatagctgttagttggattacactgc

SEQ ID NO: 6792968 - DNA, 129 bp, Homo sapiens
ccttgcccagtgtttctataaaataagggccttttgcatctgatttaagtaggaagctgattcctgagcccctcagatctgctgaatcagatagctaagggggccctggaatctgcattttagcaagcg

SEQ ID NO: 6792969 - DNA, 58 bp, Homo sapiens
ggttcccaccacccaggcagagatcaaagatgcaatctttcaagggaccctggggatc

SEQ ID NO: 6792970 - DNA, 85 bp, Homo sapiens
gcacccctcaagagggttgggaaggcaagaagtagaagcagctgcttccttttttgtccttcccagatacccatgatgagggggc

SEQ ID NO: 6792971 - DNA, 59 bp, Homo sapiens
cactgctgggcagaggctgcatgacaatatgggtaacacgcaggatctgcctagcattg

SEQ ID NO: 6792972 - DNA, 65 bp, Homo sapiens
cccctgctccagccaaggtatcatgagaggcactagtgtgtccctcacttccccttggccagggg

SEQ ID NO: 6792973 - DNA, 72 bp, Homo sapiens
tcaatttgtttatcattattattagcaacctttgcacttattttggtctagcaatgatgatgagctattaga

SEQ ID NO: 6792974 - DNA, 65 bp, Homo sapiens
cttatgcttatcagtcctatgaaattggtgctgtttttattcccatttcataggtgagcatacag

SEQ ID NO: 6792975 - DNA, 67 bp, Homo sapiens
gatgggattttttatgtgttcaggggtaagctctacctacaggaaaaattatatagagaaacccatt

SEQ ID NO: 6792976 - DNA, 77 bp, Homo sapiens
gatagcatttaaacaaatatttcaggtaggtacttcaaatgcatttgacatttatcaaagaaatggtaagtgctgtc

SEQ ID NO: 6792977 - DNA, 68 bp, Homo sapiens
gtgattggtagccaggcgaggatgggttttggaattaactcttcctacagtctgctatgcattatcac

SEQ ID NO: 6792978 - DNA, 55 bp, Homo sapiens
gaatgaagcaggtcacacagttcctttaaaaggtatttgtgaagctgcttttttc

SEQ ID NO: 6792979 - DNA, 74 bp, Homo sapiens
gctggggctcagttgtctttgggaggccctgtgtgtcctgtgtagccaagggcctggactaattggatcccagt

SEQ ID NO: 6792980 - DNA, 55 bp, Homo sapiens
ggtggttcacgcctataatcccagcaatttgggatgctgaagagggcagatcacc

SEQ ID NO: 6792981 - DNA, 58 bp, Homo sapiens
gtccacaacatcagactaactgttctaactaaaggacggctggtcaggtgttctgcgc

SEQ ID NO: 6792982 - DNA, 88 bp, Homo sapiens
gagaagctgggaacttacttgggtagatgatttggcaatattcactctttcctttgccaccccaacctccctaagttgagtgcttttc

SEQ ID NO: 6792983 - DNA, 56 bp, Homo sapiens
tctgcttctgtgaaggcagtctgagaccacactgactgctggcttttacagacaga

SEQ ID NO: 6792984 - DNA, 59 bp, Homo sapiens
tgcagaacgctcccccaggaggctggctggctcggccaggttgggtggaagtggctgta

SEQ ID NO: 6792985 - DNA, 116 bp, Homo sapiens
agtgttgtaattgcagttttgttgaagttcgggtatctgtagaagagtgtgtgtgctcactcagtagccagacatttgactgtagatacttgctattaactcagttacctctcgct

SEQ ID NO: 6792986 - DNA, 130 bp, Homo sapiens
gtcaagtgatggggcgggggatggggaaagagaagtctgccgctcctctaggctaccgcaccgccttaagtgggtggctcggccagtgcaggcctcactttcctcccctgtaaggtctggggggcttgac

SEQ ID NO: 6792987 - DNA, 98 bp, Homo sapiens
tttggtttccttcgggtattttatgtcttagaacaaaacagtgaatctgaaatgcgtttatgtttggaaaaaagacgtagtattcatggggaaaaaaa

SEQ ID NO: 6792988 - DNA, 64 bp, Homo sapiens
tttttctcatggaacatcgtttagaactgtgggagatgctaggctggggtttctatgggaaaag

SEQ ID NO: 6792989 - DNA, 57 bp, Homo sapiens
ccattctcttctgatgtcttgccatattcccaatggctgaaataaagaagggaatgg

SEQ ID NO: 6792990 - DNA, 63 bp, Homo sapiens
agggttcttagagggtgggcacgtgatggatcacaaaagaaccaccattctctcctcttccct

SEQ ID NO: 6792991 - DNA, 72 bp, Homo sapiens
ccttcaggcatggaacatttattaactgaaaatgctgaagcaaatgccaggaaatttatgttctacttaagg

SEQ ID NO: 6792992 - DNA, 63 bp, Homo sapiens
agaaaaggcagattttgaggctaccccagaaatcctgcagcaggcccaggaatttgcatttct

SEQ ID NO: 6792993 - DNA, 83 bp, Homo sapiens
ggaggatttgacagatttggtggagcaaatgcgcgatgatacagaaggtgcgtgccacaccaacatctttcagctttttctcc

SEQ ID NO: 6792994 - DNA, 68 bp, Homo sapiens
tgttaggcttgttacaaaacagtcatctcttgcaaagcacctgaaggttgatgtggaaagtctgagca

SEQ ID NO: 6792995 - DNA, 90 bp, Homo sapiens
ggggtgcagtatgcagagctaggccatctctgtcgtcctacaagaaccaggcagccctgagcaaggcttttaacatgcaaggtgtactcc

SEQ ID NO: 6792996 - DNA, 65 bp, Homo sapiens
gatgtgaacagagctgactacaaggcagaagaaattatgccttagttgctctctctgagaacatc

SEQ ID NO: 6792997 - DNA, 85 bp, Homo sapiens
gactgtagtaatttgtgttcttggtttcattctcctagcatggttgaaatggataatcatgaactttgagttaggtctggcagtc

SEQ ID NO: 6792998 - DNA, 80 bp, Homo sapiens
ctggaggcctggtctctcttcccctctactactactgcagcattctggggaaggctgggaggtgagacccctgcttccag

SEQ ID NO: 6792999 - DNA, 63 bp, Homo sapiens
gccagaagggggaagggattgtgtttgggggctgattatgctgacctttcaacccttcttggc

SEQ ID NO: 6793000 - DNA, 68 bp, Homo sapiens
ggttgacagctgtgggctctgcatatatgacacacagtgggttatgtccagttcttactgctgtgact

SEQ ID NO: 6793001 - DNA, 90 bp, Homo sapiens
tgtgcgtagttatgttacaatccaacaaaattaccatgagagccttgcttcacagataatttagttggatttgtgaattaagtaggtata

SEQ ID NO: 6793002 - DNA, 65 bp, Homo sapiens
ggtaaatcaggtgcattagattaattacctaatctgtggtagatgaaggctgagcacctgtttcc

SEQ ID NO: 6793003 - DNA, 71 bp, Homo sapiens
ggcttcagctcagttttctatatttagctgcagactggcagatgtgattcctgctgagctggtgtaaagct

SEQ ID NO: 6793004 - DNA, 61 bp, Homo sapiens
ggttaagtggctggtctaaggtcacagagcaagtcagtggcagagccgttgccatctgacc

SEQ ID NO: 6793005 - DNA, 93 bp, Homo sapiens
cctctagaccatgcagcctgctcatgggtccctggcagagaatgcccactccccagcagactcagggcaggtccccaactgcaggcttccagg

SEQ ID NO: 6793006 - DNA, 66 bp, Homo sapiens
tcggcatacgtggaagtatctgtgacctcatttctatgaactcaaactgcttaccatctgtgctgg

SEQ ID NO: 6793007 - DNA, 81 bp, Homo sapiens
cacaggccgtgtgctccttttggtttgtggtgtgtctggaaaacaaaaggaacacaggagaaaggggaagctcggcctgtg

SEQ ID NO: 6793008 - DNA, 103 bp, Homo sapiens
tgaaaagctgttttgaccaccacttaagagcaatagactataaattctggagtttaatttgtttaatgtctgtgagggcttgatggggttgggactttgttca

SEQ ID NO: 6793009 - DNA, 59 bp, Homo sapiens
ggaggggtgagaatggctgcctgtaaccccaacccatctaggcagcccctcttccttcc

SEQ ID NO: 6793010 - DNA, 71 bp, Homo sapiens
gcccttggcaaattctcctttatcttctgtctcttatagataaaccatcaggcagatttgtcaacagaggc

SEQ ID NO: 6793011 - DNA, 94 bp, Homo sapiens
tatagggccgggtgcagtggctcatgcctgtaatcccagcactttgggaggccaaggcatgttgggagcaggccccccaaaatctggccatatg

SEQ ID NO: 6793012 - DNA, 69 bp, Homo sapiens
agtcagtttaagctgagccagtggcaagtgctaggaaactgcattatcccaggctggctagctctgtct

SEQ ID NO: 6793013 - DNA, 69 bp, Homo sapiens
gttgttaattgtgggaaggcttttaattaccaatttactgtaattagcagcattcttaccaattacaat

SEQ ID NO: 6793014 - DNA, 58 bp, Homo sapiens
aggtgtttttccccactgagtcctgatcctaggtccagattcacaggcacaaaaccct

SEQ ID NO: 6793015 - DNA, 56 bp, Homo sapiens
ttctgttatcattaagcattatttgacttgcaaatgtcagttatgttgtaacagaa

SEQ ID NO: 6793016 - DNA, 60 bp, Homo sapiens
aaagagttaagagtcttaagctaaagcagctcttctgccatgtgggactctgacttggtt

SEQ ID NO: 6793017 - DNA, 87 bp, Homo sapiens
agtctattgcagttgcctaggcaagagttggtgtggacttgaactaaacaatttcatcactttcatgcctgaaaatattaatagatt

SEQ ID NO: 6793018 - DNA, 70 bp, Homo sapiens
gtatctagtcaatgctgttcaaccaaccagaagcattttaaaagaggtagggtaacaatttgctaggtgc

SEQ ID NO: 6793019 - DNA, 71 bp, Homo sapiens
aagcctccctgtgtgcctctttgatttgcaacatttaaagggcatgaagagacgcattcagaggcaggctt

SEQ ID NO: 6793020 - DNA, 68 bp, Homo sapiens
ggtgtccctggaatggactctgcgctgtgtccagtccgggacgcgcagagccctcttctgtggacgcc

SEQ ID NO: 6793021 - DNA, 101 bp, Homo sapiens
tttccatgggggctcagccatgttgaagcatgtatgtcaaactgatgtaagagtttgacagaaatgtatttgcatgaattgctgaagagcctcctgagaga

SEQ ID NO: 6793022 - DNA, 57 bp, Homo sapiens
cggggttggatgccaggcctgtgagcctggtgggctgcctggcaaaaaccggccctg

SEQ ID NO: 6793023 - DNA, 84 bp, Homo sapiens
agtgtggcaggaatcacttcaccagttcggagggttcccctcaggggatctgacttgctggtgggtaatgtggtgggccacact

SEQ ID NO: 6793024 - DNA, 67 bp, Homo sapiens
ttgttgtcaatccaaaaacctggggaaggctaaagtgaactccttctatttgtttatgtggcagcaa

SEQ ID NO: 6793025 - DNA, 62 bp, Homo sapiens
ctgaatgtttcactctgaaatgggagtccttggagggttttgagcagaggagagacattcag

SEQ ID NO: 6793026 - DNA, 64 bp, Homo sapiens
gaaacggtgttaaatgtgttagttgactgaatctggcatttataatgcaatttagcaaagtttt

SEQ ID NO: 6793027 - DNA, 129 bp, Homo sapiens
agtgcaagcactctgcttggtgttggtacaatgttgaacaaaattgacataatctcacaagctccataaaccagagattatgttagttttgtttaacattgtaccaacacctcatagagtccctatgct

SEQ ID NO: 6793028 - DNA, 67 bp, Homo sapiens
ggactattggctatgtttcgatgaacagattcaacatgataaaatatatgaacatgaccaatagtcc

SEQ ID NO: 6793029 - DNA, 62 bp, Homo sapiens
taacaatggttttgctgataatgtgctttctgtggagttatttttgatcaaaactattgtta

SEQ ID NO: 6793030 - DNA, 68 bp, Homo sapiens
gatggttcagggcacccaggggttccatgctgccacagaaaccaccctggggcacttgagtcctcatc

SEQ ID NO: 6793031 - DNA, 70 bp, Homo sapiens
agctctgcattaaaatgtgcctctctttaagtcaagtgctttaagttcaggtcttttcagtgcaactgct

SEQ ID NO: 6793032 - DNA, 74 bp, Homo sapiens
gcctattaaagagcttggagcaagttagtagtacctcatgacatatgtttgtgctccagcctctttgatagtgt

SEQ ID NO: 6793033 - DNA, 78 bp, Homo sapiens
tttgtgttcagtgcattcatgggtggctggatgtatgaacagatggatgaatgaatgaagcgcttatataaacacaag

SEQ ID NO: 6793034 - DNA, 89 bp, Homo sapiens
gaaatgacattttcaggacagcattccaaatacatagttagggacagttgttcgtagcttctggagtgtttgaaaatggccctcatatc

SEQ ID NO: 6793035 - DNA, 81 bp, Homo sapiens
gcccctgctgctgatctgtagaccgtgcttggagaacactggtccagtgcactggagttcgtacagatccgcctttggggc

SEQ ID NO: 6793036 - DNA, 82 bp, Homo sapiens
tttttctggtccttaattttagtggagaggtccatgcgaagtcaatttgctgagatctgccagtagatggaggaaagaaaaa

SEQ ID NO: 6793037 - DNA, 65 bp, Homo sapiens
tagtagcttccagactagatttctcctgggtacacatccaagtaaatgtgaactggaaggcgctg

SEQ ID NO: 6793038 - DNA, 79 bp, Homo sapiens
tcgtgttgtcgaaagcaggttttaaccacaactacggcgtctccgtgtatgaaggtttacctgctgtactacaaaacga

SEQ ID NO: 6793039 - DNA, 65 bp, Homo sapiens
agttgctgtttcattttcctcatccccagtctcaaggggaagccaggccaatgagaacagccact

SEQ ID NO: 6793040 - DNA, 63 bp, Homo sapiens
gtcctctaggttggtcatcatcatcctcatttaagaggaaaactgagccaggctaggaagggc

SEQ ID NO: 6793041 - DNA, 58 bp, Homo sapiens
tcaatgagcactctggggatacaacatggcagtcctatgatttcaagaggtttattgg

SEQ ID NO: 6793042 - DNA, 79 bp, Homo sapiens
tgtgttactgacagcctctttgcctccagagttcaactggagacagagaaaccagctagaggcagagggaggtaacacg

SEQ ID NO: 6793043 - DNA, 106 bp, Homo sapiens
aagagtgggcatccagcacttatttcccagggccctcatagttgccacaataccatacatgggaagctgaaaagttttgtggaaaaagatgtttaaacctattctt

SEQ ID NO: 6793044 - DNA, 62 bp, Homo sapiens
ggtattttgttagggtgtggtatttgttacagcacagcatattgaaccctacagactgtacc

SEQ ID NO: 6793045 - DNA, 63 bp, Homo sapiens
atctaaactgtttactctctgcctcctcagggaggttttatgagaagttagctctgtttaggt

SEQ ID NO: 6793046 - DNA, 71 bp, Homo sapiens
tcttattcttcccattttaccgattatatgatttgcctaaggctatatgcttgggaaatggtagaactaga

SEQ ID NO: 6793047 - DNA, 56 bp, Homo sapiens
tgatttcctggctttggagttcacagaccgtaagaaacaatcaaagttggaaatca

SEQ ID NO: 6793048 - DNA, 75 bp, Homo sapiens
catgaaaggggagaggaatatcattatattagcatagttactgtgtgtagtgataatccttctccatcacttctg

SEQ ID NO: 6793049 - DNA, 66 bp, Homo sapiens
gctcaagctgaatttcagatataaactgtgaagccaacatcgggtgtctgtgatttaggccagggc

SEQ ID NO: 6793050 - DNA, 81 bp, Homo sapiens
agacctgtcctcccccaaagtttgcacggataatcggaaggtgtggtagggtgggcttgggggaagccaggagaagggtct

SEQ ID NO: 6793051 - DNA, 121 bp, Homo sapiens
gatgtacaaccatgtatttgtgtaggcaggatgcaacagcttgtagtggacaaaaaaatagtctaacactaacttgctgagtgaccatgccaactcacttactttgggtctgtttcacatc

SEQ ID NO: 6793052 - DNA, 57 bp, Homo sapiens
tgtaagccttccctgagaaagtctgagattgacatcctcctctgggagaggcataca

SEQ ID NO: 6793053 - DNA, 62 bp, Homo sapiens
ttgtttccctctctgagtgtttcttttcccaaagaataaatgctcaccacagggatgtgcaa

SEQ ID NO: 6793054 - DNA, 69 bp, Homo sapiens
ccaaggtagaggagctgataaaagggggtcaggtagcctgacttccggatgtatgctctgatttcttgg

SEQ ID NO: 6793055 - DNA, 129 bp, Homo sapiens
tatgaagagtgaataggaaaatgatgaaattgttgctgctttttacagaggcttagaatcatggaaatcatttgctttcaggtataaaagggaataatttcattttctactttttactttaaatttctg

SEQ ID NO: 6793056 - DNA, 56 bp, Homo sapiens
aatgaggtacagggccttggaagtcaattgagatgtccttaggttgatgctttatt

SEQ ID NO: 6793057 - DNA, 66 bp, Homo sapiens
gacagggagcaacctcagcctgtcctcacatctgcagggcctacagcctgctgcctgcttcttgtc

SEQ ID NO: 6793058 - DNA, 63 bp, Homo sapiens
cttcatcgagttagaaaaacaaagggctgatattgcctctttgcagaaataaacttgatgagg

SEQ ID NO: 6793059 - DNA, 74 bp, Homo sapiens
gttgtaatagaatagtggaaacattgactacagcacgttttattgctgaatgcaattttcagctattttgcaac

SEQ ID NO: 6793060 - DNA, 82 bp, Homo sapiens
agcaacacagctgcggggatcctaaggtttcctgagttctaacctcgggccaggctgctgggaccccgccgctgctggggtt

SEQ ID NO: 6793061 - DNA, 56 bp, Homo sapiens
tcaggaggtgtaggtcaagtgaagaggtcttccctctatgtgagtacatcttctgg

SEQ ID NO: 6793062 - DNA, 58 bp, Homo sapiens
ggggaaggagggccagggggacccttgggcaaagccgggggctgggccctgtttctcc

SEQ ID NO: 6793063 - DNA, 69 bp, Homo sapiens
gcatgtgtaagattctaagagttaatgcagagacttatctttattgatgaaagggattttggatattgc

SEQ ID NO: 6793064 - DNA, 67 bp, Homo sapiens
ctttgaagtcagttttgctacagttgctgcaggcatagatgattcagcactgtaacagaatacagag

SEQ ID NO: 6793065 - DNA, 55 bp, Homo sapiens
aggcagctgtctccatggaggtttctttgtctccaagttctaggaactgctgcct

SEQ ID NO: 6793066 - DNA, 129 bp, Homo sapiens
tggaagtgggagatagaaaataaagggtggggtcaggttcctttctaaaaacctaaatgcatgtcaggcaagtagggcttagaaaagaatttaccctccttcacctctgtcacctcatccctccttcca

SEQ ID NO: 6793067 - DNA, 85 bp, Homo sapiens
taagtggattagtataaagggagaaaaagttccacttttaaagaaaagtggaaaacaaagctctcattattaccaaatgcatttg

SEQ ID NO: 6793068 - DNA, 56 bp, Homo sapiens
ggctgtgccaccagtgcttttgaaatatatctcacaaagcagcccatggcacagtc

SEQ ID NO: 6793069 - DNA, 118 bp, Homo sapiens
tttcagcagggctgaggatgcctgacagtaaaagtacagacctttcttgataagccccatggtttccttcttggagaagggattgtgctctgtacagatgcattcagtcttcttgaag

SEQ ID NO: 6793070 - DNA, 65 bp, Homo sapiens
tcgtgtttgcaaattatgttaaaagtaaaggaatacttttttcttaaatgatttgtagtccatgg

SEQ ID NO: 6793071 - DNA, 59 bp, Homo sapiens
gataagcacattttccagcagctctggagtcatggctgcttacaaaaactgtgccaatc

SEQ ID NO: 6793072 - DNA, 70 bp, Homo sapiens
tgaagaatgtctagacatgttaatgcaccttaatgtagtactgtagcatgaattagaccacaattcttta

SEQ ID NO: 6793073 - DNA, 59 bp, Homo sapiens
actctgtaattttcttagatttggagaaaagccggctctagaactgacgatttcagagt

SEQ ID NO: 6793074 - DNA, 95 bp, Homo sapiens
tgttttaaatagtagggcttacttttctattcgatatgtgtggtttataaaaactcgcctgtatggagaagcaaggcctgtgataatcttgaaca

SEQ ID NO: 6793075 - DNA, 73 bp, Homo sapiens
ggtccagttttgggcatgttgtggccagctggttatccaggtggaacgttcaggtgctagccagtcctggacc

SEQ ID NO: 6793076 - DNA, 104 bp, Homo sapiens
tatcattgaggcacattggagcctccaggttttacaaggtctatatagtctaaatagggaaattgtagaactggttattgttttatattatgtctgaaatgatg

SEQ ID NO: 6793077 - DNA, 70 bp, Homo sapiens
tgattcttccctctttcactgtgattttatgcaagtaaaatcacacaagtagatggggaaaccagaatca

SEQ ID NO: 6793078 - DNA, 76 bp, Homo sapiens
agttacatttcagtttcaatgagcagagcatagtctgaaaacaacttattgttaggcttttggaatttttgtgatt

SEQ ID NO: 6793079 - DNA, 83 bp, Homo sapiens
gaattgtgaagcatttaatatgcttgattaggaaaacacaagccacaccctattcagcataatcagtagcttgaccacaagtc

SEQ ID NO: 6793080 - DNA, 94 bp, Homo sapiens
tgtgtatatatgtgatgtgtatatgtgtgtgtctatgtaggcatgtgcaggtatgtgcgtgggcacacacatatgcacatcacatgtaaacata

SEQ ID NO: 6793081 - DNA, 69 bp, Homo sapiens
tggtcgagtcaggactagatgttgggcagtttgattccagagtccatattcctagcccttctctatcca

SEQ ID NO: 6793082 - DNA, 56 bp, Homo sapiens
ccaaaggctcctttaccattctggaggcccagcttcattgattgcaaggagattgg

SEQ ID NO: 6793083 - DNA, 68 bp, Homo sapiens
ggtcagtaagcatgaaaggcgtgccaacttcagtgaaatggaaagctggcagctttcatgatctgtcc

SEQ ID NO: 6793084 - DNA, 78 bp, Homo sapiens
ttgctcactattctgtggatcaagaattcaggcatcatccatgaggatgcttccctttgctccacatggtactggcag

SEQ ID NO: 6793085 - DNA, 59 bp, Homo sapiens
ctaatgttagactggccaagttttctgaatcaaagcttggaatatattgtttgacatag

SEQ ID NO: 6793086 - DNA, 108 bp, Homo sapiens
tgggcatggcctgttccctgcctgtccacgtctcctggtacagatgctgccacttcaaccctgcatctgccaagagaacgtgggtcccatggtggaacagaatgtcca

SEQ ID NO: 6793087 - DNA, 57 bp, Homo sapiens
agcttgttctccttccctgtggcttcctattggatatagccaaaggagaacagtgct

SEQ ID NO: 6793088 - DNA, 69 bp, Homo sapiens
gctgtatttcatctttcttcaattacttagtattttggtaagggtaggggaagacaagtgaaaataagt

SEQ ID NO: 6793089 - DNA, 87 bp, Homo sapiens
ttgcacaattccaggaggcagcattcgcatagacagcctacctgtgatcagcctgggatgtgactgttgcccccatgagttatgcaa

SEQ ID NO: 6793090 - DNA, 60 bp, Homo sapiens
ggtgggagtggggaagcagagtgctggccaagccaagaccatttatgcccccattccccc

SEQ ID NO: 6793091 - DNA, 57 bp, Homo sapiens
gagctcctatggtcggtggctctgcaacttctcacggcagcgcctggacggaggctc

SEQ ID NO: 6793092 - DNA, 68 bp, Homo sapiens
accagttattagccctacaactttgaacaaatcacataatcgttcataattgctggttagtaactggt

SEQ ID NO: 6793093 - DNA, 109 bp, Homo sapiens
gcaacaggacaagactgtacggctaccaggttgtctaattccaaggggcactttaacattatagtctctgtgaatggcgtcacctggggttgtgcagtgcactgtctgc

SEQ ID NO: 6793094 - DNA, 58 bp, Homo sapiens
ggaggactgccagggcctgggtttgcccttggcctgacttgtccctggcaattcatcc

SEQ ID NO: 6793095 - DNA, 74 bp, Homo sapiens
gtggactgtttcttgccctcagtagcagttgctctaagatcaaggctggttctgggtaacagctctgggttcac

SEQ ID NO: 6793096 - DNA, 113 bp, Homo sapiens
ggggccgcagcatccctcgccagcccatgccccagctgcaggtgacatcacgtggctgacatcaggcctgcagtctgggttagctgtgctgggggcccagaagctgtggctcc

SEQ ID NO: 6793097 - DNA, 78 bp, Homo sapiens
tgaacttagaatctagcctgggctaatcctcagtggtgtcacactagagaaacgcccaggctcagactttgacattta

SEQ ID NO: 6793098 - DNA, 78 bp, Homo sapiens
gctcctttatgatgaagaagatgggaggggtatgaaaacatttgcaaactgttcccagattctcacattcccaggggc

SEQ ID NO: 6793099 - DNA, 68 bp, Homo sapiens
ggagtgaaggcaaagggaatggaatccagcaacttcgtgacttggtacaaagcctctttgcctcctct

SEQ ID NO: 6793100 - DNA, 56 bp, Homo sapiens
atttggaaggtttacaaagagagattactacttttctcagtgcagattgtccaagt

SEQ ID NO: 6793101 - DNA, 73 bp, Homo sapiens
agcctgcacagccgctttgtggagctgagcgaggcataccgtgtgctcagccgtgagcagagccgccgcagct

SEQ ID NO: 6793102 - DNA, 81 bp, Homo sapiens
ttttccacaggtctcccatcgtttgtgaggaagagctagttctcattttctctaaatagggaggcttaagactgtggagaa

SEQ ID NO: 6793103 - DNA, 77 bp, Homo sapiens
cagagagttccacccatgtgtccaaggccacaatagctaatccatgatggagctggaattggacccagggctctctg

SEQ ID NO: 6793104 - DNA, 82 bp, Homo sapiens
agcagctggaggaggaagcccggagcgcaggactcgcgcggcaggccttgcaaggtgctccaagggcgctccctcagctcct

SEQ ID NO: 6793105 - DNA, 108 bp, Homo sapiens
aggaaacaacagatgctggagagtatgtggacaaataggaacacttttacactgttggtgggagtgtaaattagttcaacccttctgtaagatattgtgttgattcct

SEQ ID NO: 6793106 - DNA, 129 bp, Homo sapiens
gcaataaaactgggtcttgaagtgatgaagacaagtaggaatggttgaagttgtccaaaacattttatgttatctttagttatgattctctgctcttcatttttataaagccattaatatttttgttgc

SEQ ID NO: 6793107 - DNA, 58 bp, Homo sapiens
gctgggatgcaaaataagagccagctctgagtaggtgcttgtcatgacatcaccaagc

SEQ ID NO: 6793108 - DNA, 110 bp, Homo sapiens
aagtggaaaataaaacagcttagatgagaatgatttaaaatgtacaggggaaagtgttagtagacacaatactatttttaggtctttcttatctgttttatattgccctt

SEQ ID NO: 6793109 - DNA, 64 bp, Homo sapiens
tggccagctcttgtccacggaggggattcctgtgtaacctctgtgtcagggaagagactggcca

SEQ ID NO: 6793110 - DNA, 56 bp, Homo sapiens
gaagtcagaggagctgtctttgtgatcttcgggaagtcactttagctccctgagtc

SEQ ID NO: 6793111 - DNA, 57 bp, Homo sapiens
agaggagtttgggccagaatctgaggagggcttggctgctgtcccagactctgctct

SEQ ID NO: 6793112 - DNA, 59 bp, Homo sapiens
gtcctgtgcgtttctttcccagcttcgtggagccacgcaggggaggaaggtacacctgc

SEQ ID NO: 6793113 - DNA, 81 bp, Homo sapiens
actccggtagagcactaagtagctcttggaatatataaaggattgtgtatttattagctattctagctttctctcaggagt

SEQ ID NO: 6793114 - DNA, 80 bp, Homo sapiens
cagaggcctcgtcagttatttcaacagagaggatttcgcatcatgaatcactatgtacgaagtgactaccgaaggagctg

SEQ ID NO: 6793115 - DNA, 85 bp, Homo sapiens
gccaaggttatggagaaagatggttgatccttcaggtccagctttccgtatgaactaaacgatcagcttagtctaccatgttggc

SEQ ID NO: 6793116 - DNA, 55 bp, Homo sapiens
gtcataggtagggggaaggatgctggatgctgtgttctaagccccgaattatggc

SEQ ID NO: 6793117 - DNA, 57 bp, Homo sapiens
gcagatggtgccatgtcttgtggatattttgaaaaaataggacaggctcccatctgc

SEQ ID NO: 6793118 - DNA, 97 bp, Homo sapiens
ctgaagacatctgggagatatcagtttataaattgtatttagagcaatgaaatcatctagggagagagtgtagatagagaggtttaggtgtctgagg

SEQ ID NO: 6793119 - DNA, 95 bp, Homo sapiens
gtgacaattgatggatcgtagggaccacagttcattaactctatatgcctatctcttgtcagtggacttttagtatccttattttccatttgcac

SEQ ID NO: 6793120 - DNA, 71 bp, Homo sapiens
taagaaactaatagattgtggtaggagagtagctgggcaccagtaaccccgccctcaatgtgaatttcttg

SEQ ID NO: 6793121 - DNA, 60 bp, Homo sapiens
gcaaggctgtgcactttgcattttgtcatgcttcgtctgcagtcagtagcacagccttgt

SEQ ID NO: 6793122 - DNA, 58 bp, Homo sapiens
gctctagtcattatcttaaaccacagctctgcttagtggtgttggtgaggactgtggc

SEQ ID NO: 6793123 - DNA, 55 bp, Homo sapiens
ccagtgcttctttgctagctggcttctgtttagtttggttagtaagcatcactgg

SEQ ID NO: 6793124 - DNA, 69 bp, Homo sapiens
gcctggggaacgcagcgagcagcgccggccgggcagactctcaccagtgcgcatgcgtggctctccggc

SEQ ID NO: 6793125 - DNA, 56 bp, Homo sapiens
tgggttttagtcatatctctatttaccagtgcctggcacagagtggctaaggctca

SEQ ID NO: 6793126 - DNA, 129 bp, Homo sapiens
ggagtctcactctgttgcccaggctggagtgcaatggcacgatcttggctcactacaacctccatctcccaggttcaagcaattctcctgcctcagcctcccgagtagttgggactataggtgggcacc

SEQ ID NO: 6793127 - DNA, 69 bp, Homo sapiens
cagctggactccaaccttcatcttatgattctgaagctaaggtggaggacaggactggacagccagttg

SEQ ID NO: 6793128 - DNA, 56 bp, Homo sapiens
gctgagcaggtttgatgcttttatgaagcaagatagaagcaaaaatatgggccagc

SEQ ID NO: 6793129 - DNA, 113 bp, Homo sapiens
tctctatatgtgatagcccatttaagcaggccccacttaacttgaaagccaaataacaagctcggtttcaagttaaatggggtctttcttcaataggccaccccatatagaga

SEQ ID NO: 6793130 - DNA, 57 bp, Homo sapiens
tcagctattttgcctatcatggtagttcacattgattattatgttgtaaaatgttga

SEQ ID NO: 6793131 - DNA, 64 bp, Homo sapiens
atgtctaggtaatcgttgaggcccagctccaccacggcgtctcctcgaagcaacctgcaggcat

SEQ ID NO: 6793132 - DNA, 110 bp, Homo sapiens
gctctctgagcattcgagcggtccttgctagtatcacttggacatagcagaaaggagaagtcctttctatctagggttagagtgagaccaactgctccctttcagagagc

SEQ ID NO: 6793133 - DNA, 57 bp, Homo sapiens
ctcctagggctgtgcagtgtgcagctggaatggctacacacagctgcccttaggtag

SEQ ID NO: 6793134 - DNA, 59 bp, Homo sapiens
tgtctagaggccaacaggaaagggtcatcagaaacccactgttctggtgcttcaggata

SEQ ID NO: 6793135 - DNA, 70 bp, Homo sapiens
tcattctccatctgtgttccagcaccctgctctgcacagaggaggggctcaagcagtgtggtctgaatga

SEQ ID NO: 6793136 - DNA, 67 bp, Homo sapiens
tggatactttgggggttagtgtagagattaactctttcaaactcagctcctaacttgactggtgcca

SEQ ID NO: 6793137 - DNA, 64 bp, Homo sapiens
actggatactgattagttgagaaagcagttcaatagcatgcttgaaagccaatttgtgcacagt

SEQ ID NO: 6793138 - DNA, 78 bp, Homo sapiens
gcattcctggagggttggcagatgaacacaactggaaatacttccagtaaatctcactgtcatgtctagatggaatgc

SEQ ID NO: 6793139 - DNA, 77 bp, Homo sapiens
ttagtggtattattgggtagtatggtaaatatatgtttagctttacaaagtgctgcaccattttaatctcccactgg

SEQ ID NO: 6793140 - DNA, 119 bp, Homo sapiens
ttgttactagagtggaagttgcttctgcctgtagtatttggagaagctttaaatttgtaaatctattttgcagcttctccaaatattacaggcagaagcaacttccactctagtaacag

SEQ ID NO: 6793141 - DNA, 101 bp, Homo sapiens
tggtgactatagaatggttatggcgatctgtgtgtttcactctgagctgtaagtagagatgtgttcgctagattgctgttaattaatcgtttagtttgtca

SEQ ID NO: 6793142 - DNA, 71 bp, Homo sapiens
gtttgaacaagccctacaggtgattctggtgctcaataacatttgaaaaccactatcttagggtaacagac

SEQ ID NO: 6793143 - DNA, 65 bp, Homo sapiens
ttagagttaggttttgctgaacaagttgaagatattattcatgaattctacaaaactgattctga

SEQ ID NO: 6793144 - DNA, 130 bp, Homo sapiens
attttctgacataaacttgatctgtgtggctcaaggcttcagtgtgacaaaacaataaagcacttttttttccgtttaaattatacttgagccttggtctggctactcttcttataaatgtaagtttgat

SEQ ID NO: 6793145 - DNA, 58 bp, Homo sapiens
ggcagcagcagggagcaggggtgtcacgaggttcgtgtatcctccttcctctgtttct

SEQ ID NO: 6793146 - DNA, 59 bp, Homo sapiens
gagacaagaagtaaaggtcggatgccatttctggatcccacctcttttcttcttccctc

SEQ ID NO: 6793147 - DNA, 70 bp, Homo sapiens
cgctccaggctcagcgcgcacgtctgctccgagaaccgctgcgggtggccaggcgccgggcctggcggcg

SEQ ID NO: 6793148 - DNA, 83 bp, Homo sapiens
aaaagttacccatacctgggcctcctcctcagatcaattaaatcaaaatttctgagattggagcctgggcattagtaattttt

SEQ ID NO: 6793149 - DNA, 102 bp, Homo sapiens
ggtgagagaggcgcctagagcacaaattttaaggaggcaagaccacgaccccgaccgtgagcgcctgcttaacatttgctccccaggcgcttcccactcccc

SEQ ID NO: 6793150 - DNA, 76 bp, Homo sapiens
ttaccaaagtgtggttgtttcattaaacattagctcttcaggattagatgttacatgaaacggcctacttttgtga

SEQ ID NO: 6793151 - DNA, 58 bp, Homo sapiens
cctgtgtccatgttctaatttggcattgctcatagtcaaacatattgtgagacacagg

SEQ ID NO: 6793152 - DNA, 75 bp, Homo sapiens
agtattgtgcatgtgtgaatcttgtgatcatgatcttaattaggatcatatttagattcagactcaaattgaact

SEQ ID NO: 6793153 - DNA, 107 bp, Homo sapiens
ggcccccaccctcggcagtggtcctggacttaggcaggcaccccgtgcccacgtgcatgggacaccctcacgcctgcactagatccccagtgccagggctggaggcc

SEQ ID NO: 6793154 - DNA, 80 bp, Homo sapiens
gggagagtacatctgaggagaccagcctctgctgcagcccaccccttggccagaggacggtcaccttaatgatagttccc

SEQ ID NO: 6793155 - DNA, 109 bp, Homo sapiens
ctctttggggatgagcactctgctcatgactcattaactttttttctaagtgtgaaagctttttaaggaagaaatgaataggtggagatgccttattaacttcaaggag

SEQ ID NO: 6793156 - DNA, 72 bp, Homo sapiens
gccattcgcacaggaagtttctgttgtttctctaaatacagaactgaacagcaggcttctacctgataaggc

SEQ ID NO: 6793157 - DNA, 56 bp, Homo sapiens
gcacccctgtctgtaccccctagttcccagtatatggactggcacacaggggctgc

SEQ ID NO: 6793158 - DNA, 57 bp, Homo sapiens
cttttcttctctgattaaggctcacgtcctgtgattgttgtggttggggagggttgg

SEQ ID NO: 6793159 - DNA, 72 bp, Homo sapiens
gaggacatgaaatcagacttgaattttcatcttattttgctgaggttgaagtttggtttggttgctgttgtt

SEQ ID NO: 6793160 - DNA, 66 bp, Homo sapiens
gttgaaataacagagagctactgaactggtaggatttctttacattcagagctttcttatcataac

SEQ ID NO: 6793161 - DNA, 84 bp, Homo sapiens
tctggtttaacctaatacctagagatgatacaaatctcatttttgtttgttatattttggtgttgtaggtgggttgaaaataga

SEQ ID NO: 6793162 - DNA, 59 bp, Homo sapiens
cctctgagtcctccctggttgctctttcttctctggagtgacctggaaggactgggagg

SEQ ID NO: 6793163 - DNA, 58 bp, Homo sapiens
gtgcttgtcagtttattcaggtgaacactcaaaaacactgacgggaagctgaaggcac

SEQ ID NO: 6793164 - DNA, 57 bp, Homo sapiens
gatggaagaaaaatgcatgtctgggagcaatcacactcaagcatacatcttcctgtc

SEQ ID NO: 6793165 - DNA, 65 bp, Homo sapiens
taagactcgtgtttgaggaagatactctgctgtcagtggtaagattcttcaaacaagaggtatta

SEQ ID NO: 6793166 - DNA, 70 bp, Homo sapiens
gaacttccagcctgagagtctccagaccttggggagaatccgtgtctgggctcccatggcagagtggttc

SEQ ID NO: 6793167 - DNA, 65 bp, Homo sapiens
cggaatcggaagaggtgcacatgaactcagaaaaactgcgtttctaagtgtgattttagattccg

SEQ ID NO: 6793168 - DNA, 62 bp, Homo sapiens
attgggattcagtgatgtggtatgagttttgttgactggagtagatctgactgagtcctgat

SEQ ID NO: 6793169 - DNA, 59 bp, Homo sapiens
tggagggcatctgtggtcaggctgcaacttcaggggagaatttccacaggtgtcctgca

SEQ ID NO: 6793170 - DNA, 72 bp, Homo sapiens
agcataaggtcaaggccaggagacttggagtcagacagttttgggttcaagtcctcctgctaacactatgtt

SEQ ID NO: 6793171 - DNA, 81 bp, Homo sapiens
ctcaggtacccttccctggcatgagtgtaagattttataaaggtccagtccaccttatgccagggtggttggtaacttggg

SEQ ID NO: 6793172 - DNA, 85 bp, Homo sapiens
tgcttgtggagtgagagatgatgtggtagaaaagaagctgcattcattcattcatttattcattcatttgctcactccacaagta

SEQ ID NO: 6793173 - DNA, 84 bp, Homo sapiens
agcagagaagtcccagtccagtcggcctggagaaatgggtgaaacactcatttgtggcgacctggattgtagcccgattctgtt

SEQ ID NO: 6793174 - DNA, 63 bp, Homo sapiens
agttggtctggggaccttcccaagagacatcttgttctcccaggagggcagcccagactggct

SEQ ID NO: 6793175 - DNA, 83 bp, Homo sapiens
ttaccttaacttttctaggtgtgataatggtcggttaattacttttttaaaaaaaattactcatcagaggaagttaatggtga

SEQ ID NO: 6793176 - DNA, 58 bp, Homo sapiens
gtcaacttgacaggcagagtggaggtaaacagtcttcctctgcaggagcagtgttgac

SEQ ID NO: 6793177 - DNA, 63 bp, Homo sapiens
gcctctgtcatagctcatgtgattgagtatagacatcaagggtgagtgtggctgagatgaggc

SEQ ID NO: 6793178 - DNA, 60 bp, Homo sapiens
ctgggaagtggcaggacccgacctatgcaaatgccatgtcttcctgaaaccctgttccag

SEQ ID NO: 6793179 - DNA, 74 bp, Homo sapiens
actgcaggaactgaggtgagaggaggccatgtgacaataaagatcattatgtactcactgcctgagtcctgagt

SEQ ID NO: 6793180 - DNA, 57 bp, Homo sapiens
gagggtctcttaatgccaggggtttgagaccagcctgggcaacatagtgagaccctc

SEQ ID NO: 6793181 - DNA, 61 bp, Homo sapiens
gctgactgatggacacagcacctgagttcctcagattttgctggagtttactcaggccagc

SEQ ID NO: 6793182 - DNA, 62 bp, Homo sapiens
gatgcacattgaacaatcacaagcaggcagaaacctcactgccctaggtgattaagtgcgtt

SEQ ID NO: 6793183 - DNA, 58 bp, Homo sapiens
gttgtatgggggagtcatgcagacttggatttaaatctggatgccaccacatactaac

SEQ ID NO: 6793184 - DNA, 55 bp, Homo sapiens
tgcagcttatctctttggcagtagattccctaacagtgtaagagatgcagttgca

SEQ ID NO: 6793185 - DNA, 69 bp, Homo sapiens
ccgggctgtctgctgtgcactgagcagaaacaagtttttaattctctccttgacaggcaggcagactgg

SEQ ID NO: 6793186 - DNA, 63 bp, Homo sapiens
cctcccatctcaagtacagcagttttctccactcaaatggacagtaagctctttagagggagg

SEQ ID NO: 6793187 - DNA, 73 bp, Homo sapiens
ctcttgttgccctggctggagtgcagtggcgtgatcccagctcactgcaacctctgcctcctgggttcaaggg

SEQ ID NO: 6793188 - DNA, 78 bp, Homo sapiens
gggcttgctgtttagttccattcatctgtctctgatctcatgtcagtgtgttgtgttggagtctaagagtgcaagtcc

SEQ ID NO: 6793189 - DNA, 69 bp, Homo sapiens
gagaaaagtgattctgtgtgtaaattttaagtgtacttggtgatattatgctcagaatactctattctc

SEQ ID NO: 6793190 - DNA, 83 bp, Homo sapiens
ggtgcagaggcttacacttaaaaacagatccagcaggaggggtgggagcgttcctgttactgtttgtgagtttcttttgcact

SEQ ID NO: 6793191 - DNA, 56 bp, Homo sapiens
ccaggagcagagtaggtgttcaattcatgtctgtgaaacaaacctatttgctctgg

SEQ ID NO: 6793192 - DNA, 73 bp, Homo sapiens
aggcatagctttttgcaggcacccctcagtacagcaggcagtattgacaggtgcctgcagacataagctgcct

SEQ ID NO: 6793193 - DNA, 119 bp, Homo sapiens
tttctcattatgtccatttcagtggaagtagcatggagataatgaaagatgcttaatattgattgtctcttaaatgtggaaattactgttgtccactgagaagtaaatgtggtgagaaa

SEQ ID NO: 6793194 - DNA, 64 bp, Homo sapiens
cctagccctgtctctcactccaggtggcccatctgtgactggggttgttaggcagggacagagg

SEQ ID NO: 6793195 - DNA, 60 bp, Homo sapiens
gcactcccttcaggagcctaggactgcatttgtcgtccatgggtggtgagggggcagtgc

SEQ ID NO: 6793196 - DNA, 75 bp, Homo sapiens
cttgaaggccagttttgagataggtagtacagagagagaaatctcatggcttatttctaggcactggcttcggag

SEQ ID NO: 6793197 - DNA, 64 bp, Homo sapiens
ccttgcccactctgtttcccaagattctatctttggttctagggagctctagcagtggtaaagg

SEQ ID NO: 6793198 - DNA, 87 bp, Homo sapiens
ctcagtggtggcatcaattgacttctctcttcaactctcaacccttaaggaataaaaaagaggaatcagctgatggccatctctgag

SEQ ID NO: 6793199 - DNA, 70 bp, Homo sapiens
aatgtgtgtgtgtgtgtgtgtgtgtgtgtgcacacgcgtgcaggtgtgtataaacatacatatatgtatt

SEQ ID NO: 6793200 - DNA, 69 bp, Homo sapiens
gtcttgcaggaatagctacagagctggtatgtcactgaggtcccagattcttctgtatttttgctttgc

SEQ ID NO: 6793201 - DNA, 58 bp, Homo sapiens
gccagtttcccaagccattggctctgcagagacctgccaggagtgggtagactaatgc

SEQ ID NO: 6793202 - DNA, 89 bp, Homo sapiens
gtatgtgtattgttgtatctacctgcagatatgtatgtcttattgtatctacatgtaggtatgtatgtatacttttaatgtacacatat

SEQ ID NO: 6793203 - DNA, 88 bp, Homo sapiens
ggagaatcgcttgaacccggaaggtggaggttgcagtgagctgagaccacgccactgcactccagcctgggcgacagagcgagattcc

SEQ ID NO: 6793204 - DNA, 85 bp, Homo sapiens
atgaagtatatattggattaggcacctataggtacattacccatttcctaaattgtacctttatgtttgattacaattactttgt

SEQ ID NO: 6793205 - DNA, 60 bp, Homo sapiens
attgggtatggctgctgggatgacaaccaatggttgtctgtgccagtcacataaaacaat

SEQ ID NO: 6793206 - DNA, 100 bp, Homo sapiens
gtgacccaaggtggaaagaacaaggcagaggtgacagtgtcttttataagccagccttggaagtgacgtagcatcatttctgccttattccattggtcac

SEQ ID NO: 6793207 - DNA, 65 bp, Homo sapiens
gtgagtgaagtggccaggacctagcagctgccagtgcagcctggatccatgtggctaccaaccac

SEQ ID NO: 6793208 - DNA, 69 bp, Homo sapiens
gagtctctgttgtcagtgggctcctgacattcagcaggaggagagacaacactggaaagcaggcgactc

SEQ ID NO: 6793209 - DNA, 61 bp, Homo sapiens
cctttggtgtagatgagagagcgtgtgtgagtgtatgatacacatctatctctacacaagg

SEQ ID NO: 6793210 - DNA, 55 bp, Homo sapiens
cagcacatgtgggaatggtgctgaatgctgaggaagcattcactcatacgtgctg

SEQ ID NO: 6793211 - DNA, 58 bp, Homo sapiens
gggagatggtgaaaaaggctgagcacctgtcagtgcattaaaaccatcgaccatcccc

SEQ ID NO: 6793212 - DNA, 102 bp, Homo sapiens
agttgctaactatgcagtgtagtagtagacaaattaatgaaaaataataattatgcttttctgtatacataaatttcactgttccgtgcttggttagcaact

SEQ ID NO: 6793213 - DNA, 69 bp, Homo sapiens
gcttgtccatttctttatctcttgtcaccatatgcatgatgtactaaccaggaggaaaaaatgacgagc

SEQ ID NO: 6793214 - DNA, 79 bp, Homo sapiens
gtgttcatttacatattgtctgtgactgctttgcacactacaagagcaaatgtgagttatagcaatagaggcagaatgc

SEQ ID NO: 6793215 - DNA, 88 bp, Homo sapiens
gcccaaggcccagtactttgtgagtagataaggcacaagtcacactctggctttctgactctacaaccctcaaacgtagcacttgggc

SEQ ID NO: 6793216 - DNA, 62 bp, Homo sapiens
cagtcccagggttggttcagctgctcaacaacattaggctctggttggcatctctgagactg

SEQ ID NO: 6793217 - DNA, 64 bp, Homo sapiens
tgtcttgaatattcattaagtttgttttagagaaatatctttaggcttggtgatattcttagca

SEQ ID NO: 6793218 - DNA, 76 bp, Homo sapiens
atatttttgctttcattgcctgcggttttggggtcatatcaaaagaaatcatagcccagaccaatgtcaagaatat

SEQ ID NO: 6793219 - DNA, 89 bp, Homo sapiens
tcagctgttttcatttcttatgttttagaaaagttgtttcacaacagtgatattataggcaattttaggcatgaatgaatgtcagttga

SEQ ID NO: 6793220 - DNA, 90 bp, Homo sapiens
gtgtaatgagtcagaaacagatgaaaagggtaaagaggtgatgaaaatggtcatcaacacttttgtctttgtccctggtgacttttacat

SEQ ID NO: 6793221 - DNA, 71 bp, Homo sapiens
tgcatcacatttacttttatcccttgggccaaaataagttttacgatcaagccaaaagtcaaggtggtgca

SEQ ID NO: 6793222 - DNA, 86 bp, Homo sapiens
gcaggattgattacctttagagctgagttgactccattttatttatcatttgagatgtgtctttagttgctgaagggactgcctgc

SEQ ID NO: 6793223 - DNA, 90 bp, Homo sapiens
gcaatcttgctagtgccccacctaggcaagagtttattatggtgttaagtcactcttgtaatgtctccctagctcggtatttcattttgc

SEQ ID NO: 6793224 - DNA, 58 bp, Homo sapiens
tggctcattctggggaagtcagccaccaagtaaaagtctgactctcctgagatgacca

SEQ ID NO: 6793225 - DNA, 66 bp, Homo sapiens
tgcaacttgggttaaagcaagtactggacttcacttttggctcaaagcagttttaatcaagtagcg

SEQ ID NO: 6793226 - DNA, 75 bp, Homo sapiens
accaaaaattctgggattacaggtgtgagccaccacgcctggctggaagtggtttatatcttgattctagttggt

SEQ ID NO: 6793227 - DNA, 88 bp, Homo sapiens
ttcattatgctctgcccctattatagtccactgatcctcaccaaataggtgggtggcctagaggttaaagtagaggcagagtgatgga

SEQ ID NO: 6793228 - DNA, 98 bp, Homo sapiens
cttgtaatattgttttggggctcagtttttcaggcaacaatcatttattaattgactgccgtgcatcagaagctgagatcagcattgatatccacaag

SEQ ID NO: 6793229 - DNA, 91 bp, Homo sapiens
cagtgagtgtaggtcacaagggctttgtaggctttgctggaggatccacttcagacagaggtaggggcaaggggtcctgtgaagacacctg

SEQ ID NO: 6793230 - DNA, 129 bp, Homo sapiens
gcattttgtttcctttttgggccatctttatttctctaatggtgatgattagagttgcctttatgaatgtagtttagctcatcagtatatagggtcactgatactcctaagagggttcatatagtatgt

SEQ ID NO: 6793231 - DNA, 68 bp, Homo sapiens
ccactgtccctgggcacaatctgctggcgaatcctggaggtctgcgccggctgcccgtggggaggtgg

SEQ ID NO: 6793232 - DNA, 88 bp, Homo sapiens
actttggccctgcgtgggtcagcatgtggtctgaggtaaccctcaaatgcctccaccacacatctgtccacctgcacgggttcaaggt

SEQ ID NO: 6793233 - DNA, 68 bp, Homo sapiens
aacttcatgcatcccactccctccactttatttagagttttttgtgcagggagctttaggtagaagtt

SEQ ID NO: 6793234 - DNA, 95 bp, Homo sapiens
gggtgtgaacatggaaggagttaatatgtactaagtgcttggtgtctattcagccttagataaatgctagctccctttccattcctttctctctc

SEQ ID NO: 6793235 - DNA, 100 bp, Homo sapiens
gagtgtcgagataggtcccctttgtcagtcactgtctggatgtgagtcacctataattgtgggtgactggcatccaggcctgagccccatctcccagctc

SEQ ID NO: 6793236 - DNA, 86 bp, Homo sapiens
ttcctcacctttgttccctgggaagcacttgtcacatgccctgtgtgtcccagatgcttcgtgggtgagcacgtattgaattggaa

SEQ ID NO: 6793237 - DNA, 58 bp, Homo sapiens
ggagggggtggcgaaggcccctggggctgcacagggagcaaacccgtctatgccctcc

SEQ ID NO: 6793238 - DNA, 79 bp, Homo sapiens
ggggtctcttgttatggcaagcggggttgggggactctttcaatggagaatagaactattgcaataacaagaatgctcc

SEQ ID NO: 6793239 - DNA, 56 bp, Homo sapiens
ttctgaaagaataagatgtttacagtgccatttggagctgttggcttctcttagaa

SEQ ID NO: 6793240 - DNA, 76 bp, Homo sapiens
ggtgaaactgctgactttgagggatacaaacattttgaaagaaagtgtcttttaaaaagtttataacattttctcc

SEQ ID NO: 6793241 - DNA, 56 bp, Homo sapiens
gctgggaaccatgggaaggcagagtacctccttccaccccctaccccatgcccggc

SEQ ID NO: 6793242 - DNA, 57 bp, Homo sapiens
gttggtgaccgaggtcttgcccaaaaatatttagggcatttcagaaaggttaccaac

SEQ ID NO: 6793243 - DNA, 85 bp, Homo sapiens
atcagaagtattgcatttaatgggtagacattgttaggttagaatttaacaaaaaatatagacttgaaattgaagcatttctgat

SEQ ID NO: 6793244 - DNA, 68 bp, Homo sapiens
tgattgtattttgtcttatagattgcggtgaagactggatttcattatctttagacaggaagcaatca

SEQ ID NO: 6793245 - DNA, 60 bp, Homo sapiens
cacagaaatgatgttgtgtccttctcagtgcctcataacaagggacacaatatttctgtg

SEQ ID NO: 6793246 - DNA, 130 bp, Homo sapiens
tctgtcccattcctctgcacctctccgctgcacgtgtcacactaaccacgtctgcagctacaacttaagaagcctaaagatacggtcagtgtacacatgtgcaggggagagtgcaaaggaatgggatgga

SEQ ID NO: 6793247 - DNA, 91 bp, Homo sapiens
tattaagttgcaagccactgctgtgcagacagactctctttgtgaagatgagagttagcctgcatagttcaatggctgacatcctcagata

SEQ ID NO: 6793248 - DNA, 80 bp, Homo sapiens
acaatggcctctagttctatccatgtcgctacaaaagagattatttcattcttttttatagctgaatagtattccattgt

SEQ ID NO: 6793249 - DNA, 72 bp, Homo sapiens
gccttacatcattgagacatacatacatttcatgaggctgaatgggatttatgctgtctttgtgaagtgtgc

SEQ ID NO: 6793250 - DNA, 65 bp, Homo sapiens
caccaccacgcctggctaatttttggtagagacaggttttcaccatgttggccaagctggtcttg

SEQ ID NO: 6793251 - DNA, 129 bp, Homo sapiens
caggaggactggaagtgtttgtctaattatcatttacaattgagtctattgtatgccgtgtaaatttaattttctttgctttttgtgtcagatgagaccaactgaaaagtgattacttcagtaaccttg

SEQ ID NO: 6793252 - DNA, 82 bp, Homo sapiens
atgagggacaggccacagctcacgttccccattttccagaccaggaaaactgggacgctcggctgagttcctggtccagcat

SEQ ID NO: 6793253 - DNA, 83 bp, Homo sapiens
caggatcacagaggagggctccccatccagggcccctgtccttgggaaggttttggagcatggagagcctgagctgaatcctg

SEQ ID NO: 6793254 - DNA, 110 bp, Homo sapiens
gtccctttctttgtgatttaaatctgtataatatgacttagaaacaaaggtgtttagcagcacttctatttttttcagtggtgtgagcataaaccacaaagtatccggat

SEQ ID NO: 6793255 - DNA, 108 bp, Homo sapiens
ggactcaaagccatatactagttcccaataggcctgcacaagttattagaacaagctgctttgcattcttgtgtgatcagaaccagtaactagatggcaatcaggtct

SEQ ID NO: 6793256 - DNA, 72 bp, Homo sapiens
cacattaggccttgcctggcttcacactttcaggcatttcagaggtgaggcctgtacaaagctgcagatgtg

SEQ ID NO: 6793257 - DNA, 86 bp, Homo sapiens
ggtagaattgtacaggaagttgctggagggggtgctatatcaaaatccaagaatccaaagacttgctgtatgtaaagcattctatt

SEQ ID NO: 6793258 - DNA, 128 bp, Homo sapiens
atctggtacttaatagtaattggcattataagagtctgtatataacaaatatccatccaaacaactgcggtattcagttagccacagctattcttgcatgcttagtcttcattgttaactgttcgtat

SEQ ID NO: 6793259 - DNA, 57 bp, Homo sapiens
gaggggacaggagtagcatacttcagggcaccaggtgccctgagattcctccttttc

SEQ ID NO: 6793260 - DNA, 62 bp, Homo sapiens
ggtcctcacccgagtgtgctgccttgtttggttccacttttgcagcagctcagggaggcacc

SEQ ID NO: 6793261 - DNA, 60 bp, Homo sapiens
tgtggggtagttgatgggatatctggtgaacaccactgtttctgccacaatagccccata

SEQ ID NO: 6793262 - DNA, 85 bp, Homo sapiens
cacagcagcatggacagttgtcttgtagctaagctaggcaagctaggctcatggcatagtggacagctgtcatgtggttggtgtg

SEQ ID NO: 6793263 - DNA, 81 bp, Homo sapiens
ggatctcgagcctgtgttcaagcctgtagtgtgctatgatcatacctatatgcattctagcctggacaacatagtgagacc

SEQ ID NO: 6793264 - DNA, 58 bp, Homo sapiens
gcctgtcctcccctgcgctgagccccgcagccagcgcagccttcccgggaagcgcggc

SEQ ID NO: 6793265 - DNA, 56 bp, Homo sapiens
ggctgtagacgttcacagtctccctctctctacggggcctgatggacatttcagtt

SEQ ID NO: 6793266 - DNA, 81 bp, Homo sapiens
aatttagattgtggtgatagttgcacaattctgtgaaaatactaacaatttttaatgggcgactattatggcatgtgaatt

SEQ ID NO: 6793267 - DNA, 92 bp, Homo sapiens
aaattgtttttttcctttttaattgagggttttatgggtagctgctttgagagactatgcaaatatcccatgcctcattaaagttataattt

SEQ ID NO: 6793268 - DNA, 57 bp, Homo sapiens
agctgactgatgaagaggccttcaggagaacttgatagaattctattcatgttagtt

SEQ ID NO: 6793269 - DNA, 80 bp, Homo sapiens
cccagctgtggcagaggccgggcactcacagggccggtggtgtttgattctggcctctgagaagctcctccgacagtggg

SEQ ID NO: 6793270 - DNA, 63 bp, Homo sapiens
ggtaggttctcacattttaaaaggacataaagttatgcctgtctaaaagctgagtacatgacc

SEQ ID NO: 6793271 - DNA, 125 bp, Homo sapiens
ggacaggctcccctgagccagcagcctttagcacaaactgtgtttaggaaacaccctttccgggtgacatttctaggcagattgtctaaagctgtttcatggctagggaagagctgcgtgtgtcc

SEQ ID NO: 6793272 - DNA, 57 bp, Homo sapiens
aatggaatgaataagcaagctgatatcaatttatcagcttatcttgttagtttcatt

SEQ ID NO: 6793273 - DNA, 81 bp, Homo sapiens
gcttggggtggtggaggagaggcgccttgcggaaagccctcttcaggcactcgaaggcctcttgctcctcgactccccagt

SEQ ID NO: 6793274 - DNA, 61 bp, Homo sapiens
gattaagaaagatagatgtggatacccagccactcgttccatattggtatctttttaaatc

SEQ ID NO: 6793275 - DNA, 73 bp, Homo sapiens
agcagagggcgccccagtataatccaagagtcccagggccactgagcagctctgcgattattgggcctttgct

SEQ ID NO: 6793276 - DNA, 90 bp, Homo sapiens
tcttccatctacttttccctctcattctcccatactcacccaggagcctccaactcctccaaggcagggggagagaaggaaggaggaagg

SEQ ID NO: 6793277 - DNA, 69 bp, Homo sapiens
gttcctgcacatttatgggctgggaggcatccgtgtggaattgcgtgcagcctgtgtgtgtgctggcac

SEQ ID NO: 6793278 - DNA, 61 bp, Homo sapiens
ggccagcgtgagagagtttggcaaggagagggaagccccatgacaaaggatctcatgggcc

SEQ ID NO: 6793279 - DNA, 60 bp, Homo sapiens
tttttctttgctgttttgagccaggataagagttttggaagcaataaatggaaagaaaag

SEQ ID NO: 6793280 - DNA, 73 bp, Homo sapiens
agcctgttttttgccctgaccccaaccactcctctttggagaggagagctggtgtctggaatctggatgggct

SEQ ID NO: 6793281 - DNA, 58 bp, Homo sapiens
aggtgagggggctgatcatttactgggctaaggcctagcattgatcagcctgctccct

SEQ ID NO: 6793282 - DNA, 58 bp, Homo sapiens
ctagtcagagtctattgctgtggttacacagaaatgaccaagtggtgggctgtggtgg

SEQ ID NO: 6793283 - DNA, 55 bp, Homo sapiens
gctgccagcccagcaaggtgtgccctggcaccctctcatcttcctggggggcagc

SEQ ID NO: 6793284 - DNA, 62 bp, Homo sapiens
actgctcttttattgctgttttcctatttacatgtgagaaataacagctctggaagagttgt

SEQ ID NO: 6793285 - DNA, 58 bp, Homo sapiens
gggcgtcctggaccctcccctgactggctggagtccccccaggggtccagagacaccc

SEQ ID NO: 6793286 - DNA, 77 bp, Homo sapiens
gaaatgcagattcctggttcctacaccaaacctagtgaataagaacctctggggaaaggcccaggaatatgcatttt

SEQ ID NO: 6793287 - DNA, 64 bp, Homo sapiens
atgggaggcaaagatcgcagaatgggaggttgcttcttcctttacatagattttgccatcccat

SEQ ID NO: 6793288 - DNA, 85 bp, Homo sapiens
gtggctgcaggggctgtcagtcataatccctgtcctttcacacaatatgcagccgtgggaaggctatatgactcagccctgccac

SEQ ID NO: 6793289 - DNA, 56 bp, Homo sapiens
taggaagtggtagaggccaggatttgaacccaagtctttgtatgccacacttccta

SEQ ID NO: 6793290 - DNA, 94 bp, Homo sapiens
gctcagaggatcccaggcccactgcttgtctagtcaggtcaccagattggggagggcttgacaggctagggggctggcagtctgccttaggagc

SEQ ID NO: 6793291 - DNA, 81 bp, Homo sapiens
gggccccgggccggaggcgggcactggagggccggggttgtcctgggcctgaaggagctgcgccccgggggtctggggttc

SEQ ID NO: 6793292 - DNA, 59 bp, Homo sapiens
tttgttcagaaatttggactcctgttgcaccaggaaatctttggtttctgagaagcaga

SEQ ID NO: 6793293 - DNA, 55 bp, Homo sapiens
tggggagtgttaggccgcttgctagtcaagctgagaggctgcctaaggctctgca

SEQ ID NO: 6793294 - DNA, 73 bp, Homo sapiens
gattgtgcaggcaggagacatttggttgggacaaggcttctctgccaactcagcttctgccctgtcatgagtc

SEQ ID NO: 6793295 - DNA, 64 bp, Homo sapiens
gacatttttgaggtcatagggaagggatttatagttccccagaagtctctaacctcaagaggtt

SEQ ID NO: 6793296 - DNA, 65 bp, Homo sapiens
ggaagagctcggaggattggaggagcagaaccaaagctcgctcatctcccttttgaagctgctcc

SEQ ID NO: 6793297 - DNA, 87 bp, Homo sapiens
ataaactctctcttgctgtcaaagcagggtagggatgaagagagaatattccctgcttccctgaaggcacaggagatgtgagtttgt

SEQ ID NO: 6793298 - DNA, 85 bp, Homo sapiens
tttataggaacagtactctacagaatgaatacctgttgggaaacaggtattcattctgtagatgggaaacactggaccatataaa

SEQ ID NO: 6793299 - DNA, 77 bp, Homo sapiens
gagctgtgccatctttttgctacctcaacattacatttgcactgaaacttggaaaggtgggaactgtggtatggctc

SEQ ID NO: 6793300 - DNA, 68 bp, Homo sapiens
aagtgcaatagcaaagaacaacatctgatgttttgctgccatctttgttattccaggttaatgtactt

SEQ ID NO: 6793301 - DNA, 61 bp, Homo sapiens
gcctcttccattgggttcccatgacttacgtcacaggacatcgagccaatgggaactaggc

SEQ ID NO: 6793302 - DNA, 109 bp, Homo sapiens
cagaagcaggatgccgatcccggggaggtgccagggggctcaaaggagagtgccaggcaggtgggcgagcctctggagtcctctggagcctccttggctgctgcttctg

SEQ ID NO: 6793303 - DNA, 55 bp, Homo sapiens
cagctgaagctgacacatagtgctcagttagttacttgagactttgctttagctg

SEQ ID NO: 6793304 - DNA, 72 bp, Homo sapiens
gacctccacatttgaagccatgtcaatagtttttggttttcaaagactctgtatgaatcagcgtggaaggtc

SEQ ID NO: 6793305 - DNA, 83 bp, Homo sapiens
acatatataccttgtaccataggtctatcattctctgtctaagggggaggataatatacgtatggtacaaggatgtcctatgt

SEQ ID NO: 6793306 - DNA, 91 bp, Homo sapiens
cctgcatgggagtggcggggaggccgagggccactccccagggaaagggctcctcagggctttcggcactctgagggctccataatgcagg

SEQ ID NO: 6793307 - DNA, 66 bp, Homo sapiens
gggaaggtggcgagcggattgctgcttgggcatgtggcccgttcctagcccttctccacctcgccc

SEQ ID NO: 6793308 - DNA, 78 bp, Homo sapiens
ctgaggttttaggtttctggatttattatggcacccagtagcaaagctggagtcaagtgttttcaaggcttccattag

SEQ ID NO: 6793309 - DNA, 81 bp, Homo sapiens
cctgggcgcaggcctgcccgtgggacctgtgggacccgttttgttcctggggcttgagggcgggccacagtggtgctcagg

SEQ ID NO: 6793310 - DNA, 60 bp, Homo sapiens
ctgtccatcctgtgatgtctttggctgtataccatatagctcataatacctggatggtag

SEQ ID NO: 6793311 - DNA, 113 bp, Homo sapiens
gctggtccctctatctggagtgcatatctctgcatggctggctctttctcattatttgggtagtagaaagaacttcatgtaaaactgcactgtccagcatagtagccgccagc

SEQ ID NO: 6793312 - DNA, 88 bp, Homo sapiens
ggtgccgtgttattctggtcatgatgagttcttttcaaacagtgattcaggacaagaaatgctcttcctgaccagaacccacattacc

SEQ ID NO: 6793313 - DNA, 69 bp, Homo sapiens
ttcattgttttgattccttcatgtgctggcaaactttcgagcacgccatatgagaatttaaaaaatgaa

SEQ ID NO: 6793314 - DNA, 94 bp, Homo sapiens
ccgggcctgctgcctttgggaataggttccggctcggcggggggaaccccgaaattagcacctgggaagctattctcagcagcgggaggccagg

SEQ ID NO: 6793315 - DNA, 108 bp, Homo sapiens
gaacgcaacaaaaattgaagaaattaaggaatgcaacgaactatggtaaaaactgtaaaagaatggttactgttgctcagtttagtgtgagcttcaagctgtggattc

SEQ ID NO: 6793316 - DNA, 86 bp, Homo sapiens
acctggaggatattgttaaaatgcagaaataattgaggaactctggatggggcctaagattctgcatttctaataagttcccaggt

SEQ ID NO: 6793317 - DNA, 80 bp, Homo sapiens
ctgaggcttcagccctgcctctccaatgcccacagcttcctgctggcactggagttggggtggaggggaggaagccccag

SEQ ID NO: 6793318 - DNA, 78 bp, Homo sapiens
ctgtgtctcgaggagctgttttgaagtgctcggtcaattccatgtgagcagctcccagtggcagctccttgtcctcag

SEQ ID NO: 6793319 - DNA, 75 bp, Homo sapiens
tggaatgcaggtagtgatcgagggtgacaggattggggccccaaatgccaccctcgtcactagctgcgaataccg

SEQ ID NO: 6793320 - DNA, 55 bp, Homo sapiens
caagtgaagtaaaggcagacacctattccaggttcaagtttgctacattcacttg

SEQ ID NO: 6793321 - DNA, 86 bp, Homo sapiens
gccctgcaggctctctgctgccagatgacgagtgaagatgaaagtcctgatgtctattgtctgtgtgcacagagctttggagtggc

SEQ ID NO: 6793322 - DNA, 63 bp, Homo sapiens
gctgagcctgtgacccagggcccaggagcaccagccaccttcctgttcccgtcgcagctccgc

SEQ ID NO: 6793323 - DNA, 60 bp, Homo sapiens
cactcgtgggcccccagaagccagcaagtgtccttgtattttctgggtggctgcatagtg

SEQ ID NO: 6793324 - DNA, 64 bp, Homo sapiens
atgaaatgcaccttccacaagaactacctaggctttgggtgggggttgggggaggtgggtccat

SEQ ID NO: 6793325 - DNA, 63 bp, Homo sapiens
ctgtgatgggcagaggcagcagaaacctggatgtccgggttggagcgcttttgctacacacag

SEQ ID NO: 6793326 - DNA, 58 bp, Homo sapiens
ccttggggaaatagagacccttgtaagaatgaggtcttgtatttgattccttccaagg

SEQ ID NO: 6793327 - DNA, 81 bp, Homo sapiens
gcagtgcaaagaaggtgccccctcctgaaccttgaagtgtagccattagggttttccctggggggccttctcactaattgt

SEQ ID NO: 6793328 - DNA, 58 bp, Homo sapiens
cctgtgcctgttgtactctaagctttccaagatgacatcttagcaccagcaggacagg

SEQ ID NO: 6793329 - DNA, 64 bp, Homo sapiens
gagccttaggaggtctgcttatctctcacagcaatgagctggcagaggatggggacccaggctc

SEQ ID NO: 6793330 - DNA, 64 bp, Homo sapiens
gtctgtgaaatgtgtgtataattaatttcttttaaaattacattgttaatgcattagcacagac

SEQ ID NO: 6793331 - DNA, 76 bp, Homo sapiens
gtgagaggcagaatggaaagatatcatatggtcttcccccatataaaatagcattttccttctactttaccctcac

SEQ ID NO: 6793332 - DNA, 81 bp, Homo sapiens
gaggtccaactaaggctatgatctttttcatgaggtttttctcagatcaaccaatgatggcatcttcacaagttggacttt

SEQ ID NO: 6793333 - DNA, 55 bp, Homo sapiens
gccaggaaattcatgccagatctactgaaagaaaaggcaagatgaaattcttggc

SEQ ID NO: 6793334 - DNA, 130 bp, Homo sapiens
gttgatgttggctcttggcagggaccttgcctggtgctgtggtaggatcatagcctctctgtgtggctgcttgactttgtcacagcatggtggcaggtcccaagagggaaccaagaggccaggtggcaac

SEQ ID NO: 6793335 - DNA, 63 bp, Homo sapiens
tgttcattagtggaagtaagttgtgggctaaggcctgcactaatgctgcactgatgctgagca

SEQ ID NO: 6793336 - DNA, 72 bp, Homo sapiens
gccttatcattttctaccagcggtttgaatttggcttctcaaatgcagaccagtatgaaaaacataagtagc

SEQ ID NO: 6793337 - DNA, 130 bp, Homo sapiens
ccgcctgtccggtggagcaggcccggcccaagtctccatgcctggagggcagcccattctggacatagcgcatgcccagaactgcctccacagccggcttcctctgcggctctctcttcacaagacacgg

SEQ ID NO: 6793338 - DNA, 113 bp, Homo sapiens
ggcagaaaataattgaaataacttccgttcaatttctaattgaatctctcttctgtggggaaggaagtaaagtacaattaaagatgtagtggaaagctgtttttttttcttcc

SEQ ID NO: 6793339 - DNA, 88 bp, Homo sapiens
gtcaagggggccagacgagtccagtcttgttggcacggtgcagccctggttgactctgctgtaactggctggactgtgagcttctgat

SEQ ID NO: 6793340 - DNA, 58 bp, Homo sapiens
gtgacagcctcttgggaggttgaggccccagccccttatctcttcaaggctgatttac

SEQ ID NO: 6793341 - DNA, 77 bp, Homo sapiens
tctgcttctgaccccatctttgagccaaaccttgccagaataagcctggtctctggggttgggtactgataggcaga

SEQ ID NO: 6793342 - DNA, 80 bp, Homo sapiens
ttcttcctgatgctctggatgtagtcaagaacttaaaattgttggagattggaaattgacacattagagcttgtaaagaa

SEQ ID NO: 6793343 - DNA, 91 bp, Homo sapiens
ttaatagattcagaatcaagagatacatttctagtagggcttttgaagtattgagacctctcatggaaaatggatctcttttctcttttag

SEQ ID NO: 6793344 - DNA, 97 bp, Homo sapiens
tccaattaaccagtgagttgaacattgataatgatgatagtaatatgaataatcattaacaattgtttatgctgtgccccgcactgtgtaccttgga

SEQ ID NO: 6793345 - DNA, 76 bp, Homo sapiens
tgcagggctggaggagaatgggtgtgagtctagggtcagctcaggcagcattaaacttcagcagcttattcctgca

SEQ ID NO: 6793346 - DNA, 85 bp, Homo sapiens
ttgggagtggtgaggaagggcagctggttaagtttgcattgtaatcagtgtggctgtcccgctgacttccagctctccctcctaa

SEQ ID NO: 6793347 - DNA, 60 bp, Homo sapiens
tgacagctgatacagtgaaatcgtgccttctctttaagagtacatattatatcagctgca

SEQ ID NO: 6793348 - DNA, 62 bp, Homo sapiens
tggcatgtacccaggaatggacaaaccttgccctacgcagcatcattcttggttggatggca

SEQ ID NO: 6793349 - DNA, 77 bp, Homo sapiens
ggggccatggagcagcctgtgtagacggggacctgccctgcatgggcaccccctcactggctgcttcccttggtctc

SEQ ID NO: 6793350 - DNA, 92 bp, Homo sapiens
gtgtttagaatactgaaattaaatttgaaatccagctgagctctcaccatgtcatgctatttcgaatgtaatatgtcacgtatattaaacac

SEQ ID NO: 6793351 - DNA, 56 bp, Homo sapiens
gaaaagacagctcctcttgaagtcagaggtgactcatgaagcacagctctcttttt

SEQ ID NO: 6793352 - DNA, 130 bp, Homo sapiens
agatttcttaaatttttaaatatatagtagatataattttaagtggtaaattagttctttgataggcatgataacatagttttctacttattcttgtgttgtgtgctcatatattttttatgagaaatct

SEQ ID NO: 6793353 - DNA, 92 bp, Homo sapiens
gctaaatgcaaacaagtcaaggactgaagctggcctgagagtcagggaccccttcccttaggtaggttttagcctaacttctatacatttgc

SEQ ID NO: 6793354 - DNA, 63 bp, Homo sapiens
gtatagttattcaggctaggtgagtggattgcatccccttccaacttattctgaggacagtac

SEQ ID NO: 6793355 - DNA, 66 bp, Homo sapiens
aggtgggtgcattatttgaggtcaggagttcaagaccagcctgaccaacgtggtgaaaccccatct

SEQ ID NO: 6793356 - DNA, 66 bp, Homo sapiens
aagtgtgctttaaagacagttatgctggaaaatgcatctgtcccatcctagcaattgtccatactt

SEQ ID NO: 6793357 - DNA, 113 bp, Homo sapiens
tctgcagaactggaaatggaggacaaagattcagttgatgtgttccagaagcagacaggagggtctactgagaacatactcactgctttactccagaactctgtttctacaga

SEQ ID NO: 6793358 - DNA, 60 bp, Homo sapiens
tgataaagactgcagaactgtacattttcatatgtgtaatatgttgcagactttttatta

SEQ ID NO: 6793359 - DNA, 69 bp, Homo sapiens
tgagctattgttgaagttttatagggcgaattcattccatttactactataaagtcttaatgagtctca

SEQ ID NO: 6793360 - DNA, 124 bp, Homo sapiens
gattatttctaggccttcctgtagtctctaaagctgttatctaagtgtagactaaaagaggtcaatgacttggccttctatattccagatacagattaggaggtgccggaggcttagcataatt

SEQ ID NO: 6793361 - DNA, 82 bp, Homo sapiens
agttcaacagttttgaatctgatggacttggaaatgcatggtgccatcacagagaaaagctatcacaaagcacagttggatt

SEQ ID NO: 6793362 - DNA, 91 bp, Homo sapiens
gtgtaaacaacagtggtcaggaaaagactccccagaaggtgaaattccaacaaattttggcagagtcatttcagaaacgttaaagttacac

SEQ ID NO: 6793363 - DNA, 59 bp, Homo sapiens
cctgctatttgctacaatgtgcctgttgctcaggatacagtggtgacaatatggacagg

SEQ ID NO: 6793364 - DNA, 72 bp, Homo sapiens
ggcacaggctcatagtaagcacatggacaagtgggcacaggttcacaggccagatgcatactaagcatggct

SEQ ID NO: 6793365 - DNA, 102 bp, Homo sapiens
ggtgtggtagcccatgcctgtggtcacagcttcttgcgggtctgaggttagaggattgcctgggcctgggaggttgaggctgcagtaagccatgattgcacc

SEQ ID NO: 6793366 - DNA, 62 bp, Homo sapiens
gaggagcttacaagaaagcttgcaaggtttctttgaagctgtgctttttgtaggaaagtttc

SEQ ID NO: 6793367 - DNA, 62 bp, Homo sapiens
gtcaacaactgaaaagctttttctgttaagtagatacatggcagagcattttacttgttggc

SEQ ID NO: 6793368 - DNA, 63 bp, Homo sapiens
cagcagagcatttggtaggaggtcaggagctcacaggagatgggattctgccgatgcctgctg

SEQ ID NO: 6793369 - DNA, 72 bp, Homo sapiens
cccccaacctgaggccttctctgcacatgccagaacatctgcaggaaaaaagtgcctggggcaggtacaggg

SEQ ID NO: 6793370 - DNA, 66 bp, Homo sapiens
gaaagccaggctggcctggggttccatcctcagaaacatgtgtgaaaccctgagcaagtcgctttc

SEQ ID NO: 6793371 - DNA, 75 bp, Homo sapiens
ggggctgctcgccgcgcgtttcggagtcccggatacgcggcggagagcgggacgcgcggtccacgggcaagcccc

SEQ ID NO: 6793372 - DNA, 90 bp, Homo sapiens
ggctgggcacagtggctcatgcctggaatctcaccactttgggaggcctaggtgggaggactgtttgaggcatggagtttgagaccagcc

SEQ ID NO: 6793373 - DNA, 94 bp, Homo sapiens
attacctgggggatgttattaaagtacagattctgattgaataaggttgaaacagagcctgagagtctgcatttctaacaagctcccaggtgat

SEQ ID NO: 6793374 - DNA, 68 bp, Homo sapiens
ttacttaaattttagttgtgcatgaaccacatgcccctcatgtgccttgcacagcaaaagttgagtaa

SEQ ID NO: 6793375 - DNA, 101 bp, Homo sapiens
tatgctttcctttgggagcatgaattttcccaaagcccaccggcatcctctcctaattccttgctggtcaaaatgaatttttgctcccaaaggaaagcgta

SEQ ID NO: 6793376 - DNA, 60 bp, Homo sapiens
ctgacctgcccttaggcttctcacagtaaagtggtctcagcccagcaaagggaggttcag

SEQ ID NO: 6793377 - DNA, 106 bp, Homo sapiens
tcctgagctttgatccttggtaaaggcttctgcagggactgagggagacaaagagaagaatccatctcgatccctagcctcaaggaattgacaatctaataaagga

SEQ ID NO: 6793378 - DNA, 79 bp, Homo sapiens
tttatatggtgagtgatctcagatgccgcatccagccggatcatcctgcaatgttagcattgagcacttactgtacaga

SEQ ID NO: 6793379 - DNA, 64 bp, Homo sapiens
atgaattagcaacagttttataaagaaagagctttctgagcttttagaatctgttctgattcat

SEQ ID NO: 6793380 - DNA, 80 bp, Homo sapiens
tatgaactactattcttttccaaactgtcaacttctgtttgaaatcattgtgggggatagtttggaaatatggtggcata

SEQ ID NO: 6793381 - DNA, 82 bp, Homo sapiens
agtgattgcttctggtagaattcaatagagttgtcatatcaaattaagttttatcgagtttcaccagatagggatattcact

SEQ ID NO: 6793382 - DNA, 128 bp, Homo sapiens
aagtccaaaatgaaactctggaactaaaaatcagggaggcagcagggctggttccttctggaggctccaggggagaatctgttctttgtctcttccattttctggaggttactggcattccttggctt

SEQ ID NO: 6793383 - DNA, 80 bp, Homo sapiens
gaaagtggcatgcagtgactcagacacaggccagtcacctccacagcctgtcactctgagccgctccgtgaacgctcttc

SEQ ID NO: 6793384 - DNA, 67 bp, Homo sapiens
tgttaaccactcaaggattctggaacagaagctaacagttttctgcaacgagtctttgacttaaaca

SEQ ID NO: 6793385 - DNA, 87 bp, Homo sapiens
ctcgccccaacccgggtcagagggccagagtcctggggtcacctgtgtgtcccccaccttggggtcctaaggtccgggtagggtgag

SEQ ID NO: 6793386 - DNA, 55 bp, Homo sapiens
gagggggtctcctatcatggaagaactgccttgtttgccttttggggatcccctt

SEQ ID NO: 6793387 - DNA, 77 bp, Homo sapiens
tgtagggcccagagcaggttaacagtaaacatcacagaaaaaatgaatggatcctgtgctctttccacggccccaca

SEQ ID NO: 6793388 - DNA, 78 bp, Homo sapiens
ctcctgaggtgttcttcaaggctcccagcctgcctggtgctgcctccagggatggaagacttgaagacccagctggag

SEQ ID NO: 6793389 - DNA, 70 bp, Homo sapiens
gatgtgttcctgagggttccatctcagcatgaccacatgagtacagcaaagaaaccctcagtcccacgtc

SEQ ID NO: 6793390 - DNA, 82 bp, Homo sapiens
ctctaaaggcctttccacattccttacattcatagggtttttcacccgtatgaagtctctgatgttgagtaagttcttggag

SEQ ID NO: 6793391 - DNA, 129 bp, Homo sapiens
tgaaatatatcaaaatactaagagaacaatctgttctcattcagcatttcctaagaacctactaagggccagagattagggaatgttgactgagagcaggctgctctctttggcttttcatatggttca

SEQ ID NO: 6793392 - DNA, 113 bp, Homo sapiens
gtttctttaccattttcataacttcgtagagaatcagactgtaatttcattggtgaaaagctaagattcttaaatttgtttctctttgaaagataatgaaaacctaaagagat

SEQ ID NO: 6793393 - DNA, 100 bp, Homo sapiens
ttctggtttgaggttactaaaagtaaagctgctgtgaacattgttgtaccaatctttgtatacacgtaccttttcttttcccttaagtaactaagtagaa

SEQ ID NO: 6793394 - DNA, 56 bp, Homo sapiens
ggcctttgcccgtgggccttgcactctccgtgacaaggcgacacaggcagcaggcc

SEQ ID NO: 6793395 - DNA, 61 bp, Homo sapiens
gagcaaatgaagagggagaatgtggtttgcaggcttaaaattcaaacctcatttattgttc

SEQ ID NO: 6793396 - DNA, 58 bp, Homo sapiens
actcttatgggaacaaggattagaggaggtattaattcttccttgtgcctgtaagtgt

SEQ ID NO: 6793397 - DNA, 108 bp, Homo sapiens
tcttctcgtttcttgcatctggccactgacttctgattctctctggatggttatcatcttgcagtctagaggtagaggcagtgggaactttgtttaggatcttgaaga

SEQ ID NO: 6793398 - DNA, 73 bp, Homo sapiens
ggggccaccaacaggaggctcccctactgggtgctgaccccctgcgccggcatctgttggagtctccggcccc

SEQ ID NO: 6793399 - DNA, 71 bp, Homo sapiens
cattcatatctgttgttttctcatatgttggtctccttgatgaacatataaagaaaggaacagggacaatg

SEQ ID NO: 6793400 - DNA, 93 bp, Homo sapiens
actgctctgctccaggcttggcacatgagtcactcactaagtctttggagacaaatttactggaaaaactatgagccaggccctcagggcagt

SEQ ID NO: 6793401 - DNA, 68 bp, Homo sapiens
gggatggagagctagtgcctgccagtagggctgcacgcctgcgggtggttaggttggctctttgtccc

SEQ ID NO: 6793402 - DNA, 65 bp, Homo sapiens
tgagacagatggagctactaggtaaagcatcattattgctgtttcagtctctatttgaaacatca

SEQ ID NO: 6793403 - DNA, 96 bp, Homo sapiens
agctgagcagtacttccctgggctgggtttaccctcttcccaggccccagagatggaggagtccgaccctggcccaggaagttcctggctcctgct

SEQ ID NO: 6793404 - DNA, 73 bp, Homo sapiens
ttgcagccaaaagcttgatttcctttattcattgaaatcctcagaagaaagggaattaacttgagttttgcaa

SEQ ID NO: 6793405 - DNA, 74 bp, Homo sapiens
tctgaaaacttcacataaatagatcacatcatccctgatgatggtggtatttttatatgtgtggtgtttctaga

SEQ ID NO: 6793406 - DNA, 57 bp, Homo sapiens
caagtaactaaagatatccatttacatgaaaataagaatggtttcattgggtacttg

SEQ ID NO: 6793407 - DNA, 61 bp, Homo sapiens
caatttcactgacaccctggaatgatgcccaggtctaattctagtctctggtcagtagttg

SEQ ID NO: 6793408 - DNA, 68 bp, Homo sapiens
cttctgacaacataggagctgaagggaccttggatgttgggtaagcagttcccactgtctgtcacaag

SEQ ID NO: 6793409 - DNA, 104 bp, Homo sapiens
aaatcaaattgtgtataattttagaagagatggaagtgtcacccacaaaattactaagggtgagttttcatgtcattttgattttatataactaatgttgattt

SEQ ID NO: 6793410 - DNA, 55 bp, Homo sapiens
gcatgtgtgctgcactttgttgtgcctgaagtacccaaagtacaagtaaacatgt

SEQ ID NO: 6793411 - DNA, 58 bp, Homo sapiens
attattcaaattcccactatacattgtgcgttattgtagagcttggggatttagtagt

SEQ ID NO: 6793412 - DNA, 57 bp, Homo sapiens
gaggctggggtctgcctttctggaagcttccctgccacctcttgcagctccagcctc

SEQ ID NO: 6793413 - DNA, 92 bp, Homo sapiens
gctgcctgtgtttgtgttcctccagcacttgatgttttaaattgatttgtttgaccagaggtccctggaaaaagagagcaggtaagggcagc

SEQ ID NO: 6793414 - DNA, 77 bp, Homo sapiens
cttcctttctgctctgcctctggcctcaggcccaggccccacttgggcctcactctagaaggcacaggaggatgaag

SEQ ID NO: 6793415 - DNA, 72 bp, Homo sapiens
gtaggattgggagagaggcatagagtctggaagacattatattaactgtagatgtatcttctcttatcgtgc

SEQ ID NO: 6793416 - DNA, 71 bp, Homo sapiens
aatatggctttacttaaactgaatcacatgaagaactttctaaatggttcactatgggcataagtcatgtt

SEQ ID NO: 6793417 - DNA, 69 bp, Homo sapiens
acttatctcctgaaaaattcacactgccgtgaacacgatccagccttgcagtgtgtctcggaggtaagt

SEQ ID NO: 6793418 - DNA, 73 bp, Homo sapiens
ttcacattaatgagcgttaatcattaaatgtcataaccattctgtcaagtagtggctgcttcattggtgagga

SEQ ID NO: 6793419 - DNA, 63 bp, Homo sapiens
gtggtcagttgcatcagagaagtctgctctgaaatgcgaacactttctcttgcagctggcagc

SEQ ID NO: 6793420 - DNA, 59 bp, Homo sapiens
tacttaaggtaggccaaatcttcacactgttatgtagttggaggtgtctttcctgagta

SEQ ID NO: 6793421 - DNA, 59 bp, Homo sapiens
ttccaggcattacagggtttgctgtctcacttcagtctcacttttctgcatgtgtggaa

SEQ ID NO: 6793422 - DNA, 73 bp, Homo sapiens
tggagagttgttcaacgtgtgtgaaagaaaacgttctggagaccggtttcacacaacgtgaatatacttaaca

SEQ ID NO: 6793423 - DNA, 60 bp, Homo sapiens
tacctggtgcttactgaaaccattctagtttgagagcagatggaccataaacaccaggta

SEQ ID NO: 6793424 - DNA, 129 bp, Homo sapiens
cccaataccttccttttcctggcctgggagcctgcttgagttcaggggttgattggatttaagcgatacagagagctccggacattcatacatgttccccaaactagggccagctcaggaagccagggg

SEQ ID NO: 6793425 - DNA, 86 bp, Homo sapiens
aaagcttgttatagaggagccagattgtataaaaaagtgagtccagagggctgtttttggtggtacaatcttggccccaatgcttt

SEQ ID NO: 6793426 - DNA, 128 bp, Homo sapiens
agataaaaggaaaagaaagtgcaagtagatttgggatctatagattggggaaagacattcatacagtcaggaccagatgttcactggaagttttttccttctggatccttctttggctataggaatct

SEQ ID NO: 6793427 - DNA, 69 bp, Homo sapiens
ggaaccatgcacttacctgaaattcaagtctttgacggaaaacttggtttcaatgatgcccgtggtttt

SEQ ID NO: 6793428 - DNA, 59 bp, Homo sapiens
tggtagctttgttctcctaaccccgagatttcttggctatgagaactgacagagtgcca

SEQ ID NO: 6793429 - DNA, 82 bp, Homo sapiens
gtaaattgatatagttagatttgtagtgagttcagagttaacactggaatttaaaaaacaggtttgttgagatctaatttat

SEQ ID NO: 6793430 - DNA, 59 bp, Homo sapiens
gggagtctagcgtgaggtctgcctgtcaccatcaggcaggcaggatggcagtggacccc

SEQ ID NO: 6793431 - DNA, 73 bp, Homo sapiens
taaggaaagcacagagctcccacaggaaaccttttatatctctggagttctgtgacatctttggcttttcttg

SEQ ID NO: 6793432 - DNA, 55 bp, Homo sapiens
ccgaggctggagtgcagtggcgcgatctcggctcactgcaagctccgcctcccgg

SEQ ID NO: 6793433 - DNA, 61 bp, Homo sapiens
ttacaggctcaactaatgtattaataactctatggatgtacatttcttgatgcctctgtga

SEQ ID NO: 6793434 - DNA, 65 bp, Homo sapiens
gttttatttccatgagagaccgagaagcttcgagagctggacattttttcagggaaagataaaat

SEQ ID NO: 6793435 - DNA, 61 bp, Homo sapiens
gcttggaactatggaagttggctcggcataggtgtcagagctggagaagtggatttaaagt

SEQ ID NO: 6793436 - DNA, 74 bp, Homo sapiens
cggccaaaagaagaggtgaatagaagtcaatcactttagtaggaagatcaagtttatctcagacctattggttg

SEQ ID NO: 6793437 - DNA, 63 bp, Homo sapiens
ggcctctcttgggacagctgtcttgtaagacactgctgattctcctcaagactttcgcgggcc

SEQ ID NO: 6793438 - DNA, 59 bp, Homo sapiens
tttaaggtgggagaaaactcttaggtcatccacctcctggattttccttccaccttgaa

SEQ ID NO: 6793439 - DNA, 64 bp, Homo sapiens
tctagatcatgtctgtggtcaatgactggccagaactggccagcctccaacaggcttgtttaga

SEQ ID NO: 6793440 - DNA, 85 bp, Homo sapiens
tgagtttgtccacatctgcttcacgtgtctcattctccttggacaagtggcaatgacaatggcagaggtagaagagggcacacca

SEQ ID NO: 6793441 - DNA, 56 bp, Homo sapiens
gtctgtctgtcatcatgcacatttggtcagctcccataactgatgacagatatggc

SEQ ID NO: 6793442 - DNA, 84 bp, Homo sapiens
ccagaacgaggaaggagcggagttgggattccagcccagttggacgctgaagtccctgttttgtttactgcctcctgttcatgg

SEQ ID NO: 6793443 - DNA, 65 bp, Homo sapiens
ctctctcccaggctgccttgaggaatgcagagaaaatactcctggaaagcggacctggggcagag

SEQ ID NO: 6793444 - DNA, 58 bp, Homo sapiens
aagcattttgttttaagaatgaggttgcaaaacgcctctgctttagaatacaatgttt

SEQ ID NO: 6793445 - DNA, 56 bp, Homo sapiens
aggggaggggtggagtcacccaggtttttctggctggtacctgccaccttttccct

SEQ ID NO: 6793446 - DNA, 130 bp, Homo sapiens
acagcaacatggcaaaagttgaaaggaaactgtttggcctgggtgattttttgtctttcaggcagagtaatgagtaaatacaaaatcacctctggtgagacacagtccactggtgtttatgtcatgtcat

SEQ ID NO: 6793447 - DNA, 57 bp, Homo sapiens
caggccctcgcccgcagcgacctaaccccttccagaggctctgctggctggggcttg

SEQ ID NO: 6793448 - DNA, 79 bp, Homo sapiens
gggggcttggtgctgaattggagatgctcctgccctttggtcacctgatgcaggtgctttcctcagatctacctccctc

SEQ ID NO: 6793449 - DNA, 76 bp, Homo sapiens
gacttctactttcaaactgcccagcacacctatgaaattccaacattcttttcaggagctgcagagtggggaggtt

SEQ ID NO: 6793450 - DNA, 63 bp, Homo sapiens
gattatataatggaagctcttgttcacttattgatgaataatcttgagtttccattgtagatc

SEQ ID NO: 6793451 - DNA, 121 bp, Homo sapiens
ttagctgttactacaacacaaactttcattctgtcattcttacataatgtgacccattcaaaggatgtgtcagcattcatgaagtcatgactcagaagacgatgagctgtgtcagagctga

SEQ ID NO: 6793452 - DNA, 86 bp, Homo sapiens
gctaaacatatatatccatgaatgtatttcctcaggaatgttaataatagaacatttaccctggaacattggatagataagtctgc

SEQ ID NO: 6793453 - DNA, 74 bp, Homo sapiens
gactggcttgccacccaggatccagcccttttccccttgctttgggtgagagacctggttggcgtagctcagtc

SEQ ID NO: 6793454 - DNA, 84 bp, Homo sapiens
ttggagaagtgttggctttcaaatggtttctgaagttaggcagatgtttactctctgtcatggtttgaatgctcgcccctctaa

SEQ ID NO: 6793455 - DNA, 100 bp, Homo sapiens
ggtgggggaggcaggtggagaggaacccagacagggctttgcagccaggttggttctcagagttggagtctggacttccttgctaacttgctctctgacc

SEQ ID NO: 6793456 - DNA, 66 bp, Homo sapiens
actcctccctcactacggcctagcagggtggggaccccaatgcagggcagtggaggttgagtgagt

SEQ ID NO: 6793457 - DNA, 69 bp, Homo sapiens
cctttctgaggccattaccaataaaatggagatcacaatgtctactttatatgacggtttcagaattgg

SEQ ID NO: 6793458 - DNA, 66 bp, Homo sapiens
gattgtccagtttcagggtctgcgcttttaaccatgaagccaaggccctggaattgaaaggctttc

SEQ ID NO: 6793459 - DNA, 89 bp, Homo sapiens
agaggtgggcagtggtgttggctggacctgggctggaattctgggggtcactagttaggtttctgtctccagctaagctgcagacctct

SEQ ID NO: 6793460 - DNA, 81 bp, Homo sapiens
ctagaggatgatataatagaaagaagttttggatccaggcagacagtcctggacttgatattctctttccccattttctag

SEQ ID NO: 6793461 - DNA, 66 bp, Homo sapiens
tgggaggcactgctcagtaatagtcctatctgtcccacaacagacaggagtgctgggctgcaccta

SEQ ID NO: 6793462 - DNA, 73 bp, Homo sapiens
taatgctgtacagcatcatactacctaaatgatttgttgttgtcattgttaattgtatgatctgacgatgttg

SEQ ID NO: 6793463 - DNA, 130 bp, Homo sapiens
taagtcctgctctcatctggccctaaagaagccatcagcaggaggtgacagcgaccgtaattctgtttttatgattactgagcaacggtcatttcaggctgagtggtgctgagtgatgggtggtgattta

SEQ ID NO: 6793464 - DNA, 57 bp, Homo sapiens
aagcagactgggccataaggaaacagcaggactggctcaagtgcccaaggtttgttt

SEQ ID NO: 6793465 - DNA, 68 bp, Homo sapiens
gtctcggcacaggccccatcctgactgggaggatcttcatttcacagtgggtttggctctggctgggc

SEQ ID NO: 6793466 - DNA, 72 bp, Homo sapiens
aagaccaatggtctaagccatcataactgcggaaatgtctttcttcagtatccctgcttggacagtggtttt

SEQ ID NO: 6793467 - DNA, 113 bp, Homo sapiens
gcaaggtggaggtgaggtggactcagcagggttgcatgtcagctcagaccccaaactattgagatcagatagctggctgcttgtagactcgactgacctcattccactgctgc

SEQ ID NO: 6793468 - DNA, 85 bp, Homo sapiens
tgatctgtggcaggtgtttaggtttcatggatggtaaagagtaagtctgagctatccatgatcaatttattactaatacacatca

SEQ ID NO: 6793469 - DNA, 90 bp, Homo sapiens
agtaaggtttggtgcggtacagtgatttgcccacagtcccccagcccatgactgacagggccatgctgcactgccctcgacctctagact

SEQ ID NO: 6793470 - DNA, 57 bp, Homo sapiens
gtcctctagggtgtccagttgacagcatatgacagagtggagaggacaccccaggac

SEQ ID NO: 6793471 - DNA, 58 bp, Homo sapiens
ccctgaggctggagtgcagtggtgcgatttcagctcactgcaacctccgcctcctggg

SEQ ID NO: 6793472 - DNA, 76 bp, Homo sapiens
acaattgcttttatttagggccaggtaccactacattgacctgtgttaatactggccctagagagaagtctattgt

SEQ ID NO: 6793473 - DNA, 61 bp, Homo sapiens
gatcactggttttcaaaccctgggttgagacatgtcaaaatccaccgggtgggctgtgatc

SEQ ID NO: 6793474 - DNA, 67 bp, Homo sapiens
gcacagtgttcacttaacaatggatgcatgaaaatgacagcatcctggggagcaagagcaatgacgt

SEQ ID NO: 6793475 - DNA, 86 bp, Homo sapiens
atctcttgtttttaagtgatgaaagcagatgtctaatattgtccttaaggcaagaatttttacacttatttattaattgaagagat

SEQ ID NO: 6793476 - DNA, 74 bp, Homo sapiens
catctgttggttgtggtcaaagctgatggggttttactctgattcactgctttgtttacaactatttaagtttg

SEQ ID NO: 6793477 - DNA, 64 bp, Homo sapiens
tattaggttggtgcaaaattaattgtggtttttgccattaaaagtaatttgcaccaacctaata

SEQ ID NO: 6793478 - DNA, 69 bp, Homo sapiens
gcagctctaatgttacactgcatggttcatagttgcaaacttgaaagccaggatgcaagtagcagctgc

SEQ ID NO: 6793479 - DNA, 66 bp, Homo sapiens
gaatattcttgaaggagtactgtgatatgagtaaatcactcatttgtaccattttttaagagtctc

SEQ ID NO: 6793480 - DNA, 56 bp, Homo sapiens
tagtgtcttcaggagatatgagaaagcactccccatgtctcaatcagaagtcatta

SEQ ID NO: 6793481 - DNA, 85 bp, Homo sapiens
gcattgtacaattgatgggtgacattaggaagatagacccatttttagggtcataatcacagttttatgcacagtttataattgc

SEQ ID NO: 6793482 - DNA, 80 bp, Homo sapiens
tcttccttcttcatttggcttgaggtgtcttggacatgctgcctaagtattggcctatagctagaaggggctaaggaaga

SEQ ID NO: 6793483 - DNA, 78 bp, Homo sapiens
tgtcagttacacccagagatgtcctgagtgatacagagaatttctgtcagtcattcactcactcggacaagaaagaca

SEQ ID NO: 6793484 - DNA, 69 bp, Homo sapiens
tccaaatgggctttcttggacaggagttttatcttgaataccaaaatgcttctgtcccagaaaccagga

SEQ ID NO: 6793485 - DNA, 93 bp, Homo sapiens
ggcttctgttggtgcataaatgtgcacacacatgtgtgcatgtgtatgtctttgtgtgcatatgtgtgcacacacgtatgtgtaagagaagcc

SEQ ID NO: 6793486 - DNA, 55 bp, Homo sapiens
tacagtggggagctcaggagagtgggaaaaggaccaatcatagcagctcactgta

SEQ ID NO: 6793487 - DNA, 129 bp, Homo sapiens
tctgttgcactcttgggggacaaggggagccatgggagagggtcagtgtagcgctcaaaggaaagagattttttgattctcaattgccctctgtcttctcctttcctacttttgtgcatgaagcatggg

SEQ ID NO: 6793488 - DNA, 79 bp, Homo sapiens
gaaaagcttctgaattgctgactttaatattatataagaaaaattatgaaaatacaggacagtaattttggagcttttt

SEQ ID NO: 6793489 - DNA, 69 bp, Homo sapiens
cccgttcctataatagcatagagtgcttttattactggaagttaatgtgatgttttataaaagaacggg

SEQ ID NO: 6793490 - DNA, 62 bp, Homo sapiens
tgtcagttctataatgtggcagttgctgccttaaatagctgaactgcaaatcttagactgca

SEQ ID NO: 6793491 - DNA, 77 bp, Homo sapiens
caggacagaggccagctacccaagggtcagggacctccatctctggccctgaggggctgtgccccttctgcttcctg

SEQ ID NO: 6793492 - DNA, 59 bp, Homo sapiens
agggttttggctgaagttcagcgacatacctattctaagctgaattcgggtatagccct

SEQ ID NO: 6793493 - DNA, 66 bp, Homo sapiens
gtgaccttgggaaggaggtaagatcgctcactgcttcttttactttatctgctttttaaggctcac

SEQ ID NO: 6793494 - DNA, 74 bp, Homo sapiens
aggtttgggcttctgttcctttcacttgcagtcagacatggagttagtggtagaaggaacagaaggggtaacct

SEQ ID NO: 6793495 - DNA, 56 bp, Homo sapiens
tgctaaagcttcctgttcttattttctttccattctaaggaaaggtggccttagca

SEQ ID NO: 6793496 - DNA, 79 bp, Homo sapiens
gtcagtaagtcttgcttctgctcaaggggaggcaaattaggcttcaccttgtaaacagagtgccaaagaatttatggac

SEQ ID NO: 6793497 - DNA, 64 bp, Homo sapiens
aggccaatttaattagtgtgggctctaaggtaccttaagttagccctattaaattaaaccgcct

SEQ ID NO: 6793498 - DNA, 80 bp, Homo sapiens
ggcagcagagtaaggcaggcaacgtccctatggaggaaacaagctcagagatgctgcctgatttattcaagctcacagtc

SEQ ID NO: 6793499 - DNA, 58 bp, Homo sapiens
actggccaggttcaaaatacagggtgcatctttacataaatgatatagtctggccagt

SEQ ID NO: 6793500 - DNA, 66 bp, Homo sapiens
gtcccactgggcaactagaaaattcctaagaatgaaggagttatttggttcttgctaagtgaagac

SEQ ID NO: 6793501 - DNA, 80 bp, Homo sapiens
tggataaacagtattatcaatatatttctgggcaaaatatataaagcaggaatatgttttgtttgatacatggatggcca

SEQ ID NO: 6793502 - DNA, 62 bp, Homo sapiens
ctgccattcattcagaattccagagaatgctgaaattttttgaattggcaagtgaatggtag

SEQ ID NO: 6793503 - DNA, 55 bp, Homo sapiens
gctacctcctgggcccagaccattctctcccggtgtgtctgtccccacgagtggc

SEQ ID NO: 6793504 - DNA, 60 bp, Homo sapiens
taagttctctagtattaagctccatttttcagatggcagaatggagaaacagagaagtta

SEQ ID NO: 6793505 - DNA, 108 bp, Homo sapiens
aattggatttagaagtctatggaaattattaggaagatgggttttaagtgaccagttttttatacatcttctttgacagtgatttgtgcataagcttctgaagtagtt

SEQ ID NO: 6793506 - DNA, 87 bp, Homo sapiens
ctgactgttagagggaaaaatcatttgccacaggtgaatgacaaataacttgtgactcgctttgtggtttctctctttgagagatag

SEQ ID NO: 6793507 - DNA, 73 bp, Homo sapiens
tttcccaatctaatccccaagtcctgtattgactgcatgatctgtacagttctttgaaggatctaggaggaga

SEQ ID NO: 6793508 - DNA, 63 bp, Homo sapiens
ctgaccttggagcggcctgggtctggtgcacgtgcacggcaggcccatctgctcccaggctgg

SEQ ID NO: 6793509 - DNA, 118 bp, Homo sapiens
gtttcaccaagaccatgtgttttcaccctttctcgtttgtctgtttaagcagggagactgatctccaaattaaatcatacagacaggctcccaaagatgaaagcgatcaaggtgaagc

SEQ ID NO: 6793510 - DNA, 69 bp, Homo sapiens
tctgtagtggcctgaggcaatagtcagacatggctggtagagctgtgctgcctcagaagtcatcctgga

SEQ ID NO: 6793511 - DNA, 94 bp, Homo sapiens
aaagaggttttgaagtgttttgaggatgaaatctcccagggacattttgtgaatgtttactgaaaagatttcaataccttttcggtttttcttt

SEQ ID NO: 6793512 - DNA, 60 bp, Homo sapiens
ccgtctgggtttccttcacaagcactggagcatcttgtgctatgtgctgaactcaggtgg

SEQ ID NO: 6793513 - DNA, 64 bp, Homo sapiens
tcaaggaactaaatagttctggaatgacttcagggaaagtggttggacttcagttaggccttga

SEQ ID NO: 6793514 - DNA, 64 bp, Homo sapiens
cagtcacactcagaatgactagagtctgataccatgaaagacatccaggagctgagtctgactg

SEQ ID NO: 6793515 - DNA, 118 bp, Homo sapiens
tatttctgccttgagatatgcagcataaatgtgacatatctggcttaggcttggctctggttgagatctgtgctctgtgtctctcattctgtgtttttcatgctgaaaggcagggata

SEQ ID NO: 6793516 - DNA, 77 bp, Homo sapiens
gtttcgtgatcttgtaattgggcaatgatataaacaatcatggtgaaacagtgccccagttacatggggttaaaaat

SEQ ID NO: 6793517 - DNA, 58 bp, Homo sapiens
gctcctgtgaaggcattaggtgtcactaaggatgagaacagcaagccttcacatgagt

SEQ ID NO: 6793518 - DNA, 62 bp, Homo sapiens
ttgcattttgccaatttgttttcagctgatctttatgtactaacaaattggcagaatgacaa

SEQ ID NO: 6793519 - DNA, 58 bp, Homo sapiens
ctaatgacagctgctcccgtttctgctgctgtggcagggagtcttggcactgtcttag

SEQ ID NO: 6793520 - DNA, 63 bp, Homo sapiens
tgagcagaatttatgacaacgatagccatccgggctgttgacagacataggttttcttgttta

SEQ ID NO: 6793521 - DNA, 98 bp, Homo sapiens
gctgccttaccggcctggcactggctttgatcagagtgaccttttccttccaaacgagagcactttcgagagccggagaggatgctggtaatagtggc

SEQ ID NO: 6793522 - DNA, 56 bp, Homo sapiens
ggggataatgaaggaatggcctaaaatgctctcagtaatattcctgagtcatccct

SEQ ID NO: 6793523 - DNA, 60 bp, Homo sapiens
caatgtgagaataactcaaaacaatgagttctcattgtgaggaattttgttctcttgttg

SEQ ID NO: 6793524 - DNA, 64 bp, Homo sapiens
gcctgctgggagacacccccagcctcaggcagtgctgtcggggtgggctacctaagctgcaggt

SEQ ID NO: 6793525 - DNA, 59 bp, Homo sapiens
gatctatatattctatgttttgaaaacactatatgtgtaacatgatatgtgtatggatt

SEQ ID NO: 6793526 - DNA, 60 bp, Homo sapiens
ttgctaatgccctagaagtattaattcactttgatatgctaattagagggcattatgcaa

SEQ ID NO: 6793527 - DNA, 67 bp, Homo sapiens
ttccaaggcccagcagagaggattgtggggtcttagtccctcctgcatattcatgttggcttaggga

SEQ ID NO: 6793528 - DNA, 105 bp, Homo sapiens
ctgggaagaggcgctcctcacttcctagatgggatggcggccgggcggagacgctcctcactttccagactgggcagccaggcagaggggctcctcacatcccag

SEQ ID NO: 6793529 - DNA, 82 bp, Homo sapiens
ggacacaggaaaggtggccctctgatagggtcagggtctgtgacccagtgactaacagagaggcttcctcttccctgatgcc

SEQ ID NO: 6793530 - DNA, 73 bp, Homo sapiens
ggcaaatgacacactaggaaaagcatttgtaactcataacaagcctagttttcttactgtgtaaagtactgcc

SEQ ID NO: 6793531 - DNA, 66 bp, Homo sapiens
ttctaggggtcagtgaccattgaggatgtggacacaatctttactaagaggtcctggcccagagga

SEQ ID NO: 6793532 - DNA, 59 bp, Homo sapiens
gagcctctggctttctggggccatctcaacatcagagatatatccagagcacagagctc

SEQ ID NO: 6793533 - DNA, 64 bp, Homo sapiens
tgccacagagactttcattgtaaagcctggtactgaagtttggacaaaggtgtgtttgtgtgca

SEQ ID NO: 6793534 - DNA, 86 bp, Homo sapiens
gcttaatctttccttgccatcccttacctcagtcaacacaagttgttgaaaaatgactgatgaaaaagcaaggctgagaatgaagc

SEQ ID NO: 6793535 - DNA, 62 bp, Homo sapiens
gcatgtccaggtcagcagcagggacctgaattccaggactctcagctctgcctggaacttgt

SEQ ID NO: 6793536 - DNA, 61 bp, Homo sapiens
ggaagtggaagtagttgatgacaaaggaaacttaattactgcttcttttccttccacttcc

SEQ ID NO: 6793537 - DNA, 119 bp, Homo sapiens
cacttctcagatgtttgttgaattaaacatgttgacatcttacctccttttttgatttctagtttctcaaagatagggtatgtgcacatggtttaaaaaaaaatgaaaatctgaaagtg

SEQ ID NO: 6793538 - DNA, 77 bp, Homo sapiens
tcagaggagaaggggaaggggcaggggtgaaatggaaattctccaattcctcaggcttccctttgtccttcccttga

SEQ ID NO: 6793539 - DNA, 93 bp, Homo sapiens
agcatgtccacaaggctggaggcagcacgagggcaggaaccaagtctgcttgatgattgctgtctccccagggcctcccatgtggaccatgct

SEQ ID NO: 6793540 - DNA, 70 bp, Homo sapiens
tggaaagctctggagctttaattgctttccttctgtttttggagaacaaagcaccactgagtcagttcca

SEQ ID NO: 6793541 - DNA, 78 bp, Homo sapiens
gggtcctgctgtagcttgtgttaactctttagttgctggatcttggagatgaccaggcatgccaagaggcagtggctc

SEQ ID NO: 6793542 - DNA, 69 bp, Homo sapiens
tctgtcataagtgctgaagtattcaggaaatgggtgggcaaaggaatagtcttcagcactttgatcaga

SEQ ID NO: 6793543 - DNA, 61 bp, Homo sapiens
tagacgtggccgtgttcccaataaaactttatttacaaaattgggaagtgggccaggtttg

SEQ ID NO: 6793544 - DNA, 69 bp, Homo sapiens
gcccttctagctcttacactctgaatagaacaaatgaatgtatactattagaaaacagagcagaagggt

SEQ ID NO: 6793545 - DNA, 71 bp, Homo sapiens
ttccttcatttattcatgatctgtagctggttttgtactacagtggcagagttgaataattgaaacaggga

SEQ ID NO: 6793546 - DNA, 100 bp, Homo sapiens
agttggctgggctgttgttttattgtgtgtgtgcaatgaaaaatctcatgtattttagtgagttcatctgtacgccaagtactccaaccatctctcaact

SEQ ID NO: 6793547 - DNA, 65 bp, Homo sapiens
agcttgaggttatttattatgcatgatcatgttaatggttacatgaatacataaccattcatgtt

SEQ ID NO: 6793548 - DNA, 67 bp, Homo sapiens
tgtcttctcacgtgggttcctgtgcttcagtaagaactcagaaagcacagttcatgagacaaagaca

SEQ ID NO: 6793549 - DNA, 66 bp, Homo sapiens
tctttgggagatgttatttatattgagagaagtaaattctatgagtggataagcatcttccatagg

SEQ ID NO: 6793550 - DNA, 56 bp, Homo sapiens
tgcctgtcacttgagagttctgtggctgtgggccaaggacgtacaggagataatca

SEQ ID NO: 6793551 - DNA, 77 bp, Homo sapiens
taaacaattcctctctaggcatagcccctgaatggcttctacatggctaaacaagtgcctcagaggaagaatgttta

SEQ ID NO: 6793552 - DNA, 89 bp, Homo sapiens
agggactgtagagcaccaagctagaggtgagctgtgattcaaactccaagtcctcgcttctagctgtgtcccagtgcaggcagtccact

SEQ ID NO: 6793553 - DNA, 68 bp, Homo sapiens
tgaagttctgtgtttctcccatgttaaaaactttctcaccttcagaacagaaggaatacagatcttca

SEQ ID NO: 6793554 - DNA, 79 bp, Homo sapiens
tcagctgcaggtcagctaggcagctgcgatggccttgggatccactggcagttggctagccttcattgacctcagctgg

SEQ ID NO: 6793555 - DNA, 96 bp, Homo sapiens
ggcattcactgtactgccccccaaagctgccattgcggtcggaccccaggtcgaactcatagtcgtagctgtagctggggcggtaggggttgtgct

SEQ ID NO: 6793556 - DNA, 68 bp, Homo sapiens
tttgtctgtgcatccttaacgcctgcctagtatgaatgcatggagaggtgaatggatggatggaagaa

SEQ ID NO: 6793557 - DNA, 57 bp, Homo sapiens
ggcttcagtgaactttgaattgttctaatttcaacacagtttagaggccaacaagcc

SEQ ID NO: 6793558 - DNA, 99 bp, Homo sapiens
tggagcagggaggagctgggatgaggagcatccttacctgggcaatctgtccagacccatctcagggatctcctcctcctgtaccccccaccacctcca

SEQ ID NO: 6793559 - DNA, 57 bp, Homo sapiens
cccccttctcttggatttagtcctggtatcacaccacttggatcttatgggaggggg

SEQ ID NO: 6793560 - DNA, 56 bp, Homo sapiens
aggaaaggctctgtggttcctaaaggctcagactcttaactacagcgcactgtcct

SEQ ID NO: 6793561 - DNA, 101 bp, Homo sapiens
ggcattttaaaatgtgtttattatatcttgttttgaactcatcaggaaattttaaacatttactgatgtcaaaggaggaataaatattgtcttcaggtgct

SEQ ID NO: 6793562 - DNA, 85 bp, Homo sapiens
gctaagatgttattctctacttactgtgttgacatctgcatttgtagtaaaaagcaatggtgagtaaatctgctggcgtcttagc

SEQ ID NO: 6793563 - DNA, 76 bp, Homo sapiens
gcttgctcacagtacctggcttggctgcttacaactattaaattagctagataatcctgtgctgtgtaagtacagc

SEQ ID NO: 6793564 - DNA, 59 bp, Homo sapiens
ccctgggcaagccctattttcctccctgctaacttgatgacaacaggggaagttcaggg

SEQ ID NO: 6793565 - DNA, 75 bp, Homo sapiens
gcggggcacatttgtaagagtgggagccagacccctggcagaccaggagtctaattcctgctcttactcacctgc

SEQ ID NO: 6793566 - DNA, 58 bp, Homo sapiens
gcattctttccacgaggaggtaccctcggccgggcttcctgagtgctggagagagtgc

SEQ ID NO: 6793567 - DNA, 86 bp, Homo sapiens
gccaaacctcagagattcacgtcagtcccaaagcctccagagaaagaaaataagccaggcctggggctggggatcttgagcctggc

SEQ ID NO: 6793568 - DNA, 85 bp, Homo sapiens
tggctctctcagctgtgtttcaggcttggtgctccagtgccctcctcaaggccatagtggaggcagcagctgggtgagagggcca

SEQ ID NO: 6793569 - DNA, 67 bp, Homo sapiens
ttggcaatttaaatagcaggagagtagttcagataacaggctccagatccaagttataaagtgccaa

SEQ ID NO: 6793570 - DNA, 126 bp, Homo sapiens
aaattgcccaggatctacacagttagtgaaatggatactaggatgttacgatgctttacagaaaaaaatatctaagcatggctgttctagctatatacacaaacccagaagatcctcagacaattt

SEQ ID NO: 6793571 - DNA, 65 bp, Homo sapiens
gtgagttgtttcaaaatgatgctgtaacttggcaaggactgcagaactattttgaaaaatttcac

SEQ ID NO: 6793572 - DNA, 63 bp, Homo sapiens
ctcttgttcccttcaatcagttcttcacttaatagccatagaactggctgggaacacctagag

SEQ ID NO: 6793573 - DNA, 58 bp, Homo sapiens
tgaggtaaaaaagaggttaagtaacttgcctaaggttatataactactattttgctca

SEQ ID NO: 6793574 - DNA, 127 bp, Homo sapiens
gacttctatagtttctaaggcatcttctatttgtaaatcagtttaaatgggctgttgggtagacaattgctctaatacccaatgagctgaaataatcaacatggagcccaaggatgctaaggatttc

SEQ ID NO: 6793575 - DNA, 64 bp, Homo sapiens
caaggaaggggacagaaccatcaggagttacgcagctccaaggttttccctgtccttgtccttg

SEQ ID NO: 6793576 - DNA, 102 bp, Homo sapiens
aaggaggtcagtcaacacgtgtcatctttcatatagaagttagtttcacttctgagaaaagtgaacctttatatgaaagatgacatgttgactgacctcctt

SEQ ID NO: 6793577 - DNA, 55 bp, Homo sapiens
tttctgtttctggggtctctgacagtgactggtcctgtcttcccagcagcaggaa

SEQ ID NO: 6793578 - DNA, 66 bp, Homo sapiens
gtggttcttagccttaagtgttacttccctaagaaggatacaatagactttggttattgggaccat

SEQ ID NO: 6793579 - DNA, 115 bp, Homo sapiens
aaggtagctacaactgtaagttgaaacttcagagtaattccttagtgtgcttagaatcccattaagtctcacactggcttactcaggtatttactcccagtgtatcatttgcctt

SEQ ID NO: 6793580 - DNA, 66 bp, Homo sapiens
gcaaacttccagggtggcttgagcataatgatgctatcaaccagctcagatgccctaggaggtggc

SEQ ID NO: 6793581 - DNA, 79 bp, Homo sapiens
cccatctctaaaatgggaatataattttagcaaccacacagtgggtgttctgaaggtgtatctgttaattggagatggg

SEQ ID NO: 6793582 - DNA, 112 bp, Homo sapiens
gggacgtgaagccagacatgtgaggtgcctgtgagtatcatctgcctgcccatcagacagggaagcagttgagtctgctagctaggaccccagattttctgcctttcctcct

SEQ ID NO: 6793583 - DNA, 61 bp, Homo sapiens
tctcagtccttggcaagttctcagtctaaacggaaagacagacatggaccaagcactgtga

SEQ ID NO: 6793584 - DNA, 98 bp, Homo sapiens
aaaggtaattatgtgaagtgatgtatatgttaggtagttgcttgtgataatcattgcacaatgtatatgtatatcaaaacctcacattatacaccttt

SEQ ID NO: 6793585 - DNA, 58 bp, Homo sapiens
ccgggctttgggatgctgttcctttgttggagggagcagagcccttccatggccttgg

SEQ ID NO: 6793586 - DNA, 65 bp, Homo sapiens
gttgcttcttggcttttccaaccctctgccatgcttgaacatctttgtgaaagtccaggaacaac

SEQ ID NO: 6793587 - DNA, 78 bp, Homo sapiens
ggcaccccaggccaagccccagctggggagagagctgccacgttttcctccaagcgtgggtgtttgagagaaggtgct

SEQ ID NO: 6793588 - DNA, 76 bp, Homo sapiens
gcaggagtctgggaaggctctgcagatatgttcaacaaacacctccaggaagtcttctcagcacagcacctcctgc

SEQ ID NO: 6793589 - DNA, 68 bp, Homo sapiens
ggtttaactgtctcctttagaaagcttcagaaaacaactgtctagtttctagcaaggattgttgaatc

SEQ ID NO: 6793590 - DNA, 98 bp, Homo sapiens
tgatcttgtccacagttttcaagtacatgttgctcaacagccacatgttctcatctatgaggttgacagcagcatgaactacgaactcgttcagatca

SEQ ID NO: 6793591 - DNA, 62 bp, Homo sapiens
ggtgggatgtgccacccctaggaaggtcggcacctttaccttggggaactggacgtgctgcc

SEQ ID NO: 6793592 - DNA, 75 bp, Homo sapiens
cctctgaaccaatctctatgcaccagactagttctgcaccttgctgatgctgaattgatgcgagggaggctgagg

SEQ ID NO: 6793593 - DNA, 66 bp, Homo sapiens
gcccagggccctttggactccctggagtgacagaggagtctctgcctggggggatcagaactgggc

SEQ ID NO: 6793594 - DNA, 77 bp, Homo sapiens
tgtctccattttgcagagcctgaaactggaagtggtgggtgctacatcccaatgtggtttctgcaagaaaggggaca

SEQ ID NO: 6793595 - DNA, 83 bp, Homo sapiens
tgcctggcttttgcctgctcaggttggcgtttttctgacacacagatttctgttgccatgctctggggaggtcaagcagggta

SEQ ID NO: 6793596 - DNA, 76 bp, Homo sapiens
gtctctattcacatggaaattactattctagagaaatcatggtaatttagtgattccaatgtgaagtggaagagac

SEQ ID NO: 6793597 - DNA, 65 bp, Homo sapiens
gttgagcccatggtgtactctgtggcccagggcacggcagggcccgaggtattccaggctgcagc

SEQ ID NO: 6793598 - DNA, 80 bp, Homo sapiens
caagcaccagctcacctggactcatccatagaggtgacatcttaatcaccagacgcgtgggtctgaggaagcggagcttg

SEQ ID NO: 6793599 - DNA, 88 bp, Homo sapiens
ggagaatcgcttgaaccctggaggcagaggttgcagtgagccaagatcgtgccactgtactccagcctcggtgacaaagtgagactcc

SEQ ID NO: 6793600 - DNA, 84 bp, Homo sapiens
cctgtacaggactcttccctgggtccatccttttggtctacaacactaggcctgaggggtatccaaggggtaacagtttgcagg

SEQ ID NO: 6793601 - DNA, 76 bp, Homo sapiens
ttgttttcttttcggggaggggagtgtttattctcaaactaagcagtagccctctccaccttcgaaaaaggaacaa

SEQ ID NO: 6793602 - DNA, 104 bp, Homo sapiens
tgtttgttttgaagcatttgcttaaaagcggagcaagagtcttaacccaacttgccataacactgcttttctcgcttttgatgtaaatcttcaaaattcagaca

SEQ ID NO: 6793603 - DNA, 57 bp, Homo sapiens
tacaagtcagttgcgctactaacaggatttggctgtgagcaagagaaactgactgta

SEQ ID NO: 6793604 - DNA, 92 bp, Homo sapiens
aattaatggtagagctggagttaggacacatgtctcacagttcctagttcgttttgctttgatgtgcttgaaattcagttttgacattaatt

SEQ ID NO: 6793605 - DNA, 68 bp, Homo sapiens
cacacctctgtgtacgcaggcgtgcgcgtgcgcgtgcgtgtgtgcgcgcgtgtgtgtgtgtgtgtgtg

SEQ ID NO: 6793606 - DNA, 60 bp, Homo sapiens
cccatgggcagctgcagcagtggtgtgtatctttcatttgttgctttagctgtgcagagg

SEQ ID NO: 6793607 - DNA, 81 bp, Homo sapiens
tccttatttatttgtgttttttaaacatactcatacttccctctattgtttgtgtcatagagagcacaaatcagatttgga

SEQ ID NO: 6793608 - DNA, 95 bp, Homo sapiens
ggcaggtatgataaatatagttggatcatggaatgtctgcttttatttctatgttcattgaaaacagtgtttttatgatttatgttgtatctgtt

SEQ ID NO: 6793609 - DNA, 66 bp, Homo sapiens
atgcctccgctgctcgcagcgggcctggcctcggccccgggctccacgcacgcgagaggtgggcgt

SEQ ID NO: 6793610 - DNA, 72 bp, Homo sapiens
cccttccctcaaaatagtagctttgatgcctttatggtaagtgaccaaagagtgcattgctatagagaaggg

SEQ ID NO: 6793611 - DNA, 55 bp, Homo sapiens
cattcacaatagttgaaaggtggaaacaactccaatgtccatcaacaggtgaatg

SEQ ID NO: 6793612 - DNA, 55 bp, Homo sapiens
cagctggcaagtggagcagggtgggggctcaacctcctcaccgcttgatcagctg

SEQ ID NO: 6793613 - DNA, 81 bp, Homo sapiens
agcagcatcttctgttctccgccttagagagattcacttaaaatcccgaagtcccagatgtggacgacaatggaagctgtt

SEQ ID NO: 6793614 - DNA, 73 bp, Homo sapiens
agttaatttccttaggttcagcttccactgcctataaaaataggggtggggttgaaatctctggaactggact

SEQ ID NO: 6793615 - DNA, 59 bp, Homo sapiens
tctctgggtattcactgccttcctgatattagcccttggaattgttgactccccagaga

SEQ ID NO: 6793616 - DNA, 79 bp, Homo sapiens
gagtggatcatgtggaaaattcattgtgagtagttgaaatctttgccttttcattagattttaccatattttcacactt

SEQ ID NO: 6793617 - DNA, 65 bp, Homo sapiens
catatggccacagcttgtttgcaaagaatgctgatcatgctttcaaacaaaactgttcccatatg

SEQ ID NO: 6793618 - DNA, 84 bp, Homo sapiens
acaacacagagaccctgcaatagaaaactcaatacttaaggaaaaaagcctgtattttatttcagttcacggttatgctgttgt

SEQ ID NO: 6793619 - DNA, 72 bp, Homo sapiens
accttgcgtcaattagctggtactgacaggactgggaaggtcgttgcaggccccatctgggcatagcaaggt

SEQ ID NO: 6793620 - DNA, 130 bp, Homo sapiens
ccctacctgtgcagtgagagaggagcaagagaagaagaggagtccaggccatggtggacacagcctgacatgcacagtgggactgggctgccccaggcctccttttcttcccatactctgcagaggaggg

SEQ ID NO: 6793621 - DNA, 129 bp, Homo sapiens
cctcaaagaccgagctcaaacctgttctcttccatgttgatctcttcagtgtgagctgtggaacaatctcatgcacagccatctaagaaatacaaaattggaatcacagcaggttgaggaattgggggg

SEQ ID NO: 6793622 - DNA, 76 bp, Homo sapiens
tgtcatcatcagagtgcagggagtagcagcaagttgggattcagccagctctaaactccttgctctctttcggaca

SEQ ID NO: 6793623 - DNA, 90 bp, Homo sapiens
gctgtctggcagtcgaccttaggtgcagatgcaggcaggcaggtgagtgggcatgtggcatgtggcccaaggaggctgtcactaggcagc

SEQ ID NO: 6793624 - DNA, 69 bp, Homo sapiens
gcaccatgacattttaattttcacttagtgagaactagtgattttgctttgaagtgacagcatgtgtgt

SEQ ID NO: 6793625 - DNA, 57 bp, Homo sapiens
agctgaggcatggacaggctgctctcctaccacctgccaggccgctcttgcccagct

SEQ ID NO: 6793626 - DNA, 56 bp, Homo sapiens
cccaactttgagtgaagtgtagggtatttatttaggcttcctatcttagagctggg

SEQ ID NO: 6793627 - DNA, 88 bp, Homo sapiens
tttttgagttcatgcggtagctacaaaacataaacattgcaaaaactgcctacaatgctgtttgtgtcttagttacaaagctttaaga

SEQ ID NO: 6793628 - DNA, 60 bp, Homo sapiens
aggcctggaggtatatatagtttttttccccaaacgattttaatgtataacctctggctt

SEQ ID NO: 6793629 - DNA, 80 bp, Homo sapiens
ttcaattagatataccaagtcatctattcccatggtgagtgccactaagattggttgattggtaagcaatatttgttgaa

SEQ ID NO: 6793630 - DNA, 58 bp, Homo sapiens
gaattataggtttgcatgctaactaagcagagttgatgtatgacccgaaccttaattt

SEQ ID NO: 6793631 - DNA, 62 bp, Homo sapiens
tctttgctcacttgtgtattttcagtctctccactggaatgtaaacctcaggtgggcaggga

SEQ ID NO: 6793632 - DNA, 72 bp, Homo sapiens
tgaggcaaattactttaacctctttaagctctagcttcttgatttgtaaaagaaggattaataattgcctca

SEQ ID NO: 6793633 - DNA, 78 bp, Homo sapiens
actgacatctctccaaaggaaggtgctatagttaaacccactctacagatgtggcaactgagttcagagaggtgcagt

SEQ ID NO: 6793634 - DNA, 74 bp, Homo sapiens
ttttatgttgaagtcttaactccaggtacctcagaatgtggctgtatttggagataagatttttagatatttaa

SEQ ID NO: 6793635 - DNA, 66 bp, Homo sapiens
atttataattctgttttccatggcagttattctgttatgctaaattcagacagggttaatgtagat

SEQ ID NO: 6793636 - DNA, 74 bp, Homo sapiens
gaagtgacaattctgggtagggcaaggaactggccctgaatctggtgcttagccttgcctgccttgtcatcttc

SEQ ID NO: 6793637 - DNA, 66 bp, Homo sapiens
aagaatggggaagacagcagacactgtctctgatgttgacatatcctgctttgtctcccctcgctt

SEQ ID NO: 6793638 - DNA, 56 bp, Homo sapiens
ttctttatggaatggtgatagtgatactgctgactcgccagggatgctgtaaggaa

SEQ ID NO: 6793639 - DNA, 64 bp, Homo sapiens
tttccacaatgtttttgcaggaaaaaactttcaaacattttagtgctaaaaactttgtggtaga

SEQ ID NO: 6793640 - DNA, 85 bp, Homo sapiens
gattttattacttacctgagcttcattcgttggggcaacatcccttggaagtctgctgctcaggagttttggagtaatgagcgtc

SEQ ID NO: 6793641 - DNA, 113 bp, Homo sapiens
ttcatacagggccttgtgtgtagttgtagctcattaattctcagtgcagtgcaaatatacagcattcactgttgatgggcatgcaggtggtcgccagtttgggctattatgaa

SEQ ID NO: 6793642 - DNA, 72 bp, Homo sapiens
ctacatgtctaagacttgttagcaagatacagtcttccattgccagttttggagtcaggcttagatgtgtgg

SEQ ID NO: 6793643 - DNA, 68 bp, Homo sapiens
tttctcttaggtaagttaagcattccccttgaatttttaattggaagaattgatttgcttagtaggaa

SEQ ID NO: 6793644 - DNA, 88 bp, Homo sapiens
caccaccagcccaggagcagcttcctgtttgcaggcatgggcgcccgttgccatggtgactgcaggaggtgctccctccaggtggctg

SEQ ID NO: 6793645 - DNA, 59 bp, Homo sapiens
tttgttagggtttcagctagccaaaaatggtattttcatttgctgaaattctaaacaaa

SEQ ID NO: 6793646 - DNA, 65 bp, Homo sapiens
gggtgttcctgtcattcacagcaattccgtgtttacagggggctgtgggatgcataggagctccc

SEQ ID NO: 6793647 - DNA, 63 bp, Homo sapiens
gagtggactaacaggtcagcctcctgtcccttctgactcctgctgcctggctttagtccactt

SEQ ID NO: 6793648 - DNA, 60 bp, Homo sapiens
ccaccatttctgtgacacttccatctgggaatccagatggaagaatttcaggaagtctgg

SEQ ID NO: 6793649 - DNA, 129 bp, Homo sapiens
cactacaggccctctttgcagaacatctcattttagggtgcctccaagccccccagggcccataaggagtgctgaggaaggctgggggcatcccagtggaggggtcagctaggcagaggtcagaggacg

SEQ ID NO: 6793650 - DNA, 81 bp, Homo sapiens
ttattgggctccacactcctttttctcatctgatgttttacaaatatttttctaattgcctgagacagtgtggtccaataa

SEQ ID NO: 6793651 - DNA, 77 bp, Homo sapiens
ggtgcaagggcgcaggccacagtggagtctctgggtcttccccgggtgactttgctgttggctctgggccccacact

SEQ ID NO: 6793652 - DNA, 73 bp, Homo sapiens
ggctgacatctgtcataaaatgtataaacaagaaaaccaacaatatatatattttttgagacagagtcttgcc

SEQ ID NO: 6793653 - DNA, 80 bp, Homo sapiens
tgaacaattggggagatgggagactgctgaaataagaaactcaaagctttttctctacataacctcaatactcaggttca

SEQ ID NO: 6793654 - DNA, 57 bp, Homo sapiens
ccagaaatcctggcctcactgtaacaaaacattcgttttggttgagccagggcctgg

SEQ ID NO: 6793655 - DNA, 122 bp, Homo sapiens
agtagatataacctgagatgatagatttaaacaggatatttacgttctgctacaattgactgataacacttgaagtgtagtctgaacagtaattttgttaatcatttcaacaagtatttgct

SEQ ID NO: 6793656 - DNA, 69 bp, Homo sapiens
cctgcatataagaagtgaagaagagttaaaatgaaaatttggctgtttctttgatttcttgtttgtggg

SEQ ID NO: 6793657 - DNA, 55 bp, Homo sapiens
atgtatgtctaaaacggggaggcatgaataatccaccccgtgtttagcatatcat

SEQ ID NO: 6793658 - DNA, 65 bp, Homo sapiens
tattatcagcaatggttcatgtgttgggtccagggaagccatttccagcagccattctagtagta

SEQ ID NO: 6793659 - DNA, 69 bp, Homo sapiens
gtgctttgcattttgttacatcttatgtaagtggtgatattagcattactacattgtaacacagtacac

SEQ ID NO: 6793660 - DNA, 75 bp, Homo sapiens
ggagacatttgttcagggctgaggaagtatcctgccataaacttcctgcaaaatcacggctgtgtaacaggctcc

SEQ ID NO: 6793661 - DNA, 103 bp, Homo sapiens
tgcctgtcttgtaaatgaagaaatggagattgtagtcataatctctggagtagaaagagaacattcaagataatctagtcattgtttctttacgatcaaggta

SEQ ID NO: 6793662 - DNA, 78 bp, Homo sapiens
ggattccatggcatgagtatatgatatggtttggttctgtgtccccacctaaatctcatcatgtacctcccataattc

SEQ ID NO: 6793663 - DNA, 81 bp, Homo sapiens
aaagcagacaccctgtacaaatggacatcttggcattacagccaggatgctgtgcttttgtaggggggcatcttttgtttt

SEQ ID NO: 6793664 - DNA, 65 bp, Homo sapiens
ttcctctggctctgacactactgttatcctatccttgataagtgatgctcaggcctagaaaagaa

SEQ ID NO: 6793665 - DNA, 73 bp, Homo sapiens
atctgtctggttggagaatcactgcaagccaaggcatggcattggccaatggtgattcccggcctcctcaggt

SEQ ID NO: 6793666 - DNA, 69 bp, Homo sapiens
gcagtggcaggagactggaagatggggagaaagagtgaagcccttcctagcctttctgtctgccgcagc

SEQ ID NO: 6793667 - DNA, 128 bp, Homo sapiens
ttagaattaatgtctttgtaaactttgactctattactctgccatcaccagtaagggggaattgaaatatacccatgctgggaaacaatggaagtagtgtggagaaaagtattaaggatatattttaa

SEQ ID NO: 6793668 - DNA, 61 bp, Homo sapiens
tgcctttgctgattctctgccctagggccctcccttggggatctgagttgtcaggaaggca

SEQ ID NO: 6793669 - DNA, 85 bp, Homo sapiens
tattaggttggtgcaacagtaatttgcggtttttgccgttgaaagtaatggcaaaaactgcaattactgttgcaccaacctaata

SEQ ID NO: 6793670 - DNA, 64 bp, Homo sapiens
ccctccaggcactgccctcttccagagaaaccctccaggccacagagagggctgctggggaggg

SEQ ID NO: 6793671 - DNA, 62 bp, Homo sapiens
gtctgcactgtggagtactgtggagaagttagacaaaaatacctagtcctttatgtgtagac

SEQ ID NO: 6793672 - DNA, 59 bp, Homo sapiens
ttcaccctgctggaggcagctgactcagaaacctgaggaatgcatcttgcatgggtgag

SEQ ID NO: 6793673 - DNA, 72 bp, Homo sapiens
atgtcatgctagttaagaacacaatgtatttatagctcaattatacattttctgatgaatttggcatggcat

SEQ ID NO: 6793674 - DNA, 72 bp, Homo sapiens
gaggcacctcgcgggaggaggcggggtgaggtgtcagtgacacgacgaaacctcttcttgacgatggtcctc

SEQ ID NO: 6793675 - DNA, 92 bp, Homo sapiens
atttttagcttggcatggcatttagagaattaacataactccggttataactggtaaagaattggttctctgtaaatacctgctgcttgaat

SEQ ID NO: 6793676 - DNA, 67 bp, Homo sapiens
aggcaatgctatcatgtcagagataagagagggggcctttgtctttgagagctgcatggacttgcct

SEQ ID NO: 6793677 - DNA, 97 bp, Homo sapiens
ggggacttattataaatgcaaattctagggccctattccagacctactgtatcagcaactcgggtagggccttgcaatctgtgttttgacaagcccc

SEQ ID NO: 6793678 - DNA, 72 bp, Homo sapiens
cttatgtaactgcctaatacatgatgataggtacacaacaaatgattactttatcaatgtattatgcatagg

SEQ ID NO: 6793679 - DNA, 74 bp, Homo sapiens
gataactgattgcatctgaaggagcatgagagagtgattgagatcacttccagcccctgtcagcaaacagtatc

SEQ ID NO: 6793680 - DNA, 60 bp, Homo sapiens
cctctggccattctttgatggagttgagaaatatgaccacaattacagatggctcagggg

SEQ ID NO: 6793681 - DNA, 111 bp, Homo sapiens
atattgagcatttagaagtttaggcagaacttggcttgcttgcagcttatagtaagcagttaatgttttgtcaattaatgtctaaagtgcctataaatacacattcaatat

SEQ ID NO: 6793682 - DNA, 66 bp, Homo sapiens
aaaaggagctcttaaaatcagagaatgatgctgcctcctggtatctgtctctttcagtctcctttt

SEQ ID NO: 6793683 - DNA, 58 bp, Homo sapiens
tcagctccacagctcctctgcctttgtccgagggcaaaaggaacggatgtgaagctga

SEQ ID NO: 6793684 - DNA, 91 bp, Homo sapiens
gattactcaatgcagtctctatttgtttcttgttcttttgtccttagggcttgtcccactagaaaggtacagattatggtgtttgacagtc

SEQ ID NO: 6793685 - DNA, 56 bp, Homo sapiens
ttccatccactggtccagggaagcagattgttaccttctcagggtcttagatggaa

SEQ ID NO: 6793686 - DNA, 90 bp, Homo sapiens
aagcacatactgtttgtaagtaagagaggttcagcaaacatttcttaaataaatgaattttgctgatattttgctgatacagtctggctt

SEQ ID NO: 6793687 - DNA, 97 bp, Homo sapiens
agccaggaaattgtgtgggtgccctttttaaaacatcaagctgaatgaaatgatgatttgacacctggggcatatatatggttgaacacaagtggtt

SEQ ID NO: 6793688 - DNA, 62 bp, Homo sapiens
gcttgtctgctgagccacctgtttcatatccaagacacagtaagcatatttcagtagaaagt

SEQ ID NO: 6793689 - DNA, 67 bp, Homo sapiens
ttcctttttctaaacagtggtgttggtacttgaacaaaatcggcatttgttaagaaggaaaaaggaa

SEQ ID NO: 6793690 - DNA, 65 bp, Homo sapiens
tgcatgcacccagccgggtattcagcttggtgtggtcagtgtgcctgtgtgctgggctgcaagca

SEQ ID NO: 6793691 - DNA, 63 bp, Homo sapiens
ttatctttagttcagatgattaaatgaggtcttcctacaataagacatgtgaactaaaggtga

SEQ ID NO: 6793692 - DNA, 74 bp, Homo sapiens
ggaaatggctttgcatacaattttagaagagctgaaaccttaaagtcagcaaattagtggccaagcccaaatcc

SEQ ID NO: 6793693 - DNA, 59 bp, Homo sapiens
aggattcatggtgcagacaaagacaggcccaggcttcaagcttctgttcatgcatacct

SEQ ID NO: 6793694 - DNA, 65 bp, Homo sapiens
tagcatgggagttggtggcagagctgggtctagaaacccaagtcctgctgccactctacctgctg

SEQ ID NO: 6793695 - DNA, 68 bp, Homo sapiens
gcttttaccacagtttgataggaaagctatttctgctttttaccacttgtctaattcatggtgaaggc

SEQ ID NO: 6793696 - DNA, 92 bp, Homo sapiens
ggtgcccttgatcctcagtgagcctcatcaggtggggatgagtattcgctcttcttgcctgatgaggcagctgagccttcgacagggggacc

SEQ ID NO: 6793697 - DNA, 63 bp, Homo sapiens
tggcctcagaattgcctctgtgagcagctggtgtggctgcactttggaaaattttgagttcca

SEQ ID NO: 6793698 - DNA, 55 bp, Homo sapiens
gaaggcctctaccatagaaggcttgttagcggcctcttccatagaaggcctgttc

SEQ ID NO: 6793699 - DNA, 69 bp, Homo sapiens
gaatcaacatatgcatgggaaagtctccttttgaaatggctgattatccaagggatgtatgtggaattc

SEQ ID NO: 6793700 - DNA, 55 bp, Homo sapiens
gccccagctcaccggctcactgccccccagctgcgcttgagccggtagatggggt

SEQ ID NO: 6793701 - DNA, 57 bp, Homo sapiens
caatcaataggtgacttcatatgcagaagtgtcttttttgcaaatatctattgattg

SEQ ID NO: 6793702 - DNA, 83 bp, Homo sapiens
agagctatacaggatgcatttacagtaaggcacaacatctcaaagtgtggtctgcagacatgtgggtgtccctgtgaccttct

SEQ ID NO: 6793703 - DNA, 86 bp, Homo sapiens
tagctccttgatcctaggatggaagggagagcttatatagaagcttttacttggaaggttttgtatcctaaggtcagacatagcta

SEQ ID NO: 6793704 - DNA, 61 bp, Homo sapiens
aggctctataccgctgggagttggaacacaaaagatgtctttgctcccatgtctggagtct

SEQ ID NO: 6793705 - DNA, 79 bp, Homo sapiens
tttaaggaacaccgtttacaccactaccgcttattccgtagtttgttataactgtagttaatgtgtacggtaccttaag

SEQ ID NO: 6793706 - DNA, 57 bp, Homo sapiens
ttgcaaagtgttgagatatatgctagtcaaccagctatgttctttacatctgtgcaa

SEQ ID NO: 6793707 - DNA, 67 bp, Homo sapiens
gttctaccactaatttttccatgcagagctatagaagttaacagcatatgaaattactggcaagaac

SEQ ID NO: 6793708 - DNA, 65 bp, Homo sapiens
aggggtaaggccctctgagcactgatggaccacagacacggttacctcaggattgtctagcccct

SEQ ID NO: 6793709 - DNA, 121 bp, Homo sapiens
ggccgaccccacaatgctgggaaagccctcaggcagattctccaggggctgcagagggcctgcgcagtgcctcgagccatgagcctggggagtcaccagggcaccagcagaaaccacggct

SEQ ID NO: 6793710 - DNA, 73 bp, Homo sapiens
cctaagcgcttggcactgtgcctggcacatttactatttgtgaattggaagctagtgaccgagttaacaaagg

SEQ ID NO: 6793711 - DNA, 65 bp, Homo sapiens
cctgaggtttctcccccagtaccctgggtcacctcagcccagagctggcggtgagaagacaatgg

SEQ ID NO: 6793712 - DNA, 55 bp, Homo sapiens
gcagacgaacatttagccagtaatttgggagtggccgtgttagatgtttggctgt

SEQ ID NO: 6793713 - DNA, 67 bp, Homo sapiens
ttgagcccaggatgtcgaggctgcagtgagctgtgattgcaccactgtactccagcctgggcgacaa

SEQ ID NO: 6793714 - DNA, 89 bp, Homo sapiens
acacatctgtgctttcaccaacaatgaagctccactgagctttggcctagagtttttactggggtttcattatataggcataattgagt

SEQ ID NO: 6793715 - DNA, 129 bp, Homo sapiens
aagaaagaattgaggttggctaagtagacaaacaatgagcttacgtgggaacagactgtgttgtaaataaaggcattgcagtgttctagcgctgtgcttgttgtattgagcctgcaactttgagaactt

SEQ ID NO: 6793716 - DNA, 70 bp, Homo sapiens
gtggagttaatggtcctcatcttctgctgctattgcccttagaccaccaggaagtgtgggccaacgtcac

SEQ ID NO: 6793717 - DNA, 63 bp, Homo sapiens
gcccgctgatgcttttgcttgtcttcaaatcaactgccaggggacatgcgcaggccagtgggc

SEQ ID NO: 6793718 - DNA, 103 bp, Homo sapiens
ggattccagagatgtcttgatttttattaatgttggtttcaatggatgttccccaggtttgtaatgagattttaatattgagaaaatctctgtctttggctcc

SEQ ID NO: 6793719 - DNA, 90 bp, Homo sapiens
gatttcctgcttgttctaagaaatgtgaaaggtcctgctgttgcaatgattttatgacacgattcttccaggaaaagcgcatagtaaatc

SEQ ID NO: 6793720 - DNA, 69 bp, Homo sapiens
gaacaccatgaaatgttttgtaagcatgcatctgttgagtatttgctatacggagcatcttcaggtttc

SEQ ID NO: 6793721 - DNA, 129 bp, Homo sapiens
cacctacttagttatggatttgtagcgtttgagagtcacagaagcttagagataatctggtctaattccttcatttcagatataagaaagctattgtccagagctgccaatcaaaaccgagtaattagg

SEQ ID NO: 6793722 - DNA, 62 bp, Homo sapiens
aactaaggcccttgcagtcattgggcatcaccttgccttgttccttcatgtggtcattggtt

SEQ ID NO: 6793723 - DNA, 60 bp, Homo sapiens
actcactcagcccaaccctgcacaaggagaaaattcctggtaaagttcgggctggggagt

SEQ ID NO: 6793724 - DNA, 92 bp, Homo sapiens
ccttccagctaaatagacaattctagccaacattgagtcactcagtaagtctccagtgtgtgtgtttgctgagattgtctagcagttgaggg

SEQ ID NO: 6793725 - DNA, 56 bp, Homo sapiens
agctgtctctggtattatgtgatatttgcacagcaaactttaatgccaggacagtt

SEQ ID NO: 6793726 - DNA, 61 bp, Homo sapiens
ttaagagaattttctttagccattcttttaggacaggtctgctgaagacaaattctcttag

SEQ ID NO: 6793727 - DNA, 91 bp, Homo sapiens
tatgacctctattccagaacagggagatgggtgaaagcggaaacatttaggtcaccttcctcatccatttctcttggtttatcgggttata

SEQ ID NO: 6793728 - DNA, 70 bp, Homo sapiens
aggacaaagccctggaaagatgaagatggattctcagcccggctctgtcatcctcccagggctgtgacct

SEQ ID NO: 6793729 - DNA, 67 bp, Homo sapiens
tggtcagcagcgcatccagccatgtctttagaatcctctgaatggccagacagatggctgctctcca

SEQ ID NO: 6793730 - DNA, 65 bp, Homo sapiens
cgggtccagttctccctctatgtccaagccctatctgctggtggactggagaccaactggatctg

SEQ ID NO: 6793731 - DNA, 113 bp, Homo sapiens
ggccgctgctgcagcgctcagcgcccgggccctgctgaagccgggtctagcatgtgccgcggctccccggcggcggcggcggctcctctgcagcagcctcagcagcagcggcc

SEQ ID NO: 6793732 - DNA, 84 bp, Homo sapiens
gtgtgtaagcatatgtgtgtgtataaacaagagtctgtgtttgcctttagtacctacatgtttaatagacacaagtatacacac

SEQ ID NO: 6793733 - DNA, 58 bp, Homo sapiens
ggtgtcagttgctcatcagagttgttcttttattttatagatgatgcaactgagctcc

SEQ ID NO: 6793734 - DNA, 123 bp, Homo sapiens
aaagccatcacaggactagagctaggactaggacaggactagagcatttctaatgctttttagagcatctctaaaaagagaaatgctctagtcctgtccatacctgcgactgtgagaacattt

SEQ ID NO: 6793735 - DNA, 57 bp, Homo sapiens
gctatcccaccaaggtcccagtgcaaagatgtccctcccaggcgcctggtggggagc

SEQ ID NO: 6793736 - DNA, 63 bp, Homo sapiens
tatgtaacatacgtatgtatgtgcatgtgtacatttgcacatgtatatttctgtatgtgcata

SEQ ID NO: 6793737 - DNA, 60 bp, Homo sapiens
tcacagatgaggataggtttatatttaaaggacaaattctgaacaaagttcttatcgtga

SEQ ID NO: 6793738 - DNA, 83 bp, Homo sapiens
ctgcattcccccagtagggccccaaaatgccaggctctgtggaaagcagaccttgcctgctggggctggggctggggatgggg

SEQ ID NO: 6793739 - DNA, 76 bp, Homo sapiens
tcgctctgacacccaggctggcgtgcagtggtgtgatctcggctcactgcaaactccgcttcctgggttcaagtgg

SEQ ID NO: 6793740 - DNA, 58 bp, Homo sapiens
gatgctcttgattggaccaggggtaggtcccgacccaagctgggacaatgaaagcatc

SEQ ID NO: 6793741 - DNA, 93 bp, Homo sapiens
ggggctgggggctgggcaggccctgaggagctgagcggggagggctggaaaacaggactctcctccaacagccctgccgctgcctccaacccc

SEQ ID NO: 6793742 - DNA, 71 bp, Homo sapiens
ggttgaccgtgtgaggggtgatcaggccccgccatccgcagacgggggctggctttctctccgcacctgcc

SEQ ID NO: 6793743 - DNA, 56 bp, Homo sapiens
tccattgcagttaggcaagttaggtgtagccatgtaactgagcctaaggcagtaga

SEQ ID NO: 6793744 - DNA, 114 bp, Homo sapiens
gcataactgattttttttttaagaaggttgaatgactacttttaaaagtctcctaagagttgagaatggaaaatttccttggaccattttttaaaagaaaatctagaagaatgt

SEQ ID NO: 6793745 - DNA, 84 bp, Homo sapiens
cttgtcaaactctttaaaaattccctgttggcattgtggcatgattgataatgccaggagggagtttttaaagagtttgacaag

SEQ ID NO: 6793746 - DNA, 87 bp, Homo sapiens
gtttgatactcacagagagcttgcccttgtatattccatgtcaataaaccgaatatacaaagggcaacctcgctttaagtaccaaac

SEQ ID NO: 6793747 - DNA, 65 bp, Homo sapiens
ttgccctgtcagtagaagtgcaggtcctgctctagactgttctccttgctctgctgtcagggcag

SEQ ID NO: 6793748 - DNA, 60 bp, Homo sapiens
ctttgccatacagcaagacaaatctcagcaaacgtaaaggatgtaggatgtatggcagag

SEQ ID NO: 6793749 - DNA, 58 bp, Homo sapiens
tcaggcttccaacaatgatgttgaaggataaagagttatatctccagtgggagcctga

SEQ ID NO: 6793750 - DNA, 130 bp, Homo sapiens
tttagacatgttggaaaatagagtttgtttcttcaggtagacttgtatatgtactaatctcattggaaaactaatttcatgatagtatctattcaattagagttggtgagctctgttctatatttttaaa

SEQ ID NO: 6793751 - DNA, 86 bp, Homo sapiens
cttctgctcccctcccgcatgccattccgagtggccctgctgggggcagaggctcagattccgagtggccctgctgggggcagagg

SEQ ID NO: 6793752 - DNA, 96 bp, Homo sapiens
aataccaagatggtttcactgacgtctagcccagctcaaatgaccggttttcttaggcctcattgttgctggcgactgctggtgcctcttggtgtt

SEQ ID NO: 6793753 - DNA, 81 bp, Homo sapiens
gggattctctagaggagggatgtggttgttgggtgatgctctcagggcacagacatatccatatttacctcagtcgatctc

SEQ ID NO: 6793754 - DNA, 59 bp, Homo sapiens
gagttttaaagctggggaagagactcaaatcttcaagagctcttccaactttgagattc

SEQ ID NO: 6793755 - DNA, 61 bp, Homo sapiens
aactctgagacaggctttggtgatacatcaatgatcagagaaaaaatcctgctctcaagtt

SEQ ID NO: 6793756 - DNA, 67 bp, Homo sapiens
gcaatactgtatgagctatggtaggagcactaaggaagccttccaaagttattcaagcagtaagggc

SEQ ID NO: 6793757 - DNA, 59 bp, Homo sapiens
tttctccaaggcttgtgttattgcggcatcttggtctccagctgaagcccttggggaaa

SEQ ID NO: 6793758 - DNA, 57 bp, Homo sapiens
tctctctagatggtaaatattgcatgtaaactatgctgcttttgtatatcagagaga

SEQ ID NO: 6793759 - DNA, 85 bp, Homo sapiens
tctctggcctgatacatagtaggggctcagtaaatacttttatactgagctgacatcttcctctttttatgtggtagtcctaaga

SEQ ID NO: 6793760 - DNA, 88 bp, Homo sapiens
gcactccagtgccagcctcaatgtctatggtgcaaatgtaaaaatgaacaatttttcaccatagacactggtcctggcactggaatgc

SEQ ID NO: 6793761 - DNA, 56 bp, Homo sapiens
cagcacgttgaagtagagtaaggaggttacactccagatgcttttttaagctgttg

SEQ ID NO: 6793762 - DNA, 62 bp, Homo sapiens
gagcatgtgtcggtggcctcagggcagcagctgcctggtgaatgttcatggactggatgctc

SEQ ID NO: 6793763 - DNA, 61 bp, Homo sapiens
ctctgcatggacatacgtggcactatatgtagcccatgtgcctagtggtgggtatgcagag

SEQ ID NO: 6793764 - DNA, 72 bp, Homo sapiens
tttcttgcctgttcattttgaagtggaggaattttcattttcaagtttgaacaggaaattctactcaggaaa

SEQ ID NO: 6793765 - DNA, 92 bp, Homo sapiens
tcaaactataggttgatttgcttgctgtcaatccttggaataagaatatggataggctgagctaagagagcttatacaatggaatggtttga

SEQ ID NO: 6793766 - DNA, 83 bp, Homo sapiens
agaagactcccagcccatggagagggtctgacctgcacagccccagtgccgagaccctgcacctctcgtgggctgagtctttt

SEQ ID NO: 6793767 - DNA, 56 bp, Homo sapiens
tcttgtcttagagtgaaaactttaaaagtttaaaggaatcagttttagagataaga

SEQ ID NO: 6793768 - DNA, 69 bp, Homo sapiens
ggcggtcagggacaaagggctagccacaactacttctccctagttctgctcctcctatgttatggcccc

SEQ ID NO: 6793769 - DNA, 63 bp, Homo sapiens
gtatgaggcagagatgaccagctgatgattgagaagtatcagacagggagttctgtgtcctac

SEQ ID NO: 6793770 - DNA, 72 bp, Homo sapiens
agtaccatgcttcctgactggtctcttggggcccctttagtctcccagtctttgccatggaagcatggtgct

SEQ ID NO: 6793771 - DNA, 55 bp, Homo sapiens
agccaggtactcttgtgaccataggccctatctgtctcagggtatgtatctgcct

SEQ ID NO: 6793772 - DNA, 64 bp, Homo sapiens
gtgggtctaggaagatacctgagatactgcacttctaacacactttcaggattctagaccacac

SEQ ID NO: 6793773 - DNA, 74 bp, Homo sapiens
actccataacagctggcaccaaatatagtaaattgtgaaataatgagcttgtatattgctagcaattacagagt

SEQ ID NO: 6793774 - DNA, 121 bp, Homo sapiens
caggccttgctggatagacggtgcaggaagagaacatggaggctgagggcccatgagacaaacctcacctgatttacaactttgtctttgacaccgtctatagaatccagcacttggtctg

SEQ ID NO: 6793775 - DNA, 60 bp, Homo sapiens
ttcatgttgtgttgtggtttccaggaagacaaaatgcactttggaccacatcaacttgaa

SEQ ID NO: 6793776 - DNA, 100 bp, Homo sapiens
gtatgtttaagcacacttttaacttggcattgtcttctactgttctgttaatatctaggaggggagctgaactgctgaagttggagttggtttatactgc

SEQ ID NO: 6793777 - DNA, 77 bp, Homo sapiens
gctagggaagaagaacccattttgaattaaaatcccgtgcatattggtctcattttaaaatgtggtctctccctagt

SEQ ID NO: 6793778 - DNA, 70 bp, Homo sapiens
ctgtcatttagacattatgtattaagttcttggtctatgccaggaaccttgctagatgctgaggtgaaag

SEQ ID NO: 6793779 - DNA, 60 bp, Homo sapiens
atacatgtttgctggataaacagatgcaagcaaaacatctaggtttttgtgaacatgtgt

SEQ ID NO: 6793780 - DNA, 64 bp, Homo sapiens
gtgtggctagaattgggttcacaggaggcatttattaaaagcccatttgttccaaaagccacac

SEQ ID NO: 6793781 - DNA, 60 bp, Homo sapiens
gccttaattagtaacagaccattactgggttcctatcacgtggctgttgtaatgttaggc

SEQ ID NO: 6793782 - DNA, 102 bp, Homo sapiens
cctttatcttctgattatttccccagaaaggctgttaattttgtaggcactgcagagttccacgtacagcttttgtgtattacagaaagtctgagaagaagg

SEQ ID NO: 6793783 - DNA, 65 bp, Homo sapiens
ggaggagccacagcctggtaacagggtgacttctggagtctgggtgcaggctgtgcgctcctgcc

SEQ ID NO: 6793784 - DNA, 59 bp, Homo sapiens
tttggaataggaccttatttttgttcagtatattggacaaagtaattcctgcttccaaa

SEQ ID NO: 6793785 - DNA, 99 bp, Homo sapiens
acctcaccatttctttcttggttttgcttgaatacatttgtttcttgaaaatgaagaaaagattgttagggagaatgtggtgaaagtaagtggttaggt

SEQ ID NO: 6793786 - DNA, 112 bp, Homo sapiens
agagggtaccagtagaaaattttagcattatctgtcttatcattggtataattggatgctgacacgtggcattgacttaaggccgaaatgcatttttctattgttaccttct

SEQ ID NO: 6793787 - DNA, 105 bp, Homo sapiens
gttaagaaatctatgtcttggaataaagaagtcattgagttttaaacaggagaataacttggtcctgtttaaaatgatccctttgacattgcatggaaaattaat

SEQ ID NO: 6793788 - DNA, 59 bp, Homo sapiens
ccatgccgtcatcaaaacctgcctgctggatgagcagcgcaggcgtgtgaaggcgctgg

SEQ ID NO: 6793789 - DNA, 59 bp, Homo sapiens
aagtacagaaatagcaggtgcacattgttgaaggatgtagcaactgaggttttgtgctt

SEQ ID NO: 6793790 - DNA, 99 bp, Homo sapiens
ttgctgtttgatgcacttgctgtgaccactctaactttctgtgggaatgtccaaagaatgcatttcctagggtagatgtcacagctgtgtcaatagcaa

SEQ ID NO: 6793791 - DNA, 79 bp, Homo sapiens
cttcttcccccgagggttcccagtcttgcatagataaagagagtctgaggcagtgctgggaagcctgcagggcaggaag

SEQ ID NO: 6793792 - DNA, 86 bp, Homo sapiens
cccgtgctgagatccttatttggtcaagcttctacctatgccctggcctcggagcgagcccgatagcgctggatcacagcagaggg

SEQ ID NO: 6793793 - DNA, 65 bp, Homo sapiens
tttaaggattgtccatagtgttctgaaattgggagaaaatgaacattgtatatatgattcttgaa

SEQ ID NO: 6793794 - DNA, 68 bp, Homo sapiens
tgaacatctttaggaacctaacctattaataaacaaatgaattaacaggatcctagagaaagagttca

SEQ ID NO: 6793795 - DNA, 103 bp, Homo sapiens
ctccttgcctctccggtgtgtttcctgtgtcccgggcaccctgcagacctcctgttcctgccacgggcctggggcaggggcatcaccaggacaggcttgggag

SEQ ID NO: 6793796 - DNA, 72 bp, Homo sapiens
gggggctcctgctgggagccctgactagcctgggagggtcccaggaacttggcgggccccaaggaagcccct

SEQ ID NO: 6793797 - DNA, 55 bp, Homo sapiens
gggtgtgctcagagcagggggcccaaagaatggctcctctgtttacaacacaccc

SEQ ID NO: 6793798 - DNA, 93 bp, Homo sapiens
atgctttttgatgcttagagtagatttctctttaagatgatgtaatattagtcttctatgaagttcagagatctataccatagctcaaagcat

SEQ ID NO: 6793799 - DNA, 71 bp, Homo sapiens
cttctggctggggcacagtctgaatgtttctgaatccagcaaagaatgcagatttgcctcagggcttgaag

SEQ ID NO: 6793800 - DNA, 86 bp, Homo sapiens
agaggactcattaagcaggagaaatgtggctgctaccatggacaccatgggtgggagggctgcgttcctcttgcttccaatcttct

SEQ ID NO: 6793801 - DNA, 130 bp, Homo sapiens
gatatgtccggaattatgcagctattaaaagtgtaatacttttgaactgaaaggcatggctggaaaatgcaatgcttttgtttaaaggctatatacaaacttaatgtcttcccccaaagtctggaaatac

SEQ ID NO: 6793802 - DNA, 74 bp, Homo sapiens
gtgtgtgtgtgtgtgtgtgtgtgtgcttaaaataaaatccaatggtaaagcatatttgcattaaaatattacgc

SEQ ID NO: 6793803 - DNA, 83 bp, Homo sapiens
ctttccttccttcttcccattagtaatgaagtgtctcccttatgttacttcatacctgctagaatgggaagcttgaaggttag

SEQ ID NO: 6793804 - DNA, 57 bp, Homo sapiens
ttcagtgcagacgccgaagcccagcatgctgaggtcatacaggtatctggtactgaa

SEQ ID NO: 6793805 - DNA, 59 bp, Homo sapiens
gtgcccttataaaggaggcctgagggagctttcttaccctttccattttgtgagggcac

SEQ ID NO: 6793806 - DNA, 93 bp, Homo sapiens
gaatgtctgagtttccacagaatttaaagctctagactgatctattttagtttccaggcaggagctaattcttatggctactatagggctttc

SEQ ID NO: 6793807 - DNA, 63 bp, Homo sapiens
gagtatgctaggcaattctaaggattgcctttgaaacagtctttattcagccaagtacttctc

SEQ ID NO: 6793808 - DNA, 103 bp, Homo sapiens
ctatatatacatgacagaactggaactggtagtgttggtatgtgtctgacaccaaaatcactacacattctagtataccactctgttaaaaaagtgtatttgg

SEQ ID NO: 6793809 - DNA, 105 bp, Homo sapiens
tagttgaagacttctctttgctataactacttgaagagttcagcagaaaaattttactgaagaatccctgatcctcctttaagtagctgtagagaatattcacta

SEQ ID NO: 6793810 - DNA, 66 bp, Homo sapiens
atgcagcctatgcatatgtgttcattggagtgtgcacacttgtgtacatatatgcatgtgtaccat

SEQ ID NO: 6793811 - DNA, 86 bp, Homo sapiens
aggcatttagtccctggattctcactggactccagtgagattttttctcattttgctgagtcactgggtaatctggattgatgcct

SEQ ID NO: 6793812 - DNA, 62 bp, Homo sapiens
gagggtgcatgtgagattcctagcttagagtcctggcttaatggagctctgcatttatcttc

SEQ ID NO: 6793813 - DNA, 100 bp, Homo sapiens
gttctgttgtaggaggtcctggaaccacaccttgataaatgtggctttgaagaatatgaagaagtgtggtttaggcatcttttatgttaaggaacagaac

SEQ ID NO: 6793814 - DNA, 86 bp, Homo sapiens
gcctttctacccatctgctgttcttcacagcttgtctctgggctcagccccaagcctggaggggcagtaaatggattcagagttgc

SEQ ID NO: 6793815 - DNA, 76 bp, Homo sapiens
gcaaagcatctgcacccttggtcagctctgcagtggatttcttctgcagggcagatatgactgtaggggatgttgc

SEQ ID NO: 6793816 - DNA, 94 bp, Homo sapiens
ttgcatctctgagtcctttatagaatccagttgttgtattttaagcagaatactggttggaaattactgtagaggcatactagccagaatgtag

SEQ ID NO: 6793817 - DNA, 112 bp, Homo sapiens
ctactgggtaggaatcaagctgtatgatttggttgcaggaagtaattgcctgaaaagcagttatgtcctcagcaaatcaagagcccttgaacatttcccaatgctccagaag

SEQ ID NO: 6793818 - DNA, 83 bp, Homo sapiens
gaggctgctcactgtcatctggtagatgatgggatggaaagaacacgtctgatttgaaagccaggctgatatgccagtgcctc

SEQ ID NO: 6793819 - DNA, 60 bp, Homo sapiens
tctgtgtgattgaaacttagggtacagtgtagtccctattagtgaccacatcatatgaga

SEQ ID NO: 6793820 - DNA, 65 bp, Homo sapiens
gataatctatgttggtccatattatggtatttttataccatggaacacacacagcattagatttc

SEQ ID NO: 6793821 - DNA, 61 bp, Homo sapiens
gaatcatgacaggaatagaagggcatgcgaaatttctccagcttttctacctttcagattt

SEQ ID NO: 6793822 - DNA, 55 bp, Homo sapiens
gactttagagaaatgtagaagtaccccactgggtatgagtaagttctccagagtc

SEQ ID NO: 6793823 - DNA, 57 bp, Homo sapiens
gcttgtcttgcctgctcatcctcattgcctggaaatgaatgaataaggcaggaaagc

SEQ ID NO: 6793824 - DNA, 56 bp, Homo sapiens
acagccccagccacggcctccccaccatggagcgagaggagccgcctgggtcctgt

SEQ ID NO: 6793825 - DNA, 82 bp, Homo sapiens
gagaaaaggtttggacagagcatccagttattcaacttttatgtgggctactctggtaactggattctgtctcacttgtctc

SEQ ID NO: 6793826 - DNA, 84 bp, Homo sapiens
tcatgagtttgtaaaagttcattgatgactgaggtgaagcattgtcattcttgtcactaatgaattatcttaaataaattgtga

SEQ ID NO: 6793827 - DNA, 82 bp, Homo sapiens
gtgattttagtacagtgaaacttgtgtaggaattctaggctacagaactgcaaaataatcaagttgtattgttttaagacac

SEQ ID NO: 6793828 - DNA, 64 bp, Homo sapiens
tccatttctagcctctgaagtaggaggtggcttctccatgaggaaccaggggctggagatagga

SEQ ID NO: 6793829 - DNA, 57 bp, Homo sapiens
gcagcaagcactgcagcagaccaaactatgatggtcctgtgaagccatgtttgttgt

SEQ ID NO: 6793830 - DNA, 109 bp, Homo sapiens
gatccatgattaaccccctcgctaattggccaccagccccttgactttgctgcaggccttctcaggagctgggagcaagaggctgcaaattggccaagcaggatgggtc

SEQ ID NO: 6793831 - DNA, 111 bp, Homo sapiens
tgagatgaatacatgctttataatggtaatttcacatataggggaagctacaacagcagtatatcatggcagcttcttaatatggagaccaaggcctaactattcatctta

SEQ ID NO: 6793832 - DNA, 61 bp, Homo sapiens
ggagcccgggagtttgggggatgctctgggaatggggcatccagagggatgcctggggtct

SEQ ID NO: 6793833 - DNA, 68 bp, Homo sapiens
cagttggaaaggagggtgctattggcatctgctgggtagaggccagggacactgctcaacatcctctg

SEQ ID NO: 6793834 - DNA, 71 bp, Homo sapiens
gtatcataggaatgaggacaattagcttcaggtggctaatatctgctgagtcctccttatgtcctatatac

SEQ ID NO: 6793835 - DNA, 86 bp, Homo sapiens
aatacgaattatgaaactgggctttttgaaacagtaccaagagcaagatgcttcttttcagaaagcatcatcaaagtttgcatatt

SEQ ID NO: 6793836 - DNA, 60 bp, Homo sapiens
ggcagtgtgtggacagtggtggctggtgcctgatgctgccatgctgttcttcgcactggc

SEQ ID NO: 6793837 - DNA, 60 bp, Homo sapiens
actctgggcaggagaggtggttggaattgggaaaactaatctggcagcagtttgttgagt

SEQ ID NO: 6793838 - DNA, 71 bp, Homo sapiens
tattgctactttgccttccaaagtcttgccttctacagctacataactccaggaaatcagaagtggtaatg

SEQ ID NO: 6793839 - DNA, 64 bp, Homo sapiens
aagggcaggaaaagatggatgtcccagctcaagcagggagtgaatctgcctttcctcagccttt

SEQ ID NO: 6793840 - DNA, 67 bp, Homo sapiens
ggctggaagctcaggccctggaactggacaagtcacggttccttcctgccttagccactttcagacc

SEQ ID NO: 6793841 - DNA, 86 bp, Homo sapiens
gtgctaggaggcatttaacaagttagattgttagtataatacattttaattgtcagtgggatttgtcaacatgtctcctgctgtac

SEQ ID NO: 6793842 - DNA, 78 bp, Homo sapiens
atagggagtaactgggagacaagagagggctgacaggatggaactgtcgctgtcaccagtttcctttttgctctctgt

SEQ ID NO: 6793843 - DNA, 59 bp, Homo sapiens
gcagtggagagccacatcgattcacctgtgttcttgatcttacagtgttcttccactgc

SEQ ID NO: 6793844 - DNA, 72 bp, Homo sapiens
gcagggaaggaagggaagctaggaactcaggtggggaagcaagagacctgagtcaccctgtctgtcccctgc

SEQ ID NO: 6793845 - DNA, 71 bp, Homo sapiens
tgtagcacctagagtattttatcactgctcaaggaaacatttgacttgttgtgcggtgctttgggtttaca

SEQ ID NO: 6793846 - DNA, 70 bp, Homo sapiens
agagtgcagttggggtgaggggatctaagaggctggttctcctccgcctctcttccacctctgcacctct

SEQ ID NO: 6793847 - DNA, 66 bp, Homo sapiens
ggctccccgccctgccaggttccagcccctgctcacctggccggctgtggccagcggggctgagcc

SEQ ID NO: 6793848 - DNA, 59 bp, Homo sapiens
tgaaaagactgcaagagagcatttcagcacaataggattgcctcttgttctctctttca

SEQ ID NO: 6793849 - DNA, 68 bp, Homo sapiens
gagctttggtatctgagagtgctgagttggaaacctagctatgtctctttactcttagaaccctgttt

SEQ ID NO: 6793850 - DNA, 69 bp, Homo sapiens
ggggaagaactgtgacagaagcagtttcacagcctatatgtgtacttcttttgcttagggtttgttccc

SEQ ID NO: 6793851 - DNA, 70 bp, Homo sapiens
aagtctttgctattgtgagtagtgccacaataaacatacgtgtgcatgtgtctttatagcagcatgattt

SEQ ID NO: 6793852 - DNA, 87 bp, Homo sapiens
tttgagccagggaagtcaagcctgtagtgaattgtgattgtgccactgcactccaatctgggcaacagagcaagaccctgtctcgaa

SEQ ID NO: 6793853 - DNA, 61 bp, Homo sapiens
cacatataccagccgcggtacgtgaattctccacagccttcagagcagctgggagtgtgtg

SEQ ID NO: 6793854 - DNA, 66 bp, Homo sapiens
tgtttgtgtgggggaaacaaggtacaggttagtaacatcttgtactttggtttttgccaacaaata

SEQ ID NO: 6793855 - DNA, 65 bp, Homo sapiens
gcaatcaatgatttatatttgtaaagtgggtagaaacagtcctagaacaataactcattgattgc

SEQ ID NO: 6793856 - DNA, 81 bp, Homo sapiens
tcaggtctttgtcccaggccaggaatttttgaacgacaggatcccctgtgaaaagagagcctgtgtcagggtgagaagtgg

SEQ ID NO: 6793857 - DNA, 58 bp, Homo sapiens
cctgctgagaccctgaggtgggcctagaacctcttccgtctcacaggtctcagcgagg

SEQ ID NO: 6793858 - DNA, 80 bp, Homo sapiens
aggtagagagccaagcaaaatggaccctgggctgaaaatggagattctgtaaggcacctgtccaggctgggcttctgcct

SEQ ID NO: 6793859 - DNA, 130 bp, Homo sapiens
taaaatagaaatattcaacttgtgtcaatgagaggtaacctttgccatgggcttgataggtgcctactataggcttctcaatacctatcagccctgtggtttagtttcaatattttgaattcctatttta

SEQ ID NO: 6793860 - DNA, 55 bp, Homo sapiens
taattgttcagcaggtaacatcttttctcaaggtgttactaaagatgaacattta

SEQ ID NO: 6793861 - DNA, 67 bp, Homo sapiens
gccctttgtatgtgccttttgcggaagtagactgtatttcttcaattttccatatactgcaaatggc

SEQ ID NO: 6793862 - DNA, 65 bp, Homo sapiens
ctgtacatcccaagatatttctacttcaaaatagaacagaatatcatctctttggggtggttcag

SEQ ID NO: 6793863 - DNA, 57 bp, Homo sapiens
tggcagtgggcatattttctgttacgaccttgcttttagcagaaacagttcaggcca

SEQ ID NO: 6793864 - DNA, 72 bp, Homo sapiens
acattatccctggcacaactgcctcttagctagatcttgaaagtgcctggggcaatgaccagaggagaatgt

SEQ ID NO: 6793865 - DNA, 64 bp, Homo sapiens
tgggtggagagcatcccaatgataagcattatttgtttggatcaaatttcatgctgtcctccca

SEQ ID NO: 6793866 - DNA, 67 bp, Homo sapiens
gggtgaggctccctccatgaggcagaccggcgcgcagcctgtgaggcgggtggagtggagcacgccc

SEQ ID NO: 6793867 - DNA, 58 bp, Homo sapiens
gtgtaacttttattcatgctctgggttctccagcagcttgttaaaaagttccagacac

SEQ ID NO: 6793868 - DNA, 57 bp, Homo sapiens
aggcttctagggttggcagcggcaggttttcattagcacgtccaggcctgaagggct

SEQ ID NO: 6793869 - DNA, 63 bp, Homo sapiens
ggagtaaatgtgtgtttgtgtgtgtgggtctgtgtgtgtataaacactgatggatatttttcc

SEQ ID NO: 6793870 - DNA, 80 bp, Homo sapiens
gaatgagtagagtataaacaaagttctcccaatacagtaagagatgggcttaaaatttgtttgtgtttctttattagttc

SEQ ID NO: 6793871 - DNA, 70 bp, Homo sapiens
gaagcttggctgtgttcaagggcggctggctactgtcagtctcacctcccttaacacttttgttaaattc

SEQ ID NO: 6793872 - DNA, 62 bp, Homo sapiens
ccctgcataattagagcagctctttgctgaggaagcagagggcagagtctaatgatgcatgg

SEQ ID NO: 6793873 - DNA, 108 bp, Homo sapiens
tcaagaggggcttggagatgtagatgtttgggtattgcttcaggatatagctctattatttttgtttgtttgttttagccagagatccatccctaggacctttcttga

SEQ ID NO: 6793874 - DNA, 58 bp, Homo sapiens
ctagtgaccttggaaaattttttacctcagataatttaaaatcaccttaggtcactgg

SEQ ID NO: 6793875 - DNA, 108 bp, Homo sapiens
gttcgtgtggctgtggtggctaacaagttcaaactctataagaacttgccaataggctgaaagttcacataagagttgatgtagtcttgagtcccagattcacagagc

SEQ ID NO: 6793876 - DNA, 82 bp, Homo sapiens
ggttgtccaaggccgcagctggtcggagggcagagctgggatttgtctctaagcctcagaccacgctgcctgcctgtcagcc

SEQ ID NO: 6793877 - DNA, 55 bp, Homo sapiens
gggctcctgtttgagaaaaagccccaagaatggttcatttccaagaagagagctc

SEQ ID NO: 6793878 - DNA, 59 bp, Homo sapiens
ggccggcttactgggtagggtgttcctgcagcttgtgcagctctctccagtggctggct

SEQ ID NO: 6793879 - DNA, 70 bp, Homo sapiens
ggaacatgggacaatttgaacacagtgctcaggatagtttctgtgtagctcagatatgtccagccattcc

SEQ ID NO: 6793880 - DNA, 74 bp, Homo sapiens
gctctgaggaggtcgaagcaccttgtatgtcatgtgaaaaatatttccaagcaaagtgctttgcctccagctgc

SEQ ID NO: 6793881 - DNA, 57 bp, Homo sapiens
cattttgatttttggtctgttacatagcccatgggggctacagacaaaatggaaatg

SEQ ID NO: 6793882 - DNA, 89 bp, Homo sapiens
gtcacactgtggagagccttaaaggccacttgaaggatttttcatgttattttgtgagataaagatggtttttaggggttctgagtgac

SEQ ID NO: 6793883 - DNA, 71 bp, Homo sapiens
tggtcagtaggcagtttgaggacagggacagtgtctccatcttggtatcctcagtgctagccaactgccca

SEQ ID NO: 6793884 - DNA, 63 bp, Homo sapiens
gctcctcctgttctcatgcccctaagcacacataagcatgcttgtgcatggagaaggcagggc

SEQ ID NO: 6793885 - DNA, 81 bp, Homo sapiens
gattctccatgttctctctccttttgaagtgaccctagaagtcatatgttaaggatggcagagctgaaagatggaagaatc

SEQ ID NO: 6793886 - DNA, 70 bp, Homo sapiens
tgattctcatccagtaccatggaaggcacctcaggaaacctcctgcccgcatggtggtggtgacttatca

SEQ ID NO: 6793887 - DNA, 60 bp, Homo sapiens
tcgctttgatgctggagaactaatcacccagagagaactggtctccaggcaggtgagcga

SEQ ID NO: 6793888 - DNA, 57 bp, Homo sapiens
acatcgtgtatcactgaaccttagccaagtgtggtgggattggctgatgtcggatgt

SEQ ID NO: 6793889 - DNA, 87 bp, Homo sapiens
ctcaccttgctgagatttctcttgactaccagttaggaaccgttaggtttcaaggtcaactatgggattccattagcacttggtgag

SEQ ID NO: 6793890 - DNA, 63 bp, Homo sapiens
atgtgtgaattccaccaagtgtggtttaaaatggccccagatacactgagtgaattagcacat

SEQ ID NO: 6793891 - DNA, 70 bp, Homo sapiens
ttttataaattcactctgttcctcatggtgaatttataaattcctcatggagcagggtgaatttataaaa

SEQ ID NO: 6793892 - DNA, 57 bp, Homo sapiens
agatgaagcctgtacttagtctttgaacccaaggcaaagcaggtatagtttttattt

SEQ ID NO: 6793893 - DNA, 84 bp, Homo sapiens
cgcatgcatactcgtacaggtccacggcgcccaggggtgagggcacctcgaagaagggcctctgggccagcggggactgcagcg

SEQ ID NO: 6793894 - DNA, 76 bp, Homo sapiens
accagtctatactcagtattaattctaccctgcagtgtatgctatagaaggtaatgaaatgctgatgttttctggt

SEQ ID NO: 6793895 - DNA, 87 bp, Homo sapiens
tgaggtttggagtttttgttacagcagcatagcctaacccaacctggttaatacactgctttttgtaactatacaagctctaactca

SEQ ID NO: 6793896 - DNA, 118 bp, Homo sapiens
ggagagggaatggggcgggctcccctggccaaggttcattcatagcaggttttggacccctgcagaccagagggctgggatgtgctgtgtgactgagggtaagtccctctacctctct

SEQ ID NO: 6793897 - DNA, 66 bp, Homo sapiens
cagccagttgagaaactaacggcttgagccatatgccaatgcttcttagtctttcagggctggctg

SEQ ID NO: 6793898 - DNA, 73 bp, Homo sapiens
caggtccagcatgactagttccccatgtcctaggtctcccactgccaagatggccacttgtcctgctgcactg

SEQ ID NO: 6793899 - DNA, 64 bp, Homo sapiens
catttgaggaggagggtatatttgaacctgtgaaacacaacagagggatcatcttcctgaagtg

SEQ ID NO: 6793900 - DNA, 61 bp, Homo sapiens
gctgtggctgctggtactctgggaaccggctgctggtactctgagaaccggtagtctaggc

SEQ ID NO: 6793901 - DNA, 94 bp, Homo sapiens
aggtggtgtgtgcgcctgtagtcccagctatttctgaggcaggaagatcacttgagcccaggagtttgagttcagcatgggcaacatgagacct

SEQ ID NO: 6793902 - DNA, 128 bp, Homo sapiens
ctgactatggcggccctaaaaacaaacatacacccagggggttagatgcctagattaattttagtaacttaagaaaagtgatttgaagaaagtagtttagacttcaaccctttgatgtccacagttag

SEQ ID NO: 6793903 - DNA, 90 bp, Homo sapiens
gctgagaagatatgctgttgagtatctttgttattggaataattgttttttggtatacaaatatttagcacaaaaaatattttctctagc

SEQ ID NO: 6793904 - DNA, 62 bp, Homo sapiens
ccagacatcttggttgcagcttgttcagaccctgagcagagaatccagctaagtgtgcctgg

SEQ ID NO: 6793905 - DNA, 77 bp, Homo sapiens
gtgacgggaccactgcatgtgggaggcacacgggccctgtggcatccacagctgtggtctccttagtgtcctgtcac

SEQ ID NO: 6793906 - DNA, 71 bp, Homo sapiens
ttgtagggcctcagctggagtctgccttttttgatgaaagcagggcgtgcttggttgaatggccccagcaa

SEQ ID NO: 6793907 - DNA, 58 bp, Homo sapiens
tagaaagtagggaaggtaggattttaacctagggtggtcttactttttttccttttta

SEQ ID NO: 6793908 - DNA, 119 bp, Homo sapiens
tcaccccaaaggcaaatcgcaggacagcaaattatcttccaagacttggccagcagggtaatctctctgaaagctcatgctgtagttttgcttattggtttagctgcttggctgggtga

SEQ ID NO: 6793909 - DNA, 99 bp, Homo sapiens
gaggtgtcagttgtttgcctgccgacgctctcatgtgaactaagagaatggaaccggacattcgtgaagtgctcagtaagcaaacaaaacgaagacttc

SEQ ID NO: 6793910 - DNA, 72 bp, Homo sapiens
gcctaatggaaatagtgtttagtaatcagagctgcttgcctgatcattgttgttgctgtaattttccgaggt

SEQ ID NO: 6793911 - DNA, 60 bp, Homo sapiens
agggactatcattcaatctcttccctgcaaagggtaaggccagccctaatgatgctctct

SEQ ID NO: 6793912 - DNA, 83 bp, Homo sapiens
atattaagctggtgcaatagtaattgcagtttgccattactttaatggcaaagaccgcaattacttttgcaccaacctaatat

SEQ ID NO: 6793913 - DNA, 76 bp, Homo sapiens
gccatgaaaggaagccacttctgggcgcggtatttaaagatatgttagacagcttctagaaatggtcaccacaggc

SEQ ID NO: 6793914 - DNA, 70 bp, Homo sapiens
ttccttccttatccctacttcacctgattggctaggtttcttatcaggtgggaccatgatagggcaggga

SEQ ID NO: 6793915 - DNA, 73 bp, Homo sapiens
aaggtctctaagagccatcacagactttgacttgccttcttgtctttctgtgatcttgcatttatatgatctt

SEQ ID NO: 6793916 - DNA, 63 bp, Homo sapiens
ggagggcaggggcctccctcttcactgcggcgcctcccctgccagctgcaggctcctgtccct

SEQ ID NO: 6793917 - DNA, 76 bp, Homo sapiens
actgaatcagctttgctactctggaacaggctgcaacagaatttgtgcaggactcaagggtagcaggtgatgcagt

SEQ ID NO: 6793918 - DNA, 115 bp, Homo sapiens
tctgcatgattctaggcaggaaaattgggttagaacggtaacatacccactgtgtacatagataggtagagaccctaattttcggcagatccatgccttaaaggatcacagcaga

SEQ ID NO: 6793919 - DNA, 66 bp, Homo sapiens
ttgtgtgaattgttaagggtgttgacagttaaaaagctgtctgactgaaccaattatttacaacaa

SEQ ID NO: 6793920 - DNA, 62 bp, Homo sapiens
tagttttctgtcccagtgatcctgagtgctccccagatgtcatcacaggactgggagaactg

SEQ ID NO: 6793921 - DNA, 67 bp, Homo sapiens
gatggggtgataaaagtttggatgtgctgtctcctcagggagagtgtattgctttcatcattttctc

SEQ ID NO: 6793922 - DNA, 56 bp, Homo sapiens
taaatgcagttagtacttgccactacacccttttggcaagtgttattgtgcattta

SEQ ID NO: 6793923 - DNA, 85 bp, Homo sapiens
gcaaacagcggggagtgtggtgaacaggagcaccctaggttcctctaaagggtgtggcttcgaccacacttcaaacctagtttgc

SEQ ID NO: 6793924 - DNA, 68 bp, Homo sapiens
gatgggcataggaagaaaccttgacccttttgaaactgaactgtaaagcatcttttcctagctccatc

SEQ ID NO: 6793925 - DNA, 56 bp, Homo sapiens
cctcaggcttctagttcagtgaggcttccattatgccaaactgactgtgcttaagg

SEQ ID NO: 6793926 - DNA, 89 bp, Homo sapiens
cacacctccttttttaaggtagctcctcctcagctgccctccagtgctctgtgggaggagggaccctagcagagaggaaaccaggtgtg

SEQ ID NO: 6793927 - DNA, 86 bp, Homo sapiens
gcagtaacaatgtccagggccagagcttggcagctgggggccaccagcggcctgccctgccctctggtctcccacatgtaggctgt

SEQ ID NO: 6793928 - DNA, 105 bp, Homo sapiens
gagtctaagccagtgattcttggttacttagaagccattctaaaactggaaataattccagtggacaatttctgaggaaataagtgaatgactggtgttatactt

SEQ ID NO: 6793929 - DNA, 60 bp, Homo sapiens
tgtgtgggtggttgatgctagctgtcagctggaacctcagctggccagaacgcctacaca

SEQ ID NO: 6793930 - DNA, 66 bp, Homo sapiens
gctcctccctgggaagggtctcagcagtggcttgcagacgtctgctgtgggtccccaggagggagc

SEQ ID NO: 6793931 - DNA, 66 bp, Homo sapiens
aggactttagagccagaaagacgtgagtttgaatcccctttctatcacttctttgctgcaagtcct

SEQ ID NO: 6793932 - DNA, 58 bp, Homo sapiens
tgagatggagtctcgctctgttgcccaggctggcgtgaaatggcgtgatttcggctca

SEQ ID NO: 6793933 - DNA, 125 bp, Homo sapiens
tgagtttcttgaaaataaatctgcatggcttcctaaattgctgaccaagtatattccagatggaagtcatttatcagcaatttactgagcaatgcttcagccagaagtatttccacataaattca

SEQ ID NO: 6793934 - DNA, 103 bp, Homo sapiens
ttgaaatcagaatgctgggtcgcttctcattcaagcaaaacagatggccctccttgccacacttctgtcaaacttgaggggaaatgattaaaagcattttcaa

SEQ ID NO: 6793935 - DNA, 93 bp, Homo sapiens
tgtctccaaagcctgttccatcagtttttggttgaagccctacagatctcctaatttggtcaatgaagtgctgataacattgttatgtggaca

SEQ ID NO: 6793936 - DNA, 72 bp, Homo sapiens
gctgggcttgttcttagcatgcaaaatatgctggtctttgaccttatattggcctgtgttcagaatctcagc

SEQ ID NO: 6793937 - DNA, 129 bp, Homo sapiens
aggtactcttaccgtacaagatgctcaaatataaaacttcatgtaatttaaaacagttgcagaggagctgctcctgttttggtgcaaggagcctgtatttaggatctgtgcattaggtgatggtattat

SEQ ID NO: 6793938 - DNA, 89 bp, Homo sapiens
attcctctgttttattgtgctttgtagtcaaactgatacattattcagctgtctgaatatgtattattgtctacaaagtggacaggagt

SEQ ID NO: 6793939 - DNA, 67 bp, Homo sapiens
gagaacaaggaagagtcggcagtagtaccctggaaatgctaaatgaaacactcttccttatgttctt

SEQ ID NO: 6793940 - DNA, 67 bp, Homo sapiens
catagagcacaccagtttcttaagaatatttcacaagtgggctatgacagagataactggtgctatg

SEQ ID NO: 6793941 - DNA, 76 bp, Homo sapiens
tcgcttgaacccccgaggcagagtttgcagtgagccaagatcgtgccactgcactccagcctgggcgacagagtga

SEQ ID NO: 6793942 - DNA, 61 bp, Homo sapiens
tagtttactgttcactttgccccctagacactaggcatagacaacatgagcaagtgaactg

SEQ ID NO: 6793943 - DNA, 69 bp, Homo sapiens
gtctgcctccttgtttctgtcctgtgggaattttgcttgttacacagcagaatagcaagaaaaacaggc

SEQ ID NO: 6793944 - DNA, 61 bp, Homo sapiens
ccagatgtttcagtaatttatcttgcaaccaagaagcaggaggaattaatcatgaagcagg

SEQ ID NO: 6793945 - DNA, 58 bp, Homo sapiens
cacaggagctctggtctgtcttattcttatactgagtcctgttcctagagtttctgtg

SEQ ID NO: 6793946 - DNA, 130 bp, Homo sapiens
aaagataacagtatgcacctttttttgtgtgtgtgggttttagtgtggaccgggacctttgctacacactttactctcattatcttactagaacctcacaacaatcctatgatgtacctgttgatttttt

SEQ ID NO: 6793947 - DNA, 63 bp, Homo sapiens
agtggttgggttcactgtggaacttgagatggtgactagagtctagagtgggaccgagtctct

SEQ ID NO: 6793948 - DNA, 59 bp, Homo sapiens
ctaaacatgaactacatttagggtattgtattatggagtccctaaggtattcattttgg

SEQ ID NO: 6793949 - DNA, 130 bp, Homo sapiens
gctctcatagaacagatatcagaatgttacgtccatattcctgagggctcagtgatgactacttttcctgagattccctgaatgatatatacagacgcaataatttctgatgattcattaaaattacagc

SEQ ID NO: 6793950 - DNA, 90 bp, Homo sapiens
gagttggaacctaaaggcagacacaaaaacataaggtatgattcatgcccatcaaatctatgaattgtttctgaaattaggttttcattt

SEQ ID NO: 6793951 - DNA, 67 bp, Homo sapiens
ttactgtggctttgcagggcttgttatttgggaccacacccacagcttccaaccaaggccaaagtaa

SEQ ID NO: 6793952 - DNA, 68 bp, Homo sapiens
tcttgccaaatctcatattgacatgtaatctaaattaatgtcaaggtgatagatttgtagttgtaaga

SEQ ID NO: 6793953 - DNA, 56 bp, Homo sapiens
gcctggggggcatgtcataatagggaccctctgctttgcttgtcatgcactcaggc

SEQ ID NO: 6793954 - DNA, 55 bp, Homo sapiens
gttcaaggagcagcttgctacagtttccgtttctgctggtgcgctgttcctgagc

SEQ ID NO: 6793955 - DNA, 55 bp, Homo sapiens
acgtccgcaggagagcacgtgcacaccacggggagcgtgtgcctctgcaggacgt

SEQ ID NO: 6793956 - DNA, 55 bp, Homo sapiens
tgggtttgattctcagccaagggacaccaggactggtagagactgtcaggccaca

SEQ ID NO: 6793957 - DNA, 85 bp, Homo sapiens
cgcttttgcgtgggcagctgcagggatggtgactcgggctagctcagatgtggctgccgttagtccccagctgcgcgctcccccg

SEQ ID NO: 6793958 - DNA, 78 bp, Homo sapiens
ttttatttcattttttagccaagactctgcacacaataggtgatcaataaatgctgagtgattgaaaggtgaatgaaa

SEQ ID NO: 6793959 - DNA, 71 bp, Homo sapiens
tggtgtgaggactaaatgagtaccatctgtaaatccttagagcagcaggtgcaaagtgctagcccacacca

SEQ ID NO: 6793960 - DNA, 70 bp, Homo sapiens
ggtctgtgcagttactagctggtagaaatgaaaacaaagattgtgattagctgttagtagtgtatatgcc

SEQ ID NO: 6793961 - DNA, 62 bp, Homo sapiens
ctctgagctgccactaagatggttcaagtcttcctgaccctactttagtatgagctccaggg

SEQ ID NO: 6793962 - DNA, 56 bp, Homo sapiens
catgcggattttgatgtctctgtaatcccacagagacaaatgttagtagtttgttg

SEQ ID NO: 6793963 - DNA, 63 bp, Homo sapiens
gtggctctgtgtgtgtgtgtgtgtgtgtgtgtgtgtgtcacattttacatgccagagagttac

SEQ ID NO: 6793964 - DNA, 55 bp, Homo sapiens
tttctgttgtacttaaactaggtatgtaacaatgcttagtgacctataagagaaa

SEQ ID NO: 6793965 - DNA, 66 bp, Homo sapiens
agatttgccgactgctttgcctcactctgaaatccttaggcagtgcatgcaaaggtcggtgaattt

SEQ ID NO: 6793966 - DNA, 81 bp, Homo sapiens
accgggagacgaggcacaggcctggtgctgctgacaggtgtcagcttcagctgcattaggatctgagtctatgattctggt

SEQ ID NO: 6793967 - DNA, 76 bp, Homo sapiens
ccaggaggatggtgggagtggaacgtggaagaggggctcacttcctctaaactgcgagcatgcccccttctcctgg

SEQ ID NO: 6793968 - DNA, 55 bp, Homo sapiens
ctgtagcctgggtctgtgactctgacactcagcagaagcaacattcaggctttag

SEQ ID NO: 6793969 - DNA, 59 bp, Homo sapiens
gagaaggatgtggctcatagctgagggattcagccacatgctcagtcacatcctgactc

SEQ ID NO: 6793970 - DNA, 73 bp, Homo sapiens
aggcagcttctagaagctgaaaagggggaaggaaacagcttcttccctgaagcctctggaagggagttagcct

SEQ ID NO: 6793971 - DNA, 63 bp, Homo sapiens
gaggaacttgggttttggattggtaaagataattgaaatgctgactgcaaaacttgattcttc

SEQ ID NO: 6793972 - DNA, 109 bp, Homo sapiens
aattttctctgttgccttgtagtgattatgtgtgtaaacttttcatgtcagatggatatgtagtcaacacctggttctattacagactagcagttaaatagagaaagtt

SEQ ID NO: 6793973 - DNA, 81 bp, Homo sapiens
gtgttttgctctgttgtgcatgtgggatacaggataaggattatagtacctgcaattccatagaaattacagaagaaagac

SEQ ID NO: 6793974 - DNA, 62 bp, Homo sapiens
tgcaaaagtaattgtggtttttgctgttaaaagcaacaacaaaaaccgcaattacttttgca

SEQ ID NO: 6793975 - DNA, 60 bp, Homo sapiens
ctatcttggtccagtctacaccaggactaggacaatgaggtctggactggactactgtgg

SEQ ID NO: 6793976 - DNA, 82 bp, Homo sapiens
gcacaagtgaccaagcctgaccaatcagagtccttcaactcttccaaatacgcagagtggttcagggattggcacatgatgc

SEQ ID NO: 6793977 - DNA, 60 bp, Homo sapiens
gaaggcagcagtgcacgactgatgtaagtgaggcattagggcaaaccactgcatgctgtc

SEQ ID NO: 6793978 - DNA, 124 bp, Homo sapiens
tctcttgggcagagatgctaatttaagaatgttgtcggtttaaatgttcctaagaggattaagcaaattctacagcatataaatggacatatttggaagatttttttccccaagcaatttcaga

SEQ ID NO: 6793979 - DNA, 64 bp, Homo sapiens
ctcaaaactactggattagtaacttaacctctctgagcttcagttgcagaatccagagaaagag

SEQ ID NO: 6793980 - DNA, 92 bp, Homo sapiens
ttacacctatgtgttattctcatagttttatagttttagctcttatagttaggtctgtgattcactttgagttatttgtgcatatagtgtaa

SEQ ID NO: 6793981 - DNA, 60 bp, Homo sapiens
ctggtacagtagttggggtccaaccaggaaaatggaaaccactctaactctttacaacag

SEQ ID NO: 6793982 - DNA, 98 bp, Homo sapiens
gcgctcaccgcacgtccatgatgctgctgcgctggccgtcacggtggctctccaggtgggacagcgtgaaggcgggcagtcggcggatggcgaagcgc

SEQ ID NO: 6793983 - DNA, 56 bp, Homo sapiens
ggatgcctgtctcagggtctgtttctgataaacctaccctaagacagagtatttcc

SEQ ID NO: 6793984 - DNA, 72 bp, Homo sapiens
ggaagttctcagctaggtgatgtgtgaagacggtaagggagtgagccacacagatccctgaggagagcatcc

SEQ ID NO: 6793985 - DNA, 81 bp, Homo sapiens
tttctcctttccaagtttactactacctgtgtgtctgttctcatgacgcattagagctttgaacttcttggaagaaaggaa

SEQ ID NO: 6793986 - DNA, 86 bp, Homo sapiens
catatatatcttgattcttattgattcctgctttctgctctctttcatagagaagaagacatggaacaatagttaaggaatatatg

SEQ ID NO: 6793987 - DNA, 72 bp, Homo sapiens
tcaggtgatatgctacgtgctgtgtaagtatcttattaaatattcacagcaaccctgaggcgagttacatga

SEQ ID NO: 6793988 - DNA, 58 bp, Homo sapiens
tctctgggactaggaaattatgtagccttttacataattaatctttaagttccattgg

SEQ ID NO: 6793989 - DNA, 55 bp, Homo sapiens
cactgggctgataccaggcttcgtgagggtcggagccttgtgctgttgtccagtg

SEQ ID NO: 6793990 - DNA, 76 bp, Homo sapiens
ggctacagtactggatgctcagccctccaccattatgggggtgtttcctggccattcagctgatcactgttaagct

SEQ ID NO: 6793991 - DNA, 90 bp, Homo sapiens
tctgattaagccgttctggagtggtgccaggcctgagccagccccaggaaaggcaggaaagaggctggtggcacaggatgggaaatcaga

SEQ ID NO: 6793992 - DNA, 64 bp, Homo sapiens
tgtgaactgtgaggctcttgcatattgggagctctctgaaggcagcagtgtctccagcatcaca

SEQ ID NO: 6793993 - DNA, 61 bp, Homo sapiens
tgacattcaggccacagtggagtcagtgctgggttctgcctcctctaggacttgtgtttca

SEQ ID NO: 6793994 - DNA, 70 bp, Homo sapiens
ctggttgttttggtgactggaaaacatactctgagtaagcatttcatttcaatcaccataaagcaactgg

SEQ ID NO: 6793995 - DNA, 58 bp, Homo sapiens
gagcagtggtcacagggagggacattaagagtgtgtgccattctaggtggcagtgctc

SEQ ID NO: 6793996 - DNA, 63 bp, Homo sapiens
gctcggccccttccctttcttgctcagaatacacttattgtaagagcttccaggcagccgggc

SEQ ID NO: 6793997 - DNA, 55 bp, Homo sapiens
ggaggaggcaagtaccagatgcctctagtcagccatcttgaagactctctcttcc

SEQ ID NO: 6793998 - DNA, 61 bp, Homo sapiens
agctgcgttggaggctgtaggaccgggtatgagaaatcccattactgagccccgggcagct

SEQ ID NO: 6793999 - DNA, 64 bp, Homo sapiens
gaagtaccaggccacctcgacacagccttcctgctcttccttctccaggtggcctgggagcttt

SEQ ID NO: 6794000 - DNA, 76 bp, Homo sapiens
gcagttctaagaatgtatgggtgagaaagttgacctctttggattaacacttgaactctacatgttgggtctttgc

SEQ ID NO: 6794001 - DNA, 65 bp, Homo sapiens
ggtcgagcacattaagtgagttcatgtggctaactaaggacacagagcatgctcagtgtgtgact

SEQ ID NO: 6794002 - DNA, 56 bp, Homo sapiens
tttgcatcattcagtgccttgggaatgtcttacgggatatttctggaatgggcaaa

SEQ ID NO: 6794003 - DNA, 87 bp, Homo sapiens
atttagaacaagacttctgttcaaattagaagttcccctaatgcatgattactgagctctaggttttgaaccctgaagtttctaagt

SEQ ID NO: 6794004 - DNA, 76 bp, Homo sapiens
gaggaatgtcagcacaggcctctctcaggatgtcccttctctgacatcctgagagaggcctgtgctgacattcctc

SEQ ID NO: 6794005 - DNA, 107 bp, Homo sapiens
gaagtctatgaaagccaacatttgtggtgagcagggaacgtcagttaatcacatattagggatgattcctttgttcattgtgcaaaagtggtttctagcagacattc

SEQ ID NO: 6794006 - DNA, 66 bp, Homo sapiens
gttgcaaggggtttatgcagatgagggtcccacatgttttcttcatgctaaagccacctttgcaat

SEQ ID NO: 6794007 - DNA, 56 bp, Homo sapiens
atcatctgtctccttgtatgttagaggtggtcccatggggggagccaacagttggt

SEQ ID NO: 6794008 - DNA, 63 bp, Homo sapiens
acctgccctggaggaagatattcagccccattcccccaagccctgagttttccaggggcaggt

SEQ ID NO: 6794009 - DNA, 80 bp, Homo sapiens
ttcctggaaggtgaggctggcttgccttcttgatttatgtggccaaagggtagcagccacctctgcaaaggtccagtgaa

SEQ ID NO: 6794010 - DNA, 69 bp, Homo sapiens
gatggtcactgtgtccccagcagttgagacccatttgacagagtctcaggcagctgcaccgtgaccatc

SEQ ID NO: 6794011 - DNA, 82 bp, Homo sapiens
attttttgccagtaaagttttagttccagtccctgttggtgagagggtagcaaggctgggagatgaggcctgtgcaagacat

SEQ ID NO: 6794012 - DNA, 59 bp, Homo sapiens
ctctcatgcaatttacatgtgatgccaccaggtggtgatacagagggatagcaagactg

SEQ ID NO: 6794013 - DNA, 92 bp, Homo sapiens
ccagaaaacagcagtggcaggagaaggcggctgcgggaacattttctccttccaaaagagctttcatcactctacttagctttcatttctgg

SEQ ID NO: 6794014 - DNA, 61 bp, Homo sapiens
ggcaatggcattgagaaagattgcaagtagtaatgtgcaggtgcgttttcaagcctccgct

SEQ ID NO: 6794015 - DNA, 92 bp, Homo sapiens
cagcgttttttggtggatttcttttgaatctagaattctgtagctaacgctttcctgagacttagtcaaaagcttcactcggaaaatctatg

SEQ ID NO: 6794016 - DNA, 62 bp, Homo sapiens
tgtgaaatatttatatactcaacatggcttttctcccctgtggaagattttaatgtttcaca

SEQ ID NO: 6794017 - DNA, 65 bp, Homo sapiens
tccaagtttaagtcatagagcggaagaccagcctcggctctccttacctctttgtgccttatggg

SEQ ID NO: 6794018 - DNA, 67 bp, Homo sapiens
gtggatggtggtccagtatcatattctgaagatccaatcaactatgcatgctgttctaccagtctac

SEQ ID NO: 6794019 - DNA, 66 bp, Homo sapiens
ctgtgagaccttggctctgctggaaaggaccttaacattttggtcagcaggtctacaggttcatag

SEQ ID NO: 6794020 - DNA, 68 bp, Homo sapiens
cagacaaaaatgcttggacttaataaatctaggagagaggtttgtttatcaaggtctagcattgtttg

SEQ ID NO: 6794021 - DNA, 81 bp, Homo sapiens
atgggccagaaatgtgaaagaggtgttcagtggggagtatacttctaacttgaatacattcttttcagcatttctacttat

SEQ ID NO: 6794022 - DNA, 55 bp, Homo sapiens
tcctctgctgttctggttctttaggaaactccgccttagacatgatggcaggggg

SEQ ID NO: 6794023 - DNA, 60 bp, Homo sapiens
tctgaattaatcatgcctctttaatcaatgagaaggaagagtctcaaagattaattcaga

SEQ ID NO: 6794024 - DNA, 77 bp, Homo sapiens
ccaaagacccagcctggtttttataggccagacataaatctgagaaagtgtttataaaatagactgggtctatctgg

SEQ ID NO: 6794025 - DNA, 58 bp, Homo sapiens
tcccatgcctgctgtttatgtcctccctccccatttgatctaaacagttggcatgggg

SEQ ID NO: 6794026 - DNA, 104 bp, Homo sapiens
ggaaggttggttgtgtggctgggtcgtgtgctttgcggggaaggcatgtgttgctttatggcttccccacaaagcacacaaccgggtcacacaactgacctttc

SEQ ID NO: 6794027 - DNA, 65 bp, Homo sapiens
ctggctttggaacaaatcatagggataattttattactttctcactgtgcttcttcctaagccag

SEQ ID NO: 6794028 - DNA, 71 bp, Homo sapiens
acaggtggcactgctgttactctcctgtcacactccagaaaaaagaagtcgagttataactgccacactgt

SEQ ID NO: 6794029 - DNA, 62 bp, Homo sapiens
tcccaaggttcagctgaggagggccacatttgagaacaggtgtgccacttcactgagcagga

SEQ ID NO: 6794030 - DNA, 66 bp, Homo sapiens
tggagtagcgcaactgcagagaagtagtttgtaaaaggacatcatgttgtcagttgcccttcttca

SEQ ID NO: 6794031 - DNA, 66 bp, Homo sapiens
gcggcccagagccccaccttcctccccatccccgccaggaagctcaaaccttggggctcaggctgc

SEQ ID NO: 6794032 - DNA, 55 bp, Homo sapiens
gcccagagagacacgacagctagtgcgatgaggcatgctggatggatcctggagt

SEQ ID NO: 6794033 - DNA, 74 bp, Homo sapiens
ttcctaatgacaggtgctatgcaatcagcactattaccatatgctggaaataggcattgtagcttaataaggaa

SEQ ID NO: 6794034 - DNA, 130 bp, Homo sapiens
tggatcactgcaggcccatggtcagggttcaaggagccagattctctcactttcaacaagaaattgagaaatgaagctggtgattcagggactccaaaatctggccaggtcgtataatgcaagtgagata

SEQ ID NO: 6794035 - DNA, 61 bp, Homo sapiens
tagtgagtgtcttcacctctcagctctgtcttgaatgcttcctgggtgcaggcactgactg

SEQ ID NO: 6794036 - DNA, 57 bp, Homo sapiens
gcccaggctggagtgcagtggcacatatctgttcactgcaacctccacctcccgggc

SEQ ID NO: 6794037 - DNA, 57 bp, Homo sapiens
aaaaactctgtgcgagctatgagagtgtaagctttatagttatatacagatgttttt

SEQ ID NO: 6794038 - DNA, 111 bp, Homo sapiens
aagttctgccagtgttcgaacttcctataaatggaatttggcagtatttacccttttgtgcctatatactacatagttccatttacaggaagttaagcctgggcagaactt

SEQ ID NO: 6794039 - DNA, 58 bp, Homo sapiens
tgtgcctgatggtcacgtggccacatgcacccttggctagatcaccatccaggccaca

SEQ ID NO: 6794040 - DNA, 81 bp, Homo sapiens
ggtgttgagggtgaggtttgtgtgtgatttcgtgagacctctcacccatacctctaccacacatgacccacttttaccgcc

SEQ ID NO: 6794041 - DNA, 67 bp, Homo sapiens
gcagccccaacctctttgggccttggtttccttatttttggaactcggaggtcaggagaggttctgc

SEQ ID NO: 6794042 - DNA, 80 bp, Homo sapiens
ttagctcctgcaccacagttcctcgctgtccaccccaggcttccggactggaaggacagtgggacagtgacgggggataa

SEQ ID NO: 6794043 - DNA, 73 bp, Homo sapiens
tgtctgtgtccagtgagagagaacgcattcatactcaataagttatatgaagcaaatttattacttacagaca

SEQ ID NO: 6794044 - DNA, 87 bp, Homo sapiens
ctggtagaggaagagggagaggctctgaggactggggtgatgggggtgcctatcttagtagagcagggcctctcccctccccatcag

SEQ ID NO: 6794045 - DNA, 71 bp, Homo sapiens
tcccttgaaggcctaagcagaacaaaaaggtggagtgagagaaaatttactctctgtgtctttaagctgga

SEQ ID NO: 6794046 - DNA, 77 bp, Homo sapiens
tctcctaggacagtggagataaccagaaaacttcaaaagtcttttcaatctccagctgttttatgattctaaggaga

SEQ ID NO: 6794047 - DNA, 86 bp, Homo sapiens
ggaaacataagaaagctccagggatgagacagagtagctcagttgcacagagttcatctcatgctgtgggtgaatctcttgattcc

SEQ ID NO: 6794048 - DNA, 78 bp, Homo sapiens
gtctgggctgaattctgagaccacagaatcctggaatattagagccagaaggaattttacatctcagagagcttgagc

SEQ ID NO: 6794049 - DNA, 55 bp, Homo sapiens
gggccggggcctccccgcgtcgcggctcagggctgtgataggtggtccccgggcc

SEQ ID NO: 6794050 - DNA, 83 bp, Homo sapiens
aggtacccttttgccctttcaacattctgccttgtgagtacacagcaacaaggtatcatcttggaagcacagagactaggcct

SEQ ID NO: 6794051 - DNA, 76 bp, Homo sapiens
cagaattaaaagtagggaaagttctatttaccttggaagtaagcaagaagtggtccttttctttcttcatattctg

SEQ ID NO: 6794052 - DNA, 121 bp, Homo sapiens
tgcatttagtaagcatttgttaaatgaatggatggggtcaagatacagtactgatattttcaagtttttgcaatgtatttcctcagtcatttatctatgcatttatatgctcattaagtca

SEQ ID NO: 6794053 - DNA, 84 bp, Homo sapiens
cccaaggatactggccaggcgaaccacactgcgataagaaacagcagctgaaagtttgtttttggagccaccagatccagtggg

SEQ ID NO: 6794054 - DNA, 63 bp, Homo sapiens
catatgcagtgaccaatcatggttagattttggaagaagtactgtgattgggcactgatcatg

SEQ ID NO: 6794055 - DNA, 121 bp, Homo sapiens
gcagccaaagaagaaaaggaaggaaagatcatctgaggactaaaatagtttgttaaagggaacatctttatactagtccttgaaaaagattttatccacattctgtttaaaagaggtttgc

SEQ ID NO: 6794056 - DNA, 67 bp, Homo sapiens
ttgaatctgagcatagtgatttttctagatgtcagcatcagtagacagagggcttgctcttcatcaa

SEQ ID NO: 6794057 - DNA, 57 bp, Homo sapiens
ctacagagtatctaaagaggtaaaggctagaagtgagactttgaaagatacctgtgg

SEQ ID NO: 6794058 - DNA, 67 bp, Homo sapiens
cagatgtccacagtttgtgctgaagaaggtggcgcctcagtccaagtcagagagtgtgagacaactg

SEQ ID NO: 6794059 - DNA, 65 bp, Homo sapiens
atggcttgcttttagagagatctttcataattttcagatgcatttgtttttcttgggcgagctat

SEQ ID NO: 6794060 - DNA, 85 bp, Homo sapiens
aggcagaggtgggaagtgtgaatgcataatatactgttatgtaaatgacattcaagtttgcagttaggatttctgatttctgcct

SEQ ID NO: 6794061 - DNA, 84 bp, Homo sapiens
gtatgtgtatatgttggcatgtatgtgcatttttgtatgtttatatgtatatataagtgtatatatatgaaatatataatatat

SEQ ID NO: 6794062 - DNA, 69 bp, Homo sapiens
gcactgtggacatttgggccagataattctgctttggtgggctgtcctgtgtagaatgtttatagtagc

SEQ ID NO: 6794063 - DNA, 60 bp, Homo sapiens
ctgtttatgtcactgtaggtggaggatggtgagaattctcttaacagtgctacagagcag

SEQ ID NO: 6794064 - DNA, 106 bp, Homo sapiens
aacaagcttctaggagtcaggacttaagctctttgtagttctactttatatcctttgaatctgtggcagaaggctaaggtgtccacctgaagtttgaagtcttgtt

SEQ ID NO: 6794065 - DNA, 61 bp, Homo sapiens
tctaatgttctgggagagaagctgttgggtctttcctacctaatctggtagaaatgttaga

SEQ ID NO: 6794066 - DNA, 57 bp, Homo sapiens
cccagagccgctcccctacttctcctcaggggacatagatggggcaggtggcctggg

SEQ ID NO: 6794067 - DNA, 57 bp, Homo sapiens
tcacttatctcatttaatcaccacaggctcctccaaggtggagatcagagataagga

SEQ ID NO: 6794068 - DNA, 60 bp, Homo sapiens
caggatgcttctggggccaggctcctataagtttggaatttctacctctgaactttcctg

SEQ ID NO: 6794069 - DNA, 88 bp, Homo sapiens
agggcgcgcgctttgcggtgcaagggtagcggcaggcgggcgtaccaggcgggcggcttcatcttgcccttccacagcgtgacgccct

SEQ ID NO: 6794070 - DNA, 64 bp, Homo sapiens
gggagaaaggttctagtcatgttgttggtttcttgggaacgtaacacacctagagcattcttcc

SEQ ID NO: 6794071 - DNA, 81 bp, Homo sapiens
ggaaatttggaactactttagtattttttcatgattttgttctttaagattcagaaagcaagtgctgggtactttccttcc

SEQ ID NO: 6794072 - DNA, 68 bp, Homo sapiens
tgctgggtgacaagaagagcatttgcagggtttctggttctagtgccttcattcttcccaccctggta

SEQ ID NO: 6794073 - DNA, 59 bp, Homo sapiens
tggttgtgctgatctgtgtgtgactctgcttctgtagatgattagattaaacacggcca

SEQ ID NO: 6794074 - DNA, 81 bp, Homo sapiens
gctgagcccagagcccttgtagggaagaaacttcgttttatttatgtaacatatctacccttcaagctctctgggttttgt

SEQ ID NO: 6794075 - DNA, 119 bp, Homo sapiens
gcccaactgtaggccaatgtaaatgttgtaagtacatctaaggtatgtcaggctaagctatagacgtttggtaggttagatgtattaagtgcattttcaacttgtgaattatagtgggt

SEQ ID NO: 6794076 - DNA, 68 bp, Homo sapiens
cttcaaatgccctgcatcaagtgacactccatggaaccaagggagtatcacactgcagtcatttgcag

SEQ ID NO: 6794077 - DNA, 65 bp, Homo sapiens
ttttgtcacaagtacaatagctctggaactttcaataaagggactccaagtattgtacgatgaaa

SEQ ID NO: 6794078 - DNA, 120 bp, Homo sapiens
caaatccagtcagatattacctccaggtgcaatatttggcactgagatgagcattaaagttaaatatttattggtgccttaatattgtcagagacttgttccaacactgacccaggtttg

SEQ ID NO: 6794079 - DNA, 56 bp, Homo sapiens
tccacatctctgtaggaggagttgcaaaatcacattgcaagcagcagagatatggg

SEQ ID NO: 6794080 - DNA, 65 bp, Homo sapiens
ggaactgttacagatacatttcttttgttgaagttaccttcaacaaagtaatttgttacggcacc

SEQ ID NO: 6794081 - DNA, 84 bp, Homo sapiens
ggttatctgcagaatagggcataactttgctcaaaaatgaatctgctatgggtaccgagaaaaggctctattcatagaatgacc

SEQ ID NO: 6794082 - DNA, 61 bp, Homo sapiens
agtttggctgctgggaactcaaacaataccaagtactgtgtgaattctgagcagtttagct

SEQ ID NO: 6794083 - DNA, 70 bp, Homo sapiens
cagaatcagtagagagccctagggctcaagtgtgtgtggcttctatgagcctgggctttctctggagatg

SEQ ID NO: 6794084 - DNA, 62 bp, Homo sapiens
tggggctgatgggagctggctcaccccgagacacttggggagtgacaccacccctcacccca

SEQ ID NO: 6794085 - DNA, 79 bp, Homo sapiens
ctagcagagggcctggcacagggaggctattgtgatggtcatttctcctagagccacctctgtgcaggcctcgggttgg

SEQ ID NO: 6794086 - DNA, 65 bp, Homo sapiens
gacaggacagtggcagggtgacagagtttgggaactttgtgattctgctagctgagtatcttgtc

SEQ ID NO: 6794087 - DNA, 76 bp, Homo sapiens
tgggaaccccatccacatgaccattgtgctcctggtccttctggaagatgaggaggtgagcggtcatgtggtccca

SEQ ID NO: 6794088 - DNA, 56 bp, Homo sapiens
tcagtgtggaattcaacagcaaaatatgtctagacatgtgaaaccttccacgctga

SEQ ID NO: 6794089 - DNA, 82 bp, Homo sapiens
caggggtgagctggggtccaggggtttgccggtgagtgggtggatgaaggtggaacccgagggccccaggctcgggccgctg

SEQ ID NO: 6794090 - DNA, 67 bp, Homo sapiens
agcacaaaagtggtttcccagttcagtagtaacaacagctaatatttatgagctcccactatgtgct

SEQ ID NO: 6794091 - DNA, 94 bp, Homo sapiens
tgaattgatgtatctcacataactgggagatccaagggtggatgtggttttaaccagaactcgatctgagggtttgtgggaaatattcaaatta

SEQ ID NO: 6794092 - DNA, 87 bp, Homo sapiens
ccagtaactaatgcattccactgagatttgtatcctgcagagaattagctcctggagcaattacagtggcatgtatttccccacagg

SEQ ID NO: 6794093 - DNA, 74 bp, Homo sapiens
gcagagctgtctaagtcacttccttttacaccttcagtctcccatctgcaaaagtgctcagtggacagcattgc

SEQ ID NO: 6794094 - DNA, 71 bp, Homo sapiens
cctctcctgcctgtccctcagtccacaccgcagggccttccagagcctgtggctgaaggagggaggagagg

SEQ ID NO: 6794095 - DNA, 56 bp, Homo sapiens
aggaaaaggtgccttttgctaattcatacaaagactagcagagatcattttctcct

SEQ ID NO: 6794096 - DNA, 55 bp, Homo sapiens
taacatctgggctgcgtcctgacgtcagggctgtggtgatgaagtccagatgtta

SEQ ID NO: 6794097 - DNA, 57 bp, Homo sapiens
tctgagtttttgcagctgctgttggaatctctctaacacagagcttctcaactggga

SEQ ID NO: 6794098 - DNA, 64 bp, Homo sapiens
ggagtggaaggagcagagtgagcggcacccacagccccttctctgagcgcattcctccggctcc

SEQ ID NO: 6794099 - DNA, 85 bp, Homo sapiens
catgtcatgtagccttgatgctttcattctctctggaccacaacagagatgcccttgaaaggattagcagtttgactctgacgtg

SEQ ID NO: 6794100 - DNA, 67 bp, Homo sapiens
tcttcggaacacaaagttttcccccacgtcactagtggctgtgattcaagacttggtgctttcaaga

SEQ ID NO: 6794101 - DNA, 84 bp, Homo sapiens
ggcctcgctctgtcacccaggctggagtgcagtggcacgatctcggctcactacaatctccacctcccgggttcaagtgattct

SEQ ID NO: 6794102 - DNA, 71 bp, Homo sapiens
tactgcagaaattcagaaagcataaggcataaagatgagtgctaattatctgacctgaatttgctgtggtg

SEQ ID NO: 6794103 - DNA, 60 bp, Homo sapiens
ttgtctgaattcttctaggcagcaactgtgtctataacagtgacttgataatttagacaa

SEQ ID NO: 6794104 - DNA, 57 bp, Homo sapiens
cagtctaagactcacgccaagatttttatttccttctggggccctgtcttgggtctg

SEQ ID NO: 6794105 - DNA, 55 bp, Homo sapiens
tccaaaaagaaatgctggtttagcggggagtgaagacaatgcagtcttttttgga

SEQ ID NO: 6794106 - DNA, 78 bp, Homo sapiens
atttgccagtgctgtgttggctgccggcacaggaggcccgttctgtattctgctgctggcaccgggggatatgcaaat

SEQ ID NO: 6794107 - DNA, 56 bp, Homo sapiens
gaacagtagatgagatgctagaatatttggatattttaggatgaattatactgttt

SEQ ID NO: 6794108 - DNA, 57 bp, Homo sapiens
tgttggagcccgagtcagggagactgtgggtggtctgcttgttctccagctccagca

SEQ ID NO: 6794109 - DNA, 73 bp, Homo sapiens
caggaatcactaacttagggaatttgatgaactacttcacatagttcacatttactggtttgtccgattcctg

SEQ ID NO: 6794110 - DNA, 58 bp, Homo sapiens
atgagcatctgagccagtgactgaggaggtggcacctgacctggcttcagatgtacat

SEQ ID NO: 6794111 - DNA, 74 bp, Homo sapiens
acagcaatcagataccaagctccagaatatgctccacactgttattttctggctgaaagtttatttgaagctgt

SEQ ID NO: 6794112 - DNA, 56 bp, Homo sapiens
gccagctggaaatctgcttgaagagccagccttcaggccaaatatttatagcaggt

SEQ ID NO: 6794113 - DNA, 103 bp, Homo sapiens
ggggccagtagaatataaagggaaggagcttgataaagggcactgttagctgcacgttaaagtgcaagctggcattctccttgttattcctttttctctcccc

SEQ ID NO: 6794114 - DNA, 61 bp, Homo sapiens
tcaactggttcttgaatgtatatagggtttatcaggatatacagaaagaattcaagtctga

SEQ ID NO: 6794115 - DNA, 60 bp, Homo sapiens
gcctccctggggctcctcctatttccctgaggaagtaatagaagctctaagggcacaggc

SEQ ID NO: 6794116 - DNA, 65 bp, Homo sapiens
tctgcttgcttagtccccaagagagaccacagcccctctgtggctcctcagtggactgggccaga

SEQ ID NO: 6794117 - DNA, 68 bp, Homo sapiens
acaaacaattgctaatgcttctgttgagtgctcaccatgcgccagccatgagtctaagcagtttatgt

SEQ ID NO: 6794118 - DNA, 68 bp, Homo sapiens
cttcttaattcaacagtcagttatctcagagggtttctctctagtgtctcttcctgtttgaaaggaag

SEQ ID NO: 6794119 - DNA, 75 bp, Homo sapiens
gccagctgccaggccacaagaactaccccatctggctgtgggaagccagcctggggtcccttgttggcacttggt

SEQ ID NO: 6794120 - DNA, 80 bp, Homo sapiens
atgtagtaaagccaagattctaattcaagattgtcaccaaaatccatccaccaatctagaagtcatggctttctttacat

SEQ ID NO: 6794121 - DNA, 67 bp, Homo sapiens
tgcgtctctgtcctcaaagacctccatggcctctcttcatatcaggacatcaggagacacagacgca

SEQ ID NO: 6794122 - DNA, 67 bp, Homo sapiens
ggagatattaaggggatggcattccaggaggctgcatggaagcccctcatcctttcccacatacttt

SEQ ID NO: 6794123 - DNA, 56 bp, Homo sapiens
ctgaccttgtgatccgcctacctcggcttccccaagtgctggattacaggcgtgag

SEQ ID NO: 6794124 - DNA, 64 bp, Homo sapiens
gccctgcctgtctgctgggagggcccgcatggagcctcttgcccagctgcagacaagggagggt

SEQ ID NO: 6794125 - DNA, 115 bp, Homo sapiens
gtggggtccaagggcttcctggggaagcggatgagcttgtagcagtactccttcaactggagttgctggcatttcaggactcacccgacttgttctaatgtctccttggatccac

SEQ ID NO: 6794126 - DNA, 61 bp, Homo sapiens
caggtgaagggctccgcccctggagcaagactgcccgtgtgagaatcctgccctgcacttg

SEQ ID NO: 6794127 - DNA, 76 bp, Homo sapiens
ttggtgcctcttagaaagaaacacactggagcctgttattttcagtaaccctgctgttcagagagaaaagcaccaa

SEQ ID NO: 6794128 - DNA, 61 bp, Homo sapiens
aatacttccagggatacttttgtacctgaaagtcctaaggtaataaagagcttggagtgtt

SEQ ID NO: 6794129 - DNA, 61 bp, Homo sapiens
agttgtctggcacagtcactgggaatgctgagcagatcgaagctgggtgctaatgacaact

SEQ ID NO: 6794130 - DNA, 73 bp, Homo sapiens
cttggcttactataatgctcttagacgtttgtattgggttactagtgctttaagagattgttagtactttaag

SEQ ID NO: 6794131 - DNA, 69 bp, Homo sapiens
agcttcaaatggcaacaagaacactggctttgaccaccaagagtcggtgacaaattctctgccattgct

SEQ ID NO: 6794132 - DNA, 58 bp, Homo sapiens
ggagttagattttatcctgagggcgttgacaattttctgcaggagtgtaatgtgaccc

SEQ ID NO: 6794133 - DNA, 85 bp, Homo sapiens
ctgggataaagttaaggtattggcagggctgagttctttctggagcccctgagcctccagaacctgttttcttgcttttttccag

SEQ ID NO: 6794134 - DNA, 79 bp, Homo sapiens
ggtggctgggtgagacaattgatgacttaaaaagaccacgttctaatgagatctgctaattgactgacttctagtcatc

SEQ ID NO: 6794135 - DNA, 66 bp, Homo sapiens
gccaccatttactgagcacctactgcaggccaggccctgtgccagcatggtgccagtgagtccagc

SEQ ID NO: 6794136 - DNA, 100 bp, Homo sapiens
gtgtttctgctagttggattggagtctgcttttgtgaagagctgattgtggggtaagagtctgctcaacatttgtaggataagttcactggaggagatgc

SEQ ID NO: 6794137 - DNA, 88 bp, Homo sapiens
cagacagggaggaggtcacatggggagagggagaaggccatgcctcttccactgggccccatccctggttgccattcctccttggctg

SEQ ID NO: 6794138 - DNA, 62 bp, Homo sapiens
gacaggctttgagtcccagaacagatcagcccattttcatatggttactgggagaagccgtc

SEQ ID NO: 6794139 - DNA, 66 bp, Homo sapiens
tcctggtgattataagccactgtatcagccctgaattgcttatctccagattgtgatcatcagaga

SEQ ID NO: 6794140 - DNA, 79 bp, Homo sapiens
ccatttcttttggcacagcttcccagacttacaagatgtcttgaagtgactgaatggagttagtgttcggcaggactgg

SEQ ID NO: 6794141 - DNA, 80 bp, Homo sapiens
gtctgtgctggtgattacaatgatgacaatgatgaagttgatcagagctaacatttattgaaacttactatgtgccagat

SEQ ID NO: 6794142 - DNA, 68 bp, Homo sapiens
gggtacatgtgcacaacgtgcaggtttgttacatatgtatacatgtgccgcgttggtgtgctgcaccc

SEQ ID NO: 6794143 - DNA, 84 bp, Homo sapiens
gtgtgtgtgtgtgtgtgtgtgcgtgtgcgcgcgcgcgtgtgtgtgcatgtgtgtgtgcacgtgcgcgcgagcatatgtgcgcat

SEQ ID NO: 6794144 - DNA, 58 bp, Homo sapiens
catcagtctgaaagccagggagttggtctgagtgacaaggaattggtttcagatgatg

SEQ ID NO: 6794145 - DNA, 56 bp, Homo sapiens
tggcctggctcacagtgagattcatggggcagccacgaatctgcctgagccagcca

SEQ ID NO: 6794146 - DNA, 98 bp, Homo sapiens
gaggtggtcacctataggagatagttgattcatatagatatgcgtgcacaagcatgtgtttgtgttggattattatctgtctcgagggtgagcatctt

SEQ ID NO: 6794147 - DNA, 71 bp, Homo sapiens
ccaggcacctgtgtgtctcagggcccagaagagcttgtggcctccttgcagacatcagtagtggcccctgg

SEQ ID NO: 6794148 - DNA, 59 bp, Homo sapiens
tcggtctagacagataggggtacgaatctgcaacttaccagccatttgaccttgaccga

SEQ ID NO: 6794149 - DNA, 64 bp, Homo sapiens
ggtgttaaccagctaaactttgctcgaagccttcagtcctttgtagaggagcgagctggacgcc

SEQ ID NO: 6794150 - DNA, 60 bp, Homo sapiens
aaggggctgagaaatgttgtaattattaagaaatttggtattagcaatctcagtctcctt

SEQ ID NO: 6794151 - DNA, 122 bp, Homo sapiens
tcatctgaaaactgggtataacaatatgtacttttcaggattgttgcagggcttcgttgaggggatgtttataaagctcttagtagcagcctagtatctaaaaaatgttcagttaatggtga

SEQ ID NO: 6794152 - DNA, 65 bp, Homo sapiens
gaggtagatatacttattccatttttactgatgatgaatatgaatggaccaaagtaatttgcctt

SEQ ID NO: 6794153 - DNA, 57 bp, Homo sapiens
ctgcttctcacctgctactggagcatgctctgcctgcccccgtcagaggtgatgcag

SEQ ID NO: 6794154 - DNA, 55 bp, Homo sapiens
cctctgcatgtgcagtaccgagtacctattacacattcaggactgtactgcaagg

SEQ ID NO: 6794155 - DNA, 83 bp, Homo sapiens
tcccctcggctgcttggcacagagctgcagcctgggactctccgtggacccagactggggattttgccaggggggcgatggga

SEQ ID NO: 6794156 - DNA, 59 bp, Homo sapiens
atccagaaggccacccggggatggagttctgtgtggaagctgtccgtggccttctggat

SEQ ID NO: 6794157 - DNA, 81 bp, Homo sapiens
aaagaaaatttccagcatcagcattgtcttagggaacacttagactctgtgatgatgtgatggtgtttatgaattattttt

SEQ ID NO: 6794158 - DNA, 63 bp, Homo sapiens
agggtttctctccagtgtggaccctctgatggataaggaggtcggagctgtagatgaaaccct

SEQ ID NO: 6794159 - DNA, 87 bp, Homo sapiens
gtgcctaacgatttgccctgccttggacagccagtcctcttcaggtggtgggctgctggtaggggtaggaagcaaggcctggggcac

SEQ ID NO: 6794160 - DNA, 86 bp, Homo sapiens
atgagcttggccaatcctctttctctccctgaaatttgaactttaagcagaacttcagggacagaaaagagctggagccacttcat

SEQ ID NO: 6794161 - DNA, 80 bp, Homo sapiens
ctcagctttgtcatttggtgagtaagtttgaaaaatatcaatttatttcattctcctgtttcacagatgggaaaactgag

SEQ ID NO: 6794162 - DNA, 70 bp, Homo sapiens
tggtccaaatttgagagaaaggtgatttttaagcctaaccccagcttggattttcctcgtgtttgttcta

SEQ ID NO: 6794163 - DNA, 68 bp, Homo sapiens
ccccacaatgtagaggctgaaagcaattaactatctgttattgctcacaaatctttaggtcagcgggg

SEQ ID NO: 6794164 - DNA, 56 bp, Homo sapiens
cacagtgtgtattgttgtagaatgccccattggtttgtttgcctgtataccctgtg

SEQ ID NO: 6794165 - DNA, 67 bp, Homo sapiens
tctagctttcctgcagcaccacagttctttaaatagggatcctgtggggcggctgcaggggacgggg

SEQ ID NO: 6794166 - DNA, 63 bp, Homo sapiens
tgagtggctgcagcacatgtagtggctggaatttgacataacacctgtgctgtagtcactaca

SEQ ID NO: 6794167 - DNA, 71 bp, Homo sapiens
cgctatctgtccctggtccaagatttgacaaagtgtgcaaacaagtaaatcagacacagtgaaagttagcg

SEQ ID NO: 6794168 - DNA, 57 bp, Homo sapiens
gtttcctgtggccacagaataaacgaaactaactgtcctggggcttcttcaggaaac

SEQ ID NO: 6794169 - DNA, 114 bp, Homo sapiens
ctagagataaataaatatgtgcaaggaaaataactttgaggtcactgaattccaggaaactgagatcactgaaattctgtgtcccagagtgcaatatttatttcacaactgtag

SEQ ID NO: 6794170 - DNA, 55 bp, Homo sapiens
agcatttgcttacctcagggcccttgcagtcgttattccctgaggctagcatgct

SEQ ID NO: 6794171 - DNA, 66 bp, Homo sapiens
ggctctgcctgccccagctgagatatcacttaacagtgcgggctcttcaggggcagggccagggcc

SEQ ID NO: 6794172 - DNA, 65 bp, Homo sapiens
attttgttttgttcttgggctggtgttaagatctttaaacataaagtctttgataaagacaaagt

SEQ ID NO: 6794173 - DNA, 67 bp, Homo sapiens
gcaagcaccgaacctggctgcaaagaaggggaaccgttccccaaattttgccaagtcaggctgctgt

SEQ ID NO: 6794174 - DNA, 70 bp, Homo sapiens
gaggttcttagagccaggactgtgtctcactcacctctgcatctctagtgagtgtctggtgcagggcctc

SEQ ID NO: 6794175 - DNA, 75 bp, Homo sapiens
ttttttcatgtggaaaagggctttcagaatggcagaataaaaacctctgaaaatctactcctccatacaaagaaa

SEQ ID NO: 6794176 - DNA, 62 bp, Homo sapiens
gtagaggttgatagtaatgtttagccctagtgggtatagaacaaattctcatcaacttgtgc

SEQ ID NO: 6794177 - DNA, 70 bp, Homo sapiens
gtgtaaggatcttttcgggcagtgagaggacgttggtttctcacagcagagaagggacatcatctgacat

SEQ ID NO: 6794178 - DNA, 72 bp, Homo sapiens
tttcttaataaagtaagcaagtatgatgatgagtaatcatttatccattagctatctgtttacattaggaaa

SEQ ID NO: 6794179 - DNA, 76 bp, Homo sapiens
cccctcctcctggcaccccacactgtccacgcagctcctgggctctgaggtcagaagctggggtgtgctgaagggg

SEQ ID NO: 6794180 - DNA, 84 bp, Homo sapiens
aaacttgagctgctgcagctggctcatgggatatctgagcaaggacaactgtataccctgaggcagctgaacagagaagggttt

SEQ ID NO: 6794181 - DNA, 98 bp, Homo sapiens
ggttgctaatgatatttttccatgtgggactctataagtcttgactggagggtagagggcagagagagtcctgagtggaaaaatggtcaggagagatc

SEQ ID NO: 6794182 - DNA, 116 bp, Homo sapiens
ttccattaatagagtaaatcacattgattgggtttctaatgcttaaccaagcttgcattcctgagataaacccaacttaatgaagatgtattaccctttctctaatattaatggaa

SEQ ID NO: 6794183 - DNA, 56 bp, Homo sapiens
tgcatgtgtatgcattcatacatacacatgtgtgtgtgtatgtgtatgcatgtgta

SEQ ID NO: 6794184 - DNA, 95 bp, Homo sapiens
ctttttacatactatttcatttgatcctcacaacaatcttaggaagtaagcactcttaattaaatttctaagtgaggataccaatgtgtagaaag

SEQ ID NO: 6794185 - DNA, 80 bp, Homo sapiens
gaatggcacatggagaatgtccaggccacttatacatagatttaagtagttaggaacattctctcttggtttatctattc

SEQ ID NO: 6794186 - DNA, 78 bp, Homo sapiens
atttgtgtccacgtccatgtttctgtgtgttgtgtgtatgcttgattgcacacagagaggtggtatgtcatcatttgt

SEQ ID NO: 6794187 - DNA, 83 bp, Homo sapiens
catttgcgaaagtgcaatctgatgagtaaagcactatgggaatatcatagtgcattttattatcagcaacatttttgtgaatg

SEQ ID NO: 6794188 - DNA, 72 bp, Homo sapiens
agtcactttatgagagaaccatgtaacacccagggtagttcactatggaatggatcatcttaagaagtgatt

SEQ ID NO: 6794189 - DNA, 105 bp, Homo sapiens
ggagggacacaaacattcagatcacagcaaatgctgcttctcaaatacaccatacacattcctgttttaggacctttgtgtttgctgtctctgggtcgttcttcc

SEQ ID NO: 6794190 - DNA, 96 bp, Homo sapiens
catgtgtctgtgtgtacccttgatttacatgtttgcacacatatgtaaggtatctgtgctcatgcatgtgaattatggttcatgtatggcactatg

SEQ ID NO: 6794191 - DNA, 77 bp, Homo sapiens
gggttgggcaagcagcagtacatataagactagtgtatcattagtttttatttctgtattttcttgacttgccactc

SEQ ID NO: 6794192 - DNA, 83 bp, Homo sapiens
gcatctttgtgctaatgtagttcttgctcctaagagctgcactcacggcccaatggggaaggacagcatgtaaacaaagatgc

SEQ ID NO: 6794193 - DNA, 81 bp, Homo sapiens
gctgtctccagcgtgtggtgtcattccaggttcagccagcagaattaagtggacaaatgaatgatgaacaccaaagatggc

SEQ ID NO: 6794194 - DNA, 65 bp, Homo sapiens
ggcgctcctaggaaggagtatagtaaatgcctcatttaataacatactcctttttgaaagttgcc

SEQ ID NO: 6794195 - DNA, 63 bp, Homo sapiens
aaaggggaatggagaaaatggcaggaagctgaagacgtgagccagccacatctgtaccccttt

SEQ ID NO: 6794196 - DNA, 60 bp, Homo sapiens
tacagacatttactccactccttctagggcacagtgctgcaggcagtgtagagatgagta

SEQ ID NO: 6794197 - DNA, 56 bp, Homo sapiens
agctcgatggcctgaatagggggtctaactctccccctgctttcaaccttctagct

SEQ ID NO: 6794198 - DNA, 63 bp, Homo sapiens
taggtctgaggctgcatcttggggacacacttggttgttcccatgtgcagggttcagcactta

SEQ ID NO: 6794199 - DNA, 79 bp, Homo sapiens
gggattttactgcagttggtttagaatttctaggggtaggaggtttcacctggagagagaggccaactgcaaagatctt

SEQ ID NO: 6794200 - DNA, 80 bp, Homo sapiens
acctcctgtggggtgtccattggcctaacctagtgggaagccagagagcaagggagggtgtgggtgcagcccatagaggt

SEQ ID NO: 6794201 - DNA, 63 bp, Homo sapiens
tggaagcaagtaaaattttactaggtggccttagagggaacccgtggttttatactacttcca

SEQ ID NO: 6794202 - DNA, 87 bp, Homo sapiens
agtgctgcatggtataaaagagtaaactatgcatcattattctaacaggaaaagtattgtttactgtgtactggattttgcagcact

SEQ ID NO: 6794203 - DNA, 68 bp, Homo sapiens
ggtcatggctatgtttggagtgttcttgtattaggtagagcagggaacaggctggagtagcacagacc

SEQ ID NO: 6794204 - DNA, 61 bp, Homo sapiens
gaagaacatgttaaaagattcacatttagaaattctggagtggggcccaggactgttcttt

SEQ ID NO: 6794205 - DNA, 94 bp, Homo sapiens
agcaatagcaagaagccctcttaatgccgagattgtagtttttctaagtagaatttcaaactaataggaaccaggacttcttggacaaatagct

SEQ ID NO: 6794206 - DNA, 101 bp, Homo sapiens
agatataactttgagtgttaaatactgtatcacttgtgagtgaaatggaatttaaatattttattacagaatgcatgtatttagtaatcgagtttatattt

SEQ ID NO: 6794207 - DNA, 56 bp, Homo sapiens
gagaggctccgccactgctcagggtcaaaagccctgcgctagaacccaagtctctc

SEQ ID NO: 6794208 - DNA, 91 bp, Homo sapiens
gttaagtggaattatgtagcagtgtgcaaaatctttaacagcaaatcagactttgttaaaaatttcacactgggtatgaaagagatttaac

SEQ ID NO: 6794209 - DNA, 57 bp, Homo sapiens
tgccaggacggtgaatgggctacctggggtggtggcccagaaacattcctgcaagca

SEQ ID NO: 6794210 - DNA, 56 bp, Homo sapiens
gctaagaaggccatatcagagaaaaaataacactctagatcatggtattctttggc

SEQ ID NO: 6794211 - DNA, 102 bp, Homo sapiens
tccatttgcataaggcatgaaaaactggttaggactgggtgtgccatgcatagtgcacgaaaaggctggccacccaccctaatctttcattaagcagatggg

SEQ ID NO: 6794212 - DNA, 90 bp, Homo sapiens
gagaggggaggacagagggaaggagagttgtagctgaacaaaagagccatgaaatgcttagctgttctctctttgccatactccctcatc

SEQ ID NO: 6794213 - DNA, 57 bp, Homo sapiens
ctcacctagtgatccgcccaccttggcctcccaaagtgctgtgattacaggcatgag

SEQ ID NO: 6794214 - DNA, 84 bp, Homo sapiens
tgaacaccttgactttcacttttctcaaagtcagtgcctccaccattaagtcaacattctgaaagagtgcaagtcaaggagtca

SEQ ID NO: 6794215 - DNA, 55 bp, Homo sapiens
cattcagctggcaggttctgggaaggcgggcctcttccctcatccccagttgttg

SEQ ID NO: 6794216 - DNA, 79 bp, Homo sapiens
gtccatctggagacttcctggtctgtatgttgtgtcattttgatttcttgttgaagggccatggagacttagaatgggc

SEQ ID NO: 6794217 - DNA, 61 bp, Homo sapiens
acaattgtggcaatttgtatgttttaacttgaacttattgtaccaattgccttctagttgt

SEQ ID NO: 6794218 - DNA, 65 bp, Homo sapiens
cttgaaaaagttatttttctgttatagacgatgattttcataacagaagatgaaacttctttggg

SEQ ID NO: 6794219 - DNA, 86 bp, Homo sapiens
tgtgtgtcttgagggcagtgaatctgagagcctgggatgcatgtttatctggcttatctcattagattctttgatcaaaactcaca

SEQ ID NO: 6794220 - DNA, 97 bp, Homo sapiens
tctgagctgtaacatttggcaggtttccttgctaacatttggcaataattgtttatcaaatgctaacaaggaatgctgccaaatgtaacagctccga

SEQ ID NO: 6794221 - DNA, 77 bp, Homo sapiens
gcagccagattcagatatggcagtgggctccttcgtgttggaaaggttgtgttgttccactccgtctgtctggatgc

SEQ ID NO: 6794222 - DNA, 104 bp, Homo sapiens
ggagggtatgtggaaagggtaacagcatgacccaacctatgtccttggcatcctcactcaaccaggcaataggttcctcatctttgaccctttggatgccttcc

SEQ ID NO: 6794223 - DNA, 69 bp, Homo sapiens
ttcaagatggctgcaaatacttgtacctaccttccattgagaagcggggtctttgcccccatccttgaa

SEQ ID NO: 6794224 - DNA, 76 bp, Homo sapiens
aggttctcagcacgtggtgggtggagaacgtgctgccctagtctcttcacactacccctgtgtacctgtggagcct

SEQ ID NO: 6794225 - DNA, 67 bp, Homo sapiens
cgctccccatttattcttgagtctgtttcacaatcatggaaagactctgtatcatgagggaggagtg

SEQ ID NO: 6794226 - DNA, 79 bp, Homo sapiens
tggacagatggtcatcgtttcaggtcgccctgatctggacaagaaccaaatgagggatccagaggcagtggtgtgttca

SEQ ID NO: 6794227 - DNA, 71 bp, Homo sapiens
gcagagctgagcaggtgtggagagtggtcgggtgcccagcgttgcccctccaccacgcgccggccgtttgc

SEQ ID NO: 6794228 - DNA, 60 bp, Homo sapiens
ctttggtgggggtatttctggcaacatattcttacactaggtattttaagtccaccagag

SEQ ID NO: 6794229 - DNA, 90 bp, Homo sapiens
atcaaggtgaatgggtaattagaaatcctactcttactgaatatagtttattgtcatgtcagatattttttggttgcccattttagggat

SEQ ID NO: 6794230 - DNA, 67 bp, Homo sapiens
tgagttgtagagttaggattggacattagaagttatccttgttcagtctcctcattttacaaattca

SEQ ID NO: 6794231 - DNA, 56 bp, Homo sapiens
tcattgccaaccagcatctttccctaatcggaatttatggctctgtttggcagtga

SEQ ID NO: 6794232 - DNA, 87 bp, Homo sapiens
ttaagcaatgagacaaacatgatttagtataatgcagggtgaattatcacatgcctgttaggtgctgattattttacttaagtttaa

SEQ ID NO: 6794233 - DNA, 73 bp, Homo sapiens
ggatttgactttgcctgctggccatgcagaggccaattcctgaattcctgctggccaagcagaggtcaattcc

SEQ ID NO: 6794234 - DNA, 73 bp, Homo sapiens
catgccgtatcaggaaatctccagtcaggccgcgttgtttatttagcctgctgaggcctcttggtatggtgtg

SEQ ID NO: 6794235 - DNA, 70 bp, Homo sapiens
atagtggtatttccaggcttatggtagatggcatagctggtatggtagagagcctggaaaaattgatagt

SEQ ID NO: 6794236 - DNA, 130 bp, Homo sapiens
ggaaatagtcttcactagtttcttctggaattaatcccctctggttccattagagtcagggaacaatctgtagtgtagcagggtgggacattgtattcttagacaaggccggctagaaggaagatgtacc

SEQ ID NO: 6794237 - DNA, 130 bp, Homo sapiens
gcttcttttagggaaaagataggtgtgttaagaataacttctaatctgtacagttttcattttcttttgtgaaaatgtgtgttatttagaaaatagttctctacagtacgagtttacccctgaaaaaggt

SEQ ID NO: 6794238 - DNA, 56 bp, Homo sapiens
tgctgagatctgctctacccaaaccagaaatgtggatggagccagaggttatagca

SEQ ID NO: 6794239 - DNA, 81 bp, Homo sapiens
agtcagccgggaggtgaacaggcttcttctgggctccttagtagaggggcacttctcaggctgtggacacttctgctgact

SEQ ID NO: 6794240 - DNA, 55 bp, Homo sapiens
ttatgtggggtggatgaatttgtgagtgaatcacatcaggtgtctccccaagtgg

SEQ ID NO: 6794241 - DNA, 81 bp, Homo sapiens
aacacaaggagagtcatttctgtagtcatgtttcatttcaaaatggagacgggaagaagagaaattgagtcatcttgagtt

SEQ ID NO: 6794242 - DNA, 81 bp, Homo sapiens
ggatcaaatggcatgcatatttaaaaagcattattggcttgaccaaattagcttccagtaagttgctgccatttgcagtcc

SEQ ID NO: 6794243 - DNA, 63 bp, Homo sapiens
gtcttctgctctccatacttccgcacctggaccctggggtgagggtggggtggggcatgaggc

SEQ ID NO: 6794244 - DNA, 69 bp, Homo sapiens
ggttctggaggagctgatcccactactgatgtttctggacaaagttagtgaagctcatcacagcgaacc

SEQ ID NO: 6794245 - DNA, 71 bp, Homo sapiens
gccgtacagaccagtagttctcagcgcctttgcttaccctgggttgctcagaagacttactggttactggt

SEQ ID NO: 6794246 - DNA, 56 bp, Homo sapiens
gcaccttcctgaatggattgttgtgaggattaactgcacacatacatgggaagtgc

SEQ ID NO: 6794247 - DNA, 64 bp, Homo sapiens
tagtcttcctggaagaagtgttctagactttgaaacactagtaggattcagttagagagggcta

SEQ ID NO: 6794248 - DNA, 89 bp, Homo sapiens
ttccaagggaaggcacatgacctaggcctggccaatcagcatattccatatttatggccaaagccaggttgatgtgtatcaactgggaa

SEQ ID NO: 6794249 - DNA, 58 bp, Homo sapiens
taggaatagtttaatagtgttccaaaaaaaggaatgttaaactattgaggtattcttg

SEQ ID NO: 6794250 - DNA, 61 bp, Homo sapiens
cagccctgctgccttagtgcctgcctgaatctcttgctccaggcgcctggcctcatggctg

SEQ ID NO: 6794251 - DNA, 66 bp, Homo sapiens
atagtaaataagataccctaagtcctggtatgaagtaccaggacttcattaggttctttgtattat

SEQ ID NO: 6794252 - DNA, 68 bp, Homo sapiens
gagagggaggaagggaggaagtgaagaaggaaagagaaagaacttttatcagccattccttacctttc

SEQ ID NO: 6794253 - DNA, 57 bp, Homo sapiens
cttctctcatagatggttttgcaggagggacactgcagacttccatcctgagagagg

SEQ ID NO: 6794254 - DNA, 80 bp, Homo sapiens
tagtcccgtctatggctgctacactacaggagatttagaaatttgtatacctgttgtttagcacttagaacaaggcactg

SEQ ID NO: 6794255 - DNA, 59 bp, Homo sapiens
ccagaggctggcaagggctcctgaaccagttgtcatttctatcttgccggtctcttagg

SEQ ID NO: 6794256 - DNA, 57 bp, Homo sapiens
acgagccttgaaggaaatataccaagatgttgacaactttccaattcaaggcgttgt

SEQ ID NO: 6794257 - DNA, 100 bp, Homo sapiens
ggtgtagctgatgctgttgctttgggtagcaaggctctaaatgaagtcatccgctcatccaggcttcagctgcctactgttcacaagttcatgctacacc

SEQ ID NO: 6794258 - DNA, 60 bp, Homo sapiens
ggactggaagggaagggaagaaatgaaagtcattgagaggtttcctttcattttagtacc

SEQ ID NO: 6794259 - DNA, 85 bp, Homo sapiens
ggttacgaggagagctgaggggctgctgggtccgcccctagccgcctggggatggactcagctggccgctcatgtcccctcttcc

SEQ ID NO: 6794260 - DNA, 114 bp, Homo sapiens
gtttaggatttttgatagtgaagtcatataaatttgtggccactgattctaagtctcactggagtcaaatgagtaaatatataagactgatcaccgaagtttaattatctgagc

SEQ ID NO: 6794261 - DNA, 56 bp, Homo sapiens
ggttcagggaaaaatcaggagaagtcccctaagccctcttggtcctccctgtgacc

SEQ ID NO: 6794262 - DNA, 95 bp, Homo sapiens
tggccaggatggtctcaatctcctgaccttgtgatctgcctgccttggcctcccaaagtgctgggattacaggcgtcagccaccgcgcctggcca

SEQ ID NO: 6794263 - DNA, 60 bp, Homo sapiens
gtggcagaggttcctcagtgtgggacatgcagcatgtggacacatgggacctctggccac

SEQ ID NO: 6794264 - DNA, 80 bp, Homo sapiens
gggataggggctgtggactggccctggtatgtgtactgaggtgatgagggtgtggcagtgccatgtctgagcccctacct

SEQ ID NO: 6794265 - DNA, 64 bp, Homo sapiens
ggatattccatgcagagggcacagtgaggccatgaggcaggcatgtgcctgctgtgtggaagcc

SEQ ID NO: 6794266 - DNA, 62 bp, Homo sapiens
gctgtccctttcacaaggttttgggaactaatgcttcatttcaagcttggggtgggaacagc

SEQ ID NO: 6794267 - DNA, 72 bp, Homo sapiens
tctacagaagtttggatgccatcatagggttgaaaccttattttggatccaccaaacacaataattctgaga

SEQ ID NO: 6794268 - DNA, 78 bp, Homo sapiens
aagggtctacactatgcagtgagaaaatggccagaacacttcgctcatcttccttcactgatagacactgtagctttt

SEQ ID NO: 6794269 - DNA, 108 bp, Homo sapiens
gcatccgtggtccagcttagctgaggggaggagaaggaagttgagccagcatcccacagaggaccctggcagccttctgtcctgagagctaagctgggccatggaggc

SEQ ID NO: 6794270 - DNA, 59 bp, Homo sapiens
ctgcctgtgtctgggtggccagagtataaaatattccagtcacaaaacatattaagcag

SEQ ID NO: 6794271 - DNA, 75 bp, Homo sapiens
catggaggtagtgagcagctgaactagaaatggaaccaaatgccctggttctagtcctcgaccctaaccttcatg

SEQ ID NO: 6794272 - DNA, 61 bp, Homo sapiens
agaagcagcagtaagactgagacaagggaaatctcttcaagtcagttaagttgctgaatct

SEQ ID NO: 6794273 - DNA, 104 bp, Homo sapiens
gatactgctctgtctgcctctttcacatttatctgttctttctagccagctatagagtttctctagaatcccaaatggactgggaagtcagacctggcagcttc

SEQ ID NO: 6794274 - DNA, 67 bp, Homo sapiens
gattcctcctctggagagaccctggaggctcatcatccacaaattctgggggtgctagggagggatc

SEQ ID NO: 6794275 - DNA, 66 bp, Homo sapiens
ctgataggctcctgtttgtttgttcctgacagcctgtttcctgttacataagcagagcctagcaag

SEQ ID NO: 6794276 - DNA, 68 bp, Homo sapiens
tacaaaaagtcgggagactagaagccctgttgtctcctctagcaggcttctgggattcccttggtgtg

SEQ ID NO: 6794277 - DNA, 56 bp, Homo sapiens
gctctgcaggagtgaaagcaggcctgattcatacagtttgcttatttctgtagtgt

SEQ ID NO: 6794278 - DNA, 125 bp, Homo sapiens
gtgttgtttctgggccattcagaggtcttcttgtaccctttaaagttttaccagcagattgtttaagcatcctctgtatgaagctcttagaatttcaaatggactcttatttttagaagcagcat

SEQ ID NO: 6794279 - DNA, 103 bp, Homo sapiens
cgggcatggctgtttaggggcagccccctcattctctgagctagttttgcaaaacttggtggggggtgagggtagttgcccacaggagcagtgaaatgagctg

SEQ ID NO: 6794280 - DNA, 65 bp, Homo sapiens
tggctcagagaatctctccttagtttaactattgttcaagactctccaggaggttgttggagtca

SEQ ID NO: 6794281 - DNA, 101 bp, Homo sapiens
atgattggctgattatattaatgtagttttagtggattcttagattttgctggttaaagccctctgtaaatctactaagagctcatataagtgccaattgt

SEQ ID NO: 6794282 - DNA, 64 bp, Homo sapiens
ttgcttgatgattaatgttaaatgtgagagttgggggctctaaaatttggcatagtttaagcaa

SEQ ID NO: 6794283 - DNA, 57 bp, Homo sapiens
ggtggcattgatccctcccagcctcctgcttccttgcttggtgggttccttgcgacc

SEQ ID NO: 6794284 - DNA, 70 bp, Homo sapiens
gcgcaccacctcctcctcctcctggcgcttctcgtagtgagcaaagtcgtcgaagatggaggttgtgtgc

SEQ ID NO: 6794285 - DNA, 58 bp, Homo sapiens
cccctttctcccgcgactggcccgccccgctgcgtgaggcttgcgtgggaggaggggg

SEQ ID NO: 6794286 - DNA, 65 bp, Homo sapiens
tagtgctttaggcctgagtgtcagttcaaacatcttcgatgataactaaatgcttagagcaacta

SEQ ID NO: 6794287 - DNA, 78 bp, Homo sapiens
gtagaagcataaactgtactttaaaaaggtatttgaaaataatgtatcaaaaggctttaaaatgtacatatgcttcac

SEQ ID NO: 6794288 - DNA, 79 bp, Homo sapiens
attcatcttgtaatcatgcatattactagcacagcatcttgcacatggtaagtgcttaatacgtatttgctggatgaat

SEQ ID NO: 6794289 - DNA, 83 bp, Homo sapiens
ctgaggccaacttctgggcatgctgagtagccagaagttttattcaccataatagaagcttttctcagtgtccttggtatcag

SEQ ID NO: 6794290 - DNA, 61 bp, Homo sapiens
caaagacacatgtctcttagattagggctgggacattccaatctaccccatgctgtttttg

SEQ ID NO: 6794291 - DNA, 127 bp, Homo sapiens
ggatttgttcccctggaatattatagattatattttatgttggaattacatcagtgtgcagagcagcagaaggctggcttaatgtagctaaaaatataccttgactttccacttggaatagaactcc

SEQ ID NO: 6794292 - DNA, 61 bp, Homo sapiens
ggccagagaagtcagacccttggtatttcatagcaaagcacggtcttctgcatcgttggcc

SEQ ID NO: 6794293 - DNA, 107 bp, Homo sapiens
ctactggagttcacttactatgttcaaggcagtgggctaggaaccttaaaagatatgaaggttaatcgtgaatcgcatgtctcctctggacacgtgaattcttgtag

SEQ ID NO: 6794294 - DNA, 78 bp, Homo sapiens
gaagagagacatgcattgagaatttctcagggatgaggatggccaaaagattctagagaactcgagtgcctttgattc

SEQ ID NO: 6794295 - DNA, 89 bp, Homo sapiens
tatgtaggaaagtttttgatgttggaggagagatgtgttttgaaatgttggaaatataatttctgcctcaataatgccctccctgcgta

SEQ ID NO: 6794296 - DNA, 86 bp, Homo sapiens
ggcttcctagggctacggtaacagataccacagactggtggcttccacagcccaagtttattgtctgtatcacagctccggaagct

SEQ ID NO: 6794297 - DNA, 58 bp, Homo sapiens
aggcagcctttttggaaacatagctgatcatttcagctctgtagatctgagtctgtct

SEQ ID NO: 6794298 - DNA, 72 bp, Homo sapiens
cataatcttaggcaccatttgccaagtgactcctctgtgttactgatggtggagctggtatttgagcctatg

SEQ ID NO: 6794299 - DNA, 65 bp, Homo sapiens
aacatgagcattcttgtgcttgcttcctggtgctaggtcataaagaatgagaatgttcaactgtt

SEQ ID NO: 6794300 - DNA, 70 bp, Homo sapiens
ctcctgagcaccctacctgccactgagagtgcccgactctctagtgtagtgcaggaaggagtgtggggag

SEQ ID NO: 6794301 - DNA, 93 bp, Homo sapiens
ctgctgtactcaactacatggctgcagttgtgtgaaggccgcccctcctaggctgtctggtcaacaactgagtgtggtgagagactaaggcag

SEQ ID NO: 6794302 - DNA, 60 bp, Homo sapiens
tcaagtttagtcatggtggtagtggtggtgatgtgatactgctgtctttgaagtgcttga

SEQ ID NO: 6794303 - DNA, 73 bp, Homo sapiens
tcttcaagctcccatggtttatggtaagggaagatctatcttcattggcttccatagatgcatatgatgaaga

SEQ ID NO: 6794304 - DNA, 56 bp, Homo sapiens
gagagacagcagaacgtgcagcaaactgttgctgtgcctccagtctcgcttctctc

SEQ ID NO: 6794305 - DNA, 60 bp, Homo sapiens
aaccctggctttccctaattctacagctaaccaaatagcctgaggggaagagtcggagtt

SEQ ID NO: 6794306 - DNA, 61 bp, Homo sapiens
tgcagggtaaaggagacggggtcaaaatctgctgacagtgcccagtgcctttgcccatgca

SEQ ID NO: 6794307 - DNA, 67 bp, Homo sapiens
gtccgttgacagggcacttgacactttatatcatagtagttttgtgaacttgtcagctaccaaggat

SEQ ID NO: 6794308 - DNA, 113 bp, Homo sapiens
taagagatcagagaggggtataaaaaatgctttgactatatctataatatttgatttattaatctgggttttgggtatagaggtgttcattatatttttctgtacatctttta

SEQ ID NO: 6794309 - DNA, 64 bp, Homo sapiens
cagacaccaagactgtagaacagtgttgtccaacagaactttctgcagtgttggaaatgatctg

SEQ ID NO: 6794310 - DNA, 60 bp, Homo sapiens
gtaaggctggttctcccctaagatatggttcttccatgtcagggcagctcccagcccaac

SEQ ID NO: 6794311 - DNA, 64 bp, Homo sapiens
tataccttgctaaattgttttctagaaagcttgaaccaagttctgcacattttagcaaagtatg

SEQ ID NO: 6794312 - DNA, 65 bp, Homo sapiens
ggaagaaacccagcagatcagaggggctattggaagaacaaaagcccctcatatctgctttctct

SEQ ID NO: 6794313 - DNA, 69 bp, Homo sapiens
tctgtgtgtggcagatagggtattaggagtaatgacaaaattattctgattgtatctgtaacatatgga

SEQ ID NO: 6794314 - DNA, 65 bp, Homo sapiens
gtggccacctctagcaaagctcagccctagctgtggctggagctgtgtcgtctagaaatggccat

SEQ ID NO: 6794315 - DNA, 55 bp, Homo sapiens
tctgcacctcctgcttgctagaagacccttattccccaggcagagaggtagcaga

SEQ ID NO: 6794316 - DNA, 55 bp, Homo sapiens
aggcgcagacatacagggtctgtcactcacccgtgctcaggtggctgctgcgcct

SEQ ID NO: 6794317 - DNA, 56 bp, Homo sapiens
agcaagtagtaccaagtagctcatgaactgttgggcaggtctctcagctgcttgct

SEQ ID NO: 6794318 - DNA, 58 bp, Homo sapiens
ttgctttggttttcatagctccactctggccagggggactcggtgaaaaccaaaacag

SEQ ID NO: 6794319 - DNA, 118 bp, Homo sapiens
agaaggacagaaaggttggatagtggttggttgacactggggctactttaatacgctgcacttgatttggctttacagtttgcaaactatttcacacaaattatcccatctgcctttt

SEQ ID NO: 6794320 - DNA, 55 bp, Homo sapiens
gtgacccaggtaggtaagcaatggtgagaacacgatgtgtccatcatctgggcac

SEQ ID NO: 6794321 - DNA, 84 bp, Homo sapiens
ccacaacccagaggagggatggagggagatggggttagagacaactggaagctttaacttcaagcttcgtcccttcgagtgtgg

SEQ ID NO: 6794322 - DNA, 64 bp, Homo sapiens
aagtctttgtgttctgatccaaaggccaagatatctgtggctatggcaaagaactcagattctt

SEQ ID NO: 6794323 - DNA, 64 bp, Homo sapiens
gccacttcaccacagtctcatctacgctgtgttagagggttagcatgtgctgtggggatgtggt

SEQ ID NO: 6794324 - DNA, 59 bp, Homo sapiens
ggccctgaggatttgcatttcctataagttcccaggtgatgctgatgtcctcaggaacc

SEQ ID NO: 6794325 - DNA, 64 bp, Homo sapiens
gccaacctcagtggcaagagcattcctcattctgaatagtgcctgtgaaaaccctggggttggc

SEQ ID NO: 6794326 - DNA, 78 bp, Homo sapiens
ttgtggtaatggcaaccatatgggctggtgactgctgtcagtaaaaatagcccacatggcctgtgtggccagacacaa

SEQ ID NO: 6794327 - DNA, 57 bp, Homo sapiens
aagagagaacacagcttgggcaaaagccctgagtcagaaacatgtggacttattctt

SEQ ID NO: 6794328 - DNA, 72 bp, Homo sapiens
taatgtctttaagagcattgggtggaaaagagatgtaccaacacacacaatgttctgcacatggagtcatta

SEQ ID NO: 6794329 - DNA, 56 bp, Homo sapiens
cctcagagctcttcctcctgtccatgggactttcttggaagccagcatccttgagg

SEQ ID NO: 6794330 - DNA, 56 bp, Homo sapiens
tcaaaggctgcttgtcttctgggtcacgttgtttctttgacaggccatgcttttga

SEQ ID NO: 6794331 - DNA, 75 bp, Homo sapiens
gtatttgttcttctctagagaagtggaatattctgttccttaggaaggaccacatcaggaaaagcagacagatac

SEQ ID NO: 6794332 - DNA, 78 bp, Homo sapiens
tgtttctttcaggataaaatgtaatggcaatggctttgatgtctttgtcttgctttatccttccttctttaagaagca

SEQ ID NO: 6794333 - DNA, 75 bp, Homo sapiens
tatctgcgaaccacagtgctttgtcaaagcagtccagtaatgcagtgctttatcaaagctatagtgagcatggtg

SEQ ID NO: 6794334 - DNA, 79 bp, Homo sapiens
aatgtcctgtggtttcattcttacaatgttagaaattctttaattagttacaggtgttgaatgatgtcacatgggcatt

SEQ ID NO: 6794335 - DNA, 76 bp, Homo sapiens
tttgggaggctgaggcaggaggattgcttgagcacagaaggtgactcgctcccttttgtcttatttccatcctgaa

SEQ ID NO: 6794336 - DNA, 66 bp, Homo sapiens
tgtctccactatatcaagctgccttcatggggaagaagcagggggcagtaaggatatggaaagaca

SEQ ID NO: 6794337 - DNA, 66 bp, Homo sapiens
gatactttgtggaatcctggatgaggaggcacagaaatactcccaccatagttataacaaagtgtt

SEQ ID NO: 6794338 - DNA, 72 bp, Homo sapiens
agactctcaagagagtgctgcttggggttcgactgtgttctttagaactccatttttcaaactttagagttt

SEQ ID NO: 6794339 - DNA, 56 bp, Homo sapiens
tatccagttcactccttagtatgcgagccaacgcacactctgaagagtcctggcta

SEQ ID NO: 6794340 - DNA, 71 bp, Homo sapiens
tgatcaaagcgactgcaggttaaaacaagcatgcagagcactttcagaatcttgagcagtcgttggtatca

SEQ ID NO: 6794341 - DNA, 84 bp, Homo sapiens
tctcccagcttctgagggcctttgcttccaattgactgcacttgatcattttctggacggctgccttcagaacactggagtgga

SEQ ID NO: 6794342 - DNA, 62 bp, Homo sapiens
tttcctcacagtgcagcttctccaaagagatctggagaccccccagcagctttgacaggaaa

SEQ ID NO: 6794343 - DNA, 73 bp, Homo sapiens
aggctggagtgcagtggcgtgatctcggctcactgcaacctccgcctcctgggttcacgccattctcctgcct

SEQ ID NO: 6794344 - DNA, 99 bp, Homo sapiens
atgtcaaaaaggtagtggataaattgtgctgctataggattaagcatattgtttcttgctagattctgttcagtggatttctgttttcttgttaggcat

SEQ ID NO: 6794345 - DNA, 59 bp, Homo sapiens
ggatggtggagtaacattgcctaggttcacctcccaccctggacagttactttatctct

SEQ ID NO: 6794346 - DNA, 78 bp, Homo sapiens
tagtagtggaggagatcaagcactttagtgagaataagggcaatgtctcttttctctcaaattgcttgccttatgcta

SEQ ID NO: 6794347 - DNA, 57 bp, Homo sapiens
tggggaaggcggagcttgcagcacctgggatgcaccggttcagccctgccgttccca

SEQ ID NO: 6794348 - DNA, 55 bp, Homo sapiens
ggaggcctgggctctagatctctcacatgctgtgtgaccttgggcaagtgccttc

SEQ ID NO: 6794349 - DNA, 64 bp, Homo sapiens
gaaggagagggtcaaggataataagcaatactaattttcttctgtttcttatcccctcttgttc

SEQ ID NO: 6794350 - DNA, 66 bp, Homo sapiens
agggacccagcccagaatctggggcctctatacattgattgggttccagagtgggctgggaaacct

SEQ ID NO: 6794351 - DNA, 119 bp, Homo sapiens
aggacttcaatatttacaggtgtattaggatgttcctatgcacattaaaaacagaaaaccattgctctaggaaccatgcacataggaacatcctaatatgcctgtaaatattgaagcct

SEQ ID NO: 6794352 - DNA, 58 bp, Homo sapiens
gaactggtcttttaggttttctgaaaatgctttgaaagctcctgggaattaccagttt

SEQ ID NO: 6794353 - DNA, 90 bp, Homo sapiens
agcatagggcagcaggaggaggagagtgggcctctgagtcccagccccaggtctgatctcagccccgcgcctcagaagctgctcagtgtt

SEQ ID NO: 6794354 - DNA, 71 bp, Homo sapiens
ctaaatggaaggcatgaaagcgaaatgagattccagtttctcagtgagcttttctatgttctaacgtgtgg

SEQ ID NO: 6794355 - DNA, 90 bp, Homo sapiens
agatcagcaacgccaggctgactcccccggccttatcttcttggcctgcccattggcccaggtgggggactcaactgcgctgctgcttct

SEQ ID NO: 6794356 - DNA, 89 bp, Homo sapiens
cctgcctatgctgggaagggagtctctgctctcattccctgttaaacacagagaagagagccgcgggacatcagcctccagaaggtagg

SEQ ID NO: 6794357 - DNA, 79 bp, Homo sapiens
agatggaggactgtaggtaaaagcatctagtgtatgatggccatagcagatgttcgatagcttaattactcctccctct

SEQ ID NO: 6794358 - DNA, 57 bp, Homo sapiens
gaagggtgctggaatcagaccgaaccgttggtttgaacctgagcttctgcatgcttt

SEQ ID NO: 6794359 - DNA, 81 bp, Homo sapiens
actctgaattatggatttctgagacttgagattaatttcctcaaatgcaagaagttaataagtggcagaccatgacagagt

SEQ ID NO: 6794360 - DNA, 82 bp, Homo sapiens
ttctcaggcagtatgtccttcctcgttggcagcactttctgctgaacctgccagtgaaatgaagcctatgactttctgggga

SEQ ID NO: 6794361 - DNA, 74 bp, Homo sapiens
cagaccacagcaccactggtccttaagcattcctcctaaaacatgttgtcacatcaggtggtggctgttcactg

SEQ ID NO: 6794362 - DNA, 63 bp, Homo sapiens
agctgtttccataaatgagacacagaggcctgaaaactctgtttagtactcaggggagaagtt

SEQ ID NO: 6794363 - DNA, 55 bp, Homo sapiens
ggactccagcctttgagtccttgggaacccagaaggacctgagagttggaaatcc

SEQ ID NO: 6794364 - DNA, 55 bp, Homo sapiens
tacaaagaggtaattgcatatagattagagaagtccagtgtattccctttttgta

SEQ ID NO: 6794365 - DNA, 57 bp, Homo sapiens
ccaccctgccttgggccagtgactggggccagtgactggtctgtgtggagggtttgg

SEQ ID NO: 6794366 - DNA, 78 bp, Homo sapiens
tttcaagtattatctgtttgcgcttctgggtttagtaaacatcgtaactgtccatagcaagaggagcagaaattgaaa

SEQ ID NO: 6794367 - DNA, 71 bp, Homo sapiens
agtcagggccctggcaggaaacagctgacgcactgaagctgtttttttgagaagggcttaacaaagagact

SEQ ID NO: 6794368 - DNA, 83 bp, Homo sapiens
gaagtagagaagataagtaacgagcctcagttctcataggtagtaagaggcaaagctgggattcgaacttgtttttctgattc

SEQ ID NO: 6794369 - DNA, 74 bp, Homo sapiens
gcatgtggtgctctcagaagtaacttgtccatgatcacaaaccagtaagtggcaatttaattttgaacacatgt

SEQ ID NO: 6794370 - DNA, 96 bp, Homo sapiens
ggtacagggaacaacattcacccaggcctttcttcttggtctgcattttgcaacccaaagagtgagcgcctctgtaaattttgtactctaggtgcc

SEQ ID NO: 6794371 - DNA, 58 bp, Homo sapiens
gcaggcatatgatggaactgggatttaactaaaggtctttcttaattcaagtgcttgt

SEQ ID NO: 6794372 - DNA, 62 bp, Homo sapiens
aagtaaaagctaagttatgtctacctgccggtgagctgacagtgtgacaaaacttattactt

SEQ ID NO: 6794373 - DNA, 57 bp, Homo sapiens
gtctctcaaaactagaagagaaaggtgttttttccacatcagtctagttttgaagac

SEQ ID NO: 6794374 - DNA, 58 bp, Homo sapiens
gtccctcccacctttcactgtcactcatggggagggcagtgctggagatgggtggaac

SEQ ID NO: 6794375 - DNA, 56 bp, Homo sapiens
gctgccctgtccggctctcctgcaacacaaaacaagggaagggtcagtcgggcagc

SEQ ID NO: 6794376 - DNA, 65 bp, Homo sapiens
ggaaagtaacatgctcttgtcttggctaattcgtagctgttagttgagcaacaccgtttatttcc

SEQ ID NO: 6794377 - DNA, 58 bp, Homo sapiens
tcaccattggcaattataaaacttcactatagaaagaaaatatagatggcagtggtga

SEQ ID NO: 6794378 - DNA, 82 bp, Homo sapiens
gtttttttctattagatgtttcaaaataggtggattaaatgaaatttgttcatctgtgtgttattgtttatcagagaaaaat

SEQ ID NO: 6794379 - DNA, 59 bp, Homo sapiens
cagcctggcacccttcttcagagctcctcccaggagccctggccttggggcacaggctg

SEQ ID NO: 6794380 - DNA, 72 bp, Homo sapiens
gcttgagcccgggaggtggagactgcagtgagccgtgatcacgccactgtactccagccttggtgacagagt

SEQ ID NO: 6794381 - DNA, 96 bp, Homo sapiens
ctgttattttttacatctaaactgtgaacaattagagtatcaattcttatatgaaagagtgaccattgttacagattggcatgtaatgttgagcag

SEQ ID NO: 6794382 - DNA, 77 bp, Homo sapiens
ggttttgatcttgtggtccttgaatgtatggaattggactaaccacaatcattgcttcaggacctaccatcattact

SEQ ID NO: 6794383 - DNA, 71 bp, Homo sapiens
ttgtcaatcagaaatcatgttacaagtggctctcctatcatatccatgtgtaacagagcactgattgacaa

SEQ ID NO: 6794384 - DNA, 74 bp, Homo sapiens
gcttagagcaccattagcgttgggccggtgccacagagcaaataggactgagccccatctgaggtgcccagagt

SEQ ID NO: 6794385 - DNA, 62 bp, Homo sapiens
tcgtgatgcagtgtcctcccatgcacagtgattctcagttcatggacccaacattgctatga

SEQ ID NO: 6794386 - DNA, 103 bp, Homo sapiens
ggcgactgtggagcggggatgtgctgctggccgctgcactcgctcctctgccgccgccgcacgaggagcgccggccgcgtcacagcccgccctcgcgctcgcc

SEQ ID NO: 6794387 - DNA, 72 bp, Homo sapiens
tctgacaatgaacaatctatagttatatcctggataagcctagtcaaactcaaagattggttagatgtcaga

SEQ ID NO: 6794388 - DNA, 58 bp, Homo sapiens
ggtttagatgattttcagtcaaagcaattctattgtcacctggaaatcactctaattc

SEQ ID NO: 6794389 - DNA, 82 bp, Homo sapiens
aattgcagcattctctggttgggaggttggctttcagctaaaaacgttaagttggaaactatcctcacaactagaagcagtt

SEQ ID NO: 6794390 - DNA, 90 bp, Homo sapiens
cacccttctcccaggacatgggctctgctcacctaaccttacacagccatgaggcactttttgggcagtgcctttctgggtgagagggtg

SEQ ID NO: 6794391 - DNA, 76 bp, Homo sapiens
ccattattgcaaagcgtagactctaaacatattattagcatcaaaaaatgtttgttttgtatctttgtattaatgg

SEQ ID NO: 6794392 - DNA, 81 bp, Homo sapiens
tggggttgggctcagccagtagatcgggaggatgtaggatattgtgccaacatagcttcaatctattggctagcaactcta

SEQ ID NO: 6794393 - DNA, 100 bp, Homo sapiens
agacacttctaaggtgtgaactctgtgaatttacaaagaggcaacagctctaggatagagactgtggctctttgaagggaaaatctactttgaagtgtct

SEQ ID NO: 6794394 - DNA, 64 bp, Homo sapiens
ggtgccatcctgagaggtctctctaccatgagtggtctgtaggtagtgagttcaggagggcagc

SEQ ID NO: 6794395 - DNA, 58 bp, Homo sapiens
tctggatgagctagatccaatgctacctcctccaggaagccctcattggttctccaga

SEQ ID NO: 6794396 - DNA, 66 bp, Homo sapiens
gaggtagaccctgaggcaaaggctagagttagtggtttggctccagtttgtgccttcagctacttc

SEQ ID NO: 6794397 - DNA, 115 bp, Homo sapiens
gctcaccatcgattatatctagcaactggcctcagtggctttaggagttcagggtagcctgtcctcttgctcattggggcagatcagtgaggcattgggtgaagtcctggtgggt

SEQ ID NO: 6794398 - DNA, 89 bp, Homo sapiens
agcaagttgtagctgaactgcattgtactaaacttgtcgttaaaatattgataacaggcaatgtagttgtgttatagctatattttgtt

SEQ ID NO: 6794399 - DNA, 81 bp, Homo sapiens
cagtggtactctcagatagttctttgggaagtttaaattggcacaagcactttgaagagctttttgacacatgtattactg

SEQ ID NO: 6794400 - DNA, 59 bp, Homo sapiens
cagaaacttcttgtctcacagttctggaagccagcgctgcactcccccaagaggttctg

SEQ ID NO: 6794401 - DNA, 117 bp, Homo sapiens
caagagggaaagtgtgagattttggaaaatatatgctctgggatcctgaaagccaaaccttctcttttcacaaactcagggtgtgtgacatcttcagaatcaaatgagttctttttg

SEQ ID NO: 6794402 - DNA, 82 bp, Homo sapiens
cctgcatggatttgatagctccttccttcctgtaaggcacttaggctcttaagggaggtaaagctatttaaataatgaatgg

SEQ ID NO: 6794403 - DNA, 89 bp, Homo sapiens
aggttctattatccttttcctttgggtgccctttcagggaatgattttgaaatggaacccagggtcccgaaggagacagcaatatccct

SEQ ID NO: 6794404 - DNA, 74 bp, Homo sapiens
cacttttctaacagatgacaagagtgttcagggagaggtgtttcttcaccttttttttactcttctcaaaagtg

SEQ ID NO: 6794405 - DNA, 71 bp, Homo sapiens
agcagttgagtttgtactttttcacaggtagtacattcactgtatgaaatgtaactataaaattaattgct

SEQ ID NO: 6794406 - DNA, 65 bp, Homo sapiens
acaccaaccctgtgaggtctgtttcctcattttgcagataaggaaaccggagctcagagaggtgt

SEQ ID NO: 6794407 - DNA, 78 bp, Homo sapiens
ggatgctatgatacatgttcagttattctggaagactttataatgtttgcttagaatctggacttgttgatagtattc

SEQ ID NO: 6794408 - DNA, 75 bp, Homo sapiens
gacacaactggagctctgttgctgtggcacaggaaggctcgataagatctcccagccacagcattcttttgtgtc

SEQ ID NO: 6794409 - DNA, 76 bp, Homo sapiens
aacagttgtcaccagctgctcctcaggaactgcttgacttcttagcaaatctttaagatcacttggtgagattgtt

SEQ ID NO: 6794410 - DNA, 78 bp, Homo sapiens
gatgcagtaaaatgctagttaatctgcagagcccaggcaaacccagtgttgtcagtattaatttcacactactgcatc

SEQ ID NO: 6794411 - DNA, 127 bp, Homo sapiens
gatacatgaaactatttaaaacggctttacgtctcagaagaatttaatccttcaaagtaatataattttgaataaacggttaatgttcattttaagatggattttagagtttgtagtcatatgtatt

SEQ ID NO: 6794412 - DNA, 111 bp, Homo sapiens
catttgatgcgcaattctcattatcctttagaaaattcattcctcagactgccaagaggctgctggcagatgtagtttatattaaacagatggttagtctgcaattaaatg

SEQ ID NO: 6794413 - DNA, 61 bp, Homo sapiens
tcaagacagggtttaaggttgagagtttggaactactcacttcaacctggctctgccttga

SEQ ID NO: 6794414 - DNA, 98 bp, Homo sapiens
ggaagtcctcttggcgttggtcatctcatctacttgccacaggcagggctgtacctcctttggccctgagagatgattatggtaagtggcccacttcc

SEQ ID NO: 6794415 - DNA, 63 bp, Homo sapiens
gggacctagggctttctggaatacagtttgaaaatcagtgtgtcctgtgatctctagggttcc

SEQ ID NO: 6794416 - DNA, 75 bp, Homo sapiens
gcagagctgggatatgacctctgtctgacaccagaaccttctgtgttgtactacctctcgtattaggggctctgc

SEQ ID NO: 6794417 - DNA, 77 bp, Homo sapiens
agggagagcaactagtcccagatgacccagctactaattgacaaagcagaaaactggagtctgggactttctaccct

SEQ ID NO: 6794418 - DNA, 65 bp, Homo sapiens
gtgggggcatcgtgtggctccttttcaggaggctgccgtgcaccttcaaaggagccattccccgc

SEQ ID NO: 6794419 - DNA, 62 bp, Homo sapiens
gtcaccgagtgacagtagccatcatggctcacaacagccttgacttcctgcactcaggtgat

SEQ ID NO: 6794420 - DNA, 84 bp, Homo sapiens
gggaggccaccaggtctcttttgtcacaccactgaaaaatataagtaagcagtgatgagttactcaagaatcttaaggccttct

SEQ ID NO: 6794421 - DNA, 117 bp, Homo sapiens
tggacttgggcacattattgagtctctgagcctccatttcatagttgtcacaataaggagaaacatccttaagtcatgctgtaaatgtgaaaggagatgtgatatgtaaaaggtcta

SEQ ID NO: 6794422 - DNA, 68 bp, Homo sapiens
atcatgttgtatgtaatcttttgggacttttttttccacttcatgtaagaatacgtatcaacaatggt

SEQ ID NO: 6794423 - DNA, 102 bp, Homo sapiens
gaccagggtttctcagcctcggcactattgacatttggggctaattattcttttgtgggggctgttcagtggattgtagaaggcttagtagcatccctggtc

SEQ ID NO: 6794424 - DNA, 56 bp, Homo sapiens
tcggccactgttgctagacagagctgtcactgagtacgctgttgagatgtggctga

SEQ ID NO: 6794425 - DNA, 64 bp, Homo sapiens
gttttggttggtgcaaacatttagcctccatgacacatgtttccaaaagcaccctggccagaac

SEQ ID NO: 6794426 - DNA, 95 bp, Homo sapiens
ccaatagaagggccacactgcaggccacaggattgcacagcatgcggggctgacatgctgctgcagtacttgctgtgttcagtggccctttctgg

SEQ ID NO: 6794427 - DNA, 61 bp, Homo sapiens
gcctctgcactgtggcacaccactgacattaaatccagtcatggcctaagtggcatgaggc

SEQ ID NO: 6794428 - DNA, 55 bp, Homo sapiens
agtgtggtcttcgagcagaggtgttcatattttatatctctggatgacagacact

SEQ ID NO: 6794429 - DNA, 102 bp, Homo sapiens
agtgctttgtcaagtgcctggcacatagtaggtgcacagtaaactatagttacttttctgcgttattgaacatctggtatgtgttaaataacttgtctgcct

SEQ ID NO: 6794430 - DNA, 60 bp, Homo sapiens
gctctgggtgaacttggagcaaataaccagagaaatagcttgtctccaaggccacagagc

SEQ ID NO: 6794431 - DNA, 71 bp, Homo sapiens
catggtattaggttgctagagctgccatagcaaagtaccacagacttggtggtttaagcaatagtatcttg

SEQ ID NO: 6794432 - DNA, 58 bp, Homo sapiens
tcaaacatgttagcagtctgtgtgtacttattatacatgcagtagtgttcatgtttga

SEQ ID NO: 6794433 - DNA, 129 bp, Homo sapiens
ttgaaactggcacaaggtgcagtggctcacacctgtaatctcaggactttgggaagctcaggagggaggatcctttgagccctgcaggtcgaggtttcagtgagctacggctgccccgctacactccag

SEQ ID NO: 6794434 - DNA, 55 bp, Homo sapiens
gcacccagaggtcagcagtgctttcataaaaaggagggctgctcgtagtgggtgt

SEQ ID NO: 6794435 - DNA, 85 bp, Homo sapiens
gagcttgttcccatcccagagtgagccaggggcaggtctggaaccaggactgtttctcctgccacctgggccaggacacgtgctc

SEQ ID NO: 6794436 - DNA, 88 bp, Homo sapiens
gagggtggcaaataggcaaggtaagtaggagcagccctcgaccatctcagatcagcttcttcagcctaccttgacctctgcctgtctc

SEQ ID NO: 6794437 - DNA, 63 bp, Homo sapiens
tagtattatttgaatgatggcacaatttttaaagaagaattgtgcatttttaaatcacggcta

SEQ ID NO: 6794438 - DNA, 98 bp, Homo sapiens
acgtgcttgcatccttggctttcggggtgaggggattgaaaagactaatctttaagatttcttctcctgagagcaatcctaggactctgagaccacgt

SEQ ID NO: 6794439 - DNA, 84 bp, Homo sapiens
tccatgggtacataatgagctagttaagtttaggtgtctgtgagagatgtccagcaagtggttgataatatgtattagcattga

SEQ ID NO: 6794440 - DNA, 56 bp, Homo sapiens
tggttgggcacttatcgaaattgaggggcatcttcagcgtttaggtagttttccca

SEQ ID NO: 6794441 - DNA, 71 bp, Homo sapiens
ggagcaggaggtggcctctcttggaccaagtgcggcgaattcattccataagcaggttcttcctgaactcc

SEQ ID NO: 6794442 - DNA, 89 bp, Homo sapiens
tttggggggatagcagtggataaaacccttctggaaagtagtctgctaatatctaagaagggttttaaatattttcttatctttttaaa

SEQ ID NO: 6794443 - DNA, 66 bp, Homo sapiens
agggctgctcctttgtcagctggaggtgcggagagtcttgtctgggctggcactgaggagagctct

SEQ ID NO: 6794444 - DNA, 79 bp, Homo sapiens
gtcacatgtacaggctttagccaatcactgtggtcagaggtaggctatgttttgattggttaggtctgagtcacgtgat

SEQ ID NO: 6794445 - DNA, 76 bp, Homo sapiens
tgggagagggaactcagtattgacccagtttgttctctttgaatagcactgggcattttgaacgttctttcttgca

SEQ ID NO: 6794446 - DNA, 56 bp, Homo sapiens
atatagagagagagagagagactaggcaagatgagggctgtctctcctttctgtgt

SEQ ID NO: 6794447 - DNA, 67 bp, Homo sapiens
gttgtcctccacatggcctctccacgagcccaacctagccacacggagaagccatgtggtggagaac

SEQ ID NO: 6794448 - DNA, 71 bp, Homo sapiens
gtggctggcagcccaggacacaggcctgcaaaaacccataaggctctttagttgatggcctgcctttccac

SEQ ID NO: 6794449 - DNA, 62 bp, Homo sapiens
ccccaaaggggatgctcagtgcaggggtgaacacagcctgcactgagaccctctttgctggg

SEQ ID NO: 6794450 - DNA, 78 bp, Homo sapiens
gtccccggctcctggattggctgcccatgctcaggatggtctggggtgtggccgtggcctgtccccgggccggatggc

SEQ ID NO: 6794451 - DNA, 58 bp, Homo sapiens
gttcagtggtgtatccccagtgcctaaaacattgcctggcaatacacatttattgaac

SEQ ID NO: 6794452 - DNA, 61 bp, Homo sapiens
tttcctccttcctgccccccactcatccctccacacctgagtcttggcaccaggagagaga

SEQ ID NO: 6794453 - DNA, 60 bp, Homo sapiens
ctgcgcgctggcgtcacttagcaaccgatcgacagcgggctgctgggtccggcgatgcag

SEQ ID NO: 6794454 - DNA, 60 bp, Homo sapiens
tggtggagcaggactagctgagaatccagagactgtgttctgcttcctgcttctctccca

SEQ ID NO: 6794455 - DNA, 74 bp, Homo sapiens
agatgcagctttccatttccaggttttagaacagtgctgtttaatggaacttcatgagattatggaaatgttct

SEQ ID NO: 6794456 - DNA, 78 bp, Homo sapiens
ataagtgctcatgaggcttaattatcagtgaaatgtcttgctttagatttcacagcttaataaggctcagaggcttat

SEQ ID NO: 6794457 - DNA, 130 bp, Homo sapiens
gtttgcctgtgtgtgtcaggcattattctataatcctggaatacaagagtgaaccttggtcttatagcattatattccaggaaggtaagacataataagacattaatattataaatacataaaagtacac

SEQ ID NO: 6794458 - DNA, 60 bp, Homo sapiens
gctaccatattagaaagcacagctctggatagtttccgagaggtgtaaataaatggtggt

SEQ ID NO: 6794459 - DNA, 129 bp, Homo sapiens
ggcggatcacaacattgaacataactattgacacaattcattgccagaatctatgataattttccacacattttcttgtctatggagtttgaatgagaaaatccatcaatggcctaccaatgcatcgcc

SEQ ID NO: 6794460 - DNA, 76 bp, Homo sapiens
tctgattggctatgaggagcgcaggtgtattaaacattttcagtaagcttttttctcctcaatagcaaaaattaga

SEQ ID NO: 6794461 - DNA, 57 bp, Homo sapiens
gccagctgaaatttcagttctgttattttatccttaggtgatgggctttcagttggc

SEQ ID NO: 6794462 - DNA, 92 bp, Homo sapiens
tcttaatttcatgctgaagagtgtgcttagagagctgcattaatttccttctaatgttgttttttcataaagtatgagcaggaaatgtgtga

SEQ ID NO: 6794463 - DNA, 70 bp, Homo sapiens
ccgtcggtcatcccagtcttcagcaagcttgactggagcaagtgctatgccaggcgtggggtgaccgtgg

SEQ ID NO: 6794464 - DNA, 66 bp, Homo sapiens
gctttttgagagtattcacttagtcatccaactggtgacaaagtcaacagtactctcagaaccagc

SEQ ID NO: 6794465 - DNA, 55 bp, Homo sapiens
gccacaggtaggaacctacctcctgaaaggctggtgctatgctttacctgtgtgc

SEQ ID NO: 6794466 - DNA, 59 bp, Homo sapiens
gagccctgcttccaagggggcagaaggcaccttgccttatgcctccctgagagcagctc

SEQ ID NO: 6794467 - DNA, 82 bp, Homo sapiens
atttccccctgcttcttttcctgctatgaacacttattgaatgcttgtgtttacaaagcgttgagacaagtacaagggagat

SEQ ID NO: 6794468 - DNA, 82 bp, Homo sapiens
ggagggggctgggggtcaggatgaggccttgggcttggcccaggctcttccctctggccaagacttgtccagccccacctcc

SEQ ID NO: 6794469 - DNA, 60 bp, Homo sapiens
gtccatgccctcaagcagcatcaaagcaactgaaacagagctgcaaaggcacacttgggc

SEQ ID NO: 6794470 - DNA, 56 bp, Homo sapiens
ggtgatgatttccctgctcactgtatacagaacacagtgactatgacattattacc

SEQ ID NO: 6794471 - DNA, 100 bp, Homo sapiens
gccagagtgccacgtggggtccagcatttgctgagtgttaccggacaccgtgctaggtgatgtgatcccattagtaatacttgtgagcactttataaagc

SEQ ID NO: 6794472 - DNA, 56 bp, Homo sapiens
cagcattgtctccaagcaggtctctgccgacggaagacgctgacagacgattgctg

SEQ ID NO: 6794473 - DNA, 90 bp, Homo sapiens
gtgatacatttgcagaaggggtgggaatgtggctttgtccgtatttccaaatgtaaaacaggtctcccatcccctctgtttggttgtggc

SEQ ID NO: 6794474 - DNA, 88 bp, Homo sapiens
cactgacagatgacatggccctttgacagtgacgcctgtatgagctgacagctccacttgcagtcagtcaagtccatgctttgcagtg

SEQ ID NO: 6794475 - DNA, 74 bp, Homo sapiens
ccctggagaattttgtcaccagacattgtaattatgtttttagatgatgtcacatgtgtggcatttttccaggg

SEQ ID NO: 6794476 - DNA, 58 bp, Homo sapiens
cccaagatctttcgtgcactaaatgtctggtgtttgtaatacaatgaacaattttggg

SEQ ID NO: 6794477 - DNA, 57 bp, Homo sapiens
tctgccacaggcagcagaaaacaaatggttgggattcccatctttgccagtggcagg

SEQ ID NO: 6794478 - DNA, 100 bp, Homo sapiens
tcaaattttgtatcaaaatttaaagtctagtgtagcatgacctttaataatcattgcagttcttcatgtatgctttgattttagatgtttgataatttga

SEQ ID NO: 6794479 - DNA, 77 bp, Homo sapiens
tttaggtcagtggtcaccaaagctgatccacaggttggatgcagcccatggtgaggttgttggtgccctgtggtaga

SEQ ID NO: 6794480 - DNA, 99 bp, Homo sapiens
gctgcctgggctgatttctctactgcatgggatagggtggggaggattatcacaccctctctaacctgcatggcagctagaagggaggggcaaggcagc

SEQ ID NO: 6794481 - DNA, 58 bp, Homo sapiens
tgatcagtagcagaaagcaatgagtgtctgtacagttacttaactttgttgcttatca

SEQ ID NO: 6794482 - DNA, 99 bp, Homo sapiens
ctgatgtatgaggcctcccctctatccttatctgtctggtcgagtcattctgggctgactgggcaccatcatgagatgggcaggaggtctcatcattgg

SEQ ID NO: 6794483 - DNA, 89 bp, Homo sapiens
cagtatatgcagcaagtggacatttagaatggcacagttatccatataggaatattgttgaggcagttcatcttgttgtccctatagtg

SEQ ID NO: 6794484 - DNA, 55 bp, Homo sapiens
aatgtgcagtacctgcaaacaaggtactttagccactgactgcccgctgtacatt

SEQ ID NO: 6794485 - DNA, 90 bp, Homo sapiens
gcaagagggacagaggagcaggtggacagaggaagaaagtgaatcctcttgagaagagtttccccctttgttactttcactgtcctgtgc

SEQ ID NO: 6794486 - DNA, 98 bp, Homo sapiens
tgggagtcctattgaggtttaagggtgtgtgtaatcatgtgtatgtgtacgttatgcatatatgtgcagaccacttgaggatcatccaagtgcttcca

SEQ ID NO: 6794487 - DNA, 68 bp, Homo sapiens
gggagggccaggctcacccagggcatcacacggtctcagagcccctgcagggagagccaggctcaccc

SEQ ID NO: 6794488 - DNA, 58 bp, Homo sapiens
gggtgggtgtcctgtgaaggctcatgatctatgtgagcagagcaggctgcgccctccc

SEQ ID NO: 6794489 - DNA, 65 bp, Homo sapiens
tacacagatgggtagaaaacagaagtccacagcctatgaattctctttttactgtctgtctggta

SEQ ID NO: 6794490 - DNA, 60 bp, Homo sapiens
gggccctgtgtttgctggcttctcggcatctgcagctcttcaccggcaggcgcggagccc

SEQ ID NO: 6794491 - DNA, 116 bp, Homo sapiens
cactaacaattgcacttctataactgtgtttctgcttcctcttttgacttctggcaaaaagaaaccaggagcaactagccaggatgcagaggggttttttaaatcaactgtaagtg

SEQ ID NO: 6794492 - DNA, 86 bp, Homo sapiens
ggggagtcatgctgggttaggaaggggtatcacctcagtttaatatcactgtttggtaatacatttcctggacaccctccctcccc

SEQ ID NO: 6794493 - DNA, 56 bp, Homo sapiens
caaagtgctaggattataggtgtgagccactgcatctgaccctactcagcactttg

SEQ ID NO: 6794494 - DNA, 72 bp, Homo sapiens
gaaataactattgagtatctgtgatgtctggggccctatgtcaggtgctgacactgcaaatataaatatttc

SEQ ID NO: 6794495 - DNA, 106 bp, Homo sapiens
gggagggggacaagagatggcgctgcagaggtgagaagggcctcccaggggtcttaccatcccagggagtctcattctcctctcccaggatatcctcacccacccc

SEQ ID NO: 6794496 - DNA, 69 bp, Homo sapiens
gtgtccttatatggcagacagcagagagagagaaagaaggctctctactgcctcctcttatgaggacac

SEQ ID NO: 6794497 - DNA, 68 bp, Homo sapiens
tgctgtgagtgtggctggaggatgtcttgcatgtggttcccatctgcatcttcaatagccttccagca

SEQ ID NO: 6794498 - DNA, 78 bp, Homo sapiens
caatctctgtgtatgcgtgtttgtgcatactcactaaaacatttggaaggctgttcactaacatgttaacaaaggttg

SEQ ID NO: 6794499 - DNA, 103 bp, Homo sapiens
gtaacaagaatttattatcttacagttctggaaggtagcagtcccagtccaagatgttggcagggttgattccttctgagggctgggagggagattctgtttc

SEQ ID NO: 6794500 - DNA, 60 bp, Homo sapiens
ccaccagcttgcagtcttaacccaagatgacctggggtggggtgtctgtgtgttcggtgg

SEQ ID NO: 6794501 - DNA, 74 bp, Homo sapiens
gcactcttgtcttgtttcttgcataggatctcctcatgaccaggttctataaaactcaagagcaatttgagtgt

SEQ ID NO: 6794502 - DNA, 78 bp, Homo sapiens
tttggtcaatagattctcccatcatgagatgttcccaaacagtaacaatggtaatatttcgatgggatctgaaccaaa

SEQ ID NO: 6794503 - DNA, 59 bp, Homo sapiens
ctcgcaggcgccgcccgcctcgacccgcggcccgggtccctcgcaggcgtcgccgcgag

SEQ ID NO: 6794504 - DNA, 56 bp, Homo sapiens
ctgcgccctgccaatatggctaatactggtttatagatgaggccagcagggctcag

SEQ ID NO: 6794505 - DNA, 94 bp, Homo sapiens
cctgggctgaattggaacatgcacttgggagacaaaggctctgtctgtaaccacagcatcccttcctccctgggtgttttattttcagctctgg

SEQ ID NO: 6794506 - DNA, 60 bp, Homo sapiens
tctctctctactcactttgatctgggtttgttcttccagtctaatgagtcagagtgaaga

SEQ ID NO: 6794507 - DNA, 90 bp, Homo sapiens
tcaggtctatgtacatattctcataaggagcaagcaacccagatccctcctttgtgctcctatgagaatctaatgctaccactgatctga

SEQ ID NO: 6794508 - DNA, 59 bp, Homo sapiens
aggacttagaacattatgtactgaatcagcccctctgtctgtaatatgtgctgagtcct

SEQ ID NO: 6794509 - DNA, 59 bp, Homo sapiens
gtcagctactgcagggaactttcagtctcacatcgctatctctgtcctgtagagctggc

SEQ ID NO: 6794510 - DNA, 65 bp, Homo sapiens
aaatgtaaggatagtacaagaagctcctgtgctctttatggggattcatcaactgttttacattt

SEQ ID NO: 6794511 - DNA, 61 bp, Homo sapiens
aaggagattggttgtttagtgtgaattagatgcagttttgtactttgcaatgtatctcctt

SEQ ID NO: 6794512 - DNA, 60 bp, Homo sapiens
tcattcaccataaccaacatgtcagtttcagggtaaacaggcaagatgggtggtggggga

SEQ ID NO: 6794513 - DNA, 63 bp, Homo sapiens
aggagacactgagacttcaccattggccattatctggccttgctggtccgctcagagtttcct

SEQ ID NO: 6794514 - DNA, 92 bp, Homo sapiens
cacttaataagaatgccaccttctgcttgagctctatctcagtgtgccacaacaaactgggaagcacgctcagcagaaaaaccagttaagtg

SEQ ID NO: 6794515 - DNA, 124 bp, Homo sapiens
cctggccagctgggaagccctgagtggaccggactgcctgtgtcccttcagtgcccacctcccacttttccagggccatggataggagcagctagtggtccgtcagggctccctctaggccagg

SEQ ID NO: 6794516 - DNA, 56 bp, Homo sapiens
agggcttgctgatttaaagagctgcacagccttgggtagcctttagaaagcactct

SEQ ID NO: 6794517 - DNA, 76 bp, Homo sapiens
ggaagtttgttagaaatgcagaatgctggacccaacctgacctactgaattagcatctgcatttgtaactagttcc

SEQ ID NO: 6794518 - DNA, 99 bp, Homo sapiens
gaggcaggagaatcacttgaacctgggaggcggaggttgcagtgagccgagatcgcaccactgtactccagcctcggtgacagagtgagattctgtctc

SEQ ID NO: 6794519 - DNA, 65 bp, Homo sapiens
ctctgagtttcatttccctcctctgtataaatgagaggcttgcacatggctagtgaagctcaggg

SEQ ID NO: 6794520 - DNA, 73 bp, Homo sapiens
tcttctggatgagagcggaggctgggaagagggtgggcccggtaaccagggcctcctgcactctgccagaagg

SEQ ID NO: 6794521 - DNA, 83 bp, Homo sapiens
gtacgagtttcacatgcatggatgtgtgtgtgtgtgtgtgtgtgtgtgtttcacatggaccatgcaggagtgaagctgtgtat

SEQ ID NO: 6794522 - DNA, 83 bp, Homo sapiens
tctgcctcactttctggctttcatttgtttaaagttataaaattgtccaaccttgaactataagtaaagctacttggggcaga

SEQ ID NO: 6794523 - DNA, 77 bp, Homo sapiens
tatgaccaccttatatgatgggtactattaacatccccattttgcaaatggagcacctgtgtggtagggaggtcatg

SEQ ID NO: 6794524 - DNA, 60 bp, Homo sapiens
gaaagtgtgtgtgtgtgcacgtgtgtgtgtgtgcacgtgcgtgtgcgcacacatactttc

SEQ ID NO: 6794525 - DNA, 59 bp, Homo sapiens
tcctggtgcttgtatttgaagtccaagaagaggattttgattatttgttacttgtggga

SEQ ID NO: 6794526 - DNA, 76 bp, Homo sapiens
gggccttgttttcaaggtaggttctgtgaaacactacttctgaaggatgtaaagaactgacctgaaaagagggttc

SEQ ID NO: 6794527 - DNA, 64 bp, Homo sapiens
ctgcccagtctccgggccagccctgctggggcagtgtgggagggagggctggcggaggcggcag

SEQ ID NO: 6794528 - DNA, 76 bp, Homo sapiens
gtgcagagagagggagtctgtgcaaagaattctccgcacttgagagcttccaagcatttccctcgtgtctttgtac

SEQ ID NO: 6794529 - DNA, 61 bp, Homo sapiens
gaactgagcctcagctcatgcttctgtaacaggaagaagccattccctgtaggctctgttc

SEQ ID NO: 6794530 - DNA, 60 bp, Homo sapiens
cagagtcagagcacctgggattggatcccagccctaacccttcctaggtgtgcaattttg

SEQ ID NO: 6794531 - DNA, 71 bp, Homo sapiens
tcctgtagctgtcactgggggccccacctccgacggaatccccggagccaccccggagataggaactagga

SEQ ID NO: 6794532 - DNA, 74 bp, Homo sapiens
cccgcaatgcgcctgcttggggctccctgcagcctctgggggaggcagggcggcccagagcaggcctgtgctgg

SEQ ID NO: 6794533 - DNA, 55 bp, Homo sapiens
tattcccgtttgtgggggatattttaatgtctcctcagcagaacagatgagaata

SEQ ID NO: 6794534 - DNA, 126 bp, Homo sapiens
ctctctctatggacaccctgcaactccatttcagtcctctttggaagtcaggggcatggtggaaaattcccagaaatgggagctgtgctccttaaaagaggcagagtggtgcagaggtagagcgag

SEQ ID NO: 6794535 - DNA, 115 bp, Homo sapiens
cttcccctaactcccaagaggacatgcttatggcctgcactgactagggcagattttcaaaccagtcctagctctagcaaggctggcctggggttctgtggggttggtggggaag

SEQ ID NO: 6794536 - DNA, 57 bp, Homo sapiens
ccaaggctgtggggctgtgcagggcctctcaagtggtacagccgtaatggtccttgg

SEQ ID NO: 6794537 - DNA, 84 bp, Homo sapiens
ccagcctgggtgtgcgcagcgcctgctctgtttccatgtggcctgtgtggtcgtagctccattgcagggctcgcagcaggctgg

SEQ ID NO: 6794538 - DNA, 72 bp, Homo sapiens
ggggggtgaggaccctggtgaggacaggcaaactcagccatcacccccctggccagggtactacacccaccc

SEQ ID NO: 6794539 - DNA, 77 bp, Homo sapiens
caccgaaaatgaaaggcccttctccagagaggcccaaagcaatgttttgagcacaactcttggagagctgggtggtg

SEQ ID NO: 6794540 - DNA, 73 bp, Homo sapiens
gctaaagcacctcaattctagccacacccgtgccatagaatggtcactgggacctaggactgagctgctctgc

SEQ ID NO: 6794541 - DNA, 56 bp, Homo sapiens
cccagttctgagatgaatatccaggagtgtgctcttgtatccatgcagggtctggg

SEQ ID NO: 6794542 - DNA, 82 bp, Homo sapiens
ttttgacagacagtgctgggacacatgggtatccatatacagaaacataaactgagacccttgtctcacattgcctccaaaa

SEQ ID NO: 6794543 - DNA, 79 bp, Homo sapiens
atgggctagaaacatcagctaaccaaaagtgcaaagactttataaccaggtaggctgaagttctttgattctggtgtat

SEQ ID NO: 6794544 - DNA, 62 bp, Homo sapiens
ggcagtgccactaagctctgctgtgacctcgaggttacctctgaagtttatgagccactgcc

SEQ ID NO: 6794545 - DNA, 66 bp, Homo sapiens
taaggcataaggccagaggctagtttaggcaagaaggaataaactagcctctggccttatacctta

SEQ ID NO: 6794546 - DNA, 101 bp, Homo sapiens
cttcctagctccccaaggatggataacactaacatatagtcagtgggaaagaaatctcagaaaataactgttagtttgtcactgtcatgggaaatgggaag

SEQ ID NO: 6794547 - DNA, 84 bp, Homo sapiens
ttctctagccattaaagtgcatgttttgcactgaattgggttgtcagaagcagtatgacatgttctttcatggctaatagagaa

SEQ ID NO: 6794548 - DNA, 66 bp, Homo sapiens
ggggaaaacctgtttcctgtcttctcactatgtctccacatggtgtaatggacaagggaactctcc

SEQ ID NO: 6794549 - DNA, 71 bp, Homo sapiens
gctcagagctgtgctagcagatgtatctcttctgccagtggggagctgggtttctggcaggcttatgaagt

SEQ ID NO: 6794550 - DNA, 69 bp, Homo sapiens
gctcagagccagttagcaggtgcccagggtctgtctaccacctgtcaagcattgctgctgcctctgtgc

SEQ ID NO: 6794551 - DNA, 55 bp, Homo sapiens
cttgggagtagaggcaggagcagggctggcttacatttcctgcctgtgccccagg

SEQ ID NO: 6794552 - DNA, 72 bp, Homo sapiens
gaagcaggagtgagtgtcctcagcagagtttccctaactcgaatctcctgggttgtgactttctcctgcctc

SEQ ID NO: 6794553 - DNA, 83 bp, Homo sapiens
ggcccagattcacaggtgcagaggtgctgatctatctacctagtgggtcagagcagacctctggaagctgtggcgtctgagct

SEQ ID NO: 6794554 - DNA, 95 bp, Homo sapiens
cgcctccgcagcatcctcgcggcctctgcggcctttccctcctctcgtctgggctaggcccagtagtcgacggcgctggtcggctgaggcaggcg

SEQ ID NO: 6794555 - DNA, 58 bp, Homo sapiens
ggaagatttctgatgagttacttgatgcttctgtgccaagtaaatcagagaaataacc

SEQ ID NO: 6794556 - DNA, 81 bp, Homo sapiens
attaatagtttatgaatgtgtcagacataggacccagtttctatcctatgaggtctgaatcacatttattaaaattttaat

SEQ ID NO: 6794557 - DNA, 68 bp, Homo sapiens
atgccattggcctcactcatcatcatgtcaaggacctggcatgcccattgagaagggcctctgtgcat

SEQ ID NO: 6794558 - DNA, 60 bp, Homo sapiens
tctattttagtaatgtgtagttctctcagacagacagaaatacaaagtactaagatacga

SEQ ID NO: 6794559 - DNA, 73 bp, Homo sapiens
ggtgtctaaagaagcagagctgtgggtgtttggagaggcccaatcccaaatgccacttcagcttcaggcaacc

SEQ ID NO: 6794560 - DNA, 55 bp, Homo sapiens
tgtgctgctgtgaataagacctatttaagtaggttactttatctcatgcaccaca

SEQ ID NO: 6794561 - DNA, 81 bp, Homo sapiens
cactaacaattttctggtcagatgttaagtcaaaaatggagattcccttcattttcagcacccatctgaaagatgttattg

SEQ ID NO: 6794562 - DNA, 81 bp, Homo sapiens
atcttcatcccaatggaatgttggcagaagtgatatacaccatttctagatcaaacttttatatacatgggcatgtgagat

SEQ ID NO: 6794563 - DNA, 72 bp, Homo sapiens
tccataattgtctcatcttcattgtctcccatcctgtgacagagctgggtgggaggtgggaaggagacagga

SEQ ID NO: 6794564 - DNA, 57 bp, Homo sapiens
gactgccttttccattacttaatttttaaaaatactattaggagtgggaagggtatc

SEQ ID NO: 6794565 - DNA, 65 bp, Homo sapiens
ttcagttggccatacccctagaagagatttggaatgctgattcactagagggtgggtttgctgaa

SEQ ID NO: 6794566 - DNA, 75 bp, Homo sapiens
actgcaatcaccagggccttagctccccttggaatatgagggttccctcttgcagcagccaaggttctgtgcagt

SEQ ID NO: 6794567 - DNA, 64 bp, Homo sapiens
ccacagaaagcctgggaagtggaaacagacaggagcctgttggagctcttggagctttgtgtgg

SEQ ID NO: 6794568 - DNA, 87 bp, Homo sapiens
gagctagggatgccacttgtgtaagcgcctgtcaaggagctcatggaagagcttcgggatctcttattcaagtggtcatctgagctc

SEQ ID NO: 6794569 - DNA, 96 bp, Homo sapiens
agaagacatttttttagtaagtaaaatcaggttgaggcttggatgacaggcaagagtcatccaggaaaagatttggaaaaatgctggaaaactttt

SEQ ID NO: 6794570 - DNA, 86 bp, Homo sapiens
ctgcttcttaatatgtgcctgattttacttattccaaatataactacaacatttggatcatatggataggcagtatcagcaagtgg

SEQ ID NO: 6794571 - DNA, 56 bp, Homo sapiens
ctggcttttcaaactgttcagtcatatttttttgaagaacagtctgggaagcacag

SEQ ID NO: 6794572 - DNA, 77 bp, Homo sapiens
ggactggccgtcccaagacctggcatccaagttggctctgctgctaactcactaggaaccttgggaaaatccacttc

SEQ ID NO: 6794573 - DNA, 58 bp, Homo sapiens
gaagtttagagtttggagtccttaattcaaatcttagctctaccaaattctggatgtc

SEQ ID NO: 6794574 - DNA, 77 bp, Homo sapiens
ctctgagtagctgggactcaactgtctgggacccactgtctgggaactcagccgggtgagccctgcttggctgagag

SEQ ID NO: 6794575 - DNA, 82 bp, Homo sapiens
acaaaggattttatgcccaggtgccattcccagcaaatctgattaaactgctctgggatgaggcctaggcacgggcctttgt

SEQ ID NO: 6794576 - DNA, 77 bp, Homo sapiens
gcccacgacgcattagcatctgctgtaagcttattaatcacctaacaggcaattagcaagctgttactgtttgaggc

SEQ ID NO: 6794577 - DNA, 63 bp, Homo sapiens
tctagttggccagcacagcttgcaagtcccaccattggatgttcatagaagtctggtcaagga

SEQ ID NO: 6794578 - DNA, 75 bp, Homo sapiens
gggctggggccagccttccagccaatggctgagcgctttccttctcagatatgtgagttggggctggcatcaccc

SEQ ID NO: 6794579 - DNA, 84 bp, Homo sapiens
tctcaaatgggaggtaatatattgaagcatttactcatggacagtcagatggtaaaggctctgataagtactgctataatggga

SEQ ID NO: 6794580 - DNA, 70 bp, Homo sapiens
aagtacaggggtagagttgctttgtggagtccccttgttggcttcctggagaatcctgccacctgtcctt

SEQ ID NO: 6794581 - DNA, 63 bp, Homo sapiens
tatacgagggacattaaaggcactgttaggatttgatgacagctgccaagaatcttttctata

SEQ ID NO: 6794582 - DNA, 74 bp, Homo sapiens
gtgaaggatgaaatagagtattttagcatcttaaggatctaaattttgaattgttttttactcttcattttcac

SEQ ID NO: 6794583 - DNA, 68 bp, Homo sapiens
tgctcttctctcctttcctctactgcatgaggaggcaactggtgtagagtgacaaggtgggaagaaca

SEQ ID NO: 6794584 - DNA, 76 bp, Homo sapiens
gtcgtggagcccagtcggggtgtaggtggagcgggctgtttgcagtgtgaaagcttctctggctggtctgccacgc

SEQ ID NO: 6794585 - DNA, 77 bp, Homo sapiens
gagaggacacaattatagaagaaagcatagaatgtataatattgaatgtgtgacttttatagttaacagtgcctttc

SEQ ID NO: 6794586 - DNA, 56 bp, Homo sapiens
acctgattacttgtcttcccaggtggtctctgggctctatcaggaacaagccaggt

SEQ ID NO: 6794587 - DNA, 83 bp, Homo sapiens
tgtacagatgtttgcctcccttgagagttggccaattgctcttgcaaggcaggccagtttcaaggccattcagacctcgggca

SEQ ID NO: 6794588 - DNA, 62 bp, Homo sapiens
gtgtatcagtggcttgacagtgaattatgagtttcctgctcttggctggacaagtcactcac

SEQ ID NO: 6794589 - DNA, 72 bp, Homo sapiens
acatacagctacataaatatttatgtgtctttaagaaattgtgagtgataggtattttgtgtgtgtgtgtgt

SEQ ID NO: 6794590 - DNA, 80 bp, Homo sapiens
caggtgcccgccaccatgcctggctaattttttgcatttttagtagagaccttgttagccaggatggtctcgatctcctg

SEQ ID NO: 6794591 - DNA, 65 bp, Homo sapiens
taggtctgagcacccatgcagagggaacagatgtctgtctttctctagttggggctgagacactg

SEQ ID NO: 6794592 - DNA, 73 bp, Homo sapiens
gagctttgggttagattatatttaaatattgttttcaacagtataccattgtgactttgatgccccaaagatc

SEQ ID NO: 6794593 - DNA, 58 bp, Homo sapiens
tgctggggatccgtaccaacccatgatggtagcaggtggtcactggatgccccgcgca

SEQ ID NO: 6794594 - DNA, 62 bp, Homo sapiens
gccaaagcctgctttgcctacaagcagagaaccagagtggtccctccagagcagtctttggc

SEQ ID NO: 6794595 - DNA, 130 bp, Homo sapiens
tgctgagttctaggattgacagttcgagcttcagtataaaaactgagtacctctgcattcattcgatgatgaataatgcagggcggcttgtttatttgcttgctctgaaatcttatcctgtttttcagca

SEQ ID NO: 6794596 - DNA, 59 bp, Homo sapiens
cctgtgtgcctggccgcgggaggacccagagtcgggctggcctgcgccaggcagacggg

SEQ ID NO: 6794597 - DNA, 97 bp, Homo sapiens
ggtgtgtgatttctgtgaattggctgagatttgaatagtaactatggtcattcaaaaatggctgttcacatctggaccatttctcaaaataagcatc

SEQ ID NO: 6794598 - DNA, 87 bp, Homo sapiens
tttttcaggaacttgggtgttgtgtcaaggaaggcgtatctgtgggaacccctggtgttccttgaatatatcagacgatctgagaag

SEQ ID NO: 6794599 - DNA, 94 bp, Homo sapiens
ttcaaatggggtgtttaatgtctcagataacatgtattctaaagccaatccaaattttagagtgcagaatttgcagttaaaatacttcattgaa

SEQ ID NO: 6794600 - DNA, 61 bp, Homo sapiens
aggacacctaggcacatccccgtctctgggtccccagccttatcatgtgtctgagtgtcct

SEQ ID NO: 6794601 - DNA, 57 bp, Homo sapiens
agagcaacagagaaatttaggttacataaaacaaagacctatagttccctgtgtttt

SEQ ID NO: 6794602 - DNA, 100 bp, Homo sapiens
ggtgcttttcctagcttaaggcaagtaagtgatgggaggcttcaagagaaactcacaatggagcagcatcactttgagctgcctttgcaagaaggatacc

SEQ ID NO: 6794603 - DNA, 61 bp, Homo sapiens
tctgatctcactgtttatgttgctttccaaagatgtatgttgcataatacagtggatctga

SEQ ID NO: 6794604 - DNA, 60 bp, Homo sapiens
tgctctttgatttggcagtgctgagctttgaaagttcaggcatcttctgagttaagagca

SEQ ID NO: 6794605 - DNA, 70 bp, Homo sapiens
ctgcccctgggagcagagccaccatttggccaagccaaggacttctggagggcctgtttgtcaagggcag

SEQ ID NO: 6794606 - DNA, 70 bp, Homo sapiens
tcagactgataatttaagtcttgggggctgtgattttggcaggccctcttatattagagttaccatctga

SEQ ID NO: 6794607 - DNA, 71 bp, Homo sapiens
tgtgaagaactggcaggtcatcaactgtaattttttttaattaaaaaattaagatgatcttcaaaggcaca

SEQ ID NO: 6794608 - DNA, 57 bp, Homo sapiens
actgtggggacccatgccatgggcagtaggctgctgtgtgtgcatggttgccaccgt

SEQ ID NO: 6794609 - DNA, 130 bp, Homo sapiens
ctgaaagttcatatttccctgttagaatatccaaaccgcagactctgaaaaacacctccagctaggaggcagggctgtaatttgagcctgtgaactggatgttctcgactttaaaagtgaatcattcatg

SEQ ID NO: 6794610 - DNA, 77 bp, Homo sapiens
tgataagtatgtattgtatgaatgaggtttggggtttctgctctcctaatgcctttctgtactatatgaacttttca

SEQ ID NO: 6794611 - DNA, 66 bp, Homo sapiens
gatgtgagggataatatgcggggttttttgtgttgtacttagccactgcatgtttatttgcgcatt

SEQ ID NO: 6794612 - DNA, 73 bp, Homo sapiens
cagagtgaaactcggttcccagtgatatcagcttctaaaatgttgccaaagctatttcattgtgctgagtctg

SEQ ID NO: 6794613 - DNA, 69 bp, Homo sapiens
agaagggggctcatcatctgtgggggattttaaaacaataataaaaccaagcaccagtgagcctgctct

SEQ ID NO: 6794614 - DNA, 81 bp, Homo sapiens
gccttgctaggcagttctaattgcgttttcttgcatagtaactgttatggagagtgagtgattaggacagtgtggaggggc

SEQ ID NO: 6794615 - DNA, 111 bp, Homo sapiens
gggctgagttaagctgggctgacctgggctgagctaagctgggttgagccgatccgggctgggctgggctgggctgagccaggctaggttgagctgggctgggctgggctc

SEQ ID NO: 6794616 - DNA, 77 bp, Homo sapiens
ggagtggaagtgattgttccgttgagtgtctattgacccattaaatacaccagataagaactaatcttgttctaccc

SEQ ID NO: 6794617 - DNA, 69 bp, Homo sapiens
tccctaatctcagtgatttaataccacaaaagtttctttctcaggtacaatccactgtgggttaggtgg

SEQ ID NO: 6794618 - DNA, 67 bp, Homo sapiens
gatgtcttggtcaacttgggctgccataacaaatagcacagactggggggcttaaacaacagacatt

SEQ ID NO: 6794619 - DNA, 60 bp, Homo sapiens
tgtaccataatgtgtattttaacacttattttgcaggaatggttaaaattacatggtgca

SEQ ID NO: 6794620 - DNA, 127 bp, Homo sapiens
gttgcatttagggaaagcaacagcacagcagttaagagaaaggtgtccaatcctggttggatcatttactagtcatccggcttggtatgccttaacctctctgtgcctcagtttcctcttctgtaat

SEQ ID NO: 6794621 - DNA, 130 bp, Homo sapiens
acttgttgttttattgtgtctttgctggctccaggagagctgcttcaaaatgggctcctttgtcttttcttgaatgggtctggtaggaggagtggctggagcccaacaggcaccaatgactgcagcaggt

SEQ ID NO: 6794622 - DNA, 95 bp, Homo sapiens
ctgtggtggggagctgacaaagaggttttgagggcagctacactgatagggaaacactcttgggctgacctctaacctctcccatcccactatgg

SEQ ID NO: 6794623 - DNA, 105 bp, Homo sapiens
aaatataaatatatggttgatgacttgttgcttccagtttttgatggtttgatgaaaatgcacgctggaaagcacttattggaatgaattttatagactatattt

SEQ ID NO: 6794624 - DNA, 63 bp, Homo sapiens
tcaagaatctgtcctaaatatacctacactctgaggctgtgggtttgataggggagaatttga

SEQ ID NO: 6794625 - DNA, 60 bp, Homo sapiens
cagaggcctggcttggacacctcccccagctggccgtggagggtcacaacctggcctctg

SEQ ID NO: 6794626 - DNA, 66 bp, Homo sapiens
aggggtttcaagcgaattgccaagatatagcaggctaaaaccgccttggttttgccagaaatccct

SEQ ID NO: 6794627 - DNA, 83 bp, Homo sapiens
ggtctgtgatctgtcctcacctttacagactgaaaaaaatacatttgtcagtgctcctaaagtgaatgcacatcacatggacc

SEQ ID NO: 6794628 - DNA, 57 bp, Homo sapiens
aagcagaagagggctaggtagattacagcagatatgcagccttggcattctctgctt

SEQ ID NO: 6794629 - DNA, 104 bp, Homo sapiens
gtggctgttgaagctgaagataatagacacacaggcccaaagcctagtacatcctgggctccagctaatggtttctatcattctcccttaagcttttaagttat

SEQ ID NO: 6794630 - DNA, 57 bp, Homo sapiens
acaagcgagcggcttctggccggtcttgctaaggggtctgcaaagctgttctcttgt

SEQ ID NO: 6794631 - DNA, 126 bp, Homo sapiens
tgaacactttctataaatgaataattcagtgaaaacctcagaaatgtatagactagtgtcatggaaagtctgctttcctaacaagtctatctttgatcagtgattcatttacatagattctgtcta

SEQ ID NO: 6794632 - DNA, 88 bp, Homo sapiens
gccagtgggaatttgttgaattaagatacttgttttggtggtgtttttggacgtatgccaaatttgtatcttaaggacaattactggc

SEQ ID NO: 6794633 - DNA, 81 bp, Homo sapiens
ggagcctttttggactaaactcttggtcaacatgaggaagaaagctcagtcttctctttgttaccgtgtccatagggtttt

SEQ ID NO: 6794634 - DNA, 130 bp, Homo sapiens
gattaaacagacatgaaagagaaacagctgccaatctgttctccaggaagctctgctccacgggccttcatttaagaatcctggagcttcagtttcctttcgtcagctttttttcttaatggccaaactc

SEQ ID NO: 6794635 - DNA, 55 bp, Homo sapiens
tcatggattcagttgcattcattcataaaatattgaatgactactatatccatgg

SEQ ID NO: 6794636 - DNA, 92 bp, Homo sapiens
actgtaggtgggacttaataacataattagatcttactcccatgaataggttatatcttatgggaaagatgtaattaaggtccctaatcagt

SEQ ID NO: 6794637 - DNA, 102 bp, Homo sapiens
gggcatcgggccaccctgtgtggggcttcctaggccacggtagagtttagatttcatttgtggtgtatcaggaagccaatggagggttttaacctgggcacc

SEQ ID NO: 6794638 - DNA, 109 bp, Homo sapiens
ggcaacatttgtttcccagctgttggagtttcactgcattagtagccaaatgtgatcagctgaaagagtggtgagacgttcaatagctgctgcttctgatgattttgct

SEQ ID NO: 6794639 - DNA, 66 bp, Homo sapiens
gataaattgcaattaacatatgtcaactgttttgaacagtgcctggcatttgttaagtgttttatt

SEQ ID NO: 6794640 - DNA, 109 bp, Homo sapiens
taaaccgtgctgctcctgttctgtagtgatttaatggcaagaggagtgcagatcctcttggtgtccatcaaaacatgcacagctttcaggttggtcacattgcggttta

SEQ ID NO: 6794641 - DNA, 79 bp, Homo sapiens
ctgattccatatattattcctaagtcccaactacatgccaagcactgtggtgggtactggggaaataaaggaaatctag

SEQ ID NO: 6794642 - DNA, 84 bp, Homo sapiens
ccttcaggccagggtggactagagccccgagaattgtgcctgagtgtctgcaagcaggatttggcctttcgcatggtatgatgg

SEQ ID NO: 6794643 - DNA, 110 bp, Homo sapiens
ttgcaatgtgggccggtgccacaggaatcgtcacttagcgcattgattaaaatgatccagcgcctcaccagagacattcttgaggccccagaggcacccaacaaatgcaa

SEQ ID NO: 6794644 - DNA, 107 bp, Homo sapiens
tctttctagctttgcatataggaatgtaattcaaatttcagaaaggctggggctgaatggctctttgttctgcatttaaaatattactacagtgttcactggaaaga

SEQ ID NO: 6794645 - DNA, 56 bp, Homo sapiens
tttatcccctgtccttgcatactgctgactgcacgtacggtgaatcagtggatgaa

SEQ ID NO: 6794646 - DNA, 61 bp, Homo sapiens
tctactttgagtgtggtcaagtgattttaaaagtcaaagtctggacttgaatcagagtaga

SEQ ID NO: 6794647 - DNA, 111 bp, Homo sapiens
aggcactgctgcctgttggtatccaggatatcccagagttcaatgggaaggtccagcagaagagcttcccaggagaatcagggaattcgggataatatcacaagtatgcct

SEQ ID NO: 6794648 - DNA, 82 bp, Homo sapiens
tatcagcaaaggctcactaatgcttccattgcacagttcctgatgtgaggcacatcacttggtgcattagtctcagttgatg

SEQ ID NO: 6794649 - DNA, 57 bp, Homo sapiens
gcacattccacacagtaatactcaatagaggtttattgagtgcttaagtggaattgc

SEQ ID NO: 6794650 - DNA, 94 bp, Homo sapiens
ggtaactcaagtaatttttcaaagtcagtgcaagcagtacactcaaagccctggctctgttgtctctgaattgcaacagaaaaataattgtacc

SEQ ID NO: 6794651 - DNA, 80 bp, Homo sapiens
gagggagggaggagaggagaaagacaactttgtttcattttttagtgaggcagcccactttccttagtttccctaccttc

SEQ ID NO: 6794652 - DNA, 80 bp, Homo sapiens
aagaatctaaaggacgtgtactaggtctaacatgagtaatgctcaacatgttaaacctagtacaggtcctttagattgtt

SEQ ID NO: 6794653 - DNA, 77 bp, Homo sapiens
ctgtggacatcccgggttcagttcttggctgcccatcttcttctggcacagctgaaggtaggaaccaggagttatag

SEQ ID NO: 6794654 - DNA, 69 bp, Homo sapiens
agcttggttgaccagagactctcagaagccagtaggtccttcttttcatccctggttgcaacttgggct

SEQ ID NO: 6794655 - DNA, 63 bp, Homo sapiens
agccctagagctggaggtcagtggattctggttctgccttggccttgacttagctctgggact

SEQ ID NO: 6794656 - DNA, 66 bp, Homo sapiens
actttgtataaagtccttgaaccggatgtatgtcctccatgtacatttcattatggggcacagagt

SEQ ID NO: 6794657 - DNA, 55 bp, Homo sapiens
aatgatgtggtgggaaggacatcaggggcatatgatcttattccctcataacatt

SEQ ID NO: 6794658 - DNA, 121 bp, Homo sapiens
actgtctcgggcccaaattcagagcttccttcctgaaccgtggctggcctctctgttcctctgctggttcagctgtccagcccttgttcaccttctggaaaaaggaatgtgtctgcgaagt

SEQ ID NO: 6794659 - DNA, 65 bp, Homo sapiens
gtgcattaggctggaatgttgatatgcgaaggatttgtaaagaaatatatttctagttagtgcat

SEQ ID NO: 6794660 - DNA, 70 bp, Homo sapiens
ggaattaggcagcatggattctgaataccagccttatctttggtttttgaatgtgtgtgcttttcttttc

SEQ ID NO: 6794661 - DNA, 64 bp, Homo sapiens
tcttcaacagggtgacaggttcgttctctatgcccagggagctattgtgttactttggggagga

SEQ ID NO: 6794662 - DNA, 60 bp, Homo sapiens
ttggtaatatgatggtctccttgcctgaactgttctttgcaagggatttcatgtctctaa

SEQ ID NO: 6794663 - DNA, 68 bp, Homo sapiens
ctcccaagtttctacatgcctctttcaccctatgagaaggtggtgtggaatagtgggaaaattgggag

SEQ ID NO: 6794664 - DNA, 94 bp, Homo sapiens
cccccaggcctcagccgggccgagtgggtaccggagcaggtgcccgtgggaccggccggctggtgaccgctgggcttccggctggtggaggggg

SEQ ID NO: 6794665 - DNA, 102 bp, Homo sapiens
tgagaagccttggtgcatgcacctgcagagagaagaagaggtaatagacctcttctctggcagatgtgtgtccctctactaccaaatattgctgttgtctca

SEQ ID NO: 6794666 - DNA, 59 bp, Homo sapiens
gggcacaggaatttgggatgtgtgatagacaaagaatgtgtcatgaagtccgtgtgtcc

SEQ ID NO: 6794667 - DNA, 75 bp, Homo sapiens
ctgggggaggctgggaaagaaactgggtcctggatacatcaggttccaggttcgaatcccatctctatctcctag

SEQ ID NO: 6794668 - DNA, 60 bp, Homo sapiens
ctggcccttgacttacagcagggagaattttggcttggtgtatgagtttatgggctccag

SEQ ID NO: 6794669 - DNA, 82 bp, Homo sapiens
ttctagatgttttagcaccttaactgtggagattgatcttattcatctctcattttattcagtgttttgtgcgcatttggaa

SEQ ID NO: 6794670 - DNA, 102 bp, Homo sapiens
ttaggtgtctaagcaaaacagcctgtctttttttggagcaattgtattattgtttcaactgttaagatatgcagtattatgacttttaaaaaagacatttaa

SEQ ID NO: 6794671 - DNA, 76 bp, Homo sapiens
gagatgtacaatgtgtattaattaacattttaggagttgtggatattaactttcattgatatatagtgtatgtttc

SEQ ID NO: 6794672 - DNA, 62 bp, Homo sapiens
gtctgaagcaatcagagtcctttggcctgacaggtgggaccttgcccaaggagtctgaagac

SEQ ID NO: 6794673 - DNA, 127 bp, Homo sapiens
ctcttcacttgttagctagaatcttccaggaagcgcatcggtgcctccttccctgtgcctggttcctgcgggacggcgggagggtcactggccacgctccttgattcaccgagtgcagggtgaagag

SEQ ID NO: 6794674 - DNA, 66 bp, Homo sapiens
gcgttagagggagaggagcattcttctatttcatcagggaagccagcatccctctcccattcatgt

SEQ ID NO: 6794675 - DNA, 57 bp, Homo sapiens
atctccaggcctttcccatcttacataaatctgagattcattgtgggtcttggagat

SEQ ID NO: 6794676 - DNA, 97 bp, Homo sapiens
ggggctccttgagtgcaggagcaggagccatgtctggctcacctttaaatcctgaagagccctgagcacctgcctcctcatttgaccaaggagcgcc

SEQ ID NO: 6794677 - DNA, 58 bp, Homo sapiens
ttttgtcattgattgaaacctgagttaagaatctcagtgatcagtctattgtataaga

SEQ ID NO: 6794678 - DNA, 69 bp, Homo sapiens
cagaggtgaggcctggagggaggagtttctgccccagcaggtgaatttaaaggccagacctgagccctg

SEQ ID NO: 6794679 - DNA, 65 bp, Homo sapiens
ggagcagcaggccaggttgcaggttgaggaagtcagaagttaacttgagctgagtttgcagctct

SEQ ID NO: 6794680 - DNA, 60 bp, Homo sapiens
cagtgaccgagtagaataagctctccatcagggtagagactttgtctattttgttcactg

SEQ ID NO: 6794681 - DNA, 56 bp, Homo sapiens
gggtgtgcaggtcatggcgtctctcagagctgggaatgcccaatgaatgcactccc

SEQ ID NO: 6794682 - DNA, 98 bp, Homo sapiens
tgaacaaggtgataggagagcctgttttagatgcattgatgatagggaggaataatggctcatcagttatgaaatagttccaaattaccttgctttca

SEQ ID NO: 6794683 - DNA, 57 bp, Homo sapiens
gaagagctgacagtgtcatcctgtctatggacgggaggctggcgatggtcatttttc

SEQ ID NO: 6794684 - DNA, 130 bp, Homo sapiens
cacatcctcgaccccatatggatggggctcttgtctttggcgcaactgctggggtgctccgaatctcctcgccactgcgctcagcctagagtcagcgccgggtcaggggcccagggaggggcaggggcgg

SEQ ID NO: 6794685 - DNA, 70 bp, Homo sapiens
gtctttagatgtgcaaaggagaaaaagcactgccaactttgcaatttcttcttcacctacatctgattgc

SEQ ID NO: 6794686 - DNA, 63 bp, Homo sapiens
ttgggatggggtgggaccaacagaggaacagatatttgtttgctatatcctacttcataccaa

SEQ ID NO: 6794687 - DNA, 71 bp, Homo sapiens
ggctattgtgaatagtgccgctataaacatacgtgtatatatgtctttatagcagcatgatttataatgct

SEQ ID NO: 6794688 - DNA, 83 bp, Homo sapiens
tatgggttggcagaataattcaggcagaatttagtttacagacaacttctgaacaacttgcatgatattcaacagagcctata

SEQ ID NO: 6794689 - DNA, 85 bp, Homo sapiens
tgagctagaaataatatagaatttattagaactactgaatgccctcagtacttttttgatatctgagtttcgacttgatagctca

SEQ ID NO: 6794690 - DNA, 75 bp, Homo sapiens
cctccaaacacctttacagtttaagaggaaacaaaatgattgtttttatttcccttctttgactgtggttagagg

SEQ ID NO: 6794691 - DNA, 63 bp, Homo sapiens
ggctgaatctggatgctcagatatcatcactgagattctgtctctctagctcttggtttggcc

SEQ ID NO: 6794692 - DNA, 70 bp, Homo sapiens
aagatggaaattctgaaattcccttcgttaagaactttttgctgattcatgatttgagaatttttctctt

SEQ ID NO: 6794693 - DNA, 71 bp, Homo sapiens
aggaattcttcaagagaatgcagggatgttgaagctaaaacaaggaaggtcatcattctcttggggtccct

SEQ ID NO: 6794694 - DNA, 68 bp, Homo sapiens
tcaaactatgtggcaacaaaagagcctagtgtacctcagaatacactttggatgccactggtctatga

SEQ ID NO: 6794695 - DNA, 102 bp, Homo sapiens
ggagactgagtaaaggaagaggaagaaagcaggcatgagtgttgaagttcggtttgactcatgtcatgtgttctttacgttccttttgaatatattaaatcc

SEQ ID NO: 6794696 - DNA, 87 bp, Homo sapiens
gtattaggtctctctgatttgcttggagacattcactggcttgtgtgccaccctgtcactgtgaggcgggtttgagagacttagggc

SEQ ID NO: 6794697 - DNA, 96 bp, Homo sapiens
gagagggcgagggagaggaggatgctgtgcctggaaagcggctcttgaggagagctggaatctcggcaaagcgtccactccctcccctcccctttc

SEQ ID NO: 6794698 - DNA, 58 bp, Homo sapiens
gaagacttaggaagcttttgaggacaaacattgcctcatgatgtttgctgagggattc

SEQ ID NO: 6794699 - DNA, 66 bp, Homo sapiens
tctctaggatcccttatggggcccctcagggtcctctctgacaactccttcttgggtcctggctga

SEQ ID NO: 6794700 - DNA, 55 bp, Homo sapiens
cagatacctgggtatcatttagttcagtgaagcagaaatttaccctaggtgtctg

SEQ ID NO: 6794701 - DNA, 55 bp, Homo sapiens
gtctgttgggcatcggctcatggcttagggcaggctactgggcaagcccacagac

SEQ ID NO: 6794702 - DNA, 56 bp, Homo sapiens
cccaggctggagtgcagtggcacgatctcgcctcactgcaagctctgccttccggg

SEQ ID NO: 6794703 - DNA, 86 bp, Homo sapiens
cacctggcagcttattagaaatgcagtctcaggccctgccccaaacctactgattaaaatctgcattttaacaggatccccaggtg

SEQ ID NO: 6794704 - DNA, 80 bp, Homo sapiens
tccaatgttagtcatcactgtatcattgatagaaggtgatttcttctattttagaatcaatagggttgctgcagtatgga

SEQ ID NO: 6794705 - DNA, 79 bp, Homo sapiens
tagggaagttccttattgtgagatgcgataattttatataattgcagcagcttcagcagttttgaaggaggtttccctg

SEQ ID NO: 6794706 - DNA, 59 bp, Homo sapiens
agattgatgtattccctgagttgtaagaatagagctgagagtccaggaaaacatcagct

SEQ ID NO: 6794707 - DNA, 58 bp, Homo sapiens
gtcatctctgggcccgcactgcggcatttaacctcttccttaggctgcccggagagac

SEQ ID NO: 6794708 - DNA, 68 bp, Homo sapiens
cctctaggtaatgcacagctaaagtggttccaaatgttttatctgatgccagctgtgcagccttctgg

SEQ ID NO: 6794709 - DNA, 65 bp, Homo sapiens
tgaactaattcctgctttgggggaagtatacagcagctgtgctcccagctgtaggaatgttttca

SEQ ID NO: 6794710 - DNA, 64 bp, Homo sapiens
tatttactgatctcaggctgcttacctctttagggtaagtcattaggctgagttcaattaaatg

SEQ ID NO: 6794711 - DNA, 68 bp, Homo sapiens
gcctggcatgaggagcatgaggtttggggagagacccttggccatgtcgtactctttactgccaaggc

SEQ ID NO: 6794712 - DNA, 60 bp, Homo sapiens
ctgagagaggcctccatgtactgaagttccctgccttcagagtcaggggcctttattcag

SEQ ID NO: 6794713 - DNA, 101 bp, Homo sapiens
gggagaagtttcctggcagggctgagaggcagaatggtgcctgcacctcctggagtgcacggcaatggtctggctctgctgccttctatgggtaagggccc

SEQ ID NO: 6794714 - DNA, 55 bp, Homo sapiens
tcatgagttttctggtcaccttggttgtaagagcaaaagattagaaaacacatga

SEQ ID NO: 6794715 - DNA, 65 bp, Homo sapiens
gttagtaggaggtggtatcttgcagaggtggagagcacaggccaaatgccagctccactactaac

SEQ ID NO: 6794716 - DNA, 120 bp, Homo sapiens
agttgaaaaccacacctttttaagaagttcagaaattgaggatgcggtattctgaattatctaatttgatttttctgcatctctacagttgtttcattacttagtaaagcgtttccaact

SEQ ID NO: 6794717 - DNA, 71 bp, Homo sapiens
tgtgagaagggtgaggcttttacaagtaatcaatatccttaagcttgacttgaaaagtctattcaattaca

SEQ ID NO: 6794718 - DNA, 74 bp, Homo sapiens
tagcaattaccagcagctttgcatacactaaattgaacccctccgtttgtggggtgaagctgttgctgttgcta

SEQ ID NO: 6794719 - DNA, 62 bp, Homo sapiens
agcagtgggtggtttttgagcaggggagtgacctaagatttgtgctttagaacaatcactct

SEQ ID NO: 6794720 - DNA, 62 bp, Homo sapiens
agagtaaagatgagcggtaatacaaattcaacttagaattgtgttacttattacttttcttt

SEQ ID NO: 6794721 - DNA, 69 bp, Homo sapiens
aacaatatagtccatgagcatgcttggcaaaatataaagagcttagcaaaagcatggaattgtatagtt

SEQ ID NO: 6794722 - DNA, 80 bp, Homo sapiens
gctcttcttcaaaattaaagtatggtttaagggcttcaaataaactgaagattttctcaactgtatttgtaaaagagagc

SEQ ID NO: 6794723 - DNA, 61 bp, Homo sapiens
ctttccaggctatccggtgaagggagtggaaacatttgcttctgggtcccagcctggcaag

SEQ ID NO: 6794724 - DNA, 70 bp, Homo sapiens
gctttttactgagctggtccactgaggttgaaggctccatcatcttctacctctagccactgagaaaggc

SEQ ID NO: 6794725 - DNA, 67 bp, Homo sapiens
tgaaatgtgggtcatgacccattagtgagctttgaaatcactttagtgggttgtgacctgaatttta

SEQ ID NO: 6794726 - DNA, 77 bp, Homo sapiens
gtgtacacttctgatgttatcctcgctcacatgtcaccagcttgcaactttgagtgggatgagttagaggtgtccat

SEQ ID NO: 6794727 - DNA, 68 bp, Homo sapiens
gaccagaaagtcatgagtcagtcaatgggtttagaaaatatccttagttgtttgtaacttgtttggtt

SEQ ID NO: 6794728 - DNA, 77 bp, Homo sapiens
atagtctttagcttttgcccagccatggttctcactatccctttcctagaattttgcagtaagggctaatggactat

SEQ ID NO: 6794729 - DNA, 81 bp, Homo sapiens
tggtgggtaatatggaaagtgttttcttctgttgtgcatttctgtgctactgaggttgaatatctttgcaaatgtttatta

SEQ ID NO: 6794730 - DNA, 60 bp, Homo sapiens
aggctctggagttagccaggcattgtcccaacccaagttctgtcactttttcctgagcct

SEQ ID NO: 6794731 - DNA, 89 bp, Homo sapiens
ggctcagttctcttgcagggcaaaaatcctcatttattgggaactggaaaagtacttaaggtgaggattttgttctgctagggtgggcc

SEQ ID NO: 6794732 - DNA, 88 bp, Homo sapiens
ttcctgcactccagaacggtgctccacaactgccctagttaggctcaagagaccctaggtatggcttgtggcacagctctggaaggaa

SEQ ID NO: 6794733 - DNA, 55 bp, Homo sapiens
aaagggaggggcgataagccgggtccttgggagcgtcctggtctcccttcgcttt

SEQ ID NO: 6794734 - DNA, 61 bp, Homo sapiens
gggggcagcaggtgtcctgcgatgccccggggatgtgcgcgcagactgccctgctgtcccc

SEQ ID NO: 6794735 - DNA, 59 bp, Homo sapiens
cctgccttccatcttgtgaaggaatgaggctgctctacctgcaggatgctgaagccagg

SEQ ID NO: 6794736 - DNA, 85 bp, Homo sapiens
gggcagggtttgagcccacaggacctgcacacaaacttccccacctcttggacttggggacaggatctgtgcctcaacccagacc

SEQ ID NO: 6794737 - DNA, 92 bp, Homo sapiens
gagagacgcttacagactatttatttacagaaagctaaaagatttctttttcaggagtaagagttttcatgttagatattgtgaaccctctc

SEQ ID NO: 6794738 - DNA, 81 bp, Homo sapiens
gagaggaagtggagagccctggaggtctcacaacttctatttggaattaacagatccacacagggcatcttgactcttctc

SEQ ID NO: 6794739 - DNA, 55 bp, Homo sapiens
gggtagtggtgaatctagagccagcctgtgcctctagatttctagttcattatcc

SEQ ID NO: 6794740 - DNA, 67 bp, Homo sapiens
gaggcggcggatcacttgaggtcaggagttggagaccagcctggccaacgtggtgaaaccctgtctc

SEQ ID NO: 6794741 - DNA, 59 bp, Homo sapiens
ctcaggcacttttgtcacagacgaattttttgtccacattgctgacaagggtggtcgag

SEQ ID NO: 6794742 - DNA, 78 bp, Homo sapiens
ggttcatccatattatagcatgtatcaatccttcattcctttatttggccgaataatattctgttgtatggatgtgcc

SEQ ID NO: 6794743 - DNA, 78 bp, Homo sapiens
atttggaccatggaccatagttcctattaagcaatcataatagagtagagatggcaaactatggtccatggaccaaat

SEQ ID NO: 6794744 - DNA, 116 bp, Homo sapiens
agagaagtcataaggggcatgaacctttgtgatgtaccctgcagtgtcttagcctgactttcctatgacagtaacagtctatttctcagaggtctctcagctgctttgacttttct

SEQ ID NO: 6794745 - DNA, 97 bp, Homo sapiens
aatgacttgttctgcaaagacccagaggtgtctagcaagcttagttaaggacaagccaccctccttggacatttgtgattattgagaacatttcatt

SEQ ID NO: 6794746 - DNA, 57 bp, Homo sapiens
ttggctcaggacccctgtgactgccagggcactggtcccagcactgcctgagtgcag

SEQ ID NO: 6794747 - DNA, 110 bp, Homo sapiens
tccattatttctgtcaagaagacaattccaaatgttgattagtgtttagacttactgattatcagtcaagctaattgatccacaaaatctatcttgcagagtttcaagga

SEQ ID NO: 6794748 - DNA, 65 bp, Homo sapiens
gggtccctaggagaattgccgcagccccagcccagggcgggccggcaggcgggtctcagggaccc

SEQ ID NO: 6794749 - DNA, 115 bp, Homo sapiens
tgattcttatgcaaagagagggccggggtcagggtctgttgtttgttctggaaaagcttgtaggattttcaccagaccttgtgacctttggggacattttttttgtgtgtgatca

SEQ ID NO: 6794750 - DNA, 78 bp, Homo sapiens
gtttgtatgtgttatcccatttgagccttcaaacagtcctcttactgctcatttttcagatgaggaatgcatactaat

SEQ ID NO: 6794751 - DNA, 98 bp, Homo sapiens
acaggtaaagtagcatgatttataactttgggcccacctgttgagagttggggtttattacaaggttccagaattatgctcttttcttccagccctgt

SEQ ID NO: 6794752 - DNA, 65 bp, Homo sapiens
tctaagggccttttgtggtgttgtgtgtaattggaattttaaagcaagtgagaggcatcattaga

SEQ ID NO: 6794753 - DNA, 79 bp, Homo sapiens
tcccagcccagtccacccttactccccaactaaagggaagatagttctttctcctggggccgtgatgtgaggcctggga

SEQ ID NO: 6794754 - DNA, 76 bp, Homo sapiens
aagcctggcatatttggtataacttaagcaccaggtaaaatctggtgcttaagttgtaccaagtatagccaagttt

SEQ ID NO: 6794755 - DNA, 112 bp, Homo sapiens
ataaataatccaaactaaccctaaaattataccaaaaaattaatgtgattaggatggtaattcacagtcacatagtgttttggaatctttgtggtgaaaataaattgtttgt

SEQ ID NO: 6794756 - DNA, 57 bp, Homo sapiens
tgtagtgaggaaagactggttgtattaactgttctgagccacagttttctcactgca

SEQ ID NO: 6794757 - DNA, 66 bp, Homo sapiens
ggactataaagcggcccagccgagggcaggggcccatccggcctgaggcaggtgctcgcttggtct

SEQ ID NO: 6794758 - DNA, 102 bp, Homo sapiens
aaaatcttttcattgctgtccttttagaaggcttctgctcagtctagcctttcttcagcagggctgatgatgagcagaggtgaaggtattcctcaagatttt

SEQ ID NO: 6794759 - DNA, 74 bp, Homo sapiens
agcctgggatgctgctatcatttttacagagacttttttcttcttctgacagatgctgctggcagtaccagcct

SEQ ID NO: 6794760 - DNA, 58 bp, Homo sapiens
cacctgtacccacttcccccagctgaacagcagcctttcagaggaggtgggtaaggtg

SEQ ID NO: 6794761 - DNA, 80 bp, Homo sapiens
ccatattggaatgaaatcattggggttgaataatccattctttggtttgtttcagaaacatgtgtgtttgcatttcttgg

SEQ ID NO: 6794762 - DNA, 92 bp, Homo sapiens
gaatgtgacaaatgttatttctgttcacaatcatattgccccaactcaactctgggggagtctgggaattggagagaagcatatgcacgttc

SEQ ID NO: 6794763 - DNA, 81 bp, Homo sapiens
gtatattaagtacttgggatatattgttgaacaaaatagactaacatttttgctttagcttaaattgtaagtgaaatgtac

SEQ ID NO: 6794764 - DNA, 79 bp, Homo sapiens
gctcacacatacaataggtgtccaattaacaattgttgcatgaattgttgcagaggtcacctgtgacccttgggtgggc

SEQ ID NO: 6794765 - DNA, 63 bp, Homo sapiens
gaataagaatgtggtgccgctggagagtttagaggacttgactctctaacgacattcccattc

SEQ ID NO: 6794766 - DNA, 87 bp, Homo sapiens
ctggggtcaggtgacctgaattcctatcctggttgtacccaagcaggctgggcaatatgggcaagacatggcttctctgagccccag

SEQ ID NO: 6794767 - DNA, 64 bp, Homo sapiens
ttcattgagtggtttattctaatgttaggtgaactgtcacgagtaaaactactaactcaatgag

SEQ ID NO: 6794768 - DNA, 65 bp, Homo sapiens
ataggatctcacatacgaatatacatatgcataaaaccccattgtgtattttcgtggaggcctat

SEQ ID NO: 6794769 - DNA, 61 bp, Homo sapiens
agtctctctccagtattgagaagtatagtcctccagtactgcctcttggtgctgagagact

SEQ ID NO: 6794770 - DNA, 58 bp, Homo sapiens
ggatgtgaggaggctgtattcttctccctagagagatttacacatgccttttcccacc

SEQ ID NO: 6794771 - DNA, 57 bp, Homo sapiens
tgaccccttctcaatcaggcaaggcacatggaagcccagctgtcttgagaggaggca

SEQ ID NO: 6794772 - DNA, 58 bp, Homo sapiens
tccatcttgagtccattaacctcgctctgtgtgtgctgtgttaatgggctgggaagga

SEQ ID NO: 6794773 - DNA, 70 bp, Homo sapiens
gcaaagtatctgaccgattataaagttattgctcttcattatttttgtaatcatgttagaagagcttagc

SEQ ID NO: 6794774 - DNA, 67 bp, Homo sapiens
tcacactgatgagtctgcgttccggggaaggttgcgtttctctggcagtgagcaacttgacaggtgg

SEQ ID NO: 6794775 - DNA, 74 bp, Homo sapiens
gctcctctctgctgtcccgagggccacttgcatatttgaccagatagagtggccagtggtggcatgtcgagggc

SEQ ID NO: 6794776 - DNA, 69 bp, Homo sapiens
agctagaaaggcatggaggcaaacttggtcttaaattcagcacattcattttgcttcatgtcttttgct

SEQ ID NO: 6794777 - DNA, 58 bp, Homo sapiens
cctgtgccagccccttctgctgttctcctccctgcagcacgggtacagcctggccagg

SEQ ID NO: 6794778 - DNA, 87 bp, Homo sapiens
gtagactgggctccgggaaatgtgggtaatgggactggacctgcgcctggggtccgcccacccgtcatctcccgggagccccccgac

SEQ ID NO: 6794779 - DNA, 96 bp, Homo sapiens
tagaagactagcaaaaatttaagtagatgttgtttaaaaacccatctgggtctcttacaaggtatccacattaaatgttttgaattagtatttttg

SEQ ID NO: 6794780 - DNA, 79 bp, Homo sapiens
tcaaaataattctccaatttttgttgttgctgatcacactgacattgcaaactttagaagtaaggatgagttgagttga

SEQ ID NO: 6794781 - DNA, 56 bp, Homo sapiens
ctgcatctctgctagtcagtcattccagccgtgacttggtagctccaggggtgcgg

SEQ ID NO: 6794782 - DNA, 55 bp, Homo sapiens
ggatctgggctctgccaatcagacttggagtaagaagcagggactgcccaggtcc

SEQ ID NO: 6794783 - DNA, 63 bp, Homo sapiens
gccagagtgggccgggcccagcatcctggggatgccggggggcagcctgaggccctttctggc

SEQ ID NO: 6794784 - DNA, 55 bp, Homo sapiens
gctgggtttctggatctctaggtctggaaaggctttcctttctttgacacccagc

SEQ ID NO: 6794785 - DNA, 72 bp, Homo sapiens
gcttgagcccaggaattggaggctgcagtgagctacgatcgtgctattgcactccagcctgagcaaaagagc

SEQ ID NO: 6794786 - DNA, 64 bp, Homo sapiens
gtttttgagaagttacaagtcctctacggctgtcaactcagagaggcactaattattcagagat

SEQ ID NO: 6794787 - DNA, 129 bp, Homo sapiens
cagggagattaactcctctattgtcagtgattcaggtctccagttttctgcacattcagcagaaagaagaactcactggagaatggtgaaagttgaggctggtggtaaaggagatcaggattcttctag

SEQ ID NO: 6794788 - DNA, 77 bp, Homo sapiens
actcagcttccaaccttcagcaaccaacactctcaacaagaagagaatgtgtcttggctctggagggggatctgggt

SEQ ID NO: 6794789 - DNA, 63 bp, Homo sapiens
cagctcctgggccatctcctagaggagaggctgcctccctggaggagtgaggctccagggctg

SEQ ID NO: 6794790 - DNA, 89 bp, Homo sapiens
catctccttgccaggccttgtgagctgtctgaaggctgctggtgctgcccctgctgcctctgcacagctcactcaagccagggagcatg

SEQ ID NO: 6794791 - DNA, 83 bp, Homo sapiens
gggccttaggcatatcacttaagagattttcaggatcataggtggctcttttgatgacttcagatctttgtgatatctggccc

SEQ ID NO: 6794792 - DNA, 81 bp, Homo sapiens
gcctgcaggagaaaactggacccaggacgccccagatttggccacaccagcagggcagttaaagggtcctttcttgctggt

SEQ ID NO: 6794793 - DNA, 59 bp, Homo sapiens
gcgcgcgcccctcccggggaggcgggcccaggcacccggctctataaaggggcgcgcgc

SEQ ID NO: 6794794 - DNA, 66 bp, Homo sapiens
tgctgtcagttatacgattggttttatttaacaaatacttacatagcacttattgtatgctgagca

SEQ ID NO: 6794795 - DNA, 67 bp, Homo sapiens
aacttttctattagttaggaagacaagcataatgacctgatgctgtcattttggctggtacaaagtt

SEQ ID NO: 6794796 - DNA, 58 bp, Homo sapiens
ctaaatctagtctttactgatttagagggacaagccaaattagaagggactgatttag

SEQ ID NO: 6794797 - DNA, 96 bp, Homo sapiens
gacaggagaatcacttgaacccaggaggcggaggttgcagtgagccgagatcgcatcattgcactccagccttggcaacaagagtgaaactccgtc

SEQ ID NO: 6794798 - DNA, 63 bp, Homo sapiens
tcagtgtggaaaatcctttggcacaagctcttaccttatagtgcacaagagaatacacactgg

SEQ ID NO: 6794799 - DNA, 56 bp, Homo sapiens
ctagttcacaagtgcatttcaggaggggcttcatgaaagtgtatcttgtgggaaag

SEQ ID NO: 6794800 - DNA, 55 bp, Homo sapiens
ctgggcgggacagcgccaggcctacagtcaccacggaatgtgctctctcactcag

SEQ ID NO: 6794801 - DNA, 77 bp, Homo sapiens
gttttcaggtctaggtgtgatgggtatggtgacaagtctgctgttgctgtgctgctagacctggattcctgaacaac

SEQ ID NO: 6794802 - DNA, 106 bp, Homo sapiens
tgttcttgacactttagtgcactggttttgagagtagtcattaacaaatctttaggactaggttataaactcttacagacaggtttacattttggtgattagaata

SEQ ID NO: 6794803 - DNA, 70 bp, Homo sapiens
acctggtagcttgcagttcctgctccatgctctgccctgggcaatgagctgtggaaggcagggaccaggt

SEQ ID NO: 6794804 - DNA, 65 bp, Homo sapiens
cccagggattataaaggtgaaaatatgcacaaactttgccaatatcatgtttgtagtctcaaggg

SEQ ID NO: 6794805 - DNA, 62 bp, Homo sapiens
ttggattcactgttggtagagtggccatcaagccagaacctagccaaccaacacggagccag

SEQ ID NO: 6794806 - DNA, 80 bp, Homo sapiens
tcatcgcatgtgaattccaaagctaggttataaagctcattgcagcttccatctggctcccttggaatccgtggctctga

SEQ ID NO: 6794807 - DNA, 92 bp, Homo sapiens
atcagtgtgggtgccttcagtatttcttcatctatttcagatattagcagctactaggccttgtaatggaggggaaaaggcttcacaaggat

SEQ ID NO: 6794808 - DNA, 74 bp, Homo sapiens
gctaagaaggcacacagaccccagcaagtcagacctggaagcatactcactgctggaggcctggggtccttggt

SEQ ID NO: 6794809 - DNA, 56 bp, Homo sapiens
agggccccatagtcactgcccgggcattgtcccaggcagcaggattaggggcatct

SEQ ID NO: 6794810 - DNA, 62 bp, Homo sapiens
agacagcaagacagttggtgaaggccagatttgctttacataccaagagttcttgcctgttt

SEQ ID NO: 6794811 - DNA, 74 bp, Homo sapiens
cctgtccaagcccaaggcttccctgctggcccctggtcttccagtagccagctgggccttagggctgggcctgg

SEQ ID NO: 6794812 - DNA, 76 bp, Homo sapiens
agcagcatctggttctgatgtgtttaccgggctggtatggaaatgcccaggctgcatggcagaaacctgagctgct

SEQ ID NO: 6794813 - DNA, 86 bp, Homo sapiens
ttatttccatgagatcttctagcagaagtaatttcgggttggtgtctatctgaaagccttctgtctagcagatagcattgaagtgg

SEQ ID NO: 6794814 - DNA, 91 bp, Homo sapiens
aatacattcatttctctgccaacagctattggtccacaggtatgtcatatgacccaaactggcccaatcagccagaaggaaagaacttatt

SEQ ID NO: 6794815 - DNA, 76 bp, Homo sapiens
tgcctaaagtcctagacagagccttggcctctaaggatggggatcatccgtgtcgccagctcatctgggctcggta

SEQ ID NO: 6794816 - DNA, 78 bp, Homo sapiens
catctctgtgctttttattatttttggtaggctgtgggaaactgttctacaatatgaataatgaagagctgtgaaatg

SEQ ID NO: 6794817 - DNA, 103 bp, Homo sapiens
caaatttctcctcaaagtaacttattttatttgcaagagtgtgaagaagttcaaggctaagggcactctcaaaaagagtagcagttgtggtgaaaggaatttg

SEQ ID NO: 6794818 - DNA, 87 bp, Homo sapiens
attttcccccttttttgtagctaaaaatcacccaggcttgtccagacgagagggcagaaaattatgcggtgaaagagaagggaagat

SEQ ID NO: 6794819 - DNA, 61 bp, Homo sapiens
aactgcctggccaggctgcaacagcttcccatttcacgttgcagtttaactttgagcagtt

SEQ ID NO: 6794820 - DNA, 75 bp, Homo sapiens
taaacagcacagctctaaatgattggaattatgatcagtttattagctgacctgttacactagggctgctgttta

SEQ ID NO: 6794821 - DNA, 85 bp, Homo sapiens
ggctctctcttttctccagctcccctcagcaggtaatctatataatagattacctgctgaggggaagctggggatagagaggact

SEQ ID NO: 6794822 - DNA, 65 bp, Homo sapiens
cccactgaccgccagagtgggtgccaccttcttcagggtggcgccagcccaggccgtcgtgtggg

SEQ ID NO: 6794823 - DNA, 69 bp, Homo sapiens
agtgagcatgtattcatgtggaactcagataactaaaaaagtaaagttgtatctgaatgcatgtaggct

SEQ ID NO: 6794824 - DNA, 63 bp, Homo sapiens
acagtggtctggaggcccagcaactctctaataggtcagggccacaacaccagagtccactgt

SEQ ID NO: 6794825 - DNA, 60 bp, Homo sapiens
tgggactgctttagagagctcagagggtcttcagatttctgggcccactgtagcatccca

SEQ ID NO: 6794826 - DNA, 57 bp, Homo sapiens
ctcaccttgtgatcctcttgccttggcctcccaaagtgctgggattacaggcttgag

SEQ ID NO: 6794827 - DNA, 89 bp, Homo sapiens
agagacccacaaagctcaaagcccattgtgctaggctcctgacccatctgaacactgagcgggcactgagcgggctctgagcgggctct

SEQ ID NO: 6794828 - DNA, 58 bp, Homo sapiens
atgaacggctcttcacacagtgatgtcagtttttgacagattattgaagggtctttat

SEQ ID NO: 6794829 - DNA, 78 bp, Homo sapiens
gggttcattgtaacttgttactttgcagtgttgttaatcgttcagcatcagtaaggcaacatagcttggagtggttcc

SEQ ID NO: 6794830 - DNA, 60 bp, Homo sapiens
ggaaagcttccattttgtacattttttacaaacggaaaataagagaaagggaggctcacc

SEQ ID NO: 6794831 - DNA, 78 bp, Homo sapiens
gtcacctggaggctgattaatggaatgtgtacaacatgtcctgttaattcagagcttgcaaacattgtccacggtgat

SEQ ID NO: 6794832 - DNA, 57 bp, Homo sapiens
gagagctgtcacatagagccagaacaataatctgtctgtctcagtatgacagcactc

SEQ ID NO: 6794833 - DNA, 84 bp, Homo sapiens
aagctactagaattatctagttcacagtttttcagcctctatgctattaacactttgggctggataattatttatttgtgggtt

SEQ ID NO: 6794834 - DNA, 62 bp, Homo sapiens
tgtgttgaagccagggctgaccatgctgcaggcccctggccctggaacttcactcatgcaca

SEQ ID NO: 6794835 - DNA, 80 bp, Homo sapiens
gggaggggtggggagtgaggccgaggggagtgtgagggcctaatcttggatgcagtccctggcccactttaatctctctt

SEQ ID NO: 6794836 - DNA, 81 bp, Homo sapiens
gatatgagggagggaaaatgcaaatgatgaaactaacttttcctacttcagaaaggaaaatgtttgcctctccttccagtc

SEQ ID NO: 6794837 - DNA, 72 bp, Homo sapiens
cacatattcacaggcacgaaatattgcatatacttttttgtgtgtttggtgtattgtgtgtgtgaatgtctg

SEQ ID NO: 6794838 - DNA, 62 bp, Homo sapiens
ggccagcttctggacaaagtcccttcagggaaggggaggaaggatttgtcctgagctgagcc

SEQ ID NO: 6794839 - DNA, 61 bp, Homo sapiens
ttagaaacaaagacctgggtgctagctgtgcttattgctacaagcatgtcattgtttctag

SEQ ID NO: 6794840 - DNA, 59 bp, Homo sapiens
gtctagtcagcctcaggacatgcttgcagatgctgcctgcaggcacaggttgtctggac

SEQ ID NO: 6794841 - DNA, 69 bp, Homo sapiens
gcagtcttattaggttaaccctgctcagtgaaagcaagcaggcttactttctgattagataaaatgtgc

SEQ ID NO: 6794842 - DNA, 63 bp, Homo sapiens
tggagggtagctacccaactccagagcagcacacaacgctttgtccaggtggctaaccttcca

SEQ ID NO: 6794843 - DNA, 68 bp, Homo sapiens
gccatattggtttgggaggctttgatgagatgattctgtcagacagggcttctcaaactttaatgggc

SEQ ID NO: 6794844 - DNA, 83 bp, Homo sapiens
ttgtgtggtagtctcagggcagtattccaagagggcaaaagtagaaacagtaacctttgagataggctctgaaactcacacag

SEQ ID NO: 6794845 - DNA, 106 bp, Homo sapiens
gtggaaagtcctcatttgatacatgaaaaaactgaggcctggtgaggtggtgataaagtccaggtcaccccgggtacttatttctaatcagtagtaggcttaccac

SEQ ID NO: 6794846 - DNA, 96 bp, Homo sapiens
gaggacactagagctgggctgtctggcttcaagtcccagctctgtaacttactagcagtgaggctgtgggcaagccactccccttctctgtgcctc

SEQ ID NO: 6794847 - DNA, 64 bp, Homo sapiens
gcctggaagtccagagtacattggtaaatgcacagaaagcaaatgtagtttctggactcagtgc

SEQ ID NO: 6794848 - DNA, 67 bp, Homo sapiens
ttgacttttccactgtagagatgttgaagttaaaataatttcaacatcttggagctggaacatacaa

SEQ ID NO: 6794849 - DNA, 62 bp, Homo sapiens
atgtacaccaggtgaagatgaatatgccaaccaatcacagtacatctccactgggggtacat

SEQ ID NO: 6794850 - DNA, 62 bp, Homo sapiens
acttcactggaagacagcctactttgggatgctaaagaaggctgtgaactctatgctgaagt

SEQ ID NO: 6794851 - DNA, 87 bp, Homo sapiens
tttcagactctatgtaagagcactgtggtatgctgagcagaaacacctgactctaacactgtaatgctttctatgcgagttaagaaa

SEQ ID NO: 6794852 - DNA, 79 bp, Homo sapiens
ttggcccagtgcctggcacccggcgtgcccagggccgtgagctgggcatggtcctggtagcggtgtgcttcctggccaa

SEQ ID NO: 6794853 - DNA, 107 bp, Homo sapiens
gtctttatagcattgctgctggtctgggatgagggatgtatatttttaaaaccatctaaattcctacatcctatccctggatagttcagtagtgtctctgatgagac

SEQ ID NO: 6794854 - DNA, 77 bp, Homo sapiens
tgtaattgcttgtaaagccctgaaagtagcttagatgtttttaacaaattgtgtattcaggttttcaaataattaca

SEQ ID NO: 6794855 - DNA, 114 bp, Homo sapiens
gtgtgttgtgttctaaaacttgatgaggtggtaattggcattccagatgcttttctcagatactaatctatgctagatgagtaaatggagtcttccctctaggacagaatatgc

SEQ ID NO: 6794856 - DNA, 55 bp, Homo sapiens
cagtgtttagcacagtgcttggcacatagtaagccctagtaaatgttaaatattg

SEQ ID NO: 6794857 - DNA, 61 bp, Homo sapiens
tctcatttattaactgagacttgcctggagaaggaggcaagtcagagccaagtcaatgaga

SEQ ID NO: 6794858 - DNA, 61 bp, Homo sapiens
ggactgccgttacaaacacacaaacttggtgatttcatagaagtttgttcttgtatagtct

SEQ ID NO: 6794859 - DNA, 111 bp, Homo sapiens
attttctctgttcaagtagtacagtaggcacagattaacatttaaatttttcacatatggtatatttcagaaatttgaagttaagcaaaaattttaatgagtagagaaagt

SEQ ID NO: 6794860 - DNA, 60 bp, Homo sapiens
gtcaggagatagggcaagcttcaggaatagttaagacccagagggttatctatccttgac

SEQ ID NO: 6794861 - DNA, 64 bp, Homo sapiens
tgcctgcctctggcagccctgcccagcccacctctgtctctgcagggcatcccggaggcaggca

SEQ ID NO: 6794862 - DNA, 78 bp, Homo sapiens
cgcacgctccaccagcttcagcagccgcggcacctcggaccgcgaagccgcttcggcccggagctggcggagcaggcg

SEQ ID NO: 6794863 - DNA, 76 bp, Homo sapiens
gcagcagtcattgtctttagccagcagtcttctcctgggaagggccagcagaagtgtggtctagcagtggcgctgc

SEQ ID NO: 6794864 - DNA, 96 bp, Homo sapiens
ctggtaacctttcacggctcttagagctgggtgactttcttctcaatttatacaaacaaggtatgtacacacagctctaaatgacttggttaacag

SEQ ID NO: 6794865 - DNA, 83 bp, Homo sapiens
gggttttgtcatgttttattttattttgagacagggtcttgctctgtcatccaggctggaatatagtggcatgatcatagctc

SEQ ID NO: 6794866 - DNA, 64 bp, Homo sapiens
tttctgtgttaagtatttgatacactcttttggtagtgtagtcacatacttaatttgcatgaag

SEQ ID NO: 6794867 - DNA, 94 bp, Homo sapiens
gattttagctatttcaccttgatggagtgatgaatgattcacattagaacagatgattcacagacttcacaaggcagaaattttagcgcctgtc

SEQ ID NO: 6794868 - DNA, 55 bp, Homo sapiens
ctgtagttgggcattataatagtattattagataattttagagtgccaattatag

SEQ ID NO: 6794869 - DNA, 56 bp, Homo sapiens
ttcttcaggtggttttggtaaccagaggacatttgcatccatgctgcctgaaagaa

SEQ ID NO: 6794870 - DNA, 111 bp, Homo sapiens
gccttgtgccttcccggtcccacttgtgtcaaagctatacaggcctagacaggatctggtaggagcctgggctttagagacagagcctaaggccgagagaaggcaaggggt

SEQ ID NO: 6794871 - DNA, 55 bp, Homo sapiens
gcagctgcctccatggtcaaagatggtgacaaccaatgggaagctggcgagcagc

SEQ ID NO: 6794872 - DNA, 81 bp, Homo sapiens
ctttctcatctccattatagcatcatgcctgccttttctactcattaaggcttgttggctgaataaatggggatgcaagag

SEQ ID NO: 6794873 - DNA, 124 bp, Homo sapiens
tctggatatgtcttgaataattttgactgagattaggggaaggatacatagatctctgaagattttctttggtcattgttcttttctgtgattctaaatgcactttattttcctggtgtccaga

SEQ ID NO: 6794874 - DNA, 88 bp, Homo sapiens
tttggctcagatcttattattgttgtaaaagcaaggccgaagcatgaaagccttgtatttgaaacagtgcatgggttttgttaccaaa

SEQ ID NO: 6794875 - DNA, 112 bp, Homo sapiens
gggctgctgagaggaggctggtgaggtctgagatgttggggcagaaggagcccaagggaaatggggcttgtacaggaatccatggtattacccagcgctcccatagcaggcc

SEQ ID NO: 6794876 - DNA, 61 bp, Homo sapiens
gtctgaagaatcccagggaatttggcctctttcccagtcaggctccaaagattcttcatgc

SEQ ID NO: 6794877 - DNA, 112 bp, Homo sapiens
ggtttaagtcccattaccattgatgtgagctaagtactctcatcaagaggcttgggagcccttgagttatttagattctttttgtaacattacaggagaggggaaaaaagcc

SEQ ID NO: 6794878 - DNA, 72 bp, Homo sapiens
gccactgctttcctatttgaagtgtatgccctggaaatgataatctatagcaacagagaagtaggagatggc

SEQ ID NO: 6794879 - DNA, 56 bp, Homo sapiens
gaggggtatgcaggcaggaggctccatgtgtgagtttcaagtctctaggacttctc

SEQ ID NO: 6794880 - DNA, 59 bp, Homo sapiens
aggatttggagtttaacaacttgaagatggtgaaaattttaaagtgctgctcctatcct

SEQ ID NO: 6794881 - DNA, 78 bp, Homo sapiens
ctttattgtcttcccctgccaggtgcctttgtgcagtgcgcaaacttcacaactgtacatggcagctctgcaatggag

SEQ ID NO: 6794882 - DNA, 94 bp, Homo sapiens
gctcactttgttttgtttcatgatgtagtgacttggcagagattgtaaaactcttttcaaaatttcactgcataaacgtatcaaggatttgagt

SEQ ID NO: 6794883 - DNA, 65 bp, Homo sapiens
gttgacagaattgtgtggctgggagcatccgtctaatttgatgagtttagaaccaattctgcagc

SEQ ID NO: 6794884 - DNA, 93 bp, Homo sapiens
ctggacttttcttattttcatgtagcttcctaggagtgattaatgggtcattgaggactgggaactagggaccagggatgtgaggagggccag

SEQ ID NO: 6794885 - DNA, 64 bp, Homo sapiens
tcttgatgtatgttgtcctgccccaagtcatggggctgctgggctggaaaaacaacatacaaga

SEQ ID NO: 6794886 - DNA, 71 bp, Homo sapiens
catgtcacaatatgattagatgttttctgatgattttaagttcttctgaggcatttaattatgaccccatg

SEQ ID NO: 6794887 - DNA, 76 bp, Homo sapiens
gatggcgcagaggtgtctgtggtgggggacctaggtcctgaagccacctcacccagaggctttccccctgcccatc

SEQ ID NO: 6794888 - DNA, 63 bp, Homo sapiens
cctgggagaacatcatggaaggggcaggattcacaacgactgcagctttgtctgtcttcgggg

SEQ ID NO: 6794889 - DNA, 60 bp, Homo sapiens
ggactcaggttggagtcacagtgattggggcagagatggtcatgtgacccaacctgagcc

SEQ ID NO: 6794890 - DNA, 72 bp, Homo sapiens
agggttactgaattatgtaaaatatggtgaaaaataactagtgtttattaacataattctattggaagccct

SEQ ID NO: 6794891 - DNA, 62 bp, Homo sapiens
actctcttgagactctgctttttcatctgtgtgatggaaattaagatttgtctcagatgggt

SEQ ID NO: 6794892 - DNA, 80 bp, Homo sapiens
taatatattcctacatcagcactatgattaaagtatctaaaatggtaactatagtcagtctggtggttttggtcttatta

SEQ ID NO: 6794893 - DNA, 59 bp, Homo sapiens
tgggcttttgaacttggtttgtaaaaataagatggaacactcagccaggtacaagtcca

SEQ ID NO: 6794894 - DNA, 63 bp, Homo sapiens
ggctgcagaggggttgaagggtccaggcactagctgggctcttttacctctcctctgagggcc

SEQ ID NO: 6794895 - DNA, 77 bp, Homo sapiens
aattctagggctaactgtagtaattctagttttgcaggttaggctgcagaatttgattttattaagttcctggaatt

SEQ ID NO: 6794896 - DNA, 114 bp, Homo sapiens
agctcagggtggggagaaatcagggttcccccagtgccatctaatcagtggtgatgcaccagctgccctcgctggggccagatccctggcttcttcctgcatgatccctaggct

SEQ ID NO: 6794897 - DNA, 90 bp, Homo sapiens
gaggtagaagatactgatgcctgatgattattggtagaaatttcattttcttaatggcatgcaggtttcatggcccctttctgatacttc

SEQ ID NO: 6794898 - DNA, 69 bp, Homo sapiens
ctttagtgcttattactgtgctgtctttgagagcagatctcctgacttctattataatgaggtctaaag

SEQ ID NO: 6794899 - DNA, 78 bp, Homo sapiens
cctccagctctggagggggcggcccctgtgggcacagcccagcgtgtgttcctggggacctgccttccctgagcgagg

SEQ ID NO: 6794900 - DNA, 56 bp, Homo sapiens
atagctttctatatatgagttgctggggaccttcacattctcttttagaaagctgt

SEQ ID NO: 6794901 - DNA, 66 bp, Homo sapiens
atgggagcttaaatggctaaatataatttgtttttcagctttgtgtttttaggtttgggttcctat

SEQ ID NO: 6794902 - DNA, 60 bp, Homo sapiens
gacaaagtgaattgcttcagcagtgggtagataacccactgtttttcagttaactttttc

SEQ ID NO: 6794903 - DNA, 120 bp, Homo sapiens
ggttatactcctcctcttattgaaccctattgtttctggtctctgtattcttcctggatacagagccaaaaggacatagtagcataaagtatggtgtagctagaaggaagggtgataacc

SEQ ID NO: 6794904 - DNA, 114 bp, Homo sapiens
aagtgcagacatttaggtgacagtaggaatggagtcaggagctgagtctaacttttctggctctaagaccagtttctttccattgttacctcgatacctttaaatcatgtactt

SEQ ID NO: 6794905 - DNA, 62 bp, Homo sapiens
tccctgcagaagcttgtgtgtagtgcacatcctgcagcactgtacacagtggttctgaggga

SEQ ID NO: 6794906 - DNA, 71 bp, Homo sapiens
ctgactgtccctggagattttttagtggcgcagaggtcatttgacaacttctggtggcatccaagtgtcag

SEQ ID NO: 6794907 - DNA, 60 bp, Homo sapiens
catctttaacagaatggatttggccaccttcagacatgccctgtttattttgataagatg

SEQ ID NO: 6794908 - DNA, 62 bp, Homo sapiens
atcagattgtcaagaggctgctttgaattgtgaaagtagtagtttccctctggcaattagat

SEQ ID NO: 6794909 - DNA, 55 bp, Homo sapiens
gtagagctgttgagcttgacagtaaccttggatctgtcagttctgctcgctgtgc

SEQ ID NO: 6794910 - DNA, 129 bp, Homo sapiens
ataaacagctgtggctagagcaagaaggtgaccgggagggagggataggatacagataggtcaagaaagagacagtgaatccaaattcctaccagatgcttattttttcctcaaagttaagctgtttct

SEQ ID NO: 6794911 - DNA, 101 bp, Homo sapiens
gctgcagtccgtgggccacacattgagcagctgtttgtaactaaggtgacttttaaaatggtttataacaaacagcgtttcagatgtggttaggatgctgc

SEQ ID NO: 6794912 - DNA, 58 bp, Homo sapiens
tgagaaaggtatttcatgcacttaagagagagacagagagtatgaaagtccactctca

SEQ ID NO: 6794913 - DNA, 65 bp, Homo sapiens
gtggaacactcagaaatgctcgtccttgaaataatgtcattgggagcattccctgagggtcccat

SEQ ID NO: 6794914 - DNA, 118 bp, Homo sapiens
ctgttttgagaatcaactgggcccagcatactgtaagtgcaaaagtgtaggtaaattattgtcattgctcacattctgaatgcctgacagtaagtgctcaaaaaatttggtagaatag

SEQ ID NO: 6794915 - DNA, 96 bp, Homo sapiens
ttcttgaggcatgtaattcatggatgattttcaaaatgtcatatttgaattgggaaagtaacatttcttgaattaatcagccaattgcttcaagaa

SEQ ID NO: 6794916 - DNA, 61 bp, Homo sapiens
agccaggtcagctcaccctgcttcaacaggattccagcctgtgtgtgctgtggacctggct

SEQ ID NO: 6794917 - DNA, 129 bp, Homo sapiens
ctctgggcccatcccagccctggcctgtggcctttcttgtgaccatcagggcctggagacccagcaaggagttgcctgggtgctggctggtcactgccagaggcctgggctgcatgaggacctccaggg

SEQ ID NO: 6794918 - DNA, 66 bp, Homo sapiens
gggaagggtgggtgagagtgcgtgaggccaaggcgctgtccagcgttactattactgacacttccc

SEQ ID NO: 6794919 - DNA, 74 bp, Homo sapiens
agctgtagtgaatagagcatgctgattaattgaatgacatgacattgaattataagtgtgtctactttccagtt

SEQ ID NO: 6794920 - DNA, 64 bp, Homo sapiens
tttgagcagtattttccatttctgtagcagcaagctagtgctttgaaagataatactgtccaga

SEQ ID NO: 6794921 - DNA, 84 bp, Homo sapiens
tccatttggtaaacgcattatatccctctgtgatatcttgaatattcatatatgtattagagcatataatttgacttatgtgga

SEQ ID NO: 6794922 - DNA, 76 bp, Homo sapiens
cagggttgattccttctggaggctctgagggtgagtctgctccggacccctcttgcccagcctccagtgggtcctg

SEQ ID NO: 6794923 - DNA, 57 bp, Homo sapiens
ggaggctgctgcctcacgtgggccacctctagcactacaacccaggcaggagcatcc

SEQ ID NO: 6794924 - DNA, 60 bp, Homo sapiens
ttgttctcttatctggcattattgggttagcccccactgtgcctggtgtggagagggtag

SEQ ID NO: 6794925 - DNA, 104 bp, Homo sapiens
tccttgtcaccatggtctgcattttcctggccaaatgctttgtgagaaacaccagttccatgcagctggtcaggaggacagagatgcctatgctggcaccagga

SEQ ID NO: 6794926 - DNA, 60 bp, Homo sapiens
cctttgtgtcttgatggtagatgtgaatataaaagaatattcatgcaagattcataaagg

SEQ ID NO: 6794927 - DNA, 81 bp, Homo sapiens
gatagaagccagaatcagatgcctgtggggtctagggtaaaccctgcctgcagaaagtatctccagaatttggctgaaatc

SEQ ID NO: 6794928 - DNA, 113 bp, Homo sapiens
cctgtgagtcctcctggatggcagagccccctgcccaggcccacacttgcatcctagtgaggaccaaagcaggccctgggccaggggaggcagctgtcctggtggattccagg

SEQ ID NO: 6794929 - DNA, 80 bp, Homo sapiens
gcgccagccagtccctggggggacggggcacattggacatgttgagacccctctggcccctgtggtggattggtgagcgc

SEQ ID NO: 6794930 - DNA, 74 bp, Homo sapiens
ctgctggctatgtgactctggacccattgatgaactactcattaagccccagtttctgcatgatattgtcacag

SEQ ID NO: 6794931 - DNA, 80 bp, Homo sapiens
cctgggagaatcaaaggagtgtgaccttccagctccaagttaccaaaggtcaagtgaaaggtcgcactccgtttctcagg

SEQ ID NO: 6794932 - DNA, 56 bp, Homo sapiens
ttcctttcacgttttaatgcacactgtttaaggatgtattaggaaggaggaaggaa

SEQ ID NO: 6794933 - DNA, 65 bp, Homo sapiens
tgatttggagtcagagatagcatcatcttcctccctgaagaagggccatcttggactccccatca

SEQ ID NO: 6794934 - DNA, 91 bp, Homo sapiens
atttgtaaaccagtcactggctgaggaagttgccactgttggcttagatcaggggtaggcaaactacagttagctgcctgtttttataaat

SEQ ID NO: 6794935 - DNA, 83 bp, Homo sapiens
ccttggggaaagtgagcctataaacaagtccacactgaaatattagtgatgggtaactgtttagggagctccctctcccaggg

SEQ ID NO: 6794936 - DNA, 61 bp, Homo sapiens
aaagtgttgctgtggagcctggtttgttaatctgtacacatgaggtctgcagctgcagttt

SEQ ID NO: 6794937 - DNA, 55 bp, Homo sapiens
cctgggtccctgagagatgattgctcctgagcagtggcctctccccagacccagg

SEQ ID NO: 6794938 - DNA, 57 bp, Homo sapiens
tatattagtgagatttatccatgttatgcatagttgaagttcattctcactgatgta

SEQ ID NO: 6794939 - DNA, 77 bp, Homo sapiens
gactcttatgttcagaagtagctccccttcattagaacagaaattactgagtggataggaattgctttagatgagtc

SEQ ID NO: 6794940 - DNA, 70 bp, Homo sapiens
ttctctcttcagtttccctaaagccaattaggcactcataattgccatttgggaaatggatttgggagag

SEQ ID NO: 6794941 - DNA, 69 bp, Homo sapiens
ttttagttttacggtgcggatgtgggtttcaacaccataatgggttaacttctgcacagaaaatttgaa

SEQ ID NO: 6794942 - DNA, 128 bp, Homo sapiens
tcttaactggtataaagaaagccatttaactgatcagtgtttatttacagatggtttgacagtcctagagtttaagctgaatctgaaatagaattgttggtctgggctgcatttaatttggtggaaga

SEQ ID NO: 6794943 - DNA, 106 bp, Homo sapiens
ttttccagtgacccatgctatggccatagttaatccaggttgtgaatgtccttcagaggtgccaatgtatgaggattacaactggaatggtgctggcactggagag

SEQ ID NO: 6794944 - DNA, 68 bp, Homo sapiens
tacattggcctacggaagctactgatgtatattatctatgatagcagaaaccaagcttcttcaatgtg

SEQ ID NO: 6794945 - DNA, 63 bp, Homo sapiens
ttagtccccatgtgctctggcccctctgccccgaagagagccaggaagtggcgtggggtctga

SEQ ID NO: 6794946 - DNA, 56 bp, Homo sapiens
tgtaattgagcatccagagtatggagaagtaattcagcctcagggtgaccaatgca

SEQ ID NO: 6794947 - DNA, 125 bp, Homo sapiens
tgttaaatagcatcaatgttagtctactctgtttttgcacatgaaactaggccaatcaaattattgttccaagctgaataatttgtggtttaggtttcatggcctgacagtgatgtctaatgata

SEQ ID NO: 6794948 - DNA, 64 bp, Homo sapiens
gccatcagaatctgatatcccaccacagttgagtatctctggtctgataccggattccagttgc

SEQ ID NO: 6794949 - DNA, 74 bp, Homo sapiens
cagaggtggctgtaagtgactcattaactccctctcccatgtttccatcaccgtgaattacaacgtcatctctg

SEQ ID NO: 6794950 - DNA, 55 bp, Homo sapiens
cagaggccccagaactagctctttgttttcaaaagcttcaacaggatggcttctg

SEQ ID NO: 6794951 - DNA, 75 bp, Homo sapiens
gtagagaagaggtggccaactcaatgtttttcatgagtcttgtcatgaaggatcagtggcttcttttttatctac

SEQ ID NO: 6794952 - DNA, 59 bp, Homo sapiens
ttgccttgttgtcccggtttacagtcgatttctacaagtaaactagattagcagggcag

SEQ ID NO: 6794953 - DNA, 77 bp, Homo sapiens
gaagcctccgtccctgtcctctgtcctcagcaggacacatccctgtcctctgctggaagggcaagaggcctggcttc

SEQ ID NO: 6794954 - DNA, 84 bp, Homo sapiens
tccagacccctcaactagcccaggaagtgtgcctgagcacctcccatctttcagggatctgggttcaccatgctcctgggtgga

SEQ ID NO: 6794955 - DNA, 73 bp, Homo sapiens
ctatgtgaaatatgaactcacaggaagctgacagtaaagaaagctaatagtgtctagtgagtttgatgcatag

SEQ ID NO: 6794956 - DNA, 130 bp, Homo sapiens
agaccatgagaggaagaaggggttctctaacgtctgctcagtgaaacatcaaatagtgactttattagttaatgggataattgttcatgggagatcattagagagcccaaatcaaagaatttcttaggat

SEQ ID NO: 6794957 - DNA, 56 bp, Homo sapiens
gagacagatctcggctccatgcagcttaaggcagaggtgggtgccgagtttgtctt

SEQ ID NO: 6794958 - DNA, 63 bp, Homo sapiens
tctacttctccttcatttcccatccaaaaacatcctaaaggataagagatgaaggggaggaga

SEQ ID NO: 6794959 - DNA, 86 bp, Homo sapiens
ctcttccccagcgcccaggggcagggctctctggcctggcttgtgctggttcccagagtccctgctgtcaggtgctgggagtggag

SEQ ID NO: 6794960 - DNA, 82 bp, Homo sapiens
ggttccaagtctttgctactgtgaatagtgccacaataaacatacgtgtgcatgtgtctttatagcagcatgatttataatc

SEQ ID NO: 6794961 - DNA, 77 bp, Homo sapiens
tccagggcactcttgccctaggctggcatttgcatgatccattagtattcgtgcccacagctcagggctgctctgga

SEQ ID NO: 6794962 - DNA, 60 bp, Homo sapiens
gctctgtgctcccatgctagtaacttaacctctctgagtgtgtactagttaagtacaggc

SEQ ID NO: 6794963 - DNA, 98 bp, Homo sapiens
tatatattttcagaggaaattactagtaggtgggtagagtaagtacagacaggacttacccaagttatttgtagtttgtactggtaggaaagtatatg

SEQ ID NO: 6794964 - DNA, 59 bp, Homo sapiens
tttacaatagggtctgaatgaagtgtgaagataccttattttaaatgcctaattgtaaa

SEQ ID NO: 6794965 - DNA, 77 bp, Homo sapiens
gctgagctgtgtggcatgtggacctgttttcccaggagggagcactcctggggttttggccgcagctgcacatcagc

SEQ ID NO: 6794966 - DNA, 58 bp, Homo sapiens
tgcagctcagaagggaggaaatgaggagtagaatctccttccctctctcctgggtgta

SEQ ID NO: 6794967 - DNA, 64 bp, Homo sapiens
cggcgtgcgttcctagtaaacacgcaccgagagcacggtgtgcgttcctagtaaacgtgcaccg

SEQ ID NO: 6794968 - DNA, 76 bp, Homo sapiens
ttccctgctggcttccctacctgcaccttgtagatagcaccacccggggtgcaggctggggcaggctgtggtggga

SEQ ID NO: 6794969 - DNA, 74 bp, Homo sapiens
tatacctgctcccaagtcttcactcaggttctgctcttgggagagaggaaacccaaactaagacagtaggtata

SEQ ID NO: 6794970 - DNA, 101 bp, Homo sapiens
tggagtaaggatatcattgtcacattcaagttttatatccatggcttgataaaattgggttttagaataataactgatgacaatgtaggtcatatttttca

SEQ ID NO: 6794971 - DNA, 67 bp, Homo sapiens
caggagaaagatggttagttttcttgttaacattcattaatcttgaaatctagtcatttttagtctg

SEQ ID NO: 6794972 - DNA, 61 bp, Homo sapiens
ccagctccagcatagccaccatatggagatggcatttaatggcccggtgcaggagggctgg

SEQ ID NO: 6794973 - DNA, 56 bp, Homo sapiens
gaagaacctgatataggaagtaaaaacattttagtctcttcttgataaggttcttt

SEQ ID NO: 6794974 - DNA, 60 bp, Homo sapiens
tttacactgccattctgaatacatgctaacggacataaagattcagaataggcatgtaaa

SEQ ID NO: 6794975 - DNA, 55 bp, Homo sapiens
gcagcggtggaccaggggcggccccgaccccgcgtgcccaggggccaaccgctgc

SEQ ID NO: 6794976 - DNA, 90 bp, Homo sapiens
gaggtttctagcagaagttgcaaactaggggtttccatttgctctatttacctggaagtctcttgcacttacttttttctagtctgcctc

SEQ ID NO: 6794977 - DNA, 130 bp, Homo sapiens
catgagggtaaccaggcagagaggcacagctgacatgtgtaatcagctccgtgggcagaggagggatgagtgacggagctgtttgcggaatgtcctacctgtccatcactggtgccaaaatgccctcttg

SEQ ID NO: 6794978 - DNA, 60 bp, Homo sapiens
ctggcagggctctttgggtgctggatgcagcaaattctacacctagggatgctcttccag

SEQ ID NO: 6794979 - DNA, 81 bp, Homo sapiens
ggagcttgtttaaaatgcatgtgcctgggccatactgagaattttatttcaagtctgtttatgcatatttaaaacccctct

SEQ ID NO: 6794980 - DNA, 100 bp, Homo sapiens
gggaatccgattttcccaggtccagccaggtgctcatgcctgggatcattcagctatgattgggttggcagagactgggttggcagaggaaggggttcct

SEQ ID NO: 6794981 - DNA, 64 bp, Homo sapiens
tgattatacctcagtaggaagtacagactataaagtttaataacttattctgagattatgatca

SEQ ID NO: 6794982 - DNA, 56 bp, Homo sapiens
tcctgagttgcatagtgaagatgtgaaaagttattttaagctattgaaattcaggg

SEQ ID NO: 6794983 - DNA, 65 bp, Homo sapiens
gcttgctgggctcaacctccagagcttctgatttaccaggcttggggtgagggccaagaatttgc

SEQ ID NO: 6794984 - DNA, 55 bp, Homo sapiens
gatacaagtggagttaggaagttttgattgggtcaaagcttcacttcatttgatc

SEQ ID NO: 6794985 - DNA, 59 bp, Homo sapiens
acaccctttctctggctttgggtgttgtcttcccagtttcctgaagagaaagaatgtgt

SEQ ID NO: 6794986 - DNA, 70 bp, Homo sapiens
tctagaagaatcctgtcctctttaggagtgagagtgagccctggaatagacagggatctttccacataga

SEQ ID NO: 6794987 - DNA, 75 bp, Homo sapiens
aagttggagacagtgtcgagaaagaacaatggagtcggtgttagaagctccatgtgaccttgagctgcttgactt

SEQ ID NO: 6794988 - DNA, 74 bp, Homo sapiens
gagagatctgttgcttcagaagttctgcttgttgaccagcagagggcagtgaattttgaagctcagtatttttc

SEQ ID NO: 6794989 - DNA, 65 bp, Homo sapiens
tagtgaaagcatgtgtaatctcaatacctccattgggggttgtaggaatatatgtagtctcactg

SEQ ID NO: 6794990 - DNA, 61 bp, Homo sapiens
tgtgaatacattggtagaagcagaaaataaatttgtttccatcactccaatgtaatttata

SEQ ID NO: 6794991 - DNA, 100 bp, Homo sapiens
ggagagaaaggacagccaagattgtcacaaagaaggaattggtctttagggcctcattctgagtgttttgctttctctgtaatgttggcgctttctcttc

SEQ ID NO: 6794992 - DNA, 73 bp, Homo sapiens
aggaagcccctccccaccaggtcctgtagcacccaccactaggcaggaattgggctatagggaggagcctcct

SEQ ID NO: 6794993 - DNA, 112 bp, Homo sapiens
ggcctattgttctaacccttcccatgttcacattgaatttctgatgacaaagcatatttattgtcttccatccagattttaagtgctgtttgtggggttttgagcagttgcc

SEQ ID NO: 6794994 - DNA, 67 bp, Homo sapiens
cgtcctcagggcttgcaggagaaagtttctgattaaggaaatggatccgtggaagttgctgaggatg

SEQ ID NO: 6794995 - DNA, 57 bp, Homo sapiens
ggaatgagagcacagtgtggtctggatcgatctgattgttactgtgtcctcagcacc

SEQ ID NO: 6794996 - DNA, 67 bp, Homo sapiens
cacatttaagtgcttgttcagagctcgctattcactcaaagctttaggggcagagacacttaaagtg

SEQ ID NO: 6794997 - DNA, 66 bp, Homo sapiens
ggaaacacagggatatatattccaggccacaaattttctccctggaaaatttatgtctgtggatcc

SEQ ID NO: 6794998 - DNA, 76 bp, Homo sapiens
caattcgctgggttcaggactggggcccttgtgtcccccttgtggggcatgaggtcattcttggattacagagttg

SEQ ID NO: 6794999 - DNA, 79 bp, Homo sapiens
tacagagaattgtgagcataacagactgatttttaaatgcaattgtattttagggcagtttgttacacagcaacatgta

SEQ ID NO: 6795000 - DNA, 61 bp, Homo sapiens
ggtggcagcataaagcatttagctgcaaatgaattttccagtgtgagtgctcatgtccatc

SEQ ID NO: 6795001 - DNA, 55 bp, Homo sapiens
tgccttctgctctgaggccgctgcggtgcccgtggctactgtagagacggaagca

SEQ ID NO: 6795002 - DNA, 59 bp, Homo sapiens
gagccagaatgacccatcaggctgcacctctctggcctgtaaatagtttcttctgactc

SEQ ID NO: 6795003 - DNA, 82 bp, Homo sapiens
ggggagaatagagagaaaaggcaatatcaagagaattcgtcaccacagttgtctggatgctgttgccttctttgctcaccct

SEQ ID NO: 6795004 - DNA, 59 bp, Homo sapiens
ggctggatgggctgtctgagcgctgtgccccatacaagaaggatggagcccactttgcc

SEQ ID NO: 6795005 - DNA, 92 bp, Homo sapiens
tgtggattaaatagaatatatgattaaagttgatttcatctatttcttttaactttaaaaaatatgtctgttagaggatttgaaattccaca

SEQ ID NO: 6795006 - DNA, 98 bp, Homo sapiens
gcagtggcccagccctgcaaggccccagatggtgtcccaggctcaggctgtgcagtcgcagtcggggcctggaggcaccaggccttgcaggccactgc

SEQ ID NO: 6795007 - DNA, 84 bp, Homo sapiens
tcaagtagttcatgttatcacagaagcaaatgaaaagtctcccaaccttttcatttacttctatgacaacatgctctgagagga

SEQ ID NO: 6795008 - DNA, 63 bp, Homo sapiens
ggcagtgaggtcatgtaatttgatgtcttataataggagttcccaaattacaggccacagacc

SEQ ID NO: 6795009 - DNA, 67 bp, Homo sapiens
tggccaagatgtggccacaggagacggctcaacagtggaagctcctacggtggccacagtctggcca

SEQ ID NO: 6795010 - DNA, 72 bp, Homo sapiens
ggcatcagataacttcagtttctgtgtcctcccttgagatattttaagattagaagattcaaatctgatgtt

SEQ ID NO: 6795011 - DNA, 62 bp, Homo sapiens
aagctttttggatttgcttcagatctttatttccaagctcagtagcaaactcctgaaagctt

SEQ ID NO: 6795012 - DNA, 59 bp, Homo sapiens
tttacatgagtagcagatgttctgaaggtgaaagtcatgtactctgtctattcagtgaa

SEQ ID NO: 6795013 - DNA, 56 bp, Homo sapiens
tatgctcagatacaattcctcatgtgggagattctgagggattgatgtttgacatg

SEQ ID NO: 6795014 - DNA, 110 bp, Homo sapiens
cctcttctcctcttcctaccaagctgctcttctgtgcctctgttgtaactgggtcatgtttttgactctagcaagaggaaacaaggggccttcagtgggaaagcaagagg

SEQ ID NO: 6795015 - DNA, 62 bp, Homo sapiens
ctggctgattttctcacttctcaactagttttcctagcgttctatgagaaagtcctggtcag

SEQ ID NO: 6795016 - DNA, 77 bp, Homo sapiens
attgctagaaaagataacattctgtgccttcatttgtcatgttcatttgagcaataatgttacttttttaaggcagt

SEQ ID NO: 6795017 - DNA, 62 bp, Homo sapiens
gagatacatttgtgtgcatgtatgtgtacgtgtgtgtgcatgtatgcatatatatgtatttt

SEQ ID NO: 6795018 - DNA, 70 bp, Homo sapiens
tgtgggcagagcagagcctgcattggccatctccatctggcccaggccaacaggccttgctctgctcaca

SEQ ID NO: 6795019 - DNA, 88 bp, Homo sapiens
ctacctctgagacatctcatcctgccctaaaacagcactgtaaatcaaaatcttggtttgttttatcaagatggcatgtcgtttgtag

SEQ ID NO: 6795020 - DNA, 59 bp, Homo sapiens
gggaattatagctgtcacaggctcagcagtaatgtcttaggcttaataatgtaattccc

SEQ ID NO: 6795021 - DNA, 71 bp, Homo sapiens
gagggctggggcttaggcttaggcaaaatgaagtaaccaacagagcctctttgcagtaaattccagttctc

SEQ ID NO: 6795022 - DNA, 93 bp, Homo sapiens
gctgccagggaagaggccccaggttgcttgggtcctagaacaagacatattgttccagcccatccctagcctgggagatctgtttctggttgt

SEQ ID NO: 6795023 - DNA, 92 bp, Homo sapiens
ctcccacctgccacaatgcagcccacaccactctgctcatggactaagagaccgttgacaagtagggtgggatttgttttgtgcggggggag

SEQ ID NO: 6795024 - DNA, 64 bp, Homo sapiens
gggtctggcctggcattctatgggcacagtggttatgtggccacggctgtgagagtcagtactc

SEQ ID NO: 6795025 - DNA, 82 bp, Homo sapiens
gcccgaggccacagcagagtagttttccaacttgttccagttggcatcaagttggaaatctagtcttcttttcattttgggc

SEQ ID NO: 6795026 - DNA, 117 bp, Homo sapiens
tcacgtattttggccagtggaatgtgagtagacgtgatctagtaacatccaaggagaattttgtggtgcttgatttgtctgcttgcactcttactgtcatccatgagaaatgtatga

SEQ ID NO: 6795027 - DNA, 66 bp, Homo sapiens
ctttgccttctggagctatgcggtgtaaagaccactgctgtttttccacctggttccagggcttag

SEQ ID NO: 6795028 - DNA, 64 bp, Homo sapiens
gtctgacatgagggctgtggagaccttgattcatttgtccaatctcggcagccctgtgacagac

SEQ ID NO: 6795029 - DNA, 77 bp, Homo sapiens
aaatgtatgtgcgaagctggctctgatgtcagaatgaaccattttcacaggattgggtcagctcccactcaacattt

SEQ ID NO: 6795030 - DNA, 57 bp, Homo sapiens
agcctttgttccttctggaatggtacaagaagagtcaatgtctaggagagcagagct

SEQ ID NO: 6795031 - DNA, 75 bp, Homo sapiens
atagagaattcttccttgctcaatgtgttcactggtcttaagcttgagcatcggatggaatttcctcccctctgt

SEQ ID NO: 6795032 - DNA, 78 bp, Homo sapiens
agttcttcttctttattttatttctgcattttgttttccatgaggaaggcagctagagagtgaaactgaaggatggct

SEQ ID NO: 6795033 - DNA, 63 bp, Homo sapiens
ccccagctcccaagttgctatgggacataaaatgaaatatgaaccaggggatgggaactgggg

SEQ ID NO: 6795034 - DNA, 78 bp, Homo sapiens
gtcatttttcatgtgtgtctgtttttaaagtttaaacaattaacagtactcaagtgacagagactcatgaaagatgac

SEQ ID NO: 6795035 - DNA, 57 bp, Homo sapiens
gcattaatactcctgttcaaggatgagggttttcttctaaaagcaggtgtatagtgt

SEQ ID NO: 6795036 - DNA, 57 bp, Homo sapiens
ggggcaggagaagcagttcttttccttcagagaaagttgtttgtttgttcttgcccc

SEQ ID NO: 6795037 - DNA, 63 bp, Homo sapiens
tgtgcactggctggactctgacctcttttgcctgttgaaagacatcaccccagccattgtcca

SEQ ID NO: 6795038 - DNA, 72 bp, Homo sapiens
gcttgagcccaagaggttgaggctgcagtgagccatgatcatgccactgcactccaacttgggctacagagc

SEQ ID NO: 6795039 - DNA, 57 bp, Homo sapiens
tgtcaggcttttcttcccaggttgttttgcatttcctgggccagatccagcctcaca

SEQ ID NO: 6795040 - DNA, 77 bp, Homo sapiens
ttagctatgtattctccttctattaagttattgcaacataaaggtgatttattaagatgagaagcagacattgctaa

SEQ ID NO: 6795041 - DNA, 61 bp, Homo sapiens
aagccattcccatagacttcagtccaggaggaaaatagctggcttgttatgggaatagctt

SEQ ID NO: 6795042 - DNA, 89 bp, Homo sapiens
tttgcagtttttagtctagattaaattaattggtggtggttttcatttaatcacactaatcttttatttggtttctataatgtcgcaaa

SEQ ID NO: 6795043 - DNA, 63 bp, Homo sapiens
ccgcaatgcagttgcaatggaggactcagccaatcttactgggagctctggagctgcaatggg

SEQ ID NO: 6795044 - DNA, 57 bp, Homo sapiens
ggctctgggccagagttggcttctaggctatagtttgccaattcctggtttagagtt

SEQ ID NO: 6795045 - DNA, 70 bp, Homo sapiens
tcacatggccaaggatgctcaaccatgaatcgcagtgaaaggtttgtggatgtgcttcttgatatgatga

SEQ ID NO: 6795046 - DNA, 60 bp, Homo sapiens
ttgaaatcaccactagcatttgttgaaatgccttctgtcggctaggctggtgattgtcaa

SEQ ID NO: 6795047 - DNA, 67 bp, Homo sapiens
tgcccccgcttctctactcccagccagtgtcagtgacaaggcactgcctgggagggaggcggctgca

SEQ ID NO: 6795048 - DNA, 89 bp, Homo sapiens
tctgcctctcacctgtgtgctggtcctctccagcaggcattctctttgagaatgcttgaatgggattagagacaaccgagaagagcaga

SEQ ID NO: 6795049 - DNA, 75 bp, Homo sapiens
ttcattgtgtgtataaagcaccatttgtttatccattcttccagtgatggatacttgggctttggctattgtgaa

SEQ ID NO: 6795050 - DNA, 73 bp, Homo sapiens
gacatgccaaagatgtttgatagaagccctgagaagacataaaaagggttttttattacagttttggtgtgtt

SEQ ID NO: 6795051 - DNA, 82 bp, Homo sapiens
aatttcctacttaaagatttgtggtttaggaacatgagatcacaattcaaggtgactgaactataaactatctgtggaaatt

SEQ ID NO: 6795052 - DNA, 58 bp, Homo sapiens
gtttctcacttaccaacacatgtgtaaaatgtagcaggtgtgttagtaaaggagaagc

SEQ ID NO: 6795053 - DNA, 74 bp, Homo sapiens
cccagggtcacacagtgagcggggctcagagcttgagtgtctttgtgctttgtgtacattgtgttctccctagg

SEQ ID NO: 6795054 - DNA, 85 bp, Homo sapiens
aactccagctatgtaaactgtagggatctgtcttagtcagctcaagctgttactaacaaaataccatagattgggtagcttagtt

SEQ ID NO: 6795055 - DNA, 104 bp, Homo sapiens
gtggtggcgcttgcctgtaatcccagctactcgggaggctgaggcaggagaactgcttgaacctgggaggcggaggttgcagtgagccgagatcgtgccattgc

SEQ ID NO: 6795056 - DNA, 59 bp, Homo sapiens
gtctgaaaatgccctacgattgcctttacaaataactggtacttcggcagggtttagat

SEQ ID NO: 6795057 - DNA, 80 bp, Homo sapiens
gctaccagaggtgtctctaggacctggtactagactagcctctggtaccagtcatcctcgagaccagccccccttttagc

SEQ ID NO: 6795058 - DNA, 60 bp, Homo sapiens
cttgccagcaggcgctgtgtacagtgcacacagtgggtgctcatatgtgcttgttggagg

SEQ ID NO: 6795059 - DNA, 60 bp, Homo sapiens
gatctcaagagactaagaaagggcaataatagttgttgcacctgccttgctttagagatt

SEQ ID NO: 6795060 - DNA, 67 bp, Homo sapiens
ctccccggtgtgggaatggcggtcgtgcactctgggggtggcgttgttctcgttccctacttggggg

SEQ ID NO: 6795061 - DNA, 93 bp, Homo sapiens
ttggaaacctttgggaaaacatttcaagtagtttgctttccaagccgttttcttggtaaagtaaagattgggaatgtgtcacctaaagcccaa

SEQ ID NO: 6795062 - DNA, 124 bp, Homo sapiens
ggacttagttctcattttcctcccctgttttctccggattgtggctattgttccctggttgctagatcaacctggagcacagtaaagcagtgtcacaaagctggaaggggtctgggatgagtcc

SEQ ID NO: 6795063 - DNA, 87 bp, Homo sapiens
atcatacactcagtgcggaaggctagaaacgatgcttataataactccatagtcaaatatttctgctttctcttgcacagtgtgggt

SEQ ID NO: 6795064 - DNA, 70 bp, Homo sapiens
gtttctcctctgtgtcttgtttaacttttcgtgttagcgaaattcacaaatttgaccaaggaaccggagc

SEQ ID NO: 6795065 - DNA, 85 bp, Homo sapiens
ttcaatggtacttgatgatagaatgtgaggagtgattacacagtgttatggacttcttgcatctgtccattacagtggaattgaa

SEQ ID NO: 6795066 - DNA, 64 bp, Homo sapiens
ctgcatgctaattgcatctgtgtttctccagctgggggtagtggctgtgatgcaattaacacgg

SEQ ID NO: 6795067 - DNA, 57 bp, Homo sapiens
gggcttcgtgtcttcaacaggtgtctcaaacttgcagctcttgggcccaaagggcct

SEQ ID NO: 6795068 - DNA, 72 bp, Homo sapiens
tgggttctaggcaggccctctggaaaggtagctcacctaacaaagctcctccatctcagcatgccagaccca

SEQ ID NO: 6795069 - DNA, 94 bp, Homo sapiens
gtggggcagctcggccagctcccggttcccctgccctgcacgggtgcccgtgctggaggggcctgaccaggaggcctggctgaggttgtgccac

SEQ ID NO: 6795070 - DNA, 65 bp, Homo sapiens
agtgtccataaataaagttttaatgcaacataatcatgttcattcatgtattgtctatggatgct

SEQ ID NO: 6795071 - DNA, 68 bp, Homo sapiens
agatttgagtctctgcacagtaagaagcagtggtgggagactgttttcagatgcagggacacagaact

SEQ ID NO: 6795072 - DNA, 77 bp, Homo sapiens
catgagctaaagctttacttgctttgttacaaaactttattaaagttttaagttaatataattgaggctgtgtcatg

SEQ ID NO: 6795073 - DNA, 55 bp, Homo sapiens
cttatgagggaggctttaagcagatcggtggtttgcttagagacctcctcatcag

SEQ ID NO: 6795074 - DNA, 115 bp, Homo sapiens
ctgtttccccatctgtgttggggcatggtgtgtgtgtgtgtgtgtgtgtgtgtgtgtgtgtgtgtgtgtatgtgtatacactatataatcccaatggattttctaggtaaaatag

SEQ ID NO: 6795075 - DNA, 59 bp, Homo sapiens
tgcattcatgtgtgtttcatgtatggaatagtccatctgtttttaacacatataatgta

SEQ ID NO: 6795076 - DNA, 79 bp, Homo sapiens
tctccaagccctggaactttcctagccacccacagccactctggaacggttcagggctcagagcttccgggtatgggga

SEQ ID NO: 6795077 - DNA, 56 bp, Homo sapiens
caaaaggccagtactttgtttgacatatttggaaactgaggtagctggctcttttg

SEQ ID NO: 6795078 - DNA, 66 bp, Homo sapiens
gctagcttgctctagatgttcagagctgccttcagtatgattatctagcaagttcttcaatatagc

SEQ ID NO: 6795079 - DNA, 67 bp, Homo sapiens
cagaaaactagtcacatgatcacaggatcgtgaagtctcttgatccagaaattatgtaactgtactg

SEQ ID NO: 6795080 - DNA, 118 bp, Homo sapiens
gagttgcctcagccagtggtcttgccatatctacctagcttaggctgagtgttataggagaaagtgcactagcccgggcaccagatggatcaggtaagactctagcttaggtaagctt

SEQ ID NO: 6795081 - DNA, 56 bp, Homo sapiens
ggatgccttcttggtgctacaccagctgcgctgcaatggggtcctggaggggatcc

SEQ ID NO: 6795082 - DNA, 57 bp, Homo sapiens
tgcctggcaatgccagaagccaggactaatcagaccaggcttccttctgtccgggca

SEQ ID NO: 6795083 - DNA, 62 bp, Homo sapiens
tgtggagtcgctggcgatgctctttccttccaaaccccagtatggcttcattgtgctccgca

SEQ ID NO: 6795084 - DNA, 88 bp, Homo sapiens
tcggcattggttgatctgacaagttgtgtgtatagaaactagcctatatggagacacgaatgtcaaaagaagttttaccgatgataga

SEQ ID NO: 6795085 - DNA, 77 bp, Homo sapiens
acatatgactatgtaatttatgttatccataactccgtatgttatggatagtgaagtttacacacattggcatatgt

SEQ ID NO: 6795086 - DNA, 121 bp, Homo sapiens
gaaatgaaagtgtacatcctttaataaatggaaatacttgccataaaactttagcaacaactgccagttagtggcaaagtggtttgattaattgtaacttgtaaaactatgataaaatttc

SEQ ID NO: 6795087 - DNA, 63 bp, Homo sapiens
gagttgtagcaccgtggcttcaaggctgtcttgaccagcagaggcctggccctgccacatctc

SEQ ID NO: 6795088 - DNA, 87 bp, Homo sapiens
gcagagcgagttgctggaggacacacccagagttgaggccgggcctgatccctggtctgaagcccacgtggtaccagctgcctttgt

SEQ ID NO: 6795089 - DNA, 66 bp, Homo sapiens
tggagagctctggctttaaggatgccacaggcggaaactgacaaaggtgttgccagagggattcca

SEQ ID NO: 6795090 - DNA, 62 bp, Homo sapiens
gcctgtgttcgtcctcaccttgccgccagtcgcggatctggggccaaggaggagaaacaggc

SEQ ID NO: 6795091 - DNA, 61 bp, Homo sapiens
ggatatatattcgtttgggaggccttgtctttctgattgacctacagatggatatatattc

SEQ ID NO: 6795092 - DNA, 74 bp, Homo sapiens
ctggaaactgagtgtaggactttgagtttggtcttgctaaaccacaagtctttagattcagttcagtgttccag

SEQ ID NO: 6795093 - DNA, 130 bp, Homo sapiens
aggcataatgataagtaagaccatgaagtttctgtttgaataatgtgtatgttgttatttttatctgtctgaataatttgtatgtcgtttttatcagaaattatttggggtttttttgatgattatgttt

SEQ ID NO: 6795094 - DNA, 58 bp, Homo sapiens
ctttgtgcttgacccatgggtctttactgtttcattgacctttaattcaagcatcagg

SEQ ID NO: 6795095 - DNA, 69 bp, Homo sapiens
tgaccacccctgtccttccagccgaaatctaaggcctcacttggagataggctgaggcagggctgagca

SEQ ID NO: 6795096 - DNA, 84 bp, Homo sapiens
aaatctgtcttctcaaagtaaacaaggcaagtctgtgagcatctccgacaagatgtatgaagctttgtttgggataatggattt

SEQ ID NO: 6795097 - DNA, 68 bp, Homo sapiens
tttcagaaatggcactgaaatctgttttccggttttactcgttgtgcaatacagtgctgttttagaaa

SEQ ID NO: 6795098 - DNA, 58 bp, Homo sapiens
ctactgcatgatgagaggggttctctgtgttcaacagtgctgttcacattattagtag

SEQ ID NO: 6795099 - DNA, 79 bp, Homo sapiens
caaagtgctgggattacaggcctgagccaccacggccagccgtgaagttttaagtaggggcactgtggaccagattttg

SEQ ID NO: 6795100 - DNA, 65 bp, Homo sapiens
gtggaatgtagtgtccatggaattttttttcagcaaaaaattattgagtgtccacaatatttcac

SEQ ID NO: 6795101 - DNA, 70 bp, Homo sapiens
tgtttccctcttgctgactcttaaaggctttctgatcacccagatctgaagagtcttgcaagaaagaaca

SEQ ID NO: 6795102 - DNA, 56 bp, Homo sapiens
atttctgtggcttcattctcctgtgatggccgatgaaaccatggagccacagaagt

SEQ ID NO: 6795103 - DNA, 59 bp, Homo sapiens
gatagagggccgctggagcctggttgtcacacacaattaatatcccccgccgttctgtc

SEQ ID NO: 6795104 - DNA, 80 bp, Homo sapiens
gcccccgtccatgcagtcacctccagctccaaacctgttatttgtcagacagagctgtcctgggacgtggatttgggggc

SEQ ID NO: 6795105 - DNA, 61 bp, Homo sapiens
aaggtagttttctttaatgctggaatttcaggcaatggcagcccaaagagagagctacttt

SEQ ID NO: 6795106 - DNA, 95 bp, Homo sapiens
ttggtatcttaaatataacctctatataacttgtttttctttagtgttcaaatggtaatgtatacttgaggtagcaacttaagggtttgaaccaa

SEQ ID NO: 6795107 - DNA, 62 bp, Homo sapiens
tgtctggggtcacttaggatagaggcaaaaatctctgtacaagcaaatagaccttcaagaca

SEQ ID NO: 6795108 - DNA, 100 bp, Homo sapiens
gcccacttgtctgcaggaacagctgggccttgtcccctcagctgtggctgggagcctgccgcggactgcacaatcctggctgtgtcctggggaccctggc

SEQ ID NO: 6795109 - DNA, 87 bp, Homo sapiens
gagctgtgctatactaaaaagtaggagatatatttgtttattcagggggaggaaaatgtctttcttggttctggtttgcaatggctc

SEQ ID NO: 6795110 - DNA, 61 bp, Homo sapiens
gctggtgtcaggggatgtgctggtggcctcaaggggccacactgcccacctctgttcctgc

SEQ ID NO: 6795111 - DNA, 82 bp, Homo sapiens
gatattgccactgaaggtaggaccaaggctcacctcattgactaatgggtatggttaatctttcagcctacatggtaatatc

SEQ ID NO: 6795112 - DNA, 81 bp, Homo sapiens
tccttcccacccgcacacccgtcttcatttatagtctttcatcctttatacatgacacctctggctgggtgcctggaaggg

SEQ ID NO: 6795113 - DNA, 86 bp, Homo sapiens
cttttcatctgcttcttgcagtttcaggttgacctaatcgaacagattctgcagatcaacttgactgcctcatagcctctgagaag

SEQ ID NO: 6795114 - DNA, 74 bp, Homo sapiens
gagtcatttgtaatttcttatctgtgtacactagatgacaaacatcaaaacataaaaggaagtgacaaagattc

SEQ ID NO: 6795115 - DNA, 70 bp, Homo sapiens
cctccatgtctgattatgaaaaatccctgatctcatctttgattccatttcttcaggtcagaaatagagg

SEQ ID NO: 6795116 - DNA, 64 bp, Homo sapiens
cattgaatagttacttttgctcttcattaagtcttagtgatttaagaaaggtgactgtaagatg

SEQ ID NO: 6795117 - DNA, 130 bp, Homo sapiens
cgggagaagcacaggttgtttgtttgtttaatccatttactctttacaagaaccctttttacaaatgaggagaccaagtcttcagagatgtaacatatggaagacacagagcaaatagatggctcagctg

SEQ ID NO: 6795118 - DNA, 63 bp, Homo sapiens
gcccgcggtgctgcgacgttgacccgcctggcctcaggctcagggcggcgggcagcccagggc

SEQ ID NO: 6795119 - DNA, 98 bp, Homo sapiens
gcgcagtacttgacccctggcatgcactcaatgtgttgcagatttgaaatagaattacaaaactgtaggaattgggtgccctagtggcaactgctggt

SEQ ID NO: 6795120 - DNA, 58 bp, Homo sapiens
ctgactggaagctgtacagttcacctagaagacaggctgggcttactctttcagtgag

SEQ ID NO: 6795121 - DNA, 104 bp, Homo sapiens
gatgcagccgctaaacagggaagtctctcctcttccacggactgggcagagccaacgcgtccagagccggaagagtgacagccttatttttgtctgtgctcatc

SEQ ID NO: 6795122 - DNA, 81 bp, Homo sapiens
gtgtgagcagacttgatgaggcagcctcatgctggcccgcccaggtgatctgtgtggctgtctctccttctgctcctgcac

SEQ ID NO: 6795123 - DNA, 87 bp, Homo sapiens
agcaaagaccacccagccaacacacagcattgagagctaaatttaaaagtaattgttttaagccacaaagttgtggggtggtttgct

SEQ ID NO: 6795124 - DNA, 65 bp, Homo sapiens
agttttgcctagtagattacctgttttaatgaaaaagaattggcattggttgctaggtaaatgct

SEQ ID NO: 6795125 - DNA, 91 bp, Homo sapiens
tcccttcccctccccttctcctgtcttctcagcacccccagggttacatggcggtcaggctgagaggcaggggtgacaggatggggtggga

SEQ ID NO: 6795126 - DNA, 116 bp, Homo sapiens
tacttgtgcttttattcatttattcaaaaagtgctaaataagccctgaaggggcttttggggggtcatttggggcttatttagcactttttgaataaataaataaaagcacaagta

SEQ ID NO: 6795127 - DNA, 74 bp, Homo sapiens
gtgagccaatagttaaactgttaggaattttgtgatctgggttgaccacaggttagcagcttgaaactggccac

SEQ ID NO: 6795128 - DNA, 70 bp, Homo sapiens
ggaggggattatgcagggtgggttctctgaggggtgcaattcttcgggccatggttgcattctgccttcc

SEQ ID NO: 6795129 - DNA, 57 bp, Homo sapiens
gatcaggacatagctataggcttatttgagcccaggccttaagctacttccctgctc

SEQ ID NO: 6795130 - DNA, 109 bp, Homo sapiens
agcctccagtgagtgctgcggtgacctgatttccagttgctgggtgcttgctttgggcaagtgtacctccacgattgaaatcttccctccaccccgagctcctgaggct

SEQ ID NO: 6795131 - DNA, 130 bp, Homo sapiens
tccaattaaatatgaatctaagatcaaaccatgagtagtttgtttagtataagtctgtctcaaatgttgtacagaacatacttatactaaataatgttggttgactacctgaaattcaaatttggttgga

SEQ ID NO: 6795132 - DNA, 101 bp, Homo sapiens
gggaggagagggaagggggaaaaaggagcagggagggcagggcagagtgatgatctgggttcctgatggttctctggttcttgactcccacccctcccccc

SEQ ID NO: 6795133 - DNA, 64 bp, Homo sapiens
catgtttacccagataatgtaacagtttttgtgaaagaaatctacttagtgtctggatgacatg

SEQ ID NO: 6795134 - DNA, 62 bp, Homo sapiens
agttattgagtatctataatgtgctacatagtatgaaaagtgcaagggatactacattgact

SEQ ID NO: 6795135 - DNA, 66 bp, Homo sapiens
gcctcttccatcttgggaatgctattacccacatcacatagtctccaaggttgttgtggaaggggc

SEQ ID NO: 6795136 - DNA, 63 bp, Homo sapiens
agtgctggatccaaggggcctggggccaaggtgtgtgccaggcaggaccctagaaccagaact

SEQ ID NO: 6795137 - DNA, 55 bp, Homo sapiens
cagttattttgaggattaaatgagatatcatttatattgtcctgaagtgtaattg

SEQ ID NO: 6795138 - DNA, 84 bp, Homo sapiens
ataagtagtagtagtatttctgtagaggctatcaagattagctttgaaagaactcttcagagataaattctaaaagccatttat

SEQ ID NO: 6795139 - DNA, 82 bp, Homo sapiens
atggtcttgatctcctcaccttgtgatcctcttgccttgggctcccaaagtgctgggattacaggcctgagtcaagacacat

SEQ ID NO: 6795140 - DNA, 64 bp, Homo sapiens
taagaggggagtcctaatctgattcaccttgagtggggaagatcagtaaggactttaattctta

SEQ ID NO: 6795141 - DNA, 59 bp, Homo sapiens
ccaggacagtgaacatgtaagagtttgggagcatgaatccgggcctcttcctgtcctgg

SEQ ID NO: 6795142 - DNA, 79 bp, Homo sapiens
ggcaaagcagtgggcaaggatgagcccttagaaggccttcagagccttgctgaccatcacctttgaacacatgctggcc

SEQ ID NO: 6795143 - DNA, 106 bp, Homo sapiens
gtggccccttcatcaggtttatctacaaatccaagacccatacaattaggggtcaacctgaattggggtcaactggaattgggttcagcctgaactgaggagccac

SEQ ID NO: 6795144 - DNA, 116 bp, Homo sapiens
gattagctgatgtaggagtagcagcagaagcagcagcaatgacaacagaactagagtccaaggttgatctctgttgctgtctttgctcagctttgctttgcagacataagtgggtc

SEQ ID NO: 6795145 - DNA, 77 bp, Homo sapiens
gatggctgatgaagcacggtgaagatctggcctcagatggttctgtgggagatgcttcttgtgtttatttggttgtc

SEQ ID NO: 6795146 - DNA, 77 bp, Homo sapiens
cttattttatattgtgcatttatttgtttatctgttagcctgcctgctgcagtaagatgtaagtgctataaagtcag

SEQ ID NO: 6795147 - DNA, 101 bp, Homo sapiens
aggaaagactggagctaaggcaagatggaatggctccctgccccaggctgccctgggctaaggggcagtgccagtcctccctgcagggctccagagagcct

SEQ ID NO: 6795148 - DNA, 82 bp, Homo sapiens
ggtcttgcttggttagatgaggctggtttcacctggattacaggacactgagtcattagtttcatttgtcccttcaaatgcc

SEQ ID NO: 6795149 - DNA, 61 bp, Homo sapiens
attcagagttagtgactgcttcttggaactcccataactctgtgcttcattgattctggat

SEQ ID NO: 6795150 - DNA, 64 bp, Homo sapiens
ggtgttccccttacctcttggccccccaaaacagggacagacatagatggtgggctggaacacc

SEQ ID NO: 6795151 - DNA, 57 bp, Homo sapiens
tctacacatctggagaagccctgtggtaggaccacagcatgctgtccagggtgcaga

SEQ ID NO: 6795152 - DNA, 77 bp, Homo sapiens
agggaaacgtggccagacacatgcagacctggaatgagcttgttcagttagcaatgaaatctggatgctgtttcttt

SEQ ID NO: 6795153 - DNA, 124 bp, Homo sapiens
cagtgcatgcaaactgaatggcaggctctcttctgaaggggtaattagagctgctccctcacatggcactggaggcacccttagagaggcctgctgcccctcacgtcagtagtgcatgcagctg

SEQ ID NO: 6795154 - DNA, 65 bp, Homo sapiens
ttccactttgggtctgtgcaggcctcgataacgtgaggggatgcatcgggcccggagcagtggaa

SEQ ID NO: 6795155 - DNA, 108 bp, Homo sapiens
atgtgaagggttggcctccatggcctgtgagcaggagcctggctcagggaacctggggcctctattcttggctgggctttgcttcctggggccatcccttgaacacat

SEQ ID NO: 6795156 - DNA, 130 bp, Homo sapiens
atttctaaatacatttgccacttggttgccagctggagagaccgaaagaggctgagggcatggagagctgcattttctaaatggtttcaggcccctggcatttcagcaataggtaatacaaaacagatgt

SEQ ID NO: 6795157 - DNA, 80 bp, Homo sapiens
gcattgaggatggcagtgtgctcagccagtctgattctctggctgattttgagaagcacagtctgcctttcctaacttgt

SEQ ID NO: 6795158 - DNA, 64 bp, Homo sapiens
tggtataattattccatgttcctaagtactattataattagggacatggaagagaaattaacca

SEQ ID NO: 6795159 - DNA, 58 bp, Homo sapiens
tgttctccaaggagaggacagtcttaggctcattataagctgcttcacctggacaaca

SEQ ID NO: 6795160 - DNA, 69 bp, Homo sapiens
agctcactagttgtgagagaaaatgtgtatatgggtattcatgtgtgcacatgctcttacctagatgct

SEQ ID NO: 6795161 - DNA, 71 bp, Homo sapiens
tccagcaagcatatttcagtctaagatgtgttccctttcaaacagggacacattgaacatagcttgctgga

SEQ ID NO: 6795162 - DNA, 82 bp, Homo sapiens
aaggagctgaacccacaaatatttactgaatccactggtttgccccaggggcagcatgtaaaatttccaaacttcactcctt

SEQ ID NO: 6795163 - DNA, 107 bp, Homo sapiens
tttggcagggtgcgtggctcatagtaagtgcataataaatgttaattatttttattcatttattaaatacttactgagagtctgctatgtccaggcaccatgctaag

SEQ ID NO: 6795164 - DNA, 89 bp, Homo sapiens
tttatttcagatgaaaactgaattcccaagggcatgtttttcaaaaaatataactttgtaatgtttgtgatcatatagtttgaaatgaa

SEQ ID NO: 6795165 - DNA, 65 bp, Homo sapiens
cttatggagaggaatcattattagagaggctgactctgcaataatgtatgtcactcccccaaaag

SEQ ID NO: 6795166 - DNA, 65 bp, Homo sapiens
attcagctaagtgcttcatgctgtgatttcttcagagaaagggcttaatgaacactgagctgaat

SEQ ID NO: 6795167 - DNA, 64 bp, Homo sapiens
gccccttgtctccaggccccaaaggcatctggccaggctgggggaggcttgtggaggcaggggt

SEQ ID NO: 6795168 - DNA, 86 bp, Homo sapiens
gttactgtcttccctgtctttgtgcacccctggggggttacccaagttcatttctagcaggtggatttagacgggagttacttaac

SEQ ID NO: 6795169 - DNA, 96 bp, Homo sapiens
gtttcttccaatgagaggtgggatgctgataattcatgagaagccatggcatcacaatttaattacagtatcacttatggttgattgtgaagaaat

SEQ ID NO: 6795170 - DNA, 57 bp, Homo sapiens
tgcacaggtatgcaaagcatgtgcaaattctttcagttgtacactttgatttgtgca

SEQ ID NO: 6795171 - DNA, 66 bp, Homo sapiens
agccctggggattctgacacggagtgggctggaagtctccattcaaatgtcaaatccaccagtact

SEQ ID NO: 6795172 - DNA, 88 bp, Homo sapiens
ttatttgttgaatgagtggatggactttcatctcagctccgctctgtgatcaaagcctagttccaagatccagcttcttcatctatga

SEQ ID NO: 6795173 - DNA, 60 bp, Homo sapiens
ggcttcacagtaatgtgcccaggtaagtcccttacctctgtttggtgctgtccataggcc

SEQ ID NO: 6795174 - DNA, 66 bp, Homo sapiens
ctctcagtgcttggtagtttgatacataagtcaatgagtattgcagacaaaatgagctactgtggg

SEQ ID NO: 6795175 - DNA, 73 bp, Homo sapiens
aacatagggaggtgattaggaccatgtattttggaggcaaactgtctgtatttgagtcctgcctaccctggtt

SEQ ID NO: 6795176 - DNA, 58 bp, Homo sapiens
ggttcgtattgtggagtcacttaaggagctatcccaaagtactttaggatatgtaact

SEQ ID NO: 6795177 - DNA, 57 bp, Homo sapiens
tatttaagatgtgtcataaagaatacttagggatctttatggcagcatgtttaagta

SEQ ID NO: 6795178 - DNA, 87 bp, Homo sapiens
ggctatggattggctttataaaaggaaagaggttctaagaatgttcccaacctatgcttaccttttctggagccaggggtctttgcc

SEQ ID NO: 6795179 - DNA, 80 bp, Homo sapiens
gattactggtggaaatgtactcttggctttcatggtctggaagatcattgctggctctggagtatgcattctctgtaatt

SEQ ID NO: 6795180 - DNA, 118 bp, Homo sapiens
ttcaaatatgtttctgctacaaacattgtcctttagatggttcctttgctgccattatgactatggcgtaatctgtagtaaagcaccattaagatgttaatacagatgtatgtgtgaa

SEQ ID NO: 6795181 - DNA, 72 bp, Homo sapiens
ggtgatgttccgagtctccaaggggttgtcgtgagtgcagtcgggagagcgagtctggggctcggattcgcc

SEQ ID NO: 6795182 - DNA, 80 bp, Homo sapiens
tgtcaccccagagcctgagtgctgcctcccctacatcccgttgtgctgtggggggaggcaggaccgggcagatgggggca

SEQ ID NO: 6795183 - DNA, 69 bp, Homo sapiens
gagcaatgaataccgtttcactcagttgaaggaggtaacatttaaatatgtgaggtatgttcagtgctt

SEQ ID NO: 6795184 - DNA, 67 bp, Homo sapiens
cgaaccctttgttcggtgttctggccctccgaggtaaggcgttggtggcaccaacaaagtggcatcg

SEQ ID NO: 6795185 - DNA, 73 bp, Homo sapiens
ttacatgttgaagtcctaactcccagtacctcagaacgtgaccatatttggagacaggatttttcagaggtaa

SEQ ID NO: 6795186 - DNA, 57 bp, Homo sapiens
tccccccagatccccatgtgacctgctcatcagaggaggcccagagtcttgggggga

SEQ ID NO: 6795187 - DNA, 83 bp, Homo sapiens
tgtccagaggggcccgtagccagtgggacggtgctgcacgtggtcgtgcctcaagccctccactgcaccgggcgccctggcca

SEQ ID NO: 6795188 - DNA, 55 bp, Homo sapiens
gactgtagctttgctacttaaggtgaggtcctcaggccagtagtatagcacagtc

SEQ ID NO: 6795189 - DNA, 63 bp, Homo sapiens
gtgtgctgggttggtcaataaattatatagtcattctactaattatcagccgtcccactacat

SEQ ID NO: 6795190 - DNA, 63 bp, Homo sapiens
ttgtttcattttggctaaactggacaaaagtaatctgtggtgtcccttggtcaggagaaacag

SEQ ID NO: 6795191 - DNA, 58 bp, Homo sapiens
ccagcagcccaagcctgagcatcctctccccagagagggtgagttggggctgtcaagg

SEQ ID NO: 6795192 - DNA, 72 bp, Homo sapiens
ccaatcaaattagaggtttgttttgatgagttctttatggtgaaatgatcaatgaaaccttatttgaattgg

SEQ ID NO: 6795193 - DNA, 62 bp, Homo sapiens
gtgtctccatgtccaaagtttccttgtcttaaaaggacaacagtctttggatttgggcccac

SEQ ID NO: 6795194 - DNA, 61 bp, Homo sapiens
gtcatgggccacattccaaaccagctgccttgggcagctgctgggagaagtgagccaaggc

SEQ ID NO: 6795195 - DNA, 76 bp, Homo sapiens
ttgcctccgccatctgtcttccaaatgatcctgtaggtacagctattatttcagtcagacactggcaggtgggcaa

SEQ ID NO: 6795196 - DNA, 67 bp, Homo sapiens
ctgcaggcctcccctgctggagctgcaggctgtcccttccctgagccccggtgagggagtcctgtgg

SEQ ID NO: 6795197 - DNA, 87 bp, Homo sapiens
gtgactgtagacaacaggaggaacatgtgagtagcttctgtgtatccctgtggaactgccttgtctcttgcctgttgctgctcccat

SEQ ID NO: 6795198 - DNA, 91 bp, Homo sapiens
taggagaagactatggacttgttgatgagataaacatgctcaaaatttgacatgggcatccagttctgatcaacaataatactttctctta

SEQ ID NO: 6795199 - DNA, 56 bp, Homo sapiens
gccaaatgcaggaagagccctggagctcggagtggagccgttgggctcctgctggc

SEQ ID NO: 6795200 - DNA, 56 bp, Homo sapiens
aggtctgtgtgtgtctctcctcaagctactcaagctgaggctttgtgtgcatgcct

SEQ ID NO: 6795201 - DNA, 61 bp, Homo sapiens
gaggggttcccttcctgagatactattccttttcacctgtcttagaagtggctatttcctc

SEQ ID NO: 6795202 - DNA, 89 bp, Homo sapiens
tctttatgaattcatatttggcaaagaattttctggaaatattaggaatcagccttactcagaaatttggtgttaaaggtttgtaaaga

SEQ ID NO: 6795203 - DNA, 83 bp, Homo sapiens
gtttatgttttctgaaagcattataagaaaggaaattgctaatcagttaactcattttataatgcccatcataaagcaggaat

SEQ ID NO: 6795204 - DNA, 130 bp, Homo sapiens
ttgtgggaagatcaaacaagagatgcttattaaatggtacagtgtacagaactgtggttaattcctcccacactgtgacagccacatgttcctgtcttgtcatcaacggtactctctgaaactcccagag

SEQ ID NO: 6795205 - DNA, 57 bp, Homo sapiens
tggggtttgccaactcttgtccaggaacctattgggctagagtggaggggaactgca

SEQ ID NO: 6795206 - DNA, 66 bp, Homo sapiens
tggaaactgtgggagaaggcgatgtgaccagggacattgtttagaatagcctgctcatggtgacca

SEQ ID NO: 6795207 - DNA, 67 bp, Homo sapiens
agttgatcaaatcagctactgaggcttgtgcattcatcacatagttctcgtgccttggttttcagct

SEQ ID NO: 6795208 - DNA, 69 bp, Homo sapiens
ggttttgttgattgagccaagatactccaagtttgcagttggctgtgtaaggtgaaatcaacaaatgcc

SEQ ID NO: 6795209 - DNA, 59 bp, Homo sapiens
gggatcttcttgaaccaaaaatgttgtttattgttgtcgttgctcttcaagaaaatccc

SEQ ID NO: 6795210 - DNA, 70 bp, Homo sapiens
cactaattactgctgatataagaaaagattaacttttgtaaattaatgtcaaatagtagtagtaatagtg

SEQ ID NO: 6795211 - DNA, 74 bp, Homo sapiens
gccgagaaccatttgcagttactgagacatgctgggatacctctcagggttttagaagcagcaaaggtatctgc

SEQ ID NO: 6795212 - DNA, 69 bp, Homo sapiens
tagtgcttatatatgcacatatgcatatatatatataaatatagcaatgtgtgtgtataaattgtacta

SEQ ID NO: 6795213 - DNA, 67 bp, Homo sapiens
gggaaaaagtggttcagaatgcctgggcagagccggagctacagggattcctgccgctcgcgttccc

SEQ ID NO: 6795214 - DNA, 84 bp, Homo sapiens
gcagggcctgtcccagctttgttcctggtgggggctccctggtgtggagctccagctggggccgaagtggatgacatgtgttgc

SEQ ID NO: 6795215 - DNA, 57 bp, Homo sapiens
gaaagtagttggagtagctggctttgtgcttcatagcacttcacagtgctctatttc

SEQ ID NO: 6795216 - DNA, 62 bp, Homo sapiens
agatagagttgagttcaaatatgtcaatcatattagtaaacataaatgggcttaactcatct

SEQ ID NO: 6795217 - DNA, 58 bp, Homo sapiens
ctctcttctgcagaatttctcagagcctttgctatgctctgagcgtctaagaggtgag

SEQ ID NO: 6795218 - DNA, 75 bp, Homo sapiens
ggaaaacagcgattggtatcataattctctttacacagtgctctaagggataaactgttggcaattgttgtttcc

SEQ ID NO: 6795219 - DNA, 62 bp, Homo sapiens
caggaagaggtggggctaaagttggtaatatgccaggggagtggtaccacatcttgtccctg

SEQ ID NO: 6795220 - DNA, 61 bp, Homo sapiens
gcctggagcaggagctgcagaggaggggctccaggagcccagctggccatttgcttcaggt

SEQ ID NO: 6795221 - DNA, 65 bp, Homo sapiens
agtagaatggaacagatatttgtggcaggtttgctggaggttctatgtatatctttccattcact

SEQ ID NO: 6795222 - DNA, 56 bp, Homo sapiens
ggcccagccactgtggaatagcccccccagggagtgggagggacagggctagggtt

SEQ ID NO: 6795223 - DNA, 67 bp, Homo sapiens
ttggtgggagagatgagggttgcccatagactgaattaaagaggaggccctggtttcaactcatgaa

SEQ ID NO: 6795224 - DNA, 116 bp, Homo sapiens
accattaattaatctatgatttaagactgaagatctgcctgtctcttgagtcttatttttgaggccacagtactttgcagaccatttttctagaaatatagactctgatttcaggt

SEQ ID NO: 6795225 - DNA, 110 bp, Homo sapiens
gagcaaatcagctcagctgcagggcccccagtctatggaaatctaggtggctgctagagaaagccagctgtaggcagggggtttagcagagactgtggcttctattgctc

SEQ ID NO: 6795226 - DNA, 83 bp, Homo sapiens
ctgtctctgacccccactttgcagctgaggacatttcaggttcaaagacatgaactgacttgctcaaggtcacatagagagag

SEQ ID NO: 6795227 - DNA, 62 bp, Homo sapiens
ggatgttgtttttgtcccagaaggtgtcattacagccccttaggggtgacagaaataccacc

SEQ ID NO: 6795228 - DNA, 63 bp, Homo sapiens
gcccgtaggtagaaagaggacctgtcttggacctgagcccctgagtttctttctgcctggggc

SEQ ID NO: 6795229 - DNA, 92 bp, Homo sapiens
gctcagggaggttaaggaaatggctagcttagagtcatgctagaccttggtctagatgagcctttaaactagatgtccttgctctctagagt

SEQ ID NO: 6795230 - DNA, 70 bp, Homo sapiens
gctagcagtgttcagtgaagcaggaggctccagacaatagcctcagctggccatagtgaacacttcttgc

SEQ ID NO: 6795231 - DNA, 74 bp, Homo sapiens
ctaattgttttggagaatgtgatagacattagtattattattattggcttggagcattttccttaatatgttgg

SEQ ID NO: 6795232 - DNA, 100 bp, Homo sapiens
attccacaccaaggctctcagcaggcaggaatctaacccaaggagaagatacagccttcagccaaggtcagatttttgttcactgtgccaggtgatgaat

SEQ ID NO: 6795233 - DNA, 67 bp, Homo sapiens
tcagtttctacctactatgtgtgagtcacatgaatagacccacattcattgccagggtggaagctga

SEQ ID NO: 6795234 - DNA, 71 bp, Homo sapiens
ccgtgtcttgtatgctgatgacaccacctaagtctctctctcaggataatggtgttgcatacggagcttgg

SEQ ID NO: 6795235 - DNA, 71 bp, Homo sapiens
tctcactgggtcacagcagaggatcccccagccccaggcccaaggagtgtctgtgtgaccacacagtgagg

SEQ ID NO: 6795236 - DNA, 65 bp, Homo sapiens
accgtctttcatctttcatgcagggtaaaagaagacaccttggctacagcaagaggaaagaaggt

SEQ ID NO: 6795237 - DNA, 55 bp, Homo sapiens
cttgctgtcccttggtatgaactagcctgtatggtttgcctctggggcatgcagg

SEQ ID NO: 6795238 - DNA, 61 bp, Homo sapiens
agggagagagggacacggtcctggcttttaggaagagatgggtcaaggctgcctctccttt

SEQ ID NO: 6795239 - DNA, 58 bp, Homo sapiens
gctgtctcgcctgacactggctttcctgcccacagcgggggacgggcaggcgggcagc

SEQ ID NO: 6795240 - DNA, 83 bp, Homo sapiens
agctcacatcccggagcctttgcacttgctgtgttctcttctcttcctagaacactctggtgcaggtctccgtatgaccagct

SEQ ID NO: 6795241 - DNA, 87 bp, Homo sapiens
tagacatcagttttgaaatactgatgaaatactctctactctcctcagtgatgagtatttgatcagatgatagtaattgtgtgttta

SEQ ID NO: 6795242 - DNA, 66 bp, Homo sapiens
gttgggcagtatttgcagaataatcactccagatatattccattgatgcaaataatttgccaggac

SEQ ID NO: 6795243 - DNA, 84 bp, Homo sapiens
acagcgtgctggaccttcctgagcctgtgccttgagagcagtgagttttctcacagcaggggccaggtctgtcttgttcgctgt

SEQ ID NO: 6795244 - DNA, 69 bp, Homo sapiens
gagactctttattgtttgtggctaggatctgatataagccatttagcccaggttgtaaagatttgtctt

SEQ ID NO: 6795245 - DNA, 101 bp, Homo sapiens
tgttaaatattaaggtccaagaggtaaaggtttaggtgtacgatgttgctattttatacctcattcttagcaaaaggcttggcacattgtatatgttaata

SEQ ID NO: 6795246 - DNA, 78 bp, Homo sapiens
gtcacacagttggggcagtggccagagtggaagcagcatagcagctctttccagtctcagccctgtaactatggtgat

SEQ ID NO: 6795247 - DNA, 108 bp, Homo sapiens
gttcccattccccctgtttagtttactgttgtcaggctgctttggatcttgaaaccagaaagataaccaagcgtattacaattctggataaagtcagaagaaatgagc

SEQ ID NO: 6795248 - DNA, 77 bp, Homo sapiens
tagtttcctggttctcaggttccagcccactgctgctgtagcatgtgcctgggcagaatgtgggatccagagaagtg

SEQ ID NO: 6795249 - DNA, 57 bp, Homo sapiens
tcaggctaagggagaggcgctcatccattgacaggtgccaggctgtcctgggcctgg

SEQ ID NO: 6795250 - DNA, 68 bp, Homo sapiens
ctgattacaacagagtcatccatggattcaaactagtcctctttccagggatgactgtgtttaaaagg

SEQ ID NO: 6795251 - DNA, 55 bp, Homo sapiens
tgatgctgtgtacctcatgggatttggtgagaactgaatgagttacactgtgtca

SEQ ID NO: 6795252 - DNA, 61 bp, Homo sapiens
gtctgtgctttcctagggtcttgcctttgtgcaggtccctctgctctagagagccacagat

SEQ ID NO: 6795253 - DNA, 60 bp, Homo sapiens
cccaggagagggaaccaaatgtccatgtcctgacagcacagccagttcacctctccttgg

SEQ ID NO: 6795254 - DNA, 82 bp, Homo sapiens
agctttacactagtttttgagttattgaatgcatgagtcagactcctaagccttcgagatttaaacactgattgttatggct

SEQ ID NO: 6795255 - DNA, 60 bp, Homo sapiens
ctgggagtctggaattttggtatgtcctaggcagacagtccctacattaccagctcccag

SEQ ID NO: 6795256 - DNA, 60 bp, Homo sapiens
agtcagcaggtcaattttgtgactccatttctgtgagtcagagaataattctgatagact

SEQ ID NO: 6795257 - DNA, 68 bp, Homo sapiens
ttgacaccagcatcccattgtgggtcttgatcctcttcacaaccatggccctgatggagctggtgcaa

SEQ ID NO: 6795258 - DNA, 62 bp, Homo sapiens
ctgaccgagccgccctccacgatgtccctccagagcgggcggtcagggggctgctcggccag

SEQ ID NO: 6795259 - DNA, 61 bp, Homo sapiens
ctcctggttcctgtcttaaataatcttttaaaggtaaagtttccaagacagaagccatgag

SEQ ID NO: 6795260 - DNA, 66 bp, Homo sapiens
gaagggaaatggccaggcagagacttcttgtgaacaaaagctgtcccttctactctgttttccttc

SEQ ID NO: 6795261 - DNA, 57 bp, Homo sapiens
cccttctgtaaatgctgactggctgtcactgatggcaagatggagaagcagcaaggg

SEQ ID NO: 6795262 - DNA, 67 bp, Homo sapiens
acaccattcatgtttttgaactatgcatttgataacaaaggtatgtttcatcaggcatggagtgtgt

SEQ ID NO: 6795263 - DNA, 97 bp, Homo sapiens
ttagggctttctttgtgaatatgtatggtcattgttaatatcttgattctttgcttcttattgacaagtgatgattataattcaatggacaacctga

SEQ ID NO: 6795264 - DNA, 61 bp, Homo sapiens
tgattcaataggaattgagtagactctgtaagggagagttgtcttgaaatcttttgaatta

SEQ ID NO: 6795265 - DNA, 60 bp, Homo sapiens
gatgcaggcatgcttctgtctgggcaggtctgtctgcttgtgtgggagtgtgtgtgtgtc

SEQ ID NO: 6795266 - DNA, 57 bp, Homo sapiens
tgatgcaatgtttacatcttgatggaggtttgggtacatagatgtaagcatttgtca

SEQ ID NO: 6795267 - DNA, 56 bp, Homo sapiens
cgtgggtgcagctgggaacggggaaaacccagcctgaagtccagccctgcccgacg

SEQ ID NO: 6795268 - DNA, 129 bp, Homo sapiens
agaagataatattaagtgactctaactataaggatgtgagtaatgtgtgtgtcttctctagaggacagtagaatcctttagggaagaaactcatgtttgtagtccccatggcacatagtaggctcttct

SEQ ID NO: 6795269 - DNA, 70 bp, Homo sapiens
tgtctgggttttgggtcatatttagtaaagacattactttatgttcttagataccaagaagacccagata

SEQ ID NO: 6795270 - DNA, 67 bp, Homo sapiens
tatgtgatgttggcaattaacatatacagtttttaccagctgtcaccacatttgtcaatatcatatg

SEQ ID NO: 6795271 - DNA, 85 bp, Homo sapiens
agtgaaagaaatgagagaaaattagattttactgtgttaatgaggcacacaggaaatggtttagttttgcttttactttttcatt

SEQ ID NO: 6795272 - DNA, 89 bp, Homo sapiens
ctcaggtagttataatagctaacattgagttcttactatgtgacagacactttgctgagtactttatgttagttatttaatgcatatag

SEQ ID NO: 6795273 - DNA, 93 bp, Homo sapiens
aggaggagggagggcagtgcggacccacagctgtgggcccaggggtgatccttggcaccagggcaagggtctttctcttgcatcttttttcct

SEQ ID NO: 6795274 - DNA, 61 bp, Homo sapiens
caggctcctcactcatgctccctcactcccacctgggatgctatagctgaatgaaggcttg

SEQ ID NO: 6795275 - DNA, 73 bp, Homo sapiens
tcttaaagccacttcattctagtctatatgagtgacataggggagacacaatggaatgaagggcagacagaga

SEQ ID NO: 6795276 - DNA, 71 bp, Homo sapiens
gcttggctggttttaatacatgccataattacagatactaagttggcaggtttcgttaaaaatggttaagt

SEQ ID NO: 6795277 - DNA, 90 bp, Homo sapiens
gtatgatcattataaattccagatatgataggattagcacagggttcctcaaattctgtagaactgacattttggactggataatcatac

SEQ ID NO: 6795278 - DNA, 64 bp, Homo sapiens
gttttgttcaggactctcattttccgttcattttcatagcacagatgaatgtcctgaccagaac

SEQ ID NO: 6795279 - DNA, 63 bp, Homo sapiens
tccattgcaaagcaatgtaggtcagcttctaaacaagtaagcctgaaagtaattgtttatgga

SEQ ID NO: 6795280 - DNA, 67 bp, Homo sapiens
acagatgacacatttgtgctgttgaaggaaaactcagtgactcagatagacacaaattgttccatgt

SEQ ID NO: 6795281 - DNA, 79 bp, Homo sapiens
gggaagagttggatttgaaagggacaaagtcactgaatacaatcaattatccatgagactgccttttcaaacccttccc

SEQ ID NO: 6795282 - DNA, 66 bp, Homo sapiens
tgaggcccatctgagattttgatagttgtagcagttattttgtcatattcaaaaactcggctctca

SEQ ID NO: 6795283 - DNA, 112 bp, Homo sapiens
tggcagaccccagccaccctccaactagtgtttacccagtgcctaatacgtgcaattagcattcttctggggggcacctatagtttagtggttccgtacacgggctctgcca

SEQ ID NO: 6795284 - DNA, 110 bp, Homo sapiens
gaggtaaatctttgagtttgaatttgtttatgttcccaagggatagaaagaactaggaccaatggttagttatgatgggagacagatttttgactcaatgtgaagacctc

SEQ ID NO: 6795285 - DNA, 74 bp, Homo sapiens
ccagcctggctgctgcagacagacaggaagcacgtctgacgctcctccaccctcggtcagcacagcggggctgg

SEQ ID NO: 6795286 - DNA, 57 bp, Homo sapiens
tgaacgtttttatggcttttggtacatattaccagattgctttccaaaagcgttgca

SEQ ID NO: 6795287 - DNA, 68 bp, Homo sapiens
gtagtgtatcttctttctctctgctaatgctgaaagggatagtacaagggaagagtgaaggtcaatac

SEQ ID NO: 6795288 - DNA, 55 bp, Homo sapiens
aagagattcctcactcagaatgtctgagaaggggttctgagaaaacgaatttttt

SEQ ID NO: 6795289 - DNA, 60 bp, Homo sapiens
tgttcctgattctttgaagatgcaccctcttatagagatgccatcttgaagaattttgca

SEQ ID NO: 6795290 - DNA, 82 bp, Homo sapiens
atgtaggatgtaagaattttatgtatttactgattaatttatacttcatgtcaatacagaaaggatattttgcaaccagcat

SEQ ID NO: 6795291 - DNA, 95 bp, Homo sapiens
ttgaaggtgtctgagtccctcctggcctcacagtcctgggttctggggtatagctgtaactgaggtggggccgggaggaatggggactaatttgg

SEQ ID NO: 6795292 - DNA, 68 bp, Homo sapiens
aatggtccattttattcagagactttgcaataagctgagcattgttatgaaaataagatgtttccatt

SEQ ID NO: 6795293 - DNA, 72 bp, Homo sapiens
tctaattagtattcagtttataacacctaaggtgcaaacagcagtgtgtgggaaggctaggatgctgttgga

SEQ ID NO: 6795294 - DNA, 75 bp, Homo sapiens
aggccactggtgccagagaacagaattaagggcagaaggaattcaaggactgtttttaatggtaccagacagctt

SEQ ID NO: 6795295 - DNA, 65 bp, Homo sapiens
tcccgcgccgtccctctacggtgtgacgtacgcgtcagggccacgcggaggtgacgggaacggga

SEQ ID NO: 6795296 - DNA, 83 bp, Homo sapiens
gggggtggaggctggtccagggcctctgtgggcacttgcgagcaatgctggcttcctcagatgctcttggacgccccacctcc

SEQ ID NO: 6795297 - DNA, 69 bp, Homo sapiens
gtagcggttataactgtttgttttctacatgtctgtagtaaagtcctgttaactgttaacaactgctat

SEQ ID NO: 6795298 - DNA, 66 bp, Homo sapiens
aattcagcaattctgctagcttaagctgctagcctcaggcagctagagaatgacagagtctgaatt

SEQ ID NO: 6795299 - DNA, 64 bp, Homo sapiens
agttgtgtaattagcaaacaaatctcctttcttggaggggatatactgtctgtattacataact

SEQ ID NO: 6795300 - DNA, 77 bp, Homo sapiens
agtgctgggcacatgtattgacattatattcttttaatccaagagaaaacttttcataatgcagtgtctaaggcatt

SEQ ID NO: 6795301 - DNA, 68 bp, Homo sapiens
gctgcctttgtgagccaaggggaggtttctcactctttaaaactcctgtgggcttaaaggaaggtagc

SEQ ID NO: 6795302 - DNA, 81 bp, Homo sapiens
caatatgaatgtatgtgtttattttcagattttcttatcaaatgtgtaagatctagaaggcaaatatagtgctgtatgttg

SEQ ID NO: 6795303 - DNA, 92 bp, Homo sapiens
tcctgtccctcatccacatcagaaccaaggagctgagaatgattctgttcatgggtctccagtgttcaggtgactggatttgagtgacggga

SEQ ID NO: 6795304 - DNA, 59 bp, Homo sapiens
tcaggtgcctgctcccagcttgggcatcttctcttgcctacctggagacagcactctgg

SEQ ID NO: 6795305 - DNA, 55 bp, Homo sapiens
ccatgaaaaaacatgccctgggtagctgcagttccaggatgatgataattcatgg

SEQ ID NO: 6795306 - DNA, 80 bp, Homo sapiens
ggccatagattatatcattctatttatatgaaatttccagaataggcaaattcatagaagcagaaagtaaactagtggct

SEQ ID NO: 6795307 - DNA, 64 bp, Homo sapiens
tgttcttgggaatcttacagtttggttaaaaatgttaatactgtacatatggattctaagaaca

SEQ ID NO: 6795308 - DNA, 129 bp, Homo sapiens
tgagacaagtaaaggcaggccgggctcacagtagacatcatgtaagtagtggctagcaccctcatcctgccctcgtcattgtcttgatatgattgtcatcttgttgcttctccctccttcaacatctca

SEQ ID NO: 6795309 - DNA, 67 bp, Homo sapiens
gtggcctttatcttaggtatccacaggagaaaccacctcaggtggtacatacactaatataaaccac

SEQ ID NO: 6795310 - DNA, 78 bp, Homo sapiens
aaacacacatattaagcacctatgttgtgccaggcactgtgctaggcactacgcaaaggtgactgtttcatgatgttt

SEQ ID NO: 6795311 - DNA, 75 bp, Homo sapiens
cttcactgaaatgtgttctagtgttttgcagaaggtggaacttttgggcaacaacatgggattcatttctgtagg

SEQ ID NO: 6795312 - DNA, 64 bp, Homo sapiens
cccttcatgggaacaccagtattctcatgacatcagagaacagcaaaagtgcttcaccaaaggg

SEQ ID NO: 6795313 - DNA, 95 bp, Homo sapiens
ggcggggggttccttgagcccaggaagtggaggctgacttgagccgtgatcacatcactgcactccagcctgggtgacagagcgagatcccctcc

SEQ ID NO: 6795314 - DNA, 71 bp, Homo sapiens
ttccgtgttatgtttgtgaacagagccattttcattgataccgctttgaaaacacacgaatagacactgaa

SEQ ID NO: 6795315 - DNA, 87 bp, Homo sapiens
tcaaaagagacaaacttaaggttgtttgtgatgcaaaatatttagttttgacctatgaaacaaaccagtaattttgttggcctttga

SEQ ID NO: 6795316 - DNA, 68 bp, Homo sapiens
gagcaggggctgggaatgccaggcaatactacacaatgaagaattgtccagcagctcagtctacgttc

SEQ ID NO: 6795317 - DNA, 81 bp, Homo sapiens
ttaggtttgcttacttcagtgttttggactgtgctgacatagagagtctacacacaagtttgggtcactcagctaacttaa

SEQ ID NO: 6795318 - DNA, 98 bp, Homo sapiens
ctctgtacctatggatcttggactcccaagacctttccctgaatgtggtaagaatttaataagaaaggttcttgggagttcacagaccagggacagag

SEQ ID NO: 6795319 - DNA, 57 bp, Homo sapiens
gcccatttagagggtgaagaagctaaatcaagcctctgagtttcaccttggaagggc

SEQ ID NO: 6795320 - DNA, 94 bp, Homo sapiens
cttcattcgggtgcaattgtaacagaatttgctaaactccgcatttgatttctgaagtggattttaattattctgtcataaacttgcaatggag

SEQ ID NO: 6795321 - DNA, 60 bp, Homo sapiens
ctgtgctgggccctgagactaaaaagctcagcatttgagcccctcatggtgtctagacag

SEQ ID NO: 6795322 - DNA, 67 bp, Homo sapiens
catgagtgccttctaggtgctgtggatatagtactgactaaagtcagacacagtacttgccctcatg

SEQ ID NO: 6795323 - DNA, 100 bp, Homo sapiens
ggccttaagagaaggaaacctgtctttgggtagcttgtcctagagtaagaagatgatgggcactggcaccaaagacttgggctcttgttctgatatggcc

SEQ ID NO: 6795324 - DNA, 56 bp, Homo sapiens
ttccatttctgtgaacagacaagctaaaaaaattgaccctggtgtcagagatggaa

SEQ ID NO: 6795325 - DNA, 73 bp, Homo sapiens
ccccatgaagtagggtctctgattcttgtcccctccccgctagttcatagagtcagataccagactcaagggg

SEQ ID NO: 6795326 - DNA, 89 bp, Homo sapiens
gcgagggcagcctgacttctctggcctggtgcagaatgtctcctggagaccagctgagggggccaagagctcaggtgactttcctttgc

SEQ ID NO: 6795327 - DNA, 61 bp, Homo sapiens
ggggtgggagtgccatccttgatgcctgcacgctggcctgtcattgggtgcagcccaccct

SEQ ID NO: 6795328 - DNA, 56 bp, Homo sapiens
cacgggtggaatcagggactccctctagactcccagatcctctggtaccacccttg

SEQ ID NO: 6795329 - DNA, 56 bp, Homo sapiens
gaccatggccatggcagccctgctggcctggtaggaggagttgctgtggcctggtt

SEQ ID NO: 6795330 - DNA, 61 bp, Homo sapiens
gagctcttctggttagatgttgccttaagctgggcttggaaatgtctaatcacagcagctc

SEQ ID NO: 6795331 - DNA, 81 bp, Homo sapiens
ggggcccctgctggcctgctggtttctctgtgagctgctgctatgaggccagtagtgggcagcgatcagggctggggctct

SEQ ID NO: 6795332 - DNA, 68 bp, Homo sapiens
ccaggccagaggagttgaggctttgggtagcaccccgcaggcccagcagtagagctcatatggcctgg

SEQ ID NO: 6795333 - DNA, 66 bp, Homo sapiens
tggaaattgttaaaatggagtaagttatctatttgagggtaaactaaccattttaatttcttttca

SEQ ID NO: 6795334 - DNA, 85 bp, Homo sapiens
tgcctattggttttgaagcaactgtattaatggaagctctctgacatggtgagttctcagtaaagttctttgaaatggattttca

SEQ ID NO: 6795335 - DNA, 96 bp, Homo sapiens
gcctgtgttctccatcctctatcctattcatcattaaaagaacaaaaagttttgattttgatcatgaagaggataaactgaaaagggtacacacgc

SEQ ID NO: 6795336 - DNA, 110 bp, Homo sapiens
tgcctggctctgacctccaaaagggaggggctgccctggtgtcagggcctagggcgtacagatggctccacaaggcagctcctccaggtcaggcagctggagcccgggca

SEQ ID NO: 6795337 - DNA, 83 bp, Homo sapiens
ccctcctaactgatctctacttgggctttgtcaggatgggcctcctccaggcctaggccaagtgattggtgagctgggagagg

SEQ ID NO: 6795338 - DNA, 58 bp, Homo sapiens
tttgcttcatctcatgctgcctccccacctcccctgtgctcaggccagatgaggcaag

SEQ ID NO: 6795339 - DNA, 83 bp, Homo sapiens
tgcttattctgtctcattgtcaggcttcacttgatgtcaaagaacatgaagtgaagaaatacatgagaattttcaggaaggta

SEQ ID NO: 6795340 - DNA, 68 bp, Homo sapiens
agcggcactgactgcaagcttgcagtttcgtaaggctacttgcaaggttgcagttagaactggctgtt

SEQ ID NO: 6795341 - DNA, 56 bp, Homo sapiens
gctagctctctgggggatataggttcatctctgcaaatctctttcatggggctagt

SEQ ID NO: 6795342 - DNA, 62 bp, Homo sapiens
acaacaaagacacttgaaatgatgacaacccagtgtccttttttcaatgtgttctttgtagt

SEQ ID NO: 6795343 - DNA, 58 bp, Homo sapiens
tgccagcttttgactatcttagttcactcagctgaaatgatggctttagaagctggta

SEQ ID NO: 6795344 - DNA, 74 bp, Homo sapiens
aaggatgtattattatggaacattagaaccagaagaaaggttatatagtcctactgtccataaagtataacttt

SEQ ID NO: 6795345 - DNA, 69 bp, Homo sapiens
ttctcaatttgagaggcatgtctattatttagaaaattctggtttagattcctctacaataaatgagaa

SEQ ID NO: 6795346 - DNA, 103 bp, Homo sapiens
ctgttaatgataacaggtgtgcttgttagcatgcttaatggatattttgattagttcatatccaaagtatgcaaacatttttgattacctgtttatagtacag

SEQ ID NO: 6795347 - DNA, 56 bp, Homo sapiens
ctgtctctgctagatactagtagcaaaccatatattataatttagcaagtagacag

SEQ ID NO: 6795348 - DNA, 58 bp, Homo sapiens
ttcctgtgtgtcagatgcacagtatttactttgtactatgatttggatatgcagagaa

SEQ ID NO: 6795349 - DNA, 61 bp, Homo sapiens
aaggcaatgggatggatcatgtaacaaagttggtttgggactccacatcctcctcttcctt

SEQ ID NO: 6795350 - DNA, 67 bp, Homo sapiens
ctgagaacccattagcagcagagatactttcacaagttaggtgtttgctggagctctgggtcataag

SEQ ID NO: 6795351 - DNA, 58 bp, Homo sapiens
agagagcattgaggaaatcttctgtctggtctcagaatcctttgctcatttgctctct

SEQ ID NO: 6795352 - DNA, 77 bp, Homo sapiens
ttgttattcttgctacaactggacaacagattgggctcttaagctttctgacacatcagttgtaaagttaatgacaa

SEQ ID NO: 6795353 - DNA, 77 bp, Homo sapiens
gagaaacggaaactttttccaaagtggctgcatcatttttcattcccaccagccatgtatgagggtttccagttctc

SEQ ID NO: 6795354 - DNA, 69 bp, Homo sapiens
gtcatgtgctggatagaggaggaggtgggagggcacacaacttccaagagcctttcttctagatgtgac

SEQ ID NO: 6795355 - DNA, 56 bp, Homo sapiens
cctagactagaggcagggagccctatattctagttgtcatcctgccactggctagg

SEQ ID NO: 6795356 - DNA, 99 bp, Homo sapiens
gtctgctcagtgatgtggcagtagtggatcaaaaatatctgtttggaggtcagacaggcctagattcactgctgtgcaattttgagtaagttccttgac

SEQ ID NO: 6795357 - DNA, 65 bp, Homo sapiens
ttcttccttgttcttctgggagagacatccaaaagactctcaagctaagtttgaacaaggaagaa

SEQ ID NO: 6795358 - DNA, 74 bp, Homo sapiens
tccctcttgacaagtgaccctggagttagtcctgtgtcctggagttggaggcagcattcaggggtgatgaggga

SEQ ID NO: 6795359 - DNA, 79 bp, Homo sapiens
gaccacgttggcaccaggctgggcataggccatgtcatggggtaagataaggctcctgtcctcctggagctccaaggtc

SEQ ID NO: 6795360 - DNA, 66 bp, Homo sapiens
agaacatgaagttttctatagtgaagatagtctttacttatagctcatggaattgttcactgtttt

SEQ ID NO: 6795361 - DNA, 58 bp, Homo sapiens
ccaggaaggcaggcctccccgcggcgccttccagggctccccggggcctcctccctgg

SEQ ID NO: 6795362 - DNA, 78 bp, Homo sapiens
aaatagaatggaatgaaaaacacatgcaactggagttattaagctagtattgctcttttgtattttatctttctgttt

SEQ ID NO: 6795363 - DNA, 61 bp, Homo sapiens
tccctcatagaagcactcagctccctcggggactcccagggaagcttgttactgagaagga

SEQ ID NO: 6795364 - DNA, 59 bp, Homo sapiens
ctccaggacagattcagggccaagtacggccgcagtgacttggtccatgtgtcctgggg

SEQ ID NO: 6795365 - DNA, 106 bp, Homo sapiens
gctgacttcatgggcctacctggctaggaatccatgactctcctgtggaggtcattagccattgcctgtcgccagtggccctacaaacccccacatggaagtcagc

SEQ ID NO: 6795366 - DNA, 66 bp, Homo sapiens
ggtcctttggctgccaatggcttggaaaggctacagccccaggcttgagggggctagtgagagacc

SEQ ID NO: 6795367 - DNA, 69 bp, Homo sapiens
gcttggctctctggggcctgagtttgaaaagggccacggaggggccggtagccaggcctcaagttaagt

SEQ ID NO: 6795368 - DNA, 56 bp, Homo sapiens
ttatttctgagactaaattctttaaatataaattatagaagtcagctcagaagtga

SEQ ID NO: 6795369 - DNA, 55 bp, Homo sapiens
ggatctcagaattggacggtagtccaatgatgataactgtatttttctgagattc

SEQ ID NO: 6795370 - DNA, 128 bp, Homo sapiens
ccccaggagaaaacatacgctccagacaccagcttcatcttggcagtggtctcagttggacttgagagtaaataggagatgacagctgaatctggtgtggagattcaggaaggtggttttcctggagg

SEQ ID NO: 6795371 - DNA, 89 bp, Homo sapiens
aattcccttttgagaaattattttctgtagaccagaaggaatcaaagatgagccctgggatacagtaaaagctgttacaaaacggagtt

SEQ ID NO: 6795372 - DNA, 70 bp, Homo sapiens
cttttatggtggtctgaagtgtctgattaaccaaccctgaggtttccctttccactggacctcatgagag

SEQ ID NO: 6795373 - DNA, 57 bp, Homo sapiens
acaacaggcaggttgagaaacattttcttggagagtttcttgattcttgccagttgt

SEQ ID NO: 6795374 - DNA, 55 bp, Homo sapiens
gtaggtgttcctaaactggttgccatttgtgctccagatttgtaggggctcttac

SEQ ID NO: 6795375 - DNA, 67 bp, Homo sapiens
gacttttccagggaggaatgtggggttggagtttggtctcaggcctggagtactccttgaagtggtt

SEQ ID NO: 6795376 - DNA, 77 bp, Homo sapiens
tgagtgtcggctgagcaattttgatgacattgagcaacagcacaacaatgttacaattcaaaatgctgctgattgca

SEQ ID NO: 6795377 - DNA, 75 bp, Homo sapiens
ggaaaggagtcaggcatggctcttcctcaggtgaagtgatattcctctgtggattaatctgtctctttcctttct

SEQ ID NO: 6795378 - DNA, 75 bp, Homo sapiens
cccaagcccctttcatatacattgtttcatttactcataaatcatgaaatgtcagagctggaaggggcattaggg

SEQ ID NO: 6795379 - DNA, 89 bp, Homo sapiens
ccaatctctgctttctatgctaatgatcagttcagaaacccagatctgatgcaaccagcatatggaattttactggccagagaagttgg

SEQ ID NO: 6795380 - DNA, 91 bp, Homo sapiens
cttacagaaaatcattatcatagggagagatttgaattctgggtggaataaattagaacatcaatttcccctattgatagacccttgtagg

SEQ ID NO: 6795381 - DNA, 101 bp, Homo sapiens
gatgtccacatccttatgcccagaacctgtgaatgtgttatcttaatggcaaaagtgactttgcaaatgtgattatatttaaggatcttaaggaggagatt

SEQ ID NO: 6795382 - DNA, 72 bp, Homo sapiens
ggcaagggcaaacatctttatttggcaaggtctgtattttaaatctgatgtttctagatgcttgcccttgct

SEQ ID NO: 6795383 - DNA, 99 bp, Homo sapiens
gaggcagaagaatcgcttgaacccatgaggtggaggttgcagtgagccgagattgtgccattgcactccagcctgggtgacacagcaagacctagtctc

SEQ ID NO: 6795384 - DNA, 128 bp, Homo sapiens
caaaatgaataatgcagggcaaagtctgtctttgaaaagggagatagaaattgcctaattgcaattttcctcattgtttcaaagtcaatctttttgttctctgatatatctgcagatagtttattttg

SEQ ID NO: 6795385 - DNA, 64 bp, Homo sapiens
atgtgaaaaatttcttattacaatgtgtaaaaatattgtgaggacataggacattttttgacat

SEQ ID NO: 6795386 - DNA, 57 bp, Homo sapiens
aagtgagtggtaaggagcatgggctataatcagtgcccctggctctgtcactcactt

SEQ ID NO: 6795387 - DNA, 87 bp, Homo sapiens
cctcaattcattagagctgataatgaggccaaggccaaggccagggctatgacctctgtgaatgtcctaagctccctggatatgagg

SEQ ID NO: 6795388 - DNA, 93 bp, Homo sapiens
ccaagtagaataggtatttatgttgcctctatgtttgccttcatatatattataaacatattgagctctaaaagtacatggctttctgcctgg

SEQ ID NO: 6795389 - DNA, 79 bp, Homo sapiens
gtcctagctttgcgcatgcgtagtgggcggagaaaaaaggtccggtcccaggattggttgcgcaggcgcagggaaggat

SEQ ID NO: 6795390 - DNA, 74 bp, Homo sapiens
caggaattggctgaatcccaataagcagggagtagcatgtttggccacttcctttgggaaatcactaaggcctg

SEQ ID NO: 6795391 - DNA, 57 bp, Homo sapiens
gctggtggcagagctccgcggcagcgtgcgccaggcagtgcggctctaccactcggt

SEQ ID NO: 6795392 - DNA, 107 bp, Homo sapiens
ggggaagatgtcccagctctggactcagcactgatcctcatgaagagctgctcgaccccatcgtgtatgtttacagaggaagtgcctccatggcccacttcttccct

SEQ ID NO: 6795393 - DNA, 62 bp, Homo sapiens
gcagagtggagatgtgtgtggaagcattcctcctgaattttttatagactctctccctttgc

SEQ ID NO: 6795394 - DNA, 63 bp, Homo sapiens
gctctgctgagagccacgtggcacaactggggctccatccagttgtgtgtgcctctgtagagc

SEQ ID NO: 6795395 - DNA, 63 bp, Homo sapiens
ttgaaaagacaacagagatgacagactcttatttatctctaggagtggatctgttgttttcga

SEQ ID NO: 6795396 - DNA, 82 bp, Homo sapiens
tgtaaaatggctttctcctacttaaggccttccaatggttcttatcatggaagactcaaggtggtgaataccatgatctaca

SEQ ID NO: 6795397 - DNA, 73 bp, Homo sapiens
gtcctagctgattgctaacctgttagaatgtggccccagtattgcctactcttccattagtaattataaggac

SEQ ID NO: 6795398 - DNA, 62 bp, Homo sapiens
ggtcacctgacccaagcatggcgggctgagtccaggaggggtctgcatgttggaggtgtacc

SEQ ID NO: 6795399 - DNA, 82 bp, Homo sapiens
agcaaaatgcaagaggttggattttaagagcctaagctaagtttcttaacactcttaataattataatcagttgctacagct

SEQ ID NO: 6795400 - DNA, 112 bp, Homo sapiens
cagtttccacttgtaggttcaggatcaagagagtcatccaatatgagtatgtgttgttttgaataaagcatgcttttggaggaccattgccatactaacataaggcaaactg

SEQ ID NO: 6795401 - DNA, 94 bp, Homo sapiens
tgaggtaggagaattgcttgaacctggaggcagaggttgcagtgagctgagatcatgccactgcaccccagcctgggcaacagactccgtctca

SEQ ID NO: 6795402 - DNA, 62 bp, Homo sapiens
ttcctccagtcagagctgtccctgaggatttcctggttttaaggacaagccctgaggaagaa

SEQ ID NO: 6795403 - DNA, 115 bp, Homo sapiens
agacatctttgcctggttttggtatcagaataatattggtctcatagaatgggtggagaacaactctgtcactagaactagtattatttcttccttcaatgtttggtagaattct

SEQ ID NO: 6795404 - DNA, 82 bp, Homo sapiens
cctatagagcaggacaggtctttggtcaagggtattcgagtagctatgctcccctgctagaacctccaacatgctctcaagg

SEQ ID NO: 6795405 - DNA, 61 bp, Homo sapiens
agcatgtctttcttgtgtcccaagagagaactgttggatgtggcagaggagatgactggct

SEQ ID NO: 6795406 - DNA, 103 bp, Homo sapiens
aactttcattcctttgtcaactgcaagaatggtaatatttgacaagaaaaacccaacttgtcaaatactacgattcttgcagttgacaaaggaatgaaaagtt

SEQ ID NO: 6795407 - DNA, 55 bp, Homo sapiens
ttatctctaagttcctttccaagcaagggaggcagtataaggagctgagagatgg

SEQ ID NO: 6795408 - DNA, 67 bp, Homo sapiens
ggtaacactgtcatttaagacattctggagcccaggtttccatttgaaatgaaagtgataggttatc

SEQ ID NO: 6795409 - DNA, 58 bp, Homo sapiens
agacccaggtttcaaactactcagagatagacacaatgagtcttgagactttgggtct

SEQ ID NO: 6795410 - DNA, 76 bp, Homo sapiens
gtggttccagctcccaccaggcagacctaccctctaggacccaactccttcttggtggctgcctggtggtctccgc

SEQ ID NO: 6795411 - DNA, 68 bp, Homo sapiens
tgtctgaatctcggtttcctcatctgtaaaattggtccagatagatacataactcgaggttgtagaca

SEQ ID NO: 6795412 - DNA, 64 bp, Homo sapiens
tggtggagccaggagatgaagcaggtttgtctggctccaaagctgtggtcttttagttccatca

SEQ ID NO: 6795413 - DNA, 71 bp, Homo sapiens
gtactgggcagctgtgcaaacaatattaaaacagaaaaaatattttgtgccatgcactgccttgattgtac

SEQ ID NO: 6795414 - DNA, 98 bp, Homo sapiens
atggggtatgttctgtatctgatggagtatacagctgactacttgcacggatctgtatgtcagactgaaagatacacctctgaaatgtgccagcccat

SEQ ID NO: 6795415 - DNA, 97 bp, Homo sapiens
tagagctgggctccagggcacagcttgcaaggtcatcatgcattggagtctccatcctctccagcctcatcgcctgcctgtccctacagcttcttta

SEQ ID NO: 6795416 - DNA, 69 bp, Homo sapiens
agccacagatttggaggcctcaccccagactgaacagtctctgagggtggagctccagaatctggagtt

SEQ ID NO: 6795417 - DNA, 80 bp, Homo sapiens
ttcatatactagatgccattaagcaattgttgctaatttttaggtatgataatgctttaattgcatgtagtgaaaatgga

SEQ ID NO: 6795418 - DNA, 58 bp, Homo sapiens
ggctctggttgaccatgatggcgatgatgcctcccatgccactggccccaccatagcc

SEQ ID NO: 6795419 - DNA, 80 bp, Homo sapiens
tgattggcccatggttctgcaggccgaccggaagcatggcagcatctgcttctagggaggccgcaggaagctcccaatca

SEQ ID NO: 6795420 - DNA, 79 bp, Homo sapiens
tgtcttgccctggcttagtcattagttccctctctagggactggagaggagctggccactaggatgcaggtgcaacaca

SEQ ID NO: 6795421 - DNA, 63 bp, Homo sapiens
aaatttaggaagcactcatttaaaggagccacagctctgagaatgagtgttttcttatgattt

SEQ ID NO: 6795422 - DNA, 83 bp, Homo sapiens
agtgatagattaagtgtttagtaagagatgtttcaaaatagaaaatctttttaagttagacaccaacactcttaaatattact

SEQ ID NO: 6795423 - DNA, 67 bp, Homo sapiens
tgtttagtttttctaagtagcgatatttgggggaatttaaattggcatttcttggagaaactgaata

SEQ ID NO: 6795424 - DNA, 60 bp, Homo sapiens
gtttctgctgcgtgctccaggaaatctataatgagaagtcctggggtagccagcagagat

SEQ ID NO: 6795425 - DNA, 79 bp, Homo sapiens
ttaggttggtgcaaaagcagttggattttttgccattaaaagtacaggcaaaacagcaattacttttgcaccagcctaa

SEQ ID NO: 6795426 - DNA, 67 bp, Homo sapiens
cagtagtttttccacatgaagacaaggcttgtttgtttgaagaagtctctgctggttgtgcctattg

SEQ ID NO: 6795427 - DNA, 67 bp, Homo sapiens
ctacaagccaagaagggagatgtcagaagaaaccagctctactgacaactgcatcttggacttctag

SEQ ID NO: 6795428 - DNA, 59 bp, Homo sapiens
caagcttagtggtaggactgatttagtttaaaggagatttctcaatcctagtactattg

SEQ ID NO: 6795429 - DNA, 78 bp, Homo sapiens
tgctacagggaactcagtatctgtcagtaatcaggttctcttacagtgaactgatcacatagatatattccaagtaca

SEQ ID NO: 6795430 - DNA, 65 bp, Homo sapiens
ggagtgacttccttcaatataatttttacttgaaaagtagaacttttgattgatggaaagacttc

SEQ ID NO: 6795431 - DNA, 86 bp, Homo sapiens
aatgtgctctgtattctatggcagttggtgataataatagcttggtttcttttggtgcatttccttcaaggagttgagaggacatt

SEQ ID NO: 6795432 - DNA, 88 bp, Homo sapiens
aatttaactcttcttccagcaggtgaggagaaacagaacattactttctcatctttccttcccctagctgagaaacaagacagaaatt

SEQ ID NO: 6795433 - DNA, 123 bp, Homo sapiens
cttatcattaactgtaacttagttagcgtgatatttttgatccttaagtttttaacatcgtataaagaattttccatccaaagtaacatgaggcagagctacctgaatttcagtggtgataag

SEQ ID NO: 6795434 - DNA, 62 bp, Homo sapiens
tctattgcctgatgcaatttgagaatagaacttgtgccaactctctgtgcattatcaataga

SEQ ID NO: 6795435 - DNA, 88 bp, Homo sapiens
tgttttttcacataaacttcaaagttgtagccaaccaagtatttacactataccaggaagggctctttaaagactgtgggaaaaaaca

SEQ ID NO: 6795436 - DNA, 73 bp, Homo sapiens
tcatttcatagattctcagagagggattcctgataatatttctgctcacatgatgtgagaatgtaagaaatgg

SEQ ID NO: 6795437 - DNA, 73 bp, Homo sapiens
tgaagacttggcctctgattaaacacaggttctggagtattagagacagggcaaacagatggtggagttttta

SEQ ID NO: 6795438 - DNA, 97 bp, Homo sapiens
gcaatgggagtatcaaggagaatgcagcaaggtagtgctggactcagatcccacctccagagctttgcagtgattgttcttggaaaacttattttgc

SEQ ID NO: 6795439 - DNA, 57 bp, Homo sapiens
agcagggcagtgatcagaaagggaactcagatggcctgtcaggaaaattgccctgct

SEQ ID NO: 6795440 - DNA, 80 bp, Homo sapiens
tctgtgcacctttcaaaagaaaacttagtgctttatcaaatatgaggcactattaattttgagagaaattcaggcacaga

SEQ ID NO: 6795441 - DNA, 85 bp, Homo sapiens
tcttttgaaagcttgagtgatgccatctccaaataccatcacgtgaaatttggaaacaaatggtttcgcagtctagcacaaagga

SEQ ID NO: 6795442 - DNA, 62 bp, Homo sapiens
acgtcaggactgctgtggacagagtcatcccaaggaatgcctatgccccagggtcacaatgt

SEQ ID NO: 6795443 - DNA, 86 bp, Homo sapiens
ttatatagcagtgtatgaaaagctttctagctatgttctacagctgtgtggagttcagtagcttgaaagcaccataatttatataa

SEQ ID NO: 6795444 - DNA, 60 bp, Homo sapiens
gtgttcatggatgtcaatttgagattctgagatattcagtcactctgacttgatgaatat

SEQ ID NO: 6795445 - DNA, 55 bp, Homo sapiens
tcgccctgccagccctctgaacacaggcctttctgggagagggaaagcaggctga

SEQ ID NO: 6795446 - DNA, 67 bp, Homo sapiens
taggattatttgttctatttctgtaagcaatgccactggaattttgataggaatggaattaattctg

SEQ ID NO: 6795447 - DNA, 58 bp, Homo sapiens
tgaaggaaaatttaggagatcatgcttcacaaagcactgtctgatatgttttccatca

SEQ ID NO: 6795448 - DNA, 76 bp, Homo sapiens
gctgccctctgcggagcctttgtactgggcttcaaagtcatgatgctggagctcaaaggcctgtgggagtggtggc

SEQ ID NO: 6795449 - DNA, 74 bp, Homo sapiens
ctctcttgggcatggcctcaaaggactgcagaatagaacacctatctggtagaagaagtgaagctggcagagag

SEQ ID NO: 6795450 - DNA, 56 bp, Homo sapiens
ataatgctgggagaaattgttatctttatgggataataaatctccatagatattat

SEQ ID NO: 6795451 - DNA, 70 bp, Homo sapiens
tagcaggtggtggggctatgatctaaacacaggcattctgggtccaggtccatgctctgaacctctgctg

SEQ ID NO: 6795452 - DNA, 56 bp, Homo sapiens
cctgaagctgcataccaaagactcacacagactctgctaaatgtgtaggctccagg

SEQ ID NO: 6795453 - DNA, 59 bp, Homo sapiens
atcaaaggtatctatgctgtctgatgtacaatcagttacatagccgcagtgccattgat

SEQ ID NO: 6795454 - DNA, 96 bp, Homo sapiens
gctcctgaatccctggggacttccagaggttctcagccctgtggtgtttcatagctggaagagaacctcgaatgggcatctgcaggtcagggaagc

SEQ ID NO: 6795455 - DNA, 60 bp, Homo sapiens
cagcataggacagggtttcatctttcagcatcttcaacgcatgatacccggtctaggctg

SEQ ID NO: 6795456 - DNA, 62 bp, Homo sapiens
gtgcagcatggagttgtggaatgatgtatggtattgttccacacagctcatgactcctgtac

SEQ ID NO: 6795457 - DNA, 70 bp, Homo sapiens
agatggaagagagttgtttctgtgcagtgacatgctagattcacatgacagacagcttctcattttattt

SEQ ID NO: 6795458 - DNA, 59 bp, Homo sapiens
cccacggcctgacctggtgttgacaggagcacctgcagagagtgccgggcagccccggg

SEQ ID NO: 6795459 - DNA, 60 bp, Homo sapiens
attgtcagagtttgagaaagtaaaaccatttgtgttcaagtgtttcctaaactctacaat

SEQ ID NO: 6795460 - DNA, 65 bp, Homo sapiens
taagctaacgtccatggaaatgcaaaagactgtaccagcccattgcttcctggaccttcagttta

SEQ ID NO: 6795461 - DNA, 69 bp, Homo sapiens
agcagggccagggaaacgatcagcagaactggtgggaaagatctgggctaatggtcctggcctcaggct

SEQ ID NO: 6795462 - DNA, 107 bp, Homo sapiens
ccacttctgattcattgctgtttgccctgcccttgctatttctaacaagatgccatgtgtgaatgggagtagatgaggagtgggcagagaggaatactttggaaggg

SEQ ID NO: 6795463 - DNA, 83 bp, Homo sapiens
ggagtttgatttgtaattaagtgtagtagctatttctgtttgcacaaagcataaaacgttacaacatgttcaagtttaagtcc

SEQ ID NO: 6795464 - DNA, 81 bp, Homo sapiens
tcattttcgcctttagcctgaaatagtttatgaggctattacggtctctgagttcataccaggctacccagaaaaaattga

SEQ ID NO: 6795465 - DNA, 65 bp, Homo sapiens
aagcagaggaccgacggagggatactttctgctcttttgtgtgcctcctctttctctctctgctt

SEQ ID NO: 6795466 - DNA, 77 bp, Homo sapiens
tcattgctttaagatacattttcttcagagaaagtattttttccttactgtgaaattgtataatgagatgctaatga

SEQ ID NO: 6795467 - DNA, 75 bp, Homo sapiens
ttctttaaggtttctaggatactctaaatgtattccttcaatgcagttaagtaatgtcctagaagcctgaaagga

SEQ ID NO: 6795468 - DNA, 74 bp, Homo sapiens
attgttcagagaagggaagaataaaaagcctcattaagccatcattttggggtagaattctcttcctggatagt

SEQ ID NO: 6795469 - DNA, 77 bp, Homo sapiens
gctctgcccctcaccagctgtaagatctcggaccctctgtgagcctgtgtcctcatctgcagcgaagggatcagggt

SEQ ID NO: 6795470 - DNA, 114 bp, Homo sapiens
ttatgaaaacaagcaaagggccaaatttgctctgaaagttttagtgtatgggccaccggtatacacaaaactgatacacaggaagcaatttcagagcaatgtatgatgtcataa

SEQ ID NO: 6795471 - DNA, 65 bp, Homo sapiens
cctctgcactgctgatcccaggtctatgctgaaaagctaaggcttattaggtctgcagagtgagg

SEQ ID NO: 6795472 - DNA, 56 bp, Homo sapiens
tgtaattctaaccacataggtgtaacaggaagccactgatgctggtctgaattgca

SEQ ID NO: 6795473 - DNA, 64 bp, Homo sapiens
gagcagctggctgtattggtttgtaaggaaatgatgcaacaagccaataacagtagtctgcctc

SEQ ID NO: 6795474 - DNA, 65 bp, Homo sapiens
ccatggccaggaaagccaaggtaaagctccccagggtcaaggagcccaggtatcctaggacatgg

SEQ ID NO: 6795475 - DNA, 76 bp, Homo sapiens
ggggtggccctaccctctggaatatacaaaaccttacacagacacaatatatacaccggggaaggggggccacccc

SEQ ID NO: 6795476 - DNA, 58 bp, Homo sapiens
gggcaaaggtttgaggtgggaagaggttcagtgacatctctccaatttaaattcaccc

SEQ ID NO: 6795477 - DNA, 77 bp, Homo sapiens
gaaaagaggagggctcagtaaacggtggattgaattcctggattacaatagctacttgactggcctttctaaatttc

SEQ ID NO: 6795478 - DNA, 107 bp, Homo sapiens
ggggattgggcacttcctgtttccaggcagctggaaaactccaggctctgaaaacgctctttattctaagtctggcagatcgagcagcccagggaagccgattcccc

SEQ ID NO: 6795479 - DNA, 77 bp, Homo sapiens
tcctggacatggttttgccaggtgggccacaggctgcctctggtggcccaaagctcagctgagcgaaggacatggga

SEQ ID NO: 6795480 - DNA, 66 bp, Homo sapiens
ctgggcacctgaagatttagagattgaagatacagccttattcaacttcaaatcctcagggcctag

SEQ ID NO: 6795481 - DNA, 62 bp, Homo sapiens
gtctgatgtctctgggattagcttcaaaataaaatggtgaggttgggatgagggatacagat

SEQ ID NO: 6795482 - DNA, 73 bp, Homo sapiens
gttccggaagtgaaggtaatccctccctagccaatgaaaattgggtagaaggcatttcctttattttaaggac

SEQ ID NO: 6795483 - DNA, 126 bp, Homo sapiens
tggaaaatacaaaggatctgaagctaaacacactagagtgtgaattgatttgactgcttaatagtttgtcaattacagtgtcaccttaagtctcaggtttctgtttttgatttgtgttgttttcta

SEQ ID NO: 6795484 - DNA, 65 bp, Homo sapiens
ctggtgtttagtatgtatttaatggactgaagctatcaattcatatggatatgctagtatattag

SEQ ID NO: 6795485 - DNA, 61 bp, Homo sapiens
cagcttgggctggaaagtttctcagcatataaactgtttgtaaagctacagcccaggtctg

SEQ ID NO: 6795486 - DNA, 70 bp, Homo sapiens
tccttttagagatcctatctccaaaaacagtcacattctgaggtctgggggttaggacttaaataaagga

SEQ ID NO: 6795487 - DNA, 107 bp, Homo sapiens
cactggggtgatgttaccataataattatggaattatggcttaaaatcaaatcactattgtggacatttaagtcatgattctgtgttactaggaaaccaaactagtg

SEQ ID NO: 6795488 - DNA, 76 bp, Homo sapiens
aggacagataaagcaaggatgactgaagaccctaaaactccccaaaggaagctttaatcaaaatttttgcctgcct

SEQ ID NO: 6795489 - DNA, 72 bp, Homo sapiens
gagactgaaactgaggaagtaaaattccttggagtatgaaaataacagggagtttttgttcctctaggtttc

SEQ ID NO: 6795490 - DNA, 86 bp, Homo sapiens
attgtgatgtagactgaaaatcagaaaattaaaagtggatgaaatttgctctgagtttataggttttccagttgctgctttataat

SEQ ID NO: 6795491 - DNA, 127 bp, Homo sapiens
gcagggcacaggggacttcccttctctggtgacagtggtgacagcagggacatgtaggaagggccaggcttattcctccctcagctgtcagcgtcgccgtcttcagactgaggccccccaagtccgc

SEQ ID NO: 6795492 - DNA, 83 bp, Homo sapiens
tgatgcagcctctatcaatcagcttgttgggttggctctagctcttttaagcagctcttaacaaagcatggagggaaacatca

SEQ ID NO: 6795493 - DNA, 99 bp, Homo sapiens
aagaaaacgctggaaaatcattgaccaaggaaattaggttattttgctgctcacaccattaagaatctggtttcctggcaggctttcatagtctttctt

SEQ ID NO: 6795494 - DNA, 100 bp, Homo sapiens
accaaaggctcctgagggctgcttccagagctagccaaagcctgtgcctttggggacttggcctggatgcagccttagatgtcgcaggcgcacatgtggt

SEQ ID NO: 6795495 - DNA, 60 bp, Homo sapiens
tgaatcctagttgaagataaggtcaccaacctcccagagcctatcttccactgggactca

SEQ ID NO: 6795496 - DNA, 57 bp, Homo sapiens
atgggtctccagtatctttccaatgaatttgttttgcctaatttagctggagtccat

SEQ ID NO: 6795497 - DNA, 66 bp, Homo sapiens
ggtgatgtggctgtcacttgcttcacgtttctatgcatcttgagaaaaagctggcagaatattgcc

SEQ ID NO: 6795498 - DNA, 73 bp, Homo sapiens
gggagggcaaagacacgggaaacaacgttgtattaaagaggaatcagcgttttgtgtctagtccttgatgccc

SEQ ID NO: 6795499 - DNA, 69 bp, Homo sapiens
gaggtcgggctggctttatggggcttgtggccagcaggactgtgcaaggcccatgctcagaaggacctc

SEQ ID NO: 6795500 - DNA, 68 bp, Homo sapiens
ggttgaggagcaagcatgtgtctccctcccagcatccaatgggtaaggatatgacttgtctgccaacc

SEQ ID NO: 6795501 - DNA, 92 bp, Homo sapiens
tgctaaactgtagtggcacaaatccaagaatcaaagaagtatcctaagcctgtggttctttgggattgtagctgtctgtggtttttacagta

SEQ ID NO: 6795502 - DNA, 129 bp, Homo sapiens
tcttgggtctataaaattggaactgaaatctcatggaaactggctttctccagaaatttttggtgagccagaaatactgtgagagcagcctttcccgtggtgttttggcatttttactttggccccaga

SEQ ID NO: 6795503 - DNA, 65 bp, Homo sapiens
gcctcatgtggaggctgctccaagctggggctcccctagcctgcttggcagccctcccagctagc

SEQ ID NO: 6795504 - DNA, 62 bp, Homo sapiens
agctcagcccgttagtaagcccttgttagtaaagcttggctaccttaccaacgggctggact

SEQ ID NO: 6795505 - DNA, 55 bp, Homo sapiens
tctctctatttcatctcatctgatttctcactttcagtgctcaggaatagagaga

SEQ ID NO: 6795506 - DNA, 55 bp, Homo sapiens
gacagccctggccccaggtggtctcaggaagtgagctgcgggttccaggactgtc

SEQ ID NO: 6795507 - DNA, 130 bp, Homo sapiens
cgcagaggcttggggccaagcggagtttgccctgcgggtcctgcgcaaggccccagtgccccggctaaacctttgccgcaggatcccggagccggcgtccttcaaggagcacagagggccccgtagcacg

SEQ ID NO: 6795508 - DNA, 63 bp, Homo sapiens
gcttctctggcctgcagggcatcagggaccctgctgtcctgatccccatgccgtctagaaagc

SEQ ID NO: 6795509 - DNA, 66 bp, Homo sapiens
gagcggaggcttggaggccagccctgctcctctttctgcctgaactgggcctctcaagcctccctt

SEQ ID NO: 6795510 - DNA, 55 bp, Homo sapiens
cagtaaatttgagggatctaattatggggtttcagtagatcctggggatttattg

SEQ ID NO: 6795511 - DNA, 77 bp, Homo sapiens
gaagccaaaggcccttctgaaggcacttgtatgtctgatgatgatatttcctgcctcaaagggatcctgttgccttt

SEQ ID NO: 6795512 - DNA, 65 bp, Homo sapiens
cagagtgatggccagtaattccaaaagcctaaggttttctgaatgatctactctcattatctctg

SEQ ID NO: 6795513 - DNA, 80 bp, Homo sapiens
tgtttagtaaattcctggcatgggcagggcactgggcttctcccaaagactgtaagagtgtgcaggattatttgcagaca

SEQ ID NO: 6795514 - DNA, 64 bp, Homo sapiens
caaaattagtacattgcaaagtccatgcttaaatccagggcccctggcaagagtgctgagcttg

SEQ ID NO: 6795515 - DNA, 87 bp, Homo sapiens
cttttgcttcaattgcttcaactgttcaatgggctaataataatatctgcctcacagaactgttgcaaggattaaatgagctaagag

SEQ ID NO: 6795516 - DNA, 77 bp, Homo sapiens
tttttcaaccccatcggtggtaacatttacagaaattaacttctgtatacgttacaattgagtcaaatcttggaaag

SEQ ID NO: 6795517 - DNA, 57 bp, Homo sapiens
catgaccccccaaggcctgcagatcatgattgaggtgtgcaggggggaactgtcatg

SEQ ID NO: 6795518 - DNA, 115 bp, Homo sapiens
agtgccaggagaggaccggagcatagttagtgcttattaaatagtatcatgataacatgacacatgtaaaacacttagcaatgttcaataaactctggtccctttcctccccact

SEQ ID NO: 6795519 - DNA, 110 bp, Homo sapiens
ggaaatagtcaaggaaaacacaaatagcagcatcagtttatctccatcgatattttaaaggatcggagcaagaaaaatgctgcttttagtggtttgttgcctggtgttcc

SEQ ID NO: 6795520 - DNA, 59 bp, Homo sapiens
acaagagcttatttccctgttttctgtgatcaggtaaatggaaaagtggtgctctgtgt

SEQ ID NO: 6795521 - DNA, 90 bp, Homo sapiens
aggaacacagccatacttacttattcacatattgtcggttgttgctttgaggctgcagtagcagagctgagtagttgtggcaaagaccct

SEQ ID NO: 6795522 - DNA, 86 bp, Homo sapiens
ctccagttccaagagtaaattcaaattgcatatgccagaaattattggcttcagcataggttatggatgttattctggccaaggag

SEQ ID NO: 6795523 - DNA, 60 bp, Homo sapiens
ggacacattttactgactcttgaattagcatgatattgctaaatgagagaaagtaattcc

SEQ ID NO: 6795524 - DNA, 94 bp, Homo sapiens
gtggggagtgtccacccccctgtgatattgttcataatatccagtcccccctcaatattacacacggtatcacggggaagtgtacacaccctac

SEQ ID NO: 6795525 - DNA, 88 bp, Homo sapiens
cagtgtcagaggatgtcttttgagccctgtaccacttttcaccttggagaatacatctcatgtaagagataacattatctgataactg

SEQ ID NO: 6795526 - DNA, 57 bp, Homo sapiens
tgtgaaaagggctttgtacaaacctctcatggggttttataaaagctcttttgtaca

SEQ ID NO: 6795527 - DNA, 56 bp, Homo sapiens
ttattattccccaagtcattatttgaacacctagaatggtgcttggcaaatagtag

SEQ ID NO: 6795528 - DNA, 130 bp, Homo sapiens
cagcaggatgttgttcaaaatatgtttctaaagaacatgagttatgatgatttcacacttgccaaaaagaattataattcctgtttgaaagctactggaagctcaaatgtttctgactgtgtcagatctg

SEQ ID NO: 6795529 - DNA, 103 bp, Homo sapiens
ttgagacggagtctcgctctgtcgcccaggctggagtgcagtggcgggatctcggctcactgcaagctccgcctctggggttcaggccattctcctgcctcag

SEQ ID NO: 6795530 - DNA, 64 bp, Homo sapiens
tcttgcctggcactcctggagctcacaaaaagcctgccacttgtgagcctgtgtgcctggaagg

SEQ ID NO: 6795531 - DNA, 104 bp, Homo sapiens
cctatgacagagaatactctagtagctggatgtaggacacatagaatttgggctttttgatcaaattttaataaatatatttaattaagtaggctttgcatggg

SEQ ID NO: 6795532 - DNA, 56 bp, Homo sapiens
gtattcctgcaaatagcagtgaaatgtttgcaaggcagtgtggttttcaggaatat

SEQ ID NO: 6795533 - DNA, 57 bp, Homo sapiens
tggccactgggcctacccagattggcagacagaaggctgcctttcccccagtggcca

SEQ ID NO: 6795534 - DNA, 65 bp, Homo sapiens
ctagtgcctcagttggaaatgcagaactcacccatcttctgcgttgctcacgctgggagctgtag

SEQ ID NO: 6795535 - DNA, 60 bp, Homo sapiens
gcctcatcagttcccaggcccagacagactctgctgccacctggtggctgaagggtaggc

SEQ ID NO: 6795536 - DNA, 89 bp, Homo sapiens
agcatgggctgaaggcaaacagagacaatgaatgctatggatgtgtagtgttcattcaatctatttgcttcagcctcttgaaacatgct

SEQ ID NO: 6795537 - DNA, 67 bp, Homo sapiens
atcctcatggtagaatccaaagagaatttgacctagtcacaagatctgggttctaatcatgtgtgat

SEQ ID NO: 6795538 - DNA, 74 bp, Homo sapiens
ggacatgttttcaccatgtgggcagtggaggcggtgaacaccactgacagttgtattacatgggaattgtgtcc

SEQ ID NO: 6795539 - DNA, 68 bp, Homo sapiens
agcataatctcatggtggaagagtgccttagcttctagagctgtgttgtctagtaccgaggatgtgct

SEQ ID NO: 6795540 - DNA, 56 bp, Homo sapiens
gggtcagtccagggcgctgggaagccttagctctcgctttctacccccactgatcc

SEQ ID NO: 6795541 - DNA, 67 bp, Homo sapiens
tggaatctgctgttgtgaagattctcactaccaaggatgaggagccactctagcagtcagatctcca

SEQ ID NO: 6795542 - DNA, 62 bp, Homo sapiens
gttctccatttaacttccttatgcagctaccagctcatcgcattaaggaaaagatgcaggat

SEQ ID NO: 6795543 - DNA, 59 bp, Homo sapiens
gccccctgacactggcctgctcggctccagctccgggaagcaggcccaatggagggggc

SEQ ID NO: 6795544 - DNA, 77 bp, Homo sapiens
gttaaggaagagacttttgcgtttgtctggatttttcaagtaattactcaggaaataacgcaacattcttccctaac

SEQ ID NO: 6795545 - DNA, 75 bp, Homo sapiens
tagccacataagaccaaagttctgtagggatgagtttgagaactgttccttacctcaagcttgtggtcatagcta

SEQ ID NO: 6795546 - DNA, 66 bp, Homo sapiens
gttcctgttcttgttgactgggggaaggaatgagaccccttgtccctcagagggcaagcgcagagc

SEQ ID NO: 6795547 - DNA, 68 bp, Homo sapiens
catgtgttgttgtgagtttagagatttcatagtgaataatgagaggattttaacttatgcaacaaatg

SEQ ID NO: 6795548 - DNA, 56 bp, Homo sapiens
tatgtactgtttctgtggtggtcttagatgatacagccaagaacaagacagacatg

SEQ ID NO: 6795549 - DNA, 57 bp, Homo sapiens
ctaaactagcagttctgcaacaacacgaaatgctggggtgcgggatgggcagtttgg

SEQ ID NO: 6795550 - DNA, 77 bp, Homo sapiens
gggaaaggggatggtgtcgggaggaaagagagtatgtggggcctccacatccctcctctggaacctcacccttgccc

SEQ ID NO: 6795551 - DNA, 65 bp, Homo sapiens
ctctgtgccacatgggctctgtgaagctatcagctggtcttcactggggagatgtggcagaagag

SEQ ID NO: 6795552 - DNA, 83 bp, Homo sapiens
gatagcagattatttgctttggtcctccaagcataggctgtgttgaggctggaaggaacaaggatcagaaacaagctgctgtt

SEQ ID NO: 6795553 - DNA, 72 bp, Homo sapiens
agtctctgcctctcagagtggctgtgggaattaaattcagaaatgccagcctgcctgtgaggctttgagact

SEQ ID NO: 6795554 - DNA, 63 bp, Homo sapiens
gggatcagcagacacagatatgcatatggcttttggagccctgtgtgatctgctgttagcccc

SEQ ID NO: 6795555 - DNA, 64 bp, Homo sapiens
gcagctgttgaatgccctgtgctgggttggggacacatcattgcttccagggctcagtcactgc

SEQ ID NO: 6795556 - DNA, 58 bp, Homo sapiens
ttttcttggctactgtgagattccagaggagggagattactttggatggtcaagaaag

SEQ ID NO: 6795557 - DNA, 76 bp, Homo sapiens
ggcctgtgggttggagcttggccagagttagtctgtgcttcttggactatcctgggctgttccgcttgggcagacc

SEQ ID NO: 6795558 - DNA, 56 bp, Homo sapiens
cctgggacctcgcgggaagcgggactgggaaagggtatccgccgggaggtcccagg

SEQ ID NO: 6795559 - DNA, 81 bp, Homo sapiens
tccatgtagccaaactcagttttctgtggcctcaggactttcctgaattgggcctggaaactggtaaccaagcaacctgga

SEQ ID NO: 6795560 - DNA, 116 bp, Homo sapiens
gtgtggcagccaagttcaactctactgggcatgcctgtttgagaatagtcaggggcacccaaggtccctctgctatttctagataacaagaacagaagagcagcctgatgccatac

SEQ ID NO: 6795561 - DNA, 88 bp, Homo sapiens
gggatttcattgtgggaattagagtgtgtactactcatttatggatgacagtaatacacactctcattcctaaaagtgaaaatgtctc

SEQ ID NO: 6795562 - DNA, 113 bp, Homo sapiens
ggagcctgtccaggaggaaggggccagggctgcggtgcggggagccctgtctgaggagggtttcccaaagccagggatccctgccctcagcctggacactcggggtgggctct

SEQ ID NO: 6795563 - DNA, 106 bp, Homo sapiens
ccagtcacagcatgcattttctgagtttatttccccttagagaatctcaaggaaatttatactttgaaagggaaataaactccttggagaaatggttgattctagg

SEQ ID NO: 6795564 - DNA, 61 bp, Homo sapiens
gtggtgtgattcggatgagggtcctgagaactggatccgtaattttcattgaagacagtac

SEQ ID NO: 6795565 - DNA, 58 bp, Homo sapiens
tagtctggttttattgaggacattctcaagctaaagaatttcaaaaggaagccagcta

SEQ ID NO: 6795566 - DNA, 78 bp, Homo sapiens
accagaggagtttcaagcagatggcctgaggggctcctgtattcacagtttgaggttatctcttggataggccctggt

SEQ ID NO: 6795567 - DNA, 69 bp, Homo sapiens
tatgagagggccagtaaatgtttcctcaggacacttcttagaggacaaagtctgtgcctgtccctcatg

SEQ ID NO: 6795568 - DNA, 83 bp, Homo sapiens
gaggaggacgtgaactgatgggaatttccactatctgggtttaaatcctggctggaatttctcactctttccatttccatttc

SEQ ID NO: 6795569 - DNA, 99 bp, Homo sapiens
ttatttctgtttcactgttgtttttcttaaagtatattttaacttcagaattctattttgacagtttattttgcagaatgctgtgtggctcggaaatga

SEQ ID NO: 6795570 - DNA, 130 bp, Homo sapiens
tttcttcatttccctgacctgtgggtacttgagggtggccggggagtggtgtgtggggagggagatggctgtccttcttcatgaatgaatctttgacctccttagtttactctcacttccaaagaagtta

SEQ ID NO: 6795571 - DNA, 96 bp, Homo sapiens
gctttcagaaataagcctttctttgaaaatcagagaatatatttagaagattatattgttttcctttgaggatcaaggaagtttttccctgtaggc

SEQ ID NO: 6795572 - DNA, 63 bp, Homo sapiens
ttgacattattatcatgtcaccaccctgttgcccaggctggagtgcaatagtaataaggtcaa

SEQ ID NO: 6795573 - DNA, 55 bp, Homo sapiens
caagaaggctatatgggccagggcttcagtgattcatgatgtccaagccttcttg

SEQ ID NO: 6795574 - DNA, 68 bp, Homo sapiens
acatccaagccaggaagcaagtgattttcttggcaataagtcaagaactggctcctggctactagtgt

SEQ ID NO: 6795575 - DNA, 81 bp, Homo sapiens
gccctacactaaaggtaatttacagacttgcagttatgaggattcacactctgcgggtgacctttactgtcttatgggagt

SEQ ID NO: 6795576 - DNA, 66 bp, Homo sapiens
accacttaggaaacatttgaagaggattatgtgtcctagtagtcttctgaaaaatcttcctttggt

SEQ ID NO: 6795577 - DNA, 63 bp, Homo sapiens
tttgtagtaagggttttgagagagcgttccggacttaatctcttcagcagcctcttgcataaa

SEQ ID NO: 6795578 - DNA, 80 bp, Homo sapiens
tctggtgaccagtaaaatggactgtggcagagatgggctagatgcccactaattccatctccttttcctggccacataga

SEQ ID NO: 6795579 - DNA, 62 bp, Homo sapiens
tctgtcatctctaaaatagaaatgttatagtatccatttctaacggtcatagagatgattga

SEQ ID NO: 6795580 - DNA, 58 bp, Homo sapiens
ccccttttcgcttggcctcatctgcctttactgagatgattttggtcacccggagggg

SEQ ID NO: 6795581 - DNA, 80 bp, Homo sapiens
caccgtttataacagcatgttcatggaaaatggtttctaaatctcagacacccatttcataaacatgcttttgaaatgtg

SEQ ID NO: 6795582 - DNA, 80 bp, Homo sapiens
gcagccatcttgaaattatgcagggaaggcccaccagcctctgagatggctgcttcctttcctgctgacctcctgactgc

SEQ ID NO: 6795583 - DNA, 80 bp, Homo sapiens
gtagccctagtatatatttatagaacggttctgtgcaaatctatttcaggattacacagaaattttattgcctgggctat

SEQ ID NO: 6795584 - DNA, 68 bp, Homo sapiens
tttcaaagtttcctagatcagtgttcttaatgttgccacacatttgaatcacctgggaagctctgaaa

SEQ ID NO: 6795585 - DNA, 116 bp, Homo sapiens
tgaaaagaaacaatgtgaaggaaggaaagaagggagggaggaccaatgtgtggttatgaacatagagcaaagggatttttctaccttttagatctatccaacatactttcttttta

SEQ ID NO: 6795586 - DNA, 83 bp, Homo sapiens
gcaggtcgcggggctgtggagccgcgagggctgacggcgctcgccgcaagtttgcagagcggcccccgcagcgcagcggcagc

SEQ ID NO: 6795587 - DNA, 66 bp, Homo sapiens
gcatgttctctcagacatccaaagtcttttgctgatagtctgagactttgagctcttagagaaggc

SEQ ID NO: 6795588 - DNA, 61 bp, Homo sapiens
tttgaactgttctaggatttaaaactgtacttcagcaattatgatccagcaacagtttaga

SEQ ID NO: 6795589 - DNA, 58 bp, Homo sapiens
gagggtccccatgcagagctcaggagaagaagctggaaaggtgcatgtcgggactttc

SEQ ID NO: 6795590 - DNA, 60 bp, Homo sapiens
tttgaggaacatctgctagatatgtcattccagtggcattttacaggtcagttccttgaa

SEQ ID NO: 6795591 - DNA, 60 bp, Homo sapiens
actgagactaaccgaggaggttatggttactcttctgcctgctccttccctggtttctgt

SEQ ID NO: 6795592 - DNA, 74 bp, Homo sapiens
gtgtgctcagtgggccttgcagggtgcagggggctctggtgcgcctctgcatcccagcaggctccggagctcgc

SEQ ID NO: 6795593 - DNA, 80 bp, Homo sapiens
agattttgttggttgtgttggggattagtacacagacatttcagtttgtgtgcaattcttaacatacatactgaaaatct

SEQ ID NO: 6795594 - DNA, 99 bp, Homo sapiens
gagtgctgagaagaatcaggagtaagttataagtatttatttttaaacaagttatataaatatttgcaagcatttttccggttcctttgatagtgactt

SEQ ID NO: 6795595 - DNA, 59 bp, Homo sapiens
gcgaggaggaaacgcggagaactcaggccacttctcctgggtcccacgtcccctcccgt

SEQ ID NO: 6795596 - DNA, 88 bp, Homo sapiens
ggctgactcttagaaatggcagctctcctgtttacctgtaatcatttcagttggaattacaaagcaggtcagctgaaaagagtcagcc

SEQ ID NO: 6795597 - DNA, 65 bp, Homo sapiens
tggaaagaactcagccagaagcttcagagtcactctcatggcttgtcatgttgatgttctttcta

SEQ ID NO: 6795598 - DNA, 56 bp, Homo sapiens
ctcagcagagcgagaccaagtcatgccttgtatggaaatttctttcttctgttgag

SEQ ID NO: 6795599 - DNA, 98 bp, Homo sapiens
gcattcttcctcagcagcagaaccagaaaggaataatagaattggccaaaaaatcatttttttaaagttgcctttctcttcctgtagagagaaaatgt

SEQ ID NO: 6795600 - DNA, 57 bp, Homo sapiens
gggctacagagatgcatcttcagcaactggaatagatgaaagtgtctcttaaagccc

SEQ ID NO: 6795601 - DNA, 129 bp, Homo sapiens
ggcagctcaattccatgacaagagcaatggggcttggaattgagaaactacagcttacctctatcaagttacttaaaaattctaagccccagttcctatttttgtaaactaaggacaacaagagctacc

SEQ ID NO: 6795602 - DNA, 76 bp, Homo sapiens
agagtgctattatgatggctcccattcaactataggcttccttcagacagtcttaatggataggagctcgcactct

SEQ ID NO: 6795603 - DNA, 86 bp, Homo sapiens
cctggtctcccctgacccttccacggggctccccgctcttctgcccccagaagccagcagacagccctgcggacgaggaggccagg

SEQ ID NO: 6795604 - DNA, 61 bp, Homo sapiens
gaggtatgtgttgtttttggattatccatcaatgtggataatcaagagctgactatatttt

SEQ ID NO: 6795605 - DNA, 56 bp, Homo sapiens
tgctggcaaaggcgctcacatgcctgcagaccgcaggtgaagggcctttggtggca

SEQ ID NO: 6795606 - DNA, 77 bp, Homo sapiens
ttgttcacctgaaatgatgactggagtatgtacccacaggcttggcagctatcatttgagggtttcctcatgaatga

SEQ ID NO: 6795607 - DNA, 63 bp, Homo sapiens
atgggttaacacatgcaattgcactttgcaaattctgaagtgacatacaaatgtgttgttcat

SEQ ID NO: 6795608 - DNA, 77 bp, Homo sapiens
atccctcagctttggagggcaagagctgttcctagactatgggcaaggggcaggggtgcatccagagaagcaggggt

SEQ ID NO: 6795609 - DNA, 70 bp, Homo sapiens
ccagcagccaccttctcgaaatcctcagggttgcagaattccttgattgtgaccgtcaggaggttgctgg

SEQ ID NO: 6795610 - DNA, 114 bp, Homo sapiens
tagattgttcagtgctgtggatctgttggttttttgtaaggaggtaaattaggagaggattttactttttcccatatagaaagccaactgccccacctcactgatggagatgta

SEQ ID NO: 6795611 - DNA, 87 bp, Homo sapiens
ggcatttatgatgcattgaggatgacatgagtaaaatgaaaacttagagcactcaccagggtcattctttcatggacatctgatgcc

SEQ ID NO: 6795612 - DNA, 63 bp, Homo sapiens
gttattgctgggccacaaaaaactcctgtgctcataagcacaagcatcaggttcagcaataac

SEQ ID NO: 6795613 - DNA, 63 bp, Homo sapiens
aggctggtggagagtgggctctggagtcagccttccagttttgaatcctgcttctaccaactt

SEQ ID NO: 6795614 - DNA, 60 bp, Homo sapiens
gttcagcagcagtgattttgtggctaacacattcttctattttcatcattgctgctgggc

SEQ ID NO: 6795615 - DNA, 85 bp, Homo sapiens
acctatctgtgcacctgagtcctgatgctctggcaggagaaaaccccattttatctgtctttatcaggatttagcagaggaaggt

SEQ ID NO: 6795616 - DNA, 87 bp, Homo sapiens
ttggagatagctgaaagaaagtttagattaagtttatctctcaaggcaattttattagatagattaagtttctgttcatatctctga

SEQ ID NO: 6795617 - DNA, 79 bp, Homo sapiens
tctgaagtgcttgggcggcccctcaggtagtcttggggagcctcaagacgcttcctgccgccgcacaggcagcaacaga

SEQ ID NO: 6795618 - DNA, 92 bp, Homo sapiens
tccatagaaccttgaagcagctttctggtgaggaggtgagctacttcctgcaaaactactagtagctgctattgattaatgtattcttccaa

SEQ ID NO: 6795619 - DNA, 57 bp, Homo sapiens
ggttattgttacctttgtgtcagatttgttacttccttaacaaaggtctgcaagacc

SEQ ID NO: 6795620 - DNA, 79 bp, Homo sapiens
agaatattcatctgtattcttatccccattttcgtacttactttacccgactgctgggagtagaagcaggtaaaattct

SEQ ID NO: 6795621 - DNA, 86 bp, Homo sapiens
gttttatatgttttggaataactttcacatcacactgactaaagtatggtagcttctagttgtgaaatctagtcaatgtgtaaaac

SEQ ID NO: 6795622 - DNA, 71 bp, Homo sapiens
gtggccagttacagagccagttagagaaactgcccagtttcctcttgaattggtatctttgactaggctgc

SEQ ID NO: 6795623 - DNA, 64 bp, Homo sapiens
attgtcagaggtggcattgggcaacgcaacttcagagttccttgtcctgccgatctctgagaat

SEQ ID NO: 6795624 - DNA, 74 bp, Homo sapiens
cttgggcgtccctgcaatcacacgtggctaggtcgcacagggtgctgtttggtgaccccagtgtgtgcctcaag

SEQ ID NO: 6795625 - DNA, 72 bp, Homo sapiens
cccaggggggccaaagctggggaggggcagggccagcacgaggtggctcccacccagctttgaagatctggg

SEQ ID NO: 6795626 - DNA, 89 bp, Homo sapiens
aagtgtcagatttgataaagtagatttgttctagaagaaaacactccctttctattttctagtatacatctgtttgccagagtgcattt

SEQ ID NO: 6795627 - DNA, 94 bp, Homo sapiens
ctgtggttattgggttgggtgattttgattctgttcaacaactggatgctttgagtaatgaacttcagtgcataattatccagcgaaatcatag

SEQ ID NO: 6795628 - DNA, 77 bp, Homo sapiens
ggttttaaggcgtgtggtttttgctgttgttgttttttcaattagcagcattaattccatttgcaaccttaattgcc

SEQ ID NO: 6795629 - DNA, 60 bp, Homo sapiens
gaggtggcactgtgaggagcacgctggggtgacacctccatggtcctcacatgccatctt

SEQ ID NO: 6795630 - DNA, 65 bp, Homo sapiens
caggaacaatgtaagtctcattagatttgtgctgaatatactaatgaggcattgcattgattctg

SEQ ID NO: 6795631 - DNA, 66 bp, Homo sapiens
gagcaacttagctctttctgtgccataggtcaacacctctggcagtttgagaaaggctataaactc

SEQ ID NO: 6795632 - DNA, 85 bp, Homo sapiens
cttcaagtcaacagtgatgtctgtggctcggatgaagatggacaggccatgctcagagaattctcagatgactcaagacttgaag

SEQ ID NO: 6795633 - DNA, 74 bp, Homo sapiens
gagcagtgttgctagggcttctaatgacccccaggagtgctgaggtacaagaaaggcacctgcaaggactgctc

SEQ ID NO: 6795634 - DNA, 130 bp, Homo sapiens
ccctcccatggtgagggtggggggtgctccaggcctgccctggctggggccccttcctaggtgaaccccaggaatgtgtgtccaccggggaatgtgtggaggagcctctctctgctcaaaatgggtgggg

SEQ ID NO: 6795635 - DNA, 56 bp, Homo sapiens
ctcacagtctctccctaatttttaatacaaaagatggagatggggaagagtgtgag

SEQ ID NO: 6795636 - DNA, 101 bp, Homo sapiens
agcttcaagtttatttctctcttattccagaaggctggcagattgagattagaatctctcatccaattttagtttctgaggagcaactgatttgccaagct

SEQ ID NO: 6795637 - DNA, 84 bp, Homo sapiens
ttagccttccgctacactggccttcatttgtatgggatccttctttttatgcagcctcagtatcagaacgagccaggaggttaa

SEQ ID NO: 6795638 - DNA, 72 bp, Homo sapiens
ggatggaggaccccagcagctccccagccggctgtcagctcgctatggaggagggctggtgtctgtatttcc

SEQ ID NO: 6795639 - DNA, 73 bp, Homo sapiens
agtttcagacatagatctgtgattcattctgagttaatttttgcaaaggatgtaaggtctatgtctagattct

SEQ ID NO: 6795640 - DNA, 65 bp, Homo sapiens
ccttaatttctgtccttcagatagctggtacacagcactctaatttaaagggacagcagtttagg

SEQ ID NO: 6795641 - DNA, 58 bp, Homo sapiens
gcgtctttggatcccaactggctgggaaaaggggcccatcgggaggaaccaaagaggc

SEQ ID NO: 6795642 - DNA, 65 bp, Homo sapiens
gaggttgatagatcccttcaaagttctaatctctggttttgaaacttgaagaggatatatcgctc

SEQ ID NO: 6795643 - DNA, 60 bp, Homo sapiens
aactctgcctttctcactcaggcttttcttggttgacaggtttgtctcagaggcagagtt

SEQ ID NO: 6795644 - DNA, 66 bp, Homo sapiens
ctgaaaacagaaagatgatttgaaatggcttcaagcaagtgcattcaaatttcttcctggttttag

SEQ ID NO: 6795645 - DNA, 66 bp, Homo sapiens
tcgaggagttgcagagccagtatgggtaactattctaaaatccttaaatcgctcctgggccctcga

SEQ ID NO: 6795646 - DNA, 63 bp, Homo sapiens
catctaagttttctggaataacttggagcattttgtgcttttgttattacatgaaacttcttg

SEQ ID NO: 6795647 - DNA, 75 bp, Homo sapiens
ccgcgccccccgccgccccgatccgggccggcatgatgtgcctggaatgcgcctcggcggcggcgggcggcgcgg

SEQ ID NO: 6795648 - DNA, 74 bp, Homo sapiens
ctcccgtcgggctggagagtcccacgtggggcacagaggagaggaggtgcccggggctctgcatgccatgagag

SEQ ID NO: 6795649 - DNA, 56 bp, Homo sapiens
gtttgcactagcatttgtccatgtggttcttttacacataagagtgatgtgcagat

SEQ ID NO: 6795650 - DNA, 71 bp, Homo sapiens
tcactgttttgcctgcacttcctgggttttctatacttagctccgggcttcagttttaggtaacgcactga

SEQ ID NO: 6795651 - DNA, 80 bp, Homo sapiens
tccaccactttaaacattttgggagaaagttgttactttggcttgatggcagctcatttggaaatggagtactgtttgga

SEQ ID NO: 6795652 - DNA, 76 bp, Homo sapiens
gccagggccagcaggttgtcaaggagctgagctgccccaggtgtctggtggggctcctgggcagctgctccctggc

SEQ ID NO: 6795653 - DNA, 80 bp, Homo sapiens
acacgtgggcttccgaagccgtgacactactttgattctcactgcagagcactgcgccggctcggaaggatgccctgtgt

SEQ ID NO: 6795654 - DNA, 80 bp, Homo sapiens
actgttgagtgtgagtactatgcaaaggtgagagccatttgtttctatctttggtgcttggtgctcccacccacctcagt

SEQ ID NO: 6795655 - DNA, 92 bp, Homo sapiens
gagaatagtaaaaacaagcaatttaacaatttgtgtccatttagtgaattagttgagtgactttagttgaatcttgttttcgtgctattttc

SEQ ID NO: 6795656 - DNA, 69 bp, Homo sapiens
gtctggaattattttcctgctgatatttggtgaagtgtatccaatatatcacatggaatgattttagac

SEQ ID NO: 6795657 - DNA, 61 bp, Homo sapiens
gcccatggggtgtgattgtgatgcatttctaaaatctgagatttaatgttatattctgggc

SEQ ID NO: 6795658 - DNA, 59 bp, Homo sapiens
ggactttagctgtaatgtgtgtgtgttccattatctcacacatcactgcactgaattcc

SEQ ID NO: 6795659 - DNA, 77 bp, Homo sapiens
ggacgctccgtcagtgggggttctgcagcggggtcactgccaagaacagctgcaaagccaccctggcggtggcattc

SEQ ID NO: 6795660 - DNA, 56 bp, Homo sapiens
tctgcgccgcatgtgttctttcagggtctcaggccaaaaggacatttgttgccagg

SEQ ID NO: 6795661 - DNA, 83 bp, Homo sapiens
tcccagaatcccttagcaggtattctctttggtcccattggccacgaatgggtcacctgctctagacacaggggaagctggga

SEQ ID NO: 6795662 - DNA, 129 bp, Homo sapiens
ttcatctattcatttattcccattgatttcctcactaacatccatccagtcaggcttagaaagcagcaggtgggttggtgacagagaccagtgggctgagtgtaaccgtgaaagtcagtaggtgacaag

SEQ ID NO: 6795663 - DNA, 71 bp, Homo sapiens
cccagcatctgggagcagctcagcagattgatcgagcgcagtctctctggttctccccggatgcccttggg

SEQ ID NO: 6795664 - DNA, 82 bp, Homo sapiens
ctagaagttaacatgtgtaggtatacaaaattcttagagaattatgtaggtatctatataatggttaattatgaaaatttag

SEQ ID NO: 6795665 - DNA, 58 bp, Homo sapiens
agcacatgtattctccttgaattattgtttcaggcaaaacaggaagaatacaatggct

SEQ ID NO: 6795666 - DNA, 86 bp, Homo sapiens
gcgcttggctgggtggtggtagtagtagtagtaattgttattctttatttattattattgttgcggctgttaccgttgtcattcgc

SEQ ID NO: 6795667 - DNA, 65 bp, Homo sapiens
gattagggagggtgggcattgcaagaggtatgaaagaggccggcaattagacattcttcccggtc

SEQ ID NO: 6795668 - DNA, 68 bp, Homo sapiens
tgtcaagaacttgggagaacctgattctgtcatctagaatatttgctaacagtcccaaattcttgtca

SEQ ID NO: 6795669 - DNA, 67 bp, Homo sapiens
ctgtggtctgacatcacctgagaacttgttacgacacagactctcaggtctcatgccaggcctacag

SEQ ID NO: 6795670 - DNA, 78 bp, Homo sapiens
tgagtgccagaggcagtgaggagttgttcctctgcaagacctcccagttccccagccccccactgccatctgggacca

SEQ ID NO: 6795671 - DNA, 57 bp, Homo sapiens
tccccatgaggctgaattgggcctaagaatggatccagggttgggctgttatgggga

SEQ ID NO: 6795672 - DNA, 90 bp, Homo sapiens
tgaacagggcaccttgccatttgcagtatatggaaaattgaagaaatacagtctacttccgcaaaaggcacatacaaagggctctgttta

SEQ ID NO: 6795673 - DNA, 67 bp, Homo sapiens
tcccctctccctccctgccctgcttgtcagcctgggagtcagacagcttgcagggaggtgggcggga

SEQ ID NO: 6795674 - DNA, 55 bp, Homo sapiens
tacttgctgttagtattttacagctatacttgctgtaagtattttacagcaagtg

SEQ ID NO: 6795675 - DNA, 120 bp, Homo sapiens
tgctgtgggcctcgcagaccatgtgaagggcttaggattttgctgtgcctgtgataggaagccactgggggatcttgagcaacttccaattccagcgtctctctgggaggtccagctgca

SEQ ID NO: 6795676 - DNA, 127 bp, Homo sapiens
gttcctgggccaaagctgaacaaaagtttccaagttacaccattaacttttctcaagtcagagcctgtacatagtgaagtgacactgctgagatttaagttcaggactatatgcttcatcccaatgc

SEQ ID NO: 6795677 - DNA, 55 bp, Homo sapiens
ggatgagcggcgttgcaaagccaggctctggcgtgcgtcctgcaactggctctcc

SEQ ID NO: 6795678 - DNA, 61 bp, Homo sapiens
taggcactcatcaaatagacactgagcacttgttttgtgccaggtattctgataggcactg

SEQ ID NO: 6795679 - DNA, 62 bp, Homo sapiens
tgagagtggcatccctttaacagggtagagtccctctggctttgaatggctgccacttatca

SEQ ID NO: 6795680 - DNA, 79 bp, Homo sapiens
tgagtccaaattctgttgagtagatgacttggagagatcaatttattccaggtagatttattccagccaggtattctca

SEQ ID NO: 6795681 - DNA, 63 bp, Homo sapiens
gcgtgaggcccacattctttagccaaagccacttgaatatgaagggacagtgggacccacagc

SEQ ID NO: 6795682 - DNA, 130 bp, Homo sapiens
ctctccaaagggaataagagggctgcttggaccagaagcttctacacaggagaacccagaagcaaaacaaataaagaatgtggtccctgctaagagtcttttggcatccatcagcctactgtcttgagag

SEQ ID NO: 6795683 - DNA, 60 bp, Homo sapiens
gtccatcttattacagagctttctacaaacttatgaagaaggtagtataaaagatgtggc

SEQ ID NO: 6795684 - DNA, 67 bp, Homo sapiens
atatatgattgcattatttgcatgtgcctgtatatatatgcatgcatctagatatgcagacatgtat

SEQ ID NO: 6795685 - DNA, 77 bp, Homo sapiens
gctgggtccagccatgtcctggtcctccaccatgggcccagccctgggactcggccaggacagatggcccacttagc

SEQ ID NO: 6795686 - DNA, 58 bp, Homo sapiens
ttttggcactttgtctgattctcttccttcatcctgaaagttagcacacgtgtcaaaa

SEQ ID NO: 6795687 - DNA, 55 bp, Homo sapiens
caaggggtggggaacaaataattggaaacaataatacagtttaccacactccttg

SEQ ID NO: 6795688 - DNA, 55 bp, Homo sapiens
ctggcagtctgcctcttcaccatagctggctgcaagtttagaggagagttgctgg

SEQ ID NO: 6795689 - DNA, 86 bp, Homo sapiens
tttgttttcaaattcagaaagtgaatcttgttattttggttttagaatagcagtattatgagataacttactgcctttgaatcaaa

SEQ ID NO: 6795690 - DNA, 77 bp, Homo sapiens
ccctagagtgtgtgtctccactgtgctatttttcagaagaatatgaggaacagtactcggaggccagacttgtgggg

SEQ ID NO: 6795691 - DNA, 75 bp, Homo sapiens
cagcacgatatttatgttgatgttcacggcgtgcatactcagatgcggccaggaagggaagatcagcatgggctg

SEQ ID NO: 6795692 - DNA, 70 bp, Homo sapiens
caggaatgtacaaagttaaacctatatacacaccaggtgtatgcggtcaggggtacgctttgtttacctg

SEQ ID NO: 6795693 - DNA, 73 bp, Homo sapiens
acatcttggttaatcactttgcactcttatttgatcttcatgacaattatctaagtaagtgacagccaagtgt

SEQ ID NO: 6795694 - DNA, 87 bp, Homo sapiens
agcacttatagaagactgaactcttgtagtccatgtttttcactttacatgtgaggaaactgggcctcaggttagttatttggtgtt

SEQ ID NO: 6795695 - DNA, 130 bp, Homo sapiens
gcctcacgataacgcactcaccgcagcgttctggaactttcaagctcgcccccgctctccggacggccccggggaaagggagggtggggcgcagcgagtccgcgcgcgggagtcctcagttaccccgggc

SEQ ID NO: 6795696 - DNA, 70 bp, Homo sapiens
tggtgttacctattgactgagttgctcgtgttctcttcccctcggcctctctcttcagtagcgtagccca

SEQ ID NO: 6795697 - DNA, 117 bp, Homo sapiens
tcccgaaataactgataattggccattttatgtaactgtttagtaaattgaaatggagatatgttgagatccatgatggctgctggtaaaataggttttggaagcttgtttctagga

SEQ ID NO: 6795698 - DNA, 61 bp, Homo sapiens
tgcgcttttctgacatgggcaagagacttctatttcttagcacatatcagaaaatagtgta

SEQ ID NO: 6795699 - DNA, 64 bp, Homo sapiens
cagtcattcatttttgcattgtctgtggccactttcacactacaacagcagaggtgagcagctg

SEQ ID NO: 6795700 - DNA, 78 bp, Homo sapiens
tcaagaaaatgacgccaaccttccccaggtgctcctcaatcactgtgttgtctgtcagagggatggtcttattcttga

SEQ ID NO: 6795701 - DNA, 57 bp, Homo sapiens
aactatgataccaatccagcttgcccacttgcttgctgggtaatttttggcatggtt

SEQ ID NO: 6795702 - DNA, 106 bp, Homo sapiens
tttggattgtggggtgtgtgtgggagggtgtgtgtgcgtgcacgcgagagtgatggtaaatccatataccttcaaaggcaaatccgcacatctttatagtgccaga

SEQ ID NO: 6795703 - DNA, 72 bp, Homo sapiens
ggtcacaggctccacggtcactggctctgtgagaacacttgctccagagccttgcctggggccctgtgtgcc

SEQ ID NO: 6795704 - DNA, 59 bp, Homo sapiens
gtctcctccagtcctccaaggacaaattgaggagttatttgctctgggggtggagagac

SEQ ID NO: 6795705 - DNA, 71 bp, Homo sapiens
cacttactttgatactgtgaagcctaacttatacatttttatagaaggcagatcagtacagggttaagatg

SEQ ID NO: 6795706 - DNA, 89 bp, Homo sapiens
gaaagggagtgacagagttgttgatgtatgctttgtagttatcactttacgacagttaccaaacagcagcagctttttagctagttttc

SEQ ID NO: 6795707 - DNA, 59 bp, Homo sapiens
ctgtgggtttgggtggtggaagtagcaacgtaaaccttgctatcctagaccatacacag

SEQ ID NO: 6795708 - DNA, 68 bp, Homo sapiens
ttaggcaaactgattattggtgacaaggctgatatggcagcaatagcactgaaaattagctttcctga

SEQ ID NO: 6795709 - DNA, 63 bp, Homo sapiens
gtagaatatgtaaggtgtcctttgaaagacagcattaggaccaaaccaaccatacaattctat

SEQ ID NO: 6795710 - DNA, 68 bp, Homo sapiens
tttcagaaaaagggatttgtgatccaggtctctcatttatcttacagatctggtgccccttcctgaga

SEQ ID NO: 6795711 - DNA, 72 bp, Homo sapiens
ttgggtttccaagagagttgtagttcaagcaagcaggcaggcagtagaattacatagtttctaggttcttaa

SEQ ID NO: 6795712 - DNA, 96 bp, Homo sapiens
cacttacatgttcaggagagcttcttccaaggacgcaccttgtgtatccaaggcttatgtgcattcttggaagaagctctcccaaacatgtaagtg

SEQ ID NO: 6795713 - DNA, 83 bp, Homo sapiens
gaggattgtggttttgtgcatgccctaagatatttatatgcctgtattatgtttctgtggctgctatagattataaattcctc

SEQ ID NO: 6795714 - DNA, 71 bp, Homo sapiens
gtcagctgcacaggtgggagctgagcaggtggctgtgcctgaagaatgacaatctcccccttgcagttgac

SEQ ID NO: 6795715 - DNA, 69 bp, Homo sapiens
tccagggaagaggcaggcggctccctcacttccccttggaaggcagcatgaatccctgtacttcctgga

SEQ ID NO: 6795716 - DNA, 78 bp, Homo sapiens
tctcctgacaatttcctgcctgactctagtctcttgagcatgaggagctcttagatagggcaggaacctgtcagggga

SEQ ID NO: 6795717 - DNA, 101 bp, Homo sapiens
tttgggaatggggaagcagtctcattgaggaaaggtagtggcttctctagtcagttctccatatgaagtcatttgtctcagtgatttctccattacccaga

SEQ ID NO: 6795718 - DNA, 72 bp, Homo sapiens
gactatgctgggcagaattttaggatggcccccacatgtggtagccccttggtgttcctgcagtgtatcgtc

SEQ ID NO: 6795719 - DNA, 81 bp, Homo sapiens
ggagggggtgaggtggaggaatgactaactgttaggattgaataacaacggagttccctccacaacttctcacacacttcc

SEQ ID NO: 6795720 - DNA, 72 bp, Homo sapiens
ccatagctccatcttgtctacaagattttgttagaagccgtcaaaatcctgctgactcgagatgcgctgtgg

SEQ ID NO: 6795721 - DNA, 111 bp, Homo sapiens
tctttttgttgggttgatttcccaagtaccctgaagtacacagaattctacttgttgtcaatcaattgagtactttctgagtgccagactgaggtccccactgcaaggaga

SEQ ID NO: 6795722 - DNA, 73 bp, Homo sapiens
gcagaaataaagtcatctaggagcagattttctgcattctgcaaaatcacttaaatggcttattttcgtatgc

SEQ ID NO: 6795723 - DNA, 119 bp, Homo sapiens
aggcttagcatttttatttcatcttctgtttctctgtccttggtttttttaaaaaatgtatagaacactaaatatagacagatgacagggatacagaaaggaagaatttaatgtagttt

SEQ ID NO: 6795724 - DNA, 84 bp, Homo sapiens
gcgatggcagctcaaaggccacggacggctccgggttggacttcaccacgcacaggcactgcaccgtgtctcgggctgccgcgc

SEQ ID NO: 6795725 - DNA, 56 bp, Homo sapiens
tcctttctcccaggttagttgtcaacctgctggagctcaaccctgcagagaaagga

SEQ ID NO: 6795726 - DNA, 95 bp, Homo sapiens
tcagggtgtcagcagggcacgatcctcctggaggctctaagggagagtccaagccttcgtctttctggcttctggaggctgcctgtgttccttga

SEQ ID NO: 6795727 - DNA, 69 bp, Homo sapiens
cgggagagggtgggtacaccagccctcaggcccaggtgcggcactgtgggcggctttcagcctttcccg

SEQ ID NO: 6795728 - DNA, 61 bp, Homo sapiens
gggatccttggctgcaggccaagtttgcctagactcccttggcactgagccagatggactc

SEQ ID NO: 6795729 - DNA, 80 bp, Homo sapiens
gactggatttatagatatcataataattatctagatgtacatagatgtatagaactgtgatctctataggattcaatgtt

SEQ ID NO: 6795730 - DNA, 68 bp, Homo sapiens
gaaggggtgtcttggaaagttatcattttcctgtactcagctagaatgttccttttcattttcccttt

SEQ ID NO: 6795731 - DNA, 58 bp, Homo sapiens
agtggctgctggagtggagatgggaatgggtaggactttagccgctccagtagccatt

SEQ ID NO: 6795732 - DNA, 56 bp, Homo sapiens
aacagttggaagggcctggatctttagctctgggtctttggactttccaatttgtt

SEQ ID NO: 6795733 - DNA, 76 bp, Homo sapiens
tgaaattgctgggtcggagggtaagcagattttgcattttgtcacatattgtaaactgcttctcaccaaggtttta

SEQ ID NO: 6795734 - DNA, 85 bp, Homo sapiens
gcctcacactgacttccaggaacagcagagggacttggacgcctctccaggcaggcaggcctgttcctggaaagccaggtggggt

SEQ ID NO: 6795735 - DNA, 69 bp, Homo sapiens
ttaggtcaaggccagcgcagaccattgtccatcagcccagagagagatggtctaattggcccatcctgg

SEQ ID NO: 6795736 - DNA, 65 bp, Homo sapiens
tgctctgttatgtctctgtatcacaaagggtcacagctaaggtaaaacaggggctagcggaagca

SEQ ID NO: 6795737 - DNA, 81 bp, Homo sapiens
acacaatggatcatttatctcagacttcagattgggtgattgtcaacaggaccctcgaggttttctgaggtacccctgtgt

SEQ ID NO: 6795738 - DNA, 63 bp, Homo sapiens
ggcagcatctctggcagcagctgcatctcctcctcaactccagctcttggcagattacctgtc

SEQ ID NO: 6795739 - DNA, 77 bp, Homo sapiens
agggtttcctcattgttttggaagaacttactctgataatccaagtgattatgtccaggagaacgactataaactct

SEQ ID NO: 6795740 - DNA, 76 bp, Homo sapiens
gctcctcagctcccatgcaccctctaagaaggaccagcctggtcagatataggtggagcatggggacgtgtggggt

SEQ ID NO: 6795741 - DNA, 81 bp, Homo sapiens
tatttgttaagagagttggaggtgtcaggatttaggtatactgtatgtggtctgacttgctttggacagctctgccaagta

SEQ ID NO: 6795742 - DNA, 60 bp, Homo sapiens
ctcccaggccatgctctagccaccagaacttggtgacgtggaagaagcattgcctgggag

SEQ ID NO: 6795743 - DNA, 89 bp, Homo sapiens
aatttaaagtgaagagcattttactttccctctcagaactcttagaaaacctctgaaggagtaaagggaaagaatgatcagtttaagtt

SEQ ID NO: 6795744 - DNA, 90 bp, Homo sapiens
gtagaaggatccagctttgcctgatcatataccctggagtcaatattttattttctttgtttaagacagtgcaagctgaatttttactac

SEQ ID NO: 6795745 - DNA, 65 bp, Homo sapiens
ggtaaaaagagtttgagatttggcatctaacagacccggttttaaatctcaggcctctatttact

SEQ ID NO: 6795746 - DNA, 77 bp, Homo sapiens
gcagagcacttgttggctgaaagcatatgtggcatgaggtgctaaattgcgttagccaagaatccatagtgcagtgc

SEQ ID NO: 6795747 - DNA, 130 bp, Homo sapiens
atgtcctacttcaagtgacctattaaaatagctctcaatagtttgctttaatacaactgcctttaatagcttttaaatttagtgtttgtttgagtagactttatggtgatttgtaaaatgatatggatat

SEQ ID NO: 6795748 - DNA, 69 bp, Homo sapiens
caggtcttgagttgcctgtctgcccatagacctccctggcagccgctagcaggcactctagaggagctg

SEQ ID NO: 6795749 - DNA, 58 bp, Homo sapiens
agagctaggggtagtcaggagacctgcattgtaggcaaggcttttacatcctagctct

SEQ ID NO: 6795750 - DNA, 77 bp, Homo sapiens
gagttcaggaaatttgtctcaaattatttaactagccaatggcaggtctggattttgaacaaaattctgtcttactc

SEQ ID NO: 6795751 - DNA, 64 bp, Homo sapiens
tgtgaagcttagggataataggctgccacttgaaggctgcttttcaccttccaagccctctgca

SEQ ID NO: 6795752 - DNA, 121 bp, Homo sapiens
gctatattttactttgtatctctactgttctttgattatcggtgtgaatgttttaatgaagttctcaaattaacttccattataatgaaaggcagtgatctttttaactttaaattatggc

SEQ ID NO: 6795753 - DNA, 65 bp, Homo sapiens
cattgctctcataagtgtgctgaaagaagacaaagacaagctcctcagaggcactgagagcaatg

SEQ ID NO: 6795754 - DNA, 63 bp, Homo sapiens
ctcccaaagtgctaggattacaggcgtgagccaccgtgcctggctgattttagaacttctgag

SEQ ID NO: 6795755 - DNA, 73 bp, Homo sapiens
tcattcagagcattgggaagaagaaatttgggatagtagtaaattcaaagcaatttcaccagtgcctgtacga

SEQ ID NO: 6795756 - DNA, 62 bp, Homo sapiens
gctggagccaagctgctcttggttgaggtgtgaatgggagccaggaaaagcggaagtctagc

SEQ ID NO: 6795757 - DNA, 70 bp, Homo sapiens
tgctatctttaccccaaaatgtaaccccttaatgcatcaaaggggttacattttggggtaaggataagta

SEQ ID NO: 6795758 - DNA, 68 bp, Homo sapiens
gagcaagctgcttaagctcattgtctcataattttccatgagcataatgagtatagcattgcttgttc

SEQ ID NO: 6795759 - DNA, 85 bp, Homo sapiens
gtgatggacctggctgagcctggagcatctggtgaggtctagtcccctattaatgcttccatggttccctgcacttctccgtcac

SEQ ID NO: 6795760 - DNA, 57 bp, Homo sapiens
gtggcagaagtacacaagcatgcagctgtctgtgctgtgagctgatacattctctac

SEQ ID NO: 6795761 - DNA, 58 bp, Homo sapiens
ggtcagaacaagggtaaataaatgaaatgttgattaatttgtttattatgttctgatc

SEQ ID NO: 6795762 - DNA, 64 bp, Homo sapiens
gggagggcagggactatgtttcatggagcactgcttccatgggattcagccttgagcccatccc

SEQ ID NO: 6795763 - DNA, 64 bp, Homo sapiens
gcagttcccaaggctagaagtccaacatcaagatgttgatgggacgttctccctctgaagctgc

SEQ ID NO: 6795764 - DNA, 78 bp, Homo sapiens
gaacttctctttgtatttctttgggccacctcaaaaacacctccaggttggtatcccaggaaaacaacggttaagttc

SEQ ID NO: 6795765 - DNA, 76 bp, Homo sapiens
acctacccccaagtctctgtcttaggccaggccttggggaacccaggctcaggccaggagcagctaggtgagaggt

SEQ ID NO: 6795766 - DNA, 96 bp, Homo sapiens
tagacaaatcctgaggaaggactccagttggccccagttggttcatgggcccatccctgttttaatcactgtggccaggtggtgtggggtattctg

SEQ ID NO: 6795767 - DNA, 62 bp, Homo sapiens
taaagctgcttggcattggtaaagaatctagattggatttggaatgtgatgtgaagcctttg

SEQ ID NO: 6795768 - DNA, 70 bp, Homo sapiens
tgtctagccaggtggctgagcagctgcaggaagccctcagccctgctcccgccaccacctgtggctttca

SEQ ID NO: 6795769 - DNA, 111 bp, Homo sapiens
cttattatctggtagcctcactggcctctggctgaggactaacgctggaagaaaagtaaactggtgttggctggcctagaggttgtcttctggggctgctagtttggtaag

SEQ ID NO: 6795770 - DNA, 101 bp, Homo sapiens
acaagatgaattctggtggaatttatgatttctatataaaaaatgaaaccataaaaagtattagaagaaattataggtagacgtttttagaatcattttgt

SEQ ID NO: 6795771 - DNA, 68 bp, Homo sapiens
cacacatattgtccctagtgtggcacttctttctcccatactccaccactaatgagacagtttgtgtg

SEQ ID NO: 6795772 - DNA, 64 bp, Homo sapiens
gcctgaagtttagatttcatgaagacactcagaacttgtaggttttgtgaatctaggccctggc

SEQ ID NO: 6795773 - DNA, 61 bp, Homo sapiens
ttctctaaggcttggcttccctttgctgctgcagccccgtagggaggccagcctcagagaa

SEQ ID NO: 6795774 - DNA, 58 bp, Homo sapiens
aagcacacctccctggcaggagcaaatccccttatgctcctggggggtaggtgagttt

SEQ ID NO: 6795775 - DNA, 61 bp, Homo sapiens
agtgtgtgtttgtggtatttaatttcattagtactggagaaaaatgcttttgacacatatt

SEQ ID NO: 6795776 - DNA, 82 bp, Homo sapiens
gtatcagatcaagtagtgttttttatgctgaaaaagagcttactagtagctaatgtttctgaagatacagctttgctgatat

SEQ ID NO: 6795777 - DNA, 110 bp, Homo sapiens
ccatctgttttaagattgtgtttctgttcatacagagtatagtatcgttagaagcaatattgtgcttctgttgtgcaatattgacatagaaagttttaaagattaagtgg

SEQ ID NO: 6795778 - DNA, 77 bp, Homo sapiens
taggttggtgcaaaagtaattgcagttttggcatatcaagtaacagcaaaaactgcaattacttttgcagcaaccta

SEQ ID NO: 6795779 - DNA, 56 bp, Homo sapiens
aagcagctgaaggattcagggttaacactttgccttttgaagagacttcagttctt

SEQ ID NO: 6795780 - DNA, 66 bp, Homo sapiens
aataatgtgatatttcatttacagcagtaaaggagcatagcttgtgaatgttaatattggattatt

SEQ ID NO: 6795781 - DNA, 77 bp, Homo sapiens
ttctaagtgctccacttgcatagacccagcaggtcagtgcctggagggatagaatgcaagaggagaaggtcacagaa

SEQ ID NO: 6795782 - DNA, 61 bp, Homo sapiens
tggtgatgttgccattaacccttgtctgaccaaaagtctagacctgaggcaaccatcacta

SEQ ID NO: 6795783 - DNA, 66 bp, Homo sapiens
cagggacaatggcagagcctgaaattcttcctagtcgtccaattcaggttcactcccctgttcctg

SEQ ID NO: 6795784 - DNA, 74 bp, Homo sapiens
atcatacaaatttagatttggatagaggtttagaaatttatctatgacattttcccagatttattcctgtagat

SEQ ID NO: 6795785 - DNA, 115 bp, Homo sapiens
gctgaagaaagcacatagttgggggtcttagataggtttggaagccatatggacttcttttaatgagggagggcttttgcaatccaagtctcaaagctgtgttgttctaatcagc

SEQ ID NO: 6795786 - DNA, 58 bp, Homo sapiens
cacaaggaggtcctgaggaagcacgcttccttgctggtgtttcttaggtttcctagtg

SEQ ID NO: 6795787 - DNA, 57 bp, Homo sapiens
gcagctttctacttcctacagcttttggggtggaggaaaacggggtgagggagctgc

SEQ ID NO: 6795788 - DNA, 57 bp, Homo sapiens
agtccacagagtctctcctgaaagaagaaaattggcaaggagactgctttgtagact

SEQ ID NO: 6795789 - DNA, 86 bp, Homo sapiens
cagcaatctcagttttgcattatatataattttagcaaagcaggagaagatggtaagagtataaagtaatgcggaacagaatgctg

SEQ ID NO: 6795790 - DNA, 91 bp, Homo sapiens
aagttcaatcacctaatcccatggcagagaagaaccaggcccaggagaaaagctcaagccccttcttctctcatagattaaggttgagctt

SEQ ID NO: 6795791 - DNA, 82 bp, Homo sapiens
cagagttggtggtggagccagctgggagtgaagcggtctgcttccagagactgagctcttcaccacaacactactgcctctg

SEQ ID NO: 6795792 - DNA, 58 bp, Homo sapiens
caatgactttacagtgttctcagaatcaattcctgagagagctcactatatagcattg

SEQ ID NO: 6795793 - DNA, 94 bp, Homo sapiens
attagagtagaattcttaaatttggttgtgaagattaaactaacacgtgccaattacttatcacacactaaattaggcctggttcatacctaat

SEQ ID NO: 6795794 - DNA, 57 bp, Homo sapiens
gccaagtccagtggtcaattatctggattactttcagtcaatgatcaatggctcggc

SEQ ID NO: 6795795 - DNA, 61 bp, Homo sapiens
ggacaagattggtgaagctgctatcctacctggcagtttacatcttcaatctcattgtacc

SEQ ID NO: 6795796 - DNA, 81 bp, Homo sapiens
agatcatttattatgtcaatttattgactttggtgttcctagaatatgaaagtagtataaaattcatgtgagggaagatct

SEQ ID NO: 6795797 - DNA, 114 bp, Homo sapiens
tagttacagaaactagttctaggagcttaaaaaaattccattctgtgcctttcaaaatataagacaggtttggtaattttcttgttgttccttggttgttctagaaggtgatta

SEQ ID NO: 6795798 - DNA, 68 bp, Homo sapiens
ccacaggtttctgatttcagtgttactataacagaacctagaagttagagtatcattcaagtatgtgg

SEQ ID NO: 6795799 - DNA, 72 bp, Homo sapiens
gcccagaaagcagggcagacctccagcctattaggtcatttctgatttgggattcgtcctactatatgtggc

SEQ ID NO: 6795800 - DNA, 61 bp, Homo sapiens
cagccagatttttttagctagcattgttcttcaatgaacagcagttgaaataatttgtttg

SEQ ID NO: 6795801 - DNA, 110 bp, Homo sapiens
cattaatgaggaaaccaggtggggtaaagctggttcactaagcataatatctgtaatatttttaggtctgctgtgattctactagtgtttcacctggattttttttaatg

SEQ ID NO: 6795802 - DNA, 63 bp, Homo sapiens
gcgaggtttttgagtcatggctggaggcaacaaggcttatggccctgacttggaggcctgagc

SEQ ID NO: 6795803 - DNA, 91 bp, Homo sapiens
cttctcagccttgctctgggcactggaagcctgctgtgtatgtcttatcgaggtggtgtttcttgccctgagatgaattaaggaagagaag

SEQ ID NO: 6795804 - DNA, 90 bp, Homo sapiens
gcaatgtttccttaaggcagataagaattcagcaagctttattcaacaaacttgcagagaaatttctggtttacttccaggacacattgt

SEQ ID NO: 6795805 - DNA, 55 bp, Homo sapiens
ctttcagcatccctgggattacacaagtacttgtttctccagggatccatgaaag

SEQ ID NO: 6795806 - DNA, 71 bp, Homo sapiens
ttcaggaaagttctgtgttgtgacattctagagacagcttgcctctagaatactgtgacatgccacctgga

SEQ ID NO: 6795807 - DNA, 58 bp, Homo sapiens
tagaaatccccagtctcatagtatcttttgttacttttgtcagggctgggggattctg

SEQ ID NO: 6795808 - DNA, 89 bp, Homo sapiens
ggagggaaaaccaccagcacgggtgttggcagcctgatgcaagggtgctcccggctctgacttcctgcgctccaggttggtggccctct

SEQ ID NO: 6795809 - DNA, 93 bp, Homo sapiens
ccggccggctccgcccccaagccctggacggcccttcccccagcccgcctggctgggggccgctgcacaccgggggtggaagtggggagccgg

SEQ ID NO: 6795810 - DNA, 61 bp, Homo sapiens
ggaagccagagtgctgggcaggcagggccatacaaggggagggccttcggactttgctttc

SEQ ID NO: 6795811 - DNA, 117 bp, Homo sapiens
agaaagctcaatatcatattcattgtatagaggatttcagagcagatattgaagggtgggtttggaacagacccttcatgctctaactcctcaggcctgtaagactgtgggcgttct

SEQ ID NO: 6795812 - DNA, 75 bp, Homo sapiens
tcaatgctgtctctgctatccaaaggtagtcagtcaaccctgaaactctttctttggaagtaaagtcagcaggga

SEQ ID NO: 6795813 - DNA, 65 bp, Homo sapiens
caactttccatctttatcgtcttctgaactccataagatctttctaagaattgaggggaaagttg

SEQ ID NO: 6795814 - DNA, 75 bp, Homo sapiens
ccagctttgtctcttaaatgtttactttttttgagatcacaaagatgaaagatttttatagagagaaaagtctgg

SEQ ID NO: 6795815 - DNA, 91 bp, Homo sapiens
gtaaaataaagtgacatttgtatgacactttaaagtctttgcagaaaaaatagattttaaagtggtggtacatttatgatatttgtgatac

SEQ ID NO: 6795816 - DNA, 97 bp, Homo sapiens
ctgcaattaacttcctcagaacactggggtatcattgagcctactgcagcagcaatttgctaaatggtactccagtgatcagaaagagtgagtgcag

SEQ ID NO: 6795817 - DNA, 90 bp, Homo sapiens
ggcccttccagactttgccactgacctccaaccctcggtttataggtgccagggctgtaggtaaggatggcaaaggaatatgaaggagtc

SEQ ID NO: 6795818 - DNA, 129 bp, Homo sapiens
gattgaagtccagggaggaaaaggagctttcctgaggtcactgagttggtggcagagtcagagctaaggcctgggtccactgatcatgctccagtgttctttacagctttcttctttcccctttcaatc

SEQ ID NO: 6795819 - DNA, 61 bp, Homo sapiens
ctggccccttaaagtgctgctctggattaaggacgccagaccaagatctgttaggggctag

SEQ ID NO: 6795820 - DNA, 60 bp, Homo sapiens
agtagattccagtgatagttaaataagaagtgatttcttctaatgaccactgattctact

SEQ ID NO: 6795821 - DNA, 60 bp, Homo sapiens
gagtctctgctatgttttctctggttatacttagagatcctttccaacctagtgagactc

SEQ ID NO: 6795822 - DNA, 130 bp, Homo sapiens
ggaattttgctcttgtttcccaggctggagtgcaatggcatgatcttggctccctgcaacctctgcctctcaggttcaagccattctcctgcctcagcctcccaagtagctgggattacaggcacacacc

SEQ ID NO: 6795823 - DNA, 110 bp, Homo sapiens
gactatgggaaccattgccaggctcttgagggctttggaaagaacctcttgcaaaaaaggaggttaaaccttaaagcttcattagcttcgtggtaaattcacctctggtc

SEQ ID NO: 6795824 - DNA, 73 bp, Homo sapiens
aacaagcatttattgaacatctactaagtgccaggcactcttcaatgtgctagggatatagtagtgtcttgtt

SEQ ID NO: 6795825 - DNA, 72 bp, Homo sapiens
gggctgacctggaaggacaatagatagtgtctggggatccagctaagattaagtgcttttaggccaccgtcc

SEQ ID NO: 6795826 - DNA, 71 bp, Homo sapiens
ctccagcagagagtcagcacatagactggccaagctgcccccagatctttggtgatatctctttggtggag

SEQ ID NO: 6795827 - DNA, 68 bp, Homo sapiens
ctcattctccacacatccagaccttacccagacctagtcagccaagggtgatggtggagaaatctgag

SEQ ID NO: 6795828 - DNA, 78 bp, Homo sapiens
tgctctgaaaagagagttgccagtctgtacaccaaagaagaatgcagtatgattaatattcttaaaatttttagagta

SEQ ID NO: 6795829 - DNA, 61 bp, Homo sapiens
gctgccatttagttgaagcatgtgccaagctctcagcaataacatcttaacttgatggagt

SEQ ID NO: 6795830 - DNA, 68 bp, Homo sapiens
ggtgtgtagcatgtttaagaccgttatctcttgcctcatcttaaaggtccaggaaaggcagcagcacc

SEQ ID NO: 6795831 - DNA, 61 bp, Homo sapiens
ttcagggccttgttcaggagtgaagaatgtcattcatgattgactatcaagagcaccagag

SEQ ID NO: 6795832 - DNA, 91 bp, Homo sapiens
agctgagcaacatctattgaaggtttgctaggatcccttgctttacctcatgtaagtttcatggcagccctttactagagatactttagtt

SEQ ID NO: 6795833 - DNA, 86 bp, Homo sapiens
ggctcagcatcactgcatcactctcccagcaggtagaacattcaaggttgaggtggctgcttgctgggaaacaggagagctgggtc

SEQ ID NO: 6795834 - DNA, 73 bp, Homo sapiens
agtgacagaatgtaatattgcattttgggtaaaaatctcatatcccagattgtaacttcttaaattcttcact

SEQ ID NO: 6795835 - DNA, 58 bp, Homo sapiens
tggagctggggtttgaatctggaccatctagtctcagggtcattggtcttcagcacca

SEQ ID NO: 6795836 - DNA, 98 bp, Homo sapiens
ggacgactagccactccctggggtgaggcagctgagcacagctggtgtctgccagaggccaggctgcctgactgcccaactgggaagggcttgtctcc

SEQ ID NO: 6795837 - DNA, 67 bp, Homo sapiens
ccccctctgccggggtccttcaccttgatgggccacaggcccctctgagggtccccagcgttggggg

SEQ ID NO: 6795838 - DNA, 78 bp, Homo sapiens
ctcattgagaagttccaggacaagatgtttcaggatgctacaattttgccatgatgtttatggatgcttttaaatgag

SEQ ID NO: 6795839 - DNA, 65 bp, Homo sapiens
gggaggtggggatgggccgcagccccgtccagagggggactgaggagcaaccccgtgccctgccc

SEQ ID NO: 6795840 - DNA, 100 bp, Homo sapiens
ccaaagtaactctgtagtaagtggtggagtgtggtcttgaaccatgaaatattgaagactttgctcttaaccacagcactatattaagactaagctttgg

SEQ ID NO: 6795841 - DNA, 96 bp, Homo sapiens
gatcttatcaggctttgttgacaacaatgattcccagtcagaacacactggtacagtcacactggttgtttacagtgagcatccatttgattggtc

SEQ ID NO: 6795842 - DNA, 92 bp, Homo sapiens
ttgtactctcctctttaaacgttttctttcataataaatagcagagacaaaagtgtttctattgggaagtgtgagagtaaagagatatacaa

SEQ ID NO: 6795843 - DNA, 89 bp, Homo sapiens
cagtcactgccccttggttagagctggaacttgagatgaaacatagtttccattgctgaccaaagtcccataaggtgtctaagtggctg

SEQ ID NO: 6795844 - DNA, 58 bp, Homo sapiens
gtcatgggtggccccgtgtgcagtctggagtaagactgcaaggttggtgactaatggc

SEQ ID NO: 6795845 - DNA, 68 bp, Homo sapiens
cttcccctagcacccatagaggccgcttggtaacacagccaggtgccacctctggtgctgtctggcag

SEQ ID NO: 6795846 - DNA, 55 bp, Homo sapiens
ccctggaggaccccaatgtggctgttaatgtctagccaaacgtggcactctaggg

SEQ ID NO: 6795847 - DNA, 65 bp, Homo sapiens
gagggccttacccagcctggatgtcctagaaagcttcctggaagagggaccccaggctggccctt

SEQ ID NO: 6795848 - DNA, 69 bp, Homo sapiens
ttgtattttgcaacacaggctacttcacgttctattttaagcttgaagttgttaaggttgccattacag

SEQ ID NO: 6795849 - DNA, 130 bp, Homo sapiens
cattggaatcaccaggagagcttgtaaaaatgtagactgctgggctgcacccccagagtttctgattcagtaggtctggggtggggcctgagaacttgcatttctaacaagttcccaggtgaggctgatg

SEQ ID NO: 6795850 - DNA, 81 bp, Homo sapiens
tctatgtaagtggttggcgaactctagactgtggaccaaatctagcccaacatctgtttttgtcaattacattttactgga

SEQ ID NO: 6795851 - DNA, 78 bp, Homo sapiens
ctctgtgtgcgtccctgtggctaagacatgacaaggtagggctttcagtggcatttgttacagggccagcacacagag

SEQ ID NO: 6795852 - DNA, 65 bp, Homo sapiens
gaagacctaaggttttagccctttccttgtcacttacctttgaaaggtctctgagccttggtttc

SEQ ID NO: 6795853 - DNA, 93 bp, Homo sapiens
tacatgagcttagctagttgctcagaggaggcctttacctacctgcaggctatgttaggtaccctcttctgtgttattgtaagactctatgta

SEQ ID NO: 6795854 - DNA, 80 bp, Homo sapiens
cagaatttaaacccaggagccagagtctgcagtgtaagagctttaccctgaaattaggctcctctctgtagtagatgctg

SEQ ID NO: 6795855 - DNA, 69 bp, Homo sapiens
tcttttggttttatcagccacattttatgggttattaaaatagcacctgtgatgggatgagcaaaaaga

SEQ ID NO: 6795856 - DNA, 86 bp, Homo sapiens
tgtgagggccagctcagggtccttgggctgctgatagggacaccaaggctaggctcagggtcccttggtgctggtcctaagccaca

SEQ ID NO: 6795857 - DNA, 98 bp, Homo sapiens
ctgagcagatgtagccacatgctacagtgaaggaggaagccccggctttgcattggtctcttcttccttcatggtagcatgtggctgcatctgttcag

SEQ ID NO: 6795858 - DNA, 55 bp, Homo sapiens
gccctcagtggattcttattgttcttcaagtaatgaccaaaatccttcagagggc

SEQ ID NO: 6795859 - DNA, 59 bp, Homo sapiens
ataactcagttggaataattagagggtgactggctctttatttatttaggctgagggat

SEQ ID NO: 6795860 - DNA, 73 bp, Homo sapiens
tcctcccccagcccatgcccttatagcataaccggattagctggctgggctgtgggctgttgcaggggtaggg

SEQ ID NO: 6795861 - DNA, 73 bp, Homo sapiens
cttacctgcctggtggagttaggcatcacaatagaggtaacatttaagctgaggaactcaccaggcagagaag

SEQ ID NO: 6795862 - DNA, 66 bp, Homo sapiens
tctatacaaggtcgataactcacactggacttcagaagtctcttgctagaatcagccatgtgtaga

SEQ ID NO: 6795863 - DNA, 73 bp, Homo sapiens
gagcctagggaggtctggctgccctgagccccctacccctgggctttgggcagtaaacggtacctagagactc

SEQ ID NO: 6795864 - DNA, 58 bp, Homo sapiens
ggagcagatgtcttcatggcctccatgtctgttggagaggcgacaagctatgtgctcc

SEQ ID NO: 6795865 - DNA, 80 bp, Homo sapiens
gctgttttgggttgctttgtttcccggagcgtccaacccagcacaccgcctccggcaaactgcgagcaattcaaagcagc

SEQ ID NO: 6795866 - DNA, 69 bp, Homo sapiens
tacatgtcccagtgctgctaaagaggtagagtgtatttcctctcctcctgacgttgcaatggccatgtg

SEQ ID NO: 6795867 - DNA, 64 bp, Homo sapiens
cagagggtgcaggaggatggtagttacagcctgacattactgccatagactctgccacctactg

SEQ ID NO: 6795868 - DNA, 55 bp, Homo sapiens
gagtgggcttggggagagtttgttggagtccagcccacctcgtccaacccacctc

SEQ ID NO: 6795869 - DNA, 62 bp, Homo sapiens
atgctgaatcccagagtccccaagaaaccatactttgcatggtggcttcagggagttagcat

SEQ ID NO: 6795870 - DNA, 59 bp, Homo sapiens
tgtggaggattctgatgccagctcagggacacagaggctggtcagaatgcctccctaca

SEQ ID NO: 6795871 - DNA, 106 bp, Homo sapiens
ccatttgcatgcagattttacattattagcaaccaagagcctctagcaagaaggctgatggaagggtcagtgtgttgcttttctgagtgagatctggatggagagg

SEQ ID NO: 6795872 - DNA, 58 bp, Homo sapiens
agtgtccactccatgcccatcctcaaggataaagaggtccaggtggttggaagacact

SEQ ID NO: 6795873 - DNA, 98 bp, Homo sapiens
agcagggagggggtgacaaatatttgaagaggctgtccagatacaggcgtttccctaaatttcagtcagcctgtttgtttatcgctgcctctaaagct

SEQ ID NO: 6795874 - DNA, 59 bp, Homo sapiens
acagaggcctcggcctgcccaggggtggacaaaaaccctgcagccagtgtggccactgt

SEQ ID NO: 6795875 - DNA, 79 bp, Homo sapiens
aaggggatagatataagtgacttagaagaaaatattggagacaatagtacagcatttttcctgagtcaccaatcctctt

SEQ ID NO: 6795876 - DNA, 79 bp, Homo sapiens
tgtttatgggccttacttggggctgactccatcactgaatccaggagtagtcacagaaacccaggtgtggcagtcaaca

SEQ ID NO: 6795877 - DNA, 59 bp, Homo sapiens
ctccgggttagagcaggtgatctggtccggtgtgacctcccctgactcgaaacccagag

SEQ ID NO: 6795878 - DNA, 106 bp, Homo sapiens
tccaggagtgtagccaccaagagaaaggggtggctggagaacttggggatctcctgcgagggaacccagaagtccagctgcccattcctggtggaaacgccctgga

SEQ ID NO: 6795879 - DNA, 124 bp, Homo sapiens
ggcacctgccagctctctcccttgggccttctacctggagcaggaggcagaatcccattctcctagggagtctgtgtatattcactgcccaggagtgttccagcagattgccccatcaggtgcc

SEQ ID NO: 6795880 - DNA, 82 bp, Homo sapiens
ggttccaagtctttgctattgtgaatagtgccacaataaacatatgtgtgcctgtgtctttatagcagaatgatttataatc

SEQ ID NO: 6795881 - DNA, 62 bp, Homo sapiens
gaccctctggagttcctgcaggctgtggcctctgagccacctgttgggaactcccgaaggtt

SEQ ID NO: 6795882 - DNA, 58 bp, Homo sapiens
gtgggctgccctggtcccatggctgattggaaaaatcctgtggctccagggagccggc

SEQ ID NO: 6795883 - DNA, 82 bp, Homo sapiens
atgctatacctaccttaaagggttgttgtaaggattattttggtaagaaatagattgtggctaatagcacctggttcagcat

SEQ ID NO: 6795884 - DNA, 58 bp, Homo sapiens
ggagcattctcagctacaagacccaaagcccagctttgctttcatcatgagatgctcc

SEQ ID NO: 6795885 - DNA, 89 bp, Homo sapiens
tgcttcaggaaccatttaagggtataaagcccattttaaagtctttgctgccaaaatgggctttataccgtcagctgattcctgaagta

SEQ ID NO: 6795886 - DNA, 78 bp, Homo sapiens
gtcatcataactaggactggttattttgtttggcagagttatttcagtaatataagataaccaaattagattggtgat

SEQ ID NO: 6795887 - DNA, 63 bp, Homo sapiens
agaccttgtctttaagcccacactgaagagtgaaagtatttcatgtggaaaaggatctggtct

SEQ ID NO: 6795888 - DNA, 67 bp, Homo sapiens
cctgagtctgaggagaagctaagaaacacagtttacatcaagaagctgggtctctcttgaggcaagg

SEQ ID NO: 6795889 - DNA, 100 bp, Homo sapiens
caggtcctctgagctcctcctagggccccggaactgtgctccatgctggggtaaaccgttcctgccctcgggggtgttccagttagtaaggacagacctg

SEQ ID NO: 6795890 - DNA, 71 bp, Homo sapiens
aagctttcccacatatcttgcatttatgaggtccacctccagtgtgcattatcatgtgtcttcgaaagctt

SEQ ID NO: 6795891 - DNA, 70 bp, Homo sapiens
gggcggaagaggggaagtaatgaatgatacttccagacccaaggaatgttaacttcctcctcctctgctt

SEQ ID NO: 6795892 - DNA, 63 bp, Homo sapiens
tttgtacacaggatgttataatgggatattgacattttacggatccagcatcctgtgtataaa

SEQ ID NO: 6795893 - DNA, 72 bp, Homo sapiens
ctcccatggaggcagcaataagccctgggcagaggaagagggaatgttgtctgaggctgttgtaccagggag

SEQ ID NO: 6795894 - DNA, 60 bp, Homo sapiens
gggggcagggtagggtaggttaaagccagtgatggggcctcagctctgctctgcaaaacc

SEQ ID NO: 6795895 - DNA, 66 bp, Homo sapiens
gtgtgacagaaacaagaaataaacattgtctgtgccacagaaatgttgtgggttttgttaccacac

SEQ ID NO: 6795896 - DNA, 122 bp, Homo sapiens
ggtgatagcttttgggtagaattttgagttcttactggaataaacgatcttcagcacttctctgtgaaatgaagggcttgttctgggacctgaaatgcttcaaaccctgtgcagttgttgcc

SEQ ID NO: 6795897 - DNA, 64 bp, Homo sapiens
cttgtgacagtgaataagtctcttaagatctgatggttttatacagggagtttccctgcacaag

SEQ ID NO: 6795898 - DNA, 63 bp, Homo sapiens
cttagaggcatggtgcttgctgcagtcatgaagtcagcaatggggcagatacctgtgtttaag

SEQ ID NO: 6795899 - DNA, 64 bp, Homo sapiens
cagggctccatgcagggactccccgaccccagaagctgggaaggaaacacctcatggagtcctg

SEQ ID NO: 6795900 - DNA, 65 bp, Homo sapiens
agcttggtgttgcctgcttgagaaagttcccctggtcaccctgtctaaagcagccactacaagct

SEQ ID NO: 6795901 - DNA, 91 bp, Homo sapiens
cttgtaactccagtttttccattggtaaaatgagagtgataaatgatatcgttcacatcgtattattgggaaggttgaaaaagtgtgcagg

SEQ ID NO: 6795902 - DNA, 63 bp, Homo sapiens
gggtaagaagccatggtagaaaactcagttcatgacgaatctgttctttctactgtggctccc

SEQ ID NO: 6795903 - DNA, 87 bp, Homo sapiens
agaagctcggcagtgacttgctcaaatcagattttagacacgatttaaagcatgtttcagtaaggttaatatagtgtccgagtttct

SEQ ID NO: 6795904 - DNA, 67 bp, Homo sapiens
cttagtcctttatcaaacatttatgggtttactctgtactgtgctagttgatgggagtgggactagg

SEQ ID NO: 6795905 - DNA, 92 bp, Homo sapiens
cagagctagacatttccaagtccacttgtatttattgtgttaccatgacgtagccagtgacatacgattgggaaaaaatgtgtcctgttctg

SEQ ID NO: 6795906 - DNA, 55 bp, Homo sapiens
cagctcctctggccagccctgcacctgctctgtggggctagggcctggggaggtg

SEQ ID NO: 6795907 - DNA, 61 bp, Homo sapiens
tgcaggtgtctgggggcaacagagtctaggatgtggccacaagtgtcccatggacatggca

SEQ ID NO: 6795908 - DNA, 62 bp, Homo sapiens
atgttttgagtatttgctatgtgccatgcaccatgctaggtacttagtaaatattaactcat

SEQ ID NO: 6795909 - DNA, 66 bp, Homo sapiens
ggtggcctctgcaggcctcgacaaggcccagcctcctgcctcccgaaggcctgcacaggcccagcc

SEQ ID NO: 6795910 - DNA, 72 bp, Homo sapiens
aggtacatgaggctaatagactttcctgcattactattcttgggcaacgtctttatattggcgtatgtactt

SEQ ID NO: 6795911 - DNA, 56 bp, Homo sapiens
cctgaagtcacttttgaatatgtctcctggtgcacatattcaagagtttctctagg

SEQ ID NO: 6795912 - DNA, 107 bp, Homo sapiens
gggaggattccccaaaagaataactgtcttctgacactgttaggagggcaaagccttgccagtgttgcagaagctcagtcgtgttttgctggcacaggaacccaccc

SEQ ID NO: 6795913 - DNA, 94 bp, Homo sapiens
gttagcatgggcctaaagtcgacaaatttctaagcctttggatatgtagttgctaaattgttttctagaagttgtaataatttaggctcctggc

SEQ ID NO: 6795914 - DNA, 55 bp, Homo sapiens
ttttccactctatgatagaagggttaataatacctacatcaagggagtggtagga

SEQ ID NO: 6795915 - DNA, 85 bp, Homo sapiens
cctgccttctctctggatgtaactttcctagtccatatcctggcccatgaggacatggaaatcaggttcatccaagaggctcagg

SEQ ID NO: 6795916 - DNA, 62 bp, Homo sapiens
tgaccaacagaatttcctgttttctgttaaggagcaaccagaaaatgtttccttgttggtta

SEQ ID NO: 6795917 - DNA, 70 bp, Homo sapiens
agatatatttgtcaagagagggggatagaacatatgtaatatcacttagctctcttgattgatgatgtct

SEQ ID NO: 6795918 - DNA, 126 bp, Homo sapiens
ctgtcccctctgttatggtgcttgtgtctgtgtctgttcttggctgtgaaatggaaaaaatattttcttcttttccttatctctacagagagtcatagactcatcatgagcctctcataatgacag

SEQ ID NO: 6795919 - DNA, 112 bp, Homo sapiens
cacctggagaacttgttaaaccacagactactgggctccactcccacagtgttctattcagaaggtctagggtggagctcaaatatttgcatttttaacaaattcccaggtg

SEQ ID NO: 6795920 - DNA, 95 bp, Homo sapiens
gagtaagtcacttccctcctttatcaaaaagagatgctatttatacactttctttctcacttggtggaatgagggtaaaatgtgaagtattactc

SEQ ID NO: 6795921 - DNA, 61 bp, Homo sapiens
cctggcttccctgtcttatggaatgcaatcctgttgctttctgtcttatggaagctgtagg

SEQ ID NO: 6795922 - DNA, 76 bp, Homo sapiens
tctagaagctgagatgtccaacatcaaggcaccagcgattcagtgtctgatgaggacctggtctctgcttcataga

SEQ ID NO: 6795923 - DNA, 76 bp, Homo sapiens
cctctctctgagctttagtctctccacttaaaattaaagtgagaatgggaatgaaagtagcaacctcacagggtgg

SEQ ID NO: 6795924 - DNA, 77 bp, Homo sapiens
cagatgagccagaaatgtagaattgcttaactgaaacaaacattcagacctggaactctacattcctgtaagcactg

SEQ ID NO: 6795925 - DNA, 67 bp, Homo sapiens
gtgacatgtctaaacaatgtaaactttttgttgtatagactttagttattgttcagtacaatgtcat

SEQ ID NO: 6795926 - DNA, 92 bp, Homo sapiens
gcactgtattttcaacccactcttactctgaaaactttctccttatagttgagaagttacagttaggggtgatgacagaagaatatacatgc

SEQ ID NO: 6795927 - DNA, 74 bp, Homo sapiens
ataactgtcatgtgaaattactttaatggggaaaatcaaacccaattacagcaatgctacaagatgacaggggt

SEQ ID NO: 6795928 - DNA, 59 bp, Homo sapiens
gacatctacatgcttgccactgctaggacattagtcagagtgagtgggtaagtgaagtc

SEQ ID NO: 6795929 - DNA, 61 bp, Homo sapiens
gctgagtcctgggaggggctggtcctgatgctgtctgaccagccctgcccagggaagcagc

SEQ ID NO: 6795930 - DNA, 91 bp, Homo sapiens
gagccagggccccgatcccaggctgggcggggaacctggatgctgcctgcccaccaccgcccacacctgacctcggcgtcctcctgagctc

SEQ ID NO: 6795931 - DNA, 60 bp, Homo sapiens
aagaaatcaatatctatatgttgcagaattaaatctgcaagtagttgtgattgatttttt

SEQ ID NO: 6795932 - DNA, 65 bp, Homo sapiens
gacactgagccatacaactggaaaactgaggttaaattcatttccaatttgcttggttttgtgtc

SEQ ID NO: 6795933 - DNA, 66 bp, Homo sapiens
tcagagccagaaatggaagttctggtttaataagtttgagttagaagttccgtttcttttctttgg

SEQ ID NO: 6795934 - DNA, 91 bp, Homo sapiens
ggtagtataggctaataattatttgtagttcttcatgaattcagcttctgccaagtgaataccatcaagagctttgctagcaggtgctacc

SEQ ID NO: 6795935 - DNA, 69 bp, Homo sapiens
gcctgggaccacactttggaaatcacgattatgaacaggaatcagaatttctgaagatgtggcctgggc

SEQ ID NO: 6795936 - DNA, 77 bp, Homo sapiens
tcgggtctactcctcctaaatgattcttcctgtatgttttacgtgggggtcgaggggataggagagggtggccctga

SEQ ID NO: 6795937 - DNA, 71 bp, Homo sapiens
ggcctcagtgggccgctgcaggggccccatgactgggctctccatgccaacctgggttctcatctgaggcc

SEQ ID NO: 6795938 - DNA, 56 bp, Homo sapiens
caccatctggtaggcattagtgtcaccagaacacgggagcacttatcagattggtg

SEQ ID NO: 6795939 - DNA, 65 bp, Homo sapiens
taggaggattttgacttattcagggaggaagggaaggcttctctgaagaatcgatgattctgttg

SEQ ID NO: 6795940 - DNA, 110 bp, Homo sapiens
agtgcccagagaaaggctccattcaccgggcgggctgctctccatggccgtgagtgtcccgcgctctctgccgaccgcgggcccctaggaggagcctttgctccaggcct

SEQ ID NO: 6795941 - DNA, 77 bp, Homo sapiens
ctgtgtggaaatctcagggaagctatggtgagggcctcattgctggccctgcagagccagccctgaccttcccaaag

SEQ ID NO: 6795942 - DNA, 76 bp, Homo sapiens
tcagaatccctctgcagctggttcctgacatcgcaaacgttatctgcaattcttggcagtttcggaaggatgatga

SEQ ID NO: 6795943 - DNA, 56 bp, Homo sapiens
ccagcttggctctaagacacctattggtggaaatcgttggcactttggcaagctgg

SEQ ID NO: 6795944 - DNA, 60 bp, Homo sapiens
gggagatgaatcagaagtgatccaataaccagccctggattaagtgcatctggctctccc

SEQ ID NO: 6795945 - DNA, 89 bp, Homo sapiens
cagtgaactgctggtagttcatgcctctgaatgtgtccagagtctaacactggcattagtcacgaggcatcagaatgtcagcatcactg

SEQ ID NO: 6795946 - DNA, 66 bp, Homo sapiens
ttgctgcattttttctgtgtgccaggtactgtgaggacttagaggacacagagataagtgagacaa

SEQ ID NO: 6795947 - DNA, 56 bp, Homo sapiens
tggaggatgagtgtgggctctgatgagaatgttaaatcccaataactagtccttca

SEQ ID NO: 6795948 - DNA, 58 bp, Homo sapiens
gagcagcccaaggccataagacctttgtcaaagaattcaaaggaaccctgggttgctc

SEQ ID NO: 6795949 - DNA, 64 bp, Homo sapiens
ctcgcccttagggccactgtcactgctgggtcacaggaaaccggcagggcccttgggggcaggg

SEQ ID NO: 6795950 - DNA, 100 bp, Homo sapiens
gaacatgagaaaactttgaagtgatggatgtgttcactatcttgagtatatagtgatattctcattggtatatacatgtgtcaaaagtttattgcgtgtc

SEQ ID NO: 6795951 - DNA, 75 bp, Homo sapiens
ggccaagggccagtagaattttagtgcagtttgaaactgtgacatacggcactaatattatatttccccaaggtt

SEQ ID NO: 6795952 - DNA, 86 bp, Homo sapiens
ggagcacatggtaccccacagcatacaaaggcacctccattaagggcctattgggttaatgctgatgggtaaacatgaatctgccc

SEQ ID NO: 6795953 - DNA, 55 bp, Homo sapiens
tccatctccaggttgacttcagtcaataatcctattgtcttaaggctggagtgga

SEQ ID NO: 6795954 - DNA, 58 bp, Homo sapiens
cagatgttggagataggccatcccagcctgggattacttatttgtactaataaatctg

SEQ ID NO: 6795955 - DNA, 67 bp, Homo sapiens
tctagccactgggatgggcataagaccctattagagccaacgggtcttgatgagcctagtgcttaga

SEQ ID NO: 6795956 - DNA, 97 bp, Homo sapiens
tctcagtcaagctagtagtgtattaatgctccaggagttgtatcccacccccagtgcaccctggctgatttactgaattctggctttgaatcagaga

SEQ ID NO: 6795957 - DNA, 84 bp, Homo sapiens
tattaggttgaccataagaaattgctttctttgataaaaccaaaattgtgaaatattggcaatttcatatggtgcaatctaata

SEQ ID NO: 6795958 - DNA, 56 bp, Homo sapiens
gctgaagggcatggggcctgggctcctcagaaagaaacaagcctgccccatgctgc

SEQ ID NO: 6795959 - DNA, 76 bp, Homo sapiens
ggttttggctcctccaatatggactcctctaaacacagggagcttagaggatgtccacatggacggtgctcattcc

SEQ ID NO: 6795960 - DNA, 62 bp, Homo sapiens
ggcagtcccagggtatcctgtagtaaaaataatttttatgactttcatatcctaggtttgtc

SEQ ID NO: 6795961 - DNA, 63 bp, Homo sapiens
tgtacttgcttattagaaatctggctattttgctcaacatttgatgcacaatgggtaagtaca

SEQ ID NO: 6795962 - DNA, 63 bp, Homo sapiens
gtgcttgggtttcaacagacagacatgagcccagaggcttcctggcagggaacttgtcagcac

SEQ ID NO: 6795963 - DNA, 79 bp, Homo sapiens
atgcagaaacaagtctggctgataaaatgctctttatatctatggtcatcaggagtcatcagccagcctgagactgcat

SEQ ID NO: 6795964 - DNA, 79 bp, Homo sapiens
cggccgctgtgctgcgggaggattccgatccgggtcaggtttcgctggaacggttccctgagcaagtgcacgtgggccg

SEQ ID NO: 6795965 - DNA, 60 bp, Homo sapiens
gtctgtccacttggaagctccctctggggctgtgtactcaaggagcgtctgagggcaggc

SEQ ID NO: 6795966 - DNA, 84 bp, Homo sapiens
gacagaagtccccgccccagctgtgtggcctcaagccagccttccgctccttgaagctggtctccacacagtgctggttccgtc

SEQ ID NO: 6795967 - DNA, 76 bp, Homo sapiens
gacatgtgttctgaggcagatgactgcgggacccacgggcttgattggttctccctgttctcaaggacaacatgtt

SEQ ID NO: 6795968 - DNA, 59 bp, Homo sapiens
gaggctggcagaaaagcacaggaaccttcctctaggccaagcttgtccctgcctgcttt

SEQ ID NO: 6795969 - DNA, 84 bp, Homo sapiens
atgtcagtattttattttgtgaatgccttataagcattatgaaacaatgcttatttgccatttagcaggagatactctagatgt

SEQ ID NO: 6795970 - DNA, 106 bp, Homo sapiens
gggagaagccagtaggttcagagaagttccaggtcacaggccaagtaaggggtgaagtaggctttcaactccaggtgtgttggactctaaaccttctgcttctttc

SEQ ID NO: 6795971 - DNA, 77 bp, Homo sapiens
ggattctgtgatgactcttttgctaggtgaatatgttctttgattcatatccatagtaaaagtcattaaggaggtct

SEQ ID NO: 6795972 - DNA, 57 bp, Homo sapiens
gccagtagagcaccaatctgtggctagcctttagttctttgacggtgctttgaaggc

SEQ ID NO: 6795973 - DNA, 129 bp, Homo sapiens
ttttccttttggtcctcttttccttcagtggctctgcttgcctatctggtggtcgttttggaagttccaacccagcaccaatccagagtggagctggtgatgccgaaatggaaggagtgtttgggaagg

SEQ ID NO: 6795974 - DNA, 68 bp, Homo sapiens
ggacagggttggggcatataaaacaggtccctaaagagatgacagaccttgtccttttacccgtgtcc

SEQ ID NO: 6795975 - DNA, 73 bp, Homo sapiens
atcctatgttattatttttcagttatctgtaatattttggtcagatgtgctttattaagtaaaaatatagggt

SEQ ID NO: 6795976 - DNA, 80 bp, Homo sapiens
aataacaaggagatgccagcaaggtccagcatagggaggtaacaaactccagtctggagccttctggttaatcagttatt

SEQ ID NO: 6795977 - DNA, 64 bp, Homo sapiens
gcagcagcccagccttgtctctttatagggtcctagagaaccggtggtggctgggttgaaaagc

SEQ ID NO: 6795978 - DNA, 62 bp, Homo sapiens
gacggactcttggcaatctatactgtctttcagccaaagtgtagctttatacaagatctgtt

SEQ ID NO: 6795979 - DNA, 121 bp, Homo sapiens
ggtgacttcactttgtgaaagccccaggcaccgcttagtgaaacaacctttggcaggacctcacagttaagtcagttcatctaagcaagaagtcagcttggggaaagtcaattgtctcatc

SEQ ID NO: 6795980 - DNA, 99 bp, Homo sapiens
ttcgcgcttcgggttgtgcaagcttcctcctgcctgctttggggcctttctgcaatgttccagaagcggcatcaggaggctgcccagccagctcgtgag

SEQ ID NO: 6795981 - DNA, 62 bp, Homo sapiens
tcaagccagtggtgagaagatagcaaggaactagaaaagctacatagaaaccactggtttgg

SEQ ID NO: 6795982 - DNA, 88 bp, Homo sapiens
acacttcttgatttcatgcagttaagattcacattgcactccagcatgttgcagttaatggctactgtatgaaatttcaagatcatgt

SEQ ID NO: 6795983 - DNA, 127 bp, Homo sapiens
gtctgtgtgcgagcgaagcctggtggagtgggtgccggtcgcagggctcgacgggaagtggagtccggctgggtccgcgggcggcgccaacccccgctccaccggactacaactcccagaatgcggc

SEQ ID NO: 6795984 - DNA, 72 bp, Homo sapiens
atgttgcggcatgcagtggtaaaaagtcaggggtaaggtccctgattgcgaagctactagtatactagatat

SEQ ID NO: 6795985 - DNA, 73 bp, Homo sapiens
gtagggccagctgtggactggcagtgaccttggtgcctttgactcatatacccattgtccttccaccccctac

SEQ ID NO: 6795986 - DNA, 65 bp, Homo sapiens
tcaacactgcagtagcacatagtaaatgttcagtaaatgccatcgattgttgctgctgctgttga

SEQ ID NO: 6795987 - DNA, 118 bp, Homo sapiens
caaaggcttgttttattttatttgtttagttcaatatagccctactgatctgacatccccttagagtttgggtagagtttaatgaaaaatctgaaaaatgaaataaattcttcctttg

SEQ ID NO: 6795988 - DNA, 75 bp, Homo sapiens
gggcttcagaggaatatgagtgtgcacagcaaggacagtgctattcacctcttgttcttcataaatagaaagcct

SEQ ID NO: 6795989 - DNA, 57 bp, Homo sapiens
ccaaggaagaagctgcccgacatacctgactgacttgtctggatgcccttctcttgg

SEQ ID NO: 6795990 - DNA, 73 bp, Homo sapiens
gtttcagtatctttgtactaattgatgttacttgtgaaacaattttaaaattggtgtcagggaactttggaat

SEQ ID NO: 6795991 - DNA, 72 bp, Homo sapiens
cctcctaacatgcagagattggctttatagatgcacatggtttcaaatggccaatttttgactgtcagtagg

SEQ ID NO: 6795992 - DNA, 129 bp, Homo sapiens
taatttgctgcatgaccttggcaggacccaccgggcttgcaggatcttttctctgtgcactgatgggatgaggctggatctctgttgccttcattcgtgctgtttatgccaacagggtttgcagtttta

SEQ ID NO: 6795993 - DNA, 58 bp, Homo sapiens
cactcagcctgcaacggtctctgtcatgccaggttagaggaaccaggcaggctgagtg

SEQ ID NO: 6795994 - DNA, 114 bp, Homo sapiens
tcatttaccttctgaagtctttaatgaaagctctgtcatcattcctgttttattgatgaggaaactatgctgtcagagttgagtatttataagtagagctgctgaaaattgtga

SEQ ID NO: 6795995 - DNA, 68 bp, Homo sapiens
cgaatctgccaggtgtccgggagtcgctcggggacgcgcgagctccttgaagggctctgggagatgcg

SEQ ID NO: 6795996 - DNA, 101 bp, Homo sapiens
ccattctcccgtgtgtcgtaggccctggcctgggagctgctagcgtggagcccatgccctctgtttcccaaggccgtggccctatggcactaggcaaatgg

SEQ ID NO: 6795997 - DNA, 59 bp, Homo sapiens
gtaattacattagggtaaataaggtgtccgtcacctctagcatttatcctttgtattac

SEQ ID NO: 6795998 - DNA, 70 bp, Homo sapiens
gggtttgcataatgttttaaaacaaatttatagaaatatagatgatggaaaaaagcaatagggtaaacct

SEQ ID NO: 6795999 - DNA, 81 bp, Homo sapiens
tctatcagatgcccacatatgtatatcaaatatgactgatctatccagttagtcagcattgcagatatatggcctggtaga

SEQ ID NO: 6796000 - DNA, 55 bp, Homo sapiens
gcatgagccatttctccaaggatccctgttctttccaatttgaaatggtatatgt

SEQ ID NO: 6796001 - DNA, 55 bp, Homo sapiens
ggatccttaactatcacagtgaggagtactgattataactggatgtaaagggtcc

SEQ ID NO: 6796002 - DNA, 83 bp, Homo sapiens
gtaagagatcatggactgagttgggaagactggctttgatagttcttagctgggcaaactaggctcagtctctggtctgttac

SEQ ID NO: 6796003 - DNA, 107 bp, Homo sapiens
cctcatgatctgccctcctcagcctcccaaagtgctaggattacaggtgtgagccatcacatccattgttttgtcccagcctgggccccaggagcacaggcatgagg

SEQ ID NO: 6796004 - DNA, 71 bp, Homo sapiens
agagagtatatttggggagaactttgcatatgctcacctgagtcattgcagagtggattctgtataccttt

SEQ ID NO: 6796005 - DNA, 55 bp, Homo sapiens
atagtgtcaaagtgctatgtgtatttttccagtacattaagtaccagggcactgt

SEQ ID NO: 6796006 - DNA, 56 bp, Homo sapiens
ctatttttttgtccttagggaactaatattgttctacaaggacacaacagagatag

SEQ ID NO: 6796007 - DNA, 73 bp, Homo sapiens
ccaattctttcctgtctgtttcattccttgttttagtataaaccaataagtggaaaggcattgtcagagttgg

SEQ ID NO: 6796008 - DNA, 61 bp, Homo sapiens
agagaggcacagcagaaagtgtaggaggagatcagggtcttttgctgtttgctgtctctct

SEQ ID NO: 6796009 - DNA, 84 bp, Homo sapiens
gctattggggagagacattttcgttggagaggttggctgcaaattctttttcctcagttttcccaaatgtctccttcccatagc

SEQ ID NO: 6796010 - DNA, 74 bp, Homo sapiens
gattataggaacctctgcaatgcaatgtcatgaccactggggtttggcattggagatgcaagaacctaaatatc

SEQ ID NO: 6796011 - DNA, 101 bp, Homo sapiens
gactattggctctgagagcttttattggatttgccagcaaaccctgccatcctatgttggcaaaatttaaagaagtgataataaaattggagctcaaagtc

SEQ ID NO: 6796012 - DNA, 65 bp, Homo sapiens
gtttcatatgttctgtagtcagaggatttgagaacactttgacaataattgcatttatatgaaac

SEQ ID NO: 6796013 - DNA, 61 bp, Homo sapiens
ctgagactttggcatttacagtcacagcacatgcagggagagtcaaatgccaatgtcacag

SEQ ID NO: 6796014 - DNA, 66 bp, Homo sapiens
gtgagaggtcttaagatctagactgcacctgggaagtgaggtcatgtctgagaataaggccgacac

SEQ ID NO: 6796015 - DNA, 99 bp, Homo sapiens
taagaatgatccttcctaccctgggttcctcagcccttacttagccctagtcaagggctaagtaatcggggcggggcggggcgggaagcgtaactcttg

SEQ ID NO: 6796016 - DNA, 79 bp, Homo sapiens
taaaggcagcctaggaagtgttgattattcaagtaaaacagtagctctaaattctttgactttccaggcttgtccttta

SEQ ID NO: 6796017 - DNA, 73 bp, Homo sapiens
tttgatccttattattgcccatttacaggccaacagctttccacccccctgtaaggagcatataggggtcaga

SEQ ID NO: 6796018 - DNA, 69 bp, Homo sapiens
gcccagagagctttctttgtgctttctgccaccatggaagttacagtgaaaagaaggctctctatgagc

SEQ ID NO: 6796019 - DNA, 61 bp, Homo sapiens
tccctgcctcctgcaccttctgcagatggcgccggccatggccaggtagaggaggtagtga

SEQ ID NO: 6796020 - DNA, 65 bp, Homo sapiens
ggcttataaatattaggctttgggtaaaaactaatactgtggattcaaggggagtagtatgggcc

SEQ ID NO: 6796021 - DNA, 58 bp, Homo sapiens
catccggttcgtggtcaccttgtggaactcattggccacgaggttcacgcgctggatg

SEQ ID NO: 6796022 - DNA, 57 bp, Homo sapiens
ccactgggggctgctcccaggtgtgggtagatggtgcctggggaatggccccagtgg

SEQ ID NO: 6796023 - DNA, 95 bp, Homo sapiens
cctcctccacccaactccagcaggtgcgtctcagagctaatcccatgcacacgagtcacctgagacggggcttgttgaacgcttgggggaggcgg

SEQ ID NO: 6796024 - DNA, 61 bp, Homo sapiens
tccatacattgaaataccattcacctgttaaaagagggtggtgtggctttatgtgtatgga

SEQ ID NO: 6796025 - DNA, 73 bp, Homo sapiens
gaggactgatactgtggtgcatctggagtattgtgaaatggcccagaacccagatgccagggtgtctgaattc

SEQ ID NO: 6796026 - DNA, 64 bp, Homo sapiens
tttcccaagaaaaataattggagtaagaggccagactacactttccaaagttttttgtggggag

SEQ ID NO: 6796027 - DNA, 84 bp, Homo sapiens
atttactttagctgagaacctcatgaagtcatttcaaagttggtcattcattgagggatttacagaggtgggtcgtaaagagat

SEQ ID NO: 6796028 - DNA, 68 bp, Homo sapiens
cagccaagttccctttctttgccaggaaaggcatgggaccacttcaggggaagaaatgggaacagctg

SEQ ID NO: 6796029 - DNA, 78 bp, Homo sapiens
cctggcgtgggagggttgggctgggcatgggccacggctgcccccacagagcccacccagctgagccgctcacccagg

SEQ ID NO: 6796030 - DNA, 60 bp, Homo sapiens
tttggtgggaaggcaagatgaccagcttttgagttgagtccagctctgcctcttactaga

SEQ ID NO: 6796031 - DNA, 64 bp, Homo sapiens
tgtcctgacgtgcacaggaggccaacactaacaggcagaaacttttaaccggcatgggagggca

SEQ ID NO: 6796032 - DNA, 81 bp, Homo sapiens
ccatcagtctgagtagtctggagttttcctctgagagtcataggcattagaaagaactttagatatcatgtgtcttgatgg

SEQ ID NO: 6796033 - DNA, 100 bp, Homo sapiens
ctgtctgctctgccctgcccagcctggccttggagaggcacggccctttccttaggggtttggaggcttcctaggaccaggtcaatgggtcagagcccag

SEQ ID NO: 6796034 - DNA, 63 bp, Homo sapiens
tcagctgggaggtcttggagaattttgcagagagagaggatgtggctgagacttctgggctga

SEQ ID NO: 6796035 - DNA, 56 bp, Homo sapiens
tcttagatgggatcccactcagctacactacctgctggctggggccttagataaga

SEQ ID NO: 6796036 - DNA, 81 bp, Homo sapiens
taagtgaattgatcacaggaaaaattgcctctcaggtttcttgctttagcaatgggatggagagtgcgattcattcattta

SEQ ID NO: 6796037 - DNA, 62 bp, Homo sapiens
tcctaaagattgcaaatcattacaaaggaaagtttccagttcttttctttgtttgcttagga

SEQ ID NO: 6796038 - DNA, 96 bp, Homo sapiens
cagggtgaggccttgggggaaacaacggtctgcgcgggagatcagcgatggctgaagaatccctgaggatggttgtatttaaatggcttcatcctg

SEQ ID NO: 6796039 - DNA, 78 bp, Homo sapiens
gagactgaggctgctgtgaattttttaaatgccttgggtccaggtttttattagtcacagttagctgccaaatgtttc

SEQ ID NO: 6796040 - DNA, 68 bp, Homo sapiens
gggaagctttgaaaatggtaagcatgatattataataatagccaagctccttcatgttctggcttcct

SEQ ID NO: 6796041 - DNA, 83 bp, Homo sapiens
gactgcaagcaggctagattgaagggctggtcatactttcatcaccccatgtcccgcagcctggccagtttcaccccatagtt

SEQ ID NO: 6796042 - DNA, 59 bp, Homo sapiens
ggaaagagcccagcagtgcttgccactttcttagactgagaagtaaggtgggctcttcc

SEQ ID NO: 6796043 - DNA, 72 bp, Homo sapiens
ggtgcaacctgagcgcgttgctttctaagtctcttttacatctcttagaaggtagacgtgttcatgggaatc

SEQ ID NO: 6796044 - DNA, 104 bp, Homo sapiens
gagttaaatgtaaaatgtgaaagtggaatctaagagttaacatcaagaacagtgctagttcaactgttctaactttcaaggtcctttcacttattgcaaaactt

SEQ ID NO: 6796045 - DNA, 69 bp, Homo sapiens
ccttgaagagaagatgagggacaacaataacctttgttactgacttctattcctgtcctctctttcagg

SEQ ID NO: 6796046 - DNA, 81 bp, Homo sapiens
tgatggcattgttgaaaggaatgggctcagaaggatctcatgaatttgaattctgacagtcttttccccagcaatctttta

SEQ ID NO: 6796047 - DNA, 76 bp, Homo sapiens
ggggacatggggatcagactctgggatgtagcagtaaaaactttggctgtgacactttctttttggtgtcttcccc

SEQ ID NO: 6796048 - DNA, 62 bp, Homo sapiens
ctgggctaattaagcacagctgggtgtacatcagccccagtcaagtgtgacgattaggctgg

SEQ ID NO: 6796049 - DNA, 97 bp, Homo sapiens
gaaactgatagaaagggcagcttcacaataatgtccatcctctcttctttggagggtgcattttaccctgtgtatagctgctctccagcacagtttc

SEQ ID NO: 6796050 - DNA, 58 bp, Homo sapiens
ggtcagtagaaatttgaccaaaattgcctcagactggttggttgaatttttagtgacc

SEQ ID NO: 6796051 - DNA, 96 bp, Homo sapiens
gcagttattctgttcgtttctctctgttgtcccagacctgcacatcatctggcactggataatcacagaggagcatcccatcagaatgattcctgc

SEQ ID NO: 6796052 - DNA, 103 bp, Homo sapiens
aatctatgtttactaagtgagtctattggtctgcaggcagttttctgtaagcatatacccaggattctgtctgttgaccatagtttgctgattgagccagatt

SEQ ID NO: 6796053 - DNA, 57 bp, Homo sapiens
tttcaacctatcccaaaaagtgattgtccatttcagggcagggcaagggatatgaaa

SEQ ID NO: 6796054 - DNA, 80 bp, Homo sapiens
agtttgaagtaggatggaatgcaaatgtgtcaggcacacacacacagtctcacacactgttgctcatccaggcacaaact

SEQ ID NO: 6796055 - DNA, 93 bp, Homo sapiens
ctctggaccaaaatttctcaagttccttagccttagggcttcccatgctggagcctcaggtgtaggggatgtgacaaaggacatgctccagag

SEQ ID NO: 6796056 - DNA, 71 bp, Homo sapiens
atttcttgttctcctcatttagaggtttttattgaaatcaatgtcccttcaaaatgatgaaaggaagagat

SEQ ID NO: 6796057 - DNA, 89 bp, Homo sapiens
cttgcctggctcccttctcggggttcccgcgcccttctccgcccagggcagcagcgcgcggggcccccgggagccgaagagcaggcggg

SEQ ID NO: 6796058 - DNA, 94 bp, Homo sapiens
cccttcttagtagtatcttggtggtagagtaattcctgatgactaactactggaaactagtcactcatattatctctccacactacataaaggg

SEQ ID NO: 6796059 - DNA, 66 bp, Homo sapiens
ctcctttatctgaaacttttgggaccagatatgttttggaactcagaatttttcaaatcttagggg

SEQ ID NO: 6796060 - DNA, 71 bp, Homo sapiens
tttcaaaactctggattttagatcagggagtcagattgtgagagacccatgtcagaggtctagagaggaaa

SEQ ID NO: 6796061 - DNA, 56 bp, Homo sapiens
ccaggctgcagtcaaggggcattgggctaacccaccaccctggcaggcaagcctgg

SEQ ID NO: 6796062 - DNA, 61 bp, Homo sapiens
ttattagtgctttgttattttaatagagttatatttctagtggaaaaatgtggcctagtga

SEQ ID NO: 6796063 - DNA, 63 bp, Homo sapiens
actggtcagattttacttcccattagatgggcttctctgggacaaaagacgaatcggaccagt

SEQ ID NO: 6796064 - DNA, 86 bp, Homo sapiens
gggcagaatctgactttccctcagcccagggagactacagagtctgaagtcacccaggtgtgatggatgagctcagacccttgctc

SEQ ID NO: 6796065 - DNA, 100 bp, Homo sapiens
tagcccttcctgaattgatcctcagagctgaggccagggacaggtaagactacaaggtgcttgtgtggtcccagctttggggagcaagcagaagggactg

SEQ ID NO: 6796066 - DNA, 56 bp, Homo sapiens
gatcaaatatgagaaatgtcaggtgtggaataagccctgacagaaaatatttcatc

SEQ ID NO: 6796067 - DNA, 60 bp, Homo sapiens
catttgtaatactgacttgcagaagattcaaatagctagctgcaaggaagcaggcaagtg

SEQ ID NO: 6796068 - DNA, 72 bp, Homo sapiens
catcagcaggtgttaattgttggagcaagtggcatctcactactcaaactatggatgataatctgctggctg

SEQ ID NO: 6796069 - DNA, 55 bp, Homo sapiens
gtgcaggctgggaagagggacaacttccaagtcctccctaaatcctagactgtgc

SEQ ID NO: 6796070 - DNA, 88 bp, Homo sapiens
ctgagggaaatgcctttcttttccatatgtatatagctgttatcttaataaagctgttattgcattgggatatttgcattgatttcag

SEQ ID NO: 6796071 - DNA, 97 bp, Homo sapiens
acctctctactgatcactgaagaacctatagcatgagtgagaaataaaccttattgtttcaaaccactgaggttctgaggttgtttgttaggtaggt

SEQ ID NO: 6796072 - DNA, 96 bp, Homo sapiens
gcttttcttgattgtaactttcagataaaaattccaggcagaaatgtgagtgattcctatttacatgcagtcggaatgaaagctacttaggaaagc

SEQ ID NO: 6796073 - DNA, 57 bp, Homo sapiens
ggccagtgttgaactttccctggcaatacaacccgtaatgttagtcagcttctggtc

SEQ ID NO: 6796074 - DNA, 56 bp, Homo sapiens
agctgagtgaccatcttggctcttgctatgtgtatagctttgaaagtgattcagtt

SEQ ID NO: 6796075 - DNA, 76 bp, Homo sapiens
agctgacttctgtgtctttcacaaaggttgacttcagttcagaagttactttatgtagaagaaatcatggtcagtt

SEQ ID NO: 6796076 - DNA, 57 bp, Homo sapiens
cagctgcccaggccacctggagcaaaggtaagaagctgtcccaggggctgggggctg

SEQ ID NO: 6796077 - DNA, 129 bp, Homo sapiens
cttttgtcctgtgtagctggacccctccgtgggttccagaggccctgtaaggtgtggagatggaggctggccccgagccacagatggtggtgggacccaggggtggtaaagtttaacagagactaaaag

SEQ ID NO: 6796078 - DNA, 73 bp, Homo sapiens
gtgctttaataagatttcactttcatttccctgagtagctatgttctggggcctgtgaatcttcttggagcat

SEQ ID NO: 6796079 - DNA, 66 bp, Homo sapiens
ttatttaaactctttgaacctcagtgttctcatctgtgcagatgatgctcacttcagagaagatga

SEQ ID NO: 6796080 - DNA, 87 bp, Homo sapiens
tcatgtattgagtgctccagtggactgggggaggcaggcctgcccgccatggccaccacccagccactgcatagcttgccaaactga

SEQ ID NO: 6796081 - DNA, 74 bp, Homo sapiens
aggtggatgagattaaagtgaggttccctctggaaatattctaatgtaaccatccagcctccttcctctcccct

SEQ ID NO: 6796082 - DNA, 96 bp, Homo sapiens
ggtgacaaggaaagatgttttataatagaatcttcttcatatcagcaattttgatgcagatgttcctactgtgttacgtagactttctgatgatcc

SEQ ID NO: 6796083 - DNA, 58 bp, Homo sapiens
gaaggcttagaaacaagggagctgggagatctgtccgggcttttggaggaagctcttc

SEQ ID NO: 6796084 - DNA, 63 bp, Homo sapiens
ttctttttcttattcccacactgggatattatgtccctggtgcggcatgattgagcagatgag

SEQ ID NO: 6796085 - DNA, 67 bp, Homo sapiens
taatccctgaaacataatagatgcccagtaaataactgacaggtgtacacagtgttattagagatta

SEQ ID NO: 6796086 - DNA, 94 bp, Homo sapiens
tcttggaagtgacaatcatcacctctgtagtattcaaacaaactaacactgatacaatgtgcaagagaactacacagggatgtgactaccagga

SEQ ID NO: 6796087 - DNA, 73 bp, Homo sapiens
gatattcgatgattgtttcctatgtacacctggtcctagattaggtatatgaagatgaaataacacaaatatt

SEQ ID NO: 6796088 - DNA, 71 bp, Homo sapiens
ctgagggggtccagtcagccttccaggtacatcctgaacacagaagcagctaggatcttcattttcatcag

SEQ ID NO: 6796089 - DNA, 67 bp, Homo sapiens
ccacatgaactttaccatttaggtaactctagcaataagatgttctctttgtggtaagtatcatggg

SEQ ID NO: 6796090 - DNA, 121 bp, Homo sapiens
tctgccatctagctgccctgcgtattgcctgccagtgggtagttggagctgggtatctctccaaagctgggctcttggctgccctttgtgaaggcaattttaagggacagcaggatgtgga

SEQ ID NO: 6796091 - DNA, 85 bp, Homo sapiens
ccctcctccacccaattattcctgttccccatcaccacagtaccacctgggtggcaggattggcaggagtgggtaaggggaaggg

SEQ ID NO: 6796092 - DNA, 59 bp, Homo sapiens
aaagacagcattttaccccaacaccatgggatatggtgttggggtaaggttctgtcttt

SEQ ID NO: 6796093 - DNA, 57 bp, Homo sapiens
caggtgtataaactcagtgactccaagcggctacactgagcaatgtttacatacttg

SEQ ID NO: 6796094 - DNA, 64 bp, Homo sapiens
ctgctagagtggctaagcctgcagatgcctctagagaaaggtcctcaggatggcggcctggtgg

SEQ ID NO: 6796095 - DNA, 122 bp, Homo sapiens
ggtccaggtgagggcagggcgaggctgggggcaggcaagtggggagagtgggctggggcgtccaggacctgactgggcctgcctgccttgagaccctgtttctccctacagcgccaggggct

SEQ ID NO: 6796096 - DNA, 105 bp, Homo sapiens
tctgtcaaatattagacaaagatacacttgacctggagtgaagtatcacgaatttttaaacatttaactcctagtgtgtattagtgtgaaactaagttgagcaga

SEQ ID NO: 6796097 - DNA, 88 bp, Homo sapiens
ccaagattattgaaactaatatcacagtagttgtttagttgatatttctggagctatgctgcagttgtggagtttgagtccttcttgg

SEQ ID NO: 6796098 - DNA, 77 bp, Homo sapiens
gggaactcagccacagtggctgtgggtgtaatgccctgaggaggtttacaccattagaagctacttgttgaattctt

SEQ ID NO: 6796099 - DNA, 60 bp, Homo sapiens
ctcctggggccatggaaggaactggttctcccctgagctgttccctcacgtcctgcggag

SEQ ID NO: 6796100 - DNA, 76 bp, Homo sapiens
gcctcacactctgtgattctcatgtaccactgagaacatttggaagcagaagtggaacatgctacaggtgtgtggc

SEQ ID NO: 6796101 - DNA, 58 bp, Homo sapiens
gccagagaggttggggctgcagtgagctgagatcacgccactgtactccagcctgggc

SEQ ID NO: 6796102 - DNA, 74 bp, Homo sapiens
gtagagatggggtctcactatgttacccaggctggtcttgaactcctgggcttaagtgatctgcccccctcaac

SEQ ID NO: 6796103 - DNA, 76 bp, Homo sapiens
tacggaagccctggcatgcatgtccctggctttgccatatacaggcatgctgggactgcagctaagggcatctgtg

SEQ ID NO: 6796104 - DNA, 62 bp, Homo sapiens
tatatgaatttggctggaaaggtcgatgcttggtcaacagaccttgccacaggattcatgta

SEQ ID NO: 6796105 - DNA, 68 bp, Homo sapiens
cagttctctatgaagtctattgtcttattttattagttttctctttaggacaatcctatagtgaactg

SEQ ID NO: 6796106 - DNA, 72 bp, Homo sapiens
caaaagacctgaaatataatctagtaccctttttacctggggatccttggatggatttcagagattctgttg

SEQ ID NO: 6796107 - DNA, 66 bp, Homo sapiens
gctgcaaaggtgggggaggagctggcagaaatagagtccctagctgctcacccactttttagcagc

SEQ ID NO: 6796108 - DNA, 68 bp, Homo sapiens
aaccaggaaaagttatgaatagaagagctgggggcacttgtccctcaaaatagttatgattcctggtt

SEQ ID NO: 6796109 - DNA, 59 bp, Homo sapiens
tcaggaggatgtcggcaaatttaaagggacaggatttattttgtcgccatcttccttga

SEQ ID NO: 6796110 - DNA, 79 bp, Homo sapiens
gtctccgctgagtgacatttgcaccagctgcttccaaagggagtagctttggtgaaatgtcaccggcttcagcggggat

SEQ ID NO: 6796111 - DNA, 75 bp, Homo sapiens
ctgcttcatacagtgcacatttcttaggaaagaataaactatgattagctaagaggtctgtattagtcagggtag

SEQ ID NO: 6796112 - DNA, 72 bp, Homo sapiens
gctttcagttgagaaggtgatgttcattggaaaagtctccaagtcattcattacccttcattacttgagggc

SEQ ID NO: 6796113 - DNA, 56 bp, Homo sapiens
caagtgtaacctttcctgctaaaactcttcttgggtctggcagcattggtaccttg

SEQ ID NO: 6796114 - DNA, 67 bp, Homo sapiens
gaagttcacaccaaagttaggtagggtcagggacacccttccaccacctgcttgtggggtgaggttc

SEQ ID NO: 6796115 - DNA, 125 bp, Homo sapiens
cctgggagcctgtggctactgatcctattgcctcggtcatcagccctcctgttttcctaggtgacatagagggcttgtagggtggctgtagggtggtggaaaaagaagcagaactgaattccagg

SEQ ID NO: 6796116 - DNA, 68 bp, Homo sapiens
gtcactcaggctggagttcagtggcaatcacagctcactgcagcctcgaactcctagcctcaagtgat

SEQ ID NO: 6796117 - DNA, 92 bp, Homo sapiens
ggttttgggttggtggacttcattttctttcacgctgctgcttgcccagtgggtgtagacagcaagaaaatgaagaaaatcagtccaaggcc

SEQ ID NO: 6796118 - DNA, 72 bp, Homo sapiens
tccagaaggggaaatttggcttccccaggaaccttcactgtctttctcaagtcaattcttttgctttctgga

SEQ ID NO: 6796119 - DNA, 73 bp, Homo sapiens
ctcctggctttcccagaccaggtccaacatggttcccaccctcccaacgtttcctgggggagaagccgaggag

SEQ ID NO: 6796120 - DNA, 86 bp, Homo sapiens
gcacttttcattatttttatcagagaaatggagggcgcttacactggtaagtgctttaaaatttcctgagcaatgatcctaagtgc

SEQ ID NO: 6796121 - DNA, 72 bp, Homo sapiens
ctctgttcctgttcctggcattgtcagcggccaggcgccttggctgggaatgtgggccggtgaataggagag

SEQ ID NO: 6796122 - DNA, 57 bp, Homo sapiens
tggcaagaaactgaggcctgctgtcaacagttagcagggaaccaagaccttttgcca

SEQ ID NO: 6796123 - DNA, 56 bp, Homo sapiens
tccagagaattctacgcagtgctgttacattgttcagctgctgaattagctctgga

SEQ ID NO: 6796124 - DNA, 66 bp, Homo sapiens
agtccactgccccagctcctcgtgtgtcttttgaacacattagtattgtgctgtgcagaaaggact

SEQ ID NO: 6796125 - DNA, 94 bp, Homo sapiens
gctagggacattgtactgagacattatgacaagtggatgctgattcatgcccagatctcaagttttctcataatctcttccaataacacttagc

SEQ ID NO: 6796126 - DNA, 61 bp, Homo sapiens
gattaggacatggatgtatgtttggagggccactattcaacctgctacacttgtcctaatt

SEQ ID NO: 6796127 - DNA, 59 bp, Homo sapiens
gtatgtcctggacatttcccaagagcaaaaatgcagcatgagagagtagcaggacatat

SEQ ID NO: 6796128 - DNA, 60 bp, Homo sapiens
gtgagaaaccttgtcctgccctcaggagctcacagtcctgggtgagacaggcttctgcac

SEQ ID NO: 6796129 - DNA, 78 bp, Homo sapiens
gtggtggtgtctggagtcctaggagtctagaagtgcctttcagtgggtcttgaaggacatccagtccacactctccac

SEQ ID NO: 6796130 - DNA, 75 bp, Homo sapiens
atgctaccttgcaatgttgtgaggatttgtgttaatattaatagatatagagttcttagcataatgctggtacat

SEQ ID NO: 6796131 - DNA, 72 bp, Homo sapiens
tttccatctcttcttttgcttccctgactttgccatgagaacacgtccaggctagcctggtagagaatgaaa

SEQ ID NO: 6796132 - DNA, 61 bp, Homo sapiens
taaggaactcaagagaggagcgtttcctcagaatgctttctttagctcctgagtctcctta

SEQ ID NO: 6796133 - DNA, 69 bp, Homo sapiens
cagccgcctcttctgcatcctgtcaactctgattagttagagtttaggctcaaaagagttggtggactg

SEQ ID NO: 6796134 - DNA, 56 bp, Homo sapiens
ttctcattctgactcagtgtaggccacaccatttgcaagcctgtttagaatgagag

SEQ ID NO: 6796135 - DNA, 78 bp, Homo sapiens
tgtcctccttcccagcctccccacacaagaggcacacagctgtgtgtgggagcacgggctgttgggggagaggggaca

SEQ ID NO: 6796136 - DNA, 128 bp, Homo sapiens
atgctggctctccaagctgggacagaagatagggtcagttcccacttgctctccacgggcgcgggcccagcagagaggaggtggccctgtcttgagagcccagctgccttttgtcgagggccagtatt

SEQ ID NO: 6796137 - DNA, 82 bp, Homo sapiens
ggggtcttcttggggcagcccaggctgagcctctccccctgcgacctgctcctggccgggctgctcctggatgaggtactcc

SEQ ID NO: 6796138 - DNA, 66 bp, Homo sapiens
ttccagctggggagacagccattaatcaaataacccctaagtgggtgtttaattacagactgagag

SEQ ID NO: 6796139 - DNA, 77 bp, Homo sapiens
tgtccgcaaagagccctccatcagtgaaggagacagattcatgaggattacaattcaggttgataagggctgggaca

SEQ ID NO: 6796140 - DNA, 88 bp, Homo sapiens
gggattgggggtagaagtggaaatttgattacttgagttattgaaatgattcagaatggcaaacttctagaagtactcccaatttccc

SEQ ID NO: 6796141 - DNA, 72 bp, Homo sapiens
ctggggagcccgccaggtgcctactccgtgcccggcccaaggggaggggcagcacccagccggttctcccag

SEQ ID NO: 6796142 - DNA, 69 bp, Homo sapiens
ctgccttaaatgtgtgtgtccaagtgtcttagaaaaagagaaaatttaaagagacacacatataggtag

SEQ ID NO: 6796143 - DNA, 110 bp, Homo sapiens
gagaaagacctctgaccacacagttctgtctagtcccaacagcttacaaggaaccagaccggtccctgcggtgtttgttgagataaaacaaggtcagggtttggcttctc

SEQ ID NO: 6796144 - DNA, 103 bp, Homo sapiens
catagacttgaaaactgtgtagaaacagaaaactgtaatagtatggacatggtgtaatattgttaattaagagttttttgtatttatactgtttataactgtg

SEQ ID NO: 6796145 - DNA, 62 bp, Homo sapiens
aatagggatgactatgattcccacctcatgagttaggaggattaaatgagatcattcctatt

SEQ ID NO: 6796146 - DNA, 76 bp, Homo sapiens
gggaagcagggccagtaccaggtgggtggggagccaggcctgccctggccagcctggtgcttgctcctgagcactc

SEQ ID NO: 6796147 - DNA, 90 bp, Homo sapiens
tggggcaatgctggaagcggacgttgtggggtgtttggtggcttctcagaactcattggccatgtccaacccccttctcttcatgcccta

SEQ ID NO: 6796148 - DNA, 84 bp, Homo sapiens
tgtcacaagaagtatttcattaggaaaaaatgtactaataatatgccaaagttttcatgaggaaatactgcccatattgtgaca

SEQ ID NO: 6796149 - DNA, 79 bp, Homo sapiens
gatccccagttccatttctgcagccacgagtcacagcccaggtgcgtctgagctttgtgctggtaggtggtctgggatc

SEQ ID NO: 6796150 - DNA, 91 bp, Homo sapiens
ctgatgttctctgtctggctcctggattttccggctctttttagcatatctaaccggaaggactccaggaagcaacagaagagtgcaaaag

SEQ ID NO: 6796151 - DNA, 77 bp, Homo sapiens
gcaattccttctgaagcctttgtgtttggcatcgctaggcagcccagggtcagcataaaggcactagaaagagaggc

SEQ ID NO: 6796152 - DNA, 94 bp, Homo sapiens
gaaattccaacgaagtagtgattctgttgttttatacatctttttgccaaacatcaagaatgattacaaagcaacgaatgatacattgtatttc

SEQ ID NO: 6796153 - DNA, 63 bp, Homo sapiens
gcaagaaaggcaggctttcacatctcagactaccctgagagcaaaggttagctcctttcaagc

SEQ ID NO: 6796154 - DNA, 74 bp, Homo sapiens
gctagtgtttattaatcatgagggctctccttctgtgtattgttctcagggaccttatgaataaaaatgctggt

SEQ ID NO: 6796155 - DNA, 79 bp, Homo sapiens
tccatggctgtttctcctgcccagatgcctggggtaccgctgccccatggagctaaaggaggagcaaactgccatgaga

SEQ ID NO: 6796156 - DNA, 74 bp, Homo sapiens
gcgcagccatccaggggtaccctggagcccgacagaagcagggccgggctccagatgtcccctggcaaatgcgc

SEQ ID NO: 6796157 - DNA, 74 bp, Homo sapiens
gggggtttggatttcagcatatggattttggggggacacaaatctttcagtccgtaatagttggcctcctccct

SEQ ID NO: 6796158 - DNA, 73 bp, Homo sapiens
tgctttaagccagttccacttttttatccctgctctgatacagtcagaggacaatagaatggaaaggcgggca

SEQ ID NO: 6796159 - DNA, 62 bp, Homo sapiens
tctttcctccacccagtgtttctacaggtgtgatctgcaagttgatgtgggggaggacatga

SEQ ID NO: 6796160 - DNA, 68 bp, Homo sapiens
ggaggtgttggggaagagccagtctccgaagccagctatgccactgtctgtctcccaattatgcctcc

SEQ ID NO: 6796161 - DNA, 55 bp, Homo sapiens
gcgcaggtccagtctgctgttgataatcaattttcagcttcttctgtgacctggt

SEQ ID NO: 6796162 - DNA, 56 bp, Homo sapiens
ttgtacacacaggaacaaacgttgaagaatgacatcagaggttcctatttgtacaa

SEQ ID NO: 6796163 - DNA, 90 bp, Homo sapiens
gggcacagggatgggggaaacacaggagatatgtaatggctcagagttgagactccagagccagttctcttgtgttttattcccaggccc

SEQ ID NO: 6796164 - DNA, 128 bp, Homo sapiens
atgactggcatcacttctgagttgcctctgcacctccagagctctgggcatagctgaagagtacaaacatcaacagtcttgtccccaggctctccagaggcagcatctgaaaagtgtgatctggtagt

SEQ ID NO: 6796165 - DNA, 73 bp, Homo sapiens
acatttttcccttagaagatggagggtggggtctctgggagttgtcctttcttttctatgggcccagaaatgt

SEQ ID NO: 6796166 - DNA, 73 bp, Homo sapiens
tttactcattttttaactaccagtgcctgtagaaaactaagcatatgaaatatgagttgaacaaatgagtgga

SEQ ID NO: 6796167 - DNA, 89 bp, Homo sapiens
tcatatttagcacttgctggtggcatttacagtttgccttctagccattggaatgcacacccagaaaaatccaattgctgaggttatga

SEQ ID NO: 6796168 - DNA, 68 bp, Homo sapiens
gcgtctagtcacatggaatgtggagcagagactatgctacatcttcaccacattctcattctgactgc

SEQ ID NO: 6796169 - DNA, 78 bp, Homo sapiens
tgtggtacggtgggcttcctggagcctgtgctctctaattgtcttagtggctaagagcatcaggagtttgcagccaca

SEQ ID NO: 6796170 - DNA, 80 bp, Homo sapiens
gcatagtctgagaggatttagaaggtgtcattgacttggaattacagttctttgttacagaatgaatttccggaccatgc

SEQ ID NO: 6796171 - DNA, 75 bp, Homo sapiens
ttatgtaagaatcatatttctctctgtgcagatcacttacagaagtgtctgttaacaggagagaatgatacataa

SEQ ID NO: 6796172 - DNA, 78 bp, Homo sapiens
atccctcatctaagacaatgagtgagactcatgaaaggctttttatgtggcatgggctcctcatctaagatgatggat

SEQ ID NO: 6796173 - DNA, 60 bp, Homo sapiens
ccccaggacacatggaccaagtcactgcggccgtacttggccctgaatctgtcctggagg

SEQ ID NO: 6796174 - DNA, 62 bp, Homo sapiens
caggaacaactcccagcatctcagaatcaaatctccactcctggatgctctagtctttcctg

SEQ ID NO: 6796175 - DNA, 70 bp, Homo sapiens
cgagaaattggtgatctgtcagtcttgaagtaaagatttagtagacttggctagtcactgtatgtttttg

SEQ ID NO: 6796176 - DNA, 56 bp, Homo sapiens
gccaggtgcacctgccctggccaatggtggacaggtggccatggcatcgcctgagc

SEQ ID NO: 6796177 - DNA, 63 bp, Homo sapiens
cactgagctaggagttaggaagctggactgcctgtccaggctttctgactttagactctgatg

SEQ ID NO: 6796178 - DNA, 64 bp, Homo sapiens
tgaagctcagcaagattaagcagcttgcctgaattcacccagctgatggttttgctgagactca

SEQ ID NO: 6796179 - DNA, 69 bp, Homo sapiens
atataaactaaatgacttccagtggttatatctgtggaataagattatggagaagtcatttgtttttgt

SEQ ID NO: 6796180 - DNA, 67 bp, Homo sapiens
cggttggctggcgggggtcggaagggccccgggcacactggggcgcgtcagttccccgcctcctccg

SEQ ID NO: 6796181 - DNA, 55 bp, Homo sapiens
ccgtgcttcttcagatgtgaatgactttattcagagagatctagagggagcctgg

SEQ ID NO: 6796182 - DNA, 58 bp, Homo sapiens
catagatgtgtgtaagtacataagtatacacatatattcatgtagttttatatctatg

SEQ ID NO: 6796183 - DNA, 78 bp, Homo sapiens
cacattcacatttttccctctaaacaccaattaaaattcagaacttctggtgaaatggaaggaaggaagtccaatgtg

SEQ ID NO: 6796184 - DNA, 128 bp, Homo sapiens
cctcataagccagcacacacctccagggattttacattgcagctggtcagggtaattctaattcaaggaatcactccacgggctccagaggtgtcctcccggtgtctttaaaagccgtggccacgagg

SEQ ID NO: 6796185 - DNA, 84 bp, Homo sapiens
ctaaggtactgggcagaaggccaaagatagcacagctgctctgtgctctgttggcttcttttgtcaattgctatgtgaccttag

SEQ ID NO: 6796186 - DNA, 60 bp, Homo sapiens
agtgtagaagggtgtgccaaacagcagacccagctctggcccaaaccctttctagtcact

SEQ ID NO: 6796187 - DNA, 62 bp, Homo sapiens
gccctccctggctttgtcctgaggcagggttatgtaaccagccgggtctggccaggcagggc

SEQ ID NO: 6796188 - DNA, 70 bp, Homo sapiens
gcccagaccagggtcccacagagtctcccacttcctggggatgttctgatgccatgggatccctgggggc

SEQ ID NO: 6796189 - DNA, 62 bp, Homo sapiens
tgcaggctaggccttgccctggaacatggaggccctgcccggggctggggcctagtccagca

SEQ ID NO: 6796190 - DNA, 59 bp, Homo sapiens
gcagagcagtgcttgcccagcgcctccgtggcgggcgctgtgcacgagccactgcctgt

SEQ ID NO: 6796191 - DNA, 109 bp, Homo sapiens
ctgggcgctgagtgtgttccaaggcttctgtgacttcccttagtgcaagcactcccacgcagaggagacctagcttgcattaggagttatgactgctcagcaaactcag

SEQ ID NO: 6796192 - DNA, 97 bp, Homo sapiens
gagctcattgccttccaaggccagtttcttcgcctaatgaatcactgcatgagggcgtgactagggcgaggactgactctgggcaggcctggggctc

SEQ ID NO: 6796193 - DNA, 57 bp, Homo sapiens
gtaaggcttagggtgcctagataatgagtccactatcacccacccaataagtcttat

SEQ ID NO: 6796194 - DNA, 66 bp, Homo sapiens
ggccaggccccagctgtgcaggccccaccctctcttggccacctccaccccagctgaggcttagcc

SEQ ID NO: 6796195 - DNA, 61 bp, Homo sapiens
ccagagtccgtagtgtttacatgagggttcactcttggtgtcatacattctatgggtttgg

SEQ ID NO: 6796196 - DNA, 86 bp, Homo sapiens
aaatctccctcagacacactatgtccttgcctgccaaccatggtcactcacattgaggactgaggaggtaaggtttgaagagattt

SEQ ID NO: 6796197 - DNA, 62 bp, Homo sapiens
cgcagagagagatgaagggtgtggaggctgagtcctctaggaacctgacatctctcaatgtg

SEQ ID NO: 6796198 - DNA, 83 bp, Homo sapiens
gtgagatgatgtgtgtgtgttgttttaagctgctaaatttgggagtaatttgttataaagcaatatatataaaaatatagcac

SEQ ID NO: 6796199 - DNA, 75 bp, Homo sapiens
cctatatctttatctctaaatgtcattcttcagtaaaggaaaccatggctcattggagatgtagtggattctagg

SEQ ID NO: 6796200 - DNA, 77 bp, Homo sapiens
ttgtcatttaataatattttcattgagcacctagtatattctaggcattgtagtagacaatatggatttaatgataa

SEQ ID NO: 6796201 - DNA, 65 bp, Homo sapiens
taggctggttttataggtgaaatattactcttggaaaagactggtttttctcatgaaaatgctta

SEQ ID NO: 6796202 - DNA, 61 bp, Homo sapiens
gattgggactagaatgactctaaagtccctttcagctctagaattcaatctgttccacatc

SEQ ID NO: 6796203 - DNA, 130 bp, Homo sapiens
gtgaatggcagaattcgtggatccagagctccttctgtgaagagcagaaccatgtccaaaagtgaaagtggaaaagggtggtcttgtcttcatggcagaatggcctggcctagttcaggctgcggtttac

SEQ ID NO: 6796204 - DNA, 78 bp, Homo sapiens
cagatcagaaacccatactacactatgcatggatgtaggccaaattcacactactctgtgttgtgtggttctgtgctg

SEQ ID NO: 6796205 - DNA, 90 bp, Homo sapiens
ggatgggctgcgtgggtggctgtggcccaggccggattctgtcacactgggtcctctgtccctggggcacggccagccgggtgctcatct

SEQ ID NO: 6796206 - DNA, 62 bp, Homo sapiens
ctctttcccgtcagcttctcagaggtctgcatttaccactgtaaagcgtcacagggaccgag

SEQ ID NO: 6796207 - DNA, 103 bp, Homo sapiens
caaaaggctttgttatttggctttggggtgaagactgttattctcttggcctgaggaaactttcttttgcttcatagtcaaaagaatgatcaaagtagctttg

SEQ ID NO: 6796208 - DNA, 86 bp, Homo sapiens
ttcagtccttgaaccttttccttccctggatgagaagtctgtttaatatactctcaatggggaaagagttggtgagagacactgag

SEQ ID NO: 6796209 - DNA, 58 bp, Homo sapiens
gcccaggatggagaatagtggtgtgatctcagctcactgctacctccacctcctgggt

SEQ ID NO: 6796210 - DNA, 69 bp, Homo sapiens
ttgttcttaacttttgtgtatatgggagagttgactatctcttgtaaatgcacaataaagtaaaggcaa

SEQ ID NO: 6796211 - DNA, 115 bp, Homo sapiens
tctgttcatatttaattataagaactgtcttaataacaaaagctgctgtttttatttcatctttcagaggctaaatgctacttgagattgttctttatgaaatgaaatgaacaga

SEQ ID NO: 6796212 - DNA, 55 bp, Homo sapiens
aactgcttcttactgctgggcaccacataggctggtgcccagcaagagtgcagtt

SEQ ID NO: 6796213 - DNA, 71 bp, Homo sapiens
ggcctcccaaagtgctaggattacaggctgggatcacactgtgcctggccctagcagctttgtcctgtgcc

SEQ ID NO: 6796214 - DNA, 59 bp, Homo sapiens
gggcccctagctttgtcctccaccctcagcactctctctgctggccaggccaggggccc

SEQ ID NO: 6796215 - DNA, 79 bp, Homo sapiens
gtttccaatgtccccatacttctttctcgagtgctagtcaaaagcgacttgcagatggtatggaatgtctttgtgagat

SEQ ID NO: 6796216 - DNA, 56 bp, Homo sapiens
gtaaaatagaataacgtggctatccttaaagatgtcacgttgcttttctgttgtac

SEQ ID NO: 6796217 - DNA, 64 bp, Homo sapiens
ccatgctccctggacctgcatgtccccatcggtgacctacatggatggaggtccaggagtaggg

SEQ ID NO: 6796218 - DNA, 77 bp, Homo sapiens
tgagagacaaagctggaaaaggaggctgggacctggctgggaaggtctgagcccagagatctgagctatgtttgtta

SEQ ID NO: 6796219 - DNA, 61 bp, Homo sapiens
taaacctgtagttgatgtaattgggagaaacaatagctcttgaaaacacagctaaggttta

SEQ ID NO: 6796220 - DNA, 69 bp, Homo sapiens
gacaagtaggttatttttagcaaccaacattatgaaggtgacaaaatgagagaaatagccttccttgtc

SEQ ID NO: 6796221 - DNA, 85 bp, Homo sapiens
ggaaaggtagacattttttaatataagacaatataaaaagagattttcagttgtttcatgagtgtaaagggaactctgcctgtcc

SEQ ID NO: 6796222 - DNA, 74 bp, Homo sapiens
atggtcagcttcccaggctgggggcctgaagttcctgggaggaggtttggaaggcacggtgtggggctgggggt

SEQ ID NO: 6796223 - DNA, 67 bp, Homo sapiens
tctcattttaggtctccttagggtttgtttcttctaagaatttactctgaaatagaggctggtggga

SEQ ID NO: 6796224 - DNA, 76 bp, Homo sapiens
tttcccttgtaagggtggtgaggggaagagattgtctatcttgtccctatcctcatgcaggccaaaatttaggaag

SEQ ID NO: 6796225 - DNA, 55 bp, Homo sapiens
caggcaccctctgaggggaagccagtcctgggcagggtatccccagggtggcctg

SEQ ID NO: 6796226 - DNA, 59 bp, Homo sapiens
gagaaagagacttttggcagaggtcatgtccttgcctcctgccagatgactcctttctt

SEQ ID NO: 6796227 - DNA, 97 bp, Homo sapiens
caaagaaccactcactaaagctttctagttgacagcatgccaggtatcaaagagttcacagtgcctgcctttaacttaaagcatgacaggttttctg

SEQ ID NO: 6796228 - DNA, 62 bp, Homo sapiens
gtccctgacaaggctaacaaaaggcaaagctgtgaagtggcctcatggcctttttaggagat

SEQ ID NO: 6796229 - DNA, 101 bp, Homo sapiens
ggtggggtatagaggggtcagtcatcttcagtactcaggttaaaaggaagcccttcctctctgaaagctagaaaatgctctcctatccctttcacttcacc

SEQ ID NO: 6796230 - DNA, 58 bp, Homo sapiens
atgtgcaattattaagaagagacctgccagattgggttctattgaggtatttgcacat

SEQ ID NO: 6796231 - DNA, 70 bp, Homo sapiens
gccacttgtggacactcgtgatctcccaccctctttcctggtgctggaagtcactgcccacaggtaaggc

SEQ ID NO: 6796232 - DNA, 62 bp, Homo sapiens
gtatgtatttatggagtcctcactatgtatgtcacactggattaggtactatgaatatatat

SEQ ID NO: 6796233 - DNA, 122 bp, Homo sapiens
ggcccctaaatttgtagttcctgggtagggatttgtttgttcggcttgatttctaatctaatttgggttctgggctcaaatcctggccctgacaaggactggctgtgagaccttgggtggtc

SEQ ID NO: 6796234 - DNA, 72 bp, Homo sapiens
tagtcacaatcgatatcatttgaagatacttttctttcttgaaatttgccatctttgggatatttgtgatta

SEQ ID NO: 6796235 - DNA, 92 bp, Homo sapiens
tcacatgtggctttcagatgttgaaaaggaaaagtattcatatataacaatgggaacttttttagtacaattcttgatgtgagccacttgga

SEQ ID NO: 6796236 - DNA, 84 bp, Homo sapiens
aatgcatatataggtaggtgtatatatagtaaactgtatgcttatttctctgtatttatatttgtgtgtgcatctgtatgtatt

SEQ ID NO: 6796237 - DNA, 56 bp, Homo sapiens
aacacatatttttgctgagcatggttctgaaaaccacagaagcaaaagtaggtgtt

SEQ ID NO: 6796238 - DNA, 63 bp, Homo sapiens
gggctgcagcccggcgcgcctgagcctgcgagtccgcgagccagcgagctgcggctgcggcct

SEQ ID NO: 6796239 - DNA, 120 bp, Homo sapiens
atttctttccatctcatgggctacaccttgatctaacattttaatacttgtgcttactttaagacctttttagctgaagatgatggtatatagggtatgtggcaagagatggaagggaat

SEQ ID NO: 6796240 - DNA, 93 bp, Homo sapiens
ctccttgtggtatgcagaggccaaattgatcatctttaggcagagattccttagacatgatcgatgaggctatccatctagcgtaacactgag

SEQ ID NO: 6796241 - DNA, 85 bp, Homo sapiens
ctcattttcagtgcctgtagaatgaaggacaacaggggagcaggccacaaacctgaactccctctgctccttccctgaaagtgag

SEQ ID NO: 6796242 - DNA, 68 bp, Homo sapiens
gccccagaggctggggaaggatacagctagccagaggatcctgtctctcatctcccatcctctgatgc

SEQ ID NO: 6796243 - DNA, 90 bp, Homo sapiens
gttccctctctcagtccctgggaagaccggcagtggggtaggacgccaatctccccagctgctcttccaggctcccctgccagaggaggc

SEQ ID NO: 6796244 - DNA, 63 bp, Homo sapiens
cttacacacttactggagatgaagcacaaaattgcttcaagctttcttgtaggtaatgtgaag

SEQ ID NO: 6796245 - DNA, 71 bp, Homo sapiens
gtttatcattcaccagctgagggacatttgggtgattcccaggttttggtgatcattggagaattttaaac

SEQ ID NO: 6796246 - DNA, 60 bp, Homo sapiens
gccccagggtgctaattaaatatgctaagagtaagattctcgtatctggcatcttgtagc

SEQ ID NO: 6796247 - DNA, 68 bp, Homo sapiens
actgcttattattatgcatagcatgaaatatgcaagtgtatatgcatatgcataatggatgtgcaagt

SEQ ID NO: 6796248 - DNA, 91 bp, Homo sapiens
tagactttggcccagtgatgataggggtaaaggaggaaatttactatggtaaattcccaactctgctcttctttgctaaatccaaggtgta

SEQ ID NO: 6796249 - DNA, 56 bp, Homo sapiens
cgggcgagggcctgggccgagggacccccaatacccaggtagccctctagagcctg

SEQ ID NO: 6796250 - DNA, 108 bp, Homo sapiens
gatccaaaggtttccgtttattcagtgtggtgcacagttttgtaaagttccctattggtaaaatgtcagagctgttactattcatgaattaaattacaactttgtatc

SEQ ID NO: 6796251 - DNA, 57 bp, Homo sapiens
aagacagatttggctatgcacctctgaatttgaaactaacgaagtcaaatctgtttt

SEQ ID NO: 6796252 - DNA, 58 bp, Homo sapiens
aagggatatgtttacagctgttatgtttaccataattagtgactctcacatatgcctt

SEQ ID NO: 6796253 - DNA, 78 bp, Homo sapiens
gcttacctctgtatcacttcatgcttttgccattggtcagtataaacctatgtcagaagctggatgacagctctttgc

SEQ ID NO: 6796254 - DNA, 72 bp, Homo sapiens
ggaactaagggttgcaaggtcagaggaataaagggggctttgtaatacctgagatttaacccttcttattcc

SEQ ID NO: 6796255 - DNA, 71 bp, Homo sapiens
ctcagtactagtgtcaataatttctttttggccaattatggaccagatcagggaatgacagaagccctgag

SEQ ID NO: 6796256 - DNA, 67 bp, Homo sapiens
cagactggagagcgctgagctgctatgggaagcctcacccccatacagcacaaagggcctttacctg

SEQ ID NO: 6796257 - DNA, 68 bp, Homo sapiens
ggccaggcaggcgggtgtgcggcggacggaaggcagagacgcacacgcacagggaggctggcctggcc

SEQ ID NO: 6796258 - DNA, 127 bp, Homo sapiens
ggtttctccctgagttgcctactggtgtatctctggtgtctctatctatgcctgaagttactcaataaatacattttttatgggtggggataactgattcttacaacagtcctataaggtagatgct

SEQ ID NO: 6796259 - DNA, 71 bp, Homo sapiens
gggagggaaataacctcatgcaccatgagggagggaaataacctcatgcaccatgaggttatttctttccc

SEQ ID NO: 6796260 - DNA, 80 bp, Homo sapiens
gaggggaagggtttgaaaaggcagtctcatggataattgattgtattcagtgactttgtccctttcaaatccaactcttc

SEQ ID NO: 6796261 - DNA, 66 bp, Homo sapiens
ccagccaagctcagacggatccgatgatctttctgaatcagagccctctgagcttcagcaggctgg

SEQ ID NO: 6796262 - DNA, 67 bp, Homo sapiens
gttttccttcatatcccttatgtgaaggggcgtgaactttgttgacctagggagattgaaggagaac

SEQ ID NO: 6796263 - DNA, 56 bp, Homo sapiens
ggtgaggggctcctctgcccggccgcccctactgggaagtgaggagcccctctgcc

SEQ ID NO: 6796264 - DNA, 60 bp, Homo sapiens
gggggtggcaccacgtgtcttcaagatgaaatgcctcttggggacaaacatgctactttc

SEQ ID NO: 6796265 - DNA, 61 bp, Homo sapiens
tttagcagctaagtcatgctgcaagttcattctgaccttgcagtcaactctaactgctaag

SEQ ID NO: 6796266 - DNA, 85 bp, Homo sapiens
agaggtacagaggtcaggcagctccaggaatggtattccaggaatctggttttgcttcttagtagctgtgttggctctgacctct

SEQ ID NO: 6796267 - DNA, 85 bp, Homo sapiens
agaaattcctctcttaactcctctcctcctgtaggagtccaaacgtgctttgaagttggagatgggagattcagtgaggcattct

SEQ ID NO: 6796268 - DNA, 94 bp, Homo sapiens
gtaccattaaattttagttattgagaataatgttgctatgagcatttgtatattagctgctgaataaagatatattttcagttctcttgggtat

SEQ ID NO: 6796269 - DNA, 129 bp, Homo sapiens
tctttctctggccccccagttcggttctctctccagacatccactgcctccgcatcaggaacatcgctccactgctgcatatctggggatagggatggaggaatccgggcagccatcatggaggaagca

SEQ ID NO: 6796270 - DNA, 73 bp, Homo sapiens
gactgggggtgctgggacggcagctcaggcaccaggcagggcacagctcaggtcccagctcaggccccaggtc

SEQ ID NO: 6796271 - DNA, 71 bp, Homo sapiens
ttcaattctcgttatttgtggtagttatgttttataacgttgctgtgagtgctgcattagcagatattgaa

SEQ ID NO: 6796272 - DNA, 91 bp, Homo sapiens
gggagttttgtgttggctggagtctggtgctagccagagaatagaaactcaggcagcgctgaaaggcccatctgtgctagcaaggtctgcc

SEQ ID NO: 6796273 - DNA, 56 bp, Homo sapiens
tcattttgtcttctgatccaggtacatccactggattagtttcaaggcagcaatga

SEQ ID NO: 6796274 - DNA, 57 bp, Homo sapiens
ggttgtgtccttacatgatagaaaaggcaagacatttcttctgtaaggacattaatc

SEQ ID NO: 6796275 - DNA, 99 bp, Homo sapiens
gaggtagggttttgctctgttgcccaggctggagtacagtggtgtgatcacaactcactgcggcctcaacctcccaggctcaagcgatcctcccacctc

SEQ ID NO: 6796276 - DNA, 66 bp, Homo sapiens
gggaatttctttcaagttttgacttaaccccagtattgagccaatgatttgaatagagcaggtcct

SEQ ID NO: 6796277 - DNA, 65 bp, Homo sapiens
aggataaaggtcattattcccattttacagctgaagaaatttataagggagaaaatctttatcct

SEQ ID NO: 6796278 - DNA, 106 bp, Homo sapiens
gtattttcatttatactggtatgaaatgattccatgttatattacttagttagcaaaatggtatgcatagtatggtttcatttgagtaaaatataaaaaagaatac

SEQ ID NO: 6796279 - DNA, 59 bp, Homo sapiens
gtttgtaaccagaacagagagtcagatgtaacaagctgactctgggctgcgttgcaaac

SEQ ID NO: 6796280 - DNA, 93 bp, Homo sapiens
gcccctcctgccccagcccacccgcttgccttggtgctcagccctcccattgggagcaggttggggcgagctggaggcccgggctggaggggc

SEQ ID NO: 6796281 - DNA, 82 bp, Homo sapiens
tgttgggttgaataatataatattgccatttttatgtcaaaaatgatcaactatcagcaatgttatgtggttcaacttaata

SEQ ID NO: 6796282 - DNA, 83 bp, Homo sapiens
gactatctgtactttatataaaaggatctgtttggttttaaaatgaattcagtttctgttttaaatagcagtataaaatagtc

SEQ ID NO: 6796283 - DNA, 62 bp, Homo sapiens
ccattctcatagtggtggattgtgatcctgagatagagcatagtctgcgcaactgagagagg

SEQ ID NO: 6796284 - DNA, 78 bp, Homo sapiens
gcctggagattttacaaactgcaggacccaactgaggatctgaaaacaattgagtctggcatattgttgactgcaggc

SEQ ID NO: 6796285 - DNA, 84 bp, Homo sapiens
gggaccagccctgcatacccaggtgtgccagcagggactgggaatcgggccagatgcttggaggacacttgggcggggcctccc

SEQ ID NO: 6796286 - DNA, 95 bp, Homo sapiens
tgctctatggtaatatgcatgtatacatgtgtaaactagacagtgatgtcaaggatataatagcctgtacatatgcaaagtataattctagagta

SEQ ID NO: 6796287 - DNA, 74 bp, Homo sapiens
cttgagatatgcagctggaacttagaggagaggtaaacacctctcagtttaaatttaggttgctgtcatctaag

SEQ ID NO: 6796288 - DNA, 70 bp, Homo sapiens
cggcctgctaggctctggtagagccagggctggaatttccctggccccagatcccagagtctagaggttg

SEQ ID NO: 6796289 - DNA, 75 bp, Homo sapiens
tctcctgcccatgatgcagaatcctagagtgtccgtcaaacttagagggaaccaggtctgatcaaggtcaagaga

SEQ ID NO: 6796290 - DNA, 56 bp, Homo sapiens
gtggtccaggtacccgttgtgggcatcatggccacaggaggaggtgcccgggccat

SEQ ID NO: 6796291 - DNA, 71 bp, Homo sapiens
gatgatgttgagttctgcattaacgaggaaagtatcaccttaattatgtaatagggtaacataacatcatt

SEQ ID NO: 6796292 - DNA, 96 bp, Homo sapiens
agagcagacggcccagaaaagctgctgtttgtccggttgcactttctgccaaattatgcaaatggatctgactggcttttcttctgattttgtttt

SEQ ID NO: 6796293 - DNA, 63 bp, Homo sapiens
tgctgagaggaaggtgcactggggcagggactacataaaattccagcgcccccattcccagca

SEQ ID NO: 6796294 - DNA, 75 bp, Homo sapiens
caaaactattgggtcagaaatgagaaaactgaattctatgcttaagtatttctctgctcctctgcctaatctttg

SEQ ID NO: 6796295 - DNA, 92 bp, Homo sapiens
tccatctgcctcacatataagaaggacgttgggaccaggcgtggtggcttacgcctgtaatcccagcactttggaaggctgaggcggatgga

SEQ ID NO: 6796296 - DNA, 61 bp, Homo sapiens
ccagtttaggacacatgcccaccccttgagccacctctggtggggagtgttctgtgattgg

SEQ ID NO: 6796297 - DNA, 101 bp, Homo sapiens
gcttagtcacaaactaatatgcaagtgaatttcattccaattctttgctttcaacagaattgaaggaggatccaaatgaattgttagccgtgtgactttgt

SEQ ID NO: 6796298 - DNA, 98 bp, Homo sapiens
actgacctattgctttggaactactcttttagccccacagagactgtgaaacagtgttttggtggtctataggaaaggttcaacttggcaaatgtagt

SEQ ID NO: 6796299 - DNA, 66 bp, Homo sapiens
cctcagaaaacagtgaactactctaggctccaaggggcttagtaggagagcttgttcattctgtgg

SEQ ID NO: 6796300 - DNA, 74 bp, Homo sapiens
atggtacctactgatgtgagaatgaaatgaaataatatatgtaaaacatttagagattggcacagaggtgctat

SEQ ID NO: 6796301 - DNA, 85 bp, Homo sapiens
gccagccccctgcaacctcagccccctccagattttgagcaccgacaagcactgggaggaggctgagagcaacttggcagctggc

SEQ ID NO: 6796302 - DNA, 57 bp, Homo sapiens
gagtctcatctctggctgtcagagagtagaaaaagctgagggtcaggacaaggactt

SEQ ID NO: 6796303 - DNA, 70 bp, Homo sapiens
gagtggttagggaatgggtctggaagccagattacctgggtttgaagccaggctctttcacctgctattc

SEQ ID NO: 6796304 - DNA, 76 bp, Homo sapiens
cagcccctctcctcctcggggagtttgacctgcatggccacatcagagtcctcaccctgaggatggacaggagatg

SEQ ID NO: 6796305 - DNA, 127 bp, Homo sapiens
gggggaggaggctgcagctggggttgggggcaccgggagatgtggcttcctctgccctggatgcttcctggggagaggcacagaggcagtcccctaggtgaccccctccccactggcccactttccc

SEQ ID NO: 6796306 - DNA, 61 bp, Homo sapiens
gagacttatgaggcctcagagaaacatgtttcagacagaggagctcgtgcagatcggtttc

SEQ ID NO: 6796307 - DNA, 59 bp, Homo sapiens
gtttccaagatgctgccatcagcggatccaatcttcactgcctgtggcagagtggaaac

SEQ ID NO: 6796308 - DNA, 63 bp, Homo sapiens
cttctctttctcttttccatgttctaggttgttttagtggcctggtggtgaagggtggaggag

SEQ ID NO: 6796309 - DNA, 84 bp, Homo sapiens
gatggtttttgaaggtgggggagacttggtcaagactcaactcttggttctgtctgttctctacaggacttcaagaggctgatc

SEQ ID NO: 6796310 - DNA, 61 bp, Homo sapiens
gctttgctctgcagcagcggagccagtctgcctgctggggagtcgctgcagagcgataagc

SEQ ID NO: 6796311 - DNA, 72 bp, Homo sapiens
gaccaggatcaagactgtggggctgttccatggaaacatgaaaacatactgcagctcccagcttgaaaggtc

SEQ ID NO: 6796312 - DNA, 75 bp, Homo sapiens
catgagcttccagccaaggagataaaatgttgagctgctcctggcagctacattgtaactcctgaagtgcctgtg

SEQ ID NO: 6796313 - DNA, 65 bp, Homo sapiens
aggccgtttctttgcagttctgtatttcagggtcctgaaagttttatatgctgcagcgaattcct

SEQ ID NO: 6796314 - DNA, 86 bp, Homo sapiens
catccatgtgtgtatgtgtaaaatctgattaatactcaaagttaatgagtatatggggaattgcataatctcatatgccactgatg

SEQ ID NO: 6796315 - DNA, 97 bp, Homo sapiens
ggtgcttggcttgcaaggggttaacagtattgctcatgaacttggcctgtctgtctggctcgtgatgaatggtgagacccgctgacaagttcagcct

SEQ ID NO: 6796316 - DNA, 78 bp, Homo sapiens
tgtctgtccagaagttcctaagcatcattgtccttggaagtgattgatttcttggggttactctccactgaccagaca

SEQ ID NO: 6796317 - DNA, 72 bp, Homo sapiens
ttttggctctgaggttgttcttctcagtggcatatctacatttgccatgcaatatatatcctcaagccaagg

SEQ ID NO: 6796318 - DNA, 94 bp, Homo sapiens
tgagtcactgccttctcagccccacacgggcacttggggcaccatcagcatccaggaaagcactgggctgggagggaacaagggttagtggcca

SEQ ID NO: 6796319 - DNA, 89 bp, Homo sapiens
ctatcatctcctttcattccacgtcgtcgtttccagcataagtgattgattaatgcacagaattgacatgggtagaaaggatccgatag

SEQ ID NO: 6796320 - DNA, 106 bp, Homo sapiens
ctgcctatctggcactcaactgtgttgttactgggcaattctgactcctgcacctgccactggtctcttgtccagaacatcggggttgcctgtgcagtcctggcag

SEQ ID NO: 6796321 - DNA, 68 bp, Homo sapiens
gagacgggtagatcacctgaggtcaagaattcaagaccagcctggccaacatggtgaaaccccgtctc

SEQ ID NO: 6796322 - DNA, 62 bp, Homo sapiens
tgaagcacctgcttgtgactagggatttgttggggtcccagctaacagtggggggtgattca

SEQ ID NO: 6796323 - DNA, 72 bp, Homo sapiens
cttggatgctttcagtcagttaagtcatgaaagtaaacactttctgagttaactgactgaaaggtgcccaag

SEQ ID NO: 6796324 - DNA, 78 bp, Homo sapiens
gtctgaaagccaggaggagggcgctcgccagaaccgaatttgccagcaccttgatcttggagttccctgctttcagac

SEQ ID NO: 6796325 - DNA, 70 bp, Homo sapiens
gcctataatcaggaggataagggggtccagcattcgacagtgggactcccagcaacctctcagattgggc

SEQ ID NO: 6796326 - DNA, 78 bp, Homo sapiens
gagtcatattcccagtggggacctctgggtgacaatgtagcacatgcctcagagttgtccctaccaaggaatattttc

SEQ ID NO: 6796327 - DNA, 73 bp, Homo sapiens
ctgcaatgttaagatcacacctggaggatggtatttcctcccaggctgtaagagtgatgttgacaagttggag

SEQ ID NO: 6796328 - DNA, 69 bp, Homo sapiens
gtttattagtttcagggccttttatgtgttgtttagatgaagcaatggaattgttctgaaacttaaaac

SEQ ID NO: 6796329 - DNA, 64 bp, Homo sapiens
aagggtgagagtcaggcagagatttgctttcttgggctttgagtcatgccgatactcatcgctt

SEQ ID NO: 6796330 - DNA, 71 bp, Homo sapiens
aatctatatgcttttcacatacataaataatgacaagaaaacattaggagcagggtggagagcaatagatt

SEQ ID NO: 6796331 - DNA, 57 bp, Homo sapiens
aggtcagatgggagatgggatggggctttgcccatatctaagagtctattctaacct

SEQ ID NO: 6796332 - DNA, 69 bp, Homo sapiens
agccaacagaagaatttctctcatgatttgaatctgatttcagaaagggaccagttcttttgaagggct

SEQ ID NO: 6796333 - DNA, 57 bp, Homo sapiens
acggtcactgcagatgagtcctaagggctgcttcttgggctcagtggcaggaagagt

SEQ ID NO: 6796334 - DNA, 81 bp, Homo sapiens
ggtgattgggctagggaatgaatgattcgtaatcaaagctccgtttgaataagaacagtgtttcatctctaaactatcacc

SEQ ID NO: 6796335 - DNA, 87 bp, Homo sapiens
ttggctgctacaggtagatacatacttctaaaaaagcctaagatcactgttcttagaagttttgatctgtcttgaagaagtagccaa

SEQ ID NO: 6796336 - DNA, 72 bp, Homo sapiens
gtgagtaccaccgtggaggcaccctggccacaagagtgtacaaaatgtctccatggatgatggagaactcac

SEQ ID NO: 6796337 - DNA, 70 bp, Homo sapiens
tcagttctcatcattccttcaaagcccgggaccttctgttgtatcgggctcgaatgctgagagtaactgg

SEQ ID NO: 6796338 - DNA, 63 bp, Homo sapiens
agtctcccctgcagcctggcaatagcttgtagatcctatacccagccccagctgcaggaagct

SEQ ID NO: 6796339 - DNA, 80 bp, Homo sapiens
gagaaatagacaaattcacaattatgttgggagactttgcttcagagtcccacaattatgttgggaaacactcttttctc

SEQ ID NO: 6796340 - DNA, 65 bp, Homo sapiens
ccgtgcccatcgacgcagggatggggacatccctggaccccagcccagcgttcgaggggttctgg

SEQ ID NO: 6796341 - DNA, 55 bp, Homo sapiens
gagtcaggtccgtggacagttaagaagagcttggctaattccatcagcttggctc

SEQ ID NO: 6796342 - DNA, 63 bp, Homo sapiens
ttccacatctggagactacagtttggagtttggagtgagacccatagaaatttagatgtggaa

SEQ ID NO: 6796343 - DNA, 61 bp, Homo sapiens
ctgtggcaggaagggactagcaattggttttttccatgagcagtcctttgtcctgggacag

SEQ ID NO: 6796344 - DNA, 58 bp, Homo sapiens
gatgcaggtgtgccacagagcttctccaagagtgagtgctgtgcaggtgcccctgctc

SEQ ID NO: 6796345 - DNA, 98 bp, Homo sapiens
agaattgggaaaatgatcatacagagccctggtaacagtcatcatcatcatccattgctgtttacaaaggagactctgtatttaaccacccaggatct

SEQ ID NO: 6796346 - DNA, 56 bp, Homo sapiens
gggacattgagatacctccaaagaaaggatatgatttggatgggtggagatgtccc

SEQ ID NO: 6796347 - DNA, 72 bp, Homo sapiens
caggaaatatctcaacactttacatcccaagaattgtcatttgtaagggacactgatgagaaattcttcctg

SEQ ID NO: 6796348 - DNA, 83 bp, Homo sapiens
tgctgaaatgtcctggcacttccactttgctttactgtaagccatcttccagtccaggcctggaggagccatctatctcacca

SEQ ID NO: 6796349 - DNA, 78 bp, Homo sapiens
aggtccttatggcctgcccacagtagtttgggcctgagtgtcacattgaattgggcaggtcatgtaactagaggacct

SEQ ID NO: 6796350 - DNA, 85 bp, Homo sapiens
gctgtgcaggccctccaggcacacagggaatttggctggagagtgccggaagtcgagttctccctgctgtgtctcctgtaccagc

SEQ ID NO: 6796351 - DNA, 59 bp, Homo sapiens
tatctgatgcctgttctgttcatacttgcaatttgtgttaatgggcagtgtgtgagata

SEQ ID NO: 6796352 - DNA, 59 bp, Homo sapiens
cgccgccccccttccctaccttttaatgaattaaaggacaggaaggcagaggggctgtg

SEQ ID NO: 6796353 - DNA, 86 bp, Homo sapiens
gaaaaggtgagattaatggttctcagtgaatctcttgttatattgttttaataatttttattgtggactactgttctggttttttt

SEQ ID NO: 6796354 - DNA, 72 bp, Homo sapiens
ccaggcatggtggcatgcatctgttgtcctagctactcaggaggctgaggcaggagagttgcttgaacctgg

SEQ ID NO: 6796355 - DNA, 104 bp, Homo sapiens
aatgagaaatgtgtagcattggcattgggagcagcagggagatgcggagcctgagattccagttccgtcccctctgaccttgctgatatgcaaattgtttcatt

SEQ ID NO: 6796356 - DNA, 63 bp, Homo sapiens
ccgtgggagtggcaggaaatgggagcgaaagaaagggacttcactctctctccattcccaggg

SEQ ID NO: 6796357 - DNA, 92 bp, Homo sapiens
tggctgagagtggagagagttgtggcatggcagaagggcacaggatgaaggcccctgcacccctgctttgccaccaagctacctctgggcta

SEQ ID NO: 6796358 - DNA, 77 bp, Homo sapiens
tggggataatatttgtactagctcaggaggatttaattagatgagtgctccaaaggttggtcattgttattttgcca

SEQ ID NO: 6796359 - DNA, 67 bp, Homo sapiens
agcagtcattggctaaagctccctctacaatatgtagtaccacctggggatgctgccagtggttgtt

SEQ ID NO: 6796360 - DNA, 79 bp, Homo sapiens
gtgcggatggattgctaatgtggggatttggggggaaatcaaagtgttctcaaatgctgtattgtagtaatacttgcac

SEQ ID NO: 6796361 - DNA, 86 bp, Homo sapiens
ggactatctgaacatttattgcttaaaaaatatgtgagtttgtgagcttatcccagcatttaggcagtaagtgacaagatatgtcc

SEQ ID NO: 6796362 - DNA, 106 bp, Homo sapiens
aggattgtctttgctgtatgtccatggagagaggagcaaaggggaactgggaggcgattgtctcccatgttaggtgtttctgtttcccatgcatttgactattcct

SEQ ID NO: 6796363 - DNA, 85 bp, Homo sapiens
ccatgctgctctagggctctgtgaggttgggcaaatcatatcaccctcctaagccatagctctcacacccctaaaatgggcatgg

SEQ ID NO: 6796364 - DNA, 61 bp, Homo sapiens
aaagggctgtcaaataagcaacggtcaaaaggataagctgtttcttcagttgtcacccttt

SEQ ID NO: 6796365 - DNA, 102 bp, Homo sapiens
aaagcagtgcttcttaaactttaatgtgcttaggaatcacctgcagatcttgtagagctgcaagttcctgggtgatcctgatgttgcggtagagcatgcttt

SEQ ID NO: 6796366 - DNA, 87 bp, Homo sapiens
cttaagtttctatggccatggaatggttgaatgacgaaccatcttcccacatttatatggtttcattccatgctgaaggagaataag

SEQ ID NO: 6796367 - DNA, 58 bp, Homo sapiens
tcattgtattcagaactgaagagacctcatccaagaggtggctgttcaatacaataga

SEQ ID NO: 6796368 - DNA, 93 bp, Homo sapiens
tcctcttcattctttctcactgactgggactcagctggtaggtccgcagatcagtcctcctgggaatttagttgtgagtgaatgtgaagggga

SEQ ID NO: 6796369 - DNA, 110 bp, Homo sapiens
gttgctccatctctaagagactcaggtctacaggccactgatagccaggctgcccagctctaagcactgagcatgagtgggctgtggggtcatatttggagcaaagcaac

SEQ ID NO: 6796370 - DNA, 64 bp, Homo sapiens
tgaggaagttgtttctcttctaaaacctggtcagtagagactggaggagatgactgcttcttta

SEQ ID NO: 6796371 - DNA, 112 bp, Homo sapiens
cactaagctatgccatcactagacacagttgacagggagagggttagtgtcaggtttcaccctggaggtgatcttcaccttgttctttggtcaaggtaaggtaagtcaagtg

SEQ ID NO: 6796372 - DNA, 66 bp, Homo sapiens
gtgctctttcttgctccctgctgtatccatggcaccaggaaacagtgcctggcatggaggaggcac

SEQ ID NO: 6796373 - DNA, 70 bp, Homo sapiens
cttcagatccatcgtctctgatccattggtaatggttctctagggatctgtgttgcgatggattctgagg

SEQ ID NO: 6796374 - DNA, 127 bp, Homo sapiens
tttaatgtttactatgcctcaagcgtttcctttgatgtcagtatcattcctctcattttacaactgaggaaatactgggctcaaaagggttaaatcacttgtccaaggtcacatagatgtcaataga

SEQ ID NO: 6796375 - DNA, 65 bp, Homo sapiens
gcagagagagcagggaagggtctgccctggcaatcaagtcagccaagcccaccctggctcttagt

SEQ ID NO: 6796376 - DNA, 82 bp, Homo sapiens
atcattaccttcaacaaactgttcacgaatgtgtcatatattacttttgtgatgtaagtggaggtttgtagacattagtgat

SEQ ID NO: 6796377 - DNA, 68 bp, Homo sapiens
tcctcagccagtgcattcctggggaagaagcatgtgatctgtgctcaagacccctctgtgactgagga

SEQ ID NO: 6796378 - DNA, 65 bp, Homo sapiens
ggcctgagtggagggattctgcagcagttcatgagacctgctgacatggggatccaccttaggcc

SEQ ID NO: 6796379 - DNA, 58 bp, Homo sapiens
gatgggaaggaatatagaattcctttcagacagaaaccttttatgtcaccttcctgtc

SEQ ID NO: 6796380 - DNA, 88 bp, Homo sapiens
gtagtgaaaattaaattactcaatgcacataaagagcttggaacagtgctgggcactttgttagtgtttgataggttttagtcattac

SEQ ID NO: 6796381 - DNA, 55 bp, Homo sapiens
atcagagctgtgattcccactcttgctgcacggcgggctgaattgcgcctctgat

SEQ ID NO: 6796382 - DNA, 82 bp, Homo sapiens
gctataccagttctttctctgtttctggaatattttttctgtctgtgtcaaattctagttacataaagtggactgttgtggc

SEQ ID NO: 6796383 - DNA, 66 bp, Homo sapiens
agagtaccattactcacttattttttggggccaatgtgcagaatttacagttgctgatggtactct

SEQ ID NO: 6796384 - DNA, 64 bp, Homo sapiens
ttgctgttgcttaagttcaccctaggagcaggaaaaatgagggtgcatttaacagaaacaggaa

SEQ ID NO: 6796385 - DNA, 75 bp, Homo sapiens
gagaggctgtctggaggcactttctcatgacctctcgagttctgatgagttataaggcctcttaccccacccctc

SEQ ID NO: 6796386 - DNA, 58 bp, Homo sapiens
cttttgcagcttctaccactgtttcccttggaaaccaaagtagcagctgcctacaaag

SEQ ID NO: 6796387 - DNA, 106 bp, Homo sapiens
gggagaaaccaggctgccctcccaggcgagaggggactgcagtggcgcttccctcctgctgcgcctcctgcgggagctccgcctaggtatggtgccgcacgtcccc

SEQ ID NO: 6796388 - DNA, 69 bp, Homo sapiens
ggctgagagtgagcactggatataattcattttgattgaaattgatatggtgttattgttcttccagtt

SEQ ID NO: 6796389 - DNA, 66 bp, Homo sapiens
tgtgtgtatgtatgtatgtgtgtgtgtgtgtgcgcatgtacatgcacacctatatacatgtgcata

SEQ ID NO: 6796390 - DNA, 65 bp, Homo sapiens
agttattttatagaactcagcatcctctgaatttgcagtccgtgtgctcattttgtaatgtaact

SEQ ID NO: 6796391 - DNA, 85 bp, Homo sapiens
gtggtaaggccaggctctcactatcctcctagctgttcttccctcctagcccaggaggagggagaggttaattggttttactcac

SEQ ID NO: 6796392 - DNA, 109 bp, Homo sapiens
tgaggagagagtccttgctggatgacagcccacgtgggtctcaggctcaggcgtcttactgactaggaataccatggtggacaggtcagttagccctctctgaacctta

SEQ ID NO: 6796393 - DNA, 76 bp, Homo sapiens
taggtagacaaagaaatgtgttaagtgatgcagattcagacaagataagagtctgttacatttttttctctgcttg

SEQ ID NO: 6796394 - DNA, 75 bp, Homo sapiens
ggttgtggactcaccttgagttagccaccgtcggtgttttcagacacagtccctggcctcaagaagttcaaaacc

SEQ ID NO: 6796395 - DNA, 95 bp, Homo sapiens
aggctacctgtttaagaagaatggaaatatttcataggtaatatgttctaatttctaatatgtcatatgtaatatgttcatttcttaggtagttt

SEQ ID NO: 6796396 - DNA, 89 bp, Homo sapiens
actgcctcttggtgatcccaggtgatcttatttgtatatatgtatatataaaccatggagtagatgacgtggtacagactggatgcagt

SEQ ID NO: 6796397 - DNA, 60 bp, Homo sapiens
aagaaacgtttgagctttgactttgatctcattcagaatattttggttcaaaagtttttt

SEQ ID NO: 6796398 - DNA, 106 bp, Homo sapiens
gtggcgtgcccggcttctctccttggccacctccatgatctcctggaaggaggcattgtcctcactcgtgtagcggctcaggaagacatctaggctgggcagcggc

SEQ ID NO: 6796399 - DNA, 61 bp, Homo sapiens
tctgggcttggaacccagggctgtgtacttaagcttccagtgacaggttccatgccgcaga

SEQ ID NO: 6796400 - DNA, 58 bp, Homo sapiens
agacccttgcagtctggttgtctgtgtaaaaggcattcacgaacatattgcagggttt

SEQ ID NO: 6796401 - DNA, 58 bp, Homo sapiens
tgagacaggatctccctttgtcactcaggctggaatgcagaggcatgatcactgctca

SEQ ID NO: 6796402 - DNA, 64 bp, Homo sapiens
ttcaggaaagctgcggtcacctgtggtttgagaaatgccctctcccagagcagtggttcctgaa

SEQ ID NO: 6796403 - DNA, 71 bp, Homo sapiens
ttgccccgtacttatctgtagaatgatactttagcattgaagtcaattacagcaatgactgtacgtggcaa

SEQ ID NO: 6796404 - DNA, 55 bp, Homo sapiens
gggctcctgtttgcgaaaaagccccaagaatggttcatttccaagaagagagctc

SEQ ID NO: 6796405 - DNA, 59 bp, Homo sapiens
gtcagtggcaggtgtttcgtggtgctaccggacaggcagaatgaccgacctcgccgggc

SEQ ID NO: 6796406 - DNA, 55 bp, Homo sapiens
atccctgaatgctcctgactggtcatacccaacacataggtcagcttcatgggat

SEQ ID NO: 6796407 - DNA, 111 bp, Homo sapiens
tacagaaattgatttgcaaatattttgcaacttacaaatacacttaggagagaaggtctaatttgttcccatttgtattttgtgaatgtgcagattgttaaaatatctgta

SEQ ID NO: 6796408 - DNA, 62 bp, Homo sapiens
tgatctcaagctcttgggctcaagcgacccacccgattgggcctctcaaagtgctgggatta

SEQ ID NO: 6796409 - DNA, 65 bp, Homo sapiens
acctttactctgagttcctacttgctcctgagaagcagaaccaggattttagaaactcagtaggt

SEQ ID NO: 6796410 - DNA, 84 bp, Homo sapiens
ggctggcaccttcctattctgtacacatgacacccaactatcctgagtgtgcaacatgagacagaacagggcccggtggcggct

SEQ ID NO: 6796411 - DNA, 67 bp, Homo sapiens
tgtgcaatagcctggtgttgatctgaaacttctgaaggattctgttcaatacttggcacactgcaca

SEQ ID NO: 6796412 - DNA, 80 bp, Homo sapiens
aggctagagatgaaggctttctcccctctggttggtgttctagctggcctggggagagggccacatttgaactctagtct

SEQ ID NO: 6796413 - DNA, 77 bp, Homo sapiens
tcaccgtattggccaggctggtctcaaactcctgacctcaggtgatccaccagcctcggcctcccaaagtgctggga

SEQ ID NO: 6796414 - DNA, 59 bp, Homo sapiens
ttcattcctttatggatttttctctgtatcagttgagtaaggatctgagatagaatgga

SEQ ID NO: 6796415 - DNA, 56 bp, Homo sapiens
caggttccagttgcagggactttatagattgggaaagtctacaactagggaagctg

SEQ ID NO: 6796416 - DNA, 79 bp, Homo sapiens
ttgtaagccactgagatttcactgcagctctttctaagtaataagagtgaatgtaaggaggaaaattagtggtctagga

SEQ ID NO: 6796417 - DNA, 64 bp, Homo sapiens
tctcatgaggaggcagtaaatcgtgacagtattttcatggcagcactgactgcttttcataaga

SEQ ID NO: 6796418 - DNA, 56 bp, Homo sapiens
ggaggtggtttgatttctatattttgaattatagttcatgcaaccatactacctct

SEQ ID NO: 6796419 - DNA, 67 bp, Homo sapiens
gtggtgtccagcttgctcctctgcaatggactgagggttcaagcaaagtttagctggttaacaccat

SEQ ID NO: 6796420 - DNA, 66 bp, Homo sapiens
aggaagagaggtatagaagcaacacacttttctgaggaagaaaagtctctttacatgtctcttcct

SEQ ID NO: 6796421 - DNA, 59 bp, Homo sapiens
gggtggtggagtaattcgcagaggttgttgtttgatagcctaggaattctcttccattt

SEQ ID NO: 6796422 - DNA, 83 bp, Homo sapiens
cttggggcgaatgatctgatggaagagctaacaatatctacttctcttttgggtgttgtttttgctcccatctgtccctcaag

SEQ ID NO: 6796423 - DNA, 78 bp, Homo sapiens
tggtgttttcaaaagctctcagaggattctgatggcctgccaaggtggagacttctactagagaccttgcagacacca

SEQ ID NO: 6796424 - DNA, 64 bp, Homo sapiens
ccaagtgtcctgcattggctctgcccagatgcaccttccgggctccaggcaggcaggaaattgg

SEQ ID NO: 6796425 - DNA, 74 bp, Homo sapiens
tgggccaggtgtagtggccacacctataatcccagcactttgggaggccgaggcaggctagtcgcttgagccca

SEQ ID NO: 6796426 - DNA, 74 bp, Homo sapiens
ggggcggggcagtgcaggctgggggccctgcggggctgtttctgatggggtccttgacctggccatcccgcccc

SEQ ID NO: 6796427 - DNA, 66 bp, Homo sapiens
agccagtctcagatgtgcgtcagccacaggctccaggggccacgtgcctggccacacctgctggtt

SEQ ID NO: 6796428 - DNA, 71 bp, Homo sapiens
ccgagcccactcgtgctggatgtagtgcagtatccccgggatagtgtactgctgcggccgggacagctcgg

SEQ ID NO: 6796429 - DNA, 91 bp, Homo sapiens
atcagtttactgtgaaggattagtaggtacagttcatatgaatgaaatgaactatttggacagtatctcttattcctcaaaacaaattgat

SEQ ID NO: 6796430 - DNA, 56 bp, Homo sapiens
acaggtttgcagcttgttacctctggcttcccacagccttcatgctgtgcatctgt

SEQ ID NO: 6796431 - DNA, 56 bp, Homo sapiens
tgctctccgtttctgcaacagtctttcagctgttgattcagaaaaagatggagaca

SEQ ID NO: 6796432 - DNA, 60 bp, Homo sapiens
tccatgtggccagacactggcataagaggctgaaatgccccagtggttggaaactatggg

SEQ ID NO: 6796433 - DNA, 70 bp, Homo sapiens
gaaaatacatattcaagaagtaggagttgtatgaattaacttagtttagctcctttgaaagtatgttttt

SEQ ID NO: 6796434 - DNA, 59 bp, Homo sapiens
ctatagctgttttggtgccagtaccatgctgttttggttactgtagccttgcactgtag

SEQ ID NO: 6796435 - DNA, 68 bp, Homo sapiens
ttgtggcacccagaactgagaaaataaatttctgttatttgaagtatttcagcggttctttgttacag

SEQ ID NO: 6796436 - DNA, 68 bp, Homo sapiens
ggatgggtttaaaccaatcgtgattcatcccagggccagggataaattatgattggtctaaaccagcc

SEQ ID NO: 6796437 - DNA, 65 bp, Homo sapiens
tcgaagccttcagtccgttgcagaggagcgagttggacgccactgtggggctctgagggtcctga

SEQ ID NO: 6796438 - DNA, 130 bp, Homo sapiens
gttttaaaacattagtttgaaaattctggatattacttatctatcccctctccaggcctcaaaccaggattatgaagattagtatcatttccagggttttcctctttaattatattgaatgtaacaaagc

SEQ ID NO: 6796439 - DNA, 69 bp, Homo sapiens
gagataggaggattgcttgtggccaggagttcaagaccagcctgggcaacatagtaaaacctccatctc

SEQ ID NO: 6796440 - DNA, 72 bp, Homo sapiens
tagataaactaagcttttcaaaaacatgtttctgactgtgtgacatcttgtggagaggctttggaagatctg

SEQ ID NO: 6796441 - DNA, 76 bp, Homo sapiens
cttgttggtgaatgatagcttctctttggggaacatgtgtgctccctcaactgagaggttgtctttattaagtaag

SEQ ID NO: 6796442 - DNA, 67 bp, Homo sapiens
gctggcctggggtgcaggctggctcatgacctgcctctggcacagcttgggccccatcattctcagc

SEQ ID NO: 6796443 - DNA, 58 bp, Homo sapiens
agcagagcccaggtcctggagagggaggtgcctcccgtccccattcttgggttcccct

SEQ ID NO: 6796444 - DNA, 65 bp, Homo sapiens
gtgctctctcacgtgttacctcctaagggatatcaaatctgggaagcaaatatgtaagaaggcac

SEQ ID NO: 6796445 - DNA, 84 bp, Homo sapiens
ctgtcctcttggcagcagagtgtggtgctcaggaggccacctggcacctgtcagctctgcctttggctgccgtctgagagacag

SEQ ID NO: 6796446 - DNA, 61 bp, Homo sapiens
ggggactggctggcagaggcggtggcagtgagcttgtgtcctgtacgaagccggagaaccc

SEQ ID NO: 6796447 - DNA, 62 bp, Homo sapiens
gggctagcattttgtctgctatttcctaaataatggtaggtaagcaggaaaagtgccagtct

SEQ ID NO: 6796448 - DNA, 62 bp, Homo sapiens
ccacggaggaattctggaatgtggtgatgaccaacaggaattttatgagtgtccctctgtgg

SEQ ID NO: 6796449 - DNA, 61 bp, Homo sapiens
gcctcagacactgcctgggtgtcccctcctaggaccctgccatgtggggcaggtctggggc

SEQ ID NO: 6796450 - DNA, 77 bp, Homo sapiens
agtgaagtacttcttagttcaactaaaatttaacatacatgtttgaattgagtttgagtaagaacagaacttacact

SEQ ID NO: 6796451 - DNA, 59 bp, Homo sapiens
tctttggaacccagcccatcggaactctgtaaagtatgaacatgctgtggttataaaga

SEQ ID NO: 6796452 - DNA, 59 bp, Homo sapiens
tccggcccctttcctaccaaactgtcacacctaggcattggtctgcagggagggctgga

SEQ ID NO: 6796453 - DNA, 130 bp, Homo sapiens
gtccttcgatgccttatcacagcaagtcacgtgaccctgaagtgtataatcctgcaaagggagcttttcaggcttcctcatgtgcaatgcaagcagggcatatgtactcaagactccacccatcccaggc

SEQ ID NO: 6796454 - DNA, 63 bp, Homo sapiens
ggctttatgtttttcatgtggttcagtggactgcatatttgagaggcgtaacatcgtgcagcc

SEQ ID NO: 6796455 - DNA, 79 bp, Homo sapiens
agaagtcgtccagtaggaggttctgaggttctgggtttcgatcaaacgcatcctttatctttcctaggaatacacttct

SEQ ID NO: 6796456 - DNA, 63 bp, Homo sapiens
gcagtatatccattacttcatatgatgatttcgtttaacttgaaaaaagtgatggatgacagc

SEQ ID NO: 6796457 - DNA, 67 bp, Homo sapiens
ttagattacagtattggtcacgtttgtatctcacaagaaactaaaggaccaaaatgctgatgtctag

SEQ ID NO: 6796458 - DNA, 85 bp, Homo sapiens
ggggaaggctcagaagggcaccttcagtcggagggtggagaaccaggtctgggagccttctgcactgaccttttgtcccttcttc

SEQ ID NO: 6796459 - DNA, 130 bp, Homo sapiens
taggaaaataggttgtaacataaattgcaaatgagttgtaacataaaaaatgtaaccttatgcacctttttggagagtcgtttggcaacagtttatgtaacggaaacttacaaaaatatctattcactta

SEQ ID NO: 6796460 - DNA, 57 bp, Homo sapiens
gatcagaatgggacatatcctgcagtacaattagcagagatgggaaatattctgatt

SEQ ID NO: 6796461 - DNA, 57 bp, Homo sapiens
gacccagttataccttcaaggtcccaggactggtgctttggaaaaagtgactggctc

SEQ ID NO: 6796462 - DNA, 78 bp, Homo sapiens
gcagtcagtaaaggatggtgaaatacaagtgtgattgattgtaaaagcactacaatttcgcttcattttaaacattgc

SEQ ID NO: 6796463 - DNA, 88 bp, Homo sapiens
acccaggccacagctcagccctccccctcctggttgcttcaaacactaacccctgtgaagcagaggggtcttgagctgtgatgagggt

SEQ ID NO: 6796464 - DNA, 81 bp, Homo sapiens
agaaatctaggttctcaagaaggatgccagacaactggagacttttctctatgtcagcatctttctaccctgacaagttct

SEQ ID NO: 6796465 - DNA, 65 bp, Homo sapiens
ctgaatttacatgtattttggaaaaagtcctggaaaacttgttcattgagtacatatggtttcag

SEQ ID NO: 6796466 - DNA, 63 bp, Homo sapiens
ggaacttgagcaacactgagtgacactccagagaggctcatgtgagtgtgtgttcaggtgtcc

SEQ ID NO: 6796467 - DNA, 105 bp, Homo sapiens
gcctcagtttttcctgtcttggacctctctgcaggggagctcaagtgtccttatgaatactggcttcctccagagcaggaggtcctggacagggtaagcagaggc

SEQ ID NO: 6796468 - DNA, 64 bp, Homo sapiens
catcaaatctgacttttcttccattctaatgtttataacctggaagattaaagccagtttggtg

SEQ ID NO: 6796469 - DNA, 62 bp, Homo sapiens
tctggttaggcttgtgaggtccccgtagctgtggctgctgcagaggcctcagcctggccgga

SEQ ID NO: 6796470 - DNA, 72 bp, Homo sapiens
tccatcaattatgtgattgatagttaagagataacaaatttatctcttaactggttcagcaatttgatagga

SEQ ID NO: 6796471 - DNA, 57 bp, Homo sapiens
cattcttgaaccaggcactgtgtagggagaccacagtgttccagttggttgagagtg

SEQ ID NO: 6796472 - DNA, 95 bp, Homo sapiens
atatcataaactttagaaaagaaattccacttccgaggctaaagtttgagtaattcctcagtgtagctttggagtgggaggcctttctgtgatgt

SEQ ID NO: 6796473 - DNA, 61 bp, Homo sapiens
agctttgatctagggaggaaggccataggaagatgtgcagtcataaactagtatcaaagtt

SEQ ID NO: 6796474 - DNA, 63 bp, Homo sapiens
gtctctatctgtctaatgggcagcagatcagacaaggtctgtcggctctgacaggttcaaggc

SEQ ID NO: 6796475 - DNA, 65 bp, Homo sapiens
tgctatataattgctagaattcatcactgagtatctgaattacagtgtgtagcaatatgctggca

SEQ ID NO: 6796476 - DNA, 61 bp, Homo sapiens
gggtgacctcacatcccagtgagcccctcaattcagggccagggaggttgattggttaccc

SEQ ID NO: 6796477 - DNA, 83 bp, Homo sapiens
taacgtcaccaaatgctccactgactttggaacttgcaagagcagtgtccctgccgaggcagttggtgtcatggggtgagttg

SEQ ID NO: 6796478 - DNA, 59 bp, Homo sapiens
tattgtaggattcagagccagaccaggccgaccgtaaagtctgtgctcatcccacagta

SEQ ID NO: 6796479 - DNA, 107 bp, Homo sapiens
cagaggccctgtgcccccatattatcctacccaggcagcctgcagggaaggggatttgttccctatgcctgtcactctgcgctgtgtggagggcaatagggcttttg

SEQ ID NO: 6796480 - DNA, 75 bp, Homo sapiens
gacacttgtgctgtttctgagctccggatcttattctttcagtcaaccggtatttactgagcgcacagtcgtgtc

SEQ ID NO: 6796481 - DNA, 56 bp, Homo sapiens
ttctgtgaaactaaagagaggatgattaattcagcctagatgtaggattcacagag

SEQ ID NO: 6796482 - DNA, 66 bp, Homo sapiens
gcttccagttttaggacatgtggatgtaattttatatcgtgtttctcatgttcgttgacttaaagc

SEQ ID NO: 6796483 - DNA, 103 bp, Homo sapiens
gccatgtttttagaaattagatgggaactatagggcttttattacaagaaaaatatgtaatacttttaattccttctgagttaaatgtcaaaaaatacatggc

SEQ ID NO: 6796484 - DNA, 88 bp, Homo sapiens
gagccttgaatgtgtcctctcttaatctcatcttttacagggaagggcattgaggctgagagacattaagagacacttgctcaagttc

SEQ ID NO: 6796485 - DNA, 64 bp, Homo sapiens
cattaaatgccattgtatattcattgatcagtgaaatcacatctgggtcacagtggcatctatg

SEQ ID NO: 6796486 - DNA, 74 bp, Homo sapiens
atttgtctgaggcatgtttgagagagcactgctatcaaagtagtaagtagttccatccaaacagccagatgggt

SEQ ID NO: 6796487 - DNA, 58 bp, Homo sapiens
gtattatgtagtatgagtgtatatgtgtgtatgcatgtatacacatgcagacagatgc

SEQ ID NO: 6796488 - DNA, 81 bp, Homo sapiens
tgacttgggcgaggttaaggaataggccatttagatagctgatattatagataaccaactcctaaatgactttccaaatca

SEQ ID NO: 6796489 - DNA, 78 bp, Homo sapiens
ccacagaagatggggagagtggattgggatggacagtctccattatacatgctattttcttactgtcttgacttgagg

SEQ ID NO: 6796490 - DNA, 84 bp, Homo sapiens
tctacctgttttccttctgggactctgcttccttctccttggtggacagggaggagtcctcaaagtcataggagaagaggtgga

SEQ ID NO: 6796491 - DNA, 55 bp, Homo sapiens
tcctggataaatgctttagttggaagtcactttccctactttatttgtcccaggg

SEQ ID NO: 6796492 - DNA, 76 bp, Homo sapiens
aagcccctcagaaggaagttagagtatggaaatattaataagaatgacccatatttgcttcttgctgataatgctt

SEQ ID NO: 6796493 - DNA, 68 bp, Homo sapiens
gtgtatgtgcatgtacgcgtgtgcacatatattcatatatgtgtgcatgcatgtatatgtgtgtttat

SEQ ID NO: 6796494 - DNA, 80 bp, Homo sapiens
tttaggcatctaaatcactttaatgtatttaagcgcataattagaatgcattagactatggctgatcttaggtgttcaaa

SEQ ID NO: 6796495 - DNA, 87 bp, Homo sapiens
tgatgtgttgtcagatcaatgatatgtatgttgtcaaaaacatgtatgttcaagcaatgattatggcctttataccctagcacatta

SEQ ID NO: 6796496 - DNA, 63 bp, Homo sapiens
ttctctatggcatcaggggatgaagctggtctgcaggaagctgccatccgaggtgtcagagaa

SEQ ID NO: 6796497 - DNA, 129 bp, Homo sapiens
ttctgcatgcccctttgggagatttgaagatgagggtttcaatgggatgaatgttaagctctgggtcaagtgggccctggatttacatcattctgacttcacaagtctctgaggaaaaaagtgcattta

SEQ ID NO: 6796498 - DNA, 104 bp, Homo sapiens
ccttagctttgtagtaatgccctgggattgccttggccttgtctgtaatcagagttacacaatcaaggaaaaagcgagctcggggctgtcatttcaaatggagg

SEQ ID NO: 6796499 - DNA, 61 bp, Homo sapiens
gccttgtttaaatggttgctatcttgcctctgcaggaagccaagcagcgtttaaaaaatgc

SEQ ID NO: 6796500 - DNA, 59 bp, Homo sapiens
gccctgcctctgtggaaatggtggtcgggaagcagccccgcccctcatggaggcgtggc

SEQ ID NO: 6796501 - DNA, 72 bp, Homo sapiens
cgaactcctgaccttgtgatctgcccaccttggcctcccaaagtgctgggattacaggtgttagccaccacg

SEQ ID NO: 6796502 - DNA, 95 bp, Homo sapiens
tttaattctctctctcagtgtctctttctataatctaccatgccaggtgtttgatgtcttggggaaggtaagagggagtgagggaggaaattgaa

SEQ ID NO: 6796503 - DNA, 55 bp, Homo sapiens
ctgcttgactttgataaaattgcggaaaattgcatggatctaagaggtcaaggag

SEQ ID NO: 6796504 - DNA, 78 bp, Homo sapiens
aagtgaattaaaggaattcgaattctggaaggaatgtttttttagctctggaaggattctgatttatttgatttattt

SEQ ID NO: 6796505 - DNA, 57 bp, Homo sapiens
tttgacttctgggcattttggtttctccccaatttaggagaatgcccagaatgcaga

SEQ ID NO: 6796506 - DNA, 68 bp, Homo sapiens
agaggtggagccctgagaaccggaggaaaacatccatcacctccagcccctccagggcttcctcctct

SEQ ID NO: 6796507 - DNA, 80 bp, Homo sapiens
ccagtttttcatgtgccctgccaagaccaagtggttggatggcaagcaagtggtctttggcagggtgaaagaaggcatgg

SEQ ID NO: 6796508 - DNA, 76 bp, Homo sapiens
ggcaagacagcacagtctttcaggtcagggagaaccaagttgaaattctgattctgccacgtactggctgtgttcc

SEQ ID NO: 6796509 - DNA, 83 bp, Homo sapiens
catcagattaatctttatttattgagcacttaatgtataatggacactgtgctaggtgcttgggataagtggaggacatggtg

SEQ ID NO: 6796510 - DNA, 66 bp, Homo sapiens
ttctgagaaatgggttcacatacaccctgccctctaagaatggcgagttgtggagctcactcagga

SEQ ID NO: 6796511 - DNA, 79 bp, Homo sapiens
ccataggagcaaatgctaaagtgtagagacctgatgtgatgataatacaaatgtttttacacattaatttattctgtgg

SEQ ID NO: 6796512 - DNA, 61 bp, Homo sapiens
ctgcgggccagggctgcataatcaaagttagacagttgttatgcaagcttcctggtctcag

SEQ ID NO: 6796513 - DNA, 97 bp, Homo sapiens
gcatacctaggccagcagcacagggcttctgagcaggagtgggaggctcaggtcctctgccctcccctgctcagaactctggtgaagctgaggaagc

SEQ ID NO: 6796514 - DNA, 78 bp, Homo sapiens
cgtgattctgcctgtgccaatgctcctttgtccctgtttaagttggagagaagcctgacactggccatcaggaacatg

SEQ ID NO: 6796515 - DNA, 76 bp, Homo sapiens
gtatctgggtgaagccatatgtcttgaactagacaacagaatgtgaatggaagagacatatgttctttccagatat

SEQ ID NO: 6796516 - DNA, 65 bp, Homo sapiens
gctgggcagctgaggcctctcagtctgtgcctgagcaagcaaggagccctgagctgtccccatgc

SEQ ID NO: 6796517 - DNA, 92 bp, Homo sapiens
tgagtctattttcacccaaaggagcttgctattattcatgttcactggctgctgagtgattcatacgctgctttttgggggagatgtattca

SEQ ID NO: 6796518 - DNA, 62 bp, Homo sapiens
ggcaggcactgtgttttgtgttgagaataaaatcatgaacaaggtaagacccaggctctgcc

SEQ ID NO: 6796519 - DNA, 56 bp, Homo sapiens
aatgcagctgctgacagctttcactaagtgatagtggcttttcttccaggtgcgtt

SEQ ID NO: 6796520 - DNA, 58 bp, Homo sapiens
tctgtccatgcctggaggagaggaggccttcccccttcctccttcctgatatgacaga

SEQ ID NO: 6796521 - DNA, 65 bp, Homo sapiens
ggcttttcccaaatgcaatgaaaattgagttgaattagtctttatacaaactgggaaacatagcc

SEQ ID NO: 6796522 - DNA, 55 bp, Homo sapiens
gcttctccctacagatgtcagtgtctttatattgaagaggatgggtagggggagc

SEQ ID NO: 6796523 - DNA, 69 bp, Homo sapiens
tattgatatttgcatcatgatggtgtctgagccaaagttcttatagaaataatctgatgcaattcaata

SEQ ID NO: 6796524 - DNA, 66 bp, Homo sapiens
caacaacatctccaacctacatccacttgggggacagccagcgtgctgtgggagggagctggcttg

SEQ ID NO: 6796525 - DNA, 59 bp, Homo sapiens
tgagaagctctgaaacagtatcttggtttaggaacttgcagaatcagagcagtttctca

SEQ ID NO: 6796526 - DNA, 58 bp, Homo sapiens
ctccgggtagctgaggccctggaagtagtagtgctggtacatggtctcatactgggag

SEQ ID NO: 6796527 - DNA, 61 bp, Homo sapiens
tccaggcagttttccaggttgtactattcttcggaataagcacaacaaacttgcttaagga

SEQ ID NO: 6796528 - DNA, 89 bp, Homo sapiens
gatgaatgatgggaatataacaggttgtagaattggagaacgttaaatctttgttcctaatggcaaaacatgtttttctcattttcatc

SEQ ID NO: 6796529 - DNA, 56 bp, Homo sapiens
gtggcagaaactggcagaggaggatgctggcagcaccaccgggcttgtttctccac

SEQ ID NO: 6796530 - DNA, 80 bp, Homo sapiens
gtggaatggaaaagtgcagctgaaaacatcctgggggaagcattctttcctagggcagccaaggtacttttcatcttcac

SEQ ID NO: 6796531 - DNA, 92 bp, Homo sapiens
tgttttatatctttctccatctttaaaatgggggtagtggcctgaaggtacaaagaagcatctggtttaaaagaagaaagcaatgaaaaaca

SEQ ID NO: 6796532 - DNA, 71 bp, Homo sapiens
tcttgatgctttttctaaatgtggacaaaatactcttccatcagaatgactttagaaagagcgtgataaga

SEQ ID NO: 6796533 - DNA, 126 bp, Homo sapiens
gagcacacatcaagcgagtctttttctttaggatactgaaaaatgaaccaacagtgcgaatttcaatgttttagttcacagttttatacctgagaggacaaatgcctgaaagacagtgtagtgttt

SEQ ID NO: 6796534 - DNA, 72 bp, Homo sapiens
cagccaatgaggttaatgctgatagataatgtcctatggatattttagaagacagtattgatccattgtctg

SEQ ID NO: 6796535 - DNA, 74 bp, Homo sapiens
gacaaggaaatactcagaaagcaatctggtgaggtgacaaacttcagtctccaatgctctgtgaatttccagtc

SEQ ID NO: 6796536 - DNA, 107 bp, Homo sapiens
gagtaaatctttccaaaaacctagatttttgtgtaaaatgagcctaaagtcaattggcatgctaggcattttatgggaataaattgggtgctttgtgaagtacactc

SEQ ID NO: 6796537 - DNA, 56 bp, Homo sapiens
tcacgttaatatttgtcaggtattctttgagtactggtacttggaggttaatgtga

SEQ ID NO: 6796538 - DNA, 108 bp, Homo sapiens
gggaggatctcagattaaatgtgtacactggacttctgatcttgtgaagaacactgcctagatgcattagtcaggtgacatgtttagtcttagaagaaagagcctcct

SEQ ID NO: 6796539 - DNA, 123 bp, Homo sapiens
atgtgtttccagccacaccaaaaggtgcttggggtggagggctgggggcatagaaggtcaggcctcaggaggcctcaagttcgcattcagctttgccactgtaccaggtgggctgacgcacat

SEQ ID NO: 6796540 - DNA, 55 bp, Homo sapiens
catgcagttgaagcacagagaggggatcctagcctttctgttataaaattccatg

SEQ ID NO: 6796541 - DNA, 67 bp, Homo sapiens
ccaggagggaccgcggcatccccctttgcttctcctcacctgggccccttgctctggtctcacttgg

SEQ ID NO: 6796542 - DNA, 69 bp, Homo sapiens
gatattcatgaaagctgttagagcccccagtctgcacccggagatgggggattttacagcgtgagtgtt

SEQ ID NO: 6796543 - DNA, 56 bp, Homo sapiens
cttcctgcatggagtctgaatgcttcaccagaaactcagagaacccggcaggcaag

SEQ ID NO: 6796544 - DNA, 129 bp, Homo sapiens
ttaggccgctttgcatcaggagccctaagggtctgtggccatttggaaggcaagtaggcagaatagctacctgcatggcttccagtgcttacggagagaggaggggaatatggcatggcaaagtgggga

SEQ ID NO: 6796545 - DNA, 117 bp, Homo sapiens
agcattattggaccacagctgtattcattcattacatattgtctatgactgcttctgtgttacaagggcagaattggatagttgtgataaagattatacagcccataaaatcttgct

SEQ ID NO: 6796546 - DNA, 65 bp, Homo sapiens
ccagttataggagccattgtatagttcgtactggaaggtcttgctaccaactggccctgaattgg

SEQ ID NO: 6796547 - DNA, 69 bp, Homo sapiens
gtgtccctactcaaatctcatcttgaattgtaatctgaattgtaatccccaggtttgggggagggacat

SEQ ID NO: 6796548 - DNA, 69 bp, Homo sapiens
gttaaattttagttgctgagccagatcctttagacaagaaatactggcttccagtaatcaggatttaat

SEQ ID NO: 6796549 - DNA, 79 bp, Homo sapiens
gctttgaatagatttcacatgctgctctattattgactttattcaggaaatggagttcttgcagtggcacagtcagagc

SEQ ID NO: 6796550 - DNA, 75 bp, Homo sapiens
ctgggtgtcatgtccagggctatggtgccacattgagaacaatattgaactaaatagttttgacagaacagccag

SEQ ID NO: 6796551 - DNA, 104 bp, Homo sapiens
cagccacttggtgtcctctttgattccaggcacatgtttgaacaaataggaagttgtcaaaaatatgttgattggtaggtttgaatggctaccaagagaggctg

SEQ ID NO: 6796552 - DNA, 69 bp, Homo sapiens
tcctttgagattagctctctctgatagcctaataaataaatgtatgtatcagagaggctgtgtgaggga

SEQ ID NO: 6796553 - DNA, 66 bp, Homo sapiens
tttgggctagataacttattttcaaggatgtttctcaactttcttttgaagttatttggtgctgaa

SEQ ID NO: 6796554 - DNA, 83 bp, Homo sapiens
ccatttagtgagtgtgaatcaaatgctaggcaccagactgatgctttctttttgctatttcatttgatcctcacaataaatgg

SEQ ID NO: 6796555 - DNA, 75 bp, Homo sapiens
ttagatatggcaggggaaaaggggtgggagggggagactgagtctatctcataattgtttcccagctatatttga

SEQ ID NO: 6796556 - DNA, 60 bp, Homo sapiens
tctgcatgtggctggtggctggagggatatgcacttcccatgccatgggctggcagcaga

SEQ ID NO: 6796557 - DNA, 56 bp, Homo sapiens
gaggctgcagctatcagacatttccaaagggagtgtcttcgactcctgcgtgcttc

SEQ ID NO: 6796558 - DNA, 59 bp, Homo sapiens
gctgtggtcaggggttagacaggttggcttcccttccctccctgccccgtgacccctgc

SEQ ID NO: 6796559 - DNA, 78 bp, Homo sapiens
ggctcctgcttatgaggaccttgtgattacattgagcctgcccaaatagtccaggacaatcttcatatttcaagagtc

SEQ ID NO: 6796560 - DNA, 84 bp, Homo sapiens
gctggtcccagatgctttgacaatatcattgcactgcttctcagagcacagtagtgcaacctcgtcagagcacctgcggccagc

SEQ ID NO: 6796561 - DNA, 59 bp, Homo sapiens
cgtttcagcacccagagccacacggaagggttagtggtgggtaaactgggtctggagag

SEQ ID NO: 6796562 - DNA, 129 bp, Homo sapiens
tgaatttctctgcctccagttggcgaataggagaagaaagagtggagaaggtatacccgcttctcacccaccttggctcagaggagaccttcaccacttccactccattcctttggtgagaaatgatca

SEQ ID NO: 6796563 - DNA, 71 bp, Homo sapiens
ccctgtaactgtggttacctcttgtcttagtcagttcaggctggtataagagaataccataggctcagtgg

SEQ ID NO: 6796564 - DNA, 74 bp, Homo sapiens
gtttactgcacagtaaggtatcccagtgaatacccagtggtcttctaaatggggatcctttctgtgtcacaaat

SEQ ID NO: 6796565 - DNA, 87 bp, Homo sapiens
ggatatcgacaattcctaatcccattgtggaattaaggaatgttagatacatttcgttatccaggcaatgtggattttgatgcatcc

SEQ ID NO: 6796566 - DNA, 65 bp, Homo sapiens
attcttaagcacctaaaaagtggcaggcgtacatggggtctccatttttaaagagcttaagtaat

SEQ ID NO: 6796567 - DNA, 55 bp, Homo sapiens
gcaggacctctggatgcaatgcgtggcaaagtacggggtgtttcctgaggcttgc

SEQ ID NO: 6796568 - DNA, 97 bp, Homo sapiens
gagcgaaattttggcccatggttttatttctctatagctagaaaacaagcccattttccagctgtagatgagaaaggaaggaagggcatgtttgctt

SEQ ID NO: 6796569 - DNA, 74 bp, Homo sapiens
tctcacagactgtgagtctcattttctacatatacaaaatgaagaagataattcctacttataacgttgtgaga

SEQ ID NO: 6796570 - DNA, 55 bp, Homo sapiens
ttttcctggaaccagcattgttgttctcagagtggcacttggggattcagggagg

SEQ ID NO: 6796571 - DNA, 59 bp, Homo sapiens
cagaggatcgctacatcttgttcctatgtatatatgtggaatggccatgggatcctttg

SEQ ID NO: 6796572 - DNA, 74 bp, Homo sapiens
gatgctagctttaagatgagatgtggataactttattccttccattatccccactctctcctggagcttccatc

SEQ ID NO: 6796573 - DNA, 55 bp, Homo sapiens
gggcagatgtcttttgcaagggaaacagactgttttctgccactgcactctgccc

SEQ ID NO: 6796574 - DNA, 72 bp, Homo sapiens
gtaggccactggacagaccctacttcgtcctaaagtaaggtgaaggccaaaagacgggcttccagggccaac

SEQ ID NO: 6796575 - DNA, 95 bp, Homo sapiens
gatagcattgacttctaggtttctgagtttcctgtttaaaatttatgaacagtattggttgaactcaagaaagttcttttaagatcaatgaaatc

SEQ ID NO: 6796576 - DNA, 80 bp, Homo sapiens
ttattttatgttttcctcatatgagtttagaatcactacatgaaaattgattctctgatggagaaagacattgaaagtaa

SEQ ID NO: 6796577 - DNA, 99 bp, Homo sapiens
cttgtggaggtcttacaagaaactgaaagtggcttcataatttgtatataattcataaggcctgtttatgtattctgtcactgactcttcaattataag

SEQ ID NO: 6796578 - DNA, 110 bp, Homo sapiens
ctgtggggcagagatccagagggtagacactgggagagctggacttgggaaaagtaaaactgatgacccagagtactagcctccctttccctagggaacctgtcccttag

SEQ ID NO: 6796579 - DNA, 66 bp, Homo sapiens
gtctatgcagatgggtgccaaagtctggacagttgtgttgagactttggcacccatctacaatggc

SEQ ID NO: 6796580 - DNA, 55 bp, Homo sapiens
gcgcctggcacacagcaagggcgggaaaggctcctccctctgctaaccgcggcgc

SEQ ID NO: 6796581 - DNA, 57 bp, Homo sapiens
ccactggccggtagagagcattcagagatgaggctgttctaccagggccaagcttgg

SEQ ID NO: 6796582 - DNA, 88 bp, Homo sapiens
ctcagttttctcatacgtaactagcaattattgtataagaacaatatccacttatgttgtttacagtaattgtggtttgggctctggg

SEQ ID NO: 6796583 - DNA, 73 bp, Homo sapiens
gtttggacagtttgtgtacaggtgtttccaagtcagggtctgattaactgagacttcctgtgcaattcctagc

SEQ ID NO: 6796584 - DNA, 85 bp, Homo sapiens
cctgcagctcttggtcttcagagatctggtggtgaccaggccttctgtgtcctcctccgaatcactgataaccttggtgtgcagg

SEQ ID NO: 6796585 - DNA, 60 bp, Homo sapiens
ccaaagcatatcattataatgggagcatctagcaattcccagtggtgggtgcacatttgg

SEQ ID NO: 6796586 - DNA, 56 bp, Homo sapiens
gggttttcttctgcagaaaagattaaaggaaaattgttttagcagaaagaaagctc

SEQ ID NO: 6796587 - DNA, 61 bp, Homo sapiens
agtggagctccggggtcaggtgggtggaagaagttcccgtcctcagtctccctgctccact

SEQ ID NO: 6796588 - DNA, 76 bp, Homo sapiens
ccccacggccagcgtgccctccgtgttcatagagcccaggaagaggtgggctggggctctgcgctaggcggtgggg

SEQ ID NO: 6796589 - DNA, 109 bp, Homo sapiens
gctctttaatagtaattctgaattatttggtctttttagtgtcatcctagttacttctgataaggatggtcagaggaccaaatacagttttgtttctactaatacgagt

SEQ ID NO: 6796590 - DNA, 80 bp, Homo sapiens
tatgtgtttaacatgcaatgtctgaaaatccagggaatattttgtcttggatttccagcttcattgtctaaaaacacata

SEQ ID NO: 6796591 - DNA, 72 bp, Homo sapiens
tgaattcttaggtcctttcttaaattcctgctttgacaaggaaaaggcagaatgttggaaaggaaggactca

SEQ ID NO: 6796592 - DNA, 61 bp, Homo sapiens
tctccttcaccccagctttgatgcacctataccaggtttgatcagtaaggttggaggaaga

SEQ ID NO: 6796593 - DNA, 108 bp, Homo sapiens
cctcctcataaaagagttaacaaagctggcctgagaatgctaccctttgataggcctgcatggaaggttggcctttggctagaatctgggaacttagatttggggagg

SEQ ID NO: 6796594 - DNA, 78 bp, Homo sapiens
agcagaagtgggatcacactgcctccctgtcttcagctccaccaggacccttgggcctgcagtgctggtgcctctgct

SEQ ID NO: 6796595 - DNA, 64 bp, Homo sapiens
gaagagatgaggctgatagttgaagatgtcctttgtttacaacactgttcagcctcttctgttc

SEQ ID NO: 6796596 - DNA, 79 bp, Homo sapiens
gcttccctaagcatgtttcttaagattgcattggtgtaactagcttcaattagtctggtgagacatttctttgaaaagc

SEQ ID NO: 6796597 - DNA, 124 bp, Homo sapiens
tgctcttttggacatcagtcttgatagtatcactgccaggtttccagccagctgggcacacttccctatgtttgtcagtgaactggaaggcctgaactagtctcaaagtctcatccacagagca

SEQ ID NO: 6796598 - DNA, 111 bp, Homo sapiens
ggagaggagggggcatgaaggtgaggctgggagccccacagagtcagggcgccttagctttcggcctgggcaggctcccacgtttagagcctggctttgtcccatctctcc

SEQ ID NO: 6796599 - DNA, 60 bp, Homo sapiens
ttggatgtttgaaatcacgtacgtggaaatgatctctatgtgcatgagggaggatagcaa

SEQ ID NO: 6796600 - DNA, 79 bp, Homo sapiens
acaaaaaaagaataatctcttcccagtaaaaatggctcaggttaggtctagagctaagggaaaggattattcttattgt

SEQ ID NO: 6796601 - DNA, 128 bp, Homo sapiens
gggaacccatggaggcaggatgcagcgggggacagggtggagcctggcattggagccggggcatatgggttccagtccatgctctggaccatgactatgtgccttcccctttctaagcctcagtttcc

SEQ ID NO: 6796602 - DNA, 83 bp, Homo sapiens
tgtttccagctgcagccgagtgacattggtgtcatcaatgaccttgtggagcccacggatgtcgctttccgcagactggcgca

SEQ ID NO: 6796603 - DNA, 76 bp, Homo sapiens
tcgcttgaacccaggaggcagaagttgcagtgagctgagatcatgccactgcactccatcctgggaaacagagtga

SEQ ID NO: 6796604 - DNA, 55 bp, Homo sapiens
ccagccagctgcccttggggcctttgcagctggcccacaggtgtgagcttgctgg

SEQ ID NO: 6796605 - DNA, 67 bp, Homo sapiens
tagcagggagggagtaggagtcatggagcctttttttcccctgttttccaacttcccatccctgctg

SEQ ID NO: 6796606 - DNA, 78 bp, Homo sapiens
ccagatgaagggtggctctcaggcttctcggatgatatttctctgggtaatcagggctgggagcccaaacgtatctgg

SEQ ID NO: 6796607 - DNA, 129 bp, Homo sapiens
catgactagtgccaccactgctataattattgccacgtaatgcatccctgccaatgctttaggagtgtctagaatatggacaggaatgcactgttcaatatactgttagcagaattgtggttggtcaag

SEQ ID NO: 6796608 - DNA, 73 bp, Homo sapiens
ccatttattctctagttggtcagatgatgtttattattgatcatatgaagaattccaatttggagagtgttgg

SEQ ID NO: 6796609 - DNA, 58 bp, Homo sapiens
tcccggagccatggcctagtactcttatgtgaagtctagcaagctcgtgctcaaggga

SEQ ID NO: 6796610 - DNA, 55 bp, Homo sapiens
gagactagccctccaggaatacatgagcagcaaggccatctggaaaggctagctc

SEQ ID NO: 6796611 - DNA, 77 bp, Homo sapiens
cccaagtgacctcctaggcaggagctctgtccatgagattgtccttagcagggctctgccatgggcccggcactggg

SEQ ID NO: 6796612 - DNA, 120 bp, Homo sapiens
tcttgacctccagaaattgtgtgttggacaataaatgtttattgttttaagctgctaactattggggtagcgtgttatgtagcaatagataactaatacataatttaatggattaaatga

SEQ ID NO: 6796613 - DNA, 100 bp, Homo sapiens
tgaggcaggagaattgcgtgaacccaggaggcagaggttgcagtgaaccaagatcgcaccattgcatcctgggcgggcaacagtgtgagattctgtctca

SEQ ID NO: 6796614 - DNA, 67 bp, Homo sapiens
aggcaccattttctaaaaatatgactagggtgtgacctaaggttttattctgtgaagatgagtaact

SEQ ID NO: 6796615 - DNA, 85 bp, Homo sapiens
aaaaggggatcagtaagtgaataatgagtaaagctgtctaatataaacaattataatcattattttcttgtattgactacctttt

SEQ ID NO: 6796616 - DNA, 113 bp, Homo sapiens
agctaagcctgcaatcggcagaacctacaatacagattgctatacttacaagtctgatttgtgacaactgtggcatctgattgtgttttctagatttagcagcttctctagct

SEQ ID NO: 6796617 - DNA, 102 bp, Homo sapiens
ctcccaaatctctgcagacagagctctgcaggcacagctgaggacggcctctctttgggtcccccagactcatccctgggagctcacaactggcagagggag

SEQ ID NO: 6796618 - DNA, 85 bp, Homo sapiens
actcttctgcaccccatgcagattgttcatagacatggggcagctcctccgatgccagaagagtctgcagggataccagaaaagt

SEQ ID NO: 6796619 - DNA, 69 bp, Homo sapiens
tccattttcctgcttctacttcacttcctagaataattcgggaaatggtagagtaggaagatttctgga

SEQ ID NO: 6796620 - DNA, 74 bp, Homo sapiens
tgggactgagccctgcctcttgtcactgctgtgtatctgatagcagcaagtgttgtgcctgcaggcttgtctca

SEQ ID NO: 6796621 - DNA, 78 bp, Homo sapiens
tgcaggatattagttttcttgttatgacaacaaaccaaaatattgtcacaatgacaggaaacatttcagttttctgca

SEQ ID NO: 6796622 - DNA, 78 bp, Homo sapiens
cttcacactattttgttttcccctttcacagtcaattagtaatggctgccaatgtggggcaaggcagaagagttggag

SEQ ID NO: 6796623 - DNA, 61 bp, Homo sapiens
agtctctgaggttcagatgccttgtgtatataacaggcagattagtctaaatccagagatt

SEQ ID NO: 6796624 - DNA, 66 bp, Homo sapiens
gaggcaggaggattgcttgaggccagatgttcaagaacagcctgggcacttcaatactcttgtctc

SEQ ID NO: 6796625 - DNA, 59 bp, Homo sapiens
ttattgtaggcctattgtagaaatgctattgataagcattgcttttatacctataatga

SEQ ID NO: 6796626 - DNA, 66 bp, Homo sapiens
tgaggaagggcaaggagttgaggatgactctacatgattccagtccactgccttgctcttacttca

SEQ ID NO: 6796627 - DNA, 78 bp, Homo sapiens
gtataaatggtcacatcctgcttgctctgttgtttgtctactgctagagttaagaggaatgtgaattttctggtatgc

SEQ ID NO: 6796628 - DNA, 100 bp, Homo sapiens
gttatctgatcatatctggctcatcccatgttgtatcattctgttcctatatttgatagagagtgagttaactgtgacaatgttagtatataaagataac

SEQ ID NO: 6796629 - DNA, 79 bp, Homo sapiens
actctgagttttggtgcttagtacacttcagatcctctgctggaggctagaaatttttacttaagtatcaaaaaagggt

SEQ ID NO: 6796630 - DNA, 69 bp, Homo sapiens
cttctcaccttaatgtggtcttgtgttatattgagagagggattttaaagatcaccttgacatgaaaag

SEQ ID NO: 6796631 - DNA, 69 bp, Homo sapiens
cgagaaagttttctaacatctagtaatttgtaacttagaagtggagttgccttgtggatgtcttttttg

SEQ ID NO: 6796632 - DNA, 75 bp, Homo sapiens
gccacagtggtagtagtaggctttcaattttgtctccaaaaaaagtatatttttagcttacattaccattgttgc

SEQ ID NO: 6796633 - DNA, 76 bp, Homo sapiens
aacaccagagtccatatctctttcctggtttgtgcttgttcaaagattgatcatggaagaggtattttttgttgtt

SEQ ID NO: 6796634 - DNA, 66 bp, Homo sapiens
gcctccatctgcttgatgtctaagtgttgtatgcatacttaagatagagcaagtctgactgagggc

SEQ ID NO: 6796635 - DNA, 130 bp, Homo sapiens
accaattcaaattatccagaagcccgaaggttataatgatgttcatgtatagagagcttttattcaacaattcaaagttctgtgcaggaagtcattatgataaaagctttcttaccaaattatgaagtgt

SEQ ID NO: 6796636 - DNA, 56 bp, Homo sapiens
gacttctgagctatccagctgtggcaattcatcagctaggatctcctctgggggtc

SEQ ID NO: 6796637 - DNA, 80 bp, Homo sapiens
tgaggctagcactggccacgtggagcatcctgagccgttttgtggctctcaggctgtggcctagtttgttatatgtctca

SEQ ID NO: 6796638 - DNA, 63 bp, Homo sapiens
tcagctgcaagaagaggtccctgacaatattagggtcagatgcttccttagcttgcagacaga

SEQ ID NO: 6796639 - DNA, 57 bp, Homo sapiens
taccagtgtcttggtggatttgagtaagggaccgtctactatgctaaggcattggta

SEQ ID NO: 6796640 - DNA, 56 bp, Homo sapiens
gagagagaaaaccctgttacctcccttctaacaggaagtaagcaggacttctcctc

SEQ ID NO: 6796641 - DNA, 74 bp, Homo sapiens
cagaaaagagtaacatagcaggcctaagactactatccttagaaaggcctgcttacaatgttatcccttggctg

SEQ ID NO: 6796642 - DNA, 68 bp, Homo sapiens
ggtaacttttctaactttacactcgaaagcaaattcttttgttgtgtgtagtgttaaaaaatatgacc

SEQ ID NO: 6796643 - DNA, 72 bp, Homo sapiens
ggcactcccctcgcccagcactactcctctctgcctggggtcgagccacagtctgtgcttggtgggagggcc

SEQ ID NO: 6796644 - DNA, 90 bp, Homo sapiens
ggggtggtggcggaggctccaggaagcccagcctcctccctcactcacacctgcggtcgccaaacctggggcttatgccattgccgcccc

SEQ ID NO: 6796645 - DNA, 67 bp, Homo sapiens
gagcttcatgcctaaagacagcgtcttaaactgcttgaatggctgcgagtgtcttagcatgaggttc

SEQ ID NO: 6796646 - DNA, 58 bp, Homo sapiens
ctgatagagcattagtgtgagagtctggatttcataaagtctctcctggctctatcag

SEQ ID NO: 6796647 - DNA, 105 bp, Homo sapiens
ccctgcctgccttcgcctttctgagggagctggagtctccaggggttgggttaacacctggatatgtttcagcttgggaagattctgaggggaggtgcagcaggg

SEQ ID NO: 6796648 - DNA, 99 bp, Homo sapiens
cctgcccttctccctcagggcaccccagggcagtaccgccctctggcccagctgatgggccgggccaggctcccctggcttcccaagtggaggaggagg

SEQ ID NO: 6796649 - DNA, 65 bp, Homo sapiens
gctgctttgacatccttgttcctcagtttgtagatgacagggttgagaacaggtgtgagaatggc

SEQ ID NO: 6796650 - DNA, 56 bp, Homo sapiens
actgacagttggtttggtgatgtctggacgctctaaatcatctttacaatgtcagt

SEQ ID NO: 6796651 - DNA, 70 bp, Homo sapiens
accttgggcaacctgctcctgctagaaaaagcctaaatgcatgaagcaggactgtaggcttgccccaggt

SEQ ID NO: 6796652 - DNA, 98 bp, Homo sapiens
actttgattgattctgaaaatacacatactaggggaaagctgacatttcactttcaaacctacttgtatgtttgttttgatatggagccctgcagagt

SEQ ID NO: 6796653 - DNA, 59 bp, Homo sapiens
tctgatgataaagcatcctttaaaaattctgaataatttattggatgcttgcttacaga

SEQ ID NO: 6796654 - DNA, 59 bp, Homo sapiens
gatgcatgcatattccttcatttagtatttattgaatgtctactatgtgcaaggcactc

SEQ ID NO: 6796655 - DNA, 75 bp, Homo sapiens
ttttagtcatgtgaggtttcttatcaagaaagctgcatctgtaagagctgataaggaatttttctttggctaaaa

SEQ ID NO: 6796656 - DNA, 74 bp, Homo sapiens
ttctggcctaaggtacagaattctgtcccttgagtggacactgggaagagagaattctgtcactatccccagag

SEQ ID NO: 6796657 - DNA, 69 bp, Homo sapiens
tacgctttctcttatcagtgcacttgaagagatttgtctctgagatttgtatggtgagactgttgtgta

SEQ ID NO: 6796658 - DNA, 72 bp, Homo sapiens
catagctatagcactccattatgatgtggctgcttcgttgattagttcagattttagatgagtgtagttatg

SEQ ID NO: 6796659 - DNA, 84 bp, Homo sapiens
ggttctctcatcccttgatttgtttcaagttagcatctcattagtgatgagtgcagaaccaaatagtgtcaggcagagagaatc

SEQ ID NO: 6796660 - DNA, 67 bp, Homo sapiens
gatgtgtgtgtgtgtgtgtgtatatatatatagtttgtatatgtatatgtatacacacacatatatt

SEQ ID NO: 6796661 - DNA, 79 bp, Homo sapiens
aggagttcactgtgcaggctctgagccccacccagtattagaacgggacctgagatgcggaggcctgccaggagcttct

SEQ ID NO: 6796662 - DNA, 73 bp, Homo sapiens
tacaatgttaatggattggaggtttcaatattgttaagatgttgatttctcaaaaaatctcaataaaattgta

SEQ ID NO: 6796663 - DNA, 62 bp, Homo sapiens
acaaggcctgactgcttgtctaaaccaatcatataggtttattacagcgatcagagtaatgt

SEQ ID NO: 6796664 - DNA, 82 bp, Homo sapiens
tctgtccaatgggagatgaacaactgtgaatgtaaaactgtttgaatttacatttctagttgttcatctcccagtgcctaga

SEQ ID NO: 6796665 - DNA, 65 bp, Homo sapiens
actatgtggttcagagaacccgtctagtctgcccaactgcaacagagcattctgcactacaaggt

SEQ ID NO: 6796666 - DNA, 56 bp, Homo sapiens
gtcctgctcatttaattcagcaaactccatttgagcatgtgctaaatggcaggtgc

SEQ ID NO: 6796667 - DNA, 78 bp, Homo sapiens
tttatcatcattttcaggtacacaatcaagccaaaagatacgctttggtgaatgataatgttcgagaatgaagaagaa

SEQ ID NO: 6796668 - DNA, 80 bp, Homo sapiens
ttgaacagctctgaagcagtaaatgaaatattgactgagttacttgtcatttaatttgcaatgatttcagtgcttttcaa

SEQ ID NO: 6796669 - DNA, 58 bp, Homo sapiens
acaggaagtgggaagaaacaggcagcctaatgatgaggtcctggggtcccctttatgt

SEQ ID NO: 6796670 - DNA, 77 bp, Homo sapiens
tgtggaccaagaaaacaatgatagggtttgaaggaagaaatgttttgcaacagactcatcattgactttgaaccaca

SEQ ID NO: 6796671 - DNA, 77 bp, Homo sapiens
cttagtctttagaacactctcctgaaaattaagtgagaactattagttgaccctctaggaagtgtctggaaattaag

SEQ ID NO: 6796672 - DNA, 74 bp, Homo sapiens
ggagagggaatgacactgaatattccttgacagtctgtctggtaaatgtgaatgtcatttagcagtctctttcc

SEQ ID NO: 6796673 - DNA, 65 bp, Homo sapiens
gaacacagtgggctttgcataggagctcttaactaagcttcagtgttcccatctgtaaaatgttc

SEQ ID NO: 6796674 - DNA, 72 bp, Homo sapiens
agcaagggctgctttgtggaatcacactggagtcttcatgaagctgtgtgtttacttataaagttcctagct

SEQ ID NO: 6796675 - DNA, 77 bp, Homo sapiens
atagtacagtggaggtctgtgttcaaatcccagattctccacttaattcttgggtgagcaagtgaccaactgtctgt

SEQ ID NO: 6796676 - DNA, 58 bp, Homo sapiens
ttctaactcctgggctcaagtgatcttcctgtcacatgagtctcccaagtagttggaa

SEQ ID NO: 6796677 - DNA, 104 bp, Homo sapiens
gagtaccattgacataaatatctgtgtttgtccaagttctccaaggagacagaactattaggagacacatatacagaaagagatttattttaaaaaattggctc

SEQ ID NO: 6796678 - DNA, 75 bp, Homo sapiens
gagatgggcttccagacgatcatgtaagaccactacttgtgaggttttccaggagagtctagagaactccatctc

SEQ ID NO: 6796679 - DNA, 84 bp, Homo sapiens
catagtccacagtctgttcctgttcatgacatttacgtgagtcagatgacattcaggccaggagatcagattgaaggtaccgtg

SEQ ID NO: 6796680 - DNA, 73 bp, Homo sapiens
tcatgaatgacttctgcataacttcctgggtcatgcactatgataaagatggagaatgtagagaaaagtatga

SEQ ID NO: 6796681 - DNA, 58 bp, Homo sapiens
ggttagaagttaccacatacttctctgactcaatgtaatagagatccagcttctagct

SEQ ID NO: 6796682 - DNA, 79 bp, Homo sapiens
ttgatggcaatattgtataatagtgggctactgagcaactatttccagcttcgtggtcagtggtacagtttgaaatcaa

SEQ ID NO: 6796683 - DNA, 62 bp, Homo sapiens
cctactggtatttttatatttaagttatttaaatataacttaagtgtgaagagactcttagg

SEQ ID NO: 6796684 - DNA, 78 bp, Homo sapiens
tctggttgtggagtttcaggattgtgtttttcctgacagttgggtcaggaaattaaacacttgaaagcacagagcaga

SEQ ID NO: 6796685 - DNA, 89 bp, Homo sapiens
tctcttcatccttgctatggccctctccttaggtcagctcccaacacggcagctggcttccatcagagggtgagcaaggaagtaagaga

SEQ ID NO: 6796686 - DNA, 68 bp, Homo sapiens
ggggcctagggagtggccatgcctgcccgggcaatggggatcacaggcaaccactccccgcggacccc

SEQ ID NO: 6796687 - DNA, 68 bp, Homo sapiens
ttggcttgtgttttatctcgcattgccttgggaaatgagcctactgtgtggtctaagatacaggaaaa

SEQ ID NO: 6796688 - DNA, 92 bp, Homo sapiens
tgtgctttaggtaaagaaatttccagactttttccaggaaacctatttttcattggctaaagacctgggatcaaattcatgcttgaaataca

SEQ ID NO: 6796689 - DNA, 117 bp, Homo sapiens
tctgtatgaacagattcattctcattggggaagctgaggcagcttatcagagtaattactacttttcttggtataagctgtgtcagagccctcagtgagaacaaatccacttacaga

SEQ ID NO: 6796690 - DNA, 63 bp, Homo sapiens
ggagtgcaggtagcacaggaaagaggaacatcatgtatttgataaacctggctacctcatttc

SEQ ID NO: 6796691 - DNA, 95 bp, Homo sapiens
tggtggaagtctgaggtatcccacagccctaatggtaggctggagttttctgccttgaggaggttgtgggactatttttagcacgttttccacta

SEQ ID NO: 6796692 - DNA, 84 bp, Homo sapiens
tgctggcattggttcagtagctctaaactgtgagaacttacttgctgctttgttttcacaagacagctactgttgctccagaca

SEQ ID NO: 6796693 - DNA, 58 bp, Homo sapiens
aaatgttcccaatatgaagctgtcggcttagttttgtccgtttgattgggcaacattt

SEQ ID NO: 6796694 - DNA, 58 bp, Homo sapiens
tttaccacagaaaaaagtaacttcgttttccctctaggttacttaatgtagtggtaaa

SEQ ID NO: 6796695 - DNA, 104 bp, Homo sapiens
cctgtgctgggcaggcctgcaccgggaagtcctgcactgggcagtcccacaccgggcagtcccgcattgggcattcctggaactgcaggattacctggcacagg

SEQ ID NO: 6796696 - DNA, 76 bp, Homo sapiens
tctaatctgtcttcttgccttctgttatacctgtctctatactaaagccagggtgaagttcaaaagacagatttga

SEQ ID NO: 6796697 - DNA, 55 bp, Homo sapiens
gtcttcttttcagtctgcttgttcactaacacgagcgcagacaatgtgaggagac

SEQ ID NO: 6796698 - DNA, 69 bp, Homo sapiens
taggcaatgaattagtcaaatgtttttatggagaatccatttgtacttgacattaatttaggttgtctg

SEQ ID NO: 6796699 - DNA, 69 bp, Homo sapiens
tattgacttgccaagcagaattatttatttggcaccagtaatgtgctctgtattctatggcagttggtg

SEQ ID NO: 6796700 - DNA, 97 bp, Homo sapiens
caggcagagagttgtagggagtgttacataatgggttctgcaagtggccacaaacttatttaagtaaacacttactggaattaatatttattgcctg

SEQ ID NO: 6796701 - DNA, 99 bp, Homo sapiens
cactggattttatatttttaactttcaacctcccaagtttcagtaagagacatgttatttggagaagttgctaaagtgtagttgtatgatgtctctgtg

SEQ ID NO: 6796702 - DNA, 58 bp, Homo sapiens
gaggacaataatttttacaggtgctaaaaaatgcaaacatgtgaaagctagtgttctt

SEQ ID NO: 6796703 - DNA, 75 bp, Homo sapiens
gtgtttagaagccaagatttgggtactagcgccagctgtgtttattgttaccagagttttactgcttctaagcac

SEQ ID NO: 6796704 - DNA, 70 bp, Homo sapiens
atagtttcaagtttttgtttgtttgttttacctaattacctgaaagcaaataccaaaggctgatgtctgt

SEQ ID NO: 6796705 - DNA, 66 bp, Homo sapiens
gtacccagctcctcagaagaccagatatgaagtcccctcccaacctggttactctgttctgggaac

SEQ ID NO: 6796706 - DNA, 68 bp, Homo sapiens
gtgggctgcaggaacgacggaggggcggcccttctcctgcccctgatgtcactgcttctgcctccctc

SEQ ID NO: 6796707 - DNA, 61 bp, Homo sapiens
ggcaggcactgtgatagattctgagaatacaaaactcaatgaataagacacattgcttgcc

SEQ ID NO: 6796708 - DNA, 56 bp, Homo sapiens
cagataaggcagtggtttgcagttggaaagctgagtttaaaccctggctttttctg

SEQ ID NO: 6796709 - DNA, 57 bp, Homo sapiens
ctattttaagaggccattaggtgtccattgggatcaattaatggcctcttggaatgg

SEQ ID NO: 6796710 - DNA, 57 bp, Homo sapiens
agggcagttgcagtggtgggcagcaccccccatgcccacatgagctggcaatgccct

SEQ ID NO: 6796711 - DNA, 70 bp, Homo sapiens
cagtggaagagtctccagcaacttattgacaatttcaagccctgttaggggtctctatctcctttcactg

SEQ ID NO: 6796712 - DNA, 57 bp, Homo sapiens
cctgtggtttttagaggaagtataatacagccattagaaccactgaagactcacagg

SEQ ID NO: 6796713 - DNA, 57 bp, Homo sapiens
aaagagacaccaaagactctagcctctagggaaataggtctgttggggtggcttttt

SEQ ID NO: 6796714 - DNA, 68 bp, Homo sapiens
cagaccctgttggtggatcagattgggcttgagatgaggtgcccagccctgtccagcagagggtgctg

SEQ ID NO: 6796715 - DNA, 72 bp, Homo sapiens
cagggctggtggggcagagaataaaaacctaactcctttttgtcagtttttctatactttgtagttgccctg

SEQ ID NO: 6796716 - DNA, 72 bp, Homo sapiens
gtgccacgttgctttccccgggtctgccaggaccgctcaaaggcctgtgtcctcagggaagcagagaatcac

SEQ ID NO: 6796717 - DNA, 63 bp, Homo sapiens
agctaatcagactcccaagaaacattccattccgcttaggagggctttggagaatggtttgct

SEQ ID NO: 6796718 - DNA, 61 bp, Homo sapiens
tatttgtgtgtttgtatgtgtccagacttgggaggggaacacatatattcagatacagatg

SEQ ID NO: 6796719 - DNA, 72 bp, Homo sapiens
ggatagggaaaagaataactgaagaaactagcttacaatagctaggtttcgtcaggcttattctatccagcc

SEQ ID NO: 6796720 - DNA, 62 bp, Homo sapiens
aaaacagtgcaggaagttaagcaagttgactaataacatgccaaacttaaatgcaaagtttt

SEQ ID NO: 6796721 - DNA, 56 bp, Homo sapiens
gcaacagagcagttgatcaggaacagaccctgtctgagaagcgtgtctctgtttgc

SEQ ID NO: 6796722 - DNA, 70 bp, Homo sapiens
gggtaacatatctctttcctattcaagttaggaccttgtcctgtatttgaaagaaaagatttaatagctc

SEQ ID NO: 6796723 - DNA, 58 bp, Homo sapiens
tttggggaagagacatttgtacctgattcaatataggcttgtttgtgatttctccaga

SEQ ID NO: 6796724 - DNA, 64 bp, Homo sapiens
gcagaggcggccagcgaggccgcaaccttcgctcaggtgagccgggtccgctgcgctgcgctgc

SEQ ID NO: 6796725 - DNA, 125 bp, Homo sapiens
gagaggacaacaattatgggagggagatctttttacatccagtggtcagggaagttgtctttgatcttgacagctcccaaaacactggacatattagtcttcctcaaaaagtgttagttcctctc

SEQ ID NO: 6796726 - DNA, 121 bp, Homo sapiens
gattaaaactatataagcctcaatgtcttcatcataaaattgagataactgtgccaacttaacggggttcttagttcccttaaatttgttctgaaataaggcttattgcaagtaaataatc

SEQ ID NO: 6796727 - DNA, 65 bp, Homo sapiens
ggaggacagagcctgtgcagaccggaatgtttaagtgcctgcagtctggtttcagctttgcctcc

SEQ ID NO: 6796728 - DNA, 63 bp, Homo sapiens
gcctccactctcagggcaggtggcctttccccagggaaatctcgccaagcacctgggccaggc

SEQ ID NO: 6796729 - DNA, 77 bp, Homo sapiens
ggacaatgatttttccattgcaggataatactcttccattagaagttgtctcctcaggataaaatcacatcttgttc

SEQ ID NO: 6796730 - DNA, 56 bp, Homo sapiens
gagtcaggagtcctgtgtgagacatccgcaaacatctcataagcagcttctgaatc

SEQ ID NO: 6796731 - DNA, 59 bp, Homo sapiens
accagctcctgcagggccatagttgtgaagaagattgacccctgcaatgggaagctggt

SEQ ID NO: 6796732 - DNA, 69 bp, Homo sapiens
tgatagaaaggaaattaattggattaccaaaggacagtaggtgaccccaattacttttgcttttaatta

SEQ ID NO: 6796733 - DNA, 130 bp, Homo sapiens
ctgagctgaaaagccggcagacattgccctggggccttggcagagggctgggctcaggacacctcctcctgggctcagactctggttaggatgtgctgacgtgatgtctggcggtttgacactggcttgg

SEQ ID NO: 6796734 - DNA, 56 bp, Homo sapiens
gggccacatgacttgctgtagcaccctgtaaggacagcacccatgtcatctggctc

SEQ ID NO: 6796735 - DNA, 65 bp, Homo sapiens
aggatgaggatggggcgtggtgtgcctctgggcgaggatggcagcccaccagcccacgtctacct

SEQ ID NO: 6796736 - DNA, 68 bp, Homo sapiens
gattacagcagctcaaacaaagggcatttcttctgtgattaagtgctttttcttgagctgctgtgatc

SEQ ID NO: 6796737 - DNA, 79 bp, Homo sapiens
gcagggcatgtggcccaaacgggtccagtgaaagtcagtcctgggactttggctgggactattggggaacagcctctgc

SEQ ID NO: 6796738 - DNA, 71 bp, Homo sapiens
gctttgctgggtgcttcatgtatgttatctcatcaaatctccaacaaccttgtgaggcagctagtattagc

SEQ ID NO: 6796739 - DNA, 62 bp, Homo sapiens
ctctctggggcttgtagcaggttttaatcctgagattacactctggttgtgggccttgggag

SEQ ID NO: 6796740 - DNA, 80 bp, Homo sapiens
gaaaatacggacaccagaagatgctttgtaaaatgacaggtataacttctatcagcatgtcttttggtaggcaggttttc

SEQ ID NO: 6796741 - DNA, 107 bp, Homo sapiens
ggaagggccctgagccaggggccagctttggggccaggtggctgcaggtcccaccccggctctgctaagcctctgctttctggccctgggcatgtcactgcctttcc

SEQ ID NO: 6796742 - DNA, 67 bp, Homo sapiens
gataattaaagggggtcatgacatcacttttgggtacacagtggtcttcaattccctttgtattatt

SEQ ID NO: 6796743 - DNA, 66 bp, Homo sapiens
gtggaaagtgctctagactttctcataattattaactgagaaaaaataccactgggcattttgtat

SEQ ID NO: 6796744 - DNA, 56 bp, Homo sapiens
ctgagtaagtgtatgatgctggttgtctgagaagcaataaagtctgcactgcttag

SEQ ID NO: 6796745 - DNA, 55 bp, Homo sapiens
gctctgggctttagtttgttatctgggtaccagagagcatagcttgagcccctgc

SEQ ID NO: 6796746 - DNA, 92 bp, Homo sapiens
ccaccctcagatttgcctcccagcatgggcagctcagccaaggcagggcggccctgcacgtgctgaggacaggggcgtttctaagagggagg

SEQ ID NO: 6796747 - DNA, 70 bp, Homo sapiens
tcctacacacatgaatttataaactgagagtcatacctgctgcagttgctacagttcaagtgtgaaagga

SEQ ID NO: 6796748 - DNA, 75 bp, Homo sapiens
tggggctgcaggctgtggcaggggagccagaaggaagcctaactctcccctgagcatagactctgtcccgcccca

SEQ ID NO: 6796749 - DNA, 75 bp, Homo sapiens
gggggctgtgccaggcgccgtggcctccaggccagactggaccctacccggccctcggcctcgccagcagtcccc

SEQ ID NO: 6796750 - DNA, 65 bp, Homo sapiens
ttctgaagtgcataaaggaaaaactgaaggccccagtgttttttggcctttgtgcatgtttggaa

SEQ ID NO: 6796751 - DNA, 83 bp, Homo sapiens
ccagctgtgttcccaacagcagcctgcagccctgtgtccaagctggagatttttgtccaggcacttgcgggccgcttggctgg

SEQ ID NO: 6796752 - DNA, 64 bp, Homo sapiens
gggagttttggtattgctggtggtggtatggggatattcaaagtaataaccagaactgcatccc

SEQ ID NO: 6796753 - DNA, 129 bp, Homo sapiens
ttatttattatagttcattcattgtgacaatgtaccatagtagtaaaagatgctctaaaaatttgaaaaagaatctttcctcattgctgtcaagtatcatgatgaatctaaaaattgtagttacaccta

SEQ ID NO: 6796754 - DNA, 69 bp, Homo sapiens
tccagactgcttctaggatgagtggcctcaagcagctacatcatctttatactcctaaagcatcaagga

SEQ ID NO: 6796755 - DNA, 57 bp, Homo sapiens
agtatacactgtctcctctaggtggtacccaacatttaaaatactgcagtgtatatt

SEQ ID NO: 6796756 - DNA, 84 bp, Homo sapiens
ttccaagtatatgtgtgtgtgcatgtgtgtgtacccaggtggaaccctcctgcatgctcacatatgcctttatgaatactggaa

SEQ ID NO: 6796757 - DNA, 62 bp, Homo sapiens
tgcttataaagatattagtttctttgagggataaagaatatgaaactatctttttatgggca

SEQ ID NO: 6796758 - DNA, 60 bp, Homo sapiens
aggtgaagaagtaaggtcattaatgtaatctttcatactgtaacacttgctttttgactt

SEQ ID NO: 6796759 - DNA, 59 bp, Homo sapiens
tctttccaaggactctgtagcagcccagcctatctaggtgctaagtgctcctgggaaga

SEQ ID NO: 6796760 - DNA, 68 bp, Homo sapiens
tcttagagcagtgcttcttaagctctgacatgcagatgagtcagagcttaagaagcactgctctaaga

SEQ ID NO: 6796761 - DNA, 73 bp, Homo sapiens
ttcttaaagtaaccctgaatgtttattatatcaattaatataagcagatactgaggctcagggtgtttaggaa

SEQ ID NO: 6796762 - DNA, 79 bp, Homo sapiens
acacctgaagaaaattctgtttttgtttgcttgcttgatgtggctctatcttgtgctgacaaaacacattctttggtgt

SEQ ID NO: 6796763 - DNA, 57 bp, Homo sapiens
ttttcactcatgagagaaaacgtgcttctcagattctgaaggctttctgagtgaaaa

SEQ ID NO: 6796764 - DNA, 73 bp, Homo sapiens
gcaattcacattgaagaaattttaagtcatgatggcaatgggaacttgaaacatctttaaatgtagagcttgc

SEQ ID NO: 6796765 - DNA, 84 bp, Homo sapiens
cggagtgattttatgcatatgtacccatgttctgtgtatgcgtttttaaagtagaaatggaaccacgtcatatacatcactctg

SEQ ID NO: 6796766 - DNA, 67 bp, Homo sapiens
tccctgtggcagggtacaccttaacaccacctgtcagggatgctgtagaaggaccctggcactggga

SEQ ID NO: 6796767 - DNA, 58 bp, Homo sapiens
cactgctttgctctgcccccaggatggttaacccattcacagggccttcagcgcagtg

SEQ ID NO: 6796768 - DNA, 90 bp, Homo sapiens
tcccaggcccagaccttgaacttagttggggacaccatggtgggggaactcagctatggctccttctctactggggggctgggggtggga

SEQ ID NO: 6796769 - DNA, 62 bp, Homo sapiens
ggagaccgtgccttagtggtgtaccaggaggtgcaaacaatttcctataaagttatggttcc

SEQ ID NO: 6796770 - DNA, 59 bp, Homo sapiens
tcctcttccttctgtccaaatgagcttaagttgttttatggaccagatgagaaagagga

SEQ ID NO: 6796771 - DNA, 85 bp, Homo sapiens
ctcttatctcctttagcctggcagattgacatagccattaatgaaaatgaacaatatgccagaaatatttaacaggaggtaaggg

SEQ ID NO: 6796772 - DNA, 59 bp, Homo sapiens
tggatatctgtttctctgtccatgaatcgtcccccaggcacagagtagaacatatgcca

SEQ ID NO: 6796773 - DNA, 79 bp, Homo sapiens
cacatttcagtgtgattagccttggtatatggaattattcaaagttcctctttacctgttgatttatactgaaactgtg

SEQ ID NO: 6796774 - DNA, 61 bp, Homo sapiens
taaagttctggcattttctgtcttcaagttatgctgagagcacggtttttgtggaacttta

SEQ ID NO: 6796775 - DNA, 62 bp, Homo sapiens
acatgccaagtatgattcacatgtgtgaaaaaacacacaaagaatattctctctgagcgtgt

SEQ ID NO: 6796776 - DNA, 76 bp, Homo sapiens
gcaattgcagggtcttaagtgctttgtgtctttctgaaggaaagacacttgaggtttttaggtgcgcctgcagtgc

SEQ ID NO: 6796777 - DNA, 119 bp, Homo sapiens
gcggtacgcttttccgcagtaagtacaaatgtaagctcctttggctcgagatctcaagttcctcttgatgacttgctgtgcttgggagctactctgtccctgaaaaccaggcttgccgc

SEQ ID NO: 6796778 - DNA, 85 bp, Homo sapiens
aatactggcttttgtcattatctttgaagttgaagtagttggcctctgtcaacccttgtcttcaaagttaagaatttgtcatatt

SEQ ID NO: 6796779 - DNA, 57 bp, Homo sapiens
catgctctagattctctctaatcctactcagtcagagtttggggaagtttgggcatg

SEQ ID NO: 6796780 - DNA, 127 bp, Homo sapiens
ccacgtcctccagcctgcagggtcctgcagggccatgggtctcacacaggccgagctggacaggagaggaacagctggccttagtgagcacctgctatgtgccaggcgagggcatgagaggaggtgg

SEQ ID NO: 6796781 - DNA, 68 bp, Homo sapiens
gcaggagcaaatctgttatggtggtccagacaggaggatttagttctgggcacagtttttgcacctgc

SEQ ID NO: 6796782 - DNA, 63 bp, Homo sapiens
ggctcgtgttgtggcagtaacatgttatattgcagacgtgtttcagccagggccacctcagtc

SEQ ID NO: 6796783 - DNA, 68 bp, Homo sapiens
gctgtataattcctttcccttcctacattcttgtttgtaattttttcgggggaagaggagttgctagt

SEQ ID NO: 6796784 - DNA, 72 bp, Homo sapiens
gggagatgcaagtatgaccaacagagatccagatgaatgtcttcaaagttgtttccatgcatgcatttattc

SEQ ID NO: 6796785 - DNA, 69 bp, Homo sapiens
ggctcacagcacagagtggtatggctgccagactaaattatgtgcttgtcatttttctctgtgttgtcc

SEQ ID NO: 6796786 - DNA, 119 bp, Homo sapiens
cctctccaaggagcagcagaataccatatgaatattctgagttaaaattccagaggtaacaaagaaagtgttacctttggaggactagggtcatagaagaattctgttctcttgacagg

SEQ ID NO: 6796787 - DNA, 79 bp, Homo sapiens
taattactggagctagactttccagcctgctgcttcttcttacatcaagacagaggtcatggagagttctctggaattg

SEQ ID NO: 6796788 - DNA, 86 bp, Homo sapiens
cccacggggaaggcgtatagttgggactcagggctgactcagagggccagccctggccagctcatgtctgaggtcacatccgaggg

SEQ ID NO: 6796789 - DNA, 85 bp, Homo sapiens
ggtgagctgtagcactgccagaggtggtggtgtctagaacaaagttctaagcagaccattcctgtggcccagtcttggctgtacc

SEQ ID NO: 6796790 - DNA, 55 bp, Homo sapiens
gtacaggttggctctatcgctgtctctgtagatgtggctgtagatgtagcctgac

SEQ ID NO: 6796791 - DNA, 55 bp, Homo sapiens
tcacagcaacactggggcagacacttgtgtgctcctgttccttcaattgctgtga

SEQ ID NO: 6796792 - DNA, 57 bp, Homo sapiens
ctgctccacacctccatttcctctctgaaaatgggggtagtgtggagggtggaccag

SEQ ID NO: 6796793 - DNA, 85 bp, Homo sapiens
ggtgtttagggatagtttggtgggggacttctcatgttggtgaaacttcaccagtgggtgtcattcccttaggtccgttgacatc

SEQ ID NO: 6796794 - DNA, 71 bp, Homo sapiens
gtggtctttccttcattgtccagtcccacgatgatgaccgtgtgctctggaagcgtcggaggaagggcagc

SEQ ID NO: 6796795 - DNA, 72 bp, Homo sapiens
cagagaaagctctatgttatgcagaattaagtgcttgcttaagaccttgaagttgcaaaacattaatctctg

SEQ ID NO: 6796796 - DNA, 61 bp, Homo sapiens
gcagtggccgcggggctgtgggtcctgtgcacggtgatcgcagaaggccccccggcgctgc

SEQ ID NO: 6796797 - DNA, 67 bp, Homo sapiens
ggcacaaggctatgaagtattagttggctattgtgtcagctatttaaattttttggctctttctgtt

SEQ ID NO: 6796798 - DNA, 65 bp, Homo sapiens
agacagctaaattccaccagaatcagtaatgcccagcagctggttaagggtggagttaagtgtct

SEQ ID NO: 6796799 - DNA, 71 bp, Homo sapiens
gggcatgagtagacagatcctatgcaggcactttctttgtgatcttcaggatcatttgttttatcttgcct

SEQ ID NO: 6796800 - DNA, 84 bp, Homo sapiens
tcaggtgtatgggttgtgcctcagaatcatttatcatcttataatcaatgggattgatttagcttctgaacactatgcatctgg

SEQ ID NO: 6796801 - DNA, 61 bp, Homo sapiens
ctggcaagagttgaagctccaggatagatctgatccattggagctgtaactttcatgaaag

SEQ ID NO: 6796802 - DNA, 61 bp, Homo sapiens
ctctccggatgcctttgttcagggttctcactgcacagccacacacagcaggcccggaggg

SEQ ID NO: 6796803 - DNA, 56 bp, Homo sapiens
ccacgctttgcgactgacttgcgagcaaagcagcgggctcagtctgcggcgcgcgg

SEQ ID NO: 6796804 - DNA, 55 bp, Homo sapiens
agctctggacctgacatctggtgctcggtgtctcattgatgttaggccatgagtt

SEQ ID NO: 6796805 - DNA, 74 bp, Homo sapiens
tcagtgccgcctggcactcccacttcctgctcctgtttggtttcaccccagtggtgccgggtgggttttgctga

SEQ ID NO: 6796806 - DNA, 72 bp, Homo sapiens
ttgttggtaataatgaatgctttataaagtgtctctgcaacaaccactaattagcttcattatagcccacag

SEQ ID NO: 6796807 - DNA, 72 bp, Homo sapiens
cagcaggttcaatctgtacttgaaaaattatttgtatgaaaaattattctgactacagataatgcctggctg

SEQ ID NO: 6796808 - DNA, 80 bp, Homo sapiens
cctacttaggtcgatttgtgtcaaggtttttgaaagtaaacaaaaactttcaaacataaaactaaatcgagctatccagg

SEQ ID NO: 6796809 - DNA, 80 bp, Homo sapiens
ggccaaaccttgtttttcacagtgctgttgggagtaccactgccctatcagaagctgagagaagggaggtatattaggcc

SEQ ID NO: 6796810 - DNA, 81 bp, Homo sapiens
ggggatctgccggcatcttcgtggtcgcaggctgctctgtgccactgtgccactgggggccggcaatactgctggattccc

SEQ ID NO: 6796811 - DNA, 57 bp, Homo sapiens
ctcatgtagctctcaggccacacatttatatgatggttcagttttgagtagcatgag

SEQ ID NO: 6796812 - DNA, 68 bp, Homo sapiens
cacgtgaggcactgatgacctgctacactcatgcaggactcacatagcttcagatgactcattacgtg

SEQ ID NO: 6796813 - DNA, 59 bp, Homo sapiens
ccagtcagtttcatttgccagctctcacatacctcaagagctgtttgaagctatattgg

SEQ ID NO: 6796814 - DNA, 75 bp, Homo sapiens
gtcacgcctgtgggcctgcacgtggggatgtgtccacacaagtctctcggtccccagtgctcccacagctgtggc

SEQ ID NO: 6796815 - DNA, 65 bp, Homo sapiens
tggggaaggggttgttactggcctctaaggaagacccaaaggaaagtacaaaaattcctttctca

SEQ ID NO: 6796816 - DNA, 127 bp, Homo sapiens
atctatttatatttttatcatcttaaccatttttaagggtatagttcagtagtgttaagtatattcacattgttgtgcaattatagtttttttaagaaaggaatctaatttatcaatgaatgtagat

SEQ ID NO: 6796817 - DNA, 62 bp, Homo sapiens
tttatctgaatatgctccccacttgaatctggggccacaaaagactgcatcttcaagataag

SEQ ID NO: 6796818 - DNA, 65 bp, Homo sapiens
tggcactgggacttggcgtgatgtatttaagtcagatataccctgttcgagtcccagctctgcca

SEQ ID NO: 6796819 - DNA, 63 bp, Homo sapiens
tggcttcatgtagtttgagttgatgtgtcatttgacaccaaaataatcttgactactgaatca

SEQ ID NO: 6796820 - DNA, 91 bp, Homo sapiens
gccgggcgcagtgactcacgcctgtaatcccagcactttgggaggccgaggtgggcggatcacaaggtcaggagttcgaggccagcctggc

SEQ ID NO: 6796821 - DNA, 58 bp, Homo sapiens
tctcaggaggagggtacaccatcagtttacacattgattgcagccactcttccagagg

SEQ ID NO: 6796822 - DNA, 71 bp, Homo sapiens
cccacagaattggagaaggtgctggaggattgcttctctctaaagagaaccttttctcattccctgaaggg

SEQ ID NO: 6796823 - DNA, 63 bp, Homo sapiens
taggcagctggttctttccattaaactttattactttgatgttgctgaaagaattattgtctg

SEQ ID NO: 6796824 - DNA, 78 bp, Homo sapiens
cacaatagggtcagagtcaggtgcagtattataacccagaaacagtgcttcaaggacactgactttttattcccagtg

SEQ ID NO: 6796825 - DNA, 60 bp, Homo sapiens
ggattttgttaagctcatgcagtccatatgggcacagttgagacttcacagctcggatcc

SEQ ID NO: 6796826 - DNA, 79 bp, Homo sapiens
aggctggagtgaagtggcgcgatctcggctcactgcaagctccacctgccgggttcacgccattctctcgactcagcct

SEQ ID NO: 6796827 - DNA, 104 bp, Homo sapiens
tgcagcgatcccttcacctttagttaaagaattggactgtgctgctcaaaataaagatcagttggaggtaggatgtccaagactgaaggtaaaggactagtgca

SEQ ID NO: 6796828 - DNA, 58 bp, Homo sapiens
agaggtggcatcacagtactggggggagccctcactccaaccctcaacatgcatctct

SEQ ID NO: 6796829 - DNA, 59 bp, Homo sapiens
tggaaatatgtagcaattacaaggagctggaaagtttttttgaaagccctatgttttca

SEQ ID NO: 6796830 - DNA, 126 bp, Homo sapiens
ccgctgcctgcgcagagggggcagcccagtgtggggcctccgcagaacgtcacttcagcctctttgttcactggcatctgtggagccttttccattctgggctgccatccctttggcacccagagg

SEQ ID NO: 6796831 - DNA, 59 bp, Homo sapiens
gacacatgtcagacggacaccctttctgcagtaagattcggtgagagtctgctattgtc

SEQ ID NO: 6796832 - DNA, 79 bp, Homo sapiens
ggtgcgcatgcagtggggctgcagttggtccctggagggaagcagagctggagcagccccactggccagtgtcgatact

SEQ ID NO: 6796833 - DNA, 56 bp, Homo sapiens
ggaggaggaggagcccgaggctgcgggcacaggctcggccgggggcgccccgctct

SEQ ID NO: 6796834 - DNA, 69 bp, Homo sapiens
gttttgtagctgtcagaaatagctggaccattcaagtgtatgtgaaaccagctctgtaagctgtgaaat

SEQ ID NO: 6796835 - DNA, 62 bp, Homo sapiens
tgttgacagacacttgagttgattctggttttggactattgtgaataaagctgctgtcgata

SEQ ID NO: 6796836 - DNA, 66 bp, Homo sapiens
aggaagcatcacattacagggtgagtgtagtaacagcagcactacatcttcacgtgtcttattcct

SEQ ID NO: 6796837 - DNA, 65 bp, Homo sapiens
cagcccaagatgaatgatgaagtgtgttcaggagtgaaccacattctaggtaatcagtttggctg

SEQ ID NO: 6796838 - DNA, 81 bp, Homo sapiens
ttcagagagaaaacctccccagcattctgacttcctgacccagatttcaagaagtcccatgctggtgagaaagtccctgaa

SEQ ID NO: 6796839 - DNA, 55 bp, Homo sapiens
cagtgagggcccccttccaggtagccagacacgcaccagtttggggggcttcctg

SEQ ID NO: 6796840 - DNA, 69 bp, Homo sapiens
tcagatttggacatcactgggcatttgtgagactaaacctctgacagtggatgtgatgtccaggtaaga

SEQ ID NO: 6796841 - DNA, 91 bp, Homo sapiens
ctattatttgttcttgggagatattgttctttacatttatacatttacttatatttgttggaaggacagatcacctcaagaagagtaaaag

SEQ ID NO: 6796842 - DNA, 125 bp, Homo sapiens
atcttgggggttggggagggtggacttgttcttggatcttggcagaagaaatcattatctggacctttattggactggatacccttttctgcatcttgggccttccttctctatgctcccgaggt

SEQ ID NO: 6796843 - DNA, 66 bp, Homo sapiens
atgtcaggcctgctcaaacagattcctgggcccaagcccagaggtttgatcgagtaggtctgggat

SEQ ID NO: 6796844 - DNA, 127 bp, Homo sapiens
aagtgattccatcaacctgcctatgtactttgagtcatttgaacagtttcaagaaaactttgaatcatattgaaagaaattgccattgtattcatatgaaagtacagaacaaaacttggaaacagtt

SEQ ID NO: 6796845 - DNA, 80 bp, Homo sapiens
tgggggtgaggaaaagggcagagttcactagaaagaagtaatagtccttctgttactgaaagctgccctctcaaaatcca

SEQ ID NO: 6796846 - DNA, 88 bp, Homo sapiens
ctaaccaacgcattttaagaagagttatcactttcaaagtccatttttgaggaaaggaatttattttaaaaatgattgcgtttcttag

SEQ ID NO: 6796847 - DNA, 90 bp, Homo sapiens
tttcagacatcaggagataattatccctgtcttctcggaaccagcttcttcaaaggagtcaggaattatttatgatagaaactactgaaa

SEQ ID NO: 6796848 - DNA, 81 bp, Homo sapiens
ttgtgctgaaatctgttgtcaggaatccacaagaagttcttcatatttattttgtgtttcggatagcagattctgttacga

SEQ ID NO: 6796849 - DNA, 57 bp, Homo sapiens
cccgccttggcaccaccaagtggccatcagctgaggggccgagggggtgtcagtggg

SEQ ID NO: 6796850 - DNA, 62 bp, Homo sapiens
agcctaggcctctggccaaagggcttggaccaaagtatctgagtccaggaggaggccaggtt

SEQ ID NO: 6796851 - DNA, 65 bp, Homo sapiens
ttcccatgcccggtgggtggaattcacagaattcttcctgtttccttgaaagctggacatggggg

SEQ ID NO: 6796852 - DNA, 81 bp, Homo sapiens
gagagacagtaaatataacagcatatttacaattgttgaatctagataaagagtagatatgtgtttattatgctgtaattc

SEQ ID NO: 6796853 - DNA, 81 bp, Homo sapiens
gaaggaatgcgagtcctgagaaccgtgtctgctttgtgcacgtgctcagacgcatcaacgattctgcttctcattcgcttc

SEQ ID NO: 6796854 - DNA, 124 bp, Homo sapiens
ggctctgtggggaggtgtgcccagggtcaccagatggagagcggcagattaggaacagaatggggttagcctgtgtcctcttccagtgctccttctgggccctactccttcctgatcaggtgcc

SEQ ID NO: 6796855 - DNA, 71 bp, Homo sapiens
ggcgcaggcagctctaatggaaagtgccgtcaccaaagagcaaagcattatttatgactgtctgtaatgcc

SEQ ID NO: 6796856 - DNA, 59 bp, Homo sapiens
tcttgtaccgctgtcttcttgatctctaccctgggaagaggccccccagcaggtgaaga

SEQ ID NO: 6796857 - DNA, 80 bp, Homo sapiens
ttgtatgatctccagaggtagggagctatgttatgttcatacaaacatttagtttcccatttagttaaagatcactacaa

SEQ ID NO: 6796858 - DNA, 85 bp, Homo sapiens
ggttgggaggggcagggcactttacccatagcttggtaaggtgactctccagccctggtgccaaggttcccctccactccccacc

SEQ ID NO: 6796859 - DNA, 61 bp, Homo sapiens
gaatacttgtgtgcagttgtgctcaggtctgactctgtgcatgcaaagaatataggtgttc

SEQ ID NO: 6796860 - DNA, 83 bp, Homo sapiens
ggcttacacctgtaatcccagctactcaggagggtgaggcaggagatttgcttgaacctgggaggtggaggttgcagcgagcc

SEQ ID NO: 6796861 - DNA, 73 bp, Homo sapiens
ggactagatgtgtagagggaatttcaaataatgtatttaaaaaattatttgaagtctgttttatacttatttc

SEQ ID NO: 6796862 - DNA, 67 bp, Homo sapiens
aagggttgagttctaaaggcagaacataaaataaaccttttattaatcttatctttggaaatccctt

SEQ ID NO: 6796863 - DNA, 80 bp, Homo sapiens
attgaaggtgggtaggcaaagcaatgacgttcagcaggttaggagtcttaaacgcatttttgacttacgatattttcaat

SEQ ID NO: 6796864 - DNA, 74 bp, Homo sapiens
gggtacattcagaattgggaggcaatgaattgataactgacacaacctttttgtcattcctttctaattgtccc

SEQ ID NO: 6796865 - DNA, 80 bp, Homo sapiens
aagatggtagcagcagagcaggtcctcccacgcgtgctcgcccagcatgtggctggaatcctgccagctctgcccctctt

SEQ ID NO: 6796866 - DNA, 83 bp, Homo sapiens
gcatctttctcctgttatttatctgagcatttatcactcattattgtgatgctcagctcaaatatcatggtttctgagagtgc

SEQ ID NO: 6796867 - DNA, 62 bp, Homo sapiens
gtggcagagggtgagctggactaggaattagcagacctgggttccagttccagctttgccac

SEQ ID NO: 6796868 - DNA, 62 bp, Homo sapiens
gcagtgagctatgatcatgttactaccctctaggctgcagtgagtcatgatcatgctattgc

SEQ ID NO: 6796869 - DNA, 67 bp, Homo sapiens
gggagtccagggagatggcagaggctggcatccttgacagcatctgtaggactcctcttacattccc

SEQ ID NO: 6796870 - DNA, 57 bp, Homo sapiens
tgctattgtgaatagtgccgcaataagcatacgtgtgcatgtgtctttacagtagca

SEQ ID NO: 6796871 - DNA, 75 bp, Homo sapiens
ggaaatgttcacagagcactgccaagtacaagtgtactctcttgtgtcccggtggttctctgtcacgatctttcc

SEQ ID NO: 6796872 - DNA, 56 bp, Homo sapiens
gtcccacaggaactcggtggagctcaattgttgatgactgccatcttgtgtgggat

SEQ ID NO: 6796873 - DNA, 83 bp, Homo sapiens
ggagaggtcccgctcatcaaaggattgcatgatttgggtaaatggaaagcctaagaattttttagggtaagcaggaccactcc

SEQ ID NO: 6796874 - DNA, 76 bp, Homo sapiens
ttcaccactctctaaggtaggtactataatttcctctattttatgtatgaggaaactgaagcccagagagggtgga

SEQ ID NO: 6796875 - DNA, 62 bp, Homo sapiens
tatccttgtacttcgggcattgccataagaaccttgcagcataggccactagtgccaggatg

SEQ ID NO: 6796876 - DNA, 56 bp, Homo sapiens
gagccctcaatgaatctgcattttatagcatgtactgtgcaagtttcgggggtatc

SEQ ID NO: 6796877 - DNA, 64 bp, Homo sapiens
gccttatgttgataggaatctgattcccattcctttttgggaatgagttgggcagcatacaggc

SEQ ID NO: 6796878 - DNA, 56 bp, Homo sapiens
gctttgcttccttccccttcaaggaaaacatcctgccctggtggagggtgcagagc

SEQ ID NO: 6796879 - DNA, 87 bp, Homo sapiens
cctgtggctccaagttccaaattccaatcccctgaagacaccagggtgtctcaagctgccctgggatttggggtaatgggtcacggg

SEQ ID NO: 6796880 - DNA, 58 bp, Homo sapiens
acccaggctggagtgcagtggctcgatcttggctcactgcaacctctgcctcccgggt

SEQ ID NO: 6796881 - DNA, 86 bp, Homo sapiens
gtgatgacttaagtcatatgtgtcccaagtctctagaattttaggcaaatggagtttggggcacaaatgtacttctcagtcattgc

SEQ ID NO: 6796882 - DNA, 76 bp, Homo sapiens
aagcctcaacgactacttagattcgaagagaaatgctttcccaaggttcttcttcatttctgacgatgagttgctt

SEQ ID NO: 6796883 - DNA, 68 bp, Homo sapiens
gtgcccacatctgctgcctcctgggccagtagttcctggtcctgggcacagtatatgcccttgtccac

SEQ ID NO: 6796884 - DNA, 73 bp, Homo sapiens
gcctttttgcagtctcagagaacagttggtgcttctgggcaggaggagctgggctgctgctgggagccagggc

SEQ ID NO: 6796885 - DNA, 78 bp, Homo sapiens
ccacggacatggcagcctgcgtgaaggagcttgttttccatctcctggcagagctcctgcgcacggtgcacaccctgg

SEQ ID NO: 6796886 - DNA, 57 bp, Homo sapiens
acagaggcagtgtgagatactgaatgagaattgcgatctggttgaacattcctctgt

SEQ ID NO: 6796887 - DNA, 81 bp, Homo sapiens
gcaggagtaatgatagttcactaatagcaaaagccagctgtgctggtttcctttaatagtgatattgtagtattaaaatgt

SEQ ID NO: 6796888 - DNA, 88 bp, Homo sapiens
atgtctgttttgggatcagatgtctccacacaatctgagagtctggaagtcaagttggatgtgagagcatcatgttcccctatagcat

SEQ ID NO: 6796889 - DNA, 90 bp, Homo sapiens
tcccaggacctagtctagttctctcagcctccccgttggtggctgttttcaacttggagggagctgggtggaatctttacttgtctggga

SEQ ID NO: 6796890 - DNA, 66 bp, Homo sapiens
atggagaaagtacagcaggcaacaaaaatagtcttctcattactgttttctgtgtattttttccat

SEQ ID NO: 6796891 - DNA, 84 bp, Homo sapiens
aaaacagagctttgataagccccgtggatgcacctgacacgagagaatcaatggtgcaggtggatttgggctcaaggtggtttt

SEQ ID NO: 6796892 - DNA, 55 bp, Homo sapiens
tgagaaggccagaaaattcctttaggggcctgaaggcttggattggtcattttca

SEQ ID NO: 6796893 - DNA, 74 bp, Homo sapiens
cctctgtccctctgtgtccctgcagtccctcttgcctccaggcgatggcagcagaagacaaggagtcccagagg

SEQ ID NO: 6796894 - DNA, 108 bp, Homo sapiens
ggaaattaatacaggacccacggaattggtctctgctaaagggaggcccaggtcagcctcccttcagtagagcccaatagggatccagtaggcgtcctgtggatttcc

SEQ ID NO: 6796895 - DNA, 59 bp, Homo sapiens
aaaggtcccttgtcggagggggatgggaggaattcattattttgtcagaagggactttt

SEQ ID NO: 6796896 - DNA, 56 bp, Homo sapiens
ctgcactgccctaaaacctttgaccagagattctgggaaggcttggacagtgacag

SEQ ID NO: 6796897 - DNA, 122 bp, Homo sapiens
gcctggttagctagaagttcctgccttgtcacagcactaatcctgcaatttctccattggatttctggactgatgagcaattttgatgctgataaggcagaaacacaatcactctcctgggc

SEQ ID NO: 6796898 - DNA, 62 bp, Homo sapiens
gggtgagcaggggcctcgtctcccttctctaatcgctggtgaagattggggcctctgcaccc

SEQ ID NO: 6796899 - DNA, 72 bp, Homo sapiens
gagacagcagacttggcagtgggaatggacaaacagggccatttaccccttctaccctggcacctgcttttc

SEQ ID NO: 6796900 - DNA, 86 bp, Homo sapiens
ccaaaccctgctatttgttcaaaatcaagattaaaagcatttctacaacactacaactttcttcttgatttaaacagggagtttgg

SEQ ID NO: 6796901 - DNA, 55 bp, Homo sapiens
cctggccaggctctcagcactgcccacctgagcatgcaggggccgcctggccagg

SEQ ID NO: 6796902 - DNA, 76 bp, Homo sapiens
ttcagcattaattacagtagcaaaagaccggaagcaactttaatgcttattgggggcttaactgaataaatttgga

SEQ ID NO: 6796903 - DNA, 58 bp, Homo sapiens
acactctacagagcaatctacctgcaggaagcaggtggaatagaagctttgtaggtgt

SEQ ID NO: 6796904 - DNA, 58 bp, Homo sapiens
tccagggacagcgctggagctagaggaacctccagagccttcctgccgctgccctggg

SEQ ID NO: 6796905 - DNA, 62 bp, Homo sapiens
ctggcgctggaaatcatattttgttgtaaaacctaatactagctcattgtgatccagcctag

SEQ ID NO: 6796906 - DNA, 88 bp, Homo sapiens
ttaatgaatctggtgtccttgttgaacgaaaataggtgaaatgaaatgcctaccatttgactctctaaggataaacaagagttattga

SEQ ID NO: 6796907 - DNA, 65 bp, Homo sapiens
tgagtttttgccttctgcatcttccattagaccatgaaacacttgaagacagtggctaggactta

SEQ ID NO: 6796908 - DNA, 77 bp, Homo sapiens
ttgttcacagttctgcaggctgtacaagcagcatgatgccaacatttgcttctggtgaggcctcaggaagtttacaa

SEQ ID NO: 6796909 - DNA, 80 bp, Homo sapiens
cctggaggaggaggttggagggctgccctgcagggtcactgcacctctgcccagagcctcttacctccagatccttcagg

SEQ ID NO: 6796910 - DNA, 61 bp, Homo sapiens
gctgatgggggcgagtttctaaagccggcaaagaaagagcaggtaggctggccttcacagt

SEQ ID NO: 6796911 - DNA, 76 bp, Homo sapiens
cataaatctatctgagagatgtgtaggaagctgaatctttaaaacctggcttccctcttattttatggcatttgtg

SEQ ID NO: 6796912 - DNA, 61 bp, Homo sapiens
gcaaagcaaggaagacacagaattagatttaaatctaggtaatgcaactactttgctatgt

SEQ ID NO: 6796913 - DNA, 66 bp, Homo sapiens
gggccttctgtccaggctggcctggatcattctccaggtacatctatggggatagaacagtggccc

SEQ ID NO: 6796914 - DNA, 99 bp, Homo sapiens
gcagagtattgacaatgtcatttttgactttgaagtgagccatataagtgtcacatcacatgagtgcaaggaacactgacatacttcttcagctgctgc

SEQ ID NO: 6796915 - DNA, 118 bp, Homo sapiens
cagaactcttggctgcctgcagggctctgggcagaggacagcccccttgtctgggaggctgtaattccgaggccagggctgccttcccaatcacctcaggcaagcaaatgaggcaatg

SEQ ID NO: 6796916 - DNA, 96 bp, Homo sapiens
tgggaattgtactcttaagatatttgttcagagatgttcaagctctcagttacaagatgcttgagccagaaacagaaaagtctgagtacagtgcca

SEQ ID NO: 6796917 - DNA, 57 bp, Homo sapiens
tcaaaattatttagagcagacagttctatatggagtctaatgctcaaatacttttga

SEQ ID NO: 6796918 - DNA, 59 bp, Homo sapiens
ccttttctagaaagggaggcaacacacatgttgggtaaatctcagtttctagagtcagg

SEQ ID NO: 6796919 - DNA, 81 bp, Homo sapiens
gcctatgactcagctccctgaggaaggggtgtggtgggtcaccgaccctcaccccactcccaggaccatgagtcactatgc

SEQ ID NO: 6796920 - DNA, 69 bp, Homo sapiens
gggagcctggtaatatttacaaagcatctagtattgctaggttctttgtatatatcactttacctcacc

SEQ ID NO: 6796921 - DNA, 70 bp, Homo sapiens
ggtacattattgttagtgagactgtagattttactcgattttaccagaatctcactaatgtccttttgct

SEQ ID NO: 6796922 - DNA, 69 bp, Homo sapiens
aagattgtccaccacctggatttcggagcaactagggaaaaatctgtttccaggattaagaacaatctt

SEQ ID NO: 6796923 - DNA, 67 bp, Homo sapiens
attctgtgggcattgcccatgaaatgaaatcaaaacaatatttctcttctgttcagtgcccaagaat

SEQ ID NO: 6796924 - DNA, 63 bp, Homo sapiens
tgcaaagctgtgcaggaactgcttgcttggaacttgcttccaaggcagatgcagagctatgca

SEQ ID NO: 6796925 - DNA, 68 bp, Homo sapiens
agagacattaattcacctttctgaaccatgatttcctcactggggaatggaactgggaatgcgtctct

SEQ ID NO: 6796926 - DNA, 90 bp, Homo sapiens
gacatcttaatgataatatagaatgtattatagtacagattccaaaatcctaggatactctgttgtgaaacattgtatttaatagatgtt

SEQ ID NO: 6796927 - DNA, 87 bp, Homo sapiens
ggtcagctgtgctattcttccagttttgactgtgtttactcatttgtccacggttagccacaggctggaaatttgtctcagctgatc

SEQ ID NO: 6796928 - DNA, 79 bp, Homo sapiens
tgaggttgttgcagacactccacagtcgacatttagtttagttgctatttctggtggcacgtgtcttgcatgggcctca

SEQ ID NO: 6796929 - DNA, 86 bp, Homo sapiens
gtcttcataatgactgtgctattgtttattttgaatctactaaacacagttgatatgtaatatgcaatgccacaggggatggggac

SEQ ID NO: 6796930 - DNA, 63 bp, Homo sapiens
atttgggcaaaggtagaaggagaggggtaaaacctactattttattctgatttttgcacaagt

SEQ ID NO: 6796931 - DNA, 94 bp, Homo sapiens
cggagaaactaggctgtcggtgggacacatgggtgtgaatcagctctgctacttacatgctctgtgtgtctccgcaggacacttaacctctttg

SEQ ID NO: 6796932 - DNA, 86 bp, Homo sapiens
caggagaaagttgtgatgcagatatgcaaactgtagtttgacaaagttattaaaattgagttgcaaatttgggtgctatcttcctg

SEQ ID NO: 6796933 - DNA, 60 bp, Homo sapiens
ctgttgatgaaaaggtgcttgtgcttcagttgagctgtgagtcatctgttcattcaacag

SEQ ID NO: 6796934 - DNA, 84 bp, Homo sapiens
gaacagggttttggtttatctgtggatctctttgttgctctcctaacagtgaccacagagtaaatcaggtctgtaaaccagttc

SEQ ID NO: 6796935 - DNA, 86 bp, Homo sapiens
cgtttaatgaagctcactcttgcctgtggtttctgaacaccatcaaatagtggtaactgaggcagaagggtaagtggatgtggacg

SEQ ID NO: 6796936 - DNA, 77 bp, Homo sapiens
cagtcaaggtcacagtctaggcctaggtcaaaatctagatcaagatcttggactagtcctaaatccagtggctactg

SEQ ID NO: 6796937 - DNA, 82 bp, Homo sapiens
aaccaattgagtgtaagatagccttgggttattttaaatgagttaaggaagcccaagtctcatcttcagtaccatattggtt

SEQ ID NO: 6796938 - DNA, 63 bp, Homo sapiens
cagccacatggtggaagagcatcagaaagtgcaagtgctcaggatgcaattccatcaaggctg

SEQ ID NO: 6796939 - DNA, 60 bp, Homo sapiens
gctgaggattgaagagttgccagttgttctaacaacatggtggccattattaaccttagt

SEQ ID NO: 6796940 - DNA, 61 bp, Homo sapiens
tctttgaaacattcactctcaattttagaatgctgtggacattctgagtgtgaaacagaga

SEQ ID NO: 6796941 - DNA, 64 bp, Homo sapiens
tctgcttcacggtctctggctgatgccatcaagctgtgtcagtccaggggctgtgatgtcatgg

SEQ ID NO: 6796942 - DNA, 103 bp, Homo sapiens
aacattatattcttcagtcagggccgcattggtggacatgtggtagctatcattctgtatgctacactcaatcagtgctattaggcagactgaaatatctgtt

SEQ ID NO: 6796943 - DNA, 58 bp, Homo sapiens
agccaacaactctgagcccagtttctatctaaaaactggagctaatacttgttttgct

SEQ ID NO: 6796944 - DNA, 61 bp, Homo sapiens
ctgtagatgtctgtgtccaaatttcctcttcttataaggagaggcagcagtcatactacag

SEQ ID NO: 6796945 - DNA, 117 bp, Homo sapiens
gtacaagtgatttcaaacgatctctaatgttggatttttgctgctgctgttactgctattagcggtagtagcagtgacagctgaggtaccattagcatcttagtcaaagtcacatac

SEQ ID NO: 6796946 - DNA, 81 bp, Homo sapiens
tgagagagagtaaccagagctcttcagcacaggatcagacagctggtccttactagggtgctttgggctgctgtttcacca

SEQ ID NO: 6796947 - DNA, 62 bp, Homo sapiens
gcccactgtatagccactgccggtccatccacagtggactctgggtagggtagtgggtgggc

SEQ ID NO: 6796948 - DNA, 101 bp, Homo sapiens
tgaggcaagaggatcatttgagcctctgagtccgaagttgcagtgagccatgattgtgccattgcactctggcttgggctacagagtgaagccctgtctca

SEQ ID NO: 6796949 - DNA, 86 bp, Homo sapiens
tccagcaggctctcctggctcagaaacctctggtgtctcgagaccttagtgttcaggcctaggtttcagagccttagtctgttcga

SEQ ID NO: 6796950 - DNA, 58 bp, Homo sapiens
gcccatgccaggggctgagaaggaacgtccaggaaagttggagtggtcccgggtgggc

SEQ ID NO: 6796951 - DNA, 81 bp, Homo sapiens
ggacagtgaagcatgcagggagcagaggagacacatgataagtgtctgctgttccgttctctgtttgcatgtactatatcc

SEQ ID NO: 6796952 - DNA, 68 bp, Homo sapiens
cctgccctgctcactgtcggtattccaattcatctacactgataactttggcgggcatggagggcagg

SEQ ID NO: 6796953 - DNA, 59 bp, Homo sapiens
ccactgtctgtgacatcagaaactccagtaggacaaaaggctctgatggcatgataggg

SEQ ID NO: 6796954 - DNA, 74 bp, Homo sapiens
tgtatggtgtttatttttcccagaaccagaacatagtagattgtcaataattttgaagaagtgaatatcatata

SEQ ID NO: 6796955 - DNA, 75 bp, Homo sapiens
ccctcagcctcagttttctttccaggatgacgtcttcacagagttgtgatggaggtgaaatgagattttgtaggg

SEQ ID NO: 6796956 - DNA, 97 bp, Homo sapiens
agtaatctatgtagccccccagatctttagatggtggactatctgacttggctatgtcgcccggtagaattttaccatctgggcttcgaagacaact

SEQ ID NO: 6796957 - DNA, 82 bp, Homo sapiens
gtttttggctggacacttaacttctgagaataaagatgttttccaactttttctagcagctaggtgtgtcttggccaataac

SEQ ID NO: 6796958 - DNA, 59 bp, Homo sapiens
atagttttagcctttcttggcaatctggtgccccagccaatttcctgaggtaaagctgt

SEQ ID NO: 6796959 - DNA, 71 bp, Homo sapiens
atactttagctttataggagtttttagtatgcatatgtctaactgtgtattcctatatagtaatatagtgt

SEQ ID NO: 6796960 - DNA, 105 bp, Homo sapiens
gttgagatggagtcttgctctgtcacccaggctggagtgcagtggcacgatctcggctcactgcaaccttcgcctcccgggttcaagtgattctcctgcctcagc

SEQ ID NO: 6796961 - DNA, 84 bp, Homo sapiens
ctactcttgtgtgcgtccttgctatatgttcttaacagaaaattactttagaacttagtagcacaagaagtacacatagagcag

SEQ ID NO: 6796962 - DNA, 56 bp, Homo sapiens
gggcaggtggagggcccagccaggaggcacaggcctaggtgagccctcgcctgcct

SEQ ID NO: 6796963 - DNA, 59 bp, Homo sapiens
acttcctggttttctggcggtgcttcacattggctgaagccatcaggaagccagcaggt

SEQ ID NO: 6796964 - DNA, 87 bp, Homo sapiens
ctcgaacatgttccagcctagccctggagcagggaaatacagtttgctggattcctcccttctttgggtggtaggggcagatttggg

SEQ ID NO: 6796965 - DNA, 63 bp, Homo sapiens
tatctctaggtaaaggctttgaagtccccacctcccaacgcaaagcccccctgatctgagatg

SEQ ID NO: 6796966 - DNA, 55 bp, Homo sapiens
gtgatcttttctctcttgctttttgtgtgtcctagagcactgaagagttggtcac

SEQ ID NO: 6796967 - DNA, 75 bp, Homo sapiens
ggctggagtctcttgtaggggcagaggaagaaccagatgtctgcccttccttcctctgtcaggcaggccccagcc

SEQ ID NO: 6796968 - DNA, 60 bp, Homo sapiens
aggtgtctggatgggtgtccttgtgaactgtggctctgaggacaccctgagacagaactt

SEQ ID NO: 6796969 - DNA, 77 bp, Homo sapiens
gtagagaactgggtccaggtttgctctacttgtcttataacttctaagaacaagtggctacctagattatattctac

SEQ ID NO: 6796970 - DNA, 58 bp, Homo sapiens
gtgtcatgcacactcagtgttgcaaattaatggtctggtgatctgggtggcatggcat

SEQ ID NO: 6796971 - DNA, 56 bp, Homo sapiens
aaaataagttggtcctgtccttgtttgctcttggcatagagaaggccacttgtttt

SEQ ID NO: 6796972 - DNA, 66 bp, Homo sapiens
agagagacagtgagaatgagttgaaaaagcacatgatttttttaagtcccagtcctgtcactttct

SEQ ID NO: 6796973 - DNA, 83 bp, Homo sapiens
ggtttaagacagggaatcatttacatagaaacaatataagcattctagacattgtatactcttgtaggtgagtcctcttagcc

SEQ ID NO: 6796974 - DNA, 66 bp, Homo sapiens
cttaaaccaggtactgatattgctgctgagtttgcaaattaagatgtaagatcagagcttggtgag

SEQ ID NO: 6796975 - DNA, 58 bp, Homo sapiens
cctttggctgcatagggaaggggtgcccacatgcccccgcccgcattcagttcgaagg

SEQ ID NO: 6796976 - DNA, 56 bp, Homo sapiens
ggaggatggatccgaccccttccagctcccatggctgggaggttttccatctctcc

SEQ ID NO: 6796977 - DNA, 69 bp, Homo sapiens
tgtatctttctactgtctagtttgttaatgacaactcagttttggagtggatgtgtagaagttgaaaca

SEQ ID NO: 6796978 - DNA, 58 bp, Homo sapiens
gctggagaaatgaaaagctttgtgatcatgaagaaacataatgtatgcattttccagc

SEQ ID NO: 6796979 - DNA, 94 bp, Homo sapiens
gatgtagagaagaaggcagactgaaaagggagtttagggccaaagcaatgacattgcaatgagttccctgagttttctttctgactcatatatc

SEQ ID NO: 6796980 - DNA, 89 bp, Homo sapiens
ccgccacgtacctagttaccagttgccctttgtgtctgcgtgtttgcatatttagaaataaatctgcagctggggctttttggtggtgg

SEQ ID NO: 6796981 - DNA, 63 bp, Homo sapiens
gttctaagtgttgacaaagtctagctgtgatcatacttctgatgattgggagacatttgggat

SEQ ID NO: 6796982 - DNA, 65 bp, Homo sapiens
gccagcctgggtgtcgatcactagtgtggcacataattgctgtggtggttgatctggggcacagc

SEQ ID NO: 6796983 - DNA, 61 bp, Homo sapiens
agtgtgaccttatttaagaaattccatctgtaatgatgtgatttccaaataaggtcacatt

SEQ ID NO: 6796984 - DNA, 80 bp, Homo sapiens
caggtgtctcaggactcaggtgagcaatttgccatagaatagtccaggtaggtgcccatcacctcacagtctctcacctg

SEQ ID NO: 6796985 - DNA, 77 bp, Homo sapiens
agcaacatccttgggcatgcatccatgcactgagtacaggtatttctgcaggatggatgctcagaagtctaattgct

SEQ ID NO: 6796986 - DNA, 86 bp, Homo sapiens
agacaaggtgctggtaattagattgattaaattggaagtcccagtaggaaagcaattttatatcttttattgagcaccacatgtct

SEQ ID NO: 6796987 - DNA, 92 bp, Homo sapiens
gagtgaaatctagagacaatttgaatatagagcaaagggagagaatacagaaaccacactccacatatagaattggtcttaagagttccctc

SEQ ID NO: 6796988 - DNA, 56 bp, Homo sapiens
gtgtgtgtgtgtgtgtgtgtgtgtgtgtatgcacatgtgttcacgtgcacatgtgc

SEQ ID NO: 6796989 - DNA, 61 bp, Homo sapiens
gtggaaccggggtgccccacagtaagtcccctttgttaggcatcctgtccctggattcgac

SEQ ID NO: 6796990 - DNA, 65 bp, Homo sapiens
ctgaaatagtttcatagaacttatgtttataaatatttcataagaactagctgagaccattttag

SEQ ID NO: 6796991 - DNA, 87 bp, Homo sapiens
tctccatgatgaaaggttgtctgtattgaagtaggagaagtcagatttctctctcagccattacagaacctcatatatgatggaaga

SEQ ID NO: 6796992 - DNA, 106 bp, Homo sapiens
gatactatattcaattactctcagaggatctgggtattccttttctcctgtgtagttacttggaaaatagctataggtccctctggggcataatctaatgtatatt

SEQ ID NO: 6796993 - DNA, 85 bp, Homo sapiens
gttgctggggaagtgacaacagccatcacttttaggttttgtttgcaaggtttgcatgtgtaaggttgtttatttcctttcagat

SEQ ID NO: 6796994 - DNA, 64 bp, Homo sapiens
gaccttgtaaattttcactccagccttcaaatctatggagactggagtcagagattaaagtgtt

SEQ ID NO: 6796995 - DNA, 76 bp, Homo sapiens
cagatggtacatgtggaaatgggttggatggagtattttaatacccacacatctctaattcagttctacacgtctg

SEQ ID NO: 6796996 - DNA, 69 bp, Homo sapiens
acagaacagatgatgtgcacagatagagatataaatagtaatttttgtctgggcatgcattttcactgt

SEQ ID NO: 6796997 - DNA, 78 bp, Homo sapiens
gcatctgaatatagaatcatctgtgcactagtaaattaagctgtatactagtcatttaggtgatattataacagatgt

SEQ ID NO: 6796998 - DNA, 74 bp, Homo sapiens
cttccaggtacactgtgaggtttccaagggcaaggatattcttattcctctttggatctcaaggtggcaggagg

SEQ ID NO: 6796999 - DNA, 59 bp, Homo sapiens
ggttcagtaacttggccgaggtcatacagctaacaagtttaagagtcaagatctgaacc

SEQ ID NO: 6797000 - DNA, 70 bp, Homo sapiens
gtggccctccactgagcagtagctgcgtcgtcttctagatgcttgcagcctctgtctcacgtttggctgc

SEQ ID NO: 6797001 - DNA, 56 bp, Homo sapiens
ctcctcagctgggaggagtcccttccccaggggtctcattccctccctgacctgag

SEQ ID NO: 6797002 - DNA, 56 bp, Homo sapiens
ttctcagggttggcctcaaatcactagacagagtccttgaatgttagttctgggga

SEQ ID NO: 6797003 - DNA, 67 bp, Homo sapiens
tgggagctcagaaagggaggtccccaactcagaaccgagctaacccctattttctgagcacctccca

SEQ ID NO: 6797004 - DNA, 81 bp, Homo sapiens
tcctatatttagattttgacatccctcagtgcctggcctggctggatctggtgcaggttgctggtctgatctcgtatagga

SEQ ID NO: 6797005 - DNA, 85 bp, Homo sapiens
cacctgtgctttcaaggagctcagatgccaaggccaggtttggggggcacaggctgcctgaggctccttgtagagagtggaggtg

SEQ ID NO: 6797006 - DNA, 103 bp, Homo sapiens
ttgagttggagtcttgctttgttgcctaggctggagtgcagtggcacaatcttggctcactgcaaactgtgcctcccggcctcaagcgattcttctgcctcag

SEQ ID NO: 6797007 - DNA, 90 bp, Homo sapiens
tcacttttccaggtagggcggatggtgcttcttctcaactggccctctgcatgctgcgagaaggactacacatctggcctggtagagtgg

SEQ ID NO: 6797008 - DNA, 64 bp, Homo sapiens
tgttcagcagctgctttgtgcagaacctgctgaggtcagcagctgccctgtagctgttctagca

SEQ ID NO: 6797009 - DNA, 118 bp, Homo sapiens
tttctgagtcacgtgggctgcacctatctgtcagaagcccactgcccacccagagcccctgactctgaatggtggcccagtgctttctgaagacagaggtgggacctggtgctggaga

SEQ ID NO: 6797010 - DNA, 69 bp, Homo sapiens
ataagtaaattcagaaactctgggcagaactccaaaatttgaggttttgcttaagttctctttatttgt

SEQ ID NO: 6797011 - DNA, 57 bp, Homo sapiens
agtaacacatatctacaacatgtggataatacaaatcccagtgtgatatgtgtcatt

SEQ ID NO: 6797012 - DNA, 77 bp, Homo sapiens
gtcggatgcacagctccggggtcgttcagactagttagagagataatagtttctgcctcggaagctgaaaatttgac

SEQ ID NO: 6797013 - DNA, 72 bp, Homo sapiens
gctctctggctccactagtttaataccttcctttcttctttgttgaagaagggatggacgagagccagaggc

SEQ ID NO: 6797014 - DNA, 105 bp, Homo sapiens
cttctgtatctatggagttagggttacaccagcctcctggcatgaagatgtgtttttcaactcagagctgtccaaaccctgacacttaaggggtttttatggagg

SEQ ID NO: 6797015 - DNA, 73 bp, Homo sapiens
gctctgccctgacctgcctcagagtgggctacagtacacctttggcaaactcatgggcagcctagggccaagc

SEQ ID NO: 6797016 - DNA, 69 bp, Homo sapiens
caagaggtttcatgattttcttactatttggaaagaataatttaggactgcaatggtgatggccttttg

SEQ ID NO: 6797017 - DNA, 66 bp, Homo sapiens
tgtttacatatttggtctcagagccaaaaatacgcacagataggtcccaggccaaacttgtaagca

SEQ ID NO: 6797018 - DNA, 63 bp, Homo sapiens
gtggggagggagatgctgaagtgaccaaacttgcacagacattattcatttccctatccctac

SEQ ID NO: 6797019 - DNA, 59 bp, Homo sapiens
ccttccaggagtctctgcaggtgagatgagaacgtggccagaggcaggtcctgggacgg

SEQ ID NO: 6797020 - DNA, 107 bp, Homo sapiens
tcctgcctaggaaagccttagtgttgggagggaccctgatgactgaggagcctggtagctccaggtcgcccacactttcaggtctcttgcaccagaaggtggcagga

SEQ ID NO: 6797021 - DNA, 76 bp, Homo sapiens
ggcctattggcagagctttacaggctatctatgaagaaaaatacactgtacgctctgcttcaagtaaggtggtgcc

SEQ ID NO: 6797022 - DNA, 57 bp, Homo sapiens
cctttgctgtggttttagtcaacaccttggagagcagaggttaaaccataaagaagg

SEQ ID NO: 6797023 - DNA, 57 bp, Homo sapiens
gctcgcctctcccgtctctcggaacaaaacgccaggctgaggcgacgaagaggcggc

SEQ ID NO: 6797024 - DNA, 94 bp, Homo sapiens
gaggagcggccaggagaaaggagggaaaccaggagcagccggcccacctgccacggcctgactggctcttctgcctcatcctcttctgcttctc

SEQ ID NO: 6797025 - DNA, 72 bp, Homo sapiens
cagggggaactcagagttttacccagagacttcagaaatgatgtctggaggggagatttgggttcgatcctg

SEQ ID NO: 6797026 - DNA, 121 bp, Homo sapiens
gaaaggaaattcacccgaggtcgcagggccttgagtactcattttggtgctgattacctctctgcaaatggacacggcatcataaattggtagtttcctgctctttttgtgtaatcttttc

SEQ ID NO: 6797027 - DNA, 57 bp, Homo sapiens
gatggctaacatagaaaattacagcaatacaaaggtaattgaagatgtggagccatt

SEQ ID NO: 6797028 - DNA, 123 bp, Homo sapiens
gatgatacattgtaatgttttgggtgtgattcctttgcttttcacactggttaaaaggattttttttccgtgatcaccaaggacagagggaccagagcccagtctttcaggaaatgatacatt

SEQ ID NO: 6797029 - DNA, 61 bp, Homo sapiens
tgctcctgttttctgccctgacgttgatgccccttcatgtcctggcccgaggatggaggca

SEQ ID NO: 6797030 - DNA, 76 bp, Homo sapiens
ttccagctgctgtaacagaatactttatatcagttaattaacaaacaacagaagtttactgcttgcagttctggag

SEQ ID NO: 6797031 - DNA, 61 bp, Homo sapiens
agccatgtcaaccagttgtttgaatggatcagcccattccatcataggaattgacctggtt

SEQ ID NO: 6797032 - DNA, 91 bp, Homo sapiens
gctcccagtcggcatcgttaatcagcaccagaattcctggccgcctgtgggaaagatggtggtgagtagcaaggagtgagaggcaggaggc

SEQ ID NO: 6797033 - DNA, 71 bp, Homo sapiens
tagtttttgggataatcagtaaatgcatagggaatcagaactatccacttggctggttgttctaaactctg

SEQ ID NO: 6797034 - DNA, 79 bp, Homo sapiens
tgaaagaggaaatctctactttgtcatttgctcactagaaaatgttggtaaatgtgagaaaagaggtttctatcagtca

SEQ ID NO: 6797035 - DNA, 59 bp, Homo sapiens
taggtgccttgatgatgataactaaacacacatgtggtgaatcatcactcatggtcctg

SEQ ID NO: 6797036 - DNA, 67 bp, Homo sapiens
agtggggaaatatcaatatttgatcaaattaacactacctccttcccagtgttggtgttcactcact

SEQ ID NO: 6797037 - DNA, 65 bp, Homo sapiens
ttcattttgtgcacttaaccatgactgcgtgctgcacaagacaatgggtaagtgtaacatatgag

SEQ ID NO: 6797038 - DNA, 56 bp, Homo sapiens
ctaggtggtgggaagcgtattgtgtttgaacttagcaatctgaatcccagtcctag

SEQ ID NO: 6797039 - DNA, 84 bp, Homo sapiens
tattaacttgtgtcatatgaaattgccatttttgagggtcaaagatggtcaaatattggctatttcacatggctcatcctaata

SEQ ID NO: 6797040 - DNA, 66 bp, Homo sapiens
gtggccaagtcaaggggtaccagggacattataccttagaacctcccatagctcttgttggtccat

SEQ ID NO: 6797041 - DNA, 88 bp, Homo sapiens
gaactggccttgagccacctcctgcctcagcctccccacgtgctgggagtgaggctgagccacggggctggctgctgtgggcgagttt

SEQ ID NO: 6797042 - DNA, 62 bp, Homo sapiens
aagcctctttccaatttcttgttcttggcaatatttgaggagcatacagttgaaagtggctt

SEQ ID NO: 6797043 - DNA, 115 bp, Homo sapiens
ggagggctagggaggagggcaggctccccagctggggcaacgcaccagctccttgaagctgttctgtggctcggccagctgctgaagcctctcctcctgctcccgaagcctctcc

SEQ ID NO: 6797044 - DNA, 74 bp, Homo sapiens
aatgcagaggaattttaatatgcttgtctcttgaagaattgagtcagtatgacttatagttctctctttgtgtt

SEQ ID NO: 6797045 - DNA, 71 bp, Homo sapiens
atataaattagaatgcagggttcattgtgcctggttttcttttatcatgaatcttgtgttctatgttatat

SEQ ID NO: 6797046 - DNA, 92 bp, Homo sapiens
ctttagagccttaaatactgatgcccaggcccatacctagatgctgtggtttagttggtctgggatatggcctgggcttggggatttttcag

SEQ ID NO: 6797047 - DNA, 66 bp, Homo sapiens
tcccttttaggataaaaatggagttgctttctctgttaccagcaacttcttggcttcctaatggga

SEQ ID NO: 6797048 - DNA, 62 bp, Homo sapiens
agtcgagagtagagccgtggtttttggggcagtgggagtagtgagcctggctttgctctgct

SEQ ID NO: 6797049 - DNA, 58 bp, Homo sapiens
caaatgttagtgcccatccctctgcagagcataagtagcattctgggggtagcgtttg

SEQ ID NO: 6797050 - DNA, 73 bp, Homo sapiens
tagagatggtaaaataattttatgtgtgcagtaacataagatgtaattgtacaagtttggttatttatttcta

SEQ ID NO: 6797051 - DNA, 74 bp, Homo sapiens
tgattaacaatgtgggatttacaaagaaaaataatagtaataatctactgaacttggtgaatgccacatgatca

SEQ ID NO: 6797052 - DNA, 58 bp, Homo sapiens
gatcaccgaggttcctttcagggcttaatttcactgctttgagatttcttaggtgatt

SEQ ID NO: 6797053 - DNA, 72 bp, Homo sapiens
agttggtggctgtgaacaaagagaataattttttacaagggagtatttctcagcattttacatcctctaatt

SEQ ID NO: 6797054 - DNA, 80 bp, Homo sapiens
gcctgcccagcccgtgggtgtgcagctggtggctccctgagaacattagccaccctgcaaatgcccaggaaggcagaggc

SEQ ID NO: 6797055 - DNA, 79 bp, Homo sapiens
gcttttttctagttacaggagtttctgaaattgacaaacatgtaaggaagtcaataaagaaaaagtctgtgagatgagc

SEQ ID NO: 6797056 - DNA, 57 bp, Homo sapiens
catatccaatatgactagtgttcttataaaaacagaacatttggacacagggatatg

SEQ ID NO: 6797057 - DNA, 59 bp, Homo sapiens
actcaaatagcaacggtgagaagctcaggctgccattaatttcactgtgtgtcttgggt

SEQ ID NO: 6797058 - DNA, 60 bp, Homo sapiens
cacttccgtataataatgttaacatataaattgatgtgtggccttatttgtatgggggtg

SEQ ID NO: 6797059 - DNA, 76 bp, Homo sapiens
taatggtttaaattggttacggcttttcaaattgtgaggtagccaataatttagctttgaccagtttaaacaatta

SEQ ID NO: 6797060 - DNA, 76 bp, Homo sapiens
gcagctcctcgtcttctctgcatgtgtgtgtgttgtcacttctaactaacacaattagcaaggggaagatttctgc

SEQ ID NO: 6797061 - DNA, 59 bp, Homo sapiens
tgcagctccatgtgccgagtgcccacagtcccagggcctggcacacaaggggtgctgca

SEQ ID NO: 6797062 - DNA, 116 bp, Homo sapiens
gcatgcatgcatatatgcatgtgtgtatgcctgggtacctgtgtacatttgcatatgtctgtgtcaatgtgtgtgtatgtgtgtgtatgtatatgtgtcaatgtgtgtatgtgtgt

SEQ ID NO: 6797063 - DNA, 82 bp, Homo sapiens
gcctccgagccctcccgcgcctccgcccctagcagcaggcgcacgttgctagggcgggagtgctggagaaaagcctccgggc

SEQ ID NO: 6797064 - DNA, 72 bp, Homo sapiens
tagtgctgaaatacagaaagacctctcgggaaaagtttgagtttctcttaatgtctctgtgcttcagtgcta

SEQ ID NO: 6797065 - DNA, 108 bp, Homo sapiens
cttatttttcttaatcagtgtcattgaagtgactgaaagattgaaagcagagtctgatagtatttcagttactttaaaatttgaaccaaatttgaaaaagaaaataag

SEQ ID NO: 6797066 - DNA, 65 bp, Homo sapiens
agaacattcctggaagagtgcttaagttgtaggcaggcttaccaaaggatattccaggatgttct

SEQ ID NO: 6797067 - DNA, 82 bp, Homo sapiens
tagtacaacatgattttactctctggtctcctacactttcattttgagatgagaaaaggagggtgaaaccatgttgatgctg

SEQ ID NO: 6797068 - DNA, 72 bp, Homo sapiens
cagagctgctgttttctagggttgttggcccagggctgaacacccagggccttccagggaagacagggcctg

SEQ ID NO: 6797069 - DNA, 75 bp, Homo sapiens
ctgtaggaaaccattcaatgaggtgcctgccagactttctgggttgctggctggggtaccagttgaacttgctag

SEQ ID NO: 6797070 - DNA, 59 bp, Homo sapiens
ttcaactgcaacatcctgcctccttgcccactggaggtaccagatagatgtatgttgaa

SEQ ID NO: 6797071 - DNA, 74 bp, Homo sapiens
cttatccttcatcttttaggagagggtccaaaattctctttaggaatctattccctttctgtaaaaaggatcag

SEQ ID NO: 6797072 - DNA, 71 bp, Homo sapiens
ttgagcctggaatcttacttgtgttaactctcatccatgagtttatgttgcaagagttccaaactgttcaa

SEQ ID NO: 6797073 - DNA, 79 bp, Homo sapiens
gagtgtgagaaatctgtgagaaattcgacatatatttatttttcttggaaattagagaatatcttcacagtgtacactc

SEQ ID NO: 6797074 - DNA, 69 bp, Homo sapiens
cagagcgggtgctgttctggctgccaccaccctggaggggctggaagagggaggggcacaaaggctctg

SEQ ID NO: 6797075 - DNA, 84 bp, Homo sapiens
tgagaagcaatatcctaaatgaagctggatgtaggatccccctgttgtataatggagttttgtatccagcttcagcttatctca

SEQ ID NO: 6797076 - DNA, 58 bp, Homo sapiens
ttcaagatgcactcggagaattgtcagggtttcctgacagattagatgtgcatatgaa

SEQ ID NO: 6797077 - DNA, 62 bp, Homo sapiens
ggaactgcattctttatcccacaaccctcacagggtttgctttatgaaagaggatgtaatcc

SEQ ID NO: 6797078 - DNA, 93 bp, Homo sapiens
agattgaaattcatagatctccagctcacagatagcgtgggatatttccaaattccccaagttaatttgtagctgaaaatggaatttcagtct

SEQ ID NO: 6797079 - DNA, 74 bp, Homo sapiens
ctatgaaaatgggtatacaaataatctctttgagacccagccttcagttcttttggatgtatacccagtcgtgg

SEQ ID NO: 6797080 - DNA, 72 bp, Homo sapiens
gctccagccttccttgtggtccttctcattggtacaaatctccagtgcgtgggcaggcatggaagcctgagt

SEQ ID NO: 6797081 - DNA, 64 bp, Homo sapiens
tggaaataaccatcagccttcttcccaagtgttttcaactcagcatactgatggattttttcca

SEQ ID NO: 6797082 - DNA, 78 bp, Homo sapiens
gtggtaagaactggaaccattcactgaacagttcaactgactattcacttgaccactgaatggttctgaacttgcaac

SEQ ID NO: 6797083 - DNA, 64 bp, Homo sapiens
gtgaagatttaagcacaatagtctggatccagatctccagagatatgctgcctaaatttataac

SEQ ID NO: 6797084 - DNA, 60 bp, Homo sapiens
tgggcagggtgtgtctcatacagttggctacatcagctttatttttcacctcttgcatca

SEQ ID NO: 6797085 - DNA, 68 bp, Homo sapiens
tctcagttccacaaaatgtacccagttcctactatgttggactctgagcactgtgttggactctgaga

SEQ ID NO: 6797086 - DNA, 67 bp, Homo sapiens
tattgactgtctcctgtcatgagggatatcatcctgcttagtatccttcaatgaggagaagtttcta

SEQ ID NO: 6797087 - DNA, 98 bp, Homo sapiens
ctctgtgtcactgtttcaaaacaaagctagtaatattttaatcccctcaccacaagggcatgtctaatatagcttgtcatgaggccagtgacttagag

SEQ ID NO: 6797088 - DNA, 75 bp, Homo sapiens
ttccaatggctccaggtactcattggctgttagattacacctaatggccaatgagtacctgaacccaaatgtgaa

SEQ ID NO: 6797089 - DNA, 60 bp, Homo sapiens
aacacaggcatactggctccagagtatgggttttagccactgtatgcctataattgtgtt

SEQ ID NO: 6797090 - DNA, 100 bp, Homo sapiens
gtgttcttaatctgtgcgatgttttaggaaagagggtggcagtaggacctgcacactcctggatcctagagatgacagatatgtgacttttaaagaacat

SEQ ID NO: 6797091 - DNA, 111 bp, Homo sapiens
cagcctctgggtaaataggatatcttcatagactcaagaacagtgatcttgatcatctggcaagaatgttcttgtagtcatgaatatggcacttccttcgctgtagggctg

SEQ ID NO: 6797092 - DNA, 91 bp, Homo sapiens
tggaggatactggtgggggctatacgtttggtgaaatccatcagtgatattcaagccaagcaaataatcacccactaatttgtgttttcca

SEQ ID NO: 6797093 - DNA, 75 bp, Homo sapiens
aggagtgttattcttcaggacatgaatttcatttttatgtgttcccactttcaagttttcagaatagccactctt

SEQ ID NO: 6797094 - DNA, 60 bp, Homo sapiens
cccttcctgcacagttaagtgctcagtatacgcagctgacacaggctttgggggacaggg

SEQ ID NO: 6797095 - DNA, 130 bp, Homo sapiens
tgccttctctttcttggccggctgcgtcattcacatggcatttgtcaagataagtaccttgtagctgggtatttagaatgcgtgtacgtgtgttgtgtgtgtatgtggtggagatgaagaaaggttaggg

SEQ ID NO: 6797096 - DNA, 69 bp, Homo sapiens
gctgaatgtatggattcatgtctgtgaggtatgtataaacacacgatgtgaattcttgccccttctagc

SEQ ID NO: 6797097 - DNA, 88 bp, Homo sapiens
ggctgggtatcctctgctctgtctgggaggctcagtgctctcccgctcgcttggcggggcaccgacctcctgccgcccggagccctcc

SEQ ID NO: 6797098 - DNA, 57 bp, Homo sapiens
gtgtccagtcatagcccagggcagacatagtttatcctgcacagccttggctgacac

SEQ ID NO: 6797099 - DNA, 55 bp, Homo sapiens
aagctgtgctgcttagtagctgtgtaagtgacaagactgcactgagccacagttt

SEQ ID NO: 6797100 - DNA, 56 bp, Homo sapiens
ctgtcttcctagtgtgcattggcaggggaccctatgaccagtgcaaggtaagatag

SEQ ID NO: 6797101 - DNA, 97 bp, Homo sapiens
cctccctgtttctggctgaggagctgcagggggagtctagccggcagggctggctcctgccctcgtgagcttttctagggtcatggtgtgggggagg

SEQ ID NO: 6797102 - DNA, 56 bp, Homo sapiens
ctgcttccataaataatgtgctccatgtaaataaggagtcattaaaaatggggcag

SEQ ID NO: 6797103 - DNA, 56 bp, Homo sapiens
agcacacagaattgattcactgttatcaaaattgaaggacagtggtttgatgtgct

SEQ ID NO: 6797104 - DNA, 58 bp, Homo sapiens
attccaggcacatcccaactccagggctttggctcttctgggttgctgtgcttggaat

SEQ ID NO: 6797105 - DNA, 96 bp, Homo sapiens
ggagttcctggggacctgagcacagaaataagatattttgtaaaggaagtaactcttattgttgatgcattattagacagactcaggagaatctcc

SEQ ID NO: 6797106 - DNA, 81 bp, Homo sapiens
aggacacgtcagagctcatgagcagagccaactcaggcctgggttccaattctggctctgtcactgtgagctatgtgacct

SEQ ID NO: 6797107 - DNA, 66 bp, Homo sapiens
ggagagtaacaaagtgggagaatgattgcaaagagtatgttatcatgagttggctttgtcatcacc

SEQ ID NO: 6797108 - DNA, 69 bp, Homo sapiens
gccagatgggctttagcaaatgacagcagattattacaagctaattcaggtgctaaggctgatcatagc

SEQ ID NO: 6797109 - DNA, 61 bp, Homo sapiens
ggcctgctgtccctctgggctccatgcgcagggcagctgcgtggtgcaggggcgcacggct

SEQ ID NO: 6797110 - DNA, 67 bp, Homo sapiens
aagccatccagaagatggcaagggaagtactgtattagaatgaatacacttttatctctggaggctt

SEQ ID NO: 6797111 - DNA, 60 bp, Homo sapiens
ttggcaattagttatatctgcaaatgcgtaattgcaggtgcaacccagctggttagccaa

SEQ ID NO: 6797112 - DNA, 59 bp, Homo sapiens
ccagacttgaggttcagtaaacggcctgtgcccagcttcattacaatgacccaatctgg

SEQ ID NO: 6797113 - DNA, 77 bp, Homo sapiens
ctgagctgtgtgttagtctcaaagccgttggtgcacttgcgcccacagcctggcctgagttaaggcagagcacttag

SEQ ID NO: 6797114 - DNA, 65 bp, Homo sapiens
ttttatacttctttggccacaacttaatcatatggttgcacataggtacaaaggaggatgtaaaa

SEQ ID NO: 6797115 - DNA, 57 bp, Homo sapiens
ggctctgcttcctggaattgtgttgtataaagtcagaacctcctggaagcaggtgcc

SEQ ID NO: 6797116 - DNA, 74 bp, Homo sapiens
gagacgtgggcagtggggtcttctgccgatgctgattctaccgccttgggcagctggcctcctcgcccactctc

SEQ ID NO: 6797117 - DNA, 81 bp, Homo sapiens
atgttagctataagaagagctcttatgacttaatgggcaaccttgatccatatgtgttacttctcctggtatagctcacat

SEQ ID NO: 6797118 - DNA, 81 bp, Homo sapiens
gggttgactgtttcccagaggagcaagctctctgtggtgaccgcatctctagctaaccctctggcacccaacagtcaaccc

SEQ ID NO: 6797119 - DNA, 61 bp, Homo sapiens
ttgcacctcccctttataaatctttccatttatttctgactcaggtttatggggagggtga

SEQ ID NO: 6797120 - DNA, 69 bp, Homo sapiens
cctgcctggcactgtagccactactgccttgagccaaggccagaggaggcctgcaggggctggagcagg

SEQ ID NO: 6797121 - DNA, 91 bp, Homo sapiens
gttttttttaaggtgtatagttagccattttattcagcaggtcttagttgagtgcctgccatgagctaatgacacactgattaatagggat

SEQ ID NO: 6797122 - DNA, 79 bp, Homo sapiens
ggttttggttgtttacctaatctagttgtacttttcttaaacagaggaaagttatctttgattagaaataagcaaaact

SEQ ID NO: 6797123 - DNA, 67 bp, Homo sapiens
ctgtgcatgtcaattatgttctctggccaaaagccttgctgcacagtaaacatgactggaggcacag

SEQ ID NO: 6797124 - DNA, 63 bp, Homo sapiens
aacttcacgattttgcaggagactagctctgtctagttcccacacctgcagggatgagaggtt

SEQ ID NO: 6797125 - DNA, 78 bp, Homo sapiens
acaagcaagtatccccctgtatctggaagaatattaagtctaagtattctacatgatagaagggagaactgacaatgt

SEQ ID NO: 6797126 - DNA, 62 bp, Homo sapiens
ctggggagcctggggaccctcctgagttctcctccggctctggacctctcctggcttccaag

SEQ ID NO: 6797127 - DNA, 122 bp, Homo sapiens
ctgcctggtagaggttagtcacttggtagtgtagagtggtgggggtgtctgtggatgtatctgcttctcaaacagacattcagctaagtctattattgcccaacattaacctccactagcag

SEQ ID NO: 6797128 - DNA, 109 bp, Homo sapiens
cacaaagtctttatatttgaaaaatgctttataatcattttaattagtggtttctcaccaaagccctggatgtggtattattggcaccattttctgagaagaccgtgtg

SEQ ID NO: 6797129 - DNA, 68 bp, Homo sapiens
ctcattcattcagcgcatggttactgagcacctactgagtgccaggccctgtgctgggtgatgttgag

SEQ ID NO: 6797130 - DNA, 71 bp, Homo sapiens
tcagtcagtcagtggtttttatcgtgcaacagttaattgtttcacttaaaaccactgctggtaacagctgg

SEQ ID NO: 6797131 - DNA, 101 bp, Homo sapiens
tagacactcattcatccagcaaatatttactgagcagctattactctcctaggtgccgtgggatgcagtggtgagtggcaagaatggatagatgaagtcta

SEQ ID NO: 6797132 - DNA, 76 bp, Homo sapiens
aactataggggttacctttagcatctcccctctctgatcacactatggagggatgccaaaagtgccccccatagtt

SEQ ID NO: 6797133 - DNA, 59 bp, Homo sapiens
gcatgccatgtgtgaggagaggagtgtctgagcctgaagttctctatcaaatatggtgc

SEQ ID NO: 6797134 - DNA, 58 bp, Homo sapiens
tccggctgcgactgtacagaattgcccctgtgaaaacactgcagtcattcgtgccgga

SEQ ID NO: 6797135 - DNA, 74 bp, Homo sapiens
gatgggaaaccatgtgtgtcacttcagggctgggacacttaagagcagggacgtgatctacatgatttcttttc

SEQ ID NO: 6797136 - DNA, 58 bp, Homo sapiens
tggcctgctcacagtcagatggctaatcagcccagagccagaagctgcttgcaggcta

SEQ ID NO: 6797137 - DNA, 77 bp, Homo sapiens
cttaaacagaggtaaggaagagcctggtaaacactgtgctctctttacattgttttttcttgccatctgtttttaag

SEQ ID NO: 6797138 - DNA, 56 bp, Homo sapiens
ctcatctttccactctttttttaaccctatacctaagaaaggagtgtccctgtgag

SEQ ID NO: 6797139 - DNA, 82 bp, Homo sapiens
aggtgaacagtttatcaagtttttacagtatgtactttaaatattttggatgtgaagatttgacataaaattgattccactt

SEQ ID NO: 6797140 - DNA, 71 bp, Homo sapiens
gattgggctctctcgtgaacaggtggttggggagcccagggcctccaggtttgtgagtagtcgctccggtc

SEQ ID NO: 6797141 - DNA, 68 bp, Homo sapiens
catgcttctcttcacagggatcatcctgtgggctggggagcctgggatgagagctgggacagaagctg

SEQ ID NO: 6797142 - DNA, 88 bp, Homo sapiens
cactggggatgcttattgaaatgcagaatctcaggccccaccctagacctagtgaattggaatctgcaatttaacaaaatcccttgtg

SEQ ID NO: 6797143 - DNA, 76 bp, Homo sapiens
gagctcttcctgtacacgcttatggagtgaacagttgcctttgcaagttccccagaactgtgtggggagagggttc

SEQ ID NO: 6797144 - DNA, 58 bp, Homo sapiens
gcgtgagcacccccaggcttcaatctgctgaacgttgtgcatctgggggcgcccgtgc

SEQ ID NO: 6797145 - DNA, 55 bp, Homo sapiens
tccaggtggctttcctgggggaatgcctggtaattttcccagaggaatgcctgga

SEQ ID NO: 6797146 - DNA, 58 bp, Homo sapiens
gattatgattaagatggacctggcttctagtgctgtgtttgcatccttggttatagtt

SEQ ID NO: 6797147 - DNA, 65 bp, Homo sapiens
gcacaaggagcagtgtatgaaatcttaaatgaacaagcaatgccatgaaattgctcctttggtgc

SEQ ID NO: 6797148 - DNA, 85 bp, Homo sapiens
aaatggtgacaaagggtccagaattactactgtttgagtaagactgctgaaatggttttggattttgtccatagtacaaccattt

SEQ ID NO: 6797149 - DNA, 81 bp, Homo sapiens
gccaaactctcctgacaattggctgtcacttatttaactgccaccatccccaggagacagaaaatgccagaagggtggggc

SEQ ID NO: 6797150 - DNA, 81 bp, Homo sapiens
aggcttccttcagccaattctagcttgtgaatggaatggaaaaaaatcactcacataactggttggccaagataagaacct

SEQ ID NO: 6797151 - DNA, 58 bp, Homo sapiens
ctagggcagggagtgtttgcgccgccagccatcggcagctgggactcgatgttgctgg

SEQ ID NO: 6797152 - DNA, 78 bp, Homo sapiens
gcctcttacgtggcctttatggtgagttgtgcttggccactgaagcattagttgctcactacaaggttattcagaggc

SEQ ID NO: 6797153 - DNA, 95 bp, Homo sapiens
cacctggctgtctgggaggggtggccctggcgtgtaccgtttgctgatttctgtgccgtaggtacttacaccagggctttaaaggcaccagtgtg

SEQ ID NO: 6797154 - DNA, 69 bp, Homo sapiens
tccctaaactgttttttactagaggacttctaaagaatgaagttgaactgggaaaaaaatgggctggga

SEQ ID NO: 6797155 - DNA, 84 bp, Homo sapiens
aaggtgatatttttatttcatggtagcaaatggattgttttgacatattcagtgtggacccatttaaagtaggcatgttatttt

SEQ ID NO: 6797156 - DNA, 75 bp, Homo sapiens
gcatataggaaagaatggagggtgggagccagaaaatcaaactgaagccccagttcaatctcttcctacctgtgt

SEQ ID NO: 6797157 - DNA, 60 bp, Homo sapiens
tctattgccattttccagaatagtgtgtaaaggaatataatttggggaaagtggtgtaga

SEQ ID NO: 6797158 - DNA, 111 bp, Homo sapiens
gagacaggtctgaagtcaggtgatttccatgcatctaatacctcatttaatctcacaacaaatctactggagatgggatgacattaatggagctgatattatgcccgtttc

SEQ ID NO: 6797159 - DNA, 77 bp, Homo sapiens
ctcccactggctggcctcactgagggacctgcatcctaatctcagggtggcaggaggatgaggcggctacttgggag

SEQ ID NO: 6797160 - DNA, 65 bp, Homo sapiens
tcattttaggaaaatgaaattacctgtcctaatataaaggaaggtttttatgattcctattttga

SEQ ID NO: 6797161 - DNA, 116 bp, Homo sapiens
gccagataaaatatagagagccaagttaaatttgcatttcagataaacatactaaaatattatccaccgtttatctgaaatgcaaatttgactgagcatcctgtatttttgtttgc

SEQ ID NO: 6797162 - DNA, 60 bp, Homo sapiens
cttggtaagatattagagcaattcctagcaaggatgcttaacttcctagtctataccagg

SEQ ID NO: 6797163 - DNA, 79 bp, Homo sapiens
acagggagtcaccctttctccagaactgtctgaagctttagtgagctcgggcagaggatggaaaaggaatggtccctgt

SEQ ID NO: 6797164 - DNA, 66 bp, Homo sapiens
ggattttgttcctagctttaaacaaaacctatgcttagagttaagttagagtagagaacatgatcc

SEQ ID NO: 6797165 - DNA, 63 bp, Homo sapiens
tatggtttgttatagttgtgagtgcttctaatgtactcacatcaacattatagcatgactgta

SEQ ID NO: 6797166 - DNA, 59 bp, Homo sapiens
aattgcctcgtgtctgagtctgttcaggctgctagaacggaataccatactgggtaatt

SEQ ID NO: 6797167 - DNA, 129 bp, Homo sapiens
gacacgggatttcaccatgttggtcaggctggtctcgaactcccgacctcaggggatctgcctgcctaggcctcctgaagtgctgggattacaagtgtgaaccaccgtgcccagctggttttctgtttc

SEQ ID NO: 6797168 - DNA, 72 bp, Homo sapiens
ttcatcaagggctttaagttttgagggaaaggacatcttattgtccttaaagaatgataatgccatgatgga

SEQ ID NO: 6797169 - DNA, 56 bp, Homo sapiens
caggcataagtaatgttttatgtatagaaatgctttctttcattacttggtgcctg

SEQ ID NO: 6797170 - DNA, 56 bp, Homo sapiens
gctccccagtaaataaatgcattaattttaacttagtacatttttcagtggggagt

SEQ ID NO: 6797171 - DNA, 70 bp, Homo sapiens
gctatctcttctgattgcagggcaagtaattaagtgagaaatgtgagccctgcagtcagggtgagatggt

SEQ ID NO: 6797172 - DNA, 65 bp, Homo sapiens
cctctcctggctgtaggacctctcttgtgggtgaggggtgtccccacttacagccagacaggagg

SEQ ID NO: 6797173 - DNA, 60 bp, Homo sapiens
ttctcttcagcccagctaagtgtaattatcttcactttcttaggctgaggttgactagaa

SEQ ID NO: 6797174 - DNA, 61 bp, Homo sapiens
aattttatgccttgcacgttggagttcatgggagttagacatgtaactaaggcatggaatt

SEQ ID NO: 6797175 - DNA, 68 bp, Homo sapiens
tctgtcagttctatctttgtgctttgagtgttccaccttcaatgactgagcctagagacaggaacaga

SEQ ID NO: 6797176 - DNA, 55 bp, Homo sapiens
gactccagggattggaagatgtgctgccacgcgactttcccctctccctggtgtt

SEQ ID NO: 6797177 - DNA, 66 bp, Homo sapiens
tggttgctgtggctaaatatttattgctttaagaggttctgctttaattagagtcacaagtaacca

SEQ ID NO: 6797178 - DNA, 72 bp, Homo sapiens
gtatgagtggttgaatggtaaacttgactgaaagctctgagaaaagacacgtgttccaagcacccgtcatac

SEQ ID NO: 6797179 - DNA, 128 bp, Homo sapiens
atgacatttgttgccttttgatgtgccaaagaagagtgggaatgttctaagaattctttttggcttaatctttgttgaattgaaaatatgtataactcttctgctgaaagtgtagcaagtacagtcat

SEQ ID NO: 6797180 - DNA, 61 bp, Homo sapiens
taaggacaatttgtcgcttgcagccactgccttatcactgtaagttggaaggttgttttta

SEQ ID NO: 6797181 - DNA, 61 bp, Homo sapiens
gcaggggtcctcccagccaggagctgtgggcagcctccaggaggtatgagtggcccccagc

SEQ ID NO: 6797182 - DNA, 122 bp, Homo sapiens
gatgcactcactaactattgcagcataaccaatcactccacaacttagcagcttgaaacagcaaacatttattgtctcagtttctgtgggttaggaatttgggcatggctttcctgtgtatc

SEQ ID NO: 6797183 - DNA, 74 bp, Homo sapiens
gcaatgtccacacctgggtcagtgtgacagtcggttccttgctgtccttcctggctggggtgtgtgcacctggc

SEQ ID NO: 6797184 - DNA, 70 bp, Homo sapiens
atccccatgaatgctatgctctaccagctcccagtatgtggagcttagagtaatgtagtaccatggagat

SEQ ID NO: 6797185 - DNA, 109 bp, Homo sapiens
ctcctgggcaatctgagctgctgtacgccctgctctggtctctgcccgccaggcgagcgccgtgcgcgagaggagcaggcaggggaagcacgcaggcggcatgtaggag

SEQ ID NO: 6797186 - DNA, 70 bp, Homo sapiens
tacaaaaaacacctgtgtgagtatatgtgcacacgtgcattcttttgcatacacacaatcaggttttgta

SEQ ID NO: 6797187 - DNA, 62 bp, Homo sapiens
atgcacagtatgtagggtctatttcaggggaagcacatattataggaactcatgctttgcat

SEQ ID NO: 6797188 - DNA, 70 bp, Homo sapiens
tgctatagcacattctttagttactgtgggtgccacagaaggctgcctcagagaaaggtatggctgagca

SEQ ID NO: 6797189 - DNA, 96 bp, Homo sapiens
tcaactcacagagtaagaacgttatgccttacactcaatttctaaaacatagaagcttgcagtggttggcatgaccaagaatttgtcgatatttga

SEQ ID NO: 6797190 - DNA, 74 bp, Homo sapiens
gccccatcagggaaagtcccaccccacaccacatgctgactgcaggaggtgtgtgtgtgacctggtacaggggt

SEQ ID NO: 6797191 - DNA, 111 bp, Homo sapiens
ttcatttcagttctcttctgatgcagaattatggtgctggcttccattgaatggcaaatgggatgagatggtacacatacgattctgcctcactgatgaatttggggtgga

SEQ ID NO: 6797192 - DNA, 56 bp, Homo sapiens
tgcatgtgtattttgtactattgggcagatcttattgtttaaaagtacacactgtg

SEQ ID NO: 6797193 - DNA, 60 bp, Homo sapiens
ggagcaacatccagacaaacgagtgtgtccaagaggcatttgagtccatgggtgaactcc

SEQ ID NO: 6797194 - DNA, 68 bp, Homo sapiens
gagttgccttactgcattcagtaaacatacttgaagggtggttccgtttactggaaacaaggcaattt

SEQ ID NO: 6797195 - DNA, 70 bp, Homo sapiens
gtctttcttcaatctgtctccatgtgtatagagtcacatcttgcagaaggggacagttaaagaccaagac

SEQ ID NO: 6797196 - DNA, 83 bp, Homo sapiens
gtatagtagtagtgttgctctgtttgggggttgcagacatttagtagtcatcaaagccatagagtagataagattgcccttgc

SEQ ID NO: 6797197 - DNA, 88 bp, Homo sapiens
aggtgcggtattttctgtgattctgaggttggctgaatagaatcgtagcatgtagcacaggaatccacagtcttgtacctctgtacct

SEQ ID NO: 6797198 - DNA, 72 bp, Homo sapiens
gagatatatctcctaaagtttccagaagaatcgaatcactgaccatcttcctgctttggtgaggcttatttc

SEQ ID NO: 6797199 - DNA, 57 bp, Homo sapiens
atcctggatttttcctcctttatatgtgcatgtctagagtggtcatttgtccaggat

SEQ ID NO: 6797200 - DNA, 55 bp, Homo sapiens
caaatacgtttggctggagcaccctgaagtctctgctaccatccaagctggtttg

SEQ ID NO: 6797201 - DNA, 62 bp, Homo sapiens
gctaatggtcattggcctggggctttgaaaccattgcctgtcctgctaatgacacgtccagt

SEQ ID NO: 6797202 - DNA, 96 bp, Homo sapiens
tcctgccaatggcgagggagagcctagagaaggctcagacttacccagagctcatgaaacttttgaggttcttccatacttctgccatggagagga

SEQ ID NO: 6797203 - DNA, 65 bp, Homo sapiens
gccaagagcattgggcacttcccccacaaggtgaaaagatcatcctgtgtccactgctctgtggc

SEQ ID NO: 6797204 - DNA, 82 bp, Homo sapiens
ctactcgcggctgcggtgaacttggatggtgctactctcaccacaaaccacagtccgtcacaaattgccgtgtggtgagtag

SEQ ID NO: 6797205 - DNA, 56 bp, Homo sapiens
agcaccacttagcacaatcttgaggttcagggaatctggagtgttgagtaggtact

SEQ ID NO: 6797206 - DNA, 63 bp, Homo sapiens
catccagatggctgtgaaggtcacaccctactccttctgggagaggactcacggccattgatg

SEQ ID NO: 6797207 - DNA, 67 bp, Homo sapiens
acccaccttccctcgagagcaaacccctctgcagtcaggaggcagctctgtgtctgggaagcagggt

SEQ ID NO: 6797208 - DNA, 60 bp, Homo sapiens
ctgggctgcggttctctgaagccaccccgtgtttcagatgtacgagtgcagttgctccag

SEQ ID NO: 6797209 - DNA, 57 bp, Homo sapiens
gacagtgggggacccaggtgctgtccttctggaaagcatccaggtgcccccagggtt

SEQ ID NO: 6797210 - DNA, 77 bp, Homo sapiens
caggcctgagaggcagccagagaaaatcacatagccgcacagatttgttcattgtctctgatgtgcctctatgcctg

SEQ ID NO: 6797211 - DNA, 55 bp, Homo sapiens
tgggccaattgctccccaaactaataagatcagagtttagaagtagtctggctca

SEQ ID NO: 6797212 - DNA, 62 bp, Homo sapiens
tggtccatagagtatatattttgagggcagggtctttcttaaaaaatgtcttctgtatacta

SEQ ID NO: 6797213 - DNA, 75 bp, Homo sapiens
gacattgaaacattcagtcaacagtgtttgccactcagtaagtaaatactcatatatgttgtatgttaaaatgtt

SEQ ID NO: 6797214 - DNA, 60 bp, Homo sapiens
ggtagggatgggatttggaagtaggagctcagagttcaaattctgaccctgtccattact

SEQ ID NO: 6797215 - DNA, 81 bp, Homo sapiens
gtgaagctgaaatattttaatctcaggataaacccattatttaagttaaggtactcttgagaacaaatatgattacttcat

SEQ ID NO: 6797216 - DNA, 129 bp, Homo sapiens
tgaaaaacacatcagctataaagttctgtcaaggtactattgacctaggtgctaataatgtgttaatttccatcagggaaacagcaaattatggcaattgggcagcagataggatttagctatttttca

SEQ ID NO: 6797217 - DNA, 69 bp, Homo sapiens
atcctgtgttctgagagcgagagagcagcttagccggcaaatccttaaatccttcagagattacaggat

SEQ ID NO: 6797218 - DNA, 70 bp, Homo sapiens
gctggagatgctatgcagagggtcaacattcccattagggactcgggctccttggtatgccatgcccagc

SEQ ID NO: 6797219 - DNA, 62 bp, Homo sapiens
ttcttgtcccattgataggcaaaagtactaaatagtctacatttttgttaatggtatgggaa

SEQ ID NO: 6797220 - DNA, 77 bp, Homo sapiens
agtaattggatgctacttctgtgatgaaactacacaagatgtgagttttgtcttgctagaagtttctgtcccttgct

SEQ ID NO: 6797221 - DNA, 93 bp, Homo sapiens
tctgctatcagtggggaaaatggaggcccaagattctacagcatattcctggcggggctgaaattggaacctgggcctcctgactttggcaga

SEQ ID NO: 6797222 - DNA, 97 bp, Homo sapiens
tctggtgaatgcatttgtgcagttaatctttccctattaaatgtggcatatgtagtagcaaaaataaggagagaatgttggtcaaatgttttctgga

SEQ ID NO: 6797223 - DNA, 58 bp, Homo sapiens
cctggctcctgcacagatctttagtgccacacagagatggctgatggcaggagccagg

SEQ ID NO: 6797224 - DNA, 65 bp, Homo sapiens
ctggatgtcggcatttagcaaggagttggtcaaacagctgacactagctaaatgctgattaacag

SEQ ID NO: 6797225 - DNA, 56 bp, Homo sapiens
gcctgtctcctccttaaaaggtgacaaactcaggctccttcagggaggggccaggc

SEQ ID NO: 6797226 - DNA, 84 bp, Homo sapiens
gcagaaagaatctttgtgcccaactcaatggcaaaacaacttccatatttactgaaagctgggcacaagattctttcctaatgc

SEQ ID NO: 6797227 - DNA, 80 bp, Homo sapiens
ccttatactttgtggggtgggtggatgttctcttttctttcctgaacttgagctgtcctgcccaccctgcagggacttgg

SEQ ID NO: 6797228 - DNA, 64 bp, Homo sapiens
gggtggtctggcaggctggaaacccaggataagctgaggttgcattgaagcctgaaggccatcc

SEQ ID NO: 6797229 - DNA, 75 bp, Homo sapiens
ggggactgggtccctctagcctcagtgtgagctcattcaaagcacgtctgagagttaagagatggggctgtgccc

SEQ ID NO: 6797230 - DNA, 66 bp, Homo sapiens
cggtttatgtcattgccaagatgctaatctaaggacaaagaacgctatctgtagtgacagtccctg

SEQ ID NO: 6797231 - DNA, 81 bp, Homo sapiens
aaatgctatgaagattttgagttagaaaagttgcttttaactggaagtaacagcatcaagtctcaagtggtcacagcattt

SEQ ID NO: 6797232 - DNA, 70 bp, Homo sapiens
catggagtcaagtctctggcaaatgatcttggatgaatccagtttgcactgggatttgaaactttccatg

SEQ ID NO: 6797233 - DNA, 67 bp, Homo sapiens
agggccgtgttgggtgtctttgtgtcatcccatgaataatatcacagctacacccctttacagtcct

SEQ ID NO: 6797234 - DNA, 84 bp, Homo sapiens
ctgtgtgtccacactagatttatttccatgctaaggtacaaatacaaccttcaaggagattggagtctactgtgggaaaaacag

SEQ ID NO: 6797235 - DNA, 66 bp, Homo sapiens
gtcaaacttgattgtatgaagttatttttagccatggtttgaaatatctttagcaatcaagaagac

SEQ ID NO: 6797236 - DNA, 79 bp, Homo sapiens
gaagagataacaggttgctttggtgaaatgtctatttgttaacacttaggttttcattaaagtcaaatctggtctagtc

SEQ ID NO: 6797237 - DNA, 61 bp, Homo sapiens
tcatatatgggattatcacttataggggcttctcttaaaagtctgatgatttacatgatgg

SEQ ID NO: 6797238 - DNA, 91 bp, Homo sapiens
ggtcagaaaattagatttcatgaattccagaagcttgcctttaaatagtaaggcctgaagcctgggagattcagagcatagaatttggacc

SEQ ID NO: 6797239 - DNA, 129 bp, Homo sapiens
tgagtcctgtcaccatcgccgtcatcgtgggcctgcaagagcggagaagccagccagccctccccatggcagctgtgcagcttggcttcaggcctggtgcttgatggcctgcgatccttcagttactca

SEQ ID NO: 6797240 - DNA, 57 bp, Homo sapiens
actttgaaggggaacattttaaaggatctttaggaatacattttgttcccccaaagt

SEQ ID NO: 6797241 - DNA, 65 bp, Homo sapiens
ctcctgtgactaccactatgccactgtgtgcaggtcaccatgccagggccatagggagtctagag

SEQ ID NO: 6797242 - DNA, 56 bp, Homo sapiens
tcaggagttcggtttgggacatattaagttgaagtgtccattgagcgtctccgtgg

SEQ ID NO: 6797243 - DNA, 56 bp, Homo sapiens
tcacagctgagtttccatttcttcaacaccattgttgctgaagaaatcaggtgtga

SEQ ID NO: 6797244 - DNA, 56 bp, Homo sapiens
gcagggtacatgaccttgaaatttcatgtttcatgagtatttcttcatgtccttgc

SEQ ID NO: 6797245 - DNA, 77 bp, Homo sapiens
gtatcattcctgggcaaaagtatctgtgagccaggtgtgcctccactgtatcgcttgtccttctgctaggaggatgc

SEQ ID NO: 6797246 - DNA, 91 bp, Homo sapiens
gagcaattctgtgaatttgaaatggggtctcttaacttttacagctgcaagatgggcttgagtcacccacattaaaatgttactaaagttc

SEQ ID NO: 6797247 - DNA, 130 bp, Homo sapiens
ctatgccctcagtttgtccctttctgggggccctgccgtctgggcatcagactgcgggcgggtctaccatcagccaagcgcaggggatgcattctccgagacggttcccaggtggtgctgtgagggcagg

SEQ ID NO: 6797248 - DNA, 69 bp, Homo sapiens
ctgaccactggcctggtggggaccacagcaaactagagagcacatggcccatctcaaggtcaccctcag

SEQ ID NO: 6797249 - DNA, 104 bp, Homo sapiens
ccccatcacgggattgtcgacttcatcaaatccacaagaccccttttcactgtgaagtaatatagtcacaggttcttgggattagaggatgaacatctctgggg

SEQ ID NO: 6797250 - DNA, 88 bp, Homo sapiens
agagaaggaagcatgcaaaatgtattttattagctcctcccacactgcgatttagtggatgaaatacgttaggcgaatcacttcatct

SEQ ID NO: 6797251 - DNA, 62 bp, Homo sapiens
gagagaaggtatttttgagaatgtcatttcgtcacagatgacacttggtgatactttgtttc

SEQ ID NO: 6797252 - DNA, 77 bp, Homo sapiens
ggagttgagttttcgtatgcattgcatttgaggagtagacttgttccaaaggcagtgggtatgtggatcttaagttc

SEQ ID NO: 6797253 - DNA, 58 bp, Homo sapiens
gtttgaatgaattctacttccagatgtgttcaagtatatttgtagctttcattcagac

SEQ ID NO: 6797254 - DNA, 64 bp, Homo sapiens
gaaatgtttgggaggagtcaaccctctggtgccaaattggaacactgatgtttccagatgtctc

SEQ ID NO: 6797255 - DNA, 76 bp, Homo sapiens
gtggaagatgtatgatcgtatgtgtgatttcctcagtgacaggaaatatcagatttatgaatatactatgctccat

SEQ ID NO: 6797256 - DNA, 120 bp, Homo sapiens
gtggaaattattttaatgttgttgttataatagatcaatgagcaatttaatagttcatggggttgctagtttgtttaaattttaattcaacttttccaaaagattagaactatttctcac

SEQ ID NO: 6797257 - DNA, 76 bp, Homo sapiens
tttgtatttttatgtattttatagatgtgcatttcagatgcatgaatacattgatggagtacctagcttgtacaaa

SEQ ID NO: 6797258 - DNA, 77 bp, Homo sapiens
tctgcctggagagttcttctctgccctctgagcctggtgagctggagaacaccctcagagaggagccccatggcaga

SEQ ID NO: 6797259 - DNA, 94 bp, Homo sapiens
tcaaaatgtaattttatctggaaaaggcaggcagtggtgctctgtttaattatgaattacaagccttcctttgcaggtcaggtcaacatgatga

SEQ ID NO: 6797260 - DNA, 72 bp, Homo sapiens
cctgctttagtcagatttagatgtagcaagtgattatcacttattattgctattaatctgacacaaaggagg

SEQ ID NO: 6797261 - DNA, 82 bp, Homo sapiens
gcccaggctggagtgcaatggcgtgatctcagctcactgcaagctctgcctccttgggttcacgccattctcctgcctcagc

SEQ ID NO: 6797262 - DNA, 106 bp, Homo sapiens
ttgcatccattattttaatctttacagcaattgtatgcatagcatattccttagaatatagaaggtgttcagtatatatttgttgaatgtataaataagagtttaa

SEQ ID NO: 6797263 - DNA, 83 bp, Homo sapiens
gtgttcaaaatggataactgagagcaatctttctttcctaaagaaagaaagatatgttttatagttattaaaaccaagagcac

SEQ ID NO: 6797264 - DNA, 75 bp, Homo sapiens
ggggaaagaagggaggaggagcaaggctggttttcatccaagcctgggcaactccattcactgtgttcagttccc

SEQ ID NO: 6797265 - DNA, 80 bp, Homo sapiens
ggcaacacttctttctgatttctcttaatgtctccttttaagcaaatattgggcagacatcaggcttagaagctattgcc

SEQ ID NO: 6797266 - DNA, 77 bp, Homo sapiens
ctctgggcctcatttactcatctgcaaaacgtgagggcttgttctaggtggatgtgttggatgagtgaattccagag

SEQ ID NO: 6797267 - DNA, 88 bp, Homo sapiens
aactctatagaaatcagcaagacaattaatgaggaaatacacaaataatttccagctattaatgtttttgctgaatttgaatagagtt

SEQ ID NO: 6797268 - DNA, 65 bp, Homo sapiens
ggatctctgttaattacccactgacaggcattatgacctaacaggaggttggtagcagtagatcc

SEQ ID NO: 6797269 - DNA, 70 bp, Homo sapiens
atctcagggattccattcttgcttttgatctggatgaaaacaaatggaagaaagatgagtgccctcggat

SEQ ID NO: 6797270 - DNA, 61 bp, Homo sapiens
gttccttcctatcccgagagcctgtgactctgggcttcttaatttgagggagaggaggaat

SEQ ID NO: 6797271 - DNA, 59 bp, Homo sapiens
ctgtcttgtttcctgaaagtagagtagcagatatttttgagctctcaggcaagaagcag

SEQ ID NO: 6797272 - DNA, 64 bp, Homo sapiens
agccatttgccttctctgaacctatttccgcatctgcaaagtggaaatcaaagagggcttggct

SEQ ID NO: 6797273 - DNA, 92 bp, Homo sapiens
gcccttggcttctctctaaggttgtgggacacccctgagccaattattaggtccaggagtatctaataatctgagaactagtcactgagggc

SEQ ID NO: 6797274 - DNA, 125 bp, Homo sapiens
gaggcagatgaacagcggtttgggttttgcaatgggagtgcacctgggacacgaggatggtatgacttgagccttccctgtgggcgctcctgaggcagaggacccacgccgtgcctggtcgcctc

SEQ ID NO: 6797275 - DNA, 66 bp, Homo sapiens
ctgttggttaaagtcaatcatggtataattccttttctgtaggcagagcatgtgacgtaaccacag

SEQ ID NO: 6797276 - DNA, 76 bp, Homo sapiens
gcctagatcaatggtggggttccatgaatagaagagatcacagattctctttttcacattgtcccagcactagcgc

SEQ ID NO: 6797277 - DNA, 80 bp, Homo sapiens
gatatttgaggagaggttatccgtgttatgttcgcttcattcatcatgaataatacatggttaacctctttttgaatatc

SEQ ID NO: 6797278 - DNA, 61 bp, Homo sapiens
tgtgaataatcacccttctggatgattgattgcttcagttcactgaaagtgtttgtttaca

SEQ ID NO: 6797279 - DNA, 59 bp, Homo sapiens
tatatgtgtgttgttttaagccactatgtctgtggaaatttgttaagcagcaatatata

SEQ ID NO: 6797280 - DNA, 74 bp, Homo sapiens
gtattcactttgctgtgataattcaatgagctgtacaagaaggtatacttttatgcgtgtttcagtatgaatgc

SEQ ID NO: 6797281 - DNA, 77 bp, Homo sapiens
agttactgagtcccccccaggtttgccacactgaaccagaaacaccagtgagggccttgggaggagggtcagaaact

SEQ ID NO: 6797282 - DNA, 70 bp, Homo sapiens
gacgtagaactcacagatgttctcctttaggtttccctattgattccttgagagaagtctgtgccttgtc

SEQ ID NO: 6797283 - DNA, 82 bp, Homo sapiens
cctttgaaagctacattttcacttaaggaatttcatgatccaagggcataaagtgtataagtgaagaattgggttttgatgg

SEQ ID NO: 6797284 - DNA, 77 bp, Homo sapiens
ctcctgcctccacagcccctccagtggcagggacaggtcttgggtctttgtcatcttggtgctgtgagaggtaggag

SEQ ID NO: 6797285 - DNA, 68 bp, Homo sapiens
tctctggaaatggaagtaactatgtaactaaattgttactatacttagaactccattttctgcagaga

SEQ ID NO: 6797286 - DNA, 57 bp, Homo sapiens
ggctgcagcgggaggggcccggctcagccactcagccagccttgctctcctgcagcc

SEQ ID NO: 6797287 - DNA, 82 bp, Homo sapiens
gcctctctcctcttttaacacttggttggtcacacattctgctccattcatatcacagtgctaggctgagggactcaaaggt

SEQ ID NO: 6797288 - DNA, 86 bp, Homo sapiens
gaccgggcgcgcggcgcccccggccggtccccgcccgaccccgcgcagggcacagatcggggcgcacgcgttactcgtatccggtc

SEQ ID NO: 6797289 - DNA, 58 bp, Homo sapiens
gtctcaaactcctaggctaaagtgatcctcccactttggcctcccaaagtgttgggat

SEQ ID NO: 6797290 - DNA, 60 bp, Homo sapiens
ggtccggctgaggatctccaggcctgttcatgctgcctgggccatgcccagtcccagacc

SEQ ID NO: 6797291 - DNA, 90 bp, Homo sapiens
gacacaaattctaataacccatgtgatattgaaaatctgacatagtgaagatatattgcaatgcatatggcttgagggaataggtcagtc

SEQ ID NO: 6797292 - DNA, 55 bp, Homo sapiens
aggcctgcctggagcctggctggctcctgagtgagctaggactataggcagccct

SEQ ID NO: 6797293 - DNA, 63 bp, Homo sapiens
agcagtttagctatactgcttgttgtcttggggcaaaggaaagtagatagctaaagttttgtt

SEQ ID NO: 6797294 - DNA, 83 bp, Homo sapiens
gccctcttccacccccaggagctccagggacactgccaggcagcttgatccccaggactagggggtgggagtgcaaacatggc

SEQ ID NO: 6797295 - DNA, 81 bp, Homo sapiens
gaggtcagagaaggagcacttgtccccatgagcgccgcctggctactgcatgtggtgcaggtgccccctctacctgggctc

SEQ ID NO: 6797296 - DNA, 59 bp, Homo sapiens
gtctacagcacttaattattagttctgaattaaggggctaaataataagttgctgagat

SEQ ID NO: 6797297 - DNA, 60 bp, Homo sapiens
cactggatttaggactagtccaagatcttgatctagattttgacctaggcctagactgtg

SEQ ID NO: 6797298 - DNA, 71 bp, Homo sapiens
ggaaagggggtgtgtagtcacctcggccaaaacccggctttgggcagaaacatgcgccccagcttctttcc

SEQ ID NO: 6797299 - DNA, 76 bp, Homo sapiens
gcttcgtaccttgtgcgggttaaaagaaaagtgcataataacttatcttagttcatttgtatttgggaatgaatgc

SEQ ID NO: 6797300 - DNA, 66 bp, Homo sapiens
agtcaggtgtcttgtgggattttaataaggtctactgtataaaatcaccccgaggacactaagact

SEQ ID NO: 6797301 - DNA, 75 bp, Homo sapiens
tagggcctgggcatctggatttttaaaactccccaggttgctaatgtgtagccagagattgagatgcaggcccta

SEQ ID NO: 6797302 - DNA, 70 bp, Homo sapiens
tgattcacttcagaattcctcagcctcagcactgttgacatttggggttggataattctttgttgaatgg

SEQ ID NO: 6797303 - DNA, 58 bp, Homo sapiens
ctgtaaacccaggggtggggcccgaggtccagaaaagccctttctctgggttgcacag

SEQ ID NO: 6797304 - DNA, 76 bp, Homo sapiens
taattgtattcacaggatgtagctaatttttaaaacccaaggggtatattattagttatactactgaatggagttg

SEQ ID NO: 6797305 - DNA, 102 bp, Homo sapiens
gagctgaggaaaatggggctcgtactcactgatgaggagcacgagaagctgctgaaaactctgccaattcgcagtgagtatttaccacatcctttgagactt

SEQ ID NO: 6797306 - DNA, 102 bp, Homo sapiens
gtttgcagaagacacatttctgatgtggactgggatgacttggaagagggtgtggtctctcccacaggacagttaatgtgcagtgttgtgtcttttaaaaac

SEQ ID NO: 6797307 - DNA, 58 bp, Homo sapiens
cggtgttactgggaggacggaggttgcgacagcagccgagcccacccagttgcagccg

SEQ ID NO: 6797308 - DNA, 98 bp, Homo sapiens
atttttggattgtgtccctgcaatttgatcataaggtcctcaagatcatgaaagtttttgagaaggtgacaaattctacaaggaccactcaggaagat

SEQ ID NO: 6797309 - DNA, 69 bp, Homo sapiens
tctggatgaggctctcaacaccttgaggaaccaaaggtaccagacaggcaggtgagagctccatttaga

SEQ ID NO: 6797310 - DNA, 73 bp, Homo sapiens
cctttggaaatatccaggtagatgtcttctctttgggaaacagttggatgaaaaggcctggtgtttaggaggg

SEQ ID NO: 6797311 - DNA, 72 bp, Homo sapiens
ggttgggcatagaagagcagaaagatatgacagaaccaactcctggtagcttttgcttatctgagtgcagcc

SEQ ID NO: 6797312 - DNA, 56 bp, Homo sapiens
cagtcttttgtatattagcagaccattgggaaacttgtcaatatatatgaaggctg

SEQ ID NO: 6797313 - DNA, 56 bp, Homo sapiens
cctgcattaaatcctgttctgctcaacttaaccagaaggacagcctttcctgcagg

SEQ ID NO: 6797314 - DNA, 65 bp, Homo sapiens
aggctccaggcctccctgcatgccctctacgccccatccaagggacctgacagaacctggagcct

SEQ ID NO: 6797315 - DNA, 57 bp, Homo sapiens
atcccaggaggctgcgcagttatcagcatgaaaagcagctgcaggcctcccagggat

SEQ ID NO: 6797316 - DNA, 55 bp, Homo sapiens
gggatctcactacattgcccaggctggtctagatgtcctgggctcgagagatcct

SEQ ID NO: 6797317 - DNA, 77 bp, Homo sapiens
ttggttctttggaaggaacaggattctctcctgggaaaagagacacagtgaggatctgcagccatcttcaggaccaa

SEQ ID NO: 6797318 - DNA, 63 bp, Homo sapiens
aagcctggactatcgcgtgtgcctgccctacgccaacgcagtgctgctcgagatccagtgctt

SEQ ID NO: 6797319 - DNA, 75 bp, Homo sapiens
ctatcagccaagggctgctatcagctactgtgggcttctcccattaactggcacgtagccctctgtacaacatgg

SEQ ID NO: 6797320 - DNA, 66 bp, Homo sapiens
caggaggagaggctggagttagggcttgactgtctgagtttgccttgggccagctgctctggactg

SEQ ID NO: 6797321 - DNA, 64 bp, Homo sapiens
atgaagccctatcctctcctgggatagaaataccatctcctattagtaggacaaagggcatcat

SEQ ID NO: 6797322 - DNA, 74 bp, Homo sapiens
gcctctctctgccacctccttggagcgttttgagcagctgcacgagatgtgcctccaaggggtgcactagtggc

SEQ ID NO: 6797323 - DNA, 76 bp, Homo sapiens
gtctgttgagtgtatggaagtgaaggattggccaggcacagtggctcacccctgtaattccagcacttagcgagac

SEQ ID NO: 6797324 - DNA, 88 bp, Homo sapiens
aggggaattgcttgaacccaggaggcagaggttgcagtgagctgagatcatgctactgcactccagcctgccaacagagcaagaccct

SEQ ID NO: 6797325 - DNA, 86 bp, Homo sapiens
gtttacagatgaggaaagcaaggcttggagagaatgccatacagttattagtgtggcggagccggcctttgcacctggctgttgac

SEQ ID NO: 6797326 - DNA, 73 bp, Homo sapiens
cctgacacagtggctcgtgcttgtaatgccagcactttgggaggctgaggcaggcagatcacttgaggtcagg

SEQ ID NO: 6797327 - DNA, 70 bp, Homo sapiens
ctggggtcaatggcatgagcttcagtttatgatttttgattaagtgactaaagtaatgcttaaatctcag

SEQ ID NO: 6797328 - DNA, 118 bp, Homo sapiens
tctactttatgtgttggggtgtgacaaactgttttagcaattggtctctcgttctaaatgcaaaggaccttctcagaccatgctaacctggtgacacatcctaataagttgaggctga

SEQ ID NO: 6797329 - DNA, 55 bp, Homo sapiens
ctgaagagctctcctgtcccctctgccatgtgaggatacagagagaagtctgcag

SEQ ID NO: 6797330 - DNA, 90 bp, Homo sapiens
gggcctctctggacagtgcatgtctgtgtggggatcgggtgtcaggaatgcccagtccctccccgacaccaagaccacccaagatgcacc

SEQ ID NO: 6797331 - DNA, 81 bp, Homo sapiens
cagtacattttggtcattgaggaagtaaaggccaaaaatgagaaaagtggcttttatgaaaataagattaggaaattactg

SEQ ID NO: 6797332 - DNA, 81 bp, Homo sapiens
tgtccttacagcaatttccatcatcattaggcctagaagtataaagtacagttgcttggtgtgtgtggaagaaataggata

SEQ ID NO: 6797333 - DNA, 88 bp, Homo sapiens
ctggaagcactgccactggaacctggaggccaccaaccagactggattctattgccgcctcctggattttagtgccatttgtttctgg

SEQ ID NO: 6797334 - DNA, 67 bp, Homo sapiens
ttcattgctgcattatttaggttggccacaaaaagagagaccacaatctaaatgtccagcaatagaa

SEQ ID NO: 6797335 - DNA, 127 bp, Homo sapiens
gactattgaatcgatgcgaaggcattatcccagggtttaaagtttggaaacattctggtcaacagacttctgttcaagtactgtagatttcaggatcatgcctagaaaacatcgcatttcccaagtc

SEQ ID NO: 6797336 - DNA, 75 bp, Homo sapiens
ttgtatgaaagtggaatgcctgagtagtcttattcaaagagggacaagtgatgaactctatttcagtttcaacaa

SEQ ID NO: 6797337 - DNA, 59 bp, Homo sapiens
agcagtgttcaatgatacactgcaatatatcactgcaagcagtgtatcattgaactgtt

SEQ ID NO: 6797338 - DNA, 83 bp, Homo sapiens
gtctgcacagtgtttctcaggctgcctatcagactgtgaaacgcttttacgggagagggcgcctgagtgaagagctcgcaggc

SEQ ID NO: 6797339 - DNA, 61 bp, Homo sapiens
ccaattcctcagtcgtttgagccaaaatacttccttgttgcttaaaccactaagggttagg

SEQ ID NO: 6797340 - DNA, 72 bp, Homo sapiens
gtgaaccagaaggaatctgagctgagggcctgccaagccattctccagcatcagatttcttcctcggctcgc

SEQ ID NO: 6797341 - DNA, 74 bp, Homo sapiens
ggcagaaagtatagagatggcatgtcaaagtgcctgttacacaacaggagccaaacacatgccagcttcctgct

SEQ ID NO: 6797342 - DNA, 102 bp, Homo sapiens
acccaagcctcagaccttgtcgtcacttagaggaagtgccagggacgcatgcttctggttggtatttgtgtgagctgataggctttgatgatgggcttgggt

SEQ ID NO: 6797343 - DNA, 60 bp, Homo sapiens
ggattggtgatagactcttggtgaacaaagatttcctttcataaagttatcaccaaatcc

SEQ ID NO: 6797344 - DNA, 64 bp, Homo sapiens
gtatatgcatgtgtctgttcacacacttgtgtgactacatacatatatggatatatgcaaatgc

SEQ ID NO: 6797345 - DNA, 74 bp, Homo sapiens
ggctattgtgaatagagctgcagtggacattggtgtacaaggaattgagtcgctgctttctattcttttgggtc

SEQ ID NO: 6797346 - DNA, 61 bp, Homo sapiens
cctccaaggcctatgcacacctaggaacatcccctgtccaggctggacatgaggcgggagg

SEQ ID NO: 6797347 - DNA, 66 bp, Homo sapiens
cccaacatgccctaagtccatcagcatgccttgtcttcattagacagttgatgggactcatgtggg

SEQ ID NO: 6797348 - DNA, 63 bp, Homo sapiens
taggtgtaccagccataccctgctgtctaacaaacattgtgattctccatggttggtactcta

SEQ ID NO: 6797349 - DNA, 64 bp, Homo sapiens
tctatagcagggcatgaggtggtgttaggtcaccctgaaggccagcttttgaccccgttgtggg

SEQ ID NO: 6797350 - DNA, 70 bp, Homo sapiens
atggtatggtccttttcttgaagaaggccagagtcatatctgcaataatcagaacaggactggctgccat

SEQ ID NO: 6797351 - DNA, 108 bp, Homo sapiens
gtgaagaacgctgggtctggaatcagaagcctcaggtcttagttctgtcatcaactattttgcgaccttggacaaaagacttgatcactcacagtcccagtttcccac

SEQ ID NO: 6797352 - DNA, 56 bp, Homo sapiens
tgctcttcacagtttcagcatccagctcactctgggggcactgaaagggaatagca

SEQ ID NO: 6797353 - DNA, 59 bp, Homo sapiens
tgctatgtaacacagaaatgaaattccacaagatcttgtggttctctgtgttacattca

SEQ ID NO: 6797354 - DNA, 56 bp, Homo sapiens
ggctgtggtggcatccctgagcccctcgtctgtggggagagtgccaccaacaagtc

SEQ ID NO: 6797355 - DNA, 59 bp, Homo sapiens
ggcagttctcatcctcgatcttcttgttcagagaacaatcaagttttgatgaggaagcc

SEQ ID NO: 6797356 - DNA, 55 bp, Homo sapiens
atcccccactagatgtcactagttgcccaggacagtggtcagaacgtgggagggt

SEQ ID NO: 6797357 - DNA, 118 bp, Homo sapiens
cagaaataagatggatggatgtatagacagtagagtaaatggttagataattgataagctaaaaatgttaatggtgaaatctaagtcatgtacactgtaaaattctttcatttttctg

SEQ ID NO: 6797358 - DNA, 57 bp, Homo sapiens
tacagtatgtgatgcaacggaatacactgagtgtattagtttcctatcgctgctgta

SEQ ID NO: 6797359 - DNA, 71 bp, Homo sapiens
aacaagattctcgggagatttgtattcacattaaaatttcagacatgatgtgtttacctgaggatcttgtt

SEQ ID NO: 6797360 - DNA, 77 bp, Homo sapiens
gcctttgtggcacctagtttcgaagagactaaataggaacaaaagcctttgtggcctcttcagactgaaccacaggt

SEQ ID NO: 6797361 - DNA, 72 bp, Homo sapiens
gaggaagaagtaacgaataaacaagtgataaataccttggttttttcatgttatttttgttgttctttactc

SEQ ID NO: 6797362 - DNA, 74 bp, Homo sapiens
gtcctcatttacacagaggacactgggctggggacgtgccccgagcctgagtctcttcttctgtcaaatggggc

SEQ ID NO: 6797363 - DNA, 57 bp, Homo sapiens
ggaagctggtaattgttgggacccaggctgagtcctggagtgaagcgacgagtttcc

SEQ ID NO: 6797364 - DNA, 83 bp, Homo sapiens
gggctgggaatgagcaggtggctcctgggagtcattgtagcatagacgtagtcaaggggccaccatgccatgtgtctcagccc

SEQ ID NO: 6797365 - DNA, 129 bp, Homo sapiens
tgcatagggactgaggtacagtactagctaaaaatgtagattcctggtccccacccaagacctaatggctctagggatggaaactaggaatctatgtttttggcagtcagccaaagtgaatcttatgca

SEQ ID NO: 6797366 - DNA, 93 bp, Homo sapiens
gtaataggctcaacatatctggagactcctggtctataccacaataattaagctaaaggaattctaggtagaaagtatgcagccacttattat

SEQ ID NO: 6797367 - DNA, 58 bp, Homo sapiens
ttctctgcttatgcccatcctgtctgtggttatcaccaggccagggttgagaagagaa

SEQ ID NO: 6797368 - DNA, 101 bp, Homo sapiens
tggctggagcttttgtggcagtgattatactagcagtgttctatgaaggactcgatagcccaagagagcctgctgtgtaagtcacaagtcagcttttgcta

SEQ ID NO: 6797369 - DNA, 55 bp, Homo sapiens
tgaggtcctccactcagccctagggcactccagcgctgagaggttgggaagttca

SEQ ID NO: 6797370 - DNA, 57 bp, Homo sapiens
cccgcggagggcacagaccgctgagctccagaggagggtcttgggaggtgccctggg

SEQ ID NO: 6797371 - DNA, 74 bp, Homo sapiens
ctctgttatccatattgaaaaagacaaattcagattttttctaactgataggttattttcagtgagatataggg

SEQ ID NO: 6797372 - DNA, 58 bp, Homo sapiens
gaagagatagaactatgaaaacaacttagatttcctggtttccagttctaatctcttc

SEQ ID NO: 6797373 - DNA, 71 bp, Homo sapiens
gtctataacttgctttcccaaggcagaacatagtgatttaacactaagagtttaggggagcaggagaggac

SEQ ID NO: 6797374 - DNA, 96 bp, Homo sapiens
gggacaggctccatggaaaaggctgttgttcaactgttggccttttcagccccattgtgcggacagcagtttttctctagggtaccaaagtgtccc

SEQ ID NO: 6797375 - DNA, 55 bp, Homo sapiens
tcctgggaagttgcatcaccgtagtcaatatgctgctgtgaccagagacccagga

SEQ ID NO: 6797376 - DNA, 94 bp, Homo sapiens
ttttgattaatgttagctatggattagaggtgatgattataaatgcatttgtaggttttgcccatttaatatatagtttgataaattatcaaaa

SEQ ID NO: 6797377 - DNA, 61 bp, Homo sapiens
ggctcattcaggagcctaagcagcgaggggctgttgctggaatttgccttctggaagagct

SEQ ID NO: 6797378 - DNA, 68 bp, Homo sapiens
gaggcgctcaggccttgaaggcctgcgggaggtcgaaatggtcctggggaggtcgaggctgaggtctc

SEQ ID NO: 6797379 - DNA, 65 bp, Homo sapiens
atagattttatcagattttatctgtggttaaaattcatgagccatgaatctggtcaaatgtctat

SEQ ID NO: 6797380 - DNA, 79 bp, Homo sapiens
ggtccacaatatgggatatacattttactaagattctcatcaaaatgaacatatgaaatgtcagtgttttataaggacc

SEQ ID NO: 6797381 - DNA, 90 bp, Homo sapiens
gggtcaaatgtggcatttttcttgcaaacttttgtttattctatgacattggatgaaaagaaagagattgtcagagatatgccttgacct

SEQ ID NO: 6797382 - DNA, 55 bp, Homo sapiens
ggcgcagaacatgctatacacagtggactccacgttgcaggtggatgttctggcc

SEQ ID NO: 6797383 - DNA, 57 bp, Homo sapiens
gcaggcaggcactactcaacatggtacaatgtgtgcttgttcctatctgcctcctgc

SEQ ID NO: 6797384 - DNA, 77 bp, Homo sapiens
agtttcgatcaatactgtaagtcaaatgaaacatatgccatggtcaaatgaagcatttggttgtagtatatgaaact

SEQ ID NO: 6797385 - DNA, 81 bp, Homo sapiens
cacaccccctgtaccccagtggcttttgcccaggttggagtcattttatccgcagtggcccctggggcttcatggtcagtg

SEQ ID NO: 6797386 - DNA, 61 bp, Homo sapiens
ctctagaggcttgaatgggcgaggaagctataatgactccatgttccttcttgcctcagag

SEQ ID NO: 6797387 - DNA, 68 bp, Homo sapiens
cacagctcgtctcttgccttagtgtgctgctgtgagagtcacagtggaaactgcagggaggaggtgtg

SEQ ID NO: 6797388 - DNA, 58 bp, Homo sapiens
gtgcggtcacgcccggcccgcgttgagagagcgcttggcagccagcgggtggacgcgc

SEQ ID NO: 6797389 - DNA, 76 bp, Homo sapiens
caagaaagaactgataaacctgcaatggttgggtaatcttcaacttccaaatcagcaaaggtcagctctaagtttg

SEQ ID NO: 6797390 - DNA, 61 bp, Homo sapiens
cagccaggaatgcatgctctgctgtaaatagagacagcagggggctgagtagtcttggttg

SEQ ID NO: 6797391 - DNA, 58 bp, Homo sapiens
gctcggagtcccacctgggaaacctgggttggcccggaaacctcgggaggctcagagc

SEQ ID NO: 6797392 - DNA, 82 bp, Homo sapiens
gcaatgtggtttccccttgctacccttgcctgccaggtgacctgttgtgtctccatggcttgcaatggagtggggccaatgc

SEQ ID NO: 6797393 - DNA, 65 bp, Homo sapiens
atggtgcctgttggcattgagtggatggaggcagaagtggccatctgtgtgtgggtagggatgat

SEQ ID NO: 6797394 - DNA, 92 bp, Homo sapiens
ccttggttttcagttcttcgtgaggctctgcatcgcacaggcactgtgtctcaggggatcagagccttttaagagttggggatgcctgaagg

SEQ ID NO: 6797395 - DNA, 57 bp, Homo sapiens
ccttcgcctatggccgatcagtcttgtctgtctgcgagctgcccagagtagggaagg

SEQ ID NO: 6797396 - DNA, 74 bp, Homo sapiens
catgagatgggaacctgtcttagtccattctgtgctgccgtaacagaatactacagactggttaatatataatg

SEQ ID NO: 6797397 - DNA, 64 bp, Homo sapiens
ttcccattaatttattttcaaatgaggaaaacccacaactttgagaaactgattattatgggga

SEQ ID NO: 6797398 - DNA, 59 bp, Homo sapiens
ggctgtggagtacagagctggttcagatgaatgaatagctttctcatgacttcaccccc

SEQ ID NO: 6797399 - DNA, 76 bp, Homo sapiens
tcacggacaatgtcagtctgtcttcatgggggcagttaagggaatgtcctcagaatccaaactgcagtactgtaga

SEQ ID NO: 6797400 - DNA, 61 bp, Homo sapiens
gaggagggatgtggttgttgggtgatgctctcagggcacaagaataaccatatttaatctc

SEQ ID NO: 6797401 - DNA, 59 bp, Homo sapiens
cgtggtatgagagtgtgtgtttgcattcatatgtgcccacacaagcactcgtacatacg

SEQ ID NO: 6797402 - DNA, 87 bp, Homo sapiens
gcttgaacttctcacagcatgttgcctggattctgaagggccatttcaaaagacccagaaagcagctgcatttggaagttacacagc

SEQ ID NO: 6797403 - DNA, 62 bp, Homo sapiens
ggagctctgtgtctctcctgccacagtgcggtggattgaccgggatgggggcacagggtgcc

SEQ ID NO: 6797404 - DNA, 86 bp, Homo sapiens
tttttttaacggtgtgtgggttctgatcccaggactgctactgtggcagtcatgggtagaactcaagaaaatgcatccgaaagaaa

SEQ ID NO: 6797405 - DNA, 73 bp, Homo sapiens
gtgggtggcagagccagtaagtggctgagacagaactcactctaggatctgctggctccaacctggcatctat

SEQ ID NO: 6797406 - DNA, 72 bp, Homo sapiens
ttttaatgaagaatggctcaagattattgtctacctttagagaaaatatgggggtcatggacttccttgaga

SEQ ID NO: 6797407 - DNA, 64 bp, Homo sapiens
atctaatgcaccatttccatagcattaacagagaaaaggcagtgggaaatattggttattggat

SEQ ID NO: 6797408 - DNA, 129 bp, Homo sapiens
aaagcacataagatctgcacataaatttaaatgacaacgctaaagggtaccagaagttggacttgctgttttattcttctgggactctttaggattgacattgtaatttatgtgaaagtttcatgccat

SEQ ID NO: 6797409 - DNA, 58 bp, Homo sapiens
tgcatctgagcactacggtggagccgtggacaagctgcttcacagaggactcaggtca

SEQ ID NO: 6797410 - DNA, 103 bp, Homo sapiens
cctcccaggaaaaggaaagggttttcccagagctgtcctcaaggagctggagtcgcttggtggagtttcagcctctgggtgccctggcttgcccttggcgagg

SEQ ID NO: 6797411 - DNA, 68 bp, Homo sapiens
gcacacacaaataaaaacacaaagctacgtttttcaggttttgttctagatcgtgtttgtggctgtgt

SEQ ID NO: 6797412 - DNA, 77 bp, Homo sapiens
ggctaccttcccagcacctgtgtgagctagatgtgggtcattttatagatgagcaaacagagtcctgttgagtagtt

SEQ ID NO: 6797413 - DNA, 56 bp, Homo sapiens
gcagacaaagacagcatctcaggttcccttgtctgggcgcccgccctttgatctgc

SEQ ID NO: 6797414 - DNA, 74 bp, Homo sapiens
aagctgtgagggcagggaccagaggttaggggtcctctctccctggttgtgccctccccagcccctcacagctt

SEQ ID NO: 6797415 - DNA, 106 bp, Homo sapiens
tgtattcctcatgaaagccatagccaaagaccttttcaaccccaagcatctgtctcttggtaggtactggcttcaggcaagtggcttctctcattaagaaaataca

SEQ ID NO: 6797416 - DNA, 66 bp, Homo sapiens
tcaggagtgcggaggctggtggttcttaggtgacaagagccacctggggacctgcctcagccctga

SEQ ID NO: 6797417 - DNA, 82 bp, Homo sapiens
agggccagagaattccacggctttgaacaatctttgtgaacagagctttgtgtcagggctgtggttatgattttcaggccct

SEQ ID NO: 6797418 - DNA, 63 bp, Homo sapiens
gatttaatttgtgtctttagctgaactcatgtagaccattttagctttaggcacgtttgaatt

SEQ ID NO: 6797419 - DNA, 81 bp, Homo sapiens
gaatagctaataatacatgagattaatgtttccagggcctaacaccttgtggatattggattctcatctaatttgtcattc

SEQ ID NO: 6797420 - DNA, 60 bp, Homo sapiens
accaggagtctagcctagtcaaaaccattttgattaagtctctggtgctggtttcctggt

SEQ ID NO: 6797421 - DNA, 68 bp, Homo sapiens
acctgggagaaatggtgaatctggatggatgaagtatgtttatttatccaagcacaatttctaaaggt

SEQ ID NO: 6797422 - DNA, 59 bp, Homo sapiens
gcttctgttcaaggatataaggcccaattcacccactgtgtatcttcatgaatggaggc

SEQ ID NO: 6797423 - DNA, 79 bp, Homo sapiens
aagtagattagccttaataatttagaagtgacaactactcttgctgttccttctgaaacagcattatgggcctttactt

SEQ ID NO: 6797424 - DNA, 58 bp, Homo sapiens
gaagctggggtgctgagggcaaagttagtttggcccatatggagtacacctgagcttc

SEQ ID NO: 6797425 - DNA, 100 bp, Homo sapiens
ccctagatgtccatgcttaattcagctctttgagtattccatttacatttacaagtagaaaaatggagtcagggagaagttaggtaatttgcctttgggg

SEQ ID NO: 6797426 - DNA, 73 bp, Homo sapiens
tgataaaacagtcaaaggcctaagctattgtcaaaaacagtataatgccactagcttttgagtgtgtatgtca

SEQ ID NO: 6797427 - DNA, 87 bp, Homo sapiens
gtccaccgtgcttctccggcaccgatgccgggagcctgcagggggcgcccttgcccaggctggcctccgcagtgccggaggagggac

SEQ ID NO: 6797428 - DNA, 61 bp, Homo sapiens
tatcagagatgcacatttggtttatgacacccatgtcagtgtaaatggtgcatttcttata

SEQ ID NO: 6797429 - DNA, 90 bp, Homo sapiens
ttaagttaaactttataaaaatgaggcgatggacctaaaactcagtatgttctgctaggatttgtatagctttcttttggtttgatttaa

SEQ ID NO: 6797430 - DNA, 83 bp, Homo sapiens
tcggtttccacacctgtacagggccgggctggctcacaaacttcctgggcctcggtttccacatctgtacagggccgggctga

SEQ ID NO: 6797431 - DNA, 70 bp, Homo sapiens
ggaggccaggggggagttttgctcagaggaatgacatgatctgattgtaacaggatccctgtggctgact

SEQ ID NO: 6797432 - DNA, 63 bp, Homo sapiens
acattgttctacttctagttagctacagtgagaatgctagctgttctgtgtctaggacaatgt

SEQ ID NO: 6797433 - DNA, 69 bp, Homo sapiens
ctggctcacctcttgctacattcctaggctgcgactcaggaggcctgcagggaagcaagggtggctcag

SEQ ID NO: 6797434 - DNA, 58 bp, Homo sapiens
tcatctttaaaatgggaacaacagtaccttgcatggttgttgtaaagtttagaggtga

SEQ ID NO: 6797435 - DNA, 62 bp, Homo sapiens
tttaagagcatattaatagtggagaaattttattttcttctgtgaaataagtgcttcttaaa

SEQ ID NO: 6797436 - DNA, 60 bp, Homo sapiens
cagagaggctgtgaggcaaatggggtagtaaaccatgatttagcaccttcactttctctg

SEQ ID NO: 6797437 - DNA, 66 bp, Homo sapiens
ctccacacccttgctaacacttgttattttccattttttttaaacatcattttagtgggtgtgaag

SEQ ID NO: 6797438 - DNA, 55 bp, Homo sapiens
ctgtgcattgtaggatctttagcagcattcctggcttctccctacaacatgccag

SEQ ID NO: 6797439 - DNA, 58 bp, Homo sapiens
agatcattaaccacctgttctgcctgggagctgatggcagcagcagctgggttgatct

SEQ ID NO: 6797440 - DNA, 75 bp, Homo sapiens
acatatgcagtacagataattctacaaaatcatagtcgttagttgatcccatgtagtgtgtgtgtgtgtgtgtgt

SEQ ID NO: 6797441 - DNA, 62 bp, Homo sapiens
ctgctctgtgcgctgcagaatttgtgggtatccctgggaggcctggaccagccacagagcag

SEQ ID NO: 6797442 - DNA, 57 bp, Homo sapiens
gctgataaatagttgatgtacctgtcactcatgtcgctacatgaactgtttctcggt

SEQ ID NO: 6797443 - DNA, 74 bp, Homo sapiens
tgtgcgccaatttgtgactgggttcgtgccttcaggaattctctgtagggcatgtaagtcaccatattgtaaca

SEQ ID NO: 6797444 - DNA, 59 bp, Homo sapiens
gagtccttttctctgtccactgtaacacacagctaagtcttggcagaggacaaggactt

SEQ ID NO: 6797445 - DNA, 94 bp, Homo sapiens
tcgtcttaaggagatataattatagccgctattttgctggcttttaattgaagacaaagcaaacagtgtgctaagaaattatattcaatgatga

SEQ ID NO: 6797446 - DNA, 62 bp, Homo sapiens
gagatgagtttggatgctttcctggagttatcaggaagctccagggattaatgaagtcagtc

SEQ ID NO: 6797447 - DNA, 59 bp, Homo sapiens
tatgcactggagatcctggggagactgaagaggccattcccacagtctcacaatgcata

SEQ ID NO: 6797448 - DNA, 67 bp, Homo sapiens
tgaattgtctaatgagctccacttcagacccctggggcttgactggattgtcattacgacgttgtca

SEQ ID NO: 6797449 - DNA, 77 bp, Homo sapiens
gggtattacattgcactttattagatacaaataaaacttttatgaaagtgtttataggagtgaatgctggaagaccc

SEQ ID NO: 6797450 - DNA, 112 bp, Homo sapiens
agaggacaggggccataagctatagatcagtcgtgtagaagttgatcctgagcaaaatgcagaaagagatgatcatatgactggcttttttgcttacctgaattcttcctct

SEQ ID NO: 6797451 - DNA, 65 bp, Homo sapiens
agtgtcttcatctcagattaacaggattcaatgaaattattatgtcctgaatctagaaggatgct

SEQ ID NO: 6797452 - DNA, 81 bp, Homo sapiens
gtttaacttcaaatatccagtagagggcatgaaaggaattggttttgtttgggctcactatgctgaagatagaatttgaac

SEQ ID NO: 6797453 - DNA, 83 bp, Homo sapiens
gtgaaaggtttacaggaggcagtgggtgttgtctagaaggaaatccagaactgcttcactgtttctgagactgaactttttac

SEQ ID NO: 6797454 - DNA, 94 bp, Homo sapiens
attcgtttcagtggttgccatagtgctgccagatatctaggcaaatgaaactgtggtgtgctgggaccacgctgggtgagctattgagatgggt

SEQ ID NO: 6797455 - DNA, 84 bp, Homo sapiens
gcatctgagagggatccagagaccagtgattaaaggcacatgctgagggccctgggaatgctgatttcaggaactctgggatgc

SEQ ID NO: 6797456 - DNA, 63 bp, Homo sapiens
tagtggcgtgatgacaattacaatgacaaaattatgaaatgtgaagcagtcacacgctttcta

SEQ ID NO: 6797457 - DNA, 97 bp, Homo sapiens
gctgatgagttctgccttctgagagcactgagtgagcaaggcctttcatcagtgttttggccttctcattgggtgaggaagacattgaaccaacagc

SEQ ID NO: 6797458 - DNA, 66 bp, Homo sapiens
gttttcactggggctggtcacatgtctgcatagcacatctcaaattccaggctccagaaggaaagc

SEQ ID NO: 6797459 - DNA, 73 bp, Homo sapiens
agtcatggaattctctatgctctgttccaaataaaggcagtttcctgaggaaaagatatagagctccttgtct

SEQ ID NO: 6797460 - DNA, 125 bp, Homo sapiens
gggcagccctccctgcaagccttccattctgtgctgtgactgtgacctctgttggacccctggggctgagcctcatgcagcaggggtgcacacagagggaggagtctgacaattgaggggtgttc

SEQ ID NO: 6797461 - DNA, 59 bp, Homo sapiens
taggacccctgtggtagatgggcttcataatatctattttcataaaacagaggtctctg

SEQ ID NO: 6797462 - DNA, 66 bp, Homo sapiens
ctttggaggtctgtgtcactttagtgctctcaatgcaatgtgtagcactgagatacatttctaagg

SEQ ID NO: 6797463 - DNA, 80 bp, Homo sapiens
gagagagactgttagaggttccaggaaagtcagatgcacttcatgcaattagattttaggagattttactgtattctttc

SEQ ID NO: 6797464 - DNA, 80 bp, Homo sapiens
tagacagcactagctttaagcattctgctactaaaatatctatagtatcagaaggtgtctagctgtgtgttacctgtctg

SEQ ID NO: 6797465 - DNA, 64 bp, Homo sapiens
aacctgtgcagccagtggaacagctccattatcttggccattgttgctcttgttgccacatgtt

SEQ ID NO: 6797466 - DNA, 64 bp, Homo sapiens
agaatttgctgtggacaagatgctagacctgtatgcgtcaagttgaagtcctcatcaaatatct

SEQ ID NO: 6797467 - DNA, 80 bp, Homo sapiens
ctgagatttataggaacaggccttttaactttacaagattggattctagcatgagttatccgaaggcactgagatcttag

SEQ ID NO: 6797468 - DNA, 93 bp, Homo sapiens
cttgctggctcaggagtgaagctacagaccttcgcggtgagtgttacagctcttaatgccgcgcgtctggagttgttcgttcctcccggtggg

SEQ ID NO: 6797469 - DNA, 63 bp, Homo sapiens
gttctgtatcttgattgtggtgctagttacatgactgtacacattcgtcaagactcacagaac

SEQ ID NO: 6797470 - DNA, 56 bp, Homo sapiens
tgagggcagactgtggtgttttttattgtccagtgaattgtgctattctgctttta

SEQ ID NO: 6797471 - DNA, 105 bp, Homo sapiens
gagggtattgcaggaggaatgagaattattagaggccagattgttgacagtgataaacagatattttggtagctctcaatgaaccatttctcttatcatgccctt

SEQ ID NO: 6797472 - DNA, 56 bp, Homo sapiens
ggggttaccatgagtgggtgggtgagctcagggctctgcctgccagtctggtcctc

SEQ ID NO: 6797473 - DNA, 78 bp, Homo sapiens
tggtgggccgactggggaaggcggtgactgcgctgaatcgtagccagcatcttgcaagcttcctgtccagttccagca

SEQ ID NO: 6797474 - DNA, 70 bp, Homo sapiens
gggattacagttggtattagaccaaaagaaatttctgcaaactttttttagtattactgtaataataccc

SEQ ID NO: 6797475 - DNA, 90 bp, Homo sapiens
aattaaggttgggtagctggggagaagccctgggattgcctttatggtagctcttcaggtgcctttcaccctctgcctcttgctataatt

SEQ ID NO: 6797476 - DNA, 110 bp, Homo sapiens
tgttctctcattacgggactgaaaatgtatgctgtcttacatgaatgcagttggtaaactgtggatttacttgagaagctttgcattgttaagttttccatgaaagagca

SEQ ID NO: 6797477 - DNA, 61 bp, Homo sapiens
gctgaagtcctaatcccaagtacagtagaatgtgcctgtatttggagataaggccttcagt

SEQ ID NO: 6797478 - DNA, 82 bp, Homo sapiens
cacctgtccacgcagtctgcctaaatcctggccaggaaaaacgtggtgggagtgtcagaggaggactgcgtgagggggagtg

SEQ ID NO: 6797479 - DNA, 59 bp, Homo sapiens
gtggactcatttctcctgcctgcaaggaactgctgtccacaggtcagggagataggcac

SEQ ID NO: 6797480 - DNA, 65 bp, Homo sapiens
gccaaggccatgcacatcctaggcagacccagacattgcctgagcatggaggttcatggccaggc

SEQ ID NO: 6797481 - DNA, 70 bp, Homo sapiens
tggagtgggaatttgggacagaaagcatagctgtagtttttcaagtagcatttcaacaatttcccttcca

SEQ ID NO: 6797482 - DNA, 85 bp, Homo sapiens
caggggtgaagtgctgctgaaaactggaactcttgataattttatgacctcagttcaattcagttagataaagtaaatacttctg

SEQ ID NO: 6797483 - DNA, 64 bp, Homo sapiens
ttacattaaagcatctgtaaagacccttattccaaataaggtcacattttgaggtgctgtgtga

SEQ ID NO: 6797484 - DNA, 58 bp, Homo sapiens
tgtgaaaacagctatggccatggacattatgtgaaccagtgagcatggctgtgttcca

SEQ ID NO: 6797485 - DNA, 86 bp, Homo sapiens
gaaatgctttctgaaatgctggctttggagccaaaactgtatggattcagagtaactttggcaagttttcagaatttctacatttt

SEQ ID NO: 6797486 - DNA, 59 bp, Homo sapiens
ttgctagggcactcagtctggaggcagtctggcctacacagaggctgatgtcttagtgg

SEQ ID NO: 6797487 - DNA, 74 bp, Homo sapiens
ggacagttctgttgaattttgacaaatgtatatagttgtgtaactactaccacagtcaagacaaagaacagtcc

SEQ ID NO: 6797488 - DNA, 55 bp, Homo sapiens
agctctggtgagatgttattcaggacgccccctccctgcatctttggcctgagct

SEQ ID NO: 6797489 - DNA, 69 bp, Homo sapiens
catgggaaatagttttgtgagaaagctaggacagaaatgttttacttgaaaggaaattaaggtcccatg

SEQ ID NO: 6797490 - DNA, 58 bp, Homo sapiens
cagccgtgcccctaccatgctgggcttgtggacaggcaagagtgggtgtcacaggctg

SEQ ID NO: 6797491 - DNA, 74 bp, Homo sapiens
tagtagtatagagcagtggctgcaagtaaaccctgtaataacgttaaatttacccagtaactgcttggcttctg

SEQ ID NO: 6797492 - DNA, 65 bp, Homo sapiens
acctctgagggccaatcgcggggctggaggagtttccaatggtgctcagtgtggtcctcagatgt

SEQ ID NO: 6797493 - DNA, 82 bp, Homo sapiens
acttagtagttgggtagttgattatgcagctgaaactaatacgtacagctccaaaaatcactgtttataatactaactgagt

SEQ ID NO: 6797494 - DNA, 58 bp, Homo sapiens
ctgcattagtcatgctttgcagatttgcaaagaggaatttcagagtcagcaaatgcag

SEQ ID NO: 6797495 - DNA, 57 bp, Homo sapiens
cagactggctgaaggccgagtggagtgggttaaagcttggccccgaagcctagtctg

SEQ ID NO: 6797496 - DNA, 67 bp, Homo sapiens
tgttcaccagctctgttcaaactatccaggtacatacagcagtatttggaaactgaagctctgagca

SEQ ID NO: 6797497 - DNA, 65 bp, Homo sapiens
ggagatgctcgaagacctcagaatatacacacccttaaggttcaagggctggggttgagctctcc

SEQ ID NO: 6797498 - DNA, 60 bp, Homo sapiens
tctatatcttggctgctgtgaataatgctgcaatgaacatggcagctcagatatctcaga

SEQ ID NO: 6797499 - DNA, 66 bp, Homo sapiens
tgccacccagcatgtgatacccgcctggacacatccaggaaacactcaagccatgctggggaggca

SEQ ID NO: 6797500 - DNA, 68 bp, Homo sapiens
cagcccagaggggtttgaggactcccgggcgaagtcttctagtcccttgacacaccctctcagggctg

SEQ ID NO: 6797501 - DNA, 67 bp, Homo sapiens
tgacttgcgccaggctggagccaaccaaggcttggtttgggtggctgtcagctgcctggtgcgagca

SEQ ID NO: 6797502 - DNA, 72 bp, Homo sapiens
tggtacataatcatctccctaattatgactcatctccagacaattcgagatagttgaagagatgaatgacca

SEQ ID NO: 6797503 - DNA, 60 bp, Homo sapiens
agcaggatggtggaaggcctgctcagaagccatctgcagctttcttttcccccacctgct

SEQ ID NO: 6797504 - DNA, 66 bp, Homo sapiens
gacttagctatgaaagggaagtgaaggcattggggaaatgtgcacagacaactctttctagaagtc

SEQ ID NO: 6797505 - DNA, 81 bp, Homo sapiens
cattcggcaataagaatgcggctcatggtagaaacagtgtttctaaatggtggctgcattgtgctattagcccacagagtg

SEQ ID NO: 6797506 - DNA, 81 bp, Homo sapiens
aagtagaactcttcatggtttcatgagaattacccattcatgtgttgtgagtcctgtgaagcatgcctattggttttactt

SEQ ID NO: 6797507 - DNA, 97 bp, Homo sapiens
ccagacatggcagcttcctcagcttcgaggggacggcctctggaacacgctctgtccttcctggtgtgcaggggcctccccttgctgccctgtctgg

SEQ ID NO: 6797508 - DNA, 61 bp, Homo sapiens
ggggcccttgtggctgcaggccaggacagtcgttatgtctgatggggtcaagagaggcttc

SEQ ID NO: 6797509 - DNA, 55 bp, Homo sapiens
aatggcatattctgtagggtgatttattttaattgtcactctgggacctgttatt

SEQ ID NO: 6797510 - DNA, 75 bp, Homo sapiens
tccagtcatgctgtttgtggtatctgctgcctcttgctcctggtagcttgagtgtttcataaatatagattgcga

SEQ ID NO: 6797511 - DNA, 76 bp, Homo sapiens
acgcgatggcctcttcccgcgttctcggcgggtacggcgcgccgcctgcctgcggcccgcggggaggtggtcgggt

SEQ ID NO: 6797512 - DNA, 83 bp, Homo sapiens
aaaggaacagtgcactctttgctggatcttaaggggttttgcacatttcactggccaagctggatttagctgcacataacttt

SEQ ID NO: 6797513 - DNA, 86 bp, Homo sapiens
ggctaacactatctgccttacagggatgccatgagaattaaatggaataatgcctctgaggaagattgtgttttctaaaaatggcc

SEQ ID NO: 6797514 - DNA, 66 bp, Homo sapiens
ttctgagaaggctgtggacacagacacaatgggcatgctgcactttgttccagcagcttctctgaa

SEQ ID NO: 6797515 - DNA, 64 bp, Homo sapiens
gagcaggattacagaggaaggactcctaagactgagtccccaagtcactagtaaccatctgctt

SEQ ID NO: 6797516 - DNA, 60 bp, Homo sapiens
ccccacaggccaaagatcccattgacacgtaagtagttagcactcggtctgctctggggg

SEQ ID NO: 6797517 - DNA, 69 bp, Homo sapiens
ggacagtattcatggcagtggtaacgtttctagtttgggaacccactcactgcatgaagaacatgggcc

SEQ ID NO: 6797518 - DNA, 59 bp, Homo sapiens
ccagcaataagtagagccttgcaaagactgcaaacttgcttcaacttatttcacgttgg

SEQ ID NO: 6797519 - DNA, 61 bp, Homo sapiens
ttatgctagttgaaataacacaagtgcaaaagatggcatatgtgtgattgtatttgtatga

SEQ ID NO: 6797520 - DNA, 72 bp, Homo sapiens
ttgaagaaacttcttgcaattttcatcttatttcaaagaacatcaggtgggttttgaagaaacttcttgcaa

SEQ ID NO: 6797521 - DNA, 60 bp, Homo sapiens
gcagggtgacgttgcccacctctggctccacgcagatgctggtgaagtaacgcgccctgt

SEQ ID NO: 6797522 - DNA, 56 bp, Homo sapiens
gaggggcctcagcctcctggtcatgaaagagtcctgggtagaggcagagacccctc

SEQ ID NO: 6797523 - DNA, 82 bp, Homo sapiens
gggctggcggaggccaggcggccgcgcgggggtgctggtgtcgcgctgcttgctccggccggggttgcccctttgccggccc

SEQ ID NO: 6797524 - DNA, 88 bp, Homo sapiens
aggggaaaaatggactctttccagctcttctgtcctttagagaggacctcagggtgacagctccttggttagatgccgtttttactct

SEQ ID NO: 6797525 - DNA, 75 bp, Homo sapiens
agatttcagggctactgctgtgacaacagggtagggcagaaagggtactgctctgggattcagcagcctggatct

SEQ ID NO: 6797526 - DNA, 80 bp, Homo sapiens
tctctagtgcccgaggtagggaagacaaatatgcagtaggcttgctgcaaaatttacactccttcttcctgcaactggga

SEQ ID NO: 6797527 - DNA, 59 bp, Homo sapiens
ctgcatccaggctgcaggcccagcccatgcagggctctacacctgccagtctggagcag

SEQ ID NO: 6797528 - DNA, 72 bp, Homo sapiens
acattcaaggcagcactgagtgttggacaggacacattaattccttacatgtctcaggtgttccttcagtgt

SEQ ID NO: 6797529 - DNA, 86 bp, Homo sapiens
tctggattacggtgagtgtcagtttgctatgtgctaagtaccacaacctgggtatcttcaacaacaaattgcctcaaagttctgga

SEQ ID NO: 6797530 - DNA, 101 bp, Homo sapiens
actcccttgcacatccaggctatgtgcctgagtgctgagcgggcaccctcaggtatcctgggctgcaccctcagcctctgggacaccaagggcaagggggt

SEQ ID NO: 6797531 - DNA, 61 bp, Homo sapiens
ttctagttactcttaaatgctgccttcacaaggttaatttggctgttaatagtgattagaa

SEQ ID NO: 6797532 - DNA, 57 bp, Homo sapiens
aggtggttcatgcctgtaatcccagcactttgggaggctgaggtgggtggatcacct

SEQ ID NO: 6797533 - DNA, 62 bp, Homo sapiens
ctcatctggggaaaactccattgctgagattactcagtacaagttgcctaccttaagttgag

SEQ ID NO: 6797534 - DNA, 58 bp, Homo sapiens
ggcctcccaaagtgctgagattacaaagattagtggtagtaaagcggtatgggtggcc

SEQ ID NO: 6797535 - DNA, 59 bp, Homo sapiens
ctgggaagaaattgtgggaggcaagtgggttgattccctatatacagtttctgactcgg

SEQ ID NO: 6797536 - DNA, 57 bp, Homo sapiens
agacatgcttggaggagaaggaaactgtgttggttgatatttttcctcaaagttgct

SEQ ID NO: 6797537 - DNA, 70 bp, Homo sapiens
ccttggttagccatttcatggggacaaaaattaactccaaccaaaaatgacaatgtgtaagtaaccaagg

SEQ ID NO: 6797538 - DNA, 63 bp, Homo sapiens
agtaggttttcagccaacaagttgacatcggaacctgtgaggcggttggcactgaaaatggct

SEQ ID NO: 6797539 - DNA, 77 bp, Homo sapiens
attaccttgtttgatgtcttatttaaggcttatacaagttcaataacttgtccaaagtaacacatctagtaggtagt

SEQ ID NO: 6797540 - DNA, 61 bp, Homo sapiens
tgaaggggactatttactcaaatgaggttggtgattctgcctcagcgttgtggccctatca

SEQ ID NO: 6797541 - DNA, 66 bp, Homo sapiens
gctcttggaaaagcacccagctcctgcaggactttcctctcagtgcctgtgggcttcttccaaggc

SEQ ID NO: 6797542 - DNA, 59 bp, Homo sapiens
ggtgggggcggagcacgtgaccacgcctcttaaaggggctgtcgcaggtcgccccaccc

SEQ ID NO: 6797543 - DNA, 82 bp, Homo sapiens
cctggtgcgcctggcccgtggcgggtccctggaggacgaggacaccccggagcccagggtaccccaagggcaggtgtgcagg

SEQ ID NO: 6797544 - DNA, 62 bp, Homo sapiens
gagccgtgtctgcaaatattttattcagctttagaggttcagaaagtgcacagatacagctc

SEQ ID NO: 6797545 - DNA, 60 bp, Homo sapiens
agactgaagtaagaatgcagctgagagtagtaatacttaacgttgtttcttcttcgatct

SEQ ID NO: 6797546 - DNA, 77 bp, Homo sapiens
gcagccttttaatttgtttatgtaattggcacacttaaatggaatgtgtcatcatatgaatgtttttaaaattttgc

SEQ ID NO: 6797547 - DNA, 67 bp, Homo sapiens
gtaaggaatgcttgaatgttcctgacaatgtttttgtataattgcaggagcatttgatatttattac

SEQ ID NO: 6797548 - DNA, 75 bp, Homo sapiens
agtctgggatcaaaattttatttctcaaggacttcagagattcctaagaatattaaaatttgagaattgcagatt

SEQ ID NO: 6797549 - DNA, 61 bp, Homo sapiens
tatatagcacttgttttgcatgtctgattgtcagctcttgacaaggcagaactgctgtgtg

SEQ ID NO: 6797550 - DNA, 69 bp, Homo sapiens
agctctctagatacacacacagtcatgtgtgcacaaacatgcatgtgtatgtgtatttgtaaggaggct

SEQ ID NO: 6797551 - DNA, 85 bp, Homo sapiens
ggatcagctccagagatcagtctgtttcttctgcaccccctccctactccatttgtgcctgcaccctggctctctggaatggtct

SEQ ID NO: 6797552 - DNA, 64 bp, Homo sapiens
aggcacacttataataagtatccacctcccagagctttgtgtgaattgcttgtgaagtgtgtct

SEQ ID NO: 6797553 - DNA, 88 bp, Homo sapiens
tggaccatgccgtgcctcagtttctccatatgaacacataggggcatctctctacttcaggggactattgaatccatgagcaaattca

SEQ ID NO: 6797554 - DNA, 105 bp, Homo sapiens
tgtattatatattattttgaaatacacaaatttagtaagttttaatatcaaaataaagcacagagcatggtgaagttggtgtgtttaaaactaatgtctactata

SEQ ID NO: 6797555 - DNA, 58 bp, Homo sapiens
tgtatatgcactttccttatcctggtgttgcaggtgctgagaggggttgtgtattaca

SEQ ID NO: 6797556 - DNA, 74 bp, Homo sapiens
gagccgtccgcgccagcctctccatctcgcaagttttaattaacgctgagtgggaggcggctgacgggcgggtc

SEQ ID NO: 6797557 - DNA, 109 bp, Homo sapiens
ccaggcataaaagatcacatattgtatgattctatttacatgaaatatctattagaggatgaaaaaattcatatagagggcatacaaatggtggtttccagggccctgg

SEQ ID NO: 6797558 - DNA, 102 bp, Homo sapiens
ggtcttcggttcaaggtacatatactacctagatgatggctcccattcttgtggtaagatatcacctctaggctggtgtttcagttgtgcctttggcaggcc

SEQ ID NO: 6797559 - DNA, 56 bp, Homo sapiens
agctggtgaacctgaggcacagagagattaagcgacttgctcagggtcacacagct

SEQ ID NO: 6797560 - DNA, 78 bp, Homo sapiens
gttaaatactttacaggatgtctcagacccttgcttaagtttattttcattggtggagactccttggggctatttcac

SEQ ID NO: 6797561 - DNA, 82 bp, Homo sapiens
tgtgagtaggcaaccatacaatagtgtttgttttgaggacaattatgagtaggttttttagatacattgtatgtcacttgca

SEQ ID NO: 6797562 - DNA, 79 bp, Homo sapiens
tccccacagaaaacctgtatcaatttgtactcagataagcagagtacaaattgatacagatttgaactctgtgcaggga

SEQ ID NO: 6797563 - DNA, 60 bp, Homo sapiens
gctttatgggccatgcggtgtctggtataacattcaagtctgccgttgcagctcaaaagc

SEQ ID NO: 6797564 - DNA, 70 bp, Homo sapiens
cagatgacaaaacttttgccagcagataggaagtgacagggtggtctgtggggaattcatttgtcagttg

SEQ ID NO: 6797565 - DNA, 67 bp, Homo sapiens
gagggctgcctgctctgcattgaagctgctttgttcatttctcagtgacaagagcctggcggctttc

SEQ ID NO: 6797566 - DNA, 66 bp, Homo sapiens
gaaggtcacctcccctctctggctctcagagccatataatacaaggagaaggtggacttgatcttt

SEQ ID NO: 6797567 - DNA, 102 bp, Homo sapiens
cttggcattaaaatgtgcctgtcttccctcagtccattggtgccgttgtcctggataaacgggagcgtgggctagtgtgagatgttcacgtgggatgtcggg

SEQ ID NO: 6797568 - DNA, 74 bp, Homo sapiens
gtggccagttttgatcagaggtttaagaaacaccatgagtttgtcttgtccctggagcttctgtcccctggcac

SEQ ID NO: 6797569 - DNA, 65 bp, Homo sapiens
tttctccctgtggttctgtggcttcaccgggaaaatgtgggccttgctgagctatggaggggaaa

SEQ ID NO: 6797570 - DNA, 64 bp, Homo sapiens
ttctggagttcaggtccctaaaccgctttcctcaattttgagagaaggggcactgtctctagag

SEQ ID NO: 6797571 - DNA, 58 bp, Homo sapiens
gggcaagcctctggtgtcttgtgtgtgtctcctgcaccatccattttcttgcttgcct

SEQ ID NO: 6797572 - DNA, 55 bp, Homo sapiens
ggggtagcagtgatagaaaggacaagaggacagggtccctcagcacttctacctc

SEQ ID NO: 6797573 - DNA, 56 bp, Homo sapiens
gggtttagattgcaagtgctagaagcattttgctgaagctgctctcatccagacct

SEQ ID NO: 6797574 - DNA, 67 bp, Homo sapiens
gctccaggagcaaagatcactgggagaggaaaattccccatccctggaggtgtttgctcagggccgc

SEQ ID NO: 6797575 - DNA, 76 bp, Homo sapiens
ttggagaaattgctttatctcttatgcctcaggttcctcatctgtaaaatgggtagaataatggctcttacttcaa

SEQ ID NO: 6797576 - DNA, 74 bp, Homo sapiens
acccatattatgtcaattaagtgctgttctagaggcattctgccatgggctttttacattgaacattttagggt

SEQ ID NO: 6797577 - DNA, 81 bp, Homo sapiens
ccatctgttagggtggcactgtgcccacccatagagtggtatgccagtttcaacagggcacaggtgccagccaaacatagg

SEQ ID NO: 6797578 - DNA, 60 bp, Homo sapiens
cttgagtgatcagtaactcaagtggcagcaattggccacttagatactagatcacaaagg

SEQ ID NO: 6797579 - DNA, 63 bp, Homo sapiens
ggcttgggctcccagcaattgaggcagccttttggcttcattacttttggtgggacttgagcc

SEQ ID NO: 6797580 - DNA, 74 bp, Homo sapiens
caaatgaaaatggcgtcttggaaaaacagcacatacatggttgcttcaaggatatcgcccaataccttcatttg

SEQ ID NO: 6797581 - DNA, 56 bp, Homo sapiens
gaaacttgataattgaaacagaatggaaacagaaagtgtttggatttcaagctttc

SEQ ID NO: 6797582 - DNA, 62 bp, Homo sapiens
ggttgggctgggagctgccctgacatggaagaaccatatcttaggggagaaccagccttact

SEQ ID NO: 6797583 - DNA, 112 bp, Homo sapiens
gtgaaatcccctaaattgctattcttcagtatgtgtggattgttccaggtccttgcctatcaatttgttgacatctagaaaatagcttgctgaattttgattgggatttcat

SEQ ID NO: 6797584 - DNA, 62 bp, Homo sapiens
catcgtggtcatcattagtattattactattttggtgagttgatcaatgatgctactggatg

SEQ ID NO: 6797585 - DNA, 60 bp, Homo sapiens
aaaagatttcctttattcaacatgaccacttcatttgtttcctgatgtgggagatctttt

SEQ ID NO: 6797586 - DNA, 60 bp, Homo sapiens
gtgctttactttgcctggttgttcctggactggaagaccccagagcgaggtaagactcac

SEQ ID NO: 6797587 - DNA, 88 bp, Homo sapiens
ctttgccttagtagtaattataactggttttgttaataccaatcctaaagtattaacaatacccattctaattactattaaggcttag

SEQ ID NO: 6797588 - DNA, 60 bp, Homo sapiens
tgagccaaatcccataataaatcctctcatataacaggatttattatgggatttggcaca

SEQ ID NO: 6797589 - DNA, 64 bp, Homo sapiens
gcagggccagggctcaggctgtctcggagcccccggagtgcttgagctctcctggaagccctgc

SEQ ID NO: 6797590 - DNA, 77 bp, Homo sapiens
gtaaaagagctgggccagcctgaagccttgttactgaaagacatttcatctggcagtgtataggtggctccttgtac

SEQ ID NO: 6797591 - DNA, 60 bp, Homo sapiens
aaacaactcaacttctagttgttaactgtgtgttaattagtggaataagttaagttgttt

SEQ ID NO: 6797592 - DNA, 63 bp, Homo sapiens
actccctgaaatctcctctttatatatctcagcgttttatgcttttgatgtgaggaagggggt

SEQ ID NO: 6797593 - DNA, 59 bp, Homo sapiens
ttctactttagcatgctcattcttttgagaattgaggaatggctggcccgaggtaagaa

SEQ ID NO: 6797594 - DNA, 64 bp, Homo sapiens
tagccagaagactaccttcagggtcaaacaataactttcccctgggtcttcagtctgctggtta

SEQ ID NO: 6797595 - DNA, 61 bp, Homo sapiens
acagatgaattttgggggcactattcattcagcagtaagtgtcttacatgaattgatttgt

SEQ ID NO: 6797596 - DNA, 59 bp, Homo sapiens
gcatttctcaactgtattatgcagaactttagagttttgtgaggtgtggttaggtgtgt

SEQ ID NO: 6797597 - DNA, 69 bp, Homo sapiens
cttggcaacactttcaattcccttagcaactcaaggtgcatgagtcactaggctgaaagtggagctcag

SEQ ID NO: 6797598 - DNA, 62 bp, Homo sapiens
gagtggagtgagtggcagaaggagatcaacggtcttctgaatgaaaaaccctgactctagtt

SEQ ID NO: 6797599 - DNA, 60 bp, Homo sapiens
gcccagagactggagtgcagtggcgcgatctccgctcactgcaagctcagcctcccgggt

SEQ ID NO: 6797600 - DNA, 56 bp, Homo sapiens
gccctagggagggatgttggcatgaggaacctgccaagtcacatattccccctggc

SEQ ID NO: 6797601 - DNA, 73 bp, Homo sapiens
gaattcacagtgggtggctaagtggctgactctggggtcagactgggtttgcagccacctgttctgtgagttt

SEQ ID NO: 6797602 - DNA, 74 bp, Homo sapiens
gacacacgctttccaggcctgcctggtgtttgcccagggagactgcaagctctctgcaggcagagcccactgtc

SEQ ID NO: 6797603 - DNA, 62 bp, Homo sapiens
tttggtccttcatacttcctttccctttatgatgggaatagagctacgatgacaggcctaaa

SEQ ID NO: 6797604 - DNA, 63 bp, Homo sapiens
gggaaagtcaagacaaggccaaagtttctaaattgggaagggttctgccagtgtcttgagctc

SEQ ID NO: 6797605 - DNA, 74 bp, Homo sapiens
ccagcagccctcttccaagactatctttgggctacaaattgctttacccagcagctgggaggcagggttgctgg

SEQ ID NO: 6797606 - DNA, 58 bp, Homo sapiens
cagctatgggcagacgctgttggaaggcactccttgtgccgtctatttctgccagctg

SEQ ID NO: 6797607 - DNA, 83 bp, Homo sapiens
gctacggctgatctgacaggaggcagagctcaggtggccatgcttgcttgcccctggctcactttctgttgtgcagccagtgc

SEQ ID NO: 6797608 - DNA, 60 bp, Homo sapiens
gcacgtgtgtttccaaccaagcaagcacaattctcagaagtgctttgatggaaatacagc

SEQ ID NO: 6797609 - DNA, 89 bp, Homo sapiens
tgagaccatttgctggttttagggaatcaatctataggtgggaagttttcttttgcagaaactaatttagaactaagcctttggtgtca

SEQ ID NO: 6797610 - DNA, 90 bp, Homo sapiens
ggggacactaaaatactgagtctctgggcatggttgtgacagtgcctggcacagtccctggcacagagtaggtagttggttggtgttgcc

SEQ ID NO: 6797611 - DNA, 98 bp, Homo sapiens
aatggtaaactactaaactgtgaatgagttgattctctattttagggaaatgttaagaattcgttctcatgttttagaatgggccagtggtctccatt

SEQ ID NO: 6797612 - DNA, 92 bp, Homo sapiens
gccctgtgagtcagcccagagccccggccatgttagggtcccctggcacagtctgccttggctaaggggcccttgggttgagtcatcagggc

SEQ ID NO: 6797613 - DNA, 110 bp, Homo sapiens
gggagttcctcatttgccatgagtggacacctgcttctttactgcttcaaagtgaacacagctattccttgtaaagggtaggttttactgtaaggaaatctagaacacct

SEQ ID NO: 6797614 - DNA, 63 bp, Homo sapiens
gagttttttattctggctggtgggaataggcaccacctccagccctgtaaggatgaggcactc

SEQ ID NO: 6797615 - DNA, 57 bp, Homo sapiens
agaactttcctagacctgagatgtcgaaaggttattattttggcttgaggagagtct

SEQ ID NO: 6797616 - DNA, 84 bp, Homo sapiens
tcttagcatcgtatcttgttatctgaaccaaaattatattaaaatggtatatctcaaggtagtagtagctagcgaatgttaaga

SEQ ID NO: 6797617 - DNA, 78 bp, Homo sapiens
cagctctaataatctgtggccagaggtactattttaagaatgtactattttaggtagtggccacaatgttagattctg

SEQ ID NO: 6797618 - DNA, 77 bp, Homo sapiens
gaggaagcagctggtgagatggagcaaaagatggggcaggttttagcctcgctgcctggtttctcagctgcatactc

SEQ ID NO: 6797619 - DNA, 59 bp, Homo sapiens
tgttagggacacttggagaggaggagtttaagaacctctgcaatattatgtcccagata

SEQ ID NO: 6797620 - DNA, 61 bp, Homo sapiens
gggagcctgcactgctgtttgctgtttggtattctgtgcaggcagcagcttgctggttgcc

SEQ ID NO: 6797621 - DNA, 72 bp, Homo sapiens
gtgactggcttccttgtttccacattatgtctgtgaaattcatccctcttgtggcagacaggaggagctcac

SEQ ID NO: 6797622 - DNA, 122 bp, Homo sapiens
gcatcagaatttcctgggtgttggttcgaaattcagacttctgggtcccatgctaagagatagattcagtaggtttaggaaatctgcattttgaacacacaaccacaggagattctgattgc

SEQ ID NO: 6797623 - DNA, 62 bp, Homo sapiens
gcttcttctctacatcctttgattgccaatccaagcatcatactgggtagagagaggcaagc

SEQ ID NO: 6797624 - DNA, 55 bp, Homo sapiens
agggagctttaccccagatcacatacagattgtgtttgggaaaatattgttctct

SEQ ID NO: 6797625 - DNA, 55 bp, Homo sapiens
ccatgggcactgggtggaggtaggcgcaaagacgtccctcagcccacagccctgg

SEQ ID NO: 6797626 - DNA, 55 bp, Homo sapiens
tagatcatgggtactgcatatgatggaagaaatttcttaatgttcccatgttcta

SEQ ID NO: 6797627 - DNA, 59 bp, Homo sapiens
cctcactgggatatgcccatttgcaagagagtgacttcaagttatggcttcccagtagg

SEQ ID NO: 6797628 - DNA, 81 bp, Homo sapiens
gccagatatctcagtgtgtacactgagcatttgtgtagcttgtcacaaatttcttgggtacagtgtacatattagcctggc

SEQ ID NO: 6797629 - DNA, 130 bp, Homo sapiens
gattgcctgatggagtagaggtgaggcaagtaaaggaatacagcattgcctctaggttttggcctgagccaaatatagggatgaagttgctatttactgagatttgtgggaactggcttggagggcggac

SEQ ID NO: 6797630 - DNA, 81 bp, Homo sapiens
ttcttcgagttcatgagagaactgtttctggggtctttaaattttaagaggaacttatgatattctactcaactataagga

SEQ ID NO: 6797631 - DNA, 120 bp, Homo sapiens
ctcctatcaaacatctccttgcctatcttgttcatcactgaaatctttgactctggctaacaatttgcttcacaagaatttgtagatgaaaggagaaaaaaggaaaaaaaaggagaggag

SEQ ID NO: 6797632 - DNA, 66 bp, Homo sapiens
ctaggcactcacgtggctttagctctgcctccacactgtgtgcttctggtccatggaagtgcttag

SEQ ID NO: 6797633 - DNA, 88 bp, Homo sapiens
ttggtatcttagctgttaagttgtttggaaagtcagataaatgtctcttacccagagctttttaaaattcttagcagcaaagtcccga

SEQ ID NO: 6797634 - DNA, 69 bp, Homo sapiens
ttaaattttatctgctgtctgtgtaaacagaccaagttctcactctatgtagcagcagaaagaacttag

SEQ ID NO: 6797635 - DNA, 88 bp, Homo sapiens
gcatttagtttctcacttccagtagccaagtttagaaaattaaacaaaattgtgctcttggaagttagatttttgttaatcccaatgc

SEQ ID NO: 6797636 - DNA, 62 bp, Homo sapiens
acagatggcagtcagcttagactgtagtgtgaagccctacaggctgacttcctgccatgtgt

SEQ ID NO: 6797637 - DNA, 71 bp, Homo sapiens
tatggctgtgacttatcttgttcttccaaaatgttagacacaagtccatataagtctgtttcactgccata

SEQ ID NO: 6797638 - DNA, 112 bp, Homo sapiens
ctcatgccaggcagggagaagttctgtttctccacactcttcccaagacctggcacccaaccaggcctgggaagggctgggcagagaacctcactcatccctccttgtagag

SEQ ID NO: 6797639 - DNA, 62 bp, Homo sapiens
ggagaggtgtgcatgagaatttcctcatctccttttgaggaattttgtatggatactgtttc

SEQ ID NO: 6797640 - DNA, 83 bp, Homo sapiens
gcacctaaccttatggaagacttcctggaagagaagacatttctgacgatctcttcaaagaattttagtaatttagtaagtgc

SEQ ID NO: 6797641 - DNA, 68 bp, Homo sapiens
gaggtattgactatgggatggcccaagtcttctagatctgaccctggccaccccttagtcctgatctc

SEQ ID NO: 6797642 - DNA, 84 bp, Homo sapiens
taaaagtctagataaggtggcttggaattcttctggcattcccagattcaaattcctcaaagccatctacttcatagcgtttta

SEQ ID NO: 6797643 - DNA, 78 bp, Homo sapiens
tgggcttagattgaatgcagtcatgaaaagttgccacgcaaaaggagtagcttgttctcatccattcttctgagttca

SEQ ID NO: 6797644 - DNA, 78 bp, Homo sapiens
cccagtgtctccttgtggatctcaaggatgtgcttccacatagcagcatcttcttcagatggacaaggagacactggg

SEQ ID NO: 6797645 - DNA, 118 bp, Homo sapiens
ggaggtagatgacaaggccacaaaatcctcagggagctagcttcttccaggtttctactctgccattcctagggagcctggtcaggttggctcctggatctcaccatcactgcattcc

SEQ ID NO: 6797646 - DNA, 57 bp, Homo sapiens
ccatgtctggctaacattttgtggagacagggtctccctgtgtgttgcccaggctgg

SEQ ID NO: 6797647 - DNA, 96 bp, Homo sapiens
gcaaaaatacagtaatcttaagggaacaccattttatgtgcagtctgccattgacgcacatacaatggtgttatttggcatatgactgtaatttgc

SEQ ID NO: 6797648 - DNA, 76 bp, Homo sapiens
ttgcttcaacccaggaggtggaggttgcggtgagctgagatcatgccactgcactccagcctgggcaacagagcaa

SEQ ID NO: 6797649 - DNA, 82 bp, Homo sapiens
ccacccaggctcccacaagctcccagcccggtgcccacgctggccaggcctgtgctggctggagctctgggacctggattgg

SEQ ID NO: 6797650 - DNA, 92 bp, Homo sapiens
aaaccattatgtgtcttttatttctcttcaaaattgatgtagtgtgtatcagtatgataattcgatgagaaaatgtgaaatacttatggttt

SEQ ID NO: 6797651 - DNA, 62 bp, Homo sapiens
ggttaaagttaggagagagagagagagagcaactgttacttttccagtccctggatttaacc

SEQ ID NO: 6797652 - DNA, 64 bp, Homo sapiens
gaagtgcctcggtgtccaaggcgtggggaaggctggctccgaatatgacaccaaggcgggcttc

SEQ ID NO: 6797653 - DNA, 74 bp, Homo sapiens
gctgctgttttggtcatggaatcagatgtcttttactattctgaggcccaaagagcccagggtgaaatagcagc

SEQ ID NO: 6797654 - DNA, 100 bp, Homo sapiens
aaacactgcaccatgacaaagggcttttgagcgcacgtctgaagatccggcctctaacttcagctatgctactaacagcccttctgatgcagagctgttt

SEQ ID NO: 6797655 - DNA, 115 bp, Homo sapiens
tggaaacttatttcctagtgaaatggatgactgtgtcctgtaatagaatatttactatatttagtaacagatttatacagtctcatttgttttagttaagaagtttgagtatcca

SEQ ID NO: 6797656 - DNA, 70 bp, Homo sapiens
gccacccatgctgtcctgccagggatggcataggaaagtcatgccttggaaggcggtgtgttgtggtggt

SEQ ID NO: 6797657 - DNA, 82 bp, Homo sapiens
ttgaataatcattatacaggcagtcaagcctcactgatttgaatcagtggagtgggactggtctgattataaagatttacaa

SEQ ID NO: 6797658 - DNA, 76 bp, Homo sapiens
gaaaggaaaggagaaaataaatgttctgtaagtaaaaatatacgcatgaaacaagggtattttctctatttcattc

SEQ ID NO: 6797659 - DNA, 70 bp, Homo sapiens
ttcattctgggctctaaggaactggggtggccggttgggcaggtgggtttcttggggcccagaatctgaa

SEQ ID NO: 6797660 - DNA, 58 bp, Homo sapiens
tgacagtttgactgcaacctttgagagtccttagccagaggcacccagttaagctgca

SEQ ID NO: 6797661 - DNA, 63 bp, Homo sapiens
ttctgagaagtaaaatggcgtttccttggcctgtgagagggaactagtcagtgattctcagaa

SEQ ID NO: 6797662 - DNA, 76 bp, Homo sapiens
tctggttcccaggagataagctgagtttataattttaaggaagggagtgaatgtagcttgtcttcctggcaccaga

SEQ ID NO: 6797663 - DNA, 67 bp, Homo sapiens
tactgatgatttaagggaaaaaatgaatcaagactctattgattaaatgttccttaaattatatgtg

SEQ ID NO: 6797664 - DNA, 61 bp, Homo sapiens
cagggttagagaaaatccttaaatacattcttttgaaatgatgcttctttctctctccctg

SEQ ID NO: 6797665 - DNA, 66 bp, Homo sapiens
atcacagaaagaagagcttcagttcagccttggacaactgaaaaaagaagtgtcttgtttctggat

SEQ ID NO: 6797666 - DNA, 64 bp, Homo sapiens
cttactggatactcaagacatgtccagaaaccaattggataaaggtgtctggagtactagagag

SEQ ID NO: 6797667 - DNA, 59 bp, Homo sapiens
gagactcctgggaccatgggcatattttctaatattgccaagtggagctcaggaatctc

SEQ ID NO: 6797668 - DNA, 57 bp, Homo sapiens
ctgacttcgtgatccatctgccttggcctcctaaagtgctgggattacaggggtgag

SEQ ID NO: 6797669 - DNA, 106 bp, Homo sapiens
ctcatttggggccaaacttatgatatgcatttacctggcatataccaaccaaacagaatggctgcaatataggcacaggtgagaggtacaaaatggctgcagtggg

SEQ ID NO: 6797670 - DNA, 57 bp, Homo sapiens
ggactgtcagcttggtgagggaatccagatgaatttcccttttcaagccatcagttt

SEQ ID NO: 6797671 - DNA, 60 bp, Homo sapiens
gcagtccagagtagtcgagtattctgtaacaaaataacagggttacttattttggatagt

SEQ ID NO: 6797672 - DNA, 66 bp, Homo sapiens
ctcattgttcagattagtgttaggttacaggccaagaacctgcagcagacataatgtggattagag

SEQ ID NO: 6797673 - DNA, 60 bp, Homo sapiens
caactgctgacaccatcactccagcagactctgacagctggagaattgagttagttgttg

SEQ ID NO: 6797674 - DNA, 58 bp, Homo sapiens
gggatgattctcattttactgtgatttgaaacaaagtcatagtttcatagaacatgcc

SEQ ID NO: 6797675 - DNA, 61 bp, Homo sapiens
tgcaagacgacaggtgagatggaaagagtacttttgtttgttccttccctctctttttgca

SEQ ID NO: 6797676 - DNA, 88 bp, Homo sapiens
cagagtgagtatgaagcaaatttcaagtgtaagttaaagtgatcagtgatgcattggtagagtttgttttataaattttatttctctg

SEQ ID NO: 6797677 - DNA, 66 bp, Homo sapiens
ggacaggacgggcaaacaggatggtctcagcccaaaagagatttcctgcagagcccctccgaggcc

SEQ ID NO: 6797678 - DNA, 63 bp, Homo sapiens
atgggagggtagagtgaacagaactgggtttagaacctcactctggcacttgccagtttctat

SEQ ID NO: 6797679 - DNA, 129 bp, Homo sapiens
gttgtttagctgttgggttgtgagaatcctaaacctggagagagctccaagcgtccagtgaactggggggacagttgagtgtctctaggaagcgggacttatcaaccagtatttcaatactgtaacaac

SEQ ID NO: 6797680 - DNA, 76 bp, Homo sapiens
tgggacctggtgctagctggtgtgtaacagggcaaagaggctgagaaagacaagcacagctggtgactacatctca

SEQ ID NO: 6797681 - DNA, 57 bp, Homo sapiens
cccacagtccttagactcagcatggcaaaccctgagcttggagtctaaagactgggg

SEQ ID NO: 6797682 - DNA, 59 bp, Homo sapiens
gggccaggctcacctcccacacagttgctctggagctatgtaggaggcaagcctgtctc

SEQ ID NO: 6797683 - DNA, 69 bp, Homo sapiens
gccaaccccggtggtggtcccttaaaatctgtcctccagatggccaaggaccacgcatcgggggagggc

SEQ ID NO: 6797684 - DNA, 77 bp, Homo sapiens
gaatcatgttgatgaagtgatgcagtgtaatccccaccttgttaattgtgtgataatgcagtcctttgacatgattc

SEQ ID NO: 6797685 - DNA, 55 bp, Homo sapiens
tccaagggttcatgtgcattcatccattaacgggtcttgcacggtcacccgtggg

SEQ ID NO: 6797686 - DNA, 66 bp, Homo sapiens
tgtttgacttgacactgagataaagctgcttcctggttgcttctattcactggtcacagttctgca

SEQ ID NO: 6797687 - DNA, 74 bp, Homo sapiens
tccctccttaataagaggtctgtatcttaaacaacaggcaaagtattagagagccatatctcttaaaggaggga

SEQ ID NO: 6797688 - DNA, 60 bp, Homo sapiens
gtgtgactttatttggaaatagtgttattgccgatgtaattgattaagatgaggtcacac

SEQ ID NO: 6797689 - DNA, 56 bp, Homo sapiens
ggtattagctgtgacgaggcattgttcattgctgcctctcggttacgtttaaagcc

SEQ ID NO: 6797690 - DNA, 82 bp, Homo sapiens
agaagcatttgttccagctattgctgtgtaacagtcatccatacttagtggcgtaaaacaacaatagttgattattgtttct

SEQ ID NO: 6797691 - DNA, 62 bp, Homo sapiens
tgtgcctgaagctgcattcctagttgtctgttgaccacttgttcatgagtgtctttggcaca

SEQ ID NO: 6797692 - DNA, 70 bp, Homo sapiens
ctgcctgttaaactgtcacctaatgtatttttagaaatatataatctaaaaaagacagaggatgaggcag

SEQ ID NO: 6797693 - DNA, 71 bp, Homo sapiens
agttaaacatcgatggatagagcttgcttagttgtttatcattagcgaaatttttcatctgaatgtttact

SEQ ID NO: 6797694 - DNA, 64 bp, Homo sapiens
cttctattcttgcagtatacaactactgatgtcaaaggcagtgggctgtaatttaggaatgaag

SEQ ID NO: 6797695 - DNA, 73 bp, Homo sapiens
gcagtactcctggattttctaagacaattattatttgaaatagtctgtctaatattattcaggcatgtgttgt

SEQ ID NO: 6797696 - DNA, 86 bp, Homo sapiens
tgtagttaaatcatgttgtgcatgcagtaagtgttttaaatgaaagtaatttaaaacaactctgtgtgtttaactctggaattaca

SEQ ID NO: 6797697 - DNA, 115 bp, Homo sapiens
caagaagcagtcaaattcatcctcaacaggttagtaaggtctacataacttcaaaggacacaagaggttagtgtgtgatagacagccgaaggattcatggagcaggctgcacttg

SEQ ID NO: 6797698 - DNA, 65 bp, Homo sapiens
ctgtgtaaatgccccattcattgataagtcatagttgtgcttcttggatgtaggcatgtacacag

SEQ ID NO: 6797699 - DNA, 58 bp, Homo sapiens
tacttatatgaagtacagttgttaataaaaagcatttgatactgtacaactataggta

SEQ ID NO: 6797700 - DNA, 73 bp, Homo sapiens
tacagctttgggaaggccccatacctgcaagggacaaagctctagccaaatgactttcctggcaaaagttgta

SEQ ID NO: 6797701 - DNA, 83 bp, Homo sapiens
aggtaactgggtgccaatgagtatacatgtccatgcaggactttaactgcagttatggtttttattgcagtcggtgattacct

SEQ ID NO: 6797702 - DNA, 72 bp, Homo sapiens
tgtttattatctggccctaactgtctgttttatacacaaatgtatcctcagcacctaggacagtagtcagca

SEQ ID NO: 6797703 - DNA, 89 bp, Homo sapiens
gcctcagcaccccatacatctttggtaaatgaacctgaacttccagctgtcattatagagttgtattttaggaaaagtgctgttgaggc

SEQ ID NO: 6797704 - DNA, 81 bp, Homo sapiens
tgatgtgtcaatgaaagtttagaacaatgtgtagaaaaatggtacttttgaatttactttttgtctaatcggtgcacatta

SEQ ID NO: 6797705 - DNA, 59 bp, Homo sapiens
gggaagaggtgcatacagacggcaccatatctgataatagtgcttcctcaccatctccc

SEQ ID NO: 6797706 - DNA, 130 bp, Homo sapiens
atggtcatacatgtcggtgcatccccatgttagggcacatgatcacgtgtgtcggtgtgtgcccatggtagggcatatgatcacgtgtgtcggtgtgtgcccgttatggcatatgatcatgtgtgtcagt

SEQ ID NO: 6797707 - DNA, 66 bp, Homo sapiens
ttgtgcagctataaagaaatgggtattctatatttttaaatagcccattgctttttagctacataa

SEQ ID NO: 6797708 - DNA, 74 bp, Homo sapiens
attgtgcaatgccagctttaaatgcaaatttaagagcatttaactcatatgcagaaggcctgacattgcacaat

SEQ ID NO: 6797709 - DNA, 69 bp, Homo sapiens
tccagttttgaagggcacgacaatagttcagacatttgtcagtagctatgaagccacttttaacatgga

SEQ ID NO: 6797710 - DNA, 58 bp, Homo sapiens
gaaggatttgagattatcctagagagtgtctcaaagggtaatattttttaaatttttc

SEQ ID NO: 6797711 - DNA, 130 bp, Homo sapiens
ggatggttgcaagtttcaggacatgatatcttctactttgccaatcaggctgaatgtttcttatttcctttccacctgaactgtttgccagataggagatggcaaataatgaaactgatagtaactttcc

SEQ ID NO: 6797712 - DNA, 95 bp, Homo sapiens
gtgattccttccctaaagaagctgatgcagagggttcaattaactacttctgaggaaccctttgcatcagcttccttagggaagaaaagaatcac

SEQ ID NO: 6797713 - DNA, 65 bp, Homo sapiens
gtggctagaaaaatatgggtgcccatgtagcctcctggaagcacctgtatgacttttctagaagc

SEQ ID NO: 6797714 - DNA, 65 bp, Homo sapiens
tttctccttcgaggcccagctccccagtgtcccccactggagagggagcttctggaaggcaggaa

SEQ ID NO: 6797715 - DNA, 128 bp, Homo sapiens
accttcatttccaacaagctttgggagcctgtgtgtctgctcacagctaggaggaaagcagaggaaggccagttctccttactttttgcctgttgtggcccagctaacccaataaatgaaattcaggt

SEQ ID NO: 6797716 - DNA, 93 bp, Homo sapiens
ttttaaggacgtatgaatatggagtttacttagtgtaatatttgtgttacacccacaaaaaattccaaattgcagatgttttataccttaaag

SEQ ID NO: 6797717 - DNA, 61 bp, Homo sapiens
agtggtgataaccactatcatagctaccattaaattattcgttgtgactggttgtctcgct

SEQ ID NO: 6797718 - DNA, 76 bp, Homo sapiens
ttgtctctgttatttccagggtcaggttccttcatcttcaattacttagtcttaccgtgatatataacagagtcaa

SEQ ID NO: 6797719 - DNA, 59 bp, Homo sapiens
tgagagcaagaggtatatagtcagatagacccaaattttaatataacctctgttactca

SEQ ID NO: 6797720 - DNA, 98 bp, Homo sapiens
ggcaactgaatttgtaatctttagtgaccatctcattctcaccacgaggcctggagaaaaagagatggtgtacagggagagaaaagcattcagcagcc

SEQ ID NO: 6797721 - DNA, 95 bp, Homo sapiens
tgcagtgaatattctgctctcggtaaccttagaaaatcaaaattagaaggaaacttggatgtcatctggggatcagagagtgcacagagattgca

SEQ ID NO: 6797722 - DNA, 85 bp, Homo sapiens
tgaattgcctttcatagagatgaattctgcagtcttagtgggtgcaacaggattgctttttatttgctttgaattgctttgttca

SEQ ID NO: 6797723 - DNA, 79 bp, Homo sapiens
gctcttaagattatttggaggccaagaaaaatagtttgttatcaaaattttctgtcttgaccattaagaagttcagagc

SEQ ID NO: 6797724 - DNA, 57 bp, Homo sapiens
caggtggatggttgcttatggttagtatcgattctgagcaggtaggcattcatactg

SEQ ID NO: 6797725 - DNA, 83 bp, Homo sapiens
ttggaacttaaggagcttaaacttttataacttgaagcagaaatatgtgctttttacagaagtttcagcgttttaggtttcag

SEQ ID NO: 6797726 - DNA, 70 bp, Homo sapiens
agcatgcttttttaccttacatgtaaaatttggcatgtagcctattaggagaggagcaaatagatatgct

SEQ ID NO: 6797727 - DNA, 63 bp, Homo sapiens
ggggaactgggcctctggaagcctaatgaaggttctctagctacagatgagcccagtatccct

SEQ ID NO: 6797728 - DNA, 56 bp, Homo sapiens
agactgcggcagttggtgggagctttcaaaggcgctcttgaaaattgtagcagttt

SEQ ID NO: 6797729 - DNA, 81 bp, Homo sapiens
gattgaggaaattggatgaagggtacacggggcctctgctgtttttgcaacttcctgtgaatccatcattatttcaaaatc

SEQ ID NO: 6797730 - DNA, 69 bp, Homo sapiens
tgcatgtggatcagatgaatggacattttagtatttcccttgctcttcagtttgtataatccatatgca

SEQ ID NO: 6797731 - DNA, 75 bp, Homo sapiens
acatcttgcttcctttacagatgggcaaaatgaggcttagaaaaacgtgatgcttctgcagaggaagtagggggt

SEQ ID NO: 6797732 - DNA, 91 bp, Homo sapiens
atacatcatgattccattatacttctgattcaaaatcaggattacagttttctgtgtctttgcttcacaagtatggttctgactgttgtat

SEQ ID NO: 6797733 - DNA, 130 bp, Homo sapiens
gcgcattagaggcaccttgggagcttttaaaaagctagtgcctgtccctacccaaactagttaaatcagggtgagggtgggccctaggcatcaatgtttttaaaaagatccctaggtggtttaaatgtgc

SEQ ID NO: 6797734 - DNA, 73 bp, Homo sapiens
aactgcttggttttcttttcattcaagtttaattggttttcatggactgaattgaagcaggaaggcataagtt

SEQ ID NO: 6797735 - DNA, 86 bp, Homo sapiens
ggagtcctgtatgtctaataatccttagattagtgagtctcacagtgacctcctaggatctggggtgtttttaaaatgcagactcc

SEQ ID NO: 6797736 - DNA, 63 bp, Homo sapiens
cacaaggtggcaggactgagggaatctctaaggcatgtcttccaggccctgccacagcttgtg

SEQ ID NO: 6797737 - DNA, 59 bp, Homo sapiens
gaggtgaggatgggggagcagggaagtaaatctcatattcctctttgcatcctcaactc

SEQ ID NO: 6797738 - DNA, 59 bp, Homo sapiens
tgcaaggctgcctctgaggaccctggcaaggtgagagggaccacagggaaggtcttgca

SEQ ID NO: 6797739 - DNA, 76 bp, Homo sapiens
tctgctctggacactcggcagacttctttctctggaagactcagggacagatgaatgactgagtgaaagagccaga

SEQ ID NO: 6797740 - DNA, 95 bp, Homo sapiens
aggactaatgggaagagcgggtggggagggaagagttttgctttttgtgctctgctgcctttggcttctcctaccacctcttaacagcaggaact

SEQ ID NO: 6797741 - DNA, 80 bp, Homo sapiens
tcttatgatcttgaaatgacaaaggtttttcttagcatgtcacaaatgcaggagaccaagtatgtcacaaatccaggaga

SEQ ID NO: 6797742 - DNA, 79 bp, Homo sapiens
ttacttgatatcaataagtcagtgggagaagtgtgaagtcttatcttgatcagaacattctcattgactgcttaagtaa

SEQ ID NO: 6797743 - DNA, 62 bp, Homo sapiens
tgaaaccactgacacagacaaggcctgttctgccgaaaccaggccagttaagtcagggctca

SEQ ID NO: 6797744 - DNA, 56 bp, Homo sapiens
ggaatgagagtgtgtattactgtcatccataaatgagtagtacacactctaattcc

SEQ ID NO: 6797745 - DNA, 83 bp, Homo sapiens
tctgcatttaagcatttgtgttcttcctagagctcagaaccatcaagagctgatgagagagacaaatgctccttaaaggcaga

SEQ ID NO: 6797746 - DNA, 57 bp, Homo sapiens
ggcctgtgggaggacagctggggccggctccaggccccctggtccccacacagagcc

SEQ ID NO: 6797747 - DNA, 61 bp, Homo sapiens
cgtttttgtagctgtagacagtgtttgctgttggagcaagcacttgtatcttactaaaatg

SEQ ID NO: 6797748 - DNA, 120 bp, Homo sapiens
tataagcttcagctatatgaaattgtcaatatttgatcattttgacctataaaacagcaatttcatgtgggtcaacctgataaaatgtggtatggtgattcatatctatagagacttata

SEQ ID NO: 6797749 - DNA, 65 bp, Homo sapiens
tcagaaagatgtactaagggcagacacagaattccaactggagtctgctcccagacatgatctga

SEQ ID NO: 6797750 - DNA, 101 bp, Homo sapiens
aaaaaagggactaaggctggcagagacaagaagactaaactttgtattaatttgttgtatggtcattccttgttttttcagaatggactcctctctttttt

SEQ ID NO: 6797751 - DNA, 76 bp, Homo sapiens
aaaagaaaaaaaattctggcaaaattcacaagaaatggcaaattagtgaattgttgcccatgtttttatttctttt

SEQ ID NO: 6797752 - DNA, 57 bp, Homo sapiens
gtcctgtctctctgctgctgggacccagggctttttcagctgcagaacccactggac

SEQ ID NO: 6797753 - DNA, 63 bp, Homo sapiens
ttattcactcatttaacattataagcctggcacagggcatggtgtgagtcttgagctggatga

SEQ ID NO: 6797754 - DNA, 67 bp, Homo sapiens
ctggggtgtgcttgggcttcgcagggaagtcagacagaagtttgcccacgtgctccggccgcctgag

SEQ ID NO: 6797755 - DNA, 130 bp, Homo sapiens
gtttttactgcccagtttatatgtgaataaaattttagtaaaaatatgcttgtggctaaaattgaatttaatttggttgaataagatagttttatgtaattattaaagtgtataaaccagcagtaaaagc

SEQ ID NO: 6797756 - DNA, 77 bp, Homo sapiens
gagactaaaaggccaccagaccgagaagttctccaggccaccctgtggccacggggattgttgagttgtggggtttc

SEQ ID NO: 6797757 - DNA, 129 bp, Homo sapiens
agcttgggctgatgcaataacagaaactctggcctgctgtagcttttgttctgcttaaagtgcaggcagagcagagcagagcagtaattggctgtgaatgaaaggggattgtcagaatgagcctaagtt

SEQ ID NO: 6797758 - DNA, 75 bp, Homo sapiens
gtttaaccttggtcatcttccgtttcctcattatagcaatggggaaaatgcagaagattacagcaggagttaaat

SEQ ID NO: 6797759 - DNA, 62 bp, Homo sapiens
gggctgagaagttgatcccaaggttctctggcttggctcttggtttgaagttcttctagtcc

SEQ ID NO: 6797760 - DNA, 57 bp, Homo sapiens
ctaggtccctgggggctaatgtgggtcttggagccacagggccagcctgggacctgg

SEQ ID NO: 6797761 - DNA, 129 bp, Homo sapiens
gataatttcaaagtatgccaaagtttgaaacccgcttaggttagggacaggtcaatatgagagaaaatagtcatcttgatttactctaatagctttatcatttagattaaaacatacacccaatccgtt

SEQ ID NO: 6797762 - DNA, 62 bp, Homo sapiens
aacatgaaagttgctaagtgcagtgaaggttctccctgctcctttcatccaattctcatgtt

SEQ ID NO: 6797763 - DNA, 75 bp, Homo sapiens
aggtggtgggctggatttgcttgcagatcacagtttgctgatgtctgcaagtctaaactagccatgtcaattcct

SEQ ID NO: 6797764 - DNA, 57 bp, Homo sapiens
cccctagaacacgcagacactgagtcttctcaggctcacctgtgagtcctggctggg

SEQ ID NO: 6797765 - DNA, 73 bp, Homo sapiens
gaagggaaaggaatgagcttctgttaggcacccacgacacactgggtccttaaatccatcatttctaatcctc

SEQ ID NO: 6797766 - DNA, 79 bp, Homo sapiens
ctatggtgcctgagcttgggctttaggaccacactgtgtggctttactcctggatctactctcaattgggcaactatgg

SEQ ID NO: 6797767 - DNA, 60 bp, Homo sapiens
ggctttttagggagccaacactgggcttccaagagccagctgtgcttttcctaaaaggcc

SEQ ID NO: 6797768 - DNA, 97 bp, Homo sapiens
caaaaaatgggtcttaacctggagtctatgaacctctgcaatgacatgcaaaatgtcatatgtttatacttttcttgggtgaagatccctaggtttg

SEQ ID NO: 6797769 - DNA, 101 bp, Homo sapiens
atgccattaaaaatgagctgtgggcagatccatagagttctggagaatgccatgccttcttcagcagagaattatgatgtttgcaaaacagctcctggcat

SEQ ID NO: 6797770 - DNA, 67 bp, Homo sapiens
ggtattggtaggagaatattgaaattttaggcaattcttaagagctcccttctccttgcattgtacc

SEQ ID NO: 6797771 - DNA, 108 bp, Homo sapiens
actcagaaactatgggcctgttatctcatttgcctggttttatttcatatgtggatcttatgctgagatagctgactaggcatccaggcttggccacatcttctaagt

SEQ ID NO: 6797772 - DNA, 91 bp, Homo sapiens
tgtctcggcacacggtgtctcagatacgccatcaagggaagatctccggttcttgctttgttgtagtctctgagctcttgctttagagatg

SEQ ID NO: 6797773 - DNA, 72 bp, Homo sapiens
cgagactacaattcccagaatgcgcttcatgtgattaactcggggggtgctcttgggaaacgtagtccatcg

SEQ ID NO: 6797774 - DNA, 86 bp, Homo sapiens
ggaggataaaagttctgtgaggataaaaaggaaggagacataagcttatgctttttctgtaatatcttatacctttgttattctct

SEQ ID NO: 6797775 - DNA, 68 bp, Homo sapiens
gccatcacttgggacaaagcttctgctctagactgctgtcttagctcttttgctctccaagttttggt

SEQ ID NO: 6797776 - DNA, 59 bp, Homo sapiens
agtaagaggagtgggaagcctcatctgaaattcggtgggctttttagtattcctcttct

SEQ ID NO: 6797777 - DNA, 55 bp, Homo sapiens
cccacgagcccagcaggccgtcaatctgtagaaatggcttttatggagctctggg

SEQ ID NO: 6797778 - DNA, 78 bp, Homo sapiens
gctttttcctgtagcacattcttaaaatttgattattctgagtaagaaaatattcattgagaggctcaccaggattgc

SEQ ID NO: 6797779 - DNA, 88 bp, Homo sapiens
agggaaggtgggatttgagtattcacagatcactctgtaggggataccatttatagaacctgttgtgaaattcagtccagctctcctt

SEQ ID NO: 6797780 - DNA, 74 bp, Homo sapiens
gaaggggtcttgggaggagagagggtggaccctgttcccaggcactctgtttctcctgtcagccttgcctcttc

SEQ ID NO: 6797781 - DNA, 72 bp, Homo sapiens
tgggatttgtctgatgtttttctcatgactagactgtggtcatggattctggggagaaagtcacagattcca

SEQ ID NO: 6797782 - DNA, 79 bp, Homo sapiens
aatatcacagggagtgtacaccatgtgtacaccatgtcgcagggactgtataccatgtgtgcacactccctgtgatatt

SEQ ID NO: 6797783 - DNA, 97 bp, Homo sapiens
gccctgctgctgacaatgttgaagcagggtctggacaaccccttgttgagggcatttggtggccagatcttcttttcagtgtcttcagaccttgggc

SEQ ID NO: 6797784 - DNA, 65 bp, Homo sapiens
tgagattgtttgcattttgggaaatgccagtcatctctcccaaatctgcagatagcagcatctca

SEQ ID NO: 6797785 - DNA, 73 bp, Homo sapiens
ccacaagcctctcaggttggtattcatctccacatcttacagattgtgaactgaggcccagcgaggcttctgg

SEQ ID NO: 6797786 - DNA, 91 bp, Homo sapiens
gggccggtgtgtctggtcatcatccaggagtcgtggcgctcagcgttcattaccgagagcaagtgctgaccctggccgacactcacggctc

SEQ ID NO: 6797787 - DNA, 72 bp, Homo sapiens
gccaggcttacccagccctgcccagatgtggctacagtgcagggtgcaggcgggggtgggtaataggctggc

SEQ ID NO: 6797788 - DNA, 67 bp, Homo sapiens
tattccatggcaacatatgctttcatgaggtacttttgtattttctagagtatgtgttctggtagtg

SEQ ID NO: 6797789 - DNA, 69 bp, Homo sapiens
gccatcataaaccactttgtaatctgcattcaattatcttttgcagtgctctggtttttgtgaactggt

SEQ ID NO: 6797790 - DNA, 55 bp, Homo sapiens
tttatcttattccaccaccttgggatctcaccgtagtgggttggaagggaatgaa

SEQ ID NO: 6797791 - DNA, 92 bp, Homo sapiens
ggttccctattgggacagctttgttttccctgctgaacacaaaatcccctgttcactgggagagctgacaaggagaccccatggggctggcc

SEQ ID NO: 6797792 - DNA, 91 bp, Homo sapiens
ggagcccccgcggtgcagaactgacagcaggaaccattccgaggagaaagctgtcggaagttcagttgctagtttcattcgcaaatgctcc

SEQ ID NO: 6797793 - DNA, 70 bp, Homo sapiens
tataattttgcagtaaattttatttgtgggtgatggaactgtttctttcagagaaaatttgctgattata

SEQ ID NO: 6797794 - DNA, 62 bp, Homo sapiens
ttggcaggatgatagctttgtgataatgttcccaatttcttccattgttattgttctgttag

SEQ ID NO: 6797795 - DNA, 130 bp, Homo sapiens
agaaatctgaaatcaaggtgttgacagggctgtactccctcagaagactttagggaagaatcgttccttgcttcttcctggcttctggtggctcccagcagttctcgacagtccttggtttgtagctgct

SEQ ID NO: 6797796 - DNA, 87 bp, Homo sapiens
catttaacttatacaaaatcatctctgcatccttagcataaaagaataaataaacgattgagaggatgaatgaatgatagttgaatg

SEQ ID NO: 6797797 - DNA, 87 bp, Homo sapiens
cactgccaccagcaccagtacttgctacctcaattgagtatttttatgaaacacattgcaggttgcacagtgcagcttcaggccatg

SEQ ID NO: 6797798 - DNA, 60 bp, Homo sapiens
catgatggctcatgcttgtaatcccagcaatttgggaggccgaggcaggcagatcacatg

SEQ ID NO: 6797799 - DNA, 61 bp, Homo sapiens
ggtgctgaggaaaaatgtgactctaattttgctacaagaagagatacatctttcccacacc

SEQ ID NO: 6797800 - DNA, 81 bp, Homo sapiens
tgacagttttgaggagcactagtcaggtatttggtagaatatgcctctattgggatttgtctgatgtttttctcatggtta

SEQ ID NO: 6797801 - DNA, 55 bp, Homo sapiens
gagttcttagggagaacccaaggtgtgttggaacgttggagacacttgaggactt

SEQ ID NO: 6797802 - DNA, 58 bp, Homo sapiens
cctgtgccctctgcatagcagccactcccctgctgaaagcctgcagatggctcccagg

SEQ ID NO: 6797803 - DNA, 88 bp, Homo sapiens
cggcggcggtggggtgcctgactcgaaatgcggctggtgcaggccaagccacacactgtctgcttcgactcttcacctccaatccccg

SEQ ID NO: 6797804 - DNA, 58 bp, Homo sapiens
ttgagtgtactttagtcatctgatacaatttgtgtaagatttatgtggtcacactcag

SEQ ID NO: 6797805 - DNA, 63 bp, Homo sapiens
agcagtatgaaaattagcaagtttcatgttttaaaagagacaatatgaacttttcctgctgct

SEQ ID NO: 6797806 - DNA, 65 bp, Homo sapiens
attgattctcataggaccatcttttctttagcaagatacagatatttggccctttggggatcagt

SEQ ID NO: 6797807 - DNA, 130 bp, Homo sapiens
atgcttagaaacaaactacccatttttttgacatttatgaggcaattggaaattttaacactgactggatagttgttgatattacggaattgttaacctttttaatgtgtgataatggtattgttaggat

SEQ ID NO: 6797808 - DNA, 59 bp, Homo sapiens
agccaacttggaaagtcagatttaattcttctgtggttatttgactttccaggtttact

SEQ ID NO: 6797809 - DNA, 64 bp, Homo sapiens
ctgcccaagagagattttccccagctggtcctctgatgctagctagtccagaaacctctcgcag

SEQ ID NO: 6797810 - DNA, 93 bp, Homo sapiens
gtccaaaggtaaaaaagagaacataaggaatagaaattgttaagctgcaaagaaacatctctgtattttatagactaacttttctgcttgggc

SEQ ID NO: 6797811 - DNA, 72 bp, Homo sapiens
tgcctgcaaaagctctgggaatgcttatctgtgctggcagataactgctcccaggtttaaacttcaaaggca

SEQ ID NO: 6797812 - DNA, 94 bp, Homo sapiens
tcagaaaaattactagagactttctcttcactgtgtgcctcacaagctcttaatattgctgtagcacatttgaagagaagcactttctttctga

SEQ ID NO: 6797813 - DNA, 62 bp, Homo sapiens
ggcagctcctggagacttcatggcaaaccaacatattgaatgcaggaaattccagggtggcc

SEQ ID NO: 6797814 - DNA, 64 bp, Homo sapiens
ccagcttttggggtgacaatttttgccctgtaaacttcacgaaaaattagtcaaagaaagttgg

SEQ ID NO: 6797815 - DNA, 83 bp, Homo sapiens
tgatggcaggaggatatcagggggtcacctcaccagggccaggagggcctctgtgggccgggcctgctgccttcctgacctca

SEQ ID NO: 6797816 - DNA, 64 bp, Homo sapiens
agctctaggccctggggaatacaacagtggcccaaacagacatgggctctgccctcctggagct

SEQ ID NO: 6797817 - DNA, 69 bp, Homo sapiens
gttgaaagccaagagcacttcttgaagagctgcccaagtagcctctctgggaattttttggacatcagc

SEQ ID NO: 6797818 - DNA, 58 bp, Homo sapiens
aattaggggaggacgtatcatacctgctttatcaggcatgatttttctcttactggtt

SEQ ID NO: 6797819 - DNA, 61 bp, Homo sapiens
ttgctttttctttgtgtaacatttgtgctattatgaatatggcacatacagaaaagagtaa

SEQ ID NO: 6797820 - DNA, 66 bp, Homo sapiens
gaaataagcatctttggattgttcttctagggtgttctttctgccattcaactagatgattatttc

SEQ ID NO: 6797821 - DNA, 60 bp, Homo sapiens
acttatacgttctccatcaaggatatacgatttctgttaggagatggaaagtgtatgagt

SEQ ID NO: 6797822 - DNA, 65 bp, Homo sapiens
ggcctgctggggtcagagcactgggggtgtccccacaccctactgctgaggtccccggcactgcc

SEQ ID NO: 6797823 - DNA, 64 bp, Homo sapiens
ctgggtgtgtgaagacaagatatattgcagctgaaaaaggctgggagggtctttattcacttag

SEQ ID NO: 6797824 - DNA, 72 bp, Homo sapiens
tgcagcgccttcacaaggacagtatatgtatcctggcatgtgcaaatccaatgtgaatgcaaaggctttgca

SEQ ID NO: 6797825 - DNA, 123 bp, Homo sapiens
gtgtttaggctcgatttcatagacactggacaggttgagtaggaggagaccggattagctttaattgactcttcattttcgacctgctcacaggcttttaaaacataaatcaaccctcagcac

SEQ ID NO: 6797826 - DNA, 70 bp, Homo sapiens
ttactgaacgtagaggaagtagttttcacagtttatggtgaaaataatttctgagtctatggctatgtag

SEQ ID NO: 6797827 - DNA, 56 bp, Homo sapiens
ggtgacgtgtctgttagacttccgactcaaccttgcctctaacagaagtgtcgtcc

SEQ ID NO: 6797828 - DNA, 58 bp, Homo sapiens
cttccagtccatatgccataattctttcaaactctgggaagaatgctgtggttggaag

SEQ ID NO: 6797829 - DNA, 105 bp, Homo sapiens
gggatcattcacactttctgtattccatttggaattccatttctgcatttaaatttatttaagcagatgaatcccagataaagtagaagcctttggatgcagccc

SEQ ID NO: 6797830 - DNA, 55 bp, Homo sapiens
ggccgccccctgtgagcccgatcatgtgctttttgggcttaggtcggaggcggcc

SEQ ID NO: 6797831 - DNA, 59 bp, Homo sapiens
ggacataggacttagaactggaagacatgatttgccttcctgctttgagttctgacccc

SEQ ID NO: 6797832 - DNA, 127 bp, Homo sapiens
tgttgtctgaggtcagtttccctgggcaacagattctgagctggtgttttacgtgcagaaaaattgctgagatgtgccttcaggatcaacacctatggaagagtgaacaaagaatgatcaggcagca

SEQ ID NO: 6797833 - DNA, 57 bp, Homo sapiens
gaaggatggccacagcgctggttcctgtccctctgggtctcaggctgggcctccttc

SEQ ID NO: 6797834 - DNA, 78 bp, Homo sapiens
ttgctgttgttacccagtgctgtggagggagatgatttggcatggactcccatttgcaagctgggtaacctgaggcaa

SEQ ID NO: 6797835 - DNA, 93 bp, Homo sapiens
agggatttcaggactcactatgcccattggttgtcatggcaggagggtcagagatcctgttgtcagagaccagtcatgaccctgaatctccct

SEQ ID NO: 6797836 - DNA, 58 bp, Homo sapiens
aaatggtcactatgtaaggtgatgaatatattaattatcatgattgtggtgactattt

SEQ ID NO: 6797837 - DNA, 59 bp, Homo sapiens
tccatacatacatatgcagaaaagaatgaggaacttctctttggatatgtatggataga

SEQ ID NO: 6797838 - DNA, 74 bp, Homo sapiens
tacagcttggagaagagtatgtcataggttcagattttatacctatagttttgtattctgtctccagttttgta

SEQ ID NO: 6797839 - DNA, 56 bp, Homo sapiens
tgactgaacctgatccaatatttactcctggaaagagggcaaaggggcaggtgtca

SEQ ID NO: 6797840 - DNA, 107 bp, Homo sapiens
cagctctcgaaatcttcaatagggtgctttaccttgcagggaatattatcattggcttttgatacaatttctgctgcagggaaagactttcaaagctcagaatgctg

SEQ ID NO: 6797841 - DNA, 55 bp, Homo sapiens
tcaaaattctagggagaatggtttccaacataggattcaactcccagagtcttga

SEQ ID NO: 6797842 - DNA, 83 bp, Homo sapiens
ccaaaatgactcggattaagggcaagtgccagtgatgggtagaaataacgttatccttcatgcctgtaatcccagcactttgg

SEQ ID NO: 6797843 - DNA, 67 bp, Homo sapiens
ttgtattagatttaagaccctgaatttgggggctcaagcctcattaaatttcttgattcttatgtga

SEQ ID NO: 6797844 - DNA, 72 bp, Homo sapiens
atatagattccatggttcctttacaggcctatagaaacagaatgtgtagggcttgaaccctggaatctgtat

SEQ ID NO: 6797845 - DNA, 58 bp, Homo sapiens
tgataatatctggtttattcaccctcttctgcagggaatgaagaaatagatggtgtca

SEQ ID NO: 6797846 - DNA, 87 bp, Homo sapiens
ttaatcaatatttcattgacactgatcttcataatgtagacctcagaataatttgtgaggcattaaagggaggtcaaatttgattaa

SEQ ID NO: 6797847 - DNA, 73 bp, Homo sapiens
cgcatggagctggaggccttgcctgcaggcacaggaacctgctgctagtggagagccttgagggttccaagtg

SEQ ID NO: 6797848 - DNA, 88 bp, Homo sapiens
ggagaattgcttgaaccctggaggcaaaggttgcagtgagtcaagatggcaccactgcactccagcctgggtgacagagcaagactct

SEQ ID NO: 6797849 - DNA, 118 bp, Homo sapiens
tgtttaatctttagaaactccccttgcatgaaagttttcctggtcacagcttggcaggtggtttgttggctgtaaggacggaaaaaacagggcttgaggcatatcaacaaagagaaca

SEQ ID NO: 6797850 - DNA, 71 bp, Homo sapiens
gattttcctgagggcattttggtgactaaatccagggatttagactcaggtacctttcaggaatacaagtc

SEQ ID NO: 6797851 - DNA, 57 bp, Homo sapiens
cactggagtttgccctagcttctgtctgcttttactggatcctgggtcctccagctg

SEQ ID NO: 6797852 - DNA, 93 bp, Homo sapiens
aaggaagctggtcctaagagattaagtcacttggtcagggtctcttggtgaggtacttaagtgaaattggttttccaggtgctggtcttcctt

SEQ ID NO: 6797853 - DNA, 69 bp, Homo sapiens
gatatcaatgttatttctgatctagttgtgacatttaaagttccggcttcatgagaaatgacagatgtt

SEQ ID NO: 6797854 - DNA, 59 bp, Homo sapiens
cccctgtccttggatgctctatgcaaggtccattaaagtacaggagatctggcagaggg

SEQ ID NO: 6797855 - DNA, 65 bp, Homo sapiens
ttcatatctacccttaagatggtcttccttatctggaaaaaggctggagcaagggggcatatgga

SEQ ID NO: 6797856 - DNA, 97 bp, Homo sapiens
atactgcattaaataagttcttcattcagggatagcagaataagtaggttatatattaatttgtttatcttaaatccactgggttttaatggagtat

SEQ ID NO: 6797857 - DNA, 68 bp, Homo sapiens
ggtttgtggctatggttatgtctataagtgcaggggaagccttgcagaagtattccaggccccaaacc

SEQ ID NO: 6797858 - DNA, 87 bp, Homo sapiens
aaaatatctgctcatacgcatatgatagtaatggcttttccacatcttaagccattgagttttatgtgctatccatagagatgtttt

SEQ ID NO: 6797859 - DNA, 59 bp, Homo sapiens
agatacacagccctgccatcaccttgatttcagtccagtgaaacacaggttgtgtttct

SEQ ID NO: 6797860 - DNA, 68 bp, Homo sapiens
tgcagattaccttggctgaagaaaactgtctttcccgagatcaggccctcttccaggtacagtctgca

SEQ ID NO: 6797861 - DNA, 70 bp, Homo sapiens
cagggaagtgggtggattttaatgctatggattaagtgtctatattatcataaaaccattcaatattttg

SEQ ID NO: 6797862 - DNA, 64 bp, Homo sapiens
gtgactgtttttaggaggagtaggttttttaaaataagggctttctttttaataaaactgtcat

SEQ ID NO: 6797863 - DNA, 102 bp, Homo sapiens
tatcttttcctcctaagaacactatgattataataaaaccgtcatatatctgtggacactcctaatatttgcaggcttttgtcatggtggggggaaaagatg

SEQ ID NO: 6797864 - DNA, 84 bp, Homo sapiens
gagtgatacccagcccatcacaacagagatggctaggtttctaaagccaatttctgcctgagggctttgtggtttaatcatctc

SEQ ID NO: 6797865 - DNA, 84 bp, Homo sapiens
tctatccagcacagaactggagtcatgacggttggaggtaggtaatctcacagctgttttctccaggcagtgtgaccaagtaga

SEQ ID NO: 6797866 - DNA, 83 bp, Homo sapiens
gagatttaaggaactggcttacatgattgttgtgtgtctatcaagttcaaactctgtaggacagttcaacagacttgaaactc

SEQ ID NO: 6797867 - DNA, 70 bp, Homo sapiens
ttgagatgatatgggaagaagcagtgttatttatttaagtacagcattgcattttcctttgtcctttcaa

SEQ ID NO: 6797868 - DNA, 61 bp, Homo sapiens
taggcaatgtctcttgcttccaggtgagctcatagccctggtcgttttgggtacttgcctg

SEQ ID NO: 6797869 - DNA, 65 bp, Homo sapiens
ctgcactgtgtattccttggcttatgtctccttcttccatcttgaaagccagcagcacagtgtag

SEQ ID NO: 6797870 - DNA, 84 bp, Homo sapiens
ctagaggagcaggagaacaaagcaagctgccccagaccacccggctttcgcagaacccagatgatgctcctgtctccccctaag

SEQ ID NO: 6797871 - DNA, 62 bp, Homo sapiens
taaacatgtcatcccaaaagcaagagagtacctccctaattctcttctgggtgttatgttta

SEQ ID NO: 6797872 - DNA, 59 bp, Homo sapiens
cattcagtttaattccatttattattctttaaggatacatacatggagataaagtgatg

SEQ ID NO: 6797873 - DNA, 87 bp, Homo sapiens
ttggggcatggtgttgggtttcttatactatattgtcatctggacccaatccagtaattcaagaaataagatctagctcatccctaa

SEQ ID NO: 6797874 - DNA, 90 bp, Homo sapiens
ctgtctgtcatggtgaataccaaaccagaagctcgcaccacgggattcgatgccttgtgcctggcttgtattcacaggcaaggcagacag

SEQ ID NO: 6797875 - DNA, 79 bp, Homo sapiens
tcgtagtcactggtgtgagaggagcaaagccaccattccctttacaggttgttgctcttcatacatcaatgaattaaga

SEQ ID NO: 6797876 - DNA, 114 bp, Homo sapiens
gtgtgtgtgcatgtaaatgcccatctgtgcagctaagtgtaagtgccaggtgccctttggtgcactctcctgttcatttgtatttgtctttgctaagtttacattcatgcacat

SEQ ID NO: 6797877 - DNA, 62 bp, Homo sapiens
gagtaggatggtgcagagttggtgagattcactccgggtgtgagatctgcctgcaccctctc

SEQ ID NO: 6797878 - DNA, 70 bp, Homo sapiens
tggaatgaagctggaagttaggtagactctatccttcctggtgtttcctccaactctccagcttatgcca

SEQ ID NO: 6797879 - DNA, 71 bp, Homo sapiens
gtccttgagaggtctgttagcatgttgactattgactattcaatattagcattataataacttacaatgat

SEQ ID NO: 6797880 - DNA, 71 bp, Homo sapiens
gtggtgaggtaactgcctaaaactgtaggtgagtgcattagagttttatcattgccttaacaaatcaccac

SEQ ID NO: 6797881 - DNA, 77 bp, Homo sapiens
gtaaaactgggtaaatatagatagctggattgtattaatatcaatatcctggctgtaacattttgccatagttttgc

SEQ ID NO: 6797882 - DNA, 66 bp, Homo sapiens
tagagaaataagaggatatttggccagaagaatgtatttctctgcagtgtgttttccttaactctg

SEQ ID NO: 6797883 - DNA, 86 bp, Homo sapiens
actccatgggttagcttgagtggttcctcagttgactgtttttacaattacacagggatcactttttaaaactaaactgtgagagt

SEQ ID NO: 6797884 - DNA, 57 bp, Homo sapiens
gttgtgttcttgttgtgaagctcattggactttgacttcataaactcagaaggcagc

SEQ ID NO: 6797885 - DNA, 56 bp, Homo sapiens
ggaagaaaatgggcaacaggtggctatcagtggtctccttgtggttattttgttct

SEQ ID NO: 6797886 - DNA, 64 bp, Homo sapiens
gcccagcttctgagcaagccaggggcctggatggaggggcccgtggctgtgggggaagaggggc

SEQ ID NO: 6797887 - DNA, 65 bp, Homo sapiens
taatgctgatctgtaataagattttatgtattttacttctgaaaattccttgcagataggtattg

SEQ ID NO: 6797888 - DNA, 119 bp, Homo sapiens
aggaccagaggtgtgtgtctgcaccgcgagctccacagcagaccctgcactcactgtcaggtaagcaaaaccagagagagacagggttgtggtgccgtgatgctgcactacccttacct

SEQ ID NO: 6797889 - DNA, 98 bp, Homo sapiens
gggacttgttcacgtagacatgattgaccatctgctgggctgaccttggtcaccagcacttccagaggtcaggttgatactgtgtggttcaaagtccc

SEQ ID NO: 6797890 - DNA, 80 bp, Homo sapiens
gtgtgatgaaaagtcattgtggtatgttcttttaataggaataagagagataatagttacaaagactttttaaacaacat

SEQ ID NO: 6797891 - DNA, 87 bp, Homo sapiens
tctgagttgtgactctctggagatggttctcaattggttctcttgccagttctgacaatatctccatggcccattccacaactcaga

SEQ ID NO: 6797892 - DNA, 74 bp, Homo sapiens
tcgcctctttgaagaccttatctctaaatagcactacagtctgtgctactggggattggttcttcaacatgtga

SEQ ID NO: 6797893 - DNA, 70 bp, Homo sapiens
gttttagaggctgttgtctgttctaggcttaatatatggggtagaacttcttacagctaagttttgaaac

SEQ ID NO: 6797894 - DNA, 61 bp, Homo sapiens
gagtgggtaggcctctggtgcctgcagagcctcatgtaactggcatcaggactacccagtt

SEQ ID NO: 6797895 - DNA, 67 bp, Homo sapiens
gcaaatctgctccagattaggcaagcccctgactgctgtttctaaagggagcagattataatattgc

SEQ ID NO: 6797896 - DNA, 74 bp, Homo sapiens
ggcattaaaggatcaagtggattttcttagcataaaaatatgctgagcgtgcctgttggtttacctataatgtc

SEQ ID NO: 6797897 - DNA, 58 bp, Homo sapiens
ggtgtggcagcagatcagactgaaaaccaagcaggtgaaagtcttcatctgccaggcc

SEQ ID NO: 6797898 - DNA, 86 bp, Homo sapiens
tgttgtgtgtgtgtgtgcatgcatgtgtgaaagtctggcagttctctgtattcagggacatatatgtatgtatgcatcggatggca

SEQ ID NO: 6797899 - DNA, 63 bp, Homo sapiens
gctttagactgagtggtccattattgtagttagtgtactgcaaatgcccatttattttctggc

SEQ ID NO: 6797900 - DNA, 130 bp, Homo sapiens
ggtcaggccaaaatgtgcatgctggctgacccccctgaagctaggtcaaaaaagggcctggggaaatgaagcagtctttgatgacctacttcaggcagccagtgtgcagagccaaacaacaggccagatt

SEQ ID NO: 6797901 - DNA, 106 bp, Homo sapiens
aaaaattccacatggttcacaacactttttatatattgtatctttggctaataggtatatgtttgtgagtagtgtatgtctgtgtgcttccatatctggaattttt

SEQ ID NO: 6797902 - DNA, 75 bp, Homo sapiens
gtcacagtggtgctgagaacacagtggggtctcaataatcatttatcgactggcattccagcactataatggaac

SEQ ID NO: 6797903 - DNA, 75 bp, Homo sapiens
gtaccttgtgcacctactctatcctttctttgtctaagccccttcctagaaaaaatacagaaggtggcaaagtac

SEQ ID NO: 6797904 - DNA, 121 bp, Homo sapiens
tctcctgtcatttgagattcaagactattgtgagtgtgtctttgaagaagtagatcaataactctcttcctagttacatatgcacaaagaacctgggatgaattcagagtgactttggaga

SEQ ID NO: 6797905 - DNA, 90 bp, Homo sapiens
gagtagctacagccatgttttatgtaaatataaattgaattcctgcagcaggcaggtcactgtatttgctgatgcataatgagggtgctc

SEQ ID NO: 6797906 - DNA, 55 bp, Homo sapiens
cttggggaagccactgatccctggccctagagggccagatcgggggcgccccaag

SEQ ID NO: 6797907 - DNA, 67 bp, Homo sapiens
ctccatctccaaaagagattaataagataaataaaagtttatttgccagaatttctcttggggagag

SEQ ID NO: 6797908 - DNA, 67 bp, Homo sapiens
gaatgtacagtgataagagggcagaagtcacaggacagactctgaatcttaataattgtgtgtattc

SEQ ID NO: 6797909 - DNA, 60 bp, Homo sapiens
atttgtcaatacacttcttccaagtttaaaagccagtcattggagggattgttggcaaat

SEQ ID NO: 6797910 - DNA, 80 bp, Homo sapiens
tggattactatgaagaatgttggccatttgtgtgttggggagatttcagcccactctggtaactttcagcatggtgacca

SEQ ID NO: 6797911 - DNA, 77 bp, Homo sapiens
tcctttctcatgatgaggatcctaagtgtttcgccccatgtgagtgacatttaaagacccacccttgtgtgagagga

SEQ ID NO: 6797912 - DNA, 106 bp, Homo sapiens
tggtgatggatgaactgggatgaatgagagattggatatgtgactcaggatcatcctctgaggagaatctatcccagtttaactcatttgatccaggcaattacca

SEQ ID NO: 6797913 - DNA, 58 bp, Homo sapiens
cagcgccattattgtctccattttacagattgaaaaatggaggcacgcagtggttatg

SEQ ID NO: 6797914 - DNA, 84 bp, Homo sapiens
gtattaggttggtgcaaatgtaattgctattttggtcctactttaatggcaaaaactgcaattacttttgcaccaacctaatac

SEQ ID NO: 6797915 - DNA, 66 bp, Homo sapiens
ggcatctctgtgtgtgtgaatcccccatggctagggaggactttcaaacacagacagcagcatgcc

SEQ ID NO: 6797916 - DNA, 124 bp, Homo sapiens
gtgctacttaatcttaaaagcaaaattaaacattggactggtttacatttcaagctacaatatggaaccattgtatttggaggaatgagtttaatatgcattgtaaaataaaattagggggtac

SEQ ID NO: 6797917 - DNA, 75 bp, Homo sapiens
tattcccaggatgcttttaagtgccccatgcaaatgtattctcagcatgtccactttgtcagtgtcataggaata

SEQ ID NO: 6797918 - DNA, 68 bp, Homo sapiens
aggaggcctacgcacatgtctaaattgagcttcctttttacctgctagacaagttctgtgggtcacct

SEQ ID NO: 6797919 - DNA, 77 bp, Homo sapiens
tcaatttctcaccagttcctgaacatttctaagttgaaattattttagagtagttattcatggggcttgcaaattga

SEQ ID NO: 6797920 - DNA, 74 bp, Homo sapiens
gtaagtaggacgggtgtccctatgtccattttatacctgggaaagtgaagcaataatacatgtgtcttccttac

SEQ ID NO: 6797921 - DNA, 66 bp, Homo sapiens
ggcacaggagaggttaatgggggcctgaaagcaccacccctggaccatcagctaaccttcttggcc

SEQ ID NO: 6797922 - DNA, 74 bp, Homo sapiens
gtggagctgaaggggtgggctcagcggccagatgggccggttcgattctgggctccactacttgctaactccac

SEQ ID NO: 6797923 - DNA, 94 bp, Homo sapiens
gtgatttgcataatttattcccgtctctgggctctgattggtcacaccttgctgacgccggaaccgagactggagaaagtttgaatgaaagcgc

SEQ ID NO: 6797924 - DNA, 56 bp, Homo sapiens
ctgcttttcccctcacagcatttgccagtttgtaagctgtgcaggattgaaagcag

SEQ ID NO: 6797925 - DNA, 61 bp, Homo sapiens
ttcttacagccctattactaaatctgcaggtaacagcagtgatagagtaatactgtaagga

SEQ ID NO: 6797926 - DNA, 87 bp, Homo sapiens
ccgactttgcagccgcgccgcgcgttgattttctgtttcccagtcagagtgggaaccgagaaaggaagcgcgcgggcgggaagaagg

SEQ ID NO: 6797927 - DNA, 112 bp, Homo sapiens
gccctgtgggagaggctagtgggagggtgggcaaggccagagcgtgtcctgcctccatgtggagggagatacgggaagctggtaagtctccctgccaacctctccttggggt

SEQ ID NO: 6797928 - DNA, 59 bp, Homo sapiens
gaggttgtggctgagctgtgtttaggaaactggtgcactgagcaccagccacagatttc

SEQ ID NO: 6797929 - DNA, 76 bp, Homo sapiens
ggcccttcttggccctggcacacccccacggaggtctcactgtgtggggcagctagccggcctggccatcaaggtc

SEQ ID NO: 6797930 - DNA, 75 bp, Homo sapiens
tcctgacagttaaatagatttctaacagtgtgcttgtaatgatcaaatggcaagtgaacttagaggtcttaagga

SEQ ID NO: 6797931 - DNA, 71 bp, Homo sapiens
gccgctgccacctcctgccctgcccactgggggtccaggcctcaggaggtccgcccgggaggggcagaggc

SEQ ID NO: 6797932 - DNA, 85 bp, Homo sapiens
cctcacatttcctgcttccctgatgtcaagaagaggtcttgggacctttcacggtatcagacatctaggggcagaggggtagagg

SEQ ID NO: 6797933 - DNA, 65 bp, Homo sapiens
cccaaaattcatatgttgaaatgctagctccaaatgggatggtattaggaggtggagcctttggg

SEQ ID NO: 6797934 - DNA, 57 bp, Homo sapiens
gacatgatgcttggaactacatggactattttgttactatgaggagatgcatcagtc

SEQ ID NO: 6797935 - DNA, 106 bp, Homo sapiens
tgaagcttggcctgcccaacatttagcaagatgccctggctttctactaaaaggaacttgccttatcttttaaattaaaattgtggcatatgaatagccagctaca

SEQ ID NO: 6797936 - DNA, 101 bp, Homo sapiens
cttggtaggctcttgtgaactgacatctgccagtttggtcgtggaaaatttgatgattcttttggatagatgatggtatgaagttaggtaagccatccaag

SEQ ID NO: 6797937 - DNA, 72 bp, Homo sapiens
ttttcctgcctgaaccctgactacttagataatatcccattttacaaatgtcaggaagttgaggcgtagaga

SEQ ID NO: 6797938 - DNA, 55 bp, Homo sapiens
ggcagtgtactaaagatcactccagcccatttattggatgatttagtaagctgcc

SEQ ID NO: 6797939 - DNA, 108 bp, Homo sapiens
ttataaggattgagtgtggcacaaagagttcgatttttagtatttaaattgagtaggaaactcaaatacagaagatcctttcctgggtcacacctttggtttttttaa

SEQ ID NO: 6797940 - DNA, 99 bp, Homo sapiens
gggtaatgatttattcgggtgattatgcttagtctgctgaacctctgtacttaatttcttttgctgcagcaggctgagtattaccctagtccactgccc

SEQ ID NO: 6797941 - DNA, 122 bp, Homo sapiens
ataaaatagtaatttgataaggcaagcttttcattttgtgaagtaatttgttcattatatatttggcttaaagatagaattacataataaaatgagagctagatcagaaattaacattttat

SEQ ID NO: 6797942 - DNA, 129 bp, Homo sapiens
ttaaatatacttcaagggagaataggtcaatggaatgcagacatgggagagttgaggaatgcaacgttttaagactcccgatgctgcattttccccactaagtatgattcatgcttccttcaagaacag

SEQ ID NO: 6797943 - DNA, 68 bp, Homo sapiens
gaacccatatcttgtaataggtccacttgttaaattcctggcttatggtctagaacaggattttgttc

SEQ ID NO: 6797944 - DNA, 58 bp, Homo sapiens
tctctccacccaccatccagattctctttttctgggatatgtttaggtgttggagaga

SEQ ID NO: 6797945 - DNA, 55 bp, Homo sapiens
ttgtccaagggtgcacaactagtaagtggtggtgctggaatttgtaccctggcag

SEQ ID NO: 6797946 - DNA, 71 bp, Homo sapiens
gtgtggcactctgggttcttctcctttgctgggcccctgggcaggcatggtgagaactcagcctgtcatgt

SEQ ID NO: 6797947 - DNA, 81 bp, Homo sapiens
gcagcaaggaatctgtccagtcatctcgggatgtccttgaggaccaaaggaaatctgggctggcacaggttgatttgtagc

SEQ ID NO: 6797948 - DNA, 90 bp, Homo sapiens
ccacctcttccccaccaccttcaagattgtgggtcaatgggataatcaggtcctgcatccgttctctgaaggtcaggaatatggacgtgg

SEQ ID NO: 6797949 - DNA, 57 bp, Homo sapiens
ggcaccagcaggcaccgatgccagctggttggcatccaggtagagcttgcgggtgtc

SEQ ID NO: 6797950 - DNA, 127 bp, Homo sapiens
tgcatatgttgggctttgggctagatactgagttctcagacatgtaatctctaccaattccaagagagaaggtatctgattttattctgtgtgtcagttaatttatctcaaatgtttaattagagca

SEQ ID NO: 6797951 - DNA, 82 bp, Homo sapiens
gataggagctcatgctgcaggcccaggcaggcaggtgctctgaatgcctagaaatctgcctgggtgtggagcagagagggtt

SEQ ID NO: 6797952 - DNA, 65 bp, Homo sapiens
tcaacagtggcatctacttaatctggactcttttggttgtagtgggtaagtggagtcatttggga

SEQ ID NO: 6797953 - DNA, 59 bp, Homo sapiens
agaattcctctaggatctgcccctttcttgttctccaggcagtatgccttggacattct

SEQ ID NO: 6797954 - DNA, 58 bp, Homo sapiens
gtgatcttttaggtcacacagctaatgctttgtaaagcatttcctaaatccagatcgc

SEQ ID NO: 6797955 - DNA, 60 bp, Homo sapiens
ttgcatcaggtagacaactataatgatataagtaagcaatagttgagaacctgacagcaa

SEQ ID NO: 6797956 - DNA, 61 bp, Homo sapiens
tggccaggcaggtagaacggccctgcaccccatttccagggccttcagcaggtctggacca

SEQ ID NO: 6797957 - DNA, 59 bp, Homo sapiens
tttcccaggcaaggacatgaaactgaggaagagaattcaccacctacttgcctgggagg

SEQ ID NO: 6797958 - DNA, 87 bp, Homo sapiens
cagcactcagaccgcaggctggctccctgaaggttcacctcacagcggctctcctggatcttcagccagcaggtgcccttggtgctg

SEQ ID NO: 6797959 - DNA, 63 bp, Homo sapiens
tttttggcaagatctggggcagagggcagttttaatcttgcttcagtttcagtcttgcaaaaa

SEQ ID NO: 6797960 - DNA, 56 bp, Homo sapiens
gcagagtggtttcagagttgagagtaaattaagtctcttgattcttgctacattgc

SEQ ID NO: 6797961 - DNA, 63 bp, Homo sapiens
tggaagcctcattgacctccactgagactgtaacagcatattggagagcaatgaaggcactca

SEQ ID NO: 6797962 - DNA, 85 bp, Homo sapiens
ccaggtcctgcaggggcagtccacttccttcatagagtctgtggatcctcttgggattgctggtttgttcttgcagtcgatctgg

SEQ ID NO: 6797963 - DNA, 60 bp, Homo sapiens
gtctggaccttggactccttaatggtacttactagaagggagctctttggtcttgccgac

SEQ ID NO: 6797964 - DNA, 73 bp, Homo sapiens
gaaatgatgactgtcttctgatgtaatcagctaaccaacacaaagatgaataacacaacaggcagtcattttc

SEQ ID NO: 6797965 - DNA, 68 bp, Homo sapiens
gttttttatgatctttataacctatcttcttcctaagtagaggagaggtatatgaaggcaatgaaaac

SEQ ID NO: 6797966 - DNA, 85 bp, Homo sapiens
gcaaaagccagatattattgatgatttagtgtgttggctgggctgtaacgaaacatctatgatcattaattgctggtgggagtgc

SEQ ID NO: 6797967 - DNA, 55 bp, Homo sapiens
ccttgcatgagtgtgccccttttatatgtagcatgagggaagtgcgccatcaggg

SEQ ID NO: 6797968 - DNA, 56 bp, Homo sapiens
taggatgaaagtgactgtcaggtaaagaagcatcttccagtgattaattcatctta

SEQ ID NO: 6797969 - DNA, 62 bp, Homo sapiens
ttccatctgactgccctgagatccagcactttttgcttccacatctgaggctgtcgctggaa

SEQ ID NO: 6797970 - DNA, 58 bp, Homo sapiens
gcagcctgtgcaaaagcttggtttgtccaaataaagagaaggagaatgacacggctgc

SEQ ID NO: 6797971 - DNA, 88 bp, Homo sapiens
cagtatttataatcttgcccatcttccagagcatttattcaacaaatattaatgagcatctatgtgctgggtactgtggtaagtgctg

SEQ ID NO: 6797972 - DNA, 57 bp, Homo sapiens
gggcatgtgatctttcaggcaaatcaaccaaagtaatgctggaatgagaacatgccc

SEQ ID NO: 6797973 - DNA, 100 bp, Homo sapiens
tgaacttgcagcttggttctcagcttccagtaactcttgaaaggcaattccatgaccttgggaccctgctggaggttacaaatcccaagttcaagattca

SEQ ID NO: 6797974 - DNA, 56 bp, Homo sapiens
gtgtggctgtgggagatgttcatgctatacaaaatgcccaaatgcccatgccacac

SEQ ID NO: 6797975 - DNA, 128 bp, Homo sapiens
gtgtctgtgtttctctgctcttctctgtatttaagggtgtctgcctctttctttctgggtctctgacttgtgaattaaaaggtagtagttagaagtgcagtgtctgagtagggcatggtggtgtgcac

SEQ ID NO: 6797976 - DNA, 82 bp, Homo sapiens
cacactaggtacatattaggatggcttgtataccttcatttaggaggtgtacaagaataattttatatatgtcatacaggtg

SEQ ID NO: 6797977 - DNA, 63 bp, Homo sapiens
taacagctggcgttataggaatcagacagacttgcctttgaatccctgctgcaccacttgtta

SEQ ID NO: 6797978 - DNA, 102 bp, Homo sapiens
aattcttgagggggcaggctctggcttattctgggcaactgacttcaagtgggacccctgagctacctatgtaagcaaagagtcagccatctctggagagtt

SEQ ID NO: 6797979 - DNA, 78 bp, Homo sapiens
ttcagactcatacaactaagagtttcagaatctctcaggaacatgatgttgtgaatgtctaggttttatgtcattgaa

SEQ ID NO: 6797980 - DNA, 83 bp, Homo sapiens
agtctttcagttttcaatttcatcagaggtgatgcttcataatttgaacttttgatgctgaaaattgaactgaaaatgagact

SEQ ID NO: 6797981 - DNA, 57 bp, Homo sapiens
ggtcatgcgagcaatagggagcagctgtaaatacagaagaagcttcgctcgcttgcc

SEQ ID NO: 6797982 - DNA, 62 bp, Homo sapiens
gagtgcaggcctgagcaccatctgcaacaatgacaagctcttacttgctcaggtcttcattc

SEQ ID NO: 6797983 - DNA, 65 bp, Homo sapiens
gctctggcccctatggtggtggaggccaatactttgcccaaccacgaaaccaaggtggccgtggc

SEQ ID NO: 6797984 - DNA, 76 bp, Homo sapiens
tttcatagttgtttttctggggttacttagaatttgagagtccgtgagaagcattaggaagaacattactgagaaa

SEQ ID NO: 6797985 - DNA, 80 bp, Homo sapiens
taggcttactacatcttgcatatctataaccactctggaggaatttggaggagtaaggagtgtgtggatgtatatgtctg

SEQ ID NO: 6797986 - DNA, 91 bp, Homo sapiens
atgactgaggggtgatgctcaactatcaataacagcaacaatgtcagctgtcctttctatgtgtattgagcattgttaccactaatgtcat

SEQ ID NO: 6797987 - DNA, 56 bp, Homo sapiens
ttcctatggccagagtcaaagagaaagtctattgtattcatttggccatactggaa

SEQ ID NO: 6797988 - DNA, 72 bp, Homo sapiens
gcttgaacccaggaggcagagatagcagtgagccgagatcgcgccactgcactccagcctgggtgacagagc

SEQ ID NO: 6797989 - DNA, 103 bp, Homo sapiens
ggaggaagaaaaaggaagtgctcagggagcatagtgaatttacctgctcgtgagcaataaatcttacttatgatttttcggtgttatctgtttttcttctttt

SEQ ID NO: 6797990 - DNA, 60 bp, Homo sapiens
cagatcactgatgaagttagacctagtctagaaattaattagggcatattcagtggtctg

SEQ ID NO: 6797991 - DNA, 97 bp, Homo sapiens
ttctggccccaacaatatataagctgatgagccacagtgatatataaaacctgtcaaccaagtatttgtgaatcagctgtatagattgttggcagga

SEQ ID NO: 6797992 - DNA, 82 bp, Homo sapiens
aggccagaaatttggagtatgtggcttctccacctcacacaatttgccctaactttaatatatactcagaaattactggctt

SEQ ID NO: 6797993 - DNA, 57 bp, Homo sapiens
caggtggcagaggtctctggaacctcactccctgttccctcaatctctccccacctg

SEQ ID NO: 6797994 - DNA, 76 bp, Homo sapiens
tatggtaattccccagtgggatccacaatgctagaaacacagtagataattaatggatcagctggagaacattatg

SEQ ID NO: 6797995 - DNA, 80 bp, Homo sapiens
gttcccctaaatctggagagtcatctctgacacgttaaatgtagacagtcaggccaatactctccagcacctaggagagc

SEQ ID NO: 6797996 - DNA, 74 bp, Homo sapiens
gggttccaggtgtcccaatgttcaggacggcttcagccaggggcctgacctctgcttggcggcacttggagctt

SEQ ID NO: 6797997 - DNA, 62 bp, Homo sapiens
ttagtcacatgcccatctctgaaccagctgctgagtccaaggagatggggcagtgtgactgg

SEQ ID NO: 6797998 - DNA, 97 bp, Homo sapiens
gaggcaggagaatcgcttgatcctgggaggcggaagttgcagtgagccgagatcgtgccactgtactccagcctgcgacagggcaagactccgtctc

SEQ ID NO: 6797999 - DNA, 57 bp, Homo sapiens
ttcctggtgacctcactggtaggctgggctgggagtggttggtgacgttgccaggga

SEQ ID NO: 6798000 - DNA, 83 bp, Homo sapiens
caacatgtgttgccaaattggccttgatctctctaactgctgtggaatagctctgagattcgtgggtctcttgagacatgttg

SEQ ID NO: 6798001 - DNA, 64 bp, Homo sapiens
gggcaagtccggtgcccagagcacagtccagtgtctcctcaatttcttgggcccggcttgcgcc

SEQ ID NO: 6798002 - DNA, 56 bp, Homo sapiens
tatgttgtttttctttagtggagctactattgagcctcacagatgattgacacata

SEQ ID NO: 6798003 - DNA, 70 bp, Homo sapiens
ccacatacaatcaagttctttattagagacaaagactgttacatgaattgaaaggactggttgtaaatgg

SEQ ID NO: 6798004 - DNA, 85 bp, Homo sapiens
tatgaatgtgggttgagacctttgtattatgtgaatatcttgtttgacaaactttttcacttaaaggttttagcatccattgatg

SEQ ID NO: 6798005 - DNA, 83 bp, Homo sapiens
gccttctcctgctgtgggttaagacactgtccccaggagtccctttgtgcaatacacagtgctgaacgacatggaaggatggc

SEQ ID NO: 6798006 - DNA, 55 bp, Homo sapiens
gaatggctgaatgtcttaaattcatagattagatacccaaggaattcagctattc

SEQ ID NO: 6798007 - DNA, 58 bp, Homo sapiens
gccaagtcctttccatccaatgggattgtgacccattgaggtcccagaaaggactggt

SEQ ID NO: 6798008 - DNA, 63 bp, Homo sapiens
attttataaccaaaaatttgtgctgcttaagtaaaaaagcaggaagagtttaggttgtagaat

SEQ ID NO: 6798009 - DNA, 74 bp, Homo sapiens
tctcatagtccaggatgacccccactttcctaggaggctcaggaagtttcaggttggttctgggctcagtgaga

SEQ ID NO: 6798010 - DNA, 75 bp, Homo sapiens
ggtgccttgtacagagaggcattcggtgatcccaccgtgatcccaccgttcttctgattgccttctgcaaggtcc

SEQ ID NO: 6798011 - DNA, 83 bp, Homo sapiens
tgcttctgctttggtctagagtctagtgtatacaaagtggcccacagagtgggagatcatgaggactcagactaactgaagca

SEQ ID NO: 6798012 - DNA, 65 bp, Homo sapiens
gaggggctgtggagctctctggtccaaccatttccagttatagatagagagacctaggcctagtc

SEQ ID NO: 6798013 - DNA, 76 bp, Homo sapiens
gatctagaataaattcccctgtatcccactgctttaaggagggcagaaggagagaagggagaatttgttctgtgtc

SEQ ID NO: 6798014 - DNA, 60 bp, Homo sapiens
aggtcttgaaagaaaaagggatttgctgtgacctctgcagcagcttcctgctcttcgcct

SEQ ID NO: 6798015 - DNA, 67 bp, Homo sapiens
gtgagcagcatggagaagtagctagaaacaggggcttgggctctggctatgcgctccggcttcttgc

SEQ ID NO: 6798016 - DNA, 89 bp, Homo sapiens
atgtctgtcaagcagatctgtattgtatcacagtcttaatgattttgactgtccagaagatagaaatatagattaaatttgattgacat

SEQ ID NO: 6798017 - DNA, 67 bp, Homo sapiens
ggtctgtgatcttatggattctttctgtatgatttgattttgatgatcccataggattcttcaggct

SEQ ID NO: 6798018 - DNA, 96 bp, Homo sapiens
tcattaacctctgtcagttgtctcaatgccaaaataatgacaatatcaatcaagtcaactttacaggggtgtggaggcaatcacagacatttatgg

SEQ ID NO: 6798019 - DNA, 57 bp, Homo sapiens
gattccagcagctaacggactaccatgttcaatcaggtatatccaactgttggagtt

SEQ ID NO: 6798020 - DNA, 57 bp, Homo sapiens
agatcagtgcttcatagccctggtagcacattacagtcaccaggggaagcctgattt

SEQ ID NO: 6798021 - DNA, 59 bp, Homo sapiens
tcttggagatagtccaggtgaagggatagctggcattgtccatcagattatctccatga

SEQ ID NO: 6798022 - DNA, 63 bp, Homo sapiens
tcagtgagatgccacccttcagagcttggaaagactcattatgtctgaggcccatctctctga

SEQ ID NO: 6798023 - DNA, 61 bp, Homo sapiens
attggtttttggtgaaaaggagttaaaagatttcaaacttaacttttcatcaacagccaat

SEQ ID NO: 6798024 - DNA, 68 bp, Homo sapiens
ctgcaaccccatttcaatgccttcaacatagtgggtgttaagtccttatggaattgaaatgggttcag

SEQ ID NO: 6798025 - DNA, 57 bp, Homo sapiens
ttgtctcacgtcctcctccccacccttctcagggctcagaggagctatcggagacag

SEQ ID NO: 6798026 - DNA, 57 bp, Homo sapiens
gaggcccttcttggtggctcaggactggtgggcaccgtctctgggaggaagggcctc

SEQ ID NO: 6798027 - DNA, 60 bp, Homo sapiens
ccttctaagtaggtggaggaaccttctatttgtccgttctacccacactgctctagaagg

SEQ ID NO: 6798028 - DNA, 79 bp, Homo sapiens
aagacggaggaagaaggagaagggcagttcttgataaggacacaactcagcaatttcccatctcttctgctcacatctt

SEQ ID NO: 6798029 - DNA, 91 bp, Homo sapiens
tcatggcagttagcattatattatctggtggttatgctcttcctcccttttttaataagtagcatgtgcacagtaattttcattgtcatga

SEQ ID NO: 6798030 - DNA, 100 bp, Homo sapiens
gagggcgtttgcacatgaatcatttagctctgcatggagaccctgttctcaacttttatttctcctgtaggtcaggctgagtggatgctcaggaaccctc

SEQ ID NO: 6798031 - DNA, 98 bp, Homo sapiens
gaggcaggagattgcttgaacccaggcgggagaagttgcagtgagccgagatggtaccactgcactccagcctgggcaacagagggagactcagtctc

SEQ ID NO: 6798032 - DNA, 63 bp, Homo sapiens
ggaggtgatcagagttttgaggagcaaaaggcctaaacatcctcttgctctgttgtcactttc

SEQ ID NO: 6798033 - DNA, 97 bp, Homo sapiens
ccttgatgagtctgtaagatcttctctttagtagaaacactatagacccaatatttagctggctcttgcttacgaaggttaaacagattatacaggg

SEQ ID NO: 6798034 - DNA, 65 bp, Homo sapiens
tggtcttagctacaatcactgtcctttgctcttttctccaagcatgactgattcctgtagcacca

SEQ ID NO: 6798035 - DNA, 55 bp, Homo sapiens
tctaaacattgtgatagaccttgggtccttttagggaaatactgcaatttttgga

SEQ ID NO: 6798036 - DNA, 74 bp, Homo sapiens
gctctagacagaaagaccagtgaggtggctattgaaatagtctggaaaacgtggtggtgatttctgtccagagt

SEQ ID NO: 6798037 - DNA, 66 bp, Homo sapiens
gaaaccaggatcgaaccgcagaccagaagttctaatgagtttgctgcaagtatttattctggggtc

SEQ ID NO: 6798038 - DNA, 72 bp, Homo sapiens
atggattggatttttatggacccacaaaaatcagaactctattatggaagggtccataaaaatccaatccat

SEQ ID NO: 6798039 - DNA, 121 bp, Homo sapiens
caagcaggcaggttgtggttactgttcttgtggggaagtcatgctgagcacattctgtattttatataatacataataagttttgtctgttctctgtgaatatttagcaatgtgtggtttg

SEQ ID NO: 6798040 - DNA, 85 bp, Homo sapiens
atattgtgggtgtgtacataatggacaataatgcatctgttacagtggattaactatgttacattgacattataccccaggatat

SEQ ID NO: 6798041 - DNA, 60 bp, Homo sapiens
gctccctcccaccagcctgcaggtggggtgcctgtgattaggagagggcggtagaggagt

SEQ ID NO: 6798042 - DNA, 123 bp, Homo sapiens
ccgtgtttgctgtgccttcgggatcgtttgtgctattctagctgctgtttcacaataaaggcgaacagggtgaaagcagtttagataggcaaaggaaaagaatcaagggacagactggcatgg

SEQ ID NO: 6798043 - DNA, 66 bp, Homo sapiens
aaggcacactttcacaccgctcacattgtgcattacattttggagtccttgttggaagtgaacttt

SEQ ID NO: 6798044 - DNA, 60 bp, Homo sapiens
gccccttgcaccgccctggttcctaagacaagtggaggcacagccagggtgagaaggagc

SEQ ID NO: 6798045 - DNA, 76 bp, Homo sapiens
tgtgttgtaaggggatggatagctgtgaagctagcctatggtttcagggtctagagtatctacctcttctaacacg

SEQ ID NO: 6798046 - DNA, 69 bp, Homo sapiens
tctttgtggtgggggcagaactgtgcattgtacgatgtttagcagccttcctgacctctacccatttga

SEQ ID NO: 6798047 - DNA, 55 bp, Homo sapiens
gaaatatttctcttgagcccctcatttattagggtaggtagaagggaagtgtttt

SEQ ID NO: 6798048 - DNA, 68 bp, Homo sapiens
ctccctaaaacagagctactgcggctgacccacagaacttcaagcaatatagagcttgttttaggaag

SEQ ID NO: 6798049 - DNA, 100 bp, Homo sapiens
gctgcccccatccccatgccagtgctctaaaatcagtgctctcaaacaagggcagatggcgcagtggaagttctggcaagaggggactgtgaggggaagt

SEQ ID NO: 6798050 - DNA, 66 bp, Homo sapiens
atatatgcccagttagaaccagagtggggattcagacccaagtctctgtgtcactgaggcctgtgt

SEQ ID NO: 6798051 - DNA, 55 bp, Homo sapiens
tgccaggttgaaggatgacggggtgcccagattcccaccttcaaatttcctggca

SEQ ID NO: 6798052 - DNA, 79 bp, Homo sapiens
cctctcccatttctccagggctaccaggttttagcagcaacttacaaccaggctgcccagctctggaaggtgggggagg

SEQ ID NO: 6798053 - DNA, 55 bp, Homo sapiens
tgatgctattattctaccagattcacgagtgcagtgggctctggaggtagcatta

SEQ ID NO: 6798054 - DNA, 58 bp, Homo sapiens
aagaatacagagacccagtcctgctgaggtggaaaagatcctgggcctttgtattttt

SEQ ID NO: 6798055 - DNA, 69 bp, Homo sapiens
gctcagtgtttctggtagaaaaggcaattttcaagactgaaatagcaatttcttagccatcactggagc

SEQ ID NO: 6798056 - DNA, 94 bp, Homo sapiens
acagagtaactcatcccgttgaaacttagttgaaatttacactctatccaaagtggatttttctgagatgtcaggaatgtgagatttattctgt

SEQ ID NO: 6798057 - DNA, 73 bp, Homo sapiens
gagatctacattccaaaggaaactggctagggagacctttaagccgtgcctactctttggaggagggactctc

SEQ ID NO: 6798058 - DNA, 78 bp, Homo sapiens
ggggctggaaaagctgtgtcttgggttttatcaaatctaaaatgtttgagaagtaattcaagacattccacagacccc

SEQ ID NO: 6798059 - DNA, 59 bp, Homo sapiens
gggtacaccaatggatgccagggcacatcagtgcacacctgtgcatgccagggtacacc

SEQ ID NO: 6798060 - DNA, 77 bp, Homo sapiens
caatttcctggatgagtcttctctttccgggccgccctttgaaagcaggactggagttgactcctccagaggagttg

SEQ ID NO: 6798061 - DNA, 96 bp, Homo sapiens
agctgatctgtagaaactgtatgtagtttttgggaaatattccagattttcccataagttctccactcatccagtcatcatctacagattccagct

SEQ ID NO: 6798062 - DNA, 86 bp, Homo sapiens
ccaccctcattttacaggggcttctagggtgccagatctgcgggggtcgattgggaagaactagaagctaaaaaggagaagggcgg

SEQ ID NO: 6798063 - DNA, 68 bp, Homo sapiens
catatctagaatccattcctccagtgaggacacgcagtgccccttcatgatggaaagggttcagtgtg

SEQ ID NO: 6798064 - DNA, 65 bp, Homo sapiens
gccactctaaccgcagtgacgtgggacttcctcggcagggcctgtttgatgtctctgtgtgtggc

SEQ ID NO: 6798065 - DNA, 72 bp, Homo sapiens
tgtctgagtttgcagatctgctgacttcatatttcagtgatatcttgcagcttcatctgcaattctctggca

SEQ ID NO: 6798066 - DNA, 68 bp, Homo sapiens
ggtggtcatggaaggtcctacctagaagacgatatctgagctaggatagttaatgatgattttgcacc

SEQ ID NO: 6798067 - DNA, 72 bp, Homo sapiens
attagagtagtttgaagcacatgaatggcaaggtgaatgcccttagctaacattaaatcaggcaactctgat

SEQ ID NO: 6798068 - DNA, 55 bp, Homo sapiens
cgggccatctatctcctagttcagggcttcgtgttgtgaggggaggagaggcctg

SEQ ID NO: 6798069 - DNA, 86 bp, Homo sapiens
ttctcacaatgtgtagcatcatttattcagtgtaattaaacaaacccactttgcactaagtgattctaagcatcttgctgtgggaa

SEQ ID NO: 6798070 - DNA, 75 bp, Homo sapiens
gatgcagaaaaacagtgctgcattcattgagccagcccaaatgtgagctcatgagtggtactgtccttctgtatc

SEQ ID NO: 6798071 - DNA, 56 bp, Homo sapiens
agaggggagagagttcagaggtattaggtctctgaggcactgggcctctgcccttt

SEQ ID NO: 6798072 - DNA, 61 bp, Homo sapiens
ggtgatccaagtgaggctcaagaggaaattctccctactgcctattcaattggaattcccc

SEQ ID NO: 6798073 - DNA, 61 bp, Homo sapiens
tgggtgggaaggtacacgggaaagaggatttaagaaaaacttcacccatcttacccactca

SEQ ID NO: 6798074 - DNA, 59 bp, Homo sapiens
ggacccggccgggaactggcagtagggaggcccccgctgcagtcgccggcctgggtgcc

SEQ ID NO: 6798075 - DNA, 87 bp, Homo sapiens
gtggttgaagtgagtaacctagactgacatatgtgtatgtaatacgtacatgtgcacataaaacagtactagctatcttttctctat

SEQ ID NO: 6798076 - DNA, 88 bp, Homo sapiens
ttcaagacttcggatgaagaactttagggcagaatttagaagaaactaagttgacttttagttcttactttggctttttggtcatgaa

SEQ ID NO: 6798077 - DNA, 70 bp, Homo sapiens
ctgaaatctagtttctgataagcacattttaaggcacagcaagtgtattatcagaaactgtgggctttag

SEQ ID NO: 6798078 - DNA, 73 bp, Homo sapiens
cgcttgaacctgggaggcggaggttgtagtgagccgagattgcgccactgcactccagcctagcaaataagtg

SEQ ID NO: 6798079 - DNA, 57 bp, Homo sapiens
cctagactggatggttcgcatttttctggatgcaggaaagagagctattcacttggg

SEQ ID NO: 6798080 - DNA, 78 bp, Homo sapiens
gcacctttcccaccccttcctgtttgcattcctcagagtcagatttcagctaaagggatggaaattaaataaaggtgc

SEQ ID NO: 6798081 - DNA, 69 bp, Homo sapiens
tgtccccaccctgggaacaaggactgggtcattctgccaaaggcccatgttcagtcccaggaggatgca

SEQ ID NO: 6798082 - DNA, 73 bp, Homo sapiens
ggtttgagcccaggagtttgaggctgtggtgagctatgattgcaccactgcactccagcctgggcaacagagc

SEQ ID NO: 6798083 - DNA, 127 bp, Homo sapiens
gtgttgctgaggcccatcctggctccagcttttcctctcattgcttacctctgtgtttctggggaagtgcatggtggagtggcgtggattatggaccctgaaaccaggctgcggctttaccactcac

SEQ ID NO: 6798084 - DNA, 65 bp, Homo sapiens
caggcagagaccctctcctaaaatagaagcaggaaattatcttaggtgtaggtgtttgctgtctg

SEQ ID NO: 6798085 - DNA, 65 bp, Homo sapiens
tttctaaaattctgaaagattccttattccagcataaaactggcctaaggatttcagaaaagaga

SEQ ID NO: 6798086 - DNA, 56 bp, Homo sapiens
ggagaggctggcagtgcactccctgggctggatcctgagacagcaaaagcctctcc

SEQ ID NO: 6798087 - DNA, 76 bp, Homo sapiens
tatagaacggttcagtgtgcttcaggacgttagccttaaaggagctattcagtggacatattgaaagatttctgta

SEQ ID NO: 6798088 - DNA, 65 bp, Homo sapiens
ctgatgcagcttcaggattatgatgcagaaattttctgctgtggctccatagaagttgcaatcag

SEQ ID NO: 6798089 - DNA, 73 bp, Homo sapiens
atggtatttctggagacatcatgttgtgcctacagctgagagagattgttttcacaatgatgtcagatactgt

SEQ ID NO: 6798090 - DNA, 108 bp, Homo sapiens
atattcctactttatgatggaatttgtactgaagattgtaaactgcttcagtagtcacagtttatttgggggatcttcagtgcattgtctaaataatgtcagtgatat

SEQ ID NO: 6798091 - DNA, 65 bp, Homo sapiens
gcactgaggctgggtcacagacaaggcaggatggagctggagacttctgaggctgagcccagcgt

SEQ ID NO: 6798092 - DNA, 56 bp, Homo sapiens
ggaaaatgaactggagaacaatgacccatttctgggtctgttcactgttcagttcc

SEQ ID NO: 6798093 - DNA, 130 bp, Homo sapiens
ggtgcctcataaaccacccacatcaaaactgaaccaactaattagggttgtaatttatgtatggccaactaaagagtttttaatggctcatatcatatttgccagctctaagaacaattcagtgggaacc

SEQ ID NO: 6798094 - DNA, 129 bp, Homo sapiens
acggaggggcttggcaatgcctgctctcttgagatctctgctagggttcagcagtgccttaaatctaggggtcaagcctggcccagtagtttacccttagggagcaagctttggctcttgcagctctgt

SEQ ID NO: 6798095 - DNA, 80 bp, Homo sapiens
atcctgacctaaagaattttcatagagctgactgatggtcagttagctattaaatagaaaattttatgcattgttaagat

SEQ ID NO: 6798096 - DNA, 56 bp, Homo sapiens
ataaaggcagattttggacctctggttgtttcctgaactctagaaattgtctttgt

SEQ ID NO: 6798097 - DNA, 82 bp, Homo sapiens
agccaagagagtgattatgtctggctggttaatgagctaatccttattaggaaaaggtcagatgtgcacactgactctggct

SEQ ID NO: 6798098 - DNA, 69 bp, Homo sapiens
ggagttcttcaacttgcacatgcatcagaatctcctagagggctcgttgaagtgcagattgcggagccc

SEQ ID NO: 6798099 - DNA, 74 bp, Homo sapiens
gttaagccatcttgtttatatgttaagagtacagggaagctattataatgtgtttaaagcaagaatggctggat

SEQ ID NO: 6798100 - DNA, 99 bp, Homo sapiens
gagatgggaggattgcttgaacccaggaggcagaggctgcagtgagccgagattgcactgctgcactccagcctgggtgaaggagcaagactccatctc

SEQ ID NO: 6798101 - DNA, 110 bp, Homo sapiens
catttgactcatcactggagtgtgcagattacttaaggaactacaatgcgtgcattcattcagtgtatattttttgagtacctgttatgttccaggcactgtgttaggtg

SEQ ID NO: 6798102 - DNA, 78 bp, Homo sapiens
gaggagtttctggctcagtgctgaggaaagttgaaacccatttggccttcagcttttcagcactgctagtgtatcctt

SEQ ID NO: 6798103 - DNA, 63 bp, Homo sapiens
ctcccgagctgagccctgagtcctggcccacgatatagtcatagctcaggtgacagtcaggag

SEQ ID NO: 6798104 - DNA, 61 bp, Homo sapiens
cttcattttatttccttctgtatccccctccacctggggaaaggaggggatagaatcaaag

SEQ ID NO: 6798105 - DNA, 68 bp, Homo sapiens
ggagccccgtgtggccagctgaccgctcctccagctatgatgggcagcagtccatggcccaaggctcc

SEQ ID NO: 6798106 - DNA, 73 bp, Homo sapiens
tgtgtttgtatttgtctatgtgtaatagcatgtgtgtacagtacatgcatgcacatatacacacattaacaca

SEQ ID NO: 6798107 - DNA, 90 bp, Homo sapiens
gtgaaggctgtctcccactcaaggtgtcagctcattcattcttccaactgacctgcagaggagagtctggcgctgagatgacaccttcac

SEQ ID NO: 6798108 - DNA, 84 bp, Homo sapiens
caaactggcttatcaactttggtcagagaaattgtgtgggtcaaaacttgtattttacatgatccagagttgttgctatgtttg

SEQ ID NO: 6798109 - DNA, 88 bp, Homo sapiens
gcaatggtgaacttggggattttaaagacctctgactgcattcctcaggaaagccaaggggcttgtggagttgctggtttgcctctgc

SEQ ID NO: 6798110 - DNA, 74 bp, Homo sapiens
tgctctcctgctgaggtggagattgcagtgagctgagatcgcaccattgcactccagcctgggcaacaagagca

SEQ ID NO: 6798111 - DNA, 62 bp, Homo sapiens
ggtggcctatgggtgggctgtcctggagtcaggtgctagcttcagtccaatcagaggccacc

SEQ ID NO: 6798112 - DNA, 63 bp, Homo sapiens
tagggaagagcattcaacctttaatagaagcatctgtaaaagggtctatttgttctgctcctg

SEQ ID NO: 6798113 - DNA, 97 bp, Homo sapiens
atggtgtgaattttgacccttggctggaactcctgagaaagggaagctcctcttttgctggggtggctagcttagcactgccgaaattcatcactgt

SEQ ID NO: 6798114 - DNA, 56 bp, Homo sapiens
gcaacttaaggttagaggaaaggcaccacagcctcatgtatctggtattaggttgt

SEQ ID NO: 6798115 - DNA, 99 bp, Homo sapiens
ataatactaacttcacagggctgctgtgagttaatatttgtaatgcctttaggatggcgtttggcacacagtaagccctaagtgaatgttggctgttat

SEQ ID NO: 6798116 - DNA, 69 bp, Homo sapiens
cagtttgccatggttatgtgatatcctggcaagaaaatgcctcatgttatatcacaaacatatggtctg

SEQ ID NO: 6798117 - DNA, 58 bp, Homo sapiens
aaggaggagagtgcatggaggaatgttctcttccccttctccatggctcttcatcctt

SEQ ID NO: 6798118 - DNA, 95 bp, Homo sapiens
ctgaaaagaaagtgtagtcaatgaacatttattctgagattaagctttgctgctgattgcttgtataatgtgttcatcttacaattcatttccag

SEQ ID NO: 6798119 - DNA, 127 bp, Homo sapiens
ctttctttgtgaatcagggaagaaacagaatgaaaatagttctatagcaatcggaatcttatatcactaaattctgggaggtagaactgaaaagcaacttctttctttgaacctgaaaatagaaaag

SEQ ID NO: 6798120 - DNA, 55 bp, Homo sapiens
tctgctacctctctgcctggggaataagggtcttctagcaagcaggaggtgcaga

SEQ ID NO: 6798121 - DNA, 63 bp, Homo sapiens
gtctcccagctggtaagtgatggagccaggagttgcattgccttctcacttataagctgtgac

SEQ ID NO: 6798122 - DNA, 61 bp, Homo sapiens
ctggcaggagagcgtcagatcaggaggagcaacttcctgagcttggcttatctccagctgg

SEQ ID NO: 6798123 - DNA, 61 bp, Homo sapiens
aaactcagaaggtacagaagggaagtatctcccagccaccctgttgctctctcctgagttt

SEQ ID NO: 6798124 - DNA, 82 bp, Homo sapiens
tcatgtaatacattatcttcagtgaatggcaagatctattctaatacgttgaacaccttcactggatgaatgtaatacaaga

SEQ ID NO: 6798125 - DNA, 75 bp, Homo sapiens
aaaacctggcaaggtaagggctgcgactataaggctgcacagctcagggtcacatcttgcctaagacctggtttt

SEQ ID NO: 6798126 - DNA, 95 bp, Homo sapiens
tttaaagtgcaaggttgacaaatggattttaatgttacagagtatgaaaacatactgatgtgatttcaaattccacattgcaactaatctttaag

SEQ ID NO: 6798127 - DNA, 68 bp, Homo sapiens
accttacccagtctggatgtaggaccttactagtgttcttcaaagtgacaactaaactggggttaggt

SEQ ID NO: 6798128 - DNA, 79 bp, Homo sapiens
ccagtttctggcaagggtctctgtgcagagttttggctttcttctcccatctgtccagaataccctggcctggaagtgg

SEQ ID NO: 6798129 - DNA, 68 bp, Homo sapiens
cattccagactgggctggtggaaagctggaaaatagatcactttcccaggcccagattttaggtaatg

SEQ ID NO: 6798130 - DNA, 73 bp, Homo sapiens
tttcctttgtgcagctaagaaaatggcaccagtgtcagaattcactctagccctattatctgcataagcgaag

SEQ ID NO: 6798131 - DNA, 69 bp, Homo sapiens
ggataaaagacacacgaatgtgtatgtgcacacacacacacacgcacacatttacatgtttacgtatct

SEQ ID NO: 6798132 - DNA, 63 bp, Homo sapiens
ccctcgagccccatggttatttgcccctgtctctattatagcatcaatgacctggcatgaggg

SEQ ID NO: 6798133 - DNA, 69 bp, Homo sapiens
tcactaaaaatgtaccttcaatcatggagatgatttcgattgccggttgacagatatacattgtagtga

SEQ ID NO: 6798134 - DNA, 62 bp, Homo sapiens
gtatacagcatgaaatattgaaggctttggtatctttaaggcttagaaattcagctgagtgc

SEQ ID NO: 6798135 - DNA, 64 bp, Homo sapiens
actaaatttaagacccacagggaagttgtatgtactataaaattctctgggtcctgaacagggt

SEQ ID NO: 6798136 - DNA, 59 bp, Homo sapiens
agtaatactagctagcagggataatttagaaaaatgctttgtgctaatgctagattact

SEQ ID NO: 6798137 - DNA, 75 bp, Homo sapiens
gtctcatcctgcatttctttctcatgtggtactcccagtgggagttctgcatgaaaaaggactacgggattgggc

SEQ ID NO: 6798138 - DNA, 59 bp, Homo sapiens
atgttgttgaactctttgcatgttatttagtatgatgtgcagaaaacacttaagaacgt

SEQ ID NO: 6798139 - DNA, 89 bp, Homo sapiens
aagaaatgtcagagaagagcaatgataaattttctctttacatcaagaagaccaagttcaagtctgcatctttttttgattagtttctt

SEQ ID NO: 6798140 - DNA, 63 bp, Homo sapiens
ttctccctccgtcgtcgttcacctctgagcagatgttcagggtgaaccaggcaggaatgagag

SEQ ID NO: 6798141 - DNA, 74 bp, Homo sapiens
ggctcctctagtcacttctggtcccagtgtcacttgcaggattctgggtctgggtgtgatcacattagggggcc

SEQ ID NO: 6798142 - DNA, 72 bp, Homo sapiens
ttgtgtctttatttaggtaaacatgagtttgttcttattttaataaacttagagctctcctaaatgactcag

SEQ ID NO: 6798143 - DNA, 59 bp, Homo sapiens
gctctgtttgattctagtgaatcagagagaaagagcgactgacactggattcgcagagc

SEQ ID NO: 6798144 - DNA, 75 bp, Homo sapiens
ggagctatggtcagagcaactttcctagaataagtaacacttctcctccaggagtttgctctgtaaacatcctcc

SEQ ID NO: 6798145 - DNA, 72 bp, Homo sapiens
agacatggtgttggtgtttgtgagtcgagcctgaaaacacttctccagttccaaatacctgtcaccttgtct

SEQ ID NO: 6798146 - DNA, 71 bp, Homo sapiens
taggtgagtaattgaggagtaggctatgattttatgcagttgtgtttgattaagtccttctcagccgccta

SEQ ID NO: 6798147 - DNA, 70 bp, Homo sapiens
aaagaatgaaggacttgtttaaagtttgtgctgactttcagatgaactatacatagttcccccaattttt

SEQ ID NO: 6798148 - DNA, 55 bp, Homo sapiens
tttcccagaatcctgttctgtatttgacatttcttgcagagatgggagttggaaa

SEQ ID NO: 6798149 - DNA, 65 bp, Homo sapiens
ctgggacaggttcagcagtttataaaataatagccaatatcttgtgaatgcttaatatgtttcag

SEQ ID NO: 6798150 - DNA, 73 bp, Homo sapiens
gaattccatcttgggatgctaggaatgtattctccttttggagaatacatgttgtttccctggaggataattc

SEQ ID NO: 6798151 - DNA, 67 bp, Homo sapiens
ttaatgcttggaaagcacttagaagagtgcctgctacagggcgaacactacgctgagtgtgtattaa

SEQ ID NO: 6798152 - DNA, 70 bp, Homo sapiens
ctttacagataggaactactcagtttaactgtttctttttgagtgagtttggtagtttgtgtctttgaag

SEQ ID NO: 6798153 - DNA, 62 bp, Homo sapiens
gttgtgccaagaacatggaatttagagtcaggagactgtcttaagtatggttcctgggcaac

SEQ ID NO: 6798154 - DNA, 82 bp, Homo sapiens
gcatagacaatgacatttctccttgcaggagtcaataggttttgtgttggttcatgctcatggtgatagtgagtttctgtgt

SEQ ID NO: 6798155 - DNA, 58 bp, Homo sapiens
agaaacactggggtaggccctggagagcagtactcttaacaagctcctcagtgcttct

SEQ ID NO: 6798156 - DNA, 59 bp, Homo sapiens
gcagttccactgaggctagccaaggaaaagggcttggctgcaatcacagggactcaagc

SEQ ID NO: 6798157 - DNA, 129 bp, Homo sapiens
gcacattttaggacattgaactgtgcaaaagcgtaaactgtgttaaaggttgacagaggttgtaagagcttctcaagtagagaacctgttgacattttgggctggataattctttgttctgtgaggggt

SEQ ID NO: 6798158 - DNA, 87 bp, Homo sapiens
gggcatttagcccatttacatttaaggttaatattgtcatgtttgaatttgatcctgtcattataatgttagctggttattttgccc

SEQ ID NO: 6798159 - DNA, 77 bp, Homo sapiens
aaggggagttagtgtctcacctaaaatctggggccatgatgtcaccacattaaatagtagggatgcttgctcatctt

SEQ ID NO: 6798160 - DNA, 124 bp, Homo sapiens
gccaccaccatcagccatactatgtgtagtgccttattcaggaaggtgttacttaatagattaatatttgtaaggcacccttctgagtagagtaatgtgcaacatggacaacatttgtggtggc

SEQ ID NO: 6798161 - DNA, 81 bp, Homo sapiens
aaggattacaggtcaccagtctatccttgatccctttctgcttcagctggcagaggttggattggtgacttcactgacctt

SEQ ID NO: 6798162 - DNA, 119 bp, Homo sapiens
atatttatctttcagattgcttgttgtatgcacattttctgttagtacaaattggagggattatcatgaccttcatttgttgacagagacatgaacaggcagaacacagtgatgaatat

SEQ ID NO: 6798163 - DNA, 74 bp, Homo sapiens
gtatcatatgcatcaggcttgctgactctcatggctaaattcaatttcttcagtatagctgataattatggtac

SEQ ID NO: 6798164 - DNA, 57 bp, Homo sapiens
agatttcaggctatctatgcagacttagttgagggtctgatagttaatctgaatact

SEQ ID NO: 6798165 - DNA, 62 bp, Homo sapiens
agcctttcattttctgagatcaggaagatattttcttgaagtcacacagaaagtgagtggct

SEQ ID NO: 6798166 - DNA, 63 bp, Homo sapiens
tgaaatgtagtgaagcatggaagacactgcattcaactatttccatagcaatactgcatagca

SEQ ID NO: 6798167 - DNA, 67 bp, Homo sapiens
gctgtggcccttggcatctgcggttatattcaacaggagcaccaacggtggccaagaagtcactagt

SEQ ID NO: 6798168 - DNA, 130 bp, Homo sapiens
tttagtggaggccaaaaccaggttaagactcagtcacctcattagtatcttgtttaggcacctccaatttagtagctaggcaaagtattaatgagtgactgatttttaatctacttttggctctagtgaa

SEQ ID NO: 6798169 - DNA, 87 bp, Homo sapiens
tgtattgaggtataattgacaagcaaaaattgtttatattcaagatgtataatgtttcgttttgttgtaatatacctatccagtgca

SEQ ID NO: 6798170 - DNA, 61 bp, Homo sapiens
cttgatatctgcttgaatttcttgactactcaccttgagaagttctgttcagccagacaag

SEQ ID NO: 6798171 - DNA, 78 bp, Homo sapiens
aacagggagaactgccttctgctcagggttcagtcaccggactgagggcccaagcaaggcgggctcacgtcctctgtt

SEQ ID NO: 6798172 - DNA, 85 bp, Homo sapiens
gcacatacctctctcagggctctgcatgcacacgcaaacaaacgtacatatgtgtgtttgcaggtgtccacacgggagcatgtgc

SEQ ID NO: 6798173 - DNA, 60 bp, Homo sapiens
cgtctgcctaaggactgccttcttgggctgccaaggtactggcttatccttggttagacg

SEQ ID NO: 6798174 - DNA, 63 bp, Homo sapiens
tctacataaaaattcagaaggcacatccgtgtttgcccatagacttctggattattgtgtgga

SEQ ID NO: 6798175 - DNA, 81 bp, Homo sapiens
cactactggatcaaggaccagattatccttaataacctaatcatcagcctgttcagaaaattttggctttaatccctagtg

SEQ ID NO: 6798176 - DNA, 93 bp, Homo sapiens
agacatagatgtagattagctagaaggttgaaagcagggggagagttagaccccctattcaggccatcgagctgtatatactttgctgtgttt

SEQ ID NO: 6798177 - DNA, 127 bp, Homo sapiens
catcagcgtcaccaggagggcttgttacaatacagattgctgggcctcagcctctagtcttatttagctggtctgaggtggggcccaccaatttgcatttctaacaagcttgtgggtgatgctgatg

SEQ ID NO: 6798178 - DNA, 94 bp, Homo sapiens
gtggtcttattcctgaattcttaatgaaatctacttttttcaggagtgggaatattagtgagatattattaaagtttttagggttaagtatcac

SEQ ID NO: 6798179 - DNA, 60 bp, Homo sapiens
ccagttaccagttccaggggagaggtccaaacacttctgcccattgcatcttggtactgg

SEQ ID NO: 6798180 - DNA, 76 bp, Homo sapiens
aggtcacgcgcctatggtcctggcgagaacgtctccaaagtgggcagcatgtggcctgggactggtagtgtgacct

SEQ ID NO: 6798181 - DNA, 129 bp, Homo sapiens
gagtagatcttttgggaaatatatacggaagtggattaagtttgactaactttatgtaagccacatctagaagagaacagttacaaagagtttggtctctagatttatttgtacccagcagatcaactt

SEQ ID NO: 6798182 - DNA, 57 bp, Homo sapiens
tttatttggcatctctgccaagagacactaaaagtctatggcattggtccagataaa

SEQ ID NO: 6798183 - DNA, 116 bp, Homo sapiens
tggggaggcctcaggtgtggtactgccaagagcaggtggcaactctgggagagccctcacagaagatgctggatgttgggccttggcagataagggttaactggagagcctcccca

SEQ ID NO: 6798184 - DNA, 56 bp, Homo sapiens
tcacacagtgagaaagtgcggatttaagcccaattgtctgtggatctcaggtgtga

SEQ ID NO: 6798185 - DNA, 82 bp, Homo sapiens
ggagagaaggggagcacagactttggtgaagagctggttgttcatggcaaaaactaagtagtttgttcctctttttctttcc

SEQ ID NO: 6798186 - DNA, 92 bp, Homo sapiens
ggagttgaaggaaagaatcaagtgcaatgaatagctgcaattacaaattaggtaattgggcatggatgcatttgctttactttgcacactct

SEQ ID NO: 6798187 - DNA, 88 bp, Homo sapiens
cttggatgctaccgtcaggtccccagtgaagttgggtctttaaaatcctgccccacctaacaatctctgttgcttgaaggtcaccagg

SEQ ID NO: 6798188 - DNA, 59 bp, Homo sapiens
cttgagaacatctccagctcacgctggcctcagtcccagggaagccgagatgtctgaag

SEQ ID NO: 6798189 - DNA, 95 bp, Homo sapiens
cagaacaataaacacagtggaacacagtcattagaggcagccataatccatggcctgctgtgtactgatgtcaaccctgctgcgtttgacatctg

SEQ ID NO: 6798190 - DNA, 89 bp, Homo sapiens
ggagaattgcttgaacccaggagatggaggttgtggtgagccaagatcgcaccattgcactccagcctgggcaatgagagcaaaactcc

SEQ ID NO: 6798191 - DNA, 57 bp, Homo sapiens
tggcttctctggcttggaggagaggctctgcttctcacaaatccatccaggaggcta

SEQ ID NO: 6798192 - DNA, 62 bp, Homo sapiens
gagaagactctaagagaaatatgaattagatttcaaagtttattttctcttaaagtctgatc

SEQ ID NO: 6798193 - DNA, 70 bp, Homo sapiens
gcattcagcctaaagagaaaagggcttccttttaacaatttccccccttaaatcttttgtgttgcaatgc

SEQ ID NO: 6798194 - DNA, 96 bp, Homo sapiens
gggcttattaaaacacagatggctgggccccaccccaggctgtctgattcactagagctggggcgtagctcaggcatttgcatttctaacaagttc

SEQ ID NO: 6798195 - DNA, 57 bp, Homo sapiens
tgcaggtgctacaagaactcacagatcagtgggcctagtatttttgtagccattgca

SEQ ID NO: 6798196 - DNA, 77 bp, Homo sapiens
ccttaaatagtgcttggccctaccagatactcagtaagtattattagaatctagtgtctggttcatgcttattttgg

SEQ ID NO: 6798197 - DNA, 115 bp, Homo sapiens
ggaagaggatgtcctgtagatgcaacatgtcaagaaagagatttgaaataaaatttcaagtgtgctttgactggctgtatttaatgaatgtccttaatcgaatcaattaacttcc

SEQ ID NO: 6798198 - DNA, 67 bp, Homo sapiens
atatattctgggtataagtccctttgcagatctatgatttgcaaatattgtttacctttctgtatgt

SEQ ID NO: 6798199 - DNA, 78 bp, Homo sapiens
gctgaatcgtttttaatcagatattggcaggcatattaccatctctgccagttagaaactggttagacactataaagc

SEQ ID NO: 6798200 - DNA, 128 bp, Homo sapiens
atctgcttttcatgtaacccatgtcctttgtgtctgagcaagcaaaatgggagattccctgaatacatgggccctctgtacattttgttttgatgcttctcaaggaaagggtttccattggggtggat

SEQ ID NO: 6798201 - DNA, 61 bp, Homo sapiens
agagagagagagagaaatttgatggtgaagtatttcctatagaaacaacctctctttcttt

SEQ ID NO: 6798202 - DNA, 68 bp, Homo sapiens
ctctagacaacttgctgtgggtaacttactgcacccattctacaactagtaagctgaattttctagag

SEQ ID NO: 6798203 - DNA, 60 bp, Homo sapiens
gctccactagttgggtaggactgctgctgcgtgcatgcacagtgctgcctaatagggagt

SEQ ID NO: 6798204 - DNA, 73 bp, Homo sapiens
ttggaagcagagaccaggtcctcaccagacactgacctgctggcaccttgaccttggacttcccagcttccag

SEQ ID NO: 6798205 - DNA, 58 bp, Homo sapiens
tggtcatcttgaatttccattctatggagctgacaataggataggaaagagaagatca

SEQ ID NO: 6798206 - DNA, 79 bp, Homo sapiens
taggttggtgcaaaagtaattgtgtttttttgtcattacttttaaaggcaaaaacagcaatgactttttcaccaaccta

SEQ ID NO: 6798207 - DNA, 66 bp, Homo sapiens
agtctatatcttgatgaggttggtggtgacacagatatatattcatcaggctgtacaattaagatt

SEQ ID NO: 6798208 - DNA, 130 bp, Homo sapiens
acaagacttgactgacctgaccctcggggatccatccacgtggcccacccaagtaatgcaccttttagaatatttgctgaaataactgccacctggtggcatcttctgggtcaatgtcactgtccatggt

SEQ ID NO: 6798209 - DNA, 64 bp, Homo sapiens
tctgtgttttaccagttataggacctgagcaagagcctccatttcctgatgtgtaaaaggcagg

SEQ ID NO: 6798210 - DNA, 122 bp, Homo sapiens
gctggtgagcctgtccaactaatctgcctcgtttgttttcacagctttgcccggaacatttgcagggatggcccgacactccccgcagagcctgagagcgagtggcgagccaagataccagc

SEQ ID NO: 6798211 - DNA, 58 bp, Homo sapiens
ctgtcagagatggcatgaaagatttttcttagggagtgagtcaaacatatcctgacag

SEQ ID NO: 6798212 - DNA, 55 bp, Homo sapiens
ttctcactatatagtaagctccaggaaatgaacagagcttgcagtgtgtggagaa

SEQ ID NO: 6798213 - DNA, 63 bp, Homo sapiens
aaaagatgtgaaatagctggatatgaagaatcaaaacttcattttttctgtttcatctccttt

SEQ ID NO: 6798214 - DNA, 73 bp, Homo sapiens
caaatgttaggaactgttaattctagatggtgagtgtttgatgcacttatcttttaacttttccatatgtttg

SEQ ID NO: 6798215 - DNA, 61 bp, Homo sapiens
ctgctagctgtgcttggaagtttgcttggaaactagcagcttacctcccacagctctccag

SEQ ID NO: 6798216 - DNA, 76 bp, Homo sapiens
tctatagaaagcaaaatcctaccaagaaattccctctttcctttatgggatttgcttggtggatttgcttggtgga

SEQ ID NO: 6798217 - DNA, 59 bp, Homo sapiens
taaatacacaggcatactgtatgtgtaataaatacacatgcatactgtatgtgtattta

SEQ ID NO: 6798218 - DNA, 113 bp, Homo sapiens
ggttggagattaagaggtggcaaatttactttaagacataccaagttgtgtgatttatcacacaaacctggattcttatgagtgtgaaaagtgccactgtcaataattttgcc

SEQ ID NO: 6798219 - DNA, 57 bp, Homo sapiens
aggtggcagaggactcctcctgcaggacttggcgggtgggagggctagggccattct

SEQ ID NO: 6798220 - DNA, 71 bp, Homo sapiens
ggccacaggcaagagccctgccaatggatgaggcctgccataggttctagtgctgggctctgctgtgtgcc

SEQ ID NO: 6798221 - DNA, 68 bp, Homo sapiens
gcttaaaagccacttagtctatagtactttgttatagtaccctcaaaggactacagtagcttcaaagc

SEQ ID NO: 6798222 - DNA, 61 bp, Homo sapiens
gggtttaagcgtgttagccacagctcatgctaatgagccagataagggctcacgctaaccc

SEQ ID NO: 6798223 - DNA, 70 bp, Homo sapiens
tgataattaagcatcttgttctggattctgatttaaactttgccagatgatcccaagaagatgctgttca

SEQ ID NO: 6798224 - DNA, 125 bp, Homo sapiens
catcctatccatttcatttcatgattccattacatcatttcacttagatgaagtgataaggttacttgagatgagatgaaatgatgagatgaaatgatgaaatgatgagatgaaatgatgagatg

SEQ ID NO: 6798225 - DNA, 81 bp, Homo sapiens
gcactgtattctggagatgcctgagtaatgtcactttcttaatagcaaacaaggcacaattcaggattttcattaagtcgc

SEQ ID NO: 6798226 - DNA, 87 bp, Homo sapiens
ctaaggcaccaggtttgactaggtgtcagtaactttgaaatgtgtgtgttaaggtcctgacttctgcaatagtgacttgggacttgg

SEQ ID NO: 6798227 - DNA, 55 bp, Homo sapiens
gaattcatgcagtcttgagtctacaaccaaactgtaactcaagtctaatgaaatc

SEQ ID NO: 6798228 - DNA, 60 bp, Homo sapiens
ggtatttcgggagaacgcgcaggctgagcctctgagcctccgcgggctgcccggttttcc

SEQ ID NO: 6798229 - DNA, 56 bp, Homo sapiens
gaaagacgggtgcctgtgtgtgcgcttgtttgtgtgtacacatgtaacagtttttc

SEQ ID NO: 6798230 - DNA, 129 bp, Homo sapiens
ccagacccaattgcaaaggccaactgaaatcaccatctgtgctttactggcagtgatgtaatgtgattgcatgctttcagaaatagggctacagaggaaatgaaccccagttcttcacatgggaaatgg

SEQ ID NO: 6798231 - DNA, 126 bp, Homo sapiens
atcttatttttactcatatatcttacctgataaaggaagccattagctgcaagattcctatcctgaaaattagcagtgataactttactctttttaggtgctcatatttgtataaaaagcatagat

SEQ ID NO: 6798232 - DNA, 61 bp, Homo sapiens
caggtggcttagtcccattttatagccatgagcaccaaggcttggaaggctaagacacttg

SEQ ID NO: 6798233 - DNA, 78 bp, Homo sapiens
ggcagtgggcctggagccctggagagttggtgccagtgagagagacgtggtgcattagcagaggctgggcctgaggcc

SEQ ID NO: 6798234 - DNA, 69 bp, Homo sapiens
acacttatttcttgtctaaccagtgctgagtcctaagtctgacacagaatggatgcgcagaaattgtgt

SEQ ID NO: 6798235 - DNA, 102 bp, Homo sapiens
gagaggaggtttacccactccctgcacgcctgccgtccctgccccgctgggcagcccttcagtgtggctggcgttggggccagtgagttgcctctttccctc

SEQ ID NO: 6798236 - DNA, 58 bp, Homo sapiens
tcaattcaattgaacagttactgtctgccttttagggactgcttcttgattgagttga

SEQ ID NO: 6798237 - DNA, 60 bp, Homo sapiens
ggttggccaggctggtgtcacaactcttgacctcaagtgatctaccacccttggcctccc

SEQ ID NO: 6798238 - DNA, 90 bp, Homo sapiens
tctgccagttcttactcttaattctctttgccttgaatcccaggatccacctctgatgttcagtgaagaggaccggaaaagtctgctaga

SEQ ID NO: 6798239 - DNA, 94 bp, Homo sapiens
ctctcaagtcccatcttccaggtgaccctctcacctgcttctaagcctttgaatgggttgtaagaggttgggggctgggggttagggatgagag

SEQ ID NO: 6798240 - DNA, 55 bp, Homo sapiens
ttagtgtctacctttatctaaattttggtgtgcaggtataggaggaagatactaa

SEQ ID NO: 6798241 - DNA, 70 bp, Homo sapiens
agaaagtaagtagaaacctgcaaggactcagcctaggctgggaactggggcattgtttctgttgtattct

SEQ ID NO: 6798242 - DNA, 74 bp, Homo sapiens
aatgagttcattggtaggagtcaagctgtagtgccccgttgaggctcatattttggctccatgggtggctcatt

SEQ ID NO: 6798243 - DNA, 82 bp, Homo sapiens
aggagtgagggccttggagcccagcaggcctggagtggaatccctgcttggttactgcatagctccaagttgcccccatcct

SEQ ID NO: 6798244 - DNA, 84 bp, Homo sapiens
aggaggctgaggagtgtgatggcagtcttgctctctaagaggctgttgtcagagggctcttggctgcctgctccatggcctcct

SEQ ID NO: 6798245 - DNA, 55 bp, Homo sapiens
gttcattcatttattcgttcaacaaaaattgttgaatgaccatgatgcaagggac

SEQ ID NO: 6798246 - DNA, 119 bp, Homo sapiens
ctcaggcaggagcatgtttttacctgctcaattcaggagtttggcctacagaggctggtaccaccctctgaagaggtcacacctgtctctgaagcaagaaacactaatcactgtacaag

SEQ ID NO: 6798247 - DNA, 67 bp, Homo sapiens
agtatttcataatagaagccgctgggttgttgaactcagaaagccctgttaactgttttgaagtgct

SEQ ID NO: 6798248 - DNA, 66 bp, Homo sapiens
atgttgggtttgtttcccttttctgccaactgctttctggctggagagagaaaaagccttaaacat

SEQ ID NO: 6798249 - DNA, 61 bp, Homo sapiens
ggagatggccaaaaacacaaatgagtataattctaggctgcctgtggtatgtgccatctct

SEQ ID NO: 6798250 - DNA, 86 bp, Homo sapiens
actaaaatggtatttgcacttatcctagcaaaaggaagatatgagttttttcactattgctataaggcaggttaaagccatgcagt

SEQ ID NO: 6798251 - DNA, 79 bp, Homo sapiens
ctgcagccaaccaagctggctccatcctaggcaaatgagtagatgacagccagccaggatggagaccatgaatatgcag

SEQ ID NO: 6798252 - DNA, 63 bp, Homo sapiens
gcagggctattggaaggagatgctgaatagaaagaaaagaggcacttgacagcccagccctgt

SEQ ID NO: 6798253 - DNA, 69 bp, Homo sapiens
tctggggtatatgagctctatgtaatggcttgtctgatcatgcaaggaaccaagctctaagccctcaga

SEQ ID NO: 6798254 - DNA, 87 bp, Homo sapiens
cccaggagctggctgggcccacctggcatccctgcccagcccctggccgggcctcgggacaccgggtacgcaccgcctactccaggg

SEQ ID NO: 6798255 - DNA, 66 bp, Homo sapiens
tgtcacaatgtaggctgaaaaagctttgtgaacgttccacaaagcatcaacactatattgatgaca

SEQ ID NO: 6798256 - DNA, 65 bp, Homo sapiens
gcagaacagcagttatggttcatttccctctagtaagagatggtggagattggctctgtgtctgt

SEQ ID NO: 6798257 - DNA, 65 bp, Homo sapiens
cttcttcatttcagtctgagataagaaaaaggaagatggcatttcaggcaggtggaatgagtagg

SEQ ID NO: 6798258 - DNA, 90 bp, Homo sapiens
cccactgcagctccccctgggccctcccacatcctgtgaaccatcctccaggagaggtagagggttccagaggtaggggcatagagtggg

SEQ ID NO: 6798259 - DNA, 95 bp, Homo sapiens
tggcagcttgtagttcccagagcagtactccaggaggtgaattccaccagcctcttagggtagtctgactttttattggcagcttatagttccca

SEQ ID NO: 6798260 - DNA, 84 bp, Homo sapiens
ctaagtgcttcaggtagatagatggctgatgttcagattcaaatgttactcctgcctgaaggtcctattttttgaaatactgag

SEQ ID NO: 6798261 - DNA, 101 bp, Homo sapiens
tgagacaggagaattgcttgaaccctggaggcggaggttgcagtgagctgagcacatgccactgcactccagcctaggtgacacagcaagactccatctca

SEQ ID NO: 6798262 - DNA, 105 bp, Homo sapiens
gtaacgtggagaaggtgcccagtaattctcagttggaaatagaaggaaacaggtcaggatctgtcttgtattcccctatctctaaatacaggtatccctcgttac

SEQ ID NO: 6798263 - DNA, 68 bp, Homo sapiens
tagactccctatattcacacctgttgcaaagtgactttgcagttctccagaataaagggtggagttta

SEQ ID NO: 6798264 - DNA, 77 bp, Homo sapiens
ggctccaggtaaacatgaggcccagggtgaacattaggcttctggtaaacaccaggcccatgtggattactaggacc

SEQ ID NO: 6798265 - DNA, 88 bp, Homo sapiens
gtctttcgggggccagatggtcagggtaagtctgtgtgctcaagttagagatgtggatttgggagtgatcagggctcaatagaaatgc

SEQ ID NO: 6798266 - DNA, 57 bp, Homo sapiens
gcaagcagggttccttagggcaccagttggtaagtgtaagaggcctcatccgcttgc

SEQ ID NO: 6798267 - DNA, 60 bp, Homo sapiens
agggcactggcttgcaaactcagaagtgtcattggcatctcgagatgggttcagtgctct

SEQ ID NO: 6798268 - DNA, 56 bp, Homo sapiens
ccgggttgaggttcccatagatggtttttgtccgtttcttggtcttcccgacctgg

SEQ ID NO: 6798269 - DNA, 122 bp, Homo sapiens
ccttcatcacttggttaaggtagtgtgctaggcttctccacataaagttacaattttcccctttctgtactctactctgcagaagcaagtcactaagactatcgagccttcagggatgaagg

SEQ ID NO: 6798270 - DNA, 58 bp, Homo sapiens
caggactggctcgcagtgggtgttgtggactgccgtgccccactgtgcagcagttctg

SEQ ID NO: 6798271 - DNA, 82 bp, Homo sapiens
gggctttggagatggaggcaggtggaggagtgaaggcccaaggatggctcttcagcccttccctgttttcatcagccagcct

SEQ ID NO: 6798272 - DNA, 78 bp, Homo sapiens
tcatggcttccagtggcaccaacatgcatcaagacaagaaatttagttcatgtagtgctcactggaaaatcctaatga

SEQ ID NO: 6798273 - DNA, 65 bp, Homo sapiens
gctgttgtcagagagtttgtgttttagaaacaagctattttaaatcacaaattttctcatttagc

SEQ ID NO: 6798274 - DNA, 60 bp, Homo sapiens
gatgtgatttattgaaaagagcttggaagttgctaagctccctgacaaataaaccatgtc

SEQ ID NO: 6798275 - DNA, 58 bp, Homo sapiens
actggaaatgagatgatatcagtttggagattcagatacctgtcctcccatatccagt

SEQ ID NO: 6798276 - DNA, 56 bp, Homo sapiens
gctaggttggggaagttctcctggataatatcctgaagagtattttccaacttggt

SEQ ID NO: 6798277 - DNA, 56 bp, Homo sapiens
gctaggttggagaagttctcctggatgatatcctgaagagtattttccaacttggt

SEQ ID NO: 6798278 - DNA, 72 bp, Homo sapiens
gctgtcccccagggtccggataaccctgggcaggctgtcccccggggtccgggtaaccctgggaagggcggc

SEQ ID NO: 6798279 - DNA, 78 bp, Homo sapiens
gcattgtgctctagccattgacctagctgggtaaaccctgaatcagttagttaaaggctattaccaagggttcagtgt

SEQ ID NO: 6798280 - DNA, 71 bp, Homo sapiens
tactctctctgttaccatatggagtagtttcttgacaaggaaaaaggaacactgagggaaaagagatagta

SEQ ID NO: 6798281 - DNA, 130 bp, Homo sapiens
gccagtggcttttgtgcccagtctgtttttcctgcaatgctttggatttctgatttgagctccatttctggaactctgtgtaggaaccaggtcatgtatgagaggagctaaggggaccttgccaactggt

SEQ ID NO: 6798282 - DNA, 84 bp, Homo sapiens
gagggtggggctgggagggggtgggatgggcagcagggaagctctctcctatcgccctctggctcttctcaggccgcctccttc

SEQ ID NO: 6798283 - DNA, 62 bp, Homo sapiens
aggctggagtgcagtggcgtgatctcagctcccgggttcacaccattctcctgcctctgcct

SEQ ID NO: 6798284 - DNA, 57 bp, Homo sapiens
ttattggtcacggctaggatgctatcctttaggcatccaatctagtatgataaatga

SEQ ID NO: 6798285 - DNA, 61 bp, Homo sapiens
ggctcttgtttgactaaattggtatcactgctccaggcagctgtgatgttaaacaggtgct

SEQ ID NO: 6798286 - DNA, 57 bp, Homo sapiens
cttctcggattacacaccttctggagtgactagtctccagggatgttgaactgaaag

SEQ ID NO: 6798287 - DNA, 77 bp, Homo sapiens
gggtgggaggcagggagactatcagccagggtcactcccaccatcctggtcacccctctctctgcagcccagtcccc

SEQ ID NO: 6798288 - DNA, 66 bp, Homo sapiens
cagctacaggacctgatgcaccattgctatcagaaaatcttgcttggtgttagttttctgtatttg

SEQ ID NO: 6798289 - DNA, 62 bp, Homo sapiens
gacccagcctatgaaacaccaaaaagaaggcaattttctttgtattcagttgggctgtggtt

SEQ ID NO: 6798290 - DNA, 55 bp, Homo sapiens
ggcttctaaggagtatcctttgcttggggaggaaggtcacagaacttagcaagcc

SEQ ID NO: 6798291 - DNA, 77 bp, Homo sapiens
tgttgcatgcgctaaacttgagaagcccgtgagacatcggagtagggggctgggggtaagtttggaagctgtcagca

SEQ ID NO: 6798292 - DNA, 77 bp, Homo sapiens
gctctgtgaccataggtcttagtttttctgtccatcaaatgggaaaggcaactctgaccttatgaagtcgacaaagt

SEQ ID NO: 6798293 - DNA, 57 bp, Homo sapiens
agagctggcactgaccctcaccctcaattattcgtgtgggcagttcaatgccactct

SEQ ID NO: 6798294 - DNA, 77 bp, Homo sapiens
ggggcaaacagtctagatgctagaaaatatacaccataatgttttatgttttatttagcttcagtacataaatcccc

SEQ ID NO: 6798295 - DNA, 67 bp, Homo sapiens
gagtcccctgtccagggccagccagagagtgcggagccccaccatgagctgggcctgcaggggtctc

SEQ ID NO: 6798296 - DNA, 59 bp, Homo sapiens
gctggatgcaagaggtacatggggacttcctcactgtctccagtgtctcttcattgagt

SEQ ID NO: 6798297 - DNA, 77 bp, Homo sapiens
accctatatgttaggttttatctgaaggaaatctacacattcagttttctccagacacaaaatctaagagttggggt

SEQ ID NO: 6798298 - DNA, 60 bp, Homo sapiens
gtagtgtctgagtttggaaagtccagagagctctggaattctgaacagctcagttgttac

SEQ ID NO: 6798299 - DNA, 83 bp, Homo sapiens
gaaggtctgggatggtgctttttcaatcagaagggagtagtcattttccctctctctaaggagagggcctcctccctcccatc

SEQ ID NO: 6798300 - DNA, 58 bp, Homo sapiens
tctcacacaacatgttactttgcttttatttgcttttgattttgacagttgtgtggga

SEQ ID NO: 6798301 - DNA, 111 bp, Homo sapiens
ggtggagtctcgccctgtcacccaggctggagtgctggagtgcagtggcgtgatctcagctcactgcaacctcggcctcctgagtaactgggattacaggcgtgcaccacc

SEQ ID NO: 6798302 - DNA, 70 bp, Homo sapiens
catgggtatatgagaaccatggaggtgctaaagaaaaatagaagcattttcttattatcatattaccatg

SEQ ID NO: 6798303 - DNA, 81 bp, Homo sapiens
catgggtgggcttggtgcacttgtgatgtggtgcctcctgttaattcacctgtcatcccggctgcaccgtcaacgctcatg

SEQ ID NO: 6798304 - DNA, 59 bp, Homo sapiens
gtcttttaactctcatgacgatttcaatatgagaaatcgtcatgagaattgagatagat

SEQ ID NO: 6798305 - DNA, 73 bp, Homo sapiens
acattttatcttacttagggagacaggtataataaatcaaaagttcttctcactaagttatgataatcagtgt

SEQ ID NO: 6798306 - DNA, 67 bp, Homo sapiens
tctctttactttcaccaatttgccctgagacagacccagtcatgaaaagtttgtgacagtaaaggga

SEQ ID NO: 6798307 - DNA, 70 bp, Homo sapiens
gacagggaaagaacagtaacttttgacagaaattttgcttcctgtgagatgtggttattctcttcctttc

SEQ ID NO: 6798308 - DNA, 126 bp, Homo sapiens
tatccttgaaagtagaaatagggtgagtgccagggagtggaggagcttaaaggaataagaagacgaagtagacacttaccaaacaggcaccctttaaccctacaatcacttcctactattgggata

SEQ ID NO: 6798309 - DNA, 66 bp, Homo sapiens
gtttcatatgcagttaacagcatgtaaatttcctaaacgtgattaacagtttcatgcatgtgaaac

SEQ ID NO: 6798310 - DNA, 79 bp, Homo sapiens
taatggtgtattatagagaaattcctcaaatcaagtattgctcttgaagagagaagtctctctggttctatgactatta

SEQ ID NO: 6798311 - DNA, 82 bp, Homo sapiens
gcgggaaaatctgacagtctcattgatttgctctctttgccatcaccactcttgagaggaagaaatgtgacttcaaacttgc

SEQ ID NO: 6798312 - DNA, 67 bp, Homo sapiens
tcctcacagaactcatggctgtcatttgtgttcacaatggctatacaacatgagtatgctgtcagga

SEQ ID NO: 6798313 - DNA, 57 bp, Homo sapiens
gctctcagatgctccagcagccagagaggtgatgatggccctggaactgctgagagc

SEQ ID NO: 6798314 - DNA, 57 bp, Homo sapiens
gctcataccaacagctttcctcacccaggttcctggctggccctgtaggatgtgagt

SEQ ID NO: 6798315 - DNA, 61 bp, Homo sapiens
ccagggctttatctgcctttgactttgaagcaaaagggagaaaggaacgatcaggccctgg

SEQ ID NO: 6798316 - DNA, 94 bp, Homo sapiens
ggagctcatggtgctcgggctgtggcagggaagaggccatgcccttcagccgtccccccgtctgtcctctccctgaccacaacgccagagcttc

SEQ ID NO: 6798317 - DNA, 77 bp, Homo sapiens
cacacagctggaggcagcaccccaaaggggccgagggacatcctcccttggggatgctgtgtctggaagggctggtg

SEQ ID NO: 6798318 - DNA, 76 bp, Homo sapiens
attcatttaatcattcacaggatagctattgcacgtcatttgtgtcaggccttatcggtggctggagataatgaat

SEQ ID NO: 6798319 - DNA, 82 bp, Homo sapiens
gtgatgagttcatactttcagtaccatccaaaagtgcctattaaattggagttcagggtacctagagtcttgacttgatcat

SEQ ID NO: 6798320 - DNA, 86 bp, Homo sapiens
tttgcaaactggggctttttcttctaggtgtgcctgcatttactcatgtgctgtatgtctatggaaaagactgttaagctgtcaaa

SEQ ID NO: 6798321 - DNA, 105 bp, Homo sapiens
atgtctgaatttttacctgtcacttttctccctcctgccttcatctatatctatatgaagatgaaggcaggaagggagaaaactttacaggaaattcatagatat

SEQ ID NO: 6798322 - DNA, 56 bp, Homo sapiens
ctgagccaagagctcacctcgtgtggctggccctccgccatgtcctcttggctcag

SEQ ID NO: 6798323 - DNA, 88 bp, Homo sapiens
cccttgaacttcctgcctgcctgctttctgctttgcagcgttgtgcctgcaccaaagcctggaggtgtgtcagggaggctcgcagggg

SEQ ID NO: 6798324 - DNA, 56 bp, Homo sapiens
acgcttgcagaggctgttccagatgggtaaaattagatgtctcctcatgcaagtgt

SEQ ID NO: 6798325 - DNA, 58 bp, Homo sapiens
caggcacaagatcggctagatatcatatctaggtgtttagctctgactatgtgatctg

SEQ ID NO: 6798326 - DNA, 85 bp, Homo sapiens
tgccacattttgtgtactttctcaagctgaattgtgtctaatgatgtcaaattatgtaatgggaagagaaaaataaattcaggca

SEQ ID NO: 6798327 - DNA, 63 bp, Homo sapiens
gcacatggtaggcatttgatgttcatttattcactaaatatgcatcgagtacctcctgtgtgc

SEQ ID NO: 6798328 - DNA, 83 bp, Homo sapiens
ctgtgatggaggtcaaaccagggatcctgtggtcagccgtgaacaggatgtatgcagagtcctctggagggacttgtaagcag

SEQ ID NO: 6798329 - DNA, 69 bp, Homo sapiens
gagggccaaagagcaagagcctgtttaccttccccaaggtccacatttcctcttgcttcttcatccctc

SEQ ID NO: 6798330 - DNA, 62 bp, Homo sapiens
cgatggtatcggccagccccgggttgcacagcagcagccaccggcggggggtgatgccattg

SEQ ID NO: 6798331 - DNA, 61 bp, Homo sapiens
catggtgtatgtaaagtctgagggccatttagatatatgccacaggcttctatacacaatg

SEQ ID NO: 6798332 - DNA, 67 bp, Homo sapiens
accaaccaaaaacaatgactttggagaaaaattagactcagaaagtctgtccaggcattgggttggt

SEQ ID NO: 6798333 - DNA, 83 bp, Homo sapiens
gtgtttccttcttattgaactgtagtcttctgtctagtccagctatacagaaatataatacaagaaatcaaggaaagaaagac

SEQ ID NO: 6798334 - DNA, 107 bp, Homo sapiens
aggcaacgacttgttgattgcagaggtgactgggtgttgtatcagtttgctgaggctgctgtagcaaactaccacaaactgggcagtttcaaacaacaggcttgtct

SEQ ID NO: 6798335 - DNA, 103 bp, Homo sapiens
atagaaattgtgccaggaaaatggaatcacctgtattgtcaccaatattataggtcctatatcatttttcaaatttttggtaatataataatataacttctat

SEQ ID NO: 6798336 - DNA, 81 bp, Homo sapiens
gtttcagattaatacagaggcacatgcaattttccatcagcaactgaggagaaacacacgtgtcctgaggaattggggaat

SEQ ID NO: 6798337 - DNA, 113 bp, Homo sapiens
tgtcttccagttatctgcattgaatgggtctacctggaatgatgacacacacacactcacacatgtgtgtgcatacacacggtaacacatggtaatgtagattactaggtaca

SEQ ID NO: 6798338 - DNA, 81 bp, Homo sapiens
agtcaggcagggccctccccgctcagggcagggctcaaattccagacctgcccgcaacagggcggggaggccagcctggct

SEQ ID NO: 6798339 - DNA, 62 bp, Homo sapiens
gtgatgctatgcctgatcctcctttccataaacattagggaagaacttttggcaagtgttat

SEQ ID NO: 6798340 - DNA, 77 bp, Homo sapiens
agggtaccaggaggtgtttgctcaagtgaggacatgcagggctcacttgagcaaagctccctcatgagtcagaccct

SEQ ID NO: 6798341 - DNA, 68 bp, Homo sapiens
gcgttgttgggcaatggccccagccagcaccatccccacctccctgggccttgccttgcccacagggt

SEQ ID NO: 6798342 - DNA, 112 bp, Homo sapiens
atatgacatcatttttgaaccatgtagcaccaacctgcctttttgaacttccttgttcttgtggaaaaagaggggtgttgtgtgtgtgtgtgtgtgtgtgtgtgtgttatat

SEQ ID NO: 6798343 - DNA, 96 bp, Homo sapiens
gacattcaagggttaaactggtttctagtaaatactgtgctttaaagtagtacatactgtgagctgtgttattagaaacctgcttgtccttgtgtc

SEQ ID NO: 6798344 - DNA, 73 bp, Homo sapiens
gctggaatcctggcagtcttggttcatcatggctctaccggagcttgaggtctgagactgtgcagggttacgc

SEQ ID NO: 6798345 - DNA, 60 bp, Homo sapiens
tctcctctcctttcatgttgtttgacccaagttttttaacaattgaagggaacaaggaga

SEQ ID NO: 6798346 - DNA, 74 bp, Homo sapiens
gttgggtagaagatattgcatattggatgagttgcaatcccccaacctctctttcagcattgtttctattctac

SEQ ID NO: 6798347 - DNA, 56 bp, Homo sapiens
ctgtgtgtgcacgtgcggggaaataccatttcattgcttatctagttcacatacag

SEQ ID NO: 6798348 - DNA, 82 bp, Homo sapiens
ctcggtaaatattggttcttattactggacccattttataccaaggtttagtgctattaaggatacagagtaagtgactgag

SEQ ID NO: 6798349 - DNA, 58 bp, Homo sapiens
ctatggcttaagattgacatgattataaataaaatcatagtcataaatatggtcatag

SEQ ID NO: 6798350 - DNA, 84 bp, Homo sapiens
gtcatttttagattaccttcaaactttcattaaccagaaataaggatttgagtagagagagttgaagagcataatagaattgac

SEQ ID NO: 6798351 - DNA, 57 bp, Homo sapiens
gagagctgcaacttcataggccttcaggagtggccctgaggtgggtaagcagttctc

SEQ ID NO: 6798352 - DNA, 99 bp, Homo sapiens
ggtttaggaagaagttatatcttctttattttgtgaggtgcttagaaataaatatttgatgatgatgataaagtttccataggatttcttctctactcc

SEQ ID NO: 6798353 - DNA, 128 bp, Homo sapiens
catttgtgattgtgtgtgcatgcatgaccgtgtttgtatacatgcacatgaacatgtgtgagtgtgcctatttacatgtgtgtttatgtgtatgtacctgtttgtgtctgcttatgtgggtcaagatg

SEQ ID NO: 6798354 - DNA, 88 bp, Homo sapiens
ggctttacagatgtgattaggttaaggaccttgagatagggatagtgtcctggattatacaagcaggcttaacctgatcacatgagtc

SEQ ID NO: 6798355 - DNA, 56 bp, Homo sapiens
agagtgcttggaggctgaactctggaaggactcttccctgaggcctcttggcatct

SEQ ID NO: 6798356 - DNA, 63 bp, Homo sapiens
ccaaaattgggaattttccttaagcaagtagtgagttcctcattactgaagttacccaaatgg

SEQ ID NO: 6798357 - DNA, 75 bp, Homo sapiens
acatgatcgatattagtaactgtgacaggcagtgcttaattaagtaaactgattgttggagttacgagactgtgt

SEQ ID NO: 6798358 - DNA, 63 bp, Homo sapiens
gttattgatgtatttctaggtgcttcttagctttgtggaacatctggaataaatactcaaagc

SEQ ID NO: 6798359 - DNA, 61 bp, Homo sapiens
tgttgatggctttgcctgaggtgcttatgacaacaaagttatacctggccagagttcaata

SEQ ID NO: 6798360 - DNA, 130 bp, Homo sapiens
gtgggggctgagcggcacacagctttccatgtgtgttgtgcgtgtcactgagtggcccgtgaagtccagttattgtgtgcgttagcctatgtgggccgtgtatctaaatgtgtgtgttgtgtgtgtttac

SEQ ID NO: 6798361 - DNA, 57 bp, Homo sapiens
ggaggcagggtcgaggccttggtgctgacctccggcttcctctgccagcccgcctct

SEQ ID NO: 6798362 - DNA, 63 bp, Homo sapiens
ctgtccagaataggcaaatccatagagaaagaaagtagagtagtggttgcctagggccggcgg

SEQ ID NO: 6798363 - DNA, 87 bp, Homo sapiens
gagaaggtaccatctgctcgggctcaggaggaaacaggagccttgatggagtggggccctatcctgcaggcctgggctgggcagctc

SEQ ID NO: 6798364 - DNA, 98 bp, Homo sapiens
tccctgggctcccagcctctgggctcacccaaccctgacaccctctatgaagtttcaggacttggggcagagcaacagaggctcattgagccaatgga

SEQ ID NO: 6798365 - DNA, 58 bp, Homo sapiens
gctgattttaattataggaggtccttgttatccaaagacaatttatgttagggtcagc

SEQ ID NO: 6798366 - DNA, 78 bp, Homo sapiens
ttgccccagttatccagcatgctgtctacacgctttcctgcctcaagacagccaatgctggaagatgctatgaggcaa

SEQ ID NO: 6798367 - DNA, 56 bp, Homo sapiens
ctcaagtcaatacatttctacgagtggaaagacaaagttgagaaagttgatttggg

SEQ ID NO: 6798368 - DNA, 102 bp, Homo sapiens
ttctttgatcatttctcctgggtggattgggaaagaagtcctagctgaggcaattgcttctgggctctctttctgtgtgcctggtaaatgaaacacaaggaa

SEQ ID NO: 6798369 - DNA, 63 bp, Homo sapiens
tatgtggcagagttcaggcgtttggctccgtaatcatggtttcaaacacaagtttgtcatgta

SEQ ID NO: 6798370 - DNA, 111 bp, Homo sapiens
gggcagatctaaggacagcttcttgttacctttcctaggtttacagatactctcattatattttgaaagtttggagatgggaaaaaggaggtagtgtcaatagagctggcc

SEQ ID NO: 6798371 - DNA, 67 bp, Homo sapiens
aacagagctggtaagtggtagaggcctaaattcaactctagaaatctgtgctttcaaccagtctgtt

SEQ ID NO: 6798372 - DNA, 60 bp, Homo sapiens
gccagtctctgtgccagatcctgggacaacgtggtcaccactctgatgaatggagaaggt

SEQ ID NO: 6798373 - DNA, 72 bp, Homo sapiens
gggaaaggagtgaatatttgtgaccaaaagggcaaacagtggccattgtctgtagatattcactccttcccc

SEQ ID NO: 6798374 - DNA, 72 bp, Homo sapiens
gcagaccagaccagagtttactatttgcagtggaattaataaccacatggaaactttgcctttggtatctgc

SEQ ID NO: 6798375 - DNA, 66 bp, Homo sapiens
ggggaggggtaaagagaaagtgaaactggagggagggaggtttctgcttctcagaccctgaacccc

SEQ ID NO: 6798376 - DNA, 130 bp, Homo sapiens
gtggctgcattgtgtggaaatgcggagggaggccagtctcaccgggagcttgggagtggccatggcccttcagagaagcccggatgaaggcatggggcctggcctttgcacatttgcactaagcagtcat

SEQ ID NO: 6798377 - DNA, 65 bp, Homo sapiens
gcaagggaggatttgtgcccaccctgctgtggctctcatgccactcagaggggatgcaatcttgc

SEQ ID NO: 6798378 - DNA, 82 bp, Homo sapiens
tgggcgaggtgaggccacccttgggttcggaggccggcgcgggaggcggcggtggcggaggcgggggtggtggcgccgcctg

SEQ ID NO: 6798379 - DNA, 103 bp, Homo sapiens
ggcaagtcatttcacttaagtagggctcagggtcaccatctgtctatacagcaaaagtctggaccagatggcctttgaggcccatcttaacagtacctctgcc

SEQ ID NO: 6798380 - DNA, 57 bp, Homo sapiens
ggacttctctttgggttgtgtgttcagggacctggctattcaccgtaagaggagttc

SEQ ID NO: 6798381 - DNA, 68 bp, Homo sapiens
ggtaagggcgaggggaaggcaagcaaacctgagagaaggagaagcctctgcctgcccctgctttttcc

SEQ ID NO: 6798382 - DNA, 62 bp, Homo sapiens
ttcagtttgaattctgtagaacagactgctaagaattgttttttcacagatctctaactgag

SEQ ID NO: 6798383 - DNA, 129 bp, Homo sapiens
ttaattatttttcttaggtgtatattacatatatgtatgtgtatatgtgtggtacatatattgtctcaggtgtatattacataaacatgagtgaatattcttagaaaaaatattcttacaatatattaa

SEQ ID NO: 6798384 - DNA, 58 bp, Homo sapiens
aacctttgttgtttatagtggttgaaattatcttctcgaatactgtggatcaggggtt

SEQ ID NO: 6798385 - DNA, 65 bp, Homo sapiens
ccagcaggagcagtcagactccttaagccatcctgaaggagtgaaaacaggctgctcttgtgtgg

SEQ ID NO: 6798386 - DNA, 65 bp, Homo sapiens
aagatccttggccctgaatgaagttcccagaccaagggggccacccaggagtcaaagtgactctt

SEQ ID NO: 6798387 - DNA, 98 bp, Homo sapiens
tttaaaaactgagcgatgcatccctgaatgggtagatccctttacaaatgtaaataagggtctctccctttagttattttgtcactcagtgatttaaa

SEQ ID NO: 6798388 - DNA, 60 bp, Homo sapiens
ttgtttctgagtgagtgtaggcctgacccttgggcatggctgaacattactcatagtcaa

SEQ ID NO: 6798389 - DNA, 74 bp, Homo sapiens
agtttgtgtgtatatactgatgtaaaactctccatggctccatggctgggcttttagtcagatttcaccaaatt

SEQ ID NO: 6798390 - DNA, 66 bp, Homo sapiens
cacaggcacccctgactgctcaatagctagaaatgaatttacagcggggagaggcagcggtttgtg

SEQ ID NO: 6798391 - DNA, 84 bp, Homo sapiens
ttaccaagtattgtgtttaaaaaaacagttgaggagatgtgattcctctgctgtgccttaaaatgcaagttgatacttacgtaa

SEQ ID NO: 6798392 - DNA, 55 bp, Homo sapiens
tgtgctctgaagagtgcatgtcacaatactgtcctgacacacctgccatagcaca

SEQ ID NO: 6798393 - DNA, 76 bp, Homo sapiens
agcaggaagtaggtagaaatgcattcacgttctagaatttagctctgggaactctgtcatttccctactcactgtt

SEQ ID NO: 6798394 - DNA, 99 bp, Homo sapiens
aagaacattaagcaaacatcttagccatagagttataaatatgtcaggaatacagactttcctgccgctctatgagcagaatgattgttccatgttgtt

SEQ ID NO: 6798395 - DNA, 72 bp, Homo sapiens
ttggctattatgaataatgctgctataaatgtttgtgtacaggccattcatattttagcattaattagtcaa

SEQ ID NO: 6798396 - DNA, 62 bp, Homo sapiens
ctgccttttgggggtggagggggtgctcctgttgaagagtccttttccactcctcaaaacag

SEQ ID NO: 6798397 - DNA, 80 bp, Homo sapiens
taccatctaaccaagttctggacaggggaatatgagcagaagtcatgtaatcaaattccaggctgtgttcttagatggta

SEQ ID NO: 6798398 - DNA, 55 bp, Homo sapiens
tactataccctctaacacctttcaaaagaaagtcccagccttggaggatgtagta

SEQ ID NO: 6798399 - DNA, 89 bp, Homo sapiens
cacagtgtccctcgttccctgccctgcttgatgacagcgagctggaagagtcgctgaagcagtgtgcaggccaagcgaacgccactgtg

SEQ ID NO: 6798400 - DNA, 82 bp, Homo sapiens
ctgttgttaaaacctgcttccccactgctcagcctgccatcagccatccagctgcagagcagtggagagtaggtctcaccag

SEQ ID NO: 6798401 - DNA, 94 bp, Homo sapiens
tgtggctgatgtggcctgtgtccttgtgacattctggcttgcaggtcaactggaagctggagagtttcacagatgatgctaactacaaagccca

SEQ ID NO: 6798402 - DNA, 78 bp, Homo sapiens
accttgcaatgacagttggaatgacattagactctcaaatgagagactaagaagttttaactttgtctagtagatggt

SEQ ID NO: 6798403 - DNA, 72 bp, Homo sapiens
ggatggctttccggactttggccaggatcctcctagtaaccccttggcccaagcccgggacggccactgtcc

SEQ ID NO: 6798404 - DNA, 66 bp, Homo sapiens
tctcagtttcctgtctcgttattttcagctgctgaaagcagtgaaggtggcataggagagatggga

SEQ ID NO: 6798405 - DNA, 68 bp, Homo sapiens
tggtgagaagttttgagattctggaaatattgctttcaatggcaaaaatttcaattacttttgcacca

SEQ ID NO: 6798406 - DNA, 60 bp, Homo sapiens
gcaagtatcttcaaactgcctcgaggacaaactgccttgaggagtacaaagcatgcttgc

SEQ ID NO: 6798407 - DNA, 102 bp, Homo sapiens
ttgagatggggtcttgctctgtcaccaggctagagtgcagtggcacgatcttggctcaatgcaacatctgcctcttggtttcaagcaattctcctacctcag

SEQ ID NO: 6798408 - DNA, 83 bp, Homo sapiens
aatgaaagcaaaatgtttagaatcattcaaaagtttgcaacagttgaaatgatatttgaaggatctaatagttgtctttcatt

SEQ ID NO: 6798409 - DNA, 95 bp, Homo sapiens
ctgggtgttacacagggaggccatccgagtttcactgttagtgttttttaaagtgatttcctggcaccctacaaacagtagcattttaatcccag

SEQ ID NO: 6798410 - DNA, 60 bp, Homo sapiens
acagagaaagtgggctgaagatttccaaacatttttcactctcacctactatttctttgt

SEQ ID NO: 6798411 - DNA, 57 bp, Homo sapiens
gggtttctaaatgttctgagtttttattctaagggccattgatgcatttagaaactt

SEQ ID NO: 6798412 - DNA, 70 bp, Homo sapiens
cgttcctgctaacattgctgtaaacctgaaaacaactgttatacgtttatgagcaatgctgaggggaatg

SEQ ID NO: 6798413 - DNA, 103 bp, Homo sapiens
ccattatcagttttgtttgccagattttcatgttccttgttaagtgaccaaccaggatataaacaattacatggacattgaagagtaaacacactgataatgg

SEQ ID NO: 6798414 - DNA, 68 bp, Homo sapiens
cctgggcagcactgtcttgtcttaggactcagaaagtccagtcctgagatgagacagtgctgcccagg

SEQ ID NO: 6798415 - DNA, 87 bp, Homo sapiens
cgggcccgcccgcgcggccgggcagcggcgtggccatggtggcggcggctcgcggcctgcgctgctcccgacggcggcccgggctcg

SEQ ID NO: 6798416 - DNA, 66 bp, Homo sapiens
tggaaagaggttactcaaggctctgctgggaaccaacacacttagttatgcagtacctactttcta

SEQ ID NO: 6798417 - DNA, 56 bp, Homo sapiens
ggaagagattctttacattcattttacagttaatgaagagtaagaggaccttttct

SEQ ID NO: 6798418 - DNA, 68 bp, Homo sapiens
tctcattgcagcggctattccattattatcttcaatatactgatgaagagtaccactgttagatgagg

SEQ ID NO: 6798419 - DNA, 129 bp, Homo sapiens
gtttaataagtgtcaggcactgttctaagtccttataaaatttctgtgaattgtatagtgggataataataatacccacttcacagaaattttatgaggacttagaacagtgcctgacacttattaaac

SEQ ID NO: 6798420 - DNA, 68 bp, Homo sapiens
ctgacactggcagctgggcactttttaattagtagaattagaagagtgcttaaagctggctttgtgag

SEQ ID NO: 6798421 - DNA, 67 bp, Homo sapiens
gtgcacttctgccctcttgggagcttgcaatttagttgaggagaaaaatacagaggcagacatgtat

SEQ ID NO: 6798422 - DNA, 65 bp, Homo sapiens
tcctcatctctctgcctgccactgttcaggctcctggggccccacgtggatgggcggacacagga

SEQ ID NO: 6798423 - DNA, 74 bp, Homo sapiens
atgctaaagtattgacagagggtcagaagaggggaaggagctggtccttcatccccacctgtctatgctagcat

SEQ ID NO: 6798424 - DNA, 79 bp, Homo sapiens
gcatgtagcaaggactgtttctaaaaccatgtaggctaaaatgtcatactacaaggcagttaaaatggttaatatgtgt

SEQ ID NO: 6798425 - DNA, 73 bp, Homo sapiens
ggagatcgtcagtgtatgctgtgggtatctgtgtgctaaaaaacacagtcttatgcatacactattaagttcc

SEQ ID NO: 6798426 - DNA, 81 bp, Homo sapiens
ggatattcaaagattactgatatgcttttattcaaaagaaaagtgtagagtatcacatgtccctaatctttaggatagttc

SEQ ID NO: 6798427 - DNA, 83 bp, Homo sapiens
agctagtccccagaatgcaaatgcttctacttggaatgttctttgactcaacaaggcagcatctgcatattgggagacctgct

SEQ ID NO: 6798428 - DNA, 61 bp, Homo sapiens
ctaatgggcctgtttcccttcagggccttgaggggcctggatggtaaatgaggccccttgg

SEQ ID NO: 6798429 - DNA, 91 bp, Homo sapiens
gtatccagttttgtcttaggagagctgttcaaggaagatagagaaagtaagaattttaaagtgatgctctcctaatatgaaaactgagtac

SEQ ID NO: 6798430 - DNA, 68 bp, Homo sapiens
ctagtctgcagtcagctgcctattatctaggcagttctgcttctgagggttggctggctgtaggctgg

SEQ ID NO: 6798431 - DNA, 96 bp, Homo sapiens
gttgcttttcttatttggcaaatgggtttttgtactttacgtctgtctgaggtttataatatgctgaggtcatttccaagtgatttttcaagtgat

SEQ ID NO: 6798432 - DNA, 83 bp, Homo sapiens
gctcgcttttttgcaagccttgggtgtgggagggtaattaagatgccaacggtcctacactcaaggcatggaggagagaaagc

SEQ ID NO: 6798433 - DNA, 55 bp, Homo sapiens
gacactacgtggctcacatttcagacacaatgaaaagcaggtccatgctggtgtt

SEQ ID NO: 6798434 - DNA, 60 bp, Homo sapiens
catgtgcacagtgctttttcccaccaaggcacagtgatgggaaaaagcactgggcatttg

SEQ ID NO: 6798435 - DNA, 70 bp, Homo sapiens
tatttggagtgcaacacatgccaccttagaccattagtgctcccagtggcctgtgctgtctccccaaata

SEQ ID NO: 6798436 - DNA, 56 bp, Homo sapiens
agccacagagcaggagaccttttccaagcagagagggtcttcctggcactgtggtt

SEQ ID NO: 6798437 - DNA, 56 bp, Homo sapiens
tacatttatcgaaacttgttctgtggcccaacatagagtttgtagtggtgaatgta

SEQ ID NO: 6798438 - DNA, 59 bp, Homo sapiens
gtaaatgtgtggcctgggagaatgtgttggataattctcatcttaggttgtacatatat

SEQ ID NO: 6798439 - DNA, 61 bp, Homo sapiens
ggagtcagaaaacttgggcttcattggcaccagcttagctgccagtccaatccttgattct

SEQ ID NO: 6798440 - DNA, 60 bp, Homo sapiens
cctagaggctgcaaggagaggctgtaaaatcctcctaaccttgcttccagccttcctagg

SEQ ID NO: 6798441 - DNA, 120 bp, Homo sapiens
cacagcataggaggcccaagaacctttctgcaccgttacagcaagagtctgtgttcactggtgtgacctcatgctgtctggtgttaaatggtttaaatacccaccctatgtattactgtg

SEQ ID NO: 6798442 - DNA, 99 bp, Homo sapiens
gagtttgaggaaggaacagcaggtctttcttcagagcttggactcaaagaacttcagtttaagccctgaagaaagagctgctgctccttcctcaaactc

SEQ ID NO: 6798443 - DNA, 97 bp, Homo sapiens
gattaggcgggaaggtgttcgtcttttcttactatggttgcaagctcttcagaataactgtagcaaagaacagctctggatgttttcatgcttaatc

SEQ ID NO: 6798444 - DNA, 56 bp, Homo sapiens
ggaaggcagtgagttcagccctgtacccgacatgtggggcagagctcctgctttct

SEQ ID NO: 6798445 - DNA, 82 bp, Homo sapiens
tattgggttcgtgcaagagtgattgcagtttttgtaatgaaaatatggcaagaacctcaattatttttgcaccatcctaata

SEQ ID NO: 6798446 - DNA, 81 bp, Homo sapiens
aagtctgtattggaagatagggaatagaaagtctgccataataggcttcctaatactccctacacttagcgatacagactt

SEQ ID NO: 6798447 - DNA, 86 bp, Homo sapiens
gagtaagaaacatatcagaatctacatgcaatatttttagggggaaagcctttgttttcattgattgtagagatgattttttgctc

SEQ ID NO: 6798448 - DNA, 61 bp, Homo sapiens
ggccttctggagtggagctgatcattttaatatgctaatatatcatcaccattttgaggcc

SEQ ID NO: 6798449 - DNA, 79 bp, Homo sapiens
tggcaattgcttttgctaggaacaacatgatagagaattgattttttaaatgtgttcttagtagctaaagctaccacca

SEQ ID NO: 6798450 - DNA, 60 bp, Homo sapiens
gtgggccaggccggagtgcagatgggcaatgcctgctgggagctgtactgcctggagcac

SEQ ID NO: 6798451 - DNA, 61 bp, Homo sapiens
acataacatgtcaatcacccgattctgggcggctgagtcgggaggtgacgggcatgggtgt

SEQ ID NO: 6798452 - DNA, 102 bp, Homo sapiens
tgtgaattcttagctctgccaggagaggctctaactctgtgtttttgatagacgggaaaggctacagtttctcttgttcctttgcagagcgtaaaatttaca

SEQ ID NO: 6798453 - DNA, 89 bp, Homo sapiens
gcatgtgccatgtagtatatatgtgtgaacatgtatggtgtgttcatatgtgtgcacatatgtatttttgtgtgttgtgtggtatgtgc

SEQ ID NO: 6798454 - DNA, 80 bp, Homo sapiens
caccctgcaccagctcctcctcagtcaggtctagggtcctgcctctgtcccagtggccacctggctgtgggggcagggtg

SEQ ID NO: 6798455 - DNA, 55 bp, Homo sapiens
tcccgacctggtgccattatccccataaacagatgaggaaaccaaggctcaggga

SEQ ID NO: 6798456 - DNA, 56 bp, Homo sapiens
cagcgagaagaaaatggtctgtggagtcagacattacagattttatatctctgctg

SEQ ID NO: 6798457 - DNA, 55 bp, Homo sapiens
cgtggctcacgcctgtaatcgcagcactttgggaggccgaggcaggcggatcacg

SEQ ID NO: 6798458 - DNA, 64 bp, Homo sapiens
cgagtatgtgtaggaggaggacagggtgggaccatagactttgccaaaagctgcaggtggatcg

SEQ ID NO: 6798459 - DNA, 91 bp, Homo sapiens
ggcgtccaatctcattggtttgcctttctgttcgtcaggcttgggcgcctggtgaaaggcagagagcgcgtcactattggggctggaggcc

SEQ ID NO: 6798460 - DNA, 92 bp, Homo sapiens
tgcctacagggagagaatgtgttggtcaggatgaagccaacatctggtccacttgacacttatattactcactgtaaattaatgaactggca

SEQ ID NO: 6798461 - DNA, 57 bp, Homo sapiens
gccctcctggcctgtgcagagccccgcttgggggtcctgcgtgggcccaggacaggc

SEQ ID NO: 6798462 - DNA, 66 bp, Homo sapiens
tgttttctgtgtggaaaggggagcgttgaatatatctctgatgcttctgttacataccagaacata

SEQ ID NO: 6798463 - DNA, 58 bp, Homo sapiens
actctgagaaaacactatgctgtctggttaacccatcaaaaggtgtgagtttcggagt

SEQ ID NO: 6798464 - DNA, 97 bp, Homo sapiens
ccaatagttttgctctactttcacatggactttttgttctagcttctctcatctttctctggaatgttaattgcatgtgaaatcagatagtaattgg

SEQ ID NO: 6798465 - DNA, 67 bp, Homo sapiens
cctctaccctggtcatgacaggcagcaatcacagaccacagactctccctgctgagccagtgtgagg

SEQ ID NO: 6798466 - DNA, 58 bp, Homo sapiens
ctgtatctgtcagctggtctcgagacgtctgtgtttttcctgctcagcatagttacag

SEQ ID NO: 6798467 - DNA, 74 bp, Homo sapiens
tatgtacaagtttttgtgtgaacatgttattgtttcactatgtatgtatcatttcacacataaacttgggtata

SEQ ID NO: 6798468 - DNA, 121 bp, Homo sapiens
ggaacctgagtgttaagtaacttgcctgcagttgtagaatttggatctcggcagtctggctctagggatctgtgctctgaaccatgattctattctgcctgttacactgccattgggttct

SEQ ID NO: 6798469 - DNA, 85 bp, Homo sapiens
ttggcagaggaaactgttgatctcagttagctagaaacagctgcttttctatttttatttgtagttaatgttttccaagtgtcaa

SEQ ID NO: 6798470 - DNA, 121 bp, Homo sapiens
cccattaggagagggtggcaggtttgcttcagtaatggtagggctgtcattatcatcaccattgctggaatggcacctgctatatactgagcacctgcttgggccagactctgtcctaggg

SEQ ID NO: 6798471 - DNA, 68 bp, Homo sapiens
tgaatggatttttcactcatgcatgattttgtaacatcttgcattggtcatttgaaaatatcagttca

SEQ ID NO: 6798472 - DNA, 74 bp, Homo sapiens
gctgtagttattggtgaacttattatgtgtgtgttcatatgttttaatcaaaatgatttcatgatgatagcagc

SEQ ID NO: 6798473 - DNA, 74 bp, Homo sapiens
aaggaggcaattctataggcaagctatttttatatataacttaaaggagaaaaaactaatggaatagcttcctt

SEQ ID NO: 6798474 - DNA, 108 bp, Homo sapiens
ggcccaggaatccacatccgctctctgtagcaactactcaactctgccattgtgggaaagcagccatggacagtactgagtggactaggatggctgtggtcacgggct

SEQ ID NO: 6798475 - DNA, 55 bp, Homo sapiens
agccagagagcggggcttagggagactggccttggagatgccccactccctgtct

SEQ ID NO: 6798476 - DNA, 88 bp, Homo sapiens
ggccgcgagcggcgtgacagctgccagctcaccggctcagacggtcgccgccgcgtttgcgcagggggagctggtcgccgccgcggcc

SEQ ID NO: 6798477 - DNA, 97 bp, Homo sapiens
gatttagtacgattgctaataagaacaactaaggtttattgagcacttaccatgtggcagataaattcatttgtttgtattaatttgtattgtaatc

SEQ ID NO: 6798478 - DNA, 60 bp, Homo sapiens
gcttctttcccaggcatgttttagtctagaactgagtagtaatattttgggaaatgatgt

SEQ ID NO: 6798479 - DNA, 74 bp, Homo sapiens
gtctccaaccagaggtatggcactatcctctctgatagcaaatcaagagcacagtgctggcatctggtgaagac

SEQ ID NO: 6798480 - DNA, 95 bp, Homo sapiens
acagagtgcattacacagtaactggcgtgtagtaaatgctcattaaatgttattttattaaacgttaggttttattttatgataatttattttgt

SEQ ID NO: 6798481 - DNA, 88 bp, Homo sapiens
taggaggctgcttctctgcagatctcccatgtgctgtcctagacatgtccctgtggaagactgccagagtcgcagataacaccttcta

SEQ ID NO: 6798482 - DNA, 105 bp, Homo sapiens
tcagaagtcgaatggcccttggcaatgctctttaacctattctgaagaagttccctttaagttatgaagtaggttaagagcagtagaccaatattttgtttctga

SEQ ID NO: 6798483 - DNA, 69 bp, Homo sapiens
cgcgctctttgatggcttcactgtcctggacaccccctcagatctgtgctgtctcagagaaagcaagcg

SEQ ID NO: 6798484 - DNA, 65 bp, Homo sapiens
tgtgtgatcttagacaactcactgtatgtcccagagacacatattgacttgcctaagatcacaca

SEQ ID NO: 6798485 - DNA, 129 bp, Homo sapiens
caggccactgtgggagctgtggtgctgtgccagtgaggtgagtagtgagaagcccatcttgcagaccccacagacgaagggcttctgctcagcctgcacgcactggtgctccagcaggtcagtggcctg

SEQ ID NO: 6798486 - DNA, 57 bp, Homo sapiens
ttagtgtaaataactgcctagacaagtaaattattcttgctaggtaacctgcactag

SEQ ID NO: 6798487 - DNA, 96 bp, Homo sapiens
tcccttttctcagcgggtgaacgagtgagcagtacttactcctgcttttgtagaagcaagggtggctgcttaactctgagctgctggagagaggga

SEQ ID NO: 6798488 - DNA, 82 bp, Homo sapiens
ctgaaaatacaatagcttttcattgctcttaggatacaggatcatgctgtgtctgatgtctgaaatgctcttgtctctttag

SEQ ID NO: 6798489 - DNA, 101 bp, Homo sapiens
ggttgtgtgacaaggacctggttttagctgaactaaggagcaaagttctcaacacctttgcctcctgagtagctgggattgcaggcttatgtcactatacc

SEQ ID NO: 6798490 - DNA, 59 bp, Homo sapiens
atgttatgtccctcttactcagcaacattttctcttgctgcgtcagttggccgtgatgt

SEQ ID NO: 6798491 - DNA, 67 bp, Homo sapiens
tcaactacatagaaattagtatttgccataaaaggtacagatactatggaattttatgagaggttga

SEQ ID NO: 6798492 - DNA, 61 bp, Homo sapiens
gatttgtgaaggagcttcctctatttgggaagtccccagccagggaaactttttcttaatc

SEQ ID NO: 6798493 - DNA, 70 bp, Homo sapiens
aggagctggtggggaggaactgggagagcctgggccagtaggcttccctgcctcacttattctcagccct

SEQ ID NO: 6798494 - DNA, 110 bp, Homo sapiens
taatatgagagacttgttagaccttaaatataaggtggcttttttcccgatggataatttttggtggaaaagttcatcatatattcaggcataaattgtgtctcatatta

SEQ ID NO: 6798495 - DNA, 88 bp, Homo sapiens
gatgagaaccttctcattctccatctggccagagataaaacaaaactagctggctggaggaggaagtgtgagggcttggcttttcatt

SEQ ID NO: 6798496 - DNA, 66 bp, Homo sapiens
ggtcccaggcccaggggtctggcccactgctcctcctggggtggtgctgtgagccccttggcctcc

SEQ ID NO: 6798497 - DNA, 63 bp, Homo sapiens
cctgtcacccaggctagagtgcaatggcatgatctcggctcaatgcaacttctgcctcccagg

SEQ ID NO: 6798498 - DNA, 129 bp, Homo sapiens
ggagcctcattcacccttgcctttgttttcatttctcctctccagagtgcagtgggggccctcccagctacagctgcgcttctggaaggagcttattgataggcacagagtatgggtgagtcttcatcc

SEQ ID NO: 6798499 - DNA, 65 bp, Homo sapiens
gtattctggtaaatattcgttgagtgtttagcaatttctcgagcacttaactgtgtgccaagtac

SEQ ID NO: 6798500 - DNA, 78 bp, Homo sapiens
gagtctgatttgcttgctgagaaactccagactagcttaatggagctgcattggacagttgtagccagcagaggtctc

SEQ ID NO: 6798501 - DNA, 79 bp, Homo sapiens
gcatgggccataaacggatttaagaggctgctagagtatagaatttaatatagttagcatcattaaatagtggcacagc

SEQ ID NO: 6798502 - DNA, 80 bp, Homo sapiens
acagatcaatccatactcagaaagtattgcagaaaccagaaaccaaaaatgtttgtagacagcactgagatgggttctgt

SEQ ID NO: 6798503 - DNA, 90 bp, Homo sapiens
gcttaaagttctccctccaggcccagggccaagagcgcctcacaaagggctgctgccttgaacttggcctggggaaatgagaccctgagc

SEQ ID NO: 6798504 - DNA, 66 bp, Homo sapiens
gtggtactttggttgcagcactagatacctaatatccctatatagtgcttaacacaaagtgattgc

SEQ ID NO: 6798505 - DNA, 79 bp, Homo sapiens
ggagataggaatttaattgaagatcttaaatgctgatagaaagtgggacaagggatcataattgggttcaactatcttt

SEQ ID NO: 6798506 - DNA, 102 bp, Homo sapiens
gctatgaccaagtgtcagaaacagggaaggcatccgcgaatgtccagctatgtggcatgaatgtgttgctttctcttttcctaatcaggtcccaaaagtggc

SEQ ID NO: 6798507 - DNA, 92 bp, Homo sapiens
tgggaacagttttctcttggtgatagtctttcttgctcataaaagacaaagagtaggtacaatggcactgcaccaggattataattttccca

SEQ ID NO: 6798508 - DNA, 60 bp, Homo sapiens
atcctagcaggtgcactcctatctttaaaaaagaataaaatgcacagctgtgaataggat

SEQ ID NO: 6798509 - DNA, 62 bp, Homo sapiens
tatgctagtgtccttgtgcttcttctgtatgcatagacacaaatctcagtgacaccggcata

SEQ ID NO: 6798510 - DNA, 92 bp, Homo sapiens
tgctattttagaaatagcagtttttcactgatatagaggtagtctgttctgactattagaataaaatgtgaacaattctgaataaaaaagca

SEQ ID NO: 6798511 - DNA, 85 bp, Homo sapiens
tggttctttctttccacaagtgtttagagagggccttctggaggccagctgctgtcctaggcactgtaatgaaaagaggaaacca

SEQ ID NO: 6798512 - DNA, 56 bp, Homo sapiens
tgcatactgaatctgccatcacatcattaaatgacaccagtggcaattagaatgca

SEQ ID NO: 6798513 - DNA, 130 bp, Homo sapiens
gggggacatgacagagcatgtgtcaaggggatcagtcggctcctgctcagggctctgggaccagcctcaggaaggaagcagggagcccagggaagggacgattgctttgtaaatcacagcgctctctccc

SEQ ID NO: 6798514 - DNA, 80 bp, Homo sapiens
tttgtatgtgcattgtaaattttgatgtcattaaataacaaaactaagatatttcagatagtgataatagcatgtataga

SEQ ID NO: 6798515 - DNA, 84 bp, Homo sapiens
ttttctattttttgggcttataagagtatatagtgtactatataattagtatttgccaatattctttgtaagcttgataggaaa

SEQ ID NO: 6798516 - DNA, 59 bp, Homo sapiens
ccaagaattcagtcctggctttgttgtttgttggcagagacaggataatgggttcgtgg

SEQ ID NO: 6798517 - DNA, 56 bp, Homo sapiens
agcccagtgggccgaggcggggagtattccataatccaattgcctgctcaggggct

SEQ ID NO: 6798518 - DNA, 57 bp, Homo sapiens
tgtgcatgtcctataactcagtcatttcacatctagagacacaagaagacatgcaca

SEQ ID NO: 6798519 - DNA, 86 bp, Homo sapiens
ctccctgtgttttccatggcttgatagaaagctagttagctcaaggcattagcatagttgtgtatcaggccaggcatataacggag

SEQ ID NO: 6798520 - DNA, 62 bp, Homo sapiens
agtacttggagccttgaatatgtatcaagaaggcacttgatacatattcaacgttcagtatt

SEQ ID NO: 6798521 - DNA, 129 bp, Homo sapiens
aagctattacagaactgaatacgaataaaattctgcctggtttatgaagattttaagagaagttcacatttaaatttctacgtgatccaggggacctattgtaaacagaaaaaaatgccacaatagctt

SEQ ID NO: 6798522 - DNA, 66 bp, Homo sapiens
tgaatggttctgacaagctgggatggtttatcctgagccttcccatctgtggacaccttgcattca

SEQ ID NO: 6798523 - DNA, 115 bp, Homo sapiens
gaatgttcctcccacctcctcacttcaggctctgttattctagagggctggcctggttacaagggtagccagattaactagggtctaaatgggagagctggggcacggatcattc

SEQ ID NO: 6798524 - DNA, 83 bp, Homo sapiens
gtctggggattggtgacaatggcaacagcatctcaatcttttcctaagagatatctgagccttattcaccagccctcatagac

SEQ ID NO: 6798525 - DNA, 62 bp, Homo sapiens
taggtagggaaatggttcctgtctgaaaagcaaagggaggaaagccaatctctcttgaccta

SEQ ID NO: 6798526 - DNA, 56 bp, Homo sapiens
ggtccttggcgaatcattccagtgagcagaaagctgggatttcaggagctaggatc

SEQ ID NO: 6798527 - DNA, 123 bp, Homo sapiens
aggaaactgaggttccaaaagctaagtgaatggatgaacaagtggtagggtcaggattagaatccatgtccacctgaatccaaaaccagtgcattttccactaggcatgtggctcattttcct

SEQ ID NO: 6798528 - DNA, 55 bp, Homo sapiens
ttccgctgaaaaatctataggcattcccaattcctgtggagttccatcaggggag

SEQ ID NO: 6798529 - DNA, 120 bp, Homo sapiens
tagattccattttactaattatttcttatgtcaaatttgtgcccacattcaaaaggtgatgaaggccaaaacctctatcgcatttttttatgtcaacagtaacagataaaatgtgatcta

SEQ ID NO: 6798530 - DNA, 60 bp, Homo sapiens
tgttaccaaggctgcttctagtggccttcggcggtctccttgggagtttccatggtaaca

SEQ ID NO: 6798531 - DNA, 89 bp, Homo sapiens
tgagattgacaatctcacgtgtgtctttgttccaggtacgagagtcaacactttgtatgttgggtcaaagtacatgagtcccaatctca

SEQ ID NO: 6798532 - DNA, 72 bp, Homo sapiens
gagggtggcccgtgttcgtctttcccagctttgtggaggtgtagctgggcctgtgggcacacggacgccctc

SEQ ID NO: 6798533 - DNA, 72 bp, Homo sapiens
acttggatccgtttatactgagtttgatgaagtggataggcattgagaagtatgaatggattttttaaaagt

SEQ ID NO: 6798534 - DNA, 60 bp, Homo sapiens
atctgcctggcctgcaagctaaaaatctaagattgcttggatgactgacaggctggagat

SEQ ID NO: 6798535 - DNA, 65 bp, Homo sapiens
actcaaggcaagttaacaaatctgtttgaacagctgttggaactagagcttccagcttcttgagt

SEQ ID NO: 6798536 - DNA, 84 bp, Homo sapiens
cctgggctatcagcttagggctctgcttctgtttttctgcctgctgggaggtgtggaaacagagagggcaacagctagcttggg

SEQ ID NO: 6798537 - DNA, 74 bp, Homo sapiens
ttgaagggagaaatatgtaaagaaagacaagcctcttactgaacaggtggactctcattgccttcactcttcag

SEQ ID NO: 6798538 - DNA, 81 bp, Homo sapiens
atgtgtgtgtgtatatatgtaaataagtctaatgtatacttataatctatatatttgtatttcgtgtgtgtatatgtatat

SEQ ID NO: 6798539 - DNA, 78 bp, Homo sapiens
tcacactgagtcctgagaacattctaatttggaagtcacataaaagagaaaaacaggtgtcatgggagtcagaagtga

SEQ ID NO: 6798540 - DNA, 129 bp, Homo sapiens
ctgccctgggccacctggatccccctgctgggctctgagcagggacatgactggtctctgtgcaggccgcagggcagcttagtccctgtcacagccccagaatgatcgcccccaccaggcccaggtcgg

SEQ ID NO: 6798541 - DNA, 83 bp, Homo sapiens
gccaagaccccagcagccacagcagatctgagtcagggccctcccctttcctttgctctcttggtggctgtcctgggattggc

SEQ ID NO: 6798542 - DNA, 61 bp, Homo sapiens
gccctccaagcttcatctcaaccagaagtaaaacaggcttgtggttgtgtgctttgagagc

SEQ ID NO: 6798543 - DNA, 64 bp, Homo sapiens
ttggcattacaggaactggatataatgtgagattgttttcttcattaatttttccagatgtcaa

SEQ ID NO: 6798544 - DNA, 65 bp, Homo sapiens
aggccagatgtcgggctagaagtacaatcccatatcttatgaatttgtagccttttatctatcct

SEQ ID NO: 6798545 - DNA, 67 bp, Homo sapiens
gccgcaagttctcactctcctccatggggcagcctgcagaaaggaggggtgggaatgcagagcaggc

SEQ ID NO: 6798546 - DNA, 78 bp, Homo sapiens
tctgcctcttttctgtatgtgagagcagagaatcgtcactgacagcctctcccaggtcatacacagagaggaagtaga

SEQ ID NO: 6798547 - DNA, 56 bp, Homo sapiens
gcacacttgcagggtatgctcgggcacccgtgtccaagaggagcaggcaggtgtgc

SEQ ID NO: 6798548 - DNA, 78 bp, Homo sapiens
gggcctcagttttctcatctgtaatttgccttgcacaatcttggcaaagattagataagatagatttgtgaaggcacc

SEQ ID NO: 6798549 - DNA, 74 bp, Homo sapiens
tatggagcacaagatggaatattgagaaaattcaataaggatttggggtctcacatgatctgtctgacttcatg

SEQ ID NO: 6798550 - DNA, 123 bp, Homo sapiens
cctttcctcagagctgtttatgcttatttttaaaaaattgtcacagaagcttgacttatgtggtcatacagcaggttacagtggcacagagataacagcatatagtagaccctgagagagagg

SEQ ID NO: 6798551 - DNA, 69 bp, Homo sapiens
agtccctctgtgtgtgcatgcatgcgcctgtgtgcaaacatccgcatgtgtaggtacatatagataact

SEQ ID NO: 6798552 - DNA, 58 bp, Homo sapiens
aggggaacccctaaggtcacccctcagccagggggaactgtttaacaggggtttgtct

SEQ ID NO: 6798553 - DNA, 129 bp, Homo sapiens
tatgaacaaggggccacgctttttttagtttgcactggaccctgcaaatcaggtgtctggttctggatgggagtaatacttaccttgcagagtctatgagaactcaatgagataatgtctaaaagtcta

SEQ ID NO: 6798554 - DNA, 72 bp, Homo sapiens
tgaagtaagcatgggaatcccacagggtacaaggtcccgcatacccttctgggatttccgatgccctctttg

SEQ ID NO: 6798555 - DNA, 67 bp, Homo sapiens
agcactgtatataaattgtcagttgtgtattatatttatcactaatggcatcctttatctgcaggct

SEQ ID NO: 6798556 - DNA, 64 bp, Homo sapiens
tattagctccagtactgttgccatgccattcactctaggctgcagttttctaacagagctaata

SEQ ID NO: 6798557 - DNA, 56 bp, Homo sapiens
aggtggctcctcccatggctggcagttgatgctggctgttggcgaggagctcagct

SEQ ID NO: 6798558 - DNA, 77 bp, Homo sapiens
tggctgctaggaagctcaaagccatgatgtaagtttaagcacagttactgtcttggtttagctttctgggacagtta

SEQ ID NO: 6798559 - DNA, 78 bp, Homo sapiens
tagagtgaactatgagaaattgctgatatttgaccatttttgacctaaataaatggcaattttgtatggttcaaacta

SEQ ID NO: 6798560 - DNA, 91 bp, Homo sapiens
tccccagtggcaatgtttcagtcttttaactttctgccattagactgcctttccttctggtacagagatgtgaggcttaaatgactaagga

SEQ ID NO: 6798561 - DNA, 76 bp, Homo sapiens
gctttgcttataggaactatatgtcttaaagcttttctgaatccttaaagcatgaagtatagttctggagccttgt

SEQ ID NO: 6798562 - DNA, 58 bp, Homo sapiens
tcatctgaaattgtatatgtagtgctaactttggtgctaatgtatctttttcatatga

SEQ ID NO: 6798563 - DNA, 62 bp, Homo sapiens
ctttcacacagaatctgaggagctggcatttatttttgacagcatctcaaatcttgtgaaag

SEQ ID NO: 6798564 - DNA, 88 bp, Homo sapiens
ggagaggagatggggattgtgtaaatatctaaatgtttgaaacagactttcaaataatttgcctattttacctcctcatcttctctct

SEQ ID NO: 6798565 - DNA, 118 bp, Homo sapiens
tgctgagatatttgatgatgtttcaaatatctgaaattattgaaggtgcattttctattagcccggttagttatttttcagatatccaaattttggaaagtcatttggtatacttgca

SEQ ID NO: 6798566 - DNA, 84 bp, Homo sapiens
gctacagagaataataggacaggtgatttatgctggcgcacttgaccttaatctgtccctgttgttctactgaaagttgatagc

SEQ ID NO: 6798567 - DNA, 65 bp, Homo sapiens
agtctttttctctatatcccgctttcttctttttctccagctgcaggagctagagctgaaagact

SEQ ID NO: 6798568 - DNA, 129 bp, Homo sapiens
aaggttttgacttttattttcctgtatttaagtgtgtatttcttgtacttccttgtctataatttattgtgattctggagttaaggatgccttactttaatatttttggaaaattttaagacattattt

SEQ ID NO: 6798569 - DNA, 55 bp, Homo sapiens
cagacagacctgcaagggcacagaccctgaggagggagtgtgcttggttagtttg

SEQ ID NO: 6798570 - DNA, 80 bp, Homo sapiens
tggtaaaatatacataacttacaacctaacattatagctctttgtaagtgtacagtgtagtggcgttaagtatattacca

SEQ ID NO: 6798571 - DNA, 56 bp, Homo sapiens
tgaggctcagagaagtgctgttactggcccaaggtcacacagcgtatctgacctca

SEQ ID NO: 6798572 - DNA, 72 bp, Homo sapiens
taagaatacacattgtatgtttctgtgcacatgacagtgtgtgtgtgtgcacgtacatactgtatagtctta

SEQ ID NO: 6798573 - DNA, 63 bp, Homo sapiens
aatgcagaacttctgttagtactattcatgtttttgctaaatgtgcacacagaaatttgcatt

SEQ ID NO: 6798574 - DNA, 59 bp, Homo sapiens
ggtctactgttggtggaattgacagaattacggaattgttaagagcttagcagtaggcc

SEQ ID NO: 6798575 - DNA, 58 bp, Homo sapiens
gcatgggcagggtggccggtgctcagcagcagcactgggcctggcctcccagtccagc

SEQ ID NO: 6798576 - DNA, 59 bp, Homo sapiens
aggagattggctgaaaaatatttggagtctcctccagccatattccttggtcagcttct

SEQ ID NO: 6798577 - DNA, 74 bp, Homo sapiens
tgtataacattatacagagaggacagtggtaaacttaggactgctgccctttctatatgatgtaattttatata

SEQ ID NO: 6798578 - DNA, 64 bp, Homo sapiens
gctgaccagtgcagggggagttaggaagataaatctcccagactctttccttcattggtcttgc

SEQ ID NO: 6798579 - DNA, 57 bp, Homo sapiens
ctggtggcaaagctaattaggcccaattattacccacctgacctaatttgccatcag

SEQ ID NO: 6798580 - DNA, 59 bp, Homo sapiens
ttgcaggctttagccccatggctgctctcatgggctgggctggtgttgagtgcctgtag

SEQ ID NO: 6798581 - DNA, 55 bp, Homo sapiens
gggagctctccctgaggcctgggctgggctagaggcagggtggggaggggctctt

SEQ ID NO: 6798582 - DNA, 107 bp, Homo sapiens
acaggctgctcttcaacatttaatatatggctcttccaaactgagatatgctgtaatggtaaaattcttcccaggttttgaagacttgagtgttgaaagcagaatgt

SEQ ID NO: 6798583 - DNA, 58 bp, Homo sapiens
cagttgtgccctttgcctcagcagtccattaaaaactgttttgcagagaaggcgactg

SEQ ID NO: 6798584 - DNA, 64 bp, Homo sapiens
ggccatgcgctgggtcatcttgcgctcgtagcggaagggcctggagatggcccagtagcgggcc

SEQ ID NO: 6798585 - DNA, 108 bp, Homo sapiens
gagccagagaagtcctttataactgacttagccagtggagctcagtggactcaatgctgcaagcctaccaaagctgggcagggaaaggcacacagctcttccaggctc

SEQ ID NO: 6798586 - DNA, 94 bp, Homo sapiens
cagagcccatggctggggccacaggccttgcccgcagagcgtctccaccctcatacactcctggggtctcctgtgcctttcaaagccacctctg

SEQ ID NO: 6798587 - DNA, 67 bp, Homo sapiens
gggtgggggctggtggtggtttctccagggttcatttatactgggaccaaattcaccgcccttactt

SEQ ID NO: 6798588 - DNA, 88 bp, Homo sapiens
gtttggaatgcgggcttgtcagccaattgtggatttccttctaatgctggagagaaaggctcagatgaggccctggattcttccagac

SEQ ID NO: 6798589 - DNA, 59 bp, Homo sapiens
gggaaccctatcatggtagaacaggaatctgattttgttattatctgttaggtgttccc

SEQ ID NO: 6798590 - DNA, 63 bp, Homo sapiens
ggcctggctgtttcaggcagtgtccctctctccaggcttggtgggcaggctgagatgccagcc

SEQ ID NO: 6798591 - DNA, 57 bp, Homo sapiens
agctgatacatttcttgtagccacattgaggccctggcacaggaaagctactcagtt

SEQ ID NO: 6798592 - DNA, 70 bp, Homo sapiens
ttgtcattagcagaagacagatgaaaagatcaaaaggtcataataattgatctgctactgctgaaaataa

SEQ ID NO: 6798593 - DNA, 78 bp, Homo sapiens
gctccagctacagtgttattgcaagcaatgtgtatttaaaactaatatacagaaaagtggatagccaggggctggagc

SEQ ID NO: 6798594 - DNA, 130 bp, Homo sapiens
ccctaccttctgagaatcatttgcatgtaatcctctcttatgaaaatttctacaccagttagggttcttggttgaaaataacagaaatatttccaggtgaaggaaagtgcattcaaatctatggtacagg

SEQ ID NO: 6798595 - DNA, 87 bp, Homo sapiens
cccgtttcagtgttccttgcttgcagccatatagatgaagagatgaaggtagccaaagaaagagtaaggaaaacctaatgagaggag

SEQ ID NO: 6798596 - DNA, 57 bp, Homo sapiens
gtgtctggaacgggtggtactcagtcaattatcctatctagcatctgtgacggacac

SEQ ID NO: 6798597 - DNA, 68 bp, Homo sapiens
atagtatcctgtggggaaaagcctatcttttgagccagaaagactggcttaaatcccagtattattgt

SEQ ID NO: 6798598 - DNA, 66 bp, Homo sapiens
gctagaagaggcaggatgaggactagaaccgaggtctgtagatcccaaatcacctgcttattatgc

SEQ ID NO: 6798599 - DNA, 91 bp, Homo sapiens
gtgtccatctgaaagaagggcagtcttttttgaatatgcacaaggcttcaagtcatgggcccagggggctgcatctgtctacagaggacac

SEQ ID NO: 6798600 - DNA, 57 bp, Homo sapiens
cagtcttcaactggactccagggagagggccaccccccttcaggaggttgaagcctg

SEQ ID NO: 6798601 - DNA, 67 bp, Homo sapiens
ttcccactaatgccatcagagaaaactctttctgaatactaatcagaaactctcatgaagtgaggaa

SEQ ID NO: 6798602 - DNA, 73 bp, Homo sapiens
aggagaggggcagggcaggacagtgaaaataggttgatggatctgaaatgattgacctgtttagtctctccct

SEQ ID NO: 6798603 - DNA, 76 bp, Homo sapiens
gggcttagttaaagctgctgaatcctatttctaaaatgcttctggaaaaggtggtaagtcagcagtgttaatgccc

SEQ ID NO: 6798604 - DNA, 129 bp, Homo sapiens
aaaatgactctattttatatcttgaaatgtgtgcagcagagaatccagttagtgtgtgaaatttgtatttttaaatactaaaactactaattgtatagttgatgtaattttaagaaaatcagtcatttt

SEQ ID NO: 6798605 - DNA, 69 bp, Homo sapiens
cccataccagagtaatgtgtggaaattatcttaagagttagtgctttttgcaagttattttggggtggg

SEQ ID NO: 6798606 - DNA, 108 bp, Homo sapiens
ggtctttcaaagttacatcttttgggagaggtagcagtaagaacaggacacacaagcctgaaattattttatttcttctgtataggtgtgctaaaactctaataggcc

SEQ ID NO: 6798607 - DNA, 56 bp, Homo sapiens
aggcctgttccaggccccttttgtcccccaggcagcagaggcctagcgacaggcct

SEQ ID NO: 6798608 - DNA, 58 bp, Homo sapiens
ggctactgtgatggtctgcaagcgatttccaactgagctttatttcagctaagtagcc

SEQ ID NO: 6798609 - DNA, 102 bp, Homo sapiens
gggctagagtgagaggttcggatgctctgtgggggctgagctgcagccatgggcacacagggctcagggcacgtcatccagggacatcatgataccaagccc

SEQ ID NO: 6798610 - DNA, 62 bp, Homo sapiens
agccatagaaactgagacaaggatttaccaagcgtaaatctggacagtctcgtttctaagct

SEQ ID NO: 6798611 - DNA, 105 bp, Homo sapiens
actgctgcaaaagtggcactctttgattctcatgtttgaggttctaattactacctcatgcaggacttacaagagatcagccatgctgcttacattgtgtgtagt

SEQ ID NO: 6798612 - DNA, 57 bp, Homo sapiens
ctttcttggtcctgaagatggctgcagatcctcactgtgtctcttttcccaggagag

SEQ ID NO: 6798613 - DNA, 64 bp, Homo sapiens
ccttgtcatcatggagacctaacattgagtcccatcttagtgattttgtagctatgagatttgg

SEQ ID NO: 6798614 - DNA, 78 bp, Homo sapiens
taaaaaagtgactatgattgatgaagatgttggatgtttgtgaaataagcatctaaactatcagtttgaattttttta

SEQ ID NO: 6798615 - DNA, 127 bp, Homo sapiens
gattttgagttggatttttgccctgtaacttcgctttctgatgagcttaagaaaaaataatttttagtttgtctttctttcccttattataaatgctggagtgatgcccttatcagctctcaatatc

SEQ ID NO: 6798616 - DNA, 59 bp, Homo sapiens
ggtctgagtggggcctgagattctccgtttctaatgaccttccaggcatccttcaggct

SEQ ID NO: 6798617 - DNA, 68 bp, Homo sapiens
aggaggcgactgttgatttgaaattcctaaaaatgacgtagtagtcccggatccttagttggcttcct

SEQ ID NO: 6798618 - DNA, 57 bp, Homo sapiens
tgctcttacattaattcagcatctatttacttattgggtattggtatgtgtgaggca

SEQ ID NO: 6798619 - DNA, 82 bp, Homo sapiens
gtaaagaaagcatttcattcctttgaaagtggatcaattcagttgtttagggaatagaagtgccatgattatttttctttac

SEQ ID NO: 6798620 - DNA, 57 bp, Homo sapiens
gattgctgtgcgccccaggtgttatgaaaatcactctcctgcaaatgtacagcaatt

SEQ ID NO: 6798621 - DNA, 74 bp, Homo sapiens
cagtgttagcacagagcttttaaacttccgcactgctgatgagggagtgtgattgttctctgttaccagcactg

SEQ ID NO: 6798622 - DNA, 61 bp, Homo sapiens
ttgatggcaagggtttacattcggataaaaccatttcacccatgcaagccctctccattaa

SEQ ID NO: 6798623 - DNA, 64 bp, Homo sapiens
ataggactaggggttcagaagaattcttagtgaagctgagaagtcagtcatctcctgtctctat

SEQ ID NO: 6798624 - DNA, 122 bp, Homo sapiens
tcagtatgcatgatatatcaaattgtggacaaggtgagtcagttaatgttgctaagaggaatttccactttgcatatcatgacttctatcttaatattgtattgatattccatgatctttga

SEQ ID NO: 6798625 - DNA, 97 bp, Homo sapiens
ctcatggttcaactcactttccttatggatggggaaactgaagcctagagaggtgatgtaccttgtccaagatgaactagttggttagagccatggg

SEQ ID NO: 6798626 - DNA, 61 bp, Homo sapiens
tttgtattctagccactgttgatgtctgtctgcacccagaccaggaggcctggagcacaaa

SEQ ID NO: 6798627 - DNA, 112 bp, Homo sapiens
ctccttctcctcttctcctcaaaggcaggtcatggccactttttaatctgcaaaaaaaggattacttgagtttcactaatgaccttttttgacaagaaaaaatgggaaggag

SEQ ID NO: 6798628 - DNA, 55 bp, Homo sapiens
gttcagacacataccaagatctattctatgaaggttctgggttgttaatctgaac

SEQ ID NO: 6798629 - DNA, 59 bp, Homo sapiens
cacaaacctcacagctcctcctcattaacccgatcctgttataggagctgggggtggtg

SEQ ID NO: 6798630 - DNA, 59 bp, Homo sapiens
ctgtgtttgctcttgctggaaaagttgccctgagaccaggacaattcaagagcctacag

SEQ ID NO: 6798631 - DNA, 61 bp, Homo sapiens
ttgagacagagtcttgctctgaaacctccacctccgggttcaagcaattctcctgcctcag

SEQ ID NO: 6798632 - DNA, 76 bp, Homo sapiens
tatgaacataaattatttacagtgtgctcgaagagctcagaagggctttgtaaggtaaataatttataaactcata

SEQ ID NO: 6798633 - DNA, 76 bp, Homo sapiens
cagtccctgggtactataatttgcattgcaatatgaggcttccatttaatgcttgcaaattatgggaccagggctg

SEQ ID NO: 6798634 - DNA, 85 bp, Homo sapiens
gcccctttgccccgcgaaattccaacaccatggcggcggctgccctggctgcccccagcctgggcttcgatggggtgattggggt

SEQ ID NO: 6798635 - DNA, 58 bp, Homo sapiens
tgggctctgaagggtcccggatgaaactctctgcaggcctctgggtctctcaggtcta

SEQ ID NO: 6798636 - DNA, 76 bp, Homo sapiens
cagtattccgagagcatctcctacctactccttctcatcttgagagaaaggggagtttcaggagagccgagacctg

SEQ ID NO: 6798637 - DNA, 67 bp, Homo sapiens
gactattaaacagcctcccctttcactctcaaaaatgtcttgagtgtggatgataggttgtgtggtt

SEQ ID NO: 6798638 - DNA, 75 bp, Homo sapiens
aatagcccatttgttgatggcccacaagtactttctcgtaactagaaagatgtgctatcaactggagaagctatt

SEQ ID NO: 6798639 - DNA, 64 bp, Homo sapiens
tttttttaaacagacttctgcgtctggtatagaatgctaatatctagaagtttgtttaaaagaa

SEQ ID NO: 6798640 - DNA, 88 bp, Homo sapiens
gtgccttcttatatattgccagcttagtggattctgtgatgtgagcattaaaaaaatgaatttacaagttgaataacaaggaaaccac

SEQ ID NO: 6798641 - DNA, 65 bp, Homo sapiens
tgggaatgccctgctccaggagaataccctgcagatctgcgggtggctacgagacagggagccca

SEQ ID NO: 6798642 - DNA, 56 bp, Homo sapiens
ggcaaatgtggtggcttttctggtggtgaaaccattaataccacatttatttagcc

SEQ ID NO: 6798643 - DNA, 75 bp, Homo sapiens
tatatttgcttttgtgatttttagccagaaacacagaaaccactctaaatgctgttatcatcaggaggggatata

SEQ ID NO: 6798644 - DNA, 85 bp, Homo sapiens
gttatattccactcacattaggaagtaatgttgttcatggtatgaataaaaattcactgcttatttgatgttaaaggaaagtaac

SEQ ID NO: 6798645 - DNA, 62 bp, Homo sapiens
caggatatgatggttgtcctaggtgcatccctgtggaccagctagggtagcacatctccctg

SEQ ID NO: 6798646 - DNA, 67 bp, Homo sapiens
gaaacaggcactgcactaccacttttagagacatattcaaaagtagttcctgcagtccagaagtttc

SEQ ID NO: 6798647 - DNA, 59 bp, Homo sapiens
tatgttttagcccagtgaccacacatgggggcagataggtgtggtccagttcagatata

SEQ ID NO: 6798648 - DNA, 60 bp, Homo sapiens
ctgggtggatcgcagccccaggacagccacgctgaggcccaggggtgtctgtctttccag

SEQ ID NO: 6798649 - DNA, 90 bp, Homo sapiens
acagtgcactgcccaaagtgaaacttagtttctggctatttactgccaagtataaagtcccaggaactaagaatcctttagcatttctgt

SEQ ID NO: 6798650 - DNA, 58 bp, Homo sapiens
gcatcttctatgagatctcctgaggaaataaacacccaggaaagatccaggaagaggc

SEQ ID NO: 6798651 - DNA, 97 bp, Homo sapiens
ttatggaatttggaataaggcaaggatgtactgcaataggatgtcgtatctggacttttttaaaaaagtgtctttgattataagacaaattccatag

SEQ ID NO: 6798652 - DNA, 72 bp, Homo sapiens
tctccttctaattttctttcccgcaatcttcccctcctcaagatatgtgtgagtgggaaaattagtataaga

SEQ ID NO: 6798653 - DNA, 64 bp, Homo sapiens
gcctgcaaatttctttagtacataaagtcttacttgatgtacacaatgaaattatgatgtaggc

SEQ ID NO: 6798654 - DNA, 83 bp, Homo sapiens
tcctgttcctcagtgcttctagcttgatgaggtcattactgtgcttccatacaagccaggatcaccattctttgtgaactgga

SEQ ID NO: 6798655 - DNA, 71 bp, Homo sapiens
ggagggatgttaaagatggtgggaaattaactggaaccagaatttctcatttatacttttgctatcccttc

SEQ ID NO: 6798656 - DNA, 67 bp, Homo sapiens
ggggccggcgatgtgccaccgaggctgaggatgatggtagattgccaggtgagtgcgcgccgtcccc

SEQ ID NO: 6798657 - DNA, 61 bp, Homo sapiens
ttgcattcccagccaagttagtgctggccagcaacaggcactaacttggctgggaatgcaa

SEQ ID NO: 6798658 - DNA, 83 bp, Homo sapiens
agttttcaggagagcacaacattgcccttagactagattcaaaattttgttaaggatgttgtgatttattattccggatgact

SEQ ID NO: 6798659 - DNA, 89 bp, Homo sapiens
gatactttctctccttagaagaaagttactttttcgggccattttcctaaaatgtgaaactatcttcaaggcaagccagagtaattgtc

SEQ ID NO: 6798660 - DNA, 129 bp, Homo sapiens
tttccactgccccttccacaattcagcatgtttcaagaggctgaagcaaatagattgaatgaacactacacatccatagcattcattgtctctgtttgccttcagcccatgctctgttctgagatgaaa

SEQ ID NO: 6798661 - DNA, 60 bp, Homo sapiens
ctctccatggtggtgcgacttcaggaacacattcagcaagcttattgccaccttggggag

SEQ ID NO: 6798662 - DNA, 89 bp, Homo sapiens
gcatttgtttaatgccctcagtgtgatgttgatcggtgcttctctaaatttattgctctatgaatcacacgagggtcttgtttgaatgc

SEQ ID NO: 6798663 - DNA, 59 bp, Homo sapiens
caggttggtcggcaagtacacagaggaaatctggacactctgtgggtgttatgggcttg

SEQ ID NO: 6798664 - DNA, 59 bp, Homo sapiens
ggagaagaggggactgaggctgtcactgtcctttacccagaatcatttttcccttctct

SEQ ID NO: 6798665 - DNA, 69 bp, Homo sapiens
aggcactgagggcaggtacaagatgcttcttcgactgtgaagaagagaaatgtgctgctggccaggcct

SEQ ID NO: 6798666 - DNA, 74 bp, Homo sapiens
ggtgaagggatttacctcaagttccaggaaagcggtggcgattgctctcaaatacctggtacctccccgtcacc

SEQ ID NO: 6798667 - DNA, 113 bp, Homo sapiens
ggaatgcaggagagaatgacagggaggccggaagcagccaggcagtgcaaattccacatccagatggggccctgtgcctggcattctgggcttcttggggttgcctgggctcc

SEQ ID NO: 6798668 - DNA, 60 bp, Homo sapiens
tctgactcctgcccccatctggccaagcgttggtgtggataggatgggagcaagagaaga

SEQ ID NO: 6798669 - DNA, 84 bp, Homo sapiens
gtgctcatgtttatatatttgtaggtagtttttcattttttaaattgcatatattatgtacaaaatgttttgaaatgtgtgtac

SEQ ID NO: 6798670 - DNA, 63 bp, Homo sapiens
ctgccttggagtctttccattctgaaaatgccatagtggaaaaaacccagactctagaggcag

SEQ ID NO: 6798671 - DNA, 56 bp, Homo sapiens
ggtgcaagagctccaggccctgggatggaaaccgggaagctgcctgctcctgcatc

SEQ ID NO: 6798672 - DNA, 67 bp, Homo sapiens
agacaggcatgaggctggattgaatgtctacctcttactagctgtgtctttcagcctcagtttcttt

SEQ ID NO: 6798673 - DNA, 79 bp, Homo sapiens
gtcaagacatttgtaggacagaggaagagaagaaagtgtcacattgtattgtttctttcctgttgcctgagatgaagat

SEQ ID NO: 6798674 - DNA, 55 bp, Homo sapiens
cctcagaggtgtggcatctctgcaaccctagcaggtggccatgccggctctgagg

SEQ ID NO: 6798675 - DNA, 56 bp, Homo sapiens
atagatgtgccgctgggtcccgggagccgtcatgcccacctggctggcgcacttgt

SEQ ID NO: 6798676 - DNA, 66 bp, Homo sapiens
tagcacgtgtacacacagcatgtgcattcctacctctgagtgtgtctgcctgagtgtttatggctg

SEQ ID NO: 6798677 - DNA, 100 bp, Homo sapiens
gtgagcccaccccagcctgtcctgttgggttgtttccctctgccactggaacccagcagagaacccagcagattggctgaggaatgcgtgtggccttcat

SEQ ID NO: 6798678 - DNA, 78 bp, Homo sapiens
agttaactcctgtctgtattattcaccactctgcccccaactcctataagagtggctatgcatgactggaatataact

SEQ ID NO: 6798679 - DNA, 77 bp, Homo sapiens
tggaaatcatttctttaagtgaaaggggattaaatggtacctatgtaaattctatacacttaaaagattaatttcca

SEQ ID NO: 6798680 - DNA, 67 bp, Homo sapiens
agcagcttcaattttctaagtgtcaattaaaagccatgtttgatgtttcattttaattggagctgtt

SEQ ID NO: 6798681 - DNA, 69 bp, Homo sapiens
tgtggccaggcccctgatggtggggacagccagggtgagtggctggagggagtcagggggctggtcaca

SEQ ID NO: 6798682 - DNA, 106 bp, Homo sapiens
gaaggacagacagggtcggctcttggtgggttaagtggggcgtggctgtgtgctcagctgaggaatactagatgtatgcagaatgagatgattcggtttgtgtttt

SEQ ID NO: 6798683 - DNA, 59 bp, Homo sapiens
gcgattccagaagtggtaatgggttgtgctgagctagccccacactctctctgagaagc

SEQ ID NO: 6798684 - DNA, 90 bp, Homo sapiens
ttaaagaaataagttacatttcagaatgagaatggatgggtcctactgaccatcctcatcttggatttgaagaatgtagagaatctttaa

SEQ ID NO: 6798685 - DNA, 104 bp, Homo sapiens
atatgtaagagaaagtagttgttcattaaatgtttgttgtgccaggggaaacaatcaatcaaaacattctctttttaaacattctaacattttcttaagcatat

SEQ ID NO: 6798686 - DNA, 57 bp, Homo sapiens
ccagcctggttcagaattggctccataactggataatgctggatctgaaggtgctgg

SEQ ID NO: 6798687 - DNA, 59 bp, Homo sapiens
ttcctatgatagaaatgttggagcattctttagttctaagatctactatacatgtggaa

SEQ ID NO: 6798688 - DNA, 57 bp, Homo sapiens
gttttgctcatttggtccaagggtctaagttctgacttttattaccttgagcaaaac

SEQ ID NO: 6798689 - DNA, 79 bp, Homo sapiens
ttgcaagcagttgcttagaaagtaaacacgaagtctccagacctctggaatttggtcctgcttcttgcctgctgtgcaa

SEQ ID NO: 6798690 - DNA, 94 bp, Homo sapiens
tccagctctccctgccggctgctcccagggactctggctggagtcaaagcttttggccagaggcttcctggagggctccggctggggggctggg

SEQ ID NO: 6798691 - DNA, 55 bp, Homo sapiens
ctgcacagtgttggaagctgccctcttggcttggttgagccagcacagtgaccag

SEQ ID NO: 6798692 - DNA, 67 bp, Homo sapiens
agctccttgccgtccttactccagcggatgaatgggtccgggaaagccgaaatgcggcaagtgagct

SEQ ID NO: 6798693 - DNA, 55 bp, Homo sapiens
tgagttgagaggagcctgaagatagatctggatggtcaggctccgcattaactta

SEQ ID NO: 6798694 - DNA, 69 bp, Homo sapiens
atgggtatatcatatttgtggtccctttatctccagcaaaggggactgcttaaatatatgatgttacat

SEQ ID NO: 6798695 - DNA, 88 bp, Homo sapiens
tcagaattagatgtctatactgatgggatactattatatgataaacatgaagtttaattcggtgagtaaaatatagattatctaatga

SEQ ID NO: 6798696 - DNA, 76 bp, Homo sapiens
agctaaaaggtgtgccctgttaaatgcacagtagtaacttgactgctctgtgttgtcagaggcaccacctgaagtt

SEQ ID NO: 6798697 - DNA, 64 bp, Homo sapiens
gggtgggagaaatgagtatctattttctattctggttcaccaagatccttaatttctactaccc

SEQ ID NO: 6798698 - DNA, 59 bp, Homo sapiens
aggggagggtgttctcccaagaacacaggcatcctggttctgaaaaagcagccttccct

SEQ ID NO: 6798699 - DNA, 82 bp, Homo sapiens
ccaagagcaaatggcaccaactttatgattggtttgtcagtgtcccccattggcaccctgaagttggtcacttagtttttgg

SEQ ID NO: 6798700 - DNA, 79 bp, Homo sapiens
ctgttctgctgttttctttgtcctagcattctacatagagaaactgtctagtgttaaggcaaagtaaaggtaagaaggg

SEQ ID NO: 6798701 - DNA, 112 bp, Homo sapiens
ttgtcaccaacatgcaaggaaatgccatcattcagtttacctcaccttacctactggaaatcataggaagtggttagtgaacttaattcatttttattgtgattggtggtaa

SEQ ID NO: 6798702 - DNA, 67 bp, Homo sapiens
cttgttaaaatgcagattttgatgcagcaggtctggttctctcagaagattctgcatttctaacaag

SEQ ID NO: 6798703 - DNA, 118 bp, Homo sapiens
ggaagatctctgttttaacatatattgtaaggtttagagctacggcctttaaaaagtaatatgattactctaaaggtacaatagctacctgcggaaatgatgaaaagatcagttttcc

SEQ ID NO: 6798704 - DNA, 74 bp, Homo sapiens
ggtctttatctttgaaattagtctgctatcggttttattaggcataatgtgacaaattttcgggataaagtact

SEQ ID NO: 6798705 - DNA, 64 bp, Homo sapiens
gagatcgcctgttcacacctgtccaggtaacacatcccatctggacagggtaactggtggtttt

SEQ ID NO: 6798706 - DNA, 66 bp, Homo sapiens
gccactgttattactactatacattttcttttccactaatgtagaacaggttaatgacagattggc

SEQ ID NO: 6798707 - DNA, 63 bp, Homo sapiens
acccactgtgccctgtgtgtcccctgggctcccccgtgcaggaggaggtgggacacagtgagt

SEQ ID NO: 6798708 - DNA, 83 bp, Homo sapiens
ggttccaccatattggtcaggctggtctcaaactcctgacctcaggtgatccaccagcctcggcctcctaaagtgctgggatt

SEQ ID NO: 6798709 - DNA, 57 bp, Homo sapiens
caggcaaggagctggctcaagtaggacagggcctactgggccagctacttagcactg

SEQ ID NO: 6798710 - DNA, 58 bp, Homo sapiens
atgaatgcatggtagactctgtttccttgaggatggagcagtttcttgtttgcatcgt

SEQ ID NO: 6798711 - DNA, 56 bp, Homo sapiens
ttaagttgcctgttcaacccaacatgctgtaaattgtatgagagcaggaaacttgg

SEQ ID NO: 6798712 - DNA, 68 bp, Homo sapiens
cctgtacaagtcatcatagaagttccccatagttgtgccagtactgtgctgaaggtgggttgtacagg

SEQ ID NO: 6798713 - DNA, 91 bp, Homo sapiens
ctctggaagggctttcataatcatcttatctgactcattttccacctaaggaaagagagagtgcagaagggtaagagaccaaatttcggag

SEQ ID NO: 6798714 - DNA, 66 bp, Homo sapiens
ccatgagactgcctcaccaagagtatgacaaaagaaacctgtgatttctaaggctaggtcttaagg

SEQ ID NO: 6798715 - DNA, 115 bp, Homo sapiens
ggggtttggggaaaggtagaggagacagccaggggcctgagtgtgcccgtaaatatcagcgttcagcaggagcctcctgattccaattgcttgtctaatttccacctcccacccc

SEQ ID NO: 6798716 - DNA, 82 bp, Homo sapiens
caattggcttatagatcactcgattttgcttggaatttctagaattccttgatacaggcttgatgtgtctatactttggttg

SEQ ID NO: 6798717 - DNA, 97 bp, Homo sapiens
gtaaaaaaagttgaaagctcttgggagggttaattagagctaattataatctgattgacctgtttttcttccaaaagcttaaccaatctttctttgc

SEQ ID NO: 6798718 - DNA, 87 bp, Homo sapiens
ttcccaggtttcgagcaagactacaggcagatgagtaaggacacttgtagaactcatcttgcagtgtgtgttctgaaaattgaggaa

SEQ ID NO: 6798719 - DNA, 73 bp, Homo sapiens
ttggggctgacatagtgtgatttgaggagtctaaggaaggtcagttcccaaagtcaagctgtgtctttcccag

SEQ ID NO: 6798720 - DNA, 107 bp, Homo sapiens
ggaagtatggatggaagcattgtagcatttttacttgtctcaaaggaaatgggatttgatgaaaaccattagcttaggcatgaagagaagcagagcttcctgtctcc

SEQ ID NO: 6798721 - DNA, 58 bp, Homo sapiens
agaagtttggtcctataaactcacagtaaaattaggccttgaaaaggaccaaacttct

SEQ ID NO: 6798722 - DNA, 59 bp, Homo sapiens
taagaatagatgcttgggcaaaggtagagcaactgctctggctttcacgggtattctta

SEQ ID NO: 6798723 - DNA, 55 bp, Homo sapiens
gctgacctgtggcagaagctcaaattgaaacaagaaattatgaccccaggtcggc

SEQ ID NO: 6798724 - DNA, 95 bp, Homo sapiens
tccatatcttaattggagtggtggttacatgagtgtttacatttgtaaaatctcatggaactatacactttaaaagttgtatttattatatgtga

SEQ ID NO: 6798725 - DNA, 80 bp, Homo sapiens
atcctacagggctggcatctctaatgctgaaagtacaacaaagtgcagtggtagtcactgagtgttcagccatgctgggt

SEQ ID NO: 6798726 - DNA, 61 bp, Homo sapiens
gtggctgtttttataaatagtgcctatttttgtaaatagtgttttattagaacacagccac

SEQ ID NO: 6798727 - DNA, 61 bp, Homo sapiens
cagttaaatacattaaggaggaattccagcatggtaaagctcacttataatgtatttgctg

SEQ ID NO: 6798728 - DNA, 65 bp, Homo sapiens
agggtctttgagagggtagatgtgaagactttatatgtttatatacatacagtcttactgacttt

SEQ ID NO: 6798729 - DNA, 78 bp, Homo sapiens
agcttttgacaatgacagtcattaacttccacctgaaaatgtgattggaacctgtgacccttctttgcttcaaaggct

SEQ ID NO: 6798730 - DNA, 66 bp, Homo sapiens
gcagctggtggagctgggcctgagcaggacttccccaaaggactgagaaggaagcctccactctgt

SEQ ID NO: 6798731 - DNA, 78 bp, Homo sapiens
tggttgaagatgatgaagatgtgaaggctggatttgataatgaagagtcttctttgtgttctctcattatttatgcca

SEQ ID NO: 6798732 - DNA, 72 bp, Homo sapiens
ttgaagtcagcctgaggtcataggatgcaactttccttagaaaattttgccctatccttcataaaccttcaa

SEQ ID NO: 6798733 - DNA, 70 bp, Homo sapiens
gtgccttgtagtttcaattgagtgattccattgtgtgaaaaggaattactgggtctgagattaatagtat

SEQ ID NO: 6798734 - DNA, 57 bp, Homo sapiens
ctgaactcaggttgatgaacattatatattattgttgtttgtttattctcctgacag

SEQ ID NO: 6798735 - DNA, 76 bp, Homo sapiens
gtgctactggcatctagtgcgttgaggtcagagatgctgctaaacagcctacaacgcacaagacagcctctaccac

SEQ ID NO: 6798736 - DNA, 76 bp, Homo sapiens
gggtgtgtgtgtgtttgtctttgagaaattcatcactttgatgagttaagcaggtagcaagctagtttatatttcc

SEQ ID NO: 6798737 - DNA, 70 bp, Homo sapiens
catctttaattgtagctcccataatccccccttttcatgggaaggacctggtgggagataattgaatctg

SEQ ID NO: 6798738 - DNA, 71 bp, Homo sapiens
gagacagcccagcgaagtcttacacatgttatttggaagtattgtgacaggcacgaaattgggctggtgtc

SEQ ID NO: 6798739 - DNA, 112 bp, Homo sapiens
ggttgggcctctagatctaatgaagataagcaaatgcgtttagaggaaacatgtcaccacatgcatctccaggctcatttcatgccccctctttctagatcttggtccctct

SEQ ID NO: 6798740 - DNA, 63 bp, Homo sapiens
gctaatgtcactctgtttcctctgcatacagatagagcatgcagaggacccagatgtatttgt

SEQ ID NO: 6798741 - DNA, 123 bp, Homo sapiens
tggaggcccagaaagggagagggatttgctcaaggtcacacagagaattagtggcagagaaaagactgtagcccagatctcctgaccctcagtacagttctcttttccatacatgcacctcca

SEQ ID NO: 6798742 - DNA, 90 bp, Homo sapiens
cctgcctgaatcctctgctgggatgtaaagtcttctaaagcaggcctgcacagggctttacttctcagttctatggggacacaggatagg

SEQ ID NO: 6798743 - DNA, 112 bp, Homo sapiens
atctctagaagtgttaaaactgcagattcctgggccctgtctcagagctcctaaacgggatctctgggaacatggcttggaatccacatgtttgccaagcactccaggtgat

SEQ ID NO: 6798744 - DNA, 69 bp, Homo sapiens
gcctggagtggttaacttctgagcaggctggagatcttcgcaactcagcaacttaactgctggccgggc

SEQ ID NO: 6798745 - DNA, 86 bp, Homo sapiens
gttactgcattgtggtagtgtggagccactgagtggctgggggaggctaccagctcagcgggcttctggtaagactttgcagtggc

SEQ ID NO: 6798746 - DNA, 129 bp, Homo sapiens
tgaaaagggtttcttttgtgctcatcctgctgagtgagccgaattgcttcattaacatttaggccatgttacacattcaagtgcttgtgaggtatttggatttcagatgagttttttttttttttttta

SEQ ID NO: 6798747 - DNA, 64 bp, Homo sapiens
ttattacccctgtgggctcagagcctgttttgaaataaagcaaataagaaccacaggggagtga

SEQ ID NO: 6798748 - DNA, 62 bp, Homo sapiens
gagacatagccaatctgaccagtcttttgcaggcaggaaggttaagatgggttaagagtctc

SEQ ID NO: 6798749 - DNA, 62 bp, Homo sapiens
aggacacagtggtggggaaaagggttgtctaggcagggaccttgtcttcattatggtgccct

SEQ ID NO: 6798750 - DNA, 57 bp, Homo sapiens
tgtttgaggagggagctggtctggtgccaccattttccagctgtctgtccttaggca

SEQ ID NO: 6798751 - DNA, 61 bp, Homo sapiens
gcctccacagagatgctgattgtacgcatgctgcgtaagcctcagatttttctgttcaggc

SEQ ID NO: 6798752 - DNA, 68 bp, Homo sapiens
tttagacatcatattgagcctctctgtgtgatctggaaagctccctccacagacaggacttgtctgaa

SEQ ID NO: 6798753 - DNA, 71 bp, Homo sapiens
gattgcatcttctggttgagcccctgggagtggcaaccatagcagccatggggctgaacctggaggtggtc

SEQ ID NO: 6798754 - DNA, 85 bp, Homo sapiens
caccagaaagtgtctcaagcaatctctgtgtccctgcctgatcccggccacagggaacacggggatgctggtcagactcagggtg

SEQ ID NO: 6798755 - DNA, 57 bp, Homo sapiens
aaatgcctttacttttgctggcaagtggtactagtgcccacaaaagtaaagacattt

SEQ ID NO: 6798756 - DNA, 65 bp, Homo sapiens
gatacactattttactgatacaaatctaccagaaacaggagatttgtggttggagagattgtatc

SEQ ID NO: 6798757 - DNA, 73 bp, Homo sapiens
gggtcgtggcaccccctggtggctgatcctaggtagtgtcactgcccagccccagtaagggagggcctggccc

SEQ ID NO: 6798758 - DNA, 130 bp, Homo sapiens
cctagtttttcaattgctgctctttggacatggttttgagtgtcttcaccacttcatctctcttctgtacataagtgatggctggaagttcaaaaattgttccaaattaatgcaaccagtgacctttagg

SEQ ID NO: 6798759 - DNA, 66 bp, Homo sapiens
aggaacggacaaaccttgtaaatgccaaactagttgatcccaaagctagctactaggtttcctcct

SEQ ID NO: 6798760 - DNA, 68 bp, Homo sapiens
cttgttaaaatgcaggtccgcatctgtaagttctgaagcagggcctaggattctgcatttctaacaag

SEQ ID NO: 6798761 - DNA, 66 bp, Homo sapiens
aagcacagagatgggcacgcctctttacagaaccaaagattcagaactgtgccttaccctttgctt

SEQ ID NO: 6798762 - DNA, 116 bp, Homo sapiens
ctgatggaagtgacgctcctcacatccagctccagcttctgcaccaaggcgctggggtctatcttggtcctggcaaagatgttggtgttgatgaacggaggtataattcttattag

SEQ ID NO: 6798763 - DNA, 64 bp, Homo sapiens
gaagatttgtgcttttgaatcagtagacaattcagaaattgtctactaagaaagacaattcatc

SEQ ID NO: 6798764 - DNA, 98 bp, Homo sapiens
tgcctaaatcagcttcctgctgtgttcctcagtttcatgctgcccactgttagggccatgttctgcagagaagcagtagaaggaagttgttaagggca

SEQ ID NO: 6798765 - DNA, 76 bp, Homo sapiens
gagtacctagcatctttgggaatctttgtgcatgactaaaggcagaagtcctgtgtgacttcccaaatgctggctc

SEQ ID NO: 6798766 - DNA, 75 bp, Homo sapiens
tgtttatcttttatgctactcaatagtcagtgcctagcaaagtgattggctcttagtaagtatctatgatggata

SEQ ID NO: 6798767 - DNA, 55 bp, Homo sapiens
gctcagggaactttttgcaggcacatcctatgcccagcagggagtgtccttgagc

SEQ ID NO: 6798768 - DNA, 124 bp, Homo sapiens
ttagcacccacagatggtttcagatacactcagatgtcacaggcatccaggactaggcctgctttgatcatttggagggcaggatttctggatacctgcgtcacctgtagccatctactgctga

SEQ ID NO: 6798769 - DNA, 81 bp, Homo sapiens
gagtggatagtgtaggacagggtaagtactagtgtggtcccagaccacctgtgatgatagtttgtcctattaacttccctt

SEQ ID NO: 6798770 - DNA, 79 bp, Homo sapiens
atggaagcaatgtcaaggagaccaaaacgcgggtgtcagaacttccctttgtttttatttctgtgccgtttgttttcat

SEQ ID NO: 6798771 - DNA, 70 bp, Homo sapiens
atatgcggtgtttggttttttgttcttgtgatagtttactgagaatgatgatttccaatttcatccatgt

SEQ ID NO: 6798772 - DNA, 57 bp, Homo sapiens
ggtgcagaaggaagggagctggggaagatactctcattctccctctaccctctgacc

SEQ ID NO: 6798773 - DNA, 82 bp, Homo sapiens
tacttcatacattttaggttgcccttgcaatatttaggtttcatggggatcaaaagctgggttctaaaattaaagagaagta

SEQ ID NO: 6798774 - DNA, 87 bp, Homo sapiens
tgatggtttgggggaaaatactggttttggagatgctgattgtttccaatctaagcagttttgttcagtgttttccccaaattgtca

SEQ ID NO: 6798775 - DNA, 77 bp, Homo sapiens
gggtggggaagcactttgaacttaaactgtctttgtgtttgcgccttcagttgagctttaattgcagttctccacct

SEQ ID NO: 6798776 - DNA, 72 bp, Homo sapiens
cctacagcttgcatgcagaggcactgaagacacattagggttttgagtgcttcttctgtgccaggctgtggg

SEQ ID NO: 6798777 - DNA, 130 bp, Homo sapiens
tattccctctcctagccacacatgccatcctctgtcggaagtgacagatgatattttggtcttgggatttcctctttggagtctgtctgtcacttctgcagtctgtgatgaatgcattcttaagagctta

SEQ ID NO: 6798778 - DNA, 60 bp, Homo sapiens
tccctcaggagatgtcagctggaggtttactcttccttcctcctgacacagcctgagtga

SEQ ID NO: 6798779 - DNA, 58 bp, Homo sapiens
tctggaagtcaccttagttcctgtgttttccctctacatttgaatttctggctccaga

SEQ ID NO: 6798780 - DNA, 64 bp, Homo sapiens
ggtgacatcacaagccatctgcagctctggacaacacagcccctgttggcctggtgatgaagct

SEQ ID NO: 6798781 - DNA, 65 bp, Homo sapiens
agaagttttcattacctatacagagtgatttttgatttttacatatgtatttaatgaaggctttt

SEQ ID NO: 6798782 - DNA, 64 bp, Homo sapiens
ttggggtcttctgtgctttgcaagtgagtgcaccaccacagtttgctttacggcaaggccccag

SEQ ID NO: 6798783 - DNA, 60 bp, Homo sapiens
gggtgattcagttgcttgttaagtttgagatgcactgactatgcagcttttgattcaccc

SEQ ID NO: 6798784 - DNA, 99 bp, Homo sapiens
gtaaacgccttgagccttgcctgaatttatctgaatggtggaacagaaatcatttagggctctattctaatggattctgggaagtgtttttagctttgc

SEQ ID NO: 6798785 - DNA, 82 bp, Homo sapiens
gttgagattgagaactgtgccaaaaattttgttcaacttgtacgaaatactttgcacagttttaaatggctttaatcccaat

SEQ ID NO: 6798786 - DNA, 79 bp, Homo sapiens
gatttagtaatcattctgatggtcaatgctagcaagtcaagctagctatatgcatttgaatgctcataattactaaatt

SEQ ID NO: 6798787 - DNA, 59 bp, Homo sapiens
tacaggctagggagagtgactgcttgggtttaacctcagagtcggtttacttatctgta

SEQ ID NO: 6798788 - DNA, 55 bp, Homo sapiens
ccatgtggcaggaaggtgtttcctctgaagcagggcaaactctgaaggccactgg

SEQ ID NO: 6798789 - DNA, 58 bp, Homo sapiens
tgctggcttcctgtgcacagcaaagcctaatgatgctgacaggtcatataagcttgca

SEQ ID NO: 6798790 - DNA, 76 bp, Homo sapiens
gggtcttattaaaatgcagtttctggttcagttggcctaggatgggacctgagatactgcacttctagtaagttcc

SEQ ID NO: 6798791 - DNA, 58 bp, Homo sapiens
gcagtttctctcaataagcatcgattgagcagctattcgacgcttaacagaggactgc

SEQ ID NO: 6798792 - DNA, 130 bp, Homo sapiens
agaaacttaattgacaacttaggggaagtactcattcacaatttgtattttgcatccactgttttttgcctgtggggctttctgtagaacagattgtgtatctcttactgtagtaaatttcaacattcct

SEQ ID NO: 6798793 - DNA, 63 bp, Homo sapiens
accttaccatctgtgggaagtggctgcctctttgcacccatctccagacacaggtgggaaggt

SEQ ID NO: 6798794 - DNA, 61 bp, Homo sapiens
cttcttctgaggcagctattcagttattactatcaagagataactgctgttgaagaagagg

SEQ ID NO: 6798795 - DNA, 94 bp, Homo sapiens
gggacctgaaggctggcttcccaagcgtcctcgaggccttgtgccaggaagaggaccctcgggcttagggaagtgaaaaccaggctcaggtccc

SEQ ID NO: 6798796 - DNA, 79 bp, Homo sapiens
ctcagtgtccttaaatgaactctgcatgactggctttacccagatcaatgagcaagacatttgagttcttaccgctgag

SEQ ID NO: 6798797 - DNA, 129 bp, Homo sapiens
tgatttaggcagatttgaaagaaatatcatgcagaaggaaagagaagcagcagaaaaataggctcttcgttcctttctcttcactgtcatgatcatgctcattcattaaaaggaagattctgaagacca

SEQ ID NO: 6798798 - DNA, 67 bp, Homo sapiens
atgagcttgctttcttcagaggtgagcatgacttgctcaggtctcttcccggataaagtaagttcat

SEQ ID NO: 6798799 - DNA, 66 bp, Homo sapiens
tacaggctgttggaggattttttgagtgcataaatctcaaagtctgttttcatgatagagtctgta

SEQ ID NO: 6798800 - DNA, 108 bp, Homo sapiens
tgctattgttccactgaggttgtattcaaagtttaggtgggtgacataatgaaggatgcaatagttaaagccctaaattgatagacccagaggaaatgtctaatggca

SEQ ID NO: 6798801 - DNA, 79 bp, Homo sapiens
cccatcccagggcacttaggcccagcccacaccccaacgtgagactctggggcggactgggcatgggtgctctgcaggg

SEQ ID NO: 6798802 - DNA, 64 bp, Homo sapiens
actctttaaaggcaggatgttcacctgttgtactcagtgatgtatccttagcacttagaagagt

SEQ ID NO: 6798803 - DNA, 90 bp, Homo sapiens
ggggtgactctggggagttttttgctttctctgttcctcactgagatctacatggaagggaagggaaaaacactcgtctctaaaaacctc

SEQ ID NO: 6798804 - DNA, 59 bp, Homo sapiens
accctccttagcaggcagaaaggagaaagggttttcttcttttcatggcttgggaaggt

SEQ ID NO: 6798805 - DNA, 94 bp, Homo sapiens
ggaactgactgctgggtcatggggtagaagcatgtttatttactgccataagaaactgctagacacatcttcatccacaatgataaagagttcc

SEQ ID NO: 6798806 - DNA, 61 bp, Homo sapiens
tgtagatgagtcagggtgcatgtggaatgctggtaccccggtgcaccctgactcatctaca

SEQ ID NO: 6798807 - DNA, 56 bp, Homo sapiens
taagatgtggaatcacagcttcagctcaggcagcgggaggctggatgcccatctta

SEQ ID NO: 6798808 - DNA, 75 bp, Homo sapiens
cagagtctagaccacaggcatgcacagagcatttgtggcgtcaaggctcaggcatgtatgtggttgcagagattg

SEQ ID NO: 6798809 - DNA, 70 bp, Homo sapiens
gtagtcattggtgtctggggtaaccgagaacctcaggatgtggagggagtctagcccagagcctggctac

SEQ ID NO: 6798810 - DNA, 57 bp, Homo sapiens
agtctaggggagaggcctcaggagaaaccaaccctgctggcaccttggtcttggact

SEQ ID NO: 6798811 - DNA, 56 bp, Homo sapiens
tgaggctggtccctgtgcttcggcttccccatacagcagtgcagggagcaccctca

SEQ ID NO: 6798812 - DNA, 63 bp, Homo sapiens
acagaaggtaggatagtaatttaccactcttactatgaggtgtgggtgtactgttctagatgt

SEQ ID NO: 6798813 - DNA, 66 bp, Homo sapiens
ggatccttccagagttattctcaagcacttatttttaaaagttgattgtttagatttggaaggacc

SEQ ID NO: 6798814 - DNA, 122 bp, Homo sapiens
agagtaactacagggaccctttgtttaaatagcatgtttgctctttttaaaggaggtaattaatggcaaaggactttggaactggaggaacatgctagaaaagcaacccttgagtgccatct

SEQ ID NO: 6798815 - DNA, 64 bp, Homo sapiens
ttggcactctgcaatgtggcaagaacatagtcactggcttgttccagctcatattgaggaccaa

SEQ ID NO: 6798816 - DNA, 56 bp, Homo sapiens
gctaaaaccaccagtggtgtgatggatggtttcatttcttcttggactgttttggc

SEQ ID NO: 6798817 - DNA, 73 bp, Homo sapiens
ttgttgatggtggtggtagtgattagactacatgtgaagcggtagttatgtttacatgccatctctgcagtga

SEQ ID NO: 6798818 - DNA, 67 bp, Homo sapiens
caaagctgaggccagagttccccgagtcatggcacctcatctgggggactctttgcctctggacatg

SEQ ID NO: 6798819 - DNA, 78 bp, Homo sapiens
cctgcaacatgaaccagcgccaagtgtgtggaggaggcttacaccctgctcaacgaatatggcgatgacatgtatggg

SEQ ID NO: 6798820 - DNA, 62 bp, Homo sapiens
tgtgcaaatgattctaatgggtagtcaagatcaagaaccactgctttagactcatttgttca

SEQ ID NO: 6798821 - DNA, 55 bp, Homo sapiens
ctctagggaagaatgagagcccagaaaattgtcactgcgccttccttcctgggag

SEQ ID NO: 6798822 - DNA, 66 bp, Homo sapiens
cctaaggggtcttgtcagttttgtatactggcacacagccatgatttacagaaacaggacttttgg

SEQ ID NO: 6798823 - DNA, 64 bp, Homo sapiens
tgtttagatctcattcttcccaggggattatacagatgggtaacagggagagtgagatcaaaca

SEQ ID NO: 6798824 - DNA, 76 bp, Homo sapiens
gtggacttggggaaggcacagttatctcttatatgaatctccacaaaagcttcctaactggctttcctcattccac

SEQ ID NO: 6798825 - DNA, 70 bp, Homo sapiens
ggggtcaggcacttgtgactgtctgcatttttcagatgagaaaacaggctcagataagagcctcagcccc

SEQ ID NO: 6798826 - DNA, 65 bp, Homo sapiens
gacaatgtaggagtatgacagtagtgaaattcatttatctatattcttatgttccttttattgtc

SEQ ID NO: 6798827 - DNA, 75 bp, Homo sapiens
ttcaacactatccaggcaatcttagacccatactagtaattttaccaggacgaagatccctgctgtagtgaggaa

SEQ ID NO: 6798828 - DNA, 62 bp, Homo sapiens
gcagcaggaataggataagcaaaggcatgaaaatggaagttgtctggtccattctgggtagt

SEQ ID NO: 6798829 - DNA, 63 bp, Homo sapiens
ggccatcctgctagcccaggatgcagggacccccaggtcccttcggcctggctgcagctggcc

SEQ ID NO: 6798830 - DNA, 78 bp, Homo sapiens
attctgtcaacgtgctgtctttcattgtctgcctgaacaagttcatgtgtaaatgtagatgacggcatgagacagggt

SEQ ID NO: 6798831 - DNA, 69 bp, Homo sapiens
actgagtaacggttgtcaaactgaattaaagatgttctttaacactcagtttaatagccactggtcagt

SEQ ID NO: 6798832 - DNA, 56 bp, Homo sapiens
cctcagagaggaggaagaacttcttttgtaacaagtatttgctgccatctttgagg

SEQ ID NO: 6798833 - DNA, 62 bp, Homo sapiens
tgggagagaagggggctcgagtgtcctgggtgccttctatggaccaagcactttctcgacca

SEQ ID NO: 6798834 - DNA, 126 bp, Homo sapiens
gcacatttttgttcccttctggcagttaattggtctgtgttttctgcaggtgatttgtgtgggtcagattttctgcactgtggctgctgacaaacatgatcatgccaagcaggccacaaaagtggt

SEQ ID NO: 6798835 - DNA, 73 bp, Homo sapiens
tcccagcctcagaggtctactgggccaaggtcaaggttctgatcaggaaagagtggaactctgaaaattggga

SEQ ID NO: 6798836 - DNA, 64 bp, Homo sapiens
gctgcccagagctcagtgtgcaaggtcagcagactaccatgctgccagctctgtttagagcagc

SEQ ID NO: 6798837 - DNA, 65 bp, Homo sapiens
tgaagtcacagggtatctgggatggatctgctcatggggttcacgtgagatagccctagtgttca

SEQ ID NO: 6798838 - DNA, 55 bp, Homo sapiens
tggatccagctgctcctatgaggtgtctccgcaagcaggagctgcctggaaacca

SEQ ID NO: 6798839 - DNA, 62 bp, Homo sapiens
cattctttgtgtaggtgcctctggctttgagaaacgaggccagagtctatatgcagacagtg

SEQ ID NO: 6798840 - DNA, 87 bp, Homo sapiens
tggagaagacaagactggaatgattgaaaaggaatgattggtgctttaacttacattgagccatcacagtcatttattgtctcttca

SEQ ID NO: 6798841 - DNA, 57 bp, Homo sapiens
gagtagcattctagagtatgctaggagaatctaagtaacaactggacaatgttgctc

SEQ ID NO: 6798842 - DNA, 74 bp, Homo sapiens
gcccaagatgcaaagctaagagtctggttgcattgttcgcacccatcacttttaggctttgcaacataagaggc

SEQ ID NO: 6798843 - DNA, 83 bp, Homo sapiens
gtagaggacaacaacacgcttgtgtttgctgtcgttgttaaacccaacaagcagcagatcaaacaggcttgaagaaactctac

SEQ ID NO: 6798844 - DNA, 55 bp, Homo sapiens
tgagcagatgtgccaaactgtaaccacaaaaggttggtgttttgttttcttctca

SEQ ID NO: 6798845 - DNA, 55 bp, Homo sapiens
ttctctctggacctgggatgcgcttagcaagtcccttcttggagtccagagagaa

SEQ ID NO: 6798846 - DNA, 69 bp, Homo sapiens
ctacagaaaaacttggaggctttcattgaccacaccaaaaacagagccaagctaagtttgtttttgtag

SEQ ID NO: 6798847 - DNA, 76 bp, Homo sapiens
tttctccatcttcctttcttttcctattttgcagaccttgtaatgaggcacttaaaagtgaagatactggcaggaa

SEQ ID NO: 6798848 - DNA, 80 bp, Homo sapiens
gtgtgacccattcaaggaactgccaggtgctccatctgaaccaacatgtctgagctgggggcctggcatgagggtcatgc

SEQ ID NO: 6798849 - DNA, 78 bp, Homo sapiens
aaaggattttgtgtgtgtgctagattgtcttctaaatcactgatttggaacaaatattagtaaagcatttaattcttt

SEQ ID NO: 6798850 - DNA, 63 bp, Homo sapiens
ggagggagtctccttagagagagtgcagctctgctcacatcttagtttgggactctggcctcc

SEQ ID NO: 6798851 - DNA, 76 bp, Homo sapiens
aggcccatctcagtcaggttgaatttggctgaccaagtcaggaaatcagaggaccttactgagaacctgggggtct

SEQ ID NO: 6798852 - DNA, 61 bp, Homo sapiens
gaggggcacggaaggtcagactgcccgcttctgtgattggctactgacctctgagcccctc

SEQ ID NO: 6798853 - DNA, 70 bp, Homo sapiens
tgaaatagtcaagtatttgaactatgggcaagcagttctgccatgtccccttctgtgcttgtctatttta

SEQ ID NO: 6798854 - DNA, 57 bp, Homo sapiens
gataccagagcccaaagcagcatgtttgactctcaatagctatttgacctctggatc

SEQ ID NO: 6798855 - DNA, 55 bp, Homo sapiens
actgtactgggctggatattagagatcacttggtagctcatagtccagtgatagt

SEQ ID NO: 6798856 - DNA, 63 bp, Homo sapiens
gtcacgcctgcttaccaaatttgtggattactctaatctgacagaggtggtagatacagtgac

SEQ ID NO: 6798857 - DNA, 121 bp, Homo sapiens
gatggccctctcccctggcactttgaatctccagcagcaatgaacagtctgtacctgcatcctggcctcagctgtgattcctgctgtccagccttctgaagtgcccttggttggttccatt

SEQ ID NO: 6798858 - DNA, 56 bp, Homo sapiens
cgggggatgcggggctgggctgtcctcctctagaagcgtggctctgccactcaccg

SEQ ID NO: 6798859 - DNA, 78 bp, Homo sapiens
gcaatctatgaaatgtcatttaggattatgtttaaactaccaatattaaactatatcaatgatgatggcttatagtgc

SEQ ID NO: 6798860 - DNA, 80 bp, Homo sapiens
ggtggctgggtgtgggatgctcagggcctggagccataccagcatggtcaggactctgacccgtcccgaacccagctccc

SEQ ID NO: 6798861 - DNA, 76 bp, Homo sapiens
ccaggctgtgcttttaaaggcaattagtaggtttacaaattctatttttacattttgtattaaaagtatagtttgg

SEQ ID NO: 6798862 - DNA, 76 bp, Homo sapiens
gctgcccccttgtccaccgaactcggccccgggcagcgaggctgtcctgcggcctcagtggtgagaaggcggaggc

SEQ ID NO: 6798863 - DNA, 63 bp, Homo sapiens
tgggaaatgctgcattgggcaaaacaggttccttaaacacagtactgcttggagcatttacca

SEQ ID NO: 6798864 - DNA, 90 bp, Homo sapiens
aggggcagcacaaagcagtggctaggagtctggcgtctggagccaactgtctggattcagactctggccctgccactcgtgtatgaccct

SEQ ID NO: 6798865 - DNA, 72 bp, Homo sapiens
tttattcattgtttcgtcgcagcatgttgctcagtggtttgcaaatacttgtccgatgaaagaatgagtgaa

SEQ ID NO: 6798866 - DNA, 62 bp, Homo sapiens
cagagagctccattagctaagaggtcatactctcaaaagattcagctaatggaagtttactg

SEQ ID NO: 6798867 - DNA, 60 bp, Homo sapiens
cacagccctgcgccccagtttgggggtgaaactagactcagaaccaggggcaggtctgtg

SEQ ID NO: 6798868 - DNA, 88 bp, Homo sapiens
ggcccggacattgctgagccgagtggggcgcccaggagccagcgaggggctcccgaggcggccccggctcggcccaggtgtgcgggcc

SEQ ID NO: 6798869 - DNA, 72 bp, Homo sapiens
agtgggtgtggcttacctaaaatcattccaaaatgtagtgtaggtgggatgataggtaagtaattacctact

SEQ ID NO: 6798870 - DNA, 75 bp, Homo sapiens
ctgtgatgtctctgtttttgtggtacttctccctcttggggtagaaataatcagcttaggggcagagacctacag

SEQ ID NO: 6798871 - DNA, 55 bp, Homo sapiens
cagtaaacactgtctttatatatccctcatgcaaggtgatgtaacatgtttactg

SEQ ID NO: 6798872 - DNA, 85 bp, Homo sapiens
gcacaaagttgcacagtgaggtagggcagaggctgaatgtgaacggacacatcccagcccatcctcctcccctgtgtaattgtgc

SEQ ID NO: 6798873 - DNA, 71 bp, Homo sapiens
gaggatctgtgctgcttgaatcttgggataaaaattaaaaggcagtgttcccctgaaagcatcacatgctc

SEQ ID NO: 6798874 - DNA, 58 bp, Homo sapiens
ggcatttgcagacttgactacctgaggtgtatggtgttcagacaagtttccagaagcc

SEQ ID NO: 6798875 - DNA, 67 bp, Homo sapiens
gaaatgaaacaggcttttaaggcttgaaaaaaaggaaaatagaaggccaggggcaaattgtcgtttc

SEQ ID NO: 6798876 - DNA, 118 bp, Homo sapiens
cttcacctcccactggccaaaagcagattacaaatgctgacacactgagcatttgatagcatctctttctgctatcacgcagatgtgttagctctaactgtttttaaatgaggaaaag

SEQ ID NO: 6798877 - DNA, 72 bp, Homo sapiens
gagccatatgaaattgccatttttaaaggtcaaaaatgatagactattggcaattggcaatttcgtatgctt

SEQ ID NO: 6798878 - DNA, 63 bp, Homo sapiens
ggtgtgtgtggaatgctcatttatttgttagtgaaatgaaatgtttgagcatctacatgctct

SEQ ID NO: 6798879 - DNA, 71 bp, Homo sapiens
ccatgttcttgggtttaagattgtactttctgacgtgaacagtgaattgcaaattcagacttaagagatgg

SEQ ID NO: 6798880 - DNA, 67 bp, Homo sapiens
ctgggagccaaggagagaggccttggaaaaagtcagccctgccaactccttgatcttggacttccag

SEQ ID NO: 6798881 - DNA, 62 bp, Homo sapiens
tacattcagaagaatggacacgctaaaaaacaactgcgtcttatgtttcttaactgagtgta

SEQ ID NO: 6798882 - DNA, 103 bp, Homo sapiens
ccgaatctgatctgctcacaaggtgcgcagaagtcaggtgtgggatatcatggggagggtgtcctggcctagagtttgtgttccttttcagcatcttactagg

SEQ ID NO: 6798883 - DNA, 78 bp, Homo sapiens
atgccattatctcagttgaacttatgacgtggacattattaatatccccatattttgtatgagaaaactgaggtgcat

SEQ ID NO: 6798884 - DNA, 73 bp, Homo sapiens
tccaaacagcttgtaaggtgtaattaggatttacttcaatttaacaaatgacaccttgccaagtactaaggga

SEQ ID NO: 6798885 - DNA, 64 bp, Homo sapiens
aggtcaacagagacagagacactgagtgatgtccctagccccggtgtttcctcctctgtttcct

SEQ ID NO: 6798886 - DNA, 58 bp, Homo sapiens
ggaagggagtagttggaatgcatataagtaagcaggcatttacaaaacagtcccttcc

SEQ ID NO: 6798887 - DNA, 61 bp, Homo sapiens
ctagtgtgcctacacacacctctgcatagatatatgtaagaacatgtgtgggcacagatgg

SEQ ID NO: 6798888 - DNA, 70 bp, Homo sapiens
tgaggatctcatggctctaaagacatagatttctgaatttcaaggacctattgtccagagccaggccttg

SEQ ID NO: 6798889 - DNA, 60 bp, Homo sapiens
tgggagtgttcttggcttgcttggagaaggtaaagacaaggtaatccaaggctgctctta

SEQ ID NO: 6798890 - DNA, 76 bp, Homo sapiens
ttccagatatatctaagttaggaacactgtctcttgaaagatagagatcagttagatagcttgatgtgacctggaa

SEQ ID NO: 6798891 - DNA, 83 bp, Homo sapiens
cctgtcattctctaggcagagaggccataagaattacactacctgcgatttttatggtcctttcctgccttaatacttatagg

SEQ ID NO: 6798892 - DNA, 57 bp, Homo sapiens
taatctggttgctctgagaatagtttgggtccaaatcttatttcagttgctagattg

SEQ ID NO: 6798893 - DNA, 100 bp, Homo sapiens
ggagcccagctgctgctgagctgctccttcccttcccagtgagctccaggcagatgtggggcacacgggatgggcagggagacggcaggcaagctgctcc

SEQ ID NO: 6798894 - DNA, 104 bp, Homo sapiens
gttcaactccaagctgatgaccagtgtcgaccgccagtcattctgaacatttgaccagttgagctttcaaatgatggcagtcctggctgacattttgggtgaac

SEQ ID NO: 6798895 - DNA, 67 bp, Homo sapiens
ggggctgtgtcctggccaaggccttgcttgcagcaaaaggcagagctggggtctagccaggagcccc

SEQ ID NO: 6798896 - DNA, 58 bp, Homo sapiens
acaaaaggatttttgctaggaagacaaactttttgtatttcctggtttagatcaatgt

SEQ ID NO: 6798897 - DNA, 96 bp, Homo sapiens
ttctttttcctggacgccaggagcgccgtctagggacaatggagacatttttctccagctttttcccagttggctctggtgcaggaaagcaaagaa

SEQ ID NO: 6798898 - DNA, 58 bp, Homo sapiens
ccatggcaatggtcagtctattcaaacataagcctggcatggtgctggcctcccatgg

SEQ ID NO: 6798899 - DNA, 79 bp, Homo sapiens
gacctgatgtgggccagcttttctcctgggtgtgtgactgaatccttcttcccagagcatgtgctgcctttgttaggtc

SEQ ID NO: 6798900 - DNA, 75 bp, Homo sapiens
tttctggcactgcccagcctctgctccaacctctctggaggcaaaggaggtaacaggagggcacaaggccaggaa

SEQ ID NO: 6798901 - DNA, 65 bp, Homo sapiens
ttagactagacattttttaaggtcaaaggctacatcttattggctgctctgtgtttagtatctga

SEQ ID NO: 6798902 - DNA, 70 bp, Homo sapiens
ggtccagggtcagagatcggccatgtgagcatccctgctccagctcagtggcctcctccactgacccgcc

SEQ ID NO: 6798903 - DNA, 57 bp, Homo sapiens
aggagtccacccaggaatttaaaaaaagagatgctaaattacagggcttggggtcct

SEQ ID NO: 6798904 - DNA, 95 bp, Homo sapiens
gcttgccaaatgcctttggaaaccaggctttgagacgcctttgtgactcttgtttgcatgttttttggctatgatatcgaggcatttggttctgc

SEQ ID NO: 6798905 - DNA, 57 bp, Homo sapiens
gaggctggtttgccttttggcacagtggaaatagcatgtgctctggagccagctctc

SEQ ID NO: 6798906 - DNA, 56 bp, Homo sapiens
cgtcggccttcatctccggcaagagcactcgcctgtctgggagtttggtgctgccg

SEQ ID NO: 6798907 - DNA, 62 bp, Homo sapiens
tgcagggtggtttgaagggtctgggaactggaggtgaggccagaaccttggatgccattgca

SEQ ID NO: 6798908 - DNA, 76 bp, Homo sapiens
tccttttctttcctgagccagagtttcattgtcaataaaattagaccaatgctaactcccataggggttgaaggga

SEQ ID NO: 6798909 - DNA, 77 bp, Homo sapiens
ttccttagtgtgagtgccccatggggtacatttaggggctatgtgagcctctcttccaggaggcactgacagaggag

SEQ ID NO: 6798910 - DNA, 73 bp, Homo sapiens
ggtgtgagggttttaagggaatgaaatagtaacattaaatttgcaacagttattctgcaaaatcttcaaatcc

SEQ ID NO: 6798911 - DNA, 66 bp, Homo sapiens
gaggtgggtggatcatgaggtcaggagttcgagaccagcctggccaacatggtgacaccccatctc

SEQ ID NO: 6798912 - DNA, 94 bp, Homo sapiens
ggcctcagctgaaggcctggctctgagccagccacctccttcacacaacccaccttgctctgaagctgcctgctcacagccatgccccgatgcc

SEQ ID NO: 6798913 - DNA, 71 bp, Homo sapiens
agctctaaatggaattttgcctggacctgggagtcttcaaaggaataggaggaaaaattgtggatagagtt

SEQ ID NO: 6798914 - DNA, 84 bp, Homo sapiens
gttacctcctgcatggttgtgctattgcccccagacttctccctggccctcaatcttgttcataatcatgcagtagagagttgc

SEQ ID NO: 6798915 - DNA, 70 bp, Homo sapiens
catctgtttgtgccaacatctcaggtccctgaatgtaccccttctcctgaggttgaagtataaattgatg

SEQ ID NO: 6798916 - DNA, 82 bp, Homo sapiens
tataattcggctatggactcgttcatagttccaatttgctaggcagaatagtaaggatgaagtgagtccatgggcatttatg

SEQ ID NO: 6798917 - DNA, 90 bp, Homo sapiens
gctgcgtgtgacccatgggagacagtgcagggcgggaagaaggggaggccagcgtctctccctcactctgcctcctggggtttccgcagc

SEQ ID NO: 6798918 - DNA, 102 bp, Homo sapiens
tccattatgtcacaatgttccctattttatttaggtttagttgttgtgcaactgctgattattgaagtagagggtggaggacatatgtatttcatataagga

SEQ ID NO: 6798919 - DNA, 65 bp, Homo sapiens
gtgtgtgtgtgtgtaaggtctcctattgattctgtttctctggagaaccctaatacaatggacat

SEQ ID NO: 6798920 - DNA, 57 bp, Homo sapiens
gcagaaaactggggttttagcttgtgctacaaataaactctggcctcagtcttctgc

SEQ ID NO: 6798921 - DNA, 65 bp, Homo sapiens
ccagggctgtgtccctaggggagctgcagaaagcagtgctcttcttgtctgggacacttgcatgg

SEQ ID NO: 6798922 - DNA, 82 bp, Homo sapiens
gtctttgctattgtgaatagtgctgcaataaacatacatgtgcatgtgtctttgtagcagcatgatttataatcgtttgggc

SEQ ID NO: 6798923 - DNA, 77 bp, Homo sapiens
caatgtcttctcttgttgaatttaaatgactgtgacattatttttcataccttggcaaattttgcaaggagatattg

SEQ ID NO: 6798924 - DNA, 75 bp, Homo sapiens
ccttttctctgccacagcttctgcctttggaggcttacccttcctaggagcagaactgttgtggaggggaagagg

SEQ ID NO: 6798925 - DNA, 95 bp, Homo sapiens
gccccgagccaatcagcttctatttcatgttgatctttcgagggtgaaaacctactggagaagagcatgagcaaagccattgtatttgctggggc

SEQ ID NO: 6798926 - DNA, 73 bp, Homo sapiens
ctcctagggtgtaatacattagcaaaccaaagaatcaaagatctttgcccttgtggagtttacatgctagggg

SEQ ID NO: 6798927 - DNA, 86 bp, Homo sapiens
atggtcgccccactggcctcagaggctgtcaggcagcagggattgtgtcccgagagcctgcagcctcaagggctgagctgcgccat

SEQ ID NO: 6798928 - DNA, 90 bp, Homo sapiens
ctgtgggcccactgtcattgtacatgttatacaagtagattccttcttccacattgtataatgtgttactgtatggctactgggcttcag

SEQ ID NO: 6798929 - DNA, 79 bp, Homo sapiens
gttgtcatctctaggggaattgcagtgtgtccatccacccttgaggcatggcaaggtgaacatcccttggactgaagac

SEQ ID NO: 6798930 - DNA, 58 bp, Homo sapiens
gttgagctctccagcttcatttccagaaggctgctggctgtgcagttcagagttcaat

SEQ ID NO: 6798931 - DNA, 66 bp, Homo sapiens
aagaaagattttgcacaaagcttctgaggtcaagaaacccaaggctatgtggaataatttgctctt

SEQ ID NO: 6798932 - DNA, 55 bp, Homo sapiens
caatatctttggcatttctggtgtcaagacctagccagagctgttatggatgatg

SEQ ID NO: 6798933 - DNA, 62 bp, Homo sapiens
gagcctacttcagtacctgccataccagtgtgaggaaagacactatgacagctggagggctc

SEQ ID NO: 6798934 - DNA, 73 bp, Homo sapiens
ggcagcaggatggccaattgccatcaatttctgcagcaagtctggcatcatggcatcttggcatcttgctgct

SEQ ID NO: 6798935 - DNA, 67 bp, Homo sapiens
agagtgacattccagaagctatgtacttcttgctgttaatacagtatatatggttatctgatacttt

SEQ ID NO: 6798936 - DNA, 56 bp, Homo sapiens
gtggtgcaatgtgtgtgtgtgtgtgtgtgtgtacacacacaagcaggttgtggaac

SEQ ID NO: 6798937 - DNA, 63 bp, Homo sapiens
tcaatttcaccatcattaacttcatgtcgactaagcaggatattggttttgatggggaaatga

SEQ ID NO: 6798938 - DNA, 56 bp, Homo sapiens
tccatttggcactctatttccataatgcgattccgcagcgtacgggcgtcagagga

SEQ ID NO: 6798939 - DNA, 55 bp, Homo sapiens
aggacctttggcaaggctgctctgacaaagagaaatctaagatgctcaaggacct

SEQ ID NO: 6798940 - DNA, 130 bp, Homo sapiens
tgcagcagagcatcacctagcaacttgttagaaatgcatatgccctggcctcacctcagacttactgaatcagaaactctgaggatggggtcaagcagttgtaataagccttccaggtgattctgatgca

SEQ ID NO: 6798941 - DNA, 69 bp, Homo sapiens
tgccattagagtatatcatgttgtgcttcagcatttacttatgcataacaaatatgctttaaataggca

SEQ ID NO: 6798942 - DNA, 130 bp, Homo sapiens
cttcctacgccggagaaagctgccattgtcgaacatgtcctgggaggcggggtccaggctccagtagttgcccttgcctgggcggcccggctcgcgggggatcttgacgaagcagtcgttcagcgagagg

SEQ ID NO: 6798943 - DNA, 75 bp, Homo sapiens
tcatttctaggtcccatcccccttggcactcaggtccaaaaggtcttggtgctatcttgggtggacaggaagtga

SEQ ID NO: 6798944 - DNA, 75 bp, Homo sapiens
tgggggctgtgtacccacgtgggcaccccgcgcacaggcagtgcggcgtcctgctaggtgcacagctttatacca

SEQ ID NO: 6798945 - DNA, 61 bp, Homo sapiens
tgatctgggtcatgactcagcgtgagtctgagggtcgggttgcagtccgtggcccaagtca

SEQ ID NO: 6798946 - DNA, 129 bp, Homo sapiens
tttagtccatttcttatgtgtaaacttctgtaagatatttttaggatggtgaagtgagcacatgcattgtgctgacacttccagttaaaaatattattatagaaaaattcactagaattgaggaataaa

SEQ ID NO: 6798947 - DNA, 58 bp, Homo sapiens
ttcctggggtgaagatatttttcttccatcttagagaaagcccccttctgcccaggaa

SEQ ID NO: 6798948 - DNA, 93 bp, Homo sapiens
ggacctctaaggcaactgcctcattagcaagttgttatcctttggtggcatccagagagaaagatagcttctaagaactacagcctcaggtcc

SEQ ID NO: 6798949 - DNA, 63 bp, Homo sapiens
gccatacctgaggctcctatggcctggaacgaggaatgtggtagggacctcaggactggtggc

SEQ ID NO: 6798950 - DNA, 59 bp, Homo sapiens
tgtatcctggccattttagaatcctggtgagttggaacattctagaatgcccagggaca

SEQ ID NO: 6798951 - DNA, 100 bp, Homo sapiens
atgaagaaagaaacttgagagtgaccctcccaaggttacaagctttagtgacagagccctgacagagagcttttgactgtcagctccatgttctctttat

SEQ ID NO: 6798952 - DNA, 59 bp, Homo sapiens
tcatctgtctgagagacttctgtccaagttggatggagaaacagctctaagacacgtgg

SEQ ID NO: 6798953 - DNA, 80 bp, Homo sapiens
gagtttattaagacatcctggatgttcaaaagaatttgaggctttccccttttgatagaaccaggatatctggatatctc

SEQ ID NO: 6798954 - DNA, 129 bp, Homo sapiens
gctgagaaaatatgatgcttcaagggagctaattgtgtttagtactgtttaaaaatggaaattgaaaagtgtttattaaacttagtgataggctcatttgtgaccctggagaaagcatggttttttggt

SEQ ID NO: 6798955 - DNA, 66 bp, Homo sapiens
tgtctaaacccagcccctcactcttgtccatgtgagacctgcaaggagttgagggttgggttggca

SEQ ID NO: 6798956 - DNA, 76 bp, Homo sapiens
caagaagtgctgaaactgaggttggagaaggcagtgagaggcaaattcagagtcttaactattcagagtcttcttg

SEQ ID NO: 6798957 - DNA, 127 bp, Homo sapiens
agtgaaggcacttgaaggcatctgtgcaggaggatgacaactgcaaacattaatcaccccaaagtgtcctagcctcctttgcagttgtcaccctcctgcatggatggcctgtacagatgtcttcgct

SEQ ID NO: 6798958 - DNA, 73 bp, Homo sapiens
ctaacctgcttctgccctcacggtagcgtgcacaatcttcatcgcatgtcctgggtggtggtaggagcagtag

SEQ ID NO: 6798959 - DNA, 83 bp, Homo sapiens
ggcacgcacctgtaatccctgctacttgggaggctgaggcaggagaattgcttgaacccgggaggcagaggttgcagtgagcc

SEQ ID NO: 6798960 - DNA, 130 bp, Homo sapiens
agcatttacttagagaattgcaatccttaaactgttcggtgtggtctcatagaccagctcaaagacatgacttgtctggcagatcatgcaacctcagttctctaagctttcatttctttcattgtaaact

SEQ ID NO: 6798961 - DNA, 81 bp, Homo sapiens
taacctaaccttacctcattacatctgcaatgacctatttccaaatgaggtcagactctgaggtactgggttaaggggtta

SEQ ID NO: 6798962 - DNA, 89 bp, Homo sapiens
gggcctgggggctgtaggcggagttcacagtatctagcgatggagctggtaggtcctgagggttcgtctgcagcttggaagacaggccc

SEQ ID NO: 6798963 - DNA, 57 bp, Homo sapiens
aagtcacccacaggcagcagaaactaatgcaatgtgtctgcagctattttgtgactt

SEQ ID NO: 6798964 - DNA, 61 bp, Homo sapiens
ggggaggtcagctggaggggaggctggcaccttccaagcccctctccttgtgcacctgctc

SEQ ID NO: 6798965 - DNA, 74 bp, Homo sapiens
gctgagtttattttgaaagtctgttttgaatttgcagcactgcctctttaggagggtattttaagatgctctgc

SEQ ID NO: 6798966 - DNA, 68 bp, Homo sapiens
cccaccagacctgcaccggcacagccctcgctcagcggggcaggaagctcatggtgtagtttcgtggg

SEQ ID NO: 6798967 - DNA, 68 bp, Homo sapiens
tattggacaagacagaacagaataattgttggatgaatctacggttctgtggttctgttcgtttagta

SEQ ID NO: 6798968 - DNA, 69 bp, Homo sapiens
cactaaccatattcacactatgcccagtgtgtgtgctgtgctgtgtgtgtgtgtgtgtgtgtgtgtgtg

SEQ ID NO: 6798969 - DNA, 55 bp, Homo sapiens
agggatgagatgaatatttggggtgagtttacactaaagtagtcatcccattctt

SEQ ID NO: 6798970 - DNA, 129 bp, Homo sapiens
cagttggataagccacaggtgatatcagaggtaaaatgccccagctgtcaatgaaatgtgagattagagcaacctagaactctctgtgacagctgggtatgtcccctctgaatctggttggccagcagg

SEQ ID NO: 6798971 - DNA, 77 bp, Homo sapiens
ctacagtcttgctcccagagaccaagctgagaatgtctaaatttgatcaggtggggttggggtgaggctctaagtag

SEQ ID NO: 6798972 - DNA, 74 bp, Homo sapiens
gtgactgtttcaaagggtactgtgagagttaatgagtacctctgttgcatttcatcctgcttggaaacagtcac

SEQ ID NO: 6798973 - DNA, 96 bp, Homo sapiens
gataatcatagacctcaagtggctcagagtctattgaggaaatttaatttctttagttaccacccaatagattggctcacaatagtttagataatc

SEQ ID NO: 6798974 - DNA, 74 bp, Homo sapiens
gtttagtggaatgggaagtgtaatgggctggaagggaacccacctctacaacattatgctttctgtccttaggc

SEQ ID NO: 6798975 - DNA, 86 bp, Homo sapiens
cacttttatgtttcttgctgttttctaccctcaagaagtaccacttataatttgggggtcggagggggcaatgaaaactgaaaatg

SEQ ID NO: 6798976 - DNA, 57 bp, Homo sapiens
caagggacagttatgagaccctgttagaaagtgagtcccataggagctgtcaccttg

SEQ ID NO: 6798977 - DNA, 56 bp, Homo sapiens
tcactgcaggggaaccacctggccctctggagctgggtcttcccactgtctggtga

SEQ ID NO: 6798978 - DNA, 107 bp, Homo sapiens
aacagggaacagagggaggaatttctgacagcagatgaagcctgcagatttttacctactttgtgtaagccttccttctctattctcttttctcctccatccctgtt

SEQ ID NO: 6798979 - DNA, 76 bp, Homo sapiens
ggggaacagcttgggctctgccatttgctgactgcgtgaccctgggtggatggttcagttgcacaggctgttctct

SEQ ID NO: 6798980 - DNA, 57 bp, Homo sapiens
gctatataattctcaggtttgactatgtcattatgtcacttgctgagatttatgtgc

SEQ ID NO: 6798981 - DNA, 99 bp, Homo sapiens
actgccaactcagttaagaagaacacatagagaagttttatcagcagcctctgttcccaatggaagtctctgttaagtttctctggctgaggacttagt

SEQ ID NO: 6798982 - DNA, 65 bp, Homo sapiens
cttcagagtgcagaagattgggataatttgtaatggcttttgagttttctgttttagctctggag

SEQ ID NO: 6798983 - DNA, 129 bp, Homo sapiens
ggttcagtctttcatgggaaagctctgaggaagctttgtcttgtctcctggactatctcctgagagaaagtattgtcagccaggagtcaaataaagccaggcctggagattcagaggagacgatgagct

SEQ ID NO: 6798984 - DNA, 94 bp, Homo sapiens
gctatcatcatcttcatcatcatcattaccatcattagtagtaacagtaggagtatttaggatgaatagtggtaggatgaggaagatgttgagc

SEQ ID NO: 6798985 - DNA, 67 bp, Homo sapiens
gtttctctccttagaggaggcaagagctcactagtctttcaatgtatgtctttctgaggagtgggac

SEQ ID NO: 6798986 - DNA, 64 bp, Homo sapiens
gcatcatcacggtcaccgagccccaattacctcagggccagcacaggtgaatctggatgaatgc

SEQ ID NO: 6798987 - DNA, 57 bp, Homo sapiens
gactgggcagccggtagggaagttgattcttgcagctacttatgccatttcccagtc

SEQ ID NO: 6798988 - DNA, 60 bp, Homo sapiens
gccagctctgcttgcccagtcaggcctcctccagcctgaccatgggcagcaggctccggc

SEQ ID NO: 6798989 - DNA, 63 bp, Homo sapiens
tctcgcaatcatgcagcaacaagcaaggcagagctggcatgttgttgactgataacatcgaga

SEQ ID NO: 6798990 - DNA, 64 bp, Homo sapiens
gcctgggagattaattaggaaggatgccaagaaaatatctcagcctatgttctaatctctcagc

SEQ ID NO: 6798991 - DNA, 102 bp, Homo sapiens
tgaggcaggagaatcgcttgaacccgggaggcggaggttgcagtgagccaagatcgtgccactgcgctccagcctgggtgacaagagcgaggcttcatctca

SEQ ID NO: 6798992 - DNA, 62 bp, Homo sapiens
gttcaaagggaaaagcaggctggccaacccacgtgatggctcttgaagcttctcttttgaat

SEQ ID NO: 6798993 - DNA, 56 bp, Homo sapiens
taagccactaggactaaacaaagctgtaaattggctttgaatagaaatagtgctta

SEQ ID NO: 6798994 - DNA, 79 bp, Homo sapiens
tttactcttgcactgtcattttctgatgcagtaagtgtcatccttgtgctgcaaatgagaagagactgtgggaggtgaa

SEQ ID NO: 6798995 - DNA, 102 bp, Homo sapiens
tgggacacttgttacaatggagattccaagttccttttcctggagaatccgattccttgaaagaggcctaggaatctgtatttttaactcataactgtccca

SEQ ID NO: 6798996 - DNA, 61 bp, Homo sapiens
gctcaaagaggcctccaaatccttccaggctcagcccagaccttgaaggcctttttgcagt

SEQ ID NO: 6798997 - DNA, 76 bp, Homo sapiens
tttctgtcaaataagttgacacagtgtgctttgtccatgaattagagttttctggtctggtttgtttagacaggaa

SEQ ID NO: 6798998 - DNA, 73 bp, Homo sapiens
tatgtactagtgttaatctctgctcagccatagagagtgtttgtggctgcaagcctttggggctggtttcata

SEQ ID NO: 6798999 - DNA, 67 bp, Homo sapiens
tgtttttgcttgtacaacatggacttgctaccactgaatgtagcctatgttcttggcaagcagcaca

SEQ ID NO: 6799000 - DNA, 62 bp, Homo sapiens
ggcctggcttcatgagcatgcgatctatttagctgcatgaagcgtccatgcttagaggggcc

SEQ ID NO: 6799001 - DNA, 55 bp, Homo sapiens
tttattaatgtagcatccatggtgctcttaagacgtggctgcttttattagtaaa

SEQ ID NO: 6799002 - DNA, 55 bp, Homo sapiens
gcccaggtctggcatcagctgtgtgctcagtttcagctatatgccaggcccttgc

SEQ ID NO: 6799003 - DNA, 65 bp, Homo sapiens
tgtgtgaagtgattttaagtctagatttatttacaggtggaggatagacaaaatgacttcatgca

SEQ ID NO: 6799004 - DNA, 89 bp, Homo sapiens
ggagtcttgctcttgttgcctaggctggagtgtagtggcgcgatctcggctcattgcaaactccgcctctggggttcaagagattcttc

SEQ ID NO: 6799005 - DNA, 74 bp, Homo sapiens
gaaggaatgcccttggcagagaatatgctgtgttcgtttcgatccagacacctactgctactttggtatccttc

SEQ ID NO: 6799006 - DNA, 81 bp, Homo sapiens
caactagagtttcacagcaaagttccccgttttattaaaatccgccaggggatgttttcaacttgtgaaataacctaattg

SEQ ID NO: 6799007 - DNA, 91 bp, Homo sapiens
gtgtgttccatgggtgaagggattttgtttgcttcgatctctcctgtattctgagcagctagataaagcccttccagcacattttactcac

SEQ ID NO: 6799008 - DNA, 73 bp, Homo sapiens
gtgtatttgagatttttcacacatgtggcttgatcacttgtgatctttcactttttgtggatgatcaatgcac

SEQ ID NO: 6799009 - DNA, 79 bp, Homo sapiens
gcaggaaatggccttcataaccattctccaattttgctggaggatcagggtggtggaagtcattttaaaaaccagctgc

SEQ ID NO: 6799010 - DNA, 84 bp, Homo sapiens
ccttgggggctgttgcagggcttggggattacagcctgttttcagcatccctatttaaagcccagcttctcagtgttcccgagg

SEQ ID NO: 6799011 - DNA, 60 bp, Homo sapiens
ccagccttttctctttgcctttcagggcacattgtcatgaacaaaggcaggagaaggcgg

SEQ ID NO: 6799012 - DNA, 77 bp, Homo sapiens
gaggccagccagtgtctagtcacaggtacttatctaagcctcataattatttggaataggcattgcatttgtgcctc

SEQ ID NO: 6799013 - DNA, 63 bp, Homo sapiens
gtttctctttggactttttccctcttgtaaattgatactgagggtatgaagccaaggaagaac

SEQ ID NO: 6799014 - DNA, 55 bp, Homo sapiens
gtgtcaggggcagccaggaaatgttctgttaagatgtcctttctgttcctgagat

SEQ ID NO: 6799015 - DNA, 62 bp, Homo sapiens
aggttggaaaaattcagactgtgctccatcttgaggccaggaagctgggtttccatacacct

SEQ ID NO: 6799016 - DNA, 72 bp, Homo sapiens
gaagatagaaaagagaacaatatttgtgtcataagacatcttcaagacatctttgttcattgagctgttttc

SEQ ID NO: 6799017 - DNA, 60 bp, Homo sapiens
tgtcttaatttccctttgtcatgtaatgtagcatattcacaagttctgggaattaggaca

SEQ ID NO: 6799018 - DNA, 105 bp, Homo sapiens
aaagaatttatattaatttataatcatatggcttaaaatttcagcatggctaaatccatattgggttagtgagtcagagtttatcaaatggaatgtgattttttt

SEQ ID NO: 6799019 - DNA, 87 bp, Homo sapiens
acgctctcagtaaaagatgaatgaatgaaaaatgggtcagatgcacctgcaatgatgtgtgattcattctcaaagttgtgtgggtgt

SEQ ID NO: 6799020 - DNA, 76 bp, Homo sapiens
tgttcttactgctactgaaattagatagtccaaatgtgataaatggaagctgtaatttctcagtggaggaagaata

SEQ ID NO: 6799021 - DNA, 91 bp, Homo sapiens
tgaggtcagtattagcagactgtattcaaaatgtggttattgaaaagctaacttctcattaatgatacagtttggaagccctgtaacctta

SEQ ID NO: 6799022 - DNA, 57 bp, Homo sapiens
gctggggaccctgcctaggggagagattcacctcctccatgtaaaggtcccctcagc

SEQ ID NO: 6799023 - DNA, 74 bp, Homo sapiens
gtctgtgagctgggtgaatggtagggcagggtagcaccaacagatttcccagcccttgggccccagctcagggc

SEQ ID NO: 6799024 - DNA, 76 bp, Homo sapiens
ccactggaaagtctgaggtaaaatttctattttgataacaactcttattaaaagatgaagagtgcctttctagtgg

SEQ ID NO: 6799025 - DNA, 75 bp, Homo sapiens
agacaatatagaagtggtctgcatttgcagcaaacgttgtggggaatgcagaaatttgtgagatgcatattgttt

SEQ ID NO: 6799026 - DNA, 88 bp, Homo sapiens
agggatctttattgtaaaatttttagcccattaaagtaaattatatctaactggcttaaattttatcaagggaatttatgagatctct

SEQ ID NO: 6799027 - DNA, 74 bp, Homo sapiens
tgttatagccttatatgaactattagagcacctgccaaatctgctctcagtgcagagaggctatctttccaaca

SEQ ID NO: 6799028 - DNA, 76 bp, Homo sapiens
tcatccttaagccaggccagcttctaccctctgttgtggtgaccatggaacacagggcagctgctgggaaggatga

SEQ ID NO: 6799029 - DNA, 60 bp, Homo sapiens
tccagagcctcagaatcctgtggagagagttgagaccaggcgcctccctgaggttttgga

SEQ ID NO: 6799030 - DNA, 90 bp, Homo sapiens
gtgggcatttgagaactggtagcacttgtgattatgagtaataatgttcacctcccctgctcctcactgtctgccaggtctctgcctcac

SEQ ID NO: 6799031 - DNA, 63 bp, Homo sapiens
tgtctcacagccttaacaaggagccagctggccaacatctcagacctccagagctgtgagaca

SEQ ID NO: 6799032 - DNA, 58 bp, Homo sapiens
tggaatatagcatataggctaagagtatagtctctggacccatattgtctgcattcca

SEQ ID NO: 6799033 - DNA, 69 bp, Homo sapiens
aagctgagggtgtgaccatggtctatgattatcctaacttcatctacttgaccagcccactcccagttt

SEQ ID NO: 6799034 - DNA, 86 bp, Homo sapiens
ttcctgaccttttgaattcagttgaagttgttttctttctcaaccttgcaacaaccctcagctgtttgaggagagcttactaggaa

SEQ ID NO: 6799035 - DNA, 129 bp, Homo sapiens
agtgccccatggccaaatattcttgcactgtcttccttggatctttcctatgatttgtgcacatactgcagtgaaaatggcaaagagagatcctgcagggattggtaatttttcaccgtgggtggcact

SEQ ID NO: 6799036 - DNA, 87 bp, Homo sapiens
gccactgggccttgtgtgtctcatcttccagcagtctagcctgttggtgtttatttggtgggttacttaacagggttctaagtgagc

SEQ ID NO: 6799037 - DNA, 67 bp, Homo sapiens
gtaagaggagtaagtgttaagactagagccagactgcctgggttcggatctttactttcctacttac

SEQ ID NO: 6799038 - DNA, 69 bp, Homo sapiens
gaccttgaagatggtagcaatttcctctctgactcatgcataggaggagattccaacattttctctgtc

SEQ ID NO: 6799039 - DNA, 55 bp, Homo sapiens
cttccaagcccaggagccatttgcctggacggtgttgtggctgttggactggaag

SEQ ID NO: 6799040 - DNA, 61 bp, Homo sapiens
gctccccaaaagctccaggaaaggatacttcttggcctctcttctggcttctggtggctgc

SEQ ID NO: 6799041 - DNA, 78 bp, Homo sapiens
gccttgggtgagagaaaagaaacactgttctttgtaaagaaatgttctctaatctttctctttatccaatctctgggc

SEQ ID NO: 6799042 - DNA, 104 bp, Homo sapiens
gcaggctcagtgtcctggcccccaggtctgaggcaaacagaggagtgtgctctctacacttttcttctgcctcagaatcttaagtcagcatccccaaggcctgc

SEQ ID NO: 6799043 - DNA, 100 bp, Homo sapiens
gcagtctagccagggcccgtgtgccattacaatgaagtaataatgtatttataacacacctaaccactgatggcttctattgctgtggcattccctctgc

SEQ ID NO: 6799044 - DNA, 72 bp, Homo sapiens
cattcctatgccaagaatcctgttcttgaagataaactgttatctttggtgcatgatactttgtctagaatg

SEQ ID NO: 6799045 - DNA, 63 bp, Homo sapiens
tctgctcggctcagggtaggggtccgggttcggcttccctgtggatatctgcagctgagcagg

SEQ ID NO: 6799046 - DNA, 61 bp, Homo sapiens
ttcccatttcatgctggctgtggcatgctttgagtttgttgcttccactgtaagtggagaa

SEQ ID NO: 6799047 - DNA, 59 bp, Homo sapiens
acttttgtcatagttattgctgcccctgtgaatggtgaggggctctgcttggcagaagt

SEQ ID NO: 6799048 - DNA, 61 bp, Homo sapiens
ctacctttctgactcttgggattacgggttatcactgtttctttgatggaaggaaagggag

SEQ ID NO: 6799049 - DNA, 90 bp, Homo sapiens
ctggatggcggcgtcattcccgagatggagagctgagtggggccaggggagagggcaggttcagttccatttcaggtgggttgagttcag

SEQ ID NO: 6799050 - DNA, 89 bp, Homo sapiens
ccagccttcggtggggtgcggcagggggcctgcctccaccaggcatagcatggaggccacctgacctgctgtttcctacatgaccctgg

SEQ ID NO: 6799051 - DNA, 72 bp, Homo sapiens
taaaagaattttatcttattacttgcaaggcagtagaatctgagtgctaagtagtgatgtagagatgtttta

SEQ ID NO: 6799052 - DNA, 62 bp, Homo sapiens
ttgtggaggacaaaagaagcctttacaacacaggacgtaaagcagggcgatgtcctcctcag

SEQ ID NO: 6799053 - DNA, 59 bp, Homo sapiens
ggcttttgggtccaaatctcaggttctaataaatgctccttgaggtcaaggactaggcc

SEQ ID NO: 6799054 - DNA, 57 bp, Homo sapiens
cctgataacacagatacaagatggatacaaatgctatcagcaatctcgtgtattagg

SEQ ID NO: 6799055 - DNA, 58 bp, Homo sapiens
gggccagcagtatcggaggcatcacagctgtcatgatcatccagagcctgctgagccc

SEQ ID NO: 6799056 - DNA, 71 bp, Homo sapiens
gttctctttcaagttacctttaaacagcttcctatttttgaagcttgattttaaggcttgttagattgaac

SEQ ID NO: 6799057 - DNA, 57 bp, Homo sapiens
cattcctatcattagtgaagccctatgtatacacaggggtcacaaaatgatagagtg

SEQ ID NO: 6799058 - DNA, 67 bp, Homo sapiens
cgttgacctggagactgtggccttggagctgaacgagatgattcagggcatactcttcaaggtcacg

SEQ ID NO: 6799059 - DNA, 73 bp, Homo sapiens
ggatcgcatggctcatttatcttgcagccattaattaatggtggttaattgtagttatgagctgttgaattcc

SEQ ID NO: 6799060 - DNA, 124 bp, Homo sapiens
ggagggaaaatgccatcagcacaacagtggccagctctgcatgtttcccttgagttgcttctctccagaggtttagcagggttggggttttccactggggtttacatcttgggatttgtcttcc

SEQ ID NO: 6799061 - DNA, 86 bp, Homo sapiens
tcatctttgcaatggtcccttaaaacatttttggtgatctgtattcttactagaatctggaaggggctattctgtaagcggagtga

SEQ ID NO: 6799062 - DNA, 78 bp, Homo sapiens
accataaatgtggaatctgaattgttcattcgattccccatcatgggagtggaaagtttctgatttcctaactgtggt

SEQ ID NO: 6799063 - DNA, 84 bp, Homo sapiens
gcctatatgggaagttcaggtgggaattgagcaacaaaaggccatctcactatctgaaacttaggaacgtatgaaataaagggc

SEQ ID NO: 6799064 - DNA, 62 bp, Homo sapiens
tgcaggcatttcgcaaaggctgagcctctccaggaggcacattttttgtagaagtggcttca

SEQ ID NO: 6799065 - DNA, 65 bp, Homo sapiens
gggggagagagctccgtgacagcttcagctgccctagctctagcctggcttagctctctcacttt

SEQ ID NO: 6799066 - DNA, 63 bp, Homo sapiens
gaagtcagaaattattcaggaatttgtaggccaagataaagccatgataagatttctgatttt

SEQ ID NO: 6799067 - DNA, 83 bp, Homo sapiens
ttcactcatttttggcatacacagttgtgtattcagataattgtcagtgcaatgctaaatgtgttatgttaaaaaatgatgaa

SEQ ID NO: 6799068 - DNA, 60 bp, Homo sapiens
gacctccagcggccctgcagagcctgttcggtgagctgctcgggaaccgcctggagggtc

SEQ ID NO: 6799069 - DNA, 83 bp, Homo sapiens
gaaacaggccataagcagtgacaagtctggtaatgccagagtagtttttctgcagtaaagatttcccttcctgcttgcctttc

SEQ ID NO: 6799070 - DNA, 129 bp, Homo sapiens
aaaggagtgtttttgaagggaggcagtgaaagccctattccctgggcttgggggttgctccttggaaatgtttccatagaaccacccagagccttttgggctaaattttcagttcagattactcttgtt

SEQ ID NO: 6799071 - DNA, 129 bp, Homo sapiens
tccatatattccagtctcttgttgctgaccagctgataaggcatataattgctcttaacaattgggcataatttattcctgccttaggtggctgttacctgcagcaattaaagcatagtgactgatggg

SEQ ID NO: 6799072 - DNA, 79 bp, Homo sapiens
tgtgtgatgtccttcggacaaaattcttttaagttgacatgcaggacaggaatttgagtgctgtaggaaaatcaccaca

SEQ ID NO: 6799073 - DNA, 60 bp, Homo sapiens
catttaaataggactcctgggggttaccagtggatgacccccaggaattctacttaaatg

SEQ ID NO: 6799074 - DNA, 92 bp, Homo sapiens
taatctgtgaactacatgcatcagaggactctgggaacctgcattttcacaagcatttcacaggattctgatgtagtgaagctcacactttg

SEQ ID NO: 6799075 - DNA, 62 bp, Homo sapiens
tcttagaataaaagggggctataggagtgaaagtattactatattccctcttattgctaaga

SEQ ID NO: 6799076 - DNA, 76 bp, Homo sapiens
ggagcgcagtggcaggatcacggctcactgcagcctcaatctcccaggctcaggtgatcctcccacctcagcctcc

SEQ ID NO: 6799077 - DNA, 73 bp, Homo sapiens
ctacacagtgccaaattgcagttatttaaaggtgcaagatatgatgtattttagctgggattgcactgtatgg

SEQ ID NO: 6799078 - DNA, 117 bp, Homo sapiens
agaaaactatcaatagttgagagagctaaagtggaagtcgtgttttaaggattcatagagtagaggtgtggagaaacaggcttccattagagcaaaacaagtgatttaaatgtttct

SEQ ID NO: 6799079 - DNA, 67 bp, Homo sapiens
atccatgttgtggcatctatcagtactcacttattttcattactgaatactatttcataatgtggat

SEQ ID NO: 6799080 - DNA, 77 bp, Homo sapiens
atgcttttaactcctttatcccataaatctgttgcagtacagttaataatttgcagggtagaaatggacagaggcat

SEQ ID NO: 6799081 - DNA, 57 bp, Homo sapiens
gacctatttaagtgtagttcaaatgccaagaaacatttgaaatgtttttgataggtt

SEQ ID NO: 6799082 - DNA, 75 bp, Homo sapiens
ggggaaaggtggcttctcccgacaccctggcgggcagtatccaggcctgagatcaggagaaagccagctctcctc

SEQ ID NO: 6799083 - DNA, 84 bp, Homo sapiens
gcatagcaaacctccagtcacctggatgagaaacttacaaatatgtattgttcaacactgaggttgctgcagtgtttgttatgc

SEQ ID NO: 6799084 - DNA, 87 bp, Homo sapiens
tgtctaccgtaccccatgacccttctgtttcaaggtgctactgccaagaagccagatttggggcatatcatgtggacattgtggaca

SEQ ID NO: 6799085 - DNA, 87 bp, Homo sapiens
cacattacgggctatcgcttcatccgtgaagccaaagaaatgtgtttatttggtttggtttggggtgtgtgtgtgtgtgtgtgtgtg

SEQ ID NO: 6799086 - DNA, 60 bp, Homo sapiens
tgaatcagctgagtgttggcagatccaagctgggctccactgtgcagctctgctgattca

SEQ ID NO: 6799087 - DNA, 120 bp, Homo sapiens
tccaacagaaccctggaggcaggaaggtttggaaccaaggttctatagcaaaatctgtgggggtttcaaatggatgtgttatagaggcttgcattacttctggtgtctcccggggttgga

SEQ ID NO: 6799088 - DNA, 93 bp, Homo sapiens
gaaagctctatcagaatgattagtaaccaattttccacactaaaaaatcattgggaaaaagtgttgagtgctaataatcatttataggctttt

SEQ ID NO: 6799089 - DNA, 78 bp, Homo sapiens
tataatatgttcgtaaggtgtttgtatgttctatagtgttagatgtaaaaactcctttcgaaaagaaagcatgtttta

SEQ ID NO: 6799090 - DNA, 60 bp, Homo sapiens
cctggctcaggcacgcatggctcagctagctccacagacagccaagccttgggagccagg

SEQ ID NO: 6799091 - DNA, 58 bp, Homo sapiens
taagcaagggtctctgtatcagatatttaccaacagtgagattagagacccttgttta

SEQ ID NO: 6799092 - DNA, 70 bp, Homo sapiens
acatcacctcagctatttcaaaacagagctaaagttccagtccagggaatggctgattcttcaggtgtgt

SEQ ID NO: 6799093 - DNA, 82 bp, Homo sapiens
tatatgtgtatatgtgtttatgtgtgtgtgtgtatatatgtttatgtacatacatatgtttaaatgcatgtttctgcatgta

SEQ ID NO: 6799094 - DNA, 102 bp, Homo sapiens
ggccaagcatattgccttatatttagcaagcatgcggtaaatatgcattgcattgaatggaatgaaattgcattgcagctagattttgagatgcttatggcc

SEQ ID NO: 6799095 - DNA, 75 bp, Homo sapiens
tcctgctgggagccgtacctgtcacggggaagccacggcaagcagctcccgtgaaggtttggtttctgctaaggg

SEQ ID NO: 6799096 - DNA, 58 bp, Homo sapiens
cgtttttgtgaataagagaatgacagccatagaaataaggctgacagttccgagagcg

SEQ ID NO: 6799097 - DNA, 60 bp, Homo sapiens
gccatcatgccacagtttcccaaagggggcatccacagccttctatgtggcagtgatggc

SEQ ID NO: 6799098 - DNA, 76 bp, Homo sapiens
tgtgaggtcctggtggagtctctggggaagtgaaagaagctcctttaacttgactccactcacaggacaaagtgca

SEQ ID NO: 6799099 - DNA, 94 bp, Homo sapiens
gatgcagctgatgctttattattttgcagggaaggggtggagggatcctattattttgcttccaaagtgtaaagcgttcttttatggttgtgtc

SEQ ID NO: 6799100 - DNA, 63 bp, Homo sapiens
tctgagatcaactgtgtgggtttgaaccccagacactttccttaccaccagtgtgatctaaga

SEQ ID NO: 6799101 - DNA, 96 bp, Homo sapiens
agccttttgctgtcgttcattaagggtttagcagcttggtattgattttcttgcagctgcctctgaactttaattcctgcagcagaaaacaaggct

SEQ ID NO: 6799102 - DNA, 130 bp, Homo sapiens
ctatggtgttgtttggttaggtcactttggctttgaatctgggtacttgtaatactgtagtctaaacagtattagtggtatctgtgatttccttagtggcttggagtatggttgctagtaaaggctgtag

SEQ ID NO: 6799103 - DNA, 58 bp, Homo sapiens
aagtttccttctcgggattttcattcacatccacagtctgagtattccaaggaaactt

SEQ ID NO: 6799104 - DNA, 106 bp, Homo sapiens
tgtaataatttgtaaaaatgcgtgtatttttaggaatgcgctatttccagtaagggaagtattgacatttttaaggaactgtgctgcattaaaatccacagttgca

SEQ ID NO: 6799105 - DNA, 65 bp, Homo sapiens
tcaaagagaagtttttcttattacatgtaatacatagttcatgacggacaaagacttctctgtga

SEQ ID NO: 6799106 - DNA, 94 bp, Homo sapiens
atagccctccaatgtagtcgtgtctttgtattcatccgtaataatttctttagaaaaaaattgctgagaacggaattgctgcattggaggttgt

SEQ ID NO: 6799107 - DNA, 58 bp, Homo sapiens
cttgcgaatgacctcactgctttttgtatttgtaatggaatgcacagtcatttgtaag

SEQ ID NO: 6799108 - DNA, 78 bp, Homo sapiens
actgaaaccgtgagagtaccacctcaacatctgcatataattatgcctgatatcagttggaactctgcacttttcagt

SEQ ID NO: 6799109 - DNA, 77 bp, Homo sapiens
tgacttttcacagtggaaggctgcagggctctcacagggggagattccatttgtctgagcctgcagagtgtgagtca

SEQ ID NO: 6799110 - DNA, 62 bp, Homo sapiens
tcaaagtagagttcagtgcagccagtgcaggtgtgaatgctcaaaactggatactactgtgg

SEQ ID NO: 6799111 - DNA, 80 bp, Homo sapiens
tcatctctattggaactgagcaatggcatgaaattaggagaaaagtaatttcattgagagttgagttcctgtggagatga

SEQ ID NO: 6799112 - DNA, 77 bp, Homo sapiens
aatttggaagggagggtggtgcatgcctgtgtgtttgtcagctgagcagagctgtatttatctttccaattcaaatt

SEQ ID NO: 6799113 - DNA, 58 bp, Homo sapiens
gagtaggcagtggatttatggtaaatgacagagtgtttgcaaattttcctgactactc

SEQ ID NO: 6799114 - DNA, 89 bp, Homo sapiens
gaatgactaccaggttacttagtttgatgcctgggaatttggcctaagtaacaaaggataacttggtttagatctaaagtgggtcattt

SEQ ID NO: 6799115 - DNA, 76 bp, Homo sapiens
ggagggttggtacaaagttagatttaacttgagttaaaataacaaaagaaatctgatatttgtttcacaactgttt

SEQ ID NO: 6799116 - DNA, 69 bp, Homo sapiens
ggtaaggagagagaaattatgcattatatagttaaacactggcaaaacattatttctcattctcctact

SEQ ID NO: 6799117 - DNA, 59 bp, Homo sapiens
cccaaggaataggatcccaggaatttacctcatgtttataatcctataatcttcttggg

SEQ ID NO: 6799118 - DNA, 56 bp, Homo sapiens
aggttccaggtctgggttatgtgctctcttatgtgctcccagagcatcctgaactt

SEQ ID NO: 6799119 - DNA, 57 bp, Homo sapiens
tcttcagtttttttctattgccttgagattgcatgcaggtatgttgagaactgagga

SEQ ID NO: 6799120 - DNA, 64 bp, Homo sapiens
tttaaagtctcctgctgttggaacatacctacatttgttctttgaagtttagagagactctaaa

SEQ ID NO: 6799121 - DNA, 101 bp, Homo sapiens
ttagagacatcgcttggaaaaggctgtcttttcctcttcccacaccttccacccgctcttgcttgtgggcagaggatgaggcagcttgcccaaccctctgg

SEQ ID NO: 6799122 - DNA, 89 bp, Homo sapiens
atttattattcaaagcccagtaaacattggggaatgacatcttaagccaaatagtctatcttgtgctcactggctttgaatcattaagt

SEQ ID NO: 6799123 - DNA, 93 bp, Homo sapiens
gtgataatttacaacgttcctggtgctaagtagttccccgcttaagaatgcgttggctgggcagagattagcgcagggagttgtgtgtgtcac

SEQ ID NO: 6799124 - DNA, 55 bp, Homo sapiens
gccaggtgcatattagaagcattttcctcaataatgtattaaaaatgtatttggc

SEQ ID NO: 6799125 - DNA, 122 bp, Homo sapiens
ggctggtctgatttctaggtccttctcccagggcatgtggacttgtatgtttgactgaagttccataagccaatgctagcccacatgcaagggtgacagccaccacttagccatcactagcc

SEQ ID NO: 6799126 - DNA, 75 bp, Homo sapiens
ttttgctgaaaggtagctgtgtggtcttgggcaaataagttaacctctctgagccacggttgcttttctgtaaaa

SEQ ID NO: 6799127 - DNA, 95 bp, Homo sapiens
tcagggggagtggaggttggcctagaggtccaaagctctgccccaaggcagaagcatgctaaggattctcagagggctccgccacaccctgctga

SEQ ID NO: 6799128 - DNA, 72 bp, Homo sapiens
gccccttcccgcagccctagcgctctgggatactccaggggcagccacgtagggccctccgggaacctgggc

SEQ ID NO: 6799129 - DNA, 55 bp, Homo sapiens
ggcaggtgctctgtgggcctgggtaggtttctgcactgtggctcatgcatctgcc

SEQ ID NO: 6799130 - DNA, 71 bp, Homo sapiens
tctgaaacttccaggtcaagctcccctgtggtcagtcatgcttaccgaggagcactgacgcttgttttaga

SEQ ID NO: 6799131 - DNA, 128 bp, Homo sapiens
acattagaatcagctggggagcttttaacaattaccagtgcccagatctctccccagaacaaacgagaatctctaggggtgaggccaggcatcagtatttttaaaagcttcccgggggactctgatgt

SEQ ID NO: 6799132 - DNA, 92 bp, Homo sapiens
aatgttcctcaaattgaaatgtgtcaggcaatagaagctagtgaattacttgcactttattttgcttgtgcactatttgtttgaaggatatt

SEQ ID NO: 6799133 - DNA, 79 bp, Homo sapiens
aggggcaggaccttacccagaggggcatgacccaggtagatgggccgggctggactgggtggaagagtcctggcaccct

SEQ ID NO: 6799134 - DNA, 56 bp, Homo sapiens
cacagtcctgccagagggcctttgcacatgctttgccctcatctggaacccctgtg

SEQ ID NO: 6799135 - DNA, 64 bp, Homo sapiens
catggctcactgctgagctcgttcaagtgtccagagaagagcacctccgtgcagcgtggccatg

SEQ ID NO: 6799136 - DNA, 72 bp, Homo sapiens
tctgcaccccgccgtgacgtcacgcctggggaacgggaaaacccccacgcgtcacgtgatcgcgggggcggg

SEQ ID NO: 6799137 - DNA, 82 bp, Homo sapiens
cccaaccatgtatcagcttgtaatttgtggtgttggaagagcgaaactggctaacacagtacaagcatgatacataacaggg

SEQ ID NO: 6799138 - DNA, 94 bp, Homo sapiens
gagaaggtaaggacagctggctgggtggtgcctgaggtcctcaagccaggtaggggtgaggtccaggcctcatgatggccatctgttccttttc

SEQ ID NO: 6799139 - DNA, 57 bp, Homo sapiens
ttgcaccttcatatggactttggttttctcagttgactgcagtctgttgaagggcag

SEQ ID NO: 6799140 - DNA, 63 bp, Homo sapiens
tatatttgtgagactgactgaagttgatacatataatgtacttcattcattttcacgaatgta

SEQ ID NO: 6799141 - DNA, 123 bp, Homo sapiens
agcctgggattgtgcaactttaattggcatgttttttggcaatctgtttgatgcttgtgatacctgactggtatagctagcacgatgcaggtggctgttaatgtatagtgcacaacccaggct

SEQ ID NO: 6799142 - DNA, 58 bp, Homo sapiens
cctgatggctttgcctgctgtgaggctgcatccctctggacctgcatggccatcttgg

SEQ ID NO: 6799143 - DNA, 118 bp, Homo sapiens
aatcttgtttgttgtaactaatgagtgccctctggaagtgatggcaggtcattaccattattcaaatttatatgatcagcctatcctatctagactcattttcagtgatagatagatt

SEQ ID NO: 6799144 - DNA, 84 bp, Homo sapiens
atactctaacctgcacttcaaagatgtttgttccaaaattctaaaaaatggccaatttgactagacctcttgtggtgtgagtgt

SEQ ID NO: 6799145 - DNA, 88 bp, Homo sapiens
ggagggctgggcccagctcccaaggctgaggttcctgagctgggcagatacaggacagcagccattggcagtcacggggcagccctcc

SEQ ID NO: 6799146 - DNA, 88 bp, Homo sapiens
tatgggttgtttgcacattcgtttcaatagaattctacttttattgctttttaaaaatagtgtgcacagcatgaaaataaccatcatg

SEQ ID NO: 6799147 - DNA, 76 bp, Homo sapiens
gcgcagttttaatgatagctgtttcacatgtgcatgcggcactcatgtgggcagagctgtcagaagactgtaaagt

SEQ ID NO: 6799148 - DNA, 88 bp, Homo sapiens
aagccttggagtttggagagttaattgacagttacgaagataattcacttctttgtgttaactgcctcttcaactaaaatttaggctt

SEQ ID NO: 6799149 - DNA, 63 bp, Homo sapiens
tagcttgccaggctctggttccagccctcgtctcaggggcacatggagacttggcatcaccta

SEQ ID NO: 6799150 - DNA, 67 bp, Homo sapiens
gttctcaaactttggtacatcagattcacccaacatatgggtaaactggtcctcaaattttgatggc

SEQ ID NO: 6799151 - DNA, 95 bp, Homo sapiens
tcccctttttctccctgtcatttaggtctgtcagaaatgtttgtatatatttggtgacacctttctaaatattagggaatgcagagctaggggga

SEQ ID NO: 6799152 - DNA, 76 bp, Homo sapiens
gcctagatgttacttaaaattatggcccatttggataaaatatctcaaatgacaacgtgatcttagagcagcaggc

SEQ ID NO: 6799153 - DNA, 84 bp, Homo sapiens
ggcagtttatttgctgatttcagtttcagaattaagataaaattgtgaaaacaaatacctgaaatctgcaagttgaaacttgcc

SEQ ID NO: 6799154 - DNA, 61 bp, Homo sapiens
ggacctcggtgttgggaacgtggtcttcctggtagacacttcccttctctgctcatggtcc

SEQ ID NO: 6799155 - DNA, 66 bp, Homo sapiens
gatagtggtgtgtcaggagcaaattggtaacattccaatctaatgtaggtttcatacatggctatc

SEQ ID NO: 6799156 - DNA, 129 bp, Homo sapiens
gatgatgatggttttgataatttcattcacatgtgcctggcaagacacttgatcctgtatttctgggacaggcatcaatgttgggccaaagcaaatggccaggttataagggtccatcatattctcatc

SEQ ID NO: 6799157 - DNA, 63 bp, Homo sapiens
gcaggttgccacactgatcacatctggctgcgtctataagaaagatcaaagtggcaggcctgt

SEQ ID NO: 6799158 - DNA, 129 bp, Homo sapiens
gttaataggcagtgattcttcaatgctccttcagtgaagttacagtctgcttgctgactgctaattaaaacaagtttgctctctaagactgtgactaaaaggtagcaaggtcatcttatttaatgcaat

SEQ ID NO: 6799159 - DNA, 63 bp, Homo sapiens
atgagttatttaaaatgattgtccttggaggcctttgggaccaagtcatttaaatggactgat

SEQ ID NO: 6799160 - DNA, 102 bp, Homo sapiens
gccttttgcttagccttcatgggccaagactcagccccatggcctcaaactaactgcaaaagaggctgggaaatgtagtcttccccaggaggagcaaatggt

SEQ ID NO: 6799161 - DNA, 115 bp, Homo sapiens
caagtgtattgtgccttgttctagaacttttattaagtaggtacacttgacagtattgaggtcatttgtcatggtgctatttaattagtctaggtttaggcccttgtacttattg

SEQ ID NO: 6799162 - DNA, 69 bp, Homo sapiens
gtttaatattccaagtgggggaagctgagtctttgcagtcggacctggcttccaatctaggagctaaac

SEQ ID NO: 6799163 - DNA, 57 bp, Homo sapiens
tgcagttgtttctaatagcaagatagatttgtttgtgcagataggagacaatctgta

SEQ ID NO: 6799164 - DNA, 77 bp, Homo sapiens
aggactttcacggtggctgtgtgagagtagaagtcggattctttcattcccatagccatccggagagagcttctcct

SEQ ID NO: 6799165 - DNA, 66 bp, Homo sapiens
gaaaacaggaggagctgtttcagggaaagtcaagttccatgcaaagctagttcctttcggtagttc

SEQ ID NO: 6799166 - DNA, 56 bp, Homo sapiens
tctctgggttgagaactaggaccattttcctggttactgtttctactacttaggga

SEQ ID NO: 6799167 - DNA, 130 bp, Homo sapiens
gaaggtcattggcaggtatgtgaatcttcctggaccaggagagcatacacctctctcatctgctaggtactgtctctgccctggccaggccaatttaaaccttcacagcttatcagcttggactctcttc

SEQ ID NO: 6799168 - DNA, 56 bp, Homo sapiens
agtaatgtgcctgaaatacttgcgtagggcttggcaagtggcaggcgatcattact

SEQ ID NO: 6799169 - DNA, 87 bp, Homo sapiens
tttccgcaagaggatctgctgcttagcatgtggtgtccttgtacatttgtcctaggagaaccacagttgaactgatacttttggaaa

SEQ ID NO: 6799170 - DNA, 86 bp, Homo sapiens
ggcttcgtcgggctcgctctcctagcggagggggcggcggcggcccccaggtcccgggcaggtcgagcgagccacggcccccggcc

SEQ ID NO: 6799171 - DNA, 58 bp, Homo sapiens
gccataggcagcgtggccagcacatgaggacacttttcacatggttatctgccttggc

SEQ ID NO: 6799172 - DNA, 92 bp, Homo sapiens
gcaggagaattgcttgaacccaggaggcagaagttgcagtgagccaaagatcgcatcattgcactccagcctgggtgacagagcgagactgc

SEQ ID NO: 6799173 - DNA, 63 bp, Homo sapiens
gcagggcgctgaaatactaacatggacagatgtgttgtacatggctttattttcagcttctgt

SEQ ID NO: 6799174 - DNA, 63 bp, Homo sapiens
atgtgcagttgaagcatggggagaaatataggctcatgggtcttcctgaactatcaggcacat

SEQ ID NO: 6799175 - DNA, 55 bp, Homo sapiens
tcattctctacccactcagaagagttgctctaatagcctctgtgggagtcagtga

SEQ ID NO: 6799176 - DNA, 60 bp, Homo sapiens
tccccctgcccagggatatggcctgggcatgtctatccatatcctgggcatggcatggga

SEQ ID NO: 6799177 - DNA, 69 bp, Homo sapiens
ggtctggtcagagcccctttcatagaaatggaaacacttacttgaattggtttctgcagaagccaggcc

SEQ ID NO: 6799178 - DNA, 78 bp, Homo sapiens
catttttatatcctttactgtgtcacagactttggaaacccataaatatctgttggatggataaaggatggatggatg

SEQ ID NO: 6799179 - DNA, 58 bp, Homo sapiens
ggaagggaggccagaggttttgcagggaaatcccttaaatatgcctcttttcttttct

SEQ ID NO: 6799180 - DNA, 78 bp, Homo sapiens
aaaggcctccacctgctgggctgctttgggccaggagggtctctgtttcccacaggctgcccgcagctgggagccttt

SEQ ID NO: 6799181 - DNA, 96 bp, Homo sapiens
ctcccacaccagtgtggcagggtctctacgcactagaggggcccccgagggacctctcctggccacgttggagccagttcgtcccgctggttggag

SEQ ID NO: 6799182 - DNA, 99 bp, Homo sapiens
tcctagactatttggggaagatatcagtgaaaagtatgtgtatgaagaagcagataagcatttcacaggtgtgtttgagagtggttttatgagaaagga

SEQ ID NO: 6799183 - DNA, 55 bp, Homo sapiens
caggtagtgtgtagcacagcagttctcatctcagactgcccactagaactacctg

SEQ ID NO: 6799184 - DNA, 55 bp, Homo sapiens
ggacttgttatctgtgccacggggtttagccttgctgtctcatgggtgctagtcc

SEQ ID NO: 6799185 - DNA, 99 bp, Homo sapiens
gaggcaggagaatcgcttgaacccaggaggcggaggttgcagcgagctgagatcgtgccactgcactccagtctgggtgacagagcaagactctgtctc

SEQ ID NO: 6799186 - DNA, 86 bp, Homo sapiens
gggcgtcttgtcttctgttactctggtctgctgtatgcacctaaacccatttacagttccagagggcaggggcaatgagacacacc

SEQ ID NO: 6799187 - DNA, 87 bp, Homo sapiens
cagtaacagaaaagctacaatgtgtttttgaaactataaagtgaatggtttcttgggaaaaattgtggatttgtatatctgttgttg

SEQ ID NO: 6799188 - DNA, 93 bp, Homo sapiens
tttgtaaattttgactttgaaaggccattgtaatgtaaatatgacttcctagagtgtaaacaacagtggtttgaaattaaaaatttgtacaaa

SEQ ID NO: 6799189 - DNA, 60 bp, Homo sapiens
gatcatataagtttggctttacttagcacaagtgcaatttgaacacagatttgtctgatt

SEQ ID NO: 6799190 - DNA, 60 bp, Homo sapiens
tcatctcatttattccaactcagggagattgttcccagttggatatctcaagtgttgtga

SEQ ID NO: 6799191 - DNA, 72 bp, Homo sapiens
ttatgtaggataatgaattgccttttaatgcaggtaccaaacaggctccctgggataattcattccatataa

SEQ ID NO: 6799192 - DNA, 76 bp, Homo sapiens
tgggtcacacgttaacaatggtttccattggagtacttttatttgagaaattctagtgtttccattacaagaccta

SEQ ID NO: 6799193 - DNA, 77 bp, Homo sapiens
acttgcagttggtgtcagaagtaaggccaatcttaggtactatgtccttgagcctcacagtttggctaactgtgggt

SEQ ID NO: 6799194 - DNA, 67 bp, Homo sapiens
ggggtgggacaggtaggagtggctcttcccctagatgacctagctagcccttcaacctgcctactcc

SEQ ID NO: 6799195 - DNA, 67 bp, Homo sapiens
tcacaatggcagcagctttagctgtggctgttacaatttaaagccagaagtgattgctccgttgaga

SEQ ID NO: 6799196 - DNA, 73 bp, Homo sapiens
tggttctttctggtccttcttttctagtcacccagatggcctgacacttgagagggacacggaataagcacca

SEQ ID NO: 6799197 - DNA, 130 bp, Homo sapiens
gtttcctgatgaaaatatcttccccagaaaagccagagcttgacgtgcaacggaccaaccagaggctgctgggattcccatgttgtgcctggctgcagctgtgggcaggttaccaaccccattgggattt

SEQ ID NO: 6799198 - DNA, 65 bp, Homo sapiens
atccgagtgctctcatgctgactattaaaggtttcaatttaaaatgtttgcaagagaccagggat

SEQ ID NO: 6799199 - DNA, 103 bp, Homo sapiens
ggggggctgcagctcagattttgtttcctttctatacaggatgccatatggcacgctgtccctggggagaggactgacagtgctgtagttgccacttaccccc

SEQ ID NO: 6799200 - DNA, 76 bp, Homo sapiens
gataattggtctactttatagatgtctcttatttaatattctttggagaatttctctgtggagttagactggtatc

SEQ ID NO: 6799201 - DNA, 94 bp, Homo sapiens
gggttgggatgaacaagtgcacttgagtacgcgctgcacagtgtaggcatcaggccacgtcagtgtgtctctgcatttgggcagatgccaggcc

SEQ ID NO: 6799202 - DNA, 68 bp, Homo sapiens
aagtacttgatagattaactgtgggttttaatatattgcaaaaaaaattgacagttgtcaggatactt

SEQ ID NO: 6799203 - DNA, 55 bp, Homo sapiens
gggctgttccttccacccagaggcaactggagccttcctggggaaggagctgcct

SEQ ID NO: 6799204 - DNA, 78 bp, Homo sapiens
gatatgagatgcgctagaagtatactcccacctttgctctctatttgagagctacagctgtactctgcaggtcatatt

SEQ ID NO: 6799205 - DNA, 86 bp, Homo sapiens
ggagtcttgttctgtcacccaggctggattgcagtggtgctatcacagctcactgtaacctcgaccacctgggctcaagtgattcc

SEQ ID NO: 6799206 - DNA, 58 bp, Homo sapiens
gagtcccaggaatgagcatagtgggaagagagagaagccattgctcaccatggggctt

SEQ ID NO: 6799207 - DNA, 59 bp, Homo sapiens
atggtccaaggaaaatggtcgtgtatcttctgtcaccatcaggaacgttcatggactgt

SEQ ID NO: 6799208 - DNA, 56 bp, Homo sapiens
tcctctagcttctgtggtgtgctagcaatttttggcattcctcggctcatagagga

SEQ ID NO: 6799209 - DNA, 64 bp, Homo sapiens
tgatttgcaaagtcgtatctgtgacggacccacaggagcgtccagttgaggctttttcaggtca

SEQ ID NO: 6799210 - DNA, 76 bp, Homo sapiens
gtttcatgttcctgtgaaagtagttttggttctaggtgacctggattctggattcttctcattcgtcatatgaaac

SEQ ID NO: 6799211 - DNA, 58 bp, Homo sapiens
gtgcttattccacaacctgcacacctgtgttctcatgaaggcttgtgaagtatggcac

SEQ ID NO: 6799212 - DNA, 126 bp, Homo sapiens
ggctgccttttaattcatgactccctgttaatgcatttggggcagactagcagtatgtgactgcattctgctacacgattctgattccagaatagttgataacctataaagaagaaaaagatagcc

SEQ ID NO: 6799213 - DNA, 95 bp, Homo sapiens
ggaggtttttccaatcatctgatcttgtggaggcaccagctaatgggagtctggctgcctgaatgcaagacagccaattatatgattcttcctcc

SEQ ID NO: 6799214 - DNA, 77 bp, Homo sapiens
ttattagtttactgtagtctaaatatagtcttagtttaccatattctaagttaatagggattttagtgaatttgtaa

SEQ ID NO: 6799215 - DNA, 130 bp, Homo sapiens
attaaatcaaagcatgaattatttactgttgcccagagatgcatcaacctcacggaatattactaattcacaaaggctttgaacatctacctgaggtcaaacattcataatacatgattctaaaaataat

SEQ ID NO: 6799216 - DNA, 75 bp, Homo sapiens
gggaatgatttagtgttcaaggaatatcattcttcacataaattgatgtcacagattctttgaatagatgttccc

SEQ ID NO: 6799217 - DNA, 61 bp, Homo sapiens
gagtgcgtgtttggggatgtgggtgggtcttgcctggtctctcaaacccagatgctcattc

SEQ ID NO: 6799218 - DNA, 75 bp, Homo sapiens
ggctgaggcagaggcctgcactcaaatgcggaccaggggctgttagagaattagagtgggggctggggcttagcc

SEQ ID NO: 6799219 - DNA, 83 bp, Homo sapiens
gatattgttgatttctttaggtgtaatagtggcatttacaacgttgagagaaacatactgaaatactaagaagttaactgatc

SEQ ID NO: 6799220 - DNA, 101 bp, Homo sapiens
gctttgaaatcctagttgctgcacaaggaaatatgttaaagagacacattctctgtgtttacttaaatgttttcatataatgtagaattggttttctaagc

SEQ ID NO: 6799221 - DNA, 61 bp, Homo sapiens
ggaatcatgccatttatgacgtcaacttgtctatttagtatgatgtcactcgcattgtttc

SEQ ID NO: 6799222 - DNA, 61 bp, Homo sapiens
gaatctgcagaaaccatggcatgctgtgcaacagctcccatagcagatttttgacagattt

SEQ ID NO: 6799223 - DNA, 58 bp, Homo sapiens
ttctgacagtctcttctttagcttgaattcccaaacaggctcctagggatttttagaa

SEQ ID NO: 6799224 - DNA, 92 bp, Homo sapiens
cagaatgaagtggggtcccaggaaggagcagtgttctttttgtgaccctgtcattacatgcactcttcacctggaatgctctgcttcttttg

SEQ ID NO: 6799225 - DNA, 89 bp, Homo sapiens
catgaaggatacagtagatggaggctagatgcagggcttttactgtcatgctaagttctgtggtttggttttcatttttgtaggcaatg

SEQ ID NO: 6799226 - DNA, 62 bp, Homo sapiens
tgcggcggcgggcagaggactaccacaaatgcaaagtaaggagcttcctccccgcagttgca

SEQ ID NO: 6799227 - DNA, 88 bp, Homo sapiens
ggcttgggacatgtgtgaatcttttgggatcagaagacaactctgctaggcagaataatggtccctaaagatgtctacatcccaatcc

SEQ ID NO: 6799228 - DNA, 75 bp, Homo sapiens
tttcttgaagctgggggagcattatttatgtagattgaaacaaatgctgaatgtgctcccttttaaaatgagaaa

SEQ ID NO: 6799229 - DNA, 63 bp, Homo sapiens
tcctcagttataaataggaaacacctctaatcttgagggaaaccatttctgtgtaactgaaga

SEQ ID NO: 6799230 - DNA, 62 bp, Homo sapiens
ccctcatatgcacatttgtgctgccaacccgatggtcagcaagatggtgaatgagacgaagg

SEQ ID NO: 6799231 - DNA, 60 bp, Homo sapiens
ttcctgtcctgcccctgtagaggcaaagagggtgtctgcacagctggtgcagggcgggga

SEQ ID NO: 6799232 - DNA, 111 bp, Homo sapiens
ggctgctgggtggagacgaggcatgtgggatgctgcactgagctctctagggcataggagagcaggccagccgtcccagggagcagtgcctgtgcctcctccagtgcagcc

SEQ ID NO: 6799233 - DNA, 63 bp, Homo sapiens
tctgggccgctgcgttccatgagaactgttttattgagagggatggtatgtagtggattgaga

SEQ ID NO: 6799234 - DNA, 69 bp, Homo sapiens
tcattaagggatttagagccagagtctttttccaaagagaaaaaggactgaataattctctttcgttga

SEQ ID NO: 6799235 - DNA, 110 bp, Homo sapiens
tctttgttctgctgacataaattttcataaacaaattaaggcctggtccaaaaaattcaaatttcattttttcaggctgatttgtgttagtatgattggcattcaaaaga

SEQ ID NO: 6799236 - DNA, 56 bp, Homo sapiens
taacctattgtcaggcagaggcaggagaatcgcttgagcccaggaggcagaggttg

SEQ ID NO: 6799237 - DNA, 101 bp, Homo sapiens
tgagacggtgccttgctctgtttcccaggctggaatgcagtggtgtgatcttggctcactgcagcctccatctctggggttcaagcgattcttccgcctca

SEQ ID NO: 6799238 - DNA, 60 bp, Homo sapiens
tgccagatgtagatagcaaggtaggaatcagcagtcctgcctctgcctccctagtctgca

SEQ ID NO: 6799239 - DNA, 129 bp, Homo sapiens
tgttggcttcaagttgaagatggggctgctggctgggcatggtggctcacacctgtaatcccagcactttgggaggctgaggcgggtggatcacctgaggtcagaagttcaagaccagcatgaacaaca

SEQ ID NO: 6799240 - DNA, 118 bp, Homo sapiens
ggtaagtttttacaagatttgaagaaaaagttccatcaaaggggtataattgcataatgaatatcattggaaaatgcatgctttttaggcaggaatttacttcaaacgttgacttacc

SEQ ID NO: 6799241 - DNA, 88 bp, Homo sapiens
gaacctcctgctgagttagttatggtccaacctcctgagggaactctggaggcaaagatggggctatctgctgggtcagagagggttc

SEQ ID NO: 6799242 - DNA, 78 bp, Homo sapiens
ccaagaacacacagtatgacattggcagagctgtgggtaagtctccacctttcctgatttcatatctgtagctcttgg

SEQ ID NO: 6799243 - DNA, 81 bp, Homo sapiens
cattaaaagcaagagttttttctctcttgaaaaacacaaacctaagagctgttcaagttgaaagactttttgagggtaatg

SEQ ID NO: 6799244 - DNA, 59 bp, Homo sapiens
ggccaggggagggcactgaactcagcctcagtgagtctggaagtgtcctcttctgagtc

SEQ ID NO: 6799245 - DNA, 98 bp, Homo sapiens
cctttaatccatctccttgtttcgttaaatgctaaaactgacattacttaacataattaaagttttcagatttgatgctgaggaagctgctttagagg

SEQ ID NO: 6799246 - DNA, 82 bp, Homo sapiens
cttctccaaccatattcaaattacatttactaatgagtctgggttgttactgagttatagatgccttgagtaaatggagaag

SEQ ID NO: 6799247 - DNA, 101 bp, Homo sapiens
gaaggctcttcttttggggaaacctgaggaagggcgagaagctctccctgtctcctggatctgcttgccctcttaggacccttcccctttgggtttccttc

SEQ ID NO: 6799248 - DNA, 81 bp, Homo sapiens
gcagcctgggagtggccagtgaaggcggcagcaggacagataaggtggctgccgcagctaacagccatggccaggtcttgt

SEQ ID NO: 6799249 - DNA, 103 bp, Homo sapiens
gcccagctggcgggtaagctgtgggatggcagacgaggcagcaggggcccttgtgggtccatctctgtctcactgtcagcctggcaggatagcccacccgggt

SEQ ID NO: 6799250 - DNA, 55 bp, Homo sapiens
tctccaaagctggactgatgtggggaaaacacctttcccttctggttttgagaga

SEQ ID NO: 6799251 - DNA, 65 bp, Homo sapiens
ctggaagtccaagattaaggtgtgggtggggctcgttcctcccaaggcctctccttggcttgtag

SEQ ID NO: 6799252 - DNA, 68 bp, Homo sapiens
cagccccagagccctgtgcccaaggatggtcccgaactagtggacagcaggggccagaggcggggctg

SEQ ID NO: 6799253 - DNA, 64 bp, Homo sapiens
tcagtttcattacctgacccatgaggataataagtgtctccttcaagggttgtagtgaagatga

SEQ ID NO: 6799254 - DNA, 61 bp, Homo sapiens
gcgtcaattccatcattcttctggccatccaaaagggaatgattagaattatctttgatgc

SEQ ID NO: 6799255 - DNA, 100 bp, Homo sapiens
gcttgaagtctgagatcaagttgttgggagggttggttctttttgagagctgtgaggaaccatccctctcagcaactatggctctctcctagcttctggc

SEQ ID NO: 6799256 - DNA, 84 bp, Homo sapiens
ttgccactagatttctcacagtggaatctctgcctctggtaagaggtaaagttctggtgagaggtaagaggaaagttctggtaa

SEQ ID NO: 6799257 - DNA, 130 bp, Homo sapiens
tgggagaagggacttcccgcgccagcggctgcgcgtccactctagggcagctctcgcgcggggcaacacggcaggcagagcggccactagagggcgcgccagccacacgcaccgcgcggcccagagcccg

SEQ ID NO: 6799258 - DNA, 56 bp, Homo sapiens
ggagcatgtggacagttgtggctgctcctgagctgacactaactgctcatgactcc

SEQ ID NO: 6799259 - DNA, 71 bp, Homo sapiens
tctcaaataatgaatgggtttaatattttaggtggatgccaacataaaatgccagaccagttcacgtgaga

SEQ ID NO: 6799260 - DNA, 62 bp, Homo sapiens
gccaggaatgcataaatgacctttgccagcttcagggctttcacacattttgcttttctggc

SEQ ID NO: 6799261 - DNA, 89 bp, Homo sapiens
gtggttttcaattatttgatatgaaaggggcagcgtggttgtttaaacttgatccagcctctttgcatcttaaacagttgaatagctac

SEQ ID NO: 6799262 - DNA, 62 bp, Homo sapiens
tcaggaaagcctagaagagaacacatagcaccagacacattgtgtcatctttctttcactgg

SEQ ID NO: 6799263 - DNA, 61 bp, Homo sapiens
tgaggggtttgagctcttggttgtcttgcccttgtctaaccacagttgctgaaatcgctta

SEQ ID NO: 6799264 - DNA, 66 bp, Homo sapiens
gtggtccgtgagacaggaaggcacgggtcagaggctgacagatggtctttctgctgcacggactgc

SEQ ID NO: 6799265 - DNA, 81 bp, Homo sapiens
cataacaaattagagtcagctatccattctcctatgaacgatcagcaaatctcacaggagtcaaggaatagtactgttgtg

SEQ ID NO: 6799266 - DNA, 59 bp, Homo sapiens
cctaacctgtctcccatttctccagcctgggcggaggcagggaaaggagagacagtagg

SEQ ID NO: 6799267 - DNA, 89 bp, Homo sapiens
cccaggctgagtgtgttctggcttctgcaggattactagggaccttctctgcctgaggagtcagggcaggtactttcactgtgcctggg

SEQ ID NO: 6799268 - DNA, 75 bp, Homo sapiens
tgtgtgtgaaccattgagggctgaagggtgaaatgacagaaggaagtctggaaagctaagctggtgtcatatgca

SEQ ID NO: 6799269 - DNA, 77 bp, Homo sapiens
tccttatgactacctgctggcaatattcagtccagcgcatggacaaagctgacctggaagagcagggagtcaaggga

SEQ ID NO: 6799270 - DNA, 76 bp, Homo sapiens
gttgttattaatttgcaggctggtgatggaatttcattcttttgacttctagattgcctgtaagtaaatatttgac

SEQ ID NO: 6799271 - DNA, 117 bp, Homo sapiens
ggtttaattattttagagaatctaaagtcttaatgaaagtgaaatatcaaccggtcatataattttcactagtgatgtgtgtttattaacattttaagttctctgaagtccagaacc

SEQ ID NO: 6799272 - DNA, 77 bp, Homo sapiens
tgggcttgctgagatttcaggccaaggagtgcctgcataatagaccacttaaaactcctggaattgtagtgagctca

SEQ ID NO: 6799273 - DNA, 75 bp, Homo sapiens
acgcagctcttgcagccttaccaaggcatttggattttattatgaatgtgaaaggaagctgccaggggtgggcgt

SEQ ID NO: 6799274 - DNA, 130 bp, Homo sapiens
aaggaagggattttagtgtgttctgtgttttcgctctagagctttttcctcttgtaaaaggtagtacaagacttataaagggaagaactttggtacaggagatcagcagagattgactagaaaacccctt

SEQ ID NO: 6799275 - DNA, 67 bp, Homo sapiens
agtggcagttgtgaggttcatattttcttttatagtaggaaaagtatatgctattactactgttatt

SEQ ID NO: 6799276 - DNA, 75 bp, Homo sapiens
ggagaagttatggcaataggcgtgtttaggaggacgtggctatgtatggacttgaggaacccgcctgtcttttct

SEQ ID NO: 6799277 - DNA, 69 bp, Homo sapiens
taggtgattttctccttacgatttgattttgttaaaaggttattgacaagaatcatgagcaatcatcta

SEQ ID NO: 6799278 - DNA, 60 bp, Homo sapiens
aatgcagttttctcacccccacaactccagatggttgtgaaagcctagaaaacatgcatt

SEQ ID NO: 6799279 - DNA, 67 bp, Homo sapiens
ggggttatcaattacttacatagccttcctctaagggaaggcttgcaagtggttcatattcgaccct

SEQ ID NO: 6799280 - DNA, 87 bp, Homo sapiens
gtgacagtcagtttcttctgggtaacaaggcaagaatagttgatattattgaagcatgaagaacttaagatgaaactgactgatcat

SEQ ID NO: 6799281 - DNA, 76 bp, Homo sapiens
ggtctgccatgacaaagtaccacaaactgggtggctccaaacagtagaagtgtattttatcacaattctggaggct

SEQ ID NO: 6799282 - DNA, 56 bp, Homo sapiens
aggagttaggtgtcccagcatctaaggcaatatcctgtgctgagtgtctaactcct

SEQ ID NO: 6799283 - DNA, 55 bp, Homo sapiens
ttggttcaggacatatttgagtgcctgctgtattcaaggtgctgtgctgtgctag

SEQ ID NO: 6799284 - DNA, 100 bp, Homo sapiens
cacacctcctatggctgaggtgctatggaggatacgtagcaccttatgtcctccacatagcacctgtattctccacagcaccttagccctgggaggtgtg

SEQ ID NO: 6799285 - DNA, 66 bp, Homo sapiens
ggcttctatatgttggtgtatgggtgagttccatttgtaaaatgaatcaaactgtacactgaggct

SEQ ID NO: 6799286 - DNA, 69 bp, Homo sapiens
ctgaggtttttctgaacttaaactgatctcttaaaccagttagttgagcaaggccagagaagccctcag

SEQ ID NO: 6799287 - DNA, 55 bp, Homo sapiens
tcttaattgagaacagtgtaggacaattctcctattacaattggtcttattaaga

SEQ ID NO: 6799288 - DNA, 76 bp, Homo sapiens
cccacaggtgtccatccagggtcaccatgacacagcgtgcacagaagagctttggaatgacagagatgccagtggg

SEQ ID NO: 6799289 - DNA, 55 bp, Homo sapiens
gggctgtgtaatgtgctcttttcccaacaccaaagggtgagtataatgcaagcct

SEQ ID NO: 6799290 - DNA, 87 bp, Homo sapiens
ccgggcggggttcttgggtgccccgcctaagccggcctgggcgtctccagctgcttttagggccgggctcccaggactttcgcccgg

SEQ ID NO: 6799291 - DNA, 59 bp, Homo sapiens
gcaggagaaatgaagattgggtgaaggcgtccttcttccaggcacgcatttcttctagc

SEQ ID NO: 6799292 - DNA, 106 bp, Homo sapiens
ttaccattttttattttcaattttggaggatttgtcatctgaagataaggtggtattaaatgtattgataatgggatctttagcaggtttttttgggagatggtag

SEQ ID NO: 6799293 - DNA, 69 bp, Homo sapiens
ttttcaatttccatatattccttttgtagagcataaaagtatattgcattaggctaatatgggagagaa

SEQ ID NO: 6799294 - DNA, 66 bp, Homo sapiens
ctctcactttcctccttcatccttctaaactcaccctaccaggaggtgccaactgagagctgagag

SEQ ID NO: 6799295 - DNA, 83 bp, Homo sapiens
gagagaaaagccccaggaaggcgttgttcctctcaggcgggcgccagggaggcgcgctccttccggcccggcgtccgtctttc

SEQ ID NO: 6799296 - DNA, 81 bp, Homo sapiens
catgcattcagaatctctcacaatttaagcagtgtggtcttttttctacccgtctaattcatgtgggctttgaaatgtgtg

SEQ ID NO: 6799297 - DNA, 67 bp, Homo sapiens
catatatttggaggtggagtatacaatttgacccatcatctgagtatacatacttctagattaaatg

SEQ ID NO: 6799298 - DNA, 94 bp, Homo sapiens
agttctttagaaactatcctgagtagcaaatctcaatcccgatcaactgtttgctctctttaatgtcttaggcatagtttcttcaaattgaact

SEQ ID NO: 6799299 - DNA, 62 bp, Homo sapiens
gcacagtttagctaggttctctgctttagggtgcaagccccaattcagatattggcttgtgc

SEQ ID NO: 6799300 - DNA, 92 bp, Homo sapiens
agggccacgccttacacaaggtgacatgaaaaatgttgaggtgtagcagtttattcccttaggttaatcatgaacctttctgttaggcccct

SEQ ID NO: 6799301 - DNA, 99 bp, Homo sapiens
atctttccgtaattacagcattccagggctaggtaatgggtagttgatgctcaggtcatgtatttagccctggttagggaattggtaagttgggaagat

SEQ ID NO: 6799302 - DNA, 76 bp, Homo sapiens
ctgccgagatcagagtaggatttggaacccaagcaccagggaaccaatgttaggctctggttttagatcctggcgg

SEQ ID NO: 6799303 - DNA, 74 bp, Homo sapiens
tacaaatattctgggcttttataggtttattacactgtactgttgactgctggaaacccagaatggtttctgta

SEQ ID NO: 6799304 - DNA, 66 bp, Homo sapiens
ggccctcagctgcagcctggctggcaagctcaggtgtgacccaggccccagcagcctctgtgggcc

SEQ ID NO: 6799305 - DNA, 75 bp, Homo sapiens
gtgggaagggatggctggttggtcatcctgggagggagacccctttccttagtgacttctagctacttgctctac

SEQ ID NO: 6799306 - DNA, 61 bp, Homo sapiens
gatggctgcttggtgtttgaagacagttcccagggcatgcattcatttgttgagcaccttc

SEQ ID NO: 6799307 - DNA, 65 bp, Homo sapiens
tttgtaagcctaatgcccagcatctgtctcctgggcatctgtgtcctgggcattaggcttagaaa

SEQ ID NO: 6799308 - DNA, 92 bp, Homo sapiens
gcagccgcttcccctggcgggcactgggtcttctccacgcagattgagacgtctgctggcggggtcctagcgccgatctgggaggccgttgc

SEQ ID NO: 6799309 - DNA, 63 bp, Homo sapiens
cacagtacgcacccgatacatgtggttgacttgaacttcatgtgggtacagggtgtgtaggtg

SEQ ID NO: 6799310 - DNA, 79 bp, Homo sapiens
tttcgctcggttgtcagcttccttgaattctgtagaagcaattgctcctgctggaagtagggaatgatcgctagcgaaa

SEQ ID NO: 6799311 - DNA, 56 bp, Homo sapiens
gcttcctattgctggaaaagtttctgtgatgttatcaccagagatagcaatagtgc

SEQ ID NO: 6799312 - DNA, 58 bp, Homo sapiens
taatgagggggcctggggtctggatgaagcttgagaagccagccttgcctccttttta

SEQ ID NO: 6799313 - DNA, 61 bp, Homo sapiens
ggccagctgcctgaccttctgttcagtgaccctttttgtacaaagtcaaattgcagccgcc

SEQ ID NO: 6799314 - DNA, 95 bp, Homo sapiens
ctggggtcaaagattcagctgccatggtccaggctccaggctggggaggatgttagggattggtgtggtcaggaccagcgctgctatgactgcgg

SEQ ID NO: 6799315 - DNA, 58 bp, Homo sapiens
cttttctgctgcttattcctagtgtcattgttggccctagggctccaaagctgagaag

SEQ ID NO: 6799316 - DNA, 86 bp, Homo sapiens
gcatgtacacatttgatgtttctgtcacctagggctgcatatcaaagcatcccaaggcatatggctgaaaccaacatgtattttgc

SEQ ID NO: 6799317 - DNA, 84 bp, Homo sapiens
gcgctgtggcatctctggccagaagcacctttggcggcctgttgggcccctcgcagcctctggctgagactctgccgccggcgc

SEQ ID NO: 6799318 - DNA, 73 bp, Homo sapiens
ggtattgtatatttgcaaatacattgggttagaaatcatctttaacattttgtgttagtgtaataacaatatt

SEQ ID NO: 6799319 - DNA, 70 bp, Homo sapiens
ctcttaaagctgggttttgatgtctcacctgaaatgttctcagtacactcaagaaaccggtaataaggag

SEQ ID NO: 6799320 - DNA, 83 bp, Homo sapiens
caatcagatcaggccctgtgcaggtgtgcagcagctgagctttgtagcgctgcagaagcgtgttcaggacactggattcgttg

SEQ ID NO: 6799321 - DNA, 57 bp, Homo sapiens
tgggccagggcacccagtccagaaggagcaatggcacctgggcagtgccagggctta

SEQ ID NO: 6799322 - DNA, 83 bp, Homo sapiens
gtgtagaacaaaaaggcagaggaagggcagtgaattgttgctctctttttgagctgggacatccatcttctgcctgtgaacat

SEQ ID NO: 6799323 - DNA, 66 bp, Homo sapiens
gcaagagctgaggctggagaggtgaattggaccaggtccatgatatccttgagccttatcttttgt

SEQ ID NO: 6799324 - DNA, 69 bp, Homo sapiens
catgcctcagtgcacaggacagccaccacaaagacttatctggcccatgtgtcaatagcactgaggctg

SEQ ID NO: 6799325 - DNA, 91 bp, Homo sapiens
gagcagcctggagagcctggacctgagctacaaccccatcttctcctcctcccttgtcgttgtcagcttcctccacgccctgcgcgagctc

SEQ ID NO: 6799326 - DNA, 69 bp, Homo sapiens
gcaaaatcagaaaggtgggcaagcagatgacatagttaatctattgtccaatctttcacctgtttttgc

SEQ ID NO: 6799327 - DNA, 68 bp, Homo sapiens
gcctactctgtgtaagaccagtgctgggttcatggggaatccaacatgggttatgcatattgtttggt

SEQ ID NO: 6799328 - DNA, 67 bp, Homo sapiens
gtgcagcatctctgcatttggatcttgagctgctttgataagttcctctgattaaatgcagttgcac

SEQ ID NO: 6799329 - DNA, 64 bp, Homo sapiens
cttcctggctgaaccaatgaagtgggctcctgctcactgcatgggagatcagctttcaggtaag

SEQ ID NO: 6799330 - DNA, 70 bp, Homo sapiens
gcgggcccggggttggggcagcttgggaaattcagagggggtgatgcaggagcccctaattctgggcagc

SEQ ID NO: 6799331 - DNA, 79 bp, Homo sapiens
gagggggcgggttcctgggggccaggccagggcagcatgtggggctttcctggagggtccccagcagagaagccctctc

SEQ ID NO: 6799332 - DNA, 66 bp, Homo sapiens
acagctggtaagtttgcgtgtcctatttgataactataatagttattattgtattcttgcagttgt

SEQ ID NO: 6799333 - DNA, 84 bp, Homo sapiens
tacgcacttgcattttggtgtatgaggcctcagcaaactatataaggcatcaaccatttattatgccaaaatggaaagtgtata

SEQ ID NO: 6799334 - DNA, 71 bp, Homo sapiens
ccagtgacagccccaaggtggccagcagggacttgaccctgagctcaggcccttggggaaaatgctgctgg

SEQ ID NO: 6799335 - DNA, 61 bp, Homo sapiens
tcaaagtcagccagctagtaggtcagggagcagtttcctacctgggtgtgcctgacttcga

SEQ ID NO: 6799336 - DNA, 61 bp, Homo sapiens
atgaatccattcctgccacagacttcgattgcgggcctactgtgtgctcggatggactcgt

SEQ ID NO: 6799337 - DNA, 60 bp, Homo sapiens
gaatttggggtttgtgattccttaggtttacccccataagggaacaaaactctaaaattc

SEQ ID NO: 6799338 - DNA, 67 bp, Homo sapiens
cactgcacactccaagacctactttctctggagctctagaaaaagtcaaggaattggacaggcagtg

SEQ ID NO: 6799339 - DNA, 106 bp, Homo sapiens
tttgaataaacatcacactttaaaactgacagcccttgggtttcacttcgcactcaggaggcacagctctgtcagattttaagtgaaaggatatagtttgtttaag

SEQ ID NO: 6799340 - DNA, 116 bp, Homo sapiens
caggatgcatttgagttcccagggcatcttgttaaagtgcagattttgattcagtaggtcagggataggcctgagaatctgcatttctaacaagctcccatatactgctgctcctg

SEQ ID NO: 6799341 - DNA, 62 bp, Homo sapiens
catgtgtgtacacacgtgactctgcaggtgctctgcgtgtcccaaaattgtgtacacacgtg

SEQ ID NO: 6799342 - DNA, 101 bp, Homo sapiens
accagagaagtaggcagatgccagatcatgcagggccttgtggaatctaagtgagaaatgatgtgacctggcctagcatgaagcgtctgtcttctattggt

SEQ ID NO: 6799343 - DNA, 66 bp, Homo sapiens
gatctgggcgatgatctggtactcctgtcctatgcagggctcatcagagtagttgttgcccagatt

SEQ ID NO: 6799344 - DNA, 65 bp, Homo sapiens
gtggctgctacagagctggagggggtaaagcaacagtgttttctcagttgtgcgagcagcattac

SEQ ID NO: 6799345 - DNA, 58 bp, Homo sapiens
gctttgcctcttctccttccagctaaactgcatccatgccagatgagagagccaaggt

SEQ ID NO: 6799346 - DNA, 68 bp, Homo sapiens
ccggtcaagttgacactttaaaactgatcatcagagcagctctcaagtgtgagttttaaagtcactgg

SEQ ID NO: 6799347 - DNA, 56 bp, Homo sapiens
tgatttagcttggagtcctctgggaagtcttccttgacctcatccaggctaagtta

SEQ ID NO: 6799348 - DNA, 72 bp, Homo sapiens
tctcaggttcttggtgagcatttggtcccctctgccaggactgcaggattcagaacagctcacaatctcaga

SEQ ID NO: 6799349 - DNA, 65 bp, Homo sapiens
ctaagggcttaatgtgtgtcaggcaatagtctgaaattcaaatgtttacatgttaattcacttag

SEQ ID NO: 6799350 - DNA, 72 bp, Homo sapiens
tgtcccatggtactgccacagaagagtctcagctctctccaggattcagttctaaggtcagtgcctaagata

SEQ ID NO: 6799351 - DNA, 70 bp, Homo sapiens
gtttacagtgactcacattaacaactgaggtttgaatcacaaattgttaataagagtttgcgctgtccac

SEQ ID NO: 6799352 - DNA, 110 bp, Homo sapiens
attcatccaagttgttacatggagcaatgatgcattctttttcattgtgctatactcatatgatgaaatgctatgcaacaatgtatttatgtattttactgctgatgaat

SEQ ID NO: 6799353 - DNA, 62 bp, Homo sapiens
gctcccacctttgctatcagtacttatgcctagtaggccttgctgaaggcaggggaggtggc

SEQ ID NO: 6799354 - DNA, 78 bp, Homo sapiens
tagactagatgtggtatattagaagcagccaacaactttttcaggaatttctagttctaccacagtaatgtagaccta

SEQ ID NO: 6799355 - DNA, 85 bp, Homo sapiens
ttctctgcagaatatggagaccttcaagggcaaacgggaggttctcatagttgtcctttaatgtttagtatttttatgcggagaa

SEQ ID NO: 6799356 - DNA, 63 bp, Homo sapiens
aaacttagtagtcattgctttgaccttcaacactggttgtcaggttacagtgattataggttt

SEQ ID NO: 6799357 - DNA, 71 bp, Homo sapiens
gattattagtttcctctctaggagtgagctggatagtttccacagtttaggatgagagaacactgaaggtc

SEQ ID NO: 6799358 - DNA, 64 bp, Homo sapiens
gaaaccacagttcagtgcttttggggacctactacagattcagatactcatggaactgggtttc

SEQ ID NO: 6799359 - DNA, 58 bp, Homo sapiens
gaagcgggttcactggatggctttgaggaattatctgtactgtccacacactcgcttc

SEQ ID NO: 6799360 - DNA, 69 bp, Homo sapiens
tgtctgtctctctccagagtgcagggagcatgacccagccactctgcacctccggcagggacacgggta

SEQ ID NO: 6799361 - DNA, 55 bp, Homo sapiens
gctacaggtgacagcctctgcagtgtctcatggagaggcctttatctcctgtagc

SEQ ID NO: 6799362 - DNA, 61 bp, Homo sapiens
gctgggatggctttcctgcattatgacacttacctcgtggttccaagatggctgccacagc

SEQ ID NO: 6799363 - DNA, 63 bp, Homo sapiens
ccctttaattccaacacaggaaaggtctgtcactcccagtcactgtggaagggaactagaggg

SEQ ID NO: 6799364 - DNA, 120 bp, Homo sapiens
aagagataaaaataagtaaaactccagcaggttaggatcagatcctggagggtggtgaatgccaagccactactttggattttattctgtggcaacctggaagctactgaggattctctt

SEQ ID NO: 6799365 - DNA, 64 bp, Homo sapiens
gttctctccttgtagctccccaaggcaaaaaataccctttctggagtcacacaggaagaaggac

SEQ ID NO: 6799366 - DNA, 109 bp, Homo sapiens
taatttgttcccaatagtagtgtgtgtgtgtgtgtgtgtgtgtgtgtgtgtgtgtgtgtgtgtgcatgcacgggcacatatgctagcgtatatacctgtctacaagtta

SEQ ID NO: 6799367 - DNA, 93 bp, Homo sapiens
ttcctttttcctcctgtgtgttgaaatgtcaggtagagtgtgaattagtgatgaactgtgctgagaggaaagaatgcacagagaaaagagggg

SEQ ID NO: 6799368 - DNA, 81 bp, Homo sapiens
aggaaatgtgtgacaactaaatatagtcaaatcaaggcagcagcagtgagttctattttggctgattcatcatgtgaacct

SEQ ID NO: 6799369 - DNA, 108 bp, Homo sapiens
ggtcctttctgatacttattttaacgtatcctcataaacaattctttgaggtaagcaggtcttatgaggaatgagtcttatgaggaatgagttaccagattaaggatc

SEQ ID NO: 6799370 - DNA, 83 bp, Homo sapiens
ggcagattgggtcagttgatttgtttttccttcatgcatttattatatatatgactttggaaaaattacttgatctttctgtc

SEQ ID NO: 6799371 - DNA, 82 bp, Homo sapiens
tcccagttgaatttgtgtacctgtggatgggagagtcactagagatttctcttattgatgaaggtgctaaattgcctcggga

SEQ ID NO: 6799372 - DNA, 69 bp, Homo sapiens
gggctgagagattccgtggaagtggcaggggtgggagagtttttcacttgctccagggtatccagcacc

SEQ ID NO: 6799373 - DNA, 67 bp, Homo sapiens
ctcttaactgtctgaaactggggtttcttattttcaggggaagaaacaggacacaggcagtctagag

SEQ ID NO: 6799374 - DNA, 69 bp, Homo sapiens
tttgtgtatttatggaaatcacgtgagaagttcaggctgtcatgtgtcctagttcatataatattcaaa

SEQ ID NO: 6799375 - DNA, 81 bp, Homo sapiens
tccaaactctttgttgtggcctacaatggcttgtctctgtgcccgtcaccaagtttgtatgccaacagcaaagtgtgagga

SEQ ID NO: 6799376 - DNA, 89 bp, Homo sapiens
tgtggagcaactcccaatgttggggcttacaggagagctggggaaccacctgagacttcctgatgaggcccgagttgacctcttccaca

SEQ ID NO: 6799377 - DNA, 71 bp, Homo sapiens
ccaggcctcccggtgcacactgacacaccgccgtccgcgggctgagcttcagtgacaccgaagggcactgg

SEQ ID NO: 6799378 - DNA, 68 bp, Homo sapiens
gctttctcttacccaaggatctggagggccatctgctaggctggacagtggcttgggaagcagaaggt

SEQ ID NO: 6799379 - DNA, 72 bp, Homo sapiens
agacctgggacagagtgagctttggccatgcacagcgtgtctgaggactctctctctctgtccaggaggtct

SEQ ID NO: 6799380 - DNA, 81 bp, Homo sapiens
aaggcctagttcccagctgagattgagcaaggcaatactctgtctccttgattcaactctcatactgtaaacagctgtctt

SEQ ID NO: 6799381 - DNA, 97 bp, Homo sapiens
ttggccaggatggtctcgatctcttgaccttgtgatctgcctgccttggcctcccaaagtgctgggattacaagcgtgagacaccgcgcctggccga

SEQ ID NO: 6799382 - DNA, 81 bp, Homo sapiens
ggacagcgtgtctgggtctggctgctggtgcagcccatctcgattctggactgagattcagtggtcacacccgacgtctcc

SEQ ID NO: 6799383 - DNA, 75 bp, Homo sapiens
gcccgaccagttgggctggaccgcgacccctgagcactgccagggagcctggtgtgtcagccgctgctagcgggc

SEQ ID NO: 6799384 - DNA, 56 bp, Homo sapiens
atttgtgtgtatttctggcagaggccaaacccctggcacttgctactacgccaagt

SEQ ID NO: 6799385 - DNA, 77 bp, Homo sapiens
ggcttctctcacccagggtgtttggtgtctgctgggaagcccttcactcaggcacatccactggactgggaaaagtc

SEQ ID NO: 6799386 - DNA, 107 bp, Homo sapiens
tttgatagatttttccctccagaatgtttgcatctattcacatgtgcatcagcagtgcatttgtagttaaatgtgtagttaacgttctgtttttaaaactatacaaa

SEQ ID NO: 6799387 - DNA, 64 bp, Homo sapiens
tttggggtagtaccttcgtatgctggggtaagcactgctgtggttgagagtggtctacctgaag

SEQ ID NO: 6799388 - DNA, 78 bp, Homo sapiens
gtatcacagtgggtggcagagatagaactggaattaatagtaacctcattttaaatttctgttatatccactttgaac

SEQ ID NO: 6799389 - DNA, 64 bp, Homo sapiens
aagctgtgcctttgcctagaatttccctccacccttgaaattcttctcccttagggcccagctt

SEQ ID NO: 6799390 - DNA, 62 bp, Homo sapiens
agtgtaacttgctggaaaaactaggacccaagagaccagctcctagttgccaagttaccact

SEQ ID NO: 6799391 - DNA, 88 bp, Homo sapiens
gcccacggtgattgacagctggcacacagcagcacccagggcgccacccgccctccatgagtgtgctgctggtttaattgatgtgtgc

SEQ ID NO: 6799392 - DNA, 92 bp, Homo sapiens
atcgacccagcagtgtccccaacgcctgaggaccagcacccatctgtgacaaggcacaggggtccgcgatgttggccactgctttgggtgat

SEQ ID NO: 6799393 - DNA, 62 bp, Homo sapiens
gtatcttctcaaaaaatgtaggtggctccatagagggacccacaaaccatttgtgaaggagc

SEQ ID NO: 6799394 - DNA, 55 bp, Homo sapiens
cacagtggcagtgtagaaaaacctatttctgtctgggttacattgtctacatgtg

SEQ ID NO: 6799395 - DNA, 94 bp, Homo sapiens
taattaaaattcacttcacagcaaagagactgacattgatgttgctgggtattttcagttcttagtaatgcagtcttttggatagttatagtta

SEQ ID NO: 6799396 - DNA, 78 bp, Homo sapiens
gtgatcagaccctggtcaaagaccaggaaatgcttctcaacagaggtaggccttgatctttggaggggttctgatgac

SEQ ID NO: 6799397 - DNA, 76 bp, Homo sapiens
tctttgaactcctgctctgccatattttttctcatgagatcccagtagaagttcatggtaggttggaaggtgagga

SEQ ID NO: 6799398 - DNA, 80 bp, Homo sapiens
gacactttcctctacttccaggcggacaaagccctttctggtgaaagcccggggctgccctcctgggaagagggaaggtt

SEQ ID NO: 6799399 - DNA, 65 bp, Homo sapiens
ggctaattgtgatgctggagtgcgaatatctgtgcagatttccccacaccagtattttattagtc

SEQ ID NO: 6799400 - DNA, 88 bp, Homo sapiens
ctcaaccatcatatttctagaagtagaggtcttaagtgatattttgacaaatattgagtaattattacttcaagactgatggttagag

SEQ ID NO: 6799401 - DNA, 83 bp, Homo sapiens
ctctagaacagggacaatgagaaccttgaaaggaactttgcaagttctataagtttgtcattttaattctcctcagcttggag

SEQ ID NO: 6799402 - DNA, 78 bp, Homo sapiens
aactgcagcaggagcatgtccttaaggcacagatcactcatgctattgtttgtggcttaagaatgcctttaagcagtt

SEQ ID NO: 6799403 - DNA, 64 bp, Homo sapiens
gccctctgccactgtgatgcatgataataaaagctttgtcatgcccaggagcaaggtaatgggc

SEQ ID NO: 6799404 - DNA, 62 bp, Homo sapiens
gaaaaggagggaagtgagttctcagctgccacaggcaggaggctgctcagctttcccttttc

SEQ ID NO: 6799405 - DNA, 67 bp, Homo sapiens
gaccttgttcacagctttgtgtgtgaacccaggttccacagatgtatgaagtggtgagaacttggtc

SEQ ID NO: 6799406 - DNA, 67 bp, Homo sapiens
aaaccctcaaaacaacctacatgtgccagagtgcagcactggccttgtgagttattttcaggagttt

SEQ ID NO: 6799407 - DNA, 62 bp, Homo sapiens
ctttgtctgagaaagtgagttgcttgaggtcaaggctcaagtcttactgtcccagaacaggg

SEQ ID NO: 6799408 - DNA, 92 bp, Homo sapiens
ctttaatccagttaaagcagtttatgaaatttagggggaagggcaaaaatcaatccctttcaaattacatgactgctatacatagggtaggg

SEQ ID NO: 6799409 - DNA, 59 bp, Homo sapiens
atgcctatgtattatatactgtgtgtgaatacatatatttgtgtgtgatttatgagtat

SEQ ID NO: 6799410 - DNA, 79 bp, Homo sapiens
gaattgatggaggtgagcgtggaaggagtgggatgtccctagtgcctcctgctcagcctcgctccactgcccacagttc

SEQ ID NO: 6799411 - DNA, 78 bp, Homo sapiens
tggcagctgttaatgttttgttgatcctcctaacaatcccctgattaataataaccacagaaataataatagttgcta

SEQ ID NO: 6799412 - DNA, 87 bp, Homo sapiens
ggtggcatgtgaccatgtttgaccatcaaagcttcacattcccttgactgcagtgattggatcagagatggataatgacaggccacc

SEQ ID NO: 6799413 - DNA, 57 bp, Homo sapiens
gctgatctggattattcatctgaaggctcagctgggtctacaggatcctcatacagt

SEQ ID NO: 6799414 - DNA, 120 bp, Homo sapiens
ctgggggtctgaggaaagactgttttgaaagaggctgtcagggaatggaaagggttaagcttttcatcctgaagaacctgcttcccaaatcaggccttcctcccatcactagaccctgag

SEQ ID NO: 6799415 - DNA, 129 bp, Homo sapiens
gagagaaaaggagaggataatgagtgaaatgcaatgcagcacctccttggaacacacagttacaattcagttcacagggcacactggctcaccgtatttttaactagtttctctccccacctccttttt

SEQ ID NO: 6799416 - DNA, 83 bp, Homo sapiens
ggctgcttttctggttacagtggcagagttgggtagttgcaacaaagtatttactctctggccctttagaggaaaagctggcc

SEQ ID NO: 6799417 - DNA, 55 bp, Homo sapiens
taaaagatgatgtcttggcccaagcaatgcagggtccaggtttagtcatttgtta

SEQ ID NO: 6799418 - DNA, 91 bp, Homo sapiens
ccaagattttaaagatgtttaggtaaaaagtttttcaagagacaagacaaggactgattaagtgcctaaaatcttttagaaagaatgatgg

SEQ ID NO: 6799419 - DNA, 69 bp, Homo sapiens
ctgccctgtgtgtcgtccagccagactgcctcttgaaagatggcttgtccaagcggcagacagtggtag

SEQ ID NO: 6799420 - DNA, 65 bp, Homo sapiens
gctcttagcagagcagagtggatcagggaaccatctatctggtctgttcatgtctataattgagc

SEQ ID NO: 6799421 - DNA, 117 bp, Homo sapiens
gtgactgctgagggagagtcccttgctttgactgttgctgccattctggaaagcattgatctcttaccagaggggcttcagaggcaagagcagcttccgggggctccttagcatcac

SEQ ID NO: 6799422 - DNA, 61 bp, Homo sapiens
gggggtcatcgagggggtcaccttggctcgcccaggccgagggggctcctccggtgcttcc

SEQ ID NO: 6799423 - DNA, 64 bp, Homo sapiens
gtgtgctgggaatggaggcataacataatattcatgttttaaatgtgtctaattccaggagcac

SEQ ID NO: 6799424 - DNA, 94 bp, Homo sapiens
tccccacataggctgccttgttacagaagcttttgaaaagatgaggaacctttggatctgggaatggaagccttctgtggggccgcatggggga

SEQ ID NO: 6799425 - DNA, 56 bp, Homo sapiens
gcaaaggtggctaccagctgctccaggattgtagctttctagtttagccatcttgc

SEQ ID NO: 6799426 - DNA, 84 bp, Homo sapiens
gtttaacaataagactggtttactgaggttaggctcaataaaactgtttgggcctgctattggtgggcagactaattgcacaac

SEQ ID NO: 6799427 - DNA, 58 bp, Homo sapiens
cccagcggcggcggccggctacgcggagacccgagttcaggccgcggcccgcagtggg

SEQ ID NO: 6799428 - DNA, 58 bp, Homo sapiens
tatatatatgcacacacacctagacccacgtatgtccatgtgtgtatgcatatgtgtg

SEQ ID NO: 6799429 - DNA, 125 bp, Homo sapiens
ttaatacattagaacattattctggtggattagtttggccagcatgaatctatcctttgaataatagtacactctgagccaaaactaattcgctttctaaaccagaaaaattagaatgtgcttaa

SEQ ID NO: 6799430 - DNA, 116 bp, Homo sapiens
aatggggctgcaggggaggaaagctgcagcaggggacttacataattcagagccttccagaagagttaatggagttacgtgactgtatcctaattgtttcccccttgggttccatt

SEQ ID NO: 6799431 - DNA, 86 bp, Homo sapiens
gattttattcttggcgagcatagcaggggccatatgagaaatgtaaatatggttattgacctgttgtgctggtgacaagatgagtc

SEQ ID NO: 6799432 - DNA, 79 bp, Homo sapiens
tccttctacagtaaccttatttgtcattagaatgcaactcaatcctctaagattgtcaggcttgctgtattgccttgga

SEQ ID NO: 6799433 - DNA, 98 bp, Homo sapiens
agggaacaagatgtgaaggaacagtatgtgagatttacacatcatcactgcatgccatgtttaaatagaacatactgcataacatcttaacatgccct

SEQ ID NO: 6799434 - DNA, 71 bp, Homo sapiens
gacaaggcagaaagcttaaagggtttgttcttttttatcaaccacactttaaactttagacctgctttgtt

SEQ ID NO: 6799435 - DNA, 59 bp, Homo sapiens
tcctctccatattttctgatttgtttcctattttggcaaagagtgaagatggcagagga

SEQ ID NO: 6799436 - DNA, 64 bp, Homo sapiens
tctttggccttaggagcccttgggaggaagctgctactgccttgggggttgggagagtcaggga

SEQ ID NO: 6799437 - DNA, 79 bp, Homo sapiens
cctttgatccccagtggcctctgttggctcctaggatggcaacttccctgggaacagcagagtcctggggcatctctgg

SEQ ID NO: 6799438 - DNA, 69 bp, Homo sapiens
tttcctcacttcatgagagtttctgattagtattcagaaagagttttctctgatggcattagtgggaaa

SEQ ID NO: 6799439 - DNA, 67 bp, Homo sapiens
gccttttccctttttaagcctacttctcttcatctacaaagtgaaaggttgggtgaatggtggaggc

SEQ ID NO: 6799440 - DNA, 70 bp, Homo sapiens
agggacataaatcaggcagcgtcctgcttcctgtggccccagccaaggaggacaggacctgcccagccct

SEQ ID NO: 6799441 - DNA, 55 bp, Homo sapiens
tattcctttgggttaagacatctgtatttagcaggtattatacctagaaggagtg

SEQ ID NO: 6799442 - DNA, 123 bp, Homo sapiens
tatgtcaaaatgtggaaatatcactaatttccttgggtttccactggcagcgtagctcccaaaatttaagacaaattctacctgcagcgggaatccattagtatccaatccacgttttatata

SEQ ID NO: 6799443 - DNA, 69 bp, Homo sapiens
taccgggccaagacagaagtgatttgatgtgatccatattcacgtttgcatagctgatgttgtctggtg

SEQ ID NO: 6799444 - DNA, 118 bp, Homo sapiens
gattccttcaactattttattcttttgtgatgtatatacttttgtaagttggctgaaatcctttgtggattgaggtgagggtaaatataggcaaaggaggaaaatgaattatggagtt

SEQ ID NO: 6799445 - DNA, 62 bp, Homo sapiens
tctctgtgccgcgccggagaccctaacttcaacattgttagagtacggggctgggacagtgg

SEQ ID NO: 6799446 - DNA, 96 bp, Homo sapiens
attttctctcttgcccttagatgttgtcttgtgagagcagggtgcttggaaatgcagctgccatcttcaataacactgagggaagctaaagaaaat

SEQ ID NO: 6799447 - DNA, 86 bp, Homo sapiens
ggcattctgaaaggctgtcacccctcctcctgagctagggcttgacaacgttcaatccttagaagggagtgaggactgaagctgct

SEQ ID NO: 6799448 - DNA, 68 bp, Homo sapiens
gagacagagaggggaagactctgacggaggttttaactgtatgcatgccagtctttcccactcgtctt

SEQ ID NO: 6799449 - DNA, 64 bp, Homo sapiens
tgccccaggaactccagagctcctctcagcagtgccttgaagagggctctgagtgcttgggcca

SEQ ID NO: 6799450 - DNA, 57 bp, Homo sapiens
gtgtttctgttagctgcaaccgaaactacctggtatgtctgagtcatgcagagatat

SEQ ID NO: 6799451 - DNA, 59 bp, Homo sapiens
acatgcacatttcaagggaataaacagacttcttctgagccagagtggagtgtgcctgt

SEQ ID NO: 6799452 - DNA, 57 bp, Homo sapiens
gtctttctatgatgaactgttgctttagtactggtgacattttcatattggaaagac

SEQ ID NO: 6799453 - DNA, 96 bp, Homo sapiens
gttcagaattctttcccctgcattccataatttctccatatttatctcagaggactatgcagaatatgacagtgggttaccatggaatatctgggc

SEQ ID NO: 6799454 - DNA, 58 bp, Homo sapiens
tgcaacttagaaggcatgaaattagtactttttttaacatcatgcatttctaagtgca

SEQ ID NO: 6799455 - DNA, 58 bp, Homo sapiens
gttgatgcaggtccaaacgctagtgtttacaagactcacgtagtggttttgcttcaat

SEQ ID NO: 6799456 - DNA, 105 bp, Homo sapiens
attctcatgtatgtgccatggatgttaatagctgcattgattttaatagtgaaaaattggaaacaatgtagattaccatttatatatgacatattatgtaagagt

SEQ ID NO: 6799457 - DNA, 71 bp, Homo sapiens
tccactgagcaatgtttgaaactttgatcactaaatctatatccttgtgtttatggtctttcttcagtgga

SEQ ID NO: 6799458 - DNA, 60 bp, Homo sapiens
tctaggctctgatgatagagcagtaagtaagacagccatgttcctgttatggagcttagg

SEQ ID NO: 6799459 - DNA, 70 bp, Homo sapiens
ctttgaacaatttggtatacaaacacctttgatatttagggctgagtttggggattaaattgtaaggaag

SEQ ID NO: 6799460 - DNA, 86 bp, Homo sapiens
tactgtatgaattgtattgtattattttagagacctcctgtgaatggaggtctctaaaatagtcaaactcatagaagcagacagta

SEQ ID NO: 6799461 - DNA, 57 bp, Homo sapiens
cagaagatcagagctttctgtgaaccaatccttttcacacagagctctctgcttctg

SEQ ID NO: 6799462 - DNA, 78 bp, Homo sapiens
agaaagggaaaacaagagaatgatgtttgcaatcctaaacaacaaaaatatttattttcttgttttaagttattttct

SEQ ID NO: 6799463 - DNA, 92 bp, Homo sapiens
ggcttgacgtgcgtaatgattcctaatcacgaacattattttcgctagcgcggagacatgttccagttgttgtgacagatcgcatttcagcc

SEQ ID NO: 6799464 - DNA, 64 bp, Homo sapiens
ataggactttacagtagatacaatgagtaaaatagtttattcggtggtgctactgttgtcttat

SEQ ID NO: 6799465 - DNA, 104 bp, Homo sapiens
gaactttgcaaaccctaggagaggattatattttcaacaagtcaagtgatttatatacagtgtcagtttttgttggcaatatcctttcagttatttgtttgttc

SEQ ID NO: 6799466 - DNA, 61 bp, Homo sapiens
ctctctgcaagttttgaaatagatttttgcattcattttgacttacggacttgcaagagag

SEQ ID NO: 6799467 - DNA, 77 bp, Homo sapiens
ggatgctgctttctgggaagaagtgggctacattttctaggctaaatctagccttttggttcccaagtagcaactcc

SEQ ID NO: 6799468 - DNA, 56 bp, Homo sapiens
ggcaaacaccaggcgagggagcatccctaaccagctcaatgtgtctgctgttggcc

SEQ ID NO: 6799469 - DNA, 55 bp, Homo sapiens
gatgattaaaatcagatgcctaaaatctgactttaggcattagattttaaatgtc

SEQ ID NO: 6799470 - DNA, 65 bp, Homo sapiens
ttagacaggagccttttgaggctttcattttacagatgaagtcctgaataggggccctggactaa

SEQ ID NO: 6799471 - DNA, 68 bp, Homo sapiens
tgtgcagacttctttgtgagcattttctgacccatcagaaaattatatcttttagggaacttaacaca

SEQ ID NO: 6799472 - DNA, 72 bp, Homo sapiens
cacagagcctcttcccaatagtcggactgggaaaactcataattactgaggtattgggaagtggactcggtg

SEQ ID NO: 6799473 - DNA, 58 bp, Homo sapiens
ccagtggcttgatcttttgctgtttcggtttatcacaaatgattttccaagccagtgg

SEQ ID NO: 6799474 - DNA, 85 bp, Homo sapiens
cagacacatcctgtttctgtgcagcatgagttattcagcattattagtagacacattgctgcttccaggcacaggagcatttctg

SEQ ID NO: 6799475 - DNA, 78 bp, Homo sapiens
ctgggaaaggctgggtgggacagcggggtgggacaggggtaagccctcagactgctgtccctgcctggcccctcccag

SEQ ID NO: 6799476 - DNA, 59 bp, Homo sapiens
tctgaggtctatgactttgcttcttgttttataaagcctctttagtcctagatcacaga

SEQ ID NO: 6799477 - DNA, 69 bp, Homo sapiens
tccattcatttgcccagaaaatatatattgagcaccttcaacataacaaattggctgggcactgatgga

SEQ ID NO: 6799478 - DNA, 57 bp, Homo sapiens
cagttttaaattgttagataatctccaagggagatgagctagaaggatataagactg

SEQ ID NO: 6799479 - DNA, 69 bp, Homo sapiens
ggttgagagcgcggctctgccagtgactagtgtggaataacagtcaccagggtttgctgggttctcacc

SEQ ID NO: 6799480 - DNA, 80 bp, Homo sapiens
gaatgtatccaaactcacttactggccctcagagggaagcatcagcagccaggtgtcagaagtgacagttggaatagatc

SEQ ID NO: 6799481 - DNA, 67 bp, Homo sapiens
ttctgttgacatgtttattggagattggatttctaagagatcattttcacattaatgtttagcagga

SEQ ID NO: 6799482 - DNA, 67 bp, Homo sapiens
agtcagtcacaaaggaccacatattgtacaattccattcgtatgaaatgtgaatttagtgattggct

SEQ ID NO: 6799483 - DNA, 61 bp, Homo sapiens
tttggtggacctcatcagaaccggacattgctgtcacggatttgactgaggtcctgccagg

SEQ ID NO: 6799484 - DNA, 116 bp, Homo sapiens
gtggtaaataaaagcaatttcaagatggtgtgtatgagtgtgactaaactttttggctattagatgcctgaggtagtcattttctactctttgaagatgctgaatacaaatttcac

SEQ ID NO: 6799485 - DNA, 76 bp, Homo sapiens
cactgtctgggtctacatcctctgttctggcttttatcactgtgactgtggctactcagagggtccctagatagtg

SEQ ID NO: 6799486 - DNA, 60 bp, Homo sapiens
tggaaatcatgggagagttggaagtactgttggagcattccatctcctcctggctttcta

SEQ ID NO: 6799487 - DNA, 57 bp, Homo sapiens
cacctagccttcttgtgcctcttgattggggcagcaggtgtatataaggctgaggtg

SEQ ID NO: 6799488 - DNA, 89 bp, Homo sapiens
ctgtgcgacagtagataagatgcttcgtttttctgagtctcagtttgttcattgtaaaatgagttcaaagacaggtataggtcgcagag

SEQ ID NO: 6799489 - DNA, 77 bp, Homo sapiens
tggctggagatgctgggagaggacccattaccaagctcaactgagcatttgctagcaggccttttatttccttgcca

SEQ ID NO: 6799490 - DNA, 57 bp, Homo sapiens
ggtcctctccagcgccacagtgcccgaccagcaggcgctgggccgctgcgaggggcc

SEQ ID NO: 6799491 - DNA, 68 bp, Homo sapiens
aggtgacagcagggtcacattccctctggtggctccagaggagaatccgtttccttgccttttcagct

SEQ ID NO: 6799492 - DNA, 108 bp, Homo sapiens
gacagaagtaccaggagggagggagagaagggcatgtacactgcccttcagaacacgtttcgggcatgacatgtactgctctctcatctcattgggcaaaatctagtc

SEQ ID NO: 6799493 - DNA, 87 bp, Homo sapiens
gtccctcgcgggccgggcgtcccctcagccacccatggggcacccttcgcctccctcgggggatgggggatcggcttgcgtccggac

SEQ ID NO: 6799494 - DNA, 93 bp, Homo sapiens
gcacatctgtaaacccttttgagtcttttctgatgtccgtgtgagtccatgaaaagcctgacatcatgagagacttaaattgagcatgattgc

SEQ ID NO: 6799495 - DNA, 111 bp, Homo sapiens
tgactggcctggtgtatatggcaggggctttatgagccttgtgaaggagtgtggcatttcttctgaagtgtttattctgggagttcctgtctcctgcctgaaaggccttca

SEQ ID NO: 6799496 - DNA, 74 bp, Homo sapiens
caactatcaggtagcagcctagcagggactagatgatacaaaatagctttgctcatctgactggctgttggttg

SEQ ID NO: 6799497 - DNA, 75 bp, Homo sapiens
cttaagtctcatggcttctgtcttggaaactttacctttaaaagattatttaagacaggaaccaggaggtttggg

SEQ ID NO: 6799498 - DNA, 68 bp, Homo sapiens
aggcaatcagaaaattcagtggaattttaaagagggaatctcactcaaagaattctctaaaattgcct

SEQ ID NO: 6799499 - DNA, 91 bp, Homo sapiens
gttccctggcacacatgacctgagctttctaccaggtcctgtctccaaggggagaaggaacctgtgttgagatatgggccagctaggtgac

SEQ ID NO: 6799500 - DNA, 73 bp, Homo sapiens
tcatgctatgtgccattcaattctacaagtatagagagcgatctgtcttgtagactgaaggcttcaggcagga

SEQ ID NO: 6799501 - DNA, 61 bp, Homo sapiens
gcagagccctcaaggccgatgcatgccaggctgggctctgtcacctgcctagggtctctgt

SEQ ID NO: 6799502 - DNA, 88 bp, Homo sapiens
ctcctttcccagcttcagctcctcccaagtgtataggatgccaagtaattgccccacactggcatgggatggaggagttttaaaggag

SEQ ID NO: 6799503 - DNA, 97 bp, Homo sapiens
ttggccaggatagtcttgattttctgaccttgtgatccacccgccttggcctccccaagtgctgggattacaggcgtcagccacctcgcctggccaa

SEQ ID NO: 6799504 - DNA, 129 bp, Homo sapiens
ccaatcccaaaaaattacatattacaaaattctctttgtataacatcttgacataaaatcatagtaaagaacagattagtggttgccaggtgttaagcggagagggagcgtagtagaaaggtgagttgg

SEQ ID NO: 6799505 - DNA, 87 bp, Homo sapiens
cataggtgtaagattccatgcttttctgtgatttatactttaggtgtagatatggctcaaaggcatgaagagagagtttgctccatg

SEQ ID NO: 6799506 - DNA, 79 bp, Homo sapiens
ggggctcctagttgcacagttcctcaagcaggaggtatttcatcttcgcaacatctggaactgtcaaagaggtagcgct

SEQ ID NO: 6799507 - DNA, 61 bp, Homo sapiens
gtatttcccccagactccctggcaaaatgaaagttagctgggttgggcttgtgggaaatac

SEQ ID NO: 6799508 - DNA, 87 bp, Homo sapiens
tggtgggccataaatgtgcagatgaataaacaaattctatatttgtatttgtgagttttcatttgtaaatttttgtcatgtacacta

SEQ ID NO: 6799509 - DNA, 73 bp, Homo sapiens
acagtatttcctaggtgctcgagtgctttaaaataagaacttctgaagtttgggtgcatctaggaagtgctgt

SEQ ID NO: 6799510 - DNA, 82 bp, Homo sapiens
ctgctaacaacagtgagtgctgggaggagtgaggaagggatgtcttctccccaaccatggcactcacatgtggtgtgggcag

SEQ ID NO: 6799511 - DNA, 67 bp, Homo sapiens
gcagtcaggtgacgtgattgaaatgttagagctgagattcaaacaactcatttatgcaagctgaagc

SEQ ID NO: 6799512 - DNA, 55 bp, Homo sapiens
catgtgggacaatctcaggtatcaagtcactgatgcagctgatgatacccccatg

SEQ ID NO: 6799513 - DNA, 55 bp, Homo sapiens
caaagtgcagaaggaactgggtgtggtggctcacccctgtaatcccagcactttg

SEQ ID NO: 6799514 - DNA, 56 bp, Homo sapiens
gaccacgcatagtatataaacttatcacaaacaaagggtgattctgtgatgtggtc

SEQ ID NO: 6799515 - DNA, 92 bp, Homo sapiens
tgttagtattgttctttaataggtgagcttatctcctataatggctaaatgatgtcattggaatttgcttcagctaataacagtatgctaca

SEQ ID NO: 6799516 - DNA, 74 bp, Homo sapiens
gcctcatcctccaaagtagctgggaccacagacatgcaccaccatgaccccagctgatttttgcagagatgggt

SEQ ID NO: 6799517 - DNA, 56 bp, Homo sapiens
gcaaatacatgttgagcacctactgtatgccaggctctgtgctcagttgcatttgc

SEQ ID NO: 6799518 - DNA, 55 bp, Homo sapiens
gcttccatttgctaggggatttacatgtgaaacctcccccagtgctaatgggagt

SEQ ID NO: 6799519 - DNA, 58 bp, Homo sapiens
tgaggtcccaggggtagtgtgccccactttgggcatggaagacatcatggagacctca

SEQ ID NO: 6799520 - DNA, 74 bp, Homo sapiens
ctgtttctaagcagtttttagctttaccagtaaatcatatacatcataggcattataaaaactgaaggaagcag

SEQ ID NO: 6799521 - DNA, 90 bp, Homo sapiens
ccagcagtccccaaccttcttggccccagggactggtttcatggaagataattcttccatgaacttgcggccagtagggggatagtttgg

SEQ ID NO: 6799522 - DNA, 64 bp, Homo sapiens
atggagttgacggccgacacccagatctcgtactccgagttggggctcaggccgccgatgctgt

SEQ ID NO: 6799523 - DNA, 68 bp, Homo sapiens
gaagagtttaaaatgaaattctatcttcagctcacaccagtgagttgaagcatttctttgagcttctc

SEQ ID NO: 6799524 - DNA, 56 bp, Homo sapiens
ctctgcttcatccaccactggcgagagagatgccatcagtgagtgggaggccaggg

SEQ ID NO: 6799525 - DNA, 102 bp, Homo sapiens
ggcgtggtggcatgcacctgtggtcccagctgctcaagaggctgaggtgaggagattgctttagcttgggaggttgaggcttcagtgagctactaccatgcc

SEQ ID NO: 6799526 - DNA, 118 bp, Homo sapiens
gacgcgatttctcctccgcccacacctgcggactggcgcatgcgttgtgtgatgctctcgggcgccaccagccccatgcgctgtgctttgcaccccacgggtggggagagaaggcgtt

SEQ ID NO: 6799527 - DNA, 77 bp, Homo sapiens
catggtcaaggtgtaagcaggttggttctttctgggggaaatacccgttccaggcctctctgcttagcttgtacatg

SEQ ID NO: 6799528 - DNA, 65 bp, Homo sapiens
cactgactaggtcggtgacctccaccagccagtccgggcctaacatggtgaccacctggtcagtg

SEQ ID NO: 6799529 - DNA, 85 bp, Homo sapiens
tgttaaactgttacttttctgggccccacgctggattctgactcagtcactctgggatgggacccaggagtctgcatgtttaaca

SEQ ID NO: 6799530 - DNA, 63 bp, Homo sapiens
ggccaaatttatttgcagctggatattgaatgggacttttctggttgtcttagaattctggct

SEQ ID NO: 6799531 - DNA, 56 bp, Homo sapiens
tcccaggctaggcctctgcgtttctaagcagaactaggagcaggcgttgcctggga

SEQ ID NO: 6799532 - DNA, 81 bp, Homo sapiens
aggcacttgtgagaattcctgatcacaggtccactcatgggcatgtttggggttggaattttcacactatttatggggcct

SEQ ID NO: 6799533 - DNA, 58 bp, Homo sapiens
ccatcaggaagaattggatgctacaggcagaactggcagcattcatctcttcctcagg

SEQ ID NO: 6799534 - DNA, 74 bp, Homo sapiens
gaattgaagattactacggaacatgacctgcaatcacagacccagtttatggcctataggatctgaagcaattc

SEQ ID NO: 6799535 - DNA, 72 bp, Homo sapiens
gatggaataaggcagaaatagggaaagtgtcagacccaagacaactttcctctccatctctgcttggccatt

SEQ ID NO: 6799536 - DNA, 72 bp, Homo sapiens
gtggaagggggcagcaatgagttcactggaattgagacacattctacatctgtgcacgccctccttgaccac

SEQ ID NO: 6799537 - DNA, 75 bp, Homo sapiens
ttgattgactgtagaggcctggattgaggaggcctgtgcttctgggcccctggctaggcttccacagttgctcaa

SEQ ID NO: 6799538 - DNA, 80 bp, Homo sapiens
aatagagccgggctaggggcgcgtcacgtgacctgtgcagccaactgttccgagacgtggcctttgcctgagctgctgtt

SEQ ID NO: 6799539 - DNA, 67 bp, Homo sapiens
tccggtatttctagaaaatgcagattcctgtgacctgcccgcgaaaattatgcctaggaagtctgga

SEQ ID NO: 6799540 - DNA, 86 bp, Homo sapiens
cagaggatacagctagggctgaaggatgaaagctgcagattaacttgatttcagcttttcactttagcacaagtttgtgctttctg

SEQ ID NO: 6799541 - DNA, 79 bp, Homo sapiens
caggaagctcctcttctcagcttcatttgttccatgagtgaggccctcggactggggcggatggggctggcttttcctg

SEQ ID NO: 6799542 - DNA, 61 bp, Homo sapiens
ttagggtagatttgcattttaaaattgctcataagacaaaaaaatgtagacttttccctga

SEQ ID NO: 6799543 - DNA, 72 bp, Homo sapiens
ggaactctctttaatgtgattgtaattattttacctagagtgtttacagtgaacacattaagtatgaaagcc

SEQ ID NO: 6799544 - DNA, 66 bp, Homo sapiens
tccttgggttaagagggagtaaggaacagttgtcaaagcacccttctttcttttgatcacaggtga

SEQ ID NO: 6799545 - DNA, 109 bp, Homo sapiens
ttgagtcagggagcctggacctgtgacttggtgaggccccagggattaggccaaccacaggtctggggtacctggccctggggctgctgcctagtcatttctgactcaa

SEQ ID NO: 6799546 - DNA, 75 bp, Homo sapiens
tgccaagttacacaatcagaaagacaacaatctgtttccatttgctttttacaacgtttgtgtaacttcagggca

SEQ ID NO: 6799547 - DNA, 64 bp, Homo sapiens
tgctggagcagctaagcctctgagaagttaatgaaagtgtccaggccgcatagttactctggca

SEQ ID NO: 6799548 - DNA, 58 bp, Homo sapiens
gtccttcatggagttacagcctaagtaaatgtcaggttgtgctaagtgctatgaaggc

SEQ ID NO: 6799549 - DNA, 76 bp, Homo sapiens
cttggcaagaataatgtccctggctagatgtgggcagaaacacattacagcaagtttacgttaaagagtgactagg

SEQ ID NO: 6799550 - DNA, 85 bp, Homo sapiens
tagagggagtacactagcttttagtacttaatggctatggatcatgttatagccagaaactgcaagagctagcattggtcccctg

SEQ ID NO: 6799551 - DNA, 69 bp, Homo sapiens
gtttaggtgtgtgaagttgtggtcattttagcagggtaatcagaggccaaatcttgcacactcttgtac

SEQ ID NO: 6799552 - DNA, 60 bp, Homo sapiens
tggctcccccatcccaaggaggtcatgtgtctacacagagcccctcggtggaggggtcca

SEQ ID NO: 6799553 - DNA, 102 bp, Homo sapiens
ataatgagtatttcaatgttttgcagtcaaatttgctaaatttgtgaaggaagaaatgtaaatatatttggtagtgattgaaattatggaaatatacattat

SEQ ID NO: 6799554 - DNA, 60 bp, Homo sapiens
ggagaaggtgctggtcactgtgcgtaagagtgctaacaacattctgtctgttccttttcc

SEQ ID NO: 6799555 - DNA, 61 bp, Homo sapiens
cagaagacttttctttgtcctgtctcatctggcctgtctgtgacaatagaaaagtcttttg

SEQ ID NO: 6799556 - DNA, 79 bp, Homo sapiens
ccttaatcaccatttgttcaaccattctcgcttgggtgacattcctcttagtgaaagaagttggaagcaaatataaagg

SEQ ID NO: 6799557 - DNA, 57 bp, Homo sapiens
tttcttctgtctcctgcatgtggagttaaaagtgttacctgtctggagacaaagaga

SEQ ID NO: 6799558 - DNA, 92 bp, Homo sapiens
tttgactcagttttgacagcatgagagatgccagtgattccagaactactgtatggtacatgctggctaaaatattcaaaattgcaggagga

SEQ ID NO: 6799559 - DNA, 64 bp, Homo sapiens
cgctgactctgggattttcttataaaaatgcctgatggacgggaggaagatctggaggtcggcg

SEQ ID NO: 6799560 - DNA, 65 bp, Homo sapiens
ccctctcccattaggacaaccaaaagtgtctctagacgttgccgaatgtttcctgaggtgaaggg

SEQ ID NO: 6799561 - DNA, 116 bp, Homo sapiens
gtgtttgaatttatgggttgggctagtgacagttgacagagccttcctatagagacacaggattctccatcaccactggcactttgcccctaggaccacaatgagtatcaaaccac

SEQ ID NO: 6799562 - DNA, 87 bp, Homo sapiens
gcactctcggaatgtcccaggtcctgatctcgtcctcaccacttagctcccatggaaattcgattagcggcttgggaacagtggtgc

SEQ ID NO: 6799563 - DNA, 58 bp, Homo sapiens
cagctctcctgagcctgacaatcaccatctttagagatgatgaagagctcagagcctg

SEQ ID NO: 6799564 - DNA, 69 bp, Homo sapiens
gaaacgcaccagaatctgagtcgtgattgtatttaggtaatgcaattatgggcaatttttaactgtttt

SEQ ID NO: 6799565 - DNA, 56 bp, Homo sapiens
gtgcccacgttggctcctacagcagcaccgcctgctgagaagagggtatgtggcgc

SEQ ID NO: 6799566 - DNA, 82 bp, Homo sapiens
gtgtttcttgaggcaggtacgcacggacactgtttttagagcaagcattgtcctatctcagtgccatgtgctcaaagagcac

SEQ ID NO: 6799567 - DNA, 64 bp, Homo sapiens
gcttttgaggtgaaggcttgtgtaaaggaggcagttctggctccttcagagcctccctccaagc

SEQ ID NO: 6799568 - DNA, 130 bp, Homo sapiens
tggggatcagacagctgctgtgtgcgttagttttcaccttgggaagcgggaaaacagagaaagccatgcttctcaaagaagcataatggcaaaagtagttttatgtcattacctccccccaaattactaa

SEQ ID NO: 6799569 - DNA, 57 bp, Homo sapiens
ctccagtggtgatggggaagaagctactctggctgacttcctctaatctatcaggag

SEQ ID NO: 6799570 - DNA, 65 bp, Homo sapiens
tatatcaccaaaaacagttctgggtggaattaaacaccacatttcatgtaacttggtgccatatg

SEQ ID NO: 6799571 - DNA, 74 bp, Homo sapiens
ggcgctcggaaccgacctgggagctggcgggaccgtcctcccccgccacgccctcccatcgggctttgggcgcc

SEQ ID NO: 6799572 - DNA, 62 bp, Homo sapiens
tgattgcgtctgtgtcaccttcagggttcctcttccctgttcttgaaggacagtgcacatca

SEQ ID NO: 6799573 - DNA, 55 bp, Homo sapiens
agcttctagcccatccagcaggggttctttctcctcattaggatggtctgaagct

SEQ ID NO: 6799574 - DNA, 67 bp, Homo sapiens
agctcttggcagtcttcatcagttctgggggcaacatatttagaacttaagaatactgtcttgacct

SEQ ID NO: 6799575 - DNA, 60 bp, Homo sapiens
ccaccagccagagtgacagctccgaaggaggccgtttgtgcttttaacgtggctggttgg

SEQ ID NO: 6799576 - DNA, 57 bp, Homo sapiens
agaagagctagattgcaaacctgggccacctggctgcagacgctacttggtttttct

SEQ ID NO: 6799577 - DNA, 57 bp, Homo sapiens
ctgtgagacctgatttcttcatttggacaatgagaatgataataatctgtcttacag

SEQ ID NO: 6799578 - DNA, 63 bp, Homo sapiens
accccaggctagtatgatatcagtggagtatagagaagctgactaaagacatactctggaggt

SEQ ID NO: 6799579 - DNA, 59 bp, Homo sapiens
gtgttctgggaacaaagtggagtgggaaagcctattgcttttgtgtgctcccagggtac

SEQ ID NO: 6799580 - DNA, 89 bp, Homo sapiens
tcctgttcattggttttttagttaggtcagaatgtgcttgaggagagtaagagaatatgtggatgtggtgaaggttaaaatgagaagga

SEQ ID NO: 6799581 - DNA, 60 bp, Homo sapiens
gccagctctcttctgaaatgtgacggacctaagcaggaagtcatccaggacaggagtggc

SEQ ID NO: 6799582 - DNA, 75 bp, Homo sapiens
gcagatgtgatcaggaaattatttattaatattggctttaaaattttgtgatgaataaacttgagagtcatctgt

SEQ ID NO: 6799583 - DNA, 59 bp, Homo sapiens
ggggagtcagaaaatggacccaagcttgactcaaagctcttatatttcactggctcccc

SEQ ID NO: 6799584 - DNA, 88 bp, Homo sapiens
tgtttattgctttatccctaagcttctaacaccaagaccagaaaatggtagacatggaaaggaggcttgtggaataaatgaataaata

SEQ ID NO: 6799585 - DNA, 63 bp, Homo sapiens
gcagtaaagctcttaatgagattatccaggattgggactatttcctttgagagtttcatttgc

SEQ ID NO: 6799586 - DNA, 72 bp, Homo sapiens
gggaagagtctttgtatatagcagcagattaaaccaaaagaatgcactgacatgcacaaaaagactctttct

SEQ ID NO: 6799587 - DNA, 67 bp, Homo sapiens
gggagggaggcgacttgtccaaggccacaaagatggcaaatggcagaaccaggtctgtctgcctccc

SEQ ID NO: 6799588 - DNA, 66 bp, Homo sapiens
ggtctgtcatatattctggttttcactggtcctcaggccaggcaggctagaatgtaaattcaggcc

SEQ ID NO: 6799589 - DNA, 55 bp, Homo sapiens
tgggtgaaaattttggtggcactcttatcccagagttagccagtcttctcatcta

SEQ ID NO: 6799590 - DNA, 115 bp, Homo sapiens
aagtggcatacaaaggccagagactgctatggattctattatatgtggtgtagcaaggctgacctctccagatacatgcaatgaggattctagtgtccctttgaaaatgttactt

SEQ ID NO: 6799591 - DNA, 74 bp, Homo sapiens
cacaaagccctgctgactcattttcaacacttctccacaggactagtgctatgcgtcagcagacgctgcctgtg

SEQ ID NO: 6799592 - DNA, 79 bp, Homo sapiens
caagagccagatgtaagctggacactgacccactgtcccttggaatggctatgtctatgtccagcctgctctgctgttg

SEQ ID NO: 6799593 - DNA, 63 bp, Homo sapiens
caggctgcctggaagaggactgagattctgcagttctcaacaactccaggtgcagcaaggctg

SEQ ID NO: 6799594 - DNA, 63 bp, Homo sapiens
ttgttgcaatcactgttgctgggttgctgtatatatattctgggcaatatatgagtgcaataa

SEQ ID NO: 6799595 - DNA, 76 bp, Homo sapiens
gggagagccagggggccaggagtgtcccactcattttccaggagatgcaaaatcaccctgtctccgtgggtttcct

SEQ ID NO: 6799596 - DNA, 81 bp, Homo sapiens
gaagttagggtcagagtccctgtttcccgttaaatcctaggaagagccagcaggagacatgggggtggtggacctcacttc

SEQ ID NO: 6799597 - DNA, 87 bp, Homo sapiens
tagctcaactgtgcacaagtttcttcattgttcattattctccatggatagagtagacattgtggaacatgatctcattacatgctg

SEQ ID NO: 6799598 - DNA, 64 bp, Homo sapiens
tcactccagcattcctacgctgtcctccttctaaggggaagtcagactttgtggaaaggagtga

SEQ ID NO: 6799599 - DNA, 55 bp, Homo sapiens
gcagcccaggctcgctcactgcatctttccctggcagaggggctagcctggctgc

SEQ ID NO: 6799600 - DNA, 79 bp, Homo sapiens
ctacagaagaccattagctgctattcagtagctccctaatgaggctaccgatgctgagagactgctggtatatctgtag

SEQ ID NO: 6799601 - DNA, 80 bp, Homo sapiens
ggatgacagacagcaaatggttttctgtctgaggctggattgaccaggcccgggcactgcctttgttgatttgtctctcc

SEQ ID NO: 6799602 - DNA, 65 bp, Homo sapiens
gtacagagggtcacgtggtgaatatacccgcacccactcaccaccccaaatgaacctctgttcgc

SEQ ID NO: 6799603 - DNA, 79 bp, Homo sapiens
ctgagctgttggtttaaatttccattagtgtcaagtttcagcacttgcatgttatagaattttaactcagtggaatcag

SEQ ID NO: 6799604 - DNA, 61 bp, Homo sapiens
gcacttaatattgtatgctttgggtactttaggtatgcaaagatgaaatattaaaggatgc

SEQ ID NO: 6799605 - DNA, 78 bp, Homo sapiens
tgttgtatttggaacttgttctgtgcaagaacagattttggaacttgttctgtgcaagaccaactttcaaatattgta

SEQ ID NO: 6799606 - DNA, 57 bp, Homo sapiens
ctatgatgtccctaggcaggtagttggcaattgatagtgaaagatgggatatcatag

SEQ ID NO: 6799607 - DNA, 58 bp, Homo sapiens
gtttaactttgggcaagtgagcaaatctccttaatgctcacatttctcatgggtaaat

SEQ ID NO: 6799608 - DNA, 64 bp, Homo sapiens
catgttgagggagaagattctgcacactcatttgaggcccgcctgaccctgtctccctcacatg

SEQ ID NO: 6799609 - DNA, 55 bp, Homo sapiens
cggatgagccactttggatgggatgttcacttcccagacaatcattggccacctg

SEQ ID NO: 6799610 - DNA, 55 bp, Homo sapiens
tttaccagctgtctgtcactccctatatctatgagattcagttaaggctggtaga

SEQ ID NO: 6799611 - DNA, 64 bp, Homo sapiens
tttttttcctgcacatttgagcatgactatgtattgaatgctatttttgtaagcaggtgagaga

SEQ ID NO: 6799612 - DNA, 63 bp, Homo sapiens
caacattgaattcaaaattactgaattcaacaatctggaatcagttttggctgttcagtgttg

SEQ ID NO: 6799613 - DNA, 71 bp, Homo sapiens
gattgagtatatctgttttttgctgttgattctagaaggatatagcaattcagaatacatgtactacaatt

SEQ ID NO: 6799614 - DNA, 78 bp, Homo sapiens
caggctcccagaaaattctcagacaatgctatcagaaattctacacaacatagttttgtctggtttcttgggtgtgtg

SEQ ID NO: 6799615 - DNA, 95 bp, Homo sapiens
gctgcctttttcagatttctacttgcattactgtttggaagttgttcttcatattccatgggagatgatggggagtggaaagataagaagggagc

SEQ ID NO: 6799616 - DNA, 74 bp, Homo sapiens
gcccaaggtgccatgctgggcgggggagatggagcatgagctatccaatcccaccttccgtggaacccgtgggc

SEQ ID NO: 6799617 - DNA, 58 bp, Homo sapiens
gaagggtgggagaatctttaatccttggcatgggggaattaagaatctctgactcttt

SEQ ID NO: 6799618 - DNA, 76 bp, Homo sapiens
gtcatctcattgtgatctgtctttccttatagtctctgttcagagaaggagtgtacaggtcatgcagatagatgac

SEQ ID NO: 6799619 - DNA, 129 bp, Homo sapiens
gccccaaccccctgctctccatccctcgcgtcccgccgcgcctttgccctccgcagccgccggggctgcagggcacggtgcgcgtgggaggctgcgcgggccagggtatcccagggggttccggggggc

SEQ ID NO: 6799620 - DNA, 66 bp, Homo sapiens
gggccatgagaggttcatcaactgccactgaaatgcaaggggcttggagaggcctctgccaggccc

SEQ ID NO: 6799621 - DNA, 56 bp, Homo sapiens
gggagtgctgaagactggctagggagatatctgctctcctttcttggcgctggccc

SEQ ID NO: 6799622 - DNA, 66 bp, Homo sapiens
tgtggcttgtttggcctgcagagtgctggaaacctttcagagctcagagctgccaggcagggtacg

SEQ ID NO: 6799623 - DNA, 77 bp, Homo sapiens
ctcaggctcctgggatctgtggcctttggctgtgagttccccattaggccaggcagacaggtcatcaggacgcagag

SEQ ID NO: 6799624 - DNA, 72 bp, Homo sapiens
gccattgctggctctctctcctgggtagtccaaggaatccgtgagaccactggggtgagggccatcggtggc

SEQ ID NO: 6799625 - DNA, 74 bp, Homo sapiens
gatagacccaaaagagcagtttaaaatgctttaatttttttaaatgtgatactgttctttttaagggttctttc

SEQ ID NO: 6799626 - DNA, 78 bp, Homo sapiens
aatcagggagccctgggctcctaaccatccaggtttcggagtaggaatcatgaggaaaggagttagggcaccttaatt

SEQ ID NO: 6799627 - DNA, 81 bp, Homo sapiens
tttactcttcaacattcagcagggcatactgagcctaggaatcgctctttaggcccagctcctgttgggttgactggtgaa

SEQ ID NO: 6799628 - DNA, 61 bp, Homo sapiens
ccttttgacttatggaccttttgagttcttttcagtatttgtcaatacataggtgaagagg

SEQ ID NO: 6799629 - DNA, 78 bp, Homo sapiens
cctttaagacatggagggaatgtctagcattcttcacggaaatgtgcctgtgaggagcattaactcctgttatacagg

SEQ ID NO: 6799630 - DNA, 56 bp, Homo sapiens
ctggtgggggagttgaaggggttttgggcaaggccagagttgaactgctccactag

SEQ ID NO: 6799631 - DNA, 58 bp, Homo sapiens
ttttagtacagaatcaaaagcaatggtagaaaactatgatggtttttctgtattggag

SEQ ID NO: 6799632 - DNA, 64 bp, Homo sapiens
gtttgtcatccttggcttgccctcttcagcacttccgtgtaaggtcaaccacaagctgacaaac

SEQ ID NO: 6799633 - DNA, 67 bp, Homo sapiens
agtacttacaatagtgcctggcatagagtatgccttcaatacatgttagctactattgttataatct

SEQ ID NO: 6799634 - DNA, 65 bp, Homo sapiens
aagttgattaatctttcgagaacacccactttgatgtgtttgtactttggagtattgagggactt

SEQ ID NO: 6799635 - DNA, 55 bp, Homo sapiens
gtgtctcacaatggactggaaatagttcctgttcccatcaaccagagtgaaacac

SEQ ID NO: 6799636 - DNA, 102 bp, Homo sapiens
gagggaggtcaggggcaccccatctggccagtctgtggaagccaggcaggggtgcagccccgctgggggcagggctggctgagggagcccccttcttccctc

SEQ ID NO: 6799637 - DNA, 129 bp, Homo sapiens
agcacaatttgctaccaagactaatgactagacttcagtgttggttcattacgattttcctgtcaaatcagtgtatgcatgaatataatacagatgatccagtttaacttgcatccaaattccattgct

SEQ ID NO: 6799638 - DNA, 80 bp, Homo sapiens
ggctgttagtgagttctgtgagtgagtctagcaaattatcaagcccgagagtagcctcatagacactcattcttacagct

SEQ ID NO: 6799639 - DNA, 130 bp, Homo sapiens
tcagctatgggaaagtaattacaccaaagaaactggcaaatgctacatactgggcctctttccctcccactcccagagagccagttgttaagcacttaccaacaccacttttcctgatctctcccactga

SEQ ID NO: 6799640 - DNA, 113 bp, Homo sapiens
gaggtactaacgcactacatttttgaattactattgattgacatgtctctgttcaatgtaaacagcttaaacagagagtgcagttatagaaatggaatttgcatgagaacctt

SEQ ID NO: 6799641 - DNA, 73 bp, Homo sapiens
agaccctcctcagggattaaggtcaaaggtgggaggaagaaggcttccattggccttttatcctagaggttct

SEQ ID NO: 6799642 - DNA, 106 bp, Homo sapiens
tgcacacctaagatttggacaagctggtctccaggtgatattttgacattcttcagctgaagagtgtgttctttatgctgtgatcagaatgtccctcatgtgagca

SEQ ID NO: 6799643 - DNA, 112 bp, Homo sapiens
ggaggtaaggggttcggggacccgggctgggctccaggagtggcctggacacctccttcggggccccagttcactcctggccgagttgcatccttgagcccacgtcaccccc

SEQ ID NO: 6799644 - DNA, 84 bp, Homo sapiens
ctagagagagcttagatcctgcgactcacccagcgaggaaaaccagctgggaagaggatgaggcatatgagccccactctctag

SEQ ID NO: 6799645 - DNA, 77 bp, Homo sapiens
gagggcgtctgacccattaccatctccaagattaagacacagcacttgaagttacatgatgaggtcatagcaccctc

SEQ ID NO: 6799646 - DNA, 85 bp, Homo sapiens
ggtgatgcatccccgctgcaccacagcctgaggcagccacatgggtgggggtgtgtgtgtgcacgcgtgggtgtgtgtttgtacc

SEQ ID NO: 6799647 - DNA, 63 bp, Homo sapiens
ggtgcatgatgttaaacatcaggtacatttgcgatgaccgatgtctaattttatgtttcaacc

SEQ ID NO: 6799648 - DNA, 57 bp, Homo sapiens
gctcccagaaacctgccttgctggactgtccacttggagcaagaaggttgtgggagc

SEQ ID NO: 6799649 - DNA, 66 bp, Homo sapiens
ctgctgctttggagagaccattttcacagtggttctcatgggtagaaggtctttcccaagcttcag

SEQ ID NO: 6799650 - DNA, 62 bp, Homo sapiens
gtaaagttctgtggctgttatcccacattgttgtggccacaattagctgatagctactttat

SEQ ID NO: 6799651 - DNA, 95 bp, Homo sapiens
ataaaccagggaacataagtatttccctgagttctgtgagctgctgtagcaagttcatgaaacccaaggaagggattgtgggaaccctgatttat

SEQ ID NO: 6799652 - DNA, 65 bp, Homo sapiens
ggataacgcgcttcgtaggtatgaactcagttaaccccacagtcacactatgaagtgtgttatcc

SEQ ID NO: 6799653 - DNA, 67 bp, Homo sapiens
aaaaattattgaaatggcttggtaaggaaggttatcactatcctacatgtaggtttccttaattttt

SEQ ID NO: 6799654 - DNA, 129 bp, Homo sapiens
ccatctccaacaatgtgcccacctgaccaccaaccagttctgcccccagctcctcagccctgccttgggtgctttgacccaggaggtggaggggccagaggtgtcagcacatagtgacctagaagagag

SEQ ID NO: 6799655 - DNA, 63 bp, Homo sapiens
gctgcccctatttcagcaagaagaatgtggaggctgatgccttgtccatagctggatggtagc

SEQ ID NO: 6799656 - DNA, 69 bp, Homo sapiens
acagggcttgctttatggatttgtgtcctgtgtagttacacaagactcacacacagaagagggctctgt

SEQ ID NO: 6799657 - DNA, 55 bp, Homo sapiens
tgctgagcaacgtggagagttttgaagagattgaaaatggttcgtttgctctgca

SEQ ID NO: 6799658 - DNA, 106 bp, Homo sapiens
ttgaatctaatgtttgtagaaagattcatgttagcccacatgtagaactcgatttataggcaagagaccttgaaactctttgaattcaaatgttggaagccttcaa

SEQ ID NO: 6799659 - DNA, 63 bp, Homo sapiens
tgccagtgtggaactaggaagaccaactgggcctcttacctctttatctgttttacattagca

SEQ ID NO: 6799660 - DNA, 76 bp, Homo sapiens
tggacttctcctccatggatctggatgatgcgctccggaagttccagtcccatatccgggttcagggtgaggccca

SEQ ID NO: 6799661 - DNA, 58 bp, Homo sapiens
gtgaatgaaaggatgattcttttatcttaccacagtaaacgatcattttgccattcac

SEQ ID NO: 6799662 - DNA, 80 bp, Homo sapiens
gttgttgatgttaatgtgtcttgtttcgtaaaggaagacttggcctttatttaccaaatgagactattgttatgaacaat

SEQ ID NO: 6799663 - DNA, 59 bp, Homo sapiens
gacagggcaagactctgtctaaaattcttttttaattttaggcagagtctcgctctgtc

SEQ ID NO: 6799664 - DNA, 122 bp, Homo sapiens
tttcttctgagtaattttggcctccagcctgagtaaggatagttctagacctatagttcttaaacctagatgagtaattataagaattacctaggggaggagccaagatggccgaataggaa

SEQ ID NO: 6799665 - DNA, 104 bp, Homo sapiens
gtttctgctgagttggctgttctgttatatagataatgtgtgtgtgtgtatgtgtgtgtgtgtgtgtgtgtgtgtgtgtgtgatgtacatttaattcacaaaac

SEQ ID NO: 6799666 - DNA, 79 bp, Homo sapiens
tgtgtgtcccttttcaaagtggagggatggtataaagtgagcattttatgatatcttaccgctctgaaaatgataaata

SEQ ID NO: 6799667 - DNA, 55 bp, Homo sapiens
gtgctttccatcctccctgctgccactgctcaggagggcagaagtgcagaggcac

SEQ ID NO: 6799668 - DNA, 68 bp, Homo sapiens
tgttaacatatggagatgataccacatttgcctgtttgggtactagtgtcattccttcaatgtagata

SEQ ID NO: 6799669 - DNA, 69 bp, Homo sapiens
gtgactcgtgggggagccaaagaagactcaatcatgttgtctcttgtatcagctccctccacaaggaac

SEQ ID NO: 6799670 - DNA, 78 bp, Homo sapiens
agacactgatttcagggatgagaagaaacaggtgtcttagaaacacggtactctccactcatcctctggaatccttct

SEQ ID NO: 6799671 - DNA, 59 bp, Homo sapiens
tattacggcatgtggcatcagccattgggtactctaaaagctctgctgcatgtagaata

SEQ ID NO: 6799672 - DNA, 81 bp, Homo sapiens
atgcatctcatttgtcttcagtaggttcttccataatctcatcattattgctatggccctcagaggacagctgacttgcat

SEQ ID NO: 6799673 - DNA, 74 bp, Homo sapiens
tcagatgtttcactgtaatggaattttctttacatcagtgaaattgattaccaggtagtgggatgaacatctga

SEQ ID NO: 6799674 - DNA, 73 bp, Homo sapiens
gcattgactccttcaatgatgacaagttcaaggcaaaaatatgagggtttgtaatcaggaaagagcagtcagc

SEQ ID NO: 6799675 - DNA, 76 bp, Homo sapiens
ggctaatgataaccgtaatgattgctttcatatattgagtgcctatgacatatgaaagcaatcattatgtactgcc

SEQ ID NO: 6799676 - DNA, 62 bp, Homo sapiens
cagagaggatggattccatagcatagggtatagtcttcagctggggatgaccatgttcagtg

SEQ ID NO: 6799677 - DNA, 79 bp, Homo sapiens
tctggcatatagtcaaccttgtaattagccatgtgattctagtttaaatgtctaatttagtggttgattttagactaga

SEQ ID NO: 6799678 - DNA, 67 bp, Homo sapiens
gtaatcttgccagtctccaaatcaatacgaatggtatcattcaccttgatgaggggatcagggtagc

SEQ ID NO: 6799679 - DNA, 66 bp, Homo sapiens
ggatgaagccagcatgaagacagaggccaaaatcttgaccaaaagaagtctgatgctggctcttcc

SEQ ID NO: 6799680 - DNA, 68 bp, Homo sapiens
ttctaaagcagagatcctccacttcagcacaattggtgtcctgggctggataattctttgctgtggag

SEQ ID NO: 6799681 - DNA, 68 bp, Homo sapiens
cctggcaagggaagccctggctgagaccccccggctaaggaagggtcctcagcggctccccagccagg

SEQ ID NO: 6799682 - DNA, 82 bp, Homo sapiens
ctaccctggcacctgcttttctattggcatatccacgacaatgctgagctcagtgtggggccaggatcagggctcggtgtag

SEQ ID NO: 6799683 - DNA, 63 bp, Homo sapiens
cccttccctggcagtcctcttcctcgggcgccgcggggctcctccagggagactgcggaaggg

SEQ ID NO: 6799684 - DNA, 59 bp, Homo sapiens
cttgctttcagtctcggcctcactcagctcctctgttgggccctgggattcagagcaag

SEQ ID NO: 6799685 - DNA, 67 bp, Homo sapiens
gggcctgaggcagagagaacccgggctgcagggcactatgggccagggtagctctggcttctggccc

SEQ ID NO: 6799686 - DNA, 59 bp, Homo sapiens
gggaagatcaggatggagattcatacaaatatagatgaaaacagaatccttgttttccc

SEQ ID NO: 6799687 - DNA, 80 bp, Homo sapiens
gggatgttttaacaagtcacagaacccattgtaactagtgcacatctggtgatacaggtgttctggatataaaacatccc

SEQ ID NO: 6799688 - DNA, 61 bp, Homo sapiens
gtactcagttgtaaaacaacggtttacaagtgtcagagacaggtgttttacaacttcgtac

SEQ ID NO: 6799689 - DNA, 55 bp, Homo sapiens
gcctggagggttgaggttttgttttaataaagaaaatcccattttcttccagtgc

SEQ ID NO: 6799690 - DNA, 60 bp, Homo sapiens
tttgaggagtttttctagagctaagtatgaaaagattcagttatagaaatactttttgga

SEQ ID NO: 6799691 - DNA, 69 bp, Homo sapiens
ctgcaaaaaagtacagtgcatggtaagtgtccaataactagctgctgttatgatgttactttcttgtag

SEQ ID NO: 6799692 - DNA, 60 bp, Homo sapiens
gggactgggtcactaagatagtagaaatggtcgcataaatactattgcctgacaggtctc

SEQ ID NO: 6799693 - DNA, 87 bp, Homo sapiens
gcctgcagcctgcccacctgtgccctttcctgctcctccaggccccagcctgccagtaatgagggcaaggatcaccaggctgccagc

SEQ ID NO: 6799694 - DNA, 59 bp, Homo sapiens
tctttttctctacaaaataaccagccagaattcttgggatgggcgatgagagaggcaga

SEQ ID NO: 6799695 - DNA, 59 bp, Homo sapiens
tgtcctacacagttcagccaggcttgtgtctacactgggccttggatttgtggagttca

SEQ ID NO: 6799696 - DNA, 56 bp, Homo sapiens
gtggcccccttgtgtgtgctgggctctgaagtcctggaggcactcgctggggctgc

SEQ ID NO: 6799697 - DNA, 55 bp, Homo sapiens
gccagtgacactgaacaagtcactcatttccaggagcttcagtttcctcactggt

SEQ ID NO: 6799698 - DNA, 76 bp, Homo sapiens
atgtgctccattcattcatctctaaaatgcctgtcaatcaaagtcaggcaaattgtgagaaaatgaaactgtatgt

SEQ ID NO: 6799699 - DNA, 57 bp, Homo sapiens
tgtcagtgcacagatggttgatacataagtatcagttgtaattatctttgggtggca

SEQ ID NO: 6799700 - DNA, 115 bp, Homo sapiens
gtcccttttgacaatggtatcttaggggcttgagggtccatgaatcatcctttcagtcctggaggaggccctagagctctagagtcaccaattgtttgtcactaaagggagggac

SEQ ID NO: 6799701 - DNA, 111 bp, Homo sapiens
actgaagccaagcagcacttttggtttgaatgagcataagagggcttaattgttgtctcatcttttagagcatttctgattcaaaggtgtcatgcaatcattggtagcagt

SEQ ID NO: 6799702 - DNA, 64 bp, Homo sapiens
tgacctgtccttgctggccaggtatgggcatagttctgtggtctggccattcagggactcatca

SEQ ID NO: 6799703 - DNA, 84 bp, Homo sapiens
ctaggttttggctaggttgcaggttccaagctgctctcctgctgtgtcggtgagttctggttaacctgcaacctcctgatgtgg

SEQ ID NO: 6799704 - DNA, 111 bp, Homo sapiens
ccttcctatgccagctgatcccctaggccctaggcttccatcatatcactgagcaaagcacagggcagtttgagtgggggtcagaggcctggggggtctttggctggaagg

SEQ ID NO: 6799705 - DNA, 71 bp, Homo sapiens
ctggggcaaccctgggaaggtgaggccctggatttcctggtctggcctctgagaacctcctagcaccccag

SEQ ID NO: 6799706 - DNA, 55 bp, Homo sapiens
cgctgtgccatggattcagttcaggtcaagtgatgttcctggtttatgggcagtg

SEQ ID NO: 6799707 - DNA, 59 bp, Homo sapiens
tttctagtgtgcatagcagtgatccccaacctatttttgctgcaaaatgacattaggaa

SEQ ID NO: 6799708 - DNA, 65 bp, Homo sapiens
atgtaacatgcttgctttgggcttatgttgtaaaagaattgctaagaacagacaagcatttacat

SEQ ID NO: 6799709 - DNA, 118 bp, Homo sapiens
cctgaaccctgtgtcccttctggccacgtgaaagccatgctccttcccctctgggccggcccggggacgctcggggcagggtatgaggcaagagaaagggacccaagaaaggggcagg

SEQ ID NO: 6799710 - DNA, 99 bp, Homo sapiens
aagtttccttcaaaaagatgtgccaaattattgggtaccattttaaaaaattaaaaagttattaagaaggtactcaaagatctgtatataaggatgctt

SEQ ID NO: 6799711 - DNA, 70 bp, Homo sapiens
cacacctttgtatagtgctgctttgtagtatgtgggcatactgctttgaggggctctgtatatatttgtg

SEQ ID NO: 6799712 - DNA, 73 bp, Homo sapiens
gggtgagaactgtagcacagagctttgacactacgatgctaatggagtgtctgaaggatttggcttcttattt

SEQ ID NO: 6799713 - DNA, 57 bp, Homo sapiens
agttgctcagggactatggcaaagtcgggaagaagcctgtctcctctctgggttact

SEQ ID NO: 6799714 - DNA, 72 bp, Homo sapiens
atgaatgaaatacagagtacttctctcataaagtaagcaccagagagcaagtattcagtttgtttcattcat

SEQ ID NO: 6799715 - DNA, 57 bp, Homo sapiens
catggtgagcggccgcacacaattctgcccctagagggcagtggctgcacacacatg

SEQ ID NO: 6799716 - DNA, 88 bp, Homo sapiens
cctcagaattaccccaccagaggggtgggagctgggatatttatacaccagctgccatcagcctttggatgaggttgttcctttgagg

SEQ ID NO: 6799717 - DNA, 61 bp, Homo sapiens
aggcttcagacaaatgttatggatggattgtatatctcccagattcacatgttgaagtcct

SEQ ID NO: 6799718 - DNA, 130 bp, Homo sapiens
cagtccactgctgtcctgcacgacccatgcttggatctgccctgctgtgcctggagccacttcttgaagtagcacagggcatatgcggtggccaggatctgagtgtgtgagaagtgatagcacaggactg

SEQ ID NO: 6799719 - DNA, 61 bp, Homo sapiens
agatcatgcagctaatccaattcagtagttaagaaaattgaaaagaccagctgtgtggttt

SEQ ID NO: 6799720 - DNA, 60 bp, Homo sapiens
cagccctgctcttagtgtctccaactccagggtggggtgacaaaaaacgagggcaggctg

SEQ ID NO: 6799721 - DNA, 82 bp, Homo sapiens
ggctttggcagtgcttacatcgtgttggaaagtcaaaacctaaaaaaccagattattcaacatcattgtaagcctctaaacc

SEQ ID NO: 6799722 - DNA, 99 bp, Homo sapiens
ccccagaaagacaatactgcatgatctcacttatttgtgaaatctaaaaaaagtcaaacttatagaaacagaggtcaggcattttttgctttcttgggg

SEQ ID NO: 6799723 - DNA, 66 bp, Homo sapiens
tgtgtaccccctgccttgtagaaccaagaagaatccctctgcgtccagggccccagggggtgagca

SEQ ID NO: 6799724 - DNA, 63 bp, Homo sapiens
cctcaggacagctgggccaccaccaggactctagtatggtggacaaggtgctgtcccatgagg

SEQ ID NO: 6799725 - DNA, 60 bp, Homo sapiens
agagttagtggcctcagcagggccagtcaagccagatatgttgaaacagctattgacttt

SEQ ID NO: 6799726 - DNA, 59 bp, Homo sapiens
gaggcagtgagaaatagcaagatttaggcagaaactacacgttttgttgctactggctc

SEQ ID NO: 6799727 - DNA, 110 bp, Homo sapiens
tctattgcctacttaaaaaatttatatcccaagttggctatcatgatgttttagcctgtttgggctgctacaacagaataccatagactagggagcttataaacaataga

SEQ ID NO: 6799728 - DNA, 60 bp, Homo sapiens
ctttgttcatgacatctgcttcctgtggtatggaaagtgaggacagatgtaggaataaag

SEQ ID NO: 6799729 - DNA, 71 bp, Homo sapiens
gtggtttttaatatccagtggatacaaatgccaggagcgtttgatgttttaccattgtgaatttgaactgc

SEQ ID NO: 6799730 - DNA, 62 bp, Homo sapiens
gtgacccatgcagtggttttggacaatgaaatatatacagaagtacctggcataggagtcgc

SEQ ID NO: 6799731 - DNA, 68 bp, Homo sapiens
gggcttgtccttgggctgtgcatgcagcgcatataaaggctgcttatgtatctcatccaaggaagctc

SEQ ID NO: 6799732 - DNA, 78 bp, Homo sapiens
ggtcaccaagccattctcctcatgccaaagaagcggtacaaatagaaatgccttccagaggcttgaggaaaattgacc

SEQ ID NO: 6799733 - DNA, 86 bp, Homo sapiens
gttgcatgggctattggtagatggagagagacatgttaataaaataaccaacaatgtttttcaagcatttattaatgctaggcaac

SEQ ID NO: 6799734 - DNA, 82 bp, Homo sapiens
aggctgtgcttccaggatggcagctgggtaaaagcattcctactttttcagcagcatacacatcatgttgatggcaaagcct

SEQ ID NO: 6799735 - DNA, 76 bp, Homo sapiens
cagcacggatatgacttattctatgtaacaatacctcagcgactggatagtcagcatgaaataagcagctgtgttg

SEQ ID NO: 6799736 - DNA, 82 bp, Homo sapiens
agggcagtggcggtgtgtgggctttgggcctggatatacctggtgaagcagagtctattactatcaaaataccactgcgcct

SEQ ID NO: 6799737 - DNA, 77 bp, Homo sapiens
gccctttatcatcttcatattcctcagcttttattcccttcctgatggctggaatgtgtggatgtgatgactggagc

SEQ ID NO: 6799738 - DNA, 67 bp, Homo sapiens
ggtttgctttgggaggttgtctgggagattgctgaacttttgatatacacacctccaaagcaggacc

SEQ ID NO: 6799739 - DNA, 55 bp, Homo sapiens
gcacttttcaaagcttcctgtgtgattcctgtgcactttgaagtttgaggagtgc

SEQ ID NO: 6799740 - DNA, 88 bp, Homo sapiens
ggaatctcaccttctcaccgaggctggagtgcagtggcacaatcttggctcactgcaacatccacctcctgagtttaagtgattctcc

SEQ ID NO: 6799741 - DNA, 62 bp, Homo sapiens
ggcggctggctgtgtttcatctctgagccctctaagagacagcagagcacgtgttaactgct

SEQ ID NO: 6799742 - DNA, 79 bp, Homo sapiens
gacaggcatgctttcaggactaactaagcatggtgaggaaacaagaatgataatagtatctgaaaatgtgttgcctgtt

SEQ ID NO: 6799743 - DNA, 72 bp, Homo sapiens
tttttctctgatttatattataaagtgccatggtcaaagtggcattatgttgtgaaatagataagctaaaga

SEQ ID NO: 6799744 - DNA, 58 bp, Homo sapiens
gagattatatgtatgtgtgcatatacttatgtgtgtatttacacattcataagatttc

SEQ ID NO: 6799745 - DNA, 61 bp, Homo sapiens
cagcagatggactggtttttagcactcctgagggggagaggatggagccagtctgtctctg

SEQ ID NO: 6799746 - DNA, 66 bp, Homo sapiens
cctaccttctccctgagggttccacacaccgatgatgtcatgtgtgggacccttaggttgtgtggg

SEQ ID NO: 6799747 - DNA, 56 bp, Homo sapiens
ttgtatttcttccggtctcatttgtgatgagagtcataagattttgagaaatacaa

SEQ ID NO: 6799748 - DNA, 84 bp, Homo sapiens
aggatttctctcctgctcagaacagcctcacagttgtgcgaagtcagacgtgagcctggggcctgggcagcggtcatcaatcct

SEQ ID NO: 6799749 - DNA, 117 bp, Homo sapiens
caggacatgagggcatttcttagaggaactattgctctagcaatagctcctctagttttcaaggctctatgctagtgctagagcaattgttcctctaagaaatgttctcatggattg

SEQ ID NO: 6799750 - DNA, 65 bp, Homo sapiens
gcttgtcctattgctgaatctaaggcttccagtacaatgttcactggaaagcattaagggcaggc

SEQ ID NO: 6799751 - DNA, 72 bp, Homo sapiens
tgtgtaactcattatgtttactcatttggcttaacttctaagaagctcagagttaaatatagtgctcaaaca

SEQ ID NO: 6799752 - DNA, 96 bp, Homo sapiens
acatattttgggattttccagatgtatttctgttattgatttctatttaattccttaaaggttagagcacatactttgcatgattccaattattgt

SEQ ID NO: 6799753 - DNA, 60 bp, Homo sapiens
cagctgagtggaccctagaggcctccttgtttaaggctcctgggctgggaactcagcctg

SEQ ID NO: 6799754 - DNA, 129 bp, Homo sapiens
attacatccttatttttccttaggatcactataagaaatgtcctcatgaaggaagttttgaatcttcttgaaaagttcctttgaaggaatcattcattattaatcaggaaccataataaaataatttgt

SEQ ID NO: 6799755 - DNA, 58 bp, Homo sapiens
ggctccatgctgagctttgaatacctgatacagctgtgtcagagcaaggaatggggtc

SEQ ID NO: 6799756 - DNA, 77 bp, Homo sapiens
gtacaaattaataattatttgagagcagaccagaaatctgtgtttgaataagttctccaagtgattctgatgcctgc

SEQ ID NO: 6799757 - DNA, 55 bp, Homo sapiens
tgagggtgggggatggcaggtgtgtgtccatatctaccagctagtctccccagca

SEQ ID NO: 6799758 - DNA, 73 bp, Homo sapiens
tagaaatggacagagctgggatctgaacccaggcatctgggctccagcacctgtgctcttagccattattcta

SEQ ID NO: 6799759 - DNA, 62 bp, Homo sapiens
gctgctgagctgcaggagtagggtgtggctccacggccagcaggccctgcagcttcagcagc

SEQ ID NO: 6799760 - DNA, 106 bp, Homo sapiens
tctagtataatcttcatgaagttatggatttctctgcacctagaacagtgcctgttagtgcacagtagatgtttgagaagtttatgttcaatgaaagaataataga

SEQ ID NO: 6799761 - DNA, 67 bp, Homo sapiens
tacatatcttatggttttctaagtttaggcatctgtccctgcttagaagttcctataaaatgatgta

SEQ ID NO: 6799762 - DNA, 64 bp, Homo sapiens
cgcatggctgaggcagaggactgaaaactcagagctgagaactctgctccctgttcagccggtg

SEQ ID NO: 6799763 - DNA, 73 bp, Homo sapiens
tttaagcataatttgaggagtaattgttgttccttcttttcataaaataacatgcttccaaattatgttggaa

SEQ ID NO: 6799764 - DNA, 60 bp, Homo sapiens
ggagaggcgatgagtcacagccaagcgaactttctctgctcctgaacaaattgcttctcc

SEQ ID NO: 6799765 - DNA, 105 bp, Homo sapiens
ggctcacaaacttcagcatgaatcagaatcacctagagagcttgctaaaacacagaatgttatcccaactctaggttttctcatccgtaggtttgtggtagggcc

SEQ ID NO: 6799766 - DNA, 83 bp, Homo sapiens
aggaggcattcaggtggcttcggggagtggcagcctgtgggggcgcagccgagccccttcctgagggctttcctttgcttcct

SEQ ID NO: 6799767 - DNA, 66 bp, Homo sapiens
tctgcagctcgggcttagggtgggcaggtgggctctgaggcccccaccctcaggcttgaatggaga

SEQ ID NO: 6799768 - DNA, 77 bp, Homo sapiens
gcttaatattatgtaggttaggtggttgtcatcctagttgggagaaaacaatgaaaaaatttactgtggtgttaggc

SEQ ID NO: 6799769 - DNA, 73 bp, Homo sapiens
tgacacttggagtcaatgaccagagaccctttcaaccacggagagctggtaaaggatcttgtctgagagtgcg

SEQ ID NO: 6799770 - DNA, 75 bp, Homo sapiens
cccgctcccctccaccgggcgagagaaccggggcgcgcccctctccagctctccccggtacgagcggccgcgtgg

SEQ ID NO: 6799771 - DNA, 64 bp, Homo sapiens
cccgtcatggtgattggaactgcagaacaacatcaatgctgccagaaccattcaatgtgaaagg

SEQ ID NO: 6799772 - DNA, 72 bp, Homo sapiens
tcttggggaatgggtctctgttcacaggtaagtagaagttgctctgctgtgggcagagacccctccccaagg

SEQ ID NO: 6799773 - DNA, 117 bp, Homo sapiens
gggcaggcttcccttccctggggtcagatggacaggcctcaagacacccaggtggtcctaggtggatgatgtgggtccagatgagcccacatgaccccaggtggacgaggtgggtcc

SEQ ID NO: 6799774 - DNA, 70 bp, Homo sapiens
gttggcatacaaagactgcataacacatgaatttccccaatgtgttcacagtgttgtgccttttgttgac

SEQ ID NO: 6799775 - DNA, 96 bp, Homo sapiens
ttaagtattttaagatgtcttcagggaagaaatgggactttactgaaaatgccttgaatttcagtttcagatcttctttgggttaaaatgacttaa

SEQ ID NO: 6799776 - DNA, 93 bp, Homo sapiens
tttccattctaattgcagatgaagtgccctgggggccagagtccagacaagtattttggcacctccaaggactcgcagaacacagagaggaaa

SEQ ID NO: 6799777 - DNA, 56 bp, Homo sapiens
tctttgggctaggagtttggattgggttcagcttggtgattcttctggtctatggg

SEQ ID NO: 6799778 - DNA, 69 bp, Homo sapiens
ggttgccaaaagatacttaatagttgtctgatctcaagaaactagaccattataggtaactctggagcc

SEQ ID NO: 6799779 - DNA, 57 bp, Homo sapiens
tttaataagttgtcagcacataaatcatcagagatcaggccatggcagcttgttaag

SEQ ID NO: 6799780 - DNA, 57 bp, Homo sapiens
tgcagaaaatgacaggaagaccaggaatcaagacactgttctcttgcatcttctgta

SEQ ID NO: 6799781 - DNA, 61 bp, Homo sapiens
gcaacctgttgaactggctgatggcccatttgctggggcacaagttccactacagagttgt

SEQ ID NO: 6799782 - DNA, 59 bp, Homo sapiens
ctcctgacctgtgatcctctcaccctggcctcccaaagtgctgtgattacaggcatgag

SEQ ID NO: 6799783 - DNA, 88 bp, Homo sapiens
ggagaattgcttgaaccctggaggcggaggttgcagtgagccgagatcgcgccactgcactctagcctgggtgacagagtgagactcc

SEQ ID NO: 6799784 - DNA, 64 bp, Homo sapiens
acaagaagaggaagtctccatggagagttctcccgagtctcaccatggatcttccatttcttgt

SEQ ID NO: 6799785 - DNA, 57 bp, Homo sapiens
acatgaacactgcttgccacattccctggaggaagccaaggatgagctgtgtcatgt

SEQ ID NO: 6799786 - DNA, 66 bp, Homo sapiens
agcgtgagccactgcgcccgactgaagatgttctaaagcactttgtaggtttcagtgaaacatgtt

SEQ ID NO: 6799787 - DNA, 68 bp, Homo sapiens
tgattggcaagggattgtggagaactgaggcatttgcctactagacttccacctccctggcctagtta

SEQ ID NO: 6799788 - DNA, 100 bp, Homo sapiens
taagggaaaaagtctggagatggatgtgtgtgtttgtactgcctgcgaagtggtcagtagggaaataggcttatataaaaacatctgactcttttcctta

SEQ ID NO: 6799789 - DNA, 89 bp, Homo sapiens
gtaattgggtggagtgttgtacaaaatatcagtgaggctaagttggtattaggtttctatatcctttgtctacttatttcttcaattac

SEQ ID NO: 6799790 - DNA, 81 bp, Homo sapiens
aggattcagctcaggctctccatgctccaaaaccttcccaaggacaggggccctggatggggagccctcctctgtgatcct

SEQ ID NO: 6799791 - DNA, 65 bp, Homo sapiens
ctctgagtgtaggcacgaagctttcagctctgaaacttcacctttttgccacactagcagcagag

SEQ ID NO: 6799792 - DNA, 80 bp, Homo sapiens
gtttacactttgttattctcatgttcattcgtttcaggagagcctggcagccacatctcgtggatttaacagaggtaaat

SEQ ID NO: 6799793 - DNA, 75 bp, Homo sapiens
gctactcacttaacagaggtctattcatttgtgcagactaaatttgatcaacaaatgtcctttgtgactgatggc

SEQ ID NO: 6799794 - DNA, 56 bp, Homo sapiens
gcaaagaaagttttaatgaggttaaaggaaaggttctatattaaaattttttttgc

SEQ ID NO: 6799795 - DNA, 63 bp, Homo sapiens
agtgtggaccgtgacattggtggaagaaatgaaaaccccactagggaaagttatgttcacact

SEQ ID NO: 6799796 - DNA, 59 bp, Homo sapiens
ttctcttgactgctaaaattagaaagtgtcaattttgacctctgtggctgtggggagga

SEQ ID NO: 6799797 - DNA, 64 bp, Homo sapiens
gctaggaatgcaggcacgtgcaagcaagggagggtccttgatcatgtagagcctgcactttggc

SEQ ID NO: 6799798 - DNA, 76 bp, Homo sapiens
gtgggtgaggcttcctgttaagtcgttctgagaactgcagttttcagagctttggagaccaggaatgcctgccaac

SEQ ID NO: 6799799 - DNA, 60 bp, Homo sapiens
ctctccagggctgggggtaggaggatgcaaggacttcctggcctagctcaccctggagag

SEQ ID NO: 6799800 - DNA, 70 bp, Homo sapiens
gtcgcctagcctggagtgcagtggcgccatctcggctcactgtagcctctgcctcccaggttcaagcgat

SEQ ID NO: 6799801 - DNA, 62 bp, Homo sapiens
agaggctgctttttatttacaggtgataataatcattgaaggtgttgtagcgaaatgcctct

SEQ ID NO: 6799802 - DNA, 89 bp, Homo sapiens
gggcacggcgaagggcggggcccgtcggcccaagtccttgtagggaaatcgaggagagggctgcgggcccacgtgactgaccctcgccc

SEQ ID NO: 6799803 - DNA, 65 bp, Homo sapiens
ccattagaaacccatgtttattcagtgtgatgccctgcactgaaagtggtggttttctctcgtgg

SEQ ID NO: 6799804 - DNA, 82 bp, Homo sapiens
ctgcctgcagtcaacaatatgccagactcaattgttttcagatcctcagttgggtcctgcagtttgtaaaatctccaggcag

SEQ ID NO: 6799805 - DNA, 57 bp, Homo sapiens
aaagcactctatcctttgtagaatggcatatcctgattttctaaaggaaagtgcttt

SEQ ID NO: 6799806 - DNA, 55 bp, Homo sapiens
ggtggttcacgcctataatcccagcactttgggaggtgggtgcgggtggatcact

SEQ ID NO: 6799807 - DNA, 63 bp, Homo sapiens
cacgtcagagcctggtgcaggaagccacataaggtcttgctgtgtaactcctggcctggtctg

SEQ ID NO: 6799808 - DNA, 74 bp, Homo sapiens
tgcaggtggtccttcctctgctgtgtattaatgctgtaaagaatgctgactgagaggtgggaaacactcatgca

SEQ ID NO: 6799809 - DNA, 80 bp, Homo sapiens
cttgaggacattatgctaagtaaatgccaggaagaaaaagacaaatactgtgtgattccacttacataaagtccctagag

SEQ ID NO: 6799810 - DNA, 58 bp, Homo sapiens
tccagctgccaaccgggccccgggaccctcagactctgccgcctgggggcagcttgga

SEQ ID NO: 6799811 - DNA, 55 bp, Homo sapiens
actgtgggagcttatcatttcaggtgtgaaattatgaattaatgcatcccacagt

SEQ ID NO: 6799812 - DNA, 56 bp, Homo sapiens
gccacaggtaagagtgtaaagcaaagtttgacttagcttgccttcctatctttggc

SEQ ID NO: 6799813 - DNA, 63 bp, Homo sapiens
tggcagagtgagatatgaacccaggtctatcagctaaaacctgaaatcttggctcgtctgcta

SEQ ID NO: 6799814 - DNA, 75 bp, Homo sapiens
aggtccagtgctcgcaggggttgagttagtacactctctcaagagcctgtcccctgtgctgagtatgcctggcct

SEQ ID NO: 6799815 - DNA, 71 bp, Homo sapiens
agattcagacacactgggttacctgtactatttctttcaagtggtagaatatgactcagttgtctgcctct

SEQ ID NO: 6799816 - DNA, 126 bp, Homo sapiens
ctttgacggcagtatctatgtctattcatacttgtagccatcatagcatctgacacagtgcattgcatattgtaagagcccagtaaatgcttaatgagggtatatatggatcagattgcccagaag

SEQ ID NO: 6799817 - DNA, 74 bp, Homo sapiens
caggatgacttccctctgccaccttgaaaaggctttgaaacctacaaaacaagaaatggggaggggagttgctg

SEQ ID NO: 6799818 - DNA, 55 bp, Homo sapiens
catattctgttggtcacatagagcaaccctagtatgatgtgggaaagagagtgtg

SEQ ID NO: 6799819 - DNA, 61 bp, Homo sapiens
ctagacatcaatgatcagaggtagctatataaagtcctgcttttcttattgatgtaactag

SEQ ID NO: 6799820 - DNA, 85 bp, Homo sapiens
atagtatctacccactgaacacaatataaaggaaggtttaatacctctaataaatgttaagtttagcaggctaggccgctactgt

SEQ ID NO: 6799821 - DNA, 96 bp, Homo sapiens
gaaaggagtgaaatgaatgtttggtgatcagataggtaaattgtggcagacaatgacaatgctatgtgatcatcaaacctgatttccttttctttc

SEQ ID NO: 6799822 - DNA, 68 bp, Homo sapiens
tgggaaactgctgcctcagtgattttgacaccgacctgtaggtgcagctctgggtgtagaggctccca

SEQ ID NO: 6799823 - DNA, 60 bp, Homo sapiens
ggagtcaggagtcattggaagagagatttcttttccaaagtaatttcacttctgtcctct

SEQ ID NO: 6799824 - DNA, 75 bp, Homo sapiens
cctccatattagtcattctgctcagagtcaacatttcatttgattgctggcatcagtgacaatatctattggtgg

SEQ ID NO: 6799825 - DNA, 90 bp, Homo sapiens
gggagtgtatgggacgtgcctctgctagttactcttaacaacccaggggtgtgggaagattctacagtaggtacattcctacccagtccc

SEQ ID NO: 6799826 - DNA, 81 bp, Homo sapiens
agtttgacttctgattgttggaggatgcttgtgattatttcagaaaaaagcatagtattctttaaaattatttgtcaaatt

SEQ ID NO: 6799827 - DNA, 129 bp, Homo sapiens
agatgttttccagaaggttctgtggactctgggggtgacctgtggacagctgctgctgcccactacctggcagtttggctatgtgatacatgtcagccttacaaggagatcccccttaccctggaatct

SEQ ID NO: 6799828 - DNA, 74 bp, Homo sapiens
cctgacttcaaacagggtgctgggccaggcctggcagagatgccatctggacaaaactctgaaggggaggaggg

SEQ ID NO: 6799829 - DNA, 73 bp, Homo sapiens
ccgcatccaggactgccagtctggattggagctcgactcagaaatagacaatggcagtggcactaggaagtgg

SEQ ID NO: 6799830 - DNA, 68 bp, Homo sapiens
ataccccagagctgactctggcctctggtcctctctccagaggaagaaggcgagagtgagctgggtgt

SEQ ID NO: 6799831 - DNA, 82 bp, Homo sapiens
tctaattctacaaaagtctacaagcttcaacaaggttgttatgactttgttttgagccctggacttgctgagctgaaacaga

SEQ ID NO: 6799832 - DNA, 86 bp, Homo sapiens
gagaaatgttaatttaaaaattttgtcctttggtgaagctatttatacatgtatatcttagggttctgtttttaagtatatttttt

SEQ ID NO: 6799833 - DNA, 55 bp, Homo sapiens
gggacagctggtctacctggtaacagcaaagcctgccaggcaactatcctgtctc

SEQ ID NO: 6799834 - DNA, 72 bp, Homo sapiens
tcaaggtccacaactggtaaatggcaaaactgggatttgaatccaggcttcagtgtctagttgtggaattga

SEQ ID NO: 6799835 - DNA, 67 bp, Homo sapiens
tctgtgctccagcagggccacaattattgctatctgaatctgagttgtggcaggcaagatgtacaga

SEQ ID NO: 6799836 - DNA, 78 bp, Homo sapiens
tcctgagattcaaaagaccatgcagactcttttgcaccatatttctgtgcggagatctttctggcttggatttgggga

SEQ ID NO: 6799837 - DNA, 66 bp, Homo sapiens
agcagcatgattggcatactttctatattcaatgcatattgcattgatatgtataattatattgct

SEQ ID NO: 6799838 - DNA, 129 bp, Homo sapiens
aagagaggcagaaaaacaagatgtatgcagtttatttaggagaatgggcatattaattcttaactttaataattttaaaataatgtctatggttccaaaatgcgcatttaatttcttctctgttctctt

SEQ ID NO: 6799839 - DNA, 78 bp, Homo sapiens
gtcgtaggagaagatgttgcagttgatgcgggagccgaggccaatgtagaagctgcacatctggcccaggtccacggc

SEQ ID NO: 6799840 - DNA, 60 bp, Homo sapiens
ccagttgattttcctccatgtgagcagttccactgaacattttgctggggggaaagatgg

SEQ ID NO: 6799841 - DNA, 79 bp, Homo sapiens
ctggtgttgtgcgggcctgggggtttctctcggcccagcctgcgtacaagaggaagtaatcaggacctgcccaaaccag

SEQ ID NO: 6799842 - DNA, 63 bp, Homo sapiens
aggccggctctaaatttggatggcttcggttgatcctggatttagaagagcctcccatggctt

SEQ ID NO: 6799843 - DNA, 81 bp, Homo sapiens
gcctagcttgctcttagggtcctgcctacagagacagaagtattctctctgtccttacagggctctaggggttggtccagc

SEQ ID NO: 6799844 - DNA, 66 bp, Homo sapiens
ctgattacagtagacaatgttagtatgcacagcttgctctgctacatgatataggtctctgcacag

SEQ ID NO: 6799845 - DNA, 78 bp, Homo sapiens
gcagggtggggtggagcgcagggtgctggcggcctgcgtgagcgccagccctgcacgctgcctccgccggcgcccagc

SEQ ID NO: 6799846 - DNA, 84 bp, Homo sapiens
gttctcgtggaggcctggatcttgggtaaggcctgggttcttgtagaggtctgggttttgggcaaggtccagattcctgggaac

SEQ ID NO: 6799847 - DNA, 62 bp, Homo sapiens
cagggcgacagcctgtggaggcatcaaggagatgctcctggcattgtgcagggtgtgccctg

SEQ ID NO: 6799848 - DNA, 129 bp, Homo sapiens
ctggtacctgtgtctgggagccacggaccaaggctgaggagggcctgcaggaggtcagaggtggcccctgtgccctacacctttccaggcctgacctctgtgagccccttggacctgctagagggctgg

SEQ ID NO: 6799849 - DNA, 55 bp, Homo sapiens
gccctgccctgagccgtagacccgactccctctggcgggtctccagggtacgggc

SEQ ID NO: 6799850 - DNA, 84 bp, Homo sapiens
ggtcagcaaacacaagaggtaatttctccagaacatagagagaaggagagaggatttaggatcttttgctgttcctagctgacc

SEQ ID NO: 6799851 - DNA, 114 bp, Homo sapiens
ttgggtattattttattctcattttgcagctgaggaaattgaagcctaaagaagttaaataatttgctgaaaattccatagctagtaagtgttggagttgagattcaaacccag

SEQ ID NO: 6799852 - DNA, 60 bp, Homo sapiens
ggtgtttgccacctgacgggtcctccagtttgtccttttggtttctgtctgtggtccact

SEQ ID NO: 6799853 - DNA, 57 bp, Homo sapiens
agctttccctattttaagattttttgaggccccttggatctctggaaggagaaagct

SEQ ID NO: 6799854 - DNA, 59 bp, Homo sapiens
gtcacattgggatttattggcctcacagcaacaatggcactgagaccagagtccctgac

SEQ ID NO: 6799855 - DNA, 56 bp, Homo sapiens
ttagttggaagaaaaacaaatgaaatatgcaagatgtttgtatttctaacagctaa

SEQ ID NO: 6799856 - DNA, 61 bp, Homo sapiens
ctgggatgagctaatgtactcgtaccagaatatgaggatcattctattagctagcttccag

SEQ ID NO: 6799857 - DNA, 76 bp, Homo sapiens
gtagggggaggcatgctggcatagagccggtgatagcagaccttggatgccagcggcctcctacctccttccctac

SEQ ID NO: 6799858 - DNA, 69 bp, Homo sapiens
ctagtgttcggtcttgtgtaaacactgttacagcggatgttacagtgtgtcctaaaggtctggacttag

SEQ ID NO: 6799859 - DNA, 59 bp, Homo sapiens
agaccactggcctcctgcagactttctcttgatggggggtgagggaggagtggtggtct

SEQ ID NO: 6799860 - DNA, 55 bp, Homo sapiens
ctgacttggttcatatcctggggtccgtaaacccacactgatagcactaagtcag

SEQ ID NO: 6799861 - DNA, 118 bp, Homo sapiens
actgtaaccaaaagagtatgtcccatgtttgcaaaatgaggtgaagagtctattttgactcatcgggtggttttgtattgcaatgggaattatatctctctgttatatgagttacggt

SEQ ID NO: 6799862 - DNA, 61 bp, Homo sapiens
gatctggattcaagtccctgttttcagctccttgaaaattgtaggaactgaatcaagtatc

SEQ ID NO: 6799863 - DNA, 72 bp, Homo sapiens
cggagttccctgtctcaggaagggtggcgaggggagattttgtggccctttgggtgcaggggcaaggctctg

SEQ ID NO: 6799864 - DNA, 111 bp, Homo sapiens
ggcacataataggcatcccataagcactggatgactgagtaaataaaacacgttgtgttcatgatttattcactcattcagccagtgcttatgggatgtctaccatgtgcc

SEQ ID NO: 6799865 - DNA, 72 bp, Homo sapiens
tctccattttacagttgaggaaaccgagacataggttactttgctcaagatcacacagctgagaatgtggga

SEQ ID NO: 6799866 - DNA, 72 bp, Homo sapiens
cagccctggattctccattgtgccagtgtcattttttcaactgtgtattaggcatttgaggataaactgctg

SEQ ID NO: 6799867 - DNA, 129 bp, Homo sapiens
gctttcattaagaagtaatcagaggaagaacagcctgctctgaggttgaactttgcaaagctgggaatgttccttctttgaaggagatcttagtttaggcattcatttttattttattttttatagagt

SEQ ID NO: 6799868 - DNA, 105 bp, Homo sapiens
tcctccccaagaggccctatctttctataccagtatgtagtttctctgatgagatcagcatggaagccagttgcttggtgtggtccaggaaggcttctgagagga

SEQ ID NO: 6799869 - DNA, 63 bp, Homo sapiens
cagactgggtgctgtgggctcagaggtggcaaacatgtctggatgtctggagcatcgtgtctg

SEQ ID NO: 6799870 - DNA, 61 bp, Homo sapiens
taaacagctatttgaggactggcttgaatatttttaaccagtttaagcaaataactgtcta

SEQ ID NO: 6799871 - DNA, 86 bp, Homo sapiens
aagaagggtggaatagttggaggtttagctcttttggaggtttacagccctttttagaggctgtcccttgctattcctctctcctt

SEQ ID NO: 6799872 - DNA, 72 bp, Homo sapiens
tttgagcccaggtagtccagctctgggaccctgctgtgggccttcctgctgggccacctcaagggcattgaa

SEQ ID NO: 6799873 - DNA, 56 bp, Homo sapiens
ccgcagggccgcgagcgggaccagcaccgcctgcagctgccgctcgaggctctggg

SEQ ID NO: 6799874 - DNA, 106 bp, Homo sapiens
gaatgtaaaagaatatagtaaattttaggtttttgttacatgtagaaaagtcttctctgacaaagtagcagtaattatgaaatatatatcatgtaggtttatattc

SEQ ID NO: 6799875 - DNA, 72 bp, Homo sapiens
agtgtaaggttttgagaccagaacgtttggaggttgaaagcatttggaggtttgggtgtcaagatcttcatt

SEQ ID NO: 6799876 - DNA, 67 bp, Homo sapiens
gcgttggtccaagttaactgtacaccaaaacatcacttcctgtgtagatgttaacaattactaacgc

SEQ ID NO: 6799877 - DNA, 59 bp, Homo sapiens
tgcgttcacctctggcttctgtgttgagagtgaactgtagagaggcaagggtggaagta

SEQ ID NO: 6799878 - DNA, 93 bp, Homo sapiens
ttcagcttgttatttcttcattagcaaggtttcccctgctgctcagcagaatatgtgaggaactttgcaaatgtcagaagcactcaagttgaa

SEQ ID NO: 6799879 - DNA, 67 bp, Homo sapiens
tgccaatcttgtagctgactatcttgttccagtcgattttggtgcaggtaactggaagctgccggca

SEQ ID NO: 6799880 - DNA, 57 bp, Homo sapiens
ccagatggtgcctgtcagaaggtgttgactttttagacaactgggactgtttcctgg

SEQ ID NO: 6799881 - DNA, 56 bp, Homo sapiens
caggaaaggtagtcacaatgtagcaataatcgtaacaatgttggattgcattcctg

SEQ ID NO: 6799882 - DNA, 61 bp, Homo sapiens
cagctggcaatgtaagtccctggaaagagaacatcacacccagggcactcttgccactctg

SEQ ID NO: 6799883 - DNA, 71 bp, Homo sapiens
gaggtggctctgggttgttacactggatttactagcagagtgactttggtttgagcaagtcagtccacctc

SEQ ID NO: 6799884 - DNA, 95 bp, Homo sapiens
tctcctgggctctgtgccacctggatcctgctgaactgggcttgtgccaagcaggacacatgggcttagcaggcaggggtgcagggacctagagg

SEQ ID NO: 6799885 - DNA, 92 bp, Homo sapiens
ggccacaaactgttcattttaagtttggtgtgctcaagacctgatcatattttcctctctattcttatatcagagttaaaagaatgttggct

SEQ ID NO: 6799886 - DNA, 78 bp, Homo sapiens
aaacattggtacacaaaagaggaaaccggagcagatttctgcattcatttctatttttattgtgttctgcttttgttt

SEQ ID NO: 6799887 - DNA, 84 bp, Homo sapiens
tgggccaggtgatttcaaagtcctttgcatcttctaatttttaatgagtttaaggttttgtatgaaatctctgattatagccca

SEQ ID NO: 6799888 - DNA, 65 bp, Homo sapiens
gccccgccgcctttgggacgccccgcctggggtaggggaggggagtctcccaaagccggtcgggc

SEQ ID NO: 6799889 - DNA, 79 bp, Homo sapiens
aaccacttttagttatcagtgtggtttctggactgcttgggtccaatcccagttcctccgcttgctaattaggtgagtt

SEQ ID NO: 6799890 - DNA, 63 bp, Homo sapiens
tggaggtggagttggaaactgacatctgtgattttactctcttactttccagctctagcttca

SEQ ID NO: 6799891 - DNA, 94 bp, Homo sapiens
gcccctgcccacttgggtctgtctggccagatgcatctgttaatgtttaatgatagtttaccttccagatggcttacccactgtgggtaagggc

SEQ ID NO: 6799892 - DNA, 74 bp, Homo sapiens
tccctcagaatctgtgatctttcctcaggagcagggtgtgctccttggccgttaatgtcacaaacactgggggg

SEQ ID NO: 6799893 - DNA, 69 bp, Homo sapiens
aaataaagaatattttcagtacagatggttggcagttgctgctgtgtgtgtgtgaatgtgtgtgtgttt

SEQ ID NO: 6799894 - DNA, 74 bp, Homo sapiens
gggggcctctgagctcctttgaccaccccagctggaactgggaagctgtgggccactgggaggcaagggtcccc

SEQ ID NO: 6799895 - DNA, 100 bp, Homo sapiens
atgtgatatacttagagagagagctaaattaagggtgagaagagttggaacttatgtctaatttcaagtttagggctctataatattgggtaaattacat

SEQ ID NO: 6799896 - DNA, 76 bp, Homo sapiens
attacaatcaaattagtattgcgattcattagcagtactactgttaaatagtagtagtagtagttgaggtagtagt

SEQ ID NO: 6799897 - DNA, 66 bp, Homo sapiens
ggtgacatcactgaatgcaaagctgggaagagaggctccccgttgatttagtgattctgcaaggcc

SEQ ID NO: 6799898 - DNA, 69 bp, Homo sapiens
tcctcagagaaatgtcacaacaatcttatgcattaggtgctattgttagtgccatttttcatttgagga

SEQ ID NO: 6799899 - DNA, 80 bp, Homo sapiens
gaggtatgaatatgacatttgagcatacatgtaaagacctaaaggaagtctttagagtgaggtgacttagagtcagcctt

SEQ ID NO: 6799900 - DNA, 56 bp, Homo sapiens
gaaattgctactggagtttatgtatatgctcattaaatttcagtgtttgcaatttc

SEQ ID NO: 6799901 - DNA, 71 bp, Homo sapiens
ggcctcccaaagtgctgggattacaggcatgagccacgatgcctggactgttctaccattttttataggcc

SEQ ID NO: 6799902 - DNA, 77 bp, Homo sapiens
tgccctgggcatttttctctgttacagcatttcactcttgaaatgaatggcacttagcagggaaggtgtctttggta

SEQ ID NO: 6799903 - DNA, 79 bp, Homo sapiens
catatcttgtaagtgtataggctttgggacagctttttctctctcctgttatttaaaagcttctattcacttacttgtg

SEQ ID NO: 6799904 - DNA, 86 bp, Homo sapiens
ggcgcctcctcaagctacagggcggcgcgatcttggctacgccttggcctgaacgtcctcacctgtaacttgggacgagaaccgcc

SEQ ID NO: 6799905 - DNA, 71 bp, Homo sapiens
caggctttgtacctggggtcttaactagactttatgagaattaagcaataagatcttagatgcaaaaactg

SEQ ID NO: 6799906 - DNA, 68 bp, Homo sapiens
gagcatattcatcttgagagcatggacaactgcctaccagtcctgcatgccttatggtgaattagttc

SEQ ID NO: 6799907 - DNA, 79 bp, Homo sapiens
ggtttcagctgtttctgtgttctctgaggagcctgcaaagctaaccaagcaggtaacagaatagcagaaacagaaaacc

SEQ ID NO: 6799908 - DNA, 76 bp, Homo sapiens
tcagcctgcccgctgctagagaggccgaggtggtccggccagccgtgcgctgctgctggtgtctctgtgggcatga

SEQ ID NO: 6799909 - DNA, 68 bp, Homo sapiens
agagagctgctagttcctgttctcaccctgcctaaccagaagtgtttccactactgagcatgctttct

SEQ ID NO: 6799910 - DNA, 67 bp, Homo sapiens
gctgtctatggcttgcaatattcttggatttggcttcatccatcaagggtctggcaggtgtaacagc

SEQ ID NO: 6799911 - DNA, 115 bp, Homo sapiens
ctcatgagctaaggcctcacaccctgggccaacgggggtatccaagatgactcttgtgtttgccaacctgagtgacagagcttggtgccccctcaggtgtgggaaaggaaatgag

SEQ ID NO: 6799912 - DNA, 94 bp, Homo sapiens
agggcctggtgcaggaagggcgggtgacgggggtgtcctggagctggagaacagcagccagccctgtttatgtgtcacttgtaaaggtgtccct

SEQ ID NO: 6799913 - DNA, 64 bp, Homo sapiens
agtaacagaaggcctgacttaacctgcctttaaacagtaaggacacaagtatgcctatgttatt

SEQ ID NO: 6799914 - DNA, 72 bp, Homo sapiens
ccaatgataagcagcagcaggattaaagagggtgctgtgaggcatttttttcctaaatgctgcctgctttgg

SEQ ID NO: 6799915 - DNA, 56 bp, Homo sapiens
gctctgagctgtcttgcaggtcaagggagaggggtgcacattggaaagttcagggt

SEQ ID NO: 6799916 - DNA, 68 bp, Homo sapiens
ggcttacacatgtctcagtggaaatcgccaacggttttgttacatggcagtgtttaagactaagagcc

SEQ ID NO: 6799917 - DNA, 116 bp, Homo sapiens
gtgttatttgcatataaaaaaagagaaaggcatgttgtccctcatcttttccaggaaagagtgctgagctgctctaatcctatggtggggagggaggagggccgtgtagaggacgc

SEQ ID NO: 6799918 - DNA, 86 bp, Homo sapiens
gaagctatttagtgagtcacatccttttagggagcaaaagtatctaaggaataagatgggtgtgagttgggactaggtattgcttc

SEQ ID NO: 6799919 - DNA, 74 bp, Homo sapiens
gccttatagtaacaggtttattttacaggaagtgaacgtcacacttccagaaaactctgcctggtatgaaaggt

SEQ ID NO: 6799920 - DNA, 69 bp, Homo sapiens
tttgtgaaactcctgttctatgacaagagctttaatagcactggtgatataatggtgagtaggtataaa

SEQ ID NO: 6799921 - DNA, 68 bp, Homo sapiens
ggcagtggtcagaatggagcccaggaggccagtgctggctcccgggccctccctctgaccctgctgcc

SEQ ID NO: 6799922 - DNA, 69 bp, Homo sapiens
aacaataactagacatgccatggaaagaagctgcctatcaagaacaccatggatgttcttgtttttgtt

SEQ ID NO: 6799923 - DNA, 74 bp, Homo sapiens
catttcatctcatttggaaattactcattgtcctgatgttttttaggctagagaattttaagtagagtaaaatg

SEQ ID NO: 6799924 - DNA, 63 bp, Homo sapiens
gaacacattctgtgaagctgatttttcttccactagaaaagtcagattatggagaatggcatc

SEQ ID NO: 6799925 - DNA, 58 bp, Homo sapiens
cctaccagttcccgtgaacagaataaaaaataatattttgcaatgggcattttggagg

SEQ ID NO: 6799926 - DNA, 81 bp, Homo sapiens
gctttgtagagtcaactgttttgctaatgatgctaaataaataacagtggtcacaggtatgacagttgatgcctgcgaggt

SEQ ID NO: 6799927 - DNA, 62 bp, Homo sapiens
ggttctgcacatcacacaggtgctggaagaaatgaagacatgcactcagaggtagcagaacc

SEQ ID NO: 6799928 - DNA, 60 bp, Homo sapiens
cttcccaggtgctcttagcatgtgggcgtagtcctaacatctgcaagcatcctgaggggg

SEQ ID NO: 6799929 - DNA, 58 bp, Homo sapiens
cccattccctttactgttgcattataagctgcatacagacagataccagggacatggg

SEQ ID NO: 6799930 - DNA, 91 bp, Homo sapiens
tttctaaatcgctgctacatttctccctgcatgcctgcctgtacactgtatacaggatcagctcagagtaaatctattagcaatataggaa

SEQ ID NO: 6799931 - DNA, 58 bp, Homo sapiens
cttgatggaaaacggaggagctgtagtaaagaatctatttgctgccttcccagtcaag

SEQ ID NO: 6799932 - DNA, 75 bp, Homo sapiens
cagctggctttgcagggcagaagtacagacacttatctgctgatgagatgtctttcttctcccccagaacaggtg

SEQ ID NO: 6799933 - DNA, 84 bp, Homo sapiens
agagttatattttgattcatataagagtatggacttgagcttcaaaggaataataaggccaaactattatagttcaaggacttt

SEQ ID NO: 6799934 - DNA, 73 bp, Homo sapiens
tctgttgctccagggaacacagatggccaatagctagagataaggtcagctctgtgtcctcctggaccacaga

SEQ ID NO: 6799935 - DNA, 69 bp, Homo sapiens
gttttgaagtatgtatacattgtggaatggctaatttgagccaattaacatatgcatgacctcacatac

SEQ ID NO: 6799936 - DNA, 57 bp, Homo sapiens
aggatgatgtcaaaacagtcacagaaaagatgtcagtggaaatattggcagcatcct

SEQ ID NO: 6799937 - DNA, 78 bp, Homo sapiens
atcacatctcaggacttgtctgtgtttatatagtgagtcttcattattcaacatggctgcaatcctagaggtcatgat

SEQ ID NO: 6799938 - DNA, 59 bp, Homo sapiens
ccaggcctcatagtagacctgcccttaggaaagcaggggttaccaatacttgagcctgg

SEQ ID NO: 6799939 - DNA, 80 bp, Homo sapiens
ctgaaatgtctgttgggtcctcagaacttataaggggcttgacccctttcttccatagggcccagtcagtgcagctttag

SEQ ID NO: 6799940 - DNA, 67 bp, Homo sapiens
tcgaattcttttctaagtagagattacattgcatgtgttatcttggactacagaagagagggaaagg

SEQ ID NO: 6799941 - DNA, 86 bp, Homo sapiens
ggcaggactgatcagtgggatggtccctacggaatggaatgtcccagctgccgtcaccactgccacctccccatctctgtcctgcc
